United States Patent 11,369,692 (MATERIALS AND METHODS FOR TREATMENT OF DUCHENNE MUSCULAR DYSTROPHY) - sequence listing, part 13

SEQ ID NO: 410831 - DNA, 20 bp, Artificial Sequence
  chemically synthesized
ataacaatgaagatggaaat

SEQ ID NO: 410832 - DNA, 20 bp, Artificial Sequence
  chemically synthesized
taacaatgaagatggaaata

SEQ ID NO: 410833 - DNA, 20 bp, Artificial Sequence
  chemically synthesized
ctgagttcactcattaaata

SEQ ID NO: 410834 - DNA, 20 bp, Artificial Sequence
  chemically synthesized
ttgaaaattctgtatttaat

SEQ ID NO: 410835 - DNA, 20 bp, Artificial Sequence
  chemically synthesized
ctgtatttaatgagtgaact

SEQ ID NO: 410836 - DNA, 20 bp, Artificial Sequence
  chemically synthesized
tctttgtgtctgcagtcgct

SEQ ID NO: 410837 - DNA, 20 bp, Artificial Sequence
  chemically synthesized
atgagtgaactcagcgactg

SEQ ID NO: 410838 - DNA, 20 bp, Artificial Sequence
  chemically synthesized
atccacactctttgtgtctg

SEQ ID NO: 410839 - DNA, 20 bp, Artificial Sequence
  chemically synthesized
actcagcgactgcagacaca

SEQ ID NO: 410840 - DNA, 20 bp, Artificial Sequence
  chemically synthesized
tcagcgactgcagacacaaa

SEQ ID NO: 410841 - DNA, 20 bp, Artificial Sequence
  chemically synthesized
gactgcagacacaaagagtg

SEQ ID NO: 410842 - DNA, 20 bp, Artificial Sequence
  chemically synthesized
aaggcttttataatcattcg

SEQ ID NO: 410843 - DNA, 20 bp, Artificial Sequence
  chemically synthesized
ttaaggcttttataatcatt

SEQ ID NO: 410844 - DNA, 20 bp, Artificial Sequence
  chemically synthesized
gattctccgaatgattataa

SEQ ID NO: 410845 - DNA, 20 bp, Artificial Sequence
  chemically synthesized
aatgattataaaagccttaa

SEQ ID NO: 410846 - DNA, 20 bp, Artificial Sequence
  chemically synthesized
gtaatcatttatttctatta

SEQ ID NO: 410847 - DNA, 20 bp, Artificial Sequence
  chemically synthesized
agtaatcatttatttctatt

SEQ ID NO: 410848 - DNA, 20 bp, Artificial Sequence
  chemically synthesized
agaaataaatgattactaat

SEQ ID NO: 410849 - DNA, 20 bp, Artificial Sequence
  chemically synthesized
taaatgattactaattggaa

SEQ ID NO: 410850 - DNA, 20 bp, Artificial Sequence
  chemically synthesized
ctttcatgtcccattccaat

SEQ ID NO: 410851 - DNA, 20 bp, Artificial Sequence
  chemically synthesized
aaatgattactaattggaat

SEQ ID NO: 410852 - DNA, 20 bp, Artificial Sequence
  chemically synthesized
ctaattggaatgggacatga

SEQ ID NO: 410853 - DNA, 20 bp, Artificial Sequence
  chemically synthesized
attggaatgggacatgaaag

SEQ ID NO: 410854 - DNA, 20 bp, Artificial Sequence
  chemically synthesized
aagaagataaccttgttaca

SEQ ID NO: 410855 - DNA, 20 bp, Artificial Sequence
  chemically synthesized
tgcctggaatctttgtaaca

SEQ ID NO: 410856 - DNA, 20 bp, Artificial Sequence
  chemically synthesized
ttgcctggaatctttgtaac

SEQ ID NO: 410857 - DNA, 20 bp, Artificial Sequence
  chemically synthesized
taaccttgttacaaagattc

SEQ ID NO: 410858 - DNA, 20 bp, Artificial Sequence
  chemically synthesized
aaccttgttacaaagattcc

SEQ ID NO: 410859 - DNA, 20 bp, Artificial Sequence
  chemically synthesized
tgttacaaagattccaggca

SEQ ID NO: 410860 - DNA, 20 bp, Artificial Sequence
  chemically synthesized
ccatctcttctttctttgcc

SEQ ID NO: 410861 - DNA, 20 bp, Artificial Sequence
  chemically synthesized
acaaagattccaggcaaaga

SEQ ID NO: 410862 - DNA, 20 bp, Artificial Sequence
  chemically synthesized
aagattccaggcaaagaaag

SEQ ID NO: 410863 - DNA, 20 bp, Artificial Sequence
  chemically synthesized
gattccaggcaaagaaagaa

SEQ ID NO: 410864 - DNA, 20 bp, Artificial Sequence
  chemically synthesized
ccaggcaaagaaagaagaga

SEQ ID NO: 410865 - DNA, 20 bp, Artificial Sequence
  chemically synthesized
acctctttgattattgtaat

SEQ ID NO: 410866 - DNA, 20 bp, Artificial Sequence
  chemically synthesized
ggttccaattacaataatca

SEQ ID NO: 410867 - DNA, 20 bp, Artificial Sequence
  chemically synthesized
ttccaattacaataatcaaa

SEQ ID NO: 410868 - DNA, 20 bp, Artificial Sequence
  chemically synthesized
tccaattacaataatcaaag

SEQ ID NO: 410869 - DNA, 20 bp, Artificial Sequence
  chemically synthesized
aatcaaagaggtgattttct

SEQ ID NO: 410870 - DNA, 20 bp, Artificial Sequence
  chemically synthesized
gaggtgattttcttagaata

SEQ ID NO: 410871 - DNA, 20 bp, Artificial Sequence
  chemically synthesized
tgtttccttagccatattct

SEQ ID NO: 410872 - DNA, 20 bp, Artificial Sequence
  chemically synthesized
gattttcttagaatatggct

SEQ ID NO: 410873 - DNA, 20 bp, Artificial Sequence
  chemically synthesized
attttcttagaatatggcta

SEQ ID NO: 410874 - DNA, 20 bp, Artificial Sequence
  chemically synthesized
tgaatgaaaatgtgtttcct

SEQ ID NO: 410875 - DNA, 20 bp, Artificial Sequence
  chemically synthesized
atttgtttcattcatttttt

SEQ ID NO: 410876 - DNA, 20 bp, Artificial Sequence
  chemically synthesized
tttcattcatttttttagtg

SEQ ID NO: 410877 - DNA, 20 bp, Artificial Sequence
  chemically synthesized
catttttttagtgcagtgtt

SEQ ID NO: 410878 - DNA, 20 bp, Artificial Sequence
  chemically synthesized
atttttttagtgcagtgttt

SEQ ID NO: 410879 - DNA, 20 bp, Artificial Sequence
  chemically synthesized
cagtgtttgggaactaacct

SEQ ID NO: 410880 - DNA, 20 bp, Artificial Sequence
  chemically synthesized
atgttcactagtactgaggt

SEQ ID NO: 410881 - DNA, 20 bp, Artificial Sequence
  chemically synthesized
ttgggaactaacctcagtac

SEQ ID NO: 410882 - DNA, 20 bp, Artificial Sequence
  chemically synthesized
tcatatgttcactagtactg

SEQ ID NO: 410883 - DNA, 20 bp, Artificial Sequence
  chemically synthesized
atcatatgttcactagtact

SEQ ID NO: 410884 - DNA, 20 bp, Artificial Sequence
  chemically synthesized
aattaacatcatatgttcac

SEQ ID NO: 410885 - DNA, 20 bp, Artificial Sequence
  chemically synthesized
aacatatgatgttaattctt

SEQ ID NO: 410886 - DNA, 20 bp, Artificial Sequence
  chemically synthesized
tatgatgttaattctttagc

SEQ ID NO: 410887 - DNA, 20 bp, Artificial Sequence
  chemically synthesized
atgatgttaattctttagcg

SEQ ID NO: 410888 - DNA, 20 bp, Artificial Sequence
  chemically synthesized
caccgctcctggcctcgcta

SEQ ID NO: 410889 - DNA, 20 bp, Artificial Sequence
  chemically synthesized
tgttaattctttagcgaggc

SEQ ID NO: 410890 - DNA, 20 bp, Artificial Sequence
  chemically synthesized
gttaattctttagcgaggcc

SEQ ID NO: 410891 - DNA, 20 bp, Artificial Sequence
  chemically synthesized
taattctttagcgaggccag

SEQ ID NO: 410892 - DNA, 20 bp, Artificial Sequence
  chemically synthesized
ttctttagcgaggccaggag

SEQ ID NO: 410893 - DNA, 20 bp, Artificial Sequence
  chemically synthesized
tttagcgaggccaggagcgg

SEQ ID NO: 410894 - DNA, 20 bp, Artificial Sequence
  chemically synthesized
caggcgtgagccaccgctcc

SEQ ID NO: 410895 - DNA, 20 bp, Artificial Sequence
  chemically synthesized
agtgctgggattacaggcgt

SEQ ID NO: 410896 - DNA, 20 bp, Artificial Sequence
  chemically synthesized
gtggctcacgcctgtaatcc

SEQ ID NO: 410897 - DNA, 20 bp, Artificial Sequence
  chemically synthesized
tcccaaagtgctgggattac

SEQ ID NO: 410898 - DNA, 20 bp, Artificial Sequence
  chemically synthesized
ctcccaaagtgctgggatta

SEQ ID NO: 410899 - DNA, 20 bp, Artificial Sequence
  chemically synthesized
cgcctgtaatcccagcactt

SEQ ID NO: 410900 - DNA, 20 bp, Artificial Sequence
  chemically synthesized
ccttggcctcccaaagtgct

SEQ ID NO: 410901 - DNA, 20 bp, Artificial Sequence
  chemically synthesized
gcctgtaatcccagcacttt

SEQ ID NO: 410902 - DNA, 20 bp, Artificial Sequence
  chemically synthesized
gccttggcctcccaaagtgc

SEQ ID NO: 410903 - DNA, 20 bp, Artificial Sequence
  chemically synthesized
ctgtaatcccagcactttgg

SEQ ID NO: 410904 - DNA, 20 bp, Artificial Sequence
  chemically synthesized
tgtaatcccagcactttggg

SEQ ID NO: 410905 - DNA, 20 bp, Artificial Sequence
  chemically synthesized
ccacccgccttggcctccca

SEQ ID NO: 410906 - DNA, 20 bp, Artificial Sequence
  chemically synthesized
tcccagcactttgggaggcc

SEQ ID NO: 410907 - DNA, 20 bp, Artificial Sequence
  chemically synthesized
cccagcactttgggaggcca

SEQ ID NO: 410908 - DNA, 20 bp, Artificial Sequence
  chemically synthesized
agcactttgggaggccaagg

SEQ ID NO: 410909 - DNA, 20 bp, Artificial Sequence
  chemically synthesized
gcactttgggaggccaaggc

SEQ ID NO: 410910 - DNA, 20 bp, Artificial Sequence
  chemically synthesized
ctttgggaggccaaggcggg

SEQ ID NO: 410911 - DNA, 20 bp, Artificial Sequence
  chemically synthesized
ctcaggtgatccacccgcct

SEQ ID NO: 410912 - DNA, 20 bp, Artificial Sequence
  chemically synthesized
ccaaggcgggtggatcacct

SEQ ID NO: 410913 - DNA, 20 bp, Artificial Sequence
  chemically synthesized
gcgggtggatcacctgagat

SEQ ID NO: 410914 - DNA, 20 bp, Artificial Sequence
  chemically synthesized
cgggtggatcacctgagatc

SEQ ID NO: 410915 - DNA, 20 bp, Artificial Sequence
  chemically synthesized
agtctggaactcctgatctc

SEQ ID NO: 410916 - DNA, 20 bp, Artificial Sequence
  chemically synthesized
ggtggatcacctgagatcag

SEQ ID NO: 410917 - DNA, 20 bp, Artificial Sequence
  chemically synthesized
tagtctggaactcctgatct

SEQ ID NO: 410918 - DNA, 20 bp, Artificial Sequence
  chemically synthesized
tcacctgagatcaggagttc

SEQ ID NO: 410919 - DNA, 20 bp, Artificial Sequence
  chemically synthesized
tgagatcaggagttccagac

SEQ ID NO: 410920 - DNA, 20 bp, Artificial Sequence
  chemically synthesized
ccatgttggccaggctagtc

SEQ ID NO: 410921 - DNA, 20 bp, Artificial Sequence
  chemically synthesized
tcaggagttccagactagcc

SEQ ID NO: 410922 - DNA, 20 bp, Artificial Sequence
  chemically synthesized
tttcaccatgttggccaggc

SEQ ID NO: 410923 - DNA, 20 bp, Artificial Sequence
  chemically synthesized
gggatttcaccatgttggcc

SEQ ID NO: 410924 - DNA, 20 bp, Artificial Sequence
  chemically synthesized
ccagactagcctggccaaca

SEQ ID NO: 410925 - DNA, 20 bp, Artificial Sequence
  chemically synthesized
tgggatttcaccatgttggc

SEQ ID NO: 410926 - DNA, 20 bp, Artificial Sequence
  chemically synthesized
gagatgggatttcaccatgt

SEQ ID NO: 410927 - DNA, 20 bp, Artificial Sequence
  chemically synthesized
tttgtatttttagtagagat

SEQ ID NO: 410928 - DNA, 20 bp, Artificial Sequence
  chemically synthesized
ttttgtatttttagtagaga

SEQ ID NO: 410929 - DNA, 20 bp, Artificial Sequence
  chemically synthesized
ttttttttgtatttttagta

SEQ ID NO: 410930 - DNA, 20 bp, Artificial Sequence
  chemically synthesized
atttttttttgtatttttag

SEQ ID NO: 410931 - DNA, 20 bp, Artificial Sequence
  chemically synthesized
ataatttttttttgtatttt

SEQ ID NO: 410932 - DNA, 20 bp, Artificial Sequence
  chemically synthesized
aaatacaaaaaaaaattatc

SEQ ID NO: 410933 - DNA, 20 bp, Artificial Sequence
  chemically synthesized
aatacaaaaaaaaattatcc

SEQ ID NO: 410934 - DNA, 20 bp, Artificial Sequence
  chemically synthesized
aaaaaaaaattatccgggtg

SEQ ID NO: 410935 - DNA, 20 bp, Artificial Sequence
  chemically synthesized
cagctgcccgtcaccacacc

SEQ ID NO: 410936 - DNA, 20 bp, Artificial Sequence
  chemically synthesized
aaattatccgggtgtggtga

SEQ ID NO: 410937 - DNA, 20 bp, Artificial Sequence
  chemically synthesized
aattatccgggtgtggtgac

SEQ ID NO: 410938 - DNA, 20 bp, Artificial Sequence
  chemically synthesized
tatccgggtgtggtgacggg

SEQ ID NO: 410939 - DNA, 20 bp, Artificial Sequence
  chemically synthesized
gtgacgggcagctgtaatcc

SEQ ID NO: 410940 - DNA, 20 bp, Artificial Sequence
  chemically synthesized
ttcccaagtagctgggatta

SEQ ID NO: 410941 - DNA, 20 bp, Artificial Sequence
  chemically synthesized
cagctgtaatcccagctact

SEQ ID NO: 410942 - DNA, 20 bp, Artificial Sequence
  chemically synthesized
cctcagcttcccaagtagct

SEQ ID NO: 410943 - DNA, 20 bp, Artificial Sequence
  chemically synthesized
agctgtaatcccagctactt

SEQ ID NO: 410944 - DNA, 20 bp, Artificial Sequence
  chemically synthesized
gcctcagcttcccaagtagc

SEQ ID NO: 410945 - DNA, 20 bp, Artificial Sequence
  chemically synthesized
tgtaatcccagctacttggg

SEQ ID NO: 410946 - DNA, 20 bp, Artificial Sequence
  chemically synthesized
tcttgcctcagcttcccaag

SEQ ID NO: 410947 - DNA, 20 bp, Artificial Sequence
  chemically synthesized
ttctcttgcctcagcttccc

SEQ ID NO: 410948 - DNA, 20 bp, Artificial Sequence
  chemically synthesized
tcccagctacttgggaagct

SEQ ID NO: 410949 - DNA, 20 bp, Artificial Sequence
  chemically synthesized
cccagctacttgggaagctg

SEQ ID NO: 410950 - DNA, 20 bp, Artificial Sequence
  chemically synthesized
gctacttgggaagctgaggc

SEQ ID NO: 410951 - DNA, 20 bp, Artificial Sequence
  chemically synthesized
tacttgggaagctgaggcaa

SEQ ID NO: 410952 - DNA, 20 bp, Artificial Sequence
  chemically synthesized
ttcaagcgattctcttgcct

SEQ ID NO: 410953 - DNA, 20 bp, Artificial Sequence
  chemically synthesized
caagagaatcgcttgaaccc

SEQ ID NO: 410954 - DNA, 20 bp, Artificial Sequence
  chemically synthesized
aacctccacctctcgggttc

SEQ ID NO: 410955 - DNA, 20 bp, Artificial Sequence
  chemically synthesized
agagaatcgcttgaacccga

SEQ ID NO: 410956 - DNA, 20 bp, Artificial Sequence
  chemically synthesized
gagaatcgcttgaacccgag

SEQ ID NO: 410957 - DNA, 20 bp, Artificial Sequence
  chemically synthesized
aatcgcttgaacccgagagg

SEQ ID NO: 410958 - DNA, 20 bp, Artificial Sequence
  chemically synthesized
cactgcaacctccacctctc

SEQ ID NO: 410959 - DNA, 20 bp, Artificial Sequence
  chemically synthesized
tcgcttgaacccgagaggtg

SEQ ID NO: 410960 - DNA, 20 bp, Artificial Sequence
  chemically synthesized
tcactgcaacctccacctct

SEQ ID NO: 410961 - DNA, 20 bp, Artificial Sequence
  chemically synthesized
cgcttgaacccgagaggtgg

SEQ ID NO: 410962 - DNA, 20 bp, Artificial Sequence
  chemically synthesized
aacccgagaggtggaggttg

SEQ ID NO: 410963 - DNA, 20 bp, Artificial Sequence
  chemically synthesized
cgagaggtggaggttgcagt

SEQ ID NO: 410964 - DNA, 20 bp, Artificial Sequence
  chemically synthesized
ggtggaggttgcagtgagcc

SEQ ID NO: 410965 - DNA, 20 bp, Artificial Sequence
  chemically synthesized
ggagtgcagtggtgtgatct

SEQ ID NO: 410966 - DNA, 20 bp, Artificial Sequence
  chemically synthesized
tcgcccaggctggagtgcag

SEQ ID NO: 410967 - DNA, 20 bp, Artificial Sequence
  chemically synthesized
gagatcacaccactgcactc

SEQ ID NO: 410968 - DNA, 20 bp, Artificial Sequence
  chemically synthesized
ctgtcgcccaggctggagtg

SEQ ID NO: 410969 - DNA, 20 bp, Artificial Sequence
  chemically synthesized
cacaccactgcactccagcc

SEQ ID NO: 410970 - DNA, 20 bp, Artificial Sequence
  chemically synthesized
acaccactgcactccagcct

SEQ ID NO: 410971 - DNA, 20 bp, Artificial Sequence
  chemically synthesized
tggctctgtcgcccaggctg

SEQ ID NO: 410972 - DNA, 20 bp, Artificial Sequence
  chemically synthesized
tctggctctgtcgcccaggc

SEQ ID NO: 410973 - DNA, 20 bp, Artificial Sequence
  chemically synthesized
ctgcactccagcctgggcga

SEQ ID NO: 410974 - DNA, 20 bp, Artificial Sequence
  chemically synthesized
agagtctggctctgtcgccc

SEQ ID NO: 410975 - DNA, 20 bp, Artificial Sequence
  chemically synthesized
gcactccagcctgggcgaca

SEQ ID NO: 410976 - DNA, 20 bp, Artificial Sequence
  chemically synthesized
cagagtctggctctgtcgcc

SEQ ID NO: 410977 - DNA, 20 bp, Artificial Sequence
  chemically synthesized
tccagcctgggcgacagagc

SEQ ID NO: 410978 - DNA, 20 bp, Artificial Sequence
  chemically synthesized
cttatttttgagacagagtc

SEQ ID NO: 410979 - DNA, 20 bp, Artificial Sequence
  chemically synthesized
acttacttatttttgagaca

SEQ ID NO: 410980 - DNA, 20 bp, Artificial Sequence
  chemically synthesized
ttacttacttatttttgaga

SEQ ID NO: 410981 - DNA, 20 bp, Artificial Sequence
  chemically synthesized
ccagactctgtctcaaaaat

SEQ ID NO: 410982 - DNA, 20 bp, Artificial Sequence
  chemically synthesized
ttatttacttacttattttt

SEQ ID NO: 410983 - DNA, 20 bp, Artificial Sequence
  chemically synthesized
actctgtctcaaaaataagt

SEQ ID NO: 410984 - DNA, 20 bp, Artificial Sequence
  chemically synthesized
taataaaaataaaaattctt

SEQ ID NO: 410985 - DNA, 20 bp, Artificial Sequence
  chemically synthesized
aaaaataaaaattctttagt

SEQ ID NO: 410986 - DNA, 20 bp, Artificial Sequence
  chemically synthesized
attaacagttcatctcacta

SEQ ID NO: 410987 - DNA, 20 bp, Artificial Sequence
  chemically synthesized
ttagtgagatgaactgttaa

SEQ ID NO: 410988 - DNA, 20 bp, Artificial Sequence
  chemically synthesized
attatggaatcaaccattaa

SEQ ID NO: 410989 - DNA, 20 bp, Artificial Sequence
  chemically synthesized
tataatgagaatcagtatta

SEQ ID NO: 410990 - DNA, 20 bp, Artificial Sequence
  chemically synthesized
cagtaatttataatgagaat

SEQ ID NO: 410991 - DNA, 20 bp, Artificial Sequence
  chemically synthesized
aagttacagtaatttataat

SEQ ID NO: 410992 - DNA, 20 bp, Artificial Sequence
  chemically synthesized
ttataaattactgtaacttt

SEQ ID NO: 410993 - DNA, 20 bp, Artificial Sequence
  chemically synthesized
tttaagacaactaaaagtta

SEQ ID NO: 410994 - DNA, 20 bp, Artificial Sequence
  chemically synthesized
ttaatatttaagacaactaa

SEQ ID NO: 410995 - DNA, 20 bp, Artificial Sequence
  chemically synthesized
tgttattttgtttaatattt

SEQ ID NO: 410996 - DNA, 20 bp, Artificial Sequence
  chemically synthesized
attaaacaaaataacaacaa

SEQ ID NO: 410997 - DNA, 20 bp, Artificial Sequence
  chemically synthesized
ataacaacaatagtgccaac

SEQ ID NO: 410998 - DNA, 20 bp, Artificial Sequence
  chemically synthesized
tcagcactagcagcacttgt

SEQ ID NO: 410999 - DNA, 20 bp, Artificial Sequence
  chemically synthesized
atagtgccaacaagtgctgc

SEQ ID NO: 411000 - DNA, 20 bp, Artificial Sequence
  chemically synthesized
gaagaaattttcagcactag

SEQ ID NO: 411001 - DNA, 20 bp, Artificial Sequence
  chemically synthesized
tctgaagaaattttcagcac

SEQ ID NO: 411002 - DNA, 20 bp, Artificial Sequence
  chemically synthesized
taacaatctgaagaaatttt

SEQ ID NO: 411003 - DNA, 20 bp, Artificial Sequence
  chemically synthesized
gctagtgctgaaaatttctt

SEQ ID NO: 411004 - DNA, 20 bp, Artificial Sequence
  chemically synthesized
actgttcctctaacaatctg

SEQ ID NO: 411005 - DNA, 20 bp, Artificial Sequence
  chemically synthesized
tgaaaatttcttcagattgt

SEQ ID NO: 411006 - DNA, 20 bp, Artificial Sequence
  chemically synthesized
aaaatttcttcagattgtta

SEQ ID NO: 411007 - DNA, 20 bp, Artificial Sequence
  chemically synthesized
aaatttcttcagattgttag

SEQ ID NO: 411008 - DNA, 20 bp, Artificial Sequence
  chemically synthesized
tcttcagattgttagaggaa

SEQ ID NO: 411009 - DNA, 20 bp, Artificial Sequence
  chemically synthesized
ttgttagaggaacagtattt

SEQ ID NO: 411010 - DNA, 20 bp, Artificial Sequence
  chemically synthesized
atatattttgttacaatttc

SEQ ID NO: 411011 - DNA, 20 bp, Artificial Sequence
  chemically synthesized
attttgttacaatttcgaga

SEQ ID NO: 411012 - DNA, 20 bp, Artificial Sequence
  chemically synthesized
tcgagaaagaattcaaaacc

SEQ ID NO: 411013 - DNA, 20 bp, Artificial Sequence
  chemically synthesized
aaagaattcaaaacccagaa

SEQ ID NO: 411014 - DNA, 20 bp, Artificial Sequence
  chemically synthesized
aagaattcaaaacccagaat

SEQ ID NO: 411015 - DNA, 20 bp, Artificial Sequence
  chemically synthesized
gtctttgttattcccattct

SEQ ID NO: 411016 - DNA, 20 bp, Artificial Sequence
  chemically synthesized
ggtctttgttattcccattc

SEQ ID NO: 411017 - DNA, 20 bp, Artificial Sequence
  chemically synthesized
aacccagaatgggaataaca

SEQ ID NO: 411018 - DNA, 20 bp, Artificial Sequence
  chemically synthesized
tgggaataacaaagaccttt

SEQ ID NO: 411019 - DNA, 20 bp, Artificial Sequence
  chemically synthesized
ggaataacaaagacctttta

SEQ ID NO: 411020 - DNA, 20 bp, Artificial Sequence
  chemically synthesized
ttgagaaacacaactctaaa

SEQ ID NO: 411021 - DNA, 20 bp, Artificial Sequence
  chemically synthesized
tttgagaaacacaactctaa

SEQ ID NO: 411022 - DNA, 20 bp, Artificial Sequence
  chemically synthesized
ttttagagttgtgtttctca

SEQ ID NO: 411023 - DNA, 20 bp, Artificial Sequence
  chemically synthesized
agagttgtgtttctcaaaga

SEQ ID NO: 411024 - DNA, 20 bp, Artificial Sequence
  chemically synthesized
tattcctggggtctttcttt

SEQ ID NO: 411025 - DNA, 20 bp, Artificial Sequence
  chemically synthesized
tgtttctcaaagaaagaccc

SEQ ID NO: 411026 - DNA, 20 bp, Artificial Sequence
  chemically synthesized
gtttctcaaagaaagacccc

SEQ ID NO: 411027 - DNA, 20 bp, Artificial Sequence
  chemically synthesized
ttacaagtcatgtattcctg

SEQ ID NO: 411028 - DNA, 20 bp, Artificial Sequence
  chemically synthesized
tttacaagtcatgtattcct

SEQ ID NO: 411029 - DNA, 20 bp, Artificial Sequence
  chemically synthesized
ctttacaagtcatgtattcc

SEQ ID NO: 411030 - DNA, 20 bp, Artificial Sequence
  chemically synthesized
ccaggaatacatgacttgta

SEQ ID NO: 411031 - DNA, 20 bp, Artificial Sequence
  chemically synthesized
ttcttctggtaggtctttac

SEQ ID NO: 411032 - DNA, 20 bp, Artificial Sequence
  chemically synthesized
catgacttgtaaagacctac

SEQ ID NO: 411033 - DNA, 20 bp, Artificial Sequence
  chemically synthesized
gacttgtaaagacctaccag

SEQ ID NO: 411034 - DNA, 20 bp, Artificial Sequence
  chemically synthesized
ctaaatgatattcttctggt

SEQ ID NO: 411035 - DNA, 20 bp, Artificial Sequence
  chemically synthesized
tctaaatgatattcttctgg

SEQ ID NO: 411036 - DNA, 20 bp, Artificial Sequence
  chemically synthesized
cattctaaatgatattcttc

SEQ ID NO: 411037 - DNA, 20 bp, Artificial Sequence
  chemically synthesized
cctaccagaagaatatcatt

SEQ ID NO: 411038 - DNA, 20 bp, Artificial Sequence
  chemically synthesized
cagaagaatatcatttagaa

SEQ ID NO: 411039 - DNA, 20 bp, Artificial Sequence
  chemically synthesized
agaagaatatcatttagaat

SEQ ID NO: 411040 - DNA, 20 bp, Artificial Sequence
  chemically synthesized
gaagaatatcatttagaatg

SEQ ID NO: 411041 - DNA, 20 bp, Artificial Sequence
  chemically synthesized
tatcatttagaatggggctt

SEQ ID NO: 411042 - DNA, 20 bp, Artificial Sequence
  chemically synthesized
tattaaaaatgcagattcta

SEQ ID NO: 411043 - DNA, 20 bp, Artificial Sequence
  chemically synthesized
tagaatgcttattaaaaatg

SEQ ID NO: 411044 - DNA, 20 bp, Artificial Sequence
  chemically synthesized
ttagaatctgcatttttaat

SEQ ID NO: 411045 - DNA, 20 bp, Artificial Sequence
  chemically synthesized
tgcatttttaataagcattc

SEQ ID NO: 411046 - DNA, 20 bp, Artificial Sequence
  chemically synthesized
gcatttttaataagcattct

SEQ ID NO: 411047 - DNA, 20 bp, Artificial Sequence
  chemically synthesized
catttttaataagcattcta

SEQ ID NO: 411048 - DNA, 20 bp, Artificial Sequence
  chemically synthesized
atttttaataagcattctag

SEQ ID NO: 411049 - DNA, 20 bp, Artificial Sequence
  chemically synthesized
tagaatacagcagaatcccc

SEQ ID NO: 411050 - DNA, 20 bp, Artificial Sequence
  chemically synthesized
tcccaaactctagaatacag

SEQ ID NO: 411051 - DNA, 20 bp, Artificial Sequence
  chemically synthesized
taggggattctgctgtattc

SEQ ID NO: 411052 - DNA, 20 bp, Artificial Sequence
  chemically synthesized
ggggattctgctgtattcta

SEQ ID NO: 411053 - DNA, 20 bp, Artificial Sequence
  chemically synthesized
ccttcccaaactctagaata

SEQ ID NO: 411054 - DNA, 20 bp, Artificial Sequence
  chemically synthesized
ttctgctgtattctagagtt

SEQ ID NO: 411055 - DNA, 20 bp, Artificial Sequence
  chemically synthesized
tctgctgtattctagagttt

SEQ ID NO: 411056 - DNA, 20 bp, Artificial Sequence
  chemically synthesized
aggcagtccttcccaaactc

SEQ ID NO: 411057 - DNA, 20 bp, Artificial Sequence
  chemically synthesized
gctgtattctagagtttggg

SEQ ID NO: 411058 - DNA, 20 bp, Artificial Sequence
  chemically synthesized
ctgtattctagagtttggga

SEQ ID NO: 411059 - DNA, 20 bp, Artificial Sequence
  chemically synthesized
agagtttgggaaggactgcc

SEQ ID NO: 411060 - DNA, 20 bp, Artificial Sequence
  chemically synthesized
gtttgggaaggactgcctag

SEQ ID NO: 411061 - DNA, 20 bp, Artificial Sequence
  chemically synthesized
tggccttacaatctactagg

SEQ ID NO: 411062 - DNA, 20 bp, Artificial Sequence
  chemically synthesized
ccttggccttacaatctact

SEQ ID NO: 411063 - DNA, 20 bp, Artificial Sequence
  chemically synthesized
accttggccttacaatctac

SEQ ID NO: 411064 - DNA, 20 bp, Artificial Sequence
  chemically synthesized
aggactgcctagtagattgt

SEQ ID NO: 411065 - DNA, 20 bp, Artificial Sequence
  chemically synthesized
ggactgcctagtagattgta

SEQ ID NO: 411066 - DNA, 20 bp, Artificial Sequence
  chemically synthesized
gcctagtagattgtaaggcc

SEQ ID NO: 411067 - DNA, 20 bp, Artificial Sequence
  chemically synthesized
cctagtagattgtaaggcca

SEQ ID NO: 411068 - DNA, 20 bp, Artificial Sequence
  chemically synthesized
agtagattgtaaggccaagg

SEQ ID NO: 411069 - DNA, 20 bp, Artificial Sequence
  chemically synthesized
agatcaattaatcactacct

SEQ ID NO: 411070 - DNA, 20 bp, Artificial Sequence
  chemically synthesized
aaggtagtgattaattgatc

SEQ ID NO: 411071 - DNA, 20 bp, Artificial Sequence
  chemically synthesized
aggtagtgattaattgatct

SEQ ID NO: 411072 - DNA, 20 bp, Artificial Sequence
  chemically synthesized
agtgattaattgatctaggc

SEQ ID NO: 411073 - DNA, 20 bp, Artificial Sequence
  chemically synthesized
tgattaattgatctaggcta

SEQ ID NO: 411074 - DNA, 20 bp, Artificial Sequence
  chemically synthesized
gccacagctttactctagcc

SEQ ID NO: 411075 - DNA, 20 bp, Artificial Sequence
  chemically synthesized
aattgatctaggctagagta

SEQ ID NO: 411076 - DNA, 20 bp, Artificial Sequence
  chemically synthesized
tttcagccacagctttactc

SEQ ID NO: 411077 - DNA, 20 bp, Artificial Sequence
  chemically synthesized
tctaggctagagtaaagctg

SEQ ID NO: 411078 - DNA, 20 bp, Artificial Sequence
  chemically synthesized
ttagaaaaatatttcagcca

SEQ ID NO: 411079 - DNA, 20 bp, Artificial Sequence
  chemically synthesized
gagaacttagaaaaatattt

SEQ ID NO: 411080 - DNA, 20 bp, Artificial Sequence
  chemically synthesized
tgtggctgaaatatttttct

SEQ ID NO: 411081 - DNA, 20 bp, Artificial Sequence
  chemically synthesized
ttagactcactgggagaact

SEQ ID NO: 411082 - DNA, 20 bp, Artificial Sequence
  chemically synthesized
aatatttttctaagttctcc

SEQ ID NO: 411083 - DNA, 20 bp, Artificial Sequence
  chemically synthesized
tttttctaagttctcccagt

SEQ ID NO: 411084 - DNA, 20 bp, Artificial Sequence
  chemically synthesized
ctggctgttagactcactgg

SEQ ID NO: 411085 - DNA, 20 bp, Artificial Sequence
  chemically synthesized
tcctggctgttagactcact

SEQ ID NO: 411086 - DNA, 20 bp, Artificial Sequence
  chemically synthesized
ctcctggctgttagactcac

SEQ ID NO: 411087 - DNA, 20 bp, Artificial Sequence
  chemically synthesized
agttctcccagtgagtctaa

SEQ ID NO: 411088 - DNA, 20 bp, Artificial Sequence
  chemically synthesized
ctcccagtgagtctaacagc

SEQ ID NO: 411089 - DNA, 20 bp, Artificial Sequence
  chemically synthesized
tcccagtgagtctaacagcc

SEQ ID NO: 411090 - DNA, 20 bp, Artificial Sequence
  chemically synthesized
gtgttctttctcctggctgt

SEQ ID NO: 411091 - DNA, 20 bp, Artificial Sequence
  chemically synthesized
ccagtgagtctaacagccag

SEQ ID NO: 411092 - DNA, 20 bp, Artificial Sequence
  chemically synthesized
tgagtctaacagccaggaga

SEQ ID NO: 411093 - DNA, 20 bp, Artificial Sequence
  chemically synthesized
tgcacaggtgttctttctcc

SEQ ID NO: 411094 - DNA, 20 bp, Artificial Sequence
  chemically synthesized
gagaaagaacacctgtgcat

SEQ ID NO: 411095 - DNA, 20 bp, Artificial Sequence
  chemically synthesized
cgctgtcactgccaatgcac

SEQ ID NO: 411096 - DNA, 20 bp, Artificial Sequence
  chemically synthesized
ccgctgtcactgccaatgca

SEQ ID NO: 411097 - DNA, 20 bp, Artificial Sequence
  chemically synthesized
aaagaacacctgtgcattgg

SEQ ID NO: 411098 - DNA, 20 bp, Artificial Sequence
  chemically synthesized
cacctgtgcattggcagtga

SEQ ID NO: 411099 - DNA, 20 bp, Artificial Sequence
  chemically synthesized
ctgtgcattggcagtgacag

SEQ ID NO: 411100 - DNA, 20 bp, Artificial Sequence
  chemically synthesized
gtgcattggcagtgacagcg

SEQ ID NO: 411101 - DNA, 20 bp, Artificial Sequence
  chemically synthesized
tgcattggcagtgacagcgg

SEQ ID NO: 411102 - DNA, 20 bp, Artificial Sequence
  chemically synthesized
cattggcagtgacagcggag

SEQ ID NO: 411103 - DNA, 20 bp, Artificial Sequence
  chemically synthesized
attggcagtgacagcggagg

SEQ ID NO: 411104 - DNA, 20 bp, Artificial Sequence
  chemically synthesized
aggaggtattgtactttgcc

SEQ ID NO: 411105 - DNA, 20 bp, Artificial Sequence
  chemically synthesized
ggaggtattgtactttgcca

SEQ ID NO: 411106 - DNA, 20 bp, Artificial Sequence
  chemically synthesized
ctgtgcatacttccttggca

SEQ ID NO: 411107 - DNA, 20 bp, Artificial Sequence
  chemically synthesized
ggtattgtactttgccaagg

SEQ ID NO: 411108 - DNA, 20 bp, Artificial Sequence
  chemically synthesized
tgattctgtgcatacttcct

SEQ ID NO: 411109 - DNA, 20 bp, Artificial Sequence
  chemically synthesized
ctttgccaaggaagtatgca

SEQ ID NO: 411110 - DNA, 20 bp, Artificial Sequence
  chemically synthesized
tgcacagaatcatttttata

SEQ ID NO: 411111 - DNA, 20 bp, Artificial Sequence
  chemically synthesized
gcacagaatcatttttatat

SEQ ID NO: 411112 - DNA, 20 bp, Artificial Sequence
  chemically synthesized
atagagttttgttagatata

SEQ ID NO: 411113 - DNA, 20 bp, Artificial Sequence
  chemically synthesized
gaaatgaaatagagttttgt

SEQ ID NO: 411114 - DNA, 20 bp, Artificial Sequence
  chemically synthesized
tttaagagtgaaatgaaata

SEQ ID NO: 411115 - DNA, 20 bp, Artificial Sequence
  chemically synthesized
aatttaagagtgaaatgaaa

SEQ ID NO: 411116 - DNA, 20 bp, Artificial Sequence
  chemically synthesized
tttcatttcactcttaaatt

SEQ ID NO: 411117 - DNA, 20 bp, Artificial Sequence
  chemically synthesized
tattttttttctgaatttaa

SEQ ID NO: 411118 - DNA, 20 bp, Artificial Sequence
  chemically synthesized
tgtattttttttctgaattt

SEQ ID NO: 411119 - DNA, 20 bp, Artificial Sequence
  chemically synthesized
ttcaaaataaacgttatcac

SEQ ID NO: 411120 - DNA, 20 bp, Artificial Sequence
  chemically synthesized
ataaacgttatcactggata

SEQ ID NO: 411121 - DNA, 20 bp, Artificial Sequence
  chemically synthesized
aacgttatcactggatatgg

SEQ ID NO: 411122 - DNA, 20 bp, Artificial Sequence
  chemically synthesized
tgttgttttgctaccatatc

SEQ ID NO: 411123 - DNA, 20 bp, Artificial Sequence
  chemically synthesized
tggatatggtagcaaaacaa

SEQ ID NO: 411124 - DNA, 20 bp, Artificial Sequence
  chemically synthesized
ggtagcaaaacaacagtgcg

SEQ ID NO: 411125 - DNA, 20 bp, Artificial Sequence
  chemically synthesized
tagaactcacacggaaacat

SEQ ID NO: 411126 - DNA, 20 bp, Artificial Sequence
  chemically synthesized
atgtgcttatgtttccgtgt

SEQ ID NO: 411127 - DNA, 20 bp, Artificial Sequence
  chemically synthesized
acacatagatagaactcaca

SEQ ID NO: 411128 - DNA, 20 bp, Artificial Sequence
  chemically synthesized
tatataagcacacacataga

SEQ ID NO: 411129 - DNA, 20 bp, Artificial Sequence
  chemically synthesized
cacatatataagcacacaca

SEQ ID NO: 411130 - DNA, 20 bp, Artificial Sequence
  chemically synthesized
atgtgtgtgtacacatatat

SEQ ID NO: 411131 - DNA, 20 bp, Artificial Sequence
  chemically synthesized
acacatatacacaacacata

SEQ ID NO: 411132 - DNA, 20 bp, Artificial Sequence
  chemically synthesized
atatacacaacacatacagt

SEQ ID NO: 411133 - DNA, 20 bp, Artificial Sequence
  chemically synthesized
atacacaacacatacagtga

SEQ ID NO: 411134 - DNA, 20 bp, Artificial Sequence
  chemically synthesized
acaacacatacagtgagaga

SEQ ID NO: 411135 - DNA, 20 bp, Artificial Sequence
  chemically synthesized
aacacatacagtgagagaaa

SEQ ID NO: 411136 - DNA, 20 bp, Artificial Sequence
  chemically synthesized
cacatacagtgagagaaaga

SEQ ID NO: 411137 - DNA, 20 bp, Artificial Sequence
  chemically synthesized
acatacagtgagagaaagag

SEQ ID NO: 411138 - DNA, 20 bp, Artificial Sequence
  chemically synthesized
tacagtgagagaaagagagg

SEQ ID NO: 411139 - DNA, 20 bp, Artificial Sequence
  chemically synthesized
acataagccaaaaatgttgg

SEQ ID NO: 411140 - DNA, 20 bp, Artificial Sequence
  chemically synthesized
ttataatcttccaacatttt

SEQ ID NO: 411141 - DNA, 20 bp, Artificial Sequence
  chemically synthesized
ttgacataagccaaaaatgt

SEQ ID NO: 411142 - DNA, 20 bp, Artificial Sequence
  chemically synthesized
tttaacctacaggttgacat

SEQ ID NO: 411143 - DNA, 20 bp, Artificial Sequence
  chemically synthesized
ttttggcttatgtcaacctg

SEQ ID NO: 411144 - DNA, 20 bp, Artificial Sequence
  chemically synthesized
tttggcttatgtcaacctgt

SEQ ID NO: 411145 - DNA, 20 bp, Artificial Sequence
  chemically synthesized
aagtcagatttttaacctac

SEQ ID NO: 411146 - DNA, 20 bp, Artificial Sequence
  chemically synthesized
aaagtcagatttttaaccta

SEQ ID NO: 411147 - DNA, 20 bp, Artificial Sequence
  chemically synthesized
cctctttggcatcacaaagt

SEQ ID NO: 411148 - DNA, 20 bp, Artificial Sequence
  chemically synthesized
ctttcctctttggcatcaca

SEQ ID NO: 411149 - DNA, 20 bp, Artificial Sequence
  chemically synthesized
aatctgactttgtgatgcca

SEQ ID NO: 411150 - DNA, 20 bp, Artificial Sequence
  chemically synthesized
tctgactttgtgatgccaaa

SEQ ID NO: 411151 - DNA, 20 bp, Artificial Sequence
  chemically synthesized
ctgactttgtgatgccaaag

SEQ ID NO: 411152 - DNA, 20 bp, Artificial Sequence
  chemically synthesized
ctttgtgatgccaaagagga

SEQ ID NO: 411153 - DNA, 20 bp, Artificial Sequence
  chemically synthesized
cttcctatacctttcctctt

SEQ ID NO: 411154 - DNA, 20 bp, Artificial Sequence
  chemically synthesized
tttgtgatgccaaagaggaa

SEQ ID NO: 411155 - DNA, 20 bp, Artificial Sequence
  chemically synthesized
gatgccaaagaggaaaggta

SEQ ID NO: 411156 - DNA, 20 bp, Artificial Sequence
  chemically synthesized
atgccaaagaggaaaggtat

SEQ ID NO: 411157 - DNA, 20 bp, Artificial Sequence
  chemically synthesized
ccaaagaggaaaggtatagg

SEQ ID NO: 411158 - DNA, 20 bp, Artificial Sequence
  chemically synthesized
caaagaggaaaggtatagga

SEQ ID NO: 411159 - DNA, 20 bp, Artificial Sequence
  chemically synthesized
aagaggaaaggtataggaag

SEQ ID NO: 411160 - DNA, 20 bp, Artificial Sequence
  chemically synthesized
aggaaaggtataggaaggag

SEQ ID NO: 411161 - DNA, 20 bp, Artificial Sequence
  chemically synthesized
gaaaggtataggaaggagca

SEQ ID NO: 411162 - DNA, 20 bp, Artificial Sequence
  chemically synthesized
cagagaaaataactcaaata

SEQ ID NO: 411163 - DNA, 20 bp, Artificial Sequence
  chemically synthesized
tacctaagtaaaccatattt

SEQ ID NO: 411164 - DNA, 20 bp, Artificial Sequence
  chemically synthesized
taactcaaatatggtttact

SEQ ID NO: 411165 - DNA, 20 bp, Artificial Sequence
  chemically synthesized
aactcaaatatggtttactt

SEQ ID NO: 411166 - DNA, 20 bp, Artificial Sequence
  chemically synthesized
aaatatggtttacttaggta

SEQ ID NO: 411167 - DNA, 20 bp, Artificial Sequence
  chemically synthesized
aatatggtttacttaggtat

SEQ ID NO: 411168 - DNA, 20 bp, Artificial Sequence
  chemically synthesized
atctttcacctcccatacct

SEQ ID NO: 411169 - DNA, 20 bp, Artificial Sequence
  chemically synthesized
tatggtttacttaggtatgg

SEQ ID NO: 411170 - DNA, 20 bp, Artificial Sequence
  chemically synthesized
atggtttacttaggtatggg

SEQ ID NO: 411171 - DNA, 20 bp, Artificial Sequence
  chemically synthesized
tacttaggtatgggaggtga

SEQ ID NO: 411172 - DNA, 20 bp, Artificial Sequence
  chemically synthesized
gggaggtgaaagattatttg

SEQ ID NO: 411173 - DNA, 20 bp, Artificial Sequence
  chemically synthesized
gattatttgtggcatcatta

SEQ ID NO: 411174 - DNA, 20 bp, Artificial Sequence
  chemically synthesized
accttgccaattgtttcaca

SEQ ID NO: 411175 - DNA, 20 bp, Artificial Sequence
  chemically synthesized
ttacagctttgtgaaacaat

SEQ ID NO: 411176 - DNA, 20 bp, Artificial Sequence
  chemically synthesized
agctttgtgaaacaattggc

SEQ ID NO: 411177 - DNA, 20 bp, Artificial Sequence
  chemically synthesized
gctttgtgaaacaattggca

SEQ ID NO: 411178 - DNA, 20 bp, Artificial Sequence
  chemically synthesized
acaattggcaaggttgtgca

SEQ ID NO: 411179 - DNA, 20 bp, Artificial Sequence
  chemically synthesized
gtgcaaagtaccatcttgat

SEQ ID NO: 411180 - DNA, 20 bp, Artificial Sequence
  chemically synthesized
aaaagcttcactgatcaaga

SEQ ID NO: 411181 - DNA, 20 bp, Artificial Sequence
  chemically synthesized
gggaaaaagcttcactgatc

SEQ ID NO: 411182 - DNA, 20 bp, Artificial Sequence
  chemically synthesized
aagtaccatcttgatcagtg

SEQ ID NO: 411183 - DNA, 20 bp, Artificial Sequence
  chemically synthesized
taatccatccttaagggaaa

SEQ ID NO: 411184 - DNA, 20 bp, Artificial Sequence
  chemically synthesized
tcagtgaagctttttccctt

SEQ ID NO: 411185 - DNA, 20 bp, Artificial Sequence
  chemically synthesized
cagtgaagctttttccctta

SEQ ID NO: 411186 - DNA, 20 bp, Artificial Sequence
  chemically synthesized
gaagctttttcccttaagga

SEQ ID NO: 411187 - DNA, 20 bp, Artificial Sequence
  chemically synthesized
cacttgtaatccatccttaa

SEQ ID NO: 411188 - DNA, 20 bp, Artificial Sequence
  chemically synthesized
acacttgtaatccatcctta

SEQ ID NO: 411189 - DNA, 20 bp, Artificial Sequence
  chemically synthesized
cacacttgtaatccatcctt

SEQ ID NO: 411190 - DNA, 20 bp, Artificial Sequence
  chemically synthesized
ttcccttaaggatggattac

SEQ ID NO: 411191 - DNA, 20 bp, Artificial Sequence
  chemically synthesized
tgtaattcaaccttgacttg

SEQ ID NO: 411192 - DNA, 20 bp, Artificial Sequence
  chemically synthesized
aaatggaggtctacaagtca

SEQ ID NO: 411193 - DNA, 20 bp, Artificial Sequence
  chemically synthesized
gaaatggaggtctacaagtc

SEQ ID NO: 411194 - DNA, 20 bp, Artificial Sequence
  chemically synthesized
gagaggaaatggaggtctac

SEQ ID NO: 411195 - DNA, 20 bp, Artificial Sequence
  chemically synthesized
cataactagagaggaaatgg

SEQ ID NO: 411196 - DNA, 20 bp, Artificial Sequence
  chemically synthesized
acataactagagaggaaatg

SEQ ID NO: 411197 - DNA, 20 bp, Artificial Sequence
  chemically synthesized
tcacataactagagaggaaa

SEQ ID NO: 411198 - DNA, 20 bp, Artificial Sequence
  chemically synthesized
gtagacctccatttcctctc

SEQ ID NO: 411199 - DNA, 20 bp, Artificial Sequence
  chemically synthesized
gcacattcacataactagag

SEQ ID NO: 411200 - DNA, 20 bp, Artificial Sequence
  chemically synthesized
tgcacattcacataactaga

SEQ ID NO: 411201 - DNA, 20 bp, Artificial Sequence
  chemically synthesized
ggtgcacattcacataacta

SEQ ID NO: 411202 - DNA, 20 bp, Artificial Sequence
  chemically synthesized
atggtgcacattcacataac

SEQ ID NO: 411203 - DNA, 20 bp, Artificial Sequence
  chemically synthesized
gtatagaactttgtattgta

SEQ ID NO: 411204 - DNA, 20 bp, Artificial Sequence
  chemically synthesized
aatgtgcaccatacaataca

SEQ ID NO: 411205 - DNA, 20 bp, Artificial Sequence
  chemically synthesized
ctggtttaaagtaataggta

SEQ ID NO: 411206 - DNA, 20 bp, Artificial Sequence
  chemically synthesized
cgttactggtttaaagtaat

SEQ ID NO: 411207 - DNA, 20 bp, Artificial Sequence
  chemically synthesized
acgttactggtttaaagtaa

SEQ ID NO: 411208 - DNA, 20 bp, Artificial Sequence
  chemically synthesized
ctatacctattactttaaac

SEQ ID NO: 411209 - DNA, 20 bp, Artificial Sequence
  chemically synthesized
aataaaacgttactggttta

SEQ ID NO: 411210 - DNA, 20 bp, Artificial Sequence
  chemically synthesized
taagtacaataaaacgttac

SEQ ID NO: 411211 - DNA, 20 bp, Artificial Sequence
  chemically synthesized
cgttttattgtacttaataa

SEQ ID NO: 411212 - DNA, 20 bp, Artificial Sequence
  chemically synthesized
gatagcctaagactattatt

SEQ ID NO: 411213 - DNA, 20 bp, Artificial Sequence
  chemically synthesized
attgtacttaataatagtct

SEQ ID NO: 411214 - DNA, 20 bp, Artificial Sequence
  chemically synthesized
ttgtacttaataatagtctt

SEQ ID NO: 411215 - DNA, 20 bp, Artificial Sequence
  chemically synthesized
agagattacctagatagcct

SEQ ID NO: 411216 - DNA, 20 bp, Artificial Sequence
  chemically synthesized
aataatagtcttaggctatc

SEQ ID NO: 411217 - DNA, 20 bp, Artificial Sequence
  chemically synthesized
ataatagtcttaggctatct

SEQ ID NO: 411218 - DNA, 20 bp, Artificial Sequence
  chemically synthesized
ataaacagagattacctaga

SEQ ID NO: 411219 - DNA, 20 bp, Artificial Sequence
  chemically synthesized
acctataaacagagattacc

SEQ ID NO: 411220 - DNA, 20 bp, Artificial Sequence
  chemically synthesized
atctaggtaatctctgttta

SEQ ID NO: 411221 - DNA, 20 bp, Artificial Sequence
  chemically synthesized
tctaggtaatctctgtttat

SEQ ID NO: 411222 - DNA, 20 bp, Artificial Sequence
  chemically synthesized
tttgtaaacacctataaaca

SEQ ID NO: 411223 - DNA, 20 bp, Artificial Sequence
  chemically synthesized
actttgtaaacacctataaa

SEQ ID NO: 411224 - DNA, 20 bp, Artificial Sequence
  chemically synthesized
tctgtttataggtgtttaca

SEQ ID NO: 411225 - DNA, 20 bp, Artificial Sequence
  chemically synthesized
attagcaccaacgtttttat

SEQ ID NO: 411226 - DNA, 20 bp, Artificial Sequence
  chemically synthesized
atgtaaactaataaaaacgt

SEQ ID NO: 411227 - DNA, 20 bp, Artificial Sequence
  chemically synthesized
caagcaatgtgtaaagcaat

SEQ ID NO: 411228 - DNA, 20 bp, Artificial Sequence
  chemically synthesized
gcttttccaagcaatgtgta

SEQ ID NO: 411229 - DNA, 20 bp, Artificial Sequence
  chemically synthesized
taattgctttacacattgct

SEQ ID NO: 411230 - DNA, 20 bp, Artificial Sequence
  chemically synthesized
gctttacacattgcttggaa

SEQ ID NO: 411231 - DNA, 20 bp, Artificial Sequence
  chemically synthesized
caaaaatggcttgcttttcc

SEQ ID NO: 411232 - DNA, 20 bp, Artificial Sequence
  chemically synthesized
tacacattgcttggaaaagc

SEQ ID NO: 411233 - DNA, 20 bp, Artificial Sequence
  chemically synthesized
ggaaaagcaagccatttttg

SEQ ID NO: 411234 - DNA, 20 bp, Artificial Sequence
  chemically synthesized
caactactcaactgcaaaaa

SEQ ID NO: 411235 - DNA, 20 bp, Artificial Sequence
  chemically synthesized
agcaagccatttttgcagtt

SEQ ID NO: 411236 - DNA, 20 bp, Artificial Sequence
  chemically synthesized
aagccatttttgcagttgag

SEQ ID NO: 411237 - DNA, 20 bp, Artificial Sequence
  chemically synthesized
tttgcagttgagtagttgct

SEQ ID NO: 411238 - DNA, 20 bp, Artificial Sequence
  chemically synthesized
atagattggccaatagtgct

SEQ ID NO: 411239 - DNA, 20 bp, Artificial Sequence
  chemically synthesized
gagtagttgctcagcactat

SEQ ID NO: 411240 - DNA, 20 bp, Artificial Sequence
  chemically synthesized
tatagaaatagattggccaa

SEQ ID NO: 411241 - DNA, 20 bp, Artificial Sequence
  chemically synthesized
aagaagctatagaaatagat

SEQ ID NO: 411242 - DNA, 20 bp, Artificial Sequence
  chemically synthesized
tattggccaatctatttcta

SEQ ID NO: 411243 - DNA, 20 bp, Artificial Sequence
  chemically synthesized
aaaacaagaagctatagaaa

SEQ ID NO: 411244 - DNA, 20 bp, Artificial Sequence
  chemically synthesized
agatgaaaaacaagaagcta

SEQ ID NO: 411245 - DNA, 20 bp, Artificial Sequence
  chemically synthesized
tgaaggagatgaaaaacaag

SEQ ID NO: 411246 - DNA, 20 bp, Artificial Sequence
  chemically synthesized
tgttgaaggagatgaaaaac

SEQ ID NO: 411247 - DNA, 20 bp, Artificial Sequence
  chemically synthesized
tgtttttcatctccttcaac

SEQ ID NO: 411248 - DNA, 20 bp, Artificial Sequence
  chemically synthesized
ggcagatgaacttgttgaag

SEQ ID NO: 411249 - DNA, 20 bp, Artificial Sequence
  chemically synthesized
ttggcagatgaacttgttga

SEQ ID NO: 411250 - DNA, 20 bp, Artificial Sequence
  chemically synthesized
attggcagatgaacttgttg

SEQ ID NO: 411251 - DNA, 20 bp, Artificial Sequence
  chemically synthesized
cacggggagcaaaatattgg

SEQ ID NO: 411252 - DNA, 20 bp, Artificial Sequence
  chemically synthesized
caacacggggagcaaaatat

SEQ ID NO: 411253 - DNA, 20 bp, Artificial Sequence
  chemically synthesized
tgagattagagcaacacggg

SEQ ID NO: 411254 - DNA, 20 bp, Artificial Sequence
  chemically synthesized
attgagattagagcaacacg

SEQ ID NO: 411255 - DNA, 20 bp, Artificial Sequence
  chemically synthesized
aattgagattagagcaacac

SEQ ID NO: 411256 - DNA, 20 bp, Artificial Sequence
  chemically synthesized
aaattgagattagagcaaca

SEQ ID NO: 411257 - DNA, 20 bp, Artificial Sequence
  chemically synthesized
taagatagaaattgagatta

SEQ ID NO: 411258 - DNA, 20 bp, Artificial Sequence
  chemically synthesized
tttaagatagaaattgagat

SEQ ID NO: 411259 - DNA, 20 bp, Artificial Sequence
  chemically synthesized
atttttttaagatagaaatt

SEQ ID NO: 411260 - DNA, 20 bp, Artificial Sequence
  chemically synthesized
accattgtatttttttaaga

SEQ ID NO: 411261 - DNA, 20 bp, Artificial Sequence
  chemically synthesized
ccttaccattgtattttttt

SEQ ID NO: 411262 - DNA, 20 bp, Artificial Sequence
  chemically synthesized
tctatcttaaaaaaatacaa

SEQ ID NO: 411263 - DNA, 20 bp, Artificial Sequence
  chemically synthesized
tcttaaaaaaatacaatggt

SEQ ID NO: 411264 - DNA, 20 bp, Artificial Sequence
  chemically synthesized
cttaaaaaaatacaatggta

SEQ ID NO: 411265 - DNA, 20 bp, Artificial Sequence
  chemically synthesized
ttaaaaaaatacaatggtaa

SEQ ID NO: 411266 - DNA, 20 bp, Artificial Sequence
  chemically synthesized
taaaaaaatacaatggtaag

SEQ ID NO: 411267 - DNA, 20 bp, Artificial Sequence
  chemically synthesized
aaaaaaatacaatggtaagg

SEQ ID NO: 411268 - DNA, 20 bp, Artificial Sequence
  chemically synthesized
atggtaagggggtactttgc

SEQ ID NO: 411269 - DNA, 20 bp, Artificial Sequence
  chemically synthesized
taagggggtactttgcaagt

SEQ ID NO: 411270 - DNA, 20 bp, Artificial Sequence
  chemically synthesized
cttcttaggcctaacttgca

SEQ ID NO: 411271 - DNA, 20 bp, Artificial Sequence
  chemically synthesized
aagggggtactttgcaagtt

SEQ ID NO: 411272 - DNA, 20 bp, Artificial Sequence
  chemically synthesized
gtactttgcaagttaggcct

SEQ ID NO: 411273 - DNA, 20 bp, Artificial Sequence
  chemically synthesized
ctttgcaagttaggcctaag

SEQ ID NO: 411274 - DNA, 20 bp, Artificial Sequence
  chemically synthesized
tttgcaagttaggcctaaga

SEQ ID NO: 411275 - DNA, 20 bp, Artificial Sequence
  chemically synthesized
tgcaagttaggcctaagaag

SEQ ID NO: 411276 - DNA, 20 bp, Artificial Sequence
  chemically synthesized
gggaaatcagtctccttctt

SEQ ID NO: 411277 - DNA, 20 bp, Artificial Sequence
  chemically synthesized
tgggaaatcagtctccttct

SEQ ID NO: 411278 - DNA, 20 bp, Artificial Sequence
  chemically synthesized
aagaaggagactgatttccc

SEQ ID NO: 411279 - DNA, 20 bp, Artificial Sequence
  chemically synthesized
cgtgaacatccttgggaaat

SEQ ID NO: 411280 - DNA, 20 bp, Artificial Sequence
  chemically synthesized
agaaggagactgatttccca

SEQ ID NO: 411281 - DNA, 20 bp, Artificial Sequence
  chemically synthesized
aaatcaacgtgaacatcctt

SEQ ID NO: 411282 - DNA, 20 bp, Artificial Sequence
  chemically synthesized
taaatcaacgtgaacatcct

SEQ ID NO: 411283 - DNA, 20 bp, Artificial Sequence
  chemically synthesized
tgtgcaactagtattttaaa

SEQ ID NO: 411284 - DNA, 20 bp, Artificial Sequence
  chemically synthesized
ttgtgcaactagtattttaa

SEQ ID NO: 411285 - DNA, 20 bp, Artificial Sequence
  chemically synthesized
tttattgccttttaaaatac

SEQ ID NO: 411286 - DNA, 20 bp, Artificial Sequence
  chemically synthesized
ttgtcatttcattgtgcaac

SEQ ID NO: 411287 - DNA, 20 bp, Artificial Sequence
  chemically synthesized
aggaatagtatgtaaattgg

SEQ ID NO: 411288 - DNA, 20 bp, Artificial Sequence
  chemically synthesized
actaggaatagtatgtaaat

SEQ ID NO: 411289 - DNA, 20 bp, Artificial Sequence
  chemically synthesized
gccaatttacatactattcc

SEQ ID NO: 411290 - DNA, 20 bp, Artificial Sequence
  chemically synthesized
tgaaagaatgacactaggaa

SEQ ID NO: 411291 - DNA, 20 bp, Artificial Sequence
  chemically synthesized
aaaattgaaagaatgacact

SEQ ID NO: 411292 - DNA, 20 bp, Artificial Sequence
  chemically synthesized
aaaaattgaaagaatgacac

SEQ ID NO: 411293 - DNA, 20 bp, Artificial Sequence
  chemically synthesized
aattctggttgaaaaattga

SEQ ID NO: 411294 - DNA, 20 bp, Artificial Sequence
  chemically synthesized
cattctttcaatttttcaac

SEQ ID NO: 411295 - DNA, 20 bp, Artificial Sequence
  chemically synthesized
ttttctgtgtatatgaattc

SEQ ID NO: 411296 - DNA, 20 bp, Artificial Sequence
  chemically synthesized
tcaaccagaattcatataca

SEQ ID NO: 411297 - DNA, 20 bp, Artificial Sequence
  chemically synthesized
aggaactcaggaaacaagaa

SEQ ID NO: 411298 - DNA, 20 bp, Artificial Sequence
  chemically synthesized
acatgcttttcttgtttcct

SEQ ID NO: 411299 - DNA, 20 bp, Artificial Sequence
  chemically synthesized
cttgaaggaactcaggaaac

SEQ ID NO: 411300 - DNA, 20 bp, Artificial Sequence
  chemically synthesized
tgttttgcttgaaggaactc

SEQ ID NO: 411301 - DNA, 20 bp, Artificial Sequence
  chemically synthesized
atgttttgcttgaaggaact

SEQ ID NO: 411302 - DNA, 20 bp, Artificial Sequence
  chemically synthesized
cttgtttcctgagttccttc

SEQ ID NO: 411303 - DNA, 20 bp, Artificial Sequence
  chemically synthesized
tagaattatgttttgcttga

SEQ ID NO: 411304 - DNA, 20 bp, Artificial Sequence
  chemically synthesized
atagaattatgttttgcttg

SEQ ID NO: 411305 - DNA, 20 bp, Artificial Sequence
  chemically synthesized
gcaaaacataattctataat

SEQ ID NO: 411306 - DNA, 20 bp, Artificial Sequence
  chemically synthesized
taggctataattgctcatta

SEQ ID NO: 411307 - DNA, 20 bp, Artificial Sequence
  chemically synthesized
aattctataatgagcaatta

SEQ ID NO: 411308 - DNA, 20 bp, Artificial Sequence
  chemically synthesized
tcttcatagcagcaggtgtt

SEQ ID NO: 411309 - DNA, 20 bp, Artificial Sequence
  chemically synthesized
ctcttcatagcagcaggtgt

SEQ ID NO: 411310 - DNA, 20 bp, Artificial Sequence
  chemically synthesized
aaggtcctcttcatagcagc

SEQ ID NO: 411311 - DNA, 20 bp, Artificial Sequence
  chemically synthesized
caaggtcctcttcatagcag

SEQ ID NO: 411312 - DNA, 20 bp, Artificial Sequence
  chemically synthesized
gcctaacacctgctgctatg

SEQ ID NO: 411313 - DNA, 20 bp, Artificial Sequence
  chemically synthesized
ctaacacctgctgctatgaa

SEQ ID NO: 411314 - DNA, 20 bp, Artificial Sequence
  chemically synthesized
tgacaaggtcctcttcatag

SEQ ID NO: 411315 - DNA, 20 bp, Artificial Sequence
  chemically synthesized
taacacctgctgctatgaag

SEQ ID NO: 411316 - DNA, 20 bp, Artificial Sequence
  chemically synthesized
tgttgacaaggtcctcttca

SEQ ID NO: 411317 - DNA, 20 bp, Artificial Sequence
  chemically synthesized
aatttagatagatgttgaca

SEQ ID NO: 411318 - DNA, 20 bp, Artificial Sequence
  chemically synthesized
caatttagatagatgttgac

SEQ ID NO: 411319 - DNA, 20 bp, Artificial Sequence
  chemically synthesized
ctgttgttcttcaatttaga

SEQ ID NO: 411320 - DNA, 20 bp, Artificial Sequence
  chemically synthesized
gtcaacatctatctaaattg

SEQ ID NO: 411321 - DNA, 20 bp, Artificial Sequence
  chemically synthesized
aatgctgttgttcttcaatt

SEQ ID NO: 411322 - DNA, 20 bp, Artificial Sequence
  chemically synthesized
ctatctaaattgaagaacaa

SEQ ID NO: 411323 - DNA, 20 bp, Artificial Sequence
  chemically synthesized
acaacagcattccttgattt

SEQ ID NO: 411324 - DNA, 20 bp, Artificial Sequence
  chemically synthesized
caacagcattccttgatttt

SEQ ID NO: 411325 - DNA, 20 bp, Artificial Sequence
  chemically synthesized
tgctcattttcccaaaatca

SEQ ID NO: 411326 - DNA, 20 bp, Artificial Sequence
  chemically synthesized
ttgctcattttcccaaaatc

SEQ ID NO: 411327 - DNA, 20 bp, Artificial Sequence
  chemically synthesized
ttccttgattttgggaaaat

SEQ ID NO: 411328 - DNA, 20 bp, Artificial Sequence
  chemically synthesized
gggaaaatgagcaataaacg

SEQ ID NO: 411329 - DNA, 20 bp, Artificial Sequence
  chemically synthesized
aataaacgaagtccatttct

SEQ ID NO: 411330 - DNA, 20 bp, Artificial Sequence
  chemically synthesized
tgagtttttctgctaagaaa

SEQ ID NO: 411331 - DNA, 20 bp, Artificial Sequence
  chemically synthesized
aaacgaagtccatttcttag

SEQ ID NO: 411332 - DNA, 20 bp, Artificial Sequence
  chemically synthesized
tgcctatgagtttttctgct

SEQ ID NO: 411333 - DNA, 20 bp, Artificial Sequence
  chemically synthesized
tttcttagcagaaaaactca

SEQ ID NO: 411334 - DNA, 20 bp, Artificial Sequence
  chemically synthesized
ttcttagcagaaaaactcat

SEQ ID NO: 411335 - DNA, 20 bp, Artificial Sequence
  chemically synthesized
ccttggaatacattgcctat

SEQ ID NO: 411336 - DNA, 20 bp, Artificial Sequence
  chemically synthesized
actcataggcaatgtattcc

SEQ ID NO: 411337 - DNA, 20 bp, Artificial Sequence
  chemically synthesized
ctcataggcaatgtattcca

SEQ ID NO: 411338 - DNA, 20 bp, Artificial Sequence
  chemically synthesized
ataggcaatgtattccaagg

SEQ ID NO: 411339 - DNA, 20 bp, Artificial Sequence
  chemically synthesized
gattattctgtgagctacct

SEQ ID NO: 411340 - DNA, 20 bp, Artificial Sequence
  chemically synthesized
atgtattccaaggtagctca

SEQ ID NO: 411341 - DNA, 20 bp, Artificial Sequence
  chemically synthesized
ttaaatcctgattattctgt

SEQ ID NO: 411342 - DNA, 20 bp, Artificial Sequence
  chemically synthesized
aaggtagctcacagaataat

SEQ ID NO: 411343 - DNA, 20 bp, Artificial Sequence
  chemically synthesized
aggtagctcacagaataatc

SEQ ID NO: 411344 - DNA, 20 bp, Artificial Sequence
  chemically synthesized
acagaataatcaggatttaa

SEQ ID NO: 411345 - DNA, 20 bp, Artificial Sequence
  chemically synthesized
taatcaggatttaatagaat

SEQ ID NO: 411346 - DNA, 20 bp, Artificial Sequence
  chemically synthesized
tagattttttaccatcattt

SEQ ID NO: 411347 - DNA, 20 bp, Artificial Sequence
  chemically synthesized
caaaactttctctcaaatga

SEQ ID NO: 411348 - DNA, 20 bp, Artificial Sequence
  chemically synthesized
gattttttaccatcatttga

SEQ ID NO: 411349 - DNA, 20 bp, Artificial Sequence
  chemically synthesized
ttttaccatcatttgagaga

SEQ ID NO: 411350 - DNA, 20 bp, Artificial Sequence
  chemically synthesized
tttgagagaaagttttgctc

SEQ ID NO: 411351 - DNA, 20 bp, Artificial Sequence
  chemically synthesized
ttgagagaaagttttgctct

SEQ ID NO: 411352 - DNA, 20 bp, Artificial Sequence
  chemically synthesized
agaaagttttgctctgggct

SEQ ID NO: 411353 - DNA, 20 bp, Artificial Sequence
  chemically synthesized
taaccataatacttagccca

SEQ ID NO: 411354 - DNA, 20 bp, Artificial Sequence
  chemically synthesized
cttaaccataatacttagcc

SEQ ID NO: 411355 - DNA, 20 bp, Artificial Sequence
  chemically synthesized
ttgctctgggctaagtatta

SEQ ID NO: 411356 - DNA, 20 bp, Artificial Sequence
  chemically synthesized
gattccttaaccataatact

SEQ ID NO: 411357 - DNA, 20 bp, Artificial Sequence
  chemically synthesized
ctgggctaagtattatggtt

SEQ ID NO: 411358 - DNA, 20 bp, Artificial Sequence
  chemically synthesized
tgggctaagtattatggtta

SEQ ID NO: 411359 - DNA, 20 bp, Artificial Sequence
  chemically synthesized
gtattatggttaaggaatcc

SEQ ID NO: 411360 - DNA, 20 bp, Artificial Sequence
  chemically synthesized
aggaattttagtgtttttct

SEQ ID NO: 411361 - DNA, 20 bp, Artificial Sequence
  chemically synthesized
aagaaaaacactaaaattcc

SEQ ID NO: 411362 - DNA, 20 bp, Artificial Sequence
  chemically synthesized
tgtaagggatccaggaattt

SEQ ID NO: 411363 - DNA, 20 bp, Artificial Sequence
  chemically synthesized
atattgcctgtaagggatcc

SEQ ID NO: 411364 - DNA, 20 bp, Artificial Sequence
  chemically synthesized
aatattgcctgtaagggatc

SEQ ID NO: 411365 - DNA, 20 bp, Artificial Sequence
  chemically synthesized
taaaattcctggatccctta

SEQ ID NO: 411366 - DNA, 20 bp, Artificial Sequence
  chemically synthesized
aaaattcctggatcccttac

SEQ ID NO: 411367 - DNA, 20 bp, Artificial Sequence
  chemically synthesized
taagtaaatattgcctgtaa

SEQ ID NO: 411368 - DNA, 20 bp, Artificial Sequence
  chemically synthesized
ttaagtaaatattgcctgta

SEQ ID NO: 411369 - DNA, 20 bp, Artificial Sequence
  chemically synthesized
tttaagtaaatattgcctgt

SEQ ID NO: 411370 - DNA, 20 bp, Artificial Sequence
  chemically synthesized
tttatggatggttttatttt

SEQ ID NO: 411371 - DNA, 20 bp, Artificial Sequence
  chemically synthesized
taaaataaaaccatccataa

SEQ ID NO: 411372 - DNA, 20 bp, Artificial Sequence
  chemically synthesized
tagagaaggacttttatgga

SEQ ID NO: 411373 - DNA, 20 bp, Artificial Sequence
  chemically synthesized
atagtagagaaggactttta

SEQ ID NO: 411374 - DNA, 20 bp, Artificial Sequence
  chemically synthesized
aagagatactatagtagaga

SEQ ID NO: 411375 - DNA, 20 bp, Artificial Sequence
  chemically synthesized
gaagagatactatagtagag

SEQ ID NO: 411376 - DNA, 20 bp, Artificial Sequence
  chemically synthesized
ataaaagtccttctctacta

SEQ ID NO: 411377 - DNA, 20 bp, Artificial Sequence
  chemically synthesized
caggaagagatactatagta

SEQ ID NO: 411378 - DNA, 20 bp, Artificial Sequence
  chemically synthesized
aacaggaagagatactatag

SEQ ID NO: 411379 - DNA, 20 bp, Artificial Sequence
  chemically synthesized
aaaaacaggaagagatacta

SEQ ID NO: 411380 - DNA, 20 bp, Artificial Sequence
  chemically synthesized
tttcataagaaaaacaggaa

SEQ ID NO: 411381 - DNA, 20 bp, Artificial Sequence
  chemically synthesized
tgtttcataagaaaaacagg

SEQ ID NO: 411382 - DNA, 20 bp, Artificial Sequence
  chemically synthesized
tcttgtttcataagaaaaac

SEQ ID NO: 411383 - DNA, 20 bp, Artificial Sequence
  chemically synthesized
ttcttgtttcataagaaaaa

SEQ ID NO: 411384 - DNA, 20 bp, Artificial Sequence
  chemically synthesized
tcctgtttttcttatgaaac

SEQ ID NO: 411385 - DNA, 20 bp, Artificial Sequence
  chemically synthesized
gagcagagttcttgtttcat

SEQ ID NO: 411386 - DNA, 20 bp, Artificial Sequence
  chemically synthesized
atgaaacaagaactctgctc

SEQ ID NO: 411387 - DNA, 20 bp, Artificial Sequence
  chemically synthesized
tttacctttcagcttgagca

SEQ ID NO: 411388 - DNA, 20 bp, Artificial Sequence
  chemically synthesized
tgtttacctttcagcttgag

SEQ ID NO: 411389 - DNA, 20 bp, Artificial Sequence
  chemically synthesized
aagaactctgctcaagctga

SEQ ID NO: 411390 - DNA, 20 bp, Artificial Sequence
  chemically synthesized
atttgtttacctttcagctt

SEQ ID NO: 411391 - DNA, 20 bp, Artificial Sequence
  chemically synthesized
agaactctgctcaagctgaa

SEQ ID NO: 411392 - DNA, 20 bp, Artificial Sequence
  chemically synthesized
tatccgatttgtttaccttt

SEQ ID NO: 411393 - DNA, 20 bp, Artificial Sequence
  chemically synthesized
aagctgaaaggtaaacaaat

SEQ ID NO: 411394 - DNA, 20 bp, Artificial Sequence
  chemically synthesized
tgaaaggtaaacaaatcgga

SEQ ID NO: 411395 - DNA, 20 bp, Artificial Sequence
  chemically synthesized
aaggtaaacaaatcggatag

SEQ ID NO: 411396 - DNA, 20 bp, Artificial Sequence
  chemically synthesized
atcggatagaagcatcattt

SEQ ID NO: 411397 - DNA, 20 bp, Artificial Sequence
  chemically synthesized
tagaagcatcatttgagctc

SEQ ID NO: 411398 - DNA, 20 bp, Artificial Sequence
  chemically synthesized
caagattgttgatatggctt

SEQ ID NO: 411399 - DNA, 20 bp, Artificial Sequence
  chemically synthesized
aatccacaagattgttgata

SEQ ID NO: 411400 - DNA, 20 bp, Artificial Sequence
  chemically synthesized
aagccatatcaacaatcttg

SEQ ID NO: 411401 - DNA, 20 bp, Artificial Sequence
  chemically synthesized
tcctggcaatgtaaatccac

SEQ ID NO: 411402 - DNA, 20 bp, Artificial Sequence
  chemically synthesized
atcttgtggatttacattgc

SEQ ID NO: 411403 - DNA, 20 bp, Artificial Sequence
  chemically synthesized
tcttgtggatttacattgcc

SEQ ID NO: 411404 - DNA, 20 bp, Artificial Sequence
  chemically synthesized
aattttgaaaaaagatttcc

SEQ ID NO: 411405 - DNA, 20 bp, Artificial Sequence
  chemically synthesized
tcccggcataattttgaaaa

SEQ ID NO: 411406 - DNA, 20 bp, Artificial Sequence
  chemically synthesized
atcttttttcaaaattatgc

SEQ ID NO: 411407 - DNA, 20 bp, Artificial Sequence
  chemically synthesized
tcttttttcaaaattatgcc

SEQ ID NO: 411408 - DNA, 20 bp, Artificial Sequence
  chemically synthesized
ttttgttgatgtaattatcc

SEQ ID NO: 411409 - DNA, 20 bp, Artificial Sequence
  chemically synthesized
gataattacatcaacaaaaa

SEQ ID NO: 411410 - DNA, 20 bp, Artificial Sequence
  chemically synthesized
taattacatcaacaaaaatg

SEQ ID NO: 411411 - DNA, 20 bp, Artificial Sequence
  chemically synthesized
aattacatcaacaaaaatgg

SEQ ID NO: 411412 - DNA, 20 bp, Artificial Sequence
  chemically synthesized
tacatcaacaaaaatggagg

SEQ ID NO: 411413 - DNA, 20 bp, Artificial Sequence
  chemically synthesized
aaaaatggaggcagaaatct

SEQ ID NO: 411414 - DNA, 20 bp, Artificial Sequence
  chemically synthesized
catctttttgatattatacc

SEQ ID NO: 411415 - DNA, 20 bp, Artificial Sequence
  chemically synthesized
aatcttggtataatatcaaa

SEQ ID NO: 411416 - DNA, 20 bp, Artificial Sequence
  chemically synthesized
ttggtataatatcaaaaaga

SEQ ID NO: 411417 - DNA, 20 bp, Artificial Sequence
  chemically synthesized
tggtataatatcaaaaagat

SEQ ID NO: 411418 - DNA, 20 bp, Artificial Sequence
  chemically synthesized
ggtataatatcaaaaagatg

SEQ ID NO: 411419 - DNA, 20 bp, Artificial Sequence
  chemically synthesized
gtataatatcaaaaagatgg

SEQ ID NO: 411420 - DNA, 20 bp, Artificial Sequence
  chemically synthesized
taatatcaaaaagatggggg

SEQ ID NO: 411421 - DNA, 20 bp, Artificial Sequence
  chemically synthesized
tcaaaaagatgggggaagaa

SEQ ID NO: 411422 - DNA, 20 bp, Artificial Sequence
  chemically synthesized
caaaaagatgggggaagaat

SEQ ID NO: 411423 - DNA, 20 bp, Artificial Sequence
  chemically synthesized
atgggggaagaataggttgc

SEQ ID NO: 411424 - DNA, 20 bp, Artificial Sequence
  chemically synthesized
gaagaataggttgctggaaa

SEQ ID NO: 411425 - DNA, 20 bp, Artificial Sequence
  chemically synthesized
atctgctagcaggctttttc

SEQ ID NO: 411426 - DNA, 20 bp, Artificial Sequence
  chemically synthesized
ggttgctggaaaaagcctgc

SEQ ID NO: 411427 - DNA, 20 bp, Artificial Sequence
  chemically synthesized
tgctggaaaaagcctgctag

SEQ ID NO: 411428 - DNA, 20 bp, Artificial Sequence
  chemically synthesized
tttctaggcaatctgctagc

SEQ ID NO: 411429 - DNA, 20 bp, Artificial Sequence
  chemically synthesized
ctttctaggcaatctgctag

SEQ ID NO: 411430 - DNA, 20 bp, Artificial Sequence
  chemically synthesized
tttctttctaggcaatctgc

SEQ ID NO: 411431 - DNA, 20 bp, Artificial Sequence
  chemically synthesized
aagcctgctagcagattgcc

SEQ ID NO: 411432 - DNA, 20 bp, Artificial Sequence
  chemically synthesized
ctgctagcagattgcctaga

SEQ ID NO: 411433 - DNA, 20 bp, Artificial Sequence
  chemically synthesized
atggcttcatttttctttct

SEQ ID NO: 411434 - DNA, 20 bp, Artificial Sequence
  chemically synthesized
aatggcttcatttttctttc

SEQ ID NO: 411435 - DNA, 20 bp, Artificial Sequence
  chemically synthesized
attgcctagaaagaaaaatg

SEQ ID NO: 411436 - DNA, 20 bp, Artificial Sequence
  chemically synthesized
gagattttaacatattagaa

SEQ ID NO: 411437 - DNA, 20 bp, Artificial Sequence
  chemically synthesized
tagatgagattttaacatat

SEQ ID NO: 411438 - DNA, 20 bp, Artificial Sequence
  chemically synthesized
atttatttcaatgtttagat

SEQ ID NO: 411439 - DNA, 20 bp, Artificial Sequence
  chemically synthesized
taatcatttatttcaatgtt

SEQ ID NO: 411440 - DNA, 20 bp, Artificial Sequence
  chemically synthesized
aataaatgattattcactta

SEQ ID NO: 411441 - DNA, 20 bp, Artificial Sequence
  chemically synthesized
taaatgattattcacttaca

SEQ ID NO: 411442 - DNA, 20 bp, Artificial Sequence
  chemically synthesized
aacatatctgtttactctgt

SEQ ID NO: 411443 - DNA, 20 bp, Artificial Sequence
  chemically synthesized
ttattcacttacagagtaaa

SEQ ID NO: 411444 - DNA, 20 bp, Artificial Sequence
  chemically synthesized
cagagtaaacagatatgttt

SEQ ID NO: 411445 - DNA, 20 bp, Artificial Sequence
  chemically synthesized
tttaagtgtatttttttacg

SEQ ID NO: 411446 - DNA, 20 bp, Artificial Sequence
  chemically synthesized
tgtgcgtgtacataggcaca

SEQ ID NO: 411447 - DNA, 20 bp, Artificial Sequence
  chemically synthesized
atgtatgtgtgcgtgtacat

SEQ ID NO: 411448 - DNA, 20 bp, Artificial Sequence
  chemically synthesized
tatgtatgtgtgcgtgtaca

SEQ ID NO: 411449 - DNA, 20 bp, Artificial Sequence
  chemically synthesized
atacgtacaagttgacgttc

SEQ ID NO: 411450 - DNA, 20 bp, Artificial Sequence
  chemically synthesized
attgcactattaatacgtac

SEQ ID NO: 411451 - DNA, 20 bp, Artificial Sequence
  chemically synthesized
cgtcaacttgtacgtattaa

SEQ ID NO: 411452 - DNA, 20 bp, Artificial Sequence
  chemically synthesized
agtgcaataaaaaatgttgt

SEQ ID NO: 411453 - DNA, 20 bp, Artificial Sequence
  chemically synthesized
gtgcaataaaaaatgttgtc

SEQ ID NO: 411454 - DNA, 20 bp, Artificial Sequence
  chemically synthesized
tgcaataaaaaatgttgtca

SEQ ID NO: 411455 - DNA, 20 bp, Artificial Sequence
  chemically synthesized
gtcagggatgacttcccctc

SEQ ID NO: 411456 - DNA, 20 bp, Artificial Sequence
  chemically synthesized
tgctgggaatgccagagggg

SEQ ID NO: 411457 - DNA, 20 bp, Artificial Sequence
  chemically synthesized
tagtgctgggaatgccagag

SEQ ID NO: 411458 - DNA, 20 bp, Artificial Sequence
  chemically synthesized
atagtgctgggaatgccaga

SEQ ID NO: 411459 - DNA, 20 bp, Artificial Sequence
  chemically synthesized
catagtgctgggaatgccag

SEQ ID NO: 411460 - DNA, 20 bp, Artificial Sequence
  chemically synthesized
tcatagtgctgggaatgcca

SEQ ID NO: 411461 - DNA, 20 bp, Artificial Sequence
  chemically synthesized
gacttcccctctggcattcc

SEQ ID NO: 411462 - DNA, 20 bp, Artificial Sequence
  chemically synthesized
agtcatagtgctgggaatgc

SEQ ID NO: 411463 - DNA, 20 bp, Artificial Sequence
  chemically synthesized
gagctgtcagtcatagtgct

SEQ ID NO: 411464 - DNA, 20 bp, Artificial Sequence
  chemically synthesized
agagctgtcagtcatagtgc

SEQ ID NO: 411465 - DNA, 20 bp, Artificial Sequence
  chemically synthesized
attcccagcactatgactga

SEQ ID NO: 411466 - DNA, 20 bp, Artificial Sequence
  chemically synthesized
gcagtaagagctgtcagtca

SEQ ID NO: 411467 - DNA, 20 bp, Artificial Sequence
  chemically synthesized
attgatgcagtaagagctgt

SEQ ID NO: 411468 - DNA, 20 bp, Artificial Sequence
  chemically synthesized
ttcttctattgatgcagtaa

SEQ ID NO: 411469 - DNA, 20 bp, Artificial Sequence
  chemically synthesized
aattcttctattgatgcagt

SEQ ID NO: 411470 - DNA, 20 bp, Artificial Sequence
  chemically synthesized
gacagctcttactgcatcaa

SEQ ID NO: 411471 - DNA, 20 bp, Artificial Sequence
  chemically synthesized
atacaattcttctattgatg

SEQ ID NO: 411472 - DNA, 20 bp, Artificial Sequence
  chemically synthesized
agctcttactgcatcaatag

SEQ ID NO: 411473 - DNA, 20 bp, Artificial Sequence
  chemically synthesized
gaagaattgtatttaaacaa

SEQ ID NO: 411474 - DNA, 20 bp, Artificial Sequence
  chemically synthesized
ttgtatttaaacaaaagtta

SEQ ID NO: 411475 - DNA, 20 bp, Artificial Sequence
  chemically synthesized
aaaagttatggtacaattcc

SEQ ID NO: 411476 - DNA, 20 bp, Artificial Sequence
  chemically synthesized
aaagttatggtacaattcct

SEQ ID NO: 411477 - DNA, 20 bp, Artificial Sequence
  chemically synthesized
tgtctattaagcatcaacct

SEQ ID NO: 411478 - DNA, 20 bp, Artificial Sequence
  chemically synthesized
ctgtctattaagcatcaacc

SEQ ID NO: 411479 - DNA, 20 bp, Artificial Sequence
  chemically synthesized
attcctaggttgatgcttaa

SEQ ID NO: 411480 - DNA, 20 bp, Artificial Sequence
  chemically synthesized
ctaggttgatgcttaataga

SEQ ID NO: 411481 - DNA, 20 bp, Artificial Sequence
  chemically synthesized
tgtagtatttactgtctatt

SEQ ID NO: 411482 - DNA, 20 bp, Artificial Sequence
  chemically synthesized
ttaatagacagtaaatacta

SEQ ID NO: 411483 - DNA, 20 bp, Artificial Sequence
  chemically synthesized
taatagacagtaaatactac

SEQ ID NO: 411484 - DNA, 20 bp, Artificial Sequence
  chemically synthesized
aagcttattggtagttcctg

SEQ ID NO: 411485 - DNA, 20 bp, Artificial Sequence
  chemically synthesized
atactacaggaactaccaat

SEQ ID NO: 411486 - DNA, 20 bp, Artificial Sequence
  chemically synthesized
ttaataaggaagcttattgg

SEQ ID NO: 411487 - DNA, 20 bp, Artificial Sequence
  chemically synthesized
tatttaataaggaagcttat

SEQ ID NO: 411488 - DNA, 20 bp, Artificial Sequence
  chemically synthesized
aatacatttatttaataagg

SEQ ID NO: 411489 - DNA, 20 bp, Artificial Sequence
  chemically synthesized
ataaatacatttatttaata

SEQ ID NO: 411490 - DNA, 20 bp, Artificial Sequence
  chemically synthesized
aataaatacatttatttaat

SEQ ID NO: 411491 - DNA, 20 bp, Artificial Sequence
  chemically synthesized
tattcatttgatcttatgta

SEQ ID NO: 411492 - DNA, 20 bp, Artificial Sequence
  chemically synthesized
accttttgtgttctttacat

SEQ ID NO: 411493 - DNA, 20 bp, Artificial Sequence
  chemically synthesized
atcttatgtaaagaacacaa

SEQ ID NO: 411494 - DNA, 20 bp, Artificial Sequence
  chemically synthesized
tcttatgtaaagaacacaaa

SEQ ID NO: 411495 - DNA, 20 bp, Artificial Sequence
  chemically synthesized
gtaaagaacacaaaaggtaa

SEQ ID NO: 411496 - DNA, 20 bp, Artificial Sequence
  chemically synthesized
gtaaaagaaaaaaattaaaa

SEQ ID NO: 411497 - DNA, 20 bp, Artificial Sequence
  chemically synthesized
aaaagaaaaaaattaaaaaa

SEQ ID NO: 411498 - DNA, 20 bp, Artificial Sequence
  chemically synthesized
ttttgtataattaaaaaatc

SEQ ID NO: 411499 - DNA, 20 bp, Artificial Sequence
  chemically synthesized
caaatccaggaagaaggaac

SEQ ID NO: 411500 - DNA, 20 bp, Artificial Sequence
  chemically synthesized
aaaatctagttccttcttcc

SEQ ID NO: 411501 - DNA, 20 bp, Artificial Sequence
  chemically synthesized
atacctcaaatccaggaaga

SEQ ID NO: 411502 - DNA, 20 bp, Artificial Sequence
  chemically synthesized
gatacctcaaatccaggaag

SEQ ID NO: 411503 - DNA, 20 bp, Artificial Sequence
  chemically synthesized
atagatacctcaaatccagg

SEQ ID NO: 411504 - DNA, 20 bp, Artificial Sequence
  chemically synthesized
agttccttcttcctggattt

SEQ ID NO: 411505 - DNA, 20 bp, Artificial Sequence
  chemically synthesized
gttccttcttcctggatttg

SEQ ID NO: 411506 - DNA, 20 bp, Artificial Sequence
  chemically synthesized
gatatagatacctcaaatcc

SEQ ID NO: 411507 - DNA, 20 bp, Artificial Sequence
  chemically synthesized
agatatagatacctcaaatc

SEQ ID NO: 411508 - DNA, 20 bp, Artificial Sequence
  chemically synthesized
gagatggatagatacagata

SEQ ID NO: 411509 - DNA, 20 bp, Artificial Sequence
  chemically synthesized
gagagagagatggatagata

SEQ ID NO: 411510 - DNA, 20 bp, Artificial Sequence
  chemically synthesized
gagagagagagagagatgga

SEQ ID NO: 411511 - DNA, 20 bp, Artificial Sequence
  chemically synthesized
gagagagagagagagagaga

SEQ ID NO: 411512 - DNA, 20 bp, Artificial Sequence
  chemically synthesized
gagagagagagagagagaga

SEQ ID NO: 411513 - DNA, 20 bp, Artificial Sequence
  chemically synthesized
gagagagagagagagagaga

SEQ ID NO: 411514 - DNA, 20 bp, Artificial Sequence
  chemically synthesized
gagagagagagagagagaga

SEQ ID NO: 411515 - DNA, 20 bp, Artificial Sequence
  chemically synthesized
gagagagagagagagagaga

SEQ ID NO: 411516 - DNA, 20 bp, Artificial Sequence
  chemically synthesized
gagagagagagagagagaga

SEQ ID NO: 411517 - DNA, 20 bp, Artificial Sequence
  chemically synthesized
gagagagagagagagagaga

SEQ ID NO: 411518 - DNA, 20 bp, Artificial Sequence
  chemically synthesized
tagagagagagagagagaga

SEQ ID NO: 411519 - DNA, 20 bp, Artificial Sequence
  chemically synthesized
tatagagagagagagagaga

SEQ ID NO: 411520 - DNA, 20 bp, Artificial Sequence
  chemically synthesized
tatatagagagagagagaga

SEQ ID NO: 411521 - DNA, 20 bp, Artificial Sequence
  chemically synthesized
tatatatagagagagagaga

SEQ ID NO: 411522 - DNA, 20 bp, Artificial Sequence
  chemically synthesized
tatatatatagagagagaga

SEQ ID NO: 411523 - DNA, 20 bp, Artificial Sequence
  chemically synthesized
tatatatatatagagagaga

SEQ ID NO: 411524 - DNA, 20 bp, Artificial Sequence
  chemically synthesized
tatatatatatatagagaga

SEQ ID NO: 411525 - DNA, 20 bp, Artificial Sequence
  chemically synthesized
tatatatatatatatagaga

SEQ ID NO: 411526 - DNA, 20 bp, Artificial Sequence
  chemically synthesized
tatatatatatatatataga

SEQ ID NO: 411527 - DNA, 20 bp, Artificial Sequence
  chemically synthesized
tatatatatatatatatata

SEQ ID NO: 411528 - DNA, 20 bp, Artificial Sequence
  chemically synthesized
tatatatatatatatatata

SEQ ID NO: 411529 - DNA, 20 bp, Artificial Sequence
  chemically synthesized
aaacattatcaatattgata

SEQ ID NO: 411530 - DNA, 20 bp, Artificial Sequence
  chemically synthesized
aattctttatttaagaagta

SEQ ID NO: 411531 - DNA, 20 bp, Artificial Sequence
  chemically synthesized
taggtaattctttatttaag

SEQ ID NO: 411532 - DNA, 20 bp, Artificial Sequence
  chemically synthesized
gtttctttacttcttaaata

SEQ ID NO: 411533 - DNA, 20 bp, Artificial Sequence
  chemically synthesized
gcttaggtaattctttattt

SEQ ID NO: 411534 - DNA, 20 bp, Artificial Sequence
  chemically synthesized
tcttaaataaagaattacct

SEQ ID NO: 411535 - DNA, 20 bp, Artificial Sequence
  chemically synthesized
ccgcttgaaaaaagatgctt

SEQ ID NO: 411536 - DNA, 20 bp, Artificial Sequence
  chemically synthesized
cccgcttgaaaaaagatgct

SEQ ID NO: 411537 - DNA, 20 bp, Artificial Sequence
  chemically synthesized
ttacctaagcatcttttttc

SEQ ID NO: 411538 - DNA, 20 bp, Artificial Sequence
  chemically synthesized
ttcattctcccgcttgaaaa

SEQ ID NO: 411539 - DNA, 20 bp, Artificial Sequence
  chemically synthesized
cctaagcatcttttttcaag

SEQ ID NO: 411540 - DNA, 20 bp, Artificial Sequence
  chemically synthesized
ctaagcatcttttttcaagc

SEQ ID NO: 411541 - DNA, 20 bp, Artificial Sequence
  chemically synthesized
aagcatcttttttcaagcgg

SEQ ID NO: 411542 - DNA, 20 bp, Artificial Sequence
  chemically synthesized
aatgaaaacacaattattct

SEQ ID NO: 411543 - DNA, 20 bp, Artificial Sequence
  chemically synthesized
aaaacacaattattctaaga

SEQ ID NO: 411544 - DNA, 20 bp, Artificial Sequence
  chemically synthesized
cttgtcaatattcgccatct

SEQ ID NO: 411545 - DNA, 20 bp, Artificial Sequence
  chemically synthesized
ctaagatggcgaatattgac

SEQ ID NO: 411546 - DNA, 20 bp, Artificial Sequence
  chemically synthesized
taagatggcgaatattgaca

SEQ ID NO: 411547 - DNA, 20 bp, Artificial Sequence
  chemically synthesized
aagatggcgaatattgacaa

SEQ ID NO: 411548 - DNA, 20 bp, Artificial Sequence
  chemically synthesized
atattgacaagggaatgaaa

SEQ ID NO: 411549 - DNA, 20 bp, Artificial Sequence
  chemically synthesized
acaagggaatgaaatggtga

SEQ ID NO: 411550 - DNA, 20 bp, Artificial Sequence
  chemically synthesized
atggtgaaagcaaatctatc

SEQ ID NO: 411551 - DNA, 20 bp, Artificial Sequence
  chemically synthesized
agggggcccttttttctaga

SEQ ID NO: 411552 - DNA, 20 bp, Artificial Sequence
  chemically synthesized
aagcaaatctatctagaaaa

SEQ ID NO: 411553 - DNA, 20 bp, Artificial Sequence
  chemically synthesized
agcaaatctatctagaaaaa

SEQ ID NO: 411554 - DNA, 20 bp, Artificial Sequence
  chemically synthesized
gcaaatctatctagaaaaaa

SEQ ID NO: 411555 - DNA, 20 bp, Artificial Sequence
  chemically synthesized
gctaagggggcccttttttc

SEQ ID NO: 411556 - DNA, 20 bp, Artificial Sequence
  chemically synthesized
tctagaaaaaagggccccct

SEQ ID NO: 411557 - DNA, 20 bp, Artificial Sequence
  chemically synthesized
tctattcattcaggctaagg

SEQ ID NO: 411558 - DNA, 20 bp, Artificial Sequence
  chemically synthesized
gtctattcattcaggctaag

SEQ ID NO: 411559 - DNA, 20 bp, Artificial Sequence
  chemically synthesized
ggtctattcattcaggctaa

SEQ ID NO: 411560 - DNA, 20 bp, Artificial Sequence
  chemically synthesized
tggtctattcattcaggcta

SEQ ID NO: 411561 - DNA, 20 bp, Artificial Sequence
  chemically synthesized
ctggtctattcattcaggct

SEQ ID NO: 411562 - DNA, 20 bp, Artificial Sequence
  chemically synthesized
gcccccttagcctgaatgaa

SEQ ID NO: 411563 - DNA, 20 bp, Artificial Sequence
  chemically synthesized
attcactggtctattcattc

SEQ ID NO: 411564 - DNA, 20 bp, Artificial Sequence
  chemically synthesized
cattcactggtctattcatt

SEQ ID NO: 411565 - DNA, 20 bp, Artificial Sequence
  chemically synthesized
cttagcctgaatgaatagac

SEQ ID NO: 411566 - DNA, 20 bp, Artificial Sequence
  chemically synthesized
gaatgaatagaccagtgaat

SEQ ID NO: 411567 - DNA, 20 bp, Artificial Sequence
  chemically synthesized
aatgaatagaccagtgaatg

SEQ ID NO: 411568 - DNA, 20 bp, Artificial Sequence
  chemically synthesized
cattttgtttcctcattcac

SEQ ID NO: 411569 - DNA, 20 bp, Artificial Sequence
  chemically synthesized
ggaaacaaaatgattaaatc

SEQ ID NO: 411570 - DNA, 20 bp, Artificial Sequence
  chemically synthesized
gattaaatcaagtcttttga

SEQ ID NO: 411571 - DNA, 20 bp, Artificial Sequence
  chemically synthesized
caataatgctgtgctttcaa

SEQ ID NO: 411572 - DNA, 20 bp, Artificial Sequence
  chemically synthesized
aatcaagtcttttgaaagca

SEQ ID NO: 411573 - DNA, 20 bp, Artificial Sequence
  chemically synthesized
tgaaagcacagcattattgt

SEQ ID NO: 411574 - DNA, 20 bp, Artificial Sequence
  chemically synthesized
ttattgtgagacatattgta

SEQ ID NO: 411575 - DNA, 20 bp, Artificial Sequence
  chemically synthesized
acatattgtaaagatctgtg

SEQ ID NO: 411576 - DNA, 20 bp, Artificial Sequence
  chemically synthesized
ggaagggcagaatagctgca

SEQ ID NO: 411577 - DNA, 20 bp, Artificial Sequence
  chemically synthesized
agtatgtaggaagggcagaa

SEQ ID NO: 411578 - DNA, 20 bp, Artificial Sequence
  chemically synthesized
caatgagtatgtaggaaggg

SEQ ID NO: 411579 - DNA, 20 bp, Artificial Sequence
  chemically synthesized
gagcaatgagtatgtaggaa

SEQ ID NO: 411580 - DNA, 20 bp, Artificial Sequence
  chemically synthesized
agagcaatgagtatgtagga

SEQ ID NO: 411581 - DNA, 20 bp, Artificial Sequence
  chemically synthesized
gagagcaatgagtatgtagg

SEQ ID NO: 411582 - DNA, 20 bp, Artificial Sequence
  chemically synthesized
atagagagcaatgagtatgt

SEQ ID NO: 411583 - DNA, 20 bp, Artificial Sequence
  chemically synthesized
aatagagagcaatgagtatg

SEQ ID NO: 411584 - DNA, 20 bp, Artificial Sequence
  chemically synthesized
tttgtataatagagagcaat

SEQ ID NO: 411585 - DNA, 20 bp, Artificial Sequence
  chemically synthesized
ttccttctttgtataataga

SEQ ID NO: 411586 - DNA, 20 bp, Artificial Sequence
  chemically synthesized
tgttccttctttgtataata

SEQ ID NO: 411587 - DNA, 20 bp, Artificial Sequence
  chemically synthesized
tcattgctctctattataca

SEQ ID NO: 411588 - DNA, 20 bp, Artificial Sequence
  chemically synthesized
tgtgttccttctttgtataa

SEQ ID NO: 411589 - DNA, 20 bp, Artificial Sequence
  chemically synthesized
ttgctctctattatacaaag

SEQ ID NO: 411590 - DNA, 20 bp, Artificial Sequence
  chemically synthesized
tgctctctattatacaaaga

SEQ ID NO: 411591 - DNA, 20 bp, Artificial Sequence
  chemically synthesized
tattatacaaagaaggaaca

SEQ ID NO: 411592 - DNA, 20 bp, Artificial Sequence
  chemically synthesized
ttatacaaagaaggaacaca

SEQ ID NO: 411593 - DNA, 20 bp, Artificial Sequence
  chemically synthesized
caaagaaggaacacagagaa

SEQ ID NO: 411594 - DNA, 20 bp, Artificial Sequence
  chemically synthesized
agaaaagaacattatacttg

SEQ ID NO: 411595 - DNA, 20 bp, Artificial Sequence
  chemically synthesized
aagaacattatacttgaagt

SEQ ID NO: 411596 - DNA, 20 bp, Artificial Sequence
  chemically synthesized
aacccaggtattctaacttc

SEQ ID NO: 411597 - DNA, 20 bp, Artificial Sequence
  chemically synthesized
atacttgaagttagaatacc

SEQ ID NO: 411598 - DNA, 20 bp, Artificial Sequence
  chemically synthesized
tacttgaagttagaatacct

SEQ ID NO: 411599 - DNA, 20 bp, Artificial Sequence
  chemically synthesized
aagttagaatacctgggttt

SEQ ID NO: 411600 - DNA, 20 bp, Artificial Sequence
  chemically synthesized
ataaagtcacactcaaaccc

SEQ ID NO: 411601 - DNA, 20 bp, Artificial Sequence
  chemically synthesized
gataaagtcacactcaaacc

SEQ ID NO: 411602 - DNA, 20 bp, Artificial Sequence
  chemically synthesized
cacataattagtaagtgata

SEQ ID NO: 411603 - DNA, 20 bp, Artificial Sequence
  chemically synthesized
ttcaagatcacataattagt

SEQ ID NO: 411604 - DNA, 20 bp, Artificial Sequence
  chemically synthesized
cttgttcaagatcacataat

SEQ ID NO: 411605 - DNA, 20 bp, Artificial Sequence
  chemically synthesized
ctaattatgtgatcttgaac

SEQ ID NO: 411606 - DNA, 20 bp, Artificial Sequence
  chemically synthesized
agaggttgagtaacttgttc

SEQ ID NO: 411607 - DNA, 20 bp, Artificial Sequence
  chemically synthesized
aaactgagcacaaagaggtt

SEQ ID NO: 411608 - DNA, 20 bp, Artificial Sequence
  chemically synthesized
aaaggaaactgagcacaaag

SEQ ID NO: 411609 - DNA, 20 bp, Artificial Sequence
  chemically synthesized
aaaaggaaactgagcacaaa

SEQ ID NO: 411610 - DNA, 20 bp, Artificial Sequence
  chemically synthesized
ttactcaacctctttgtgct

SEQ ID NO: 411611 - DNA, 20 bp, Artificial Sequence
  chemically synthesized
agaaaaggaaactgagcaca

SEQ ID NO: 411612 - DNA, 20 bp, Artificial Sequence
  chemically synthesized
attttttagaaaaggaaact

SEQ ID NO: 411613 - DNA, 20 bp, Artificial Sequence
  chemically synthesized
gtatgtccattttttagaaa

SEQ ID NO: 411614 - DNA, 20 bp, Artificial Sequence
  chemically synthesized
tgtatgtccattttttagaa

SEQ ID NO: 411615 - DNA, 20 bp, Artificial Sequence
  chemically synthesized
cagtttccttttctaaaaaa

SEQ ID NO: 411616 - DNA, 20 bp, Artificial Sequence
  chemically synthesized
cggcctgtatgtccattttt

SEQ ID NO: 411617 - DNA, 20 bp, Artificial Sequence
  chemically synthesized
ttttctaaaaaatggacata

SEQ ID NO: 411618 - DNA, 20 bp, Artificial Sequence
  chemically synthesized
tttctaaaaaatggacatac

SEQ ID NO: 411619 - DNA, 20 bp, Artificial Sequence
  chemically synthesized
taaaaaatggacatacaggc

SEQ ID NO: 411620 - DNA, 20 bp, Artificial Sequence
  chemically synthesized
atggacatacaggccggact

SEQ ID NO: 411621 - DNA, 20 bp, Artificial Sequence
  chemically synthesized
gacatacaggccggacttgg

SEQ ID NO: 411622 - DNA, 20 bp, Artificial Sequence
  chemically synthesized
caggtgtgagccaccaagtc

SEQ ID NO: 411623 - DNA, 20 bp, Artificial Sequence
  chemically synthesized
gattacaggtgtgagccacc

SEQ ID NO: 411624 - DNA, 20 bp, Artificial Sequence
  chemically synthesized
agtgctgggattacaggtgt

SEQ ID NO: 411625 - DNA, 20 bp, Artificial Sequence
  chemically synthesized
gtggctcacacctgtaatcc

SEQ ID NO: 411626 - DNA, 20 bp, Artificial Sequence
  chemically synthesized
tcccaaagtgctgggattac

SEQ ID NO: 411627 - DNA, 20 bp, Artificial Sequence
  chemically synthesized
ctcccaaagtgctgggatta

SEQ ID NO: 411628 - DNA, 20 bp, Artificial Sequence
  chemically synthesized
cacctgtaatcccagcactt

SEQ ID NO: 411629 - DNA, 20 bp, Artificial Sequence
  chemically synthesized
cctcggcctcccaaagtgct

SEQ ID NO: 411630 - DNA, 20 bp, Artificial Sequence
  chemically synthesized
acctgtaatcccagcacttt

SEQ ID NO: 411631 - DNA, 20 bp, Artificial Sequence
  chemically synthesized
acctcggcctcccaaagtgc

SEQ ID NO: 411632 - DNA, 20 bp, Artificial Sequence
  chemically synthesized
ctgtaatcccagcactttgg

SEQ ID NO: 411633 - DNA, 20 bp, Artificial Sequence
  chemically synthesized
tgtaatcccagcactttggg

SEQ ID NO: 411634 - DNA, 20 bp, Artificial Sequence
  chemically synthesized
tctgccacctcggcctccca

SEQ ID NO: 411635 - DNA, 20 bp, Artificial Sequence
  chemically synthesized
tcccagcactttgggaggcc

SEQ ID NO: 411636 - DNA, 20 bp, Artificial Sequence
  chemically synthesized
cccagcactttgggaggccg

SEQ ID NO: 411637 - DNA, 20 bp, Artificial Sequence
  chemically synthesized
agcactttgggaggccgagg

SEQ ID NO: 411638 - DNA, 20 bp, Artificial Sequence
  chemically synthesized
actttgggaggccgaggtgg

SEQ ID NO: 411639 - DNA, 20 bp, Artificial Sequence
  chemically synthesized
cctcaagtcatctgccacct

SEQ ID NO: 411640 - DNA, 20 bp, Artificial Sequence
  chemically synthesized
gccgaggtggcagatgactt

SEQ ID NO: 411641 - DNA, 20 bp, Artificial Sequence
  chemically synthesized
ccgaggtggcagatgacttg

SEQ ID NO: 411642 - DNA, 20 bp, Artificial Sequence
  chemically synthesized
ggtggcagatgacttgaggc

SEQ ID NO: 411643 - DNA, 20 bp, Artificial Sequence
  chemically synthesized
gtggcagatgacttgaggcc

SEQ ID NO: 411644 - DNA, 20 bp, Artificial Sequence
  chemically synthesized
tgttttgaactcctggcctc

SEQ ID NO: 411645 - DNA, 20 bp, Artificial Sequence
  chemically synthesized
ggcagatgacttgaggccag

SEQ ID NO: 411646 - DNA, 20 bp, Artificial Sequence
  chemically synthesized
ccaggcttgttttgaactcc

SEQ ID NO: 411647 - DNA, 20 bp, Artificial Sequence
  chemically synthesized
tgaggccaggagttcaaaac

SEQ ID NO: 411648 - DNA, 20 bp, Artificial Sequence
  chemically synthesized
ccaggagttcaaaacaagcc

SEQ ID NO: 411649 - DNA, 20 bp, Artificial Sequence
  chemically synthesized
ggggtttcaccatgttggcc

SEQ ID NO: 411650 - DNA, 20 bp, Artificial Sequence
  chemically synthesized
caaaacaagcctggccaaca

SEQ ID NO: 411651 - DNA, 20 bp, Artificial Sequence
  chemically synthesized
cggggtttcaccatgttggc

SEQ ID NO: 411652 - DNA, 20 bp, Artificial Sequence
  chemically synthesized
gaaacggggtttcaccatgt

SEQ ID NO: 411653 - DNA, 20 bp, Artificial Sequence
  chemically synthesized
ttgtatttttagtggaaacg

SEQ ID NO: 411654 - DNA, 20 bp, Artificial Sequence
  chemically synthesized
tttgtatttttagtggaaac

SEQ ID NO: 411655 - DNA, 20 bp, Artificial Sequence
  chemically synthesized
ttttgtatttttagtggaaa

SEQ ID NO: 411656 - DNA, 20 bp, Artificial Sequence
  chemically synthesized
gctaatttttgtatttttag

SEQ ID NO: 411657 - DNA, 20 bp, Artificial Sequence
  chemically synthesized
ttggctaatttttgtatttt

SEQ ID NO: 411658 - DNA, 20 bp, Artificial Sequence
  chemically synthesized
tccactaaaaatacaaaaat

SEQ ID NO: 411659 - DNA, 20 bp, Artificial Sequence
  chemically synthesized
taaaaatacaaaaattagcc

SEQ ID NO: 411660 - DNA, 20 bp, Artificial Sequence
  chemically synthesized
atacaaaaattagccaagtg

SEQ ID NO: 411661 - DNA, 20 bp, Artificial Sequence
  chemically synthesized
caaaaattagccaagtgtgg

SEQ ID NO: 411662 - DNA, 20 bp, Artificial Sequence
  chemically synthesized
caggcatgtgccaccacact

SEQ ID NO: 411663 - DNA, 20 bp, Artificial Sequence
  chemically synthesized
agtgtggtggcacatgcctg

SEQ ID NO: 411664 - DNA, 20 bp, Artificial Sequence
  chemically synthesized
gtggcacatgcctgtagtcc

SEQ ID NO: 411665 - DNA, 20 bp, Artificial Sequence
  chemically synthesized
tcccagatagctgggactac

SEQ ID NO: 411666 - DNA, 20 bp, Artificial Sequence
  chemically synthesized
ctcccagatagctgggacta

SEQ ID NO: 411667 - DNA, 20 bp, Artificial Sequence
  chemically synthesized
tgcctgtagtcccagctatc

SEQ ID NO: 411668 - DNA, 20 bp, Artificial Sequence
  chemically synthesized
ccactgcctcccagatagct

SEQ ID NO: 411669 - DNA, 20 bp, Artificial Sequence
  chemically synthesized
gcctgtagtcccagctatct

SEQ ID NO: 411670 - DNA, 20 bp, Artificial Sequence
  chemically synthesized
accactgcctcccagatagc

SEQ ID NO: 411671 - DNA, 20 bp, Artificial Sequence
  chemically synthesized
ctgtagtcccagctatctgg

SEQ ID NO: 411672 - DNA, 20 bp, Artificial Sequence
  chemically synthesized
tgtagtcccagctatctggg

SEQ ID NO: 411673 - DNA, 20 bp, Artificial Sequence
  chemically synthesized
tgcaaccactgcctcccaga

SEQ ID NO: 411674 - DNA, 20 bp, Artificial Sequence
  chemically synthesized
agtcccagctatctgggagg

SEQ ID NO: 411675 - DNA, 20 bp, Artificial Sequence
  chemically synthesized
tcactgcaaccactgcctcc

SEQ ID NO: 411676 - DNA, 20 bp, Artificial Sequence
  chemically synthesized
cccagctatctgggaggcag

SEQ ID NO: 411677 - DNA, 20 bp, Artificial Sequence
  chemically synthesized
tatctgggaggcagtggttg

SEQ ID NO: 411678 - DNA, 20 bp, Artificial Sequence
  chemically synthesized
tgggaggcagtggttgcagt

SEQ ID NO: 411679 - DNA, 20 bp, Artificial Sequence
  chemically synthesized
ggcagtggttgcagtgagct

SEQ ID NO: 411680 - DNA, 20 bp, Artificial Sequence
  chemically synthesized
ggagtgaagtggcgtgatct

SEQ ID NO: 411681 - DNA, 20 bp, Artificial Sequence
  chemically synthesized
ttgcccaggctggagtgaag

SEQ ID NO: 411682 - DNA, 20 bp, Artificial Sequence
  chemically synthesized
gagatcacgccacttcactc

SEQ ID NO: 411683 - DNA, 20 bp, Artificial Sequence
  chemically synthesized
ctgttgcccaggctggagtg

SEQ ID NO: 411684 - DNA, 20 bp, Artificial Sequence
  chemically synthesized
cacgccacttcactccagcc

SEQ ID NO: 411685 - DNA, 20 bp, Artificial Sequence
  chemically synthesized
acgccacttcactccagcct

SEQ ID NO: 411686 - DNA, 20 bp, Artificial Sequence
  chemically synthesized
tcactctgttgcccaggctg

SEQ ID NO: 411687 - DNA, 20 bp, Artificial Sequence
  chemically synthesized
tctcactctgttgcccaggc

SEQ ID NO: 411688 - DNA, 20 bp, Artificial Sequence
  chemically synthesized
cttcactccagcctgggcaa

SEQ ID NO: 411689 - DNA, 20 bp, Artificial Sequence
  chemically synthesized
agagtctcactctgttgccc

SEQ ID NO: 411690 - DNA, 20 bp, Artificial Sequence
  chemically synthesized
tcactccagcctgggcaaca

SEQ ID NO: 411691 - DNA, 20 bp, Artificial Sequence
  chemically synthesized
cagagtctcactctgttgcc

SEQ ID NO: 411692 - DNA, 20 bp, Artificial Sequence
  chemically synthesized
tccagcctgggcaacagagt

SEQ ID NO: 411693 - DNA, 20 bp, Artificial Sequence
  chemically synthesized
ttttttttttaatcaggaca

SEQ ID NO: 411694 - DNA, 20 bp, Artificial Sequence
  chemically synthesized
ttttttttttttaatcagga

SEQ ID NO: 411695 - DNA, 20 bp, Artificial Sequence
  chemically synthesized
ttttttttttttttttaatc

SEQ ID NO: 411696 - DNA, 20 bp, Artificial Sequence
  chemically synthesized
tttttttttttttttttaat

SEQ ID NO: 411697 - DNA, 20 bp, Artificial Sequence
  chemically synthesized
ttaaaaaaaaaaaaaaaaaa

SEQ ID NO: 411698 - DNA, 20 bp, Artificial Sequence
  chemically synthesized
taaaaaaaaaaaaaaaaaaa

SEQ ID NO: 411699 - DNA, 20 bp, Artificial Sequence
  chemically synthesized
aaaaaggatatacaaatatc

SEQ ID NO: 411700 - DNA, 20 bp, Artificial Sequence
  chemically synthesized
aaaaggatatacaaatatcc

SEQ ID NO: 411701 - DNA, 20 bp, Artificial Sequence
  chemically synthesized
aaaggatatacaaatatcca

SEQ ID NO: 411702 - DNA, 20 bp, Artificial Sequence
  chemically synthesized
tctgaatctccaattagccc

SEQ ID NO: 411703 - DNA, 20 bp, Artificial Sequence
  chemically synthesized
tacaaatatccagggctaat

SEQ ID NO: 411704 - DNA, 20 bp, Artificial Sequence
  chemically synthesized
caaatatccagggctaattg

SEQ ID NO: 411705 - DNA, 20 bp, Artificial Sequence
  chemically synthesized
atcaaatctgaatctccaat

SEQ ID NO: 411706 - DNA, 20 bp, Artificial Sequence
  chemically synthesized
tccagggctaattggagatt

SEQ ID NO: 411707 - DNA, 20 bp, Artificial Sequence
  chemically synthesized
gattcagatttgataatgca

SEQ ID NO: 411708 - DNA, 20 bp, Artificial Sequence
  chemically synthesized
attcagatttgataatgcat

SEQ ID NO: 411709 - DNA, 20 bp, Artificial Sequence
  chemically synthesized
agatttgataatgcatagga

SEQ ID NO: 411710 - DNA, 20 bp, Artificial Sequence
  chemically synthesized
ataatgcataggaaagatcc

SEQ ID NO: 411711 - DNA, 20 bp, Artificial Sequence
  chemically synthesized
aaggtgtcttatagtgtact

SEQ ID NO: 411712 - DNA, 20 bp, Artificial Sequence
  chemically synthesized
taaggtgtcttatagtgtac

SEQ ID NO: 411713 - DNA, 20 bp, Artificial Sequence
  chemically synthesized
gaaagatcctagtacactat

SEQ ID NO: 411714 - DNA, 20 bp, Artificial Sequence
  chemically synthesized
tataaatgtaaggtgtctta

SEQ ID NO: 411715 - DNA, 20 bp, Artificial Sequence
  chemically synthesized
tatactactttataaatgta

SEQ ID NO: 411716 - DNA, 20 bp, Artificial Sequence
  chemically synthesized
ttatactactttataaatgt

SEQ ID NO: 411717 - DNA, 20 bp, Artificial Sequence
  chemically synthesized
taagacaccttacatttata

SEQ ID NO: 411718 - DNA, 20 bp, Artificial Sequence
  chemically synthesized
gacaccttacatttataaag

SEQ ID NO: 411719 - DNA, 20 bp, Artificial Sequence
  chemically synthesized
gatgtaataataatggtatg

SEQ ID NO: 411720 - DNA, 20 bp, Artificial Sequence
  chemically synthesized
tcactatgatgtaataataa

SEQ ID NO: 411721 - DNA, 20 bp, Artificial Sequence
  chemically synthesized
ataccattattattacatca

SEQ ID NO: 411722 - DNA, 20 bp, Artificial Sequence
  chemically synthesized
agtgaaaaaatacaacttac

SEQ ID NO: 411723 - DNA, 20 bp, Artificial Sequence
  chemically synthesized
tgaaaaaatacaacttacaa

SEQ ID NO: 411724 - DNA, 20 bp, Artificial Sequence
  chemically synthesized
aagctcagctgaactcttgt

SEQ ID NO: 411725 - DNA, 20 bp, Artificial Sequence
  chemically synthesized
aaatacaacttacaagagtt

SEQ ID NO: 411726 - DNA, 20 bp, Artificial Sequence
  chemically synthesized
caacttacaagagttcagct

SEQ ID NO: 411727 - DNA, 20 bp, Artificial Sequence
  chemically synthesized
caagagttcagctgagctta

SEQ ID NO: 411728 - DNA, 20 bp, Artificial Sequence
  chemically synthesized
atgaatatattctttaagct

SEQ ID NO: 411729 - DNA, 20 bp, Artificial Sequence
  chemically synthesized
ttcaaatgaatatattcttt

SEQ ID NO: 411730 - DNA, 20 bp, Artificial Sequence
  chemically synthesized
ttaaagaatatattcatttg

SEQ ID NO: 411731 - DNA, 20 bp, Artificial Sequence
  chemically synthesized
aagctcacacaacaatgatt

SEQ ID NO: 411732 - DNA, 20 bp, Artificial Sequence
  chemically synthesized
gaagctcacacaacaatgat

SEQ ID NO: 411733 - DNA, 20 bp, Artificial Sequence
  chemically synthesized
aagcccaatcattgttgtgt

SEQ ID NO: 411734 - DNA, 20 bp, Artificial Sequence
  chemically synthesized
tgaaataagataatatgaag

SEQ ID NO: 411735 - DNA, 20 bp, Artificial Sequence
  chemically synthesized
aattgaaataagataatatg

SEQ ID NO: 411736 - DNA, 20 bp, Artificial Sequence
  chemically synthesized
aaaagcataataattgaaat

SEQ ID NO: 411737 - DNA, 20 bp, Artificial Sequence
  chemically synthesized
caattattatgcttttatct

SEQ ID NO: 411738 - DNA, 20 bp, Artificial Sequence
  chemically synthesized
ataattagagtctaagataa

SEQ ID NO: 411739 - DNA, 20 bp, Artificial Sequence
  chemically synthesized
tggatatataattagagtct

SEQ ID NO: 411740 - DNA, 20 bp, Artificial Sequence
  chemically synthesized
taaaactggatatataatta

SEQ ID NO: 411741 - DNA, 20 bp, Artificial Sequence
  chemically synthesized
agtaaaactggatatataat

SEQ ID NO: 411742 - DNA, 20 bp, Artificial Sequence
  chemically synthesized
ttagactctaattatatatc

SEQ ID NO: 411743 - DNA, 20 bp, Artificial Sequence
  chemically synthesized
tttaatggcgtaagtaaaac

SEQ ID NO: 411744 - DNA, 20 bp, Artificial Sequence
  chemically synthesized
taaaattcatttaatggcgt

SEQ ID NO: 411745 - DNA, 20 bp, Artificial Sequence
  chemically synthesized
tccttttaaaattcatttaa

SEQ ID NO: 411746 - DNA, 20 bp, Artificial Sequence
  chemically synthesized
cgccattaaatgaattttaa

SEQ ID NO: 411747 - DNA, 20 bp, Artificial Sequence
  chemically synthesized
gccattaaatgaattttaaa

SEQ ID NO: 411748 - DNA, 20 bp, Artificial Sequence
  chemically synthesized
cattaaatgaattttaaaag

SEQ ID NO: 411749 - DNA, 20 bp, Artificial Sequence
  chemically synthesized
aaaaggagtcacattaaata

SEQ ID NO: 411750 - DNA, 20 bp, Artificial Sequence
  chemically synthesized
aaaggagtcacattaaataa

SEQ ID NO: 411751 - DNA, 20 bp, Artificial Sequence
  chemically synthesized
tatctcataaaaaatttaaa

SEQ ID NO: 411752 - DNA, 20 bp, Artificial Sequence
  chemically synthesized
ttatctcataaaaaatttaa

SEQ ID NO: 411753 - DNA, 20 bp, Artificial Sequence
  chemically synthesized
tttatctcataaaaaattta

SEQ ID NO: 411754 - DNA, 20 bp, Artificial Sequence
  chemically synthesized
aggccctttaaattttttat

SEQ ID NO: 411755 - DNA, 20 bp, Artificial Sequence
  chemically synthesized
tttaaattttttatgagata

SEQ ID NO: 411756 - DNA, 20 bp, Artificial Sequence
  chemically synthesized
taaattttttatgagataaa

SEQ ID NO: 411757 - DNA, 20 bp, Artificial Sequence
  chemically synthesized
tatgagataaagagttgcca

SEQ ID NO: 411758 - DNA, 20 bp, Artificial Sequence
  chemically synthesized
gatgcaaaagagtgtgtcta

SEQ ID NO: 411759 - DNA, 20 bp, Artificial Sequence
  chemically synthesized
gtaccgggtaagatgcaaaa

SEQ ID NO: 411760 - DNA, 20 bp, Artificial Sequence
  chemically synthesized
ctgtaccgggtaagatgcaa

SEQ ID NO: 411761 - DNA, 20 bp, Artificial Sequence
  chemically synthesized
acactcttttgcatcttacc

SEQ ID NO: 411762 - DNA, 20 bp, Artificial Sequence
  chemically synthesized
tgagtttgactgtaccgggt

SEQ ID NO: 411763 - DNA, 20 bp, Artificial Sequence
  chemically synthesized
cttttgcatcttacccggta

SEQ ID NO: 411764 - DNA, 20 bp, Artificial Sequence
  chemically synthesized
taattgagtttgactgtacc

SEQ ID NO: 411765 - DNA, 20 bp, Artificial Sequence
  chemically synthesized
ttaattgagtttgactgtac

SEQ ID NO: 411766 - DNA, 20 bp, Artificial Sequence
  chemically synthesized
gccagtctgaatagttaatt

SEQ ID NO: 411767 - DNA, 20 bp, Artificial Sequence
  chemically synthesized
gtcaaactcaattaactatt

SEQ ID NO: 411768 - DNA, 20 bp, Artificial Sequence
  chemically synthesized
actcaattaactattcagac

SEQ ID NO: 411769 - DNA, 20 bp, Artificial Sequence
  chemically synthesized
agatgctttgccagtctgaa

SEQ ID NO: 411770 - DNA, 20 bp, Artificial Sequence
  chemically synthesized
attaactattcagactggca

SEQ ID NO: 411771 - DNA, 20 bp, Artificial Sequence
  chemically synthesized
aaatgtaaaagatgctttgc

SEQ ID NO: 411772 - DNA, 20 bp, Artificial Sequence
  chemically synthesized
aatctttacgaaaaatgtaa

SEQ ID NO: 411773 - DNA, 20 bp, Artificial Sequence
  chemically synthesized
catcttttacatttttcgta

SEQ ID NO: 411774 - DNA, 20 bp, Artificial Sequence
  chemically synthesized
acatttttcgtaaagattct

SEQ ID NO: 411775 - DNA, 20 bp, Artificial Sequence
  chemically synthesized
tcgtaaagattctaagtgaa

SEQ ID NO: 411776 - DNA, 20 bp, Artificial Sequence
  chemically synthesized
aatagtacaatcttttcact

SEQ ID NO: 411777 - DNA, 20 bp, Artificial Sequence
  chemically synthesized
tatataacttaattgaaaaa

SEQ ID NO: 411778 - DNA, 20 bp, Artificial Sequence
  chemically synthesized
gattgtactatttttcaatt

SEQ ID NO: 411779 - DNA, 20 bp, Artificial Sequence
  chemically synthesized
agttatatatctttcaaaaa

SEQ ID NO: 411780 - DNA, 20 bp, Artificial Sequence
  chemically synthesized
aatctaccagctatttttga

SEQ ID NO: 411781 - DNA, 20 bp, Artificial Sequence
  chemically synthesized
atatatctttcaaaaatagc

SEQ ID NO: 411782 - DNA, 20 bp, Artificial Sequence
  chemically synthesized
tatctttcaaaaatagctgg

SEQ ID NO: 411783 - DNA, 20 bp, Artificial Sequence
  chemically synthesized
gtgcctttgctttaatctac

SEQ ID NO: 411784 - DNA, 20 bp, Artificial Sequence
  chemically synthesized
caaaaatagctggtagatta

SEQ ID NO: 411785 - DNA, 20 bp, Artificial Sequence
  chemically synthesized
atagctggtagattaaagca

SEQ ID NO: 411786 - DNA, 20 bp, Artificial Sequence
  chemically synthesized
tagctggtagattaaagcaa

SEQ ID NO: 411787 - DNA, 20 bp, Artificial Sequence
  chemically synthesized
aatagaatctgtgattgtga

SEQ ID NO: 411788 - DNA, 20 bp, Artificial Sequence
  chemically synthesized
caaaggcactgtcacaatca

SEQ ID NO: 411789 - DNA, 20 bp, Artificial Sequence
  chemically synthesized
tcacaatcacagattctatt

SEQ ID NO: 411790 - DNA, 20 bp, Artificial Sequence
  chemically synthesized
gtcctctaaatggcactaaa

SEQ ID NO: 411791 - DNA, 20 bp, Artificial Sequence
  chemically synthesized
agattctatttagtgccatt

SEQ ID NO: 411792 - DNA, 20 bp, Artificial Sequence
  chemically synthesized
attctatttagtgccattta

SEQ ID NO: 411793 - DNA, 20 bp, Artificial Sequence
  chemically synthesized
ttctatttagtgccatttag

SEQ ID NO: 411794 - DNA, 20 bp, Artificial Sequence
  chemically synthesized
cttcatttttgtcctctaaa

SEQ ID NO: 411795 - DNA, 20 bp, Artificial Sequence
  chemically synthesized
ccatttagaggacaaaaatg

SEQ ID NO: 411796 - DNA, 20 bp, Artificial Sequence
  chemically synthesized
ttagaggacaaaaatgaagc

SEQ ID NO: 411797 - DNA, 20 bp, Artificial Sequence
  chemically synthesized
aggacaaaaatgaagccagc

SEQ ID NO: 411798 - DNA, 20 bp, Artificial Sequence
  chemically synthesized
aacacattttcaagtctagc

SEQ ID NO: 411799 - DNA, 20 bp, Artificial Sequence
  chemically synthesized
tatgaacacattttcaagtc

SEQ ID NO: 411800 - DNA, 20 bp, Artificial Sequence
  chemically synthesized
atcactatgaacacattttc

SEQ ID NO: 411801 - DNA, 20 bp, Artificial Sequence
  chemically synthesized
tagacttgaaaatgtgttca

SEQ ID NO: 411802 - DNA, 20 bp, Artificial Sequence
  chemically synthesized
atgtatcaaaatctactaaa

SEQ ID NO: 411803 - DNA, 20 bp, Artificial Sequence
  chemically synthesized
ccattcaatgttccatttag

SEQ ID NO: 411804 - DNA, 20 bp, Artificial Sequence
  chemically synthesized
ttgccattcaatgttccatt

SEQ ID NO: 411805 - DNA, 20 bp, Artificial Sequence
  chemically synthesized
ctactaaatggaacattgaa

SEQ ID NO: 411806 - DNA, 20 bp, Artificial Sequence
  chemically synthesized
taaatggaacattgaatggc

SEQ ID NO: 411807 - DNA, 20 bp, Artificial Sequence
  chemically synthesized
aacattgaatggcaagtcca

SEQ ID NO: 411808 - DNA, 20 bp, Artificial Sequence
  chemically synthesized
acattgaatggcaagtccaa

SEQ ID NO: 411809 - DNA, 20 bp, Artificial Sequence
  chemically synthesized
tcttaaccatcacatgcctt

SEQ ID NO: 411810 - DNA, 20 bp, Artificial Sequence
  chemically synthesized
gcaagtccaaaggcatgtga

SEQ ID NO: 411811 - DNA, 20 bp, Artificial Sequence
  chemically synthesized
tccaaaggcatgtgatggtt

SEQ ID NO: 411812 - DNA, 20 bp, Artificial Sequence
  chemically synthesized
catgtgatggttaagaaatc

SEQ ID NO: 411813 - DNA, 20 bp, Artificial Sequence
  chemically synthesized
atggttaagaaatctggtca

SEQ ID NO: 411814 - DNA, 20 bp, Artificial Sequence
  chemically synthesized
tggttaagaaatctggtcac

SEQ ID NO: 411815 - DNA, 20 bp, Artificial Sequence
  chemically synthesized
caccgcgctgggcctgtgac

SEQ ID NO: 411816 - DNA, 20 bp, Artificial Sequence
  chemically synthesized
aagaaatctggtcacaggcc

SEQ ID NO: 411817 - DNA, 20 bp, Artificial Sequence
  chemically synthesized
atctggtcacaggcccagcg

SEQ ID NO: 411818 - DNA, 20 bp, Artificial Sequence
  chemically synthesized
tggtcacaggcccagcgcgg

SEQ ID NO: 411819 - DNA, 20 bp, Artificial Sequence
  chemically synthesized
caggcgtgagccaccgcgct

SEQ ID NO: 411820 - DNA, 20 bp, Artificial Sequence
  chemically synthesized
acaggcgtgagccaccgcgc

SEQ ID NO: 411821 - DNA, 20 bp, Artificial Sequence
  chemically synthesized
agtgctgggattacaggcgt

SEQ ID NO: 411822 - DNA, 20 bp, Artificial Sequence
  chemically synthesized
gtggctcacgcctgtaatcc

SEQ ID NO: 411823 - DNA, 20 bp, Artificial Sequence
  chemically synthesized
tcccaaagtgctgggattac

SEQ ID NO: 411824 - DNA, 20 bp, Artificial Sequence
  chemically synthesized
ctcccaaagtgctgggatta

SEQ ID NO: 411825 - DNA, 20 bp, Artificial Sequence
  chemically synthesized
cgcctgtaatcccagcactt

SEQ ID NO: 411826 - DNA, 20 bp, Artificial Sequence
  chemically synthesized
ccttggcctcccaaagtgct

SEQ ID NO: 411827 - DNA, 20 bp, Artificial Sequence
  chemically synthesized
gcctgtaatcccagcacttt

SEQ ID NO: 411828 - DNA, 20 bp, Artificial Sequence
  chemically synthesized
gccttggcctcccaaagtgc

SEQ ID NO: 411829 - DNA, 20 bp, Artificial Sequence
  chemically synthesized
ctgtaatcccagcactttgg

SEQ ID NO: 411830 - DNA, 20 bp, Artificial Sequence
  chemically synthesized
tgtaatcccagcactttggg

SEQ ID NO: 411831 - DNA, 20 bp, Artificial Sequence
  chemically synthesized
ccgcctgccttggcctccca

SEQ ID NO: 411832 - DNA, 20 bp, Artificial Sequence
  chemically synthesized
tcccagcactttgggaggcc

SEQ ID NO: 411833 - DNA, 20 bp, Artificial Sequence
  chemically synthesized
cccagcactttgggaggcca

SEQ ID NO: 411834 - DNA, 20 bp, Artificial Sequence
  chemically synthesized
agcactttgggaggccaagg

SEQ ID NO: 411835 - DNA, 20 bp, Artificial Sequence
  chemically synthesized
gcactttgggaggccaaggc

SEQ ID NO: 411836 - DNA, 20 bp, Artificial Sequence
  chemically synthesized
ctttgggaggccaaggcagg

SEQ ID NO: 411837 - DNA, 20 bp, Artificial Sequence
  chemically synthesized
ctcaggtgatccgcctgcct

SEQ ID NO: 411838 - DNA, 20 bp, Artificial Sequence
  chemically synthesized
ccaaggcaggcggatcacct

SEQ ID NO: 411839 - DNA, 20 bp, Artificial Sequence
  chemically synthesized
caaggcaggcggatcacctg

SEQ ID NO: 411840 - DNA, 20 bp, Artificial Sequence
  chemically synthesized
gcaggcggatcacctgaggt

SEQ ID NO: 411841 - DNA, 20 bp, Artificial Sequence
  chemically synthesized
caggcggatcacctgaggtc

SEQ ID NO: 411842 - DNA, 20 bp, Artificial Sequence
  chemically synthesized
agtcttaaactcctgacctc

SEQ ID NO: 411843 - DNA, 20 bp, Artificial Sequence
  chemically synthesized
ggcggatcacctgaggtcag

SEQ ID NO: 411844 - DNA, 20 bp, Artificial Sequence
  chemically synthesized
tagtcttaaactcctgacct

SEQ ID NO: 411845 - DNA, 20 bp, Artificial Sequence
  chemically synthesized
tcacctgaggtcaggagttt

SEQ ID NO: 411846 - DNA, 20 bp, Artificial Sequence
  chemically synthesized
tgaggtcaggagtttaagac

SEQ ID NO: 411847 - DNA, 20 bp, Artificial Sequence
  chemically synthesized
tcaggagtttaagactagcc

SEQ ID NO: 411848 - DNA, 20 bp, Artificial Sequence
  chemically synthesized
gagtttaagactagcctggt

SEQ ID NO: 411849 - DNA, 20 bp, Artificial Sequence
  chemically synthesized
tttcactatgctgaccaggc

SEQ ID NO: 411850 - DNA, 20 bp, Artificial Sequence
  chemically synthesized
ggggtttcactatgctgacc

SEQ ID NO: 411851 - DNA, 20 bp, Artificial Sequence
  chemically synthesized
taagactagcctggtcagca

SEQ ID NO: 411852 - DNA, 20 bp, Artificial Sequence
  chemically synthesized
aggggtttcactatgctgac

SEQ ID NO: 411853 - DNA, 20 bp, Artificial Sequence
  chemically synthesized
ttgtatttttagtagagaag

SEQ ID NO: 411854 - DNA, 20 bp, Artificial Sequence
  chemically synthesized
tttgtatttttagtagagaa

SEQ ID NO: 411855 - DNA, 20 bp, Artificial Sequence
  chemically synthesized
ttttgtatttttagtagaga

SEQ ID NO: 411856 - DNA, 20 bp, Artificial Sequence
  chemically synthesized
tttttgtatttttagtagag

SEQ ID NO: 411857 - DNA, 20 bp, Artificial Sequence
  chemically synthesized
taatttttgtatttttagta

SEQ ID NO: 411858 - DNA, 20 bp, Artificial Sequence
  chemically synthesized
gctaatttttgtatttttag

SEQ ID NO: 411859 - DNA, 20 bp, Artificial Sequence
  chemically synthesized
ctggctaatttttgtatttt

SEQ ID NO: 411860 - DNA, 20 bp, Artificial Sequence
  chemically synthesized
tctactaaaaatacaaaaat

SEQ ID NO: 411861 - DNA, 20 bp, Artificial Sequence
  chemically synthesized
ctaaaaatacaaaaattagc

SEQ ID NO: 411862 - DNA, 20 bp, Artificial Sequence
  chemically synthesized
taaaaatacaaaaattagcc

SEQ ID NO: 411863 - DNA, 20 bp, Artificial Sequence
  chemically synthesized
atacaaaaattagccaggtg

SEQ ID NO: 411864 - DNA, 20 bp, Artificial Sequence
  chemically synthesized
caggtgcctgcgaccacacc

SEQ ID NO: 411865 - DNA, 20 bp, Artificial Sequence
  chemically synthesized
aaattagccaggtgtggtcg

SEQ ID NO: 411866 - DNA, 20 bp, Artificial Sequence
  chemically synthesized
aattagccaggtgtggtcgc

SEQ ID NO: 411867 - DNA, 20 bp, Artificial Sequence
  chemically synthesized
gtcgcaggcacctgtaatcc

SEQ ID NO: 411868 - DNA, 20 bp, Artificial Sequence
  chemically synthesized
tcccgagtagctaggattac

SEQ ID NO: 411869 - DNA, 20 bp, Artificial Sequence
  chemically synthesized
ctcccgagtagctaggatta

SEQ ID NO: 411870 - DNA, 20 bp, Artificial Sequence
  chemically synthesized
cacctgtaatcctagctact

SEQ ID NO: 411871 - DNA, 20 bp, Artificial Sequence
  chemically synthesized
cctcagcctcccgagtagct

SEQ ID NO: 411872 - DNA, 20 bp, Artificial Sequence
  chemically synthesized
acctgtaatcctagctactc

SEQ ID NO: 411873 - DNA, 20 bp, Artificial Sequence
  chemically synthesized
acctcagcctcccgagtagc

SEQ ID NO: 411874 - DNA, 20 bp, Artificial Sequence
  chemically synthesized
ctgtaatcctagctactcgg

SEQ ID NO: 411875 - DNA, 20 bp, Artificial Sequence
  chemically synthesized
tgtaatcctagctactcggg

SEQ ID NO: 411876 - DNA, 20 bp, Artificial Sequence
  chemically synthesized
tcctacctcagcctcccgag

SEQ ID NO: 411877 - DNA, 20 bp, Artificial Sequence
  chemically synthesized
ttctcctacctcagcctccc

SEQ ID NO: 411878 - DNA, 20 bp, Artificial Sequence
  chemically synthesized
tcctagctactcgggaggct

SEQ ID NO: 411879 - DNA, 20 bp, Artificial Sequence
  chemically synthesized
cctagctactcgggaggctg

SEQ ID NO: 411880 - DNA, 20 bp, Artificial Sequence
  chemically synthesized
agctactcgggaggctgagg

SEQ ID NO: 411881 - DNA, 20 bp, Artificial Sequence
  chemically synthesized
gctactcgggaggctgaggt

SEQ ID NO: 411882 - DNA, 20 bp, Artificial Sequence
  chemically synthesized
tactcgggaggctgaggtag

SEQ ID NO: 411883 - DNA, 20 bp, Artificial Sequence
  chemically synthesized
ttcaaatgattctcctacct

SEQ ID NO: 411884 - DNA, 20 bp, Artificial Sequence
  chemically synthesized
gtaggagaatcatttgaacc

SEQ ID NO: 411885 - DNA, 20 bp, Artificial Sequence
  chemically synthesized
taggagaatcatttgaacct

SEQ ID NO: 411886 - DNA, 20 bp, Artificial Sequence
  chemically synthesized
ggagaatcatttgaacctgg

SEQ ID NO: 411887 - DNA, 20 bp, Artificial Sequence
  chemically synthesized
aatcatttgaacctgggaga

SEQ ID NO: 411888 - DNA, 20 bp, Artificial Sequence
  chemically synthesized
cactgcaacctccatctccc

SEQ ID NO: 411889 - DNA, 20 bp, Artificial Sequence
  chemically synthesized
tcatttgaacctgggagatg

SEQ ID NO: 411890 - DNA, 20 bp, Artificial Sequence
  chemically synthesized
tcactgcaacctccatctcc

SEQ ID NO: 411891 - DNA, 20 bp, Artificial Sequence
  chemically synthesized
catttgaacctgggagatgg

SEQ ID NO: 411892 - DNA, 20 bp, Artificial Sequence
  chemically synthesized
aacctgggagatggaggttg

SEQ ID NO: 411893 - DNA, 20 bp, Artificial Sequence
  chemically synthesized
tgggagatggaggttgcagt

SEQ ID NO: 411894 - DNA, 20 bp, Artificial Sequence
  chemically synthesized
ggagtgcagtggtgcgatcg

SEQ ID NO: 411895 - DNA, 20 bp, Artificial Sequence
  chemically synthesized
tcgcccaggctggagtgcag

SEQ ID NO: 411896 - DNA, 20 bp, Artificial Sequence
  chemically synthesized
acgatcgcaccactgcactc

SEQ ID NO: 411897 - DNA, 20 bp, Artificial Sequence
  chemically synthesized
ttatcgcccaggctggagtg

SEQ ID NO: 411898 - DNA, 20 bp, Artificial Sequence
  chemically synthesized
cgcaccactgcactccagcc

SEQ ID NO: 411899 - DNA, 20 bp, Artificial Sequence
  chemically synthesized
gcaccactgcactccagcct

SEQ ID NO: 411900 - DNA, 20 bp, Artificial Sequence
  chemically synthesized
cactcttatcgcccaggctg

SEQ ID NO: 411901 - DNA, 20 bp, Artificial Sequence
  chemically synthesized
ttcactcttatcgcccaggc

SEQ ID NO: 411902 - DNA, 20 bp, Artificial Sequence
  chemically synthesized
tgcactccagcctgggcgat

SEQ ID NO: 411903 - DNA, 20 bp, Artificial Sequence
  chemically synthesized
gagtttcactcttatcgccc

SEQ ID NO: 411904 - DNA, 20 bp, Artificial Sequence
  chemically synthesized
agagtttcactcttatcgcc

SEQ ID NO: 411905 - DNA, 20 bp, Artificial Sequence
  chemically synthesized
cactccagcctgggcgataa

SEQ ID NO: 411906 - DNA, 20 bp, Artificial Sequence
  chemically synthesized
tgtttttggtttttgaaaca

SEQ ID NO: 411907 - DNA, 20 bp, Artificial Sequence
  chemically synthesized
tttgtttttggtttttgaaa

SEQ ID NO: 411908 - DNA, 20 bp, Artificial Sequence
  chemically synthesized
tttttgtcgttgtttgtttt

SEQ ID NO: 411909 - DNA, 20 bp, Artificial Sequence
  chemically synthesized
caaacaacgacaaaaaaatc

SEQ ID NO: 411910 - DNA, 20 bp, Artificial Sequence
  chemically synthesized
aaacaacgacaaaaaaatct

SEQ ID NO: 411911 - DNA, 20 bp, Artificial Sequence
  chemically synthesized
acgacaaaaaaatctgggca

SEQ ID NO: 411912 - DNA, 20 bp, Artificial Sequence
  chemically synthesized
cttgtgtaattatctgtgcc

SEQ ID NO: 411913 - DNA, 20 bp, Artificial Sequence
  chemically synthesized
ctgggcacagataattacac

SEQ ID NO: 411914 - DNA, 20 bp, Artificial Sequence
  chemically synthesized
tgggcacagataattacaca

SEQ ID NO: 411915 - DNA, 20 bp, Artificial Sequence
  chemically synthesized
tctctaaatgaataacagag

SEQ ID NO: 411916 - DNA, 20 bp, Artificial Sequence
  chemically synthesized
atctctaaatgaataacaga

SEQ ID NO: 411917 - DNA, 20 bp, Artificial Sequence
  chemically synthesized
acatctctaaatgaataaca

SEQ ID NO: 411918 - DNA, 20 bp, Artificial Sequence
  chemically synthesized
agacatctctaaatgaataa

SEQ ID NO: 411919 - DNA, 20 bp, Artificial Sequence
  chemically synthesized
taacctctctgttattcatt

SEQ ID NO: 411920 - DNA, 20 bp, Artificial Sequence
  chemically synthesized
acctctctgttattcattta

SEQ ID NO: 411921 - DNA, 20 bp, Artificial Sequence
  chemically synthesized
attcatttagagatgtctaa

SEQ ID NO: 411922 - DNA, 20 bp, Artificial Sequence
  chemically synthesized
aatttctcaggaattacttt

SEQ ID NO: 411923 - DNA, 20 bp, Artificial Sequence
  chemically synthesized
gatgtctaaaagtaattcct

SEQ ID NO: 411924 - DNA, 20 bp, Artificial Sequence
  chemically synthesized
ataaaaattccaaatttctc

SEQ ID NO: 411925 - DNA, 20 bp, Artificial Sequence
  chemically synthesized
aaagtaattcctgagaaatt

SEQ ID NO: 411926 - DNA, 20 bp, Artificial Sequence
  chemically synthesized
aataaaaattccaaatttct

SEQ ID NO: 411927 - DNA, 20 bp, Artificial Sequence
  chemically synthesized
ggaatttttattgaacatgt

SEQ ID NO: 411928 - DNA, 20 bp, Artificial Sequence
  chemically synthesized
gattcagaagttatttagag

SEQ ID NO: 411929 - DNA, 20 bp, Artificial Sequence
  chemically synthesized
ggtgattcagaagttattta

SEQ ID NO: 411930 - DNA, 20 bp, Artificial Sequence
  chemically synthesized
caggtgattcagaagttatt

SEQ ID NO: 411931 - DNA, 20 bp, Artificial Sequence
  chemically synthesized
tgcatttacaggtgattcag

SEQ ID NO: 411932 - DNA, 20 bp, Artificial Sequence
  chemically synthesized
tggtgcatttacaggtgatt

SEQ ID NO: 411933 - DNA, 20 bp, Artificial Sequence
  chemically synthesized
caaatcaatggtgcatttac

SEQ ID NO: 411934 - DNA, 20 bp, Artificial Sequence
  chemically synthesized
ccaaatcaatggtgcattta

SEQ ID NO: 411935 - DNA, 20 bp, Artificial Sequence
  chemically synthesized
ctgtaaatgcaccattgatt

SEQ ID NO: 411936 - DNA, 20 bp, Artificial Sequence
  chemically synthesized
tccaccattatccaaatcaa

SEQ ID NO: 411937 - DNA, 20 bp, Artificial Sequence
  chemically synthesized
tgcaccattgatttggataa

SEQ ID NO: 411938 - DNA, 20 bp, Artificial Sequence
  chemically synthesized
accattgatttggataatgg

SEQ ID NO: 411939 - DNA, 20 bp, Artificial Sequence
  chemically synthesized
atttggataatggtggaatc

SEQ ID NO: 411940 - DNA, 20 bp, Artificial Sequence
  chemically synthesized
ataatggtggaatctagctg

SEQ ID NO: 411941 - DNA, 20 bp, Artificial Sequence
  chemically synthesized
cttttaacttattccacagc

SEQ ID NO: 411942 - DNA, 20 bp, Artificial Sequence
  chemically synthesized
gtggaatctagctgtggaat

SEQ ID NO: 411943 - DNA, 20 bp, Artificial Sequence
  chemically synthesized
tgaccttttaacttattcca

SEQ ID NO: 411944 - DNA, 20 bp, Artificial Sequence
  chemically synthesized
ctagctgtggaataagttaa

SEQ ID NO: 411945 - DNA, 20 bp, Artificial Sequence
  chemically synthesized
tagctgtggaataagttaaa

SEQ ID NO: 411946 - DNA, 20 bp, Artificial Sequence
  chemically synthesized
ggaataagttaaaaggtcat

SEQ ID NO: 411947 - DNA, 20 bp, Artificial Sequence
  chemically synthesized
gaataagttaaaaggtcata

SEQ ID NO: 411948 - DNA, 20 bp, Artificial Sequence
  chemically synthesized
taaaaggtcataaggcctcc

SEQ ID NO: 411949 - DNA, 20 bp, Artificial Sequence
  chemically synthesized
aaaaggtcataaggcctcca

SEQ ID NO: 411950 - DNA, 20 bp, Artificial Sequence
  chemically synthesized
aaaggtcataaggcctccaa

SEQ ID NO: 411951 - DNA, 20 bp, Artificial Sequence
  chemically synthesized
cactgaaatttcacccttgg

SEQ ID NO: 411952 - DNA, 20 bp, Artificial Sequence
  chemically synthesized
tcactgaaatttcacccttg

SEQ ID NO: 411953 - DNA, 20 bp, Artificial Sequence
  chemically synthesized
cctcactgaaatttcaccct

SEQ ID NO: 411954 - DNA, 20 bp, Artificial Sequence
  chemically synthesized
ggcctccaagggtgaaattt

SEQ ID NO: 411955 - DNA, 20 bp, Artificial Sequence
  chemically synthesized
tccaagggtgaaatttcagt

SEQ ID NO: 411956 - DNA, 20 bp, Artificial Sequence
  chemically synthesized
ccaagggtgaaatttcagtg

SEQ ID NO: 411957 - DNA, 20 bp, Artificial Sequence
  chemically synthesized
tgaaatttcagtgaggtaac

SEQ ID NO: 411958 - DNA, 20 bp, Artificial Sequence
  chemically synthesized
atttcagtgaggtaaccagc

SEQ ID NO: 411959 - DNA, 20 bp, Artificial Sequence
  chemically synthesized
tttcagtgaggtaaccagcc

SEQ ID NO: 411960 - DNA, 20 bp, Artificial Sequence
  chemically synthesized
gagctgctccgtagcctggc

SEQ ID NO: 411961 - DNA, 20 bp, Artificial Sequence
  chemically synthesized
tgaggtaaccagccaggcta

SEQ ID NO: 411962 - DNA, 20 bp, Artificial Sequence
  chemically synthesized
aggtaaccagccaggctacg

SEQ ID NO: 411963 - DNA, 20 bp, Artificial Sequence
  chemically synthesized
caccgagctgctccgtagcc

SEQ ID NO: 411964 - DNA, 20 bp, Artificial Sequence
  chemically synthesized
taaccagccaggctacggag

SEQ ID NO: 411965 - DNA, 20 bp, Artificial Sequence
  chemically synthesized
atgctcaccgagctgctccg

SEQ ID NO: 411966 - DNA, 20 bp, Artificial Sequence
  chemically synthesized
agccaggctacggagcagct

SEQ ID NO: 411967 - DNA, 20 bp, Artificial Sequence
  chemically synthesized
aggctacggagcagctcggt

SEQ ID NO: 411968 - DNA, 20 bp, Artificial Sequence
  chemically synthesized
aaactgatgaaatgctcacc

SEQ ID NO: 411969 - DNA, 20 bp, Artificial Sequence
  chemically synthesized
cagctcggtgagcatttcat

SEQ ID NO: 411970 - DNA, 20 bp, Artificial Sequence
  chemically synthesized
cggtgagcatttcatcagtt

SEQ ID NO: 411971 - DNA, 20 bp, Artificial Sequence
  chemically synthesized
gtgagcatttcatcagtttg

SEQ ID NO: 411972 - DNA, 20 bp, Artificial Sequence
  chemically synthesized
agcatttcatcagtttggag

SEQ ID NO: 411973 - DNA, 20 bp, Artificial Sequence
  chemically synthesized
catcagtttggagtagaata

SEQ ID NO: 411974 - DNA, 20 bp, Artificial Sequence
  chemically synthesized
atcagtttggagtagaatat

SEQ ID NO: 411975 - DNA, 20 bp, Artificial Sequence
  chemically synthesized
tcagtttggagtagaatatg

SEQ ID NO: 411976 - DNA, 20 bp, Artificial Sequence
  chemically synthesized
agtttggagtagaatatggg

SEQ ID NO: 411977 - DNA, 20 bp, Artificial Sequence
  chemically synthesized
tttttacctgagttgagaaa

SEQ ID NO: 411978 - DNA, 20 bp, Artificial Sequence
  chemically synthesized
ctttttacctgagttgagaa

SEQ ID NO: 411979 - DNA, 20 bp, Artificial Sequence
  chemically synthesized
gatgataccttttctcaact

SEQ ID NO: 411980 - DNA, 20 bp, Artificial Sequence
  chemically synthesized
atgataccttttctcaactc

SEQ ID NO: 411981 - DNA, 20 bp, Artificial Sequence
  chemically synthesized
aaattctttttacctgagtt

SEQ ID NO: 411982 - DNA, 20 bp, Artificial Sequence
  chemically synthesized
cttttctcaactcaggtaaa

SEQ ID NO: 411983 - DNA, 20 bp, Artificial Sequence
  chemically synthesized
tggtcaaattctttttacct

SEQ ID NO: 411984 - DNA, 20 bp, Artificial Sequence
  chemically synthesized
caggtaaaaagaatttgacc

SEQ ID NO: 411985 - DNA, 20 bp, Artificial Sequence
  chemically synthesized
taaaagctggtatgagaact

SEQ ID NO: 411986 - DNA, 20 bp, Artificial Sequence
  chemically synthesized
atttgaccaagttctcatac

SEQ ID NO: 411987 - DNA, 20 bp, Artificial Sequence
  chemically synthesized
tgtaacataaaagctggtat

SEQ ID NO: 411988 - DNA, 20 bp, Artificial Sequence
  chemically synthesized
cagctgtgtaacataaaagc

SEQ ID NO: 411989 - DNA, 20 bp, Artificial Sequence
  chemically synthesized
taaacagctgtgtaacataa

SEQ ID NO: 411990 - DNA, 20 bp, Artificial Sequence
  chemically synthesized
ataccagcttttatgttaca

SEQ ID NO: 411991 - DNA, 20 bp, Artificial Sequence
  chemically synthesized
aaaacattgatggtaataaa

SEQ ID NO: 411992 - DNA, 20 bp, Artificial Sequence
  chemically synthesized
ccagttttcaaaaacattga

SEQ ID NO: 411993 - DNA, 20 bp, Artificial Sequence
  chemically synthesized
ccatcaatgtttttgaaaac

SEQ ID NO: 411994 - DNA, 20 bp, Artificial Sequence
  chemically synthesized
catcaatgtttttgaaaact

SEQ ID NO: 411995 - DNA, 20 bp, Artificial Sequence
  chemically synthesized
caatgtttttgaaaactggg

SEQ ID NO: 411996 - DNA, 20 bp, Artificial Sequence
  chemically synthesized
atgatggaaattatgctgcc

SEQ ID NO: 411997 - DNA, 20 bp, Artificial Sequence
  chemically synthesized
gaaccagggacatagcatga

SEQ ID NO: 411998 - DNA, 20 bp, Artificial Sequence
  chemically synthesized
tttccatcatgctatgtccc

SEQ ID NO: 411999 - DNA, 20 bp, Artificial Sequence
  chemically synthesized
aataagtagaaccagggaca

SEQ ID NO: 412000 - DNA, 20 bp, Artificial Sequence
  chemically synthesized
ccaaataataagtagaacca

SEQ ID NO: 412001 - DNA, 20 bp, Artificial Sequence
  chemically synthesized
tccaaataataagtagaacc

SEQ ID NO: 412002 - DNA, 20 bp, Artificial Sequence
  chemically synthesized
gtccaaataataagtagaac

SEQ ID NO: 412003 - DNA, 20 bp, Artificial Sequence
  chemically synthesized
caggaggtccaaataataag

SEQ ID NO: 412004 - DNA, 20 bp, Artificial Sequence
  chemically synthesized
ccctggttctacttattatt

SEQ ID NO: 412005 - DNA, 20 bp, Artificial Sequence
  chemically synthesized
aatcaggaggtccaaataat

SEQ ID NO: 412006 - DNA, 20 bp, Artificial Sequence
  chemically synthesized
gttttagtcagtaaatcagg

SEQ ID NO: 412007 - DNA, 20 bp, Artificial Sequence
  chemically synthesized
agttttagtcagtaaatcag

SEQ ID NO: 412008 - DNA, 20 bp, Artificial Sequence
  chemically synthesized
gtagttttagtcagtaaatc

SEQ ID NO: 412009 - DNA, 20 bp, Artificial Sequence
  chemically synthesized
agtagttttagtcagtaaat

SEQ ID NO: 412010 - DNA, 20 bp, Artificial Sequence
  chemically synthesized
aattaaatagtagttttagt

SEQ ID NO: 412011 - DNA, 20 bp, Artificial Sequence
  chemically synthesized
agataattaaatagtagttt

SEQ ID NO: 412012 - DNA, 20 bp, Artificial Sequence
  chemically synthesized
gtatacagataattaaatag

SEQ ID NO: 412013 - DNA, 20 bp, Artificial Sequence
  chemically synthesized
tttgtatacagataattaaa

SEQ ID NO: 412014 - DNA, 20 bp, Artificial Sequence
  chemically synthesized
atggccggtgaatttgtata

SEQ ID NO: 412015 - DNA, 20 bp, Artificial Sequence
  chemically synthesized
ttatctgtatacaaattcac

SEQ ID NO: 412016 - DNA, 20 bp, Artificial Sequence
  chemically synthesized
atacctcaaaggaaaatggc

SEQ ID NO: 412017 - DNA, 20 bp, Artificial Sequence
  chemically synthesized
agggatacctcaaaggaaaa

SEQ ID NO: 412018 - DNA, 20 bp, Artificial Sequence
  chemically synthesized
ttcaccggccattttccttt

SEQ ID NO: 412019 - DNA, 20 bp, Artificial Sequence
  chemically synthesized
tcaccggccattttcctttg

SEQ ID NO: 412020 - DNA, 20 bp, Artificial Sequence
  chemically synthesized
gccaaatagggatacctcaa

SEQ ID NO: 412021 - DNA, 20 bp, Artificial Sequence
  chemically synthesized
ggccaaatagggatacctca

SEQ ID NO: 412022 - DNA, 20 bp, Artificial Sequence
  chemically synthesized
tcctttgaggtatccctatt

SEQ ID NO: 412023 - DNA, 20 bp, Artificial Sequence
  chemically synthesized
ctaaattttctggccaaata

SEQ ID NO: 412024 - DNA, 20 bp, Artificial Sequence
  chemically synthesized
ttgaggtatccctatttggc

SEQ ID NO: 412025 - DNA, 20 bp, Artificial Sequence
  chemically synthesized
tctaaattttctggccaaat

SEQ ID NO: 412026 - DNA, 20 bp, Artificial Sequence
  chemically synthesized
ctctaaattttctggccaaa

SEQ ID NO: 412027 - DNA, 20 bp, Artificial Sequence
  chemically synthesized
ccctatttggccagaaaatt

SEQ ID NO: 412028 - DNA, 20 bp, Artificial Sequence
  chemically synthesized
atcttttgctctaaattttc

SEQ ID NO: 412029 - DNA, 20 bp, Artificial Sequence
  chemically synthesized
ctatttggccagaaaattta

SEQ ID NO: 412030 - DNA, 20 bp, Artificial Sequence
  chemically synthesized
ggccagaaaatttagagcaa

SEQ ID NO: 412031 - DNA, 20 bp, Artificial Sequence
  chemically synthesized
agagcaaaagatgttcaatt

SEQ ID NO: 412032 - DNA, 20 bp, Artificial Sequence
  chemically synthesized
aactgataaataacattaaa

SEQ ID NO: 412033 - DNA, 20 bp, Artificial Sequence
  chemically synthesized
ttctttttaatgttatttat

SEQ ID NO: 412034 - DNA, 20 bp, Artificial Sequence
  chemically synthesized
aagtgaaagattatgtatat

SEQ ID NO: 412035 - DNA, 20 bp, Artificial Sequence
  chemically synthesized
aatctctgacagtaaagtga

SEQ ID NO: 412036 - DNA, 20 bp, Artificial Sequence
  chemically synthesized
ataatctttcactttactgt

SEQ ID NO: 412037 - DNA, 20 bp, Artificial Sequence
  chemically synthesized
gttataaatctctgacagta

SEQ ID NO: 412038 - DNA, 20 bp, Artificial Sequence
  chemically synthesized
aatctttcactttactgtca

SEQ ID NO: 412039 - DNA, 20 bp, Artificial Sequence
  chemically synthesized
attttgttataaatctctga

SEQ ID NO: 412040 - DNA, 20 bp, Artificial Sequence
  chemically synthesized
agatttataacaaaattatc

SEQ ID NO: 412041 - DNA, 20 bp, Artificial Sequence
  chemically synthesized
ttttattcagtagatatcac

SEQ ID NO: 412042 - DNA, 20 bp, Artificial Sequence
  chemically synthesized
aacattacttttttattcag

SEQ ID NO: 412043 - DNA, 20 bp, Artificial Sequence
  chemically synthesized
gtgatatctactgaataaaa

SEQ ID NO: 412044 - DNA, 20 bp, Artificial Sequence
  chemically synthesized
ataaacattacttttttatt

SEQ ID NO: 412045 - DNA, 20 bp, Artificial Sequence
  chemically synthesized
aaaaaagtaatgtttatcct

SEQ ID NO: 412046 - DNA, 20 bp, Artificial Sequence
  chemically synthesized
actgaacaattggtatactg

SEQ ID NO: 412047 - DNA, 20 bp, Artificial Sequence
  chemically synthesized
aactgaacaattggtatact

SEQ ID NO: 412048 - DNA, 20 bp, Artificial Sequence
  chemically synthesized
tcctcagtataccaattgtt

SEQ ID NO: 412049 - DNA, 20 bp, Artificial Sequence
  chemically synthesized
ttgcaccaaaactgaacaat

SEQ ID NO: 412050 - DNA, 20 bp, Artificial Sequence
  chemically synthesized
gtataccaattgttcagttt

SEQ ID NO: 412051 - DNA, 20 bp, Artificial Sequence
  chemically synthesized
caattgttcagttttggtgc

SEQ ID NO: 412052 - DNA, 20 bp, Artificial Sequence
  chemically synthesized
aattgttcagttttggtgca

SEQ ID NO: 412053 - DNA, 20 bp, Artificial Sequence
  chemically synthesized
tgttcagttttggtgcaagg

SEQ ID NO: 412054 - DNA, 20 bp, Artificial Sequence
  chemically synthesized
caaggtggtttaatatgtca

SEQ ID NO: 412055 - DNA, 20 bp, Artificial Sequence
  chemically synthesized
ggtttaatatgtcacagctc

SEQ ID NO: 412056 - DNA, 20 bp, Artificial Sequence
  chemically synthesized
gtttaatatgtcacagctct

SEQ ID NO: 412057 - DNA, 20 bp, Artificial Sequence
  chemically synthesized
aatatgtcacagctctaggt

SEQ ID NO: 412058 - DNA, 20 bp, Artificial Sequence
  chemically synthesized
tcttactatattcttaccta

SEQ ID NO: 412059 - DNA, 20 bp, Artificial Sequence
  chemically synthesized
tttcttactatattcttacc

SEQ ID NO: 412060 - DNA, 20 bp, Artificial Sequence
  chemically synthesized
cacagctctaggtaagaata

SEQ ID NO: 412061 - DNA, 20 bp, Artificial Sequence
  chemically synthesized
gctctaggtaagaatatagt

SEQ ID NO: 412062 - DNA, 20 bp, Artificial Sequence
  chemically synthesized
agaatatagtaagaaaccct

SEQ ID NO: 412063 - DNA, 20 bp, Artificial Sequence
  chemically synthesized
aatatagtaagaaaccctga

SEQ ID NO: 412064 - DNA, 20 bp, Artificial Sequence
  chemically synthesized
atatagtaagaaaccctgag

SEQ ID NO: 412065 - DNA, 20 bp, Artificial Sequence
  chemically synthesized
tatagtaagaaaccctgaga

SEQ ID NO: 412066 - DNA, 20 bp, Artificial Sequence
  chemically synthesized
aattaaacatgtccctctca

SEQ ID NO: 412067 - DNA, 20 bp, Artificial Sequence
  chemically synthesized
caattaaacatgtccctctc

SEQ ID NO: 412068 - DNA, 20 bp, Artificial Sequence
  chemically synthesized
acaattaaacatgtccctct

SEQ ID NO: 412069 - DNA, 20 bp, Artificial Sequence
  chemically synthesized
tgtttaattgtaaaactgtg

SEQ ID NO: 412070 - DNA, 20 bp, Artificial Sequence
  chemically synthesized
gtatgtatttatgtgcttca

SEQ ID NO: 412071 - DNA, 20 bp, Artificial Sequence
  chemically synthesized
ctattattattgataatagt

SEQ ID NO: 412072 - DNA, 20 bp, Artificial Sequence
  chemically synthesized
gtaactattattattgataa

SEQ ID NO: 412073 - DNA, 20 bp, Artificial Sequence
  chemically synthesized
cttactattatcaataataa

SEQ ID NO: 412074 - DNA, 20 bp, Artificial Sequence
  chemically synthesized
tatagcaggcaatatttaaa

SEQ ID NO: 412075 - DNA, 20 bp, Artificial Sequence
  chemically synthesized
agtgctttgtgatatatagc

SEQ ID NO: 412076 - DNA, 20 bp, Artificial Sequence
  chemically synthesized
tagtgctttgtgatatatag

SEQ ID NO: 412077 - DNA, 20 bp, Artificial Sequence
  chemically synthesized
tcttagtgctttgtgatata

SEQ ID NO: 412078 - DNA, 20 bp, Artificial Sequence
  chemically synthesized
attgcctgctatatatcaca

SEQ ID NO: 412079 - DNA, 20 bp, Artificial Sequence
  chemically synthesized
gctatatatcacaaagcact

SEQ ID NO: 412080 - DNA, 20 bp, Artificial Sequence
  chemically synthesized
tatatatcacaaagcactaa

SEQ ID NO: 412081 - DNA, 20 bp, Artificial Sequence
  chemically synthesized
atatatcacaaagcactaag

SEQ ID NO: 412082 - DNA, 20 bp, Artificial Sequence
  chemically synthesized
aaaatgtattttaagcctct

SEQ ID NO: 412083 - DNA, 20 bp, Artificial Sequence
  chemically synthesized
gacagagaaaaatgtatttt

SEQ ID NO: 412084 - DNA, 20 bp, Artificial Sequence
  chemically synthesized
aaatagaattgtacaggaca

SEQ ID NO: 412085 - DNA, 20 bp, Artificial Sequence
  chemically synthesized
ttaaatagaattgtacagga

SEQ ID NO: 412086 - DNA, 20 bp, Artificial Sequence
  chemically synthesized
atttttaaatagaattgtac

SEQ ID NO: 412087 - DNA, 20 bp, Artificial Sequence
  chemically synthesized
tatttttaaatagaattgta

SEQ ID NO: 412088 - DNA, 20 bp, Artificial Sequence
  chemically synthesized
aaattttgcctatttttaaa

SEQ ID NO: 412089 - DNA, 20 bp, Artificial Sequence
  chemically synthesized
tgtacaattctatttaaaaa

SEQ ID NO: 412090 - DNA, 20 bp, Artificial Sequence
  chemically synthesized
gtacaattctatttaaaaat

SEQ ID NO: 412091 - DNA, 20 bp, Artificial Sequence
  chemically synthesized
ttctccttacatacaaagtg

SEQ ID NO: 412092 - DNA, 20 bp, Artificial Sequence
  chemically synthesized
cattctccttacatacaaag

SEQ ID NO: 412093 - DNA, 20 bp, Artificial Sequence
  chemically synthesized
aatttctccactttgtatgt

SEQ ID NO: 412094 - DNA, 20 bp, Artificial Sequence
  chemically synthesized
actcattctccttacataca

SEQ ID NO: 412095 - DNA, 20 bp, Artificial Sequence
  chemically synthesized
atttctccactttgtatgta

SEQ ID NO: 412096 - DNA, 20 bp, Artificial Sequence
  chemically synthesized
ttctccactttgtatgtaag

SEQ ID NO: 412097 - DNA, 20 bp, Artificial Sequence
  chemically synthesized
actttgtatgtaaggagaat

SEQ ID NO: 412098 - DNA, 20 bp, Artificial Sequence
  chemically synthesized
gaatgagtcacaaaaatgtt

SEQ ID NO: 412099 - DNA, 20 bp, Artificial Sequence
  chemically synthesized
aaaatgttaagcaacttgat

SEQ ID NO: 412100 - DNA, 20 bp, Artificial Sequence
  chemically synthesized
aaatgttaagcaacttgatc

SEQ ID NO: 412101 - DNA, 20 bp, Artificial Sequence
  chemically synthesized
attggcagttgggcctgatc

SEQ ID NO: 412102 - DNA, 20 bp, Artificial Sequence
  chemically synthesized
cttcaaacttattggcagtt

SEQ ID NO: 412103 - DNA, 20 bp, Artificial Sequence
  chemically synthesized
tcttcaaacttattggcagt

SEQ ID NO: 412104 - DNA, 20 bp, Artificial Sequence
  chemically synthesized
gatcaggcccaactgccaat

SEQ ID NO: 412105 - DNA, 20 bp, Artificial Sequence
  chemically synthesized
cctgtcttcaaacttattgg

SEQ ID NO: 412106 - DNA, 20 bp, Artificial Sequence
  chemically synthesized
aatcctgtcttcaaacttat

SEQ ID NO: 412107 - DNA, 20 bp, Artificial Sequence
  chemically synthesized
cccaactgccaataagtttg

SEQ ID NO: 412108 - DNA, 20 bp, Artificial Sequence
  chemically synthesized
actgccaataagtttgaaga

SEQ ID NO: 412109 - DNA, 20 bp, Artificial Sequence
  chemically synthesized
ctgccaataagtttgaagac

SEQ ID NO: 412110 - DNA, 20 bp, Artificial Sequence
  chemically synthesized
tgaagacaggattcaaacct

SEQ ID NO: 412111 - DNA, 20 bp, Artificial Sequence
  chemically synthesized
agatttggagaggcaaactg

SEQ ID NO: 412112 - DNA, 20 bp, Artificial Sequence
  chemically synthesized
gagatttggagaggcaaact

SEQ ID NO: 412113 - DNA, 20 bp, Artificial Sequence
  chemically synthesized
atagttcctgagatttggag

SEQ ID NO: 412114 - DNA, 20 bp, Artificial Sequence
  chemically synthesized
tatagttcctgagatttgga

SEQ ID NO: 412115 - DNA, 20 bp, Artificial Sequence
  chemically synthesized
cagtttgcctctccaaatct

SEQ ID NO: 412116 - DNA, 20 bp, Artificial Sequence
  chemically synthesized
ggtatagttcctgagatttg

SEQ ID NO: 412117 - DNA, 20 bp, Artificial Sequence
  chemically synthesized
agtttgcctctccaaatctc

SEQ ID NO: 412118 - DNA, 20 bp, Artificial Sequence
  chemically synthesized
ttggtatagttcctgagatt

SEQ ID NO: 412119 - DNA, 20 bp, Artificial Sequence
  chemically synthesized
catggcttggtatagttcct

SEQ ID NO: 412120 - DNA, 20 bp, Artificial Sequence
  chemically synthesized
caaatctcaggaactatacc

SEQ ID NO: 412121 - DNA, 20 bp, Artificial Sequence
  chemically synthesized
atgtaactcatggcttggta

SEQ ID NO: 412122 - DNA, 20 bp, Artificial Sequence
  chemically synthesized
caggaactataccaagccat

SEQ ID NO: 412123 - DNA, 20 bp, Artificial Sequence
  chemically synthesized
ttaatatgtaactcatggct

SEQ ID NO: 412124 - DNA, 20 bp, Artificial Sequence
  chemically synthesized
gctgtttaatatgtaactca

SEQ ID NO: 412125 - DNA, 20 bp, Artificial Sequence
  chemically synthesized
gccatgagttacatattaaa

SEQ ID NO: 412126 - DNA, 20 bp, Artificial Sequence
  chemically synthesized
gagttacatattaaacagct

SEQ ID NO: 412127 - DNA, 20 bp, Artificial Sequence
  chemically synthesized
agttacatattaaacagcta

SEQ ID NO: 412128 - DNA, 20 bp, Artificial Sequence
  chemically synthesized
tacatattaaacagctaagg

SEQ ID NO: 412129 - DNA, 20 bp, Artificial Sequence
  chemically synthesized
acatattaaacagctaaggc

SEQ ID NO: 412130 - DNA, 20 bp, Artificial Sequence
  chemically synthesized
tattaaacagctaaggcagg

SEQ ID NO: 412131 - DNA, 20 bp, Artificial Sequence
  chemically synthesized
gccaccacgcccacctgcct

SEQ ID NO: 412132 - DNA, 20 bp, Artificial Sequence
  chemically synthesized
attaaacagctaaggcaggt

SEQ ID NO: 412133 - DNA, 20 bp, Artificial Sequence
  chemically synthesized
acagctaaggcaggtgggcg

SEQ ID NO: 412134 - DNA, 20 bp, Artificial Sequence
  chemically synthesized
gctaaggcaggtgggcgtgg

SEQ ID NO: 412135 - DNA, 20 bp, Artificial Sequence
  chemically synthesized
agtgctgggattacaggcat

SEQ ID NO: 412136 - DNA, 20 bp, Artificial Sequence
  chemically synthesized
gtggctcatgcctgtaatcc

SEQ ID NO: 412137 - DNA, 20 bp, Artificial Sequence
  chemically synthesized
tcccaaagtgctgggattac

SEQ ID NO: 412138 - DNA, 20 bp, Artificial Sequence
  chemically synthesized
ctcccaaagtgctgggatta

SEQ ID NO: 412139 - DNA, 20 bp, Artificial Sequence
  chemically synthesized
tgcctgtaatcccagcactt

SEQ ID NO: 412140 - DNA, 20 bp, Artificial Sequence
  chemically synthesized
cctcagcctcccaaagtgct

SEQ ID NO: 412141 - DNA, 20 bp, Artificial Sequence
  chemically synthesized
gcctgtaatcccagcacttt

SEQ ID NO: 412142 - DNA, 20 bp, Artificial Sequence
  chemically synthesized
acctcagcctcccaaagtgc

SEQ ID NO: 412143 - DNA, 20 bp, Artificial Sequence
  chemically synthesized
ctgtaatcccagcactttgg

SEQ ID NO: 412144 - DNA, 20 bp, Artificial Sequence
  chemically synthesized
tgtaatcccagcactttggg

SEQ ID NO: 412145 - DNA, 20 bp, Artificial Sequence
  chemically synthesized
ccacccacctcagcctccca

SEQ ID NO: 412146 - DNA, 20 bp, Artificial Sequence
  chemically synthesized
tcccagcactttgggaggct

SEQ ID NO: 412147 - DNA, 20 bp, Artificial Sequence
  chemically synthesized
cccagcactttgggaggctg

SEQ ID NO: 412148 - DNA, 20 bp, Artificial Sequence
  chemically synthesized
agcactttgggaggctgagg

SEQ ID NO: 412149 - DNA, 20 bp, Artificial Sequence
  chemically synthesized
gcactttgggaggctgaggt

SEQ ID NO: 412150 - DNA, 20 bp, Artificial Sequence
  chemically synthesized
ctttgggaggctgaggtggg

SEQ ID NO: 412151 - DNA, 20 bp, Artificial Sequence
  chemically synthesized
ctcaggtgacccacccacct

SEQ ID NO: 412152 - DNA, 20 bp, Artificial Sequence
  chemically synthesized
tttgggaggctgaggtgggt

SEQ ID NO: 412153 - DNA, 20 bp, Artificial Sequence
  chemically synthesized
ctgaggtgggtgggtcacct

SEQ ID NO: 412154 - DNA, 20 bp, Artificial Sequence
  chemically synthesized
tgaggtgggtgggtcacctg

SEQ ID NO: 412155 - DNA, 20 bp, Artificial Sequence
  chemically synthesized
gtgggtgggtcacctgaggt

SEQ ID NO: 412156 - DNA, 20 bp, Artificial Sequence
  chemically synthesized
tgggtgggtcacctgaggtc

SEQ ID NO: 412157 - DNA, 20 bp, Artificial Sequence
  chemically synthesized
ggtctcgaactcctgacctc

SEQ ID NO: 412158 - DNA, 20 bp, Artificial Sequence
  chemically synthesized
ggtgggtcacctgaggtcag

SEQ ID NO: 412159 - DNA, 20 bp, Artificial Sequence
  chemically synthesized
tggtctcgaactcctgacct

SEQ ID NO: 412160 - DNA, 20 bp, Artificial Sequence
  chemically synthesized
tcacctgaggtcaggagttc

SEQ ID NO: 412161 - DNA, 20 bp, Artificial Sequence
  chemically synthesized
tgaggtcaggagttcgagac

SEQ ID NO: 412162 - DNA, 20 bp, Artificial Sequence
  chemically synthesized
tcaggagttcgagaccagcc

SEQ ID NO: 412163 - DNA, 20 bp, Artificial Sequence
  chemically synthesized
tttcaccacattggccaggc

SEQ ID NO: 412164 - DNA, 20 bp, Artificial Sequence
  chemically synthesized
ggggtttcaccacattggcc

SEQ ID NO: 412165 - DNA, 20 bp, Artificial Sequence
  chemically synthesized
cgagaccagcctggccaatg

SEQ ID NO: 412166 - DNA, 20 bp, Artificial Sequence
  chemically synthesized
cggggtttcaccacattggc

SEQ ID NO: 412167 - DNA, 20 bp, Artificial Sequence
  chemically synthesized
gagacggggtttcaccacat

SEQ ID NO: 412168 - DNA, 20 bp, Artificial Sequence
  chemically synthesized
ttgtgtttttagtagagacg

SEQ ID NO: 412169 - DNA, 20 bp, Artificial Sequence
  chemically synthesized
tttgtgtttttagtagagac

SEQ ID NO: 412170 - DNA, 20 bp, Artificial Sequence
  chemically synthesized
ttttgtgtttttagtagaga

SEQ ID NO: 412171 - DNA, 20 bp, Artificial Sequence
  chemically synthesized
aattttttgtgtttttagta

SEQ ID NO: 412172 - DNA, 20 bp, Artificial Sequence
  chemically synthesized
ctaattttttgtgtttttag

SEQ ID NO: 412173 - DNA, 20 bp, Artificial Sequence
  chemically synthesized
cggctaattttttgtgtttt

SEQ ID NO: 412174 - DNA, 20 bp, Artificial Sequence
  chemically synthesized
ctactaaaaacacaaaaaat

SEQ ID NO: 412175 - DNA, 20 bp, Artificial Sequence
  chemically synthesized
taaaaacacaaaaaattagc

SEQ ID NO: 412176 - DNA, 20 bp, Artificial Sequence
  chemically synthesized
aaaaacacaaaaaattagcc

SEQ ID NO: 412177 - DNA, 20 bp, Artificial Sequence
  chemically synthesized
cacaaaaaattagccgggct

SEQ ID NO: 412178 - DNA, 20 bp, Artificial Sequence
  chemically synthesized
aaaaaattagccgggcttgg

SEQ ID NO: 412179 - DNA, 20 bp, Artificial Sequence
  chemically synthesized
cgggcacccgccaccaagcc

SEQ ID NO: 412180 - DNA, 20 bp, Artificial Sequence
  chemically synthesized
aaattagccgggcttggtgg

SEQ ID NO: 412181 - DNA, 20 bp, Artificial Sequence
  chemically synthesized
aattagccgggcttggtggc

SEQ ID NO: 412182 - DNA, 20 bp, Artificial Sequence
  chemically synthesized
gattacgggcacccgccacc

SEQ ID NO: 412183 - DNA, 20 bp, Artificial Sequence
  chemically synthesized
gtggcgggtgcccgtaatcc

SEQ ID NO: 412184 - DNA, 20 bp, Artificial Sequence
  chemically synthesized
tctcgagtagctaggattac

SEQ ID NO: 412185 - DNA, 20 bp, Artificial Sequence
  chemically synthesized
ctctcgagtagctaggatta

SEQ ID NO: 412186 - DNA, 20 bp, Artificial Sequence
  chemically synthesized
cctcagcctctcgagtagct

SEQ ID NO: 412187 - DNA, 20 bp, Artificial Sequence
  chemically synthesized
gcccgtaatcctagctactc

SEQ ID NO: 412188 - DNA, 20 bp, Artificial Sequence
  chemically synthesized
gcctcagcctctcgagtagc

SEQ ID NO: 412189 - DNA, 20 bp, Artificial Sequence
  chemically synthesized
ccgtaatcctagctactcga

SEQ ID NO: 412190 - DNA, 20 bp, Artificial Sequence
  chemically synthesized
cgtaatcctagctactcgag

SEQ ID NO: 412191 - DNA, 20 bp, Artificial Sequence
  chemically synthesized
tcctgcctcagcctctcgag

SEQ ID NO: 412192 - DNA, 20 bp, Artificial Sequence
  chemically synthesized
ttctcctgcctcagcctctc

SEQ ID NO: 412193 - DNA, 20 bp, Artificial Sequence
  chemically synthesized
tcctagctactcgagaggct

SEQ ID NO: 412194 - DNA, 20 bp, Artificial Sequence
  chemically synthesized
cctagctactcgagaggctg

SEQ ID NO: 412195 - DNA, 20 bp, Artificial Sequence
  chemically synthesized
agctactcgagaggctgagg

SEQ ID NO: 412196 - DNA, 20 bp, Artificial Sequence
  chemically synthesized
gctactcgagaggctgaggc

SEQ ID NO: 412197 - DNA, 20 bp, Artificial Sequence
  chemically synthesized
tactcgagaggctgaggcag

SEQ ID NO: 412198 - DNA, 20 bp, Artificial Sequence
  chemically synthesized
ttcaagtgattctcctgcct

SEQ ID NO: 412199 - DNA, 20 bp, Artificial Sequence
  chemically synthesized
gcaggagaatcacttgaacc

SEQ ID NO: 412200 - DNA, 20 bp, Artificial Sequence
  chemically synthesized
aacctccgcctgccaggttc

SEQ ID NO: 412201 - DNA, 20 bp, Artificial Sequence
  chemically synthesized
ggagaatcacttgaacctgg

SEQ ID NO: 412202 - DNA, 20 bp, Artificial Sequence
  chemically synthesized
gagaatcacttgaacctggc

SEQ ID NO: 412203 - DNA, 20 bp, Artificial Sequence
  chemically synthesized
aatcacttgaacctggcagg

SEQ ID NO: 412204 - DNA, 20 bp, Artificial Sequence
  chemically synthesized
cactgcaacctccgcctgcc

SEQ ID NO: 412205 - DNA, 20 bp, Artificial Sequence
  chemically synthesized
tcacttgaacctggcaggcg

SEQ ID NO: 412206 - DNA, 20 bp, Artificial Sequence
  chemically synthesized
tcactgcaacctccgcctgc

SEQ ID NO: 412207 - DNA, 20 bp, Artificial Sequence
  chemically synthesized
cacttgaacctggcaggcgg

SEQ ID NO: 412208 - DNA, 20 bp, Artificial Sequence
  chemically synthesized
aacctggcaggcggaggttg

SEQ ID NO: 412209 - DNA, 20 bp, Artificial Sequence
  chemically synthesized
tggcaggcggaggttgcagt

SEQ ID NO: 412210 - DNA, 20 bp, Artificial Sequence
  chemically synthesized
ggcggaggttgcagtgagcc

SEQ ID NO: 412211 - DNA, 20 bp, Artificial Sequence
  chemically synthesized
ggagtgcggtgatgcgatct

SEQ ID NO: 412212 - DNA, 20 bp, Artificial Sequence
  chemically synthesized
tcgttgtccaggatggagtg

SEQ ID NO: 412213 - DNA, 20 bp, Artificial Sequence
  chemically synthesized
cgcatcaccgcactccatcc

SEQ ID NO: 412214 - DNA, 20 bp, Artificial Sequence
  chemically synthesized
tgctctcgttgtccaggatg

SEQ ID NO: 412215 - DNA, 20 bp, Artificial Sequence
  chemically synthesized
tttgctctcgttgtccagga

SEQ ID NO: 412216 - DNA, 20 bp, Artificial Sequence
  chemically synthesized
cgcactccatcctggacaac

SEQ ID NO: 412217 - DNA, 20 bp, Artificial Sequence
  chemically synthesized
gagttttgctctcgttgtcc

SEQ ID NO: 412218 - DNA, 20 bp, Artificial Sequence
  chemically synthesized
agagttttgctctcgttgtc

SEQ ID NO: 412219 - DNA, 20 bp, Artificial Sequence
  chemically synthesized
cactccatcctggacaacga

SEQ ID NO: 412220 - DNA, 20 bp, Artificial Sequence
  chemically synthesized
ttatttatttatttgagaca

SEQ ID NO: 412221 - DNA, 20 bp, Artificial Sequence
  chemically synthesized
atttatttatttatttgaga

SEQ ID NO: 412222 - DNA, 20 bp, Artificial Sequence
  chemically synthesized
atttatttatttatttattt

SEQ ID NO: 412223 - DNA, 20 bp, Artificial Sequence
  chemically synthesized
taaataaataaataaataaa

SEQ ID NO: 412224 - DNA, 20 bp, Artificial Sequence
  chemically synthesized
aaataaataaataaacagct

SEQ ID NO: 412225 - DNA, 20 bp, Artificial Sequence
  chemically synthesized
aataaataaataaacagcta

SEQ ID NO: 412226 - DNA, 20 bp, Artificial Sequence
  chemically synthesized
aaataaacagctaaggctaa

SEQ ID NO: 412227 - DNA, 20 bp, Artificial Sequence
  chemically synthesized
ttaatattgactgttagcct

SEQ ID NO: 412228 - DNA, 20 bp, Artificial Sequence
  chemically synthesized
taatttttaatattgactgt

SEQ ID NO: 412229 - DNA, 20 bp, Artificial Sequence
  chemically synthesized
attaaaaattataaacacta

SEQ ID NO: 412230 - DNA, 20 bp, Artificial Sequence
  chemically synthesized
aataagttagagaaacactt

SEQ ID NO: 412231 - DNA, 20 bp, Artificial Sequence
  chemically synthesized
aaatgcaaaataataagtta

SEQ ID NO: 412232 - DNA, 20 bp, Artificial Sequence
  chemically synthesized
ttaaatgcaaaataataagt

SEQ ID NO: 412233 - DNA, 20 bp, Artificial Sequence
  chemically synthesized
tttgttaaatgcaaaataat

SEQ ID NO: 412234 - DNA, 20 bp, Artificial Sequence
  chemically synthesized
caatagactttatgggaaaa

SEQ ID NO: 412235 - DNA, 20 bp, Artificial Sequence
  chemically synthesized
caaaataccattttcccata

SEQ ID NO: 412236 - DNA, 20 bp, Artificial Sequence
  chemically synthesized
gctttaacaatagactttat

SEQ ID NO: 412237 - DNA, 20 bp, Artificial Sequence
  chemically synthesized
tgctttaacaatagacttta

SEQ ID NO: 412238 - DNA, 20 bp, Artificial Sequence
  chemically synthesized
tcccataaagtctattgtta

SEQ ID NO: 412239 - DNA, 20 bp, Artificial Sequence
  chemically synthesized
tatttagtttgctttaacaa

SEQ ID NO: 412240 - DNA, 20 bp, Artificial Sequence
  chemically synthesized
ttgttaaagcaaactaaata

SEQ ID NO: 412241 - DNA, 20 bp, Artificial Sequence
  chemically synthesized
agtccttctcaggccgtatt

SEQ ID NO: 412242 - DNA, 20 bp, Artificial Sequence
  chemically synthesized
aagcaaactaaatacggcct

SEQ ID NO: 412243 - DNA, 20 bp, Artificial Sequence
  chemically synthesized
caaactaaatacggcctgag

SEQ ID NO: 412244 - DNA, 20 bp, Artificial Sequence
  chemically synthesized
aaactaaatacggcctgaga

SEQ ID NO: 412245 - DNA, 20 bp, Artificial Sequence
  chemically synthesized
agaagtacggagtccttctc

SEQ ID NO: 412246 - DNA, 20 bp, Artificial Sequence
  chemically synthesized
tagaagtacggagtccttct

SEQ ID NO: 412247 - DNA, 20 bp, Artificial Sequence
  chemically synthesized
gactcaaatatagaagtacg

SEQ ID NO: 412248 - DNA, 20 bp, Artificial Sequence
  chemically synthesized
gggactcaaatatagaagta

SEQ ID NO: 412249 - DNA, 20 bp, Artificial Sequence
  chemically synthesized
ccacagggactcaaatatag

SEQ ID NO: 412250 - DNA, 20 bp, Artificial Sequence
  chemically synthesized
gactccgtacttctatattt

SEQ ID NO: 412251 - DNA, 20 bp, Artificial Sequence
  chemically synthesized
catccacagggactcaaata

SEQ ID NO: 412252 - DNA, 20 bp, Artificial Sequence
  chemically synthesized
cttctatatttgagtccctg

SEQ ID NO: 412253 - DNA, 20 bp, Artificial Sequence
  chemically synthesized
taggttgtagttcatccaca

SEQ ID NO: 412254 - DNA, 20 bp, Artificial Sequence
  chemically synthesized
ataggttgtagttcatccac

SEQ ID NO: 412255 - DNA, 20 bp, Artificial Sequence
  chemically synthesized
gataggttgtagttcatcca

SEQ ID NO: 412256 - DNA, 20 bp, Artificial Sequence
  chemically synthesized
ctacctattgagataggttg

SEQ ID NO: 412257 - DNA, 20 bp, Artificial Sequence
  chemically synthesized
tgaactacaacctatctcaa

SEQ ID NO: 412258 - DNA, 20 bp, Artificial Sequence
  chemically synthesized
tcttgtctacctattgagat

SEQ ID NO: 412259 - DNA, 20 bp, Artificial Sequence
  chemically synthesized
gaactacaacctatctcaat

SEQ ID NO: 412260 - DNA, 20 bp, Artificial Sequence
  chemically synthesized
atcttgtctacctattgaga

SEQ ID NO: 412261 - DNA, 20 bp, Artificial Sequence
  chemically synthesized
ctacaacctatctcaatagg

SEQ ID NO: 412262 - DNA, 20 bp, Artificial Sequence
  chemically synthesized
ttcaatcttgtctacctatt

SEQ ID NO: 412263 - DNA, 20 bp, Artificial Sequence
  chemically synthesized
acctatctcaataggtagac

SEQ ID NO: 412264 - DNA, 20 bp, Artificial Sequence
  chemically synthesized
acaagattgaaaaactaact

SEQ ID NO: 412265 - DNA, 20 bp, Artificial Sequence
  chemically synthesized
caagattgaaaaactaactt

SEQ ID NO: 412266 - DNA, 20 bp, Artificial Sequence
  chemically synthesized
agattgaaaaactaacttag

SEQ ID NO: 412267 - DNA, 20 bp, Artificial Sequence
  chemically synthesized
acaggcccatactcctaagt

SEQ ID NO: 412268 - DNA, 20 bp, Artificial Sequence
  chemically synthesized
gaaaaactaacttaggagta

SEQ ID NO: 412269 - DNA, 20 bp, Artificial Sequence
  chemically synthesized
tgtcacaggcccatactcct

SEQ ID NO: 412270 - DNA, 20 bp, Artificial Sequence
  chemically synthesized
aaaaactaacttaggagtat

SEQ ID NO: 412271 - DNA, 20 bp, Artificial Sequence
  chemically synthesized
caagactgagtgattgtcac

SEQ ID NO: 412272 - DNA, 20 bp, Artificial Sequence
  chemically synthesized
ccaagactgagtgattgtca

SEQ ID NO: 412273 - DNA, 20 bp, Artificial Sequence
  chemically synthesized
atgggcctgtgacaatcact

SEQ ID NO: 412274 - DNA, 20 bp, Artificial Sequence
  chemically synthesized
ctgtgacaatcactcagtct

SEQ ID NO: 412275 - DNA, 20 bp, Artificial Sequence
  chemically synthesized
ggctgggattggccaagact

SEQ ID NO: 412276 - DNA, 20 bp, Artificial Sequence
  chemically synthesized
aatggcggctgggattggcc

SEQ ID NO: 412277 - DNA, 20 bp, Artificial Sequence
  chemically synthesized
cactcagtcttggccaatcc

SEQ ID NO: 412278 - DNA, 20 bp, Artificial Sequence
  chemically synthesized
tgaagaatggcggctgggat

SEQ ID NO: 412279 - DNA, 20 bp, Artificial Sequence
  chemically synthesized
ctggctgaagaatggcggct

SEQ ID NO: 412280 - DNA, 20 bp, Artificial Sequence
  chemically synthesized
actggctgaagaatggcggc

SEQ ID NO: 412281 - DNA, 20 bp, Artificial Sequence
  chemically synthesized
tataactggctgaagaatgg

SEQ ID NO: 412282 - DNA, 20 bp, Artificial Sequence
  chemically synthesized
caatcccagccgccattctt

SEQ ID NO: 412283 - DNA, 20 bp, Artificial Sequence
  chemically synthesized
gtgtataactggctgaagaa

SEQ ID NO: 412284 - DNA, 20 bp, Artificial Sequence
  chemically synthesized
cccagccgccattcttcagc

SEQ ID NO: 412285 - DNA, 20 bp, Artificial Sequence
  chemically synthesized
cagcagtgtataactggctg

SEQ ID NO: 412286 - DNA, 20 bp, Artificial Sequence
  chemically synthesized
aacaatcagcagtgtataac

SEQ ID NO: 412287 - DNA, 20 bp, Artificial Sequence
  chemically synthesized
aacacagtttgaacaatcag

SEQ ID NO: 412288 - DNA, 20 bp, Artificial Sequence
  chemically synthesized
ttgaacacagtttgaacaat

SEQ ID NO: 412289 - DNA, 20 bp, Artificial Sequence
  chemically synthesized
ctgtttgccttatttgaaca

SEQ ID NO: 412290 - DNA, 20 bp, Artificial Sequence
  chemically synthesized
tgttcaaactgtgttcaaat

SEQ ID NO: 412291 - DNA, 20 bp, Artificial Sequence
  chemically synthesized
gttcaaactgtgttcaaata

SEQ ID NO: 412292 - DNA, 20 bp, Artificial Sequence
  chemically synthesized
ctgtgttcaaataaggcaaa

SEQ ID NO: 412293 - DNA, 20 bp, Artificial Sequence
  chemically synthesized
gttcaaataaggcaaacagc

SEQ ID NO: 412294 - DNA, 20 bp, Artificial Sequence
  chemically synthesized
agaaacagctggattggtta

SEQ ID NO: 412295 - DNA, 20 bp, Artificial Sequence
  chemically synthesized
acagcgagctgtaaccaatc

SEQ ID NO: 412296 - DNA, 20 bp, Artificial Sequence
  chemically synthesized
agatgcagaaacagctggat

SEQ ID NO: 412297 - DNA, 20 bp, Artificial Sequence
  chemically synthesized
aagtgagatgcagaaacagc

SEQ ID NO: 412298 - DNA, 20 bp, Artificial Sequence
  chemically synthesized
tcggaagtgagatgcagaaa

SEQ ID NO: 412299 - DNA, 20 bp, Artificial Sequence
  chemically synthesized
tagaaatcggaagtgagatg

SEQ ID NO: 412300 - DNA, 20 bp, Artificial Sequence
  chemically synthesized
gacatgtagaaatcggaagt

SEQ ID NO: 412301 - DNA, 20 bp, Artificial Sequence
  chemically synthesized
aagtgacatgtagaaatcgg

SEQ ID NO: 412302 - DNA, 20 bp, Artificial Sequence
  chemically synthesized
gtaaagtgacatgtagaaat

SEQ ID NO: 412303 - DNA, 20 bp, Artificial Sequence
  chemically synthesized
aaaaaaagtaaagtgacatg

SEQ ID NO: 412304 - DNA, 20 bp, Artificial Sequence
  chemically synthesized
tttatagacaaaaaaaagta

SEQ ID NO: 412305 - DNA, 20 bp, Artificial Sequence
  chemically synthesized
ataaatttatagacaaaaaa

SEQ ID NO: 412306 - DNA, 20 bp, Artificial Sequence
  chemically synthesized
ttgtggtcagaataaattta

SEQ ID NO: 412307 - DNA, 20 bp, Artificial Sequence
  chemically synthesized
tataaatttattctgaccac

SEQ ID NO: 412308 - DNA, 20 bp, Artificial Sequence
  chemically synthesized
ataaatttattctgaccaca

SEQ ID NO: 412309 - DNA, 20 bp, Artificial Sequence
  chemically synthesized
ctccaggggtgccttgtggt

SEQ ID NO: 412310 - DNA, 20 bp, Artificial Sequence
  chemically synthesized
gagactccaggggtgccttg

SEQ ID NO: 412311 - DNA, 20 bp, Artificial Sequence
  chemically synthesized
ttctgaccacaaggcacccc

SEQ ID NO: 412312 - DNA, 20 bp, Artificial Sequence
  chemically synthesized
ctgaccacaaggcacccctg

SEQ ID NO: 412313 - DNA, 20 bp, Artificial Sequence
  chemically synthesized
cagattcagagagactccag

SEQ ID NO: 412314 - DNA, 20 bp, Artificial Sequence
  chemically synthesized
gcagattcagagagactcca

SEQ ID NO: 412315 - DNA, 20 bp, Artificial Sequence
  chemically synthesized
agcagattcagagagactcc

SEQ ID NO: 412316 - DNA, 20 bp, Artificial Sequence
  chemically synthesized
cagcagattcagagagactc

SEQ ID NO: 412317 - DNA, 20 bp, Artificial Sequence
  chemically synthesized
agaattacagcagattcaga

SEQ ID NO: 412318 - DNA, 20 bp, Artificial Sequence
  chemically synthesized
tcagaattacagcagattca

SEQ ID NO: 412319 - DNA, 20 bp, Artificial Sequence
  chemically synthesized
cctcagaattacagcagatt

SEQ ID NO: 412320 - DNA, 20 bp, Artificial Sequence
  chemically synthesized
ggcagccctcagaattacag

SEQ ID NO: 412321 - DNA, 20 bp, Artificial Sequence
  chemically synthesized
tctgaatctgctgtaattct

SEQ ID NO: 412322 - DNA, 20 bp, Artificial Sequence
  chemically synthesized
tcaggcagccctcagaatta

SEQ ID NO: 412323 - DNA, 20 bp, Artificial Sequence
  chemically synthesized
ctgaatctgctgtaattctg

SEQ ID NO: 412324 - DNA, 20 bp, Artificial Sequence
  chemically synthesized
tgaatctgctgtaattctga

SEQ ID NO: 412325 - DNA, 20 bp, Artificial Sequence
  chemically synthesized
tttgcgaatcaggcagccct

SEQ ID NO: 412326 - DNA, 20 bp, Artificial Sequence
  chemically synthesized
tgaacgatttgcgaatcagg

SEQ ID NO: 412327 - DNA, 20 bp, Artificial Sequence
  chemically synthesized
caatgaacgatttgcgaatc

SEQ ID NO: 412328 - DNA, 20 bp, Artificial Sequence
  chemically synthesized
gcaatgaacgatttgcgaat

SEQ ID NO: 412329 - DNA, 20 bp, Artificial Sequence
  chemically synthesized
aaagttaaaggagtttaatt

SEQ ID NO: 412330 - DNA, 20 bp, Artificial Sequence
  chemically synthesized
gagccaaattaaagttaaag

SEQ ID NO: 412331 - DNA, 20 bp, Artificial Sequence
  chemically synthesized
ttgagccaaattaaagttaa

SEQ ID NO: 412332 - DNA, 20 bp, Artificial Sequence
  chemically synthesized
cttgagccaaattaaagtta

SEQ ID NO: 412333 - DNA, 20 bp, Artificial Sequence
  chemically synthesized
aaactcctttaactttaatt

SEQ ID NO: 412334 - DNA, 20 bp, Artificial Sequence
  chemically synthesized
gaaaaacttgagccaaatta

SEQ ID NO: 412335 - DNA, 20 bp, Artificial Sequence
  chemically synthesized
ctttaactttaatttggctc

SEQ ID NO: 412336 - DNA, 20 bp, Artificial Sequence
  chemically synthesized
tagtgttaaaagaaaaactt

SEQ ID NO: 412337 - DNA, 20 bp, Artificial Sequence
  chemically synthesized
aaaaaaaaatatagtgttaa

SEQ ID NO: 412338 - DNA, 20 bp, Artificial Sequence
  chemically synthesized
aaagacaaaaaaaaaaaata

SEQ ID NO: 412339 - DNA, 20 bp, Artificial Sequence
  chemically synthesized
tattttttttttttgtcttt

SEQ ID NO: 412340 - DNA, 20 bp, Artificial Sequence
  chemically synthesized
atttttaaaaatgatgctaa

SEQ ID NO: 412341 - DNA, 20 bp, Artificial Sequence
  chemically synthesized
tttagcatcatttttaaaaa

SEQ ID NO: 412342 - DNA, 20 bp, Artificial Sequence
  chemically synthesized
tagcaaccactgaatcaaag

SEQ ID NO: 412343 - DNA, 20 bp, Artificial Sequence
  chemically synthesized
agcatttaactcctttgatt

SEQ ID NO: 412344 - DNA, 20 bp, Artificial Sequence
  chemically synthesized
catagcaaccactgaatcaa

SEQ ID NO: 412345 - DNA, 20 bp, Artificial Sequence
  chemically synthesized
ccatagcaaccactgaatca

SEQ ID NO: 412346 - DNA, 20 bp, Artificial Sequence
  chemically synthesized
atttaactcctttgattcag

SEQ ID NO: 412347 - DNA, 20 bp, Artificial Sequence
  chemically synthesized
ctttgattcagtggttgcta

SEQ ID NO: 412348 - DNA, 20 bp, Artificial Sequence
  chemically synthesized
ggggataaatagtgaaacca

SEQ ID NO: 412349 - DNA, 20 bp, Artificial Sequence
  chemically synthesized
taaattttggaggggataaa

SEQ ID NO: 412350 - DNA, 20 bp, Artificial Sequence
  chemically synthesized
ctgggggttaaattttggag

SEQ ID NO: 412351 - DNA, 20 bp, Artificial Sequence
  chemically synthesized
actgggggttaaattttgga

SEQ ID NO: 412352 - DNA, 20 bp, Artificial Sequence
  chemically synthesized
cactgggggttaaattttgg

SEQ ID NO: 412353 - DNA, 20 bp, Artificial Sequence
  chemically synthesized
acactgggggttaaattttg

SEQ ID NO: 412354 - DNA, 20 bp, Artificial Sequence
  chemically synthesized
ccacactgggggttaaattt

SEQ ID NO: 412355 - DNA, 20 bp, Artificial Sequence
  chemically synthesized
cccctccaaaatttaacccc

SEQ ID NO: 412356 - DNA, 20 bp, Artificial Sequence
  chemically synthesized
ccaaaatttaacccccagtg

SEQ ID NO: 412357 - DNA, 20 bp, Artificial Sequence
  chemically synthesized
tctcaatactgccacactgg

SEQ ID NO: 412358 - DNA, 20 bp, Artificial Sequence
  chemically synthesized
ctctcaatactgccacactg

SEQ ID NO: 412359 - DNA, 20 bp, Artificial Sequence
  chemically synthesized
aaatttaacccccagtgtgg

SEQ ID NO: 412360 - DNA, 20 bp, Artificial Sequence
  chemically synthesized
cctctcaatactgccacact

SEQ ID NO: 412361 - DNA, 20 bp, Artificial Sequence
  chemically synthesized
ccctctcaatactgccacac

SEQ ID NO: 412362 - DNA, 20 bp, Artificial Sequence
  chemically synthesized
acccccagtgtggcagtatt

SEQ ID NO: 412363 - DNA, 20 bp, Artificial Sequence
  chemically synthesized
ccccagtgtggcagtattga

SEQ ID NO: 412364 - DNA, 20 bp, Artificial Sequence
  chemically synthesized
cccagtgtggcagtattgag

SEQ ID NO: 412365 - DNA, 20 bp, Artificial Sequence
  chemically synthesized
ccagtgtggcagtattgaga

SEQ ID NO: 412366 - DNA, 20 bp, Artificial Sequence
  chemically synthesized
cagtgtggcagtattgagag

SEQ ID NO: 412367 - DNA, 20 bp, Artificial Sequence
  chemically synthesized
gtgtggcagtattgagaggg

SEQ ID NO: 412368 - DNA, 20 bp, Artificial Sequence
  chemically synthesized
tgtggcagtattgagagggg

SEQ ID NO: 412369 - DNA, 20 bp, Artificial Sequence
  chemically synthesized
tattgagaggggaggccttt

SEQ ID NO: 412370 - DNA, 20 bp, Artificial Sequence
  chemically synthesized
ttgagaggggaggcctttaa

SEQ ID NO: 412371 - DNA, 20 bp, Artificial Sequence
  chemically synthesized
tgagaggggaggcctttaag

SEQ ID NO: 412372 - DNA, 20 bp, Artificial Sequence
  chemically synthesized
atgatccaagtgcctcttaa

SEQ ID NO: 412373 - DNA, 20 bp, Artificial Sequence
  chemically synthesized
catgatccaagtgcctctta

SEQ ID NO: 412374 - DNA, 20 bp, Artificial Sequence
  chemically synthesized
ggaggcctttaagaggcact

SEQ ID NO: 412375 - DNA, 20 bp, Artificial Sequence
  chemically synthesized
gggcagaactttcatgatcc

SEQ ID NO: 412376 - DNA, 20 bp, Artificial Sequence
  chemically synthesized
aagaggcacttggatcatga

SEQ ID NO: 412377 - DNA, 20 bp, Artificial Sequence
  chemically synthesized
tcatgaaagttctgccctaa

SEQ ID NO: 412378 - DNA, 20 bp, Artificial Sequence
  chemically synthesized
aactcattaatccattaggg

SEQ ID NO: 412379 - DNA, 20 bp, Artificial Sequence
  chemically synthesized
attaactcattaatccatta

SEQ ID NO: 412380 - DNA, 20 bp, Artificial Sequence
  chemically synthesized
cattaactcattaatccatt

SEQ ID NO: 412381 - DNA, 20 bp, Artificial Sequence
  chemically synthesized
ccattaactcattaatccat

SEQ ID NO: 412382 - DNA, 20 bp, Artificial Sequence
  chemically synthesized
ttctgccctaatggattaat

SEQ ID NO: 412383 - DNA, 20 bp, Artificial Sequence
  chemically synthesized
ctaatggattaatgagttaa

SEQ ID NO: 412384 - DNA, 20 bp, Artificial Sequence
  chemically synthesized
aatggattaatgcattatca

SEQ ID NO: 412385 - DNA, 20 bp, Artificial Sequence
  chemically synthesized
atggattaatgcattatcat

SEQ ID NO: 412386 - DNA, 20 bp, Artificial Sequence
  chemically synthesized
ttaatgcattatcatgggaa

SEQ ID NO: 412387 - DNA, 20 bp, Artificial Sequence
  chemically synthesized
cattatcatgggaatggcac

SEQ ID NO: 412388 - DNA, 20 bp, Artificial Sequence
  chemically synthesized
tatcatgggaatggcactgg

SEQ ID NO: 412389 - DNA, 20 bp, Artificial Sequence
  chemically synthesized
ctctcttcttatcaagccac

SEQ ID NO: 412390 - DNA, 20 bp, Artificial Sequence
  chemically synthesized
aatggcactggtggcttgat

SEQ ID NO: 412391 - DNA, 20 bp, Artificial Sequence
  chemically synthesized
ggcactggtggcttgataag

SEQ ID NO: 412392 - DNA, 20 bp, Artificial Sequence
  chemically synthesized
ctcaggtctctcttcttatc

SEQ ID NO: 412393 - DNA, 20 bp, Artificial Sequence
  chemically synthesized
cactggtggcttgataagaa

SEQ ID NO: 412394 - DNA, 20 bp, Artificial Sequence
  chemically synthesized
ctggtggcttgataagaaga

SEQ ID NO: 412395 - DNA, 20 bp, Artificial Sequence
  chemically synthesized
cttgataagaagagagacct

SEQ ID NO: 412396 - DNA, 20 bp, Artificial Sequence
  chemically synthesized
ataagaagagagacctgagc

SEQ ID NO: 412397 - DNA, 20 bp, Artificial Sequence
  chemically synthesized
gtatgctaacttgctagctc

SEQ ID NO: 412398 - DNA, 20 bp, Artificial Sequence
  chemically synthesized
gaagagagacctgagctagc

SEQ ID NO: 412399 - DNA, 20 bp, Artificial Sequence
  chemically synthesized
tgtatgctaacttgctagct

SEQ ID NO: 412400 - DNA, 20 bp, Artificial Sequence
  chemically synthesized
agagacctgagctagcaagt

SEQ ID NO: 412401 - DNA, 20 bp, Artificial Sequence
  chemically synthesized
ggctgtgtatgctaacttgc

SEQ ID NO: 412402 - DNA, 20 bp, Artificial Sequence
  chemically synthesized
agctagcaagttagcataca

SEQ ID NO: 412403 - DNA, 20 bp, Artificial Sequence
  chemically synthesized
tggggcatcacatggcagga

SEQ ID NO: 412404 - DNA, 20 bp, Artificial Sequence
  chemically synthesized
ctggggcatcacatggcagg

SEQ ID NO: 412405 - DNA, 20 bp, Artificial Sequence
  chemically synthesized
cctggggcatcacatggcag

SEQ ID NO: 412406 - DNA, 20 bp, Artificial Sequence
  chemically synthesized
ggcctggggcatcacatggc

SEQ ID NO: 412407 - DNA, 20 bp, Artificial Sequence
  chemically synthesized
tggcctggggcatcacatgg

SEQ ID NO: 412408 - DNA, 20 bp, Artificial Sequence
  chemically synthesized
caatggcctggggcatcaca

SEQ ID NO: 412409 - DNA, 20 bp, Artificial Sequence
  chemically synthesized
cctcctgccatgtgatgccc

SEQ ID NO: 412410 - DNA, 20 bp, Artificial Sequence
  chemically synthesized
ctcctgccatgtgatgcccc

SEQ ID NO: 412411 - DNA, 20 bp, Artificial Sequence
  chemically synthesized
tacagggtcccaatggcctg

SEQ ID NO: 412412 - DNA, 20 bp, Artificial Sequence
  chemically synthesized
catgtgatgccccaggccat

SEQ ID NO: 412413 - DNA, 20 bp, Artificial Sequence
  chemically synthesized
ctacagggtcccaatggcct

SEQ ID NO: 412414 - DNA, 20 bp, Artificial Sequence
  chemically synthesized
atgtgatgccccaggccatt

SEQ ID NO: 412415 - DNA, 20 bp, Artificial Sequence
  chemically synthesized
tctacagggtcccaatggcc

SEQ ID NO: 412416 - DNA, 20 bp, Artificial Sequence
  chemically synthesized
aactctctacagggtcccaa

SEQ ID NO: 412417 - DNA, 20 bp, Artificial Sequence
  chemically synthesized
cccaggccattgggaccctg

SEQ ID NO: 412418 - DNA, 20 bp, Artificial Sequence
  chemically synthesized
caggccattgggaccctgta

SEQ ID NO: 412419 - DNA, 20 bp, Artificial Sequence
  chemically synthesized
ggccattgggaccctgtaga

SEQ ID NO: 412420 - DNA, 20 bp, Artificial Sequence
  chemically synthesized
gctggtgggaactctctaca

SEQ ID NO: 412421 - DNA, 20 bp, Artificial Sequence
  chemically synthesized
tgctggtgggaactctctac

SEQ ID NO: 412422 - DNA, 20 bp, Artificial Sequence
  chemically synthesized
ttgctggtgggaactctcta

SEQ ID NO: 412423 - DNA, 20 bp, Artificial Sequence
  chemically synthesized
accctgtagagagttcccac

SEQ ID NO: 412424 - DNA, 20 bp, Artificial Sequence
  chemically synthesized
tgtagagagttcccaccagc

SEQ ID NO: 412425 - DNA, 20 bp, Artificial Sequence
  chemically synthesized
gtgagggccttcttgctggt

SEQ ID NO: 412426 - DNA, 20 bp, Artificial Sequence
  chemically synthesized
ggtgagggccttcttgctgg

SEQ ID NO: 412427 - DNA, 20 bp, Artificial Sequence
  chemically synthesized
agagagttcccaccagcaag

SEQ ID NO: 412428 - DNA, 20 bp, Artificial Sequence
  chemically synthesized
gagagttcccaccagcaaga

SEQ ID NO: 412429 - DNA, 20 bp, Artificial Sequence
  chemically synthesized
tctggtgagggccttcttgc

SEQ ID NO: 412430 - DNA, 20 bp, Artificial Sequence
  chemically synthesized
accagcaagaaggccctcac

SEQ ID NO: 412431 - DNA, 20 bp, Artificial Sequence
  chemically synthesized
caaaaggacacatctggtga

SEQ ID NO: 412432 - DNA, 20 bp, Artificial Sequence
  chemically synthesized
tcaaaaggacacatctggtg

SEQ ID NO: 412433 - DNA, 20 bp, Artificial Sequence
  chemically synthesized
gtcaaaaggacacatctggt

SEQ ID NO: 412434 - DNA, 20 bp, Artificial Sequence
  chemically synthesized
ccaggtcaaaaggacacatc

SEQ ID NO: 412435 - DNA, 20 bp, Artificial Sequence
  chemically synthesized
ccagatgtgtccttttgacc

SEQ ID NO: 412436 - DNA, 20 bp, Artificial Sequence
  chemically synthesized
tcaagaagtcccaggtcaaa

SEQ ID NO: 412437 - DNA, 20 bp, Artificial Sequence
  chemically synthesized
cagatgtgtccttttgacct

SEQ ID NO: 412438 - DNA, 20 bp, Artificial Sequence
  chemically synthesized
ttcaagaagtcccaggtcaa

SEQ ID NO: 412439 - DNA, 20 bp, Artificial Sequence
  chemically synthesized
agaccatttcaagaagtccc

SEQ ID NO: 412440 - DNA, 20 bp, Artificial Sequence
  chemically synthesized
aagaccatttcaagaagtcc

SEQ ID NO: 412441 - DNA, 20 bp, Artificial Sequence
  chemically synthesized
tgacctgggacttcttgaaa

SEQ ID NO: 412442 - DNA, 20 bp, Artificial Sequence
  chemically synthesized
tttgcaaagaccatttcaag

SEQ ID NO: 412443 - DNA, 20 bp, Artificial Sequence
  chemically synthesized
atttttgcaaagaccatttc

SEQ ID NO: 412444 - DNA, 20 bp, Artificial Sequence
  chemically synthesized
tcaccgttataatttttgca

SEQ ID NO: 412445 - DNA, 20 bp, Artificial Sequence
  chemically synthesized
ggtctttgcaaaaattataa

SEQ ID NO: 412446 - DNA, 20 bp, Artificial Sequence
  chemically synthesized
tttgcaaaaattataacggt

SEQ ID NO: 412447 - DNA, 20 bp, Artificial Sequence
  chemically synthesized
ttataacggtgagaaaatga

SEQ ID NO: 412448 - DNA, 20 bp, Artificial Sequence
  chemically synthesized
taacggtgagaaaatgatgg

SEQ ID NO: 412449 - DNA, 20 bp, Artificial Sequence
  chemically synthesized
tgagaaaatgatggaagtga

SEQ ID NO: 412450 - DNA, 20 bp, Artificial Sequence
  chemically synthesized
gagaaaatgatggaagtgaa

SEQ ID NO: 412451 - DNA, 20 bp, Artificial Sequence
  chemically synthesized
agaaaatgatggaagtgaaa

SEQ ID NO: 412452 - DNA, 20 bp, Artificial Sequence
  chemically synthesized
gaagtgaaagggatctaatc

SEQ ID NO: 412453 - DNA, 20 bp, Artificial Sequence
  chemically synthesized
aagagaggagttggctagat

SEQ ID NO: 412454 - DNA, 20 bp, Artificial Sequence
  chemically synthesized
aaggcaagagaggagttggc

SEQ ID NO: 412455 - DNA, 20 bp, Artificial Sequence
  chemically synthesized
gctaaaggcaagagaggagt

SEQ ID NO: 412456 - DNA, 20 bp, Artificial Sequence
  chemically synthesized
gaaggctaaaggcaagagag

SEQ ID NO: 412457 - DNA, 20 bp, Artificial Sequence
  chemically synthesized
ttgaaggctaaaggcaagag

SEQ ID NO: 412458 - DNA, 20 bp, Artificial Sequence
  chemically synthesized
cttgaaggctaaaggcaaga

SEQ ID NO: 412459 - DNA, 20 bp, Artificial Sequence
  chemically synthesized
gccaactcctctcttgcctt

SEQ ID NO: 412460 - DNA, 20 bp, Artificial Sequence
  chemically synthesized
agcttgaaggctaaaggcaa

SEQ ID NO: 412461 - DNA, 20 bp, Artificial Sequence
  chemically synthesized
gcagcttgaaggctaaaggc

SEQ ID NO: 412462 - DNA, 20 bp, Artificial Sequence
  chemically synthesized
aagagcagcttgaaggctaa

SEQ ID NO: 412463 - DNA, 20 bp, Artificial Sequence
  chemically synthesized
taagagcagcttgaaggcta

SEQ ID NO: 412464 - DNA, 20 bp, Artificial Sequence
  chemically synthesized
ctctcttgcctttagccttc

SEQ ID NO: 412465 - DNA, 20 bp, Artificial Sequence
  chemically synthesized
aataattaagagcagcttga

SEQ ID NO: 412466 - DNA, 20 bp, Artificial Sequence
  chemically synthesized
gaataattaagagcagcttg

SEQ ID NO: 412467 - DNA, 20 bp, Artificial Sequence
  chemically synthesized
agcccaggaataattaagag

SEQ ID NO: 412468 - DNA, 20 bp, Artificial Sequence
  chemically synthesized
ataagcccaggaataattaa

SEQ ID NO: 412469 - DNA, 20 bp, Artificial Sequence
  chemically synthesized
gcataagcccaggaataatt

SEQ ID NO: 412470 - DNA, 20 bp, Artificial Sequence
  chemically synthesized
aagctgctcttaattattcc

SEQ ID NO: 412471 - DNA, 20 bp, Artificial Sequence
  chemically synthesized
agctgctcttaattattcct

SEQ ID NO: 412472 - DNA, 20 bp, Artificial Sequence
  chemically synthesized
agttagcttggcataagccc

SEQ ID NO: 412473 - DNA, 20 bp, Artificial Sequence
  chemically synthesized
aagttagcttggcataagcc

SEQ ID NO: 412474 - DNA, 20 bp, Artificial Sequence
  chemically synthesized
attattcctgggcttatgcc

SEQ ID NO: 412475 - DNA, 20 bp, Artificial Sequence
  chemically synthesized
tcccaaagttagcttggcat

SEQ ID NO: 412476 - DNA, 20 bp, Artificial Sequence
  chemically synthesized
aatgtctcccaaagttagct

SEQ ID NO: 412477 - DNA, 20 bp, Artificial Sequence
  chemically synthesized
ggcttatgccaagctaactt

SEQ ID NO: 412478 - DNA, 20 bp, Artificial Sequence
  chemically synthesized
gcttatgccaagctaacttt

SEQ ID NO: 412479 - DNA, 20 bp, Artificial Sequence
  chemically synthesized
ttatgccaagctaactttgg

SEQ ID NO: 412480 - DNA, 20 bp, Artificial Sequence
  chemically synthesized
ctataaatgtctcccaaagt

SEQ ID NO: 412481 - DNA, 20 bp, Artificial Sequence
  chemically synthesized
taaactataaatgtctccca

SEQ ID NO: 412482 - DNA, 20 bp, Artificial Sequence
  chemically synthesized
ctaactttgggagacattta

SEQ ID NO: 412483 - DNA, 20 bp, Artificial Sequence
  chemically synthesized
atttatagtttaaatgacaa

SEQ ID NO: 412484 - DNA, 20 bp, Artificial Sequence
  chemically synthesized
cgcggttgagttttggggaa

SEQ ID NO: 412485 - DNA, 20 bp, Artificial Sequence
  chemically synthesized
acgcggttgagttttgggga

SEQ ID NO: 412486 - DNA, 20 bp, Artificial Sequence
  chemically synthesized
aacgcggttgagttttgggg

SEQ ID NO: 412487 - DNA, 20 bp, Artificial Sequence
  chemically synthesized
acaaacgcggttgagttttg

SEQ ID NO: 412488 - DNA, 20 bp, Artificial Sequence
  chemically synthesized
tacaaacgcggttgagtttt

SEQ ID NO: 412489 - DNA, 20 bp, Artificial Sequence
  chemically synthesized
ctacaaacgcggttgagttt

SEQ ID NO: 412490 - DNA, 20 bp, Artificial Sequence
  chemically synthesized
ttagctctacaaacgcggtt

SEQ ID NO: 412491 - DNA, 20 bp, Artificial Sequence
  chemically synthesized
ccaaaactcaaccgcgtttg

SEQ ID NO: 412492 - DNA, 20 bp, Artificial Sequence
  chemically synthesized
tctcattagctctacaaacg

SEQ ID NO: 412493 - DNA, 20 bp, Artificial Sequence
  chemically synthesized
aaaactcaaccgcgtttgta

SEQ ID NO: 412494 - DNA, 20 bp, Artificial Sequence
  chemically synthesized
accgcgtttgtagagctaat

SEQ ID NO: 412495 - DNA, 20 bp, Artificial Sequence
  chemically synthesized
cgcgtttgtagagctaatga

SEQ ID NO: 412496 - DNA, 20 bp, Artificial Sequence
  chemically synthesized
ctagcctggtggtctctcat

SEQ ID NO: 412497 - DNA, 20 bp, Artificial Sequence
  chemically synthesized
tagagctaatgagagaccac

SEQ ID NO: 412498 - DNA, 20 bp, Artificial Sequence
  chemically synthesized
agagctaatgagagaccacc

SEQ ID NO: 412499 - DNA, 20 bp, Artificial Sequence
  chemically synthesized
ctaatgagagaccaccaggc

SEQ ID NO: 412500 - DNA, 20 bp, Artificial Sequence
  chemically synthesized
taatgagagaccaccaggct

SEQ ID NO: 412501 - DNA, 20 bp, Artificial Sequence
  chemically synthesized
cccctatcctcctagcctgg

SEQ ID NO: 412502 - DNA, 20 bp, Artificial Sequence
  chemically synthesized
atgagagaccaccaggctag

SEQ ID NO: 412503 - DNA, 20 bp, Artificial Sequence
  chemically synthesized
tgagagaccaccaggctagg

SEQ ID NO: 412504 - DNA, 20 bp, Artificial Sequence
  chemically synthesized
tttcccctatcctcctagcc

SEQ ID NO: 412505 - DNA, 20 bp, Artificial Sequence
  chemically synthesized
agaccaccaggctaggagga

SEQ ID NO: 412506 - DNA, 20 bp, Artificial Sequence
  chemically synthesized
gaccaccaggctaggaggat

SEQ ID NO: 412507 - DNA, 20 bp, Artificial Sequence
  chemically synthesized
tttagtttcccctatcctcc

SEQ ID NO: 412508 - DNA, 20 bp, Artificial Sequence
  chemically synthesized
accaccaggctaggaggata

SEQ ID NO: 412509 - DNA, 20 bp, Artificial Sequence
  chemically synthesized
ccaccaggctaggaggatag

SEQ ID NO: 412510 - DNA, 20 bp, Artificial Sequence
  chemically synthesized
gtctacaccgcagcagaatt

SEQ ID NO: 412511 - DNA, 20 bp, Artificial Sequence
  chemically synthesized
ggggaaactaaattctgctg

SEQ ID NO: 412512 - DNA, 20 bp, Artificial Sequence
  chemically synthesized
cctgtatgtctacaccgcag

SEQ ID NO: 412513 - DNA, 20 bp, Artificial Sequence
  chemically synthesized
aactaaattctgctgcggtg

SEQ ID NO: 412514 - DNA, 20 bp, Artificial Sequence
  chemically synthesized
aatcctgtatgtctacaccg

SEQ ID NO: 412515 - DNA, 20 bp, Artificial Sequence
  chemically synthesized
tctgctgcggtgtagacata

SEQ ID NO: 412516 - DNA, 20 bp, Artificial Sequence
  chemically synthesized
ctgctgcggtgtagacatac

SEQ ID NO: 412517 - DNA, 20 bp, Artificial Sequence
  chemically synthesized
gtgtagacatacaggattgc

SEQ ID NO: 412518 - DNA, 20 bp, Artificial Sequence
  chemically synthesized
gtgacctctggaataatggc

SEQ ID NO: 412519 - DNA, 20 bp, Artificial Sequence
  chemically synthesized
aggattgccagccattattc

SEQ ID NO: 412520 - DNA, 20 bp, Artificial Sequence
  chemically synthesized
tcttgtgacctctggaataa

SEQ ID NO: 412521 - DNA, 20 bp, Artificial Sequence
  chemically synthesized
gattgccagccattattcca

SEQ ID NO: 412522 - DNA, 20 bp, Artificial Sequence
  chemically synthesized
attgccagccattattccag

SEQ ID NO: 412523 - DNA, 20 bp, Artificial Sequence
  chemically synthesized
gtcgcgtgtcttgtgacctc

SEQ ID NO: 412524 - DNA, 20 bp, Artificial Sequence
  chemically synthesized
gccattattccagaggtcac

SEQ ID NO: 412525 - DNA, 20 bp, Artificial Sequence
  chemically synthesized
gtctgcaagagtagttgggg

SEQ ID NO: 412526 - DNA, 20 bp, Artificial Sequence
  chemically synthesized
gttgtctgcaagagtagttg

SEQ ID NO: 412527 - DNA, 20 bp, Artificial Sequence
  chemically synthesized
tgttgtctgcaagagtagtt

SEQ ID NO: 412528 - DNA, 20 bp, Artificial Sequence
  chemically synthesized
atgttgtctgcaagagtagt

SEQ ID NO: 412529 - DNA, 20 bp, Artificial Sequence
  chemically synthesized
gacttccccaactactcttg

SEQ ID NO: 412530 - DNA, 20 bp, Artificial Sequence
  chemically synthesized
agtgatgttgtctgcaagag

SEQ ID NO: 412531 - DNA, 20 bp, Artificial Sequence
  chemically synthesized
aatagtgatgttgtctgcaa

SEQ ID NO: 412532 - DNA, 20 bp, Artificial Sequence
  chemically synthesized
acaatagtgatgttgtctgc

SEQ ID NO: 412533 - DNA, 20 bp, Artificial Sequence
  chemically synthesized
tgcagacaacatcactattg

SEQ ID NO: 412534 - DNA, 20 bp, Artificial Sequence
  chemically synthesized
gccaatcttaagttctacaa

SEQ ID NO: 412535 - DNA, 20 bp, Artificial Sequence
  chemically synthesized
acatcactattgtagaactt

SEQ ID NO: 412536 - DNA, 20 bp, Artificial Sequence
  chemically synthesized
actattgtagaacttaagat

SEQ ID NO: 412537 - DNA, 20 bp, Artificial Sequence
  chemically synthesized
tatctcaaaaggccaatctt

SEQ ID NO: 412538 - DNA, 20 bp, Artificial Sequence
  chemically synthesized
gaacttaagattggcctttt

SEQ ID NO: 412539 - DNA, 20 bp, Artificial Sequence
  chemically synthesized
atctgaacagatatctcaaa

SEQ ID NO: 412540 - DNA, 20 bp, Artificial Sequence
  chemically synthesized
tatctgaacagatatctcaa

SEQ ID NO: 412541 - DNA, 20 bp, Artificial Sequence
  chemically synthesized
ggccttttgagatatctgtt

SEQ ID NO: 412542 - DNA, 20 bp, Artificial Sequence
  chemically synthesized
agacatgaaatatatctgaa

SEQ ID NO: 412543 - DNA, 20 bp, Artificial Sequence
  chemically synthesized
caggtggagccatcagtcat

SEQ ID NO: 412544 - DNA, 20 bp, Artificial Sequence
  chemically synthesized
atttcatgtctgatgactga

SEQ ID NO: 412545 - DNA, 20 bp, Artificial Sequence
  chemically synthesized
gcaggtgcaggtggagccat

SEQ ID NO: 412546 - DNA, 20 bp, Artificial Sequence
  chemically synthesized
gcagttggcaggtgcaggtg

SEQ ID NO: 412547 - DNA, 20 bp, Artificial Sequence
  chemically synthesized
gagcagttggcaggtgcagg

SEQ ID NO: 412548 - DNA, 20 bp, Artificial Sequence
  chemically synthesized
caggagcagttggcaggtgc

SEQ ID NO: 412549 - DNA, 20 bp, Artificial Sequence
  chemically synthesized
acaggagcagttggcaggtg

SEQ ID NO: 412550 - DNA, 20 bp, Artificial Sequence
  chemically synthesized
gggccacaggagcagttggc

SEQ ID NO: 412551 - DNA, 20 bp, Artificial Sequence
  chemically synthesized
ggggccacaggagcagttgg

SEQ ID NO: 412552 - DNA, 20 bp, Artificial Sequence
  chemically synthesized
ggcggggccacaggagcagt

SEQ ID NO: 412553 - DNA, 20 bp, Artificial Sequence
  chemically synthesized
gcacctgccaactgctcctg

SEQ ID NO: 412554 - DNA, 20 bp, Artificial Sequence
  chemically synthesized
tctgggcggggccacaggag

SEQ ID NO: 412555 - DNA, 20 bp, Artificial Sequence
  chemically synthesized
tcttctgggcggggccacag

SEQ ID NO: 412556 - DNA, 20 bp, Artificial Sequence
  chemically synthesized
tctcttctgggcggggccac

SEQ ID NO: 412557 - DNA, 20 bp, Artificial Sequence
  chemically synthesized
gtctcttctgggcggggcca

SEQ ID NO: 412558 - DNA, 20 bp, Artificial Sequence
  chemically synthesized
actgctcctgtggccccgcc

SEQ ID NO: 412559 - DNA, 20 bp, Artificial Sequence
  chemically synthesized
gctcctgtggccccgcccag

SEQ ID NO: 412560 - DNA, 20 bp, Artificial Sequence
  chemically synthesized
cactgagtctcttctgggcg

SEQ ID NO: 412561 - DNA, 20 bp, Artificial Sequence
  chemically synthesized
gcactgagtctcttctgggc

SEQ ID NO: 412562 - DNA, 20 bp, Artificial Sequence
  chemically synthesized
tcctgtggccccgcccagaa

SEQ ID NO: 412563 - DNA, 20 bp, Artificial Sequence
  chemically synthesized
tgcactgagtctcttctggg

SEQ ID NO: 412564 - DNA, 20 bp, Artificial Sequence
  chemically synthesized
ctgtgcactgagtctcttct

SEQ ID NO: 412565 - DNA, 20 bp, Artificial Sequence
  chemically synthesized
cctgtgcactgagtctcttc

SEQ ID NO: 412566 - DNA, 20 bp, Artificial Sequence
  chemically synthesized
ggccccgcccagaagagact

SEQ ID NO: 412567 - DNA, 20 bp, Artificial Sequence
  chemically synthesized
cccagaagagactcagtgca

SEQ ID NO: 412568 - DNA, 20 bp, Artificial Sequence
  chemically synthesized
ccagaagagactcagtgcac

SEQ ID NO: 412569 - DNA, 20 bp, Artificial Sequence
  chemically synthesized
caagggtcctcctgtgcact

SEQ ID NO: 412570 - DNA, 20 bp, Artificial Sequence
  chemically synthesized
agaagagactcagtgcacag

SEQ ID NO: 412571 - DNA, 20 bp, Artificial Sequence
  chemically synthesized
gaagagactcagtgcacagg

SEQ ID NO: 412572 - DNA, 20 bp, Artificial Sequence
  chemically synthesized
cacaggaggacccttgccca

SEQ ID NO: 412573 - DNA, 20 bp, Artificial Sequence
  chemically synthesized
aatcataggactgtgggcaa

SEQ ID NO: 412574 - DNA, 20 bp, Artificial Sequence
  chemically synthesized
caatcataggactgtgggca

SEQ ID NO: 412575 - DNA, 20 bp, Artificial Sequence
  chemically synthesized
gcaatcataggactgtgggc

SEQ ID NO: 412576 - DNA, 20 bp, Artificial Sequence
  chemically synthesized
gattgcaatcataggactgt

SEQ ID NO: 412577 - DNA, 20 bp, Artificial Sequence
  chemically synthesized
ggattgcaatcataggactg

SEQ ID NO: 412578 - DNA, 20 bp, Artificial Sequence
  chemically synthesized
ctggtagggattgcaatcat

SEQ ID NO: 412579 - DNA, 20 bp, Artificial Sequence
  chemically synthesized
actggtagggattgcaatca

SEQ ID NO: 412580 - DNA, 20 bp, Artificial Sequence
  chemically synthesized
cctatgattgcaatccctac

SEQ ID NO: 412581 - DNA, 20 bp, Artificial Sequence
  chemically synthesized
tgattgcaatccctaccagt

SEQ ID NO: 412582 - DNA, 20 bp, Artificial Sequence
  chemically synthesized
gtgcttgctgctgactggta

SEQ ID NO: 412583 - DNA, 20 bp, Artificial Sequence
  chemically synthesized
ggtgcttgctgctgactggt

SEQ ID NO: 412584 - DNA, 20 bp, Artificial Sequence
  chemically synthesized
aggtgcttgctgctgactgg

SEQ ID NO: 412585 - DNA, 20 bp, Artificial Sequence
  chemically synthesized
ttgcaatccctaccagtcag

SEQ ID NO: 412586 - DNA, 20 bp, Artificial Sequence
  chemically synthesized
aataggtgcttgctgctgac

SEQ ID NO: 412587 - DNA, 20 bp, Artificial Sequence
  chemically synthesized
aatccctaccagtcagcagc

SEQ ID NO: 412588 - DNA, 20 bp, Artificial Sequence
  chemically synthesized
agcagcaagcacctattgcg

SEQ ID NO: 412589 - DNA, 20 bp, Artificial Sequence
  chemically synthesized
catgtggaaagctacgcaat

SEQ ID NO: 412590 - DNA, 20 bp, Artificial Sequence
  chemically synthesized
gcatgtggaaagctacgcaa

SEQ ID NO: 412591 - DNA, 20 bp, Artificial Sequence
  chemically synthesized
tttggggaaaggcatgtgga

SEQ ID NO: 412592 - DNA, 20 bp, Artificial Sequence
  chemically synthesized
tcggtttggggaaaggcatg

SEQ ID NO: 412593 - DNA, 20 bp, Artificial Sequence
  chemically synthesized
ttcaagatcggtttggggaa

SEQ ID NO: 412594 - DNA, 20 bp, Artificial Sequence
  chemically synthesized
tttcaagatcggtttgggga

SEQ ID NO: 412595 - DNA, 20 bp, Artificial Sequence
  chemically synthesized
gggttttcaagatcggtttg

SEQ ID NO: 412596 - DNA, 20 bp, Artificial Sequence
  chemically synthesized
agggttttcaagatcggttt

SEQ ID NO: 412597 - DNA, 20 bp, Artificial Sequence
  chemically synthesized
tagggttttcaagatcggtt

SEQ ID NO: 412598 - DNA, 20 bp, Artificial Sequence
  chemically synthesized
gaggctagggttttcaagat

SEQ ID NO: 412599 - DNA, 20 bp, Artificial Sequence
  chemically synthesized
agtctgaggctagggttttc

SEQ ID NO: 412600 - DNA, 20 bp, Artificial Sequence
  chemically synthesized
caaaccgatcttgaaaaccc

SEQ ID NO: 412601 - DNA, 20 bp, Artificial Sequence
  chemically synthesized
gatcttgaaaaccctagcct

SEQ ID NO: 412602 - DNA, 20 bp, Artificial Sequence
  chemically synthesized
cctcaagaagtctgaggcta

SEQ ID NO: 412603 - DNA, 20 bp, Artificial Sequence
  chemically synthesized
tcctcaagaagtctgaggct

SEQ ID NO: 412604 - DNA, 20 bp, Artificial Sequence
  chemically synthesized
ctcctcaagaagtctgaggc

SEQ ID NO: 412605 - DNA, 20 bp, Artificial Sequence
  chemically synthesized
cagtctcctcaagaagtctg

SEQ ID NO: 412606 - DNA, 20 bp, Artificial Sequence
  chemically synthesized
tcagtctcctcaagaagtct

SEQ ID NO: 412607 - DNA, 20 bp, Artificial Sequence
  chemically synthesized
accctagcctcagacttctt

SEQ ID NO: 412608 - DNA, 20 bp, Artificial Sequence
  chemically synthesized
ccctagcctcagacttcttg

SEQ ID NO: 412609 - DNA, 20 bp, Artificial Sequence
  chemically synthesized
ctagcctcagacttcttgag

SEQ ID NO: 412610 - DNA, 20 bp, Artificial Sequence
  chemically synthesized
ctcaaatcagtctcctcaag

SEQ ID NO: 412611 - DNA, 20 bp, Artificial Sequence
  chemically synthesized
ttactcaaatcagtctcctc

SEQ ID NO: 412612 - DNA, 20 bp, Artificial Sequence
  chemically synthesized
cttcttgaggagactgattt

SEQ ID NO: 412613 - DNA, 20 bp, Artificial Sequence
  chemically synthesized
agttttactattactcaaat

SEQ ID NO: 412614 - DNA, 20 bp, Artificial Sequence
  chemically synthesized
gaggagactgatttgagtaa

SEQ ID NO: 412615 - DNA, 20 bp, Artificial Sequence
  chemically synthesized
accagctaagcagaagatca

SEQ ID NO: 412616 - DNA, 20 bp, Artificial Sequence
  chemically synthesized
ccaccagctaagcagaagat

SEQ ID NO: 412617 - DNA, 20 bp, Artificial Sequence
  chemically synthesized
taaaactctgatcttctgct

SEQ ID NO: 412618 - DNA, 20 bp, Artificial Sequence
  chemically synthesized
tacagccaccagctaagcag

SEQ ID NO: 412619 - DNA, 20 bp, Artificial Sequence
  chemically synthesized
actctgatcttctgcttagc

SEQ ID NO: 412620 - DNA, 20 bp, Artificial Sequence
  chemically synthesized
atgtacagccaccagctaag

SEQ ID NO: 412621 - DNA, 20 bp, Artificial Sequence
  chemically synthesized
ctgatcttctgcttagctgg

SEQ ID NO: 412622 - DNA, 20 bp, Artificial Sequence
  chemically synthesized
tacatgtacagccaccagct

SEQ ID NO: 412623 - DNA, 20 bp, Artificial Sequence
  chemically synthesized
ttttatacatgtacagccac

SEQ ID NO: 412624 - DNA, 20 bp, Artificial Sequence
  chemically synthesized
tggagagttttatacatgta

SEQ ID NO: 412625 - DNA, 20 bp, Artificial Sequence
  chemically synthesized
gacaagggaattgcaatgga

SEQ ID NO: 412626 - DNA, 20 bp, Artificial Sequence
  chemically synthesized
aagacaagggaattgcaatg

SEQ ID NO: 412627 - DNA, 20 bp, Artificial Sequence
  chemically synthesized
tcaagacaagggaattgcaa

SEQ ID NO: 412628 - DNA, 20 bp, Artificial Sequence
  chemically synthesized
gagctgatttatcaagacaa

SEQ ID NO: 412629 - DNA, 20 bp, Artificial Sequence
  chemically synthesized
agagctgatttatcaagaca

SEQ ID NO: 412630 - DNA, 20 bp, Artificial Sequence
  chemically synthesized
tagagctgatttatcaagac

SEQ ID NO: 412631 - DNA, 20 bp, Artificial Sequence
  chemically synthesized
attcccttgtcttgataaat

SEQ ID NO: 412632 - DNA, 20 bp, Artificial Sequence
  chemically synthesized
ccaggtagagctgatttatc

SEQ ID NO: 412633 - DNA, 20 bp, Artificial Sequence
  chemically synthesized
cttgataaatcagctctacc

SEQ ID NO: 412634 - DNA, 20 bp, Artificial Sequence
  chemically synthesized
ttgataaatcagctctacct

SEQ ID NO: 412635 - DNA, 20 bp, Artificial Sequence
  chemically synthesized
tctttcctgctgcccaggta

SEQ ID NO: 412636 - DNA, 20 bp, Artificial Sequence
  chemically synthesized
ataaatcagctctacctggg

SEQ ID NO: 412637 - DNA, 20 bp, Artificial Sequence
  chemically synthesized
cttctttcctgctgcccagg

SEQ ID NO: 412638 - DNA, 20 bp, Artificial Sequence
  chemically synthesized
aatcagctctacctgggcag

SEQ ID NO: 412639 - DNA, 20 bp, Artificial Sequence
  chemically synthesized
atcagctctacctgggcagc

SEQ ID NO: 412640 - DNA, 20 bp, Artificial Sequence
  chemically synthesized
gttcttctttcctgctgccc

SEQ ID NO: 412641 - DNA, 20 bp, Artificial Sequence
  chemically synthesized
ggttcttctttcctgctgcc

SEQ ID NO: 412642 - DNA, 20 bp, Artificial Sequence
  chemically synthesized
gctctacctgggcagcagga

SEQ ID NO: 412643 - DNA, 20 bp, Artificial Sequence
  chemically synthesized
ctacctgggcagcaggaaag

SEQ ID NO: 412644 - DNA, 20 bp, Artificial Sequence
  chemically synthesized
ggaaagaagaacctattgtg

SEQ ID NO: 412645 - DNA, 20 bp, Artificial Sequence
  chemically synthesized
tcagaatgtatctgcacaat

SEQ ID NO: 412646 - DNA, 20 bp, Artificial Sequence
  chemically synthesized
ctcagaatgtatctgcacaa

SEQ ID NO: 412647 - DNA, 20 bp, Artificial Sequence
  chemically synthesized
ctattgtgcagatacattct

SEQ ID NO: 412648 - DNA, 20 bp, Artificial Sequence
  chemically synthesized
ttcttacagttatggaggct

SEQ ID NO: 412649 - DNA, 20 bp, Artificial Sequence
  chemically synthesized
cttatttcttacagttatgg

SEQ ID NO: 412650 - DNA, 20 bp, Artificial Sequence
  chemically synthesized
acttatttcttacagttatg

SEQ ID NO: 412651 - DNA, 20 bp, Artificial Sequence
  chemically synthesized
ttctgagcctccataactgt

SEQ ID NO: 412652 - DNA, 20 bp, Artificial Sequence
  chemically synthesized
gaacttatttcttacagtta

SEQ ID NO: 412653 - DNA, 20 bp, Artificial Sequence
  chemically synthesized
aaaaaggaacttatttctta

SEQ ID NO: 412654 - DNA, 20 bp, Artificial Sequence
  chemically synthesized
cctccataactgtaagaaat

SEQ ID NO: 412655 - DNA, 20 bp, Artificial Sequence
  chemically synthesized
ctaggttacttatttcaaaa

SEQ ID NO: 412656 - DNA, 20 bp, Artificial Sequence
  chemically synthesized
actaggttacttatttcaaa

SEQ ID NO: 412657 - DNA, 20 bp, Artificial Sequence
  chemically synthesized
aataagttcctttttgaaat

SEQ ID NO: 412658 - DNA, 20 bp, Artificial Sequence
  chemically synthesized
cctttttgaaataagtaacc

SEQ ID NO: 412659 - DNA, 20 bp, Artificial Sequence
  chemically synthesized
tgaaataagtaacctagttt

SEQ ID NO: 412660 - DNA, 20 bp, Artificial Sequence
  chemically synthesized
gaaataagtaacctagtttc

SEQ ID NO: 412661 - DNA, 20 bp, Artificial Sequence
  chemically synthesized
aaaacagaatacctgaaact

SEQ ID NO: 412662 - DNA, 20 bp, Artificial Sequence
  chemically synthesized
taaaacagaatacctgaaac

SEQ ID NO: 412663 - DNA, 20 bp, Artificial Sequence
  chemically synthesized
gtttcaggtattctgtttta

SEQ ID NO: 412664 - DNA, 20 bp, Artificial Sequence
  chemically synthesized
catttgctgttgctataaaa

SEQ ID NO: 412665 - DNA, 20 bp, Artificial Sequence
  chemically synthesized
ggtattctgttttatagcaa

SEQ ID NO: 412666 - DNA, 20 bp, Artificial Sequence
  chemically synthesized
acagcaaatgaattaatacc

SEQ ID NO: 412667 - DNA, 20 bp, Artificial Sequence
  chemically synthesized
acggtattaattcatttgct

SEQ ID NO: 412668 - DNA, 20 bp, Artificial Sequence
  chemically synthesized
caaatgaattaataccgtat

SEQ ID NO: 412669 - DNA, 20 bp, Artificial Sequence
  chemically synthesized
aaatgaattaataccgtatt

SEQ ID NO: 412670 - DNA, 20 bp, Artificial Sequence
  chemically synthesized
acatctaagatatcccaata

SEQ ID NO: 412671 - DNA, 20 bp, Artificial Sequence
  chemically synthesized
aataccgtattgggatatct

SEQ ID NO: 412672 - DNA, 20 bp, Artificial Sequence
  chemically synthesized
gcttcaatgccaaaacatct

SEQ ID NO: 412673 - DNA, 20 bp, Artificial Sequence
  chemically synthesized
ttgggatatcttagatgttt

SEQ ID NO: 412674 - DNA, 20 bp, Artificial Sequence
  chemically synthesized
tcttagatgttttggcattg

SEQ ID NO: 412675 - DNA, 20 bp, Artificial Sequence
  chemically synthesized
gaatgcattttcgtaagaca

SEQ ID NO: 412676 - DNA, 20 bp, Artificial Sequence
  chemically synthesized
atacctgaatgcattttcgt

SEQ ID NO: 412677 - DNA, 20 bp, Artificial Sequence
  chemically synthesized
ttgtcttacgaaaatgcatt

SEQ ID NO: 412678 - DNA, 20 bp, Artificial Sequence
  chemically synthesized
tgtcttacgaaaatgcattc

SEQ ID NO: 412679 - DNA, 20 bp, Artificial Sequence
  chemically synthesized
cagttataattttgcaatgg

SEQ ID NO: 412680 - DNA, 20 bp, Artificial Sequence
  chemically synthesized
tttcagttataattttgcaa

SEQ ID NO: 412681 - DNA, 20 bp, Artificial Sequence
  chemically synthesized
ttgcaaaattataactgaaa

SEQ ID NO: 412682 - DNA, 20 bp, Artificial Sequence
  chemically synthesized
tcagatctctttcactattt

SEQ ID NO: 412683 - DNA, 20 bp, Artificial Sequence
  chemically synthesized
aattataactgaaatagtga

SEQ ID NO: 412684 - DNA, 20 bp, Artificial Sequence
  chemically synthesized
ttataactgaaatagtgaaa

SEQ ID NO: 412685 - DNA, 20 bp, Artificial Sequence
  chemically synthesized
caagagggagttggttacat

SEQ ID NO: 412686 - DNA, 20 bp, Artificial Sequence
  chemically synthesized
gcttagatgcaagagggagt

SEQ ID NO: 412687 - DNA, 20 bp, Artificial Sequence
  chemically synthesized
tggggcttagatgcaagagg

SEQ ID NO: 412688 - DNA, 20 bp, Artificial Sequence
  chemically synthesized
cctggggcttagatgcaaga

SEQ ID NO: 412689 - DNA, 20 bp, Artificial Sequence
  chemically synthesized
gcctggggcttagatgcaag

SEQ ID NO: 412690 - DNA, 20 bp, Artificial Sequence
  chemically synthesized
agcctggggcttagatgcaa

SEQ ID NO: 412691 - DNA, 20 bp, Artificial Sequence
  chemically synthesized
accaactccctcttgcatct

SEQ ID NO: 412692 - DNA, 20 bp, Artificial Sequence
  chemically synthesized
acagcctggggcttagatgc

SEQ ID NO: 412693 - DNA, 20 bp, Artificial Sequence
  chemically synthesized
tccctcttgcatctaagccc

SEQ ID NO: 412694 - DNA, 20 bp, Artificial Sequence
  chemically synthesized
ccctcttgcatctaagcccc

SEQ ID NO: 412695 - DNA, 20 bp, Artificial Sequence
  chemically synthesized
agcaaggacagcctggggct

SEQ ID NO: 412696 - DNA, 20 bp, Artificial Sequence
  chemically synthesized
gaatgagcaaggacagcctg

SEQ ID NO: 412697 - DNA, 20 bp, Artificial Sequence
  chemically synthesized
ggaatgagcaaggacagcct

SEQ ID NO: 412698 - DNA, 20 bp, Artificial Sequence
  chemically synthesized
aggaatgagcaaggacagcc

SEQ ID NO: 412699 - DNA, 20 bp, Artificial Sequence
  chemically synthesized
cccccaggaatgagcaagga

SEQ ID NO: 412700 - DNA, 20 bp, Artificial Sequence
  chemically synthesized
cttacccccaggaatgagca

SEQ ID NO: 412701 - DNA, 20 bp, Artificial Sequence
  chemically synthesized
gcttacccccaggaatgagc

SEQ ID NO: 412702 - DNA, 20 bp, Artificial Sequence
  chemically synthesized
aggctgtccttgctcattcc

SEQ ID NO: 412703 - DNA, 20 bp, Artificial Sequence
  chemically synthesized
ggctgtccttgctcattcct

SEQ ID NO: 412704 - DNA, 20 bp, Artificial Sequence
  chemically synthesized
gctgtccttgctcattcctg

SEQ ID NO: 412705 - DNA, 20 bp, Artificial Sequence
  chemically synthesized
ttcagcttacccccaggaat

SEQ ID NO: 412706 - DNA, 20 bp, Artificial Sequence
  chemically synthesized
ctgtccttgctcattcctgg

SEQ ID NO: 412707 - DNA, 20 bp, Artificial Sequence
  chemically synthesized
ccttgctcattcctgggggt

SEQ ID NO: 412708 - DNA, 20 bp, Artificial Sequence
  chemically synthesized
agttatttcagcttaccccc

SEQ ID NO: 412709 - DNA, 20 bp, Artificial Sequence
  chemically synthesized
aagttatttcagcttacccc

SEQ ID NO: 412710 - DNA, 20 bp, Artificial Sequence
  chemically synthesized
agttcctcccaaagttattt

SEQ ID NO: 412711 - DNA, 20 bp, Artificial Sequence
  chemically synthesized
ggggtaagctgaaataactt

SEQ ID NO: 412712 - DNA, 20 bp, Artificial Sequence
  chemically synthesized
gggtaagctgaaataacttt

SEQ ID NO: 412713 - DNA, 20 bp, Artificial Sequence
  chemically synthesized
gtaagctgaaataactttgg

SEQ ID NO: 412714 - DNA, 20 bp, Artificial Sequence
  chemically synthesized
taagctgaaataactttggg

SEQ ID NO: 412715 - DNA, 20 bp, Artificial Sequence
  chemically synthesized
tataaactaagttcctccca

SEQ ID NO: 412716 - DNA, 20 bp, Artificial Sequence
  chemically synthesized
aaataactttgggaggaact

SEQ ID NO: 412717 - DNA, 20 bp, Artificial Sequence
  chemically synthesized
tttgggaggaacttagttta

SEQ ID NO: 412718 - DNA, 20 bp, Artificial Sequence
  chemically synthesized
taaaccataagctataaact

SEQ ID NO: 412719 - DNA, 20 bp, Artificial Sequence
  chemically synthesized
ggaacttagtttatagctta

SEQ ID NO: 412720 - DNA, 20 bp, Artificial Sequence
  chemically synthesized
ttgcctttgttttaaaccat

SEQ ID NO: 412721 - DNA, 20 bp, Artificial Sequence
  chemically synthesized
atagcttatggtttaaaaca

SEQ ID NO: 412722 - DNA, 20 bp, Artificial Sequence
  chemically synthesized
tagcttatggtttaaaacaa

SEQ ID NO: 412723 - DNA, 20 bp, Artificial Sequence
  chemically synthesized
aggaggttggttttggggaa

SEQ ID NO: 412724 - DNA, 20 bp, Artificial Sequence
  chemically synthesized
aaggaggttggttttgggga

SEQ ID NO: 412725 - DNA, 20 bp, Artificial Sequence
  chemically synthesized
gaaggaggttggttttgggg

SEQ ID NO: 412726 - DNA, 20 bp, Artificial Sequence
  chemically synthesized
caagaaggaggttggttttg

SEQ ID NO: 412727 - DNA, 20 bp, Artificial Sequence
  chemically synthesized
gcaagaaggaggttggtttt

SEQ ID NO: 412728 - DNA, 20 bp, Artificial Sequence
  chemically synthesized
ggcaagaaggaggttggttt

SEQ ID NO: 412729 - DNA, 20 bp, Artificial Sequence
  chemically synthesized
tccccaggcaagaaggaggt

SEQ ID NO: 412730 - DNA, 20 bp, Artificial Sequence
  chemically synthesized
ctagtccccaggcaagaagg

SEQ ID NO: 412731 - DNA, 20 bp, Artificial Sequence
  chemically synthesized
tctagtccccaggcaagaag

SEQ ID NO: 412732 - DNA, 20 bp, Artificial Sequence
  chemically synthesized
aaaccaacctccttcttgcc

SEQ ID NO: 412733 - DNA, 20 bp, Artificial Sequence
  chemically synthesized
agtctagtccccaggcaaga

SEQ ID NO: 412734 - DNA, 20 bp, Artificial Sequence
  chemically synthesized
aaccaacctccttcttgcct

SEQ ID NO: 412735 - DNA, 20 bp, Artificial Sequence
  chemically synthesized
cagtctagtccccaggcaag

SEQ ID NO: 412736 - DNA, 20 bp, Artificial Sequence
  chemically synthesized
accaacctccttcttgcctg

SEQ ID NO: 412737 - DNA, 20 bp, Artificial Sequence
  chemically synthesized
aggcagtctagtccccaggc

SEQ ID NO: 412738 - DNA, 20 bp, Artificial Sequence
  chemically synthesized
cctccttcttgcctggggac

SEQ ID NO: 412739 - DNA, 20 bp, Artificial Sequence
  chemically synthesized
acaaaggcagtctagtcccc

SEQ ID NO: 412740 - DNA, 20 bp, Artificial Sequence
  chemically synthesized
tacaaaggcagtctagtccc

SEQ ID NO: 412741 - DNA, 20 bp, Artificial Sequence
  chemically synthesized
ttagtcctacaaaggcagtc

SEQ ID NO: 412742 - DNA, 20 bp, Artificial Sequence
  chemically synthesized
tggggactagactgcctttg

SEQ ID NO: 412743 - DNA, 20 bp, Artificial Sequence
  chemically synthesized
ggggactagactgcctttgt

SEQ ID NO: 412744 - DNA, 20 bp, Artificial Sequence
  chemically synthesized
ttttgttagtcctacaaagg

SEQ ID NO: 412745 - DNA, 20 bp, Artificial Sequence
  chemically synthesized
ctattttgttagtcctacaa

SEQ ID NO: 412746 - DNA, 20 bp, Artificial Sequence
  chemically synthesized
gctattttgttagtcctaca

SEQ ID NO: 412747 - DNA, 20 bp, Artificial Sequence
  chemically synthesized
cctttgtaggactaacaaaa

SEQ ID NO: 412748 - DNA, 20 bp, Artificial Sequence
  chemically synthesized
taatcttttggctattttgt

SEQ ID NO: 412749 - DNA, 20 bp, Artificial Sequence
  chemically synthesized
aggactaacaaaatagccaa

SEQ ID NO: 412750 - DNA, 20 bp, Artificial Sequence
  chemically synthesized
taacaaaatagccaaaagat

SEQ ID NO: 412751 - DNA, 20 bp, Artificial Sequence
  chemically synthesized
aaccgtaatttctaatcttt

SEQ ID NO: 412752 - DNA, 20 bp, Artificial Sequence
  chemically synthesized
agccaaaagattagaaatta

SEQ ID NO: 412753 - DNA, 20 bp, Artificial Sequence
  chemically synthesized
aaagattagaaattacggtt

SEQ ID NO: 412754 - DNA, 20 bp, Artificial Sequence
  chemically synthesized
gattagaaattacggtttag

SEQ ID NO: 412755 - DNA, 20 bp, Artificial Sequence
  chemically synthesized
attacggtttagtagtcatg

SEQ ID NO: 412756 - DNA, 20 bp, Artificial Sequence
  chemically synthesized
cggtttagtagtcatgcagc

SEQ ID NO: 412757 - DNA, 20 bp, Artificial Sequence
  chemically synthesized
gtttagtagtcatgcagcta

SEQ ID NO: 412758 - DNA, 20 bp, Artificial Sequence
  chemically synthesized
aagcagtatcttgtagtctc

SEQ ID NO: 412759 - DNA, 20 bp, Artificial Sequence
  chemically synthesized
gtcatgcagctagagactac

SEQ ID NO: 412760 - DNA, 20 bp, Artificial Sequence
  chemically synthesized
tggggagaagcagtatcttg

SEQ ID NO: 412761 - DNA, 20 bp, Artificial Sequence
  chemically synthesized
aggagcaatttggggagaag

SEQ ID NO: 412762 - DNA, 20 bp, Artificial Sequence
  chemically synthesized
cccaggagcaatttggggag

SEQ ID NO: 412763 - DNA, 20 bp, Artificial Sequence
  chemically synthesized
atgcccaggagcaatttggg

SEQ ID NO: 412764 - DNA, 20 bp, Artificial Sequence
  chemically synthesized
ttatgcccaggagcaatttg

SEQ ID NO: 412765 - DNA, 20 bp, Artificial Sequence
  chemically synthesized
tttatgcccaggagcaattt

SEQ ID NO: 412766 - DNA, 20 bp, Artificial Sequence
  chemically synthesized
ctttatgcccaggagcaatt

SEQ ID NO: 412767 - DNA, 20 bp, Artificial Sequence
  chemically synthesized
gcttctccccaaattgctcc

SEQ ID NO: 412768 - DNA, 20 bp, Artificial Sequence
  chemically synthesized
cttctccccaaattgctcct

SEQ ID NO: 412769 - DNA, 20 bp, Artificial Sequence
  chemically synthesized
aatggtgactttatgcccag

SEQ ID NO: 412770 - DNA, 20 bp, Artificial Sequence
  chemically synthesized
ccaaattgctcctgggcata

SEQ ID NO: 412771 - DNA, 20 bp, Artificial Sequence
  chemically synthesized
acaatggtgactttatgccc

SEQ ID NO: 412772 - DNA, 20 bp, Artificial Sequence
  chemically synthesized
tacaatggtgactttatgcc

SEQ ID NO: 412773 - DNA, 20 bp, Artificial Sequence
  chemically synthesized
ggcataaagtcaccattgta

SEQ ID NO: 412774 - DNA, 20 bp, Artificial Sequence
  chemically synthesized
actgatcttaggctttacaa

SEQ ID NO: 412775 - DNA, 20 bp, Artificial Sequence
  chemically synthesized
aagtcaccattgtaaagcct

SEQ ID NO: 412776 - DNA, 20 bp, Artificial Sequence
  chemically synthesized
accattgtaaagcctaagat

SEQ ID NO: 412777 - DNA, 20 bp, Artificial Sequence
  chemically synthesized
acgtctcaagcactgatctt

SEQ ID NO: 412778 - DNA, 20 bp, Artificial Sequence
  chemically synthesized
aacgtctcaagcactgatct

SEQ ID NO: 412779 - DNA, 20 bp, Artificial Sequence
  chemically synthesized
aaagcctaagatcagtgctt

SEQ ID NO: 412780 - DNA, 20 bp, Artificial Sequence
  chemically synthesized
cagggtctgcaaaacgtctc

SEQ ID NO: 412781 - DNA, 20 bp, Artificial Sequence
  chemically synthesized
tcagtgcttgagacgttttg

SEQ ID NO: 412782 - DNA, 20 bp, Artificial Sequence
  chemically synthesized
cagttgatccatcgagtgca

SEQ ID NO: 412783 - DNA, 20 bp, Artificial Sequence
  chemically synthesized
ccagttgatccatcgagtgc

SEQ ID NO: 412784 - DNA, 20 bp, Artificial Sequence
  chemically synthesized
tttgcagaccctgcactcga

SEQ ID NO: 412785 - DNA, 20 bp, Artificial Sequence
  chemically synthesized
accagttgatccatcgagtg

SEQ ID NO: 412786 - DNA, 20 bp, Artificial Sequence
  chemically synthesized
gtggtaccagttgatccatc

SEQ ID NO: 412787 - DNA, 20 bp, Artificial Sequence
  chemically synthesized
cctgcactcgatggatcaac

SEQ ID NO: 412788 - DNA, 20 bp, Artificial Sequence
  chemically synthesized
tttattgatctgtgtggtac

SEQ ID NO: 412789 - DNA, 20 bp, Artificial Sequence
  chemically synthesized
atggatcaactggtaccaca

SEQ ID NO: 412790 - DNA, 20 bp, Artificial Sequence
  chemically synthesized
agccagtttattgatctgtg

SEQ ID NO: 412791 - DNA, 20 bp, Artificial Sequence
  chemically synthesized
taccacacagatcaataaac

SEQ ID NO: 412792 - DNA, 20 bp, Artificial Sequence
  chemically synthesized
ggtcataggatgagatgagc

SEQ ID NO: 412793 - DNA, 20 bp, Artificial Sequence
  chemically synthesized
ggggggtcataggatgagat

SEQ ID NO: 412794 - DNA, 20 bp, Artificial Sequence
  chemically synthesized
tgagtggggggtcataggat

SEQ ID NO: 412795 - DNA, 20 bp, Artificial Sequence
  chemically synthesized
gttcctgagtggggggtcat

SEQ ID NO: 412796 - DNA, 20 bp, Artificial Sequence
  chemically synthesized
agttcctgagtggggggtca

SEQ ID NO: 412797 - DNA, 20 bp, Artificial Sequence
  chemically synthesized
tcatcctatgaccccccact

SEQ ID NO: 412798 - DNA, 20 bp, Artificial Sequence
  chemically synthesized
catcctatgaccccccactc

SEQ ID NO: 412799 - DNA, 20 bp, Artificial Sequence
  chemically synthesized
tgagtcagttcctgagtggg

SEQ ID NO: 412800 - DNA, 20 bp, Artificial Sequence
  chemically synthesized
ctgagtcagttcctgagtgg

SEQ ID NO: 412801 - DNA, 20 bp, Artificial Sequence
  chemically synthesized
cctgagtcagttcctgagtg

SEQ ID NO: 412802 - DNA, 20 bp, Artificial Sequence
  chemically synthesized
ccctgagtcagttcctgagt

SEQ ID NO: 412803 - DNA, 20 bp, Artificial Sequence
  chemically synthesized
gccctgagtcagttcctgag

SEQ ID NO: 412804 - DNA, 20 bp, Artificial Sequence
  chemically synthesized
cttgccctgagtcagttcct

SEQ ID NO: 412805 - DNA, 20 bp, Artificial Sequence
  chemically synthesized
cccccactcaggaactgact

SEQ ID NO: 412806 - DNA, 20 bp, Artificial Sequence
  chemically synthesized
ccccactcaggaactgactc

SEQ ID NO: 412807 - DNA, 20 bp, Artificial Sequence
  chemically synthesized
cccactcaggaactgactca

SEQ ID NO: 412808 - DNA, 20 bp, Artificial Sequence
  chemically synthesized
aaagctgtcttgccctgagt

SEQ ID NO: 412809 - DNA, 20 bp, Artificial Sequence
  chemically synthesized
ctcaggaactgactcagggc

SEQ ID NO: 412810 - DNA, 20 bp, Artificial Sequence
  chemically synthesized
agtcaaagctgtcttgccct

SEQ ID NO: 412811 - DNA, 20 bp, Artificial Sequence
  chemically synthesized
ggaactgactcagggcaaga

SEQ ID NO: 412812 - DNA, 20 bp, Artificial Sequence
  chemically synthesized
gatgaaatcatagggagtca

SEQ ID NO: 412813 - DNA, 20 bp, Artificial Sequence
  chemically synthesized
atcagagatgaaatcatagg

SEQ ID NO: 412814 - DNA, 20 bp, Artificial Sequence
  chemically synthesized
ggatcagagatgaaatcata

SEQ ID NO: 412815 - DNA, 20 bp, Artificial Sequence
  chemically synthesized
tggatcagagatgaaatcat

SEQ ID NO: 412816 - DNA, 20 bp, Artificial Sequence
  chemically synthesized
ttggatcagagatgaaatca

SEQ ID NO: 412817 - DNA, 20 bp, Artificial Sequence
  chemically synthesized
agtaatgattggttggatca

SEQ ID NO: 412818 - DNA, 20 bp, Artificial Sequence
  chemically synthesized
gaagtaatgattggttggat

SEQ ID NO: 412819 - DNA, 20 bp, Artificial Sequence
  chemically synthesized
ggtcagaagtaatgattggt

SEQ ID NO: 412820 - DNA, 20 bp, Artificial Sequence
  chemically synthesized
cagtggtcagaagtaatgat

SEQ ID NO: 412821 - DNA, 20 bp, Artificial Sequence
  chemically synthesized
ggggagcagccagtggtcag

SEQ ID NO: 412822 - DNA, 20 bp, Artificial Sequence
  chemically synthesized
caatcattacttctgaccac

SEQ ID NO: 412823 - DNA, 20 bp, Artificial Sequence
  chemically synthesized
ggtggggagcagccagtggt

SEQ ID NO: 412824 - DNA, 20 bp, Artificial Sequence
  chemically synthesized
ggtgggtggggagcagccag

SEQ ID NO: 412825 - DNA, 20 bp, Artificial Sequence
  chemically synthesized
tttggtgggtggggagcagc

SEQ ID NO: 412826 - DNA, 20 bp, Artificial Sequence
  chemically synthesized
acaatttggtgggtggggag

SEQ ID NO: 412827 - DNA, 20 bp, Artificial Sequence
  chemically synthesized
aggacaatttggtgggtggg

SEQ ID NO: 412828 - DNA, 20 bp, Artificial Sequence
  chemically synthesized
taaggacaatttggtgggtg

SEQ ID NO: 412829 - DNA, 20 bp, Artificial Sequence
  chemically synthesized
ttaaggacaatttggtgggt

SEQ ID NO: 412830 - DNA, 20 bp, Artificial Sequence
  chemically synthesized
tttaaggacaatttggtggg

SEQ ID NO: 412831 - DNA, 20 bp, Artificial Sequence
  chemically synthesized
gtttttaaggacaatttggt

SEQ ID NO: 412832 - DNA, 20 bp, Artificial Sequence
  chemically synthesized
ggtttttaaggacaatttgg

SEQ ID NO: 412833 - DNA, 20 bp, Artificial Sequence
  chemically synthesized
cagggtttttaaggacaatt

SEQ ID NO: 412834 - DNA, 20 bp, Artificial Sequence
  chemically synthesized
tttggggaccagggttttta

SEQ ID NO: 412835 - DNA, 20 bp, Artificial Sequence
  chemically synthesized
atttggggaccagggttttt

SEQ ID NO: 412836 - DNA, 20 bp, Artificial Sequence
  chemically synthesized
caaattgtccttaaaaaccc

SEQ ID NO: 412837 - DNA, 20 bp, Artificial Sequence
  chemically synthesized
ccctgagcatttggggacca

SEQ ID NO: 412838 - DNA, 20 bp, Artificial Sequence
  chemically synthesized
tccctgagcatttggggacc

SEQ ID NO: 412839 - DNA, 20 bp, Artificial Sequence
  chemically synthesized
ctccctgagcatttggggac

SEQ ID NO: 412840 - DNA, 20 bp, Artificial Sequence
  chemically synthesized
tcagtctccctgagcatttg

SEQ ID NO: 412841 - DNA, 20 bp, Artificial Sequence
  chemically synthesized
aaccctggtccccaaatgct

SEQ ID NO: 412842 - DNA, 20 bp, Artificial Sequence
  chemically synthesized
atcagtctccctgagcattt

SEQ ID NO: 412843 - DNA, 20 bp, Artificial Sequence
  chemically synthesized
accctggtccccaaatgctc

SEQ ID NO: 412844 - DNA, 20 bp, Artificial Sequence
  chemically synthesized
aatcagtctccctgagcatt

SEQ ID NO: 412845 - DNA, 20 bp, Artificial Sequence
  chemically synthesized
ccctggtccccaaatgctca

SEQ ID NO: 412846 - DNA, 20 bp, Artificial Sequence
  chemically synthesized
ctggtccccaaatgctcagg

SEQ ID NO: 412847 - DNA, 20 bp, Artificial Sequence
  chemically synthesized
ttactcaaatcagtctccct

SEQ ID NO: 412848 - DNA, 20 bp, Artificial Sequence
  chemically synthesized
atgctcagggagactgattt

SEQ ID NO: 412849 - DNA, 20 bp, Artificial Sequence
  chemically synthesized
agttttattattactcaaat

SEQ ID NO: 412850 - DNA, 20 bp, Artificial Sequence
  chemically synthesized
tttgagtaataataaaactc

SEQ ID NO: 412851 - DNA, 20 bp, Artificial Sequence
  chemically synthesized
gcaggctgtatgggagactg

SEQ ID NO: 412852 - DNA, 20 bp, Artificial Sequence
  chemically synthesized
gagcaggctgtatgggagac

SEQ ID NO: 412853 - DNA, 20 bp, Artificial Sequence
  chemically synthesized
taaaactccagtctcccata

SEQ ID NO: 412854 - DNA, 20 bp, Artificial Sequence
  chemically synthesized
atgcagagcaggctgtatgg

SEQ ID NO: 412855 - DNA, 20 bp, Artificial Sequence
  chemically synthesized
tcatgcagagcaggctgtat

SEQ ID NO: 412856 - DNA, 20 bp, Artificial Sequence
  chemically synthesized
ttcatgcagagcaggctgta

SEQ ID NO: 412857 - DNA, 20 bp, Artificial Sequence
  chemically synthesized
aagagtaattcatgcagagc

SEQ ID NO: 412858 - DNA, 20 bp, Artificial Sequence
  chemically synthesized
aaagagtaattcatgcagag

SEQ ID NO: 412859 - DNA, 20 bp, Artificial Sequence
  chemically synthesized
gagaaagagtaattcatgca

SEQ ID NO: 412860 - DNA, 20 bp, Artificial Sequence
  chemically synthesized
tagagaaagagtaattcatg

SEQ ID NO: 412861 - DNA, 20 bp, Artificial Sequence
  chemically synthesized
gggaaattgcaatagagaaa

SEQ ID NO: 412862 - DNA, 20 bp, Artificial Sequence
  chemically synthesized
cagggaaattgcaatagaga

SEQ ID NO: 412863 - DNA, 20 bp, Artificial Sequence
  chemically synthesized
aagacagggaaattgcaata

SEQ ID NO: 412864 - DNA, 20 bp, Artificial Sequence
  chemically synthesized
tcaagacagggaaattgcaa

SEQ ID NO: 412865 - DNA, 20 bp, Artificial Sequence
  chemically synthesized
agagttgatttatcaagaca

SEQ ID NO: 412866 - DNA, 20 bp, Artificial Sequence
  chemically synthesized
cagagttgatttatcaagac

SEQ ID NO: 412867 - DNA, 20 bp, Artificial Sequence
  chemically synthesized
acagagttgatttatcaaga

SEQ ID NO: 412868 - DNA, 20 bp, Artificial Sequence
  chemically synthesized
ctagacagagttgatttatc

SEQ ID NO: 412869 - DNA, 20 bp, Artificial Sequence
  chemically synthesized
cttgataaatcaactctgtc

SEQ ID NO: 412870 - DNA, 20 bp, Artificial Sequence
  chemically synthesized
tgataaatcaactctgtcta

SEQ ID NO: 412871 - DNA, 20 bp, Artificial Sequence
  chemically synthesized
ccttgcccactctctagaca

SEQ ID NO: 412872 - DNA, 20 bp, Artificial Sequence
  chemically synthesized
ataaatcaactctgtctaga

SEQ ID NO: 412873 - DNA, 20 bp, Artificial Sequence
  chemically synthesized
caccttgcccactctctaga

SEQ ID NO: 412874 - DNA, 20 bp, Artificial Sequence
  chemically synthesized
aatcaactctgtctagagag

SEQ ID NO: 412875 - DNA, 20 bp, Artificial Sequence
  chemically synthesized
atcaactctgtctagagagt

SEQ ID NO: 412876 - DNA, 20 bp, Artificial Sequence
  chemically synthesized
ggttcaccttgcccactctc

SEQ ID NO: 412877 - DNA, 20 bp, Artificial Sequence
  chemically synthesized
actctgtctagagagtgggc

SEQ ID NO: 412878 - DNA, 20 bp, Artificial Sequence
  chemically synthesized
ctctgtctagagagtgggca

SEQ ID NO: 412879 - DNA, 20 bp, Artificial Sequence
  chemically synthesized
agtgggcaaggtgaacctga

SEQ ID NO: 412880 - DNA, 20 bp, Artificial Sequence
  chemically synthesized
tacatactgcaattgccatc

SEQ ID NO: 412881 - DNA, 20 bp, Artificial Sequence
  chemically synthesized
atacatactgcaattgccat

SEQ ID NO: 412882 - DNA, 20 bp, Artificial Sequence
  chemically synthesized
ggtgaacctgatggcaattg

SEQ ID NO: 412883 - DNA, 20 bp, Artificial Sequence
  chemically synthesized
aaaattacatacaagatgtt

SEQ ID NO: 412884 - DNA, 20 bp, Artificial Sequence
  chemically synthesized
taaaattacatacaagatgt

SEQ ID NO: 412885 - DNA, 20 bp, Artificial Sequence
  chemically synthesized
catcccttaaaattacatac

SEQ ID NO: 412886 - DNA, 20 bp, Artificial Sequence
  chemically synthesized
aacatcttgtatgtaatttt

SEQ ID NO: 412887 - DNA, 20 bp, Artificial Sequence
  chemically synthesized
acatcttgtatgtaatttta

SEQ ID NO: 412888 - DNA, 20 bp, Artificial Sequence
  chemically synthesized
catcttgtatgtaattttaa

SEQ ID NO: 412889 - DNA, 20 bp, Artificial Sequence
  chemically synthesized
tatgtaattttaagggatgc

SEQ ID NO: 412890 - DNA, 20 bp, Artificial Sequence
  chemically synthesized
atgtaattttaagggatgca

SEQ ID NO: 412891 - DNA, 20 bp, Artificial Sequence
  chemically synthesized
ctaaagttctagtttatttt

SEQ ID NO: 412892 - DNA, 20 bp, Artificial Sequence
  chemically synthesized
cctaaagttctagtttattt

SEQ ID NO: 412893 - DNA, 20 bp, Artificial Sequence
  chemically synthesized
gcaaggatcccaaaataaac

SEQ ID NO: 412894 - DNA, 20 bp, Artificial Sequence
  chemically synthesized
cccaaaataaactagaactt

SEQ ID NO: 412895 - DNA, 20 bp, Artificial Sequence
  chemically synthesized
ccaaaataaactagaacttt

SEQ ID NO: 412896 - DNA, 20 bp, Artificial Sequence
  chemically synthesized
actcgatcaccctaaagttc

SEQ ID NO: 412897 - DNA, 20 bp, Artificial Sequence
  chemically synthesized
caaaataaactagaacttta

SEQ ID NO: 412898 - DNA, 20 bp, Artificial Sequence
  chemically synthesized
ccagacactcgatcacccta

SEQ ID NO: 412899 - DNA, 20 bp, Artificial Sequence
  chemically synthesized
actagaactttagggtgatc

SEQ ID NO: 412900 - DNA, 20 bp, Artificial Sequence
  chemically synthesized
ctttagggtgatcgagtgtc

SEQ ID NO: 412901 - DNA, 20 bp, Artificial Sequence
  chemically synthesized
gatcgagtgtctggtgtgcc

SEQ ID NO: 412902 - DNA, 20 bp, Artificial Sequence
  chemically synthesized
tgcttagcccccaggcacac

SEQ ID NO: 412903 - DNA, 20 bp, Artificial Sequence
  chemically synthesized
atcgagtgtctggtgtgcct

SEQ ID NO: 412904 - DNA, 20 bp, Artificial Sequence
  chemically synthesized
tcgagtgtctggtgtgcctg

SEQ ID NO: 412905 - DNA, 20 bp, Artificial Sequence
  chemically synthesized
cgagtgtctggtgtgcctgg

SEQ ID NO: 412906 - DNA, 20 bp, Artificial Sequence
  chemically synthesized
gtctggtgtgcctgggggct

SEQ ID NO: 412907 - DNA, 20 bp, Artificial Sequence
  chemically synthesized
cacaaacctgcttagccccc

SEQ ID NO: 412908 - DNA, 20 bp, Artificial Sequence
  chemically synthesized
ccacaaacctgcttagcccc

SEQ ID NO: 412909 - DNA, 20 bp, Artificial Sequence
  chemically synthesized
tggtgtgcctgggggctaag

SEQ ID NO: 412910 - DNA, 20 bp, Artificial Sequence
  chemically synthesized
ggtgtgcctgggggctaagc

SEQ ID NO: 412911 - DNA, 20 bp, Artificial Sequence
  chemically synthesized
ccatatcccacaaacctgct

SEQ ID NO: 412912 - DNA, 20 bp, Artificial Sequence
  chemically synthesized
ctgggggctaagcaggtttg

SEQ ID NO: 412913 - DNA, 20 bp, Artificial Sequence
  chemically synthesized
tgggggctaagcaggtttgt

SEQ ID NO: 412914 - DNA, 20 bp, Artificial Sequence
  chemically synthesized
ctaagcaggtttgtgggata

SEQ ID NO: 412915 - DNA, 20 bp, Artificial Sequence
  chemically synthesized
taagcaggtttgtgggatat

SEQ ID NO: 412916 - DNA, 20 bp, Artificial Sequence
  chemically synthesized
tttctcagttttaaaattta

SEQ ID NO: 412917 - DNA, 20 bp, Artificial Sequence
  chemically synthesized
ggactttaaattttaaaact

SEQ ID NO: 412918 - DNA, 20 bp, Artificial Sequence
  chemically synthesized
tttgtttttcaggaatttct

SEQ ID NO: 412919 - DNA, 20 bp, Artificial Sequence
  chemically synthesized
tttgtttgtttttgtttttc

SEQ ID NO: 412920 - DNA, 20 bp, Artificial Sequence
  chemically synthesized
ttttgtttgtttttgttttt

SEQ ID NO: 412921 - DNA, 20 bp, Artificial Sequence
  chemically synthesized
aaaacaaacaaaaataaaac

SEQ ID NO: 412922 - DNA, 20 bp, Artificial Sequence
  chemically synthesized
aaacaaaaataaaacaagaa

SEQ ID NO: 412923 - DNA, 20 bp, Artificial Sequence
  chemically synthesized
aaaaataaaacaagaaaagt

SEQ ID NO: 412924 - DNA, 20 bp, Artificial Sequence
  chemically synthesized
tatataaacgttacatttta

SEQ ID NO: 412925 - DNA, 20 bp, Artificial Sequence
  chemically synthesized
ctatataaacgttacatttt

SEQ ID NO: 412926 - DNA, 20 bp, Artificial Sequence
  chemically synthesized
gctatataaacgttacattt

SEQ ID NO: 412927 - DNA, 20 bp, Artificial Sequence
  chemically synthesized
cctaaaatgtaacgtttata

SEQ ID NO: 412928 - DNA, 20 bp, Artificial Sequence
  chemically synthesized
ctagtaaatagtatttatta

SEQ ID NO: 412929 - DNA, 20 bp, Artificial Sequence
  chemically synthesized
ctttaataaatactatttac

SEQ ID NO: 412930 - DNA, 20 bp, Artificial Sequence
  chemically synthesized
aagccttagcttctagtaaa

SEQ ID NO: 412931 - DNA, 20 bp, Artificial Sequence
  chemically synthesized
taataaatactatttactag

SEQ ID NO: 412932 - DNA, 20 bp, Artificial Sequence
  chemically synthesized
aatactatttactagaagct

SEQ ID NO: 412933 - DNA, 20 bp, Artificial Sequence
  chemically synthesized
atactatttactagaagcta

SEQ ID NO: 412934 - DNA, 20 bp, Artificial Sequence
  chemically synthesized
taaccaaaagccttagcttc

SEQ ID NO: 412935 - DNA, 20 bp, Artificial Sequence
  chemically synthesized
ttactagaagctaaggcttt

SEQ ID NO: 412936 - DNA, 20 bp, Artificial Sequence
  chemically synthesized
atatacataaccaaaagcct

SEQ ID NO: 412937 - DNA, 20 bp, Artificial Sequence
  chemically synthesized
tttataatatacataaccaa

SEQ ID NO: 412938 - DNA, 20 bp, Artificial Sequence
  chemically synthesized
tggttatgtatattataaat

SEQ ID NO: 412939 - DNA, 20 bp, Artificial Sequence
  chemically synthesized
ggttatgtatattataaatt

SEQ ID NO: 412940 - DNA, 20 bp, Artificial Sequence
  chemically synthesized
gtatattataaattaggcca

SEQ ID NO: 412941 - DNA, 20 bp, Artificial Sequence
  chemically synthesized
tatattataaattaggccat

SEQ ID NO: 412942 - DNA, 20 bp, Artificial Sequence
  chemically synthesized
atattataaattaggccata

SEQ ID NO: 412943 - DNA, 20 bp, Artificial Sequence
  chemically synthesized
ataaattaggccatagggca

SEQ ID NO: 412944 - DNA, 20 bp, Artificial Sequence
  chemically synthesized
cattttcttgctttgcccta

SEQ ID NO: 412945 - DNA, 20 bp, Artificial Sequence
  chemically synthesized
attaggccatagggcaaagc

SEQ ID NO: 412946 - DNA, 20 bp, Artificial Sequence
  chemically synthesized
agggcaaagcaagaaaatga

SEQ ID NO: 412947 - DNA, 20 bp, Artificial Sequence
  chemically synthesized
caagaaaatgaaagctttac

SEQ ID NO: 412948 - DNA, 20 bp, Artificial Sequence
  chemically synthesized
aagaaaatgaaagctttact

SEQ ID NO: 412949 - DNA, 20 bp, Artificial Sequence
  chemically synthesized
gtcacagttttgacctagta

SEQ ID NO: 412950 - DNA, 20 bp, Artificial Sequence
  chemically synthesized
gggcggtcacagttttgacc

SEQ ID NO: 412951 - DNA, 20 bp, Artificial Sequence
  chemically synthesized
ttgaacctcttgggcggtca

SEQ ID NO: 412952 - DNA, 20 bp, Artificial Sequence
  chemically synthesized
ggtcaaaactgtgaccgccc

SEQ ID NO: 412953 - DNA, 20 bp, Artificial Sequence
  chemically synthesized
tcaaaactgtgaccgcccaa

SEQ ID NO: 412954 - DNA, 20 bp, Artificial Sequence
  chemically synthesized
caaaactgtgaccgcccaag

SEQ ID NO: 412955 - DNA, 20 bp, Artificial Sequence
  chemically synthesized
ggcgagttgaacctcttggg

SEQ ID NO: 412956 - DNA, 20 bp, Artificial Sequence
  chemically synthesized
gcaggcgagttgaacctctt

SEQ ID NO: 412957 - DNA, 20 bp, Artificial Sequence
  chemically synthesized
agcaggcgagttgaacctct

SEQ ID NO: 412958 - DNA, 20 bp, Artificial Sequence
  chemically synthesized
gctctgtccaggcagcaggc

SEQ ID NO: 412959 - DNA, 20 bp, Artificial Sequence
  chemically synthesized
ggttcaactcgcctgctgcc

SEQ ID NO: 412960 - DNA, 20 bp, Artificial Sequence
  chemically synthesized
atcggctctgtccaggcagc

SEQ ID NO: 412961 - DNA, 20 bp, Artificial Sequence
  chemically synthesized
aatcggctctgtccaggcag

SEQ ID NO: 412962 - DNA, 20 bp, Artificial Sequence
  chemically synthesized
caactcgcctgctgcctgga

SEQ ID NO: 412963 - DNA, 20 bp, Artificial Sequence
  chemically synthesized
atgaatcggctctgtccagg

SEQ ID NO: 412964 - DNA, 20 bp, Artificial Sequence
  chemically synthesized
actcgcctgctgcctggaca

SEQ ID NO: 412965 - DNA, 20 bp, Artificial Sequence
  chemically synthesized
ttgatgaatcggctctgtcc

SEQ ID NO: 412966 - DNA, 20 bp, Artificial Sequence
  chemically synthesized
cttgatgaatcggctctgtc

SEQ ID NO: 412967 - DNA, 20 bp, Artificial Sequence
  chemically synthesized
ctggacagagccgattcatc

SEQ ID NO: 412968 - DNA, 20 bp, Artificial Sequence
  chemically synthesized
attcccctgtcttgatgaat

SEQ ID NO: 412969 - DNA, 20 bp, Artificial Sequence
  chemically synthesized
acagagccgattcatcaaga

SEQ ID NO: 412970 - DNA, 20 bp, Artificial Sequence
  chemically synthesized
cagagccgattcatcaagac

SEQ ID NO: 412971 - DNA, 20 bp, Artificial Sequence
  chemically synthesized
agagccgattcatcaagaca

SEQ ID NO: 412972 - DNA, 20 bp, Artificial Sequence
  chemically synthesized
gagccgattcatcaagacag

SEQ ID NO: 412973 - DNA, 20 bp, Artificial Sequence
  chemically synthesized
tcaagacaggggaattgcaa

SEQ ID NO: 412974 - DNA, 20 bp, Artificial Sequence
  chemically synthesized
aagacaggggaattgcaata

SEQ ID NO: 412975 - DNA, 20 bp, Artificial Sequence
  chemically synthesized
caggggaattgcaatagaga

SEQ ID NO: 412976 - DNA, 20 bp, Artificial Sequence
  chemically synthesized
ggggaattgcaatagagaaa

SEQ ID NO: 412977 - DNA, 20 bp, Artificial Sequence
  chemically synthesized
tagagaaagagtaactccct

SEQ ID NO: 412978 - DNA, 20 bp, Artificial Sequence
  chemically synthesized
gagaaagagtaactccctca

SEQ ID NO: 412979 - DNA, 20 bp, Artificial Sequence
  chemically synthesized
ccgcacagctggctctgagg

SEQ ID NO: 412980 - DNA, 20 bp, Artificial Sequence
  chemically synthesized
aagagtaactccctcagagc

SEQ ID NO: 412981 - DNA, 20 bp, Artificial Sequence
  chemically synthesized
tcccgcacagctggctctga

SEQ ID NO: 412982 - DNA, 20 bp, Artificial Sequence
  chemically synthesized
ctcccgcacagctggctctg

SEQ ID NO: 412983 - DNA, 20 bp, Artificial Sequence
  chemically synthesized
tctcccgcacagctggctct

SEQ ID NO: 412984 - DNA, 20 bp, Artificial Sequence
  chemically synthesized
ctccctcagagccagctgtg

SEQ ID NO: 412985 - DNA, 20 bp, Artificial Sequence
  chemically synthesized
tccctcagagccagctgtgc

SEQ ID NO: 412986 - DNA, 20 bp, Artificial Sequence
  chemically synthesized
acttcggtctcccgcacagc

SEQ ID NO: 412987 - DNA, 20 bp, Artificial Sequence
  chemically synthesized
cctcagagccagctgtgcgg

SEQ ID NO: 412988 - DNA, 20 bp, Artificial Sequence
  chemically synthesized
taaaacttcggtctcccgca

SEQ ID NO: 412989 - DNA, 20 bp, Artificial Sequence
  chemically synthesized
gccagctgtgcgggagaccg

SEQ ID NO: 412990 - DNA, 20 bp, Artificial Sequence
  chemically synthesized
tttgagtaataataaaactt

SEQ ID NO: 412991 - DNA, 20 bp, Artificial Sequence
  chemically synthesized
agttttattattactcaaat

SEQ ID NO: 412992 - DNA, 20 bp, Artificial Sequence
  chemically synthesized
atgcttggggagactgattt

SEQ ID NO: 412993 - DNA, 20 bp, Artificial Sequence
  chemically synthesized
ttactcaaatcagtctcccc

SEQ ID NO: 412994 - DNA, 20 bp, Artificial Sequence
  chemically synthesized
ctgctccccgaatgcttggg

SEQ ID NO: 412995 - DNA, 20 bp, Artificial Sequence
  chemically synthesized
ctctgctccccgaatgcttg

SEQ ID NO: 412996 - DNA, 20 bp, Artificial Sequence
  chemically synthesized
aatcagtctccccaagcatt

SEQ ID NO: 412997 - DNA, 20 bp, Artificial Sequence
  chemically synthesized
actctgctccccgaatgctt

SEQ ID NO: 412998 - DNA, 20 bp, Artificial Sequence
  chemically synthesized
atcagtctccccaagcattc

SEQ ID NO: 412999 - DNA, 20 bp, Artificial Sequence
  chemically synthesized
aactctgctccccgaatgct

SEQ ID NO: 413000 - DNA, 20 bp, Artificial Sequence
  chemically synthesized
tcagtctccccaagcattcg

SEQ ID NO: 413001 - DNA, 20 bp, Artificial Sequence
  chemically synthesized
agtctccccaagcattcggg

SEQ ID NO: 413002 - DNA, 20 bp, Artificial Sequence
  chemically synthesized
ctccccaagcattcggggag

SEQ ID NO: 413003 - DNA, 20 bp, Artificial Sequence
  chemically synthesized
ccccaagcattcggggagca

SEQ ID NO: 413004 - DNA, 20 bp, Artificial Sequence
  chemically synthesized
attcggggagcagagttttt

SEQ ID NO: 413005 - DNA, 20 bp, Artificial Sequence
  chemically synthesized
ttcggggagcagagttttta

SEQ ID NO: 413006 - DNA, 20 bp, Artificial Sequence
  chemically synthesized
cagagtttttaaggataact

SEQ ID NO: 413007 - DNA, 20 bp, Artificial Sequence
  chemically synthesized
agtttttaaggataacttgg

SEQ ID NO: 413008 - DNA, 20 bp, Artificial Sequence
  chemically synthesized
gtttttaaggataacttggt

SEQ ID NO: 413009 - DNA, 20 bp, Artificial Sequence
  chemically synthesized
tttaaggataacttggtggg

SEQ ID NO: 413010 - DNA, 20 bp, Artificial Sequence
  chemically synthesized
ttaaggataacttggtgggt

SEQ ID NO: 413011 - DNA, 20 bp, Artificial Sequence
  chemically synthesized
ctggcttccccccacccacc

SEQ ID NO: 413012 - DNA, 20 bp, Artificial Sequence
  chemically synthesized
taaggataacttggtgggtg

SEQ ID NO: 413013 - DNA, 20 bp, Artificial Sequence
  chemically synthesized
aaggataacttggtgggtgg

SEQ ID NO: 413014 - DNA, 20 bp, Artificial Sequence
  chemically synthesized
aggataacttggtgggtggg

SEQ ID NO: 413015 - DNA, 20 bp, Artificial Sequence
  chemically synthesized
ataacttggtgggtgggggg

SEQ ID NO: 413016 - DNA, 20 bp, Artificial Sequence
  chemically synthesized
cttggtgggtggggggaagc

SEQ ID NO: 413017 - DNA, 20 bp, Artificial Sequence
  chemically synthesized
gtgggtggggggaagccagt

SEQ ID NO: 413018 - DNA, 20 bp, Artificial Sequence
  chemically synthesized
gtggggggaagccagtgagc

SEQ ID NO: 413019 - DNA, 20 bp, Artificial Sequence
  chemically synthesized
tggggggaagccagtgagcc

SEQ ID NO: 413020 - DNA, 20 bp, Artificial Sequence
  chemically synthesized
agtcagcactcctggctcac

SEQ ID NO: 413021 - DNA, 20 bp, Artificial Sequence
  chemically synthesized
gggggaagccagtgagccag

SEQ ID NO: 413022 - DNA, 20 bp, Artificial Sequence
  chemically synthesized
ctctgaccagtcagcactcc

SEQ ID NO: 413023 - DNA, 20 bp, Artificial Sequence
  chemically synthesized
agtgagccaggagtgctgac

SEQ ID NO: 413024 - DNA, 20 bp, Artificial Sequence
  chemically synthesized
agccaggagtgctgactggt

SEQ ID NO: 413025 - DNA, 20 bp, Artificial Sequence
  chemically synthesized
tgatttcatctctgaccagt

SEQ ID NO: 413026 - DNA, 20 bp, Artificial Sequence
  chemically synthesized
ccaggagtgctgactggtca

SEQ ID NO: 413027 - DNA, 20 bp, Artificial Sequence
  chemically synthesized
cctgtgatttcatctctgac

SEQ ID NO: 413028 - DNA, 20 bp, Artificial Sequence
  chemically synthesized
actggtcagagatgaaatca

SEQ ID NO: 413029 - DNA, 20 bp, Artificial Sequence
  chemically synthesized
ctggtcagagatgaaatcac

SEQ ID NO: 413030 - DNA, 20 bp, Artificial Sequence
  chemically synthesized
tggtcagagatgaaatcaca

SEQ ID NO: 413031 - DNA, 20 bp, Artificial Sequence
  chemically synthesized
gtcagagatgaaatcacagg

SEQ ID NO: 413032 - DNA, 20 bp, Artificial Sequence
  chemically synthesized
gagatgaaatcacagggagt

SEQ ID NO: 413033 - DNA, 20 bp, Artificial Sequence
  chemically synthesized
gatgaaatcacagggagtcg

SEQ ID NO: 413034 - DNA, 20 bp, Artificial Sequence
  chemically synthesized
actgactcagcgcaagaaga

SEQ ID NO: 413035 - DNA, 20 bp, Artificial Sequence
  chemically synthesized
aggaactgactcagcgcaag

SEQ ID NO: 413036 - DNA, 20 bp, Artificial Sequence
  chemically synthesized
cggagctgtcttcttgcgct

SEQ ID NO: 413037 - DNA, 20 bp, Artificial Sequence
  chemically synthesized
cccaggaactgactcagcgc

SEQ ID NO: 413038 - DNA, 20 bp, Artificial Sequence
  chemically synthesized
gctgtcttcttgcgctgagt

SEQ ID NO: 413039 - DNA, 20 bp, Artificial Sequence
  chemically synthesized
cctccacccaggaactgact

SEQ ID NO: 413040 - DNA, 20 bp, Artificial Sequence
  chemically synthesized
tcttgcgctgagtcagttcc

SEQ ID NO: 413041 - DNA, 20 bp, Artificial Sequence
  chemically synthesized
cttgcgctgagtcagttcct

SEQ ID NO: 413042 - DNA, 20 bp, Artificial Sequence
  chemically synthesized
gcgctgagtcagttcctggg

SEQ ID NO: 413043 - DNA, 20 bp, Artificial Sequence
  chemically synthesized
gctgagtcagttcctgggtg

SEQ ID NO: 413044 - DNA, 20 bp, Artificial Sequence
  chemically synthesized
ctgagtcagttcctgggtgg

SEQ ID NO: 413045 - DNA, 20 bp, Artificial Sequence
  chemically synthesized
tgatcttgtggcctccaccc

SEQ ID NO: 413046 - DNA, 20 bp, Artificial Sequence
  chemically synthesized
ctgatcttgtggcctccacc

SEQ ID NO: 413047 - DNA, 20 bp, Artificial Sequence
  chemically synthesized
agttcctgggtggaggccac

SEQ ID NO: 413048 - DNA, 20 bp, Artificial Sequence
  chemically synthesized
ctgggtggaggccacaagat

SEQ ID NO: 413049 - DNA, 20 bp, Artificial Sequence
  chemically synthesized
aactggctcatctgatcttg

SEQ ID NO: 413050 - DNA, 20 bp, Artificial Sequence
  chemically synthesized
tggaggccacaagatcagat

SEQ ID NO: 413051 - DNA, 20 bp, Artificial Sequence
  chemically synthesized
ggccacaagatcagatgagc

SEQ ID NO: 413052 - DNA, 20 bp, Artificial Sequence
  chemically synthesized
caccacccagatcaataaac

SEQ ID NO: 413053 - DNA, 20 bp, Artificial Sequence
  chemically synthesized
gatgagccagtttattgatc

SEQ ID NO: 413054 - DNA, 20 bp, Artificial Sequence
  chemically synthesized
atgagccagtttattgatct

SEQ ID NO: 413055 - DNA, 20 bp, Artificial Sequence
  chemically synthesized
agccagtttattgatctggg

SEQ ID NO: 413056 - DNA, 20 bp, Artificial Sequence
  chemically synthesized
atggatcagctggcaccacc

SEQ ID NO: 413057 - DNA, 20 bp, Artificial Sequence
  chemically synthesized
tttattgatctgggtggtgc

SEQ ID NO: 413058 - DNA, 20 bp, Artificial Sequence
  chemically synthesized
cctgcacttgatggatcagc

SEQ ID NO: 413059 - DNA, 20 bp, Artificial Sequence
  chemically synthesized
gtggtgccagctgatccatc

SEQ ID NO: 413060 - DNA, 20 bp, Artificial Sequence
  chemically synthesized
agaccctgcacttgatggat

SEQ ID NO: 413061 - DNA, 20 bp, Artificial Sequence
  chemically synthesized
gccagctgatccatcaagtg

SEQ ID NO: 413062 - DNA, 20 bp, Artificial Sequence
  chemically synthesized
tttgcagaccctgcacttga

SEQ ID NO: 413063 - DNA, 20 bp, Artificial Sequence
  chemically synthesized
ccagctgatccatcaagtgc

SEQ ID NO: 413064 - DNA, 20 bp, Artificial Sequence
  chemically synthesized
cagctgatccatcaagtgca

SEQ ID NO: 413065 - DNA, 20 bp, Artificial Sequence
  chemically synthesized
tcagtgcttgagatattttg

SEQ ID NO: 413066 - DNA, 20 bp, Artificial Sequence
  chemically synthesized
cagggtctgcaaaatatctc

SEQ ID NO: 413067 - DNA, 20 bp, Artificial Sequence
  chemically synthesized
tgctcctaagatcagtgctt

SEQ ID NO: 413068 - DNA, 20 bp, Artificial Sequence
  chemically synthesized
aatatctcaagcactgatct

SEQ ID NO: 413069 - DNA, 20 bp, Artificial Sequence
  chemically synthesized
atatctcaagcactgatctt

SEQ ID NO: 413070 - DNA, 20 bp, Artificial Sequence
  chemically synthesized
atctcaagcactgatcttag

SEQ ID NO: 413071 - DNA, 20 bp, Artificial Sequence
  chemically synthesized
caccaaactgctcctaagat

SEQ ID NO: 413072 - DNA, 20 bp, Artificial Sequence
  chemically synthesized
tcaagcactgatcttaggag

SEQ ID NO: 413073 - DNA, 20 bp, Artificial Sequence
  chemically synthesized
acccccaccaaactgctcct

SEQ ID NO: 413074 - DNA, 20 bp, Artificial Sequence
  chemically synthesized
cactgatcttaggagcagtt

SEQ ID NO: 413075 - DNA, 20 bp, Artificial Sequence
  chemically synthesized
tgatcttaggagcagtttgg

SEQ ID NO: 413076 - DNA, 20 bp, Artificial Sequence
  chemically synthesized
gatcttaggagcagtttggt

SEQ ID NO: 413077 - DNA, 20 bp, Artificial Sequence
  chemically synthesized
atcttaggagcagtttggtg

SEQ ID NO: 413078 - DNA, 20 bp, Artificial Sequence
  chemically synthesized
tcttaggagcagtttggtgg

SEQ ID NO: 413079 - DNA, 20 bp, Artificial Sequence
  chemically synthesized
aggagcagtttggtgggggt

SEQ ID NO: 413080 - DNA, 20 bp, Artificial Sequence
  chemically synthesized
gtcatgcagctggaggcaac

SEQ ID NO: 413081 - DNA, 20 bp, Artificial Sequence
  chemically synthesized
ggtcagaatcttgttgcctc

SEQ ID NO: 413082 - DNA, 20 bp, Artificial Sequence
  chemically synthesized
tttaggagtcatgcagctgg

SEQ ID NO: 413083 - DNA, 20 bp, Artificial Sequence
  chemically synthesized
gtttaggagtcatgcagctg

SEQ ID NO: 413084 - DNA, 20 bp, Artificial Sequence
  chemically synthesized
tggtttaggagtcatgcagc

SEQ ID NO: 413085 - DNA, 20 bp, Artificial Sequence
  chemically synthesized
attatggtttaggagtcatg

SEQ ID NO: 413086 - DNA, 20 bp, Artificial Sequence
  chemically synthesized
tgttagaaattatggtttag

SEQ ID NO: 413087 - DNA, 20 bp, Artificial Sequence
  chemically synthesized
agtgttagaaattatggttt

SEQ ID NO: 413088 - DNA, 20 bp, Artificial Sequence
  chemically synthesized
cagtgttagaaattatggtt

SEQ ID NO: 413089 - DNA, 20 bp, Artificial Sequence
  chemically synthesized
agccacagtgttagaaatta

SEQ ID NO: 413090 - DNA, 20 bp, Artificial Sequence
  chemically synthesized
aaccataatttctaacactg

SEQ ID NO: 413091 - DNA, 20 bp, Artificial Sequence
  chemically synthesized
actaacatcagccacagtgt

SEQ ID NO: 413092 - DNA, 20 bp, Artificial Sequence
  chemically synthesized
tgtaggactaacatcagcca

SEQ ID NO: 413093 - DNA, 20 bp, Artificial Sequence
  chemically synthesized
tctaacactgtggctgatgt

SEQ ID NO: 413094 - DNA, 20 bp, Artificial Sequence
  chemically synthesized
tgcgtttgtaggactaacat

SEQ ID NO: 413095 - DNA, 20 bp, Artificial Sequence
  chemically synthesized
tgcctgggacttgcgtttgt

SEQ ID NO: 413096 - DNA, 20 bp, Artificial Sequence
  chemically synthesized
gatgttagtcctacaaacgc

SEQ ID NO: 413097 - DNA, 20 bp, Artificial Sequence
  chemically synthesized
ttgcctgggacttgcgtttg

SEQ ID NO: 413098 - DNA, 20 bp, Artificial Sequence
  chemically synthesized
agtcctacaaacgcaagtcc

SEQ ID NO: 413099 - DNA, 20 bp, Artificial Sequence
  chemically synthesized
gtcctacaaacgcaagtccc

SEQ ID NO: 413100 - DNA, 20 bp, Artificial Sequence
  chemically synthesized
tacaaacgcaagtcccaggc

SEQ ID NO: 413101 - DNA, 20 bp, Artificial Sequence
  chemically synthesized
aaacgcaagtcccaggcaag

SEQ ID NO: 413102 - DNA, 20 bp, Artificial Sequence
  chemically synthesized
agcaaaattccttcttgcct

SEQ ID NO: 413103 - DNA, 20 bp, Artificial Sequence
  chemically synthesized
aacgcaagtcccaggcaaga

SEQ ID NO: 413104 - DNA, 20 bp, Artificial Sequence
  chemically synthesized
gagcaaaattccttcttgcc

SEQ ID NO: 413105 - DNA, 20 bp, Artificial Sequence
  chemically synthesized
ggcaagaaggaattttgctc

SEQ ID NO: 413106 - DNA, 20 bp, Artificial Sequence
  chemically synthesized
gcaagaaggaattttgctct

SEQ ID NO: 413107 - DNA, 20 bp, Artificial Sequence
  chemically synthesized
gaaggaattttgctctggga

SEQ ID NO: 413108 - DNA, 20 bp, Artificial Sequence
  chemically synthesized
aaggaattttgctctgggaa

SEQ ID NO: 413109 - DNA, 20 bp, Artificial Sequence
  chemically synthesized
aggaattttgctctgggaaa

SEQ ID NO: 413110 - DNA, 20 bp, Artificial Sequence
  chemically synthesized
atggtaacagccctttccca

SEQ ID NO: 413111 - DNA, 20 bp, Artificial Sequence
  chemically synthesized
agatggtaacagccctttcc

SEQ ID NO: 413112 - DNA, 20 bp, Artificial Sequence
  chemically synthesized
ttacagtttaaagatggtaa

SEQ ID NO: 413113 - DNA, 20 bp, Artificial Sequence
  chemically synthesized
cttagtttacagtttaaaga

SEQ ID NO: 413114 - DNA, 20 bp, Artificial Sequence
  chemically synthesized
gaaacttagtttacagttta

SEQ ID NO: 413115 - DNA, 20 bp, Artificial Sequence
  chemically synthesized
ccatctttaaactgtaaact

SEQ ID NO: 413116 - DNA, 20 bp, Artificial Sequence
  chemically synthesized
tttgggagaaacttagttta

SEQ ID NO: 413117 - DNA, 20 bp, Artificial Sequence
  chemically synthesized
aactaactttgggagaaact

SEQ ID NO: 413118 - DNA, 20 bp, Artificial Sequence
  chemically synthesized
tgtaaactaagtttctccca

SEQ ID NO: 413119 - DNA, 20 bp, Artificial Sequence
  chemically synthesized
aactaagtttctcccaaagt

SEQ ID NO: 413120 - DNA, 20 bp, Artificial Sequence
  chemically synthesized
ataggctgaactaactttgg

SEQ ID NO: 413121 - DNA, 20 bp, Artificial Sequence
  chemically synthesized
gcataggctgaactaacttt

SEQ ID NO: 413122 - DNA, 20 bp, Artificial Sequence
  chemically synthesized
ggcataggctgaactaactt

SEQ ID NO: 413123 - DNA, 20 bp, Artificial Sequence
  chemically synthesized
agtttctcccaaagttagtt

SEQ ID NO: 413124 - DNA, 20 bp, Artificial Sequence
  chemically synthesized
aagttagttcagcctatgcc

SEQ ID NO: 413125 - DNA, 20 bp, Artificial Sequence
  chemically synthesized
agttagttcagcctatgccc

SEQ ID NO: 413126 - DNA, 20 bp, Artificial Sequence
  chemically synthesized
cttcgttcattcctgggcat

SEQ ID NO: 413127 - DNA, 20 bp, Artificial Sequence
  chemically synthesized
tcttcgttcattcctgggca

SEQ ID NO: 413128 - DNA, 20 bp, Artificial Sequence
  chemically synthesized
agctgtcttcgttcattcct

SEQ ID NO: 413129 - DNA, 20 bp, Artificial Sequence
  chemically synthesized
aagctgtcttcgttcattcc

SEQ ID NO: 413130 - DNA, 20 bp, Artificial Sequence
  chemically synthesized
cctatgcccaggaatgaacg

SEQ ID NO: 413131 - DNA, 20 bp, Artificial Sequence
  chemically synthesized
tgcccaggaatgaacgaaga

SEQ ID NO: 413132 - DNA, 20 bp, Artificial Sequence
  chemically synthesized
aggaatgaacgaagacagct

SEQ ID NO: 413133 - DNA, 20 bp, Artificial Sequence
  chemically synthesized
gaatgaacgaagacagcttg

SEQ ID NO: 413134 - DNA, 20 bp, Artificial Sequence
  chemically synthesized
aatgaacgaagacagcttgg

SEQ ID NO: 413135 - DNA, 20 bp, Artificial Sequence
  chemically synthesized
aacgaagacagcttggaggt

SEQ ID NO: 413136 - DNA, 20 bp, Artificial Sequence
  chemically synthesized
ccatcttgcttctaacctcc

SEQ ID NO: 413137 - DNA, 20 bp, Artificial Sequence
  chemically synthesized
gaagacagcttggaggttag

SEQ ID NO: 413138 - DNA, 20 bp, Artificial Sequence
  chemically synthesized
acagcttggaggttagaagc

SEQ ID NO: 413139 - DNA, 20 bp, Artificial Sequence
  chemically synthesized
cttggaggttagaagcaaga

SEQ ID NO: 413140 - DNA, 20 bp, Artificial Sequence
  chemically synthesized
tggaggttagaagcaagatg

SEQ ID NO: 413141 - DNA, 20 bp, Artificial Sequence
  chemically synthesized
ggttagaagcaagatggagt

SEQ ID NO: 413142 - DNA, 20 bp, Artificial Sequence
  chemically synthesized
gaagcaagatggagtcagtt

SEQ ID NO: 413143 - DNA, 20 bp, Artificial Sequence
  chemically synthesized
caagatggagtcagttaagt

SEQ ID NO: 413144 - DNA, 20 bp, Artificial Sequence
  chemically synthesized
ttagattgttttcactgtct

SEQ ID NO: 413145 - DNA, 20 bp, Artificial Sequence
  chemically synthesized
ttgcaaaattaggtctgaga

SEQ ID NO: 413146 - DNA, 20 bp, Artificial Sequence
  chemically synthesized
acctttgcaaaattaggtct

SEQ ID NO: 413147 - DNA, 20 bp, Artificial Sequence
  chemically synthesized
gaaaccacctttgcaaaatt

SEQ ID NO: 413148 - DNA, 20 bp, Artificial Sequence
  chemically synthesized
tgaaaccacctttgcaaaat

SEQ ID NO: 413149 - DNA, 20 bp, Artificial Sequence
  chemically synthesized
gtctcagacctaattttgca

SEQ ID NO: 413150 - DNA, 20 bp, Artificial Sequence
  chemically synthesized
tctcagacctaattttgcaa

SEQ ID NO: 413151 - DNA, 20 bp, Artificial Sequence
  chemically synthesized
cagacctaattttgcaaagg

SEQ ID NO: 413152 - DNA, 20 bp, Artificial Sequence
  chemically synthesized
gtggtttcaatcccttcctt

SEQ ID NO: 413153 - DNA, 20 bp, Artificial Sequence
  chemically synthesized
tggtttcaatcccttccttt

SEQ ID NO: 413154 - DNA, 20 bp, Artificial Sequence
  chemically synthesized
tgttagaaaacccaaaggaa

SEQ ID NO: 413155 - DNA, 20 bp, Artificial Sequence
  chemically synthesized
gtgttagaaaacccaaagga

SEQ ID NO: 413156 - DNA, 20 bp, Artificial Sequence
  chemically synthesized
agtgttagaaaacccaaagg

SEQ ID NO: 413157 - DNA, 20 bp, Artificial Sequence
  chemically synthesized
taaagtgttagaaaacccaa

SEQ ID NO: 413158 - DNA, 20 bp, Artificial Sequence
  chemically synthesized
ttaaagtgttagaaaaccca

SEQ ID NO: 413159 - DNA, 20 bp, Artificial Sequence
  chemically synthesized
ataccttagggttaaagtgt

SEQ ID NO: 413160 - DNA, 20 bp, Artificial Sequence
  chemically synthesized
ttttctaacactttaaccct

SEQ ID NO: 413161 - DNA, 20 bp, Artificial Sequence
  chemically synthesized
tagcctataccttagggtta

SEQ ID NO: 413162 - DNA, 20 bp, Artificial Sequence
  chemically synthesized
tttctaacactttaacccta

SEQ ID NO: 413163 - DNA, 20 bp, Artificial Sequence
  chemically synthesized
aacactttaaccctaaggta

SEQ ID NO: 413164 - DNA, 20 bp, Artificial Sequence
  chemically synthesized
tctttatagcctatacctta

SEQ ID NO: 413165 - DNA, 20 bp, Artificial Sequence
  chemically synthesized
acactttaaccctaaggtat

SEQ ID NO: 413166 - DNA, 20 bp, Artificial Sequence
  chemically synthesized
atctttatagcctatacctt

SEQ ID NO: 413167 - DNA, 20 bp, Artificial Sequence
  chemically synthesized
catctttatagcctatacct

SEQ ID NO: 413168 - DNA, 20 bp, Artificial Sequence
  chemically synthesized
accctaaggtataggctata

SEQ ID NO: 413169 - DNA, 20 bp, Artificial Sequence
  chemically synthesized
taaggtataggctataaaga

SEQ ID NO: 413170 - DNA, 20 bp, Artificial Sequence
  chemically synthesized
aaggtataggctataaagat

SEQ ID NO: 413171 - DNA, 20 bp, Artificial Sequence
  chemically synthesized
acggccttttcccatcttta

SEQ ID NO: 413172 - DNA, 20 bp, Artificial Sequence
  chemically synthesized
ataggctataaagatgggaa

SEQ ID NO: 413173 - DNA, 20 bp, Artificial Sequence
  chemically synthesized
taggctataaagatgggaaa

SEQ ID NO: 413174 - DNA, 20 bp, Artificial Sequence
  chemically synthesized
gaagaagccagagcgatcga

SEQ ID NO: 413175 - DNA, 20 bp, Artificial Sequence
  chemically synthesized
gaaaaggccgtcgatcgctc

SEQ ID NO: 413176 - DNA, 20 bp, Artificial Sequence
  chemically synthesized
ccatcagcaggaagaagcca

SEQ ID NO: 413177 - DNA, 20 bp, Artificial Sequence
  chemically synthesized
ccccatcagcaggaagaagc

SEQ ID NO: 413178 - DNA, 20 bp, Artificial Sequence
  chemically synthesized
cttcccccatcagcaggaag

SEQ ID NO: 413179 - DNA, 20 bp, Artificial Sequence
  chemically synthesized
ctacttcccccatcagcagg

SEQ ID NO: 413180 - DNA, 20 bp, Artificial Sequence
  chemically synthesized
ctctggcttcttcctgctga

SEQ ID NO: 413181 - DNA, 20 bp, Artificial Sequence
  chemically synthesized
tctggcttcttcctgctgat

SEQ ID NO: 413182 - DNA, 20 bp, Artificial Sequence
  chemically synthesized
ctggcttcttcctgctgatg

SEQ ID NO: 413183 - DNA, 20 bp, Artificial Sequence
  chemically synthesized
ccgctacttcccccatcagc

SEQ ID NO: 413184 - DNA, 20 bp, Artificial Sequence
  chemically synthesized
tggcttcttcctgctgatgg

SEQ ID NO: 413185 - DNA, 20 bp, Artificial Sequence
  chemically synthesized
cccgctacttcccccatcag

SEQ ID NO: 413186 - DNA, 20 bp, Artificial Sequence
  chemically synthesized
cttcttcctgctgatggggg

SEQ ID NO: 413187 - DNA, 20 bp, Artificial Sequence
  chemically synthesized
attcccgctacttcccccat

SEQ ID NO: 413188 - DNA, 20 bp, Artificial Sequence
  chemically synthesized
cttcctgctgatgggggaag

SEQ ID NO: 413189 - DNA, 20 bp, Artificial Sequence
  chemically synthesized
cctgctgatgggggaagtag

SEQ ID NO: 413190 - DNA, 20 bp, Artificial Sequence
  chemically synthesized
ctgctgatgggggaagtagc

SEQ ID NO: 413191 - DNA, 20 bp, Artificial Sequence
  chemically synthesized
gatgggggaagtagcgggaa

SEQ ID NO: 413192 - DNA, 20 bp, Artificial Sequence
  chemically synthesized
atgggggaagtagcgggaat

SEQ ID NO: 413193 - DNA, 20 bp, Artificial Sequence
  chemically synthesized
cgggaatgggaacgaactcc

SEQ ID NO: 413194 - DNA, 20 bp, Artificial Sequence
  chemically synthesized
gggaatgggaacgaactcca

SEQ ID NO: 413195 - DNA, 20 bp, Artificial Sequence
  chemically synthesized
atgggaacgaactccaaggt

SEQ ID NO: 413196 - DNA, 20 bp, Artificial Sequence
  chemically synthesized
gttccactcttctcaccttg

SEQ ID NO: 413197 - DNA, 20 bp, Artificial Sequence
  chemically synthesized
ggaacgaactccaaggtgag

SEQ ID NO: 413198 - DNA, 20 bp, Artificial Sequence
  chemically synthesized
cagttccactcttctcacct

SEQ ID NO: 413199 - DNA, 20 bp, Artificial Sequence
  chemically synthesized
aacgaactccaaggtgagaa

SEQ ID NO: 413200 - DNA, 20 bp, Artificial Sequence
  chemically synthesized
gaactccaaggtgagaagag

SEQ ID NO: 413201 - DNA, 20 bp, Artificial Sequence
  chemically synthesized
ccactcaaacagttgcaaag

SEQ ID NO: 413202 - DNA, 20 bp, Artificial Sequence
  chemically synthesized
aatccactcaaacagttgca

SEQ ID NO: 413203 - DNA, 20 bp, Artificial Sequence
  chemically synthesized
gaactgctttgcaactgttt

SEQ ID NO: 413204 - DNA, 20 bp, Artificial Sequence
  chemically synthesized
ctgctttgcaactgtttgag

SEQ ID NO: 413205 - DNA, 20 bp, Artificial Sequence
  chemically synthesized
cctgcatgaatccactcaaa

SEQ ID NO: 413206 - DNA, 20 bp, Artificial Sequence
  chemically synthesized
actgtttgagtggattcatg

SEQ ID NO: 413207 - DNA, 20 bp, Artificial Sequence
  chemically synthesized
ctgtttgagtggattcatgc

SEQ ID NO: 413208 - DNA, 20 bp, Artificial Sequence
  chemically synthesized
tggattcatgcaggcctaat

SEQ ID NO: 413209 - DNA, 20 bp, Artificial Sequence
  chemically synthesized
ggattcatgcaggcctaatt

SEQ ID NO: 413210 - DNA, 20 bp, Artificial Sequence
  chemically synthesized
caagccttggaagcccaatt

SEQ ID NO: 413211 - DNA, 20 bp, Artificial Sequence
  chemically synthesized
gcaagccttggaagcccaat

SEQ ID NO: 413212 - DNA, 20 bp, Artificial Sequence
  chemically synthesized
gcaggcctaattgggcttcc

SEQ ID NO: 413213 - DNA, 20 bp, Artificial Sequence
  chemically synthesized
caggcctaattgggcttcca

SEQ ID NO: 413214 - DNA, 20 bp, Artificial Sequence
  chemically synthesized
ttctgccacgcaagccttgg

SEQ ID NO: 413215 - DNA, 20 bp, Artificial Sequence
  chemically synthesized
tgtttctgccacgcaagcct

SEQ ID NO: 413216 - DNA, 20 bp, Artificial Sequence
  chemically synthesized
ttgggcttccaaggcttgcg

SEQ ID NO: 413217 - DNA, 20 bp, Artificial Sequence
  chemically synthesized
ggcttccaaggcttgcgtgg

SEQ ID NO: 413218 - DNA, 20 bp, Artificial Sequence
  chemically synthesized
taataatgtttctgccacgc

SEQ ID NO: 413219 - DNA, 20 bp, Artificial Sequence
  chemically synthesized
aacattattactctcatcta

SEQ ID NO: 413220 - DNA, 20 bp, Artificial Sequence
  chemically synthesized
tgtagtaaaactatagatga

SEQ ID NO: 413221 - DNA, 20 bp, Artificial Sequence
  chemically synthesized
actgtagtaaaactatagat

SEQ ID NO: 413222 - DNA, 20 bp, Artificial Sequence
  chemically synthesized
taaacactgtagtaaaacta

SEQ ID NO: 413223 - DNA, 20 bp, Artificial Sequence
  chemically synthesized
tctcatctatagttttacta

SEQ ID NO: 413224 - DNA, 20 bp, Artificial Sequence
  chemically synthesized
ggctattcacataaacactg

SEQ ID NO: 413225 - DNA, 20 bp, Artificial Sequence
  chemically synthesized
tactacagtgtttatgtgaa

SEQ ID NO: 413226 - DNA, 20 bp, Artificial Sequence
  chemically synthesized
ttatgtgaatagcctactat

SEQ ID NO: 413227 - DNA, 20 bp, Artificial Sequence
  chemically synthesized
tatgtgaatagcctactata

SEQ ID NO: 413228 - DNA, 20 bp, Artificial Sequence
  chemically synthesized
gactcattataccttatagt

SEQ ID NO: 413229 - DNA, 20 bp, Artificial Sequence
  chemically synthesized
ggactcattataccttatag

SEQ ID NO: 413230 - DNA, 20 bp, Artificial Sequence
  chemically synthesized
ctaggactcattatacctta

SEQ ID NO: 413231 - DNA, 20 bp, Artificial Sequence
  chemically synthesized
agcctactataaggtataat

SEQ ID NO: 413232 - DNA, 20 bp, Artificial Sequence
  chemically synthesized
ctataaggtataatgagtcc

SEQ ID NO: 413233 - DNA, 20 bp, Artificial Sequence
  chemically synthesized
tataaggtataatgagtcct

SEQ ID NO: 413234 - DNA, 20 bp, Artificial Sequence
  chemically synthesized
ggtataatgagtcctaggat

SEQ ID NO: 413235 - DNA, 20 bp, Artificial Sequence
  chemically synthesized
ggaattgtacttctcatcct

SEQ ID NO: 413236 - DNA, 20 bp, Artificial Sequence
  chemically synthesized
ataatgagtcctaggatgag

SEQ ID NO: 413237 - DNA, 20 bp, Artificial Sequence
  chemically synthesized
gggaattgtacttctcatcc

SEQ ID NO: 413238 - DNA, 20 bp, Artificial Sequence
  chemically synthesized
aaatgtttgcttttaaaatt

SEQ ID NO: 413239 - DNA, 20 bp, Artificial Sequence
  chemically synthesized
agtacaattcccaattttaa

SEQ ID NO: 413240 - DNA, 20 bp, Artificial Sequence
  chemically synthesized
caaatgtttgcttttaaaat

SEQ ID NO: 413241 - DNA, 20 bp, Artificial Sequence
  chemically synthesized
aagcaaacatttgaaatcat

SEQ ID NO: 413242 - DNA, 20 bp, Artificial Sequence
  chemically synthesized
aacatttgaaatcattagtt

SEQ ID NO: 413243 - DNA, 20 bp, Artificial Sequence
  chemically synthesized
acatttgaaatcattagttt

SEQ ID NO: 413244 - DNA, 20 bp, Artificial Sequence
  chemically synthesized
ctaaattgtttgtgggttag

SEQ ID NO: 413245 - DNA, 20 bp, Artificial Sequence
  chemically synthesized
attctaaattgtttgtgggt

SEQ ID NO: 413246 - DNA, 20 bp, Artificial Sequence
  chemically synthesized
ctaaattctaaattgtttgt

SEQ ID NO: 413247 - DNA, 20 bp, Artificial Sequence
  chemically synthesized
actaaattctaaattgtttg

SEQ ID NO: 413248 - DNA, 20 bp, Artificial Sequence
  chemically synthesized
cttctaacccacaaacaatt

SEQ ID NO: 413249 - DNA, 20 bp, Artificial Sequence
  chemically synthesized
cccacaaacaatttagaatt

SEQ ID NO: 413250 - DNA, 20 bp, Artificial Sequence
  chemically synthesized
ttagaatttagtctaaactg

SEQ ID NO: 413251 - DNA, 20 bp, Artificial Sequence
  chemically synthesized
ttgaggttaattcttcagtt

SEQ ID NO: 413252 - DNA, 20 bp, Artificial Sequence
  chemically synthesized
tattcttgaggttaattctt

SEQ ID NO: 413253 - DNA, 20 bp, Artificial Sequence
  chemically synthesized
taaactgaagaattaacctc

SEQ ID NO: 413254 - DNA, 20 bp, Artificial Sequence
  chemically synthesized
tgaagaattaacctcaagaa

SEQ ID NO: 413255 - DNA, 20 bp, Artificial Sequence
  chemically synthesized
taaactattagctattcttg

SEQ ID NO: 413256 - DNA, 20 bp, Artificial Sequence
  chemically synthesized
gtaaactattagctattctt

SEQ ID NO: 413257 - DNA, 20 bp, Artificial Sequence
  chemically synthesized
ttaacctcaagaatagctaa

SEQ ID NO: 413258 - DNA, 20 bp, Artificial Sequence
  chemically synthesized
gaaaatctatagtaaactat

SEQ ID NO: 413259 - DNA, 20 bp, Artificial Sequence
  chemically synthesized
gaatagctaatagtttacta

SEQ ID NO: 413260 - DNA, 20 bp, Artificial Sequence
  chemically synthesized
atgcttcaaaagaaaatcta

SEQ ID NO: 413261 - DNA, 20 bp, Artificial Sequence
  chemically synthesized
ttactatagattttcttttg

SEQ ID NO: 413262 - DNA, 20 bp, Artificial Sequence
  chemically synthesized
agagaaatattatgcttcaa

SEQ ID NO: 413263 - DNA, 20 bp, Artificial Sequence
  chemically synthesized
aagcataatatttctctgtt

SEQ ID NO: 413264 - DNA, 20 bp, Artificial Sequence
  chemically synthesized
ataaaaatggggactgaaca

SEQ ID NO: 413265 - DNA, 20 bp, Artificial Sequence
  chemically synthesized
taataaaaatggggactgaa

SEQ ID NO: 413266 - DNA, 20 bp, Artificial Sequence
  chemically synthesized
atttgtttttaataaaaatg

SEQ ID NO: 413267 - DNA, 20 bp, Artificial Sequence
  chemically synthesized
gatttgtttttaataaaaat

SEQ ID NO: 413268 - DNA, 20 bp, Artificial Sequence
  chemically synthesized
tgatttgtttttaataaaaa

SEQ ID NO: 413269 - DNA, 20 bp, Artificial Sequence
  chemically synthesized
ttattaaaaacaaatcatga

SEQ ID NO: 413270 - DNA, 20 bp, Artificial Sequence
  chemically synthesized
aagactaaaatgcattttat

SEQ ID NO: 413271 - DNA, 20 bp, Artificial Sequence
  chemically synthesized
tttgcttataaaatgcattt

SEQ ID NO: 413272 - DNA, 20 bp, Artificial Sequence
  chemically synthesized
ataatcaggccaagtacagt

SEQ ID NO: 413273 - DNA, 20 bp, Artificial Sequence
  chemically synthesized
cattttagtcttactgtact

SEQ ID NO: 413274 - DNA, 20 bp, Artificial Sequence
  chemically synthesized
gcaaataatcaggccaagta

SEQ ID NO: 413275 - DNA, 20 bp, Artificial Sequence
  chemically synthesized
ttcatgcaaataatcaggcc

SEQ ID NO: 413276 - DNA, 20 bp, Artificial Sequence
  chemically synthesized
tgcacttcatgcaaataatc

SEQ ID NO: 413277 - DNA, 20 bp, Artificial Sequence
  chemically synthesized
ctgcacttcatgcaaataat

SEQ ID NO: 413278 - DNA, 20 bp, Artificial Sequence
  chemically synthesized
ttggcctgattatttgcatg

SEQ ID NO: 413279 - DNA, 20 bp, Artificial Sequence
  chemically synthesized
ctgattatttgcatgaagtg

SEQ ID NO: 413280 - DNA, 20 bp, Artificial Sequence
  chemically synthesized
ttatttgcatgaagtgcagc

SEQ ID NO: 413281 - DNA, 20 bp, Artificial Sequence
  chemically synthesized
aagaataattatttttcact

SEQ ID NO: 413282 - DNA, 20 bp, Artificial Sequence
  chemically synthesized
agaataattatttttcactt

SEQ ID NO: 413283 - DNA, 20 bp, Artificial Sequence
  chemically synthesized
aaagccaatttaaaaagcct

SEQ ID NO: 413284 - DNA, 20 bp, Artificial Sequence
  chemically synthesized
ttcacttaggctttttaaat

SEQ ID NO: 413285 - DNA, 20 bp, Artificial Sequence
  chemically synthesized
tccatcaaagccaatttaaa

SEQ ID NO: 413286 - DNA, 20 bp, Artificial Sequence
  chemically synthesized
gctttttaaattggctttga

SEQ ID NO: 413287 - DNA, 20 bp, Artificial Sequence
  chemically synthesized
catggaacagagttccatca

SEQ ID NO: 413288 - DNA, 20 bp, Artificial Sequence
  chemically synthesized
ctgagattcttcatggaaca

SEQ ID NO: 413289 - DNA, 20 bp, Artificial Sequence
  chemically synthesized
tgatggaactctgttccatg

SEQ ID NO: 413290 - DNA, 20 bp, Artificial Sequence
  chemically synthesized
atctgagattcttcatggaa

SEQ ID NO: 413291 - DNA, 20 bp, Artificial Sequence
  chemically synthesized
gtcttatctgagattcttca

SEQ ID NO: 413292 - DNA, 20 bp, Artificial Sequence
  chemically synthesized
ctctgttccatgaagaatct

SEQ ID NO: 413293 - DNA, 20 bp, Artificial Sequence
  chemically synthesized
ttccatgaagaatctcagat

SEQ ID NO: 413294 - DNA, 20 bp, Artificial Sequence
  chemically synthesized
gctttcaaaaagtcttatct

SEQ ID NO: 413295 - DNA, 20 bp, Artificial Sequence
  chemically synthesized
tctcagataagactttttga

SEQ ID NO: 413296 - DNA, 20 bp, Artificial Sequence
  chemically synthesized
ggctgggctcggctttcaaa

SEQ ID NO: 413297 - DNA, 20 bp, Artificial Sequence
  chemically synthesized
gataagactttttgaaagcc

SEQ ID NO: 413298 - DNA, 20 bp, Artificial Sequence
  chemically synthesized
gactttttgaaagccgagcc

SEQ ID NO: 413299 - DNA, 20 bp, Artificial Sequence
  chemically synthesized
tacaaacccatggctgggct

SEQ ID NO: 413300 - DNA, 20 bp, Artificial Sequence
  chemically synthesized
ttgaaagccgagcccagcca

SEQ ID NO: 413301 - DNA, 20 bp, Artificial Sequence
  chemically synthesized
tgaaagccgagcccagccat

SEQ ID NO: 413302 - DNA, 20 bp, Artificial Sequence
  chemically synthesized
gagggtacaaacccatggct

SEQ ID NO: 413303 - DNA, 20 bp, Artificial Sequence
  chemically synthesized
tgagggtacaaacccatggc

SEQ ID NO: 413304 - DNA, 20 bp, Artificial Sequence
  chemically synthesized
tatttgagggtacaaaccca

SEQ ID NO: 413305 - DNA, 20 bp, Artificial Sequence
  chemically synthesized
gtcaactcataggtatttga

SEQ ID NO: 413306 - DNA, 20 bp, Artificial Sequence
  chemically synthesized
ggtcaactcataggtatttg

SEQ ID NO: 413307 - DNA, 20 bp, Artificial Sequence
  chemically synthesized
tggtcaactcataggtattt

SEQ ID NO: 413308 - DNA, 20 bp, Artificial Sequence
  chemically synthesized
ttgtaccctcaaatacctat

SEQ ID NO: 413309 - DNA, 20 bp, Artificial Sequence
  chemically synthesized
gaggactttggtcaactcat

SEQ ID NO: 413310 - DNA, 20 bp, Artificial Sequence
  chemically synthesized
agaggactttggtcaactca

SEQ ID NO: 413311 - DNA, 20 bp, Artificial Sequence
  chemically synthesized
aaatacctatgagttgacca

SEQ ID NO: 413312 - DNA, 20 bp, Artificial Sequence
  chemically synthesized
acctcaagaggagaggactt

SEQ ID NO: 413313 - DNA, 20 bp, Artificial Sequence
  chemically synthesized
tcttgggacctcaagaggag

SEQ ID NO: 413314 - DNA, 20 bp, Artificial Sequence
  chemically synthesized
gaccaaagtcctctcctctt

SEQ ID NO: 413315 - DNA, 20 bp, Artificial Sequence
  chemically synthesized
atcttgggacctcaagagga

SEQ ID NO: 413316 - DNA, 20 bp, Artificial Sequence
  chemically synthesized
accaaagtcctctcctcttg

SEQ ID NO: 413317 - DNA, 20 bp, Artificial Sequence
  chemically synthesized
ttatcttgggacctcaagag

SEQ ID NO: 413318 - DNA, 20 bp, Artificial Sequence
  chemically synthesized
agttatcttgggacctcaag

SEQ ID NO: 413319 - DNA, 20 bp, Artificial Sequence
  chemically synthesized
aagttatcttgggacctcaa

SEQ ID NO: 413320 - DNA, 20 bp, Artificial Sequence
  chemically synthesized
ccaagttatcttgggacctc

SEQ ID NO: 413321 - DNA, 20 bp, Artificial Sequence
  chemically synthesized
tcctctcctcttgaggtccc

SEQ ID NO: 413322 - DNA, 20 bp, Artificial Sequence
  chemically synthesized
caggaaccccaagttatctt

SEQ ID NO: 413323 - DNA, 20 bp, Artificial Sequence
  chemically synthesized
ccaggaaccccaagttatct

SEQ ID NO: 413324 - DNA, 20 bp, Artificial Sequence
  chemically synthesized
cttgaggtcccaagataact

SEQ ID NO: 413325 - DNA, 20 bp, Artificial Sequence
  chemically synthesized
ttgaggtcccaagataactt

SEQ ID NO: 413326 - DNA, 20 bp, Artificial Sequence
  chemically synthesized
tgaggtcccaagataacttg

SEQ ID NO: 413327 - DNA, 20 bp, Artificial Sequence
  chemically synthesized
ctaacaggcccaggaacccc

SEQ ID NO: 413328 - DNA, 20 bp, Artificial Sequence
  chemically synthesized
ccaagataacttggggttcc

SEQ ID NO: 413329 - DNA, 20 bp, Artificial Sequence
  chemically synthesized
caagataacttggggttcct

SEQ ID NO: 413330 - DNA, 20 bp, Artificial Sequence
  chemically synthesized
tgtcactttctaacaggccc

SEQ ID NO: 413331 - DNA, 20 bp, Artificial Sequence
  chemically synthesized
cttggggttcctgggcctgt

SEQ ID NO: 413332 - DNA, 20 bp, Artificial Sequence
  chemically synthesized
atgtcactttctaacaggcc

SEQ ID NO: 413333 - DNA, 20 bp, Artificial Sequence
  chemically synthesized
gggttcctgggcctgttaga

SEQ ID NO: 413334 - DNA, 20 bp, Artificial Sequence
  chemically synthesized
aaagaatgtcactttctaac

SEQ ID NO: 413335 - DNA, 20 bp, Artificial Sequence
  chemically synthesized
taaagaatgtcactttctaa

SEQ ID NO: 413336 - DNA, 20 bp, Artificial Sequence
  chemically synthesized
ttcctgacctgtggtaagta

SEQ ID NO: 413337 - DNA, 20 bp, Artificial Sequence
  chemically synthesized
gtgacattctttacttacca

SEQ ID NO: 413338 - DNA, 20 bp, Artificial Sequence
  chemically synthesized
tgacattctttacttaccac

SEQ ID NO: 413339 - DNA, 20 bp, Artificial Sequence
  chemically synthesized
caaggttcctgacctgtggt

SEQ ID NO: 413340 - DNA, 20 bp, Artificial Sequence
  chemically synthesized
attctttacttaccacaggt

SEQ ID NO: 413341 - DNA, 20 bp, Artificial Sequence
  chemically synthesized
ttctttacttaccacaggtc

SEQ ID NO: 413342 - DNA, 20 bp, Artificial Sequence
  chemically synthesized
tgtacaaggttcctgacctg

SEQ ID NO: 413343 - DNA, 20 bp, Artificial Sequence
  chemically synthesized
cacaggtcaggaaccttgta

SEQ ID NO: 413344 - DNA, 20 bp, Artificial Sequence
  chemically synthesized
acaggtcaggaaccttgtac

SEQ ID NO: 413345 - DNA, 20 bp, Artificial Sequence
  chemically synthesized
caggtcaggaaccttgtaca

SEQ ID NO: 413346 - DNA, 20 bp, Artificial Sequence
  chemically synthesized
ccacacagagtccctgtaca

SEQ ID NO: 413347 - DNA, 20 bp, Artificial Sequence
  chemically synthesized
tccacacagagtccctgtac

SEQ ID NO: 413348 - DNA, 20 bp, Artificial Sequence
  chemically synthesized
ccttgtacagggactctgtg

SEQ ID NO: 413349 - DNA, 20 bp, Artificial Sequence
  chemically synthesized
cctcataccttgtccacaca

SEQ ID NO: 413350 - DNA, 20 bp, Artificial Sequence
  chemically synthesized
tacagggactctgtgtggac

SEQ ID NO: 413351 - DNA, 20 bp, Artificial Sequence
  chemically synthesized
ggcctcataccttgtccaca

SEQ ID NO: 413352 - DNA, 20 bp, Artificial Sequence
  chemically synthesized
acagggactctgtgtggaca

SEQ ID NO: 413353 - DNA, 20 bp, Artificial Sequence
  chemically synthesized
actctgtgtggacaaggtat

SEQ ID NO: 413354 - DNA, 20 bp, Artificial Sequence
  chemically synthesized
ctctgtgtggacaaggtatg

SEQ ID NO: 413355 - DNA, 20 bp, Artificial Sequence
  chemically synthesized
gtgtggacaaggtatgaggc

SEQ ID NO: 413356 - DNA, 20 bp, Artificial Sequence
  chemically synthesized
ttaaagcccgttggggaatc

SEQ ID NO: 413357 - DNA, 20 bp, Artificial Sequence
  chemically synthesized
tatgaggccagattccccaa

SEQ ID NO: 413358 - DNA, 20 bp, Artificial Sequence
  chemically synthesized
atgaggccagattccccaac

SEQ ID NO: 413359 - DNA, 20 bp, Artificial Sequence
  chemically synthesized
gagccatttaaagcccgttg

SEQ ID NO: 413360 - DNA, 20 bp, Artificial Sequence
  chemically synthesized
agagccatttaaagcccgtt

SEQ ID NO: 413361 - DNA, 20 bp, Artificial Sequence
  chemically synthesized
tagagccatttaaagcccgt

SEQ ID NO: 413362 - DNA, 20 bp, Artificial Sequence
  chemically synthesized
attccccaacgggctttaaa

SEQ ID NO: 413363 - DNA, 20 bp, Artificial Sequence
  chemically synthesized
ttgacttatagagccattta

SEQ ID NO: 413364 - DNA, 20 bp, Artificial Sequence
  chemically synthesized
cgggctttaaatggctctat

SEQ ID NO: 413365 - DNA, 20 bp, Artificial Sequence
  chemically synthesized
agaatcaaagttgacttata

SEQ ID NO: 413366 - DNA, 20 bp, Artificial Sequence
  chemically synthesized
aaagaatcaaagttgactta

SEQ ID NO: 413367 - DNA, 20 bp, Artificial Sequence
  chemically synthesized
atgcttcctttaaagaatca

SEQ ID NO: 413368 - DNA, 20 bp, Artificial Sequence
  chemically synthesized
aagtcaactttgattcttta

SEQ ID NO: 413369 - DNA, 20 bp, Artificial Sequence
  chemically synthesized
agtcaactttgattctttaa

SEQ ID NO: 413370 - DNA, 20 bp, Artificial Sequence
  chemically synthesized
caactttgattctttaaagg

SEQ ID NO: 413371 - DNA, 20 bp, Artificial Sequence
  chemically synthesized
ggaatggcatgcttccttta

SEQ ID NO: 413372 - DNA, 20 bp, Artificial Sequence
  chemically synthesized
ttaaaggaagcatgccattc

SEQ ID NO: 413373 - DNA, 20 bp, Artificial Sequence
  chemically synthesized
taccaaggctttgactggaa

SEQ ID NO: 413374 - DNA, 20 bp, Artificial Sequence
  chemically synthesized
gaagcatgccattccagtca

SEQ ID NO: 413375 - DNA, 20 bp, Artificial Sequence
  chemically synthesized
cattttaccaaggctttgac

SEQ ID NO: 413376 - DNA, 20 bp, Artificial Sequence
  chemically synthesized
tgccattccagtcaaagcct

SEQ ID NO: 413377 - DNA, 20 bp, Artificial Sequence
  chemically synthesized
agaaattggtcattttacca

SEQ ID NO: 413378 - DNA, 20 bp, Artificial Sequence
  chemically synthesized
gagaaattggtcattttacc

SEQ ID NO: 413379 - DNA, 20 bp, Artificial Sequence
  chemically synthesized
caggacaccattggagaaat

SEQ ID NO: 413380 - DNA, 20 bp, Artificial Sequence
  chemically synthesized
aaaatgaccaatttctccaa

SEQ ID NO: 413381 - DNA, 20 bp, Artificial Sequence
  chemically synthesized
tttgtaacaggacaccattg

SEQ ID NO: 413382 - DNA, 20 bp, Artificial Sequence
  chemically synthesized
cttttgtaacaggacaccat

SEQ ID NO: 413383 - DNA, 20 bp, Artificial Sequence
  chemically synthesized
ccaatggtgtcctgttacaa

SEQ ID NO: 413384 - DNA, 20 bp, Artificial Sequence
  chemically synthesized
aatctgttttcttttgtaac

SEQ ID NO: 413385 - DNA, 20 bp, Artificial Sequence
  chemically synthesized
gaatctgttttcttttgtaa

SEQ ID NO: 413386 - DNA, 20 bp, Artificial Sequence
  chemically synthesized
tgtcctgttacaaaagaaaa

SEQ ID NO: 413387 - DNA, 20 bp, Artificial Sequence
  chemically synthesized
gttaattgcatacgtgcaat

SEQ ID NO: 413388 - DNA, 20 bp, Artificial Sequence
  chemically synthesized
attctcaatttatgacagta

SEQ ID NO: 413389 - DNA, 20 bp, Artificial Sequence
  chemically synthesized
tgagtattctcaatttatga

SEQ ID NO: 413390 - DNA, 20 bp, Artificial Sequence
  chemically synthesized
taactatactgtcataaatt

SEQ ID NO: 413391 - DNA, 20 bp, Artificial Sequence
  chemically synthesized
aaattgagaatactcacaaa

SEQ ID NO: 413392 - DNA, 20 bp, Artificial Sequence
  chemically synthesized
agaatttggaaaccatttgt

SEQ ID NO: 413393 - DNA, 20 bp, Artificial Sequence
  chemically synthesized
cacaaatggtttccaaattc

SEQ ID NO: 413394 - DNA, 20 bp, Artificial Sequence
  chemically synthesized
caaatggtttccaaattcta

SEQ ID NO: 413395 - DNA, 20 bp, Artificial Sequence
  chemically synthesized
tacctgatttctctagaatt

SEQ ID NO: 413396 - DNA, 20 bp, Artificial Sequence
  chemically synthesized
tttccaaattctagagaaat

SEQ ID NO: 413397 - DNA, 20 bp, Artificial Sequence
  chemically synthesized
ttctctctacctgatttctc

SEQ ID NO: 413398 - DNA, 20 bp, Artificial Sequence
  chemically synthesized
ttccaaattctagagaaatc

SEQ ID NO: 413399 - DNA, 20 bp, Artificial Sequence
  chemically synthesized
caaattctagagaaatcagg

SEQ ID NO: 413400 - DNA, 20 bp, Artificial Sequence
  chemically synthesized
aattctagagaaatcaggta

SEQ ID NO: 413401 - DNA, 20 bp, Artificial Sequence
  chemically synthesized
ttctagagaaatcaggtaga

SEQ ID NO: 413402 - DNA, 20 bp, Artificial Sequence
  chemically synthesized
acactcagtgacaaattttg

SEQ ID NO: 413403 - DNA, 20 bp, Artificial Sequence
  chemically synthesized
atacactcagtgacaaattt

SEQ ID NO: 413404 - DNA, 20 bp, Artificial Sequence
  chemically synthesized
ttgctccaaaatttgtcact

SEQ ID NO: 413405 - DNA, 20 bp, Artificial Sequence
  chemically synthesized
ccgagtgagtaaaatacact

SEQ ID NO: 413406 - DNA, 20 bp, Artificial Sequence
  chemically synthesized
ctgagtgtattttactcact

SEQ ID NO: 413407 - DNA, 20 bp, Artificial Sequence
  chemically synthesized
atttgccacttttaccgagt

SEQ ID NO: 413408 - DNA, 20 bp, Artificial Sequence
  chemically synthesized
gtattttactcactcggtaa

SEQ ID NO: 413409 - DNA, 20 bp, Artificial Sequence
  chemically synthesized
agctatttgccacttttacc

SEQ ID NO: 413410 - DNA, 20 bp, Artificial Sequence
  chemically synthesized
ttttactcactcggtaaaag

SEQ ID NO: 413411 - DNA, 20 bp, Artificial Sequence
  chemically synthesized
cactcggtaaaagtggcaaa

SEQ ID NO: 413412 - DNA, 20 bp, Artificial Sequence
  chemically synthesized
aaaagtggcaaatagctcta

SEQ ID NO: 413413 - DNA, 20 bp, Artificial Sequence
  chemically synthesized
caacataacttatttcttta

SEQ ID NO: 413414 - DNA, 20 bp, Artificial Sequence
  chemically synthesized
gcaaatagctctaaagaaat

SEQ ID NO: 413415 - DNA, 20 bp, Artificial Sequence
  chemically synthesized
gtcaacataacttatttctt

SEQ ID NO: 413416 - DNA, 20 bp, Artificial Sequence
  chemically synthesized
tgctaatccttttgttttca

SEQ ID NO: 413417 - DNA, 20 bp, Artificial Sequence
  chemically synthesized
tatgttgactctgaaaacaa

SEQ ID NO: 413418 - DNA, 20 bp, Artificial Sequence
  chemically synthesized
attgctaatccttttgtttt

SEQ ID NO: 413419 - DNA, 20 bp, Artificial Sequence
  chemically synthesized
atgttgactctgaaaacaaa

SEQ ID NO: 413420 - DNA, 20 bp, Artificial Sequence
  chemically synthesized
gactctgaaaacaaaaggat

SEQ ID NO: 413421 - DNA, 20 bp, Artificial Sequence
  chemically synthesized
attagcaatgtttaacacat

SEQ ID NO: 413422 - DNA, 20 bp, Artificial Sequence
  chemically synthesized
acacatcagtttgccacatt

SEQ ID NO: 413423 - DNA, 20 bp, Artificial Sequence
  chemically synthesized
agggaaaaaacatctaaatg

SEQ ID NO: 413424 - DNA, 20 bp, Artificial Sequence
  chemically synthesized
aattatgctcttggaataga

SEQ ID NO: 413425 - DNA, 20 bp, Artificial Sequence
  chemically synthesized
atgttttttccctctattcc

SEQ ID NO: 413426 - DNA, 20 bp, Artificial Sequence
  chemically synthesized
aaattatgctcttggaatag

SEQ ID NO: 413427 - DNA, 20 bp, Artificial Sequence
  chemically synthesized
aaaattatgctcttggaata

SEQ ID NO: 413428 - DNA, 20 bp, Artificial Sequence
  chemically synthesized
gttttttccctctattccaa

SEQ ID NO: 413429 - DNA, 20 bp, Artificial Sequence
  chemically synthesized
taaaaattatgctcttggaa

SEQ ID NO: 413430 - DNA, 20 bp, Artificial Sequence
  chemically synthesized
aactttaaaaattatgctct

SEQ ID NO: 413431 - DNA, 20 bp, Artificial Sequence
  chemically synthesized
ttccaagagcataattttta

SEQ ID NO: 413432 - DNA, 20 bp, Artificial Sequence
  chemically synthesized
cataatttttaaagttatct

SEQ ID NO: 413433 - DNA, 20 bp, Artificial Sequence
  chemically synthesized
aatactctgagtgcaggtct

SEQ ID NO: 413434 - DNA, 20 bp, Artificial Sequence
  chemically synthesized
agttatctaagacctgcact

SEQ ID NO: 413435 - DNA, 20 bp, Artificial Sequence
  chemically synthesized
ttatctaagacctgcactca

SEQ ID NO: 413436 - DNA, 20 bp, Artificial Sequence
  chemically synthesized
ggatataatactctgagtgc

SEQ ID NO: 413437 - DNA, 20 bp, Artificial Sequence
  chemically synthesized
cggatataatactctgagtg

SEQ ID NO: 413438 - DNA, 20 bp, Artificial Sequence
  chemically synthesized
ataatcggatataatactct

SEQ ID NO: 413439 - DNA, 20 bp, Artificial Sequence
  chemically synthesized
ttcaaaaggcagtttataat

SEQ ID NO: 413440 - DNA, 20 bp, Artificial Sequence
  chemically synthesized
ctttggtccttttcaaaagg

SEQ ID NO: 413441 - DNA, 20 bp, Artificial Sequence
  chemically synthesized
attataaactgccttttgaa

SEQ ID NO: 413442 - DNA, 20 bp, Artificial Sequence
  chemically synthesized
ttataaactgccttttgaaa

SEQ ID NO: 413443 - DNA, 20 bp, Artificial Sequence
  chemically synthesized
ttgctttggtccttttcaaa

SEQ ID NO: 413444 - DNA, 20 bp, Artificial Sequence
  chemically synthesized
cttgctttggtccttttcaa

SEQ ID NO: 413445 - DNA, 20 bp, Artificial Sequence
  chemically synthesized
ctgccttttgaaaaggacca

SEQ ID NO: 413446 - DNA, 20 bp, Artificial Sequence
  chemically synthesized
cttttgaaaaggaccaaagc

SEQ ID NO: 413447 - DNA, 20 bp, Artificial Sequence
  chemically synthesized
acagacattttatcttgctt

SEQ ID NO: 413448 - DNA, 20 bp, Artificial Sequence
  chemically synthesized
aaagcaagataaaatgtctg

SEQ ID NO: 413449 - DNA, 20 bp, Artificial Sequence
  chemically synthesized
ctgtagacttttgtcatcca

SEQ ID NO: 413450 - DNA, 20 bp, Artificial Sequence
  chemically synthesized
aaaatgtctgtggatgacaa

SEQ ID NO: 413451 - DNA, 20 bp, Artificial Sequence
  chemically synthesized
ctgtggatgacaaaagtcta

SEQ ID NO: 413452 - DNA, 20 bp, Artificial Sequence
  chemically synthesized
tgtagctttaataatggctg

SEQ ID NO: 413453 - DNA, 20 bp, Artificial Sequence
  chemically synthesized
aaagtctacagccattatta

SEQ ID NO: 413454 - DNA, 20 bp, Artificial Sequence
  chemically synthesized
gtcaattgtagctttaataa

SEQ ID NO: 413455 - DNA, 20 bp, Artificial Sequence
  chemically synthesized
ccaaaattcctagtcaattg

SEQ ID NO: 413456 - DNA, 20 bp, Artificial Sequence
  chemically synthesized
ttattaaagctacaattgac

SEQ ID NO: 413457 - DNA, 20 bp, Artificial Sequence
  chemically synthesized
tattaaagctacaattgact

SEQ ID NO: 413458 - DNA, 20 bp, Artificial Sequence
  chemically synthesized
ctacaattgactaggaattt

SEQ ID NO: 413459 - DNA, 20 bp, Artificial Sequence
  chemically synthesized
acggaagtaaccaaaattcc

SEQ ID NO: 413460 - DNA, 20 bp, Artificial Sequence
  chemically synthesized
aggaattttggttacttccg

SEQ ID NO: 413461 - DNA, 20 bp, Artificial Sequence
  chemically synthesized
aaaattgttgtgtgccacgg

SEQ ID NO: 413462 - DNA, 20 bp, Artificial Sequence
  chemically synthesized
tgtaaaattgttgtgtgcca

SEQ ID NO: 413463 - DNA, 20 bp, Artificial Sequence
  chemically synthesized
ataacaattataattattaa

SEQ ID NO: 413464 - DNA, 20 bp, Artificial Sequence
  chemically synthesized
tattaatagtgaaatcatat

SEQ ID NO: 413465 - DNA, 20 bp, Artificial Sequence
  chemically synthesized
gtgaaatcatatcagaatta

SEQ ID NO: 413466 - DNA, 20 bp, Artificial Sequence
  chemically synthesized
aaatcatatcagaattatag

SEQ ID NO: 413467 - DNA, 20 bp, Artificial Sequence
  chemically synthesized
gtgtgtgttccaaaaattat

SEQ ID NO: 413468 - DNA, 20 bp, Artificial Sequence
  chemically synthesized
tagaagtttcccataatttt

SEQ ID NO: 413469 - DNA, 20 bp, Artificial Sequence
  chemically synthesized
agtgtgtgttccaaaaatta

SEQ ID NO: 413470 - DNA, 20 bp, Artificial Sequence
  chemically synthesized
tatttgtataaatatgttat

SEQ ID NO: 413471 - DNA, 20 bp, Artificial Sequence
  chemically synthesized
ataacatatttatacaaata

SEQ ID NO: 413472 - DNA, 20 bp, Artificial Sequence
  chemically synthesized
atttatacaaatacagtcca

SEQ ID NO: 413473 - DNA, 20 bp, Artificial Sequence
  chemically synthesized
gaatggtgtttggttttctt

SEQ ID NO: 413474 - DNA, 20 bp, Artificial Sequence
  chemically synthesized
atagaagagtgaatggtgtt

SEQ ID NO: 413475 - DNA, 20 bp, Artificial Sequence
  chemically synthesized
ctttcaaatagaagagtgaa

SEQ ID NO: 413476 - DNA, 20 bp, Artificial Sequence
  chemically synthesized
aggaaaactttcaaatagaa

SEQ ID NO: 413477 - DNA, 20 bp, Artificial Sequence
  chemically synthesized
gaaggaaaactttcaaatag

SEQ ID NO: 413478 - DNA, 20 bp, Artificial Sequence
  chemically synthesized
ccattcactcttctatttga

SEQ ID NO: 413479 - DNA, 20 bp, Artificial Sequence
  chemically synthesized
atagaaggaaaactttcaaa

SEQ ID NO: 413480 - DNA, 20 bp, Artificial Sequence
  chemically synthesized
gattgtgacgttagaataga

SEQ ID NO: 413481 - DNA, 20 bp, Artificial Sequence
  chemically synthesized
agattgtgacgttagaatag

SEQ ID NO: 413482 - DNA, 20 bp, Artificial Sequence
  chemically synthesized
tggagattgtgacgttagaa

SEQ ID NO: 413483 - DNA, 20 bp, Artificial Sequence
  chemically synthesized
aactctggagattgtgacgt

SEQ ID NO: 413484 - DNA, 20 bp, Artificial Sequence
  chemically synthesized
tattctaacgtcacaatctc

SEQ ID NO: 413485 - DNA, 20 bp, Artificial Sequence
  chemically synthesized
ttctaacgtcacaatctcca

SEQ ID NO: 413486 - DNA, 20 bp, Artificial Sequence
  chemically synthesized
gtttctgattaataactctg

SEQ ID NO: 413487 - DNA, 20 bp, Artificial Sequence
  chemically synthesized
aggtttctgattaataactc

SEQ ID NO: 413488 - DNA, 20 bp, Artificial Sequence
  chemically synthesized
caatctccagagttattaat

SEQ ID NO: 413489 - DNA, 20 bp, Artificial Sequence
  chemically synthesized
ttaatcagaaacctgcattt

SEQ ID NO: 413490 - DNA, 20 bp, Artificial Sequence
  chemically synthesized
taacaggtggtcttaaatgc

SEQ ID NO: 413491 - DNA, 20 bp, Artificial Sequence
  chemically synthesized
gtaacaggtggtcttaaatg

SEQ ID NO: 413492 - DNA, 20 bp, Artificial Sequence
  chemically synthesized
cagctgtaaaatgtaacagg

SEQ ID NO: 413493 - DNA, 20 bp, Artificial Sequence
  chemically synthesized
taccagctgtaaaatgtaac

SEQ ID NO: 413494 - DNA, 20 bp, Artificial Sequence
  chemically synthesized
ataccagctgtaaaatgtaa

SEQ ID NO: 413495 - DNA, 20 bp, Artificial Sequence
  chemically synthesized
agaccacctgttacatttta

SEQ ID NO: 413496 - DNA, 20 bp, Artificial Sequence
  chemically synthesized
cacctgttacattttacagc

SEQ ID NO: 413497 - DNA, 20 bp, Artificial Sequence
  chemically synthesized
aaaaaaaatggttttaatac

SEQ ID NO: 413498 - DNA, 20 bp, Artificial Sequence
  chemically synthesized
aactctgtctcaaaaaaaaa

SEQ ID NO: 413499 - DNA, 20 bp, Artificial Sequence
  chemically synthesized
tattaaaaccattttttttt

SEQ ID NO: 413500 - DNA, 20 bp, Artificial Sequence
  chemically synthesized
aaaaccatttttttttgaga

SEQ ID NO: 413501 - DNA, 20 bp, Artificial Sequence
  chemically synthesized
aaccatttttttttgagaca

SEQ ID NO: 413502 - DNA, 20 bp, Artificial Sequence
  chemically synthesized
ctccagcctgggcaacaaga

SEQ ID NO: 413503 - DNA, 20 bp, Artificial Sequence
  chemically synthesized
cactccagcctgggcaacaa

SEQ ID NO: 413504 - DNA, 20 bp, Artificial Sequence
  chemically synthesized
agagtttctctcttgttgcc

SEQ ID NO: 413505 - DNA, 20 bp, Artificial Sequence
  chemically synthesized
gagtttctctcttgttgccc

SEQ ID NO: 413506 - DNA, 20 bp, Artificial Sequence
  chemically synthesized
tgcactccagcctgggcaac

SEQ ID NO: 413507 - DNA, 20 bp, Artificial Sequence
  chemically synthesized
ttctctcttgttgcccaggc

SEQ ID NO: 413508 - DNA, 20 bp, Artificial Sequence
  chemically synthesized
ctctcttgttgcccaggctg

SEQ ID NO: 413509 - DNA, 20 bp, Artificial Sequence
  chemically synthesized
atgccattgcactccagcct

SEQ ID NO: 413510 - DNA, 20 bp, Artificial Sequence
  chemically synthesized
catgccattgcactccagcc

SEQ ID NO: 413511 - DNA, 20 bp, Artificial Sequence
  chemically synthesized
aagatcatgccattgcactc

SEQ ID NO: 413512 - DNA, 20 bp, Artificial Sequence
  chemically synthesized
ttgcccaggctggagtgcaa

SEQ ID NO: 413513 - DNA, 20 bp, Artificial Sequence
  chemically synthesized
ggagtgcaatggcatgatct

SEQ ID NO: 413514 - DNA, 20 bp, Artificial Sequence
  chemically synthesized
ggcggaggttgcggtgagcc

SEQ ID NO: 413515 - DNA, 20 bp, Artificial Sequence
  chemically synthesized
taggaggcggaggttgcggt

SEQ ID NO: 413516 - DNA, 20 bp, Artificial Sequence
  chemically synthesized
aacctaggaggcggaggttg

SEQ ID NO: 413517 - DNA, 20 bp, Artificial Sequence
  chemically synthesized
cgcttgaacctaggaggcgg

SEQ ID NO: 413518 - DNA, 20 bp, Artificial Sequence
  chemically synthesized
tcaccgcaacctccgcctcc

SEQ ID NO: 413519 - DNA, 20 bp, Artificial Sequence
  chemically synthesized
tcgcttgaacctaggaggcg

SEQ ID NO: 413520 - DNA, 20 bp, Artificial Sequence
  chemically synthesized
caccgcaacctccgcctcct

SEQ ID NO: 413521 - DNA, 20 bp, Artificial Sequence
  chemically synthesized
aatcgcttgaacctaggagg

SEQ ID NO: 413522 - DNA, 20 bp, Artificial Sequence
  chemically synthesized
gagaatcgcttgaacctagg

SEQ ID NO: 413523 - DNA, 20 bp, Artificial Sequence
  chemically synthesized
ggagaatcgcttgaacctag

SEQ ID NO: 413524 - DNA, 20 bp, Artificial Sequence
  chemically synthesized
aacctccgcctcctaggttc

SEQ ID NO: 413525 - DNA, 20 bp, Artificial Sequence
  chemically synthesized
caggagaatcgcttgaacct

SEQ ID NO: 413526 - DNA, 20 bp, Artificial Sequence
  chemically synthesized
gcaggagaatcgcttgaacc

SEQ ID NO: 413527 - DNA, 20 bp, Artificial Sequence
  chemically synthesized
ttcaagcgattctcctgcct

SEQ ID NO: 413528 - DNA, 20 bp, Artificial Sequence
  chemically synthesized
tactcgggagaccgaggcag

SEQ ID NO: 413529 - DNA, 20 bp, Artificial Sequence
  chemically synthesized
gctactcgggagaccgaggc

SEQ ID NO: 413530 - DNA, 20 bp, Artificial Sequence
  chemically synthesized
agctactcgggagaccgagg

SEQ ID NO: 413531 - DNA, 20 bp, Artificial Sequence
  chemically synthesized
cccagctactcgggagaccg

SEQ ID NO: 413532 - DNA, 20 bp, Artificial Sequence
  chemically synthesized
tcccagctactcgggagacc

SEQ ID NO: 413533 - DNA, 20 bp, Artificial Sequence
  chemically synthesized
ttctcctgcctcggtctccc

SEQ ID NO: 413534 - DNA, 20 bp, Artificial Sequence
  chemically synthesized
tcctgcctcggtctcccgag

SEQ ID NO: 413535 - DNA, 20 bp, Artificial Sequence
  chemically synthesized
ctgtaatcccagctactcgg

SEQ ID NO: 413536 - DNA, 20 bp, Artificial Sequence
  chemically synthesized
gcctcggtctcccgagtagc

SEQ ID NO: 413537 - DNA, 20 bp, Artificial Sequence
  chemically synthesized
tcctgtaatcccagctactc

SEQ ID NO: 413538 - DNA, 20 bp, Artificial Sequence
  chemically synthesized
cctcggtctcccgagtagct

SEQ ID NO: 413539 - DNA, 20 bp, Artificial Sequence
  chemically synthesized
ttcctgtaatcccagctact

SEQ ID NO: 413540 - DNA, 20 bp, Artificial Sequence
  chemically synthesized
ctcccgagtagctgggatta

SEQ ID NO: 413541 - DNA, 20 bp, Artificial Sequence
  chemically synthesized
tcccgagtagctgggattac

SEQ ID NO: 413542 - DNA, 20 bp, Artificial Sequence
  chemically synthesized
caaaatcattcctgtaatcc

SEQ ID NO: 413543 - DNA, 20 bp, Artificial Sequence
  chemically synthesized
caggaatgattttgtatttt

SEQ ID NO: 413544 - DNA, 20 bp, Artificial Sequence
  chemically synthesized
gaatgattttgtatttttag

SEQ ID NO: 413545 - DNA, 20 bp, Artificial Sequence
  chemically synthesized
atgattttgtatttttagta

SEQ ID NO: 413546 - DNA, 20 bp, Artificial Sequence
  chemically synthesized
ttttgtatttttagtagaga

SEQ ID NO: 413547 - DNA, 20 bp, Artificial Sequence
  chemically synthesized
tttgtatttttagtagagat

SEQ ID NO: 413548 - DNA, 20 bp, Artificial Sequence
  chemically synthesized
ttgtatttttagtagagatg

SEQ ID NO: 413549 - DNA, 20 bp, Artificial Sequence
  chemically synthesized
gagatggggtttctccatgt

SEQ ID NO: 413550 - DNA, 20 bp, Artificial Sequence
  chemically synthesized
agaccagcctgaccaacatg

SEQ ID NO: 413551 - DNA, 20 bp, Artificial Sequence
  chemically synthesized
tggggtttctccatgttggt

SEQ ID NO: 413552 - DNA, 20 bp, Artificial Sequence
  chemically synthesized
caagaccagcctgaccaaca

SEQ ID NO: 413553 - DNA, 20 bp, Artificial Sequence
  chemically synthesized
ggggtttctccatgttggtc

SEQ ID NO: 413554 - DNA, 20 bp, Artificial Sequence
  chemically synthesized
tttctccatgttggtcaggc

SEQ ID NO: 413555 - DNA, 20 bp, Artificial Sequence
  chemically synthesized
tgaggtcgggagttcaagac

SEQ ID NO: 413556 - DNA, 20 bp, Artificial Sequence
  chemically synthesized
tcacctgaggtcgggagttc

SEQ ID NO: 413557 - DNA, 20 bp, Artificial Sequence
  chemically synthesized
tggtcttgaactcccgacct

SEQ ID NO: 413558 - DNA, 20 bp, Artificial Sequence
  chemically synthesized
ggcagatcacctgaggtcgg

SEQ ID NO: 413559 - DNA, 20 bp, Artificial Sequence
  chemically synthesized
ggtcttgaactcccgacctc

SEQ ID NO: 413560 - DNA, 20 bp, Artificial Sequence
  chemically synthesized
tgggcagatcacctgaggtc

SEQ ID NO: 413561 - DNA, 20 bp, Artificial Sequence
  chemically synthesized
gtgggcagatcacctgaggt

SEQ ID NO: 413562 - DNA, 20 bp, Artificial Sequence
  chemically synthesized
cgaggtgggcagatcacctg

SEQ ID NO: 413563 - DNA, 20 bp, Artificial Sequence
  chemically synthesized
ccgaggtgggcagatcacct

SEQ ID NO: 413564 - DNA, 20 bp, Artificial Sequence
  chemically synthesized
ctcaggtgatctgcccacct

SEQ ID NO: 413565 - DNA, 20 bp, Artificial Sequence
  chemically synthesized
cgttaggaggccgaggtggg

SEQ ID NO: 413566 - DNA, 20 bp, Artificial Sequence
  chemically synthesized
gcacgttaggaggccgaggt

SEQ ID NO: 413567 - DNA, 20 bp, Artificial Sequence
  chemically synthesized
agcacgttaggaggccgagg

SEQ ID NO: 413568 - DNA, 20 bp, Artificial Sequence
  chemically synthesized
cccagcacgttaggaggccg

SEQ ID NO: 413569 - DNA, 20 bp, Artificial Sequence
  chemically synthesized
tcccagcacgttaggaggcc

SEQ ID NO: 413570 - DNA, 20 bp, Artificial Sequence
  chemically synthesized
tgtaatcccagcacgttagg

SEQ ID NO: 413571 - DNA, 20 bp, Artificial Sequence
  chemically synthesized
ctgtaatcccagcacgttag

SEQ ID NO: 413572 - DNA, 20 bp, Artificial Sequence
  chemically synthesized
acctcggcctcctaacgtgc

SEQ ID NO: 413573 - DNA, 20 bp, Artificial Sequence
  chemically synthesized
gcctgtaatcccagcacgtt

SEQ ID NO: 413574 - DNA, 20 bp, Artificial Sequence
  chemically synthesized
cctcggcctcctaacgtgct

SEQ ID NO: 413575 - DNA, 20 bp, Artificial Sequence
  chemically synthesized
tgcctgtaatcccagcacgt

SEQ ID NO: 413576 - DNA, 20 bp, Artificial Sequence
  chemically synthesized
ctcctaacgtgctgggatta

SEQ ID NO: 413577 - DNA, 20 bp, Artificial Sequence
  chemically synthesized
tcctaacgtgctgggattac

SEQ ID NO: 413578 - DNA, 20 bp, Artificial Sequence
  chemically synthesized
gtggctcatgcctgtaatcc

SEQ ID NO: 413579 - DNA, 20 bp, Artificial Sequence
  chemically synthesized
cgtgctgggattacaggcat

SEQ ID NO: 413580 - DNA, 20 bp, Artificial Sequence
  chemically synthesized
caggcatgagccaccatgcc

SEQ ID NO: 413581 - DNA, 20 bp, Artificial Sequence
  chemically synthesized
gttttataggccgggcatgg

SEQ ID NO: 413582 - DNA, 20 bp, Artificial Sequence
  chemically synthesized
atggttttataggccgggca

SEQ ID NO: 413583 - DNA, 20 bp, Artificial Sequence
  chemically synthesized
aaaagatggttttataggcc

SEQ ID NO: 413584 - DNA, 20 bp, Artificial Sequence
  chemically synthesized
taaaagatggttttataggc

SEQ ID NO: 413585 - DNA, 20 bp, Artificial Sequence
  chemically synthesized
ctcttaaaagatggttttat

SEQ ID NO: 413586 - DNA, 20 bp, Artificial Sequence
  chemically synthesized
cctcttaaaagatggtttta

SEQ ID NO: 413587 - DNA, 20 bp, Artificial Sequence
  chemically synthesized
ggcctataaaaccatctttt

SEQ ID NO: 413588 - DNA, 20 bp, Artificial Sequence
  chemically synthesized
atttttgtcctcttaaaaga

SEQ ID NO: 413589 - DNA, 20 bp, Artificial Sequence
  chemically synthesized
cctataaaaccatcttttaa

SEQ ID NO: 413590 - DNA, 20 bp, Artificial Sequence
  chemically synthesized
ctataaaaccatcttttaag

SEQ ID NO: 413591 - DNA, 20 bp, Artificial Sequence
  chemically synthesized
tctcatttttgtcctcttaa

SEQ ID NO: 413592 - DNA, 20 bp, Artificial Sequence
  chemically synthesized
tcttttaagaggacaaaaat

SEQ ID NO: 413593 - DNA, 20 bp, Artificial Sequence
  chemically synthesized
aatgagacaacaattgcctg

SEQ ID NO: 413594 - DNA, 20 bp, Artificial Sequence
  chemically synthesized
acaatgtttgtgtcgtccac

SEQ ID NO: 413595 - DNA, 20 bp, Artificial Sequence
  chemically synthesized
tacaatgtttgtgtcgtcca

SEQ ID NO: 413596 - DNA, 20 bp, Artificial Sequence
  chemically synthesized
tgtggacgacacaaacattg

SEQ ID NO: 413597 - DNA, 20 bp, Artificial Sequence
  chemically synthesized
tggacgacacaaacattgta

SEQ ID NO: 413598 - DNA, 20 bp, Artificial Sequence
  chemically synthesized
acgacacaaacattgtagag

SEQ ID NO: 413599 - DNA, 20 bp, Artificial Sequence
  chemically synthesized
cacaaacattgtagagtagc

SEQ ID NO: 413600 - DNA, 20 bp, Artificial Sequence
  chemically synthesized
caaacattgtagagtagcca

SEQ ID NO: 413601 - DNA, 20 bp, Artificial Sequence
  chemically synthesized
ttgtagagtagccagagtta

SEQ ID NO: 413602 - DNA, 20 bp, Artificial Sequence
  chemically synthesized
gtcgattgtgtctttaactc

SEQ ID NO: 413603 - DNA, 20 bp, Artificial Sequence
  chemically synthesized
gagttaaagacacaatcgac

SEQ ID NO: 413604 - DNA, 20 bp, Artificial Sequence
  chemically synthesized
agttaaagacacaatcgaca

SEQ ID NO: 413605 - DNA, 20 bp, Artificial Sequence
  chemically synthesized
aaggaaatttgttacctctg

SEQ ID NO: 413606 - DNA, 20 bp, Artificial Sequence
  chemically synthesized
taaatggctatgtgccacag

SEQ ID NO: 413607 - DNA, 20 bp, Artificial Sequence
  chemically synthesized
ttaaatggctatgtgccaca

SEQ ID NO: 413608 - DNA, 20 bp, Artificial Sequence
  chemically synthesized
tttgttacctctgtggcaca

SEQ ID NO: 413609 - DNA, 20 bp, Artificial Sequence
  chemically synthesized
tgttaaatggctatgtgcca

SEQ ID NO: 413610 - DNA, 20 bp, Artificial Sequence
  chemically synthesized
ataattgtaattatgttaaa

SEQ ID NO: 413611 - DNA, 20 bp, Artificial Sequence
  chemically synthesized
tatgacttagtatatgttat

SEQ ID NO: 413612 - DNA, 20 bp, Artificial Sequence
  chemically synthesized
tattactgataacatatact

SEQ ID NO: 413613 - DNA, 20 bp, Artificial Sequence
  chemically synthesized
cctataattctaatatgact

SEQ ID NO: 413614 - DNA, 20 bp, Artificial Sequence
  chemically synthesized
taacatatactaagtcatat

SEQ ID NO: 413615 - DNA, 20 bp, Artificial Sequence
  chemically synthesized
actaagtcatattagaatta

SEQ ID NO: 413616 - DNA, 20 bp, Artificial Sequence
  chemically synthesized
ctaagtcatattagaattat

SEQ ID NO: 413617 - DNA, 20 bp, Artificial Sequence
  chemically synthesized
aagtcatattagaattatag

SEQ ID NO: 413618 - DNA, 20 bp, Artificial Sequence
  chemically synthesized
ataggagttttacataatct

SEQ ID NO: 413619 - DNA, 20 bp, Artificial Sequence
  chemically synthesized
atatgattgacatatgttct

SEQ ID NO: 413620 - DNA, 20 bp, Artificial Sequence
  chemically synthesized
atcatatatttacacaaata

SEQ ID NO: 413621 - DNA, 20 bp, Artificial Sequence
  chemically synthesized
acacaaatatagcccccaaa

SEQ ID NO: 413622 - DNA, 20 bp, Artificial Sequence
  chemically synthesized
aatggtgtttggctttttgg

SEQ ID NO: 413623 - DNA, 20 bp, Artificial Sequence
  chemically synthesized
aaatggtgtttggctttttg

SEQ ID NO: 413624 - DNA, 20 bp, Artificial Sequence
  chemically synthesized
gaaatggtgtttggcttttt

SEQ ID NO: 413625 - DNA, 20 bp, Artificial Sequence
  chemically synthesized
tgaaatggtgtttggctttt

SEQ ID NO: 413626 - DNA, 20 bp, Artificial Sequence
  chemically synthesized
gtcaaatatgaaatggtgtt

SEQ ID NO: 413627 - DNA, 20 bp, Artificial Sequence
  chemically synthesized
aaacattgtcaaatatgaaa

SEQ ID NO: 413628 - DNA, 20 bp, Artificial Sequence
  chemically synthesized
attttgcataaaaatcatac

SEQ ID NO: 413629 - DNA, 20 bp, Artificial Sequence
  chemically synthesized
tattttgcataaaaatcata

SEQ ID NO: 413630 - DNA, 20 bp, Artificial Sequence
  chemically synthesized
taaagtccaaaaatgacatt

SEQ ID NO: 413631 - DNA, 20 bp, Artificial Sequence
  chemically synthesized
aatacgccaaatgtcatttt

SEQ ID NO: 413632 - DNA, 20 bp, Artificial Sequence
  chemically synthesized
caaatgtcatttttggactt

SEQ ID NO: 413633 - DNA, 20 bp, Artificial Sequence
  chemically synthesized
aatgtcatttttggacttta

SEQ ID NO: 413634 - DNA, 20 bp, Artificial Sequence
  chemically synthesized
atgtcatttttggactttag

SEQ ID NO: 413635 - DNA, 20 bp, Artificial Sequence
  chemically synthesized
tttagatattaggtcctcta

SEQ ID NO: 413636 - DNA, 20 bp, Artificial Sequence
  chemically synthesized
ggcctaatcttttagatatt

SEQ ID NO: 413637 - DNA, 20 bp, Artificial Sequence
  chemically synthesized
tggcctaatcttttagatat

SEQ ID NO: 413638 - DNA, 20 bp, Artificial Sequence
  chemically synthesized
ttagaggacctaatatctaa

SEQ ID NO: 413639 - DNA, 20 bp, Artificial Sequence
  chemically synthesized
ggacctaatatctaaaagat

SEQ ID NO: 413640 - DNA, 20 bp, Artificial Sequence
  chemically synthesized
gacctaatatctaaaagatt

SEQ ID NO: 413641 - DNA, 20 bp, Artificial Sequence
  chemically synthesized
ctctttctggcctaatcttt

SEQ ID NO: 413642 - DNA, 20 bp, Artificial Sequence
  chemically synthesized
taatatctaaaagattaggc

SEQ ID NO: 413643 - DNA, 20 bp, Artificial Sequence
  chemically synthesized
atctaaaagattaggccaga

SEQ ID NO: 413644 - DNA, 20 bp, Artificial Sequence
  chemically synthesized
ctaaaagattaggccagaaa

SEQ ID NO: 413645 - DNA, 20 bp, Artificial Sequence
  chemically synthesized
ttataaattatgtctctttc

SEQ ID NO: 413646 - DNA, 20 bp, Artificial Sequence
  chemically synthesized
cataatttataatttgattt

SEQ ID NO: 413647 - DNA, 20 bp, Artificial Sequence
  chemically synthesized
atttataatttgattttgga

SEQ ID NO: 413648 - DNA, 20 bp, Artificial Sequence
  chemically synthesized
ggaaagtttgccaaatatca

SEQ ID NO: 413649 - DNA, 20 bp, Artificial Sequence
  chemically synthesized
tgttttaaacctttgatatt

SEQ ID NO: 413650 - DNA, 20 bp, Artificial Sequence
  chemically synthesized
gaaagtttgccaaatatcaa

SEQ ID NO: 413651 - DNA, 20 bp, Artificial Sequence
  chemically synthesized
atatcaaaggtttaaaacac

SEQ ID NO: 413652 - DNA, 20 bp, Artificial Sequence
  chemically synthesized
ggattctattttgtgatatc

SEQ ID NO: 413653 - DNA, 20 bp, Artificial Sequence
  chemically synthesized
aaacactggatatcacaaaa

SEQ ID NO: 413654 - DNA, 20 bp, Artificial Sequence
  chemically synthesized
gatatcacaaaatagaatcc

SEQ ID NO: 413655 - DNA, 20 bp, Artificial Sequence
  chemically synthesized
atatcacaaaatagaatccc

SEQ ID NO: 413656 - DNA, 20 bp, Artificial Sequence
  chemically synthesized
tgaatgacttatggtgacct

SEQ ID NO: 413657 - DNA, 20 bp, Artificial Sequence
  chemically synthesized
atgaatgacttatggtgacc

SEQ ID NO: 413658 - DNA, 20 bp, Artificial Sequence
  chemically synthesized
atagaatcccaggtcaccat

SEQ ID NO: 413659 - DNA, 20 bp, Artificial Sequence
  chemically synthesized
ttggtcaaatgaatgactta

SEQ ID NO: 413660 - DNA, 20 bp, Artificial Sequence
  chemically synthesized
agattttggagttatcgttt

SEQ ID NO: 413661 - DNA, 20 bp, Artificial Sequence
  chemically synthesized
gtttttcttttaagattttg

SEQ ID NO: 413662 - DNA, 20 bp, Artificial Sequence
  chemically synthesized
aggtttttcttttaagattt

SEQ ID NO: 413663 - DNA, 20 bp, Artificial Sequence
  chemically synthesized
cgataactccaaaatcttaa

SEQ ID NO: 413664 - DNA, 20 bp, Artificial Sequence
  chemically synthesized
agaataaaggtttttctttt

SEQ ID NO: 413665 - DNA, 20 bp, Artificial Sequence
  chemically synthesized
agtctcctctgtcagaataa

SEQ ID NO: 413666 - DNA, 20 bp, Artificial Sequence
  chemically synthesized
aagtctcctctgtcagaata

SEQ ID NO: 413667 - DNA, 20 bp, Artificial Sequence
  chemically synthesized
aagaaaaacctttattctga

SEQ ID NO: 413668 - DNA, 20 bp, Artificial Sequence
  chemically synthesized
gaaaaacctttattctgaca

SEQ ID NO: 413669 - DNA, 20 bp, Artificial Sequence
  chemically synthesized
aaaaacctttattctgacag

SEQ ID NO: 413670 - DNA, 20 bp, Artificial Sequence
  chemically synthesized
aaacctttattctgacagag

SEQ ID NO: 413671 - DNA, 20 bp, Artificial Sequence
  chemically synthesized
gaaagctaagtctcctctgt

SEQ ID NO: 413672 - DNA, 20 bp, Artificial Sequence
  chemically synthesized
ttattctgacagaggagact

SEQ ID NO: 413673 - DNA, 20 bp, Artificial Sequence
  chemically synthesized
tgggtcttgtttggaaagct

SEQ ID NO: 413674 - DNA, 20 bp, Artificial Sequence
  chemically synthesized
ggagacttagctttccaaac

SEQ ID NO: 413675 - DNA, 20 bp, Artificial Sequence
  chemically synthesized
tttattgggtcttgtttgga

SEQ ID NO: 413676 - DNA, 20 bp, Artificial Sequence
  chemically synthesized
tgtctttattgggtcttgtt

SEQ ID NO: 413677 - DNA, 20 bp, Artificial Sequence
  chemically synthesized
tttccaaacaagacccaata

SEQ ID NO: 413678 - DNA, 20 bp, Artificial Sequence
  chemically synthesized
atcctcatgctgtctttatt

SEQ ID NO: 413679 - DNA, 20 bp, Artificial Sequence
  chemically synthesized
caaacaagacccaataaaga

SEQ ID NO: 413680 - DNA, 20 bp, Artificial Sequence
  chemically synthesized
tatcctcatgctgtctttat

SEQ ID NO: 413681 - DNA, 20 bp, Artificial Sequence
  chemically synthesized
agacccaataaagacagcat

SEQ ID NO: 413682 - DNA, 20 bp, Artificial Sequence
  chemically synthesized
gacccaataaagacagcatg

SEQ ID NO: 413683 - DNA, 20 bp, Artificial Sequence
  chemically synthesized
ggagagagaagagacaaatt

SEQ ID NO: 413684 - DNA, 20 bp, Artificial Sequence
  chemically synthesized
ggggaaaaggggagagagaa

SEQ ID NO: 413685 - DNA, 20 bp, Artificial Sequence
  chemically synthesized
caggggaaaaggggagagag

SEQ ID NO: 413686 - DNA, 20 bp, Artificial Sequence
  chemically synthesized
tggcaggggaaaaggggaga

SEQ ID NO: 413687 - DNA, 20 bp, Artificial Sequence
  chemically synthesized
aatggcaggggaaaagggga

SEQ ID NO: 413688 - DNA, 20 bp, Artificial Sequence
  chemically synthesized
taaatggcaggggaaaaggg

SEQ ID NO: 413689 - DNA, 20 bp, Artificial Sequence
  chemically synthesized
ggtaaatggcaggggaaaag

SEQ ID NO: 413690 - DNA, 20 bp, Artificial Sequence
  chemically synthesized
gggtaaatggcaggggaaaa

SEQ ID NO: 413691 - DNA, 20 bp, Artificial Sequence
  chemically synthesized
tgggtaaatggcaggggaaa

SEQ ID NO: 413692 - DNA, 20 bp, Artificial Sequence
  chemically synthesized
ttgggtaaatggcaggggaa

SEQ ID NO: 413693 - DNA, 20 bp, Artificial Sequence
  chemically synthesized
ctcctttgggtaaatggcag

SEQ ID NO: 413694 - DNA, 20 bp, Artificial Sequence
  chemically synthesized
tctcctttgggtaaatggca

SEQ ID NO: 413695 - DNA, 20 bp, Artificial Sequence
  chemically synthesized
ttctcctttgggtaaatggc

SEQ ID NO: 413696 - DNA, 20 bp, Artificial Sequence
  chemically synthesized
tttctcctttgggtaaatgg

SEQ ID NO: 413697 - DNA, 20 bp, Artificial Sequence
  chemically synthesized
ggctttctcctttgggtaaa

SEQ ID NO: 413698 - DNA, 20 bp, Artificial Sequence
  chemically synthesized
tttcccctgccatttaccca

SEQ ID NO: 413699 - DNA, 20 bp, Artificial Sequence
  chemically synthesized
ttcccctgccatttacccaa

SEQ ID NO: 413700 - DNA, 20 bp, Artificial Sequence
  chemically synthesized
cccctgccatttacccaaag

SEQ ID NO: 413701 - DNA, 20 bp, Artificial Sequence
  chemically synthesized
agggtttggctttctccttt

SEQ ID NO: 413702 - DNA, 20 bp, Artificial Sequence
  chemically synthesized
tgccatttacccaaaggaga

SEQ ID NO: 413703 - DNA, 20 bp, Artificial Sequence
  chemically synthesized
aagggtttggctttctcctt

SEQ ID NO: 413704 - DNA, 20 bp, Artificial Sequence
  chemically synthesized
taaaagataatgaaagggtt

SEQ ID NO: 413705 - DNA, 20 bp, Artificial Sequence
  chemically synthesized
aacgttaaaagataatgaaa

SEQ ID NO: 413706 - DNA, 20 bp, Artificial Sequence
  chemically synthesized
taacgttaaaagataatgaa

SEQ ID NO: 413707 - DNA, 20 bp, Artificial Sequence
  chemically synthesized
gtaacgttaaaagataatga

SEQ ID NO: 413708 - DNA, 20 bp, Artificial Sequence
  chemically synthesized
cgatttttttgtaacgttaa

SEQ ID NO: 413709 - DNA, 20 bp, Artificial Sequence
  chemically synthesized
tacaaaaaaatcgtcttcaa

SEQ ID NO: 413710 - DNA, 20 bp, Artificial Sequence
  chemically synthesized
caaaaaaatcgtcttcaaaa

SEQ ID NO: 413711 - DNA, 20 bp, Artificial Sequence
  chemically synthesized
aaatttggttttctcttttg

SEQ ID NO: 413712 - DNA, 20 bp, Artificial Sequence
  chemically synthesized
actaatgcgaacatgaaatt

SEQ ID NO: 413713 - DNA, 20 bp, Artificial Sequence
  chemically synthesized
accaaatttcatgttcgcat

SEQ ID NO: 413714 - DNA, 20 bp, Artificial Sequence
  chemically synthesized
aaaaactagctttagcatta

SEQ ID NO: 413715 - DNA, 20 bp, Artificial Sequence
  chemically synthesized
ttagtgcatctttaatgcta

SEQ ID NO: 413716 - DNA, 20 bp, Artificial Sequence
  chemically synthesized
tgcatctttaatgctaaagc

SEQ ID NO: 413717 - DNA, 20 bp, Artificial Sequence
  chemically synthesized
ttttatttaaaaactagctt

SEQ ID NO: 413718 - DNA, 20 bp, Artificial Sequence
  chemically synthesized
ataaaattttatttaaaaac

SEQ ID NO: 413719 - DNA, 20 bp, Artificial Sequence
  chemically synthesized
taaaattttatgtatctatc

SEQ ID NO: 413720 - DNA, 20 bp, Artificial Sequence
  chemically synthesized
tcaaactaattaaaactgga

SEQ ID NO: 413721 - DNA, 20 bp, Artificial Sequence
  chemically synthesized
gtggtcaaactaattaaaac

SEQ ID NO: 413722 - DNA, 20 bp, Artificial Sequence
  chemically synthesized
tgtatctatccagttttaat

SEQ ID NO: 413723 - DNA, 20 bp, Artificial Sequence
  chemically synthesized
gttttaattagtttgaccac

SEQ ID NO: 413724 - DNA, 20 bp, Artificial Sequence
  chemically synthesized
ttttaattagtttgaccaca

SEQ ID NO: 413725 - DNA, 20 bp, Artificial Sequence
  chemically synthesized
tttatgagaatgtcaccttg

SEQ ID NO: 413726 - DNA, 20 bp, Artificial Sequence
  chemically synthesized
aagcgttctaaaaagtttat

SEQ ID NO: 413727 - DNA, 20 bp, Artificial Sequence
  chemically synthesized
tgacattctcataaactttt

SEQ ID NO: 413728 - DNA, 20 bp, Artificial Sequence
  chemically synthesized
aaattataaagcgttctaaa

SEQ ID NO: 413729 - DNA, 20 bp, Artificial Sequence
  chemically synthesized
ctgtttaatggaaaattata

SEQ ID NO: 413730 - DNA, 20 bp, Artificial Sequence
  chemically synthesized
ctttataattttccattaaa

SEQ ID NO: 413731 - DNA, 20 bp, Artificial Sequence
  chemically synthesized
aaaattgatctgctgtttaa

SEQ ID NO: 413732 - DNA, 20 bp, Artificial Sequence
  chemically synthesized
tataattttccattaaacag

SEQ ID NO: 413733 - DNA, 20 bp, Artificial Sequence
  chemically synthesized
aaacagcagatcaattttct

SEQ ID NO: 413734 - DNA, 20 bp, Artificial Sequence
  chemically synthesized
cagcagatcaattttctaag

SEQ ID NO: 413735 - DNA, 20 bp, Artificial Sequence
  chemically synthesized
tccaaataacagggtcttct

SEQ ID NO: 413736 - DNA, 20 bp, Artificial Sequence
  chemically synthesized
tctaagaagaccctgttatt

SEQ ID NO: 413737 - DNA, 20 bp, Artificial Sequence
  chemically synthesized
gcccatgtgtccaaataaca

SEQ ID NO: 413738 - DNA, 20 bp, Artificial Sequence
  chemically synthesized
ggcccatgtgtccaaataac

SEQ ID NO: 413739 - DNA, 20 bp, Artificial Sequence
  chemically synthesized
gggcccatgtgtccaaataa

SEQ ID NO: 413740 - DNA, 20 bp, Artificial Sequence
  chemically synthesized
gaccctgttatttggacaca

SEQ ID NO: 413741 - DNA, 20 bp, Artificial Sequence
  chemically synthesized
accctgttatttggacacat

SEQ ID NO: 413742 - DNA, 20 bp, Artificial Sequence
  chemically synthesized
gttatttggacacatgggcc

SEQ ID NO: 413743 - DNA, 20 bp, Artificial Sequence
  chemically synthesized
ggacacatgggcccagattc

SEQ ID NO: 413744 - DNA, 20 bp, Artificial Sequence
  chemically synthesized
atactgtggggccagaatct

SEQ ID NO: 413745 - DNA, 20 bp, Artificial Sequence
  chemically synthesized
catactgtggggccagaatc

SEQ ID NO: 413746 - DNA, 20 bp, Artificial Sequence
  chemically synthesized
gggcccagattctggcccca

SEQ ID NO: 413747 - DNA, 20 bp, Artificial Sequence
  chemically synthesized
ttaaagtcatactgtggggc

SEQ ID NO: 413748 - DNA, 20 bp, Artificial Sequence
  chemically synthesized
aatattaaagtcatactgtg

SEQ ID NO: 413749 - DNA, 20 bp, Artificial Sequence
  chemically synthesized
aaatattaaagtcatactgt

SEQ ID NO: 413750 - DNA, 20 bp, Artificial Sequence
  chemically synthesized
aaaatattaaagtcatactg

SEQ ID NO: 413751 - DNA, 20 bp, Artificial Sequence
  chemically synthesized
ttctataggttaaaatatta

SEQ ID NO: 413752 - DNA, 20 bp, Artificial Sequence
  chemically synthesized
gactttaatattttaaccta

SEQ ID NO: 413753 - DNA, 20 bp, Artificial Sequence
  chemically synthesized
aatattttaacctatagaaa

SEQ ID NO: 413754 - DNA, 20 bp, Artificial Sequence
  chemically synthesized
ggttatttagctttttctat

SEQ ID NO: 413755 - DNA, 20 bp, Artificial Sequence
  chemically synthesized
aggttatttagctttttcta

SEQ ID NO: 413756 - DNA, 20 bp, Artificial Sequence
  chemically synthesized
aagatttgaaaaaggttatt

SEQ ID NO: 413757 - DNA, 20 bp, Artificial Sequence
  chemically synthesized
agttggctaagatttgaaaa

SEQ ID NO: 413758 - DNA, 20 bp, Artificial Sequence
  chemically synthesized
aagttggctaagatttgaaa

SEQ ID NO: 413759 - DNA, 20 bp, Artificial Sequence
  chemically synthesized
aaataacctttttcaaatct

SEQ ID NO: 413760 - DNA, 20 bp, Artificial Sequence
  chemically synthesized
tgggtataaacaagttggct

SEQ ID NO: 413761 - DNA, 20 bp, Artificial Sequence
  chemically synthesized
ttctgtgggtataaacaagt

SEQ ID NO: 413762 - DNA, 20 bp, Artificial Sequence
  chemically synthesized
aaaattctgtgggtataaac

SEQ ID NO: 413763 - DNA, 20 bp, Artificial Sequence
  chemically synthesized
agccaacttgtttataccca

SEQ ID NO: 413764 - DNA, 20 bp, Artificial Sequence
  chemically synthesized
cctgaaaaaaaaaattctgt

SEQ ID NO: 413765 - DNA, 20 bp, Artificial Sequence
  chemically synthesized
tcctgaaaaaaaaaattctg

SEQ ID NO: 413766 - DNA, 20 bp, Artificial Sequence
  chemically synthesized
acccacagaatttttttttt

SEQ ID NO: 413767 - DNA, 20 bp, Artificial Sequence
  chemically synthesized
cccacagaattttttttttc

SEQ ID NO: 413768 - DNA, 20 bp, Artificial Sequence
  chemically synthesized
aagtgaaaagggtttataca

SEQ ID NO: 413769 - DNA, 20 bp, Artificial Sequence
  chemically synthesized
aaagtgaaaagggtttatac

SEQ ID NO: 413770 - DNA, 20 bp, Artificial Sequence
  chemically synthesized
caaagtgaaaagggtttata

SEQ ID NO: 413771 - DNA, 20 bp, Artificial Sequence
  chemically synthesized
gggtttaagcaaagtgaaaa

SEQ ID NO: 413772 - DNA, 20 bp, Artificial Sequence
  chemically synthesized
agggtttaagcaaagtgaaa

SEQ ID NO: 413773 - DNA, 20 bp, Artificial Sequence
  chemically synthesized
gagggtttaagcaaagtgaa

SEQ ID NO: 413774 - DNA, 20 bp, Artificial Sequence
  chemically synthesized
cgaaactgagggtttaagca

SEQ ID NO: 413775 - DNA, 20 bp, Artificial Sequence
  chemically synthesized
tttcactttgcttaaaccct

SEQ ID NO: 413776 - DNA, 20 bp, Artificial Sequence
  chemically synthesized
cggaacgaaactgagggttt

SEQ ID NO: 413777 - DNA, 20 bp, Artificial Sequence
  chemically synthesized
gagtaacggaacgaaactga

SEQ ID NO: 413778 - DNA, 20 bp, Artificial Sequence
  chemically synthesized
agagtaacggaacgaaactg

SEQ ID NO: 413779 - DNA, 20 bp, Artificial Sequence
  chemically synthesized
aagagtaacggaacgaaact

SEQ ID NO: 413780 - DNA, 20 bp, Artificial Sequence
  chemically synthesized
gtcttaaactaaaagagtaa

SEQ ID NO: 413781 - DNA, 20 bp, Artificial Sequence
  chemically synthesized
gtttcgttccgttactcttt

SEQ ID NO: 413782 - DNA, 20 bp, Artificial Sequence
  chemically synthesized
aagactgtcttaaactaaaa

SEQ ID NO: 413783 - DNA, 20 bp, Artificial Sequence
  chemically synthesized
ttccgttactcttttagttt

SEQ ID NO: 413784 - DNA, 20 bp, Artificial Sequence
  chemically synthesized
taaagactgtcttaaactaa

SEQ ID NO: 413785 - DNA, 20 bp, Artificial Sequence
  chemically synthesized
gttactcttttagtttaaga

SEQ ID NO: 413786 - DNA, 20 bp, Artificial Sequence
  chemically synthesized
tgtctagttcagaggtttta

SEQ ID NO: 413787 - DNA, 20 bp, Artificial Sequence
  chemically synthesized
agtctttaaaacctctgaac

SEQ ID NO: 413788 - DNA, 20 bp, Artificial Sequence
  chemically synthesized
tgtaattttgtctagttcag

SEQ ID NO: 413789 - DNA, 20 bp, Artificial Sequence
  chemically synthesized
atgtaattttgtctagttca

SEQ ID NO: 413790 - DNA, 20 bp, Artificial Sequence
  chemically synthesized
gaatgtaattttgtctagtt

SEQ ID NO: 413791 - DNA, 20 bp, Artificial Sequence
  chemically synthesized
gaagagaatgtaattttgtc

SEQ ID NO: 413792 - DNA, 20 bp, Artificial Sequence
  chemically synthesized
ggaatatggcttttgttgaa

SEQ ID NO: 413793 - DNA, 20 bp, Artificial Sequence
  chemically synthesized
aattacattctcttcaacaa

SEQ ID NO: 413794 - DNA, 20 bp, Artificial Sequence
  chemically synthesized
taggaatatggcttttgttg

SEQ ID NO: 413795 - DNA, 20 bp, Artificial Sequence
  chemically synthesized
gataataaggcataggaata

SEQ ID NO: 413796 - DNA, 20 bp, Artificial Sequence
  chemically synthesized
ggtgaaagataataaggcat

SEQ ID NO: 413797 - DNA, 20 bp, Artificial Sequence
  chemically synthesized
tggtgaaagataataaggca

SEQ ID NO: 413798 - DNA, 20 bp, Artificial Sequence
  chemically synthesized
gtttttggtgaaagataata

SEQ ID NO: 413799 - DNA, 20 bp, Artificial Sequence
  chemically synthesized
tgtttttggtgaaagataat

SEQ ID NO: 413800 - DNA, 20 bp, Artificial Sequence
  chemically synthesized
agggaatgtgtttttggtga

SEQ ID NO: 413801 - DNA, 20 bp, Artificial Sequence
  chemically synthesized
gtgtgtagggaatgtgtttt

SEQ ID NO: 413802 - DNA, 20 bp, Artificial Sequence
  chemically synthesized
ttttacatacaaggtgtgta

SEQ ID NO: 413803 - DNA, 20 bp, Artificial Sequence
  chemically synthesized
gttttacatacaaggtgtgt

SEQ ID NO: 413804 - DNA, 20 bp, Artificial Sequence
  chemically synthesized
agttttacatacaaggtgtg

SEQ ID NO: 413805 - DNA, 20 bp, Artificial Sequence
  chemically synthesized
gagaaacagttttacataca

SEQ ID NO: 413806 - DNA, 20 bp, Artificial Sequence
  chemically synthesized
ggagaaacagttttacatac

SEQ ID NO: 413807 - DNA, 20 bp, Artificial Sequence
  chemically synthesized
tgtatgtaaaactgtttctc

SEQ ID NO: 413808 - DNA, 20 bp, Artificial Sequence
  chemically synthesized
aatcgaggttactggagaaa

SEQ ID NO: 413809 - DNA, 20 bp, Artificial Sequence
  chemically synthesized
acatgaaatcgaggttactg

SEQ ID NO: 413810 - DNA, 20 bp, Artificial Sequence
  chemically synthesized
taacatgaaatcgaggttac

SEQ ID NO: 413811 - DNA, 20 bp, Artificial Sequence
  chemically synthesized
aacattgtaacatgaaatcg

SEQ ID NO: 413812 - DNA, 20 bp, Artificial Sequence
  chemically synthesized
taacattgtaacatgaaatc

SEQ ID NO: 413813 - DNA, 20 bp, Artificial Sequence
  chemically synthesized
catgttacaatgttaactct

SEQ ID NO: 413814 - DNA, 20 bp, Artificial Sequence
  chemically synthesized
ctaaaaatcaaagttgctaa

SEQ ID NO: 413815 - DNA, 20 bp, Artificial Sequence
  chemically synthesized
cactaaaaatcaaagttgct

SEQ ID NO: 413816 - DNA, 20 bp, Artificial Sequence
  chemically synthesized
ctcttagcaactttgatttt

SEQ ID NO: 413817 - DNA, 20 bp, Artificial Sequence
  chemically synthesized
aggtttttcactaaaaatca

SEQ ID NO: 413818 - DNA, 20 bp, Artificial Sequence
  chemically synthesized
tagtgaaaaacctgataaaa

SEQ ID NO: 413819 - DNA, 20 bp, Artificial Sequence
  chemically synthesized
attaaaatagcttttttatc

SEQ ID NO: 413820 - DNA, 20 bp, Artificial Sequence
  chemically synthesized
aattaaaatagcttttttat

SEQ ID NO: 413821 - DNA, 20 bp, Artificial Sequence
  chemically synthesized
tccctagcatataattaaaa

SEQ ID NO: 413822 - DNA, 20 bp, Artificial Sequence
  chemically synthesized
aagctattttaattatatgc

SEQ ID NO: 413823 - DNA, 20 bp, Artificial Sequence
  chemically synthesized
agctattttaattatatgct

SEQ ID NO: 413824 - DNA, 20 bp, Artificial Sequence
  chemically synthesized
gctattttaattatatgcta

SEQ ID NO: 413825 - DNA, 20 bp, Artificial Sequence
  chemically synthesized
ttttaattatatgctaggga

SEQ ID NO: 413826 - DNA, 20 bp, Artificial Sequence
  chemically synthesized
ttaattatatgctagggatg

SEQ ID NO: 413827 - DNA, 20 bp, Artificial Sequence
  chemically synthesized
gatgtcctaggctccatccc

SEQ ID NO: 413828 - DNA, 20 bp, Artificial Sequence
  chemically synthesized
tatatgctagggatggagcc

SEQ ID NO: 413829 - DNA, 20 bp, Artificial Sequence
  chemically synthesized
atatgctagggatggagcct

SEQ ID NO: 413830 - DNA, 20 bp, Artificial Sequence
  chemically synthesized
agggatggagcctaggacat

SEQ ID NO: 413831 - DNA, 20 bp, Artificial Sequence
  chemically synthesized
tcacttctgtctgatgtcct

SEQ ID NO: 413832 - DNA, 20 bp, Artificial Sequence
  chemically synthesized
ttcacttctgtctgatgtcc

SEQ ID NO: 413833 - DNA, 20 bp, Artificial Sequence
  chemically synthesized
atggagcctaggacatcaga

SEQ ID NO: 413834 - DNA, 20 bp, Artificial Sequence
  chemically synthesized
gagcctaggacatcagacag

SEQ ID NO: 413835 - DNA, 20 bp, Artificial Sequence
  chemically synthesized
taggacatcagacagaagtg

SEQ ID NO: 413836 - DNA, 20 bp, Artificial Sequence
  chemically synthesized
catcagacagaagtgaagat

SEQ ID NO: 413837 - DNA, 20 bp, Artificial Sequence
  chemically synthesized
atcagacagaagtgaagata

SEQ ID NO: 413838 - DNA, 20 bp, Artificial Sequence
  chemically synthesized
ctagctatgctgaaaagagt

SEQ ID NO: 413839 - DNA, 20 bp, Artificial Sequence
  chemically synthesized
agataaggtctgactctttt

SEQ ID NO: 413840 - DNA, 20 bp, Artificial Sequence
  chemically synthesized
gcccctagctatgctgaaaa

SEQ ID NO: 413841 - DNA, 20 bp, Artificial Sequence
  chemically synthesized
aggtctgactcttttcagca

SEQ ID NO: 413842 - DNA, 20 bp, Artificial Sequence
  chemically synthesized
atgcccctagctatgctgaa

SEQ ID NO: 413843 - DNA, 20 bp, Artificial Sequence
  chemically synthesized
ctgactcttttcagcatagc

SEQ ID NO: 413844 - DNA, 20 bp, Artificial Sequence
  chemically synthesized
tgactcttttcagcatagct

SEQ ID NO: 413845 - DNA, 20 bp, Artificial Sequence
  chemically synthesized
gactcttttcagcatagcta

SEQ ID NO: 413846 - DNA, 20 bp, Artificial Sequence
  chemically synthesized
actcttttcagcatagctag

SEQ ID NO: 413847 - DNA, 20 bp, Artificial Sequence
  chemically synthesized
tttcagcatagctaggggca

SEQ ID NO: 413848 - DNA, 20 bp, Artificial Sequence
  chemically synthesized
cacgtggagagctatgcccc

SEQ ID NO: 413849 - DNA, 20 bp, Artificial Sequence
  chemically synthesized
gaggcctggggacacgtgga

SEQ ID NO: 413850 - DNA, 20 bp, Artificial Sequence
  chemically synthesized
atgaggcctggggacacgtg

SEQ ID NO: 413851 - DNA, 20 bp, Artificial Sequence
  chemically synthesized
agatgaggcctggggacacg

SEQ ID NO: 413852 - DNA, 20 bp, Artificial Sequence
  chemically synthesized
catagctctccacgtgtccc

SEQ ID NO: 413853 - DNA, 20 bp, Artificial Sequence
  chemically synthesized
atagctctccacgtgtcccc

SEQ ID NO: 413854 - DNA, 20 bp, Artificial Sequence
  chemically synthesized
tatattatagatgaggcctg

SEQ ID NO: 413855 - DNA, 20 bp, Artificial Sequence
  chemically synthesized
ttatattatagatgaggcct

SEQ ID NO: 413856 - DNA, 20 bp, Artificial Sequence
  chemically synthesized
attatattatagatgaggcc

SEQ ID NO: 413857 - DNA, 20 bp, Artificial Sequence
  chemically synthesized
ggagcattatattatagatg

SEQ ID NO: 413858 - DNA, 20 bp, Artificial Sequence
  chemically synthesized
tggagcattatattatagat

SEQ ID NO: 413859 - DNA, 20 bp, Artificial Sequence
  chemically synthesized
tactttggagcattatatta

SEQ ID NO: 413860 - DNA, 20 bp, Artificial Sequence
  chemically synthesized
atctataatataatgctcca

SEQ ID NO: 413861 - DNA, 20 bp, Artificial Sequence
  chemically synthesized
tgttcaatttatttactttg

SEQ ID NO: 413862 - DNA, 20 bp, Artificial Sequence
  chemically synthesized
attgttcaatttatttactt

SEQ ID NO: 413863 - DNA, 20 bp, Artificial Sequence
  chemically synthesized
ataaattgaacaattttcca

SEQ ID NO: 413864 - DNA, 20 bp, Artificial Sequence
  chemically synthesized
ttgaacaattttccaaagtc

SEQ ID NO: 413865 - DNA, 20 bp, Artificial Sequence
  chemically synthesized
tgaacaattttccaaagtca

SEQ ID NO: 413866 - DNA, 20 bp, Artificial Sequence
  chemically synthesized
tcaaactgtttccttgactt

SEQ ID NO: 413867 - DNA, 20 bp, Artificial Sequence
  chemically synthesized
attttccaaagtcaaggaaa

SEQ ID NO: 413868 - DNA, 20 bp, Artificial Sequence
  chemically synthesized
aaggaaacagtttgacctta

SEQ ID NO: 413869 - DNA, 20 bp, Artificial Sequence
  chemically synthesized
cagatttgctaaattcttta

SEQ ID NO: 413870 - DNA, 20 bp, Artificial Sequence
  chemically synthesized
tcagatttgctaaattcttt

SEQ ID NO: 413871 - DNA, 20 bp, Artificial Sequence
  chemically synthesized
cagtttgaccttaaagaatt

SEQ ID NO: 413872 - DNA, 20 bp, Artificial Sequence
  chemically synthesized
aaagaatttagcaaatctga

SEQ ID NO: 413873 - DNA, 20 bp, Artificial Sequence
  chemically synthesized
tctaaattaaggtcagctat

SEQ ID NO: 413874 - DNA, 20 bp, Artificial Sequence
  chemically synthesized
catttggtctaaattaaggt

SEQ ID NO: 413875 - DNA, 20 bp, Artificial Sequence
  chemically synthesized
tctgatagctgaccttaatt

SEQ ID NO: 413876 - DNA, 20 bp, Artificial Sequence
  chemically synthesized
tagacatttggtctaaatta

SEQ ID NO: 413877 - DNA, 20 bp, Artificial Sequence
  chemically synthesized
gtagacatttggtctaaatt

SEQ ID NO: 413878 - DNA, 20 bp, Artificial Sequence
  chemically synthesized
atcttgaaaatgtagacatt

SEQ ID NO: 413879 - DNA, 20 bp, Artificial Sequence
  chemically synthesized
gaccaaatgtctacattttc

SEQ ID NO: 413880 - DNA, 20 bp, Artificial Sequence
  chemically synthesized
agtaaaatatcttgaaaatg

SEQ ID NO: 413881 - DNA, 20 bp, Artificial Sequence
  chemically synthesized
aattttaaagattattgtta

SEQ ID NO: 413882 - DNA, 20 bp, Artificial Sequence
  chemically synthesized
tggcaataaagacaatttta

SEQ ID NO: 413883 - DNA, 20 bp, Artificial Sequence
  chemically synthesized
ttagtaatcttttggcaata

SEQ ID NO: 413884 - DNA, 20 bp, Artificial Sequence
  chemically synthesized
aaaattgtctttattgccaa

SEQ ID NO: 413885 - DNA, 20 bp, Artificial Sequence
  chemically synthesized
acatgactttagtaatcttt

SEQ ID NO: 413886 - DNA, 20 bp, Artificial Sequence
  chemically synthesized
ttattgccaaaagattacta

SEQ ID NO: 413887 - DNA, 20 bp, Artificial Sequence
  chemically synthesized
actttttgttcacatgactt

SEQ ID NO: 413888 - DNA, 20 bp, Artificial Sequence
  chemically synthesized
actaaagtcatgtgaacaaa

SEQ ID NO: 413889 - DNA, 20 bp, Artificial Sequence
  chemically synthesized
atgtgaacaaaaagtcatca

SEQ ID NO: 413890 - DNA, 20 bp, Artificial Sequence
  chemically synthesized
aaaatattttgtcagaaaaa

SEQ ID NO: 413891 - DNA, 20 bp, Artificial Sequence
  chemically synthesized
taaataaaaaaatattttgt

SEQ ID NO: 413892 - DNA, 20 bp, Artificial Sequence
  chemically synthesized
gacaaaatatttttttattt

SEQ ID NO: 413893 - DNA, 20 bp, Artificial Sequence
  chemically synthesized
tatttaagcacttattttcc

SEQ ID NO: 413894 - DNA, 20 bp, Artificial Sequence
  chemically synthesized
gattaattggcttggaaaat

SEQ ID NO: 413895 - DNA, 20 bp, Artificial Sequence
  chemically synthesized
agagctctgattaattggct

SEQ ID NO: 413896 - DNA, 20 bp, Artificial Sequence
  chemically synthesized
tattttccaagccaattaat

SEQ ID NO: 413897 - DNA, 20 bp, Artificial Sequence
  chemically synthesized
ataaaagagctctgattaat

SEQ ID NO: 413898 - DNA, 20 bp, Artificial Sequence
  chemically synthesized
ttttccaagccaattaatca

SEQ ID NO: 413899 - DNA, 20 bp, Artificial Sequence
  chemically synthesized
tgtgtgtgatgtttataaaa

SEQ ID NO: 413900 - DNA, 20 bp, Artificial Sequence
  chemically synthesized
tgtgtgtgtgatgtttataa

SEQ ID NO: 413901 - DNA, 20 bp, Artificial Sequence
  chemically synthesized
cacaaaaacacatgtaaata

SEQ ID NO: 413902 - DNA, 20 bp, Artificial Sequence
  chemically synthesized
aaaacacatgtaaatacaga

SEQ ID NO: 413903 - DNA, 20 bp, Artificial Sequence
  chemically synthesized
acacatgtaaatacagacag

SEQ ID NO: 413904 - DNA, 20 bp, Artificial Sequence
  chemically synthesized
gtaaatacagacagaagatt

SEQ ID NO: 413905 - DNA, 20 bp, Artificial Sequence
  chemically synthesized
acagaagatttggcactgat

SEQ ID NO: 413906 - DNA, 20 bp, Artificial Sequence
  chemically synthesized
tggcaaataaaaagtcttat

SEQ ID NO: 413907 - DNA, 20 bp, Artificial Sequence
  chemically synthesized
ttaagaaactggcaaataaa

SEQ ID NO: 413908 - DNA, 20 bp, Artificial Sequence
  chemically synthesized
tgataagactttttatttgc

SEQ ID NO: 413909 - DNA, 20 bp, Artificial Sequence
  chemically synthesized
cagtaatctgattaagaaac

SEQ ID NO: 413910 - DNA, 20 bp, Artificial Sequence
  chemically synthesized
ttatttgccagtttcttaat

SEQ ID NO: 413911 - DNA, 20 bp, Artificial Sequence
  chemically synthesized
ctgaagccagtaatctgatt

SEQ ID NO: 413912 - DNA, 20 bp, Artificial Sequence
  chemically synthesized
cagtttcttaatcagattac

SEQ ID NO: 413913 - DNA, 20 bp, Artificial Sequence
  chemically synthesized
cttaatcagattactggctt

SEQ ID NO: 413914 - DNA, 20 bp, Artificial Sequence
  chemically synthesized
ttaatcagattactggcttc

SEQ ID NO: 413915 - DNA, 20 bp, Artificial Sequence
  chemically synthesized
taatcagattactggcttca

SEQ ID NO: 413916 - DNA, 20 bp, Artificial Sequence
  chemically synthesized
caaaggctccaccctgaagc

SEQ ID NO: 413917 - DNA, 20 bp, Artificial Sequence
  chemically synthesized
tcagattactggcttcaggg

SEQ ID NO: 413918 - DNA, 20 bp, Artificial Sequence
  chemically synthesized
agattactggcttcagggtg

SEQ ID NO: 413919 - DNA, 20 bp, Artificial Sequence
  chemically synthesized
cctccaaaggctccaccctg

SEQ ID NO: 413920 - DNA, 20 bp, Artificial Sequence
  chemically synthesized
tggcttcagggtggagcctt

SEQ ID NO: 413921 - DNA, 20 bp, Artificial Sequence
  chemically synthesized
gcttcagggtggagcctttg

SEQ ID NO: 413922 - DNA, 20 bp, Artificial Sequence
  chemically synthesized
cttcagggtggagcctttgg

SEQ ID NO: 413923 - DNA, 20 bp, Artificial Sequence
  chemically synthesized
tcctggccctgttcctccaa

SEQ ID NO: 413924 - DNA, 20 bp, Artificial Sequence
  chemically synthesized
ttcctggccctgttcctcca

SEQ ID NO: 413925 - DNA, 20 bp, Artificial Sequence
  chemically synthesized
gggtggagcctttggaggaa

SEQ ID NO: 413926 - DNA, 20 bp, Artificial Sequence
  chemically synthesized
ggtggagcctttggaggaac

SEQ ID NO: 413927 - DNA, 20 bp, Artificial Sequence
  chemically synthesized
gtggagcctttggaggaaca

SEQ ID NO: 413928 - DNA, 20 bp, Artificial Sequence
  chemically synthesized
agcctttggaggaacagggc

SEQ ID NO: 413929 - DNA, 20 bp, Artificial Sequence
  chemically synthesized
gcctttggaggaacagggcc

SEQ ID NO: 413930 - DNA, 20 bp, Artificial Sequence
  chemically synthesized
ttggaggaacagggccagga

SEQ ID NO: 413931 - DNA, 20 bp, Artificial Sequence
  chemically synthesized
cttagaaatgcatactttcc

SEQ ID NO: 413932 - DNA, 20 bp, Artificial Sequence
  chemically synthesized
ccaggaaagtatgcatttct

SEQ ID NO: 413933 - DNA, 20 bp, Artificial Sequence
  chemically synthesized
caggaaagtatgcatttcta

SEQ ID NO: 413934 - DNA, 20 bp, Artificial Sequence
  chemically synthesized
cttcagctgtgattaagcct

SEQ ID NO: 413935 - DNA, 20 bp, Artificial Sequence
  chemically synthesized
gcatttctaaggcttaatca

SEQ ID NO: 413936 - DNA, 20 bp, Artificial Sequence
  chemically synthesized
ctttgccttcagctgtgatt

SEQ ID NO: 413937 - DNA, 20 bp, Artificial Sequence
  chemically synthesized
ctaaggcttaatcacagctg

SEQ ID NO: 413938 - DNA, 20 bp, Artificial Sequence
  chemically synthesized
taaggcttaatcacagctga

SEQ ID NO: 413939 - DNA, 20 bp, Artificial Sequence
  chemically synthesized
cttaatcacagctgaaggca

SEQ ID NO: 413940 - DNA, 20 bp, Artificial Sequence
  chemically synthesized
gggagttctgtctttgcctt

SEQ ID NO: 413941 - DNA, 20 bp, Artificial Sequence
  chemically synthesized
atcacagctgaaggcaaaga

SEQ ID NO: 413942 - DNA, 20 bp, Artificial Sequence
  chemically synthesized
aaagacagaactcccaaatt

SEQ ID NO: 413943 - DNA, 20 bp, Artificial Sequence
  chemically synthesized
aaatggtgcccttaatttgg

SEQ ID NO: 413944 - DNA, 20 bp, Artificial Sequence
  chemically synthesized
aagacagaactcccaaatta

SEQ ID NO: 413945 - DNA, 20 bp, Artificial Sequence
  chemically synthesized
agacagaactcccaaattaa

SEQ ID NO: 413946 - DNA, 20 bp, Artificial Sequence
  chemically synthesized
taaaatggtgcccttaattt

SEQ ID NO: 413947 - DNA, 20 bp, Artificial Sequence
  chemically synthesized
ataaaatggtgcccttaatt

SEQ ID NO: 413948 - DNA, 20 bp, Artificial Sequence
  chemically synthesized
ttttgggttgcagtataaaa

SEQ ID NO: 413949 - DNA, 20 bp, Artificial Sequence
  chemically synthesized
atttctctccttttgggttg

SEQ ID NO: 413950 - DNA, 20 bp, Artificial Sequence
  chemically synthesized
cattttatactgcaacccaa

SEQ ID NO: 413951 - DNA, 20 bp, Artificial Sequence
  chemically synthesized
attttatactgcaacccaaa

SEQ ID NO: 413952 - DNA, 20 bp, Artificial Sequence
  chemically synthesized
tttatactgcaacccaaaag

SEQ ID NO: 413953 - DNA, 20 bp, Artificial Sequence
  chemically synthesized
tatactgcaacccaaaagga

SEQ ID NO: 413954 - DNA, 20 bp, Artificial Sequence
  chemically synthesized
cgtagtatttctctcctttt

SEQ ID NO: 413955 - DNA, 20 bp, Artificial Sequence
  chemically synthesized
ccgtagtatttctctccttt

SEQ ID NO: 413956 - DNA, 20 bp, Artificial Sequence
  chemically synthesized
ccaaaaggagagaaatacta

SEQ ID NO: 413957 - DNA, 20 bp, Artificial Sequence
  chemically synthesized
caaaaggagagaaatactac

SEQ ID NO: 413958 - DNA, 20 bp, Artificial Sequence
  chemically synthesized
aaaggagagaaatactacgg

SEQ ID NO: 413959 - DNA, 20 bp, Artificial Sequence
  chemically synthesized
ggagagaaatactacgggag

SEQ ID NO: 413960 - DNA, 20 bp, Artificial Sequence
  chemically synthesized
cactgtactgtcttctcccg

SEQ ID NO: 413961 - DNA, 20 bp, Artificial Sequence
  chemically synthesized
agaaatactacgggagaaga

SEQ ID NO: 413962 - DNA, 20 bp, Artificial Sequence
  chemically synthesized
tactacgggagaagacagta

SEQ ID NO: 413963 - DNA, 20 bp, Artificial Sequence
  chemically synthesized
agaaaagaaatgtagggtag

SEQ ID NO: 413964 - DNA, 20 bp, Artificial Sequence
  chemically synthesized
ataagaaaagaaatgtaggg

SEQ ID NO: 413965 - DNA, 20 bp, Artificial Sequence
  chemically synthesized
aaaataagaaaagaaatgta

SEQ ID NO: 413966 - DNA, 20 bp, Artificial Sequence
  chemically synthesized
aaaaataagaaaagaaatgt

SEQ ID NO: 413967 - DNA, 20 bp, Artificial Sequence
  chemically synthesized
caaaaataagaaaagaaatg

SEQ ID NO: 413968 - DNA, 20 bp, Artificial Sequence
  chemically synthesized
gaaagaaacaaaaataagaa

SEQ ID NO: 413969 - DNA, 20 bp, Artificial Sequence
  chemically synthesized
agaaagaaagaaacaaaaat

SEQ ID NO: 413970 - DNA, 20 bp, Artificial Sequence
  chemically synthesized
ctccgtcttaaaaagaaaga

SEQ ID NO: 413971 - DNA, 20 bp, Artificial Sequence
  chemically synthesized
ttgtttctttctttcttttt

SEQ ID NO: 413972 - DNA, 20 bp, Artificial Sequence
  chemically synthesized
gagactccgtcttaaaaaga

SEQ ID NO: 413973 - DNA, 20 bp, Artificial Sequence
  chemically synthesized
ttctttctttctttttaaga

SEQ ID NO: 413974 - DNA, 20 bp, Artificial Sequence
  chemically synthesized
gagcgagactccgtcttaaa

SEQ ID NO: 413975 - DNA, 20 bp, Artificial Sequence
  chemically synthesized
ctttctttctttttaagacg

SEQ ID NO: 413976 - DNA, 20 bp, Artificial Sequence
  chemically synthesized
tccagcctgggtgacagagc

SEQ ID NO: 413977 - DNA, 20 bp, Artificial Sequence
  chemically synthesized
cggagtctcgctctgtcacc

SEQ ID NO: 413978 - DNA, 20 bp, Artificial Sequence
  chemically synthesized
gcactccagcctgggtgaca

SEQ ID NO: 413979 - DNA, 20 bp, Artificial Sequence
  chemically synthesized
ggagtctcgctctgtcaccc

SEQ ID NO: 413980 - DNA, 20 bp, Artificial Sequence
  chemically synthesized
ctgcactccagcctgggtga

SEQ ID NO: 413981 - DNA, 20 bp, Artificial Sequence
  chemically synthesized
tctcgctctgtcacccaggc

SEQ ID NO: 413982 - DNA, 20 bp, Artificial Sequence
  chemically synthesized
tcgctctgtcacccaggctg

SEQ ID NO: 413983 - DNA, 20 bp, Artificial Sequence
  chemically synthesized
gcaccactgcactccagcct

SEQ ID NO: 413984 - DNA, 20 bp, Artificial Sequence
  chemically synthesized
agcaccactgcactccagcc

SEQ ID NO: 413985 - DNA, 20 bp, Artificial Sequence
  chemically synthesized
ctgtcacccaggctggagtg

SEQ ID NO: 413986 - DNA, 20 bp, Artificial Sequence
  chemically synthesized
gagatagcaccactgcactc

SEQ ID NO: 413987 - DNA, 20 bp, Artificial Sequence
  chemically synthesized
tcacccaggctggagtgcag

SEQ ID NO: 413988 - DNA, 20 bp, Artificial Sequence
  chemically synthesized
ggagtgcagtggtgctatct

SEQ ID NO: 413989 - DNA, 20 bp, Artificial Sequence
  chemically synthesized
gaggttgcagtgagctgaga

SEQ ID NO: 413990 - DNA, 20 bp, Artificial Sequence
  chemically synthesized
ggcggaggttgcagtgagct

SEQ ID NO: 413991 - DNA, 20 bp, Artificial Sequence
  chemically synthesized
caggaggcggaggttgcagt

SEQ ID NO: 413992 - DNA, 20 bp, Artificial Sequence
  chemically synthesized
aacccaggaggcggaggttg

SEQ ID NO: 413993 - DNA, 20 bp, Artificial Sequence
  chemically synthesized
cccttgaacccaggaggcgg

SEQ ID NO: 413994 - DNA, 20 bp, Artificial Sequence
  chemically synthesized
tcactgcaacctccgcctcc

SEQ ID NO: 413995 - DNA, 20 bp, Artificial Sequence
  chemically synthesized
tcccttgaacccaggaggcg

SEQ ID NO: 413996 - DNA, 20 bp, Artificial Sequence
  chemically synthesized
cactgcaacctccgcctcct

SEQ ID NO: 413997 - DNA, 20 bp, Artificial Sequence
  chemically synthesized
aatcccttgaacccaggagg

SEQ ID NO: 413998 - DNA, 20 bp, Artificial Sequence
  chemically synthesized
gagaatcccttgaacccagg

SEQ ID NO: 413999 - DNA, 20 bp, Artificial Sequence
  chemically synthesized
ggagaatcccttgaacccag

SEQ ID NO: 414000 - DNA, 20 bp, Artificial Sequence
  chemically synthesized
aacctccgcctcctgggttc

SEQ ID NO: 414001 - DNA, 20 bp, Artificial Sequence
  chemically synthesized
acctccgcctcctgggttca

SEQ ID NO: 414002 - DNA, 20 bp, Artificial Sequence
  chemically synthesized
caggagaatcccttgaaccc

SEQ ID NO: 414003 - DNA, 20 bp, Artificial Sequence
  chemically synthesized
cctccgcctcctgggttcaa

SEQ ID NO: 414004 - DNA, 20 bp, Artificial Sequence
  chemically synthesized
gcaggagaatcccttgaacc

SEQ ID NO: 414005 - DNA, 20 bp, Artificial Sequence
  chemically synthesized
ttcaagggattctcctgcct

SEQ ID NO: 414006 - DNA, 20 bp, Artificial Sequence
  chemically synthesized
tacttgagaggctaaggcag

SEQ ID NO: 414007 - DNA, 20 bp, Artificial Sequence
  chemically synthesized
gctacttgagaggctaaggc

SEQ ID NO: 414008 - DNA, 20 bp, Artificial Sequence
  chemically synthesized
agctacttgagaggctaagg

SEQ ID NO: 414009 - DNA, 20 bp, Artificial Sequence
  chemically synthesized
cccagctacttgagaggcta

SEQ ID NO: 414010 - DNA, 20 bp, Artificial Sequence
  chemically synthesized
tcccagctacttgagaggct

SEQ ID NO: 414011 - DNA, 20 bp, Artificial Sequence
  chemically synthesized
ttctcctgccttagcctctc

SEQ ID NO: 414012 - DNA, 20 bp, Artificial Sequence
  chemically synthesized
tcctgccttagcctctcaag

SEQ ID NO: 414013 - DNA, 20 bp, Artificial Sequence
  chemically synthesized
tgtaatcccagctacttgag

SEQ ID NO: 414014 - DNA, 20 bp, Artificial Sequence
  chemically synthesized
ctgtaatcccagctacttga

SEQ ID NO: 414015 - DNA, 20 bp, Artificial Sequence
  chemically synthesized
gccttagcctctcaagtagc

SEQ ID NO: 414016 - DNA, 20 bp, Artificial Sequence
  chemically synthesized
gcctgtaatcccagctactt

SEQ ID NO: 414017 - DNA, 20 bp, Artificial Sequence
  chemically synthesized
ccttagcctctcaagtagct

SEQ ID NO: 414018 - DNA, 20 bp, Artificial Sequence
  chemically synthesized
ctctcaagtagctgggatta

SEQ ID NO: 414019 - DNA, 20 bp, Artificial Sequence
  chemically synthesized
tctcaagtagctgggattac

SEQ ID NO: 414020 - DNA, 20 bp, Artificial Sequence
  chemically synthesized
gtggcacatgcctgtaatcc

SEQ ID NO: 414021 - DNA, 20 bp, Artificial Sequence
  chemically synthesized
caggcatgtgccaccacgcc

SEQ ID NO: 414022 - DNA, 20 bp, Artificial Sequence
  chemically synthesized
caaaaattagccaggcgtgg

SEQ ID NO: 414023 - DNA, 20 bp, Artificial Sequence
  chemically synthesized
atacaaaaattagccaggcg

SEQ ID NO: 414024 - DNA, 20 bp, Artificial Sequence
  chemically synthesized
gaaaaatacaaaaattagcc

SEQ ID NO: 414025 - DNA, 20 bp, Artificial Sequence
  chemically synthesized
agaaaaatacaaaaattagc

SEQ ID NO: 414026 - DNA, 20 bp, Artificial Sequence
  chemically synthesized
tctaagaaaaatacaaaaat

SEQ ID NO: 414027 - DNA, 20 bp, Artificial Sequence
  chemically synthesized
gctaatttttgtatttttct

SEQ ID NO: 414028 - DNA, 20 bp, Artificial Sequence
  chemically synthesized
taatttttgtatttttctta

SEQ ID NO: 414029 - DNA, 20 bp, Artificial Sequence
  chemically synthesized
ttttgtatttttcttagaga

SEQ ID NO: 414030 - DNA, 20 bp, Artificial Sequence
  chemically synthesized
tttgtatttttcttagagac

SEQ ID NO: 414031 - DNA, 20 bp, Artificial Sequence
  chemically synthesized
ttgtatttttcttagagacg

SEQ ID NO: 414032 - DNA, 20 bp, Artificial Sequence
  chemically synthesized
catggtgaaaccccgtctct

SEQ ID NO: 414033 - DNA, 20 bp, Artificial Sequence
  chemically synthesized
gagacggggtttcaccatgt

SEQ ID NO: 414034 - DNA, 20 bp, Artificial Sequence
  chemically synthesized
cggggtttcaccatgttggc

SEQ ID NO: 414035 - DNA, 20 bp, Artificial Sequence
  chemically synthesized
tgagaccagcctggccaaca

SEQ ID NO: 414036 - DNA, 20 bp, Artificial Sequence
  chemically synthesized
ggggtttcaccatgttggcc

SEQ ID NO: 414037 - DNA, 20 bp, Artificial Sequence
  chemically synthesized
tttcaccatgttggccaggc

SEQ ID NO: 414038 - DNA, 20 bp, Artificial Sequence
  chemically synthesized
tcagcagtttgagaccagcc

SEQ ID NO: 414039 - DNA, 20 bp, Artificial Sequence
  chemically synthesized
tgaggtcagcagtttgagac

SEQ ID NO: 414040 - DNA, 20 bp, Artificial Sequence
  chemically synthesized
tcacttgaggtcagcagttt

SEQ ID NO: 414041 - DNA, 20 bp, Artificial Sequence
  chemically synthesized
ggcggatcacttgaggtcag

SEQ ID NO: 414042 - DNA, 20 bp, Artificial Sequence
  chemically synthesized
ggtctcaaactgctgacctc

SEQ ID NO: 414043 - DNA, 20 bp, Artificial Sequence
  chemically synthesized
gagggcggatcacttgaggt

SEQ ID NO: 414044 - DNA, 20 bp, Artificial Sequence
  chemically synthesized
cgaggagggcggatcacttg

SEQ ID NO: 414045 - DNA, 20 bp, Artificial Sequence
  chemically synthesized
ccgaggagggcggatcactt

SEQ ID NO: 414046 - DNA, 20 bp, Artificial Sequence
  chemically synthesized
ctcaagtgatccgccctcct

SEQ ID NO: 414047 - DNA, 20 bp, Artificial Sequence
  chemically synthesized
ctttgggaggccgaggaggg

SEQ ID NO: 414048 - DNA, 20 bp, Artificial Sequence
  chemically synthesized
gcactttgggaggccgagga

SEQ ID NO: 414049 - DNA, 20 bp, Artificial Sequence
  chemically synthesized
tgcactttgggaggccgagg

SEQ ID NO: 414050 - DNA, 20 bp, Artificial Sequence
  chemically synthesized
ctgcactttgggaggccgag

SEQ ID NO: 414051 - DNA, 20 bp, Artificial Sequence
  chemically synthesized
ggctgcactttgggaggccg

SEQ ID NO: 414052 - DNA, 20 bp, Artificial Sequence
  chemically synthesized
aggctgcactttgggaggcc

SEQ ID NO: 414053 - DNA, 20 bp, Artificial Sequence
  chemically synthesized
ccgccctcctcggcctccca

SEQ ID NO: 414054 - DNA, 20 bp, Artificial Sequence
  chemically synthesized
ttgggaggctgcactttggg

SEQ ID NO: 414055 - DNA, 20 bp, Artificial Sequence
  chemically synthesized
tttgggaggctgcactttgg

SEQ ID NO: 414056 - DNA, 20 bp, Artificial Sequence
  chemically synthesized
ctcctcggcctcccaaagtg

SEQ ID NO: 414057 - DNA, 20 bp, Artificial Sequence
  chemically synthesized
actttgggaggctgcacttt

SEQ ID NO: 414058 - DNA, 20 bp, Artificial Sequence
  chemically synthesized
cactttgggaggctgcactt

SEQ ID NO: 414059 - DNA, 20 bp, Artificial Sequence
  chemically synthesized
tcccaaagtgcagcctccca

SEQ ID NO: 414060 - DNA, 20 bp, Artificial Sequence
  chemically synthesized
tgtaatccaagcactttggg

SEQ ID NO: 414061 - DNA, 20 bp, Artificial Sequence
  chemically synthesized
ttgtaatccaagcactttgg

SEQ ID NO: 414062 - DNA, 20 bp, Artificial Sequence
  chemically synthesized
gcttgtaatccaagcacttt

SEQ ID NO: 414063 - DNA, 20 bp, Artificial Sequence
  chemically synthesized
gtgcagcctcccaaagtgct

SEQ ID NO: 414064 - DNA, 20 bp, Artificial Sequence
  chemically synthesized
tgcttgtaatccaagcactt

SEQ ID NO: 414065 - DNA, 20 bp, Artificial Sequence
  chemically synthesized
tcccaaagtgcttggattac

SEQ ID NO: 414066 - DNA, 20 bp, Artificial Sequence
  chemically synthesized
gtggctcgtgcttgtaatcc

SEQ ID NO: 414067 - DNA, 20 bp, Artificial Sequence
  chemically synthesized
agtgcttggattacaagcac

SEQ ID NO: 414068 - DNA, 20 bp, Artificial Sequence
  chemically synthesized
tggattacaagcacgagcca

SEQ ID NO: 414069 - DNA, 20 bp, Artificial Sequence
  chemically synthesized
caagcacgagccacggcacc

SEQ ID NO: 414070 - DNA, 20 bp, Artificial Sequence
  chemically synthesized
cagggtatggccgggtgccg

SEQ ID NO: 414071 - DNA, 20 bp, Artificial Sequence
  chemically synthesized
atgaaatgcagggtatggcc

SEQ ID NO: 414072 - DNA, 20 bp, Artificial Sequence
  chemically synthesized
aatgaaatgcagggtatggc

SEQ ID NO: 414073 - DNA, 20 bp, Artificial Sequence
  chemically synthesized
ttgcaatgaaatgcagggta

SEQ ID NO: 414074 - DNA, 20 bp, Artificial Sequence
  chemically synthesized
ttgccttgcaatgaaatgca

SEQ ID NO: 414075 - DNA, 20 bp, Artificial Sequence
  chemically synthesized
gttgccttgcaatgaaatgc

SEQ ID NO: 414076 - DNA, 20 bp, Artificial Sequence
  chemically synthesized
ggttgccttgcaatgaaatg

SEQ ID NO: 414077 - DNA, 20 bp, Artificial Sequence
  chemically synthesized
cataccctgcatttcattgc

SEQ ID NO: 414078 - DNA, 20 bp, Artificial Sequence
  chemically synthesized
ataccctgcatttcattgca

SEQ ID NO: 414079 - DNA, 20 bp, Artificial Sequence
  chemically synthesized
tttcattgcaaggcaaccca

SEQ ID NO: 414080 - DNA, 20 bp, Artificial Sequence
  chemically synthesized
aaaatgggctgattgacttt

SEQ ID NO: 414081 - DNA, 20 bp, Artificial Sequence
  chemically synthesized
caaaatgggctgattgactt

SEQ ID NO: 414082 - DNA, 20 bp, Artificial Sequence
  chemically synthesized
caaggcaacccaaagtcaat

SEQ ID NO: 414083 - DNA, 20 bp, Artificial Sequence
  chemically synthesized
ggacgggctgattacaaaat

SEQ ID NO: 414084 - DNA, 20 bp, Artificial Sequence
  chemically synthesized
aggacgggctgattacaaaa

SEQ ID NO: 414085 - DNA, 20 bp, Artificial Sequence
  chemically synthesized
caatcagcccattttgtaat

SEQ ID NO: 414086 - DNA, 20 bp, Artificial Sequence
  chemically synthesized
atcagactcccatgaaggac

SEQ ID NO: 414087 - DNA, 20 bp, Artificial Sequence
  chemically synthesized
tgtaatcagcccgtccttca

SEQ ID NO: 414088 - DNA, 20 bp, Artificial Sequence
  chemically synthesized
gatcagactcccatgaagga

SEQ ID NO: 414089 - DNA, 20 bp, Artificial Sequence
  chemically synthesized
gtaatcagcccgtccttcat

SEQ ID NO: 414090 - DNA, 20 bp, Artificial Sequence
  chemically synthesized
aatcagcccgtccttcatgg

SEQ ID NO: 414091 - DNA, 20 bp, Artificial Sequence
  chemically synthesized
gggagatcagactcccatga

SEQ ID NO: 414092 - DNA, 20 bp, Artificial Sequence
  chemically synthesized
tgggagatcagactcccatg

SEQ ID NO: 414093 - DNA, 20 bp, Artificial Sequence
  chemically synthesized
ttcatgggagtctgatctcc

SEQ ID NO: 414094 - DNA, 20 bp, Artificial Sequence
  chemically synthesized
ctcaccctccactgggagat

SEQ ID NO: 414095 - DNA, 20 bp, Artificial Sequence
  chemically synthesized
atgggagtctgatctcccag

SEQ ID NO: 414096 - DNA, 20 bp, Artificial Sequence
  chemically synthesized
gggagtctgatctcccagtg

SEQ ID NO: 414097 - DNA, 20 bp, Artificial Sequence
  chemically synthesized
ggagtctgatctcccagtgg

SEQ ID NO: 414098 - DNA, 20 bp, Artificial Sequence
  chemically synthesized
cattcctcaccctccactgg

SEQ ID NO: 414099 - DNA, 20 bp, Artificial Sequence
  chemically synthesized
gagtctgatctcccagtgga

SEQ ID NO: 414100 - DNA, 20 bp, Artificial Sequence
  chemically synthesized
aacattcctcaccctccact

SEQ ID NO: 414101 - DNA, 20 bp, Artificial Sequence
  chemically synthesized
aaacattcctcaccctccac

SEQ ID NO: 414102 - DNA, 20 bp, Artificial Sequence
  chemically synthesized
ctgatctcccagtggagggt

SEQ ID NO: 414103 - DNA, 20 bp, Artificial Sequence
  chemically synthesized
tgatctcccagtggagggtg

SEQ ID NO: 414104 - DNA, 20 bp, Artificial Sequence
  chemically synthesized
aggaatgtttccttatcttc

SEQ ID NO: 414105 - DNA, 20 bp, Artificial Sequence
  chemically synthesized
ttttggtcacccggaagata

SEQ ID NO: 414106 - DNA, 20 bp, Artificial Sequence
  chemically synthesized
ggaatgtttccttatcttcc

SEQ ID NO: 414107 - DNA, 20 bp, Artificial Sequence
  chemically synthesized
cttttggtcacccggaagat

SEQ ID NO: 414108 - DNA, 20 bp, Artificial Sequence
  chemically synthesized
gcatgcttttggtcacccgg

SEQ ID NO: 414109 - DNA, 20 bp, Artificial Sequence
  chemically synthesized
gaagcatgcttttggtcacc

SEQ ID NO: 414110 - DNA, 20 bp, Artificial Sequence
  chemically synthesized
cttatcttccgggtgaccaa

SEQ ID NO: 414111 - DNA, 20 bp, Artificial Sequence
  chemically synthesized
gatccagagaagcatgcttt

SEQ ID NO: 414112 - DNA, 20 bp, Artificial Sequence
  chemically synthesized
tgaccaaaagcatgcttctc

SEQ ID NO: 414113 - DNA, 20 bp, Artificial Sequence
  chemically synthesized
ttgcacacttggatccagag

SEQ ID NO: 414114 - DNA, 20 bp, Artificial Sequence
  chemically synthesized
aagcatgcttctctggatcc

SEQ ID NO: 414115 - DNA, 20 bp, Artificial Sequence
  chemically synthesized
tctttgcacacttggatcca

SEQ ID NO: 414116 - DNA, 20 bp, Artificial Sequence
  chemically synthesized
actctttgcacacttggatc

SEQ ID NO: 414117 - DNA, 20 bp, Artificial Sequence
  chemically synthesized
tacttgactctttgcacact

SEQ ID NO: 414118 - DNA, 20 bp, Artificial Sequence
  chemically synthesized
tctctggatccaagtgtgca

SEQ ID NO: 414119 - DNA, 20 bp, Artificial Sequence
  chemically synthesized
tctggatccaagtgtgcaaa

SEQ ID NO: 414120 - DNA, 20 bp, Artificial Sequence
  chemically synthesized
atccaagtgtgcaaagagtc

SEQ ID NO: 414121 - DNA, 20 bp, Artificial Sequence
  chemically synthesized
tggctaatggtagttataca

SEQ ID NO: 414122 - DNA, 20 bp, Artificial Sequence
  chemically synthesized
atggctaatggtagttatac

SEQ ID NO: 414123 - DNA, 20 bp, Artificial Sequence
  chemically synthesized
gatggctaatggtagttata

SEQ ID NO: 414124 - DNA, 20 bp, Artificial Sequence
  chemically synthesized
tatccctgtataactaccat

SEQ ID NO: 414125 - DNA, 20 bp, Artificial Sequence
  chemically synthesized
ctttaagggatggctaatgg

SEQ ID NO: 414126 - DNA, 20 bp, Artificial Sequence
  chemically synthesized
atactttaagggatggctaa

SEQ ID NO: 414127 - DNA, 20 bp, Artificial Sequence
  chemically synthesized
ctaccattagccatccctta

SEQ ID NO: 414128 - DNA, 20 bp, Artificial Sequence
  chemically synthesized
aggaaatatactttaaggga

SEQ ID NO: 414129 - DNA, 20 bp, Artificial Sequence
  chemically synthesized
agataggaaatatactttaa

SEQ ID NO: 414130 - DNA, 20 bp, Artificial Sequence
  chemically synthesized
tagataggaaatatacttta

SEQ ID NO: 414131 - DNA, 20 bp, Artificial Sequence
  chemically synthesized
ctagataggaaatatacttt

SEQ ID NO: 414132 - DNA, 20 bp, Artificial Sequence
  chemically synthesized
cttaaagtatatttcctatc

SEQ ID NO: 414133 - DNA, 20 bp, Artificial Sequence
  chemically synthesized
ttagtgtgtaataactagat

SEQ ID NO: 414134 - DNA, 20 bp, Artificial Sequence
  chemically synthesized
tttagtgtgtaataactaga

SEQ ID NO: 414135 - DNA, 20 bp, Artificial Sequence
  chemically synthesized
gagctttagtgtgtaataac

SEQ ID NO: 414136 - DNA, 20 bp, Artificial Sequence
  chemically synthesized
tatctagttattacacacta

SEQ ID NO: 414137 - DNA, 20 bp, Artificial Sequence
  chemically synthesized
ttcacattatgagggagctt

SEQ ID NO: 414138 - DNA, 20 bp, Artificial Sequence
  chemically synthesized
aattacttcacattatgagg

SEQ ID NO: 414139 - DNA, 20 bp, Artificial Sequence
  chemically synthesized
gaaattacttcacattatga

SEQ ID NO: 414140 - DNA, 20 bp, Artificial Sequence
  chemically synthesized
agaaattacttcacattatg

SEQ ID NO: 414141 - DNA, 20 bp, Artificial Sequence
  chemically synthesized
cagaaattacttcacattat

SEQ ID NO: 414142 - DNA, 20 bp, Artificial Sequence
  chemically synthesized
taaagctccctcataatgtg

SEQ ID NO: 414143 - DNA, 20 bp, Artificial Sequence
  chemically synthesized
gttttgagttttggggatat

SEQ ID NO: 414144 - DNA, 20 bp, Artificial Sequence
  chemically synthesized
tctgatggttttgagttttg

SEQ ID NO: 414145 - DNA, 20 bp, Artificial Sequence
  chemically synthesized
atctgatggttttgagtttt

SEQ ID NO: 414146 - DNA, 20 bp, Artificial Sequence
  chemically synthesized
tatctgatggttttgagttt

SEQ ID NO: 414147 - DNA, 20 bp, Artificial Sequence
  chemically synthesized
ttgtgttatctgatggtttt

SEQ ID NO: 414148 - DNA, 20 bp, Artificial Sequence
  chemically synthesized
tccccaaaactcaaaaccat

SEQ ID NO: 414149 - DNA, 20 bp, Artificial Sequence
  chemically synthesized
tttttcattgtgttatctga

SEQ ID NO: 414150 - DNA, 20 bp, Artificial Sequence
  chemically synthesized
tcagataacacaatgaaaaa

SEQ ID NO: 414151 - DNA, 20 bp, Artificial Sequence
  chemically synthesized
agataacacaatgaaaaaca

SEQ ID NO: 414152 - DNA, 20 bp, Artificial Sequence
  chemically synthesized
taacacaatgaaaaacagag

SEQ ID NO: 414153 - DNA, 20 bp, Artificial Sequence
  chemically synthesized
acacaatgaaaaacagagca

SEQ ID NO: 414154 - DNA, 20 bp, Artificial Sequence
  chemically synthesized
agagcagagtctttgatttt

SEQ ID NO: 414155 - DNA, 20 bp, Artificial Sequence
  chemically synthesized
atggatccctctcaaaatca

SEQ ID NO: 414156 - DNA, 20 bp, Artificial Sequence
  chemically synthesized
agcagagtctttgattttga

SEQ ID NO: 414157 - DNA, 20 bp, Artificial Sequence
  chemically synthesized
gcagagtctttgattttgag

SEQ ID NO: 414158 - DNA, 20 bp, Artificial Sequence
  chemically synthesized
cagagtctttgattttgaga

SEQ ID NO: 414159 - DNA, 20 bp, Artificial Sequence
  chemically synthesized
ccccaggaattaaaaacaga

SEQ ID NO: 414160 - DNA, 20 bp, Artificial Sequence
  chemically synthesized
gaaaccccaggaattaaaaa

SEQ ID NO: 414161 - DNA, 20 bp, Artificial Sequence
  chemically synthesized
atccatctgtttttaattcc

SEQ ID NO: 414162 - DNA, 20 bp, Artificial Sequence
  chemically synthesized
tccatctgtttttaattcct

SEQ ID NO: 414163 - DNA, 20 bp, Artificial Sequence
  chemically synthesized
ccatctgtttttaattcctg

SEQ ID NO: 414164 - DNA, 20 bp, Artificial Sequence
  chemically synthesized
tgttttccacatgaaacccc

SEQ ID NO: 414165 - DNA, 20 bp, Artificial Sequence
  chemically synthesized
ctgttttccacatgaaaccc

SEQ ID NO: 414166 - DNA, 20 bp, Artificial Sequence
  chemically synthesized
ttaattcctggggtttcatg

SEQ ID NO: 414167 - DNA, 20 bp, Artificial Sequence
  chemically synthesized
ctggggtttcatgtggaaaa

SEQ ID NO: 414168 - DNA, 20 bp, Artificial Sequence
  chemically synthesized
ttttttttttttccctaaaa

SEQ ID NO: 414169 - DNA, 20 bp, Artificial Sequence
  chemically synthesized
tttttttttttccctaaaac

SEQ ID NO: 414170 - DNA, 20 bp, Artificial Sequence
  chemically synthesized
gcaccacagaacccgtttta

SEQ ID NO: 414171 - DNA, 20 bp, Artificial Sequence
  chemically synthesized
ggcaccacagaacccgtttt

SEQ ID NO: 414172 - DNA, 20 bp, Artificial Sequence
  chemically synthesized
aggcaccacagaacccgttt

SEQ ID NO: 414173 - DNA, 20 bp, Artificial Sequence
  chemically synthesized
tttccctaaaacgggttctg

SEQ ID NO: 414174 - DNA, 20 bp, Artificial Sequence
  chemically synthesized
gaaaaacagaggaggcacca

SEQ ID NO: 414175 - DNA, 20 bp, Artificial Sequence
  chemically synthesized
ctcattgggaaaaacagagg

SEQ ID NO: 414176 - DNA, 20 bp, Artificial Sequence
  chemically synthesized
actcattgggaaaaacagag

SEQ ID NO: 414177 - DNA, 20 bp, Artificial Sequence
  chemically synthesized
ggactcattgggaaaaacag

SEQ ID NO: 414178 - DNA, 20 bp, Artificial Sequence
  chemically synthesized
gggactcattgggaaaaaca

SEQ ID NO: 414179 - DNA, 20 bp, Artificial Sequence
  chemically synthesized
ctgggactcattgggaaaaa

SEQ ID NO: 414180 - DNA, 20 bp, Artificial Sequence
  chemically synthesized
cctcctctgtttttcccaat

SEQ ID NO: 414181 - DNA, 20 bp, Artificial Sequence
  chemically synthesized
ctggtagcctgggactcatt

SEQ ID NO: 414182 - DNA, 20 bp, Artificial Sequence
  chemically synthesized
tctggtagcctgggactcat

SEQ ID NO: 414183 - DNA, 20 bp, Artificial Sequence
  chemically synthesized
ctgtttttcccaatgagtcc

SEQ ID NO: 414184 - DNA, 20 bp, Artificial Sequence
  chemically synthesized
tgtttttcccaatgagtccc

SEQ ID NO: 414185 - DNA, 20 bp, Artificial Sequence
  chemically synthesized
cccaatgagtcccaggctac

SEQ ID NO: 414186 - DNA, 20 bp, Artificial Sequence
  chemically synthesized
aagataacttctggtagcct

SEQ ID NO: 414187 - DNA, 20 bp, Artificial Sequence
  chemically synthesized
taagataacttctggtagcc

SEQ ID NO: 414188 - DNA, 20 bp, Artificial Sequence
  chemically synthesized
aatgagtcccaggctaccag

SEQ ID NO: 414189 - DNA, 20 bp, Artificial Sequence
  chemically synthesized
gtccctaagataacttctgg

SEQ ID NO: 414190 - DNA, 20 bp, Artificial Sequence
  chemically synthesized
tgagtccctaagataacttc

SEQ ID NO: 414191 - DNA, 20 bp, Artificial Sequence
  chemically synthesized
caggctaccagaagttatct

SEQ ID NO: 414192 - DNA, 20 bp, Artificial Sequence
  chemically synthesized
aggctaccagaagttatctt

SEQ ID NO: 414193 - DNA, 20 bp, Artificial Sequence
  chemically synthesized
ggctaccagaagttatctta

SEQ ID NO: 414194 - DNA, 20 bp, Artificial Sequence
  chemically synthesized
taacgcacacgtgagtccct

SEQ ID NO: 414195 - DNA, 20 bp, Artificial Sequence
  chemically synthesized
gccactcttaacgcacacgt

SEQ ID NO: 414196 - DNA, 20 bp, Artificial Sequence
  chemically synthesized
tagggactcacgtgtgcgtt

SEQ ID NO: 414197 - DNA, 20 bp, Artificial Sequence
  chemically synthesized
gggactcacgtgtgcgttaa

SEQ ID NO: 414198 - DNA, 20 bp, Artificial Sequence
  chemically synthesized
actcacgtgtgcgttaagag

SEQ ID NO: 414199 - DNA, 20 bp, Artificial Sequence
  chemically synthesized
acgtgtgcgttaagagtggc

SEQ ID NO: 414200 - DNA, 20 bp, Artificial Sequence
  chemically synthesized
gcaagacaaaaaaattaaaa

SEQ ID NO: 414201 - DNA, 20 bp, Artificial Sequence
  chemically synthesized
aagacaaaaaaattaaaaaa

SEQ ID NO: 414202 - DNA, 20 bp, Artificial Sequence
  chemically synthesized
aattaaaaaagagaaaaaaa

SEQ ID NO: 414203 - DNA, 20 bp, Artificial Sequence
  chemically synthesized
ttaaaaaagagaaaaaaatg

SEQ ID NO: 414204 - DNA, 20 bp, Artificial Sequence
  chemically synthesized
aaaaatggagaaaaataatt

SEQ ID NO: 414205 - DNA, 20 bp, Artificial Sequence
  chemically synthesized
atggagaaaaataattcagt

SEQ ID NO: 414206 - DNA, 20 bp, Artificial Sequence
  chemically synthesized
gaaaaataattcagtcggct

SEQ ID NO: 414207 - DNA, 20 bp, Artificial Sequence
  chemically synthesized
aaataattcagtcggctgag

SEQ ID NO: 414208 - DNA, 20 bp, Artificial Sequence
  chemically synthesized
tggaaaaagttttttcttct

SEQ ID NO: 414209 - DNA, 20 bp, Artificial Sequence
  chemically synthesized
ggaacttgtttttttggaaa

SEQ ID NO: 414210 - DNA, 20 bp, Artificial Sequence
  chemically synthesized
aaaactttttccaaaaaaac

SEQ ID NO: 414211 - DNA, 20 bp, Artificial Sequence
  chemically synthesized
cttcttggaacttgtttttt

SEQ ID NO: 414212 - DNA, 20 bp, Artificial Sequence
  chemically synthesized
tttccaaaaaaacaagttcc

SEQ ID NO: 414213 - DNA, 20 bp, Artificial Sequence
  chemically synthesized
ccaaaaaaacaagttccaag

SEQ ID NO: 414214 - DNA, 20 bp, Artificial Sequence
  chemically synthesized
aaaaaaacaagttccaagaa

SEQ ID NO: 414215 - DNA, 20 bp, Artificial Sequence
  chemically synthesized
cctttatgtttttctcttct

SEQ ID NO: 414216 - DNA, 20 bp, Artificial Sequence
  chemically synthesized
tccaagaagagaaaaacata

SEQ ID NO: 414217 - DNA, 20 bp, Artificial Sequence
  chemically synthesized
ccaagaagagaaaaacataa

SEQ ID NO: 414218 - DNA, 20 bp, Artificial Sequence
  chemically synthesized
aagctatagatatatttaaa

SEQ ID NO: 414219 - DNA, 20 bp, Artificial Sequence
  chemically synthesized
caagctatagatatatttaa

SEQ ID NO: 414220 - DNA, 20 bp, Artificial Sequence
  chemically synthesized
aggccttttaaatatatcta

SEQ ID NO: 414221 - DNA, 20 bp, Artificial Sequence
  chemically synthesized
aagagtggataaacaagcta

SEQ ID NO: 414222 - DNA, 20 bp, Artificial Sequence
  chemically synthesized
ttaattaagagtggataaac

SEQ ID NO: 414223 - DNA, 20 bp, Artificial Sequence
  chemically synthesized
aaagtcagcttaattaagag

SEQ ID NO: 414224 - DNA, 20 bp, Artificial Sequence
  chemically synthesized
ttgtttatccactcttaatt

SEQ ID NO: 414225 - DNA, 20 bp, Artificial Sequence
  chemically synthesized
ttaaaagtcagcttaattaa

SEQ ID NO: 414226 - DNA, 20 bp, Artificial Sequence
  chemically synthesized
ggttaaaagtcagcttaatt

SEQ ID NO: 414227 - DNA, 20 bp, Artificial Sequence
  chemically synthesized
agagcactatggttaaaagt

SEQ ID NO: 414228 - DNA, 20 bp, Artificial Sequence
  chemically synthesized
attaagctgacttttaacca

SEQ ID NO: 414229 - DNA, 20 bp, Artificial Sequence
  chemically synthesized
ttaaagagcactatggttaa

SEQ ID NO: 414230 - DNA, 20 bp, Artificial Sequence
  chemically synthesized
ttcttttttaaagagcacta

SEQ ID NO: 414231 - DNA, 20 bp, Artificial Sequence
  chemically synthesized
aaccatagtgctctttaaaa

SEQ ID NO: 414232 - DNA, 20 bp, Artificial Sequence
  chemically synthesized
aaaagaatttcttttttaaa

SEQ ID NO: 414233 - DNA, 20 bp, Artificial Sequence
  chemically synthesized
ctaaaagaatttctttttta

SEQ ID NO: 414234 - DNA, 20 bp, Artificial Sequence
  chemically synthesized
ctttaaaaaagaaattcttt

SEQ ID NO: 414235 - DNA, 20 bp, Artificial Sequence
  chemically synthesized
ttaggtaataagagatctaa

SEQ ID NO: 414236 - DNA, 20 bp, Artificial Sequence
  chemically synthesized
tggctaaaattaggtaataa

SEQ ID NO: 414237 - DNA, 20 bp, Artificial Sequence
  chemically synthesized
catggctaaaattaggtaat

SEQ ID NO: 414238 - DNA, 20 bp, Artificial Sequence
  chemically synthesized
gatctcttattacctaattt

SEQ ID NO: 414239 - DNA, 20 bp, Artificial Sequence
  chemically synthesized
cacttggcatggctaaaatt

SEQ ID NO: 414240 - DNA, 20 bp, Artificial Sequence
  chemically synthesized
ccacttggcatggctaaaat

SEQ ID NO: 414241 - DNA, 20 bp, Artificial Sequence
  chemically synthesized
tacctaattttagccatgcc

SEQ ID NO: 414242 - DNA, 20 bp, Artificial Sequence
  chemically synthesized
ctaattttagccatgccaag

SEQ ID NO: 414243 - DNA, 20 bp, Artificial Sequence
  chemically synthesized
aaaatattgtccacttggca

SEQ ID NO: 414244 - DNA, 20 bp, Artificial Sequence
  chemically synthesized
agctaaaaatattgtccact

SEQ ID NO: 414245 - DNA, 20 bp, Artificial Sequence
  chemically synthesized
tgccaagtggacaatatttt

SEQ ID NO: 414246 - DNA, 20 bp, Artificial Sequence
  chemically synthesized
tttcctttggtaaagttcag

SEQ ID NO: 414247 - DNA, 20 bp, Artificial Sequence
  chemically synthesized
aggtttcctttggtaaagtt

SEQ ID NO: 414248 - DNA, 20 bp, Artificial Sequence
  chemically synthesized
ttagcttctgaactttacca

SEQ ID NO: 414249 - DNA, 20 bp, Artificial Sequence
  chemically synthesized
tagcttctgaactttaccaa

SEQ ID NO: 414250 - DNA, 20 bp, Artificial Sequence
  chemically synthesized
ctaggaggtttcctttggta

SEQ ID NO: 414251 - DNA, 20 bp, Artificial Sequence
  chemically synthesized
agcacctaggaggtttcctt

SEQ ID NO: 414252 - DNA, 20 bp, Artificial Sequence
  chemically synthesized
ctttaccaaaggaaacctcc

SEQ ID NO: 414253 - DNA, 20 bp, Artificial Sequence
  chemically synthesized
tttaccaaaggaaacctcct

SEQ ID NO: 414254 - DNA, 20 bp, Artificial Sequence
  chemically synthesized
atgtctttgcagcacctagg

SEQ ID NO: 414255 - DNA, 20 bp, Artificial Sequence
  chemically synthesized
tatgtctttgcagcacctag

SEQ ID NO: 414256 - DNA, 20 bp, Artificial Sequence
  chemically synthesized
actatgtctttgcagcacct

SEQ ID NO: 414257 - DNA, 20 bp, Artificial Sequence
  chemically synthesized
tactatgtctttgcagcacc

SEQ ID NO: 414258 - DNA, 20 bp, Artificial Sequence
  chemically synthesized
gaaacctcctaggtgctgca

SEQ ID NO: 414259 - DNA, 20 bp, Artificial Sequence
  chemically synthesized
aacttcttactatgtctttg

SEQ ID NO: 414260 - DNA, 20 bp, Artificial Sequence
  chemically synthesized
tcctaggtgctgcaaagaca

SEQ ID NO: 414261 - DNA, 20 bp, Artificial Sequence
  chemically synthesized
aggtgctgcaaagacatagt

SEQ ID NO: 414262 - DNA, 20 bp, Artificial Sequence
  chemically synthesized
tgctgcaaagacatagtaag

SEQ ID NO: 414263 - DNA, 20 bp, Artificial Sequence
  chemically synthesized
agtaagaagtttctttttac

SEQ ID NO: 414264 - DNA, 20 bp, Artificial Sequence
  chemically synthesized
gagattctaaatcttgtaaa

SEQ ID NO: 414265 - DNA, 20 bp, Artificial Sequence
  chemically synthesized
aagtttctttttacaagatt

SEQ ID NO: 414266 - DNA, 20 bp, Artificial Sequence
  chemically synthesized
acaagatttagaatctccac

SEQ ID NO: 414267 - DNA, 20 bp, Artificial Sequence
  chemically synthesized
caagatttagaatctccaca

SEQ ID NO: 414268 - DNA, 20 bp, Artificial Sequence
  chemically synthesized
gatttagaatctccacaagg

SEQ ID NO: 414269 - DNA, 20 bp, Artificial Sequence
  chemically synthesized
tttctctggactaccttgtg

SEQ ID NO: 414270 - DNA, 20 bp, Artificial Sequence
  chemically synthesized
cctttctctggactaccttg

SEQ ID NO: 414271 - DNA, 20 bp, Artificial Sequence
  chemically synthesized
agaatctccacaaggtagtc

SEQ ID NO: 414272 - DNA, 20 bp, Artificial Sequence
  chemically synthesized
aatctccacaaggtagtcca

SEQ ID NO: 414273 - DNA, 20 bp, Artificial Sequence
  chemically synthesized
tccacaaggtagtccagaga

SEQ ID NO: 414274 - DNA, 20 bp, Artificial Sequence
  chemically synthesized
ccacaaggtagtccagagaa

SEQ ID NO: 414275 - DNA, 20 bp, Artificial Sequence
  chemically synthesized
ctcttgaattttcctttctc

SEQ ID NO: 414276 - DNA, 20 bp, Artificial Sequence
  chemically synthesized
gtccagagaaaggaaaattc

SEQ ID NO: 414277 - DNA, 20 bp, Artificial Sequence
  chemically synthesized
ccagagaaaggaaaattcaa

SEQ ID NO: 414278 - DNA, 20 bp, Artificial Sequence
  chemically synthesized
agagaaaggaaaattcaaga

SEQ ID NO: 414279 - DNA, 20 bp, Artificial Sequence
  chemically synthesized
gagaaaggaaaattcaagag

SEQ ID NO: 414280 - DNA, 20 bp, Artificial Sequence
  chemically synthesized
gaaaattcaagagaggaaat

SEQ ID NO: 414281 - DNA, 20 bp, Artificial Sequence
  chemically synthesized
ttcaagagaggaaatcagaa

SEQ ID NO: 414282 - DNA, 20 bp, Artificial Sequence
  chemically synthesized
cagaaaagaaacttaataaa

SEQ ID NO: 414283 - DNA, 20 bp, Artificial Sequence
  chemically synthesized
gtgtagctttgccatttatt

SEQ ID NO: 414284 - DNA, 20 bp, Artificial Sequence
  chemically synthesized
aagaaacttaataaatggca

SEQ ID NO: 414285 - DNA, 20 bp, Artificial Sequence
  chemically synthesized
tttctgatttgttatttgtg

SEQ ID NO: 414286 - DNA, 20 bp, Artificial Sequence
  chemically synthesized
aagctacacaaataacaaat

SEQ ID NO: 414287 - DNA, 20 bp, Artificial Sequence
  chemically synthesized
tacacaaataacaaatcaga

SEQ ID NO: 414288 - DNA, 20 bp, Artificial Sequence
  chemically synthesized
acacaaataacaaatcagaa

SEQ ID NO: 414289 - DNA, 20 bp, Artificial Sequence
  chemically synthesized
aaatcagaaaggaatcattc

SEQ ID NO: 414290 - DNA, 20 bp, Artificial Sequence
  chemically synthesized
tcagaaaggaatcattccag

SEQ ID NO: 414291 - DNA, 20 bp, Artificial Sequence
  chemically synthesized
tgggttcaattgttggcttc

SEQ ID NO: 414292 - DNA, 20 bp, Artificial Sequence
  chemically synthesized
ggtggcctgggttcaattgt

SEQ ID NO: 414293 - DNA, 20 bp, Artificial Sequence
  chemically synthesized
cagaagccaacaattgaacc

SEQ ID NO: 414294 - DNA, 20 bp, Artificial Sequence
  chemically synthesized
agaagccaacaattgaaccc

SEQ ID NO: 414295 - DNA, 20 bp, Artificial Sequence
  chemically synthesized
tcttttgacagtggtggcct

SEQ ID NO: 414296 - DNA, 20 bp, Artificial Sequence
  chemically synthesized
gtcttttgacagtggtggcc

SEQ ID NO: 414297 - DNA, 20 bp, Artificial Sequence
  chemically synthesized
gctttgtcttttgacagtgg

SEQ ID NO: 414298 - DNA, 20 bp, Artificial Sequence
  chemically synthesized
acccaggccaccactgtcaa

SEQ ID NO: 414299 - DNA, 20 bp, Artificial Sequence
  chemically synthesized
aaggctttgtcttttgacag

SEQ ID NO: 414300 - DNA, 20 bp, Artificial Sequence
  chemically synthesized
gctaaggctttgtcttttga

SEQ ID NO: 414301 - DNA, 20 bp, Artificial Sequence
  chemically synthesized
gccaccactgtcaaaagaca

SEQ ID NO: 414302 - DNA, 20 bp, Artificial Sequence
  chemically synthesized
actgtcaaaagacaaagcct

SEQ ID NO: 414303 - DNA, 20 bp, Artificial Sequence
  chemically synthesized
tgtatatagctcagtagcta

SEQ ID NO: 414304 - DNA, 20 bp, Artificial Sequence
  chemically synthesized
aagacaaagccttagctact

SEQ ID NO: 414305 - DNA, 20 bp, Artificial Sequence
  chemically synthesized
ctgtatatagctcagtagct

SEQ ID NO: 414306 - DNA, 20 bp, Artificial Sequence
  chemically synthesized
caacgctgtatatagctcag

SEQ ID NO: 414307 - DNA, 20 bp, Artificial Sequence
  chemically synthesized
tctcaacgctgtatatagct

SEQ ID NO: 414308 - DNA, 20 bp, Artificial Sequence
  chemically synthesized
cttagctactgagctatata

SEQ ID NO: 414309 - DNA, 20 bp, Artificial Sequence
  chemically synthesized
aaatttctcaacgctgtata

SEQ ID NO: 414310 - DNA, 20 bp, Artificial Sequence
  chemically synthesized
actgagctatatacagcgtt

SEQ ID NO: 414311 - DNA, 20 bp, Artificial Sequence
  chemically synthesized
gctccttctgggaaaagcag

SEQ ID NO: 414312 - DNA, 20 bp, Artificial Sequence
  chemically synthesized
gaaatttctactgcttttcc

SEQ ID NO: 414313 - DNA, 20 bp, Artificial Sequence
  chemically synthesized
taggctccttctgggaaaag

SEQ ID NO: 414314 - DNA, 20 bp, Artificial Sequence
  chemically synthesized
atttctactgcttttcccag

SEQ ID NO: 414315 - DNA, 20 bp, Artificial Sequence
  chemically synthesized
ctctaggctccttctgggaa

SEQ ID NO: 414316 - DNA, 20 bp, Artificial Sequence
  chemically synthesized
tttctactgcttttcccaga

SEQ ID NO: 414317 - DNA, 20 bp, Artificial Sequence
  chemically synthesized
tctactgcttttcccagaag

SEQ ID NO: 414318 - DNA, 20 bp, Artificial Sequence
  chemically synthesized
ggcttctctaggctccttct

SEQ ID NO: 414319 - DNA, 20 bp, Artificial Sequence
  chemically synthesized
tggcttctctaggctccttc

SEQ ID NO: 414320 - DNA, 20 bp, Artificial Sequence
  chemically synthesized
tgcttttcccagaaggagcc

SEQ ID NO: 414321 - DNA, 20 bp, Artificial Sequence
  chemically synthesized
cttttcccagaaggagccta

SEQ ID NO: 414322 - DNA, 20 bp, Artificial Sequence
  chemically synthesized
ttcccagaaggagcctagag

SEQ ID NO: 414323 - DNA, 20 bp, Artificial Sequence
  chemically synthesized
agcctgaaactggcttctct

SEQ ID NO: 414324 - DNA, 20 bp, Artificial Sequence
  chemically synthesized
cagaaggagcctagagaagc

SEQ ID NO: 414325 - DNA, 20 bp, Artificial Sequence
  chemically synthesized
aagcctgaaactggcttctc

SEQ ID NO: 414326 - DNA, 20 bp, Artificial Sequence
  chemically synthesized
gagcctagagaagccagttt

SEQ ID NO: 414327 - DNA, 20 bp, Artificial Sequence
  chemically synthesized
agcctagagaagccagtttc

SEQ ID NO: 414328 - DNA, 20 bp, Artificial Sequence
  chemically synthesized
aagccttgcaagcctgaaac

SEQ ID NO: 414329 - DNA, 20 bp, Artificial Sequence
  chemically synthesized
gaagccagtttcaggcttgc

SEQ ID NO: 414330 - DNA, 20 bp, Artificial Sequence
  chemically synthesized
aagccagtttcaggcttgca

SEQ ID NO: 414331 - DNA, 20 bp, Artificial Sequence
  chemically synthesized
tgagcagttaaaagccttgc

SEQ ID NO: 414332 - DNA, 20 bp, Artificial Sequence
  chemically synthesized
gatttttcttgagcagttaa

SEQ ID NO: 414333 - DNA, 20 bp, Artificial Sequence
  chemically synthesized
tgcaaggcttttaactgctc

SEQ ID NO: 414334 - DNA, 20 bp, Artificial Sequence
  chemically synthesized
ctcctaagatttttcttgag

SEQ ID NO: 414335 - DNA, 20 bp, Artificial Sequence
  chemically synthesized
ttactcctaagatttttctt

SEQ ID NO: 414336 - DNA, 20 bp, Artificial Sequence
  chemically synthesized
taactgctcaagaaaaatct

SEQ ID NO: 414337 - DNA, 20 bp, Artificial Sequence
  chemically synthesized
aactgctcaagaaaaatctt

SEQ ID NO: 414338 - DNA, 20 bp, Artificial Sequence
  chemically synthesized
ctgctcaagaaaaatcttag

SEQ ID NO: 414339 - DNA, 20 bp, Artificial Sequence
  chemically synthesized
ttcatgtcatagttactcct

SEQ ID NO: 414340 - DNA, 20 bp, Artificial Sequence
  chemically synthesized
gaattttggggttcatgtca

SEQ ID NO: 414341 - DNA, 20 bp, Artificial Sequence
  chemically synthesized
tccagaggacaggaattttg

SEQ ID NO: 414342 - DNA, 20 bp, Artificial Sequence
  chemically synthesized
atccagaggacaggaatttt

SEQ ID NO: 414343 - DNA, 20 bp, Artificial Sequence
  chemically synthesized
catccagaggacaggaattt

SEQ ID NO: 414344 - DNA, 20 bp, Artificial Sequence
  chemically synthesized
accccaaaattcctgtcctc

SEQ ID NO: 414345 - DNA, 20 bp, Artificial Sequence
  chemically synthesized
gtttctaccatccagaggac

SEQ ID NO: 414346 - DNA, 20 bp, Artificial Sequence
  chemically synthesized
ggtttctaccatccagagga

SEQ ID NO: 414347 - DNA, 20 bp, Artificial Sequence
  chemically synthesized
caaaattcctgtcctctgga

SEQ ID NO: 414348 - DNA, 20 bp, Artificial Sequence
  chemically synthesized
ttttggtttctaccatccag

SEQ ID NO: 414349 - DNA, 20 bp, Artificial Sequence
  chemically synthesized
aattcctgtcctctggatgg

SEQ ID NO: 414350 - DNA, 20 bp, Artificial Sequence
  chemically synthesized
cttttggtttctaccatcca

SEQ ID NO: 414351 - DNA, 20 bp, Artificial Sequence
  chemically synthesized
ttcttttggtttctaccatc

SEQ ID NO: 414352 - DNA, 20 bp, Artificial Sequence
  chemically synthesized
ctctggatggtagaaaccaa

SEQ ID NO: 414353 - DNA, 20 bp, Artificial Sequence
  chemically synthesized
ggatggtagaaaccaaaaga

SEQ ID NO: 414354 - DNA, 20 bp, Artificial Sequence
  chemically synthesized
catgtggggatactttcttt

SEQ ID NO: 414355 - DNA, 20 bp, Artificial Sequence
  chemically synthesized
caaaagaaagtatccccaca

SEQ ID NO: 414356 - DNA, 20 bp, Artificial Sequence
  chemically synthesized
cttaaccttgtgaccatgtg

SEQ ID NO: 414357 - DNA, 20 bp, Artificial Sequence
  chemically synthesized
gcttaaccttgtgaccatgt

SEQ ID NO: 414358 - DNA, 20 bp, Artificial Sequence
  chemically synthesized
agcttaaccttgtgaccatg

SEQ ID NO: 414359 - DNA, 20 bp, Artificial Sequence
  chemically synthesized
aagtatccccacatggtcac

SEQ ID NO: 414360 - DNA, 20 bp, Artificial Sequence
  chemically synthesized
agtatccccacatggtcaca

SEQ ID NO: 414361 - DNA, 20 bp, Artificial Sequence
  chemically synthesized
ccccacatggtcacaaggtt

SEQ ID NO: 414362 - DNA, 20 bp, Artificial Sequence
  chemically synthesized
ggtcacaaggttaagctctt

SEQ ID NO: 414363 - DNA, 20 bp, Artificial Sequence
  chemically synthesized
gtcacaaggttaagctctta

SEQ ID NO: 414364 - DNA, 20 bp, Artificial Sequence
  chemically synthesized
gtcttgttttgtgtccttaa

SEQ ID NO: 414365 - DNA, 20 bp, Artificial Sequence
  chemically synthesized
ctgtcttgttttgtgtcctt

SEQ ID NO: 414366 - DNA, 20 bp, Artificial Sequence
  chemically synthesized
agctcttaaggacacaaaac

SEQ ID NO: 414367 - DNA, 20 bp, Artificial Sequence
  chemically synthesized
cttaaggacacaaaacaaga

SEQ ID NO: 414368 - DNA, 20 bp, Artificial Sequence
  chemically synthesized
taaggacacaaaacaagaca

SEQ ID NO: 414369 - DNA, 20 bp, Artificial Sequence
  chemically synthesized
aacaagacagagaaatttca

SEQ ID NO: 414370 - DNA, 20 bp, Artificial Sequence
  chemically synthesized
caagacagagaaatttcata

SEQ ID NO: 414371 - DNA, 20 bp, Artificial Sequence
  chemically synthesized
agagaaatttcatagagtat

SEQ ID NO: 414372 - DNA, 20 bp, Artificial Sequence
  chemically synthesized
atttcatagagtattggttt

SEQ ID NO: 414373 - DNA, 20 bp, Artificial Sequence
  chemically synthesized
tttcatagagtattggtttc

SEQ ID NO: 414374 - DNA, 20 bp, Artificial Sequence
  chemically synthesized
ttcatagagtattggtttca

SEQ ID NO: 414375 - DNA, 20 bp, Artificial Sequence
  chemically synthesized
gtattggtttcagggacctg

SEQ ID NO: 414376 - DNA, 20 bp, Artificial Sequence
  chemically synthesized
ggtttcagggacctgtagca

SEQ ID NO: 414377 - DNA, 20 bp, Artificial Sequence
  chemically synthesized
tcagctacaaactttgctac

SEQ ID NO: 414378 - DNA, 20 bp, Artificial Sequence
  chemically synthesized
gtcagctacaaactttgcta

SEQ ID NO: 414379 - DNA, 20 bp, Artificial Sequence
  chemically synthesized
gggacctgtagcaaagtttg

SEQ ID NO: 414380 - DNA, 20 bp, Artificial Sequence
  chemically synthesized
tagcaaagtttgtagctgac

SEQ ID NO: 414381 - DNA, 20 bp, Artificial Sequence
  chemically synthesized
agtcagcttgggaggctggt

SEQ ID NO: 414382 - DNA, 20 bp, Artificial Sequence
  chemically synthesized
ttgtagctgaccagcctccc

SEQ ID NO: 414383 - DNA, 20 bp, Artificial Sequence
  chemically synthesized
ttcaagtcagcttgggaggc

SEQ ID NO: 414384 - DNA, 20 bp, Artificial Sequence
  chemically synthesized
gcttttcaagtcagcttggg

SEQ ID NO: 414385 - DNA, 20 bp, Artificial Sequence
  chemically synthesized
tgcttttcaagtcagcttgg

SEQ ID NO: 414386 - DNA, 20 bp, Artificial Sequence
  chemically synthesized
tctgcttttcaagtcagctt

SEQ ID NO: 414387 - DNA, 20 bp, Artificial Sequence
  chemically synthesized
gtctgcttttcaagtcagct

SEQ ID NO: 414388 - DNA, 20 bp, Artificial Sequence
  chemically synthesized
gcctcccaagctgacttgaa

SEQ ID NO: 414389 - DNA, 20 bp, Artificial Sequence
  chemically synthesized
cataagtctgcttttcaagt

SEQ ID NO: 414390 - DNA, 20 bp, Artificial Sequence
  chemically synthesized
tcccaagctgacttgaaaag

SEQ ID NO: 414391 - DNA, 20 bp, Artificial Sequence
  chemically synthesized
cacccataagtctgcttttc

SEQ ID NO: 414392 - DNA, 20 bp, Artificial Sequence
  chemically synthesized
tgacttgaaaagcagactta

SEQ ID NO: 414393 - DNA, 20 bp, Artificial Sequence
  chemically synthesized
gacttgaaaagcagacttat

SEQ ID NO: 414394 - DNA, 20 bp, Artificial Sequence
  chemically synthesized
acgtgggttaggacacccat

SEQ ID NO: 414395 - DNA, 20 bp, Artificial Sequence
  chemically synthesized
cacgtgatagaacgtgggtt

SEQ ID NO: 414396 - DNA, 20 bp, Artificial Sequence
  chemically synthesized
tcacgtgatagaacgtgggt

SEQ ID NO: 414397 - DNA, 20 bp, Artificial Sequence
  chemically synthesized
gatatcacgtgatagaacgt

SEQ ID NO: 414398 - DNA, 20 bp, Artificial Sequence
  chemically synthesized
ggatatcacgtgatagaacg

SEQ ID NO: 414399 - DNA, 20 bp, Artificial Sequence
  chemically synthesized
gagagagggatatcacgtga

SEQ ID NO: 414400 - DNA, 20 bp, Artificial Sequence
  chemically synthesized
tgtgttatgtaatggagaga

SEQ ID NO: 414401 - DNA, 20 bp, Artificial Sequence
  chemically synthesized
ctgtgttatgtaatggagag

SEQ ID NO: 414402 - DNA, 20 bp, Artificial Sequence
  chemically synthesized
tctgtgttatgtaatggaga

SEQ ID NO: 414403 - DNA, 20 bp, Artificial Sequence
  chemically synthesized
tttctgtgttatgtaatgga

SEQ ID NO: 414404 - DNA, 20 bp, Artificial Sequence
  chemically synthesized
tctttctgtgttatgtaatg

SEQ ID NO: 414405 - DNA, 20 bp, Artificial Sequence
  chemically synthesized
tgtctttctgtgttatgtaa

SEQ ID NO: 414406 - DNA, 20 bp, Artificial Sequence
  chemically synthesized
cctctctccattacataaca

SEQ ID NO: 414407 - DNA, 20 bp, Artificial Sequence
  chemically synthesized
tctccattacataacacaga

SEQ ID NO: 414408 - DNA, 20 bp, Artificial Sequence
  chemically synthesized
aacacagaaagacaaattct

SEQ ID NO: 414409 - DNA, 20 bp, Artificial Sequence
  chemically synthesized
catctgatgtagtttgtgct

SEQ ID NO: 414410 - DNA, 20 bp, Artificial Sequence
  chemically synthesized
attcttagcacaaactacat

SEQ ID NO: 414411 - DNA, 20 bp, Artificial Sequence
  chemically synthesized
taatcttagcacatctgatg

SEQ ID NO: 414412 - DNA, 20 bp, Artificial Sequence
  chemically synthesized
caaactacatcagatgtgct

SEQ ID NO: 414413 - DNA, 20 bp, Artificial Sequence
  chemically synthesized
tacatcagatgtgctaagat

SEQ ID NO: 414414 - DNA, 20 bp, Artificial Sequence
  chemically synthesized
aggatttgtgagactaatct

SEQ ID NO: 414415 - DNA, 20 bp, Artificial Sequence
  chemically synthesized
taatagaaagaaggatttgt

SEQ ID NO: 414416 - DNA, 20 bp, Artificial Sequence
  chemically synthesized
gggtttggttaatagaaaga

SEQ ID NO: 414417 - DNA, 20 bp, Artificial Sequence
  chemically synthesized
agggtttggttaatagaaag

SEQ ID NO: 414418 - DNA, 20 bp, Artificial Sequence
  chemically synthesized
gcaagggtttggttaataga

SEQ ID NO: 414419 - DNA, 20 bp, Artificial Sequence
  chemically synthesized
ctctgcaagggtttggttaa

SEQ ID NO: 414420 - DNA, 20 bp, Artificial Sequence
  chemically synthesized
ttgtctcctctgcaagggtt

SEQ ID NO: 414421 - DNA, 20 bp, Artificial Sequence
  chemically synthesized
ttctattaaccaaacccttg

SEQ ID NO: 414422 - DNA, 20 bp, Artificial Sequence
  chemically synthesized
ctattaaccaaacccttgca

SEQ ID NO: 414423 - DNA, 20 bp, Artificial Sequence
  chemically synthesized
tattaaccaaacccttgcag

SEQ ID NO: 414424 - DNA, 20 bp, Artificial Sequence
  chemically synthesized
actatttgtctcctctgcaa

SEQ ID NO: 414425 - DNA, 20 bp, Artificial Sequence
  chemically synthesized
ttaaccaaacccttgcagag

SEQ ID NO: 414426 - DNA, 20 bp, Artificial Sequence
  chemically synthesized
aactatttgtctcctctgca

SEQ ID NO: 414427 - DNA, 20 bp, Artificial Sequence
  chemically synthesized
aaactatttgtctcctctgc

SEQ ID NO: 414428 - DNA, 20 bp, Artificial Sequence
  chemically synthesized
acccttgcagaggagacaaa

SEQ ID NO: 414429 - DNA, 20 bp, Artificial Sequence
  chemically synthesized
tctttctctgcattgttaaa

SEQ ID NO: 414430 - DNA, 20 bp, Artificial Sequence
  chemically synthesized
tagtttactatttaacaatg

SEQ ID NO: 414431 - DNA, 20 bp, Artificial Sequence
  chemically synthesized
gtttactatttaacaatgca

SEQ ID NO: 414432 - DNA, 20 bp, Artificial Sequence
  chemically synthesized
actatttaacaatgcagaga

SEQ ID NO: 414433 - DNA, 20 bp, Artificial Sequence
  chemically synthesized
tatttaacaatgcagagaaa

SEQ ID NO: 414434 - DNA, 20 bp, Artificial Sequence
  chemically synthesized
tttaacaatgcagagaaaga

SEQ ID NO: 414435 - DNA, 20 bp, Artificial Sequence
  chemically synthesized
taacaatgcagagaaagaga

SEQ ID NO: 414436 - DNA, 20 bp, Artificial Sequence
  chemically synthesized
acaatgcagagaaagagaga

SEQ ID NO: 414437 - DNA, 20 bp, Artificial Sequence
  chemically synthesized
aatgcagagaaagagagaga

SEQ ID NO: 414438 - DNA, 20 bp, Artificial Sequence
  chemically synthesized
tgcagagaaagagagagaga

SEQ ID NO: 414439 - DNA, 20 bp, Artificial Sequence
  chemically synthesized
cagagaaagagagagagaga

SEQ ID NO: 414440 - DNA, 20 bp, Artificial Sequence
  chemically synthesized
gagaaagagagagagagaga

SEQ ID NO: 414441 - DNA, 20 bp, Artificial Sequence
  chemically synthesized
gaaagagagagagagagaga

SEQ ID NO: 414442 - DNA, 20 bp, Artificial Sequence
  chemically synthesized
agagagagagagagagagac

SEQ ID NO: 414443 - DNA, 20 bp, Artificial Sequence
  chemically synthesized
attcttatcagtcaagtttc

SEQ ID NO: 414444 - DNA, 20 bp, Artificial Sequence
  chemically synthesized
agaccagaaacttgactgat

SEQ ID NO: 414445 - DNA, 20 bp, Artificial Sequence
  chemically synthesized
gtaagaaattcttatcagtc

SEQ ID NO: 414446 - DNA, 20 bp, Artificial Sequence
  chemically synthesized
taagggtaagaaattcttat

SEQ ID NO: 414447 - DNA, 20 bp, Artificial Sequence
  chemically synthesized
ggcatcccagcaataagggt

SEQ ID NO: 414448 - DNA, 20 bp, Artificial Sequence
  chemically synthesized
gaatttcttacccttattgc

SEQ ID NO: 414449 - DNA, 20 bp, Artificial Sequence
  chemically synthesized
acctggcatcccagcaataa

SEQ ID NO: 414450 - DNA, 20 bp, Artificial Sequence
  chemically synthesized
aatttcttacccttattgct

SEQ ID NO: 414451 - DNA, 20 bp, Artificial Sequence
  chemically synthesized
aacctggcatcccagcaata

SEQ ID NO: 414452 - DNA, 20 bp, Artificial Sequence
  chemically synthesized
aaacctggcatcccagcaat

SEQ ID NO: 414453 - DNA, 20 bp, Artificial Sequence
  chemically synthesized
tacccttattgctgggatgc

SEQ ID NO: 414454 - DNA, 20 bp, Artificial Sequence
  chemically synthesized
acccttattgctgggatgcc

SEQ ID NO: 414455 - DNA, 20 bp, Artificial Sequence
  chemically synthesized
aacccagaaacctggcatcc

SEQ ID NO: 414456 - DNA, 20 bp, Artificial Sequence
  chemically synthesized
ttgctgggatgccaggtttc

SEQ ID NO: 414457 - DNA, 20 bp, Artificial Sequence
  chemically synthesized
tgctgggatgccaggtttct

SEQ ID NO: 414458 - DNA, 20 bp, Artificial Sequence
  chemically synthesized
agaaagggaacccagaaacc

SEQ ID NO: 414459 - DNA, 20 bp, Artificial Sequence
  chemically synthesized
agctgcagagaaagggaacc

SEQ ID NO: 414460 - DNA, 20 bp, Artificial Sequence
  chemically synthesized
ttctggaagctgcagagaaa

SEQ ID NO: 414461 - DNA, 20 bp, Artificial Sequence
  chemically synthesized
ttctgggttccctttctctg

SEQ ID NO: 414462 - DNA, 20 bp, Artificial Sequence
  chemically synthesized
cttctggaagctgcagagaa

SEQ ID NO: 414463 - DNA, 20 bp, Artificial Sequence
  chemically synthesized
tcttctggaagctgcagaga

SEQ ID NO: 414464 - DNA, 20 bp, Artificial Sequence
  chemically synthesized
ccgttcttctggaagctgca

SEQ ID NO: 414465 - DNA, 20 bp, Artificial Sequence
  chemically synthesized
ttccctttctctgcagcttc

SEQ ID NO: 414466 - DNA, 20 bp, Artificial Sequence
  chemically synthesized
ctccgttcttctggaagctg

SEQ ID NO: 414467 - DNA, 20 bp, Artificial Sequence
  chemically synthesized
cctttctctgcagcttccag

SEQ ID NO: 414468 - DNA, 20 bp, Artificial Sequence
  chemically synthesized
acgccactccgttcttctgg

SEQ ID NO: 414469 - DNA, 20 bp, Artificial Sequence
  chemically synthesized
ctctgcagcttccagaagaa

SEQ ID NO: 414470 - DNA, 20 bp, Artificial Sequence
  chemically synthesized
aagacgccactccgttcttc

SEQ ID NO: 414471 - DNA, 20 bp, Artificial Sequence
  chemically synthesized
ctgcagcttccagaagaacg

SEQ ID NO: 414472 - DNA, 20 bp, Artificial Sequence
  chemically synthesized
cagcttccagaagaacggag

SEQ ID NO: 414473 - DNA, 20 bp, Artificial Sequence
  chemically synthesized
gcacaagcaagcagggtcgt

SEQ ID NO: 414474 - DNA, 20 bp, Artificial Sequence
  chemically synthesized
agctatagcacaagcaagca

SEQ ID NO: 414475 - DNA, 20 bp, Artificial Sequence
  chemically synthesized
cagctatagcacaagcaagc

SEQ ID NO: 414476 - DNA, 20 bp, Artificial Sequence
  chemically synthesized
acagctatagcacaagcaag

SEQ ID NO: 414477 - DNA, 20 bp, Artificial Sequence
  chemically synthesized
cccacagctatagcacaagc

SEQ ID NO: 414478 - DNA, 20 bp, Artificial Sequence
  chemically synthesized
gaccctgcttgcttgtgcta

SEQ ID NO: 414479 - DNA, 20 bp, Artificial Sequence
  chemically synthesized
aaaccccacagctatagcac

SEQ ID NO: 414480 - DNA, 20 bp, Artificial Sequence
  chemically synthesized
gcttgcttgtgctatagctg

SEQ ID NO: 414481 - DNA, 20 bp, Artificial Sequence
  chemically synthesized
cttgcttgtgctatagctgt

SEQ ID NO: 414482 - DNA, 20 bp, Artificial Sequence
  chemically synthesized
tggcttaaaccccacagcta

SEQ ID NO: 414483 - DNA, 20 bp, Artificial Sequence
  chemically synthesized
ttgcttgtgctatagctgtg

SEQ ID NO: 414484 - DNA, 20 bp, Artificial Sequence
  chemically synthesized
gtaaagtggcttaaacccca

SEQ ID NO: 414485 - DNA, 20 bp, Artificial Sequence
  chemically synthesized
gtgctatagctgtggggttt

SEQ ID NO: 414486 - DNA, 20 bp, Artificial Sequence
  chemically synthesized
tggggtttaagccactttac

SEQ ID NO: 414487 - DNA, 20 bp, Artificial Sequence
  chemically synthesized
ggtgattttatcttgtaaag

SEQ ID NO: 414488 - DNA, 20 bp, Artificial Sequence
  chemically synthesized
aagggtgattttatcttgta

SEQ ID NO: 414489 - DNA, 20 bp, Artificial Sequence
  chemically synthesized
tggttccataaaatggtaaa

SEQ ID NO: 414490 - DNA, 20 bp, Artificial Sequence
  chemically synthesized
atggttccataaaatggtaa

SEQ ID NO: 414491 - DNA, 20 bp, Artificial Sequence
  chemically synthesized
tatggttccataaaatggta

SEQ ID NO: 414492 - DNA, 20 bp, Artificial Sequence
  chemically synthesized
aatcaccctttaccatttta

SEQ ID NO: 414493 - DNA, 20 bp, Artificial Sequence
  chemically synthesized
ttgtttatggttccataaaa

SEQ ID NO: 414494 - DNA, 20 bp, Artificial Sequence
  chemically synthesized
cattttatggaaccataaac

SEQ ID NO: 414495 - DNA, 20 bp, Artificial Sequence
  chemically synthesized
caaattaagaatcttgttta

SEQ ID NO: 414496 - DNA, 20 bp, Artificial Sequence
  chemically synthesized
aaacaagattcttaatttgc

SEQ ID NO: 414497 - DNA, 20 bp, Artificial Sequence
  chemically synthesized
tgggcagaatcttgcaaatt

SEQ ID NO: 414498 - DNA, 20 bp, Artificial Sequence
  chemically synthesized
atttgcaagattctgcccaa

SEQ ID NO: 414499 - DNA, 20 bp, Artificial Sequence
  chemically synthesized
tttgcaagattctgcccaac

SEQ ID NO: 414500 - DNA, 20 bp, Artificial Sequence
  chemically synthesized
tccccatgcagcccgttggg

SEQ ID NO: 414501 - DNA, 20 bp, Artificial Sequence
  chemically synthesized
agttccccatgcagcccgtt

SEQ ID NO: 414502 - DNA, 20 bp, Artificial Sequence
  chemically synthesized
cagttccccatgcagcccgt

SEQ ID NO: 414503 - DNA, 20 bp, Artificial Sequence
  chemically synthesized
attctgcccaacgggctgca

SEQ ID NO: 414504 - DNA, 20 bp, Artificial Sequence
  chemically synthesized
ttctgcccaacgggctgcat

SEQ ID NO: 414505 - DNA, 20 bp, Artificial Sequence
  chemically synthesized
tctgcccaacgggctgcatg

SEQ ID NO: 414506 - DNA, 20 bp, Artificial Sequence
  chemically synthesized
tgttaattcagttccccatg

SEQ ID NO: 414507 - DNA, 20 bp, Artificial Sequence
  chemically synthesized
tgggttggaaaatgttaatt

SEQ ID NO: 414508 - DNA, 20 bp, Artificial Sequence
  chemically synthesized
tgaattaacattttccaacc

SEQ ID NO: 414509 - DNA, 20 bp, Artificial Sequence
  chemically synthesized
ttatgtgtattttgctgggt

SEQ ID NO: 414510 - DNA, 20 bp, Artificial Sequence
  chemically synthesized
tttgttatgtgtattttgct

SEQ ID NO: 414511 - DNA, 20 bp, Artificial Sequence
  chemically synthesized
ttttgttatgtgtattttgc

SEQ ID NO: 414512 - DNA, 20 bp, Artificial Sequence
  chemically synthesized
gcaaaatacacataacaaaa

SEQ ID NO: 414513 - DNA, 20 bp, Artificial Sequence
  chemically synthesized
acacataacaaaacagacat

SEQ ID NO: 414514 - DNA, 20 bp, Artificial Sequence
  chemically synthesized
ctgatattgggtgcggaaag

SEQ ID NO: 414515 - DNA, 20 bp, Artificial Sequence
  chemically synthesized
gctgatattgggtgcggaaa

SEQ ID NO: 414516 - DNA, 20 bp, Artificial Sequence
  chemically synthesized
aggctgatattgggtgcgga

SEQ ID NO: 414517 - DNA, 20 bp, Artificial Sequence
  chemically synthesized
tgccaggctgatattgggtg

SEQ ID NO: 414518 - DNA, 20 bp, Artificial Sequence
  chemically synthesized
cctctttccgcacccaatat

SEQ ID NO: 414519 - DNA, 20 bp, Artificial Sequence
  chemically synthesized
agctttgccaggctgatatt

SEQ ID NO: 414520 - DNA, 20 bp, Artificial Sequence
  chemically synthesized
gagctttgccaggctgatat

SEQ ID NO: 414521 - DNA, 20 bp, Artificial Sequence
  chemically synthesized
ttccgcacccaatatcagcc

SEQ ID NO: 414522 - DNA, 20 bp, Artificial Sequence
  chemically synthesized
cacccaatatcagcctggca

SEQ ID NO: 414523 - DNA, 20 bp, Artificial Sequence
  chemically synthesized
gaaaaattttgagctttgcc

SEQ ID NO: 414524 - DNA, 20 bp, Artificial Sequence
  chemically synthesized
tgaaaaattttgagctttgc

SEQ ID NO: 414525 - DNA, 20 bp, Artificial Sequence
  chemically synthesized
ggaccaagatgaaaaatttt

SEQ ID NO: 414526 - DNA, 20 bp, Artificial Sequence
  chemically synthesized
aagctcaaaatttttcatct

SEQ ID NO: 414527 - DNA, 20 bp, Artificial Sequence
  chemically synthesized
gatcaaagacaacagggacc

SEQ ID NO: 414528 - DNA, 20 bp, Artificial Sequence
  chemically synthesized
ggtgtggatcaaagacaaca

SEQ ID NO: 414529 - DNA, 20 bp, Artificial Sequence
  chemically synthesized
tggtgtggatcaaagacaac

SEQ ID NO: 414530 - DNA, 20 bp, Artificial Sequence
  chemically synthesized
ctggtgtggatcaaagacaa

SEQ ID NO: 414531 - DNA, 20 bp, Artificial Sequence
  chemically synthesized
tccccacctggtgtggatca

SEQ ID NO: 414532 - DNA, 20 bp, Artificial Sequence
  chemically synthesized
ctgttgtctttgatccacac

SEQ ID NO: 414533 - DNA, 20 bp, Artificial Sequence
  chemically synthesized
tgttgtctttgatccacacc

SEQ ID NO: 414534 - DNA, 20 bp, Artificial Sequence
  chemically synthesized
tgtctttgatccacaccagg

SEQ ID NO: 414535 - DNA, 20 bp, Artificial Sequence
  chemically synthesized
tcatccgtccccacctggtg

SEQ ID NO: 414536 - DNA, 20 bp, Artificial Sequence
  chemically synthesized
gtctttgatccacaccaggt

SEQ ID NO: 414537 - DNA, 20 bp, Artificial Sequence
  chemically synthesized
tctttgatccacaccaggtg

SEQ ID NO: 414538 - DNA, 20 bp, Artificial Sequence
  chemically synthesized
agaggtcatccgtccccacc

SEQ ID NO: 414539 - DNA, 20 bp, Artificial Sequence
  chemically synthesized
tgatccacaccaggtgggga

SEQ ID NO: 414540 - DNA, 20 bp, Artificial Sequence
  chemically synthesized
ggggacggatgacctctgaa

SEQ ID NO: 414541 - DNA, 20 bp, Artificial Sequence
  chemically synthesized
cattgtgaattaccgttcag

SEQ ID NO: 414542 - DNA, 20 bp, Artificial Sequence
  chemically synthesized
tcattgtgaattaccgttca

SEQ ID NO: 414543 - DNA, 20 bp, Artificial Sequence
  chemically synthesized
cctcattgtgaattaccgtt

SEQ ID NO: 414544 - DNA, 20 bp, Artificial Sequence
  chemically synthesized
tctgaacggtaattcacaat

SEQ ID NO: 414545 - DNA, 20 bp, Artificial Sequence
  chemically synthesized
ctgaacggtaattcacaatg

SEQ ID NO: 414546 - DNA, 20 bp, Artificial Sequence
  chemically synthesized
gtaattcacaatgaggtctc

SEQ ID NO: 414547 - DNA, 20 bp, Artificial Sequence
  chemically synthesized
taattcacaatgaggtctct

SEQ ID NO: 414548 - DNA, 20 bp, Artificial Sequence
  chemically synthesized
tcacaatgaggtctctgggc

SEQ ID NO: 414549 - DNA, 20 bp, Artificial Sequence
  chemically synthesized
cacaatgaggtctctgggca

SEQ ID NO: 414550 - DNA, 20 bp, Artificial Sequence
  chemically synthesized
acaatgaggtctctgggcaa

SEQ ID NO: 414551 - DNA, 20 bp, Artificial Sequence
  chemically synthesized
tctgctctttcccttgccca

SEQ ID NO: 414552 - DNA, 20 bp, Artificial Sequence
  chemically synthesized
tatctgctctttcccttgcc

SEQ ID NO: 414553 - DNA, 20 bp, Artificial Sequence
  chemically synthesized
tgaggtctctgggcaaggga

SEQ ID NO: 414554 - DNA, 20 bp, Artificial Sequence
  chemically synthesized
aggtctctgggcaagggaaa

SEQ ID NO: 414555 - DNA, 20 bp, Artificial Sequence
  chemically synthesized
tctctgggcaagggaaagag

SEQ ID NO: 414556 - DNA, 20 bp, Artificial Sequence
  chemically synthesized
tgggcaagggaaagagcaga

SEQ ID NO: 414557 - DNA, 20 bp, Artificial Sequence
  chemically synthesized
aaagagcagatagtcaccct

SEQ ID NO: 414558 - DNA, 20 bp, Artificial Sequence
  chemically synthesized
agagcagatagtcaccctga

SEQ ID NO: 414559 - DNA, 20 bp, Artificial Sequence
  chemically synthesized
cagatagtcaccctgagaga

SEQ ID NO: 414560 - DNA, 20 bp, Artificial Sequence
  chemically synthesized
ctcaacagtcctgtctctca

SEQ ID NO: 414561 - DNA, 20 bp, Artificial Sequence
  chemically synthesized
agatagtcaccctgagagac

SEQ ID NO: 414562 - DNA, 20 bp, Artificial Sequence
  chemically synthesized
gctcaacagtcctgtctctc

SEQ ID NO: 414563 - DNA, 20 bp, Artificial Sequence
  chemically synthesized
ggctcaacagtcctgtctct

SEQ ID NO: 414564 - DNA, 20 bp, Artificial Sequence
  chemically synthesized
ccctgagagacaggactgtt

SEQ ID NO: 414565 - DNA, 20 bp, Artificial Sequence
  chemically synthesized
gagctctaaagaaggctcaa

SEQ ID NO: 414566 - DNA, 20 bp, Artificial Sequence
  chemically synthesized
caggactgttgagccttctt

SEQ ID NO: 414567 - DNA, 20 bp, Artificial Sequence
  chemically synthesized
ggactgttgagccttcttta

SEQ ID NO: 414568 - DNA, 20 bp, Artificial Sequence
  chemically synthesized
cattcagtgagctctaaaga

SEQ ID NO: 414569 - DNA, 20 bp, Artificial Sequence
  chemically synthesized
acattcagtgagctctaaag

SEQ ID NO: 414570 - DNA, 20 bp, Artificial Sequence
  chemically synthesized
gtcacattcagtgagctcta

SEQ ID NO: 414571 - DNA, 20 bp, Artificial Sequence
  chemically synthesized
tttgtctggtcacattcagt

SEQ ID NO: 414572 - DNA, 20 bp, Artificial Sequence
  chemically synthesized
cttatttgtctggtcacatt

SEQ ID NO: 414573 - DNA, 20 bp, Artificial Sequence
  chemically synthesized
tagagctcactgaatgtgac

SEQ ID NO: 414574 - DNA, 20 bp, Artificial Sequence
  chemically synthesized
ctgaatgtgaccagacaaat

SEQ ID NO: 414575 - DNA, 20 bp, Artificial Sequence
  chemically synthesized
gagaaccctccttatttgtc

SEQ ID NO: 414576 - DNA, 20 bp, Artificial Sequence
  chemically synthesized
tgaatgtgaccagacaaata

SEQ ID NO: 414577 - DNA, 20 bp, Artificial Sequence
  chemically synthesized
aatgtgaccagacaaataag

SEQ ID NO: 414578 - DNA, 20 bp, Artificial Sequence
  chemically synthesized
atgtgaccagacaaataagg

SEQ ID NO: 414579 - DNA, 20 bp, Artificial Sequence
  chemically synthesized
tgtgaccagacaaataagga

SEQ ID NO: 414580 - DNA, 20 bp, Artificial Sequence
  chemically synthesized
acaaataaggagggttctct

SEQ ID NO: 414581 - DNA, 20 bp, Artificial Sequence
  chemically synthesized
ataaggagggttctctgagt

SEQ ID NO: 414582 - DNA, 20 bp, Artificial Sequence
  chemically synthesized
taaggagggttctctgagtt

SEQ ID NO: 414583 - DNA, 20 bp, Artificial Sequence
  chemically synthesized
agtccagcatgcctaactca

SEQ ID NO: 414584 - DNA, 20 bp, Artificial Sequence
  chemically synthesized
gaagtccagcatgcctaact

SEQ ID NO: 414585 - DNA, 20 bp, Artificial Sequence
  chemically synthesized
gttctctgagttaggcatgc

SEQ ID NO: 414586 - DNA, 20 bp, Artificial Sequence
  chemically synthesized
aggggttgctgatagaagtc

SEQ ID NO: 414587 - DNA, 20 bp, Artificial Sequence
  chemically synthesized
taggcatgctggacttctat

SEQ ID NO: 414588 - DNA, 20 bp, Artificial Sequence
  chemically synthesized
tcagaaggggttgctgatag

SEQ ID NO: 414589 - DNA, 20 bp, Artificial Sequence
  chemically synthesized
atctcagaaggggttgctga

SEQ ID NO: 414590 - DNA, 20 bp, Artificial Sequence
  chemically synthesized
ttctatcagcaaccccttct

SEQ ID NO: 414591 - DNA, 20 bp, Artificial Sequence
  chemically synthesized
tgtgaaagggatctcagaag

SEQ ID NO: 414592 - DNA, 20 bp, Artificial Sequence
  chemically synthesized
atgtgaaagggatctcagaa

SEQ ID NO: 414593 - DNA, 20 bp, Artificial Sequence
  chemically synthesized
tatgtgaaagggatctcaga

SEQ ID NO: 414594 - DNA, 20 bp, Artificial Sequence
  chemically synthesized
atatgtgaaagggatctcag

SEQ ID NO: 414595 - DNA, 20 bp, Artificial Sequence
  chemically synthesized
taaatatgtgaaagggatct

SEQ ID NO: 414596 - DNA, 20 bp, Artificial Sequence
  chemically synthesized
atgtgtttaaatatgtgaaa

SEQ ID NO: 414597 - DNA, 20 bp, Artificial Sequence
  chemically synthesized
catgtgtttaaatatgtgaa

SEQ ID NO: 414598 - DNA, 20 bp, Artificial Sequence
  chemically synthesized
gcatgtgtttaaatatgtga

SEQ ID NO: 414599 - DNA, 20 bp, Artificial Sequence
  chemically synthesized
cacatatttaaacacatgca

SEQ ID NO: 414600 - DNA, 20 bp, Artificial Sequence
  chemically synthesized
atttaaacacatgcaaagac

SEQ ID NO: 414601 - DNA, 20 bp, Artificial Sequence
  chemically synthesized
ttaaacacatgcaaagacaa

SEQ ID NO: 414602 - DNA, 20 bp, Artificial Sequence
  chemically synthesized
taaacacatgcaaagacaag

SEQ ID NO: 414603 - DNA, 20 bp, Artificial Sequence
  chemically synthesized
aaacacatgcaaagacaaga

SEQ ID NO: 414604 - DNA, 20 bp, Artificial Sequence
  chemically synthesized
acatgcaaagacaagaggga

SEQ ID NO: 414605 - DNA, 20 bp, Artificial Sequence
  chemically synthesized
tgcaaagacaagagggacag

SEQ ID NO: 414606 - DNA, 20 bp, Artificial Sequence
  chemically synthesized
gcaaagacaagagggacaga

SEQ ID NO: 414607 - DNA, 20 bp, Artificial Sequence
  chemically synthesized
ggacagaaggccttccaaat

SEQ ID NO: 414608 - DNA, 20 bp, Artificial Sequence
  chemically synthesized
ggttagggatctgatttgga

SEQ ID NO: 414609 - DNA, 20 bp, Artificial Sequence
  chemically synthesized
tggttagggatctgatttgg

SEQ ID NO: 414610 - DNA, 20 bp, Artificial Sequence
  chemically synthesized
tcttggttagggatctgatt

SEQ ID NO: 414611 - DNA, 20 bp, Artificial Sequence
  chemically synthesized
tccaaatcagatccctaacc

SEQ ID NO: 414612 - DNA, 20 bp, Artificial Sequence
  chemically synthesized
actcttggacttcttggtta

SEQ ID NO: 414613 - DNA, 20 bp, Artificial Sequence
  chemically synthesized
aaatcagatccctaaccaag

SEQ ID NO: 414614 - DNA, 20 bp, Artificial Sequence
  chemically synthesized
tactcttggacttcttggtt

SEQ ID NO: 414615 - DNA, 20 bp, Artificial Sequence
  chemically synthesized
atactcttggacttcttggt

SEQ ID NO: 414616 - DNA, 20 bp, Artificial Sequence
  chemically synthesized
agggatactcttggacttct

SEQ ID NO: 414617 - DNA, 20 bp, Artificial Sequence
  chemically synthesized
gatccctaaccaagaagtcc

SEQ ID NO: 414618 - DNA, 20 bp, Artificial Sequence
  chemically synthesized
tccctaaccaagaagtccaa

SEQ ID NO: 414619 - DNA, 20 bp, Artificial Sequence
  chemically synthesized
tagtttggaagggatactct

SEQ ID NO: 414620 - DNA, 20 bp, Artificial Sequence
  chemically synthesized
aataggaggatagtttggaa

SEQ ID NO: 414621 - DNA, 20 bp, Artificial Sequence
  chemically synthesized
aaataggaggatagtttgga

SEQ ID NO: 414622 - DNA, 20 bp, Artificial Sequence
  chemically synthesized
aaaataggaggatagtttgg

SEQ ID NO: 414623 - DNA, 20 bp, Artificial Sequence
  chemically synthesized
cagaaaataggaggatagtt

SEQ ID NO: 414624 - DNA, 20 bp, Artificial Sequence
  chemically synthesized
tcatacagaaaataggagga

SEQ ID NO: 414625 - DNA, 20 bp, Artificial Sequence
  chemically synthesized
tttctcatacagaaaatagg

SEQ ID NO: 414626 - DNA, 20 bp, Artificial Sequence
  chemically synthesized
gtttctcatacagaaaatag

SEQ ID NO: 414627 - DNA, 20 bp, Artificial Sequence
  chemically synthesized
aggtttctcatacagaaaat

SEQ ID NO: 414628 - DNA, 20 bp, Artificial Sequence
  chemically synthesized
gaggtttctcatacagaaaa

SEQ ID NO: 414629 - DNA, 20 bp, Artificial Sequence
  chemically synthesized
tatcctcctattttctgtat

SEQ ID NO: 414630 - DNA, 20 bp, Artificial Sequence
  chemically synthesized
ttttgaggaggtttctcata

SEQ ID NO: 414631 - DNA, 20 bp, Artificial Sequence
  chemically synthesized
caatcaggaagattttgagg

SEQ ID NO: 414632 - DNA, 20 bp, Artificial Sequence
  chemically synthesized
tcaatcaggaagattttgag

SEQ ID NO: 414633 - DNA, 20 bp, Artificial Sequence
  chemically synthesized
cttcaatcaggaagattttg

SEQ ID NO: 414634 - DNA, 20 bp, Artificial Sequence
  chemically synthesized
tcttcaatcaggaagatttt

SEQ ID NO: 414635 - DNA, 20 bp, Artificial Sequence
  chemically synthesized
gagacttctcttcaatcagg

SEQ ID NO: 414636 - DNA, 20 bp, Artificial Sequence
  chemically synthesized
cctcaaaatcttcctgattg

SEQ ID NO: 414637 - DNA, 20 bp, Artificial Sequence
  chemically synthesized
tcaaaatcttcctgattgaa

SEQ ID NO: 414638 - DNA, 20 bp, Artificial Sequence
  chemically synthesized
tgggagacttctcttcaatc

SEQ ID NO: 414639 - DNA, 20 bp, Artificial Sequence
  chemically synthesized
ttgggagacttctcttcaat

SEQ ID NO: 414640 - DNA, 20 bp, Artificial Sequence
  chemically synthesized
aaatcttcctgattgaagag

SEQ ID NO: 414641 - DNA, 20 bp, Artificial Sequence
  chemically synthesized
tgaagagaagtctcccaaac

SEQ ID NO: 414642 - DNA, 20 bp, Artificial Sequence
  chemically synthesized
taggaagactactggtttgg

SEQ ID NO: 414643 - DNA, 20 bp, Artificial Sequence
  chemically synthesized
agagaagtctcccaaaccag

SEQ ID NO: 414644 - DNA, 20 bp, Artificial Sequence
  chemically synthesized
agtaggaagactactggttt

SEQ ID NO: 414645 - DNA, 20 bp, Artificial Sequence
  chemically synthesized
tagtaggaagactactggtt

SEQ ID NO: 414646 - DNA, 20 bp, Artificial Sequence
  chemically synthesized
ctaactagtaggaagactac

SEQ ID NO: 414647 - DNA, 20 bp, Artificial Sequence
  chemically synthesized
caaaccagtagtcttcctac

SEQ ID NO: 414648 - DNA, 20 bp, Artificial Sequence
  chemically synthesized
cgctctttctaactagtagg

SEQ ID NO: 414649 - DNA, 20 bp, Artificial Sequence
  chemically synthesized
ccagtagtcttcctactagt

SEQ ID NO: 414650 - DNA, 20 bp, Artificial Sequence
  chemically synthesized
gttcgctctttctaactagt

SEQ ID NO: 414651 - DNA, 20 bp, Artificial Sequence
  chemically synthesized
agttcgctctttctaactag

SEQ ID NO: 414652 - DNA, 20 bp, Artificial Sequence
  chemically synthesized
tagtcttcctactagttaga

SEQ ID NO: 414653 - DNA, 20 bp, Artificial Sequence
  chemically synthesized
ctcagttcgctctttctaac

SEQ ID NO: 414654 - DNA, 20 bp, Artificial Sequence
  chemically synthesized
gtcttcctactagttagaaa

SEQ ID NO: 414655 - DNA, 20 bp, Artificial Sequence
  chemically synthesized
ctagttagaaagagcgaact

SEQ ID NO: 414656 - DNA, 20 bp, Artificial Sequence
  chemically synthesized
gttcagctcctgggaggtct

SEQ ID NO: 414657 - DNA, 20 bp, Artificial Sequence
  chemically synthesized
aagagcgaactgagacctcc

SEQ ID NO: 414658 - DNA, 20 bp, Artificial Sequence
  chemically synthesized
agagcgaactgagacctccc

SEQ ID NO: 414659 - DNA, 20 bp, Artificial Sequence
  chemically synthesized
agcgaactgagacctcccag

SEQ ID NO: 414660 - DNA, 20 bp, Artificial Sequence
  chemically synthesized
gtgtctgttcagctcctggg

SEQ ID NO: 414661 - DNA, 20 bp, Artificial Sequence
  chemically synthesized
ggtgtctgttcagctcctgg

SEQ ID NO: 414662 - DNA, 20 bp, Artificial Sequence
  chemically synthesized
ggggtgtctgttcagctcct

SEQ ID NO: 414663 - DNA, 20 bp, Artificial Sequence
  chemically synthesized
tggggtgtctgttcagctcc

SEQ ID NO: 414664 - DNA, 20 bp, Artificial Sequence
  chemically synthesized
gagacctcccaggagctgaa

SEQ ID NO: 414665 - DNA, 20 bp, Artificial Sequence
  chemically synthesized
tccattgtggggtgtctgtt

SEQ ID NO: 414666 - DNA, 20 bp, Artificial Sequence
  chemically synthesized
gctgaacagacaccccacaa

SEQ ID NO: 414667 - DNA, 20 bp, Artificial Sequence
  chemically synthesized
tgaacagacaccccacaatg

SEQ ID NO: 414668 - DNA, 20 bp, Artificial Sequence
  chemically synthesized
ctgtctgttactccattgtg

SEQ ID NO: 414669 - DNA, 20 bp, Artificial Sequence
  chemically synthesized
tctgtctgttactccattgt

SEQ ID NO: 414670 - DNA, 20 bp, Artificial Sequence
  chemically synthesized
ctctgtctgttactccattg

SEQ ID NO: 414671 - DNA, 20 bp, Artificial Sequence
  chemically synthesized
gacaccccacaatggagtaa

SEQ ID NO: 414672 - DNA, 20 bp, Artificial Sequence
  chemically synthesized
ccccacaatggagtaacaga

SEQ ID NO: 414673 - DNA, 20 bp, Artificial Sequence
  chemically synthesized
ccacaatggagtaacagaca

SEQ ID NO: 414674 - DNA, 20 bp, Artificial Sequence
  chemically synthesized
cagacagagacaccccatgc

SEQ ID NO: 414675 - DNA, 20 bp, Artificial Sequence
  chemically synthesized
gtgtctgtagatccagcatg

SEQ ID NO: 414676 - DNA, 20 bp, Artificial Sequence
  chemically synthesized
ggtgtctgtagatccagcat

SEQ ID NO: 414677 - DNA, 20 bp, Artificial Sequence
  chemically synthesized
gggtgtctgtagatccagca

SEQ ID NO: 414678 - DNA, 20 bp, Artificial Sequence
  chemically synthesized
gacaccccatgctggatcta

SEQ ID NO: 414679 - DNA, 20 bp, Artificial Sequence
  chemically synthesized
ttgtggggtgtctgtagatc

SEQ ID NO: 414680 - DNA, 20 bp, Artificial Sequence
  chemically synthesized
gccccattgtggggtgtctg

SEQ ID NO: 414681 - DNA, 20 bp, Artificial Sequence
  chemically synthesized
gatctacagacaccccacaa

SEQ ID NO: 414682 - DNA, 20 bp, Artificial Sequence
  chemically synthesized
atctacagacaccccacaat

SEQ ID NO: 414683 - DNA, 20 bp, Artificial Sequence
  chemically synthesized
tctacagacaccccacaatg

SEQ ID NO: 414684 - DNA, 20 bp, Artificial Sequence
  chemically synthesized
gtgtctgtagccccattgtg

SEQ ID NO: 414685 - DNA, 20 bp, Artificial Sequence
  chemically synthesized
ggtgtctgtagccccattgt

SEQ ID NO: 414686 - DNA, 20 bp, Artificial Sequence
  chemically synthesized
gggtgtctgtagccccattg

SEQ ID NO: 414687 - DNA, 20 bp, Artificial Sequence
  chemically synthesized
gacaccccacaatggggcta

SEQ ID NO: 414688 - DNA, 20 bp, Artificial Sequence
  chemically synthesized
gccctatggtggggtgtctg

SEQ ID NO: 414689 - DNA, 20 bp, Artificial Sequence
  chemically synthesized
gggctacagacaccccacca

SEQ ID NO: 414690 - DNA, 20 bp, Artificial Sequence
  chemically synthesized
ggctacagacaccccaccat

SEQ ID NO: 414691 - DNA, 20 bp, Artificial Sequence
  chemically synthesized
gctacagacaccccaccata

SEQ ID NO: 414692 - DNA, 20 bp, Artificial Sequence
  chemically synthesized
ggttctgtagccctatggtg

SEQ ID NO: 414693 - DNA, 20 bp, Artificial Sequence
  chemically synthesized
tggttctgtagccctatggt

SEQ ID NO: 414694 - DNA, 20 bp, Artificial Sequence
  chemically synthesized
ctggttctgtagccctatgg

SEQ ID NO: 414695 - DNA, 20 bp, Artificial Sequence
  chemically synthesized
tgactggttctgtagcccta

SEQ ID NO: 414696 - DNA, 20 bp, Artificial Sequence
  chemically synthesized
gacaccccaccatagggcta

SEQ ID NO: 414697 - DNA, 20 bp, Artificial Sequence
  chemically synthesized
ccaccatagggctacagaac

SEQ ID NO: 414698 - DNA, 20 bp, Artificial Sequence
  chemically synthesized
cattctcctgactggttctg

SEQ ID NO: 414699 - DNA, 20 bp, Artificial Sequence
  chemically synthesized
catagggctacagaaccagt

SEQ ID NO: 414700 - DNA, 20 bp, Artificial Sequence
  chemically synthesized
atagggctacagaaccagtc

SEQ ID NO: 414701 - DNA, 20 bp, Artificial Sequence
  chemically synthesized
agggctacagaaccagtcag

SEQ ID NO: 414702 - DNA, 20 bp, Artificial Sequence
  chemically synthesized
gcctgcttcattctcctgac

SEQ ID NO: 414703 - DNA, 20 bp, Artificial Sequence
  chemically synthesized
cagaaccagtcaggagaatg

SEQ ID NO: 414704 - DNA, 20 bp, Artificial Sequence
  chemically synthesized
aaccagtcaggagaatgaag

SEQ ID NO: 414705 - DNA, 20 bp, Artificial Sequence
  chemically synthesized
accagtcaggagaatgaagc

SEQ ID NO: 414706 - DNA, 20 bp, Artificial Sequence
  chemically synthesized
caggagaatgaagcaggcat

SEQ ID NO: 414707 - DNA, 20 bp, Artificial Sequence
  chemically synthesized
gagaatgaagcaggcattgg

SEQ ID NO: 414708 - DNA, 20 bp, Artificial Sequence
  chemically synthesized
aagcaggcattggcagcacc

SEQ ID NO: 414709 - DNA, 20 bp, Artificial Sequence
  chemically synthesized
agcaggcattggcagcacct

SEQ ID NO: 414710 - DNA, 20 bp, Artificial Sequence
  chemically synthesized
tctggattggtgagtatcct

SEQ ID NO: 414711 - DNA, 20 bp, Artificial Sequence
  chemically synthesized
gtctggattggtgagtatcc

SEQ ID NO: 414712 - DNA, 20 bp, Artificial Sequence
  chemically synthesized
acctaggatactcaccaatc

SEQ ID NO: 414713 - DNA, 20 bp, Artificial Sequence
  chemically synthesized
tttggggtgtctggattggt

SEQ ID NO: 414714 - DNA, 20 bp, Artificial Sequence
  chemically synthesized
ccgttttggggtgtctggat

SEQ ID NO: 414715 - DNA, 20 bp, Artificial Sequence
  chemically synthesized
tagctccgttttggggtgtc

SEQ ID NO: 414716 - DNA, 20 bp, Artificial Sequence
  chemically synthesized
ccaatccagacaccccaaaa

SEQ ID NO: 414717 - DNA, 20 bp, Artificial Sequence
  chemically synthesized
aatccagacaccccaaaacg

SEQ ID NO: 414718 - DNA, 20 bp, Artificial Sequence
  chemically synthesized
ctatctgtagctccgttttg

SEQ ID NO: 414719 - DNA, 20 bp, Artificial Sequence
  chemically synthesized
tctatctgtagctccgtttt

SEQ ID NO: 414720 - DNA, 20 bp, Artificial Sequence
  chemically synthesized
gtctatctgtagctccgttt

SEQ ID NO: 414721 - DNA, 20 bp, Artificial Sequence
  chemically synthesized
gacaccccaaaacggagcta

SEQ ID NO: 414722 - DNA, 20 bp, Artificial Sequence
  chemically synthesized
ccccaaaacggagctacaga

SEQ ID NO: 414723 - DNA, 20 bp, Artificial Sequence
  chemically synthesized
catggtggggtgtctatctg

SEQ ID NO: 414724 - DNA, 20 bp, Artificial Sequence
  chemically synthesized
acagatagacaccccaccat

SEQ ID NO: 414725 - DNA, 20 bp, Artificial Sequence
  chemically synthesized
cagatagacaccccaccatg

SEQ ID NO: 414726 - DNA, 20 bp, Artificial Sequence
  chemically synthesized
gtatctgtagcctcatggtg

SEQ ID NO: 414727 - DNA, 20 bp, Artificial Sequence
  chemically synthesized
ggtatctgtagcctcatggt

SEQ ID NO: 414728 - DNA, 20 bp, Artificial Sequence
  chemically synthesized
gggtatctgtagcctcatgg

SEQ ID NO: 414729 - DNA, 20 bp, Artificial Sequence
  chemically synthesized
acagggtatctgtagcctca

SEQ ID NO: 414730 - DNA, 20 bp, Artificial Sequence
  chemically synthesized
gacaccccaccatgaggcta

SEQ ID NO: 414731 - DNA, 20 bp, Artificial Sequence
  chemically synthesized
gccctattacagggtatctg

SEQ ID NO: 414732 - DNA, 20 bp, Artificial Sequence
  chemically synthesized
aggctacagataccctgtaa

SEQ ID NO: 414733 - DNA, 20 bp, Artificial Sequence
  chemically synthesized
ggctacagataccctgtaat

SEQ ID NO: 414734 - DNA, 20 bp, Artificial Sequence
  chemically synthesized
gctacagataccctgtaata

SEQ ID NO: 414735 - DNA, 20 bp, Artificial Sequence
  chemically synthesized
ttaactgtagccctattaca

SEQ ID NO: 414736 - DNA, 20 bp, Artificial Sequence
  chemically synthesized
cttaactgtagccctattac

SEQ ID NO: 414737 - DNA, 20 bp, Artificial Sequence
  chemically synthesized
ccttaactgtagccctatta

SEQ ID NO: 414738 - DNA, 20 bp, Artificial Sequence
  chemically synthesized
gataccctgtaatagggcta

SEQ ID NO: 414739 - DNA, 20 bp, Artificial Sequence
  chemically synthesized
cctgtaatagggctacagtt

SEQ ID NO: 414740 - DNA, 20 bp, Artificial Sequence
  chemically synthesized
ctgtaatagggctacagtta

SEQ ID NO: 414741 - DNA, 20 bp, Artificial Sequence
  chemically synthesized
tgtaatagggctacagttaa

SEQ ID NO: 414742 - DNA, 20 bp, Artificial Sequence
  chemically synthesized
ggggagatgtcccttaactg

SEQ ID NO: 414743 - DNA, 20 bp, Artificial Sequence
  chemically synthesized
aatggaaaaatagtcatggg

SEQ ID NO: 414744 - DNA, 20 bp, Artificial Sequence
  chemically synthesized
gcaatggaaaaatagtcatg

SEQ ID NO: 414745 - DNA, 20 bp, Artificial Sequence
  chemically synthesized
tgcaatggaaaaatagtcat

SEQ ID NO: 414746 - DNA, 20 bp, Artificial Sequence
  chemically synthesized
ttgcaatggaaaaatagtca

SEQ ID NO: 414747 - DNA, 20 bp, Artificial Sequence
  chemically synthesized
acttaattgcaatggaaaaa

SEQ ID NO: 414748 - DNA, 20 bp, Artificial Sequence
  chemically synthesized
gtgcgtggacttaattgcaa

SEQ ID NO: 414749 - DNA, 20 bp, Artificial Sequence
  chemically synthesized
actatttttccattgcaatt

SEQ ID NO: 414750 - DNA, 20 bp, Artificial Sequence
  chemically synthesized
gcaattaagtccacgcacat

SEQ ID NO: 414751 - DNA, 20 bp, Artificial Sequence
  chemically synthesized
gtattccaacccaatgtgcg

SEQ ID NO: 414752 - DNA, 20 bp, Artificial Sequence
  chemically synthesized
caattaagtccacgcacatt

SEQ ID NO: 414753 - DNA, 20 bp, Artificial Sequence
  chemically synthesized
taagtccacgcacattgggt

SEQ ID NO: 414754 - DNA, 20 bp, Artificial Sequence
  chemically synthesized
attgggttggaataccccac

SEQ ID NO: 414755 - DNA, 20 bp, Artificial Sequence
  chemically synthesized
gggttggaataccccaccag

SEQ ID NO: 414756 - DNA, 20 bp, Artificial Sequence
  chemically synthesized
tgttactctgtctactggtg

SEQ ID NO: 414757 - DNA, 20 bp, Artificial Sequence
  chemically synthesized
ctgttactctgtctactggt

SEQ ID NO: 414758 - DNA, 20 bp, Artificial Sequence
  chemically synthesized
tctgttactctgtctactgg

SEQ ID NO: 414759 - DNA, 20 bp, Artificial Sequence
  chemically synthesized
tggaataccccaccagtaga

SEQ ID NO: 414760 - DNA, 20 bp, Artificial Sequence
  chemically synthesized
gaataccccaccagtagaca

SEQ ID NO: 414761 - DNA, 20 bp, Artificial Sequence
  chemically synthesized
gactctgttactctgtctac

SEQ ID NO: 414762 - DNA, 20 bp, Artificial Sequence
  chemically synthesized
cccaccagtagacagagtaa

SEQ ID NO: 414763 - DNA, 20 bp, Artificial Sequence
  chemically synthesized
caccagtagacagagtaaca

SEQ ID NO: 414764 - DNA, 20 bp, Artificial Sequence
  chemically synthesized
agtagacagagtaacagagt

SEQ ID NO: 414765 - DNA, 20 bp, Artificial Sequence
  chemically synthesized
agagtaacagagtcagcccc

SEQ ID NO: 414766 - DNA, 20 bp, Artificial Sequence
  chemically synthesized
acagagtcagcccccagtcc

SEQ ID NO: 414767 - DNA, 20 bp, Artificial Sequence
  chemically synthesized
gcctaattctcttggactgg

SEQ ID NO: 414768 - DNA, 20 bp, Artificial Sequence
  chemically synthesized
tgcctaattctcttggactg

SEQ ID NO: 414769 - DNA, 20 bp, Artificial Sequence
  chemically synthesized
agagtcagcccccagtccaa

SEQ ID NO: 414770 - DNA, 20 bp, Artificial Sequence
  chemically synthesized
ctgcctaattctcttggact

SEQ ID NO: 414771 - DNA, 20 bp, Artificial Sequence
  chemically synthesized
gctgcctaattctcttggac

SEQ ID NO: 414772 - DNA, 20 bp, Artificial Sequence
  chemically synthesized
agcccccagtccaagagaat

SEQ ID NO: 414773 - DNA, 20 bp, Artificial Sequence
  chemically synthesized
aagtggctgcctaattctct

SEQ ID NO: 414774 - DNA, 20 bp, Artificial Sequence
  chemically synthesized
gcccccagtccaagagaatt

SEQ ID NO: 414775 - DNA, 20 bp, Artificial Sequence
  chemically synthesized
cccagtccaagagaattagg

SEQ ID NO: 414776 - DNA, 20 bp, Artificial Sequence
  chemically synthesized
aagagaattaggcagccact

SEQ ID NO: 414777 - DNA, 20 bp, Artificial Sequence
  chemically synthesized
agagaattaggcagccactt

SEQ ID NO: 414778 - DNA, 20 bp, Artificial Sequence
  chemically synthesized
gatccagaaggcagcccaag

SEQ ID NO: 414779 - DNA, 20 bp, Artificial Sequence
  chemically synthesized
atggatccagaaggcagccc

SEQ ID NO: 414780 - DNA, 20 bp, Artificial Sequence
  chemically synthesized
cagccacttgggctgccttc

SEQ ID NO: 414781 - DNA, 20 bp, Artificial Sequence
  chemically synthesized
tcagtgatggatccagaagg

SEQ ID NO: 414782 - DNA, 20 bp, Artificial Sequence
  chemically synthesized
ctttcagtgatggatccaga

SEQ ID NO: 414783 - DNA, 20 bp, Artificial Sequence
  chemically synthesized
cctttcagtgatggatccag

SEQ ID NO: 414784 - DNA, 20 bp, Artificial Sequence
  chemically synthesized
ccccctttcagtgatggatc

SEQ ID NO: 414785 - DNA, 20 bp, Artificial Sequence
  chemically synthesized
ccttctggatccatcactga

SEQ ID NO: 414786 - DNA, 20 bp, Artificial Sequence
  chemically synthesized
tggtggccccctttcagtga

SEQ ID NO: 414787 - DNA, 20 bp, Artificial Sequence
  chemically synthesized
cttctggatccatcactgaa

SEQ ID NO: 414788 - DNA, 20 bp, Artificial Sequence
  chemically synthesized
ttctggatccatcactgaaa

SEQ ID NO: 414789 - DNA, 20 bp, Artificial Sequence
  chemically synthesized
tctggatccatcactgaaag

SEQ ID NO: 414790 - DNA, 20 bp, Artificial Sequence
  chemically synthesized
ctggatccatcactgaaagg

SEQ ID NO: 414791 - DNA, 20 bp, Artificial Sequence
  chemically synthesized
gttgtttggtggcccccttt

SEQ ID NO: 414792 - DNA, 20 bp, Artificial Sequence
  chemically synthesized
gctacctgcctgttgtttgg

SEQ ID NO: 414793 - DNA, 20 bp, Artificial Sequence
  chemically synthesized
gaaagggggccaccaaacaa

SEQ ID NO: 414794 - DNA, 20 bp, Artificial Sequence
  chemically synthesized
aaagggggccaccaaacaac

SEQ ID NO: 414795 - DNA, 20 bp, Artificial Sequence
  chemically synthesized
gtggctacctgcctgttgtt

SEQ ID NO: 414796 - DNA, 20 bp, Artificial Sequence
  chemically synthesized
gggggccaccaaacaacagg

SEQ ID NO: 414797 - DNA, 20 bp, Artificial Sequence
  chemically synthesized
ggggccaccaaacaacaggc

SEQ ID NO: 414798 - DNA, 20 bp, Artificial Sequence
  chemically synthesized
gccaccaaacaacaggcagg

SEQ ID NO: 414799 - DNA, 20 bp, Artificial Sequence
  chemically synthesized
aaacaacaggcaggtagcca

SEQ ID NO: 414800 - DNA, 20 bp, Artificial Sequence
  chemically synthesized
aacaacaggcaggtagccac

SEQ ID NO: 414801 - DNA, 20 bp, Artificial Sequence
  chemically synthesized
acaacaggcaggtagccaca

SEQ ID NO: 414802 - DNA, 20 bp, Artificial Sequence
  chemically synthesized
caacaggcaggtagccacag

SEQ ID NO: 414803 - DNA, 20 bp, Artificial Sequence
  chemically synthesized
ctcacccaggattgcccctg

SEQ ID NO: 414804 - DNA, 20 bp, Artificial Sequence
  chemically synthesized
ggtagccacaggggcaatcc

SEQ ID NO: 414805 - DNA, 20 bp, Artificial Sequence
  chemically synthesized
gtagccacaggggcaatcct

SEQ ID NO: 414806 - DNA, 20 bp, Artificial Sequence
  chemically synthesized
ccacaggggcaatcctgggt

SEQ ID NO: 414807 - DNA, 20 bp, Artificial Sequence
  chemically synthesized
acaaatttgggggctcaccc

SEQ ID NO: 414808 - DNA, 20 bp, Artificial Sequence
  chemically synthesized
tacaaatttgggggctcacc

SEQ ID NO: 414809 - DNA, 20 bp, Artificial Sequence
  chemically synthesized
ttgggtggttacaaatttgg

SEQ ID NO: 414810 - DNA, 20 bp, Artificial Sequence
  chemically synthesized
cttgggtggttacaaatttg

SEQ ID NO: 414811 - DNA, 20 bp, Artificial Sequence
  chemically synthesized
ccttgggtggttacaaattt

SEQ ID NO: 414812 - DNA, 20 bp, Artificial Sequence
  chemically synthesized
cccttgggtggttacaaatt

SEQ ID NO: 414813 - DNA, 20 bp, Artificial Sequence
  chemically synthesized
ccccaaatttgtaaccaccc

SEQ ID NO: 414814 - DNA, 20 bp, Artificial Sequence
  chemically synthesized
cccaaatttgtaaccaccca

SEQ ID NO: 414815 - DNA, 20 bp, Artificial Sequence
  chemically synthesized
ccaaatttgtaaccacccaa

SEQ ID NO: 414816 - DNA, 20 bp, Artificial Sequence
  chemically synthesized
caaatttgtaaccacccaag

SEQ ID NO: 414817 - DNA, 20 bp, Artificial Sequence
  chemically synthesized
ggcaaggtgaaccccttggg

SEQ ID NO: 414818 - DNA, 20 bp, Artificial Sequence
  chemically synthesized
gtgggcaaggtgaacccctt

SEQ ID NO: 414819 - DNA, 20 bp, Artificial Sequence
  chemically synthesized
agtgggcaaggtgaacccct

SEQ ID NO: 414820 - DNA, 20 bp, Artificial Sequence
  chemically synthesized
ctctgtctaggcagtgggca

SEQ ID NO: 414821 - DNA, 20 bp, Artificial Sequence
  chemically synthesized
gctctgtctaggcagtgggc

SEQ ID NO: 414822 - DNA, 20 bp, Artificial Sequence
  chemically synthesized
ggttcaccttgcccactgcc

SEQ ID NO: 414823 - DNA, 20 bp, Artificial Sequence
  chemically synthesized
gtcagctctgtctaggcagt

SEQ ID NO: 414824 - DNA, 20 bp, Artificial Sequence
  chemically synthesized
agtcagctctgtctaggcag

SEQ ID NO: 414825 - DNA, 20 bp, Artificial Sequence
  chemically synthesized
caccttgcccactgcctaga

SEQ ID NO: 414826 - DNA, 20 bp, Artificial Sequence
  chemically synthesized
ctgagtcagctctgtctagg

SEQ ID NO: 414827 - DNA, 20 bp, Artificial Sequence
  chemically synthesized
ccttgcccactgcctagaca

SEQ ID NO: 414828 - DNA, 20 bp, Artificial Sequence
  chemically synthesized
ttgctgagtcagctctgtct

SEQ ID NO: 414829 - DNA, 20 bp, Artificial Sequence
  chemically synthesized
cttgctgagtcagctctgtc

SEQ ID NO: 414830 - DNA, 20 bp, Artificial Sequence
  chemically synthesized
ctgcctagacagagctgact

SEQ ID NO: 414831 - DNA, 20 bp, Artificial Sequence
  chemically synthesized
ctagacagagctgactcagc

SEQ ID NO: 414832 - DNA, 20 bp, Artificial Sequence
  chemically synthesized
attcccctgtcttgctgagt

SEQ ID NO: 414833 - DNA, 20 bp, Artificial Sequence
  chemically synthesized
acagagctgactcagcaaga

SEQ ID NO: 414834 - DNA, 20 bp, Artificial Sequence
  chemically synthesized
tgcaattcccctgtcttgct

SEQ ID NO: 414835 - DNA, 20 bp, Artificial Sequence
  chemically synthesized
cagagctgactcagcaagac

SEQ ID NO: 414836 - DNA, 20 bp, Artificial Sequence
  chemically synthesized
agagctgactcagcaagaca

SEQ ID NO: 414837 - DNA, 20 bp, Artificial Sequence
  chemically synthesized
gagctgactcagcaagacag

SEQ ID NO: 414838 - DNA, 20 bp, Artificial Sequence
  chemically synthesized
aagacaggggaattgcaatg

SEQ ID NO: 414839 - DNA, 20 bp, Artificial Sequence
  chemically synthesized
caggggaattgcaatgaaga

SEQ ID NO: 414840 - DNA, 20 bp, Artificial Sequence
  chemically synthesized
ggggaattgcaatgaagaaa

SEQ ID NO: 414841 - DNA, 20 bp, Artificial Sequence
  chemically synthesized
tgaagaaagagtaattcatg

SEQ ID NO: 414842 - DNA, 20 bp, Artificial Sequence
  chemically synthesized
aagaaagagtaattcatgca

SEQ ID NO: 414843 - DNA, 20 bp, Artificial Sequence
  chemically synthesized
aagagtaattcatgcagagc

SEQ ID NO: 414844 - DNA, 20 bp, Artificial Sequence
  chemically synthesized
ttcatgcagagctggctgtg

SEQ ID NO: 414845 - DNA, 20 bp, Artificial Sequence
  chemically synthesized
tcatgcagagctggctgtgt

SEQ ID NO: 414846 - DNA, 20 bp, Artificial Sequence
  chemically synthesized
actccagtgtcccacacagc

SEQ ID NO: 414847 - DNA, 20 bp, Artificial Sequence
  chemically synthesized
caaaactccagtgtcccaca

SEQ ID NO: 414848 - DNA, 20 bp, Artificial Sequence
  chemically synthesized
gagctggctgtgtgggacac

SEQ ID NO: 414849 - DNA, 20 bp, Artificial Sequence
  chemically synthesized
gctggctgtgtgggacactg

SEQ ID NO: 414850 - DNA, 20 bp, Artificial Sequence
  chemically synthesized
tttgagtaataacaaaactc

SEQ ID NO: 414851 - DNA, 20 bp, Artificial Sequence
  chemically synthesized
agttttgttattactcaaat

SEQ ID NO: 414852 - DNA, 20 bp, Artificial Sequence
  chemically synthesized
ggagaccgatttgctgattt

SEQ ID NO: 414853 - DNA, 20 bp, Artificial Sequence
  chemically synthesized
tattactcaaatcagcaaat

SEQ ID NO: 414854 - DNA, 20 bp, Artificial Sequence
  chemically synthesized
aatcagcaaatcggtctccc

SEQ ID NO: 414855 - DNA, 20 bp, Artificial Sequence
  chemically synthesized
atcagcaaatcggtctcccc

SEQ ID NO: 414856 - DNA, 20 bp, Artificial Sequence
  chemically synthesized
ctgttccccgaatgcctggg

SEQ ID NO: 414857 - DNA, 20 bp, Artificial Sequence
  chemically synthesized
ctctgttccccgaatgcctg

SEQ ID NO: 414858 - DNA, 20 bp, Artificial Sequence
  chemically synthesized
aatcggtctccccaggcatt

SEQ ID NO: 414859 - DNA, 20 bp, Artificial Sequence
  chemically synthesized
actctgttccccgaatgcct

SEQ ID NO: 414860 - DNA, 20 bp, Artificial Sequence
  chemically synthesized
atcggtctccccaggcattc

SEQ ID NO: 414861 - DNA, 20 bp, Artificial Sequence
  chemically synthesized
aactctgttccccgaatgcc

SEQ ID NO: 414862 - DNA, 20 bp, Artificial Sequence
  chemically synthesized
tcggtctccccaggcattcg

SEQ ID NO: 414863 - DNA, 20 bp, Artificial Sequence
  chemically synthesized
ctccccaggcattcggggaa

SEQ ID NO: 414864 - DNA, 20 bp, Artificial Sequence
  chemically synthesized
ccccaggcattcggggaaca

SEQ ID NO: 414865 - DNA, 20 bp, Artificial Sequence
  chemically synthesized
attcggggaacagagttttt

SEQ ID NO: 414866 - DNA, 20 bp, Artificial Sequence
  chemically synthesized
ttcggggaacagagttttta

SEQ ID NO: 414867 - DNA, 20 bp, Artificial Sequence
  chemically synthesized
cagagtttttaaggataact

SEQ ID NO: 414868 - DNA, 20 bp, Artificial Sequence
  chemically synthesized
agtttttaaggataacttgg

SEQ ID NO: 414869 - DNA, 20 bp, Artificial Sequence
  chemically synthesized
gtttttaaggataacttggt

SEQ ID NO: 414870 - DNA, 20 bp, Artificial Sequence
  chemically synthesized
ttaaggataacttggtgggt

SEQ ID NO: 414871 - DNA, 20 bp, Artificial Sequence
  chemically synthesized
ctggcttcccccgacccacc

SEQ ID NO: 414872 - DNA, 20 bp, Artificial Sequence
  chemically synthesized
taaggataacttggtgggtc

SEQ ID NO: 414873 - DNA, 20 bp, Artificial Sequence
  chemically synthesized
aaggataacttggtgggtcg

SEQ ID NO: 414874 - DNA, 20 bp, Artificial Sequence
  chemically synthesized
aggataacttggtgggtcgg

SEQ ID NO: 414875 - DNA, 20 bp, Artificial Sequence
  chemically synthesized
ataacttggtgggtcggggg

SEQ ID NO: 414876 - DNA, 20 bp, Artificial Sequence
  chemically synthesized
cttggtgggtcgggggaagc

SEQ ID NO: 414877 - DNA, 20 bp, Artificial Sequence
  chemically synthesized
gtgggtcgggggaagccagt

SEQ ID NO: 414878 - DNA, 20 bp, Artificial Sequence
  chemically synthesized
gtcgggggaagccagtgagc

SEQ ID NO: 414879 - DNA, 20 bp, Artificial Sequence
  chemically synthesized
tcgggggaagccagtgagcc

SEQ ID NO: 414880 - DNA, 20 bp, Artificial Sequence
  chemically synthesized
agtcagcactcctggctcac

SEQ ID NO: 414881 - DNA, 20 bp, Artificial Sequence
  chemically synthesized
gggggaagccagtgagccag

SEQ ID NO: 414882 - DNA, 20 bp, Artificial Sequence
  chemically synthesized
ctctgaccagtcagcactcc

SEQ ID NO: 414883 - DNA, 20 bp, Artificial Sequence
  chemically synthesized
agtgagccaggagtgctgac

SEQ ID NO: 414884 - DNA, 20 bp, Artificial Sequence
  chemically synthesized
agccaggagtgctgactggt

SEQ ID NO: 414885 - DNA, 20 bp, Artificial Sequence
  chemically synthesized
tgatttcatctctgaccagt

SEQ ID NO: 414886 - DNA, 20 bp, Artificial Sequence
  chemically synthesized
ccaggagtgctgactggtca

SEQ ID NO: 414887 - DNA, 20 bp, Artificial Sequence
  chemically synthesized
cctgtgatttcatctctgac

SEQ ID NO: 414888 - DNA, 20 bp, Artificial Sequence
  chemically synthesized
actggtcagagatgaaatca

SEQ ID NO: 414889 - DNA, 20 bp, Artificial Sequence
  chemically synthesized
ctggtcagagatgaaatcac

SEQ ID NO: 414890 - DNA, 20 bp, Artificial Sequence
  chemically synthesized
tggtcagagatgaaatcaca

SEQ ID NO: 414891 - DNA, 20 bp, Artificial Sequence
  chemically synthesized
gtcagagatgaaatcacagg

SEQ ID NO: 414892 - DNA, 20 bp, Artificial Sequence
  chemically synthesized
gagatgaaatcacagggagt

SEQ ID NO: 414893 - DNA, 20 bp, Artificial Sequence
  chemically synthesized
gatgaaatcacagggagttg

SEQ ID NO: 414894 - DNA, 20 bp, Artificial Sequence
  chemically synthesized
actgactcagcgcaagaaga

SEQ ID NO: 414895 - DNA, 20 bp, Artificial Sequence
  chemically synthesized
aggaactgactcagcgcaag

SEQ ID NO: 414896 - DNA, 20 bp, Artificial Sequence
  chemically synthesized
tggagctgtcttcttgcgct

SEQ ID NO: 414897 - DNA, 20 bp, Artificial Sequence
  chemically synthesized
cccaggaactgactcagcgc

SEQ ID NO: 414898 - DNA, 20 bp, Artificial Sequence
  chemically synthesized
gctgtcttcttgcgctgagt

SEQ ID NO: 414899 - DNA, 20 bp, Artificial Sequence
  chemically synthesized
cctccacccaggaactgact

SEQ ID NO: 414900 - DNA, 20 bp, Artificial Sequence
  chemically synthesized
tcttgcgctgagtcagttcc

SEQ ID NO: 414901 - DNA, 20 bp, Artificial Sequence
  chemically synthesized
cttgcgctgagtcagttcct

SEQ ID NO: 414902 - DNA, 20 bp, Artificial Sequence
  chemically synthesized
gcgctgagtcagttcctggg

SEQ ID NO: 414903 - DNA, 20 bp, Artificial Sequence
  chemically synthesized
gctgagtcagttcctgggtg

SEQ ID NO: 414904 - DNA, 20 bp, Artificial Sequence
  chemically synthesized
ctgagtcagttcctgggtgg

SEQ ID NO: 414905 - DNA, 20 bp, Artificial Sequence
  chemically synthesized
tgatcttgtggcctccaccc

SEQ ID NO: 414906 - DNA, 20 bp, Artificial Sequence
  chemically synthesized
ctgatcttgtggcctccacc

SEQ ID NO: 414907 - DNA, 20 bp, Artificial Sequence
  chemically synthesized
agttcctgggtggaggccac

SEQ ID NO: 414908 - DNA, 20 bp, Artificial Sequence
  chemically synthesized
ctgggtggaggccacaagat

SEQ ID NO: 414909 - DNA, 20 bp, Artificial Sequence
  chemically synthesized
aactggctcatctgatcttg

SEQ ID NO: 414910 - DNA, 20 bp, Artificial Sequence
  chemically synthesized
tggaggccacaagatcagat

SEQ ID NO: 414911 - DNA, 20 bp, Artificial Sequence
  chemically synthesized
ggccacaagatcagatgagc

SEQ ID NO: 414912 - DNA, 20 bp, Artificial Sequence
  chemically synthesized
cactacccatatcaataaac

SEQ ID NO: 414913 - DNA, 20 bp, Artificial Sequence
  chemically synthesized
gatgagccagtttattgata

SEQ ID NO: 414914 - DNA, 20 bp, Artificial Sequence
  chemically synthesized
atgagccagtttattgatat

SEQ ID NO: 414915 - DNA, 20 bp, Artificial Sequence
  chemically synthesized
agccagtttattgatatggg

SEQ ID NO: 414916 - DNA, 20 bp, Artificial Sequence
  chemically synthesized
tttattgatatgggtagtgc

SEQ ID NO: 414917 - DNA, 20 bp, Artificial Sequence
  chemically synthesized
cctgcacttgatggatcagc

SEQ ID NO: 414918 - DNA, 20 bp, Artificial Sequence
  chemically synthesized
gtagtgccagctgatccatc

SEQ ID NO: 414919 - DNA, 20 bp, Artificial Sequence
  chemically synthesized
agaccctgcacttgatggat

SEQ ID NO: 414920 - DNA, 20 bp, Artificial Sequence
  chemically synthesized
gccagctgatccatcaagtg

SEQ ID NO: 414921 - DNA, 20 bp, Artificial Sequence
  chemically synthesized
tttgcagaccctgcacttga

SEQ ID NO: 414922 - DNA, 20 bp, Artificial Sequence
  chemically synthesized
ccagctgatccatcaagtgc

SEQ ID NO: 414923 - DNA, 20 bp, Artificial Sequence
  chemically synthesized
cagctgatccatcaagtgca

SEQ ID NO: 414924 - DNA, 20 bp, Artificial Sequence
  chemically synthesized
tcagtgcttgagataatttg

SEQ ID NO: 414925 - DNA, 20 bp, Artificial Sequence
  chemically synthesized
cagggtctgcaaattatctc

SEQ ID NO: 414926 - DNA, 20 bp, Artificial Sequence
  chemically synthesized
tgctcctaagatcagtgctt

SEQ ID NO: 414927 - DNA, 20 bp, Artificial Sequence
  chemically synthesized
attatctcaagcactgatct

SEQ ID NO: 414928 - DNA, 20 bp, Artificial Sequence
  chemically synthesized
ttatctcaagcactgatctt

SEQ ID NO: 414929 - DNA, 20 bp, Artificial Sequence
  chemically synthesized
atctcaagcactgatcttag

SEQ ID NO: 414930 - DNA, 20 bp, Artificial Sequence
  chemically synthesized
caccaaactgctcctaagat

SEQ ID NO: 414931 - DNA, 20 bp, Artificial Sequence
  chemically synthesized
tcaagcactgatcttaggag

SEQ ID NO: 414932 - DNA, 20 bp, Artificial Sequence
  chemically synthesized
acccccaccaaactgctcct

SEQ ID NO: 414933 - DNA, 20 bp, Artificial Sequence
  chemically synthesized
cactgatcttaggagcagtt

SEQ ID NO: 414934 - DNA, 20 bp, Artificial Sequence
  chemically synthesized
tgatcttaggagcagtttgg

SEQ ID NO: 414935 - DNA, 20 bp, Artificial Sequence
  chemically synthesized
gatcttaggagcagtttggt

SEQ ID NO: 414936 - DNA, 20 bp, Artificial Sequence
  chemically synthesized
atcttaggagcagtttggtg

SEQ ID NO: 414937 - DNA, 20 bp, Artificial Sequence
  chemically synthesized
tcttaggagcagtttggtgg

SEQ ID NO: 414938 - DNA, 20 bp, Artificial Sequence
  chemically synthesized
aggagcagtttggtgggggt

SEQ ID NO: 414939 - DNA, 20 bp, Artificial Sequence
  chemically synthesized
gtcatgcagctggaggcaac

SEQ ID NO: 414940 - DNA, 20 bp, Artificial Sequence
  chemically synthesized
ggtcagaatcttgttgcctc

SEQ ID NO: 414941 - DNA, 20 bp, Artificial Sequence
  chemically synthesized
tttaggagtcatgcagctgg

SEQ ID NO: 414942 - DNA, 20 bp, Artificial Sequence
  chemically synthesized
gtttaggagtcatgcagctg

SEQ ID NO: 414943 - DNA, 20 bp, Artificial Sequence
  chemically synthesized
tggtttaggagtcatgcagc

SEQ ID NO: 414944 - DNA, 20 bp, Artificial Sequence
  chemically synthesized
attatggtttaggagtcatg

SEQ ID NO: 414945 - DNA, 20 bp, Artificial Sequence
  chemically synthesized
tattagaaattatggtttag

SEQ ID NO: 414946 - DNA, 20 bp, Artificial Sequence
  chemically synthesized
agtattagaaattatggttt

SEQ ID NO: 414947 - DNA, 20 bp, Artificial Sequence
  chemically synthesized
cagtattagaaattatggtt

SEQ ID NO: 414948 - DNA, 20 bp, Artificial Sequence
  chemically synthesized
agccacagtattagaaatta

SEQ ID NO: 414949 - DNA, 20 bp, Artificial Sequence
  chemically synthesized
aaccataatttctaatactg

SEQ ID NO: 414950 - DNA, 20 bp, Artificial Sequence
  chemically synthesized
actaacatcagccacagtat

SEQ ID NO: 414951 - DNA, 20 bp, Artificial Sequence
  chemically synthesized
tgtaggactaacatcagcca

SEQ ID NO: 414952 - DNA, 20 bp, Artificial Sequence
  chemically synthesized
tctaatactgtggctgatgt

SEQ ID NO: 414953 - DNA, 20 bp, Artificial Sequence
  chemically synthesized
tgcctctgtaggactaacat

SEQ ID NO: 414954 - DNA, 20 bp, Artificial Sequence
  chemically synthesized
tgtggctgatgttagtccta

SEQ ID NO: 414955 - DNA, 20 bp, Artificial Sequence
  chemically synthesized
tggctgatgttagtcctaca

SEQ ID NO: 414956 - DNA, 20 bp, Artificial Sequence
  chemically synthesized
ggctgatgttagtcctacag

SEQ ID NO: 414957 - DNA, 20 bp, Artificial Sequence
  chemically synthesized
ggggactagattgcctctgt

SEQ ID NO: 414958 - DNA, 20 bp, Artificial Sequence
  chemically synthesized
tggggactagattgcctctg

SEQ ID NO: 414959 - DNA, 20 bp, Artificial Sequence
  chemically synthesized
ttagtcctacagaggcaatc

SEQ ID NO: 414960 - DNA, 20 bp, Artificial Sequence
  chemically synthesized
tacagaggcaatctagtccc

SEQ ID NO: 414961 - DNA, 20 bp, Artificial Sequence
  chemically synthesized
acagaggcaatctagtcccc

SEQ ID NO: 414962 - DNA, 20 bp, Artificial Sequence
  chemically synthesized
agaccttcttgcctggggac

SEQ ID NO: 414963 - DNA, 20 bp, Artificial Sequence
  chemically synthesized
aggcaatctagtccccaggc

SEQ ID NO: 414964 - DNA, 20 bp, Artificial Sequence
  chemically synthesized
aaagcagaccttcttgcctg

SEQ ID NO: 414965 - DNA, 20 bp, Artificial Sequence
  chemically synthesized
caatctagtccccaggcaag

SEQ ID NO: 414966 - DNA, 20 bp, Artificial Sequence
  chemically synthesized
caaagcagaccttcttgcct

SEQ ID NO: 414967 - DNA, 20 bp, Artificial Sequence
  chemically synthesized
aatctagtccccaggcaaga

SEQ ID NO: 414968 - DNA, 20 bp, Artificial Sequence
  chemically synthesized
ccaaagcagaccttcttgcc

SEQ ID NO: 414969 - DNA, 20 bp, Artificial Sequence
  chemically synthesized
ccaggcaagaaggtctgctt

SEQ ID NO: 414970 - DNA, 20 bp, Artificial Sequence
  chemically synthesized
caggcaagaaggtctgcttt

SEQ ID NO: 414971 - DNA, 20 bp, Artificial Sequence
  chemically synthesized
ataacagccctttcccaaag

SEQ ID NO: 414972 - DNA, 20 bp, Artificial Sequence
  chemically synthesized
caagaaggtctgctttggga

SEQ ID NO: 414973 - DNA, 20 bp, Artificial Sequence
  chemically synthesized
aagaaggtctgctttgggaa

SEQ ID NO: 414974 - DNA, 20 bp, Artificial Sequence
  chemically synthesized
agaaggtctgctttgggaaa

SEQ ID NO: 414975 - DNA, 20 bp, Artificial Sequence
  chemically synthesized
atcataacagccctttccca

SEQ ID NO: 414976 - DNA, 20 bp, Artificial Sequence
  chemically synthesized
cgtttaaacaaacatcataa

SEQ ID NO: 414977 - DNA, 20 bp, Artificial Sequence
  chemically synthesized
ttaaacgataaactataaat

SEQ ID NO: 414978 - DNA, 20 bp, Artificial Sequence
  chemically synthesized
ttctaacctccactaattta

SEQ ID NO: 414979 - DNA, 20 bp, Artificial Sequence
  chemically synthesized
aacgataaactataaattag

SEQ ID NO: 414980 - DNA, 20 bp, Artificial Sequence
  chemically synthesized
cgataaactataaattagtg

SEQ ID NO: 414981 - DNA, 20 bp, Artificial Sequence
  chemically synthesized
gataaactataaattagtgg

SEQ ID NO: 414982 - DNA, 20 bp, Artificial Sequence
  chemically synthesized
aactataaattagtggaggt

SEQ ID NO: 414983 - DNA, 20 bp, Artificial Sequence
  chemically synthesized
tataaattagtggaggttag

SEQ ID NO: 414984 - DNA, 20 bp, Artificial Sequence
  chemically synthesized
aattagtggaggttagaagc

SEQ ID NO: 414985 - DNA, 20 bp, Artificial Sequence
  chemically synthesized
agtggaggttagaagcaaga

SEQ ID NO: 414986 - DNA, 20 bp, Artificial Sequence
  chemically synthesized
tggaggttagaagcaagatg

SEQ ID NO: 414987 - DNA, 20 bp, Artificial Sequence
  chemically synthesized
ggttagaagcaagatggagt

SEQ ID NO: 414988 - DNA, 20 bp, Artificial Sequence
  chemically synthesized
gaagcaagatggagtcagtt

SEQ ID NO: 414989 - DNA, 20 bp, Artificial Sequence
  chemically synthesized
caagatggagtcagttaagt

SEQ ID NO: 414990 - DNA, 20 bp, Artificial Sequence
  chemically synthesized
ttaggactgagacagtgaaa

SEQ ID NO: 414991 - DNA, 20 bp, Artificial Sequence
  chemically synthesized
aattaggactgagacagtga

SEQ ID NO: 414992 - DNA, 20 bp, Artificial Sequence
  chemically synthesized
ttagatctctttcactgtct

SEQ ID NO: 414993 - DNA, 20 bp, Artificial Sequence
  chemically synthesized
ctgcaaaattaggactgaga

SEQ ID NO: 414994 - DNA, 20 bp, Artificial Sequence
  chemically synthesized
accactgcaaaattaggact

SEQ ID NO: 414995 - DNA, 20 bp, Artificial Sequence
  chemically synthesized
ctgtctcagtcctaattttg

SEQ ID NO: 414996 - DNA, 20 bp, Artificial Sequence
  chemically synthesized
gaaaccaccactgcaaaatt

SEQ ID NO: 414997 - DNA, 20 bp, Artificial Sequence
  chemically synthesized
tgaaaccaccactgcaaaat

SEQ ID NO: 414998 - DNA, 20 bp, Artificial Sequence
  chemically synthesized
tctcagtcctaattttgcag

SEQ ID NO: 414999 - DNA, 20 bp, Artificial Sequence
  chemically synthesized
cagtcctaattttgcagtgg

SEQ ID NO: 415000 - DNA, 20 bp, Artificial Sequence
  chemically synthesized
tatggtaaaataaagtataa

SEQ ID NO: 415001 - DNA, 20 bp, Artificial Sequence
  chemically synthesized
ttatggtaaaataaagtata

SEQ ID NO: 415002 - DNA, 20 bp, Artificial Sequence
  chemically synthesized
tttatggtaaaataaagtat

SEQ ID NO: 415003 - DNA, 20 bp, Artificial Sequence
  chemically synthesized
catttgtttatggtaaaata

SEQ ID NO: 415004 - DNA, 20 bp, Artificial Sequence
  chemically synthesized
actaaaagctcatttgttta

SEQ ID NO: 415005 - DNA, 20 bp, Artificial Sequence
  chemically synthesized
ttattttaccataaacaaat

SEQ ID NO: 415006 - DNA, 20 bp, Artificial Sequence
  chemically synthesized
accataaacaaatgagcttt

SEQ ID NO: 415007 - DNA, 20 bp, Artificial Sequence
  chemically synthesized
tcattagaattcattactaa

SEQ ID NO: 415008 - DNA, 20 bp, Artificial Sequence
  chemically synthesized
ccccaccccattgcagtcat

SEQ ID NO: 415009 - DNA, 20 bp, Artificial Sequence
  chemically synthesized
atgaattctaatgactgcaa

SEQ ID NO: 415010 - DNA, 20 bp, Artificial Sequence
  chemically synthesized
tgaattctaatgactgcaat

SEQ ID NO: 415011 - DNA, 20 bp, Artificial Sequence
  chemically synthesized
gaattctaatgactgcaatg

SEQ ID NO: 415012 - DNA, 20 bp, Artificial Sequence
  chemically synthesized
tcaccacccccaccccattg

SEQ ID NO: 415013 - DNA, 20 bp, Artificial Sequence
  chemically synthesized
ttctaatgactgcaatgggg

SEQ ID NO: 415014 - DNA, 20 bp, Artificial Sequence
  chemically synthesized
tctaatgactgcaatggggt

SEQ ID NO: 415015 - DNA, 20 bp, Artificial Sequence
  chemically synthesized
ctaatgactgcaatggggtg

SEQ ID NO: 415016 - DNA, 20 bp, Artificial Sequence
  chemically synthesized
taatgactgcaatggggtgg

SEQ ID NO: 415017 - DNA, 20 bp, Artificial Sequence
  chemically synthesized
tgactgcaatggggtggggg

SEQ ID NO: 415018 - DNA, 20 bp, Artificial Sequence
  chemically synthesized
tgcaatggggtgggggtggt

SEQ ID NO: 415019 - DNA, 20 bp, Artificial Sequence
  chemically synthesized
ggtggtgagttaattgttat

SEQ ID NO: 415020 - DNA, 20 bp, Artificial Sequence
  chemically synthesized
ttaattgttatcagttgtac

SEQ ID NO: 415021 - DNA, 20 bp, Artificial Sequence
  chemically synthesized
taattgttatcagttgtaca

SEQ ID NO: 415022 - DNA, 20 bp, Artificial Sequence
  chemically synthesized
tgtacaaggttgttttattg

SEQ ID NO: 415023 - DNA, 20 bp, Artificial Sequence
  chemically synthesized
ttttattgtagctcaaatgt

SEQ ID NO: 415024 - DNA, 20 bp, Artificial Sequence
  chemically synthesized
ttccctttcctccaacattt

SEQ ID NO: 415025 - DNA, 20 bp, Artificial Sequence
  chemically synthesized
ttattgtagctcaaatgttg

SEQ ID NO: 415026 - DNA, 20 bp, Artificial Sequence
  chemically synthesized
tattgtagctcaaatgttgg

SEQ ID NO: 415027 - DNA, 20 bp, Artificial Sequence
  chemically synthesized
gtagctcaaatgttggagga

SEQ ID NO: 415028 - DNA, 20 bp, Artificial Sequence
  chemically synthesized
tagctcaaatgttggaggaa

SEQ ID NO: 415029 - DNA, 20 bp, Artificial Sequence
  chemically synthesized
agctcaaatgttggaggaaa

SEQ ID NO: 415030 - DNA, 20 bp, Artificial Sequence
  chemically synthesized
tcaaatgttggaggaaaggg

SEQ ID NO: 415031 - DNA, 20 bp, Artificial Sequence
  chemically synthesized
tggaggaaagggaagcttta

SEQ ID NO: 415032 - DNA, 20 bp, Artificial Sequence
  chemically synthesized
taatgaaacataataccata

SEQ ID NO: 415033 - DNA, 20 bp, Artificial Sequence
  chemically synthesized
gtattatgtttcattaaact

SEQ ID NO: 415034 - DNA, 20 bp, Artificial Sequence
  chemically synthesized
tatgtttcattaaactaaga

SEQ ID NO: 415035 - DNA, 20 bp, Artificial Sequence
  chemically synthesized
atgtttcattaaactaagat

SEQ ID NO: 415036 - DNA, 20 bp, Artificial Sequence
  chemically synthesized
acaattctgaaagcctatct

SEQ ID NO: 415037 - DNA, 20 bp, Artificial Sequence
  chemically synthesized
attaaactaagataggcttt

SEQ ID NO: 415038 - DNA, 20 bp, Artificial Sequence
  chemically synthesized
aatgttttgtacaattctga

SEQ ID NO: 415039 - DNA, 20 bp, Artificial Sequence
  chemically synthesized
aaatcatcagtaatacatat

SEQ ID NO: 415040 - DNA, 20 bp, Artificial Sequence
  chemically synthesized
taaatcatcagtaatacata

SEQ ID NO: 415041 - DNA, 20 bp, Artificial Sequence
  chemically synthesized
atatgtattactgatgattt

SEQ ID NO: 415042 - DNA, 20 bp, Artificial Sequence
  chemically synthesized
gatacactcacttaaatcat

SEQ ID NO: 415043 - DNA, 20 bp, Artificial Sequence
  chemically synthesized
gtattactgatgatttaagt

SEQ ID NO: 415044 - DNA, 20 bp, Artificial Sequence
  chemically synthesized
gatgatttaagtgagtgtat

SEQ ID NO: 415045 - DNA, 20 bp, Artificial Sequence
  chemically synthesized
atgatttaagtgagtgtatc

SEQ ID NO: 415046 - DNA, 20 bp, Artificial Sequence
  chemically synthesized
tgatttaagtgagtgtatca

SEQ ID NO: 415047 - DNA, 20 bp, Artificial Sequence
  chemically synthesized
tatcagggaaataacttgtt

SEQ ID NO: 415048 - DNA, 20 bp, Artificial Sequence
  chemically synthesized
tattccatttttcaccaaac

SEQ ID NO: 415049 - DNA, 20 bp, Artificial Sequence
  chemically synthesized
ataacttgtttggtgaaaaa

SEQ ID NO: 415050 - DNA, 20 bp, Artificial Sequence
  chemically synthesized
gtttggtgaaaaatggaata

SEQ ID NO: 415051 - DNA, 20 bp, Artificial Sequence
  chemically synthesized
gaagttgttgttatgttttc

SEQ ID NO: 415052 - DNA, 20 bp, Artificial Sequence
  chemically synthesized
cgaagttgttgttatgtttt

SEQ ID NO: 415053 - DNA, 20 bp, Artificial Sequence
  chemically synthesized
aaacataacaacaacttcgt

SEQ ID NO: 415054 - DNA, 20 bp, Artificial Sequence
  chemically synthesized
gagaaaatggacaacttacg

SEQ ID NO: 415055 - DNA, 20 bp, Artificial Sequence
  chemically synthesized
atattatttttatgagaaaa

SEQ ID NO: 415056 - DNA, 20 bp, Artificial Sequence
  chemically synthesized
taagtcaatattatttttat

SEQ ID NO: 415057 - DNA, 20 bp, Artificial Sequence
  chemically synthesized
cactaatttaatatataagt

SEQ ID NO: 415058 - DNA, 20 bp, Artificial Sequence
  chemically synthesized
gaatcactaatttaatatat

SEQ ID NO: 415059 - DNA, 20 bp, Artificial Sequence
  chemically synthesized
gacttacttatatattaaat

SEQ ID NO: 415060 - DNA, 20 bp, Artificial Sequence
  chemically synthesized
aattagtgattcaatttcta

SEQ ID NO: 415061 - DNA, 20 bp, Artificial Sequence
  chemically synthesized
attagtgattcaatttctaa

SEQ ID NO: 415062 - DNA, 20 bp, Artificial Sequence
  chemically synthesized
ttatatctttgtaaggcctt

SEQ ID NO: 415063 - DNA, 20 bp, Artificial Sequence
  chemically synthesized
caatttctaaaggccttaca

SEQ ID NO: 415064 - DNA, 20 bp, Artificial Sequence
  chemically synthesized
tactgaattatatctttgta

SEQ ID NO: 415065 - DNA, 20 bp, Artificial Sequence
  chemically synthesized
atactgaattatatctttgt

SEQ ID NO: 415066 - DNA, 20 bp, Artificial Sequence
  chemically synthesized
ggccttacaaagatataatt

SEQ ID NO: 415067 - DNA, 20 bp, Artificial Sequence
  chemically synthesized
agatataattcagtatttta

SEQ ID NO: 415068 - DNA, 20 bp, Artificial Sequence
  chemically synthesized
tatggtaattattttctaat

SEQ ID NO: 415069 - DNA, 20 bp, Artificial Sequence
  chemically synthesized
agtaaaagtaaatttctaat

SEQ ID NO: 415070 - DNA, 20 bp, Artificial Sequence
  chemically synthesized
ttagaaatttacttttacta

SEQ ID NO: 415071 - DNA, 20 bp, Artificial Sequence
  chemically synthesized
ggcacttagtgctatagtaa

SEQ ID NO: 415072 - DNA, 20 bp, Artificial Sequence
  chemically synthesized
tttacttttactatagcact

SEQ ID NO: 415073 - DNA, 20 bp, Artificial Sequence
  chemically synthesized
actggtggcacttagtgcta

SEQ ID NO: 415074 - DNA, 20 bp, Artificial Sequence
  chemically synthesized
taattaatactggtggcact

SEQ ID NO: 415075 - DNA, 20 bp, Artificial Sequence
  chemically synthesized
actatagcactaagtgccac

SEQ ID NO: 415076 - DNA, 20 bp, Artificial Sequence
  chemically synthesized
ataacaataattaatactgg

SEQ ID NO: 415077 - DNA, 20 bp, Artificial Sequence
  chemically synthesized
gaaataacaataattaatac

SEQ ID NO: 415078 - DNA, 20 bp, Artificial Sequence
  chemically synthesized
ctaggaacaagtatggtgta

SEQ ID NO: 415079 - DNA, 20 bp, Artificial Sequence
  chemically synthesized
actaggaacaagtatggtgt

SEQ ID NO: 415080 - DNA, 20 bp, Artificial Sequence
  chemically synthesized
tgttttactaggaacaagta

SEQ ID NO: 415081 - DNA, 20 bp, Artificial Sequence
  chemically synthesized
ccttacaccatacttgttcc

SEQ ID NO: 415082 - DNA, 20 bp, Artificial Sequence
  chemically synthesized
aagcttgttttactaggaac

SEQ ID NO: 415083 - DNA, 20 bp, Artificial Sequence
  chemically synthesized
tggctgaagcttgttttact

SEQ ID NO: 415084 - DNA, 20 bp, Artificial Sequence
  chemically synthesized
atacttgttcctagtaaaac

SEQ ID NO: 415085 - DNA, 20 bp, Artificial Sequence
  chemically synthesized
gtggctgaagcttgttttac

SEQ ID NO: 415086 - DNA, 20 bp, Artificial Sequence
  chemically synthesized
gttcctagtaaaacaagctt

SEQ ID NO: 415087 - DNA, 20 bp, Artificial Sequence
  chemically synthesized
tttatagagaacagtggctg

SEQ ID NO: 415088 - DNA, 20 bp, Artificial Sequence
  chemically synthesized
ccatattttatagagaacag

SEQ ID NO: 415089 - DNA, 20 bp, Artificial Sequence
  chemically synthesized
acaccatattttatagagaa

SEQ ID NO: 415090 - DNA, 20 bp, Artificial Sequence
  chemically synthesized
agaagacaccatattttata

SEQ ID NO: 415091 - DNA, 20 bp, Artificial Sequence
  chemically synthesized
ccactgttctctataaaata

SEQ ID NO: 415092 - DNA, 20 bp, Artificial Sequence
  chemically synthesized
ctagaagacaccatatttta

SEQ ID NO: 415093 - DNA, 20 bp, Artificial Sequence
  chemically synthesized
ctataaaatatggtgtcttc

SEQ ID NO: 415094 - DNA, 20 bp, Artificial Sequence
  chemically synthesized
aaaatatggtgtcttctaga

SEQ ID NO: 415095 - DNA, 20 bp, Artificial Sequence
  chemically synthesized
aaatatggtgtcttctagat

SEQ ID NO: 415096 - DNA, 20 bp, Artificial Sequence
  chemically synthesized
atattcttgttcccatctag

SEQ ID NO: 415097 - DNA, 20 bp, Artificial Sequence
  chemically synthesized
aaaatattcttgttcccatc

SEQ ID NO: 415098 - DNA, 20 bp, Artificial Sequence
  chemically synthesized
ggtgtcttctagatgggaac

SEQ ID NO: 415099 - DNA, 20 bp, Artificial Sequence
  chemically synthesized
gtcacaaccctagaaatggg

SEQ ID NO: 415100 - DNA, 20 bp, Artificial Sequence
  chemically synthesized
aacacataacctcccatttc

SEQ ID NO: 415101 - DNA, 20 bp, Artificial Sequence
  chemically synthesized
tgtcacaaccctagaaatgg

SEQ ID NO: 415102 - DNA, 20 bp, Artificial Sequence
  chemically synthesized
acacataacctcccatttct

SEQ ID NO: 415103 - DNA, 20 bp, Artificial Sequence
  chemically synthesized
cacataacctcccatttcta

SEQ ID NO: 415104 - DNA, 20 bp, Artificial Sequence
  chemically synthesized
tttgtcacaaccctagaaat

SEQ ID NO: 415105 - DNA, 20 bp, Artificial Sequence
  chemically synthesized
ttttgtcacaaccctagaaa

SEQ ID NO: 415106 - DNA, 20 bp, Artificial Sequence
  chemically synthesized
aatgcattttgtcacaaccc

SEQ ID NO: 415107 - DNA, 20 bp, Artificial Sequence
  chemically synthesized
aaaatgcattttatttcaaa

SEQ ID NO: 415108 - DNA, 20 bp, Artificial Sequence
  chemically synthesized
cacgcaatattaaaacaact

SEQ ID NO: 415109 - DNA, 20 bp, Artificial Sequence
  chemically synthesized
tgattaatgaaacataaact

SEQ ID NO: 415110 - DNA, 20 bp, Artificial Sequence
  chemically synthesized
cagtttatgtttcattaatc

SEQ ID NO: 415111 - DNA, 20 bp, Artificial Sequence
  chemically synthesized
tattatggatttacaaaatg

SEQ ID NO: 415112 - DNA, 20 bp, Artificial Sequence
  chemically synthesized
atattatggatttacaaaat

SEQ ID NO: 415113 - DNA, 20 bp, Artificial Sequence
  chemically synthesized
gtagccaagtttgcatatta

SEQ ID NO: 415114 - DNA, 20 bp, Artificial Sequence
  chemically synthesized
aaatccataatatgcaaact

SEQ ID NO: 415115 - DNA, 20 bp, Artificial Sequence
  chemically synthesized
ataatatgcaaacttggcta

SEQ ID NO: 415116 - DNA, 20 bp, Artificial Sequence
  chemically synthesized
tgattggacagtctgtagcc

SEQ ID NO: 415117 - DNA, 20 bp, Artificial Sequence
  chemically synthesized
aaatctgattggacagtctg

SEQ ID NO: 415118 - DNA, 20 bp, Artificial Sequence
  chemically synthesized
ttggctacagactgtccaat

SEQ ID NO: 415119 - DNA, 20 bp, Artificial Sequence
  chemically synthesized
gagaataaaatctgattgga

SEQ ID NO: 415120 - DNA, 20 bp, Artificial Sequence
  chemically synthesized
aaaggagaataaaatctgat

SEQ ID NO: 415121 - DNA, 20 bp, Artificial Sequence
  chemically synthesized
tcagattttattctcctttc

SEQ ID NO: 415122 - DNA, 20 bp, Artificial Sequence
  chemically synthesized
aggaaaatctgacttgaaag

SEQ ID NO: 415123 - DNA, 20 bp, Artificial Sequence
  chemically synthesized
attttattctcctttcaagt

SEQ ID NO: 415124 - DNA, 20 bp, Artificial Sequence
  chemically synthesized
taaggaaaatctgacttgaa

SEQ ID NO: 415125 - DNA, 20 bp, Artificial Sequence
  chemically synthesized
ataaggaaaatctgacttga

SEQ ID NO: 415126 - DNA, 20 bp, Artificial Sequence
  chemically synthesized
tagtgtaagtaaagaggata

SEQ ID NO: 415127 - DNA, 20 bp, Artificial Sequence
  chemically synthesized
atagtgtaagtaaagaggat

SEQ ID NO: 415128 - DNA, 20 bp, Artificial Sequence
  chemically synthesized
gtaagatagtgtaagtaaag

SEQ ID NO: 415129 - DNA, 20 bp, Artificial Sequence
  chemically synthesized
ggtaagatagtgtaagtaaa

SEQ ID NO: 415130 - DNA, 20 bp, Artificial Sequence
  chemically synthesized
ttggtaagatagtgtaagta

SEQ ID NO: 415131 - DNA, 20 bp, Artificial Sequence
  chemically synthesized
gcctattggtaagatagtgt

SEQ ID NO: 415132 - DNA, 20 bp, Artificial Sequence
  chemically synthesized
ctgacagcctattggtaaga

SEQ ID NO: 415133 - DNA, 20 bp, Artificial Sequence
  chemically synthesized
tacttacactatcttaccaa

SEQ ID NO: 415134 - DNA, 20 bp, Artificial Sequence
  chemically synthesized
acttacactatcttaccaat

SEQ ID NO: 415135 - DNA, 20 bp, Artificial Sequence
  chemically synthesized
gcatctgacagcctattggt

SEQ ID NO: 415136 - DNA, 20 bp, Artificial Sequence
  chemically synthesized
actagcatctgacagcctat

SEQ ID NO: 415137 - DNA, 20 bp, Artificial Sequence
  chemically synthesized
ctatcttaccaataggctgt

SEQ ID NO: 415138 - DNA, 20 bp, Artificial Sequence
  chemically synthesized
cagaacatactagcatctga

SEQ ID NO: 415139 - DNA, 20 bp, Artificial Sequence
  chemically synthesized
accaataggctgtcagatgc

SEQ ID NO: 415140 - DNA, 20 bp, Artificial Sequence
  chemically synthesized
ctgaatgtctcagaacatac

SEQ ID NO: 415141 - DNA, 20 bp, Artificial Sequence
  chemically synthesized
gtcagatgctagtatgttct

SEQ ID NO: 415142 - DNA, 20 bp, Artificial Sequence
  chemically synthesized
ctagtatgttctgagacatt

SEQ ID NO: 415143 - DNA, 20 bp, Artificial Sequence
  chemically synthesized
ataagagatactgaatgtct

SEQ ID NO: 415144 - DNA, 20 bp, Artificial Sequence
  chemically synthesized
atatgagtggtgagtgataa

SEQ ID NO: 415145 - DNA, 20 bp, Artificial Sequence
  chemically synthesized
gtatatgagtggtgagtgat

SEQ ID NO: 415146 - DNA, 20 bp, Artificial Sequence
  chemically synthesized
cctgagagtatatgagtggt

SEQ ID NO: 415147 - DNA, 20 bp, Artificial Sequence
  chemically synthesized
tatccctgagagtatatgag

SEQ ID NO: 415148 - DNA, 20 bp, Artificial Sequence
  chemically synthesized
ttttatccctgagagtatat

SEQ ID NO: 415149 - DNA, 20 bp, Artificial Sequence
  chemically synthesized
actcaccactcatatactct

SEQ ID NO: 415150 - DNA, 20 bp, Artificial Sequence
  chemically synthesized
ctcaccactcatatactctc

SEQ ID NO: 415151 - DNA, 20 bp, Artificial Sequence
  chemically synthesized
tcaccactcatatactctca

SEQ ID NO: 415152 - DNA, 20 bp, Artificial Sequence
  chemically synthesized
ctacagaattttatccctga

SEQ ID NO: 415153 - DNA, 20 bp, Artificial Sequence
  chemically synthesized
ctctacagaattttatccct

SEQ ID NO: 415154 - DNA, 20 bp, Artificial Sequence
  chemically synthesized
ctctcagggataaaattctg

SEQ ID NO: 415155 - DNA, 20 bp, Artificial Sequence
  chemically synthesized
ctcagggataaaattctgta

SEQ ID NO: 415156 - DNA, 20 bp, Artificial Sequence
  chemically synthesized
tcagggataaaattctgtag

SEQ ID NO: 415157 - DNA, 20 bp, Artificial Sequence
  chemically synthesized
atgcgaattgagtgcctcta

SEQ ID NO: 415158 - DNA, 20 bp, Artificial Sequence
  chemically synthesized
tggttgtttctatgcgaatt

SEQ ID NO: 415159 - DNA, 20 bp, Artificial Sequence
  chemically synthesized
gtagaggcactcaattcgca

SEQ ID NO: 415160 - DNA, 20 bp, Artificial Sequence
  chemically synthesized
atagaaacaaccataaaacc

SEQ ID NO: 415161 - DNA, 20 bp, Artificial Sequence
  chemically synthesized
atttgcaaaactgggtttta

SEQ ID NO: 415162 - DNA, 20 bp, Artificial Sequence
  chemically synthesized
aacttaatatttgcaaaact

SEQ ID NO: 415163 - DNA, 20 bp, Artificial Sequence
  chemically synthesized
taacttaatatttgcaaaac

SEQ ID NO: 415164 - DNA, 20 bp, Artificial Sequence
  chemically synthesized
aacccagttttgcaaatatt

SEQ ID NO: 415165 - DNA, 20 bp, Artificial Sequence
  chemically synthesized
cagttttgcaaatattaagt

SEQ ID NO: 415166 - DNA, 20 bp, Artificial Sequence
  chemically synthesized
atattaagttagaaaacaat

SEQ ID NO: 415167 - DNA, 20 bp, Artificial Sequence
  chemically synthesized
aagttagaaaacaattggca

SEQ ID NO: 415168 - DNA, 20 bp, Artificial Sequence
  chemically synthesized
attggcatagcattacacta

SEQ ID NO: 415169 - DNA, 20 bp, Artificial Sequence
  chemically synthesized
gtgcatagtaagtattacca

SEQ ID NO: 415170 - DNA, 20 bp, Artificial Sequence
  chemically synthesized
aaattttaggagtgcatagt

SEQ ID NO: 415171 - DNA, 20 bp, Artificial Sequence
  chemically synthesized
cactaaattttaggagtgca

SEQ ID NO: 415172 - DNA, 20 bp, Artificial Sequence
  chemically synthesized
agatcaacactaaattttag

SEQ ID NO: 415173 - DNA, 20 bp, Artificial Sequence
  chemically synthesized
tactatgcactcctaaaatt

SEQ ID NO: 415174 - DNA, 20 bp, Artificial Sequence
  chemically synthesized
taagatcaacactaaatttt

SEQ ID NO: 415175 - DNA, 20 bp, Artificial Sequence
  chemically synthesized
ataagatcaacactaaattt

SEQ ID NO: 415176 - DNA, 20 bp, Artificial Sequence
  chemically synthesized
ttgtttttacatcatggcat

SEQ ID NO: 415177 - DNA, 20 bp, Artificial Sequence
  chemically synthesized
ctttttttgtttttacatca

SEQ ID NO: 415178 - DNA, 20 bp, Artificial Sequence
  chemically synthesized
ccatgatgtaaaaacaaaaa

SEQ ID NO: 415179 - DNA, 20 bp, Artificial Sequence
  chemically synthesized
taaaaacaaaaaaagaaaaa

SEQ ID NO: 415180 - DNA, 20 bp, Artificial Sequence
  chemically synthesized
aaaaaaagaaaaaaagttat

SEQ ID NO: 415181 - DNA, 20 bp, Artificial Sequence
  chemically synthesized
gaaaaaaagttattagtaca

SEQ ID NO: 415182 - DNA, 20 bp, Artificial Sequence
  chemically synthesized
aaaaaagttattagtacaaa

SEQ ID NO: 415183 - DNA, 20 bp, Artificial Sequence
  chemically synthesized
tagtacaaagagaaaaatgt

SEQ ID NO: 415184 - DNA, 20 bp, Artificial Sequence
  chemically synthesized
acatattttagtcaaatcag

SEQ ID NO: 415185 - DNA, 20 bp, Artificial Sequence
  chemically synthesized
cacatattttagtcaaatca

SEQ ID NO: 415186 - DNA, 20 bp, Artificial Sequence
  chemically synthesized
atcacatattttagtcaaat

SEQ ID NO: 415187 - DNA, 20 bp, Artificial Sequence
  chemically synthesized
gtgaatgttatcacatattt

SEQ ID NO: 415188 - DNA, 20 bp, Artificial Sequence
  chemically synthesized
aaatatgtgataacattcac

SEQ ID NO: 415189 - DNA, 20 bp, Artificial Sequence
  chemically synthesized
atgtgataacattcacaagc

SEQ ID NO: 415190 - DNA, 20 bp, Artificial Sequence
  chemically synthesized
aacattcacaagccagaatt

SEQ ID NO: 415191 - DNA, 20 bp, Artificial Sequence
  chemically synthesized
ctgccagctctactcaattc

SEQ ID NO: 415192 - DNA, 20 bp, Artificial Sequence
  chemically synthesized
attcacaagccagaattgag

SEQ ID NO: 415193 - DNA, 20 bp, Artificial Sequence
  chemically synthesized
tcacaagccagaattgagta

SEQ ID NO: 415194 - DNA, 20 bp, Artificial Sequence
  chemically synthesized
aagccagaattgagtagagc

SEQ ID NO: 415195 - DNA, 20 bp, Artificial Sequence
  chemically synthesized
ccagaattgagtagagctgg

SEQ ID NO: 415196 - DNA, 20 bp, Artificial Sequence
  chemically synthesized
tcaggccttctgtgaactgc

SEQ ID NO: 415197 - DNA, 20 bp, Artificial Sequence
  chemically synthesized
tgagtagagctggcagttca

SEQ ID NO: 415198 - DNA, 20 bp, Artificial Sequence
  chemically synthesized
gtagagctggcagttcacag

SEQ ID NO: 415199 - DNA, 20 bp, Artificial Sequence
  chemically synthesized
tagagctggcagttcacaga

SEQ ID NO: 415200 - DNA, 20 bp, Artificial Sequence
  chemically synthesized
ggcagttcacagaaggcctg

SEQ ID NO: 415201 - DNA, 20 bp, Artificial Sequence
  chemically synthesized
ttcacagaaggcctgaagcc

SEQ ID NO: 415202 - DNA, 20 bp, Artificial Sequence
  chemically synthesized
attgattacatctaggcttc

SEQ ID NO: 415203 - DNA, 20 bp, Artificial Sequence
  chemically synthesized
cattgattacatctaggctt

SEQ ID NO: 415204 - DNA, 20 bp, Artificial Sequence
  chemically synthesized
ctatgtcattgattacatct

SEQ ID NO: 415205 - DNA, 20 bp, Artificial Sequence
  chemically synthesized
gctatgtcattgattacatc

SEQ ID NO: 415206 - DNA, 20 bp, Artificial Sequence
  chemically synthesized
cctagatgtaatcaatgaca

SEQ ID NO: 415207 - DNA, 20 bp, Artificial Sequence
  chemically synthesized
atgtgttgatttatcaagtt

SEQ ID NO: 415208 - DNA, 20 bp, Artificial Sequence
  chemically synthesized
tgtaaatgtgttgatttatc

SEQ ID NO: 415209 - DNA, 20 bp, Artificial Sequence
  chemically synthesized
ataaatcaacacatttacat

SEQ ID NO: 415210 - DNA, 20 bp, Artificial Sequence
  chemically synthesized
taaatcaacacatttacata

SEQ ID NO: 415211 - DNA, 20 bp, Artificial Sequence
  chemically synthesized
gttcaatcctatgataatca

SEQ ID NO: 415212 - DNA, 20 bp, Artificial Sequence
  chemically synthesized
ggttcaatcctatgataatc

SEQ ID NO: 415213 - DNA, 20 bp, Artificial Sequence
  chemically synthesized
gaaaatatccctgattatca

SEQ ID NO: 415214 - DNA, 20 bp, Artificial Sequence
  chemically synthesized
aggttcaatcctatgataat

SEQ ID NO: 415215 - DNA, 20 bp, Artificial Sequence
  chemically synthesized
aaaatatccctgattatcat

SEQ ID NO: 415216 - DNA, 20 bp, Artificial Sequence
  chemically synthesized
ctgtcaacagataatttaga

SEQ ID NO: 415217 - DNA, 20 bp, Artificial Sequence
  chemically synthesized
actgtcaacagataatttag

SEQ ID NO: 415218 - DNA, 20 bp, Artificial Sequence
  chemically synthesized
ttgactgtcaacagataatt

SEQ ID NO: 415219 - DNA, 20 bp, Artificial Sequence
  chemically synthesized
ccttctaaattatctgttga

SEQ ID NO: 415220 - DNA, 20 bp, Artificial Sequence
  chemically synthesized
atcagaatattgactgtcaa

SEQ ID NO: 415221 - DNA, 20 bp, Artificial Sequence
  chemically synthesized
ttcacagtgaagaaaatgat

SEQ ID NO: 415222 - DNA, 20 bp, Artificial Sequence
  chemically synthesized
gtctgtctgaattcacagtg

SEQ ID NO: 415223 - DNA, 20 bp, Artificial Sequence
  chemically synthesized
cattttcttcactgtgaatt

SEQ ID NO: 415224 - DNA, 20 bp, Artificial Sequence
  chemically synthesized
tgatagtctgtctgaattca

SEQ ID NO: 415225 - DNA, 20 bp, Artificial Sequence
  chemically synthesized
ttcttcactgtgaattcaga

SEQ ID NO: 415226 - DNA, 20 bp, Artificial Sequence
  chemically synthesized
ttcagacagactatcattca

SEQ ID NO: 415227 - DNA, 20 bp, Artificial Sequence
  chemically synthesized
tatagcaaacctttgaatga

SEQ ID NO: 415228 - DNA, 20 bp, Artificial Sequence
  chemically synthesized
tcagacagactatcattcaa

SEQ ID NO: 415229 - DNA, 20 bp, Artificial Sequence
  chemically synthesized
tcattcaaaggtttgctata

SEQ ID NO: 415230 - DNA, 20 bp, Artificial Sequence
  chemically synthesized
tcaaaggtttgctatacaga

SEQ ID NO: 415231 - DNA, 20 bp, Artificial Sequence
  chemically synthesized
ggtatttttctctttctgta

SEQ ID NO: 415232 - DNA, 20 bp, Artificial Sequence
  chemically synthesized
aaaggtttgctatacagaaa

SEQ ID NO: 415233 - DNA, 20 bp, Artificial Sequence
  chemically synthesized
gagaaaaataccaaaatgct

SEQ ID NO: 415234 - DNA, 20 bp, Artificial Sequence
  chemically synthesized
atatttgtgccttagcattt

SEQ ID NO: 415235 - DNA, 20 bp, Artificial Sequence
  chemically synthesized
agaaaaataccaaaatgcta

SEQ ID NO: 415236 - DNA, 20 bp, Artificial Sequence
  chemically synthesized
gagatttgatatttgtgcct

SEQ ID NO: 415237 - DNA, 20 bp, Artificial Sequence
  chemically synthesized
tatctgattttcatgggaaa

SEQ ID NO: 415238 - DNA, 20 bp, Artificial Sequence
  chemically synthesized
attatctgattttcatggga

SEQ ID NO: 415239 - DNA, 20 bp, Artificial Sequence
  chemically synthesized
ctaaattatctgattttcat

SEQ ID NO: 415240 - DNA, 20 bp, Artificial Sequence
  chemically synthesized
aatctctttcccatgaaaat

SEQ ID NO: 415241 - DNA, 20 bp, Artificial Sequence
  chemically synthesized
tctaaattatctgattttca

SEQ ID NO: 415242 - DNA, 20 bp, Artificial Sequence
  chemically synthesized
cccatgaaaatcagataatt

SEQ ID NO: 415243 - DNA, 20 bp, Artificial Sequence
  chemically synthesized
agataatttagaatttttta

SEQ ID NO: 415244 - DNA, 20 bp, Artificial Sequence
  chemically synthesized
aattacatagtcacatttca

SEQ ID NO: 415245 - DNA, 20 bp, Artificial Sequence
  chemically synthesized
taattacatagtcacatttc

SEQ ID NO: 415246 - DNA, 20 bp, Artificial Sequence
  chemically synthesized
ttttattttttttaattaca

SEQ ID NO: 415247 - DNA, 20 bp, Artificial Sequence
  chemically synthesized
gtttttgacttatcacaaaa

SEQ ID NO: 415248 - DNA, 20 bp, Artificial Sequence
  chemically synthesized
ataaaatacttttttgtgat

SEQ ID NO: 415249 - DNA, 20 bp, Artificial Sequence
  chemically synthesized
ataagtcaaaaactaattat

SEQ ID NO: 415250 - DNA, 20 bp, Artificial Sequence
  chemically synthesized
taagtcaaaaactaattata

SEQ ID NO: 415251 - DNA, 20 bp, Artificial Sequence
  chemically synthesized
caaatgttctaccttataat

SEQ ID NO: 415252 - DNA, 20 bp, Artificial Sequence
  chemically synthesized
gtcaaaaactaattataagg

SEQ ID NO: 415253 - DNA, 20 bp, Artificial Sequence
  chemically synthesized
aggtagaacatttgctaata

SEQ ID NO: 415254 - DNA, 20 bp, Artificial Sequence
  chemically synthesized
tgttgctttgaaatctatat

SEQ ID NO: 415255 - DNA, 20 bp, Artificial Sequence
  chemically synthesized
atttgctaatatagatttca

SEQ ID NO: 415256 - DNA, 20 bp, Artificial Sequence
  chemically synthesized
tgggaacatatgttattaac

SEQ ID NO: 415257 - DNA, 20 bp, Artificial Sequence
  chemically synthesized
atgggaacatatgttattaa

SEQ ID NO: 415258 - DNA, 20 bp, Artificial Sequence
  chemically synthesized
aacatatgttcccattttaa

SEQ ID NO: 415259 - DNA, 20 bp, Artificial Sequence
  chemically synthesized
ctgttacctacttttaaaat

SEQ ID NO: 415260 - DNA, 20 bp, Artificial Sequence
  chemically synthesized
tctgttacctacttttaaaa

SEQ ID NO: 415261 - DNA, 20 bp, Artificial Sequence
  chemically synthesized
atatgttcccattttaaaag

SEQ ID NO: 415262 - DNA, 20 bp, Artificial Sequence
  chemically synthesized
tatgttcccattttaaaagt

SEQ ID NO: 415263 - DNA, 20 bp, Artificial Sequence
  chemically synthesized
cccattttaaaagtaggtaa

SEQ ID NO: 415264 - DNA, 20 bp, Artificial Sequence
  chemically synthesized
taacagaaattaataactca

SEQ ID NO: 415265 - DNA, 20 bp, Artificial Sequence
  chemically synthesized
gaaccccattatataactat

SEQ ID NO: 415266 - DNA, 20 bp, Artificial Sequence
  chemically synthesized
aataactcatagttatataa

SEQ ID NO: 415267 - DNA, 20 bp, Artificial Sequence
  chemically synthesized
ataactcatagttatataat

SEQ ID NO: 415268 - DNA, 20 bp, Artificial Sequence
  chemically synthesized
taactcatagttatataatg

SEQ ID NO: 415269 - DNA, 20 bp, Artificial Sequence
  chemically synthesized
tagttatataatggggttcc

SEQ ID NO: 415270 - DNA, 20 bp, Artificial Sequence
  chemically synthesized
catttcatactataaaatct

SEQ ID NO: 415271 - DNA, 20 bp, Artificial Sequence
  chemically synthesized
aatggggttccaagatttta

SEQ ID NO: 415272 - DNA, 20 bp, Artificial Sequence
  chemically synthesized
agattttatagtatgaaatg

SEQ ID NO: 415273 - DNA, 20 bp, Artificial Sequence
  chemically synthesized
tatagtatgaaatgtggtaa

SEQ ID NO: 415274 - DNA, 20 bp, Artificial Sequence
  chemically synthesized
atagtatgaaatgtggtaaa

SEQ ID NO: 415275 - DNA, 20 bp, Artificial Sequence
  chemically synthesized
atgaaatgtggtaaaaggtt

SEQ ID NO: 415276 - DNA, 20 bp, Artificial Sequence
  chemically synthesized
aaaaggtttggtatttatta

SEQ ID NO: 415277 - DNA, 20 bp, Artificial Sequence
  chemically synthesized
aaaggtttggtatttattat

SEQ ID NO: 415278 - DNA, 20 bp, Artificial Sequence
  chemically synthesized
gtatttattataggatgtga

SEQ ID NO: 415279 - DNA, 20 bp, Artificial Sequence
  chemically synthesized
tatttattataggatgtgaa

SEQ ID NO: 415280 - DNA, 20 bp, Artificial Sequence
  chemically synthesized
aggatgtgaaaggcccccta

SEQ ID NO: 415281 - DNA, 20 bp, Artificial Sequence
  chemically synthesized
gtaattaaaagtgctttagg

SEQ ID NO: 415282 - DNA, 20 bp, Artificial Sequence
  chemically synthesized
agtaattaaaagtgctttag

SEQ ID NO: 415283 - DNA, 20 bp, Artificial Sequence
  chemically synthesized
gagtaattaaaagtgcttta

SEQ ID NO: 415284 - DNA, 20 bp, Artificial Sequence
  chemically synthesized
tgagtaattaaaagtgcttt

SEQ ID NO: 415285 - DNA, 20 bp, Artificial Sequence
  chemically synthesized
atgagtaattaaaagtgctt

SEQ ID NO: 415286 - DNA, 20 bp, Artificial Sequence
  chemically synthesized
attcatgaatgagtaattaa

SEQ ID NO: 415287 - DNA, 20 bp, Artificial Sequence
  chemically synthesized
ttaattagcaattcatgaat

SEQ ID NO: 415288 - DNA, 20 bp, Artificial Sequence
  chemically synthesized
tttagtttggaagtattaat

SEQ ID NO: 415289 - DNA, 20 bp, Artificial Sequence
  chemically synthesized
tgtttaatattttagtttgg

SEQ ID NO: 415290 - DNA, 20 bp, Artificial Sequence
  chemically synthesized
aagtgtttaatattttagtt

SEQ ID NO: 415291 - DNA, 20 bp, Artificial Sequence
  chemically synthesized
ttctaaagtgtttaatattt

SEQ ID NO: 415292 - DNA, 20 bp, Artificial Sequence
  chemically synthesized
aactaaaatattaaacactt

SEQ ID NO: 415293 - DNA, 20 bp, Artificial Sequence
  chemically synthesized
aaaatattaaacactttaga

SEQ ID NO: 415294 - DNA, 20 bp, Artificial Sequence
  chemically synthesized
atattgggtcagtctttcta

SEQ ID NO: 415295 - DNA, 20 bp, Artificial Sequence
  chemically synthesized
cttggattttaatattgggt

SEQ ID NO: 415296 - DNA, 20 bp, Artificial Sequence
  chemically synthesized
acagcttggattttaatatt

SEQ ID NO: 415297 - DNA, 20 bp, Artificial Sequence
  chemically synthesized
aacagcttggattttaatat

SEQ ID NO: 415298 - DNA, 20 bp, Artificial Sequence
  chemically synthesized
ctgacccaatattaaaatcc

SEQ ID NO: 415299 - DNA, 20 bp, Artificial Sequence
  chemically synthesized
aatattaaaatccaagctgt

SEQ ID NO: 415300 - DNA, 20 bp, Artificial Sequence
  chemically synthesized
cactttaaaatctaacagct

SEQ ID NO: 415301 - DNA, 20 bp, Artificial Sequence
  chemically synthesized
acatacactttaaaatctaa

SEQ ID NO: 415302 - DNA, 20 bp, Artificial Sequence
  chemically synthesized
atccaagctgttagatttta

SEQ ID NO: 415303 - DNA, 20 bp, Artificial Sequence
  chemically synthesized
atatacactaagagatatta

SEQ ID NO: 415304 - DNA, 20 bp, Artificial Sequence
  chemically synthesized
atttaaactataatatctct

SEQ ID NO: 415305 - DNA, 20 bp, Artificial Sequence
  chemically synthesized
tgtgtgtatatatacactaa

SEQ ID NO: 415306 - DNA, 20 bp, Artificial Sequence
  chemically synthesized
tttgtgtgtatatatacact

SEQ ID NO: 415307 - DNA, 20 bp, Artificial Sequence
  chemically synthesized
tataaacatatatatgaaaa

SEQ ID NO: 415308 - DNA, 20 bp, Artificial Sequence
  chemically synthesized
atgtatataatatatataca

SEQ ID NO: 415309 - DNA, 20 bp, Artificial Sequence
  chemically synthesized
gtatataatatatatacata

SEQ ID NO: 415310 - DNA, 20 bp, Artificial Sequence
  chemically synthesized
atataatatatatacataga

SEQ ID NO: 415311 - DNA, 20 bp, Artificial Sequence
  chemically synthesized
tatatatacatagagagcga

SEQ ID NO: 415312 - DNA, 20 bp, Artificial Sequence
  chemically synthesized
tatatacatagagagcgata

SEQ ID NO: 415313 - DNA, 20 bp, Artificial Sequence
  chemically synthesized
atatacatagagagcgatag

SEQ ID NO: 415314 - DNA, 20 bp, Artificial Sequence
  chemically synthesized
tatacatagagagcgataga

SEQ ID NO: 415315 - DNA, 20 bp, Artificial Sequence
  chemically synthesized
tacatagagagcgatagagg

SEQ ID NO: 415316 - DNA, 20 bp, Artificial Sequence
  chemically synthesized
gagagcgatagagggagata

SEQ ID NO: 415317 - DNA, 20 bp, Artificial Sequence
  chemically synthesized
agagcgatagagggagataa

SEQ ID NO: 415318 - DNA, 20 bp, Artificial Sequence
  chemically synthesized
gcgatagagggagataaagg

SEQ ID NO: 415319 - DNA, 20 bp, Artificial Sequence
  chemically synthesized
cgatagagggagataaagga

SEQ ID NO: 415320 - DNA, 20 bp, Artificial Sequence
  chemically synthesized
gatagagggagataaaggaa

SEQ ID NO: 415321 - DNA, 20 bp, Artificial Sequence
  chemically synthesized
atagagggagataaaggaag

SEQ ID NO: 415322 - DNA, 20 bp, Artificial Sequence
  chemically synthesized
tagagggagataaaggaagg

SEQ ID NO: 415323 - DNA, 20 bp, Artificial Sequence
  chemically synthesized
tgtggtcagctaaaatatat

SEQ ID NO: 415324 - DNA, 20 bp, Artificial Sequence
  chemically synthesized
tttgtttgtccaatatattt

SEQ ID NO: 415325 - DNA, 20 bp, Artificial Sequence
  chemically synthesized
aatacataaaatgatgtggt

SEQ ID NO: 415326 - DNA, 20 bp, Artificial Sequence
  chemically synthesized
aaaaaatacataaaatgatg

SEQ ID NO: 415327 - DNA, 20 bp, Artificial Sequence
  chemically synthesized
tttatgtatttttttattta

SEQ ID NO: 415328 - DNA, 20 bp, Artificial Sequence
  chemically synthesized
ttatgtatttttttatttaa

SEQ ID NO: 415329 - DNA, 20 bp, Artificial Sequence
  chemically synthesized
tatgtatttttttatttaaa

SEQ ID NO: 415330 - DNA, 20 bp, Artificial Sequence
  chemically synthesized
atttttttatttaaagggcc

SEQ ID NO: 415331 - DNA, 20 bp, Artificial Sequence
  chemically synthesized
tttttttatttaaagggcca

SEQ ID NO: 415332 - DNA, 20 bp, Artificial Sequence
  chemically synthesized
cgcattcttattttattcct

SEQ ID NO: 415333 - DNA, 20 bp, Artificial Sequence
  chemically synthesized
aaagggccaaggaataaaat

SEQ ID NO: 415334 - DNA, 20 bp, Artificial Sequence
  chemically synthesized
aggaataaaataagaatgcg

SEQ ID NO: 415335 - DNA, 20 bp, Artificial Sequence
  chemically synthesized
ggaataaaataagaatgcga

SEQ ID NO: 415336 - DNA, 20 bp, Artificial Sequence
  chemically synthesized
ataaaataagaatgcgaagg

SEQ ID NO: 415337 - DNA, 20 bp, Artificial Sequence
  chemically synthesized
aagaatgcgaaggtagaatg

SEQ ID NO: 415338 - DNA, 20 bp, Artificial Sequence
  chemically synthesized
catttttctaattgaggata

SEQ ID NO: 415339 - DNA, 20 bp, Artificial Sequence
  chemically synthesized
tgcagcactttatcctcaat

SEQ ID NO: 415340 - DNA, 20 bp, Artificial Sequence
  chemically synthesized
cctctgcatttttctaattg

SEQ ID NO: 415341 - DNA, 20 bp, Artificial Sequence
  chemically synthesized
tcctctgcatttttctaatt

SEQ ID NO: 415342 - DNA, 20 bp, Artificial Sequence
  chemically synthesized
tatcctcaattagaaaaatg

SEQ ID NO: 415343 - DNA, 20 bp, Artificial Sequence
  chemically synthesized
tcctcaattagaaaaatgca

SEQ ID NO: 415344 - DNA, 20 bp, Artificial Sequence
  chemically synthesized
cctcaattagaaaaatgcag

SEQ ID NO: 415345 - DNA, 20 bp, Artificial Sequence
  chemically synthesized
tgcagaggaatttaaataat

SEQ ID NO: 415346 - DNA, 20 bp, Artificial Sequence
  chemically synthesized
caaacataacatttgtggaa

SEQ ID NO: 415347 - DNA, 20 bp, Artificial Sequence
  chemically synthesized
ggcaacaaacataacatttg

SEQ ID NO: 415348 - DNA, 20 bp, Artificial Sequence
  chemically synthesized
acaaatgttatgtttgttgc

SEQ ID NO: 415349 - DNA, 20 bp, Artificial Sequence
  chemically synthesized
caaatgttatgtttgttgcc

SEQ ID NO: 415350 - DNA, 20 bp, Artificial Sequence
  chemically synthesized
atgtttgttgccaggaaaca

SEQ ID NO: 415351 - DNA, 20 bp, Artificial Sequence
  chemically synthesized
ttagaagcacctgtgtttcc

SEQ ID NO: 415352 - DNA, 20 bp, Artificial Sequence
  chemically synthesized
tgtttgttgccaggaaacac

SEQ ID NO: 415353 - DNA, 20 bp, Artificial Sequence
  chemically synthesized
gcctaaagcagtgagtttag

SEQ ID NO: 415354 - DNA, 20 bp, Artificial Sequence
  chemically synthesized
atggcctaaagcagtgagtt

SEQ ID NO: 415355 - DNA, 20 bp, Artificial Sequence
  chemically synthesized
tgcttctaaactcactgctt

SEQ ID NO: 415356 - DNA, 20 bp, Artificial Sequence
  chemically synthesized
tttgcatggcctaaagcagt

SEQ ID NO: 415357 - DNA, 20 bp, Artificial Sequence
  chemically synthesized
gcttctaaactcactgcttt

SEQ ID NO: 415358 - DNA, 20 bp, Artificial Sequence
  chemically synthesized
aaattttgcatggcctaaag

SEQ ID NO: 415359 - DNA, 20 bp, Artificial Sequence
  chemically synthesized
cctaaattttgcatggccta

SEQ ID NO: 415360 - DNA, 20 bp, Artificial Sequence
  chemically synthesized
cctgtctcctaaattttgca

SEQ ID NO: 415361 - DNA, 20 bp, Artificial Sequence
  chemically synthesized
gctttaggccatgcaaaatt

SEQ ID NO: 415362 - DNA, 20 bp, Artificial Sequence
  chemically synthesized
ctttaggccatgcaaaattt

SEQ ID NO: 415363 - DNA, 20 bp, Artificial Sequence
  chemically synthesized
ttaggccatgcaaaatttag

SEQ ID NO: 415364 - DNA, 20 bp, Artificial Sequence
  chemically synthesized
gccatgcaaaatttaggaga

SEQ ID NO: 415365 - DNA, 20 bp, Artificial Sequence
  chemically synthesized
ccatgcaaaatttaggagac

SEQ ID NO: 415366 - DNA, 20 bp, Artificial Sequence
  chemically synthesized
cctccctagaggaggggaat

SEQ ID NO: 415367 - DNA, 20 bp, Artificial Sequence
  chemically synthesized
acaggccaattcccctcctc

SEQ ID NO: 415368 - DNA, 20 bp, Artificial Sequence
  chemically synthesized
caggccaattcccctcctct

SEQ ID NO: 415369 - DNA, 20 bp, Artificial Sequence
  chemically synthesized
aagtttcctccctagaggag

SEQ ID NO: 415370 - DNA, 20 bp, Artificial Sequence
  chemically synthesized
aggccaattcccctcctcta

SEQ ID NO: 415371 - DNA, 20 bp, Artificial Sequence
  chemically synthesized
caagtttcctccctagagga

SEQ ID NO: 415372 - DNA, 20 bp, Artificial Sequence
  chemically synthesized
acaagtttcctccctagagg

SEQ ID NO: 415373 - DNA, 20 bp, Artificial Sequence
  chemically synthesized
gccaattcccctcctctagg

SEQ ID NO: 415374 - DNA, 20 bp, Artificial Sequence
  chemically synthesized
gacaagtttcctccctagag

SEQ ID NO: 415375 - DNA, 20 bp, Artificial Sequence
  chemically synthesized
ccaattcccctcctctaggg

SEQ ID NO: 415376 - DNA, 20 bp, Artificial Sequence
  chemically synthesized
ctgacaagtttcctccctag

SEQ ID NO: 415377 - DNA, 20 bp, Artificial Sequence
  chemically synthesized
actgacaagtttcctcccta

SEQ ID NO: 415378 - DNA, 20 bp, Artificial Sequence
  chemically synthesized
tgactgacaagtttcctccc

SEQ ID NO: 415379 - DNA, 20 bp, Artificial Sequence
  chemically synthesized
cctctagggaggaaacttgt

SEQ ID NO: 415380 - DNA, 20 bp, Artificial Sequence
  chemically synthesized
tagggaggaaacttgtcagt

SEQ ID NO: 415381 - DNA, 20 bp, Artificial Sequence
  chemically synthesized
agggaggaaacttgtcagtc

SEQ ID NO: 415382 - DNA, 20 bp, Artificial Sequence
  chemically synthesized
cttgagctttcctgactgac

SEQ ID NO: 415383 - DNA, 20 bp, Artificial Sequence
  chemically synthesized
aggaaacttgtcagtcagga

SEQ ID NO: 415384 - DNA, 20 bp, Artificial Sequence
  chemically synthesized
cttgtcagtcaggaaagctc

SEQ ID NO: 415385 - DNA, 20 bp, Artificial Sequence
  chemically synthesized
tgtcagtcaggaaagctcaa

SEQ ID NO: 415386 - DNA, 20 bp, Artificial Sequence
  chemically synthesized
gtcaggaaagctcaagagat

SEQ ID NO: 415387 - DNA, 20 bp, Artificial Sequence
  chemically synthesized
gctttggatgctaatctctt

SEQ ID NO: 415388 - DNA, 20 bp, Artificial Sequence
  chemically synthesized
gctcaagagattagcatcca

SEQ ID NO: 415389 - DNA, 20 bp, Artificial Sequence
  chemically synthesized
aagagattagcatccaaagc

SEQ ID NO: 415390 - DNA, 20 bp, Artificial Sequence
  chemically synthesized
ccccagaagtaaactggctt

SEQ ID NO: 415391 - DNA, 20 bp, Artificial Sequence
  chemically synthesized
aaccagccccagaagtaaac

SEQ ID NO: 415392 - DNA, 20 bp, Artificial Sequence
  chemically synthesized
atccaaagccagtttacttc

SEQ ID NO: 415393 - DNA, 20 bp, Artificial Sequence
  chemically synthesized
tccaaagccagtttacttct

SEQ ID NO: 415394 - DNA, 20 bp, Artificial Sequence
  chemically synthesized
ccaaagccagtttacttctg

SEQ ID NO: 415395 - DNA, 20 bp, Artificial Sequence
  chemically synthesized
agccagtttacttctggggc

SEQ ID NO: 415396 - DNA, 20 bp, Artificial Sequence
  chemically synthesized
aagcttttaaccagccccag

SEQ ID NO: 415397 - DNA, 20 bp, Artificial Sequence
  chemically synthesized
tgaaagcttttaaccagccc

SEQ ID NO: 415398 - DNA, 20 bp, Artificial Sequence
  chemically synthesized
ttacttctggggctggttaa

SEQ ID NO: 415399 - DNA, 20 bp, Artificial Sequence
  chemically synthesized
atcctctgaaagcttttaac

SEQ ID NO: 415400 - DNA, 20 bp, Artificial Sequence
  chemically synthesized
tggggctggttaaaagcttt

SEQ ID NO: 415401 - DNA, 20 bp, Artificial Sequence
  chemically synthesized
gggctggttaaaagctttca

SEQ ID NO: 415402 - DNA, 20 bp, Artificial Sequence
  chemically synthesized
ggctggttaaaagctttcag

SEQ ID NO: 415403 - DNA, 20 bp, Artificial Sequence
  chemically synthesized
attacacaggaatcctctga

SEQ ID NO: 415404 - DNA, 20 bp, Artificial Sequence
  chemically synthesized
acaatatttagcaattacac

SEQ ID NO: 415405 - DNA, 20 bp, Artificial Sequence
  chemically synthesized
tacaatatttagcaattaca

SEQ ID NO: 415406 - DNA, 20 bp, Artificial Sequence
  chemically synthesized
tgtgtaattgctaaatattg

SEQ ID NO: 415407 - DNA, 20 bp, Artificial Sequence
  chemically synthesized
ttaatttagcctacaatatt

SEQ ID NO: 415408 - DNA, 20 bp, Artificial Sequence
  chemically synthesized
gtgtaattgctaaatattgt

SEQ ID NO: 415409 - DNA, 20 bp, Artificial Sequence
  chemically synthesized
aaatattgtaggctaaatta

SEQ ID NO: 415410 - DNA, 20 bp, Artificial Sequence
  chemically synthesized
tttaaataacaactttaatt

SEQ ID NO: 415411 - DNA, 20 bp, Artificial Sequence
  chemically synthesized
atttaaaatgtaaacatcaa

SEQ ID NO: 415412 - DNA, 20 bp, Artificial Sequence
  chemically synthesized
caagagcaagaatcaaatgt

SEQ ID NO: 415413 - DNA, 20 bp, Artificial Sequence
  chemically synthesized
taacatttgattcttgctct

SEQ ID NO: 415414 - DNA, 20 bp, Artificial Sequence
  chemically synthesized
tgcttttttataccaagagc

SEQ ID NO: 415415 - DNA, 20 bp, Artificial Sequence
  chemically synthesized
ttattgcttttttataccaa

SEQ ID NO: 415416 - DNA, 20 bp, Artificial Sequence
  chemically synthesized
ttttattgcttttttatacc

SEQ ID NO: 415417 - DNA, 20 bp, Artificial Sequence
  chemically synthesized
ttcttgctcttggtataaaa

SEQ ID NO: 415418 - DNA, 20 bp, Artificial Sequence
  chemically synthesized
caataaaattattaacacct

SEQ ID NO: 415419 - DNA, 20 bp, Artificial Sequence
  chemically synthesized
aaaattattaacaccttgga

SEQ ID NO: 415420 - DNA, 20 bp, Artificial Sequence
  chemically synthesized
tgaattttcaaatctttcca

SEQ ID NO: 415421 - DNA, 20 bp, Artificial Sequence
  chemically synthesized
atgaattttcaaatctttcc

SEQ ID NO: 415422 - DNA, 20 bp, Artificial Sequence
  chemically synthesized
ggaaagatttgaaaattcat

SEQ ID NO: 415423 - DNA, 20 bp, Artificial Sequence
  chemically synthesized
aagatttgaaaattcattgg

SEQ ID NO: 415424 - DNA, 20 bp, Artificial Sequence
  chemically synthesized
gaaaattcattggtagcatt

SEQ ID NO: 415425 - DNA, 20 bp, Artificial Sequence
  chemically synthesized
attcattggtagcattaagc

SEQ ID NO: 415426 - DNA, 20 bp, Artificial Sequence
  chemically synthesized
gcattaagcaagtaaatatc

SEQ ID NO: 415427 - DNA, 20 bp, Artificial Sequence
  chemically synthesized
gcaagtaaatatctagcatt

SEQ ID NO: 415428 - DNA, 20 bp, Artificial Sequence
  chemically synthesized
tcgccatatgaactaaatgc

SEQ ID NO: 415429 - DNA, 20 bp, Artificial Sequence
  chemically synthesized
tatctagcatttagttcata

SEQ ID NO: 415430 - DNA, 20 bp, Artificial Sequence
  chemically synthesized
tagcatttagttcatatggc

SEQ ID NO: 415431 - DNA, 20 bp, Artificial Sequence
  chemically synthesized
catatggcgagaccaattgt

SEQ ID NO: 415432 - DNA, 20 bp, Artificial Sequence
  chemically synthesized
gtattttaagttctcacaat

SEQ ID NO: 415433 - DNA, 20 bp, Artificial Sequence
  chemically synthesized
tcaacacaaatatgtatttt

SEQ ID NO: 415434 - DNA, 20 bp, Artificial Sequence
  chemically synthesized
catatttgtgttgatgattc

SEQ ID NO: 415435 - DNA, 20 bp, Artificial Sequence
  chemically synthesized
ataacctctcaaacagtagc

SEQ ID NO: 415436 - DNA, 20 bp, Artificial Sequence
  chemically synthesized
gatgattctggctactgttt

SEQ ID NO: 415437 - DNA, 20 bp, Artificial Sequence
  chemically synthesized
caatataacctctcaaacag

SEQ ID NO: 415438 - DNA, 20 bp, Artificial Sequence
  chemically synthesized
tgattctggctactgtttga

SEQ ID NO: 415439 - DNA, 20 bp, Artificial Sequence
  chemically synthesized
gattctggctactgtttgag

SEQ ID NO: 415440 - DNA, 20 bp, Artificial Sequence
  chemically synthesized
gggcaatataacctctcaaa

SEQ ID NO: 415441 - DNA, 20 bp, Artificial Sequence
  chemically synthesized
tgagaaatccttggggaaga

SEQ ID NO: 415442 - DNA, 20 bp, Artificial Sequence
  chemically synthesized
gttatattgccctcttcccc

SEQ ID NO: 415443 - DNA, 20 bp, Artificial Sequence
  chemically synthesized
ttgagaaatccttggggaag

SEQ ID NO: 415444 - DNA, 20 bp, Artificial Sequence
  chemically synthesized
ttatattgccctcttcccca

SEQ ID NO: 415445 - DNA, 20 bp, Artificial Sequence
  chemically synthesized
cttgagaaatccttggggaa

SEQ ID NO: 415446 - DNA, 20 bp, Artificial Sequence
  chemically synthesized
ttcttgagaaatccttgggg

SEQ ID NO: 415447 - DNA, 20 bp, Artificial Sequence
  chemically synthesized
catttcttgagaaatccttg

SEQ ID NO: 415448 - DNA, 20 bp, Artificial Sequence
  chemically synthesized
acatttcttgagaaatcctt

SEQ ID NO: 415449 - DNA, 20 bp, Artificial Sequence
  chemically synthesized
aacatttcttgagaaatcct

SEQ ID NO: 415450 - DNA, 20 bp, Artificial Sequence
  chemically synthesized
ctcttccccaaggatttctc

SEQ ID NO: 415451 - DNA, 20 bp, Artificial Sequence
  chemically synthesized
aaatcaaataaacatttctt

SEQ ID NO: 415452 - DNA, 20 bp, Artificial Sequence
  chemically synthesized
tgatttgtatgatacatttc

SEQ ID NO: 415453 - DNA, 20 bp, Artificial Sequence
  chemically synthesized
gacatttctgagaacaaagc

SEQ ID NO: 415454 - DNA, 20 bp, Artificial Sequence
  chemically synthesized
tacatttccagctttgttct

SEQ ID NO: 415455 - DNA, 20 bp, Artificial Sequence
  chemically synthesized
aaaagacatttctgagaaca

SEQ ID NO: 415456 - DNA, 20 bp, Artificial Sequence
  chemically synthesized
tgagtagaaaagacatttct

SEQ ID NO: 415457 - DNA, 20 bp, Artificial Sequence
  chemically synthesized
atgaatgaatgtgagtagaa

SEQ ID NO: 415458 - DNA, 20 bp, Artificial Sequence
  chemically synthesized
acagaatgaatgaatgtgag

SEQ ID NO: 415459 - DNA, 20 bp, Artificial Sequence
  chemically synthesized
tgaacagaatgaatgaatgt

SEQ ID NO: 415460 - DNA, 20 bp, Artificial Sequence
  chemically synthesized
tcacattcattcattctgtt

SEQ ID NO: 415461 - DNA, 20 bp, Artificial Sequence
  chemically synthesized
gaacacagtattgtactgaa

SEQ ID NO: 415462 - DNA, 20 bp, Artificial Sequence
  chemically synthesized
aagcctcagcataatgaaca

SEQ ID NO: 415463 - DNA, 20 bp, Artificial Sequence
  chemically synthesized
aatactgtgttcattatgct

SEQ ID NO: 415464 - DNA, 20 bp, Artificial Sequence
  chemically synthesized
atactgtgttcattatgctg

SEQ ID NO: 415465 - DNA, 20 bp, Artificial Sequence
  chemically synthesized
agtttctaattttaaagcct

SEQ ID NO: 415466 - DNA, 20 bp, Artificial Sequence
  chemically synthesized
ttatgctgaggctttaaaat

SEQ ID NO: 415467 - DNA, 20 bp, Artificial Sequence
  chemically synthesized
ccccacagtttctaatttta

SEQ ID NO: 415468 - DNA, 20 bp, Artificial Sequence
  chemically synthesized
ggctttaaaattagaaactg

SEQ ID NO: 415469 - DNA, 20 bp, Artificial Sequence
  chemically synthesized
gctttaaaattagaaactgt

SEQ ID NO: 415470 - DNA, 20 bp, Artificial Sequence
  chemically synthesized
ctttaaaattagaaactgtg

SEQ ID NO: 415471 - DNA, 20 bp, Artificial Sequence
  chemically synthesized
tttaaaattagaaactgtgg

SEQ ID NO: 415472 - DNA, 20 bp, Artificial Sequence
  chemically synthesized
aaacaagattcaaaccccca

SEQ ID NO: 415473 - DNA, 20 bp, Artificial Sequence
  chemically synthesized
agctatcacatggcaaaaac

SEQ ID NO: 415474 - DNA, 20 bp, Artificial Sequence
  chemically synthesized
atcttgtttttgccatgtga

SEQ ID NO: 415475 - DNA, 20 bp, Artificial Sequence
  chemically synthesized
aaggtcacacagctatcaca

SEQ ID NO: 415476 - DNA, 20 bp, Artificial Sequence
  chemically synthesized
gaaatatgcctaaggtcaca

SEQ ID NO: 415477 - DNA, 20 bp, Artificial Sequence
  chemically synthesized
atgtgatagctgtgtgacct

SEQ ID NO: 415478 - DNA, 20 bp, Artificial Sequence
  chemically synthesized
tgtgatagctgtgtgacctt

SEQ ID NO: 415479 - DNA, 20 bp, Artificial Sequence
  chemically synthesized
gaggctgtgaaatatgccta

SEQ ID NO: 415480 - DNA, 20 bp, Artificial Sequence
  chemically synthesized
ggaggctgtgaaatatgcct

SEQ ID NO: 415481 - DNA, 20 bp, Artificial Sequence
  chemically synthesized
gtgaccttaggcatatttca

SEQ ID NO: 415482 - DNA, 20 bp, Artificial Sequence
  chemically synthesized
aggcatatttcacagcctcc

SEQ ID NO: 415483 - DNA, 20 bp, Artificial Sequence
  chemically synthesized
tttatctttattttactggg

SEQ ID NO: 415484 - DNA, 20 bp, Artificial Sequence
  chemically synthesized
ttttatctttattttactgg

SEQ ID NO: 415485 - DNA, 20 bp, Artificial Sequence
  chemically synthesized
tgttttatctttattttact

SEQ ID NO: 415486 - DNA, 20 bp, Artificial Sequence
  chemically synthesized
ctgttttatctttattttac

SEQ ID NO: 415487 - DNA, 20 bp, Artificial Sequence
  chemically synthesized
cacagcctcccagtaaaata

SEQ ID NO: 415488 - DNA, 20 bp, Artificial Sequence
  chemically synthesized
ccagtaaaataaagataaaa

SEQ ID NO: 415489 - DNA, 20 bp, Artificial Sequence
  chemically synthesized
ataaaacagatctttcttca

SEQ ID NO: 415490 - DNA, 20 bp, Artificial Sequence
  chemically synthesized
tgaaataatttctatgaaga

SEQ ID NO: 415491 - DNA, 20 bp, Artificial Sequence
  chemically synthesized
tgcttgaaataatttctatg

SEQ ID NO: 415492 - DNA, 20 bp, Artificial Sequence
  chemically synthesized
ttcttcatagaaattatttc

SEQ ID NO: 415493 - DNA, 20 bp, Artificial Sequence
  chemically synthesized
aattatttcaagcattcaat

SEQ ID NO: 415494 - DNA, 20 bp, Artificial Sequence
  chemically synthesized
attatttcaagcattcaatg

SEQ ID NO: 415495 - DNA, 20 bp, Artificial Sequence
  chemically synthesized
tcaatgaggatattaaaata

SEQ ID NO: 415496 - DNA, 20 bp, Artificial Sequence
  chemically synthesized
ggatattaaaatacagaact

SEQ ID NO: 415497 - DNA, 20 bp, Artificial Sequence
  chemically synthesized
aaaatacagaacttagcaca

SEQ ID NO: 415498 - DNA, 20 bp, Artificial Sequence
  chemically synthesized
ttcctttgtcaccatgtgct

SEQ ID NO: 415499 - DNA, 20 bp, Artificial Sequence
  chemically synthesized
gaacttagcacatggtgaca

SEQ ID NO: 415500 - DNA, 20 bp, Artificial Sequence
  chemically synthesized
aacttagcacatggtgacaa

SEQ ID NO: 415501 - DNA, 20 bp, Artificial Sequence
  chemically synthesized
ttagcacatggtgacaaagg

SEQ ID NO: 415502 - DNA, 20 bp, Artificial Sequence
  chemically synthesized
gacaaaggaagtactcaata

SEQ ID NO: 415503 - DNA, 20 bp, Artificial Sequence
  chemically synthesized
ttataagagccaactttatt

SEQ ID NO: 415504 - DNA, 20 bp, Artificial Sequence
  chemically synthesized
aaggaagtactcaataaagt

SEQ ID NO: 415505 - DNA, 20 bp, Artificial Sequence
  chemically synthesized
tagctacatcataattataa

SEQ ID NO: 415506 - DNA, 20 bp, Artificial Sequence
  chemically synthesized
ggtagctacatcataattat

SEQ ID NO: 415507 - DNA, 20 bp, Artificial Sequence
  chemically synthesized
tggctcttataattatgatg

SEQ ID NO: 415508 - DNA, 20 bp, Artificial Sequence
  chemically synthesized
aataatcaagaaggtgaggg

SEQ ID NO: 415509 - DNA, 20 bp, Artificial Sequence
  chemically synthesized
agaaataatcaagaaggtga

SEQ ID NO: 415510 - DNA, 20 bp, Artificial Sequence
  chemically synthesized
cagaaataatcaagaaggtg

SEQ ID NO: 415511 - DNA, 20 bp, Artificial Sequence
  chemically synthesized
tcagaaataatcaagaaggt

SEQ ID NO: 415512 - DNA, 20 bp, Artificial Sequence
  chemically synthesized
gaactcagaaataatcaaga

SEQ ID NO: 415513 - DNA, 20 bp, Artificial Sequence
  chemically synthesized
agaactcagaaataatcaag

SEQ ID NO: 415514 - DNA, 20 bp, Artificial Sequence
  chemically synthesized
aaaagaactcagaaataatc

SEQ ID NO: 415515 - DNA, 20 bp, Artificial Sequence
  chemically synthesized
tcaccttcttgattatttct

SEQ ID NO: 415516 - DNA, 20 bp, Artificial Sequence
  chemically synthesized
ataaagatccaaaaagaact

SEQ ID NO: 415517 - DNA, 20 bp, Artificial Sequence
  chemically synthesized
gattatttctgagttctttt

SEQ ID NO: 415518 - DNA, 20 bp, Artificial Sequence
  chemically synthesized
agaagtcataaagatccaaa

SEQ ID NO: 415519 - DNA, 20 bp, Artificial Sequence
  chemically synthesized
gtgaatataaagaagtcata

SEQ ID NO: 415520 - DNA, 20 bp, Artificial Sequence
  chemically synthesized
agggactagtgaatataaag

SEQ ID NO: 415521 - DNA, 20 bp, Artificial Sequence
  chemically synthesized
cagagggactagtgaatata

SEQ ID NO: 415522 - DNA, 20 bp, Artificial Sequence
  chemically synthesized
tatgacttctttatattcac

SEQ ID NO: 415523 - DNA, 20 bp, Artificial Sequence
  chemically synthesized
ttcatcgtaagcagagggac

SEQ ID NO: 415524 - DNA, 20 bp, Artificial Sequence
  chemically synthesized
aaaaattcatcgtaagcaga

SEQ ID NO: 415525 - DNA, 20 bp, Artificial Sequence
  chemically synthesized
aaaaaattcatcgtaagcag

SEQ ID NO: 415526 - DNA, 20 bp, Artificial Sequence
  chemically synthesized
gaaaaaattcatcgtaagca

SEQ ID NO: 415527 - DNA, 20 bp, Artificial Sequence
  chemically synthesized
tagaaaaaattcatcgtaag

SEQ ID NO: 415528 - DNA, 20 bp, Artificial Sequence
  chemically synthesized
acatagaaaaaattcatcgt

SEQ ID NO: 415529 - DNA, 20 bp, Artificial Sequence
  chemically synthesized
atctagaatttcaatagaca

SEQ ID NO: 415530 - DNA, 20 bp, Artificial Sequence
  chemically synthesized
gaagacatctagaatttcaa

SEQ ID NO: 415531 - DNA, 20 bp, Artificial Sequence
  chemically synthesized
ttctatgtctattgaaattc

SEQ ID NO: 415532 - DNA, 20 bp, Artificial Sequence
  chemically synthesized
ggtgacatcttgaagacatc

SEQ ID NO: 415533 - DNA, 20 bp, Artificial Sequence
  chemically synthesized
ttgaaattctagatgtcttc

SEQ ID NO: 415534 - DNA, 20 bp, Artificial Sequence
  chemically synthesized
gtaaaggaggtgacatcttg

SEQ ID NO: 415535 - DNA, 20 bp, Artificial Sequence
  chemically synthesized
taagattagtttcgtaaagg

SEQ ID NO: 415536 - DNA, 20 bp, Artificial Sequence
  chemically synthesized
ctaagattagtttcgtaaag

SEQ ID NO: 415537 - DNA, 20 bp, Artificial Sequence
  chemically synthesized
agctaagattagtttcgtaa

SEQ ID NO: 415538 - DNA, 20 bp, Artificial Sequence
  chemically synthesized
gagctaagattagtttcgta

SEQ ID NO: 415539 - DNA, 20 bp, Artificial Sequence
  chemically synthesized
ctcctttacgaaactaatct

SEQ ID NO: 415540 - DNA, 20 bp, Artificial Sequence
  chemically synthesized
cagtttgggggagctaagat

SEQ ID NO: 415541 - DNA, 20 bp, Artificial Sequence
  chemically synthesized
gcattcagtttgggggagct

SEQ ID NO: 415542 - DNA, 20 bp, Artificial Sequence
  chemically synthesized
atgatgcattcagtttgggg

SEQ ID NO: 415543 - DNA, 20 bp, Artificial Sequence
  chemically synthesized
gaatgatgcattcagtttgg

SEQ ID NO: 415544 - DNA, 20 bp, Artificial Sequence
  chemically synthesized
agaatgatgcattcagtttg

SEQ ID NO: 415545 - DNA, 20 bp, Artificial Sequence
  chemically synthesized
gagaatgatgcattcagttt

SEQ ID NO: 415546 - DNA, 20 bp, Artificial Sequence
  chemically synthesized
agagaatgatgcattcagtt

SEQ ID NO: 415547 - DNA, 20 bp, Artificial Sequence
  chemically synthesized
aaagcagagaatgatgcatt

SEQ ID NO: 415548 - DNA, 20 bp, Artificial Sequence
  chemically synthesized
atgcatcattctctgctttg

SEQ ID NO: 415549 - DNA, 20 bp, Artificial Sequence
  chemically synthesized
aagctatgggccgcaaagca

SEQ ID NO: 415550 - DNA, 20 bp, Artificial Sequence
  chemically synthesized
ggaagctatgggccgcaaag

SEQ ID NO: 415551 - DNA, 20 bp, Artificial Sequence
  chemically synthesized
ttgggaagctatgggccgca

SEQ ID NO: 415552 - DNA, 20 bp, Artificial Sequence
  chemically synthesized
attctctgctttgcggccca

SEQ ID NO: 415553 - DNA, 20 bp, Artificial Sequence
  chemically synthesized
gggtaactttgggaagctat

SEQ ID NO: 415554 - DNA, 20 bp, Artificial Sequence
  chemically synthesized
ggggtaactttgggaagcta

SEQ ID NO: 415555 - DNA, 20 bp, Artificial Sequence
  chemically synthesized
ttgcggcccatagcttccca

SEQ ID NO: 415556 - DNA, 20 bp, Artificial Sequence
  chemically synthesized
gaaataggggtaactttggg

SEQ ID NO: 415557 - DNA, 20 bp, Artificial Sequence
  chemically synthesized
actgaaataggggtaacttt

SEQ ID NO: 415558 - DNA, 20 bp, Artificial Sequence
  chemically synthesized
tactgaaataggggtaactt

SEQ ID NO: 415559 - DNA, 20 bp, Artificial Sequence
  chemically synthesized
tcccaaagttacccctattt

SEQ ID NO: 415560 - DNA, 20 bp, Artificial Sequence
  chemically synthesized
tgagttgaatactgaaatag

SEQ ID NO: 415561 - DNA, 20 bp, Artificial Sequence
  chemically synthesized
ttgagttgaatactgaaata

SEQ ID NO: 415562 - DNA, 20 bp, Artificial Sequence
  chemically synthesized
attgagttgaatactgaaat

SEQ ID NO: 415563 - DNA, 20 bp, Artificial Sequence
  chemically synthesized
tattgagttgaatactgaaa

SEQ ID NO: 415564 - DNA, 20 bp, Artificial Sequence
  chemically synthesized
aaaataaaataaaatatatt

SEQ ID NO: 415565 - DNA, 20 bp, Artificial Sequence
  chemically synthesized
ttttatttttattgcttttt

SEQ ID NO: 415566 - DNA, 20 bp, Artificial Sequence
  chemically synthesized
atttttattgctttttgaga

SEQ ID NO: 415567 - DNA, 20 bp, Artificial Sequence
  chemically synthesized
gacagagactccatctcaaa

SEQ ID NO: 415568 - DNA, 20 bp, Artificial Sequence
  chemically synthesized
ttttattgctttttgagatg

SEQ ID NO: 415569 - DNA, 20 bp, Artificial Sequence
  chemically synthesized
gagatggagtctctgtcact

SEQ ID NO: 415570 - DNA, 20 bp, Artificial Sequence
  chemically synthesized
gcactccagcctgagtgaca

SEQ ID NO: 415571 - DNA, 20 bp, Artificial Sequence
  chemically synthesized
agatggagtctctgtcactc

SEQ ID NO: 415572 - DNA, 20 bp, Artificial Sequence
  chemically synthesized
ctgcactccagcctgagtga

SEQ ID NO: 415573 - DNA, 20 bp, Artificial Sequence
  chemically synthesized
ggagtctctgtcactcaggc

SEQ ID NO: 415574 - DNA, 20 bp, Artificial Sequence
  chemically synthesized
agtctctgtcactcaggctg

SEQ ID NO: 415575 - DNA, 20 bp, Artificial Sequence
  chemically synthesized
tcaccactgcactccagcct

SEQ ID NO: 415576 - DNA, 20 bp, Artificial Sequence
  chemically synthesized
ctgtcactcaggctggagtg

SEQ ID NO: 415577 - DNA, 20 bp, Artificial Sequence
  chemically synthesized
gagatttcaccactgcactc

SEQ ID NO: 415578 - DNA, 20 bp, Artificial Sequence
  chemically synthesized
tcactcaggctggagtgcag

SEQ ID NO: 415579 - DNA, 20 bp, Artificial Sequence
  chemically synthesized
ggagtgcagtggtgaaatct

SEQ ID NO: 415580 - DNA, 20 bp, Artificial Sequence
  chemically synthesized
ggtaaaggttgcagtgagct

SEQ ID NO: 415581 - DNA, 20 bp, Artificial Sequence
  chemically synthesized
cgggaggtaaaggttgcagt

SEQ ID NO: 415582 - DNA, 20 bp, Artificial Sequence
  chemically synthesized
cctccgggaggtaaaggttg

SEQ ID NO: 415583 - DNA, 20 bp, Artificial Sequence
  chemically synthesized
ttgaatcctccgggaggtaa

SEQ ID NO: 415584 - DNA, 20 bp, Artificial Sequence
  chemically synthesized
tcactgcaacctttacctcc

SEQ ID NO: 415585 - DNA, 20 bp, Artificial Sequence
  chemically synthesized
cttgaatcctccgggaggta

SEQ ID NO: 415586 - DNA, 20 bp, Artificial Sequence
  chemically synthesized
actgcaacctttacctcccg

SEQ ID NO: 415587 - DNA, 20 bp, Artificial Sequence
  chemically synthesized
ctgcaacctttacctcccgg

SEQ ID NO: 415588 - DNA, 20 bp, Artificial Sequence
  chemically synthesized
aattgcttgaatcctccggg

SEQ ID NO: 415589 - DNA, 20 bp, Artificial Sequence
  chemically synthesized
gaattgcttgaatcctccgg

SEQ ID NO: 415590 - DNA, 20 bp, Artificial Sequence
  chemically synthesized
gagaattgcttgaatcctcc

SEQ ID NO: 415591 - DNA, 20 bp, Artificial Sequence
  chemically synthesized
ggagaattgcttgaatcctc

SEQ ID NO: 415592 - DNA, 20 bp, Artificial Sequence
  chemically synthesized
ctttacctcccggaggattc

SEQ ID NO: 415593 - DNA, 20 bp, Artificial Sequence
  chemically synthesized
ttcaagcaattctcctgtct

SEQ ID NO: 415594 - DNA, 20 bp, Artificial Sequence
  chemically synthesized
tagtctggaggctgagacag

SEQ ID NO: 415595 - DNA, 20 bp, Artificial Sequence
  chemically synthesized
actagtctggaggctgagac

SEQ ID NO: 415596 - DNA, 20 bp, Artificial Sequence
  chemically synthesized
aactagtctggaggctgaga

SEQ ID NO: 415597 - DNA, 20 bp, Artificial Sequence
  chemically synthesized
aattctcctgtctcagcctc

SEQ ID NO: 415598 - DNA, 20 bp, Artificial Sequence
  chemically synthesized
tcacaactagtctggaggct

SEQ ID NO: 415599 - DNA, 20 bp, Artificial Sequence
  chemically synthesized
tcctgtctcagcctccagac

SEQ ID NO: 415600 - DNA, 20 bp, Artificial Sequence
  chemically synthesized
tgtaatcacaactagtctgg

SEQ ID NO: 415601 - DNA, 20 bp, Artificial Sequence
  chemically synthesized
ctgtaatcacaactagtctg

SEQ ID NO: 415602 - DNA, 20 bp, Artificial Sequence
  chemically synthesized
gcctgtaatcacaactagtc

SEQ ID NO: 415603 - DNA, 20 bp, Artificial Sequence
  chemically synthesized
tgcatgcctgtaatcacaac

SEQ ID NO: 415604 - DNA, 20 bp, Artificial Sequence
  chemically synthesized
ctccagactagttgtgatta

SEQ ID NO: 415605 - DNA, 20 bp, Artificial Sequence
  chemically synthesized
tccagactagttgtgattac

SEQ ID NO: 415606 - DNA, 20 bp, Artificial Sequence
  chemically synthesized
tagttgtgattacaggcatg

SEQ ID NO: 415607 - DNA, 20 bp, Artificial Sequence
  chemically synthesized
tctactaaaaatagaaaaat

SEQ ID NO: 415608 - DNA, 20 bp, Artificial Sequence
  chemically synthesized
gcagctaatttttctatttt

SEQ ID NO: 415609 - DNA, 20 bp, Artificial Sequence
  chemically synthesized
gctaatttttctatttttag

SEQ ID NO: 415610 - DNA, 20 bp, Artificial Sequence
  chemically synthesized
acccctgtctctactaaaaa

SEQ ID NO: 415611 - DNA, 20 bp, Artificial Sequence
  chemically synthesized
taatttttctatttttagta

SEQ ID NO: 415612 - DNA, 20 bp, Artificial Sequence
  chemically synthesized
ttttctatttttagtagaga

SEQ ID NO: 415613 - DNA, 20 bp, Artificial Sequence
  chemically synthesized
tttctatttttagtagagac

SEQ ID NO: 415614 - DNA, 20 bp, Artificial Sequence
  chemically synthesized
ttctatttttagtagagaca

SEQ ID NO: 415615 - DNA, 20 bp, Artificial Sequence
  chemically synthesized
tctatttttagtagagacag

SEQ ID NO: 415616 - DNA, 20 bp, Artificial Sequence
  chemically synthesized
accagcttgatcaacatggt

SEQ ID NO: 415617 - DNA, 20 bp, Artificial Sequence
  chemically synthesized
cgacaccagcttgatcaaca

SEQ ID NO: 415618 - DNA, 20 bp, Artificial Sequence
  chemically synthesized
ggggtctcaccatgttgatc

SEQ ID NO: 415619 - DNA, 20 bp, Artificial Sequence
  chemically synthesized
tctcaccatgttgatcaagc

SEQ ID NO: 415620 - DNA, 20 bp, Artificial Sequence
  chemically synthesized
tgaagtcaggagttcgacac

SEQ ID NO: 415621 - DNA, 20 bp, Artificial Sequence
  chemically synthesized
gatggatcatttgaagtcag

SEQ ID NO: 415622 - DNA, 20 bp, Artificial Sequence
  chemically synthesized
cggatggatcatttgaagtc

SEQ ID NO: 415623 - DNA, 20 bp, Artificial Sequence
  chemically synthesized
gcggatggatcatttgaagt

SEQ ID NO: 415624 - DNA, 20 bp, Artificial Sequence
  chemically synthesized
ggaggcggatggatcatttg

SEQ ID NO: 415625 - DNA, 20 bp, Artificial Sequence
  chemically synthesized
ctttgggaggcggaggcgga

SEQ ID NO: 415626 - DNA, 20 bp, Artificial Sequence
  chemically synthesized
agaactttgggaggcggagg

SEQ ID NO: 415627 - DNA, 20 bp, Artificial Sequence
  chemically synthesized
cccagaactttgggaggcgg

SEQ ID NO: 415628 - DNA, 20 bp, Artificial Sequence
  chemically synthesized
tcccagaactttgggaggcg

SEQ ID NO: 415629 - DNA, 20 bp, Artificial Sequence
  chemically synthesized
ccatccgcctccgcctccca

SEQ ID NO: 415630 - DNA, 20 bp, Artificial Sequence
  chemically synthesized
gatcccagaactttgggagg

SEQ ID NO: 415631 - DNA, 20 bp, Artificial Sequence
  chemically synthesized
tgtgatcccagaactttggg

SEQ ID NO: 415632 - DNA, 20 bp, Artificial Sequence
  chemically synthesized
ctgtgatcccagaactttgg

SEQ ID NO: 415633 - DNA, 20 bp, Artificial Sequence
  chemically synthesized
gcctccgcctcccaaagttc

SEQ ID NO: 415634 - DNA, 20 bp, Artificial Sequence
  chemically synthesized
acctgtgatcccagaacttt

SEQ ID NO: 415635 - DNA, 20 bp, Artificial Sequence
  chemically synthesized
cctccgcctcccaaagttct

SEQ ID NO: 415636 - DNA, 20 bp, Artificial Sequence
  chemically synthesized
cacctgtgatcccagaactt

SEQ ID NO: 415637 - DNA, 20 bp, Artificial Sequence
  chemically synthesized
ctcccaaagttctgggatca

SEQ ID NO: 415638 - DNA, 20 bp, Artificial Sequence
  chemically synthesized
tcccaaagttctgggatcac

SEQ ID NO: 415639 - DNA, 20 bp, Artificial Sequence
  chemically synthesized
gtggctcacacctgtgatcc

SEQ ID NO: 415640 - DNA, 20 bp, Artificial Sequence
  chemically synthesized
agttctgggatcacaggtgt

SEQ ID NO: 415641 - DNA, 20 bp, Artificial Sequence
  chemically synthesized
caggtgtgagccactgcatc

SEQ ID NO: 415642 - DNA, 20 bp, Artificial Sequence
  chemically synthesized
ttagtcaaagccagatgcag

SEQ ID NO: 415643 - DNA, 20 bp, Artificial Sequence
  chemically synthesized
tatttagtcaaagccagatg

SEQ ID NO: 415644 - DNA, 20 bp, Artificial Sequence
  chemically synthesized
aaaatatatttagtcaaagc

SEQ ID NO: 415645 - DNA, 20 bp, Artificial Sequence
  chemically synthesized
aattaaaatatatttagtca

SEQ ID NO: 415646 - DNA, 20 bp, Artificial Sequence
  chemically synthesized
taactcaattaaaatatatt

SEQ ID NO: 415647 - DNA, 20 bp, Artificial Sequence
  chemically synthesized
tgactaaatatattttaatt

SEQ ID NO: 415648 - DNA, 20 bp, Artificial Sequence
  chemically synthesized
atattttaattgagttaata

SEQ ID NO: 415649 - DNA, 20 bp, Artificial Sequence
  chemically synthesized
tattttaattgagttaatat

SEQ ID NO: 415650 - DNA, 20 bp, Artificial Sequence
  chemically synthesized
tcatggaattcacagtaagg

SEQ ID NO: 415651 - DNA, 20 bp, Artificial Sequence
  chemically synthesized
ccttcatggaattcacagta

SEQ ID NO: 415652 - DNA, 20 bp, Artificial Sequence
  chemically synthesized
gccttcatggaattcacagt

SEQ ID NO: 415653 - DNA, 20 bp, Artificial Sequence
  chemically synthesized
cacagccttcatggaattca

SEQ ID NO: 415654 - DNA, 20 bp, Artificial Sequence
  chemically synthesized
gccttactgtgaattccatg

SEQ ID NO: 415655 - DNA, 20 bp, Artificial Sequence
  chemically synthesized
ccttactgtgaattccatga

SEQ ID NO: 415656 - DNA, 20 bp, Artificial Sequence
  chemically synthesized
aaataacttcacagccttca

SEQ ID NO: 415657 - DNA, 20 bp, Artificial Sequence
  chemically synthesized
tgaattccatgaaggctgtg

SEQ ID NO: 415658 - DNA, 20 bp, Artificial Sequence
  chemically synthesized
agaagaattaaataacttca

SEQ ID NO: 415659 - DNA, 20 bp, Artificial Sequence
  chemically synthesized
tggctttggacaaagtacag

SEQ ID NO: 415660 - DNA, 20 bp, Artificial Sequence
  chemically synthesized
ccatggctttggacaaagta

SEQ ID NO: 415661 - DNA, 20 bp, Artificial Sequence
  chemically synthesized
attcttctgtactttgtcca

SEQ ID NO: 415662 - DNA, 20 bp, Artificial Sequence
  chemically synthesized
tgcttccatggctttggaca

SEQ ID NO: 415663 - DNA, 20 bp, Artificial Sequence
  chemically synthesized
ctgtactttgtccaaagcca

SEQ ID NO: 415664 - DNA, 20 bp, Artificial Sequence
  chemically synthesized
gcaaggtgcttccatggctt

SEQ ID NO: 415665 - DNA, 20 bp, Artificial Sequence
  chemically synthesized
tactttgtccaaagccatgg

SEQ ID NO: 415666 - DNA, 20 bp, Artificial Sequence
  chemically synthesized
ccaattgcaaggtgcttcca

SEQ ID NO: 415667 - DNA, 20 bp, Artificial Sequence
  chemically synthesized
ccatggaagcaccttgcaat

SEQ ID NO: 415668 - DNA, 20 bp, Artificial Sequence
  chemically synthesized
gttgaattctaccaattgca

SEQ ID NO: 415669 - DNA, 20 bp, Artificial Sequence
  chemically synthesized
tgttgaattctaccaattgc

SEQ ID NO: 415670 - DNA, 20 bp, Artificial Sequence
  chemically synthesized
tggaagcaccttgcaattgg

SEQ ID NO: 415671 - DNA, 20 bp, Artificial Sequence
  chemically synthesized
caattggtagaattcaacac

SEQ ID NO: 415672 - DNA, 20 bp, Artificial Sequence
  chemically synthesized
aattggtagaattcaacact

SEQ ID NO: 415673 - DNA, 20 bp, Artificial Sequence
  chemically synthesized
attggtagaattcaacactg

SEQ ID NO: 415674 - DNA, 20 bp, Artificial Sequence
  chemically synthesized
ttggtagaattcaacactgg

SEQ ID NO: 415675 - DNA, 20 bp, Artificial Sequence
  chemically synthesized
ggtagaattcaacactgggg

SEQ ID NO: 415676 - DNA, 20 bp, Artificial Sequence
  chemically synthesized
gtagaattcaacactggggg

SEQ ID NO: 415677 - DNA, 20 bp, Artificial Sequence
  chemically synthesized
gttactttaagatcctcccc

SEQ ID NO: 415678 - DNA, 20 bp, Artificial Sequence
  chemically synthesized
aacactgggggaggatctta

SEQ ID NO: 415679 - DNA, 20 bp, Artificial Sequence
  chemically synthesized
acatatttattcgttacttt

SEQ ID NO: 415680 - DNA, 20 bp, Artificial Sequence
  chemically synthesized
tgtcacaatcgtatgtgcat

SEQ ID NO: 415681 - DNA, 20 bp, Artificial Sequence
  chemically synthesized
tcacaatcgtatgtgcatta

SEQ ID NO: 415682 - DNA, 20 bp, Artificial Sequence
  chemically synthesized
acaatcgtatgtgcattaga

SEQ ID NO: 415683 - DNA, 20 bp, Artificial Sequence
  chemically synthesized
gtatgtgcattagagagcta

SEQ ID NO: 415684 - DNA, 20 bp, Artificial Sequence
  chemically synthesized
cttcttaattaaagaatcca

SEQ ID NO: 415685 - DNA, 20 bp, Artificial Sequence
  chemically synthesized
gagctatggattctttaatt

SEQ ID NO: 415686 - DNA, 20 bp, Artificial Sequence
  chemically synthesized
tcttagcagcttcttaatta

SEQ ID NO: 415687 - DNA, 20 bp, Artificial Sequence
  chemically synthesized
ctatggattctttaattaag

SEQ ID NO: 415688 - DNA, 20 bp, Artificial Sequence
  chemically synthesized
tctttaattaagaagctgct

SEQ ID NO: 415689 - DNA, 20 bp, Artificial Sequence
  chemically synthesized
tttaattaagaagctgctaa

SEQ ID NO: 415690 - DNA, 20 bp, Artificial Sequence
  chemically synthesized
gcctcccgagtagctcttag

SEQ ID NO: 415691 - DNA, 20 bp, Artificial Sequence
  chemically synthesized
tcagcctcccgagtagctct

SEQ ID NO: 415692 - DNA, 20 bp, Artificial Sequence
  chemically synthesized
agaagctgctaagagctact

SEQ ID NO: 415693 - DNA, 20 bp, Artificial Sequence
  chemically synthesized
gaagctgctaagagctactc

SEQ ID NO: 415694 - DNA, 20 bp, Artificial Sequence
  chemically synthesized
agctgctaagagctactcgg

SEQ ID NO: 415695 - DNA, 20 bp, Artificial Sequence
  chemically synthesized
gctgctaagagctactcggg

SEQ ID NO: 415696 - DNA, 20 bp, Artificial Sequence
  chemically synthesized
tcctgcctcagcctcccgag

SEQ ID NO: 415697 - DNA, 20 bp, Artificial Sequence
  chemically synthesized
ttctcctgcctcagcctccc

SEQ ID NO: 415698 - DNA, 20 bp, Artificial Sequence
  chemically synthesized
taagagctactcgggaggct

SEQ ID NO: 415699 - DNA, 20 bp, Artificial Sequence
  chemically synthesized
aagagctactcgggaggctg

SEQ ID NO: 415700 - DNA, 20 bp, Artificial Sequence
  chemically synthesized
agctactcgggaggctgagg

SEQ ID NO: 415701 - DNA, 20 bp, Artificial Sequence
  chemically synthesized
gctactcgggaggctgaggc

SEQ ID NO: 415702 - DNA, 20 bp, Artificial Sequence
  chemically synthesized
tactcgggaggctgaggcag

SEQ ID NO: 415703 - DNA, 20 bp, Artificial Sequence
  chemically synthesized
tttacaccattctcctgcct

SEQ ID NO: 415704 - DNA, 20 bp, Artificial Sequence
  chemically synthesized
gggaggctgaggcaggagaa

SEQ ID NO: 415705 - DNA, 20 bp, Artificial Sequence
  chemically synthesized
gcaggagaatggtgtaaacc

SEQ ID NO: 415706 - DNA, 20 bp, Artificial Sequence
  chemically synthesized
caggagaatggtgtaaaccc

SEQ ID NO: 415707 - DNA, 20 bp, Artificial Sequence
  chemically synthesized
ggagaatggtgtaaacccgg

SEQ ID NO: 415708 - DNA, 20 bp, Artificial Sequence
  chemically synthesized
gagaatggtgtaaacccggg

SEQ ID NO: 415709 - DNA, 20 bp, Artificial Sequence
  chemically synthesized
aatggtgtaaacccgggagg

SEQ ID NO: 415710 - DNA, 20 bp, Artificial Sequence
  chemically synthesized
cactgcaagctccgcctccc

SEQ ID NO: 415711 - DNA, 20 bp, Artificial Sequence
  chemically synthesized
tggtgtaaacccgggaggcg

SEQ ID NO: 415712 - DNA, 20 bp, Artificial Sequence
  chemically synthesized
tcactgcaagctccgcctcc

SEQ ID NO: 415713 - DNA, 20 bp, Artificial Sequence
  chemically synthesized
aacccgggaggcggagcttg

SEQ ID NO: 415714 - DNA, 20 bp, Artificial Sequence
  chemically synthesized
cgggaggcggagcttgcagt

SEQ ID NO: 415715 - DNA, 20 bp, Artificial Sequence
  chemically synthesized
gcgcgatgtcggctcactgc

SEQ ID NO: 415716 - DNA, 20 bp, Artificial Sequence
  chemically synthesized
ggagtgcagtggcgcgatgt

SEQ ID NO: 415717 - DNA, 20 bp, Artificial Sequence
  chemically synthesized
tcgcccaggctggagtgcag

SEQ ID NO: 415718 - DNA, 20 bp, Artificial Sequence
  chemically synthesized
gacatcgcgccactgcactc

SEQ ID NO: 415719 - DNA, 20 bp, Artificial Sequence
  chemically synthesized
ctgtcgcccaggctggagtg

SEQ ID NO: 415720 - DNA, 20 bp, Artificial Sequence
  chemically synthesized
cgcgccactgcactccagcc

SEQ ID NO: 415721 - DNA, 20 bp, Artificial Sequence
  chemically synthesized
gcgccactgcactccagcct

SEQ ID NO: 415722 - DNA, 20 bp, Artificial Sequence
  chemically synthesized
tcgctctgtcgcccaggctg

SEQ ID NO: 415723 - DNA, 20 bp, Artificial Sequence
  chemically synthesized
tctcgctctgtcgcccaggc

SEQ ID NO: 415724 - DNA, 20 bp, Artificial Sequence
  chemically synthesized
ctgcactccagcctgggcga

SEQ ID NO: 415725 - DNA, 20 bp, Artificial Sequence
  chemically synthesized
ggagtctcgctctgtcgccc

SEQ ID NO: 415726 - DNA, 20 bp, Artificial Sequence
  chemically synthesized
gcactccagcctgggcgaca

SEQ ID NO: 415727 - DNA, 20 bp, Artificial Sequence
  chemically synthesized
tggagtctcgctctgtcgcc

SEQ ID NO: 415728 - DNA, 20 bp, Artificial Sequence
  chemically synthesized
tccagcctgggcgacagagc

SEQ ID NO: 415729 - DNA, 20 bp, Artificial Sequence
  chemically synthesized
ttattcttttttttgagatg

SEQ ID NO: 415730 - DNA, 20 bp, Artificial Sequence
  chemically synthesized
atttattcttttttttgaga

SEQ ID NO: 415731 - DNA, 20 bp, Artificial Sequence
  chemically synthesized
cgagactccatctcaaaaaa

SEQ ID NO: 415732 - DNA, 20 bp, Artificial Sequence
  chemically synthesized
taatatttattctttttttt

SEQ ID NO: 415733 - DNA, 20 bp, Artificial Sequence
  chemically synthesized
aaagaataaatattaattac

SEQ ID NO: 415734 - DNA, 20 bp, Artificial Sequence
  chemically synthesized
aaaatatttaatatgtcatc

SEQ ID NO: 415735 - DNA, 20 bp, Artificial Sequence
  chemically synthesized
tttattataagttttaatat

SEQ ID NO: 415736 - DNA, 20 bp, Artificial Sequence
  chemically synthesized
cattaaagttattttattat

SEQ ID NO: 415737 - DNA, 20 bp, Artificial Sequence
  chemically synthesized
tataataaaataactttaat

SEQ ID NO: 415738 - DNA, 20 bp, Artificial Sequence
  chemically synthesized
aataaaataactttaatgag

SEQ ID NO: 415739 - DNA, 20 bp, Artificial Sequence
  chemically synthesized
aatttccaagccactcatta

SEQ ID NO: 415740 - DNA, 20 bp, Artificial Sequence
  chemically synthesized
aataactttaatgagtggct

SEQ ID NO: 415741 - DNA, 20 bp, Artificial Sequence
  chemically synthesized
aaattaaacagttaatttcc

SEQ ID NO: 415742 - DNA, 20 bp, Artificial Sequence
  chemically synthesized
atatttctttgaaaattaaa

SEQ ID NO: 415743 - DNA, 20 bp, Artificial Sequence
  chemically synthesized
aattaactgtttaattttca

SEQ ID NO: 415744 - DNA, 20 bp, Artificial Sequence
  chemically synthesized
gtctttatttcatttcaaaa

SEQ ID NO: 415745 - DNA, 20 bp, Artificial Sequence
  chemically synthesized
tgcttttttgaaatgaaata

SEQ ID NO: 415746 - DNA, 20 bp, Artificial Sequence
  chemically synthesized
agagccagtcattaatgaac

SEQ ID NO: 415747 - DNA, 20 bp, Artificial Sequence
  chemically synthesized
atttcttgttcattaatgac

SEQ ID NO: 415748 - DNA, 20 bp, Artificial Sequence
  chemically synthesized
tgttcattaatgactggctc

SEQ ID NO: 415749 - DNA, 20 bp, Artificial Sequence
  chemically synthesized
tgtgtcacttttaccagagc

SEQ ID NO: 415750 - DNA, 20 bp, Artificial Sequence
  chemically synthesized
ttaatgactggctctggtaa

SEQ ID NO: 415751 - DNA, 20 bp, Artificial Sequence
  chemically synthesized
tttttgtgtcacttttacca

SEQ ID NO: 415752 - DNA, 20 bp, Artificial Sequence
  chemically synthesized
cctttttgtgtcacttttac

SEQ ID NO: 415753 - DNA, 20 bp, Artificial Sequence
  chemically synthesized
tctggtaaaagtgacacaaa

SEQ ID NO: 415754 - DNA, 20 bp, Artificial Sequence
  chemically synthesized
ctggtaaaagtgacacaaaa

SEQ ID NO: 415755 - DNA, 20 bp, Artificial Sequence
  chemically synthesized
taaaagtgacacaaaaaggt

SEQ ID NO: 415756 - DNA, 20 bp, Artificial Sequence
  chemically synthesized
acacaaaaaggtgagtgtaa

SEQ ID NO: 415757 - DNA, 20 bp, Artificial Sequence
  chemically synthesized
aggtgagtgtaacagtgtta

SEQ ID NO: 415758 - DNA, 20 bp, Artificial Sequence
  chemically synthesized
gtgtaacagtgttatggaaa

SEQ ID NO: 415759 - DNA, 20 bp, Artificial Sequence
  chemically synthesized
tgttatggaaaaagatgaaa

SEQ ID NO: 415760 - DNA, 20 bp, Artificial Sequence
  chemically synthesized
gttatggaaaaagatgaaac

SEQ ID NO: 415761 - DNA, 20 bp, Artificial Sequence
  chemically synthesized
tggaaaaagatgaaacagga

SEQ ID NO: 415762 - DNA, 20 bp, Artificial Sequence
  chemically synthesized
aacaggatagtaaaataact

SEQ ID NO: 415763 - DNA, 20 bp, Artificial Sequence
  chemically synthesized
caggatagtaaaataactga

SEQ ID NO: 415764 - DNA, 20 bp, Artificial Sequence
  chemically synthesized
tagtaaaataactgagagat

SEQ ID NO: 415765 - DNA, 20 bp, Artificial Sequence
  chemically synthesized
caggctatttgctcatctct

SEQ ID NO: 415766 - DNA, 20 bp, Artificial Sequence
  chemically synthesized
ataactgagagatgagcaaa

SEQ ID NO: 415767 - DNA, 20 bp, Artificial Sequence
  chemically synthesized
tgagagatgagcaaatagcc

SEQ ID NO: 415768 - DNA, 20 bp, Artificial Sequence
  chemically synthesized
tctacgttgctggatgggcc

SEQ ID NO: 415769 - DNA, 20 bp, Artificial Sequence
  chemically synthesized
agcaaatagcctggcccatc

SEQ ID NO: 415770 - DNA, 20 bp, Artificial Sequence
  chemically synthesized
gtctacgttgctggatgggc

SEQ ID NO: 415771 - DNA, 20 bp, Artificial Sequence
  chemically synthesized
atgtgtctacgttgctggat

SEQ ID NO: 415772 - DNA, 20 bp, Artificial Sequence
  chemically synthesized
tatgtgtctacgttgctgga

SEQ ID NO: 415773 - DNA, 20 bp, Artificial Sequence
  chemically synthesized
gcctggcccatccagcaacg

SEQ ID NO: 415774 - DNA, 20 bp, Artificial Sequence
  chemically synthesized
gatatatgtgtctacgttgc

SEQ ID NO: 415775 - DNA, 20 bp, Artificial Sequence
  chemically synthesized
gacacatatatctaaatgtg

SEQ ID NO: 415776 - DNA, 20 bp, Artificial Sequence
  chemically synthesized
gaacccgccaacttcacatt

SEQ ID NO: 415777 - DNA, 20 bp, Artificial Sequence
  chemically synthesized
catatatctaaatgtgaagt

SEQ ID NO: 415778 - DNA, 20 bp, Artificial Sequence
  chemically synthesized
atatctaaatgtgaagttgg

SEQ ID NO: 415779 - DNA, 20 bp, Artificial Sequence
  chemically synthesized
tatctaaatgtgaagttggc

SEQ ID NO: 415780 - DNA, 20 bp, Artificial Sequence
  chemically synthesized
tggcgggttcaaacgaatat

SEQ ID NO: 415781 - DNA, 20 bp, Artificial Sequence
  chemically synthesized
caaacgaatattggcgccat

SEQ ID NO: 415782 - DNA, 20 bp, Artificial Sequence
  chemically synthesized
aaacgaatattggcgccatg

SEQ ID NO: 415783 - DNA, 20 bp, Artificial Sequence
  chemically synthesized
acgaatattggcgccatgag

SEQ ID NO: 415784 - DNA, 20 bp, Artificial Sequence
  chemically synthesized
cgaatattggcgccatgagg

SEQ ID NO: 415785 - DNA, 20 bp, Artificial Sequence
  chemically synthesized
agatatcatgagcctcctca

SEQ ID NO: 415786 - DNA, 20 bp, Artificial Sequence
  chemically synthesized
tgagtagcaatagatatcat

SEQ ID NO: 415787 - DNA, 20 bp, Artificial Sequence
  chemically synthesized
aaaaatgaattgagtagcaa

SEQ ID NO: 415788 - DNA, 20 bp, Artificial Sequence
  chemically synthesized
aaaaaaaaaaatgaattgag

SEQ ID NO: 415789 - DNA, 20 bp, Artificial Sequence
  chemically synthesized
aaaaaaaaaaaaaatgaatt

SEQ ID NO: 415790 - DNA, 20 bp, Artificial Sequence
  chemically synthesized
attttttttttttttttttt

SEQ ID NO: 415791 - DNA, 20 bp, Artificial Sequence
  chemically synthesized
ttttttttttttttttgaga

SEQ ID NO: 415792 - DNA, 20 bp, Artificial Sequence
  chemically synthesized
ttttttttttttttgagaca

SEQ ID NO: 415793 - DNA, 20 bp, Artificial Sequence
  chemically synthesized
tccagcctgggtgacagagc

SEQ ID NO: 415794 - DNA, 20 bp, Artificial Sequence
  chemically synthesized
cagagtcttgctctgtcacc

SEQ ID NO: 415795 - DNA, 20 bp, Artificial Sequence
  chemically synthesized
gcactccagcctgggtgaca

SEQ ID NO: 415796 - DNA, 20 bp, Artificial Sequence
  chemically synthesized
agagtcttgctctgtcaccc

SEQ ID NO: 415797 - DNA, 20 bp, Artificial Sequence
  chemically synthesized
ctgcactccagcctgggtga

SEQ ID NO: 415798 - DNA, 20 bp, Artificial Sequence
  chemically synthesized
tcttgctctgtcacccaggc

SEQ ID NO: 415799 - DNA, 20 bp, Artificial Sequence
  chemically synthesized
ttgctctgtcacccaggctg

SEQ ID NO: 415800 - DNA, 20 bp, Artificial Sequence
  chemically synthesized
gtgacactgcactccagcct

SEQ ID NO: 415801 - DNA, 20 bp, Artificial Sequence
  chemically synthesized
cgtgacactgcactccagcc

SEQ ID NO: 415802 - DNA, 20 bp, Artificial Sequence
  chemically synthesized
ctgtcacccaggctggagtg

SEQ ID NO: 415803 - DNA, 20 bp, Artificial Sequence
  chemically synthesized
gagatcgtgacactgcactc

SEQ ID NO: 415804 - DNA, 20 bp, Artificial Sequence
  chemically synthesized
ggagtgcagtgtcacgatct

SEQ ID NO: 415805 - DNA, 20 bp, Artificial Sequence
  chemically synthesized
ggcagaggttgcagtgagcc

SEQ ID NO: 415806 - DNA, 20 bp, Artificial Sequence
  chemically synthesized
tgggaggcagaggttgcagt

SEQ ID NO: 415807 - DNA, 20 bp, Artificial Sequence
  chemically synthesized
aacctgggaggcagaggttg

SEQ ID NO: 415808 - DNA, 20 bp, Artificial Sequence
  chemically synthesized
tgcttaaacctgggaggcag

SEQ ID NO: 415809 - DNA, 20 bp, Artificial Sequence
  chemically synthesized
tcactgcaacctctgcctcc

SEQ ID NO: 415810 - DNA, 20 bp, Artificial Sequence
  chemically synthesized
gtgcttaaacctgggaggca

SEQ ID NO: 415811 - DNA, 20 bp, Artificial Sequence
  chemically synthesized
cactgcaacctctgcctccc

SEQ ID NO: 415812 - DNA, 20 bp, Artificial Sequence
  chemically synthesized
aagtgcttaaacctgggagg

SEQ ID NO: 415813 - DNA, 20 bp, Artificial Sequence
  chemically synthesized
gagaagtgcttaaacctggg

SEQ ID NO: 415814 - DNA, 20 bp, Artificial Sequence
  chemically synthesized
ggagaagtgcttaaacctgg

SEQ ID NO: 415815 - DNA, 20 bp, Artificial Sequence
  chemically synthesized
aacctctgcctcccaggttt

SEQ ID NO: 415816 - DNA, 20 bp, Artificial Sequence
  chemically synthesized
caggagaagtgcttaaacct

SEQ ID NO: 415817 - DNA, 20 bp, Artificial Sequence
  chemically synthesized
gcaggagaagtgcttaaacc

SEQ ID NO: 415818 - DNA, 20 bp, Artificial Sequence
  chemically synthesized
ttgggaggctgaggcaggag

SEQ ID NO: 415819 - DNA, 20 bp, Artificial Sequence
  chemically synthesized
tttaagcacttctcctgcct

SEQ ID NO: 415820 - DNA, 20 bp, Artificial Sequence
  chemically synthesized
tacttgggaggctgaggcag

SEQ ID NO: 415821 - DNA, 20 bp, Artificial Sequence
  chemically synthesized
gctacttgggaggctgaggc

SEQ ID NO: 415822 - DNA, 20 bp, Artificial Sequence
  chemically synthesized
agctacttgggaggctgagg

SEQ ID NO: 415823 - DNA, 20 bp, Artificial Sequence
  chemically synthesized
cccagctacttgggaggctg

SEQ ID NO: 415824 - DNA, 20 bp, Artificial Sequence
  chemically synthesized
tcccagctacttgggaggct

SEQ ID NO: 415825 - DNA, 20 bp, Artificial Sequence
  chemically synthesized
ttctcctgcctcagcctccc

SEQ ID NO: 415826 - DNA, 20 bp, Artificial Sequence
  chemically synthesized
tcctgcctcagcctcccaag

SEQ ID NO: 415827 - DNA, 20 bp, Artificial Sequence
  chemically synthesized
tgtagtcccagctacttggg

SEQ ID NO: 415828 - DNA, 20 bp, Artificial Sequence
  chemically synthesized
ctgtagtcccagctacttgg

SEQ ID NO: 415829 - DNA, 20 bp, Artificial Sequence
  chemically synthesized
gcctcagcctcccaagtagc

SEQ ID NO: 415830 - DNA, 20 bp, Artificial Sequence
  chemically synthesized
gcctgtagtcccagctactt

SEQ ID NO: 415831 - DNA, 20 bp, Artificial Sequence
  chemically synthesized
cctcagcctcccaagtagct

SEQ ID NO: 415832 - DNA, 20 bp, Artificial Sequence
  chemically synthesized
tgcctgtagtcccagctact

SEQ ID NO: 415833 - DNA, 20 bp, Artificial Sequence
  chemically synthesized
ctcccaagtagctgggacta

SEQ ID NO: 415834 - DNA, 20 bp, Artificial Sequence
  chemically synthesized
tcccaagtagctgggactac

SEQ ID NO: 415835 - DNA, 20 bp, Artificial Sequence
  chemically synthesized
gtggtgcgtgcctgtagtcc

SEQ ID NO: 415836 - DNA, 20 bp, Artificial Sequence
  chemically synthesized
ggtgtggtggtgcgtgcctg

SEQ ID NO: 415837 - DNA, 20 bp, Artificial Sequence
  chemically synthesized
caggcacgcaccaccacacc

SEQ ID NO: 415838 - DNA, 20 bp, Artificial Sequence
  chemically synthesized
gaaaaattagctgggtgtgg

SEQ ID NO: 415839 - DNA, 20 bp, Artificial Sequence
  chemically synthesized
atagaaaaattagctgggtg

SEQ ID NO: 415840 - DNA, 20 bp, Artificial Sequence
  chemically synthesized
taaaaatagaaaaattagct

SEQ ID NO: 415841 - DNA, 20 bp, Artificial Sequence
  chemically synthesized
ctaaaaatagaaaaattagc

SEQ ID NO: 415842 - DNA, 20 bp, Artificial Sequence
  chemically synthesized
tctactaaaaatagaaaaat

SEQ ID NO: 415843 - DNA, 20 bp, Artificial Sequence
  chemically synthesized
ccagctaatttttctatttt

SEQ ID NO: 415844 - DNA, 20 bp, Artificial Sequence
  chemically synthesized
gctaatttttctatttttag

SEQ ID NO: 415845 - DNA, 20 bp, Artificial Sequence
  chemically synthesized
aaccccgtctctactaaaaa

SEQ ID NO: 415846 - DNA, 20 bp, Artificial Sequence
  chemically synthesized
taatttttctatttttagta

SEQ ID NO: 415847 - DNA, 20 bp, Artificial Sequence
  chemically synthesized
ttttctatttttagtagaga

SEQ ID NO: 415848 - DNA, 20 bp, Artificial Sequence
  chemically synthesized
tttctatttttagtagagac

SEQ ID NO: 415849 - DNA, 20 bp, Artificial Sequence
  chemically synthesized
ttctatttttagtagagacg

SEQ ID NO: 415850 - DNA, 20 bp, Artificial Sequence
  chemically synthesized
gagacggggtttcaccatgt

SEQ ID NO: 415851 - DNA, 20 bp, Artificial Sequence
  chemically synthesized
cggggtttcaccatgttggc

SEQ ID NO: 415852 - DNA, 20 bp, Artificial Sequence
  chemically synthesized
cgagaccatcctggccaaca

SEQ ID NO: 415853 - DNA, 20 bp, Artificial Sequence
  chemically synthesized
ggggtttcaccatgttggcc

SEQ ID NO: 415854 - DNA, 20 bp, Artificial Sequence
  chemically synthesized
tttcaccatgttggccagga

SEQ ID NO: 415855 - DNA, 20 bp, Artificial Sequence
  chemically synthesized
tcaagagatcgagaccatcc

SEQ ID NO: 415856 - DNA, 20 bp, Artificial Sequence
  chemically synthesized
gatcatgaggtcaagagatc

SEQ ID NO: 415857 - DNA, 20 bp, Artificial Sequence
  chemically synthesized
ctggtggatcatgaggtcaa

SEQ ID NO: 415858 - DNA, 20 bp, Artificial Sequence
  chemically synthesized
ggctggtggatcatgaggtc

SEQ ID NO: 415859 - DNA, 20 bp, Artificial Sequence
  chemically synthesized
gccgaggctggtggatcatg

SEQ ID NO: 415860 - DNA, 20 bp, Artificial Sequence
  chemically synthesized
ggccgaggctggtggatcat

SEQ ID NO: 415861 - DNA, 20 bp, Artificial Sequence
  chemically synthesized
ctcttgacctcatgatccac

SEQ ID NO: 415862 - DNA, 20 bp, Artificial Sequence
  chemically synthesized
acctcatgatccaccagcct

SEQ ID NO: 415863 - DNA, 20 bp, Artificial Sequence
  chemically synthesized
ctttgggaggccgaggctgg

SEQ ID NO: 415864 - DNA, 20 bp, Artificial Sequence
  chemically synthesized
acactttgggaggccgaggc

SEQ ID NO: 415865 - DNA, 20 bp, Artificial Sequence
  chemically synthesized
cctaacactttgggaggccg

SEQ ID NO: 415866 - DNA, 20 bp, Artificial Sequence
  chemically synthesized
tcctaacactttgggaggcc

SEQ ID NO: 415867 - DNA, 20 bp, Artificial Sequence
  chemically synthesized
ccaccagcctcggcctccca

SEQ ID NO: 415868 - DNA, 20 bp, Artificial Sequence
  chemically synthesized
tgtaatcctaacactttggg

SEQ ID NO: 415869 - DNA, 20 bp, Artificial Sequence
  chemically synthesized
ctgtaatcctaacactttgg

SEQ ID NO: 415870 - DNA, 20 bp, Artificial Sequence
  chemically synthesized
gcctcggcctcccaaagtgt

SEQ ID NO: 415871 - DNA, 20 bp, Artificial Sequence
  chemically synthesized
gcctgtaatcctaacacttt

SEQ ID NO: 415872 - DNA, 20 bp, Artificial Sequence
  chemically synthesized
cctcggcctcccaaagtgtt

SEQ ID NO: 415873 - DNA, 20 bp, Artificial Sequence
  chemically synthesized
cgcctgtaatcctaacactt

SEQ ID NO: 415874 - DNA, 20 bp, Artificial Sequence
  chemically synthesized
ctcccaaagtgttaggatta

SEQ ID NO: 415875 - DNA, 20 bp, Artificial Sequence
  chemically synthesized
tcccaaagtgttaggattac

SEQ ID NO: 415876 - DNA, 20 bp, Artificial Sequence
  chemically synthesized
agtgttaggattacaggcgt

SEQ ID NO: 415877 - DNA, 20 bp, Artificial Sequence
  chemically synthesized
tacaggcgtgagccaccgtg

SEQ ID NO: 415878 - DNA, 20 bp, Artificial Sequence
  chemically synthesized
gaagcaacagggccgcacgg

SEQ ID NO: 415879 - DNA, 20 bp, Artificial Sequence
  chemically synthesized
ggagaagcaacagggccgca

SEQ ID NO: 415880 - DNA, 20 bp, Artificial Sequence
  chemically synthesized
ttaagaatggagaagcaaca

SEQ ID NO: 415881 - DNA, 20 bp, Artificial Sequence
  chemically synthesized
gttaagaatggagaagcaac

SEQ ID NO: 415882 - DNA, 20 bp, Artificial Sequence
  chemically synthesized
agttaagaatggagaagcaa

SEQ ID NO: 415883 - DNA, 20 bp, Artificial Sequence
  chemically synthesized
gcaatcagttaagaatggag

SEQ ID NO: 415884 - DNA, 20 bp, Artificial Sequence
  chemically synthesized
ggagcaatcagttaagaatg

SEQ ID NO: 415885 - DNA, 20 bp, Artificial Sequence
  chemically synthesized
ctggagcaatcagttaagaa

SEQ ID NO: 415886 - DNA, 20 bp, Artificial Sequence
  chemically synthesized
taaagctggagcaatcagtt

SEQ ID NO: 415887 - DNA, 20 bp, Artificial Sequence
  chemically synthesized
ccattcttaactgattgctc

SEQ ID NO: 415888 - DNA, 20 bp, Artificial Sequence
  chemically synthesized
ttttgtaaagctggagcaat

SEQ ID NO: 415889 - DNA, 20 bp, Artificial Sequence
  chemically synthesized
tttatcattttgtaaagctg

SEQ ID NO: 415890 - DNA, 20 bp, Artificial Sequence
  chemically synthesized
ggtttatcattttgtaaagc

SEQ ID NO: 415891 - DNA, 20 bp, Artificial Sequence
  chemically synthesized
cctgggtttatcattttgta

SEQ ID NO: 415892 - DNA, 20 bp, Artificial Sequence
  chemically synthesized
gctttacaaaatgataaacc

SEQ ID NO: 415893 - DNA, 20 bp, Artificial Sequence
  chemically synthesized
ctttacaaaatgataaaccc

SEQ ID NO: 415894 - DNA, 20 bp, Artificial Sequence
  chemically synthesized
aggcgtgagacacaattcct

SEQ ID NO: 415895 - DNA, 20 bp, Artificial Sequence
  chemically synthesized
taggcgtgagacacaattcc

SEQ ID NO: 415896 - DNA, 20 bp, Artificial Sequence
  chemically synthesized
gtagctgggattataggcgt

SEQ ID NO: 415897 - DNA, 20 bp, Artificial Sequence
  chemically synthesized
gtgtctcacgcctataatcc

SEQ ID NO: 415898 - DNA, 20 bp, Artificial Sequence
  chemically synthesized
ccccaggtagctgggattat

SEQ ID NO: 415899 - DNA, 20 bp, Artificial Sequence
  chemically synthesized
cccccaggtagctgggatta

SEQ ID NO: 415900 - DNA, 20 bp, Artificial Sequence
  chemically synthesized
cgcctataatcccagctacc

SEQ ID NO: 415901 - DNA, 20 bp, Artificial Sequence
  chemically synthesized
cttcagtcccccaggtagct

SEQ ID NO: 415902 - DNA, 20 bp, Artificial Sequence
  chemically synthesized
gcctataatcccagctacct

SEQ ID NO: 415903 - DNA, 20 bp, Artificial Sequence
  chemically synthesized
acttcagtcccccaggtagc

SEQ ID NO: 415904 - DNA, 20 bp, Artificial Sequence
  chemically synthesized
cctataatcccagctacctg

SEQ ID NO: 415905 - DNA, 20 bp, Artificial Sequence
  chemically synthesized
ctataatcccagctacctgg

SEQ ID NO: 415906 - DNA, 20 bp, Artificial Sequence
  chemically synthesized
tcccacttcagtcccccagg

SEQ ID NO: 415907 - DNA, 20 bp, Artificial Sequence
  chemically synthesized
ttctcccacttcagtccccc

SEQ ID NO: 415908 - DNA, 20 bp, Artificial Sequence
  chemically synthesized
attctcccacttcagtcccc

SEQ ID NO: 415909 - DNA, 20 bp, Artificial Sequence
  chemically synthesized
cccagctacctgggggactg

SEQ ID NO: 415910 - DNA, 20 bp, Artificial Sequence
  chemically synthesized
agctacctgggggactgaag

SEQ ID NO: 415911 - DNA, 20 bp, Artificial Sequence
  chemically synthesized
gctacctgggggactgaagt

SEQ ID NO: 415912 - DNA, 20 bp, Artificial Sequence
  chemically synthesized
tacctgggggactgaagtgg

SEQ ID NO: 415913 - DNA, 20 bp, Artificial Sequence
  chemically synthesized
ctcaagttattctcccactt

SEQ ID NO: 415914 - DNA, 20 bp, Artificial Sequence
  chemically synthesized
ctgaagtgggagaataactt

SEQ ID NO: 415915 - DNA, 20 bp, Artificial Sequence
  chemically synthesized
gtgggagaataacttgagcc

SEQ ID NO: 415916 - DNA, 20 bp, Artificial Sequence
  chemically synthesized
tgggagaataacttgagccc

SEQ ID NO: 415917 - DNA, 20 bp, Artificial Sequence
  chemically synthesized
ggcctggaactcctgggctc

SEQ ID NO: 415918 - DNA, 20 bp, Artificial Sequence
  chemically synthesized
ggagaataacttgagcccag

SEQ ID NO: 415919 - DNA, 20 bp, Artificial Sequence
  chemically synthesized
caggctggcctggaactcct

SEQ ID NO: 415920 - DNA, 20 bp, Artificial Sequence
  chemically synthesized
taacttgagcccaggagttc

SEQ ID NO: 415921 - DNA, 20 bp, Artificial Sequence
  chemically synthesized
ccaggctggcctggaactcc

SEQ ID NO: 415922 - DNA, 20 bp, Artificial Sequence
  chemically synthesized
aacttgagcccaggagttcc

SEQ ID NO: 415923 - DNA, 20 bp, Artificial Sequence
  chemically synthesized
tgagcccaggagttccaggc

SEQ ID NO: 415924 - DNA, 20 bp, Artificial Sequence
  chemically synthesized
ctatgatgcccaggctggcc

SEQ ID NO: 415925 - DNA, 20 bp, Artificial Sequence
  chemically synthesized
ccaggagttccaggccagcc

SEQ ID NO: 415926 - DNA, 20 bp, Artificial Sequence
  chemically synthesized
caggagttccaggccagcct

SEQ ID NO: 415927 - DNA, 20 bp, Artificial Sequence
  chemically synthesized
tctcactatgatgcccaggc

SEQ ID NO: 415928 - DNA, 20 bp, Artificial Sequence
  chemically synthesized
ggtgtctcactatgatgccc

SEQ ID NO: 415929 - DNA, 20 bp, Artificial Sequence
  chemically synthesized
ccaggccagcctgggcatca

SEQ ID NO: 415930 - DNA, 20 bp, Artificial Sequence
  chemically synthesized
tggtgtctcactatgatgcc

SEQ ID NO: 415931 - DNA, 20 bp, Artificial Sequence
  chemically synthesized
gccagcctgggcatcatagt

SEQ ID NO: 415932 - DNA, 20 bp, Artificial Sequence
  chemically synthesized
caggctgtttttttttgaga

SEQ ID NO: 415933 - DNA, 20 bp, Artificial Sequence
  chemically synthesized
ttatcaggctgttttttttt

SEQ ID NO: 415934 - DNA, 20 bp, Artificial Sequence
  chemically synthesized
gacaccatctcaaaaaaaaa

SEQ ID NO: 415935 - DNA, 20 bp, Artificial Sequence
  chemically synthesized
ttatactgacgtttattatc

SEQ ID NO: 415936 - DNA, 20 bp, Artificial Sequence
  chemically synthesized
tttatactgacgtttattat

SEQ ID NO: 415937 - DNA, 20 bp, Artificial Sequence
  chemically synthesized
aacagcctgataataaacgt

SEQ ID NO: 415938 - DNA, 20 bp, Artificial Sequence
  chemically synthesized
tgataataaacgtcagtata

SEQ ID NO: 415939 - DNA, 20 bp, Artificial Sequence
  chemically synthesized
gataataaacgtcagtataa

SEQ ID NO: 415940 - DNA, 20 bp, Artificial Sequence
  chemically synthesized
taataaacgtcagtataaag

SEQ ID NO: 415941 - DNA, 20 bp, Artificial Sequence
  chemically synthesized
aggagatacaatgtgactct

SEQ ID NO: 415942 - DNA, 20 bp, Artificial Sequence
  chemically synthesized
ttttttaaaaatttttccga

SEQ ID NO: 415943 - DNA, 20 bp, Artificial Sequence
  chemically synthesized
acttttttaaaaatttttcc

SEQ ID NO: 415944 - DNA, 20 bp, Artificial Sequence
  chemically synthesized
tctcggaaaaatttttaaaa

SEQ ID NO: 415945 - DNA, 20 bp, Artificial Sequence
  chemically synthesized
tgaattaaaaaactttgaat

SEQ ID NO: 415946 - DNA, 20 bp, Artificial Sequence
  chemically synthesized
cttttagcaaggctgattca

SEQ ID NO: 415947 - DNA, 20 bp, Artificial Sequence
  chemically synthesized
ctttgaatcagccttgctaa

SEQ ID NO: 415948 - DNA, 20 bp, Artificial Sequence
  chemically synthesized
aggttcttttacttttagca

SEQ ID NO: 415949 - DNA, 20 bp, Artificial Sequence
  chemically synthesized
taggttcttttacttttagc

SEQ ID NO: 415950 - DNA, 20 bp, Artificial Sequence
  chemically synthesized
atcagccttgctaaaagtaa

SEQ ID NO: 415951 - DNA, 20 bp, Artificial Sequence
  chemically synthesized
actttaggttcttttacttt

SEQ ID NO: 415952 - DNA, 20 bp, Artificial Sequence
  chemically synthesized
gctaaaagtaaaagaaccta

SEQ ID NO: 415953 - DNA, 20 bp, Artificial Sequence
  chemically synthesized
caaatacccctgtgtacttt

SEQ ID NO: 415954 - DNA, 20 bp, Artificial Sequence
  chemically synthesized
gtaaaagaacctaaagtaca

SEQ ID NO: 415955 - DNA, 20 bp, Artificial Sequence
  chemically synthesized
tcaaatacccctgtgtactt

SEQ ID NO: 415956 - DNA, 20 bp, Artificial Sequence
  chemically synthesized
taaaagaacctaaagtacac

SEQ ID NO: 415957 - DNA, 20 bp, Artificial Sequence
  chemically synthesized
aaaagaacctaaagtacaca

SEQ ID NO: 415958 - DNA, 20 bp, Artificial Sequence
  chemically synthesized
aaagaacctaaagtacacag

SEQ ID NO: 415959 - DNA, 20 bp, Artificial Sequence
  chemically synthesized
agtacacaggggtatttgat

SEQ ID NO: 415960 - DNA, 20 bp, Artificial Sequence
  chemically synthesized
gtacacaggggtatttgatg

SEQ ID NO: 415961 - DNA, 20 bp, Artificial Sequence
  chemically synthesized
acacaggggtatttgatgag

SEQ ID NO: 415962 - DNA, 20 bp, Artificial Sequence
  chemically synthesized
ggtatttgatgaggagccct

SEQ ID NO: 415963 - DNA, 20 bp, Artificial Sequence
  chemically synthesized
atttgatgaggagcccttag

SEQ ID NO: 415964 - DNA, 20 bp, Artificial Sequence
  chemically synthesized
gtcaacaagattacttctaa

SEQ ID NO: 415965 - DNA, 20 bp, Artificial Sequence
  chemically synthesized
ggtcaacaagattacttcta

SEQ ID NO: 415966 - DNA, 20 bp, Artificial Sequence
  chemically synthesized
aggtcaacaagattacttct

SEQ ID NO: 415967 - DNA, 20 bp, Artificial Sequence
  chemically synthesized
tgtaatatgcttaggtcaac

SEQ ID NO: 415968 - DNA, 20 bp, Artificial Sequence
  chemically synthesized
agaagtaatcttgttgacct

SEQ ID NO: 415969 - DNA, 20 bp, Artificial Sequence
  chemically synthesized
tcaatttttgtaatatgctt

SEQ ID NO: 415970 - DNA, 20 bp, Artificial Sequence
  chemically synthesized
ttcaatttttgtaatatgct

SEQ ID NO: 415971 - DNA, 20 bp, Artificial Sequence
  chemically synthesized
ttacaaaaattgaaattaat

SEQ ID NO: 415972 - DNA, 20 bp, Artificial Sequence
  chemically synthesized
ttaccgtgaagaataataat

SEQ ID NO: 415973 - DNA, 20 bp, Artificial Sequence
  chemically synthesized
gagctaattattattcttca

SEQ ID NO: 415974 - DNA, 20 bp, Artificial Sequence
  chemically synthesized
taattattattcttcacggt

SEQ ID NO: 415975 - DNA, 20 bp, Artificial Sequence
  chemically synthesized
tacttctgtatcttaccgtg

SEQ ID NO: 415976 - DNA, 20 bp, Artificial Sequence
  chemically synthesized
ttattcttcacggtaagata

SEQ ID NO: 415977 - DNA, 20 bp, Artificial Sequence
  chemically synthesized
ttcttcacggtaagatacag

SEQ ID NO: 415978 - DNA, 20 bp, Artificial Sequence
  chemically synthesized
ttcacggtaagatacagaag

SEQ ID NO: 415979 - DNA, 20 bp, Artificial Sequence
  chemically synthesized
cacggtaagatacagaagta

SEQ ID NO: 415980 - DNA, 20 bp, Artificial Sequence
  chemically synthesized
taagatacagaagtagagtt

SEQ ID NO: 415981 - DNA, 20 bp, Artificial Sequence
  chemically synthesized
agatacagaagtagagttca

SEQ ID NO: 415982 - DNA, 20 bp, Artificial Sequence
  chemically synthesized
tttacattttgcctctacaa

SEQ ID NO: 415983 - DNA, 20 bp, Artificial Sequence
  chemically synthesized
ttacattttgcctctacaaa

SEQ ID NO: 415984 - DNA, 20 bp, Artificial Sequence
  chemically synthesized
ttttaaacgtccttttgtag

SEQ ID NO: 415985 - DNA, 20 bp, Artificial Sequence
  chemically synthesized
tttttaaacgtccttttgta

SEQ ID NO: 415986 - DNA, 20 bp, Artificial Sequence
  chemically synthesized
tttttttaaacgtccttttg

SEQ ID NO: 415987 - DNA, 20 bp, Artificial Sequence
  chemically synthesized
caaaaggacgtttaaaaaaa

SEQ ID NO: 415988 - DNA, 20 bp, Artificial Sequence
  chemically synthesized
aaggacgtttaaaaaaaaag

SEQ ID NO: 415989 - DNA, 20 bp, Artificial Sequence
  chemically synthesized
ttaaaaaaaaagaagcctct

SEQ ID NO: 415990 - DNA, 20 bp, Artificial Sequence
  chemically synthesized
taaaaaaaaagaagcctctc

SEQ ID NO: 415991 - DNA, 20 bp, Artificial Sequence
  chemically synthesized
aaaaaaaagaagcctctcgg

SEQ ID NO: 415992 - DNA, 20 bp, Artificial Sequence
  chemically synthesized
tacttcatttttctcccgag

SEQ ID NO: 415993 - DNA, 20 bp, Artificial Sequence
  chemically synthesized
ctacttcatttttctcccga

SEQ ID NO: 415994 - DNA, 20 bp, Artificial Sequence
  chemically synthesized
ctctacttcatttttctccc

SEQ ID NO: 415995 - DNA, 20 bp, Artificial Sequence
  chemically synthesized
agcctctcgggagaaaaatg

SEQ ID NO: 415996 - DNA, 20 bp, Artificial Sequence
  chemically synthesized
ctctcgggagaaaaatgaag

SEQ ID NO: 415997 - DNA, 20 bp, Artificial Sequence
  chemically synthesized
ctcgggagaaaaatgaagta

SEQ ID NO: 415998 - DNA, 20 bp, Artificial Sequence
  chemically synthesized
gagaaaaatgaagtagagca

SEQ ID NO: 415999 - DNA, 20 bp, Artificial Sequence
  chemically synthesized
agaaaaatgaagtagagcaa

SEQ ID NO: 416000 - DNA, 20 bp, Artificial Sequence
  chemically synthesized
gtagagcaaaggacttactc

SEQ ID NO: 416001 - DNA, 20 bp, Artificial Sequence
  chemically synthesized
ctgcaaatttaaacttgagt

SEQ ID NO: 416002 - DNA, 20 bp, Artificial Sequence
  chemically synthesized
gttactgcaaatttaaactt

SEQ ID NO: 416003 - DNA, 20 bp, Artificial Sequence
  chemically synthesized
cttactcaagtttaaatttg

SEQ ID NO: 416004 - DNA, 20 bp, Artificial Sequence
  chemically synthesized
atttgtgaaatcaagagaca

SEQ ID NO: 416005 - DNA, 20 bp, Artificial Sequence
  chemically synthesized
taatttgtgaaatcaagaga

SEQ ID NO: 416006 - DNA, 20 bp, Artificial Sequence
  chemically synthesized
tccttaatttgtgaaatcaa

SEQ ID NO: 416007 - DNA, 20 bp, Artificial Sequence
  chemically synthesized
tctccttaatttgtgaaatc

SEQ ID NO: 416008 - DNA, 20 bp, Artificial Sequence
  chemically synthesized
gtctcttgatttcacaaatt

SEQ ID NO: 416009 - DNA, 20 bp, Artificial Sequence
  chemically synthesized
tctcttgatttcacaaatta

SEQ ID NO: 416010 - DNA, 20 bp, Artificial Sequence
  chemically synthesized
tcttgatttcacaaattaag

SEQ ID NO: 416011 - DNA, 20 bp, Artificial Sequence
  chemically synthesized
tgatttcacaaattaaggag

SEQ ID NO: 416012 - DNA, 20 bp, Artificial Sequence
  chemically synthesized
gatttcacaaattaaggaga

SEQ ID NO: 416013 - DNA, 20 bp, Artificial Sequence
  chemically synthesized
tttcacaaattaaggagaag

SEQ ID NO: 416014 - DNA, 20 bp, Artificial Sequence
  chemically synthesized
acaaattaaggagaaggagc

SEQ ID NO: 416015 - DNA, 20 bp, Artificial Sequence
  chemically synthesized
aattaaggagaaggagcaag

SEQ ID NO: 416016 - DNA, 20 bp, Artificial Sequence
  chemically synthesized
gagaaggagcaagaagttcc

SEQ ID NO: 416017 - DNA, 20 bp, Artificial Sequence
  chemically synthesized
gttgtatgattggatgtact

SEQ ID NO: 416018 - DNA, 20 bp, Artificial Sequence
  chemically synthesized
agttgtatgattggatgtac

SEQ ID NO: 416019 - DNA, 20 bp, Artificial Sequence
  chemically synthesized
gaacttcatagttgtatgat

SEQ ID NO: 416020 - DNA, 20 bp, Artificial Sequence
  chemically synthesized
catccaatcatacaactatg

SEQ ID NO: 416021 - DNA, 20 bp, Artificial Sequence
  chemically synthesized
aaatatgtcagggaacttca

SEQ ID NO: 416022 - DNA, 20 bp, Artificial Sequence
  chemically synthesized
atacatacttaaatatgtca

SEQ ID NO: 416023 - DNA, 20 bp, Artificial Sequence
  chemically synthesized
gatacatacttaaatatgtc

SEQ ID NO: 416024 - DNA, 20 bp, Artificial Sequence
  chemically synthesized
agatacatacttaaatatgt

SEQ ID NO: 416025 - DNA, 20 bp, Artificial Sequence
  chemically synthesized
tgaagttccctgacatattt

SEQ ID NO: 416026 - DNA, 20 bp, Artificial Sequence
  chemically synthesized
gagtatcttaggggttttta

SEQ ID NO: 416027 - DNA, 20 bp, Artificial Sequence
  chemically synthesized
atgtatctataaaaacccct

SEQ ID NO: 416028 - DNA, 20 bp, Artificial Sequence
  chemically synthesized
cacatgattgagtatcttag

SEQ ID NO: 416029 - DNA, 20 bp, Artificial Sequence
  chemically synthesized
tcacatgattgagtatctta

SEQ ID NO: 416030 - DNA, 20 bp, Artificial Sequence
  chemically synthesized
ctcacatgattgagtatctt

SEQ ID NO: 416031 - DNA, 20 bp, Artificial Sequence
  chemically synthesized
gctcacatgattgagtatct

SEQ ID NO: 416032 - DNA, 20 bp, Artificial Sequence
  chemically synthesized
aactttgtgctcacatgatt

SEQ ID NO: 416033 - DNA, 20 bp, Artificial Sequence
  chemically synthesized
cctaagatactcaatcatgt

SEQ ID NO: 416034 - DNA, 20 bp, Artificial Sequence
  chemically synthesized
tactcaatcatgtgagcaca

SEQ ID NO: 416035 - DNA, 20 bp, Artificial Sequence
  chemically synthesized
tacatctatggaagattaca

SEQ ID NO: 416036 - DNA, 20 bp, Artificial Sequence
  chemically synthesized
agttactgtgtaatcttcca

SEQ ID NO: 416037 - DNA, 20 bp, Artificial Sequence
  chemically synthesized
gttaaagtttacatctatgg

SEQ ID NO: 416038 - DNA, 20 bp, Artificial Sequence
  chemically synthesized
gtggttaaagtttacatcta

SEQ ID NO: 416039 - DNA, 20 bp, Artificial Sequence
  chemically synthesized
tatcacttacttcgtggtta

SEQ ID NO: 416040 - DNA, 20 bp, Artificial Sequence
  chemically synthesized
agatgtaaactttaaccacg

SEQ ID NO: 416041 - DNA, 20 bp, Artificial Sequence
  chemically synthesized
gtaaactttaaccacgaagt

SEQ ID NO: 416042 - DNA, 20 bp, Artificial Sequence
  chemically synthesized
tgtagctatcacttacttcg

SEQ ID NO: 416043 - DNA, 20 bp, Artificial Sequence
  chemically synthesized
tttaaccacgaagtaagtga

SEQ ID NO: 416044 - DNA, 20 bp, Artificial Sequence
  chemically synthesized
cgaagtaagtgatagctaca

SEQ ID NO: 416045 - DNA, 20 bp, Artificial Sequence
  chemically synthesized
aacatattttacaagctttg

SEQ ID NO: 416046 - DNA, 20 bp, Artificial Sequence
  chemically synthesized
ctttaataaacatattttac

SEQ ID NO: 416047 - DNA, 20 bp, Artificial Sequence
  chemically synthesized
cttgtaaaatatgtttatta

SEQ ID NO: 416048 - DNA, 20 bp, Artificial Sequence
  chemically synthesized
ttgtaaaatatgtttattaa

SEQ ID NO: 416049 - DNA, 20 bp, Artificial Sequence
  chemically synthesized
aaaggaaattgatttttttt

SEQ ID NO: 416050 - DNA, 20 bp, Artificial Sequence
  chemically synthesized
tgattttttttcagtcaatc

SEQ ID NO: 416051 - DNA, 20 bp, Artificial Sequence
  chemically synthesized
attttttttcagtcaatcta

SEQ ID NO: 416052 - DNA, 20 bp, Artificial Sequence
  chemically synthesized
ttttttttcagtcaatctag

SEQ ID NO: 416053 - DNA, 20 bp, Artificial Sequence
  chemically synthesized
ttcagtcaatctagaggaaa

SEQ ID NO: 416054 - DNA, 20 bp, Artificial Sequence
  chemically synthesized
atctccgaagccatttcctc

SEQ ID NO: 416055 - DNA, 20 bp, Artificial Sequence
  chemically synthesized
caatctagaggaaatggctt

SEQ ID NO: 416056 - DNA, 20 bp, Artificial Sequence
  chemically synthesized
atctagaggaaatggcttcg

SEQ ID NO: 416057 - DNA, 20 bp, Artificial Sequence
  chemically synthesized
acaaattccatgtatctccg

SEQ ID NO: 416058 - DNA, 20 bp, Artificial Sequence
  chemically synthesized
gaaatggcttcggagataca

SEQ ID NO: 416059 - DNA, 20 bp, Artificial Sequence
  chemically synthesized
tggaatttgtttgcttcgac

SEQ ID NO: 416060 - DNA, 20 bp, Artificial Sequence
  chemically synthesized
ctttgtgagatggccagtcg

SEQ ID NO: 416061 - DNA, 20 bp, Artificial Sequence
  chemically synthesized
aatgagctttgtgagatggc

SEQ ID NO: 416062 - DNA, 20 bp, Artificial Sequence
  chemically synthesized
cttcgactggccatctcaca

SEQ ID NO: 416063 - DNA, 20 bp, Artificial Sequence
  chemically synthesized
gtccaatgagctttgtgaga

SEQ ID NO: 416064 - DNA, 20 bp, Artificial Sequence
  chemically synthesized
ataagtccaatgagctttgt

SEQ ID NO: 416065 - DNA, 20 bp, Artificial Sequence
  chemically synthesized
ggccatctcacaaagctcat

SEQ ID NO: 416066 - DNA, 20 bp, Artificial Sequence
  chemically synthesized
taaattattataagtccaat

SEQ ID NO: 416067 - DNA, 20 bp, Artificial Sequence
  chemically synthesized
ggtgttaactaaattattat

SEQ ID NO: 416068 - DNA, 20 bp, Artificial Sequence
  chemically synthesized
tcattggacttataataatt

SEQ ID NO: 416069 - DNA, 20 bp, Artificial Sequence
  chemically synthesized
tttttatggagacatgaata

SEQ ID NO: 416070 - DNA, 20 bp, Artificial Sequence
  chemically synthesized
ggcttatgagggtttttatg

SEQ ID NO: 416071 - DNA, 20 bp, Artificial Sequence
  chemically synthesized
gtggcttatgagggttttta

SEQ ID NO: 416072 - DNA, 20 bp, Artificial Sequence
  chemically synthesized
gtctccataaaaaccctcat

SEQ ID NO: 416073 - DNA, 20 bp, Artificial Sequence
  chemically synthesized
tatatatacgtggcttatga

SEQ ID NO: 416074 - DNA, 20 bp, Artificial Sequence
  chemically synthesized
gtatatatacgtggcttatg

SEQ ID NO: 416075 - DNA, 20 bp, Artificial Sequence
  chemically synthesized
ggtatatatacgtggcttat

SEQ ID NO: 416076 - DNA, 20 bp, Artificial Sequence
  chemically synthesized
gtaattttggtatatatacg

SEQ ID NO: 416077 - DNA, 20 bp, Artificial Sequence
  chemically synthesized
taaatacatgtatgtaattt

SEQ ID NO: 416078 - DNA, 20 bp, Artificial Sequence
  chemically synthesized
tacatacatgtatttaccca

SEQ ID NO: 416079 - DNA, 20 bp, Artificial Sequence
  chemically synthesized
tagactatatttgtagctgt

SEQ ID NO: 416080 - DNA, 20 bp, Artificial Sequence
  chemically synthesized
atagactatatttgtagctg

SEQ ID NO: 416081 - DNA, 20 bp, Artificial Sequence
  chemically synthesized
tttacccacagctacaaata

SEQ ID NO: 416082 - DNA, 20 bp, Artificial Sequence
  chemically synthesized
actcacatagactatatttg

SEQ ID NO: 416083 - DNA, 20 bp, Artificial Sequence
  chemically synthesized
gctacaaatatagtctatgt

SEQ ID NO: 416084 - DNA, 20 bp, Artificial Sequence
  chemically synthesized
catttaatatgaaactcaca

SEQ ID NO: 416085 - DNA, 20 bp, Artificial Sequence
  chemically synthesized
gtgagtttcatattaaatga

SEQ ID NO: 416086 - DNA, 20 bp, Artificial Sequence
  chemically synthesized
tttcatattaaatgatagta

SEQ ID NO: 416087 - DNA, 20 bp, Artificial Sequence
  chemically synthesized
tataataatatagtatagaa

SEQ ID NO: 416088 - DNA, 20 bp, Artificial Sequence
  chemically synthesized
tattctataataatatagta

SEQ ID NO: 416089 - DNA, 20 bp, Artificial Sequence
  chemically synthesized
tagaatattctataataata

SEQ ID NO: 416090 - DNA, 20 bp, Artificial Sequence
  chemically synthesized
tattctatactatattatta

SEQ ID NO: 416091 - DNA, 20 bp, Artificial Sequence
  chemically synthesized
atatatgttataatatagaa

SEQ ID NO: 416092 - DNA, 20 bp, Artificial Sequence
  chemically synthesized
ataatatatatgttataata

SEQ ID NO: 416093 - DNA, 20 bp, Artificial Sequence
  chemically synthesized
aaatgtatatatataatatc

SEQ ID NO: 416094 - DNA, 20 bp, Artificial Sequence
  chemically synthesized
attatatatatacatttctt

SEQ ID NO: 416095 - DNA, 20 bp, Artificial Sequence
  chemically synthesized
ttatatatatacatttcttt

SEQ ID NO: 416096 - DNA, 20 bp, Artificial Sequence
  chemically synthesized
atatatatacatttctttag

SEQ ID NO: 416097 - DNA, 20 bp, Artificial Sequence
  chemically synthesized
gcagccatgagtatctccta

SEQ ID NO: 416098 - DNA, 20 bp, Artificial Sequence
  chemically synthesized
atttctttaggagatactca

SEQ ID NO: 416099 - DNA, 20 bp, Artificial Sequence
  chemically synthesized
gttggacacagagcagccat

SEQ ID NO: 416100 - DNA, 20 bp, Artificial Sequence
  chemically synthesized
aaatgtagttggacacagag

SEQ ID NO: 416101 - DNA, 20 bp, Artificial Sequence
  chemically synthesized
cccaaatgtagttggacaca

SEQ ID NO: 416102 - DNA, 20 bp, Artificial Sequence
  chemically synthesized
ctcccaaatgtagttggaca

SEQ ID NO: 416103 - DNA, 20 bp, Artificial Sequence
  chemically synthesized
aggtgactcccaaatgtagt

SEQ ID NO: 416104 - DNA, 20 bp, Artificial Sequence
  chemically synthesized
gctctgtgtccaactacatt

SEQ ID NO: 416105 - DNA, 20 bp, Artificial Sequence
  chemically synthesized
ctctgtgtccaactacattt

SEQ ID NO: 416106 - DNA, 20 bp, Artificial Sequence
  chemically synthesized
ctgtgtccaactacatttgg

SEQ ID NO: 416107 - DNA, 20 bp, Artificial Sequence
  chemically synthesized
taagaggtgactcccaaatg

SEQ ID NO: 416108 - DNA, 20 bp, Artificial Sequence
  chemically synthesized
atataaaaggattcagtaag

SEQ ID NO: 416109 - DNA, 20 bp, Artificial Sequence
  chemically synthesized
tatataaaaggattcagtaa

SEQ ID NO: 416110 - DNA, 20 bp, Artificial Sequence
  chemically synthesized
agtatataaaaggattcagt

SEQ ID NO: 416111 - DNA, 20 bp, Artificial Sequence
  chemically synthesized
acccagtatataaaaggatt

SEQ ID NO: 416112 - DNA, 20 bp, Artificial Sequence
  chemically synthesized
caagtgacccagtatataaa

SEQ ID NO: 416113 - DNA, 20 bp, Artificial Sequence
  chemically synthesized
gcaagtgacccagtatataa

SEQ ID NO: 416114 - DNA, 20 bp, Artificial Sequence
  chemically synthesized
tactgaatccttttatatac

SEQ ID NO: 416115 - DNA, 20 bp, Artificial Sequence
  chemically synthesized
actgaatccttttatatact

SEQ ID NO: 416116 - DNA, 20 bp, Artificial Sequence
  chemically synthesized
ttaagcctttgcaagtgacc

SEQ ID NO: 416117 - DNA, 20 bp, Artificial Sequence
  chemically synthesized
tatatactgggtcacttgca

SEQ ID NO: 416118 - DNA, 20 bp, Artificial Sequence
  chemically synthesized
atatactgggtcacttgcaa

SEQ ID NO: 416119 - DNA, 20 bp, Artificial Sequence
  chemically synthesized
atgctcaattaagcctttgc

SEQ ID NO: 416120 - DNA, 20 bp, Artificial Sequence
  chemically synthesized
tcacttgcaaaggcttaatt

SEQ ID NO: 416121 - DNA, 20 bp, Artificial Sequence
  chemically synthesized
tgatagtcaaatgctcaatt

SEQ ID NO: 416122 - DNA, 20 bp, Artificial Sequence
  chemically synthesized
atccattctgtggcatatga

SEQ ID NO: 416123 - DNA, 20 bp, Artificial Sequence
  chemically synthesized
catttgactatcatatgcca

SEQ ID NO: 416124 - DNA, 20 bp, Artificial Sequence
  chemically synthesized
gactatcatatgccacagaa

SEQ ID NO: 416125 - DNA, 20 bp, Artificial Sequence
  chemically synthesized
atagtgtccgatccattctg

SEQ ID NO: 416126 - DNA, 20 bp, Artificial Sequence
  chemically synthesized
tcatatgccacagaatggat

SEQ ID NO: 416127 - DNA, 20 bp, Artificial Sequence
  chemically synthesized
tctcttttgtgttttattta

SEQ ID NO: 416128 - DNA, 20 bp, Artificial Sequence
  chemically synthesized
acactataaataaaacacaa

SEQ ID NO: 416129 - DNA, 20 bp, Artificial Sequence
  chemically synthesized
actataaataaaacacaaaa

SEQ ID NO: 416130 - DNA, 20 bp, Artificial Sequence
  chemically synthesized
tataaataaaacacaaaaga

SEQ ID NO: 416131 - DNA, 20 bp, Artificial Sequence
  chemically synthesized
aaaagagagtttgtcttttc

SEQ ID NO: 416132 - DNA, 20 bp, Artificial Sequence
  chemically synthesized
aaagagagtttgtcttttct

SEQ ID NO: 416133 - DNA, 20 bp, Artificial Sequence
  chemically synthesized
taagaagatgaagcccagaa

SEQ ID NO: 416134 - DNA, 20 bp, Artificial Sequence
  chemically synthesized
ttttttaagaagatgaagcc

SEQ ID NO: 416135 - DNA, 20 bp, Artificial Sequence
  chemically synthesized
ctgatttttttaagaagatg

SEQ ID NO: 416136 - DNA, 20 bp, Artificial Sequence
  chemically synthesized
taatagctgatttttttaag

SEQ ID NO: 416137 - DNA, 20 bp, Artificial Sequence
  chemically synthesized
gtctaatagctgattttttt

SEQ ID NO: 416138 - DNA, 20 bp, Artificial Sequence
  chemically synthesized
cttcatcttcttaaaaaaat

SEQ ID NO: 416139 - DNA, 20 bp, Artificial Sequence
  chemically synthesized
ttcttaaaaaaatcagctat

SEQ ID NO: 416140 - DNA, 20 bp, Artificial Sequence
  chemically synthesized
aaaaaaatcagctattagac

SEQ ID NO: 416141 - DNA, 20 bp, Artificial Sequence
  chemically synthesized
ttagacatatgcttgtctaa

SEQ ID NO: 416142 - DNA, 20 bp, Artificial Sequence
  chemically synthesized
atatgcttgatatatataat

SEQ ID NO: 416143 - DNA, 20 bp, Artificial Sequence
  chemically synthesized
tatgtctaattatatatatc

SEQ ID NO: 416144 - DNA, 20 bp, Artificial Sequence
  chemically synthesized
tatgtcatattatatatatc

SEQ ID NO: 416145 - DNA, 20 bp, Artificial Sequence
  chemically synthesized
taaacatcatacatatactg

SEQ ID NO: 416146 - DNA, 20 bp, Artificial Sequence
  chemically synthesized
aaacatcatacatatactgt

SEQ ID NO: 416147 - DNA, 20 bp, Artificial Sequence
  chemically synthesized
catcatacatatactgtagg

SEQ ID NO: 416148 - DNA, 20 bp, Artificial Sequence
  chemically synthesized
tgaccacaaaaagctaccta

SEQ ID NO: 416149 - DNA, 20 bp, Artificial Sequence
  chemically synthesized
atactgtaggtagctttttg

SEQ ID NO: 416150 - DNA, 20 bp, Artificial Sequence
  chemically synthesized
taaagctttgtgaccacaaa

SEQ ID NO: 416151 - DNA, 20 bp, Artificial Sequence
  chemically synthesized
ggtagctttttgtggtcaca

SEQ ID NO: 416152 - DNA, 20 bp, Artificial Sequence
  chemically synthesized
acataaaaataataatagta

SEQ ID NO: 416153 - DNA, 20 bp, Artificial Sequence
  chemically synthesized
gaagtacataaaaataataa

SEQ ID NO: 416154 - DNA, 20 bp, Artificial Sequence
  chemically synthesized
attatttttatgtacttctt

SEQ ID NO: 416155 - DNA, 20 bp, Artificial Sequence
  chemically synthesized
atagatagccttttctcaag

SEQ ID NO: 416156 - DNA, 20 bp, Artificial Sequence
  chemically synthesized
ttttatgtacttcttgagaa

SEQ ID NO: 416157 - DNA, 20 bp, Artificial Sequence
  chemically synthesized
tttatgtacttcttgagaaa

SEQ ID NO: 416158 - DNA, 20 bp, Artificial Sequence
  chemically synthesized
gttatagatagccttttctc

SEQ ID NO: 416159 - DNA, 20 bp, Artificial Sequence
  chemically synthesized
tgagaaaaggctatctataa

SEQ ID NO: 416160 - DNA, 20 bp, Artificial Sequence
  chemically synthesized
taaaattatcctgttataga

SEQ ID NO: 416161 - DNA, 20 bp, Artificial Sequence
  chemically synthesized
gagaaaaggctatctataac

SEQ ID NO: 416162 - DNA, 20 bp, Artificial Sequence
  chemically synthesized
tacttaaaattatcctgtta

SEQ ID NO: 416163 - DNA, 20 bp, Artificial Sequence
  chemically synthesized
atctataacaggataatttt

SEQ ID NO: 416164 - DNA, 20 bp, Artificial Sequence
  chemically synthesized
aggataattttaagtaaaaa

SEQ ID NO: 416165 - DNA, 20 bp, Artificial Sequence
  chemically synthesized
gaacattgactgaaagattt

SEQ ID NO: 416166 - DNA, 20 bp, Artificial Sequence
  chemically synthesized
taaaaaaagcttaaatcttt

SEQ ID NO: 416167 - DNA, 20 bp, Artificial Sequence
  chemically synthesized
aatatatgaacattgactga

SEQ ID NO: 416168 - DNA, 20 bp, Artificial Sequence
  chemically synthesized
tgttcatatattatcctcat

SEQ ID NO: 416169 - DNA, 20 bp, Artificial Sequence
  chemically synthesized
taacacaaattgttcttatg

SEQ ID NO: 416170 - DNA, 20 bp, Artificial Sequence
  chemically synthesized
ctaacacaaattgttcttat

SEQ ID NO: 416171 - DNA, 20 bp, Artificial Sequence
  chemically synthesized
ctcataagaacaatttgtgt

SEQ ID NO: 416172 - DNA, 20 bp, Artificial Sequence
  chemically synthesized
tcataagaacaatttgtgtt

SEQ ID NO: 416173 - DNA, 20 bp, Artificial Sequence
  chemically synthesized
ttatctactttaaaatagaa

SEQ ID NO: 416174 - DNA, 20 bp, Artificial Sequence
  chemically synthesized
aggtattcttttctatttta

SEQ ID NO: 416175 - DNA, 20 bp, Artificial Sequence
  chemically synthesized
atattttatctactttaaaa

SEQ ID NO: 416176 - DNA, 20 bp, Artificial Sequence
  chemically synthesized
tattcttttctattttaaag

SEQ ID NO: 416177 - DNA, 20 bp, Artificial Sequence
  chemically synthesized
attttaaagtagataaaata

SEQ ID NO: 416178 - DNA, 20 bp, Artificial Sequence
  chemically synthesized
ttttaaagtagataaaatat

SEQ ID NO: 416179 - DNA, 20 bp, Artificial Sequence
  chemically synthesized
aatataggtacaaacatgtt

SEQ ID NO: 416180 - DNA, 20 bp, Artificial Sequence
  chemically synthesized
acatgttaagtaatttgtct

SEQ ID NO: 416181 - DNA, 20 bp, Artificial Sequence
  chemically synthesized
catgttaagtaatttgtctg

SEQ ID NO: 416182 - DNA, 20 bp, Artificial Sequence
  chemically synthesized
aagtaatttgtctgaggtac

SEQ ID NO: 416183 - DNA, 20 bp, Artificial Sequence
  chemically synthesized
tcgccatacctctagtacct

SEQ ID NO: 416184 - DNA, 20 bp, Artificial Sequence
  chemically synthesized
gtaatttgtctgaggtacta

SEQ ID NO: 416185 - DNA, 20 bp, Artificial Sequence
  chemically synthesized
taatttgtctgaggtactag

SEQ ID NO: 416186 - DNA, 20 bp, Artificial Sequence
  chemically synthesized
tgtctgaggtactagaggta

SEQ ID NO: 416187 - DNA, 20 bp, Artificial Sequence
  chemically synthesized
tcagcttctcgccatacctc

SEQ ID NO: 416188 - DNA, 20 bp, Artificial Sequence
  chemically synthesized
tgaggtactagaggtatggc

SEQ ID NO: 416189 - DNA, 20 bp, Artificial Sequence
  chemically synthesized
ggtactagaggtatggcgag

SEQ ID NO: 416190 - DNA, 20 bp, Artificial Sequence
  chemically synthesized
tatggcgagaagctgatctc

SEQ ID NO: 416191 - DNA, 20 bp, Artificial Sequence
  chemically synthesized
tttacattttggcttgagat

SEQ ID NO: 416192 - DNA, 20 bp, Artificial Sequence
  chemically synthesized
aggcctttacattttggctt

SEQ ID NO: 416193 - DNA, 20 bp, Artificial Sequence
  chemically synthesized
tgatctcaagccaaaatgta

SEQ ID NO: 416194 - DNA, 20 bp, Artificial Sequence
  chemically synthesized
aaacataggcctttacattt

SEQ ID NO: 416195 - DNA, 20 bp, Artificial Sequence
  chemically synthesized
gatctcaagccaaaatgtaa

SEQ ID NO: 416196 - DNA, 20 bp, Artificial Sequence
  chemically synthesized
taggagaatcagaaaaacat

SEQ ID NO: 416197 - DNA, 20 bp, Artificial Sequence
  chemically synthesized
ataggagaatcagaaaaaca

SEQ ID NO: 416198 - DNA, 20 bp, Artificial Sequence
  chemically synthesized
aaccaaaataataggagaat

SEQ ID NO: 416199 - DNA, 20 bp, Artificial Sequence
  chemically synthesized
tcatagaaccaaaataatag

SEQ ID NO: 416200 - DNA, 20 bp, Artificial Sequence
  chemically synthesized
ttctgattctcctattattt

SEQ ID NO: 416201 - DNA, 20 bp, Artificial Sequence
  chemically synthesized
tctcatagaaccaaaataat

SEQ ID NO: 416202 - DNA, 20 bp, Artificial Sequence
  chemically synthesized
ctctcatagaaccaaaataa

SEQ ID NO: 416203 - DNA, 20 bp, Artificial Sequence
  chemically synthesized
tcctattattttggttctat

SEQ ID NO: 416204 - DNA, 20 bp, Artificial Sequence
  chemically synthesized
ctattattttggttctatga

SEQ ID NO: 416205 - DNA, 20 bp, Artificial Sequence
  chemically synthesized
ttttctttaacattctctca

SEQ ID NO: 416206 - DNA, 20 bp, Artificial Sequence
  chemically synthesized
ggttctatgagagaatgtta

SEQ ID NO: 416207 - DNA, 20 bp, Artificial Sequence
  chemically synthesized
ctggactgagagttgggaaa

SEQ ID NO: 416208 - DNA, 20 bp, Artificial Sequence
  chemically synthesized
cataactttttcccaactct

SEQ ID NO: 416209 - DNA, 20 bp, Artificial Sequence
  chemically synthesized
tcagtcctggactgagagtt

SEQ ID NO: 416210 - DNA, 20 bp, Artificial Sequence
  chemically synthesized
ctcagtcctggactgagagt

SEQ ID NO: 416211 - DNA, 20 bp, Artificial Sequence
  chemically synthesized
ctttttcccaactctcagtc

SEQ ID NO: 416212 - DNA, 20 bp, Artificial Sequence
  chemically synthesized
tttttcccaactctcagtcc

SEQ ID NO: 416213 - DNA, 20 bp, Artificial Sequence
  chemically synthesized
atttctcagtcctggactga

SEQ ID NO: 416214 - DNA, 20 bp, Artificial Sequence
  chemically synthesized
agatttctcagtcctggact

SEQ ID NO: 416215 - DNA, 20 bp, Artificial Sequence
  chemically synthesized
ccaactctcagtccaggact

SEQ ID NO: 416216 - DNA, 20 bp, Artificial Sequence
  chemically synthesized
tgtttgagatttctcagtcc

SEQ ID NO: 416217 - DNA, 20 bp, Artificial Sequence
  chemically synthesized
gcttagtgtttgagatttct

SEQ ID NO: 416218 - DNA, 20 bp, Artificial Sequence
  chemically synthesized
actgagaaatctcaaacact

SEQ ID NO: 416219 - DNA, 20 bp, Artificial Sequence
  chemically synthesized
aactcatatgcttagtgttt

SEQ ID NO: 416220 - DNA, 20 bp, Artificial Sequence
  chemically synthesized
atctcaaacactaagcatat

SEQ ID NO: 416221 - DNA, 20 bp, Artificial Sequence
  chemically synthesized
cgctcacaaactcatatgct

SEQ ID NO: 416222 - DNA, 20 bp, Artificial Sequence
  chemically synthesized
cactaagcatatgagtttgt

SEQ ID NO: 416223 - DNA, 20 bp, Artificial Sequence
  chemically synthesized
agcatatgagtttgtgagcg

SEQ ID NO: 416224 - DNA, 20 bp, Artificial Sequence
  chemically synthesized
gcatatgagtttgtgagcga

SEQ ID NO: 416225 - DNA, 20 bp, Artificial Sequence
  chemically synthesized
aatgtatatactcacattta

SEQ ID NO: 416226 - DNA, 20 bp, Artificial Sequence
  chemically synthesized
tcatatattcccataaatgt

SEQ ID NO: 416227 - DNA, 20 bp, Artificial Sequence
  chemically synthesized
atgtatatactcacatttat

SEQ ID NO: 416228 - DNA, 20 bp, Artificial Sequence
  chemically synthesized
ggaatatatgatctgtactt

SEQ ID NO: 416229 - DNA, 20 bp, Artificial Sequence
  chemically synthesized
tttagtttatggcttaagta

SEQ ID NO: 416230 - DNA, 20 bp, Artificial Sequence
  chemically synthesized
ttaaatttagtttatggctt

SEQ ID NO: 416231 - DNA, 20 bp, Artificial Sequence
  chemically synthesized
taaattttaaatttagttta

SEQ ID NO: 416232 - DNA, 20 bp, Artificial Sequence
  chemically synthesized
taaactataaattttaaatt

SEQ ID NO: 416233 - DNA, 20 bp, Artificial Sequence
  chemically synthesized
taaactaaatttaaaattta

SEQ ID NO: 416234 - DNA, 20 bp, Artificial Sequence
  chemically synthesized
aacatgatatttcaaaattc

SEQ ID NO: 416235 - DNA, 20 bp, Artificial Sequence
  chemically synthesized
gatatttcaaaattctagta

SEQ ID NO: 416236 - DNA, 20 bp, Artificial Sequence
  chemically synthesized
atttcaaaattctagtaaag

SEQ ID NO: 416237 - DNA, 20 bp, Artificial Sequence
  chemically synthesized
gaagtgtgtgtctgctttac

SEQ ID NO: 416238 - DNA, 20 bp, Artificial Sequence
  chemically synthesized
ataaatagaaaagtaaatag

SEQ ID NO: 416239 - DNA, 20 bp, Artificial Sequence
  chemically synthesized
aatataaatagaaaagtaaa

SEQ ID NO: 416240 - DNA, 20 bp, Artificial Sequence
  chemically synthesized
atacataaatataaatagaa

SEQ ID NO: 416241 - DNA, 20 bp, Artificial Sequence
  chemically synthesized
agaagatacataaatataaa

SEQ ID NO: 416242 - DNA, 20 bp, Artificial Sequence
  chemically synthesized
atttatatttatgtatcttc

SEQ ID NO: 416243 - DNA, 20 bp, Artificial Sequence
  chemically synthesized
taaaatagtaaaaggaccag

SEQ ID NO: 416244 - DNA, 20 bp, Artificial Sequence
  chemically synthesized
tgataaaatagtaaaaggac

SEQ ID NO: 416245 - DNA, 20 bp, Artificial Sequence
  chemically synthesized
tatcttgataaaatagtaaa

SEQ ID NO: 416246 - DNA, 20 bp, Artificial Sequence
  chemically synthesized
gtatcttgataaaatagtaa

SEQ ID NO: 416247 - DNA, 20 bp, Artificial Sequence
  chemically synthesized
ggtccttttactattttatc

SEQ ID NO: 416248 - DNA, 20 bp, Artificial Sequence
  chemically synthesized
tttcaagtatcttgataaaa

SEQ ID NO: 416249 - DNA, 20 bp, Artificial Sequence
  chemically synthesized
tattttatcaagatacttga

SEQ ID NO: 416250 - DNA, 20 bp, Artificial Sequence
  chemically synthesized
tttatcaagatacttgaaag

SEQ ID NO: 416251 - DNA, 20 bp, Artificial Sequence
  chemically synthesized
ttatcaagatacttgaaagc

SEQ ID NO: 416252 - DNA, 20 bp, Artificial Sequence
  chemically synthesized
tatcaagatacttgaaagca

SEQ ID NO: 416253 - DNA, 20 bp, Artificial Sequence
  chemically synthesized
ggttaagtatccctgctttc

SEQ ID NO: 416254 - DNA, 20 bp, Artificial Sequence
  chemically synthesized
aagcagggatacttaaccaa

SEQ ID NO: 416255 - DNA, 20 bp, Artificial Sequence
  chemically synthesized
tcctaaaccagcttttggtt

SEQ ID NO: 416256 - DNA, 20 bp, Artificial Sequence
  chemically synthesized
agggatacttaaccaaaagc

SEQ ID NO: 416257 - DNA, 20 bp, Artificial Sequence
  chemically synthesized
tccattcctaaaccagcttt

SEQ ID NO: 416258 - DNA, 20 bp, Artificial Sequence
  chemically synthesized
tacttaaccaaaagctggtt

SEQ ID NO: 416259 - DNA, 20 bp, Artificial Sequence
  chemically synthesized
acttaaccaaaagctggttt

SEQ ID NO: 416260 - DNA, 20 bp, Artificial Sequence
  chemically synthesized
ttcataatccattcctaaac

SEQ ID NO: 416261 - DNA, 20 bp, Artificial Sequence
  chemically synthesized
accaaaagctggtttaggaa

SEQ ID NO: 416262 - DNA, 20 bp, Artificial Sequence
  chemically synthesized
gtttaggaatggattatgaa

SEQ ID NO: 416263 - DNA, 20 bp, Artificial Sequence
  chemically synthesized
gattatgaatggcttatgaa

SEQ ID NO: 416264 - DNA, 20 bp, Artificial Sequence
  chemically synthesized
tgctcctgcaatccattcat

SEQ ID NO: 416265 - DNA, 20 bp, Artificial Sequence
  chemically synthesized
aatggcttatgaatggattg

SEQ ID NO: 416266 - DNA, 20 bp, Artificial Sequence
  chemically synthesized
atggcttatgaatggattgc

SEQ ID NO: 416267 - DNA, 20 bp, Artificial Sequence
  chemically synthesized
ggcttatgaatggattgcag

SEQ ID NO: 416268 - DNA, 20 bp, Artificial Sequence
  chemically synthesized
tgcaggagcatttgaactgc

SEQ ID NO: 416269 - DNA, 20 bp, Artificial Sequence
  chemically synthesized
ccttttacataaaaatccag

SEQ ID NO: 416270 - DNA, 20 bp, Artificial Sequence
  chemically synthesized
caaccttttacataaaaatc

SEQ ID NO: 416271 - DNA, 20 bp, Artificial Sequence
  chemically synthesized
actgctggatttttatgtaa

SEQ ID NO: 416272 - DNA, 20 bp, Artificial Sequence
  chemically synthesized
ctgctggatttttatgtaaa

SEQ ID NO: 416273 - DNA, 20 bp, Artificial Sequence
  chemically synthesized
tatgtaaaaggttgtatgta

SEQ ID NO: 416274 - DNA, 20 bp, Artificial Sequence
  chemically synthesized
atgtaaaaggttgtatgtaa

SEQ ID NO: 416275 - DNA, 20 bp, Artificial Sequence
  chemically synthesized
ggactcctcagaaaaataca

SEQ ID NO: 416276 - DNA, 20 bp, Artificial Sequence
  chemically synthesized
tattcactgtgtatttttct

SEQ ID NO: 416277 - DNA, 20 bp, Artificial Sequence
  chemically synthesized
attcactgtgtatttttctg

SEQ ID NO: 416278 - DNA, 20 bp, Artificial Sequence
  chemically synthesized
tcactgtgtatttttctgag

SEQ ID NO: 416279 - DNA, 20 bp, Artificial Sequence
  chemically synthesized
ataaaagctgtgggactcct

SEQ ID NO: 416280 - DNA, 20 bp, Artificial Sequence
  chemically synthesized
tatttttctgaggagtccca

SEQ ID NO: 416281 - DNA, 20 bp, Artificial Sequence
  chemically synthesized
gtcagtctgataaaagctgt

SEQ ID NO: 416282 - DNA, 20 bp, Artificial Sequence
  chemically synthesized
tgtcagtctgataaaagctg

SEQ ID NO: 416283 - DNA, 20 bp, Artificial Sequence
  chemically synthesized
aggagtcccacagcttttat

SEQ ID NO: 416284 - DNA, 20 bp, Artificial Sequence
  chemically synthesized
atcctttgtcagtctgataa

SEQ ID NO: 416285 - DNA, 20 bp, Artificial Sequence
  chemically synthesized
cagcttttatcagactgaca

SEQ ID NO: 416286 - DNA, 20 bp, Artificial Sequence
  chemically synthesized
agcttttatcagactgacaa

SEQ ID NO: 416287 - DNA, 20 bp, Artificial Sequence
  chemically synthesized
ttagttcatgcatcctttgt

SEQ ID NO: 416288 - DNA, 20 bp, Artificial Sequence
  chemically synthesized
taattgctttttaatttgtt

SEQ ID NO: 416289 - DNA, 20 bp, Artificial Sequence
  chemically synthesized
catgaactaaacaaattaaa

SEQ ID NO: 416290 - DNA, 20 bp, Artificial Sequence
  chemically synthesized
aaacaaattaaaaagcaatt

SEQ ID NO: 416291 - DNA, 20 bp, Artificial Sequence
  chemically synthesized
aacaaattaaaaagcaatta

SEQ ID NO: 416292 - DNA, 20 bp, Artificial Sequence
  chemically synthesized
ttctatgtatagaggttata

SEQ ID NO: 416293 - DNA, 20 bp, Artificial Sequence
  chemically synthesized
gtctttataacctctataca

SEQ ID NO: 416294 - DNA, 20 bp, Artificial Sequence
  chemically synthesized
atagaactttctatgtatag

SEQ ID NO: 416295 - DNA, 20 bp, Artificial Sequence
  chemically synthesized
catagaactttctatgtata

SEQ ID NO: 416296 - DNA, 20 bp, Artificial Sequence
  chemically synthesized
aacatagaactttctatgta

SEQ ID NO: 416297 - DNA, 20 bp, Artificial Sequence
  chemically synthesized
ttataacctctatacataga

SEQ ID NO: 416298 - DNA, 20 bp, Artificial Sequence
  chemically synthesized
aataaaaagtagaaaaaaca

SEQ ID NO: 416299 - DNA, 20 bp, Artificial Sequence
  chemically synthesized
gtccagctggaaataaaaag

SEQ ID NO: 416300 - DNA, 20 bp, Artificial Sequence
  chemically synthesized
tttgtccagctggaaataaa

SEQ ID NO: 416301 - DNA, 20 bp, Artificial Sequence
  chemically synthesized
ttttttctactttttatttc

SEQ ID NO: 416302 - DNA, 20 bp, Artificial Sequence
  chemically synthesized
ttctactttttatttccagc

SEQ ID NO: 416303 - DNA, 20 bp, Artificial Sequence
  chemically synthesized
caagacattatttgtccagc

SEQ ID NO: 416304 - DNA, 20 bp, Artificial Sequence
  chemically synthesized
tttacaagacattatttgtc

SEQ ID NO: 416305 - DNA, 20 bp, Artificial Sequence
  chemically synthesized
ggacaaataatgtcttgtaa

SEQ ID NO: 416306 - DNA, 20 bp, Artificial Sequence
  chemically synthesized
acagtgaactaaacttttac

SEQ ID NO: 416307 - DNA, 20 bp, Artificial Sequence
  chemically synthesized
aataatgtcttgtaaaagtt

SEQ ID NO: 416308 - DNA, 20 bp, Artificial Sequence
  chemically synthesized
gggggcttgaagggagaaaa

SEQ ID NO: 416309 - DNA, 20 bp, Artificial Sequence
  chemically synthesized
gttcactgttttctcccttc

SEQ ID NO: 416310 - DNA, 20 bp, Artificial Sequence
  chemically synthesized
cttcactgggggcttgaagg

SEQ ID NO: 416311 - DNA, 20 bp, Artificial Sequence
  chemically synthesized
tacttcactgggggcttgaa

SEQ ID NO: 416312 - DNA, 20 bp, Artificial Sequence
  chemically synthesized
ctacttcactgggggcttga

SEQ ID NO: 416313 - DNA, 20 bp, Artificial Sequence
  chemically synthesized
cctacttcactgggggcttg

SEQ ID NO: 416314 - DNA, 20 bp, Artificial Sequence
  chemically synthesized
gttttctcccttcaagcccc

SEQ ID NO: 416315 - DNA, 20 bp, Artificial Sequence
  chemically synthesized
ctcccttcaagcccccagtg

SEQ ID NO: 416316 - DNA, 20 bp, Artificial Sequence
  chemically synthesized
atcatctcctacttcactgg

SEQ ID NO: 416317 - DNA, 20 bp, Artificial Sequence
  chemically synthesized
catcatctcctacttcactg

SEQ ID NO: 416318 - DNA, 20 bp, Artificial Sequence
  chemically synthesized
ccttcaagcccccagtgaag

SEQ ID NO: 416319 - DNA, 20 bp, Artificial Sequence
  chemically synthesized
acatcatctcctacttcact

SEQ ID NO: 416320 - DNA, 20 bp, Artificial Sequence
  chemically synthesized
cttcaagcccccagtgaagt

SEQ ID NO: 416321 - DNA, 20 bp, Artificial Sequence
  chemically synthesized
aacatcatctcctacttcac

SEQ ID NO: 416322 - DNA, 20 bp, Artificial Sequence
  chemically synthesized
tcaagcccccagtgaagtag

SEQ ID NO: 416323 - DNA, 20 bp, Artificial Sequence
  chemically synthesized
aggagatgatgttatctatt

SEQ ID NO: 416324 - DNA, 20 bp, Artificial Sequence
  chemically synthesized
atgatgttatctatttagta

SEQ ID NO: 416325 - DNA, 20 bp, Artificial Sequence
  chemically synthesized
tatctccagcccgtactaaa

SEQ ID NO: 416326 - DNA, 20 bp, Artificial Sequence
  chemically synthesized
tgatgttatctatttagtac

SEQ ID NO: 416327 - DNA, 20 bp, Artificial Sequence
  chemically synthesized
gttatctatttagtacgggc

SEQ ID NO: 416328 - DNA, 20 bp, Artificial Sequence
  chemically synthesized
tatctatttagtacgggctg

SEQ ID NO: 416329 - DNA, 20 bp, Artificial Sequence
  chemically synthesized
tgttcacaatttattatctc

SEQ ID NO: 416330 - DNA, 20 bp, Artificial Sequence
  chemically synthesized
gagataataaattgtgaaca

SEQ ID NO: 416331 - DNA, 20 bp, Artificial Sequence
  chemically synthesized
aataaattgtgaacaaagtg

SEQ ID NO: 416332 - DNA, 20 bp, Artificial Sequence
  chemically synthesized
attgtgaacaaagtgaagaa

SEQ ID NO: 416333 - DNA, 20 bp, Artificial Sequence
  chemically synthesized
caaagtgaagaatagtcatg

SEQ ID NO: 416334 - DNA, 20 bp, Artificial Sequence
  chemically synthesized
aaagtgaagaatagtcatga

SEQ ID NO: 416335 - DNA, 20 bp, Artificial Sequence
  chemically synthesized
tagtcatgaaggctgcttta

SEQ ID NO: 416336 - DNA, 20 bp, Artificial Sequence
  chemically synthesized
ttacctccaattctgtaaag

SEQ ID NO: 416337 - DNA, 20 bp, Artificial Sequence
  chemically synthesized
aaattacctccaattctgta

SEQ ID NO: 416338 - DNA, 20 bp, Artificial Sequence
  chemically synthesized
tgaaggctgctttacagaat

SEQ ID NO: 416339 - DNA, 20 bp, Artificial Sequence
  chemically synthesized
aaggctgctttacagaattg

SEQ ID NO: 416340 - DNA, 20 bp, Artificial Sequence
  chemically synthesized
aggctgctttacagaattgg

SEQ ID NO: 416341 - DNA, 20 bp, Artificial Sequence
  chemically synthesized
ttacagaattggaggtaatt

SEQ ID NO: 416342 - DNA, 20 bp, Artificial Sequence
  chemically synthesized
cttttagctgcagtaaataa

SEQ ID NO: 416343 - DNA, 20 bp, Artificial Sequence
  chemically synthesized
ttggtgtcttttatttactg

SEQ ID NO: 416344 - DNA, 20 bp, Artificial Sequence
  chemically synthesized
cttttatttactgcagctaa

SEQ ID NO: 416345 - DNA, 20 bp, Artificial Sequence
  chemically synthesized
tttgaagaaccttttagctg

SEQ ID NO: 416346 - DNA, 20 bp, Artificial Sequence
  chemically synthesized
ttttatttactgcagctaaa

SEQ ID NO: 416347 - DNA, 20 bp, Artificial Sequence
  chemically synthesized
gcttattttgaagaaccttt

SEQ ID NO: 416348 - DNA, 20 bp, Artificial Sequence
  chemically synthesized
gctaaaaggttcttcaaaat

SEQ ID NO: 416349 - DNA, 20 bp, Artificial Sequence
  chemically synthesized
caaagattatgcttattttg

SEQ ID NO: 416350 - DNA, 20 bp, Artificial Sequence
  chemically synthesized
aataagcataatctttgctt

SEQ ID NO: 416351 - DNA, 20 bp, Artificial Sequence
  chemically synthesized
aaacacatgtagctgaagca

SEQ ID NO: 416352 - DNA, 20 bp, Artificial Sequence
  chemically synthesized
ggaagaaacacatgtagctg

SEQ ID NO: 416353 - DNA, 20 bp, Artificial Sequence
  chemically synthesized
aaatctggaagaaacacatg

SEQ ID NO: 416354 - DNA, 20 bp, Artificial Sequence
  chemically synthesized
tcagctacatgtgtttcttc

SEQ ID NO: 416355 - DNA, 20 bp, Artificial Sequence
  chemically synthesized
aagagcattagaaaatctgg

SEQ ID NO: 416356 - DNA, 20 bp, Artificial Sequence
  chemically synthesized
tggaagagcattagaaaatc

SEQ ID NO: 416357 - DNA, 20 bp, Artificial Sequence
  chemically synthesized
acagtgatgtggaagagcat

SEQ ID NO: 416358 - DNA, 20 bp, Artificial Sequence
  chemically synthesized
aagaaaacagtgatgtggaa

SEQ ID NO: 416359 - DNA, 20 bp, Artificial Sequence
  chemically synthesized
ccaagaaaacagtgatgtgg

SEQ ID NO: 416360 - DNA, 20 bp, Artificial Sequence
  chemically synthesized
gaaccaagaaaacagtgatg

SEQ ID NO: 416361 - DNA, 20 bp, Artificial Sequence
  chemically synthesized
cttccacatcactgttttct

SEQ ID NO: 416362 - DNA, 20 bp, Artificial Sequence
  chemically synthesized
taaagggtgaaccaagaaaa

SEQ ID NO: 416363 - DNA, 20 bp, Artificial Sequence
  chemically synthesized
taaaatgtaaagggtgaacc

SEQ ID NO: 416364 - DNA, 20 bp, Artificial Sequence
  chemically synthesized
atatttatctaaaatgtaaa

SEQ ID NO: 416365 - DNA, 20 bp, Artificial Sequence
  chemically synthesized
aatatttatctaaaatgtaa

SEQ ID NO: 416366 - DNA, 20 bp, Artificial Sequence
  chemically synthesized
ttggttcaccctttacattt

SEQ ID NO: 416367 - DNA, 20 bp, Artificial Sequence
  chemically synthesized
gaatatttatctaaaatgta

SEQ ID NO: 416368 - DNA, 20 bp, Artificial Sequence
  chemically synthesized
cattttagataaatattcca

SEQ ID NO: 416369 - DNA, 20 bp, Artificial Sequence
  chemically synthesized
ttagataaatattccacagt

SEQ ID NO: 416370 - DNA, 20 bp, Artificial Sequence
  chemically synthesized
ggatcaggaaggtctcactg

SEQ ID NO: 416371 - DNA, 20 bp, Artificial Sequence
  chemically synthesized
attcaggtttgggatcagga

SEQ ID NO: 416372 - DNA, 20 bp, Artificial Sequence
  chemically synthesized
aattcaggtttgggatcagg

SEQ ID NO: 416373 - DNA, 20 bp, Artificial Sequence
  chemically synthesized
tttaattcaggtttgggatc

SEQ ID NO: 416374 - DNA, 20 bp, Artificial Sequence
  chemically synthesized
atttaattcaggtttgggat

SEQ ID NO: 416375 - DNA, 20 bp, Artificial Sequence
  chemically synthesized
tatttatttaattcaggttt

SEQ ID NO: 416376 - DNA, 20 bp, Artificial Sequence
  chemically synthesized
gtatttatttaattcaggtt

SEQ ID NO: 416377 - DNA, 20 bp, Artificial Sequence
  chemically synthesized
taagagtatttatttaattc

SEQ ID NO: 416378 - DNA, 20 bp, Artificial Sequence
  chemically synthesized
gtaagagtatttatttaatt

SEQ ID NO: 416379 - DNA, 20 bp, Artificial Sequence
  chemically synthesized
aagtgcatgagagagcgtaa

SEQ ID NO: 416380 - DNA, 20 bp, Artificial Sequence
  chemically synthesized
ataagtgcatgagagagcgt

SEQ ID NO: 416381 - DNA, 20 bp, Artificial Sequence
  chemically synthesized
ataaaaataagtgcatgaga

SEQ ID NO: 416382 - DNA, 20 bp, Artificial Sequence
  chemically synthesized
aaataaaaataagtgcatga

SEQ ID NO: 416383 - DNA, 20 bp, Artificial Sequence
  chemically synthesized
ctaaataaaaataagtgcat

SEQ ID NO: 416384 - DNA, 20 bp, Artificial Sequence
  chemically synthesized
taaattttctaaataaaaat

SEQ ID NO: 416385 - DNA, 20 bp, Artificial Sequence
  chemically synthesized
ctcatgcacttatttttatt

SEQ ID NO: 416386 - DNA, 20 bp, Artificial Sequence
  chemically synthesized
acaagcatatgtaagtagtc

SEQ ID NO: 416387 - DNA, 20 bp, Artificial Sequence
  chemically synthesized
attagacaagcatatgtaag

SEQ ID NO: 416388 - DNA, 20 bp, Artificial Sequence
  chemically synthesized
gctattagacaagcatatgt

SEQ ID NO: 416389 - DNA, 20 bp, Artificial Sequence
  chemically synthesized
acttacatatgcttgtctaa

SEQ ID NO: 416390 - DNA, 20 bp, Artificial Sequence
  chemically synthesized
aaaaaaatcagctattagac

SEQ ID NO: 416391 - DNA, 20 bp, Artificial Sequence
  chemically synthesized
ttcttaaaaaaatcagctat

SEQ ID NO: 416392 - DNA, 20 bp, Artificial Sequence
  chemically synthesized
cttcatcttcttaaaaaaat

SEQ ID NO: 416393 - DNA, 20 bp, Artificial Sequence
  chemically synthesized
gtctaatagctgattttttt

SEQ ID NO: 416394 - DNA, 20 bp, Artificial Sequence
  chemically synthesized
taatagctgatttttttaag

SEQ ID NO: 416395 - DNA, 20 bp, Artificial Sequence
  chemically synthesized
ctgatttttttaagaagatg

SEQ ID NO: 416396 - DNA, 20 bp, Artificial Sequence
  chemically synthesized
ttttttaagaagatgaagcc

SEQ ID NO: 416397 - DNA, 20 bp, Artificial Sequence
  chemically synthesized
taagaagatgaagcccagaa

SEQ ID NO: 416398 - DNA, 20 bp, Artificial Sequence
  chemically synthesized
aaagagagtttgtcttttct

SEQ ID NO: 416399 - DNA, 20 bp, Artificial Sequence
  chemically synthesized
aaaagagagtttgtcttttc

SEQ ID NO: 416400 - DNA, 20 bp, Artificial Sequence
  chemically synthesized
tataaataaaacacaaaaga

SEQ ID NO: 416401 - DNA, 20 bp, Artificial Sequence
  chemically synthesized
actataaataaaacacaaaa

SEQ ID NO: 416402 - DNA, 20 bp, Artificial Sequence
  chemically synthesized
acactataaataaaacacaa

SEQ ID NO: 416403 - DNA, 20 bp, Artificial Sequence
  chemically synthesized
tctcttttgtgttttattta

SEQ ID NO: 416404 - DNA, 20 bp, Artificial Sequence
  chemically synthesized
tcatatgccacagaatggat

SEQ ID NO: 416405 - DNA, 20 bp, Artificial Sequence
  chemically synthesized
atagtgtccgatccattctg

SEQ ID NO: 416406 - DNA, 20 bp, Artificial Sequence
  chemically synthesized
gactgtcatatgccacagaa

SEQ ID NO: 416407 - DNA, 20 bp, Artificial Sequence
  chemically synthesized
catttgactgtcatatgcca

SEQ ID NO: 416408 - DNA, 20 bp, Artificial Sequence
  chemically synthesized
atccattctgtggcatatga

SEQ ID NO: 416409 - DNA, 20 bp, Artificial Sequence
  chemically synthesized
tgacagtcaaatgctcaatt

SEQ ID NO: 416410 - DNA, 20 bp, Artificial Sequence
  chemically synthesized
tcacttgcaaaggcttaatt

SEQ ID NO: 416411 - DNA, 20 bp, Artificial Sequence
  chemically synthesized
atgctcaattaagcctttgc

SEQ ID NO: 416412 - DNA, 20 bp, Artificial Sequence
  chemically synthesized
atatactgggtcacttgcaa

SEQ ID NO: 416413 - DNA, 20 bp, Artificial Sequence
  chemically synthesized
tatatactgggtcacttgca

SEQ ID NO: 416414 - DNA, 20 bp, Artificial Sequence
  chemically synthesized
ttaagcctttgcaagtgacc

SEQ ID NO: 416415 - DNA, 20 bp, Artificial Sequence
  chemically synthesized
actgaatccttttatatact

SEQ ID NO: 416416 - DNA, 20 bp, Artificial Sequence
  chemically synthesized
tactgaatccttttatatac

SEQ ID NO: 416417 - DNA, 20 bp, Artificial Sequence
  chemically synthesized
gcaagtgacccagtatataa

SEQ ID NO: 416418 - DNA, 20 bp, Artificial Sequence
  chemically synthesized
caagtgacccagtatataaa

SEQ ID NO: 416419 - DNA, 20 bp, Artificial Sequence
  chemically synthesized
acccagtatataaaaggatt

SEQ ID NO: 416420 - DNA, 20 bp, Artificial Sequence
  chemically synthesized
tatataaaaggattcagtat

SEQ ID NO: 416421 - DNA, 20 bp, Artificial Sequence
  chemically synthesized
atataaaaggattcagtatg

SEQ ID NO: 416422 - DNA, 20 bp, Artificial Sequence
  chemically synthesized
tatgaggtgactcccaaatg

SEQ ID NO: 416423 - DNA, 20 bp, Artificial Sequence
  chemically synthesized
ctgtgtccaactacatttgg

SEQ ID NO: 416424 - DNA, 20 bp, Artificial Sequence
  chemically synthesized
ctctgtgtccaactacattt

SEQ ID NO: 416425 - DNA, 20 bp, Artificial Sequence
  chemically synthesized
gctctgtgtccaactacatt

SEQ ID NO: 416426 - DNA, 20 bp, Artificial Sequence
  chemically synthesized
aggtgactcccaaatgtagt

SEQ ID NO: 416427 - DNA, 20 bp, Artificial Sequence
  chemically synthesized
ctcccaaatgtagttggaca

SEQ ID NO: 416428 - DNA, 20 bp, Artificial Sequence
  chemically synthesized
cccaaatgtagttggacaca

SEQ ID NO: 416429 - DNA, 20 bp, Artificial Sequence
  chemically synthesized
aaatgtagttggacacagag

SEQ ID NO: 416430 - DNA, 20 bp, Artificial Sequence
  chemically synthesized
atttctttaggagatattca

SEQ ID NO: 416431 - DNA, 20 bp, Artificial Sequence
  chemically synthesized
gcagccatgaatatctccta

SEQ ID NO: 416432 - DNA, 20 bp, Artificial Sequence
  chemically synthesized
cctgtggaacatttctttag

SEQ ID NO: 416433 - DNA, 20 bp, Artificial Sequence
  chemically synthesized
agcctgtggaacatttcttt

SEQ ID NO: 416434 - DNA, 20 bp, Artificial Sequence
  chemically synthesized
cagcctgtggaacatttctt

SEQ ID NO: 416435 - DNA, 20 bp, Artificial Sequence
  chemically synthesized
tctcctaaagaaatgttcca

SEQ ID NO: 416436 - DNA, 20 bp, Artificial Sequence
  chemically synthesized
ctcctaaagaaatgttccac

SEQ ID NO: 416437 - DNA, 20 bp, Artificial Sequence
  chemically synthesized
tatgccttaatttcagcctg

SEQ ID NO: 416438 - DNA, 20 bp, Artificial Sequence
  chemically synthesized
atgttccacaggctgaaatt

SEQ ID NO: 416439 - DNA, 20 bp, Artificial Sequence
  chemically synthesized
tgttccacaggctgaaatta

SEQ ID NO: 416440 - DNA, 20 bp, Artificial Sequence
  chemically synthesized
tagagattatgccttaattt

SEQ ID NO: 416441 - DNA, 20 bp, Artificial Sequence
  chemically synthesized
tgaaattaaggcataatctc

SEQ ID NO: 416442 - DNA, 20 bp, Artificial Sequence
  chemically synthesized
ttttaaaaaacatttttcta

SEQ ID NO: 416443 - DNA, 20 bp, Artificial Sequence
  chemically synthesized
acttttaaaaaacatttttc

SEQ ID NO: 416444 - DNA, 20 bp, Artificial Sequence
  chemically synthesized
tctagaaaaatgttttttaa

SEQ ID NO: 416445 - DNA, 20 bp, Artificial Sequence
  chemically synthesized
atgataaatgtgatattata

SEQ ID NO: 416446 - DNA, 20 bp, Artificial Sequence
  chemically synthesized
ttataatatcacatttatca

SEQ ID NO: 416447 - DNA, 20 bp, Artificial Sequence
  chemically synthesized
tgttattgatacataatgat

SEQ ID NO: 416448 - DNA, 20 bp, Artificial Sequence
  chemically synthesized
tgatcattatgtatcaataa

SEQ ID NO: 416449 - DNA, 20 bp, Artificial Sequence
  chemically synthesized
aaaacctaaagaaaatagta

SEQ ID NO: 416450 - DNA, 20 bp, Artificial Sequence
  chemically synthesized
gtgtgctttactattttctt

SEQ ID NO: 416451 - DNA, 20 bp, Artificial Sequence
  chemically synthesized
ttagcaaaacctaaagaaaa

SEQ ID NO: 416452 - DNA, 20 bp, Artificial Sequence
  chemically synthesized
tgtgctttactattttcttt

SEQ ID NO: 416453 - DNA, 20 bp, Artificial Sequence
  chemically synthesized
gtaagttttagcaaaaccta

SEQ ID NO: 416454 - DNA, 20 bp, Artificial Sequence
  chemically synthesized
ggatatttggtagtaagttt

SEQ ID NO: 416455 - DNA, 20 bp, Artificial Sequence
  chemically synthesized
atttcaggatatttggtagt

SEQ ID NO: 416456 - DNA, 20 bp, Artificial Sequence
  chemically synthesized
attaatttcaggatatttgg

SEQ ID NO: 416457 - DNA, 20 bp, Artificial Sequence
  chemically synthesized
gaaattaatttcaggatatt

SEQ ID NO: 416458 - DNA, 20 bp, Artificial Sequence
  chemically synthesized
tttaaagtgaaattaatttc

SEQ ID NO: 416459 - DNA, 20 bp, Artificial Sequence
  chemically synthesized
ctttaaagtgaaattaattt

SEQ ID NO: 416460 - DNA, 20 bp, Artificial Sequence
  chemically synthesized
ctgaaattaatttcacttta

SEQ ID NO: 416461 - DNA, 20 bp, Artificial Sequence
  chemically synthesized
gaccaatttatttagcttta

SEQ ID NO: 416462 - DNA, 20 bp, Artificial Sequence
  chemically synthesized
cactttaaagctaaataaat

SEQ ID NO: 416463 - DNA, 20 bp, Artificial Sequence
  chemically synthesized
tgtatatagaccaatttatt

SEQ ID NO: 416464 - DNA, 20 bp, Artificial Sequence
  chemically synthesized
acttatgactttagtgtata

SEQ ID NO: 416465 - DNA, 20 bp, Artificial Sequence
  chemically synthesized
aaattggtctatatacacta

SEQ ID NO: 416466 - DNA, 20 bp, Artificial Sequence
  chemically synthesized
tctatatacactaaagtcat

SEQ ID NO: 416467 - DNA, 20 bp, Artificial Sequence
  chemically synthesized
aaaatgttcacttatgactt

SEQ ID NO: 416468 - DNA, 20 bp, Artificial Sequence
  chemically synthesized
cataagtgaacattttcttt

SEQ ID NO: 416469 - DNA, 20 bp, Artificial Sequence
  chemically synthesized
aagtgaacattttcttttag

SEQ ID NO: 416470 - DNA, 20 bp, Artificial Sequence
  chemically synthesized
tttgtataattgtctactaa

SEQ ID NO: 416471 - DNA, 20 bp, Artificial Sequence
  chemically synthesized
aagaaatgccttcaggaaaa

SEQ ID NO: 416472 - DNA, 20 bp, Artificial Sequence
  chemically synthesized
aaaaaaattcccttttcctg

SEQ ID NO: 416473 - DNA, 20 bp, Artificial Sequence
  chemically synthesized
caagaaatgccttcaggaaa

SEQ ID NO: 416474 - DNA, 20 bp, Artificial Sequence
  chemically synthesized
aaaaaattcccttttcctga

SEQ ID NO: 416475 - DNA, 20 bp, Artificial Sequence
  chemically synthesized
acaagaaatgccttcaggaa

SEQ ID NO: 416476 - DNA, 20 bp, Artificial Sequence
  chemically synthesized
cagagacaagaaatgccttc

SEQ ID NO: 416477 - DNA, 20 bp, Artificial Sequence
  chemically synthesized
tcagagacaagaaatgcctt

SEQ ID NO: 416478 - DNA, 20 bp, Artificial Sequence
  chemically synthesized
aaattcttattttcagagac

SEQ ID NO: 416479 - DNA, 20 bp, Artificial Sequence
  chemically synthesized
catttcttgtctctgaaaat

SEQ ID NO: 416480 - DNA, 20 bp, Artificial Sequence
  chemically synthesized
ttataaaattcttattttca

SEQ ID NO: 416481 - DNA, 20 bp, Artificial Sequence
  chemically synthesized
aattataaaattcttatttt

SEQ ID NO: 416482 - DNA, 20 bp, Artificial Sequence
  chemically synthesized
gaaaataagaattttataat

SEQ ID NO: 416483 - DNA, 20 bp, Artificial Sequence
  chemically synthesized
agccaaagaaaacggaaaat

SEQ ID NO: 416484 - DNA, 20 bp, Artificial Sequence
  chemically synthesized
gtcttattttccgttttctt

SEQ ID NO: 416485 - DNA, 20 bp, Artificial Sequence
  chemically synthesized
cccctagaagccaaagaaaa

SEQ ID NO: 416486 - DNA, 20 bp, Artificial Sequence
  chemically synthesized
tttccgttttctttggcttc

SEQ ID NO: 416487 - DNA, 20 bp, Artificial Sequence
  chemically synthesized
tctgggacccctagaagcca

SEQ ID NO: 416488 - DNA, 20 bp, Artificial Sequence
  chemically synthesized
ttccgttttctttggcttct

SEQ ID NO: 416489 - DNA, 20 bp, Artificial Sequence
  chemically synthesized
tccgttttctttggcttcta

SEQ ID NO: 416490 - DNA, 20 bp, Artificial Sequence
  chemically synthesized
ccgttttctttggcttctag

SEQ ID NO: 416491 - DNA, 20 bp, Artificial Sequence
  chemically synthesized
tgttattctgggacccctag

SEQ ID NO: 416492 - DNA, 20 bp, Artificial Sequence
  chemically synthesized
tctttggcttctaggggtcc

SEQ ID NO: 416493 - DNA, 20 bp, Artificial Sequence
  chemically synthesized
gtatgttattctgggacccc

SEQ ID NO: 416494 - DNA, 20 bp, Artificial Sequence
  chemically synthesized
attgattcgtatgttattct

SEQ ID NO: 416495 - DNA, 20 bp, Artificial Sequence
  chemically synthesized
aattgattcgtatgttattc

SEQ ID NO: 416496 - DNA, 20 bp, Artificial Sequence
  chemically synthesized
gaatcaattatttatcttct

SEQ ID NO: 416497 - DNA, 20 bp, Artificial Sequence
  chemically synthesized
gattaagggtgttggctaag

SEQ ID NO: 416498 - DNA, 20 bp, Artificial Sequence
  chemically synthesized
ttggattaagggtgttggct

SEQ ID NO: 416499 - DNA, 20 bp, Artificial Sequence
  chemically synthesized
gttgcttggattaagggtgt

SEQ ID NO: 416500 - DNA, 20 bp, Artificial Sequence
  chemically synthesized
ttagccaacacccttaatcc

SEQ ID NO: 416501 - DNA, 20 bp, Artificial Sequence
  chemically synthesized
aggtcagttgcttggattaa

SEQ ID NO: 416502 - DNA, 20 bp, Artificial Sequence
  chemically synthesized
gaggtcagttgcttggatta

SEQ ID NO: 416503 - DNA, 20 bp, Artificial Sequence
  chemically synthesized
agaggtcagttgcttggatt

SEQ ID NO: 416504 - DNA, 20 bp, Artificial Sequence
  chemically synthesized
agcaaaagaggtcagttgct

SEQ ID NO: 416505 - DNA, 20 bp, Artificial Sequence
  chemically synthesized
gtaatcaaagcaaaagaggt

SEQ ID NO: 416506 - DNA, 20 bp, Artificial Sequence
  chemically synthesized
taatgtaatcaaagcaaaag

SEQ ID NO: 416507 - DNA, 20 bp, Artificial Sequence
  chemically synthesized
gtaatgtaatcaaagcaaaa

SEQ ID NO: 416508 - DNA, 20 bp, Artificial Sequence
  chemically synthesized
aagtaatgtaatcaaagcaa

SEQ ID NO: 416509 - DNA, 20 bp, Artificial Sequence
  chemically synthesized
tattgaaagtaatgtaatca

SEQ ID NO: 416510 - DNA, 20 bp, Artificial Sequence
  chemically synthesized
aggttatgagaatgtattga

SEQ ID NO: 416511 - DNA, 20 bp, Artificial Sequence
  chemically synthesized
ctctttattggtgaggttat

SEQ ID NO: 416512 - DNA, 20 bp, Artificial Sequence
  chemically synthesized
caaatagctctttattggtg

SEQ ID NO: 416513 - DNA, 20 bp, Artificial Sequence
  chemically synthesized
ttctcataacctcaccaata

SEQ ID NO: 416514 - DNA, 20 bp, Artificial Sequence
  chemically synthesized
tcaaatagctctttattggt

SEQ ID NO: 416515 - DNA, 20 bp, Artificial Sequence
  chemically synthesized
ctcataacctcaccaataaa

SEQ ID NO: 416516 - DNA, 20 bp, Artificial Sequence
  chemically synthesized
tctgtcaaatagctctttat

SEQ ID NO: 416517 - DNA, 20 bp, Artificial Sequence
  chemically synthesized
accaataaagagctatttga

SEQ ID NO: 416518 - DNA, 20 bp, Artificial Sequence
  chemically synthesized
gatcacattcatctgtcaaa

SEQ ID NO: 416519 - DNA, 20 bp, Artificial Sequence
  chemically synthesized
tttgacagatgaatgtgatc

SEQ ID NO: 416520 - DNA, 20 bp, Artificial Sequence
  chemically synthesized
attgaagaattgtaagcaaa

SEQ ID NO: 416521 - DNA, 20 bp, Artificial Sequence
  chemically synthesized
tattgaagaattgtaagcaa

SEQ ID NO: 416522 - DNA, 20 bp, Artificial Sequence
  chemically synthesized
ctattgaagaattgtaagca

SEQ ID NO: 416523 - DNA, 20 bp, Artificial Sequence
  chemically synthesized
gtatgctattgaagaattgt

SEQ ID NO: 416524 - DNA, 20 bp, Artificial Sequence
  chemically synthesized
ctttgcttacaattcttcaa

SEQ ID NO: 416525 - DNA, 20 bp, Artificial Sequence
  chemically synthesized
aaagcagtagtatgctattg

SEQ ID NO: 416526 - DNA, 20 bp, Artificial Sequence
  chemically synthesized
gatatctatcttaaaagcag

SEQ ID NO: 416527 - DNA, 20 bp, Artificial Sequence
  chemically synthesized
aatagcatactactgctttt

SEQ ID NO: 416528 - DNA, 20 bp, Artificial Sequence
  chemically synthesized
tcggatatctatcttaaaag

SEQ ID NO: 416529 - DNA, 20 bp, Artificial Sequence
  chemically synthesized
gcatactactgcttttaaga

SEQ ID NO: 416530 - DNA, 20 bp, Artificial Sequence
  chemically synthesized
agttcggatatctatcttaa

SEQ ID NO: 416531 - DNA, 20 bp, Artificial Sequence
  chemically synthesized
ttaagatagatatccgaact

SEQ ID NO: 416532 - DNA, 20 bp, Artificial Sequence
  chemically synthesized
taagatagatatccgaactc

SEQ ID NO: 416533 - DNA, 20 bp, Artificial Sequence
  chemically synthesized
agatagatatccgaactcag

SEQ ID NO: 416534 - DNA, 20 bp, Artificial Sequence
  chemically synthesized
gaaatgaaagctcctgagtt

SEQ ID NO: 416535 - DNA, 20 bp, Artificial Sequence
  chemically synthesized
ttcaagaaatgaaagctcct

SEQ ID NO: 416536 - DNA, 20 bp, Artificial Sequence
  chemically synthesized
cctcttcattcaagaaatga

SEQ ID NO: 416537 - DNA, 20 bp, Artificial Sequence
  chemically synthesized
gagctttcatttcttgaatg

SEQ ID NO: 416538 - DNA, 20 bp, Artificial Sequence
  chemically synthesized
gctttcatttcttgaatgaa

SEQ ID NO: 416539 - DNA, 20 bp, Artificial Sequence
  chemically synthesized
acacagaagcctcttcattc

SEQ ID NO: 416540 - DNA, 20 bp, Artificial Sequence
  chemically synthesized
ctttcatttcttgaatgaag

SEQ ID NO: 416541 - DNA, 20 bp, Artificial Sequence
  chemically synthesized
tgaatgaagaggcttctgtg

SEQ ID NO: 416542 - DNA, 20 bp, Artificial Sequence
  chemically synthesized
gacgaggaggaactacacag

SEQ ID NO: 416543 - DNA, 20 bp, Artificial Sequence
  chemically synthesized
caagacgaggaggaactaca

SEQ ID NO: 416544 - DNA, 20 bp, Artificial Sequence
  chemically synthesized
tacggtgctacaagacgagg

SEQ ID NO: 416545 - DNA, 20 bp, Artificial Sequence
  chemically synthesized
ttacggtgctacaagacgag

SEQ ID NO: 416546 - DNA, 20 bp, Artificial Sequence
  chemically synthesized
tgtagttcctcctcgtcttg

SEQ ID NO: 416547 - DNA, 20 bp, Artificial Sequence
  chemically synthesized
aattacggtgctacaagacg

SEQ ID NO: 416548 - DNA, 20 bp, Artificial Sequence
  chemically synthesized
aaattacggtgctacaagac

SEQ ID NO: 416549 - DNA, 20 bp, Artificial Sequence
  chemically synthesized
aaagaaaattacggtgctac

SEQ ID NO: 416550 - DNA, 20 bp, Artificial Sequence
  chemically synthesized
ataaataaaaaagaaaatta

SEQ ID NO: 416551 - DNA, 20 bp, Artificial Sequence
  chemically synthesized
aataaaataaataaataaaa

SEQ ID NO: 416552 - DNA, 20 bp, Artificial Sequence
  chemically synthesized
tattttatttatttattttt

SEQ ID NO: 416553 - DNA, 20 bp, Artificial Sequence
  chemically synthesized
ttatttatttatttttgaga

SEQ ID NO: 416554 - DNA, 20 bp, Artificial Sequence
  chemically synthesized
atttatttatttttgagatg

SEQ ID NO: 416555 - DNA, 20 bp, Artificial Sequence
  chemically synthesized
tccagcctgggcgacagagc

SEQ ID NO: 416556 - DNA, 20 bp, Artificial Sequence
  chemically synthesized
tggagtcttgctctgtcgcc

SEQ ID NO: 416557 - DNA, 20 bp, Artificial Sequence
  chemically synthesized
gcactccagcctgggcgaca

SEQ ID NO: 416558 - DNA, 20 bp, Artificial Sequence
  chemically synthesized
ggagtcttgctctgtcgccc

SEQ ID NO: 416559 - DNA, 20 bp, Artificial Sequence
  chemically synthesized
ctgcactccagcctgggcga

SEQ ID NO: 416560 - DNA, 20 bp, Artificial Sequence
  chemically synthesized
tcttgctctgtcgcccaggc

SEQ ID NO: 416561 - DNA, 20 bp, Artificial Sequence
  chemically synthesized
ttgctctgtcgcccaggctg

SEQ ID NO: 416562 - DNA, 20 bp, Artificial Sequence
  chemically synthesized
gtgacactgcactccagcct

SEQ ID NO: 416563 - DNA, 20 bp, Artificial Sequence
  chemically synthesized
cgtgacactgcactccagcc

SEQ ID NO: 416564 - DNA, 20 bp, Artificial Sequence
  chemically synthesized
ctgtcgcccaggctggagtg

SEQ ID NO: 416565 - DNA, 20 bp, Artificial Sequence
  chemically synthesized
gagatcgtgacactgcactc

SEQ ID NO: 416566 - DNA, 20 bp, Artificial Sequence
  chemically synthesized
ggagtgcagtgtcacgatct

SEQ ID NO: 416567 - DNA, 20 bp, Artificial Sequence
  chemically synthesized
ggtggaggttgcagtgagct

SEQ ID NO: 416568 - DNA, 20 bp, Artificial Sequence
  chemically synthesized
caggaggtggaggttgcagt

SEQ ID NO: 416569 - DNA, 20 bp, Artificial Sequence
  chemically synthesized
aacccaggaggtggaggttg

SEQ ID NO: 416570 - DNA, 20 bp, Artificial Sequence
  chemically synthesized
cgcttgaacccaggaggtgg

SEQ ID NO: 416571 - DNA, 20 bp, Artificial Sequence
  chemically synthesized
tcactgcaacctccacctcc

SEQ ID NO: 416572 - DNA, 20 bp, Artificial Sequence
  chemically synthesized
tcgcttgaacccaggaggtg

SEQ ID NO: 416573 - DNA, 20 bp, Artificial Sequence
  chemically synthesized
cactgcaacctccacctcct

SEQ ID NO: 416574 - DNA, 20 bp, Artificial Sequence
  chemically synthesized
aatcgcttgaacccaggagg

SEQ ID NO: 416575 - DNA, 20 bp, Artificial Sequence
  chemically synthesized
gagaatcgcttgaacccagg

SEQ ID NO: 416576 - DNA, 20 bp, Artificial Sequence
  chemically synthesized
ggagaatcgcttgaacccag

SEQ ID NO: 416577 - DNA, 20 bp, Artificial Sequence
  chemically synthesized
aacctccacctcctgggttc

SEQ ID NO: 416578 - DNA, 20 bp, Artificial Sequence
  chemically synthesized
ctggagaatcgcttgaaccc

SEQ ID NO: 416579 - DNA, 20 bp, Artificial Sequence
  chemically synthesized
gctggagaatcgcttgaacc

SEQ ID NO: 416580 - DNA, 20 bp, Artificial Sequence
  chemically synthesized
cctgggttcaagcgattctc

SEQ ID NO: 416581 - DNA, 20 bp, Artificial Sequence
  chemically synthesized
ttcaagcgattctccagcct

SEQ ID NO: 416582 - DNA, 20 bp, Artificial Sequence
  chemically synthesized
tacttgggaggctgaggctg

SEQ ID NO: 416583 - DNA, 20 bp, Artificial Sequence
  chemically synthesized
gctacttgggaggctgaggc

SEQ ID NO: 416584 - DNA, 20 bp, Artificial Sequence
  chemically synthesized
cctagctacttgggaggctg

SEQ ID NO: 416585 - DNA, 20 bp, Artificial Sequence
  chemically synthesized
tcctagctacttgggaggct

SEQ ID NO: 416586 - DNA, 20 bp, Artificial Sequence
  chemically synthesized
ttctccagcctcagcctccc

SEQ ID NO: 416587 - DNA, 20 bp, Artificial Sequence
  chemically synthesized
tccagcctcagcctcccaag

SEQ ID NO: 416588 - DNA, 20 bp, Artificial Sequence
  chemically synthesized
tataatcctagctacttggg

SEQ ID NO: 416589 - DNA, 20 bp, Artificial Sequence
  chemically synthesized
ctataatcctagctacttgg

SEQ ID NO: 416590 - DNA, 20 bp, Artificial Sequence
  chemically synthesized
gcctcagcctcccaagtagc

SEQ ID NO: 416591 - DNA, 20 bp, Artificial Sequence
  chemically synthesized
acctataatcctagctactt

SEQ ID NO: 416592 - DNA, 20 bp, Artificial Sequence
  chemically synthesized
cctcagcctcccaagtagct

SEQ ID NO: 416593 - DNA, 20 bp, Artificial Sequence
  chemically synthesized
cacctataatcctagctact

SEQ ID NO: 416594 - DNA, 20 bp, Artificial Sequence
  chemically synthesized
ctcccaagtagctaggatta

SEQ ID NO: 416595 - DNA, 20 bp, Artificial Sequence
  chemically synthesized
tcccaagtagctaggattat

SEQ ID NO: 416596 - DNA, 20 bp, Artificial Sequence
  chemically synthesized
gtggcgggcacctataatcc

SEQ ID NO: 416597 - DNA, 20 bp, Artificial Sequence
  chemically synthesized
aattagccggacgtggtggc

SEQ ID NO: 416598 - DNA, 20 bp, Artificial Sequence
  chemically synthesized
aaattagccggacgtggtgg

SEQ ID NO: 416599 - DNA, 20 bp, Artificial Sequence
  chemically synthesized
taggtgcccgccaccacgtc

SEQ ID NO: 416600 - DNA, 20 bp, Artificial Sequence
  chemically synthesized
aaaaaattagccggacgtgg

SEQ ID NO: 416601 - DNA, 20 bp, Artificial Sequence
  chemically synthesized
tacaaaaaattagccggacg

SEQ ID NO: 416602 - DNA, 20 bp, Artificial Sequence
  chemically synthesized
tttaaatacaaaaaattagc

SEQ ID NO: 416603 - DNA, 20 bp, Artificial Sequence
  chemically synthesized
ctgctttaaatacaaaaaat

SEQ ID NO: 416604 - DNA, 20 bp, Artificial Sequence
  chemically synthesized
cggctaattttttgtattta

SEQ ID NO: 416605 - DNA, 20 bp, Artificial Sequence
  chemically synthesized
ctaattttttgtatttaaag

SEQ ID NO: 416606 - DNA, 20 bp, Artificial Sequence
  chemically synthesized
aattttttgtatttaaagca

SEQ ID NO: 416607 - DNA, 20 bp, Artificial Sequence
  chemically synthesized
ttgtatttaaagcagagatg

SEQ ID NO: 416608 - DNA, 20 bp, Artificial Sequence
  chemically synthesized
gagatgaagtttcactatgt

SEQ ID NO: 416609 - DNA, 20 bp, Artificial Sequence
  chemically synthesized
tgaagtttcactatgttgga

SEQ ID NO: 416610 - DNA, 20 bp, Artificial Sequence
  chemically synthesized
cgagaccagcctatccaaca

SEQ ID NO: 416611 - DNA, 20 bp, Artificial Sequence
  chemically synthesized
gaagtttcactatgttggat

SEQ ID NO: 416612 - DNA, 20 bp, Artificial Sequence
  chemically synthesized
tttcactatgttggataggc

SEQ ID NO: 416613 - DNA, 20 bp, Artificial Sequence
  chemically synthesized
tgaggtcaggagttcgagac

SEQ ID NO: 416614 - DNA, 20 bp, Artificial Sequence
  chemically synthesized
tcacctgaggtcaggagttc

SEQ ID NO: 416615 - DNA, 20 bp, Artificial Sequence
  chemically synthesized
tggtctcgaactcctgacct

SEQ ID NO: 416616 - DNA, 20 bp, Artificial Sequence
  chemically synthesized
ggtggatcacctgaggtcag

SEQ ID NO: 416617 - DNA, 20 bp, Artificial Sequence
  chemically synthesized
ggtctcgaactcctgacctc

SEQ ID NO: 416618 - DNA, 20 bp, Artificial Sequence
  chemically synthesized
cgggtggatcacctgaggtc

SEQ ID NO: 416619 - DNA, 20 bp, Artificial Sequence
  chemically synthesized
gcgggtggatcacctgaggt

SEQ ID NO: 416620 - DNA, 20 bp, Artificial Sequence
  chemically synthesized
cgaggcgggtggatcacctg

SEQ ID NO: 416621 - DNA, 20 bp, Artificial Sequence
  chemically synthesized
ccgaggcgggtggatcacct

SEQ ID NO: 416622 - DNA, 20 bp, Artificial Sequence
  chemically synthesized
ctcaggtgatccacccgcct

SEQ ID NO: 416623 - DNA, 20 bp, Artificial Sequence
  chemically synthesized
ctttgggaggccgaggcggg

SEQ ID NO: 416624 - DNA, 20 bp, Artificial Sequence
  chemically synthesized
acactttgggaggccgaggc

SEQ ID NO: 416625 - DNA, 20 bp, Artificial Sequence
  chemically synthesized
aacactttgggaggccgagg

SEQ ID NO: 416626 - DNA, 20 bp, Artificial Sequence
  chemically synthesized
cccaacactttgggaggccg

SEQ ID NO: 416627 - DNA, 20 bp, Artificial Sequence
  chemically synthesized
tcccaacactttgggaggcc

SEQ ID NO: 416628 - DNA, 20 bp, Artificial Sequence
  chemically synthesized
ccacccgcctcggcctccca

SEQ ID NO: 416629 - DNA, 20 bp, Artificial Sequence
  chemically synthesized
tgtaatcccaacactttggg

SEQ ID NO: 416630 - DNA, 20 bp, Artificial Sequence
  chemically synthesized
ctgtaatcccaacactttgg

SEQ ID NO: 416631 - DNA, 20 bp, Artificial Sequence
  chemically synthesized
gcctcggcctcccaaagtgt

SEQ ID NO: 416632 - DNA, 20 bp, Artificial Sequence
  chemically synthesized
gcctgtaatcccaacacttt

SEQ ID NO: 416633 - DNA, 20 bp, Artificial Sequence
  chemically synthesized
cctcggcctcccaaagtgtt

SEQ ID NO: 416634 - DNA, 20 bp, Artificial Sequence
  chemically synthesized
cgcctgtaatcccaacactt

SEQ ID NO: 416635 - DNA, 20 bp, Artificial Sequence
  chemically synthesized
ctcccaaagtgttgggatta

SEQ ID NO: 416636 - DNA, 20 bp, Artificial Sequence
  chemically synthesized
tcccaaagtgttgggattac

SEQ ID NO: 416637 - DNA, 20 bp, Artificial Sequence
  chemically synthesized
agtgttgggattacaggcgt

SEQ ID NO: 416638 - DNA, 20 bp, Artificial Sequence
  chemically synthesized
caggcgtgagccactgtgcc

SEQ ID NO: 416639 - DNA, 20 bp, Artificial Sequence
  chemically synthesized
aaattacaggctgggcacag

SEQ ID NO: 416640 - DNA, 20 bp, Artificial Sequence
  chemically synthesized
agaaaattacaggctgggca

SEQ ID NO: 416641 - DNA, 20 bp, Artificial Sequence
  chemically synthesized
taagaagaaaattacaggct

SEQ ID NO: 416642 - DNA, 20 bp, Artificial Sequence
  chemically synthesized
ctaagaagaaaattacaggc

SEQ ID NO: 416643 - DNA, 20 bp, Artificial Sequence
  chemically synthesized
atatctaagaagaaaattac

SEQ ID NO: 416644 - DNA, 20 bp, Artificial Sequence
  chemically synthesized
tatatctaagaagaaaatta

SEQ ID NO: 416645 - DNA, 20 bp, Artificial Sequence
  chemically synthesized
ccagcctgtaattttcttct

SEQ ID NO: 416646 - DNA, 20 bp, Artificial Sequence
  chemically synthesized
ccagggtaactatatctaag

SEQ ID NO: 416647 - DNA, 20 bp, Artificial Sequence
  chemically synthesized
tgtaattttcttcttagata

SEQ ID NO: 416648 - DNA, 20 bp, Artificial Sequence
  chemically synthesized
aggccagggtaactatatct

SEQ ID NO: 416649 - DNA, 20 bp, Artificial Sequence
  chemically synthesized
cttcttagatatagttaccc

SEQ ID NO: 416650 - DNA, 20 bp, Artificial Sequence
  chemically synthesized
gggaaggaacagaaaggcca

SEQ ID NO: 416651 - DNA, 20 bp, Artificial Sequence
  chemically synthesized
tgggaaggaacagaaaggcc

SEQ ID NO: 416652 - DNA, 20 bp, Artificial Sequence
  chemically synthesized
gtgggaaggaacagaaaggc

SEQ ID NO: 416653 - DNA, 20 bp, Artificial Sequence
  chemically synthesized
tattgtgggaaggaacagaa

SEQ ID NO: 416654 - DNA, 20 bp, Artificial Sequence
  chemically synthesized
ctattgtgggaaggaacaga

SEQ ID NO: 416655 - DNA, 20 bp, Artificial Sequence
  chemically synthesized
gctcctattgtgggaaggaa

SEQ ID NO: 416656 - DNA, 20 bp, Artificial Sequence
  chemically synthesized
gcaaagctcctattgtggga

SEQ ID NO: 416657 - DNA, 20 bp, Artificial Sequence
  chemically synthesized
ctttctgttccttcccacaa

SEQ ID NO: 416658 - DNA, 20 bp, Artificial Sequence
  chemically synthesized
tgcaaagctcctattgtggg

SEQ ID NO: 416659 - DNA, 20 bp, Artificial Sequence
  chemically synthesized
tttctgttccttcccacaat

SEQ ID NO: 416660 - DNA, 20 bp, Artificial Sequence
  chemically synthesized
tctgttccttcccacaatag

SEQ ID NO: 416661 - DNA, 20 bp, Artificial Sequence
  chemically synthesized
ttatgcaaagctcctattgt

SEQ ID NO: 416662 - DNA, 20 bp, Artificial Sequence
  chemically synthesized
cttatgcaaagctcctattg

SEQ ID NO: 416663 - DNA, 20 bp, Artificial Sequence
  chemically synthesized
ccacaataggagctttgcat

SEQ ID NO: 416664 - DNA, 20 bp, Artificial Sequence
  chemically synthesized
tggagtaaagagcttatgca

SEQ ID NO: 416665 - DNA, 20 bp, Artificial Sequence
  chemically synthesized
gcctattctgttggagtaaa

SEQ ID NO: 416666 - DNA, 20 bp, Artificial Sequence
  chemically synthesized
aagcctattctgttggagta

SEQ ID NO: 416667 - DNA, 20 bp, Artificial Sequence
  chemically synthesized
gcataagctctttactccaa

SEQ ID NO: 416668 - DNA, 20 bp, Artificial Sequence
  chemically synthesized
caaggaagcctattctgttg

SEQ ID NO: 416669 - DNA, 20 bp, Artificial Sequence
  chemically synthesized
agctctttactccaacagaa

SEQ ID NO: 416670 - DNA, 20 bp, Artificial Sequence
  chemically synthesized
gctctttactccaacagaat

SEQ ID NO: 416671 - DNA, 20 bp, Artificial Sequence
  chemically synthesized
atcaaggaagcctattctgt

SEQ ID NO: 416672 - DNA, 20 bp, Artificial Sequence
  chemically synthesized
tcagaaagagaatatcaagg

SEQ ID NO: 416673 - DNA, 20 bp, Artificial Sequence
  chemically synthesized
tattcagaaagagaatatca

SEQ ID NO: 416674 - DNA, 20 bp, Artificial Sequence
  chemically synthesized
gtattcagaaagagaatatc

SEQ ID NO: 416675 - DNA, 20 bp, Artificial Sequence
  chemically synthesized
acattatctgtattcagaaa

SEQ ID NO: 416676 - DNA, 20 bp, Artificial Sequence
  chemically synthesized
ttacattatctgtattcaga

SEQ ID NO: 416677 - DNA, 20 bp, Artificial Sequence
  chemically synthesized
tgatattctctttctgaata

SEQ ID NO: 416678 - DNA, 20 bp, Artificial Sequence
  chemically synthesized
atatttacattatctgtatt

SEQ ID NO: 416679 - DNA, 20 bp, Artificial Sequence
  chemically synthesized
atgttaatatttacaacgta

SEQ ID NO: 416680 - DNA, 20 bp, Artificial Sequence
  chemically synthesized
atattaacatttctctgact

SEQ ID NO: 416681 - DNA, 20 bp, Artificial Sequence
  chemically synthesized
ggaagacgtacactcagtca

SEQ ID NO: 416682 - DNA, 20 bp, Artificial Sequence
  chemically synthesized
ggggaagacgtacactcagt

SEQ ID NO: 416683 - DNA, 20 bp, Artificial Sequence
  chemically synthesized
caatggggaagacgtacact

SEQ ID NO: 416684 - DNA, 20 bp, Artificial Sequence
  chemically synthesized
gaaacttactgtcaatgggg

SEQ ID NO: 416685 - DNA, 20 bp, Artificial Sequence
  chemically synthesized
gtgtacgtcttccccattga

SEQ ID NO: 416686 - DNA, 20 bp, Artificial Sequence
  chemically synthesized
tgtgaaacttactgtcaatg

SEQ ID NO: 416687 - DNA, 20 bp, Artificial Sequence
  chemically synthesized
ttgtgaaacttactgtcaat

SEQ ID NO: 416688 - DNA, 20 bp, Artificial Sequence
  chemically synthesized
cttgtgaaacttactgtcaa

SEQ ID NO: 416689 - DNA, 20 bp, Artificial Sequence
  chemically synthesized
acgtcttccccattgacagt

SEQ ID NO: 416690 - DNA, 20 bp, Artificial Sequence
  chemically synthesized
ccattgacagtaagtttcac

SEQ ID NO: 416691 - DNA, 20 bp, Artificial Sequence
  chemically synthesized
cattgacagtaagtttcaca

SEQ ID NO: 416692 - DNA, 20 bp, Artificial Sequence
  chemically synthesized
gacagtaagtttcacaagga

SEQ ID NO: 416693 - DNA, 20 bp, Artificial Sequence
  chemically synthesized
acagtaagtttcacaaggat

SEQ ID NO: 416694 - DNA, 20 bp, Artificial Sequence
  chemically synthesized
aaggataggaaacatgtttt

SEQ ID NO: 416695 - DNA, 20 bp, Artificial Sequence
  chemically synthesized
tgagaaaacaaaacagtaac

SEQ ID NO: 416696 - DNA, 20 bp, Artificial Sequence
  chemically synthesized
agtatgatgagaaaacaaaa

SEQ ID NO: 416697 - DNA, 20 bp, Artificial Sequence
  chemically synthesized
gctagttgctggagtatgat

SEQ ID NO: 416698 - DNA, 20 bp, Artificial Sequence
  chemically synthesized
tttgttttctcatcatactc

SEQ ID NO: 416699 - DNA, 20 bp, Artificial Sequence
  chemically synthesized
tctcatcatactccagcaac

SEQ ID NO: 416700 - DNA, 20 bp, Artificial Sequence
  chemically synthesized
ataaaaggtgctagttgctg

SEQ ID NO: 416701 - DNA, 20 bp, Artificial Sequence
  chemically synthesized
acataaaaggtgctagttgc

SEQ ID NO: 416702 - DNA, 20 bp, Artificial Sequence
  chemically synthesized
aaacagtacataaaaggtgc

SEQ ID NO: 416703 - DNA, 20 bp, Artificial Sequence
  chemically synthesized
aattaaaaacagtacataaa

SEQ ID NO: 416704 - DNA, 20 bp, Artificial Sequence
  chemically synthesized
taattaaaaacagtacataa

SEQ ID NO: 416705 - DNA, 20 bp, Artificial Sequence
  chemically synthesized
attcaaattttaattaaaaa

SEQ ID NO: 416706 - DNA, 20 bp, Artificial Sequence
  chemically synthesized
tttttaattaaaatttgaat

SEQ ID NO: 416707 - DNA, 20 bp, Artificial Sequence
  chemically synthesized
gaatgagtgaactaaaacat

SEQ ID NO: 416708 - DNA, 20 bp, Artificial Sequence
  chemically synthesized
aatgagtgaactaaaacatc

SEQ ID NO: 416709 - DNA, 20 bp, Artificial Sequence
  chemically synthesized
agatttaaggcctgatgttt

SEQ ID NO: 416710 - DNA, 20 bp, Artificial Sequence
  chemically synthesized
caaatatgtatgcagattta

SEQ ID NO: 416711 - DNA, 20 bp, Artificial Sequence
  chemically synthesized
ccaaatatgtatgcagattt

SEQ ID NO: 416712 - DNA, 20 bp, Artificial Sequence
  chemically synthesized
actagagccaaatatgtatg

SEQ ID NO: 416713 - DNA, 20 bp, Artificial Sequence
  chemically synthesized
cttaaatctgcatacatatt

SEQ ID NO: 416714 - DNA, 20 bp, Artificial Sequence
  chemically synthesized
tctgcatacatatttggctc

SEQ ID NO: 416715 - DNA, 20 bp, Artificial Sequence
  chemically synthesized
agtatatatataattgacta

SEQ ID NO: 416716 - DNA, 20 bp, Artificial Sequence
  chemically synthesized
gaagtatatatataattgac

SEQ ID NO: 416717 - DNA, 20 bp, Artificial Sequence
  chemically synthesized
ccaaattagtgaaaataaag

SEQ ID NO: 416718 - DNA, 20 bp, Artificial Sequence
  chemically synthesized
caaccaaattagtgaaaata

SEQ ID NO: 416719 - DNA, 20 bp, Artificial Sequence
  chemically synthesized
cttctttattttcactaatt

SEQ ID NO: 416720 - DNA, 20 bp, Artificial Sequence
  chemically synthesized
aataaaatgtgcaaccaaat

SEQ ID NO: 416721 - DNA, 20 bp, Artificial Sequence
  chemically synthesized
ctgtctttcacaatgatttg

SEQ ID NO: 416722 - DNA, 20 bp, Artificial Sequence
  chemically synthesized
tactgtctttcacaatgatt

SEQ ID NO: 416723 - DNA, 20 bp, Artificial Sequence
  chemically synthesized
atgtctccaaatcattgtga

SEQ ID NO: 416724 - DNA, 20 bp, Artificial Sequence
  chemically synthesized
ctccaaatcattgtgaaaga

SEQ ID NO: 416725 - DNA, 20 bp, Artificial Sequence
  chemically synthesized
aaatcattgtgaaagacagt

SEQ ID NO: 416726 - DNA, 20 bp, Artificial Sequence
  chemically synthesized
gtaagcaaaaactgacaaat

SEQ ID NO: 416727 - DNA, 20 bp, Artificial Sequence
  chemically synthesized
ccaagattgtactaatttgt

SEQ ID NO: 416728 - DNA, 20 bp, Artificial Sequence
  chemically synthesized
ctgacaaattagtacaatct

SEQ ID NO: 416729 - DNA, 20 bp, Artificial Sequence
  chemically synthesized
ttttataatacatgaattcc

SEQ ID NO: 416730 - DNA, 20 bp, Artificial Sequence
  chemically synthesized
ttggaattcatgtattataa

SEQ ID NO: 416731 - DNA, 20 bp, Artificial Sequence
  chemically synthesized
tggaattcatgtattataaa

SEQ ID NO: 416732 - DNA, 20 bp, Artificial Sequence
  chemically synthesized
attcatgtattataaaaggc

SEQ ID NO: 416733 - DNA, 20 bp, Artificial Sequence
  chemically synthesized
tgtattataaaaggctggtt

SEQ ID NO: 416734 - DNA, 20 bp, Artificial Sequence
  chemically synthesized
ttgagtaaaacaatctgaac

SEQ ID NO: 416735 - DNA, 20 bp, Artificial Sequence
  chemically synthesized
aatcaaaacatgttacaatt

SEQ ID NO: 416736 - DNA, 20 bp, Artificial Sequence
  chemically synthesized
gtaacatgttttgattgaaa

SEQ ID NO: 416737 - DNA, 20 bp, Artificial Sequence
  chemically synthesized
ttgattgaaacggtgtaaaa

SEQ ID NO: 416738 - DNA, 20 bp, Artificial Sequence
  chemically synthesized
tgattgaaacggtgtaaaac

SEQ ID NO: 416739 - DNA, 20 bp, Artificial Sequence
  chemically synthesized
taaaacaggaaaaaattatc

SEQ ID NO: 416740 - DNA, 20 bp, Artificial Sequence
  chemically synthesized
atgcaataaaagtttggttc

SEQ ID NO: 416741 - DNA, 20 bp, Artificial Sequence
  chemically synthesized
gccaacatgcaataaaagtt

SEQ ID NO: 416742 - DNA, 20 bp, Artificial Sequence
  chemically synthesized
ccatagccaacatgcaataa

SEQ ID NO: 416743 - DNA, 20 bp, Artificial Sequence
  chemically synthesized
accaaacttttattgcatgt

SEQ ID NO: 416744 - DNA, 20 bp, Artificial Sequence
  chemically synthesized
cttttattgcatgttggcta

SEQ ID NO: 416745 - DNA, 20 bp, Artificial Sequence
  chemically synthesized
attgcatgttggctatggaa

SEQ ID NO: 416746 - DNA, 20 bp, Artificial Sequence
  chemically synthesized
ttattatttgtacttttcca

SEQ ID NO: 416747 - DNA, 20 bp, Artificial Sequence
  chemically synthesized
gaaaagtacaaataataact

SEQ ID NO: 416748 - DNA, 20 bp, Artificial Sequence
  chemically synthesized
tggcctagttgattacgtct

SEQ ID NO: 416749 - DNA, 20 bp, Artificial Sequence
  chemically synthesized
ataactaagacgtaatcaac

SEQ ID NO: 416750 - DNA, 20 bp, Artificial Sequence
  chemically synthesized
taactaagacgtaatcaact

SEQ ID NO: 416751 - DNA, 20 bp, Artificial Sequence
  chemically synthesized
aactcatcaagattatggcc

SEQ ID NO: 416752 - DNA, 20 bp, Artificial Sequence
  chemically synthesized
ctgaaaactcatcaagatta

SEQ ID NO: 416753 - DNA, 20 bp, Artificial Sequence
  chemically synthesized
aactaggccataatcttgat

SEQ ID NO: 416754 - DNA, 20 bp, Artificial Sequence
  chemically synthesized
atcaaatctgaaaactcatc

SEQ ID NO: 416755 - DNA, 20 bp, Artificial Sequence
  chemically synthesized
ccataatcttgatgagtttt

SEQ ID NO: 416756 - DNA, 20 bp, Artificial Sequence
  chemically synthesized
agatttgattatattatata

SEQ ID NO: 416757 - DNA, 20 bp, Artificial Sequence
  chemically synthesized
ttatatatagatataaaata

SEQ ID NO: 416758 - DNA, 20 bp, Artificial Sequence
  chemically synthesized
tatatatagatataaaataa

SEQ ID NO: 416759 - DNA, 20 bp, Artificial Sequence
  chemically synthesized
atctattgtaaaatatattg

SEQ ID NO: 416760 - DNA, 20 bp, Artificial Sequence
  chemically synthesized
aacttcaatatattttacaa

SEQ ID NO: 416761 - DNA, 20 bp, Artificial Sequence
  chemically synthesized
actttcataaaaaatcaaca

SEQ ID NO: 416762 - DNA, 20 bp, Artificial Sequence
  chemically synthesized
actatgttgattttttatga

SEQ ID NO: 416763 - DNA, 20 bp, Artificial Sequence
  chemically synthesized
gttgattttttatgaaagtt

SEQ ID NO: 416764 - DNA, 20 bp, Artificial Sequence
  chemically synthesized
tgaaagttcagaacatcaaa

SEQ ID NO: 416765 - DNA, 20 bp, Artificial Sequence
  chemically synthesized
atggcaaatttatgttgcat

SEQ ID NO: 416766 - DNA, 20 bp, Artificial Sequence
  chemically synthesized
atgcaacataaatttgccat

SEQ ID NO: 416767 - DNA, 20 bp, Artificial Sequence
  chemically synthesized
ttaaggtgcgtataaactca

SEQ ID NO: 416768 - DNA, 20 bp, Artificial Sequence
  chemically synthesized
tgagtttatacgcaccttaa

SEQ ID NO: 416769 - DNA, 20 bp, Artificial Sequence
  chemically synthesized
atctgcgaacatttctttta

SEQ ID NO: 416770 - DNA, 20 bp, Artificial Sequence
  chemically synthesized
aatctgcgaacatttctttt

SEQ ID NO: 416771 - DNA, 20 bp, Artificial Sequence
  chemically synthesized
caccttaaaagaaatgttcg

SEQ ID NO: 416772 - DNA, 20 bp, Artificial Sequence
  chemically synthesized
gcaacccatcatgatacaag

SEQ ID NO: 416773 - DNA, 20 bp, Artificial Sequence
  chemically synthesized
aaagcaacccatcatgatac

SEQ ID NO: 416774 - DNA, 20 bp, Artificial Sequence
  chemically synthesized
agattctacttgtatcatga

SEQ ID NO: 416775 - DNA, 20 bp, Artificial Sequence
  chemically synthesized
gattctacttgtatcatgat

SEQ ID NO: 416776 - DNA, 20 bp, Artificial Sequence
  chemically synthesized
tttcaatagttatgtcacaa

SEQ ID NO: 416777 - DNA, 20 bp, Artificial Sequence
  chemically synthesized
aaaaaaacacacattttcaa

SEQ ID NO: 416778 - DNA, 20 bp, Artificial Sequence
  chemically synthesized
atgtgtgttttttttttctg

SEQ ID NO: 416779 - DNA, 20 bp, Artificial Sequence
  chemically synthesized
tgaatgtgaagattgtactg

SEQ ID NO: 416780 - DNA, 20 bp, Artificial Sequence
  chemically synthesized
tgcagtacaatcttcacatt

SEQ ID NO: 416781 - DNA, 20 bp, Artificial Sequence
  chemically synthesized
tacaattaaatctgaatgtg

SEQ ID NO: 416782 - DNA, 20 bp, Artificial Sequence
  chemically synthesized
ttcagatttaattgtaatct

SEQ ID NO: 416783 - DNA, 20 bp, Artificial Sequence
  chemically synthesized
tctatgagcaaaagttggct

SEQ ID NO: 416784 - DNA, 20 bp, Artificial Sequence
  chemically synthesized
atccttctatgagcaaaagt

SEQ ID NO: 416785 - DNA, 20 bp, Artificial Sequence
  chemically synthesized
tcttagccaacttttgctca

SEQ ID NO: 416786 - DNA, 20 bp, Artificial Sequence
  chemically synthesized
attaatccttctatgagcaa

SEQ ID NO: 416787 - DNA, 20 bp, Artificial Sequence
  chemically synthesized
tagccaacttttgctcatag

SEQ ID NO: 416788 - DNA, 20 bp, Artificial Sequence
  chemically synthesized
agccaacttttgctcataga

SEQ ID NO: 416789 - DNA, 20 bp, Artificial Sequence
  chemically synthesized
catatgattaatccttctat

SEQ ID NO: 416790 - DNA, 20 bp, Artificial Sequence
  chemically synthesized
ggtgattgtgtgtaaacaaa

SEQ ID NO: 416791 - DNA, 20 bp, Artificial Sequence
  chemically synthesized
tgtttacacacaatcacctg

SEQ ID NO: 416792 - DNA, 20 bp, Artificial Sequence
  chemically synthesized
tacacacaatcacctgtaga

SEQ ID NO: 416793 - DNA, 20 bp, Artificial Sequence
  chemically synthesized
gaatgataactgctttctac

SEQ ID NO: 416794 - DNA, 20 bp, Artificial Sequence
  chemically synthesized
acacaatcacctgtagaaag

SEQ ID NO: 416795 - DNA, 20 bp, Artificial Sequence
  chemically synthesized
agaatgataactgctttcta

SEQ ID NO: 416796 - DNA, 20 bp, Artificial Sequence
  chemically synthesized
tgaatgaatgaagaaatgaa

SEQ ID NO: 416797 - DNA, 20 bp, Artificial Sequence
  chemically synthesized
tcagtgttgttgaatgaatg

SEQ ID NO: 416798 - DNA, 20 bp, Artificial Sequence
  chemically synthesized
gcatagagtagcataaaagt

SEQ ID NO: 416799 - DNA, 20 bp, Artificial Sequence
  chemically synthesized
cctggcatagagtagcataa

SEQ ID NO: 416800 - DNA, 20 bp, Artificial Sequence
  chemically synthesized
actcagggcctggcatagag

SEQ ID NO: 416801 - DNA, 20 bp, Artificial Sequence
  chemically synthesized
acttttatgctactctatgc

SEQ ID NO: 416802 - DNA, 20 bp, Artificial Sequence
  chemically synthesized
cttttatgctactctatgcc

SEQ ID NO: 416803 - DNA, 20 bp, Artificial Sequence
  chemically synthesized
ctcactcagggcctggcata

SEQ ID NO: 416804 - DNA, 20 bp, Artificial Sequence
  chemically synthesized
aactcactcagggcctggca

SEQ ID NO: 416805 - DNA, 20 bp, Artificial Sequence
  chemically synthesized
gctactctatgccaggccct

SEQ ID NO: 416806 - DNA, 20 bp, Artificial Sequence
  chemically synthesized
cccagaactcactcagggcc

SEQ ID NO: 416807 - DNA, 20 bp, Artificial Sequence
  chemically synthesized
ctctatgccaggccctgagt

SEQ ID NO: 416808 - DNA, 20 bp, Artificial Sequence
  chemically synthesized
tatctcccagaactcactca

SEQ ID NO: 416809 - DNA, 20 bp, Artificial Sequence
  chemically synthesized
gtatctcccagaactcactc

SEQ ID NO: 416810 - DNA, 20 bp, Artificial Sequence
  chemically synthesized
agtatctcccagaactcact

SEQ ID NO: 416811 - DNA, 20 bp, Artificial Sequence
  chemically synthesized
gccaggccctgagtgagttc

SEQ ID NO: 416812 - DNA, 20 bp, Artificial Sequence
  chemically synthesized
ccaggccctgagtgagttct

SEQ ID NO: 416813 - DNA, 20 bp, Artificial Sequence
  chemically synthesized
aggccctgagtgagttctgg

SEQ ID NO: 416814 - DNA, 20 bp, Artificial Sequence
  chemically synthesized
aagtgtatattagtatctcc

SEQ ID NO: 416815 - DNA, 20 bp, Artificial Sequence
  chemically synthesized
ggcagaacttaagtgtatat

SEQ ID NO: 416816 - DNA, 20 bp, Artificial Sequence
  chemically synthesized
ggagatactaatatacactt

SEQ ID NO: 416817 - DNA, 20 bp, Artificial Sequence
  chemically synthesized
gttcattgatggcagaactt

SEQ ID NO: 416818 - DNA, 20 bp, Artificial Sequence
  chemically synthesized
gactgtaagttcattgatgg

SEQ ID NO: 416819 - DNA, 20 bp, Artificial Sequence
  chemically synthesized
aaagactgtaagttcattga

SEQ ID NO: 416820 - DNA, 20 bp, Artificial Sequence
  chemically synthesized
ttctgccatcaatgaactta

SEQ ID NO: 416821 - DNA, 20 bp, Artificial Sequence
  chemically synthesized
tgtctttctcaaaagactgt

SEQ ID NO: 416822 - DNA, 20 bp, Artificial Sequence
  chemically synthesized
caatgaacttacagtctttt

SEQ ID NO: 416823 - DNA, 20 bp, Artificial Sequence
  chemically synthesized
gaacttacagtcttttgaga

SEQ ID NO: 416824 - DNA, 20 bp, Artificial Sequence
  chemically synthesized
tattgccttgtctttctcaa

SEQ ID NO: 416825 - DNA, 20 bp, Artificial Sequence
  chemically synthesized
tacagtcttttgagaaagac

SEQ ID NO: 416826 - DNA, 20 bp, Artificial Sequence
  chemically synthesized
acagtcttttgagaaagaca

SEQ ID NO: 416827 - DNA, 20 bp, Artificial Sequence
  chemically synthesized
ttttgagaaagacaaggcaa

SEQ ID NO: 416828 - DNA, 20 bp, Artificial Sequence
  chemically synthesized
gaaagacaaggcaatagttt

SEQ ID NO: 416829 - DNA, 20 bp, Artificial Sequence
  chemically synthesized
cttttttcttaagatttgtc

SEQ ID NO: 416830 - DNA, 20 bp, Artificial Sequence
  chemically synthesized
agcatgacttgacaaatctt

SEQ ID NO: 416831 - DNA, 20 bp, Artificial Sequence
  chemically synthesized
cttgacaaatcttaagaaaa

SEQ ID NO: 416832 - DNA, 20 bp, Artificial Sequence
  chemically synthesized
ttctctggctcttttttctt

SEQ ID NO: 416833 - DNA, 20 bp, Artificial Sequence
  chemically synthesized
tgacaaatcttaagaaaaaa

SEQ ID NO: 416834 - DNA, 20 bp, Artificial Sequence
  chemically synthesized
aaatcttaagaaaaaagagc

SEQ ID NO: 416835 - DNA, 20 bp, Artificial Sequence
  chemically synthesized
atcttaagaaaaaagagcca

SEQ ID NO: 416836 - DNA, 20 bp, Artificial Sequence
  chemically synthesized
tccctctttctatgtttctc

SEQ ID NO: 416837 - DNA, 20 bp, Artificial Sequence
  chemically synthesized
aaaaaagagccagagaaaca

SEQ ID NO: 416838 - DNA, 20 bp, Artificial Sequence
  chemically synthesized
aagagccagagaaacataga

SEQ ID NO: 416839 - DNA, 20 bp, Artificial Sequence
  chemically synthesized
gagccagagaaacatagaaa

SEQ ID NO: 416840 - DNA, 20 bp, Artificial Sequence
  chemically synthesized
agccagagaaacatagaaag

SEQ ID NO: 416841 - DNA, 20 bp, Artificial Sequence
  chemically synthesized
gccagagaaacatagaaaga

SEQ ID NO: 416842 - DNA, 20 bp, Artificial Sequence
  chemically synthesized
atagaaagagggatctaaat

SEQ ID NO: 416843 - DNA, 20 bp, Artificial Sequence
  chemically synthesized
tagaaagagggatctaaatt

SEQ ID NO: 416844 - DNA, 20 bp, Artificial Sequence
  chemically synthesized
ctatttcttctagcctaatt

SEQ ID NO: 416845 - DNA, 20 bp, Artificial Sequence
  chemically synthesized
aagagggatctaaattaggc

SEQ ID NO: 416846 - DNA, 20 bp, Artificial Sequence
  chemically synthesized
agggatctaaattaggctag

SEQ ID NO: 416847 - DNA, 20 bp, Artificial Sequence
  chemically synthesized
ctaaattaggctagaagaaa

SEQ ID NO: 416848 - DNA, 20 bp, Artificial Sequence
  chemically synthesized
ctactccttgctatttcttc

SEQ ID NO: 416849 - DNA, 20 bp, Artificial Sequence
  chemically synthesized
attaggctagaagaaatagc

SEQ ID NO: 416850 - DNA, 20 bp, Artificial Sequence
  chemically synthesized
ttaggctagaagaaatagca

SEQ ID NO: 416851 - DNA, 20 bp, Artificial Sequence
  chemically synthesized
aggctagaagaaatagcaag

SEQ ID NO: 416852 - DNA, 20 bp, Artificial Sequence
  chemically synthesized
ctagaagaaatagcaaggag

SEQ ID NO: 416853 - DNA, 20 bp, Artificial Sequence
  chemically synthesized
gaaatagcaaggagtagata

SEQ ID NO: 416854 - DNA, 20 bp, Artificial Sequence
  chemically synthesized
aaatagcaaggagtagatac

SEQ ID NO: 416855 - DNA, 20 bp, Artificial Sequence
  chemically synthesized
aatagcaaggagtagataca

SEQ ID NO: 416856 - DNA, 20 bp, Artificial Sequence
  chemically synthesized
tagcaaggagtagatacagg

SEQ ID NO: 416857 - DNA, 20 bp, Artificial Sequence
  chemically synthesized
agcaaggagtagatacaggg

SEQ ID NO: 416858 - DNA, 20 bp, Artificial Sequence
  chemically synthesized
aaggagtagatacagggagg

SEQ ID NO: 416859 - DNA, 20 bp, Artificial Sequence
  chemically synthesized
aggagtagatacagggagga

SEQ ID NO: 416860 - DNA, 20 bp, Artificial Sequence
  chemically synthesized
ggagtagatacagggaggaa

SEQ ID NO: 416861 - DNA, 20 bp, Artificial Sequence
  chemically synthesized
tacagggaggaagggtgtcc

SEQ ID NO: 416862 - DNA, 20 bp, Artificial Sequence
  chemically synthesized
gaggaagggtgtcccagaca

SEQ ID NO: 416863 - DNA, 20 bp, Artificial Sequence
  chemically synthesized
acatgcatatttctgtgtct

SEQ ID NO: 416864 - DNA, 20 bp, Artificial Sequence
  chemically synthesized
cacatgcatatttctgtgtc

SEQ ID NO: 416865 - DNA, 20 bp, Artificial Sequence
  chemically synthesized
atatattatgtaattttata

SEQ ID NO: 416866 - DNA, 20 bp, Artificial Sequence
  chemically synthesized
taaaattacataatatattt

SEQ ID NO: 416867 - DNA, 20 bp, Artificial Sequence
  chemically synthesized
attacataatatatttaaga

SEQ ID NO: 416868 - DNA, 20 bp, Artificial Sequence
  chemically synthesized
tacataatatatttaagaaa

SEQ ID NO: 416869 - DNA, 20 bp, Artificial Sequence
  chemically synthesized
taatatatttaagaaagagc

SEQ ID NO: 416870 - DNA, 20 bp, Artificial Sequence
  chemically synthesized
tatatttaagaaagagcaag

SEQ ID NO: 416871 - DNA, 20 bp, Artificial Sequence
  chemically synthesized
atatttaagaaagagcaaga

SEQ ID NO: 416872 - DNA, 20 bp, Artificial Sequence
  chemically synthesized
ttaagaaagagcaagaaggc

SEQ ID NO: 416873 - DNA, 20 bp, Artificial Sequence
  chemically synthesized
taagaaagagcaagaaggcc

SEQ ID NO: 416874 - DNA, 20 bp, Artificial Sequence
  chemically synthesized
aagagcaagaaggccgggcg

SEQ ID NO: 416875 - DNA, 20 bp, Artificial Sequence
  chemically synthesized
agcaagaaggccgggcgcgg

SEQ ID NO: 416876 - DNA, 20 bp, Artificial Sequence
  chemically synthesized
caggcgtgagccaccgcgcc

SEQ ID NO: 416877 - DNA, 20 bp, Artificial Sequence
  chemically synthesized
agtgctgggattacaggcgt

SEQ ID NO: 416878 - DNA, 20 bp, Artificial Sequence
  chemically synthesized
gtggctcacgcctgtaatcc

SEQ ID NO: 416879 - DNA, 20 bp, Artificial Sequence
  chemically synthesized
tcccaaagtgctgggattac

SEQ ID NO: 416880 - DNA, 20 bp, Artificial Sequence
  chemically synthesized
ctcccaaagtgctgggatta

SEQ ID NO: 416881 - DNA, 20 bp, Artificial Sequence
  chemically synthesized
cgcctgtaatcccagcactt

SEQ ID NO: 416882 - DNA, 20 bp, Artificial Sequence
  chemically synthesized
ccatggactcccaaagtgct

SEQ ID NO: 416883 - DNA, 20 bp, Artificial Sequence
  chemically synthesized
gcctgtaatcccagcacttt

SEQ ID NO: 416884 - DNA, 20 bp, Artificial Sequence
  chemically synthesized
gccatggactcccaaagtgc

SEQ ID NO: 416885 - DNA, 20 bp, Artificial Sequence
  chemically synthesized
ctgtaatcccagcactttgg

SEQ ID NO: 416886 - DNA, 20 bp, Artificial Sequence
  chemically synthesized
ccacctgccatggactccca

SEQ ID NO: 416887 - DNA, 20 bp, Artificial Sequence
  chemically synthesized
cccagcactttgggagtcca

SEQ ID NO: 416888 - DNA, 20 bp, Artificial Sequence
  chemically synthesized
agcactttgggagtccatgg

SEQ ID NO: 416889 - DNA, 20 bp, Artificial Sequence
  chemically synthesized
gcactttgggagtccatggc

SEQ ID NO: 416890 - DNA, 20 bp, Artificial Sequence
  chemically synthesized
ctttgggagtccatggcagg

SEQ ID NO: 416891 - DNA, 20 bp, Artificial Sequence
  chemically synthesized
ctcaggtgatccacctgcca

SEQ ID NO: 416892 - DNA, 20 bp, Artificial Sequence
  chemically synthesized
ccatggcaggtggatcacct

SEQ ID NO: 416893 - DNA, 20 bp, Artificial Sequence
  chemically synthesized
catggcaggtggatcacctg

SEQ ID NO: 416894 - DNA, 20 bp, Artificial Sequence
  chemically synthesized
gcaggtggatcacctgaggt

SEQ ID NO: 416895 - DNA, 20 bp, Artificial Sequence
  chemically synthesized
caggtggatcacctgaggtc

SEQ ID NO: 416896 - DNA, 20 bp, Artificial Sequence
  chemically synthesized
ggtcttgaactcctgacctc

SEQ ID NO: 416897 - DNA, 20 bp, Artificial Sequence
  chemically synthesized
ggtggatcacctgaggtcag

SEQ ID NO: 416898 - DNA, 20 bp, Artificial Sequence
  chemically synthesized
tggtcttgaactcctgacct

SEQ ID NO: 416899 - DNA, 20 bp, Artificial Sequence
  chemically synthesized
tcacctgaggtcaggagttc

SEQ ID NO: 416900 - DNA, 20 bp, Artificial Sequence
  chemically synthesized
tgaggtcaggagttcaagac

SEQ ID NO: 416901 - DNA, 20 bp, Artificial Sequence
  chemically synthesized
tcaggagttcaagaccagcc

SEQ ID NO: 416902 - DNA, 20 bp, Artificial Sequence
  chemically synthesized
tttcatcatgttggccaggc

SEQ ID NO: 416903 - DNA, 20 bp, Artificial Sequence
  chemically synthesized
ggggtttcatcatgttggcc

SEQ ID NO: 416904 - DNA, 20 bp, Artificial Sequence
  chemically synthesized
tggggtttcatcatgttggc

SEQ ID NO: 416905 - DNA, 20 bp, Artificial Sequence
  chemically synthesized
gagatggggtttcatcatgt

SEQ ID NO: 416906 - DNA, 20 bp, Artificial Sequence
  chemically synthesized
ttgtatttttaggagagatg

SEQ ID NO: 416907 - DNA, 20 bp, Artificial Sequence
  chemically synthesized
tttgtatttttaggagagat

SEQ ID NO: 416908 - DNA, 20 bp, Artificial Sequence
  chemically synthesized
ttttgtatttttaggagaga

SEQ ID NO: 416909 - DNA, 20 bp, Artificial Sequence
  chemically synthesized
aattttttgtatttttagga

SEQ ID NO: 416910 - DNA, 20 bp, Artificial Sequence
  chemically synthesized
ctaattttttgtatttttag

SEQ ID NO: 416911 - DNA, 20 bp, Artificial Sequence
  chemically synthesized
agctaattttttgtattttt

SEQ ID NO: 416912 - DNA, 20 bp, Artificial Sequence
  chemically synthesized
cagctaattttttgtatttt

SEQ ID NO: 416913 - DNA, 20 bp, Artificial Sequence
  chemically synthesized
ctcctaaaaatacaaaaaat

SEQ ID NO: 416914 - DNA, 20 bp, Artificial Sequence
  chemically synthesized
taaaaatacaaaaaattagc

SEQ ID NO: 416915 - DNA, 20 bp, Artificial Sequence
  chemically synthesized
aaaaatacaaaaaattagct

SEQ ID NO: 416916 - DNA, 20 bp, Artificial Sequence
  chemically synthesized
aaaaaattagctgggcatcg

SEQ ID NO: 416917 - DNA, 20 bp, Artificial Sequence
  chemically synthesized
ctggtgactgccacgatgcc

SEQ ID NO: 416918 - DNA, 20 bp, Artificial Sequence
  chemically synthesized
aaattagctgggcatcgtgg

SEQ ID NO: 416919 - DNA, 20 bp, Artificial Sequence
  chemically synthesized
ctgggcatcgtggcagtcac

SEQ ID NO: 416920 - DNA, 20 bp, Artificial Sequence
  chemically synthesized
gtggcagtcaccagtaatcc

SEQ ID NO: 416921 - DNA, 20 bp, Artificial Sequence
  chemically synthesized
tcccgagtagctgggattac

SEQ ID NO: 416922 - DNA, 20 bp, Artificial Sequence
  chemically synthesized
caccagtaatcccagctact

SEQ ID NO: 416923 - DNA, 20 bp, Artificial Sequence
  chemically synthesized
cctcagcctcccgagtagct

SEQ ID NO: 416924 - DNA, 20 bp, Artificial Sequence
  chemically synthesized
accagtaatcccagctactc

SEQ ID NO: 416925 - DNA, 20 bp, Artificial Sequence
  chemically synthesized
tcctcagcctcccgagtagc

SEQ ID NO: 416926 - DNA, 20 bp, Artificial Sequence
  chemically synthesized
cagtaatcccagctactcgg

SEQ ID NO: 416927 - DNA, 20 bp, Artificial Sequence
  chemically synthesized
agtaatcccagctactcggg

SEQ ID NO: 416928 - DNA, 20 bp, Artificial Sequence
  chemically synthesized
tccctcctcagcctcccgag

SEQ ID NO: 416929 - DNA, 20 bp, Artificial Sequence
  chemically synthesized
ttctccctcctcagcctccc

SEQ ID NO: 416930 - DNA, 20 bp, Artificial Sequence
  chemically synthesized
tcccagctactcgggaggct

SEQ ID NO: 416931 - DNA, 20 bp, Artificial Sequence
  chemically synthesized
cccagctactcgggaggctg

SEQ ID NO: 416932 - DNA, 20 bp, Artificial Sequence
  chemically synthesized
cagctactcgggaggctgag

SEQ ID NO: 416933 - DNA, 20 bp, Artificial Sequence
  chemically synthesized
agctactcgggaggctgagg

SEQ ID NO: 416934 - DNA, 20 bp, Artificial Sequence
  chemically synthesized
gctactcgggaggctgagga

SEQ ID NO: 416935 - DNA, 20 bp, Artificial Sequence
  chemically synthesized
tactcgggaggctgaggagg

SEQ ID NO: 416936 - DNA, 20 bp, Artificial Sequence
  chemically synthesized
ttcaagcgattctccctcct

SEQ ID NO: 416937 - DNA, 20 bp, Artificial Sequence
  chemically synthesized
gagggagaatcgcttgaacc

SEQ ID NO: 416938 - DNA, 20 bp, Artificial Sequence
  chemically synthesized
agggagaatcgcttgaacct

SEQ ID NO: 416939 - DNA, 20 bp, Artificial Sequence
  chemically synthesized
aacttccacctcccaggttc

SEQ ID NO: 416940 - DNA, 20 bp, Artificial Sequence
  chemically synthesized
ggagaatcgcttgaacctgg

SEQ ID NO: 416941 - DNA, 20 bp, Artificial Sequence
  chemically synthesized
gagaatcgcttgaacctggg

SEQ ID NO: 416942 - DNA, 20 bp, Artificial Sequence
  chemically synthesized
aatcgcttgaacctgggagg

SEQ ID NO: 416943 - DNA, 20 bp, Artificial Sequence
  chemically synthesized
cactgcaacttccacctccc

SEQ ID NO: 416944 - DNA, 20 bp, Artificial Sequence
  chemically synthesized
tcactgcaacttccacctcc

SEQ ID NO: 416945 - DNA, 20 bp, Artificial Sequence
  chemically synthesized
cgcttgaacctgggaggtgg

SEQ ID NO: 416946 - DNA, 20 bp, Artificial Sequence
  chemically synthesized
aacctgggaggtggaagttg

SEQ ID NO: 416947 - DNA, 20 bp, Artificial Sequence
  chemically synthesized
tgggaggtggaagttgcagt

SEQ ID NO: 416948 - DNA, 20 bp, Artificial Sequence
  chemically synthesized
ggtggaagttgcagtgagct

SEQ ID NO: 416949 - DNA, 20 bp, Artificial Sequence
  chemically synthesized
ggagtgcaatggcacaatct

SEQ ID NO: 416950 - DNA, 20 bp, Artificial Sequence
  chemically synthesized
tcgccctgcctggagtgcaa

SEQ ID NO: 416951 - DNA, 20 bp, Artificial Sequence
  chemically synthesized
gagattgtgccattgcactc

SEQ ID NO: 416952 - DNA, 20 bp, Artificial Sequence
  chemically synthesized
agattgtgccattgcactcc

SEQ ID NO: 416953 - DNA, 20 bp, Artificial Sequence
  chemically synthesized
ttgtgccattgcactccagg

SEQ ID NO: 416954 - DNA, 20 bp, Artificial Sequence
  chemically synthesized
tgtgccattgcactccaggc

SEQ ID NO: 416955 - DNA, 20 bp, Artificial Sequence
  chemically synthesized
gtgccattgcactccaggca

SEQ ID NO: 416956 - DNA, 20 bp, Artificial Sequence
  chemically synthesized
ttgctctgtcgccctgcctg

SEQ ID NO: 416957 - DNA, 20 bp, Artificial Sequence
  chemically synthesized
tcttgctctgtcgccctgcc

SEQ ID NO: 416958 - DNA, 20 bp, Artificial Sequence
  chemically synthesized
ttgcactccaggcagggcga

SEQ ID NO: 416959 - DNA, 20 bp, Artificial Sequence
  chemically synthesized
gcactccaggcagggcgaca

SEQ ID NO: 416960 - DNA, 20 bp, Artificial Sequence
  chemically synthesized
tccaggcagggcgacagagc

SEQ ID NO: 416961 - DNA, 20 bp, Artificial Sequence
  chemically synthesized
ttttttttttttttgagatg

SEQ ID NO: 416962 - DNA, 20 bp, Artificial Sequence
  chemically synthesized
ctttttttttttttttgaga

SEQ ID NO: 416963 - DNA, 20 bp, Artificial Sequence
  chemically synthesized
ttttcttttttttttttttt

SEQ ID NO: 416964 - DNA, 20 bp, Artificial Sequence
  chemically synthesized
ccatctcaaaaaaaaaaaaa

SEQ ID NO: 416965 - DNA, 20 bp, Artificial Sequence
  chemically synthesized
aaaaaaaaaaaaagaaaaaa

SEQ ID NO: 416966 - DNA, 20 bp, Artificial Sequence
  chemically synthesized
aaaaaaaaagaaaaaaaaga

SEQ ID NO: 416967 - DNA, 20 bp, Artificial Sequence
  chemically synthesized
aaaaaaagaaaaaaaagaaa

SEQ ID NO: 416968 - DNA, 20 bp, Artificial Sequence
  chemically synthesized
aaagaaaaaaaagaaagagc

SEQ ID NO: 416969 - DNA, 20 bp, Artificial Sequence
  chemically synthesized
aaagagcaagaaatttcatg

SEQ ID NO: 416970 - DNA, 20 bp, Artificial Sequence
  chemically synthesized
agcaagaaatttcatgtagt

SEQ ID NO: 416971 - DNA, 20 bp, Artificial Sequence
  chemically synthesized
gcaagaaatttcatgtagtt

SEQ ID NO: 416972 - DNA, 20 bp, Artificial Sequence
  chemically synthesized
aatttcatgtagttgggatc

SEQ ID NO: 416973 - DNA, 20 bp, Artificial Sequence
  chemically synthesized
atttcatgtagttgggatca

SEQ ID NO: 416974 - DNA, 20 bp, Artificial Sequence
  chemically synthesized
tttcatgtagttgggatcaa

SEQ ID NO: 416975 - DNA, 20 bp, Artificial Sequence
  chemically synthesized
gttgggatcaagggcatttt

SEQ ID NO: 416976 - DNA, 20 bp, Artificial Sequence
  chemically synthesized
ttgggatcaagggcattttg

SEQ ID NO: 416977 - DNA, 20 bp, Artificial Sequence
  chemically synthesized
gatcaagggcattttgaggt

SEQ ID NO: 416978 - DNA, 20 bp, Artificial Sequence
  chemically synthesized
aagggcattttgaggtaagt

SEQ ID NO: 416979 - DNA, 20 bp, Artificial Sequence
  chemically synthesized
gcattttgaggtaagtaaga

SEQ ID NO: 416980 - DNA, 20 bp, Artificial Sequence
  chemically synthesized
gaggtaagtaagacagattt

SEQ ID NO: 416981 - DNA, 20 bp, Artificial Sequence
  chemically synthesized
aggtaagtaagacagatttt

SEQ ID NO: 416982 - DNA, 20 bp, Artificial Sequence
  chemically synthesized
gtaagacagattttaggtta

SEQ ID NO: 416983 - DNA, 20 bp, Artificial Sequence
  chemically synthesized
taagacagattttaggttaa

SEQ ID NO: 416984 - DNA, 20 bp, Artificial Sequence
  chemically synthesized
aagacagattttaggttaaa

SEQ ID NO: 416985 - DNA, 20 bp, Artificial Sequence
  chemically synthesized
agacagattttaggttaaag

SEQ ID NO: 416986 - DNA, 20 bp, Artificial Sequence
  chemically synthesized
cagattttaggttaaagggg

SEQ ID NO: 416987 - DNA, 20 bp, Artificial Sequence
  chemically synthesized
tttaggttaaaggggtagcc

SEQ ID NO: 416988 - DNA, 20 bp, Artificial Sequence
  chemically synthesized
tgtttagaatttaaaaatct

SEQ ID NO: 416989 - DNA, 20 bp, Artificial Sequence
  chemically synthesized
tttttcctttcaaatatgtt

SEQ ID NO: 416990 - DNA, 20 bp, Artificial Sequence
  chemically synthesized
taaattctaaacatatttga

SEQ ID NO: 416991 - DNA, 20 bp, Artificial Sequence
  chemically synthesized
aaattctaaacatatttgaa

SEQ ID NO: 416992 - DNA, 20 bp, Artificial Sequence
  chemically synthesized
aataaagagtaataaaaaat

SEQ ID NO: 416993 - DNA, 20 bp, Artificial Sequence
  chemically synthesized
aaatttgtttttgtaataaa

SEQ ID NO: 416994 - DNA, 20 bp, Artificial Sequence
  chemically synthesized
ccaaatttgtttttgtaata

SEQ ID NO: 416995 - DNA, 20 bp, Artificial Sequence
  chemically synthesized
ctttattacaaaaacaaatt

SEQ ID NO: 416996 - DNA, 20 bp, Artificial Sequence
  chemically synthesized
caaaaacaaatttggtttta

SEQ ID NO: 416997 - DNA, 20 bp, Artificial Sequence
  chemically synthesized
actactttgtattaaaaatg

SEQ ID NO: 416998 - DNA, 20 bp, Artificial Sequence
  chemically synthesized
taaactacatttttaataca

SEQ ID NO: 416999 - DNA, 20 bp, Artificial Sequence
  chemically synthesized
actacatttttaatacaaag

SEQ ID NO: 417000 - DNA, 20 bp, Artificial Sequence
  chemically synthesized
gcaaagcttgaaatagcaaa

SEQ ID NO: 417001 - DNA, 20 bp, Artificial Sequence
  chemically synthesized
agcaaagcttgaaatagcaa

SEQ ID NO: 417002 - DNA, 20 bp, Artificial Sequence
  chemically synthesized
taattaccttttgctatttc

SEQ ID NO: 417003 - DNA, 20 bp, Artificial Sequence
  chemically synthesized
acacagagcaaagcttgaaa

SEQ ID NO: 417004 - DNA, 20 bp, Artificial Sequence
  chemically synthesized
atttgtatgcacacagagca

SEQ ID NO: 417005 - DNA, 20 bp, Artificial Sequence
  chemically synthesized
gatatatttgtatgcacaca

SEQ ID NO: 417006 - DNA, 20 bp, Artificial Sequence
  chemically synthesized
ttgatatatttgtatgcaca

SEQ ID NO: 417007 - DNA, 20 bp, Artificial Sequence
  chemically synthesized
atatgtgtgttgtacacatt

SEQ ID NO: 417008 - DNA, 20 bp, Artificial Sequence
  chemically synthesized
cgttttgaatatttaaacaa

SEQ ID NO: 417009 - DNA, 20 bp, Artificial Sequence
  chemically synthesized
gtacatatttgcaatttagc

SEQ ID NO: 417010 - DNA, 20 bp, Artificial Sequence
  chemically synthesized
atatgtacatatttgcaatt

SEQ ID NO: 417011 - DNA, 20 bp, Artificial Sequence
  chemically synthesized
aaattgcaaatatgtacata

SEQ ID NO: 417012 - DNA, 20 bp, Artificial Sequence
  chemically synthesized
aaatatgtacatatggaaaa

SEQ ID NO: 417013 - DNA, 20 bp, Artificial Sequence
  chemically synthesized
attttaaaaagcagttgcat

SEQ ID NO: 417014 - DNA, 20 bp, Artificial Sequence
  chemically synthesized
agtaatggaattttaaaaag

SEQ ID NO: 417015 - DNA, 20 bp, Artificial Sequence
  chemically synthesized
agaagtaatggaattttaaa

SEQ ID NO: 417016 - DNA, 20 bp, Artificial Sequence
  chemically synthesized
gcttgatttggcagaagtaa

SEQ ID NO: 417017 - DNA, 20 bp, Artificial Sequence
  chemically synthesized
agtgttgcttgatttggcag

SEQ ID NO: 417018 - DNA, 20 bp, Artificial Sequence
  chemically synthesized
tccattacttctgccaaatc

SEQ ID NO: 417019 - DNA, 20 bp, Artificial Sequence
  chemically synthesized
gtgagtgttgcttgatttgg

SEQ ID NO: 417020 - DNA, 20 bp, Artificial Sequence
  chemically synthesized
cgtgtgagtgttgcttgatt

SEQ ID NO: 417021 - DNA, 20 bp, Artificial Sequence
  chemically synthesized
caaatcaagcaacactcaca

SEQ ID NO: 417022 - DNA, 20 bp, Artificial Sequence
  chemically synthesized
aaatcaagcaacactcacac

SEQ ID NO: 417023 - DNA, 20 bp, Artificial Sequence
  chemically synthesized
tcaagcaacactcacacggg

SEQ ID NO: 417024 - DNA, 20 bp, Artificial Sequence
  chemically synthesized
tgtacttataccacccgtgt

SEQ ID NO: 417025 - DNA, 20 bp, Artificial Sequence
  chemically synthesized
aacactcacacgggtggtat

SEQ ID NO: 417026 - DNA, 20 bp, Artificial Sequence
  chemically synthesized
acacgggtggtataagtaca

SEQ ID NO: 417027 - DNA, 20 bp, Artificial Sequence
  chemically synthesized
gtggtataagtacacagaaa

SEQ ID NO: 417028 - DNA, 20 bp, Artificial Sequence
  chemically synthesized
atagcgaacaacataaatgt

SEQ ID NO: 417029 - DNA, 20 bp, Artificial Sequence
  chemically synthesized
aacataaatgttagcattca

SEQ ID NO: 417030 - DNA, 20 bp, Artificial Sequence
  chemically synthesized
aaatgttagcattcatagat

SEQ ID NO: 417031 - DNA, 20 bp, Artificial Sequence
  chemically synthesized
attcatagatcagcctttta

SEQ ID NO: 417032 - DNA, 20 bp, Artificial Sequence
  chemically synthesized
ttcatagatcagccttttat

SEQ ID NO: 417033 - DNA, 20 bp, Artificial Sequence
  chemically synthesized
aaaaattacattcccataaa

SEQ ID NO: 417034 - DNA, 20 bp, Artificial Sequence
  chemically synthesized
gaaaaattacattcccataa

SEQ ID NO: 417035 - DNA, 20 bp, Artificial Sequence
  chemically synthesized
aaagattgttttaatatgtt

SEQ ID NO: 417036 - DNA, 20 bp, Artificial Sequence
  chemically synthesized
accataacaagggacataaa

SEQ ID NO: 417037 - DNA, 20 bp, Artificial Sequence
  chemically synthesized
tctttttatgtcccttgtta

SEQ ID NO: 417038 - DNA, 20 bp, Artificial Sequence
  chemically synthesized
gtctgataaaaccataacaa

SEQ ID NO: 417039 - DNA, 20 bp, Artificial Sequence
  chemically synthesized
tgtctgataaaaccataaca

SEQ ID NO: 417040 - DNA, 20 bp, Artificial Sequence
  chemically synthesized
ttgtctgataaaaccataac

SEQ ID NO: 417041 - DNA, 20 bp, Artificial Sequence
  chemically synthesized
gtcccttgttatggttttat

SEQ ID NO: 417042 - DNA, 20 bp, Artificial Sequence
  chemically synthesized
ttgttatggttttatcagac

SEQ ID NO: 417043 - DNA, 20 bp, Artificial Sequence
  chemically synthesized
ttatggttttatcagacaag

SEQ ID NO: 417044 - DNA, 20 bp, Artificial Sequence
  chemically synthesized
cagacaagcagaacaatttc

SEQ ID NO: 417045 - DNA, 20 bp, Artificial Sequence
  chemically synthesized
agacaagcagaacaatttca

SEQ ID NO: 417046 - DNA, 20 bp, Artificial Sequence
  chemically synthesized
gacaagcagaacaatttcaa

SEQ ID NO: 417047 - DNA, 20 bp, Artificial Sequence
  chemically synthesized
gaacaatttcaagggaacct

SEQ ID NO: 417048 - DNA, 20 bp, Artificial Sequence
  chemically synthesized
acaatttcaagggaacctaa

SEQ ID NO: 417049 - DNA, 20 bp, Artificial Sequence
  chemically synthesized
atttcaagggaacctaagag

SEQ ID NO: 417050 - DNA, 20 bp, Artificial Sequence
  chemically synthesized
aatattgatagtctactctt

SEQ ID NO: 417051 - DNA, 20 bp, Artificial Sequence
  chemically synthesized
taatattgatagtctactct

SEQ ID NO: 417052 - DNA, 20 bp, Artificial Sequence
  chemically synthesized
taagagtagactatcaatat

SEQ ID NO: 417053 - DNA, 20 bp, Artificial Sequence
  chemically synthesized
tgagcaatgactaatattga

SEQ ID NO: 417054 - DNA, 20 bp, Artificial Sequence
  chemically synthesized
acttcctgtaaacacaacat

SEQ ID NO: 417055 - DNA, 20 bp, Artificial Sequence
  chemically synthesized
cattgctcatgttgtgttta

SEQ ID NO: 417056 - DNA, 20 bp, Artificial Sequence
  chemically synthesized
attgctcatgttgtgtttac

SEQ ID NO: 417057 - DNA, 20 bp, Artificial Sequence
  chemically synthesized
gctcatgttgtgtttacagg

SEQ ID NO: 417058 - DNA, 20 bp, Artificial Sequence
  chemically synthesized
aatataaatcgaatgtaaat

SEQ ID NO: 417059 - DNA, 20 bp, Artificial Sequence
  chemically synthesized
ttcgatttatattaataatc

SEQ ID NO: 417060 - DNA, 20 bp, Artificial Sequence
  chemically synthesized
cgatttatattaataatcaa

SEQ ID NO: 417061 - DNA, 20 bp, Artificial Sequence
  chemically synthesized
tttatattaataatcaagag

SEQ ID NO: 417062 - DNA, 20 bp, Artificial Sequence
  chemically synthesized
tcaagagtggaactgcaatg

SEQ ID NO: 417063 - DNA, 20 bp, Artificial Sequence
  chemically synthesized
agaaagtttgcacttcattg

SEQ ID NO: 417064 - DNA, 20 bp, Artificial Sequence
  chemically synthesized
agaaaagagaattaaaaaga

SEQ ID NO: 417065 - DNA, 20 bp, Artificial Sequence
  chemically synthesized
ctacagaaaagagaattaaa

SEQ ID NO: 417066 - DNA, 20 bp, Artificial Sequence
  chemically synthesized
ctttttaattctcttttctg

SEQ ID NO: 417067 - DNA, 20 bp, Artificial Sequence
  chemically synthesized
agtttgtacactacagaaaa

SEQ ID NO: 417068 - DNA, 20 bp, Artificial Sequence
  chemically synthesized
tgagtttgtacactacagaa

SEQ ID NO: 417069 - DNA, 20 bp, Artificial Sequence
  chemically synthesized
atacatgagtttgtacacta

SEQ ID NO: 417070 - DNA, 20 bp, Artificial Sequence
  chemically synthesized
tagtgtacaaactcatgtat

SEQ ID NO: 417071 - DNA, 20 bp, Artificial Sequence
  chemically synthesized
ccccaaagctactgatacat

SEQ ID NO: 417072 - DNA, 20 bp, Artificial Sequence
  chemically synthesized
tgtacaaactcatgtatcag

SEQ ID NO: 417073 - DNA, 20 bp, Artificial Sequence
  chemically synthesized
aactcatgtatcagtagctt

SEQ ID NO: 417074 - DNA, 20 bp, Artificial Sequence
  chemically synthesized
actcatgtatcagtagcttt

SEQ ID NO: 417075 - DNA, 20 bp, Artificial Sequence
  chemically synthesized
ctcatgtatcagtagctttg

SEQ ID NO: 417076 - DNA, 20 bp, Artificial Sequence
  chemically synthesized
tcatgtatcagtagctttgg

SEQ ID NO: 417077 - DNA, 20 bp, Artificial Sequence
  chemically synthesized
ggtagtgctaatagccccca

SEQ ID NO: 417078 - DNA, 20 bp, Artificial Sequence
  chemically synthesized
tcagtagctttgggggctat

SEQ ID NO: 417079 - DNA, 20 bp, Artificial Sequence
  chemically synthesized
tattctggaggtagtgctaa

SEQ ID NO: 417080 - DNA, 20 bp, Artificial Sequence
  chemically synthesized
ggggctattagcactacctc

SEQ ID NO: 417081 - DNA, 20 bp, Artificial Sequence
  chemically synthesized
acaggtttatattctggagg

SEQ ID NO: 417082 - DNA, 20 bp, Artificial Sequence
  chemically synthesized
atgacaggtttatattctgg

SEQ ID NO: 417083 - DNA, 20 bp, Artificial Sequence
  chemically synthesized
tatgacaggtttatattctg

SEQ ID NO: 417084 - DNA, 20 bp, Artificial Sequence
  chemically synthesized
aatatgacaggtttatattc

SEQ ID NO: 417085 - DNA, 20 bp, Artificial Sequence
  chemically synthesized
aggcaaatttaaaatatgac

SEQ ID NO: 417086 - DNA, 20 bp, Artificial Sequence
  chemically synthesized
gaggcaaatttaaaatatga

SEQ ID NO: 417087 - DNA, 20 bp, Artificial Sequence
  chemically synthesized
attttaaatttgcctcattt

SEQ ID NO: 417088 - DNA, 20 bp, Artificial Sequence
  chemically synthesized
aagacaaaacttctgaaatg

SEQ ID NO: 417089 - DNA, 20 bp, Artificial Sequence
  chemically synthesized
ttaaatttgcctcatttcag

SEQ ID NO: 417090 - DNA, 20 bp, Artificial Sequence
  chemically synthesized
gaagacaaaacttctgaaat

SEQ ID NO: 417091 - DNA, 20 bp, Artificial Sequence
  chemically synthesized
catgctcctttgaatataag

SEQ ID NO: 417092 - DNA, 20 bp, Artificial Sequence
  chemically synthesized
gttttgtcttcttatattca

SEQ ID NO: 417093 - DNA, 20 bp, Artificial Sequence
  chemically synthesized
aagcatgctcctttgaatat

SEQ ID NO: 417094 - DNA, 20 bp, Artificial Sequence
  chemically synthesized
ttttgtcttcttatattcaa

SEQ ID NO: 417095 - DNA, 20 bp, Artificial Sequence
  chemically synthesized
ttgtcttcttatattcaaag

SEQ ID NO: 417096 - DNA, 20 bp, Artificial Sequence
  chemically synthesized
tatattcaaaggagcatgct

SEQ ID NO: 417097 - DNA, 20 bp, Artificial Sequence
  chemically synthesized
caaaggagcatgcttggtat

SEQ ID NO: 417098 - DNA, 20 bp, Artificial Sequence
  chemically synthesized
ttgatactgtgactcatacc

SEQ ID NO: 417099 - DNA, 20 bp, Artificial Sequence
  chemically synthesized
agcatgcttggtatgagtca

SEQ ID NO: 417100 - DNA, 20 bp, Artificial Sequence
  chemically synthesized
ttagaaaacattcaatgcag

SEQ ID NO: 417101 - DNA, 20 bp, Artificial Sequence
  chemically synthesized
ggcttagaaaacattcaatg

SEQ ID NO: 417102 - DNA, 20 bp, Artificial Sequence
  chemically synthesized
ttctgcattgaatgttttct

SEQ ID NO: 417103 - DNA, 20 bp, Artificial Sequence
  chemically synthesized
gtatgcattttgagatggct

SEQ ID NO: 417104 - DNA, 20 bp, Artificial Sequence
  chemically synthesized
aatttgtatgcattttgaga

SEQ ID NO: 417105 - DNA, 20 bp, Artificial Sequence
  chemically synthesized
taacaatttgtatgcatttt

SEQ ID NO: 417106 - DNA, 20 bp, Artificial Sequence
  chemically synthesized
tcaaaatgcatacaaattgt

SEQ ID NO: 417107 - DNA, 20 bp, Artificial Sequence
  chemically synthesized
atatgttagataaataaatt

SEQ ID NO: 417108 - DNA, 20 bp, Artificial Sequence
  chemically synthesized
tggatatcatgtaaatatgt

SEQ ID NO: 417109 - DNA, 20 bp, Artificial Sequence
  chemically synthesized
ttacatgatatccaaaaatg

SEQ ID NO: 417110 - DNA, 20 bp, Artificial Sequence
  chemically synthesized
atctatcctgtcttcatttt

SEQ ID NO: 417111 - DNA, 20 bp, Artificial Sequence
  chemically synthesized
atgatatccaaaaatgaaga

SEQ ID NO: 417112 - DNA, 20 bp, Artificial Sequence
  chemically synthesized
tgatatccaaaaatgaagac

SEQ ID NO: 417113 - DNA, 20 bp, Artificial Sequence
  chemically synthesized
atccaaaaatgaagacagga

SEQ ID NO: 417114 - DNA, 20 bp, Artificial Sequence
  chemically synthesized
aatgaagacaggatagataa

SEQ ID NO: 417115 - DNA, 20 bp, Artificial Sequence
  chemically synthesized
aatagcttacaggtttatat

SEQ ID NO: 417116 - DNA, 20 bp, Artificial Sequence
  chemically synthesized
gaaatctaatataaacctgt

SEQ ID NO: 417117 - DNA, 20 bp, Artificial Sequence
  chemically synthesized
atgttgttaaaatagcttac

SEQ ID NO: 417118 - DNA, 20 bp, Artificial Sequence
  chemically synthesized
gatgttgttaaaatagctta

SEQ ID NO: 417119 - DNA, 20 bp, Artificial Sequence
  chemically synthesized
tacatttgatgttgttaaaa

SEQ ID NO: 417120 - DNA, 20 bp, Artificial Sequence
  chemically synthesized
ttttaacaacatcaaatgta

SEQ ID NO: 417121 - DNA, 20 bp, Artificial Sequence
  chemically synthesized
tcaaatgtatggtgtccctt

SEQ ID NO: 417122 - DNA, 20 bp, Artificial Sequence
  chemically synthesized
aaatgtatggtgtcccttaa

SEQ ID NO: 417123 - DNA, 20 bp, Artificial Sequence
  chemically synthesized
gtttgatttagcactcttaa

SEQ ID NO: 417124 - DNA, 20 bp, Artificial Sequence
  chemically synthesized
tgtttgatttagcactctta

SEQ ID NO: 417125 - DNA, 20 bp, Artificial Sequence
  chemically synthesized
gtgtttgatttagcactctt

SEQ ID NO: 417126 - DNA, 20 bp, Artificial Sequence
  chemically synthesized
ggaagaagtagtgtttgatt

SEQ ID NO: 417127 - DNA, 20 bp, Artificial Sequence
  chemically synthesized
aaatcaaacactacttcttc

SEQ ID NO: 417128 - DNA, 20 bp, Artificial Sequence
  chemically synthesized
aaaaaaaattctggaagaag

SEQ ID NO: 417129 - DNA, 20 bp, Artificial Sequence
  chemically synthesized
aaaaaaaaaaattctggaag

SEQ ID NO: 417130 - DNA, 20 bp, Artificial Sequence
  chemically synthesized
aaaaaaaaaaaaaattctgg

SEQ ID NO: 417131 - DNA, 20 bp, Artificial Sequence
  chemically synthesized
aaaaaaaaaaaaaaaaattc

SEQ ID NO: 417132 - DNA, 20 bp, Artificial Sequence
  chemically synthesized
tttttttttttttttttttt

SEQ ID NO: 417133 - DNA, 20 bp, Artificial Sequence
  chemically synthesized
ttttttttttttttttgaga

SEQ ID NO: 417134 - DNA, 20 bp, Artificial Sequence
  chemically synthesized
ttttttttttttttgagatg

SEQ ID NO: 417135 - DNA, 20 bp, Artificial Sequence
  chemically synthesized
tccagcctgggtgacagagc

SEQ ID NO: 417136 - DNA, 20 bp, Artificial Sequence
  chemically synthesized
tggagtctcgctctgtcacc

SEQ ID NO: 417137 - DNA, 20 bp, Artificial Sequence
  chemically synthesized
gcactccagcctgggtgaca

SEQ ID NO: 417138 - DNA, 20 bp, Artificial Sequence
  chemically synthesized
ggagtctcgctctgtcaccc

SEQ ID NO: 417139 - DNA, 20 bp, Artificial Sequence
  chemically synthesized
ctgcactccagcctgggtga

SEQ ID NO: 417140 - DNA, 20 bp, Artificial Sequence
  chemically synthesized
tctcgctctgtcacccaggc

SEQ ID NO: 417141 - DNA, 20 bp, Artificial Sequence
  chemically synthesized
tcgctctgtcacccaggctg

SEQ ID NO: 417142 - DNA, 20 bp, Artificial Sequence
  chemically synthesized
gcaccactgcactccagcct

SEQ ID NO: 417143 - DNA, 20 bp, Artificial Sequence
  chemically synthesized
cgcaccactgcactccagcc

SEQ ID NO: 417144 - DNA, 20 bp, Artificial Sequence
  chemically synthesized
ctgtcacccaggctggagtg

SEQ ID NO: 417145 - DNA, 20 bp, Artificial Sequence
  chemically synthesized
gagatcgcaccactgcactc

SEQ ID NO: 417146 - DNA, 20 bp, Artificial Sequence
  chemically synthesized
tcacccaggctggagtgcag

SEQ ID NO: 417147 - DNA, 20 bp, Artificial Sequence
  chemically synthesized
ggagtgcagtggtgcgatct

SEQ ID NO: 417148 - DNA, 20 bp, Artificial Sequence
  chemically synthesized
ggcggaggttgcagtgagcc

SEQ ID NO: 417149 - DNA, 20 bp, Artificial Sequence
  chemically synthesized
caagaggcggaggttgcagt

SEQ ID NO: 417150 - DNA, 20 bp, Artificial Sequence
  chemically synthesized
agcccaagaggcggaggttg

SEQ ID NO: 417151 - DNA, 20 bp, Artificial Sequence
  chemically synthesized
ggcgtgagcccaagaggcgg

SEQ ID NO: 417152 - DNA, 20 bp, Artificial Sequence
  chemically synthesized
tcactgcaacctccgcctct

SEQ ID NO: 417153 - DNA, 20 bp, Artificial Sequence
  chemically synthesized
tggcgtgagcccaagaggcg

SEQ ID NO: 417154 - DNA, 20 bp, Artificial Sequence
  chemically synthesized
cactgcaacctccgcctctt

SEQ ID NO: 417155 - DNA, 20 bp, Artificial Sequence
  chemically synthesized
aatggcgtgagcccaagagg

SEQ ID NO: 417156 - DNA, 20 bp, Artificial Sequence
  chemically synthesized
gagaatggcgtgagcccaag

SEQ ID NO: 417157 - DNA, 20 bp, Artificial Sequence
  chemically synthesized
ggagaatggcgtgagcccaa

SEQ ID NO: 417158 - DNA, 20 bp, Artificial Sequence
  chemically synthesized
caggagaatggcgtgagccc

SEQ ID NO: 417159 - DNA, 20 bp, Artificial Sequence
  chemically synthesized
ctgaggcaggagaatggcgt

SEQ ID NO: 417160 - DNA, 20 bp, Artificial Sequence
  chemically synthesized
tggaggctgaggcaggagaa

SEQ ID NO: 417161 - DNA, 20 bp, Artificial Sequence
  chemically synthesized
ctcacgccattctcctgcct

SEQ ID NO: 417162 - DNA, 20 bp, Artificial Sequence
  chemically synthesized
tactctggaggctgaggcag

SEQ ID NO: 417163 - DNA, 20 bp, Artificial Sequence
  chemically synthesized
gctactctggaggctgaggc

SEQ ID NO: 417164 - DNA, 20 bp, Artificial Sequence
  chemically synthesized
agctactctggaggctgagg

SEQ ID NO: 417165 - DNA, 20 bp, Artificial Sequence
  chemically synthesized
cattctcctgcctcagcctc

SEQ ID NO: 417166 - DNA, 20 bp, Artificial Sequence
  chemically synthesized
cccagctactctggaggctg

SEQ ID NO: 417167 - DNA, 20 bp, Artificial Sequence
  chemically synthesized
acccagctactctggaggct

SEQ ID NO: 417168 - DNA, 20 bp, Artificial Sequence
  chemically synthesized
ttctcctgcctcagcctcca

SEQ ID NO: 417169 - DNA, 20 bp, Artificial Sequence
  chemically synthesized
tcctgcctcagcctccagag

SEQ ID NO: 417170 - DNA, 20 bp, Artificial Sequence
  chemically synthesized
tgtagacccagctactctgg

SEQ ID NO: 417171 - DNA, 20 bp, Artificial Sequence
  chemically synthesized
ctgtagacccagctactctg

SEQ ID NO: 417172 - DNA, 20 bp, Artificial Sequence
  chemically synthesized
gcctcagcctccagagtagc

SEQ ID NO: 417173 - DNA, 20 bp, Artificial Sequence
  chemically synthesized
gcctgtagacccagctactc

SEQ ID NO: 417174 - DNA, 20 bp, Artificial Sequence
  chemically synthesized
cctcagcctccagagtagct

SEQ ID NO: 417175 - DNA, 20 bp, Artificial Sequence
  chemically synthesized
ctccagagtagctgggtcta

SEQ ID NO: 417176 - DNA, 20 bp, Artificial Sequence
  chemically synthesized
tccagagtagctgggtctac

SEQ ID NO: 417177 - DNA, 20 bp, Artificial Sequence
  chemically synthesized
gtggcaggcgcctgtagacc

SEQ ID NO: 417178 - DNA, 20 bp, Artificial Sequence
  chemically synthesized
ggcgtggtggcaggcgcctg

SEQ ID NO: 417179 - DNA, 20 bp, Artificial Sequence
  chemically synthesized
agttagccgggcgtggtggc

SEQ ID NO: 417180 - DNA, 20 bp, Artificial Sequence
  chemically synthesized
aagttagccgggcgtggtgg

SEQ ID NO: 417181 - DNA, 20 bp, Artificial Sequence
  chemically synthesized
caggcgcctgccaccacgcc

SEQ ID NO: 417182 - DNA, 20 bp, Artificial Sequence
  chemically synthesized
aaaaagttagccgggcgtgg

SEQ ID NO: 417183 - DNA, 20 bp, Artificial Sequence
  chemically synthesized
tacaaaaagttagccgggcg

SEQ ID NO: 417184 - DNA, 20 bp, Artificial Sequence
  chemically synthesized
aaaaatacaaaaagttagcc

SEQ ID NO: 417185 - DNA, 20 bp, Artificial Sequence
  chemically synthesized
taaaaatacaaaaagttagc

SEQ ID NO: 417186 - DNA, 20 bp, Artificial Sequence
  chemically synthesized
ctactaaaaatacaaaaagt

SEQ ID NO: 417187 - DNA, 20 bp, Artificial Sequence
  chemically synthesized
gtctctactaaaaatacaaa

SEQ ID NO: 417188 - DNA, 20 bp, Artificial Sequence
  chemically synthesized
cggctaactttttgtatttt

SEQ ID NO: 417189 - DNA, 20 bp, Artificial Sequence
  chemically synthesized
ctaactttttgtatttttag

SEQ ID NO: 417190 - DNA, 20 bp, Artificial Sequence
  chemically synthesized
aactttttgtatttttagta

SEQ ID NO: 417191 - DNA, 20 bp, Artificial Sequence
  chemically synthesized
ttttgtatttttagtagaga

SEQ ID NO: 417192 - DNA, 20 bp, Artificial Sequence
  chemically synthesized
tttgtatttttagtagagac

SEQ ID NO: 417193 - DNA, 20 bp, Artificial Sequence
  chemically synthesized
ttgtatttttagtagagacg

SEQ ID NO: 417194 - DNA, 20 bp, Artificial Sequence
  chemically synthesized
gagacggggtttcaccatgt

SEQ ID NO: 417195 - DNA, 20 bp, Artificial Sequence
  chemically synthesized
cggggtttcaccatgttagc

SEQ ID NO: 417196 - DNA, 20 bp, Artificial Sequence
  chemically synthesized
cgagaccatcctggctaaca

SEQ ID NO: 417197 - DNA, 20 bp, Artificial Sequence
  chemically synthesized
ggggtttcaccatgttagcc

SEQ ID NO: 417198 - DNA, 20 bp, Artificial Sequence
  chemically synthesized
tttcaccatgttagccagga

SEQ ID NO: 417199 - DNA, 20 bp, Artificial Sequence
  chemically synthesized
tcaggagatcgagaccatcc

SEQ ID NO: 417200 - DNA, 20 bp, Artificial Sequence
  chemically synthesized
gatcacgaggtcaggagatc

SEQ ID NO: 417201 - DNA, 20 bp, Artificial Sequence
  chemically synthesized
tgggtggatcacgaggtcag

SEQ ID NO: 417202 - DNA, 20 bp, Artificial Sequence
  chemically synthesized
ggtgggtggatcacgaggtc

SEQ ID NO: 417203 - DNA, 20 bp, Artificial Sequence
  chemically synthesized
aggtgggtggatcacgaggt

SEQ ID NO: 417204 - DNA, 20 bp, Artificial Sequence
  chemically synthesized
gccaaggtgggtggatcacg

SEQ ID NO: 417205 - DNA, 20 bp, Artificial Sequence
  chemically synthesized
ggccaaggtgggtggatcac

SEQ ID NO: 417206 - DNA, 20 bp, Artificial Sequence
  chemically synthesized
acctcgtgatccacccacct

SEQ ID NO: 417207 - DNA, 20 bp, Artificial Sequence
  chemically synthesized
ctttgggaggccaaggtggg

SEQ ID NO: 417208 - DNA, 20 bp, Artificial Sequence
  chemically synthesized
gcactttgggaggccaaggt

SEQ ID NO: 417209 - DNA, 20 bp, Artificial Sequence
  chemically synthesized
agcactttgggaggccaagg

SEQ ID NO: 417210 - DNA, 20 bp, Artificial Sequence
  chemically synthesized
cccagcactttgggaggcca

SEQ ID NO: 417211 - DNA, 20 bp, Artificial Sequence
  chemically synthesized
tcccagcactttgggaggcc

SEQ ID NO: 417212 - DNA, 20 bp, Artificial Sequence
  chemically synthesized
ccacccaccttggcctccca

SEQ ID NO: 417213 - DNA, 20 bp, Artificial Sequence
  chemically synthesized
agtaatcccagcactttggg

SEQ ID NO: 417214 - DNA, 20 bp, Artificial Sequence
  chemically synthesized
cagtaatcccagcactttgg

SEQ ID NO: 417215 - DNA, 20 bp, Artificial Sequence
  chemically synthesized
accttggcctcccaaagtgc

SEQ ID NO: 417216 - DNA, 20 bp, Artificial Sequence
  chemically synthesized
gccagtaatcccagcacttt

SEQ ID NO: 417217 - DNA, 20 bp, Artificial Sequence
  chemically synthesized
ccttggcctcccaaagtgct

SEQ ID NO: 417218 - DNA, 20 bp, Artificial Sequence
  chemically synthesized
cgccagtaatcccagcactt

SEQ ID NO: 417219 - DNA, 20 bp, Artificial Sequence
  chemically synthesized
tcccaaagtgctgggattac

SEQ ID NO: 417220 - DNA, 20 bp, Artificial Sequence
  chemically synthesized
gtggctcacgccagtaatcc

SEQ ID NO: 417221 - DNA, 20 bp, Artificial Sequence
  chemically synthesized
agtgctgggattactggcgt

SEQ ID NO: 417222 - DNA, 20 bp, Artificial Sequence
  chemically synthesized
ccgggcgcggtggctcacgc

SEQ ID NO: 417223 - DNA, 20 bp, Artificial Sequence
  chemically synthesized
ctggcgtgagccaccgcgcc

SEQ ID NO: 417224 - DNA, 20 bp, Artificial Sequence
  chemically synthesized
tggaagaaggccgggcgcgg

SEQ ID NO: 417225 - DNA, 20 bp, Artificial Sequence
  chemically synthesized
ttctggaagaaggccgggcg

SEQ ID NO: 417226 - DNA, 20 bp, Artificial Sequence
  chemically synthesized
aaaaattctggaagaaggcc

SEQ ID NO: 417227 - DNA, 20 bp, Artificial Sequence
  chemically synthesized
caaaaattctggaagaaggc

SEQ ID NO: 417228 - DNA, 20 bp, Artificial Sequence
  chemically synthesized
caccgcgcccggccttcttc

SEQ ID NO: 417229 - DNA, 20 bp, Artificial Sequence
  chemically synthesized
ctcccaaaaattctggaaga

SEQ ID NO: 417230 - DNA, 20 bp, Artificial Sequence
  chemically synthesized
tctcccaaaaattctggaag

SEQ ID NO: 417231 - DNA, 20 bp, Artificial Sequence
  chemically synthesized
acatctcccaaaaattctgg

SEQ ID NO: 417232 - DNA, 20 bp, Artificial Sequence
  chemically synthesized
cggccttcttccagaatttt

SEQ ID NO: 417233 - DNA, 20 bp, Artificial Sequence
  chemically synthesized
tttacatctcccaaaaattc

SEQ ID NO: 417234 - DNA, 20 bp, Artificial Sequence
  chemically synthesized
ggccttcttccagaattttt

SEQ ID NO: 417235 - DNA, 20 bp, Artificial Sequence
  chemically synthesized
ccttcttccagaatttttgg

SEQ ID NO: 417236 - DNA, 20 bp, Artificial Sequence
  chemically synthesized
tttttgggagatgtaaaata

SEQ ID NO: 417237 - DNA, 20 bp, Artificial Sequence
  chemically synthesized
tttgggagatgtaaaataaa

SEQ ID NO: 417238 - DNA, 20 bp, Artificial Sequence
  chemically synthesized
aaataaagagatgatttaaa

SEQ ID NO: 417239 - DNA, 20 bp, Artificial Sequence
  chemically synthesized
ttaaaatatgcattcacaaa

SEQ ID NO: 417240 - DNA, 20 bp, Artificial Sequence
  chemically synthesized
gattaaaatatgcattcaca

SEQ ID NO: 417241 - DNA, 20 bp, Artificial Sequence
  chemically synthesized
gcatattttaatctttactc

SEQ ID NO: 417242 - DNA, 20 bp, Artificial Sequence
  chemically synthesized
aaatctccagagccagagta

SEQ ID NO: 417243 - DNA, 20 bp, Artificial Sequence
  chemically synthesized
tttaatctttactctggctc

SEQ ID NO: 417244 - DNA, 20 bp, Artificial Sequence
  chemically synthesized
ctataaaatctccagagcca

SEQ ID NO: 417245 - DNA, 20 bp, Artificial Sequence
  chemically synthesized
taatctttactctggctctg

SEQ ID NO: 417246 - DNA, 20 bp, Artificial Sequence
  chemically synthesized
ctctataaaatctccagagc

SEQ ID NO: 417247 - DNA, 20 bp, Artificial Sequence
  chemically synthesized
ctacctctataaaatctcca

SEQ ID NO: 417248 - DNA, 20 bp, Artificial Sequence
  chemically synthesized
acctacctctataaaatctc

SEQ ID NO: 417249 - DNA, 20 bp, Artificial Sequence
  chemically synthesized
ctctggctctggagatttta

SEQ ID NO: 417250 - DNA, 20 bp, Artificial Sequence
  chemically synthesized
ctggctctggagattttata

SEQ ID NO: 417251 - DNA, 20 bp, Artificial Sequence
  chemically synthesized
tggctctggagattttatag

SEQ ID NO: 417252 - DNA, 20 bp, Artificial Sequence
  chemically synthesized
ctctggagattttatagagg

SEQ ID NO: 417253 - DNA, 20 bp, Artificial Sequence
  chemically synthesized
tctggagattttatagaggt

SEQ ID NO: 417254 - DNA, 20 bp, Artificial Sequence
  chemically synthesized
ttatagaggtaggtaaacta

SEQ ID NO: 417255 - DNA, 20 bp, Artificial Sequence
  chemically synthesized
attatttagaaacacaactt

SEQ ID NO: 417256 - DNA, 20 bp, Artificial Sequence
  chemically synthesized
tatcttacagaaacattatt

SEQ ID NO: 417257 - DNA, 20 bp, Artificial Sequence
  chemically synthesized
tttctaaataatgtttctgt

SEQ ID NO: 417258 - DNA, 20 bp, Artificial Sequence
  chemically synthesized
agatttaaaaatatatctta

SEQ ID NO: 417259 - DNA, 20 bp, Artificial Sequence
  chemically synthesized
agatatatttttaaatctat

SEQ ID NO: 417260 - DNA, 20 bp, Artificial Sequence
  chemically synthesized
ctctgaaacattttaactta

SEQ ID NO: 417261 - DNA, 20 bp, Artificial Sequence
  chemically synthesized
atctataagttaaaatgttt

SEQ ID NO: 417262 - DNA, 20 bp, Artificial Sequence
  chemically synthesized
ctataagttaaaatgtttca

SEQ ID NO: 417263 - DNA, 20 bp, Artificial Sequence
  chemically synthesized
ataagttaaaatgtttcaga

SEQ ID NO: 417264 - DNA, 20 bp, Artificial Sequence
  chemically synthesized
gagataatgcgatctgtttg

SEQ ID NO: 417265 - DNA, 20 bp, Artificial Sequence
  chemically synthesized
aaatatagcatggcttcaaa

SEQ ID NO: 417266 - DNA, 20 bp, Artificial Sequence
  chemically synthesized
gtcgtctccaaaatatagca

SEQ ID NO: 417267 - DNA, 20 bp, Artificial Sequence
  chemically synthesized
tttgaagccatgctatattt

SEQ ID NO: 417268 - DNA, 20 bp, Artificial Sequence
  chemically synthesized
tgaagccatgctatattttg

SEQ ID NO: 417269 - DNA, 20 bp, Artificial Sequence
  chemically synthesized
aaaaagtcgtctccaaaata

SEQ ID NO: 417270 - DNA, 20 bp, Artificial Sequence
  chemically synthesized
caaaaaaataaaaaaaaaaa

SEQ ID NO: 417271 - DNA, 20 bp, Artificial Sequence
  chemically synthesized
ttttttttttttattttttt

SEQ ID NO: 417272 - DNA, 20 bp, Artificial Sequence
  chemically synthesized
ttttttttatttttttgaga

SEQ ID NO: 417273 - DNA, 20 bp, Artificial Sequence
  chemically synthesized
ttttttatttttttgagaca

SEQ ID NO: 417274 - DNA, 20 bp, Artificial Sequence
  chemically synthesized
cactccagcctgggtgacaa

SEQ ID NO: 417275 - DNA, 20 bp, Artificial Sequence
  chemically synthesized
agagttttgctcttgtcacc

SEQ ID NO: 417276 - DNA, 20 bp, Artificial Sequence
  chemically synthesized
gagttttgctcttgtcaccc

SEQ ID NO: 417277 - DNA, 20 bp, Artificial Sequence
  chemically synthesized
tgcactccagcctgggtgac

SEQ ID NO: 417278 - DNA, 20 bp, Artificial Sequence
  chemically synthesized
tttgctcttgtcacccaggc

SEQ ID NO: 417279 - DNA, 20 bp, Artificial Sequence
  chemically synthesized
tgctcttgtcacccaggctg

SEQ ID NO: 417280 - DNA, 20 bp, Artificial Sequence
  chemically synthesized
gtgccattgcactccagcct

SEQ ID NO: 417281 - DNA, 20 bp, Artificial Sequence
  chemically synthesized
ggtgccattgcactccagcc

SEQ ID NO: 417282 - DNA, 20 bp, Artificial Sequence
  chemically synthesized
aagatggtgccattgcactc

SEQ ID NO: 417283 - DNA, 20 bp, Artificial Sequence
  chemically synthesized
tcacccaggctggagtgcaa

SEQ ID NO: 417284 - DNA, 20 bp, Artificial Sequence
  chemically synthesized
ggagtgcaatggcaccatct

SEQ ID NO: 417285 - DNA, 20 bp, Artificial Sequence
  chemically synthesized
gaggttgcagtgagccaaga

SEQ ID NO: 417286 - DNA, 20 bp, Artificial Sequence
  chemically synthesized
ggcagaggttgcagtgagcc

SEQ ID NO: 417287 - DNA, 20 bp, Artificial Sequence
  chemically synthesized
tgggaggcagaggttgcagt

SEQ ID NO: 417288 - DNA, 20 bp, Artificial Sequence
  chemically synthesized
aatctgggaggcagaggttg

SEQ ID NO: 417289 - DNA, 20 bp, Artificial Sequence
  chemically synthesized
tctttgaatctgggaggcag

SEQ ID NO: 417290 - DNA, 20 bp, Artificial Sequence
  chemically synthesized
tcactgcaacctctgcctcc

SEQ ID NO: 417291 - DNA, 20 bp, Artificial Sequence
  chemically synthesized
atctttgaatctgggaggca

SEQ ID NO: 417292 - DNA, 20 bp, Artificial Sequence
  chemically synthesized
gaatctttgaatctgggagg

SEQ ID NO: 417293 - DNA, 20 bp, Artificial Sequence
  chemically synthesized
ggagaatctttgaatctggg

SEQ ID NO: 417294 - DNA, 20 bp, Artificial Sequence
  chemically synthesized
aggagaatctttgaatctgg

SEQ ID NO: 417295 - DNA, 20 bp, Artificial Sequence
  chemically synthesized
acctctgcctcccagattca

SEQ ID NO: 417296 - DNA, 20 bp, Artificial Sequence
  chemically synthesized
gcaggagaatctttgaatct

SEQ ID NO: 417297 - DNA, 20 bp, Artificial Sequence
  chemically synthesized
ggcaggagaatctttgaatc

SEQ ID NO: 417298 - DNA, 20 bp, Artificial Sequence
  chemically synthesized
attcaaagattctcctgcct

SEQ ID NO: 417299 - DNA, 20 bp, Artificial Sequence
  chemically synthesized
tacttgggaggctgaggcag

SEQ ID NO: 417300 - DNA, 20 bp, Artificial Sequence
  chemically synthesized
gctacttgggaggctgaggc

SEQ ID NO: 417301 - DNA, 20 bp, Artificial Sequence
  chemically synthesized
agctacttgggaggctgagg

SEQ ID NO: 417302 - DNA, 20 bp, Artificial Sequence
  chemically synthesized
cccagctacttgggaggctg

SEQ ID NO: 417303 - DNA, 20 bp, Artificial Sequence
  chemically synthesized
tcccagctacttgggaggct

SEQ ID NO: 417304 - DNA, 20 bp, Artificial Sequence
  chemically synthesized
ttctcctgcctcagcctccc

SEQ ID NO: 417305 - DNA, 20 bp, Artificial Sequence
  chemically synthesized
tcctgcctcagcctcccaag

SEQ ID NO: 417306 - DNA, 20 bp, Artificial Sequence
  chemically synthesized
tgtaatcccagctacttggg

SEQ ID NO: 417307 - DNA, 20 bp, Artificial Sequence
  chemically synthesized
ttgtaatcccagctacttgg

SEQ ID NO: 417308 - DNA, 20 bp, Artificial Sequence
  chemically synthesized
gcctcagcctcccaagtagc

SEQ ID NO: 417309 - DNA, 20 bp, Artificial Sequence
  chemically synthesized
gcttgtaatcccagctactt

SEQ ID NO: 417310 - DNA, 20 bp, Artificial Sequence
  chemically synthesized
cctcagcctcccaagtagct

SEQ ID NO: 417311 - DNA, 20 bp, Artificial Sequence
  chemically synthesized
tgcttgtaatcccagctact

SEQ ID NO: 417312 - DNA, 20 bp, Artificial Sequence
  chemically synthesized
tcccaagtagctgggattac

SEQ ID NO: 417313 - DNA, 20 bp, Artificial Sequence
  chemically synthesized
gtggtgcatgcttgtaatcc

SEQ ID NO: 417314 - DNA, 20 bp, Artificial Sequence
  chemically synthesized
caagcatgcaccaccacacc

SEQ ID NO: 417315 - DNA, 20 bp, Artificial Sequence
  chemically synthesized
aaacgattagccaggtgtgg

SEQ ID NO: 417316 - DNA, 20 bp, Artificial Sequence
  chemically synthesized
tacaaacgattagccaggtg

SEQ ID NO: 417317 - DNA, 20 bp, Artificial Sequence
  chemically synthesized
aaaaatacaaacgattagcc

SEQ ID NO: 417318 - DNA, 20 bp, Artificial Sequence
  chemically synthesized
taaaaatacaaacgattagc

SEQ ID NO: 417319 - DNA, 20 bp, Artificial Sequence
  chemically synthesized
ctactaaaaatacaaacgat

SEQ ID NO: 417320 - DNA, 20 bp, Artificial Sequence
  chemically synthesized
tggctaatcgtttgtatttt

SEQ ID NO: 417321 - DNA, 20 bp, Artificial Sequence
  chemically synthesized
ctaatcgtttgtatttttag

SEQ ID NO: 417322 - DNA, 20 bp, Artificial Sequence
  chemically synthesized
aatcgtttgtatttttagta

SEQ ID NO: 417323 - DNA, 20 bp, Artificial Sequence
  chemically synthesized
gtttgtatttttagtagaga

SEQ ID NO: 417324 - DNA, 20 bp, Artificial Sequence
  chemically synthesized
tttgtatttttagtagagat

SEQ ID NO: 417325 - DNA, 20 bp, Artificial Sequence
  chemically synthesized
ttgtatttttagtagagatg

SEQ ID NO: 417326 - DNA, 20 bp, Artificial Sequence
  chemically synthesized
agagatggggtttcaccatg

SEQ ID NO: 417327 - DNA, 20 bp, Artificial Sequence
  chemically synthesized
gagatggggtttcaccatgt

SEQ ID NO: 417328 - DNA, 20 bp, Artificial Sequence
  chemically synthesized
tggggtttcaccatgtgggc

SEQ ID NO: 417329 - DNA, 20 bp, Artificial Sequence
  chemically synthesized
cgagaccagcctggcccaca

SEQ ID NO: 417330 - DNA, 20 bp, Artificial Sequence
  chemically synthesized
ggggtttcaccatgtgggcc

SEQ ID NO: 417331 - DNA, 20 bp, Artificial Sequence
  chemically synthesized
tttcaccatgtgggccaggc

SEQ ID NO: 417332 - DNA, 20 bp, Artificial Sequence
  chemically synthesized
ccaggagttcgagaccagcc

SEQ ID NO: 417333 - DNA, 20 bp, Artificial Sequence
  chemically synthesized
tgaggccaggagttcgagac

SEQ ID NO: 417334 - DNA, 20 bp, Artificial Sequence
  chemically synthesized
ccaggctggtctcgaactcc

SEQ ID NO: 417335 - DNA, 20 bp, Artificial Sequence
  chemically synthesized
tcgcttgaggccaggagttc

SEQ ID NO: 417336 - DNA, 20 bp, Artificial Sequence
  chemically synthesized
agtaaatcgcttgaggccag

SEQ ID NO: 417337 - DNA, 20 bp, Artificial Sequence
  chemically synthesized
ggtctcgaactcctggcctc

SEQ ID NO: 417338 - DNA, 20 bp, Artificial Sequence
  chemically synthesized
cgagtaaatcgcttgaggcc

SEQ ID NO: 417339 - DNA, 20 bp, Artificial Sequence
  chemically synthesized
gcgagtaaatcgcttgaggc

SEQ ID NO: 417340 - DNA, 20 bp, Artificial Sequence
  chemically synthesized
tgaggcgagtaaatcgcttg

SEQ ID NO: 417341 - DNA, 20 bp, Artificial Sequence
  chemically synthesized
ctgaggcgagtaaatcgctt

SEQ ID NO: 417342 - DNA, 20 bp, Artificial Sequence
  chemically synthesized
ctcaagcgatttactcgcct

SEQ ID NO: 417343 - DNA, 20 bp, Artificial Sequence
  chemically synthesized
gcactttgggaggctgaggc

SEQ ID NO: 417344 - DNA, 20 bp, Artificial Sequence
  chemically synthesized
cccagcactttgggaggctg

SEQ ID NO: 417345 - DNA, 20 bp, Artificial Sequence
  chemically synthesized
tcccagcactttgggaggct

SEQ ID NO: 417346 - DNA, 20 bp, Artificial Sequence
  chemically synthesized
ttactcgcctcagcctccca

SEQ ID NO: 417347 - DNA, 20 bp, Artificial Sequence
  chemically synthesized
tataatcccagcactttggg

SEQ ID NO: 417348 - DNA, 20 bp, Artificial Sequence
  chemically synthesized
ctataatcccagcactttgg

SEQ ID NO: 417349 - DNA, 20 bp, Artificial Sequence
  chemically synthesized
gcctcagcctcccaaagtgc

SEQ ID NO: 417350 - DNA, 20 bp, Artificial Sequence
  chemically synthesized
gcctataatcccagcacttt

SEQ ID NO: 417351 - DNA, 20 bp, Artificial Sequence
  chemically synthesized
cctcagcctcccaaagtgct

SEQ ID NO: 417352 - DNA, 20 bp, Artificial Sequence
  chemically synthesized
cgcctataatcccagcactt

SEQ ID NO: 417353 - DNA, 20 bp, Artificial Sequence
  chemically synthesized
ctcccaaagtgctgggatta

SEQ ID NO: 417354 - DNA, 20 bp, Artificial Sequence
  chemically synthesized
tcccaaagtgctgggattat

SEQ ID NO: 417355 - DNA, 20 bp, Artificial Sequence
  chemically synthesized
gtggctcgcgcctataatcc

SEQ ID NO: 417356 - DNA, 20 bp, Artificial Sequence
  chemically synthesized
agtgctgggattataggcgc

SEQ ID NO: 417357 - DNA, 20 bp, Artificial Sequence
  chemically synthesized
taggcgcgagccaccgcacc

SEQ ID NO: 417358 - DNA, 20 bp, Artificial Sequence
  chemically synthesized
gtccctttggccaggtgcgg

SEQ ID NO: 417359 - DNA, 20 bp, Artificial Sequence
  chemically synthesized
attgtccctttggccaggtg

SEQ ID NO: 417360 - DNA, 20 bp, Artificial Sequence
  chemically synthesized
cgagccaccgcacctggcca

SEQ ID NO: 417361 - DNA, 20 bp, Artificial Sequence
  chemically synthesized
gagccaccgcacctggccaa

SEQ ID NO: 417362 - DNA, 20 bp, Artificial Sequence
  chemically synthesized
agccaccgcacctggccaaa

SEQ ID NO: 417363 - DNA, 20 bp, Artificial Sequence
  chemically synthesized
gaaatattgtccctttggcc

SEQ ID NO: 417364 - DNA, 20 bp, Artificial Sequence
  chemically synthesized
agaaatattgtccctttggc

SEQ ID NO: 417365 - DNA, 20 bp, Artificial Sequence
  chemically synthesized
ctaaagaaatattgtccctt

SEQ ID NO: 417366 - DNA, 20 bp, Artificial Sequence
  chemically synthesized
ccaaagggacaatatttctt

SEQ ID NO: 417367 - DNA, 20 bp, Artificial Sequence
  chemically synthesized
caaagggacaatatttcttt

SEQ ID NO: 417368 - DNA, 20 bp, Artificial Sequence
  chemically synthesized
gacaatatttctttaggtca

SEQ ID NO: 417369 - DNA, 20 bp, Artificial Sequence
  chemically synthesized
taaactttccctttgaccta

SEQ ID NO: 417370 - DNA, 20 bp, Artificial Sequence
  chemically synthesized
acaatatttctttaggtcaa

SEQ ID NO: 417371 - DNA, 20 bp, Artificial Sequence
  chemically synthesized
caatatttctttaggtcaaa

SEQ ID NO: 417372 - DNA, 20 bp, Artificial Sequence
  chemically synthesized
atttctttaggtcaaaggga

SEQ ID NO: 417373 - DNA, 20 bp, Artificial Sequence
  chemically synthesized
ttgcagtttgtgtggttacg

SEQ ID NO: 417374 - DNA, 20 bp, Artificial Sequence
  chemically synthesized
atttgttcttgcagtttgtg

SEQ ID NO: 417375 - DNA, 20 bp, Artificial Sequence
  chemically synthesized
cacgtaaccacacaaactgc

SEQ ID NO: 417376 - DNA, 20 bp, Artificial Sequence
  chemically synthesized
aagggaaatatttgttcttg

SEQ ID NO: 417377 - DNA, 20 bp, Artificial Sequence
  chemically synthesized
agaacaaatatttcccttct

SEQ ID NO: 417378 - DNA, 20 bp, Artificial Sequence
  chemically synthesized
tttgctaaggcagctcagaa

SEQ ID NO: 417379 - DNA, 20 bp, Artificial Sequence
  chemically synthesized
ctttgctaaggcagctcaga

SEQ ID NO: 417380 - DNA, 20 bp, Artificial Sequence
  chemically synthesized
cctttgctaaggcagctcag

SEQ ID NO: 417381 - DNA, 20 bp, Artificial Sequence
  chemically synthesized
taccctttgctaaggcagct

SEQ ID NO: 417382 - DNA, 20 bp, Artificial Sequence
  chemically synthesized
atttcccttctgagctgcct

SEQ ID NO: 417383 - DNA, 20 bp, Artificial Sequence
  chemically synthesized
ccagataccctttgctaagg

SEQ ID NO: 417384 - DNA, 20 bp, Artificial Sequence
  chemically synthesized
ccttctgagctgccttagca

SEQ ID NO: 417385 - DNA, 20 bp, Artificial Sequence
  chemically synthesized
cttctgagctgccttagcaa

SEQ ID NO: 417386 - DNA, 20 bp, Artificial Sequence
  chemically synthesized
ttctgagctgccttagcaaa

SEQ ID NO: 417387 - DNA, 20 bp, Artificial Sequence
  chemically synthesized
ttcccagataccctttgcta

SEQ ID NO: 417388 - DNA, 20 bp, Artificial Sequence
  chemically synthesized
attcccagataccctttgct

SEQ ID NO: 417389 - DNA, 20 bp, Artificial Sequence
  chemically synthesized
ctgccttagcaaagggtatc

SEQ ID NO: 417390 - DNA, 20 bp, Artificial Sequence
  chemically synthesized
tgccttagcaaagggtatct

SEQ ID NO: 417391 - DNA, 20 bp, Artificial Sequence
  chemically synthesized
atcattctgtttgatattcc

SEQ ID NO: 417392 - DNA, 20 bp, Artificial Sequence
  chemically synthesized
gggtatctgggaatatcaaa

SEQ ID NO: 417393 - DNA, 20 bp, Artificial Sequence
  chemically synthesized
tatcaaacagaatgattcat

SEQ ID NO: 417394 - DNA, 20 bp, Artificial Sequence
  chemically synthesized
cataagcaaattataatgtc

SEQ ID NO: 417395 - DNA, 20 bp, Artificial Sequence
  chemically synthesized
tattgaaaatttgaatattc

SEQ ID NO: 417396 - DNA, 20 bp, Artificial Sequence
  chemically synthesized
atattcaaattttcaatatc

SEQ ID NO: 417397 - DNA, 20 bp, Artificial Sequence
  chemically synthesized
atatcaagtttgtgttttac

SEQ ID NO: 417398 - DNA, 20 bp, Artificial Sequence
  chemically synthesized
tcaagtttgtgttttaccag

SEQ ID NO: 417399 - DNA, 20 bp, Artificial Sequence
  chemically synthesized
tcttataattttgattctgc

SEQ ID NO: 417400 - DNA, 20 bp, Artificial Sequence
  chemically synthesized
accagcagaatcaaaattat

SEQ ID NO: 417401 - DNA, 20 bp, Artificial Sequence
  chemically synthesized
caaaattataagaaattatc

SEQ ID NO: 417402 - DNA, 20 bp, Artificial Sequence
  chemically synthesized
ttataagaaattatcgagtt

SEQ ID NO: 417403 - DNA, 20 bp, Artificial Sequence
  chemically synthesized
gaaattatcgagtttggtct

SEQ ID NO: 417404 - DNA, 20 bp, Artificial Sequence
  chemically synthesized
tatcgagtttggtctcagta

SEQ ID NO: 417405 - DNA, 20 bp, Artificial Sequence
  chemically synthesized
atagcacatagaactatact

SEQ ID NO: 417406 - DNA, 20 bp, Artificial Sequence
  chemically synthesized
tggaggatccttatagcaca

SEQ ID NO: 417407 - DNA, 20 bp, Artificial Sequence
  chemically synthesized
agtatagttctatgtgctat

SEQ ID NO: 417408 - DNA, 20 bp, Artificial Sequence
  chemically synthesized
gtatagttctatgtgctata

SEQ ID NO: 417409 - DNA, 20 bp, Artificial Sequence
  chemically synthesized
tacattctggaggatcctta

SEQ ID NO: 417410 - DNA, 20 bp, Artificial Sequence
  chemically synthesized
tatgtgctataaggatcctc

SEQ ID NO: 417411 - DNA, 20 bp, Artificial Sequence
  chemically synthesized
tattattttttacattctgg

SEQ ID NO: 417412 - DNA, 20 bp, Artificial Sequence
  chemically synthesized
gtattattttttacattctg

SEQ ID NO: 417413 - DNA, 20 bp, Artificial Sequence
  chemically synthesized
aggtattattttttacattc

SEQ ID NO: 417414 - DNA, 20 bp, Artificial Sequence
  chemically synthesized
aaaaaataatacctgttctc

SEQ ID NO: 417415 - DNA, 20 bp, Artificial Sequence
  chemically synthesized
taaataagattcttgagaac

SEQ ID NO: 417416 - DNA, 20 bp, Artificial Sequence
  chemically synthesized
ttaaataagattcttgagaa

SEQ ID NO: 417417 - DNA, 20 bp, Artificial Sequence
  chemically synthesized
aactgttaaataagattctt

SEQ ID NO: 417418 - DNA, 20 bp, Artificial Sequence
  chemically synthesized
ttctcaagaatcttatttaa

SEQ ID NO: 417419 - DNA, 20 bp, Artificial Sequence
  chemically synthesized
cattctctcaactgttaaat

SEQ ID NO: 417420 - DNA, 20 bp, Artificial Sequence
  chemically synthesized
aagaatcttatttaacagtt

SEQ ID NO: 417421 - DNA, 20 bp, Artificial Sequence
  chemically synthesized
gaatcttatttaacagttga

SEQ ID NO: 417422 - DNA, 20 bp, Artificial Sequence
  chemically synthesized
tatttaacagttgagagaat

SEQ ID NO: 417423 - DNA, 20 bp, Artificial Sequence
  chemically synthesized
taacagttgagagaatgagc

SEQ ID NO: 417424 - DNA, 20 bp, Artificial Sequence
  chemically synthesized
ttatgtgttttattcagatc

SEQ ID NO: 417425 - DNA, 20 bp, Artificial Sequence
  chemically synthesized
catagtttatgtgttttatt

SEQ ID NO: 417426 - DNA, 20 bp, Artificial Sequence
  chemically synthesized
aacacataaactatgattct

SEQ ID NO: 417427 - DNA, 20 bp, Artificial Sequence
  chemically synthesized
tgataaaagtctaagaatca

SEQ ID NO: 417428 - DNA, 20 bp, Artificial Sequence
  chemically synthesized
ctctgaggtgataaaagtct

SEQ ID NO: 417429 - DNA, 20 bp, Artificial Sequence
  chemically synthesized
gcatatctctgaggtgataa

SEQ ID NO: 417430 - DNA, 20 bp, Artificial Sequence
  chemically synthesized
ttcttagacttttatcacct

SEQ ID NO: 417431 - DNA, 20 bp, Artificial Sequence
  chemically synthesized
cttagacttttatcacctca

SEQ ID NO: 417432 - DNA, 20 bp, Artificial Sequence
  chemically synthesized
attttcctagcatatctctg

SEQ ID NO: 417433 - DNA, 20 bp, Artificial Sequence
  chemically synthesized
tattttcctagcatatctct

SEQ ID NO: 417434 - DNA, 20 bp, Artificial Sequence
  chemically synthesized
ttatcacctcagagatatgc

SEQ ID NO: 417435 - DNA, 20 bp, Artificial Sequence
  chemically synthesized
tatcacctcagagatatgct

SEQ ID NO: 417436 - DNA, 20 bp, Artificial Sequence
  chemically synthesized
taaaaaatacagtattttcc

SEQ ID NO: 417437 - DNA, 20 bp, Artificial Sequence
  chemically synthesized
aaagggattcttaaaaaata

SEQ ID NO: 417438 - DNA, 20 bp, Artificial Sequence
  chemically synthesized
aggaaaatactgtatttttt

SEQ ID NO: 417439 - DNA, 20 bp, Artificial Sequence
  chemically synthesized
ctttaaggaaagtttttaaa

SEQ ID NO: 417440 - DNA, 20 bp, Artificial Sequence
  chemically synthesized
gctttaaggaaagtttttaa

SEQ ID NO: 417441 - DNA, 20 bp, Artificial Sequence
  chemically synthesized
tgctttaaggaaagttttta

SEQ ID NO: 417442 - DNA, 20 bp, Artificial Sequence
  chemically synthesized
ccctttaaaaactttcctta

SEQ ID NO: 417443 - DNA, 20 bp, Artificial Sequence
  chemically synthesized
ttgtgttattgctttaagga

SEQ ID NO: 417444 - DNA, 20 bp, Artificial Sequence
  chemically synthesized
atgcttgtgttattgcttta

SEQ ID NO: 417445 - DNA, 20 bp, Artificial Sequence
  chemically synthesized
aatgcttgtgttattgcttt

SEQ ID NO: 417446 - DNA, 20 bp, Artificial Sequence
  chemically synthesized
tttccttaaagcaataacac

SEQ ID NO: 417447 - DNA, 20 bp, Artificial Sequence
  chemically synthesized
aagcaataacacaagcattc

SEQ ID NO: 417448 - DNA, 20 bp, Artificial Sequence
  chemically synthesized
aataacacaagcattctaga

SEQ ID NO: 417449 - DNA, 20 bp, Artificial Sequence
  chemically synthesized
tgcttctatgtggaaccatc

SEQ ID NO: 417450 - DNA, 20 bp, Artificial Sequence
  chemically synthesized
gcattctagatggttccaca

SEQ ID NO: 417451 - DNA, 20 bp, Artificial Sequence
  chemically synthesized
ttctagatggttccacatag

SEQ ID NO: 417452 - DNA, 20 bp, Artificial Sequence
  chemically synthesized
attttttttctgcttctatg

SEQ ID NO: 417453 - DNA, 20 bp, Artificial Sequence
  chemically synthesized
tagatggttccacatagaag

SEQ ID NO: 417454 - DNA, 20 bp, Artificial Sequence
  chemically synthesized
tagaagcagaaaaaaaatac

SEQ ID NO: 417455 - DNA, 20 bp, Artificial Sequence
  chemically synthesized
agcagaaaaaaaatacaaga

SEQ ID NO: 417456 - DNA, 20 bp, Artificial Sequence
  chemically synthesized
gaaaaaaaatacaagaaaga

SEQ ID NO: 417457 - DNA, 20 bp, Artificial Sequence
  chemically synthesized
aatcagggattggttatata

SEQ ID NO: 417458 - DNA, 20 bp, Artificial Sequence
  chemically synthesized
taaatcagggattggttata

SEQ ID NO: 417459 - DNA, 20 bp, Artificial Sequence
  chemically synthesized
cacaattttaaatcagggat

SEQ ID NO: 417460 - DNA, 20 bp, Artificial Sequence
  chemically synthesized
tgtttcacaattttaaatca

SEQ ID NO: 417461 - DNA, 20 bp, Artificial Sequence
  chemically synthesized
ttgtttcacaattttaaatc

SEQ ID NO: 417462 - DNA, 20 bp, Artificial Sequence
  chemically synthesized
attgtttcacaattttaaat

SEQ ID NO: 417463 - DNA, 20 bp, Artificial Sequence
  chemically synthesized
aattgtgaaacaatctcaaa

SEQ ID NO: 417464 - DNA, 20 bp, Artificial Sequence
  chemically synthesized
attgtgaaacaatctcaaat

SEQ ID NO: 417465 - DNA, 20 bp, Artificial Sequence
  chemically synthesized
aaatgggactggacctattt

SEQ ID NO: 417466 - DNA, 20 bp, Artificial Sequence
  chemically synthesized
gaaacaatctcaaataggtc

SEQ ID NO: 417467 - DNA, 20 bp, Artificial Sequence
  chemically synthesized
gtttggtaatgaaatgggac

SEQ ID NO: 417468 - DNA, 20 bp, Artificial Sequence
  chemically synthesized
tagatgtttggtaatgaaat

SEQ ID NO: 417469 - DNA, 20 bp, Artificial Sequence
  chemically synthesized
gtagatgtttggtaatgaaa

SEQ ID NO: 417470 - DNA, 20 bp, Artificial Sequence
  chemically synthesized
agcataaacttgtagatgtt

SEQ ID NO: 417471 - DNA, 20 bp, Artificial Sequence
  chemically synthesized
tttcattaccaaacatctac

SEQ ID NO: 417472 - DNA, 20 bp, Artificial Sequence
  chemically synthesized
aaacccagagcataaacttg

SEQ ID NO: 417473 - DNA, 20 bp, Artificial Sequence
  chemically synthesized
acatctacaagtttatgctc

SEQ ID NO: 417474 - DNA, 20 bp, Artificial Sequence
  chemically synthesized
catctacaagtttatgctct

SEQ ID NO: 417475 - DNA, 20 bp, Artificial Sequence
  chemically synthesized
atcaaaagatggtaaaccca

SEQ ID NO: 417476 - DNA, 20 bp, Artificial Sequence
  chemically synthesized
atatcaaaagatggtaaacc

SEQ ID NO: 417477 - DNA, 20 bp, Artificial Sequence
  chemically synthesized
agggaggagatatcaaaaga

SEQ ID NO: 417478 - DNA, 20 bp, Artificial Sequence
  chemically synthesized
tattagggaggagatatcaa

SEQ ID NO: 417479 - DNA, 20 bp, Artificial Sequence
  chemically synthesized
ctttcactggtattagggag

SEQ ID NO: 417480 - DNA, 20 bp, Artificial Sequence
  chemically synthesized
ccctttcactggtattaggg

SEQ ID NO: 417481 - DNA, 20 bp, Artificial Sequence
  chemically synthesized
tccctttcactggtattagg

SEQ ID NO: 417482 - DNA, 20 bp, Artificial Sequence
  chemically synthesized
tgatatctcctccctaatac

SEQ ID NO: 417483 - DNA, 20 bp, Artificial Sequence
  chemically synthesized
tatccctttcactggtatta

SEQ ID NO: 417484 - DNA, 20 bp, Artificial Sequence
  chemically synthesized
atatccctttcactggtatt

SEQ ID NO: 417485 - DNA, 20 bp, Artificial Sequence
  chemically synthesized
catatccctttcactggtat

SEQ ID NO: 417486 - DNA, 20 bp, Artificial Sequence
  chemically synthesized
ctcctccctaataccagtga

SEQ ID NO: 417487 - DNA, 20 bp, Artificial Sequence
  chemically synthesized
tcctccctaataccagtgaa

SEQ ID NO: 417488 - DNA, 20 bp, Artificial Sequence
  chemically synthesized
cctccctaataccagtgaaa

SEQ ID NO: 417489 - DNA, 20 bp, Artificial Sequence
  chemically synthesized
aatttccatatccctttcac

SEQ ID NO: 417490 - DNA, 20 bp, Artificial Sequence
  chemically synthesized
taataccagtgaaagggata

SEQ ID NO: 417491 - DNA, 20 bp, Artificial Sequence
  chemically synthesized
gatatggaaatttgttgata

SEQ ID NO: 417492 - DNA, 20 bp, Artificial Sequence
  chemically synthesized
tgttgatacagatgttactg

SEQ ID NO: 417493 - DNA, 20 bp, Artificial Sequence
  chemically synthesized
cactgtcagtattaattcta

SEQ ID NO: 417494 - DNA, 20 bp, Artificial Sequence
  chemically synthesized
tactgtagaattaatactga

SEQ ID NO: 417495 - DNA, 20 bp, Artificial Sequence
  chemically synthesized
taaatttcactgatcactgt

SEQ ID NO: 417496 - DNA, 20 bp, Artificial Sequence
  chemically synthesized
gaattaatactgacagtgat

SEQ ID NO: 417497 - DNA, 20 bp, Artificial Sequence
  chemically synthesized
gtgatcagtgaaatttacat

SEQ ID NO: 417498 - DNA, 20 bp, Artificial Sequence
  chemically synthesized
tgatcagtgaaatttacatt

SEQ ID NO: 417499 - DNA, 20 bp, Artificial Sequence
  chemically synthesized
gatcagtgaaatttacattg

SEQ ID NO: 417500 - DNA, 20 bp, Artificial Sequence
  chemically synthesized
cagtgaaatttacattgggg

SEQ ID NO: 417501 - DNA, 20 bp, Artificial Sequence
  chemically synthesized
atttacattggggtggtaat

SEQ ID NO: 417502 - DNA, 20 bp, Artificial Sequence
  chemically synthesized
ttaatgatttaaaattttta

SEQ ID NO: 417503 - DNA, 20 bp, Artificial Sequence
  chemically synthesized
acatcgttagaagacagtaa

SEQ ID NO: 417504 - DNA, 20 bp, Artificial Sequence
  chemically synthesized
cacatcgttagaagacagta

SEQ ID NO: 417505 - DNA, 20 bp, Artificial Sequence
  chemically synthesized
ggacacacatcgttagaaga

SEQ ID NO: 417506 - DNA, 20 bp, Artificial Sequence
  chemically synthesized
ttttggacacacatcgttag

SEQ ID NO: 417507 - DNA, 20 bp, Artificial Sequence
  chemically synthesized
ctgttttggacacacatcgt

SEQ ID NO: 417508 - DNA, 20 bp, Artificial Sequence
  chemically synthesized
ctaacgatgtgtgtccaaaa

SEQ ID NO: 417509 - DNA, 20 bp, Artificial Sequence
  chemically synthesized
ctcatgtataaatactgttt

SEQ ID NO: 417510 - DNA, 20 bp, Artificial Sequence
  chemically synthesized
ccaaaacagtatttatacat

SEQ ID NO: 417511 - DNA, 20 bp, Artificial Sequence
  chemically synthesized
aaaaaaaaaaaaaaaaaaaa

SEQ ID NO: 417512 - DNA, 20 bp, Artificial Sequence
  chemically synthesized
aaaaaaaaaaaaaaaaaaaa

SEQ ID NO: 417513 - DNA, 20 bp, Artificial Sequence
  chemically synthesized
tttttttttttttttttttt

SEQ ID NO: 417514 - DNA, 20 bp, Artificial Sequence
  chemically synthesized
ttttttttttttttttgaga

SEQ ID NO: 417515 - DNA, 20 bp, Artificial Sequence
  chemically synthesized
ttttttttttttttgagaca

SEQ ID NO: 417516 - DNA, 20 bp, Artificial Sequence
  chemically synthesized
ggctgggcgacagagtgagt

SEQ ID NO: 417517 - DNA, 20 bp, Artificial Sequence
  chemically synthesized
tccaggctgggcgacagagt

SEQ ID NO: 417518 - DNA, 20 bp, Artificial Sequence
  chemically synthesized
gtctcactcactctgtcgcc

SEQ ID NO: 417519 - DNA, 20 bp, Artificial Sequence
  chemically synthesized
gccctccaggctgggcgaca

SEQ ID NO: 417520 - DNA, 20 bp, Artificial Sequence
  chemically synthesized
ctgccctccaggctgggcga

SEQ ID NO: 417521 - DNA, 20 bp, Artificial Sequence
  chemically synthesized
actcactctgtcgcccagcc

SEQ ID NO: 417522 - DNA, 20 bp, Artificial Sequence
  chemically synthesized
tcactctgtcgcccagcctg

SEQ ID NO: 417523 - DNA, 20 bp, Artificial Sequence
  chemically synthesized
cactctgtcgcccagcctgg

SEQ ID NO: 417524 - DNA, 20 bp, Artificial Sequence
  chemically synthesized
acaccactgccctccaggct

SEQ ID NO: 417525 - DNA, 20 bp, Artificial Sequence
  chemically synthesized
actctgtcgcccagcctgga

SEQ ID NO: 417526 - DNA, 20 bp, Artificial Sequence
  chemically synthesized
cacaccactgccctccaggc

SEQ ID NO: 417527 - DNA, 20 bp, Artificial Sequence
  chemically synthesized
ctgtcgcccagcctggaggg

SEQ ID NO: 417528 - DNA, 20 bp, Artificial Sequence
  chemically synthesized
agatcacaccactgccctcc

SEQ ID NO: 417529 - DNA, 20 bp, Artificial Sequence
  chemically synthesized
cagatcacaccactgccctc

SEQ ID NO: 417530 - DNA, 20 bp, Artificial Sequence
  chemically synthesized
tcgcccagcctggagggcag

SEQ ID NO: 417531 - DNA, 20 bp, Artificial Sequence
  chemically synthesized
tggagggcagtggtgtgatc

SEQ ID NO: 417532 - DNA, 20 bp, Artificial Sequence
  chemically synthesized
ggagggcagtggtgtgatct

SEQ ID NO: 417533 - DNA, 20 bp, Artificial Sequence
  chemically synthesized
ggcagaggttgcagtgagcc

SEQ ID NO: 417534 - DNA, 20 bp, Artificial Sequence
  chemically synthesized
tgggaggcagaggttgcagt

SEQ ID NO: 417535 - DNA, 20 bp, Artificial Sequence
  chemically synthesized
agcctgggaggcagaggttg

SEQ ID NO: 417536 - DNA, 20 bp, Artificial Sequence
  chemically synthesized
tgcttgagcctgggaggcag

SEQ ID NO: 417537 - DNA, 20 bp, Artificial Sequence
  chemically synthesized
tcactgcaacctctgcctcc

SEQ ID NO: 417538 - DNA, 20 bp, Artificial Sequence
  chemically synthesized
ttgcttgagcctgggaggca

SEQ ID NO: 417539 - DNA, 20 bp, Artificial Sequence
  chemically synthesized
cactgcaacctctgcctccc

SEQ ID NO: 417540 - DNA, 20 bp, Artificial Sequence
  chemically synthesized
aattgcttgagcctgggagg

SEQ ID NO: 417541 - DNA, 20 bp, Artificial Sequence
  chemically synthesized
gagaattgcttgagcctggg

SEQ ID NO: 417542 - DNA, 20 bp, Artificial Sequence
  chemically synthesized
ggagaattgcttgagcctgg

SEQ ID NO: 417543 - DNA, 20 bp, Artificial Sequence
  chemically synthesized
aacctctgcctcccaggctc

SEQ ID NO: 417544 - DNA, 20 bp, Artificial Sequence
  chemically synthesized
caggagaattgcttgagcct

SEQ ID NO: 417545 - DNA, 20 bp, Artificial Sequence
  chemically synthesized
gcaggagaattgcttgagcc

SEQ ID NO: 417546 - DNA, 20 bp, Artificial Sequence
  chemically synthesized
ctgaggcaggagaattgctt

SEQ ID NO: 417547 - DNA, 20 bp, Artificial Sequence
  chemically synthesized
ctcaagcaattctcctgcct

SEQ ID NO: 417548 - DNA, 20 bp, Artificial Sequence
  chemically synthesized
tgcttgggaggctgaggcag

SEQ ID NO: 417549 - DNA, 20 bp, Artificial Sequence
  chemically synthesized
gctgcttgggaggctgaggc

SEQ ID NO: 417550 - DNA, 20 bp, Artificial Sequence
  chemically synthesized
agctgcttgggaggctgagg

SEQ ID NO: 417551 - DNA, 20 bp, Artificial Sequence
  chemically synthesized
ctcagctgcttgggaggctg

SEQ ID NO: 417552 - DNA, 20 bp, Artificial Sequence
  chemically synthesized
tctcagctgcttgggaggct

SEQ ID NO: 417553 - DNA, 20 bp, Artificial Sequence
  chemically synthesized
ttctcctgcctcagcctccc

SEQ ID NO: 417554 - DNA, 20 bp, Artificial Sequence
  chemically synthesized
tcctgcctcagcctcccaag

SEQ ID NO: 417555 - DNA, 20 bp, Artificial Sequence
  chemically synthesized
tgtaatctcagctgcttggg

SEQ ID NO: 417556 - DNA, 20 bp, Artificial Sequence
  chemically synthesized
ctgtaatctcagctgcttgg

SEQ ID NO: 417557 - DNA, 20 bp, Artificial Sequence
  chemically synthesized
gcctgtaatctcagctgctt

SEQ ID NO: 417558 - DNA, 20 bp, Artificial Sequence
  chemically synthesized
cctcagcctcccaagcagct

SEQ ID NO: 417559 - DNA, 20 bp, Artificial Sequence
  chemically synthesized
tgcctgtaatctcagctgct

SEQ ID NO: 417560 - DNA, 20 bp, Artificial Sequence
  chemically synthesized
ctcccaagcagctgagatta

SEQ ID NO: 417561 - DNA, 20 bp, Artificial Sequence
  chemically synthesized
tcccaagcagctgagattac

SEQ ID NO: 417562 - DNA, 20 bp, Artificial Sequence
  chemically synthesized
gtggccagtgcctgtaatct

SEQ ID NO: 417563 - DNA, 20 bp, Artificial Sequence
  chemically synthesized
gcagctgagattacaggcac

SEQ ID NO: 417564 - DNA, 20 bp, Artificial Sequence
  chemically synthesized
aattagccgggcgtggtggc

SEQ ID NO: 417565 - DNA, 20 bp, Artificial Sequence
  chemically synthesized
caggcactggccaccacgcc

SEQ ID NO: 417566 - DNA, 20 bp, Artificial Sequence
  chemically synthesized
caaaaattagccgggcgtgg

SEQ ID NO: 417567 - DNA, 20 bp, Artificial Sequence
  chemically synthesized
atacaaaaattagccgggcg

SEQ ID NO: 417568 - DNA, 20 bp, Artificial Sequence
  chemically synthesized
taaaaatacaaaaattagcc

SEQ ID NO: 417569 - DNA, 20 bp, Artificial Sequence
  chemically synthesized
ctaaaaatacaaaaattagc

SEQ ID NO: 417570 - DNA, 20 bp, Artificial Sequence
  chemically synthesized
tctactaaaaatacaaaaat

SEQ ID NO: 417571 - DNA, 20 bp, Artificial Sequence
  chemically synthesized
ccggctaatttttgtatttt

SEQ ID NO: 417572 - DNA, 20 bp, Artificial Sequence
  chemically synthesized
gctaatttttgtatttttag

SEQ ID NO: 417573 - DNA, 20 bp, Artificial Sequence
  chemically synthesized
taatttttgtatttttagta

SEQ ID NO: 417574 - DNA, 20 bp, Artificial Sequence
  chemically synthesized
ttttgtatttttagtagaga

SEQ ID NO: 417575 - DNA, 20 bp, Artificial Sequence
  chemically synthesized
tttgtatttttagtagagac

SEQ ID NO: 417576 - DNA, 20 bp, Artificial Sequence
  chemically synthesized
ttgtatttttagtagagacg

SEQ ID NO: 417577 - DNA, 20 bp, Artificial Sequence
  chemically synthesized
gagacggggtttcatcatgc

SEQ ID NO: 417578 - DNA, 20 bp, Artificial Sequence
  chemically synthesized
cggggtttcatcatgctggc

SEQ ID NO: 417579 - DNA, 20 bp, Artificial Sequence
  chemically synthesized
ggggtttcatcatgctggcc

SEQ ID NO: 417580 - DNA, 20 bp, Artificial Sequence
  chemically synthesized
tttcatcatgctggccaggc

SEQ ID NO: 417581 - DNA, 20 bp, Artificial Sequence
  chemically synthesized
gagtttgagaccagcctggc

SEQ ID NO: 417582 - DNA, 20 bp, Artificial Sequence
  chemically synthesized
tcaggagtttgagaccagcc

SEQ ID NO: 417583 - DNA, 20 bp, Artificial Sequence
  chemically synthesized
tgaggtcaggagtttgagac

SEQ ID NO: 417584 - DNA, 20 bp, Artificial Sequence
  chemically synthesized
ttacctgaggtcaggagttt

SEQ ID NO: 417585 - DNA, 20 bp, Artificial Sequence
  chemically synthesized
tggtctcaaactcctgacct

SEQ ID NO: 417586 - DNA, 20 bp, Artificial Sequence
  chemically synthesized
gatgaattacctgaggtcag

SEQ ID NO: 417587 - DNA, 20 bp, Artificial Sequence
  chemically synthesized
ggtctcaaactcctgacctc

SEQ ID NO: 417588 - DNA, 20 bp, Artificial Sequence
  chemically synthesized
gggatgaattacctgaggtc

SEQ ID NO: 417589 - DNA, 20 bp, Artificial Sequence
  chemically synthesized
ggggatgaattacctgaggt

SEQ ID NO: 417590 - DNA, 20 bp, Artificial Sequence
  chemically synthesized
ctgaggggatgaattacctg

SEQ ID NO: 417591 - DNA, 20 bp, Artificial Sequence
  chemically synthesized
gctgaggggatgaattacct

SEQ ID NO: 417592 - DNA, 20 bp, Artificial Sequence
  chemically synthesized
cctcaggtaattcatcccct

SEQ ID NO: 417593 - DNA, 20 bp, Artificial Sequence
  chemically synthesized
cagcactttgggaggctgag

SEQ ID NO: 417594 - DNA, 20 bp, Artificial Sequence
  chemically synthesized
ccagcactttgggaggctga

SEQ ID NO: 417595 - DNA, 20 bp, Artificial Sequence
  chemically synthesized
cccagcactttgggaggctg

SEQ ID NO: 417596 - DNA, 20 bp, Artificial Sequence
  chemically synthesized
tcccagcactttgggaggct

SEQ ID NO: 417597 - DNA, 20 bp, Artificial Sequence
  chemically synthesized
ttcatcccctcagcctccca

SEQ ID NO: 417598 - DNA, 20 bp, Artificial Sequence
  chemically synthesized
tgtaatcccagcactttggg

SEQ ID NO: 417599 - DNA, 20 bp, Artificial Sequence
  chemically synthesized
ctgtaatcccagcactttgg

SEQ ID NO: 417600 - DNA, 20 bp, Artificial Sequence
  chemically synthesized
ccctcagcctcccaaagtgc

SEQ ID NO: 417601 - DNA, 20 bp, Artificial Sequence
  chemically synthesized
acctgtaatcccagcacttt

SEQ ID NO: 417602 - DNA, 20 bp, Artificial Sequence
  chemically synthesized
cctcagcctcccaaagtgct

SEQ ID NO: 417603 - DNA, 20 bp, Artificial Sequence
  chemically synthesized
cacctgtaatcccagcactt

SEQ ID NO: 417604 - DNA, 20 bp, Artificial Sequence
  chemically synthesized
ctcccaaagtgctgggatta

SEQ ID NO: 417605 - DNA, 20 bp, Artificial Sequence
  chemically synthesized
tcccaaagtgctgggattac

SEQ ID NO: 417606 - DNA, 20 bp, Artificial Sequence
  chemically synthesized
gtggctcacacctgtaatcc

SEQ ID NO: 417607 - DNA, 20 bp, Artificial Sequence
  chemically synthesized
agtgctgggattacaggtgt

SEQ ID NO: 417608 - DNA, 20 bp, Artificial Sequence
  chemically synthesized
caggtgtgagccaccatgcc

SEQ ID NO: 417609 - DNA, 20 bp, Artificial Sequence
  chemically synthesized
actggtggggctgggcatgg

SEQ ID NO: 417610 - DNA, 20 bp, Artificial Sequence
  chemically synthesized
gttactggtggggctgggca

SEQ ID NO: 417611 - DNA, 20 bp, Artificial Sequence
  chemically synthesized
aaaatgttactggtggggct

SEQ ID NO: 417612 - DNA, 20 bp, Artificial Sequence
  chemically synthesized
gccaccatgcccagccccac

SEQ ID NO: 417613 - DNA, 20 bp, Artificial Sequence
  chemically synthesized
taaaatgttactggtggggc

SEQ ID NO: 417614 - DNA, 20 bp, Artificial Sequence
  chemically synthesized
cccttaaaatgttactggtg

SEQ ID NO: 417615 - DNA, 20 bp, Artificial Sequence
  chemically synthesized
gcccttaaaatgttactggt

SEQ ID NO: 417616 - DNA, 20 bp, Artificial Sequence
  chemically synthesized
agcccttaaaatgttactgg

SEQ ID NO: 417617 - DNA, 20 bp, Artificial Sequence
  chemically synthesized
ttgagcccttaaaatgttac

SEQ ID NO: 417618 - DNA, 20 bp, Artificial Sequence
  chemically synthesized
agccccaccagtaacatttt

SEQ ID NO: 417619 - DNA, 20 bp, Artificial Sequence
  chemically synthesized
gccccaccagtaacatttta

SEQ ID NO: 417620 - DNA, 20 bp, Artificial Sequence
  chemically synthesized
ccccaccagtaacattttaa

SEQ ID NO: 417621 - DNA, 20 bp, Artificial Sequence
  chemically synthesized
gtaacattttaagggctcaa

SEQ ID NO: 417622 - DNA, 20 bp, Artificial Sequence
  chemically synthesized
aatagccatatgtgactatt

SEQ ID NO: 417623 - DNA, 20 bp, Artificial Sequence
  chemically synthesized
aagggctcaatagtcacata

SEQ ID NO: 417624 - DNA, 20 bp, Artificial Sequence
  chemically synthesized
caatagtcacatatggctat

SEQ ID NO: 417625 - DNA, 20 bp, Artificial Sequence
  chemically synthesized
atgaccaatatagtagccaa

SEQ ID NO: 417626 - DNA, 20 bp, Artificial Sequence
  chemically synthesized
atggctattggctactatat

SEQ ID NO: 417627 - DNA, 20 bp, Artificial Sequence
  chemically synthesized
atctatcatgaccaatatag

SEQ ID NO: 417628 - DNA, 20 bp, Artificial Sequence
  chemically synthesized
tgtatctatcatgaccaata

SEQ ID NO: 417629 - DNA, 20 bp, Artificial Sequence
  chemically synthesized
ggctactatattggtcatga

SEQ ID NO: 417630 - DNA, 20 bp, Artificial Sequence
  chemically synthesized
tatattggtcatgatagata

SEQ ID NO: 417631 - DNA, 20 bp, Artificial Sequence
  chemically synthesized
gatacagaacatttctattg

SEQ ID NO: 417632 - DNA, 20 bp, Artificial Sequence
  chemically synthesized
cagaacatttctattgcaga

SEQ ID NO: 417633 - DNA, 20 bp, Artificial Sequence
  chemically synthesized
gctaatagaactttctgcaa

SEQ ID NO: 417634 - DNA, 20 bp, Artificial Sequence
  chemically synthesized
tctattgcagaaagttctat

SEQ ID NO: 417635 - DNA, 20 bp, Artificial Sequence
  chemically synthesized
tattgctcagatagtgctaa

SEQ ID NO: 417636 - DNA, 20 bp, Artificial Sequence
  chemically synthesized
aagttctattagcactatct

SEQ ID NO: 417637 - DNA, 20 bp, Artificial Sequence
  chemically synthesized
aaaaagttatattgctcaga

SEQ ID NO: 417638 - DNA, 20 bp, Artificial Sequence
  chemically synthesized
caataaaaagttatattgct

SEQ ID NO: 417639 - DNA, 20 bp, Artificial Sequence
  chemically synthesized
ttcctcttagtgacaataaa

SEQ ID NO: 417640 - DNA, 20 bp, Artificial Sequence
  chemically synthesized
tataactttttattgtcact

SEQ ID NO: 417641 - DNA, 20 bp, Artificial Sequence
  chemically synthesized
taactttttattgtcactaa

SEQ ID NO: 417642 - DNA, 20 bp, Artificial Sequence
  chemically synthesized
aactttttattgtcactaag

SEQ ID NO: 417643 - DNA, 20 bp, Artificial Sequence
  chemically synthesized
ataactaggtaagttcctct

SEQ ID NO: 417644 - DNA, 20 bp, Artificial Sequence
  chemically synthesized
gtcactaagaggaacttacc

SEQ ID NO: 417645 - DNA, 20 bp, Artificial Sequence
  chemically synthesized
accagagtaaataactaggt

SEQ ID NO: 417646 - DNA, 20 bp, Artificial Sequence
  chemically synthesized
gcagaccagagtaaataact

SEQ ID NO: 417647 - DNA, 20 bp, Artificial Sequence
  chemically synthesized
agcagaccagagtaaataac

SEQ ID NO: 417648 - DNA, 20 bp, Artificial Sequence
  chemically synthesized
acttacctagttatttactc

SEQ ID NO: 417649 - DNA, 20 bp, Artificial Sequence
  chemically synthesized
aaaatcatactagcagacca

SEQ ID NO: 417650 - DNA, 20 bp, Artificial Sequence
  chemically synthesized
agttatttactctggtctgc

SEQ ID NO: 417651 - DNA, 20 bp, Artificial Sequence
  chemically synthesized
gtaaaatcatactagcagac

SEQ ID NO: 417652 - DNA, 20 bp, Artificial Sequence
  chemically synthesized
tacaggtaaaatcatactag

SEQ ID NO: 417653 - DNA, 20 bp, Artificial Sequence
  chemically synthesized
atttacaggtaaaatcatac

SEQ ID NO: 417654 - DNA, 20 bp, Artificial Sequence
  chemically synthesized
atatgctgtattatatttac

SEQ ID NO: 417655 - DNA, 20 bp, Artificial Sequence
  chemically synthesized
aatatgctgtattatattta

SEQ ID NO: 417656 - DNA, 20 bp, Artificial Sequence
  chemically synthesized
ttttacctgtaaatataata

SEQ ID NO: 417657 - DNA, 20 bp, Artificial Sequence
  chemically synthesized
taaatataatacagcatatt

SEQ ID NO: 417658 - DNA, 20 bp, Artificial Sequence
  chemically synthesized
aaagattcaattatgtgttg

SEQ ID NO: 417659 - DNA, 20 bp, Artificial Sequence
  chemically synthesized
acacataattgaatctttcc

SEQ ID NO: 417660 - DNA, 20 bp, Artificial Sequence
  chemically synthesized
ataattgaatctttcccaga

SEQ ID NO: 417661 - DNA, 20 bp, Artificial Sequence
  chemically synthesized
atattctgtcctatctggga

SEQ ID NO: 417662 - DNA, 20 bp, Artificial Sequence
  chemically synthesized
taattgaatctttcccagat

SEQ ID NO: 417663 - DNA, 20 bp, Artificial Sequence
  chemically synthesized
acatatattctgtcctatct

SEQ ID NO: 417664 - DNA, 20 bp, Artificial Sequence
  chemically synthesized
tgaatctttcccagatagga

SEQ ID NO: 417665 - DNA, 20 bp, Artificial Sequence
  chemically synthesized
tacatatattctgtcctatc

SEQ ID NO: 417666 - DNA, 20 bp, Artificial Sequence
  chemically synthesized
atatatgtatttgttctgtt

SEQ ID NO: 417667 - DNA, 20 bp, Artificial Sequence
  chemically synthesized
atgtatttgttctgttcaga

SEQ ID NO: 417668 - DNA, 20 bp, Artificial Sequence
  chemically synthesized
ctgggatgaatctttctgaa

SEQ ID NO: 417669 - DNA, 20 bp, Artificial Sequence
  chemically synthesized
ctgttcagaaagattcatcc

SEQ ID NO: 417670 - DNA, 20 bp, Artificial Sequence
  chemically synthesized
cagaaagattcatcccagtt

SEQ ID NO: 417671 - DNA, 20 bp, Artificial Sequence
  chemically synthesized
aaagattcatcccagtttag

SEQ ID NO: 417672 - DNA, 20 bp, Artificial Sequence
  chemically synthesized
gttttctcttccgctaaact

SEQ ID NO: 417673 - DNA, 20 bp, Artificial Sequence
  chemically synthesized
cgttttctcttccgctaaac

SEQ ID NO: 417674 - DNA, 20 bp, Artificial Sequence
  chemically synthesized
gattcatcccagtttagcgg

SEQ ID NO: 417675 - DNA, 20 bp, Artificial Sequence
  chemically synthesized
ttcatcccagtttagcggaa

SEQ ID NO: 417676 - DNA, 20 bp, Artificial Sequence
  chemically synthesized
gtttagcggaagagaaaacg

SEQ ID NO: 417677 - DNA, 20 bp, Artificial Sequence
  chemically synthesized
aaaagctattataggtgttg

SEQ ID NO: 417678 - DNA, 20 bp, Artificial Sequence
  chemically synthesized
aaaaagctattataggtgtt

SEQ ID NO: 417679 - DNA, 20 bp, Artificial Sequence
  chemically synthesized
cgaagcctcaacacctataa

SEQ ID NO: 417680 - DNA, 20 bp, Artificial Sequence
  chemically synthesized
gatatttaaaaagctattat

SEQ ID NO: 417681 - DNA, 20 bp, Artificial Sequence
  chemically synthesized
tgatatttaaaaagctatta

SEQ ID NO: 417682 - DNA, 20 bp, Artificial Sequence
  chemically synthesized
ccagttttgtgatatttaaa

SEQ ID NO: 417683 - DNA, 20 bp, Artificial Sequence
  chemically synthesized
ctttttaaatatcacaaaac

SEQ ID NO: 417684 - DNA, 20 bp, Artificial Sequence
  chemically synthesized
attctttgatagataagcac

SEQ ID NO: 417685 - DNA, 20 bp, Artificial Sequence
  chemically synthesized
gtcagtattctttgatagat

SEQ ID NO: 417686 - DNA, 20 bp, Artificial Sequence
  chemically synthesized
aaactggtgcttatctatca

SEQ ID NO: 417687 - DNA, 20 bp, Artificial Sequence
  chemically synthesized
gcattgtcagtattctttga

SEQ ID NO: 417688 - DNA, 20 bp, Artificial Sequence
  chemically synthesized
aacaattttaatggcattgt

SEQ ID NO: 417689 - DNA, 20 bp, Artificial Sequence
  chemically synthesized
gcagagaacaacaattttaa

SEQ ID NO: 417690 - DNA, 20 bp, Artificial Sequence
  chemically synthesized
gtatatttatatacagcgca

SEQ ID NO: 417691 - DNA, 20 bp, Artificial Sequence
  chemically synthesized
cagtatatttatatacagcg

SEQ ID NO: 417692 - DNA, 20 bp, Artificial Sequence
  chemically synthesized
ttattcagtatatttatata

SEQ ID NO: 417693 - DNA, 20 bp, Artificial Sequence
  chemically synthesized
ccatattaaccaatattatt

SEQ ID NO: 417694 - DNA, 20 bp, Artificial Sequence
  chemically synthesized
ataaatatactgaataatat

SEQ ID NO: 417695 - DNA, 20 bp, Artificial Sequence
  chemically synthesized
ctgaataatattggttaata

SEQ ID NO: 417696 - DNA, 20 bp, Artificial Sequence
  chemically synthesized
tgaataatattggttaatat

SEQ ID NO: 417697 - DNA, 20 bp, Artificial Sequence
  chemically synthesized
ttggttaatatgggtatgcc

SEQ ID NO: 417698 - DNA, 20 bp, Artificial Sequence
  chemically synthesized
tggttaatatgggtatgcct

SEQ ID NO: 417699 - DNA, 20 bp, Artificial Sequence
  chemically synthesized
gttaatatgggtatgcctag

SEQ ID NO: 417700 - DNA, 20 bp, Artificial Sequence
  chemically synthesized
atatgggtatgcctaggagc

SEQ ID NO: 417701 - DNA, 20 bp, Artificial Sequence
  chemically synthesized
aaagttagcaacttgctcct

SEQ ID NO: 417702 - DNA, 20 bp, Artificial Sequence
  chemically synthesized
gaaagttagcaacttgctcc

SEQ ID NO: 417703 - DNA, 20 bp, Artificial Sequence
  chemically synthesized
aactataattcaaagaaagt

SEQ ID NO: 417704 - DNA, 20 bp, Artificial Sequence
  chemically synthesized
gagaaactataattcaaaga

SEQ ID NO: 417705 - DNA, 20 bp, Artificial Sequence
  chemically synthesized
tgctaactttctttgaatta

SEQ ID NO: 417706 - DNA, 20 bp, Artificial Sequence
  chemically synthesized
ccatgagaaactataattca

SEQ ID NO: 417707 - DNA, 20 bp, Artificial Sequence
  chemically synthesized
ctttgaattatagtttctca

SEQ ID NO: 417708 - DNA, 20 bp, Artificial Sequence
  chemically synthesized
gcagaattggtttacaccat

SEQ ID NO: 417709 - DNA, 20 bp, Artificial Sequence
  chemically synthesized
cagacccattcaagcagaat

SEQ ID NO: 417710 - DNA, 20 bp, Artificial Sequence
  chemically synthesized
gtaaaccaattctgcttgaa

SEQ ID NO: 417711 - DNA, 20 bp, Artificial Sequence
  chemically synthesized
taaaccaattctgcttgaat

SEQ ID NO: 417712 - DNA, 20 bp, Artificial Sequence
  chemically synthesized
tgacagcagacccattcaag

SEQ ID NO: 417713 - DNA, 20 bp, Artificial Sequence
  chemically synthesized
caatgacagcagacccattc

SEQ ID NO: 417714 - DNA, 20 bp, Artificial Sequence
  chemically synthesized
ttgaatgggtctgctgtcat

SEQ ID NO: 417715 - DNA, 20 bp, Artificial Sequence
  chemically synthesized
tataccacatccaatgacag

SEQ ID NO: 417716 - DNA, 20 bp, Artificial Sequence
  chemically synthesized
ttttataccacatccaatga

SEQ ID NO: 417717 - DNA, 20 bp, Artificial Sequence
  chemically synthesized
gggtctgctgtcattggatg

SEQ ID NO: 417718 - DNA, 20 bp, Artificial Sequence
  chemically synthesized
ggatgtggtataaaaattgt

SEQ ID NO: 417719 - DNA, 20 bp, Artificial Sequence
  chemically synthesized
gatgtggtataaaaattgtg

SEQ ID NO: 417720 - DNA, 20 bp, Artificial Sequence
  chemically synthesized
tgtggtataaaaattgtgag

SEQ ID NO: 417721 - DNA, 20 bp, Artificial Sequence
  chemically synthesized
tataaaaattgtgaggagct

SEQ ID NO: 417722 - DNA, 20 bp, Artificial Sequence
  chemically synthesized
ccctaggttatggttatgct

SEQ ID NO: 417723 - DNA, 20 bp, Artificial Sequence
  chemically synthesized
agcttagcataaccataacc

SEQ ID NO: 417724 - DNA, 20 bp, Artificial Sequence
  chemically synthesized
gcttagcataaccataacct

SEQ ID NO: 417725 - DNA, 20 bp, Artificial Sequence
  chemically synthesized
cttagcataaccataaccta

SEQ ID NO: 417726 - DNA, 20 bp, Artificial Sequence
  chemically synthesized
cttgggtttgccctaggtta

SEQ ID NO: 417727 - DNA, 20 bp, Artificial Sequence
  chemically synthesized
gaagggcttgggtttgccct

SEQ ID NO: 417728 - DNA, 20 bp, Artificial Sequence
  chemically synthesized
agaagggcttgggtttgccc

SEQ ID NO: 417729 - DNA, 20 bp, Artificial Sequence
  chemically synthesized
ccataacctagggcaaaccc

SEQ ID NO: 417730 - DNA, 20 bp, Artificial Sequence
  chemically synthesized
gctacttaagagaagggctt

SEQ ID NO: 417731 - DNA, 20 bp, Artificial Sequence
  chemically synthesized
tgctacttaagagaagggct

SEQ ID NO: 417732 - DNA, 20 bp, Artificial Sequence
  chemically synthesized
caaacccaagcccttctctt

SEQ ID NO: 417733 - DNA, 20 bp, Artificial Sequence
  chemically synthesized
tgccgtgctacttaagagaa

SEQ ID NO: 417734 - DNA, 20 bp, Artificial Sequence
  chemically synthesized
gtgccgtgctacttaagaga

SEQ ID NO: 417735 - DNA, 20 bp, Artificial Sequence
  chemically synthesized
agtgccgtgctacttaagag

SEQ ID NO: 417736 - DNA, 20 bp, Artificial Sequence
  chemically synthesized
acccaagcccttctcttaag

SEQ ID NO: 417737 - DNA, 20 bp, Artificial Sequence
  chemically synthesized
tttagtgccgtgctacttaa

SEQ ID NO: 417738 - DNA, 20 bp, Artificial Sequence
  chemically synthesized
tctttagtgccgtgctactt

SEQ ID NO: 417739 - DNA, 20 bp, Artificial Sequence
  chemically synthesized
agcccttctcttaagtagca

SEQ ID NO: 417740 - DNA, 20 bp, Artificial Sequence
  chemically synthesized
tcttaagtagcacggcacta

SEQ ID NO: 417741 - DNA, 20 bp, Artificial Sequence
  chemically synthesized
gcactcaagttataagtctt

SEQ ID NO: 417742 - DNA, 20 bp, Artificial Sequence
  chemically synthesized
gcactaaagacttataactt

SEQ ID NO: 417743 - DNA, 20 bp, Artificial Sequence
  chemically synthesized
ttgaaaagcactcaagttat

SEQ ID NO: 417744 - DNA, 20 bp, Artificial Sequence
  chemically synthesized
cacacctttgaaaagcactc

SEQ ID NO: 417745 - DNA, 20 bp, Artificial Sequence
  chemically synthesized
tataacttgagtgcttttca

SEQ ID NO: 417746 - DNA, 20 bp, Artificial Sequence
  chemically synthesized
ataacttgagtgcttttcaa

SEQ ID NO: 417747 - DNA, 20 bp, Artificial Sequence
  chemically synthesized
agcctccacacacctttgaa

SEQ ID NO: 417748 - DNA, 20 bp, Artificial Sequence
  chemically synthesized
gagtgcttttcaaaggtgtg

SEQ ID NO: 417749 - DNA, 20 bp, Artificial Sequence
  chemically synthesized
gtgcttttcaaaggtgtgtg

SEQ ID NO: 417750 - DNA, 20 bp, Artificial Sequence
  chemically synthesized
tgcttttcaaaggtgtgtgg

SEQ ID NO: 417751 - DNA, 20 bp, Artificial Sequence
  chemically synthesized
aaggagcagtaaagaggata

SEQ ID NO: 417752 - DNA, 20 bp, Artificial Sequence
  chemically synthesized
acagggaaggagcagtaaag

SEQ ID NO: 417753 - DNA, 20 bp, Artificial Sequence
  chemically synthesized
cacagggaaggagcagtaaa

SEQ ID NO: 417754 - DNA, 20 bp, Artificial Sequence
  chemically synthesized
aacacagggaaggagcagta

SEQ ID NO: 417755 - DNA, 20 bp, Artificial Sequence
  chemically synthesized
catataacacagggaaggag

SEQ ID NO: 417756 - DNA, 20 bp, Artificial Sequence
  chemically synthesized
ttacatataacacagggaag

SEQ ID NO: 417757 - DNA, 20 bp, Artificial Sequence
  chemically synthesized
gtttacatataacacaggga

SEQ ID NO: 417758 - DNA, 20 bp, Artificial Sequence
  chemically synthesized
tgtttacatataacacaggg

SEQ ID NO: 417759 - DNA, 20 bp, Artificial Sequence
  chemically synthesized
cattgtttacatataacaca

SEQ ID NO: 417760 - DNA, 20 bp, Artificial Sequence
  chemically synthesized
acattgtttacatataacac

SEQ ID NO: 417761 - DNA, 20 bp, Artificial Sequence
  chemically synthesized
aacattgtttacatataaca

SEQ ID NO: 417762 - DNA, 20 bp, Artificial Sequence
  chemically synthesized
atatgtaaacaatgtttatt

SEQ ID NO: 417763 - DNA, 20 bp, Artificial Sequence
  chemically synthesized
aaacaatgtttatttagaaa

SEQ ID NO: 417764 - DNA, 20 bp, Artificial Sequence
  chemically synthesized
gaaacagaatgcttgttccc

SEQ ID NO: 417765 - DNA, 20 bp, Artificial Sequence
  chemically synthesized
tctttgcagcaccagggaac

SEQ ID NO: 417766 - DNA, 20 bp, Artificial Sequence
  chemically synthesized
gctgtttctttgcagcacca

SEQ ID NO: 417767 - DNA, 20 bp, Artificial Sequence
  chemically synthesized
tgctgtttctttgcagcacc

SEQ ID NO: 417768 - DNA, 20 bp, Artificial Sequence
  chemically synthesized
gtgctgtttctttgcagcac

SEQ ID NO: 417769 - DNA, 20 bp, Artificial Sequence
  chemically synthesized
gcttgttccctggtgctgca

SEQ ID NO: 417770 - DNA, 20 bp, Artificial Sequence
  chemically synthesized
gttcgagtgctgtttctttg

SEQ ID NO: 417771 - DNA, 20 bp, Artificial Sequence
  chemically synthesized
tccctggtgctgcaaagaaa

SEQ ID NO: 417772 - DNA, 20 bp, Artificial Sequence
  chemically synthesized
agagagttaaatttatgttc

SEQ ID NO: 417773 - DNA, 20 bp, Artificial Sequence
  chemically synthesized
gaacataaatttaactctct

SEQ ID NO: 417774 - DNA, 20 bp, Artificial Sequence
  chemically synthesized
ataaatttaactctctcagc

SEQ ID NO: 417775 - DNA, 20 bp, Artificial Sequence
  chemically synthesized
taaaaatgaccttgctgaga

SEQ ID NO: 417776 - DNA, 20 bp, Artificial Sequence
  chemically synthesized
taaatttaactctctcagca

SEQ ID NO: 417777 - DNA, 20 bp, Artificial Sequence
  chemically synthesized
agtaaaaatgaccttgctga

SEQ ID NO: 417778 - DNA, 20 bp, Artificial Sequence
  chemically synthesized
aaagtaaaaatgaccttgct

SEQ ID NO: 417779 - DNA, 20 bp, Artificial Sequence
  chemically synthesized
aaggtcatttttactttttg

SEQ ID NO: 417780 - DNA, 20 bp, Artificial Sequence
  chemically synthesized
gagtgtaccctttctgcaaa

SEQ ID NO: 417781 - DNA, 20 bp, Artificial Sequence
  chemically synthesized
tcatttttactttttgcaga

SEQ ID NO: 417782 - DNA, 20 bp, Artificial Sequence
  chemically synthesized
catttttactttttgcagaa

SEQ ID NO: 417783 - DNA, 20 bp, Artificial Sequence
  chemically synthesized
atttttactttttgcagaaa

SEQ ID NO: 417784 - DNA, 20 bp, Artificial Sequence
  chemically synthesized
tgcagaaagggtacactcgc

SEQ ID NO: 417785 - DNA, 20 bp, Artificial Sequence
  chemically synthesized
agaaagggtacactcgccag

SEQ ID NO: 417786 - DNA, 20 bp, Artificial Sequence
  chemically synthesized
ctcgtggcaaaactgctggc

SEQ ID NO: 417787 - DNA, 20 bp, Artificial Sequence
  chemically synthesized
tactctcgtggcaaaactgc

SEQ ID NO: 417788 - DNA, 20 bp, Artificial Sequence
  chemically synthesized
ctcgccagcagttttgccac

SEQ ID NO: 417789 - DNA, 20 bp, Artificial Sequence
  chemically synthesized
cgccagcagttttgccacga

SEQ ID NO: 417790 - DNA, 20 bp, Artificial Sequence
  chemically synthesized
ctttgttcggtgtactctcg

SEQ ID NO: 417791 - DNA, 20 bp, Artificial Sequence
  chemically synthesized
ccacgagagtacaccgaaca

SEQ ID NO: 417792 - DNA, 20 bp, Artificial Sequence
  chemically synthesized
cacgagagtacaccgaacaa

SEQ ID NO: 417793 - DNA, 20 bp, Artificial Sequence
  chemically synthesized
cgagagtacaccgaacaaag

SEQ ID NO: 417794 - DNA, 20 bp, Artificial Sequence
  chemically synthesized
atgaccctgtctcctttgtt

SEQ ID NO: 417795 - DNA, 20 bp, Artificial Sequence
  chemically synthesized
agtacaccgaacaaaggaga

SEQ ID NO: 417796 - DNA, 20 bp, Artificial Sequence
  chemically synthesized
gtacaccgaacaaaggagac

SEQ ID NO: 417797 - DNA, 20 bp, Artificial Sequence
  chemically synthesized
tacaccgaacaaaggagaca

SEQ ID NO: 417798 - DNA, 20 bp, Artificial Sequence
  chemically synthesized
agcagtagagtaaacatgtc

SEQ ID NO: 417799 - DNA, 20 bp, Artificial Sequence
  chemically synthesized
cagcagtagagtaaacatgt

SEQ ID NO: 417800 - DNA, 20 bp, Artificial Sequence
  chemically synthesized
ggaaaccggacacagcagta

SEQ ID NO: 417801 - DNA, 20 bp, Artificial Sequence
  chemically synthesized
atggaaaccggacacagcag

SEQ ID NO: 417802 - DNA, 20 bp, Artificial Sequence
  chemically synthesized
gtttactctactgctgtgtc

SEQ ID NO: 417803 - DNA, 20 bp, Artificial Sequence
  chemically synthesized
ccaatggaaaccggacacag

SEQ ID NO: 417804 - DNA, 20 bp, Artificial Sequence
  chemically synthesized
cagccaatggaaaccggaca

SEQ ID NO: 417805 - DNA, 20 bp, Artificial Sequence
  chemically synthesized
ctgttccagccaatggaaac

SEQ ID NO: 417806 - DNA, 20 bp, Artificial Sequence
  chemically synthesized
ctgctgtgtccggtttccat

SEQ ID NO: 417807 - DNA, 20 bp, Artificial Sequence
  chemically synthesized
tgtgtccggtttccattggc

SEQ ID NO: 417808 - DNA, 20 bp, Artificial Sequence
  chemically synthesized
tgtggtcctgttccagccaa

SEQ ID NO: 417809 - DNA, 20 bp, Artificial Sequence
  chemically synthesized
ccggtttccattggctggaa

SEQ ID NO: 417810 - DNA, 20 bp, Artificial Sequence
  chemically synthesized
cggtttccattggctggaac

SEQ ID NO: 417811 - DNA, 20 bp, Artificial Sequence
  chemically synthesized
cagaatgtgtggtcctgttc

SEQ ID NO: 417812 - DNA, 20 bp, Artificial Sequence
  chemically synthesized
cgggacaaatacagaatgtg

SEQ ID NO: 417813 - DNA, 20 bp, Artificial Sequence
  chemically synthesized
ctagccaatcgggacaaata

SEQ ID NO: 417814 - DNA, 20 bp, Artificial Sequence
  chemically synthesized
cattctgtatttgtcccgat

SEQ ID NO: 417815 - DNA, 20 bp, Artificial Sequence
  chemically synthesized
ctgtatttgtcccgattggc

SEQ ID NO: 417816 - DNA, 20 bp, Artificial Sequence
  chemically synthesized
ttctaagttgctagccaatc

SEQ ID NO: 417817 - DNA, 20 bp, Artificial Sequence
  chemically synthesized
gttctaagttgctagccaat

SEQ ID NO: 417818 - DNA, 20 bp, Artificial Sequence
  chemically synthesized
gtcccgattggctagcaact

SEQ ID NO: 417819 - DNA, 20 bp, Artificial Sequence
  chemically synthesized
tttgaaaagttctaagttgc

SEQ ID NO: 417820 - DNA, 20 bp, Artificial Sequence
  chemically synthesized
tgtctcttttgaaaagttct

SEQ ID NO: 417821 - DNA, 20 bp, Artificial Sequence
  chemically synthesized
agcaacttagaacttttcaa

SEQ ID NO: 417822 - DNA, 20 bp, Artificial Sequence
  chemically synthesized
caacttagaacttttcaaaa

SEQ ID NO: 417823 - DNA, 20 bp, Artificial Sequence
  chemically synthesized
ctgcctttgtctcttttgaa

SEQ ID NO: 417824 - DNA, 20 bp, Artificial Sequence
  chemically synthesized
agaacttttcaaaagagaca

SEQ ID NO: 417825 - DNA, 20 bp, Artificial Sequence
  chemically synthesized
gaacttttcaaaagagacaa

SEQ ID NO: 417826 - DNA, 20 bp, Artificial Sequence
  chemically synthesized
cttttcaaaagagacaaagg

SEQ ID NO: 417827 - DNA, 20 bp, Artificial Sequence
  chemically synthesized
tttcaaaagagacaaaggca

SEQ ID NO: 417828 - DNA, 20 bp, Artificial Sequence
  chemically synthesized
ttcaaaagagacaaaggcag

SEQ ID NO: 417829 - DNA, 20 bp, Artificial Sequence
  chemically synthesized
caaaagagacaaaggcagag

SEQ ID NO: 417830 - DNA, 20 bp, Artificial Sequence
  chemically synthesized
gacaaaggcagaggagaaca

SEQ ID NO: 417831 - DNA, 20 bp, Artificial Sequence
  chemically synthesized
acaaaggcagaggagaacaa

SEQ ID NO: 417832 - DNA, 20 bp, Artificial Sequence
  chemically synthesized
aaggcagaggagaacaaagg

SEQ ID NO: 417833 - DNA, 20 bp, Artificial Sequence
  chemically synthesized
aggcagaggagaacaaagga

SEQ ID NO: 417834 - DNA, 20 bp, Artificial Sequence
  chemically synthesized
gcagaggagaacaaaggaag

SEQ ID NO: 417835 - DNA, 20 bp, Artificial Sequence
  chemically synthesized
cagaggagaacaaaggaagg

SEQ ID NO: 417836 - DNA, 20 bp, Artificial Sequence
  chemically synthesized
aggagaacaaaggaaggagg

SEQ ID NO: 417837 - DNA, 20 bp, Artificial Sequence
  chemically synthesized
agcaagtaacttgtggaaac

SEQ ID NO: 417838 - DNA, 20 bp, Artificial Sequence
  chemically synthesized
aggaagtaacttgtttccac

SEQ ID NO: 417839 - DNA, 20 bp, Artificial Sequence
  chemically synthesized
ctttctcagcaagtaacttg

SEQ ID NO: 417840 - DNA, 20 bp, Artificial Sequence
  chemically synthesized
gtttccacaagttacttgct

SEQ ID NO: 417841 - DNA, 20 bp, Artificial Sequence
  chemically synthesized
ccacaagttacttgctgaga

SEQ ID NO: 417842 - DNA, 20 bp, Artificial Sequence
  chemically synthesized
gtgtttttacctttctcagc

SEQ ID NO: 417843 - DNA, 20 bp, Artificial Sequence
  chemically synthesized
cacaagttacttgctgagaa

SEQ ID NO: 417844 - DNA, 20 bp, Artificial Sequence
  chemically synthesized
gaaggtgtttttacctttct

SEQ ID NO: 417845 - DNA, 20 bp, Artificial Sequence
  chemically synthesized
aggtaaaaacaccttcaaat

SEQ ID NO: 417846 - DNA, 20 bp, Artificial Sequence
  chemically synthesized
ggtaaaaacaccttcaaata

SEQ ID NO: 417847 - DNA, 20 bp, Artificial Sequence
  chemically synthesized
tgttcctcttccttatttga

SEQ ID NO: 417848 - DNA, 20 bp, Artificial Sequence
  chemically synthesized
ctgttcctcttccttatttg

SEQ ID NO: 417849 - DNA, 20 bp, Artificial Sequence
  chemically synthesized
aaaaacaccttcaaataagg

SEQ ID NO: 417850 - DNA, 20 bp, Artificial Sequence
  chemically synthesized
aaacaccttcaaataaggaa

SEQ ID NO: 417851 - DNA, 20 bp, Artificial Sequence
  chemically synthesized
aacaccttcaaataaggaag

SEQ ID NO: 417852 - DNA, 20 bp, Artificial Sequence
  chemically synthesized
cttcaaataaggaagaggaa

SEQ ID NO: 417853 - DNA, 20 bp, Artificial Sequence
  chemically synthesized
ttcaaataaggaagaggaac

SEQ ID NO: 417854 - DNA, 20 bp, Artificial Sequence
  chemically synthesized
tccaagcacgcattaggtca

SEQ ID NO: 417855 - DNA, 20 bp, Artificial Sequence
  chemically synthesized
tactggtccaagcacgcatt

SEQ ID NO: 417856 - DNA, 20 bp, Artificial Sequence
  chemically synthesized
atactggtccaagcacgcat

SEQ ID NO: 417857 - DNA, 20 bp, Artificial Sequence
  chemically synthesized
gctatgacctaatgcgtgct

SEQ ID NO: 417858 - DNA, 20 bp, Artificial Sequence
  chemically synthesized
gacctaatgcgtgcttggac

SEQ ID NO: 417859 - DNA, 20 bp, Artificial Sequence
  chemically synthesized
tggcatgcttatactggtcc

SEQ ID NO: 417860 - DNA, 20 bp, Artificial Sequence
  chemically synthesized
atgcgtgcttggaccagtat

SEQ ID NO: 417861 - DNA, 20 bp, Artificial Sequence
  chemically synthesized
ttgccctggcatgcttatac

SEQ ID NO: 417862 - DNA, 20 bp, Artificial Sequence
  chemically synthesized
ttggaccagtataagcatgc

SEQ ID NO: 417863 - DNA, 20 bp, Artificial Sequence
  chemically synthesized
tggaccagtataagcatgcc

SEQ ID NO: 417864 - DNA, 20 bp, Artificial Sequence
  chemically synthesized
ggaccagtataagcatgcca

SEQ ID NO: 417865 - DNA, 20 bp, Artificial Sequence
  chemically synthesized
tttagcctaaatatttgccc

SEQ ID NO: 417866 - DNA, 20 bp, Artificial Sequence
  chemically synthesized
agcatgccagggcaaatatt

SEQ ID NO: 417867 - DNA, 20 bp, Artificial Sequence
  chemically synthesized
gcatgccagggcaaatattt

SEQ ID NO: 417868 - DNA, 20 bp, Artificial Sequence
  chemically synthesized
caaatatttaggctaaattg

SEQ ID NO: 417869 - DNA, 20 bp, Artificial Sequence
  chemically synthesized
aaatatttaggctaaattgt

SEQ ID NO: 417870 - DNA, 20 bp, Artificial Sequence
  chemically synthesized
tgttcttagttcccacaatt

SEQ ID NO: 417871 - DNA, 20 bp, Artificial Sequence
  chemically synthesized
taggctaaattgtgggaact

SEQ ID NO: 417872 - DNA, 20 bp, Artificial Sequence
  chemically synthesized
atcaatgtactttatgttct

SEQ ID NO: 417873 - DNA, 20 bp, Artificial Sequence
  chemically synthesized
ttgtgggaactaagaacata

SEQ ID NO: 417874 - DNA, 20 bp, Artificial Sequence
  chemically synthesized
gtacattgatttctttatta

SEQ ID NO: 417875 - DNA, 20 bp, Artificial Sequence
  chemically synthesized
aatatctactagccgtaata

SEQ ID NO: 417876 - DNA, 20 bp, Artificial Sequence
  chemically synthesized
attgatttctttattacggc

SEQ ID NO: 417877 - DNA, 20 bp, Artificial Sequence
  chemically synthesized
gatttctttattacggctag

SEQ ID NO: 417878 - DNA, 20 bp, Artificial Sequence
  chemically synthesized
taacattcttaaatatctac

SEQ ID NO: 417879 - DNA, 20 bp, Artificial Sequence
  chemically synthesized
attacggctagtagatattt

SEQ ID NO: 417880 - DNA, 20 bp, Artificial Sequence
  chemically synthesized
tagtagatatttaagaatgt

SEQ ID NO: 417881 - DNA, 20 bp, Artificial Sequence
  chemically synthesized
gatatttaagaatgttagca

SEQ ID NO: 417882 - DNA, 20 bp, Artificial Sequence
  chemically synthesized
atatttaagaatgttagcac

SEQ ID NO: 417883 - DNA, 20 bp, Artificial Sequence
  chemically synthesized
cgtttaataaattttgcttc

SEQ ID NO: 417884 - DNA, 20 bp, Artificial Sequence
  chemically synthesized
gtttaataaattttgcttct

SEQ ID NO: 417885 - DNA, 20 bp, Artificial Sequence
  chemically synthesized
ttaataaattttgcttctag

SEQ ID NO: 417886 - DNA, 20 bp, Artificial Sequence
  chemically synthesized
taaatagtaacgtctcctag

SEQ ID NO: 417887 - DNA, 20 bp, Artificial Sequence
  chemically synthesized
gaataaatagtaacgtctcc

SEQ ID NO: 417888 - DNA, 20 bp, Artificial Sequence
  chemically synthesized
cccatctaaatgggaataaa

SEQ ID NO: 417889 - DNA, 20 bp, Artificial Sequence
  chemically synthesized
cgttactatttattcccatt

SEQ ID NO: 417890 - DNA, 20 bp, Artificial Sequence
  chemically synthesized
actatttattcccatttaga

SEQ ID NO: 417891 - DNA, 20 bp, Artificial Sequence
  chemically synthesized
actttcctacccatctaaat

SEQ ID NO: 417892 - DNA, 20 bp, Artificial Sequence
  chemically synthesized
ctatttattcccatttagat

SEQ ID NO: 417893 - DNA, 20 bp, Artificial Sequence
  chemically synthesized
aactttcctacccatctaaa

SEQ ID NO: 417894 - DNA, 20 bp, Artificial Sequence
  chemically synthesized
tttattcccatttagatggg

SEQ ID NO: 417895 - DNA, 20 bp, Artificial Sequence
  chemically synthesized
ttattcccatttagatgggt

SEQ ID NO: 417896 - DNA, 20 bp, Artificial Sequence
  chemically synthesized
tcccatttagatgggtagga

SEQ ID NO: 417897 - DNA, 20 bp, Artificial Sequence
  chemically synthesized
gatgggtaggaaagtttctt

SEQ ID NO: 417898 - DNA, 20 bp, Artificial Sequence
  chemically synthesized
tgggtaggaaagtttctttg

SEQ ID NO: 417899 - DNA, 20 bp, Artificial Sequence
  chemically synthesized
ggtaggaaagtttctttgga

SEQ ID NO: 417900 - DNA, 20 bp, Artificial Sequence
  chemically synthesized
aaagtagaggtttctctcca

SEQ ID NO: 417901 - DNA, 20 bp, Artificial Sequence
  chemically synthesized
cttgcaggtgtaaaaagtag

SEQ ID NO: 417902 - DNA, 20 bp, Artificial Sequence
  chemically synthesized
tcttgcaggtgtaaaaagta

SEQ ID NO: 417903 - DNA, 20 bp, Artificial Sequence
  chemically synthesized
gctcttgcaggtgtaaaaag

SEQ ID NO: 417904 - DNA, 20 bp, Artificial Sequence
  chemically synthesized
tgagctcttgcaggtgtaaa

SEQ ID NO: 417905 - DNA, 20 bp, Artificial Sequence
  chemically synthesized
cctctactttttacacctgc

SEQ ID NO: 417906 - DNA, 20 bp, Artificial Sequence
  chemically synthesized
tctactttttacacctgcaa

SEQ ID NO: 417907 - DNA, 20 bp, Artificial Sequence
  chemically synthesized
cttacaacctgagctcttgc

SEQ ID NO: 417908 - DNA, 20 bp, Artificial Sequence
  chemically synthesized
acttacaacctgagctcttg

SEQ ID NO: 417909 - DNA, 20 bp, Artificial Sequence
  chemically synthesized
tttttacacctgcaagagct

SEQ ID NO: 417910 - DNA, 20 bp, Artificial Sequence
  chemically synthesized
ttttacacctgcaagagctc

SEQ ID NO: 417911 - DNA, 20 bp, Artificial Sequence
  chemically synthesized
cctgcaagagctcaggttgt

SEQ ID NO: 417912 - DNA, 20 bp, Artificial Sequence
  chemically synthesized
aatacagccacttacaacct

SEQ ID NO: 417913 - DNA, 20 bp, Artificial Sequence
  chemically synthesized
gcaagagctcaggttgtaag

SEQ ID NO: 417914 - DNA, 20 bp, Artificial Sequence
  chemically synthesized
tgacctttgaaaaagaaata

SEQ ID NO: 417915 - DNA, 20 bp, Artificial Sequence
  chemically synthesized
gtggctgtatttctttttca

SEQ ID NO: 417916 - DNA, 20 bp, Artificial Sequence
  chemically synthesized
tggctgtatttctttttcaa

SEQ ID NO: 417917 - DNA, 20 bp, Artificial Sequence
  chemically synthesized
aagagctgtgacctttgaaa

SEQ ID NO: 417918 - DNA, 20 bp, Artificial Sequence
  chemically synthesized
tatttctttttcaaaggtca

SEQ ID NO: 417919 - DNA, 20 bp, Artificial Sequence
  chemically synthesized
tcaaaggtcacagctcttgt

SEQ ID NO: 417920 - DNA, 20 bp, Artificial Sequence
  chemically synthesized
caaaggtcacagctcttgtt

SEQ ID NO: 417921 - DNA, 20 bp, Artificial Sequence
  chemically synthesized
gaggagagaccgcccaacaa

SEQ ID NO: 417922 - DNA, 20 bp, Artificial Sequence
  chemically synthesized
aggtcacagctcttgttggg

SEQ ID NO: 417923 - DNA, 20 bp, Artificial Sequence
  chemically synthesized
ctgaggagagaccgcccaac

SEQ ID NO: 417924 - DNA, 20 bp, Artificial Sequence
  chemically synthesized
cttgttgggcggtctctcct

SEQ ID NO: 417925 - DNA, 20 bp, Artificial Sequence
  chemically synthesized
ggaaatggaggagctgagga

SEQ ID NO: 417926 - DNA, 20 bp, Artificial Sequence
  chemically synthesized
ctggaaatggaggagctgag

SEQ ID NO: 417927 - DNA, 20 bp, Artificial Sequence
  chemically synthesized
tcctggaaatggaggagctg

SEQ ID NO: 417928 - DNA, 20 bp, Artificial Sequence
  chemically synthesized
atcctggaaatggaggagct

SEQ ID NO: 417929 - DNA, 20 bp, Artificial Sequence
  chemically synthesized
actagatcctggaaatggag

SEQ ID NO: 417930 - DNA, 20 bp, Artificial Sequence
  chemically synthesized
ctcctcagctcctccatttc

SEQ ID NO: 417931 - DNA, 20 bp, Artificial Sequence
  chemically synthesized
ttactagatcctggaaatgg

SEQ ID NO: 417932 - DNA, 20 bp, Artificial Sequence
  chemically synthesized
tcctcagctcctccatttcc

SEQ ID NO: 417933 - DNA, 20 bp, Artificial Sequence
  chemically synthesized
attactagatcctggaaatg

SEQ ID NO: 417934 - DNA, 20 bp, Artificial Sequence
  chemically synthesized
caattactagatcctggaaa

SEQ ID NO: 417935 - DNA, 20 bp, Artificial Sequence
  chemically synthesized
gctcctccatttccaggatc

SEQ ID NO: 417936 - DNA, 20 bp, Artificial Sequence
  chemically synthesized
agggagcaattactagatcc

SEQ ID NO: 417937 - DNA, 20 bp, Artificial Sequence
  chemically synthesized
aaatgtgagggagcaattac

SEQ ID NO: 417938 - DNA, 20 bp, Artificial Sequence
  chemically synthesized
aaaaaaggtaaaatgtgagg

SEQ ID NO: 417939 - DNA, 20 bp, Artificial Sequence
  chemically synthesized
ctaaaaaaggtaaaatgtga

SEQ ID NO: 417940 - DNA, 20 bp, Artificial Sequence
  chemically synthesized
cctaaaaaaggtaaaatgtg

SEQ ID NO: 417941 - DNA, 20 bp, Artificial Sequence
  chemically synthesized
gcctaaaaaaggtaaaatgt

SEQ ID NO: 417942 - DNA, 20 bp, Artificial Sequence
  chemically synthesized
ccctcacattttaccttttt

SEQ ID NO: 417943 - DNA, 20 bp, Artificial Sequence
  chemically synthesized
cctcacattttacctttttt

SEQ ID NO: 417944 - DNA, 20 bp, Artificial Sequence
  chemically synthesized
cccaccactaggcctaaaaa

SEQ ID NO: 417945 - DNA, 20 bp, Artificial Sequence
  chemically synthesized
acccaccactaggcctaaaa

SEQ ID NO: 417946 - DNA, 20 bp, Artificial Sequence
  chemically synthesized
cattttaccttttttaggcc

SEQ ID NO: 417947 - DNA, 20 bp, Artificial Sequence
  chemically synthesized
tttaccttttttaggcctag

SEQ ID NO: 417948 - DNA, 20 bp, Artificial Sequence
  chemically synthesized
accttttttaggcctagtgg

SEQ ID NO: 417949 - DNA, 20 bp, Artificial Sequence
  chemically synthesized
ccttttttaggcctagtggt

SEQ ID NO: 417950 - DNA, 20 bp, Artificial Sequence
  chemically synthesized
gaaagacataacccaccact

SEQ ID NO: 417951 - DNA, 20 bp, Artificial Sequence
  chemically synthesized
agaaagacataacccaccac

SEQ ID NO: 417952 - DNA, 20 bp, Artificial Sequence
  chemically synthesized
ctggctctggggacaataga

SEQ ID NO: 417953 - DNA, 20 bp, Artificial Sequence
  chemically synthesized
ttatgtctttctattgtccc

SEQ ID NO: 417954 - DNA, 20 bp, Artificial Sequence
  chemically synthesized
gcccctggctctggggacaa

SEQ ID NO: 417955 - DNA, 20 bp, Artificial Sequence
  chemically synthesized
atgtctttctattgtcccca

SEQ ID NO: 417956 - DNA, 20 bp, Artificial Sequence
  chemically synthesized
ctttctattgtccccagagc

SEQ ID NO: 417957 - DNA, 20 bp, Artificial Sequence
  chemically synthesized
tttctattgtccccagagcc

SEQ ID NO: 417958 - DNA, 20 bp, Artificial Sequence
  chemically synthesized
gcaggtggcccctggctctg

SEQ ID NO: 417959 - DNA, 20 bp, Artificial Sequence
  chemically synthesized
ttctattgtccccagagcca

SEQ ID NO: 417960 - DNA, 20 bp, Artificial Sequence
  chemically synthesized
tgcaggtggcccctggctct

SEQ ID NO: 417961 - DNA, 20 bp, Artificial Sequence
  chemically synthesized
tctattgtccccagagccag

SEQ ID NO: 417962 - DNA, 20 bp, Artificial Sequence
  chemically synthesized
atgcaggtggcccctggctc

SEQ ID NO: 417963 - DNA, 20 bp, Artificial Sequence
  chemically synthesized
actgtgatgcaggtggcccc

SEQ ID NO: 417964 - DNA, 20 bp, Artificial Sequence
  chemically synthesized
aatgaatactgtgatgcagg

SEQ ID NO: 417965 - DNA, 20 bp, Artificial Sequence
  chemically synthesized
gccaggggccacctgcatca

SEQ ID NO: 417966 - DNA, 20 bp, Artificial Sequence
  chemically synthesized
actaatgaatactgtgatgc

SEQ ID NO: 417967 - DNA, 20 bp, Artificial Sequence
  chemically synthesized
aactaatgaatactgtgatg

SEQ ID NO: 417968 - DNA, 20 bp, Artificial Sequence
  chemically synthesized
acctgcatcacagtattcat

SEQ ID NO: 417969 - DNA, 20 bp, Artificial Sequence
  chemically synthesized
aaagttgtgggtagggttaa

SEQ ID NO: 417970 - DNA, 20 bp, Artificial Sequence
  chemically synthesized
caaagttgtgggtagggtta

SEQ ID NO: 417971 - DNA, 20 bp, Artificial Sequence
  chemically synthesized
tcaaagttgtgggtagggtt

SEQ ID NO: 417972 - DNA, 20 bp, Artificial Sequence
  chemically synthesized
aatattcaaagttgtgggta

SEQ ID NO: 417973 - DNA, 20 bp, Artificial Sequence
  chemically synthesized
caatattcaaagttgtgggt

SEQ ID NO: 417974 - DNA, 20 bp, Artificial Sequence
  chemically synthesized
acaatattcaaagttgtggg

SEQ ID NO: 417975 - DNA, 20 bp, Artificial Sequence
  chemically synthesized
gaaacaatattcaaagttgt

SEQ ID NO: 417976 - DNA, 20 bp, Artificial Sequence
  chemically synthesized
agaaacaatattcaaagttg

SEQ ID NO: 417977 - DNA, 20 bp, Artificial Sequence
  chemically synthesized
gcaataagaaacaatattca

SEQ ID NO: 417978 - DNA, 20 bp, Artificial Sequence
  chemically synthesized
ggtaaactatgagaggcaat

SEQ ID NO: 417979 - DNA, 20 bp, Artificial Sequence
  chemically synthesized
ttgtttcttattgcctctca

SEQ ID NO: 417980 - DNA, 20 bp, Artificial Sequence
  chemically synthesized
taaaatgggtaaactatgag

SEQ ID NO: 417981 - DNA, 20 bp, Artificial Sequence
  chemically synthesized
ctaaaatgggtaaactatga

SEQ ID NO: 417982 - DNA, 20 bp, Artificial Sequence
  chemically synthesized
tgctaaaatgggtaaactat

SEQ ID NO: 417983 - DNA, 20 bp, Artificial Sequence
  chemically synthesized
ctctcatagtttacccattt

SEQ ID NO: 417984 - DNA, 20 bp, Artificial Sequence
  chemically synthesized
aacacacggcatgctaaaat

SEQ ID NO: 417985 - DNA, 20 bp, Artificial Sequence
  chemically synthesized
aaacacacggcatgctaaaa

SEQ ID NO: 417986 - DNA, 20 bp, Artificial Sequence
  chemically synthesized
tcagcaagaaaacaaacaca

SEQ ID NO: 417987 - DNA, 20 bp, Artificial Sequence
  chemically synthesized
cttatctatcagagatcagc

SEQ ID NO: 417988 - DNA, 20 bp, Artificial Sequence
  chemically synthesized
gatgcttatctatcagagat

SEQ ID NO: 417989 - DNA, 20 bp, Artificial Sequence
  chemically synthesized
gttttcttgctgatctctga

SEQ ID NO: 417990 - DNA, 20 bp, Artificial Sequence
  chemically synthesized
ctctggatgcttatctatca

SEQ ID NO: 417991 - DNA, 20 bp, Artificial Sequence
  chemically synthesized
cttgctgatctctgatagat

SEQ ID NO: 417992 - DNA, 20 bp, Artificial Sequence
  chemically synthesized
atctctggatgcttatctat

SEQ ID NO: 417993 - DNA, 20 bp, Artificial Sequence
  chemically synthesized
atctctgatagataagcatc

SEQ ID NO: 417994 - DNA, 20 bp, Artificial Sequence
  chemically synthesized
ctctgatagataagcatcca

SEQ ID NO: 417995 - DNA, 20 bp, Artificial Sequence
  chemically synthesized
agcagacatatcatcatctc

SEQ ID NO: 417996 - DNA, 20 bp, Artificial Sequence
  chemically synthesized
aacaaatccttaattaatag

SEQ ID NO: 417997 - DNA, 20 bp, Artificial Sequence
  chemically synthesized
tgatatgtctgctattaatt

SEQ ID NO: 417998 - DNA, 20 bp, Artificial Sequence
  chemically synthesized
gatatgtctgctattaatta

SEQ ID NO: 417999 - DNA, 20 bp, Artificial Sequence
  chemically synthesized
acgaacaaatccttaattaa

SEQ ID NO: 418000 - DNA, 20 bp, Artificial Sequence
  chemically synthesized
atttgttcgtcactccatat

SEQ ID NO: 418001 - DNA, 20 bp, Artificial Sequence
  chemically synthesized
gacttttattaactcatatg

SEQ ID NO: 418002 - DNA, 20 bp, Artificial Sequence
  chemically synthesized
tggacttttattaactcata

SEQ ID NO: 418003 - DNA, 20 bp, Artificial Sequence
  chemically synthesized
cactccatatgagttaataa

SEQ ID NO: 418004 - DNA, 20 bp, Artificial Sequence
  chemically synthesized
gttaattttaagtcatattt

SEQ ID NO: 418005 - DNA, 20 bp, Artificial Sequence
  chemically synthesized
atacaaaatttgttaatttt

SEQ ID NO: 418006 - DNA, 20 bp, Artificial Sequence
  chemically synthesized
acaaattttgtatgaacttg

SEQ ID NO: 418007 - DNA, 20 bp, Artificial Sequence
  chemically synthesized
gatagatatggaacaaccac

SEQ ID NO: 418008 - DNA, 20 bp, Artificial Sequence
  chemically synthesized
gatatgtttctagatagata

SEQ ID NO: 418009 - DNA, 20 bp, Artificial Sequence
  chemically synthesized
gtggttgttccatatctatc

SEQ ID NO: 418010 - DNA, 20 bp, Artificial Sequence
  chemically synthesized
tctagagatatgtttctaga

SEQ ID NO: 418011 - DNA, 20 bp, Artificial Sequence
  chemically synthesized
ctattctagagatatgtttc

SEQ ID NO: 418012 - DNA, 20 bp, Artificial Sequence
  chemically synthesized
tctatctagaaacatatctc

SEQ ID NO: 418013 - DNA, 20 bp, Artificial Sequence
  chemically synthesized
ctagaaacatatctctagaa

SEQ ID NO: 418014 - DNA, 20 bp, Artificial Sequence
  chemically synthesized
atgaaatgagaactattcta

SEQ ID NO: 418015 - DNA, 20 bp, Artificial Sequence
  chemically synthesized
acatgaaatgagaactattc

SEQ ID NO: 418016 - DNA, 20 bp, Artificial Sequence
  chemically synthesized
tcttaatctcgacatgaaat

SEQ ID NO: 418017 - DNA, 20 bp, Artificial Sequence
  chemically synthesized
aatagttctcatttcatgtc

SEQ ID NO: 418018 - DNA, 20 bp, Artificial Sequence
  chemically synthesized
tctcatttcatgtcgagatt

SEQ ID NO: 418019 - DNA, 20 bp, Artificial Sequence
  chemically synthesized
catgtcgagattaagatatt

SEQ ID NO: 418020 - DNA, 20 bp, Artificial Sequence
  chemically synthesized
agattaagatatttagtata

SEQ ID NO: 418021 - DNA, 20 bp, Artificial Sequence
  chemically synthesized
ttaagatatttagtatatag

SEQ ID NO: 418022 - DNA, 20 bp, Artificial Sequence
  chemically synthesized
cctttaatgggcaagatgaa

SEQ ID NO: 418023 - DNA, 20 bp, Artificial Sequence
  chemically synthesized
tgcctttaatgggcaagatg

SEQ ID NO: 418024 - DNA, 20 bp, Artificial Sequence
  chemically synthesized
ctgttttgcctttaatgggc

SEQ ID NO: 418025 - DNA, 20 bp, Artificial Sequence
  chemically synthesized
actcttcatcttgcccatta

SEQ ID NO: 418026 - DNA, 20 bp, Artificial Sequence
  chemically synthesized
ctcttcatcttgcccattaa

SEQ ID NO: 418027 - DNA, 20 bp, Artificial Sequence
  chemically synthesized
caatctgttttgcctttaat

SEQ ID NO: 418028 - DNA, 20 bp, Artificial Sequence
  chemically synthesized
acaatctgttttgcctttaa

SEQ ID NO: 418029 - DNA, 20 bp, Artificial Sequence
  chemically synthesized
cttgcccattaaaggcaaaa

SEQ ID NO: 418030 - DNA, 20 bp, Artificial Sequence
  chemically synthesized
tttttaattatttcttcaaa

SEQ ID NO: 418031 - DNA, 20 bp, Artificial Sequence
  chemically synthesized
atgaaaggaagttccatttg

SEQ ID NO: 418032 - DNA, 20 bp, Artificial Sequence
  chemically synthesized
cacgttgtctttatgaaagg

SEQ ID NO: 418033 - DNA, 20 bp, Artificial Sequence
  chemically synthesized
aaatggaacttcctttcata

SEQ ID NO: 418034 - DNA, 20 bp, Artificial Sequence
  chemically synthesized
gtacacgttgtctttatgaa

SEQ ID NO: 418035 - DNA, 20 bp, Artificial Sequence
  chemically synthesized
agtacacgttgtctttatga

SEQ ID NO: 418036 - DNA, 20 bp, Artificial Sequence
  chemically synthesized
ataaagacaacgtgtactgt

SEQ ID NO: 418037 - DNA, 20 bp, Artificial Sequence
  chemically synthesized
aaaacagtaaagaatgctta

SEQ ID NO: 418038 - DNA, 20 bp, Artificial Sequence
  chemically synthesized
cttggctgtaaaaaacagta

SEQ ID NO: 418039 - DNA, 20 bp, Artificial Sequence
  chemically synthesized
gcattctttactgtttttta

SEQ ID NO: 418040 - DNA, 20 bp, Artificial Sequence
  chemically synthesized
tttttcttggctgtaaaaaa

SEQ ID NO: 418041 - DNA, 20 bp, Artificial Sequence
  chemically synthesized
ctttactgttttttacagcc

SEQ ID NO: 418042 - DNA, 20 bp, Artificial Sequence
  chemically synthesized
taaactatgtcgatttttct

SEQ ID NO: 418043 - DNA, 20 bp, Artificial Sequence
  chemically synthesized
acagccaagaaaaatcgaca

SEQ ID NO: 418044 - DNA, 20 bp, Artificial Sequence
  chemically synthesized
acatcttatgacaaatcaat

SEQ ID NO: 418045 - DNA, 20 bp, Artificial Sequence
  chemically synthesized
gacatcttatgacaaatcaa

SEQ ID NO: 418046 - DNA, 20 bp, Artificial Sequence
  chemically synthesized
cacacctattgatttgtcat

SEQ ID NO: 418047 - DNA, 20 bp, Artificial Sequence
  chemically synthesized
atttgtcataagatgtcaac

SEQ ID NO: 418048 - DNA, 20 bp, Artificial Sequence
  chemically synthesized
ttgtcataagatgtcaacta

SEQ ID NO: 418049 - DNA, 20 bp, Artificial Sequence
  chemically synthesized
tttgggttttttttgttctc

SEQ ID NO: 418050 - DNA, 20 bp, Artificial Sequence
  chemically synthesized
gagaacaaaaaaaacccaaa

SEQ ID NO: 418051 - DNA, 20 bp, Artificial Sequence
  chemically synthesized
tcttgtccattaatctgttt

SEQ ID NO: 418052 - DNA, 20 bp, Artificial Sequence
  chemically synthesized
ctcttgtccattaatctgtt

SEQ ID NO: 418053 - DNA, 20 bp, Artificial Sequence
  chemically synthesized
aaaaaacccaaacagattaa

SEQ ID NO: 418054 - DNA, 20 bp, Artificial Sequence
  chemically synthesized
acccaaacagattaatggac

SEQ ID NO: 418055 - DNA, 20 bp, Artificial Sequence
  chemically synthesized
ccaaacagattaatggacaa

SEQ ID NO: 418056 - DNA, 20 bp, Artificial Sequence
  chemically synthesized
aattgcaatgatatataaaa

SEQ ID NO: 418057 - DNA, 20 bp, Artificial Sequence
  chemically synthesized
ttagagctattatgtaattt

SEQ ID NO: 418058 - DNA, 20 bp, Artificial Sequence
  chemically synthesized
aaaaagccaaaattacataa

SEQ ID NO: 418059 - DNA, 20 bp, Artificial Sequence
  chemically synthesized
gtgtcagagctattacgtta

SEQ ID NO: 418060 - DNA, 20 bp, Artificial Sequence
  chemically synthesized
acataatagctctaacgtaa

SEQ ID NO: 418061 - DNA, 20 bp, Artificial Sequence
  chemically synthesized
gcgtgtcagagctattacgt

SEQ ID NO: 418062 - DNA, 20 bp, Artificial Sequence
  chemically synthesized
tcttcttatgttgcgtgtca

SEQ ID NO: 418063 - DNA, 20 bp, Artificial Sequence
  chemically synthesized
tatcttcttatgttgcgtgt

SEQ ID NO: 418064 - DNA, 20 bp, Artificial Sequence
  chemically synthesized
atagctctgacacgcaacat

SEQ ID NO: 418065 - DNA, 20 bp, Artificial Sequence
  chemically synthesized
gctctgacacgcaacataag

SEQ ID NO: 418066 - DNA, 20 bp, Artificial Sequence
  chemically synthesized
acacgcaacataagaagata

SEQ ID NO: 418067 - DNA, 20 bp, Artificial Sequence
  chemically synthesized
gataaagaatgaactatcta

SEQ ID NO: 418068 - DNA, 20 bp, Artificial Sequence
  chemically synthesized
ataaagaatgaactatctat

SEQ ID NO: 418069 - DNA, 20 bp, Artificial Sequence
  chemically synthesized
ttttaaatattacctataga

SEQ ID NO: 418070 - DNA, 20 bp, Artificial Sequence
  chemically synthesized
atatttttaaatattaccta

SEQ ID NO: 418071 - DNA, 20 bp, Artificial Sequence
  chemically synthesized
gtaatatttaaaaatatatg

SEQ ID NO: 418072 - DNA, 20 bp, Artificial Sequence
  chemically synthesized
aaatatatgtagaaaccatt

SEQ ID NO: 418073 - DNA, 20 bp, Artificial Sequence
  chemically synthesized
aatatatgtagaaaccatta

SEQ ID NO: 418074 - DNA, 20 bp, Artificial Sequence
  chemically synthesized
ttgagtcaacaatgccttaa

SEQ ID NO: 418075 - DNA, 20 bp, Artificial Sequence
  chemically synthesized
cattaaggcattgttgactc

SEQ ID NO: 418076 - DNA, 20 bp, Artificial Sequence
  chemically synthesized
attaaggcattgttgactca

SEQ ID NO: 418077 - DNA, 20 bp, Artificial Sequence
  chemically synthesized
gcatctcttccagtgtcctt

SEQ ID NO: 418078 - DNA, 20 bp, Artificial Sequence
  chemically synthesized
cattgttgactcaaggacac

SEQ ID NO: 418079 - DNA, 20 bp, Artificial Sequence
  chemically synthesized
tgttgactcaaggacactgg

SEQ ID NO: 418080 - DNA, 20 bp, Artificial Sequence
  chemically synthesized
ttgactcaaggacactggaa

SEQ ID NO: 418081 - DNA, 20 bp, Artificial Sequence
  chemically synthesized
gattgggccagcatctcttc

SEQ ID NO: 418082 - DNA, 20 bp, Artificial Sequence
  chemically synthesized
aaggacactggaagagatgc

SEQ ID NO: 418083 - DNA, 20 bp, Artificial Sequence
  chemically synthesized
agcatctgtttggattgggc

SEQ ID NO: 418084 - DNA, 20 bp, Artificial Sequence
  chemically synthesized
aaccagcatctgtttggatt

SEQ ID NO: 418085 - DNA, 20 bp, Artificial Sequence
  chemically synthesized
agatgctggcccaatccaaa

SEQ ID NO: 418086 - DNA, 20 bp, Artificial Sequence
  chemically synthesized
aaaccagcatctgtttggat

SEQ ID NO: 418087 - DNA, 20 bp, Artificial Sequence
  chemically synthesized
attttaaaccagcatctgtt

SEQ ID NO: 418088 - DNA, 20 bp, Artificial Sequence
  chemically synthesized
ggcccaatccaaacagatgc

SEQ ID NO: 418089 - DNA, 20 bp, Artificial Sequence
  chemically synthesized
atagtccagtcattttaaac

SEQ ID NO: 418090 - DNA, 20 bp, Artificial Sequence
  chemically synthesized
agatgctggtttaaaatgac

SEQ ID NO: 418091 - DNA, 20 bp, Artificial Sequence
  chemically synthesized
tgccccttgtaagaatagtc

SEQ ID NO: 418092 - DNA, 20 bp, Artificial Sequence
  chemically synthesized
aatgactggactattcttac

SEQ ID NO: 418093 - DNA, 20 bp, Artificial Sequence
  chemically synthesized
tggtgtgccccttgtaagaa

SEQ ID NO: 418094 - DNA, 20 bp, Artificial Sequence
  chemically synthesized
atgactggactattcttaca

SEQ ID NO: 418095 - DNA, 20 bp, Artificial Sequence
  chemically synthesized
tgactggactattcttacaa

SEQ ID NO: 418096 - DNA, 20 bp, Artificial Sequence
  chemically synthesized
gactggactattcttacaag

SEQ ID NO: 418097 - DNA, 20 bp, Artificial Sequence
  chemically synthesized
tgagttggtgtgccccttgt

SEQ ID NO: 418098 - DNA, 20 bp, Artificial Sequence
  chemically synthesized
ttacaaggggcacaccaact

SEQ ID NO: 418099 - DNA, 20 bp, Artificial Sequence
  chemically synthesized
ctgtagaactgatactgagt

SEQ ID NO: 418100 - DNA, 20 bp, Artificial Sequence
  chemically synthesized
ggggcacaccaactcagtat

SEQ ID NO: 418101 - DNA, 20 bp, Artificial Sequence
  chemically synthesized
tttgctgtagaactgatact

SEQ ID NO: 418102 - DNA, 20 bp, Artificial Sequence
  chemically synthesized
ccaactcagtatcagttcta

SEQ ID NO: 418103 - DNA, 20 bp, Artificial Sequence
  chemically synthesized
tctgtcatatggttttgctg

SEQ ID NO: 418104 - DNA, 20 bp, Artificial Sequence
  chemically synthesized
tctacagcaaaaccatatga

SEQ ID NO: 418105 - DNA, 20 bp, Artificial Sequence
  chemically synthesized
ctccataatattctgtcata

SEQ ID NO: 418106 - DNA, 20 bp, Artificial Sequence
  chemically synthesized
aaccatatgacagaatatta

SEQ ID NO: 418107 - DNA, 20 bp, Artificial Sequence
  chemically synthesized
ccatatgacagaatattatg

SEQ ID NO: 418108 - DNA, 20 bp, Artificial Sequence
  chemically synthesized
agaatattatggagcaatgt

SEQ ID NO: 418109 - DNA, 20 bp, Artificial Sequence
  chemically synthesized
gagcaatgtaagtaatgatt

SEQ ID NO: 418110 - DNA, 20 bp, Artificial Sequence
  chemically synthesized
tgattaagttttacaatgca

SEQ ID NO: 418111 - DNA, 20 bp, Artificial Sequence
  chemically synthesized
taagttttacaatgcaaagt

SEQ ID NO: 418112 - DNA, 20 bp, Artificial Sequence
  chemically synthesized
taataaagttagatattttt

SEQ ID NO: 418113 - DNA, 20 bp, Artificial Sequence
  chemically synthesized
tattttttccttaataaagt

SEQ ID NO: 418114 - DNA, 20 bp, Artificial Sequence
  chemically synthesized
aaaaaatatctaactttatt

SEQ ID NO: 418115 - DNA, 20 bp, Artificial Sequence
  chemically synthesized
aaaaatatctaactttatta

SEQ ID NO: 418116 - DNA, 20 bp, Artificial Sequence
  chemically synthesized
agtttattttttccttaata

SEQ ID NO: 418117 - DNA, 20 bp, Artificial Sequence
  chemically synthesized
taaggaaaaaataaactgtt

SEQ ID NO: 418118 - DNA, 20 bp, Artificial Sequence
  chemically synthesized
aggaaaaaataaactgttta

SEQ ID NO: 418119 - DNA, 20 bp, Artificial Sequence
  chemically synthesized
taaaacatcctttctctaaa

SEQ ID NO: 418120 - DNA, 20 bp, Artificial Sequence
  chemically synthesized
aaaaataaactgtttagaga

SEQ ID NO: 418121 - DNA, 20 bp, Artificial Sequence
  chemically synthesized
aaaataaactgtttagagaa

SEQ ID NO: 418122 - DNA, 20 bp, Artificial Sequence
  chemically synthesized
tgtttagagaaaggatgttt

SEQ ID NO: 418123 - DNA, 20 bp, Artificial Sequence
  chemically synthesized
gagaaaggatgttttagctg

SEQ ID NO: 418124 - DNA, 20 bp, Artificial Sequence
  chemically synthesized
agaaaggatgttttagctgt

SEQ ID NO: 418125 - DNA, 20 bp, Artificial Sequence
  chemically synthesized
aaggatgttttagctgtggg

SEQ ID NO: 418126 - DNA, 20 bp, Artificial Sequence
  chemically synthesized
aacagagggaaagccaccca

SEQ ID NO: 418127 - DNA, 20 bp, Artificial Sequence
  chemically synthesized
ataattttaaaacagaggga

SEQ ID NO: 418128 - DNA, 20 bp, Artificial Sequence
  chemically synthesized
aagtataattttaaaacaga

SEQ ID NO: 418129 - DNA, 20 bp, Artificial Sequence
  chemically synthesized
aaagtataattttaaaacag

SEQ ID NO: 418130 - DNA, 20 bp, Artificial Sequence
  chemically synthesized
aaaagtataattttaaaaca

SEQ ID NO: 418131 - DNA, 20 bp, Artificial Sequence
  chemically synthesized
ttaaaagtataattttaaaa

SEQ ID NO: 418132 - DNA, 20 bp, Artificial Sequence
  chemically synthesized
gatatttaaagaaattttaa

SEQ ID NO: 418133 - DNA, 20 bp, Artificial Sequence
  chemically synthesized
aaagaaatacatgatattta

SEQ ID NO: 418134 - DNA, 20 bp, Artificial Sequence
  chemically synthesized
tatcatgtatttctttgtta

SEQ ID NO: 418135 - DNA, 20 bp, Artificial Sequence
  chemically synthesized
catcgtttccatctttaaca

SEQ ID NO: 418136 - DNA, 20 bp, Artificial Sequence
  chemically synthesized
atgtatttctttgttaaaga

SEQ ID NO: 418137 - DNA, 20 bp, Artificial Sequence
  chemically synthesized
tgttaaagatggaaacgatg

SEQ ID NO: 418138 - DNA, 20 bp, Artificial Sequence
  chemically synthesized
aaagatggaaacgatgaagc

SEQ ID NO: 418139 - DNA, 20 bp, Artificial Sequence
  chemically synthesized
aagatggaaacgatgaagcc

SEQ ID NO: 418140 - DNA, 20 bp, Artificial Sequence
  chemically synthesized
ggaaacgatgaagccgggca

SEQ ID NO: 418141 - DNA, 20 bp, Artificial Sequence
  chemically synthesized
aacgatgaagccgggcacgg

SEQ ID NO: 418142 - DNA, 20 bp, Artificial Sequence
  chemically synthesized
caagcgtgagccaccgtgcc

SEQ ID NO: 418143 - DNA, 20 bp, Artificial Sequence
  chemically synthesized
agtgctgggattacaagcgt

SEQ ID NO: 418144 - DNA, 20 bp, Artificial Sequence
  chemically synthesized
gtggctcacgcttgtaatcc

SEQ ID NO: 418145 - DNA, 20 bp, Artificial Sequence
  chemically synthesized
tcccaaagtgctgggattac

SEQ ID NO: 418146 - DNA, 20 bp, Artificial Sequence
  chemically synthesized
cgcttgtaatcccagcactt

SEQ ID NO: 418147 - DNA, 20 bp, Artificial Sequence
  chemically synthesized
cctctgcctcccaaagtgct

SEQ ID NO: 418148 - DNA, 20 bp, Artificial Sequence
  chemically synthesized
gcttgtaatcccagcacttt

SEQ ID NO: 418149 - DNA, 20 bp, Artificial Sequence
  chemically synthesized
gcctctgcctcccaaagtgc

SEQ ID NO: 418150 - DNA, 20 bp, Artificial Sequence
  chemically synthesized
ttgtaatcccagcactttgg

SEQ ID NO: 418151 - DNA, 20 bp, Artificial Sequence
  chemically synthesized
tgtaatcccagcactttggg

SEQ ID NO: 418152 - DNA, 20 bp, Artificial Sequence
  chemically synthesized
aatcccagcactttgggagg

SEQ ID NO: 418153 - DNA, 20 bp, Artificial Sequence
  chemically synthesized
ccacctgcctctgcctccca

SEQ ID NO: 418154 - DNA, 20 bp, Artificial Sequence
  chemically synthesized
tcccagcactttgggaggca

SEQ ID NO: 418155 - DNA, 20 bp, Artificial Sequence
  chemically synthesized
cccagcactttgggaggcag

SEQ ID NO: 418156 - DNA, 20 bp, Artificial Sequence
  chemically synthesized
agcactttgggaggcagagg

SEQ ID NO: 418157 - DNA, 20 bp, Artificial Sequence
  chemically synthesized
gcactttgggaggcagaggc

SEQ ID NO: 418158 - DNA, 20 bp, Artificial Sequence
  chemically synthesized
ctttgggaggcagaggcagg

SEQ ID NO: 418159 - DNA, 20 bp, Artificial Sequence
  chemically synthesized
cagaggcaggtggatcacct

SEQ ID NO: 418160 - DNA, 20 bp, Artificial Sequence
  chemically synthesized
agaggcaggtggatcacctg

SEQ ID NO: 418161 - DNA, 20 bp, Artificial Sequence
  chemically synthesized
gcaggtggatcacctgaggc

SEQ ID NO: 418162 - DNA, 20 bp, Artificial Sequence
  chemically synthesized
caggtggatcacctgaggcc

SEQ ID NO: 418163 - DNA, 20 bp, Artificial Sequence
  chemically synthesized
ggtctcgaactcctggcctc

SEQ ID NO: 418164 - DNA, 20 bp, Artificial Sequence
  chemically synthesized
ggtggatcacctgaggccag

SEQ ID NO: 418165 - DNA, 20 bp, Artificial Sequence
  chemically synthesized
tggtctcgaactcctggcct

SEQ ID NO: 418166 - DNA, 20 bp, Artificial Sequence
  chemically synthesized
tcacctgaggccaggagttc

SEQ ID NO: 418167 - DNA, 20 bp, Artificial Sequence
  chemically synthesized
tcaggctggtctcgaactcc

SEQ ID NO: 418168 - DNA, 20 bp, Artificial Sequence
  chemically synthesized
tgaggccaggagttcgagac

SEQ ID NO: 418169 - DNA, 20 bp, Artificial Sequence
  chemically synthesized
tttcgccattttggtcaggc

SEQ ID NO: 418170 - DNA, 20 bp, Artificial Sequence
  chemically synthesized
ggggtttcgccattttggtc

SEQ ID NO: 418171 - DNA, 20 bp, Artificial Sequence
  chemically synthesized
cgagaccagcctgaccaaaa

SEQ ID NO: 418172 - DNA, 20 bp, Artificial Sequence
  chemically synthesized
tggggtttcgccattttggt

SEQ ID NO: 418173 - DNA, 20 bp, Artificial Sequence
  chemically synthesized
cagatggggtttcgccattt

SEQ ID NO: 418174 - DNA, 20 bp, Artificial Sequence
  chemically synthesized
ttatattagtagtacagatg

SEQ ID NO: 418175 - DNA, 20 bp, Artificial Sequence
  chemically synthesized
tttatattagtagtacagat

SEQ ID NO: 418176 - DNA, 20 bp, Artificial Sequence
  chemically synthesized
ttttatattagtagtacaga

SEQ ID NO: 418177 - DNA, 20 bp, Artificial Sequence
  chemically synthesized
ctaattttatattagtagta

SEQ ID NO: 418178 - DNA, 20 bp, Artificial Sequence
  chemically synthesized
cctgactaattttatattag

SEQ ID NO: 418179 - DNA, 20 bp, Artificial Sequence
  chemically synthesized
atccctgactaattttatat

SEQ ID NO: 418180 - DNA, 20 bp, Artificial Sequence
  chemically synthesized
ctgtactactaatataaaat

SEQ ID NO: 418181 - DNA, 20 bp, Artificial Sequence
  chemically synthesized
actactaatataaaattagt

SEQ ID NO: 418182 - DNA, 20 bp, Artificial Sequence
  chemically synthesized
ctactaatataaaattagtc

SEQ ID NO: 418183 - DNA, 20 bp, Artificial Sequence
  chemically synthesized
tactaatataaaattagtca

SEQ ID NO: 418184 - DNA, 20 bp, Artificial Sequence
  chemically synthesized
aatataaaattagtcaggga

SEQ ID NO: 418185 - DNA, 20 bp, Artificial Sequence
  chemically synthesized
ataaaattagtcagggatgg

SEQ ID NO: 418186 - DNA, 20 bp, Artificial Sequence
  chemically synthesized
gtggcgcatgcctgtcatcc

SEQ ID NO: 418187 - DNA, 20 bp, Artificial Sequence
  chemically synthesized
tcccgagtatctgggatgac

SEQ ID NO: 418188 - DNA, 20 bp, Artificial Sequence
  chemically synthesized
ttcccgagtatctgggatga

SEQ ID NO: 418189 - DNA, 20 bp, Artificial Sequence
  chemically synthesized
tgcctgtcatcccagatact

SEQ ID NO: 418190 - DNA, 20 bp, Artificial Sequence
  chemically synthesized
cctcagcttcccgagtatct

SEQ ID NO: 418191 - DNA, 20 bp, Artificial Sequence
  chemically synthesized
gcctgtcatcccagatactc

SEQ ID NO: 418192 - DNA, 20 bp, Artificial Sequence
  chemically synthesized
gcctcagcttcccgagtatc

SEQ ID NO: 418193 - DNA, 20 bp, Artificial Sequence
  chemically synthesized
tgtcatcccagatactcggg

SEQ ID NO: 418194 - DNA, 20 bp, Artificial Sequence
  chemically synthesized
ttctcctgcctcagcttccc

SEQ ID NO: 418195 - DNA, 20 bp, Artificial Sequence
  chemically synthesized
tcccagatactcgggaagct

SEQ ID NO: 418196 - DNA, 20 bp, Artificial Sequence
  chemically synthesized
cccagatactcgggaagctg

SEQ ID NO: 418197 - DNA, 20 bp, Artificial Sequence
  chemically synthesized
agatactcgggaagctgagg

SEQ ID NO: 418198 - DNA, 20 bp, Artificial Sequence
  chemically synthesized
gatactcgggaagctgaggc

SEQ ID NO: 418199 - DNA, 20 bp, Artificial Sequence
  chemically synthesized
tactcgggaagctgaggcag

SEQ ID NO: 418200 - DNA, 20 bp, Artificial Sequence
  chemically synthesized
ttcaagcgattctcctgcct

SEQ ID NO: 418201 - DNA, 20 bp, Artificial Sequence
  chemically synthesized
gcaggagaatcgcttgaacc

SEQ ID NO: 418202 - DNA, 20 bp, Artificial Sequence
  chemically synthesized
caggagaatcgcttgaaccc

SEQ ID NO: 418203 - DNA, 20 bp, Artificial Sequence
  chemically synthesized
aatctccgcctcctgggttc

SEQ ID NO: 418204 - DNA, 20 bp, Artificial Sequence
  chemically synthesized
ggagaatcgcttgaacccag

SEQ ID NO: 418205 - DNA, 20 bp, Artificial Sequence
  chemically synthesized
gagaatcgcttgaacccagg

SEQ ID NO: 418206 - DNA, 20 bp, Artificial Sequence
  chemically synthesized
aatcgcttgaacccaggagg

SEQ ID NO: 418207 - DNA, 20 bp, Artificial Sequence
  chemically synthesized
cactgcaatctccgcctcct

SEQ ID NO: 418208 - DNA, 20 bp, Artificial Sequence
  chemically synthesized
tcgcttgaacccaggaggcg

SEQ ID NO: 418209 - DNA, 20 bp, Artificial Sequence
  chemically synthesized
tcactgcaatctccgcctcc

SEQ ID NO: 418210 - DNA, 20 bp, Artificial Sequence
  chemically synthesized
aacccaggaggcggagattg

SEQ ID NO: 418211 - DNA, 20 bp, Artificial Sequence
  chemically synthesized
caggaggcggagattgcagt

SEQ ID NO: 418212 - DNA, 20 bp, Artificial Sequence
  chemically synthesized
ggcggagattgcagtgagcc

SEQ ID NO: 418213 - DNA, 20 bp, Artificial Sequence
  chemically synthesized
agagggcaactgtgcaatct

SEQ ID NO: 418214 - DNA, 20 bp, Artificial Sequence
  chemically synthesized
tgcagtgagccaagattgca

SEQ ID NO: 418215 - DNA, 20 bp, Artificial Sequence
  chemically synthesized
aagattgcacagttgccctc

SEQ ID NO: 418216 - DNA, 20 bp, Artificial Sequence
  chemically synthesized
tgcacagttgccctctagcc

SEQ ID NO: 418217 - DNA, 20 bp, Artificial Sequence
  chemically synthesized
ctcttgtcacccaggctaga

SEQ ID NO: 418218 - DNA, 20 bp, Artificial Sequence
  chemically synthesized
gcacagttgccctctagcct

SEQ ID NO: 418219 - DNA, 20 bp, Artificial Sequence
  chemically synthesized
gctcttgtcacccaggctag

SEQ ID NO: 418220 - DNA, 20 bp, Artificial Sequence
  chemically synthesized
tgctcttgtcacccaggcta

SEQ ID NO: 418221 - DNA, 20 bp, Artificial Sequence
  chemically synthesized
tttgctcttgtcacccaggc

SEQ ID NO: 418222 - DNA, 20 bp, Artificial Sequence
  chemically synthesized
tgccctctagcctgggtgac

SEQ ID NO: 418223 - DNA, 20 bp, Artificial Sequence
  chemically synthesized
gagttttgctcttgtcaccc

SEQ ID NO: 418224 - DNA, 20 bp, Artificial Sequence
  chemically synthesized
ggagttttgctcttgtcacc

SEQ ID NO: 418225 - DNA, 20 bp, Artificial Sequence
  chemically synthesized
ccctctagcctgggtgacaa

SEQ ID NO: 418226 - DNA, 20 bp, Artificial Sequence
  chemically synthesized
gttttttgttttttgagacg

SEQ ID NO: 418227 - DNA, 20 bp, Artificial Sequence
  chemically synthesized
ttgttttttgttttttgaga

SEQ ID NO: 418228 - DNA, 20 bp, Artificial Sequence
  chemically synthesized
ttttttgttttttgtttttt

SEQ ID NO: 418229 - DNA, 20 bp, Artificial Sequence
  chemically synthesized
aaacaaaaaatgaaaaccat

SEQ ID NO: 418230 - DNA, 20 bp, Artificial Sequence
  chemically synthesized
tgattttcatttattactca

SEQ ID NO: 418231 - DNA, 20 bp, Artificial Sequence
  chemically synthesized
taaatgaaaatcaattaact

SEQ ID NO: 418232 - DNA, 20 bp, Artificial Sequence
  chemically synthesized
aatgaaaatcaattaactca

SEQ ID NO: 418233 - DNA, 20 bp, Artificial Sequence
  chemically synthesized
taattccattaatacactct

SEQ ID NO: 418234 - DNA, 20 bp, Artificial Sequence
  chemically synthesized
attaactcagagtgtattaa

SEQ ID NO: 418235 - DNA, 20 bp, Artificial Sequence
  chemically synthesized
aatggaattatatgtgtatc

SEQ ID NO: 418236 - DNA, 20 bp, Artificial Sequence
  chemically synthesized
ggagttttacaattataatt

SEQ ID NO: 418237 - DNA, 20 bp, Artificial Sequence
  chemically synthesized
aattgtaaaactcctgaatt

SEQ ID NO: 418238 - DNA, 20 bp, Artificial Sequence
  chemically synthesized
gatattctatccaaattcag

SEQ ID NO: 418239 - DNA, 20 bp, Artificial Sequence
  chemically synthesized
gagatattctatccaaattc

SEQ ID NO: 418240 - DNA, 20 bp, Artificial Sequence
  chemically synthesized
tgagatattctatccaaatt

SEQ ID NO: 418241 - DNA, 20 bp, Artificial Sequence
  chemically synthesized
gtaaaactcctgaatttgga

SEQ ID NO: 418242 - DNA, 20 bp, Artificial Sequence
  chemically synthesized
tgaatttggatagaatatct

SEQ ID NO: 418243 - DNA, 20 bp, Artificial Sequence
  chemically synthesized
attggtaggggtagatttct

SEQ ID NO: 418244 - DNA, 20 bp, Artificial Sequence
  chemically synthesized
catgaaaaaattggtagggg

SEQ ID NO: 418245 - DNA, 20 bp, Artificial Sequence
  chemically synthesized
taacatgaaaaaattggtag

SEQ ID NO: 418246 - DNA, 20 bp, Artificial Sequence
  chemically synthesized
ttaacatgaaaaaattggta

SEQ ID NO: 418247 - DNA, 20 bp, Artificial Sequence
  chemically synthesized
attaacatgaaaaaattggt

SEQ ID NO: 418248 - DNA, 20 bp, Artificial Sequence
  chemically synthesized
tattaacatgaaaaaattgg

SEQ ID NO: 418249 - DNA, 20 bp, Artificial Sequence
  chemically synthesized
tgatattaacatgaaaaaat

SEQ ID NO: 418250 - DNA, 20 bp, Artificial Sequence
  chemically synthesized
agctgatgagattttagaag

SEQ ID NO: 418251 - DNA, 20 bp, Artificial Sequence
  chemically synthesized
gagctgatgagattttagaa

SEQ ID NO: 418252 - DNA, 20 bp, Artificial Sequence
  chemically synthesized
aggagctgatgagattttag

SEQ ID NO: 418253 - DNA, 20 bp, Artificial Sequence
  chemically synthesized
cctaggagctgatgagattt

SEQ ID NO: 418254 - DNA, 20 bp, Artificial Sequence
  chemically synthesized
cacctcttctaaaatctcat

SEQ ID NO: 418255 - DNA, 20 bp, Artificial Sequence
  chemically synthesized
ggcatttcctaggagctgat

SEQ ID NO: 418256 - DNA, 20 bp, Artificial Sequence
  chemically synthesized
tctaaaatctcatcagctcc

SEQ ID NO: 418257 - DNA, 20 bp, Artificial Sequence
  chemically synthesized
ctaaaatctcatcagctcct

SEQ ID NO: 418258 - DNA, 20 bp, Artificial Sequence
  chemically synthesized
aaaatctaggcatttcctag

SEQ ID NO: 418259 - DNA, 20 bp, Artificial Sequence
  chemically synthesized
ttaaaatctaggcatttcct

SEQ ID NO: 418260 - DNA, 20 bp, Artificial Sequence
  chemically synthesized
tttaaaatctaggcatttcc

SEQ ID NO: 418261 - DNA, 20 bp, Artificial Sequence
  chemically synthesized
atcagctcctaggaaatgcc

SEQ ID NO: 418262 - DNA, 20 bp, Artificial Sequence
  chemically synthesized
atagttgctttttaaaatct

SEQ ID NO: 418263 - DNA, 20 bp, Artificial Sequence
  chemically synthesized
tatagttgctttttaaaatc

SEQ ID NO: 418264 - DNA, 20 bp, Artificial Sequence
  chemically synthesized
ggaaatgcctagattttaaa

SEQ ID NO: 418265 - DNA, 20 bp, Artificial Sequence
  chemically synthesized
taaaaagcaactataaccta

SEQ ID NO: 418266 - DNA, 20 bp, Artificial Sequence
  chemically synthesized
accatcctatccataggtta

SEQ ID NO: 418267 - DNA, 20 bp, Artificial Sequence
  chemically synthesized
aagcaactataacctatgga

SEQ ID NO: 418268 - DNA, 20 bp, Artificial Sequence
  chemically synthesized
agcaactataacctatggat

SEQ ID NO: 418269 - DNA, 20 bp, Artificial Sequence
  chemically synthesized
acagggaccatcctatccat

SEQ ID NO: 418270 - DNA, 20 bp, Artificial Sequence
  chemically synthesized
cacagggaccatcctatcca

SEQ ID NO: 418271 - DNA, 20 bp, Artificial Sequence
  chemically synthesized
actataacctatggatagga

SEQ ID NO: 418272 - DNA, 20 bp, Artificial Sequence
  chemically synthesized
tggataggatggtccctgtg

SEQ ID NO: 418273 - DNA, 20 bp, Artificial Sequence
  chemically synthesized
agcttcctagtggccacaca

SEQ ID NO: 418274 - DNA, 20 bp, Artificial Sequence
  chemically synthesized
cagcttcctagtggccacac

SEQ ID NO: 418275 - DNA, 20 bp, Artificial Sequence
  chemically synthesized
gcagcttcctagtggccaca

SEQ ID NO: 418276 - DNA, 20 bp, Artificial Sequence
  chemically synthesized
gatggtccctgtgtggccac

SEQ ID NO: 418277 - DNA, 20 bp, Artificial Sequence
  chemically synthesized
atggtccctgtgtggccact

SEQ ID NO: 418278 - DNA, 20 bp, Artificial Sequence
  chemically synthesized
gtccctgtgtggccactagg

SEQ ID NO: 418279 - DNA, 20 bp, Artificial Sequence
  chemically synthesized
ctcttccagcagcttcctag

SEQ ID NO: 418280 - DNA, 20 bp, Artificial Sequence
  chemically synthesized
tttctcttccagcagcttcc

SEQ ID NO: 418281 - DNA, 20 bp, Artificial Sequence
  chemically synthesized
tgtggccactaggaagctgc

SEQ ID NO: 418282 - DNA, 20 bp, Artificial Sequence
  chemically synthesized
ggccactaggaagctgctgg

SEQ ID NO: 418283 - DNA, 20 bp, Artificial Sequence
  chemically synthesized
ccactaggaagctgctggaa

SEQ ID NO: 418284 - DNA, 20 bp, Artificial Sequence
  chemically synthesized
tatctctctttctcttccag

SEQ ID NO: 418285 - DNA, 20 bp, Artificial Sequence
  chemically synthesized
taggaagctgctggaagaga

SEQ ID NO: 418286 - DNA, 20 bp, Artificial Sequence
  chemically synthesized
ctatatctctctttctcttc

SEQ ID NO: 418287 - DNA, 20 bp, Artificial Sequence
  chemically synthesized
ggaagctgctggaagagaaa

SEQ ID NO: 418288 - DNA, 20 bp, Artificial Sequence
  chemically synthesized
aagctgctggaagagaaaga

SEQ ID NO: 418289 - DNA, 20 bp, Artificial Sequence
  chemically synthesized
ctggaagagaaagagagata

SEQ ID NO: 418290 - DNA, 20 bp, Artificial Sequence
  chemically synthesized
gagagatatagtatattctg

SEQ ID NO: 418291 - DNA, 20 bp, Artificial Sequence
  chemically synthesized
ccacacttgtcacatggcta

SEQ ID NO: 418292 - DNA, 20 bp, Artificial Sequence
  chemically synthesized
atattctgtagccatgtgac

SEQ ID NO: 418293 - DNA, 20 bp, Artificial Sequence
  chemically synthesized
ctggtcccacacttgtcaca

SEQ ID NO: 418294 - DNA, 20 bp, Artificial Sequence
  chemically synthesized
ctgtagccatgtgacaagtg

SEQ ID NO: 418295 - DNA, 20 bp, Artificial Sequence
  chemically synthesized
tgtagccatgtgacaagtgt

SEQ ID NO: 418296 - DNA, 20 bp, Artificial Sequence
  chemically synthesized
ccatgtgacaagtgtgggac

SEQ ID NO: 418297 - DNA, 20 bp, Artificial Sequence
  chemically synthesized
tgtgacaagtgtgggaccag

SEQ ID NO: 418298 - DNA, 20 bp, Artificial Sequence
  chemically synthesized
tgacaagtgtgggaccagaa

SEQ ID NO: 418299 - DNA, 20 bp, Artificial Sequence
  chemically synthesized
caagtgtgggaccagaagag

SEQ ID NO: 418300 - DNA, 20 bp, Artificial Sequence
  chemically synthesized
atcctcactaactgctcttc

SEQ ID NO: 418301 - DNA, 20 bp, Artificial Sequence
  chemically synthesized
tgtgggaccagaagagcagt

SEQ ID NO: 418302 - DNA, 20 bp, Artificial Sequence
  chemically synthesized
ggaccagaagagcagttagt

SEQ ID NO: 418303 - DNA, 20 bp, Artificial Sequence
  chemically synthesized
gaccagaagagcagttagtg

SEQ ID NO: 418304 - DNA, 20 bp, Artificial Sequence
  chemically synthesized
ttagtgaggataattttgca

SEQ ID NO: 418305 - DNA, 20 bp, Artificial Sequence
  chemically synthesized
catttgaaattcttacatta

SEQ ID NO: 418306 - DNA, 20 bp, Artificial Sequence
  chemically synthesized
caacaaagtatctttaatgt

SEQ ID NO: 418307 - DNA, 20 bp, Artificial Sequence
  chemically synthesized
ttacattaaagatactttgt

SEQ ID NO: 418308 - DNA, 20 bp, Artificial Sequence
  chemically synthesized
aaacgctgcgattgccaaca

SEQ ID NO: 418309 - DNA, 20 bp, Artificial Sequence
  chemically synthesized
agatactttgttggcaatcg

SEQ ID NO: 418310 - DNA, 20 bp, Artificial Sequence
  chemically synthesized
gcagcgtttatttgtttatt

SEQ ID NO: 418311 - DNA, 20 bp, Artificial Sequence
  chemically synthesized
ataaataaaaatgcattcct

SEQ ID NO: 418312 - DNA, 20 bp, Artificial Sequence
  chemically synthesized
agtgcctctttaatatgctt

SEQ ID NO: 418313 - DNA, 20 bp, Artificial Sequence
  chemically synthesized
aagtgcctctttaatatgct

SEQ ID NO: 418314 - DNA, 20 bp, Artificial Sequence
  chemically synthesized
atgcattcctaagcatatta

SEQ ID NO: 418315 - DNA, 20 bp, Artificial Sequence
  chemically synthesized
gcattcctaagcatattaaa

SEQ ID NO: 418316 - DNA, 20 bp, Artificial Sequence
  chemically synthesized
cattcctaagcatattaaag

SEQ ID NO: 418317 - DNA, 20 bp, Artificial Sequence
  chemically synthesized
tagtaggacattaacaatac

SEQ ID NO: 418318 - DNA, 20 bp, Artificial Sequence
  chemically synthesized
gtattgttaatgtcctacta

SEQ ID NO: 418319 - DNA, 20 bp, Artificial Sequence
  chemically synthesized
tgtattttcctagctttagt

SEQ ID NO: 418320 - DNA, 20 bp, Artificial Sequence
  chemically synthesized
tgttaatgtcctactaaagc

SEQ ID NO: 418321 - DNA, 20 bp, Artificial Sequence
  chemically synthesized
ctgtattttcctagctttag

SEQ ID NO: 418322 - DNA, 20 bp, Artificial Sequence
  chemically synthesized
gttaatgtcctactaaagct

SEQ ID NO: 418323 - DNA, 20 bp, Artificial Sequence
  chemically synthesized
aaactgtattttcctagctt

SEQ ID NO: 418324 - DNA, 20 bp, Artificial Sequence
  chemically synthesized
atccaaaaactgtattttcc

SEQ ID NO: 418325 - DNA, 20 bp, Artificial Sequence
  chemically synthesized
ctactaaagctaggaaaata

SEQ ID NO: 418326 - DNA, 20 bp, Artificial Sequence
  chemically synthesized
agctaggaaaatacagtttt

SEQ ID NO: 418327 - DNA, 20 bp, Artificial Sequence
  chemically synthesized
ggaaaatacagtttttggat

SEQ ID NO: 418328 - DNA, 20 bp, Artificial Sequence
  chemically synthesized
tttggatcagatctaaattt

SEQ ID NO: 418329 - DNA, 20 bp, Artificial Sequence
  chemically synthesized
gcagaatctagacttaaatt

SEQ ID NO: 418330 - DNA, 20 bp, Artificial Sequence
  chemically synthesized
atcagatctaaatttaagtc

SEQ ID NO: 418331 - DNA, 20 bp, Artificial Sequence
  chemically synthesized
agctcctaggtggcagaatc

SEQ ID NO: 418332 - DNA, 20 bp, Artificial Sequence
  chemically synthesized
taagtctagattctgccacc

SEQ ID NO: 418333 - DNA, 20 bp, Artificial Sequence
  chemically synthesized
aagtctagattctgccacct

SEQ ID NO: 418334 - DNA, 20 bp, Artificial Sequence
  chemically synthesized
attttacagctcctaggtgg

SEQ ID NO: 418335 - DNA, 20 bp, Artificial Sequence
  chemically synthesized
gtctagattctgccacctag

SEQ ID NO: 418336 - DNA, 20 bp, Artificial Sequence
  chemically synthesized
aagattttacagctcctagg

SEQ ID NO: 418337 - DNA, 20 bp, Artificial Sequence
  chemically synthesized
cacaagattttacagctcct

SEQ ID NO: 418338 - DNA, 20 bp, Artificial Sequence
  chemically synthesized
acacaagattttacagctcc

SEQ ID NO: 418339 - DNA, 20 bp, Artificial Sequence
  chemically synthesized
gtaatttacacaagatttta

SEQ ID NO: 418340 - DNA, 20 bp, Artificial Sequence
  chemically synthesized
gatttttcagtaatttacac

SEQ ID NO: 418341 - DNA, 20 bp, Artificial Sequence
  chemically synthesized
tagggttcagagagattttt

SEQ ID NO: 418342 - DNA, 20 bp, Artificial Sequence
  chemically synthesized
tatagataatagggttcaga

SEQ ID NO: 418343 - DNA, 20 bp, Artificial Sequence
  chemically synthesized
aatatagataatagggttca

SEQ ID NO: 418344 - DNA, 20 bp, Artificial Sequence
  chemically synthesized
tcaatatagataatagggtt

SEQ ID NO: 418345 - DNA, 20 bp, Artificial Sequence
  chemically synthesized
attcatcaatatagataata

SEQ ID NO: 418346 - DNA, 20 bp, Artificial Sequence
  chemically synthesized
cattcatcaatatagataat

SEQ ID NO: 418347 - DNA, 20 bp, Artificial Sequence
  chemically synthesized
ccattcatcaatatagataa

SEQ ID NO: 418348 - DNA, 20 bp, Artificial Sequence
  chemically synthesized
cttatgcccattcatcaata

SEQ ID NO: 418349 - DNA, 20 bp, Artificial Sequence
  chemically synthesized
ctattatctatattgatgaa

SEQ ID NO: 418350 - DNA, 20 bp, Artificial Sequence
  chemically synthesized
tattatctatattgatgaat

SEQ ID NO: 418351 - DNA, 20 bp, Artificial Sequence
  chemically synthesized
ctatattgatgaatgggcat

SEQ ID NO: 418352 - DNA, 20 bp, Artificial Sequence
  chemically synthesized
atattgatgaatgggcataa

SEQ ID NO: 418353 - DNA, 20 bp, Artificial Sequence
  chemically synthesized
gggcataagagaaactactt

SEQ ID NO: 418354 - DNA, 20 bp, Artificial Sequence
  chemically synthesized
ggcataagagaaactacttc

SEQ ID NO: 418355 - DNA, 20 bp, Artificial Sequence
  chemically synthesized
ccaccgcacctggcctgaag

SEQ ID NO: 418356 - DNA, 20 bp, Artificial Sequence
  chemically synthesized
taagagaaactacttcaggc

SEQ ID NO: 418357 - DNA, 20 bp, Artificial Sequence
  chemically synthesized
aagagaaactacttcaggcc

SEQ ID NO: 418358 - DNA, 20 bp, Artificial Sequence
  chemically synthesized
gagccaccgcacctggcctg

SEQ ID NO: 418359 - DNA, 20 bp, Artificial Sequence
  chemically synthesized
aaactacttcaggccaggtg

SEQ ID NO: 418360 - DNA, 20 bp, Artificial Sequence
  chemically synthesized
ctacttcaggccaggtgcgg

SEQ ID NO: 418361 - DNA, 20 bp, Artificial Sequence
  chemically synthesized
tgggcgtgagccaccgcacc

SEQ ID NO: 418362 - DNA, 20 bp, Artificial Sequence
  chemically synthesized
agtgctgagattatgggcgt

SEQ ID NO: 418363 - DNA, 20 bp, Artificial Sequence
  chemically synthesized
gtggctcacgcccataatct

SEQ ID NO: 418364 - DNA, 20 bp, Artificial Sequence
  chemically synthesized
tcccaaagtgctgagattat

SEQ ID NO: 418365 - DNA, 20 bp, Artificial Sequence
  chemically synthesized
ctcccaaagtgctgagatta

SEQ ID NO: 418366 - DNA, 20 bp, Artificial Sequence
  chemically synthesized
cgcccataatctcagcactt

SEQ ID NO: 418367 - DNA, 20 bp, Artificial Sequence
  chemically synthesized
cctcggcctcccaaagtgct

SEQ ID NO: 418368 - DNA, 20 bp, Artificial Sequence
  chemically synthesized
gcccataatctcagcacttt

SEQ ID NO: 418369 - DNA, 20 bp, Artificial Sequence
  chemically synthesized
ccataatctcagcactttgg

SEQ ID NO: 418370 - DNA, 20 bp, Artificial Sequence
  chemically synthesized
cataatctcagcactttggg

SEQ ID NO: 418371 - DNA, 20 bp, Artificial Sequence
  chemically synthesized
ccgcgtgcctcggcctccca

SEQ ID NO: 418372 - DNA, 20 bp, Artificial Sequence
  chemically synthesized
tctcagcactttgggaggcc

SEQ ID NO: 418373 - DNA, 20 bp, Artificial Sequence
  chemically synthesized
ctcagcactttgggaggccg

SEQ ID NO: 418374 - DNA, 20 bp, Artificial Sequence
  chemically synthesized
ctttgggaggccgaggcacg

SEQ ID NO: 418375 - DNA, 20 bp, Artificial Sequence
  chemically synthesized
ctcaggtgatccgcgtgcct

SEQ ID NO: 418376 - DNA, 20 bp, Artificial Sequence
  chemically synthesized
ccgaggcacgcggatcacct

SEQ ID NO: 418377 - DNA, 20 bp, Artificial Sequence
  chemically synthesized
cgaggcacgcggatcacctg

SEQ ID NO: 418378 - DNA, 20 bp, Artificial Sequence
  chemically synthesized
gcacgcggatcacctgaggt

SEQ ID NO: 418379 - DNA, 20 bp, Artificial Sequence
  chemically synthesized
cacgcggatcacctgaggtc

SEQ ID NO: 418380 - DNA, 20 bp, Artificial Sequence
  chemically synthesized
ggtctcgaactcctgacctc

SEQ ID NO: 418381 - DNA, 20 bp, Artificial Sequence
  chemically synthesized
cgcggatcacctgaggtcag

SEQ ID NO: 418382 - DNA, 20 bp, Artificial Sequence
  chemically synthesized
tggtctcgaactcctgacct

SEQ ID NO: 418383 - DNA, 20 bp, Artificial Sequence
  chemically synthesized
tcacctgaggtcaggagttc

SEQ ID NO: 418384 - DNA, 20 bp, Artificial Sequence
  chemically synthesized
tgaggtcaggagttcgagac

SEQ ID NO: 418385 - DNA, 20 bp, Artificial Sequence
  chemically synthesized
tcaggagttcgagaccagcc

SEQ ID NO: 418386 - DNA, 20 bp, Artificial Sequence
  chemically synthesized
tcactatacgttggccaggc

SEQ ID NO: 418387 - DNA, 20 bp, Artificial Sequence
  chemically synthesized
ggtttcactatacgttggcc

SEQ ID NO: 418388 - DNA, 20 bp, Artificial Sequence
  chemically synthesized
gggtttcactatacgttggc

SEQ ID NO: 418389 - DNA, 20 bp, Artificial Sequence
  chemically synthesized
agaccagcctggccaacgta

SEQ ID NO: 418390 - DNA, 20 bp, Artificial Sequence
  chemically synthesized
gacggggtttcactatacgt

SEQ ID NO: 418391 - DNA, 20 bp, Artificial Sequence
  chemically synthesized
tgtattttttagtagagacg

SEQ ID NO: 418392 - DNA, 20 bp, Artificial Sequence
  chemically synthesized
ctgtattttttagtagagac

SEQ ID NO: 418393 - DNA, 20 bp, Artificial Sequence
  chemically synthesized
tctgtattttttagtagaga

SEQ ID NO: 418394 - DNA, 20 bp, Artificial Sequence
  chemically synthesized
aatttctgtattttttagta

SEQ ID NO: 418395 - DNA, 20 bp, Artificial Sequence
  chemically synthesized
ctaatttctgtattttttag

SEQ ID NO: 418396 - DNA, 20 bp, Artificial Sequence
  chemically synthesized
cccgtctctactaaaaaata

SEQ ID NO: 418397 - DNA, 20 bp, Artificial Sequence
  chemically synthesized
cagctaatttctgtattttt

SEQ ID NO: 418398 - DNA, 20 bp, Artificial Sequence
  chemically synthesized
ctactaaaaaatacagaaat

SEQ ID NO: 418399 - DNA, 20 bp, Artificial Sequence
  chemically synthesized
taaaaaatacagaaattagc

SEQ ID NO: 418400 - DNA, 20 bp, Artificial Sequence
  chemically synthesized
aaaaaatacagaaattagct

SEQ ID NO: 418401 - DNA, 20 bp, Artificial Sequence
  chemically synthesized
atacagaaattagctgggcg

SEQ ID NO: 418402 - DNA, 20 bp, Artificial Sequence
  chemically synthesized
cagaaattagctgggcgtgg

SEQ ID NO: 418403 - DNA, 20 bp, Artificial Sequence
  chemically synthesized
caggcatgtgccaccacgcc

SEQ ID NO: 418404 - DNA, 20 bp, Artificial Sequence
  chemically synthesized
ggcgtggtggcacatgcctg

SEQ ID NO: 418405 - DNA, 20 bp, Artificial Sequence
  chemically synthesized
gtggcacatgcctgtagtcc

SEQ ID NO: 418406 - DNA, 20 bp, Artificial Sequence
  chemically synthesized
tcccaagtagctgggactac

SEQ ID NO: 418407 - DNA, 20 bp, Artificial Sequence
  chemically synthesized
ttcccaagtagctgggacta

SEQ ID NO: 418408 - DNA, 20 bp, Artificial Sequence
  chemically synthesized
tgcctgtagtcccagctact

SEQ ID NO: 418409 - DNA, 20 bp, Artificial Sequence
  chemically synthesized
ccttagcttcccaagtagct

SEQ ID NO: 418410 - DNA, 20 bp, Artificial Sequence
  chemically synthesized
gcctgtagtcccagctactt

SEQ ID NO: 418411 - DNA, 20 bp, Artificial Sequence
  chemically synthesized
gccttagcttcccaagtagc

SEQ ID NO: 418412 - DNA, 20 bp, Artificial Sequence
  chemically synthesized
tgtagtcccagctacttggg

SEQ ID NO: 418413 - DNA, 20 bp, Artificial Sequence
  chemically synthesized
tcctgccttagcttcccaag

SEQ ID NO: 418414 - DNA, 20 bp, Artificial Sequence
  chemically synthesized
ttctcctgccttagcttccc

SEQ ID NO: 418415 - DNA, 20 bp, Artificial Sequence
  chemically synthesized
tcccagctacttgggaagct

SEQ ID NO: 418416 - DNA, 20 bp, Artificial Sequence
  chemically synthesized
cccagctacttgggaagcta

SEQ ID NO: 418417 - DNA, 20 bp, Artificial Sequence
  chemically synthesized
agctacttgggaagctaagg

SEQ ID NO: 418418 - DNA, 20 bp, Artificial Sequence
  chemically synthesized
gctacttgggaagctaaggc

SEQ ID NO: 418419 - DNA, 20 bp, Artificial Sequence
  chemically synthesized
tacttgggaagctaaggcag

SEQ ID NO: 418420 - DNA, 20 bp, Artificial Sequence
  chemically synthesized
ttcaagcgattctcctgcct

SEQ ID NO: 418421 - DNA, 20 bp, Artificial Sequence
  chemically synthesized
ggcaggagaatcgcttgaac

SEQ ID NO: 418422 - DNA, 20 bp, Artificial Sequence
  chemically synthesized
gcaggagaatcgcttgaacc

SEQ ID NO: 418423 - DNA, 20 bp, Artificial Sequence
  chemically synthesized
caggagaatcgcttgaacca

SEQ ID NO: 418424 - DNA, 20 bp, Artificial Sequence
  chemically synthesized
aacctccgcctccctggttc

SEQ ID NO: 418425 - DNA, 20 bp, Artificial Sequence
  chemically synthesized
ggagaatcgcttgaaccagg

SEQ ID NO: 418426 - DNA, 20 bp, Artificial Sequence
  chemically synthesized
gagaatcgcttgaaccaggg

SEQ ID NO: 418427 - DNA, 20 bp, Artificial Sequence
  chemically synthesized
aatcgcttgaaccagggagg

SEQ ID NO: 418428 - DNA, 20 bp, Artificial Sequence
  chemically synthesized
cgctgcaacctccgcctccc

SEQ ID NO: 418429 - DNA, 20 bp, Artificial Sequence
  chemically synthesized
tcgcttgaaccagggaggcg

SEQ ID NO: 418430 - DNA, 20 bp, Artificial Sequence
  chemically synthesized
cgcttgaaccagggaggcgg

SEQ ID NO: 418431 - DNA, 20 bp, Artificial Sequence
  chemically synthesized
aaccagggaggcggaggttg

SEQ ID NO: 418432 - DNA, 20 bp, Artificial Sequence
  chemically synthesized
cagggaggcggaggttgcag

SEQ ID NO: 418433 - DNA, 20 bp, Artificial Sequence
  chemically synthesized
agggaggcggaggttgcagc

SEQ ID NO: 418434 - DNA, 20 bp, Artificial Sequence
  chemically synthesized
gaggcggaggttgcagcggg

SEQ ID NO: 418435 - DNA, 20 bp, Artificial Sequence
  chemically synthesized
ggcggaggttgcagcgggca

SEQ ID NO: 418436 - DNA, 20 bp, Artificial Sequence
  chemically synthesized
ttgcccaggctggagtgcag

SEQ ID NO: 418437 - DNA, 20 bp, Artificial Sequence
  chemically synthesized
gagatcgtgccactgcactc

SEQ ID NO: 418438 - DNA, 20 bp, Artificial Sequence
  chemically synthesized
ctgttgcccaggctggagtg

SEQ ID NO: 418439 - DNA, 20 bp, Artificial Sequence
  chemically synthesized
cgtgccactgcactccagcc

SEQ ID NO: 418440 - DNA, 20 bp, Artificial Sequence
  chemically synthesized
gtgccactgcactccagcct

SEQ ID NO: 418441 - DNA, 20 bp, Artificial Sequence
  chemically synthesized
ttgctctgttgcccaggctg

SEQ ID NO: 418442 - DNA, 20 bp, Artificial Sequence
  chemically synthesized
tcttgctctgttgcccaggc

SEQ ID NO: 418443 - DNA, 20 bp, Artificial Sequence
  chemically synthesized
ctgcactccagcctgggcaa

SEQ ID NO: 418444 - DNA, 20 bp, Artificial Sequence
  chemically synthesized
ggagtcttgctctgttgccc

SEQ ID NO: 418445 - DNA, 20 bp, Artificial Sequence
  chemically synthesized
gcactccagcctgggcaaca

SEQ ID NO: 418446 - DNA, 20 bp, Artificial Sequence
  chemically synthesized
tggagtcttgctctgttgcc

SEQ ID NO: 418447 - DNA, 20 bp, Artificial Sequence
  chemically synthesized
tccagcctgggcaacagagc

SEQ ID NO: 418448 - DNA, 20 bp, Artificial Sequence
  chemically synthesized
ttttctttttttgagagatg

SEQ ID NO: 418449 - DNA, 20 bp, Artificial Sequence
  chemically synthesized
tcttttctttttttgagaga

SEQ ID NO: 418450 - DNA, 20 bp, Artificial Sequence
  chemically synthesized
aagactccatctctcaaaaa

SEQ ID NO: 418451 - DNA, 20 bp, Artificial Sequence
  chemically synthesized
cttttcttttctttttttga

SEQ ID NO: 418452 - DNA, 20 bp, Artificial Sequence
  chemically synthesized
ttcttttcttttcttttttt

SEQ ID NO: 418453 - DNA, 20 bp, Artificial Sequence
  chemically synthesized
tccatctctcaaaaaaagaa

SEQ ID NO: 418454 - DNA, 20 bp, Artificial Sequence
  chemically synthesized
ctctcaaaaaaagaaaagaa

SEQ ID NO: 418455 - DNA, 20 bp, Artificial Sequence
  chemically synthesized
tcaaaaaaagaaaagaaaag

SEQ ID NO: 418456 - DNA, 20 bp, Artificial Sequence
  chemically synthesized
aaaagaaaagaagaaaaaaa

SEQ ID NO: 418457 - DNA, 20 bp, Artificial Sequence
  chemically synthesized
gaaaagaagaaaaaaaaaga

SEQ ID NO: 418458 - DNA, 20 bp, Artificial Sequence
  chemically synthesized
gaaagaaaaactacttcaaa

SEQ ID NO: 418459 - DNA, 20 bp, Artificial Sequence
  chemically synthesized
ttcccaaaagccatttgaag

SEQ ID NO: 418460 - DNA, 20 bp, Artificial Sequence
  chemically synthesized
ttcttcccaaaagccatttg

SEQ ID NO: 418461 - DNA, 20 bp, Artificial Sequence
  chemically synthesized
aaactacttcaaatggcttt

SEQ ID NO: 418462 - DNA, 20 bp, Artificial Sequence
  chemically synthesized
aactacttcaaatggctttt

SEQ ID NO: 418463 - DNA, 20 bp, Artificial Sequence
  chemically synthesized
tacttcaaatggcttttggg

SEQ ID NO: 418464 - DNA, 20 bp, Artificial Sequence
  chemically synthesized
atcacattagttcttcccaa

SEQ ID NO: 418465 - DNA, 20 bp, Artificial Sequence
  chemically synthesized
tttgggaagaactaatgtga

SEQ ID NO: 418466 - DNA, 20 bp, Artificial Sequence
  chemically synthesized
ttcaacacacactatcacat

SEQ ID NO: 418467 - DNA, 20 bp, Artificial Sequence
  chemically synthesized
gatagtgtgtgttgaatgcg

SEQ ID NO: 418468 - DNA, 20 bp, Artificial Sequence
  chemically synthesized
gttgaatgcgtagtgcctga

SEQ ID NO: 418469 - DNA, 20 bp, Artificial Sequence
  chemically synthesized
tttattaattatgcactatc

SEQ ID NO: 418470 - DNA, 20 bp, Artificial Sequence
  chemically synthesized
atttattaattatgcactat

SEQ ID NO: 418471 - DNA, 20 bp, Artificial Sequence
  chemically synthesized
tacttcctcattttagaaaa

SEQ ID NO: 418472 - DNA, 20 bp, Artificial Sequence
  chemically synthesized
ttacttcctcattttagaaa

SEQ ID NO: 418473 - DNA, 20 bp, Artificial Sequence
  chemically synthesized
tttacttcctcattttagaa

SEQ ID NO: 418474 - DNA, 20 bp, Artificial Sequence
  chemically synthesized
tttattcccttttctaaaat

SEQ ID NO: 418475 - DNA, 20 bp, Artificial Sequence
  chemically synthesized
ttattcccttttctaaaatg

SEQ ID NO: 418476 - DNA, 20 bp, Artificial Sequence
  chemically synthesized
tattatttacttcctcattt

SEQ ID NO: 418477 - DNA, 20 bp, Artificial Sequence
  chemically synthesized
ttcccttttctaaaatgagg

SEQ ID NO: 418478 - DNA, 20 bp, Artificial Sequence
  chemically synthesized
aaatgaggaagtaaataata

SEQ ID NO: 418479 - DNA, 20 bp, Artificial Sequence
  chemically synthesized
tgtgaatataatttaaaaaa

SEQ ID NO: 418480 - DNA, 20 bp, Artificial Sequence
  chemically synthesized
cttgtgaatataatttaaaa

SEQ ID NO: 418481 - DNA, 20 bp, Artificial Sequence
  chemically synthesized
cttttttaaattatattcac

SEQ ID NO: 418482 - DNA, 20 bp, Artificial Sequence
  chemically synthesized
ttttttaaattatattcaca

SEQ ID NO: 418483 - DNA, 20 bp, Artificial Sequence
  chemically synthesized
tttaaattatattcacaagg

SEQ ID NO: 418484 - DNA, 20 bp, Artificial Sequence
  chemically synthesized
ttactgatatagagggaaac

SEQ ID NO: 418485 - DNA, 20 bp, Artificial Sequence
  chemically synthesized
agacttgtttccctctatat

SEQ ID NO: 418486 - DNA, 20 bp, Artificial Sequence
  chemically synthesized
aacaagcttactgatataga

SEQ ID NO: 418487 - DNA, 20 bp, Artificial Sequence
  chemically synthesized
aaacaagcttactgatatag

SEQ ID NO: 418488 - DNA, 20 bp, Artificial Sequence
  chemically synthesized
taaacaagcttactgatata

SEQ ID NO: 418489 - DNA, 20 bp, Artificial Sequence
  chemically synthesized
ttgtttccctctatatcagt

SEQ ID NO: 418490 - DNA, 20 bp, Artificial Sequence
  chemically synthesized
aataaacaagcttactgata

SEQ ID NO: 418491 - DNA, 20 bp, Artificial Sequence
  chemically synthesized
gagccagtttaaaaataaac

SEQ ID NO: 418492 - DNA, 20 bp, Artificial Sequence
  chemically synthesized
aagcttgtttatttttaaac

SEQ ID NO: 418493 - DNA, 20 bp, Artificial Sequence
  chemically synthesized
gtttatttttaaactggctc

SEQ ID NO: 418494 - DNA, 20 bp, Artificial Sequence
  chemically synthesized
tttatttttaaactggctca

SEQ ID NO: 418495 - DNA, 20 bp, Artificial Sequence
  chemically synthesized
tatcttcaattgccttgagc

SEQ ID NO: 418496 - DNA, 20 bp, Artificial Sequence
  chemically synthesized
gaaatatcttcaattgcctt

SEQ ID NO: 418497 - DNA, 20 bp, Artificial Sequence
  chemically synthesized
aaactggctcaaggcaattg

SEQ ID NO: 418498 - DNA, 20 bp, Artificial Sequence
  chemically synthesized
caaggcaattgaagatattt

SEQ ID NO: 418499 - DNA, 20 bp, Artificial Sequence
  chemically synthesized
attgaagatatttcagataa

SEQ ID NO: 418500 - DNA, 20 bp, Artificial Sequence
  chemically synthesized
gaagatatttcagataacag

SEQ ID NO: 418501 - DNA, 20 bp, Artificial Sequence
  chemically synthesized
tgaataccaagaggatggaa

SEQ ID NO: 418502 - DNA, 20 bp, Artificial Sequence
  chemically synthesized
ttgaataccaagaggatgga

SEQ ID NO: 418503 - DNA, 20 bp, Artificial Sequence
  chemically synthesized
agttaacctttccatcctct

SEQ ID NO: 418504 - DNA, 20 bp, Artificial Sequence
  chemically synthesized
gaatttgaataccaagagga

SEQ ID NO: 418505 - DNA, 20 bp, Artificial Sequence
  chemically synthesized
gaaagaatttgaataccaag

SEQ ID NO: 418506 - DNA, 20 bp, Artificial Sequence
  chemically synthesized
agaaagaatttgaataccaa

SEQ ID NO: 418507 - DNA, 20 bp, Artificial Sequence
  chemically synthesized
ggagaaagaatttgaatacc

SEQ ID NO: 418508 - DNA, 20 bp, Artificial Sequence
  chemically synthesized
gaaagttttatcaaaggaga

SEQ ID NO: 418509 - DNA, 20 bp, Artificial Sequence
  chemically synthesized
ctttgaaagttttatcaaag

SEQ ID NO: 418510 - DNA, 20 bp, Artificial Sequence
  chemically synthesized
ttctttgaaagttttatcaa

SEQ ID NO: 418511 - DNA, 20 bp, Artificial Sequence
  chemically synthesized
cttctttgaaagttttatca

SEQ ID NO: 418512 - DNA, 20 bp, Artificial Sequence
  chemically synthesized
ctcctttgataaaactttca

SEQ ID NO: 418513 - DNA, 20 bp, Artificial Sequence
  chemically synthesized
ctttgataaaactttcaaag

SEQ ID NO: 418514 - DNA, 20 bp, Artificial Sequence
  chemically synthesized
tttgataaaactttcaaaga

SEQ ID NO: 418515 - DNA, 20 bp, Artificial Sequence
  chemically synthesized
acattgaaaaccttctttga

SEQ ID NO: 418516 - DNA, 20 bp, Artificial Sequence
  chemically synthesized
aacgtcaacttgaaatcatt

SEQ ID NO: 418517 - DNA, 20 bp, Artificial Sequence
  chemically synthesized
tgtttattccaaatgatttc

SEQ ID NO: 418518 - DNA, 20 bp, Artificial Sequence
  chemically synthesized
tgatttcaagttgacgttat

SEQ ID NO: 418519 - DNA, 20 bp, Artificial Sequence
  chemically synthesized
gacgttataagttcaaatta

SEQ ID NO: 418520 - DNA, 20 bp, Artificial Sequence
  chemically synthesized
ttagaaaagtttaggaagtt

SEQ ID NO: 418521 - DNA, 20 bp, Artificial Sequence
  chemically synthesized
ctgtcttagaaaagtttagg

SEQ ID NO: 418522 - DNA, 20 bp, Artificial Sequence
  chemically synthesized
ttactgtcttagaaaagttt

SEQ ID NO: 418523 - DNA, 20 bp, Artificial Sequence
  chemically synthesized
tttactgtcttagaaaagtt

SEQ ID NO: 418524 - DNA, 20 bp, Artificial Sequence
  chemically synthesized
caaacttcctaaacttttct

SEQ ID NO: 418525 - DNA, 20 bp, Artificial Sequence
  chemically synthesized
gttattttactgtcttagaa

SEQ ID NO: 418526 - DNA, 20 bp, Artificial Sequence
  chemically synthesized
cttcctaaacttttctaaga

SEQ ID NO: 418527 - DNA, 20 bp, Artificial Sequence
  chemically synthesized
caatggttattttactgtct

SEQ ID NO: 418528 - DNA, 20 bp, Artificial Sequence
  chemically synthesized
tccgtgagcctaaagaacaa

SEQ ID NO: 418529 - DNA, 20 bp, Artificial Sequence
  chemically synthesized
gtaaaataaccattgttctt

SEQ ID NO: 418530 - DNA, 20 bp, Artificial Sequence
  chemically synthesized
taaaataaccattgttcttt

SEQ ID NO: 418531 - DNA, 20 bp, Artificial Sequence
  chemically synthesized
ctatgaagtccgtgagccta

SEQ ID NO: 418532 - DNA, 20 bp, Artificial Sequence
  chemically synthesized
accattgttctttaggctca

SEQ ID NO: 418533 - DNA, 20 bp, Artificial Sequence
  chemically synthesized
tgacagtctatgaagtccgt

SEQ ID NO: 418534 - DNA, 20 bp, Artificial Sequence
  chemically synthesized
ctttaggctcacggacttca

SEQ ID NO: 418535 - DNA, 20 bp, Artificial Sequence
  chemically synthesized
ataaaacgtgacagtctatg

SEQ ID NO: 418536 - DNA, 20 bp, Artificial Sequence
  chemically synthesized
ctgaaataaataaaacgtga

SEQ ID NO: 418537 - DNA, 20 bp, Artificial Sequence
  chemically synthesized
ctgtcacgttttatttattt

SEQ ID NO: 418538 - DNA, 20 bp, Artificial Sequence
  chemically synthesized
tgtcacgttttatttatttc

SEQ ID NO: 418539 - DNA, 20 bp, Artificial Sequence
  chemically synthesized
aggtttgttgtttgccacaa

SEQ ID NO: 418540 - DNA, 20 bp, Artificial Sequence
  chemically synthesized
aaagagaagaatgtctattg

SEQ ID NO: 418541 - DNA, 20 bp, Artificial Sequence
  chemically synthesized
tattattttatttcaaagag

SEQ ID NO: 418542 - DNA, 20 bp, Artificial Sequence
  chemically synthesized
aaatattattttatttcaaa

SEQ ID NO: 418543 - DNA, 20 bp, Artificial Sequence
  chemically synthesized
ggaaatattattttatttca

SEQ ID NO: 418544 - DNA, 20 bp, Artificial Sequence
  chemically synthesized
ttatctcaaggaataaatag

SEQ ID NO: 418545 - DNA, 20 bp, Artificial Sequence
  chemically synthesized
gttatctcaaggaataaata

SEQ ID NO: 418546 - DNA, 20 bp, Artificial Sequence
  chemically synthesized
gagttatctcaaggaataaa

SEQ ID NO: 418547 - DNA, 20 bp, Artificial Sequence
  chemically synthesized
atttcctctatttattcctt

SEQ ID NO: 418548 - DNA, 20 bp, Artificial Sequence
  chemically synthesized
taaattttagagttatctca

SEQ ID NO: 418549 - DNA, 20 bp, Artificial Sequence
  chemically synthesized
ataaattttagagttatctc

SEQ ID NO: 418550 - DNA, 20 bp, Artificial Sequence
  chemically synthesized
cttttaatgaataaatttta

SEQ ID NO: 418551 - DNA, 20 bp, Artificial Sequence
  chemically synthesized
ttcttttaatgaataaattt

SEQ ID NO: 418552 - DNA, 20 bp, Artificial Sequence
  chemically synthesized
ctctaaaatttattcattaa

SEQ ID NO: 418553 - DNA, 20 bp, Artificial Sequence
  chemically synthesized
cattaaaagaatcgtccttt

SEQ ID NO: 418554 - DNA, 20 bp, Artificial Sequence
  chemically synthesized
ttttccaaaattatacttaa

SEQ ID NO: 418555 - DNA, 20 bp, Artificial Sequence
  chemically synthesized
tttttccaaaattatactta

SEQ ID NO: 418556 - DNA, 20 bp, Artificial Sequence
  chemically synthesized
tcgtcctttaagtataattt

SEQ ID NO: 418557 - DNA, 20 bp, Artificial Sequence
  chemically synthesized
taagtataattttggaaaaa

SEQ ID NO: 418558 - DNA, 20 bp, Artificial Sequence
  chemically synthesized
tggaaaaaaagaaacttcca

SEQ ID NO: 418559 - DNA, 20 bp, Artificial Sequence
  chemically synthesized
gaaaaaaagaaacttccaaa

SEQ ID NO: 418560 - DNA, 20 bp, Artificial Sequence
  chemically synthesized
aaaaaaagaaacttccaaag

SEQ ID NO: 418561 - DNA, 20 bp, Artificial Sequence
  chemically synthesized
gggtaatatctcctctttgg

SEQ ID NO: 418562 - DNA, 20 bp, Artificial Sequence
  chemically synthesized
aaaaagaaacttccaaagag

SEQ ID NO: 418563 - DNA, 20 bp, Artificial Sequence
  chemically synthesized
ctggggtaatatctcctctt

SEQ ID NO: 418564 - DNA, 20 bp, Artificial Sequence
  chemically synthesized
ccaaagaggagatattaccc

SEQ ID NO: 418565 - DNA, 20 bp, Artificial Sequence
  chemically synthesized
aagaggagatattaccccag

SEQ ID NO: 418566 - DNA, 20 bp, Artificial Sequence
  chemically synthesized
agaggagatattaccccaga

SEQ ID NO: 418567 - DNA, 20 bp, Artificial Sequence
  chemically synthesized
caaaaaaaaccagccttctg

SEQ ID NO: 418568 - DNA, 20 bp, Artificial Sequence
  chemically synthesized
gagatattaccccagaaggc

SEQ ID NO: 418569 - DNA, 20 bp, Artificial Sequence
  chemically synthesized
acaaaaaaaaccagccttct

SEQ ID NO: 418570 - DNA, 20 bp, Artificial Sequence
  chemically synthesized
aacaaaaaaaaccagccttc

SEQ ID NO: 418571 - DNA, 20 bp, Artificial Sequence
  chemically synthesized
aaaaaaaaaacaaaaaaaac

SEQ ID NO: 418572 - DNA, 20 bp, Artificial Sequence
  chemically synthesized
ttttgttttttttttttttt

SEQ ID NO: 418573 - DNA, 20 bp, Artificial Sequence
  chemically synthesized
taacacctgagtttttaaag

SEQ ID NO: 418574 - DNA, 20 bp, Artificial Sequence
  chemically synthesized
ctgtaacacctgagttttta

SEQ ID NO: 418575 - DNA, 20 bp, Artificial Sequence
  chemically synthesized
agtattccactttaaaaact

SEQ ID NO: 418576 - DNA, 20 bp, Artificial Sequence
  chemically synthesized
gtattccactttaaaaactc

SEQ ID NO: 418577 - DNA, 20 bp, Artificial Sequence
  chemically synthesized
ctcagtgaactgtaacacct

SEQ ID NO: 418578 - DNA, 20 bp, Artificial Sequence
  chemically synthesized
ctttaaaaactcaggtgtta

SEQ ID NO: 418579 - DNA, 20 bp, Artificial Sequence
  chemically synthesized
ctcaggtgttacagttcact

SEQ ID NO: 418580 - DNA, 20 bp, Artificial Sequence
  chemically synthesized
gaaatccaatacattatgct

SEQ ID NO: 418581 - DNA, 20 bp, Artificial Sequence
  chemically synthesized
gttcactgagcataatgtat

SEQ ID NO: 418582 - DNA, 20 bp, Artificial Sequence
  chemically synthesized
agcataatgtattggatttc

SEQ ID NO: 418583 - DNA, 20 bp, Artificial Sequence
  chemically synthesized
gcataatgtattggatttct

SEQ ID NO: 418584 - DNA, 20 bp, Artificial Sequence
  chemically synthesized
tattggatttctgggaatta

SEQ ID NO: 418585 - DNA, 20 bp, Artificial Sequence
  chemically synthesized
ataacattgcctttaattcc

SEQ ID NO: 418586 - DNA, 20 bp, Artificial Sequence
  chemically synthesized
attggatttctgggaattaa

SEQ ID NO: 418587 - DNA, 20 bp, Artificial Sequence
  chemically synthesized
aaaggcaatgttatttgaca

SEQ ID NO: 418588 - DNA, 20 bp, Artificial Sequence
  chemically synthesized
ttgacaaagttctaattaac

SEQ ID NO: 418589 - DNA, 20 bp, Artificial Sequence
  chemically synthesized
taactgtacaaccagttaat

SEQ ID NO: 418590 - DNA, 20 bp, Artificial Sequence
  chemically synthesized
gttctaattaactggttgta

SEQ ID NO: 418591 - DNA, 20 bp, Artificial Sequence
  chemically synthesized
aaaaattttaactgtacaac

SEQ ID NO: 418592 - DNA, 20 bp, Artificial Sequence
  chemically synthesized
ttatctgatgagaaaatttg

SEQ ID NO: 418593 - DNA, 20 bp, Artificial Sequence
  chemically synthesized
ttttcttcaaattttctcat

SEQ ID NO: 418594 - DNA, 20 bp, Artificial Sequence
  chemically synthesized
tatttgagaggttatctgat

SEQ ID NO: 418595 - DNA, 20 bp, Artificial Sequence
  chemically synthesized
ttgatgagaaaatatttgag

SEQ ID NO: 418596 - DNA, 20 bp, Artificial Sequence
  chemically synthesized
tttgatgagaaaatatttga

SEQ ID NO: 418597 - DNA, 20 bp, Artificial Sequence
  chemically synthesized
tatttgatgagaaaatattt

SEQ ID NO: 418598 - DNA, 20 bp, Artificial Sequence
  chemically synthesized
tttctaagaagttatttgat

SEQ ID NO: 418599 - DNA, 20 bp, Artificial Sequence
  chemically synthesized
tttctcatcaaataacttct

SEQ ID NO: 418600 - DNA, 20 bp, Artificial Sequence
  chemically synthesized
ataaaacctccatttctaag

SEQ ID NO: 418601 - DNA, 20 bp, Artificial Sequence
  chemically synthesized
atcaaataacttcttagaaa

SEQ ID NO: 418602 - DNA, 20 bp, Artificial Sequence
  chemically synthesized
caaataacttcttagaaatg

SEQ ID NO: 418603 - DNA, 20 bp, Artificial Sequence
  chemically synthesized
aaaataaaacctccatttct

SEQ ID NO: 418604 - DNA, 20 bp, Artificial Sequence
  chemically synthesized
aaataacttcttagaaatgg

SEQ ID NO: 418605 - DNA, 20 bp, Artificial Sequence
  chemically synthesized
atggaggttttattttaaaa

SEQ ID NO: 418606 - DNA, 20 bp, Artificial Sequence
  chemically synthesized
aggttttattttaaaaaaga

SEQ ID NO: 418607 - DNA, 20 bp, Artificial Sequence
  chemically synthesized
gacagtgttacatttaatgc

SEQ ID NO: 418608 - DNA, 20 bp, Artificial Sequence
  chemically synthesized
acagtgttacatttaatgct

SEQ ID NO: 418609 - DNA, 20 bp, Artificial Sequence
  chemically synthesized
ctttaggaagatttcaatcc

SEQ ID NO: 418610 - DNA, 20 bp, Artificial Sequence
  chemically synthesized
ctaggattgaaatcttccta

SEQ ID NO: 418611 - DNA, 20 bp, Artificial Sequence
  chemically synthesized
ggattgaaatcttcctaaag

SEQ ID NO: 418612 - DNA, 20 bp, Artificial Sequence
  chemically synthesized
atttattctcccactttagg

SEQ ID NO: 418613 - DNA, 20 bp, Artificial Sequence
  chemically synthesized
gattgaaatcttcctaaagt

SEQ ID NO: 418614 - DNA, 20 bp, Artificial Sequence
  chemically synthesized
ttgaaatcttcctaaagtgg

SEQ ID NO: 418615 - DNA, 20 bp, Artificial Sequence
  chemically synthesized
attatttattctcccacttt

SEQ ID NO: 418616 - DNA, 20 bp, Artificial Sequence
  chemically synthesized
tattatttattctcccactt

SEQ ID NO: 418617 - DNA, 20 bp, Artificial Sequence
  chemically synthesized
tggaatcaataaagcattca

SEQ ID NO: 418618 - DNA, 20 bp, Artificial Sequence
  chemically synthesized
agtggaatcaataaagcatt

SEQ ID NO: 418619 - DNA, 20 bp, Artificial Sequence
  chemically synthesized
aaattgtagtggaatcaata

SEQ ID NO: 418620 - DNA, 20 bp, Artificial Sequence
  chemically synthesized
aacacatggacaaattgtag

SEQ ID NO: 418621 - DNA, 20 bp, Artificial Sequence
  chemically synthesized
ggtaacacatggacaaattg

SEQ ID NO: 418622 - DNA, 20 bp, Artificial Sequence
  chemically synthesized
tggtaacacatggtaacaca

SEQ ID NO: 418623 - DNA, 20 bp, Artificial Sequence
  chemically synthesized
ataccaagtatggtaacaca

SEQ ID NO: 418624 - DNA, 20 bp, Artificial Sequence
  chemically synthesized
ttaccatgtgttaccatact

SEQ ID NO: 418625 - DNA, 20 bp, Artificial Sequence
  chemically synthesized
atgaaataatataccaagta

SEQ ID NO: 418626 - DNA, 20 bp, Artificial Sequence
  chemically synthesized
tggatatgaaataatatacc

SEQ ID NO: 418627 - DNA, 20 bp, Artificial Sequence
  chemically synthesized
ttggtatattatttcatatc

SEQ ID NO: 418628 - DNA, 20 bp, Artificial Sequence
  chemically synthesized
ggtatattatttcatatcca

SEQ ID NO: 418629 - DNA, 20 bp, Artificial Sequence
  chemically synthesized
ttataagactgaatggactc

SEQ ID NO: 418630 - DNA, 20 bp, Artificial Sequence
  chemically synthesized
tttcatatccagagtccatt

SEQ ID NO: 418631 - DNA, 20 bp, Artificial Sequence
  chemically synthesized
taagctcttataagactgaa

SEQ ID NO: 418632 - DNA, 20 bp, Artificial Sequence
  chemically synthesized
cagagtccattcagtcttat

SEQ ID NO: 418633 - DNA, 20 bp, Artificial Sequence
  chemically synthesized
gagtccattcagtcttataa

SEQ ID NO: 418634 - DNA, 20 bp, Artificial Sequence
  chemically synthesized
tgtatttaataagctcttat

SEQ ID NO: 418635 - DNA, 20 bp, Artificial Sequence
  chemically synthesized
tgtattagtatgtatttaat

SEQ ID NO: 418636 - DNA, 20 bp, Artificial Sequence
  chemically synthesized
atttataatttgatatgtat

SEQ ID NO: 418637 - DNA, 20 bp, Artificial Sequence
  chemically synthesized
atatcaaattataaatgaat

SEQ ID NO: 418638 - DNA, 20 bp, Artificial Sequence
  chemically synthesized
tcaaattataaatgaatcag

SEQ ID NO: 418639 - DNA, 20 bp, Artificial Sequence
  chemically synthesized
caaattataaatgaatcagt

SEQ ID NO: 418640 - DNA, 20 bp, Artificial Sequence
  chemically synthesized
catatatacgatgtaaaatg

SEQ ID NO: 418641 - DNA, 20 bp, Artificial Sequence
  chemically synthesized
aatgcttgagcatttatatg

SEQ ID NO: 418642 - DNA, 20 bp, Artificial Sequence
  chemically synthesized
atatctacatataaatgctc

SEQ ID NO: 418643 - DNA, 20 bp, Artificial Sequence
  chemically synthesized
catataaatgctcaagcatt

SEQ ID NO: 418644 - DNA, 20 bp, Artificial Sequence
  chemically synthesized
cacttaacaactaaatgctt

SEQ ID NO: 418645 - DNA, 20 bp, Artificial Sequence
  chemically synthesized
tgctcaagcatttagttgtt

SEQ ID NO: 418646 - DNA, 20 bp, Artificial Sequence
  chemically synthesized
gttaagtgaacgcttttcat

SEQ ID NO: 418647 - DNA, 20 bp, Artificial Sequence
  chemically synthesized
aagtttttcttgccaatgaa

SEQ ID NO: 418648 - DNA, 20 bp, Artificial Sequence
  chemically synthesized
agtgaacgcttttcattggc

SEQ ID NO: 418649 - DNA, 20 bp, Artificial Sequence
  chemically synthesized
gaaccaattaaacatcaagt

SEQ ID NO: 418650 - DNA, 20 bp, Artificial Sequence
  chemically synthesized
acctgaaccaattaaacatc

SEQ ID NO: 418651 - DNA, 20 bp, Artificial Sequence
  chemically synthesized
aaacttacttgatgtttaat

SEQ ID NO: 418652 - DNA, 20 bp, Artificial Sequence
  chemically synthesized
tacttgatgtttaattggtt

SEQ ID NO: 418653 - DNA, 20 bp, Artificial Sequence
  chemically synthesized
acttgatgtttaattggttc

SEQ ID NO: 418654 - DNA, 20 bp, Artificial Sequence
  chemically synthesized
acgggtttaagtatgtgcat

SEQ ID NO: 418655 - DNA, 20 bp, Artificial Sequence
  chemically synthesized
cacttgccatttacgggttt

SEQ ID NO: 418656 - DNA, 20 bp, Artificial Sequence
  chemically synthesized
cacatacttaaacccgtaaa

SEQ ID NO: 418657 - DNA, 20 bp, Artificial Sequence
  chemically synthesized
ccataccacttgccatttac

SEQ ID NO: 418658 - DNA, 20 bp, Artificial Sequence
  chemically synthesized
tccataccacttgccattta

SEQ ID NO: 418659 - DNA, 20 bp, Artificial Sequence
  chemically synthesized
tacttaaacccgtaaatggc

SEQ ID NO: 418660 - DNA, 20 bp, Artificial Sequence
  chemically synthesized
ttaaacccgtaaatggcaag

SEQ ID NO: 418661 - DNA, 20 bp, Artificial Sequence
  chemically synthesized
cccgtaaatggcaagtggta

SEQ ID NO: 418662 - DNA, 20 bp, Artificial Sequence
  chemically synthesized
gtaaatggcaagtggtatgg

SEQ ID NO: 418663 - DNA, 20 bp, Artificial Sequence
  chemically synthesized
caagtggtatggaagcatat

SEQ ID NO: 418664 - DNA, 20 bp, Artificial Sequence
  chemically synthesized
ggaagcatataagcgaatta

SEQ ID NO: 418665 - DNA, 20 bp, Artificial Sequence
  chemically synthesized
tatgattcattttctgtgac

SEQ ID NO: 418666 - DNA, 20 bp, Artificial Sequence
  chemically synthesized
atgattcattttctgtgaca

SEQ ID NO: 418667 - DNA, 20 bp, Artificial Sequence
  chemically synthesized
tgattcattttctgtgacaa

SEQ ID NO: 418668 - DNA, 20 bp, Artificial Sequence
  chemically synthesized
gattcattttctgtgacaag

SEQ ID NO: 418669 - DNA, 20 bp, Artificial Sequence
  chemically synthesized
aatgagactaccccttgtca

SEQ ID NO: 418670 - DNA, 20 bp, Artificial Sequence
  chemically synthesized
tcattttctgtgacaagggg

SEQ ID NO: 418671 - DNA, 20 bp, Artificial Sequence
  chemically synthesized
gtagtcttcagtaaagaaat

SEQ ID NO: 418672 - DNA, 20 bp, Artificial Sequence
  chemically synthesized
gtagtctcatttctttactg

SEQ ID NO: 418673 - DNA, 20 bp, Artificial Sequence
  chemically synthesized
tttcacagtagtcttcagta

SEQ ID NO: 418674 - DNA, 20 bp, Artificial Sequence
  chemically synthesized
cacaatttcacagtagtctt

SEQ ID NO: 418675 - DNA, 20 bp, Artificial Sequence
  chemically synthesized
ccatcctcacaatttcacag

SEQ ID NO: 418676 - DNA, 20 bp, Artificial Sequence
  chemically synthesized
tctccatcctcacaatttca

SEQ ID NO: 418677 - DNA, 20 bp, Artificial Sequence
  chemically synthesized
gaagactactgtgaaattgt

SEQ ID NO: 418678 - DNA, 20 bp, Artificial Sequence
  chemically synthesized
aagactactgtgaaattgtg

SEQ ID NO: 418679 - DNA, 20 bp, Artificial Sequence
  chemically synthesized
ctactgtgaaattgtgagga

SEQ ID NO: 418680 - DNA, 20 bp, Artificial Sequence
  chemically synthesized
actgtgaaattgtgaggatg

SEQ ID NO: 418681 - DNA, 20 bp, Artificial Sequence
  chemically synthesized
aattgtgaggatggagatct

SEQ ID NO: 418682 - DNA, 20 bp, Artificial Sequence
  chemically synthesized
aatagaactctgattttgct

SEQ ID NO: 418683 - DNA, 20 bp, Artificial Sequence
  chemically synthesized
gatggagatctgagcaaaat

SEQ ID NO: 418684 - DNA, 20 bp, Artificial Sequence
  chemically synthesized
tggagatctgagcaaaatca

SEQ ID NO: 418685 - DNA, 20 bp, Artificial Sequence
  chemically synthesized
gagcaaaatcagagttctat

SEQ ID NO: 418686 - DNA, 20 bp, Artificial Sequence
  chemically synthesized
aaatcagagttctattggaa

SEQ ID NO: 418687 - DNA, 20 bp, Artificial Sequence
  chemically synthesized
cattcctgtgtccattccaa

SEQ ID NO: 418688 - DNA, 20 bp, Artificial Sequence
  chemically synthesized
gagttctattggaatggaca

SEQ ID NO: 418689 - DNA, 20 bp, Artificial Sequence
  chemically synthesized
agttctattggaatggacac

SEQ ID NO: 418690 - DNA, 20 bp, Artificial Sequence
  chemically synthesized
attggaatggacacaggaat

SEQ ID NO: 418691 - DNA, 20 bp, Artificial Sequence
  chemically synthesized
gacacaggaatgagcctatc

SEQ ID NO: 418692 - DNA, 20 bp, Artificial Sequence
  chemically synthesized
acaggaatgagcctatctgg

SEQ ID NO: 418693 - DNA, 20 bp, Artificial Sequence
  chemically synthesized
caggaatgagcctatctggt

SEQ ID NO: 418694 - DNA, 20 bp, Artificial Sequence
  chemically synthesized
accttaatcacctaccagat

SEQ ID NO: 418695 - DNA, 20 bp, Artificial Sequence
  chemically synthesized
taccttaatcacctaccaga

SEQ ID NO: 418696 - DNA, 20 bp, Artificial Sequence
  chemically synthesized
cagataccttaatcacctac

SEQ ID NO: 418697 - DNA, 20 bp, Artificial Sequence
  chemically synthesized
agcctatctggtaggtgatt

SEQ ID NO: 418698 - DNA, 20 bp, Artificial Sequence
  chemically synthesized
gcctatctggtaggtgatta

SEQ ID NO: 418699 - DNA, 20 bp, Artificial Sequence
  chemically synthesized
tgttgtgtatcaagttgtaa

SEQ ID NO: 418700 - DNA, 20 bp, Artificial Sequence
  chemically synthesized
tggatttcttgttgtgtatc

SEQ ID NO: 418701 - DNA, 20 bp, Artificial Sequence
  chemically synthesized
gttacaacttgatacacaac

SEQ ID NO: 418702 - DNA, 20 bp, Artificial Sequence
  chemically synthesized
ttgatacacaacaagaaatc

SEQ ID NO: 418703 - DNA, 20 bp, Artificial Sequence
  chemically synthesized
gtcttaccaattaatattac

SEQ ID NO: 418704 - DNA, 20 bp, Artificial Sequence
  chemically synthesized
agaaatccagtaatattaat

SEQ ID NO: 418705 - DNA, 20 bp, Artificial Sequence
  chemically synthesized
atccagtaatattaattggt

SEQ ID NO: 418706 - DNA, 20 bp, Artificial Sequence
  chemically synthesized
taattggtaagacattcttc

SEQ ID NO: 418707 - DNA, 20 bp, Artificial Sequence
  chemically synthesized
atttaatatcgtgatgctag

SEQ ID NO: 418708 - DNA, 20 bp, Artificial Sequence
  chemically synthesized
cgtatttaatatcgtgatgc

SEQ ID NO: 418709 - DNA, 20 bp, Artificial Sequence
  chemically synthesized
atcacgatattaaatacgtc

SEQ ID NO: 418710 - DNA, 20 bp, Artificial Sequence
  chemically synthesized
tacagattttataggaattc

SEQ ID NO: 418711 - DNA, 20 bp, Artificial Sequence
  chemically synthesized
acttaatgtacagattttat

SEQ ID NO: 418712 - DNA, 20 bp, Artificial Sequence
  chemically synthesized
aacttaatgtacagatttta

SEQ ID NO: 418713 - DNA, 20 bp, Artificial Sequence
  chemically synthesized
tcctataaaatctgtacatt

SEQ ID NO: 418714 - DNA, 20 bp, Artificial Sequence
  chemically synthesized
aaagaaattaacttaatgta

SEQ ID NO: 418715 - DNA, 20 bp, Artificial Sequence
  chemically synthesized
aaccaaaagttaatttttga

SEQ ID NO: 418716 - DNA, 20 bp, Artificial Sequence
  chemically synthesized
ttctttcaaaaattaacttt

SEQ ID NO: 418717 - DNA, 20 bp, Artificial Sequence
  chemically synthesized
caaaaattaacttttggttc

SEQ ID NO: 418718 - DNA, 20 bp, Artificial Sequence
  chemically synthesized
tcaaagtactctagaaccaa

SEQ ID NO: 418719 - DNA, 20 bp, Artificial Sequence
  chemically synthesized
aaaattaacttttggttcta

SEQ ID NO: 418720 - DNA, 20 bp, Artificial Sequence
  chemically synthesized
ggaaacacatcaaagtactc

SEQ ID NO: 418721 - DNA, 20 bp, Artificial Sequence
  chemically synthesized
tcagttatggaaacacatca

SEQ ID NO: 418722 - DNA, 20 bp, Artificial Sequence
  chemically synthesized
gaggcctgacaggtcagtta

SEQ ID NO: 418723 - DNA, 20 bp, Artificial Sequence
  chemically synthesized
tgtttccataactgacctgt

SEQ ID NO: 418724 - DNA, 20 bp, Artificial Sequence
  chemically synthesized
gtttccataactgacctgtc

SEQ ID NO: 418725 - DNA, 20 bp, Artificial Sequence
  chemically synthesized
ggctcagaggcctgacaggt

SEQ ID NO: 418726 - DNA, 20 bp, Artificial Sequence
  chemically synthesized
cttgggctcagaggcctgac

SEQ ID NO: 418727 - DNA, 20 bp, Artificial Sequence
  chemically synthesized
gcttgggctcagaggcctga

SEQ ID NO: 418728 - DNA, 20 bp, Artificial Sequence
  chemically synthesized
aactgacctgtcaggcctct

SEQ ID NO: 418729 - DNA, 20 bp, Artificial Sequence
  chemically synthesized
atggcttagcttgggctcag

SEQ ID NO: 418730 - DNA, 20 bp, Artificial Sequence
  chemically synthesized
cctgtcaggcctctgagccc

SEQ ID NO: 418731 - DNA, 20 bp, Artificial Sequence
  chemically synthesized
gatggcttagcttgggctca

SEQ ID NO: 418732 - DNA, 20 bp, Artificial Sequence
  chemically synthesized
atgatggcttagcttgggct

SEQ ID NO: 418733 - DNA, 20 bp, Artificial Sequence
  chemically synthesized
caggcctctgagcccaagct

SEQ ID NO: 418734 - DNA, 20 bp, Artificial Sequence
  chemically synthesized
gggatatgatggcttagctt

SEQ ID NO: 418735 - DNA, 20 bp, Artificial Sequence
  chemically synthesized
ggggatatgatggcttagct

SEQ ID NO: 418736 - DNA, 20 bp, Artificial Sequence
  chemically synthesized
tcacaggggatatgatggct

SEQ ID NO: 418737 - DNA, 20 bp, Artificial Sequence
  chemically synthesized
gcaggtcacaggggatatga

SEQ ID NO: 418738 - DNA, 20 bp, Artificial Sequence
  chemically synthesized
cgtatacatgcaggtcacag

SEQ ID NO: 418739 - DNA, 20 bp, Artificial Sequence
  chemically synthesized
gcgtatacatgcaggtcaca

SEQ ID NO: 418740 - DNA, 20 bp, Artificial Sequence
  chemically synthesized
ggcgtatacatgcaggtcac

SEQ ID NO: 418741 - DNA, 20 bp, Artificial Sequence
  chemically synthesized
gggcgtatacatgcaggtca

SEQ ID NO: 418742 - DNA, 20 bp, Artificial Sequence
  chemically synthesized
ccatctgggcgtatacatgc

SEQ ID NO: 418743 - DNA, 20 bp, Artificial Sequence
  chemically synthesized
gccatctgggcgtatacatg

SEQ ID NO: 418744 - DNA, 20 bp, Artificial Sequence
  chemically synthesized
gtgacctgcatgtatacgcc

SEQ ID NO: 418745 - DNA, 20 bp, Artificial Sequence
  chemically synthesized
cctgcatgtatacgcccaga

SEQ ID NO: 418746 - DNA, 20 bp, Artificial Sequence
  chemically synthesized
tcagttacttcaggccatct

SEQ ID NO: 418747 - DNA, 20 bp, Artificial Sequence
  chemically synthesized
ttcagttacttcaggccatc

SEQ ID NO: 418748 - DNA, 20 bp, Artificial Sequence
  chemically synthesized
gtatacgcccagatggcctg

SEQ ID NO: 418749 - DNA, 20 bp, Artificial Sequence
  chemically synthesized
tgtgattcttcagttacttc

SEQ ID NO: 418750 - DNA, 20 bp, Artificial Sequence
  chemically synthesized
ttgtgattcttcagttactt

SEQ ID NO: 418751 - DNA, 20 bp, Artificial Sequence
  chemically synthesized
cagatggcctgaagtaactg

SEQ ID NO: 418752 - DNA, 20 bp, Artificial Sequence
  chemically synthesized
tcacttcttttgtgattctt

SEQ ID NO: 418753 - DNA, 20 bp, Artificial Sequence
  chemically synthesized
aagtaactgaagaatcacaa

SEQ ID NO: 418754 - DNA, 20 bp, Artificial Sequence
  chemically synthesized
taactgaagaatcacaaaag

SEQ ID NO: 418755 - DNA, 20 bp, Artificial Sequence
  chemically synthesized
aatcacaaaagaagtgaaaa

SEQ ID NO: 418756 - DNA, 20 bp, Artificial Sequence
  chemically synthesized
tcatcagttaaggcaggaac

SEQ ID NO: 418757 - DNA, 20 bp, Artificial Sequence
  chemically synthesized
gtcatcagttaaggcaggaa

SEQ ID NO: 418758 - DNA, 20 bp, Artificial Sequence
  chemically synthesized
ggaatgtcatcagttaaggc

SEQ ID NO: 418759 - DNA, 20 bp, Artificial Sequence
  chemically synthesized
tggaatgtcatcagttaagg

SEQ ID NO: 418760 - DNA, 20 bp, Artificial Sequence
  chemically synthesized
tggtggaatgtcatcagtta

SEQ ID NO: 418761 - DNA, 20 bp, Artificial Sequence
  chemically synthesized
gtggtggaatgtcatcagtt

SEQ ID NO: 418762 - DNA, 20 bp, Artificial Sequence
  chemically synthesized
cttttgtggtggaatgtcat

SEQ ID NO: 418763 - DNA, 20 bp, Artificial Sequence
  chemically synthesized
ctgatgacattccaccacaa

SEQ ID NO: 418764 - DNA, 20 bp, Artificial Sequence
  chemically synthesized
catttccacttcttttgtgg

SEQ ID NO: 418765 - DNA, 20 bp, Artificial Sequence
  chemically synthesized
atgacattccaccacaaaag

SEQ ID NO: 418766 - DNA, 20 bp, Artificial Sequence
  chemically synthesized
ggccatttccacttcttttg

SEQ ID NO: 418767 - DNA, 20 bp, Artificial Sequence
  chemically synthesized
acattccaccacaaaagaag

SEQ ID NO: 418768 - DNA, 20 bp, Artificial Sequence
  chemically synthesized
caccacaaaagaagtggaaa

SEQ ID NO: 418769 - DNA, 20 bp, Artificial Sequence
  chemically synthesized
tcatcagttaaggcaggaac

SEQ ID NO: 418770 - DNA, 20 bp, Artificial Sequence
  chemically synthesized
gtcatcagttaaggcaggaa

SEQ ID NO: 418771 - DNA, 20 bp, Artificial Sequence
  chemically synthesized
gtaatgtcatcagttaaggc

SEQ ID NO: 418772 - DNA, 20 bp, Artificial Sequence
  chemically synthesized
ggtaatgtcatcagttaagg

SEQ ID NO: 418773 - DNA, 20 bp, Artificial Sequence
  chemically synthesized
caaggtaatgtcatcagtta

SEQ ID NO: 418774 - DNA, 20 bp, Artificial Sequence
  chemically synthesized
acaaggtaatgtcatcagtt

SEQ ID NO: 418775 - DNA, 20 bp, Artificial Sequence
  chemically synthesized
atttcacaaggtaatgtcat

SEQ ID NO: 418776 - DNA, 20 bp, Artificial Sequence
  chemically synthesized
ccaggagaaggaatttcaca

SEQ ID NO: 418777 - DNA, 20 bp, Artificial Sequence
  chemically synthesized
gccaggagaaggaatttcac

SEQ ID NO: 418778 - DNA, 20 bp, Artificial Sequence
  chemically synthesized
ccttgtgaaattccttctcc

SEQ ID NO: 418779 - DNA, 20 bp, Artificial Sequence
  chemically synthesized
agccaggatgagccaggaga

SEQ ID NO: 418780 - DNA, 20 bp, Artificial Sequence
  chemically synthesized
gagccaggatgagccaggag

SEQ ID NO: 418781 - DNA, 20 bp, Artificial Sequence
  chemically synthesized
tttgagccaggatgagccag

SEQ ID NO: 418782 - DNA, 20 bp, Artificial Sequence
  chemically synthesized
tttttgagccaggatgagcc

SEQ ID NO: 418783 - DNA, 20 bp, Artificial Sequence
  chemically synthesized
ctttttgagccaggatgagc

SEQ ID NO: 418784 - DNA, 20 bp, Artificial Sequence
  chemically synthesized
ttccttctcctggctcatcc

SEQ ID NO: 418785 - DNA, 20 bp, Artificial Sequence
  chemically synthesized
ggagctttttgagccaggat

SEQ ID NO: 418786 - DNA, 20 bp, Artificial Sequence
  chemically synthesized
gtgggggagctttttgagcc

SEQ ID NO: 418787 - DNA, 20 bp, Artificial Sequence
  chemically synthesized
ctggctcatcctggctcaaa

SEQ ID NO: 418788 - DNA, 20 bp, Artificial Sequence
  chemically synthesized
agtgggggagctttttgagc

SEQ ID NO: 418789 - DNA, 20 bp, Artificial Sequence
  chemically synthesized
gctcagtgggggagcttttt

SEQ ID NO: 418790 - DNA, 20 bp, Artificial Sequence
  chemically synthesized
gctcaaaaagctcccccact

SEQ ID NO: 418791 - DNA, 20 bp, Artificial Sequence
  chemically synthesized
tcacaaggtgctcagtgggg

SEQ ID NO: 418792 - DNA, 20 bp, Artificial Sequence
  chemically synthesized
ggtcacaaggtgctcagtgg

SEQ ID NO: 418793 - DNA, 20 bp, Artificial Sequence
  chemically synthesized
gggtcacaaggtgctcagtg

SEQ ID NO: 418794 - DNA, 20 bp, Artificial Sequence
  chemically synthesized
ggggtcacaaggtgctcagt

SEQ ID NO: 418795 - DNA, 20 bp, Artificial Sequence
  chemically synthesized
gggggtcacaaggtgctcag

SEQ ID NO: 418796 - DNA, 20 bp, Artificial Sequence
  chemically synthesized
agtgggggtcacaaggtgct

SEQ ID NO: 418797 - DNA, 20 bp, Artificial Sequence
  chemically synthesized
gggcaggagtgggggtcaca

SEQ ID NO: 418798 - DNA, 20 bp, Artificial Sequence
  chemically synthesized
tgggcaggagtgggggtcac

SEQ ID NO: 418799 - DNA, 20 bp, Artificial Sequence
  chemically synthesized
tctctggtgggcaggagtgg

SEQ ID NO: 418800 - DNA, 20 bp, Artificial Sequence
  chemically synthesized
ttctctggtgggcaggagtg

SEQ ID NO: 418801 - DNA, 20 bp, Artificial Sequence
  chemically synthesized
gttctctggtgggcaggagt

SEQ ID NO: 418802 - DNA, 20 bp, Artificial Sequence
  chemically synthesized
tgttctctggtgggcaggag

SEQ ID NO: 418803 - DNA, 20 bp, Artificial Sequence
  chemically synthesized
ggttgttctctggtgggcag

SEQ ID NO: 418804 - DNA, 20 bp, Artificial Sequence
  chemically synthesized
tgacccccactcctgcccac

SEQ ID NO: 418805 - DNA, 20 bp, Artificial Sequence
  chemically synthesized
ggggttgttctctggtgggc

SEQ ID NO: 418806 - DNA, 20 bp, Artificial Sequence
  chemically synthesized
acccccactcctgcccacca

SEQ ID NO: 418807 - DNA, 20 bp, Artificial Sequence
  chemically synthesized
aggggttgttctctggtggg

SEQ ID NO: 418808 - DNA, 20 bp, Artificial Sequence
  chemically synthesized
aagaggggttgttctctggt

SEQ ID NO: 418809 - DNA, 20 bp, Artificial Sequence
  chemically synthesized
aaagaggggttgttctctgg

SEQ ID NO: 418810 - DNA, 20 bp, Artificial Sequence
  chemically synthesized
tacaaagaggggttgttctc

SEQ ID NO: 418811 - DNA, 20 bp, Artificial Sequence
  chemically synthesized
taaaggaaaattacaaagag

SEQ ID NO: 418812 - DNA, 20 bp, Artificial Sequence
  chemically synthesized
gtaaaggaaaattacaaaga

SEQ ID NO: 418813 - DNA, 20 bp, Artificial Sequence
  chemically synthesized
ggtaaaggaaaattacaaag

SEQ ID NO: 418814 - DNA, 20 bp, Artificial Sequence
  chemically synthesized
aggtaaaggaaaattacaaa

SEQ ID NO: 418815 - DNA, 20 bp, Artificial Sequence
  chemically synthesized
gtaggtaaaggaaaattaca

SEQ ID NO: 418816 - DNA, 20 bp, Artificial Sequence
  chemically synthesized
tataagctttcggtaggtaa

SEQ ID NO: 418817 - DNA, 20 bp, Artificial Sequence
  chemically synthesized
ttataagctttcggtaggta

SEQ ID NO: 418818 - DNA, 20 bp, Artificial Sequence
  chemically synthesized
aattttcctttacctaccga

SEQ ID NO: 418819 - DNA, 20 bp, Artificial Sequence
  chemically synthesized
ccgttttataagctttcggt

SEQ ID NO: 418820 - DNA, 20 bp, Artificial Sequence
  chemically synthesized
gccgttttataagctttcgg

SEQ ID NO: 418821 - DNA, 20 bp, Artificial Sequence
  chemically synthesized
ggggccgttttataagcttt

SEQ ID NO: 418822 - DNA, 20 bp, Artificial Sequence
  chemically synthesized
cctaccgaaagcttataaaa

SEQ ID NO: 418823 - DNA, 20 bp, Artificial Sequence
  chemically synthesized
taggggtggggccgttttat

SEQ ID NO: 418824 - DNA, 20 bp, Artificial Sequence
  chemically synthesized
agggaagggagataggggtg

SEQ ID NO: 418825 - DNA, 20 bp, Artificial Sequence
  chemically synthesized
cagggaagggagataggggt

SEQ ID NO: 418826 - DNA, 20 bp, Artificial Sequence
  chemically synthesized
tcagggaagggagatagggg

SEQ ID NO: 418827 - DNA, 20 bp, Artificial Sequence
  chemically synthesized
gagtcagggaagggagatag

SEQ ID NO: 418828 - DNA, 20 bp, Artificial Sequence
  chemically synthesized
agagtcagggaagggagata

SEQ ID NO: 418829 - DNA, 20 bp, Artificial Sequence
  chemically synthesized
gagagtcagggaagggagat

SEQ ID NO: 418830 - DNA, 20 bp, Artificial Sequence
  chemically synthesized
agagagtcagggaagggaga

SEQ ID NO: 418831 - DNA, 20 bp, Artificial Sequence
  chemically synthesized
gaaaagagagtcagggaagg

SEQ ID NO: 418832 - DNA, 20 bp, Artificial Sequence
  chemically synthesized
ccgaaaagagagtcagggaa

SEQ ID NO: 418833 - DNA, 20 bp, Artificial Sequence
  chemically synthesized
tccgaaaagagagtcaggga

SEQ ID NO: 418834 - DNA, 20 bp, Artificial Sequence
  chemically synthesized
gtccgaaaagagagtcaggg

SEQ ID NO: 418835 - DNA, 20 bp, Artificial Sequence
  chemically synthesized
tgagtccgaaaagagagtca

SEQ ID NO: 418836 - DNA, 20 bp, Artificial Sequence
  chemically synthesized
ctgagtccgaaaagagagtc

SEQ ID NO: 418837 - DNA, 20 bp, Artificial Sequence
  chemically synthesized
gctgagtccgaaaagagagt

SEQ ID NO: 418838 - DNA, 20 bp, Artificial Sequence
  chemically synthesized
cccttccctgactctctttt

SEQ ID NO: 418839 - DNA, 20 bp, Artificial Sequence
  chemically synthesized
gcgggctgagtccgaaaaga

SEQ ID NO: 418840 - DNA, 20 bp, Artificial Sequence
  chemically synthesized
aggcgggctgagtccgaaaa

SEQ ID NO: 418841 - DNA, 20 bp, Artificial Sequence
  chemically synthesized
gcaggcgggctgagtccgaa

SEQ ID NO: 418842 - DNA, 20 bp, Artificial Sequence
  chemically synthesized
cctgactctcttttcggact

SEQ ID NO: 418843 - DNA, 20 bp, Artificial Sequence
  chemically synthesized
cacctgggtgcaggcgggct

SEQ ID NO: 418844 - DNA, 20 bp, Artificial Sequence
  chemically synthesized
ttaatcacctgggtgcaggc

SEQ ID NO: 418845 - DNA, 20 bp, Artificial Sequence
  chemically synthesized
tttaatcacctgggtgcagg

SEQ ID NO: 418846 - DNA, 20 bp, Artificial Sequence
  chemically synthesized
ggactcagcccgcctgcacc

SEQ ID NO: 418847 - DNA, 20 bp, Artificial Sequence
  chemically synthesized
gactcagcccgcctgcaccc

SEQ ID NO: 418848 - DNA, 20 bp, Artificial Sequence
  chemically synthesized
ctttttaatcacctgggtgc

SEQ ID NO: 418849 - DNA, 20 bp, Artificial Sequence
  chemically synthesized
gctttttaatcacctgggtg

SEQ ID NO: 418850 - DNA, 20 bp, Artificial Sequence
  chemically synthesized
ataaagctttttaatcacct

SEQ ID NO: 418851 - DNA, 20 bp, Artificial Sequence
  chemically synthesized
aataaagctttttaatcacc

SEQ ID NO: 418852 - DNA, 20 bp, Artificial Sequence
  chemically synthesized
cctgcacccaggtgattaaa

SEQ ID NO: 418853 - DNA, 20 bp, Artificial Sequence
  chemically synthesized
caggctttgtgtgagcaata

SEQ ID NO: 418854 - DNA, 20 bp, Artificial Sequence
  chemically synthesized
aaagctttattgctcacaca

SEQ ID NO: 418855 - DNA, 20 bp, Artificial Sequence
  chemically synthesized
ccaccaaacaggctttgtgt

SEQ ID NO: 418856 - DNA, 20 bp, Artificial Sequence
  chemically synthesized
ttgctcacacaaagcctgtt

SEQ ID NO: 418857 - DNA, 20 bp, Artificial Sequence
  chemically synthesized
ctcacacaaagcctgtttgg

SEQ ID NO: 418858 - DNA, 20 bp, Artificial Sequence
  chemically synthesized
gtgtgaagagaccaccaaac

SEQ ID NO: 418859 - DNA, 20 bp, Artificial Sequence
  chemically synthesized
cgtgtgaagagaccaccaaa

SEQ ID NO: 418860 - DNA, 20 bp, Artificial Sequence
  chemically synthesized
tgtttggtggtctcttcaca

SEQ ID NO: 418861 - DNA, 20 bp, Artificial Sequence
  chemically synthesized
ttcagtcgcgtccgtgtgaa

SEQ ID NO: 418862 - DNA, 20 bp, Artificial Sequence
  chemically synthesized
atttcagtcgcgtccgtgtg

SEQ ID NO: 418863 - DNA, 20 bp, Artificial Sequence
  chemically synthesized
gcttttctaatgggtcattt

SEQ ID NO: 418864 - DNA, 20 bp, Artificial Sequence
  chemically synthesized
acgcgactgaaatgacccat

SEQ ID NO: 418865 - DNA, 20 bp, Artificial Sequence
  chemically synthesized
actgaaatgacccattagaa

SEQ ID NO: 418866 - DNA, 20 bp, Artificial Sequence
  chemically synthesized
agtaagtatgcttttctaat

SEQ ID NO: 418867 - DNA, 20 bp, Artificial Sequence
  chemically synthesized
aagtaagtatgcttttctaa

SEQ ID NO: 418868 - DNA, 20 bp, Artificial Sequence
  chemically synthesized
aaaaaatgcaagacataagt

SEQ ID NO: 418869 - DNA, 20 bp, Artificial Sequence
  chemically synthesized
gctcaaaaaatgcaagacat

SEQ ID NO: 418870 - DNA, 20 bp, Artificial Sequence
  chemically synthesized
aattatagctcaaaaaatgc

SEQ ID NO: 418871 - DNA, 20 bp, Artificial Sequence
  chemically synthesized
acttatgtcttgcatttttt

SEQ ID NO: 418872 - DNA, 20 bp, Artificial Sequence
  chemically synthesized
tttacattttttaaaaatta

SEQ ID NO: 418873 - DNA, 20 bp, Artificial Sequence
  chemically synthesized
atttttaaaaaatgtaaact

SEQ ID NO: 418874 - DNA, 20 bp, Artificial Sequence
  chemically synthesized
tagtgattccatacatttct

SEQ ID NO: 418875 - DNA, 20 bp, Artificial Sequence
  chemically synthesized
aatgtaaactcagaaatgta

SEQ ID NO: 418876 - DNA, 20 bp, Artificial Sequence
  chemically synthesized
cccattttctataatttttt

SEQ ID NO: 418877 - DNA, 20 bp, Artificial Sequence
  chemically synthesized
tggaatcactaaaaaaatta

SEQ ID NO: 418878 - DNA, 20 bp, Artificial Sequence
  chemically synthesized
actaaaaaaattatagaaaa

SEQ ID NO: 418879 - DNA, 20 bp, Artificial Sequence
  chemically synthesized
ctaaaaaaattatagaaaat

SEQ ID NO: 418880 - DNA, 20 bp, Artificial Sequence
  chemically synthesized
ttatagaaaatgggatctca

SEQ ID NO: 418881 - DNA, 20 bp, Artificial Sequence
  chemically synthesized
agttacaaagacataactgt

SEQ ID NO: 418882 - DNA, 20 bp, Artificial Sequence
  chemically synthesized
tttaatgtgcatgagttaca

SEQ ID NO: 418883 - DNA, 20 bp, Artificial Sequence
  chemically synthesized
ggattgcttttaatgtgcat

SEQ ID NO: 418884 - DNA, 20 bp, Artificial Sequence
  chemically synthesized
ttgtaactcatgcacattaa

SEQ ID NO: 418885 - DNA, 20 bp, Artificial Sequence
  chemically synthesized
atttatcattatttttattt

SEQ ID NO: 418886 - DNA, 20 bp, Artificial Sequence
  chemically synthesized
gatttatcattatttttatt

SEQ ID NO: 418887 - DNA, 20 bp, Artificial Sequence
  chemically synthesized
aataaaaataatgataaatc

SEQ ID NO: 418888 - DNA, 20 bp, Artificial Sequence
  chemically synthesized
gaaataatgatttattatgc

SEQ ID NO: 418889 - DNA, 20 bp, Artificial Sequence
  chemically synthesized
tcttaggaaaaatatattta

SEQ ID NO: 418890 - DNA, 20 bp, Artificial Sequence
  chemically synthesized
tctttaaatatatttttcct

SEQ ID NO: 418891 - DNA, 20 bp, Artificial Sequence
  chemically synthesized
aaatatatttttcctaagaa

SEQ ID NO: 418892 - DNA, 20 bp, Artificial Sequence
  chemically synthesized
tgagttatcgttctgttctt

SEQ ID NO: 418893 - DNA, 20 bp, Artificial Sequence
  chemically synthesized
ttgagttatcgttctgttct

SEQ ID NO: 418894 - DNA, 20 bp, Artificial Sequence
  chemically synthesized
cagaacgataactcaaattt

SEQ ID NO: 418895 - DNA, 20 bp, Artificial Sequence
  chemically synthesized
agtttggaacacttaaattt

SEQ ID NO: 418896 - DNA, 20 bp, Artificial Sequence
  chemically synthesized
tttaagtgttccaaactgat

SEQ ID NO: 418897 - DNA, 20 bp, Artificial Sequence
  chemically synthesized
cccctgaggacttatcagtt

SEQ ID NO: 418898 - DNA, 20 bp, Artificial Sequence
  chemically synthesized
gtgttcccctgaggacttat

SEQ ID NO: 418899 - DNA, 20 bp, Artificial Sequence
  chemically synthesized
gttccaaactgataagtcct

SEQ ID NO: 418900 - DNA, 20 bp, Artificial Sequence
  chemically synthesized
ttccaaactgataagtcctc

SEQ ID NO: 418901 - DNA, 20 bp, Artificial Sequence
  chemically synthesized
tccaaactgataagtcctca

SEQ ID NO: 418902 - DNA, 20 bp, Artificial Sequence
  chemically synthesized
ccaaactgataagtcctcag

SEQ ID NO: 418903 - DNA, 20 bp, Artificial Sequence
  chemically synthesized
tcacttttagtgttcccctg

SEQ ID NO: 418904 - DNA, 20 bp, Artificial Sequence
  chemically synthesized
ctcacttttagtgttcccct

SEQ ID NO: 418905 - DNA, 20 bp, Artificial Sequence
  chemically synthesized
agtcctcaggggaacactaa

SEQ ID NO: 418906 - DNA, 20 bp, Artificial Sequence
  chemically synthesized
ctcaggggaacactaaaagt

SEQ ID NO: 418907 - DNA, 20 bp, Artificial Sequence
  chemically synthesized
caggggaacactaaaagtga

SEQ ID NO: 418908 - DNA, 20 bp, Artificial Sequence
  chemically synthesized
ttttaaattactctcacttt

SEQ ID NO: 418909 - DNA, 20 bp, Artificial Sequence
  chemically synthesized
taaaagtgagagtaatttaa

SEQ ID NO: 418910 - DNA, 20 bp, Artificial Sequence
  chemically synthesized
aagtgagagtaatttaaaag

SEQ ID NO: 418911 - DNA, 20 bp, Artificial Sequence
  chemically synthesized
gtaatttaaaagtagaatat

SEQ ID NO: 418912 - DNA, 20 bp, Artificial Sequence
  chemically synthesized
atttaaaagtagaatatcag

SEQ ID NO: 418913 - DNA, 20 bp, Artificial Sequence
  chemically synthesized
agtagaatatcagtagattt

SEQ ID NO: 418914 - DNA, 20 bp, Artificial Sequence
  chemically synthesized
atatcagtagattttagcaa

SEQ ID NO: 418915 - DNA, 20 bp, Artificial Sequence
  chemically synthesized
tttagcaaaagaaaaattga

SEQ ID NO: 418916 - DNA, 20 bp, Artificial Sequence
  chemically synthesized
gaaaaattgatagtgctcat

SEQ ID NO: 418917 - DNA, 20 bp, Artificial Sequence
  chemically synthesized
aaaaattgatagtgctcatt

SEQ ID NO: 418918 - DNA, 20 bp, Artificial Sequence
  chemically synthesized
aaattatataaattcctaat

SEQ ID NO: 418919 - DNA, 20 bp, Artificial Sequence
  chemically synthesized
gagtctgttatgtaaatcaa

SEQ ID NO: 418920 - DNA, 20 bp, Artificial Sequence
  chemically synthesized
tacactattgatttacataa

SEQ ID NO: 418921 - DNA, 20 bp, Artificial Sequence
  chemically synthesized
tacataacagactcctttca

SEQ ID NO: 418922 - DNA, 20 bp, Artificial Sequence
  chemically synthesized
acataacagactcctttcac

SEQ ID NO: 418923 - DNA, 20 bp, Artificial Sequence
  chemically synthesized
agaaagtttacctgtgaaag

SEQ ID NO: 418924 - DNA, 20 bp, Artificial Sequence
  chemically synthesized
ggagaaagtttacctgtgaa

SEQ ID NO: 418925 - DNA, 20 bp, Artificial Sequence
  chemically synthesized
aggagaaagtttacctgtga

SEQ ID NO: 418926 - DNA, 20 bp, Artificial Sequence
  chemically synthesized
ttcacaggtaaactttctcc

SEQ ID NO: 418927 - DNA, 20 bp, Artificial Sequence
  chemically synthesized
cacaggtaaactttctccta

SEQ ID NO: 418928 - DNA, 20 bp, Artificial Sequence
  chemically synthesized
tatgacaaaactctaggaga

SEQ ID NO: 418929 - DNA, 20 bp, Artificial Sequence
  chemically synthesized
aaaatatgacaaaactctag

SEQ ID NO: 418930 - DNA, 20 bp, Artificial Sequence
  chemically synthesized
gtaaaatatgacaaaactct

SEQ ID NO: 418931 - DNA, 20 bp, Artificial Sequence
  chemically synthesized
tgtaaaatatgacaaaactc

SEQ ID NO: 418932 - DNA, 20 bp, Artificial Sequence
  chemically synthesized
atattttacaaattctaaat

SEQ ID NO: 418933 - DNA, 20 bp, Artificial Sequence
  chemically synthesized
tttacaaattctaaatgagt

SEQ ID NO: 418934 - DNA, 20 bp, Artificial Sequence
  chemically synthesized
tttaagtgggctaactcatt

SEQ ID NO: 418935 - DNA, 20 bp, Artificial Sequence
  chemically synthesized
taagaaacaaacatttaagt

SEQ ID NO: 418936 - DNA, 20 bp, Artificial Sequence
  chemically synthesized
ttaagaaacaaacatttaag

SEQ ID NO: 418937 - DNA, 20 bp, Artificial Sequence
  chemically synthesized
attttaagaaacaaacattt

SEQ ID NO: 418938 - DNA, 20 bp, Artificial Sequence
  chemically synthesized
tttctgtgctagaaaatttt

SEQ ID NO: 418939 - DNA, 20 bp, Artificial Sequence
  chemically synthesized
gtttgtttcttaaaattttc

SEQ ID NO: 418940 - DNA, 20 bp, Artificial Sequence
  chemically synthesized
tttcttaaaattttctagca

SEQ ID NO: 418941 - DNA, 20 bp, Artificial Sequence
  chemically synthesized
attaacatatttttctgtgc

SEQ ID NO: 418942 - DNA, 20 bp, Artificial Sequence
  chemically synthesized
aacgttttaaaataataatg

SEQ ID NO: 418943 - DNA, 20 bp, Artificial Sequence
  chemically synthesized
tagtgtgtttcttttgaata

SEQ ID NO: 418944 - DNA, 20 bp, Artificial Sequence
  chemically synthesized
atgatagtctctttattcaa

SEQ ID NO: 418945 - DNA, 20 bp, Artificial Sequence
  chemically synthesized
gtgtgtttcttttgaataaa

SEQ ID NO: 418946 - DNA, 20 bp, Artificial Sequence
  chemically synthesized
tgaataaagagactatcatg

SEQ ID NO: 418947 - DNA, 20 bp, Artificial Sequence
  chemically synthesized
gcctgacagtttctacatga

SEQ ID NO: 418948 - DNA, 20 bp, Artificial Sequence
  chemically synthesized
gactatcatgtagaaactgt

SEQ ID NO: 418949 - DNA, 20 bp, Artificial Sequence
  chemically synthesized
actatcatgtagaaactgtc

SEQ ID NO: 418950 - DNA, 20 bp, Artificial Sequence
  chemically synthesized
gcttgggctcagaggcctga

SEQ ID NO: 418951 - DNA, 20 bp, Artificial Sequence
  chemically synthesized
gtagaaactgtcaggcctct

SEQ ID NO: 418952 - DNA, 20 bp, Artificial Sequence
  chemically synthesized
atggcttagcttgggctcag

SEQ ID NO: 418953 - DNA, 20 bp, Artificial Sequence
  chemically synthesized
actgtcaggcctctgagccc

SEQ ID NO: 418954 - DNA, 20 bp, Artificial Sequence
  chemically synthesized
gatggcttagcttgggctca

SEQ ID NO: 418955 - DNA, 20 bp, Artificial Sequence
  chemically synthesized
atgatggcttagcttgggct

SEQ ID NO: 418956 - DNA, 20 bp, Artificial Sequence
  chemically synthesized
caggcctctgagcccaagct

SEQ ID NO: 418957 - DNA, 20 bp, Artificial Sequence
  chemically synthesized
gggatatgatggcttagctt

SEQ ID NO: 418958 - DNA, 20 bp, Artificial Sequence
  chemically synthesized
ggggatatgatggcttagct

SEQ ID NO: 418959 - DNA, 20 bp, Artificial Sequence
  chemically synthesized
tcacaggggatatgatggct

SEQ ID NO: 418960 - DNA, 20 bp, Artificial Sequence
  chemically synthesized
gcagatcacaggggatatga

SEQ ID NO: 418961 - DNA, 20 bp, Artificial Sequence
  chemically synthesized
tgtgtacgtgcagatcacag

SEQ ID NO: 418962 - DNA, 20 bp, Artificial Sequence
  chemically synthesized
atgtgtacgtgcagatcaca

SEQ ID NO: 418963 - DNA, 20 bp, Artificial Sequence
  chemically synthesized
gatgtgtacgtgcagatcac

SEQ ID NO: 418964 - DNA, 20 bp, Artificial Sequence
  chemically synthesized
ggatgtgtacgtgcagatca

SEQ ID NO: 418965 - DNA, 20 bp, Artificial Sequence
  chemically synthesized
gcaatctggatgtgtacgtg

SEQ ID NO: 418966 - DNA, 20 bp, Artificial Sequence
  chemically synthesized
gtgatctgcacgtacacatc

SEQ ID NO: 418967 - DNA, 20 bp, Artificial Sequence
  chemically synthesized
cacgtacacatccagattgc

SEQ ID NO: 418968 - DNA, 20 bp, Artificial Sequence
  chemically synthesized
taaggcaggaaccggcaatc

SEQ ID NO: 418969 - DNA, 20 bp, Artificial Sequence
  chemically synthesized
tcatcagttaaggcaggaac

SEQ ID NO: 418970 - DNA, 20 bp, Artificial Sequence
  chemically synthesized
ggaatgtcatcagttaaggc

SEQ ID NO: 418971 - DNA, 20 bp, Artificial Sequence
  chemically synthesized
tggaatgtcatcagttaagg

SEQ ID NO: 418972 - DNA, 20 bp, Artificial Sequence
  chemically synthesized
tggtggaatgtcatcagtta

SEQ ID NO: 418973 - DNA, 20 bp, Artificial Sequence
  chemically synthesized
gtggtggaatgtcatcagtt

SEQ ID NO: 418974 - DNA, 20 bp, Artificial Sequence
  chemically synthesized
cttttgtggtggaatgtcat

SEQ ID NO: 418975 - DNA, 20 bp, Artificial Sequence
  chemically synthesized
ctgatgacattccaccacaa

SEQ ID NO: 418976 - DNA, 20 bp, Artificial Sequence
  chemically synthesized
cattttcacttcttttgtgg

SEQ ID NO: 418977 - DNA, 20 bp, Artificial Sequence
  chemically synthesized
atgacattccaccacaaaag

SEQ ID NO: 418978 - DNA, 20 bp, Artificial Sequence
  chemically synthesized
ggccattttcacttcttttg

SEQ ID NO: 418979 - DNA, 20 bp, Artificial Sequence
  chemically synthesized
caccacaaaagaagtgaaaa

SEQ ID NO: 418980 - DNA, 20 bp, Artificial Sequence
  chemically synthesized
tcatcagttaaggcaggaac

SEQ ID NO: 418981 - DNA, 20 bp, Artificial Sequence
  chemically synthesized
gtcatcagttaaggcaggaa

SEQ ID NO: 418982 - DNA, 20 bp, Artificial Sequence
  chemically synthesized
acaatgtcatcagttaaggc

SEQ ID NO: 418983 - DNA, 20 bp, Artificial Sequence
  chemically synthesized
gacaatgtcatcagttaagg

SEQ ID NO: 418984 - DNA, 20 bp, Artificial Sequence
  chemically synthesized
caagacaatgtcatcagtta

SEQ ID NO: 418985 - DNA, 20 bp, Artificial Sequence
  chemically synthesized
acaagacaatgtcatcagtt

SEQ ID NO: 418986 - DNA, 20 bp, Artificial Sequence
  chemically synthesized
atttcacaagacaatgtcat

SEQ ID NO: 418987 - DNA, 20 bp, Artificial Sequence
  chemically synthesized
gccaggagaaggaatttcac

SEQ ID NO: 418988 - DNA, 20 bp, Artificial Sequence
  chemically synthesized
tcttgtgaaattccttctcc

SEQ ID NO: 418989 - DNA, 20 bp, Artificial Sequence
  chemically synthesized
agccaggatgagccaggaga

SEQ ID NO: 418990 - DNA, 20 bp, Artificial Sequence
  chemically synthesized
gagccaggatgagccaggag

SEQ ID NO: 418991 - DNA, 20 bp, Artificial Sequence
  chemically synthesized
tttgagccaggatgagccag

SEQ ID NO: 418992 - DNA, 20 bp, Artificial Sequence
  chemically synthesized
cttttgagccaggatgagcc

SEQ ID NO: 418993 - DNA, 20 bp, Artificial Sequence
  chemically synthesized
gcttttgagccaggatgagc

SEQ ID NO: 418994 - DNA, 20 bp, Artificial Sequence
  chemically synthesized
ttccttctcctggctcatcc

SEQ ID NO: 418995 - DNA, 20 bp, Artificial Sequence
  chemically synthesized
gggagcttttgagccaggat

SEQ ID NO: 418996 - DNA, 20 bp, Artificial Sequence
  chemically synthesized
cctggctcatcctggctcaa

SEQ ID NO: 418997 - DNA, 20 bp, Artificial Sequence
  chemically synthesized
agtgggggagcttttgagcc

SEQ ID NO: 418998 - DNA, 20 bp, Artificial Sequence
  chemically synthesized
cagtgggggagcttttgagc

SEQ ID NO: 418999 - DNA, 20 bp, Artificial Sequence
  chemically synthesized
tactcagtgggggagctttt

SEQ ID NO: 419000 - DNA, 20 bp, Artificial Sequence
  chemically synthesized
ggctcaaaagctcccccact

SEQ ID NO: 419001 - DNA, 20 bp, Artificial Sequence
  chemically synthesized
tcacaaggtactcagtgggg

SEQ ID NO: 419002 - DNA, 20 bp, Artificial Sequence
  chemically synthesized
ggtcacaaggtactcagtgg

SEQ ID NO: 419003 - DNA, 20 bp, Artificial Sequence
  chemically synthesized
gggtcacaaggtactcagtg

SEQ ID NO: 419004 - DNA, 20 bp, Artificial Sequence
  chemically synthesized
ggggtcacaaggtactcagt

SEQ ID NO: 419005 - DNA, 20 bp, Artificial Sequence
  chemically synthesized
gggggtcacaaggtactcag

SEQ ID NO: 419006 - DNA, 20 bp, Artificial Sequence
  chemically synthesized
agtgggggtcacaaggtact

SEQ ID NO: 419007 - DNA, 20 bp, Artificial Sequence
  chemically synthesized
aggcaggagtgggggtcaca

SEQ ID NO: 419008 - DNA, 20 bp, Artificial Sequence
  chemically synthesized
caggcaggagtgggggtcac

SEQ ID NO: 419009 - DNA, 20 bp, Artificial Sequence
  chemically synthesized
tctctggcaggcaggagtgg

SEQ ID NO: 419010 - DNA, 20 bp, Artificial Sequence
  chemically synthesized
ttctctggcaggcaggagtg

SEQ ID NO: 419011 - DNA, 20 bp, Artificial Sequence
  chemically synthesized
gttctctggcaggcaggagt

SEQ ID NO: 419012 - DNA, 20 bp, Artificial Sequence
  chemically synthesized
tgttctctggcaggcaggag

SEQ ID NO: 419013 - DNA, 20 bp, Artificial Sequence
  chemically synthesized
ggttgttctctggcaggcag

SEQ ID NO: 419014 - DNA, 20 bp, Artificial Sequence
  chemically synthesized
tgacccccactcctgcctgc

SEQ ID NO: 419015 - DNA, 20 bp, Artificial Sequence
  chemically synthesized
ggggttgttctctggcaggc

SEQ ID NO: 419016 - DNA, 20 bp, Artificial Sequence
  chemically synthesized
acccccactcctgcctgcca

SEQ ID NO: 419017 - DNA, 20 bp, Artificial Sequence
  chemically synthesized
gggggttgttctctggcagg

SEQ ID NO: 419018 - DNA, 20 bp, Artificial Sequence
  chemically synthesized
aaggggggttgttctctggc

SEQ ID NO: 419019 - DNA, 20 bp, Artificial Sequence
  chemically synthesized
aaaggggggttgttctctgg

SEQ ID NO: 419020 - DNA, 20 bp, Artificial Sequence
  chemically synthesized
gaaaaaggggggttgttctc

SEQ ID NO: 419021 - DNA, 20 bp, Artificial Sequence
  chemically synthesized
ggtagataaaggaaaaaggg

SEQ ID NO: 419022 - DNA, 20 bp, Artificial Sequence
  chemically synthesized
gggtagataaaggaaaaagg

SEQ ID NO: 419023 - DNA, 20 bp, Artificial Sequence
  chemically synthesized
tgggtagataaaggaaaaag

SEQ ID NO: 419024 - DNA, 20 bp, Artificial Sequence
  chemically synthesized
ttgggtagataaaggaaaaa

SEQ ID NO: 419025 - DNA, 20 bp, Artificial Sequence
  chemically synthesized
tttgggtagataaaggaaaa

SEQ ID NO: 419026 - DNA, 20 bp, Artificial Sequence
  chemically synthesized
atttgggtagataaaggaaa

SEQ ID NO: 419027 - DNA, 20 bp, Artificial Sequence
  chemically synthesized
tataggatttgggtagataa

SEQ ID NO: 419028 - DNA, 20 bp, Artificial Sequence
  chemically synthesized
ttataggatttgggtagata

SEQ ID NO: 419029 - DNA, 20 bp, Artificial Sequence
  chemically synthesized
gccgttttataggatttggg

SEQ ID NO: 419030 - DNA, 20 bp, Artificial Sequence
  chemically synthesized
ggggccgttttataggattt

SEQ ID NO: 419031 - DNA, 20 bp, Artificial Sequence
  chemically synthesized
tggggccgttttataggatt

SEQ ID NO: 419032 - DNA, 20 bp, Artificial Sequence
  chemically synthesized
tctacccaaatcctataaaa

SEQ ID NO: 419033 - DNA, 20 bp, Artificial Sequence
  chemically synthesized
taggggtggggccgttttat

SEQ ID NO: 419034 - DNA, 20 bp, Artificial Sequence
  chemically synthesized
ataggggtggggccgtttta

SEQ ID NO: 419035 - DNA, 20 bp, Artificial Sequence
  chemically synthesized
agcgaagggagataggggtg

SEQ ID NO: 419036 - DNA, 20 bp, Artificial Sequence
  chemically synthesized
cagcgaagggagataggggt

SEQ ID NO: 419037 - DNA, 20 bp, Artificial Sequence
  chemically synthesized
tcagcgaagggagatagggg

SEQ ID NO: 419038 - DNA, 20 bp, Artificial Sequence
  chemically synthesized
gagtcagcgaagggagatag

SEQ ID NO: 419039 - DNA, 20 bp, Artificial Sequence
  chemically synthesized
agagtcagcgaagggagata

SEQ ID NO: 419040 - DNA, 20 bp, Artificial Sequence
  chemically synthesized
gagagtcagcgaagggagat

SEQ ID NO: 419041 - DNA, 20 bp, Artificial Sequence
  chemically synthesized
agagagtcagcgaagggaga

SEQ ID NO: 419042 - DNA, 20 bp, Artificial Sequence
  chemically synthesized
gaaaagagagtcagcgaagg

SEQ ID NO: 419043 - DNA, 20 bp, Artificial Sequence
  chemically synthesized
ccgaaaagagagtcagcgaa

SEQ ID NO: 419044 - DNA, 20 bp, Artificial Sequence
  chemically synthesized
tccgaaaagagagtcagcga

SEQ ID NO: 419045 - DNA, 20 bp, Artificial Sequence
  chemically synthesized
gtccgaaaagagagtcagcg

SEQ ID NO: 419046 - DNA, 20 bp, Artificial Sequence
  chemically synthesized
gctgagtccgaaaagagagt

SEQ ID NO: 419047 - DNA, 20 bp, Artificial Sequence
  chemically synthesized
cccttcgctgactctctttt

SEQ ID NO: 419048 - DNA, 20 bp, Artificial Sequence
  chemically synthesized
gtgggctgagtccgaaaaga

SEQ ID NO: 419049 - DNA, 20 bp, Artificial Sequence
  chemically synthesized
aggtgggctgagtccgaaaa

SEQ ID NO: 419050 - DNA, 20 bp, Artificial Sequence
  chemically synthesized
gcaggtgggctgagtccgaa

SEQ ID NO: 419051 - DNA, 20 bp, Artificial Sequence
  chemically synthesized
gctgactctcttttcggact

SEQ ID NO: 419052 - DNA, 20 bp, Artificial Sequence
  chemically synthesized
cacctgggtgcaggtgggct

SEQ ID NO: 419053 - DNA, 20 bp, Artificial Sequence
  chemically synthesized
tatttcacctgggtgcaggt

SEQ ID NO: 419054 - DNA, 20 bp, Artificial Sequence
  chemically synthesized
ttatttcacctgggtgcagg

SEQ ID NO: 419055 - DNA, 20 bp, Artificial Sequence
  chemically synthesized
ggactcagcccacctgcacc

SEQ ID NO: 419056 - DNA, 20 bp, Artificial Sequence
  chemically synthesized
gactcagcccacctgcaccc

SEQ ID NO: 419057 - DNA, 20 bp, Artificial Sequence
  chemically synthesized
tgtttatttcacctgggtgc

SEQ ID NO: 419058 - DNA, 20 bp, Artificial Sequence
  chemically synthesized
ctgtttatttcacctgggtg

SEQ ID NO: 419059 - DNA, 20 bp, Artificial Sequence
  chemically synthesized
taaagctgtttatttcacct

SEQ ID NO: 419060 - DNA, 20 bp, Artificial Sequence
  chemically synthesized
ataaagctgtttatttcacc

SEQ ID NO: 419061 - DNA, 20 bp, Artificial Sequence
  chemically synthesized
ctgcacccaggtgaaataaa

SEQ ID NO: 419062 - DNA, 20 bp, Artificial Sequence
  chemically synthesized
aggtgaaataaacagcttta

SEQ ID NO: 419063 - DNA, 20 bp, Artificial Sequence
  chemically synthesized
caggctttgtgtgagccata

SEQ ID NO: 419064 - DNA, 20 bp, Artificial Sequence
  chemically synthesized
acagctttatggctcacaca

SEQ ID NO: 419065 - DNA, 20 bp, Artificial Sequence
  chemically synthesized
ccaccaaacaggctttgtgt

SEQ ID NO: 419066 - DNA, 20 bp, Artificial Sequence
  chemically synthesized
tggctcacacaaagcctgtt

SEQ ID NO: 419067 - DNA, 20 bp, Artificial Sequence
  chemically synthesized
ctcacacaaagcctgtttgg

SEQ ID NO: 419068 - DNA, 20 bp, Artificial Sequence
  chemically synthesized
gtgtgaagagaccaccaaac

SEQ ID NO: 419069 - DNA, 20 bp, Artificial Sequence
  chemically synthesized
cgtgtgaagagaccaccaaa

SEQ ID NO: 419070 - DNA, 20 bp, Artificial Sequence
  chemically synthesized
tgtttggtggtctcttcaca

SEQ ID NO: 419071 - DNA, 20 bp, Artificial Sequence
  chemically synthesized
ttcatacgcgtccgtgtgaa

SEQ ID NO: 419072 - DNA, 20 bp, Artificial Sequence
  chemically synthesized
ctttcatacgcgtccgtgtg

SEQ ID NO: 419073 - DNA, 20 bp, Artificial Sequence
  chemically synthesized
cttcacacggacgcgtatga

SEQ ID NO: 419074 - DNA, 20 bp, Artificial Sequence
  chemically synthesized
gtctgtgtttgaattaagaa

SEQ ID NO: 419075 - DNA, 20 bp, Artificial Sequence
  chemically synthesized
tgggcgtctgtgtttgaatt

SEQ ID NO: 419076 - DNA, 20 bp, Artificial Sequence
  chemically synthesized
aaccattcttaattcaaaca

SEQ ID NO: 419077 - DNA, 20 bp, Artificial Sequence
  chemically synthesized
taattcaaacacagacgccc

SEQ ID NO: 419078 - DNA, 20 bp, Artificial Sequence
  chemically synthesized
tcaaacacagacgcccaagt

SEQ ID NO: 419079 - DNA, 20 bp, Artificial Sequence
  chemically synthesized
taaattcacttttcttactt

SEQ ID NO: 419080 - DNA, 20 bp, Artificial Sequence
  chemically synthesized
ataaattcacttttcttact

SEQ ID NO: 419081 - DNA, 20 bp, Artificial Sequence
  chemically synthesized
cacagacgcccaagtaagaa

SEQ ID NO: 419082 - DNA, 20 bp, Artificial Sequence
  chemically synthesized
gaaaagtgaatttataaaat

SEQ ID NO: 419083 - DNA, 20 bp, Artificial Sequence
  chemically synthesized
aaaagtgaatttataaaatt

SEQ ID NO: 419084 - DNA, 20 bp, Artificial Sequence
  chemically synthesized
taaaattgggtaaaattcac

SEQ ID NO: 419085 - DNA, 20 bp, Artificial Sequence
  chemically synthesized
aaattcacaagctgaattat

SEQ ID NO: 419086 - DNA, 20 bp, Artificial Sequence
  chemically synthesized
cagtttgtgaactaataatt

SEQ ID NO: 419087 - DNA, 20 bp, Artificial Sequence
  chemically synthesized
tagttcacaaactgaaatat

SEQ ID NO: 419088 - DNA, 20 bp, Artificial Sequence
  chemically synthesized
ttaggttattactgatattt

SEQ ID NO: 419089 - DNA, 20 bp, Artificial Sequence
  chemically synthesized
atatcagtaataacctaaaa

SEQ ID NO: 419090 - DNA, 20 bp, Artificial Sequence
  chemically synthesized
ttgagaataaacactatttt

SEQ ID NO: 419091 - DNA, 20 bp, Artificial Sequence
  chemically synthesized
tttgagaataaacactattt

SEQ ID NO: 419092 - DNA, 20 bp, Artificial Sequence
  chemically synthesized
taaaatagtgtttattctca

SEQ ID NO: 419093 - DNA, 20 bp, Artificial Sequence
  chemically synthesized
agagttttcacattgtcttt

SEQ ID NO: 419094 - DNA, 20 bp, Artificial Sequence
  chemically synthesized
gacaatgtgaaaactctcat

SEQ ID NO: 419095 - DNA, 20 bp, Artificial Sequence
  chemically synthesized
acaatgtgaaaactctcatt

SEQ ID NO: 419096 - DNA, 20 bp, Artificial Sequence
  chemically synthesized
tagattctaatgcctaatga

SEQ ID NO: 419097 - DNA, 20 bp, Artificial Sequence
  chemically synthesized
agtagattctaatgcctaat

SEQ ID NO: 419098 - DNA, 20 bp, Artificial Sequence
  chemically synthesized
tgaaaactctcattaggcat

SEQ ID NO: 419099 - DNA, 20 bp, Artificial Sequence
  chemically synthesized
tcacttttgagtttgaaaag

SEQ ID NO: 419100 - DNA, 20 bp, Artificial Sequence
  chemically synthesized
gattcacttttgagtttgaa

SEQ ID NO: 419101 - DNA, 20 bp, Artificial Sequence
  chemically synthesized
aatctacttttcaaactcaa

SEQ ID NO: 419102 - DNA, 20 bp, Artificial Sequence
  chemically synthesized
ttacaaggagattcactttt

SEQ ID NO: 419103 - DNA, 20 bp, Artificial Sequence
  chemically synthesized
ttagctctgataattacaag

SEQ ID NO: 419104 - DNA, 20 bp, Artificial Sequence
  chemically synthesized
atttagctctgataattaca

SEQ ID NO: 419105 - DNA, 20 bp, Artificial Sequence
  chemically synthesized
tatttagctctgataattac

SEQ ID NO: 419106 - DNA, 20 bp, Artificial Sequence
  chemically synthesized
gtgaatctccttgtaattat

SEQ ID NO: 419107 - DNA, 20 bp, Artificial Sequence
  chemically synthesized
gaatctccttgtaattatca

SEQ ID NO: 419108 - DNA, 20 bp, Artificial Sequence
  chemically synthesized
ttactttgtttacatatatt

SEQ ID NO: 419109 - DNA, 20 bp, Artificial Sequence
  chemically synthesized
gagctaaatatatgtaaaca

SEQ ID NO: 419110 - DNA, 20 bp, Artificial Sequence
  chemically synthesized
tgtaaacaaagtaactgatt

SEQ ID NO: 419111 - DNA, 20 bp, Artificial Sequence
  chemically synthesized
tttaatcactttaactaaat

SEQ ID NO: 419112 - DNA, 20 bp, Artificial Sequence
  chemically synthesized
caaagtaactgatttagtta

SEQ ID NO: 419113 - DNA, 20 bp, Artificial Sequence
  chemically synthesized
actgggggagaatgggaaaa

SEQ ID NO: 419114 - DNA, 20 bp, Artificial Sequence
  chemically synthesized
cattttaactgggggagaat

SEQ ID NO: 419115 - DNA, 20 bp, Artificial Sequence
  chemically synthesized
tcattttaactgggggagaa

SEQ ID NO: 419116 - DNA, 20 bp, Artificial Sequence
  chemically synthesized
acttttttcccattctcccc

SEQ ID NO: 419117 - DNA, 20 bp, Artificial Sequence
  chemically synthesized
actgttcattttaactgggg

SEQ ID NO: 419118 - DNA, 20 bp, Artificial Sequence
  chemically synthesized
ccactgttcattttaactgg

SEQ ID NO: 419119 - DNA, 20 bp, Artificial Sequence
  chemically synthesized
gccactgttcattttaactg

SEQ ID NO: 419120 - DNA, 20 bp, Artificial Sequence
  chemically synthesized
agccactgttcattttaact

SEQ ID NO: 419121 - DNA, 20 bp, Artificial Sequence
  chemically synthesized
tagccactgttcattttaac

SEQ ID NO: 419122 - DNA, 20 bp, Artificial Sequence
  chemically synthesized
tctcccccagttaaaatgaa

SEQ ID NO: 419123 - DNA, 20 bp, Artificial Sequence
  chemically synthesized
cccccagttaaaatgaacag

SEQ ID NO: 419124 - DNA, 20 bp, Artificial Sequence
  chemically synthesized
acctttaagataataatttt

SEQ ID NO: 419125 - DNA, 20 bp, Artificial Sequence
  chemically synthesized
ggctaaaaattattatctta

SEQ ID NO: 419126 - DNA, 20 bp, Artificial Sequence
  chemically synthesized
gctaaaaattattatcttaa

SEQ ID NO: 419127 - DNA, 20 bp, Artificial Sequence
  chemically synthesized
ggaactatggataaaccttt

SEQ ID NO: 419128 - DNA, 20 bp, Artificial Sequence
  chemically synthesized
ttatcttaaaggtttatcca

SEQ ID NO: 419129 - DNA, 20 bp, Artificial Sequence
  chemically synthesized
aaatgttgcaattggaacta

SEQ ID NO: 419130 - DNA, 20 bp, Artificial Sequence
  chemically synthesized
acgttttaaaatgttgcaat

SEQ ID NO: 419131 - DNA, 20 bp, Artificial Sequence
  chemically synthesized
tccaatggtctatgtaggaa

SEQ ID NO: 419132 - DNA, 20 bp, Artificial Sequence
  chemically synthesized
ttaaaacgtctattcctaca

SEQ ID NO: 419133 - DNA, 20 bp, Artificial Sequence
  chemically synthesized
tctattccaatggtctatgt

SEQ ID NO: 419134 - DNA, 20 bp, Artificial Sequence
  chemically synthesized
ttctattccaatggtctatg

SEQ ID NO: 419135 - DNA, 20 bp, Artificial Sequence
  chemically synthesized
tctattcctacatagaccat

SEQ ID NO: 419136 - DNA, 20 bp, Artificial Sequence
  chemically synthesized
tcctacatagaccattggaa

SEQ ID NO: 419137 - DNA, 20 bp, Artificial Sequence
  chemically synthesized
gcttctctattctattccaa

SEQ ID NO: 419138 - DNA, 20 bp, Artificial Sequence
  chemically synthesized
catagaccattggaatagaa

SEQ ID NO: 419139 - DNA, 20 bp, Artificial Sequence
  chemically synthesized
tagaccattggaatagaata

SEQ ID NO: 419140 - DNA, 20 bp, Artificial Sequence
  chemically synthesized
accattggaatagaatagag

SEQ ID NO: 419141 - DNA, 20 bp, Artificial Sequence
  chemically synthesized
ttggaatagaatagagaagc

SEQ ID NO: 419142 - DNA, 20 bp, Artificial Sequence
  chemically synthesized
gaatagaatagagaagccag

SEQ ID NO: 419143 - DNA, 20 bp, Artificial Sequence
  chemically synthesized
gaatagagaagccagaagtg

SEQ ID NO: 419144 - DNA, 20 bp, Artificial Sequence
  chemically synthesized
taagtatttggcttcacttc

SEQ ID NO: 419145 - DNA, 20 bp, Artificial Sequence
  chemically synthesized
gtaaattggttttaagtatt

SEQ ID NO: 419146 - DNA, 20 bp, Artificial Sequence
  chemically synthesized
gttgaaggtaaattggtttt

SEQ ID NO: 419147 - DNA, 20 bp, Artificial Sequence
  chemically synthesized
atgctttgttgaaggtaaat

SEQ ID NO: 419148 - DNA, 20 bp, Artificial Sequence
  chemically synthesized
aaaccaatttaccttcaaca

SEQ ID NO: 419149 - DNA, 20 bp, Artificial Sequence
  chemically synthesized
gtttttgtatgctttgttga

SEQ ID NO: 419150 - DNA, 20 bp, Artificial Sequence
  chemically synthesized
tgtttttgtatgctttgttg

SEQ ID NO: 419151 - DNA, 20 bp, Artificial Sequence
  chemically synthesized
aagcatacaaaaacataaat

SEQ ID NO: 419152 - DNA, 20 bp, Artificial Sequence
  chemically synthesized
agcatacaaaaacataaatt

SEQ ID NO: 419153 - DNA, 20 bp, Artificial Sequence
  chemically synthesized
acaaaaacataaattgggca

SEQ ID NO: 419154 - DNA, 20 bp, Artificial Sequence
  chemically synthesized
caaaaacataaattgggcaa

SEQ ID NO: 419155 - DNA, 20 bp, Artificial Sequence
  chemically synthesized
aacataaattgggcaaagga

SEQ ID NO: 419156 - DNA, 20 bp, Artificial Sequence
  chemically synthesized
cccagcaccatttattgaat

SEQ ID NO: 419157 - DNA, 20 bp, Artificial Sequence
  chemically synthesized
tcccagcaccatttattgaa

SEQ ID NO: 419158 - DNA, 20 bp, Artificial Sequence
  chemically synthesized
aggacagcctattcaataaa

SEQ ID NO: 419159 - DNA, 20 bp, Artificial Sequence
  chemically synthesized
gcctattcaataaatggtgc

SEQ ID NO: 419160 - DNA, 20 bp, Artificial Sequence
  chemically synthesized
cctattcaataaatggtgct

SEQ ID NO: 419161 - DNA, 20 bp, Artificial Sequence
  chemically synthesized
aataaatggtgctgggaaaa

SEQ ID NO: 419162 - DNA, 20 bp, Artificial Sequence
  chemically synthesized
ataaatggtgctgggaaaat

SEQ ID NO: 419163 - DNA, 20 bp, Artificial Sequence
  chemically synthesized
atgtggttgtcccattttcc

SEQ ID NO: 419164 - DNA, 20 bp, Artificial Sequence
  chemically synthesized
gaaaatgggacaaccacatg

SEQ ID NO: 419165 - DNA, 20 bp, Artificial Sequence
  chemically synthesized
aatgggacaaccacatgtgg

SEQ ID NO: 419166 - DNA, 20 bp, Artificial Sequence
  chemically synthesized
cagtttcattcttccacatg

SEQ ID NO: 419167 - DNA, 20 bp, Artificial Sequence
  chemically synthesized
cacatgtggaagaatgaaac

SEQ ID NO: 419168 - DNA, 20 bp, Artificial Sequence
  chemically synthesized
tatggtaggagatagggatc

SEQ ID NO: 419169 - DNA, 20 bp, Artificial Sequence
  chemically synthesized
tttgtatatggtaggagata

SEQ ID NO: 419170 - DNA, 20 bp, Artificial Sequence
  chemically synthesized
ttttgtatatggtaggagat

SEQ ID NO: 419171 - DNA, 20 bp, Artificial Sequence
  chemically synthesized
tttttgtatatggtaggaga

SEQ ID NO: 419172 - DNA, 20 bp, Artificial Sequence
  chemically synthesized
ctaatttttgtatatggtag

SEQ ID NO: 419173 - DNA, 20 bp, Artificial Sequence
  chemically synthesized
agctaatttttgtatatggt

SEQ ID NO: 419174 - DNA, 20 bp, Artificial Sequence
  chemically synthesized
gagctaatttttgtatatgg

SEQ ID NO: 419175 - DNA, 20 bp, Artificial Sequence
  chemically synthesized
cttgagctaatttttgtata

SEQ ID NO: 419176 - DNA, 20 bp, Artificial Sequence
  chemically synthesized
ctcctaccatatacaaaaat

SEQ ID NO: 419177 - DNA, 20 bp, Artificial Sequence
  chemically synthesized
ccatatacaaaaattagctc

SEQ ID NO: 419178 - DNA, 20 bp, Artificial Sequence
  chemically synthesized
catatacaaaaattagctca

SEQ ID NO: 419179 - DNA, 20 bp, Artificial Sequence
  chemically synthesized
tatacaaaaattagctcaag

SEQ ID NO: 419180 - DNA, 20 bp, Artificial Sequence
  chemically synthesized
atacaaaaattagctcaagg

SEQ ID NO: 419181 - DNA, 20 bp, Artificial Sequence
  chemically synthesized
ttaagtctttaatcctcctt

SEQ ID NO: 419182 - DNA, 20 bp, Artificial Sequence
  chemically synthesized
aattagctcaaggaggatta

SEQ ID NO: 419183 - DNA, 20 bp, Artificial Sequence
  chemically synthesized
tcaaggaggattaaagactt

SEQ ID NO: 419184 - DNA, 20 bp, Artificial Sequence
  chemically synthesized
aggattaaagacttaagtct

SEQ ID NO: 419185 - DNA, 20 bp, Artificial Sequence
  chemically synthesized
tggtttcaggtcttagactt

SEQ ID NO: 419186 - DNA, 20 bp, Artificial Sequence
  chemically synthesized
agttttatggtttcaggtct

SEQ ID NO: 419187 - DNA, 20 bp, Artificial Sequence
  chemically synthesized
ttgaggagttttatggtttc

SEQ ID NO: 419188 - DNA, 20 bp, Artificial Sequence
  chemically synthesized
tttgaggagttttatggttt

SEQ ID NO: 419189 - DNA, 20 bp, Artificial Sequence
  chemically synthesized
gttttctttgaggagtttta

SEQ ID NO: 419190 - DNA, 20 bp, Artificial Sequence
  chemically synthesized
tgaaaccataaaactcctca

SEQ ID NO: 419191 - DNA, 20 bp, Artificial Sequence
  chemically synthesized
tttcctaggttttctttgag

SEQ ID NO: 419192 - DNA, 20 bp, Artificial Sequence
  chemically synthesized
tttttcctaggttttctttg

SEQ ID NO: 419193 - DNA, 20 bp, Artificial Sequence
  chemically synthesized
gtttttcctaggttttcttt

SEQ ID NO: 419194 - DNA, 20 bp, Artificial Sequence
  chemically synthesized
aaaactcctcaaagaaaacc

SEQ ID NO: 419195 - DNA, 20 bp, Artificial Sequence
  chemically synthesized
aaactcctcaaagaaaacct

SEQ ID NO: 419196 - DNA, 20 bp, Artificial Sequence
  chemically synthesized
tgtccaggagagtttttcct

SEQ ID NO: 419197 - DNA, 20 bp, Artificial Sequence
  chemically synthesized
atgtccaggagagtttttcc

SEQ ID NO: 419198 - DNA, 20 bp, Artificial Sequence
  chemically synthesized
aaacctaggaaaaactctcc

SEQ ID NO: 419199 - DNA, 20 bp, Artificial Sequence
  chemically synthesized
acctaggccaatgtccagga

SEQ ID NO: 419200 - DNA, 20 bp, Artificial Sequence
  chemically synthesized
ttacctaggccaatgtccag

SEQ ID NO: 419201 - DNA, 20 bp, Artificial Sequence
  chemically synthesized
ggaaaaactctcctggacat

SEQ ID NO: 419202 - DNA, 20 bp, Artificial Sequence
  chemically synthesized
ctttacctaggccaatgtcc

SEQ ID NO: 419203 - DNA, 20 bp, Artificial Sequence
  chemically synthesized
tctttacctaggccaatgtc

SEQ ID NO: 419204 - DNA, 20 bp, Artificial Sequence
  chemically synthesized
aactctcctggacattggcc

SEQ ID NO: 419205 - DNA, 20 bp, Artificial Sequence
  chemically synthesized
actctcctggacattggcct

SEQ ID NO: 419206 - DNA, 20 bp, Artificial Sequence
  chemically synthesized
cctggacattggcctaggta

SEQ ID NO: 419207 - DNA, 20 bp, Artificial Sequence
  chemically synthesized
tggtcataaattctttacct

SEQ ID NO: 419208 - DNA, 20 bp, Artificial Sequence
  chemically synthesized
ttggtcataaattctttacc

SEQ ID NO: 419209 - DNA, 20 bp, Artificial Sequence
  chemically synthesized
taggtaaagaatttatgacc

SEQ ID NO: 419210 - DNA, 20 bp, Artificial Sequence
  chemically synthesized
tgcatttgcttttgaggtct

SEQ ID NO: 419211 - DNA, 20 bp, Artificial Sequence
  chemically synthesized
atttatgaccaagacctcaa

SEQ ID NO: 419212 - DNA, 20 bp, Artificial Sequence
  chemically synthesized
ttttgttgcatttgcttttg

SEQ ID NO: 419213 - DNA, 20 bp, Artificial Sequence
  chemically synthesized
tttttgttgcatttgctttt

SEQ ID NO: 419214 - DNA, 20 bp, Artificial Sequence
  chemically synthesized
caaaaataaaaataaacaaa

SEQ ID NO: 419215 - DNA, 20 bp, Artificial Sequence
  chemically synthesized
aaaaataaaaataaacaaat

SEQ ID NO: 419216 - DNA, 20 bp, Artificial Sequence
  chemically synthesized
aaaataaacaaatgggatct

SEQ ID NO: 419217 - DNA, 20 bp, Artificial Sequence
  chemically synthesized
cagaagctttttagtttact

SEQ ID NO: 419218 - DNA, 20 bp, Artificial Sequence
  chemically synthesized
tgggatctaagtaaactaaa

SEQ ID NO: 419219 - DNA, 20 bp, Artificial Sequence
  chemically synthesized
tttgctgtgcagaagctttt

SEQ ID NO: 419220 - DNA, 20 bp, Artificial Sequence
  chemically synthesized
taaactaaaaagcttctgca

SEQ ID NO: 419221 - DNA, 20 bp, Artificial Sequence
  chemically synthesized
ttatttcttttgctgtgcag

SEQ ID NO: 419222 - DNA, 20 bp, Artificial Sequence
  chemically synthesized
tggttatttcttttgctgtg

SEQ ID NO: 419223 - DNA, 20 bp, Artificial Sequence
  chemically synthesized
aaaaagcttctgcacagcaa

SEQ ID NO: 419224 - DNA, 20 bp, Artificial Sequence
  chemically synthesized
cggttttctgtttacgttga

SEQ ID NO: 419225 - DNA, 20 bp, Artificial Sequence
  chemically synthesized
gaaataaccatcaacgtaaa

SEQ ID NO: 419226 - DNA, 20 bp, Artificial Sequence
  chemically synthesized
caacgtaaacagaaaaccga

SEQ ID NO: 419227 - DNA, 20 bp, Artificial Sequence
  chemically synthesized
taaacagaaaaccgacagaa

SEQ ID NO: 419228 - DNA, 20 bp, Artificial Sequence
  chemically synthesized
aatatttttttccattctgt

SEQ ID NO: 419229 - DNA, 20 bp, Artificial Sequence
  chemically synthesized
tattggtcagttgtcagatg

SEQ ID NO: 419230 - DNA, 20 bp, Artificial Sequence
  chemically synthesized
tgtagatattggtcagttgt

SEQ ID NO: 419231 - DNA, 20 bp, Artificial Sequence
  chemically synthesized
tgtaggttgtagatattggt

SEQ ID NO: 419232 - DNA, 20 bp, Artificial Sequence
  chemically synthesized
tctttgtaggttgtagatat

SEQ ID NO: 419233 - DNA, 20 bp, Artificial Sequence
  chemically synthesized
cttgagttctttgtaggttg

SEQ ID NO: 419234 - DNA, 20 bp, Artificial Sequence
  chemically synthesized
accaatatctacaacctaca

SEQ ID NO: 419235 - DNA, 20 bp, Artificial Sequence
  chemically synthesized
gatttgcttgagttctttgt

SEQ ID NO: 419236 - DNA, 20 bp, Artificial Sequence
  chemically synthesized
tgatttgcttgagttctttg

SEQ ID NO: 419237 - DNA, 20 bp, Artificial Sequence
  chemically synthesized
ctacaacctacaaagaactc

SEQ ID NO: 419238 - DNA, 20 bp, Artificial Sequence
  chemically synthesized
ttcttcttgctgatttgctt

SEQ ID NO: 419239 - DNA, 20 bp, Artificial Sequence
  chemically synthesized
tacaaagaactcaagcaaat

SEQ ID NO: 419240 - DNA, 20 bp, Artificial Sequence
  chemically synthesized
aagaactcaagcaaatcagc

SEQ ID NO: 419241 - DNA, 20 bp, Artificial Sequence
  chemically synthesized
aactcaagcaaatcagcaag

SEQ ID NO: 419242 - DNA, 20 bp, Artificial Sequence
  chemically synthesized
aagaaaacaatctctttaaa

SEQ ID NO: 419243 - DNA, 20 bp, Artificial Sequence
  chemically synthesized
tcgtttccaagctttttaaa

SEQ ID NO: 419244 - DNA, 20 bp, Artificial Sequence
  chemically synthesized
tgtcgtttccaagcttttta

SEQ ID NO: 419245 - DNA, 20 bp, Artificial Sequence
  chemically synthesized
aacaatctctttaaaaagct

SEQ ID NO: 419246 - DNA, 20 bp, Artificial Sequence
  chemically synthesized
tgtatattcttgtcgtttcc

SEQ ID NO: 419247 - DNA, 20 bp, Artificial Sequence
  chemically synthesized
ttaaaaagcttggaaacgac

SEQ ID NO: 419248 - DNA, 20 bp, Artificial Sequence
  chemically synthesized
caagaatatacatttctcaa

SEQ ID NO: 419249 - DNA, 20 bp, Artificial Sequence
  chemically synthesized
gaatatacatttctcaaaag

SEQ ID NO: 419250 - DNA, 20 bp, Artificial Sequence
  chemically synthesized
tcatttgtatatcttctttt

SEQ ID NO: 419251 - DNA, 20 bp, Artificial Sequence
  chemically synthesized
ccctgatgattagtgatgtt

SEQ ID NO: 419252 - DNA, 20 bp, Artificial Sequence
  chemically synthesized
tacttaacatcactaatcat

SEQ ID NO: 419253 - DNA, 20 bp, Artificial Sequence
  chemically synthesized
acttaacatcactaatcatc

SEQ ID NO: 419254 - DNA, 20 bp, Artificial Sequence
  chemically synthesized
cttaacatcactaatcatca

SEQ ID NO: 419255 - DNA, 20 bp, Artificial Sequence
  chemically synthesized
atttgcattcccctgatgat

SEQ ID NO: 419256 - DNA, 20 bp, Artificial Sequence
  chemically synthesized
ttaacatcactaatcatcag

SEQ ID NO: 419257 - DNA, 20 bp, Artificial Sequence
  chemically synthesized
atgcaaattaaaaccacaat

SEQ ID NO: 419258 - DNA, 20 bp, Artificial Sequence
  chemically synthesized
gataaggaagtatctcattg

SEQ ID NO: 419259 - DNA, 20 bp, Artificial Sequence
  chemically synthesized
ccattctggctaagataagg

SEQ ID NO: 419260 - DNA, 20 bp, Artificial Sequence
  chemically synthesized
aatgagatacttccttatct

SEQ ID NO: 419261 - DNA, 20 bp, Artificial Sequence
  chemically synthesized
tggccattctggctaagata

SEQ ID NO: 419262 - DNA, 20 bp, Artificial Sequence
  chemically synthesized
atggccattctggctaagat

SEQ ID NO: 419263 - DNA, 20 bp, Artificial Sequence
  chemically synthesized
agatacttccttatcttagc

SEQ ID NO: 419264 - DNA, 20 bp, Artificial Sequence
  chemically synthesized
taataatggccattctggct

SEQ ID NO: 419265 - DNA, 20 bp, Artificial Sequence
  chemically synthesized
cttccttatcttagccagaa

SEQ ID NO: 419266 - DNA, 20 bp, Artificial Sequence
  chemically synthesized
ctttttaataatggccattc

SEQ ID NO: 419267 - DNA, 20 bp, Artificial Sequence
  chemically synthesized
gttttttgactttttaataa

SEQ ID NO: 419268 - DNA, 20 bp, Artificial Sequence
  chemically synthesized
ccagaatggccattattaaa

SEQ ID NO: 419269 - DNA, 20 bp, Artificial Sequence
  chemically synthesized
agtcaaaaaacaataaacgt

SEQ ID NO: 419270 - DNA, 20 bp, Artificial Sequence
  chemically synthesized
aaaaacaataaacgttggca

SEQ ID NO: 419271 - DNA, 20 bp, Artificial Sequence
  chemically synthesized
caataaacgttggcatggac

SEQ ID NO: 419272 - DNA, 20 bp, Artificial Sequence
  chemically synthesized
gttggcatggacaagataaa

SEQ ID NO: 419273 - DNA, 20 bp, Artificial Sequence
  chemically synthesized
tggcatggacaagataaaaa

SEQ ID NO: 419274 - DNA, 20 bp, Artificial Sequence
  chemically synthesized
cacttccaccagcagtatat

SEQ ID NO: 419275 - DNA, 20 bp, Artificial Sequence
  chemically synthesized
agagaacacttatatactgc

SEQ ID NO: 419276 - DNA, 20 bp, Artificial Sequence
  chemically synthesized
gaacacttatatactgctgg

SEQ ID NO: 419277 - DNA, 20 bp, Artificial Sequence
  chemically synthesized
cacttatatactgctggtgg

SEQ ID NO: 419278 - DNA, 20 bp, Artificial Sequence
  chemically synthesized
ttaatttacacttccaccag

SEQ ID NO: 419279 - DNA, 20 bp, Artificial Sequence
  chemically synthesized
gtattaatttacacttccac

SEQ ID NO: 419280 - DNA, 20 bp, Artificial Sequence
  chemically synthesized
agtgtaaattaatacctctc

SEQ ID NO: 419281 - DNA, 20 bp, Artificial Sequence
  chemically synthesized
ctccatactgttttccagag

SEQ ID NO: 419282 - DNA, 20 bp, Artificial Sequence
  chemically synthesized
tctccatactgttttccaga

SEQ ID NO: 419283 - DNA, 20 bp, Artificial Sequence
  chemically synthesized
attaatacctctctggaaaa

SEQ ID NO: 419284 - DNA, 20 bp, Artificial Sequence
  chemically synthesized
aatctccatactgttttcca

SEQ ID NO: 419285 - DNA, 20 bp, Artificial Sequence
  chemically synthesized
gaaatctccatactgttttc

SEQ ID NO: 419286 - DNA, 20 bp, Artificial Sequence
  chemically synthesized
tacctctctggaaaacagta

SEQ ID NO: 419287 - DNA, 20 bp, Artificial Sequence
  chemically synthesized
cctctctggaaaacagtatg

SEQ ID NO: 419288 - DNA, 20 bp, Artificial Sequence
  chemically synthesized
aacagtatggagatttctca

SEQ ID NO: 419289 - DNA, 20 bp, Artificial Sequence
  chemically synthesized
atggagatttctcaaagaac

SEQ ID NO: 419290 - DNA, 20 bp, Artificial Sequence
  chemically synthesized
atacctacttctagttcttt

SEQ ID NO: 419291 - DNA, 20 bp, Artificial Sequence
  chemically synthesized
gagatttctcaaagaactag

SEQ ID NO: 419292 - DNA, 20 bp, Artificial Sequence
  chemically synthesized
atttctcaaagaactagaag

SEQ ID NO: 419293 - DNA, 20 bp, Artificial Sequence
  chemically synthesized
tttctcaaagaactagaagt

SEQ ID NO: 419294 - DNA, 20 bp, Artificial Sequence
  chemically synthesized
ttgaatggtatacctacttc

SEQ ID NO: 419295 - DNA, 20 bp, Artificial Sequence
  chemically synthesized
attaggattcgtggattgaa

SEQ ID NO: 419296 - DNA, 20 bp, Artificial Sequence
  chemically synthesized
atatgcagtattaggattcg

SEQ ID NO: 419297 - DNA, 20 bp, Artificial Sequence
  chemically synthesized
tttggtagatatgcagtatt

SEQ ID NO: 419298 - DNA, 20 bp, Artificial Sequence
  chemically synthesized
ttttggtagatatgcagtat

SEQ ID NO: 419299 - DNA, 20 bp, Artificial Sequence
  chemically synthesized
tttttattttggtagatatg

SEQ ID NO: 419300 - DNA, 20 bp, Artificial Sequence
  chemically synthesized
gtgacttatttttattttgg

SEQ ID NO: 419301 - DNA, 20 bp, Artificial Sequence
  chemically synthesized
atagtgacttatttttattt

SEQ ID NO: 419302 - DNA, 20 bp, Artificial Sequence
  chemically synthesized
atatctaccaaaataaaaat

SEQ ID NO: 419303 - DNA, 20 bp, Artificial Sequence
  chemically synthesized
aaataagtcactatatgaaa

SEQ ID NO: 419304 - DNA, 20 bp, Artificial Sequence
  chemically synthesized
atgcaggtgcctttttcata

SEQ ID NO: 419305 - DNA, 20 bp, Artificial Sequence
  chemically synthesized
aataagtcactatatgaaaa

SEQ ID NO: 419306 - DNA, 20 bp, Artificial Sequence
  chemically synthesized
tgcaataaacatatgtatgc

SEQ ID NO: 419307 - DNA, 20 bp, Artificial Sequence
  chemically synthesized
ctgcaataaacatatgtatg

SEQ ID NO: 419308 - DNA, 20 bp, Artificial Sequence
  chemically synthesized
ctgcatacatatgtttattg

SEQ ID NO: 419309 - DNA, 20 bp, Artificial Sequence
  chemically synthesized
cagcacaattcacaatcgca

SEQ ID NO: 419310 - DNA, 20 bp, Artificial Sequence
  chemically synthesized
aattcacaatcgcaaagata

SEQ ID NO: 419311 - DNA, 20 bp, Artificial Sequence
  chemically synthesized
caaagatatagaatccacct

SEQ ID NO: 419312 - DNA, 20 bp, Artificial Sequence
  chemically synthesized
aagatatagaatccacctta

SEQ ID NO: 419313 - DNA, 20 bp, Artificial Sequence
  chemically synthesized
tttctttatccactctaagg

SEQ ID NO: 419314 - DNA, 20 bp, Artificial Sequence
  chemically synthesized
atatagaatccaccttagag

SEQ ID NO: 419315 - DNA, 20 bp, Artificial Sequence
  chemically synthesized
cattttctttatccactcta

SEQ ID NO: 419316 - DNA, 20 bp, Artificial Sequence
  chemically synthesized
acattttctttatccactct

SEQ ID NO: 419317 - DNA, 20 bp, Artificial Sequence
  chemically synthesized
aatccaccttagagtggata

SEQ ID NO: 419318 - DNA, 20 bp, Artificial Sequence
  chemically synthesized
agagtggataaagaaaatgt

SEQ ID NO: 419319 - DNA, 20 bp, Artificial Sequence
  chemically synthesized
tgtgtgtgtgtgtgtgtgtg

SEQ ID NO: 419320 - DNA, 20 bp, Artificial Sequence
  chemically synthesized
acacacacacacacacacca

SEQ ID NO: 419321 - DNA, 20 bp, Artificial Sequence
  chemically synthesized
tatggctgagtagtattcta

SEQ ID NO: 419322 - DNA, 20 bp, Artificial Sequence
  chemically synthesized
acacaccatagaatactact

SEQ ID NO: 419323 - DNA, 20 bp, Artificial Sequence
  chemically synthesized
tcattgtttatatggctgag

SEQ ID NO: 419324 - DNA, 20 bp, Artificial Sequence
  chemically synthesized
atttcattgtttatatggct

SEQ ID NO: 419325 - DNA, 20 bp, Artificial Sequence
  chemically synthesized
acgttatttcattgtttata

SEQ ID NO: 419326 - DNA, 20 bp, Artificial Sequence
  chemically synthesized
caatgaaataacgtcttctg

SEQ ID NO: 419327 - DNA, 20 bp, Artificial Sequence
  chemically synthesized
ttccatccaagttgctgcag

SEQ ID NO: 419328 - DNA, 20 bp, Artificial Sequence
  chemically synthesized
cagttccatccaagttgctg

SEQ ID NO: 419329 - DNA, 20 bp, Artificial Sequence
  chemically synthesized
taacgtcttctgcagcaact

SEQ ID NO: 419330 - DNA, 20 bp, Artificial Sequence
  chemically synthesized
gtcttctgcagcaacttgga

SEQ ID NO: 419331 - DNA, 20 bp, Artificial Sequence
  chemically synthesized
aataacctccagttccatcc

SEQ ID NO: 419332 - DNA, 20 bp, Artificial Sequence
  chemically synthesized
tgcagcaacttggatggaac

SEQ ID NO: 419333 - DNA, 20 bp, Artificial Sequence
  chemically synthesized
cagcaacttggatggaactg

SEQ ID NO: 419334 - DNA, 20 bp, Artificial Sequence
  chemically synthesized
agcaacttggatggaactgg

SEQ ID NO: 419335 - DNA, 20 bp, Artificial Sequence
  chemically synthesized
tcacttagaataataacctc

SEQ ID NO: 419336 - DNA, 20 bp, Artificial Sequence
  chemically synthesized
gaactggaggttattattct

SEQ ID NO: 419337 - DNA, 20 bp, Artificial Sequence
  chemically synthesized
ggaggttattattctaagtg

SEQ ID NO: 419338 - DNA, 20 bp, Artificial Sequence
  chemically synthesized
catttctgagttacttcact

SEQ ID NO: 419339 - DNA, 20 bp, Artificial Sequence
  chemically synthesized
ttattctaagtgaagtaact

SEQ ID NO: 419340 - DNA, 20 bp, Artificial Sequence
  chemically synthesized
taagtgaagtaactcagaaa

SEQ ID NO: 419341 - DNA, 20 bp, Artificial Sequence
  chemically synthesized
gtatttgattttccatttct

SEQ ID NO: 419342 - DNA, 20 bp, Artificial Sequence
  chemically synthesized
ccattataagtgagaacaca

SEQ ID NO: 419343 - DNA, 20 bp, Artificial Sequence
  chemically synthesized
agttagttcccattataagt

SEQ ID NO: 419344 - DNA, 20 bp, Artificial Sequence
  chemically synthesized
ctgtgtgttctcacttataa

SEQ ID NO: 419345 - DNA, 20 bp, Artificial Sequence
  chemically synthesized
tgtgtgttctcacttataat

SEQ ID NO: 419346 - DNA, 20 bp, Artificial Sequence
  chemically synthesized
cataagttagttcccattat

SEQ ID NO: 419347 - DNA, 20 bp, Artificial Sequence
  chemically synthesized
tataatgggaactaacttat

SEQ ID NO: 419348 - DNA, 20 bp, Artificial Sequence
  chemically synthesized
gcctttgcatactcataagt

SEQ ID NO: 419349 - DNA, 20 bp, Artificial Sequence
  chemically synthesized
gtatgcctttgcatactcat

SEQ ID NO: 419350 - DNA, 20 bp, Artificial Sequence
  chemically synthesized
aactaacttatgagtatgca

SEQ ID NO: 419351 - DNA, 20 bp, Artificial Sequence
  chemically synthesized
actaacttatgagtatgcaa

SEQ ID NO: 419352 - DNA, 20 bp, Artificial Sequence
  chemically synthesized
tatgagtatgcaaaggcata

SEQ ID NO: 419353 - DNA, 20 bp, Artificial Sequence
  chemically synthesized
tgagtatgcaaaggcataca

SEQ ID NO: 419354 - DNA, 20 bp, Artificial Sequence
  chemically synthesized
aaaggcatacagagtgatat

SEQ ID NO: 419355 - DNA, 20 bp, Artificial Sequence
  chemically synthesized
aaggcatacagagtgatata

SEQ ID NO: 419356 - DNA, 20 bp, Artificial Sequence
  chemically synthesized
aggcatacagagtgatataa

SEQ ID NO: 419357 - DNA, 20 bp, Artificial Sequence
  chemically synthesized
cagagtgatataagggactt

SEQ ID NO: 419358 - DNA, 20 bp, Artificial Sequence
  chemically synthesized
gagtgatataagggacttca

SEQ ID NO: 419359 - DNA, 20 bp, Artificial Sequence
  chemically synthesized
cctccacttctgagtctctg

SEQ ID NO: 419360 - DNA, 20 bp, Artificial Sequence
  chemically synthesized
tataagggacttcagagact

SEQ ID NO: 419361 - DNA, 20 bp, Artificial Sequence
  chemically synthesized
aagggacttcagagactcag

SEQ ID NO: 419362 - DNA, 20 bp, Artificial Sequence
  chemically synthesized
ggacttcagagactcagaag

SEQ ID NO: 419363 - DNA, 20 bp, Artificial Sequence
  chemically synthesized
acttcagagactcagaagtg

SEQ ID NO: 419364 - DNA, 20 bp, Artificial Sequence
  chemically synthesized
ttcccaccccctccacttct

SEQ ID NO: 419365 - DNA, 20 bp, Artificial Sequence
  chemically synthesized
cttcagagactcagaagtgg

SEQ ID NO: 419366 - DNA, 20 bp, Artificial Sequence
  chemically synthesized
ttcagagactcagaagtgga

SEQ ID NO: 419367 - DNA, 20 bp, Artificial Sequence
  chemically synthesized
tcagagactcagaagtggag

SEQ ID NO: 419368 - DNA, 20 bp, Artificial Sequence
  chemically synthesized
cagagactcagaagtggagg

SEQ ID NO: 419369 - DNA, 20 bp, Artificial Sequence
  chemically synthesized
agactcagaagtggaggggg

SEQ ID NO: 419370 - DNA, 20 bp, Artificial Sequence
  chemically synthesized
gactcagaagtggagggggt

SEQ ID NO: 419371 - DNA, 20 bp, Artificial Sequence
  chemically synthesized
gaagtggagggggtgggaat

SEQ ID NO: 419372 - DNA, 20 bp, Artificial Sequence
  chemically synthesized
aagtggagggggtgggaatg

SEQ ID NO: 419373 - DNA, 20 bp, Artificial Sequence
  chemically synthesized
agtggagggggtgggaatga

SEQ ID NO: 419374 - DNA, 20 bp, Artificial Sequence
  chemically synthesized
agggataaaaaactacatat

SEQ ID NO: 419375 - DNA, 20 bp, Artificial Sequence
  chemically synthesized
gggataaaaaactacatatt

SEQ ID NO: 419376 - DNA, 20 bp, Artificial Sequence
  chemically synthesized
tgtacgttgtacccaatatg

SEQ ID NO: 419377 - DNA, 20 bp, Artificial Sequence
  chemically synthesized
tgggtacaacgtacactact

SEQ ID NO: 419378 - DNA, 20 bp, Artificial Sequence
  chemically synthesized
gggtacaacgtacactactc

SEQ ID NO: 419379 - DNA, 20 bp, Artificial Sequence
  chemically synthesized
ttattgagccgtcacccgag

SEQ ID NO: 419380 - DNA, 20 bp, Artificial Sequence
  chemically synthesized
aacgtacactactcgggtga

SEQ ID NO: 419381 - DNA, 20 bp, Artificial Sequence
  chemically synthesized
attttattgagccgtcaccc

SEQ ID NO: 419382 - DNA, 20 bp, Artificial Sequence
  chemically synthesized
gtgaagtccgggattttatt

SEQ ID NO: 419383 - DNA, 20 bp, Artificial Sequence
  chemically synthesized
gtgacggctcaataaaatcc

SEQ ID NO: 419384 - DNA, 20 bp, Artificial Sequence
  chemically synthesized
attgtataatggtgaagtcc

SEQ ID NO: 419385 - DNA, 20 bp, Artificial Sequence
  chemically synthesized
aattgtataatggtgaagtc

SEQ ID NO: 419386 - DNA, 20 bp, Artificial Sequence
  chemically synthesized
gtatgaattgtataatggtg

SEQ ID NO: 419387 - DNA, 20 bp, Artificial Sequence
  chemically synthesized
tacgtgtatgaattgtataa

SEQ ID NO: 419388 - DNA, 20 bp, Artificial Sequence
  chemically synthesized
attatacaattcatacacgt

SEQ ID NO: 419389 - DNA, 20 bp, Artificial Sequence
  chemically synthesized
aatagctttagggtttcaag

SEQ ID NO: 419390 - DNA, 20 bp, Artificial Sequence
  chemically synthesized
ttcaatagctttagggtttc

SEQ ID NO: 419391 - DNA, 20 bp, Artificial Sequence
  chemically synthesized
aaaaaccacttgaaacccta

SEQ ID NO: 419392 - DNA, 20 bp, Artificial Sequence
  chemically synthesized
gttgtacttcaatagcttta

SEQ ID NO: 419393 - DNA, 20 bp, Artificial Sequence
  chemically synthesized
tgttgtacttcaatagcttt

SEQ ID NO: 419394 - DNA, 20 bp, Artificial Sequence
  chemically synthesized
ttgttgtacttcaatagctt

SEQ ID NO: 419395 - DNA, 20 bp, Artificial Sequence
  chemically synthesized
ttgaaaccctaaagctattg

SEQ ID NO: 419396 - DNA, 20 bp, Artificial Sequence
  chemically synthesized
tttattttgttgtacttcaa

SEQ ID NO: 419397 - DNA, 20 bp, Artificial Sequence
  chemically synthesized
aataaaatgtatattccaat

SEQ ID NO: 419398 - DNA, 20 bp, Artificial Sequence
  chemically synthesized
taaaatgtatattccaataa

SEQ ID NO: 419399 - DNA, 20 bp, Artificial Sequence
  chemically synthesized
aaaatgtatattccaataag

SEQ ID NO: 419400 - DNA, 20 bp, Artificial Sequence
  chemically synthesized
gactacaaacttcctcttat

SEQ ID NO: 419401 - DNA, 20 bp, Artificial Sequence
  chemically synthesized
atgtatattccaataagagg

SEQ ID NO: 419402 - DNA, 20 bp, Artificial Sequence
  chemically synthesized
ttccaataagaggaagtttg

SEQ ID NO: 419403 - DNA, 20 bp, Artificial Sequence
  chemically synthesized
ttgctgagcaataagaatat

SEQ ID NO: 419404 - DNA, 20 bp, Artificial Sequence
  chemically synthesized
agtcttatattcttattgct

SEQ ID NO: 419405 - DNA, 20 bp, Artificial Sequence
  chemically synthesized
tgtacaatttgctgagcaat

SEQ ID NO: 419406 - DNA, 20 bp, Artificial Sequence
  chemically synthesized
cccttaatgtacaatttgct

SEQ ID NO: 419407 - DNA, 20 bp, Artificial Sequence
  chemically synthesized
tgctcagcaaattgtacatt

SEQ ID NO: 419408 - DNA, 20 bp, Artificial Sequence
  chemically synthesized
gctcagcaaattgtacatta

SEQ ID NO: 419409 - DNA, 20 bp, Artificial Sequence
  chemically synthesized
ctcagcaaattgtacattaa

SEQ ID NO: 419410 - DNA, 20 bp, Artificial Sequence
  chemically synthesized
aattagtgaaaaatatttta

SEQ ID NO: 419411 - DNA, 20 bp, Artificial Sequence
  chemically synthesized
atgattactagtaattaaat

SEQ ID NO: 419412 - DNA, 20 bp, Artificial Sequence
  chemically synthesized
tttttcactaatttaattac

SEQ ID NO: 419413 - DNA, 20 bp, Artificial Sequence
  chemically synthesized
ttttggctttacatgattac

SEQ ID NO: 419414 - DNA, 20 bp, Artificial Sequence
  chemically synthesized
taattactagtaatcatgta

SEQ ID NO: 419415 - DNA, 20 bp, Artificial Sequence
  chemically synthesized
ccctgtgaatgtttatgttt

SEQ ID NO: 419416 - DNA, 20 bp, Artificial Sequence
  chemically synthesized
agccaaaacataaacattca

SEQ ID NO: 419417 - DNA, 20 bp, Artificial Sequence
  chemically synthesized
gccaaaacataaacattcac

SEQ ID NO: 419418 - DNA, 20 bp, Artificial Sequence
  chemically synthesized
ccaaaacataaacattcaca

SEQ ID NO: 419419 - DNA, 20 bp, Artificial Sequence
  chemically synthesized
taaacattcacagggcttcc

SEQ ID NO: 419420 - DNA, 20 bp, Artificial Sequence
  chemically synthesized
tgaggaaatagatcaccagg

SEQ ID NO: 419421 - DNA, 20 bp, Artificial Sequence
  chemically synthesized
atatgaggaaatagatcacc

SEQ ID NO: 419422 - DNA, 20 bp, Artificial Sequence
  chemically synthesized
aatatgaggaaatagatcac

SEQ ID NO: 419423 - DNA, 20 bp, Artificial Sequence
  chemically synthesized
gaggaaaaaatatgaggaaa

SEQ ID NO: 419424 - DNA, 20 bp, Artificial Sequence
  chemically synthesized
aatgaggaggaaaaaatatg

SEQ ID NO: 419425 - DNA, 20 bp, Artificial Sequence
  chemically synthesized
taatgaggaggaaaaaatat

SEQ ID NO: 419426 - DNA, 20 bp, Artificial Sequence
  chemically synthesized
ttatgaggcaaataatgagg

SEQ ID NO: 419427 - DNA, 20 bp, Artificial Sequence
  chemically synthesized
attatgaggcaaataatgag

SEQ ID NO: 419428 - DNA, 20 bp, Artificial Sequence
  chemically synthesized
acattatgaggcaaataatg

SEQ ID NO: 419429 - DNA, 20 bp, Artificial Sequence
  chemically synthesized
aacattatgaggcaaataat

SEQ ID NO: 419430 - DNA, 20 bp, Artificial Sequence
  chemically synthesized
gatgtgttcaaaacattatg

SEQ ID NO: 419431 - DNA, 20 bp, Artificial Sequence
  chemically synthesized
ggatgtgttcaaaacattat

SEQ ID NO: 419432 - DNA, 20 bp, Artificial Sequence
  chemically synthesized
gggaagcttattgaagacag

SEQ ID NO: 419433 - DNA, 20 bp, Artificial Sequence
  chemically synthesized
taagggaagcttattgaaga

SEQ ID NO: 419434 - DNA, 20 bp, Artificial Sequence
  chemically synthesized
acacatccactgtcttcaat

SEQ ID NO: 419435 - DNA, 20 bp, Artificial Sequence
  chemically synthesized
gttgtaagggaagcttattg

SEQ ID NO: 419436 - DNA, 20 bp, Artificial Sequence
  chemically synthesized
cacatttgatgttgtaaggg

SEQ ID NO: 419437 - DNA, 20 bp, Artificial Sequence
  chemically synthesized
aatcacatttgatgttgtaa

SEQ ID NO: 419438 - DNA, 20 bp, Artificial Sequence
  chemically synthesized
aaatcacatttgatgttgta

SEQ ID NO: 419439 - DNA, 20 bp, Artificial Sequence
  chemically synthesized
gaaatcacatttgatgttgt

SEQ ID NO: 419440 - DNA, 20 bp, Artificial Sequence
  chemically synthesized
ggaagtgaataggggaaaat

SEQ ID NO: 419441 - DNA, 20 bp, Artificial Sequence
  chemically synthesized
tggaagtgaataggggaaaa

SEQ ID NO: 419442 - DNA, 20 bp, Artificial Sequence
  chemically synthesized
tctctgttggaagtgaatag

SEQ ID NO: 419443 - DNA, 20 bp, Artificial Sequence
  chemically synthesized
atctctgttggaagtgaata

SEQ ID NO: 419444 - DNA, 20 bp, Artificial Sequence
  chemically synthesized
aatctctgttggaagtgaat

SEQ ID NO: 419445 - DNA, 20 bp, Artificial Sequence
  chemically synthesized
aaatctctgttggaagtgaa

SEQ ID NO: 419446 - DNA, 20 bp, Artificial Sequence
  chemically synthesized
tttcccctattcacttccaa

SEQ ID NO: 419447 - DNA, 20 bp, Artificial Sequence
  chemically synthesized
tcccctattcacttccaaca

SEQ ID NO: 419448 - DNA, 20 bp, Artificial Sequence
  chemically synthesized
ccaactaaaatctctgttgg

SEQ ID NO: 419449 - DNA, 20 bp, Artificial Sequence
  chemically synthesized
taaccaactaaaatctctgt

SEQ ID NO: 419450 - DNA, 20 bp, Artificial Sequence
  chemically synthesized
ttcacttccaacagagattt

SEQ ID NO: 419451 - DNA, 20 bp, Artificial Sequence
  chemically synthesized
cttccaacagagattttagt

SEQ ID NO: 419452 - DNA, 20 bp, Artificial Sequence
  chemically synthesized
cagagattttagttggttat

SEQ ID NO: 419453 - DNA, 20 bp, Artificial Sequence
  chemically synthesized
ttggttatcagatcctgttg

SEQ ID NO: 419454 - DNA, 20 bp, Artificial Sequence
  chemically synthesized
taatgcctgtcagccacaac

SEQ ID NO: 419455 - DNA, 20 bp, Artificial Sequence
  chemically synthesized
ctaatgcctgtcagccacaa

SEQ ID NO: 419456 - DNA, 20 bp, Artificial Sequence
  chemically synthesized
tcagatcctgttgtggctga

SEQ ID NO: 419457 - DNA, 20 bp, Artificial Sequence
  chemically synthesized
cagatcctgttgtggctgac

SEQ ID NO: 419458 - DNA, 20 bp, Artificial Sequence
  chemically synthesized
tttctatttctaatgcctgt

SEQ ID NO: 419459 - DNA, 20 bp, Artificial Sequence
  chemically synthesized
ctgttgtggctgacaggcat

SEQ ID NO: 419460 - DNA, 20 bp, Artificial Sequence
  chemically synthesized
tggctgacaggcattagaaa

SEQ ID NO: 419461 - DNA, 20 bp, Artificial Sequence
  chemically synthesized
attagaaatagaaaattatc

SEQ ID NO: 419462 - DNA, 20 bp, Artificial Sequence
  chemically synthesized
agaaaattatcaagttactt

SEQ ID NO: 419463 - DNA, 20 bp, Artificial Sequence
  chemically synthesized
gaaaattatcaagttacttg

SEQ ID NO: 419464 - DNA, 20 bp, Artificial Sequence
  chemically synthesized
gccctcaatttcatggcctc

SEQ ID NO: 419465 - DNA, 20 bp, Artificial Sequence
  chemically synthesized
ttacttgaggccatgaaatt

SEQ ID NO: 419466 - DNA, 20 bp, Artificial Sequence
  chemically synthesized
gtgtttggccctcaatttca

SEQ ID NO: 419467 - DNA, 20 bp, Artificial Sequence
  chemically synthesized
tacttgaggccatgaaattg

SEQ ID NO: 419468 - DNA, 20 bp, Artificial Sequence
  chemically synthesized
acttgaggccatgaaattga

SEQ ID NO: 419469 - DNA, 20 bp, Artificial Sequence
  chemically synthesized
atgaaattgagggccaaaca

SEQ ID NO: 419470 - DNA, 20 bp, Artificial Sequence
  chemically synthesized
gctttttggaaatctgtgtt

SEQ ID NO: 419471 - DNA, 20 bp, Artificial Sequence
  chemically synthesized
gccaaacacagatttccaaa

SEQ ID NO: 419472 - DNA, 20 bp, Artificial Sequence
  chemically synthesized
atcgaaaacagcaagctttt

SEQ ID NO: 419473 - DNA, 20 bp, Artificial Sequence
  chemically synthesized
ataaccatatcgaaaacagc

SEQ ID NO: 419474 - DNA, 20 bp, Artificial Sequence
  chemically synthesized
agacataaccatatcgaaaa

SEQ ID NO: 419475 - DNA, 20 bp, Artificial Sequence
  chemically synthesized
aaagcttgctgttttcgata

SEQ ID NO: 419476 - DNA, 20 bp, Artificial Sequence
  chemically synthesized
tttcgatatggttatgtctt

SEQ ID NO: 419477 - DNA, 20 bp, Artificial Sequence
  chemically synthesized
gcatgacaggatgtgggctg

SEQ ID NO: 419478 - DNA, 20 bp, Artificial Sequence
  chemically synthesized
gccctagcatgacaggatgt

SEQ ID NO: 419479 - DNA, 20 bp, Artificial Sequence
  chemically synthesized
tgccctagcatgacaggatg

SEQ ID NO: 419480 - DNA, 20 bp, Artificial Sequence
  chemically synthesized
cagcccacatcctgtcatgc

SEQ ID NO: 419481 - DNA, 20 bp, Artificial Sequence
  chemically synthesized
gaaaactgccctagcatgac

SEQ ID NO: 419482 - DNA, 20 bp, Artificial Sequence
  chemically synthesized
agcccacatcctgtcatgct

SEQ ID NO: 419483 - DNA, 20 bp, Artificial Sequence
  chemically synthesized
ggaaaactgccctagcatga

SEQ ID NO: 419484 - DNA, 20 bp, Artificial Sequence
  chemically synthesized
gcccacatcctgtcatgcta

SEQ ID NO: 419485 - DNA, 20 bp, Artificial Sequence
  chemically synthesized
cacatcctgtcatgctaggg

SEQ ID NO: 419486 - DNA, 20 bp, Artificial Sequence
  chemically synthesized
ctgtaaatggaaaactgccc

SEQ ID NO: 419487 - DNA, 20 bp, Artificial Sequence
  chemically synthesized
ctagggcagttttccattta

SEQ ID NO: 419488 - DNA, 20 bp, Artificial Sequence
  chemically synthesized
gggcagttttccatttacag

SEQ ID NO: 419489 - DNA, 20 bp, Artificial Sequence
  chemically synthesized
cagccacttgcttctgtaaa

SEQ ID NO: 419490 - DNA, 20 bp, Artificial Sequence
  chemically synthesized
agttttccatttacagaagc

SEQ ID NO: 419491 - DNA, 20 bp, Artificial Sequence
  chemically synthesized
tttccatttacagaagcaag

SEQ ID NO: 419492 - DNA, 20 bp, Artificial Sequence
  chemically synthesized
ttacagaagcaagtggctgt

SEQ ID NO: 419493 - DNA, 20 bp, Artificial Sequence
  chemically synthesized
tacagaagcaagtggctgta

SEQ ID NO: 419494 - DNA, 20 bp, Artificial Sequence
  chemically synthesized
ctgactaccacaaaacctta

SEQ ID NO: 419495 - DNA, 20 bp, Artificial Sequence
  chemically synthesized
caagtggctgtaaggttttg

SEQ ID NO: 419496 - DNA, 20 bp, Artificial Sequence
  chemically synthesized
gtggctgtaaggttttgtgg

SEQ ID NO: 419497 - DNA, 20 bp, Artificial Sequence
  chemically synthesized
ctgtaaggttttgtggtagt

SEQ ID NO: 419498 - DNA, 20 bp, Artificial Sequence
  chemically synthesized
tgtaaggttttgtggtagtc

SEQ ID NO: 419499 - DNA, 20 bp, Artificial Sequence
  chemically synthesized
aaggttttgtggtagtcagg

SEQ ID NO: 419500 - DNA, 20 bp, Artificial Sequence
  chemically synthesized
tggtagtcaggtagatgtca

SEQ ID NO: 419501 - DNA, 20 bp, Artificial Sequence
  chemically synthesized
ggtagatgtcacagcgcaaa

SEQ ID NO: 419502 - DNA, 20 bp, Artificial Sequence
  chemically synthesized
gtagatgtcacagcgcaaac

SEQ ID NO: 419503 - DNA, 20 bp, Artificial Sequence
  chemically synthesized
ctttctcttttatacgtatt

SEQ ID NO: 419504 - DNA, 20 bp, Artificial Sequence
  chemically synthesized
aattaactcaatacgtataa

SEQ ID NO: 419505 - DNA, 20 bp, Artificial Sequence
  chemically synthesized
ttaactcaatacgtataaaa

SEQ ID NO: 419506 - DNA, 20 bp, Artificial Sequence
  chemically synthesized
ctcaatacgtataaaagaga

SEQ ID NO: 419507 - DNA, 20 bp, Artificial Sequence
  chemically synthesized
taaaagagaaagctttcgaa

SEQ ID NO: 419508 - DNA, 20 bp, Artificial Sequence
  chemically synthesized
ggccttaaacttcttttcga

SEQ ID NO: 419509 - DNA, 20 bp, Artificial Sequence
  chemically synthesized
aagagaaagctttcgaaaag

SEQ ID NO: 419510 - DNA, 20 bp, Artificial Sequence
  chemically synthesized
aagctttcgaaaagaagttt

SEQ ID NO: 419511 - DNA, 20 bp, Artificial Sequence
  chemically synthesized
agctttcgaaaagaagttta

SEQ ID NO: 419512 - DNA, 20 bp, Artificial Sequence
  chemically synthesized
ttcgaaaagaagtttaaggc

SEQ ID NO: 419513 - DNA, 20 bp, Artificial Sequence
  chemically synthesized
tcgaaaagaagtttaaggcc

SEQ ID NO: 419514 - DNA, 20 bp, Artificial Sequence
  chemically synthesized
aagaagtttaaggccgggtg

SEQ ID NO: 419515 - DNA, 20 bp, Artificial Sequence
  chemically synthesized
aggcgttgagtcactgcacc

SEQ ID NO: 419516 - DNA, 20 bp, Artificial Sequence
  chemically synthesized
gtgctgggattacaggcgtt

SEQ ID NO: 419517 - DNA, 20 bp, Artificial Sequence
  chemically synthesized
tgactcaacgcctgtaatcc

SEQ ID NO: 419518 - DNA, 20 bp, Artificial Sequence
  chemically synthesized
tccgaaagtgctgggattac

SEQ ID NO: 419519 - DNA, 20 bp, Artificial Sequence
  chemically synthesized
ctccgaaagtgctgggatta

SEQ ID NO: 419520 - DNA, 20 bp, Artificial Sequence
  chemically synthesized
cctctgcctccgaaagtgct

SEQ ID NO: 419521 - DNA, 20 bp, Artificial Sequence
  chemically synthesized
gcctgtaatcccagcacttt

SEQ ID NO: 419522 - DNA, 20 bp, Artificial Sequence
  chemically synthesized
acctctgcctccgaaagtgc

SEQ ID NO: 419523 - DNA, 20 bp, Artificial Sequence
  chemically synthesized
ctgtaatcccagcactttcg

SEQ ID NO: 419524 - DNA, 20 bp, Artificial Sequence
  chemically synthesized
tgtaatcccagcactttcgg

SEQ ID NO: 419525 - DNA, 20 bp, Artificial Sequence
  chemically synthesized
aatcccagcactttcggagg

SEQ ID NO: 419526 - DNA, 20 bp, Artificial Sequence
  chemically synthesized
ccgcccacctctgcctccga

SEQ ID NO: 419527 - DNA, 20 bp, Artificial Sequence
  chemically synthesized
tcccagcactttcggaggca

SEQ ID NO: 419528 - DNA, 20 bp, Artificial Sequence
  chemically synthesized
cccagcactttcggaggcag

SEQ ID NO: 419529 - DNA, 20 bp, Artificial Sequence
  chemically synthesized
agcactttcggaggcagagg

SEQ ID NO: 419530 - DNA, 20 bp, Artificial Sequence
  chemically synthesized
gcactttcggaggcagaggt

SEQ ID NO: 419531 - DNA, 20 bp, Artificial Sequence
  chemically synthesized
ctttcggaggcagaggtggg

SEQ ID NO: 419532 - DNA, 20 bp, Artificial Sequence
  chemically synthesized
cagaggtgggcggatcacct

SEQ ID NO: 419533 - DNA, 20 bp, Artificial Sequence
  chemically synthesized
agaggtgggcggatcacctg

SEQ ID NO: 419534 - DNA, 20 bp, Artificial Sequence
  chemically synthesized
gtgggcggatcacctgaggt

SEQ ID NO: 419535 - DNA, 20 bp, Artificial Sequence
  chemically synthesized
tgggcggatcacctgaggtc

SEQ ID NO: 419536 - DNA, 20 bp, Artificial Sequence
  chemically synthesized
ggtcttgaactcctgacctc

SEQ ID NO: 419537 - DNA, 20 bp, Artificial Sequence
  chemically synthesized
ggcggatcacctgaggtcag

SEQ ID NO: 419538 - DNA, 20 bp, Artificial Sequence
  chemically synthesized
tggtcttgaactcctgacct

SEQ ID NO: 419539 - DNA, 20 bp, Artificial Sequence
  chemically synthesized
tcacctgaggtcaggagttc

SEQ ID NO: 419540 - DNA, 20 bp, Artificial Sequence
  chemically synthesized
tgaggtcaggagttcaagac

SEQ ID NO: 419541 - DNA, 20 bp, Artificial Sequence
  chemically synthesized
tcaggagttcaagaccagcc

SEQ ID NO: 419542 - DNA, 20 bp, Artificial Sequence
  chemically synthesized
tttcaccatgttggccaggc

SEQ ID NO: 419543 - DNA, 20 bp, Artificial Sequence
  chemically synthesized
ggggtttcaccatgttggcc

SEQ ID NO: 419544 - DNA, 20 bp, Artificial Sequence
  chemically synthesized
caagaccagcctggccaaca

SEQ ID NO: 419545 - DNA, 20 bp, Artificial Sequence
  chemically synthesized
cggggtttcaccatgttggc

SEQ ID NO: 419546 - DNA, 20 bp, Artificial Sequence
  chemically synthesized
gagacggggtttcaccatgt

SEQ ID NO: 419547 - DNA, 20 bp, Artificial Sequence
  chemically synthesized
ttgtatttttagtagagacg

SEQ ID NO: 419548 - DNA, 20 bp, Artificial Sequence
  chemically synthesized
tttgtatttttagtagagac

SEQ ID NO: 419549 - DNA, 20 bp, Artificial Sequence
  chemically synthesized
ttttgtatttttagtagaga

SEQ ID NO: 419550 - DNA, 20 bp, Artificial Sequence
  chemically synthesized
taatttttgtatttttagta

SEQ ID NO: 419551 - DNA, 20 bp, Artificial Sequence
  chemically synthesized
gctaatttttgtatttttag

SEQ ID NO: 419552 - DNA, 20 bp, Artificial Sequence
  chemically synthesized
ccagctaatttttgtatttt

SEQ ID NO: 419553 - DNA, 20 bp, Artificial Sequence
  chemically synthesized
tctactaaaaatacaaaaat

SEQ ID NO: 419554 - DNA, 20 bp, Artificial Sequence
  chemically synthesized
ctaaaaatacaaaaattagc

SEQ ID NO: 419555 - DNA, 20 bp, Artificial Sequence
  chemically synthesized
atacaaaaattagctggctg

SEQ ID NO: 419556 - DNA, 20 bp, Artificial Sequence
  chemically synthesized
caaaaattagctggctgtgg

SEQ ID NO: 419557 - DNA, 20 bp, Artificial Sequence
  chemically synthesized
caggcatccgccaccacagc

SEQ ID NO: 419558 - DNA, 20 bp, Artificial Sequence
  chemically synthesized
aaattagctggctgtggtgg

SEQ ID NO: 419559 - DNA, 20 bp, Artificial Sequence
  chemically synthesized
attacaggcatccgccacca

SEQ ID NO: 419560 - DNA, 20 bp, Artificial Sequence
  chemically synthesized
gtggcggatgcctgtaatcc

SEQ ID NO: 419561 - DNA, 20 bp, Artificial Sequence
  chemically synthesized
tcccgagtagctgggattac

SEQ ID NO: 419562 - DNA, 20 bp, Artificial Sequence
  chemically synthesized
ctcccgagtagctgggatta

SEQ ID NO: 419563 - DNA, 20 bp, Artificial Sequence
  chemically synthesized
tgcctgtaatcccagctact

SEQ ID NO: 419564 - DNA, 20 bp, Artificial Sequence
  chemically synthesized
cctcagcctcccgagtagct

SEQ ID NO: 419565 - DNA, 20 bp, Artificial Sequence
  chemically synthesized
gcctgtaatcccagctactc

SEQ ID NO: 419566 - DNA, 20 bp, Artificial Sequence
  chemically synthesized
gcctcagcctcccgagtagc

SEQ ID NO: 419567 - DNA, 20 bp, Artificial Sequence
  chemically synthesized
ctgtaatcccagctactcgg

SEQ ID NO: 419568 - DNA, 20 bp, Artificial Sequence
  chemically synthesized
tgtaatcccagctactcggg

SEQ ID NO: 419569 - DNA, 20 bp, Artificial Sequence
  chemically synthesized
ttctgcctcagcctcccgag

SEQ ID NO: 419570 - DNA, 20 bp, Artificial Sequence
  chemically synthesized
ttcttctgcctcagcctccc

SEQ ID NO: 419571 - DNA, 20 bp, Artificial Sequence
  chemically synthesized
tcccagctactcgggaggct

SEQ ID NO: 419572 - DNA, 20 bp, Artificial Sequence
  chemically synthesized
cccagctactcgggaggctg

SEQ ID NO: 419573 - DNA, 20 bp, Artificial Sequence
  chemically synthesized
agctactcgggaggctgagg

SEQ ID NO: 419574 - DNA, 20 bp, Artificial Sequence
  chemically synthesized
tactcgggaggctgaggcag

SEQ ID NO: 419575 - DNA, 20 bp, Artificial Sequence
  chemically synthesized
ttaaagagattcttctgcct

SEQ ID NO: 419576 - DNA, 20 bp, Artificial Sequence
  chemically synthesized
gcagaagaatctctttaact

SEQ ID NO: 419577 - DNA, 20 bp, Artificial Sequence
  chemically synthesized
cctccgcctcctgagttaaa

SEQ ID NO: 419578 - DNA, 20 bp, Artificial Sequence
  chemically synthesized
cagaagaatctctttaactc

SEQ ID NO: 419579 - DNA, 20 bp, Artificial Sequence
  chemically synthesized
aacctccgcctcctgagtta

SEQ ID NO: 419580 - DNA, 20 bp, Artificial Sequence
  chemically synthesized
gaagaatctctttaactcag

SEQ ID NO: 419581 - DNA, 20 bp, Artificial Sequence
  chemically synthesized
aagaatctctttaactcagg

SEQ ID NO: 419582 - DNA, 20 bp, Artificial Sequence
  chemically synthesized
aatctctttaactcaggagg

SEQ ID NO: 419583 - DNA, 20 bp, Artificial Sequence
  chemically synthesized
cactgcaacctccgcctcct

SEQ ID NO: 419584 - DNA, 20 bp, Artificial Sequence
  chemically synthesized
tctctttaactcaggaggcg

SEQ ID NO: 419585 - DNA, 20 bp, Artificial Sequence
  chemically synthesized
ctctttaactcaggaggcgg

SEQ ID NO: 419586 - DNA, 20 bp, Artificial Sequence
  chemically synthesized
aactcaggaggcggaggttg

SEQ ID NO: 419587 - DNA, 20 bp, Artificial Sequence
  chemically synthesized
caggaggcggaggttgcagt

SEQ ID NO: 419588 - DNA, 20 bp, Artificial Sequence
  chemically synthesized
ggcggaggttgcagtgagcc

SEQ ID NO: 419589 - DNA, 20 bp, Artificial Sequence
  chemically synthesized
gaggttgcagtgagccgaga

SEQ ID NO: 419590 - DNA, 20 bp, Artificial Sequence
  chemically synthesized
ggagtgcaatgatgccatct

SEQ ID NO: 419591 - DNA, 20 bp, Artificial Sequence
  chemically synthesized
gagatggcatcattgcactc

SEQ ID NO: 419592 - DNA, 20 bp, Artificial Sequence
  chemically synthesized
gcatcattgcactccagcct

SEQ ID NO: 419593 - DNA, 20 bp, Artificial Sequence
  chemically synthesized
cgctcttgttgccgaggctg

SEQ ID NO: 419594 - DNA, 20 bp, Artificial Sequence
  chemically synthesized
ttcgctcttgttgccgaggc

SEQ ID NO: 419595 - DNA, 20 bp, Artificial Sequence
  chemically synthesized
tgcactccagcctcggcaac

SEQ ID NO: 419596 - DNA, 20 bp, Artificial Sequence
  chemically synthesized
gagcttcgctcttgttgccg

SEQ ID NO: 419597 - DNA, 20 bp, Artificial Sequence
  chemically synthesized
agagcttcgctcttgttgcc

SEQ ID NO: 419598 - DNA, 20 bp, Artificial Sequence
  chemically synthesized
cactccagcctcggcaacaa

SEQ ID NO: 419599 - DNA, 20 bp, Artificial Sequence
  chemically synthesized
cagcctcggcaacaagagcg

SEQ ID NO: 419600 - DNA, 20 bp, Artificial Sequence
  chemically synthesized
ttgggggggggggggggaca

SEQ ID NO: 419601 - DNA, 20 bp, Artificial Sequence
  chemically synthesized
tgttggggggggggggggga

SEQ ID NO: 419602 - DNA, 20 bp, Artificial Sequence
  chemically synthesized
tgtgtgttgggggggggggg

SEQ ID NO: 419603 - DNA, 20 bp, Artificial Sequence
  chemically synthesized
gtgtgtgttggggggggggg

SEQ ID NO: 419604 - DNA, 20 bp, Artificial Sequence
  chemically synthesized
tgtgtgtgttgggggggggg

SEQ ID NO: 419605 - DNA, 20 bp, Artificial Sequence
  chemically synthesized
ttgtgtgtgttggggggggg

SEQ ID NO: 419606 - DNA, 20 bp, Artificial Sequence
  chemically synthesized
tttgtgtgtgttgggggggg

SEQ ID NO: 419607 - DNA, 20 bp, Artificial Sequence
  chemically synthesized
ttttgtgtgtgttggggggg

SEQ ID NO: 419608 - DNA, 20 bp, Artificial Sequence
  chemically synthesized
tttttgtgtgtgttgggggg

SEQ ID NO: 419609 - DNA, 20 bp, Artificial Sequence
  chemically synthesized
ttttttgtgtgtgttggggg

SEQ ID NO: 419610 - DNA, 20 bp, Artificial Sequence
  chemically synthesized
tttttttgtgtgtgttgggg

SEQ ID NO: 419611 - DNA, 20 bp, Artificial Sequence
  chemically synthesized
ttttttttgtgtgtgttggg

SEQ ID NO: 419612 - DNA, 20 bp, Artificial Sequence
  chemically synthesized
gttttttttgtgtgtgttgg

SEQ ID NO: 419613 - DNA, 20 bp, Artificial Sequence
  chemically synthesized
tgttttttttgtgtgtgttg

SEQ ID NO: 419614 - DNA, 20 bp, Artificial Sequence
  chemically synthesized
ctgttttttttgtgtgtgtt

SEQ ID NO: 419615 - DNA, 20 bp, Artificial Sequence
  chemically synthesized
gctgttttttttgtgtgtgt

SEQ ID NO: 419616 - DNA, 20 bp, Artificial Sequence
  chemically synthesized
cccaacacacacaaaaaaaa

SEQ ID NO: 419617 - DNA, 20 bp, Artificial Sequence
  chemically synthesized
agcaacaacaacaaaaaaca

SEQ ID NO: 419618 - DNA, 20 bp, Artificial Sequence
  chemically synthesized
gtttgtgtataatacatgcc

SEQ ID NO: 419619 - DNA, 20 bp, Artificial Sequence
  chemically synthesized
ttgtgtataatacatgccaa

SEQ ID NO: 419620 - DNA, 20 bp, Artificial Sequence
  chemically synthesized
tgtgtataatacatgccaag

SEQ ID NO: 419621 - DNA, 20 bp, Artificial Sequence
  chemically synthesized
gtgtataatacatgccaaga

SEQ ID NO: 419622 - DNA, 20 bp, Artificial Sequence
  chemically synthesized
tataatacatgccaagaggg

SEQ ID NO: 419623 - DNA, 20 bp, Artificial Sequence
  chemically synthesized
ataatacatgccaagagggt

SEQ ID NO: 419624 - DNA, 20 bp, Artificial Sequence
  chemically synthesized
gtattttattcctaccctct

SEQ ID NO: 419625 - DNA, 20 bp, Artificial Sequence
  chemically synthesized
aaatatatcttgacagcaaa

SEQ ID NO: 419626 - DNA, 20 bp, Artificial Sequence
  chemically synthesized
ataaaataccatttgctgtc

SEQ ID NO: 419627 - DNA, 20 bp, Artificial Sequence
  chemically synthesized
tgtttagaaatatatcttga

SEQ ID NO: 419628 - DNA, 20 bp, Artificial Sequence
  chemically synthesized
gtcaagatatatttctaaac

SEQ ID NO: 419629 - DNA, 20 bp, Artificial Sequence
  chemically synthesized
gccttcctaataaacttgtt

SEQ ID NO: 419630 - DNA, 20 bp, Artificial Sequence
  chemically synthesized
atatttctaaacaagtttat

SEQ ID NO: 419631 - DNA, 20 bp, Artificial Sequence
  chemically synthesized
tatttctaaacaagtttatt

SEQ ID NO: 419632 - DNA, 20 bp, Artificial Sequence
  chemically synthesized
ttctaaacaagtttattagg

SEQ ID NO: 419633 - DNA, 20 bp, Artificial Sequence
  chemically synthesized
tctaaacaagtttattagga

SEQ ID NO: 419634 - DNA, 20 bp, Artificial Sequence
  chemically synthesized
aaacaagtttattaggaagg

SEQ ID NO: 419635 - DNA, 20 bp, Artificial Sequence
  chemically synthesized
caagtttattaggaaggcag

SEQ ID NO: 419636 - DNA, 20 bp, Artificial Sequence
  chemically synthesized
gtttattaggaaggcagtag

SEQ ID NO: 419637 - DNA, 20 bp, Artificial Sequence
  chemically synthesized
tagcagatatgaaaaaaaaa

SEQ ID NO: 419638 - DNA, 20 bp, Artificial Sequence
  chemically synthesized
agcagatatgaaaaaaaaat

SEQ ID NO: 419639 - DNA, 20 bp, Artificial Sequence
  chemically synthesized
gatatgaaaaaaaaatagga

SEQ ID NO: 419640 - DNA, 20 bp, Artificial Sequence
  chemically synthesized
atatgaaaaaaaaataggat

SEQ ID NO: 419641 - DNA, 20 bp, Artificial Sequence
  chemically synthesized
tatgaaaaaaaaataggata

SEQ ID NO: 419642 - DNA, 20 bp, Artificial Sequence
  chemically synthesized
aaaaaaataggatagggcac

SEQ ID NO: 419643 - DNA, 20 bp, Artificial Sequence
  chemically synthesized
tgatttaaatttattatttc

SEQ ID NO: 419644 - DNA, 20 bp, Artificial Sequence
  chemically synthesized
tggaaataataaatttaaat

SEQ ID NO: 419645 - DNA, 20 bp, Artificial Sequence
  chemically synthesized
aatcagcatttttttaaatt

SEQ ID NO: 419646 - DNA, 20 bp, Artificial Sequence
  chemically synthesized
aattcataatctccaaccaa

SEQ ID NO: 419647 - DNA, 20 bp, Artificial Sequence
  chemically synthesized
agtattagttctgttggttg

SEQ ID NO: 419648 - DNA, 20 bp, Artificial Sequence
  chemically synthesized
taagtattagttctgttggt

SEQ ID NO: 419649 - DNA, 20 bp, Artificial Sequence
  chemically synthesized
tacttaagtattagttctgt

SEQ ID NO: 419650 - DNA, 20 bp, Artificial Sequence
  chemically synthesized
aaccaacagaactaatactt

SEQ ID NO: 419651 - DNA, 20 bp, Artificial Sequence
  chemically synthesized
tggaaattatacttaagtat

SEQ ID NO: 419652 - DNA, 20 bp, Artificial Sequence
  chemically synthesized
ttaccatggaaattatactt

SEQ ID NO: 419653 - DNA, 20 bp, Artificial Sequence
  chemically synthesized
atacttaagtataatttcca

SEQ ID NO: 419654 - DNA, 20 bp, Artificial Sequence
  chemically synthesized
gttttaaataatcattacca

SEQ ID NO: 419655 - DNA, 20 bp, Artificial Sequence
  chemically synthesized
ataaattcatagtcaatatg

SEQ ID NO: 419656 - DNA, 20 bp, Artificial Sequence
  chemically synthesized
tataaattcatagtcaatat

SEQ ID NO: 419657 - DNA, 20 bp, Artificial Sequence
  chemically synthesized
ctataaattcatagtcaata

SEQ ID NO: 419658 - DNA, 20 bp, Artificial Sequence
  chemically synthesized
aatcaccatctataaattca

SEQ ID NO: 419659 - DNA, 20 bp, Artificial Sequence
  chemically synthesized
ccatattgactatgaattta

SEQ ID NO: 419660 - DNA, 20 bp, Artificial Sequence
  chemically synthesized
attgactatgaatttataga

SEQ ID NO: 419661 - DNA, 20 bp, Artificial Sequence
  chemically synthesized
caagtttgcttttttgcata

SEQ ID NO: 419662 - DNA, 20 bp, Artificial Sequence
  chemically synthesized
tggtgattccatatgcaaaa

SEQ ID NO: 419663 - DNA, 20 bp, Artificial Sequence
  chemically synthesized
ctcatttctattataaatgc

SEQ ID NO: 419664 - DNA, 20 bp, Artificial Sequence
  chemically synthesized
aagcaaacttgcatttataa

SEQ ID NO: 419665 - DNA, 20 bp, Artificial Sequence
  chemically synthesized
cttgcatttataatagaaat

SEQ ID NO: 419666 - DNA, 20 bp, Artificial Sequence
  chemically synthesized
ttataatagaaatgagaaca

SEQ ID NO: 419667 - DNA, 20 bp, Artificial Sequence
  chemically synthesized
tagaaatgagaacaaagcaa

SEQ ID NO: 419668 - DNA, 20 bp, Artificial Sequence
  chemically synthesized
acagaatgtgtaatatgttg

SEQ ID NO: 419669 - DNA, 20 bp, Artificial Sequence
  chemically synthesized
cagaatgtgtaatatgttga

SEQ ID NO: 419670 - DNA, 20 bp, Artificial Sequence
  chemically synthesized
gaatgtgtaatatgttgaag

SEQ ID NO: 419671 - DNA, 20 bp, Artificial Sequence
  chemically synthesized
gttgaaggagtcattaactt

SEQ ID NO: 419672 - DNA, 20 bp, Artificial Sequence
  chemically synthesized
gaaggagtcattaactttag

SEQ ID NO: 419673 - DNA, 20 bp, Artificial Sequence
  chemically synthesized
aggagtcattaactttagtg

SEQ ID NO: 419674 - DNA, 20 bp, Artificial Sequence
  chemically synthesized
ggagtcattaactttagtgg

SEQ ID NO: 419675 - DNA, 20 bp, Artificial Sequence
  chemically synthesized
aacttgactgtcctccacta

SEQ ID NO: 419676 - DNA, 20 bp, Artificial Sequence
  chemically synthesized
tcattaactttagtggagga

SEQ ID NO: 419677 - DNA, 20 bp, Artificial Sequence
  chemically synthesized
aactttagtggaggacagtc

SEQ ID NO: 419678 - DNA, 20 bp, Artificial Sequence
  chemically synthesized
ggaggacagtcaagttccta

SEQ ID NO: 419679 - DNA, 20 bp, Artificial Sequence
  chemically synthesized
gaataaataaatgaatcttt

SEQ ID NO: 419680 - DNA, 20 bp, Artificial Sequence
  chemically synthesized
tgaataaataaatgaatctt

SEQ ID NO: 419681 - DNA, 20 bp, Artificial Sequence
  chemically synthesized
catttatttattcattcatt

SEQ ID NO: 419682 - DNA, 20 bp, Artificial Sequence
  chemically synthesized
tcattcattcagcaaaaaaa

SEQ ID NO: 419683 - DNA, 20 bp, Artificial Sequence
  chemically synthesized
agcaaaaaaatagaattatt

SEQ ID NO: 419684 - DNA, 20 bp, Artificial Sequence
  chemically synthesized
aaaaatagaattatttagtt

SEQ ID NO: 419685 - DNA, 20 bp, Artificial Sequence
  chemically synthesized
aaaatagaattatttagttc

SEQ ID NO: 419686 - DNA, 20 bp, Artificial Sequence
  chemically synthesized
tttagttcaggttataattc

SEQ ID NO: 419687 - DNA, 20 bp, Artificial Sequence
  chemically synthesized
ttattaatttataaagaatc

SEQ ID NO: 419688 - DNA, 20 bp, Artificial Sequence
  chemically synthesized
aaagtcattattaatttata

SEQ ID NO: 419689 - DNA, 20 bp, Artificial Sequence
  chemically synthesized
atgaaattcacatgcattta

SEQ ID NO: 419690 - DNA, 20 bp, Artificial Sequence
  chemically synthesized
ttaaatgcatgtgaatttca

SEQ ID NO: 419691 - DNA, 20 bp, Artificial Sequence
  chemically synthesized
ttcctagataaaaaaatata

SEQ ID NO: 419692 - DNA, 20 bp, Artificial Sequence
  chemically synthesized
gtactgtatatttttttatc

SEQ ID NO: 419693 - DNA, 20 bp, Artificial Sequence
  chemically synthesized
tactgtatatttttttatct

SEQ ID NO: 419694 - DNA, 20 bp, Artificial Sequence
  chemically synthesized
catttaaggaaaaatattcc

SEQ ID NO: 419695 - DNA, 20 bp, Artificial Sequence
  chemically synthesized
tcggagaatagtatcattta

SEQ ID NO: 419696 - DNA, 20 bp, Artificial Sequence
  chemically synthesized
ttcggagaatagtatcattt

SEQ ID NO: 419697 - DNA, 20 bp, Artificial Sequence
  chemically synthesized
actttattaaattcggagaa

SEQ ID NO: 419698 - DNA, 20 bp, Artificial Sequence
  chemically synthesized
atggtactttattaaattcg

SEQ ID NO: 419699 - DNA, 20 bp, Artificial Sequence
  chemically synthesized
aaatggtactttattaaatt

SEQ ID NO: 419700 - DNA, 20 bp, Artificial Sequence
  chemically synthesized
actattctccgaatttaata

SEQ ID NO: 419701 - DNA, 20 bp, Artificial Sequence
  chemically synthesized
tcataatctatcagtagaaa

SEQ ID NO: 419702 - DNA, 20 bp, Artificial Sequence
  chemically synthesized
taaagtaccatttctactga

SEQ ID NO: 419703 - DNA, 20 bp, Artificial Sequence
  chemically synthesized
taaaagtcataatctatcag

SEQ ID NO: 419704 - DNA, 20 bp, Artificial Sequence
  chemically synthesized
ttttaaaagtcataatctat

SEQ ID NO: 419705 - DNA, 20 bp, Artificial Sequence
  chemically synthesized
attataaaccaattttttaa

SEQ ID NO: 419706 - DNA, 20 bp, Artificial Sequence
  chemically synthesized
gattatgacttttaaaaaat

SEQ ID NO: 419707 - DNA, 20 bp, Artificial Sequence
  chemically synthesized
taaaaaattggtttataatt

SEQ ID NO: 419708 - DNA, 20 bp, Artificial Sequence
  chemically synthesized
aaaaaattggtttataatta

SEQ ID NO: 419709 - DNA, 20 bp, Artificial Sequence
  chemically synthesized
ttaaggaaaatatgaataaa

SEQ ID NO: 419710 - DNA, 20 bp, Artificial Sequence
  chemically synthesized
taaggaaaatatgaataaaa

SEQ ID NO: 419711 - DNA, 20 bp, Artificial Sequence
  chemically synthesized
aaaatatgaataaaaaggac

SEQ ID NO: 419712 - DNA, 20 bp, Artificial Sequence
  chemically synthesized
ttgcctcttaatgaatcaat

SEQ ID NO: 419713 - DNA, 20 bp, Artificial Sequence
  chemically synthesized
gacaagctgattgattcatt

SEQ ID NO: 419714 - DNA, 20 bp, Artificial Sequence
  chemically synthesized
caagctgattgattcattaa

SEQ ID NO: 419715 - DNA, 20 bp, Artificial Sequence
  chemically synthesized
aagctgattgattcattaag

SEQ ID NO: 419716 - DNA, 20 bp, Artificial Sequence
  chemically synthesized
attaagaggcaaaattatgc

SEQ ID NO: 419717 - DNA, 20 bp, Artificial Sequence
  chemically synthesized
tatattgttgatacaatatc

SEQ ID NO: 419718 - DNA, 20 bp, Artificial Sequence
  chemically synthesized
ggaaacattagttttattgt

SEQ ID NO: 419719 - DNA, 20 bp, Artificial Sequence
  chemically synthesized
attttagttaatggaaacat

SEQ ID NO: 419720 - DNA, 20 bp, Artificial Sequence
  chemically synthesized
taattatttattttagttaa

SEQ ID NO: 419721 - DNA, 20 bp, Artificial Sequence
  chemically synthesized
gtcattctaattatttattt

SEQ ID NO: 419722 - DNA, 20 bp, Artificial Sequence
  chemically synthesized
cattaactaaaataaataat

SEQ ID NO: 419723 - DNA, 20 bp, Artificial Sequence
  chemically synthesized
tctacgtatttcaaaaatgg

SEQ ID NO: 419724 - DNA, 20 bp, Artificial Sequence
  chemically synthesized
tgttctacgtatttcaaaaa

SEQ ID NO: 419725 - DNA, 20 bp, Artificial Sequence
  chemically synthesized
actaccatttttgaaatacg

SEQ ID NO: 419726 - DNA, 20 bp, Artificial Sequence
  chemically synthesized
gtagaacaaataacaaattt

SEQ ID NO: 419727 - DNA, 20 bp, Artificial Sequence
  chemically synthesized
aacctaataaaattaaaata

SEQ ID NO: 419728 - DNA, 20 bp, Artificial Sequence
  chemically synthesized
aaacctaataaaattaaaat

SEQ ID NO: 419729 - DNA, 20 bp, Artificial Sequence
  chemically synthesized
aaaacctaataaaattaaaa

SEQ ID NO: 419730 - DNA, 20 bp, Artificial Sequence
  chemically synthesized
aatccctattttaattttat

SEQ ID NO: 419731 - DNA, 20 bp, Artificial Sequence
  chemically synthesized
atccctattttaattttatt

SEQ ID NO: 419732 - DNA, 20 bp, Artificial Sequence
  chemically synthesized
attttattaggttttttttt

SEQ ID NO: 419733 - DNA, 20 bp, Artificial Sequence
  chemically synthesized
atgtttgcttgtatgtaaag

SEQ ID NO: 419734 - DNA, 20 bp, Artificial Sequence
  chemically synthesized
ttcagttctactttacatac

SEQ ID NO: 419735 - DNA, 20 bp, Artificial Sequence
  chemically synthesized
agcatgtttgcttgtatgta

SEQ ID NO: 419736 - DNA, 20 bp, Artificial Sequence
  chemically synthesized
tacatacaagcaaacatgct

SEQ ID NO: 419737 - DNA, 20 bp, Artificial Sequence
  chemically synthesized
acaagcaaacatgctgagct

SEQ ID NO: 419738 - DNA, 20 bp, Artificial Sequence
  chemically synthesized
tattttgtattagcttagct

SEQ ID NO: 419739 - DNA, 20 bp, Artificial Sequence
  chemically synthesized
tgtattattttgtattagct

SEQ ID NO: 419740 - DNA, 20 bp, Artificial Sequence
  chemically synthesized
gaaaatgtattattttgtat

SEQ ID NO: 419741 - DNA, 20 bp, Artificial Sequence
  chemically synthesized
cagaagacaaacaacagcaa

SEQ ID NO: 419742 - DNA, 20 bp, Artificial Sequence
  chemically synthesized
aaaaaacagaagacaaacaa

SEQ ID NO: 419743 - DNA, 20 bp, Artificial Sequence
  chemically synthesized
tacttcgtctcaaaaaacag

SEQ ID NO: 419744 - DNA, 20 bp, Artificial Sequence
  chemically synthesized
ttgtttgtcttctgtttttt

SEQ ID NO: 419745 - DNA, 20 bp, Artificial Sequence
  chemically synthesized
ggatacttcgtctcaaaaaa

SEQ ID NO: 419746 - DNA, 20 bp, Artificial Sequence
  chemically synthesized
gtcttctgttttttgagacg

SEQ ID NO: 419747 - DNA, 20 bp, Artificial Sequence
  chemically synthesized
cctaggtgacaggtgacaga

SEQ ID NO: 419748 - DNA, 20 bp, Artificial Sequence
  chemically synthesized
gcctaggtgacaggtgacag

SEQ ID NO: 419749 - DNA, 20 bp, Artificial Sequence
  chemically synthesized
agcctaggtgacaggtgaca

SEQ ID NO: 419750 - DNA, 20 bp, Artificial Sequence
  chemically synthesized
acagcctaggtgacaggtga

SEQ ID NO: 419751 - DNA, 20 bp, Artificial Sequence
  chemically synthesized
tccctctgtcacctgtcacc

SEQ ID NO: 419752 - DNA, 20 bp, Artificial Sequence
  chemically synthesized
ccctctgtcacctgtcacct

SEQ ID NO: 419753 - DNA, 20 bp, Artificial Sequence
  chemically synthesized
tgcactacagcctaggtgac

SEQ ID NO: 419754 - DNA, 20 bp, Artificial Sequence
  chemically synthesized
ctgcactacagcctaggtga

SEQ ID NO: 419755 - DNA, 20 bp, Artificial Sequence
  chemically synthesized
gtcacctgtcacctaggctg

SEQ ID NO: 419756 - DNA, 20 bp, Artificial Sequence
  chemically synthesized
atgccactgcactacagcct

SEQ ID NO: 419757 - DNA, 20 bp, Artificial Sequence
  chemically synthesized
catgccactgcactacagcc

SEQ ID NO: 419758 - DNA, 20 bp, Artificial Sequence
  chemically synthesized
ctgtcacctaggctgtagtg

SEQ ID NO: 419759 - DNA, 20 bp, Artificial Sequence
  chemically synthesized
aagatcatgccactgcacta

SEQ ID NO: 419760 - DNA, 20 bp, Artificial Sequence
  chemically synthesized
tcacctaggctgtagtgcag

SEQ ID NO: 419761 - DNA, 20 bp, Artificial Sequence
  chemically synthesized
gtagtgcagtggcatgatct

SEQ ID NO: 419762 - DNA, 20 bp, Artificial Sequence
  chemically synthesized
ggcagaggttacagtgagcc

SEQ ID NO: 419763 - DNA, 20 bp, Artificial Sequence
  chemically synthesized
cgagaggcagaggttacagt

SEQ ID NO: 419764 - DNA, 20 bp, Artificial Sequence
  chemically synthesized
aaaccgagaggcagaggtta

SEQ ID NO: 419765 - DNA, 20 bp, Artificial Sequence
  chemically synthesized
cccttgaaaccgagaggcag

SEQ ID NO: 419766 - DNA, 20 bp, Artificial Sequence
  chemically synthesized
tcactgtaacctctgcctct

SEQ ID NO: 419767 - DNA, 20 bp, Artificial Sequence
  chemically synthesized
tcccttgaaaccgagaggca

SEQ ID NO: 419768 - DNA, 20 bp, Artificial Sequence
  chemically synthesized
aatcccttgaaaccgagagg

SEQ ID NO: 419769 - DNA, 20 bp, Artificial Sequence
  chemically synthesized
aagaatcccttgaaaccgag

SEQ ID NO: 419770 - DNA, 20 bp, Artificial Sequence
  chemically synthesized
aaagaatcccttgaaaccga

SEQ ID NO: 419771 - DNA, 20 bp, Artificial Sequence
  chemically synthesized
aacctctgcctctcggtttc

SEQ ID NO: 419772 - DNA, 20 bp, Artificial Sequence
  chemically synthesized
acctctgcctctcggtttca

SEQ ID NO: 419773 - DNA, 20 bp, Artificial Sequence
  chemically synthesized
caaaagaatcccttgaaacc

SEQ ID NO: 419774 - DNA, 20 bp, Artificial Sequence
  chemically synthesized
cctctgcctctcggtttcaa

SEQ ID NO: 419775 - DNA, 20 bp, Artificial Sequence
  chemically synthesized
ttcaagggattcttttgcct

SEQ ID NO: 419776 - DNA, 20 bp, Artificial Sequence
  chemically synthesized
actcgggggtgctgaggcaa

SEQ ID NO: 419777 - DNA, 20 bp, Artificial Sequence
  chemically synthesized
ccagctactcgggggtgctg

SEQ ID NO: 419778 - DNA, 20 bp, Artificial Sequence
  chemically synthesized
cccagctactcgggggtgct

SEQ ID NO: 419779 - DNA, 20 bp, Artificial Sequence
  chemically synthesized
tcttttgcctcagcaccccc

SEQ ID NO: 419780 - DNA, 20 bp, Artificial Sequence
  chemically synthesized
tttgcctcagcacccccgag

SEQ ID NO: 419781 - DNA, 20 bp, Artificial Sequence
  chemically synthesized
ctttaatcccagctactcgg

SEQ ID NO: 419782 - DNA, 20 bp, Artificial Sequence
  chemically synthesized
cctttaatcccagctactcg

SEQ ID NO: 419783 - DNA, 20 bp, Artificial Sequence
  chemically synthesized
cctcagcacccccgagtagc

SEQ ID NO: 419784 - DNA, 20 bp, Artificial Sequence
  chemically synthesized
gcctttaatcccagctactc

SEQ ID NO: 419785 - DNA, 20 bp, Artificial Sequence
  chemically synthesized
ctcagcacccccgagtagct

SEQ ID NO: 419786 - DNA, 20 bp, Artificial Sequence
  chemically synthesized
tgcctttaatcccagctact

SEQ ID NO: 419787 - DNA, 20 bp, Artificial Sequence
  chemically synthesized
cccccgagtagctgggatta

SEQ ID NO: 419788 - DNA, 20 bp, Artificial Sequence
  chemically synthesized
ccccgagtagctgggattaa

SEQ ID NO: 419789 - DNA, 20 bp, Artificial Sequence
  chemically synthesized
gtggcacatgcctttaatcc

SEQ ID NO: 419790 - DNA, 20 bp, Artificial Sequence
  chemically synthesized
ggattaaaggcatgtgccac

SEQ ID NO: 419791 - DNA, 20 bp, Artificial Sequence
  chemically synthesized
gattaaaggcatgtgccacc

SEQ ID NO: 419792 - DNA, 20 bp, Artificial Sequence
  chemically synthesized
aaaggcatgtgccaccaggc

SEQ ID NO: 419793 - DNA, 20 bp, Artificial Sequence
  chemically synthesized
acaaaaattagccggcctgg

SEQ ID NO: 419794 - DNA, 20 bp, Artificial Sequence
  chemically synthesized
aatacaaaaattagccggcc

SEQ ID NO: 419795 - DNA, 20 bp, Artificial Sequence
  chemically synthesized
ctaaaaatacaaaaattagc

SEQ ID NO: 419796 - DNA, 20 bp, Artificial Sequence
  chemically synthesized
tgtactaaaaatacaaaaat

SEQ ID NO: 419797 - DNA, 20 bp, Artificial Sequence
  chemically synthesized
ccggctaatttttgtatttt

SEQ ID NO: 419798 - DNA, 20 bp, Artificial Sequence
  chemically synthesized
taatttttgtatttttagta

SEQ ID NO: 419799 - DNA, 20 bp, Artificial Sequence
  chemically synthesized
ttttgtatttttagtacaga

SEQ ID NO: 419800 - DNA, 20 bp, Artificial Sequence
  chemically synthesized
tttgtatttttagtacagac

SEQ ID NO: 419801 - DNA, 20 bp, Artificial Sequence
  chemically synthesized
ttgtatttttagtacagacg

SEQ ID NO: 419802 - DNA, 20 bp, Artificial Sequence
  chemically synthesized
cagacggggtttcactatgt

SEQ ID NO: 419803 - DNA, 20 bp, Artificial Sequence
  chemically synthesized
cggggtttcactatgttggc

SEQ ID NO: 419804 - DNA, 20 bp, Artificial Sequence
  chemically synthesized
ttgagccagcctggccaaca

SEQ ID NO: 419805 - DNA, 20 bp, Artificial Sequence
  chemically synthesized
ggggtttcactatgttggcc

SEQ ID NO: 419806 - DNA, 20 bp, Artificial Sequence
  chemically synthesized
tttcactatgttggccaggc

SEQ ID NO: 419807 - DNA, 20 bp, Artificial Sequence
  chemically synthesized
atcaggagtttgagccagcc

SEQ ID NO: 419808 - DNA, 20 bp, Artificial Sequence
  chemically synthesized
ctgagatcaggagtttgagc

SEQ ID NO: 419809 - DNA, 20 bp, Artificial Sequence
  chemically synthesized
tcacctgagatcaggagttt

SEQ ID NO: 419810 - DNA, 20 bp, Artificial Sequence
  chemically synthesized
ctggctcaaactcctgatct

SEQ ID NO: 419811 - DNA, 20 bp, Artificial Sequence
  chemically synthesized
gtccgatcacctgagatcag

SEQ ID NO: 419812 - DNA, 20 bp, Artificial Sequence
  chemically synthesized
tggctcaaactcctgatctc

SEQ ID NO: 419813 - DNA, 20 bp, Artificial Sequence
  chemically synthesized
cggtccgatcacctgagatc

SEQ ID NO: 419814 - DNA, 20 bp, Artificial Sequence
  chemically synthesized
gcggtccgatcacctgagat

SEQ ID NO: 419815 - DNA, 20 bp, Artificial Sequence
  chemically synthesized
aactcctgatctcaggtgat

SEQ ID NO: 419816 - DNA, 20 bp, Artificial Sequence
  chemically synthesized
ctgaggcggtccgatcacct

SEQ ID NO: 419817 - DNA, 20 bp, Artificial Sequence
  chemically synthesized
ctcaggtgatcggaccgcct

SEQ ID NO: 419818 - DNA, 20 bp, Artificial Sequence
  chemically synthesized
agcactttggcaggctgagg

SEQ ID NO: 419819 - DNA, 20 bp, Artificial Sequence
  chemically synthesized
cccagcactttggcaggctg

SEQ ID NO: 419820 - DNA, 20 bp, Artificial Sequence
  chemically synthesized
tcccagcactttggcaggct

SEQ ID NO: 419821 - DNA, 20 bp, Artificial Sequence
  chemically synthesized
cggaccgcctcagcctgcca

SEQ ID NO: 419822 - DNA, 20 bp, Artificial Sequence
  chemically synthesized
tgtaatcccagcactttggc

SEQ ID NO: 419823 - DNA, 20 bp, Artificial Sequence
  chemically synthesized
ctgtaatcccagcactttgg

SEQ ID NO: 419824 - DNA, 20 bp, Artificial Sequence
  chemically synthesized
gcctcagcctgccaaagtgc

SEQ ID NO: 419825 - DNA, 20 bp, Artificial Sequence
  chemically synthesized
cctcagcctgccaaagtgct

SEQ ID NO: 419826 - DNA, 20 bp, Artificial Sequence
  chemically synthesized
tgcctgtaatcccagcactt

SEQ ID NO: 419827 - DNA, 20 bp, Artificial Sequence
  chemically synthesized
ctgccaaagtgctgggatta

SEQ ID NO: 419828 - DNA, 20 bp, Artificial Sequence
  chemically synthesized
tgccaaagtgctgggattac

SEQ ID NO: 419829 - DNA, 20 bp, Artificial Sequence
  chemically synthesized
gtggatcatgcctgtaatcc

SEQ ID NO: 419830 - DNA, 20 bp, Artificial Sequence
  chemically synthesized
acaggcatgatccaccgtgc

SEQ ID NO: 419831 - DNA, 20 bp, Artificial Sequence
  chemically synthesized
caggcatgatccaccgtgct

SEQ ID NO: 419832 - DNA, 20 bp, Artificial Sequence
  chemically synthesized
ttattctgggcccagcacgg

SEQ ID NO: 419833 - DNA, 20 bp, Artificial Sequence
  chemically synthesized
gtgttattctgggcccagca

SEQ ID NO: 419834 - DNA, 20 bp, Artificial Sequence
  chemically synthesized
atgatccaccgtgctgggcc

SEQ ID NO: 419835 - DNA, 20 bp, Artificial Sequence
  chemically synthesized
taaatgtgttattctgggcc

SEQ ID NO: 419836 - DNA, 20 bp, Artificial Sequence
  chemically synthesized
cttcttaaatgtgttattct

SEQ ID NO: 419837 - DNA, 20 bp, Artificial Sequence
  chemically synthesized
acttcttaaatgtgttattc

SEQ ID NO: 419838 - DNA, 20 bp, Artificial Sequence
  chemically synthesized
gggcccagaataacacattt

SEQ ID NO: 419839 - DNA, 20 bp, Artificial Sequence
  chemically synthesized
cccagaataacacatttaag

SEQ ID NO: 419840 - DNA, 20 bp, Artificial Sequence
  chemically synthesized
acacatttaagaagtgattt

SEQ ID NO: 419841 - DNA, 20 bp, Artificial Sequence
  chemically synthesized
atttaagaagtgattttggc

SEQ ID NO: 419842 - DNA, 20 bp, Artificial Sequence
  chemically synthesized
gaagtgattttggctggccg

SEQ ID NO: 419843 - DNA, 20 bp, Artificial Sequence
  chemically synthesized
gtgattttggctggccgcgg

SEQ ID NO: 419844 - DNA, 20 bp, Artificial Sequence
  chemically synthesized
caggggtgagccaccgcggc

SEQ ID NO: 419845 - DNA, 20 bp, Artificial Sequence
  chemically synthesized
attacaggggtgagccaccg

SEQ ID NO: 419846 - DNA, 20 bp, Artificial Sequence
  chemically synthesized
agggctgggattacaggggt

SEQ ID NO: 419847 - DNA, 20 bp, Artificial Sequence
  chemically synthesized
acaaagggctgggattacag

SEQ ID NO: 419848 - DNA, 20 bp, Artificial Sequence
  chemically synthesized
cacaaagggctgggattaca

SEQ ID NO: 419849 - DNA, 20 bp, Artificial Sequence
  chemically synthesized
gtggctcacccctgtaatcc

SEQ ID NO: 419850 - DNA, 20 bp, Artificial Sequence
  chemically synthesized
tcacaaagggctgggattac

SEQ ID NO: 419851 - DNA, 20 bp, Artificial Sequence
  chemically synthesized
ctcacaaagggctgggatta

SEQ ID NO: 419852 - DNA, 20 bp, Artificial Sequence
  chemically synthesized
cctgggcctcacaaagggct

SEQ ID NO: 419853 - DNA, 20 bp, Artificial Sequence
  chemically synthesized
tcctgggcctcacaaagggc

SEQ ID NO: 419854 - DNA, 20 bp, Artificial Sequence
  chemically synthesized
ctgtaatcccagccctttgt

SEQ ID NO: 419855 - DNA, 20 bp, Artificial Sequence
  chemically synthesized
tgtaatcccagccctttgtg

SEQ ID NO: 419856 - DNA, 20 bp, Artificial Sequence
  chemically synthesized
gccctcctgggcctcacaaa

SEQ ID NO: 419857 - DNA, 20 bp, Artificial Sequence
  chemically synthesized
cgccctcctgggcctcacaa

SEQ ID NO: 419858 - DNA, 20 bp, Artificial Sequence
  chemically synthesized
ccgccctcctgggcctcaca

SEQ ID NO: 419859 - DNA, 20 bp, Artificial Sequence
  chemically synthesized
tcccagccctttgtgaggcc

SEQ ID NO: 419860 - DNA, 20 bp, Artificial Sequence
  chemically synthesized
cccagccctttgtgaggccc

SEQ ID NO: 419861 - DNA, 20 bp, Artificial Sequence
  chemically synthesized
cagccctttgtgaggcccag

SEQ ID NO: 419862 - DNA, 20 bp, Artificial Sequence
  chemically synthesized
agccctttgtgaggcccagg

SEQ ID NO: 419863 - DNA, 20 bp, Artificial Sequence
  chemically synthesized
gccctttgtgaggcccagga

SEQ ID NO: 419864 - DNA, 20 bp, Artificial Sequence
  chemically synthesized
ctttgtgaggcccaggaggg

SEQ ID NO: 419865 - DNA, 20 bp, Artificial Sequence
  chemically synthesized
ctcaggtaatccgccctcct

SEQ ID NO: 419866 - DNA, 20 bp, Artificial Sequence
  chemically synthesized
cctcaggtaatccgccctcc

SEQ ID NO: 419867 - DNA, 20 bp, Artificial Sequence
  chemically synthesized
cccaggagggcggattacct

SEQ ID NO: 419868 - DNA, 20 bp, Artificial Sequence
  chemically synthesized
ccaggagggcggattacctg

SEQ ID NO: 419869 - DNA, 20 bp, Artificial Sequence
  chemically synthesized
gagggcggattacctgaggt

SEQ ID NO: 419870 - DNA, 20 bp, Artificial Sequence
  chemically synthesized
agggcggattacctgaggtc

SEQ ID NO: 419871 - DNA, 20 bp, Artificial Sequence
  chemically synthesized
ggtctcaaactcctgacctc

SEQ ID NO: 419872 - DNA, 20 bp, Artificial Sequence
  chemically synthesized
ggcggattacctgaggtcag

SEQ ID NO: 419873 - DNA, 20 bp, Artificial Sequence
  chemically synthesized
tggtctcaaactcctgacct

SEQ ID NO: 419874 - DNA, 20 bp, Artificial Sequence
  chemically synthesized
ttacctgaggtcaggagttt

SEQ ID NO: 419875 - DNA, 20 bp, Artificial Sequence
  chemically synthesized
tgaggtcaggagtttgagac

SEQ ID NO: 419876 - DNA, 20 bp, Artificial Sequence
  chemically synthesized
tcaggagtttgagaccagcc

SEQ ID NO: 419877 - DNA, 20 bp, Artificial Sequence
  chemically synthesized
tttcaccatgttggccaggc

SEQ ID NO: 419878 - DNA, 20 bp, Artificial Sequence
  chemically synthesized
gaggtttcaccatgttggcc

SEQ ID NO: 419879 - DNA, 20 bp, Artificial Sequence
  chemically synthesized
tgagaccagcctggccaaca

SEQ ID NO: 419880 - DNA, 20 bp, Artificial Sequence
  chemically synthesized
cgaggtttcaccatgttggc

SEQ ID NO: 419881 - DNA, 20 bp, Artificial Sequence
  chemically synthesized
gagacgaggtttcaccatgt

SEQ ID NO: 419882 - DNA, 20 bp, Artificial Sequence
  chemically synthesized
ttgtatttgtagtagagacg

SEQ ID NO: 419883 - DNA, 20 bp, Artificial Sequence
  chemically synthesized
tttgtatttgtagtagagac

SEQ ID NO: 419884 - DNA, 20 bp, Artificial Sequence
  chemically synthesized
aattttttgtatttgtagta

SEQ ID NO: 419885 - DNA, 20 bp, Artificial Sequence
  chemically synthesized
ataattttttgtatttgtag

SEQ ID NO: 419886 - DNA, 20 bp, Artificial Sequence
  chemically synthesized
tggataattttttgtatttg

SEQ ID NO: 419887 - DNA, 20 bp, Artificial Sequence
  chemically synthesized
tacaaatacaaaaaattatc

SEQ ID NO: 419888 - DNA, 20 bp, Artificial Sequence
  chemically synthesized
acaaatacaaaaaattatcc

SEQ ID NO: 419889 - DNA, 20 bp, Artificial Sequence
  chemically synthesized
tacaaaaaattatccaggca

SEQ ID NO: 419890 - DNA, 20 bp, Artificial Sequence
  chemically synthesized
aaaaaattatccaggcatgg

SEQ ID NO: 419891 - DNA, 20 bp, Artificial Sequence
  chemically synthesized
agttggccctccaccatgcc

SEQ ID NO: 419892 - DNA, 20 bp, Artificial Sequence
  chemically synthesized
aaaattatccaggcatggtg

SEQ ID NO: 419893 - DNA, 20 bp, Artificial Sequence
  chemically synthesized
aaattatccaggcatggtgg

SEQ ID NO: 419894 - DNA, 20 bp, Artificial Sequence
  chemically synthesized
aattatccaggcatggtgga

SEQ ID NO: 419895 - DNA, 20 bp, Artificial Sequence
  chemically synthesized
gcctcagcctcatgagtagt

SEQ ID NO: 419896 - DNA, 20 bp, Artificial Sequence
  chemically synthesized
gtggagggccaactactcat

SEQ ID NO: 419897 - DNA, 20 bp, Artificial Sequence
  chemically synthesized
tggagggccaactactcatg

SEQ ID NO: 419898 - DNA, 20 bp, Artificial Sequence
  chemically synthesized
tcctgcctcagcctcatgag

SEQ ID NO: 419899 - DNA, 20 bp, Artificial Sequence
  chemically synthesized
ttctcctgcctcagcctcat

SEQ ID NO: 419900 - DNA, 20 bp, Artificial Sequence
  chemically synthesized
ggccaactactcatgaggct

SEQ ID NO: 419901 - DNA, 20 bp, Artificial Sequence
  chemically synthesized
gccaactactcatgaggctg

SEQ ID NO: 419902 - DNA, 20 bp, Artificial Sequence
  chemically synthesized
aactactcatgaggctgagg

SEQ ID NO: 419903 - DNA, 20 bp, Artificial Sequence
  chemically synthesized
actactcatgaggctgaggc

SEQ ID NO: 419904 - DNA, 20 bp, Artificial Sequence
  chemically synthesized
tactcatgaggctgaggcag

SEQ ID NO: 419905 - DNA, 20 bp, Artificial Sequence
  chemically synthesized
ttcaagcaattctcctgcct

SEQ ID NO: 419906 - DNA, 20 bp, Artificial Sequence
  chemically synthesized
gcaggagaattgcttgaacc

SEQ ID NO: 419907 - DNA, 20 bp, Artificial Sequence
  chemically synthesized
caggagaattgcttgaacct

SEQ ID NO: 419908 - DNA, 20 bp, Artificial Sequence
  chemically synthesized
aacctccacctcccaggttc

SEQ ID NO: 419909 - DNA, 20 bp, Artificial Sequence
  chemically synthesized
ggagaattgcttgaacctgg

SEQ ID NO: 419910 - DNA, 20 bp, Artificial Sequence
  chemically synthesized
gagaattgcttgaacctggg

SEQ ID NO: 419911 - DNA, 20 bp, Artificial Sequence
  chemically synthesized
aattgcttgaacctgggagg

SEQ ID NO: 419912 - DNA, 20 bp, Artificial Sequence
  chemically synthesized
cactgcaacctccacctccc

SEQ ID NO: 419913 - DNA, 20 bp, Artificial Sequence
  chemically synthesized
ttgcttgaacctgggaggtg

SEQ ID NO: 419914 - DNA, 20 bp, Artificial Sequence
  chemically synthesized
tcactgcaacctccacctcc

SEQ ID NO: 419915 - DNA, 20 bp, Artificial Sequence
  chemically synthesized
tgcttgaacctgggaggtgg

SEQ ID NO: 419916 - DNA, 20 bp, Artificial Sequence
  chemically synthesized
aacctgggaggtggaggttg

SEQ ID NO: 419917 - DNA, 20 bp, Artificial Sequence
  chemically synthesized
tgggaggtggaggttgcagt

SEQ ID NO: 419918 - DNA, 20 bp, Artificial Sequence
  chemically synthesized
ggtggaggttgcagtgagcc

SEQ ID NO: 419919 - DNA, 20 bp, Artificial Sequence
  chemically synthesized
ggagtgcaacggcgcgatct

SEQ ID NO: 419920 - DNA, 20 bp, Artificial Sequence
  chemically synthesized
ttgcccaggctggagtgcaa

SEQ ID NO: 419921 - DNA, 20 bp, Artificial Sequence
  chemically synthesized
gagatcgcgccgttgcactc

SEQ ID NO: 419922 - DNA, 20 bp, Artificial Sequence
  chemically synthesized
cgcgccgttgcactccagcc

SEQ ID NO: 419923 - DNA, 20 bp, Artificial Sequence
  chemically synthesized
gcgccgttgcactccagcct

SEQ ID NO: 419924 - DNA, 20 bp, Artificial Sequence
  chemically synthesized
cactcttgttgcccaggctg

SEQ ID NO: 419925 - DNA, 20 bp, Artificial Sequence
  chemically synthesized
ttcactcttgttgcccaggc

SEQ ID NO: 419926 - DNA, 20 bp, Artificial Sequence
  chemically synthesized
tgcactccagcctgggcaac

SEQ ID NO: 419927 - DNA, 20 bp, Artificial Sequence
  chemically synthesized
gagtttcactcttgttgccc

SEQ ID NO: 419928 - DNA, 20 bp, Artificial Sequence
  chemically synthesized
ggagtttcactcttgttgcc

SEQ ID NO: 419929 - DNA, 20 bp, Artificial Sequence
  chemically synthesized
cactccagcctgggcaacaa

SEQ ID NO: 419930 - DNA, 20 bp, Artificial Sequence
  chemically synthesized
acaagagtgaaactccgttt

SEQ ID NO: 419931 - DNA, 20 bp, Artificial Sequence
  chemically synthesized
ttttttttttttccgaaacg

SEQ ID NO: 419932 - DNA, 20 bp, Artificial Sequence
  chemically synthesized
ttttttttttttttccgaaa

SEQ ID NO: 419933 - DNA, 20 bp, Artificial Sequence
  chemically synthesized
gtttcggaaaaaaaaaaaaa

SEQ ID NO: 419934 - DNA, 20 bp, Artificial Sequence
  chemically synthesized
tcggaaaaaaaaaaaaaaag

SEQ ID NO: 419935 - DNA, 20 bp, Artificial Sequence
  chemically synthesized
gaaaaaaaaaaaaaaagaag

SEQ ID NO: 419936 - DNA, 20 bp, Artificial Sequence
  chemically synthesized
aaaaaaaaaaaaaagaagaa

SEQ ID NO: 419937 - DNA, 20 bp, Artificial Sequence
  chemically synthesized
aaaaaaaaaaaagaagaaga

SEQ ID NO: 419938 - DNA, 20 bp, Artificial Sequence
  chemically synthesized
aaaaaaaaaagaagaagaga

SEQ ID NO: 419939 - DNA, 20 bp, Artificial Sequence
  chemically synthesized
aaaaaaagaagaagagagag

SEQ ID NO: 419940 - DNA, 20 bp, Artificial Sequence
  chemically synthesized
gagagaagtgatttaaacct

SEQ ID NO: 419941 - DNA, 20 bp, Artificial Sequence
  chemically synthesized
ttttaaaattgaacagactt

SEQ ID NO: 419942 - DNA, 20 bp, Artificial Sequence
  chemically synthesized
gttttaaaattgaacagact

SEQ ID NO: 419943 - DNA, 20 bp, Artificial Sequence
  chemically synthesized
ttacaagttttaaaattgaa

SEQ ID NO: 419944 - DNA, 20 bp, Artificial Sequence
  chemically synthesized
taatttttatttaagattac

SEQ ID NO: 419945 - DNA, 20 bp, Artificial Sequence
  chemically synthesized
tctaaatataatttttattt

SEQ ID NO: 419946 - DNA, 20 bp, Artificial Sequence
  chemically synthesized
tcttaaataaaaattatatt

SEQ ID NO: 419947 - DNA, 20 bp, Artificial Sequence
  chemically synthesized
aaaaattatatttagaatta

SEQ ID NO: 419948 - DNA, 20 bp, Artificial Sequence
  chemically synthesized
aattatagtatcaattttat

SEQ ID NO: 419949 - DNA, 20 bp, Artificial Sequence
  chemically synthesized
atagtatcaattttattggc

SEQ ID NO: 419950 - DNA, 20 bp, Artificial Sequence
  chemically synthesized
tactttattaaaattttaac

SEQ ID NO: 419951 - DNA, 20 bp, Artificial Sequence
  chemically synthesized
ggccagttaaaattttaata

SEQ ID NO: 419952 - DNA, 20 bp, Artificial Sequence
  chemically synthesized
cagttaaaattttaataaag

SEQ ID NO: 419953 - DNA, 20 bp, Artificial Sequence
  chemically synthesized
atatatgcaatttgtactat

SEQ ID NO: 419954 - DNA, 20 bp, Artificial Sequence
  chemically synthesized
gcaatttgtactatcagcta

SEQ ID NO: 419955 - DNA, 20 bp, Artificial Sequence
  chemically synthesized
aacaagccatctatagctga

SEQ ID NO: 419956 - DNA, 20 bp, Artificial Sequence
  chemically synthesized
tttgtactatcagctataga

SEQ ID NO: 419957 - DNA, 20 bp, Artificial Sequence
  chemically synthesized
gtggtcaaacaagccatcta

SEQ ID NO: 419958 - DNA, 20 bp, Artificial Sequence
  chemically synthesized
acattaaaatgtggtcaaac

SEQ ID NO: 419959 - DNA, 20 bp, Artificial Sequence
  chemically synthesized
atatgtaacacattaaaatg

SEQ ID NO: 419960 - DNA, 20 bp, Artificial Sequence
  chemically synthesized
atgtgttacatattttcatt

SEQ ID NO: 419961 - DNA, 20 bp, Artificial Sequence
  chemically synthesized
ttacatattttcatttagta

SEQ ID NO: 419962 - DNA, 20 bp, Artificial Sequence
  chemically synthesized
tcatttagtatagttcatcc

SEQ ID NO: 419963 - DNA, 20 bp, Artificial Sequence
  chemically synthesized
tctagggaacttaatattcc

SEQ ID NO: 419964 - DNA, 20 bp, Artificial Sequence
  chemically synthesized
atagttcatcctggaatatt

SEQ ID NO: 419965 - DNA, 20 bp, Artificial Sequence
  chemically synthesized
atctagggaacttaatattc

SEQ ID NO: 419966 - DNA, 20 bp, Artificial Sequence
  chemically synthesized
tcctggaatattaagttccc

SEQ ID NO: 419967 - DNA, 20 bp, Artificial Sequence
  chemically synthesized
attaaaaagtggttgatcta

SEQ ID NO: 419968 - DNA, 20 bp, Artificial Sequence
  chemically synthesized
tattaaaaagtggttgatct

SEQ ID NO: 419969 - DNA, 20 bp, Artificial Sequence
  chemically synthesized
atattaaaaagtggttgatc

SEQ ID NO: 419970 - DNA, 20 bp, Artificial Sequence
  chemically synthesized
catgagtatatattaaaaag

SEQ ID NO: 419971 - DNA, 20 bp, Artificial Sequence
  chemically synthesized
tagcatgagtatatattaaa

SEQ ID NO: 419972 - DNA, 20 bp, Artificial Sequence
  chemically synthesized
aattttcaaaacaatagcat

SEQ ID NO: 419973 - DNA, 20 bp, Artificial Sequence
  chemically synthesized
atctctaattttcaaaacaa

SEQ ID NO: 419974 - DNA, 20 bp, Artificial Sequence
  chemically synthesized
catgctattgttttgaaaat

SEQ ID NO: 419975 - DNA, 20 bp, Artificial Sequence
  chemically synthesized
tgctattgttttgaaaatta

SEQ ID NO: 419976 - DNA, 20 bp, Artificial Sequence
  chemically synthesized
gaaaattagagataactgtt

SEQ ID NO: 419977 - DNA, 20 bp, Artificial Sequence
  chemically synthesized
agccttatgttaaagctaaa

SEQ ID NO: 419978 - DNA, 20 bp, Artificial Sequence
  chemically synthesized
taactgtttagctttaacat

SEQ ID NO: 419979 - DNA, 20 bp, Artificial Sequence
  chemically synthesized
aactgtttagctttaacata

SEQ ID NO: 419980 - DNA, 20 bp, Artificial Sequence
  chemically synthesized
cagtctaaagccttatgtta

SEQ ID NO: 419981 - DNA, 20 bp, Artificial Sequence
  chemically synthesized
ttagctttaacataaggctt

SEQ ID NO: 419982 - DNA, 20 bp, Artificial Sequence
  chemically synthesized
tttaacataaggctttagac

SEQ ID NO: 419983 - DNA, 20 bp, Artificial Sequence
  chemically synthesized
actactagttaaccagtcta

SEQ ID NO: 419984 - DNA, 20 bp, Artificial Sequence
  chemically synthesized
aaggctttagactggttaac

SEQ ID NO: 419985 - DNA, 20 bp, Artificial Sequence
  chemically synthesized
aatggacactactagttaac

SEQ ID NO: 419986 - DNA, 20 bp, Artificial Sequence
  chemically synthesized
gctttagactggttaactag

SEQ ID NO: 419987 - DNA, 20 bp, Artificial Sequence
  chemically synthesized
gggacctgaatggacactac

SEQ ID NO: 419988 - DNA, 20 bp, Artificial Sequence
  chemically synthesized
gttaactagtagtgtccatt

SEQ ID NO: 419989 - DNA, 20 bp, Artificial Sequence
  chemically synthesized
ttaactagtagtgtccattc

SEQ ID NO: 419990 - DNA, 20 bp, Artificial Sequence
  chemically synthesized
gaaaccagcagggacctgaa

SEQ ID NO: 419991 - DNA, 20 bp, Artificial Sequence
  chemically synthesized
gtgtccattcaggtccctgc

SEQ ID NO: 419992 - DNA, 20 bp, Artificial Sequence
  chemically synthesized
atttcaaacagaaaccagca

SEQ ID NO: 419993 - DNA, 20 bp, Artificial Sequence
  chemically synthesized
gatttcaaacagaaaccagc

SEQ ID NO: 419994 - DNA, 20 bp, Artificial Sequence
  chemically synthesized
tgatttcaaacagaaaccag

SEQ ID NO: 419995 - DNA, 20 bp, Artificial Sequence
  chemically synthesized
ccttgatttcaaacagaaac

SEQ ID NO: 419996 - DNA, 20 bp, Artificial Sequence
  chemically synthesized
ttattggccttgatttcaaa

SEQ ID NO: 419997 - DNA, 20 bp, Artificial Sequence
  chemically synthesized
gctggtttctgtttgaaatc

SEQ ID NO: 419998 - DNA, 20 bp, Artificial Sequence
  chemically synthesized
ctggtttctgtttgaaatca

SEQ ID NO: 419999 - DNA, 20 bp, Artificial Sequence
  chemically synthesized
gaaatcaaggccaataataa

SEQ ID NO: 420000 - DNA, 20 bp, Artificial Sequence
  chemically synthesized
ctctttaagaccgttattat

SEQ ID NO: 420001 - DNA, 20 bp, Artificial Sequence
  chemically synthesized
ggccaataataacggtctta

SEQ ID NO: 420002 - DNA, 20 bp, Artificial Sequence
  chemically synthesized
ccaataataacggtcttaaa

SEQ ID NO: 420003 - DNA, 20 bp, Artificial Sequence
  chemically synthesized
caataataacggtcttaaag

SEQ ID NO: 420004 - DNA, 20 bp, Artificial Sequence
  chemically synthesized
cttttccaataatcctcttt

SEQ ID NO: 420005 - DNA, 20 bp, Artificial Sequence
  chemically synthesized
acggtcttaaagaggattat

SEQ ID NO: 420006 - DNA, 20 bp, Artificial Sequence
  chemically synthesized
cttaaagaggattattggaa

SEQ ID NO: 420007 - DNA, 20 bp, Artificial Sequence
  chemically synthesized
agaggattattggaaaagtt

SEQ ID NO: 420008 - DNA, 20 bp, Artificial Sequence
  chemically synthesized
gcattctttgttgagcaaga

SEQ ID NO: 420009 - DNA, 20 bp, Artificial Sequence
  chemically synthesized
tgcattctttgttgagcaag

SEQ ID NO: 420010 - DNA, 20 bp, Artificial Sequence
  chemically synthesized
gcttgcattctttgttgagc

SEQ ID NO: 420011 - DNA, 20 bp, Artificial Sequence
  chemically synthesized
gtgaaccttcttgctcaaca

SEQ ID NO: 420012 - DNA, 20 bp, Artificial Sequence
  chemically synthesized
ttttgcttgcattctttgtt

SEQ ID NO: 420013 - DNA, 20 bp, Artificial Sequence
  chemically synthesized
tcttgctcaacaaagaatgc

SEQ ID NO: 420014 - DNA, 20 bp, Artificial Sequence
  chemically synthesized
caagcaaaattgtcttaatc

SEQ ID NO: 420015 - DNA, 20 bp, Artificial Sequence
  chemically synthesized
ttttcaaactgttctagatt

SEQ ID NO: 420016 - DNA, 20 bp, Artificial Sequence
  chemically synthesized
aaaattgtcttaatctagaa

SEQ ID NO: 420017 - DNA, 20 bp, Artificial Sequence
  chemically synthesized
atagtgttttcaaactgttc

SEQ ID NO: 420018 - DNA, 20 bp, Artificial Sequence
  chemically synthesized
acagtttgaaaacactatct

SEQ ID NO: 420019 - DNA, 20 bp, Artificial Sequence
  chemically synthesized
aatacactaatagactaaga

SEQ ID NO: 420020 - DNA, 20 bp, Artificial Sequence
  chemically synthesized
aaaacactatcttagtctat

SEQ ID NO: 420021 - DNA, 20 bp, Artificial Sequence
  chemically synthesized
aaaaaatacactaatagact

SEQ ID NO: 420022 - DNA, 20 bp, Artificial Sequence
  chemically synthesized
ggactgaaaaaatacactaa

SEQ ID NO: 420023 - DNA, 20 bp, Artificial Sequence
  chemically synthesized
agtctattagtgtatttttt

SEQ ID NO: 420024 - DNA, 20 bp, Artificial Sequence
  chemically synthesized
attagtgtattttttcagtc

SEQ ID NO: 420025 - DNA, 20 bp, Artificial Sequence
  chemically synthesized
aagaagcagaagaaacaaac

SEQ ID NO: 420026 - DNA, 20 bp, Artificial Sequence
  chemically synthesized
actatgatttaaagaagcag

SEQ ID NO: 420027 - DNA, 20 bp, Artificial Sequence
  chemically synthesized
acaactatgatttaaagaag

SEQ ID NO: 420028 - DNA, 20 bp, Artificial Sequence
  chemically synthesized
aaaacaactatgatttaaag

SEQ ID NO: 420029 - DNA, 20 bp, Artificial Sequence
  chemically synthesized
tcttctgcttctttaaatca

SEQ ID NO: 420030 - DNA, 20 bp, Artificial Sequence
  chemically synthesized
agaaaaacaactatgattta

SEQ ID NO: 420031 - DNA, 20 bp, Artificial Sequence
  chemically synthesized
ttaaatcatagttgtttttc

SEQ ID NO: 420032 - DNA, 20 bp, Artificial Sequence
  chemically synthesized
agattataatgaagttcatc

SEQ ID NO: 420033 - DNA, 20 bp, Artificial Sequence
  chemically synthesized
tgaatttccagattataatg

SEQ ID NO: 420034 - DNA, 20 bp, Artificial Sequence
  chemically synthesized
ggatgaacttcattataatc

SEQ ID NO: 420035 - DNA, 20 bp, Artificial Sequence
  chemically synthesized
gaaatgtcaatgtgaatttc

SEQ ID NO: 420036 - DNA, 20 bp, Artificial Sequence
  chemically synthesized
attcacattgacatttctcc

SEQ ID NO: 420037 - DNA, 20 bp, Artificial Sequence
  chemically synthesized
acattgacatttctcccaga

SEQ ID NO: 420038 - DNA, 20 bp, Artificial Sequence
  chemically synthesized
tgctttatttggctttctgg

SEQ ID NO: 420039 - DNA, 20 bp, Artificial Sequence
  chemically synthesized
tgtgctttatttggctttct

SEQ ID NO: 420040 - DNA, 20 bp, Artificial Sequence
  chemically synthesized
gtgtgctttatttggctttc

SEQ ID NO: 420041 - DNA, 20 bp, Artificial Sequence
  chemically synthesized
ttctcccagaaagccaaata

SEQ ID NO: 420042 - DNA, 20 bp, Artificial Sequence
  chemically synthesized
ttctaaatgtgtgctttatt

SEQ ID NO: 420043 - DNA, 20 bp, Artificial Sequence
  chemically synthesized
agccaaataaagcacacatt

SEQ ID NO: 420044 - DNA, 20 bp, Artificial Sequence
  chemically synthesized
aaataaagcacacatttaga

SEQ ID NO: 420045 - DNA, 20 bp, Artificial Sequence
  chemically synthesized
agcacacatttagaaagcct

SEQ ID NO: 420046 - DNA, 20 bp, Artificial Sequence
  chemically synthesized
acatttagaaagcctaagta

SEQ ID NO: 420047 - DNA, 20 bp, Artificial Sequence
  chemically synthesized
aagctttagatgctgtactt

SEQ ID NO: 420048 - DNA, 20 bp, Artificial Sequence
  chemically synthesized
gaagctttagatgctgtact

SEQ ID NO: 420049 - DNA, 20 bp, Artificial Sequence
  chemically synthesized
aagcctaagtacagcatcta

SEQ ID NO: 420050 - DNA, 20 bp, Artificial Sequence
  chemically synthesized
tataatggtcaaggaagctt

SEQ ID NO: 420051 - DNA, 20 bp, Artificial Sequence
  chemically synthesized
ttcagttataatggtcaagg

SEQ ID NO: 420052 - DNA, 20 bp, Artificial Sequence
  chemically synthesized
ttattcagttataatggtca

SEQ ID NO: 420053 - DNA, 20 bp, Artificial Sequence
  chemically synthesized
gttattcagttataatggtc

SEQ ID NO: 420054 - DNA, 20 bp, Artificial Sequence
  chemically synthesized
cggctgttattcagttataa

SEQ ID NO: 420055 - DNA, 20 bp, Artificial Sequence
  chemically synthesized
tgaccattataactgaataa

SEQ ID NO: 420056 - DNA, 20 bp, Artificial Sequence
  chemically synthesized
tacactacacggctgttatt

SEQ ID NO: 420057 - DNA, 20 bp, Artificial Sequence
  chemically synthesized
ataactgaataacagccgtg

SEQ ID NO: 420058 - DNA, 20 bp, Artificial Sequence
  chemically synthesized
tgaataacagccgtgtagtg

SEQ ID NO: 420059 - DNA, 20 bp, Artificial Sequence
  chemically synthesized
ttttttagcactacactaca

SEQ ID NO: 420060 - DNA, 20 bp, Artificial Sequence
  chemically synthesized
ctggaataattttttttttt

SEQ ID NO: 420061 - DNA, 20 bp, Artificial Sequence
  chemically synthesized
ctaaaaaaaaaaaattattc

SEQ ID NO: 420062 - DNA, 20 bp, Artificial Sequence
  chemically synthesized
aaaaaattattccagttaca

SEQ ID NO: 420063 - DNA, 20 bp, Artificial Sequence
  chemically synthesized
aagagactgaaccatgtaac

SEQ ID NO: 420064 - DNA, 20 bp, Artificial Sequence
  chemically synthesized
attattccagttacatggtt

SEQ ID NO: 420065 - DNA, 20 bp, Artificial Sequence
  chemically synthesized
gttacatggttcagtctctt

SEQ ID NO: 420066 - DNA, 20 bp, Artificial Sequence
  chemically synthesized
tggctacctgtaaatctcaa

SEQ ID NO: 420067 - DNA, 20 bp, Artificial Sequence
  chemically synthesized
attggctacctgtaaatctc

SEQ ID NO: 420068 - DNA, 20 bp, Artificial Sequence
  chemically synthesized
gttcagtctcttgagattta

SEQ ID NO: 420069 - DNA, 20 bp, Artificial Sequence
  chemically synthesized
ttcagtctcttgagatttac

SEQ ID NO: 420070 - DNA, 20 bp, Artificial Sequence
  chemically synthesized
agtctcttgagatttacagg

SEQ ID NO: 420071 - DNA, 20 bp, Artificial Sequence
  chemically synthesized
gatttacaggtagccaatta

SEQ ID NO: 420072 - DNA, 20 bp, Artificial Sequence
  chemically synthesized
tctggcctgtgggccataat

SEQ ID NO: 420073 - DNA, 20 bp, Artificial Sequence
  chemically synthesized
aggtagccaattatggccca

SEQ ID NO: 420074 - DNA, 20 bp, Artificial Sequence
  chemically synthesized
ggtagccaattatggcccac

SEQ ID NO: 420075 - DNA, 20 bp, Artificial Sequence
  chemically synthesized
gccaattatggcccacaggc

SEQ ID NO: 420076 - DNA, 20 bp, Artificial Sequence
  chemically synthesized
cagtcacttgtctggcctgt

SEQ ID NO: 420077 - DNA, 20 bp, Artificial Sequence
  chemically synthesized
tcagtcacttgtctggcctg

SEQ ID NO: 420078 - DNA, 20 bp, Artificial Sequence
  chemically synthesized
ttatggcccacaggccagac

SEQ ID NO: 420079 - DNA, 20 bp, Artificial Sequence
  chemically synthesized
acaacgatcagtcacttgtc

SEQ ID NO: 420080 - DNA, 20 bp, Artificial Sequence
  chemically synthesized
cgttgttttcagacaacgat

SEQ ID NO: 420081 - DNA, 20 bp, Artificial Sequence
  chemically synthesized
ccccacttcgtcgttgtttt

SEQ ID NO: 420082 - DNA, 20 bp, Artificial Sequence
  chemically synthesized
gttgtctgaaaacaacgacg

SEQ ID NO: 420083 - DNA, 20 bp, Artificial Sequence
  chemically synthesized
gtctgaaaacaacgacgaag

SEQ ID NO: 420084 - DNA, 20 bp, Artificial Sequence
  chemically synthesized
tctgaaaacaacgacgaagt

SEQ ID NO: 420085 - DNA, 20 bp, Artificial Sequence
  chemically synthesized
ctgaaaacaacgacgaagtg

SEQ ID NO: 420086 - DNA, 20 bp, Artificial Sequence
  chemically synthesized
gaaaacaacgacgaagtggg

SEQ ID NO: 420087 - DNA, 20 bp, Artificial Sequence
  chemically synthesized
aaaacaacgacgaagtgggg

SEQ ID NO: 420088 - DNA, 20 bp, Artificial Sequence
  chemically synthesized
gacgaagtggggaggtgaaa

SEQ ID NO: 420089 - DNA, 20 bp, Artificial Sequence
  chemically synthesized
ggggaggtgaaaaagattta

SEQ ID NO: 420090 - DNA, 20 bp, Artificial Sequence
  chemically synthesized
tacggttttttttcccctta

SEQ ID NO: 420091 - DNA, 20 bp, Artificial Sequence
  chemically synthesized
acggttttttttccccttac

SEQ ID NO: 420092 - DNA, 20 bp, Artificial Sequence
  chemically synthesized
aaacaacatctacctgtaag

SEQ ID NO: 420093 - DNA, 20 bp, Artificial Sequence
  chemically synthesized
gttttttttccccttacagg

SEQ ID NO: 420094 - DNA, 20 bp, Artificial Sequence
  chemically synthesized
caaacaacatctacctgtaa

SEQ ID NO: 420095 - DNA, 20 bp, Artificial Sequence
  chemically synthesized
tcaaacaacatctacctgta

SEQ ID NO: 420096 - DNA, 20 bp, Artificial Sequence
  chemically synthesized
ttcaaacaacatctacctgt

SEQ ID NO: 420097 - DNA, 20 bp, Artificial Sequence
  chemically synthesized
tagatgttgtttgaaataat

SEQ ID NO: 420098 - DNA, 20 bp, Artificial Sequence
  chemically synthesized
tgagatttaaaacgctaatg

SEQ ID NO: 420099 - DNA, 20 bp, Artificial Sequence
  chemically synthesized
agatttaaaacgctaatgca

SEQ ID NO: 420100 - DNA, 20 bp, Artificial Sequence
  chemically synthesized
aagagatcaaagctctgcat

SEQ ID NO: 420101 - DNA, 20 bp, Artificial Sequence
  chemically synthesized
aaacatcaaagaagagatca

SEQ ID NO: 420102 - DNA, 20 bp, Artificial Sequence
  chemically synthesized
aggcaagaaacatcaaagaa

SEQ ID NO: 420103 - DNA, 20 bp, Artificial Sequence
  chemically synthesized
acaggcaagaaacatcaaag

SEQ ID NO: 420104 - DNA, 20 bp, Artificial Sequence
  chemically synthesized
acaacaggcaagaaacatca

SEQ ID NO: 420105 - DNA, 20 bp, Artificial Sequence
  chemically synthesized
atttcatatagacaacaggc

SEQ ID NO: 420106 - DNA, 20 bp, Artificial Sequence
  chemically synthesized
ctatatttcatatagacaac

SEQ ID NO: 420107 - DNA, 20 bp, Artificial Sequence
  chemically synthesized
actatatttcatatagacaa

SEQ ID NO: 420108 - DNA, 20 bp, Artificial Sequence
  chemically synthesized
ttaactgactatatttcata

SEQ ID NO: 420109 - DNA, 20 bp, Artificial Sequence
  chemically synthesized
cctgttgtctatatgaaata

SEQ ID NO: 420110 - DNA, 20 bp, Artificial Sequence
  chemically synthesized
ttgtctatatgaaatatagt

SEQ ID NO: 420111 - DNA, 20 bp, Artificial Sequence
  chemically synthesized
atatagtcagttaaaataaa

SEQ ID NO: 420112 - DNA, 20 bp, Artificial Sequence
  chemically synthesized
agtcagttaaaataaaaagc

SEQ ID NO: 420113 - DNA, 20 bp, Artificial Sequence
  chemically synthesized
tcagttaaaataaaaagcca

SEQ ID NO: 420114 - DNA, 20 bp, Artificial Sequence
  chemically synthesized
taaaataaaaagccagagaa

SEQ ID NO: 420115 - DNA, 20 bp, Artificial Sequence
  chemically synthesized
agtgagtagaaactattctc

SEQ ID NO: 420116 - DNA, 20 bp, Artificial Sequence
  chemically synthesized
ttttattaatcattagtgag

SEQ ID NO: 420117 - DNA, 20 bp, Artificial Sequence
  chemically synthesized
agtttttattaatcattagt

SEQ ID NO: 420118 - DNA, 20 bp, Artificial Sequence
  chemically synthesized
aagcagtttttattaatcat

SEQ ID NO: 420119 - DNA, 20 bp, Artificial Sequence
  chemically synthesized
aatgattaataaaaactgct

SEQ ID NO: 420120 - DNA, 20 bp, Artificial Sequence
  chemically synthesized
gcaagattgcatttgccaag

SEQ ID NO: 420121 - DNA, 20 bp, Artificial Sequence
  chemically synthesized
tgtgcaagattgcatttgcc

SEQ ID NO: 420122 - DNA, 20 bp, Artificial Sequence
  chemically synthesized
gttttcatttgtcaatgtgc

SEQ ID NO: 420123 - DNA, 20 bp, Artificial Sequence
  chemically synthesized
tgcacattgacaaatgaaaa

SEQ ID NO: 420124 - DNA, 20 bp, Artificial Sequence
  chemically synthesized
attgacaaatgaaaacagaa

SEQ ID NO: 420125 - DNA, 20 bp, Artificial Sequence
  chemically synthesized
ttgacaaatgaaaacagaat

SEQ ID NO: 420126 - DNA, 20 bp, Artificial Sequence
  chemically synthesized
cagaataggatgcccaacaa

SEQ ID NO: 420127 - DNA, 20 bp, Artificial Sequence
  chemically synthesized
tttttttttaaaccattgtt

SEQ ID NO: 420128 - DNA, 20 bp, Artificial Sequence
  chemically synthesized
ttttttttttaaaccattgt

SEQ ID NO: 420129 - DNA, 20 bp, Artificial Sequence
  chemically synthesized
acaatggtttaaaaaaaaaa

SEQ ID NO: 420130 - DNA, 20 bp, Artificial Sequence
  chemically synthesized
caatggtttaaaaaaaaaaa

SEQ ID NO: 420131 - DNA, 20 bp, Artificial Sequence
  chemically synthesized
tgtggcaatgtaaacaaaca

SEQ ID NO: 420132 - DNA, 20 bp, Artificial Sequence
  chemically synthesized
tttgtttgtttacattgcca

SEQ ID NO: 420133 - DNA, 20 bp, Artificial Sequence
  chemically synthesized
gaacaaagagcagtgtactg

SEQ ID NO: 420134 - DNA, 20 bp, Artificial Sequence
  chemically synthesized
cagggtcagggaacaaagag

SEQ ID NO: 420135 - DNA, 20 bp, Artificial Sequence
  chemically synthesized
ttgcagggtcagggaacaaa

SEQ ID NO: 420136 - DNA, 20 bp, Artificial Sequence
  chemically synthesized
gcttgcagggtcagggaaca

SEQ ID NO: 420137 - DNA, 20 bp, Artificial Sequence
  chemically synthesized
ggtgagagcttgcagggtca

SEQ ID NO: 420138 - DNA, 20 bp, Artificial Sequence
  chemically synthesized
cggtgagagcttgcagggtc

SEQ ID NO: 420139 - DNA, 20 bp, Artificial Sequence
  chemically synthesized
tctttgttccctgaccctgc

SEQ ID NO: 420140 - DNA, 20 bp, Artificial Sequence
  chemically synthesized
ccggtgagagcttgcagggt

SEQ ID NO: 420141 - DNA, 20 bp, Artificial Sequence
  chemically synthesized
tcacccggtgagagcttgca

SEQ ID NO: 420142 - DNA, 20 bp, Artificial Sequence
  chemically synthesized
gtcacccggtgagagcttgc

SEQ ID NO: 420143 - DNA, 20 bp, Artificial Sequence
  chemically synthesized
agtcacccggtgagagcttg

SEQ ID NO: 420144 - DNA, 20 bp, Artificial Sequence
  chemically synthesized
ctgaccctgcaagctctcac

SEQ ID NO: 420145 - DNA, 20 bp, Artificial Sequence
  chemically synthesized
tgaccctgcaagctctcacc

SEQ ID NO: 420146 - DNA, 20 bp, Artificial Sequence
  chemically synthesized
aagtcgaagtcacccggtga

SEQ ID NO: 420147 - DNA, 20 bp, Artificial Sequence
  chemically synthesized
caaagtcgaagtcacccggt

SEQ ID NO: 420148 - DNA, 20 bp, Artificial Sequence
  chemically synthesized
ggtgcaaagtcgaagtcacc

SEQ ID NO: 420149 - DNA, 20 bp, Artificial Sequence
  chemically synthesized
gaaaagtaggtgcaaagtcg

SEQ ID NO: 420150 - DNA, 20 bp, Artificial Sequence
  chemically synthesized
aaaagagaaaagtaggtgca

SEQ ID NO: 420151 - DNA, 20 bp, Artificial Sequence
  chemically synthesized
attctaaaaaagagaaaagt

SEQ ID NO: 420152 - DNA, 20 bp, Artificial Sequence
  chemically synthesized
cattctaaaaaagagaaaag

SEQ ID NO: 420153 - DNA, 20 bp, Artificial Sequence
  chemically synthesized
gggcattctaaaaaagagaa

SEQ ID NO: 420154 - DNA, 20 bp, Artificial Sequence
  chemically synthesized
gcacctacttttctcttttt

SEQ ID NO: 420155 - DNA, 20 bp, Artificial Sequence
  chemically synthesized
agagagggcattctaaaaaa

SEQ ID NO: 420156 - DNA, 20 bp, Artificial Sequence
  chemically synthesized
tgagagagggcattctaaaa

SEQ ID NO: 420157 - DNA, 20 bp, Artificial Sequence
  chemically synthesized
tagtggtaacatgtgagaga

SEQ ID NO: 420158 - DNA, 20 bp, Artificial Sequence
  chemically synthesized
ctagtggtaacatgtgagag

SEQ ID NO: 420159 - DNA, 20 bp, Artificial Sequence
  chemically synthesized
tctagtggtaacatgtgaga

SEQ ID NO: 420160 - DNA, 20 bp, Artificial Sequence
  chemically synthesized
tctctagtggtaacatgtga

SEQ ID NO: 420161 - DNA, 20 bp, Artificial Sequence
  chemically synthesized
tttctctagtggtaacatgt

SEQ ID NO: 420162 - DNA, 20 bp, Artificial Sequence
  chemically synthesized
cctctctcacatgttaccac

SEQ ID NO: 420163 - DNA, 20 bp, Artificial Sequence
  chemically synthesized
tctctcacatgttaccacta

SEQ ID NO: 420164 - DNA, 20 bp, Artificial Sequence
  chemically synthesized
acacgtgattgtttctctag

SEQ ID NO: 420165 - DNA, 20 bp, Artificial Sequence
  chemically synthesized
agcacacgtgattgtttctc

SEQ ID NO: 420166 - DNA, 20 bp, Artificial Sequence
  chemically synthesized
gaaacaatcacgtgtgcttc

SEQ ID NO: 420167 - DNA, 20 bp, Artificial Sequence
  chemically synthesized
aaacaatcacgtgtgcttca

SEQ ID NO: 420168 - DNA, 20 bp, Artificial Sequence
  chemically synthesized
aaatttttgatttggccttg

SEQ ID NO: 420169 - DNA, 20 bp, Artificial Sequence
  chemically synthesized
tgaagaggaaatttttgatt

SEQ ID NO: 420170 - DNA, 20 bp, Artificial Sequence
  chemically synthesized
caaatcaaaaatttcctctt

SEQ ID NO: 420171 - DNA, 20 bp, Artificial Sequence
  chemically synthesized
ctcagtccaaaggactgaag

SEQ ID NO: 420172 - DNA, 20 bp, Artificial Sequence
  chemically synthesized
tctcagtccaaaggactgaa

SEQ ID NO: 420173 - DNA, 20 bp, Artificial Sequence
  chemically synthesized
tctctcagtccaaaggactg

SEQ ID NO: 420174 - DNA, 20 bp, Artificial Sequence
  chemically synthesized
aaatttcctcttcagtcctt

SEQ ID NO: 420175 - DNA, 20 bp, Artificial Sequence
  chemically synthesized
cctcttcagtcctttggact

SEQ ID NO: 420176 - DNA, 20 bp, Artificial Sequence
  chemically synthesized
gcataactctctcagtccaa

SEQ ID NO: 420177 - DNA, 20 bp, Artificial Sequence
  chemically synthesized
ggcataactctctcagtcca

SEQ ID NO: 420178 - DNA, 20 bp, Artificial Sequence
  chemically synthesized
tcttcagtcctttggactga

SEQ ID NO: 420179 - DNA, 20 bp, Artificial Sequence
  chemically synthesized
ttcagtcctttggactgaga

SEQ ID NO: 420180 - DNA, 20 bp, Artificial Sequence
  chemically synthesized
gaaattgggcataactctct

SEQ ID NO: 420181 - DNA, 20 bp, Artificial Sequence
  chemically synthesized
gagagttatgcccaatttca

SEQ ID NO: 420182 - DNA, 20 bp, Artificial Sequence
  chemically synthesized
gtaccatatgctgtgaaatt

SEQ ID NO: 420183 - DNA, 20 bp, Artificial Sequence
  chemically synthesized
tgtaccatatgctgtgaaat

SEQ ID NO: 420184 - DNA, 20 bp, Artificial Sequence
  chemically synthesized
atgcccaatttcacagcata

SEQ ID NO: 420185 - DNA, 20 bp, Artificial Sequence
  chemically synthesized
aatttcacagcatatggtac

SEQ ID NO: 420186 - DNA, 20 bp, Artificial Sequence
  chemically synthesized
atggtacagaaaaataacag

SEQ ID NO: 420187 - DNA, 20 bp, Artificial Sequence
  chemically synthesized
catggtacagaaaaataaca

SEQ ID NO: 420188 - DNA, 20 bp, Artificial Sequence
  chemically synthesized
accatggtacagaaaaataa

SEQ ID NO: 420189 - DNA, 20 bp, Artificial Sequence
  chemically synthesized
tctgttatttttctgtacca

SEQ ID NO: 420190 - DNA, 20 bp, Artificial Sequence
  chemically synthesized
gtacatataataccatggta

SEQ ID NO: 420191 - DNA, 20 bp, Artificial Sequence
  chemically synthesized
ggcaagtacatataatacca

SEQ ID NO: 420192 - DNA, 20 bp, Artificial Sequence
  chemically synthesized
tatctagaagagacacaggc

SEQ ID NO: 420193 - DNA, 20 bp, Artificial Sequence
  chemically synthesized
cccatatctagaagagacac

SEQ ID NO: 420194 - DNA, 20 bp, Artificial Sequence
  chemically synthesized
ccccatatctagaagagaca

SEQ ID NO: 420195 - DNA, 20 bp, Artificial Sequence
  chemically synthesized
gtacttgcctgtgtctcttc

SEQ ID NO: 420196 - DNA, 20 bp, Artificial Sequence
  chemically synthesized
taaggaccccatatctagaa

SEQ ID NO: 420197 - DNA, 20 bp, Artificial Sequence
  chemically synthesized
gcctgtgtctcttctagata

SEQ ID NO: 420198 - DNA, 20 bp, Artificial Sequence
  chemically synthesized
gttaaggaccccatatctag

SEQ ID NO: 420199 - DNA, 20 bp, Artificial Sequence
  chemically synthesized
cctgtgtctcttctagatat

SEQ ID NO: 420200 - DNA, 20 bp, Artificial Sequence
  chemically synthesized
ctgtgtctcttctagatatg

SEQ ID NO: 420201 - DNA, 20 bp, Artificial Sequence
  chemically synthesized
atagttaaggaccccatatc

SEQ ID NO: 420202 - DNA, 20 bp, Artificial Sequence
  chemically synthesized
ccatagcacaaaaatagtta

SEQ ID NO: 420203 - DNA, 20 bp, Artificial Sequence
  chemically synthesized
tccatagcacaaaaatagtt

SEQ ID NO: 420204 - DNA, 20 bp, Artificial Sequence
  chemically synthesized
agggatccatagcacaaaaa

SEQ ID NO: 420205 - DNA, 20 bp, Artificial Sequence
  chemically synthesized
ccttaactatttttgtgcta

SEQ ID NO: 420206 - DNA, 20 bp, Artificial Sequence
  chemically synthesized
ccagatgccaaagggatcca

SEQ ID NO: 420207 - DNA, 20 bp, Artificial Sequence
  chemically synthesized
ttttgtgctatggatccctt

SEQ ID NO: 420208 - DNA, 20 bp, Artificial Sequence
  chemically synthesized
atgcttcaccagatgccaaa

SEQ ID NO: 420209 - DNA, 20 bp, Artificial Sequence
  chemically synthesized
tatgcttcaccagatgccaa

SEQ ID NO: 420210 - DNA, 20 bp, Artificial Sequence
  chemically synthesized
ctatggatccctttggcatc

SEQ ID NO: 420211 - DNA, 20 bp, Artificial Sequence
  chemically synthesized
atatgcttcaccagatgcca

SEQ ID NO: 420212 - DNA, 20 bp, Artificial Sequence
  chemically synthesized
gatccctttggcatctggtg

SEQ ID NO: 420213 - DNA, 20 bp, Artificial Sequence
  chemically synthesized
aagtgttccatatgcttcac

SEQ ID NO: 420214 - DNA, 20 bp, Artificial Sequence
  chemically synthesized
ttggcatctggtgaagcata

SEQ ID NO: 420215 - DNA, 20 bp, Artificial Sequence
  chemically synthesized
gaagcatatggaacacttcc

SEQ ID NO: 420216 - DNA, 20 bp, Artificial Sequence
  chemically synthesized
acatttgaaaacagtctggg

SEQ ID NO: 420217 - DNA, 20 bp, Artificial Sequence
  chemically synthesized
tgcacatttgaaaacagtct

SEQ ID NO: 420218 - DNA, 20 bp, Artificial Sequence
  chemically synthesized
ttgcacatttgaaaacagtc

SEQ ID NO: 420219 - DNA, 20 bp, Artificial Sequence
  chemically synthesized
tcattttgcacatttgaaaa

SEQ ID NO: 420220 - DNA, 20 bp, Artificial Sequence
  chemically synthesized
atgtgcaaaatgaaaactaa

SEQ ID NO: 420221 - DNA, 20 bp, Artificial Sequence
  chemically synthesized
ctttgttttttatatgcttt

SEQ ID NO: 420222 - DNA, 20 bp, Artificial Sequence
  chemically synthesized
ctaaaagcatataaaaaaca

SEQ ID NO: 420223 - DNA, 20 bp, Artificial Sequence
  chemically synthesized
taaaagcatataaaaaacaa

SEQ ID NO: 420224 - DNA, 20 bp, Artificial Sequence
  chemically synthesized
gcatataatagtattatatt

SEQ ID NO: 420225 - DNA, 20 bp, Artificial Sequence
  chemically synthesized
aatgtattaatagcatataa

SEQ ID NO: 420226 - DNA, 20 bp, Artificial Sequence
  chemically synthesized
gcttataactaatgtattaa

SEQ ID NO: 420227 - DNA, 20 bp, Artificial Sequence
  chemically synthesized
attatatgctattaatacat

SEQ ID NO: 420228 - DNA, 20 bp, Artificial Sequence
  chemically synthesized
gctattaatacattagttat

SEQ ID NO: 420229 - DNA, 20 bp, Artificial Sequence
  chemically synthesized
taataattaatacaaattaa

SEQ ID NO: 420230 - DNA, 20 bp, Artificial Sequence
  chemically synthesized
taattaatacaaattaaaag

SEQ ID NO: 420231 - DNA, 20 bp, Artificial Sequence
  chemically synthesized
tacaaattaaaagtagtgat

SEQ ID NO: 420232 - DNA, 20 bp, Artificial Sequence
  chemically synthesized
gtgattagtatactaaccac

SEQ ID NO: 420233 - DNA, 20 bp, Artificial Sequence
  chemically synthesized
tgttaatatataccagtggt

SEQ ID NO: 420234 - DNA, 20 bp, Artificial Sequence
  chemically synthesized
catatgttaatatataccag

SEQ ID NO: 420235 - DNA, 20 bp, Artificial Sequence
  chemically synthesized
aatcatatgttaatatatac

SEQ ID NO: 420236 - DNA, 20 bp, Artificial Sequence
  chemically synthesized
atattaacatatgatttttc

SEQ ID NO: 420237 - DNA, 20 bp, Artificial Sequence
  chemically synthesized
ttcaagatatccaaaacaac

SEQ ID NO: 420238 - DNA, 20 bp, Artificial Sequence
  chemically synthesized
atatcaaatcctagttgttt

SEQ ID NO: 420239 - DNA, 20 bp, Artificial Sequence
  chemically synthesized
tcaagatatccaaaacaact

SEQ ID NO: 420240 - DNA, 20 bp, Artificial Sequence
  chemically synthesized
aatatttttatatcaaatcc

SEQ ID NO: 420241 - DNA, 20 bp, Artificial Sequence
  chemically synthesized
aggatttgatataaaaatat

SEQ ID NO: 420242 - DNA, 20 bp, Artificial Sequence
  chemically synthesized
aaatattggtaataaattca

SEQ ID NO: 420243 - DNA, 20 bp, Artificial Sequence
  chemically synthesized
taagcaacacagaacggtat

SEQ ID NO: 420244 - DNA, 20 bp, Artificial Sequence
  chemically synthesized
tgaagataagcaacacagaa

SEQ ID NO: 420245 - DNA, 20 bp, Artificial Sequence
  chemically synthesized
ctttatgaagataagcaaca

SEQ ID NO: 420246 - DNA, 20 bp, Artificial Sequence
  chemically synthesized
ttctttccctttatgaagat

SEQ ID NO: 420247 - DNA, 20 bp, Artificial Sequence
  chemically synthesized
ctgtgttgcttatcttcata

SEQ ID NO: 420248 - DNA, 20 bp, Artificial Sequence
  chemically synthesized
tgtgttgcttatcttcataa

SEQ ID NO: 420249 - DNA, 20 bp, Artificial Sequence
  chemically synthesized
gtgttgcttatcttcataaa

SEQ ID NO: 420250 - DNA, 20 bp, Artificial Sequence
  chemically synthesized
tgcatttctttccctttatg

SEQ ID NO: 420251 - DNA, 20 bp, Artificial Sequence
  chemically synthesized
tgcttatcttcataaaggga

SEQ ID NO: 420252 - DNA, 20 bp, Artificial Sequence
  chemically synthesized
gggaaagaaatgcaaatttt

SEQ ID NO: 420253 - DNA, 20 bp, Artificial Sequence
  chemically synthesized
gaaatgcaaattttcagtta

SEQ ID NO: 420254 - DNA, 20 bp, Artificial Sequence
  chemically synthesized
aaatgcaaattttcagttac

SEQ ID NO: 420255 - DNA, 20 bp, Artificial Sequence
  chemically synthesized
gcaaattttcagttacaggt

SEQ ID NO: 420256 - DNA, 20 bp, Artificial Sequence
  chemically synthesized
gttacaggttagtgaaaata

SEQ ID NO: 420257 - DNA, 20 bp, Artificial Sequence
  chemically synthesized
atgtaatttttttcctatca

SEQ ID NO: 420258 - DNA, 20 bp, Artificial Sequence
  chemically synthesized
tggggtccatgaaccatgat

SEQ ID NO: 420259 - DNA, 20 bp, Artificial Sequence
  chemically synthesized
ctggggtccatgaaccatga

SEQ ID NO: 420260 - DNA, 20 bp, Artificial Sequence
  chemically synthesized
ttttttcctatcatggttca

SEQ ID NO: 420261 - DNA, 20 bp, Artificial Sequence
  chemically synthesized
ctatcatggttcatggaccc

SEQ ID NO: 420262 - DNA, 20 bp, Artificial Sequence
  chemically synthesized
tggttcatggaccccagatt

SEQ ID NO: 420263 - DNA, 20 bp, Artificial Sequence
  chemically synthesized
ggttcatggaccccagatta

SEQ ID NO: 420264 - DNA, 20 bp, Artificial Sequence
  chemically synthesized
aatacagtgtccttaatctg

SEQ ID NO: 420265 - DNA, 20 bp, Artificial Sequence
  chemically synthesized
aaatacagtgtccttaatct

SEQ ID NO: 420266 - DNA, 20 bp, Artificial Sequence
  chemically synthesized
aaaatacagtgtccttaatc

SEQ ID NO: 420267 - DNA, 20 bp, Artificial Sequence
  chemically synthesized
gaagccatacagtcaaaata

SEQ ID NO: 420268 - DNA, 20 bp, Artificial Sequence
  chemically synthesized
gacactgtattttgactgta

SEQ ID NO: 420269 - DNA, 20 bp, Artificial Sequence
  chemically synthesized
actctgcccttgaagccata

SEQ ID NO: 420270 - DNA, 20 bp, Artificial Sequence
  chemically synthesized
tattttgactgtatggcttc

SEQ ID NO: 420271 - DNA, 20 bp, Artificial Sequence
  chemically synthesized
attttgactgtatggcttca

SEQ ID NO: 420272 - DNA, 20 bp, Artificial Sequence
  chemically synthesized
ttttgactgtatggcttcaa

SEQ ID NO: 420273 - DNA, 20 bp, Artificial Sequence
  chemically synthesized
tgactgtatggcttcaaggg

SEQ ID NO: 420274 - DNA, 20 bp, Artificial Sequence
  chemically synthesized
aaataaaaactctgcccttg

SEQ ID NO: 420275 - DNA, 20 bp, Artificial Sequence
  chemically synthesized
actgtatggcttcaagggca

SEQ ID NO: 420276 - DNA, 20 bp, Artificial Sequence
  chemically synthesized
tgttctgtactaaagacaca

SEQ ID NO: 420277 - DNA, 20 bp, Artificial Sequence
  chemically synthesized
tttgttcatctttgtgtctt

SEQ ID NO: 420278 - DNA, 20 bp, Artificial Sequence
  chemically synthesized
tcatctttgtgtctttagta

SEQ ID NO: 420279 - DNA, 20 bp, Artificial Sequence
  chemically synthesized
catggttctgttctgtacta

SEQ ID NO: 420280 - DNA, 20 bp, Artificial Sequence
  chemically synthesized
tttgtgtctttagtacagaa

SEQ ID NO: 420281 - DNA, 20 bp, Artificial Sequence
  chemically synthesized
tttagtacagaacagaacca

SEQ ID NO: 420282 - DNA, 20 bp, Artificial Sequence
  chemically synthesized
ttagtacagaacagaaccat

SEQ ID NO: 420283 - DNA, 20 bp, Artificial Sequence
  chemically synthesized
ataggcttggattgtgccca

SEQ ID NO: 420284 - DNA, 20 bp, Artificial Sequence
  chemically synthesized
cagaaccatgggcacaatcc

SEQ ID NO: 420285 - DNA, 20 bp, Artificial Sequence
  chemically synthesized
cggccaccattcaataggct

SEQ ID NO: 420286 - DNA, 20 bp, Artificial Sequence
  chemically synthesized
cacaatccaagcctattgaa

SEQ ID NO: 420287 - DNA, 20 bp, Artificial Sequence
  chemically synthesized
caattcggccaccattcaat

SEQ ID NO: 420288 - DNA, 20 bp, Artificial Sequence
  chemically synthesized
acaattcggccaccattcaa

SEQ ID NO: 420289 - DNA, 20 bp, Artificial Sequence
  chemically synthesized
aatccaagcctattgaatgg

SEQ ID NO: 420290 - DNA, 20 bp, Artificial Sequence
  chemically synthesized
tgaacgttcaatacacaatt

SEQ ID NO: 420291 - DNA, 20 bp, Artificial Sequence
  chemically synthesized
tgtattgaacgttcaaatgt

SEQ ID NO: 420292 - DNA, 20 bp, Artificial Sequence
  chemically synthesized
tgatgtgataagggcagtga

SEQ ID NO: 420293 - DNA, 20 bp, Artificial Sequence
  chemically synthesized
ctcttgtgatgtgataaggg

SEQ ID NO: 420294 - DNA, 20 bp, Artificial Sequence
  chemically synthesized
tctctcttgtgatgtgataa

SEQ ID NO: 420295 - DNA, 20 bp, Artificial Sequence
  chemically synthesized
ttctctcttgtgatgtgata

SEQ ID NO: 420296 - DNA, 20 bp, Artificial Sequence
  chemically synthesized
tttctctcttgtgatgtgat

SEQ ID NO: 420297 - DNA, 20 bp, Artificial Sequence
  chemically synthesized
cactgcccttatcacatcac

SEQ ID NO: 420298 - DNA, 20 bp, Artificial Sequence
  chemically synthesized
ctgcccttatcacatcacaa

SEQ ID NO: 420299 - DNA, 20 bp, Artificial Sequence
  chemically synthesized
gcccttatcacatcacaaga

SEQ ID NO: 420300 - DNA, 20 bp, Artificial Sequence
  chemically synthesized
atacccattgacaagtttat

SEQ ID NO: 420301 - DNA, 20 bp, Artificial Sequence
  chemically synthesized
aaatctgataaacttgtcaa

SEQ ID NO: 420302 - DNA, 20 bp, Artificial Sequence
  chemically synthesized
aatctgataaacttgtcaat

SEQ ID NO: 420303 - DNA, 20 bp, Artificial Sequence
  chemically synthesized
cacgtatcatacccattgac

SEQ ID NO: 420304 - DNA, 20 bp, Artificial Sequence
  chemically synthesized
ttgtcaatgggtatgatacg

SEQ ID NO: 420305 - DNA, 20 bp, Artificial Sequence
  chemically synthesized
tataagcaaaagaatataca

SEQ ID NO: 420306 - DNA, 20 bp, Artificial Sequence
  chemically synthesized
aagcatctgtgtataagcaa

SEQ ID NO: 420307 - DNA, 20 bp, Artificial Sequence
  chemically synthesized
tatattcttttgcttataca

SEQ ID NO: 420308 - DNA, 20 bp, Artificial Sequence
  chemically synthesized
attttcaagcatctgtgtat

SEQ ID NO: 420309 - DNA, 20 bp, Artificial Sequence
  chemically synthesized
gctttttaattttaattttc

SEQ ID NO: 420310 - DNA, 20 bp, Artificial Sequence
  chemically synthesized
gcttgaaaattaaaattaaa

SEQ ID NO: 420311 - DNA, 20 bp, Artificial Sequence
  chemically synthesized
tgctgagtgcttagttgcag

SEQ ID NO: 420312 - DNA, 20 bp, Artificial Sequence
  chemically synthesized
attaaaaagctactgcaact

SEQ ID NO: 420313 - DNA, 20 bp, Artificial Sequence
  chemically synthesized
aattgctgagtgcttagttg

SEQ ID NO: 420314 - DNA, 20 bp, Artificial Sequence
  chemically synthesized
agctactgcaactaagcact

SEQ ID NO: 420315 - DNA, 20 bp, Artificial Sequence
  chemically synthesized
tatgacaattgctgagtgct

SEQ ID NO: 420316 - DNA, 20 bp, Artificial Sequence
  chemically synthesized
agaaaaatatgacaattgct

SEQ ID NO: 420317 - DNA, 20 bp, Artificial Sequence
  chemically synthesized
tattgacttagggaaaagtg

SEQ ID NO: 420318 - DNA, 20 bp, Artificial Sequence
  chemically synthesized
cctattgacttagggaaaag

SEQ ID NO: 420319 - DNA, 20 bp, Artificial Sequence
  chemically synthesized
atttttctccacttttccct

SEQ ID NO: 420320 - DNA, 20 bp, Artificial Sequence
  chemically synthesized
ttgcctattgacttagggaa

SEQ ID NO: 420321 - DNA, 20 bp, Artificial Sequence
  chemically synthesized
catggttgcctattgactta

SEQ ID NO: 420322 - DNA, 20 bp, Artificial Sequence
  chemically synthesized
tccacttttccctaagtcaa

SEQ ID NO: 420323 - DNA, 20 bp, Artificial Sequence
  chemically synthesized
tcatggttgcctattgactt

SEQ ID NO: 420324 - DNA, 20 bp, Artificial Sequence
  chemically synthesized
ccacttttccctaagtcaat

SEQ ID NO: 420325 - DNA, 20 bp, Artificial Sequence
  chemically synthesized
ttcatggttgcctattgact

SEQ ID NO: 420326 - DNA, 20 bp, Artificial Sequence
  chemically synthesized
taagtcaataggcaaccatg

SEQ ID NO: 420327 - DNA, 20 bp, Artificial Sequence
  chemically synthesized
cagcaacattgtcaacttca

SEQ ID NO: 420328 - DNA, 20 bp, Artificial Sequence
  chemically synthesized
gttgagtatgacaatgttat

SEQ ID NO: 420329 - DNA, 20 bp, Artificial Sequence
  chemically synthesized
gctttgtgggaaatgatgtt

SEQ ID NO: 420330 - DNA, 20 bp, Artificial Sequence
  chemically synthesized
actcaacatcatttcccaca

SEQ ID NO: 420331 - DNA, 20 bp, Artificial Sequence
  chemically synthesized
tgtagaggtttaagctttgt

SEQ ID NO: 420332 - DNA, 20 bp, Artificial Sequence
  chemically synthesized
ctgtagaggtttaagctttg

SEQ ID NO: 420333 - DNA, 20 bp, Artificial Sequence
  chemically synthesized
ctgagtttctgtagaggttt

SEQ ID NO: 420334 - DNA, 20 bp, Artificial Sequence
  chemically synthesized
ccacaaagcttaaacctcta

SEQ ID NO: 420335 - DNA, 20 bp, Artificial Sequence
  chemically synthesized
ggactgctgagtttctgtag

SEQ ID NO: 420336 - DNA, 20 bp, Artificial Sequence
  chemically synthesized
gggactgctgagtttctgta

SEQ ID NO: 420337 - DNA, 20 bp, Artificial Sequence
  chemically synthesized
tagggactgctgagtttctg

SEQ ID NO: 420338 - DNA, 20 bp, Artificial Sequence
  chemically synthesized
cttaaacctctacagaaact

SEQ ID NO: 420339 - DNA, 20 bp, Artificial Sequence
  chemically synthesized
aaacctctacagaaactcag

SEQ ID NO: 420340 - DNA, 20 bp, Artificial Sequence
  chemically synthesized
gatgtgttgtagggactgct

SEQ ID NO: 420341 - DNA, 20 bp, Artificial Sequence
  chemically synthesized
ttcttcaaggatgtgttgta

SEQ ID NO: 420342 - DNA, 20 bp, Artificial Sequence
  chemically synthesized
attcttcaaggatgtgttgt

SEQ ID NO: 420343 - DNA, 20 bp, Artificial Sequence
  chemically synthesized
cattcttcaaggatgtgttg

SEQ ID NO: 420344 - DNA, 20 bp, Artificial Sequence
  chemically synthesized
gtccctacaacacatccttg

SEQ ID NO: 420345 - DNA, 20 bp, Artificial Sequence
  chemically synthesized
gacacccctctcattcttca

SEQ ID NO: 420346 - DNA, 20 bp, Artificial Sequence
  chemically synthesized
acaacacatccttgaagaat

SEQ ID NO: 420347 - DNA, 20 bp, Artificial Sequence
  chemically synthesized
tgacacccctctcattcttc

SEQ ID NO: 420348 - DNA, 20 bp, Artificial Sequence
  chemically synthesized
aacacatccttgaagaatga

SEQ ID NO: 420349 - DNA, 20 bp, Artificial Sequence
  chemically synthesized
acacatccttgaagaatgag

SEQ ID NO: 420350 - DNA, 20 bp, Artificial Sequence
  chemically synthesized
cacatccttgaagaatgaga

SEQ ID NO: 420351 - DNA, 20 bp, Artificial Sequence
  chemically synthesized
acatccttgaagaatgagag

SEQ ID NO: 420352 - DNA, 20 bp, Artificial Sequence
  chemically synthesized
gagaggggtgtcaataattt

SEQ ID NO: 420353 - DNA, 20 bp, Artificial Sequence
  chemically synthesized
aataatttcagctgctcaaa

SEQ ID NO: 420354 - DNA, 20 bp, Artificial Sequence
  chemically synthesized
gtcagagccttccatttgag

SEQ ID NO: 420355 - DNA, 20 bp, Artificial Sequence
  chemically synthesized
aatttcagctgctcaaatgg

SEQ ID NO: 420356 - DNA, 20 bp, Artificial Sequence
  chemically synthesized
atttcagctgctcaaatgga

SEQ ID NO: 420357 - DNA, 20 bp, Artificial Sequence
  chemically synthesized
gatgtcagagccttccattt

SEQ ID NO: 420358 - DNA, 20 bp, Artificial Sequence
  chemically synthesized
aaatggaaggctctgacatc

SEQ ID NO: 420359 - DNA, 20 bp, Artificial Sequence
  chemically synthesized
cttaatattccttgatgtca

SEQ ID NO: 420360 - DNA, 20 bp, Artificial Sequence
  chemically synthesized
aatggaaggctctgacatca

SEQ ID NO: 420361 - DNA, 20 bp, Artificial Sequence
  chemically synthesized
cacttaatattccttgatgt

SEQ ID NO: 420362 - DNA, 20 bp, Artificial Sequence
  chemically synthesized
ctctgacatcaaggaatatt

SEQ ID NO: 420363 - DNA, 20 bp, Artificial Sequence
  chemically synthesized
tgacatcaaggaatattaag

SEQ ID NO: 420364 - DNA, 20 bp, Artificial Sequence
  chemically synthesized
gaatattaagtggcacattg

SEQ ID NO: 420365 - DNA, 20 bp, Artificial Sequence
  chemically synthesized
aatattaagtggcacattga

SEQ ID NO: 420366 - DNA, 20 bp, Artificial Sequence
  chemically synthesized
atattaagtggcacattgaa

SEQ ID NO: 420367 - DNA, 20 bp, Artificial Sequence
  chemically synthesized
ttgaagggaattctactatt

SEQ ID NO: 420368 - DNA, 20 bp, Artificial Sequence
  chemically synthesized
tcaccttcattacttaatag

SEQ ID NO: 420369 - DNA, 20 bp, Artificial Sequence
  chemically synthesized
tcctcaccttcattacttaa

SEQ ID NO: 420370 - DNA, 20 bp, Artificial Sequence
  chemically synthesized
aattctactattaagtaatg

SEQ ID NO: 420371 - DNA, 20 bp, Artificial Sequence
  chemically synthesized
attctactattaagtaatga

SEQ ID NO: 420372 - DNA, 20 bp, Artificial Sequence
  chemically synthesized
tactattaagtaatgaaggt

SEQ ID NO: 420373 - DNA, 20 bp, Artificial Sequence
  chemically synthesized
actattaagtaatgaaggtg

SEQ ID NO: 420374 - DNA, 20 bp, Artificial Sequence
  chemically synthesized
gaaaacaatttctcaatcca

SEQ ID NO: 420375 - DNA, 20 bp, Artificial Sequence
  chemically synthesized
caaagaaataaccgtggatt

SEQ ID NO: 420376 - DNA, 20 bp, Artificial Sequence
  chemically synthesized
gtataacaaagaaataaccg

SEQ ID NO: 420377 - DNA, 20 bp, Artificial Sequence
  chemically synthesized
gcacggttcttagtataaca

SEQ ID NO: 420378 - DNA, 20 bp, Artificial Sequence
  chemically synthesized
ggttatttctttgttatact

SEQ ID NO: 420379 - DNA, 20 bp, Artificial Sequence
  chemically synthesized
taagtattgggcacggttct

SEQ ID NO: 420380 - DNA, 20 bp, Artificial Sequence
  chemically synthesized
tgttccataagtattgggca

SEQ ID NO: 420381 - DNA, 20 bp, Artificial Sequence
  chemically synthesized
tattttgttccataagtatt

SEQ ID NO: 420382 - DNA, 20 bp, Artificial Sequence
  chemically synthesized
agaaccgtgcccaatactta

SEQ ID NO: 420383 - DNA, 20 bp, Artificial Sequence
  chemically synthesized
ttattttgttccataagtat

SEQ ID NO: 420384 - DNA, 20 bp, Artificial Sequence
  chemically synthesized
ataggcttattttgttccat

SEQ ID NO: 420385 - DNA, 20 bp, Artificial Sequence
  chemically synthesized
caatacttatggaacaaaat

SEQ ID NO: 420386 - DNA, 20 bp, Artificial Sequence
  chemically synthesized
aacaaaataagcctatcatt

SEQ ID NO: 420387 - DNA, 20 bp, Artificial Sequence
  chemically synthesized
ataggagacgtccaaatgat

SEQ ID NO: 420388 - DNA, 20 bp, Artificial Sequence
  chemically synthesized
gataggagacgtccaaatga

SEQ ID NO: 420389 - DNA, 20 bp, Artificial Sequence
  chemically synthesized
atcatttggacgtctcctat

SEQ ID NO: 420390 - DNA, 20 bp, Artificial Sequence
  chemically synthesized
atcaggcttcaggctgatag

SEQ ID NO: 420391 - DNA, 20 bp, Artificial Sequence
  chemically synthesized
acatcaggcttcaggctgat

SEQ ID NO: 420392 - DNA, 20 bp, Artificial Sequence
  chemically synthesized
gacatcaggcttcaggctga

SEQ ID NO: 420393 - DNA, 20 bp, Artificial Sequence
  chemically synthesized
ggacgtctcctatcagcctg

SEQ ID NO: 420394 - DNA, 20 bp, Artificial Sequence
  chemically synthesized
tttatatgacatcaggcttc

SEQ ID NO: 420395 - DNA, 20 bp, Artificial Sequence
  chemically synthesized
gtttatatgacatcaggctt

SEQ ID NO: 420396 - DNA, 20 bp, Artificial Sequence
  chemically synthesized
ttattggtttatatgacatc

SEQ ID NO: 420397 - DNA, 20 bp, Artificial Sequence
  chemically synthesized
attattggtttatatgacat

SEQ ID NO: 420398 - DNA, 20 bp, Artificial Sequence
  chemically synthesized
aaaattcaatcacagattat

SEQ ID NO: 420399 - DNA, 20 bp, Artificial Sequence
  chemically synthesized
aaagctgaaaaattcaatca

SEQ ID NO: 420400 - DNA, 20 bp, Artificial Sequence
  chemically synthesized
taatctgtgattgaattttt

SEQ ID NO: 420401 - DNA, 20 bp, Artificial Sequence
  chemically synthesized
tgattgaatttttcagcttt

SEQ ID NO: 420402 - DNA, 20 bp, Artificial Sequence
  chemically synthesized
tgctaaaaataaaacactga

SEQ ID NO: 420403 - DNA, 20 bp, Artificial Sequence
  chemically synthesized
agctttcagtgttttatttt

SEQ ID NO: 420404 - DNA, 20 bp, Artificial Sequence
  chemically synthesized
tttatttttagcataatatt

SEQ ID NO: 420405 - DNA, 20 bp, Artificial Sequence
  chemically synthesized
acagaataataagtcacgta

SEQ ID NO: 420406 - DNA, 20 bp, Artificial Sequence
  chemically synthesized
attaaattgaacagaataat

SEQ ID NO: 420407 - DNA, 20 bp, Artificial Sequence
  chemically synthesized
tctaatttgattaaattgaa

SEQ ID NO: 420408 - DNA, 20 bp, Artificial Sequence
  chemically synthesized
tctgttcaatttaatcaaat

SEQ ID NO: 420409 - DNA, 20 bp, Artificial Sequence
  chemically synthesized
tgttcaatttaatcaaatta

SEQ ID NO: 420410 - DNA, 20 bp, Artificial Sequence
  chemically synthesized
aaaacacacacgcacattaa

SEQ ID NO: 420411 - DNA, 20 bp, Artificial Sequence
  chemically synthesized
gaaaaacacacacgcacatt

SEQ ID NO: 420412 - DNA, 20 bp, Artificial Sequence
  chemically synthesized
cgtgtgtgtttttctttttt

SEQ ID NO: 420413 - DNA, 20 bp, Artificial Sequence
  chemically synthesized
aatgaaacttcgtctcaaaa

SEQ ID NO: 420414 - DNA, 20 bp, Artificial Sequence
  chemically synthesized
tgtttttcttttttgagacg

SEQ ID NO: 420415 - DNA, 20 bp, Artificial Sequence
  chemically synthesized
gaagtttcattcttgttgcc

SEQ ID NO: 420416 - DNA, 20 bp, Artificial Sequence
  chemically synthesized
aagtttcattcttgttgccc

SEQ ID NO: 420417 - DNA, 20 bp, Artificial Sequence
  chemically synthesized
tcgaatcgagcctgggcaac

SEQ ID NO: 420418 - DNA, 20 bp, Artificial Sequence
  chemically synthesized
atcgcactcgaatcgagcct

SEQ ID NO: 420419 - DNA, 20 bp, Artificial Sequence
  chemically synthesized
catcgcactcgaatcgagcc

SEQ ID NO: 420420 - DNA, 20 bp, Artificial Sequence
  chemically synthesized
ttgttgcccaggctcgattc

SEQ ID NO: 420421 - DNA, 20 bp, Artificial Sequence
  chemically synthesized
tatgccatcgcactcgaatc

SEQ ID NO: 420422 - DNA, 20 bp, Artificial Sequence
  chemically synthesized
caggctcgattcgagtgcga

SEQ ID NO: 420423 - DNA, 20 bp, Artificial Sequence
  chemically synthesized
tcgattcgagtgcgatggca

SEQ ID NO: 420424 - DNA, 20 bp, Artificial Sequence
  chemically synthesized
cgagtgcgatggcatagtgt

SEQ ID NO: 420425 - DNA, 20 bp, Artificial Sequence
  chemically synthesized
ccagaggcagaggttgcagt

SEQ ID NO: 420426 - DNA, 20 bp, Artificial Sequence
  chemically synthesized
aaccccagaggcagaggttg

SEQ ID NO: 420427 - DNA, 20 bp, Artificial Sequence
  chemically synthesized
ctcactgcaacctctgcctc

SEQ ID NO: 420428 - DNA, 20 bp, Artificial Sequence
  chemically synthesized
cccttgaaccccagaggcag

SEQ ID NO: 420429 - DNA, 20 bp, Artificial Sequence
  chemically synthesized
tcactgcaacctctgcctct

SEQ ID NO: 420430 - DNA, 20 bp, Artificial Sequence
  chemically synthesized
tcccttgaaccccagaggca

SEQ ID NO: 420431 - DNA, 20 bp, Artificial Sequence
  chemically synthesized
cactgcaacctctgcctctg

SEQ ID NO: 420432 - DNA, 20 bp, Artificial Sequence
  chemically synthesized
aatcccttgaaccccagagg

SEQ ID NO: 420433 - DNA, 20 bp, Artificial Sequence
  chemically synthesized
gagaatcccttgaaccccag

SEQ ID NO: 420434 - DNA, 20 bp, Artificial Sequence
  chemically synthesized
ggagaatcccttgaacccca

SEQ ID NO: 420435 - DNA, 20 bp, Artificial Sequence
  chemically synthesized
aacctctgcctctggggttc

SEQ ID NO: 420436 - DNA, 20 bp, Artificial Sequence
  chemically synthesized
acctctgcctctggggttca

SEQ ID NO: 420437 - DNA, 20 bp, Artificial Sequence
  chemically synthesized
caggagaatcccttgaaccc

SEQ ID NO: 420438 - DNA, 20 bp, Artificial Sequence
  chemically synthesized
cctctgcctctggggttcaa

SEQ ID NO: 420439 - DNA, 20 bp, Artificial Sequence
  chemically synthesized
ttcaagggattctcctgact

SEQ ID NO: 420440 - DNA, 20 bp, Artificial Sequence
  chemically synthesized
tacttgggaggctgagtcag

SEQ ID NO: 420441 - DNA, 20 bp, Artificial Sequence
  chemically synthesized
gttacttgggaggctgagtc

SEQ ID NO: 420442 - DNA, 20 bp, Artificial Sequence
  chemically synthesized
agttacttgggaggctgagt

SEQ ID NO: 420443 - DNA, 20 bp, Artificial Sequence
  chemically synthesized
tcccagttacttgggaggct

SEQ ID NO: 420444 - DNA, 20 bp, Artificial Sequence
  chemically synthesized
ttctcctgactcagcctccc

SEQ ID NO: 420445 - DNA, 20 bp, Artificial Sequence
  chemically synthesized
tgtaatcccagttacttggg

SEQ ID NO: 420446 - DNA, 20 bp, Artificial Sequence
  chemically synthesized
ctgtaatcccagttacttgg

SEQ ID NO: 420447 - DNA, 20 bp, Artificial Sequence
  chemically synthesized
gactcagcctcccaagtaac

SEQ ID NO: 420448 - DNA, 20 bp, Artificial Sequence
  chemically synthesized
acctgtaatcccagttactt

SEQ ID NO: 420449 - DNA, 20 bp, Artificial Sequence
  chemically synthesized
actcagcctcccaagtaact

SEQ ID NO: 420450 - DNA, 20 bp, Artificial Sequence
  chemically synthesized
cacctgtaatcccagttact

SEQ ID NO: 420451 - DNA, 20 bp, Artificial Sequence
  chemically synthesized
ctcccaagtaactgggatta

SEQ ID NO: 420452 - DNA, 20 bp, Artificial Sequence
  chemically synthesized
tcccaagtaactgggattac

SEQ ID NO: 420453 - DNA, 20 bp, Artificial Sequence
  chemically synthesized
gtggcaggcacctgtaatcc

SEQ ID NO: 420454 - DNA, 20 bp, Artificial Sequence
  chemically synthesized
aatcagccgggcgtggtggc

SEQ ID NO: 420455 - DNA, 20 bp, Artificial Sequence
  chemically synthesized
aaatcagccgggcgtggtgg

SEQ ID NO: 420456 - DNA, 20 bp, Artificial Sequence
  chemically synthesized
caggtgcctgccaccacgcc

SEQ ID NO: 420457 - DNA, 20 bp, Artificial Sequence
  chemically synthesized
aaaaaatcagccgggcgtgg

SEQ ID NO: 420458 - DNA, 20 bp, Artificial Sequence
  chemically synthesized
gaaaaaaaatcagccgggcg

SEQ ID NO: 420459 - DNA, 20 bp, Artificial Sequence
  chemically synthesized
aaatagaaaaaaaatcagcc

SEQ ID NO: 420460 - DNA, 20 bp, Artificial Sequence
  chemically synthesized
aaaatagaaaaaaaatcagc

SEQ ID NO: 420461 - DNA, 20 bp, Artificial Sequence
  chemically synthesized
actaaaaatagaaaaaaaat

SEQ ID NO: 420462 - DNA, 20 bp, Artificial Sequence
  chemically synthesized
gctgattttttttctatttt

SEQ ID NO: 420463 - DNA, 20 bp, Artificial Sequence
  chemically synthesized
gattttttttctatttttag

SEQ ID NO: 420464 - DNA, 20 bp, Artificial Sequence
  chemically synthesized
accccggtctctactaaaaa

SEQ ID NO: 420465 - DNA, 20 bp, Artificial Sequence
  chemically synthesized
ttttttttctatttttagta

SEQ ID NO: 420466 - DNA, 20 bp, Artificial Sequence
  chemically synthesized
tttctatttttagtagagac

SEQ ID NO: 420467 - DNA, 20 bp, Artificial Sequence
  chemically synthesized
ttctatttttagtagagacc

SEQ ID NO: 420468 - DNA, 20 bp, Artificial Sequence
  chemically synthesized
tctatttttagtagagaccg

SEQ ID NO: 420469 - DNA, 20 bp, Artificial Sequence
  chemically synthesized
tggccaacatggtgaaaccc

SEQ ID NO: 420470 - DNA, 20 bp, Artificial Sequence
  chemically synthesized
agaccggggtttcaccatgt

SEQ ID NO: 420471 - DNA, 20 bp, Artificial Sequence
  chemically synthesized
cggggtttcaccatgttggc

SEQ ID NO: 420472 - DNA, 20 bp, Artificial Sequence
  chemically synthesized
tgagaccagcctggccaaca

SEQ ID NO: 420473 - DNA, 20 bp, Artificial Sequence
  chemically synthesized
ggggtttcaccatgttggcc

SEQ ID NO: 420474 - DNA, 20 bp, Artificial Sequence
  chemically synthesized
tttcaccatgttggccaggc

SEQ ID NO: 420475 - DNA, 20 bp, Artificial Sequence
  chemically synthesized
tcaggagtttgagaccagcc

SEQ ID NO: 420476 - DNA, 20 bp, Artificial Sequence
  chemically synthesized
tgaggtcaggagtttgagac

SEQ ID NO: 420477 - DNA, 20 bp, Artificial Sequence
  chemically synthesized
tcacttgaggtcaggagttt

SEQ ID NO: 420478 - DNA, 20 bp, Artificial Sequence
  chemically synthesized
ggtgaatcacttgaggtcag

SEQ ID NO: 420479 - DNA, 20 bp, Artificial Sequence
  chemically synthesized
ggtctcaaactcctgacctc

SEQ ID NO: 420480 - DNA, 20 bp, Artificial Sequence
  chemically synthesized
caggtgaatcacttgaggtc

SEQ ID NO: 420481 - DNA, 20 bp, Artificial Sequence
  chemically synthesized
gcaggtgaatcacttgaggt

SEQ ID NO: 420482 - DNA, 20 bp, Artificial Sequence
  chemically synthesized
cgaggcaggtgaatcacttg

SEQ ID NO: 420483 - DNA, 20 bp, Artificial Sequence
  chemically synthesized
ccgaggcaggtgaatcactt

SEQ ID NO: 420484 - DNA, 20 bp, Artificial Sequence
  chemically synthesized
ctcaagtgattcacctgcct

SEQ ID NO: 420485 - DNA, 20 bp, Artificial Sequence
  chemically synthesized
gcactttgggaggccgaggc

SEQ ID NO: 420486 - DNA, 20 bp, Artificial Sequence
  chemically synthesized
agcactttgggaggccgagg

SEQ ID NO: 420487 - DNA, 20 bp, Artificial Sequence
  chemically synthesized
cccagcactttgggaggccg

SEQ ID NO: 420488 - DNA, 20 bp, Artificial Sequence
  chemically synthesized
tcccagcactttgggaggcc

SEQ ID NO: 420489 - DNA, 20 bp, Artificial Sequence
  chemically synthesized
tcacctgcctcggcctccca

SEQ ID NO: 420490 - DNA, 20 bp, Artificial Sequence
  chemically synthesized
tgtaatcccagcactttggg

SEQ ID NO: 420491 - DNA, 20 bp, Artificial Sequence
  chemically synthesized
ctgtaatcccagcactttgg

SEQ ID NO: 420492 - DNA, 20 bp, Artificial Sequence
  chemically synthesized
gcctcggcctcccaaagtgc

SEQ ID NO: 420493 - DNA, 20 bp, Artificial Sequence
  chemically synthesized
gcctgtaatcccagcacttt

SEQ ID NO: 420494 - DNA, 20 bp, Artificial Sequence
  chemically synthesized
cctcggcctcccaaagtgct

SEQ ID NO: 420495 - DNA, 20 bp, Artificial Sequence
  chemically synthesized
cgcctgtaatcccagcactt

SEQ ID NO: 420496 - DNA, 20 bp, Artificial Sequence
  chemically synthesized
ctcccaaagtgctgggatta

SEQ ID NO: 420497 - DNA, 20 bp, Artificial Sequence
  chemically synthesized
tcccaaagtgctgggattac

SEQ ID NO: 420498 - DNA, 20 bp, Artificial Sequence
  chemically synthesized
ctggctcacgcctgtaatcc

SEQ ID NO: 420499 - DNA, 20 bp, Artificial Sequence
  chemically synthesized
agtgctgggattacaggcgt

SEQ ID NO: 420500 - DNA, 20 bp, Artificial Sequence
  chemically synthesized
ctgggattacaggcgtgagc

SEQ ID NO: 420501 - DNA, 20 bp, Artificial Sequence
  chemically synthesized
caggcgtgagccagcatgct

SEQ ID NO: 420502 - DNA, 20 bp, Artificial Sequence
  chemically synthesized
acacattaagccaagcatgc

SEQ ID NO: 420503 - DNA, 20 bp, Artificial Sequence
  chemically synthesized
tcattaaaacacattaagcc

SEQ ID NO: 420504 - DNA, 20 bp, Artificial Sequence
  chemically synthesized
ttatgtcattaaaacacatt

SEQ ID NO: 420505 - DNA, 20 bp, Artificial Sequence
  chemically synthesized
taatatagttatatggttgt

SEQ ID NO: 420506 - DNA, 20 bp, Artificial Sequence
  chemically synthesized
tttgtactaatatagttata

SEQ ID NO: 420507 - DNA, 20 bp, Artificial Sequence
  chemically synthesized
caacaaccatataactatat

SEQ ID NO: 420508 - DNA, 20 bp, Artificial Sequence
  chemically synthesized
agttgctttttgtactaata

SEQ ID NO: 420509 - DNA, 20 bp, Artificial Sequence
  chemically synthesized
tataactatattagtacaaa

SEQ ID NO: 420510 - DNA, 20 bp, Artificial Sequence
  chemically synthesized
attgagatttttatttcatg

SEQ ID NO: 420511 - DNA, 20 bp, Artificial Sequence
  chemically synthesized
tatccatttggcaaacaatt

SEQ ID NO: 420512 - DNA, 20 bp, Artificial Sequence
  chemically synthesized
aatctcaattgtttgccaaa

SEQ ID NO: 420513 - DNA, 20 bp, Artificial Sequence
  chemically synthesized
atatattatttgtatccatt

SEQ ID NO: 420514 - DNA, 20 bp, Artificial Sequence
  chemically synthesized
catgcatataataaaataca

SEQ ID NO: 420515 - DNA, 20 bp, Artificial Sequence
  chemically synthesized
gcatataataaaatacacag

SEQ ID NO: 420516 - DNA, 20 bp, Artificial Sequence
  chemically synthesized
ccaaaaccatggataagagg

SEQ ID NO: 420517 - DNA, 20 bp, Artificial Sequence
  chemically synthesized
taaccaaaaccatggataag

SEQ ID NO: 420518 - DNA, 20 bp, Artificial Sequence
  chemically synthesized
agtagtctgcctcttatcca

SEQ ID NO: 420519 - DNA, 20 bp, Artificial Sequence
  chemically synthesized
gtaaccaaaaccatggataa

SEQ ID NO: 420520 - DNA, 20 bp, Artificial Sequence
  chemically synthesized
gggtaaccaaaaccatggat

SEQ ID NO: 420521 - DNA, 20 bp, Artificial Sequence
  chemically synthesized
ctgcctcttatccatggttt

SEQ ID NO: 420522 - DNA, 20 bp, Artificial Sequence
  chemically synthesized
atcatgggtaaccaaaacca

SEQ ID NO: 420523 - DNA, 20 bp, Artificial Sequence
  chemically synthesized
tttggactgcagttgatcat

SEQ ID NO: 420524 - DNA, 20 bp, Artificial Sequence
  chemically synthesized
ttttggactgcagttgatca

SEQ ID NO: 420525 - DNA, 20 bp, Artificial Sequence
  chemically synthesized
tggttacccatgatcaactg

SEQ ID NO: 420526 - DNA, 20 bp, Artificial Sequence
  chemically synthesized
actcatctatttttggactg

SEQ ID NO: 420527 - DNA, 20 bp, Artificial Sequence
  chemically synthesized
gatcaactgcagtccaaaaa

SEQ ID NO: 420528 - DNA, 20 bp, Artificial Sequence
  chemically synthesized
gtactgtactcatctatttt

SEQ ID NO: 420529 - DNA, 20 bp, Artificial Sequence
  chemically synthesized
actgcagtccaaaaatagat

SEQ ID NO: 420530 - DNA, 20 bp, Artificial Sequence
  chemically synthesized
agtccaaaaatagatgagta

SEQ ID NO: 420531 - DNA, 20 bp, Artificial Sequence
  chemically synthesized
atagatgagtacagtacaat

SEQ ID NO: 420532 - DNA, 20 bp, Artificial Sequence
  chemically synthesized
acagtacaataagatatttt

SEQ ID NO: 420533 - DNA, 20 bp, Artificial Sequence
  chemically synthesized
agtacaataagatattttga

SEQ ID NO: 420534 - DNA, 20 bp, Artificial Sequence
  chemically synthesized
caataagatattttgagaga

SEQ ID NO: 420535 - DNA, 20 bp, Artificial Sequence
  chemically synthesized
ataagatattttgagagata

SEQ ID NO: 420536 - DNA, 20 bp, Artificial Sequence
  chemically synthesized
tgataaaagttatgtgaatg

SEQ ID NO: 420537 - DNA, 20 bp, Artificial Sequence
  chemically synthesized
cattcacataacttttatca

SEQ ID NO: 420538 - DNA, 20 bp, Artificial Sequence
  chemically synthesized
ataacaatatactgtgataa

SEQ ID NO: 420539 - DNA, 20 bp, Artificial Sequence
  chemically synthesized
tgttataattgttctaatat

SEQ ID NO: 420540 - DNA, 20 bp, Artificial Sequence
  chemically synthesized
ttaacaacaataactaatat

SEQ ID NO: 420541 - DNA, 20 bp, Artificial Sequence
  chemically synthesized
ttattgttgttaatctctta

SEQ ID NO: 420542 - DNA, 20 bp, Artificial Sequence
  chemically synthesized
atatacattaggaaccataa

SEQ ID NO: 420543 - DNA, 20 bp, Artificial Sequence
  chemically synthesized
atatatacattaggaaccat

SEQ ID NO: 420544 - DNA, 20 bp, Artificial Sequence
  chemically synthesized
caaagtttaatatatacatt

SEQ ID NO: 420545 - DNA, 20 bp, Artificial Sequence
  chemically synthesized
acaaagtttaatatatacat

SEQ ID NO: 420546 - DNA, 20 bp, Artificial Sequence
  chemically synthesized
atatacatacacatataaca

SEQ ID NO: 420547 - DNA, 20 bp, Artificial Sequence
  chemically synthesized
tgttatatgtgtatgtatat

SEQ ID NO: 420548 - DNA, 20 bp, Artificial Sequence
  chemically synthesized
aagaaacataatatatacat

SEQ ID NO: 420549 - DNA, 20 bp, Artificial Sequence
  chemically synthesized
agaaacataatatatacata

SEQ ID NO: 420550 - DNA, 20 bp, Artificial Sequence
  chemically synthesized
cataatatatacataaggtt

SEQ ID NO: 420551 - DNA, 20 bp, Artificial Sequence
  chemically synthesized
ataaggtttggtattatcca

SEQ ID NO: 420552 - DNA, 20 bp, Artificial Sequence
  chemically synthesized
tttggtattatccacagttt

SEQ ID NO: 420553 - DNA, 20 bp, Artificial Sequence
  chemically synthesized
ttggtattatccacagtttc

SEQ ID NO: 420554 - DNA, 20 bp, Artificial Sequence
  chemically synthesized
ctggtggatgcctgaaactg

SEQ ID NO: 420555 - DNA, 20 bp, Artificial Sequence
  chemically synthesized
ccacagtttcaggcatccac

SEQ ID NO: 420556 - DNA, 20 bp, Artificial Sequence
  chemically synthesized
cacagtttcaggcatccacc

SEQ ID NO: 420557 - DNA, 20 bp, Artificial Sequence
  chemically synthesized
acagtttcaggcatccacca

SEQ ID NO: 420558 - DNA, 20 bp, Artificial Sequence
  chemically synthesized
cagtttcaggcatccaccag

SEQ ID NO: 420559 - DNA, 20 bp, Artificial Sequence
  chemically synthesized
acgtgttctaagacccctgg

SEQ ID NO: 420560 - DNA, 20 bp, Artificial Sequence
  chemically synthesized
caggcatccaccaggggtct

SEQ ID NO: 420561 - DNA, 20 bp, Artificial Sequence
  chemically synthesized
gatacgtgttctaagacccc

SEQ ID NO: 420562 - DNA, 20 bp, Artificial Sequence
  chemically synthesized
tctgtagggatacgtgttct

SEQ ID NO: 420563 - DNA, 20 bp, Artificial Sequence
  chemically synthesized
tcttagaacacgtatcccta

SEQ ID NO: 420564 - DNA, 20 bp, Artificial Sequence
  chemically synthesized
gaacacgtatccctacagat

SEQ ID NO: 420565 - DNA, 20 bp, Artificial Sequence
  chemically synthesized
ttaatctccccttatctgta

SEQ ID NO: 420566 - DNA, 20 bp, Artificial Sequence
  chemically synthesized
aacacgtatccctacagata

SEQ ID NO: 420567 - DNA, 20 bp, Artificial Sequence
  chemically synthesized
attaatctccccttatctgt

SEQ ID NO: 420568 - DNA, 20 bp, Artificial Sequence
  chemically synthesized
acacgtatccctacagataa

SEQ ID NO: 420569 - DNA, 20 bp, Artificial Sequence
  chemically synthesized
aattaatctccccttatctg

SEQ ID NO: 420570 - DNA, 20 bp, Artificial Sequence
  chemically synthesized
cacgtatccctacagataag

SEQ ID NO: 420571 - DNA, 20 bp, Artificial Sequence
  chemically synthesized
cgtatccctacagataaggg

SEQ ID NO: 420572 - DNA, 20 bp, Artificial Sequence
  chemically synthesized
attaattatttctaccatta

SEQ ID NO: 420573 - DNA, 20 bp, Artificial Sequence
  chemically synthesized
tcattttaattctgtaatgg

SEQ ID NO: 420574 - DNA, 20 bp, Artificial Sequence
  chemically synthesized
gactcattttaattctgtaa

SEQ ID NO: 420575 - DNA, 20 bp, Artificial Sequence
  chemically synthesized
taccattacagaattaaaat

SEQ ID NO: 420576 - DNA, 20 bp, Artificial Sequence
  chemically synthesized
tttgaataggaagattaaca

SEQ ID NO: 420577 - DNA, 20 bp, Artificial Sequence
  chemically synthesized
agaaataatttttgaatagg

SEQ ID NO: 420578 - DNA, 20 bp, Artificial Sequence
  chemically synthesized
attagaaataatttttgaat

SEQ ID NO: 420579 - DNA, 20 bp, Artificial Sequence
  chemically synthesized
aattagaaataatttttgaa

SEQ ID NO: 420580 - DNA, 20 bp, Artificial Sequence
  chemically synthesized
ttcaaaaattatttctaatt

SEQ ID NO: 420581 - DNA, 20 bp, Artificial Sequence
  chemically synthesized
caaaaattatttctaattca

SEQ ID NO: 420582 - DNA, 20 bp, Artificial Sequence
  chemically synthesized
ctctttgaatttctctgaat

SEQ ID NO: 420583 - DNA, 20 bp, Artificial Sequence
  chemically synthesized
ttctaattcagagaaattca

SEQ ID NO: 420584 - DNA, 20 bp, Artificial Sequence
  chemically synthesized
ctaattcagagaaattcaaa

SEQ ID NO: 420585 - DNA, 20 bp, Artificial Sequence
  chemically synthesized
aattcagagaaattcaaaga

SEQ ID NO: 420586 - DNA, 20 bp, Artificial Sequence
  chemically synthesized
caataaaccgcatagcgtta

SEQ ID NO: 420587 - DNA, 20 bp, Artificial Sequence
  chemically synthesized
agagagtctataacgctatg

SEQ ID NO: 420588 - DNA, 20 bp, Artificial Sequence
  chemically synthesized
tttaatgtcaataaaccgca

SEQ ID NO: 420589 - DNA, 20 bp, Artificial Sequence
  chemically synthesized
tatgcggtttattgacatta

SEQ ID NO: 420590 - DNA, 20 bp, Artificial Sequence
  chemically synthesized
attgacattaaagacattaa

SEQ ID NO: 420591 - DNA, 20 bp, Artificial Sequence
  chemically synthesized
cattaatagttaattgcttg

SEQ ID NO: 420592 - DNA, 20 bp, Artificial Sequence
  chemically synthesized
taatagttaattgcttgaag

SEQ ID NO: 420593 - DNA, 20 bp, Artificial Sequence
  chemically synthesized
aaaagtctattttcttcttc

SEQ ID NO: 420594 - DNA, 20 bp, Artificial Sequence
  chemically synthesized
taattgcttgaagaagaaaa

SEQ ID NO: 420595 - DNA, 20 bp, Artificial Sequence
  chemically synthesized
aagaagaaaatagacttttt

SEQ ID NO: 420596 - DNA, 20 bp, Artificial Sequence
  chemically synthesized
atttgttattattactgaaa

SEQ ID NO: 420597 - DNA, 20 bp, Artificial Sequence
  chemically synthesized
cagtaataataacaaatttg

SEQ ID NO: 420598 - DNA, 20 bp, Artificial Sequence
  chemically synthesized
taacaaatttgcagcataat

SEQ ID NO: 420599 - DNA, 20 bp, Artificial Sequence
  chemically synthesized
caaatttgcagcataattgg

SEQ ID NO: 420600 - DNA, 20 bp, Artificial Sequence
  chemically synthesized
tagttcaaagggggatagga

SEQ ID NO: 420601 - DNA, 20 bp, Artificial Sequence
  chemically synthesized
tttatagttcaaagggggat

SEQ ID NO: 420602 - DNA, 20 bp, Artificial Sequence
  chemically synthesized
ttttatagttcaaaggggga

SEQ ID NO: 420603 - DNA, 20 bp, Artificial Sequence
  chemically synthesized
attattttatagttcaaagg

SEQ ID NO: 420604 - DNA, 20 bp, Artificial Sequence
  chemically synthesized
tattattttatagttcaaag

SEQ ID NO: 420605 - DNA, 20 bp, Artificial Sequence
  chemically synthesized
atattattttatagttcaaa

SEQ ID NO: 420606 - DNA, 20 bp, Artificial Sequence
  chemically synthesized
aatattattttatagttcaa

SEQ ID NO: 420607 - DNA, 20 bp, Artificial Sequence
  chemically synthesized
aaatattattttatagttca

SEQ ID NO: 420608 - DNA, 20 bp, Artificial Sequence
  chemically synthesized
tttaccaaaatattatttta

SEQ ID NO: 420609 - DNA, 20 bp, Artificial Sequence
  chemically synthesized
tgaactataaaataatattt

SEQ ID NO: 420610 - DNA, 20 bp, Artificial Sequence
  chemically synthesized
aataatattttggtaaaata

SEQ ID NO: 420611 - DNA, 20 bp, Artificial Sequence
  chemically synthesized
tattttggtaaaatatggtg

SEQ ID NO: 420612 - DNA, 20 bp, Artificial Sequence
  chemically synthesized
attttggtaaaatatggtga

SEQ ID NO: 420613 - DNA, 20 bp, Artificial Sequence
  chemically synthesized
aatatggtgaaggatcctta

SEQ ID NO: 420614 - DNA, 20 bp, Artificial Sequence
  chemically synthesized
tatgatcaagatacactgta

SEQ ID NO: 420615 - DNA, 20 bp, Artificial Sequence
  chemically synthesized
ctatgatcaagatacactgt

SEQ ID NO: 420616 - DNA, 20 bp, Artificial Sequence
  chemically synthesized
cttacagtgtatcttgatca

SEQ ID NO: 420617 - DNA, 20 bp, Artificial Sequence
  chemically synthesized
aactcaggaggactatgatc

SEQ ID NO: 420618 - DNA, 20 bp, Artificial Sequence
  chemically synthesized
atcttgatcatagtcctcct

SEQ ID NO: 420619 - DNA, 20 bp, Artificial Sequence
  chemically synthesized
gtagataattataactcagg

SEQ ID NO: 420620 - DNA, 20 bp, Artificial Sequence
  chemically synthesized
tgtagataattataactcag

SEQ ID NO: 420621 - DNA, 20 bp, Artificial Sequence
  chemically synthesized
aatgtagataattataactc

SEQ ID NO: 420622 - DNA, 20 bp, Artificial Sequence
  chemically synthesized
taatgtagataattataact

SEQ ID NO: 420623 - DNA, 20 bp, Artificial Sequence
  chemically synthesized
acaattttagtataataatg

SEQ ID NO: 420624 - DNA, 20 bp, Artificial Sequence
  chemically synthesized
acattattatactaaaattg

SEQ ID NO: 420625 - DNA, 20 bp, Artificial Sequence
  chemically synthesized
atgaggaagagccacaattt

SEQ ID NO: 420626 - DNA, 20 bp, Artificial Sequence
  chemically synthesized
tattaatatcttatgaggaa

SEQ ID NO: 420627 - DNA, 20 bp, Artificial Sequence
  chemically synthesized
aaattgtggctcttcctcat

SEQ ID NO: 420628 - DNA, 20 bp, Artificial Sequence
  chemically synthesized
tatattaatatcttatgagg

SEQ ID NO: 420629 - DNA, 20 bp, Artificial Sequence
  chemically synthesized
gaatatattaatatcttatg

SEQ ID NO: 420630 - DNA, 20 bp, Artificial Sequence
  chemically synthesized
tgaatatattaatatcttat

SEQ ID NO: 420631 - DNA, 20 bp, Artificial Sequence
  chemically synthesized
tgcaattagttaatttcata

SEQ ID NO: 420632 - DNA, 20 bp, Artificial Sequence
  chemically synthesized
tatgaaattaactaattgca

SEQ ID NO: 420633 - DNA, 20 bp, Artificial Sequence
  chemically synthesized
ttttattggagctatgcaat

SEQ ID NO: 420634 - DNA, 20 bp, Artificial Sequence
  chemically synthesized
aataagttaatattttattg

SEQ ID NO: 420635 - DNA, 20 bp, Artificial Sequence
  chemically synthesized
tgaataagttaatattttat

SEQ ID NO: 420636 - DNA, 20 bp, Artificial Sequence
  chemically synthesized
tcttactttaacagttgaat

SEQ ID NO: 420637 - DNA, 20 bp, Artificial Sequence
  chemically synthesized
attaacttattcaactgtta

SEQ ID NO: 420638 - DNA, 20 bp, Artificial Sequence
  chemically synthesized
acttattcaactgttaaagt

SEQ ID NO: 420639 - DNA, 20 bp, Artificial Sequence
  chemically synthesized
ggccgatattcttactttaa

SEQ ID NO: 420640 - DNA, 20 bp, Artificial Sequence
  chemically synthesized
aactgttaaagtaagaatat

SEQ ID NO: 420641 - DNA, 20 bp, Artificial Sequence
  chemically synthesized
gttaaagtaagaatatcggc

SEQ ID NO: 420642 - DNA, 20 bp, Artificial Sequence
  chemically synthesized
ttaaagtaagaatatcggcc

SEQ ID NO: 420643 - DNA, 20 bp, Artificial Sequence
  chemically synthesized
gtaagaatatcggccaggcg

SEQ ID NO: 420644 - DNA, 20 bp, Artificial Sequence
  chemically synthesized
agaatatcggccaggcgcgg

SEQ ID NO: 420645 - DNA, 20 bp, Artificial Sequence
  chemically synthesized
caggcacgagccaccgcgcc

SEQ ID NO: 420646 - DNA, 20 bp, Artificial Sequence
  chemically synthesized
agtgctgggattacaggcac

SEQ ID NO: 420647 - DNA, 20 bp, Artificial Sequence
  chemically synthesized
gtggctcgtgcctgtaatcc

SEQ ID NO: 420648 - DNA, 20 bp, Artificial Sequence
  chemically synthesized
tcccaaagtgctgggattac

SEQ ID NO: 420649 - DNA, 20 bp, Artificial Sequence
  chemically synthesized
ctcccaaagtgctgggatta

SEQ ID NO: 420650 - DNA, 20 bp, Artificial Sequence
  chemically synthesized
tgcctgtaatcccagcactt

SEQ ID NO: 420651 - DNA, 20 bp, Artificial Sequence
  chemically synthesized
tgtcagcctcccaaagtgct

SEQ ID NO: 420652 - DNA, 20 bp, Artificial Sequence
  chemically synthesized
gcctgtaatcccagcacttt

SEQ ID NO: 420653 - DNA, 20 bp, Artificial Sequence
  chemically synthesized
gtgtcagcctcccaaagtgc

SEQ ID NO: 420654 - DNA, 20 bp, Artificial Sequence
  chemically synthesized
ctgtaatcccagcactttgg

SEQ ID NO: 420655 - DNA, 20 bp, Artificial Sequence
  chemically synthesized
tgtaatcccagcactttggg

SEQ ID NO: 420656 - DNA, 20 bp, Artificial Sequence
  chemically synthesized
tctcctgtgtcagcctccca

SEQ ID NO: 420657 - DNA, 20 bp, Artificial Sequence
  chemically synthesized
agcactttgggaggctgaca

SEQ ID NO: 420658 - DNA, 20 bp, Artificial Sequence
  chemically synthesized
gcactttgggaggctgacac

SEQ ID NO: 420659 - DNA, 20 bp, Artificial Sequence
  chemically synthesized
actttgggaggctgacacag

SEQ ID NO: 420660 - DNA, 20 bp, Artificial Sequence
  chemically synthesized
ttcaagtgattctcctgtgt

SEQ ID NO: 420661 - DNA, 20 bp, Artificial Sequence
  chemically synthesized
acaggagaatcacttgaacc

SEQ ID NO: 420662 - DNA, 20 bp, Artificial Sequence
  chemically synthesized
caggagaatcacttgaacct

SEQ ID NO: 420663 - DNA, 20 bp, Artificial Sequence
  chemically synthesized
aacctctgcctcccaggttc

SEQ ID NO: 420664 - DNA, 20 bp, Artificial Sequence
  chemically synthesized
ggagaatcacttgaacctgg

SEQ ID NO: 420665 - DNA, 20 bp, Artificial Sequence
  chemically synthesized
gagaatcacttgaacctggg

SEQ ID NO: 420666 - DNA, 20 bp, Artificial Sequence
  chemically synthesized
aatcacttgaacctgggagg

SEQ ID NO: 420667 - DNA, 20 bp, Artificial Sequence
  chemically synthesized
cactgcaacctctgcctccc

SEQ ID NO: 420668 - DNA, 20 bp, Artificial Sequence
  chemically synthesized
tcacttgaacctgggaggca

SEQ ID NO: 420669 - DNA, 20 bp, Artificial Sequence
  chemically synthesized
tcactgcaacctctgcctcc

SEQ ID NO: 420670 - DNA, 20 bp, Artificial Sequence
  chemically synthesized
cacttgaacctgggaggcag

SEQ ID NO: 420671 - DNA, 20 bp, Artificial Sequence
  chemically synthesized
aacctgggaggcagaggttg

SEQ ID NO: 420672 - DNA, 20 bp, Artificial Sequence
  chemically synthesized
tgggaggcagaggttgcagt

SEQ ID NO: 420673 - DNA, 20 bp, Artificial Sequence
  chemically synthesized
ggcagaggttgcagtgagcc

SEQ ID NO: 420674 - DNA, 20 bp, Artificial Sequence
  chemically synthesized
ggagtgcaatggcgcagtct

SEQ ID NO: 420675 - DNA, 20 bp, Artificial Sequence
  chemically synthesized
caaactggagtgcaatggcg

SEQ ID NO: 420676 - DNA, 20 bp, Artificial Sequence
  chemically synthesized
ttgcccaaactggagtgcaa

SEQ ID NO: 420677 - DNA, 20 bp, Artificial Sequence
  chemically synthesized
aagactgcgccattgcactc

SEQ ID NO: 420678 - DNA, 20 bp, Artificial Sequence
  chemically synthesized
tgcgccattgcactccagtt

SEQ ID NO: 420679 - DNA, 20 bp, Artificial Sequence
  chemically synthesized
gcgccattgcactccagttt

SEQ ID NO: 420680 - DNA, 20 bp, Artificial Sequence
  chemically synthesized
tctcactgttgcccaaactg

SEQ ID NO: 420681 - DNA, 20 bp, Artificial Sequence
  chemically synthesized
agtctcactgttgcccaaac

SEQ ID NO: 420682 - DNA, 20 bp, Artificial Sequence
  chemically synthesized
ttgcactccagtttgggcaa

SEQ ID NO: 420683 - DNA, 20 bp, Artificial Sequence
  chemically synthesized
actccagtttgggcaacagt

SEQ ID NO: 420684 - DNA, 20 bp, Artificial Sequence
  chemically synthesized
ttatttatttttttgagatg

SEQ ID NO: 420685 - DNA, 20 bp, Artificial Sequence
  chemically synthesized
ttttatttatttttttgaga

SEQ ID NO: 420686 - DNA, 20 bp, Artificial Sequence
  chemically synthesized
tttattttatttattttttt

SEQ ID NO: 420687 - DNA, 20 bp, Artificial Sequence
  chemically synthesized
aaaaataaataaaataaata

SEQ ID NO: 420688 - DNA, 20 bp, Artificial Sequence
  chemically synthesized
aatattaattgcatacaaaa

SEQ ID NO: 420689 - DNA, 20 bp, Artificial Sequence
  chemically synthesized
catacaaaaaagaaatatgc

SEQ ID NO: 420690 - DNA, 20 bp, Artificial Sequence
  chemically synthesized
ctaatacaatggacggtatc

SEQ ID NO: 420691 - DNA, 20 bp, Artificial Sequence
  chemically synthesized
gaaattgctaatacaatgga

SEQ ID NO: 420692 - DNA, 20 bp, Artificial Sequence
  chemically synthesized
ctggataccgtccattgtat

SEQ ID NO: 420693 - DNA, 20 bp, Artificial Sequence
  chemically synthesized
ccttgaaattgctaatacaa

SEQ ID NO: 420694 - DNA, 20 bp, Artificial Sequence
  chemically synthesized
tccattgtattagcaatttc

SEQ ID NO: 420695 - DNA, 20 bp, Artificial Sequence
  chemically synthesized
ccattgtattagcaatttca

SEQ ID NO: 420696 - DNA, 20 bp, Artificial Sequence
  chemically synthesized
aaaaaaaaaaaagtaatgtt

SEQ ID NO: 420697 - DNA, 20 bp, Artificial Sequence
  chemically synthesized
catctcaaaaaaaaaaaaaa

SEQ ID NO: 420698 - DNA, 20 bp, Artificial Sequence
  chemically synthesized
ttactttttttttttttttt

SEQ ID NO: 420699 - DNA, 20 bp, Artificial Sequence
  chemically synthesized
ttttttttttttttttgaga

SEQ ID NO: 420700 - DNA, 20 bp, Artificial Sequence
  chemically synthesized
cactccagcctgggcgacaa

SEQ ID NO: 420701 - DNA, 20 bp, Artificial Sequence
  chemically synthesized
ggaattttgctcttgtcgcc

SEQ ID NO: 420702 - DNA, 20 bp, Artificial Sequence
  chemically synthesized
gaattttgctcttgtcgccc

SEQ ID NO: 420703 - DNA, 20 bp, Artificial Sequence
  chemically synthesized
tgcactccagcctgggcgac

SEQ ID NO: 420704 - DNA, 20 bp, Artificial Sequence
  chemically synthesized
tttgctcttgtcgcccaggc

SEQ ID NO: 420705 - DNA, 20 bp, Artificial Sequence
  chemically synthesized
tgctcttgtcgcccaggctg

SEQ ID NO: 420706 - DNA, 20 bp, Artificial Sequence
  chemically synthesized
gagccgctgcactccagcct

SEQ ID NO: 420707 - DNA, 20 bp, Artificial Sequence
  chemically synthesized
tgagccgctgcactccagcc

SEQ ID NO: 420708 - DNA, 20 bp, Artificial Sequence
  chemically synthesized
ttgtcgcccaggctggagtg

SEQ ID NO: 420709 - DNA, 20 bp, Artificial Sequence
  chemically synthesized
gagattgagccgctgcactc

SEQ ID NO: 420710 - DNA, 20 bp, Artificial Sequence
  chemically synthesized
tcgcccaggctggagtgcag

SEQ ID NO: 420711 - DNA, 20 bp, Artificial Sequence
  chemically synthesized
ggagtgcagcggctcaatct

SEQ ID NO: 420712 - DNA, 20 bp, Artificial Sequence
  chemically synthesized
ggtcgcagtgagccgagatt

SEQ ID NO: 420713 - DNA, 20 bp, Artificial Sequence
  chemically synthesized
ggcagaggtcgcagtgagcc

SEQ ID NO: 420714 - DNA, 20 bp, Artificial Sequence
  chemically synthesized
tgggaggcagaggtcgcagt

SEQ ID NO: 420715 - DNA, 20 bp, Artificial Sequence
  chemically synthesized
aacttgggaggcagaggtcg

SEQ ID NO: 420716 - DNA, 20 bp, Artificial Sequence
  chemically synthesized
ctcttgaacttgggaggcag

SEQ ID NO: 420717 - DNA, 20 bp, Artificial Sequence
  chemically synthesized
tctcttgaacttgggaggca

SEQ ID NO: 420718 - DNA, 20 bp, Artificial Sequence
  chemically synthesized
cactgcgacctctgcctccc

SEQ ID NO: 420719 - DNA, 20 bp, Artificial Sequence
  chemically synthesized
aatctcttgaacttgggagg

SEQ ID NO: 420720 - DNA, 20 bp, Artificial Sequence
  chemically synthesized
gagaatctcttgaacttggg

SEQ ID NO: 420721 - DNA, 20 bp, Artificial Sequence
  chemically synthesized
ggagaatctcttgaacttgg

SEQ ID NO: 420722 - DNA, 20 bp, Artificial Sequence
  chemically synthesized
gacctctgcctcccaagttc

SEQ ID NO: 420723 - DNA, 20 bp, Artificial Sequence
  chemically synthesized
caggagaatctcttgaactt

SEQ ID NO: 420724 - DNA, 20 bp, Artificial Sequence
  chemically synthesized
cctctgcctcccaagttcaa

SEQ ID NO: 420725 - DNA, 20 bp, Artificial Sequence
  chemically synthesized
gcaggagaatctcttgaact

SEQ ID NO: 420726 - DNA, 20 bp, Artificial Sequence
  chemically synthesized
ttcaagagattctcctgcct

SEQ ID NO: 420727 - DNA, 20 bp, Artificial Sequence
  chemically synthesized
tactagggaggctgaggcag

SEQ ID NO: 420728 - DNA, 20 bp, Artificial Sequence
  chemically synthesized
gctactagggaggctgaggc

SEQ ID NO: 420729 - DNA, 20 bp, Artificial Sequence
  chemically synthesized
agctactagggaggctgagg

SEQ ID NO: 420730 - DNA, 20 bp, Artificial Sequence
  chemically synthesized
tccagctactagggaggctg

SEQ ID NO: 420731 - DNA, 20 bp, Artificial Sequence
  chemically synthesized
ttccagctactagggaggct

SEQ ID NO: 420732 - DNA, 20 bp, Artificial Sequence
  chemically synthesized
ttctcctgcctcagcctccc

SEQ ID NO: 420733 - DNA, 20 bp, Artificial Sequence
  chemically synthesized
tcctgcctcagcctccctag

SEQ ID NO: 420734 - DNA, 20 bp, Artificial Sequence
  chemically synthesized
tgttattccagctactaggg

SEQ ID NO: 420735 - DNA, 20 bp, Artificial Sequence
  chemically synthesized
ctgttattccagctactagg

SEQ ID NO: 420736 - DNA, 20 bp, Artificial Sequence
  chemically synthesized
gcctcagcctccctagtagc

SEQ ID NO: 420737 - DNA, 20 bp, Artificial Sequence
  chemically synthesized
gcctgttattccagctacta

SEQ ID NO: 420738 - DNA, 20 bp, Artificial Sequence
  chemically synthesized
cgcctgttattccagctact

SEQ ID NO: 420739 - DNA, 20 bp, Artificial Sequence
  chemically synthesized
gcgcctgttattccagctac

SEQ ID NO: 420740 - DNA, 20 bp, Artificial Sequence
  chemically synthesized
ctccctagtagctggaataa

SEQ ID NO: 420741 - DNA, 20 bp, Artificial Sequence
  chemically synthesized
tccctagtagctggaataac

SEQ ID NO: 420742 - DNA, 20 bp, Artificial Sequence
  chemically synthesized
gtggcgggcgcctgttattc

SEQ ID NO: 420743 - DNA, 20 bp, Artificial Sequence
  chemically synthesized
aattagccaggcatggtggc

SEQ ID NO: 420744 - DNA, 20 bp, Artificial Sequence
  chemically synthesized
aaattagccaggcatggtgg

SEQ ID NO: 420745 - DNA, 20 bp, Artificial Sequence
  chemically synthesized
caggcgcccgccaccatgcc

SEQ ID NO: 420746 - DNA, 20 bp, Artificial Sequence
  chemically synthesized
agaaaattagccaggcatgg

SEQ ID NO: 420747 - DNA, 20 bp, Artificial Sequence
  chemically synthesized
caaagaaaattagccaggca

SEQ ID NO: 420748 - DNA, 20 bp, Artificial Sequence
  chemically synthesized
aaatacaaagaaaattagcc

SEQ ID NO: 420749 - DNA, 20 bp, Artificial Sequence
  chemically synthesized
aaaatacaaagaaaattagc

SEQ ID NO: 420750 - DNA, 20 bp, Artificial Sequence
  chemically synthesized
actaaaaatacaaagaaaat

SEQ ID NO: 420751 - DNA, 20 bp, Artificial Sequence
  chemically synthesized
ccgtctctactaaaaataca

SEQ ID NO: 420752 - DNA, 20 bp, Artificial Sequence
  chemically synthesized
gctaattttctttgtatttt

SEQ ID NO: 420753 - DNA, 20 bp, Artificial Sequence
  chemically synthesized
aattttctttgtatttttag

SEQ ID NO: 420754 - DNA, 20 bp, Artificial Sequence
  chemically synthesized
ttttctttgtatttttagta

SEQ ID NO: 420755 - DNA, 20 bp, Artificial Sequence
  chemically synthesized
ctttgtatttttagtagaga

SEQ ID NO: 420756 - DNA, 20 bp, Artificial Sequence
  chemically synthesized
tttgtatttttagtagagac

SEQ ID NO: 420757 - DNA, 20 bp, Artificial Sequence
  chemically synthesized
ttgtatttttagtagagacg

SEQ ID NO: 420758 - DNA, 20 bp, Artificial Sequence
  chemically synthesized
gagacggggtttcaccatgt

SEQ ID NO: 420759 - DNA, 20 bp, Artificial Sequence
  chemically synthesized
cggggtttcaccatgttggc

SEQ ID NO: 420760 - DNA, 20 bp, Artificial Sequence
  chemically synthesized
tgagaccagcctggccaaca

SEQ ID NO: 420761 - DNA, 20 bp, Artificial Sequence
  chemically synthesized
ggggtttcaccatgttggcc

SEQ ID NO: 420762 - DNA, 20 bp, Artificial Sequence
  chemically synthesized
tttcaccatgttggccaggc

SEQ ID NO: 420763 - DNA, 20 bp, Artificial Sequence
  chemically synthesized
tcaggagtttgagaccagcc

SEQ ID NO: 420764 - DNA, 20 bp, Artificial Sequence
  chemically synthesized
tgaggtcaggagtttgagac

SEQ ID NO: 420765 - DNA, 20 bp, Artificial Sequence
  chemically synthesized
tcacctgaggtcaggagttt

SEQ ID NO: 420766 - DNA, 20 bp, Artificial Sequence
  chemically synthesized
tggtctcaaactcctgacct

SEQ ID NO: 420767 - DNA, 20 bp, Artificial Sequence
  chemically synthesized
tgcggatcacctgaggtcag

SEQ ID NO: 420768 - DNA, 20 bp, Artificial Sequence
  chemically synthesized
ggtctcaaactcctgacctc

SEQ ID NO: 420769 - DNA, 20 bp, Artificial Sequence
  chemically synthesized
cgtgcggatcacctgaggtc

SEQ ID NO: 420770 - DNA, 20 bp, Artificial Sequence
  chemically synthesized
gcgtgcggatcacctgaggt

SEQ ID NO: 420771 - DNA, 20 bp, Artificial Sequence
  chemically synthesized
tgaggcgtgcggatcacctg

SEQ ID NO: 420772 - DNA, 20 bp, Artificial Sequence
  chemically synthesized
ctgaggcgtgcggatcacct

SEQ ID NO: 420773 - DNA, 20 bp, Artificial Sequence
  chemically synthesized
ctcaggtgatccgcacgcct

SEQ ID NO: 420774 - DNA, 20 bp, Artificial Sequence
  chemically synthesized
ctttgggcggctgaggcgtg

SEQ ID NO: 420775 - DNA, 20 bp, Artificial Sequence
  chemically synthesized
cccagcactttgggcggctg

SEQ ID NO: 420776 - DNA, 20 bp, Artificial Sequence
  chemically synthesized
tcccagcactttgggcggct

SEQ ID NO: 420777 - DNA, 20 bp, Artificial Sequence
  chemically synthesized
ccgcacgcctcagccgccca

SEQ ID NO: 420778 - DNA, 20 bp, Artificial Sequence
  chemically synthesized
tgtaatcccagcactttggg

SEQ ID NO: 420779 - DNA, 20 bp, Artificial Sequence
  chemically synthesized
gcctcagccgcccaaagtgc

SEQ ID NO: 420780 - DNA, 20 bp, Artificial Sequence
  chemically synthesized
gcctgtaatcccagcacttt

SEQ ID NO: 420781 - DNA, 20 bp, Artificial Sequence
  chemically synthesized
cctcagccgcccaaagtgct

SEQ ID NO: 420782 - DNA, 20 bp, Artificial Sequence
  chemically synthesized
tgcctgtaatcccagcactt

SEQ ID NO: 420783 - DNA, 20 bp, Artificial Sequence
  chemically synthesized
cgcccaaagtgctgggatta

SEQ ID NO: 420784 - DNA, 20 bp, Artificial Sequence
  chemically synthesized
gcccaaagtgctgggattac

SEQ ID NO: 420785 - DNA, 20 bp, Artificial Sequence
  chemically synthesized
gtggctcatgcctgtaatcc

SEQ ID NO: 420786 - DNA, 20 bp, Artificial Sequence
  chemically synthesized
agtgctgggattacaggcat

SEQ ID NO: 420787 - DNA, 20 bp, Artificial Sequence
  chemically synthesized
caggcatgagccaccgtgcc

SEQ ID NO: 420788 - DNA, 20 bp, Artificial Sequence
  chemically synthesized
aatgttgaggccgggcacgg

SEQ ID NO: 420789 - DNA, 20 bp, Artificial Sequence
  chemically synthesized
agtaatgttgaggccgggca

SEQ ID NO: 420790 - DNA, 20 bp, Artificial Sequence
  chemically synthesized
tcgaaagtaatgttgaggcc

SEQ ID NO: 420791 - DNA, 20 bp, Artificial Sequence
  chemically synthesized
atcgaaagtaatgttgaggc

SEQ ID NO: 420792 - DNA, 20 bp, Artificial Sequence
  chemically synthesized
tgagatcgaaagtaatgttg

SEQ ID NO: 420793 - DNA, 20 bp, Artificial Sequence
  chemically synthesized
ttgagatcgaaagtaatgtt

SEQ ID NO: 420794 - DNA, 20 bp, Artificial Sequence
  chemically synthesized
acttccagtcttgagatcga

SEQ ID NO: 420795 - DNA, 20 bp, Artificial Sequence
  chemically synthesized
tcaacattactttcgatctc

SEQ ID NO: 420796 - DNA, 20 bp, Artificial Sequence
  chemically synthesized
attactttcgatctcaagac

SEQ ID NO: 420797 - DNA, 20 bp, Artificial Sequence
  chemically synthesized
agtactgcacttccagtctt

SEQ ID NO: 420798 - DNA, 20 bp, Artificial Sequence
  chemically synthesized
actttcgatctcaagactgg

SEQ ID NO: 420799 - DNA, 20 bp, Artificial Sequence
  chemically synthesized
cgatctcaagactggaagtg

SEQ ID NO: 420800 - DNA, 20 bp, Artificial Sequence
  chemically synthesized
tttgttgagtactgcacttc

SEQ ID NO: 420801 - DNA, 20 bp, Artificial Sequence
  chemically synthesized
tggaagtgcagtactcaaca

SEQ ID NO: 420802 - DNA, 20 bp, Artificial Sequence
  chemically synthesized
ttttccccaattactttgtt

SEQ ID NO: 420803 - DNA, 20 bp, Artificial Sequence
  chemically synthesized
gcagtactcaacaaagtaat

SEQ ID NO: 420804 - DNA, 20 bp, Artificial Sequence
  chemically synthesized
cagtactcaacaaagtaatt

SEQ ID NO: 420805 - DNA, 20 bp, Artificial Sequence
  chemically synthesized
agtactcaacaaagtaattg

SEQ ID NO: 420806 - DNA, 20 bp, Artificial Sequence
  chemically synthesized
aaagtaattggggaaaaaaa

SEQ ID NO: 420807 - DNA, 20 bp, Artificial Sequence
  chemically synthesized
agtttttgatgtaaaaattt

SEQ ID NO: 420808 - DNA, 20 bp, Artificial Sequence
  chemically synthesized
tttttgatgtaaaaatttta

SEQ ID NO: 420809 - DNA, 20 bp, Artificial Sequence
  chemically synthesized
accaacttcattcaaagatc

SEQ ID NO: 420810 - DNA, 20 bp, Artificial Sequence
  chemically synthesized
gagttcttgatctttgaatg

SEQ ID NO: 420811 - DNA, 20 bp, Artificial Sequence
  chemically synthesized
tgggagaccaacttcattca

SEQ ID NO: 420812 - DNA, 20 bp, Artificial Sequence
  chemically synthesized
tcttgatctttgaatgaagt

SEQ ID NO: 420813 - DNA, 20 bp, Artificial Sequence
  chemically synthesized
attcgtttgaaatttattgg

SEQ ID NO: 420814 - DNA, 20 bp, Artificial Sequence
  chemically synthesized
ttattcgtttgaaatttatt

SEQ ID NO: 420815 - DNA, 20 bp, Artificial Sequence
  chemically synthesized
cttattcgtttgaaatttat

SEQ ID NO: 420816 - DNA, 20 bp, Artificial Sequence
  chemically synthesized
ccaataaatttcaaacgaat

SEQ ID NO: 420817 - DNA, 20 bp, Artificial Sequence
  chemically synthesized
ttcaaacgaataagaaacat

SEQ ID NO: 420818 - DNA, 20 bp, Artificial Sequence
  chemically synthesized
acattagatttgtttccttc

SEQ ID NO: 420819 - DNA, 20 bp, Artificial Sequence
  chemically synthesized
tcctatatactagagccaga

SEQ ID NO: 420820 - DNA, 20 bp, Artificial Sequence
  chemically synthesized
gatttgtttccttctggctc

SEQ ID NO: 420821 - DNA, 20 bp, Artificial Sequence
  chemically synthesized
ttcctatatactagagccag

SEQ ID NO: 420822 - DNA, 20 bp, Artificial Sequence
  chemically synthesized
tctttcctatatactagagc

SEQ ID NO: 420823 - DNA, 20 bp, Artificial Sequence
  chemically synthesized
ttccttctggctctagtata

SEQ ID NO: 420824 - DNA, 20 bp, Artificial Sequence
  chemically synthesized
aatgtctttcctatatacta

SEQ ID NO: 420825 - DNA, 20 bp, Artificial Sequence
  chemically synthesized
tccttctggctctagtatat

SEQ ID NO: 420826 - DNA, 20 bp, Artificial Sequence
  chemically synthesized
caaatgtctttcctatatac

SEQ ID NO: 420827 - DNA, 20 bp, Artificial Sequence
  chemically synthesized
tctggctctagtatatagga

SEQ ID NO: 420828 - DNA, 20 bp, Artificial Sequence
  chemically synthesized
atataggaaagacatttgca

SEQ ID NO: 420829 - DNA, 20 bp, Artificial Sequence
  chemically synthesized
taggaaagacatttgcaaag

SEQ ID NO: 420830 - DNA, 20 bp, Artificial Sequence
  chemically synthesized
aggaaagacatttgcaaagc

SEQ ID NO: 420831 - DNA, 20 bp, Artificial Sequence
  chemically synthesized
aagcaggtattccaaaatat

SEQ ID NO: 420832 - DNA, 20 bp, Artificial Sequence
  chemically synthesized
agcaggtattccaaaatatg

SEQ ID NO: 420833 - DNA, 20 bp, Artificial Sequence
  chemically synthesized
gatgattttgcctcatattt

SEQ ID NO: 420834 - DNA, 20 bp, Artificial Sequence
  chemically synthesized
atttttttgggggggggggc

SEQ ID NO: 420835 - DNA, 20 bp, Artificial Sequence
  chemically synthesized
gaagatttttttgggggggg

SEQ ID NO: 420836 - DNA, 20 bp, Artificial Sequence
  chemically synthesized
agaagatttttttggggggg

SEQ ID NO: 420837 - DNA, 20 bp, Artificial Sequence
  chemically synthesized
tagaagatttttttgggggg

SEQ ID NO: 420838 - DNA, 20 bp, Artificial Sequence
  chemically synthesized
ctagaagatttttttggggg

SEQ ID NO: 420839 - DNA, 20 bp, Artificial Sequence
  chemically synthesized
gctagaagatttttttgggg

SEQ ID NO: 420840 - DNA, 20 bp, Artificial Sequence
  chemically synthesized
tgctagaagatttttttggg

SEQ ID NO: 420841 - DNA, 20 bp, Artificial Sequence
  chemically synthesized
ttgctagaagatttttttgg

SEQ ID NO: 420842 - DNA, 20 bp, Artificial Sequence
  chemically synthesized
gttgctagaagatttttttg

SEQ ID NO: 420843 - DNA, 20 bp, Artificial Sequence
  chemically synthesized
agttgctagaagattttttt

SEQ ID NO: 420844 - DNA, 20 bp, Artificial Sequence
  chemically synthesized
cagttgctagaagatttttt

SEQ ID NO: 420845 - DNA, 20 bp, Artificial Sequence
  chemically synthesized
ccccccccaaaaaaatcttc

SEQ ID NO: 420846 - DNA, 20 bp, Artificial Sequence
  chemically synthesized
tgtgttacaacagttgctag

SEQ ID NO: 420847 - DNA, 20 bp, Artificial Sequence
  chemically synthesized
ctctgtgttacaacagttgc

SEQ ID NO: 420848 - DNA, 20 bp, Artificial Sequence
  chemically synthesized
ataatggctctgtgttacaa

SEQ ID NO: 420849 - DNA, 20 bp, Artificial Sequence
  chemically synthesized
ttctagcaactgttgtaaca

SEQ ID NO: 420850 - DNA, 20 bp, Artificial Sequence
  chemically synthesized
ctagcaactgttgtaacaca

SEQ ID NO: 420851 - DNA, 20 bp, Artificial Sequence
  chemically synthesized
tctgtctaattacattataa

SEQ ID NO: 420852 - DNA, 20 bp, Artificial Sequence
  chemically synthesized
cagagccattataatgtaat

SEQ ID NO: 420853 - DNA, 20 bp, Artificial Sequence
  chemically synthesized
gccattataatgtaattaga

SEQ ID NO: 420854 - DNA, 20 bp, Artificial Sequence
  chemically synthesized
ataatgtaattagacagact

SEQ ID NO: 420855 - DNA, 20 bp, Artificial Sequence
  chemically synthesized
taattagacagactaagaac

SEQ ID NO: 420856 - DNA, 20 bp, Artificial Sequence
  chemically synthesized
cttccttagcatctggttct

SEQ ID NO: 420857 - DNA, 20 bp, Artificial Sequence
  chemically synthesized
cagactaagaaccagatgct

SEQ ID NO: 420858 - DNA, 20 bp, Artificial Sequence
  chemically synthesized
agactaagaaccagatgcta

SEQ ID NO: 420859 - DNA, 20 bp, Artificial Sequence
  chemically synthesized
tattttgcttccttagcatc

SEQ ID NO: 420860 - DNA, 20 bp, Artificial Sequence
  chemically synthesized
ctaagaaccagatgctaagg

SEQ ID NO: 420861 - DNA, 20 bp, Artificial Sequence
  chemically synthesized
tcttttatattttgcttcct

SEQ ID NO: 420862 - DNA, 20 bp, Artificial Sequence
  chemically synthesized
gctaaggaagcaaaatataa

SEQ ID NO: 420863 - DNA, 20 bp, Artificial Sequence
  chemically synthesized
gaagcaaaatataaaagatg

SEQ ID NO: 420864 - DNA, 20 bp, Artificial Sequence
  chemically synthesized
gatgaagcatgatattattt

SEQ ID NO: 420865 - DNA, 20 bp, Artificial Sequence
  chemically synthesized
gaatttaattccaaatgtta

SEQ ID NO: 420866 - DNA, 20 bp, Artificial Sequence
  chemically synthesized
tgaatcactcctgtaacatt

SEQ ID NO: 420867 - DNA, 20 bp, Artificial Sequence
  chemically synthesized
aatttaattccaaatgttac

SEQ ID NO: 420868 - DNA, 20 bp, Artificial Sequence
  chemically synthesized
tttaattccaaatgttacag

SEQ ID NO: 420869 - DNA, 20 bp, Artificial Sequence
  chemically synthesized
aatgttacaggagtgattca

SEQ ID NO: 420870 - DNA, 20 bp, Artificial Sequence
  chemically synthesized
ctgatcttttgggaaaaaaa

SEQ ID NO: 420871 - DNA, 20 bp, Artificial Sequence
  chemically synthesized
atggactttttttttcccaa

SEQ ID NO: 420872 - DNA, 20 bp, Artificial Sequence
  chemically synthesized
ctttttttttcccaaaagat

SEQ ID NO: 420873 - DNA, 20 bp, Artificial Sequence
  chemically synthesized
catgtgacaactgatctttt

SEQ ID NO: 420874 - DNA, 20 bp, Artificial Sequence
  chemically synthesized
acatgtgacaactgatcttt

SEQ ID NO: 420875 - DNA, 20 bp, Artificial Sequence
  chemically synthesized
tgatgtttatgtaatctaat

SEQ ID NO: 420876 - DNA, 20 bp, Artificial Sequence
  chemically synthesized
tttatgtaatctaatgagaa

SEQ ID NO: 420877 - DNA, 20 bp, Artificial Sequence
  chemically synthesized
tgagaatttacttttctcat

SEQ ID NO: 420878 - DNA, 20 bp, Artificial Sequence
  chemically synthesized
cgaaacatctaatattacat

SEQ ID NO: 420879 - DNA, 20 bp, Artificial Sequence
  chemically synthesized
agtaaattctcatgtaatat

SEQ ID NO: 420880 - DNA, 20 bp, Artificial Sequence
  chemically synthesized
taatattagatgtttcgaaa

SEQ ID NO: 420881 - DNA, 20 bp, Artificial Sequence
  chemically synthesized
gtttcgaaatggataaactg

SEQ ID NO: 420882 - DNA, 20 bp, Artificial Sequence
  chemically synthesized
tctacccgtggaagtgtctg

SEQ ID NO: 420883 - DNA, 20 bp, Artificial Sequence
  chemically synthesized
ataaactgcagacacttcca

SEQ ID NO: 420884 - DNA, 20 bp, Artificial Sequence
  chemically synthesized
taaactgcagacacttccac

SEQ ID NO: 420885 - DNA, 20 bp, Artificial Sequence
  chemically synthesized
actgcagacacttccacggg

SEQ ID NO: 420886 - DNA, 20 bp, Artificial Sequence
  chemically synthesized
aattattcatctacccgtgg

SEQ ID NO: 420887 - DNA, 20 bp, Artificial Sequence
  chemically synthesized
acgaattattcatctacccg

SEQ ID NO: 420888 - DNA, 20 bp, Artificial Sequence
  chemically synthesized
gtagatgaataattcgtcaa

SEQ ID NO: 420889 - DNA, 20 bp, Artificial Sequence
  chemically synthesized
aataattcgtcaatagtgat

SEQ ID NO: 420890 - DNA, 20 bp, Artificial Sequence
  chemically synthesized
cattttgaggggtaagttta

SEQ ID NO: 420891 - DNA, 20 bp, Artificial Sequence
  chemically synthesized
tcttaaccattttgaggggt

SEQ ID NO: 420892 - DNA, 20 bp, Artificial Sequence
  chemically synthesized
tttaaacttacccctcaaaa

SEQ ID NO: 420893 - DNA, 20 bp, Artificial Sequence
  chemically synthesized
taactcttaaccattttgag

SEQ ID NO: 420894 - DNA, 20 bp, Artificial Sequence
  chemically synthesized
ctaactcttaaccattttga

SEQ ID NO: 420895 - DNA, 20 bp, Artificial Sequence
  chemically synthesized
cctaactcttaaccattttg

SEQ ID NO: 420896 - DNA, 20 bp, Artificial Sequence
  chemically synthesized
acctaactcttaaccatttt

SEQ ID NO: 420897 - DNA, 20 bp, Artificial Sequence
  chemically synthesized
acttacccctcaaaatggtt

SEQ ID NO: 420898 - DNA, 20 bp, Artificial Sequence
  chemically synthesized
ttacccctcaaaatggttaa

SEQ ID NO: 420899 - DNA, 20 bp, Artificial Sequence
  chemically synthesized
ccctcaaaatggttaagagt

SEQ ID NO: 420900 - DNA, 20 bp, Artificial Sequence
  chemically synthesized
cctcaaaatggttaagagtt

SEQ ID NO: 420901 - DNA, 20 bp, Artificial Sequence
  chemically synthesized
atggaattatattacattta

SEQ ID NO: 420902 - DNA, 20 bp, Artificial Sequence
  chemically synthesized
ttttgtcttggttattttta

SEQ ID NO: 420903 - DNA, 20 bp, Artificial Sequence
  chemically synthesized
ataattccataaaaataacc

SEQ ID NO: 420904 - DNA, 20 bp, Artificial Sequence
  chemically synthesized
ttctaaagtattttttgtct

SEQ ID NO: 420905 - DNA, 20 bp, Artificial Sequence
  chemically synthesized
aaccaagacaaaaaatactt

SEQ ID NO: 420906 - DNA, 20 bp, Artificial Sequence
  chemically synthesized
ttatattttcaatatttcta

SEQ ID NO: 420907 - DNA, 20 bp, Artificial Sequence
  chemically synthesized
taccagattgaggatattag

SEQ ID NO: 420908 - DNA, 20 bp, Artificial Sequence
  chemically synthesized
ataccagattgaggatatta

SEQ ID NO: 420909 - DNA, 20 bp, Artificial Sequence
  chemically synthesized
taataccagattgaggatat

SEQ ID NO: 420910 - DNA, 20 bp, Artificial Sequence
  chemically synthesized
ttcctctaatatcctcaatc

SEQ ID NO: 420911 - DNA, 20 bp, Artificial Sequence
  chemically synthesized
tacacaataataccagattg

SEQ ID NO: 420912 - DNA, 20 bp, Artificial Sequence
  chemically synthesized
ttacacaataataccagatt

SEQ ID NO: 420913 - DNA, 20 bp, Artificial Sequence
  chemically synthesized
ttcgaattacacaataatac

SEQ ID NO: 420914 - DNA, 20 bp, Artificial Sequence
  chemically synthesized
tattgtgtaattcgaatata

SEQ ID NO: 420915 - DNA, 20 bp, Artificial Sequence
  chemically synthesized
tattattttttttttttttt

SEQ ID NO: 420916 - DNA, 20 bp, Artificial Sequence
  chemically synthesized
atttttttttttttttgaga

SEQ ID NO: 420917 - DNA, 20 bp, Artificial Sequence
  chemically synthesized
tccagcctgggcaaaaaagt

SEQ ID NO: 420918 - DNA, 20 bp, Artificial Sequence
  chemically synthesized
cagaatctcacttttttgcc

SEQ ID NO: 420919 - DNA, 20 bp, Artificial Sequence
  chemically synthesized
gcactccagcctgggcaaaa

SEQ ID NO: 420920 - DNA, 20 bp, Artificial Sequence
  chemically synthesized
agaatctcacttttttgccc

SEQ ID NO: 420921 - DNA, 20 bp, Artificial Sequence
  chemically synthesized
tctcacttttttgcccaggc

SEQ ID NO: 420922 - DNA, 20 bp, Artificial Sequence
  chemically synthesized
tcacttttttgcccaggctg

SEQ ID NO: 420923 - DNA, 20 bp, Artificial Sequence
  chemically synthesized
atgccactgcactccagcct

SEQ ID NO: 420924 - DNA, 20 bp, Artificial Sequence
  chemically synthesized
catgccactgcactccagcc

SEQ ID NO: 420925 - DNA, 20 bp, Artificial Sequence
  chemically synthesized
tttttgcccaggctggagtg

SEQ ID NO: 420926 - DNA, 20 bp, Artificial Sequence
  chemically synthesized
aagaacatgccactgcactc

SEQ ID NO: 420927 - DNA, 20 bp, Artificial Sequence
  chemically synthesized
ttgcccaggctggagtgcag

SEQ ID NO: 420928 - DNA, 20 bp, Artificial Sequence
  chemically synthesized
ggagtgcagtggcatgttct

SEQ ID NO: 420929 - DNA, 20 bp, Artificial Sequence
  chemically synthesized
ggtggaggctgcagtaagcc

SEQ ID NO: 420930 - DNA, 20 bp, Artificial Sequence
  chemically synthesized
ggcatgttcttggcttactg

SEQ ID NO: 420931 - DNA, 20 bp, Artificial Sequence
  chemically synthesized
cgggaggtggaggctgcagt

SEQ ID NO: 420932 - DNA, 20 bp, Artificial Sequence
  chemically synthesized
aacccgggaggtggaggctg

SEQ ID NO: 420933 - DNA, 20 bp, Artificial Sequence
  chemically synthesized
cgcttgaacccgggaggtgg

SEQ ID NO: 420934 - DNA, 20 bp, Artificial Sequence
  chemically synthesized
ttactgcagcctccacctcc

SEQ ID NO: 420935 - DNA, 20 bp, Artificial Sequence
  chemically synthesized
tcgcttgaacccgggaggtg

SEQ ID NO: 420936 - DNA, 20 bp, Artificial Sequence
  chemically synthesized
tactgcagcctccacctccc

SEQ ID NO: 420937 - DNA, 20 bp, Artificial Sequence
  chemically synthesized
aatcgcttgaacccgggagg

SEQ ID NO: 420938 - DNA, 20 bp, Artificial Sequence
  chemically synthesized
gagaatcgcttgaacccggg

SEQ ID NO: 420939 - DNA, 20 bp, Artificial Sequence
  chemically synthesized
ggagaatcgcttgaacccgg

SEQ ID NO: 420940 - DNA, 20 bp, Artificial Sequence
  chemically synthesized
agcctccacctcccgggttc

SEQ ID NO: 420941 - DNA, 20 bp, Artificial Sequence
  chemically synthesized
caggagaatcgcttgaaccc

SEQ ID NO: 420942 - DNA, 20 bp, Artificial Sequence
  chemically synthesized
acaggagaatcgcttgaacc

SEQ ID NO: 420943 - DNA, 20 bp, Artificial Sequence
  chemically synthesized
ttcaagcgattctcctgtct

SEQ ID NO: 420944 - DNA, 20 bp, Artificial Sequence
  chemically synthesized
tactcgggaggctgagacag

SEQ ID NO: 420945 - DNA, 20 bp, Artificial Sequence
  chemically synthesized
gctactcgggaggctgagac

SEQ ID NO: 420946 - DNA, 20 bp, Artificial Sequence
  chemically synthesized
agctactcgggaggctgaga

SEQ ID NO: 420947 - DNA, 20 bp, Artificial Sequence
  chemically synthesized
tctcagctactcgggaggct

SEQ ID NO: 420948 - DNA, 20 bp, Artificial Sequence
  chemically synthesized
ttctcctgtctcagcctccc

SEQ ID NO: 420949 - DNA, 20 bp, Artificial Sequence
  chemically synthesized
tcctgtctcagcctcccgag

SEQ ID NO: 420950 - DNA, 20 bp, Artificial Sequence
  chemically synthesized
tgtaatctcagctactcggg

SEQ ID NO: 420951 - DNA, 20 bp, Artificial Sequence
  chemically synthesized
ctgtaatctcagctactcgg

SEQ ID NO: 420952 - DNA, 20 bp, Artificial Sequence
  chemically synthesized
atctgtaatctcagctactc

SEQ ID NO: 420953 - DNA, 20 bp, Artificial Sequence
  chemically synthesized
tctcagcctcccgagtagct

SEQ ID NO: 420954 - DNA, 20 bp, Artificial Sequence
  chemically synthesized
catctgtaatctcagctact

SEQ ID NO: 420955 - DNA, 20 bp, Artificial Sequence
  chemically synthesized
ctcccgagtagctgagatta

SEQ ID NO: 420956 - DNA, 20 bp, Artificial Sequence
  chemically synthesized
gtggtgggcatctgtaatct

SEQ ID NO: 420957 - DNA, 20 bp, Artificial Sequence
  chemically synthesized
atttagccaggcgtggtggt

SEQ ID NO: 420958 - DNA, 20 bp, Artificial Sequence
  chemically synthesized
aatttagccaggcgtggtgg

SEQ ID NO: 420959 - DNA, 20 bp, Artificial Sequence
  chemically synthesized
cagatgcccaccaccacgcc

SEQ ID NO: 420960 - DNA, 20 bp, Artificial Sequence
  chemically synthesized
caaaatttagccaggcgtgg

SEQ ID NO: 420961 - DNA, 20 bp, Artificial Sequence
  chemically synthesized
atacaaaatttagccaggcg

SEQ ID NO: 420962 - DNA, 20 bp, Artificial Sequence
  chemically synthesized
taaaaatacaaaatttagcc

SEQ ID NO: 420963 - DNA, 20 bp, Artificial Sequence
  chemically synthesized
ctaaaaatacaaaatttagc

SEQ ID NO: 420964 - DNA, 20 bp, Artificial Sequence
  chemically synthesized
tctactaaaaatacaaaatt

SEQ ID NO: 420965 - DNA, 20 bp, Artificial Sequence
  chemically synthesized
ctggctaaattttgtatttt

SEQ ID NO: 420966 - DNA, 20 bp, Artificial Sequence
  chemically synthesized
gctaaattttgtatttttag

SEQ ID NO: 420967 - DNA, 20 bp, Artificial Sequence
  chemically synthesized
taaattttgtatttttagta

SEQ ID NO: 420968 - DNA, 20 bp, Artificial Sequence
  chemically synthesized
ttttgtatttttagtagaga

SEQ ID NO: 420969 - DNA, 20 bp, Artificial Sequence
  chemically synthesized
tttgtatttttagtagagac

SEQ ID NO: 420970 - DNA, 20 bp, Artificial Sequence
  chemically synthesized
ttgtatttttagtagagacg

SEQ ID NO: 420971 - DNA, 20 bp, Artificial Sequence
  chemically synthesized
gagacggggtttcaccatgt

SEQ ID NO: 420972 - DNA, 20 bp, Artificial Sequence
  chemically synthesized
cggggtttcaccatgttggc

SEQ ID NO: 420973 - DNA, 20 bp, Artificial Sequence
  chemically synthesized
cgagaccagcctggccaaca

SEQ ID NO: 420974 - DNA, 20 bp, Artificial Sequence
  chemically synthesized
ggggtttcaccatgttggcc

SEQ ID NO: 420975 - DNA, 20 bp, Artificial Sequence
  chemically synthesized
tttcaccatgttggccaggc

SEQ ID NO: 420976 - DNA, 20 bp, Artificial Sequence
  chemically synthesized
tcaggagttcgagaccagcc

SEQ ID NO: 420977 - DNA, 20 bp, Artificial Sequence
  chemically synthesized
tgaggtcaggagttcgagac

SEQ ID NO: 420978 - DNA, 20 bp, Artificial Sequence
  chemically synthesized
tcacctgaggtcaggagttc

SEQ ID NO: 420979 - DNA, 20 bp, Artificial Sequence
  chemically synthesized
tggtctcgaactcctgacct

SEQ ID NO: 420980 - DNA, 20 bp, Artificial Sequence
  chemically synthesized
ggcggatcacctgaggtcag

SEQ ID NO: 420981 - DNA, 20 bp, Artificial Sequence
  chemically synthesized
ggtctcgaactcctgacctc

SEQ ID NO: 420982 - DNA, 20 bp, Artificial Sequence
  chemically synthesized
caggcggatcacctgaggtc

SEQ ID NO: 420983 - DNA, 20 bp, Artificial Sequence
  chemically synthesized
gcaggcggatcacctgaggt

SEQ ID NO: 420984 - DNA, 20 bp, Artificial Sequence
  chemically synthesized
tgaggcaggcggatcacctg

SEQ ID NO: 420985 - DNA, 20 bp, Artificial Sequence
  chemically synthesized
ctgaggcaggcggatcacct

SEQ ID NO: 420986 - DNA, 20 bp, Artificial Sequence
  chemically synthesized
ctcaggtgatccgcctgcct

SEQ ID NO: 420987 - DNA, 20 bp, Artificial Sequence
  chemically synthesized
ctttgggagtctgaggcagg

SEQ ID NO: 420988 - DNA, 20 bp, Artificial Sequence
  chemically synthesized
gcactttgggagtctgaggc

SEQ ID NO: 420989 - DNA, 20 bp, Artificial Sequence
  chemically synthesized
agcactttgggagtctgagg

SEQ ID NO: 420990 - DNA, 20 bp, Artificial Sequence
  chemically synthesized
atcagcactttgggagtctg

SEQ ID NO: 420991 - DNA, 20 bp, Artificial Sequence
  chemically synthesized
tatcagcactttgggagtct

SEQ ID NO: 420992 - DNA, 20 bp, Artificial Sequence
  chemically synthesized
ccgcctgcctcagactccca

SEQ ID NO: 420993 - DNA, 20 bp, Artificial Sequence
  chemically synthesized
ctgtaatatcagcactttgg

SEQ ID NO: 420994 - DNA, 20 bp, Artificial Sequence
  chemically synthesized
acctgtaatatcagcacttt

SEQ ID NO: 420995 - DNA, 20 bp, Artificial Sequence
  chemically synthesized
cacctgtaatatcagcactt

SEQ ID NO: 420996 - DNA, 20 bp, Artificial Sequence
  chemically synthesized
ctcccaaagtgctgatatta

SEQ ID NO: 420997 - DNA, 20 bp, Artificial Sequence
  chemically synthesized
tcccaaagtgctgatattac

SEQ ID NO: 420998 - DNA, 20 bp, Artificial Sequence
  chemically synthesized
gtggctcacacctgtaatat

SEQ ID NO: 420999 - DNA, 20 bp, Artificial Sequence
  chemically synthesized
agtgctgatattacaggtgt

SEQ ID NO: 421000 - DNA, 20 bp, Artificial Sequence
  chemically synthesized
ttgctggccgggcacggtgg

SEQ ID NO: 421001 - DNA, 20 bp, Artificial Sequence
  chemically synthesized
gtgtgagccaccaccgtgcc

SEQ ID NO: 421002 - DNA, 20 bp, Artificial Sequence
  chemically synthesized
attttgctggccgggcacgg

SEQ ID NO: 421003 - DNA, 20 bp, Artificial Sequence
  chemically synthesized
attattttgctggccgggca

SEQ ID NO: 421004 - DNA, 20 bp, Artificial Sequence
  chemically synthesized
gagccaccaccgtgcccggc

SEQ ID NO: 421005 - DNA, 20 bp, Artificial Sequence
  chemically synthesized
taagaattattttgctggcc

SEQ ID NO: 421006 - DNA, 20 bp, Artificial Sequence
  chemically synthesized
ttaagaattattttgctggc

SEQ ID NO: 421007 - DNA, 20 bp, Artificial Sequence
  chemically synthesized
aattttaagaattattttgc

SEQ ID NO: 421008 - DNA, 20 bp, Artificial Sequence
  chemically synthesized
taatttttaagttgaatttt

SEQ ID NO: 421009 - DNA, 20 bp, Artificial Sequence
  chemically synthesized
catttcttggagtaattttt

SEQ ID NO: 421010 - DNA, 20 bp, Artificial Sequence
  chemically synthesized
ttcaacttaaaaattactcc

SEQ ID NO: 421011 - DNA, 20 bp, Artificial Sequence
  chemically synthesized
ttttacctacacatttcttg

SEQ ID NO: 421012 - DNA, 20 bp, Artificial Sequence
  chemically synthesized
acttttacctacacatttct

SEQ ID NO: 421013 - DNA, 20 bp, Artificial Sequence
  chemically synthesized
aaattactccaagaaatgtg

SEQ ID NO: 421014 - DNA, 20 bp, Artificial Sequence
  chemically synthesized
aattactccaagaaatgtgt

SEQ ID NO: 421015 - DNA, 20 bp, Artificial Sequence
  chemically synthesized
tccaagaaatgtgtaggtaa

SEQ ID NO: 421016 - DNA, 20 bp, Artificial Sequence
  chemically synthesized
aggtaaaagtcaaaacactt

SEQ ID NO: 421017 - DNA, 20 bp, Artificial Sequence
  chemically synthesized
tacaaaatgtggatttacta

SEQ ID NO: 421018 - DNA, 20 bp, Artificial Sequence
  chemically synthesized
ataaatggaaatacaaaatg

SEQ ID NO: 421019 - DNA, 20 bp, Artificial Sequence
  chemically synthesized
acattttgtatttccattta

SEQ ID NO: 421020 - DNA, 20 bp, Artificial Sequence
  chemically synthesized
gcactagaggttactataaa

SEQ ID NO: 421021 - DNA, 20 bp, Artificial Sequence
  chemically synthesized
tttccatttatagtaacctc

SEQ ID NO: 421022 - DNA, 20 bp, Artificial Sequence
  chemically synthesized
ttcaaaataatgagcactag

SEQ ID NO: 421023 - DNA, 20 bp, Artificial Sequence
  chemically synthesized
cttcaaaataatgagcacta

SEQ ID NO: 421024 - DNA, 20 bp, Artificial Sequence
  chemically synthesized
atcttcaaaataatgagcac

SEQ ID NO: 421025 - DNA, 20 bp, Artificial Sequence
  chemically synthesized
agttttatcttcaaaataat

SEQ ID NO: 421026 - DNA, 20 bp, Artificial Sequence
  chemically synthesized
ctctagtgctcattattttg

SEQ ID NO: 421027 - DNA, 20 bp, Artificial Sequence
  chemically synthesized
gaagataaaactttcttata

SEQ ID NO: 421028 - DNA, 20 bp, Artificial Sequence
  chemically synthesized
aaaaagcttactgtataaga

SEQ ID NO: 421029 - DNA, 20 bp, Artificial Sequence
  chemically synthesized
ataaaactttcttatacagt

SEQ ID NO: 421030 - DNA, 20 bp, Artificial Sequence
  chemically synthesized
ttttaaaaagcttactgtat

SEQ ID NO: 421031 - DNA, 20 bp, Artificial Sequence
  chemically synthesized
atttggtctcacattttaaa

SEQ ID NO: 421032 - DNA, 20 bp, Artificial Sequence
  chemically synthesized
cagtaagctttttaaaatgt

SEQ ID NO: 421033 - DNA, 20 bp, Artificial Sequence
  chemically synthesized
tacgctcttgttgtttgatt

SEQ ID NO: 421034 - DNA, 20 bp, Artificial Sequence
  chemically synthesized
gtgagaccaaatcaaacaac

SEQ ID NO: 421035 - DNA, 20 bp, Artificial Sequence
  chemically synthesized
gagaccaaatcaaacaacaa

SEQ ID NO: 421036 - DNA, 20 bp, Artificial Sequence
  chemically synthesized
aagagcgtaatgaaaaacga

SEQ ID NO: 421037 - DNA, 20 bp, Artificial Sequence
  chemically synthesized
agcgtaatgaaaaacgatag

SEQ ID NO: 421038 - DNA, 20 bp, Artificial Sequence
  chemically synthesized
gcgtaatgaaaaacgataga

SEQ ID NO: 421039 - DNA, 20 bp, Artificial Sequence
  chemically synthesized
agaaggaaaacaactaaaat

SEQ ID NO: 421040 - DNA, 20 bp, Artificial Sequence
  chemically synthesized
gagctaggaggttcttattt

SEQ ID NO: 421041 - DNA, 20 bp, Artificial Sequence
  chemically synthesized
caactaaaataagaacctcc

SEQ ID NO: 421042 - DNA, 20 bp, Artificial Sequence
  chemically synthesized
aaaataagaacctcctagct

SEQ ID NO: 421043 - DNA, 20 bp, Artificial Sequence
  chemically synthesized
tagaataaatctgagctagg

SEQ ID NO: 421044 - DNA, 20 bp, Artificial Sequence
  chemically synthesized
ttagaataaatctgagctag

SEQ ID NO: 421045 - DNA, 20 bp, Artificial Sequence
  chemically synthesized
ttttagaataaatctgagct

SEQ ID NO: 421046 - DNA, 20 bp, Artificial Sequence
  chemically synthesized
tttttagaataaatctgagc

SEQ ID NO: 421047 - DNA, 20 bp, Artificial Sequence
  chemically synthesized
caactttttagaataaatct

SEQ ID NO: 421048 - DNA, 20 bp, Artificial Sequence
  chemically synthesized
tagctcagatttattctaaa

SEQ ID NO: 421049 - DNA, 20 bp, Artificial Sequence
  chemically synthesized
tatatttattttcaactttt

SEQ ID NO: 421050 - DNA, 20 bp, Artificial Sequence
  chemically synthesized
agttgaaaataaatataatg

SEQ ID NO: 421051 - DNA, 20 bp, Artificial Sequence
  chemically synthesized
tgaaaataaatataatgtag

SEQ ID NO: 421052 - DNA, 20 bp, Artificial Sequence
  chemically synthesized
taaataataatattttttca

SEQ ID NO: 421053 - DNA, 20 bp, Artificial Sequence
  chemically synthesized
taataatattttttcataga

SEQ ID NO: 421054 - DNA, 20 bp, Artificial Sequence
  chemically synthesized
tttttcatagatagtaacac

SEQ ID NO: 421055 - DNA, 20 bp, Artificial Sequence
  chemically synthesized
ttctactttcagagtaaagc

SEQ ID NO: 421056 - DNA, 20 bp, Artificial Sequence
  chemically synthesized
cagattctactttcagagta

SEQ ID NO: 421057 - DNA, 20 bp, Artificial Sequence
  chemically synthesized
taacactagctttactctga

SEQ ID NO: 421058 - DNA, 20 bp, Artificial Sequence
  chemically synthesized
cactagctttactctgaaag

SEQ ID NO: 421059 - DNA, 20 bp, Artificial Sequence
  chemically synthesized
aagcacagattctactttca

SEQ ID NO: 421060 - DNA, 20 bp, Artificial Sequence
  chemically synthesized
tgaagcacagattctacttt

SEQ ID NO: 421061 - DNA, 20 bp, Artificial Sequence
  chemically synthesized
caggcactattaatgaagca

SEQ ID NO: 421062 - DNA, 20 bp, Artificial Sequence
  chemically synthesized
tagaatctgtgcttcattaa

SEQ ID NO: 421063 - DNA, 20 bp, Artificial Sequence
  chemically synthesized
aaacacaggcactattaatg

SEQ ID NO: 421064 - DNA, 20 bp, Artificial Sequence
  chemically synthesized
gttatcaaagtgttaaacac

SEQ ID NO: 421065 - DNA, 20 bp, Artificial Sequence
  chemically synthesized
agttatcaaagtgttaaaca

SEQ ID NO: 421066 - DNA, 20 bp, Artificial Sequence
  chemically synthesized
ttctgtatggtgagttatca

SEQ ID NO: 421067 - DNA, 20 bp, Artificial Sequence
  chemically synthesized
cactttgataactcaccata

SEQ ID NO: 421068 - DNA, 20 bp, Artificial Sequence
  chemically synthesized
aggctatacttctgtatggt

SEQ ID NO: 421069 - DNA, 20 bp, Artificial Sequence
  chemically synthesized
tttgataactcaccatacag

SEQ ID NO: 421070 - DNA, 20 bp, Artificial Sequence
  chemically synthesized
actgaggctatacttctgta

SEQ ID NO: 421071 - DNA, 20 bp, Artificial Sequence
  chemically synthesized
taactcaccatacagaagta

SEQ ID NO: 421072 - DNA, 20 bp, Artificial Sequence
  chemically synthesized
accatacagaagtatagcct

SEQ ID NO: 421073 - DNA, 20 bp, Artificial Sequence
  chemically synthesized
acaggaatctgggaacactg

SEQ ID NO: 421074 - DNA, 20 bp, Artificial Sequence
  chemically synthesized
aacaggaatctgggaacact

SEQ ID NO: 421075 - DNA, 20 bp, Artificial Sequence
  chemically synthesized
aagtatagcctcagtgttcc

SEQ ID NO: 421076 - DNA, 20 bp, Artificial Sequence
  chemically synthesized
atccctaggaacaggaatct

SEQ ID NO: 421077 - DNA, 20 bp, Artificial Sequence
  chemically synthesized
catccctaggaacaggaatc

SEQ ID NO: 421078 - DNA, 20 bp, Artificial Sequence
  chemically synthesized
tgttcccagattcctgttcc

SEQ ID NO: 421079 - DNA, 20 bp, Artificial Sequence
  chemically synthesized
gttcccagattcctgttcct

SEQ ID NO: 421080 - DNA, 20 bp, Artificial Sequence
  chemically synthesized
ttcccagattcctgttccta

SEQ ID NO: 421081 - DNA, 20 bp, Artificial Sequence
  chemically synthesized
gatcattcatccctaggaac

SEQ ID NO: 421082 - DNA, 20 bp, Artificial Sequence
  chemically synthesized
tgatcattcatccctaggaa

SEQ ID NO: 421083 - DNA, 20 bp, Artificial Sequence
  chemically synthesized
taatgtgatcattcatccct

SEQ ID NO: 421084 - DNA, 20 bp, Artificial Sequence
  chemically synthesized
ctaatgtgatcattcatccc

SEQ ID NO: 421085 - DNA, 20 bp, Artificial Sequence
  chemically synthesized
ctagggatgaatgatcacat

SEQ ID NO: 421086 - DNA, 20 bp, Artificial Sequence
  chemically synthesized
tagggatgaatgatcacatt

SEQ ID NO: 421087 - DNA, 20 bp, Artificial Sequence
  chemically synthesized
ggatgaatgatcacattagg

SEQ ID NO: 421088 - DNA, 20 bp, Artificial Sequence
  chemically synthesized
gatgaatgatcacattagga

SEQ ID NO: 421089 - DNA, 20 bp, Artificial Sequence
  chemically synthesized
aaggtacattcctgttaatt

SEQ ID NO: 421090 - DNA, 20 bp, Artificial Sequence
  chemically synthesized
gcagatttagccaaattaac

SEQ ID NO: 421091 - DNA, 20 bp, Artificial Sequence
  chemically synthesized
ggcagatttagccaaattaa

SEQ ID NO: 421092 - DNA, 20 bp, Artificial Sequence
  chemically synthesized
gttaatttggctaaatctgc

SEQ ID NO: 421093 - DNA, 20 bp, Artificial Sequence
  chemically synthesized
atgatttgggctggcagatt

SEQ ID NO: 421094 - DNA, 20 bp, Artificial Sequence
  chemically synthesized
aactttatgatttgggctgg

SEQ ID NO: 421095 - DNA, 20 bp, Artificial Sequence
  chemically synthesized
gagaactttatgatttgggc

SEQ ID NO: 421096 - DNA, 20 bp, Artificial Sequence
  chemically synthesized
ttaggagaactttatgattt

SEQ ID NO: 421097 - DNA, 20 bp, Artificial Sequence
  chemically synthesized
atctgccagcccaaatcata

SEQ ID NO: 421098 - DNA, 20 bp, Artificial Sequence
  chemically synthesized
tttaggagaactttatgatt

SEQ ID NO: 421099 - DNA, 20 bp, Artificial Sequence
  chemically synthesized
caaatcataaagttctccta

SEQ ID NO: 421100 - DNA, 20 bp, Artificial Sequence
  chemically synthesized
ttgagatagagcatctttag

SEQ ID NO: 421101 - DNA, 20 bp, Artificial Sequence
  chemically synthesized
tcttgagatagagcatcttt

SEQ ID NO: 421102 - DNA, 20 bp, Artificial Sequence
  chemically synthesized
ctcttgagatagagcatctt

SEQ ID NO: 421103 - DNA, 20 bp, Artificial Sequence
  chemically synthesized
tcctaaagatgctctatctc

SEQ ID NO: 421104 - DNA, 20 bp, Artificial Sequence
  chemically synthesized
aagtgtttgctcttgagata

SEQ ID NO: 421105 - DNA, 20 bp, Artificial Sequence
  chemically synthesized
ctaaagatgctctatctcaa

SEQ ID NO: 421106 - DNA, 20 bp, Artificial Sequence
  chemically synthesized
ctaagtgtttgctcttgaga

SEQ ID NO: 421107 - DNA, 20 bp, Artificial Sequence
  chemically synthesized
tttcctaagtgtttgctctt

SEQ ID NO: 421108 - DNA, 20 bp, Artificial Sequence
  chemically synthesized
ctatctcaagagcaaacact

SEQ ID NO: 421109 - DNA, 20 bp, Artificial Sequence
  chemically synthesized
tatctcaagagcaaacactt

SEQ ID NO: 421110 - DNA, 20 bp, Artificial Sequence
  chemically synthesized
taaacattaacaattttcct

SEQ ID NO: 421111 - DNA, 20 bp, Artificial Sequence
  chemically synthesized
aaattgttaatgtttataac

SEQ ID NO: 421112 - DNA, 20 bp, Artificial Sequence
  chemically synthesized
aattgttaatgtttataaca

SEQ ID NO: 421113 - DNA, 20 bp, Artificial Sequence
  chemically synthesized
caatttctgaatatttaaat

SEQ ID NO: 421114 - DNA, 20 bp, Artificial Sequence
  chemically synthesized
caacatctcatttaaatatt

SEQ ID NO: 421115 - DNA, 20 bp, Artificial Sequence
  chemically synthesized
aactgaaagtatgaagtgga

SEQ ID NO: 421116 - DNA, 20 bp, Artificial Sequence
  chemically synthesized
taactgaaagtatgaagtgg

SEQ ID NO: 421117 - DNA, 20 bp, Artificial Sequence
  chemically synthesized
tcctaactgaaagtatgaag

SEQ ID NO: 421118 - DNA, 20 bp, Artificial Sequence
  chemically synthesized
tcatcctaactgaaagtatg

SEQ ID NO: 421119 - DNA, 20 bp, Artificial Sequence
  chemically synthesized
atccttccacttcatacttt

SEQ ID NO: 421120 - DNA, 20 bp, Artificial Sequence
  chemically synthesized
ttccacttcatactttcagt

SEQ ID NO: 421121 - DNA, 20 bp, Artificial Sequence
  chemically synthesized
tccacttcatactttcagtt

SEQ ID NO: 421122 - DNA, 20 bp, Artificial Sequence
  chemically synthesized
tcaatgctcatcctaactga

SEQ ID NO: 421123 - DNA, 20 bp, Artificial Sequence
  chemically synthesized
ttcatactttcagttaggat

SEQ ID NO: 421124 - DNA, 20 bp, Artificial Sequence
  chemically synthesized
ggatgagcattgaaaacatg

SEQ ID NO: 421125 - DNA, 20 bp, Artificial Sequence
  chemically synthesized
agcattgaaaacatgtagta

SEQ ID NO: 421126 - DNA, 20 bp, Artificial Sequence
  chemically synthesized
catgtagtaaagcacaacct

SEQ ID NO: 421127 - DNA, 20 bp, Artificial Sequence
  chemically synthesized
catattcattatgaatgctg

SEQ ID NO: 421128 - DNA, 20 bp, Artificial Sequence
  chemically synthesized
tcatattcattatgaatgct

SEQ ID NO: 421129 - DNA, 20 bp, Artificial Sequence
  chemically synthesized
gcattcataatgaatatgat

SEQ ID NO: 421130 - DNA, 20 bp, Artificial Sequence
  chemically synthesized
ataatgaatatgataagaac

SEQ ID NO: 421131 - DNA, 20 bp, Artificial Sequence
  chemically synthesized
tagtaaacatgaatgagaaa

SEQ ID NO: 421132 - DNA, 20 bp, Artificial Sequence
  chemically synthesized
gtagtaaacatgaatgagaa

SEQ ID NO: 421133 - DNA, 20 bp, Artificial Sequence
  chemically synthesized
gtttggtagtaaacatgaat

SEQ ID NO: 421134 - DNA, 20 bp, Artificial Sequence
  chemically synthesized
tttattcaacagatgtttgg

SEQ ID NO: 421135 - DNA, 20 bp, Artificial Sequence
  chemically synthesized
tagtttattcaacagatgtt

SEQ ID NO: 421136 - DNA, 20 bp, Artificial Sequence
  chemically synthesized
ggattaagtagtttattcaa

SEQ ID NO: 421137 - DNA, 20 bp, Artificial Sequence
  chemically synthesized
ttatgtttgtaaggattaag

SEQ ID NO: 421138 - DNA, 20 bp, Artificial Sequence
  chemically synthesized
tggttatgtttgtaaggatt

SEQ ID NO: 421139 - DNA, 20 bp, Artificial Sequence
  chemically synthesized
ataatctggttatgtttgta

SEQ ID NO: 421140 - DNA, 20 bp, Artificial Sequence
  chemically synthesized
aataatctggttatgtttgt

SEQ ID NO: 421141 - DNA, 20 bp, Artificial Sequence
  chemically synthesized
ttaatccttacaaacataac

SEQ ID NO: 421142 - DNA, 20 bp, Artificial Sequence
  chemically synthesized
tattgttgctgaaaataatc

SEQ ID NO: 421143 - DNA, 20 bp, Artificial Sequence
  chemically synthesized
aaacataaccagattatttt

SEQ ID NO: 421144 - DNA, 20 bp, Artificial Sequence
  chemically synthesized
cagcaacaatacaaactcta

SEQ ID NO: 421145 - DNA, 20 bp, Artificial Sequence
  chemically synthesized
gaccagctgttatcactata

SEQ ID NO: 421146 - DNA, 20 bp, Artificial Sequence
  chemically synthesized
aggaccagctgttatcacta

SEQ ID NO: 421147 - DNA, 20 bp, Artificial Sequence
  chemically synthesized
tacaaactctatagtgataa

SEQ ID NO: 421148 - DNA, 20 bp, Artificial Sequence
  chemically synthesized
aactctatagtgataacagc

SEQ ID NO: 421149 - DNA, 20 bp, Artificial Sequence
  chemically synthesized
ccctgaagaaagtaaaggac

SEQ ID NO: 421150 - DNA, 20 bp, Artificial Sequence
  chemically synthesized
tatatccctgaagaaagtaa

SEQ ID NO: 421151 - DNA, 20 bp, Artificial Sequence
  chemically synthesized
gtatatccctgaagaaagta

SEQ ID NO: 421152 - DNA, 20 bp, Artificial Sequence
  chemically synthesized
agctggtcctttactttctt

SEQ ID NO: 421153 - DNA, 20 bp, Artificial Sequence
  chemically synthesized
gctggtcctttactttcttc

SEQ ID NO: 421154 - DNA, 20 bp, Artificial Sequence
  chemically synthesized
ctggtcctttactttcttca

SEQ ID NO: 421155 - DNA, 20 bp, Artificial Sequence
  chemically synthesized
ggagtgtatatccctgaaga

SEQ ID NO: 421156 - DNA, 20 bp, Artificial Sequence
  chemically synthesized
atgtggagtgtatatccctg

SEQ ID NO: 421157 - DNA, 20 bp, Artificial Sequence
  chemically synthesized
gaagaaatgaaatatatgtg

SEQ ID NO: 421158 - DNA, 20 bp, Artificial Sequence
  chemically synthesized
gagaagaaatgaaatatatg

SEQ ID NO: 421159 - DNA, 20 bp, Artificial Sequence
  chemically synthesized
catatatttcatttcttctc

SEQ ID NO: 421160 - DNA, 20 bp, Artificial Sequence
  chemically synthesized
tttttgtcacttaacttgag

SEQ ID NO: 421161 - DNA, 20 bp, Artificial Sequence
  chemically synthesized
atttcatttcttctcaagtt

SEQ ID NO: 421162 - DNA, 20 bp, Artificial Sequence
  chemically synthesized
agctttttgtcacttaactt

SEQ ID NO: 421163 - DNA, 20 bp, Artificial Sequence
  chemically synthesized
ttctcaagttaagtgacaaa

SEQ ID NO: 421164 - DNA, 20 bp, Artificial Sequence
  chemically synthesized
taagtgacaaaaagctaaaa

SEQ ID NO: 421165 - DNA, 20 bp, Artificial Sequence
  chemically synthesized
gactgcatcacaatccattt

SEQ ID NO: 421166 - DNA, 20 bp, Artificial Sequence
  chemically synthesized
agctaaaatggattgtgatg

SEQ ID NO: 421167 - DNA, 20 bp, Artificial Sequence
  chemically synthesized
aatggattgtgatgcagtca

SEQ ID NO: 421168 - DNA, 20 bp, Artificial Sequence
  chemically synthesized
gtagaaaactgtgtcattcg

SEQ ID NO: 421169 - DNA, 20 bp, Artificial Sequence
  chemically synthesized
agtcaaagccacgaatgaca

SEQ ID NO: 421170 - DNA, 20 bp, Artificial Sequence
  chemically synthesized
aatgacacagttttctacca

SEQ ID NO: 421171 - DNA, 20 bp, Artificial Sequence
  chemically synthesized
aattatccccttgtctatgg

SEQ ID NO: 421172 - DNA, 20 bp, Artificial Sequence
  chemically synthesized
cacagttttctaccatagac

SEQ ID NO: 421173 - DNA, 20 bp, Artificial Sequence
  chemically synthesized
acagttttctaccatagaca

SEQ ID NO: 421174 - DNA, 20 bp, Artificial Sequence
  chemically synthesized
cagttttctaccatagacaa

SEQ ID NO: 421175 - DNA, 20 bp, Artificial Sequence
  chemically synthesized
aaaaattatccccttgtcta

SEQ ID NO: 421176 - DNA, 20 bp, Artificial Sequence
  chemically synthesized
agttttctaccatagacaag

SEQ ID NO: 421177 - DNA, 20 bp, Artificial Sequence
  chemically synthesized
ttttttttttctttcaatgt

SEQ ID NO: 421178 - DNA, 20 bp, Artificial Sequence
  chemically synthesized
acacttgtggcttacattga

SEQ ID NO: 421179 - DNA, 20 bp, Artificial Sequence
  chemically synthesized
tttctttcaatgtaagccac

SEQ ID NO: 421180 - DNA, 20 bp, Artificial Sequence
  chemically synthesized
agatccccccattacacttg

SEQ ID NO: 421181 - DNA, 20 bp, Artificial Sequence
  chemically synthesized
aatgtaagccacaagtgtaa

SEQ ID NO: 421182 - DNA, 20 bp, Artificial Sequence
  chemically synthesized
atgtaagccacaagtgtaat

SEQ ID NO: 421183 - DNA, 20 bp, Artificial Sequence
  chemically synthesized
tgtaagccacaagtgtaatg

SEQ ID NO: 421184 - DNA, 20 bp, Artificial Sequence
  chemically synthesized
gtaagccacaagtgtaatgg

SEQ ID NO: 421185 - DNA, 20 bp, Artificial Sequence
  chemically synthesized
taagccacaagtgtaatggg

SEQ ID NO: 421186 - DNA, 20 bp, Artificial Sequence
  chemically synthesized
ccataatgcctttcgtttag

SEQ ID NO: 421187 - DNA, 20 bp, Artificial Sequence
  chemically synthesized
tggggggatctcctaaacga

SEQ ID NO: 421188 - DNA, 20 bp, Artificial Sequence
  chemically synthesized
ggggggatctcctaaacgaa

SEQ ID NO: 421189 - DNA, 20 bp, Artificial Sequence
  chemically synthesized
taccataatgcctttcgttt

SEQ ID NO: 421190 - DNA, 20 bp, Artificial Sequence
  chemically synthesized
ctaccataatgcctttcgtt

SEQ ID NO: 421191 - DNA, 20 bp, Artificial Sequence
  chemically synthesized
ctcctaaacgaaaggcatta

SEQ ID NO: 421192 - DNA, 20 bp, Artificial Sequence
  chemically synthesized
ctaaacgaaaggcattatgg

SEQ ID NO: 421193 - DNA, 20 bp, Artificial Sequence
  chemically synthesized
taaacgaaaggcattatggt

SEQ ID NO: 421194 - DNA, 20 bp, Artificial Sequence
  chemically synthesized
aaacgaaaggcattatggta

SEQ ID NO: 421195 - DNA, 20 bp, Artificial Sequence
  chemically synthesized
aacgaaaggcattatggtag

SEQ ID NO: 421196 - DNA, 20 bp, Artificial Sequence
  chemically synthesized
acgaaaggcattatggtagg

SEQ ID NO: 421197 - DNA, 20 bp, Artificial Sequence
  chemically synthesized
gaaaggcattatggtagggg

SEQ ID NO: 421198 - DNA, 20 bp, Artificial Sequence
  chemically synthesized
aaaggcattatggtaggggg

SEQ ID NO: 421199 - DNA, 20 bp, Artificial Sequence
  chemically synthesized
gtagggggaggttccttttc

SEQ ID NO: 421200 - DNA, 20 bp, Artificial Sequence
  chemically synthesized
gtttaggcgtggtcttgaaa

SEQ ID NO: 421201 - DNA, 20 bp, Artificial Sequence
  chemically synthesized
agtttaggcgtggtcttgaa

SEQ ID NO: 421202 - DNA, 20 bp, Artificial Sequence
  chemically synthesized
atttatcagtagtttaggcg

SEQ ID NO: 421203 - DNA, 20 bp, Artificial Sequence
  chemically synthesized
atcatatttatcagtagttt

SEQ ID NO: 421204 - DNA, 20 bp, Artificial Sequence
  chemically synthesized
tatcatatttatcagtagtt

SEQ ID NO: 421205 - DNA, 20 bp, Artificial Sequence
  chemically synthesized
atatttatcatatttatcag

SEQ ID NO: 421206 - DNA, 20 bp, Artificial Sequence
  chemically synthesized
catatatttatcatatttat

SEQ ID NO: 421207 - DNA, 20 bp, Artificial Sequence
  chemically synthesized
tgataaatatgataaatata

SEQ ID NO: 421208 - DNA, 20 bp, Artificial Sequence
  chemically synthesized
tgataaatatatggttgtaa

SEQ ID NO: 421209 - DNA, 20 bp, Artificial Sequence
  chemically synthesized
tccatctcgaaaaaaaaaaa

SEQ ID NO: 421210 - DNA, 20 bp, Artificial Sequence
  chemically synthesized
catttctttttttttttttc

SEQ ID NO: 421211 - DNA, 20 bp, Artificial Sequence
  chemically synthesized
tctttttttttttttcgaga

SEQ ID NO: 421212 - DNA, 20 bp, Artificial Sequence
  chemically synthesized
tttttttttttttcgagatg

SEQ ID NO: 421213 - DNA, 20 bp, Artificial Sequence
  chemically synthesized
cgagatggagtctcgctctg

SEQ ID NO: 421214 - DNA, 20 bp, Artificial Sequence
  chemically synthesized
tccagcctgggccacagagc

SEQ ID NO: 421215 - DNA, 20 bp, Artificial Sequence
  chemically synthesized
tggagtctcgctctgtggcc

SEQ ID NO: 421216 - DNA, 20 bp, Artificial Sequence
  chemically synthesized
gagctccagcctgggccaca

SEQ ID NO: 421217 - DNA, 20 bp, Artificial Sequence
  chemically synthesized
ggagtctcgctctgtggccc

SEQ ID NO: 421218 - DNA, 20 bp, Artificial Sequence
  chemically synthesized
ctgagctccagcctgggcca

SEQ ID NO: 421219 - DNA, 20 bp, Artificial Sequence
  chemically synthesized
tctcgctctgtggcccaggc

SEQ ID NO: 421220 - DNA, 20 bp, Artificial Sequence
  chemically synthesized
tcgctctgtggcccaggctg

SEQ ID NO: 421221 - DNA, 20 bp, Artificial Sequence
  chemically synthesized
acgccactgagctccagcct

SEQ ID NO: 421222 - DNA, 20 bp, Artificial Sequence
  chemically synthesized
cacgccactgagctccagcc

SEQ ID NO: 421223 - DNA, 20 bp, Artificial Sequence
  chemically synthesized
ctgtggcccaggctggagct

SEQ ID NO: 421224 - DNA, 20 bp, Artificial Sequence
  chemically synthesized
gagaccacgccactgagctc

SEQ ID NO: 421225 - DNA, 20 bp, Artificial Sequence
  chemically synthesized
tggcccaggctggagctcag

SEQ ID NO: 421226 - DNA, 20 bp, Artificial Sequence
  chemically synthesized
caggctggagctcagtggcg

SEQ ID NO: 421227 - DNA, 20 bp, Artificial Sequence
  chemically synthesized
tgagccgagaccacgccact

SEQ ID NO: 421228 - DNA, 20 bp, Artificial Sequence
  chemically synthesized
ggagctcagtggcgtggtct

SEQ ID NO: 421229 - DNA, 20 bp, Artificial Sequence
  chemically synthesized
ggcggagcttgcagtgagcc

SEQ ID NO: 421230 - DNA, 20 bp, Artificial Sequence
  chemically synthesized
gcgtggtctcggctcactgc

SEQ ID NO: 421231 - DNA, 20 bp, Artificial Sequence
  chemically synthesized
caggaggcggagcttgcagt

SEQ ID NO: 421232 - DNA, 20 bp, Artificial Sequence
  chemically synthesized
aacccaggaggcggagcttg

SEQ ID NO: 421233 - DNA, 20 bp, Artificial Sequence
  chemically synthesized
tcactgcaagctccgcctcc

SEQ ID NO: 421234 - DNA, 20 bp, Artificial Sequence
  chemically synthesized
tggcgtgaacccaggaggcg

SEQ ID NO: 421235 - DNA, 20 bp, Artificial Sequence
  chemically synthesized
cactgcaagctccgcctcct

SEQ ID NO: 421236 - DNA, 20 bp, Artificial Sequence
  chemically synthesized
aatggcgtgaacccaggagg

SEQ ID NO: 421237 - DNA, 20 bp, Artificial Sequence
  chemically synthesized
gagaatggcgtgaacccagg

SEQ ID NO: 421238 - DNA, 20 bp, Artificial Sequence
  chemically synthesized
ggagaatggcgtgaacccag

SEQ ID NO: 421239 - DNA, 20 bp, Artificial Sequence
  chemically synthesized
caggagaatggcgtgaaccc

SEQ ID NO: 421240 - DNA, 20 bp, Artificial Sequence
  chemically synthesized
gcaggagaatggcgtgaacc

SEQ ID NO: 421241 - DNA, 20 bp, Artificial Sequence
  chemically synthesized
aggaggctgaggcaggagaa

SEQ ID NO: 421242 - DNA, 20 bp, Artificial Sequence
  chemically synthesized
ttcacgccattctcctgcct

SEQ ID NO: 421243 - DNA, 20 bp, Artificial Sequence
  chemically synthesized
tactcaggaggctgaggcag

SEQ ID NO: 421244 - DNA, 20 bp, Artificial Sequence
  chemically synthesized
gctactcaggaggctgaggc

SEQ ID NO: 421245 - DNA, 20 bp, Artificial Sequence
  chemically synthesized
agctactcaggaggctgagg

SEQ ID NO: 421246 - DNA, 20 bp, Artificial Sequence
  chemically synthesized
cccagctactcaggaggctg

SEQ ID NO: 421247 - DNA, 20 bp, Artificial Sequence
  chemically synthesized
tcccagctactcaggaggct

SEQ ID NO: 421248 - DNA, 20 bp, Artificial Sequence
  chemically synthesized
ttctcctgcctcagcctcct

SEQ ID NO: 421249 - DNA, 20 bp, Artificial Sequence
  chemically synthesized
tcctgcctcagcctcctgag

SEQ ID NO: 421250 - DNA, 20 bp, Artificial Sequence
  chemically synthesized
tgtagtcccagctactcagg

SEQ ID NO: 421251 - DNA, 20 bp, Artificial Sequence
  chemically synthesized
ctgtagtcccagctactcag

SEQ ID NO: 421252 - DNA, 20 bp, Artificial Sequence
  chemically synthesized
gcctcagcctcctgagtagc

SEQ ID NO: 421253 - DNA, 20 bp, Artificial Sequence
  chemically synthesized
gcctgtagtcccagctactc

SEQ ID NO: 421254 - DNA, 20 bp, Artificial Sequence
  chemically synthesized
cctcagcctcctgagtagct

SEQ ID NO: 421255 - DNA, 20 bp, Artificial Sequence
  chemically synthesized
cgcctgtagtcccagctact

SEQ ID NO: 421256 - DNA, 20 bp, Artificial Sequence
  chemically synthesized
ctcctgagtagctgggacta

SEQ ID NO: 421257 - DNA, 20 bp, Artificial Sequence
  chemically synthesized
tcctgagtagctgggactac

SEQ ID NO: 421258 - DNA, 20 bp, Artificial Sequence
  chemically synthesized
gttgcgggcgcctgtagtcc

SEQ ID NO: 421259 - DNA, 20 bp, Artificial Sequence
  chemically synthesized
ggcgtggttgcgggcgcctg

SEQ ID NO: 421260 - DNA, 20 bp, Artificial Sequence
  chemically synthesized
aattagccgggcgtggttgc

SEQ ID NO: 421261 - DNA, 20 bp, Artificial Sequence
  chemically synthesized
aaattagccgggcgtggttg

SEQ ID NO: 421262 - DNA, 20 bp, Artificial Sequence
  chemically synthesized
caggcgcccgcaaccacgcc

SEQ ID NO: 421263 - DNA, 20 bp, Artificial Sequence
  chemically synthesized
tacaaaaaattagccgggcg

SEQ ID NO: 421264 - DNA, 20 bp, Artificial Sequence
  chemically synthesized
aaaaatacaaaaaattagcc

SEQ ID NO: 421265 - DNA, 20 bp, Artificial Sequence
  chemically synthesized
taaaaatacaaaaaattagc

SEQ ID NO: 421266 - DNA, 20 bp, Artificial Sequence
  chemically synthesized
ctactaaaaatacaaaaaat

SEQ ID NO: 421267 - DNA, 20 bp, Artificial Sequence
  chemically synthesized
cggctaattttttgtatttt

SEQ ID NO: 421268 - DNA, 20 bp, Artificial Sequence
  chemically synthesized
ctaattttttgtatttttag

SEQ ID NO: 421269 - DNA, 20 bp, Artificial Sequence
  chemically synthesized
ttttgtatttttagtagata

SEQ ID NO: 421270 - DNA, 20 bp, Artificial Sequence
  chemically synthesized
tttgtatttttagtagatac

SEQ ID NO: 421271 - DNA, 20 bp, Artificial Sequence
  chemically synthesized
ttgtatttttagtagatacg

SEQ ID NO: 421272 - DNA, 20 bp, Artificial Sequence
  chemically synthesized
cggggtttgtatcactgtgt

SEQ ID NO: 421273 - DNA, 20 bp, Artificial Sequence
  chemically synthesized
gtttgtatcactgtgttagc

SEQ ID NO: 421274 - DNA, 20 bp, Artificial Sequence
  chemically synthesized
cgagaccatcctggctaaca

SEQ ID NO: 421275 - DNA, 20 bp, Artificial Sequence
  chemically synthesized
tttgtatcactgtgttagcc

SEQ ID NO: 421276 - DNA, 20 bp, Artificial Sequence
  chemically synthesized
tatcactgtgttagccagga

SEQ ID NO: 421277 - DNA, 20 bp, Artificial Sequence
  chemically synthesized
tcaggagatcgagaccatcc

SEQ ID NO: 421278 - DNA, 20 bp, Artificial Sequence
  chemically synthesized
gatcacgaggtcaggagatc

SEQ ID NO: 421279 - DNA, 20 bp, Artificial Sequence
  chemically synthesized
ccggcggatcacgaggtcag

SEQ ID NO: 421280 - DNA, 20 bp, Artificial Sequence
  chemically synthesized
ggccggcggatcacgaggtc

SEQ ID NO: 421281 - DNA, 20 bp, Artificial Sequence
  chemically synthesized
aggccggcggatcacgaggt

SEQ ID NO: 421282 - DNA, 20 bp, Artificial Sequence
  chemically synthesized
tgggaggccggcggatcacg

SEQ ID NO: 421283 - DNA, 20 bp, Artificial Sequence
  chemically synthesized
ttgggaggccggcggatcac

SEQ ID NO: 421284 - DNA, 20 bp, Artificial Sequence
  chemically synthesized
ctcctgacctcgtgatccgc

SEQ ID NO: 421285 - DNA, 20 bp, Artificial Sequence
  chemically synthesized
ccagcactttgggaggccgg

SEQ ID NO: 421286 - DNA, 20 bp, Artificial Sequence
  chemically synthesized
atcccagcactttgggaggc

SEQ ID NO: 421287 - DNA, 20 bp, Artificial Sequence
  chemically synthesized
cgtgatccgccggcctccca

SEQ ID NO: 421288 - DNA, 20 bp, Artificial Sequence
  chemically synthesized
tgtaatcccagcactttggg

SEQ ID NO: 421289 - DNA, 20 bp, Artificial Sequence
  chemically synthesized
ctgtaatcccagcactttgg

SEQ ID NO: 421290 - DNA, 20 bp, Artificial Sequence
  chemically synthesized
ccgccggcctcccaaagtgc

SEQ ID NO: 421291 - DNA, 20 bp, Artificial Sequence
  chemically synthesized
gcctgtaatcccagcacttt

SEQ ID NO: 421292 - DNA, 20 bp, Artificial Sequence
  chemically synthesized
cgccggcctcccaaagtgct

SEQ ID NO: 421293 - DNA, 20 bp, Artificial Sequence
  chemically synthesized
cgcctgtaatcccagcactt

SEQ ID NO: 421294 - DNA, 20 bp, Artificial Sequence
  chemically synthesized
ctcccaaagtgctgggatta

SEQ ID NO: 421295 - DNA, 20 bp, Artificial Sequence
  chemically synthesized
tcccaaagtgctgggattac

SEQ ID NO: 421296 - DNA, 20 bp, Artificial Sequence
  chemically synthesized
gtggctcacgcctgtaatcc

SEQ ID NO: 421297 - DNA, 20 bp, Artificial Sequence
  chemically synthesized
agtgctgggattacaggcgt

SEQ ID NO: 421298 - DNA, 20 bp, Artificial Sequence
  chemically synthesized
caggcgtgagccactgcgcc

SEQ ID NO: 421299 - DNA, 20 bp, Artificial Sequence
  chemically synthesized
tttcttttggccgggcgcag

SEQ ID NO: 421300 - DNA, 20 bp, Artificial Sequence
  chemically synthesized
cgttttcttttggccgggcg

SEQ ID NO: 421301 - DNA, 20 bp, Artificial Sequence
  chemically synthesized
gagccactgcgcccggccaa

SEQ ID NO: 421302 - DNA, 20 bp, Artificial Sequence
  chemically synthesized
agaaacgttttcttttggcc

SEQ ID NO: 421303 - DNA, 20 bp, Artificial Sequence
  chemically synthesized
tagaaacgttttcttttggc

SEQ ID NO: 421304 - DNA, 20 bp, Artificial Sequence
  chemically synthesized
ttcatagaaacgttttcttt

SEQ ID NO: 421305 - DNA, 20 bp, Artificial Sequence
  chemically synthesized
agaaaacgtttctatgaaca

SEQ ID NO: 421306 - DNA, 20 bp, Artificial Sequence
  chemically synthesized
tataagtaatactgtgttca

SEQ ID NO: 421307 - DNA, 20 bp, Artificial Sequence
  chemically synthesized
tatgtttttaaatattgtat

SEQ ID NO: 421308 - DNA, 20 bp, Artificial Sequence
  chemically synthesized
atcattgtttataaaacatt

SEQ ID NO: 421309 - DNA, 20 bp, Artificial Sequence
  chemically synthesized
taaacaatgattcaaaaatg

SEQ ID NO: 421310 - DNA, 20 bp, Artificial Sequence
  chemically synthesized
aacaatgattcaaaaatgca

SEQ ID NO: 421311 - DNA, 20 bp, Artificial Sequence
  chemically synthesized
atgattcaaaaatgcagagc

SEQ ID NO: 421312 - DNA, 20 bp, Artificial Sequence
  chemically synthesized
tgattcaaaaatgcagagct

SEQ ID NO: 421313 - DNA, 20 bp, Artificial Sequence
  chemically synthesized
tcaaaaatgcagagctgggt

SEQ ID NO: 421314 - DNA, 20 bp, Artificial Sequence
  chemically synthesized
catgagccgccgtgctcacc

SEQ ID NO: 421315 - DNA, 20 bp, Artificial Sequence
  chemically synthesized
aatgcagagctgggtgagca

SEQ ID NO: 421316 - DNA, 20 bp, Artificial Sequence
  chemically synthesized
gcagagctgggtgagcacgg

SEQ ID NO: 421317 - DNA, 20 bp, Artificial Sequence
  chemically synthesized
agtgctgggattacaggcat

SEQ ID NO: 421318 - DNA, 20 bp, Artificial Sequence
  chemically synthesized
gcggctcatgcctgtaatcc

SEQ ID NO: 421319 - DNA, 20 bp, Artificial Sequence
  chemically synthesized
tcccaaagtgctgggattac

SEQ ID NO: 421320 - DNA, 20 bp, Artificial Sequence
  chemically synthesized
ctcccaaagtgctgggatta

SEQ ID NO: 421321 - DNA, 20 bp, Artificial Sequence
  chemically synthesized
tgcctgtaatcccagcactt

SEQ ID NO: 421322 - DNA, 20 bp, Artificial Sequence
  chemically synthesized
cctcggcctcccaaagtgct

SEQ ID NO: 421323 - DNA, 20 bp, Artificial Sequence
  chemically synthesized
gcctgtaatcccagcacttt

SEQ ID NO: 421324 - DNA, 20 bp, Artificial Sequence
  chemically synthesized
tcctcggcctcccaaagtgc

SEQ ID NO: 421325 - DNA, 20 bp, Artificial Sequence
  chemically synthesized
ctgtaatcccagcactttgg

SEQ ID NO: 421326 - DNA, 20 bp, Artificial Sequence
  chemically synthesized
tgtaatcccagcactttggg

SEQ ID NO: 421327 - DNA, 20 bp, Artificial Sequence
  chemically synthesized
cctctgtcctcggcctccca

SEQ ID NO: 421328 - DNA, 20 bp, Artificial Sequence
  chemically synthesized
tcccagcactttgggaggcc

SEQ ID NO: 421329 - DNA, 20 bp, Artificial Sequence
  chemically synthesized
cccagcactttgggaggccg

SEQ ID NO: 421330 - DNA, 20 bp, Artificial Sequence
  chemically synthesized
gcactttgggaggccgagga

SEQ ID NO: 421331 - DNA, 20 bp, Artificial Sequence
  chemically synthesized
actttgggaggccgaggaca

SEQ ID NO: 421332 - DNA, 20 bp, Artificial Sequence
  chemically synthesized
ctttgggaggccgaggacag

SEQ ID NO: 421333 - DNA, 20 bp, Artificial Sequence
  chemically synthesized
ctcaggtgatcctctgtcct

SEQ ID NO: 421334 - DNA, 20 bp, Artificial Sequence
  chemically synthesized
ccgaggacagaggatcacct

SEQ ID NO: 421335 - DNA, 20 bp, Artificial Sequence
  chemically synthesized
cgaggacagaggatcacctg

SEQ ID NO: 421336 - DNA, 20 bp, Artificial Sequence
  chemically synthesized
gacagaggatcacctgaggt

SEQ ID NO: 421337 - DNA, 20 bp, Artificial Sequence
  chemically synthesized
ggtctcgaactgctgacctc

SEQ ID NO: 421338 - DNA, 20 bp, Artificial Sequence
  chemically synthesized
agaggatcacctgaggtcag

SEQ ID NO: 421339 - DNA, 20 bp, Artificial Sequence
  chemically synthesized
tggtctcgaactgctgacct

SEQ ID NO: 421340 - DNA, 20 bp, Artificial Sequence
  chemically synthesized
tcacctgaggtcagcagttc

SEQ ID NO: 421341 - DNA, 20 bp, Artificial Sequence
  chemically synthesized
tgaggtcagcagttcgagac

SEQ ID NO: 421342 - DNA, 20 bp, Artificial Sequence
  chemically synthesized
tcagcagttcgagaccagcc

SEQ ID NO: 421343 - DNA, 20 bp, Artificial Sequence
  chemically synthesized
tttcaccatgtgggccaggc

SEQ ID NO: 421344 - DNA, 20 bp, Artificial Sequence
  chemically synthesized
tgggtttcaccatgtgggcc

SEQ ID NO: 421345 - DNA, 20 bp, Artificial Sequence
  chemically synthesized
cgagaccagcctggcccaca

SEQ ID NO: 421346 - DNA, 20 bp, Artificial Sequence
  chemically synthesized
atgggtttcaccatgtgggc

SEQ ID NO: 421347 - DNA, 20 bp, Artificial Sequence
  chemically synthesized
agagatgggtttcaccatgt

SEQ ID NO: 421348 - DNA, 20 bp, Artificial Sequence
  chemically synthesized
tagagatgggtttcaccatg

SEQ ID NO: 421349 - DNA, 20 bp, Artificial Sequence
  chemically synthesized
tttgtatttttagtagagat

SEQ ID NO: 421350 - DNA, 20 bp, Artificial Sequence
  chemically synthesized
ttttgtatttttagtagaga

SEQ ID NO: 421351 - DNA, 20 bp, Artificial Sequence
  chemically synthesized
caatttttgtatttttagta

SEQ ID NO: 421352 - DNA, 20 bp, Artificial Sequence
  chemically synthesized
gccaatttttgtatttttag

SEQ ID NO: 421353 - DNA, 20 bp, Artificial Sequence
  chemically synthesized
ctggccaatttttgtatttt

SEQ ID NO: 421354 - DNA, 20 bp, Artificial Sequence
  chemically synthesized
tctactaaaaatacaaaaat

SEQ ID NO: 421355 - DNA, 20 bp, Artificial Sequence
  chemically synthesized
ctaaaaatacaaaaattggc

SEQ ID NO: 421356 - DNA, 20 bp, Artificial Sequence
  chemically synthesized
taaaaatacaaaaattggcc

SEQ ID NO: 421357 - DNA, 20 bp, Artificial Sequence
  chemically synthesized
atacaaaaattggccaggca

SEQ ID NO: 421358 - DNA, 20 bp, Artificial Sequence
  chemically synthesized
caaaaattggccaggcatgg

SEQ ID NO: 421359 - DNA, 20 bp, Artificial Sequence
  chemically synthesized
ctggtgcacgccaccatgcc

SEQ ID NO: 421360 - DNA, 20 bp, Artificial Sequence
  chemically synthesized
ccaggcatggtggcgtgcac

SEQ ID NO: 421361 - DNA, 20 bp, Artificial Sequence
  chemically synthesized
tcccgaatagcagggattac

SEQ ID NO: 421362 - DNA, 20 bp, Artificial Sequence
  chemically synthesized
caccagtaatccctgctatt

SEQ ID NO: 421363 - DNA, 20 bp, Artificial Sequence
  chemically synthesized
cctcagcctcccgaatagca

SEQ ID NO: 421364 - DNA, 20 bp, Artificial Sequence
  chemically synthesized
accagtaatccctgctattc

SEQ ID NO: 421365 - DNA, 20 bp, Artificial Sequence
  chemically synthesized
gcctcagcctcccgaatagc

SEQ ID NO: 421366 - DNA, 20 bp, Artificial Sequence
  chemically synthesized
tgcctcagcctcccgaatag

SEQ ID NO: 421367 - DNA, 20 bp, Artificial Sequence
  chemically synthesized
cagtaatccctgctattcgg

SEQ ID NO: 421368 - DNA, 20 bp, Artificial Sequence
  chemically synthesized
agtaatccctgctattcggg

SEQ ID NO: 421369 - DNA, 20 bp, Artificial Sequence
  chemically synthesized
ttctgcctcagcctcccgaa

SEQ ID NO: 421370 - DNA, 20 bp, Artificial Sequence
  chemically synthesized
tccctgctattcgggaggct

SEQ ID NO: 421371 - DNA, 20 bp, Artificial Sequence
  chemically synthesized
ccctgctattcgggaggctg

SEQ ID NO: 421372 - DNA, 20 bp, Artificial Sequence
  chemically synthesized
tgctattcgggaggctgagg

SEQ ID NO: 421373 - DNA, 20 bp, Artificial Sequence
  chemically synthesized
ttcaagcgatttttctgcct

SEQ ID NO: 421374 - DNA, 20 bp, Artificial Sequence
  chemically synthesized
gcagaaaaatcgcttgaacc

SEQ ID NO: 421375 - DNA, 20 bp, Artificial Sequence
  chemically synthesized
cagaaaaatcgcttgaaccc

SEQ ID NO: 421376 - DNA, 20 bp, Artificial Sequence
  chemically synthesized
aacctctgcctcctgggttc

SEQ ID NO: 421377 - DNA, 20 bp, Artificial Sequence
  chemically synthesized
gaaaaatcgcttgaacccag

SEQ ID NO: 421378 - DNA, 20 bp, Artificial Sequence
  chemically synthesized
aaaaatcgcttgaacccagg

SEQ ID NO: 421379 - DNA, 20 bp, Artificial Sequence
  chemically synthesized
aatcgcttgaacccaggagg

SEQ ID NO: 421380 - DNA, 20 bp, Artificial Sequence
  chemically synthesized
cactgcaacctctgcctcct

SEQ ID NO: 421381 - DNA, 20 bp, Artificial Sequence
  chemically synthesized
tcgcttgaacccaggaggca

SEQ ID NO: 421382 - DNA, 20 bp, Artificial Sequence
  chemically synthesized
tcactgcaacctctgcctcc

SEQ ID NO: 421383 - DNA, 20 bp, Artificial Sequence
  chemically synthesized
cgcttgaacccaggaggcag

SEQ ID NO: 421384 - DNA, 20 bp, Artificial Sequence
  chemically synthesized
aacccaggaggcagaggttg

SEQ ID NO: 421385 - DNA, 20 bp, Artificial Sequence
  chemically synthesized
caggaggcagaggttgcagt

SEQ ID NO: 421386 - DNA, 20 bp, Artificial Sequence
  chemically synthesized
ggcagaggttgcagtgagcc

SEQ ID NO: 421387 - DNA, 20 bp, Artificial Sequence
  chemically synthesized
gaggttgcagtgagccgaga

SEQ ID NO: 421388 - DNA, 20 bp, Artificial Sequence
  chemically synthesized
gcagtgcagtggcaccatct

SEQ ID NO: 421389 - DNA, 20 bp, Artificial Sequence
  chemically synthesized
tctcgcaggctgcagtgcag

SEQ ID NO: 421390 - DNA, 20 bp, Artificial Sequence
  chemically synthesized
gagatggtgccactgcactg

SEQ ID NO: 421391 - DNA, 20 bp, Artificial Sequence
  chemically synthesized
ctgtctcgcaggctgcagtg

SEQ ID NO: 421392 - DNA, 20 bp, Artificial Sequence
  chemically synthesized
tcactctgtctcgcaggctg

SEQ ID NO: 421393 - DNA, 20 bp, Artificial Sequence
  chemically synthesized
gccactgcactgcagcctgc

SEQ ID NO: 421394 - DNA, 20 bp, Artificial Sequence
  chemically synthesized
ctgcactgcagcctgcgaga

SEQ ID NO: 421395 - DNA, 20 bp, Artificial Sequence
  chemically synthesized
tgggtttcactctgtctcgc

SEQ ID NO: 421396 - DNA, 20 bp, Artificial Sequence
  chemically synthesized
gcactgcagcctgcgagaca

SEQ ID NO: 421397 - DNA, 20 bp, Artificial Sequence
  chemically synthesized
ctgggtttcactctgtctcg

SEQ ID NO: 421398 - DNA, 20 bp, Artificial Sequence
  chemically synthesized
ctgcgagacagagtgaaacc

SEQ ID NO: 421399 - DNA, 20 bp, Artificial Sequence
  chemically synthesized
gttttggtttttttgagact

SEQ ID NO: 421400 - DNA, 20 bp, Artificial Sequence
  chemically synthesized
tgttttggtttttttgagac

SEQ ID NO: 421401 - DNA, 20 bp, Artificial Sequence
  chemically synthesized
gtcgttgttttggttttttt

SEQ ID NO: 421402 - DNA, 20 bp, Artificial Sequence
  chemically synthesized
gtggttttttgtcgttgttt

SEQ ID NO: 421403 - DNA, 20 bp, Artificial Sequence
  chemically synthesized
aaaacaacgacaaaaaacca

SEQ ID NO: 421404 - DNA, 20 bp, Artificial Sequence
  chemically synthesized
aaacaacgacaaaaaaccac

SEQ ID NO: 421405 - DNA, 20 bp, Artificial Sequence
  chemically synthesized
aacaacgacaaaaaaccaca

SEQ ID NO: 421406 - DNA, 20 bp, Artificial Sequence
  chemically synthesized
acgacaaaaaaccacagggc

SEQ ID NO: 421407 - DNA, 20 bp, Artificial Sequence
  chemically synthesized
actgtgcccggccagccctg

SEQ ID NO: 421408 - DNA, 20 bp, Artificial Sequence
  chemically synthesized
caaaaaaccacagggctggc

SEQ ID NO: 421409 - DNA, 20 bp, Artificial Sequence
  chemically synthesized
aaaaaaccacagggctggcc

SEQ ID NO: 421410 - DNA, 20 bp, Artificial Sequence
  chemically synthesized
tgtgagccactgtgcccggc

SEQ ID NO: 421411 - DNA, 20 bp, Artificial Sequence
  chemically synthesized
accacagggctggccgggca

SEQ ID NO: 421412 - DNA, 20 bp, Artificial Sequence
  chemically synthesized
acagggctggccgggcacag

SEQ ID NO: 421413 - DNA, 20 bp, Artificial Sequence
  chemically synthesized
caggtgtgagccactgtgcc

SEQ ID NO: 421414 - DNA, 20 bp, Artificial Sequence
  chemically synthesized
agtgctgggattacaggtgt

SEQ ID NO: 421415 - DNA, 20 bp, Artificial Sequence
  chemically synthesized
gtggctcacacctgtaatcc

SEQ ID NO: 421416 - DNA, 20 bp, Artificial Sequence
  chemically synthesized
tcccaaagtgctgggattac

SEQ ID NO: 421417 - DNA, 20 bp, Artificial Sequence
  chemically synthesized
ttcccaaagtgctgggatta

SEQ ID NO: 421418 - DNA, 20 bp, Artificial Sequence
  chemically synthesized
cacctgtaatcccagcactt

SEQ ID NO: 421419 - DNA, 20 bp, Artificial Sequence
  chemically synthesized
cctcagcttcccaaagtgct

SEQ ID NO: 421420 - DNA, 20 bp, Artificial Sequence
  chemically synthesized
acctgtaatcccagcacttt

SEQ ID NO: 421421 - DNA, 20 bp, Artificial Sequence
  chemically synthesized
gcctcagcttcccaaagtgc

SEQ ID NO: 421422 - DNA, 20 bp, Artificial Sequence
  chemically synthesized
tgtaatcccagcactttggg

SEQ ID NO: 421423 - DNA, 20 bp, Artificial Sequence
  chemically synthesized
ccacctgcctcagcttccca

SEQ ID NO: 421424 - DNA, 20 bp, Artificial Sequence
  chemically synthesized
tcccagcactttgggaagct

SEQ ID NO: 421425 - DNA, 20 bp, Artificial Sequence
  chemically synthesized
cccagcactttgggaagctg

SEQ ID NO: 421426 - DNA, 20 bp, Artificial Sequence
  chemically synthesized
agcactttgggaagctgagg

SEQ ID NO: 421427 - DNA, 20 bp, Artificial Sequence
  chemically synthesized
gcactttgggaagctgaggc

SEQ ID NO: 421428 - DNA, 20 bp, Artificial Sequence
  chemically synthesized
ctttgggaagctgaggcagg

SEQ ID NO: 421429 - DNA, 20 bp, Artificial Sequence
  chemically synthesized
ctcaggtgacccacctgcct

SEQ ID NO: 421430 - DNA, 20 bp, Artificial Sequence
  chemically synthesized
tttgggaagctgaggcaggt

SEQ ID NO: 421431 - DNA, 20 bp, Artificial Sequence
  chemically synthesized
ctgaggcaggtgggtcacct

SEQ ID NO: 421432 - DNA, 20 bp, Artificial Sequence
  chemically synthesized
gcaggtgggtcacctgagct

SEQ ID NO: 421433 - DNA, 20 bp, Artificial Sequence
  chemically synthesized
caggtgggtcacctgagctc

SEQ ID NO: 421434 - DNA, 20 bp, Artificial Sequence
  chemically synthesized
gatctcaaactcccgagctc

SEQ ID NO: 421435 - DNA, 20 bp, Artificial Sequence
  chemically synthesized
ggtgggtcacctgagctcgg

SEQ ID NO: 421436 - DNA, 20 bp, Artificial Sequence
  chemically synthesized
tgatctcaaactcccgagct

SEQ ID NO: 421437 - DNA, 20 bp, Artificial Sequence
  chemically synthesized
caggctgatctcaaactccc

SEQ ID NO: 421438 - DNA, 20 bp, Artificial Sequence
  chemically synthesized
tcacctgagctcgggagttt

SEQ ID NO: 421439 - DNA, 20 bp, Artificial Sequence
  chemically synthesized
tgagctcgggagtttgagat

SEQ ID NO: 421440 - DNA, 20 bp, Artificial Sequence
  chemically synthesized
cgggagtttgagatcagcct

SEQ ID NO: 421441 - DNA, 20 bp, Artificial Sequence
  chemically synthesized
ttgagatcagcctgagtgat

SEQ ID NO: 421442 - DNA, 20 bp, Artificial Sequence
  chemically synthesized
ggggttttgccttatcactc

SEQ ID NO: 421443 - DNA, 20 bp, Artificial Sequence
  chemically synthesized
tgagatcagcctgagtgata

SEQ ID NO: 421444 - DNA, 20 bp, Artificial Sequence
  chemically synthesized
tggggttttgccttatcact

SEQ ID NO: 421445 - DNA, 20 bp, Artificial Sequence
  chemically synthesized
tcgtactttttgtagagatg

SEQ ID NO: 421446 - DNA, 20 bp, Artificial Sequence
  chemically synthesized
ttcgtactttttgtagagat

SEQ ID NO: 421447 - DNA, 20 bp, Artificial Sequence
  chemically synthesized
tttcgtactttttgtagaga

SEQ ID NO: 421448 - DNA, 20 bp, Artificial Sequence
  chemically synthesized
caaaaccccatctctacaaa

SEQ ID NO: 421449 - DNA, 20 bp, Artificial Sequence
  chemically synthesized
taattttcgtactttttgta

SEQ ID NO: 421450 - DNA, 20 bp, Artificial Sequence
  chemically synthesized
gctaattttcgtactttttg

SEQ ID NO: 421451 - DNA, 20 bp, Artificial Sequence
  chemically synthesized
tctacaaaaagtacgaaaat

SEQ ID NO: 421452 - DNA, 20 bp, Artificial Sequence
  chemically synthesized
caaaaagtacgaaaattagc

SEQ ID NO: 421453 - DNA, 20 bp, Artificial Sequence
  chemically synthesized
aaaaagtacgaaaattagct

SEQ ID NO: 421454 - DNA, 20 bp, Artificial Sequence
  chemically synthesized
gtacgaaaattagctgggtg

SEQ ID NO: 421455 - DNA, 20 bp, Artificial Sequence
  chemically synthesized
cgaaaattagctgggtgtgg

SEQ ID NO: 421456 - DNA, 20 bp, Artificial Sequence
  chemically synthesized
taccagcgctccaccacacc

SEQ ID NO: 421457 - DNA, 20 bp, Artificial Sequence
  chemically synthesized
aaaattagctgggtgtggtg

SEQ ID NO: 421458 - DNA, 20 bp, Artificial Sequence
  chemically synthesized
agctgggtgtggtggagcgc

SEQ ID NO: 421459 - DNA, 20 bp, Artificial Sequence
  chemically synthesized
tgggtgtggtggagcgctgg

SEQ ID NO: 421460 - DNA, 20 bp, Artificial Sequence
  chemically synthesized
tggtggagcgctggtagtcc

SEQ ID NO: 421461 - DNA, 20 bp, Artificial Sequence
  chemically synthesized
tcccgagtagctgggactac

SEQ ID NO: 421462 - DNA, 20 bp, Artificial Sequence
  chemically synthesized
cgctggtagtcccagctact

SEQ ID NO: 421463 - DNA, 20 bp, Artificial Sequence
  chemically synthesized
cctcagcctcccgagtagct

SEQ ID NO: 421464 - DNA, 20 bp, Artificial Sequence
  chemically synthesized
gctggtagtcccagctactc

SEQ ID NO: 421465 - DNA, 20 bp, Artificial Sequence
  chemically synthesized
acctcagcctcccgagtagc

SEQ ID NO: 421466 - DNA, 20 bp, Artificial Sequence
  chemically synthesized
tggtagtcccagctactcgg

SEQ ID NO: 421467 - DNA, 20 bp, Artificial Sequence
  chemically synthesized
ggtagtcccagctactcggg

SEQ ID NO: 421468 - DNA, 20 bp, Artificial Sequence
  chemically synthesized
tcccacctcagcctcccgag

SEQ ID NO: 421469 - DNA, 20 bp, Artificial Sequence
  chemically synthesized
tcctcccacctcagcctccc

SEQ ID NO: 421470 - DNA, 20 bp, Artificial Sequence
  chemically synthesized
tcccagctactcgggaggct

SEQ ID NO: 421471 - DNA, 20 bp, Artificial Sequence
  chemically synthesized
cccagctactcgggaggctg

SEQ ID NO: 421472 - DNA, 20 bp, Artificial Sequence
  chemically synthesized
agctactcgggaggctgagg

SEQ ID NO: 421473 - DNA, 20 bp, Artificial Sequence
  chemically synthesized
gctactcgggaggctgaggt

SEQ ID NO: 421474 - DNA, 20 bp, Artificial Sequence
  chemically synthesized
tactcgggaggctgaggtgg

SEQ ID NO: 421475 - DNA, 20 bp, Artificial Sequence
  chemically synthesized
actcgggaggctgaggtggg

SEQ ID NO: 421476 - DNA, 20 bp, Artificial Sequence
  chemically synthesized
ttcaagtgatcctcccacct

SEQ ID NO: 421477 - DNA, 20 bp, Artificial Sequence
  chemically synthesized
gtgggaggatcacttgaact

SEQ ID NO: 421478 - DNA, 20 bp, Artificial Sequence
  chemically synthesized
tgggaggatcacttgaactc

SEQ ID NO: 421479 - DNA, 20 bp, Artificial Sequence
  chemically synthesized
acccttgacctcctgagttc

SEQ ID NO: 421480 - DNA, 20 bp, Artificial Sequence
  chemically synthesized
ggaggatcacttgaactcag

SEQ ID NO: 421481 - DNA, 20 bp, Artificial Sequence
  chemically synthesized
gaggatcacttgaactcagg

SEQ ID NO: 421482 - DNA, 20 bp, Artificial Sequence
  chemically synthesized
gactgaacccttgacctcct

SEQ ID NO: 421483 - DNA, 20 bp, Artificial Sequence
  chemically synthesized
tcacttgaactcaggaggtc

SEQ ID NO: 421484 - DNA, 20 bp, Artificial Sequence
  chemically synthesized
cacttgaactcaggaggtca

SEQ ID NO: 421485 - DNA, 20 bp, Artificial Sequence
  chemically synthesized
acttgaactcaggaggtcaa

SEQ ID NO: 421486 - DNA, 20 bp, Artificial Sequence
  chemically synthesized
aactcaggaggtcaagggtt

SEQ ID NO: 421487 - DNA, 20 bp, Artificial Sequence
  chemically synthesized
caggaggtcaagggttcagt

SEQ ID NO: 421488 - DNA, 20 bp, Artificial Sequence
  chemically synthesized
tggagtgcagtggtcgatca

SEQ ID NO: 421489 - DNA, 20 bp, Artificial Sequence
  chemically synthesized
tcatccaggatggagtgcag

SEQ ID NO: 421490 - DNA, 20 bp, Artificial Sequence
  chemically synthesized
ctgtcatccaggatggagtg

SEQ ID NO: 421491 - DNA, 20 bp, Artificial Sequence
  chemically synthesized
tcgaccactgcactccatcc

SEQ ID NO: 421492 - DNA, 20 bp, Artificial Sequence
  chemically synthesized
tttctctgtcatccaggatg

SEQ ID NO: 421493 - DNA, 20 bp, Artificial Sequence
  chemically synthesized
tttttctctgtcatccagga

SEQ ID NO: 421494 - DNA, 20 bp, Artificial Sequence
  chemically synthesized
ctgcactccatcctggatga

SEQ ID NO: 421495 - DNA, 20 bp, Artificial Sequence
  chemically synthesized
attttttttctctgtcatcc

SEQ ID NO: 421496 - DNA, 20 bp, Artificial Sequence
  chemically synthesized
gcactccatcctggatgaca

SEQ ID NO: 421497 - DNA, 20 bp, Artificial Sequence
  chemically synthesized
cattttttttctctgtcatc

SEQ ID NO: 421498 - DNA, 20 bp, Artificial Sequence
  chemically synthesized
gatgacagagaaaaaaaatg

SEQ ID NO: 421499 - DNA, 20 bp, Artificial Sequence
  chemically synthesized
tgacagagaaaaaaaatgca

SEQ ID NO: 421500 - DNA, 20 bp, Artificial Sequence
  chemically synthesized
aaaaaaaatgcagagctact

SEQ ID NO: 421501 - DNA, 20 bp, Artificial Sequence
  chemically synthesized
aaaaaaatgcagagctactg

SEQ ID NO: 421502 - DNA, 20 bp, Artificial Sequence
  chemically synthesized
tttctttgtaaatacctcag

SEQ ID NO: 421503 - DNA, 20 bp, Artificial Sequence
  chemically synthesized
atatttctttgtaaatacct

SEQ ID NO: 421504 - DNA, 20 bp, Artificial Sequence
  chemically synthesized
gagctactgaggtatttaca

SEQ ID NO: 421505 - DNA, 20 bp, Artificial Sequence
  chemically synthesized
ggtatttacaaagaaatata

SEQ ID NO: 421506 - DNA, 20 bp, Artificial Sequence
  chemically synthesized
ttacaaagaaatataaagca

SEQ ID NO: 421507 - DNA, 20 bp, Artificial Sequence
  chemically synthesized
taaagcacagcacgtgctct

SEQ ID NO: 421508 - DNA, 20 bp, Artificial Sequence
  chemically synthesized
aaagcacagcacgtgctctc

SEQ ID NO: 421509 - DNA, 20 bp, Artificial Sequence
  chemically synthesized
cttttttatagatttcctga

SEQ ID NO: 421510 - DNA, 20 bp, Artificial Sequence
  chemically synthesized
aacttttttatagatttcct

SEQ ID NO: 421511 - DNA, 20 bp, Artificial Sequence
  chemically synthesized
ctctcaggaaatctataaaa

SEQ ID NO: 421512 - DNA, 20 bp, Artificial Sequence
  chemically synthesized
ataactttttaactttttta

SEQ ID NO: 421513 - DNA, 20 bp, Artificial Sequence
  chemically synthesized
aaatctataaaaaagttaaa

SEQ ID NO: 421514 - DNA, 20 bp, Artificial Sequence
  chemically synthesized
ataaaaaagttaaaaagtta

SEQ ID NO: 421515 - DNA, 20 bp, Artificial Sequence
  chemically synthesized
gttaaaaagttatggaatca

SEQ ID NO: 421516 - DNA, 20 bp, Artificial Sequence
  chemically synthesized
atggaatcaaagttaatcca

SEQ ID NO: 421517 - DNA, 20 bp, Artificial Sequence
  chemically synthesized
tggaatcaaagttaatccac

SEQ ID NO: 421518 - DNA, 20 bp, Artificial Sequence
  chemically synthesized
tgcttgctaattatttcctg

SEQ ID NO: 421519 - DNA, 20 bp, Artificial Sequence
  chemically synthesized
gttaatccacaggaaataat

SEQ ID NO: 421520 - DNA, 20 bp, Artificial Sequence
  chemically synthesized
atccacaggaaataattagc

SEQ ID NO: 421521 - DNA, 20 bp, Artificial Sequence
  chemically synthesized
caagcaattatgtcgataac

SEQ ID NO: 421522 - DNA, 20 bp, Artificial Sequence
  chemically synthesized
aagcaattatgtcgataact

SEQ ID NO: 421523 - DNA, 20 bp, Artificial Sequence
  chemically synthesized
caattatgtcgataactggg

SEQ ID NO: 421524 - DNA, 20 bp, Artificial Sequence
  chemically synthesized
tccacatagttatttctacc

SEQ ID NO: 421525 - DNA, 20 bp, Artificial Sequence
  chemically synthesized
actgggtagaaataactatg

SEQ ID NO: 421526 - DNA, 20 bp, Artificial Sequence
  chemically synthesized
ctatgaacttttgttccaca

SEQ ID NO: 421527 - DNA, 20 bp, Artificial Sequence
  chemically synthesized
gaaataactatgtggaacaa

SEQ ID NO: 421528 - DNA, 20 bp, Artificial Sequence
  chemically synthesized
ctatgtggaacaaaagttca

SEQ ID NO: 421529 - DNA, 20 bp, Artificial Sequence
  chemically synthesized
gaacaaaagttcatagaaaa

SEQ ID NO: 421530 - DNA, 20 bp, Artificial Sequence
  chemically synthesized
acaaaagttcatagaaaaaa

SEQ ID NO: 421531 - DNA, 20 bp, Artificial Sequence
  chemically synthesized
caaaagttcatagaaaaaag

SEQ ID NO: 421532 - DNA, 20 bp, Artificial Sequence
  chemically synthesized
atagaaaaaagaggtgtttc

SEQ ID NO: 421533 - DNA, 20 bp, Artificial Sequence
  chemically synthesized
aaagaggtgtttcaagccgt

SEQ ID NO: 421534 - DNA, 20 bp, Artificial Sequence
  chemically synthesized
agaggtgtttcaagccgtta

SEQ ID NO: 421535 - DNA, 20 bp, Artificial Sequence
  chemically synthesized
gtgtttcaagccgttagaga

SEQ ID NO: 421536 - DNA, 20 bp, Artificial Sequence
  chemically synthesized
taccacaacactttctctaa

SEQ ID NO: 421537 - DNA, 20 bp, Artificial Sequence
  chemically synthesized
agccgttagagaaagtgttg

SEQ ID NO: 421538 - DNA, 20 bp, Artificial Sequence
  chemically synthesized
agagaaagtgttgtggtaac

SEQ ID NO: 421539 - DNA, 20 bp, Artificial Sequence
  chemically synthesized
gagaaagtgttgtggtaact

SEQ ID NO: 421540 - DNA, 20 bp, Artificial Sequence
  chemically synthesized
caaaaattcaattcaagtcc

SEQ ID NO: 421541 - DNA, 20 bp, Artificial Sequence
  chemically synthesized
catcttcaaaaattcaattc

SEQ ID NO: 421542 - DNA, 20 bp, Artificial Sequence
  chemically synthesized
ggacttgaattgaatttttg

SEQ ID NO: 421543 - DNA, 20 bp, Artificial Sequence
  chemically synthesized
ttgaattgaatttttgaaga

SEQ ID NO: 421544 - DNA, 20 bp, Artificial Sequence
  chemically synthesized
tgaattgaatttttgaagat

SEQ ID NO: 421545 - DNA, 20 bp, Artificial Sequence
  chemically synthesized
ttttgaagatgggaatgctt

SEQ ID NO: 421546 - DNA, 20 bp, Artificial Sequence
  chemically synthesized
tccatcgacttttggttcta

SEQ ID NO: 421547 - DNA, 20 bp, Artificial Sequence
  chemically synthesized
tgggaatgctttagaaccaa

SEQ ID NO: 421548 - DNA, 20 bp, Artificial Sequence
  chemically synthesized
ctttttcctccatcgacttt

SEQ ID NO: 421549 - DNA, 20 bp, Artificial Sequence
  chemically synthesized
gctttagaaccaaaagtcga

SEQ ID NO: 421550 - DNA, 20 bp, Artificial Sequence
  chemically synthesized
tttagaaccaaaagtcgatg

SEQ ID NO: 421551 - DNA, 20 bp, Artificial Sequence
  chemically synthesized
ttagaaccaaaagtcgatgg

SEQ ID NO: 421552 - DNA, 20 bp, Artificial Sequence
  chemically synthesized
ccaaaagtcgatggaggaaa

SEQ ID NO: 421553 - DNA, 20 bp, Artificial Sequence
  chemically synthesized
tcgatggaggaaaaagattc

SEQ ID NO: 421554 - DNA, 20 bp, Artificial Sequence
  chemically synthesized
tggaggaaaaagattccaga

SEQ ID NO: 421555 - DNA, 20 bp, Artificial Sequence
  chemically synthesized
ggaggaaaaagattccagaa

SEQ ID NO: 421556 - DNA, 20 bp, Artificial Sequence
  chemically synthesized
gaggaaaaagattccagaaa

SEQ ID NO: 421557 - DNA, 20 bp, Artificial Sequence
  chemically synthesized
aggaaaaagattccagaaag

SEQ ID NO: 421558 - DNA, 20 bp, Artificial Sequence
  chemically synthesized
ggaaaaagattccagaaagg

SEQ ID NO: 421559 - DNA, 20 bp, Artificial Sequence
  chemically synthesized
ctagtctgattccccctttc

SEQ ID NO: 421560 - DNA, 20 bp, Artificial Sequence
  chemically synthesized
agattccagaaagggggaat

SEQ ID NO: 421561 - DNA, 20 bp, Artificial Sequence
  chemically synthesized
ccagaaagggggaatcagac

SEQ ID NO: 421562 - DNA, 20 bp, Artificial Sequence
  chemically synthesized
aagggggaatcagactagaa

SEQ ID NO: 421563 - DNA, 20 bp, Artificial Sequence
  chemically synthesized
gggaatcagactagaaaagc

SEQ ID NO: 421564 - DNA, 20 bp, Artificial Sequence
  chemically synthesized
ctcatttattcttgcttttc

SEQ ID NO: 421565 - DNA, 20 bp, Artificial Sequence
  chemically synthesized
ctagaaaagcaagaataaat

SEQ ID NO: 421566 - DNA, 20 bp, Artificial Sequence
  chemically synthesized
aaaagcaagaataaatgagc

SEQ ID NO: 421567 - DNA, 20 bp, Artificial Sequence
  chemically synthesized
aataaatgagctggcctgta

SEQ ID NO: 421568 - DNA, 20 bp, Artificial Sequence
  chemically synthesized
attctctctcctatacaggc

SEQ ID NO: 421569 - DNA, 20 bp, Artificial Sequence
  chemically synthesized
ataaatgagctggcctgtat

SEQ ID NO: 421570 - DNA, 20 bp, Artificial Sequence
  chemically synthesized
aaatgagctggcctgtatag

SEQ ID NO: 421571 - DNA, 20 bp, Artificial Sequence
  chemically synthesized
aaatattctctctcctatac

SEQ ID NO: 421572 - DNA, 20 bp, Artificial Sequence
  chemically synthesized
atgagctggcctgtatagga

SEQ ID NO: 421573 - DNA, 20 bp, Artificial Sequence
  chemically synthesized
aaaatattctctctcctata

SEQ ID NO: 421574 - DNA, 20 bp, Artificial Sequence
  chemically synthesized
gagctggcctgtataggaga

SEQ ID NO: 421575 - DNA, 20 bp, Artificial Sequence
  chemically synthesized
aggagagagaatattttatg

SEQ ID NO: 421576 - DNA, 20 bp, Artificial Sequence
  chemically synthesized
gagagagaatattttatgca

SEQ ID NO: 421577 - DNA, 20 bp, Artificial Sequence
  chemically synthesized
aatattttatgcagagtata

SEQ ID NO: 421578 - DNA, 20 bp, Artificial Sequence
  chemically synthesized
ttatgcagagtatatagata

SEQ ID NO: 421579 - DNA, 20 bp, Artificial Sequence
  chemically synthesized
agtatatagataaagtaaca

SEQ ID NO: 421580 - DNA, 20 bp, Artificial Sequence
  chemically synthesized
aacacagttcaaacccttaa

SEQ ID NO: 421581 - DNA, 20 bp, Artificial Sequence
  chemically synthesized
tgctggctatacacttttaa

SEQ ID NO: 421582 - DNA, 20 bp, Artificial Sequence
  chemically synthesized
atgctggctatacactttta

SEQ ID NO: 421583 - DNA, 20 bp, Artificial Sequence
  chemically synthesized
tatgctggctatacactttt

SEQ ID NO: 421584 - DNA, 20 bp, Artificial Sequence
  chemically synthesized
ttcaaacccttaaaagtgta

SEQ ID NO: 421585 - DNA, 20 bp, Artificial Sequence
  chemically synthesized
aacccttaaaagtgtatagc

SEQ ID NO: 421586 - DNA, 20 bp, Artificial Sequence
  chemically synthesized
ttaaaagtgtatagccagca

SEQ ID NO: 421587 - DNA, 20 bp, Artificial Sequence
  chemically synthesized
atcctggcagaaaactatgc

SEQ ID NO: 421588 - DNA, 20 bp, Artificial Sequence
  chemically synthesized
tagccagcatagttttctgc

SEQ ID NO: 421589 - DNA, 20 bp, Artificial Sequence
  chemically synthesized
agccagcatagttttctgcc

SEQ ID NO: 421590 - DNA, 20 bp, Artificial Sequence
  chemically synthesized
gagagcagtatgaatcctgg

SEQ ID NO: 421591 - DNA, 20 bp, Artificial Sequence
  chemically synthesized
tttgagagcagtatgaatcc

SEQ ID NO: 421592 - DNA, 20 bp, Artificial Sequence
  chemically synthesized
agtatcttctgatttgagag

SEQ ID NO: 421593 - DNA, 20 bp, Artificial Sequence
  chemically synthesized
gattcatactgctctcaaat

SEQ ID NO: 421594 - DNA, 20 bp, Artificial Sequence
  chemically synthesized
tagagtatcttctgatttga

SEQ ID NO: 421595 - DNA, 20 bp, Artificial Sequence
  chemically synthesized
tcatactgctctcaaatcag

SEQ ID NO: 421596 - DNA, 20 bp, Artificial Sequence
  chemically synthesized
agtagagtatcttctgattt

SEQ ID NO: 421597 - DNA, 20 bp, Artificial Sequence
  chemically synthesized
caaatcagaagatactctac

SEQ ID NO: 421598 - DNA, 20 bp, Artificial Sequence
  chemically synthesized
tgtaattcttaaatctagta

SEQ ID NO: 421599 - DNA, 20 bp, Artificial Sequence
  chemically synthesized
tatgtaattcttaaatctag

SEQ ID NO: 421600 - DNA, 20 bp, Artificial Sequence
  chemically synthesized
gaagatactctactagattt

SEQ ID NO: 421601 - DNA, 20 bp, Artificial Sequence
  chemically synthesized
gactatgtaattcttaaatc

SEQ ID NO: 421602 - DNA, 20 bp, Artificial Sequence
  chemically synthesized
tactagatttaagaattaca

SEQ ID NO: 421603 - DNA, 20 bp, Artificial Sequence
  chemically synthesized
ttaagaattacatagtcaat

SEQ ID NO: 421604 - DNA, 20 bp, Artificial Sequence
  chemically synthesized
ttacatagtcaatcagctga

SEQ ID NO: 421605 - DNA, 20 bp, Artificial Sequence
  chemically synthesized
agtcaatcagctgaaagcct

SEQ ID NO: 421606 - DNA, 20 bp, Artificial Sequence
  chemically synthesized
gccgaaagttccaaggcttt

SEQ ID NO: 421607 - DNA, 20 bp, Artificial Sequence
  chemically synthesized
ctatgtagccgaaagttcca

SEQ ID NO: 421608 - DNA, 20 bp, Artificial Sequence
  chemically synthesized
actatgtagccgaaagttcc

SEQ ID NO: 421609 - DNA, 20 bp, Artificial Sequence
  chemically synthesized
gctgaaagccttggaacttt

SEQ ID NO: 421610 - DNA, 20 bp, Artificial Sequence
  chemically synthesized
tttaatgactatgtagccga

SEQ ID NO: 421611 - DNA, 20 bp, Artificial Sequence
  chemically synthesized
ccttggaactttcggctaca

SEQ ID NO: 421612 - DNA, 20 bp, Artificial Sequence
  chemically synthesized
tagtgtttttaatgactatg

SEQ ID NO: 421613 - DNA, 20 bp, Artificial Sequence
  chemically synthesized
cattaaaaacactactatta

SEQ ID NO: 421614 - DNA, 20 bp, Artificial Sequence
  chemically synthesized
gtgaaattgagctataatag

SEQ ID NO: 421615 - DNA, 20 bp, Artificial Sequence
  chemically synthesized
ctggtgaaattgagctataa

SEQ ID NO: 421616 - DNA, 20 bp, Artificial Sequence
  chemically synthesized
taatgtggcctggtgaaatt

SEQ ID NO: 421617 - DNA, 20 bp, Artificial Sequence
  chemically synthesized
ctattatagctcaatttcac

SEQ ID NO: 421618 - DNA, 20 bp, Artificial Sequence
  chemically synthesized
tattatagctcaatttcacc

SEQ ID NO: 421619 - DNA, 20 bp, Artificial Sequence
  chemically synthesized
tatatatatataatgtggcc

SEQ ID NO: 421620 - DNA, 20 bp, Artificial Sequence
  chemically synthesized
aaatatatatatatataatg

SEQ ID NO: 421621 - DNA, 20 bp, Artificial Sequence
  chemically synthesized
ttttgaaaaacaagtttaat

SEQ ID NO: 421622 - DNA, 20 bp, Artificial Sequence
  chemically synthesized
tgagttactttttgaaaaac

SEQ ID NO: 421623 - DNA, 20 bp, Artificial Sequence
  chemically synthesized
aattaaacttgtttttcaaa

SEQ ID NO: 421624 - DNA, 20 bp, Artificial Sequence
  chemically synthesized
ttaacttctttagataaaat

SEQ ID NO: 421625 - DNA, 20 bp, Artificial Sequence
  chemically synthesized
aaagtaactcattttatcta

SEQ ID NO: 421626 - DNA, 20 bp, Artificial Sequence
  chemically synthesized
gtaactcattttatctaaag

SEQ ID NO: 421627 - DNA, 20 bp, Artificial Sequence
  chemically synthesized
tttgatgagcttaacttctt

SEQ ID NO: 421628 - DNA, 20 bp, Artificial Sequence
  chemically synthesized
tcattttatctaaagaagtt

SEQ ID NO: 421629 - DNA, 20 bp, Artificial Sequence
  chemically synthesized
taaagaagttaagctcatca

SEQ ID NO: 421630 - DNA, 20 bp, Artificial Sequence
  chemically synthesized
ctgttccactttgctttgat

SEQ ID NO: 421631 - DNA, 20 bp, Artificial Sequence
  chemically synthesized
aagttaagctcatcaaagca

SEQ ID NO: 421632 - DNA, 20 bp, Artificial Sequence
  chemically synthesized
ttaagctcatcaaagcaaag

SEQ ID NO: 421633 - DNA, 20 bp, Artificial Sequence
  chemically synthesized
ctcatcaaagcaaagtggaa

SEQ ID NO: 421634 - DNA, 20 bp, Artificial Sequence
  chemically synthesized
atcaaagcaaagtggaacag

SEQ ID NO: 421635 - DNA, 20 bp, Artificial Sequence
  chemically synthesized
aaagcaaagtggaacagtgg

SEQ ID NO: 421636 - DNA, 20 bp, Artificial Sequence
  chemically synthesized
caaagtggaacagtggtagc

SEQ ID NO: 421637 - DNA, 20 bp, Artificial Sequence
  chemically synthesized
gaacagtggtagccagtaac

SEQ ID NO: 421638 - DNA, 20 bp, Artificial Sequence
  chemically synthesized
aacagtggtagccagtaact

SEQ ID NO: 421639 - DNA, 20 bp, Artificial Sequence
  chemically synthesized
acagtggtagccagtaactg

SEQ ID NO: 421640 - DNA, 20 bp, Artificial Sequence
  chemically synthesized
ttttttccatccccagttac

SEQ ID NO: 421641 - DNA, 20 bp, Artificial Sequence
  chemically synthesized
tggtagccagtaactgggga

SEQ ID NO: 421642 - DNA, 20 bp, Artificial Sequence
  chemically synthesized
tccccatttttttccatccc

SEQ ID NO: 421643 - DNA, 20 bp, Artificial Sequence
  chemically synthesized
taactggggatggaaaaaaa

SEQ ID NO: 421644 - DNA, 20 bp, Artificial Sequence
  chemically synthesized
aactggggatggaaaaaaat

SEQ ID NO: 421645 - DNA, 20 bp, Artificial Sequence
  chemically synthesized
actggggatggaaaaaaatg

SEQ ID NO: 421646 - DNA, 20 bp, Artificial Sequence
  chemically synthesized
ggaaaaaaatggggaaatgc

SEQ ID NO: 421647 - DNA, 20 bp, Artificial Sequence
  chemically synthesized
aaatggggaaatgctggtcg

SEQ ID NO: 421648 - DNA, 20 bp, Artificial Sequence
  chemically synthesized
aatggggaaatgctggtcga

SEQ ID NO: 421649 - DNA, 20 bp, Artificial Sequence
  chemically synthesized
gagagtttctatccttcgac

SEQ ID NO: 421650 - DNA, 20 bp, Artificial Sequence
  chemically synthesized
gggaaatgctggtcgaagga

SEQ ID NO: 421651 - DNA, 20 bp, Artificial Sequence
  chemically synthesized
ggtcgaaggatagaaactct

SEQ ID NO: 421652 - DNA, 20 bp, Artificial Sequence
  chemically synthesized
cttactcatcttataactga

SEQ ID NO: 421653 - DNA, 20 bp, Artificial Sequence
  chemically synthesized
ggatagaaactctcagttat

SEQ ID NO: 421654 - DNA, 20 bp, Artificial Sequence
  chemically synthesized
agcttactcatcttataact

SEQ ID NO: 421655 - DNA, 20 bp, Artificial Sequence
  chemically synthesized
gaaactctcagttataagat

SEQ ID NO: 421656 - DNA, 20 bp, Artificial Sequence
  chemically synthesized
ctctcagttataagatgagt

SEQ ID NO: 421657 - DNA, 20 bp, Artificial Sequence
  chemically synthesized
gttataagatgagtaagctc

SEQ ID NO: 421658 - DNA, 20 bp, Artificial Sequence
  chemically synthesized
ttataagatgagtaagctct

SEQ ID NO: 421659 - DNA, 20 bp, Artificial Sequence
  chemically synthesized
tataagatgagtaagctctg

SEQ ID NO: 421660 - DNA, 20 bp, Artificial Sequence
  chemically synthesized
tgctgtacattagatcccca

SEQ ID NO: 421661 - DNA, 20 bp, Artificial Sequence
  chemically synthesized
catgctgtacattagatccc

SEQ ID NO: 421662 - DNA, 20 bp, Artificial Sequence
  chemically synthesized
agctctggggatctaatgta

SEQ ID NO: 421663 - DNA, 20 bp, Artificial Sequence
  chemically synthesized
atagtcaacatgctgtacat

SEQ ID NO: 421664 - DNA, 20 bp, Artificial Sequence
  chemically synthesized
aatgtacagcatgttgacta

SEQ ID NO: 421665 - DNA, 20 bp, Artificial Sequence
  chemically synthesized
agcatgttgactatagttaa

SEQ ID NO: 421666 - DNA, 20 bp, Artificial Sequence
  chemically synthesized
caatagagtactattaacta

SEQ ID NO: 421667 - DNA, 20 bp, Artificial Sequence
  chemically synthesized
gcaaatttcaagtaacaata

SEQ ID NO: 421668 - DNA, 20 bp, Artificial Sequence
  chemically synthesized
tagcaaatttcaagtaacaa

SEQ ID NO: 421669 - DNA, 20 bp, Artificial Sequence
  chemically synthesized
gatctctcttagcaaatttc

SEQ ID NO: 421670 - DNA, 20 bp, Artificial Sequence
  chemically synthesized
attgttacttgaaatttgct

SEQ ID NO: 421671 - DNA, 20 bp, Artificial Sequence
  chemically synthesized
tgttacttgaaatttgctaa

SEQ ID NO: 421672 - DNA, 20 bp, Artificial Sequence
  chemically synthesized
ttacttgaaatttgctaaga

SEQ ID NO: 421673 - DNA, 20 bp, Artificial Sequence
  chemically synthesized
agaacacttaagatctctct

SEQ ID NO: 421674 - DNA, 20 bp, Artificial Sequence
  chemically synthesized
aatttgctaagagagatctt

SEQ ID NO: 421675 - DNA, 20 bp, Artificial Sequence
  chemically synthesized
tttttatgatgagaacactt

SEQ ID NO: 421676 - DNA, 20 bp, Artificial Sequence
  chemically synthesized
ccattataattttttatgat

SEQ ID NO: 421677 - DNA, 20 bp, Artificial Sequence
  chemically synthesized
ctcatcataaaaaattataa

SEQ ID NO: 421678 - DNA, 20 bp, Artificial Sequence
  chemically synthesized
aattataatggcaactatgt

SEQ ID NO: 421679 - DNA, 20 bp, Artificial Sequence
  chemically synthesized
attataatggcaactatgtg

SEQ ID NO: 421680 - DNA, 20 bp, Artificial Sequence
  chemically synthesized
aatatatccttcacctcaca

SEQ ID NO: 421681 - DNA, 20 bp, Artificial Sequence
  chemically synthesized
aatggcaactatgtgaggtg

SEQ ID NO: 421682 - DNA, 20 bp, Artificial Sequence
  chemically synthesized
atggcaactatgtgaggtga

SEQ ID NO: 421683 - DNA, 20 bp, Artificial Sequence
  chemically synthesized
ctgaaatgattatcacaatc

SEQ ID NO: 421684 - DNA, 20 bp, Artificial Sequence
  chemically synthesized
cttgattgtgataatcattt

SEQ ID NO: 421685 - DNA, 20 bp, Artificial Sequence
  chemically synthesized
atggcgattgggtatattca

SEQ ID NO: 421686 - DNA, 20 bp, Artificial Sequence
  chemically synthesized
aatggcgattgggtatattc

SEQ ID NO: 421687 - DNA, 20 bp, Artificial Sequence
  chemically synthesized
ataattgacaaatggcgatt

SEQ ID NO: 421688 - DNA, 20 bp, Artificial Sequence
  chemically synthesized
tataattgacaaatggcgat

SEQ ID NO: 421689 - DNA, 20 bp, Artificial Sequence
  chemically synthesized
attgaggtataattgacaaa

SEQ ID NO: 421690 - DNA, 20 bp, Artificial Sequence
  chemically synthesized
ttgtcaattatacctcaata

SEQ ID NO: 421691 - DNA, 20 bp, Artificial Sequence
  chemically synthesized
cttttcccccagctttattg

SEQ ID NO: 421692 - DNA, 20 bp, Artificial Sequence
  chemically synthesized
ccttttcccccagctttatt

SEQ ID NO: 421693 - DNA, 20 bp, Artificial Sequence
  chemically synthesized
caattatacctcaataaagc

SEQ ID NO: 421694 - DNA, 20 bp, Artificial Sequence
  chemically synthesized
aattatacctcaataaagct

SEQ ID NO: 421695 - DNA, 20 bp, Artificial Sequence
  chemically synthesized
attatacctcaataaagctg

SEQ ID NO: 421696 - DNA, 20 bp, Artificial Sequence
  chemically synthesized
ttatacctcaataaagctgg

SEQ ID NO: 421697 - DNA, 20 bp, Artificial Sequence
  chemically synthesized
cctcaataaagctgggggaa

SEQ ID NO: 421698 - DNA, 20 bp, Artificial Sequence
  chemically synthesized
ctcaataaagctgggggaaa

SEQ ID NO: 421699 - DNA, 20 bp, Artificial Sequence
  chemically synthesized
atatgaggtaccttttcccc

SEQ ID NO: 421700 - DNA, 20 bp, Artificial Sequence
  chemically synthesized
aaaatgtaataataaatatg

SEQ ID NO: 421701 - DNA, 20 bp, Artificial Sequence
  chemically synthesized
taaaatgtaataataaatat

SEQ ID NO: 421702 - DNA, 20 bp, Artificial Sequence
  chemically synthesized
agttacttcaagggtcaaat

SEQ ID NO: 421703 - DNA, 20 bp, Artificial Sequence
  chemically synthesized
tttatctcatttgacccttg

SEQ ID NO: 421704 - DNA, 20 bp, Artificial Sequence
  chemically synthesized
tttaggttcagttacttcaa

SEQ ID NO: 421705 - DNA, 20 bp, Artificial Sequence
  chemically synthesized
ttttaggttcagttacttca

SEQ ID NO: 421706 - DNA, 20 bp, Artificial Sequence
  chemically synthesized
tttttaggttcagttacttc

SEQ ID NO: 421707 - DNA, 20 bp, Artificial Sequence
  chemically synthesized
aaaatactgctttttaggtt

SEQ ID NO: 421708 - DNA, 20 bp, Artificial Sequence
  chemically synthesized
ttgaagtaactgaacctaaa

SEQ ID NO: 421709 - DNA, 20 bp, Artificial Sequence
  chemically synthesized
aagtaactgaacctaaaaag

SEQ ID NO: 421710 - DNA, 20 bp, Artificial Sequence
  chemically synthesized
atctaaaaatactgcttttt

SEQ ID NO: 421711 - DNA, 20 bp, Artificial Sequence
  chemically synthesized
tatctaaaaatactgctttt

SEQ ID NO: 421712 - DNA, 20 bp, Artificial Sequence
  chemically synthesized
aacctaaaaagcagtatttt

SEQ ID NO: 421713 - DNA, 20 bp, Artificial Sequence
  chemically synthesized
tatttttagatatgaaaact

SEQ ID NO: 421714 - DNA, 20 bp, Artificial Sequence
  chemically synthesized
atttttagatatgaaaactg

SEQ ID NO: 421715 - DNA, 20 bp, Artificial Sequence
  chemically synthesized
cattaatcctcaatgggcct

SEQ ID NO: 421716 - DNA, 20 bp, Artificial Sequence
  chemically synthesized
tatgaaaactgaggcccatt

SEQ ID NO: 421717 - DNA, 20 bp, Artificial Sequence
  chemically synthesized
atgaaaactgaggcccattg

SEQ ID NO: 421718 - DNA, 20 bp, Artificial Sequence
  chemically synthesized
gagaatcattaatcctcaat

SEQ ID NO: 421719 - DNA, 20 bp, Artificial Sequence
  chemically synthesized
tgagaatcattaatcctcaa

SEQ ID NO: 421720 - DNA, 20 bp, Artificial Sequence
  chemically synthesized
ttgaggattaatgattctca

SEQ ID NO: 421721 - DNA, 20 bp, Artificial Sequence
  chemically synthesized
attaatgattctcaaagcca

SEQ ID NO: 421722 - DNA, 20 bp, Artificial Sequence
  chemically synthesized
actgcttaccctgtggcttt

SEQ ID NO: 421723 - DNA, 20 bp, Artificial Sequence
  chemically synthesized
ttaatgattctcaaagccac

SEQ ID NO: 421724 - DNA, 20 bp, Artificial Sequence
  chemically synthesized
taatgattctcaaagccaca

SEQ ID NO: 421725 - DNA, 20 bp, Artificial Sequence
  chemically synthesized
gattctcaaagccacagggt

SEQ ID NO: 421726 - DNA, 20 bp, Artificial Sequence
  chemically synthesized
taactttactgcttaccctg

SEQ ID NO: 421727 - DNA, 20 bp, Artificial Sequence
  chemically synthesized
tctcaaagccacagggtaag

SEQ ID NO: 421728 - DNA, 20 bp, Artificial Sequence
  chemically synthesized
aagccacagggtaagcagta

SEQ ID NO: 421729 - DNA, 20 bp, Artificial Sequence
  chemically synthesized
gtaatcaggacacatgagag

SEQ ID NO: 421730 - DNA, 20 bp, Artificial Sequence
  chemically synthesized
ttgtaatcaggacacatgag

SEQ ID NO: 421731 - DNA, 20 bp, Artificial Sequence
  chemically synthesized
tttgtaatcaggacacatga

SEQ ID NO: 421732 - DNA, 20 bp, Artificial Sequence
  chemically synthesized
gatttgtaatcaggacacat

SEQ ID NO: 421733 - DNA, 20 bp, Artificial Sequence
  chemically synthesized
ttaggtaatgatttgtaatc

SEQ ID NO: 421734 - DNA, 20 bp, Artificial Sequence
  chemically synthesized
gttaggtaatgatttgtaat

SEQ ID NO: 421735 - DNA, 20 bp, Artificial Sequence
  chemically synthesized
gcaaggaaattacagacgtt

SEQ ID NO: 421736 - DNA, 20 bp, Artificial Sequence
  chemically synthesized
tgcaaggaaattacagacgt

SEQ ID NO: 421737 - DNA, 20 bp, Artificial Sequence
  chemically synthesized
tcgatgatgcaaggaaatta

SEQ ID NO: 421738 - DNA, 20 bp, Artificial Sequence
  chemically synthesized
ttcaggttctcgatgatgca

SEQ ID NO: 421739 - DNA, 20 bp, Artificial Sequence
  chemically synthesized
tttcaggttctcgatgatgc

SEQ ID NO: 421740 - DNA, 20 bp, Artificial Sequence
  chemically synthesized
tgtaatttccttgcatcatc

SEQ ID NO: 421741 - DNA, 20 bp, Artificial Sequence
  chemically synthesized
gtttttatgataaaagtttc

SEQ ID NO: 421742 - DNA, 20 bp, Artificial Sequence
  chemically synthesized
tgtttttatgataaaagttt

SEQ ID NO: 421743 - DNA, 20 bp, Artificial Sequence
  chemically synthesized
tagaaatgtttttatgataa

SEQ ID NO: 421744 - DNA, 20 bp, Artificial Sequence
  chemically synthesized
ttttatcataaaaacatttc

SEQ ID NO: 421745 - DNA, 20 bp, Artificial Sequence
  chemically synthesized
tttatcataaaaacatttct

SEQ ID NO: 421746 - DNA, 20 bp, Artificial Sequence
  chemically synthesized
aaaaacatttctaggaaatc

SEQ ID NO: 421747 - DNA, 20 bp, Artificial Sequence
  chemically synthesized
gcgtatggtaccagatttcc

SEQ ID NO: 421748 - DNA, 20 bp, Artificial Sequence
  chemically synthesized
agttgattagcgtatggtac

SEQ ID NO: 421749 - DNA, 20 bp, Artificial Sequence
  chemically synthesized
ttccatagttgattagcgta

SEQ ID NO: 421750 - DNA, 20 bp, Artificial Sequence
  chemically synthesized
attttctttccatagttgat

SEQ ID NO: 421751 - DNA, 20 bp, Artificial Sequence
  chemically synthesized
taccatacgctaatcaacta

SEQ ID NO: 421752 - DNA, 20 bp, Artificial Sequence
  chemically synthesized
atacgctaatcaactatgga

SEQ ID NO: 421753 - DNA, 20 bp, Artificial Sequence
  chemically synthesized
aaaaatggattttctttcca

SEQ ID NO: 421754 - DNA, 20 bp, Artificial Sequence
  chemically synthesized
ggaaagaaaatccattttta

SEQ ID NO: 421755 - DNA, 20 bp, Artificial Sequence
  chemically synthesized
gaaagaaaatccatttttaa

SEQ ID NO: 421756 - DNA, 20 bp, Artificial Sequence
  chemically synthesized
ttgagatactcctttaaaaa

SEQ ID NO: 421757 - DNA, 20 bp, Artificial Sequence
  chemically synthesized
aagaaaatccatttttaaag

SEQ ID NO: 421758 - DNA, 20 bp, Artificial Sequence
  chemically synthesized
tgtgcaaattgcaacaagtt

SEQ ID NO: 421759 - DNA, 20 bp, Artificial Sequence
  chemically synthesized
ttttatgtgcaaattgcaac

SEQ ID NO: 421760 - DNA, 20 bp, Artificial Sequence
  chemically synthesized
tcccgtagtatatgagacaa

SEQ ID NO: 421761 - DNA, 20 bp, Artificial Sequence
  chemically synthesized
gtcccgtagtatatgagaca

SEQ ID NO: 421762 - DNA, 20 bp, Artificial Sequence
  chemically synthesized
tgttttgtcccgtagtatat

SEQ ID NO: 421763 - DNA, 20 bp, Artificial Sequence
  chemically synthesized
atcctttgtctcatatacta

SEQ ID NO: 421764 - DNA, 20 bp, Artificial Sequence
  chemically synthesized
tcctttgtctcatatactac

SEQ ID NO: 421765 - DNA, 20 bp, Artificial Sequence
  chemically synthesized
tctgcttctgttttgtcccg

SEQ ID NO: 421766 - DNA, 20 bp, Artificial Sequence
  chemically synthesized
tcatatactacgggacaaaa

SEQ ID NO: 421767 - DNA, 20 bp, Artificial Sequence
  chemically synthesized
tatactacgggacaaaacag

SEQ ID NO: 421768 - DNA, 20 bp, Artificial Sequence
  chemically synthesized
actacgggacaaaacagaag

SEQ ID NO: 421769 - DNA, 20 bp, Artificial Sequence
  chemically synthesized
cagaagcagaaacaatgaaa

SEQ ID NO: 421770 - DNA, 20 bp, Artificial Sequence
  chemically synthesized
agaagcagaaacaatgaaat

SEQ ID NO: 421771 - DNA, 20 bp, Artificial Sequence
  chemically synthesized
caatgaaataggttcaccat

SEQ ID NO: 421772 - DNA, 20 bp, Artificial Sequence
  chemically synthesized
atgaaataggttcaccatta

SEQ ID NO: 421773 - DNA, 20 bp, Artificial Sequence
  chemically synthesized
aagactagtcagatctctaa

SEQ ID NO: 421774 - DNA, 20 bp, Artificial Sequence
  chemically synthesized
ttcaccattagagatctgac

SEQ ID NO: 421775 - DNA, 20 bp, Artificial Sequence
  chemically synthesized
gtctacatttcaagactagt

SEQ ID NO: 421776 - DNA, 20 bp, Artificial Sequence
  chemically synthesized
aattgtctacatttcaagac

SEQ ID NO: 421777 - DNA, 20 bp, Artificial Sequence
  chemically synthesized
atctgactagtcttgaaatg

SEQ ID NO: 421778 - DNA, 20 bp, Artificial Sequence
  chemically synthesized
acctgaattgtctacatttc

SEQ ID NO: 421779 - DNA, 20 bp, Artificial Sequence
  chemically synthesized
gtcttgaaatgtagacaatt

SEQ ID NO: 421780 - DNA, 20 bp, Artificial Sequence
  chemically synthesized
tcttgaaatgtagacaattc

SEQ ID NO: 421781 - DNA, 20 bp, Artificial Sequence
  chemically synthesized
atgtagacaattcaggtcat

SEQ ID NO: 421782 - DNA, 20 bp, Artificial Sequence
  chemically synthesized
acaattcaggtcattagtca

SEQ ID NO: 421783 - DNA, 20 bp, Artificial Sequence
  chemically synthesized
aattcaggtcattagtcatg

SEQ ID NO: 421784 - DNA, 20 bp, Artificial Sequence
  chemically synthesized
gtcattagtcatggagtcct

SEQ ID NO: 421785 - DNA, 20 bp, Artificial Sequence
  chemically synthesized
tcattagtcatggagtccta

SEQ ID NO: 421786 - DNA, 20 bp, Artificial Sequence
  chemically synthesized
cattagtcatggagtcctaa

SEQ ID NO: 421787 - DNA, 20 bp, Artificial Sequence
  chemically synthesized
attagtcatggagtcctaag

SEQ ID NO: 421788 - DNA, 20 bp, Artificial Sequence
  chemically synthesized
caggcatgctttttcccctt

SEQ ID NO: 421789 - DNA, 20 bp, Artificial Sequence
  chemically synthesized
tcaggcatgctttttcccct

SEQ ID NO: 421790 - DNA, 20 bp, Artificial Sequence
  chemically synthesized
catggagtcctaaggggaaa

SEQ ID NO: 421791 - DNA, 20 bp, Artificial Sequence
  chemically synthesized
ggctttactagtgtggaatc

SEQ ID NO: 421792 - DNA, 20 bp, Artificial Sequence
  chemically synthesized
tggctttactagtgtggaat

SEQ ID NO: 421793 - DNA, 20 bp, Artificial Sequence
  chemically synthesized
aagcatgcctgattccacac

SEQ ID NO: 421794 - DNA, 20 bp, Artificial Sequence
  chemically synthesized
agcttctggctttactagtg

SEQ ID NO: 421795 - DNA, 20 bp, Artificial Sequence
  chemically synthesized
tgcctgattccacactagta

SEQ ID NO: 421796 - DNA, 20 bp, Artificial Sequence
  chemically synthesized
tgattccacactagtaaagc

SEQ ID NO: 421797 - DNA, 20 bp, Artificial Sequence
  chemically synthesized
tagatagcttctggctttac

SEQ ID NO: 421798 - DNA, 20 bp, Artificial Sequence
  chemically synthesized
ttccacactagtaaagccag

SEQ ID NO: 421799 - DNA, 20 bp, Artificial Sequence
  chemically synthesized
gatgtaaattagatagcttc

SEQ ID NO: 421800 - DNA, 20 bp, Artificial Sequence
  chemically synthesized
agtataggatgtaaattaga

SEQ ID NO: 421801 - DNA, 20 bp, Artificial Sequence
  chemically synthesized
gccaagtataggatgtaaat

SEQ ID NO: 421802 - DNA, 20 bp, Artificial Sequence
  chemically synthesized
tctaatttacatcctatact

SEQ ID NO: 421803 - DNA, 20 bp, Artificial Sequence
  chemically synthesized
tgatatcctcagccaagtat

SEQ ID NO: 421804 - DNA, 20 bp, Artificial Sequence
  chemically synthesized
ctgatatcctcagccaagta

SEQ ID NO: 421805 - DNA, 20 bp, Artificial Sequence
  chemically synthesized
tttacatcctatacttggct

SEQ ID NO: 421806 - DNA, 20 bp, Artificial Sequence
  chemically synthesized
ttacatcctatacttggctg

SEQ ID NO: 421807 - DNA, 20 bp, Artificial Sequence
  chemically synthesized
cacatctgatatcctcagcc

SEQ ID NO: 421808 - DNA, 20 bp, Artificial Sequence
  chemically synthesized
ctatacttggctgaggatat

SEQ ID NO: 421809 - DNA, 20 bp, Artificial Sequence
  chemically synthesized
ctgaacacatctgatatcct

SEQ ID NO: 421810 - DNA, 20 bp, Artificial Sequence
  chemically synthesized
ctgaggatatcagatgtgtt

SEQ ID NO: 421811 - DNA, 20 bp, Artificial Sequence
  chemically synthesized
tgaggatatcagatgtgttc

SEQ ID NO: 421812 - DNA, 20 bp, Artificial Sequence
  chemically synthesized
cagatgtgttcaggctgaac

SEQ ID NO: 421813 - DNA, 20 bp, Artificial Sequence
  chemically synthesized
aaaagagtcttgaacttgtt

SEQ ID NO: 421814 - DNA, 20 bp, Artificial Sequence
  chemically synthesized
tgttcaggctgaacaagttc

SEQ ID NO: 421815 - DNA, 20 bp, Artificial Sequence
  chemically synthesized
tctcaaaaaaaaaaaaaaaa

SEQ ID NO: 421816 - DNA, 20 bp, Artificial Sequence
  chemically synthesized
cgtctcaaaaaaaaaaaaaa

SEQ ID NO: 421817 - DNA, 20 bp, Artificial Sequence
  chemically synthesized
actctttttttttttttttt

SEQ ID NO: 421818 - DNA, 20 bp, Artificial Sequence
  chemically synthesized
ttttttttttttttttgaga

SEQ ID NO: 421819 - DNA, 20 bp, Artificial Sequence
  chemically synthesized
ttttttttttttttgagacg

SEQ ID NO: 421820 - DNA, 20 bp, Artificial Sequence
  chemically synthesized
tccagcctgggcgacagagc

SEQ ID NO: 421821 - DNA, 20 bp, Artificial Sequence
  chemically synthesized
cggagtctcgctctgtcgcc

SEQ ID NO: 421822 - DNA, 20 bp, Artificial Sequence
  chemically synthesized
gcactccagcctgggcgaca

SEQ ID NO: 421823 - DNA, 20 bp, Artificial Sequence
  chemically synthesized
ggagtctcgctctgtcgccc

SEQ ID NO: 421824 - DNA, 20 bp, Artificial Sequence
  chemically synthesized
ctgcactccagcctgggcga

SEQ ID NO: 421825 - DNA, 20 bp, Artificial Sequence
  chemically synthesized
tctcgctctgtcgcccaggc

SEQ ID NO: 421826 - DNA, 20 bp, Artificial Sequence
  chemically synthesized
tcgctctgtcgcccaggctg

SEQ ID NO: 421827 - DNA, 20 bp, Artificial Sequence
  chemically synthesized
gcgccactgcactccagcct

SEQ ID NO: 421828 - DNA, 20 bp, Artificial Sequence
  chemically synthesized
cgcgccactgcactccagcc

SEQ ID NO: 421829 - DNA, 20 bp, Artificial Sequence
  chemically synthesized
ctgtcgcccaggctggagtg

SEQ ID NO: 421830 - DNA, 20 bp, Artificial Sequence
  chemically synthesized
gagatcgcgccactgcactc

SEQ ID NO: 421831 - DNA, 20 bp, Artificial Sequence
  chemically synthesized
tcgcccaggctggagtgcag

SEQ ID NO: 421832 - DNA, 20 bp, Artificial Sequence
  chemically synthesized
ggagtgcagtggcgcgatct

SEQ ID NO: 421833 - DNA, 20 bp, Artificial Sequence
  chemically synthesized
ggcggagcttgcagtgagcc

SEQ ID NO: 421834 - DNA, 20 bp, Artificial Sequence
  chemically synthesized
gcgcgatctcggctcactgc

SEQ ID NO: 421835 - DNA, 20 bp, Artificial Sequence
  chemically synthesized
cgggaggcggagcttgcagt

SEQ ID NO: 421836 - DNA, 20 bp, Artificial Sequence
  chemically synthesized
aacccgggaggcggagcttg

SEQ ID NO: 421837 - DNA, 20 bp, Artificial Sequence
  chemically synthesized
tcactgcaagctccgcctcc

SEQ ID NO: 421838 - DNA, 20 bp, Artificial Sequence
  chemically synthesized
tggcgtgaacccgggaggcg

SEQ ID NO: 421839 - DNA, 20 bp, Artificial Sequence
  chemically synthesized
cactgcaagctccgcctccc

SEQ ID NO: 421840 - DNA, 20 bp, Artificial Sequence
  chemically synthesized
aatggcgtgaacccgggagg

SEQ ID NO: 421841 - DNA, 20 bp, Artificial Sequence
  chemically synthesized
gagaatggcgtgaacccggg

SEQ ID NO: 421842 - DNA, 20 bp, Artificial Sequence
  chemically synthesized
ggagaatggcgtgaacccgg

SEQ ID NO: 421843 - DNA, 20 bp, Artificial Sequence
  chemically synthesized
caggagaatggcgtgaaccc

SEQ ID NO: 421844 - DNA, 20 bp, Artificial Sequence
  chemically synthesized
gcaggagaatggcgtgaacc

SEQ ID NO: 421845 - DNA, 20 bp, Artificial Sequence
  chemically synthesized
gggaggctgaggcaggagaa

SEQ ID NO: 421846 - DNA, 20 bp, Artificial Sequence
  chemically synthesized
ttcacgccattctcctgcct

SEQ ID NO: 421847 - DNA, 20 bp, Artificial Sequence
  chemically synthesized
tactcgggaggctgaggcag

SEQ ID NO: 421848 - DNA, 20 bp, Artificial Sequence
  chemically synthesized
gctactcgggaggctgaggc

SEQ ID NO: 421849 - DNA, 20 bp, Artificial Sequence
  chemically synthesized
agctactcgggaggctgagg

SEQ ID NO: 421850 - DNA, 20 bp, Artificial Sequence
  chemically synthesized
cccagctactcgggaggctg

SEQ ID NO: 421851 - DNA, 20 bp, Artificial Sequence
  chemically synthesized
tcccagctactcgggaggct

SEQ ID NO: 421852 - DNA, 20 bp, Artificial Sequence
  chemically synthesized
ttctcctgcctcagcctccc

SEQ ID NO: 421853 - DNA, 20 bp, Artificial Sequence
  chemically synthesized
tcctgcctcagcctcccgag

SEQ ID NO: 421854 - DNA, 20 bp, Artificial Sequence
  chemically synthesized
tgtagtcccagctactcggg

SEQ ID NO: 421855 - DNA, 20 bp, Artificial Sequence
  chemically synthesized
ctgtagtcccagctactcgg

SEQ ID NO: 421856 - DNA, 20 bp, Artificial Sequence
  chemically synthesized
gcctcagcctcccgagtagc

SEQ ID NO: 421857 - DNA, 20 bp, Artificial Sequence
  chemically synthesized
gcctgtagtcccagctactc

SEQ ID NO: 421858 - DNA, 20 bp, Artificial Sequence
  chemically synthesized
cctcagcctcccgagtagct

SEQ ID NO: 421859 - DNA, 20 bp, Artificial Sequence
  chemically synthesized
cgcctgtagtcccagctact

SEQ ID NO: 421860 - DNA, 20 bp, Artificial Sequence
  chemically synthesized
ctcccgagtagctgggacta

SEQ ID NO: 421861 - DNA, 20 bp, Artificial Sequence
  chemically synthesized
tcccgagtagctgggactac

SEQ ID NO: 421862 - DNA, 20 bp, Artificial Sequence
  chemically synthesized
gtagcgggcgcctgtagtcc

SEQ ID NO: 421863 - DNA, 20 bp, Artificial Sequence
  chemically synthesized
ggcgtggtagcgggcgcctg

SEQ ID NO: 421864 - DNA, 20 bp, Artificial Sequence
  chemically synthesized
aattagccgggcgtggtagc

SEQ ID NO: 421865 - DNA, 20 bp, Artificial Sequence
  chemically synthesized
aaattagccgggcgtggtag

SEQ ID NO: 421866 - DNA, 20 bp, Artificial Sequence
  chemically synthesized
caggcgcccgctaccacgcc

SEQ ID NO: 421867 - DNA, 20 bp, Artificial Sequence
  chemically synthesized
aaaaaattagccgggcgtgg

SEQ ID NO: 421868 - DNA, 20 bp, Artificial Sequence
  chemically synthesized
tacaaaaaattagccgggcg

SEQ ID NO: 421869 - DNA, 20 bp, Artificial Sequence
  chemically synthesized
aaaaatacaaaaaattagcc

SEQ ID NO: 421870 - DNA, 20 bp, Artificial Sequence
  chemically synthesized
taaaaatacaaaaaattagc

SEQ ID NO: 421871 - DNA, 20 bp, Artificial Sequence
  chemically synthesized
ccactaaaaatacaaaaaat

SEQ ID NO: 421872 - DNA, 20 bp, Artificial Sequence
  chemically synthesized
cggctaattttttgtatttt

SEQ ID NO: 421873 - DNA, 20 bp, Artificial Sequence
  chemically synthesized
ctaattttttgtatttttag

SEQ ID NO: 421874 - DNA, 20 bp, Artificial Sequence
  chemically synthesized
aattttttgtatttttagtg

SEQ ID NO: 421875 - DNA, 20 bp, Artificial Sequence
  chemically synthesized
ttttgtatttttagtggaga

SEQ ID NO: 421876 - DNA, 20 bp, Artificial Sequence
  chemically synthesized
tttgtatttttagtggagac

SEQ ID NO: 421877 - DNA, 20 bp, Artificial Sequence
  chemically synthesized
ttgtatttttagtggagacg

SEQ ID NO: 421878 - DNA, 20 bp, Artificial Sequence
  chemically synthesized
gagacggggtttcaccgtgt

SEQ ID NO: 421879 - DNA, 20 bp, Artificial Sequence
  chemically synthesized
cggggtttcaccgtgttagc

SEQ ID NO: 421880 - DNA, 20 bp, Artificial Sequence
  chemically synthesized
cgagaccatcctggctaaca

SEQ ID NO: 421881 - DNA, 20 bp, Artificial Sequence
  chemically synthesized
ggggtttcaccgtgttagcc

SEQ ID NO: 421882 - DNA, 20 bp, Artificial Sequence
  chemically synthesized
tttcaccgtgttagccagga

SEQ ID NO: 421883 - DNA, 20 bp, Artificial Sequence
  chemically synthesized
tcaggagatcgagaccatcc

SEQ ID NO: 421884 - DNA, 20 bp, Artificial Sequence
  chemically synthesized
gatcacgaggtcaggagatc

SEQ ID NO: 421885 - DNA, 20 bp, Artificial Sequence
  chemically synthesized
cgggcggatcacgaggtcag

SEQ ID NO: 421886 - DNA, 20 bp, Artificial Sequence
  chemically synthesized
ggcgggcggatcacgaggtc

SEQ ID NO: 421887 - DNA, 20 bp, Artificial Sequence
  chemically synthesized
aggcgggcggatcacgaggt

SEQ ID NO: 421888 - DNA, 20 bp, Artificial Sequence
  chemically synthesized
gccgaggcgggcggatcacg

SEQ ID NO: 421889 - DNA, 20 bp, Artificial Sequence
  chemically synthesized
ggccgaggcgggcggatcac

SEQ ID NO: 421890 - DNA, 20 bp, Artificial Sequence
  chemically synthesized
acctcgtgatccgcccgcct

SEQ ID NO: 421891 - DNA, 20 bp, Artificial Sequence
  chemically synthesized
ctttgggaggccgaggcggg

SEQ ID NO: 421892 - DNA, 20 bp, Artificial Sequence
  chemically synthesized
gcactttgggaggccgaggc

SEQ ID NO: 421893 - DNA, 20 bp, Artificial Sequence
  chemically synthesized
agcactttgggaggccgagg

SEQ ID NO: 421894 - DNA, 20 bp, Artificial Sequence
  chemically synthesized
cccagcactttgggaggccg

SEQ ID NO: 421895 - DNA, 20 bp, Artificial Sequence
  chemically synthesized
tcccagcactttgggaggcc

SEQ ID NO: 421896 - DNA, 20 bp, Artificial Sequence
  chemically synthesized
ccgcccgcctcggcctccca

SEQ ID NO: 421897 - DNA, 20 bp, Artificial Sequence
  chemically synthesized
tgtaatcccagcactttggg

SEQ ID NO: 421898 - DNA, 20 bp, Artificial Sequence
  chemically synthesized
ctgtaatcccagcactttgg

SEQ ID NO: 421899 - DNA, 20 bp, Artificial Sequence
  chemically synthesized
gcctcggcctcccaaagtgc

SEQ ID NO: 421900 - DNA, 20 bp, Artificial Sequence
  chemically synthesized
gcctgtaatcccagcacttt

SEQ ID NO: 421901 - DNA, 20 bp, Artificial Sequence
  chemically synthesized
cctcggcctcccaaagtgct

SEQ ID NO: 421902 - DNA, 20 bp, Artificial Sequence
  chemically synthesized
cgcctgtaatcccagcactt

SEQ ID NO: 421903 - DNA, 20 bp, Artificial Sequence
  chemically synthesized
ctcccaaagtgctgggatta

SEQ ID NO: 421904 - DNA, 20 bp, Artificial Sequence
  chemically synthesized
tcccaaagtgctgggattac

SEQ ID NO: 421905 - DNA, 20 bp, Artificial Sequence
  chemically synthesized
gtggctcacgcctgtaatcc

SEQ ID NO: 421906 - DNA, 20 bp, Artificial Sequence
  chemically synthesized
agtgctgggattacaggcgt

SEQ ID NO: 421907 - DNA, 20 bp, Artificial Sequence
  chemically synthesized
caggcgtgagccaccgcgcc

SEQ ID NO: 421908 - DNA, 20 bp, Artificial Sequence
  chemically synthesized
agagtcttggccgggcgcgg

SEQ ID NO: 421909 - DNA, 20 bp, Artificial Sequence
  chemically synthesized
gcaagagtcttggccgggcg

SEQ ID NO: 421910 - DNA, 20 bp, Artificial Sequence
  chemically synthesized
gtgagccaccgcgcccggcc

SEQ ID NO: 421911 - DNA, 20 bp, Artificial Sequence
  chemically synthesized
ctcaagcaagagtcttggcc

SEQ ID NO: 421912 - DNA, 20 bp, Artificial Sequence
  chemically synthesized
actcaagcaagagtcttggc

SEQ ID NO: 421913 - DNA, 20 bp, Artificial Sequence
  chemically synthesized
aattactcaagcaagagtct

SEQ ID NO: 421914 - DNA, 20 bp, Artificial Sequence
  chemically synthesized
cccggccaagactcttgctt

SEQ ID NO: 421915 - DNA, 20 bp, Artificial Sequence
  chemically synthesized
cctttaaattactcaagcaa

SEQ ID NO: 421916 - DNA, 20 bp, Artificial Sequence
  chemically synthesized
tccctttaaattactcaagc

SEQ ID NO: 421917 - DNA, 20 bp, Artificial Sequence
  chemically synthesized
cacatccctttaaattactc

SEQ ID NO: 421918 - DNA, 20 bp, Artificial Sequence
  chemically synthesized
actcttgcttgagtaattta

SEQ ID NO: 421919 - DNA, 20 bp, Artificial Sequence
  chemically synthesized
ctcttgcttgagtaatttaa

SEQ ID NO: 421920 - DNA, 20 bp, Artificial Sequence
  chemically synthesized
tcttgcttgagtaatttaaa

SEQ ID NO: 421921 - DNA, 20 bp, Artificial Sequence
  chemically synthesized
taatttaaagggatgtgaca

SEQ ID NO: 421922 - DNA, 20 bp, Artificial Sequence
  chemically synthesized
gggatgtgacacagtctgaa

SEQ ID NO: 421923 - DNA, 20 bp, Artificial Sequence
  chemically synthesized
ttaaataaccaattactatt

SEQ ID NO: 421924 - DNA, 20 bp, Artificial Sequence
  chemically synthesized
gacacagtctgaatagtaat

SEQ ID NO: 421925 - DNA, 20 bp, Artificial Sequence
  chemically synthesized
ttatttaataatcctgcctg

SEQ ID NO: 421926 - DNA, 20 bp, Artificial Sequence
  chemically synthesized
cttatgttgccactgcaggc

SEQ ID NO: 421927 - DNA, 20 bp, Artificial Sequence
  chemically synthesized
tttaataatcctgcctgcag

SEQ ID NO: 421928 - DNA, 20 bp, Artificial Sequence
  chemically synthesized
gcttatgttgccactgcagg

SEQ ID NO: 421929 - DNA, 20 bp, Artificial Sequence
  chemically synthesized
caagcttatgttgccactgc

SEQ ID NO: 421930 - DNA, 20 bp, Artificial Sequence
  chemically synthesized
gcaagcttatgttgccactg

SEQ ID NO: 421931 - DNA, 20 bp, Artificial Sequence
  chemically synthesized
cctgcctgcagtggcaacat

SEQ ID NO: 421932 - DNA, 20 bp, Artificial Sequence
  chemically synthesized
ccagtgcttaagagtaaagc

SEQ ID NO: 421933 - DNA, 20 bp, Artificial Sequence
  chemically synthesized
cataagcttgctttactctt

SEQ ID NO: 421934 - DNA, 20 bp, Artificial Sequence
  chemically synthesized
ctatccagtgcttaagagta

SEQ ID NO: 421935 - DNA, 20 bp, Artificial Sequence
  chemically synthesized
ttgtcctatccagtgcttaa

SEQ ID NO: 421936 - DNA, 20 bp, Artificial Sequence
  chemically synthesized
cttgctttactcttaagcac

SEQ ID NO: 421937 - DNA, 20 bp, Artificial Sequence
  chemically synthesized
gtttgtcctatccagtgctt

SEQ ID NO: 421938 - DNA, 20 bp, Artificial Sequence
  chemically synthesized
ctttactcttaagcactgga

SEQ ID NO: 421939 - DNA, 20 bp, Artificial Sequence
  chemically synthesized
tttactcttaagcactggat

SEQ ID NO: 421940 - DNA, 20 bp, Artificial Sequence
  chemically synthesized
gtaagacagtttgtcctatc

SEQ ID NO: 421941 - DNA, 20 bp, Artificial Sequence
  chemically synthesized
ataggacaaactgtcttact

SEQ ID NO: 421942 - DNA, 20 bp, Artificial Sequence
  chemically synthesized
tttcctaggactgagtaaga

SEQ ID NO: 421943 - DNA, 20 bp, Artificial Sequence
  chemically synthesized
ttcttttcctaggactgagt

SEQ ID NO: 421944 - DNA, 20 bp, Artificial Sequence
  chemically synthesized
caaactgtcttactcagtcc

SEQ ID NO: 421945 - DNA, 20 bp, Artificial Sequence
  chemically synthesized
aaactgtcttactcagtcct

SEQ ID NO: 421946 - DNA, 20 bp, Artificial Sequence
  chemically synthesized
acgtttcttttcctaggact

SEQ ID NO: 421947 - DNA, 20 bp, Artificial Sequence
  chemically synthesized
gtcttactcagtcctaggaa

SEQ ID NO: 421948 - DNA, 20 bp, Artificial Sequence
  chemically synthesized
agatgaacgtttcttttcct

SEQ ID NO: 421949 - DNA, 20 bp, Artificial Sequence
  chemically synthesized
cagatgaacgtttcttttcc

SEQ ID NO: 421950 - DNA, 20 bp, Artificial Sequence
  chemically synthesized
agaaacgttcatctgaacaa

SEQ ID NO: 421951 - DNA, 20 bp, Artificial Sequence
  chemically synthesized
tcgactttaaatcttttgtt

SEQ ID NO: 421952 - DNA, 20 bp, Artificial Sequence
  chemically synthesized
tcatctgaacaaaagattta

SEQ ID NO: 421953 - DNA, 20 bp, Artificial Sequence
  chemically synthesized
gtatttcaggatttcacatc

SEQ ID NO: 421954 - DNA, 20 bp, Artificial Sequence
  chemically synthesized
tgtatttcaggatttcacat

SEQ ID NO: 421955 - DNA, 20 bp, Artificial Sequence
  chemically synthesized
tcattttcaaaatgtatttc

SEQ ID NO: 421956 - DNA, 20 bp, Artificial Sequence
  chemically synthesized
ttcattttcaaaatgtattt

SEQ ID NO: 421957 - DNA, 20 bp, Artificial Sequence
  chemically synthesized
aaatacattttgaaaatgaa

SEQ ID NO: 421958 - DNA, 20 bp, Artificial Sequence
  chemically synthesized
cattttgaaaatgaatggat

SEQ ID NO: 421959 - DNA, 20 bp, Artificial Sequence
  chemically synthesized
ggattagcgataaaattaat

SEQ ID NO: 421960 - DNA, 20 bp, Artificial Sequence
  chemically synthesized
ttagcgataaaattaatgag

SEQ ID NO: 421961 - DNA, 20 bp, Artificial Sequence
  chemically synthesized
taaaattaatgagaagacta

SEQ ID NO: 421962 - DNA, 20 bp, Artificial Sequence
  chemically synthesized
atgtttcatttcagagactt

SEQ ID NO: 421963 - DNA, 20 bp, Artificial Sequence
  chemically synthesized
gccaaaaatgtttcatttca

SEQ ID NO: 421964 - DNA, 20 bp, Artificial Sequence
  chemically synthesized
atgccaaaaatgtttcattt

SEQ ID NO: 421965 - DNA, 20 bp, Artificial Sequence
  chemically synthesized
tctctgaaatgaaacatttt

SEQ ID NO: 421966 - DNA, 20 bp, Artificial Sequence
  chemically synthesized
acttttgaggggagcatatc

SEQ ID NO: 421967 - DNA, 20 bp, Artificial Sequence
  chemically synthesized
gacttttgaggggagcatat

SEQ ID NO: 421968 - DNA, 20 bp, Artificial Sequence
  chemically synthesized
acctgatatgctcccctcaa

SEQ ID NO: 421969 - DNA, 20 bp, Artificial Sequence
  chemically synthesized
ttccaagggacttttgaggg

SEQ ID NO: 421970 - DNA, 20 bp, Artificial Sequence
  chemically synthesized
aattccaagggacttttgag

SEQ ID NO: 421971 - DNA, 20 bp, Artificial Sequence
  chemically synthesized
taattccaagggacttttga

SEQ ID NO: 421972 - DNA, 20 bp, Artificial Sequence
  chemically synthesized
ctaattccaagggacttttg

SEQ ID NO: 421973 - DNA, 20 bp, Artificial Sequence
  chemically synthesized
gctaattccaagggactttt

SEQ ID NO: 421974 - DNA, 20 bp, Artificial Sequence
  chemically synthesized
tgctcccctcaaaagtccct

SEQ ID NO: 421975 - DNA, 20 bp, Artificial Sequence
  chemically synthesized
cctcaaaagtcccttggaat

SEQ ID NO: 421976 - DNA, 20 bp, Artificial Sequence
  chemically synthesized
gatagctaggctaattccaa

SEQ ID NO: 421977 - DNA, 20 bp, Artificial Sequence
  chemically synthesized
agatagctaggctaattcca

SEQ ID NO: 421978 - DNA, 20 bp, Artificial Sequence
  chemically synthesized
gagatagctaggctaattcc

SEQ ID NO: 421979 - DNA, 20 bp, Artificial Sequence
  chemically synthesized
aaagtcccttggaattagcc

SEQ ID NO: 421980 - DNA, 20 bp, Artificial Sequence
  chemically synthesized
aaagctatgctgagatagct

SEQ ID NO: 421981 - DNA, 20 bp, Artificial Sequence
  chemically synthesized
tggaattagcctagctatct

SEQ ID NO: 421982 - DNA, 20 bp, Artificial Sequence
  chemically synthesized
aaaagctatgctgagatagc

SEQ ID NO: 421983 - DNA, 20 bp, Artificial Sequence
  chemically synthesized
taagaaaagctatgctgaga

SEQ ID NO: 421984 - DNA, 20 bp, Artificial Sequence
  chemically synthesized
ttagcctagctatctcagca

SEQ ID NO: 421985 - DNA, 20 bp, Artificial Sequence
  chemically synthesized
gatgtaagaaaagctatgct

SEQ ID NO: 421986 - DNA, 20 bp, Artificial Sequence
  chemically synthesized
taatacccatgatgtaagaa

SEQ ID NO: 421987 - DNA, 20 bp, Artificial Sequence
  chemically synthesized
gcatagcttttcttacatca

SEQ ID NO: 421988 - DNA, 20 bp, Artificial Sequence
  chemically synthesized
catagcttttcttacatcat

SEQ ID NO: 421989 - DNA, 20 bp, Artificial Sequence
  chemically synthesized
taatgtaatacccatgatgt

SEQ ID NO: 421990 - DNA, 20 bp, Artificial Sequence
  chemically synthesized
ttacatcatgggtattacat

SEQ ID NO: 421991 - DNA, 20 bp, Artificial Sequence
  chemically synthesized
tcatgggtattacattagcc

SEQ ID NO: 421992 - DNA, 20 bp, Artificial Sequence
  chemically synthesized
gacaaatagacaagttggct

SEQ ID NO: 421993 - DNA, 20 bp, Artificial Sequence
  chemically synthesized
acaaggacaaatagacaagt

SEQ ID NO: 421994 - DNA, 20 bp, Artificial Sequence
  chemically synthesized
tgagacaaggacaaatagac

SEQ ID NO: 421995 - DNA, 20 bp, Artificial Sequence
  chemically synthesized
tgatgtgagacaaggacaaa

SEQ ID NO: 421996 - DNA, 20 bp, Artificial Sequence
  chemically synthesized
gtgaaaagtgatgtgagaca

SEQ ID NO: 421997 - DNA, 20 bp, Artificial Sequence
  chemically synthesized
ggtgaaaagtgatgtgagac

SEQ ID NO: 421998 - DNA, 20 bp, Artificial Sequence
  chemically synthesized
ttgagggtgaaaagtgatgt

SEQ ID NO: 421999 - DNA, 20 bp, Artificial Sequence
  chemically synthesized
gagtaaaagttgagggtgaa

SEQ ID NO: 422000 - DNA, 20 bp, Artificial Sequence
  chemically synthesized
ataaatggagtaaaagttga

SEQ ID NO: 422001 - DNA, 20 bp, Artificial Sequence
  chemically synthesized
cataaatggagtaaaagttg

SEQ ID NO: 422002 - DNA, 20 bp, Artificial Sequence
  chemically synthesized
gcataaatggagtaaaagtt

SEQ ID NO: 422003 - DNA, 20 bp, Artificial Sequence
  chemically synthesized
gattggcataaatggagtaa

SEQ ID NO: 422004 - DNA, 20 bp, Artificial Sequence
  chemically synthesized
taaggagattggcataaatg

SEQ ID NO: 422005 - DNA, 20 bp, Artificial Sequence
  chemically synthesized
gataaggagattggcataaa

SEQ ID NO: 422006 - DNA, 20 bp, Artificial Sequence
  chemically synthesized
cttgctgtggataaggagat

SEQ ID NO: 422007 - DNA, 20 bp, Artificial Sequence
  chemically synthesized
agcatcttgctgtggataag

SEQ ID NO: 422008 - DNA, 20 bp, Artificial Sequence
  chemically synthesized
tatgccaatctccttatcca

SEQ ID NO: 422009 - DNA, 20 bp, Artificial Sequence
  chemically synthesized
gtagcatcttgctgtggata

SEQ ID NO: 422010 - DNA, 20 bp, Artificial Sequence
  chemically synthesized
agtagcatcttgctgtggat

SEQ ID NO: 422011 - DNA, 20 bp, Artificial Sequence
  chemically synthesized
ccaatctccttatccacagc

SEQ ID NO: 422012 - DNA, 20 bp, Artificial Sequence
  chemically synthesized
gtcaaagtagcatcttgctg

SEQ ID NO: 422013 - DNA, 20 bp, Artificial Sequence
  chemically synthesized
gaaaggccaaaaagtcaaag

SEQ ID NO: 422014 - DNA, 20 bp, Artificial Sequence
  chemically synthesized
tgagaaaggccaaaaagtca

SEQ ID NO: 422015 - DNA, 20 bp, Artificial Sequence
  chemically synthesized
aagatgctactttgactttt

SEQ ID NO: 422016 - DNA, 20 bp, Artificial Sequence
  chemically synthesized
gcatgctgagaaaggccaaa

SEQ ID NO: 422017 - DNA, 20 bp, Artificial Sequence
  chemically synthesized
tttgactttttggcctttct

SEQ ID NO: 422018 - DNA, 20 bp, Artificial Sequence
  chemically synthesized
gtgaagaagcatgctgagaa

SEQ ID NO: 422019 - DNA, 20 bp, Artificial Sequence
  chemically synthesized
ggtgaagaagcatgctgaga

SEQ ID NO: 422020 - DNA, 20 bp, Artificial Sequence
  chemically synthesized
cagtggtgaagaagcatgct

SEQ ID NO: 422021 - DNA, 20 bp, Artificial Sequence
  chemically synthesized
gctcttccacagtggtgaag

SEQ ID NO: 422022 - DNA, 20 bp, Artificial Sequence
  chemically synthesized
gaagctcttccacagtggtg

SEQ ID NO: 422023 - DNA, 20 bp, Artificial Sequence
  chemically synthesized
agcatgcttcttcaccactg

SEQ ID NO: 422024 - DNA, 20 bp, Artificial Sequence
  chemically synthesized
atgcttcttcaccactgtgg

SEQ ID NO: 422025 - DNA, 20 bp, Artificial Sequence
  chemically synthesized
actgggaagctcttccacag

SEQ ID NO: 422026 - DNA, 20 bp, Artificial Sequence
  chemically synthesized
gcttcttcaccactgtggaa

SEQ ID NO: 422027 - DNA, 20 bp, Artificial Sequence
  chemically synthesized
tgtactgggaagctcttcca

SEQ ID NO: 422028 - DNA, 20 bp, Artificial Sequence
  chemically synthesized
accactgtggaagagcttcc

SEQ ID NO: 422029 - DNA, 20 bp, Artificial Sequence
  chemically synthesized
gtagtagtagttgtactggg

SEQ ID NO: 422030 - DNA, 20 bp, Artificial Sequence
  chemically synthesized
gcagtagtagtagttgtact

SEQ ID NO: 422031 - DNA, 20 bp, Artificial Sequence
  chemically synthesized
ggcagtagtagtagttgtac

SEQ ID NO: 422032 - DNA, 20 bp, Artificial Sequence
  chemically synthesized
gttgtggttggcagtagtag

SEQ ID NO: 422033 - DNA, 20 bp, Artificial Sequence
  chemically synthesized
gaggttgtggttggcagtag

SEQ ID NO: 422034 - DNA, 20 bp, Artificial Sequence
  chemically synthesized
atggaggttgtggttggcag

SEQ ID NO: 422035 - DNA, 20 bp, Artificial Sequence
  chemically synthesized
gatatggaggttgtggttgg

SEQ ID NO: 422036 - DNA, 20 bp, Artificial Sequence
  chemically synthesized
tcagatatggaggttgtggt

SEQ ID NO: 422037 - DNA, 20 bp, Artificial Sequence
  chemically synthesized
agtgtcagatatggaggttg

SEQ ID NO: 422038 - DNA, 20 bp, Artificial Sequence
  chemically synthesized
ggatttagtgtcagatatgg

SEQ ID NO: 422039 - DNA, 20 bp, Artificial Sequence
  chemically synthesized
aggatttagtgtcagatatg

SEQ ID NO: 422040 - DNA, 20 bp, Artificial Sequence
  chemically synthesized
caaggatttagtgtcagata

SEQ ID NO: 422041 - DNA, 20 bp, Artificial Sequence
  chemically synthesized
agtaggcaaggatttagtgt

SEQ ID NO: 422042 - DNA, 20 bp, Artificial Sequence
  chemically synthesized
cagtttagtaggcaaggatt

SEQ ID NO: 422043 - DNA, 20 bp, Artificial Sequence
  chemically synthesized
aatgagcagtttagtaggca

SEQ ID NO: 422044 - DNA, 20 bp, Artificial Sequence
  chemically synthesized
taatgagcagtttagtaggc

SEQ ID NO: 422045 - DNA, 20 bp, Artificial Sequence
  chemically synthesized
aagataatgagcagtttagt

SEQ ID NO: 422046 - DNA, 20 bp, Artificial Sequence
  chemically synthesized
aaagataatgagcagtttag

SEQ ID NO: 422047 - DNA, 20 bp, Artificial Sequence
  chemically synthesized
tttaaagataatgagcagtt

SEQ ID NO: 422048 - DNA, 20 bp, Artificial Sequence
  chemically synthesized
ccaattttaaagataatgag

SEQ ID NO: 422049 - DNA, 20 bp, Artificial Sequence
  chemically synthesized
atgccaattttaaagataat

SEQ ID NO: 422050 - DNA, 20 bp, Artificial Sequence
  chemically synthesized
ctgctcattatctttaaaat

SEQ ID NO: 422051 - DNA, 20 bp, Artificial Sequence
  chemically synthesized
agtgagtgatgccaatttta

SEQ ID NO: 422052 - DNA, 20 bp, Artificial Sequence
  chemically synthesized
tggatgtgtgaagtagaagt

SEQ ID NO: 422053 - DNA, 20 bp, Artificial Sequence
  chemically synthesized
acagtggatgtgtgaagtag

SEQ ID NO: 422054 - DNA, 20 bp, Artificial Sequence
  chemically synthesized
cgaacagtggatgtgtgaag

SEQ ID NO: 422055 - DNA, 20 bp, Artificial Sequence
  chemically synthesized
tatcgaacagtggatgtgtg

SEQ ID NO: 422056 - DNA, 20 bp, Artificial Sequence
  chemically synthesized
cttggctggatatcgaacag

SEQ ID NO: 422057 - DNA, 20 bp, Artificial Sequence
  chemically synthesized
aggcttggctggatatcgaa

SEQ ID NO: 422058 - DNA, 20 bp, Artificial Sequence
  chemically synthesized
cacatccactgttcgatatc

SEQ ID NO: 422059 - DNA, 20 bp, Artificial Sequence
  chemically synthesized
ccactgttcgatatccagcc

SEQ ID NO: 422060 - DNA, 20 bp, Artificial Sequence
  chemically synthesized
agtcagagtccaggcttggc

SEQ ID NO: 422061 - DNA, 20 bp, Artificial Sequence
  chemically synthesized
gttcgatatccagccaagcc

SEQ ID NO: 422062 - DNA, 20 bp, Artificial Sequence
  chemically synthesized
gatcagtcagagtccaggct

SEQ ID NO: 422063 - DNA, 20 bp, Artificial Sequence
  chemically synthesized
gaagtgatcagtcagagtcc

SEQ ID NO: 422064 - DNA, 20 bp, Artificial Sequence
  chemically synthesized
tgaagtgatcagtcagagtc

SEQ ID NO: 422065 - DNA, 20 bp, Artificial Sequence
  chemically synthesized
agcactgaagtgatcagtca

SEQ ID NO: 422066 - DNA, 20 bp, Artificial Sequence
  chemically synthesized
gtagcactgaagtgatcagt

SEQ ID NO: 422067 - DNA, 20 bp, Artificial Sequence
  chemically synthesized
tggactctgactgatcactt

SEQ ID NO: 422068 - DNA, 20 bp, Artificial Sequence
  chemically synthesized
gtatgtagcactgaagtgat

SEQ ID NO: 422069 - DNA, 20 bp, Artificial Sequence
  chemically synthesized
tgtctttgtatgtagcactg

SEQ ID NO: 422070 - DNA, 20 bp, Artificial Sequence
  chemically synthesized
tcacttcagtgctacataca

SEQ ID NO: 422071 - DNA, 20 bp, Artificial Sequence
  chemically synthesized
gtctaaggtgtctttgtatg

SEQ ID NO: 422072 - DNA, 20 bp, Artificial Sequence
  chemically synthesized
tgctacatacaaagacacct

SEQ ID NO: 422073 - DNA, 20 bp, Artificial Sequence
  chemically synthesized
gttcaaggaagtaaagtcta

SEQ ID NO: 422074 - DNA, 20 bp, Artificial Sequence
  chemically synthesized
agttcaaggaagtaaagtct

SEQ ID NO: 422075 - DNA, 20 bp, Artificial Sequence
  chemically synthesized
caataaagttcaaggaagta

SEQ ID NO: 422076 - DNA, 20 bp, Artificial Sequence
  chemically synthesized
atgttcaataaagttcaagg

SEQ ID NO: 422077 - DNA, 20 bp, Artificial Sequence
  chemically synthesized
aagatgttcaataaagttca

SEQ ID NO: 422078 - DNA, 20 bp, Artificial Sequence
  chemically synthesized
aaagatgttcaataaagttc

SEQ ID NO: 422079 - DNA, 20 bp, Artificial Sequence
  chemically synthesized
ggaagtaaagatgttcaata

SEQ ID NO: 422080 - DNA, 20 bp, Artificial Sequence
  chemically synthesized
acaatgtgttcaaggaagta

SEQ ID NO: 422081 - DNA, 20 bp, Artificial Sequence
  chemically synthesized
tatatacaatgtgttcaagg

SEQ ID NO: 422082 - DNA, 20 bp, Artificial Sequence
  chemically synthesized
ttatatatacaatgtgttca

SEQ ID NO: 422083 - DNA, 20 bp, Artificial Sequence
  chemically synthesized
attatatatacaatgtgttc

SEQ ID NO: 422084 - DNA, 20 bp, Artificial Sequence
  chemically synthesized
tgaacacattgtatatataa

SEQ ID NO: 422085 - DNA, 20 bp, Artificial Sequence
  chemically synthesized
aacacattgtatatataata

SEQ ID NO: 422086 - DNA, 20 bp, Artificial Sequence
  chemically synthesized
acattgtatatataatagag

SEQ ID NO: 422087 - DNA, 20 bp, Artificial Sequence
  chemically synthesized
cattgtatatataatagaga

SEQ ID NO: 422088 - DNA, 20 bp, Artificial Sequence
  chemically synthesized
ttgtatatataatagagaag

SEQ ID NO: 422089 - DNA, 20 bp, Artificial Sequence
  chemically synthesized
tgtatatataatagagaagg

SEQ ID NO: 422090 - DNA, 20 bp, Artificial Sequence
  chemically synthesized
cacacacacacatataaaat

SEQ ID NO: 422091 - DNA, 20 bp, Artificial Sequence
  chemically synthesized
cacacatataaaatgagctc

SEQ ID NO: 422092 - DNA, 20 bp, Artificial Sequence
  chemically synthesized
acacatataaaatgagctca

SEQ ID NO: 422093 - DNA, 20 bp, Artificial Sequence
  chemically synthesized
catataaaatgagctcaagg

SEQ ID NO: 422094 - DNA, 20 bp, Artificial Sequence
  chemically synthesized
ttacaattctttacttcctt

SEQ ID NO: 422095 - DNA, 20 bp, Artificial Sequence
  chemically synthesized
aaaatgagctcaaggaagta

SEQ ID NO: 422096 - DNA, 20 bp, Artificial Sequence
  chemically synthesized
tcaaggaagtaaagaattgt

SEQ ID NO: 422097 - DNA, 20 bp, Artificial Sequence
  chemically synthesized
ggagtaggtattggagaaag

SEQ ID NO: 422098 - DNA, 20 bp, Artificial Sequence
  chemically synthesized
agaggagtaggtattggaga

SEQ ID NO: 422099 - DNA, 20 bp, Artificial Sequence
  chemically synthesized
gcaaagaggagtaggtattg

SEQ ID NO: 422100 - DNA, 20 bp, Artificial Sequence
  chemically synthesized
tagcaaagaggagtaggtat

SEQ ID NO: 422101 - DNA, 20 bp, Artificial Sequence
  chemically synthesized
atgccttagcaaagaggagt

SEQ ID NO: 422102 - DNA, 20 bp, Artificial Sequence
  chemically synthesized
gatgccttagcaaagaggag

SEQ ID NO: 422103 - DNA, 20 bp, Artificial Sequence
  chemically synthesized
tctgatgccttagcaaagag

SEQ ID NO: 422104 - DNA, 20 bp, Artificial Sequence
  chemically synthesized
aatacctactcctctttgct

SEQ ID NO: 422105 - DNA, 20 bp, Artificial Sequence
  chemically synthesized
catctgatgccttagcaaag

SEQ ID NO: 422106 - DNA, 20 bp, Artificial Sequence
  chemically synthesized
atacctactcctctttgcta

SEQ ID NO: 422107 - DNA, 20 bp, Artificial Sequence
  chemically synthesized
tcatctgatgccttagcaaa

SEQ ID NO: 422108 - DNA, 20 bp, Artificial Sequence
  chemically synthesized
catcatctgatgccttagca

SEQ ID NO: 422109 - DNA, 20 bp, Artificial Sequence
  chemically synthesized
actcctctttgctaaggcat

SEQ ID NO: 422110 - DNA, 20 bp, Artificial Sequence
  chemically synthesized
aacaacatcatctgatgcct

SEQ ID NO: 422111 - DNA, 20 bp, Artificial Sequence
  chemically synthesized
agatgatgttgtttgtgact

SEQ ID NO: 422112 - DNA, 20 bp, Artificial Sequence
  chemically synthesized
gtggataatagtgatttact

SEQ ID NO: 422113 - DNA, 20 bp, Artificial Sequence
  chemically synthesized
gttcagttgatggtggataa

SEQ ID NO: 422114 - DNA, 20 bp, Artificial Sequence
  chemically synthesized
cagcatggttcagttgatgg

SEQ ID NO: 422115 - DNA, 20 bp, Artificial Sequence
  chemically synthesized
taacagcatggttcagttga

SEQ ID NO: 422116 - DNA, 20 bp, Artificial Sequence
  chemically synthesized
gaaagagtaacagcatggtt

SEQ ID NO: 422117 - DNA, 20 bp, Artificial Sequence
  chemically synthesized
aatgggaaagagtaacagca

SEQ ID NO: 422118 - DNA, 20 bp, Artificial Sequence
  chemically synthesized
aaactaatgggaaagagtaa

SEQ ID NO: 422119 - DNA, 20 bp, Artificial Sequence
  chemically synthesized
cggaataaactaatgggaaa

SEQ ID NO: 422120 - DNA, 20 bp, Artificial Sequence
  chemically synthesized
atgctgttactctttcccat

SEQ ID NO: 422121 - DNA, 20 bp, Artificial Sequence
  chemically synthesized
tgcggaataaactaatggga

SEQ ID NO: 422122 - DNA, 20 bp, Artificial Sequence
  chemically synthesized
tatttgcggaataaactaat

SEQ ID NO: 422123 - DNA, 20 bp, Artificial Sequence
  chemically synthesized
gtatttgcggaataaactaa

SEQ ID NO: 422124 - DNA, 20 bp, Artificial Sequence
  chemically synthesized
agtagcttaatatgtatttg

SEQ ID NO: 422125 - DNA, 20 bp, Artificial Sequence
  chemically synthesized
ttattccgcaaatacatatt

SEQ ID NO: 422126 - DNA, 20 bp, Artificial Sequence
  chemically synthesized
tattgtcagtcacgcagtag

SEQ ID NO: 422127 - DNA, 20 bp, Artificial Sequence
  chemically synthesized
gcatattgtcagtcacgcag

SEQ ID NO: 422128 - DNA, 20 bp, Artificial Sequence
  chemically synthesized
catgcatattgtcagtcacg

SEQ ID NO: 422129 - DNA, 20 bp, Artificial Sequence
  chemically synthesized
tacactaacatgcatattgt

SEQ ID NO: 422130 - DNA, 20 bp, Artificial Sequence
  chemically synthesized
gtgactgacaatatgcatgt

SEQ ID NO: 422131 - DNA, 20 bp, Artificial Sequence
  chemically synthesized
tatgcatgttagtgtatatt

SEQ ID NO: 422132 - DNA, 20 bp, Artificial Sequence
  chemically synthesized
gcatgttagtgtatattcag

SEQ ID NO: 422133 - DNA, 20 bp, Artificial Sequence
  chemically synthesized
gtgtatattcagtggcgatc

SEQ ID NO: 422134 - DNA, 20 bp, Artificial Sequence
  chemically synthesized
tgtatattcagtggcgatca

SEQ ID NO: 422135 - DNA, 20 bp, Artificial Sequence
  chemically synthesized
atattcagtggcgatcaagg

SEQ ID NO: 422136 - DNA, 20 bp, Artificial Sequence
  chemically synthesized
tcagtggcgatcaaggcagt

SEQ ID NO: 422137 - DNA, 20 bp, Artificial Sequence
  chemically synthesized
agtggcgatcaaggcagtta

SEQ ID NO: 422138 - DNA, 20 bp, Artificial Sequence
  chemically synthesized
gtggcgatcaaggcagttag

SEQ ID NO: 422139 - DNA, 20 bp, Artificial Sequence
  chemically synthesized
cgatcaaggcagttagagga

SEQ ID NO: 422140 - DNA, 20 bp, Artificial Sequence
  chemically synthesized
aaggcagttagaggatggat

SEQ ID NO: 422141 - DNA, 20 bp, Artificial Sequence
  chemically synthesized
aggcagttagaggatggatg

SEQ ID NO: 422142 - DNA, 20 bp, Artificial Sequence
  chemically synthesized
gcagttagaggatggatgag

SEQ ID NO: 422143 - DNA, 20 bp, Artificial Sequence
  chemically synthesized
agttagaggatggatgagga

SEQ ID NO: 422144 - DNA, 20 bp, Artificial Sequence
  chemically synthesized
gatggatgaggagagcattc

SEQ ID NO: 422145 - DNA, 20 bp, Artificial Sequence
  chemically synthesized
atggatgaggagagcattcc

SEQ ID NO: 422146 - DNA, 20 bp, Artificial Sequence
  chemically synthesized
gatgaggagagcattccagg

SEQ ID NO: 422147 - DNA, 20 bp, Artificial Sequence
  chemically synthesized
tgaggagagcattccaggaa

SEQ ID NO: 422148 - DNA, 20 bp, Artificial Sequence
  chemically synthesized
gaggagagcattccaggaag

SEQ ID NO: 422149 - DNA, 20 bp, Artificial Sequence
  chemically synthesized
gtactgctattgcctcttcc

SEQ ID NO: 422150 - DNA, 20 bp, Artificial Sequence
  chemically synthesized
agcattccaggaagaggcaa

SEQ ID NO: 422151 - DNA, 20 bp, Artificial Sequence
  chemically synthesized
attccaggaagaggcaatag

SEQ ID NO: 422152 - DNA, 20 bp, Artificial Sequence
  chemically synthesized
aggaagaggcaatagcagta

SEQ ID NO: 422153 - DNA, 20 bp, Artificial Sequence
  chemically synthesized
gaagaggcaatagcagtaca

SEQ ID NO: 422154 - DNA, 20 bp, Artificial Sequence
  chemically synthesized
ggcaatagcagtacagagac

SEQ ID NO: 422155 - DNA, 20 bp, Artificial Sequence
  chemically synthesized
cagtacagagactggcattt

SEQ ID NO: 422156 - DNA, 20 bp, Artificial Sequence
  chemically synthesized
tgctgccatttctcaaatgc

SEQ ID NO: 422157 - DNA, 20 bp, Artificial Sequence
  chemically synthesized
agagactggcatttgagaaa

SEQ ID NO: 422158 - DNA, 20 bp, Artificial Sequence
  chemically synthesized
gactggcatttgagaaatgg

SEQ ID NO: 422159 - DNA, 20 bp, Artificial Sequence
  chemically synthesized
tggcatttgagaaatggcag

SEQ ID NO: 422160 - DNA, 20 bp, Artificial Sequence
  chemically synthesized
ggcatttgagaaatggcagc

SEQ ID NO: 422161 - DNA, 20 bp, Artificial Sequence
  chemically synthesized
tttgagaaatggcagcaggt

SEQ ID NO: 422162 - DNA, 20 bp, Artificial Sequence
  chemically synthesized
gaaatggcagcaggtcagta

SEQ ID NO: 422163 - DNA, 20 bp, Artificial Sequence
  chemically synthesized
aggtcagtatggctgaaatg

SEQ ID NO: 422164 - DNA, 20 bp, Artificial Sequence
  chemically synthesized
tctgcagtcttgctgcattt

SEQ ID NO: 422165 - DNA, 20 bp, Artificial Sequence
  chemically synthesized
cagtatggctgaaatgcagc

SEQ ID NO: 422166 - DNA, 20 bp, Artificial Sequence
  chemically synthesized
gctgaaatgcagcaagactg

SEQ ID NO: 422167 - DNA, 20 bp, Artificial Sequence
  chemically synthesized
gaaatgcagcaagactgcag

SEQ ID NO: 422168 - DNA, 20 bp, Artificial Sequence
  chemically synthesized
tttttcttccttttcttctg

SEQ ID NO: 422169 - DNA, 20 bp, Artificial Sequence
  chemically synthesized
gcagcaagactgcagaagaa

SEQ ID NO: 422170 - DNA, 20 bp, Artificial Sequence
  chemically synthesized
cagcaagactgcagaagaaa

SEQ ID NO: 422171 - DNA, 20 bp, Artificial Sequence
  chemically synthesized
caagactgcagaagaaaagg

SEQ ID NO: 422172 - DNA, 20 bp, Artificial Sequence
  chemically synthesized
gaagaaaaggaagaaaaatg

SEQ ID NO: 422173 - DNA, 20 bp, Artificial Sequence
  chemically synthesized
aaaggaagaaaaatgaagtg

SEQ ID NO: 422174 - DNA, 20 bp, Artificial Sequence
  chemically synthesized
gaaaaatgaagtgtggttct

SEQ ID NO: 422175 - DNA, 20 bp, Artificial Sequence
  chemically synthesized
atgaagtgtggttcttggta

SEQ ID NO: 422176 - DNA, 20 bp, Artificial Sequence
  chemically synthesized
atgcgtccaatatctttacc

SEQ ID NO: 422177 - DNA, 20 bp, Artificial Sequence
  chemically synthesized
gtggttcttggtaaagatat

SEQ ID NO: 422178 - DNA, 20 bp, Artificial Sequence
  chemically synthesized
ggtaaagatattggacgcat

SEQ ID NO: 422179 - DNA, 20 bp, Artificial Sequence
  chemically synthesized
taaagatattggacgcatca

SEQ ID NO: 422180 - DNA, 20 bp, Artificial Sequence
  chemically synthesized
agatattggacgcatcagag

SEQ ID NO: 422181 - DNA, 20 bp, Artificial Sequence
  chemically synthesized
gagcagtaacgaattttaat

SEQ ID NO: 422182 - DNA, 20 bp, Artificial Sequence
  chemically synthesized
gcagtaacgaattttaatca

SEQ ID NO: 422183 - DNA, 20 bp, Artificial Sequence
  chemically synthesized
aatcagagattgacacaacc

SEQ ID NO: 422184 - DNA, 20 bp, Artificial Sequence
  chemically synthesized
agcttttaaaaacataaacc

SEQ ID NO: 422185 - DNA, 20 bp, Artificial Sequence
  chemically synthesized
gagcttttaaaaacataaac

SEQ ID NO: 422186 - DNA, 20 bp, Artificial Sequence
  chemically synthesized
aacctggtttatgtttttaa

SEQ ID NO: 422187 - DNA, 20 bp, Artificial Sequence
  chemically synthesized
gtttttaaaagctcaacctt

SEQ ID NO: 422188 - DNA, 20 bp, Artificial Sequence
  chemically synthesized
tttttaaaagctcaaccttt

SEQ ID NO: 422189 - DNA, 20 bp, Artificial Sequence
  chemically synthesized
ctctacatggcctaaaggtt

SEQ ID NO: 422190 - DNA, 20 bp, Artificial Sequence
  chemically synthesized
ccatactctacatggcctaa

SEQ ID NO: 422191 - DNA, 20 bp, Artificial Sequence
  chemically synthesized
tccatactctacatggccta

SEQ ID NO: 422192 - DNA, 20 bp, Artificial Sequence
  chemically synthesized
agctcaacctttaggccatg

SEQ ID NO: 422193 - DNA, 20 bp, Artificial Sequence
  chemically synthesized
ctcaacctttaggccatgta

SEQ ID NO: 422194 - DNA, 20 bp, Artificial Sequence
  chemically synthesized
tactcactccatactctaca

SEQ ID NO: 422195 - DNA, 20 bp, Artificial Sequence
  chemically synthesized
cctttaggccatgtagagta

SEQ ID NO: 422196 - DNA, 20 bp, Artificial Sequence
  chemically synthesized
tttaggccatgtagagtatg

SEQ ID NO: 422197 - DNA, 20 bp, Artificial Sequence
  chemically synthesized
ggccatgtagagtatggagt

SEQ ID NO: 422198 - DNA, 20 bp, Artificial Sequence
  chemically synthesized
catgtagagtatggagtgag

SEQ ID NO: 422199 - DNA, 20 bp, Artificial Sequence
  chemically synthesized
agagtatggagtgagtagaa

SEQ ID NO: 422200 - DNA, 20 bp, Artificial Sequence
  chemically synthesized
gagtatggagtgagtagaaa

SEQ ID NO: 422201 - DNA, 20 bp, Artificial Sequence
  chemically synthesized
gagtgagtagaaaaggacaa

SEQ ID NO: 422202 - DNA, 20 bp, Artificial Sequence
  chemically synthesized
gtagaaaaggacaaaagcac

SEQ ID NO: 422203 - DNA, 20 bp, Artificial Sequence
  chemically synthesized
gaaaaggacaaaagcacaag

SEQ ID NO: 422204 - DNA, 20 bp, Artificial Sequence
  chemically synthesized
ggacaaaagcacaagtggca

SEQ ID NO: 422205 - DNA, 20 bp, Artificial Sequence
  chemically synthesized
aaagcacaagtggcaaagat

SEQ ID NO: 422206 - DNA, 20 bp, Artificial Sequence
  chemically synthesized
cacaagtggcaaagatgagt

SEQ ID NO: 422207 - DNA, 20 bp, Artificial Sequence
  chemically synthesized
acaagtggcaaagatgagtt

SEQ ID NO: 422208 - DNA, 20 bp, Artificial Sequence
  chemically synthesized
caagtggcaaagatgagttg

SEQ ID NO: 422209 - DNA, 20 bp, Artificial Sequence
  chemically synthesized
aagtggcaaagatgagttgg

SEQ ID NO: 422210 - DNA, 20 bp, Artificial Sequence
  chemically synthesized
gatgagttgggggattattg

SEQ ID NO: 422211 - DNA, 20 bp, Artificial Sequence
  chemically synthesized
gggggattattgtagtatct

SEQ ID NO: 422212 - DNA, 20 bp, Artificial Sequence
  chemically synthesized
ggggattattgtagtatcta

SEQ ID NO: 422213 - DNA, 20 bp, Artificial Sequence
  chemically synthesized
gggattattgtagtatctaa

SEQ ID NO: 422214 - DNA, 20 bp, Artificial Sequence
  chemically synthesized
atcctagtctaatttaccct

SEQ ID NO: 422215 - DNA, 20 bp, Artificial Sequence
  chemically synthesized
tgtagtatctaagggtaaat

SEQ ID NO: 422216 - DNA, 20 bp, Artificial Sequence
  chemically synthesized
tatctaagggtaaattagac

SEQ ID NO: 422217 - DNA, 20 bp, Artificial Sequence
  chemically synthesized
atctaagggtaaattagact

SEQ ID NO: 422218 - DNA, 20 bp, Artificial Sequence
  chemically synthesized
aagggtaaattagactagga

SEQ ID NO: 422219 - DNA, 20 bp, Artificial Sequence
  chemically synthesized
catatattttgtttccatcc

SEQ ID NO: 422220 - DNA, 20 bp, Artificial Sequence
  chemically synthesized
taggatggaaacaaaatata

SEQ ID NO: 422221 - DNA, 20 bp, Artificial Sequence
  chemically synthesized
tcatggaacagcagagaaaa

SEQ ID NO: 422222 - DNA, 20 bp, Artificial Sequence
  chemically synthesized
aaaaggctcatggaacagca

SEQ ID NO: 422223 - DNA, 20 bp, Artificial Sequence
  chemically synthesized
agaaaaggctcatggaacag

SEQ ID NO: 422224 - DNA, 20 bp, Artificial Sequence
  chemically synthesized
cattttctctgctgttccat

SEQ ID NO: 422225 - DNA, 20 bp, Artificial Sequence
  chemically synthesized
tgaagaaaaggctcatggaa

SEQ ID NO: 422226 - DNA, 20 bp, Artificial Sequence
  chemically synthesized
gtaagtgaagaaaaggctca

SEQ ID NO: 422227 - DNA, 20 bp, Artificial Sequence
  chemically synthesized
tagcccagtaagtgaagaaa

SEQ ID NO: 422228 - DNA, 20 bp, Artificial Sequence
  chemically synthesized
atagcccagtaagtgaagaa

SEQ ID NO: 422229 - DNA, 20 bp, Artificial Sequence
  chemically synthesized
tgagccttttcttcacttac

SEQ ID NO: 422230 - DNA, 20 bp, Artificial Sequence
  chemically synthesized
accagatagcccagtaagtg

SEQ ID NO: 422231 - DNA, 20 bp, Artificial Sequence
  chemically synthesized
gagccttttcttcacttact

SEQ ID NO: 422232 - DNA, 20 bp, Artificial Sequence
  chemically synthesized
gatggaccagatagcccagt

SEQ ID NO: 422233 - DNA, 20 bp, Artificial Sequence
  chemically synthesized
tcttcacttactgggctatc

SEQ ID NO: 422234 - DNA, 20 bp, Artificial Sequence
  chemically synthesized
gggagatggaccagatagcc

SEQ ID NO: 422235 - DNA, 20 bp, Artificial Sequence
  chemically synthesized
gttatgggagatggaccaga

SEQ ID NO: 422236 - DNA, 20 bp, Artificial Sequence
  chemically synthesized
actggttatgggagatggac

SEQ ID NO: 422237 - DNA, 20 bp, Artificial Sequence
  chemically synthesized
agaagactggttatgggaga

SEQ ID NO: 422238 - DNA, 20 bp, Artificial Sequence
  chemically synthesized
tctggtccatctcccataac

SEQ ID NO: 422239 - DNA, 20 bp, Artificial Sequence
  chemically synthesized
ggttagaagactggttatgg

SEQ ID NO: 422240 - DNA, 20 bp, Artificial Sequence
  chemically synthesized
agggttagaagactggttat

SEQ ID NO: 422241 - DNA, 20 bp, Artificial Sequence
  chemically synthesized
aagggttagaagactggtta

SEQ ID NO: 422242 - DNA, 20 bp, Artificial Sequence
  chemically synthesized
aataggaagggttagaagac

SEQ ID NO: 422243 - DNA, 20 bp, Artificial Sequence
  chemically synthesized
aaatcaataggaagggttag

SEQ ID NO: 422244 - DNA, 20 bp, Artificial Sequence
  chemically synthesized
tgcaaatcaataggaagggt

SEQ ID NO: 422245 - DNA, 20 bp, Artificial Sequence
  chemically synthesized
aacctgcaaatcaataggaa

SEQ ID NO: 422246 - DNA, 20 bp, Artificial Sequence
  chemically synthesized
gaacctgcaaatcaatagga

SEQ ID NO: 422247 - DNA, 20 bp, Artificial Sequence
  chemically synthesized
tgaacctgcaaatcaatagg

SEQ ID NO: 422248 - DNA, 20 bp, Artificial Sequence
  chemically synthesized
tagtgaacctgcaaatcaat

SEQ ID NO: 422249 - DNA, 20 bp, Artificial Sequence
  chemically synthesized
ttagtgaacctgcaaatcaa

SEQ ID NO: 422250 - DNA, 20 bp, Artificial Sequence
  chemically synthesized
taacccttcctattgatttg

SEQ ID NO: 422251 - DNA, 20 bp, Artificial Sequence
  chemically synthesized
aacccttcctattgatttgc

SEQ ID NO: 422252 - DNA, 20 bp, Artificial Sequence
  chemically synthesized
gtggatcgaaaggaaacagt

SEQ ID NO: 422253 - DNA, 20 bp, Artificial Sequence
  chemically synthesized
ggaggtggatcgaaaggaaa

SEQ ID NO: 422254 - DNA, 20 bp, Artificial Sequence
  chemically synthesized
tgaacaggaggtggatcgaa

SEQ ID NO: 422255 - DNA, 20 bp, Artificial Sequence
  chemically synthesized
gtgaacaggaggtggatcga

SEQ ID NO: 422256 - DNA, 20 bp, Artificial Sequence
  chemically synthesized
acctaaaagtgaacaggagg

SEQ ID NO: 422257 - DNA, 20 bp, Artificial Sequence
  chemically synthesized
agtacctaaaagtgaacagg

SEQ ID NO: 422258 - DNA, 20 bp, Artificial Sequence
  chemically synthesized
tagtacctaaaagtgaacag

SEQ ID NO: 422259 - DNA, 20 bp, Artificial Sequence
  chemically synthesized
tttagtacctaaaagtgaac

SEQ ID NO: 422260 - DNA, 20 bp, Artificial Sequence
  chemically synthesized
gtttagtacctaaaagtgaa

SEQ ID NO: 422261 - DNA, 20 bp, Artificial Sequence
  chemically synthesized
atccacctcctgttcacttt

SEQ ID NO: 422262 - DNA, 20 bp, Artificial Sequence
  chemically synthesized
tccacctcctgttcactttt

SEQ ID NO: 422263 - DNA, 20 bp, Artificial Sequence
  chemically synthesized
tcactctgtttagtacctaa

SEQ ID NO: 422264 - DNA, 20 bp, Artificial Sequence
  chemically synthesized
gttcacttttaggtactaaa

SEQ ID NO: 422265 - DNA, 20 bp, Artificial Sequence
  chemically synthesized
tcacttttaggtactaaaca

SEQ ID NO: 422266 - DNA, 20 bp, Artificial Sequence
  chemically synthesized
cgggatgacttcactctgtt

SEQ ID NO: 422267 - DNA, 20 bp, Artificial Sequence
  chemically synthesized
tttaggtactaaacagagtg

SEQ ID NO: 422268 - DNA, 20 bp, Artificial Sequence
  chemically synthesized
agagtgaagtcatcccgtgt

SEQ ID NO: 422269 - DNA, 20 bp, Artificial Sequence
  chemically synthesized
gagggtgaggaaactcacac

SEQ ID NO: 422270 - DNA, 20 bp, Artificial Sequence
  chemically synthesized
ggagggtgaggaaactcaca

SEQ ID NO: 422271 - DNA, 20 bp, Artificial Sequence
  chemically synthesized
tgttagagggagggagggtg

SEQ ID NO: 422272 - DNA, 20 bp, Artificial Sequence
  chemically synthesized
atgttagagggagggagggt

SEQ ID NO: 422273 - DNA, 20 bp, Artificial Sequence
  chemically synthesized
taagatgttagagggaggga

SEQ ID NO: 422274 - DNA, 20 bp, Artificial Sequence
  chemically synthesized
ttaagatgttagagggaggg

SEQ ID NO: 422275 - DNA, 20 bp, Artificial Sequence
  chemically synthesized
cttaagatgttagagggagg

SEQ ID NO: 422276 - DNA, 20 bp, Artificial Sequence
  chemically synthesized
cacttaagatgttagaggga

SEQ ID NO: 422277 - DNA, 20 bp, Artificial Sequence
  chemically synthesized
gcacttaagatgttagaggg

SEQ ID NO: 422278 - DNA, 20 bp, Artificial Sequence
  chemically synthesized
ggcacttaagatgttagagg

SEQ ID NO: 422279 - DNA, 20 bp, Artificial Sequence
  chemically synthesized
aaggcacttaagatgttaga

SEQ ID NO: 422280 - DNA, 20 bp, Artificial Sequence
  chemically synthesized
aaaggcacttaagatgttag

SEQ ID NO: 422281 - DNA, 20 bp, Artificial Sequence
  chemically synthesized
caaaggcacttaagatgtta

SEQ ID NO: 422282 - DNA, 20 bp, Artificial Sequence
  chemically synthesized
ctccctccctctaacatctt

SEQ ID NO: 422283 - DNA, 20 bp, Artificial Sequence
  chemically synthesized
ggcaaaggcacttaagatgt

SEQ ID NO: 422284 - DNA, 20 bp, Artificial Sequence
  chemically synthesized
aaaacagggcaaaggcactt

SEQ ID NO: 422285 - DNA, 20 bp, Artificial Sequence
  chemically synthesized
gcttaaacaaaacagggcaa

SEQ ID NO: 422286 - DNA, 20 bp, Artificial Sequence
  chemically synthesized
tgcttaaacaaaacagggca

SEQ ID NO: 422287 - DNA, 20 bp, Artificial Sequence
  chemically synthesized
tcacatgcttaaacaaaaca

SEQ ID NO: 422288 - DNA, 20 bp, Artificial Sequence
  chemically synthesized
ttcacatgcttaaacaaaac

SEQ ID NO: 422289 - DNA, 20 bp, Artificial Sequence
  chemically synthesized
tttcacatgcttaaacaaaa

SEQ ID NO: 422290 - DNA, 20 bp, Artificial Sequence
  chemically synthesized
gcctttgccctgttttgttt

SEQ ID NO: 422291 - DNA, 20 bp, Artificial Sequence
  chemically synthesized
aagtaacacagaaggttagc

SEQ ID NO: 422292 - DNA, 20 bp, Artificial Sequence
  chemically synthesized
tctaaagtaacacagaaggt

SEQ ID NO: 422293 - DNA, 20 bp, Artificial Sequence
  chemically synthesized
agaatctaaagtaacacaga

SEQ ID NO: 422294 - DNA, 20 bp, Artificial Sequence
  chemically synthesized
gagaatctaaagtaacacag

SEQ ID NO: 422295 - DNA, 20 bp, Artificial Sequence
  chemically synthesized
ggggagaatctaaagtaaca

SEQ ID NO: 422296 - DNA, 20 bp, Artificial Sequence
  chemically synthesized
gctaaccttctgtgttactt

SEQ ID NO: 422297 - DNA, 20 bp, Artificial Sequence
  chemically synthesized
gtctgtctggggagaatcta

SEQ ID NO: 422298 - DNA, 20 bp, Artificial Sequence
  chemically synthesized
gtgttactttagattctccc

SEQ ID NO: 422299 - DNA, 20 bp, Artificial Sequence
  chemically synthesized
tactttagattctccccaga

SEQ ID NO: 422300 - DNA, 20 bp, Artificial Sequence
  chemically synthesized
tgcctcagtgtctgtctggg

SEQ ID NO: 422301 - DNA, 20 bp, Artificial Sequence
  chemically synthesized
cttgcctcagtgtctgtctg

SEQ ID NO: 422302 - DNA, 20 bp, Artificial Sequence
  chemically synthesized
ccttgcctcagtgtctgtct

SEQ ID NO: 422303 - DNA, 20 bp, Artificial Sequence
  chemically synthesized
tccttgcctcagtgtctgtc

SEQ ID NO: 422304 - DNA, 20 bp, Artificial Sequence
  chemically synthesized
attctccccagacagacact

SEQ ID NO: 422305 - DNA, 20 bp, Artificial Sequence
  chemically synthesized
ttctccccagacagacactg

SEQ ID NO: 422306 - DNA, 20 bp, Artificial Sequence
  chemically synthesized
ccccagacagacactgaggc

SEQ ID NO: 422307 - DNA, 20 bp, Artificial Sequence
  chemically synthesized
cccagacagacactgaggca

SEQ ID NO: 422308 - DNA, 20 bp, Artificial Sequence
  chemically synthesized
tgcacctcaaatccttgcct

SEQ ID NO: 422309 - DNA, 20 bp, Artificial Sequence
  chemically synthesized
agacactgaggcaaggattt

SEQ ID NO: 422310 - DNA, 20 bp, Artificial Sequence
  chemically synthesized
gacactgaggcaaggatttg

SEQ ID NO: 422311 - DNA, 20 bp, Artificial Sequence
  chemically synthesized
tgaggcaaggatttgaggtg

SEQ ID NO: 422312 - DNA, 20 bp, Artificial Sequence
  chemically synthesized
gaggcaaggatttgaggtgc

SEQ ID NO: 422313 - DNA, 20 bp, Artificial Sequence
  chemically synthesized
ggatttgaggtgcaggtaca

SEQ ID NO: 422314 - DNA, 20 bp, Artificial Sequence
  chemically synthesized
gtgcaggtacacagtttatc

SEQ ID NO: 422315 - DNA, 20 bp, Artificial Sequence
  chemically synthesized
tactttttgtaatcaattgc

SEQ ID NO: 422316 - DNA, 20 bp, Artificial Sequence
  chemically synthesized
atctggcaattgattacaaa

SEQ ID NO: 422317 - DNA, 20 bp, Artificial Sequence
  chemically synthesized
caattgattacaaaaagtac

SEQ ID NO: 422318 - DNA, 20 bp, Artificial Sequence
  chemically synthesized
tgattacaaaaagtacaagt

SEQ ID NO: 422319 - DNA, 20 bp, Artificial Sequence
  chemically synthesized
attacaaaaagtacaagtga

SEQ ID NO: 422320 - DNA, 20 bp, Artificial Sequence
  chemically synthesized
ttacaaaaagtacaagtgag

SEQ ID NO: 422321 - DNA, 20 bp, Artificial Sequence
  chemically synthesized
aaaaagtacaagtgagagga

SEQ ID NO: 422322 - DNA, 20 bp, Artificial Sequence
  chemically synthesized
aaagtacaagtgagaggaaa

SEQ ID NO: 422323 - DNA, 20 bp, Artificial Sequence
  chemically synthesized
tacaagtgagaggaaagaga

SEQ ID NO: 422324 - DNA, 20 bp, Artificial Sequence
  chemically synthesized
agtgagaggaaagagaaagt

SEQ ID NO: 422325 - DNA, 20 bp, Artificial Sequence
  chemically synthesized
gaggaaagagaaagtgagat

SEQ ID NO: 422326 - DNA, 20 bp, Artificial Sequence
  chemically synthesized
aggaaagagaaagtgagatt

SEQ ID NO: 422327 - DNA, 20 bp, Artificial Sequence
  chemically synthesized
aagagaaagtgagattagga

SEQ ID NO: 422328 - DNA, 20 bp, Artificial Sequence
  chemically synthesized
agagaaagtgagattaggaa

SEQ ID NO: 422329 - DNA, 20 bp, Artificial Sequence
  chemically synthesized
aaagtgagattaggaaaggt

SEQ ID NO: 422330 - DNA, 20 bp, Artificial Sequence
  chemically synthesized
aagtgagattaggaaaggta

SEQ ID NO: 422331 - DNA, 20 bp, Artificial Sequence
  chemically synthesized
gtgagattaggaaaggtaag

SEQ ID NO: 422332 - DNA, 20 bp, Artificial Sequence
  chemically synthesized
tgagattaggaaaggtaagg

SEQ ID NO: 422333 - DNA, 20 bp, Artificial Sequence
  chemically synthesized
gaaaggtaaggaggcaatca

SEQ ID NO: 422334 - DNA, 20 bp, Artificial Sequence
  chemically synthesized
aaaggtaaggaggcaatcaa

SEQ ID NO: 422335 - DNA, 20 bp, Artificial Sequence
  chemically synthesized
gcaatcaaaggtgtgtcaat

SEQ ID NO: 422336 - DNA, 20 bp, Artificial Sequence
  chemically synthesized
tgtcaatgagcacattattc

SEQ ID NO: 422337 - DNA, 20 bp, Artificial Sequence
  chemically synthesized
gtcaatgagcacattattct

SEQ ID NO: 422338 - DNA, 20 bp, Artificial Sequence
  chemically synthesized
tcaatgagcacattattctg

SEQ ID NO: 422339 - DNA, 20 bp, Artificial Sequence
  chemically synthesized
gagcacattattctggggct

SEQ ID NO: 422340 - DNA, 20 bp, Artificial Sequence
  chemically synthesized
tcaccagcaggactgagccc

SEQ ID NO: 422341 - DNA, 20 bp, Artificial Sequence
  chemically synthesized
agagattcaccagcaggact

SEQ ID NO: 422342 - DNA, 20 bp, Artificial Sequence
  chemically synthesized
attctggggctcagtcctgc

SEQ ID NO: 422343 - DNA, 20 bp, Artificial Sequence
  chemically synthesized
cttctcagagattcaccagc

SEQ ID NO: 422344 - DNA, 20 bp, Artificial Sequence
  chemically synthesized
gcttctcagagattcaccag

SEQ ID NO: 422345 - DNA, 20 bp, Artificial Sequence
  chemically synthesized
acagcttctcagagattcac

SEQ ID NO: 422346 - DNA, 20 bp, Artificial Sequence
  chemically synthesized
agtcctgctggtgaatctct

SEQ ID NO: 422347 - DNA, 20 bp, Artificial Sequence
  chemically synthesized
cctgctggtgaatctctgag

SEQ ID NO: 422348 - DNA, 20 bp, Artificial Sequence
  chemically synthesized
atgttcctcacagcttctca

SEQ ID NO: 422349 - DNA, 20 bp, Artificial Sequence
  chemically synthesized
gcatgttcctcacagcttct

SEQ ID NO: 422350 - DNA, 20 bp, Artificial Sequence
  chemically synthesized
gtgaatctctgagaagctgt

SEQ ID NO: 422351 - DNA, 20 bp, Artificial Sequence
  chemically synthesized
tgaatctctgagaagctgtg

SEQ ID NO: 422352 - DNA, 20 bp, Artificial Sequence
  chemically synthesized
attctgaggcatgttcctca

SEQ ID NO: 422353 - DNA, 20 bp, Artificial Sequence
  chemically synthesized
aagctgtgaggaacatgcct

SEQ ID NO: 422354 - DNA, 20 bp, Artificial Sequence
  chemically synthesized
tcttctggtgcataattctg

SEQ ID NO: 422355 - DNA, 20 bp, Artificial Sequence
  chemically synthesized
atcttctggtgcataattct

SEQ ID NO: 422356 - DNA, 20 bp, Artificial Sequence
  chemically synthesized
catgcctcagaattatgcac

SEQ ID NO: 422357 - DNA, 20 bp, Artificial Sequence
  chemically synthesized
gcctcagaattatgcaccag

SEQ ID NO: 422358 - DNA, 20 bp, Artificial Sequence
  chemically synthesized
agaattatgcaccagaagat

SEQ ID NO: 422359 - DNA, 20 bp, Artificial Sequence
  chemically synthesized
cacgcagccatctcatcttc

SEQ ID NO: 422360 - DNA, 20 bp, Artificial Sequence
  chemically synthesized
ttatgcaccagaagatgaga

SEQ ID NO: 422361 - DNA, 20 bp, Artificial Sequence
  chemically synthesized
aagtacttgaaaaaagcacg

SEQ ID NO: 422362 - DNA, 20 bp, Artificial Sequence
  chemically synthesized
gatggctgcgtgcttttttc

SEQ ID NO: 422363 - DNA, 20 bp, Artificial Sequence
  chemically synthesized
gggatggaagtacttgaaaa

SEQ ID NO: 422364 - DNA, 20 bp, Artificial Sequence
  chemically synthesized
ctttaactacgaggggatgg

SEQ ID NO: 422365 - DNA, 20 bp, Artificial Sequence
  chemically synthesized
gacctttaactacgagggga

SEQ ID NO: 422366 - DNA, 20 bp, Artificial Sequence
  chemically synthesized
caagtacttccatcccctcg

SEQ ID NO: 422367 - DNA, 20 bp, Artificial Sequence
  chemically synthesized
aagcgacctttaactacgag

SEQ ID NO: 422368 - DNA, 20 bp, Artificial Sequence
  chemically synthesized
gaagcgacctttaactacga

SEQ ID NO: 422369 - DNA, 20 bp, Artificial Sequence
  chemically synthesized
agaagcgacctttaactacg

SEQ ID NO: 422370 - DNA, 20 bp, Artificial Sequence
  chemically synthesized
cttccatcccctcgtagtta

SEQ ID NO: 422371 - DNA, 20 bp, Artificial Sequence
  chemically synthesized
cagaagcgacctttaactac

SEQ ID NO: 422372 - DNA, 20 bp, Artificial Sequence
  chemically synthesized
ttccatcccctcgtagttaa

SEQ ID NO: 422373 - DNA, 20 bp, Artificial Sequence
  chemically synthesized
tcgtagttaaaggtcgcttc

SEQ ID NO: 422374 - DNA, 20 bp, Artificial Sequence
  chemically synthesized
ggttgtgttaatgtcaccag

SEQ ID NO: 422375 - DNA, 20 bp, Artificial Sequence
  chemically synthesized
aggggttgtgttaatgtcac

SEQ ID NO: 422376 - DNA, 20 bp, Artificial Sequence
  chemically synthesized
gagtaagccagaaatatgag

SEQ ID NO: 422377 - DNA, 20 bp, Artificial Sequence
  chemically synthesized
ggagtaagccagaaatatga

SEQ ID NO: 422378 - DNA, 20 bp, Artificial Sequence
  chemically synthesized
aggagtaagccagaaatatg

SEQ ID NO: 422379 - DNA, 20 bp, Artificial Sequence
  chemically synthesized
aacacaacccctcatatttc

SEQ ID NO: 422380 - DNA, 20 bp, Artificial Sequence
  chemically synthesized
caggagtaagccagaaatat

SEQ ID NO: 422381 - DNA, 20 bp, Artificial Sequence
  chemically synthesized
tgctataaacaggagtaagc

SEQ ID NO: 422382 - DNA, 20 bp, Artificial Sequence
  chemically synthesized
gctttgctataaacaggagt

SEQ ID NO: 422383 - DNA, 20 bp, Artificial Sequence
  chemically synthesized
ttctggcttactcctgttta

SEQ ID NO: 422384 - DNA, 20 bp, Artificial Sequence
  chemically synthesized
tcttgctttgctataaacag

SEQ ID NO: 422385 - DNA, 20 bp, Artificial Sequence
  chemically synthesized
tatcttgctttgctataaac

SEQ ID NO: 422386 - DNA, 20 bp, Artificial Sequence
  chemically synthesized
gtatcttgctttgctataaa

SEQ ID NO: 422387 - DNA, 20 bp, Artificial Sequence
  chemically synthesized
gcttactcctgtttatagca

SEQ ID NO: 422388 - DNA, 20 bp, Artificial Sequence
  chemically synthesized
actcctgtttatagcaaagc

SEQ ID NO: 422389 - DNA, 20 bp, Artificial Sequence
  chemically synthesized
tagcaaagcaagatactgca

SEQ ID NO: 422390 - DNA, 20 bp, Artificial Sequence
  chemically synthesized
ttccccacccgagttccatg

SEQ ID NO: 422391 - DNA, 20 bp, Artificial Sequence
  chemically synthesized
gcaagatactgcatggaact

SEQ ID NO: 422392 - DNA, 20 bp, Artificial Sequence
  chemically synthesized
caagatactgcatggaactc

SEQ ID NO: 422393 - DNA, 20 bp, Artificial Sequence
  chemically synthesized
gatactgcatggaactcggg

SEQ ID NO: 422394 - DNA, 20 bp, Artificial Sequence
  chemically synthesized
atactgcatggaactcgggt

SEQ ID NO: 422395 - DNA, 20 bp, Artificial Sequence
  chemically synthesized
tactgcatggaactcgggtg

SEQ ID NO: 422396 - DNA, 20 bp, Artificial Sequence
  chemically synthesized
gcatatttctttccccaccc

SEQ ID NO: 422397 - DNA, 20 bp, Artificial Sequence
  chemically synthesized
gcatggaactcgggtgggga

SEQ ID NO: 422398 - DNA, 20 bp, Artificial Sequence
  chemically synthesized
cgggtggggaaagaaatatg

SEQ ID NO: 422399 - DNA, 20 bp, Artificial Sequence
  chemically synthesized
gtggggaaagaaatatgcgg

SEQ ID NO: 422400 - DNA, 20 bp, Artificial Sequence
  chemically synthesized
agaaatatgcggcagaacat

SEQ ID NO: 422401 - DNA, 20 bp, Artificial Sequence
  chemically synthesized
gaagggataagaagatgtaa

SEQ ID NO: 422402 - DNA, 20 bp, Artificial Sequence
  chemically synthesized
caagatcctgaagggataag

SEQ ID NO: 422403 - DNA, 20 bp, Artificial Sequence
  chemically synthesized
tttacatcttcttatccctt

SEQ ID NO: 422404 - DNA, 20 bp, Artificial Sequence
  chemically synthesized
aaacaagatcctgaagggat

SEQ ID NO: 422405 - DNA, 20 bp, Artificial Sequence
  chemically synthesized
ttacatcttcttatcccttc

SEQ ID NO: 422406 - DNA, 20 bp, Artificial Sequence
  chemically synthesized
gaaataaacaagatcctgaa

SEQ ID NO: 422407 - DNA, 20 bp, Artificial Sequence
  chemically synthesized
agaaataaacaagatcctga

SEQ ID NO: 422408 - DNA, 20 bp, Artificial Sequence
  chemically synthesized
gagaaataaacaagatcctg

SEQ ID NO: 422409 - DNA, 20 bp, Artificial Sequence
  chemically synthesized
aatagaggagagaaataaac

SEQ ID NO: 422410 - DNA, 20 bp, Artificial Sequence
  chemically synthesized
aaaagtgtttcaatagagga

SEQ ID NO: 422411 - DNA, 20 bp, Artificial Sequence
  chemically synthesized
taaaaagtgtttcaatagag

SEQ ID NO: 422412 - DNA, 20 bp, Artificial Sequence
  chemically synthesized
cctaaaaagtgtttcaatag

SEQ ID NO: 422413 - DNA, 20 bp, Artificial Sequence
  chemically synthesized
gcctaaaaagtgtttcaata

SEQ ID NO: 422414 - DNA, 20 bp, Artificial Sequence
  chemically synthesized
tggcctaaaaagtgtttcaa

SEQ ID NO: 422415 - DNA, 20 bp, Artificial Sequence
  chemically synthesized
tcctctattgaaacactttt

SEQ ID NO: 422416 - DNA, 20 bp, Artificial Sequence
  chemically synthesized
cctctattgaaacacttttt

SEQ ID NO: 422417 - DNA, 20 bp, Artificial Sequence
  chemically synthesized
tattgaaacactttttaggc

SEQ ID NO: 422418 - DNA, 20 bp, Artificial Sequence
  chemically synthesized
gccactgtgcctggcctaaa

SEQ ID NO: 422419 - DNA, 20 bp, Artificial Sequence
  chemically synthesized
attgaaacactttttaggcc

SEQ ID NO: 422420 - DNA, 20 bp, Artificial Sequence
  chemically synthesized
aacactttttaggccaggca

SEQ ID NO: 422421 - DNA, 20 bp, Artificial Sequence
  chemically synthesized
actttttaggccaggcacag

SEQ ID NO: 422422 - DNA, 20 bp, Artificial Sequence
  chemically synthesized
caggcgtgagccactgtgcc

SEQ ID NO: 422423 - DNA, 20 bp, Artificial Sequence
  chemically synthesized
agtgctgggattacaggcgt

SEQ ID NO: 422424 - DNA, 20 bp, Artificial Sequence
  chemically synthesized
gtggctcacgcctgtaatcc

SEQ ID NO: 422425 - DNA, 20 bp, Artificial Sequence
  chemically synthesized
tcccaaagtgctgggattac

SEQ ID NO: 422426 - DNA, 20 bp, Artificial Sequence
  chemically synthesized
ctcccaaagtgctgggatta

SEQ ID NO: 422427 - DNA, 20 bp, Artificial Sequence
  chemically synthesized
cgcctgtaatcccagcactt

SEQ ID NO: 422428 - DNA, 20 bp, Artificial Sequence
  chemically synthesized
cctcggcctcccaaagtgct

SEQ ID NO: 422429 - DNA, 20 bp, Artificial Sequence
  chemically synthesized
gcctgtaatcccagcacttt

SEQ ID NO: 422430 - DNA, 20 bp, Artificial Sequence
  chemically synthesized
gcctcggcctcccaaagtgc

SEQ ID NO: 422431 - DNA, 20 bp, Artificial Sequence
  chemically synthesized
ctgtaatcccagcactttgg

SEQ ID NO: 422432 - DNA, 20 bp, Artificial Sequence
  chemically synthesized
tgtaatcccagcactttggg

SEQ ID NO: 422433 - DNA, 20 bp, Artificial Sequence
  chemically synthesized
ccgcctgcctcggcctccca

SEQ ID NO: 422434 - DNA, 20 bp, Artificial Sequence
  chemically synthesized
tcccagcactttgggaggcc

SEQ ID NO: 422435 - DNA, 20 bp, Artificial Sequence
  chemically synthesized
cccagcactttgggaggccg

SEQ ID NO: 422436 - DNA, 20 bp, Artificial Sequence
  chemically synthesized
agcactttgggaggccgagg

SEQ ID NO: 422437 - DNA, 20 bp, Artificial Sequence
  chemically synthesized
gcactttgggaggccgaggc

SEQ ID NO: 422438 - DNA, 20 bp, Artificial Sequence
  chemically synthesized
ctttgggaggccgaggcagg

SEQ ID NO: 422439 - DNA, 20 bp, Artificial Sequence
  chemically synthesized
ctcaggtgatccgcctgcct

SEQ ID NO: 422440 - DNA, 20 bp, Artificial Sequence
  chemically synthesized
ccgaggcaggcggatcacct

SEQ ID NO: 422441 - DNA, 20 bp, Artificial Sequence
  chemically synthesized
cgaggcaggcggatcacctg

SEQ ID NO: 422442 - DNA, 20 bp, Artificial Sequence
  chemically synthesized
gcaggcggatcacctgaggt

SEQ ID NO: 422443 - DNA, 20 bp, Artificial Sequence
  chemically synthesized
caggcggatcacctgaggtc

SEQ ID NO: 422444 - DNA, 20 bp, Artificial Sequence
  chemically synthesized
ggtcttgaactcctgacctc

SEQ ID NO: 422445 - DNA, 20 bp, Artificial Sequence
  chemically synthesized
ggcggatcacctgaggtcag

SEQ ID NO: 422446 - DNA, 20 bp, Artificial Sequence
  chemically synthesized
tggtcttgaactcctgacct

SEQ ID NO: 422447 - DNA, 20 bp, Artificial Sequence
  chemically synthesized
tcacctgaggtcaggagttc

SEQ ID NO: 422448 - DNA, 20 bp, Artificial Sequence
  chemically synthesized
tgaggtcaggagttcaagac

SEQ ID NO: 422449 - DNA, 20 bp, Artificial Sequence
  chemically synthesized
tcaggagttcaagaccagcc

SEQ ID NO: 422450 - DNA, 20 bp, Artificial Sequence
  chemically synthesized
tttcgccacgttggccaggc

SEQ ID NO: 422451 - DNA, 20 bp, Artificial Sequence
  chemically synthesized
ggggtttcgccacgttggcc

SEQ ID NO: 422452 - DNA, 20 bp, Artificial Sequence
  chemically synthesized
caagaccagcctggccaacg

SEQ ID NO: 422453 - DNA, 20 bp, Artificial Sequence
  chemically synthesized
cggggtttcgccacgttggc

SEQ ID NO: 422454 - DNA, 20 bp, Artificial Sequence
  chemically synthesized
gagacggggtttcgccacgt

SEQ ID NO: 422455 - DNA, 20 bp, Artificial Sequence
  chemically synthesized
ttgtatttttagtagagacg

SEQ ID NO: 422456 - DNA, 20 bp, Artificial Sequence
  chemically synthesized
tttgtatttttagtagagac

SEQ ID NO: 422457 - DNA, 20 bp, Artificial Sequence
  chemically synthesized
ttttgtatttttagtagaga

SEQ ID NO: 422458 - DNA, 20 bp, Artificial Sequence
  chemically synthesized
taatttttgtatttttagta

SEQ ID NO: 422459 - DNA, 20 bp, Artificial Sequence
  chemically synthesized
gctaatttttgtatttttag

SEQ ID NO: 422460 - DNA, 20 bp, Artificial Sequence
  chemically synthesized
ctggctaatttttgtatttt

SEQ ID NO: 422461 - DNA, 20 bp, Artificial Sequence
  chemically synthesized
tctactaaaaatacaaaaat

SEQ ID NO: 422462 - DNA, 20 bp, Artificial Sequence
  chemically synthesized
ctaaaaatacaaaaattagc

SEQ ID NO: 422463 - DNA, 20 bp, Artificial Sequence
  chemically synthesized
taaaaatacaaaaattagcc

SEQ ID NO: 422464 - DNA, 20 bp, Artificial Sequence
  chemically synthesized
atacaaaaattagccaggtg

SEQ ID NO: 422465 - DNA, 20 bp, Artificial Sequence
  chemically synthesized
caaaaattagccaggtgtgg

SEQ ID NO: 422466 - DNA, 20 bp, Artificial Sequence
  chemically synthesized
taggcacacgccaccacacc

SEQ ID NO: 422467 - DNA, 20 bp, Artificial Sequence
  chemically synthesized
gtggcgtgtgcctataatcc

SEQ ID NO: 422468 - DNA, 20 bp, Artificial Sequence
  chemically synthesized
tcccgagtagctgggattat

SEQ ID NO: 422469 - DNA, 20 bp, Artificial Sequence
  chemically synthesized
ctcccgagtagctgggatta

SEQ ID NO: 422470 - DNA, 20 bp, Artificial Sequence
  chemically synthesized
tgcctataatcccagctact

SEQ ID NO: 422471 - DNA, 20 bp, Artificial Sequence
  chemically synthesized
cctcagcctcccgagtagct

SEQ ID NO: 422472 - DNA, 20 bp, Artificial Sequence
  chemically synthesized
gcctataatcccagctactc

SEQ ID NO: 422473 - DNA, 20 bp, Artificial Sequence
  chemically synthesized
gcctcagcctcccgagtagc

SEQ ID NO: 422474 - DNA, 20 bp, Artificial Sequence
  chemically synthesized
ctataatcccagctactcgg

SEQ ID NO: 422475 - DNA, 20 bp, Artificial Sequence
  chemically synthesized
tataatcccagctactcggg

SEQ ID NO: 422476 - DNA, 20 bp, Artificial Sequence
  chemically synthesized
tcctgcctcagcctcccgag

SEQ ID NO: 422477 - DNA, 20 bp, Artificial Sequence
  chemically synthesized
ttctcctgcctcagcctccc

SEQ ID NO: 422478 - DNA, 20 bp, Artificial Sequence
  chemically synthesized
tcccagctactcgggaggct

SEQ ID NO: 422479 - DNA, 20 bp, Artificial Sequence
  chemically synthesized
cccagctactcgggaggctg

SEQ ID NO: 422480 - DNA, 20 bp, Artificial Sequence
  chemically synthesized
agctactcgggaggctgagg

SEQ ID NO: 422481 - DNA, 20 bp, Artificial Sequence
  chemically synthesized
gctactcgggaggctgaggc

SEQ ID NO: 422482 - DNA, 20 bp, Artificial Sequence
  chemically synthesized
tactcgggaggctgaggcag

SEQ ID NO: 422483 - DNA, 20 bp, Artificial Sequence
  chemically synthesized
ttcaagcgattctcctgcct

SEQ ID NO: 422484 - DNA, 20 bp, Artificial Sequence
  chemically synthesized
ggcaggagaatcgcttgaaa

SEQ ID NO: 422485 - DNA, 20 bp, Artificial Sequence
  chemically synthesized
gcaggagaatcgcttgaaac

SEQ ID NO: 422486 - DNA, 20 bp, Artificial Sequence
  chemically synthesized
caggagaatcgcttgaaaca

SEQ ID NO: 422487 - DNA, 20 bp, Artificial Sequence
  chemically synthesized
aacctccgcctccctgtttc

SEQ ID NO: 422488 - DNA, 20 bp, Artificial Sequence
  chemically synthesized
ggagaatcgcttgaaacagg

SEQ ID NO: 422489 - DNA, 20 bp, Artificial Sequence
  chemically synthesized
gagaatcgcttgaaacaggg

SEQ ID NO: 422490 - DNA, 20 bp, Artificial Sequence
  chemically synthesized
aatcgcttgaaacagggagg

SEQ ID NO: 422491 - DNA, 20 bp, Artificial Sequence
  chemically synthesized
tcgcttgaaacagggaggcg

SEQ ID NO: 422492 - DNA, 20 bp, Artificial Sequence
  chemically synthesized
cgcttgaaacagggaggcgg

SEQ ID NO: 422493 - DNA, 20 bp, Artificial Sequence
  chemically synthesized
aaacagggaggcggaggttg

SEQ ID NO: 422494 - DNA, 20 bp, Artificial Sequence
  chemically synthesized
agggaggcggaggttgcagt

SEQ ID NO: 422495 - DNA, 20 bp, Artificial Sequence
  chemically synthesized
ggcggaggttgcagtgagct

SEQ ID NO: 422496 - DNA, 20 bp, Artificial Sequence
  chemically synthesized
ggagtgcagtggcacgatct

SEQ ID NO: 422497 - DNA, 20 bp, Artificial Sequence
  chemically synthesized
tcacccaggctggagtgcag

SEQ ID NO: 422498 - DNA, 20 bp, Artificial Sequence
  chemically synthesized
gagatcgtgccactgcactc

SEQ ID NO: 422499 - DNA, 20 bp, Artificial Sequence
  chemically synthesized
ctgtcacccaggctggagtg

SEQ ID NO: 422500 - DNA, 20 bp, Artificial Sequence
  chemically synthesized
cgtgccactgcactccagcc

SEQ ID NO: 422501 - DNA, 20 bp, Artificial Sequence
  chemically synthesized
gtgccactgcactccagcct

SEQ ID NO: 422502 - DNA, 20 bp, Artificial Sequence
  chemically synthesized
atgctctgtcacccaggctg

SEQ ID NO: 422503 - DNA, 20 bp, Artificial Sequence
  chemically synthesized
tcatgctctgtcacccaggc

SEQ ID NO: 422504 - DNA, 20 bp, Artificial Sequence
  chemically synthesized
ctgcactccagcctgggtga

SEQ ID NO: 422505 - DNA, 20 bp, Artificial Sequence
  chemically synthesized
agagtcatgctctgtcaccc

SEQ ID NO: 422506 - DNA, 20 bp, Artificial Sequence
  chemically synthesized
gcactccagcctgggtgaca

SEQ ID NO: 422507 - DNA, 20 bp, Artificial Sequence
  chemically synthesized
gagagtcatgctctgtcacc

SEQ ID NO: 422508 - DNA, 20 bp, Artificial Sequence
  chemically synthesized
ttttttttttttttttgaga

SEQ ID NO: 422509 - DNA, 20 bp, Artificial Sequence
  chemically synthesized
ttttttttttttttttttga

SEQ ID NO: 422510 - DNA, 20 bp, Artificial Sequence
  chemically synthesized
tttttttttttttttttttt

SEQ ID NO: 422511 - DNA, 20 bp, Artificial Sequence
  chemically synthesized
aaaaaaaaaaaaaaaaaaaa

SEQ ID NO: 422512 - DNA, 20 bp, Artificial Sequence
  chemically synthesized
aaaaaaaaaaagacttttta

SEQ ID NO: 422513 - DNA, 20 bp, Artificial Sequence
  chemically synthesized
aaaaaaaaaagactttttaa

SEQ ID NO: 422514 - DNA, 20 bp, Artificial Sequence
  chemically synthesized
aaaaaaaaagactttttaaa

SEQ ID NO: 422515 - DNA, 20 bp, Artificial Sequence
  chemically synthesized
aaaaaaaagactttttaaag

SEQ ID NO: 422516 - DNA, 20 bp, Artificial Sequence
  chemically synthesized
ctaataataacccctttaaa

SEQ ID NO: 422517 - DNA, 20 bp, Artificial Sequence
  chemically synthesized
ctttttaaaggggttattat

SEQ ID NO: 422518 - DNA, 20 bp, Artificial Sequence
  chemically synthesized
tttttaaaggggttattatt

SEQ ID NO: 422519 - DNA, 20 bp, Artificial Sequence
  chemically synthesized
ttttaaaggggttattatta

SEQ ID NO: 422520 - DNA, 20 bp, Artificial Sequence
  chemically synthesized
tttaaaggggttattattag

SEQ ID NO: 422521 - DNA, 20 bp, Artificial Sequence
  chemically synthesized
tattattaggggctatatac

SEQ ID NO: 422522 - DNA, 20 bp, Artificial Sequence
  chemically synthesized
gatttataagatccagtata

SEQ ID NO: 422523 - DNA, 20 bp, Artificial Sequence
  chemically synthesized
actagatgatttataagatc

SEQ ID NO: 422524 - DNA, 20 bp, Artificial Sequence
  chemically synthesized
ggttggactagatgatttat

SEQ ID NO: 422525 - DNA, 20 bp, Artificial Sequence
  chemically synthesized
actggatcttataaatcatc

SEQ ID NO: 422526 - DNA, 20 bp, Artificial Sequence
  chemically synthesized
ttcacataatagggttggac

SEQ ID NO: 422527 - DNA, 20 bp, Artificial Sequence
  chemically synthesized
taatcttcacataatagggt

SEQ ID NO: 422528 - DNA, 20 bp, Artificial Sequence
  chemically synthesized
tttctaatcttcacataata

SEQ ID NO: 422529 - DNA, 20 bp, Artificial Sequence
  chemically synthesized
ttttctaatcttcacataat

SEQ ID NO: 422530 - DNA, 20 bp, Artificial Sequence
  chemically synthesized
tagtccaaccctattatgtg

SEQ ID NO: 422531 - DNA, 20 bp, Artificial Sequence
  chemically synthesized
gttttctaatcttcacataa

SEQ ID NO: 422532 - DNA, 20 bp, Artificial Sequence
  chemically synthesized
caaccctattatgtgaagat

SEQ ID NO: 422533 - DNA, 20 bp, Artificial Sequence
  chemically synthesized
tatgtgaagattagaaaaca

SEQ ID NO: 422534 - DNA, 20 bp, Artificial Sequence
  chemically synthesized
aatagcattccaaaaatcga

SEQ ID NO: 422535 - DNA, 20 bp, Artificial Sequence
  chemically synthesized
cacattattctatcgatttt

SEQ ID NO: 422536 - DNA, 20 bp, Artificial Sequence
  chemically synthesized
cccagaaaaaagtttgcaaa

SEQ ID NO: 422537 - DNA, 20 bp, Artificial Sequence
  chemically synthesized
gctatttgcaaacttttttc

SEQ ID NO: 422538 - DNA, 20 bp, Artificial Sequence
  chemically synthesized
ctatttgcaaacttttttct

SEQ ID NO: 422539 - DNA, 20 bp, Artificial Sequence
  chemically synthesized
atttaagtgggcccagaaaa

SEQ ID NO: 422540 - DNA, 20 bp, Artificial Sequence
  chemically synthesized
cttatacatttaagtgggcc

SEQ ID NO: 422541 - DNA, 20 bp, Artificial Sequence
  chemically synthesized
gaaaacttatacatttaagt

SEQ ID NO: 422542 - DNA, 20 bp, Artificial Sequence
  chemically synthesized
ggaaaacttatacatttaag

SEQ ID NO: 422543 - DNA, 20 bp, Artificial Sequence
  chemically synthesized
tatggaaaacttatacattt

SEQ ID NO: 422544 - DNA, 20 bp, Artificial Sequence
  chemically synthesized
ctgggcccacttaaatgtat

SEQ ID NO: 422545 - DNA, 20 bp, Artificial Sequence
  chemically synthesized
ttattaaccaacataaaata

SEQ ID NO: 422546 - DNA, 20 bp, Artificial Sequence
  chemically synthesized
aagttttccatattttatgt

SEQ ID NO: 422547 - DNA, 20 bp, Artificial Sequence
  chemically synthesized
catattttatgttggttaat

SEQ ID NO: 422548 - DNA, 20 bp, Artificial Sequence
  chemically synthesized
tggtgtcaagatattaaaat

SEQ ID NO: 422549 - DNA, 20 bp, Artificial Sequence
  chemically synthesized
ataaatggcaatgtggtgtc

SEQ ID NO: 422550 - DNA, 20 bp, Artificial Sequence
  chemically synthesized
catattgataaatggcaatg

SEQ ID NO: 422551 - DNA, 20 bp, Artificial Sequence
  chemically synthesized
acgtagtacatattgataaa

SEQ ID NO: 422552 - DNA, 20 bp, Artificial Sequence
  chemically synthesized
tgaggaaccagtaaaaaacg

SEQ ID NO: 422553 - DNA, 20 bp, Artificial Sequence
  chemically synthesized
atatgtactacgttttttac

SEQ ID NO: 422554 - DNA, 20 bp, Artificial Sequence
  chemically synthesized
agatttgagatttgaggaac

SEQ ID NO: 422555 - DNA, 20 bp, Artificial Sequence
  chemically synthesized
tggcacagatttgagatttg

SEQ ID NO: 422556 - DNA, 20 bp, Artificial Sequence
  chemically synthesized
ctggcacagatttgagattt

SEQ ID NO: 422557 - DNA, 20 bp, Artificial Sequence
  chemically synthesized
acagacgctggcacagattt

SEQ ID NO: 422558 - DNA, 20 bp, Artificial Sequence
  chemically synthesized
ctcaaatctcaaatctgtgc

SEQ ID NO: 422559 - DNA, 20 bp, Artificial Sequence
  chemically synthesized
aaattcaacagacgctggca

SEQ ID NO: 422560 - DNA, 20 bp, Artificial Sequence
  chemically synthesized
tataaaaattcaacagacgc

SEQ ID NO: 422561 - DNA, 20 bp, Artificial Sequence
  chemically synthesized
tcaaaattataaaaattcaa

SEQ ID NO: 422562 - DNA, 20 bp, Artificial Sequence
  chemically synthesized
aaaaaaaagaatgataaatt

SEQ ID NO: 422563 - DNA, 20 bp, Artificial Sequence
  chemically synthesized
gtctcaataaaaaaaaaaaa

SEQ ID NO: 422564 - DNA, 20 bp, Artificial Sequence
  chemically synthesized
ttcttttttttttttttatt

SEQ ID NO: 422565 - DNA, 20 bp, Artificial Sequence
  chemically synthesized
tttttttttttttattgaga

SEQ ID NO: 422566 - DNA, 20 bp, Artificial Sequence
  chemically synthesized
tttttttttttattgagacg

SEQ ID NO: 422567 - DNA, 20 bp, Artificial Sequence
  chemically synthesized
tccagcctgagagacagagg

SEQ ID NO: 422568 - DNA, 20 bp, Artificial Sequence
  chemically synthesized
cactccagcctgagagacag

SEQ ID NO: 422569 - DNA, 20 bp, Artificial Sequence
  chemically synthesized
cggagtcttcctctgtctct

SEQ ID NO: 422570 - DNA, 20 bp, Artificial Sequence
  chemically synthesized
gcactccagcctgagagaca

SEQ ID NO: 422571 - DNA, 20 bp, Artificial Sequence
  chemically synthesized
ggagtcttcctctgtctctc

SEQ ID NO: 422572 - DNA, 20 bp, Artificial Sequence
  chemically synthesized
ctgcactccagcctgagaga

SEQ ID NO: 422573 - DNA, 20 bp, Artificial Sequence
  chemically synthesized
tcttcctctgtctctcaggc

SEQ ID NO: 422574 - DNA, 20 bp, Artificial Sequence
  chemically synthesized
gccactgcactccagcctga

SEQ ID NO: 422575 - DNA, 20 bp, Artificial Sequence
  chemically synthesized
ttcctctgtctctcaggctg

SEQ ID NO: 422576 - DNA, 20 bp, Artificial Sequence
  chemically synthesized
gtgccactgcactccagcct

SEQ ID NO: 422577 - DNA, 20 bp, Artificial Sequence
  chemically synthesized
ctgtctctcaggctggagtg

SEQ ID NO: 422578 - DNA, 20 bp, Artificial Sequence
  chemically synthesized
aagatagtgccactgcactc

SEQ ID NO: 422579 - DNA, 20 bp, Artificial Sequence
  chemically synthesized
tctctcaggctggagtgcag

SEQ ID NO: 422580 - DNA, 20 bp, Artificial Sequence
  chemically synthesized
ggagtgcagtggcactatct

SEQ ID NO: 422581 - DNA, 20 bp, Artificial Sequence
  chemically synthesized
gaggtttcggtgagccaaga

SEQ ID NO: 422582 - DNA, 20 bp, Artificial Sequence
  chemically synthesized
ggcggaggtttcggtgagcc

SEQ ID NO: 422583 - DNA, 20 bp, Artificial Sequence
  chemically synthesized
tgggaggcggaggtttcggt

SEQ ID NO: 422584 - DNA, 20 bp, Artificial Sequence
  chemically synthesized
aacctgggaggcggaggttt

SEQ ID NO: 422585 - DNA, 20 bp, Artificial Sequence
  chemically synthesized
cacttgaacctgggaggcgg

SEQ ID NO: 422586 - DNA, 20 bp, Artificial Sequence
  chemically synthesized
tcaccgaaacctccgcctcc

SEQ ID NO: 422587 - DNA, 20 bp, Artificial Sequence
  chemically synthesized
tcacttgaacctgggaggcg

SEQ ID NO: 422588 - DNA, 20 bp, Artificial Sequence
  chemically synthesized
caccgaaacctccgcctccc

SEQ ID NO: 422589 - DNA, 20 bp, Artificial Sequence
  chemically synthesized
aatcacttgaacctgggagg

SEQ ID NO: 422590 - DNA, 20 bp, Artificial Sequence
  chemically synthesized
gagaatcacttgaacctggg

SEQ ID NO: 422591 - DNA, 20 bp, Artificial Sequence
  chemically synthesized
ggagaatcacttgaacctgg

SEQ ID NO: 422592 - DNA, 20 bp, Artificial Sequence
  chemically synthesized
aacctccgcctcccaggttc

SEQ ID NO: 422593 - DNA, 20 bp, Artificial Sequence
  chemically synthesized
caggagaatcacttgaacct

SEQ ID NO: 422594 - DNA, 20 bp, Artificial Sequence
  chemically synthesized
gcaggagaatcacttgaacc

SEQ ID NO: 422595 - DNA, 20 bp, Artificial Sequence
  chemically synthesized
ttcaagtgattctcctgcct

SEQ ID NO: 422596 - DNA, 20 bp, Artificial Sequence
  chemically synthesized
tactagggaggctgaggcag

SEQ ID NO: 422597 - DNA, 20 bp, Artificial Sequence
  chemically synthesized
gctactagggaggctgaggc

SEQ ID NO: 422598 - DNA, 20 bp, Artificial Sequence
  chemically synthesized
agctactagggaggctgagg

SEQ ID NO: 422599 - DNA, 20 bp, Artificial Sequence
  chemically synthesized
cccagctactagggaggctg

SEQ ID NO: 422600 - DNA, 20 bp, Artificial Sequence
  chemically synthesized
tcccagctactagggaggct

SEQ ID NO: 422601 - DNA, 20 bp, Artificial Sequence
  chemically synthesized
ttctcctgcctcagcctccc

SEQ ID NO: 422602 - DNA, 20 bp, Artificial Sequence
  chemically synthesized
tcctgcctcagcctccctag

SEQ ID NO: 422603 - DNA, 20 bp, Artificial Sequence
  chemically synthesized
tgtagtcccagctactaggg

SEQ ID NO: 422604 - DNA, 20 bp, Artificial Sequence
  chemically synthesized
ctgtagtcccagctactagg

SEQ ID NO: 422605 - DNA, 20 bp, Artificial Sequence
  chemically synthesized
gcctcagcctccctagtagc

SEQ ID NO: 422606 - DNA, 20 bp, Artificial Sequence
  chemically synthesized
gcctgtagtcccagctacta

SEQ ID NO: 422607 - DNA, 20 bp, Artificial Sequence
  chemically synthesized
cctcagcctccctagtagct

SEQ ID NO: 422608 - DNA, 20 bp, Artificial Sequence
  chemically synthesized
cgcctgtagtcccagctact

SEQ ID NO: 422609 - DNA, 20 bp, Artificial Sequence
  chemically synthesized
gcgcctgtagtcccagctac

SEQ ID NO: 422610 - DNA, 20 bp, Artificial Sequence
  chemically synthesized
ctccctagtagctgggacta

SEQ ID NO: 422611 - DNA, 20 bp, Artificial Sequence
  chemically synthesized
tccctagtagctgggactac

SEQ ID NO: 422612 - DNA, 20 bp, Artificial Sequence
  chemically synthesized
gtggcatgcgcctgtagtcc

SEQ ID NO: 422613 - DNA, 20 bp, Artificial Sequence
  chemically synthesized
gacatggtggcatgcgcctg

SEQ ID NO: 422614 - DNA, 20 bp, Artificial Sequence
  chemically synthesized
caggcgcatgccaccatgtc

SEQ ID NO: 422615 - DNA, 20 bp, Artificial Sequence
  chemically synthesized
aaaaaattaaccagacatgg

SEQ ID NO: 422616 - DNA, 20 bp, Artificial Sequence
  chemically synthesized
acaaaaaaattaaccagaca

SEQ ID NO: 422617 - DNA, 20 bp, Artificial Sequence
  chemically synthesized
aaaaatacaaaaaaattaac

SEQ ID NO: 422618 - DNA, 20 bp, Artificial Sequence
  chemically synthesized
ggttaatttttttgtatttt

SEQ ID NO: 422619 - DNA, 20 bp, Artificial Sequence
  chemically synthesized
taatttttttgtatttttgg

SEQ ID NO: 422620 - DNA, 20 bp, Artificial Sequence
  chemically synthesized
atttttttgtatttttggta

SEQ ID NO: 422621 - DNA, 20 bp, Artificial Sequence
  chemically synthesized
ttttgtatttttggtagaga

SEQ ID NO: 422622 - DNA, 20 bp, Artificial Sequence
  chemically synthesized
tttgtatttttggtagagac

SEQ ID NO: 422623 - DNA, 20 bp, Artificial Sequence
  chemically synthesized
ttgtatttttggtagagacg

SEQ ID NO: 422624 - DNA, 20 bp, Artificial Sequence
  chemically synthesized
gagacggggtttcaccatgt

SEQ ID NO: 422625 - DNA, 20 bp, Artificial Sequence
  chemically synthesized
cggggtttcaccatgttggc

SEQ ID NO: 422626 - DNA, 20 bp, Artificial Sequence
  chemically synthesized
cgagacctgcctggccaaca

SEQ ID NO: 422627 - DNA, 20 bp, Artificial Sequence
  chemically synthesized
ggggtttcaccatgttggcc

SEQ ID NO: 422628 - DNA, 20 bp, Artificial Sequence
  chemically synthesized
gtttcaccatgttggccagg

SEQ ID NO: 422629 - DNA, 20 bp, Artificial Sequence
  chemically synthesized
tttcaccatgttggccaggc

SEQ ID NO: 422630 - DNA, 20 bp, Artificial Sequence
  chemically synthesized
tcaggatgtcgagacctgcc

SEQ ID NO: 422631 - DNA, 20 bp, Artificial Sequence
  chemically synthesized
ttacttgaggtcaggatgtc

SEQ ID NO: 422632 - DNA, 20 bp, Artificial Sequence
  chemically synthesized
ggtctcgacatcctgacctc

SEQ ID NO: 422633 - DNA, 20 bp, Artificial Sequence
  chemically synthesized
tgggcggattacttgaggtc

SEQ ID NO: 422634 - DNA, 20 bp, Artificial Sequence
  chemically synthesized
gtgggcggattacttgaggt

SEQ ID NO: 422635 - DNA, 20 bp, Artificial Sequence
  chemically synthesized
caaggtgggcggattacttg

SEQ ID NO: 422636 - DNA, 20 bp, Artificial Sequence
  chemically synthesized
ccaaggtgggcggattactt

SEQ ID NO: 422637 - DNA, 20 bp, Artificial Sequence
  chemically synthesized
ctcaagtaatccgcccacct

SEQ ID NO: 422638 - DNA, 20 bp, Artificial Sequence
  chemically synthesized
ttttgagaggccaaggtggg

SEQ ID NO: 422639 - DNA, 20 bp, Artificial Sequence
  chemically synthesized
acattttgagaggccaaggt

SEQ ID NO: 422640 - DNA, 20 bp, Artificial Sequence
  chemically synthesized
aacattttgagaggccaagg

SEQ ID NO: 422641 - DNA, 20 bp, Artificial Sequence
  chemically synthesized
cccaacattttgagaggcca

SEQ ID NO: 422642 - DNA, 20 bp, Artificial Sequence
  chemically synthesized
tcccaacattttgagaggcc

SEQ ID NO: 422643 - DNA, 20 bp, Artificial Sequence
  chemically synthesized
tgtaatcccaacattttgag

SEQ ID NO: 422644 - DNA, 20 bp, Artificial Sequence
  chemically synthesized
ctgtaatcccaacattttga

SEQ ID NO: 422645 - DNA, 20 bp, Artificial Sequence
  chemically synthesized
accttggcctctcaaaatgt

SEQ ID NO: 422646 - DNA, 20 bp, Artificial Sequence
  chemically synthesized
gcctgtaatcccaacatttt

SEQ ID NO: 422647 - DNA, 20 bp, Artificial Sequence
  chemically synthesized
ccttggcctctcaaaatgtt

SEQ ID NO: 422648 - DNA, 20 bp, Artificial Sequence
  chemically synthesized
ctctcaaaatgttgggatta

SEQ ID NO: 422649 - DNA, 20 bp, Artificial Sequence
  chemically synthesized
tctcaaaatgttgggattac

SEQ ID NO: 422650 - DNA, 20 bp, Artificial Sequence
  chemically synthesized
aatgttgggattacaggcgt

SEQ ID NO: 422651 - DNA, 20 bp, Artificial Sequence
  chemically synthesized
caggcgtgagccaccacgcc

SEQ ID NO: 422652 - DNA, 20 bp, Artificial Sequence
  chemically synthesized
gaatgataggccaggcgtgg

SEQ ID NO: 422653 - DNA, 20 bp, Artificial Sequence
  chemically synthesized
aaagaatgataggccaggcg

SEQ ID NO: 422654 - DNA, 20 bp, Artificial Sequence
  chemically synthesized
ttaaaaaagaatgataggcc

SEQ ID NO: 422655 - DNA, 20 bp, Artificial Sequence
  chemically synthesized
attaaaaaagaatgataggc

SEQ ID NO: 422656 - DNA, 20 bp, Artificial Sequence
  chemically synthesized
gcaaattaaaaaagaatgat

SEQ ID NO: 422657 - DNA, 20 bp, Artificial Sequence
  chemically synthesized
tgcaaattaaaaaagaatga

SEQ ID NO: 422658 - DNA, 20 bp, Artificial Sequence
  chemically synthesized
taaaagtctgcaaattaaaa

SEQ ID NO: 422659 - DNA, 20 bp, Artificial Sequence
  chemically synthesized
tatcattcttttttaatttg

SEQ ID NO: 422660 - DNA, 20 bp, Artificial Sequence
  chemically synthesized
tttttaatttgcagactttt

SEQ ID NO: 422661 - DNA, 20 bp, Artificial Sequence
  chemically synthesized
aatttgcagacttttaagaa

SEQ ID NO: 422662 - DNA, 20 bp, Artificial Sequence
  chemically synthesized
tcaaattagcctgttcttaa

SEQ ID NO: 422663 - DNA, 20 bp, Artificial Sequence
  chemically synthesized
atttgcagacttttaagaac

SEQ ID NO: 422664 - DNA, 20 bp, Artificial Sequence
  chemically synthesized
ttttaagaacaggctaattt

SEQ ID NO: 422665 - DNA, 20 bp, Artificial Sequence
  chemically synthesized
tgtggttctgtgtctcaaat

SEQ ID NO: 422666 - DNA, 20 bp, Artificial Sequence
  chemically synthesized
gaacaggctaatttgagaca

SEQ ID NO: 422667 - DNA, 20 bp, Artificial Sequence
  chemically synthesized
tttgagacacagaaccacaa

SEQ ID NO: 422668 - DNA, 20 bp, Artificial Sequence
  chemically synthesized
tggaacgtaagtagcttttg

SEQ ID NO: 422669 - DNA, 20 bp, Artificial Sequence
  chemically synthesized
agagcattttggaacgtaag

SEQ ID NO: 422670 - DNA, 20 bp, Artificial Sequence
  chemically synthesized
tgcagagcattttggaacgt

SEQ ID NO: 422671 - DNA, 20 bp, Artificial Sequence
  chemically synthesized
agagattctgcagagcattt

SEQ ID NO: 422672 - DNA, 20 bp, Artificial Sequence
  chemically synthesized
ttacgttccaaaatgctctg

SEQ ID NO: 422673 - DNA, 20 bp, Artificial Sequence
  chemically synthesized
atgcaaaaagagattctgca

SEQ ID NO: 422674 - DNA, 20 bp, Artificial Sequence
  chemically synthesized
acatgcaaaaagagattctg

SEQ ID NO: 422675 - DNA, 20 bp, Artificial Sequence
  chemically synthesized
atacgtagcacatgcaaaaa

SEQ ID NO: 422676 - DNA, 20 bp, Artificial Sequence
  chemically synthesized
ccatacgtagcacatgcaaa

SEQ ID NO: 422677 - DNA, 20 bp, Artificial Sequence
  chemically synthesized
ctttttgcatgtgctacgta

SEQ ID NO: 422678 - DNA, 20 bp, Artificial Sequence
  chemically synthesized
cttctcccaaaggccatacg

SEQ ID NO: 422679 - DNA, 20 bp, Artificial Sequence
  chemically synthesized
catgtgctacgtatggcctt

SEQ ID NO: 422680 - DNA, 20 bp, Artificial Sequence
  chemically synthesized
atgtgctacgtatggccttt

SEQ ID NO: 422681 - DNA, 20 bp, Artificial Sequence
  chemically synthesized
gtgctacgtatggcctttgg

SEQ ID NO: 422682 - DNA, 20 bp, Artificial Sequence
  chemically synthesized
ctacgtatggcctttgggag

SEQ ID NO: 422683 - DNA, 20 bp, Artificial Sequence
  chemically synthesized
aaaaaatgtacttctcccaa

SEQ ID NO: 422684 - DNA, 20 bp, Artificial Sequence
  chemically synthesized
caaaaaatgtacttctccca

SEQ ID NO: 422685 - DNA, 20 bp, Artificial Sequence
  chemically synthesized
tgggagaagtacattttttg

SEQ ID NO: 422686 - DNA, 20 bp, Artificial Sequence
  chemically synthesized
cattttttgtagttgttttg

SEQ ID NO: 422687 - DNA, 20 bp, Artificial Sequence
  chemically synthesized
ttgtggttttttgaaatgac

SEQ ID NO: 422688 - DNA, 20 bp, Artificial Sequence
  chemically synthesized
tagggccctaaaaatatttc

SEQ ID NO: 422689 - DNA, 20 bp, Artificial Sequence
  chemically synthesized
gaaatgactagaaatatttt

SEQ ID NO: 422690 - DNA, 20 bp, Artificial Sequence
  chemically synthesized
aaatgactagaaatattttt

SEQ ID NO: 422691 - DNA, 20 bp, Artificial Sequence
  chemically synthesized
aatgactagaaatattttta

SEQ ID NO: 422692 - DNA, 20 bp, Artificial Sequence
  chemically synthesized
tagaaatatttttagggccc

SEQ ID NO: 422693 - DNA, 20 bp, Artificial Sequence
  chemically synthesized
acttaccttggaggtttcta

SEQ ID NO: 422694 - DNA, 20 bp, Artificial Sequence
  chemically synthesized
cacttaccttggaggtttct

SEQ ID NO: 422695 - DNA, 20 bp, Artificial Sequence
  chemically synthesized
acacttaccttggaggtttc

SEQ ID NO: 422696 - DNA, 20 bp, Artificial Sequence
  chemically synthesized
ttagggccctagaaacctcc

SEQ ID NO: 422697 - DNA, 20 bp, Artificial Sequence
  chemically synthesized
tagggccctagaaacctcca

SEQ ID NO: 422698 - DNA, 20 bp, Artificial Sequence
  chemically synthesized
gccctagaaacctccaaggt

SEQ ID NO: 422699 - DNA, 20 bp, Artificial Sequence
  chemically synthesized
tttctaaacacttaccttgg

SEQ ID NO: 422700 - DNA, 20 bp, Artificial Sequence
  chemically synthesized
atttctaaacacttaccttg

SEQ ID NO: 422701 - DNA, 20 bp, Artificial Sequence
  chemically synthesized
caatttctaaacacttacct

SEQ ID NO: 422702 - DNA, 20 bp, Artificial Sequence
  chemically synthesized
aaacctccaaggtaagtgtt

SEQ ID NO: 422703 - DNA, 20 bp, Artificial Sequence
  chemically synthesized
gtgtttagaaattgtgcttc

SEQ ID NO: 422704 - DNA, 20 bp, Artificial Sequence
  chemically synthesized
tgtttagaaattgtgcttct

SEQ ID NO: 422705 - DNA, 20 bp, Artificial Sequence
  chemically synthesized
aagtactgacagattcctag

SEQ ID NO: 422706 - DNA, 20 bp, Artificial Sequence
  chemically synthesized
caaaagtactgacagattcc

SEQ ID NO: 422707 - DNA, 20 bp, Artificial Sequence
  chemically synthesized
ttgtgcttctaggaatctgt

SEQ ID NO: 422708 - DNA, 20 bp, Artificial Sequence
  chemically synthesized
aatgtttacaaaagtactga

SEQ ID NO: 422709 - DNA, 20 bp, Artificial Sequence
  chemically synthesized
gcttcagataatgtttacaa

SEQ ID NO: 422710 - DNA, 20 bp, Artificial Sequence
  chemically synthesized
acttttgtaaacattatctg

SEQ ID NO: 422711 - DNA, 20 bp, Artificial Sequence
  chemically synthesized
gtaaacattatctgaagcat

SEQ ID NO: 422712 - DNA, 20 bp, Artificial Sequence
  chemically synthesized
atttgtttatgcttatgctt

SEQ ID NO: 422713 - DNA, 20 bp, Artificial Sequence
  chemically synthesized
taagcataaacaaatttgaa

SEQ ID NO: 422714 - DNA, 20 bp, Artificial Sequence
  chemically synthesized
gcataaacaaatttgaacag

SEQ ID NO: 422715 - DNA, 20 bp, Artificial Sequence
  chemically synthesized
cataaacaaatttgaacagc

SEQ ID NO: 422716 - DNA, 20 bp, Artificial Sequence
  chemically synthesized
aacaaatttgaacagcaggc

SEQ ID NO: 422717 - DNA, 20 bp, Artificial Sequence
  chemically synthesized
gaacagcaggctagctcaca

SEQ ID NO: 422718 - DNA, 20 bp, Artificial Sequence
  chemically synthesized
aaaatcatttctgtgtgagc

SEQ ID NO: 422719 - DNA, 20 bp, Artificial Sequence
  chemically synthesized
gaataaaatcatttctgtgt

SEQ ID NO: 422720 - DNA, 20 bp, Artificial Sequence
  chemically synthesized
acagaaatgattttattcat

SEQ ID NO: 422721 - DNA, 20 bp, Artificial Sequence
  chemically synthesized
cattggaatgttctcacatg

SEQ ID NO: 422722 - DNA, 20 bp, Artificial Sequence
  chemically synthesized
aaataaagtataccacatgt

SEQ ID NO: 422723 - DNA, 20 bp, Artificial Sequence
  chemically synthesized
catgtggtatactttatttt

SEQ ID NO: 422724 - DNA, 20 bp, Artificial Sequence
  chemically synthesized
atgaaaccaaactaaaaata

SEQ ID NO: 422725 - DNA, 20 bp, Artificial Sequence
  chemically synthesized
ggtatactttatttttagtt

SEQ ID NO: 422726 - DNA, 20 bp, Artificial Sequence
  chemically synthesized
gattaataattatgattcca

SEQ ID NO: 422727 - DNA, 20 bp, Artificial Sequence
  chemically synthesized
attaataattatgattccaa

SEQ ID NO: 422728 - DNA, 20 bp, Artificial Sequence
  chemically synthesized
ccggctgatttaagcacctt

SEQ ID NO: 422729 - DNA, 20 bp, Artificial Sequence
  chemically synthesized
gattccaaaggtgcttaaat

SEQ ID NO: 422730 - DNA, 20 bp, Artificial Sequence
  chemically synthesized
ccaccatggccggctgattt

SEQ ID NO: 422731 - DNA, 20 bp, Artificial Sequence
  chemically synthesized
ccaaaggtgcttaaatcagc

SEQ ID NO: 422732 - DNA, 20 bp, Artificial Sequence
  chemically synthesized
gtgcttaaatcagccggcca

SEQ ID NO: 422733 - DNA, 20 bp, Artificial Sequence
  chemically synthesized
cttaaatcagccggccatgg

SEQ ID NO: 422734 - DNA, 20 bp, Artificial Sequence
  chemically synthesized
caggcatgaaccaccatggc

SEQ ID NO: 422735 - DNA, 20 bp, Artificial Sequence
  chemically synthesized
attacaggcatgaaccacca

SEQ ID NO: 422736 - DNA, 20 bp, Artificial Sequence
  chemically synthesized
tcccaaagtgttgagattac

SEQ ID NO: 422737 - DNA, 20 bp, Artificial Sequence
  chemically synthesized
ctcccaaagtgttgagatta

SEQ ID NO: 422738 - DNA, 20 bp, Artificial Sequence
  chemically synthesized
tgcctgtaatctcaacactt

SEQ ID NO: 422739 - DNA, 20 bp, Artificial Sequence
  chemically synthesized
tctcggcctcccaaagtgtt

SEQ ID NO: 422740 - DNA, 20 bp, Artificial Sequence
  chemically synthesized
gcctgtaatctcaacacttt

SEQ ID NO: 422741 - DNA, 20 bp, Artificial Sequence
  chemically synthesized
ctgtaatctcaacactttgg

SEQ ID NO: 422742 - DNA, 20 bp, Artificial Sequence
  chemically synthesized
tgtaatctcaacactttggg

SEQ ID NO: 422743 - DNA, 20 bp, Artificial Sequence
  chemically synthesized
ctgcccatctcggcctccca

SEQ ID NO: 422744 - DNA, 20 bp, Artificial Sequence
  chemically synthesized
tctcaacactttgggaggcc

SEQ ID NO: 422745 - DNA, 20 bp, Artificial Sequence
  chemically synthesized
aacactttgggaggccgaga

SEQ ID NO: 422746 - DNA, 20 bp, Artificial Sequence
  chemically synthesized
acactttgggaggccgagat

SEQ ID NO: 422747 - DNA, 20 bp, Artificial Sequence
  chemically synthesized
ctttgggaggccgagatggg

SEQ ID NO: 422748 - DNA, 20 bp, Artificial Sequence
  chemically synthesized
ctcaagtgatctgcccatct

SEQ ID NO: 422749 - DNA, 20 bp, Artificial Sequence
  chemically synthesized
ccgagatgggcagatcactt

SEQ ID NO: 422750 - DNA, 20 bp, Artificial Sequence
  chemically synthesized
cgagatgggcagatcacttg

SEQ ID NO: 422751 - DNA, 20 bp, Artificial Sequence
  chemically synthesized
atgggcagatcacttgaggt

SEQ ID NO: 422752 - DNA, 20 bp, Artificial Sequence
  chemically synthesized
tgggcagatcacttgaggtc

SEQ ID NO: 422753 - DNA, 20 bp, Artificial Sequence
  chemically synthesized
ggtctcgaactcctgacctc

SEQ ID NO: 422754 - DNA, 20 bp, Artificial Sequence
  chemically synthesized
ggcagatcacttgaggtcag

SEQ ID NO: 422755 - DNA, 20 bp, Artificial Sequence
  chemically synthesized
tcacttgaggtcaggagttc

SEQ ID NO: 422756 - DNA, 20 bp, Artificial Sequence
  chemically synthesized
tgaggtcaggagttcgagac

SEQ ID NO: 422757 - DNA, 20 bp, Artificial Sequence
  chemically synthesized
tcaggagttcgagaccagcc

SEQ ID NO: 422758 - DNA, 20 bp, Artificial Sequence
  chemically synthesized
tttcaccctgttggccaggc

SEQ ID NO: 422759 - DNA, 20 bp, Artificial Sequence
  chemically synthesized
ttcgagaccagcctggccaa

SEQ ID NO: 422760 - DNA, 20 bp, Artificial Sequence
  chemically synthesized
tcgagaccagcctggccaac

SEQ ID NO: 422761 - DNA, 20 bp, Artificial Sequence
  chemically synthesized
ggggtttcaccctgttggcc

SEQ ID NO: 422762 - DNA, 20 bp, Artificial Sequence
  chemically synthesized
cgagaccagcctggccaaca

SEQ ID NO: 422763 - DNA, 20 bp, Artificial Sequence
  chemically synthesized
cggggtttcaccctgttggc

SEQ ID NO: 422764 - DNA, 20 bp, Artificial Sequence
  chemically synthesized
gagacggggtttcaccctgt

SEQ ID NO: 422765 - DNA, 20 bp, Artificial Sequence
  chemically synthesized
ttatatttttaggagagacg

SEQ ID NO: 422766 - DNA, 20 bp, Artificial Sequence
  chemically synthesized
tttatatttttaggagagac

SEQ ID NO: 422767 - DNA, 20 bp, Artificial Sequence
  chemically synthesized
ttttatatttttaggagaga

SEQ ID NO: 422768 - DNA, 20 bp, Artificial Sequence
  chemically synthesized
taatttttatatttttagga

SEQ ID NO: 422769 - DNA, 20 bp, Artificial Sequence
  chemically synthesized
actaatttttatatttttag

SEQ ID NO: 422770 - DNA, 20 bp, Artificial Sequence
  chemically synthesized
tgactaatttttatattttt

SEQ ID NO: 422771 - DNA, 20 bp, Artificial Sequence
  chemically synthesized
ctgactaatttttatatttt

SEQ ID NO: 422772 - DNA, 20 bp, Artificial Sequence
  chemically synthesized
tctcctaaaaatataaaaat

SEQ ID NO: 422773 - DNA, 20 bp, Artificial Sequence
  chemically synthesized
ctaaaaatataaaaattagt

SEQ ID NO: 422774 - DNA, 20 bp, Artificial Sequence
  chemically synthesized
taaaaatataaaaattagtc

SEQ ID NO: 422775 - DNA, 20 bp, Artificial Sequence
  chemically synthesized
atataaaaattagtcaggca

SEQ ID NO: 422776 - DNA, 20 bp, Artificial Sequence
  chemically synthesized
taaaaattagtcaggcacgg

SEQ ID NO: 422777 - DNA, 20 bp, Artificial Sequence
  chemically synthesized
gtggtgcatgcctgtaatcc

SEQ ID NO: 422778 - DNA, 20 bp, Artificial Sequence
  chemically synthesized
tcctcagtaactgggattac

SEQ ID NO: 422779 - DNA, 20 bp, Artificial Sequence
  chemically synthesized
ctcctcagtaactgggatta

SEQ ID NO: 422780 - DNA, 20 bp, Artificial Sequence
  chemically synthesized
tgcctgtaatcccagttact

SEQ ID NO: 422781 - DNA, 20 bp, Artificial Sequence
  chemically synthesized
cctgagcctcctcagtaact

SEQ ID NO: 422782 - DNA, 20 bp, Artificial Sequence
  chemically synthesized
gcctgtaatcccagttactg

SEQ ID NO: 422783 - DNA, 20 bp, Artificial Sequence
  chemically synthesized
gcctgagcctcctcagtaac

SEQ ID NO: 422784 - DNA, 20 bp, Artificial Sequence
  chemically synthesized
ctgtaatcccagttactgag

SEQ ID NO: 422785 - DNA, 20 bp, Artificial Sequence
  chemically synthesized
tgtaatcccagttactgagg

SEQ ID NO: 422786 - DNA, 20 bp, Artificial Sequence
  chemically synthesized
ttctcctgcctgagcctcct

SEQ ID NO: 422787 - DNA, 20 bp, Artificial Sequence
  chemically synthesized
tcccagttactgaggaggct

SEQ ID NO: 422788 - DNA, 20 bp, Artificial Sequence
  chemically synthesized
cccagttactgaggaggctc

SEQ ID NO: 422789 - DNA, 20 bp, Artificial Sequence
  chemically synthesized
agttactgaggaggctcagg

SEQ ID NO: 422790 - DNA, 20 bp, Artificial Sequence
  chemically synthesized
gttactgaggaggctcaggc

SEQ ID NO: 422791 - DNA, 20 bp, Artificial Sequence
  chemically synthesized
tactgaggaggctcaggcag

SEQ ID NO: 422792 - DNA, 20 bp, Artificial Sequence
  chemically synthesized
ctcaagcaattctcctgcct

SEQ ID NO: 422793 - DNA, 20 bp, Artificial Sequence
  chemically synthesized
ctcaggcaggagaattgctt

SEQ ID NO: 422794 - DNA, 20 bp, Artificial Sequence
  chemically synthesized
gcaggagaattgcttgagcc

SEQ ID NO: 422795 - DNA, 20 bp, Artificial Sequence
  chemically synthesized
aggagaattgcttgagcctg

SEQ ID NO: 422796 - DNA, 20 bp, Artificial Sequence
  chemically synthesized
caacctccacctccaggctc

SEQ ID NO: 422797 - DNA, 20 bp, Artificial Sequence
  chemically synthesized
ggagaattgcttgagcctgg

SEQ ID NO: 422798 - DNA, 20 bp, Artificial Sequence
  chemically synthesized
gaattgcttgagcctggagg

SEQ ID NO: 422799 - DNA, 20 bp, Artificial Sequence
  chemically synthesized
attgcttgagcctggaggtg

SEQ ID NO: 422800 - DNA, 20 bp, Artificial Sequence
  chemically synthesized
tccctgcaacctccacctcc

SEQ ID NO: 422801 - DNA, 20 bp, Artificial Sequence
  chemically synthesized
ttgcttgagcctggaggtgg

SEQ ID NO: 422802 - DNA, 20 bp, Artificial Sequence
  chemically synthesized
ctccctgcaacctccacctc

SEQ ID NO: 422803 - DNA, 20 bp, Artificial Sequence
  chemically synthesized
gagcctggaggtggaggttg

SEQ ID NO: 422804 - DNA, 20 bp, Artificial Sequence
  chemically synthesized
agcctggaggtggaggttgc

SEQ ID NO: 422805 - DNA, 20 bp, Artificial Sequence
  chemically synthesized
gcctggaggtggaggttgca

SEQ ID NO: 422806 - DNA, 20 bp, Artificial Sequence
  chemically synthesized
ctggaggtggaggttgcagg

SEQ ID NO: 422807 - DNA, 20 bp, Artificial Sequence
  chemically synthesized
ggtggaggttgcagggagcc

SEQ ID NO: 422808 - DNA, 20 bp, Artificial Sequence
  chemically synthesized
ggagctcactggtgcaatct

SEQ ID NO: 422809 - DNA, 20 bp, Artificial Sequence
  chemically synthesized
gcagggagccgagattgcac

SEQ ID NO: 422810 - DNA, 20 bp, Artificial Sequence
  chemically synthesized
ggagccgagattgcaccagt

SEQ ID NO: 422811 - DNA, 20 bp, Artificial Sequence
  chemically synthesized
tcacccaggctggagctcac

SEQ ID NO: 422812 - DNA, 20 bp, Artificial Sequence
  chemically synthesized
gagattgcaccagtgagctc

SEQ ID NO: 422813 - DNA, 20 bp, Artificial Sequence
  chemically synthesized
tgcaccagtgagctccagcc

SEQ ID NO: 422814 - DNA, 20 bp, Artificial Sequence
  chemically synthesized
gcaccagtgagctccagcct

SEQ ID NO: 422815 - DNA, 20 bp, Artificial Sequence
  chemically synthesized
tcactctgtcacccaggctg

SEQ ID NO: 422816 - DNA, 20 bp, Artificial Sequence
  chemically synthesized
tctcactctgtcacccaggc

SEQ ID NO: 422817 - DNA, 20 bp, Artificial Sequence
  chemically synthesized
gtgagctccagcctgggtga

SEQ ID NO: 422818 - DNA, 20 bp, Artificial Sequence
  chemically synthesized
ggagtctcactctgtcaccc

SEQ ID NO: 422819 - DNA, 20 bp, Artificial Sequence
  chemically synthesized
gagctccagcctgggtgaca

SEQ ID NO: 422820 - DNA, 20 bp, Artificial Sequence
  chemically synthesized
cggagtctcactctgtcacc

SEQ ID NO: 422821 - DNA, 20 bp, Artificial Sequence
  chemically synthesized
tccagcctgggtgacagagt

SEQ ID NO: 422822 - DNA, 20 bp, Artificial Sequence
  chemically synthesized
gtttgtttgtttttgagacg

SEQ ID NO: 422823 - DNA, 20 bp, Artificial Sequence
  chemically synthesized
ttgtttgtttgtttttgaga

SEQ ID NO: 422824 - DNA, 20 bp, Artificial Sequence
  chemically synthesized
ttgtttgtttgtttgttttt

SEQ ID NO: 422825 - DNA, 20 bp, Artificial Sequence
  chemically synthesized
aaaacaaaaaacaaaaatca

SEQ ID NO: 422826 - DNA, 20 bp, Artificial Sequence
  chemically synthesized
aaacaaaaaacaaaaatcaa

SEQ ID NO: 422827 - DNA, 20 bp, Artificial Sequence
  chemically synthesized
caaaaaacaaaaatcaaagg

SEQ ID NO: 422828 - DNA, 20 bp, Artificial Sequence
  chemically synthesized
aaataattttgttgaatatt

SEQ ID NO: 422829 - DNA, 20 bp, Artificial Sequence
  chemically synthesized
agtgtgtgcattaatgtaga

SEQ ID NO: 422830 - DNA, 20 bp, Artificial Sequence
  chemically synthesized
attgagtgtgtgcattaatg

SEQ ID NO: 422831 - DNA, 20 bp, Artificial Sequence
  chemically synthesized
taagttaaaatatatacatt

SEQ ID NO: 422832 - DNA, 20 bp, Artificial Sequence
  chemically synthesized
tacaattttaagtataaatt

SEQ ID NO: 422833 - DNA, 20 bp, Artificial Sequence
  chemically synthesized
aaataattttatacaatttt

SEQ ID NO: 422834 - DNA, 20 bp, Artificial Sequence
  chemically synthesized
aaaattgtataaaattattt

SEQ ID NO: 422835 - DNA, 20 bp, Artificial Sequence
  chemically synthesized
gtataaaattattttagtca

SEQ ID NO: 422836 - DNA, 20 bp, Artificial Sequence
  chemically synthesized
tttagtcaaagaacctaatg

SEQ ID NO: 422837 - DNA, 20 bp, Artificial Sequence
  chemically synthesized
aatcaaggctaagctgcatt

SEQ ID NO: 422838 - DNA, 20 bp, Artificial Sequence
  chemically synthesized
caatcaaggctaagctgcat

SEQ ID NO: 422839 - DNA, 20 bp, Artificial Sequence
  chemically synthesized
tcaaagaacctaatgcagct

SEQ ID NO: 422840 - DNA, 20 bp, Artificial Sequence
  chemically synthesized
tgaaattatcaatcaaggct

SEQ ID NO: 422841 - DNA, 20 bp, Artificial Sequence
  chemically synthesized
gataatgaaattatcaatca

SEQ ID NO: 422842 - DNA, 20 bp, Artificial Sequence
  chemically synthesized
agataatgaaattatcaatc

SEQ ID NO: 422843 - DNA, 20 bp, Artificial Sequence
  chemically synthesized
gaaattctgccatgtaatta

SEQ ID NO: 422844 - DNA, 20 bp, Artificial Sequence
  chemically synthesized
tttcattatctttaattaca

SEQ ID NO: 422845 - DNA, 20 bp, Artificial Sequence
  chemically synthesized
cattatctttaattacatgg

SEQ ID NO: 422846 - DNA, 20 bp, Artificial Sequence
  chemically synthesized
tttggttaaagagtaatgag

SEQ ID NO: 422847 - DNA, 20 bp, Artificial Sequence
  chemically synthesized
cttttggttaaagagtaatg

SEQ ID NO: 422848 - DNA, 20 bp, Artificial Sequence
  chemically synthesized
ccttttggttaaagagtaat

SEQ ID NO: 422849 - DNA, 20 bp, Artificial Sequence
  chemically synthesized
accacagccttttggttaaa

SEQ ID NO: 422850 - DNA, 20 bp, Artificial Sequence
  chemically synthesized
cctcattactctttaaccaa

SEQ ID NO: 422851 - DNA, 20 bp, Artificial Sequence
  chemically synthesized
ctaccacagccttttggtta

SEQ ID NO: 422852 - DNA, 20 bp, Artificial Sequence
  chemically synthesized
ctcattactctttaaccaaa

SEQ ID NO: 422853 - DNA, 20 bp, Artificial Sequence
  chemically synthesized
tgatttctaccacagccttt

SEQ ID NO: 422854 - DNA, 20 bp, Artificial Sequence
  chemically synthesized
actctttaaccaaaaggctg

SEQ ID NO: 422855 - DNA, 20 bp, Artificial Sequence
  chemically synthesized
ctttaaccaaaaggctgtgg

SEQ ID NO: 422856 - DNA, 20 bp, Artificial Sequence
  chemically synthesized
agcatcaatgatttctacca

SEQ ID NO: 422857 - DNA, 20 bp, Artificial Sequence
  chemically synthesized
aattactttccaataaaaat

SEQ ID NO: 422858 - DNA, 20 bp, Artificial Sequence
  chemically synthesized
tcattgatgctcatttttat

SEQ ID NO: 422859 - DNA, 20 bp, Artificial Sequence
  chemically synthesized
tgatgctcatttttattgga

SEQ ID NO: 422860 - DNA, 20 bp, Artificial Sequence
  chemically synthesized
ttattggaaagtaatttttc

SEQ ID NO: 422861 - DNA, 20 bp, Artificial Sequence
  chemically synthesized
cactcaattatcaggaaatc

SEQ ID NO: 422862 - DNA, 20 bp, Artificial Sequence
  chemically synthesized
ttctagatttcctgataatt

SEQ ID NO: 422863 - DNA, 20 bp, Artificial Sequence
  chemically synthesized
gaagttatcactcaattatc

SEQ ID NO: 422864 - DNA, 20 bp, Artificial Sequence
  chemically synthesized
tgaagttatcactcaattat

SEQ ID NO: 422865 - DNA, 20 bp, Artificial Sequence
  chemically synthesized
tgataattgagtgataactt

SEQ ID NO: 422866 - DNA, 20 bp, Artificial Sequence
  chemically synthesized
aaagtgactaaggagtgctg

SEQ ID NO: 422867 - DNA, 20 bp, Artificial Sequence
  chemically synthesized
gtgataacttcagcactcct

SEQ ID NO: 422868 - DNA, 20 bp, Artificial Sequence
  chemically synthesized
cataatgaaaagtgactaag

SEQ ID NO: 422869 - DNA, 20 bp, Artificial Sequence
  chemically synthesized
tgcataatgaaaagtgacta

SEQ ID NO: 422870 - DNA, 20 bp, Artificial Sequence
  chemically synthesized
ctgcataatgaaaagtgact

SEQ ID NO: 422871 - DNA, 20 bp, Artificial Sequence
  chemically synthesized
gattttgtctgcataatgaa

SEQ ID NO: 422872 - DNA, 20 bp, Artificial Sequence
  chemically synthesized
cttagtcacttttcattatg

SEQ ID NO: 422873 - DNA, 20 bp, Artificial Sequence
  chemically synthesized
tttttttgaaagttaagagt

SEQ ID NO: 422874 - DNA, 20 bp, Artificial Sequence
  chemically synthesized
gatatttttttgaaagttaa

SEQ ID NO: 422875 - DNA, 20 bp, Artificial Sequence
  chemically synthesized
aagatatttttttgaaagtt

SEQ ID NO: 422876 - DNA, 20 bp, Artificial Sequence
  chemically synthesized
atggtaagatatttttttga

SEQ ID NO: 422877 - DNA, 20 bp, Artificial Sequence
  chemically synthesized
atttgaaaatacattatggt

SEQ ID NO: 422878 - DNA, 20 bp, Artificial Sequence
  chemically synthesized
tgttatttgaaaatacatta

SEQ ID NO: 422879 - DNA, 20 bp, Artificial Sequence
  chemically synthesized
aatgtattttcaaataacat

SEQ ID NO: 422880 - DNA, 20 bp, Artificial Sequence
  chemically synthesized
ataacatgagtttaattaaa

SEQ ID NO: 422881 - DNA, 20 bp, Artificial Sequence
  chemically synthesized
aattaaaaagaactttccca

SEQ ID NO: 422882 - DNA, 20 bp, Artificial Sequence
  chemically synthesized
attaaaaagaactttcccac

SEQ ID NO: 422883 - DNA, 20 bp, Artificial Sequence
  chemically synthesized
ttaaacatgaacctgtggga

SEQ ID NO: 422884 - DNA, 20 bp, Artificial Sequence
  chemically synthesized
aagattaaacatgaacctgt

SEQ ID NO: 422885 - DNA, 20 bp, Artificial Sequence
  chemically synthesized
caagattaaacatgaacctg

SEQ ID NO: 422886 - DNA, 20 bp, Artificial Sequence
  chemically synthesized
cacaggttcatgtttaatct

SEQ ID NO: 422887 - DNA, 20 bp, Artificial Sequence
  chemically synthesized
ttcatgtttaatcttggttt

SEQ ID NO: 422888 - DNA, 20 bp, Artificial Sequence
  chemically synthesized
ctatattcaagactcaaacc

SEQ ID NO: 422889 - DNA, 20 bp, Artificial Sequence
  chemically synthesized
cttggtttgagtcttgaata

SEQ ID NO: 422890 - DNA, 20 bp, Artificial Sequence
  chemically synthesized
tggtttgagtcttgaatata

SEQ ID NO: 422891 - DNA, 20 bp, Artificial Sequence
  chemically synthesized
cttcgcttcactctatattc

SEQ ID NO: 422892 - DNA, 20 bp, Artificial Sequence
  chemically synthesized
tgagtcttgaatatagagtg

SEQ ID NO: 422893 - DNA, 20 bp, Artificial Sequence
  chemically synthesized
cttgaatatagagtgaagcg

SEQ ID NO: 422894 - DNA, 20 bp, Artificial Sequence
  chemically synthesized
aaatttgtccaaagcagaaa

SEQ ID NO: 422895 - DNA, 20 bp, Artificial Sequence
  chemically synthesized
aagtacaactttttctgctt

SEQ ID NO: 422896 - DNA, 20 bp, Artificial Sequence
  chemically synthesized
agctctaaatttgtccaaag

SEQ ID NO: 422897 - DNA, 20 bp, Artificial Sequence
  chemically synthesized
agcagctctaaatttgtcca

SEQ ID NO: 422898 - DNA, 20 bp, Artificial Sequence
  chemically synthesized
ttttctgctttggacaaatt

SEQ ID NO: 422899 - DNA, 20 bp, Artificial Sequence
  chemically synthesized
ttctgctttggacaaattta

SEQ ID NO: 422900 - DNA, 20 bp, Artificial Sequence
  chemically synthesized
gacaaatttagagctgcttg

SEQ ID NO: 422901 - DNA, 20 bp, Artificial Sequence
  chemically synthesized
caaatttagagctgcttgaa

SEQ ID NO: 422902 - DNA, 20 bp, Artificial Sequence
  chemically synthesized
cttgtttttatctcttcaag

SEQ ID NO: 422903 - DNA, 20 bp, Artificial Sequence
  chemically synthesized
ccgcttgtttttatctcttc

SEQ ID NO: 422904 - DNA, 20 bp, Artificial Sequence
  chemically synthesized
ctgcttgaagagataaaaac

SEQ ID NO: 422905 - DNA, 20 bp, Artificial Sequence
  chemically synthesized
cttgaagagataaaaacaag

SEQ ID NO: 422906 - DNA, 20 bp, Artificial Sequence
  chemically synthesized
ttgaagagataaaaacaagc

SEQ ID NO: 422907 - DNA, 20 bp, Artificial Sequence
  chemically synthesized
tgaagagataaaaacaagcg

SEQ ID NO: 422908 - DNA, 20 bp, Artificial Sequence
  chemically synthesized
gaagtggaaggtttagaggg

SEQ ID NO: 422909 - DNA, 20 bp, Artificial Sequence
  chemically synthesized
agaagtggaaggtttagagg

SEQ ID NO: 422910 - DNA, 20 bp, Artificial Sequence
  chemically synthesized
agagaagtggaaggtttaga

SEQ ID NO: 422911 - DNA, 20 bp, Artificial Sequence
  chemically synthesized
aagagaagtggaaggtttag

SEQ ID NO: 422912 - DNA, 20 bp, Artificial Sequence
  chemically synthesized
aaagagaagtggaaggttta

SEQ ID NO: 422913 - DNA, 20 bp, Artificial Sequence
  chemically synthesized
agaaagagaagtggaaggtt

SEQ ID NO: 422914 - DNA, 20 bp, Artificial Sequence
  chemically synthesized
gggagagaaagagaagtgga

SEQ ID NO: 422915 - DNA, 20 bp, Artificial Sequence
  chemically synthesized
agggagagaaagagaagtgg

SEQ ID NO: 422916 - DNA, 20 bp, Artificial Sequence
  chemically synthesized
gagagggagagaaagagaag

SEQ ID NO: 422917 - DNA, 20 bp, Artificial Sequence
  chemically synthesized
tgagagagggagagaaagag

SEQ ID NO: 422918 - DNA, 20 bp, Artificial Sequence
  chemically synthesized
agttgagagagggagagaaa

SEQ ID NO: 422919 - DNA, 20 bp, Artificial Sequence
  chemically synthesized
acagttgagagagggagaga

SEQ ID NO: 422920 - DNA, 20 bp, Artificial Sequence
  chemically synthesized
gaacacagttgagagaggga

SEQ ID NO: 422921 - DNA, 20 bp, Artificial Sequence
  chemically synthesized
cggaacacagttgagagagg

SEQ ID NO: 422922 - DNA, 20 bp, Artificial Sequence
  chemically synthesized
ttcggaacacagttgagaga

SEQ ID NO: 422923 - DNA, 20 bp, Artificial Sequence
  chemically synthesized
attcggaacacagttgagag

SEQ ID NO: 422924 - DNA, 20 bp, Artificial Sequence
  chemically synthesized
cattcggaacacagttgaga

SEQ ID NO: 422925 - DNA, 20 bp, Artificial Sequence
  chemically synthesized
agcattcggaacacagttga

SEQ ID NO: 422926 - DNA, 20 bp, Artificial Sequence
  chemically synthesized
aaagcattcggaacacagtt

SEQ ID NO: 422927 - DNA, 20 bp, Artificial Sequence
  chemically synthesized
tagagaaagcattcggaaca

SEQ ID NO: 422928 - DNA, 20 bp, Artificial Sequence
  chemically synthesized
tgtgttttagagaaagcatt

SEQ ID NO: 422929 - DNA, 20 bp, Artificial Sequence
  chemically synthesized
cagcctctgtgttttagaga

SEQ ID NO: 422930 - DNA, 20 bp, Artificial Sequence
  chemically synthesized
cgaatgctttctctaaaaca

SEQ ID NO: 422931 - DNA, 20 bp, Artificial Sequence
  chemically synthesized
aactcagcctctgtgtttta

SEQ ID NO: 422932 - DNA, 20 bp, Artificial Sequence
  chemically synthesized
aatgctttctctaaaacaca

SEQ ID NO: 422933 - DNA, 20 bp, Artificial Sequence
  chemically synthesized
aaaactcagcctctgtgttt

SEQ ID NO: 422934 - DNA, 20 bp, Artificial Sequence
  chemically synthesized
atgctttctctaaaacacag

SEQ ID NO: 422935 - DNA, 20 bp, Artificial Sequence
  chemically synthesized
ttctctaaaacacagaggct

SEQ ID NO: 422936 - DNA, 20 bp, Artificial Sequence
  chemically synthesized
ttttccagccagtcaaaact

SEQ ID NO: 422937 - DNA, 20 bp, Artificial Sequence
  chemically synthesized
cacagaggctgagttttgac

SEQ ID NO: 422938 - DNA, 20 bp, Artificial Sequence
  chemically synthesized
gaggctgagttttgactggc

SEQ ID NO: 422939 - DNA, 20 bp, Artificial Sequence
  chemically synthesized
taaactgatgtttttccagc

SEQ ID NO: 422940 - DNA, 20 bp, Artificial Sequence
  chemically synthesized
gaaataaactgatgtttttc

SEQ ID NO: 422941 - DNA, 20 bp, Artificial Sequence
  chemically synthesized
ttgactggctggaaaaacat

SEQ ID NO: 422942 - DNA, 20 bp, Artificial Sequence
  chemically synthesized
aaatggaagctggagaaagg

SEQ ID NO: 422943 - DNA, 20 bp, Artificial Sequence
  chemically synthesized
tttcatgttcttcctttctc

SEQ ID NO: 422944 - DNA, 20 bp, Artificial Sequence
  chemically synthesized
ttgaaatggaagctggagaa

SEQ ID NO: 422945 - DNA, 20 bp, Artificial Sequence
  chemically synthesized
attgaaatggaagctggaga

SEQ ID NO: 422946 - DNA, 20 bp, Artificial Sequence
  chemically synthesized
tggaattgaaatggaagctg

SEQ ID NO: 422947 - DNA, 20 bp, Artificial Sequence
  chemically synthesized
cttggaattgaaatggaagc

SEQ ID NO: 422948 - DNA, 20 bp, Artificial Sequence
  chemically synthesized
cacacttggaattgaaatgg

SEQ ID NO: 422949 - DNA, 20 bp, Artificial Sequence
  chemically synthesized
ggccacacttggaattgaaa

SEQ ID NO: 422950 - DNA, 20 bp, Artificial Sequence
  chemically synthesized
ccagcttccatttcaattcc

SEQ ID NO: 422951 - DNA, 20 bp, Artificial Sequence
  chemically synthesized
ttccatttcaattccaagtg

SEQ ID NO: 422952 - DNA, 20 bp, Artificial Sequence
  chemically synthesized
cttttcttttgggccacact

SEQ ID NO: 422953 - DNA, 20 bp, Artificial Sequence
  chemically synthesized
caattccaagtgtggcccaa

SEQ ID NO: 422954 - DNA, 20 bp, Artificial Sequence
  chemically synthesized
ccaagtgtggcccaaaagaa

SEQ ID NO: 422955 - DNA, 20 bp, Artificial Sequence
  chemically synthesized
cagttcctatcttttctttt

SEQ ID NO: 422956 - DNA, 20 bp, Artificial Sequence
  chemically synthesized
gcagttcctatcttttcttt

SEQ ID NO: 422957 - DNA, 20 bp, Artificial Sequence
  chemically synthesized
gtgtggcccaaaagaaaaga

SEQ ID NO: 422958 - DNA, 20 bp, Artificial Sequence
  chemically synthesized
tgtggcccaaaagaaaagat

SEQ ID NO: 422959 - DNA, 20 bp, Artificial Sequence
  chemically synthesized
agaaaagataggaactgcat

SEQ ID NO: 422960 - DNA, 20 bp, Artificial Sequence
  chemically synthesized
gaaaagataggaactgcata

SEQ ID NO: 422961 - DNA, 20 bp, Artificial Sequence
  chemically synthesized
ttgactgaaacatccttatg

SEQ ID NO: 422962 - DNA, 20 bp, Artificial Sequence
  chemically synthesized
ggaactgcataaggatgttt

SEQ ID NO: 422963 - DNA, 20 bp, Artificial Sequence
  chemically synthesized
tgggaccactgcggtatatg

SEQ ID NO: 422964 - DNA, 20 bp, Artificial Sequence
  chemically synthesized
atgataaactgcatataccg

SEQ ID NO: 422965 - DNA, 20 bp, Artificial Sequence
  chemically synthesized
ataaactgcatataccgcag

SEQ ID NO: 422966 - DNA, 20 bp, Artificial Sequence
  chemically synthesized
ataatcaaatgggaccactg

SEQ ID NO: 422967 - DNA, 20 bp, Artificial Sequence
  chemically synthesized
atcccgtgttataatcaaat

SEQ ID NO: 422968 - DNA, 20 bp, Artificial Sequence
  chemically synthesized
aatcccgtgttataatcaaa

SEQ ID NO: 422969 - DNA, 20 bp, Artificial Sequence
  chemically synthesized
ggtcccatttgattataaca

SEQ ID NO: 422970 - DNA, 20 bp, Artificial Sequence
  chemically synthesized
gtcccatttgattataacac

SEQ ID NO: 422971 - DNA, 20 bp, Artificial Sequence
  chemically synthesized
tatctaaccattagaaggta

SEQ ID NO: 422972 - DNA, 20 bp, Artificial Sequence
  chemically synthesized
atttttactgtaccttctaa

SEQ ID NO: 422973 - DNA, 20 bp, Artificial Sequence
  chemically synthesized
aaacatatctaaccattaga

SEQ ID NO: 422974 - DNA, 20 bp, Artificial Sequence
  chemically synthesized
aaaacatatctaaccattag

SEQ ID NO: 422975 - DNA, 20 bp, Artificial Sequence
  chemically synthesized
ttactgtaccttctaatggt

SEQ ID NO: 422976 - DNA, 20 bp, Artificial Sequence
  chemically synthesized
tctaaaacatatctaaccat

SEQ ID NO: 422977 - DNA, 20 bp, Artificial Sequence
  chemically synthesized
tctaatggttagatatgttt

SEQ ID NO: 422978 - DNA, 20 bp, Artificial Sequence
  chemically synthesized
tgtaggcaactgtagcacaa

SEQ ID NO: 422979 - DNA, 20 bp, Artificial Sequence
  chemically synthesized
aaatatttaccattgtgcta

SEQ ID NO: 422980 - DNA, 20 bp, Artificial Sequence
  chemically synthesized
ctgaatactgtaggcaactg

SEQ ID NO: 422981 - DNA, 20 bp, Artificial Sequence
  chemically synthesized
cattgtgctacagttgccta

SEQ ID NO: 422982 - DNA, 20 bp, Artificial Sequence
  chemically synthesized
gtgactgtactgaatactgt

SEQ ID NO: 422983 - DNA, 20 bp, Artificial Sequence
  chemically synthesized
ctacagttgcctacagtatt

SEQ ID NO: 422984 - DNA, 20 bp, Artificial Sequence
  chemically synthesized
tgtgactgtactgaatactg

SEQ ID NO: 422985 - DNA, 20 bp, Artificial Sequence
  chemically synthesized
gttgcctacagtattcagta

SEQ ID NO: 422986 - DNA, 20 bp, Artificial Sequence
  chemically synthesized
cagtacagtcacatgctgta

SEQ ID NO: 422987 - DNA, 20 bp, Artificial Sequence
  chemically synthesized
agtacagtcacatgctgtac

SEQ ID NO: 422988 - DNA, 20 bp, Artificial Sequence
  chemically synthesized
tgtttggctacaaacctgta

SEQ ID NO: 422989 - DNA, 20 bp, Artificial Sequence
  chemically synthesized
tcacatgctgtacaggtttg

SEQ ID NO: 422990 - DNA, 20 bp, Artificial Sequence
  chemically synthesized
tgtacaggtttgtagccaaa

SEQ ID NO: 422991 - DNA, 20 bp, Artificial Sequence
  chemically synthesized
tggtatatcctatttctgtt

SEQ ID NO: 422992 - DNA, 20 bp, Artificial Sequence
  chemically synthesized
ggtttgtagccaaacagaaa

SEQ ID NO: 422993 - DNA, 20 bp, Artificial Sequence
  chemically synthesized
gtttgtagccaaacagaaat

SEQ ID NO: 422994 - DNA, 20 bp, Artificial Sequence
  chemically synthesized
ataggatataccatacaacc

SEQ ID NO: 422995 - DNA, 20 bp, Artificial Sequence
  chemically synthesized
tagtgcagacctaggttgta

SEQ ID NO: 422996 - DNA, 20 bp, Artificial Sequence
  chemically synthesized
taggatataccatacaacct

SEQ ID NO: 422997 - DNA, 20 bp, Artificial Sequence
  chemically synthesized
gtatagcgtagtgcagacct

SEQ ID NO: 422998 - DNA, 20 bp, Artificial Sequence
  chemically synthesized
ggtatagcgtagtgcagacc

SEQ ID NO: 422999 - DNA, 20 bp, Artificial Sequence
  chemically synthesized
ctacgtggtatagcgtagtg

SEQ ID NO: 423000 - DNA, 20 bp, Artificial Sequence
  chemically synthesized
ctaacctacgtggtatagcg

SEQ ID NO: 423001 - DNA, 20 bp, Artificial Sequence
  chemically synthesized
ctgcactacgctataccacg

SEQ ID NO: 423002 - DNA, 20 bp, Artificial Sequence
  chemically synthesized
ttacactaacctacgtggta

SEQ ID NO: 423003 - DNA, 20 bp, Artificial Sequence
  chemically synthesized
tgcactacgctataccacgt

SEQ ID NO: 423004 - DNA, 20 bp, Artificial Sequence
  chemically synthesized
ctacgctataccacgtaggt

SEQ ID NO: 423005 - DNA, 20 bp, Artificial Sequence
  chemically synthesized
tgtacttacactaacctacg

SEQ ID NO: 423006 - DNA, 20 bp, Artificial Sequence
  chemically synthesized
tataccacgtaggttagtgt

SEQ ID NO: 423007 - DNA, 20 bp, Artificial Sequence
  chemically synthesized
atcgttgtgtgaatgtcaca

SEQ ID NO: 423008 - DNA, 20 bp, Artificial Sequence
  chemically synthesized
tcatcgttgtgtgaatgtca

SEQ ID NO: 423009 - DNA, 20 bp, Artificial Sequence
  chemically synthesized
acacaacgatgaaattacct

SEQ ID NO: 423010 - DNA, 20 bp, Artificial Sequence
  chemically synthesized
acgatgaaattaccttagta

SEQ ID NO: 423011 - DNA, 20 bp, Artificial Sequence
  chemically synthesized
attctgatcaatccatacta

SEQ ID NO: 423012 - DNA, 20 bp, Artificial Sequence
  chemically synthesized
cattctgatcaatccatact

SEQ ID NO: 423013 - DNA, 20 bp, Artificial Sequence
  chemically synthesized
ttaccttagtatggattgat

SEQ ID NO: 423014 - DNA, 20 bp, Artificial Sequence
  chemically synthesized
gattgatcagaatgtatccc

SEQ ID NO: 423015 - DNA, 20 bp, Artificial Sequence
  chemically synthesized
acagttatgtgttaacacca

SEQ ID NO: 423016 - DNA, 20 bp, Artificial Sequence
  chemically synthesized
tacagttatgtgttaacacc

SEQ ID NO: 423017 - DNA, 20 bp, Artificial Sequence
  chemically synthesized
atacagttatgtgttaacac

SEQ ID NO: 423018 - DNA, 20 bp, Artificial Sequence
  chemically synthesized
aaacacacacaggatatata

SEQ ID NO: 423019 - DNA, 20 bp, Artificial Sequence
  chemically synthesized
agtgacacacaaacacacac

SEQ ID NO: 423020 - DNA, 20 bp, Artificial Sequence
  chemically synthesized
cagtgacacacaaacacaca

SEQ ID NO: 423021 - DNA, 20 bp, Artificial Sequence
  chemically synthesized
tgtgtgtttgtgtgtcactg

SEQ ID NO: 423022 - DNA, 20 bp, Artificial Sequence
  chemically synthesized
tgtgtttgtgtgtcactgaa

SEQ ID NO: 423023 - DNA, 20 bp, Artificial Sequence
  chemically synthesized
gtgaaggaatcatatctctt

SEQ ID NO: 423024 - DNA, 20 bp, Artificial Sequence
  chemically synthesized
agatatgattccttcaccat

SEQ ID NO: 423025 - DNA, 20 bp, Artificial Sequence
  chemically synthesized
tttctgattcctcatggtga

SEQ ID NO: 423026 - DNA, 20 bp, Artificial Sequence
  chemically synthesized
gatatgattccttcaccatg

SEQ ID NO: 423027 - DNA, 20 bp, Artificial Sequence
  chemically synthesized
ttttctgattcctcatggtg

SEQ ID NO: 423028 - DNA, 20 bp, Artificial Sequence
  chemically synthesized
ttcagttttctgattcctca

SEQ ID NO: 423029 - DNA, 20 bp, Artificial Sequence
  chemically synthesized
attccttcaccatgaggaat

SEQ ID NO: 423030 - DNA, 20 bp, Artificial Sequence
  chemically synthesized
tgaggaatcagaaaactgaa

SEQ ID NO: 423031 - DNA, 20 bp, Artificial Sequence
  chemically synthesized
gaggaatcagaaaactgaaa

SEQ ID NO: 423032 - DNA, 20 bp, Artificial Sequence
  chemically synthesized
caataatttgtttacctttt

SEQ ID NO: 423033 - DNA, 20 bp, Artificial Sequence
  chemically synthesized
aacaaattattgtatcctga

SEQ ID NO: 423034 - DNA, 20 bp, Artificial Sequence
  chemically synthesized
aaaactcatttgagactttc

SEQ ID NO: 423035 - DNA, 20 bp, Artificial Sequence
  chemically synthesized
aaaaactcatttgagacttt

SEQ ID NO: 423036 - DNA, 20 bp, Artificial Sequence
  chemically synthesized
gtatcctgaaagtctcaaat

SEQ ID NO: 423037 - DNA, 20 bp, Artificial Sequence
  chemically synthesized
agtagaacaaaaactcattt

SEQ ID NO: 423038 - DNA, 20 bp, Artificial Sequence
  chemically synthesized
caaaaaaaaacaaaagaaag

SEQ ID NO: 423039 - DNA, 20 bp, Artificial Sequence
  chemically synthesized
tctcaaaaaaaaacaaaaga

SEQ ID NO: 423040 - DNA, 20 bp, Artificial Sequence
  chemically synthesized
tctgtctcaaaaaaaaacaa

SEQ ID NO: 423041 - DNA, 20 bp, Artificial Sequence
  chemically synthesized
actttcttttgttttttttt

SEQ ID NO: 423042 - DNA, 20 bp, Artificial Sequence
  chemically synthesized
tcttttgtttttttttgaga

SEQ ID NO: 423043 - DNA, 20 bp, Artificial Sequence
  chemically synthesized
tccagcctgggcgacagagg

SEQ ID NO: 423044 - DNA, 20 bp, Artificial Sequence
  chemically synthesized
cactccagcctgggcgacag

SEQ ID NO: 423045 - DNA, 20 bp, Artificial Sequence
  chemically synthesized
cagaatctacctctgtcgcc

SEQ ID NO: 423046 - DNA, 20 bp, Artificial Sequence
  chemically synthesized
gcactccagcctgggcgaca

SEQ ID NO: 423047 - DNA, 20 bp, Artificial Sequence
  chemically synthesized
agaatctacctctgtcgccc

SEQ ID NO: 423048 - DNA, 20 bp, Artificial Sequence
  chemically synthesized
ctgcactccagcctgggcga

SEQ ID NO: 423049 - DNA, 20 bp, Artificial Sequence
  chemically synthesized
tctacctctgtcgcccaggc

SEQ ID NO: 423050 - DNA, 20 bp, Artificial Sequence
  chemically synthesized
tacctctgtcgcccaggctg

SEQ ID NO: 423051 - DNA, 20 bp, Artificial Sequence
  chemically synthesized
gcacccctgcactccagcct

SEQ ID NO: 423052 - DNA, 20 bp, Artificial Sequence
  chemically synthesized
cgcacccctgcactccagcc

SEQ ID NO: 423053 - DNA, 20 bp, Artificial Sequence
  chemically synthesized
ctgtcgcccaggctggagtg

SEQ ID NO: 423054 - DNA, 20 bp, Artificial Sequence
  chemically synthesized
tgtcgcccaggctggagtgc

SEQ ID NO: 423055 - DNA, 20 bp, Artificial Sequence
  chemically synthesized
gtcgcccaggctggagtgca

SEQ ID NO: 423056 - DNA, 20 bp, Artificial Sequence
  chemically synthesized
gagatcgcacccctgcactc

SEQ ID NO: 423057 - DNA, 20 bp, Artificial Sequence
  chemically synthesized
tcgcccaggctggagtgcag

SEQ ID NO: 423058 - DNA, 20 bp, Artificial Sequence
  chemically synthesized
ggagtgcaggggtgcgatct

SEQ ID NO: 423059 - DNA, 20 bp, Artificial Sequence
  chemically synthesized
ggcggaggttgcattgaacc

SEQ ID NO: 423060 - DNA, 20 bp, Artificial Sequence
  chemically synthesized
tgcttgaacccgggaggcgg

SEQ ID NO: 423061 - DNA, 20 bp, Artificial Sequence
  chemically synthesized
tcaatgcaacctccgcctcc

SEQ ID NO: 423062 - DNA, 20 bp, Artificial Sequence
  chemically synthesized
ttgcttgaacccgggaggcg

SEQ ID NO: 423063 - DNA, 20 bp, Artificial Sequence
  chemically synthesized
caatgcaacctccgcctccc

SEQ ID NO: 423064 - DNA, 20 bp, Artificial Sequence
  chemically synthesized
aattgcttgaacccgggagg

SEQ ID NO: 423065 - DNA, 20 bp, Artificial Sequence
  chemically synthesized
gagaattgcttgaacccggg

SEQ ID NO: 423066 - DNA, 20 bp, Artificial Sequence
  chemically synthesized
ggagaattgcttgaacccgg

SEQ ID NO: 423067 - DNA, 20 bp, Artificial Sequence
  chemically synthesized
aacctccgcctcccgggttc

SEQ ID NO: 423068 - DNA, 20 bp, Artificial Sequence
  chemically synthesized
caggagaattgcttgaaccc

SEQ ID NO: 423069 - DNA, 20 bp, Artificial Sequence
  chemically synthesized
gcaggagaattgcttgaacc

SEQ ID NO: 423070 - DNA, 20 bp, Artificial Sequence
  chemically synthesized
ttcaagcaattctcctgcct

SEQ ID NO: 423071 - DNA, 20 bp, Artificial Sequence
  chemically synthesized
tactcgggaggctgaggcag

SEQ ID NO: 423072 - DNA, 20 bp, Artificial Sequence
  chemically synthesized
gctactcgggaggctgaggc

SEQ ID NO: 423073 - DNA, 20 bp, Artificial Sequence
  chemically synthesized
agctactcgggaggctgagg

SEQ ID NO: 423074 - DNA, 20 bp, Artificial Sequence
  chemically synthesized
cccagctactcgggaggctg

SEQ ID NO: 423075 - DNA, 20 bp, Artificial Sequence
  chemically synthesized
tcccagctactcgggaggct

SEQ ID NO: 423076 - DNA, 20 bp, Artificial Sequence
  chemically synthesized
ttctcctgcctcagcctccc

SEQ ID NO: 423077 - DNA, 20 bp, Artificial Sequence
  chemically synthesized
tcctgcctcagcctcccgag

SEQ ID NO: 423078 - DNA, 20 bp, Artificial Sequence
  chemically synthesized
tgaaatcccagctactcggg

SEQ ID NO: 423079 - DNA, 20 bp, Artificial Sequence
  chemically synthesized
ctgaaatcccagctactcgg

SEQ ID NO: 423080 - DNA, 20 bp, Artificial Sequence
  chemically synthesized
gcctcagcctcccgagtagc

SEQ ID NO: 423081 - DNA, 20 bp, Artificial Sequence
  chemically synthesized
tcctgaaatcccagctactc

SEQ ID NO: 423082 - DNA, 20 bp, Artificial Sequence
  chemically synthesized
cctcagcctcccgagtagct

SEQ ID NO: 423083 - DNA, 20 bp, Artificial Sequence
  chemically synthesized
ttcctgaaatcccagctact

SEQ ID NO: 423084 - DNA, 20 bp, Artificial Sequence
  chemically synthesized
ctcccgagtagctgggattt

SEQ ID NO: 423085 - DNA, 20 bp, Artificial Sequence
  chemically synthesized
tcccgagtagctgggatttc

SEQ ID NO: 423086 - DNA, 20 bp, Artificial Sequence
  chemically synthesized
gtggcaggttcctgaaatcc

SEQ ID NO: 423087 - DNA, 20 bp, Artificial Sequence
  chemically synthesized
attagccaggttgtggtggc

SEQ ID NO: 423088 - DNA, 20 bp, Artificial Sequence
  chemically synthesized
aattagccaggttgtggtgg

SEQ ID NO: 423089 - DNA, 20 bp, Artificial Sequence
  chemically synthesized
aaaaattagccaggttgtgg

SEQ ID NO: 423090 - DNA, 20 bp, Artificial Sequence
  chemically synthesized
aggaacctgccaccacaacc

SEQ ID NO: 423091 - DNA, 20 bp, Artificial Sequence
  chemically synthesized
tacaaaaattagccaggttg

SEQ ID NO: 423092 - DNA, 20 bp, Artificial Sequence
  chemically synthesized
taaaaatacaaaaattagcc

SEQ ID NO: 423093 - DNA, 20 bp, Artificial Sequence
  chemically synthesized
ctaaaaatacaaaaattagc

SEQ ID NO: 423094 - DNA, 20 bp, Artificial Sequence
  chemically synthesized
tctcctaaaaatacaaaaat

SEQ ID NO: 423095 - DNA, 20 bp, Artificial Sequence
  chemically synthesized
ctggctaatttttgtatttt

SEQ ID NO: 423096 - DNA, 20 bp, Artificial Sequence
  chemically synthesized
tggctaatttttgtattttt

SEQ ID NO: 423097 - DNA, 20 bp, Artificial Sequence
  chemically synthesized
gctaatttttgtatttttag

SEQ ID NO: 423098 - DNA, 20 bp, Artificial Sequence
  chemically synthesized
taatttttgtatttttagga

SEQ ID NO: 423099 - DNA, 20 bp, Artificial Sequence
  chemically synthesized
ttttgtatttttaggagaga

SEQ ID NO: 423100 - DNA, 20 bp, Artificial Sequence
  chemically synthesized
tttgtatttttaggagagac

SEQ ID NO: 423101 - DNA, 20 bp, Artificial Sequence
  chemically synthesized
ttgtatttttaggagagaca

SEQ ID NO: 423102 - DNA, 20 bp, Artificial Sequence
  chemically synthesized
gagacagggtttcgccatgt

SEQ ID NO: 423103 - DNA, 20 bp, Artificial Sequence
  chemically synthesized
cagggtttcgccatgttggc

SEQ ID NO: 423104 - DNA, 20 bp, Artificial Sequence
  chemically synthesized
tgagaccagcctggccaaca

SEQ ID NO: 423105 - DNA, 20 bp, Artificial Sequence
  chemically synthesized
agggtttcgccatgttggcc

SEQ ID NO: 423106 - DNA, 20 bp, Artificial Sequence
  chemically synthesized
tttcgccatgttggccaggc

SEQ ID NO: 423107 - DNA, 20 bp, Artificial Sequence
  chemically synthesized
tcaggagtttgagaccagcc

SEQ ID NO: 423108 - DNA, 20 bp, Artificial Sequence
  chemically synthesized
tgaggtcaggagtttgagac

SEQ ID NO: 423109 - DNA, 20 bp, Artificial Sequence
  chemically synthesized
tcacttgaggtcaggagttt

SEQ ID NO: 423110 - DNA, 20 bp, Artificial Sequence
  chemically synthesized
tacagatcacttgaggtcag

SEQ ID NO: 423111 - DNA, 20 bp, Artificial Sequence
  chemically synthesized
ggtctcaaactcctgacctc

SEQ ID NO: 423112 - DNA, 20 bp, Artificial Sequence
  chemically synthesized
tgtacagatcacttgaggtc

SEQ ID NO: 423113 - DNA, 20 bp, Artificial Sequence
  chemically synthesized
gtgtacagatcacttgaggt

SEQ ID NO: 423114 - DNA, 20 bp, Artificial Sequence
  chemically synthesized
tgaggtgtacagatcacttg

SEQ ID NO: 423115 - DNA, 20 bp, Artificial Sequence
  chemically synthesized
ctgaggtgtacagatcactt

SEQ ID NO: 423116 - DNA, 20 bp, Artificial Sequence
  chemically synthesized
ctcaagtgatctgtacacct

SEQ ID NO: 423117 - DNA, 20 bp, Artificial Sequence
  chemically synthesized
atttgggaggctgaggtgta

SEQ ID NO: 423118 - DNA, 20 bp, Artificial Sequence
  chemically synthesized
cccagcaatttgggaggctg

SEQ ID NO: 423119 - DNA, 20 bp, Artificial Sequence
  chemically synthesized
tcccagcaatttgggaggct

SEQ ID NO: 423120 - DNA, 20 bp, Artificial Sequence
  chemically synthesized
tgtaatcccagcaatttggg

SEQ ID NO: 423121 - DNA, 20 bp, Artificial Sequence
  chemically synthesized
ctgtaatcccagcaatttgg

SEQ ID NO: 423122 - DNA, 20 bp, Artificial Sequence
  chemically synthesized
acctcagcctcccaaattgc

SEQ ID NO: 423123 - DNA, 20 bp, Artificial Sequence
  chemically synthesized
acctgtaatcccagcaattt

SEQ ID NO: 423124 - DNA, 20 bp, Artificial Sequence
  chemically synthesized
cctcagcctcccaaattgct

SEQ ID NO: 423125 - DNA, 20 bp, Artificial Sequence
  chemically synthesized
tacctgtaatcccagcaatt

SEQ ID NO: 423126 - DNA, 20 bp, Artificial Sequence
  chemically synthesized
ctcccaaattgctgggatta

SEQ ID NO: 423127 - DNA, 20 bp, Artificial Sequence
  chemically synthesized
tcccaaattgctgggattac

SEQ ID NO: 423128 - DNA, 20 bp, Artificial Sequence
  chemically synthesized
gtggctcatacctgtaatcc

SEQ ID NO: 423129 - DNA, 20 bp, Artificial Sequence
  chemically synthesized
attgctgggattacaggtat

SEQ ID NO: 423130 - DNA, 20 bp, Artificial Sequence
  chemically synthesized
caggtatgagccaccacgcc

SEQ ID NO: 423131 - DNA, 20 bp, Artificial Sequence
  chemically synthesized
ctcatttgaaccgggcgtgg

SEQ ID NO: 423132 - DNA, 20 bp, Artificial Sequence
  chemically synthesized
aaactcatttgaaccgggcg

SEQ ID NO: 423133 - DNA, 20 bp, Artificial Sequence
  chemically synthesized
aaaaaaaactcatttgaacc

SEQ ID NO: 423134 - DNA, 20 bp, Artificial Sequence
  chemically synthesized
aaaaaaaaactcatttgaac

SEQ ID NO: 423135 - DNA, 20 bp, Artificial Sequence
  chemically synthesized
ccaccacgcccggttcaaat

SEQ ID NO: 423136 - DNA, 20 bp, Artificial Sequence
  chemically synthesized
gagttttttttttttttttt

SEQ ID NO: 423137 - DNA, 20 bp, Artificial Sequence
  chemically synthesized
gttttcgtttgttttaatat

SEQ ID NO: 423138 - DNA, 20 bp, Artificial Sequence
  chemically synthesized
atattaaaacaaacgaaaac

SEQ ID NO: 423139 - DNA, 20 bp, Artificial Sequence
  chemically synthesized
tgtgagaacaaaaggcattc

SEQ ID NO: 423140 - DNA, 20 bp, Artificial Sequence
  chemically synthesized
gaattgaatgtgagaacaaa

SEQ ID NO: 423141 - DNA, 20 bp, Artificial Sequence
  chemically synthesized
tgaattgaatgtgagaacaa

SEQ ID NO: 423142 - DNA, 20 bp, Artificial Sequence
  chemically synthesized
ttagattatgaattgaatgt

SEQ ID NO: 423143 - DNA, 20 bp, Artificial Sequence
  chemically synthesized
acattcaattcataatctaa

SEQ ID NO: 423144 - DNA, 20 bp, Artificial Sequence
  chemically synthesized
cattttattctgatagctat

SEQ ID NO: 423145 - DNA, 20 bp, Artificial Sequence
  chemically synthesized
attcataatctaatagctat

SEQ ID NO: 423146 - DNA, 20 bp, Artificial Sequence
  chemically synthesized
aatatgacattttattctga

SEQ ID NO: 423147 - DNA, 20 bp, Artificial Sequence
  chemically synthesized
tgtcatatttattattcatt

SEQ ID NO: 423148 - DNA, 20 bp, Artificial Sequence
  chemically synthesized
catatttattattcatttgg

SEQ ID NO: 423149 - DNA, 20 bp, Artificial Sequence
  chemically synthesized
ttcatttggaagaaaacaaa

SEQ ID NO: 423150 - DNA, 20 bp, Artificial Sequence
  chemically synthesized
atttggaagaaaacaaacag

SEQ ID NO: 423151 - DNA, 20 bp, Artificial Sequence
  chemically synthesized
agcagtaaaaattgaaataa

SEQ ID NO: 423152 - DNA, 20 bp, Artificial Sequence
  chemically synthesized
gcagtaaaaattgaaataaa

SEQ ID NO: 423153 - DNA, 20 bp, Artificial Sequence
  chemically synthesized
taaaaattgaaataaaaggc

SEQ ID NO: 423154 - DNA, 20 bp, Artificial Sequence
  chemically synthesized
aaaaattgaaataaaaggct

SEQ ID NO: 423155 - DNA, 20 bp, Artificial Sequence
  chemically synthesized
taggagtgactcacaacgcc

SEQ ID NO: 423156 - DNA, 20 bp, Artificial Sequence
  chemically synthesized
aataaaaggctgggcgttgt

SEQ ID NO: 423157 - DNA, 20 bp, Artificial Sequence
  chemically synthesized
ccaaagtgttgggattatag

SEQ ID NO: 423158 - DNA, 20 bp, Artificial Sequence
  chemically synthesized
tcccaaagtgttgggattat

SEQ ID NO: 423159 - DNA, 20 bp, Artificial Sequence
  chemically synthesized
ctcccaaagtgttgggatta

SEQ ID NO: 423160 - DNA, 20 bp, Artificial Sequence
  chemically synthesized
ctcctataatcccaacactt

SEQ ID NO: 423161 - DNA, 20 bp, Artificial Sequence
  chemically synthesized
cctcggcctcccaaagtgtt

SEQ ID NO: 423162 - DNA, 20 bp, Artificial Sequence
  chemically synthesized
tcctataatcccaacacttt

SEQ ID NO: 423163 - DNA, 20 bp, Artificial Sequence
  chemically synthesized
acctcggcctcccaaagtgt

SEQ ID NO: 423164 - DNA, 20 bp, Artificial Sequence
  chemically synthesized
ctataatcccaacactttgg

SEQ ID NO: 423165 - DNA, 20 bp, Artificial Sequence
  chemically synthesized
tataatcccaacactttggg

SEQ ID NO: 423166 - DNA, 20 bp, Artificial Sequence
  chemically synthesized
ccgcccacctcggcctccca

SEQ ID NO: 423167 - DNA, 20 bp, Artificial Sequence
  chemically synthesized
tcccaacactttgggaggcc

SEQ ID NO: 423168 - DNA, 20 bp, Artificial Sequence
  chemically synthesized
cccaacactttgggaggccg

SEQ ID NO: 423169 - DNA, 20 bp, Artificial Sequence
  chemically synthesized
aacactttgggaggccgagg

SEQ ID NO: 423170 - DNA, 20 bp, Artificial Sequence
  chemically synthesized
acactttgggaggccgaggt

SEQ ID NO: 423171 - DNA, 20 bp, Artificial Sequence
  chemically synthesized
ctttgggaggccgaggtggg

SEQ ID NO: 423172 - DNA, 20 bp, Artificial Sequence
  chemically synthesized
ctcaagtgatccgcccacct

SEQ ID NO: 423173 - DNA, 20 bp, Artificial Sequence
  chemically synthesized
ccgaggtgggcggatcactt

SEQ ID NO: 423174 - DNA, 20 bp, Artificial Sequence
  chemically synthesized
cgaggtgggcggatcacttg

SEQ ID NO: 423175 - DNA, 20 bp, Artificial Sequence
  chemically synthesized
gtgggcggatcacttgagga

SEQ ID NO: 423176 - DNA, 20 bp, Artificial Sequence
  chemically synthesized
tgggcggatcacttgaggac

SEQ ID NO: 423177 - DNA, 20 bp, Artificial Sequence
  chemically synthesized
ggtctctaactcctgtcctc

SEQ ID NO: 423178 - DNA, 20 bp, Artificial Sequence
  chemically synthesized
ggcggatcacttgaggacag

SEQ ID NO: 423179 - DNA, 20 bp, Artificial Sequence
  chemically synthesized
gatcacttgaggacaggagt

SEQ ID NO: 423180 - DNA, 20 bp, Artificial Sequence
  chemically synthesized
tcacttgaggacaggagtta

SEQ ID NO: 423181 - DNA, 20 bp, Artificial Sequence
  chemically synthesized
tgaggacaggagttagagac

SEQ ID NO: 423182 - DNA, 20 bp, Artificial Sequence
  chemically synthesized
acaggagttagagaccagct

SEQ ID NO: 423183 - DNA, 20 bp, Artificial Sequence
  chemically synthesized
tttcaccatgttggccaagc

SEQ ID NO: 423184 - DNA, 20 bp, Artificial Sequence
  chemically synthesized
agggtttcaccatgttggcc

SEQ ID NO: 423185 - DNA, 20 bp, Artificial Sequence
  chemically synthesized
agagaccagcttggccaaca

SEQ ID NO: 423186 - DNA, 20 bp, Artificial Sequence
  chemically synthesized
gagacagggtttcaccatgt

SEQ ID NO: 423187 - DNA, 20 bp, Artificial Sequence
  chemically synthesized
ttgtatttttattagagaca

SEQ ID NO: 423188 - DNA, 20 bp, Artificial Sequence
  chemically synthesized
tttgtatttttattagagac

SEQ ID NO: 423189 - DNA, 20 bp, Artificial Sequence
  chemically synthesized
ttttgtatttttattagaga

SEQ ID NO: 423190 - DNA, 20 bp, Artificial Sequence
  chemically synthesized
atttttttgtatttttatta

SEQ ID NO: 423191 - DNA, 20 bp, Artificial Sequence
  chemically synthesized
taatttttttgtatttttat

SEQ ID NO: 423192 - DNA, 20 bp, Artificial Sequence
  chemically synthesized
taataaaaatacaaaaaaat

SEQ ID NO: 423193 - DNA, 20 bp, Artificial Sequence
  chemically synthesized
aaaaatacaaaaaaattagc

SEQ ID NO: 423194 - DNA, 20 bp, Artificial Sequence
  chemically synthesized
aaaatacaaaaaaattagct

SEQ ID NO: 423195 - DNA, 20 bp, Artificial Sequence
  chemically synthesized
acaaaaaaattagctgggcg

SEQ ID NO: 423196 - DNA, 20 bp, Artificial Sequence
  chemically synthesized
aaaaaattagctgggcgtag

SEQ ID NO: 423197 - DNA, 20 bp, Artificial Sequence
  chemically synthesized
taagcattcgccactacgcc

SEQ ID NO: 423198 - DNA, 20 bp, Artificial Sequence
  chemically synthesized
agtggcgaatgcttatatcc

SEQ ID NO: 423199 - DNA, 20 bp, Artificial Sequence
  chemically synthesized
ctcccaagtaactgggatat

SEQ ID NO: 423200 - DNA, 20 bp, Artificial Sequence
  chemically synthesized
atgcttatatcccagttact

SEQ ID NO: 423201 - DNA, 20 bp, Artificial Sequence
  chemically synthesized
cctcagcctcccaagtaact

SEQ ID NO: 423202 - DNA, 20 bp, Artificial Sequence
  chemically synthesized
tgcttatatcccagttactt

SEQ ID NO: 423203 - DNA, 20 bp, Artificial Sequence
  chemically synthesized
gcctcagcctcccaagtaac

SEQ ID NO: 423204 - DNA, 20 bp, Artificial Sequence
  chemically synthesized
cttatatcccagttacttgg

SEQ ID NO: 423205 - DNA, 20 bp, Artificial Sequence
  chemically synthesized
ttatatcccagttacttggg

SEQ ID NO: 423206 - DNA, 20 bp, Artificial Sequence
  chemically synthesized
ttcttctgcctcagcctccc

SEQ ID NO: 423207 - DNA, 20 bp, Artificial Sequence
  chemically synthesized
tcccagttacttgggaggct

SEQ ID NO: 423208 - DNA, 20 bp, Artificial Sequence
  chemically synthesized
cccagttacttgggaggctg

SEQ ID NO: 423209 - DNA, 20 bp, Artificial Sequence
  chemically synthesized
agttacttgggaggctgagg

SEQ ID NO: 423210 - DNA, 20 bp, Artificial Sequence
  chemically synthesized
tacttgggaggctgaggcag

SEQ ID NO: 423211 - DNA, 20 bp, Artificial Sequence
  chemically synthesized
ttcaagcaattcttctgcct

SEQ ID NO: 423212 - DNA, 20 bp, Artificial Sequence
  chemically synthesized
gcagaagaattgcttgaacc

SEQ ID NO: 423213 - DNA, 20 bp, Artificial Sequence
  chemically synthesized
cagaagaattgcttgaaccc

SEQ ID NO: 423214 - DNA, 20 bp, Artificial Sequence
  chemically synthesized
aacctccgcctcctgggttc

SEQ ID NO: 423215 - DNA, 20 bp, Artificial Sequence
  chemically synthesized
gaagaattgcttgaacccag

SEQ ID NO: 423216 - DNA, 20 bp, Artificial Sequence
  chemically synthesized
aagaattgcttgaacccagg

SEQ ID NO: 423217 - DNA, 20 bp, Artificial Sequence
  chemically synthesized
aattgcttgaacccaggagg

SEQ ID NO: 423218 - DNA, 20 bp, Artificial Sequence
  chemically synthesized
cactgcaacctccgcctcct

SEQ ID NO: 423219 - DNA, 20 bp, Artificial Sequence
  chemically synthesized
ttgcttgaacccaggaggcg

SEQ ID NO: 423220 - DNA, 20 bp, Artificial Sequence
  chemically synthesized
tcactgcaacctccgcctcc

SEQ ID NO: 423221 - DNA, 20 bp, Artificial Sequence
  chemically synthesized
tgcttgaacccaggaggcgg

SEQ ID NO: 423222 - DNA, 20 bp, Artificial Sequence
  chemically synthesized
aacccaggaggcggaggttg

SEQ ID NO: 423223 - DNA, 20 bp, Artificial Sequence
  chemically synthesized
caggaggcggaggttgcagt

SEQ ID NO: 423224 - DNA, 20 bp, Artificial Sequence
  chemically synthesized
ggcggaggttgcagtgagcc

SEQ ID NO: 423225 - DNA, 20 bp, Artificial Sequence
  chemically synthesized
gaggttgcagtgagcccaga

SEQ ID NO: 423226 - DNA, 20 bp, Artificial Sequence
  chemically synthesized
gaagtgcaatggcactatct

SEQ ID NO: 423227 - DNA, 20 bp, Artificial Sequence
  chemically synthesized
tgaagtgcaatggcactatc

SEQ ID NO: 423228 - DNA, 20 bp, Artificial Sequence
  chemically synthesized
tcgcccaggctgaagtgcaa

SEQ ID NO: 423229 - DNA, 20 bp, Artificial Sequence
  chemically synthesized
cagatagtgccattgcactt

SEQ ID NO: 423230 - DNA, 20 bp, Artificial Sequence
  chemically synthesized
agtgccattgcacttcagcc

SEQ ID NO: 423231 - DNA, 20 bp, Artificial Sequence
  chemically synthesized
gtgccattgcacttcagcct

SEQ ID NO: 423232 - DNA, 20 bp, Artificial Sequence
  chemically synthesized
tccctctgtcgcccaggctg

SEQ ID NO: 423233 - DNA, 20 bp, Artificial Sequence
  chemically synthesized
ttgcacttcagcctgggcga

SEQ ID NO: 423234 - DNA, 20 bp, Artificial Sequence
  chemically synthesized
agcgtctccctctgtcgccc

SEQ ID NO: 423235 - DNA, 20 bp, Artificial Sequence
  chemically synthesized
gcacttcagcctgggcgaca

SEQ ID NO: 423236 - DNA, 20 bp, Artificial Sequence
  chemically synthesized
cagcgtctccctctgtcgcc

SEQ ID NO: 423237 - DNA, 20 bp, Artificial Sequence
  chemically synthesized
cacttcagcctgggcgacag

SEQ ID NO: 423238 - DNA, 20 bp, Artificial Sequence
  chemically synthesized
acttcagcctgggcgacaga

SEQ ID NO: 423239 - DNA, 20 bp, Artificial Sequence
  chemically synthesized
ttcagcctgggcgacagagg

SEQ ID NO: 423240 - DNA, 20 bp, Artificial Sequence
  chemically synthesized
tttattttatttttttgaga

SEQ ID NO: 423241 - DNA, 20 bp, Artificial Sequence
  chemically synthesized
tatttttattttattttttt

SEQ ID NO: 423242 - DNA, 20 bp, Artificial Sequence
  chemically synthesized
aaataaaaataaaaataccc

SEQ ID NO: 423243 - DNA, 20 bp, Artificial Sequence
  chemically synthesized
aaaaataaaaataccctggc

SEQ ID NO: 423244 - DNA, 20 bp, Artificial Sequence
  chemically synthesized
aaaataaaaataccctggcc

SEQ ID NO: 423245 - DNA, 20 bp, Artificial Sequence
  chemically synthesized
tgagccaccgtgcctggcca

SEQ ID NO: 423246 - DNA, 20 bp, Artificial Sequence
  chemically synthesized
gtgagccaccgtgcctggcc

SEQ ID NO: 423247 - DNA, 20 bp, Artificial Sequence
  chemically synthesized
cgtgagccaccgtgcctggc

SEQ ID NO: 423248 - DNA, 20 bp, Artificial Sequence
  chemically synthesized
aaaaataccctggccaggca

SEQ ID NO: 423249 - DNA, 20 bp, Artificial Sequence
  chemically synthesized
aataccctggccaggcacgg

SEQ ID NO: 423250 - DNA, 20 bp, Artificial Sequence
  chemically synthesized
caggcgtgagccaccgtgcc

SEQ ID NO: 423251 - DNA, 20 bp, Artificial Sequence
  chemically synthesized
agtgctggggttacaggcgt

SEQ ID NO: 423252 - DNA, 20 bp, Artificial Sequence
  chemically synthesized
gtggctcacgcctgtaaccc

SEQ ID NO: 423253 - DNA, 20 bp, Artificial Sequence
  chemically synthesized
tcccaaagtgctggggttac

SEQ ID NO: 423254 - DNA, 20 bp, Artificial Sequence
  chemically synthesized
ctcccaaagtgctggggtta

SEQ ID NO: 423255 - DNA, 20 bp, Artificial Sequence
  chemically synthesized
cttggcctcccaaagtgctg

SEQ ID NO: 423256 - DNA, 20 bp, Artificial Sequence
  chemically synthesized
cgcctgtaaccccagcactt

SEQ ID NO: 423257 - DNA, 20 bp, Artificial Sequence
  chemically synthesized
ccttggcctcccaaagtgct

SEQ ID NO: 423258 - DNA, 20 bp, Artificial Sequence
  chemically synthesized
gcctgtaaccccagcacttt

SEQ ID NO: 423259 - DNA, 20 bp, Artificial Sequence
  chemically synthesized
gccttggcctcccaaagtgc

SEQ ID NO: 423260 - DNA, 20 bp, Artificial Sequence
  chemically synthesized
ctgtaaccccagcactttgg

SEQ ID NO: 423261 - DNA, 20 bp, Artificial Sequence
  chemically synthesized
tgtaaccccagcactttggg

SEQ ID NO: 423262 - DNA, 20 bp, Artificial Sequence
  chemically synthesized
tcgcatgccttggcctccca

SEQ ID NO: 423263 - DNA, 20 bp, Artificial Sequence
  chemically synthesized
ccccagcactttgggaggcc

SEQ ID NO: 423264 - DNA, 20 bp, Artificial Sequence
  chemically synthesized
cccagcactttgggaggcca

SEQ ID NO: 423265 - DNA, 20 bp, Artificial Sequence
  chemically synthesized
acctcgtgattcgcatgcct

SEQ ID NO: 423266 - DNA, 20 bp, Artificial Sequence
  chemically synthesized
ggccaaggcatgcgaatcac

SEQ ID NO: 423267 - DNA, 20 bp, Artificial Sequence
  chemically synthesized
gccaaggcatgcgaatcacg

SEQ ID NO: 423268 - DNA, 20 bp, Artificial Sequence
  chemically synthesized
aggcatgcgaatcacgaggt

SEQ ID NO: 423269 - DNA, 20 bp, Artificial Sequence
  chemically synthesized
ggcatgcgaatcacgaggtc

SEQ ID NO: 423270 - DNA, 20 bp, Artificial Sequence
  chemically synthesized
catgcgaatcacgaggtcag

SEQ ID NO: 423271 - DNA, 20 bp, Artificial Sequence
  chemically synthesized
cgaatcacgaggtcaggagt

SEQ ID NO: 423272 - DNA, 20 bp, Artificial Sequence
  chemically synthesized
cgaggtcaggagttagaaac

SEQ ID NO: 423273 - DNA, 20 bp, Artificial Sequence
  chemically synthesized
tcaggagttagaaacaagcc

SEQ ID NO: 423274 - DNA, 20 bp, Artificial Sequence
  chemically synthesized
gaggtttcaccatgttggcc

SEQ ID NO: 423275 - DNA, 20 bp, Artificial Sequence
  chemically synthesized
agaaacaagcctggccaaca

SEQ ID NO: 423276 - DNA, 20 bp, Artificial Sequence
  chemically synthesized
cgaggtttcaccatgttggc

SEQ ID NO: 423277 - DNA, 20 bp, Artificial Sequence
  chemically synthesized
gagccgaggtttcaccatgt

SEQ ID NO: 423278 - DNA, 20 bp, Artificial Sequence
  chemically synthesized
tggccaacatggtgaaacct

SEQ ID NO: 423279 - DNA, 20 bp, Artificial Sequence
  chemically synthesized
ttgtatttttagtagagccg

SEQ ID NO: 423280 - DNA, 20 bp, Artificial Sequence
  chemically synthesized
tttgtatttttagtagagcc

SEQ ID NO: 423281 - DNA, 20 bp, Artificial Sequence
  chemically synthesized
taatgtttgtatttttagta

SEQ ID NO: 423282 - DNA, 20 bp, Artificial Sequence
  chemically synthesized
gctaatgtttgtatttttag

SEQ ID NO: 423283 - DNA, 20 bp, Artificial Sequence
  chemically synthesized
ccagctaatgtttgtatttt

SEQ ID NO: 423284 - DNA, 20 bp, Artificial Sequence
  chemically synthesized
tctactaaaaatacaaacat

SEQ ID NO: 423285 - DNA, 20 bp, Artificial Sequence
  chemically synthesized
ctaaaaatacaaacattagc

SEQ ID NO: 423286 - DNA, 20 bp, Artificial Sequence
  chemically synthesized
taaaaatacaaacattagct

SEQ ID NO: 423287 - DNA, 20 bp, Artificial Sequence
  chemically synthesized
atacaaacattagctgggcg

SEQ ID NO: 423288 - DNA, 20 bp, Artificial Sequence
  chemically synthesized
caaacattagctgggcgtgg

SEQ ID NO: 423289 - DNA, 20 bp, Artificial Sequence
  chemically synthesized
caggcgcctgccaccacgcc

SEQ ID NO: 423290 - DNA, 20 bp, Artificial Sequence
  chemically synthesized
acattagctgggcgtggtgg

SEQ ID NO: 423291 - DNA, 20 bp, Artificial Sequence
  chemically synthesized
cattagctgggcgtggtggc

SEQ ID NO: 423292 - DNA, 20 bp, Artificial Sequence
  chemically synthesized
ggcgtggtggcaggcgcctg

SEQ ID NO: 423293 - DNA, 20 bp, Artificial Sequence
  chemically synthesized
gtggcaggcgcctgtagtcc

SEQ ID NO: 423294 - DNA, 20 bp, Artificial Sequence
  chemically synthesized
tcccgaatagctgggactac

SEQ ID NO: 423295 - DNA, 20 bp, Artificial Sequence
  chemically synthesized
ctcccgaatagctgggacta

SEQ ID NO: 423296 - DNA, 20 bp, Artificial Sequence
  chemically synthesized
cgcctgtagtcccagctatt

SEQ ID NO: 423297 - DNA, 20 bp, Artificial Sequence
  chemically synthesized
cgtcagcctcccgaatagct

SEQ ID NO: 423298 - DNA, 20 bp, Artificial Sequence
  chemically synthesized
gcctgtagtcccagctattc

SEQ ID NO: 423299 - DNA, 20 bp, Artificial Sequence
  chemically synthesized
gcgtcagcctcccgaatagc

SEQ ID NO: 423300 - DNA, 20 bp, Artificial Sequence
  chemically synthesized
ctgtagtcccagctattcgg

SEQ ID NO: 423301 - DNA, 20 bp, Artificial Sequence
  chemically synthesized
tgtagtcccagctattcggg

SEQ ID NO: 423302 - DNA, 20 bp, Artificial Sequence
  chemically synthesized
tcctgcgtcagcctcccgaa

SEQ ID NO: 423303 - DNA, 20 bp, Artificial Sequence
  chemically synthesized
agctattcgggaggctgacg

SEQ ID NO: 423304 - DNA, 20 bp, Artificial Sequence
  chemically synthesized
gctattcgggaggctgacgc

SEQ ID NO: 423305 - DNA, 20 bp, Artificial Sequence
  chemically synthesized
tattcgggaggctgacgcag

SEQ ID NO: 423306 - DNA, 20 bp, Artificial Sequence
  chemically synthesized
ttcaagtgattctcctgcgt

SEQ ID NO: 423307 - DNA, 20 bp, Artificial Sequence
  chemically synthesized
aggagaatcacttgaacctg

SEQ ID NO: 423308 - DNA, 20 bp, Artificial Sequence
  chemically synthesized
aacctccgcccttcaggttc

SEQ ID NO: 423309 - DNA, 20 bp, Artificial Sequence
  chemically synthesized
ggagaatcacttgaacctga

SEQ ID NO: 423310 - DNA, 20 bp, Artificial Sequence
  chemically synthesized
gagaatcacttgaacctgaa

SEQ ID NO: 423311 - DNA, 20 bp, Artificial Sequence
  chemically synthesized
aatcacttgaacctgaaggg

SEQ ID NO: 423312 - DNA, 20 bp, Artificial Sequence
  chemically synthesized
cactgcaacctccgcccttc

SEQ ID NO: 423313 - DNA, 20 bp, Artificial Sequence
  chemically synthesized
tcacttgaacctgaagggcg

SEQ ID NO: 423314 - DNA, 20 bp, Artificial Sequence
  chemically synthesized
tcactgcaacctccgccctt

SEQ ID NO: 423315 - DNA, 20 bp, Artificial Sequence
  chemically synthesized
cacttgaacctgaagggcgg

SEQ ID NO: 423316 - DNA, 20 bp, Artificial Sequence
  chemically synthesized
aacctgaagggcggaggttg

SEQ ID NO: 423317 - DNA, 20 bp, Artificial Sequence
  chemically synthesized
tgaagggcggaggttgcagt

SEQ ID NO: 423318 - DNA, 20 bp, Artificial Sequence
  chemically synthesized
ggcggaggttgcagtgagcc

SEQ ID NO: 423319 - DNA, 20 bp, Artificial Sequence
  chemically synthesized
ggagtgcagtggcacgatct

SEQ ID NO: 423320 - DNA, 20 bp, Artificial Sequence
  chemically synthesized
tcgcccaggctggagtgcag

SEQ ID NO: 423321 - DNA, 20 bp, Artificial Sequence
  chemically synthesized
gagatcgtgccactgcactc

SEQ ID NO: 423322 - DNA, 20 bp, Artificial Sequence
  chemically synthesized
tattcgcccaggctggagtg

SEQ ID NO: 423323 - DNA, 20 bp, Artificial Sequence
  chemically synthesized
cgtgccactgcactccagcc

SEQ ID NO: 423324 - DNA, 20 bp, Artificial Sequence
  chemically synthesized
gtgccactgcactccagcct

SEQ ID NO: 423325 - DNA, 20 bp, Artificial Sequence
  chemically synthesized
ccctctattcgcccaggctg

SEQ ID NO: 423326 - DNA, 20 bp, Artificial Sequence
  chemically synthesized
ctccctctattcgcccaggc

SEQ ID NO: 423327 - DNA, 20 bp, Artificial Sequence
  chemically synthesized
tgcactccagcctgggcgaa

SEQ ID NO: 423328 - DNA, 20 bp, Artificial Sequence
  chemically synthesized
gagtctccctctattcgccc

SEQ ID NO: 423329 - DNA, 20 bp, Artificial Sequence
  chemically synthesized
agagtctccctctattcgcc

SEQ ID NO: 423330 - DNA, 20 bp, Artificial Sequence
  chemically synthesized
cactccagcctgggcgaata

SEQ ID NO: 423331 - DNA, 20 bp, Artificial Sequence
  chemically synthesized
actccagcctgggcgaatag

SEQ ID NO: 423332 - DNA, 20 bp, Artificial Sequence
  chemically synthesized
ctccagcctgggcgaataga

SEQ ID NO: 423333 - DNA, 20 bp, Artificial Sequence
  chemically synthesized
ccagcctgggcgaatagagg

SEQ ID NO: 423334 - DNA, 20 bp, Artificial Sequence
  chemically synthesized
ttttttttttttttcagaca

SEQ ID NO: 423335 - DNA, 20 bp, Artificial Sequence
  chemically synthesized
ttttttttttttttttcaga

SEQ ID NO: 423336 - DNA, 20 bp, Artificial Sequence
  chemically synthesized
tttttttttttttttttttt

SEQ ID NO: 423337 - DNA, 20 bp, Artificial Sequence
  chemically synthesized
aaaaaaaaaaaaaaaaccga

SEQ ID NO: 423338 - DNA, 20 bp, Artificial Sequence
  chemically synthesized
cagggtatttttatttcttt

SEQ ID NO: 423339 - DNA, 20 bp, Artificial Sequence
  chemically synthesized
caaggaagaaaataaagaca

SEQ ID NO: 423340 - DNA, 20 bp, Artificial Sequence
  chemically synthesized
ccaaggaagaaaataaagac

SEQ ID NO: 423341 - DNA, 20 bp, Artificial Sequence
  chemically synthesized
gccaaggaagaaaataaaga

SEQ ID NO: 423342 - DNA, 20 bp, Artificial Sequence
  chemically synthesized
ttttgccaaggaagaaaata

SEQ ID NO: 423343 - DNA, 20 bp, Artificial Sequence
  chemically synthesized
cctgtctttattttcttcct

SEQ ID NO: 423344 - DNA, 20 bp, Artificial Sequence
  chemically synthesized
tacagacaattttgccaagg

SEQ ID NO: 423345 - DNA, 20 bp, Artificial Sequence
  chemically synthesized
tcctacagacaattttgcca

SEQ ID NO: 423346 - DNA, 20 bp, Artificial Sequence
  chemically synthesized
atcctacagacaattttgcc

SEQ ID NO: 423347 - DNA, 20 bp, Artificial Sequence
  chemically synthesized
ttccttggcaaaattgtctg

SEQ ID NO: 423348 - DNA, 20 bp, Artificial Sequence
  chemically synthesized
tccttggcaaaattgtctgt

SEQ ID NO: 423349 - DNA, 20 bp, Artificial Sequence
  chemically synthesized
aaatggatgagtgaatccta

SEQ ID NO: 423350 - DNA, 20 bp, Artificial Sequence
  chemically synthesized
aattaattaaataaatggat

SEQ ID NO: 423351 - DNA, 20 bp, Artificial Sequence
  chemically synthesized
caataaattaattaaataaa

SEQ ID NO: 423352 - DNA, 20 bp, Artificial Sequence
  chemically synthesized
atacctgcttggaatgtaat

SEQ ID NO: 423353 - DNA, 20 bp, Artificial Sequence
  chemically synthesized
aatacctgcttggaatgtaa

SEQ ID NO: 423354 - DNA, 20 bp, Artificial Sequence
  chemically synthesized
ttgaattcccattacattcc

SEQ ID NO: 423355 - DNA, 20 bp, Artificial Sequence
  chemically synthesized
aattcccattacattccaag

SEQ ID NO: 423356 - DNA, 20 bp, Artificial Sequence
  chemically synthesized
attcccattacattccaagc

SEQ ID NO: 423357 - DNA, 20 bp, Artificial Sequence
  chemically synthesized
cttagtagttaatacctgct

SEQ ID NO: 423358 - DNA, 20 bp, Artificial Sequence
  chemically synthesized
ccaagcaggtattaactact

SEQ ID NO: 423359 - DNA, 20 bp, Artificial Sequence
  chemically synthesized
caagcaggtattaactacta

SEQ ID NO: 423360 - DNA, 20 bp, Artificial Sequence
  chemically synthesized
tttcatcattgaatccttag

SEQ ID NO: 423361 - DNA, 20 bp, Artificial Sequence
  chemically synthesized
gtctttcatcattgaatcct

SEQ ID NO: 423362 - DNA, 20 bp, Artificial Sequence
  chemically synthesized
tactaaggattcaatgatga

SEQ ID NO: 423363 - DNA, 20 bp, Artificial Sequence
  chemically synthesized
aggattcaatgatgaaagac

SEQ ID NO: 423364 - DNA, 20 bp, Artificial Sequence
  chemically synthesized
ggattcaatgatgaaagaca

SEQ ID NO: 423365 - DNA, 20 bp, Artificial Sequence
  chemically synthesized
atgatgaaagacaaggtgta

SEQ ID NO: 423366 - DNA, 20 bp, Artificial Sequence
  chemically synthesized
tgatgaaagacaaggtgtat

SEQ ID NO: 423367 - DNA, 20 bp, Artificial Sequence
  chemically synthesized
atgaaagacaaggtgtatag

SEQ ID NO: 423368 - DNA, 20 bp, Artificial Sequence
  chemically synthesized
gacaaggtgtataggagacc

SEQ ID NO: 423369 - DNA, 20 bp, Artificial Sequence
  chemically synthesized
aaactaaggctgtacgtact

SEQ ID NO: 423370 - DNA, 20 bp, Artificial Sequence
  chemically synthesized
tataggagacctagtacgta

SEQ ID NO: 423371 - DNA, 20 bp, Artificial Sequence
  chemically synthesized
gaaactaaggctgtacgtac

SEQ ID NO: 423372 - DNA, 20 bp, Artificial Sequence
  chemically synthesized
agacctagtacgtacagcct

SEQ ID NO: 423373 - DNA, 20 bp, Artificial Sequence
  chemically synthesized
aaatctgagaaaagaaacta

SEQ ID NO: 423374 - DNA, 20 bp, Artificial Sequence
  chemically synthesized
taaatctgagaaaagaaact

SEQ ID NO: 423375 - DNA, 20 bp, Artificial Sequence
  chemically synthesized
acagccttagtttcttttct

SEQ ID NO: 423376 - DNA, 20 bp, Artificial Sequence
  chemically synthesized
ttagagcataaatctgagaa

SEQ ID NO: 423377 - DNA, 20 bp, Artificial Sequence
  chemically synthesized
gaattttagagcataaatct

SEQ ID NO: 423378 - DNA, 20 bp, Artificial Sequence
  chemically synthesized
ccattcttaacggaatttta

SEQ ID NO: 423379 - DNA, 20 bp, Artificial Sequence
  chemically synthesized
atccattcttaacggaattt

SEQ ID NO: 423380 - DNA, 20 bp, Artificial Sequence
  chemically synthesized
ttatgctctaaaattccgtt

SEQ ID NO: 423381 - DNA, 20 bp, Artificial Sequence
  chemically synthesized
ctctaaaattccgttaagaa

SEQ ID NO: 423382 - DNA, 20 bp, Artificial Sequence
  chemically synthesized
gccaataaatccattcttaa

SEQ ID NO: 423383 - DNA, 20 bp, Artificial Sequence
  chemically synthesized
tccgttaagaatggatttat

SEQ ID NO: 423384 - DNA, 20 bp, Artificial Sequence
  chemically synthesized
ttaagaatggatttattggc

SEQ ID NO: 423385 - DNA, 20 bp, Artificial Sequence
  chemically synthesized
taagaatggatttattggct

SEQ ID NO: 423386 - DNA, 20 bp, Artificial Sequence
  chemically synthesized
atggatttattggctgggtg

SEQ ID NO: 423387 - DNA, 20 bp, Artificial Sequence
  chemically synthesized
gatttattggctgggtgcgg

SEQ ID NO: 423388 - DNA, 20 bp, Artificial Sequence
  chemically synthesized
caggcgtgagccaccgcacc

SEQ ID NO: 423389 - DNA, 20 bp, Artificial Sequence
  chemically synthesized
agtgctgggattacaggcgt

SEQ ID NO: 423390 - DNA, 20 bp, Artificial Sequence
  chemically synthesized
gtggctcacgcctgtaatcc

SEQ ID NO: 423391 - DNA, 20 bp, Artificial Sequence
  chemically synthesized
tcccaaagtgctgggattac

SEQ ID NO: 423392 - DNA, 20 bp, Artificial Sequence
  chemically synthesized
ctcccaaagtgctgggatta

SEQ ID NO: 423393 - DNA, 20 bp, Artificial Sequence
  chemically synthesized
cgcctgtaatcccagcactt

SEQ ID NO: 423394 - DNA, 20 bp, Artificial Sequence
  chemically synthesized
cctctgcctcccaaagtgct

SEQ ID NO: 423395 - DNA, 20 bp, Artificial Sequence
  chemically synthesized
gcctgtaatcccagcacttt

SEQ ID NO: 423396 - DNA, 20 bp, Artificial Sequence
  chemically synthesized
gcctctgcctcccaaagtgc

SEQ ID NO: 423397 - DNA, 20 bp, Artificial Sequence
  chemically synthesized
ctgtaatcccagcactttgg

SEQ ID NO: 423398 - DNA, 20 bp, Artificial Sequence
  chemically synthesized
tgtaatcccagcactttggg

SEQ ID NO: 423399 - DNA, 20 bp, Artificial Sequence
  chemically synthesized
aatcccagcactttgggagg

SEQ ID NO: 423400 - DNA, 20 bp, Artificial Sequence
  chemically synthesized
ccacctgcctctgcctccca

SEQ ID NO: 423401 - DNA, 20 bp, Artificial Sequence
  chemically synthesized
tcccagcactttgggaggca

SEQ ID NO: 423402 - DNA, 20 bp, Artificial Sequence
  chemically synthesized
cccagcactttgggaggcag

SEQ ID NO: 423403 - DNA, 20 bp, Artificial Sequence
  chemically synthesized
agcactttgggaggcagagg

SEQ ID NO: 423404 - DNA, 20 bp, Artificial Sequence
  chemically synthesized
gcactttgggaggcagaggc

SEQ ID NO: 423405 - DNA, 20 bp, Artificial Sequence
  chemically synthesized
ctttgggaggcagaggcagg

SEQ ID NO: 423406 - DNA, 20 bp, Artificial Sequence
  chemically synthesized
cagaggcaggtggctcacct

SEQ ID NO: 423407 - DNA, 20 bp, Artificial Sequence
  chemically synthesized
agaggcaggtggctcacctg

SEQ ID NO: 423408 - DNA, 20 bp, Artificial Sequence
  chemically synthesized
tcgaactcctgacctcaggt

SEQ ID NO: 423409 - DNA, 20 bp, Artificial Sequence
  chemically synthesized
gcaggtggctcacctgaggt

SEQ ID NO: 423410 - DNA, 20 bp, Artificial Sequence
  chemically synthesized
caggtggctcacctgaggtc

SEQ ID NO: 423411 - DNA, 20 bp, Artificial Sequence
  chemically synthesized
ggtctcgaactcctgacctc

SEQ ID NO: 423412 - DNA, 20 bp, Artificial Sequence
  chemically synthesized
ggtggctcacctgaggtcag

SEQ ID NO: 423413 - DNA, 20 bp, Artificial Sequence
  chemically synthesized
tggtctcgaactcctgacct

SEQ ID NO: 423414 - DNA, 20 bp, Artificial Sequence
  chemically synthesized
tcacctgaggtcaggagttc

SEQ ID NO: 423415 - DNA, 20 bp, Artificial Sequence
  chemically synthesized
tgaggtcaggagttcgagac

SEQ ID NO: 423416 - DNA, 20 bp, Artificial Sequence
  chemically synthesized
tttctccatgttggtcaggc

SEQ ID NO: 423417 - DNA, 20 bp, Artificial Sequence
  chemically synthesized
ggagtttctccatgttggtc

SEQ ID NO: 423418 - DNA, 20 bp, Artificial Sequence
  chemically synthesized
cgagaccagcctgaccaaca

SEQ ID NO: 423419 - DNA, 20 bp, Artificial Sequence
  chemically synthesized
cggagtttctccatgttggt

SEQ ID NO: 423420 - DNA, 20 bp, Artificial Sequence
  chemically synthesized
agaccagcctgaccaacatg

SEQ ID NO: 423421 - DNA, 20 bp, Artificial Sequence
  chemically synthesized
gagacggagtttctccatgt

SEQ ID NO: 423422 - DNA, 20 bp, Artificial Sequence
  chemically synthesized
ttgtatttttaggagagacg

SEQ ID NO: 423423 - DNA, 20 bp, Artificial Sequence
  chemically synthesized
ttttgtatttttaggagaga

SEQ ID NO: 423424 - DNA, 20 bp, Artificial Sequence
  chemically synthesized
ctaattttgtatttttagga

SEQ ID NO: 423425 - DNA, 20 bp, Artificial Sequence
  chemically synthesized
agctaattttgtatttttag

SEQ ID NO: 423426 - DNA, 20 bp, Artificial Sequence
  chemically synthesized
caagctaattttgtattttt

SEQ ID NO: 423427 - DNA, 20 bp, Artificial Sequence
  chemically synthesized
ccaagctaattttgtatttt

SEQ ID NO: 423428 - DNA, 20 bp, Artificial Sequence
  chemically synthesized
ctctcctaaaaatacaaaat

SEQ ID NO: 423429 - DNA, 20 bp, Artificial Sequence
  chemically synthesized
ctaaaaatacaaaattagct

SEQ ID NO: 423430 - DNA, 20 bp, Artificial Sequence
  chemically synthesized
aatacaaaattagcttggtg

SEQ ID NO: 423431 - DNA, 20 bp, Artificial Sequence
  chemically synthesized
acaaaattagcttggtgtgg

SEQ ID NO: 423432 - DNA, 20 bp, Artificial Sequence
  chemically synthesized
caggcatgcaccaccacacc

SEQ ID NO: 423433 - DNA, 20 bp, Artificial Sequence
  chemically synthesized
gtggtgcatgcctgtaatcc

SEQ ID NO: 423434 - DNA, 20 bp, Artificial Sequence
  chemically synthesized
tcccgagtagctgggattac

SEQ ID NO: 423435 - DNA, 20 bp, Artificial Sequence
  chemically synthesized
ctcccgagtagctgggatta

SEQ ID NO: 423436 - DNA, 20 bp, Artificial Sequence
  chemically synthesized
tgcctgtaatcccagctact

SEQ ID NO: 423437 - DNA, 20 bp, Artificial Sequence
  chemically synthesized
cctcagcctcccgagtagct

SEQ ID NO: 423438 - DNA, 20 bp, Artificial Sequence
  chemically synthesized
gcctgtaatcccagctactc

SEQ ID NO: 423439 - DNA, 20 bp, Artificial Sequence
  chemically synthesized
gcctcagcctcccgagtagc

SEQ ID NO: 423440 - DNA, 20 bp, Artificial Sequence
  chemically synthesized
ctgtaatcccagctactcgg

SEQ ID NO: 423441 - DNA, 20 bp, Artificial Sequence
  chemically synthesized
tgtaatcccagctactcggg

SEQ ID NO: 423442 - DNA, 20 bp, Artificial Sequence
  chemically synthesized
tcctgcctcagcctcccgag

SEQ ID NO: 423443 - DNA, 20 bp, Artificial Sequence
  chemically synthesized
ttctcctgcctcagcctccc

SEQ ID NO: 423444 - DNA, 20 bp, Artificial Sequence
  chemically synthesized
tcccagctactcgggaggct

SEQ ID NO: 423445 - DNA, 20 bp, Artificial Sequence
  chemically synthesized
cccagctactcgggaggctg

SEQ ID NO: 423446 - DNA, 20 bp, Artificial Sequence
  chemically synthesized
agctactcgggaggctgagg

SEQ ID NO: 423447 - DNA, 20 bp, Artificial Sequence
  chemically synthesized
gctactcgggaggctgaggc

SEQ ID NO: 423448 - DNA, 20 bp, Artificial Sequence
  chemically synthesized
tactcgggaggctgaggcag

SEQ ID NO: 423449 - DNA, 20 bp, Artificial Sequence
  chemically synthesized
ttcaagcaattctcctgcct

SEQ ID NO: 423450 - DNA, 20 bp, Artificial Sequence
  chemically synthesized
caggagaattgcttgaaccc

SEQ ID NO: 423451 - DNA, 20 bp, Artificial Sequence
  chemically synthesized
aacctccgcctcttgggttc

SEQ ID NO: 423452 - DNA, 20 bp, Artificial Sequence
  chemically synthesized
ggagaattgcttgaacccaa

SEQ ID NO: 423453 - DNA, 20 bp, Artificial Sequence
  chemically synthesized
gagaattgcttgaacccaag

SEQ ID NO: 423454 - DNA, 20 bp, Artificial Sequence
  chemically synthesized
aattgcttgaacccaagagg

SEQ ID NO: 423455 - DNA, 20 bp, Artificial Sequence
  chemically synthesized
caccgcaacctccgcctctt

SEQ ID NO: 423456 - DNA, 20 bp, Artificial Sequence
  chemically synthesized
ttgcttgaacccaagaggcg

SEQ ID NO: 423457 - DNA, 20 bp, Artificial Sequence
  chemically synthesized
tcaccgcaacctccgcctct

SEQ ID NO: 423458 - DNA, 20 bp, Artificial Sequence
  chemically synthesized
tgcttgaacccaagaggcgg

SEQ ID NO: 423459 - DNA, 20 bp, Artificial Sequence
  chemically synthesized
aacccaagaggcggaggttg

SEQ ID NO: 423460 - DNA, 20 bp, Artificial Sequence
  chemically synthesized
caagaggcggaggttgcggt

SEQ ID NO: 423461 - DNA, 20 bp, Artificial Sequence
  chemically synthesized
ggagtgcaatggcgagattt

SEQ ID NO: 423462 - DNA, 20 bp, Artificial Sequence
  chemically synthesized
tggagtgcaatggcgagatt

SEQ ID NO: 423463 - DNA, 20 bp, Artificial Sequence
  chemically synthesized
ccaggctggagtgcaatggc

SEQ ID NO: 423464 - DNA, 20 bp, Artificial Sequence
  chemically synthesized
ttgcccaggctggagtgcaa

SEQ ID NO: 423465 - DNA, 20 bp, Artificial Sequence
  chemically synthesized
taaatctcgccattgcactc

SEQ ID NO: 423466 - DNA, 20 bp, Artificial Sequence
  chemically synthesized
ctcgccattgcactccagcc

SEQ ID NO: 423467 - DNA, 20 bp, Artificial Sequence
  chemically synthesized
tcgccattgcactccagcct

SEQ ID NO: 423468 - DNA, 20 bp, Artificial Sequence
  chemically synthesized
cgctcttgttgcccaggctg

SEQ ID NO: 423469 - DNA, 20 bp, Artificial Sequence
  chemically synthesized
ttcgctcttgttgcccaggc

SEQ ID NO: 423470 - DNA, 20 bp, Artificial Sequence
  chemically synthesized
tgcactccagcctgggcaac

SEQ ID NO: 423471 - DNA, 20 bp, Artificial Sequence
  chemically synthesized
gactttcgctcttgttgccc

SEQ ID NO: 423472 - DNA, 20 bp, Artificial Sequence
  chemically synthesized
ggactttcgctcttgttgcc

SEQ ID NO: 423473 - DNA, 20 bp, Artificial Sequence
  chemically synthesized
cactccagcctgggcaacaa

SEQ ID NO: 423474 - DNA, 20 bp, Artificial Sequence
  chemically synthesized
agcctgggcaacaagagcga

SEQ ID NO: 423475 - DNA, 20 bp, Artificial Sequence
  chemically synthesized
tttttttttttttttttaga

SEQ ID NO: 423476 - DNA, 20 bp, Artificial Sequence
  chemically synthesized
tttttttttttttttttttt

SEQ ID NO: 423477 - DNA, 20 bp, Artificial Sequence
  chemically synthesized
aaaaaaaaaaaaaaaaaaaa

SEQ ID NO: 423478 - DNA, 20 bp, Artificial Sequence
  chemically synthesized
aaaaaaaaaaaaaaaaaaaa

SEQ ID NO: 423479 - DNA, 20 bp, Artificial Sequence
  chemically synthesized
tggttttcttcataaaaata

SEQ ID NO: 423480 - DNA, 20 bp, Artificial Sequence
  chemically synthesized
aaaaaggctttatttttatg

SEQ ID NO: 423481 - DNA, 20 bp, Artificial Sequence
  chemically synthesized
agatttatgacattaattta

SEQ ID NO: 423482 - DNA, 20 bp, Artificial Sequence
  chemically synthesized
tgataattattaacatagat

SEQ ID NO: 423483 - DNA, 20 bp, Artificial Sequence
  chemically synthesized
gcaactgataattattaaca

SEQ ID NO: 423484 - DNA, 20 bp, Artificial Sequence
  chemically synthesized
ttatctatgttaataattat

SEQ ID NO: 423485 - DNA, 20 bp, Artificial Sequence
  chemically synthesized
cccttttgttttcatgatta

SEQ ID NO: 423486 - DNA, 20 bp, Artificial Sequence
  chemically synthesized
tgctttaatcatgaaaacaa

SEQ ID NO: 423487 - DNA, 20 bp, Artificial Sequence
  chemically synthesized
gctttaatcatgaaaacaaa

SEQ ID NO: 423488 - DNA, 20 bp, Artificial Sequence
  chemically synthesized
ctttaatcatgaaaacaaaa

SEQ ID NO: 423489 - DNA, 20 bp, Artificial Sequence
  chemically synthesized
tgaaaacaaaagggaaaaac

SEQ ID NO: 423490 - DNA, 20 bp, Artificial Sequence
  chemically synthesized
aacaaaagggaaaaactggc

SEQ ID NO: 423491 - DNA, 20 bp, Artificial Sequence
  chemically synthesized
aaagggaaaaactggcaagt

SEQ ID NO: 423492 - DNA, 20 bp, Artificial Sequence
  chemically synthesized
tttcagcctggctcacttgc

SEQ ID NO: 423493 - DNA, 20 bp, Artificial Sequence
  chemically synthesized
ggaaaaactggcaagtgagc

SEQ ID NO: 423494 - DNA, 20 bp, Artificial Sequence
  chemically synthesized
gaaaaactggcaagtgagcc

SEQ ID NO: 423495 - DNA, 20 bp, Artificial Sequence
  chemically synthesized
tatattgaattatttcagcc

SEQ ID NO: 423496 - DNA, 20 bp, Artificial Sequence
  chemically synthesized
aatattatattgaattattt

SEQ ID NO: 423497 - DNA, 20 bp, Artificial Sequence
  chemically synthesized
ataattcaatataatattta

SEQ ID NO: 423498 - DNA, 20 bp, Artificial Sequence
  chemically synthesized
tcaatataatatttaaagat

SEQ ID NO: 423499 - DNA, 20 bp, Artificial Sequence
  chemically synthesized
atatttaaagattagaaata

SEQ ID NO: 423500 - DNA, 20 bp, Artificial Sequence
  chemically synthesized
ggagctgatctttagaaaac

SEQ ID NO: 423501 - DNA, 20 bp, Artificial Sequence
  chemically synthesized
tatggtacacttgttttcta

SEQ ID NO: 423502 - DNA, 20 bp, Artificial Sequence
  chemically synthesized
tacacttgttttctaaagat

SEQ ID NO: 423503 - DNA, 20 bp, Artificial Sequence
  chemically synthesized
gataagatggagctgatctt

SEQ ID NO: 423504 - DNA, 20 bp, Artificial Sequence
  chemically synthesized
tattccagtttgataagatg

SEQ ID NO: 423505 - DNA, 20 bp, Artificial Sequence
  chemically synthesized
gttattccagtttgataaga

SEQ ID NO: 423506 - DNA, 20 bp, Artificial Sequence
  chemically synthesized
tcagctccatcttatcaaac

SEQ ID NO: 423507 - DNA, 20 bp, Artificial Sequence
  chemically synthesized
agatgttattccagtttgat

SEQ ID NO: 423508 - DNA, 20 bp, Artificial Sequence
  chemically synthesized
ttttaattcagatgttattc

SEQ ID NO: 423509 - DNA, 20 bp, Artificial Sequence
  chemically synthesized
aatgtcacattattttaatt

SEQ ID NO: 423510 - DNA, 20 bp, Artificial Sequence
  chemically synthesized
ataatgtgacattgtcatca

SEQ ID NO: 423511 - DNA, 20 bp, Artificial Sequence
  chemically synthesized
acatgcttcagcaataatca

SEQ ID NO: 423512 - DNA, 20 bp, Artificial Sequence
  chemically synthesized
tcacatgcttcagcaataat

SEQ ID NO: 423513 - DNA, 20 bp, Artificial Sequence
  chemically synthesized
caaagctctgattattgctg

SEQ ID NO: 423514 - DNA, 20 bp, Artificial Sequence
  chemically synthesized
gtcctacctatcacatgctt

SEQ ID NO: 423515 - DNA, 20 bp, Artificial Sequence
  chemically synthesized
attattgctgaagcatgtga

SEQ ID NO: 423516 - DNA, 20 bp, Artificial Sequence
  chemically synthesized
ttattgctgaagcatgtgat

SEQ ID NO: 423517 - DNA, 20 bp, Artificial Sequence
  chemically synthesized
ttgctgaagcatgtgatagg

SEQ ID NO: 423518 - DNA, 20 bp, Artificial Sequence
  chemically synthesized
tgctgaagcatgtgataggt

SEQ ID NO: 423519 - DNA, 20 bp, Artificial Sequence
  chemically synthesized
aagcatgtgataggtaggac

SEQ ID NO: 423520 - DNA, 20 bp, Artificial Sequence
  chemically synthesized
ctaatgtattaatttttggc

SEQ ID NO: 423521 - DNA, 20 bp, Artificial Sequence
  chemically synthesized
ttttctaatgtattaatttt

SEQ ID NO: 423522 - DNA, 20 bp, Artificial Sequence
  chemically synthesized
ctggccaaaaattaatacat

SEQ ID NO: 423523 - DNA, 20 bp, Artificial Sequence
  chemically synthesized
caaaaattaatacattagaa

SEQ ID NO: 423524 - DNA, 20 bp, Artificial Sequence
  chemically synthesized
gtttttgattaaacatatca

SEQ ID NO: 423525 - DNA, 20 bp, Artificial Sequence
  chemically synthesized
tgtttttgattaaacatatc

SEQ ID NO: 423526 - DNA, 20 bp, Artificial Sequence
  chemically synthesized
gatatgtttaatcaaaaaca

SEQ ID NO: 423527 - DNA, 20 bp, Artificial Sequence
  chemically synthesized
tatgtttaatcaaaaacatg

SEQ ID NO: 423528 - DNA, 20 bp, Artificial Sequence
  chemically synthesized
tgaacatgcctttaaggatg

SEQ ID NO: 423529 - DNA, 20 bp, Artificial Sequence
  chemically synthesized
taaaaatgtctacatcctta

SEQ ID NO: 423530 - DNA, 20 bp, Artificial Sequence
  chemically synthesized
aaaaatgtctacatccttaa

SEQ ID NO: 423531 - DNA, 20 bp, Artificial Sequence
  chemically synthesized
taggggtgaacatgccttta

SEQ ID NO: 423532 - DNA, 20 bp, Artificial Sequence
  chemically synthesized
ttaggggtgaacatgccttt

SEQ ID NO: 423533 - DNA, 20 bp, Artificial Sequence
  chemically synthesized
tgttcgtaactgagagttag

SEQ ID NO: 423534 - DNA, 20 bp, Artificial Sequence
  chemically synthesized
gcatgttcacccctaactct

SEQ ID NO: 423535 - DNA, 20 bp, Artificial Sequence
  chemically synthesized
atgttcgtaactgagagtta

SEQ ID NO: 423536 - DNA, 20 bp, Artificial Sequence
  chemically synthesized
gatgttcgtaactgagagtt

SEQ ID NO: 423537 - DNA, 20 bp, Artificial Sequence
  chemically synthesized
agatgttcgtaactgagagt

SEQ ID NO: 423538 - DNA, 20 bp, Artificial Sequence
  chemically synthesized
atctagatgttcgtaactga

SEQ ID NO: 423539 - DNA, 20 bp, Artificial Sequence
  chemically synthesized
taatctagatgttcgtaact

SEQ ID NO: 423540 - DNA, 20 bp, Artificial Sequence
  chemically synthesized
aactctcagttacgaacatc

SEQ ID NO: 423541 - DNA, 20 bp, Artificial Sequence
  chemically synthesized
acttttaatgaaatttaatc

SEQ ID NO: 423542 - DNA, 20 bp, Artificial Sequence
  chemically synthesized
tctagattaaatttcattaa

SEQ ID NO: 423543 - DNA, 20 bp, Artificial Sequence
  chemically synthesized
tttagattaaatgtttaata

SEQ ID NO: 423544 - DNA, 20 bp, Artificial Sequence
  chemically synthesized
ttctaatggggcgcaacgtt

SEQ ID NO: 423545 - DNA, 20 bp, Artificial Sequence
  chemically synthesized
atctaaacgttgcgccccat

SEQ ID NO: 423546 - DNA, 20 bp, Artificial Sequence
  chemically synthesized
gcttttgatgtattctaatg

SEQ ID NO: 423547 - DNA, 20 bp, Artificial Sequence
  chemically synthesized
agcttttgatgtattctaat

SEQ ID NO: 423548 - DNA, 20 bp, Artificial Sequence
  chemically synthesized
aagcttttgatgtattctaa

SEQ ID NO: 423549 - DNA, 20 bp, Artificial Sequence
  chemically synthesized
gccccattagaatacatcaa

SEQ ID NO: 423550 - DNA, 20 bp, Artificial Sequence
  chemically synthesized
actttcttttagtaaaatgt

SEQ ID NO: 423551 - DNA, 20 bp, Artificial Sequence
  chemically synthesized
aaaagcttacattttactaa

SEQ ID NO: 423552 - DNA, 20 bp, Artificial Sequence
  chemically synthesized
gcttacattttactaaaaga

SEQ ID NO: 423553 - DNA, 20 bp, Artificial Sequence
  chemically synthesized
tcattgtagtcactttcttt

SEQ ID NO: 423554 - DNA, 20 bp, Artificial Sequence
  chemically synthesized
agttatatgttcattcattg

SEQ ID NO: 423555 - DNA, 20 bp, Artificial Sequence
  chemically synthesized
tgaatgaacatataacttta

SEQ ID NO: 423556 - DNA, 20 bp, Artificial Sequence
  chemically synthesized
gaacatataactttatagca

SEQ ID NO: 423557 - DNA, 20 bp, Artificial Sequence
  chemically synthesized
aaattataacctttgctata

SEQ ID NO: 423558 - DNA, 20 bp, Artificial Sequence
  chemically synthesized
aacatataactttatagcaa

SEQ ID NO: 423559 - DNA, 20 bp, Artificial Sequence
  chemically synthesized
aatttttgaatgtttgactt

SEQ ID NO: 423560 - DNA, 20 bp, Artificial Sequence
  chemically synthesized
tttaaaaatgttaacaacta

SEQ ID NO: 423561 - DNA, 20 bp, Artificial Sequence
  chemically synthesized
tttagttgttaacattttta

SEQ ID NO: 423562 - DNA, 20 bp, Artificial Sequence
  chemically synthesized
tataatgcttcgtaaaaaat

SEQ ID NO: 423563 - DNA, 20 bp, Artificial Sequence
  chemically synthesized
agacgttctaattttttacg

SEQ ID NO: 423564 - DNA, 20 bp, Artificial Sequence
  chemically synthesized
ttttacgaagcattataatt

SEQ ID NO: 423565 - DNA, 20 bp, Artificial Sequence
  chemically synthesized
ttataattaagcaaaatatc

SEQ ID NO: 423566 - DNA, 20 bp, Artificial Sequence
  chemically synthesized
aactgaaactatgaaaaaac

SEQ ID NO: 423567 - DNA, 20 bp, Artificial Sequence
  chemically synthesized
caaaatatccagttttttca

SEQ ID NO: 423568 - DNA, 20 bp, Artificial Sequence
  chemically synthesized
atccagttttttcatagttt

SEQ ID NO: 423569 - DNA, 20 bp, Artificial Sequence
  chemically synthesized
tagtttcagttttcaaactg

SEQ ID NO: 423570 - DNA, 20 bp, Artificial Sequence
  chemically synthesized
cagttttcaaactgtggctt

SEQ ID NO: 423571 - DNA, 20 bp, Artificial Sequence
  chemically synthesized
aacttaccttaccaaagcca

SEQ ID NO: 423572 - DNA, 20 bp, Artificial Sequence
  chemically synthesized
tttcaaactgtggctttggt

SEQ ID NO: 423573 - DNA, 20 bp, Artificial Sequence
  chemically synthesized
ttcaaactgtggctttggta

SEQ ID NO: 423574 - DNA, 20 bp, Artificial Sequence
  chemically synthesized
ttttccaacttaccttacca

SEQ ID NO: 423575 - DNA, 20 bp, Artificial Sequence
  chemically synthesized
aactgtggctttggtaaggt

SEQ ID NO: 423576 - DNA, 20 bp, Artificial Sequence
  chemically synthesized
gtggctttggtaaggtaagt

SEQ ID NO: 423577 - DNA, 20 bp, Artificial Sequence
  chemically synthesized
aggtaagttggaaaacatct

SEQ ID NO: 423578 - DNA, 20 bp, Artificial Sequence
  chemically synthesized
ccttttgggccattaaaact

SEQ ID NO: 423579 - DNA, 20 bp, Artificial Sequence
  chemically synthesized
ggaaaacatcttagttttaa

SEQ ID NO: 423580 - DNA, 20 bp, Artificial Sequence
  chemically synthesized
tcttagttttaatggcccaa

SEQ ID NO: 423581 - DNA, 20 bp, Artificial Sequence
  chemically synthesized
cttagttttaatggcccaaa

SEQ ID NO: 423582 - DNA, 20 bp, Artificial Sequence
  chemically synthesized
ttagttttaatggcccaaaa

SEQ ID NO: 423583 - DNA, 20 bp, Artificial Sequence
  chemically synthesized
tagttttaatggcccaaaag

SEQ ID NO: 423584 - DNA, 20 bp, Artificial Sequence
  chemically synthesized
gttttaatggcccaaaaggg

SEQ ID NO: 423585 - DNA, 20 bp, Artificial Sequence
  chemically synthesized
acatcaaagtctcccctttt

SEQ ID NO: 423586 - DNA, 20 bp, Artificial Sequence
  chemically synthesized
tacatcaaagtctccccttt

SEQ ID NO: 423587 - DNA, 20 bp, Artificial Sequence
  chemically synthesized
aaaggggagactttgatgta

SEQ ID NO: 423588 - DNA, 20 bp, Artificial Sequence
  chemically synthesized
tgaatctatactatacatca

SEQ ID NO: 423589 - DNA, 20 bp, Artificial Sequence
  chemically synthesized
ggagactttgatgtatagta

SEQ ID NO: 423590 - DNA, 20 bp, Artificial Sequence
  chemically synthesized
ttgatgtatagtatagattc

SEQ ID NO: 423591 - DNA, 20 bp, Artificial Sequence
  chemically synthesized
agattcaagtgcttatctca

SEQ ID NO: 423592 - DNA, 20 bp, Artificial Sequence
  chemically synthesized
gaaagcatgatccatgagat

SEQ ID NO: 423593 - DNA, 20 bp, Artificial Sequence
  chemically synthesized
aaaatgaaagcatgatccat

SEQ ID NO: 423594 - DNA, 20 bp, Artificial Sequence
  chemically synthesized
ttatatttttagtaaaatga

SEQ ID NO: 423595 - DNA, 20 bp, Artificial Sequence
  chemically synthesized
gttttagtctattatatttt

SEQ ID NO: 423596 - DNA, 20 bp, Artificial Sequence
  chemically synthesized
tcattttactaaaaatataa

SEQ ID NO: 423597 - DNA, 20 bp, Artificial Sequence
  chemically synthesized
tttctccctatgtaaagttt

SEQ ID NO: 423598 - DNA, 20 bp, Artificial Sequence
  chemically synthesized
taatagactaaaactttaca

SEQ ID NO: 423599 - DNA, 20 bp, Artificial Sequence
  chemically synthesized
aatagactaaaactttacat

SEQ ID NO: 423600 - DNA, 20 bp, Artificial Sequence
  chemically synthesized
atagactaaaactttacata

SEQ ID NO: 423601 - DNA, 20 bp, Artificial Sequence
  chemically synthesized
ctgcgatttctccctatgta

SEQ ID NO: 423602 - DNA, 20 bp, Artificial Sequence
  chemically synthesized
agactaaaactttacatagg

SEQ ID NO: 423603 - DNA, 20 bp, Artificial Sequence
  chemically synthesized
ctttacatagggagaaatcg

SEQ ID NO: 423604 - DNA, 20 bp, Artificial Sequence
  chemically synthesized
ttacatagggagaaatcgca

SEQ ID NO: 423605 - DNA, 20 bp, Artificial Sequence
  chemically synthesized
agggagaaatcgcagagaat

SEQ ID NO: 423606 - DNA, 20 bp, Artificial Sequence
  chemically synthesized
atcgcagagaataagaatca

SEQ ID NO: 423607 - DNA, 20 bp, Artificial Sequence
  chemically synthesized
tcgcagagaataagaatcaa

SEQ ID NO: 423608 - DNA, 20 bp, Artificial Sequence
  chemically synthesized
gcagagaataagaatcaaag

SEQ ID NO: 423609 - DNA, 20 bp, Artificial Sequence
  chemically synthesized
caaaggagtaattaaaaatt

SEQ ID NO: 423610 - DNA, 20 bp, Artificial Sequence
  chemically synthesized
aaaggagtaattaaaaattg

SEQ ID NO: 423611 - DNA, 20 bp, Artificial Sequence
  chemically synthesized
aaggagtaattaaaaattga

SEQ ID NO: 423612 - DNA, 20 bp, Artificial Sequence
  chemically synthesized
taattaaaaattgagggttt

SEQ ID NO: 423613 - DNA, 20 bp, Artificial Sequence
  chemically synthesized
aattaaaaattgagggtttt

SEQ ID NO: 423614 - DNA, 20 bp, Artificial Sequence
  chemically synthesized
ttaaaaattgagggttttgg

SEQ ID NO: 423615 - DNA, 20 bp, Artificial Sequence
  chemically synthesized
taaaaattgagggttttggg

SEQ ID NO: 423616 - DNA, 20 bp, Artificial Sequence
  chemically synthesized
attgagggttttgggaggct

SEQ ID NO: 423617 - DNA, 20 bp, Artificial Sequence
  chemically synthesized
ttgagggttttgggaggctg

SEQ ID NO: 423618 - DNA, 20 bp, Artificial Sequence
  chemically synthesized
agggttttgggaggctgagg

SEQ ID NO: 423619 - DNA, 20 bp, Artificial Sequence
  chemically synthesized
gggttttgggaggctgaggc

SEQ ID NO: 423620 - DNA, 20 bp, Artificial Sequence
  chemically synthesized
gttttgggaggctgaggcag

SEQ ID NO: 423621 - DNA, 20 bp, Artificial Sequence
  chemically synthesized
ttcaagtgattctcctgcct

SEQ ID NO: 423622 - DNA, 20 bp, Artificial Sequence
  chemically synthesized
gcaggagaatcacttgaaca

SEQ ID NO: 423623 - DNA, 20 bp, Artificial Sequence
  chemically synthesized
caggagaatcacttgaacat

SEQ ID NO: 423624 - DNA, 20 bp, Artificial Sequence
  chemically synthesized
aacctccacctcccatgttc

SEQ ID NO: 423625 - DNA, 20 bp, Artificial Sequence
  chemically synthesized
ggagaatcacttgaacatgg

SEQ ID NO: 423626 - DNA, 20 bp, Artificial Sequence
  chemically synthesized
gagaatcacttgaacatggg

SEQ ID NO: 423627 - DNA, 20 bp, Artificial Sequence
  chemically synthesized
aatcacttgaacatgggagg

SEQ ID NO: 423628 - DNA, 20 bp, Artificial Sequence
  chemically synthesized
tcacttgaacatgggaggtg

SEQ ID NO: 423629 - DNA, 20 bp, Artificial Sequence
  chemically synthesized
cacttgaacatgggaggtgg

SEQ ID NO: 423630 - DNA, 20 bp, Artificial Sequence
  chemically synthesized
aacatgggaggtggaggttg

SEQ ID NO: 423631 - DNA, 20 bp, Artificial Sequence
  chemically synthesized
ggtggaggttgcagtgaccc

SEQ ID NO: 423632 - DNA, 20 bp, Artificial Sequence
  chemically synthesized
gagtgcaatggcacgatctc

SEQ ID NO: 423633 - DNA, 20 bp, Artificial Sequence
  chemically synthesized
agagtgcaatggcacgatct

SEQ ID NO: 423634 - DNA, 20 bp, Artificial Sequence
  chemically synthesized
tcacccaggctagagtgcaa

SEQ ID NO: 423635 - DNA, 20 bp, Artificial Sequence
  chemically synthesized
gagatcgtgccattgcactc

SEQ ID NO: 423636 - DNA, 20 bp, Artificial Sequence
  chemically synthesized
cgtgccattgcactctagcc

SEQ ID NO: 423637 - DNA, 20 bp, Artificial Sequence
  chemically synthesized
gtgccattgcactctagcct

SEQ ID NO: 423638 - DNA, 20 bp, Artificial Sequence
  chemically synthesized
tcgctctgtcacccaggcta

SEQ ID NO: 423639 - DNA, 20 bp, Artificial Sequence
  chemically synthesized
tctcgctctgtcacccaggc

SEQ ID NO: 423640 - DNA, 20 bp, Artificial Sequence
  chemically synthesized
ttgcactctagcctgggtga

SEQ ID NO: 423641 - DNA, 20 bp, Artificial Sequence
  chemically synthesized
ggagtctcgctctgtcaccc

SEQ ID NO: 423642 - DNA, 20 bp, Artificial Sequence
  chemically synthesized
gcactctagcctgggtgaca

SEQ ID NO: 423643 - DNA, 20 bp, Artificial Sequence
  chemically synthesized
cggagtctcgctctgtcacc

SEQ ID NO: 423644 - DNA, 20 bp, Artificial Sequence
  chemically synthesized
tctagcctgggtgacagagc

SEQ ID NO: 423645 - DNA, 20 bp, Artificial Sequence
  chemically synthesized
acagagcgagactccgtctc

SEQ ID NO: 423646 - DNA, 20 bp, Artificial Sequence
  chemically synthesized
tttttttttttcttgagacg

SEQ ID NO: 423647 - DNA, 20 bp, Artificial Sequence
  chemically synthesized
tttttttttttttcttgaga

SEQ ID NO: 423648 - DNA, 20 bp, Artificial Sequence
  chemically synthesized
caattttttttttttttctt

SEQ ID NO: 423649 - DNA, 20 bp, Artificial Sequence
  chemically synthesized
caagaaaaaaaaaaaaaatt

SEQ ID NO: 423650 - DNA, 20 bp, Artificial Sequence
  chemically synthesized
aagaaaaaaaaaaaaaattg

SEQ ID NO: 423651 - DNA, 20 bp, Artificial Sequence
  chemically synthesized
aattgaggttttacgtattt

SEQ ID NO: 423652 - DNA, 20 bp, Artificial Sequence
  chemically synthesized
aaagtaaacaattggtcatt

SEQ ID NO: 423653 - DNA, 20 bp, Artificial Sequence
  chemically synthesized
aaaagtaaacaattggtcat

SEQ ID NO: 423654 - DNA, 20 bp, Artificial Sequence
  chemically synthesized
tgttgacaaaagtaaacaat

SEQ ID NO: 423655 - DNA, 20 bp, Artificial Sequence
  chemically synthesized
caattgtttacttttgtcaa

SEQ ID NO: 423656 - DNA, 20 bp, Artificial Sequence
  chemically synthesized
agtaaaattactgttgacaa

SEQ ID NO: 423657 - DNA, 20 bp, Artificial Sequence
  chemically synthesized
tcaacagtaattttactgct

SEQ ID NO: 423658 - DNA, 20 bp, Artificial Sequence
  chemically synthesized
aaattacttaaattacttag

SEQ ID NO: 423659 - DNA, 20 bp, Artificial Sequence
  chemically synthesized
gtaaaattacttaaattact

SEQ ID NO: 423660 - DNA, 20 bp, Artificial Sequence
  chemically synthesized
attttactgctaagtaattt

SEQ ID NO: 423661 - DNA, 20 bp, Artificial Sequence
  chemically synthesized
aatttaagtaattttactgc

SEQ ID NO: 423662 - DNA, 20 bp, Artificial Sequence
  chemically synthesized
agtaattttactgccagttt

SEQ ID NO: 423663 - DNA, 20 bp, Artificial Sequence
  chemically synthesized
tgtattcctgctgaaactgg

SEQ ID NO: 423664 - DNA, 20 bp, Artificial Sequence
  chemically synthesized
aattttactgccagtttcag

SEQ ID NO: 423665 - DNA, 20 bp, Artificial Sequence
  chemically synthesized
aattgtattcctgctgaaac

SEQ ID NO: 423666 - DNA, 20 bp, Artificial Sequence
  chemically synthesized
attttactgccagtttcagc

SEQ ID NO: 423667 - DNA, 20 bp, Artificial Sequence
  chemically synthesized
aggaatacaatttcctaaca

SEQ ID NO: 423668 - DNA, 20 bp, Artificial Sequence
  chemically synthesized
aaatattaaatatctatgtt

SEQ ID NO: 423669 - DNA, 20 bp, Artificial Sequence
  chemically synthesized
aaaatattaaatatctatgt

SEQ ID NO: 423670 - DNA, 20 bp, Artificial Sequence
  chemically synthesized
tattttaatatattaatctt

SEQ ID NO: 423671 - DNA, 20 bp, Artificial Sequence
  chemically synthesized
tttaatatattaatctttag

SEQ ID NO: 423672 - DNA, 20 bp, Artificial Sequence
  chemically synthesized
ttgaagcatatattctacta

SEQ ID NO: 423673 - DNA, 20 bp, Artificial Sequence
  chemically synthesized
cacatatcctcacaaaattg

SEQ ID NO: 423674 - DNA, 20 bp, Artificial Sequence
  chemically synthesized
aatatatgcttcaattttgt

SEQ ID NO: 423675 - DNA, 20 bp, Artificial Sequence
  chemically synthesized
atatatgcttcaattttgtg

SEQ ID NO: 423676 - DNA, 20 bp, Artificial Sequence
  chemically synthesized
tatgtgtttattttcttgta

SEQ ID NO: 423677 - DNA, 20 bp, Artificial Sequence
  chemically synthesized
ttgtttagtttacactgtac

SEQ ID NO: 423678 - DNA, 20 bp, Artificial Sequence
  chemically synthesized
tgttctctttatgcgttgtt

SEQ ID NO: 423679 - DNA, 20 bp, Artificial Sequence
  chemically synthesized
tgtaaactaaacaacgcata

SEQ ID NO: 423680 - DNA, 20 bp, Artificial Sequence
  chemically synthesized
taaactaaacaacgcataaa

SEQ ID NO: 423681 - DNA, 20 bp, Artificial Sequence
  chemically synthesized
aacaacgcataaagagaaca

SEQ ID NO: 423682 - DNA, 20 bp, Artificial Sequence
  chemically synthesized
acaacgcataaagagaacac

SEQ ID NO: 423683 - DNA, 20 bp, Artificial Sequence
  chemically synthesized
ataaagagaacacaggtaac

SEQ ID NO: 423684 - DNA, 20 bp, Artificial Sequence
  chemically synthesized
agaacacaggtaactagatt

SEQ ID NO: 423685 - DNA, 20 bp, Artificial Sequence
  chemically synthesized
gaaaataattgttcttaatc

SEQ ID NO: 423686 - DNA, 20 bp, Artificial Sequence
  chemically synthesized
gagtgttctaatacaaagag

SEQ ID NO: 423687 - DNA, 20 bp, Artificial Sequence
  chemically synthesized
ttattttctgctctttgtat

SEQ ID NO: 423688 - DNA, 20 bp, Artificial Sequence
  chemically synthesized
aatgagtgttctaatacaaa

SEQ ID NO: 423689 - DNA, 20 bp, Artificial Sequence
  chemically synthesized
aaaatgagtgttctaataca

SEQ ID NO: 423690 - DNA, 20 bp, Artificial Sequence
  chemically synthesized
gattactaagaacagaaaat

SEQ ID NO: 423691 - DNA, 20 bp, Artificial Sequence
  chemically synthesized
gaacactcattttctgttct

SEQ ID NO: 423692 - DNA, 20 bp, Artificial Sequence
  chemically synthesized
tgctgctagattactaagaa

SEQ ID NO: 423693 - DNA, 20 bp, Artificial Sequence
  chemically synthesized
attttctgttcttagtaatc

SEQ ID NO: 423694 - DNA, 20 bp, Artificial Sequence
  chemically synthesized
gctgatgctgctagattact

SEQ ID NO: 423695 - DNA, 20 bp, Artificial Sequence
  chemically synthesized
ttctgttcttagtaatctag

SEQ ID NO: 423696 - DNA, 20 bp, Artificial Sequence
  chemically synthesized
tcttagtaatctagcagcat

SEQ ID NO: 423697 - DNA, 20 bp, Artificial Sequence
  chemically synthesized
ttaggagatgctgatgctgc

SEQ ID NO: 423698 - DNA, 20 bp, Artificial Sequence
  chemically synthesized
atttttaacagattttttag

SEQ ID NO: 423699 - DNA, 20 bp, Artificial Sequence
  chemically synthesized
gcatttttaacagatttttt

SEQ ID NO: 423700 - DNA, 20 bp, Artificial Sequence
  chemically synthesized
tgcatttttaacagattttt

SEQ ID NO: 423701 - DNA, 20 bp, Artificial Sequence
  chemically synthesized
cccaacctctgcatttttaa

SEQ ID NO: 423702 - DNA, 20 bp, Artificial Sequence
  chemically synthesized
taaaaaatctgttaaaaatg

SEQ ID NO: 423703 - DNA, 20 bp, Artificial Sequence
  chemically synthesized
aaaaatctgttaaaaatgca

SEQ ID NO: 423704 - DNA, 20 bp, Artificial Sequence
  chemically synthesized
aaaatctgttaaaaatgcag

SEQ ID NO: 423705 - DNA, 20 bp, Artificial Sequence
  chemically synthesized
tctgttaaaaatgcagaggt

SEQ ID NO: 423706 - DNA, 20 bp, Artificial Sequence
  chemically synthesized
ctgttaaaaatgcagaggtt

SEQ ID NO: 423707 - DNA, 20 bp, Artificial Sequence
  chemically synthesized
tgttaaaaatgcagaggttg

SEQ ID NO: 423708 - DNA, 20 bp, Artificial Sequence
  chemically synthesized
cagaggttggggccccactt

SEQ ID NO: 423709 - DNA, 20 bp, Artificial Sequence
  chemically synthesized
gattcagtccttctgaagtg

SEQ ID NO: 423710 - DNA, 20 bp, Artificial Sequence
  chemically synthesized
aggttggggccccacttcag

SEQ ID NO: 423711 - DNA, 20 bp, Artificial Sequence
  chemically synthesized
tgattcagtccttctgaagt

SEQ ID NO: 423712 - DNA, 20 bp, Artificial Sequence
  chemically synthesized
ggttggggccccacttcaga

SEQ ID NO: 423713 - DNA, 20 bp, Artificial Sequence
  chemically synthesized
ctgattcagtccttctgaag

SEQ ID NO: 423714 - DNA, 20 bp, Artificial Sequence
  chemically synthesized
tttctgattcagtccttctg

SEQ ID NO: 423715 - DNA, 20 bp, Artificial Sequence
  chemically synthesized
ccacttcagaaggactgaat

SEQ ID NO: 423716 - DNA, 20 bp, Artificial Sequence
  chemically synthesized
cacccccagagtttctgatt

SEQ ID NO: 423717 - DNA, 20 bp, Artificial Sequence
  chemically synthesized
aaggactgaatcagaaactc

SEQ ID NO: 423718 - DNA, 20 bp, Artificial Sequence
  chemically synthesized
aggactgaatcagaaactct

SEQ ID NO: 423719 - DNA, 20 bp, Artificial Sequence
  chemically synthesized
ggactgaatcagaaactctg

SEQ ID NO: 423720 - DNA, 20 bp, Artificial Sequence
  chemically synthesized
gactgaatcagaaactctgg

SEQ ID NO: 423721 - DNA, 20 bp, Artificial Sequence
  chemically synthesized
tgaatcagaaactctggggg

SEQ ID NO: 423722 - DNA, 20 bp, Artificial Sequence
  chemically synthesized
cttgctggatgccaccccca

SEQ ID NO: 423723 - DNA, 20 bp, Artificial Sequence
  chemically synthesized
agcttgctggatgccacccc

SEQ ID NO: 423724 - DNA, 20 bp, Artificial Sequence
  chemically synthesized
gaaactctgggggtggcatc

SEQ ID NO: 423725 - DNA, 20 bp, Artificial Sequence
  chemically synthesized
ctctgggggtggcatccagc

SEQ ID NO: 423726 - DNA, 20 bp, Artificial Sequence
  chemically synthesized
ctggttaaaccacagcttgc

SEQ ID NO: 423727 - DNA, 20 bp, Artificial Sequence
  chemically synthesized
gggtggcatccagcaagctg

SEQ ID NO: 423728 - DNA, 20 bp, Artificial Sequence
  chemically synthesized
ctggagggctggttaaacca

SEQ ID NO: 423729 - DNA, 20 bp, Artificial Sequence
  chemically synthesized
ccagcaagctgtggtttaac

SEQ ID NO: 423730 - DNA, 20 bp, Artificial Sequence
  chemically synthesized
ctgtggtttaaccagccctc

SEQ ID NO: 423731 - DNA, 20 bp, Artificial Sequence
  chemically synthesized
tgtggtttaaccagccctcc

SEQ ID NO: 423732 - DNA, 20 bp, Artificial Sequence
  chemically synthesized
atcagattcacctggagggc

SEQ ID NO: 423733 - DNA, 20 bp, Artificial Sequence
  chemically synthesized
gggcatcagattcacctgga

SEQ ID NO: 423734 - DNA, 20 bp, Artificial Sequence
  chemically synthesized
tgggcatcagattcacctgg

SEQ ID NO: 423735 - DNA, 20 bp, Artificial Sequence
  chemically synthesized
gtgggcatcagattcacctg

SEQ ID NO: 423736 - DNA, 20 bp, Artificial Sequence
  chemically synthesized
gagtgggcatcagattcacc

SEQ ID NO: 423737 - DNA, 20 bp, Artificial Sequence
  chemically synthesized
actcttccttgagtgggcat

SEQ ID NO: 423738 - DNA, 20 bp, Artificial Sequence
  chemically synthesized
ggtgaatctgatgcccactc

SEQ ID NO: 423739 - DNA, 20 bp, Artificial Sequence
  chemically synthesized
gtgaatctgatgcccactca

SEQ ID NO: 423740 - DNA, 20 bp, Artificial Sequence
  chemically synthesized
gttctcactcttccttgagt

SEQ ID NO: 423741 - DNA, 20 bp, Artificial Sequence
  chemically synthesized
aatctgatgcccactcaagg

SEQ ID NO: 423742 - DNA, 20 bp, Artificial Sequence
  chemically synthesized
ggttctcactcttccttgag

SEQ ID NO: 423743 - DNA, 20 bp, Artificial Sequence
  chemically synthesized
tctgatgcccactcaaggaa

SEQ ID NO: 423744 - DNA, 20 bp, Artificial Sequence
  chemically synthesized
agtggttctcactcttcctt

SEQ ID NO: 423745 - DNA, 20 bp, Artificial Sequence
  chemically synthesized
atgcccactcaaggaagagt

SEQ ID NO: 423746 - DNA, 20 bp, Artificial Sequence
  chemically synthesized
aagacgatagattagaacag

SEQ ID NO: 423747 - DNA, 20 bp, Artificial Sequence
  chemically synthesized
tggaagacgatagattagaa

SEQ ID NO: 423748 - DNA, 20 bp, Artificial Sequence
  chemically synthesized
actcttggaagacgatagat

SEQ ID NO: 423749 - DNA, 20 bp, Artificial Sequence
  chemically synthesized
cacacactcttggaagacga

SEQ ID NO: 423750 - DNA, 20 bp, Artificial Sequence
  chemically synthesized
gttctaatctatcgtcttcc

SEQ ID NO: 423751 - DNA, 20 bp, Artificial Sequence
  chemically synthesized
tctaatctatcgtcttccaa

SEQ ID NO: 423752 - DNA, 20 bp, Artificial Sequence
  chemically synthesized
atcttcccacacactcttgg

SEQ ID NO: 423753 - DNA, 20 bp, Artificial Sequence
  chemically synthesized
ttgatcttcccacacactct

SEQ ID NO: 423754 - DNA, 20 bp, Artificial Sequence
  chemically synthesized
tatcgtcttccaagagtgtg

SEQ ID NO: 423755 - DNA, 20 bp, Artificial Sequence
  chemically synthesized
atcgtcttccaagagtgtgt

SEQ ID NO: 423756 - DNA, 20 bp, Artificial Sequence
  chemically synthesized
gtcttccaagagtgtgtggg

SEQ ID NO: 423757 - DNA, 20 bp, Artificial Sequence
  chemically synthesized
aagagtgtgtgggaagatca

SEQ ID NO: 423758 - DNA, 20 bp, Artificial Sequence
  chemically synthesized
tgggaagatcaaagaaaaat

SEQ ID NO: 423759 - DNA, 20 bp, Artificial Sequence
  chemically synthesized
gggaagatcaaagaaaaatc

SEQ ID NO: 423760 - DNA, 20 bp, Artificial Sequence
  chemically synthesized
atcaaagaaaaatcaggtca

SEQ ID NO: 423761 - DNA, 20 bp, Artificial Sequence
  chemically synthesized
tcaaagaaaaatcaggtcat

SEQ ID NO: 423762 - DNA, 20 bp, Artificial Sequence
  chemically synthesized
caaagaaaaatcaggtcatg

SEQ ID NO: 423763 - DNA, 20 bp, Artificial Sequence
  chemically synthesized
aatcaggtcatggggctttg

SEQ ID NO: 423764 - DNA, 20 bp, Artificial Sequence
  chemically synthesized
tcaggtcatggggctttgcg

SEQ ID NO: 423765 - DNA, 20 bp, Artificial Sequence
  chemically synthesized
ttgtttgattgttctccgca

SEQ ID NO: 423766 - DNA, 20 bp, Artificial Sequence
  chemically synthesized
atcaaacaaatacataaatc

SEQ ID NO: 423767 - DNA, 20 bp, Artificial Sequence
  chemically synthesized
tcaaacaaatacataaatca

SEQ ID NO: 423768 - DNA, 20 bp, Artificial Sequence
  chemically synthesized
acataaatcaaggactctat

SEQ ID NO: 423769 - DNA, 20 bp, Artificial Sequence
  chemically synthesized
tttattaaattatgcttata

SEQ ID NO: 423770 - DNA, 20 bp, Artificial Sequence
  chemically synthesized
tatttattaaattatgctta

SEQ ID NO: 423771 - DNA, 20 bp, Artificial Sequence
  chemically synthesized
tataagcataatttaataaa

SEQ ID NO: 423772 - DNA, 20 bp, Artificial Sequence
  chemically synthesized
agcataatttaataaataga

SEQ ID NO: 423773 - DNA, 20 bp, Artificial Sequence
  chemically synthesized
taaggaggaaattgaaaaat

SEQ ID NO: 423774 - DNA, 20 bp, Artificial Sequence
  chemically synthesized
ttatttttcaatttcctcct

SEQ ID NO: 423775 - DNA, 20 bp, Artificial Sequence
  chemically synthesized
aatgcatgtacaaactaagg

SEQ ID NO: 423776 - DNA, 20 bp, Artificial Sequence
  chemically synthesized
aaatgcatgtacaaactaag

SEQ ID NO: 423777 - DNA, 20 bp, Artificial Sequence
  chemically synthesized
ctaaatgcatgtacaaacta

SEQ ID NO: 423778 - DNA, 20 bp, Artificial Sequence
  chemically synthesized
tctaaatgcatgtacaaact

SEQ ID NO: 423779 - DNA, 20 bp, Artificial Sequence
  chemically synthesized
ccttagtttgtacatgcatt

SEQ ID NO: 423780 - DNA, 20 bp, Artificial Sequence
  chemically synthesized
ttagtttgtacatgcattta

SEQ ID NO: 423781 - DNA, 20 bp, Artificial Sequence
  chemically synthesized
catgcatttagagataatct

SEQ ID NO: 423782 - DNA, 20 bp, Artificial Sequence
  chemically synthesized
ccaagctcgctgacattgct

SEQ ID NO: 423783 - DNA, 20 bp, Artificial Sequence
  chemically synthesized
agagataatctcagcaatgt

SEQ ID NO: 423784 - DNA, 20 bp, Artificial Sequence
  chemically synthesized
ataatctcagcaatgtcagc

SEQ ID NO: 423785 - DNA, 20 bp, Artificial Sequence
  chemically synthesized
ctcagcaatgtcagcgagct

SEQ ID NO: 423786 - DNA, 20 bp, Artificial Sequence
  chemically synthesized
agcaatgtcagcgagcttgg

SEQ ID NO: 423787 - DNA, 20 bp, Artificial Sequence
  chemically synthesized
tgtcagcgagcttggtggca

SEQ ID NO: 423788 - DNA, 20 bp, Artificial Sequence
  chemically synthesized
acagcttgaactatgccacc

SEQ ID NO: 423789 - DNA, 20 bp, Artificial Sequence
  chemically synthesized
cgagcttggtggcatagttc

SEQ ID NO: 423790 - DNA, 20 bp, Artificial Sequence
  chemically synthesized
gtggcatagttcaagctgtg

SEQ ID NO: 423791 - DNA, 20 bp, Artificial Sequence
  chemically synthesized
tggcatagttcaagctgtga

SEQ ID NO: 423792 - DNA, 20 bp, Artificial Sequence
  chemically synthesized
acctatttattgaaccttca

SEQ ID NO: 423793 - DNA, 20 bp, Artificial Sequence
  chemically synthesized
agctgtgaaggttcaataaa

SEQ ID NO: 423794 - DNA, 20 bp, Artificial Sequence
  chemically synthesized
gctgtgaaggttcaataaat

SEQ ID NO: 423795 - DNA, 20 bp, Artificial Sequence
  chemically synthesized
tgaaggttcaataaataggt

SEQ ID NO: 423796 - DNA, 20 bp, Artificial Sequence
  chemically synthesized
gtaaacattgcaaatcaaca

SEQ ID NO: 423797 - DNA, 20 bp, Artificial Sequence
  chemically synthesized
cttgcctgacatttcatcaa

SEQ ID NO: 423798 - DNA, 20 bp, Artificial Sequence
  chemically synthesized
cacagcttttgatgaaatgt

SEQ ID NO: 423799 - DNA, 20 bp, Artificial Sequence
  chemically synthesized
acagcttttgatgaaatgtc

SEQ ID NO: 423800 - DNA, 20 bp, Artificial Sequence
  chemically synthesized
cttttgatgaaatgtcaggc

SEQ ID NO: 423801 - DNA, 20 bp, Artificial Sequence
  chemically synthesized
tgatgaaatgtcaggcaaga

SEQ ID NO: 423802 - DNA, 20 bp, Artificial Sequence
  chemically synthesized
gatgaaatgtcaggcaagac

SEQ ID NO: 423803 - DNA, 20 bp, Artificial Sequence
  chemically synthesized
atgaaatgtcaggcaagaca

SEQ ID NO: 423804 - DNA, 20 bp, Artificial Sequence
  chemically synthesized
atgtcaggcaagacagggct

SEQ ID NO: 423805 - DNA, 20 bp, Artificial Sequence
  chemically synthesized
aagctgagccgaatatagct

SEQ ID NO: 423806 - DNA, 20 bp, Artificial Sequence
  chemically synthesized
agacagggcttagctatatt

SEQ ID NO: 423807 - DNA, 20 bp, Artificial Sequence
  chemically synthesized
agttcaagctgagccgaata

SEQ ID NO: 423808 - DNA, 20 bp, Artificial Sequence
  chemically synthesized
gggcttagctatattcggct

SEQ ID NO: 423809 - DNA, 20 bp, Artificial Sequence
  chemically synthesized
atggtttatgagttcaagct

SEQ ID NO: 423810 - DNA, 20 bp, Artificial Sequence
  chemically synthesized
agttgatggtttatgagttc

SEQ ID NO: 423811 - DNA, 20 bp, Artificial Sequence
  chemically synthesized
gaggccagttgatggtttat

SEQ ID NO: 423812 - DNA, 20 bp, Artificial Sequence
  chemically synthesized
tgaactcataaaccatcaac

SEQ ID NO: 423813 - DNA, 20 bp, Artificial Sequence
  chemically synthesized
gaagtacagaggccagttga

SEQ ID NO: 423814 - DNA, 20 bp, Artificial Sequence
  chemically synthesized
tgtcctggaagtacagaggc

SEQ ID NO: 423815 - DNA, 20 bp, Artificial Sequence
  chemically synthesized
agattgtcctggaagtacag

SEQ ID NO: 423816 - DNA, 20 bp, Artificial Sequence
  chemically synthesized
cagattgtcctggaagtaca

SEQ ID NO: 423817 - DNA, 20 bp, Artificial Sequence
  chemically synthesized
tcaactggcctctgtacttc

SEQ ID NO: 423818 - DNA, 20 bp, Artificial Sequence
  chemically synthesized
caactggcctctgtacttcc

SEQ ID NO: 423819 - DNA, 20 bp, Artificial Sequence
  chemically synthesized
atcagattgtcctggaagta

SEQ ID NO: 423820 - DNA, 20 bp, Artificial Sequence
  chemically synthesized
tattcatcagattgtcctgg

SEQ ID NO: 423821 - DNA, 20 bp, Artificial Sequence
  chemically synthesized
ttttattcatcagattgtcc

SEQ ID NO: 423822 - DNA, 20 bp, Artificial Sequence
  chemically synthesized
tatatctgtattttattcat

SEQ ID NO: 423823 - DNA, 20 bp, Artificial Sequence
  chemically synthesized
acaatctgatgaataaaata

SEQ ID NO: 423824 - DNA, 20 bp, Artificial Sequence
  chemically synthesized
aattaaaaaatatatttata

SEQ ID NO: 423825 - DNA, 20 bp, Artificial Sequence
  chemically synthesized
ttaaaaaatatatttataaa

SEQ ID NO: 423826 - DNA, 20 bp, Artificial Sequence
  chemically synthesized
aaatatatttataaagagat

SEQ ID NO: 423827 - DNA, 20 bp, Artificial Sequence
  chemically synthesized
ttataaagagattagtaaaa

SEQ ID NO: 423828 - DNA, 20 bp, Artificial Sequence
  chemically synthesized
ttagtaaaacagcaatctgt

SEQ ID NO: 423829 - DNA, 20 bp, Artificial Sequence
  chemically synthesized
taaaacagcaatctgtaagt

SEQ ID NO: 423830 - DNA, 20 bp, Artificial Sequence
  chemically synthesized
tggttgtcatttctcactta

SEQ ID NO: 423831 - DNA, 20 bp, Artificial Sequence
  chemically synthesized
agtgagaaatgacaaccact

SEQ ID NO: 423832 - DNA, 20 bp, Artificial Sequence
  chemically synthesized
gaaatgacaaccacttagtc

SEQ ID NO: 423833 - DNA, 20 bp, Artificial Sequence
  chemically synthesized
ctcatttggtctggactaag

SEQ ID NO: 423834 - DNA, 20 bp, Artificial Sequence
  chemically synthesized
tctctcatttggtctggact

SEQ ID NO: 423835 - DNA, 20 bp, Artificial Sequence
  chemically synthesized
gtcttctctctcatttggtc

SEQ ID NO: 423836 - DNA, 20 bp, Artificial Sequence
  chemically synthesized
ccacttagtccagaccaaat

SEQ ID NO: 423837 - DNA, 20 bp, Artificial Sequence
  chemically synthesized
acttagtccagaccaaatga

SEQ ID NO: 423838 - DNA, 20 bp, Artificial Sequence
  chemically synthesized
ttagtccagaccaaatgaga

SEQ ID NO: 423839 - DNA, 20 bp, Artificial Sequence
  chemically synthesized
tgcaagtcttctctctcatt

SEQ ID NO: 423840 - DNA, 20 bp, Artificial Sequence
  chemically synthesized
gtccagaccaaatgagagag

SEQ ID NO: 423841 - DNA, 20 bp, Artificial Sequence
  chemically synthesized
atgagagagaagacttgcaa

SEQ ID NO: 423842 - DNA, 20 bp, Artificial Sequence
  chemically synthesized
tgagagagaagacttgcaaa

SEQ ID NO: 423843 - DNA, 20 bp, Artificial Sequence
  chemically synthesized
gagagagaagacttgcaaaa

SEQ ID NO: 423844 - DNA, 20 bp, Artificial Sequence
  chemically synthesized
aagaaaagttacccttttgc

SEQ ID NO: 423845 - DNA, 20 bp, Artificial Sequence
  chemically synthesized
cataacttgatttgtaagaa

SEQ ID NO: 423846 - DNA, 20 bp, Artificial Sequence
  chemically synthesized
ggtaacttttcttacaaatc

SEQ ID NO: 423847 - DNA, 20 bp, Artificial Sequence
  chemically synthesized
tttcccataacttgatttgt

SEQ ID NO: 423848 - DNA, 20 bp, Artificial Sequence
  chemically synthesized
ttttcttacaaatcaagtta

SEQ ID NO: 423849 - DNA, 20 bp, Artificial Sequence
  chemically synthesized
tttcttacaaatcaagttat

SEQ ID NO: 423850 - DNA, 20 bp, Artificial Sequence
  chemically synthesized
atcaagttatgggaaaattt

SEQ ID NO: 423851 - DNA, 20 bp, Artificial Sequence
  chemically synthesized
gggaaaatttgagatccaaa

SEQ ID NO: 423852 - DNA, 20 bp, Artificial Sequence
  chemically synthesized
tccaaagttaaaagtctatt

SEQ ID NO: 423853 - DNA, 20 bp, Artificial Sequence
  chemically synthesized
tccaaatagacttttaactt

SEQ ID NO: 423854 - DNA, 20 bp, Artificial Sequence
  chemically synthesized
taaagacaatccaaagttaa

SEQ ID NO: 423855 - DNA, 20 bp, Artificial Sequence
  chemically synthesized
ttgggaataaagacaatcca

SEQ ID NO: 423856 - DNA, 20 bp, Artificial Sequence
  chemically synthesized
aaaaacgtgtgttgggaata

SEQ ID NO: 423857 - DNA, 20 bp, Artificial Sequence
  chemically synthesized
ttaaattaaaaacgtgtgtt

SEQ ID NO: 423858 - DNA, 20 bp, Artificial Sequence
  chemically synthesized
attaaattaaaaacgtgtgt

SEQ ID NO: 423859 - DNA, 20 bp, Artificial Sequence
  chemically synthesized
cacacgtttttaatttaatg

SEQ ID NO: 423860 - DNA, 20 bp, Artificial Sequence
  chemically synthesized
gagctaaaagagttaggata

SEQ ID NO: 423861 - DNA, 20 bp, Artificial Sequence
  chemically synthesized
gggggtgagctaaaagagtt

SEQ ID NO: 423862 - DNA, 20 bp, Artificial Sequence
  chemically synthesized
gtactttatcctaactcttt

SEQ ID NO: 423863 - DNA, 20 bp, Artificial Sequence
  chemically synthesized
ggggggtgagctaaaagagt

SEQ ID NO: 423864 - DNA, 20 bp, Artificial Sequence
  chemically synthesized
ttcaggggggtgagctaaaa

SEQ ID NO: 423865 - DNA, 20 bp, Artificial Sequence
  chemically synthesized
ttttcaggggggtgagctaa

SEQ ID NO: 423866 - DNA, 20 bp, Artificial Sequence
  chemically synthesized
agtttttttttcaggggggt

SEQ ID NO: 423867 - DNA, 20 bp, Artificial Sequence
  chemically synthesized
agctagtttttttttcaggg

SEQ ID NO: 423868 - DNA, 20 bp, Artificial Sequence
  chemically synthesized
cagctagtttttttttcagg

SEQ ID NO: 423869 - DNA, 20 bp, Artificial Sequence
  chemically synthesized
acagctagtttttttttcag

SEQ ID NO: 423870 - DNA, 20 bp, Artificial Sequence
  chemically synthesized
gacagctagtttttttttca

SEQ ID NO: 423871 - DNA, 20 bp, Artificial Sequence
  chemically synthesized
agacagctagtttttttttc

SEQ ID NO: 423872 - DNA, 20 bp, Artificial Sequence
  chemically synthesized
aagacagctagttttttttt

SEQ ID NO: 423873 - DNA, 20 bp, Artificial Sequence
  chemically synthesized
cacccccctgaaaaaaaaac

SEQ ID NO: 423874 - DNA, 20 bp, Artificial Sequence
  chemically synthesized
tctatctttaggaagacagc

SEQ ID NO: 423875 - DNA, 20 bp, Artificial Sequence
  chemically synthesized
tttctctatctttaggaaga

SEQ ID NO: 423876 - DNA, 20 bp, Artificial Sequence
  chemically synthesized
aaaaactagctgtcttccta

SEQ ID NO: 423877 - DNA, 20 bp, Artificial Sequence
  chemically synthesized
aagttttctctatctttagg

SEQ ID NO: 423878 - DNA, 20 bp, Artificial Sequence
  chemically synthesized
actagctgtcttcctaaaga

SEQ ID NO: 423879 - DNA, 20 bp, Artificial Sequence
  chemically synthesized
tagctgtcttcctaaagata

SEQ ID NO: 423880 - DNA, 20 bp, Artificial Sequence
  chemically synthesized
gacaagttttctctatcttt

SEQ ID NO: 423881 - DNA, 20 bp, Artificial Sequence
  chemically synthesized
ggacaagttttctctatctt

SEQ ID NO: 423882 - DNA, 20 bp, Artificial Sequence
  chemically synthesized
aagatagagaaaacttgtcc

SEQ ID NO: 423883 - DNA, 20 bp, Artificial Sequence
  chemically synthesized
aaagagtttctgacttggac

SEQ ID NO: 423884 - DNA, 20 bp, Artificial Sequence
  chemically synthesized
tagagaaaacttgtccaagt

SEQ ID NO: 423885 - DNA, 20 bp, Artificial Sequence
  chemically synthesized
attccaaagagtttctgact

SEQ ID NO: 423886 - DNA, 20 bp, Artificial Sequence
  chemically synthesized
tgtccaagtcagaaactctt

SEQ ID NO: 423887 - DNA, 20 bp, Artificial Sequence
  chemically synthesized
acttttattaaaattccaaa

SEQ ID NO: 423888 - DNA, 20 bp, Artificial Sequence
  chemically synthesized
ttacttttattaaaattcca

SEQ ID NO: 423889 - DNA, 20 bp, Artificial Sequence
  chemically synthesized
actctttggaattttaataa

SEQ ID NO: 423890 - DNA, 20 bp, Artificial Sequence
  chemically synthesized
ttaataaaagtaacataatt

SEQ ID NO: 423891 - DNA, 20 bp, Artificial Sequence
  chemically synthesized
atatactgtcagtatatttg

SEQ ID NO: 423892 - DNA, 20 bp, Artificial Sequence
  chemically synthesized
atatacttcaaatatactga

SEQ ID NO: 423893 - DNA, 20 bp, Artificial Sequence
  chemically synthesized
ctgttgccaatatatactgt

SEQ ID NO: 423894 - DNA, 20 bp, Artificial Sequence
  chemically synthesized
aatatactgacagtatatat

SEQ ID NO: 423895 - DNA, 20 bp, Artificial Sequence
  chemically synthesized
ctgacagtatatattggcaa

SEQ ID NO: 423896 - DNA, 20 bp, Artificial Sequence
  chemically synthesized
caacagaatatatgctaatt

SEQ ID NO: 423897 - DNA, 20 bp, Artificial Sequence
  chemically synthesized
aatatcctaaaattctaaat

SEQ ID NO: 423898 - DNA, 20 bp, Artificial Sequence
  chemically synthesized
tatatgctaatttagaattt

SEQ ID NO: 423899 - DNA, 20 bp, Artificial Sequence
  chemically synthesized
atatgctaatttagaatttt

SEQ ID NO: 423900 - DNA, 20 bp, Artificial Sequence
  chemically synthesized
atcaggtttttttttaatta

SEQ ID NO: 423901 - DNA, 20 bp, Artificial Sequence
  chemically synthesized
aaaaggtgtagtgatttatc

SEQ ID NO: 423902 - DNA, 20 bp, Artificial Sequence
  chemically synthesized
gaaaaggtgtagtgatttat

SEQ ID NO: 423903 - DNA, 20 bp, Artificial Sequence
  chemically synthesized
ctaaataaagtgaaaaggtg

SEQ ID NO: 423904 - DNA, 20 bp, Artificial Sequence
  chemically synthesized
agcttctaaataaagtgaaa

SEQ ID NO: 423905 - DNA, 20 bp, Artificial Sequence
  chemically synthesized
tagcttctaaataaagtgaa

SEQ ID NO: 423906 - DNA, 20 bp, Artificial Sequence
  chemically synthesized
ctacaccttttcactttatt

SEQ ID NO: 423907 - DNA, 20 bp, Artificial Sequence
  chemically synthesized
caccttttcactttatttag

SEQ ID NO: 423908 - DNA, 20 bp, Artificial Sequence
  chemically synthesized
taaatggtagcttctaaata

SEQ ID NO: 423909 - DNA, 20 bp, Artificial Sequence
  chemically synthesized
aaacacttattattaaatgg

SEQ ID NO: 423910 - DNA, 20 bp, Artificial Sequence
  chemically synthesized
gttaaacacttattattaaa

SEQ ID NO: 423911 - DNA, 20 bp, Artificial Sequence
  chemically synthesized
agaagctaccatttaataat

SEQ ID NO: 423912 - DNA, 20 bp, Artificial Sequence
  chemically synthesized
atatctcagaatgattttag

SEQ ID NO: 423913 - DNA, 20 bp, Artificial Sequence
  chemically synthesized
aatatctcagaatgatttta

SEQ ID NO: 423914 - DNA, 20 bp, Artificial Sequence
  chemically synthesized
gaaatatctcagaatgattt

SEQ ID NO: 423915 - DNA, 20 bp, Artificial Sequence
  chemically synthesized
ttaacctctaaaatcattct

SEQ ID NO: 423916 - DNA, 20 bp, Artificial Sequence
  chemically synthesized
cctaattatctgaaatatct

SEQ ID NO: 423917 - DNA, 20 bp, Artificial Sequence
  chemically synthesized
aaaatcattctgagatattt

SEQ ID NO: 423918 - DNA, 20 bp, Artificial Sequence
  chemically synthesized
tctgagatatttcagataat

SEQ ID NO: 423919 - DNA, 20 bp, Artificial Sequence
  chemically synthesized
ctgagatatttcagataatt

SEQ ID NO: 423920 - DNA, 20 bp, Artificial Sequence
  chemically synthesized
agatatttcagataattagg

SEQ ID NO: 423921 - DNA, 20 bp, Artificial Sequence
  chemically synthesized
tttcagataattaggcagcc

SEQ ID NO: 423922 - DNA, 20 bp, Artificial Sequence
  chemically synthesized
caattgtaaacagtaattcc

SEQ ID NO: 423923 - DNA, 20 bp, Artificial Sequence
  chemically synthesized
acaattgtaaacagtaattc

SEQ ID NO: 423924 - DNA, 20 bp, Artificial Sequence
  chemically synthesized
caaactgggacaattgtaaa

SEQ ID NO: 423925 - DNA, 20 bp, Artificial Sequence
  chemically synthesized
attactgtttacaattgtcc

SEQ ID NO: 423926 - DNA, 20 bp, Artificial Sequence
  chemically synthesized
aacttattaggaagcaaact

SEQ ID NO: 423927 - DNA, 20 bp, Artificial Sequence
  chemically synthesized
caacttattaggaagcaaac

SEQ ID NO: 423928 - DNA, 20 bp, Artificial Sequence
  chemically synthesized
gtcccagtttgcttcctaat

SEQ ID NO: 423929 - DNA, 20 bp, Artificial Sequence
  chemically synthesized
gacaagcacaacttattagg

SEQ ID NO: 423930 - DNA, 20 bp, Artificial Sequence
  chemically synthesized
ttagacaagcacaacttatt

SEQ ID NO: 423931 - DNA, 20 bp, Artificial Sequence
  chemically synthesized
tttagacaagcacaacttat

SEQ ID NO: 423932 - DNA, 20 bp, Artificial Sequence
  chemically synthesized
taatttagacatgtttagac

SEQ ID NO: 423933 - DNA, 20 bp, Artificial Sequence
  chemically synthesized
aatagtaatttagacatgtt

SEQ ID NO: 423934 - DNA, 20 bp, Artificial Sequence
  chemically synthesized
gatccttgtgaatagtaatt

SEQ ID NO: 423935 - DNA, 20 bp, Artificial Sequence
  chemically synthesized
atgtctaaattactattcac

SEQ ID NO: 423936 - DNA, 20 bp, Artificial Sequence
  chemically synthesized
tgtctaaattactattcaca

SEQ ID NO: 423937 - DNA, 20 bp, Artificial Sequence
  chemically synthesized
ataacaaggatccttgtgaa

SEQ ID NO: 423938 - DNA, 20 bp, Artificial Sequence
  chemically synthesized
caaagaagacggaaataaca

SEQ ID NO: 423939 - DNA, 20 bp, Artificial Sequence
  chemically synthesized
tcaaagaagacggaaataac

SEQ ID NO: 423940 - DNA, 20 bp, Artificial Sequence
  chemically synthesized
aagtttttaatcaaagaaga

SEQ ID NO: 423941 - DNA, 20 bp, Artificial Sequence
  chemically synthesized
taagaagtttttaatcaaag

SEQ ID NO: 423942 - DNA, 20 bp, Artificial Sequence
  chemically synthesized
ttttaagaagtttttaatca

SEQ ID NO: 423943 - DNA, 20 bp, Artificial Sequence
  chemically synthesized
tatacactcacatttttaag

SEQ ID NO: 423944 - DNA, 20 bp, Artificial Sequence
  chemically synthesized
acatatacactcacattttt

SEQ ID NO: 423945 - DNA, 20 bp, Artificial Sequence
  chemically synthesized
taaaaacttcttaaaaatgt

SEQ ID NO: 423946 - DNA, 20 bp, Artificial Sequence
  chemically synthesized
atgtacatatatgcataaat

SEQ ID NO: 423947 - DNA, 20 bp, Artificial Sequence
  chemically synthesized
tgtgtttcacatatatatat

SEQ ID NO: 423948 - DNA, 20 bp, Artificial Sequence
  chemically synthesized
ctgtgtttcacatatatata

SEQ ID NO: 423949 - DNA, 20 bp, Artificial Sequence
  chemically synthesized
ccatatatatatgtgaaaca

SEQ ID NO: 423950 - DNA, 20 bp, Artificial Sequence
  chemically synthesized
catatatatatgtgaaacac

SEQ ID NO: 423951 - DNA, 20 bp, Artificial Sequence
  chemically synthesized
agggatttttatattaacaa

SEQ ID NO: 423952 - DNA, 20 bp, Artificial Sequence
  chemically synthesized
ttaatataaaaatccctcat

SEQ ID NO: 423953 - DNA, 20 bp, Artificial Sequence
  chemically synthesized
actcattagaaaactaatga

SEQ ID NO: 423954 - DNA, 20 bp, Artificial Sequence
  chemically synthesized
aactcattagaaaactaatg

SEQ ID NO: 423955 - DNA, 20 bp, Artificial Sequence
  chemically synthesized
aaactcattagaaaactaat

SEQ ID NO: 423956 - DNA, 20 bp, Artificial Sequence
  chemically synthesized
tccctcattagttttctaat

SEQ ID NO: 423957 - DNA, 20 bp, Artificial Sequence
  chemically synthesized
gactacattcataaactcat

SEQ ID NO: 423958 - DNA, 20 bp, Artificial Sequence
  chemically synthesized
ttctaatgagtttatgaatg

SEQ ID NO: 423959 - DNA, 20 bp, Artificial Sequence
  chemically synthesized
atgaatgtagtctacgtcct

SEQ ID NO: 423960 - DNA, 20 bp, Artificial Sequence
  chemically synthesized
aaattaaatttctaaggacg

SEQ ID NO: 423961 - DNA, 20 bp, Artificial Sequence
  chemically synthesized
tacctcaaattaaatttcta

SEQ ID NO: 423962 - DNA, 20 bp, Artificial Sequence
  chemically synthesized
ttacctcaaattaaatttct

SEQ ID NO: 423963 - DNA, 20 bp, Artificial Sequence
  chemically synthesized
cgtccttagaaatttaattt

SEQ ID NO: 423964 - DNA, 20 bp, Artificial Sequence
  chemically synthesized
gtccttagaaatttaatttg

SEQ ID NO: 423965 - DNA, 20 bp, Artificial Sequence
  chemically synthesized
ggtaaaaatattatcgttta

SEQ ID NO: 423966 - DNA, 20 bp, Artificial Sequence
  chemically synthesized
aatattatcgtttatagatt

SEQ ID NO: 423967 - DNA, 20 bp, Artificial Sequence
  chemically synthesized
atattatcgtttatagatta

SEQ ID NO: 423968 - DNA, 20 bp, Artificial Sequence
  chemically synthesized
atcgtttatagattaaggtc

SEQ ID NO: 423969 - DNA, 20 bp, Artificial Sequence
  chemically synthesized
gaagaaaagaaaaaaatatc

SEQ ID NO: 423970 - DNA, 20 bp, Artificial Sequence
  chemically synthesized
attatttctagtatgaagaa

SEQ ID NO: 423971 - DNA, 20 bp, Artificial Sequence
  chemically synthesized
tttttttcttttcttcatac

SEQ ID NO: 423972 - DNA, 20 bp, Artificial Sequence
  chemically synthesized
ctaaaattatttctagtatg

SEQ ID NO: 423973 - DNA, 20 bp, Artificial Sequence
  chemically synthesized
caggtatctaaaattatttc

SEQ ID NO: 423974 - DNA, 20 bp, Artificial Sequence
  chemically synthesized
cttcatactagaaataattt

SEQ ID NO: 423975 - DNA, 20 bp, Artificial Sequence
  chemically synthesized
gaaataattttagatacctg

SEQ ID NO: 423976 - DNA, 20 bp, Artificial Sequence
  chemically synthesized
attttagatacctgaagaca

SEQ ID NO: 423977 - DNA, 20 bp, Artificial Sequence
  chemically synthesized
ctttaatgaactttgtcttc

SEQ ID NO: 423978 - DNA, 20 bp, Artificial Sequence
  chemically synthesized
gctttaatgaactttgtctt

SEQ ID NO: 423979 - DNA, 20 bp, Artificial Sequence
  chemically synthesized
cctgaagacaaagttcatta

SEQ ID NO: 423980 - DNA, 20 bp, Artificial Sequence
  chemically synthesized
atattctactttttgggttg

SEQ ID NO: 423981 - DNA, 20 bp, Artificial Sequence
  chemically synthesized
cattaaagccacaacccaaa

SEQ ID NO: 423982 - DNA, 20 bp, Artificial Sequence
  chemically synthesized
taaagccacaacccaaaaag

SEQ ID NO: 423983 - DNA, 20 bp, Artificial Sequence
  chemically synthesized
gaacccatattctacttttt

SEQ ID NO: 423984 - DNA, 20 bp, Artificial Sequence
  chemically synthesized
ggaacccatattctactttt

SEQ ID NO: 423985 - DNA, 20 bp, Artificial Sequence
  chemically synthesized
acaacccaaaaagtagaata

SEQ ID NO: 423986 - DNA, 20 bp, Artificial Sequence
  chemically synthesized
caacccaaaaagtagaatat

SEQ ID NO: 423987 - DNA, 20 bp, Artificial Sequence
  chemically synthesized
tgcaaatcactgaaataaga

SEQ ID NO: 423988 - DNA, 20 bp, Artificial Sequence
  chemically synthesized
atatgggttccttcttattt

SEQ ID NO: 423989 - DNA, 20 bp, Artificial Sequence
  chemically synthesized
atgcaaatcactgaaataag

SEQ ID NO: 423990 - DNA, 20 bp, Artificial Sequence
  chemically synthesized
ataatgcaaatcactgaaat

SEQ ID NO: 423991 - DNA, 20 bp, Artificial Sequence
  chemically synthesized
cagtgatttgcattatccta

SEQ ID NO: 423992 - DNA, 20 bp, Artificial Sequence
  chemically synthesized
agtgatttgcattatcctat

SEQ ID NO: 423993 - DNA, 20 bp, Artificial Sequence
  chemically synthesized
gtttgacaccaataacctat

SEQ ID NO: 423994 - DNA, 20 bp, Artificial Sequence
  chemically synthesized
ggtttgacaccaataaccta

SEQ ID NO: 423995 - DNA, 20 bp, Artificial Sequence
  chemically synthesized
tgcattatcctataggttat

SEQ ID NO: 423996 - DNA, 20 bp, Artificial Sequence
  chemically synthesized
ttgtgaggaagggaagaaag

SEQ ID NO: 423997 - DNA, 20 bp, Artificial Sequence
  chemically synthesized
gttgtgaggaagggaagaaa

SEQ ID NO: 423998 - DNA, 20 bp, Artificial Sequence
  chemically synthesized
tgttgtgaggaagggaagaa

SEQ ID NO: 423999 - DNA, 20 bp, Artificial Sequence
  chemically synthesized
ttgttgtgaggaagggaaga

SEQ ID NO: 424000 - DNA, 20 bp, Artificial Sequence
  chemically synthesized
gcttttgttgtgaggaaggg

SEQ ID NO: 424001 - DNA, 20 bp, Artificial Sequence
  chemically synthesized
ggggcttttgttgtgaggaa

SEQ ID NO: 424002 - DNA, 20 bp, Artificial Sequence
  chemically synthesized
tggggcttttgttgtgagga

SEQ ID NO: 424003 - DNA, 20 bp, Artificial Sequence
  chemically synthesized
ttggggcttttgttgtgagg

SEQ ID NO: 424004 - DNA, 20 bp, Artificial Sequence
  chemically synthesized
aaattggggcttttgttgtg

SEQ ID NO: 424005 - DNA, 20 bp, Artificial Sequence
  chemically synthesized
tcttcccttcctcacaacaa

SEQ ID NO: 424006 - DNA, 20 bp, Artificial Sequence
  chemically synthesized
taaattggggcttttgttgt

SEQ ID NO: 424007 - DNA, 20 bp, Artificial Sequence
  chemically synthesized
tttctataaaagttaaattg

SEQ ID NO: 424008 - DNA, 20 bp, Artificial Sequence
  chemically synthesized
ctttctataaaagttaaatt

SEQ ID NO: 424009 - DNA, 20 bp, Artificial Sequence
  chemically synthesized
cctttctataaaagttaaat

SEQ ID NO: 424010 - DNA, 20 bp, Artificial Sequence
  chemically synthesized
aagccccaatttaactttta

SEQ ID NO: 424011 - DNA, 20 bp, Artificial Sequence
  chemically synthesized
cccaatttaacttttataga

SEQ ID NO: 424012 - DNA, 20 bp, Artificial Sequence
  chemically synthesized
ttccatatgcctttctataa

SEQ ID NO: 424013 - DNA, 20 bp, Artificial Sequence
  chemically synthesized
ccaatttaacttttatagaa

SEQ ID NO: 424014 - DNA, 20 bp, Artificial Sequence
  chemically synthesized
aacttttatagaaaggcata

SEQ ID NO: 424015 - DNA, 20 bp, Artificial Sequence
  chemically synthesized
ttatagaaaggcatatggaa

SEQ ID NO: 424016 - DNA, 20 bp, Artificial Sequence
  chemically synthesized
tatagaaaggcatatggaac

SEQ ID NO: 424017 - DNA, 20 bp, Artificial Sequence
  chemically synthesized
tagaaaggcatatggaacag

SEQ ID NO: 424018 - DNA, 20 bp, Artificial Sequence
  chemically synthesized
tgcaacccctgggatatatt

SEQ ID NO: 424019 - DNA, 20 bp, Artificial Sequence
  chemically synthesized
ggagtcatccaaatatatcc

SEQ ID NO: 424020 - DNA, 20 bp, Artificial Sequence
  chemically synthesized
gagtcatccaaatatatccc

SEQ ID NO: 424021 - DNA, 20 bp, Artificial Sequence
  chemically synthesized
agtcatccaaatatatccca

SEQ ID NO: 424022 - DNA, 20 bp, Artificial Sequence
  chemically synthesized
gtcatccaaatatatcccag

SEQ ID NO: 424023 - DNA, 20 bp, Artificial Sequence
  chemically synthesized
ttggtcaatttgcaacccct

SEQ ID NO: 424024 - DNA, 20 bp, Artificial Sequence
  chemically synthesized
tttggtcaatttgcaacccc

SEQ ID NO: 424025 - DNA, 20 bp, Artificial Sequence
  chemically synthesized
aggggttgcaaattgaccaa

SEQ ID NO: 424026 - DNA, 20 bp, Artificial Sequence
  chemically synthesized
gggttgcaaattgaccaaaa

SEQ ID NO: 424027 - DNA, 20 bp, Artificial Sequence
  chemically synthesized
ttccctaaaggtgactcttt

SEQ ID NO: 424028 - DNA, 20 bp, Artificial Sequence
  chemically synthesized
ttgaccaaaagagtcacctt

SEQ ID NO: 424029 - DNA, 20 bp, Artificial Sequence
  chemically synthesized
tgaccaaaagagtcaccttt

SEQ ID NO: 424030 - DNA, 20 bp, Artificial Sequence
  chemically synthesized
gaccaaaagagtcaccttta

SEQ ID NO: 424031 - DNA, 20 bp, Artificial Sequence
  chemically synthesized
caaaagagtcacctttaggg

SEQ ID NO: 424032 - DNA, 20 bp, Artificial Sequence
  chemically synthesized
tcagaagcaggcttccctaa

SEQ ID NO: 424033 - DNA, 20 bp, Artificial Sequence
  chemically synthesized
ttcagaagcaggcttcccta

SEQ ID NO: 424034 - DNA, 20 bp, Artificial Sequence
  chemically synthesized
ttccacaagcattcagaagc

SEQ ID NO: 424035 - DNA, 20 bp, Artificial Sequence
  chemically synthesized
attccacaagcattcagaag

SEQ ID NO: 424036 - DNA, 20 bp, Artificial Sequence
  chemically synthesized
taaattccacaagcattcag

SEQ ID NO: 424037 - DNA, 20 bp, Artificial Sequence
  chemically synthesized
tgataaattccacaagcatt

SEQ ID NO: 424038 - DNA, 20 bp, Artificial Sequence
  chemically synthesized
agcctgcttctgaatgcttg

SEQ ID NO: 424039 - DNA, 20 bp, Artificial Sequence
  chemically synthesized
agaagaatgataaattccac

SEQ ID NO: 424040 - DNA, 20 bp, Artificial Sequence
  chemically synthesized
gaatttatcattcttctgaa

SEQ ID NO: 424041 - DNA, 20 bp, Artificial Sequence
  chemically synthesized
taaatgcaacagccattcag

SEQ ID NO: 424042 - DNA, 20 bp, Artificial Sequence
  chemically synthesized
agataaatgcaacagccatt

SEQ ID NO: 424043 - DNA, 20 bp, Artificial Sequence
  chemically synthesized
aaagctgcagataaatgcaa

SEQ ID NO: 424044 - DNA, 20 bp, Artificial Sequence
  chemically synthesized
atggctgttgcatttatctg

SEQ ID NO: 424045 - DNA, 20 bp, Artificial Sequence
  chemically synthesized
catctggtgagtaaaagctg

SEQ ID NO: 424046 - DNA, 20 bp, Artificial Sequence
  chemically synthesized
aggtctcatctggtgagtaa

SEQ ID NO: 424047 - DNA, 20 bp, Artificial Sequence
  chemically synthesized
tatctgcagcttttactcac

SEQ ID NO: 424048 - DNA, 20 bp, Artificial Sequence
  chemically synthesized
gcagcttttactcaccagat

SEQ ID NO: 424049 - DNA, 20 bp, Artificial Sequence
  chemically synthesized
tgtctgaggtctcatctggt

SEQ ID NO: 424050 - DNA, 20 bp, Artificial Sequence
  chemically synthesized
gaaatgtctgaggtctcatc

SEQ ID NO: 424051 - DNA, 20 bp, Artificial Sequence
  chemically synthesized
ttactcaccagatgagacct

SEQ ID NO: 424052 - DNA, 20 bp, Artificial Sequence
  chemically synthesized
cgcagaatttgaaatgtctg

SEQ ID NO: 424053 - DNA, 20 bp, Artificial Sequence
  chemically synthesized
ccgcagaatttgaaatgtct

SEQ ID NO: 424054 - DNA, 20 bp, Artificial Sequence
  chemically synthesized
ctcagacatttcaaattctg

SEQ ID NO: 424055 - DNA, 20 bp, Artificial Sequence
  chemically synthesized
cagacatttcaaattctgcg

SEQ ID NO: 424056 - DNA, 20 bp, Artificial Sequence
  chemically synthesized
agacatttcaaattctgcgg

SEQ ID NO: 424057 - DNA, 20 bp, Artificial Sequence
  chemically synthesized
atttcaaattctgcggaggc

SEQ ID NO: 424058 - DNA, 20 bp, Artificial Sequence
  chemically synthesized
aggtgtgtagccagcctccg

SEQ ID NO: 424059 - DNA, 20 bp, Artificial Sequence
  chemically synthesized
ttcctatgaaggtgtgtagc

SEQ ID NO: 424060 - DNA, 20 bp, Artificial Sequence
  chemically synthesized
agctttcctatgaaggtgtg

SEQ ID NO: 424061 - DNA, 20 bp, Artificial Sequence
  chemically synthesized
aggctggctacacaccttca

SEQ ID NO: 424062 - DNA, 20 bp, Artificial Sequence
  chemically synthesized
ggctggctacacaccttcat

SEQ ID NO: 424063 - DNA, 20 bp, Artificial Sequence
  chemically synthesized
agcaaaaagctttcctatga

SEQ ID NO: 424064 - DNA, 20 bp, Artificial Sequence
  chemically synthesized
ggctacacaccttcatagga

SEQ ID NO: 424065 - DNA, 20 bp, Artificial Sequence
  chemically synthesized
cagcaaaaagctttcctatg

SEQ ID NO: 424066 - DNA, 20 bp, Artificial Sequence
  chemically synthesized
ccaacagggaaatcagcaaa

SEQ ID NO: 424067 - DNA, 20 bp, Artificial Sequence
  chemically synthesized
aaaagtaccaacagggaaat

SEQ ID NO: 424068 - DNA, 20 bp, Artificial Sequence
  chemically synthesized
ctttttgctgatttccctgt

SEQ ID NO: 424069 - DNA, 20 bp, Artificial Sequence
  chemically synthesized
gtaagagaaaagtaccaaca

SEQ ID NO: 424070 - DNA, 20 bp, Artificial Sequence
  chemically synthesized
tgtaagagaaaagtaccaac

SEQ ID NO: 424071 - DNA, 20 bp, Artificial Sequence
  chemically synthesized
gtgtaagagaaaagtaccaa

SEQ ID NO: 424072 - DNA, 20 bp, Artificial Sequence
  chemically synthesized
ccatagaatgtgtaagagaa

SEQ ID NO: 424073 - DNA, 20 bp, Artificial Sequence
  chemically synthesized
ataccccatagaatgtgtaa

SEQ ID NO: 424074 - DNA, 20 bp, Artificial Sequence
  chemically synthesized
ccataccccatagaatgtgt

SEQ ID NO: 424075 - DNA, 20 bp, Artificial Sequence
  chemically synthesized
cttttctcttacacattcta

SEQ ID NO: 424076 - DNA, 20 bp, Artificial Sequence
  chemically synthesized
ttttctcttacacattctat

SEQ ID NO: 424077 - DNA, 20 bp, Artificial Sequence
  chemically synthesized
tttctcttacacattctatg

SEQ ID NO: 424078 - DNA, 20 bp, Artificial Sequence
  chemically synthesized
cttacacattctatggggta

SEQ ID NO: 424079 - DNA, 20 bp, Artificial Sequence
  chemically synthesized
tccaggtttaccatacccca

SEQ ID NO: 424080 - DNA, 20 bp, Artificial Sequence
  chemically synthesized
tctatggggtatggtaaacc

SEQ ID NO: 424081 - DNA, 20 bp, Artificial Sequence
  chemically synthesized
tatggggtatggtaaacctg

SEQ ID NO: 424082 - DNA, 20 bp, Artificial Sequence
  chemically synthesized
atggggtatggtaaacctgg

SEQ ID NO: 424083 - DNA, 20 bp, Artificial Sequence
  chemically synthesized
gggtatggtaaacctggagg

SEQ ID NO: 424084 - DNA, 20 bp, Artificial Sequence
  chemically synthesized
gtatggtaaacctggaggta

SEQ ID NO: 424085 - DNA, 20 bp, Artificial Sequence
  chemically synthesized
ttggctatgactctacctcc

SEQ ID NO: 424086 - DNA, 20 bp, Artificial Sequence
  chemically synthesized
cttggctatgactctacctc

SEQ ID NO: 424087 - DNA, 20 bp, Artificial Sequence
  chemically synthesized
taaacctggaggtagagtca

SEQ ID NO: 424088 - DNA, 20 bp, Artificial Sequence
  chemically synthesized
ctggaggtagagtcatagcc

SEQ ID NO: 424089 - DNA, 20 bp, Artificial Sequence
  chemically synthesized
ggtagagtcatagccaagca

SEQ ID NO: 424090 - DNA, 20 bp, Artificial Sequence
  chemically synthesized
gtgcctgctttatctgtgct

SEQ ID NO: 424091 - DNA, 20 bp, Artificial Sequence
  chemically synthesized
gtcatagccaagcacagata

SEQ ID NO: 424092 - DNA, 20 bp, Artificial Sequence
  chemically synthesized
atagccaagcacagataaag

SEQ ID NO: 424093 - DNA, 20 bp, Artificial Sequence
  chemically synthesized
tagccaagcacagataaagc

SEQ ID NO: 424094 - DNA, 20 bp, Artificial Sequence
  chemically synthesized
aagcacagataaagcaggca

SEQ ID NO: 424095 - DNA, 20 bp, Artificial Sequence
  chemically synthesized
gcaggcacagaatctctgac

SEQ ID NO: 424096 - DNA, 20 bp, Artificial Sequence
  chemically synthesized
tgcttttgtgaggctggtca

SEQ ID NO: 424097 - DNA, 20 bp, Artificial Sequence
  chemically synthesized
tctgcttttgtgaggctggt

SEQ ID NO: 424098 - DNA, 20 bp, Artificial Sequence
  chemically synthesized
tttgtctgcttttgtgaggc

SEQ ID NO: 424099 - DNA, 20 bp, Artificial Sequence
  chemically synthesized
atctctgaccagcctcacaa

SEQ ID NO: 424100 - DNA, 20 bp, Artificial Sequence
  chemically synthesized
tgtgtttgtctgcttttgtg

SEQ ID NO: 424101 - DNA, 20 bp, Artificial Sequence
  chemically synthesized
tctgaccagcctcacaaaag

SEQ ID NO: 424102 - DNA, 20 bp, Artificial Sequence
  chemically synthesized
gtgtgtttgtctgcttttgt

SEQ ID NO: 424103 - DNA, 20 bp, Artificial Sequence
  chemically synthesized
gtggaagaaacaggtgcaaa

SEQ ID NO: 424104 - DNA, 20 bp, Artificial Sequence
  chemically synthesized
gcaaccggagtggaagaaac

SEQ ID NO: 424105 - DNA, 20 bp, Artificial Sequence
  chemically synthesized
ggcaaccggagtggaagaaa

SEQ ID NO: 424106 - DNA, 20 bp, Artificial Sequence
  chemically synthesized
tgcacctgtttcttccactc

SEQ ID NO: 424107 - DNA, 20 bp, Artificial Sequence
  chemically synthesized
attcacggcaaccggagtgg

SEQ ID NO: 424108 - DNA, 20 bp, Artificial Sequence
  chemically synthesized
actattcacggcaaccggag

SEQ ID NO: 424109 - DNA, 20 bp, Artificial Sequence
  chemically synthesized
ctcactattcacggcaaccg

SEQ ID NO: 424110 - DNA, 20 bp, Artificial Sequence
  chemically synthesized
acctcactattcacggcaac

SEQ ID NO: 424111 - DNA, 20 bp, Artificial Sequence
  chemically synthesized
tccactccggttgccgtgaa

SEQ ID NO: 424112 - DNA, 20 bp, Artificial Sequence
  chemically synthesized
tgagaacacctcactattca

SEQ ID NO: 424113 - DNA, 20 bp, Artificial Sequence
  chemically synthesized
ctccggttgccgtgaatagt

SEQ ID NO: 424114 - DNA, 20 bp, Artificial Sequence
  chemically synthesized
tccggttgccgtgaatagtg

SEQ ID NO: 424115 - DNA, 20 bp, Artificial Sequence
  chemically synthesized
tgaatagtgaggtgttctca

SEQ ID NO: 424116 - DNA, 20 bp, Artificial Sequence
  chemically synthesized
gtgaggtgttctcacagatt

SEQ ID NO: 424117 - DNA, 20 bp, Artificial Sequence
  chemically synthesized
gtctgtgaagctgaatctgt

SEQ ID NO: 424118 - DNA, 20 bp, Artificial Sequence
  chemically synthesized
ttctcacagattcagcttca

SEQ ID NO: 424119 - DNA, 20 bp, Artificial Sequence
  chemically synthesized
cacagattcagcttcacaga

SEQ ID NO: 424120 - DNA, 20 bp, Artificial Sequence
  chemically synthesized
tttgcaaaatgctgtctgtg

SEQ ID NO: 424121 - DNA, 20 bp, Artificial Sequence
  chemically synthesized
aaaccattgctgtgagaggg

SEQ ID NO: 424122 - DNA, 20 bp, Artificial Sequence
  chemically synthesized
ttgcaaacactcccctctca

SEQ ID NO: 424123 - DNA, 20 bp, Artificial Sequence
  chemically synthesized
agaaaccattgctgtgagag

SEQ ID NO: 424124 - DNA, 20 bp, Artificial Sequence
  chemically synthesized
aagaaaccattgctgtgaga

SEQ ID NO: 424125 - DNA, 20 bp, Artificial Sequence
  chemically synthesized
gaagaaaccattgctgtgag

SEQ ID NO: 424126 - DNA, 20 bp, Artificial Sequence
  chemically synthesized
ggaagaaaccattgctgtga

SEQ ID NO: 424127 - DNA, 20 bp, Artificial Sequence
  chemically synthesized
acactcccctctcacagcaa

SEQ ID NO: 424128 - DNA, 20 bp, Artificial Sequence
  chemically synthesized
agggaagaaaccattgctgt

SEQ ID NO: 424129 - DNA, 20 bp, Artificial Sequence
  chemically synthesized
gcaatggtttcttccctcac

SEQ ID NO: 424130 - DNA, 20 bp, Artificial Sequence
  chemically synthesized
gtagattgagccggtgaggg

SEQ ID NO: 424131 - DNA, 20 bp, Artificial Sequence
  chemically synthesized
caggtagattgagccggtga

SEQ ID NO: 424132 - DNA, 20 bp, Artificial Sequence
  chemically synthesized
tcaggtagattgagccggtg

SEQ ID NO: 424133 - DNA, 20 bp, Artificial Sequence
  chemically synthesized
atcaggtagattgagccggt

SEQ ID NO: 424134 - DNA, 20 bp, Artificial Sequence
  chemically synthesized
cgtaatcaggtagattgagc

SEQ ID NO: 424135 - DNA, 20 bp, Artificial Sequence
  chemically synthesized
ggaacgtaatcaggtagatt

SEQ ID NO: 424136 - DNA, 20 bp, Artificial Sequence
  chemically synthesized
tagaagggaacgtaatcagg

SEQ ID NO: 424137 - DNA, 20 bp, Artificial Sequence
  chemically synthesized
gattagaagggaacgtaatc

SEQ ID NO: 424138 - DNA, 20 bp, Artificial Sequence
  chemically synthesized
tgattagaagggaacgtaat

SEQ ID NO: 424139 - DNA, 20 bp, Artificial Sequence
  chemically synthesized
tgattacgttcccttctaat

SEQ ID NO: 424140 - DNA, 20 bp, Artificial Sequence
  chemically synthesized
actgaggttactgattagaa

SEQ ID NO: 424141 - DNA, 20 bp, Artificial Sequence
  chemically synthesized
aactgaggttactgattaga

SEQ ID NO: 424142 - DNA, 20 bp, Artificial Sequence
  chemically synthesized
gaactgaggttactgattag

SEQ ID NO: 424143 - DNA, 20 bp, Artificial Sequence
  chemically synthesized
gaggaactgaggttactgat

SEQ ID NO: 424144 - DNA, 20 bp, Artificial Sequence
  chemically synthesized
tcccttctaatcagtaacct

SEQ ID NO: 424145 - DNA, 20 bp, Artificial Sequence
  chemically synthesized
agttatttctagaggaactg

SEQ ID NO: 424146 - DNA, 20 bp, Artificial Sequence
  chemically synthesized
cagttatttctagaggaact

SEQ ID NO: 424147 - DNA, 20 bp, Artificial Sequence
  chemically synthesized
atcagtaacctcagttcctc

SEQ ID NO: 424148 - DNA, 20 bp, Artificial Sequence
  chemically synthesized
gacgacacagttatttctag

SEQ ID NO: 424149 - DNA, 20 bp, Artificial Sequence
  chemically synthesized
agacgacacagttatttcta

SEQ ID NO: 424150 - DNA, 20 bp, Artificial Sequence
  chemically synthesized
gcagacgacacagttatttc

SEQ ID NO: 424151 - DNA, 20 bp, Artificial Sequence
  chemically synthesized
cctatataaagcagacgaca

SEQ ID NO: 424152 - DNA, 20 bp, Artificial Sequence
  chemically synthesized
actgtgtcgtctgctttata

SEQ ID NO: 424153 - DNA, 20 bp, Artificial Sequence
  chemically synthesized
cagataaatcctatataaag

SEQ ID NO: 424154 - DNA, 20 bp, Artificial Sequence
  chemically synthesized
ctgtgtcgtctgctttatat

SEQ ID NO: 424155 - DNA, 20 bp, Artificial Sequence
  chemically synthesized
actcagataaatcctatata

SEQ ID NO: 424156 - DNA, 20 bp, Artificial Sequence
  chemically synthesized
gctttatataggatttatct

SEQ ID NO: 424157 - DNA, 20 bp, Artificial Sequence
  chemically synthesized
ataggatttatctgagtctg

SEQ ID NO: 424158 - DNA, 20 bp, Artificial Sequence
  chemically synthesized
tccagtttctgcttcagact

SEQ ID NO: 424159 - DNA, 20 bp, Artificial Sequence
  chemically synthesized
ggatttatctgagtctgaag

SEQ ID NO: 424160 - DNA, 20 bp, Artificial Sequence
  chemically synthesized
ctactttccagtttctgctt

SEQ ID NO: 424161 - DNA, 20 bp, Artificial Sequence
  chemically synthesized
tctgagtctgaagcagaaac

SEQ ID NO: 424162 - DNA, 20 bp, Artificial Sequence
  chemically synthesized
agtctgaagcagaaactgga

SEQ ID NO: 424163 - DNA, 20 bp, Artificial Sequence
  chemically synthesized
ctgaagcagaaactggaaag

SEQ ID NO: 424164 - DNA, 20 bp, Artificial Sequence
  chemically synthesized
gctcctctaagtctactttc

SEQ ID NO: 424165 - DNA, 20 bp, Artificial Sequence
  chemically synthesized
cagaaactggaaagtagact

SEQ ID NO: 424166 - DNA, 20 bp, Artificial Sequence
  chemically synthesized
gaaactggaaagtagactta

SEQ ID NO: 424167 - DNA, 20 bp, Artificial Sequence
  chemically synthesized
aaactggaaagtagacttag

SEQ ID NO: 424168 - DNA, 20 bp, Artificial Sequence
  chemically synthesized
actggaaagtagacttagag

SEQ ID NO: 424169 - DNA, 20 bp, Artificial Sequence
  chemically synthesized
tcataataatcagctcctct

SEQ ID NO: 424170 - DNA, 20 bp, Artificial Sequence
  chemically synthesized
acaggtgtcttcataataat

SEQ ID NO: 424171 - DNA, 20 bp, Artificial Sequence
  chemically synthesized
tagaggagctgattattatg

SEQ ID NO: 424172 - DNA, 20 bp, Artificial Sequence
  chemically synthesized
tgaataccagacaaaaatac

SEQ ID NO: 424173 - DNA, 20 bp, Artificial Sequence
  chemically synthesized
gtgaataccagacaaaaata

SEQ ID NO: 424174 - DNA, 20 bp, Artificial Sequence
  chemically synthesized
aagacacctgtatttttgtc

SEQ ID NO: 424175 - DNA, 20 bp, Artificial Sequence
  chemically synthesized
tgtcgagttcacgtgaatac

SEQ ID NO: 424176 - DNA, 20 bp, Artificial Sequence
  chemically synthesized
tggtattcacgtgaactcga

SEQ ID NO: 424177 - DNA, 20 bp, Artificial Sequence
  chemically synthesized
gcataaatgagtgcactgtc

SEQ ID NO: 424178 - DNA, 20 bp, Artificial Sequence
  chemically synthesized
taacaccagtttgcataaat

SEQ ID NO: 424179 - DNA, 20 bp, Artificial Sequence
  chemically synthesized
gtgcactcatttatgcaaac

SEQ ID NO: 424180 - DNA, 20 bp, Artificial Sequence
  chemically synthesized
tcatttatgcaaactggtgt

SEQ ID NO: 424181 - DNA, 20 bp, Artificial Sequence
  chemically synthesized
tttttctttttcactaacac

SEQ ID NO: 424182 - DNA, 20 bp, Artificial Sequence
  chemically synthesized
gcaaactggtgttagtgaaa

SEQ ID NO: 424183 - DNA, 20 bp, Artificial Sequence
  chemically synthesized
tggtgttagtgaaaaagaaa

SEQ ID NO: 424184 - DNA, 20 bp, Artificial Sequence
  chemically synthesized
tgttagtgaaaaagaaaaag

SEQ ID NO: 424185 - DNA, 20 bp, Artificial Sequence
  chemically synthesized
tagtgaaaaagaaaaagaag

SEQ ID NO: 424186 - DNA, 20 bp, Artificial Sequence
  chemically synthesized
gtgaaaaagaaaaagaagca

SEQ ID NO: 424187 - DNA, 20 bp, Artificial Sequence
  chemically synthesized
aaaaagaaaaagaagcagag

SEQ ID NO: 424188 - DNA, 20 bp, Artificial Sequence
  chemically synthesized
aaaagaaaaagaagcagaga

SEQ ID NO: 424189 - DNA, 20 bp, Artificial Sequence
  chemically synthesized
agaaaaagaagcagagaagg

SEQ ID NO: 424190 - DNA, 20 bp, Artificial Sequence
  chemically synthesized
gaagcagagaaggaagcaaa

SEQ ID NO: 424191 - DNA, 20 bp, Artificial Sequence
  chemically synthesized
gcagagaaggaagcaaaaag

SEQ ID NO: 424192 - DNA, 20 bp, Artificial Sequence
  chemically synthesized
agagaaggaagcaaaaagaa

SEQ ID NO: 424193 - DNA, 20 bp, Artificial Sequence
  chemically synthesized
aggaagcaaaaagaagagac

SEQ ID NO: 424194 - DNA, 20 bp, Artificial Sequence
  chemically synthesized
ggtgcgcaactttataggtc

SEQ ID NO: 424195 - DNA, 20 bp, Artificial Sequence
  chemically synthesized
aagaagagactggacctata

SEQ ID NO: 424196 - DNA, 20 bp, Artificial Sequence
  chemically synthesized
acacaggtgcgcaactttat

SEQ ID NO: 424197 - DNA, 20 bp, Artificial Sequence
  chemically synthesized
cacacaggtgcgcaacttta

SEQ ID NO: 424198 - DNA, 20 bp, Artificial Sequence
  chemically synthesized
ttcttctcctagcatcacac

SEQ ID NO: 424199 - DNA, 20 bp, Artificial Sequence
  chemically synthesized
tttcttctcctagcatcaca

SEQ ID NO: 424200 - DNA, 20 bp, Artificial Sequence
  chemically synthesized
gttgcgcacctgtgtgatgc

SEQ ID NO: 424201 - DNA, 20 bp, Artificial Sequence
  chemically synthesized
ttgcgcacctgtgtgatgct

SEQ ID NO: 424202 - DNA, 20 bp, Artificial Sequence
  chemically synthesized
gcgcacctgtgtgatgctag

SEQ ID NO: 424203 - DNA, 20 bp, Artificial Sequence
  chemically synthesized
cacctgtgtgatgctaggag

SEQ ID NO: 424204 - DNA, 20 bp, Artificial Sequence
  chemically synthesized
ttagagttattttcttctcc

SEQ ID NO: 424205 - DNA, 20 bp, Artificial Sequence
  chemically synthesized
agcagcactggacgttttta

SEQ ID NO: 424206 - DNA, 20 bp, Artificial Sequence
  chemically synthesized
tcagcagcactggacgtttt

SEQ ID NO: 424207 - DNA, 20 bp, Artificial Sequence
  chemically synthesized
aaaataactctaaaaacgtc

SEQ ID NO: 424208 - DNA, 20 bp, Artificial Sequence
  chemically synthesized
aaatgtgttttcagcagcac

SEQ ID NO: 424209 - DNA, 20 bp, Artificial Sequence
  chemically synthesized
aagttcaaatgtgttttcag

SEQ ID NO: 424210 - DNA, 20 bp, Artificial Sequence
  chemically synthesized
aggaagttcaaatgtgtttt

SEQ ID NO: 424211 - DNA, 20 bp, Artificial Sequence
  chemically synthesized
gcactgttggttttcatagg

SEQ ID NO: 424212 - DNA, 20 bp, Artificial Sequence
  chemically synthesized
caagcactgttggttttcat

SEQ ID NO: 424213 - DNA, 20 bp, Artificial Sequence
  chemically synthesized
tcaagcactgttggttttca

SEQ ID NO: 424214 - DNA, 20 bp, Artificial Sequence
  chemically synthesized
gaacttcctatgaaaaccaa

SEQ ID NO: 424215 - DNA, 20 bp, Artificial Sequence
  chemically synthesized
atttgtatgtcaagcactgt

SEQ ID NO: 424216 - DNA, 20 bp, Artificial Sequence
  chemically synthesized
gaggaagatatttgtatgtc

SEQ ID NO: 424217 - DNA, 20 bp, Artificial Sequence
  chemically synthesized
gacatacaaatatcttcctc

SEQ ID NO: 424218 - DNA, 20 bp, Artificial Sequence
  chemically synthesized
tttaaaggtgtgtctggagg

SEQ ID NO: 424219 - DNA, 20 bp, Artificial Sequence
  chemically synthesized
atttttaaaggtgtgtctgg

SEQ ID NO: 424220 - DNA, 20 bp, Artificial Sequence
  chemically synthesized
tatttttaaaggtgtgtctg

SEQ ID NO: 424221 - DNA, 20 bp, Artificial Sequence
  chemically synthesized
tgtatttttaaaggtgtgtc

SEQ ID NO: 424222 - DNA, 20 bp, Artificial Sequence
  chemically synthesized
attttaaaatgtatttttaa

SEQ ID NO: 424223 - DNA, 20 bp, Artificial Sequence
  chemically synthesized
gattttaaaatgtattttta

SEQ ID NO: 424224 - DNA, 20 bp, Artificial Sequence
  chemically synthesized
gattgagtttaagattgttt

SEQ ID NO: 424225 - DNA, 20 bp, Artificial Sequence
  chemically synthesized
ttgtggtttagattgagttt

SEQ ID NO: 424226 - DNA, 20 bp, Artificial Sequence
  chemically synthesized
tctgcattgtggtttagatt

SEQ ID NO: 424227 - DNA, 20 bp, Artificial Sequence
  chemically synthesized
ttaacttctgcattgtggtt

SEQ ID NO: 424228 - DNA, 20 bp, Artificial Sequence
  chemically synthesized
actcaatctaaaccacaatg

SEQ ID NO: 424229 - DNA, 20 bp, Artificial Sequence
  chemically synthesized
aagaattaacttctgcattg

SEQ ID NO: 424230 - DNA, 20 bp, Artificial Sequence
  chemically synthesized
caatctaaaccacaatgcag

SEQ ID NO: 424231 - DNA, 20 bp, Artificial Sequence
  chemically synthesized
caatgcagaagttaattctt

SEQ ID NO: 424232 - DNA, 20 bp, Artificial Sequence
  chemically synthesized
aatgcagaagttaattctta

SEQ ID NO: 424233 - DNA, 20 bp, Artificial Sequence
  chemically synthesized
tcttaatctccatttgcctt

SEQ ID NO: 424234 - DNA, 20 bp, Artificial Sequence
  chemically synthesized
aagttaattcttaaggcaaa

SEQ ID NO: 424235 - DNA, 20 bp, Artificial Sequence
  chemically synthesized
gttaattcttaaggcaaatg

SEQ ID NO: 424236 - DNA, 20 bp, Artificial Sequence
  chemically synthesized
tcttaaggcaaatggagatt

SEQ ID NO: 424237 - DNA, 20 bp, Artificial Sequence
  chemically synthesized
acacagggtttatgtggatg

SEQ ID NO: 424238 - DNA, 20 bp, Artificial Sequence
  chemically synthesized
tttaaaacacagggtttatg

SEQ ID NO: 424239 - DNA, 20 bp, Artificial Sequence
  chemically synthesized
aattctttttttaaaacaca

SEQ ID NO: 424240 - DNA, 20 bp, Artificial Sequence
  chemically synthesized
taattctttttttaaaacac

SEQ ID NO: 424241 - DNA, 20 bp, Artificial Sequence
  chemically synthesized
ttaattctttttttaaaaca

SEQ ID NO: 424242 - DNA, 20 bp, Artificial Sequence
  chemically synthesized
taaaccctgtgttttaaaaa

SEQ ID NO: 424243 - DNA, 20 bp, Artificial Sequence
  chemically synthesized
tgttttaaaaaaagaattaa

SEQ ID NO: 424244 - DNA, 20 bp, Artificial Sequence
  chemically synthesized
gttttaaaaaaagaattaaa

SEQ ID NO: 424245 - DNA, 20 bp, Artificial Sequence
  chemically synthesized
acaaatttgagtaagttata

SEQ ID NO: 424246 - DNA, 20 bp, Artificial Sequence
  chemically synthesized
cttcaaatacaaatttgagt

SEQ ID NO: 424247 - DNA, 20 bp, Artificial Sequence
  chemically synthesized
ttaacttcaaatacaaattt

SEQ ID NO: 424248 - DNA, 20 bp, Artificial Sequence
  chemically synthesized
cttactcaaatttgtatttg

SEQ ID NO: 424249 - DNA, 20 bp, Artificial Sequence
  chemically synthesized
ttttcaagaagcaggattca

SEQ ID NO: 424250 - DNA, 20 bp, Artificial Sequence
  chemically synthesized
tttttcaagaagcaggattc

SEQ ID NO: 424251 - DNA, 20 bp, Artificial Sequence
  chemically synthesized
attctgttttttcaagaagc

SEQ ID NO: 424252 - DNA, 20 bp, Artificial Sequence
  chemically synthesized
aattctgttttttcaagaag

SEQ ID NO: 424253 - DNA, 20 bp, Artificial Sequence
  chemically synthesized
cacaattctgttttttcaag

SEQ ID NO: 424254 - DNA, 20 bp, Artificial Sequence
  chemically synthesized
aatcctgcttcttgaaaaaa

SEQ ID NO: 424255 - DNA, 20 bp, Artificial Sequence
  chemically synthesized
tgacacaattctgttttttc

SEQ ID NO: 424256 - DNA, 20 bp, Artificial Sequence
  chemically synthesized
ttgaaaaaacagaattgtgt

SEQ ID NO: 424257 - DNA, 20 bp, Artificial Sequence
  chemically synthesized
tgaaaaaacagaattgtgtc

SEQ ID NO: 424258 - DNA, 20 bp, Artificial Sequence
  chemically synthesized
tgggtaaacagtcattacag

SEQ ID NO: 424259 - DNA, 20 bp, Artificial Sequence
  chemically synthesized
ctctgggtaaacagtcatta

SEQ ID NO: 424260 - DNA, 20 bp, Artificial Sequence
  chemically synthesized
ttctgtaatgactgtttacc

SEQ ID NO: 424261 - DNA, 20 bp, Artificial Sequence
  chemically synthesized
aatcttatgctctgggtaaa

SEQ ID NO: 424262 - DNA, 20 bp, Artificial Sequence
  chemically synthesized
ctgtaatgactgtttaccca

SEQ ID NO: 424263 - DNA, 20 bp, Artificial Sequence
  chemically synthesized
tgactgtttacccagagcat

SEQ ID NO: 424264 - DNA, 20 bp, Artificial Sequence
  chemically synthesized
ccacttcaatcttatgctct

SEQ ID NO: 424265 - DNA, 20 bp, Artificial Sequence
  chemically synthesized
tccacttcaatcttatgctc

SEQ ID NO: 424266 - DNA, 20 bp, Artificial Sequence
  chemically synthesized
ttacccagagcataagattg

SEQ ID NO: 424267 - DNA, 20 bp, Artificial Sequence
  chemically synthesized
cccagagcataagattgaag

SEQ ID NO: 424268 - DNA, 20 bp, Artificial Sequence
  chemically synthesized
ataagattgaagtggatttt

SEQ ID NO: 424269 - DNA, 20 bp, Artificial Sequence
  chemically synthesized
agattaaaaataaaactctt

SEQ ID NO: 424270 - DNA, 20 bp, Artificial Sequence
  chemically synthesized
atggggattgacatacttaa

SEQ ID NO: 424271 - DNA, 20 bp, Artificial Sequence
  chemically synthesized
agatggggattgacatactt

SEQ ID NO: 424272 - DNA, 20 bp, Artificial Sequence
  chemically synthesized
ttatatgctttgatcagatg

SEQ ID NO: 424273 - DNA, 20 bp, Artificial Sequence
  chemically synthesized
tttatatgctttgatcagat

SEQ ID NO: 424274 - DNA, 20 bp, Artificial Sequence
  chemically synthesized
gtttatatgctttgatcaga

SEQ ID NO: 424275 - DNA, 20 bp, Artificial Sequence
  chemically synthesized
tgtcaatccccatctgatca

SEQ ID NO: 424276 - DNA, 20 bp, Artificial Sequence
  chemically synthesized
tttagtttatatgctttgat

SEQ ID NO: 424277 - DNA, 20 bp, Artificial Sequence
  chemically synthesized
atgaagtccttggaaaaatt

SEQ ID NO: 424278 - DNA, 20 bp, Artificial Sequence
  chemically synthesized
catataaactaaatttttcc

SEQ ID NO: 424279 - DNA, 20 bp, Artificial Sequence
  chemically synthesized
atataaactaaatttttcca

SEQ ID NO: 424280 - DNA, 20 bp, Artificial Sequence
  chemically synthesized
tatattgttaatgaagtcct

SEQ ID NO: 424281 - DNA, 20 bp, Artificial Sequence
  chemically synthesized
acttggttatattgttaatg

SEQ ID NO: 424282 - DNA, 20 bp, Artificial Sequence
  chemically synthesized
acttcattaacaatataacc

SEQ ID NO: 424283 - DNA, 20 bp, Artificial Sequence
  chemically synthesized
tcattaacaatataaccaag

SEQ ID NO: 424284 - DNA, 20 bp, Artificial Sequence
  chemically synthesized
attaacaatataaccaagta

SEQ ID NO: 424285 - DNA, 20 bp, Artificial Sequence
  chemically synthesized
ccaagaactgcagctctact

SEQ ID NO: 424286 - DNA, 20 bp, Artificial Sequence
  chemically synthesized
aatataaccaagtagagctg

SEQ ID NO: 424287 - DNA, 20 bp, Artificial Sequence
  chemically synthesized
ccaagtagagctgcagttct

SEQ ID NO: 424288 - DNA, 20 bp, Artificial Sequence
  chemically synthesized
ctaaagaaaaccaagaactg

SEQ ID NO: 424289 - DNA, 20 bp, Artificial Sequence
  chemically synthesized
aacttactctaaagaaaacc

SEQ ID NO: 424290 - DNA, 20 bp, Artificial Sequence
  chemically synthesized
ctgcagttcttggttttctt

SEQ ID NO: 424291 - DNA, 20 bp, Artificial Sequence
  chemically synthesized
gcagttcttggttttcttta

SEQ ID NO: 424292 - DNA, 20 bp, Artificial Sequence
  chemically synthesized
ttcttggttttctttagagt

SEQ ID NO: 424293 - DNA, 20 bp, Artificial Sequence
  chemically synthesized
cattttaacaacttactcta

SEQ ID NO: 424294 - DNA, 20 bp, Artificial Sequence
  chemically synthesized
gtaagttgttaaaatgattg

SEQ ID NO: 424295 - DNA, 20 bp, Artificial Sequence
  chemically synthesized
aatgattgaagttcatgtaa

SEQ ID NO: 424296 - DNA, 20 bp, Artificial Sequence
  chemically synthesized
aagttcatgtaaaagaaatc

SEQ ID NO: 424297 - DNA, 20 bp, Artificial Sequence
  chemically synthesized
gttcatgtaaaagaaatcca

SEQ ID NO: 424298 - DNA, 20 bp, Artificial Sequence
  chemically synthesized
gtaaaagaaatccagagtta

SEQ ID NO: 424299 - DNA, 20 bp, Artificial Sequence
  chemically synthesized
gcaaaccttaactgtaactc

SEQ ID NO: 424300 - DNA, 20 bp, Artificial Sequence
  chemically synthesized
agaaatccagagttacagtt

SEQ ID NO: 424301 - DNA, 20 bp, Artificial Sequence
  chemically synthesized
gaaatccagagttacagtta

SEQ ID NO: 424302 - DNA, 20 bp, Artificial Sequence
  chemically synthesized
aaaaaaaaaaaaaaaaaaaa

SEQ ID NO: 424303 - DNA, 20 bp, Artificial Sequence
  chemically synthesized
tttttttttttttttttttt

SEQ ID NO: 424304 - DNA, 20 bp, Artificial Sequence
  chemically synthesized
ttttttttttttttttttag

SEQ ID NO: 424305 - DNA, 20 bp, Artificial Sequence
  chemically synthesized
ttttttttttttagtagatc

SEQ ID NO: 424306 - DNA, 20 bp, Artificial Sequence
  chemically synthesized
tttttagtagatccagtgcc

SEQ ID NO: 424307 - DNA, 20 bp, Artificial Sequence
  chemically synthesized
acatactgtttgccgggcac

SEQ ID NO: 424308 - DNA, 20 bp, Artificial Sequence
  chemically synthesized
tagatccagtgcccggcaaa

SEQ ID NO: 424309 - DNA, 20 bp, Artificial Sequence
  chemically synthesized
ttgagcacatactgtttgcc

SEQ ID NO: 424310 - DNA, 20 bp, Artificial Sequence
  chemically synthesized
gttgagcacatactgtttgc

SEQ ID NO: 424311 - DNA, 20 bp, Artificial Sequence
  chemically synthesized
gcattaaataaacatatgtt

SEQ ID NO: 424312 - DNA, 20 bp, Artificial Sequence
  chemically synthesized
tgtttatttaatgcgaccaa

SEQ ID NO: 424313 - DNA, 20 bp, Artificial Sequence
  chemically synthesized
cactttatattgtatgcttt

SEQ ID NO: 424314 - DNA, 20 bp, Artificial Sequence
  chemically synthesized
gaccaaaagcatacaatata

SEQ ID NO: 424315 - DNA, 20 bp, Artificial Sequence
  chemically synthesized
tggctttttaaaaatatcag

SEQ ID NO: 424316 - DNA, 20 bp, Artificial Sequence
  chemically synthesized
acatggctttttaaaaatat

SEQ ID NO: 424317 - DNA, 20 bp, Artificial Sequence
  chemically synthesized
ttgccactgatatttttaaa

SEQ ID NO: 424318 - DNA, 20 bp, Artificial Sequence
  chemically synthesized
aatgaaataagtatagaaca

SEQ ID NO: 424319 - DNA, 20 bp, Artificial Sequence
  chemically synthesized
acgtaaaaatgaaataagta

SEQ ID NO: 424320 - DNA, 20 bp, Artificial Sequence
  chemically synthesized
ggcttacgtaaaaatgaaat

SEQ ID NO: 424321 - DNA, 20 bp, Artificial Sequence
  chemically synthesized
tacttatttcatttttacgt

SEQ ID NO: 424322 - DNA, 20 bp, Artificial Sequence
  chemically synthesized
tttgaaaccttgtaaaattg

SEQ ID NO: 424323 - DNA, 20 bp, Artificial Sequence
  chemically synthesized
tacgtaagccacaattttac

SEQ ID NO: 424324 - DNA, 20 bp, Artificial Sequence
  chemically synthesized
acgtaagccacaattttaca

SEQ ID NO: 424325 - DNA, 20 bp, Artificial Sequence
  chemically synthesized
tattaaagaaaacaaggtgt

SEQ ID NO: 424326 - DNA, 20 bp, Artificial Sequence
  chemically synthesized
atattaaagaaaacaaggtg

SEQ ID NO: 424327 - DNA, 20 bp, Artificial Sequence
  chemically synthesized
attttatattaaagaaaaca

SEQ ID NO: 424328 - DNA, 20 bp, Artificial Sequence
  chemically synthesized
tattttatattaaagaaaac

SEQ ID NO: 424329 - DNA, 20 bp, Artificial Sequence
  chemically synthesized
ttgccaaatattttatatta

SEQ ID NO: 424330 - DNA, 20 bp, Artificial Sequence
  chemically synthesized
tttctttaatataaaatatt

SEQ ID NO: 424331 - DNA, 20 bp, Artificial Sequence
  chemically synthesized
ataaaatatttggcaattat

SEQ ID NO: 424332 - DNA, 20 bp, Artificial Sequence
  chemically synthesized
atatttggcaattataagca

SEQ ID NO: 424333 - DNA, 20 bp, Artificial Sequence
  chemically synthesized
attataagcatggaccgtgc

SEQ ID NO: 424334 - DNA, 20 bp, Artificial Sequence
  chemically synthesized
ataagcatggaccgtgctgg

SEQ ID NO: 424335 - DNA, 20 bp, Artificial Sequence
  chemically synthesized
attttaacttactgccagca

SEQ ID NO: 424336 - DNA, 20 bp, Artificial Sequence
  chemically synthesized
gcatggaccgtgctggcagt

SEQ ID NO: 424337 - DNA, 20 bp, Artificial Sequence
  chemically synthesized
gtcacattttaacttactgc

SEQ ID NO: 424338 - DNA, 20 bp, Artificial Sequence
  chemically synthesized
ggaacggagaaaaaaaaaat

SEQ ID NO: 424339 - DNA, 20 bp, Artificial Sequence
  chemically synthesized
aaaattgagagtagggaacg

SEQ ID NO: 424340 - DNA, 20 bp, Artificial Sequence
  chemically synthesized
tgaaaattgagagtagggaa

SEQ ID NO: 424341 - DNA, 20 bp, Artificial Sequence
  chemically synthesized
gcatctgaaaattgagagta

SEQ ID NO: 424342 - DNA, 20 bp, Artificial Sequence
  chemically synthesized
cgcatctgaaaattgagagt

SEQ ID NO: 424343 - DNA, 20 bp, Artificial Sequence
  chemically synthesized
ccgcatctgaaaattgagag

SEQ ID NO: 424344 - DNA, 20 bp, Artificial Sequence
  chemically synthesized
tttccgcatctgaaaattga

SEQ ID NO: 424345 - DNA, 20 bp, Artificial Sequence
  chemically synthesized
cgttccctactctcaatttt

SEQ ID NO: 424346 - DNA, 20 bp, Artificial Sequence
  chemically synthesized
aatttccgcatctgaaaatt

SEQ ID NO: 424347 - DNA, 20 bp, Artificial Sequence
  chemically synthesized
ctactctcaattttcagatg

SEQ ID NO: 424348 - DNA, 20 bp, Artificial Sequence
  chemically synthesized
tcagatgcggaaatttcatt

SEQ ID NO: 424349 - DNA, 20 bp, Artificial Sequence
  chemically synthesized
agatgcggaaatttcatttg

SEQ ID NO: 424350 - DNA, 20 bp, Artificial Sequence
  chemically synthesized
atgcggaaatttcatttgga

SEQ ID NO: 424351 - DNA, 20 bp, Artificial Sequence
  chemically synthesized
gaaatttcatttggagagaa

SEQ ID NO: 424352 - DNA, 20 bp, Artificial Sequence
  chemically synthesized
aaatttcatttggagagaac

SEQ ID NO: 424353 - DNA, 20 bp, Artificial Sequence
  chemically synthesized
atttcatttggagagaacag

SEQ ID NO: 424354 - DNA, 20 bp, Artificial Sequence
  chemically synthesized
tttcatttggagagaacagg

SEQ ID NO: 424355 - DNA, 20 bp, Artificial Sequence
  chemically synthesized
ttggagagaacaggaggtgt

SEQ ID NO: 424356 - DNA, 20 bp, Artificial Sequence
  chemically synthesized
gagagaacaggaggtgttgg

SEQ ID NO: 424357 - DNA, 20 bp, Artificial Sequence
  chemically synthesized
agagaacaggaggtgttggt

SEQ ID NO: 424358 - DNA, 20 bp, Artificial Sequence
  chemically synthesized
gggaatacggtacgattaat

SEQ ID NO: 424359 - DNA, 20 bp, Artificial Sequence
  chemically synthesized
tctttgtagacaagggaata

SEQ ID NO: 424360 - DNA, 20 bp, Artificial Sequence
  chemically synthesized
gcagtactctttgtagacaa

SEQ ID NO: 424361 - DNA, 20 bp, Artificial Sequence
  chemically synthesized
tgcagtactctttgtagaca

SEQ ID NO: 424362 - DNA, 20 bp, Artificial Sequence
  chemically synthesized
accgtattcccttgtctaca

SEQ ID NO: 424363 - DNA, 20 bp, Artificial Sequence
  chemically synthesized
atgcagtactctttgtagac

SEQ ID NO: 424364 - DNA, 20 bp, Artificial Sequence
  chemically synthesized
cgtattcccttgtctacaaa

SEQ ID NO: 424365 - DNA, 20 bp, Artificial Sequence
  chemically synthesized
tttggatgcagtactctttg

SEQ ID NO: 424366 - DNA, 20 bp, Artificial Sequence
  chemically synthesized
gttcttctgtaatttggatg

SEQ ID NO: 424367 - DNA, 20 bp, Artificial Sequence
  chemically synthesized
agagtactgcatccaaatta

SEQ ID NO: 424368 - DNA, 20 bp, Artificial Sequence
  chemically synthesized
tctttagttcttctgtaatt

SEQ ID NO: 424369 - DNA, 20 bp, Artificial Sequence
  chemically synthesized
gtactgcatccaaattacag

SEQ ID NO: 424370 - DNA, 20 bp, Artificial Sequence
  chemically synthesized
tccaaattacagaagaacta

SEQ ID NO: 424371 - DNA, 20 bp, Artificial Sequence
  chemically synthesized
ctcatgctacaaggtttctt

SEQ ID NO: 424372 - DNA, 20 bp, Artificial Sequence
  chemically synthesized
gaagaactaaagaaaccttg

SEQ ID NO: 424373 - DNA, 20 bp, Artificial Sequence
  chemically synthesized
ctaattatactcatgctaca

SEQ ID NO: 424374 - DNA, 20 bp, Artificial Sequence
  chemically synthesized
ctaaagaaaccttgtagcat

SEQ ID NO: 424375 - DNA, 20 bp, Artificial Sequence
  chemically synthesized
gctaattatactcatgctac

SEQ ID NO: 424376 - DNA, 20 bp, Artificial Sequence
  chemically synthesized
ccttgtagcatgagtataat

SEQ ID NO: 424377 - DNA, 20 bp, Artificial Sequence
  chemically synthesized
tgtagcatgagtataattag

SEQ ID NO: 424378 - DNA, 20 bp, Artificial Sequence
  chemically synthesized
gtataattagcagtgctact

SEQ ID NO: 424379 - DNA, 20 bp, Artificial Sequence
  chemically synthesized
ctccatttccattcacttag

SEQ ID NO: 424380 - DNA, 20 bp, Artificial Sequence
  chemically synthesized
tagcagtgctactaagtgaa

SEQ ID NO: 424381 - DNA, 20 bp, Artificial Sequence
  chemically synthesized
aacctccatttccattcact

SEQ ID NO: 424382 - DNA, 20 bp, Artificial Sequence
  chemically synthesized
tgctactaagtgaatggaaa

SEQ ID NO: 424383 - DNA, 20 bp, Artificial Sequence
  chemically synthesized
ctactaagtgaatggaaatg

SEQ ID NO: 424384 - DNA, 20 bp, Artificial Sequence
  chemically synthesized
tactaagtgaatggaaatgg

SEQ ID NO: 424385 - DNA, 20 bp, Artificial Sequence
  chemically synthesized
tgattacagttaattaagtt

SEQ ID NO: 424386 - DNA, 20 bp, Artificial Sequence
  chemically synthesized
atgattacagttaattaagt

SEQ ID NO: 424387 - DNA, 20 bp, Artificial Sequence
  chemically synthesized
agtaatgattacagttaatt

SEQ ID NO: 424388 - DNA, 20 bp, Artificial Sequence
  chemically synthesized
acgacaatgagtaatgatta

SEQ ID NO: 424389 - DNA, 20 bp, Artificial Sequence
  chemically synthesized
tttctaagcagtacgacaat

SEQ ID NO: 424390 - DNA, 20 bp, Artificial Sequence
  chemically synthesized
ttactcattgtcgtactgct

SEQ ID NO: 424391 - DNA, 20 bp, Artificial Sequence
  chemically synthesized
tcattgtcgtactgcttaga

SEQ ID NO: 424392 - DNA, 20 bp, Artificial Sequence
  chemically synthesized
cctcaactaatctttctaag

SEQ ID NO: 424393 - DNA, 20 bp, Artificial Sequence
  chemically synthesized
taccctcaactaatctttct

SEQ ID NO: 424394 - DNA, 20 bp, Artificial Sequence
  chemically synthesized
gtcgtactgcttagaaagat

SEQ ID NO: 424395 - DNA, 20 bp, Artificial Sequence
  chemically synthesized
actgcttagaaagattagtt

SEQ ID NO: 424396 - DNA, 20 bp, Artificial Sequence
  chemically synthesized
ctgcttagaaagattagttg

SEQ ID NO: 424397 - DNA, 20 bp, Artificial Sequence
  chemically synthesized
tgcttagaaagattagttga

SEQ ID NO: 424398 - DNA, 20 bp, Artificial Sequence
  chemically synthesized
agttgagggtatttcttctg

SEQ ID NO: 424399 - DNA, 20 bp, Artificial Sequence
  chemically synthesized
cgcctaaagtaataccacag

SEQ ID NO: 424400 - DNA, 20 bp, Artificial Sequence
  chemically synthesized
aaacgcctaaagtaatacca

SEQ ID NO: 424401 - DNA, 20 bp, Artificial Sequence
  chemically synthesized
tttcttctgtggtattactt

SEQ ID NO: 424402 - DNA, 20 bp, Artificial Sequence
  chemically synthesized
ttcttctgtggtattacttt

SEQ ID NO: 424403 - DNA, 20 bp, Artificial Sequence
  chemically synthesized
gagggaaggagaaacgccta

SEQ ID NO: 424404 - DNA, 20 bp, Artificial Sequence
  chemically synthesized
tttcacatttaagagggaag

SEQ ID NO: 424405 - DNA, 20 bp, Artificial Sequence
  chemically synthesized
tgtttcacatttaagaggga

SEQ ID NO: 424406 - DNA, 20 bp, Artificial Sequence
  chemically synthesized
ttgtttcacatttaagaggg

SEQ ID NO: 424407 - DNA, 20 bp, Artificial Sequence
  chemically synthesized
taattgtttcacatttaaga

SEQ ID NO: 424408 - DNA, 20 bp, Artificial Sequence
  chemically synthesized
gtaattgtttcacatttaag

SEQ ID NO: 424409 - DNA, 20 bp, Artificial Sequence
  chemically synthesized
tgtaattgtttcacatttaa

SEQ ID NO: 424410 - DNA, 20 bp, Artificial Sequence
  chemically synthesized
agtgtaattgtttcacattt

SEQ ID NO: 424411 - DNA, 20 bp, Artificial Sequence
  chemically synthesized
tgtgaaacaattacactata

SEQ ID NO: 424412 - DNA, 20 bp, Artificial Sequence
  chemically synthesized
aaacaattacactataaaga

SEQ ID NO: 424413 - DNA, 20 bp, Artificial Sequence
  chemically synthesized
gcatgctaattctttcttta

SEQ ID NO: 424414 - DNA, 20 bp, Artificial Sequence
  chemically synthesized
ttacactataaagaaagaat

SEQ ID NO: 424415 - DNA, 20 bp, Artificial Sequence
  chemically synthesized
aattagcatgccctttcaat

SEQ ID NO: 424416 - DNA, 20 bp, Artificial Sequence
  chemically synthesized
aagcttctatctgattgaaa

SEQ ID NO: 424417 - DNA, 20 bp, Artificial Sequence
  chemically synthesized
aaagcttctatctgattgaa

SEQ ID NO: 424418 - DNA, 20 bp, Artificial Sequence
  chemically synthesized
aaaagcttctatctgattga

SEQ ID NO: 424419 - DNA, 20 bp, Artificial Sequence
  chemically synthesized
agcatgccctttcaatcaga

SEQ ID NO: 424420 - DNA, 20 bp, Artificial Sequence
  chemically synthesized
atgccctttcaatcagatag

SEQ ID NO: 424421 - DNA, 20 bp, Artificial Sequence
  chemically synthesized
tggaacttacttgttcggaa

SEQ ID NO: 424422 - DNA, 20 bp, Artificial Sequence
  chemically synthesized
agatagaagcttttccgaac

SEQ ID NO: 424423 - DNA, 20 bp, Artificial Sequence
  chemically synthesized
agaagcttttccgaacaagt

SEQ ID NO: 424424 - DNA, 20 bp, Artificial Sequence
  chemically synthesized
ggacatggaacttacttgtt

SEQ ID NO: 424425 - DNA, 20 bp, Artificial Sequence
  chemically synthesized
aacaagtaagttccatgtcc

SEQ ID NO: 424426 - DNA, 20 bp, Artificial Sequence
  chemically synthesized
gccgccctcgagctaggaca

SEQ ID NO: 424427 - DNA, 20 bp, Artificial Sequence
  chemically synthesized
taagttccatgtcctagctc

SEQ ID NO: 424428 - DNA, 20 bp, Artificial Sequence
  chemically synthesized
aagttccatgtcctagctcg

SEQ ID NO: 424429 - DNA, 20 bp, Artificial Sequence
  chemically synthesized
agttccatgtcctagctcga

SEQ ID NO: 424430 - DNA, 20 bp, Artificial Sequence
  chemically synthesized
tgttttgccgccctcgagct

SEQ ID NO: 424431 - DNA, 20 bp, Artificial Sequence
  chemically synthesized
ctgttttgccgccctcgagc

SEQ ID NO: 424432 - DNA, 20 bp, Artificial Sequence
  chemically synthesized
tccatgtcctagctcgaggg

SEQ ID NO: 424433 - DNA, 20 bp, Artificial Sequence
  chemically synthesized
attcctgttttgccgccctc

SEQ ID NO: 424434 - DNA, 20 bp, Artificial Sequence
  chemically synthesized
ctagctcgagggcggcaaaa

SEQ ID NO: 424435 - DNA, 20 bp, Artificial Sequence
  chemically synthesized
tagctcgagggcggcaaaac

SEQ ID NO: 424436 - DNA, 20 bp, Artificial Sequence
  chemically synthesized
gggcggcaaaacaggaatga

SEQ ID NO: 424437 - DNA, 20 bp, Artificial Sequence
  chemically synthesized
ggcggcaaaacaggaatgat

SEQ ID NO: 424438 - DNA, 20 bp, Artificial Sequence
  chemically synthesized
aggaatgatgggaaaatatt

SEQ ID NO: 424439 - DNA, 20 bp, Artificial Sequence
  chemically synthesized
atgatgggaaaatatttagt

SEQ ID NO: 424440 - DNA, 20 bp, Artificial Sequence
  chemically synthesized
tgatgggaaaatatttagtt

SEQ ID NO: 424441 - DNA, 20 bp, Artificial Sequence
  chemically synthesized
gaaaatatttagttgggcca

SEQ ID NO: 424442 - DNA, 20 bp, Artificial Sequence
  chemically synthesized
atatttagttgggccaaagt

SEQ ID NO: 424443 - DNA, 20 bp, Artificial Sequence
  chemically synthesized
atttagttgggccaaagtta

SEQ ID NO: 424444 - DNA, 20 bp, Artificial Sequence
  chemically synthesized
tttcttaatttctctaactt

SEQ ID NO: 424445 - DNA, 20 bp, Artificial Sequence
  chemically synthesized
gggccaaagttagagaaatt

SEQ ID NO: 424446 - DNA, 20 bp, Artificial Sequence
  chemically synthesized
agttagagaaattaagaaaa

SEQ ID NO: 424447 - DNA, 20 bp, Artificial Sequence
  chemically synthesized
tagagaaattaagaaaaaag

SEQ ID NO: 424448 - DNA, 20 bp, Artificial Sequence
  chemically synthesized
aagaaaaaagtagttaattg

SEQ ID NO: 424449 - DNA, 20 bp, Artificial Sequence
  chemically synthesized
aaaaaagtagttaattgcag

SEQ ID NO: 424450 - DNA, 20 bp, Artificial Sequence
  chemically synthesized
attgcagaagttactgactt

SEQ ID NO: 424451 - DNA, 20 bp, Artificial Sequence
  chemically synthesized
ttgcagaagttactgacttg

SEQ ID NO: 424452 - DNA, 20 bp, Artificial Sequence
  chemically synthesized
gcagaagttactgacttgag

SEQ ID NO: 424453 - DNA, 20 bp, Artificial Sequence
  chemically synthesized
tccttttttcctcctcaagt

SEQ ID NO: 424454 - DNA, 20 bp, Artificial Sequence
  chemically synthesized
cagaagttactgacttgagg

SEQ ID NO: 424455 - DNA, 20 bp, Artificial Sequence
  chemically synthesized
gggttccttttttcctcctc

SEQ ID NO: 424456 - DNA, 20 bp, Artificial Sequence
  chemically synthesized
tactgacttgaggaggaaaa

SEQ ID NO: 424457 - DNA, 20 bp, Artificial Sequence
  chemically synthesized
actgacttgaggaggaaaaa

SEQ ID NO: 424458 - DNA, 20 bp, Artificial Sequence
  chemically synthesized
aaaaaaggaaccctatatat

SEQ ID NO: 424459 - DNA, 20 bp, Artificial Sequence
  chemically synthesized
tttacagaaactcatatata

SEQ ID NO: 424460 - DNA, 20 bp, Artificial Sequence
  chemically synthesized
ctttacagaaactcatatat

SEQ ID NO: 424461 - DNA, 20 bp, Artificial Sequence
  chemically synthesized
tctttacagaaactcatata

SEQ ID NO: 424462 - DNA, 20 bp, Artificial Sequence
  chemically synthesized
cctatatatgagtttctgta

SEQ ID NO: 424463 - DNA, 20 bp, Artificial Sequence
  chemically synthesized
gccaagagctaatttcttta

SEQ ID NO: 424464 - DNA, 20 bp, Artificial Sequence
  chemically synthesized
atgagtttctgtaaagaaat

SEQ ID NO: 424465 - DNA, 20 bp, Artificial Sequence
  chemically synthesized
tctgtaaagaaattagctct

SEQ ID NO: 424466 - DNA, 20 bp, Artificial Sequence
  chemically synthesized
taaagaaattagctcttggc

SEQ ID NO: 424467 - DNA, 20 bp, Artificial Sequence
  chemically synthesized
aaagaaattagctcttggcc

SEQ ID NO: 424468 - DNA, 20 bp, Artificial Sequence
  chemically synthesized
aagaaattagctcttggcca

SEQ ID NO: 424469 - DNA, 20 bp, Artificial Sequence
  chemically synthesized
tttatttcttccctggccaa

SEQ ID NO: 424470 - DNA, 20 bp, Artificial Sequence
  chemically synthesized
tatttatttcttccctggcc

SEQ ID NO: 424471 - DNA, 20 bp, Artificial Sequence
  chemically synthesized
aaattagctcttggccaggg

SEQ ID NO: 424472 - DNA, 20 bp, Artificial Sequence
  chemically synthesized
tttgttatttatttcttccc

SEQ ID NO: 424473 - DNA, 20 bp, Artificial Sequence
  chemically synthesized
gaagaaataaataacaaatt

SEQ ID NO: 424474 - DNA, 20 bp, Artificial Sequence
  chemically synthesized
aaataacaaattaagatcta

SEQ ID NO: 424475 - DNA, 20 bp, Artificial Sequence
  chemically synthesized
aataacaaattaagatctaa

SEQ ID NO: 424476 - DNA, 20 bp, Artificial Sequence
  chemically synthesized
ataacaaattaagatctaaa

SEQ ID NO: 424477 - DNA, 20 bp, Artificial Sequence
  chemically synthesized
ttatccttaatttttccctt

SEQ ID NO: 424478 - DNA, 20 bp, Artificial Sequence
  chemically synthesized
aagatctaaagggaaaaatt

SEQ ID NO: 424479 - DNA, 20 bp, Artificial Sequence
  chemically synthesized
agatctaaagggaaaaatta

SEQ ID NO: 424480 - DNA, 20 bp, Artificial Sequence
  chemically synthesized
gggaaaaattaaggataaca

SEQ ID NO: 424481 - DNA, 20 bp, Artificial Sequence
  chemically synthesized
gataacacagtacaaatacg

SEQ ID NO: 424482 - DNA, 20 bp, Artificial Sequence
  chemically synthesized
atacgcagtactgtctgatg

SEQ ID NO: 424483 - DNA, 20 bp, Artificial Sequence
  chemically synthesized
ttgtgaacaacttcatcaga

SEQ ID NO: 424484 - DNA, 20 bp, Artificial Sequence
  chemically synthesized
gcaattgtgaacaacttcat

SEQ ID NO: 424485 - DNA, 20 bp, Artificial Sequence
  chemically synthesized
agttgttcacaattgcacaa

SEQ ID NO: 424486 - DNA, 20 bp, Artificial Sequence
  chemically synthesized
tcacaattgcacaacagtgc

SEQ ID NO: 424487 - DNA, 20 bp, Artificial Sequence
  chemically synthesized
gtgtccttgaaggtgcattg

SEQ ID NO: 424488 - DNA, 20 bp, Artificial Sequence
  chemically synthesized
agattccacaatgcaccttc

SEQ ID NO: 424489 - DNA, 20 bp, Artificial Sequence
  chemically synthesized
gattccacaatgcaccttca

SEQ ID NO: 424490 - DNA, 20 bp, Artificial Sequence
  chemically synthesized
cttagctacagtgtccttga

SEQ ID NO: 424491 - DNA, 20 bp, Artificial Sequence
  chemically synthesized
ccttagctacagtgtccttg

SEQ ID NO: 424492 - DNA, 20 bp, Artificial Sequence
  chemically synthesized
atgcaccttcaaggacactg

SEQ ID NO: 424493 - DNA, 20 bp, Artificial Sequence
  chemically synthesized
ccttcaaggacactgtagct

SEQ ID NO: 424494 - DNA, 20 bp, Artificial Sequence
  chemically synthesized
cttcaaggacactgtagcta

SEQ ID NO: 424495 - DNA, 20 bp, Artificial Sequence
  chemically synthesized
cagaaagcaatccttagcta

SEQ ID NO: 424496 - DNA, 20 bp, Artificial Sequence
  chemically synthesized
aatgatcagaaagcaatcct

SEQ ID NO: 424497 - DNA, 20 bp, Artificial Sequence
  chemically synthesized
taaaaggataaatgatcaga

SEQ ID NO: 424498 - DNA, 20 bp, Artificial Sequence
  chemically synthesized
ccgctaaaaggataaatgat

SEQ ID NO: 424499 - DNA, 20 bp, Artificial Sequence
  chemically synthesized
tttctgatcatttatccttt

SEQ ID NO: 424500 - DNA, 20 bp, Artificial Sequence
  chemically synthesized
ctgatcatttatccttttag

SEQ ID NO: 424501 - DNA, 20 bp, Artificial Sequence
  chemically synthesized
gccaagtgtcttccgctaaa

SEQ ID NO: 424502 - DNA, 20 bp, Artificial Sequence
  chemically synthesized
atcatttatccttttagcgg

SEQ ID NO: 424503 - DNA, 20 bp, Artificial Sequence
  chemically synthesized
tgccaagtgtcttccgctaa

SEQ ID NO: 424504 - DNA, 20 bp, Artificial Sequence
  chemically synthesized
tccttttagcggaagacact

SEQ ID NO: 424505 - DNA, 20 bp, Artificial Sequence
  chemically synthesized
agcggaagacacttggcatc

SEQ ID NO: 424506 - DNA, 20 bp, Artificial Sequence
  chemically synthesized
gcggaagacacttggcatct

SEQ ID NO: 424507 - DNA, 20 bp, Artificial Sequence
  chemically synthesized
aacaaatgttcccagatgcc

SEQ ID NO: 424508 - DNA, 20 bp, Artificial Sequence
  chemically synthesized
ttcaaaagaacaaatgttcc

SEQ ID NO: 424509 - DNA, 20 bp, Artificial Sequence
  chemically synthesized
atgaggtgatttttattcaa

SEQ ID NO: 424510 - DNA, 20 bp, Artificial Sequence
  chemically synthesized
aaaggttccttttaggtatg

SEQ ID NO: 424511 - DNA, 20 bp, Artificial Sequence
  chemically synthesized
taaaggttccttttaggtat

SEQ ID NO: 424512 - DNA, 20 bp, Artificial Sequence
  chemically synthesized
aaaaatcacctcatacctaa

SEQ ID NO: 424513 - DNA, 20 bp, Artificial Sequence
  chemically synthesized
aaaatcacctcatacctaaa

SEQ ID NO: 424514 - DNA, 20 bp, Artificial Sequence
  chemically synthesized
tatttataaaggttcctttt

SEQ ID NO: 424515 - DNA, 20 bp, Artificial Sequence
  chemically synthesized
atatttataaaggttccttt

SEQ ID NO: 424516 - DNA, 20 bp, Artificial Sequence
  chemically synthesized
tgtttttctgatatttataa

SEQ ID NO: 424517 - DNA, 20 bp, Artificial Sequence
  chemically synthesized
ctgtttttctgatatttata

SEQ ID NO: 424518 - DNA, 20 bp, Artificial Sequence
  chemically synthesized
aaaggaacctttataaatat

SEQ ID NO: 424519 - DNA, 20 bp, Artificial Sequence
  chemically synthesized
ctttataaatatcagaaaaa

SEQ ID NO: 424520 - DNA, 20 bp, Artificial Sequence
  chemically synthesized
tttataaatatcagaaaaac

SEQ ID NO: 424521 - DNA, 20 bp, Artificial Sequence
  chemically synthesized
cccaccaatgatcgtcgtca

SEQ ID NO: 424522 - DNA, 20 bp, Artificial Sequence
  chemically synthesized
atgtctgtgacgacgatcat

SEQ ID NO: 424523 - DNA, 20 bp, Artificial Sequence
  chemically synthesized
tctgtgacgacgatcattgg

SEQ ID NO: 424524 - DNA, 20 bp, Artificial Sequence
  chemically synthesized
ctgtgacgacgatcattggt

SEQ ID NO: 424525 - DNA, 20 bp, Artificial Sequence
  chemically synthesized
tgtgacgacgatcattggtg

SEQ ID NO: 424526 - DNA, 20 bp, Artificial Sequence
  chemically synthesized
cgacgatcattggtggggct

SEQ ID NO: 424527 - DNA, 20 bp, Artificial Sequence
  chemically synthesized
gccccagagctaatgaggcc

SEQ ID NO: 424528 - DNA, 20 bp, Artificial Sequence
  chemically synthesized
ttggtggggcttggcctcat

SEQ ID NO: 424529 - DNA, 20 bp, Artificial Sequence
  chemically synthesized
tagtggccccagagctaatg

SEQ ID NO: 424530 - DNA, 20 bp, Artificial Sequence
  chemically synthesized
ctagtggccccagagctaat

SEQ ID NO: 424531 - DNA, 20 bp, Artificial Sequence
  chemically synthesized
gggcttggcctcattagctc

SEQ ID NO: 424532 - DNA, 20 bp, Artificial Sequence
  chemically synthesized
ggcttggcctcattagctct

SEQ ID NO: 424533 - DNA, 20 bp, Artificial Sequence
  chemically synthesized
gcttggcctcattagctctg

SEQ ID NO: 424534 - DNA, 20 bp, Artificial Sequence
  chemically synthesized
tttttacactagtggcccca

SEQ ID NO: 424535 - DNA, 20 bp, Artificial Sequence
  chemically synthesized
ctcattagctctggggccac

SEQ ID NO: 424536 - DNA, 20 bp, Artificial Sequence
  chemically synthesized
tttttttacactagtggccc

SEQ ID NO: 424537 - DNA, 20 bp, Artificial Sequence
  chemically synthesized
tgaacctttttttacactag

SEQ ID NO: 424538 - DNA, 20 bp, Artificial Sequence
  chemically synthesized
ctgtgaacctttttttacac

SEQ ID NO: 424539 - DNA, 20 bp, Artificial Sequence
  chemically synthesized
tggggccactagtgtaaaaa

SEQ ID NO: 424540 - DNA, 20 bp, Artificial Sequence
  chemically synthesized
ggggccactagtgtaaaaaa

SEQ ID NO: 424541 - DNA, 20 bp, Artificial Sequence
  chemically synthesized
ctagtgtaaaaaaaggttca

SEQ ID NO: 424542 - DNA, 20 bp, Artificial Sequence
  chemically synthesized
tagtgtaaaaaaaggttcac

SEQ ID NO: 424543 - DNA, 20 bp, Artificial Sequence
  chemically synthesized
agtgtaaaaaaaggttcaca

SEQ ID NO: 424544 - DNA, 20 bp, Artificial Sequence
  chemically synthesized
ggttcacagggactctcttc

SEQ ID NO: 424545 - DNA, 20 bp, Artificial Sequence
  chemically synthesized
atatagtccctactagaaga

SEQ ID NO: 424546 - DNA, 20 bp, Artificial Sequence
  chemically synthesized
tcacagggactctcttctag

SEQ ID NO: 424547 - DNA, 20 bp, Artificial Sequence
  chemically synthesized
cacagggactctcttctagt

SEQ ID NO: 424548 - DNA, 20 bp, Artificial Sequence
  chemically synthesized
atatatagtccctactagaa

SEQ ID NO: 424549 - DNA, 20 bp, Artificial Sequence
  chemically synthesized
acagggactctcttctagta

SEQ ID NO: 424550 - DNA, 20 bp, Artificial Sequence
  chemically synthesized
atatatatagtccctactag

SEQ ID NO: 424551 - DNA, 20 bp, Artificial Sequence
  chemically synthesized
tatatatatatagtccctac

SEQ ID NO: 424552 - DNA, 20 bp, Artificial Sequence
  chemically synthesized
tatatatttatatatatata

SEQ ID NO: 424553 - DNA, 20 bp, Artificial Sequence
  chemically synthesized
ataaatatatatatatatga

SEQ ID NO: 424554 - DNA, 20 bp, Artificial Sequence
  chemically synthesized
aaatatatatatatatgacg

SEQ ID NO: 424555 - DNA, 20 bp, Artificial Sequence
  chemically synthesized
cactccaacctgggcaacaa

SEQ ID NO: 424556 - DNA, 20 bp, Artificial Sequence
  chemically synthesized
ggagttttgctcttgttgcc

SEQ ID NO: 424557 - DNA, 20 bp, Artificial Sequence
  chemically synthesized
gagttttgctcttgttgccc

SEQ ID NO: 424558 - DNA, 20 bp, Artificial Sequence
  chemically synthesized
tgcactccaacctgggcaac

SEQ ID NO: 424559 - DNA, 20 bp, Artificial Sequence
  chemically synthesized
tttgctcttgttgcccaggt

SEQ ID NO: 424560 - DNA, 20 bp, Artificial Sequence
  chemically synthesized
tgctcttgttgcccaggttg

SEQ ID NO: 424561 - DNA, 20 bp, Artificial Sequence
  chemically synthesized
acgccattgcactccaacct

SEQ ID NO: 424562 - DNA, 20 bp, Artificial Sequence
  chemically synthesized
cacgccattgcactccaacc

SEQ ID NO: 424563 - DNA, 20 bp, Artificial Sequence
  chemically synthesized
ttgcccaggttggagtgcaa

SEQ ID NO: 424564 - DNA, 20 bp, Artificial Sequence
  chemically synthesized
ggagtgcaatggcgtgatct

SEQ ID NO: 424565 - DNA, 20 bp, Artificial Sequence
  chemically synthesized
ggcagaggttgcggtgagcc

SEQ ID NO: 424566 - DNA, 20 bp, Artificial Sequence
  chemically synthesized
cgggaggcagaggttgcggt

SEQ ID NO: 424567 - DNA, 20 bp, Artificial Sequence
  chemically synthesized
aacccgggaggcagaggttg

SEQ ID NO: 424568 - DNA, 20 bp, Artificial Sequence
  chemically synthesized
cgcttgaacccgggaggcag

SEQ ID NO: 424569 - DNA, 20 bp, Artificial Sequence
  chemically synthesized
tcaccgcaacctctgcctcc

SEQ ID NO: 424570 - DNA, 20 bp, Artificial Sequence
  chemically synthesized
tcgcttgaacccgggaggca

SEQ ID NO: 424571 - DNA, 20 bp, Artificial Sequence
  chemically synthesized
caccgcaacctctgcctccc

SEQ ID NO: 424572 - DNA, 20 bp, Artificial Sequence
  chemically synthesized
aatcgcttgaacccgggagg

SEQ ID NO: 424573 - DNA, 20 bp, Artificial Sequence
  chemically synthesized
gagaatcgcttgaacccggg

SEQ ID NO: 424574 - DNA, 20 bp, Artificial Sequence
  chemically synthesized
ggagaatcgcttgaacccgg

SEQ ID NO: 424575 - DNA, 20 bp, Artificial Sequence
  chemically synthesized
aacctctgcctcccgggttc

SEQ ID NO: 424576 - DNA, 20 bp, Artificial Sequence
  chemically synthesized
caggagaatcgcttgaaccc

SEQ ID NO: 424577 - DNA, 20 bp, Artificial Sequence
  chemically synthesized
gcaggagaatcgcttgaacc

SEQ ID NO: 424578 - DNA, 20 bp, Artificial Sequence
  chemically synthesized
ttcaagcgattctcctgcct

SEQ ID NO: 424579 - DNA, 20 bp, Artificial Sequence
  chemically synthesized
tgctccggaggctgaggcag

SEQ ID NO: 424580 - DNA, 20 bp, Artificial Sequence
  chemically synthesized
gctgctccggaggctgaggc

SEQ ID NO: 424581 - DNA, 20 bp, Artificial Sequence
  chemically synthesized
agctgctccggaggctgagg

SEQ ID NO: 424582 - DNA, 20 bp, Artificial Sequence
  chemically synthesized
gattctcctgcctcagcctc

SEQ ID NO: 424583 - DNA, 20 bp, Artificial Sequence
  chemically synthesized
cccagctgctccggaggctg

SEQ ID NO: 424584 - DNA, 20 bp, Artificial Sequence
  chemically synthesized
tcccagctgctccggaggct

SEQ ID NO: 424585 - DNA, 20 bp, Artificial Sequence
  chemically synthesized
ttctcctgcctcagcctccg

SEQ ID NO: 424586 - DNA, 20 bp, Artificial Sequence
  chemically synthesized
tcctgcctcagcctccggag

SEQ ID NO: 424587 - DNA, 20 bp, Artificial Sequence
  chemically synthesized
ggtagtcccagctgctccgg

SEQ ID NO: 424588 - DNA, 20 bp, Artificial Sequence
  chemically synthesized
tggtagtcccagctgctccg

SEQ ID NO: 424589 - DNA, 20 bp, Artificial Sequence
  chemically synthesized
gcctcagcctccggagcagc

SEQ ID NO: 424590 - DNA, 20 bp, Artificial Sequence
  chemically synthesized
catggtagtcccagctgctc

SEQ ID NO: 424591 - DNA, 20 bp, Artificial Sequence
  chemically synthesized
cctcagcctccggagcagct

SEQ ID NO: 424592 - DNA, 20 bp, Artificial Sequence
  chemically synthesized
gtggtggcgcatggtagtcc

SEQ ID NO: 424593 - DNA, 20 bp, Artificial Sequence
  chemically synthesized
ctgggcgtggtggcgcatgg

SEQ ID NO: 424594 - DNA, 20 bp, Artificial Sequence
  chemically synthesized
tagctgggcgtggtggcgca

SEQ ID NO: 424595 - DNA, 20 bp, Artificial Sequence
  chemically synthesized
ctaccatgcgccaccacgcc

SEQ ID NO: 424596 - DNA, 20 bp, Artificial Sequence
  chemically synthesized
acaaaattagctgggcgtgg

SEQ ID NO: 424597 - DNA, 20 bp, Artificial Sequence
  chemically synthesized
aatacaaaattagctgggcg

SEQ ID NO: 424598 - DNA, 20 bp, Artificial Sequence
  chemically synthesized
ctaaaaatacaaaattagct

SEQ ID NO: 424599 - DNA, 20 bp, Artificial Sequence
  chemically synthesized
actaaaaatacaaaattagc

SEQ ID NO: 424600 - DNA, 20 bp, Artificial Sequence
  chemically synthesized
ctctactaaaaatacaaaat

SEQ ID NO: 424601 - DNA, 20 bp, Artificial Sequence
  chemically synthesized
cccagctaattttgtatttt

SEQ ID NO: 424602 - DNA, 20 bp, Artificial Sequence
  chemically synthesized
agctaattttgtatttttag

SEQ ID NO: 424603 - DNA, 20 bp, Artificial Sequence
  chemically synthesized
ctaattttgtatttttagta

SEQ ID NO: 424604 - DNA, 20 bp, Artificial Sequence
  chemically synthesized
ttttgtatttttagtagaga

SEQ ID NO: 424605 - DNA, 20 bp, Artificial Sequence
  chemically synthesized
tttgtatttttagtagagac

SEQ ID NO: 424606 - DNA, 20 bp, Artificial Sequence
  chemically synthesized
ttgtatttttagtagagacg

SEQ ID NO: 424607 - DNA, 20 bp, Artificial Sequence
  chemically synthesized
gagacggggtttctccatgt

SEQ ID NO: 424608 - DNA, 20 bp, Artificial Sequence
  chemically synthesized
agaccagcctgaccaacatg

SEQ ID NO: 424609 - DNA, 20 bp, Artificial Sequence
  chemically synthesized
cggggtttctccatgttggt

SEQ ID NO: 424610 - DNA, 20 bp, Artificial Sequence
  chemically synthesized
cgagaccagcctgaccaaca

SEQ ID NO: 424611 - DNA, 20 bp, Artificial Sequence
  chemically synthesized
ggggtttctccatgttggtc

SEQ ID NO: 424612 - DNA, 20 bp, Artificial Sequence
  chemically synthesized
tttctccatgttggtcaggc

SEQ ID NO: 424613 - DNA, 20 bp, Artificial Sequence
  chemically synthesized
catgttggtcaggctggtct

SEQ ID NO: 424614 - DNA, 20 bp, Artificial Sequence
  chemically synthesized
tgaggtcgggagtccgagac

SEQ ID NO: 424615 - DNA, 20 bp, Artificial Sequence
  chemically synthesized
tcacctgaggtcgggagtcc

SEQ ID NO: 424616 - DNA, 20 bp, Artificial Sequence
  chemically synthesized
tggtctcggactcccgacct

SEQ ID NO: 424617 - DNA, 20 bp, Artificial Sequence
  chemically synthesized
ggcggatcacctgaggtcgg

SEQ ID NO: 424618 - DNA, 20 bp, Artificial Sequence
  chemically synthesized
ggtctcggactcccgacctc

SEQ ID NO: 424619 - DNA, 20 bp, Artificial Sequence
  chemically synthesized
caggcggatcacctgaggtc

SEQ ID NO: 424620 - DNA, 20 bp, Artificial Sequence
  chemically synthesized
gcaggcggatcacctgaggt

SEQ ID NO: 424621 - DNA, 20 bp, Artificial Sequence
  chemically synthesized
cgaggcaggcggatcacctg

SEQ ID NO: 424622 - DNA, 20 bp, Artificial Sequence
  chemically synthesized
ccgaggcaggcggatcacct

SEQ ID NO: 424623 - DNA, 20 bp, Artificial Sequence
  chemically synthesized
ctcaggtgatccgcctgcct

SEQ ID NO: 424624 - DNA, 20 bp, Artificial Sequence
  chemically synthesized
ctttgggaggccgaggcagg

SEQ ID NO: 424625 - DNA, 20 bp, Artificial Sequence
  chemically synthesized
gcactttgggaggccgaggc

SEQ ID NO: 424626 - DNA, 20 bp, Artificial Sequence
  chemically synthesized
agcactttgggaggccgagg

SEQ ID NO: 424627 - DNA, 20 bp, Artificial Sequence
  chemically synthesized
cccagcactttgggaggccg

SEQ ID NO: 424628 - DNA, 20 bp, Artificial Sequence
  chemically synthesized
tcccagcactttgggaggcc

SEQ ID NO: 424629 - DNA, 20 bp, Artificial Sequence
  chemically synthesized
ccgcctgcctcggcctccca

SEQ ID NO: 424630 - DNA, 20 bp, Artificial Sequence
  chemically synthesized
tgtaatcccagcactttggg

SEQ ID NO: 424631 - DNA, 20 bp, Artificial Sequence
  chemically synthesized
ctgtaatcccagcactttgg

SEQ ID NO: 424632 - DNA, 20 bp, Artificial Sequence
  chemically synthesized
gcctcggcctcccaaagtgc

SEQ ID NO: 424633 - DNA, 20 bp, Artificial Sequence
  chemically synthesized
gcctgtaatcccagcacttt

SEQ ID NO: 424634 - DNA, 20 bp, Artificial Sequence
  chemically synthesized
cctcggcctcccaaagtgct

SEQ ID NO: 424635 - DNA, 20 bp, Artificial Sequence
  chemically synthesized
cgcctgtaatcccagcactt

SEQ ID NO: 424636 - DNA, 20 bp, Artificial Sequence
  chemically synthesized
ctcccaaagtgctgggatta

SEQ ID NO: 424637 - DNA, 20 bp, Artificial Sequence
  chemically synthesized
tcccaaagtgctgggattac

SEQ ID NO: 424638 - DNA, 20 bp, Artificial Sequence
  chemically synthesized
gtggctcacgcctgtaatcc

SEQ ID NO: 424639 - DNA, 20 bp, Artificial Sequence
  chemically synthesized
agtgctgggattacaggcgt

SEQ ID NO: 424640 - DNA, 20 bp, Artificial Sequence
  chemically synthesized
gggattacaggcgtgagcca

SEQ ID NO: 424641 - DNA, 20 bp, Artificial Sequence
  chemically synthesized
caggcgtgagccacagcgcc

SEQ ID NO: 424642 - DNA, 20 bp, Artificial Sequence
  chemically synthesized
gaagtcccggccaggcgctg

SEQ ID NO: 424643 - DNA, 20 bp, Artificial Sequence
  chemically synthesized
cgtgagccacagcgcctggc

SEQ ID NO: 424644 - DNA, 20 bp, Artificial Sequence
  chemically synthesized
gtgagccacagcgcctggcc

SEQ ID NO: 424645 - DNA, 20 bp, Artificial Sequence
  chemically synthesized
ttaaatatgaagtcccggcc

SEQ ID NO: 424646 - DNA, 20 bp, Artificial Sequence
  chemically synthesized
attaaatatgaagtcccggc

SEQ ID NO: 424647 - DNA, 20 bp, Artificial Sequence
  chemically synthesized
cctcattaaatatgaagtcc

SEQ ID NO: 424648 - DNA, 20 bp, Artificial Sequence
  chemically synthesized
gaaaagcctcattaaatatg

SEQ ID NO: 424649 - DNA, 20 bp, Artificial Sequence
  chemically synthesized
gccgggacttcatatttaat

SEQ ID NO: 424650 - DNA, 20 bp, Artificial Sequence
  chemically synthesized
ccgggacttcatatttaatg

SEQ ID NO: 424651 - DNA, 20 bp, Artificial Sequence
  chemically synthesized
ttaattcctagaacagtgaa

SEQ ID NO: 424652 - DNA, 20 bp, Artificial Sequence
  chemically synthesized
aatgaggcttttcactgttc

SEQ ID NO: 424653 - DNA, 20 bp, Artificial Sequence
  chemically synthesized
atgaggcttttcactgttct

SEQ ID NO: 424654 - DNA, 20 bp, Artificial Sequence
  chemically synthesized
actcagtttaattcctagaa

SEQ ID NO: 424655 - DNA, 20 bp, Artificial Sequence
  chemically synthesized
ctgaaactcagtttaattcc

SEQ ID NO: 424656 - DNA, 20 bp, Artificial Sequence
  chemically synthesized
actgttctaggaattaaact

SEQ ID NO: 424657 - DNA, 20 bp, Artificial Sequence
  chemically synthesized
ctaggaattaaactgagttt

SEQ ID NO: 424658 - DNA, 20 bp, Artificial Sequence
  chemically synthesized
taggaattaaactgagtttc

SEQ ID NO: 424659 - DNA, 20 bp, Artificial Sequence
  chemically synthesized
tgaatgcaatacctgaaact

SEQ ID NO: 424660 - DNA, 20 bp, Artificial Sequence
  chemically synthesized
gagtttcaggtattgcattc

SEQ ID NO: 424661 - DNA, 20 bp, Artificial Sequence
  chemically synthesized
attgcattcaagaatcttct

SEQ ID NO: 424662 - DNA, 20 bp, Artificial Sequence
  chemically synthesized
aatattgcaggtttgctgag

SEQ ID NO: 424663 - DNA, 20 bp, Artificial Sequence
  chemically synthesized
accaatattgcaggtttgct

SEQ ID NO: 424664 - DNA, 20 bp, Artificial Sequence
  chemically synthesized
tctcagcaaacctgcaatat

SEQ ID NO: 424665 - DNA, 20 bp, Artificial Sequence
  chemically synthesized
aataacattaccaatattgc

SEQ ID NO: 424666 - DNA, 20 bp, Artificial Sequence
  chemically synthesized
gaataacattaccaatattg

SEQ ID NO: 424667 - DNA, 20 bp, Artificial Sequence
  chemically synthesized
tcacctgtaaaacgagttta

SEQ ID NO: 424668 - DNA, 20 bp, Artificial Sequence
  chemically synthesized
ctcacctgtaaaacgagttt

SEQ ID NO: 424669 - DNA, 20 bp, Artificial Sequence
  chemically synthesized
tattccttaaactcgtttta

SEQ ID NO: 424670 - DNA, 20 bp, Artificial Sequence
  chemically synthesized
attccttaaactcgttttac

SEQ ID NO: 424671 - DNA, 20 bp, Artificial Sequence
  chemically synthesized
aatctcctcacctgtaaaac

SEQ ID NO: 424672 - DNA, 20 bp, Artificial Sequence
  chemically synthesized
cttaaactcgttttacaggt

SEQ ID NO: 424673 - DNA, 20 bp, Artificial Sequence
  chemically synthesized
ttaaactcgttttacaggtg

SEQ ID NO: 424674 - DNA, 20 bp, Artificial Sequence
  chemically synthesized
aaactcgttttacaggtgag

SEQ ID NO: 424675 - DNA, 20 bp, Artificial Sequence
  chemically synthesized
cgttttacaggtgaggagat

SEQ ID NO: 424676 - DNA, 20 bp, Artificial Sequence
  chemically synthesized
ttttacaggtgaggagattg

SEQ ID NO: 424677 - DNA, 20 bp, Artificial Sequence
  chemically synthesized
caggtgaggagattggagct

SEQ ID NO: 424678 - DNA, 20 bp, Artificial Sequence
  chemically synthesized
ggtgaggagattggagctca

SEQ ID NO: 424679 - DNA, 20 bp, Artificial Sequence
  chemically synthesized
tgaggagattggagctcaga

SEQ ID NO: 424680 - DNA, 20 bp, Artificial Sequence
  chemically synthesized
gaggagattggagctcagag

SEQ ID NO: 424681 - DNA, 20 bp, Artificial Sequence
  chemically synthesized
gatgactgaaaaacctctct

SEQ ID NO: 424682 - DNA, 20 bp, Artificial Sequence
  chemically synthesized
tggagctcagagaggttttt

SEQ ID NO: 424683 - DNA, 20 bp, Artificial Sequence
  chemically synthesized
ttttcagtcatccaactaac

SEQ ID NO: 424684 - DNA, 20 bp, Artificial Sequence
  chemically synthesized
cttaagcacttccggttagt

SEQ ID NO: 424685 - DNA, 20 bp, Artificial Sequence
  chemically synthesized
tcagtcatccaactaaccgg

SEQ ID NO: 424686 - DNA, 20 bp, Artificial Sequence
  chemically synthesized
gattcttaagcacttccggt

SEQ ID NO: 424687 - DNA, 20 bp, Artificial Sequence
  chemically synthesized
gctggattcttaagcacttc

SEQ ID NO: 424688 - DNA, 20 bp, Artificial Sequence
  chemically synthesized
ccaactaaccggaagtgctt

SEQ ID NO: 424689 - DNA, 20 bp, Artificial Sequence
  chemically synthesized
accggaagtgcttaagaatc

SEQ ID NO: 424690 - DNA, 20 bp, Artificial Sequence
  chemically synthesized
tcaggtagagctggattctt

SEQ ID NO: 424691 - DNA, 20 bp, Artificial Sequence
  chemically synthesized
tttagggagtcaggtagagc

SEQ ID NO: 424692 - DNA, 20 bp, Artificial Sequence
  chemically synthesized
cttgtttagggagtcaggta

SEQ ID NO: 424693 - DNA, 20 bp, Artificial Sequence
  chemically synthesized
cacttgtttagggagtcagg

SEQ ID NO: 424694 - DNA, 20 bp, Artificial Sequence
  chemically synthesized
acacacttgtttagggagtc

SEQ ID NO: 424695 - DNA, 20 bp, Artificial Sequence
  chemically synthesized
cacacacttgtttagggagt

SEQ ID NO: 424696 - DNA, 20 bp, Artificial Sequence
  chemically synthesized
ctctacctgactccctaaac

SEQ ID NO: 424697 - DNA, 20 bp, Artificial Sequence
  chemically synthesized
ttgacacacacttgtttagg

SEQ ID NO: 424698 - DNA, 20 bp, Artificial Sequence
  chemically synthesized
tcttgacacacacttgttta

SEQ ID NO: 424699 - DNA, 20 bp, Artificial Sequence
  chemically synthesized
ctcttgacacacacttgttt

SEQ ID NO: 424700 - DNA, 20 bp, Artificial Sequence
  chemically synthesized
actcttgacacacacttgtt

SEQ ID NO: 424701 - DNA, 20 bp, Artificial Sequence
  chemically synthesized
tccctaaacaagtgtgtgtc

SEQ ID NO: 424702 - DNA, 20 bp, Artificial Sequence
  chemically synthesized
cctaaacaagtgtgtgtcaa

SEQ ID NO: 424703 - DNA, 20 bp, Artificial Sequence
  chemically synthesized
aagtgtgtgtcaagagttaa

SEQ ID NO: 424704 - DNA, 20 bp, Artificial Sequence
  chemically synthesized
agtgtgtgtcaagagttaat

SEQ ID NO: 424705 - DNA, 20 bp, Artificial Sequence
  chemically synthesized
taatgggcatacaaaccacc

SEQ ID NO: 424706 - DNA, 20 bp, Artificial Sequence
  chemically synthesized
aatgggcatacaaaccacct

SEQ ID NO: 424707 - DNA, 20 bp, Artificial Sequence
  chemically synthesized
attttaccaagatacccagg

SEQ ID NO: 424708 - DNA, 20 bp, Artificial Sequence
  chemically synthesized
cgtattttaccaagataccc

SEQ ID NO: 424709 - DNA, 20 bp, Artificial Sequence
  chemically synthesized
tacaaaccacctgggtatct

SEQ ID NO: 424710 - DNA, 20 bp, Artificial Sequence
  chemically synthesized
ccgtattttaccaagatacc

SEQ ID NO: 424711 - DNA, 20 bp, Artificial Sequence
  chemically synthesized
atcagaacccgtattttacc

SEQ ID NO: 424712 - DNA, 20 bp, Artificial Sequence
  chemically synthesized
ctgggtatcttggtaaaata

SEQ ID NO: 424713 - DNA, 20 bp, Artificial Sequence
  chemically synthesized
tgggtatcttggtaaaatac

SEQ ID NO: 424714 - DNA, 20 bp, Artificial Sequence
  chemically synthesized
gtaaaatacgggttctgatt

SEQ ID NO: 424715 - DNA, 20 bp, Artificial Sequence
  chemically synthesized
cccacctaaaattaccgaat

SEQ ID NO: 424716 - DNA, 20 bp, Artificial Sequence
  chemically synthesized
gggttctgattcggtaattt

SEQ ID NO: 424717 - DNA, 20 bp, Artificial Sequence
  chemically synthesized
ggttctgattcggtaatttt

SEQ ID NO: 424718 - DNA, 20 bp, Artificial Sequence
  chemically synthesized
tctgattcggtaattttagg

SEQ ID NO: 424719 - DNA, 20 bp, Artificial Sequence
  chemically synthesized
ctgattcggtaattttaggt

SEQ ID NO: 424720 - DNA, 20 bp, Artificial Sequence
  chemically synthesized
ggtaattttaggtgggacct

SEQ ID NO: 424721 - DNA, 20 bp, Artificial Sequence
  chemically synthesized
tattggaaatgcagaatctc

SEQ ID NO: 424722 - DNA, 20 bp, Artificial Sequence
  chemically synthesized
ttattggaaatgcagaatct

SEQ ID NO: 424723 - DNA, 20 bp, Artificial Sequence
  chemically synthesized
cagggaacttattggaaatg

SEQ ID NO: 424724 - DNA, 20 bp, Artificial Sequence
  chemically synthesized
tgagattctgcatttccaat

SEQ ID NO: 424725 - DNA, 20 bp, Artificial Sequence
  chemically synthesized
agcagccccagggaacttat

SEQ ID NO: 424726 - DNA, 20 bp, Artificial Sequence
  chemically synthesized
tgcatttccaataagttccc

SEQ ID NO: 424727 - DNA, 20 bp, Artificial Sequence
  chemically synthesized
gcatttccaataagttccct

SEQ ID NO: 424728 - DNA, 20 bp, Artificial Sequence
  chemically synthesized
catttccaataagttccctg

SEQ ID NO: 424729 - DNA, 20 bp, Artificial Sequence
  chemically synthesized
cagcagccgcagcagcccca

SEQ ID NO: 424730 - DNA, 20 bp, Artificial Sequence
  chemically synthesized
gcagcagccgcagcagcccc

SEQ ID NO: 424731 - DNA, 20 bp, Artificial Sequence
  chemically synthesized
agcagcagccgcagcagccc

SEQ ID NO: 424732 - DNA, 20 bp, Artificial Sequence
  chemically synthesized
taagttccctggggctgctg

SEQ ID NO: 424733 - DNA, 20 bp, Artificial Sequence
  chemically synthesized
agcagcagcagcagccgcag

SEQ ID NO: 424734 - DNA, 20 bp, Artificial Sequence
  chemically synthesized
accagcagcagcagcagccg

SEQ ID NO: 424735 - DNA, 20 bp, Artificial Sequence
  chemically synthesized
aagaccaccagcagcagcag

SEQ ID NO: 424736 - DNA, 20 bp, Artificial Sequence
  chemically synthesized
gctgcggctgctgctgctgc

SEQ ID NO: 424737 - DNA, 20 bp, Artificial Sequence
  chemically synthesized
ccaaagaccaccagcagcag

SEQ ID NO: 424738 - DNA, 20 bp, Artificial Sequence
  chemically synthesized
gcggctgctgctgctgctgg

SEQ ID NO: 424739 - DNA, 20 bp, Artificial Sequence
  chemically synthesized
tgtccaaagaccaccagcag

SEQ ID NO: 424740 - DNA, 20 bp, Artificial Sequence
  chemically synthesized
tgttgtccaaagaccaccag

SEQ ID NO: 424741 - DNA, 20 bp, Artificial Sequence
  chemically synthesized
atgtgttgtccaaagaccac

SEQ ID NO: 424742 - DNA, 20 bp, Artificial Sequence
  chemically synthesized
ctgctgctgctggtggtctt

SEQ ID NO: 424743 - DNA, 20 bp, Artificial Sequence
  chemically synthesized
gctacccgatgtgttgtcca

SEQ ID NO: 424744 - DNA, 20 bp, Artificial Sequence
  chemically synthesized
gtggtctttggacaacacat

SEQ ID NO: 424745 - DNA, 20 bp, Artificial Sequence
  chemically synthesized
tggtctttggacaacacatc

SEQ ID NO: 424746 - DNA, 20 bp, Artificial Sequence
  chemically synthesized
tctttggacaacacatcggg

SEQ ID NO: 424747 - DNA, 20 bp, Artificial Sequence
  chemically synthesized
tggacaacacatcgggtagc

SEQ ID NO: 424748 - DNA, 20 bp, Artificial Sequence
  chemically synthesized
ggacaacacatcgggtagcg

SEQ ID NO: 424749 - DNA, 20 bp, Artificial Sequence
  chemically synthesized
acatcgggtagcgaggcccc

SEQ ID NO: 424750 - DNA, 20 bp, Artificial Sequence
  chemically synthesized
ttggagaaccacgggtctag

SEQ ID NO: 424751 - DNA, 20 bp, Artificial Sequence
  chemically synthesized
gttggagaaccacgggtcta

SEQ ID NO: 424752 - DNA, 20 bp, Artificial Sequence
  chemically synthesized
tagcgaggcccctagacccg

SEQ ID NO: 424753 - DNA, 20 bp, Artificial Sequence
  chemically synthesized
agttggagaaccacgggtct

SEQ ID NO: 424754 - DNA, 20 bp, Artificial Sequence
  chemically synthesized
aagttggagaaccacgggtc

SEQ ID NO: 424755 - DNA, 20 bp, Artificial Sequence
  chemically synthesized
cagcaaagttggagaaccac

SEQ ID NO: 424756 - DNA, 20 bp, Artificial Sequence
  chemically synthesized
tcagcaaagttggagaacca

SEQ ID NO: 424757 - DNA, 20 bp, Artificial Sequence
  chemically synthesized
ttctaatatcagcaaagttg

SEQ ID NO: 424758 - DNA, 20 bp, Artificial Sequence
  chemically synthesized
gattctaatatcagcaaagt

SEQ ID NO: 424759 - DNA, 20 bp, Artificial Sequence
  chemically synthesized
aggggattctaatatcagca

SEQ ID NO: 424760 - DNA, 20 bp, Artificial Sequence
  chemically synthesized
ttctccaactttgctgatat

SEQ ID NO: 424761 - DNA, 20 bp, Artificial Sequence
  chemically synthesized
tcttcaggggattctaatat

SEQ ID NO: 424762 - DNA, 20 bp, Artificial Sequence
  chemically synthesized
gctgatattagaatcccctg

SEQ ID NO: 424763 - DNA, 20 bp, Artificial Sequence
  chemically synthesized
ttcttaaagaagttcttcag

SEQ ID NO: 424764 - DNA, 20 bp, Artificial Sequence
  chemically synthesized
tttcttaaagaagttcttca

SEQ ID NO: 424765 - DNA, 20 bp, Artificial Sequence
  chemically synthesized
ttttcttaaagaagttcttc

SEQ ID NO: 424766 - DNA, 20 bp, Artificial Sequence
  chemically synthesized
tttttcttaaagaagttctt

SEQ ID NO: 424767 - DNA, 20 bp, Artificial Sequence
  chemically synthesized
atcccctgaagaacttcttt

SEQ ID NO: 424768 - DNA, 20 bp, Artificial Sequence
  chemically synthesized
actgggtttttttcttaaag

SEQ ID NO: 424769 - DNA, 20 bp, Artificial Sequence
  chemically synthesized
ggcactgggtttttttctta

SEQ ID NO: 424770 - DNA, 20 bp, Artificial Sequence
  chemically synthesized
acttctttaagaaaaaaacc

SEQ ID NO: 424771 - DNA, 20 bp, Artificial Sequence
  chemically synthesized
tgaagtgcagtttgggcact

SEQ ID NO: 424772 - DNA, 20 bp, Artificial Sequence
  chemically synthesized
atgaagtgcagtttgggcac

SEQ ID NO: 424773 - DNA, 20 bp, Artificial Sequence
  chemically synthesized
attgatatgaagtgcagttt

SEQ ID NO: 424774 - DNA, 20 bp, Artificial Sequence
  chemically synthesized
cattgatatgaagtgcagtt

SEQ ID NO: 424775 - DNA, 20 bp, Artificial Sequence
  chemically synthesized
gatttcattgatatgaagtg

SEQ ID NO: 424776 - DNA, 20 bp, Artificial Sequence
  chemically synthesized
actctgatttcattgatatg

SEQ ID NO: 424777 - DNA, 20 bp, Artificial Sequence
  chemically synthesized
gcacttcatatcaatgaaat

SEQ ID NO: 424778 - DNA, 20 bp, Artificial Sequence
  chemically synthesized
acttcatatcaatgaaatca

SEQ ID NO: 424779 - DNA, 20 bp, Artificial Sequence
  chemically synthesized
atcaatgaaatcagagtctc

SEQ ID NO: 424780 - DNA, 20 bp, Artificial Sequence
  chemically synthesized
aaatcagagtctctagaaat

SEQ ID NO: 424781 - DNA, 20 bp, Artificial Sequence
  chemically synthesized
ttgcttgagtctcatttcta

SEQ ID NO: 424782 - DNA, 20 bp, Artificial Sequence
  chemically synthesized
aattgcttgagtctcatttc

SEQ ID NO: 424783 - DNA, 20 bp, Artificial Sequence
  chemically synthesized
agtctctagaaatgagactc

SEQ ID NO: 424784 - DNA, 20 bp, Artificial Sequence
  chemically synthesized
gctgttcattagaattgctt

SEQ ID NO: 424785 - DNA, 20 bp, Artificial Sequence
  chemically synthesized
actcaagcaattctaatgaa

SEQ ID NO: 424786 - DNA, 20 bp, Artificial Sequence
  chemically synthesized
tctcaaacttggctgttcat

SEQ ID NO: 424787 - DNA, 20 bp, Artificial Sequence
  chemically synthesized
agcaattctaatgaacagcc

SEQ ID NO: 424788 - DNA, 20 bp, Artificial Sequence
  chemically synthesized
tctaatgaacagccaagttt

SEQ ID NO: 424789 - DNA, 20 bp, Artificial Sequence
  chemically synthesized
tgggtacagattctcaaact

SEQ ID NO: 424790 - DNA, 20 bp, Artificial Sequence
  chemically synthesized
taacaacatgtcaatgggta

SEQ ID NO: 424791 - DNA, 20 bp, Artificial Sequence
  chemically synthesized
tttgataacaacatgtcaat

SEQ ID NO: 424792 - DNA, 20 bp, Artificial Sequence
  chemically synthesized
atttgataacaacatgtcaa

SEQ ID NO: 424793 - DNA, 20 bp, Artificial Sequence
  chemically synthesized
ttgacatgttgttatcaaat

SEQ ID NO: 424794 - DNA, 20 bp, Artificial Sequence
  chemically synthesized
tgacatgttgttatcaaatt

SEQ ID NO: 424795 - DNA, 20 bp, Artificial Sequence
  chemically synthesized
ttatcaaattaggtgctcat

SEQ ID NO: 424796 - DNA, 20 bp, Artificial Sequence
  chemically synthesized
gctcgtcagttgattctgat

SEQ ID NO: 424797 - DNA, 20 bp, Artificial Sequence
  chemically synthesized
gctcatcagaatcaactgac

SEQ ID NO: 424798 - DNA, 20 bp, Artificial Sequence
  chemically synthesized
tgggtttataatgagctcgt

SEQ ID NO: 424799 - DNA, 20 bp, Artificial Sequence
  chemically synthesized
taggtctctgggtttataat

SEQ ID NO: 424800 - DNA, 20 bp, Artificial Sequence
  chemically synthesized
tgacgagctcattataaacc

SEQ ID NO: 424801 - DNA, 20 bp, Artificial Sequence
  chemically synthesized
acgagctcattataaaccca

SEQ ID NO: 424802 - DNA, 20 bp, Artificial Sequence
  chemically synthesized
tttaatgaatgtaggtctct

SEQ ID NO: 424803 - DNA, 20 bp, Artificial Sequence
  chemically synthesized
ctttaatgaatgtaggtctc

SEQ ID NO: 424804 - DNA, 20 bp, Artificial Sequence
  chemically synthesized
atcactgctttaatgaatgt

SEQ ID NO: 424805 - DNA, 20 bp, Artificial Sequence
  chemically synthesized
tatcactgctttaatgaatg

SEQ ID NO: 424806 - DNA, 20 bp, Artificial Sequence
  chemically synthesized
ccagagacctacattcatta

SEQ ID NO: 424807 - DNA, 20 bp, Artificial Sequence
  chemically synthesized
gagacctacattcattaaag

SEQ ID NO: 424808 - DNA, 20 bp, Artificial Sequence
  chemically synthesized
acattcattaaagcagtgat

SEQ ID NO: 424809 - DNA, 20 bp, Artificial Sequence
  chemically synthesized
attaaagcagtgataagact

SEQ ID NO: 424810 - DNA, 20 bp, Artificial Sequence
  chemically synthesized
ttaaagcagtgataagactt

SEQ ID NO: 424811 - DNA, 20 bp, Artificial Sequence
  chemically synthesized
acctaaatgtgcaaaggcct

SEQ ID NO: 424812 - DNA, 20 bp, Artificial Sequence
  chemically synthesized
gggtctacctaaatgtgcaa

SEQ ID NO: 424813 - DNA, 20 bp, Artificial Sequence
  chemically synthesized
ggggtctacctaaatgtgca

SEQ ID NO: 424814 - DNA, 20 bp, Artificial Sequence
  chemically synthesized
gacttaggcctttgcacatt

SEQ ID NO: 424815 - DNA, 20 bp, Artificial Sequence
  chemically synthesized
acttaggcctttgcacattt

SEQ ID NO: 424816 - DNA, 20 bp, Artificial Sequence
  chemically synthesized
taggcctttgcacatttagg

SEQ ID NO: 424817 - DNA, 20 bp, Artificial Sequence
  chemically synthesized
gcacatttaggtagaccccc

SEQ ID NO: 424818 - DNA, 20 bp, Artificial Sequence
  chemically synthesized
cacatttaggtagacccccc

SEQ ID NO: 424819 - DNA, 20 bp, Artificial Sequence
  chemically synthesized
ggataacagaatcacctggg

SEQ ID NO: 424820 - DNA, 20 bp, Artificial Sequence
  chemically synthesized
tggataacagaatcacctgg

SEQ ID NO: 424821 - DNA, 20 bp, Artificial Sequence
  chemically synthesized
ttggataacagaatcacctg

SEQ ID NO: 424822 - DNA, 20 bp, Artificial Sequence
  chemically synthesized
gttggataacagaatcacct

SEQ ID NO: 424823 - DNA, 20 bp, Artificial Sequence
  chemically synthesized
tgttggataacagaatcacc

SEQ ID NO: 424824 - DNA, 20 bp, Artificial Sequence
  chemically synthesized
gttctcaaactgttggataa

SEQ ID NO: 424825 - DNA, 20 bp, Artificial Sequence
  chemically synthesized
caggtgattctgttatccaa

SEQ ID NO: 424826 - DNA, 20 bp, Artificial Sequence
  chemically synthesized
attctgttatccaacagttt

SEQ ID NO: 424827 - DNA, 20 bp, Artificial Sequence
  chemically synthesized
gaaagtggttctcaaactgt

SEQ ID NO: 424828 - DNA, 20 bp, Artificial Sequence
  chemically synthesized
acagtttgagaaccactttc

SEQ ID NO: 424829 - DNA, 20 bp, Artificial Sequence
  chemically synthesized
aaggagcatggtctagaaag

SEQ ID NO: 424830 - DNA, 20 bp, Artificial Sequence
  chemically synthesized
ttgaaggagcatggtctaga

SEQ ID NO: 424831 - DNA, 20 bp, Artificial Sequence
  chemically synthesized
tgatttgaaggagcatggtc

SEQ ID NO: 424832 - DNA, 20 bp, Artificial Sequence
  chemically synthesized
ctgattgatttgaaggagca

SEQ ID NO: 424833 - DNA, 20 bp, Artificial Sequence
  chemically synthesized
ttggtctgattgatttgaag

SEQ ID NO: 424834 - DNA, 20 bp, Artificial Sequence
  chemically synthesized
gcttggtctgattgatttga

SEQ ID NO: 424835 - DNA, 20 bp, Artificial Sequence
  chemically synthesized
ggcttggtctgattgatttg

SEQ ID NO: 424836 - DNA, 20 bp, Artificial Sequence
  chemically synthesized
ccatgctccttcaaatcaat

SEQ ID NO: 424837 - DNA, 20 bp, Artificial Sequence
  chemically synthesized
tccttcaaatcaatcagacc

SEQ ID NO: 424838 - DNA, 20 bp, Artificial Sequence
  chemically synthesized
atcaatcagaccaagccctg

SEQ ID NO: 424839 - DNA, 20 bp, Artificial Sequence
  chemically synthesized
gtaagtttgtctgcagggct

SEQ ID NO: 424840 - DNA, 20 bp, Artificial Sequence
  chemically synthesized
gaatggtaagtttgtctgca

SEQ ID NO: 424841 - DNA, 20 bp, Artificial Sequence
  chemically synthesized
tgaatggtaagtttgtctgc

SEQ ID NO: 424842 - DNA, 20 bp, Artificial Sequence
  chemically synthesized
ctgaatggtaagtttgtctg

SEQ ID NO: 424843 - DNA, 20 bp, Artificial Sequence
  chemically synthesized
ctgcagacaaacttaccatt

SEQ ID NO: 424844 - DNA, 20 bp, Artificial Sequence
  chemically synthesized
tgcagacaaacttaccattc

SEQ ID NO: 424845 - DNA, 20 bp, Artificial Sequence
  chemically synthesized
actttttttgcctgaatggt

SEQ ID NO: 424846 - DNA, 20 bp, Artificial Sequence
  chemically synthesized
cacaactttttttgcctgaa

SEQ ID NO: 424847 - DNA, 20 bp, Artificial Sequence
  chemically synthesized
acttaccattcaggcaaaaa

SEQ ID NO: 424848 - DNA, 20 bp, Artificial Sequence
  chemically synthesized
attcaggcaaaaaaagttgt

SEQ ID NO: 424849 - DNA, 20 bp, Artificial Sequence
  chemically synthesized
caggcaaaaaaagttgtgag

SEQ ID NO: 424850 - DNA, 20 bp, Artificial Sequence
  chemically synthesized
aggcaaaaaaagttgtgagt

SEQ ID NO: 424851 - DNA, 20 bp, Artificial Sequence
  chemically synthesized
gcaaaaaaagttgtgagtag

SEQ ID NO: 424852 - DNA, 20 bp, Artificial Sequence
  chemically synthesized
ctgaggatatgcatgaaaac

SEQ ID NO: 424853 - DNA, 20 bp, Artificial Sequence
  chemically synthesized
cttgttttcatgcatatcct

SEQ ID NO: 424854 - DNA, 20 bp, Artificial Sequence
  chemically synthesized
ttgttttcatgcatatcctc

SEQ ID NO: 424855 - DNA, 20 bp, Artificial Sequence
  chemically synthesized
tgttttcatgcatatcctca

SEQ ID NO: 424856 - DNA, 20 bp, Artificial Sequence
  chemically synthesized
tatcgtaccgatgaaccctg

SEQ ID NO: 424857 - DNA, 20 bp, Artificial Sequence
  chemically synthesized
ttatcgtaccgatgaaccct

SEQ ID NO: 424858 - DNA, 20 bp, Artificial Sequence
  chemically synthesized
tgcatatcctcagggttcat

SEQ ID NO: 424859 - DNA, 20 bp, Artificial Sequence
  chemically synthesized
tcagggttcatcggtacgat

SEQ ID NO: 424860 - DNA, 20 bp, Artificial Sequence
  chemically synthesized
ggtacgataagatatcctcc

SEQ ID NO: 424861 - DNA, 20 bp, Artificial Sequence
  chemically synthesized
cccatgaatttttagcttgg

SEQ ID NO: 424862 - DNA, 20 bp, Artificial Sequence
  chemically synthesized
ccccatgaatttttagcttg

SEQ ID NO: 424863 - DNA, 20 bp, Artificial Sequence
  chemically synthesized
ggccccatgaatttttagct

SEQ ID NO: 424864 - DNA, 20 bp, Artificial Sequence
  chemically synthesized
gtgagggccccatgaatttt

SEQ ID NO: 424865 - DNA, 20 bp, Artificial Sequence
  chemically synthesized
tcctccaagctaaaaattca

SEQ ID NO: 424866 - DNA, 20 bp, Artificial Sequence
  chemically synthesized
cctccaagctaaaaattcat

SEQ ID NO: 424867 - DNA, 20 bp, Artificial Sequence
  chemically synthesized
ctccaagctaaaaattcatg

SEQ ID NO: 424868 - DNA, 20 bp, Artificial Sequence
  chemically synthesized
ctggggatgtggtggtgtga

SEQ ID NO: 424869 - DNA, 20 bp, Artificial Sequence
  chemically synthesized
actggggatgtggtggtgtg

SEQ ID NO: 424870 - DNA, 20 bp, Artificial Sequence
  chemically synthesized
aactggggatgtggtggtgt

SEQ ID NO: 424871 - DNA, 20 bp, Artificial Sequence
  chemically synthesized
gtctgtaactggggatgtgg

SEQ ID NO: 424872 - DNA, 20 bp, Artificial Sequence
  chemically synthesized
ccctcacaccaccacatccc

SEQ ID NO: 424873 - DNA, 20 bp, Artificial Sequence
  chemically synthesized
aatgtctgtaactggggatg

SEQ ID NO: 424874 - DNA, 20 bp, Artificial Sequence
  chemically synthesized
caccaccacatccccagtta

SEQ ID NO: 424875 - DNA, 20 bp, Artificial Sequence
  chemically synthesized
taaaaaaatgtctgtaactg

SEQ ID NO: 424876 - DNA, 20 bp, Artificial Sequence
  chemically synthesized
ttaaaaaaatgtctgtaact

SEQ ID NO: 424877 - DNA, 20 bp, Artificial Sequence
  chemically synthesized
tttaaaaaaatgtctgtaac

SEQ ID NO: 424878 - DNA, 20 bp, Artificial Sequence
  chemically synthesized
tttttttaaacctcttttgt

SEQ ID NO: 424879 - DNA, 20 bp, Artificial Sequence
  chemically synthesized
tacactgatactcacaaaag

SEQ ID NO: 424880 - DNA, 20 bp, Artificial Sequence
  chemically synthesized
gtacactgatactcacaaaa

SEQ ID NO: 424881 - DNA, 20 bp, Artificial Sequence
  chemically synthesized
gagtacactgatactcacaa

SEQ ID NO: 424882 - DNA, 20 bp, Artificial Sequence
  chemically synthesized
taaacctcttttgtgagtat

SEQ ID NO: 424883 - DNA, 20 bp, Artificial Sequence
  chemically synthesized
acacagtgtaagcatacaat

SEQ ID NO: 424884 - DNA, 20 bp, Artificial Sequence
  chemically synthesized
taaaaacccacacacagtgt

SEQ ID NO: 424885 - DNA, 20 bp, Artificial Sequence
  chemically synthesized
ttgtatgcttacactgtgtg

SEQ ID NO: 424886 - DNA, 20 bp, Artificial Sequence
  chemically synthesized
tgtatgcttacactgtgtgt

SEQ ID NO: 424887 - DNA, 20 bp, Artificial Sequence
  chemically synthesized
caggcataaaaacccacaca

SEQ ID NO: 424888 - DNA, 20 bp, Artificial Sequence
  chemically synthesized
tgtgtgggtttttatgcctg

SEQ ID NO: 424889 - DNA, 20 bp, Artificial Sequence
  chemically synthesized
tagatttaatgcgcaaccac

SEQ ID NO: 424890 - DNA, 20 bp, Artificial Sequence
  chemically synthesized
atagatttaatgcgcaacca

SEQ ID NO: 424891 - DNA, 20 bp, Artificial Sequence
  chemically synthesized
ctgaagtactgacaaagtaa

SEQ ID NO: 424892 - DNA, 20 bp, Artificial Sequence
  chemically synthesized
cattaaatctattactttgt

SEQ ID NO: 424893 - DNA, 20 bp, Artificial Sequence
  chemically synthesized
tttcccctgaagtactgaca

SEQ ID NO: 424894 - DNA, 20 bp, Artificial Sequence
  chemically synthesized
ctattactttgtcagtactt

SEQ ID NO: 424895 - DNA, 20 bp, Artificial Sequence
  chemically synthesized
tattactttgtcagtacttc

SEQ ID NO: 424896 - DNA, 20 bp, Artificial Sequence
  chemically synthesized
attactttgtcagtacttca

SEQ ID NO: 424897 - DNA, 20 bp, Artificial Sequence
  chemically synthesized
ttactttgtcagtacttcag

SEQ ID NO: 424898 - DNA, 20 bp, Artificial Sequence
  chemically synthesized
tttgtcagtacttcagggga

SEQ ID NO: 424899 - DNA, 20 bp, Artificial Sequence
  chemically synthesized
cattgatacgctttcccctg

SEQ ID NO: 424900 - DNA, 20 bp, Artificial Sequence
  chemically synthesized
ggaaagcgtatcaatgttgt

SEQ ID NO: 424901 - DNA, 20 bp, Artificial Sequence
  chemically synthesized
taagacatttaatatatgcc

SEQ ID NO: 424902 - DNA, 20 bp, Artificial Sequence
  chemically synthesized
aagacatttaatatatgccc

SEQ ID NO: 424903 - DNA, 20 bp, Artificial Sequence
  chemically synthesized
agacatttaatatatgccca

SEQ ID NO: 424904 - DNA, 20 bp, Artificial Sequence
  chemically synthesized
catttaatatatgcccaggg

SEQ ID NO: 424905 - DNA, 20 bp, Artificial Sequence
  chemically synthesized
tttaattatacagctaccct

SEQ ID NO: 424906 - DNA, 20 bp, Artificial Sequence
  chemically synthesized
ttttaattatacagctaccc

SEQ ID NO: 424907 - DNA, 20 bp, Artificial Sequence
  chemically synthesized
atcaattccttttaattata

SEQ ID NO: 424908 - DNA, 20 bp, Artificial Sequence
  chemically synthesized
cagggtagctgtataattaa

SEQ ID NO: 424909 - DNA, 20 bp, Artificial Sequence
  chemically synthesized
agggtagctgtataattaaa

SEQ ID NO: 424910 - DNA, 20 bp, Artificial Sequence
  chemically synthesized
aaaaggaattgattttgaaa

SEQ ID NO: 424911 - DNA, 20 bp, Artificial Sequence
  chemically synthesized
gattttgaaaaagaacctaa

SEQ ID NO: 424912 - DNA, 20 bp, Artificial Sequence
  chemically synthesized
attcatttcaggttaccatt

SEQ ID NO: 424913 - DNA, 20 bp, Artificial Sequence
  chemically synthesized
tattcatttcaggttaccat

SEQ ID NO: 424914 - DNA, 20 bp, Artificial Sequence
  chemically synthesized
tcattttgtctattcatttc

SEQ ID NO: 424915 - DNA, 20 bp, Artificial Sequence
  chemically synthesized
taatggtaacctgaaatgaa

SEQ ID NO: 424916 - DNA, 20 bp, Artificial Sequence
  chemically synthesized
atcattttgtctattcattt

SEQ ID NO: 424917 - DNA, 20 bp, Artificial Sequence
  chemically synthesized
gaatagacaaaatgatccct

SEQ ID NO: 424918 - DNA, 20 bp, Artificial Sequence
  chemically synthesized
gacaaaatgatccctaagct

SEQ ID NO: 424919 - DNA, 20 bp, Artificial Sequence
  chemically synthesized
tgcagttgttactgagctta

SEQ ID NO: 424920 - DNA, 20 bp, Artificial Sequence
  chemically synthesized
ctgcagttgttactgagctt

SEQ ID NO: 424921 - DNA, 20 bp, Artificial Sequence
  chemically synthesized
gctgcagttgttactgagct

SEQ ID NO: 424922 - DNA, 20 bp, Artificial Sequence
  chemically synthesized
attgtgctgcagttgttact

SEQ ID NO: 424923 - DNA, 20 bp, Artificial Sequence
  chemically synthesized
cctaagctcagtaacaactg

SEQ ID NO: 424924 - DNA, 20 bp, Artificial Sequence
  chemically synthesized
taaggtgatacattgtgctg

SEQ ID NO: 424925 - DNA, 20 bp, Artificial Sequence
  chemically synthesized
tgcagcacaatgtatcacct

SEQ ID NO: 424926 - DNA, 20 bp, Artificial Sequence
  chemically synthesized
gcagcacaatgtatcacctt

SEQ ID NO: 424927 - DNA, 20 bp, Artificial Sequence
  chemically synthesized
atgaactaggttttaaccta

SEQ ID NO: 424928 - DNA, 20 bp, Artificial Sequence
  chemically synthesized
tatgaactaggttttaacct

SEQ ID NO: 424929 - DNA, 20 bp, Artificial Sequence
  chemically synthesized
tatcaccttaggttaaaacc

SEQ ID NO: 424930 - DNA, 20 bp, Artificial Sequence
  chemically synthesized
ttgaggattatttatgaact

SEQ ID NO: 424931 - DNA, 20 bp, Artificial Sequence
  chemically synthesized
gttgaggattatttatgaac

SEQ ID NO: 424932 - DNA, 20 bp, Artificial Sequence
  chemically synthesized
aagcccttgaagaggagttg

SEQ ID NO: 424933 - DNA, 20 bp, Artificial Sequence
  chemically synthesized
caagcccttgaagaggagtt

SEQ ID NO: 424934 - DNA, 20 bp, Artificial Sequence
  chemically synthesized
ataatcctcaactcctcttc

SEQ ID NO: 424935 - DNA, 20 bp, Artificial Sequence
  chemically synthesized
taatcctcaactcctcttca

SEQ ID NO: 424936 - DNA, 20 bp, Artificial Sequence
  chemically synthesized
cttcacaagcccttgaagag

SEQ ID NO: 424937 - DNA, 20 bp, Artificial Sequence
  chemically synthesized
aatcctcaactcctcttcaa

SEQ ID NO: 424938 - DNA, 20 bp, Artificial Sequence
  chemically synthesized
atcttcacaagcccttgaag

SEQ ID NO: 424939 - DNA, 20 bp, Artificial Sequence
  chemically synthesized
catcttcacaagcccttgaa

SEQ ID NO: 424940 - DNA, 20 bp, Artificial Sequence
  chemically synthesized
ctcatcttcacaagcccttg

SEQ ID NO: 424941 - DNA, 20 bp, Artificial Sequence
  chemically synthesized
ctcctcttcaagggcttgtg

SEQ ID NO: 424942 - DNA, 20 bp, Artificial Sequence
  chemically synthesized
aaaatgaccctcatcttcac

SEQ ID NO: 424943 - DNA, 20 bp, Artificial Sequence
  chemically synthesized
cttcaagggcttgtgaagat

SEQ ID NO: 424944 - DNA, 20 bp, Artificial Sequence
  chemically synthesized
ttcaagggcttgtgaagatg

SEQ ID NO: 424945 - DNA, 20 bp, Artificial Sequence
  chemically synthesized
tcaagggcttgtgaagatga

SEQ ID NO: 424946 - DNA, 20 bp, Artificial Sequence
  chemically synthesized
gtgaagatgagggtcatttt

SEQ ID NO: 424947 - DNA, 20 bp, Artificial Sequence
  chemically synthesized
aagatgagggtcattttgag

SEQ ID NO: 424948 - DNA, 20 bp, Artificial Sequence
  chemically synthesized
ttttgagaagtgacacattt

SEQ ID NO: 424949 - DNA, 20 bp, Artificial Sequence
  chemically synthesized
gaagtgacacattttggctt

SEQ ID NO: 424950 - DNA, 20 bp, Artificial Sequence
  chemically synthesized
aagtgacacattttggcttc

SEQ ID NO: 424951 - DNA, 20 bp, Artificial Sequence
  chemically synthesized
agtgacacattttggcttca

SEQ ID NO: 424952 - DNA, 20 bp, Artificial Sequence
  chemically synthesized
gtgacacattttggcttcag

SEQ ID NO: 424953 - DNA, 20 bp, Artificial Sequence
  chemically synthesized
gacacattttggcttcaggg

SEQ ID NO: 424954 - DNA, 20 bp, Artificial Sequence
  chemically synthesized
gttatgctaaaactcccctg

SEQ ID NO: 424955 - DNA, 20 bp, Artificial Sequence
  chemically synthesized
ttttggcttcaggggagttt

SEQ ID NO: 424956 - DNA, 20 bp, Artificial Sequence
  chemically synthesized
agttttagcataactgctgt

SEQ ID NO: 424957 - DNA, 20 bp, Artificial Sequence
  chemically synthesized
aagaagatataatctgacag

SEQ ID NO: 424958 - DNA, 20 bp, Artificial Sequence
  chemically synthesized
tttaagaagatataatctga

SEQ ID NO: 424959 - DNA, 20 bp, Artificial Sequence
  chemically synthesized
tgccaacgaaaatgtttaag

SEQ ID NO: 424960 - DNA, 20 bp, Artificial Sequence
  chemically synthesized
cactgccaacgaaaatgttt

SEQ ID NO: 424961 - DNA, 20 bp, Artificial Sequence
  chemically synthesized
atcttcttaaacattttcgt

SEQ ID NO: 424962 - DNA, 20 bp, Artificial Sequence
  chemically synthesized
ttcttaaacattttcgttgg

SEQ ID NO: 424963 - DNA, 20 bp, Artificial Sequence
  chemically synthesized
aaacattttcgttggcagtg

SEQ ID NO: 424964 - DNA, 20 bp, Artificial Sequence
  chemically synthesized
aacattttcgttggcagtga

SEQ ID NO: 424965 - DNA, 20 bp, Artificial Sequence
  chemically synthesized
acattttcgttggcagtgaa

SEQ ID NO: 424966 - DNA, 20 bp, Artificial Sequence
  chemically synthesized
ttttcgttggcagtgaaggg

SEQ ID NO: 424967 - DNA, 20 bp, Artificial Sequence
  chemically synthesized
tggcagtgaagggaagatgt

SEQ ID NO: 424968 - DNA, 20 bp, Artificial Sequence
  chemically synthesized
gggaagatgttagatcatgt

SEQ ID NO: 424969 - DNA, 20 bp, Artificial Sequence
  chemically synthesized
catgttagaaatgtaactaa

SEQ ID NO: 424970 - DNA, 20 bp, Artificial Sequence
  chemically synthesized
atgttagaaatgtaactaat

SEQ ID NO: 424971 - DNA, 20 bp, Artificial Sequence
  chemically synthesized
tgttagaaatgtaactaatg

SEQ ID NO: 424972 - DNA, 20 bp, Artificial Sequence
  chemically synthesized
aagtaaaattttgaccccat

SEQ ID NO: 424973 - DNA, 20 bp, Artificial Sequence
  chemically synthesized
gtcaaaattttacttcctta

SEQ ID NO: 424974 - DNA, 20 bp, Artificial Sequence
  chemically synthesized
tgctcttaagagctgtaagg

SEQ ID NO: 424975 - DNA, 20 bp, Artificial Sequence
  chemically synthesized
atgtgctcttaagagctgta

SEQ ID NO: 424976 - DNA, 20 bp, Artificial Sequence
  chemically synthesized
tatgtgctcttaagagctgt

SEQ ID NO: 424977 - DNA, 20 bp, Artificial Sequence
  chemically synthesized
tttacttccttacagctctt

SEQ ID NO: 424978 - DNA, 20 bp, Artificial Sequence
  chemically synthesized
tacttccttacagctcttaa

SEQ ID NO: 424979 - DNA, 20 bp, Artificial Sequence
  chemically synthesized
ctataagtatgtgctcttaa

SEQ ID NO: 424980 - DNA, 20 bp, Artificial Sequence
  chemically synthesized
tcctataagtatgtgctctt

SEQ ID NO: 424981 - DNA, 20 bp, Artificial Sequence
  chemically synthesized
ctcttaagagcacatactta

SEQ ID NO: 424982 - DNA, 20 bp, Artificial Sequence
  chemically synthesized
tcttaagagcacatacttat

SEQ ID NO: 424983 - DNA, 20 bp, Artificial Sequence
  chemically synthesized
tatccaaaagagtttcctat

SEQ ID NO: 424984 - DNA, 20 bp, Artificial Sequence
  chemically synthesized
atacttataggaaactcttt

SEQ ID NO: 424985 - DNA, 20 bp, Artificial Sequence
  chemically synthesized
attaagggagatatccaaaa

SEQ ID NO: 424986 - DNA, 20 bp, Artificial Sequence
  chemically synthesized
atattaagggagatatccaa

SEQ ID NO: 424987 - DNA, 20 bp, Artificial Sequence
  chemically synthesized
aattctagataatattaagg

SEQ ID NO: 424988 - DNA, 20 bp, Artificial Sequence
  chemically synthesized
acaattctagataatattaa

SEQ ID NO: 424989 - DNA, 20 bp, Artificial Sequence
  chemically synthesized
gacaattctagataatatta

SEQ ID NO: 424990 - DNA, 20 bp, Artificial Sequence
  chemically synthesized
ggacaattctagataatatt

SEQ ID NO: 424991 - DNA, 20 bp, Artificial Sequence
  chemically synthesized
atatctcccttaatattatc

SEQ ID NO: 424992 - DNA, 20 bp, Artificial Sequence
  chemically synthesized
aaggaatagttggacaattc

SEQ ID NO: 424993 - DNA, 20 bp, Artificial Sequence
  chemically synthesized
tgctcatttaaaggaatagt

SEQ ID NO: 424994 - DNA, 20 bp, Artificial Sequence
  chemically synthesized
gttgtgctcatttaaaggaa

SEQ ID NO: 424995 - DNA, 20 bp, Artificial Sequence
  chemically synthesized
gtccaactattcctttaaat

SEQ ID NO: 424996 - DNA, 20 bp, Artificial Sequence
  chemically synthesized
ccccagttgtgctcatttaa

SEQ ID NO: 424997 - DNA, 20 bp, Artificial Sequence
  chemically synthesized
gccccagttgtgctcattta

SEQ ID NO: 424998 - DNA, 20 bp, Artificial Sequence
  chemically synthesized
ttcctttaaatgagcacaac

SEQ ID NO: 424999 - DNA, 20 bp, Artificial Sequence
  chemically synthesized
tcctttaaatgagcacaact

SEQ ID NO: 425000 - DNA, 20 bp, Artificial Sequence
  chemically synthesized
cctttaaatgagcacaactg

SEQ ID NO: 425001 - DNA, 20 bp, Artificial Sequence
  chemically synthesized
agagccataaggagtggccc

SEQ ID NO: 425002 - DNA, 20 bp, Artificial Sequence
  chemically synthesized
acaactggggccactcctta

SEQ ID NO: 425003 - DNA, 20 bp, Artificial Sequence
  chemically synthesized
atgcccagagccataaggag

SEQ ID NO: 425004 - DNA, 20 bp, Artificial Sequence
  chemically synthesized
gcaatgcccagagccataag

SEQ ID NO: 425005 - DNA, 20 bp, Artificial Sequence
  chemically synthesized
gtgcaatgcccagagccata

SEQ ID NO: 425006 - DNA, 20 bp, Artificial Sequence
  chemically synthesized
ggggccactccttatggctc

SEQ ID NO: 425007 - DNA, 20 bp, Artificial Sequence
  chemically synthesized
ggtgcaatgcccagagccat

SEQ ID NO: 425008 - DNA, 20 bp, Artificial Sequence
  chemically synthesized
gggccactccttatggctct

SEQ ID NO: 425009 - DNA, 20 bp, Artificial Sequence
  chemically synthesized
tgtgcaaggtgcaatgccca

SEQ ID NO: 425010 - DNA, 20 bp, Artificial Sequence
  chemically synthesized
tttgtgcaaggtgcaatgcc

SEQ ID NO: 425011 - DNA, 20 bp, Artificial Sequence
  chemically synthesized
tgggcattgcaccttgcaca

SEQ ID NO: 425012 - DNA, 20 bp, Artificial Sequence
  chemically synthesized
gggcattgcaccttgcacaa

SEQ ID NO: 425013 - DNA, 20 bp, Artificial Sequence
  chemically synthesized
tactcaagcacctttgtgca

SEQ ID NO: 425014 - DNA, 20 bp, Artificial Sequence
  chemically synthesized
atactcaagcacctttgtgc

SEQ ID NO: 425015 - DNA, 20 bp, Artificial Sequence
  chemically synthesized
caccttgcacaaaggtgctt

SEQ ID NO: 425016 - DNA, 20 bp, Artificial Sequence
  chemically synthesized
ggaatgtgggtatgatactc

SEQ ID NO: 425017 - DNA, 20 bp, Artificial Sequence
  chemically synthesized
gggatggctggggggaatgt

SEQ ID NO: 425018 - DNA, 20 bp, Artificial Sequence
  chemically synthesized
agggatggctggggggaatg

SEQ ID NO: 425019 - DNA, 20 bp, Artificial Sequence
  chemically synthesized
tatcatacccacattccccc

SEQ ID NO: 425020 - DNA, 20 bp, Artificial Sequence
  chemically synthesized
ggatcacagggatggctggg

SEQ ID NO: 425021 - DNA, 20 bp, Artificial Sequence
  chemically synthesized
aggatcacagggatggctgg

SEQ ID NO: 425022 - DNA, 20 bp, Artificial Sequence
  chemically synthesized
gaggatcacagggatggctg

SEQ ID NO: 425023 - DNA, 20 bp, Artificial Sequence
  chemically synthesized
ggaggatcacagggatggct

SEQ ID NO: 425024 - DNA, 20 bp, Artificial Sequence
  chemically synthesized
tggaggatcacagggatggc

SEQ ID NO: 425025 - DNA, 20 bp, Artificial Sequence
  chemically synthesized
ttattggaggatcacaggga

SEQ ID NO: 425026 - DNA, 20 bp, Artificial Sequence
  chemically synthesized
tgctttattggaggatcaca

SEQ ID NO: 425027 - DNA, 20 bp, Artificial Sequence
  chemically synthesized
ctgctttattggaggatcac

SEQ ID NO: 425028 - DNA, 20 bp, Artificial Sequence
  chemically synthesized
tctgctttattggaggatca

SEQ ID NO: 425029 - DNA, 20 bp, Artificial Sequence
  chemically synthesized
atccctgtgatcctccaata

SEQ ID NO: 425030 - DNA, 20 bp, Artificial Sequence
  chemically synthesized
gtatgactctgctttattgg

SEQ ID NO: 425031 - DNA, 20 bp, Artificial Sequence
  chemically synthesized
agtatgactctgctttattg

SEQ ID NO: 425032 - DNA, 20 bp, Artificial Sequence
  chemically synthesized
cctgtgatcctccaataaag

SEQ ID NO: 425033 - DNA, 20 bp, Artificial Sequence
  chemically synthesized
tcagtatgactctgctttat

SEQ ID NO: 425034 - DNA, 20 bp, Artificial Sequence
  chemically synthesized
tgtgatcctccaataaagca

SEQ ID NO: 425035 - DNA, 20 bp, Artificial Sequence
  chemically synthesized
gcagagtcatactgaaaaaa

SEQ ID NO: 425036 - DNA, 20 bp, Artificial Sequence
  chemically synthesized
aagaaagcacgctttttttt

SEQ ID NO: 425037 - DNA, 20 bp, Artificial Sequence
  chemically synthesized
gaatagccaattttgaaaga

SEQ ID NO: 425038 - DNA, 20 bp, Artificial Sequence
  chemically synthesized
agcgtgctttctttcaaaat

SEQ ID NO: 425039 - DNA, 20 bp, Artificial Sequence
  chemically synthesized
cacagaatagccaattttga

SEQ ID NO: 425040 - DNA, 20 bp, Artificial Sequence
  chemically synthesized
tttcaaaattggctattctg

SEQ ID NO: 425041 - DNA, 20 bp, Artificial Sequence
  chemically synthesized
cacttcccaaatccacagaa

SEQ ID NO: 425042 - DNA, 20 bp, Artificial Sequence
  chemically synthesized
aattggctattctgtggatt

SEQ ID NO: 425043 - DNA, 20 bp, Artificial Sequence
  chemically synthesized
attggctattctgtggattt

SEQ ID NO: 425044 - DNA, 20 bp, Artificial Sequence
  chemically synthesized
ctccccacttcccaaatcca

SEQ ID NO: 425045 - DNA, 20 bp, Artificial Sequence
  chemically synthesized
ggctattctgtggatttggg

SEQ ID NO: 425046 - DNA, 20 bp, Artificial Sequence
  chemically synthesized
tattctgtggatttgggaag

SEQ ID NO: 425047 - DNA, 20 bp, Artificial Sequence
  chemically synthesized
attctgtggatttgggaagt

SEQ ID NO: 425048 - DNA, 20 bp, Artificial Sequence
  chemically synthesized
ttctgtggatttgggaagtg

SEQ ID NO: 425049 - DNA, 20 bp, Artificial Sequence
  chemically synthesized
ctgtggatttgggaagtggg

SEQ ID NO: 425050 - DNA, 20 bp, Artificial Sequence
  chemically synthesized
tgtggatttgggaagtgggg

SEQ ID NO: 425051 - DNA, 20 bp, Artificial Sequence
  chemically synthesized
tctttgaaaattaaacaaag

SEQ ID NO: 425052 - DNA, 20 bp, Artificial Sequence
  chemically synthesized
ctctttgaaaattaaacaaa

SEQ ID NO: 425053 - DNA, 20 bp, Artificial Sequence
  chemically synthesized
tactctttgaaaattaaaca

SEQ ID NO: 425054 - DNA, 20 bp, Artificial Sequence
  chemically synthesized
gcctctttgtttaattttca

SEQ ID NO: 425055 - DNA, 20 bp, Artificial Sequence
  chemically synthesized
ctctttgtttaattttcaaa

SEQ ID NO: 425056 - DNA, 20 bp, Artificial Sequence
  chemically synthesized
attttcaaagagtaccatat

SEQ ID NO: 425057 - DNA, 20 bp, Artificial Sequence
  chemically synthesized
ttcaaagagtaccatataag

SEQ ID NO: 425058 - DNA, 20 bp, Artificial Sequence
  chemically synthesized
tcaaagagtaccatataagc

SEQ ID NO: 425059 - DNA, 20 bp, Artificial Sequence
  chemically synthesized
aggactgctacccgcttata

SEQ ID NO: 425060 - DNA, 20 bp, Artificial Sequence
  chemically synthesized
aagagtaccatataagcggg

SEQ ID NO: 425061 - DNA, 20 bp, Artificial Sequence
  chemically synthesized
agtaccatataagcgggtag

SEQ ID NO: 425062 - DNA, 20 bp, Artificial Sequence
  chemically synthesized
ataagcgggtagcagtcctg

SEQ ID NO: 425063 - DNA, 20 bp, Artificial Sequence
  chemically synthesized
tattacactttgttgtccgc

SEQ ID NO: 425064 - DNA, 20 bp, Artificial Sequence
  chemically synthesized
ttattacactttgttgtccg

SEQ ID NO: 425065 - DNA, 20 bp, Artificial Sequence
  chemically synthesized
tagcagtcctgcggacaaca

SEQ ID NO: 425066 - DNA, 20 bp, Artificial Sequence
  chemically synthesized
aaagtgtaataaaaaatgtt

SEQ ID NO: 425067 - DNA, 20 bp, Artificial Sequence
  chemically synthesized
aagtgtaataaaaaatgttt

SEQ ID NO: 425068 - DNA, 20 bp, Artificial Sequence
  chemically synthesized
ataaaaaatgtttgggattt

SEQ ID NO: 425069 - DNA, 20 bp, Artificial Sequence
  chemically synthesized
aaaatgtttgggatttcagt

SEQ ID NO: 425070 - DNA, 20 bp, Artificial Sequence
  chemically synthesized
atgtttgggatttcagttgg

SEQ ID NO: 425071 - DNA, 20 bp, Artificial Sequence
  chemically synthesized
tgtttgggatttcagttgga

SEQ ID NO: 425072 - DNA, 20 bp, Artificial Sequence
  chemically synthesized
ggatttcagttggaaggcat

SEQ ID NO: 425073 - DNA, 20 bp, Artificial Sequence
  chemically synthesized
gatttcagttggaaggcatt

SEQ ID NO: 425074 - DNA, 20 bp, Artificial Sequence
  chemically synthesized
cttgccctaggtcataaaat

SEQ ID NO: 425075 - DNA, 20 bp, Artificial Sequence
  chemically synthesized
tgggaactaattttatgacc

SEQ ID NO: 425076 - DNA, 20 bp, Artificial Sequence
  chemically synthesized
gggaactaattttatgacct

SEQ ID NO: 425077 - DNA, 20 bp, Artificial Sequence
  chemically synthesized
ggaactaattttatgaccta

SEQ ID NO: 425078 - DNA, 20 bp, Artificial Sequence
  chemically synthesized
ctaattttatgacctagggc

SEQ ID NO: 425079 - DNA, 20 bp, Artificial Sequence
  chemically synthesized
taattttatgacctagggca

SEQ ID NO: 425080 - DNA, 20 bp, Artificial Sequence
  chemically synthesized
aagtttaaataccttgccct

SEQ ID NO: 425081 - DNA, 20 bp, Artificial Sequence
  chemically synthesized
aaagtttaaataccttgccc

SEQ ID NO: 425082 - DNA, 20 bp, Artificial Sequence
  chemically synthesized
gggcaaggtatttaaacttt

SEQ ID NO: 425083 - DNA, 20 bp, Artificial Sequence
  chemically synthesized
ggaaagcctggtgatgctaa

SEQ ID NO: 425084 - DNA, 20 bp, Artificial Sequence
  chemically synthesized
atttaaacttttagcatcac

SEQ ID NO: 425085 - DNA, 20 bp, Artificial Sequence
  chemically synthesized
tttaaacttttagcatcacc

SEQ ID NO: 425086 - DNA, 20 bp, Artificial Sequence
  chemically synthesized
tttagcatcaccaggctttc

SEQ ID NO: 425087 - DNA, 20 bp, Artificial Sequence
  chemically synthesized
tattttatagctggaaagcc

SEQ ID NO: 425088 - DNA, 20 bp, Artificial Sequence
  chemically synthesized
caagctattttatagctgga

SEQ ID NO: 425089 - DNA, 20 bp, Artificial Sequence
  chemically synthesized
ttgccaagctattttatagc

SEQ ID NO: 425090 - DNA, 20 bp, Artificial Sequence
  chemically synthesized
caggctttccagctataaaa

SEQ ID NO: 425091 - DNA, 20 bp, Artificial Sequence
  chemically synthesized
catgttgccaagctatttta

SEQ ID NO: 425092 - DNA, 20 bp, Artificial Sequence
  chemically synthesized
tttccagctataaaatagct

SEQ ID NO: 425093 - DNA, 20 bp, Artificial Sequence
  chemically synthesized
attgtctatggcatgttgcc

SEQ ID NO: 425094 - DNA, 20 bp, Artificial Sequence
  chemically synthesized
aatagcttggcaacatgcca

SEQ ID NO: 425095 - DNA, 20 bp, Artificial Sequence
  chemically synthesized
gcctgagtgttgattgtcta

SEQ ID NO: 425096 - DNA, 20 bp, Artificial Sequence
  chemically synthesized
tgccatagacaatcaacact

SEQ ID NO: 425097 - DNA, 20 bp, Artificial Sequence
  chemically synthesized
gccatagacaatcaacactc

SEQ ID NO: 425098 - DNA, 20 bp, Artificial Sequence
  chemically synthesized
ttgctttgacttcggagcct

SEQ ID NO: 425099 - DNA, 20 bp, Artificial Sequence
  chemically synthesized
caatcaacactcaggctccg

SEQ ID NO: 425100 - DNA, 20 bp, Artificial Sequence
  chemically synthesized
gttaaattgctttgacttcg

SEQ ID NO: 425101 - DNA, 20 bp, Artificial Sequence
  chemically synthesized
acactcaggctccgaagtca

SEQ ID NO: 425102 - DNA, 20 bp, Artificial Sequence
  chemically synthesized
tagttaaattgctttgactt

SEQ ID NO: 425103 - DNA, 20 bp, Artificial Sequence
  chemically synthesized
cgaagtcaaagcaatttaac

SEQ ID NO: 425104 - DNA, 20 bp, Artificial Sequence
  chemically synthesized
gaagtcaaagcaatttaact

SEQ ID NO: 425105 - DNA, 20 bp, Artificial Sequence
  chemically synthesized
aagtcaaagcaatttaacta

SEQ ID NO: 425106 - DNA, 20 bp, Artificial Sequence
  chemically synthesized
gagaactggaattcaagccc

SEQ ID NO: 425107 - DNA, 20 bp, Artificial Sequence
  chemically synthesized
tttaactagggcttgaattc

SEQ ID NO: 425108 - DNA, 20 bp, Artificial Sequence
  chemically synthesized
acataggagaactggaattc

SEQ ID NO: 425109 - DNA, 20 bp, Artificial Sequence
  chemically synthesized
cagctagtacataggagaac

SEQ ID NO: 425110 - DNA, 20 bp, Artificial Sequence
  chemically synthesized
attatgcagctagtacatag

SEQ ID NO: 425111 - DNA, 20 bp, Artificial Sequence
  chemically synthesized
attccagttctcctatgtac

SEQ ID NO: 425112 - DNA, 20 bp, Artificial Sequence
  chemically synthesized
agattatgcagctagtacat

SEQ ID NO: 425113 - DNA, 20 bp, Artificial Sequence
  chemically synthesized
aagattatgcagctagtaca

SEQ ID NO: 425114 - DNA, 20 bp, Artificial Sequence
  chemically synthesized
acgtgccaagattatgcagc

SEQ ID NO: 425115 - DNA, 20 bp, Artificial Sequence
  chemically synthesized
cataacgtgccaagattatg

SEQ ID NO: 425116 - DNA, 20 bp, Artificial Sequence
  chemically synthesized
atgtactagctgcataatct

SEQ ID NO: 425117 - DNA, 20 bp, Artificial Sequence
  chemically synthesized
tataaataacataacgtgcc

SEQ ID NO: 425118 - DNA, 20 bp, Artificial Sequence
  chemically synthesized
acatttcgttgtctgtaaaa

SEQ ID NO: 425119 - DNA, 20 bp, Artificial Sequence
  chemically synthesized
catttcgttgtctgtaaaat

SEQ ID NO: 425120 - DNA, 20 bp, Artificial Sequence
  chemically synthesized
atttcgttgtctgtaaaatg

SEQ ID NO: 425121 - DNA, 20 bp, Artificial Sequence
  chemically synthesized
ttgatattatccccatttta

SEQ ID NO: 425122 - DNA, 20 bp, Artificial Sequence
  chemically synthesized
aatggggataatatcaattc

SEQ ID NO: 425123 - DNA, 20 bp, Artificial Sequence
  chemically synthesized
aatatcaattccagcctcct

SEQ ID NO: 425124 - DNA, 20 bp, Artificial Sequence
  chemically synthesized
taacaatagcctcaggaggc

SEQ ID NO: 425125 - DNA, 20 bp, Artificial Sequence
  chemically synthesized
atatcaattccagcctcctg

SEQ ID NO: 425126 - DNA, 20 bp, Artificial Sequence
  chemically synthesized
aaactaacaatagcctcagg

SEQ ID NO: 425127 - DNA, 20 bp, Artificial Sequence
  chemically synthesized
gaaactaacaatagcctcag

SEQ ID NO: 425128 - DNA, 20 bp, Artificial Sequence
  chemically synthesized
tggaaactaacaatagcctc

SEQ ID NO: 425129 - DNA, 20 bp, Artificial Sequence
  chemically synthesized
gtggaaactaacaatagcct

SEQ ID NO: 425130 - DNA, 20 bp, Artificial Sequence
  chemically synthesized
cagcctcctgaggctattgt

SEQ ID NO: 425131 - DNA, 20 bp, Artificial Sequence
  chemically synthesized
cttgtagtggaaactaacaa

SEQ ID NO: 425132 - DNA, 20 bp, Artificial Sequence
  chemically synthesized
ctattgttagtttccactac

SEQ ID NO: 425133 - DNA, 20 bp, Artificial Sequence
  chemically synthesized
tattgttagtttccactaca

SEQ ID NO: 425134 - DNA, 20 bp, Artificial Sequence
  chemically synthesized
ctgtggtaaacaccttgtag

SEQ ID NO: 425135 - DNA, 20 bp, Artificial Sequence
  chemically synthesized
gaactgtggtaaacaccttg

SEQ ID NO: 425136 - DNA, 20 bp, Artificial Sequence
  chemically synthesized
ccactacaaggtgtttacca

SEQ ID NO: 425137 - DNA, 20 bp, Artificial Sequence
  chemically synthesized
caaggtgtttaccacagttc

SEQ ID NO: 425138 - DNA, 20 bp, Artificial Sequence
  chemically synthesized
taactctgtatctggaactg

SEQ ID NO: 425139 - DNA, 20 bp, Artificial Sequence
  chemically synthesized
gtttaccacagttccagata

SEQ ID NO: 425140 - DNA, 20 bp, Artificial Sequence
  chemically synthesized
ttaccacagttccagataca

SEQ ID NO: 425141 - DNA, 20 bp, Artificial Sequence
  chemically synthesized
tttagcactaactctgtatc

SEQ ID NO: 425142 - DNA, 20 bp, Artificial Sequence
  chemically synthesized
cacagttccagatacagagt

SEQ ID NO: 425143 - DNA, 20 bp, Artificial Sequence
  chemically synthesized
cagagttagtgctaaataaa

SEQ ID NO: 425144 - DNA, 20 bp, Artificial Sequence
  chemically synthesized
aatagtagctactatttatt

SEQ ID NO: 425145 - DNA, 20 bp, Artificial Sequence
  chemically synthesized
agttagtgctaaataaatag

SEQ ID NO: 425146 - DNA, 20 bp, Artificial Sequence
  chemically synthesized
ttattgttgttgataaatag

SEQ ID NO: 425147 - DNA, 20 bp, Artificial Sequence
  chemically synthesized
ttattattgttgttgataaa

SEQ ID NO: 425148 - DNA, 20 bp, Artificial Sequence
  chemically synthesized
tatttatcaacaacaataat

SEQ ID NO: 425149 - DNA, 20 bp, Artificial Sequence
  chemically synthesized
tccaaagccttgggaaatgt

SEQ ID NO: 425150 - DNA, 20 bp, Artificial Sequence
  chemically synthesized
gataatcactcacatttccc

SEQ ID NO: 425151 - DNA, 20 bp, Artificial Sequence
  chemically synthesized
ataatcactcacatttccca

SEQ ID NO: 425152 - DNA, 20 bp, Artificial Sequence
  chemically synthesized
actcacatttcccaaggctt

SEQ ID NO: 425153 - DNA, 20 bp, Artificial Sequence
  chemically synthesized
ttaatttcctccaaagcctt

SEQ ID NO: 425154 - DNA, 20 bp, Artificial Sequence
  chemically synthesized
tttaatttcctccaaagcct

SEQ ID NO: 425155 - DNA, 20 bp, Artificial Sequence
  chemically synthesized
tcacatttcccaaggctttg

SEQ ID NO: 425156 - DNA, 20 bp, Artificial Sequence
  chemically synthesized
cacatttcccaaggctttgg

SEQ ID NO: 425157 - DNA, 20 bp, Artificial Sequence
  chemically synthesized
atttgatttaatttcctcca

SEQ ID NO: 425158 - DNA, 20 bp, Artificial Sequence
  chemically synthesized
tcaaatgatgcatacaaaat

SEQ ID NO: 425159 - DNA, 20 bp, Artificial Sequence
  chemically synthesized
gcatacaaaataagcctttg

SEQ ID NO: 425160 - DNA, 20 bp, Artificial Sequence
  chemically synthesized
tatggtgtttttcacttcaa

SEQ ID NO: 425161 - DNA, 20 bp, Artificial Sequence
  chemically synthesized
ttatggtgtttttcacttca

SEQ ID NO: 425162 - DNA, 20 bp, Artificial Sequence
  chemically synthesized
acccatcttcaacaacatta

SEQ ID NO: 425163 - DNA, 20 bp, Artificial Sequence
  chemically synthesized
aaaacaccataatgttgttg

SEQ ID NO: 425164 - DNA, 20 bp, Artificial Sequence
  chemically synthesized
caccataatgttgttgaaga

SEQ ID NO: 425165 - DNA, 20 bp, Artificial Sequence
  chemically synthesized
accataatgttgttgaagat

SEQ ID NO: 425166 - DNA, 20 bp, Artificial Sequence
  chemically synthesized
aagatgggttttcttccttt

SEQ ID NO: 425167 - DNA, 20 bp, Artificial Sequence
  chemically synthesized
gcaaacatattactaaaagg

SEQ ID NO: 425168 - DNA, 20 bp, Artificial Sequence
  chemically synthesized
atggcaaacatattactaaa

SEQ ID NO: 425169 - DNA, 20 bp, Artificial Sequence
  chemically synthesized
tatggcaaacatattactaa

SEQ ID NO: 425170 - DNA, 20 bp, Artificial Sequence
  chemically synthesized
tttctttaaaatcaaagata

SEQ ID NO: 425171 - DNA, 20 bp, Artificial Sequence
  chemically synthesized
ctactatttctttaaaatca

SEQ ID NO: 425172 - DNA, 20 bp, Artificial Sequence
  chemically synthesized
ttgccatatctttgatttta

SEQ ID NO: 425173 - DNA, 20 bp, Artificial Sequence
  chemically synthesized
tatctttgattttaaagaaa

SEQ ID NO: 425174 - DNA, 20 bp, Artificial Sequence
  chemically synthesized
ctttgattttaaagaaatag

SEQ ID NO: 425175 - DNA, 20 bp, Artificial Sequence
  chemically synthesized
tgattttaaagaaatagtag

SEQ ID NO: 425176 - DNA, 20 bp, Artificial Sequence
  chemically synthesized
aatagtagtggttaaaaaaa

SEQ ID NO: 425177 - DNA, 20 bp, Artificial Sequence
  chemically synthesized
gtagtggttaaaaaaaaagc

SEQ ID NO: 425178 - DNA, 20 bp, Artificial Sequence
  chemically synthesized
gtggttaaaaaaaaagcaag

SEQ ID NO: 425179 - DNA, 20 bp, Artificial Sequence
  chemically synthesized
gttaaaaaaaaagcaagtag

SEQ ID NO: 425180 - DNA, 20 bp, Artificial Sequence
  chemically synthesized
ttaaaaaaaaagcaagtagt

SEQ ID NO: 425181 - DNA, 20 bp, Artificial Sequence
  chemically synthesized
taaaaaaaaagcaagtagta

SEQ ID NO: 425182 - DNA, 20 bp, Artificial Sequence
  chemically synthesized
agcaagtagtagggccacca

SEQ ID NO: 425183 - DNA, 20 bp, Artificial Sequence
  chemically synthesized
tattgtagccagatctttgg

SEQ ID NO: 425184 - DNA, 20 bp, Artificial Sequence
  chemically synthesized
tagtagggccaccaaagatc

SEQ ID NO: 425185 - DNA, 20 bp, Artificial Sequence
  chemically synthesized
aattattgtagccagatctt

SEQ ID NO: 425186 - DNA, 20 bp, Artificial Sequence
  chemically synthesized
ctcagaacaattattgtagc

SEQ ID NO: 425187 - DNA, 20 bp, Artificial Sequence
  chemically synthesized
acctctcagaacaattattg

SEQ ID NO: 425188 - DNA, 20 bp, Artificial Sequence
  chemically synthesized
ctggctacaataattgttct

SEQ ID NO: 425189 - DNA, 20 bp, Artificial Sequence
  chemically synthesized
ggctacaataattgttctga

SEQ ID NO: 425190 - DNA, 20 bp, Artificial Sequence
  chemically synthesized
gctacaataattgttctgag

SEQ ID NO: 425191 - DNA, 20 bp, Artificial Sequence
  chemically synthesized
caataattgttctgagaggt

SEQ ID NO: 425192 - DNA, 20 bp, Artificial Sequence
  chemically synthesized
aataattgttctgagaggtt

SEQ ID NO: 425193 - DNA, 20 bp, Artificial Sequence
  chemically synthesized
tcagcaggagcctaacctct

SEQ ID NO: 425194 - DNA, 20 bp, Artificial Sequence
  chemically synthesized
tgagaggttaggctcctgct

SEQ ID NO: 425195 - DNA, 20 bp, Artificial Sequence
  chemically synthesized
agaggttaggctcctgctga

SEQ ID NO: 425196 - DNA, 20 bp, Artificial Sequence
  chemically synthesized
ttagctccaactctcagcag

SEQ ID NO: 425197 - DNA, 20 bp, Artificial Sequence
  chemically synthesized
gtttagctccaactctcagc

SEQ ID NO: 425198 - DNA, 20 bp, Artificial Sequence
  chemically synthesized
ggtttagctccaactctcag

SEQ ID NO: 425199 - DNA, 20 bp, Artificial Sequence
  chemically synthesized
gttaggctcctgctgagagt

SEQ ID NO: 425200 - DNA, 20 bp, Artificial Sequence
  chemically synthesized
taggctcctgctgagagttg

SEQ ID NO: 425201 - DNA, 20 bp, Artificial Sequence
  chemically synthesized
ctaggtttagctccaactct

SEQ ID NO: 425202 - DNA, 20 bp, Artificial Sequence
  chemically synthesized
ctgagagttggagctaaacc

SEQ ID NO: 425203 - DNA, 20 bp, Artificial Sequence
  chemically synthesized
ctacatataggtgctaggtt

SEQ ID NO: 425204 - DNA, 20 bp, Artificial Sequence
  chemically synthesized
tactactacatataggtgct

SEQ ID NO: 425205 - DNA, 20 bp, Artificial Sequence
  chemically synthesized
gtactactacatataggtgc

SEQ ID NO: 425206 - DNA, 20 bp, Artificial Sequence
  chemically synthesized
ctaaacctagcacctatatg

SEQ ID NO: 425207 - DNA, 20 bp, Artificial Sequence
  chemically synthesized
aggtttgtactactacatat

SEQ ID NO: 425208 - DNA, 20 bp, Artificial Sequence
  chemically synthesized
aacctagcacctatatgtag

SEQ ID NO: 425209 - DNA, 20 bp, Artificial Sequence
  chemically synthesized
taggtttgtactactacata

SEQ ID NO: 425210 - DNA, 20 bp, Artificial Sequence
  chemically synthesized
gtagtacaaacctaaatata

SEQ ID NO: 425211 - DNA, 20 bp, Artificial Sequence
  chemically synthesized
ccctgatgtactgtatattt

SEQ ID NO: 425212 - DNA, 20 bp, Artificial Sequence
  chemically synthesized
tccctgatgtactgtatatt

SEQ ID NO: 425213 - DNA, 20 bp, Artificial Sequence
  chemically synthesized
aacctaaatatacagtacat

SEQ ID NO: 425214 - DNA, 20 bp, Artificial Sequence
  chemically synthesized
acctaaatatacagtacatc

SEQ ID NO: 425215 - DNA, 20 bp, Artificial Sequence
  chemically synthesized
cctaaatatacagtacatca

SEQ ID NO: 425216 - DNA, 20 bp, Artificial Sequence
  chemically synthesized
cagtacatcagggaacaacg

SEQ ID NO: 425217 - DNA, 20 bp, Artificial Sequence
  chemically synthesized
gttttaaatctgtacattcg

SEQ ID NO: 425218 - DNA, 20 bp, Artificial Sequence
  chemically synthesized
caacgtagacttcgaatgta

SEQ ID NO: 425219 - DNA, 20 bp, Artificial Sequence
  chemically synthesized
cgaatgtacagatttaaaac

SEQ ID NO: 425220 - DNA, 20 bp, Artificial Sequence
  chemically synthesized
tcaccaggttattgcagttc

SEQ ID NO: 425221 - DNA, 20 bp, Artificial Sequence
  chemically synthesized
agtatgtcaccaggttattg

SEQ ID NO: 425222 - DNA, 20 bp, Artificial Sequence
  chemically synthesized
aaactagaactgcaataacc

SEQ ID NO: 425223 - DNA, 20 bp, Artificial Sequence
  chemically synthesized
aatttattcagtatgtcacc

SEQ ID NO: 425224 - DNA, 20 bp, Artificial Sequence
  chemically synthesized
caatttattcagtatgtcac

SEQ ID NO: 425225 - DNA, 20 bp, Artificial Sequence
  chemically synthesized
tggtgacatactgaataaat

SEQ ID NO: 425226 - DNA, 20 bp, Artificial Sequence
  chemically synthesized
ggacttacttccaatttatt

SEQ ID NO: 425227 - DNA, 20 bp, Artificial Sequence
  chemically synthesized
tgacatactgaataaattgg

SEQ ID NO: 425228 - DNA, 20 bp, Artificial Sequence
  chemically synthesized
atactgaataaattggaagt

SEQ ID NO: 425229 - DNA, 20 bp, Artificial Sequence
  chemically synthesized
actctagagacaagatttaa

SEQ ID NO: 425230 - DNA, 20 bp, Artificial Sequence
  chemically synthesized
agtccattaaatcttgtctc

SEQ ID NO: 425231 - DNA, 20 bp, Artificial Sequence
  chemically synthesized
tccattaaatcttgtctcta

SEQ ID NO: 425232 - DNA, 20 bp, Artificial Sequence
  chemically synthesized
ggaataataactctagagac

SEQ ID NO: 425233 - DNA, 20 bp, Artificial Sequence
  chemically synthesized
tattgggaataataactcta

SEQ ID NO: 425234 - DNA, 20 bp, Artificial Sequence
  chemically synthesized
attattgggaataataactc

SEQ ID NO: 425235 - DNA, 20 bp, Artificial Sequence
  chemically synthesized
tttaaaaaattgtgattatt

SEQ ID NO: 425236 - DNA, 20 bp, Artificial Sequence
  chemically synthesized
ttttaaaaaattgtgattat

SEQ ID NO: 425237 - DNA, 20 bp, Artificial Sequence
  chemically synthesized
aggaaacatgattttcaaga

SEQ ID NO: 425238 - DNA, 20 bp, Artificial Sequence
  chemically synthesized
ctccaggaaacatgattttc

SEQ ID NO: 425239 - DNA, 20 bp, Artificial Sequence
  chemically synthesized
atcttgaaaatcatgtttcc

SEQ ID NO: 425240 - DNA, 20 bp, Artificial Sequence
  chemically synthesized
cttgaaaatcatgtttcctg

SEQ ID NO: 425241 - DNA, 20 bp, Artificial Sequence
  chemically synthesized
tgctatttggaggtgactcc

SEQ ID NO: 425242 - DNA, 20 bp, Artificial Sequence
  chemically synthesized
ctgctatttggaggtgactc

SEQ ID NO: 425243 - DNA, 20 bp, Artificial Sequence
  chemically synthesized
ttcctggagtcacctccaaa

SEQ ID NO: 425244 - DNA, 20 bp, Artificial Sequence
  chemically synthesized
ggtagcttactgctatttgg

SEQ ID NO: 425245 - DNA, 20 bp, Artificial Sequence
  chemically synthesized
ctggagtcacctccaaatag

SEQ ID NO: 425246 - DNA, 20 bp, Artificial Sequence
  chemically synthesized
gggtagcttactgctatttg

SEQ ID NO: 425247 - DNA, 20 bp, Artificial Sequence
  chemically synthesized
atgggtagcttactgctatt

SEQ ID NO: 425248 - DNA, 20 bp, Artificial Sequence
  chemically synthesized
agtcacctccaaatagcagt

SEQ ID NO: 425249 - DNA, 20 bp, Artificial Sequence
  chemically synthesized
tttttgtaataggagatggg

SEQ ID NO: 425250 - DNA, 20 bp, Artificial Sequence
  chemically synthesized
ttctttttgtaataggagat

SEQ ID NO: 425251 - DNA, 20 bp, Artificial Sequence
  chemically synthesized
tttctttttgtaataggaga

SEQ ID NO: 425252 - DNA, 20 bp, Artificial Sequence
  chemically synthesized
catttttctttttgtaatag

SEQ ID NO: 425253 - DNA, 20 bp, Artificial Sequence
  chemically synthesized
ctcatttttctttttgtaat

SEQ ID NO: 425254 - DNA, 20 bp, Artificial Sequence
  chemically synthesized
tacccatctcctattacaaa

SEQ ID NO: 425255 - DNA, 20 bp, Artificial Sequence
  chemically synthesized
tctcatttttctttttgtaa

SEQ ID NO: 425256 - DNA, 20 bp, Artificial Sequence
  chemically synthesized
cctattacaaaaagaaaaat

SEQ ID NO: 425257 - DNA, 20 bp, Artificial Sequence
  chemically synthesized
tacaaaaagaaaaatgagac

SEQ ID NO: 425258 - DNA, 20 bp, Artificial Sequence
  chemically synthesized
tgggtaatgtgtttacaagc

SEQ ID NO: 425259 - DNA, 20 bp, Artificial Sequence
  chemically synthesized
ttattgggtaatgtgtttac

SEQ ID NO: 425260 - DNA, 20 bp, Artificial Sequence
  chemically synthesized
tgtaaacacattacccaata

SEQ ID NO: 425261 - DNA, 20 bp, Artificial Sequence
  chemically synthesized
gcactgtaaggtactttatt

SEQ ID NO: 425262 - DNA, 20 bp, Artificial Sequence
  chemically synthesized
tgcactgtaaggtactttat

SEQ ID NO: 425263 - DNA, 20 bp, Artificial Sequence
  chemically synthesized
ttacccaataaagtacctta

SEQ ID NO: 425264 - DNA, 20 bp, Artificial Sequence
  chemically synthesized
gcctccctgcttgcactgta

SEQ ID NO: 425265 - DNA, 20 bp, Artificial Sequence
  chemically synthesized
aataaagtaccttacagtgc

SEQ ID NO: 425266 - DNA, 20 bp, Artificial Sequence
  chemically synthesized
tgcctccctgcttgcactgt

SEQ ID NO: 425267 - DNA, 20 bp, Artificial Sequence
  chemically synthesized
aaagtaccttacagtgcaag

SEQ ID NO: 425268 - DNA, 20 bp, Artificial Sequence
  chemically synthesized
aagtaccttacagtgcaagc

SEQ ID NO: 425269 - DNA, 20 bp, Artificial Sequence
  chemically synthesized
agtaccttacagtgcaagca

SEQ ID NO: 425270 - DNA, 20 bp, Artificial Sequence
  chemically synthesized
taccttacagtgcaagcagg

SEQ ID NO: 425271 - DNA, 20 bp, Artificial Sequence
  chemically synthesized
accttacagtgcaagcaggg

SEQ ID NO: 425272 - DNA, 20 bp, Artificial Sequence
  chemically synthesized
agggaggcattattgctcaa

SEQ ID NO: 425273 - DNA, 20 bp, Artificial Sequence
  chemically synthesized
gaggcattattgctcaatgg

SEQ ID NO: 425274 - DNA, 20 bp, Artificial Sequence
  chemically synthesized
attttaaattgacttccatt

SEQ ID NO: 425275 - DNA, 20 bp, Artificial Sequence
  chemically synthesized
aatggaagtcaatttaaaat

SEQ ID NO: 425276 - DNA, 20 bp, Artificial Sequence
  chemically synthesized
tggaagtcaatttaaaataa

SEQ ID NO: 425277 - DNA, 20 bp, Artificial Sequence
  chemically synthesized
ggaagtcaatttaaaataag

SEQ ID NO: 425278 - DNA, 20 bp, Artificial Sequence
  chemically synthesized
atttaaaataagaggttacc

SEQ ID NO: 425279 - DNA, 20 bp, Artificial Sequence
  chemically synthesized
ttactcttattgagaaagct

SEQ ID NO: 425280 - DNA, 20 bp, Artificial Sequence
  chemically synthesized
ggttaccgagctttctcaat

SEQ ID NO: 425281 - DNA, 20 bp, Artificial Sequence
  chemically synthesized
atcctttactcttattgaga

SEQ ID NO: 425282 - DNA, 20 bp, Artificial Sequence
  chemically synthesized
ttaccgagctttctcaataa

SEQ ID NO: 425283 - DNA, 20 bp, Artificial Sequence
  chemically synthesized
cgggatcctttactcttatt

SEQ ID NO: 425284 - DNA, 20 bp, Artificial Sequence
  chemically synthesized
gagctttctcaataagagta

SEQ ID NO: 425285 - DNA, 20 bp, Artificial Sequence
  chemically synthesized
agctttctcaataagagtaa

SEQ ID NO: 425286 - DNA, 20 bp, Artificial Sequence
  chemically synthesized
tcaataagagtaaaggatcc

SEQ ID NO: 425287 - DNA, 20 bp, Artificial Sequence
  chemically synthesized
actgcagaacaattatggcc

SEQ ID NO: 425288 - DNA, 20 bp, Artificial Sequence
  chemically synthesized
tactgcagaacaattatggc

SEQ ID NO: 425289 - DNA, 20 bp, Artificial Sequence
  chemically synthesized
aagttactgcagaacaatta

SEQ ID NO: 425290 - DNA, 20 bp, Artificial Sequence
  chemically synthesized
tcccggccataattgttctg

SEQ ID NO: 425291 - DNA, 20 bp, Artificial Sequence
  chemically synthesized
acacctttccaaagttactg

SEQ ID NO: 425292 - DNA, 20 bp, Artificial Sequence
  chemically synthesized
taattgttctgcagtaactt

SEQ ID NO: 425293 - DNA, 20 bp, Artificial Sequence
  chemically synthesized
tgttctgcagtaactttgga

SEQ ID NO: 425294 - DNA, 20 bp, Artificial Sequence
  chemically synthesized
gttctgcagtaactttggaa

SEQ ID NO: 425295 - DNA, 20 bp, Artificial Sequence
  chemically synthesized
aataaaagtacacctttcca

SEQ ID NO: 425296 - DNA, 20 bp, Artificial Sequence
  chemically synthesized
tcatagcacggtttgaataa

SEQ ID NO: 425297 - DNA, 20 bp, Artificial Sequence
  chemically synthesized
gagaagccaaaatcatagca

SEQ ID NO: 425298 - DNA, 20 bp, Artificial Sequence
  chemically synthesized
ttcaaaccgtgctatgattt

SEQ ID NO: 425299 - DNA, 20 bp, Artificial Sequence
  chemically synthesized
taggagagaagccaaaatca

SEQ ID NO: 425300 - DNA, 20 bp, Artificial Sequence
  chemically synthesized
tatgattttggcttctctcc

SEQ ID NO: 425301 - DNA, 20 bp, Artificial Sequence
  chemically synthesized
atgattttggcttctctcct

SEQ ID NO: 425302 - DNA, 20 bp, Artificial Sequence
  chemically synthesized
aaagttcctccctaggagag

SEQ ID NO: 425303 - DNA, 20 bp, Artificial Sequence
  chemically synthesized
tgattttggcttctctccta

SEQ ID NO: 425304 - DNA, 20 bp, Artificial Sequence
  chemically synthesized
attttggcttctctcctagg

SEQ ID NO: 425305 - DNA, 20 bp, Artificial Sequence
  chemically synthesized
atgaaagttcctccctagga

SEQ ID NO: 425306 - DNA, 20 bp, Artificial Sequence
  chemically synthesized
ttttggcttctctcctaggg

SEQ ID NO: 425307 - DNA, 20 bp, Artificial Sequence
  chemically synthesized
aaatgaaagttcctccctag

SEQ ID NO: 425308 - DNA, 20 bp, Artificial Sequence
  chemically synthesized
tgaaatgaaagttcctccct

SEQ ID NO: 425309 - DNA, 20 bp, Artificial Sequence
  chemically synthesized
ctgaaatgaaagttcctccc

SEQ ID NO: 425310 - DNA, 20 bp, Artificial Sequence
  chemically synthesized
ctagggaggaactttcattt

SEQ ID NO: 425311 - DNA, 20 bp, Artificial Sequence
  chemically synthesized
gaacttagttactgaaatga

SEQ ID NO: 425312 - DNA, 20 bp, Artificial Sequence
  chemically synthesized
gaactttcatttcagtaact

SEQ ID NO: 425313 - DNA, 20 bp, Artificial Sequence
  chemically synthesized
agtttggcttttcatgaact

SEQ ID NO: 425314 - DNA, 20 bp, Artificial Sequence
  chemically synthesized
tcagtaactaagttcatgaa

SEQ ID NO: 425315 - DNA, 20 bp, Artificial Sequence
  chemically synthesized
ctgaagagctgcaaagagtt

SEQ ID NO: 425316 - DNA, 20 bp, Artificial Sequence
  chemically synthesized
atgaaaagccaaactctttg

SEQ ID NO: 425317 - DNA, 20 bp, Artificial Sequence
  chemically synthesized
gccagctgaagagctgcaaa

SEQ ID NO: 425318 - DNA, 20 bp, Artificial Sequence
  chemically synthesized
ctgccagctgaagagctgca

SEQ ID NO: 425319 - DNA, 20 bp, Artificial Sequence
  chemically synthesized
ccaaactctttgcagctctt

SEQ ID NO: 425320 - DNA, 20 bp, Artificial Sequence
  chemically synthesized
actctttgcagctcttcagc

SEQ ID NO: 425321 - DNA, 20 bp, Artificial Sequence
  chemically synthesized
aaaaaatgctgccagctgaa

SEQ ID NO: 425322 - DNA, 20 bp, Artificial Sequence
  chemically synthesized
ctttgcagctcttcagctgg

SEQ ID NO: 425323 - DNA, 20 bp, Artificial Sequence
  chemically synthesized
ggaaaaaatgctgccagctg

SEQ ID NO: 425324 - DNA, 20 bp, Artificial Sequence
  chemically synthesized
gaaactggaaaaaatgctgc

SEQ ID NO: 425325 - DNA, 20 bp, Artificial Sequence
  chemically synthesized
tcagctggcagcattttttc

SEQ ID NO: 425326 - DNA, 20 bp, Artificial Sequence
  chemically synthesized
agtgatgagattgtagaaac

SEQ ID NO: 425327 - DNA, 20 bp, Artificial Sequence
  chemically synthesized
acaccacagtgatgagattg

SEQ ID NO: 425328 - DNA, 20 bp, Artificial Sequence
  chemically synthesized
tttctacaatctcatcactg

SEQ ID NO: 425329 - DNA, 20 bp, Artificial Sequence
  chemically synthesized
cagacacacaccacagtgat

SEQ ID NO: 425330 - DNA, 20 bp, Artificial Sequence
  chemically synthesized
aagtaaacagacacacacca

SEQ ID NO: 425331 - DNA, 20 bp, Artificial Sequence
  chemically synthesized
gcttaaaatcgttaagtaaa

SEQ ID NO: 425332 - DNA, 20 bp, Artificial Sequence
  chemically synthesized
gaattgtgcttaaaatcgtt

SEQ ID NO: 425333 - DNA, 20 bp, Artificial Sequence
  chemically synthesized
tctgtttacttaacgatttt

SEQ ID NO: 425334 - DNA, 20 bp, Artificial Sequence
  chemically synthesized
ccaaaaataaatgggtcatg

SEQ ID NO: 425335 - DNA, 20 bp, Artificial Sequence
  chemically synthesized
aacagtatccaaaaataaat

SEQ ID NO: 425336 - DNA, 20 bp, Artificial Sequence
  chemically synthesized
gaacagtatccaaaaataaa

SEQ ID NO: 425337 - DNA, 20 bp, Artificial Sequence
  chemically synthesized
cttcatgacccatttatttt

SEQ ID NO: 425338 - DNA, 20 bp, Artificial Sequence
  chemically synthesized
atgcaatcaaaataaaagaa

SEQ ID NO: 425339 - DNA, 20 bp, Artificial Sequence
  chemically synthesized
aagatatgcaatcaaaataa

SEQ ID NO: 425340 - DNA, 20 bp, Artificial Sequence
  chemically synthesized
ttgattgcatatctttccca

SEQ ID NO: 425341 - DNA, 20 bp, Artificial Sequence
  chemically synthesized
tgattgcatatctttcccat

SEQ ID NO: 425342 - DNA, 20 bp, Artificial Sequence
  chemically synthesized
gattgcatatctttcccata

SEQ ID NO: 425343 - DNA, 20 bp, Artificial Sequence
  chemically synthesized
cttgctgtaaccctatggga

SEQ ID NO: 425344 - DNA, 20 bp, Artificial Sequence
  chemically synthesized
caaacttgctgtaaccctat

SEQ ID NO: 425345 - DNA, 20 bp, Artificial Sequence
  chemically synthesized
tcaaacttgctgtaacccta

SEQ ID NO: 425346 - DNA, 20 bp, Artificial Sequence
  chemically synthesized
atatctttcccatagggtta

SEQ ID NO: 425347 - DNA, 20 bp, Artificial Sequence
  chemically synthesized
ctttcccatagggttacagc

SEQ ID NO: 425348 - DNA, 20 bp, Artificial Sequence
  chemically synthesized
atagggttacagcaagtttg

SEQ ID NO: 425349 - DNA, 20 bp, Artificial Sequence
  chemically synthesized
tagggttacagcaagtttga

SEQ ID NO: 425350 - DNA, 20 bp, Artificial Sequence
  chemically synthesized
atacccctatgatattgagt

SEQ ID NO: 425351 - DNA, 20 bp, Artificial Sequence
  chemically synthesized
aaaacactcactcaatatca

SEQ ID NO: 425352 - DNA, 20 bp, Artificial Sequence
  chemically synthesized
gcaaatacccctatgatatt

SEQ ID NO: 425353 - DNA, 20 bp, Artificial Sequence
  chemically synthesized
aaacactcactcaatatcat

SEQ ID NO: 425354 - DNA, 20 bp, Artificial Sequence
  chemically synthesized
aacactcactcaatatcata

SEQ ID NO: 425355 - DNA, 20 bp, Artificial Sequence
  chemically synthesized
acactcactcaatatcatag

SEQ ID NO: 425356 - DNA, 20 bp, Artificial Sequence
  chemically synthesized
ataggggtatttgctttcaa

SEQ ID NO: 425357 - DNA, 20 bp, Artificial Sequence
  chemically synthesized
tcattctgtttgacttttga

SEQ ID NO: 425358 - DNA, 20 bp, Artificial Sequence
  chemically synthesized
atttgctttcaaaagtcaaa

SEQ ID NO: 425359 - DNA, 20 bp, Artificial Sequence
  chemically synthesized
aaacagaatgaaaatctatc

SEQ ID NO: 425360 - DNA, 20 bp, Artificial Sequence
  chemically synthesized
agaatgaaaatctatctggt

SEQ ID NO: 425361 - DNA, 20 bp, Artificial Sequence
  chemically synthesized
atctaaaataaccaaccaga

SEQ ID NO: 425362 - DNA, 20 bp, Artificial Sequence
  chemically synthesized
aatcatctaaaataaccaac

SEQ ID NO: 425363 - DNA, 20 bp, Artificial Sequence
  chemically synthesized
atctatctggttggttattt

SEQ ID NO: 425364 - DNA, 20 bp, Artificial Sequence
  chemically synthesized
ggttggttattttagatgat

SEQ ID NO: 425365 - DNA, 20 bp, Artificial Sequence
  chemically synthesized
taaaatgatttttggtcatc

SEQ ID NO: 425366 - DNA, 20 bp, Artificial Sequence
  chemically synthesized
ctaaaatgatttttggtcat

SEQ ID NO: 425367 - DNA, 20 bp, Artificial Sequence
  chemically synthesized
tcaaattctaaaatgatttt

SEQ ID NO: 425368 - DNA, 20 bp, Artificial Sequence
  chemically synthesized
ctgatgaccaaaaatcattt

SEQ ID NO: 425369 - DNA, 20 bp, Artificial Sequence
  chemically synthesized
atcattttagaatttgatat

SEQ ID NO: 425370 - DNA, 20 bp, Artificial Sequence
  chemically synthesized
tcattttagaatttgatata

SEQ ID NO: 425371 - DNA, 20 bp, Artificial Sequence
  chemically synthesized
tgatataaggaacttttgca

SEQ ID NO: 425372 - DNA, 20 bp, Artificial Sequence
  chemically synthesized
gttgtaagatgtctgtgcaa

SEQ ID NO: 425373 - DNA, 20 bp, Artificial Sequence
  chemically synthesized
tgcacagacatcttacaaca

SEQ ID NO: 425374 - DNA, 20 bp, Artificial Sequence
  chemically synthesized
ttagagatattccatgttgt

SEQ ID NO: 425375 - DNA, 20 bp, Artificial Sequence
  chemically synthesized
ttacaacatggaatatctct

SEQ ID NO: 425376 - DNA, 20 bp, Artificial Sequence
  chemically synthesized
tatgtaaaacttaacactta

SEQ ID NO: 425377 - DNA, 20 bp, Artificial Sequence
  chemically synthesized
atggaatatctctaagtgtt

SEQ ID NO: 425378 - DNA, 20 bp, Artificial Sequence
  chemically synthesized
tttatgtaaaacttaacact

SEQ ID NO: 425379 - DNA, 20 bp, Artificial Sequence
  chemically synthesized
tttacataaacatgaacatc

SEQ ID NO: 425380 - DNA, 20 bp, Artificial Sequence
  chemically synthesized
acataaacatgaacatctgg

SEQ ID NO: 425381 - DNA, 20 bp, Artificial Sequence
  chemically synthesized
caagttggctcaagttcttc

SEQ ID NO: 425382 - DNA, 20 bp, Artificial Sequence
  chemically synthesized
atgaacatctggaagaactt

SEQ ID NO: 425383 - DNA, 20 bp, Artificial Sequence
  chemically synthesized
aatagctcccaagttggctc

SEQ ID NO: 425384 - DNA, 20 bp, Artificial Sequence
  chemically synthesized
tggaagaacttgagccaact

SEQ ID NO: 425385 - DNA, 20 bp, Artificial Sequence
  chemically synthesized
ggaagaacttgagccaactt

SEQ ID NO: 425386 - DNA, 20 bp, Artificial Sequence
  chemically synthesized
aagaacttgagccaacttgg

SEQ ID NO: 425387 - DNA, 20 bp, Artificial Sequence
  chemically synthesized
taaaataatagctcccaagt

SEQ ID NO: 425388 - DNA, 20 bp, Artificial Sequence
  chemically synthesized
tgggtaaaataatagctccc

SEQ ID NO: 425389 - DNA, 20 bp, Artificial Sequence
  chemically synthesized
aaggaggctgggtaaaataa

SEQ ID NO: 425390 - DNA, 20 bp, Artificial Sequence
  chemically synthesized
ttgggagctattattttacc

SEQ ID NO: 425391 - DNA, 20 bp, Artificial Sequence
  chemically synthesized
tctgtttgatgaaggaggct

SEQ ID NO: 425392 - DNA, 20 bp, Artificial Sequence
  chemically synthesized
ctctgtttgatgaaggaggc

SEQ ID NO: 425393 - DNA, 20 bp, Artificial Sequence
  chemically synthesized
tgagctctgtttgatgaagg

SEQ ID NO: 425394 - DNA, 20 bp, Artificial Sequence
  chemically synthesized
ctgagctctgtttgatgaag

SEQ ID NO: 425395 - DNA, 20 bp, Artificial Sequence
  chemically synthesized
ttctgagctctgtttgatga

SEQ ID NO: 425396 - DNA, 20 bp, Artificial Sequence
  chemically synthesized
acccagcctccttcatcaaa

SEQ ID NO: 425397 - DNA, 20 bp, Artificial Sequence
  chemically synthesized
gttctgagctctgtttgatg

SEQ ID NO: 425398 - DNA, 20 bp, Artificial Sequence
  chemically synthesized
ccagcctccttcatcaaaca

SEQ ID NO: 425399 - DNA, 20 bp, Artificial Sequence
  chemically synthesized
ctccttcatcaaacagagct

SEQ ID NO: 425400 - DNA, 20 bp, Artificial Sequence
  chemically synthesized
agctaacggaggggagttct

SEQ ID NO: 425401 - DNA, 20 bp, Artificial Sequence
  chemically synthesized
agcttaaagctaacggaggg

SEQ ID NO: 425402 - DNA, 20 bp, Artificial Sequence
  chemically synthesized
agctcagaactcccctccgt

SEQ ID NO: 425403 - DNA, 20 bp, Artificial Sequence
  chemically synthesized
aaagcttaaagctaacggag

SEQ ID NO: 425404 - DNA, 20 bp, Artificial Sequence
  chemically synthesized
aaaagcttaaagctaacgga

SEQ ID NO: 425405 - DNA, 20 bp, Artificial Sequence
  chemically synthesized
gaaaagcttaaagctaacgg

SEQ ID NO: 425406 - DNA, 20 bp, Artificial Sequence
  chemically synthesized
agaaaagcttaaagctaacg

SEQ ID NO: 425407 - DNA, 20 bp, Artificial Sequence
  chemically synthesized
tgagaaaagcttaaagctaa

SEQ ID NO: 425408 - DNA, 20 bp, Artificial Sequence
  chemically synthesized
aactcccctccgttagcttt

SEQ ID NO: 425409 - DNA, 20 bp, Artificial Sequence
  chemically synthesized
agttcattgagaaaagctta

SEQ ID NO: 425410 - DNA, 20 bp, Artificial Sequence
  chemically synthesized
attactcagttcattgagaa

SEQ ID NO: 425411 - DNA, 20 bp, Artificial Sequence
  chemically synthesized
attccattactcagttcatt

SEQ ID NO: 425412 - DNA, 20 bp, Artificial Sequence
  chemically synthesized
taagcttttctcaatgaact

SEQ ID NO: 425413 - DNA, 20 bp, Artificial Sequence
  chemically synthesized
tttctcaatgaactgagtaa

SEQ ID NO: 425414 - DNA, 20 bp, Artificial Sequence
  chemically synthesized
tccctcaagattccattact

SEQ ID NO: 425415 - DNA, 20 bp, Artificial Sequence
  chemically synthesized
gaactgagtaatggaatctt

SEQ ID NO: 425416 - DNA, 20 bp, Artificial Sequence
  chemically synthesized
aactgagtaatggaatcttg

SEQ ID NO: 425417 - DNA, 20 bp, Artificial Sequence
  chemically synthesized
actgagtaatggaatcttga

SEQ ID NO: 425418 - DNA, 20 bp, Artificial Sequence
  chemically synthesized
tggatttaaaggtgtccctc

SEQ ID NO: 425419 - DNA, 20 bp, Artificial Sequence
  chemically synthesized
ttgagggacacctttaaatc

SEQ ID NO: 425420 - DNA, 20 bp, Artificial Sequence
  chemically synthesized
gcttctactgctggatttaa

SEQ ID NO: 425421 - DNA, 20 bp, Artificial Sequence
  chemically synthesized
tgcttctactgctggattta

SEQ ID NO: 425422 - DNA, 20 bp, Artificial Sequence
  chemically synthesized
agggacacctttaaatccag

SEQ ID NO: 425423 - DNA, 20 bp, Artificial Sequence
  chemically synthesized
gacacctttaaatccagcag

SEQ ID NO: 425424 - DNA, 20 bp, Artificial Sequence
  chemically synthesized
acctttaaatccagcagtag

SEQ ID NO: 425425 - DNA, 20 bp, Artificial Sequence
  chemically synthesized
aaggtttttgcttctactgc

SEQ ID NO: 425426 - DNA, 20 bp, Artificial Sequence
  chemically synthesized
cttttgcttatcagtgggga

SEQ ID NO: 425427 - DNA, 20 bp, Artificial Sequence
  chemically synthesized
tcttttgcttatcagtgggg

SEQ ID NO: 425428 - DNA, 20 bp, Artificial Sequence
  chemically synthesized
caaaaaccttccccactgat

SEQ ID NO: 425429 - DNA, 20 bp, Artificial Sequence
  chemically synthesized
tattcttttgcttatcagtg

SEQ ID NO: 425430 - DNA, 20 bp, Artificial Sequence
  chemically synthesized
atattcttttgcttatcagt

SEQ ID NO: 425431 - DNA, 20 bp, Artificial Sequence
  chemically synthesized
aatattcttttgcttatcag

SEQ ID NO: 425432 - DNA, 20 bp, Artificial Sequence
  chemically synthesized
agaaatattcttttgcttat

SEQ ID NO: 425433 - DNA, 20 bp, Artificial Sequence
  chemically synthesized
ccttccccactgataagcaa

SEQ ID NO: 425434 - DNA, 20 bp, Artificial Sequence
  chemically synthesized
gataagcaaaagaatatttc

SEQ ID NO: 425435 - DNA, 20 bp, Artificial Sequence
  chemically synthesized
tagttgatgggttttgttgc

SEQ ID NO: 425436 - DNA, 20 bp, Artificial Sequence
  chemically synthesized
atataccgcctatagttgat

SEQ ID NO: 425437 - DNA, 20 bp, Artificial Sequence
  chemically synthesized
gcaacaaaacccatcaacta

SEQ ID NO: 425438 - DNA, 20 bp, Artificial Sequence
  chemically synthesized
tatataccgcctatagttga

SEQ ID NO: 425439 - DNA, 20 bp, Artificial Sequence
  chemically synthesized
caacaaaacccatcaactat

SEQ ID NO: 425440 - DNA, 20 bp, Artificial Sequence
  chemically synthesized
caaaacccatcaactatagg

SEQ ID NO: 425441 - DNA, 20 bp, Artificial Sequence
  chemically synthesized
agttagatatataccgccta

SEQ ID NO: 425442 - DNA, 20 bp, Artificial Sequence
  chemically synthesized
taggcggtatatatctaact

SEQ ID NO: 425443 - DNA, 20 bp, Artificial Sequence
  chemically synthesized
cggtatatatctaactcagt

SEQ ID NO: 425444 - DNA, 20 bp, Artificial Sequence
  chemically synthesized
taactcaaggctgactgagt

SEQ ID NO: 425445 - DNA, 20 bp, Artificial Sequence
  chemically synthesized
cgtttaactcaaggctgact

SEQ ID NO: 425446 - DNA, 20 bp, Artificial Sequence
  chemically synthesized
tatctaactcagtcagcctt

SEQ ID NO: 425447 - DNA, 20 bp, Artificial Sequence
  chemically synthesized
actgactcacgtttaactca

SEQ ID NO: 425448 - DNA, 20 bp, Artificial Sequence
  chemically synthesized
tactgactcacgtttaactc

SEQ ID NO: 425449 - DNA, 20 bp, Artificial Sequence
  chemically synthesized
gtcagccttgagttaaacgt

SEQ ID NO: 425450 - DNA, 20 bp, Artificial Sequence
  chemically synthesized
gccttgagttaaacgtgagt

SEQ ID NO: 425451 - DNA, 20 bp, Artificial Sequence
  chemically synthesized
acgtgagtcagtaacccctg

SEQ ID NO: 425452 - DNA, 20 bp, Artificial Sequence
  chemically synthesized
cgtgagtcagtaacccctga

SEQ ID NO: 425453 - DNA, 20 bp, Artificial Sequence
  chemically synthesized
gcctttgttgttgccttcag

SEQ ID NO: 425454 - DNA, 20 bp, Artificial Sequence
  chemically synthesized
agcctttgttgttgccttca

SEQ ID NO: 425455 - DNA, 20 bp, Artificial Sequence
  chemically synthesized
aagcctttgttgttgccttc

SEQ ID NO: 425456 - DNA, 20 bp, Artificial Sequence
  chemically synthesized
taagcctttgttgttgcctt

SEQ ID NO: 425457 - DNA, 20 bp, Artificial Sequence
  chemically synthesized
aacccctgaaggcaacaaca

SEQ ID NO: 425458 - DNA, 20 bp, Artificial Sequence
  chemically synthesized
acccctgaaggcaacaacaa

SEQ ID NO: 425459 - DNA, 20 bp, Artificial Sequence
  chemically synthesized
tgaaggcaacaacaaaggct

SEQ ID NO: 425460 - DNA, 20 bp, Artificial Sequence
  chemically synthesized
aaggcaacaacaaaggctta

SEQ ID NO: 425461 - DNA, 20 bp, Artificial Sequence
  chemically synthesized
gaacttttttatttcactct

SEQ ID NO: 425462 - DNA, 20 bp, Artificial Sequence
  chemically synthesized
aggcttagagtgaaataaaa

SEQ ID NO: 425463 - DNA, 20 bp, Artificial Sequence
  chemically synthesized
gagtgaaataaaaaagttcg

SEQ ID NO: 425464 - DNA, 20 bp, Artificial Sequence
  chemically synthesized
aaaagttcgcagacatactg

SEQ ID NO: 425465 - DNA, 20 bp, Artificial Sequence
  chemically synthesized
agttcgcagacatactgcag

SEQ ID NO: 425466 - DNA, 20 bp, Artificial Sequence
  chemically synthesized
ctctgagactggatcttctg

SEQ ID NO: 425467 - DNA, 20 bp, Artificial Sequence
  chemically synthesized
cagacatactgcagaagatc

SEQ ID NO: 425468 - DNA, 20 bp, Artificial Sequence
  chemically synthesized
tactgcagaagatccagtct

SEQ ID NO: 425469 - DNA, 20 bp, Artificial Sequence
  chemically synthesized
ctgcagaagatccagtctca

SEQ ID NO: 425470 - DNA, 20 bp, Artificial Sequence
  chemically synthesized
agcagatcattctctgagac

SEQ ID NO: 425471 - DNA, 20 bp, Artificial Sequence
  chemically synthesized
tgttaagcagatcattctct

SEQ ID NO: 425472 - DNA, 20 bp, Artificial Sequence
  chemically synthesized
tctcagggccaagtgttaag

SEQ ID NO: 425473 - DNA, 20 bp, Artificial Sequence
  chemically synthesized
agaatgatctgcttaacact

SEQ ID NO: 425474 - DNA, 20 bp, Artificial Sequence
  chemically synthesized
taatctcagggccaagtgtt

SEQ ID NO: 425475 - DNA, 20 bp, Artificial Sequence
  chemically synthesized
tctgcttaacacttggccct

SEQ ID NO: 425476 - DNA, 20 bp, Artificial Sequence
  chemically synthesized
tctcagataatctcagggcc

SEQ ID NO: 425477 - DNA, 20 bp, Artificial Sequence
  chemically synthesized
gaaattctcagataatctca

SEQ ID NO: 425478 - DNA, 20 bp, Artificial Sequence
  chemically synthesized
ggaaattctcagataatctc

SEQ ID NO: 425479 - DNA, 20 bp, Artificial Sequence
  chemically synthesized
aggaaattctcagataatct

SEQ ID NO: 425480 - DNA, 20 bp, Artificial Sequence
  chemically synthesized
acttggccctgagattatct

SEQ ID NO: 425481 - DNA, 20 bp, Artificial Sequence
  chemically synthesized
tgaatgttttaggaaattct

SEQ ID NO: 425482 - DNA, 20 bp, Artificial Sequence
  chemically synthesized
tgtgaggtgttgaatgtttt

SEQ ID NO: 425483 - DNA, 20 bp, Artificial Sequence
  chemically synthesized
ctgtgaggtgttgaatgttt

SEQ ID NO: 425484 - DNA, 20 bp, Artificial Sequence
  chemically synthesized
ctaaaacattcaacacctca

SEQ ID NO: 425485 - DNA, 20 bp, Artificial Sequence
  chemically synthesized
ttttaactgtggtcactgtg

SEQ ID NO: 425486 - DNA, 20 bp, Artificial Sequence
  chemically synthesized
tttttaactgtggtcactgt

SEQ ID NO: 425487 - DNA, 20 bp, Artificial Sequence
  chemically synthesized
tcaacacctcacagtgacca

SEQ ID NO: 425488 - DNA, 20 bp, Artificial Sequence
  chemically synthesized
taatacattatttttaactg

SEQ ID NO: 425489 - DNA, 20 bp, Artificial Sequence
  chemically synthesized
cagttaaaaataatgtatta

SEQ ID NO: 425490 - DNA, 20 bp, Artificial Sequence
  chemically synthesized
agttaaaaataatgtattat

SEQ ID NO: 425491 - DNA, 20 bp, Artificial Sequence
  chemically synthesized
ataggtttcaaaattgctaa

SEQ ID NO: 425492 - DNA, 20 bp, Artificial Sequence
  chemically synthesized
tttcaaaattgctaaaagaa

SEQ ID NO: 425493 - DNA, 20 bp, Artificial Sequence
  chemically synthesized
cattaaaaaatctattcttt

SEQ ID NO: 425494 - DNA, 20 bp, Artificial Sequence
  chemically synthesized
aacttatcattttttgtagc

SEQ ID NO: 425495 - DNA, 20 bp, Artificial Sequence
  chemically synthesized
caccaacttatcattttttg

SEQ ID NO: 425496 - DNA, 20 bp, Artificial Sequence
  chemically synthesized
ttctcgctacaaaaaatgat

SEQ ID NO: 425497 - DNA, 20 bp, Artificial Sequence
  chemically synthesized
cgctacaaaaaatgataagt

SEQ ID NO: 425498 - DNA, 20 bp, Artificial Sequence
  chemically synthesized
acaaaaaatgataagttggt

SEQ ID NO: 425499 - DNA, 20 bp, Artificial Sequence
  chemically synthesized
caaaaaatgataagttggtg

SEQ ID NO: 425500 - DNA, 20 bp, Artificial Sequence
  chemically synthesized
atgataagttggtgaggtga

SEQ ID NO: 425501 - DNA, 20 bp, Artificial Sequence
  chemically synthesized
tggtgaggtgatagatatgt

SEQ ID NO: 425502 - DNA, 20 bp, Artificial Sequence
  chemically synthesized
gaggtgatagatatgttagt

SEQ ID NO: 425503 - DNA, 20 bp, Artificial Sequence
  chemically synthesized
tgttgtagaaagagtcagtc

SEQ ID NO: 425504 - DNA, 20 bp, Artificial Sequence
  chemically synthesized
gtgtatgttgtagaaagagt

SEQ ID NO: 425505 - DNA, 20 bp, Artificial Sequence
  chemically synthesized
ctatgtgtatgttgtagaaa

SEQ ID NO: 425506 - DNA, 20 bp, Artificial Sequence
  chemically synthesized
atctatgtgtatgttgtaga

SEQ ID NO: 425507 - DNA, 20 bp, Artificial Sequence
  chemically synthesized
tttgatctatgtgtatgttg

SEQ ID NO: 425508 - DNA, 20 bp, Artificial Sequence
  chemically synthesized
ctctttctacaacatacaca

SEQ ID NO: 425509 - DNA, 20 bp, Artificial Sequence
  chemically synthesized
caaaaacatcacgttgtact

SEQ ID NO: 425510 - DNA, 20 bp, Artificial Sequence
  chemically synthesized
aatagttgtacatatttacc

SEQ ID NO: 425511 - DNA, 20 bp, Artificial Sequence
  chemically synthesized
tatttttaactgacaaataa

SEQ ID NO: 425512 - DNA, 20 bp, Artificial Sequence
  chemically synthesized
tatgtacaactattatttgt

SEQ ID NO: 425513 - DNA, 20 bp, Artificial Sequence
  chemically synthesized
cccagatcttggaagtattg

SEQ ID NO: 425514 - DNA, 20 bp, Artificial Sequence
  chemically synthesized
taaaaaacttcaatacttcc

SEQ ID NO: 425515 - DNA, 20 bp, Artificial Sequence
  chemically synthesized
tagttgttcccagatcttgg

SEQ ID NO: 425516 - DNA, 20 bp, Artificial Sequence
  chemically synthesized
acttcaatacttccaagatc

SEQ ID NO: 425517 - DNA, 20 bp, Artificial Sequence
  chemically synthesized
cttcaatacttccaagatct

SEQ ID NO: 425518 - DNA, 20 bp, Artificial Sequence
  chemically synthesized
acgtagttgttcccagatct

SEQ ID NO: 425519 - DNA, 20 bp, Artificial Sequence
  chemically synthesized
gcttaccacgtagttgttcc

SEQ ID NO: 425520 - DNA, 20 bp, Artificial Sequence
  chemically synthesized
aagatctgggaacaactacg

SEQ ID NO: 425521 - DNA, 20 bp, Artificial Sequence
  chemically synthesized
tctgggaacaactacgtggt

SEQ ID NO: 425522 - DNA, 20 bp, Artificial Sequence
  chemically synthesized
aaattaatgggcttaccacg

SEQ ID NO: 425523 - DNA, 20 bp, Artificial Sequence
  chemically synthesized
agtcccagttataaattaat

SEQ ID NO: 425524 - DNA, 20 bp, Artificial Sequence
  chemically synthesized
cagtcccagttataaattaa

SEQ ID NO: 425525 - DNA, 20 bp, Artificial Sequence
  chemically synthesized
taagcccattaatttataac

SEQ ID NO: 425526 - DNA, 20 bp, Artificial Sequence
  chemically synthesized
aagcccattaatttataact

SEQ ID NO: 425527 - DNA, 20 bp, Artificial Sequence
  chemically synthesized
gttctgttggtttacagtcc

SEQ ID NO: 425528 - DNA, 20 bp, Artificial Sequence
  chemically synthesized
gaattcgttctgttggttta

SEQ ID NO: 425529 - DNA, 20 bp, Artificial Sequence
  chemically synthesized
taactgggactgtaaaccaa

SEQ ID NO: 425530 - DNA, 20 bp, Artificial Sequence
  chemically synthesized
agtggaagaattcgttctgt

SEQ ID NO: 425531 - DNA, 20 bp, Artificial Sequence
  chemically synthesized
caaaggctgattttaagtgg

SEQ ID NO: 425532 - DNA, 20 bp, Artificial Sequence
  chemically synthesized
aatcaaaggctgattttaag

SEQ ID NO: 425533 - DNA, 20 bp, Artificial Sequence
  chemically synthesized
cgaattcttccacttaaaat

SEQ ID NO: 425534 - DNA, 20 bp, Artificial Sequence
  chemically synthesized
attaatcaaaggctgatttt

SEQ ID NO: 425535 - DNA, 20 bp, Artificial Sequence
  chemically synthesized
atgggtatgccattaatcaa

SEQ ID NO: 425536 - DNA, 20 bp, Artificial Sequence
  chemically synthesized
taaaatcagcctttgattaa

SEQ ID NO: 425537 - DNA, 20 bp, Artificial Sequence
  chemically synthesized
tatgggtatgccattaatca

SEQ ID NO: 425538 - DNA, 20 bp, Artificial Sequence
  chemically synthesized
atataggagacgtaatatat

SEQ ID NO: 425539 - DNA, 20 bp, Artificial Sequence
  chemically synthesized
catataggagacgtaatata

SEQ ID NO: 425540 - DNA, 20 bp, Artificial Sequence
  chemically synthesized
atatattacgtctcctatat

SEQ ID NO: 425541 - DNA, 20 bp, Artificial Sequence
  chemically synthesized
tatatgttgttctcatatag

SEQ ID NO: 425542 - DNA, 20 bp, Artificial Sequence
  chemically synthesized
attatatgttgttctcatat

SEQ ID NO: 425543 - DNA, 20 bp, Artificial Sequence
  chemically synthesized
cattatatgttgttctcata

SEQ ID NO: 425544 - DNA, 20 bp, Artificial Sequence
  chemically synthesized
tgagaacaacatataatgta

SEQ ID NO: 425545 - DNA, 20 bp, Artificial Sequence
  chemically synthesized
atttattatcacaaaatttc

SEQ ID NO: 425546 - DNA, 20 bp, Artificial Sequence
  chemically synthesized
aactggacttattttatttc

SEQ ID NO: 425547 - DNA, 20 bp, Artificial Sequence
  chemically synthesized
aaaatttctagaaataaaat

SEQ ID NO: 425548 - DNA, 20 bp, Artificial Sequence
  chemically synthesized
ttctagaaataaaataagtc

SEQ ID NO: 425549 - DNA, 20 bp, Artificial Sequence
  chemically synthesized
gaaataaaataagtccagtt

SEQ ID NO: 425550 - DNA, 20 bp, Artificial Sequence
  chemically synthesized
ataaaataagtccagttcag

SEQ ID NO: 425551 - DNA, 20 bp, Artificial Sequence
  chemically synthesized
taaaataagtccagttcagt

SEQ ID NO: 425552 - DNA, 20 bp, Artificial Sequence
  chemically synthesized
caggattatacctactgaac

SEQ ID NO: 425553 - DNA, 20 bp, Artificial Sequence
  chemically synthesized
gacatatggggatttagaac

SEQ ID NO: 425554 - DNA, 20 bp, Artificial Sequence
  chemically synthesized
agacatatggggatttagaa

SEQ ID NO: 425555 - DNA, 20 bp, Artificial Sequence
  chemically synthesized
attatagacatatggggatt

SEQ ID NO: 425556 - DNA, 20 bp, Artificial Sequence
  chemically synthesized
ggcagcattatagacatatg

SEQ ID NO: 425557 - DNA, 20 bp, Artificial Sequence
  chemically synthesized
tggcagcattatagacatat

SEQ ID NO: 425558 - DNA, 20 bp, Artificial Sequence
  chemically synthesized
gtggcagcattatagacata

SEQ ID NO: 425559 - DNA, 20 bp, Artificial Sequence
  chemically synthesized
agatatatgtggcagcatta

SEQ ID NO: 425560 - DNA, 20 bp, Artificial Sequence
  chemically synthesized
ttttaagaagatatatgtgg

SEQ ID NO: 425561 - DNA, 20 bp, Artificial Sequence
  chemically synthesized
gtgttttaagaagatatatg

SEQ ID NO: 425562 - DNA, 20 bp, Artificial Sequence
  chemically synthesized
gaagaaactagtgttttaag

SEQ ID NO: 425563 - DNA, 20 bp, Artificial Sequence
  chemically synthesized
catatatcttcttaaaacac

SEQ ID NO: 425564 - DNA, 20 bp, Artificial Sequence
  chemically synthesized
tatgaagaaactagtgtttt

SEQ ID NO: 425565 - DNA, 20 bp, Artificial Sequence
  chemically synthesized
agtaggtgatatgaagaaac

SEQ ID NO: 425566 - DNA, 20 bp, Artificial Sequence
  chemically synthesized
gaatgacagtaggtgatatg

SEQ ID NO: 425567 - DNA, 20 bp, Artificial Sequence
  chemically synthesized
ggggttataagaatgacagt

SEQ ID NO: 425568 - DNA, 20 bp, Artificial Sequence
  chemically synthesized
tggggttataagaatgacag

SEQ ID NO: 425569 - DNA, 20 bp, Artificial Sequence
  chemically synthesized
agttggggttataagaatga

SEQ ID NO: 425570 - DNA, 20 bp, Artificial Sequence
  chemically synthesized
ttatcaagagttggggttat

SEQ ID NO: 425571 - DNA, 20 bp, Artificial Sequence
  chemically synthesized
aactatcttatcaagagttg

SEQ ID NO: 425572 - DNA, 20 bp, Artificial Sequence
  chemically synthesized
aaactatcttatcaagagtt

SEQ ID NO: 425573 - DNA, 20 bp, Artificial Sequence
  chemically synthesized
gaaactatcttatcaagagt

SEQ ID NO: 425574 - DNA, 20 bp, Artificial Sequence
  chemically synthesized
ttataaccccaactcttgat

SEQ ID NO: 425575 - DNA, 20 bp, Artificial Sequence
  chemically synthesized
gatggaaactatcttatcaa

SEQ ID NO: 425576 - DNA, 20 bp, Artificial Sequence
  chemically synthesized
aaccccaactcttgataaga

SEQ ID NO: 425577 - DNA, 20 bp, Artificial Sequence
  chemically synthesized
tggatggaaactatcttatc

SEQ ID NO: 425578 - DNA, 20 bp, Artificial Sequence
  chemically synthesized
gatgaagtttggacaatgga

SEQ ID NO: 425579 - DNA, 20 bp, Artificial Sequence
  chemically synthesized
agatgatgaagtttggacaa

SEQ ID NO: 425580 - DNA, 20 bp, Artificial Sequence
  chemically synthesized
gaaaggcagatgatgaagtt

SEQ ID NO: 425581 - DNA, 20 bp, Artificial Sequence
  chemically synthesized
gaaatgaaaggcagatgatg

SEQ ID NO: 425582 - DNA, 20 bp, Artificial Sequence
  chemically synthesized
gtgtactgagaaatgaaagg

SEQ ID NO: 425583 - DNA, 20 bp, Artificial Sequence
  chemically synthesized
ttagtgtactgagaaatgaa

SEQ ID NO: 425584 - DNA, 20 bp, Artificial Sequence
  chemically synthesized
cttagtgtactgagaaatga

SEQ ID NO: 425585 - DNA, 20 bp, Artificial Sequence
  chemically synthesized
atcatctgcctttcatttct

SEQ ID NO: 425586 - DNA, 20 bp, Artificial Sequence
  chemically synthesized
agaagcaagcttagtgtact

SEQ ID NO: 425587 - DNA, 20 bp, Artificial Sequence
  chemically synthesized
ctttcatttctcagtacact

SEQ ID NO: 425588 - DNA, 20 bp, Artificial Sequence
  chemically synthesized
cgtttcagtagaagcaagct

SEQ ID NO: 425589 - DNA, 20 bp, Artificial Sequence
  chemically synthesized
tagtgcgtttcagtagaagc

SEQ ID NO: 425590 - DNA, 20 bp, Artificial Sequence
  chemically synthesized
agaatagtgcgtttcagtag

SEQ ID NO: 425591 - DNA, 20 bp, Artificial Sequence
  chemically synthesized
tgtagaatagtgcgtttcag

SEQ ID NO: 425592 - DNA, 20 bp, Artificial Sequence
  chemically synthesized
acctgtagaatagtgcgttt

SEQ ID NO: 425593 - DNA, 20 bp, Artificial Sequence
  chemically synthesized
tactgaaacgcactattcta

SEQ ID NO: 425594 - DNA, 20 bp, Artificial Sequence
  chemically synthesized
actgaaacgcactattctac

SEQ ID NO: 425595 - DNA, 20 bp, Artificial Sequence
  chemically synthesized
ggagagagaaacctgtagaa

SEQ ID NO: 425596 - DNA, 20 bp, Artificial Sequence
  chemically synthesized
ctaatggagagagaaacctg

SEQ ID NO: 425597 - DNA, 20 bp, Artificial Sequence
  chemically synthesized
ctacaggtttctctctccat

SEQ ID NO: 425598 - DNA, 20 bp, Artificial Sequence
  chemically synthesized
atcttataatctaatggaga

SEQ ID NO: 425599 - DNA, 20 bp, Artificial Sequence
  chemically synthesized
atatcttataatctaatgga

SEQ ID NO: 425600 - DNA, 20 bp, Artificial Sequence
  chemically synthesized
aaatatcttataatctaatg

SEQ ID NO: 425601 - DNA, 20 bp, Artificial Sequence
  chemically synthesized
ttaaatatcttataatctaa

SEQ ID NO: 425602 - DNA, 20 bp, Artificial Sequence
  chemically synthesized
ttctctctccattagattat

SEQ ID NO: 425603 - DNA, 20 bp, Artificial Sequence
  chemically synthesized
cattagattataagatattt

SEQ ID NO: 425604 - DNA, 20 bp, Artificial Sequence
  chemically synthesized
gattataagatatttaagaa

SEQ ID NO: 425605 - DNA, 20 bp, Artificial Sequence
  chemically synthesized
ataagatatttaagaacaga

SEQ ID NO: 425606 - DNA, 20 bp, Artificial Sequence
  chemically synthesized
atatttaagaacagaaagac

SEQ ID NO: 425607 - DNA, 20 bp, Artificial Sequence
  chemically synthesized
ctggaaagctgtaaaaaagc

SEQ ID NO: 425608 - DNA, 20 bp, Artificial Sequence
  chemically synthesized
cagaaagactggctttttta

SEQ ID NO: 425609 - DNA, 20 bp, Artificial Sequence
  chemically synthesized
gggactggaaagctgtaaaa

SEQ ID NO: 425610 - DNA, 20 bp, Artificial Sequence
  chemically synthesized
ctggcttttttacagctttc

SEQ ID NO: 425611 - DNA, 20 bp, Artificial Sequence
  chemically synthesized
aggaagcactagggactgga

SEQ ID NO: 425612 - DNA, 20 bp, Artificial Sequence
  chemically synthesized
ttttacagctttccagtccc

SEQ ID NO: 425613 - DNA, 20 bp, Artificial Sequence
  chemically synthesized
tgctaggaagcactagggac

SEQ ID NO: 425614 - DNA, 20 bp, Artificial Sequence
  chemically synthesized
aacagtgctaggaagcacta

SEQ ID NO: 425615 - DNA, 20 bp, Artificial Sequence
  chemically synthesized
gaacagtgctaggaagcact

SEQ ID NO: 425616 - DNA, 20 bp, Artificial Sequence
  chemically synthesized
ggaacagtgctaggaagcac

SEQ ID NO: 425617 - DNA, 20 bp, Artificial Sequence
  chemically synthesized
ttccagtccctagtgcttcc

SEQ ID NO: 425618 - DNA, 20 bp, Artificial Sequence
  chemically synthesized
gttccaggaacagtgctagg

SEQ ID NO: 425619 - DNA, 20 bp, Artificial Sequence
  chemically synthesized
tatgttccaggaacagtgct

SEQ ID NO: 425620 - DNA, 20 bp, Artificial Sequence
  chemically synthesized
ctatgttccaggaacagtgc

SEQ ID NO: 425621 - DNA, 20 bp, Artificial Sequence
  chemically synthesized
gtgcttcctagcactgttcc

SEQ ID NO: 425622 - DNA, 20 bp, Artificial Sequence
  chemically synthesized
tggtaactatgttccaggaa

SEQ ID NO: 425623 - DNA, 20 bp, Artificial Sequence
  chemically synthesized
ctagcactgttcctggaaca

SEQ ID NO: 425624 - DNA, 20 bp, Artificial Sequence
  chemically synthesized
ctttgtggtaactatgttcc

SEQ ID NO: 425625 - DNA, 20 bp, Artificial Sequence
  chemically synthesized
gctttgtggtaactatgttc

SEQ ID NO: 425626 - DNA, 20 bp, Artificial Sequence
  chemically synthesized
cctggaacatagttaccaca

SEQ ID NO: 425627 - DNA, 20 bp, Artificial Sequence
  chemically synthesized
tgaagtagatgtttgctttg

SEQ ID NO: 425628 - DNA, 20 bp, Artificial Sequence
  chemically synthesized
tatcaatgtgaaacatgaag

SEQ ID NO: 425629 - DNA, 20 bp, Artificial Sequence
  chemically synthesized
atatatcaatgtgaaacatg

SEQ ID NO: 425630 - DNA, 20 bp, Artificial Sequence
  chemically synthesized
acacgtgttggacgttagtg

SEQ ID NO: 425631 - DNA, 20 bp, Artificial Sequence
  chemically synthesized
aacacgtgttggacgttagt

SEQ ID NO: 425632 - DNA, 20 bp, Artificial Sequence
  chemically synthesized
taacacgtgttggacgttag

SEQ ID NO: 425633 - DNA, 20 bp, Artificial Sequence
  chemically synthesized
aaataacacgtgttggacgt

SEQ ID NO: 425634 - DNA, 20 bp, Artificial Sequence
  chemically synthesized
tttgtttaaataacacgtgt

SEQ ID NO: 425635 - DNA, 20 bp, Artificial Sequence
  chemically synthesized
cgtgttatttaaacaaatac

SEQ ID NO: 425636 - DNA, 20 bp, Artificial Sequence
  chemically synthesized
atgtacaagtatttagagac

SEQ ID NO: 425637 - DNA, 20 bp, Artificial Sequence
  chemically synthesized
agcagatgtacaagtattta

SEQ ID NO: 425638 - DNA, 20 bp, Artificial Sequence
  chemically synthesized
tgagcagatgtacaagtatt

SEQ ID NO: 425639 - DNA, 20 bp, Artificial Sequence
  chemically synthesized
aaatttttgagcagatgtac

SEQ ID NO: 425640 - DNA, 20 bp, Artificial Sequence
  chemically synthesized
tattttataaaatttttgag

SEQ ID NO: 425641 - DNA, 20 bp, Artificial Sequence
  chemically synthesized
gcatattttataaaattttt

SEQ ID NO: 425642 - DNA, 20 bp, Artificial Sequence
  chemically synthesized
aaaaattttataaaatatgc

SEQ ID NO: 425643 - DNA, 20 bp, Artificial Sequence
  chemically synthesized
ttttcacaatagaaatgatc

SEQ ID NO: 425644 - DNA, 20 bp, Artificial Sequence
  chemically synthesized
ttgcttctaatttttcacaa

SEQ ID NO: 425645 - DNA, 20 bp, Artificial Sequence
  chemically synthesized
tcatttctattgtgaaaaat

SEQ ID NO: 425646 - DNA, 20 bp, Artificial Sequence
  chemically synthesized
tttctattgtgaaaaattag

SEQ ID NO: 425647 - DNA, 20 bp, Artificial Sequence
  chemically synthesized
atttctatttcatgaatatt

SEQ ID NO: 425648 - DNA, 20 bp, Artificial Sequence
  chemically synthesized
caaactaaatattcatgaaa

SEQ ID NO: 425649 - DNA, 20 bp, Artificial Sequence
  chemically synthesized
aatagaaatgaaaacaattc

SEQ ID NO: 425650 - DNA, 20 bp, Artificial Sequence
  chemically synthesized
aatatattaataggatgtac

SEQ ID NO: 425651 - DNA, 20 bp, Artificial Sequence
  chemically synthesized
ctgcatataaatatattaat

SEQ ID NO: 425652 - DNA, 20 bp, Artificial Sequence
  chemically synthesized
tctgcatataaatatattaa

SEQ ID NO: 425653 - DNA, 20 bp, Artificial Sequence
  chemically synthesized
cctattaatatatttatatg

SEQ ID NO: 425654 - DNA, 20 bp, Artificial Sequence
  chemically synthesized
ataaaaaaatcacattctta

SEQ ID NO: 425655 - DNA, 20 bp, Artificial Sequence
  chemically synthesized
aacgtagttaaatattccat

SEQ ID NO: 425656 - DNA, 20 bp, Artificial Sequence
  chemically synthesized
tatggaatatttaactacgt

SEQ ID NO: 425657 - DNA, 20 bp, Artificial Sequence
  chemically synthesized
tatcatatggttttccaacg

SEQ ID NO: 425658 - DNA, 20 bp, Artificial Sequence
  chemically synthesized
aattcacttaatatatcata

SEQ ID NO: 425659 - DNA, 20 bp, Artificial Sequence
  chemically synthesized
ggaaaaccatatgatatatt

SEQ ID NO: 425660 - DNA, 20 bp, Artificial Sequence
  chemically synthesized
tatgatatattaagtgaatt

SEQ ID NO: 425661 - DNA, 20 bp, Artificial Sequence
  chemically synthesized
gatatattaagtgaattaag

SEQ ID NO: 425662 - DNA, 20 bp, Artificial Sequence
  chemically synthesized
tagcatacacatagttttgg

SEQ ID NO: 425663 - DNA, 20 bp, Artificial Sequence
  chemically synthesized
ttttagcatacacatagttt

SEQ ID NO: 425664 - DNA, 20 bp, Artificial Sequence
  chemically synthesized
ttagtattttagcatacaca

SEQ ID NO: 425665 - DNA, 20 bp, Artificial Sequence
  chemically synthesized
aataatacattttagtattt

SEQ ID NO: 425666 - DNA, 20 bp, Artificial Sequence
  chemically synthesized
ccactaagaataatacattt

SEQ ID NO: 425667 - DNA, 20 bp, Artificial Sequence
  chemically synthesized
atactaaaatgtattattct

SEQ ID NO: 425668 - DNA, 20 bp, Artificial Sequence
  chemically synthesized
ctaaaatgtattattcttag

SEQ ID NO: 425669 - DNA, 20 bp, Artificial Sequence
  chemically synthesized
agcctaggtttttaaccact

SEQ ID NO: 425670 - DNA, 20 bp, Artificial Sequence
  chemically synthesized
attcttagtggttaaaaacc

SEQ ID NO: 425671 - DNA, 20 bp, Artificial Sequence
  chemically synthesized
ttcttagtggttaaaaacct

SEQ ID NO: 425672 - DNA, 20 bp, Artificial Sequence
  chemically synthesized
gtggttaaaaacctaggctc

SEQ ID NO: 425673 - DNA, 20 bp, Artificial Sequence
  chemically synthesized
gcattcaggctccagagcct

SEQ ID NO: 425674 - DNA, 20 bp, Artificial Sequence
  chemically synthesized
ggttaaaaacctaggctctg

SEQ ID NO: 425675 - DNA, 20 bp, Artificial Sequence
  chemically synthesized
ggcattcaggctccagagcc

SEQ ID NO: 425676 - DNA, 20 bp, Artificial Sequence
  chemically synthesized
aaccaggcattcaggctcca

SEQ ID NO: 425677 - DNA, 20 bp, Artificial Sequence
  chemically synthesized
taaaccaggcattcaggctc

SEQ ID NO: 425678 - DNA, 20 bp, Artificial Sequence
  chemically synthesized
ggctctggagcctgaatgcc

SEQ ID NO: 425679 - DNA, 20 bp, Artificial Sequence
  chemically synthesized
gaattctaaaccaggcattc

SEQ ID NO: 425680 - DNA, 20 bp, Artificial Sequence
  chemically synthesized
ggaattctaaaccaggcatt

SEQ ID NO: 425681 - DNA, 20 bp, Artificial Sequence
  chemically synthesized
tggagcctgaatgcctggtt

SEQ ID NO: 425682 - DNA, 20 bp, Artificial Sequence
  chemically synthesized
tggagccggaattctaaacc

SEQ ID NO: 425683 - DNA, 20 bp, Artificial Sequence
  chemically synthesized
atggagccggaattctaaac

SEQ ID NO: 425684 - DNA, 20 bp, Artificial Sequence
  chemically synthesized
gaatgcctggtttagaattc

SEQ ID NO: 425685 - DNA, 20 bp, Artificial Sequence
  chemically synthesized
atgccattataaaatggagc

SEQ ID NO: 425686 - DNA, 20 bp, Artificial Sequence
  chemically synthesized
cacaatgccattataaaatg

SEQ ID NO: 425687 - DNA, 20 bp, Artificial Sequence
  chemically synthesized
gtcacaatgccattataaaa

SEQ ID NO: 425688 - DNA, 20 bp, Artificial Sequence
  chemically synthesized
attccggctccattttataa

SEQ ID NO: 425689 - DNA, 20 bp, Artificial Sequence
  chemically synthesized
atggcattgtgaccctgaac

SEQ ID NO: 425690 - DNA, 20 bp, Artificial Sequence
  chemically synthesized
aagatgcattaacttgttca

SEQ ID NO: 425691 - DNA, 20 bp, Artificial Sequence
  chemically synthesized
caagatgcattaacttgttc

SEQ ID NO: 425692 - DNA, 20 bp, Artificial Sequence
  chemically synthesized
acaagatgcattaacttgtt

SEQ ID NO: 425693 - DNA, 20 bp, Artificial Sequence
  chemically synthesized
gtgaaaattggtgcaataac

SEQ ID NO: 425694 - DNA, 20 bp, Artificial Sequence
  chemically synthesized
cattttaaaaatgtgaaaat

SEQ ID NO: 425695 - DNA, 20 bp, Artificial Sequence
  chemically synthesized
caattttcacatttttaaaa

SEQ ID NO: 425696 - DNA, 20 bp, Artificial Sequence
  chemically synthesized
tttttaaaatggtctaataa

SEQ ID NO: 425697 - DNA, 20 bp, Artificial Sequence
  chemically synthesized
tataatataagtactgttat

SEQ ID NO: 425698 - DNA, 20 bp, Artificial Sequence
  chemically synthesized
tgaaaataattttataatat

SEQ ID NO: 425699 - DNA, 20 bp, Artificial Sequence
  chemically synthesized
ttatattataaaattatttt

SEQ ID NO: 425700 - DNA, 20 bp, Artificial Sequence
  chemically synthesized
tatattataaaattattttc

SEQ ID NO: 425701 - DNA, 20 bp, Artificial Sequence
  chemically synthesized
aaattattttcaggcataaa

SEQ ID NO: 425702 - DNA, 20 bp, Artificial Sequence
  chemically synthesized
atggataatatttaacatat

SEQ ID NO: 425703 - DNA, 20 bp, Artificial Sequence
  chemically synthesized
tggataatatttaacatata

SEQ ID NO: 425704 - DNA, 20 bp, Artificial Sequence
  chemically synthesized
catataaggtaattgaaaca

SEQ ID NO: 425705 - DNA, 20 bp, Artificial Sequence
  chemically synthesized
atataaggtaattgaaacat

SEQ ID NO: 425706 - DNA, 20 bp, Artificial Sequence
  chemically synthesized
ttgaaacatgggtatgtacc

SEQ ID NO: 425707 - DNA, 20 bp, Artificial Sequence
  chemically synthesized
catgggtatgtaccaagtgc

SEQ ID NO: 425708 - DNA, 20 bp, Artificial Sequence
  chemically synthesized
agctaatatttactagcact

SEQ ID NO: 425709 - DNA, 20 bp, Artificial Sequence
  chemically synthesized
taatgatagctaatatttac

SEQ ID NO: 425710 - DNA, 20 bp, Artificial Sequence
  chemically synthesized
taccaagtgctagtaaatat

SEQ ID NO: 425711 - DNA, 20 bp, Artificial Sequence
  chemically synthesized
tattgagaactatataatga

SEQ ID NO: 425712 - DNA, 20 bp, Artificial Sequence
  chemically synthesized
aaatattagctatcattata

SEQ ID NO: 425713 - DNA, 20 bp, Artificial Sequence
  chemically synthesized
tatcattatatagttctcaa

SEQ ID NO: 425714 - DNA, 20 bp, Artificial Sequence
  chemically synthesized
atcattatatagttctcaat

SEQ ID NO: 425715 - DNA, 20 bp, Artificial Sequence
  chemically synthesized
ttggcacagacattcctatt

SEQ ID NO: 425716 - DNA, 20 bp, Artificial Sequence
  chemically synthesized
ataggaatgtctgtgccaaa

SEQ ID NO: 425717 - DNA, 20 bp, Artificial Sequence
  chemically synthesized
ccagtgttacctgtttggca

SEQ ID NO: 425718 - DNA, 20 bp, Artificial Sequence
  chemically synthesized
taggaatgtctgtgccaaac

SEQ ID NO: 425719 - DNA, 20 bp, Artificial Sequence
  chemically synthesized
aataaccagtgttacctgtt

SEQ ID NO: 425720 - DNA, 20 bp, Artificial Sequence
  chemically synthesized
ctgtgccaaacaggtaacac

SEQ ID NO: 425721 - DNA, 20 bp, Artificial Sequence
  chemically synthesized
ttttgctattcaggaataac

SEQ ID NO: 425722 - DNA, 20 bp, Artificial Sequence
  chemically synthesized
taacactggttattcctgaa

SEQ ID NO: 425723 - DNA, 20 bp, Artificial Sequence
  chemically synthesized
tgcctataattttgctattc

SEQ ID NO: 425724 - DNA, 20 bp, Artificial Sequence
  chemically synthesized
ttgcctataattttgctatt

SEQ ID NO: 425725 - DNA, 20 bp, Artificial Sequence
  chemically synthesized
attcctgaatagcaaaatta

SEQ ID NO: 425726 - DNA, 20 bp, Artificial Sequence
  chemically synthesized
ttcctgaatagcaaaattat

SEQ ID NO: 425727 - DNA, 20 bp, Artificial Sequence
  chemically synthesized
gaaaaacacaataaaggtaa

SEQ ID NO: 425728 - DNA, 20 bp, Artificial Sequence
  chemically synthesized
aatacagaaaaacacaataa

SEQ ID NO: 425729 - DNA, 20 bp, Artificial Sequence
  chemically synthesized
gaatacagaaaaacacaata

SEQ ID NO: 425730 - DNA, 20 bp, Artificial Sequence
  chemically synthesized
tcactgccaaaagtagaata

SEQ ID NO: 425731 - DNA, 20 bp, Artificial Sequence
  chemically synthesized
gtttttctgtattctacttt

SEQ ID NO: 425732 - DNA, 20 bp, Artificial Sequence
  chemically synthesized
tttctgtattctacttttgg

SEQ ID NO: 425733 - DNA, 20 bp, Artificial Sequence
  chemically synthesized
tatacactcactgccaaaag

SEQ ID NO: 425734 - DNA, 20 bp, Artificial Sequence
  chemically synthesized
taatatacactcactgccaa

SEQ ID NO: 425735 - DNA, 20 bp, Artificial Sequence
  chemically synthesized
tgtattctacttttggcagt

SEQ ID NO: 425736 - DNA, 20 bp, Artificial Sequence
  chemically synthesized
tattttgtattataaaaaat

SEQ ID NO: 425737 - DNA, 20 bp, Artificial Sequence
  chemically synthesized
attttgtattataaaaaatc

SEQ ID NO: 425738 - DNA, 20 bp, Artificial Sequence
  chemically synthesized
tgtattataaaaaatcaggc

SEQ ID NO: 425739 - DNA, 20 bp, Artificial Sequence
  chemically synthesized
gtattataaaaaatcaggct

SEQ ID NO: 425740 - DNA, 20 bp, Artificial Sequence
  chemically synthesized
ataaaaaatcaggctgggtt

SEQ ID NO: 425741 - DNA, 20 bp, Artificial Sequence
  chemically synthesized
aaaaatcaggctgggtttgg

SEQ ID NO: 425742 - DNA, 20 bp, Artificial Sequence
  chemically synthesized
caggcatgagccaccaaacc

SEQ ID NO: 425743 - DNA, 20 bp, Artificial Sequence
  chemically synthesized
agtgctgggattacaggcat

SEQ ID NO: 425744 - DNA, 20 bp, Artificial Sequence
  chemically synthesized
gtggctcatgcctgtaatcc

SEQ ID NO: 425745 - DNA, 20 bp, Artificial Sequence
  chemically synthesized
ttccaaagtgctgggattac

SEQ ID NO: 425746 - DNA, 20 bp, Artificial Sequence
  chemically synthesized
cttccaaagtgctgggatta

SEQ ID NO: 425747 - DNA, 20 bp, Artificial Sequence
  chemically synthesized
tgcctgtaatcccagcactt

SEQ ID NO: 425748 - DNA, 20 bp, Artificial Sequence
  chemically synthesized
ccttggccttccaaagtgct

SEQ ID NO: 425749 - DNA, 20 bp, Artificial Sequence
  chemically synthesized
gccttggccttccaaagtgc

SEQ ID NO: 425750 - DNA, 20 bp, Artificial Sequence
  chemically synthesized
ctgtaatcccagcactttgg

SEQ ID NO: 425751 - DNA, 20 bp, Artificial Sequence
  chemically synthesized
tgtaatcccagcactttgga

SEQ ID NO: 425752 - DNA, 20 bp, Artificial Sequence
  chemically synthesized
cctctggccttggccttcca

SEQ ID NO: 425753 - DNA, 20 bp, Artificial Sequence
  chemically synthesized
tcccagcactttggaaggcc

SEQ ID NO: 425754 - DNA, 20 bp, Artificial Sequence
  chemically synthesized
cccagcactttggaaggcca

SEQ ID NO: 425755 - DNA, 20 bp, Artificial Sequence
  chemically synthesized
gcactttggaaggccaaggc

SEQ ID NO: 425756 - DNA, 20 bp, Artificial Sequence
  chemically synthesized
actttggaaggccaaggcca

SEQ ID NO: 425757 - DNA, 20 bp, Artificial Sequence
  chemically synthesized
ctttggaaggccaaggccag

SEQ ID NO: 425758 - DNA, 20 bp, Artificial Sequence
  chemically synthesized
ctcaaccacccctctggcct

SEQ ID NO: 425759 - DNA, 20 bp, Artificial Sequence
  chemically synthesized
tttggaaggccaaggccaga

SEQ ID NO: 425760 - DNA, 20 bp, Artificial Sequence
  chemically synthesized
ttggaaggccaaggccagag

SEQ ID NO: 425761 - DNA, 20 bp, Artificial Sequence
  chemically synthesized
gaaggccaaggccagagggg

SEQ ID NO: 425762 - DNA, 20 bp, Artificial Sequence
  chemically synthesized
tctgggctcaaccacccctc

SEQ ID NO: 425763 - DNA, 20 bp, Artificial Sequence
  chemically synthesized
ccaaggccagaggggtggtt

SEQ ID NO: 425764 - DNA, 20 bp, Artificial Sequence
  chemically synthesized
gccagaggggtggttgagcc

SEQ ID NO: 425765 - DNA, 20 bp, Artificial Sequence
  chemically synthesized
agaggggtggttgagcccag

SEQ ID NO: 425766 - DNA, 20 bp, Artificial Sequence
  chemically synthesized
caggctggtcttgaacttct

SEQ ID NO: 425767 - DNA, 20 bp, Artificial Sequence
  chemically synthesized
gtggttgagcccagaagttc

SEQ ID NO: 425768 - DNA, 20 bp, Artificial Sequence
  chemically synthesized
tcaggctggtcttgaacttc

SEQ ID NO: 425769 - DNA, 20 bp, Artificial Sequence
  chemically synthesized
tgagcccagaagttcaagac

SEQ ID NO: 425770 - DNA, 20 bp, Artificial Sequence
  chemically synthesized
cagaagttcaagaccagcct

SEQ ID NO: 425771 - DNA, 20 bp, Artificial Sequence
  chemically synthesized
tctcactacgttgctcaggc

SEQ ID NO: 425772 - DNA, 20 bp, Artificial Sequence
  chemically synthesized
aaggtctcactacgttgctc

SEQ ID NO: 425773 - DNA, 20 bp, Artificial Sequence
  chemically synthesized
caagaccagcctgagcaacg

SEQ ID NO: 425774 - DNA, 20 bp, Artificial Sequence
  chemically synthesized
caaggtctcactacgttgct

SEQ ID NO: 425775 - DNA, 20 bp, Artificial Sequence
  chemically synthesized
accagcctgagcaacgtagt

SEQ ID NO: 425776 - DNA, 20 bp, Artificial Sequence
  chemically synthesized
agaaattatttgtagagaca

SEQ ID NO: 425777 - DNA, 20 bp, Artificial Sequence
  chemically synthesized
aagaaattatttgtagagac

SEQ ID NO: 425778 - DNA, 20 bp, Artificial Sequence
  chemically synthesized
taaaaaagaaattatttgta

SEQ ID NO: 425779 - DNA, 20 bp, Artificial Sequence
  chemically synthesized
tttaaaaaagaaattatttg

SEQ ID NO: 425780 - DNA, 20 bp, Artificial Sequence
  chemically synthesized
cacgcctggctgatttaaaa

SEQ ID NO: 425781 - DNA, 20 bp, Artificial Sequence
  chemically synthesized
aaataatttcttttttaaat

SEQ ID NO: 425782 - DNA, 20 bp, Artificial Sequence
  chemically synthesized
aatttcttttttaaatcagc

SEQ ID NO: 425783 - DNA, 20 bp, Artificial Sequence
  chemically synthesized
atttcttttttaaatcagcc

SEQ ID NO: 425784 - DNA, 20 bp, Artificial Sequence
  chemically synthesized
ttttttaaatcagccaggcg

SEQ ID NO: 425785 - DNA, 20 bp, Artificial Sequence
  chemically synthesized
tttaaatcagccaggcgtgg

SEQ ID NO: 425786 - DNA, 20 bp, Artificial Sequence
  chemically synthesized
caggtgcgtgccaccacgcc

SEQ ID NO: 425787 - DNA, 20 bp, Artificial Sequence
  chemically synthesized
ggcgtggtggcacgcacctg

SEQ ID NO: 425788 - DNA, 20 bp, Artificial Sequence
  chemically synthesized
ggtggcacgcacctgtggtc

SEQ ID NO: 425789 - DNA, 20 bp, Artificial Sequence
  chemically synthesized
gtggcacgcacctgtggtct

SEQ ID NO: 425790 - DNA, 20 bp, Artificial Sequence
  chemically synthesized
gccttgccctcccagaccac

SEQ ID NO: 425791 - DNA, 20 bp, Artificial Sequence
  chemically synthesized
agccttgccctcccagacca

SEQ ID NO: 425792 - DNA, 20 bp, Artificial Sequence
  chemically synthesized
ggcacgcacctgtggtctgg

SEQ ID NO: 425793 - DNA, 20 bp, Artificial Sequence
  chemically synthesized
gcacgcacctgtggtctggg

SEQ ID NO: 425794 - DNA, 20 bp, Artificial Sequence
  chemically synthesized
cacgcacctgtggtctggga

SEQ ID NO: 425795 - DNA, 20 bp, Artificial Sequence
  chemically synthesized
cacctgtggtctgggagggc

SEQ ID NO: 425796 - DNA, 20 bp, Artificial Sequence
  chemically synthesized
tcactgcagccttgccctcc

SEQ ID NO: 425797 - DNA, 20 bp, Artificial Sequence
  chemically synthesized
acctgtggtctgggagggca

SEQ ID NO: 425798 - DNA, 20 bp, Artificial Sequence
  chemically synthesized
ggtctgggagggcaaggctg

SEQ ID NO: 425799 - DNA, 20 bp, Artificial Sequence
  chemically synthesized
tgggagggcaaggctgcagt

SEQ ID NO: 425800 - DNA, 20 bp, Artificial Sequence
  chemically synthesized
ggcttaatcacagctcactg

SEQ ID NO: 425801 - DNA, 20 bp, Artificial Sequence
  chemically synthesized
ggctgcagtgagctgtgatt

SEQ ID NO: 425802 - DNA, 20 bp, Artificial Sequence
  chemically synthesized
gaagtgcattggcttaatca

SEQ ID NO: 425803 - DNA, 20 bp, Artificial Sequence
  chemically synthesized
ccacccaggctgaagtgcat

SEQ ID NO: 425804 - DNA, 20 bp, Artificial Sequence
  chemically synthesized
gtgattaagccaatgcactt

SEQ ID NO: 425805 - DNA, 20 bp, Artificial Sequence
  chemically synthesized
taagccaatgcacttcagcc

SEQ ID NO: 425806 - DNA, 20 bp, Artificial Sequence
  chemically synthesized
aagccaatgcacttcagcct

SEQ ID NO: 425807 - DNA, 20 bp, Artificial Sequence
  chemically synthesized
tcactctgccacccaggctg

SEQ ID NO: 425808 - DNA, 20 bp, Artificial Sequence
  chemically synthesized
ccaatgcacttcagcctggg

SEQ ID NO: 425809 - DNA, 20 bp, Artificial Sequence
  chemically synthesized
atgcacttcagcctgggtgg

SEQ ID NO: 425810 - DNA, 20 bp, Artificial Sequence
  chemically synthesized
ggggtctcactctgccaccc

SEQ ID NO: 425811 - DNA, 20 bp, Artificial Sequence
  chemically synthesized
gcacttcagcctgggtggca

SEQ ID NO: 425812 - DNA, 20 bp, Artificial Sequence
  chemically synthesized
cggggtctcactctgccacc

SEQ ID NO: 425813 - DNA, 20 bp, Artificial Sequence
  chemically synthesized
ttcagcctgggtggcagagt

SEQ ID NO: 425814 - DNA, 20 bp, Artificial Sequence
  chemically synthesized
ttttttttttttttgagacg

SEQ ID NO: 425815 - DNA, 20 bp, Artificial Sequence
  chemically synthesized
tttttttttttttttgagac

SEQ ID NO: 425816 - DNA, 20 bp, Artificial Sequence
  chemically synthesized
ttttttttttttttttgaga

SEQ ID NO: 425817 - DNA, 20 bp, Artificial Sequence
  chemically synthesized
tttttttttttttttttttt

SEQ ID NO: 425818 - DNA, 20 bp, Artificial Sequence
  chemically synthesized
aaaaaaaaaaaaaaccacaa

SEQ ID NO: 425819 - DNA, 20 bp, Artificial Sequence
  chemically synthesized
attttaagaggaatctgttg

SEQ ID NO: 425820 - DNA, 20 bp, Artificial Sequence
  chemically synthesized
aatattttgcatattttaag

SEQ ID NO: 425821 - DNA, 20 bp, Artificial Sequence
  chemically synthesized
aaatattttgcatattttaa

SEQ ID NO: 425822 - DNA, 20 bp, Artificial Sequence
  chemically synthesized
gtaaatattttgcatatttt

SEQ ID NO: 425823 - DNA, 20 bp, Artificial Sequence
  chemically synthesized
catcttaccaatgtaatgtt

SEQ ID NO: 425824 - DNA, 20 bp, Artificial Sequence
  chemically synthesized
atatttactgaacattacat

SEQ ID NO: 425825 - DNA, 20 bp, Artificial Sequence
  chemically synthesized
ttactgaacattacattggt

SEQ ID NO: 425826 - DNA, 20 bp, Artificial Sequence
  chemically synthesized
taagatgcatacattgttaa

SEQ ID NO: 425827 - DNA, 20 bp, Artificial Sequence
  chemically synthesized
cattgttaatggaacaatgc

SEQ ID NO: 425828 - DNA, 20 bp, Artificial Sequence
  chemically synthesized
attgttaatggaacaatgct

SEQ ID NO: 425829 - DNA, 20 bp, Artificial Sequence
  chemically synthesized
atggaacaatgctgggatac

SEQ ID NO: 425830 - DNA, 20 bp, Artificial Sequence
  chemically synthesized
acttcttcgatctagtatcc

SEQ ID NO: 425831 - DNA, 20 bp, Artificial Sequence
  chemically synthesized
aatgctgggatactagatcg

SEQ ID NO: 425832 - DNA, 20 bp, Artificial Sequence
  chemically synthesized
atgacaatacttcttcgatc

SEQ ID NO: 425833 - DNA, 20 bp, Artificial Sequence
  chemically synthesized
gctgggatactagatcgaag

SEQ ID NO: 425834 - DNA, 20 bp, Artificial Sequence
  chemically synthesized
cgaagaagtattgtcatcac

SEQ ID NO: 425835 - DNA, 20 bp, Artificial Sequence
  chemically synthesized
agaagtattgtcatcacgag

SEQ ID NO: 425836 - DNA, 20 bp, Artificial Sequence
  chemically synthesized
gtattgtcatcacgagtagc

SEQ ID NO: 425837 - DNA, 20 bp, Artificial Sequence
  chemically synthesized
aatgtctactattttacagg

SEQ ID NO: 425838 - DNA, 20 bp, Artificial Sequence
  chemically synthesized
gtagcaagctgcctgtaaaa

SEQ ID NO: 425839 - DNA, 20 bp, Artificial Sequence
  chemically synthesized
agcaatgtctactattttac

SEQ ID NO: 425840 - DNA, 20 bp, Artificial Sequence
  chemically synthesized
gagcaatgtctactatttta

SEQ ID NO: 425841 - DNA, 20 bp, Artificial Sequence
  chemically synthesized
gcaagctgcctgtaaaatag

SEQ ID NO: 425842 - DNA, 20 bp, Artificial Sequence
  chemically synthesized
tgaaatacagcatttttaga

SEQ ID NO: 425843 - DNA, 20 bp, Artificial Sequence
  chemically synthesized
aatgaaatacagcattttta

SEQ ID NO: 425844 - DNA, 20 bp, Artificial Sequence
  chemically synthesized
ctaatgaaatacagcatttt

SEQ ID NO: 425845 - DNA, 20 bp, Artificial Sequence
  chemically synthesized
cccatagcactaatgaaata

SEQ ID NO: 425846 - DNA, 20 bp, Artificial Sequence
  chemically synthesized
ctaaaaatgctgtatttcat

SEQ ID NO: 425847 - DNA, 20 bp, Artificial Sequence
  chemically synthesized
gctgtatttcattagtgcta

SEQ ID NO: 425848 - DNA, 20 bp, Artificial Sequence
  chemically synthesized
ctgtatttcattagtgctat

SEQ ID NO: 425849 - DNA, 20 bp, Artificial Sequence
  chemically synthesized
ggacacaaatattcaaccca

SEQ ID NO: 425850 - DNA, 20 bp, Artificial Sequence
  chemically synthesized
ttctacatatgaattttgga

SEQ ID NO: 425851 - DNA, 20 bp, Artificial Sequence
  chemically synthesized
tttctacatatgaattttgg

SEQ ID NO: 425852 - DNA, 20 bp, Artificial Sequence
  chemically synthesized
gtttctacatatgaattttg

SEQ ID NO: 425853 - DNA, 20 bp, Artificial Sequence
  chemically synthesized
atgtttctacatatgaattt

SEQ ID NO: 425854 - DNA, 20 bp, Artificial Sequence
  chemically synthesized
gtccctccaaaattcatatg

SEQ ID NO: 425855 - DNA, 20 bp, Artificial Sequence
  chemically synthesized
ctcttaatactgtggcattg

SEQ ID NO: 425856 - DNA, 20 bp, Artificial Sequence
  chemically synthesized
aaacataatccccaatgcca

SEQ ID NO: 425857 - DNA, 20 bp, Artificial Sequence
  chemically synthesized
cctcttaatactgtggcatt

SEQ ID NO: 425858 - DNA, 20 bp, Artificial Sequence
  chemically synthesized
acctcttaatactgtggcat

SEQ ID NO: 425859 - DNA, 20 bp, Artificial Sequence
  chemically synthesized
atccccaatgccacagtatt

SEQ ID NO: 425860 - DNA, 20 bp, Artificial Sequence
  chemically synthesized
aaccctacctcttaatactg

SEQ ID NO: 425861 - DNA, 20 bp, Artificial Sequence
  chemically synthesized
ccccaatgccacagtattaa

SEQ ID NO: 425862 - DNA, 20 bp, Artificial Sequence
  chemically synthesized
cccaatgccacagtattaag

SEQ ID NO: 425863 - DNA, 20 bp, Artificial Sequence
  chemically synthesized
aatgccacagtattaagagg

SEQ ID NO: 425864 - DNA, 20 bp, Artificial Sequence
  chemically synthesized
atgccacagtattaagaggt

SEQ ID NO: 425865 - DNA, 20 bp, Artificial Sequence
  chemically synthesized
tgccacagtattaagaggta

SEQ ID NO: 425866 - DNA, 20 bp, Artificial Sequence
  chemically synthesized
gtattaagaggtagggtttt

SEQ ID NO: 425867 - DNA, 20 bp, Artificial Sequence
  chemically synthesized
ttaagaggtagggttttaag

SEQ ID NO: 425868 - DNA, 20 bp, Artificial Sequence
  chemically synthesized
taagaggtagggttttaaga

SEQ ID NO: 425869 - DNA, 20 bp, Artificial Sequence
  chemically synthesized
tagggttttaagaaggtgat

SEQ ID NO: 425870 - DNA, 20 bp, Artificial Sequence
  chemically synthesized
agggttttaagaaggtgatt

SEQ ID NO: 425871 - DNA, 20 bp, Artificial Sequence
  chemically synthesized
agaaggtgattaggtcatat

SEQ ID NO: 425872 - DNA, 20 bp, Artificial Sequence
  chemically synthesized
aggtgattaggtcatataag

SEQ ID NO: 425873 - DNA, 20 bp, Artificial Sequence
  chemically synthesized
gtgattaggtcatataagcg

SEQ ID NO: 425874 - DNA, 20 bp, Artificial Sequence
  chemically synthesized
ataagcggagccctcatgaa

SEQ ID NO: 425875 - DNA, 20 bp, Artificial Sequence
  chemically synthesized
ggcactaatcccattcatga

SEQ ID NO: 425876 - DNA, 20 bp, Artificial Sequence
  chemically synthesized
taagcggagccctcatgaat

SEQ ID NO: 425877 - DNA, 20 bp, Artificial Sequence
  chemically synthesized
gggcactaatcccattcatg

SEQ ID NO: 425878 - DNA, 20 bp, Artificial Sequence
  chemically synthesized
agggcactaatcccattcat

SEQ ID NO: 425879 - DNA, 20 bp, Artificial Sequence
  chemically synthesized
ggagccctcatgaatgggat

SEQ ID NO: 425880 - DNA, 20 bp, Artificial Sequence
  chemically synthesized
tgggattagtgcccttataa

SEQ ID NO: 425881 - DNA, 20 bp, Artificial Sequence
  chemically synthesized
tcccttggcctcttttataa

SEQ ID NO: 425882 - DNA, 20 bp, Artificial Sequence
  chemically synthesized
ggattagtgcccttataaaa

SEQ ID NO: 425883 - DNA, 20 bp, Artificial Sequence
  chemically synthesized
ttcccttggcctcttttata

SEQ ID NO: 425884 - DNA, 20 bp, Artificial Sequence
  chemically synthesized
gattagtgcccttataaaag

SEQ ID NO: 425885 - DNA, 20 bp, Artificial Sequence
  chemically synthesized
gttcccttggcctcttttat

SEQ ID NO: 425886 - DNA, 20 bp, Artificial Sequence
  chemically synthesized
gtgcccttataaaagaggcc

SEQ ID NO: 425887 - DNA, 20 bp, Artificial Sequence
  chemically synthesized
tgcccttataaaagaggcca

SEQ ID NO: 425888 - DNA, 20 bp, Artificial Sequence
  chemically synthesized
gcccttataaaagaggccaa

SEQ ID NO: 425889 - DNA, 20 bp, Artificial Sequence
  chemically synthesized
gaagggcaaacaagttccct

SEQ ID NO: 425890 - DNA, 20 bp, Artificial Sequence
  chemically synthesized
cacatactggaagggcaaac

SEQ ID NO: 425891 - DNA, 20 bp, Artificial Sequence
  chemically synthesized
agggaacttgtttgcccttc

SEQ ID NO: 425892 - DNA, 20 bp, Artificial Sequence
  chemically synthesized
tttaccctcacatactggaa

SEQ ID NO: 425893 - DNA, 20 bp, Artificial Sequence
  chemically synthesized
ctttaccctcacatactgga

SEQ ID NO: 425894 - DNA, 20 bp, Artificial Sequence
  chemically synthesized
cctttaccctcacatactgg

SEQ ID NO: 425895 - DNA, 20 bp, Artificial Sequence
  chemically synthesized
tgtttgcccttccagtatgt

SEQ ID NO: 425896 - DNA, 20 bp, Artificial Sequence
  chemically synthesized
gtttgcccttccagtatgtg

SEQ ID NO: 425897 - DNA, 20 bp, Artificial Sequence
  chemically synthesized
cttcctttaccctcacatac

SEQ ID NO: 425898 - DNA, 20 bp, Artificial Sequence
  chemically synthesized
tttgcccttccagtatgtga

SEQ ID NO: 425899 - DNA, 20 bp, Artificial Sequence
  chemically synthesized
ccttccagtatgtgagggta

SEQ ID NO: 425900 - DNA, 20 bp, Artificial Sequence
  chemically synthesized
cttccagtatgtgagggtaa

SEQ ID NO: 425901 - DNA, 20 bp, Artificial Sequence
  chemically synthesized
ccagtatgtgagggtaaagg

SEQ ID NO: 425902 - DNA, 20 bp, Artificial Sequence
  chemically synthesized
gtatgtgagggtaaaggaag

SEQ ID NO: 425903 - DNA, 20 bp, Artificial Sequence
  chemically synthesized
tatgtgagggtaaaggaaga

SEQ ID NO: 425904 - DNA, 20 bp, Artificial Sequence
  chemically synthesized
ggaagaaggcaccatctgtg

SEQ ID NO: 425905 - DNA, 20 bp, Artificial Sequence
  chemically synthesized
ggttctgtctgcttcacaga

SEQ ID NO: 425906 - DNA, 20 bp, Artificial Sequence
  chemically synthesized
agaaggcaccatctgtgaag

SEQ ID NO: 425907 - DNA, 20 bp, Artificial Sequence
  chemically synthesized
tgagggttctgtctgcttca

SEQ ID NO: 425908 - DNA, 20 bp, Artificial Sequence
  chemically synthesized
ggcaccatctgtgaagcaga

SEQ ID NO: 425909 - DNA, 20 bp, Artificial Sequence
  chemically synthesized
gaagcagacagaaccctcac

SEQ ID NO: 425910 - DNA, 20 bp, Artificial Sequence
  chemically synthesized
gcagatttggtgtctggtga

SEQ ID NO: 425911 - DNA, 20 bp, Artificial Sequence
  chemically synthesized
ggcagatttggtgtctggtg

SEQ ID NO: 425912 - DNA, 20 bp, Artificial Sequence
  chemically synthesized
tggcagatttggtgtctggt

SEQ ID NO: 425913 - DNA, 20 bp, Artificial Sequence
  chemically synthesized
atgttggcagatttggtgtc

SEQ ID NO: 425914 - DNA, 20 bp, Artificial Sequence
  chemically synthesized
gatcaaaatgttggcagatt

SEQ ID NO: 425915 - DNA, 20 bp, Artificial Sequence
  chemically synthesized
atccaagatcaaaatgttgg

SEQ ID NO: 425916 - DNA, 20 bp, Artificial Sequence
  chemically synthesized
gaaatccaagatcaaaatgt

SEQ ID NO: 425917 - DNA, 20 bp, Artificial Sequence
  chemically synthesized
atctgccaacattttgatct

SEQ ID NO: 425918 - DNA, 20 bp, Artificial Sequence
  chemically synthesized
ttctgcagcccaggaaatcc

SEQ ID NO: 425919 - DNA, 20 bp, Artificial Sequence
  chemically synthesized
cattttgatcttggatttcc

SEQ ID NO: 425920 - DNA, 20 bp, Artificial Sequence
  chemically synthesized
attttgatcttggatttcct

SEQ ID NO: 425921 - DNA, 20 bp, Artificial Sequence
  chemically synthesized
atcttggatttcctgggctg

SEQ ID NO: 425922 - DNA, 20 bp, Artificial Sequence
  chemically synthesized
cagaactgtttctgcagccc

SEQ ID NO: 425923 - DNA, 20 bp, Artificial Sequence
  chemically synthesized
gcagaactgtttctgcagcc

SEQ ID NO: 425924 - DNA, 20 bp, Artificial Sequence
  chemically synthesized
gatttcctgggctgcagaaa

SEQ ID NO: 425925 - DNA, 20 bp, Artificial Sequence
  chemically synthesized
ttgctgcagaactgtttctg

SEQ ID NO: 425926 - DNA, 20 bp, Artificial Sequence
  chemically synthesized
gggctgcagaaacagttctg

SEQ ID NO: 425927 - DNA, 20 bp, Artificial Sequence
  chemically synthesized
acaacgaagatttattgctg

SEQ ID NO: 425928 - DNA, 20 bp, Artificial Sequence
  chemically synthesized
tgtgtaatttataaacaacg

SEQ ID NO: 425929 - DNA, 20 bp, Artificial Sequence
  chemically synthesized
ttcgttgtttataaattaca

SEQ ID NO: 425930 - DNA, 20 bp, Artificial Sequence
  chemically synthesized
ctgctataataaaaatatca

SEQ ID NO: 425931 - DNA, 20 bp, Artificial Sequence
  chemically synthesized
agtctatgatatttttatta

SEQ ID NO: 425932 - DNA, 20 bp, Artificial Sequence
  chemically synthesized
ctatgatatttttattatag

SEQ ID NO: 425933 - DNA, 20 bp, Artificial Sequence
  chemically synthesized
ctaattgtcttagttcaatt

SEQ ID NO: 425934 - DNA, 20 bp, Artificial Sequence
  chemically synthesized
cctaattgtcttagttcaat

SEQ ID NO: 425935 - DNA, 20 bp, Artificial Sequence
  chemically synthesized
tatagcagcccaattgaact

SEQ ID NO: 425936 - DNA, 20 bp, Artificial Sequence
  chemically synthesized
cccaattgaactaagacaat

SEQ ID NO: 425937 - DNA, 20 bp, Artificial Sequence
  chemically synthesized
cttcttactcctaattgtct

SEQ ID NO: 425938 - DNA, 20 bp, Artificial Sequence
  chemically synthesized
ccaattgaactaagacaatt

SEQ ID NO: 425939 - DNA, 20 bp, Artificial Sequence
  chemically synthesized
aattgaactaagacaattag

SEQ ID NO: 425940 - DNA, 20 bp, Artificial Sequence
  chemically synthesized
gaactaagacaattaggagt

SEQ ID NO: 425941 - DNA, 20 bp, Artificial Sequence
  chemically synthesized
ctaagacaattaggagtaag

SEQ ID NO: 425942 - DNA, 20 bp, Artificial Sequence
  chemically synthesized
aattaggagtaagaagtacg

SEQ ID NO: 425943 - DNA, 20 bp, Artificial Sequence
  chemically synthesized
aacctcatcatatataatga

SEQ ID NO: 425944 - DNA, 20 bp, Artificial Sequence
  chemically synthesized
ttaccatcattatatatgat

SEQ ID NO: 425945 - DNA, 20 bp, Artificial Sequence
  chemically synthesized
taccatcattatatatgatg

SEQ ID NO: 425946 - DNA, 20 bp, Artificial Sequence
  chemically synthesized
tatgatgaggttaaaaatta

SEQ ID NO: 425947 - DNA, 20 bp, Artificial Sequence
  chemically synthesized
tgaggttaaaaattatagaa

SEQ ID NO: 425948 - DNA, 20 bp, Artificial Sequence
  chemically synthesized
ttatagaaaagatatttcta

SEQ ID NO: 425949 - DNA, 20 bp, Artificial Sequence
  chemically synthesized
tagaaaagatatttctacag

SEQ ID NO: 425950 - DNA, 20 bp, Artificial Sequence
  chemically synthesized
accacttaaaaattcttctg

SEQ ID NO: 425951 - DNA, 20 bp, Artificial Sequence
  chemically synthesized
atttctacagaagaattttt

SEQ ID NO: 425952 - DNA, 20 bp, Artificial Sequence
  chemically synthesized
tctacagaagaatttttaag

SEQ ID NO: 425953 - DNA, 20 bp, Artificial Sequence
  chemically synthesized
gaagaatttttaagtggtac

SEQ ID NO: 425954 - DNA, 20 bp, Artificial Sequence
  chemically synthesized
taatacatatataaatatac

SEQ ID NO: 425955 - DNA, 20 bp, Artificial Sequence
  chemically synthesized
catatataaatatacaagtt

SEQ ID NO: 425956 - DNA, 20 bp, Artificial Sequence
  chemically synthesized
agtatatattttatatattc

SEQ ID NO: 425957 - DNA, 20 bp, Artificial Sequence
  chemically synthesized
aattttaatatatatgtata

SEQ ID NO: 425958 - DNA, 20 bp, Artificial Sequence
  chemically synthesized
atcacataaaaatacctctc

SEQ ID NO: 425959 - DNA, 20 bp, Artificial Sequence
  chemically synthesized
tagaaaggatatttctagag

SEQ ID NO: 425960 - DNA, 20 bp, Artificial Sequence
  chemically synthesized
atagaaaggatatttctaga

SEQ ID NO: 425961 - DNA, 20 bp, Artificial Sequence
  chemically synthesized
ttatagaaaggatatttcta

SEQ ID NO: 425962 - DNA, 20 bp, Artificial Sequence
  chemically synthesized
aattatagaaaggatatttc

SEQ ID NO: 425963 - DNA, 20 bp, Artificial Sequence
  chemically synthesized
tgaggttaaaaattatagaa

SEQ ID NO: 425964 - DNA, 20 bp, Artificial Sequence
  chemically synthesized
atgaggttaaaaattataga

SEQ ID NO: 425965 - DNA, 20 bp, Artificial Sequence
  chemically synthesized
aatgatgaggttaaaaatta

SEQ ID NO: 425966 - DNA, 20 bp, Artificial Sequence
  chemically synthesized
acaaattccaataaatgatg

SEQ ID NO: 425967 - DNA, 20 bp, Artificial Sequence
  chemically synthesized
aacaaattccaataaatgat

SEQ ID NO: 425968 - DNA, 20 bp, Artificial Sequence
  chemically synthesized
tttttaacctcatcatttat

SEQ ID NO: 425969 - DNA, 20 bp, Artificial Sequence
  chemically synthesized
tcatttattggaatttgtta

SEQ ID NO: 425970 - DNA, 20 bp, Artificial Sequence
  chemically synthesized
atttattggaatttgttatg

SEQ ID NO: 425971 - DNA, 20 bp, Artificial Sequence
  chemically synthesized
tttattggaatttgttatgg

SEQ ID NO: 425972 - DNA, 20 bp, Artificial Sequence
  chemically synthesized
ttattggaatttgttatgga

SEQ ID NO: 425973 - DNA, 20 bp, Artificial Sequence
  chemically synthesized
attggaatttgttatggagg

SEQ ID NO: 425974 - DNA, 20 bp, Artificial Sequence
  chemically synthesized
tataaactttaagggagcag

SEQ ID NO: 425975 - DNA, 20 bp, Artificial Sequence
  chemically synthesized
ctataaactttaagggagca

SEQ ID NO: 425976 - DNA, 20 bp, Artificial Sequence
  chemically synthesized
tctataaactttaagggagc

SEQ ID NO: 425977 - DNA, 20 bp, Artificial Sequence
  chemically synthesized
ttctataaactttaagggag

SEQ ID NO: 425978 - DNA, 20 bp, Artificial Sequence
  chemically synthesized
gatcgtcccctgctccctta

SEQ ID NO: 425979 - DNA, 20 bp, Artificial Sequence
  chemically synthesized
tatttctataaactttaagg

SEQ ID NO: 425980 - DNA, 20 bp, Artificial Sequence
  chemically synthesized
cctatttctataaactttaa

SEQ ID NO: 425981 - DNA, 20 bp, Artificial Sequence
  chemically synthesized
acctatttctataaacttta

SEQ ID NO: 425982 - DNA, 20 bp, Artificial Sequence
  chemically synthesized
gacctatttctataaacttt

SEQ ID NO: 425983 - DNA, 20 bp, Artificial Sequence
  chemically synthesized
ccctgctcccttaaagttta

SEQ ID NO: 425984 - DNA, 20 bp, Artificial Sequence
  chemically synthesized
tcccttaaagtttatagaaa

SEQ ID NO: 425985 - DNA, 20 bp, Artificial Sequence
  chemically synthesized
cccttaaagtttatagaaat

SEQ ID NO: 425986 - DNA, 20 bp, Artificial Sequence
  chemically synthesized
aataggtcaatgccatcttt

SEQ ID NO: 425987 - DNA, 20 bp, Artificial Sequence
  chemically synthesized
ataggtcaatgccatctttc

SEQ ID NO: 425988 - DNA, 20 bp, Artificial Sequence
  chemically synthesized
taggtcaatgccatctttcg

SEQ ID NO: 425989 - DNA, 20 bp, Artificial Sequence
  chemically synthesized
cttgggagagccccgaaaga

SEQ ID NO: 425990 - DNA, 20 bp, Artificial Sequence
  chemically synthesized
tagtcttgggagagccccga

SEQ ID NO: 425991 - DNA, 20 bp, Artificial Sequence
  chemically synthesized
ccatctttcggggctctccc

SEQ ID NO: 425992 - DNA, 20 bp, Artificial Sequence
  chemically synthesized
ttattgtaatagtcttggga

SEQ ID NO: 425993 - DNA, 20 bp, Artificial Sequence
  chemically synthesized
ttttattgtaatagtcttgg

SEQ ID NO: 425994 - DNA, 20 bp, Artificial Sequence
  chemically synthesized
cgttttattgtaatagtctt

SEQ ID NO: 425995 - DNA, 20 bp, Artificial Sequence
  chemically synthesized
ccgttttattgtaatagtct

SEQ ID NO: 425996 - DNA, 20 bp, Artificial Sequence
  chemically synthesized
tacaccccgttttattgtaa

SEQ ID NO: 425997 - DNA, 20 bp, Artificial Sequence
  chemically synthesized
ccaagactattacaataaaa

SEQ ID NO: 425998 - DNA, 20 bp, Artificial Sequence
  chemically synthesized
caagactattacaataaaac

SEQ ID NO: 425999 - DNA, 20 bp, Artificial Sequence
  chemically synthesized
aagactattacaataaaacg

SEQ ID NO: 426000 - DNA, 20 bp, Artificial Sequence
  chemically synthesized
tattacaataaaacggggtg

SEQ ID NO: 426001 - DNA, 20 bp, Artificial Sequence
  chemically synthesized
acaataaaacggggtgtagc

SEQ ID NO: 426002 - DNA, 20 bp, Artificial Sequence
  chemically synthesized
caagataaataaaacacact

SEQ ID NO: 426003 - DNA, 20 bp, Artificial Sequence
  chemically synthesized
aagataaataaaacacactt

SEQ ID NO: 426004 - DNA, 20 bp, Artificial Sequence
  chemically synthesized
taaataaaacacacttaggc

SEQ ID NO: 426005 - DNA, 20 bp, Artificial Sequence
  chemically synthesized
aaataaaacacacttaggca

SEQ ID NO: 426006 - DNA, 20 bp, Artificial Sequence
  chemically synthesized
aatcctagcacaccttgcct

SEQ ID NO: 426007 - DNA, 20 bp, Artificial Sequence
  chemically synthesized
cacacttaggcaaggtgtgc

SEQ ID NO: 426008 - DNA, 20 bp, Artificial Sequence
  chemically synthesized
acacttaggcaaggtgtgct

SEQ ID NO: 426009 - DNA, 20 bp, Artificial Sequence
  chemically synthesized
gttaaagtggttggaaatcc

SEQ ID NO: 426010 - DNA, 20 bp, Artificial Sequence
  chemically synthesized
tcatgccaagttaaagtggt

SEQ ID NO: 426011 - DNA, 20 bp, Artificial Sequence
  chemically synthesized
gtcctcatgccaagttaaag

SEQ ID NO: 426012 - DNA, 20 bp, Artificial Sequence
  chemically synthesized
gatttccaaccactttaact

SEQ ID NO: 426013 - DNA, 20 bp, Artificial Sequence
  chemically synthesized
atagtcctcatgccaagtta

SEQ ID NO: 426014 - DNA, 20 bp, Artificial Sequence
  chemically synthesized
caaccactttaacttggcat

SEQ ID NO: 426015 - DNA, 20 bp, Artificial Sequence
  chemically synthesized
aaccactttaacttggcatg

SEQ ID NO: 426016 - DNA, 20 bp, Artificial Sequence
  chemically synthesized
agactaatagtcctcatgcc

SEQ ID NO: 426017 - DNA, 20 bp, Artificial Sequence
  chemically synthesized
taacttggcatgaggactat

SEQ ID NO: 426018 - DNA, 20 bp, Artificial Sequence
  chemically synthesized
atctcattctgttagactaa

SEQ ID NO: 426019 - DNA, 20 bp, Artificial Sequence
  chemically synthesized
catgaggactattagtctaa

SEQ ID NO: 426020 - DNA, 20 bp, Artificial Sequence
  chemically synthesized
gactattagtctaacagaat

SEQ ID NO: 426021 - DNA, 20 bp, Artificial Sequence
  chemically synthesized
ttctcagtatctcattctgt

SEQ ID NO: 426022 - DNA, 20 bp, Artificial Sequence
  chemically synthesized
gtctaacagaatgagatact

SEQ ID NO: 426023 - DNA, 20 bp, Artificial Sequence
  chemically synthesized
tgcttctgatgatgtgttct

SEQ ID NO: 426024 - DNA, 20 bp, Artificial Sequence
  chemically synthesized
agatactgagaacacatcat

SEQ ID NO: 426025 - DNA, 20 bp, Artificial Sequence
  chemically synthesized
tactgagaacacatcatcag

SEQ ID NO: 426026 - DNA, 20 bp, Artificial Sequence
  chemically synthesized
acacatcatcagaagcactt

SEQ ID NO: 426027 - DNA, 20 bp, Artificial Sequence
  chemically synthesized
aaaagagaacatttatgctt

SEQ ID NO: 426028 - DNA, 20 bp, Artificial Sequence
  chemically synthesized
gcataaatgttctcttttta

SEQ ID NO: 426029 - DNA, 20 bp, Artificial Sequence
  chemically synthesized
tccccccaccactataaaaa

SEQ ID NO: 426030 - DNA, 20 bp, Artificial Sequence
  chemically synthesized
taaatgttctctttttatag

SEQ ID NO: 426031 - DNA, 20 bp, Artificial Sequence
  chemically synthesized
cctccccccaccactataaa

SEQ ID NO: 426032 - DNA, 20 bp, Artificial Sequence
  chemically synthesized
atgttctctttttatagtgg

SEQ ID NO: 426033 - DNA, 20 bp, Artificial Sequence
  chemically synthesized
tgttctctttttatagtggt

SEQ ID NO: 426034 - DNA, 20 bp, Artificial Sequence
  chemically synthesized
gttctctttttatagtggtg

SEQ ID NO: 426035 - DNA, 20 bp, Artificial Sequence
  chemically synthesized
ttctctttttatagtggtgg

SEQ ID NO: 426036 - DNA, 20 bp, Artificial Sequence
  chemically synthesized
tctctttttatagtggtggg

SEQ ID NO: 426037 - DNA, 20 bp, Artificial Sequence
  chemically synthesized
tctttttatagtggtggggg

SEQ ID NO: 426038 - DNA, 20 bp, Artificial Sequence
  chemically synthesized
ctttttatagtggtgggggg

SEQ ID NO: 426039 - DNA, 20 bp, Artificial Sequence
  chemically synthesized
tagtggtggggggaggataa

SEQ ID NO: 426040 - DNA, 20 bp, Artificial Sequence
  chemically synthesized
agtggtggggggaggataac

SEQ ID NO: 426041 - DNA, 20 bp, Artificial Sequence
  chemically synthesized
tggtggggggaggataacgg

SEQ ID NO: 426042 - DNA, 20 bp, Artificial Sequence
  chemically synthesized
gggaggataacgggagaaat

SEQ ID NO: 426043 - DNA, 20 bp, Artificial Sequence
  chemically synthesized
gggagaaatgagtaaaaatg

SEQ ID NO: 426044 - DNA, 20 bp, Artificial Sequence
  chemically synthesized
aatgagtaaaaatgtggttt

SEQ ID NO: 426045 - DNA, 20 bp, Artificial Sequence
  chemically synthesized
aaaaatgtggtttcagcttc

SEQ ID NO: 426046 - DNA, 20 bp, Artificial Sequence
  chemically synthesized
tccgttcctagtgaaactag

SEQ ID NO: 426047 - DNA, 20 bp, Artificial Sequence
  chemically synthesized
gtttcagcttctagtttcac

SEQ ID NO: 426048 - DNA, 20 bp, Artificial Sequence
  chemically synthesized
ttgtccgttcctagtgaaac

SEQ ID NO: 426049 - DNA, 20 bp, Artificial Sequence
  chemically synthesized
tttcagcttctagtttcact

SEQ ID NO: 426050 - DNA, 20 bp, Artificial Sequence
  chemically synthesized
gcttctagtttcactaggaa

SEQ ID NO: 426051 - DNA, 20 bp, Artificial Sequence
  chemically synthesized
ctttctaatttgtccgttcc

SEQ ID NO: 426052 - DNA, 20 bp, Artificial Sequence
  chemically synthesized
ttcactaggaacggacaaat

SEQ ID NO: 426053 - DNA, 20 bp, Artificial Sequence
  chemically synthesized
ctaggaacggacaaattaga

SEQ ID NO: 426054 - DNA, 20 bp, Artificial Sequence
  chemically synthesized
caaattagaaagtgaaatgt

SEQ ID NO: 426055 - DNA, 20 bp, Artificial Sequence
  chemically synthesized
gaaagtgaaatgtgagacaa

SEQ ID NO: 426056 - DNA, 20 bp, Artificial Sequence
  chemically synthesized
gtgaaatgtgagacaataga

SEQ ID NO: 426057 - DNA, 20 bp, Artificial Sequence
  chemically synthesized
atagaaagtttgatgtaatt

SEQ ID NO: 426058 - DNA, 20 bp, Artificial Sequence
  chemically synthesized
gaaagtttgatgtaattcag

SEQ ID NO: 426059 - DNA, 20 bp, Artificial Sequence
  chemically synthesized
aaaataataattgatggttg

SEQ ID NO: 426060 - DNA, 20 bp, Artificial Sequence
  chemically synthesized
aatgttaaaataataattga

SEQ ID NO: 426061 - DNA, 20 bp, Artificial Sequence
  chemically synthesized
aattattattttaacatttt

SEQ ID NO: 426062 - DNA, 20 bp, Artificial Sequence
  chemically synthesized
ttattttaacatttttggta

SEQ ID NO: 426063 - DNA, 20 bp, Artificial Sequence
  chemically synthesized
gtcctcttggatgtaaaagg

SEQ ID NO: 426064 - DNA, 20 bp, Artificial Sequence
  chemically synthesized
ttggtcctcttggatgtaaa

SEQ ID NO: 426065 - DNA, 20 bp, Artificial Sequence
  chemically synthesized
cttggtcctcttggatgtaa

SEQ ID NO: 426066 - DNA, 20 bp, Artificial Sequence
  chemically synthesized
taaagcttccttttacatcc

SEQ ID NO: 426067 - DNA, 20 bp, Artificial Sequence
  chemically synthesized
aagcttccttttacatccaa

SEQ ID NO: 426068 - DNA, 20 bp, Artificial Sequence
  chemically synthesized
agcttccttttacatccaag

SEQ ID NO: 426069 - DNA, 20 bp, Artificial Sequence
  chemically synthesized
gtgatttcacttggtcctct

SEQ ID NO: 426070 - DNA, 20 bp, Artificial Sequence
  chemically synthesized
cttttacatccaagaggacc

SEQ ID NO: 426071 - DNA, 20 bp, Artificial Sequence
  chemically synthesized
aagaacatggtgatttcact

SEQ ID NO: 426072 - DNA, 20 bp, Artificial Sequence
  chemically synthesized
tatgggtaaatataagaaca

SEQ ID NO: 426073 - DNA, 20 bp, Artificial Sequence
  chemically synthesized
gaaatgctatgggtaaatat

SEQ ID NO: 426074 - DNA, 20 bp, Artificial Sequence
  chemically synthesized
catgttcttatatttaccca

SEQ ID NO: 426075 - DNA, 20 bp, Artificial Sequence
  chemically synthesized
aaataaaaaagaaatgctat

SEQ ID NO: 426076 - DNA, 20 bp, Artificial Sequence
  chemically synthesized
aaaataaaaaagaaatgcta

SEQ ID NO: 426077 - DNA, 20 bp, Artificial Sequence
  chemically synthesized
aggagctcataaaaataaaa

SEQ ID NO: 426078 - DNA, 20 bp, Artificial Sequence
  chemically synthesized
catttcttttttatttttat

SEQ ID NO: 426079 - DNA, 20 bp, Artificial Sequence
  chemically synthesized
tattcattcagcaaaagaag

SEQ ID NO: 426080 - DNA, 20 bp, Artificial Sequence
  chemically synthesized
gttattcattcagcaaaaga

SEQ ID NO: 426081 - DNA, 20 bp, Artificial Sequence
  chemically synthesized
agttattcattcagcaaaag

SEQ ID NO: 426082 - DNA, 20 bp, Artificial Sequence
  chemically synthesized
aatagttattcattcagcaa

SEQ ID NO: 426083 - DNA, 20 bp, Artificial Sequence
  chemically synthesized
tgctgaaatagttattcatt

SEQ ID NO: 426084 - DNA, 20 bp, Artificial Sequence
  chemically synthesized
tgctgaatgaataactattt

SEQ ID NO: 426085 - DNA, 20 bp, Artificial Sequence
  chemically synthesized
aattttttagtgtgctgaaa

SEQ ID NO: 426086 - DNA, 20 bp, Artificial Sequence
  chemically synthesized
acatctaaggcacaattttt

SEQ ID NO: 426087 - DNA, 20 bp, Artificial Sequence
  chemically synthesized
cacactaaaaaattgtgcct

SEQ ID NO: 426088 - DNA, 20 bp, Artificial Sequence
  chemically synthesized
cactgttagaaagacatcta

SEQ ID NO: 426089 - DNA, 20 bp, Artificial Sequence
  chemically synthesized
gcactgttagaaagacatct

SEQ ID NO: 426090 - DNA, 20 bp, Artificial Sequence
  chemically synthesized
tgccttagatgtctttctaa

SEQ ID NO: 426091 - DNA, 20 bp, Artificial Sequence
  chemically synthesized
catatacaggcactgttaga

SEQ ID NO: 426092 - DNA, 20 bp, Artificial Sequence
  chemically synthesized
ttaccatatacaggcactgt

SEQ ID NO: 426093 - DNA, 20 bp, Artificial Sequence
  chemically synthesized
tttctaacagtgcctgtata

SEQ ID NO: 426094 - DNA, 20 bp, Artificial Sequence
  chemically synthesized
attgagcacttaccatatac

SEQ ID NO: 426095 - DNA, 20 bp, Artificial Sequence
  chemically synthesized
tattgagcacttaccatata

SEQ ID NO: 426096 - DNA, 20 bp, Artificial Sequence
  chemically synthesized
taacagtgcctgtatatggt

SEQ ID NO: 426097 - DNA, 20 bp, Artificial Sequence
  chemically synthesized
ttatttatcaagcaattatt

SEQ ID NO: 426098 - DNA, 20 bp, Artificial Sequence
  chemically synthesized
cagaatgcatattatttatc

SEQ ID NO: 426099 - DNA, 20 bp, Artificial Sequence
  chemically synthesized
gataaataatatgcattctg

SEQ ID NO: 426100 - DNA, 20 bp, Artificial Sequence
  chemically synthesized
ataatatgcattctgcagtt

SEQ ID NO: 426101 - DNA, 20 bp, Artificial Sequence
  chemically synthesized
taatatgcattctgcagttg

SEQ ID NO: 426102 - DNA, 20 bp, Artificial Sequence
  chemically synthesized
tttcttttttgcctcaactg

SEQ ID NO: 426103 - DNA, 20 bp, Artificial Sequence
  chemically synthesized
attctgcagttgaggcaaaa

SEQ ID NO: 426104 - DNA, 20 bp, Artificial Sequence
  chemically synthesized
aaaaagaaatgacccttttt

SEQ ID NO: 426105 - DNA, 20 bp, Artificial Sequence
  chemically synthesized
tcttggttcattccaaaaaa

SEQ ID NO: 426106 - DNA, 20 bp, Artificial Sequence
  chemically synthesized
ctcttggttcattccaaaaa

SEQ ID NO: 426107 - DNA, 20 bp, Artificial Sequence
  chemically synthesized
tctcttggttcattccaaaa

SEQ ID NO: 426108 - DNA, 20 bp, Artificial Sequence
  chemically synthesized
acccttttttggaatgaacc

SEQ ID NO: 426109 - DNA, 20 bp, Artificial Sequence
  chemically synthesized
ccttttttggaatgaaccaa

SEQ ID NO: 426110 - DNA, 20 bp, Artificial Sequence
  chemically synthesized
ttttttggaatgaaccaaga

SEQ ID NO: 426111 - DNA, 20 bp, Artificial Sequence
  chemically synthesized
ttggaatgaaccaagagaga

SEQ ID NO: 426112 - DNA, 20 bp, Artificial Sequence
  chemically synthesized
tttttcagttctgtctctct

SEQ ID NO: 426113 - DNA, 20 bp, Artificial Sequence
  chemically synthesized
caagagagacagaactgaaa

SEQ ID NO: 426114 - DNA, 20 bp, Artificial Sequence
  chemically synthesized
agagacagaactgaaaaagt

SEQ ID NO: 426115 - DNA, 20 bp, Artificial Sequence
  chemically synthesized
tcccttcttcctcacttttt

SEQ ID NO: 426116 - DNA, 20 bp, Artificial Sequence
  chemically synthesized
gagacagaactgaaaaagtg

SEQ ID NO: 426117 - DNA, 20 bp, Artificial Sequence
  chemically synthesized
acagaactgaaaaagtgagg

SEQ ID NO: 426118 - DNA, 20 bp, Artificial Sequence
  chemically synthesized
gaactgaaaaagtgaggaag

SEQ ID NO: 426119 - DNA, 20 bp, Artificial Sequence
  chemically synthesized
aactgaaaaagtgaggaaga

SEQ ID NO: 426120 - DNA, 20 bp, Artificial Sequence
  chemically synthesized
actgaaaaagtgaggaagaa

SEQ ID NO: 426121 - DNA, 20 bp, Artificial Sequence
  chemically synthesized
ggaagaagggaaaaataatg

SEQ ID NO: 426122 - DNA, 20 bp, Artificial Sequence
  chemically synthesized
gaagaagggaaaaataatga

SEQ ID NO: 426123 - DNA, 20 bp, Artificial Sequence
  chemically synthesized
agggaaaaataatgaaggaa

SEQ ID NO: 426124 - DNA, 20 bp, Artificial Sequence
  chemically synthesized
gaaaaataatgaaggaacag

SEQ ID NO: 426125 - DNA, 20 bp, Artificial Sequence
  chemically synthesized
gaaggaacagaagatgatgt

SEQ ID NO: 426126 - DNA, 20 bp, Artificial Sequence
  chemically synthesized
gaacagaagatgatgtcaga

SEQ ID NO: 426127 - DNA, 20 bp, Artificial Sequence
  chemically synthesized
aacagaagatgatgtcagat

SEQ ID NO: 426128 - DNA, 20 bp, Artificial Sequence
  chemically synthesized
atatttacttacattgataa

SEQ ID NO: 426129 - DNA, 20 bp, Artificial Sequence
  chemically synthesized
gataggacttttatcaatgt

SEQ ID NO: 426130 - DNA, 20 bp, Artificial Sequence
  chemically synthesized
tatcacattcattaatatat

SEQ ID NO: 426131 - DNA, 20 bp, Artificial Sequence
  chemically synthesized
atatcacattcattaatata

SEQ ID NO: 426132 - DNA, 20 bp, Artificial Sequence
  chemically synthesized
atatgttacattcatattaa

SEQ ID NO: 426133 - DNA, 20 bp, Artificial Sequence
  chemically synthesized
aatctcaactatattcattg

SEQ ID NO: 426134 - DNA, 20 bp, Artificial Sequence
  chemically synthesized
aaacatcaccacaatgaata

SEQ ID NO: 426135 - DNA, 20 bp, Artificial Sequence
  chemically synthesized
tcaccacaatgaatatagtt

SEQ ID NO: 426136 - DNA, 20 bp, Artificial Sequence
  chemically synthesized
ccagtacctatcacatagca

SEQ ID NO: 426137 - DNA, 20 bp, Artificial Sequence
  chemically synthesized
accagtacctatcacatagc

SEQ ID NO: 426138 - DNA, 20 bp, Artificial Sequence
  chemically synthesized
agattttccttgctatgtga

SEQ ID NO: 426139 - DNA, 20 bp, Artificial Sequence
  chemically synthesized
gattttccttgctatgtgat

SEQ ID NO: 426140 - DNA, 20 bp, Artificial Sequence
  chemically synthesized
ttagaccagtacctatcaca

SEQ ID NO: 426141 - DNA, 20 bp, Artificial Sequence
  chemically synthesized
ccttgctatgtgataggtac

SEQ ID NO: 426142 - DNA, 20 bp, Artificial Sequence
  chemically synthesized
tatgtgataggtactggtct

SEQ ID NO: 426143 - DNA, 20 bp, Artificial Sequence
  chemically synthesized
caaataaaaatcacttagac

SEQ ID NO: 426144 - DNA, 20 bp, Artificial Sequence
  chemically synthesized
attaacaaataaaaatcact

SEQ ID NO: 426145 - DNA, 20 bp, Artificial Sequence
  chemically synthesized
atttgttaattttctcatct

SEQ ID NO: 426146 - DNA, 20 bp, Artificial Sequence
  chemically synthesized
cctcataggattgctgagat

SEQ ID NO: 426147 - DNA, 20 bp, Artificial Sequence
  chemically synthesized
acctacctcataggattgct

SEQ ID NO: 426148 - DNA, 20 bp, Artificial Sequence
  chemically synthesized
tctcatctcagcaatcctat

SEQ ID NO: 426149 - DNA, 20 bp, Artificial Sequence
  chemically synthesized
ctcatctcagcaatcctatg

SEQ ID NO: 426150 - DNA, 20 bp, Artificial Sequence
  chemically synthesized
atctcagcaatcctatgagg

SEQ ID NO: 426151 - DNA, 20 bp, Artificial Sequence
  chemically synthesized
tctcagcaatcctatgaggt

SEQ ID NO: 426152 - DNA, 20 bp, Artificial Sequence
  chemically synthesized
aataatagcacctacctcat

SEQ ID NO: 426153 - DNA, 20 bp, Artificial Sequence
  chemically synthesized
taataatagcacctacctca

SEQ ID NO: 426154 - DNA, 20 bp, Artificial Sequence
  chemically synthesized
ctgaaaaatagagttaataa

SEQ ID NO: 426155 - DNA, 20 bp, Artificial Sequence
  chemically synthesized
ctattattaactctattttt

SEQ ID NO: 426156 - DNA, 20 bp, Artificial Sequence
  chemically synthesized
gtttcttcatctgaaaaata

SEQ ID NO: 426157 - DNA, 20 bp, Artificial Sequence
  chemically synthesized
tagtttcttcatctgaaaaa

SEQ ID NO: 426158 - DNA, 20 bp, Artificial Sequence
  chemically synthesized
ttaactctatttttcagatg

SEQ ID NO: 426159 - DNA, 20 bp, Artificial Sequence
  chemically synthesized
atttttcagatgaagaaact

SEQ ID NO: 426160 - DNA, 20 bp, Artificial Sequence
  chemically synthesized
tttttcagatgaagaaacta

SEQ ID NO: 426161 - DNA, 20 bp, Artificial Sequence
  chemically synthesized
gatgaagaaactaaggaaaa

SEQ ID NO: 426162 - DNA, 20 bp, Artificial Sequence
  chemically synthesized
cactgactctcttttttcct

SEQ ID NO: 426163 - DNA, 20 bp, Artificial Sequence
  chemically synthesized
tgaagaaactaaggaaaaaa

SEQ ID NO: 426164 - DNA, 20 bp, Artificial Sequence
  chemically synthesized
aagaaactaaggaaaaaaga

SEQ ID NO: 426165 - DNA, 20 bp, Artificial Sequence
  chemically synthesized
aactaaggaaaaaagagagt

SEQ ID NO: 426166 - DNA, 20 bp, Artificial Sequence
  chemically synthesized
aagagagtcagtgtataaaa

SEQ ID NO: 426167 - DNA, 20 bp, Artificial Sequence
  chemically synthesized
gagtcagtgtataaaaaaga

SEQ ID NO: 426168 - DNA, 20 bp, Artificial Sequence
  chemically synthesized
taaaaaagacagtacaaaaa

SEQ ID NO: 426169 - DNA, 20 bp, Artificial Sequence
  chemically synthesized
gtacaaaaaaagtgtataaa

SEQ ID NO: 426170 - DNA, 20 bp, Artificial Sequence
  chemically synthesized
acaaaaaaagtgtataaaaa

SEQ ID NO: 426171 - DNA, 20 bp, Artificial Sequence
  chemically synthesized
aaaaaaagtgtataaaaaga

SEQ ID NO: 426172 - DNA, 20 bp, Artificial Sequence
  chemically synthesized
tgtataaaaagagagtccta

SEQ ID NO: 426173 - DNA, 20 bp, Artificial Sequence
  chemically synthesized
aaaaagagagtcctacagta

SEQ ID NO: 426174 - DNA, 20 bp, Artificial Sequence
  chemically synthesized
ttctctcagtactgtactgt

SEQ ID NO: 426175 - DNA, 20 bp, Artificial Sequence
  chemically synthesized
tttctctcagtactgtactg

SEQ ID NO: 426176 - DNA, 20 bp, Artificial Sequence
  chemically synthesized
gagtcctacagtacagtact

SEQ ID NO: 426177 - DNA, 20 bp, Artificial Sequence
  chemically synthesized
gtcctacagtacagtactga

SEQ ID NO: 426178 - DNA, 20 bp, Artificial Sequence
  chemically synthesized
ccaactctttcattttctct

SEQ ID NO: 426179 - DNA, 20 bp, Artificial Sequence
  chemically synthesized
acagtactgagagaaaatga

SEQ ID NO: 426180 - DNA, 20 bp, Artificial Sequence
  chemically synthesized
agtactgagagaaaatgaaa

SEQ ID NO: 426181 - DNA, 20 bp, Artificial Sequence
  chemically synthesized
ctgagagaaaatgaaagagt

SEQ ID NO: 426182 - DNA, 20 bp, Artificial Sequence
  chemically synthesized
aaagagttggatttccaacc

SEQ ID NO: 426183 - DNA, 20 bp, Artificial Sequence
  chemically synthesized
agttggatttccaacccaga

SEQ ID NO: 426184 - DNA, 20 bp, Artificial Sequence
  chemically synthesized
caaagccaaactttctgggt

SEQ ID NO: 426185 - DNA, 20 bp, Artificial Sequence
  chemically synthesized
gactcaaagccaaactttct

SEQ ID NO: 426186 - DNA, 20 bp, Artificial Sequence
  chemically synthesized
gatttccaacccagaaagtt

SEQ ID NO: 426187 - DNA, 20 bp, Artificial Sequence
  chemically synthesized
agactcaaagccaaactttc

SEQ ID NO: 426188 - DNA, 20 bp, Artificial Sequence
  chemically synthesized
aacccagaaagtttggcttt

SEQ ID NO: 426189 - DNA, 20 bp, Artificial Sequence
  chemically synthesized
tggttaaaaggacagactca

SEQ ID NO: 426190 - DNA, 20 bp, Artificial Sequence
  chemically synthesized
gaatattttggttaaaagga

SEQ ID NO: 426191 - DNA, 20 bp, Artificial Sequence
  chemically synthesized
ttaagaatattttggttaaa

SEQ ID NO: 426192 - DNA, 20 bp, Artificial Sequence
  chemically synthesized
tttaagaatattttggttaa

SEQ ID NO: 426193 - DNA, 20 bp, Artificial Sequence
  chemically synthesized
acagatgtttaagaatattt

SEQ ID NO: 426194 - DNA, 20 bp, Artificial Sequence
  chemically synthesized
gacaatatagacagatgttt

SEQ ID NO: 426195 - DNA, 20 bp, Artificial Sequence
  chemically synthesized
ataaatggagacaatataga

SEQ ID NO: 426196 - DNA, 20 bp, Artificial Sequence
  chemically synthesized
atatataaatggagacaata

SEQ ID NO: 426197 - DNA, 20 bp, Artificial Sequence
  chemically synthesized
agttaatgtatatataaatg

SEQ ID NO: 426198 - DNA, 20 bp, Artificial Sequence
  chemically synthesized
tcagttaatgtatatataaa

SEQ ID NO: 426199 - DNA, 20 bp, Artificial Sequence
  chemically synthesized
agggacattaaaaaaatatt

SEQ ID NO: 426200 - DNA, 20 bp, Artificial Sequence
  chemically synthesized
atatttttttaatgtccctt

SEQ ID NO: 426201 - DNA, 20 bp, Artificial Sequence
  chemically synthesized
ttttttaatgtcccttgagt

SEQ ID NO: 426202 - DNA, 20 bp, Artificial Sequence
  chemically synthesized
gtattatttctctaactcaa

SEQ ID NO: 426203 - DNA, 20 bp, Artificial Sequence
  chemically synthesized
ttttaatgtcccttgagtta

SEQ ID NO: 426204 - DNA, 20 bp, Artificial Sequence
  chemically synthesized
agtattatttctctaactca

SEQ ID NO: 426205 - DNA, 20 bp, Artificial Sequence
  chemically synthesized
tagtattatttctctaactc

SEQ ID NO: 426206 - DNA, 20 bp, Artificial Sequence
  chemically synthesized
tcttcctgtcgaataggtaa

SEQ ID NO: 426207 - DNA, 20 bp, Artificial Sequence
  chemically synthesized
taatactattacctattcga

SEQ ID NO: 426208 - DNA, 20 bp, Artificial Sequence
  chemically synthesized
aatactattacctattcgac

SEQ ID NO: 426209 - DNA, 20 bp, Artificial Sequence
  chemically synthesized
gatgtttcttcctgtcgaat

SEQ ID NO: 426210 - DNA, 20 bp, Artificial Sequence
  chemically synthesized
tgatgtttcttcctgtcgaa

SEQ ID NO: 426211 - DNA, 20 bp, Artificial Sequence
  chemically synthesized
actattacctattcgacagg

SEQ ID NO: 426212 - DNA, 20 bp, Artificial Sequence
  chemically synthesized
tattcgacaggaagaaacat

SEQ ID NO: 426213 - DNA, 20 bp, Artificial Sequence
  chemically synthesized
cgacaggaagaaacatcaga

SEQ ID NO: 426214 - DNA, 20 bp, Artificial Sequence
  chemically synthesized
aacatcagacagaaatgacg

SEQ ID NO: 426215 - DNA, 20 bp, Artificial Sequence
  chemically synthesized
aatgacgtggcctgatcact

SEQ ID NO: 426216 - DNA, 20 bp, Artificial Sequence
  chemically synthesized
aatataatagctgagtgatc

SEQ ID NO: 426217 - DNA, 20 bp, Artificial Sequence
  chemically synthesized
caatataatagctgagtgat

SEQ ID NO: 426218 - DNA, 20 bp, Artificial Sequence
  chemically synthesized
ttgctgccaatataatagct

SEQ ID NO: 426219 - DNA, 20 bp, Artificial Sequence
  chemically synthesized
tgatcactcagctattatat

SEQ ID NO: 426220 - DNA, 20 bp, Artificial Sequence
  chemically synthesized
aggctttgctgccaatataa

SEQ ID NO: 426221 - DNA, 20 bp, Artificial Sequence
  chemically synthesized
tcactcagctattatattgg

SEQ ID NO: 426222 - DNA, 20 bp, Artificial Sequence
  chemically synthesized
cagctattatattggcagca

SEQ ID NO: 426223 - DNA, 20 bp, Artificial Sequence
  chemically synthesized
ttggcagcaaagcctttctc

SEQ ID NO: 426224 - DNA, 20 bp, Artificial Sequence
  chemically synthesized
aattaagtaatgccagagaa

SEQ ID NO: 426225 - DNA, 20 bp, Artificial Sequence
  chemically synthesized
gaattaagtaatgccagaga

SEQ ID NO: 426226 - DNA, 20 bp, Artificial Sequence
  chemically synthesized
atacgaattaagtaatgcca

SEQ ID NO: 426227 - DNA, 20 bp, Artificial Sequence
  chemically synthesized
gaatacgaattaagtaatgc

SEQ ID NO: 426228 - DNA, 20 bp, Artificial Sequence
  chemically synthesized
ttactgtgagaatacgaatt

SEQ ID NO: 426229 - DNA, 20 bp, Artificial Sequence
  chemically synthesized
ttacttaattcgtattctca

SEQ ID NO: 426230 - DNA, 20 bp, Artificial Sequence
  chemically synthesized
aattcgtattctcacagtaa

SEQ ID NO: 426231 - DNA, 20 bp, Artificial Sequence
  chemically synthesized
taggagaatgctgttactgt

SEQ ID NO: 426232 - DNA, 20 bp, Artificial Sequence
  chemically synthesized
gcactgagaattagggatag

SEQ ID NO: 426233 - DNA, 20 bp, Artificial Sequence
  chemically synthesized
aagcactgagaattagggat

SEQ ID NO: 426234 - DNA, 20 bp, Artificial Sequence
  chemically synthesized
aaagcactgagaattaggga

SEQ ID NO: 426235 - DNA, 20 bp, Artificial Sequence
  chemically synthesized
attctcctatccctaattct

SEQ ID NO: 426236 - DNA, 20 bp, Artificial Sequence
  chemically synthesized
gcctaaagcactgagaatta

SEQ ID NO: 426237 - DNA, 20 bp, Artificial Sequence
  chemically synthesized
agcctaaagcactgagaatt

SEQ ID NO: 426238 - DNA, 20 bp, Artificial Sequence
  chemically synthesized
tagcctaaagcactgagaat

SEQ ID NO: 426239 - DNA, 20 bp, Artificial Sequence
  chemically synthesized
atccctaattctcagtgctt

SEQ ID NO: 426240 - DNA, 20 bp, Artificial Sequence
  chemically synthesized
gggaaatagcctaaagcact

SEQ ID NO: 426241 - DNA, 20 bp, Artificial Sequence
  chemically synthesized
tccctaattctcagtgcttt

SEQ ID NO: 426242 - DNA, 20 bp, Artificial Sequence
  chemically synthesized
tgttcctgggaaatagccta

SEQ ID NO: 426243 - DNA, 20 bp, Artificial Sequence
  chemically synthesized
cagtgctttaggctatttcc

SEQ ID NO: 426244 - DNA, 20 bp, Artificial Sequence
  chemically synthesized
agtgctttaggctatttccc

SEQ ID NO: 426245 - DNA, 20 bp, Artificial Sequence
  chemically synthesized
tatagcatgttcctgggaaa

SEQ ID NO: 426246 - DNA, 20 bp, Artificial Sequence
  chemically synthesized
cagctatatagcatgttcct

SEQ ID NO: 426247 - DNA, 20 bp, Artificial Sequence
  chemically synthesized
ccagctatatagcatgttcc

SEQ ID NO: 426248 - DNA, 20 bp, Artificial Sequence
  chemically synthesized
tttcccaggaacatgctata

SEQ ID NO: 426249 - DNA, 20 bp, Artificial Sequence
  chemically synthesized
ccaggaacatgctatatagc

SEQ ID NO: 426250 - DNA, 20 bp, Artificial Sequence
  chemically synthesized
tatatctctttccagctata

SEQ ID NO: 426251 - DNA, 20 bp, Artificial Sequence
  chemically synthesized
gaacatgctatatagctgga

SEQ ID NO: 426252 - DNA, 20 bp, Artificial Sequence
  chemically synthesized
acatgctatatagctggaaa

SEQ ID NO: 426253 - DNA, 20 bp, Artificial Sequence
  chemically synthesized
attgtacttatatctctttc

SEQ ID NO: 426254 - DNA, 20 bp, Artificial Sequence
  chemically synthesized
atatagctggaaagagatat

SEQ ID NO: 426255 - DNA, 20 bp, Artificial Sequence
  chemically synthesized
gagatataagtacaatttgc

SEQ ID NO: 426256 - DNA, 20 bp, Artificial Sequence
  chemically synthesized
aatatccctattattaatgc

SEQ ID NO: 426257 - DNA, 20 bp, Artificial Sequence
  chemically synthesized
caatttgccagcattaataa

SEQ ID NO: 426258 - DNA, 20 bp, Artificial Sequence
  chemically synthesized
aatttgccagcattaataat

SEQ ID NO: 426259 - DNA, 20 bp, Artificial Sequence
  chemically synthesized
atttgccagcattaataata

SEQ ID NO: 426260 - DNA, 20 bp, Artificial Sequence
  chemically synthesized
aaagaagtagcaaatgcaag

SEQ ID NO: 426261 - DNA, 20 bp, Artificial Sequence
  chemically synthesized
agaaagaagtagcaaatgca

SEQ ID NO: 426262 - DNA, 20 bp, Artificial Sequence
  chemically synthesized
cagaaagaagtagcaaatgc

SEQ ID NO: 426263 - DNA, 20 bp, Artificial Sequence
  chemically synthesized
tagacagatacagaaagaag

SEQ ID NO: 426264 - DNA, 20 bp, Artificial Sequence
  chemically synthesized
aagtagacagatacagaaag

SEQ ID NO: 426265 - DNA, 20 bp, Artificial Sequence
  chemically synthesized
taaaagtagacagatacaga

SEQ ID NO: 426266 - DNA, 20 bp, Artificial Sequence
  chemically synthesized
aaaataaaagtagacagata

SEQ ID NO: 426267 - DNA, 20 bp, Artificial Sequence
  chemically synthesized
agaaaaaaaataaaagtaga

SEQ ID NO: 426268 - DNA, 20 bp, Artificial Sequence
  chemically synthesized
aataagaaaaaaaataaaag

SEQ ID NO: 426269 - DNA, 20 bp, Artificial Sequence
  chemically synthesized
gggaataagaaaaaaaataa

SEQ ID NO: 426270 - DNA, 20 bp, Artificial Sequence
  chemically synthesized
agatagagtgtttagggaat

SEQ ID NO: 426271 - DNA, 20 bp, Artificial Sequence
  chemically synthesized
caatggagatagagtgttta

SEQ ID NO: 426272 - DNA, 20 bp, Artificial Sequence
  chemically synthesized
acaatggagatagagtgttt

SEQ ID NO: 426273 - DNA, 20 bp, Artificial Sequence
  chemically synthesized
cacaatggagatagagtgtt

SEQ ID NO: 426274 - DNA, 20 bp, Artificial Sequence
  chemically synthesized
aaatcagcacaatggagata

SEQ ID NO: 426275 - DNA, 20 bp, Artificial Sequence
  chemically synthesized
aaaaatcagcacaatggaga

SEQ ID NO: 426276 - DNA, 20 bp, Artificial Sequence
  chemically synthesized
ttcaaaaaatcagcacaatg

SEQ ID NO: 426277 - DNA, 20 bp, Artificial Sequence
  chemically synthesized
tcttcaaaaaatcagcacaa

SEQ ID NO: 426278 - DNA, 20 bp, Artificial Sequence
  chemically synthesized
gatgaatatcttcaaaaaat

SEQ ID NO: 426279 - DNA, 20 bp, Artificial Sequence
  chemically synthesized
tccattgtgctgattttttg

SEQ ID NO: 426280 - DNA, 20 bp, Artificial Sequence
  chemically synthesized
aaaagtaaggaaaatcaaga

SEQ ID NO: 426281 - DNA, 20 bp, Artificial Sequence
  chemically synthesized
aataaaaagtaaggaaaatc

SEQ ID NO: 426282 - DNA, 20 bp, Artificial Sequence
  chemically synthesized
caaaaagaaaataaaaagta

SEQ ID NO: 426283 - DNA, 20 bp, Artificial Sequence
  chemically synthesized
gcaaaaagaaaataaaaagt

SEQ ID NO: 426284 - DNA, 20 bp, Artificial Sequence
  chemically synthesized
caaggcaaaaagaaaataaa

SEQ ID NO: 426285 - DNA, 20 bp, Artificial Sequence
  chemically synthesized
tttttattttctttttgcct

SEQ ID NO: 426286 - DNA, 20 bp, Artificial Sequence
  chemically synthesized
aaacactactccaaggcaaa

SEQ ID NO: 426287 - DNA, 20 bp, Artificial Sequence
  chemically synthesized
tttattttctttttgccttg

SEQ ID NO: 426288 - DNA, 20 bp, Artificial Sequence
  chemically synthesized
attttctttttgccttggag

SEQ ID NO: 426289 - DNA, 20 bp, Artificial Sequence
  chemically synthesized
gaaaaggaaacactactcca

SEQ ID NO: 426290 - DNA, 20 bp, Artificial Sequence
  chemically synthesized
agaaaaggaaacactactcc

SEQ ID NO: 426291 - DNA, 20 bp, Artificial Sequence
  chemically synthesized
tattccaggatgaaaagaaa

SEQ ID NO: 426292 - DNA, 20 bp, Artificial Sequence
  chemically synthesized
ctattccaggatgaaaagaa

SEQ ID NO: 426293 - DNA, 20 bp, Artificial Sequence
  chemically synthesized
gtttccttttcttttcatcc

SEQ ID NO: 426294 - DNA, 20 bp, Artificial Sequence
  chemically synthesized
ataatctattccaggatgaa

SEQ ID NO: 426295 - DNA, 20 bp, Artificial Sequence
  chemically synthesized
cttttcttttcatcctggaa

SEQ ID NO: 426296 - DNA, 20 bp, Artificial Sequence
  chemically synthesized
aaatgacaataatctattcc

SEQ ID NO: 426297 - DNA, 20 bp, Artificial Sequence
  chemically synthesized
gaaatgacaataatctattc

SEQ ID NO: 426298 - DNA, 20 bp, Artificial Sequence
  chemically synthesized
gaatagattattgtcatttc

SEQ ID NO: 426299 - DNA, 20 bp, Artificial Sequence
  chemically synthesized
aatagattattgtcatttca

SEQ ID NO: 426300 - DNA, 20 bp, Artificial Sequence
  chemically synthesized
catttcaaggcctcccttgt

SEQ ID NO: 426301 - DNA, 20 bp, Artificial Sequence
  chemically synthesized
gaaaaaagtactcacaaggg

SEQ ID NO: 426302 - DNA, 20 bp, Artificial Sequence
  chemically synthesized
agaaaaaagtactcacaagg

SEQ ID NO: 426303 - DNA, 20 bp, Artificial Sequence
  chemically synthesized
ggagaaaaaagtactcacaa

SEQ ID NO: 426304 - DNA, 20 bp, Artificial Sequence
  chemically synthesized
aggagaaaaaagtactcaca

SEQ ID NO: 426305 - DNA, 20 bp, Artificial Sequence
  chemically synthesized
aaggagaaaaaagtactcac

SEQ ID NO: 426306 - DNA, 20 bp, Artificial Sequence
  chemically synthesized
tggcaataaaaaggagaaaa

SEQ ID NO: 426307 - DNA, 20 bp, Artificial Sequence
  chemically synthesized
tgaagaatggcaataaaaag

SEQ ID NO: 426308 - DNA, 20 bp, Artificial Sequence
  chemically synthesized
gctgaagaatggcaataaaa

SEQ ID NO: 426309 - DNA, 20 bp, Artificial Sequence
  chemically synthesized
tgctgaagaatggcaataaa

SEQ ID NO: 426310 - DNA, 20 bp, Artificial Sequence
  chemically synthesized
tcctttttattgccattctt

SEQ ID NO: 426311 - DNA, 20 bp, Artificial Sequence
  chemically synthesized
ccagtaaaaatgctgaagaa

SEQ ID NO: 426312 - DNA, 20 bp, Artificial Sequence
  chemically synthesized
aagtaccagtaaaaatgctg

SEQ ID NO: 426313 - DNA, 20 bp, Artificial Sequence
  chemically synthesized
ccattcttcagcatttttac

SEQ ID NO: 426314 - DNA, 20 bp, Artificial Sequence
  chemically synthesized
aggagaactgttataagtac

SEQ ID NO: 426315 - DNA, 20 bp, Artificial Sequence
  chemically synthesized
atttttactggtacttataa

SEQ ID NO: 426316 - DNA, 20 bp, Artificial Sequence
  chemically synthesized
aagaaaaggagaactgttat

SEQ ID NO: 426317 - DNA, 20 bp, Artificial Sequence
  chemically synthesized
ccagaagccagcaagaaaag

SEQ ID NO: 426318 - DNA, 20 bp, Artificial Sequence
  chemically synthesized
cgccagaagccagcaagaaa

SEQ ID NO: 426319 - DNA, 20 bp, Artificial Sequence
  chemically synthesized
aacagttctccttttcttgc

SEQ ID NO: 426320 - DNA, 20 bp, Artificial Sequence
  chemically synthesized
acgccagaagccagcaagaa

SEQ ID NO: 426321 - DNA, 20 bp, Artificial Sequence
  chemically synthesized
aacccacgccagaagccagc

SEQ ID NO: 426322 - DNA, 20 bp, Artificial Sequence
  chemically synthesized
ctccttttcttgctggcttc

SEQ ID NO: 426323 - DNA, 20 bp, Artificial Sequence
  chemically synthesized
aacaaacccacgccagaagc

SEQ ID NO: 426324 - DNA, 20 bp, Artificial Sequence
  chemically synthesized
tttcttgctggcttctggcg

SEQ ID NO: 426325 - DNA, 20 bp, Artificial Sequence
  chemically synthesized
ttcttgctggcttctggcgt

SEQ ID NO: 426326 - DNA, 20 bp, Artificial Sequence
  chemically synthesized
tagcaacaaacccacgccag

SEQ ID NO: 426327 - DNA, 20 bp, Artificial Sequence
  chemically synthesized
aaatagcaacaaacccacgc

SEQ ID NO: 426328 - DNA, 20 bp, Artificial Sequence
  chemically synthesized
aaacatcaaagaacaagaaa

SEQ ID NO: 426329 - DNA, 20 bp, Artificial Sequence
  chemically synthesized
tatgcgaaacatcaaagaac

SEQ ID NO: 426330 - DNA, 20 bp, Artificial Sequence
  chemically synthesized
atcagatatgcgaaacatca

SEQ ID NO: 426331 - DNA, 20 bp, Artificial Sequence
  chemically synthesized
ggggtgagaaagggaacaat

SEQ ID NO: 426332 - DNA, 20 bp, Artificial Sequence
  chemically synthesized
cagaaagcaggggtgagaaa

SEQ ID NO: 426333 - DNA, 20 bp, Artificial Sequence
  chemically synthesized
gcagaaagcaggggtgagaa

SEQ ID NO: 426334 - DNA, 20 bp, Artificial Sequence
  chemically synthesized
ggcagaaagcaggggtgaga

SEQ ID NO: 426335 - DNA, 20 bp, Artificial Sequence
  chemically synthesized
acgtggcagaaagcaggggt

SEQ ID NO: 426336 - DNA, 20 bp, Artificial Sequence
  chemically synthesized
gtaaacgtggcagaaagcag

SEQ ID NO: 426337 - DNA, 20 bp, Artificial Sequence
  chemically synthesized
ggtaaacgtggcagaaagca

SEQ ID NO: 426338 - DNA, 20 bp, Artificial Sequence
  chemically synthesized
aggtaaacgtggcagaaagc

SEQ ID NO: 426339 - DNA, 20 bp, Artificial Sequence
  chemically synthesized
gaggtaaacgtggcagaaag

SEQ ID NO: 426340 - DNA, 20 bp, Artificial Sequence
  chemically synthesized
aaagaggtaaacgtggcaga

SEQ ID NO: 426341 - DNA, 20 bp, Artificial Sequence
  chemically synthesized
tagcaaagaggtaaacgtgg

SEQ ID NO: 426342 - DNA, 20 bp, Artificial Sequence
  chemically synthesized
taatagcaaagaggtaaacg

SEQ ID NO: 426343 - DNA, 20 bp, Artificial Sequence
  chemically synthesized
ggaaacaaataatagcaaag

SEQ ID NO: 426344 - DNA, 20 bp, Artificial Sequence
  chemically synthesized
aggaaacaaataatagcaaa

SEQ ID NO: 426345 - DNA, 20 bp, Artificial Sequence
  chemically synthesized
ataggaaacaaataatagca

SEQ ID NO: 426346 - DNA, 20 bp, Artificial Sequence
  chemically synthesized
tcaaaataggaaacaaataa

SEQ ID NO: 426347 - DNA, 20 bp, Artificial Sequence
  chemically synthesized
attatttgtttcctattttg

SEQ ID NO: 426348 - DNA, 20 bp, Artificial Sequence
  chemically synthesized
ttatttgtttcctattttga

SEQ ID NO: 426349 - DNA, 20 bp, Artificial Sequence
  chemically synthesized
tagttgtcaaccttcaaaat

SEQ ID NO: 426350 - DNA, 20 bp, Artificial Sequence
  chemically synthesized
ttagttgtcaaccttcaaaa

SEQ ID NO: 426351 - DNA, 20 bp, Artificial Sequence
  chemically synthesized
tattttgaaggttgacaact

SEQ ID NO: 426352 - DNA, 20 bp, Artificial Sequence
  chemically synthesized
attttgaaggttgacaacta

SEQ ID NO: 426353 - DNA, 20 bp, Artificial Sequence
  chemically synthesized
ttttgaaggttgacaactaa

SEQ ID NO: 426354 - DNA, 20 bp, Artificial Sequence
  chemically synthesized
tttgaaggttgacaactaag

SEQ ID NO: 426355 - DNA, 20 bp, Artificial Sequence
  chemically synthesized
aaggttgacaactaagggga

SEQ ID NO: 426356 - DNA, 20 bp, Artificial Sequence
  chemically synthesized
aaggaatgatactgtcccct

SEQ ID NO: 426357 - DNA, 20 bp, Artificial Sequence
  chemically synthesized
taagctggagaaacacatta

SEQ ID NO: 426358 - DNA, 20 bp, Artificial Sequence
  chemically synthesized
gtaagctggagaaacacatt

SEQ ID NO: 426359 - DNA, 20 bp, Artificial Sequence
  chemically synthesized
cattccttaatgtgtttctc

SEQ ID NO: 426360 - DNA, 20 bp, Artificial Sequence
  chemically synthesized
ctgatttcatgagtaagctg

SEQ ID NO: 426361 - DNA, 20 bp, Artificial Sequence
  chemically synthesized
tgctgatttcatgagtaagc

SEQ ID NO: 426362 - DNA, 20 bp, Artificial Sequence
  chemically synthesized
ctgctgctgatttcatgagt

SEQ ID NO: 426363 - DNA, 20 bp, Artificial Sequence
  chemically synthesized
ctccagcttactcatgaaat

SEQ ID NO: 426364 - DNA, 20 bp, Artificial Sequence
  chemically synthesized
gaggctgctgctgatttcat

SEQ ID NO: 426365 - DNA, 20 bp, Artificial Sequence
  chemically synthesized
cagcttactcatgaaatcag

SEQ ID NO: 426366 - DNA, 20 bp, Artificial Sequence
  chemically synthesized
cttactcatgaaatcagcag

SEQ ID NO: 426367 - DNA, 20 bp, Artificial Sequence
  chemically synthesized
actggttttatgtgtgaagg

SEQ ID NO: 426368 - DNA, 20 bp, Artificial Sequence
  chemically synthesized
gactggttttatgtgtgaag

SEQ ID NO: 426369 - DNA, 20 bp, Artificial Sequence
  chemically synthesized
cggactggttttatgtgtga

SEQ ID NO: 426370 - DNA, 20 bp, Artificial Sequence
  chemically synthesized
ccggactggttttatgtgtg

SEQ ID NO: 426371 - DNA, 20 bp, Artificial Sequence
  chemically synthesized
gcctccttcacacataaaac

SEQ ID NO: 426372 - DNA, 20 bp, Artificial Sequence
  chemically synthesized
cttcacacataaaaccagtc

SEQ ID NO: 426373 - DNA, 20 bp, Artificial Sequence
  chemically synthesized
ttcacacataaaaccagtcc

SEQ ID NO: 426374 - DNA, 20 bp, Artificial Sequence
  chemically synthesized
cacacataaaaccagtccgg

SEQ ID NO: 426375 - DNA, 20 bp, Artificial Sequence
  chemically synthesized
acacataaaaccagtccggg

SEQ ID NO: 426376 - DNA, 20 bp, Artificial Sequence
  chemically synthesized
gtcactttgccctcccggac

SEQ ID NO: 426377 - DNA, 20 bp, Artificial Sequence
  chemically synthesized
cacataaaaccagtccggga

SEQ ID NO: 426378 - DNA, 20 bp, Artificial Sequence
  chemically synthesized
cgtgagtcactttgccctcc

SEQ ID NO: 426379 - DNA, 20 bp, Artificial Sequence
  chemically synthesized
aaaaccagtccgggagggca

SEQ ID NO: 426380 - DNA, 20 bp, Artificial Sequence
  chemically synthesized
agtgctgggattacagacgt

SEQ ID NO: 426381 - DNA, 20 bp, Artificial Sequence
  chemically synthesized
gtgactcacgtctgtaatcc

SEQ ID NO: 426382 - DNA, 20 bp, Artificial Sequence
  chemically synthesized
ctctcggagtgctgggatta

SEQ ID NO: 426383 - DNA, 20 bp, Artificial Sequence
  chemically synthesized
tctcggcctctcggagtgct

SEQ ID NO: 426384 - DNA, 20 bp, Artificial Sequence
  chemically synthesized
gtctgtaatcccagcactcc

SEQ ID NO: 426385 - DNA, 20 bp, Artificial Sequence
  chemically synthesized
atctcggcctctcggagtgc

SEQ ID NO: 426386 - DNA, 20 bp, Artificial Sequence
  chemically synthesized
ctgtaatcccagcactccga

SEQ ID NO: 426387 - DNA, 20 bp, Artificial Sequence
  chemically synthesized
tgtaatcccagcactccgag

SEQ ID NO: 426388 - DNA, 20 bp, Artificial Sequence
  chemically synthesized
ccgcccatctcggcctctcg

SEQ ID NO: 426389 - DNA, 20 bp, Artificial Sequence
  chemically synthesized
tcccagcactccgagaggcc

SEQ ID NO: 426390 - DNA, 20 bp, Artificial Sequence
  chemically synthesized
atccgcccatctcggcctct

SEQ ID NO: 426391 - DNA, 20 bp, Artificial Sequence
  chemically synthesized
agcactccgagaggccgaga

SEQ ID NO: 426392 - DNA, 20 bp, Artificial Sequence
  chemically synthesized
gcactccgagaggccgagat

SEQ ID NO: 426393 - DNA, 20 bp, Artificial Sequence
  chemically synthesized
ctccgagaggccgagatggg

SEQ ID NO: 426394 - DNA, 20 bp, Artificial Sequence
  chemically synthesized
cttaagtgatccgcccatct

SEQ ID NO: 426395 - DNA, 20 bp, Artificial Sequence
  chemically synthesized
ccgagatgggcggatcactt

SEQ ID NO: 426396 - DNA, 20 bp, Artificial Sequence
  chemically synthesized
cgagatgggcggatcactta

SEQ ID NO: 426397 - DNA, 20 bp, Artificial Sequence
  chemically synthesized
atgggcggatcacttaaggc

SEQ ID NO: 426398 - DNA, 20 bp, Artificial Sequence
  chemically synthesized
tgggcggatcacttaaggcc

SEQ ID NO: 426399 - DNA, 20 bp, Artificial Sequence
  chemically synthesized
ggtctcaaactcctggcctt

SEQ ID NO: 426400 - DNA, 20 bp, Artificial Sequence
  chemically synthesized
ggcggatcacttaaggccag

SEQ ID NO: 426401 - DNA, 20 bp, Artificial Sequence
  chemically synthesized
tcacttaaggccaggagttt

SEQ ID NO: 426402 - DNA, 20 bp, Artificial Sequence
  chemically synthesized
ctgctttggtctcaaactcc

SEQ ID NO: 426403 - DNA, 20 bp, Artificial Sequence
  chemically synthesized
aggccaggagtttgagacca

SEQ ID NO: 426404 - DNA, 20 bp, Artificial Sequence
  chemically synthesized
ccaggagtttgagaccaaag

SEQ ID NO: 426405 - DNA, 20 bp, Artificial Sequence
  chemically synthesized
caggagtttgagaccaaagc

SEQ ID NO: 426406 - DNA, 20 bp, Artificial Sequence
  chemically synthesized
tctccttatgttgcctgctt

SEQ ID NO: 426407 - DNA, 20 bp, Artificial Sequence
  chemically synthesized
gagaccaaagcaggcaacat

SEQ ID NO: 426408 - DNA, 20 bp, Artificial Sequence
  chemically synthesized
agaccaaagcaggcaacata

SEQ ID NO: 426409 - DNA, 20 bp, Artificial Sequence
  chemically synthesized
accaaagcaggcaacataag

SEQ ID NO: 426410 - DNA, 20 bp, Artificial Sequence
  chemically synthesized
ggctcatttttgtagaaatg

SEQ ID NO: 426411 - DNA, 20 bp, Artificial Sequence
  chemically synthesized
tggctcatttttgtagaaat

SEQ ID NO: 426412 - DNA, 20 bp, Artificial Sequence
  chemically synthesized
ctggctcatttttgtagaaa

SEQ ID NO: 426413 - DNA, 20 bp, Artificial Sequence
  chemically synthesized
gaccccatttctacaaaaat

SEQ ID NO: 426414 - DNA, 20 bp, Artificial Sequence
  chemically synthesized
ccacatctggctcatttttg

SEQ ID NO: 426415 - DNA, 20 bp, Artificial Sequence
  chemically synthesized
ccatttctacaaaaatgagc

SEQ ID NO: 426416 - DNA, 20 bp, Artificial Sequence
  chemically synthesized
ctacaaaaatgagccagatg

SEQ ID NO: 426417 - DNA, 20 bp, Artificial Sequence
  chemically synthesized
caaaaatgagccagatgtgg

SEQ ID NO: 426418 - DNA, 20 bp, Artificial Sequence
  chemically synthesized
tacagttgcgccaccacatc

SEQ ID NO: 426419 - DNA, 20 bp, Artificial Sequence
  chemically synthesized
cagatgtggtggcgcaactg

SEQ ID NO: 426420 - DNA, 20 bp, Artificial Sequence
  chemically synthesized
tggtggcgcaactgtagtcc

SEQ ID NO: 426421 - DNA, 20 bp, Artificial Sequence
  chemically synthesized
ttccccagtagctaggacta

SEQ ID NO: 426422 - DNA, 20 bp, Artificial Sequence
  chemically synthesized
gcaactgtagtcctagctac

SEQ ID NO: 426423 - DNA, 20 bp, Artificial Sequence
  chemically synthesized
caactgtagtcctagctact

SEQ ID NO: 426424 - DNA, 20 bp, Artificial Sequence
  chemically synthesized
cctcagcttccccagtagct

SEQ ID NO: 426425 - DNA, 20 bp, Artificial Sequence
  chemically synthesized
aactgtagtcctagctactg

SEQ ID NO: 426426 - DNA, 20 bp, Artificial Sequence
  chemically synthesized
acctcagcttccccagtagc

SEQ ID NO: 426427 - DNA, 20 bp, Artificial Sequence
  chemically synthesized
tgtagtcctagctactgggg

SEQ ID NO: 426428 - DNA, 20 bp, Artificial Sequence
  chemically synthesized
tcccacctcagcttccccag

SEQ ID NO: 426429 - DNA, 20 bp, Artificial Sequence
  chemically synthesized
tcctcccacctcagcttccc

SEQ ID NO: 426430 - DNA, 20 bp, Artificial Sequence
  chemically synthesized
tcctagctactggggaagct

SEQ ID NO: 426431 - DNA, 20 bp, Artificial Sequence
  chemically synthesized
cctagctactggggaagctg

SEQ ID NO: 426432 - DNA, 20 bp, Artificial Sequence
  chemically synthesized
agctactggggaagctgagg

SEQ ID NO: 426433 - DNA, 20 bp, Artificial Sequence
  chemically synthesized
gctactggggaagctgaggt

SEQ ID NO: 426434 - DNA, 20 bp, Artificial Sequence
  chemically synthesized
tactggggaagctgaggtgg

SEQ ID NO: 426435 - DNA, 20 bp, Artificial Sequence
  chemically synthesized
actggggaagctgaggtggg

SEQ ID NO: 426436 - DNA, 20 bp, Artificial Sequence
  chemically synthesized
ttccggcgatcctcccacct

SEQ ID NO: 426437 - DNA, 20 bp, Artificial Sequence
  chemically synthesized
agctgaggtgggaggatcgc

SEQ ID NO: 426438 - DNA, 20 bp, Artificial Sequence
  chemically synthesized
gtgggaggatcgccggaata

SEQ ID NO: 426439 - DNA, 20 bp, Artificial Sequence
  chemically synthesized
tgggaggatcgccggaatac

SEQ ID NO: 426440 - DNA, 20 bp, Artificial Sequence
  chemically synthesized
agcctggaactcctgtattc

SEQ ID NO: 426441 - DNA, 20 bp, Artificial Sequence
  chemically synthesized
ggaggatcgccggaatacag

SEQ ID NO: 426442 - DNA, 20 bp, Artificial Sequence
  chemically synthesized
tcgccggaatacaggagttc

SEQ ID NO: 426443 - DNA, 20 bp, Artificial Sequence
  chemically synthesized
cgccggaatacaggagttcc

SEQ ID NO: 426444 - DNA, 20 bp, Artificial Sequence
  chemically synthesized
aatacaggagttccaggctg

SEQ ID NO: 426445 - DNA, 20 bp, Artificial Sequence
  chemically synthesized
catcgtaactcactgcagcc

SEQ ID NO: 426446 - DNA, 20 bp, Artificial Sequence
  chemically synthesized
caggagttccaggctgcagt

SEQ ID NO: 426447 - DNA, 20 bp, Artificial Sequence
  chemically synthesized
ggcaccatcgtaactcactg

SEQ ID NO: 426448 - DNA, 20 bp, Artificial Sequence
  chemically synthesized
caggctgcagtgagttacga

SEQ ID NO: 426449 - DNA, 20 bp, Artificial Sequence
  chemically synthesized
gagttacgatggtgccactg

SEQ ID NO: 426450 - DNA, 20 bp, Artificial Sequence
  chemically synthesized
ctctgtctcccaggcttcag

SEQ ID NO: 426451 - DNA, 20 bp, Artificial Sequence
  chemically synthesized
acgatggtgccactgaagcc

SEQ ID NO: 426452 - DNA, 20 bp, Artificial Sequence
  chemically synthesized
cgatggtgccactgaagcct

SEQ ID NO: 426453 - DNA, 20 bp, Artificial Sequence
  chemically synthesized
tcgctctgtctcccaggctt

SEQ ID NO: 426454 - DNA, 20 bp, Artificial Sequence
  chemically synthesized
atggtgccactgaagcctgg

SEQ ID NO: 426455 - DNA, 20 bp, Artificial Sequence
  chemically synthesized
tgccactgaagcctgggaga

SEQ ID NO: 426456 - DNA, 20 bp, Artificial Sequence
  chemically synthesized
ggggtctcgctctgtctccc

SEQ ID NO: 426457 - DNA, 20 bp, Artificial Sequence
  chemically synthesized
ccactgaagcctgggagaca

SEQ ID NO: 426458 - DNA, 20 bp, Artificial Sequence
  chemically synthesized
aggggtctcgctctgtctcc

SEQ ID NO: 426459 - DNA, 20 bp, Artificial Sequence
  chemically synthesized
tgaagcctgggagacagagc

SEQ ID NO: 426460 - DNA, 20 bp, Artificial Sequence
  chemically synthesized
acagagcgagacccctgata

SEQ ID NO: 426461 - DNA, 20 bp, Artificial Sequence
  chemically synthesized
aaatattcaaactatatcag

SEQ ID NO: 426462 - DNA, 20 bp, Artificial Sequence
  chemically synthesized
caaatattcaaactatatca

SEQ ID NO: 426463 - DNA, 20 bp, Artificial Sequence
  chemically synthesized
acaaatattcaaactatatc

SEQ ID NO: 426464 - DNA, 20 bp, Artificial Sequence
  chemically synthesized
gacaaatattcaaactatat

SEQ ID NO: 426465 - DNA, 20 bp, Artificial Sequence
  chemically synthesized
ttcaatatgagattatggca

SEQ ID NO: 426466 - DNA, 20 bp, Artificial Sequence
  chemically synthesized
tttcaatatgagattatggc

SEQ ID NO: 426467 - DNA, 20 bp, Artificial Sequence
  chemically synthesized
atttcaatatgagattatgg

SEQ ID NO: 426468 - DNA, 20 bp, Artificial Sequence
  chemically synthesized
tacatttcaatatgagatta

SEQ ID NO: 426469 - DNA, 20 bp, Artificial Sequence
  chemically synthesized
tggggattacatttcaatat

SEQ ID NO: 426470 - DNA, 20 bp, Artificial Sequence
  chemically synthesized
aaacaaacaaacaaacattg

SEQ ID NO: 426471 - DNA, 20 bp, Artificial Sequence
  chemically synthesized
aaaacaaacaaacaaacatt

SEQ ID NO: 426472 - DNA, 20 bp, Artificial Sequence
  chemically synthesized
aaaaacaaacaaacaaacat

SEQ ID NO: 426473 - DNA, 20 bp, Artificial Sequence
  chemically synthesized
atgtttgtttgtttgttttt

SEQ ID NO: 426474 - DNA, 20 bp, Artificial Sequence
  chemically synthesized
ttgtttgtttgtttttgaga

SEQ ID NO: 426475 - DNA, 20 bp, Artificial Sequence
  chemically synthesized
cactccagcctgggtgacaa

SEQ ID NO: 426476 - DNA, 20 bp, Artificial Sequence
  chemically synthesized
ggaatttcactcttgtcacc

SEQ ID NO: 426477 - DNA, 20 bp, Artificial Sequence
  chemically synthesized
gaatttcactcttgtcaccc

SEQ ID NO: 426478 - DNA, 20 bp, Artificial Sequence
  chemically synthesized
tgcactccagcctgggtgac

SEQ ID NO: 426479 - DNA, 20 bp, Artificial Sequence
  chemically synthesized
ttcactcttgtcacccaggc

SEQ ID NO: 426480 - DNA, 20 bp, Artificial Sequence
  chemically synthesized
cactcttgtcacccaggctg

SEQ ID NO: 426481 - DNA, 20 bp, Artificial Sequence
  chemically synthesized
gttccactgcactccagcct

SEQ ID NO: 426482 - DNA, 20 bp, Artificial Sequence
  chemically synthesized
cgttccactgcactccagcc

SEQ ID NO: 426483 - DNA, 20 bp, Artificial Sequence
  chemically synthesized
ttgtcacccaggctggagtg

SEQ ID NO: 426484 - DNA, 20 bp, Artificial Sequence
  chemically synthesized
gagatcgttccactgcactc

SEQ ID NO: 426485 - DNA, 20 bp, Artificial Sequence
  chemically synthesized
tcacccaggctggagtgcag

SEQ ID NO: 426486 - DNA, 20 bp, Artificial Sequence
  chemically synthesized
ggagtgcagtggaacgatct

SEQ ID NO: 426487 - DNA, 20 bp, Artificial Sequence
  chemically synthesized
gacagacgttgcagtgagct

SEQ ID NO: 426488 - DNA, 20 bp, Artificial Sequence
  chemically synthesized
tgggagacagacgttgcagt

SEQ ID NO: 426489 - DNA, 20 bp, Artificial Sequence
  chemically synthesized
tacttgggagacagacgttg

SEQ ID NO: 426490 - DNA, 20 bp, Artificial Sequence
  chemically synthesized
cactgcaacgtctgtctccc

SEQ ID NO: 426491 - DNA, 20 bp, Artificial Sequence
  chemically synthesized
aatctcagctacttgggaga

SEQ ID NO: 426492 - DNA, 20 bp, Artificial Sequence
  chemically synthesized
tgcaacgtctgtctcccaag

SEQ ID NO: 426493 - DNA, 20 bp, Artificial Sequence
  chemically synthesized
ctgtaatctcagctacttgg

SEQ ID NO: 426494 - DNA, 20 bp, Artificial Sequence
  chemically synthesized
gcctgtaatctcagctactt

SEQ ID NO: 426495 - DNA, 20 bp, Artificial Sequence
  chemically synthesized
cgtctgtctcccaagtagct

SEQ ID NO: 426496 - DNA, 20 bp, Artificial Sequence
  chemically synthesized
tgcctgtaatctcagctact

SEQ ID NO: 426497 - DNA, 20 bp, Artificial Sequence
  chemically synthesized
ctcccaagtagctgagatta

SEQ ID NO: 426498 - DNA, 20 bp, Artificial Sequence
  chemically synthesized
tcccaagtagctgagattac

SEQ ID NO: 426499 - DNA, 20 bp, Artificial Sequence
  chemically synthesized
atggcaggtgcctgtaatct

SEQ ID NO: 426500 - DNA, 20 bp, Artificial Sequence
  chemically synthesized
acttaaccgggcgtgatggc

SEQ ID NO: 426501 - DNA, 20 bp, Artificial Sequence
  chemically synthesized
aacttaaccgggcgtgatgg

SEQ ID NO: 426502 - DNA, 20 bp, Artificial Sequence
  chemically synthesized
caggcacctgccatcacgcc

SEQ ID NO: 426503 - DNA, 20 bp, Artificial Sequence
  chemically synthesized
aataacttaaccgggcgtga

SEQ ID NO: 426504 - DNA, 20 bp, Artificial Sequence
  chemically synthesized
acctgccatcacgcccggtt

SEQ ID NO: 426505 - DNA, 20 bp, Artificial Sequence
  chemically synthesized
acactgggaataacttaacc

SEQ ID NO: 426506 - DNA, 20 bp, Artificial Sequence
  chemically synthesized
aacactgggaataacttaac

SEQ ID NO: 426507 - DNA, 20 bp, Artificial Sequence
  chemically synthesized
acgcccggttaagttattcc

SEQ ID NO: 426508 - DNA, 20 bp, Artificial Sequence
  chemically synthesized
ttaagttattcccagtgttg

SEQ ID NO: 426509 - DNA, 20 bp, Artificial Sequence
  chemically synthesized
caggccccaccttcaacact

SEQ ID NO: 426510 - DNA, 20 bp, Artificial Sequence
  chemically synthesized
taagttattcccagtgttga

SEQ ID NO: 426511 - DNA, 20 bp, Artificial Sequence
  chemically synthesized
ccaggccccaccttcaacac

SEQ ID NO: 426512 - DNA, 20 bp, Artificial Sequence
  chemically synthesized
gttattcccagtgttgaagg

SEQ ID NO: 426513 - DNA, 20 bp, Artificial Sequence
  chemically synthesized
ttattcccagtgttgaaggt

SEQ ID NO: 426514 - DNA, 20 bp, Artificial Sequence
  chemically synthesized
tattcccagtgttgaaggtg

SEQ ID NO: 426515 - DNA, 20 bp, Artificial Sequence
  chemically synthesized
ccagtgttgaaggtggggcc

SEQ ID NO: 426516 - DNA, 20 bp, Artificial Sequence
  chemically synthesized
gtgttgaaggtggggcctgg

SEQ ID NO: 426517 - DNA, 20 bp, Artificial Sequence
  chemically synthesized
tgttgaaggtggggcctggt

SEQ ID NO: 426518 - DNA, 20 bp, Artificial Sequence
  chemically synthesized
ttgaaggtggggcctggtgg

SEQ ID NO: 426519 - DNA, 20 bp, Artificial Sequence
  chemically synthesized
tgaaggtggggcctggtggg

SEQ ID NO: 426520 - DNA, 20 bp, Artificial Sequence
  chemically synthesized
tgctccgatcacctcccacc

SEQ ID NO: 426521 - DNA, 20 bp, Artificial Sequence
  chemically synthesized
atgctccgatcacctcccac

SEQ ID NO: 426522 - DNA, 20 bp, Artificial Sequence
  chemically synthesized
ggggcctggtgggaggtgat

SEQ ID NO: 426523 - DNA, 20 bp, Artificial Sequence
  chemically synthesized
ggcctggtgggaggtgatcg

SEQ ID NO: 426524 - DNA, 20 bp, Artificial Sequence
  chemically synthesized
tgggaggtgatcggagcatg

SEQ ID NO: 426525 - DNA, 20 bp, Artificial Sequence
  chemically synthesized
gggaggtgatcggagcatgc

SEQ ID NO: 426526 - DNA, 20 bp, Artificial Sequence
  chemically synthesized
aggtgatcggagcatgcggg

SEQ ID NO: 426527 - DNA, 20 bp, Artificial Sequence
  chemically synthesized
catgcgggtggatttctcac

SEQ ID NO: 426528 - DNA, 20 bp, Artificial Sequence
  chemically synthesized
gcgggtggatttctcacgag

SEQ ID NO: 426529 - DNA, 20 bp, Artificial Sequence
  chemically synthesized
gatgatgataaaccactcgt

SEQ ID NO: 426530 - DNA, 20 bp, Artificial Sequence
  chemically synthesized
gtggtttatcatcatcccat

SEQ ID NO: 426531 - DNA, 20 bp, Artificial Sequence
  chemically synthesized
catctgaagacagcaccaat

SEQ ID NO: 426532 - DNA, 20 bp, Artificial Sequence
  chemically synthesized
ccatctgaagacagcaccaa

SEQ ID NO: 426533 - DNA, 20 bp, Artificial Sequence
  chemically synthesized
catcccattggtgctgtctt

SEQ ID NO: 426534 - DNA, 20 bp, Artificial Sequence
  chemically synthesized
atacactcaccatctgaaga

SEQ ID NO: 426535 - DNA, 20 bp, Artificial Sequence
  chemically synthesized
ccattggtgctgtcttcaga

SEQ ID NO: 426536 - DNA, 20 bp, Artificial Sequence
  chemically synthesized
gagaatacactcaccatctg

SEQ ID NO: 426537 - DNA, 20 bp, Artificial Sequence
  chemically synthesized
tggtgctgtcttcagatggt

SEQ ID NO: 426538 - DNA, 20 bp, Artificial Sequence
  chemically synthesized
gatggtgagtgtattctcat

SEQ ID NO: 426539 - DNA, 20 bp, Artificial Sequence
  chemically synthesized
tttaagcaaccgtatctcat

SEQ ID NO: 426540 - DNA, 20 bp, Artificial Sequence
  chemically synthesized
gagtgtattctcatgagata

SEQ ID NO: 426541 - DNA, 20 bp, Artificial Sequence
  chemically synthesized
catgagatacggttgcttaa

SEQ ID NO: 426542 - DNA, 20 bp, Artificial Sequence
  chemically synthesized
gggaggtgtcaaacactttt

SEQ ID NO: 426543 - DNA, 20 bp, Artificial Sequence
  chemically synthesized
aacatgagagagagagtggg

SEQ ID NO: 426544 - DNA, 20 bp, Artificial Sequence
  chemically synthesized
gaacatgagagagagagtgg

SEQ ID NO: 426545 - DNA, 20 bp, Artificial Sequence
  chemically synthesized
aggaacatgagagagagagt

SEQ ID NO: 426546 - DNA, 20 bp, Artificial Sequence
  chemically synthesized
caggaacatgagagagagag

SEQ ID NO: 426547 - DNA, 20 bp, Artificial Sequence
  chemically synthesized
gggcaggaacatgagagaga

SEQ ID NO: 426548 - DNA, 20 bp, Artificial Sequence
  chemically synthesized
cagggcaggaacatgagaga

SEQ ID NO: 426549 - DNA, 20 bp, Artificial Sequence
  chemically synthesized
gccagggcaggaacatgaga

SEQ ID NO: 426550 - DNA, 20 bp, Artificial Sequence
  chemically synthesized
tggccagggcaggaacatga

SEQ ID NO: 426551 - DNA, 20 bp, Artificial Sequence
  chemically synthesized
tgtggccagggcaggaacat

SEQ ID NO: 426552 - DNA, 20 bp, Artificial Sequence
  chemically synthesized
tctctctcatgttcctgccc

SEQ ID NO: 426553 - DNA, 20 bp, Artificial Sequence
  chemically synthesized
gcatgtcatgtggccagggc

SEQ ID NO: 426554 - DNA, 20 bp, Artificial Sequence
  chemically synthesized
agcatgtcatgtggccaggg

SEQ ID NO: 426555 - DNA, 20 bp, Artificial Sequence
  chemically synthesized
gcaagcatgtcatgtggcca

SEQ ID NO: 426556 - DNA, 20 bp, Artificial Sequence
  chemically synthesized
agcaagcatgtcatgtggcc

SEQ ID NO: 426557 - DNA, 20 bp, Artificial Sequence
  chemically synthesized
gagcaagcatgtcatgtggc

SEQ ID NO: 426558 - DNA, 20 bp, Artificial Sequence
  chemically synthesized
gggggagcaagcatgtcatg

SEQ ID NO: 426559 - DNA, 20 bp, Artificial Sequence
  chemically synthesized
ggtggaaatgaagggggagc

SEQ ID NO: 426560 - DNA, 20 bp, Artificial Sequence
  chemically synthesized
tcatggtggaaatgaagggg

SEQ ID NO: 426561 - DNA, 20 bp, Artificial Sequence
  chemically synthesized
aatcatggtggaaatgaagg

SEQ ID NO: 426562 - DNA, 20 bp, Artificial Sequence
  chemically synthesized
aaatcatggtggaaatgaag

SEQ ID NO: 426563 - DNA, 20 bp, Artificial Sequence
  chemically synthesized
aaaatcatggtggaaatgaa

SEQ ID NO: 426564 - DNA, 20 bp, Artificial Sequence
  chemically synthesized
caaaatcatggtggaaatga

SEQ ID NO: 426565 - DNA, 20 bp, Artificial Sequence
  chemically synthesized
tcaaaatcatggtggaaatg

SEQ ID NO: 426566 - DNA, 20 bp, Artificial Sequence
  chemically synthesized
caggaagctcaaaatcatgg

SEQ ID NO: 426567 - DNA, 20 bp, Artificial Sequence
  chemically synthesized
ttcatttccaccatgatttt

SEQ ID NO: 426568 - DNA, 20 bp, Artificial Sequence
  chemically synthesized
cctcaggaagctcaaaatca

SEQ ID NO: 426569 - DNA, 20 bp, Artificial Sequence
  chemically synthesized
accatgattttgagcttcct

SEQ ID NO: 426570 - DNA, 20 bp, Artificial Sequence
  chemically synthesized
ccatgattttgagcttcctg

SEQ ID NO: 426571 - DNA, 20 bp, Artificial Sequence
  chemically synthesized
gcttctgggaaagcctcagg

SEQ ID NO: 426572 - DNA, 20 bp, Artificial Sequence
  chemically synthesized
tcggcttctgggaaagcctc

SEQ ID NO: 426573 - DNA, 20 bp, Artificial Sequence
  chemically synthesized
ctcggcttctgggaaagcct

SEQ ID NO: 426574 - DNA, 20 bp, Artificial Sequence
  chemically synthesized
tgagcttcctgaggctttcc

SEQ ID NO: 426575 - DNA, 20 bp, Artificial Sequence
  chemically synthesized
gcttcctgaggctttcccag

SEQ ID NO: 426576 - DNA, 20 bp, Artificial Sequence
  chemically synthesized
catcttctcggcttctggga

SEQ ID NO: 426577 - DNA, 20 bp, Artificial Sequence
  chemically synthesized
ctgaggctttcccagaagcc

SEQ ID NO: 426578 - DNA, 20 bp, Artificial Sequence
  chemically synthesized
ctggcatcttctcggcttct

SEQ ID NO: 426579 - DNA, 20 bp, Artificial Sequence
  chemically synthesized
gctggcatcttctcggcttc

SEQ ID NO: 426580 - DNA, 20 bp, Artificial Sequence
  chemically synthesized
aggctttcccagaagccgag

SEQ ID NO: 426581 - DNA, 20 bp, Artificial Sequence
  chemically synthesized
gcataatgctggcatcttct

SEQ ID NO: 426582 - DNA, 20 bp, Artificial Sequence
  chemically synthesized
cccagaagccgagaagatgc

SEQ ID NO: 426583 - DNA, 20 bp, Artificial Sequence
  chemically synthesized
ctgtacaggaagcataatgc

SEQ ID NO: 426584 - DNA, 20 bp, Artificial Sequence
  chemically synthesized
ccagcattatgcttcctgta

SEQ ID NO: 426585 - DNA, 20 bp, Artificial Sequence
  chemically synthesized
agttccataggctgtacagg

SEQ ID NO: 426586 - DNA, 20 bp, Artificial Sequence
  chemically synthesized
caaagttccataggctgtac

SEQ ID NO: 426587 - DNA, 20 bp, Artificial Sequence
  chemically synthesized
tcaaagttccataggctgta

SEQ ID NO: 426588 - DNA, 20 bp, Artificial Sequence
  chemically synthesized
tatgcttcctgtacagccta

SEQ ID NO: 426589 - DNA, 20 bp, Artificial Sequence
  chemically synthesized
taattggctcaaagttccat

SEQ ID NO: 426590 - DNA, 20 bp, Artificial Sequence
  chemically synthesized
gtaattggctcaaagttcca

SEQ ID NO: 426591 - DNA, 20 bp, Artificial Sequence
  chemically synthesized
tgtacagcctatggaacttt

SEQ ID NO: 426592 - DNA, 20 bp, Artificial Sequence
  chemically synthesized
agaaaagagtaattggctca

SEQ ID NO: 426593 - DNA, 20 bp, Artificial Sequence
  chemically synthesized
tttttaaagaaaagagtaat

SEQ ID NO: 426594 - DNA, 20 bp, Artificial Sequence
  chemically synthesized
gaggtaatttttaaagaaaa

SEQ ID NO: 426595 - DNA, 20 bp, Artificial Sequence
  chemically synthesized
atgaggtaatttttaaagaa

SEQ ID NO: 426596 - DNA, 20 bp, Artificial Sequence
  chemically synthesized
gcaagatgaggtaattttta

SEQ ID NO: 426597 - DNA, 20 bp, Artificial Sequence
  chemically synthesized
ataaagaaatacgcaagatg

SEQ ID NO: 426598 - DNA, 20 bp, Artificial Sequence
  chemically synthesized
cataaagaaatacgcaagat

SEQ ID NO: 426599 - DNA, 20 bp, Artificial Sequence
  chemically synthesized
actgccataaagaaatacgc

SEQ ID NO: 426600 - DNA, 20 bp, Artificial Sequence
  chemically synthesized
tcatcttgcgtatttcttta

SEQ ID NO: 426601 - DNA, 20 bp, Artificial Sequence
  chemically synthesized
tcttgcgtatttctttatgg

SEQ ID NO: 426602 - DNA, 20 bp, Artificial Sequence
  chemically synthesized
tcaattctcacactgccata

SEQ ID NO: 426603 - DNA, 20 bp, Artificial Sequence
  chemically synthesized
gtatttctttatggcagtgt

SEQ ID NO: 426604 - DNA, 20 bp, Artificial Sequence
  chemically synthesized
agtgtgagaattgactaata

SEQ ID NO: 426605 - DNA, 20 bp, Artificial Sequence
  chemically synthesized
ttttagcgatggggctgtat

SEQ ID NO: 426606 - DNA, 20 bp, Artificial Sequence
  chemically synthesized
tttttttttttttagcgatg

SEQ ID NO: 426607 - DNA, 20 bp, Artificial Sequence
  chemically synthesized
ttttttttttttttagcgat

SEQ ID NO: 426608 - DNA, 20 bp, Artificial Sequence
  chemically synthesized
tttttttttttttttagcga

SEQ ID NO: 426609 - DNA, 20 bp, Artificial Sequence
  chemically synthesized
tttttttttttttttttttt

SEQ ID NO: 426610 - DNA, 20 bp, Artificial Sequence
  chemically synthesized
aaaaaaaaaatgtctaatca

SEQ ID NO: 426611 - DNA, 20 bp, Artificial Sequence
  chemically synthesized
gttcactttccaactttgat

SEQ ID NO: 426612 - DNA, 20 bp, Artificial Sequence
  chemically synthesized
aaaaaatgtctaatcaaagt

SEQ ID NO: 426613 - DNA, 20 bp, Artificial Sequence
  chemically synthesized
aatgtctaatcaaagttgga

SEQ ID NO: 426614 - DNA, 20 bp, Artificial Sequence
  chemically synthesized
caaagttggaaagtgaacat

SEQ ID NO: 426615 - DNA, 20 bp, Artificial Sequence
  chemically synthesized
aaagttggaaagtgaacatt

SEQ ID NO: 426616 - DNA, 20 bp, Artificial Sequence
  chemically synthesized
aagttggaaagtgaacatta

SEQ ID NO: 426617 - DNA, 20 bp, Artificial Sequence
  chemically synthesized
ttttgtataaataaatcctt

SEQ ID NO: 426618 - DNA, 20 bp, Artificial Sequence
  chemically synthesized
ggaagaagctgggagtccaa

SEQ ID NO: 426619 - DNA, 20 bp, Artificial Sequence
  chemically synthesized
aggaagaagctgggagtcca

SEQ ID NO: 426620 - DNA, 20 bp, Artificial Sequence
  chemically synthesized
aaataaatcctttggactcc

SEQ ID NO: 426621 - DNA, 20 bp, Artificial Sequence
  chemically synthesized
tcggcaaaggaagaagctgg

SEQ ID NO: 426622 - DNA, 20 bp, Artificial Sequence
  chemically synthesized
gatcggcaaaggaagaagct

SEQ ID NO: 426623 - DNA, 20 bp, Artificial Sequence
  chemically synthesized
tgatcggcaaaggaagaagc

SEQ ID NO: 426624 - DNA, 20 bp, Artificial Sequence
  chemically synthesized
aagctgatcggcaaaggaag

SEQ ID NO: 426625 - DNA, 20 bp, Artificial Sequence
  chemically synthesized
ttaaagctgatcggcaaagg

SEQ ID NO: 426626 - DNA, 20 bp, Artificial Sequence
  chemically synthesized
cccttaaagctgatcggcaa

SEQ ID NO: 426627 - DNA, 20 bp, Artificial Sequence
  chemically synthesized
cagcttcttcctttgccgat

SEQ ID NO: 426628 - DNA, 20 bp, Artificial Sequence
  chemically synthesized
tcccttaaagctgatcggca

SEQ ID NO: 426629 - DNA, 20 bp, Artificial Sequence
  chemically synthesized
cactgtcccttaaagctgat

SEQ ID NO: 426630 - DNA, 20 bp, Artificial Sequence
  chemically synthesized
ttcctttgccgatcagcttt

SEQ ID NO: 426631 - DNA, 20 bp, Artificial Sequence
  chemically synthesized
tcctttgccgatcagcttta

SEQ ID NO: 426632 - DNA, 20 bp, Artificial Sequence
  chemically synthesized
cctttgccgatcagctttaa

SEQ ID NO: 426633 - DNA, 20 bp, Artificial Sequence
  chemically synthesized
tgccgatcagctttaaggga

SEQ ID NO: 426634 - DNA, 20 bp, Artificial Sequence
  chemically synthesized
aacagaaccactgtccctta

SEQ ID NO: 426635 - DNA, 20 bp, Artificial Sequence
  chemically synthesized
cgatcagctttaagggacag

SEQ ID NO: 426636 - DNA, 20 bp, Artificial Sequence
  chemically synthesized
ctgtcctttcaaaagtcaaa

SEQ ID NO: 426637 - DNA, 20 bp, Artificial Sequence
  chemically synthesized
tggttctgtttgacttttga

SEQ ID NO: 426638 - DNA, 20 bp, Artificial Sequence
  chemically synthesized
ggttctgtttgacttttgaa

SEQ ID NO: 426639 - DNA, 20 bp, Artificial Sequence
  chemically synthesized
atcttgttctgtcctttcaa

SEQ ID NO: 426640 - DNA, 20 bp, Artificial Sequence
  chemically synthesized
ctgtttgacttttgaaagga

SEQ ID NO: 426641 - DNA, 20 bp, Artificial Sequence
  chemically synthesized
gacttttgaaaggacagaac

SEQ ID NO: 426642 - DNA, 20 bp, Artificial Sequence
  chemically synthesized
tagcagaaatgtgatatata

SEQ ID NO: 426643 - DNA, 20 bp, Artificial Sequence
  chemically synthesized
atagcagaaatgtgatatat

SEQ ID NO: 426644 - DNA, 20 bp, Artificial Sequence
  chemically synthesized
tatcacatttctgctatcaa

SEQ ID NO: 426645 - DNA, 20 bp, Artificial Sequence
  chemically synthesized
aaactcttaactattgatag

SEQ ID NO: 426646 - DNA, 20 bp, Artificial Sequence
  chemically synthesized
caaaaactcttaactattga

SEQ ID NO: 426647 - DNA, 20 bp, Artificial Sequence
  chemically synthesized
catttctgctatcaatagtt

SEQ ID NO: 426648 - DNA, 20 bp, Artificial Sequence
  chemically synthesized
tttctgctatcaatagttaa

SEQ ID NO: 426649 - DNA, 20 bp, Artificial Sequence
  chemically synthesized
tccatgatactttcaattta

SEQ ID NO: 426650 - DNA, 20 bp, Artificial Sequence
  chemically synthesized
gagtttttgctataaattga

SEQ ID NO: 426651 - DNA, 20 bp, Artificial Sequence
  chemically synthesized
gctataaattgaaagtatca

SEQ ID NO: 426652 - DNA, 20 bp, Artificial Sequence
  chemically synthesized
agtatcatggacacattctt

SEQ ID NO: 426653 - DNA, 20 bp, Artificial Sequence
  chemically synthesized
tcatggacacattctttagt

SEQ ID NO: 426654 - DNA, 20 bp, Artificial Sequence
  chemically synthesized
tggacacattctttagtcag

SEQ ID NO: 426655 - DNA, 20 bp, Artificial Sequence
  chemically synthesized
cagggagtgactgctgacta

SEQ ID NO: 426656 - DNA, 20 bp, Artificial Sequence
  chemically synthesized
aacacctaattaatgacagg

SEQ ID NO: 426657 - DNA, 20 bp, Artificial Sequence
  chemically synthesized
ccaacacctaattaatgaca

SEQ ID NO: 426658 - DNA, 20 bp, Artificial Sequence
  chemically synthesized
tccaacacctaattaatgac

SEQ ID NO: 426659 - DNA, 20 bp, Artificial Sequence
  chemically synthesized
ttccaacacctaattaatga

SEQ ID NO: 426660 - DNA, 20 bp, Artificial Sequence
  chemically synthesized
agtcactccctgtcattaat

SEQ ID NO: 426661 - DNA, 20 bp, Artificial Sequence
  chemically synthesized
gtcactccctgtcattaatt

SEQ ID NO: 426662 - DNA, 20 bp, Artificial Sequence
  chemically synthesized
ccctgtcattaattaggtgt

SEQ ID NO: 426663 - DNA, 20 bp, Artificial Sequence
  chemically synthesized
atagaaattaaacagcattt

SEQ ID NO: 426664 - DNA, 20 bp, Artificial Sequence
  chemically synthesized
tgaaattcatagaaattaaa

SEQ ID NO: 426665 - DNA, 20 bp, Artificial Sequence
  chemically synthesized
gcaatcccacttgaaattca

SEQ ID NO: 426666 - DNA, 20 bp, Artificial Sequence
  chemically synthesized
gtttaatttctatgaatttc

SEQ ID NO: 426667 - DNA, 20 bp, Artificial Sequence
  chemically synthesized
taatttctatgaatttcaag

SEQ ID NO: 426668 - DNA, 20 bp, Artificial Sequence
  chemically synthesized
aatttctatgaatttcaagt

SEQ ID NO: 426669 - DNA, 20 bp, Artificial Sequence
  chemically synthesized
gaatttcaagtgggattgcc

SEQ ID NO: 426670 - DNA, 20 bp, Artificial Sequence
  chemically synthesized
ttcaagtgggattgcccagc

SEQ ID NO: 426671 - DNA, 20 bp, Artificial Sequence
  chemically synthesized
atgctggcaatgtacttgct

SEQ ID NO: 426672 - DNA, 20 bp, Artificial Sequence
  chemically synthesized
tatgctggcaatgtacttgc

SEQ ID NO: 426673 - DNA, 20 bp, Artificial Sequence
  chemically synthesized
ttgcccagcaagtacattgc

SEQ ID NO: 426674 - DNA, 20 bp, Artificial Sequence
  chemically synthesized
aagtacattgccagcatatg

SEQ ID NO: 426675 - DNA, 20 bp, Artificial Sequence
  chemically synthesized
tacctacttactacatatgc

SEQ ID NO: 426676 - DNA, 20 bp, Artificial Sequence
  chemically synthesized
acattgccagcatatgtagt

SEQ ID NO: 426677 - DNA, 20 bp, Artificial Sequence
  chemically synthesized
ttgccagcatatgtagtaag

SEQ ID NO: 426678 - DNA, 20 bp, Artificial Sequence
  chemically synthesized
tgccagcatatgtagtaagt

SEQ ID NO: 426679 - DNA, 20 bp, Artificial Sequence
  chemically synthesized
taagtaggtaattttctttt

SEQ ID NO: 426680 - DNA, 20 bp, Artificial Sequence
  chemically synthesized
aataacattcataatcttaa

SEQ ID NO: 426681 - DNA, 20 bp, Artificial Sequence
  chemically synthesized
gaatgttattctcaaaattt

SEQ ID NO: 426682 - DNA, 20 bp, Artificial Sequence
  chemically synthesized
taaaaacaacctaaaatttt

SEQ ID NO: 426683 - DNA, 20 bp, Artificial Sequence
  chemically synthesized
aatgttattctcaaaatttt

SEQ ID NO: 426684 - DNA, 20 bp, Artificial Sequence
  chemically synthesized
aaattttaggttgtttttat

SEQ ID NO: 426685 - DNA, 20 bp, Artificial Sequence
  chemically synthesized
aattttaggttgtttttata

SEQ ID NO: 426686 - DNA, 20 bp, Artificial Sequence
  chemically synthesized
attttaggttgtttttataa

SEQ ID NO: 426687 - DNA, 20 bp, Artificial Sequence
  chemically synthesized
taggttgtttttataaggga

SEQ ID NO: 426688 - DNA, 20 bp, Artificial Sequence
  chemically synthesized
tttttataagggacagtgta

SEQ ID NO: 426689 - DNA, 20 bp, Artificial Sequence
  chemically synthesized
ataagggacagtgtacagtt

SEQ ID NO: 426690 - DNA, 20 bp, Artificial Sequence
  chemically synthesized
taagggacagtgtacagttt

SEQ ID NO: 426691 - DNA, 20 bp, Artificial Sequence
  chemically synthesized
tcaacctccaattaacacaa

SEQ ID NO: 426692 - DNA, 20 bp, Artificial Sequence
  chemically synthesized
gtttgggcttttgtgttaat

SEQ ID NO: 426693 - DNA, 20 bp, Artificial Sequence
  chemically synthesized
ttgggcttttgtgttaattg

SEQ ID NO: 426694 - DNA, 20 bp, Artificial Sequence
  chemically synthesized
tgggcttttgtgttaattgg

SEQ ID NO: 426695 - DNA, 20 bp, Artificial Sequence
  chemically synthesized
tgtgttaattggaggttgac

SEQ ID NO: 426696 - DNA, 20 bp, Artificial Sequence
  chemically synthesized
gtgttaattggaggttgaca

SEQ ID NO: 426697 - DNA, 20 bp, Artificial Sequence
  chemically synthesized
tgttaattggaggttgacaa

SEQ ID NO: 426698 - DNA, 20 bp, Artificial Sequence
  chemically synthesized
ttggaggttgacaagggaaa

SEQ ID NO: 426699 - DNA, 20 bp, Artificial Sequence
  chemically synthesized
tggaggttgacaagggaaaa

SEQ ID NO: 426700 - DNA, 20 bp, Artificial Sequence
  chemically synthesized
ggaggttgacaagggaaaaa

SEQ ID NO: 426701 - DNA, 20 bp, Artificial Sequence
  chemically synthesized
gttgacaagggaaaaaggga

SEQ ID NO: 426702 - DNA, 20 bp, Artificial Sequence
  chemically synthesized
gggaaaaagggatagttttc

SEQ ID NO: 426703 - DNA, 20 bp, Artificial Sequence
  chemically synthesized
gaaaaacctagaaagcatgc

SEQ ID NO: 426704 - DNA, 20 bp, Artificial Sequence
  chemically synthesized
tagttttccagcatgctttc

SEQ ID NO: 426705 - DNA, 20 bp, Artificial Sequence
  chemically synthesized
agttttccagcatgctttct

SEQ ID NO: 426706 - DNA, 20 bp, Artificial Sequence
  chemically synthesized
actatttagaaaaacctaga

SEQ ID NO: 426707 - DNA, 20 bp, Artificial Sequence
  chemically synthesized
ttgtactatttagaaaaacc

SEQ ID NO: 426708 - DNA, 20 bp, Artificial Sequence
  chemically synthesized
gctttctaggtttttctaaa

SEQ ID NO: 426709 - DNA, 20 bp, Artificial Sequence
  chemically synthesized
ctgaacatctttgtactatt

SEQ ID NO: 426710 - DNA, 20 bp, Artificial Sequence
  chemically synthesized
aggtttttctaaatagtaca

SEQ ID NO: 426711 - DNA, 20 bp, Artificial Sequence
  chemically synthesized
ctaaatagtacaaagatgtt

SEQ ID NO: 426712 - DNA, 20 bp, Artificial Sequence
  chemically synthesized
taaatagtacaaagatgttc

SEQ ID NO: 426713 - DNA, 20 bp, Artificial Sequence
  chemically synthesized
aatagtacaaagatgttcag

SEQ ID NO: 426714 - DNA, 20 bp, Artificial Sequence
  chemically synthesized
atagtacaaagatgttcagg

SEQ ID NO: 426715 - DNA, 20 bp, Artificial Sequence
  chemically synthesized
gtacaaagatgttcaggagg

SEQ ID NO: 426716 - DNA, 20 bp, Artificial Sequence
  chemically synthesized
gaaaatattgctattttaaa

SEQ ID NO: 426717 - DNA, 20 bp, Artificial Sequence
  chemically synthesized
tgaaaatattccatttaaaa

SEQ ID NO: 426718 - DNA, 20 bp, Artificial Sequence
  chemically synthesized
aatattttcaacgctaactt

SEQ ID NO: 426719 - DNA, 20 bp, Artificial Sequence
  chemically synthesized
atactgagatatgcttaagt

SEQ ID NO: 426720 - DNA, 20 bp, Artificial Sequence
  chemically synthesized
ttaaatactgagatatgctt

SEQ ID NO: 426721 - DNA, 20 bp, Artificial Sequence
  chemically synthesized
acgctaacttaagcatatct

SEQ ID NO: 426722 - DNA, 20 bp, Artificial Sequence
  chemically synthesized
ttaagcatatctcagtattt

SEQ ID NO: 426723 - DNA, 20 bp, Artificial Sequence
  chemically synthesized
caaatgtctgcttaaatact

SEQ ID NO: 426724 - DNA, 20 bp, Artificial Sequence
  chemically synthesized
agcatatctcagtatttaag

SEQ ID NO: 426725 - DNA, 20 bp, Artificial Sequence
  chemically synthesized
tcagtatttaagcagacatt

SEQ ID NO: 426726 - DNA, 20 bp, Artificial Sequence
  chemically synthesized
tttggatattttcctcatct

SEQ ID NO: 426727 - DNA, 20 bp, Artificial Sequence
  chemically synthesized
agtagttattgtctgagatg

SEQ ID NO: 426728 - DNA, 20 bp, Artificial Sequence
  chemically synthesized
tagtagttattgtctgagat

SEQ ID NO: 426729 - DNA, 20 bp, Artificial Sequence
  chemically synthesized
ggtcatagtagttattgtct

SEQ ID NO: 426730 - DNA, 20 bp, Artificial Sequence
  chemically synthesized
ggatttgttcaaggtcatag

SEQ ID NO: 426731 - DNA, 20 bp, Artificial Sequence
  chemically synthesized
gagggatttgttcaaggtca

SEQ ID NO: 426732 - DNA, 20 bp, Artificial Sequence
  chemically synthesized
aaaatggagggatttgttca

SEQ ID NO: 426733 - DNA, 20 bp, Artificial Sequence
  chemically synthesized
gaaaatggagggatttgttc

SEQ ID NO: 426734 - DNA, 20 bp, Artificial Sequence
  chemically synthesized
actgagaatcagaaaatgga

SEQ ID NO: 426735 - DNA, 20 bp, Artificial Sequence
  chemically synthesized
aactgagaatcagaaaatgg

SEQ ID NO: 426736 - DNA, 20 bp, Artificial Sequence
  chemically synthesized
aaactgagaatcagaaaatg

SEQ ID NO: 426737 - DNA, 20 bp, Artificial Sequence
  chemically synthesized
gaaaactgagaatcagaaaa

SEQ ID NO: 426738 - DNA, 20 bp, Artificial Sequence
  chemically synthesized
tccctccattttctgattct

SEQ ID NO: 426739 - DNA, 20 bp, Artificial Sequence
  chemically synthesized
tagatgagaaaactgagaat

SEQ ID NO: 426740 - DNA, 20 bp, Artificial Sequence
  chemically synthesized
attttatagatgagaaaact

SEQ ID NO: 426741 - DNA, 20 bp, Artificial Sequence
  chemically synthesized
aattcccatattttatagat

SEQ ID NO: 426742 - DNA, 20 bp, Artificial Sequence
  chemically synthesized
gttttctcatctataaaata

SEQ ID NO: 426743 - DNA, 20 bp, Artificial Sequence
  chemically synthesized
agtccaattcccatatttta

SEQ ID NO: 426744 - DNA, 20 bp, Artificial Sequence
  chemically synthesized
ttttctcatctataaaatat

SEQ ID NO: 426745 - DNA, 20 bp, Artificial Sequence
  chemically synthesized
catctataaaatatgggaat

SEQ ID NO: 426746 - DNA, 20 bp, Artificial Sequence
  chemically synthesized
taaatggaaacaaagttatt

SEQ ID NO: 426747 - DNA, 20 bp, Artificial Sequence
  chemically synthesized
gctaaagctaaatggaaaca

SEQ ID NO: 426748 - DNA, 20 bp, Artificial Sequence
  chemically synthesized
taaataactttgtttccatt

SEQ ID NO: 426749 - DNA, 20 bp, Artificial Sequence
  chemically synthesized
catagagtgctaaagctaaa

SEQ ID NO: 426750 - DNA, 20 bp, Artificial Sequence
  chemically synthesized
actttgtttccatttagctt

SEQ ID NO: 426751 - DNA, 20 bp, Artificial Sequence
  chemically synthesized
ataaaagtcatagagtgcta

SEQ ID NO: 426752 - DNA, 20 bp, Artificial Sequence
  chemically synthesized
gtaaatggataaaagtcata

SEQ ID NO: 426753 - DNA, 20 bp, Artificial Sequence
  chemically synthesized
aagtaaatggataaaagtca

SEQ ID NO: 426754 - DNA, 20 bp, Artificial Sequence
  chemically synthesized
ttgtgtaagtaaatggataa

SEQ ID NO: 426755 - DNA, 20 bp, Artificial Sequence
  chemically synthesized
agtagtgttgtgtaagtaaa

SEQ ID NO: 426756 - DNA, 20 bp, Artificial Sequence
  chemically synthesized
tctcaggagtagtgttgtgt

SEQ ID NO: 426757 - DNA, 20 bp, Artificial Sequence
  chemically synthesized
acttacacaacactactcct

SEQ ID NO: 426758 - DNA, 20 bp, Artificial Sequence
  chemically synthesized
aaatgtatgtttctcaggag

SEQ ID NO: 426759 - DNA, 20 bp, Artificial Sequence
  chemically synthesized
cataaatgtatgtttctcag

SEQ ID NO: 426760 - DNA, 20 bp, Artificial Sequence
  chemically synthesized
tgcataaatgtatgtttctc

SEQ ID NO: 426761 - DNA, 20 bp, Artificial Sequence
  chemically synthesized
ttgcataaatgtatgtttct

SEQ ID NO: 426762 - DNA, 20 bp, Artificial Sequence
  chemically synthesized
aacatacatttatgcaatta

SEQ ID NO: 426763 - DNA, 20 bp, Artificial Sequence
  chemically synthesized
acatacatttatgcaattat

SEQ ID NO: 426764 - DNA, 20 bp, Artificial Sequence
  chemically synthesized
catacatttatgcaattata

SEQ ID NO: 426765 - DNA, 20 bp, Artificial Sequence
  chemically synthesized
caattatagggataaacacc

SEQ ID NO: 426766 - DNA, 20 bp, Artificial Sequence
  chemically synthesized
aattatagggataaacaccc

SEQ ID NO: 426767 - DNA, 20 bp, Artificial Sequence
  chemically synthesized
aatctattaaatgaagtcct

SEQ ID NO: 426768 - DNA, 20 bp, Artificial Sequence
  chemically synthesized
aaatctattaaatgaagtcc

SEQ ID NO: 426769 - DNA, 20 bp, Artificial Sequence
  chemically synthesized
acacccaggacttcatttaa

SEQ ID NO: 426770 - DNA, 20 bp, Artificial Sequence
  chemically synthesized
taaggaaaatctattaaatg

SEQ ID NO: 426771 - DNA, 20 bp, Artificial Sequence
  chemically synthesized
tacagtacagtggtggtata

SEQ ID NO: 426772 - DNA, 20 bp, Artificial Sequence
  chemically synthesized
gtacagtacagtggtggtat

SEQ ID NO: 426773 - DNA, 20 bp, Artificial Sequence
  chemically synthesized
ttaccagtacagtacagtgg

SEQ ID NO: 426774 - DNA, 20 bp, Artificial Sequence
  chemically synthesized
ctgttaccagtacagtacag

SEQ ID NO: 426775 - DNA, 20 bp, Artificial Sequence
  chemically synthesized
tgtctgttaccagtacagta

SEQ ID NO: 426776 - DNA, 20 bp, Artificial Sequence
  chemically synthesized
ataccaccactgtactgtac

SEQ ID NO: 426777 - DNA, 20 bp, Artificial Sequence
  chemically synthesized
gaaagtgtctgttaccagta

SEQ ID NO: 426778 - DNA, 20 bp, Artificial Sequence
  chemically synthesized
ccactgtactgtactggtaa

SEQ ID NO: 426779 - DNA, 20 bp, Artificial Sequence
  chemically synthesized
caggggaaagtgtctgttac

SEQ ID NO: 426780 - DNA, 20 bp, Artificial Sequence
  chemically synthesized
tagcttacttatacagggga

SEQ ID NO: 426781 - DNA, 20 bp, Artificial Sequence
  chemically synthesized
acagacactttcccctgtat

SEQ ID NO: 426782 - DNA, 20 bp, Artificial Sequence
  chemically synthesized
aggatagcttacttatacag

SEQ ID NO: 426783 - DNA, 20 bp, Artificial Sequence
  chemically synthesized
caggatagcttacttataca

SEQ ID NO: 426784 - DNA, 20 bp, Artificial Sequence
  chemically synthesized
gcaggatagcttacttatac

SEQ ID NO: 426785 - DNA, 20 bp, Artificial Sequence
  chemically synthesized
acactttcccctgtataagt

SEQ ID NO: 426786 - DNA, 20 bp, Artificial Sequence
  chemically synthesized
tgcaggatagcttacttata

SEQ ID NO: 426787 - DNA, 20 bp, Artificial Sequence
  chemically synthesized
tgtataagtaagctatcctg

SEQ ID NO: 426788 - DNA, 20 bp, Artificial Sequence
  chemically synthesized
ccccattagcatctgcagga

SEQ ID NO: 426789 - DNA, 20 bp, Artificial Sequence
  chemically synthesized
gtcaccccattagcatctgc

SEQ ID NO: 426790 - DNA, 20 bp, Artificial Sequence
  chemically synthesized
ggtcaccccattagcatctg

SEQ ID NO: 426791 - DNA, 20 bp, Artificial Sequence
  chemically synthesized
agctatcctgcagatgctaa

SEQ ID NO: 426792 - DNA, 20 bp, Artificial Sequence
  chemically synthesized
gctatcctgcagatgctaat

SEQ ID NO: 426793 - DNA, 20 bp, Artificial Sequence
  chemically synthesized
ctatcctgcagatgctaatg

SEQ ID NO: 426794 - DNA, 20 bp, Artificial Sequence
  chemically synthesized
gccttttggggtcaccccat

SEQ ID NO: 426795 - DNA, 20 bp, Artificial Sequence
  chemically synthesized
tgctaatggggtgaccccaa

SEQ ID NO: 426796 - DNA, 20 bp, Artificial Sequence
  chemically synthesized
gctaatggggtgaccccaaa

SEQ ID NO: 426797 - DNA, 20 bp, Artificial Sequence
  chemically synthesized
taatttctgttggccttttg

SEQ ID NO: 426798 - DNA, 20 bp, Artificial Sequence
  chemically synthesized
ttaatttctgttggcctttt

SEQ ID NO: 426799 - DNA, 20 bp, Artificial Sequence
  chemically synthesized
tttaatttctgttggccttt

SEQ ID NO: 426800 - DNA, 20 bp, Artificial Sequence
  chemically synthesized
gggtgaccccaaaaggccaa

SEQ ID NO: 426801 - DNA, 20 bp, Artificial Sequence
  chemically synthesized
caagtttctttaatttctgt

SEQ ID NO: 426802 - DNA, 20 bp, Artificial Sequence
  chemically synthesized
caaaaggccaacagaaatta

SEQ ID NO: 426803 - DNA, 20 bp, Artificial Sequence
  chemically synthesized
caacagaaattaaagaaact

SEQ ID NO: 426804 - DNA, 20 bp, Artificial Sequence
  chemically synthesized
tttgtttgtttatttttgcc

SEQ ID NO: 426805 - DNA, 20 bp, Artificial Sequence
  chemically synthesized
aaaataaacaaacaaaaaac

SEQ ID NO: 426806 - DNA, 20 bp, Artificial Sequence
  chemically synthesized
aacaaacaaaaaactagccg

SEQ ID NO: 426807 - DNA, 20 bp, Artificial Sequence
  chemically synthesized
cttaatctgtatgccacggc

SEQ ID NO: 426808 - DNA, 20 bp, Artificial Sequence
  chemically synthesized
aaaaaactagccgtggcata

SEQ ID NO: 426809 - DNA, 20 bp, Artificial Sequence
  chemically synthesized
tatacttaatctgtatgcca

SEQ ID NO: 426810 - DNA, 20 bp, Artificial Sequence
  chemically synthesized
ctagccgtggcatacagatt

SEQ ID NO: 426811 - DNA, 20 bp, Artificial Sequence
  chemically synthesized
agattaagtatatttacacc

SEQ ID NO: 426812 - DNA, 20 bp, Artificial Sequence
  chemically synthesized
tcactaaaaaaatcataact

SEQ ID NO: 426813 - DNA, 20 bp, Artificial Sequence
  chemically synthesized
acaccaagttatgatttttt

SEQ ID NO: 426814 - DNA, 20 bp, Artificial Sequence
  chemically synthesized
atcagtaactttaaatgggg

SEQ ID NO: 426815 - DNA, 20 bp, Artificial Sequence
  chemically synthesized
tttagtgacttccccattta

SEQ ID NO: 426816 - DNA, 20 bp, Artificial Sequence
  chemically synthesized
tatatcagtaactttaaatg

SEQ ID NO: 426817 - DNA, 20 bp, Artificial Sequence
  chemically synthesized
atatatcagtaactttaaat

SEQ ID NO: 426818 - DNA, 20 bp, Artificial Sequence
  chemically synthesized
tatatatcagtaactttaaa

SEQ ID NO: 426819 - DNA, 20 bp, Artificial Sequence
  chemically synthesized
atatacacacacgtatatat

SEQ ID NO: 426820 - DNA, 20 bp, Artificial Sequence
  chemically synthesized
tatacaatatacaaaatcat

SEQ ID NO: 426821 - DNA, 20 bp, Artificial Sequence
  chemically synthesized
atcatcagtatattttcccc

SEQ ID NO: 426822 - DNA, 20 bp, Artificial Sequence
  chemically synthesized
acttaacaattattatctag

SEQ ID NO: 426823 - DNA, 20 bp, Artificial Sequence
  chemically synthesized
tacttaacaattattatcta

SEQ ID NO: 426824 - DNA, 20 bp, Artificial Sequence
  chemically synthesized
atacttaacaattattatct

SEQ ID NO: 426825 - DNA, 20 bp, Artificial Sequence
  chemically synthesized
tatacttaacaattattatc

SEQ ID NO: 426826 - DNA, 20 bp, Artificial Sequence
  chemically synthesized
tcccctagataataattgtt

SEQ ID NO: 426827 - DNA, 20 bp, Artificial Sequence
  chemically synthesized
tatatcacttaaaatgtata

SEQ ID NO: 426828 - DNA, 20 bp, Artificial Sequence
  chemically synthesized
ttacatgctgtatacatttt

SEQ ID NO: 426829 - DNA, 20 bp, Artificial Sequence
  chemically synthesized
tacattttaggtttgttgga

SEQ ID NO: 426830 - DNA, 20 bp, Artificial Sequence
  chemically synthesized
tacttacattttaggtttgt

SEQ ID NO: 426831 - DNA, 20 bp, Artificial Sequence
  chemically synthesized
ttccaacaaacctaaaatgt

SEQ ID NO: 426832 - DNA, 20 bp, Artificial Sequence
  chemically synthesized
aaaagaactacttacatttt

SEQ ID NO: 426833 - DNA, 20 bp, Artificial Sequence
  chemically synthesized
gaaaagaactacttacattt

SEQ ID NO: 426834 - DNA, 20 bp, Artificial Sequence
  chemically synthesized
caacaaacctaaaatgtaag

SEQ ID NO: 426835 - DNA, 20 bp, Artificial Sequence
  chemically synthesized
ttaattttggaaattaggaa

SEQ ID NO: 426836 - DNA, 20 bp, Artificial Sequence
  chemically synthesized
ctctcttaattttggaaatt

SEQ ID NO: 426837 - DNA, 20 bp, Artificial Sequence
  chemically synthesized
cctctcttaattttggaaat

SEQ ID NO: 426838 - DNA, 20 bp, Artificial Sequence
  chemically synthesized
ttttcctaatttccaaaatt

SEQ ID NO: 426839 - DNA, 20 bp, Artificial Sequence
  chemically synthesized
ttcctaatttccaaaattaa

SEQ ID NO: 426840 - DNA, 20 bp, Artificial Sequence
  chemically synthesized
aactctgcctctcttaattt

SEQ ID NO: 426841 - DNA, 20 bp, Artificial Sequence
  chemically synthesized
cctaatttccaaaattaaga

SEQ ID NO: 426842 - DNA, 20 bp, Artificial Sequence
  chemically synthesized
ctaatttccaaaattaagag

SEQ ID NO: 426843 - DNA, 20 bp, Artificial Sequence
  chemically synthesized
atttccaaaattaagagagg

SEQ ID NO: 426844 - DNA, 20 bp, Artificial Sequence
  chemically synthesized
ttccaaaattaagagaggca

SEQ ID NO: 426845 - DNA, 20 bp, Artificial Sequence
  chemically synthesized
aaattaagagaggcagagtt

SEQ ID NO: 426846 - DNA, 20 bp, Artificial Sequence
  chemically synthesized
cagagttaagcaacttgcct

SEQ ID NO: 426847 - DNA, 20 bp, Artificial Sequence
  chemically synthesized
agagttaagcaacttgccta

SEQ ID NO: 426848 - DNA, 20 bp, Artificial Sequence
  chemically synthesized
taatgactgtgaccttaggc

SEQ ID NO: 426849 - DNA, 20 bp, Artificial Sequence
  chemically synthesized
aagcaacttgcctaaggtca

SEQ ID NO: 426850 - DNA, 20 bp, Artificial Sequence
  chemically synthesized
tatttaatgactgtgacctt

SEQ ID NO: 426851 - DNA, 20 bp, Artificial Sequence
  chemically synthesized
ctatttaatgactgtgacct

SEQ ID NO: 426852 - DNA, 20 bp, Artificial Sequence
  chemically synthesized
ctaaggtcacagtcattaaa

SEQ ID NO: 426853 - DNA, 20 bp, Artificial Sequence
  chemically synthesized
aggtcacagtcattaaatag

SEQ ID NO: 426854 - DNA, 20 bp, Artificial Sequence
  chemically synthesized
agtcattaaatagcagcact

SEQ ID NO: 426855 - DNA, 20 bp, Artificial Sequence
  chemically synthesized
tgtttgctgagttcgaatct

SEQ ID NO: 426856 - DNA, 20 bp, Artificial Sequence
  chemically synthesized
gcagcactgagattcgaact

SEQ ID NO: 426857 - DNA, 20 bp, Artificial Sequence
  chemically synthesized
tgagattcgaactcagcaaa

SEQ ID NO: 426858 - DNA, 20 bp, Artificial Sequence
  chemically synthesized
ctggagccaggctgtttgct

SEQ ID NO: 426859 - DNA, 20 bp, Artificial Sequence
  chemically synthesized
ttcgaactcagcaaacagcc

SEQ ID NO: 426860 - DNA, 20 bp, Artificial Sequence
  chemically synthesized
ctcagcaaacagcctggctc

SEQ ID NO: 426861 - DNA, 20 bp, Artificial Sequence
  chemically synthesized
gacgcatgggttctggagcc

SEQ ID NO: 426862 - DNA, 20 bp, Artificial Sequence
  chemically synthesized
agacgcatgggttctggagc

SEQ ID NO: 426863 - DNA, 20 bp, Artificial Sequence
  chemically synthesized
tatcagacgcatgggttctg

SEQ ID NO: 426864 - DNA, 20 bp, Artificial Sequence
  chemically synthesized
gttatcagacgcatgggttc

SEQ ID NO: 426865 - DNA, 20 bp, Artificial Sequence
  chemically synthesized
gaagcagttatcagacgcat

SEQ ID NO: 426866 - DNA, 20 bp, Artificial Sequence
  chemically synthesized
agaagcagttatcagacgca

SEQ ID NO: 426867 - DNA, 20 bp, Artificial Sequence
  chemically synthesized
atattataagaagcagttat

SEQ ID NO: 426868 - DNA, 20 bp, Artificial Sequence
  chemically synthesized
cacaaccatattataagaag

SEQ ID NO: 426869 - DNA, 20 bp, Artificial Sequence
  chemically synthesized
gaacacaaccatattataag

SEQ ID NO: 426870 - DNA, 20 bp, Artificial Sequence
  chemically synthesized
gataactgcttcttataata

SEQ ID NO: 426871 - DNA, 20 bp, Artificial Sequence
  chemically synthesized
gatgaacacaaccatattat

SEQ ID NO: 426872 - DNA, 20 bp, Artificial Sequence
  chemically synthesized
acaatagatgaacaagaaaa

SEQ ID NO: 426873 - DNA, 20 bp, Artificial Sequence
  chemically synthesized
caacctcacaatagatgaac

SEQ ID NO: 426874 - DNA, 20 bp, Artificial Sequence
  chemically synthesized
ttttcttgttcatctattgt

SEQ ID NO: 426875 - DNA, 20 bp, Artificial Sequence
  chemically synthesized
tttcttgttcatctattgtg

SEQ ID NO: 426876 - DNA, 20 bp, Artificial Sequence
  chemically synthesized
tcacgctggcaacctcacaa

SEQ ID NO: 426877 - DNA, 20 bp, Artificial Sequence
  chemically synthesized
ttcatctattgtgaggttgc

SEQ ID NO: 426878 - DNA, 20 bp, Artificial Sequence
  chemically synthesized
ggcctttgaagaaatcacgc

SEQ ID NO: 426879 - DNA, 20 bp, Artificial Sequence
  chemically synthesized
ttgccagcgtgatttcttca

SEQ ID NO: 426880 - DNA, 20 bp, Artificial Sequence
  chemically synthesized
tgccagcgtgatttcttcaa

SEQ ID NO: 426881 - DNA, 20 bp, Artificial Sequence
  chemically synthesized
ctgactccagcaggcctttg

SEQ ID NO: 426882 - DNA, 20 bp, Artificial Sequence
  chemically synthesized
tgatttcttcaaaggcctgc

SEQ ID NO: 426883 - DNA, 20 bp, Artificial Sequence
  chemically synthesized
atttcttcaaaggcctgctg

SEQ ID NO: 426884 - DNA, 20 bp, Artificial Sequence
  chemically synthesized
gacatattcctgactccagc

SEQ ID NO: 426885 - DNA, 20 bp, Artificial Sequence
  chemically synthesized
cttcaaaggcctgctggagt

SEQ ID NO: 426886 - DNA, 20 bp, Artificial Sequence
  chemically synthesized
ggacatattcctgactccag

SEQ ID NO: 426887 - DNA, 20 bp, Artificial Sequence
  chemically synthesized
ttcaaaggcctgctggagtc

SEQ ID NO: 426888 - DNA, 20 bp, Artificial Sequence
  chemically synthesized
tagggacatattcctgactc

SEQ ID NO: 426889 - DNA, 20 bp, Artificial Sequence
  chemically synthesized
tggagtcaggaatatgtccc

SEQ ID NO: 426890 - DNA, 20 bp, Artificial Sequence
  chemically synthesized
ggagtcaggaatatgtccct

SEQ ID NO: 426891 - DNA, 20 bp, Artificial Sequence
  chemically synthesized
aggaatatgtccctaggtca

SEQ ID NO: 426892 - DNA, 20 bp, Artificial Sequence
  chemically synthesized
ttgctgagctctgtgaccta

SEQ ID NO: 426893 - DNA, 20 bp, Artificial Sequence
  chemically synthesized
tttgctgagctctgtgacct

SEQ ID NO: 426894 - DNA, 20 bp, Artificial Sequence
  chemically synthesized
gaatatgtccctaggtcaca

SEQ ID NO: 426895 - DNA, 20 bp, Artificial Sequence
  chemically synthesized
atttgctgagctctgtgacc

SEQ ID NO: 426896 - DNA, 20 bp, Artificial Sequence
  chemically synthesized
tgtccctaggtcacagagct

SEQ ID NO: 426897 - DNA, 20 bp, Artificial Sequence
  chemically synthesized
ttaggctactaaaatttgct

SEQ ID NO: 426898 - DNA, 20 bp, Artificial Sequence
  chemically synthesized
tcacagagctcagcaaattt

SEQ ID NO: 426899 - DNA, 20 bp, Artificial Sequence
  chemically synthesized
cagagctcagcaaattttag

SEQ ID NO: 426900 - DNA, 20 bp, Artificial Sequence
  chemically synthesized
ggagaattgagtcaagtttt

SEQ ID NO: 426901 - DNA, 20 bp, Artificial Sequence
  chemically synthesized
aggagaattgagtcaagttt

SEQ ID NO: 426902 - DNA, 20 bp, Artificial Sequence
  chemically synthesized
ccgctcaggagaattgagtc

SEQ ID NO: 426903 - DNA, 20 bp, Artificial Sequence
  chemically synthesized
gagtaccgctcaggagaatt

SEQ ID NO: 426904 - DNA, 20 bp, Artificial Sequence
  chemically synthesized
aaacttgactcaattctcct

SEQ ID NO: 426905 - DNA, 20 bp, Artificial Sequence
  chemically synthesized
cttgactcaattctcctgag

SEQ ID NO: 426906 - DNA, 20 bp, Artificial Sequence
  chemically synthesized
acactgagagtaccgctcag

SEQ ID NO: 426907 - DNA, 20 bp, Artificial Sequence
  chemically synthesized
tcacactgagagtaccgctc

SEQ ID NO: 426908 - DNA, 20 bp, Artificial Sequence
  chemically synthesized
gtcacactgagagtaccgct

SEQ ID NO: 426909 - DNA, 20 bp, Artificial Sequence
  chemically synthesized
attctcctgagcggtactct

SEQ ID NO: 426910 - DNA, 20 bp, Artificial Sequence
  chemically synthesized
cagtagcgaggtcacactga

SEQ ID NO: 426911 - DNA, 20 bp, Artificial Sequence
  chemically synthesized
accagtagcgaggtcacact

SEQ ID NO: 426912 - DNA, 20 bp, Artificial Sequence
  chemically synthesized
tctcagtgtgacctcgctac

SEQ ID NO: 426913 - DNA, 20 bp, Artificial Sequence
  chemically synthesized
acaacttttgaccagtagcg

SEQ ID NO: 426914 - DNA, 20 bp, Artificial Sequence
  chemically synthesized
tacaacttttgaccagtagc

SEQ ID NO: 426915 - DNA, 20 bp, Artificial Sequence
  chemically synthesized
cgtttacaacttttgaccag

SEQ ID NO: 426916 - DNA, 20 bp, Artificial Sequence
  chemically synthesized
gtgacctcgctactggtcaa

SEQ ID NO: 426917 - DNA, 20 bp, Artificial Sequence
  chemically synthesized
gctcgtttacaacttttgac

SEQ ID NO: 426918 - DNA, 20 bp, Artificial Sequence
  chemically synthesized
actggtcaaaagttgtaaac

SEQ ID NO: 426919 - DNA, 20 bp, Artificial Sequence
  chemically synthesized
ggtcaaaagttgtaaacgag

SEQ ID NO: 426920 - DNA, 20 bp, Artificial Sequence
  chemically synthesized
aagacatgtattggtgagag

SEQ ID NO: 426921 - DNA, 20 bp, Artificial Sequence
  chemically synthesized
agcaagacatgtattggtga

SEQ ID NO: 426922 - DNA, 20 bp, Artificial Sequence
  chemically synthesized
atagcaagacatgtattggt

SEQ ID NO: 426923 - DNA, 20 bp, Artificial Sequence
  chemically synthesized
atacatagcaagacatgtat

SEQ ID NO: 426924 - DNA, 20 bp, Artificial Sequence
  chemically synthesized
cccgtttggccatacatagc

SEQ ID NO: 426925 - DNA, 20 bp, Artificial Sequence
  chemically synthesized
aatacatgtcttgctatgta

SEQ ID NO: 426926 - DNA, 20 bp, Artificial Sequence
  chemically synthesized
tcaacccgtttggccataca

SEQ ID NO: 426927 - DNA, 20 bp, Artificial Sequence
  chemically synthesized
tcttgctatgtatggccaaa

SEQ ID NO: 426928 - DNA, 20 bp, Artificial Sequence
  chemically synthesized
cttgctatgtatggccaaac

SEQ ID NO: 426929 - DNA, 20 bp, Artificial Sequence
  chemically synthesized
agtgcacaagtcaacccgtt

SEQ ID NO: 426930 - DNA, 20 bp, Artificial Sequence
  chemically synthesized
tttttgcattttgagtgcac

SEQ ID NO: 426931 - DNA, 20 bp, Artificial Sequence
  chemically synthesized
atagtacttttttgcatttt

SEQ ID NO: 426932 - DNA, 20 bp, Artificial Sequence
  chemically synthesized
tgtgcactcaaaatgcaaaa

SEQ ID NO: 426933 - DNA, 20 bp, Artificial Sequence
  chemically synthesized
gcaaaaaagtactataaata

SEQ ID NO: 426934 - DNA, 20 bp, Artificial Sequence
  chemically synthesized
ccatttctactctatattta

SEQ ID NO: 426935 - DNA, 20 bp, Artificial Sequence
  chemically synthesized
aaaaaagtactataaatata

SEQ ID NO: 426936 - DNA, 20 bp, Artificial Sequence
  chemically synthesized
aaagtactataaatatagag

SEQ ID NO: 426937 - DNA, 20 bp, Artificial Sequence
  chemically synthesized
ctataaatatagagtagaaa

SEQ ID NO: 426938 - DNA, 20 bp, Artificial Sequence
  chemically synthesized
tatagagtagaaatggaaat

SEQ ID NO: 426939 - DNA, 20 bp, Artificial Sequence
  chemically synthesized
ctcttaagacttgtgaaaat

SEQ ID NO: 426940 - DNA, 20 bp, Artificial Sequence
  chemically synthesized
ttaaaatatctgattttcac

SEQ ID NO: 426941 - DNA, 20 bp, Artificial Sequence
  chemically synthesized
atctgattttcacaagtctt

SEQ ID NO: 426942 - DNA, 20 bp, Artificial Sequence
  chemically synthesized
ctgattttcacaagtcttaa

SEQ ID NO: 426943 - DNA, 20 bp, Artificial Sequence
  chemically synthesized
tgaatatcactgaggctctt

SEQ ID NO: 426944 - DNA, 20 bp, Artificial Sequence
  chemically synthesized
ttcacaagtcttaagagcct

SEQ ID NO: 426945 - DNA, 20 bp, Artificial Sequence
  chemically synthesized
aatcatactgaatatcactg

SEQ ID NO: 426946 - DNA, 20 bp, Artificial Sequence
  chemically synthesized
caatcatactgaatatcact

SEQ ID NO: 426947 - DNA, 20 bp, Artificial Sequence
  chemically synthesized
ttaagagcctcagtgatatt

SEQ ID NO: 426948 - DNA, 20 bp, Artificial Sequence
  chemically synthesized
tcagtgatattcagtatgat

SEQ ID NO: 426949 - DNA, 20 bp, Artificial Sequence
  chemically synthesized
agtgatattcagtatgattg

SEQ ID NO: 426950 - DNA, 20 bp, Artificial Sequence
  chemically synthesized
tgatattcagtatgattgga

SEQ ID NO: 426951 - DNA, 20 bp, Artificial Sequence
  chemically synthesized
tgaattgtgtaaactttatt

SEQ ID NO: 426952 - DNA, 20 bp, Artificial Sequence
  chemically synthesized
aattgtgtaaactttattaa

SEQ ID NO: 426953 - DNA, 20 bp, Artificial Sequence
  chemically synthesized
ttctagctagtctcttaata

SEQ ID NO: 426954 - DNA, 20 bp, Artificial Sequence
  chemically synthesized
tgtaaactttattaagagac

SEQ ID NO: 426955 - DNA, 20 bp, Artificial Sequence
  chemically synthesized
aactttattaagagactagc

SEQ ID NO: 426956 - DNA, 20 bp, Artificial Sequence
  chemically synthesized
aactctgctgagtttctagc

SEQ ID NO: 426957 - DNA, 20 bp, Artificial Sequence
  chemically synthesized
taagagactagctagaaact

SEQ ID NO: 426958 - DNA, 20 bp, Artificial Sequence
  chemically synthesized
tgaaaactctgctgagtttc

SEQ ID NO: 426959 - DNA, 20 bp, Artificial Sequence
  chemically synthesized
gagactagctagaaactcag

SEQ ID NO: 426960 - DNA, 20 bp, Artificial Sequence
  chemically synthesized
gactagctagaaactcagca

SEQ ID NO: 426961 - DNA, 20 bp, Artificial Sequence
  chemically synthesized
caatccatgaaaactctgct

SEQ ID NO: 426962 - DNA, 20 bp, Artificial Sequence
  chemically synthesized
gaaactcagcagagttttca

SEQ ID NO: 426963 - DNA, 20 bp, Artificial Sequence
  chemically synthesized
gactgcaaagaaaatgaaag

SEQ ID NO: 426964 - DNA, 20 bp, Artificial Sequence
  chemically synthesized
gatgactgcaaagaaaatga

SEQ ID NO: 426965 - DNA, 20 bp, Artificial Sequence
  chemically synthesized
cactactttcattttctttg

SEQ ID NO: 426966 - DNA, 20 bp, Artificial Sequence
  chemically synthesized
ttacttgtgtgatgactgca

SEQ ID NO: 426967 - DNA, 20 bp, Artificial Sequence
  chemically synthesized
tttctttgcagtcatcacac

SEQ ID NO: 426968 - DNA, 20 bp, Artificial Sequence
  chemically synthesized
atcacacaagtaaaatttta

SEQ ID NO: 426969 - DNA, 20 bp, Artificial Sequence
  chemically synthesized
tcacacaagtaaaattttat

SEQ ID NO: 426970 - DNA, 20 bp, Artificial Sequence
  chemically synthesized
agagcaattaggtgtatgtg

SEQ ID NO: 426971 - DNA, 20 bp, Artificial Sequence
  chemically synthesized
agagagcaattaggtgtatg

SEQ ID NO: 426972 - DNA, 20 bp, Artificial Sequence
  chemically synthesized
tactaccctagagagcaatt

SEQ ID NO: 426973 - DNA, 20 bp, Artificial Sequence
  chemically synthesized
ttactaccctagagagcaat

SEQ ID NO: 426974 - DNA, 20 bp, Artificial Sequence
  chemically synthesized
acatacacctaattgctctc

SEQ ID NO: 426975 - DNA, 20 bp, Artificial Sequence
  chemically synthesized
catacacctaattgctctct

SEQ ID NO: 426976 - DNA, 20 bp, Artificial Sequence
  chemically synthesized
atacacctaattgctctcta

SEQ ID NO: 426977 - DNA, 20 bp, Artificial Sequence
  chemically synthesized
cacctaattgctctctaggg

SEQ ID NO: 426978 - DNA, 20 bp, Artificial Sequence
  chemically synthesized
ggttgttttactaccctaga

SEQ ID NO: 426979 - DNA, 20 bp, Artificial Sequence
  chemically synthesized
ttggttgttttactacccta

SEQ ID NO: 426980 - DNA, 20 bp, Artificial Sequence
  chemically synthesized
gcttggttgttttactaccc

SEQ ID NO: 426981 - DNA, 20 bp, Artificial Sequence
  chemically synthesized
tctagggtagtaaaacaacc

SEQ ID NO: 426982 - DNA, 20 bp, Artificial Sequence
  chemically synthesized
agggtagtaaaacaaccaag

SEQ ID NO: 426983 - DNA, 20 bp, Artificial Sequence
  chemically synthesized
gtttttgtggattcactgct

SEQ ID NO: 426984 - DNA, 20 bp, Artificial Sequence
  chemically synthesized
aagcagtgaatccacaaaaa

SEQ ID NO: 426985 - DNA, 20 bp, Artificial Sequence
  chemically synthesized
aactcactgaactgtttttg

SEQ ID NO: 426986 - DNA, 20 bp, Artificial Sequence
  chemically synthesized
gtgaatccacaaaaacagtt

SEQ ID NO: 426987 - DNA, 20 bp, Artificial Sequence
  chemically synthesized
atccacaaaaacagttcagt

SEQ ID NO: 426988 - DNA, 20 bp, Artificial Sequence
  chemically synthesized
actttttggtagtgtatgca

SEQ ID NO: 426989 - DNA, 20 bp, Artificial Sequence
  chemically synthesized
accatgcatacactaccaaa

SEQ ID NO: 426990 - DNA, 20 bp, Artificial Sequence
  chemically synthesized
tgctgtgagtcactttttgg

SEQ ID NO: 426991 - DNA, 20 bp, Artificial Sequence
  chemically synthesized
ctctgctgtgagtcactttt

SEQ ID NO: 426992 - DNA, 20 bp, Artificial Sequence
  chemically synthesized
cactaccaaaaagtgactca

SEQ ID NO: 426993 - DNA, 20 bp, Artificial Sequence
  chemically synthesized
taccaaaaagtgactcacag

SEQ ID NO: 426994 - DNA, 20 bp, Artificial Sequence
  chemically synthesized
ccaaaaagtgactcacagca

SEQ ID NO: 426995 - DNA, 20 bp, Artificial Sequence
  chemically synthesized
caaaaagtgactcacagcag

SEQ ID NO: 426996 - DNA, 20 bp, Artificial Sequence
  chemically synthesized
aaattaatttcctctgctgt

SEQ ID NO: 426997 - DNA, 20 bp, Artificial Sequence
  chemically synthesized
aagaattgtgttttcatggc

SEQ ID NO: 426998 - DNA, 20 bp, Artificial Sequence
  chemically synthesized
cattaagaattgtgttttca

SEQ ID NO: 426999 - DNA, 20 bp, Artificial Sequence
  chemically synthesized
gtcatagtgttgggatcatt

SEQ ID NO: 427000 - DNA, 20 bp, Artificial Sequence
  chemically synthesized
ttaggtactgtcatagtgtt

SEQ ID NO: 427001 - DNA, 20 bp, Artificial Sequence
  chemically synthesized
tttaggtactgtcatagtgt

SEQ ID NO: 427002 - DNA, 20 bp, Artificial Sequence
  chemically synthesized
taatgatcccaacactatga

SEQ ID NO: 427003 - DNA, 20 bp, Artificial Sequence
  chemically synthesized
agaaattttaggtactgtca

SEQ ID NO: 427004 - DNA, 20 bp, Artificial Sequence
  chemically synthesized
atatacacacaagaaatttt

SEQ ID NO: 427005 - DNA, 20 bp, Artificial Sequence
  chemically synthesized
tatatacacacaagaaattt

SEQ ID NO: 427006 - DNA, 20 bp, Artificial Sequence
  chemically synthesized
gtgtccaaatatatacacac

SEQ ID NO: 427007 - DNA, 20 bp, Artificial Sequence
  chemically synthesized
atttcttgtgtgtatatatt

SEQ ID NO: 427008 - DNA, 20 bp, Artificial Sequence
  chemically synthesized
tgttcttgctataaaatgtg

SEQ ID NO: 427009 - DNA, 20 bp, Artificial Sequence
  chemically synthesized
acacatgtccacacatttta

SEQ ID NO: 427010 - DNA, 20 bp, Artificial Sequence
  chemically synthesized
atgtccacacattttatagc

SEQ ID NO: 427011 - DNA, 20 bp, Artificial Sequence
  chemically synthesized
taagggttgcttaggcattt

SEQ ID NO: 427012 - DNA, 20 bp, Artificial Sequence
  chemically synthesized
catttcaaactgaaatgcct

SEQ ID NO: 427013 - DNA, 20 bp, Artificial Sequence
  chemically synthesized
gctatctttaagggttgctt

SEQ ID NO: 427014 - DNA, 20 bp, Artificial Sequence
  chemically synthesized
agctatctttaagggttgct

SEQ ID NO: 427015 - DNA, 20 bp, Artificial Sequence
  chemically synthesized
aaatgcctaagcaaccctta

SEQ ID NO: 427016 - DNA, 20 bp, Artificial Sequence
  chemically synthesized
gcctaagcaacccttaaaga

SEQ ID NO: 427017 - DNA, 20 bp, Artificial Sequence
  chemically synthesized
ttgacaaaagctatctttaa

SEQ ID NO: 427018 - DNA, 20 bp, Artificial Sequence
  chemically synthesized
cttgacaaaagctatcttta

SEQ ID NO: 427019 - DNA, 20 bp, Artificial Sequence
  chemically synthesized
gcttgacaaaagctatcttt

SEQ ID NO: 427020 - DNA, 20 bp, Artificial Sequence
  chemically synthesized
ccttaaagatagcttttgtc

SEQ ID NO: 427021 - DNA, 20 bp, Artificial Sequence
  chemically synthesized
accagattttagcttgacaa

SEQ ID NO: 427022 - DNA, 20 bp, Artificial Sequence
  chemically synthesized
gcttttgtcaagctaaaatc

SEQ ID NO: 427023 - DNA, 20 bp, Artificial Sequence
  chemically synthesized
ttcattttctcaccagattt

SEQ ID NO: 427024 - DNA, 20 bp, Artificial Sequence
  chemically synthesized
ttgtcaagctaaaatctggt

SEQ ID NO: 427025 - DNA, 20 bp, Artificial Sequence
  chemically synthesized
cttaactttcattttctcac

SEQ ID NO: 427026 - DNA, 20 bp, Artificial Sequence
  chemically synthesized
aaaatctggtgagaaaatga

SEQ ID NO: 427027 - DNA, 20 bp, Artificial Sequence
  chemically synthesized
ctggtgagaaaatgaaagtt

SEQ ID NO: 427028 - DNA, 20 bp, Artificial Sequence
  chemically synthesized
tggtgagaaaatgaaagtta

SEQ ID NO: 427029 - DNA, 20 bp, Artificial Sequence
  chemically synthesized
caaaaaataaaataaaataa

SEQ ID NO: 427030 - DNA, 20 bp, Artificial Sequence
  chemically synthesized
tttattttattttatttttt

SEQ ID NO: 427031 - DNA, 20 bp, Artificial Sequence
  chemically synthesized
ttttattttattttttgaga

SEQ ID NO: 427032 - DNA, 20 bp, Artificial Sequence
  chemically synthesized
ttattttattttttgagatg

SEQ ID NO: 427033 - DNA, 20 bp, Artificial Sequence
  chemically synthesized
cactccagcctgggcaacaa

SEQ ID NO: 427034 - DNA, 20 bp, Artificial Sequence
  chemically synthesized
ggagtttcactcttgttgcc

SEQ ID NO: 427035 - DNA, 20 bp, Artificial Sequence
  chemically synthesized
gagtttcactcttgttgccc

SEQ ID NO: 427036 - DNA, 20 bp, Artificial Sequence
  chemically synthesized
tgcactccagcctgggcaac

SEQ ID NO: 427037 - DNA, 20 bp, Artificial Sequence
  chemically synthesized
ttcactcttgttgcccaggc

SEQ ID NO: 427038 - DNA, 20 bp, Artificial Sequence
  chemically synthesized
cactcttgttgcccaggctg

SEQ ID NO: 427039 - DNA, 20 bp, Artificial Sequence
  chemically synthesized
gtgccattgcactccagcct

SEQ ID NO: 427040 - DNA, 20 bp, Artificial Sequence
  chemically synthesized
tgtgccattgcactccagcc

SEQ ID NO: 427041 - DNA, 20 bp, Artificial Sequence
  chemically synthesized
gagattgtgccattgcactc

SEQ ID NO: 427042 - DNA, 20 bp, Artificial Sequence
  chemically synthesized
ttgcccaggctggagtgcaa

SEQ ID NO: 427043 - DNA, 20 bp, Artificial Sequence
  chemically synthesized
ggcggaggttgcagtgagcg

SEQ ID NO: 427044 - DNA, 20 bp, Artificial Sequence
  chemically synthesized
gaggcggaggttgcagtgag

SEQ ID NO: 427045 - DNA, 20 bp, Artificial Sequence
  chemically synthesized
tgggaggcggaggttgcagt

SEQ ID NO: 427046 - DNA, 20 bp, Artificial Sequence
  chemically synthesized
aagctgggaggcggaggttg

SEQ ID NO: 427047 - DNA, 20 bp, Artificial Sequence
  chemically synthesized
tgcttgaagctgggaggcgg

SEQ ID NO: 427048 - DNA, 20 bp, Artificial Sequence
  chemically synthesized
tcactgcaacctccgcctcc

SEQ ID NO: 427049 - DNA, 20 bp, Artificial Sequence
  chemically synthesized
ctgcttgaagctgggaggcg

SEQ ID NO: 427050 - DNA, 20 bp, Artificial Sequence
  chemically synthesized
aactgcttgaagctgggagg

SEQ ID NO: 427051 - DNA, 20 bp, Artificial Sequence
  chemically synthesized
gagaactgcttgaagctggg

SEQ ID NO: 427052 - DNA, 20 bp, Artificial Sequence
  chemically synthesized
ggagaactgcttgaagctgg

SEQ ID NO: 427053 - DNA, 20 bp, Artificial Sequence
  chemically synthesized
aacctccgcctcccagcttc

SEQ ID NO: 427054 - DNA, 20 bp, Artificial Sequence
  chemically synthesized
caggagaactgcttgaagct

SEQ ID NO: 427055 - DNA, 20 bp, Artificial Sequence
  chemically synthesized
acaggagaactgcttgaagc

SEQ ID NO: 427056 - DNA, 20 bp, Artificial Sequence
  chemically synthesized
ctccgcctcccagcttcaag

SEQ ID NO: 427057 - DNA, 20 bp, Artificial Sequence
  chemically synthesized
tgagacaggagaactgcttg

SEQ ID NO: 427058 - DNA, 20 bp, Artificial Sequence
  chemically synthesized
ttcaagcagttctcctgtct

SEQ ID NO: 427059 - DNA, 20 bp, Artificial Sequence
  chemically synthesized
tacttgggaggctgagacag

SEQ ID NO: 427060 - DNA, 20 bp, Artificial Sequence
  chemically synthesized
gctacttgggaggctgagac

SEQ ID NO: 427061 - DNA, 20 bp, Artificial Sequence
  chemically synthesized
agctacttgggaggctgaga

SEQ ID NO: 427062 - DNA, 20 bp, Artificial Sequence
  chemically synthesized
tcccagctacttgggaggct

SEQ ID NO: 427063 - DNA, 20 bp, Artificial Sequence
  chemically synthesized
ttctcctgtctcagcctccc

SEQ ID NO: 427064 - DNA, 20 bp, Artificial Sequence
  chemically synthesized
tcctgtctcagcctcccaag

SEQ ID NO: 427065 - DNA, 20 bp, Artificial Sequence
  chemically synthesized
tgtaatcccagctacttggg

SEQ ID NO: 427066 - DNA, 20 bp, Artificial Sequence
  chemically synthesized
ctgtaatcccagctacttgg

SEQ ID NO: 427067 - DNA, 20 bp, Artificial Sequence
  chemically synthesized
gtctcagcctcccaagtagc

SEQ ID NO: 427068 - DNA, 20 bp, Artificial Sequence
  chemically synthesized
gcctgtaatcccagctactt

SEQ ID NO: 427069 - DNA, 20 bp, Artificial Sequence
  chemically synthesized
tctcagcctcccaagtagct

SEQ ID NO: 427070 - DNA, 20 bp, Artificial Sequence
  chemically synthesized
tgcctgtaatcccagctact

SEQ ID NO: 427071 - DNA, 20 bp, Artificial Sequence
  chemically synthesized
ctcccaagtagctgggatta

SEQ ID NO: 427072 - DNA, 20 bp, Artificial Sequence
  chemically synthesized
tcccaagtagctgggattac

SEQ ID NO: 427073 - DNA, 20 bp, Artificial Sequence
  chemically synthesized
gtggcacatgcctgtaatcc

SEQ ID NO: 427074 - DNA, 20 bp, Artificial Sequence
  chemically synthesized
caggcatgtgccaccatgct

SEQ ID NO: 427075 - DNA, 20 bp, Artificial Sequence
  chemically synthesized
gcaaaattagccgagcatgg

SEQ ID NO: 427076 - DNA, 20 bp, Artificial Sequence
  chemically synthesized
aacgcaaaattagccgagca

SEQ ID NO: 427077 - DNA, 20 bp, Artificial Sequence
  chemically synthesized
ctaaaaacgcaaaattagcc

SEQ ID NO: 427078 - DNA, 20 bp, Artificial Sequence
  chemically synthesized
ctctactaaaaacgcaaaat

SEQ ID NO: 427079 - DNA, 20 bp, Artificial Sequence
  chemically synthesized
ctcggctaattttgcgtttt

SEQ ID NO: 427080 - DNA, 20 bp, Artificial Sequence
  chemically synthesized
ggctaattttgcgtttttag

SEQ ID NO: 427081 - DNA, 20 bp, Artificial Sequence
  chemically synthesized
ctaattttgcgtttttagta

SEQ ID NO: 427082 - DNA, 20 bp, Artificial Sequence
  chemically synthesized
ttttgcgtttttagtagaga

SEQ ID NO: 427083 - DNA, 20 bp, Artificial Sequence
  chemically synthesized
tttgcgtttttagtagagaa

SEQ ID NO: 427084 - DNA, 20 bp, Artificial Sequence
  chemically synthesized
ttgcgtttttagtagagaaa

SEQ ID NO: 427085 - DNA, 20 bp, Artificial Sequence
  chemically synthesized
aagggtttcaccatgttgat

SEQ ID NO: 427086 - DNA, 20 bp, Artificial Sequence
  chemically synthesized
ccagaccagcctgatcaaca

SEQ ID NO: 427087 - DNA, 20 bp, Artificial Sequence
  chemically synthesized
agggtttcaccatgttgatc

SEQ ID NO: 427088 - DNA, 20 bp, Artificial Sequence
  chemically synthesized
tttcaccatgttgatcaggc

SEQ ID NO: 427089 - DNA, 20 bp, Artificial Sequence
  chemically synthesized
ccatgttgatcaggctggtc

SEQ ID NO: 427090 - DNA, 20 bp, Artificial Sequence
  chemically synthesized
tgaggtcaggagttccagac

SEQ ID NO: 427091 - DNA, 20 bp, Artificial Sequence
  chemically synthesized
tcacctgaggtcaggagttc

SEQ ID NO: 427092 - DNA, 20 bp, Artificial Sequence
  chemically synthesized
tggtctggaactcctgacct

SEQ ID NO: 427093 - DNA, 20 bp, Artificial Sequence
  chemically synthesized
ggtggatcacctgaggtcag

SEQ ID NO: 427094 - DNA, 20 bp, Artificial Sequence
  chemically synthesized
ggtctggaactcctgacctc

SEQ ID NO: 427095 - DNA, 20 bp, Artificial Sequence
  chemically synthesized
cgggtggatcacctgaggtc

SEQ ID NO: 427096 - DNA, 20 bp, Artificial Sequence
  chemically synthesized
gcgggtggatcacctgaggt

SEQ ID NO: 427097 - DNA, 20 bp, Artificial Sequence
  chemically synthesized
caaggcgggtggatcacctg

SEQ ID NO: 427098 - DNA, 20 bp, Artificial Sequence
  chemically synthesized
ccaaggcgggtggatcacct

SEQ ID NO: 427099 - DNA, 20 bp, Artificial Sequence
  chemically synthesized
ctcaggtgatccacccgcct

SEQ ID NO: 427100 - DNA, 20 bp, Artificial Sequence
  chemically synthesized
ctttgggaggccaaggcggg

SEQ ID NO: 427101 - DNA, 20 bp, Artificial Sequence
  chemically synthesized
gtactttgggaggccaaggc

SEQ ID NO: 427102 - DNA, 20 bp, Artificial Sequence
  chemically synthesized
agtactttgggaggccaagg

SEQ ID NO: 427103 - DNA, 20 bp, Artificial Sequence
  chemically synthesized
cccagtactttgggaggcca

SEQ ID NO: 427104 - DNA, 20 bp, Artificial Sequence
  chemically synthesized
tcccagtactttgggaggcc

SEQ ID NO: 427105 - DNA, 20 bp, Artificial Sequence
  chemically synthesized
ccacccgccttggcctccca

SEQ ID NO: 427106 - DNA, 20 bp, Artificial Sequence
  chemically synthesized
tgtaatcccagtactttggg

SEQ ID NO: 427107 - DNA, 20 bp, Artificial Sequence
  chemically synthesized
ctgtaatcccagtactttgg

SEQ ID NO: 427108 - DNA, 20 bp, Artificial Sequence
  chemically synthesized
gccttggcctcccaaagtac

SEQ ID NO: 427109 - DNA, 20 bp, Artificial Sequence
  chemically synthesized
gcctgtaatcccagtacttt

SEQ ID NO: 427110 - DNA, 20 bp, Artificial Sequence
  chemically synthesized
ccttggcctcccaaagtact

SEQ ID NO: 427111 - DNA, 20 bp, Artificial Sequence
  chemically synthesized
cgcctgtaatcccagtactt

SEQ ID NO: 427112 - DNA, 20 bp, Artificial Sequence
  chemically synthesized
ctcccaaagtactgggatta

SEQ ID NO: 427113 - DNA, 20 bp, Artificial Sequence
  chemically synthesized
tcccaaagtactgggattac

SEQ ID NO: 427114 - DNA, 20 bp, Artificial Sequence
  chemically synthesized
gcggctcacgcctgtaatcc

SEQ ID NO: 427115 - DNA, 20 bp, Artificial Sequence
  chemically synthesized
agtactgggattacaggcgt

SEQ ID NO: 427116 - DNA, 20 bp, Artificial Sequence
  chemically synthesized
caggcgtgagccgctgtgcc

SEQ ID NO: 427117 - DNA, 20 bp, Artificial Sequence
  chemically synthesized
aaaagcctcgccgggcacag

SEQ ID NO: 427118 - DNA, 20 bp, Artificial Sequence
  chemically synthesized
tttaaaagcctcgccgggca

SEQ ID NO: 427119 - DNA, 20 bp, Artificial Sequence
  chemically synthesized
cgtgagccgctgtgcccggc

SEQ ID NO: 427120 - DNA, 20 bp, Artificial Sequence
  chemically synthesized
gtgagccgctgtgcccggcg

SEQ ID NO: 427121 - DNA, 20 bp, Artificial Sequence
  chemically synthesized
accaatttaaaagcctcgcc

SEQ ID NO: 427122 - DNA, 20 bp, Artificial Sequence
  chemically synthesized
caccaatttaaaagcctcgc

SEQ ID NO: 427123 - DNA, 20 bp, Artificial Sequence
  chemically synthesized
gcccggcgaggcttttaaat

SEQ ID NO: 427124 - DNA, 20 bp, Artificial Sequence
  chemically synthesized
tggcattttcaccaatttaa

SEQ ID NO: 427125 - DNA, 20 bp, Artificial Sequence
  chemically synthesized
caaagtaaaaattgaatggt

SEQ ID NO: 427126 - DNA, 20 bp, Artificial Sequence
  chemically synthesized
tattcaaagtaaaaattgaa

SEQ ID NO: 427127 - DNA, 20 bp, Artificial Sequence
  chemically synthesized
acttcagttttgattattca

SEQ ID NO: 427128 - DNA, 20 bp, Artificial Sequence
  chemically synthesized
actttgaataatcaaaactg

SEQ ID NO: 427129 - DNA, 20 bp, Artificial Sequence
  chemically synthesized
aatcactacttgaatcactt

SEQ ID NO: 427130 - DNA, 20 bp, Artificial Sequence
  chemically synthesized
aatcaaaactgaagtgattc

SEQ ID NO: 427131 - DNA, 20 bp, Artificial Sequence
  chemically synthesized
caaaactgaagtgattcaag

SEQ ID NO: 427132 - DNA, 20 bp, Artificial Sequence
  chemically synthesized
tcaagtagtgattcatcatc

SEQ ID NO: 427133 - DNA, 20 bp, Artificial Sequence
  chemically synthesized
attgctgtgctagattacac

SEQ ID NO: 427134 - DNA, 20 bp, Artificial Sequence
  chemically synthesized
attcatcatccagtgtaatc

SEQ ID NO: 427135 - DNA, 20 bp, Artificial Sequence
  chemically synthesized
tcatccagtgtaatctagca

SEQ ID NO: 427136 - DNA, 20 bp, Artificial Sequence
  chemically synthesized
caaaatctccattgctgtgc

SEQ ID NO: 427137 - DNA, 20 bp, Artificial Sequence
  chemically synthesized
agtgtaatctagcacagcaa

SEQ ID NO: 427138 - DNA, 20 bp, Artificial Sequence
  chemically synthesized
tgtaatctagcacagcaatg

SEQ ID NO: 427139 - DNA, 20 bp, Artificial Sequence
  chemically synthesized
attttgtgtgaaacatacca

SEQ ID NO: 427140 - DNA, 20 bp, Artificial Sequence
  chemically synthesized
ttttgtgtgaaacataccaa

SEQ ID NO: 427141 - DNA, 20 bp, Artificial Sequence
  chemically synthesized
gtgtgaaacataccaaagga

SEQ ID NO: 427142 - DNA, 20 bp, Artificial Sequence
  chemically synthesized
tgtgaaacataccaaaggaa

SEQ ID NO: 427143 - DNA, 20 bp, Artificial Sequence
  chemically synthesized
aaaaccccaaacctttcctt

SEQ ID NO: 427144 - DNA, 20 bp, Artificial Sequence
  chemically synthesized
aacataccaaaggaaaggtt

SEQ ID NO: 427145 - DNA, 20 bp, Artificial Sequence
  chemically synthesized
acataccaaaggaaaggttt

SEQ ID NO: 427146 - DNA, 20 bp, Artificial Sequence
  chemically synthesized
cataccaaaggaaaggtttg

SEQ ID NO: 427147 - DNA, 20 bp, Artificial Sequence
  chemically synthesized
ttgcgtaattgactaattct

SEQ ID NO: 427148 - DNA, 20 bp, Artificial Sequence
  chemically synthesized
tgcgtaattgactaattctt

SEQ ID NO: 427149 - DNA, 20 bp, Artificial Sequence
  chemically synthesized
ggaaggaggtgcccaagaat

SEQ ID NO: 427150 - DNA, 20 bp, Artificial Sequence
  chemically synthesized
attgagggaaggaggtgccc

SEQ ID NO: 427151 - DNA, 20 bp, Artificial Sequence
  chemically synthesized
tatctttgattgagggaagg

SEQ ID NO: 427152 - DNA, 20 bp, Artificial Sequence
  chemically synthesized
gtatctttgattgagggaag

SEQ ID NO: 427153 - DNA, 20 bp, Artificial Sequence
  chemically synthesized
atgtatctttgattgaggga

SEQ ID NO: 427154 - DNA, 20 bp, Artificial Sequence
  chemically synthesized
gatgtatctttgattgaggg

SEQ ID NO: 427155 - DNA, 20 bp, Artificial Sequence
  chemically synthesized
gcacctccttccctcaatca

SEQ ID NO: 427156 - DNA, 20 bp, Artificial Sequence
  chemically synthesized
gatgatgtatctttgattga

SEQ ID NO: 427157 - DNA, 20 bp, Artificial Sequence
  chemically synthesized
agatgatgtatctttgattg

SEQ ID NO: 427158 - DNA, 20 bp, Artificial Sequence
  chemically synthesized
cagatgatgtatctttgatt

SEQ ID NO: 427159 - DNA, 20 bp, Artificial Sequence
  chemically synthesized
tcaaagatacatcatctgaa

SEQ ID NO: 427160 - DNA, 20 bp, Artificial Sequence
  chemically synthesized
gggggaggctgtgaactatt

SEQ ID NO: 427161 - DNA, 20 bp, Artificial Sequence
  chemically synthesized
tacatcatctgaatagttca

SEQ ID NO: 427162 - DNA, 20 bp, Artificial Sequence
  chemically synthesized
cactttcatttattcggggg

SEQ ID NO: 427163 - DNA, 20 bp, Artificial Sequence
  chemically synthesized
tcactttcatttattcgggg

SEQ ID NO: 427164 - DNA, 20 bp, Artificial Sequence
  chemically synthesized
tgtcactttcatttattcgg

SEQ ID NO: 427165 - DNA, 20 bp, Artificial Sequence
  chemically synthesized
ctgtcactttcatttattcg

SEQ ID NO: 427166 - DNA, 20 bp, Artificial Sequence
  chemically synthesized
cctgtcactttcatttattc

SEQ ID NO: 427167 - DNA, 20 bp, Artificial Sequence
  chemically synthesized
gcctgtcactttcatttatt

SEQ ID NO: 427168 - DNA, 20 bp, Artificial Sequence
  chemically synthesized
agcctcccccgaataaatga

SEQ ID NO: 427169 - DNA, 20 bp, Artificial Sequence
  chemically synthesized
ccccgaataaatgaaagtga

SEQ ID NO: 427170 - DNA, 20 bp, Artificial Sequence
  chemically synthesized
cccgaataaatgaaagtgac

SEQ ID NO: 427171 - DNA, 20 bp, Artificial Sequence
  chemically synthesized
gcgtcaaattaagaaataca

SEQ ID NO: 427172 - DNA, 20 bp, Artificial Sequence
  chemically synthesized
aggcgtcaaattaagaaata

SEQ ID NO: 427173 - DNA, 20 bp, Artificial Sequence
  chemically synthesized
tctttgaaaggcgtcaaatt

SEQ ID NO: 427174 - DNA, 20 bp, Artificial Sequence
  chemically synthesized
tcttaatttgacgcctttca

SEQ ID NO: 427175 - DNA, 20 bp, Artificial Sequence
  chemically synthesized
ccattaaccttatctttgaa

SEQ ID NO: 427176 - DNA, 20 bp, Artificial Sequence
  chemically synthesized
tccattaaccttatctttga

SEQ ID NO: 427177 - DNA, 20 bp, Artificial Sequence
  chemically synthesized
atttgacgcctttcaaagat

SEQ ID NO: 427178 - DNA, 20 bp, Artificial Sequence
  chemically synthesized
tttgacgcctttcaaagata

SEQ ID NO: 427179 - DNA, 20 bp, Artificial Sequence
  chemically synthesized
cctttcaaagataaggttaa

SEQ ID NO: 427180 - DNA, 20 bp, Artificial Sequence
  chemically synthesized
aagataaggttaatggaatt

SEQ ID NO: 427181 - DNA, 20 bp, Artificial Sequence
  chemically synthesized
aatggaattaagtaaccata

SEQ ID NO: 427182 - DNA, 20 bp, Artificial Sequence
  chemically synthesized
ttaatttacaataatcttta

SEQ ID NO: 427183 - DNA, 20 bp, Artificial Sequence
  chemically synthesized
taaattaaatgttatatcct

SEQ ID NO: 427184 - DNA, 20 bp, Artificial Sequence
  chemically synthesized
taaattaactcagacatcta

SEQ ID NO: 427185 - DNA, 20 bp, Artificial Sequence
  chemically synthesized
ttaaattaactcagacatct

SEQ ID NO: 427186 - DNA, 20 bp, Artificial Sequence
  chemically synthesized
tgttatatccttagatgtct

SEQ ID NO: 427187 - DNA, 20 bp, Artificial Sequence
  chemically synthesized
tgaaatgcattaaattaact

SEQ ID NO: 427188 - DNA, 20 bp, Artificial Sequence
  chemically synthesized
taatgcatttcaataaatat

SEQ ID NO: 427189 - DNA, 20 bp, Artificial Sequence
  chemically synthesized
aatgcatttcaataaatatg

SEQ ID NO: 427190 - DNA, 20 bp, Artificial Sequence
  chemically synthesized
catttcaataaatatgaggt

SEQ ID NO: 427191 - DNA, 20 bp, Artificial Sequence
  chemically synthesized
atttcaataaatatgaggtt

SEQ ID NO: 427192 - DNA, 20 bp, Artificial Sequence
  chemically synthesized
atgaggttaggaaacataaa

SEQ ID NO: 427193 - DNA, 20 bp, Artificial Sequence
  chemically synthesized
tgaggttaggaaacataaaa

SEQ ID NO: 427194 - DNA, 20 bp, Artificial Sequence
  chemically synthesized
aacataaaaaggaaaattta

SEQ ID NO: 427195 - DNA, 20 bp, Artificial Sequence
  chemically synthesized
atttatggtactaatttaaa

SEQ ID NO: 427196 - DNA, 20 bp, Artificial Sequence
  chemically synthesized
tggaaaggtaccatttaaat

SEQ ID NO: 427197 - DNA, 20 bp, Artificial Sequence
  chemically synthesized
cacgcacaagagatgtggaa

SEQ ID NO: 427198 - DNA, 20 bp, Artificial Sequence
  chemically synthesized
gcacgcacaagagatgtgga

SEQ ID NO: 427199 - DNA, 20 bp, Artificial Sequence
  chemically synthesized
tttagcacgcacaagagatg

SEQ ID NO: 427200 - DNA, 20 bp, Artificial Sequence
  chemically synthesized
ctatgctttagcacgcacaa

SEQ ID NO: 427201 - DNA, 20 bp, Artificial Sequence
  chemically synthesized
gcctatgctttagcacgcac

SEQ ID NO: 427202 - DNA, 20 bp, Artificial Sequence
  chemically synthesized
cacatctcttgtgcgtgcta

SEQ ID NO: 427203 - DNA, 20 bp, Artificial Sequence
  chemically synthesized
ctcttgtgcgtgctaaagca

SEQ ID NO: 427204 - DNA, 20 bp, Artificial Sequence
  chemically synthesized
tcttgtgcgtgctaaagcat

SEQ ID NO: 427205 - DNA, 20 bp, Artificial Sequence
  chemically synthesized
aaacataaaagcctatgctt

SEQ ID NO: 427206 - DNA, 20 bp, Artificial Sequence
  chemically synthesized
ttgtgagttgacaaacataa

SEQ ID NO: 427207 - DNA, 20 bp, Artificial Sequence
  chemically synthesized
ttccctgcaacaatatttgt

SEQ ID NO: 427208 - DNA, 20 bp, Artificial Sequence
  chemically synthesized
tcaactcacaaatattgttg

SEQ ID NO: 427209 - DNA, 20 bp, Artificial Sequence
  chemically synthesized
caactcacaaatattgttgc

SEQ ID NO: 427210 - DNA, 20 bp, Artificial Sequence
  chemically synthesized
aactcacaaatattgttgca

SEQ ID NO: 427211 - DNA, 20 bp, Artificial Sequence
  chemically synthesized
tcacaaatattgttgcaggg

SEQ ID NO: 427212 - DNA, 20 bp, Artificial Sequence
  chemically synthesized
acaaatattgttgcagggaa

SEQ ID NO: 427213 - DNA, 20 bp, Artificial Sequence
  chemically synthesized
atattgttgcagggaagaga

SEQ ID NO: 427214 - DNA, 20 bp, Artificial Sequence
  chemically synthesized
attgttgcagggaagagata

SEQ ID NO: 427215 - DNA, 20 bp, Artificial Sequence
  chemically synthesized
ttgttgcagggaagagatag

SEQ ID NO: 427216 - DNA, 20 bp, Artificial Sequence
  chemically synthesized
agggaagagatagaggtccc

SEQ ID NO: 427217 - DNA, 20 bp, Artificial Sequence
  chemically synthesized
ccatattcttaagacaactt

SEQ ID NO: 427218 - DNA, 20 bp, Artificial Sequence
  chemically synthesized
tccatattcttaagacaact

SEQ ID NO: 427219 - DNA, 20 bp, Artificial Sequence
  chemically synthesized
tagaggtcccaagttgtctt

SEQ ID NO: 427220 - DNA, 20 bp, Artificial Sequence
  chemically synthesized
cccaagttgtcttaagaata

SEQ ID NO: 427221 - DNA, 20 bp, Artificial Sequence
  chemically synthesized
acatctgactccatattctt

SEQ ID NO: 427222 - DNA, 20 bp, Artificial Sequence
  chemically synthesized
caagttgtcttaagaatatg

SEQ ID NO: 427223 - DNA, 20 bp, Artificial Sequence
  chemically synthesized
ttgtcttaagaatatggagt

SEQ ID NO: 427224 - DNA, 20 bp, Artificial Sequence
  chemically synthesized
agaatatggagtcagatgtt

SEQ ID NO: 427225 - DNA, 20 bp, Artificial Sequence
  chemically synthesized
tcagatgttcagtatgattt

SEQ ID NO: 427226 - DNA, 20 bp, Artificial Sequence
  chemically synthesized
cagatgttcagtatgatttt

SEQ ID NO: 427227 - DNA, 20 bp, Artificial Sequence
  chemically synthesized
gttcagtatgattttaggaa

SEQ ID NO: 427228 - DNA, 20 bp, Artificial Sequence
  chemically synthesized
tatgactatttcatttcata

SEQ ID NO: 427229 - DNA, 20 bp, Artificial Sequence
  chemically synthesized
aacagccatatgaaatgaaa

SEQ ID NO: 427230 - DNA, 20 bp, Artificial Sequence
  chemically synthesized
catatgaaatgaaatagtca

SEQ ID NO: 427231 - DNA, 20 bp, Artificial Sequence
  chemically synthesized
tgatgtttaacaatagttca

SEQ ID NO: 427232 - DNA, 20 bp, Artificial Sequence
  chemically synthesized
cctctattgatgtttaacaa

SEQ ID NO: 427233 - DNA, 20 bp, Artificial Sequence
  chemically synthesized
gaactattgttaaacatcaa

SEQ ID NO: 427234 - DNA, 20 bp, Artificial Sequence
  chemically synthesized
actattgttaaacatcaata

SEQ ID NO: 427235 - DNA, 20 bp, Artificial Sequence
  chemically synthesized
ctattgttaaacatcaatag

SEQ ID NO: 427236 - DNA, 20 bp, Artificial Sequence
  chemically synthesized
tattgttaaacatcaataga

SEQ ID NO: 427237 - DNA, 20 bp, Artificial Sequence
  chemically synthesized
ttgttaaacatcaatagagg

SEQ ID NO: 427238 - DNA, 20 bp, Artificial Sequence
  chemically synthesized
tgttaaacatcaatagaggg

SEQ ID NO: 427239 - DNA, 20 bp, Artificial Sequence
  chemically synthesized
gttaaacatcaatagaggga

SEQ ID NO: 427240 - DNA, 20 bp, Artificial Sequence
  chemically synthesized
atagagggagggtacataaa

SEQ ID NO: 427241 - DNA, 20 bp, Artificial Sequence
  chemically synthesized
gagggagggtacataaatag

SEQ ID NO: 427242 - DNA, 20 bp, Artificial Sequence
  chemically synthesized
cataaatagaagttaatcac

SEQ ID NO: 427243 - DNA, 20 bp, Artificial Sequence
  chemically synthesized
tcacaagtaaaataacctaa

SEQ ID NO: 427244 - DNA, 20 bp, Artificial Sequence
  chemically synthesized
taataaaaataatcactgtt

SEQ ID NO: 427245 - DNA, 20 bp, Artificial Sequence
  chemically synthesized
ataataaaaataatcactgt

SEQ ID NO: 427246 - DNA, 20 bp, Artificial Sequence
  chemically synthesized
tttttattatcataatcatc

SEQ ID NO: 427247 - DNA, 20 bp, Artificial Sequence
  chemically synthesized
ttttattatcataatcatca

SEQ ID NO: 427248 - DNA, 20 bp, Artificial Sequence
  chemically synthesized
attatcataatcatcaaggt

SEQ ID NO: 427249 - DNA, 20 bp, Artificial Sequence
  chemically synthesized
aatcatcaaggttagattta

SEQ ID NO: 427250 - DNA, 20 bp, Artificial Sequence
  chemically synthesized
tcatcaaggttagatttaca

SEQ ID NO: 427251 - DNA, 20 bp, Artificial Sequence
  chemically synthesized
ctcactaaaccaacatagaa

SEQ ID NO: 427252 - DNA, 20 bp, Artificial Sequence
  chemically synthesized
aaacaaatgcttttctatgt

SEQ ID NO: 427253 - DNA, 20 bp, Artificial Sequence
  chemically synthesized
aaatactcactaaaccaaca

SEQ ID NO: 427254 - DNA, 20 bp, Artificial Sequence
  chemically synthesized
aatgcttttctatgttggtt

SEQ ID NO: 427255 - DNA, 20 bp, Artificial Sequence
  chemically synthesized
cttttctatgttggtttagt

SEQ ID NO: 427256 - DNA, 20 bp, Artificial Sequence
  chemically synthesized
tggtttagtgagtattttca

SEQ ID NO: 427257 - DNA, 20 bp, Artificial Sequence
  chemically synthesized
aagaaaaactaaaatacata

SEQ ID NO: 427258 - DNA, 20 bp, Artificial Sequence
  chemically synthesized
tttcacagctatatgtattt

SEQ ID NO: 427259 - DNA, 20 bp, Artificial Sequence
  chemically synthesized
ttaatatatataaaaattta

SEQ ID NO: 427260 - DNA, 20 bp, Artificial Sequence
  chemically synthesized
aaatttttatatatattaac

SEQ ID NO: 427261 - DNA, 20 bp, Artificial Sequence
  chemically synthesized
gtgaagtttgtattatgttc

SEQ ID NO: 427262 - DNA, 20 bp, Artificial Sequence
  chemically synthesized
acataatacaaacttcactt

SEQ ID NO: 427263 - DNA, 20 bp, Artificial Sequence
  chemically synthesized
gtaattctagtaccaaagtg

SEQ ID NO: 427264 - DNA, 20 bp, Artificial Sequence
  chemically synthesized
tacaaacttcactttggtac

SEQ ID NO: 427265 - DNA, 20 bp, Artificial Sequence
  chemically synthesized
aaaatgtaattctagtacca

SEQ ID NO: 427266 - DNA, 20 bp, Artificial Sequence
  chemically synthesized
tggttttaaaaatgtaattc

SEQ ID NO: 427267 - DNA, 20 bp, Artificial Sequence
  chemically synthesized
tgtaaaaattataacgttaa

SEQ ID NO: 427268 - DNA, 20 bp, Artificial Sequence
  chemically synthesized
attaacgttataatttttac

SEQ ID NO: 427269 - DNA, 20 bp, Artificial Sequence
  chemically synthesized
ttaacgttataatttttaca

SEQ ID NO: 427270 - DNA, 20 bp, Artificial Sequence
  chemically synthesized
aacgttataatttttacaag

SEQ ID NO: 427271 - DNA, 20 bp, Artificial Sequence
  chemically synthesized
ttataatttttacaaggaga

SEQ ID NO: 427272 - DNA, 20 bp, Artificial Sequence
  chemically synthesized
tataatttttacaaggagaa

SEQ ID NO: 427273 - DNA, 20 bp, Artificial Sequence
  chemically synthesized
tattatattattatcaatat

SEQ ID NO: 427274 - DNA, 20 bp, Artificial Sequence
  chemically synthesized
attatcaatattggttatct

SEQ ID NO: 427275 - DNA, 20 bp, Artificial Sequence
  chemically synthesized
aagtattaagcacagtttct

SEQ ID NO: 427276 - DNA, 20 bp, Artificial Sequence
  chemically synthesized
catgagaaaagtattaagca

SEQ ID NO: 427277 - DNA, 20 bp, Artificial Sequence
  chemically synthesized
gttgccatgagaaaagtatt

SEQ ID NO: 427278 - DNA, 20 bp, Artificial Sequence
  chemically synthesized
tgtgcttaatacttttctca

SEQ ID NO: 427279 - DNA, 20 bp, Artificial Sequence
  chemically synthesized
ttcataagttgccatgagaa

SEQ ID NO: 427280 - DNA, 20 bp, Artificial Sequence
  chemically synthesized
aagacttcataagttgccat

SEQ ID NO: 427281 - DNA, 20 bp, Artificial Sequence
  chemically synthesized
ttttctcatggcaacttatg

SEQ ID NO: 427282 - DNA, 20 bp, Artificial Sequence
  chemically synthesized
gattataataaagacttcat

SEQ ID NO: 427283 - DNA, 20 bp, Artificial Sequence
  chemically synthesized
taaataaaatgattataata

SEQ ID NO: 427284 - DNA, 20 bp, Artificial Sequence
  chemically synthesized
attataatcattttatttat

SEQ ID NO: 427285 - DNA, 20 bp, Artificial Sequence
  chemically synthesized
ttataatcattttatttata

SEQ ID NO: 427286 - DNA, 20 bp, Artificial Sequence
  chemically synthesized
attttatttataaggcaatt

SEQ ID NO: 427287 - DNA, 20 bp, Artificial Sequence
  chemically synthesized
tttataaggcaattgagtct

SEQ ID NO: 427288 - DNA, 20 bp, Artificial Sequence
  chemically synthesized
taaggcaattgagtcttaga

SEQ ID NO: 427289 - DNA, 20 bp, Artificial Sequence
  chemically synthesized
aaggcaattgagtcttagaa

SEQ ID NO: 427290 - DNA, 20 bp, Artificial Sequence
  chemically synthesized
actatctatttaacctttct

SEQ ID NO: 427291 - DNA, 20 bp, Artificial Sequence
  chemically synthesized
tgagtcttagaaaggttaaa

SEQ ID NO: 427292 - DNA, 20 bp, Artificial Sequence
  chemically synthesized
tcttagaaaggttaaataga

SEQ ID NO: 427293 - DNA, 20 bp, Artificial Sequence
  chemically synthesized
aaaggttaaatagatagtat

SEQ ID NO: 427294 - DNA, 20 bp, Artificial Sequence
  chemically synthesized
aaggttaaatagatagtata

SEQ ID NO: 427295 - DNA, 20 bp, Artificial Sequence
  chemically synthesized
atagtataaggtcatccttc

SEQ ID NO: 427296 - DNA, 20 bp, Artificial Sequence
  chemically synthesized
tttgtcactcattttctaga

SEQ ID NO: 427297 - DNA, 20 bp, Artificial Sequence
  chemically synthesized
atttgtcactcattttctag

SEQ ID NO: 427298 - DNA, 20 bp, Artificial Sequence
  chemically synthesized
aggtcatccttctagaaaat

SEQ ID NO: 427299 - DNA, 20 bp, Artificial Sequence
  chemically synthesized
taaatttgtcactcattttc

SEQ ID NO: 427300 - DNA, 20 bp, Artificial Sequence
  chemically synthesized
atgagtgacaaatttaaact

SEQ ID NO: 427301 - DNA, 20 bp, Artificial Sequence
  chemically synthesized
aataagcttagaaatcatct

SEQ ID NO: 427302 - DNA, 20 bp, Artificial Sequence
  chemically synthesized
tttaaacttagatgatttct

SEQ ID NO: 427303 - DNA, 20 bp, Artificial Sequence
  chemically synthesized
tacagtcaaaagaataagct

SEQ ID NO: 427304 - DNA, 20 bp, Artificial Sequence
  chemically synthesized
aatgctacagtcaaaagaat

SEQ ID NO: 427305 - DNA, 20 bp, Artificial Sequence
  chemically synthesized
taagcttattcttttgactg

SEQ ID NO: 427306 - DNA, 20 bp, Artificial Sequence
  chemically synthesized
taatataatgctacagtcaa

SEQ ID NO: 427307 - DNA, 20 bp, Artificial Sequence
  chemically synthesized
aggaacataatataatgcta

SEQ ID NO: 427308 - DNA, 20 bp, Artificial Sequence
  chemically synthesized
agcattatattatgttcctg

SEQ ID NO: 427309 - DNA, 20 bp, Artificial Sequence
  chemically synthesized
atattatgttcctgtagtta

SEQ ID NO: 427310 - DNA, 20 bp, Artificial Sequence
  chemically synthesized
ttatattattctgtaactac

SEQ ID NO: 427311 - DNA, 20 bp, Artificial Sequence
  chemically synthesized
gttatattattctgtaacta

SEQ ID NO: 427312 - DNA, 20 bp, Artificial Sequence
  chemically synthesized
agttacagaataatataaca

SEQ ID NO: 427313 - DNA, 20 bp, Artificial Sequence
  chemically synthesized
ataacacagtgtccaaaaac

SEQ ID NO: 427314 - DNA, 20 bp, Artificial Sequence
  chemically synthesized
ataaaatgatttctagtttt

SEQ ID NO: 427315 - DNA, 20 bp, Artificial Sequence
  chemically synthesized
taagggaataaaatgatttc

SEQ ID NO: 427316 - DNA, 20 bp, Artificial Sequence
  chemically synthesized
aatcattttattcccttatt

SEQ ID NO: 427317 - DNA, 20 bp, Artificial Sequence
  chemically synthesized
atcattttattcccttattt

SEQ ID NO: 427318 - DNA, 20 bp, Artificial Sequence
  chemically synthesized
tcattttattcccttattta

SEQ ID NO: 427319 - DNA, 20 bp, Artificial Sequence
  chemically synthesized
cagccctctaccctaaataa

SEQ ID NO: 427320 - DNA, 20 bp, Artificial Sequence
  chemically synthesized
tcagccctctaccctaaata

SEQ ID NO: 427321 - DNA, 20 bp, Artificial Sequence
  chemically synthesized
atcagccctctaccctaaat

SEQ ID NO: 427322 - DNA, 20 bp, Artificial Sequence
  chemically synthesized
ttttattcccttatttaggg

SEQ ID NO: 427323 - DNA, 20 bp, Artificial Sequence
  chemically synthesized
ttattcccttatttagggta

SEQ ID NO: 427324 - DNA, 20 bp, Artificial Sequence
  chemically synthesized
tattcccttatttagggtag

SEQ ID NO: 427325 - DNA, 20 bp, Artificial Sequence
  chemically synthesized
attcccttatttagggtaga

SEQ ID NO: 427326 - DNA, 20 bp, Artificial Sequence
  chemically synthesized
tttattgccaaggttattat

SEQ ID NO: 427327 - DNA, 20 bp, Artificial Sequence
  chemically synthesized
tagagggctgataataacct

SEQ ID NO: 427328 - DNA, 20 bp, Artificial Sequence
  chemically synthesized
tttgggtttttttattgcca

SEQ ID NO: 427329 - DNA, 20 bp, Artificial Sequence
  chemically synthesized
ttttgggtttttttattgcc

SEQ ID NO: 427330 - DNA, 20 bp, Artificial Sequence
  chemically synthesized
gaactgtgacagtaggtttt

SEQ ID NO: 427331 - DNA, 20 bp, Artificial Sequence
  chemically synthesized
agaactgtgacagtaggttt

SEQ ID NO: 427332 - DNA, 20 bp, Artificial Sequence
  chemically synthesized
aaacccaaaacctactgtca

SEQ ID NO: 427333 - DNA, 20 bp, Artificial Sequence
  chemically synthesized
acagtaagaactgtgacagt

SEQ ID NO: 427334 - DNA, 20 bp, Artificial Sequence
  chemically synthesized
aacagtaagaactgtgacag

SEQ ID NO: 427335 - DNA, 20 bp, Artificial Sequence
  chemically synthesized
atcaacagtaagaactgtga

SEQ ID NO: 427336 - DNA, 20 bp, Artificial Sequence
  chemically synthesized
ttattaaaaccatcaacagt

SEQ ID NO: 427337 - DNA, 20 bp, Artificial Sequence
  chemically synthesized
gtcacagttcttactgttga

SEQ ID NO: 427338 - DNA, 20 bp, Artificial Sequence
  chemically synthesized
tcttttattaaaaccatcaa

SEQ ID NO: 427339 - DNA, 20 bp, Artificial Sequence
  chemically synthesized
actgttgatggttttaataa

SEQ ID NO: 427340 - DNA, 20 bp, Artificial Sequence
  chemically synthesized
ataaaagaaaaaatgtcttt

SEQ ID NO: 427341 - DNA, 20 bp, Artificial Sequence
  chemically synthesized
taaaagaaaaaatgtctttg

SEQ ID NO: 427342 - DNA, 20 bp, Artificial Sequence
  chemically synthesized
cacataaaaggaaaacctca

SEQ ID NO: 427343 - DNA, 20 bp, Artificial Sequence
  chemically synthesized
tttgaggttttccttttatg

SEQ ID NO: 427344 - DNA, 20 bp, Artificial Sequence
  chemically synthesized
aataccagatgccacataaa

SEQ ID NO: 427345 - DNA, 20 bp, Artificial Sequence
  chemically synthesized
aaataccagatgccacataa

SEQ ID NO: 427346 - DNA, 20 bp, Artificial Sequence
  chemically synthesized
ttttccttttatgtggcatc

SEQ ID NO: 427347 - DNA, 20 bp, Artificial Sequence
  chemically synthesized
tcatggatataggcaaatac

SEQ ID NO: 427348 - DNA, 20 bp, Artificial Sequence
  chemically synthesized
tgtaaatagatcatggatat

SEQ ID NO: 427349 - DNA, 20 bp, Artificial Sequence
  chemically synthesized
ctgtaaatagatcatggata

SEQ ID NO: 427350 - DNA, 20 bp, Artificial Sequence
  chemically synthesized
aagaggctgtaaatagatca

SEQ ID NO: 427351 - DNA, 20 bp, Artificial Sequence
  chemically synthesized
ctatatccatgatctattta

SEQ ID NO: 427352 - DNA, 20 bp, Artificial Sequence
  chemically synthesized
attttcaaagaggctgtaaa

SEQ ID NO: 427353 - DNA, 20 bp, Artificial Sequence
  chemically synthesized
cattcggttaattttcaaag

SEQ ID NO: 427354 - DNA, 20 bp, Artificial Sequence
  chemically synthesized
tcattcggttaattttcaaa

SEQ ID NO: 427355 - DNA, 20 bp, Artificial Sequence
  chemically synthesized
tatcattcggttaattttca

SEQ ID NO: 427356 - DNA, 20 bp, Artificial Sequence
  chemically synthesized
aactatctattaatatcatt

SEQ ID NO: 427357 - DNA, 20 bp, Artificial Sequence
  chemically synthesized
aattaaccgaatgatattaa

SEQ ID NO: 427358 - DNA, 20 bp, Artificial Sequence
  chemically synthesized
aaccgaatgatattaataga

SEQ ID NO: 427359 - DNA, 20 bp, Artificial Sequence
  chemically synthesized
aatagatagtttattttata

SEQ ID NO: 427360 - DNA, 20 bp, Artificial Sequence
  chemically synthesized
aatgtgtacaaagttaggag

SEQ ID NO: 427361 - DNA, 20 bp, Artificial Sequence
  chemically synthesized
gaaatgtgtacaaagttagg

SEQ ID NO: 427362 - DNA, 20 bp, Artificial Sequence
  chemically synthesized
agaaatgtgtacaaagttag

SEQ ID NO: 427363 - DNA, 20 bp, Artificial Sequence
  chemically synthesized
agagaaatgtgtacaaagtt

SEQ ID NO: 427364 - DNA, 20 bp, Artificial Sequence
  chemically synthesized
cagagaaatgtgtacaaagt

SEQ ID NO: 427365 - DNA, 20 bp, Artificial Sequence
  chemically synthesized
tatgcagagaaatgtgtaca

SEQ ID NO: 427366 - DNA, 20 bp, Artificial Sequence
  chemically synthesized
cttattcttcaaattatgca

SEQ ID NO: 427367 - DNA, 20 bp, Artificial Sequence
  chemically synthesized
ttcttattcttcaaattatg

SEQ ID NO: 427368 - DNA, 20 bp, Artificial Sequence
  chemically synthesized
acatttctctgcataatttg

SEQ ID NO: 427369 - DNA, 20 bp, Artificial Sequence
  chemically synthesized
ctctgcataatttgaagaat

SEQ ID NO: 427370 - DNA, 20 bp, Artificial Sequence
  chemically synthesized
cataatttgaagaataagaa

SEQ ID NO: 427371 - DNA, 20 bp, Artificial Sequence
  chemically synthesized
taatttgaagaataagaaca

SEQ ID NO: 427372 - DNA, 20 bp, Artificial Sequence
  chemically synthesized
aatttgaagaataagaacag

SEQ ID NO: 427373 - DNA, 20 bp, Artificial Sequence
  chemically synthesized
ggaaatcaacaccgataata

SEQ ID NO: 427374 - DNA, 20 bp, Artificial Sequence
  chemically synthesized
gaaatcaacaccgataatac

SEQ ID NO: 427375 - DNA, 20 bp, Artificial Sequence
  chemically synthesized
tatttttttccctgtattat

SEQ ID NO: 427376 - DNA, 20 bp, Artificial Sequence
  chemically synthesized
aaatcaacaccgataataca

SEQ ID NO: 427377 - DNA, 20 bp, Artificial Sequence
  chemically synthesized
ataatacagggaaaaaaata

SEQ ID NO: 427378 - DNA, 20 bp, Artificial Sequence
  chemically synthesized
aatacagttttttttaaacc

SEQ ID NO: 427379 - DNA, 20 bp, Artificial Sequence
  chemically synthesized
cagttttttttaaaccaagc

SEQ ID NO: 427380 - DNA, 20 bp, Artificial Sequence
  chemically synthesized
tcagattgcattttcttgct

SEQ ID NO: 427381 - DNA, 20 bp, Artificial Sequence
  chemically synthesized
atatttatttgttttggcat

SEQ ID NO: 427382 - DNA, 20 bp, Artificial Sequence
  chemically synthesized
gtcttcatatttatttgttt

SEQ ID NO: 427383 - DNA, 20 bp, Artificial Sequence
  chemically synthesized
tgccaaaacaaataaatatg

SEQ ID NO: 427384 - DNA, 20 bp, Artificial Sequence
  chemically synthesized
aaacaaataaatatgaagac

SEQ ID NO: 427385 - DNA, 20 bp, Artificial Sequence
  chemically synthesized
acaaataaatatgaagacca

SEQ ID NO: 427386 - DNA, 20 bp, Artificial Sequence
  chemically synthesized
ttggatatcagatttttctc

SEQ ID NO: 427387 - DNA, 20 bp, Artificial Sequence
  chemically synthesized
agagaaaaatctgatatcca

SEQ ID NO: 427388 - DNA, 20 bp, Artificial Sequence
  chemically synthesized
agattccagtctttggatat

SEQ ID NO: 427389 - DNA, 20 bp, Artificial Sequence
  chemically synthesized
aaaatctgatatccaaagac

SEQ ID NO: 427390 - DNA, 20 bp, Artificial Sequence
  chemically synthesized
ttactttagattccagtctt

SEQ ID NO: 427391 - DNA, 20 bp, Artificial Sequence
  chemically synthesized
tatccaaagactggaatcta

SEQ ID NO: 427392 - DNA, 20 bp, Artificial Sequence
  chemically synthesized
tcatcatttactttagattc

SEQ ID NO: 427393 - DNA, 20 bp, Artificial Sequence
  chemically synthesized
aatatcttcatcatttactt

SEQ ID NO: 427394 - DNA, 20 bp, Artificial Sequence
  chemically synthesized
ggaatctaaagtaaatgatg

SEQ ID NO: 427395 - DNA, 20 bp, Artificial Sequence
  chemically synthesized
aaagtaaatgatgaagatat

SEQ ID NO: 427396 - DNA, 20 bp, Artificial Sequence
  chemically synthesized
ggaatccatttaacagaaaa

SEQ ID NO: 427397 - DNA, 20 bp, Artificial Sequence
  chemically synthesized
gcaatctgttttctgttaaa

SEQ ID NO: 427398 - DNA, 20 bp, Artificial Sequence
  chemically synthesized
acaaagaggaatccatttaa

SEQ ID NO: 427399 - DNA, 20 bp, Artificial Sequence
  chemically synthesized
tgtgtgcaaaggtaacaaag

SEQ ID NO: 427400 - DNA, 20 bp, Artificial Sequence
  chemically synthesized
ctgtgtgcaaaggtaacaaa

SEQ ID NO: 427401 - DNA, 20 bp, Artificial Sequence
  chemically synthesized
tgctgtgtgcaaaggtaaca

SEQ ID NO: 427402 - DNA, 20 bp, Artificial Sequence
  chemically synthesized
ctctttgttacctttgcaca

SEQ ID NO: 427403 - DNA, 20 bp, Artificial Sequence
  chemically synthesized
tgaatgtatgctgtgtgcaa

SEQ ID NO: 427404 - DNA, 20 bp, Artificial Sequence
  chemically synthesized
ttgaatgtatgctgtgtgca

SEQ ID NO: 427405 - DNA, 20 bp, Artificial Sequence
  chemically synthesized
acagcatacattcaaaatat

SEQ ID NO: 427406 - DNA, 20 bp, Artificial Sequence
  chemically synthesized
caaaatattagaaaaaaatc

SEQ ID NO: 427407 - DNA, 20 bp, Artificial Sequence
  chemically synthesized
aaaaaatcaagtttcaactg

SEQ ID NO: 427408 - DNA, 20 bp, Artificial Sequence
  chemically synthesized
actgccaataaagcaaacca

SEQ ID NO: 427409 - DNA, 20 bp, Artificial Sequence
  chemically synthesized
tcaactgtggtttgctttat

SEQ ID NO: 427410 - DNA, 20 bp, Artificial Sequence
  chemically synthesized
actgtggtttgctttattgg

SEQ ID NO: 427411 - DNA, 20 bp, Artificial Sequence
  chemically synthesized
ccttcacattactgccaata

SEQ ID NO: 427412 - DNA, 20 bp, Artificial Sequence
  chemically synthesized
gctttattggcagtaatgtg

SEQ ID NO: 427413 - DNA, 20 bp, Artificial Sequence
  chemically synthesized
ctttattggcagtaatgtga

SEQ ID NO: 427414 - DNA, 20 bp, Artificial Sequence
  chemically synthesized
tggcagtaatgtgaaggatc

SEQ ID NO: 427415 - DNA, 20 bp, Artificial Sequence
  chemically synthesized
aaaatttgcttaaattattt

SEQ ID NO: 427416 - DNA, 20 bp, Artificial Sequence
  chemically synthesized
atcaagtactcaaataattt

SEQ ID NO: 427417 - DNA, 20 bp, Artificial Sequence
  chemically synthesized
caaataatttaagcaaattt

SEQ ID NO: 427418 - DNA, 20 bp, Artificial Sequence
  chemically synthesized
tttaagcaaattttagaaat

SEQ ID NO: 427419 - DNA, 20 bp, Artificial Sequence
  chemically synthesized
taagcaaattttagaaataa

SEQ ID NO: 427420 - DNA, 20 bp, Artificial Sequence
  chemically synthesized
aagcaaattttagaaataag

SEQ ID NO: 427421 - DNA, 20 bp, Artificial Sequence
  chemically synthesized
tttctaggttgtgttttgat

SEQ ID NO: 427422 - DNA, 20 bp, Artificial Sequence
  chemically synthesized
tgtctaatcaaaacacaacc

SEQ ID NO: 427423 - DNA, 20 bp, Artificial Sequence
  chemically synthesized
taatcaaaacacaacctaga

SEQ ID NO: 427424 - DNA, 20 bp, Artificial Sequence
  chemically synthesized
catgcaatatttgtctttct

SEQ ID NO: 427425 - DNA, 20 bp, Artificial Sequence
  chemically synthesized
acatgcaatatttgtctttc

SEQ ID NO: 427426 - DNA, 20 bp, Artificial Sequence
  chemically synthesized
tttagctcccacatacgcgt

SEQ ID NO: 427427 - DNA, 20 bp, Artificial Sequence
  chemically synthesized
tgcatgttctcacgcgtatg

SEQ ID NO: 427428 - DNA, 20 bp, Artificial Sequence
  chemically synthesized
gcatgttctcacgcgtatgt

SEQ ID NO: 427429 - DNA, 20 bp, Artificial Sequence
  chemically synthesized
atgttctcacgcgtatgtgg

SEQ ID NO: 427430 - DNA, 20 bp, Artificial Sequence
  chemically synthesized
cctccatgagatcaattttt

SEQ ID NO: 427431 - DNA, 20 bp, Artificial Sequence
  chemically synthesized
gagctaaaaaattgatctca

SEQ ID NO: 427432 - DNA, 20 bp, Artificial Sequence
  chemically synthesized
gctaaaaaattgatctcatg

SEQ ID NO: 427433 - DNA, 20 bp, Artificial Sequence
  chemically synthesized
ctaaaaaattgatctcatgg

SEQ ID NO: 427434 - DNA, 20 bp, Artificial Sequence
  chemically synthesized
aaaaattgatctcatggagg

SEQ ID NO: 427435 - DNA, 20 bp, Artificial Sequence
  chemically synthesized
attccactttctacctccat

SEQ ID NO: 427436 - DNA, 20 bp, Artificial Sequence
  chemically synthesized
attgatctcatggaggtaga

SEQ ID NO: 427437 - DNA, 20 bp, Artificial Sequence
  chemically synthesized
gatctcatggaggtagaaag

SEQ ID NO: 427438 - DNA, 20 bp, Artificial Sequence
  chemically synthesized
gaaagtggaatgattgttac

SEQ ID NO: 427439 - DNA, 20 bp, Artificial Sequence
  chemically synthesized
aagtggaatgattgttacca

SEQ ID NO: 427440 - DNA, 20 bp, Artificial Sequence
  chemically synthesized
agtggaatgattgttaccag

SEQ ID NO: 427441 - DNA, 20 bp, Artificial Sequence
  chemically synthesized
gaatgattgttaccagaggc

SEQ ID NO: 427442 - DNA, 20 bp, Artificial Sequence
  chemically synthesized
aatgattgttaccagaggct

SEQ ID NO: 427443 - DNA, 20 bp, Artificial Sequence
  chemically synthesized
ccactacccttcccagcctc

SEQ ID NO: 427444 - DNA, 20 bp, Artificial Sequence
  chemically synthesized
gattgttaccagaggctggg

SEQ ID NO: 427445 - DNA, 20 bp, Artificial Sequence
  chemically synthesized
attgttaccagaggctggga

SEQ ID NO: 427446 - DNA, 20 bp, Artificial Sequence
  chemically synthesized
ttgttaccagaggctgggaa

SEQ ID NO: 427447 - DNA, 20 bp, Artificial Sequence
  chemically synthesized
ttaccagaggctgggaaggg

SEQ ID NO: 427448 - DNA, 20 bp, Artificial Sequence
  chemically synthesized
cccctccccactacccttcc

SEQ ID NO: 427449 - DNA, 20 bp, Artificial Sequence
  chemically synthesized
ccagaggctgggaagggtag

SEQ ID NO: 427450 - DNA, 20 bp, Artificial Sequence
  chemically synthesized
cagaggctgggaagggtagt

SEQ ID NO: 427451 - DNA, 20 bp, Artificial Sequence
  chemically synthesized
agaggctgggaagggtagtg

SEQ ID NO: 427452 - DNA, 20 bp, Artificial Sequence
  chemically synthesized
aggctgggaagggtagtggg

SEQ ID NO: 427453 - DNA, 20 bp, Artificial Sequence
  chemically synthesized
ggctgggaagggtagtgggg

SEQ ID NO: 427454 - DNA, 20 bp, Artificial Sequence
  chemically synthesized
gctgggaagggtagtgggga

SEQ ID NO: 427455 - DNA, 20 bp, Artificial Sequence
  chemically synthesized
ctgggaagggtagtggggag

SEQ ID NO: 427456 - DNA, 20 bp, Artificial Sequence
  chemically synthesized
tgggaagggtagtggggagg

SEQ ID NO: 427457 - DNA, 20 bp, Artificial Sequence
  chemically synthesized
gtagtggggagggggtgatg

SEQ ID NO: 427458 - DNA, 20 bp, Artificial Sequence
  chemically synthesized
agtggggagggggtgatgaa

SEQ ID NO: 427459 - DNA, 20 bp, Artificial Sequence
  chemically synthesized
gtggggagggggtgatgaag

SEQ ID NO: 427460 - DNA, 20 bp, Artificial Sequence
  chemically synthesized
tggggagggggtgatgaaga

SEQ ID NO: 427461 - DNA, 20 bp, Artificial Sequence
  chemically synthesized
ggggagggggtgatgaagag

SEQ ID NO: 427462 - DNA, 20 bp, Artificial Sequence
  chemically synthesized
tgaagaggggcttgtttaat

SEQ ID NO: 427463 - DNA, 20 bp, Artificial Sequence
  chemically synthesized
tatttttatactcattaaac

SEQ ID NO: 427464 - DNA, 20 bp, Artificial Sequence
  chemically synthesized
gtttaatgagtataaaaata

SEQ ID NO: 427465 - DNA, 20 bp, Artificial Sequence
  chemically synthesized
aatgagtataaaaatacagt

SEQ ID NO: 427466 - DNA, 20 bp, Artificial Sequence
  chemically synthesized
agtataaaaatacagttagc

SEQ ID NO: 427467 - DNA, 20 bp, Artificial Sequence
  chemically synthesized
ataaaaatacagttagctag

SEQ ID NO: 427468 - DNA, 20 bp, Artificial Sequence
  chemically synthesized
taaaaatacagttagctagt

SEQ ID NO: 427469 - DNA, 20 bp, Artificial Sequence
  chemically synthesized
acactagattttattcctac

SEQ ID NO: 427470 - DNA, 20 bp, Artificial Sequence
  chemically synthesized
tagctagtaggaataaaatc

SEQ ID NO: 427471 - DNA, 20 bp, Artificial Sequence
  chemically synthesized
cctattgtggtacagaacac

SEQ ID NO: 427472 - DNA, 20 bp, Artificial Sequence
  chemically synthesized
ataatcaccctattgtggta

SEQ ID NO: 427473 - DNA, 20 bp, Artificial Sequence
  chemically synthesized
tctagtgttctgtaccacaa

SEQ ID NO: 427474 - DNA, 20 bp, Artificial Sequence
  chemically synthesized
ctagtgttctgtaccacaat

SEQ ID NO: 427475 - DNA, 20 bp, Artificial Sequence
  chemically synthesized
tagtgttctgtaccacaata

SEQ ID NO: 427476 - DNA, 20 bp, Artificial Sequence
  chemically synthesized
taactataatcaccctattg

SEQ ID NO: 427477 - DNA, 20 bp, Artificial Sequence
  chemically synthesized
gtaccacaatagggtgatta

SEQ ID NO: 427478 - DNA, 20 bp, Artificial Sequence
  chemically synthesized
attgtttatttcaaattaac

SEQ ID NO: 427479 - DNA, 20 bp, Artificial Sequence
  chemically synthesized
tgtttatttcaaattaactg

SEQ ID NO: 427480 - DNA, 20 bp, Artificial Sequence
  chemically synthesized
gtttatttcaaattaactgg

SEQ ID NO: 427481 - DNA, 20 bp, Artificial Sequence
  chemically synthesized
ttatttcaaattaactggag

SEQ ID NO: 427482 - DNA, 20 bp, Artificial Sequence
  chemically synthesized
tttcaaattaactggaggag

SEQ ID NO: 427483 - DNA, 20 bp, Artificial Sequence
  chemically synthesized
acattccaagtctactcctc

SEQ ID NO: 427484 - DNA, 20 bp, Artificial Sequence
  chemically synthesized
attaactggaggagtagact

SEQ ID NO: 427485 - DNA, 20 bp, Artificial Sequence
  chemically synthesized
atttgtgttgggaacattcc

SEQ ID NO: 427486 - DNA, 20 bp, Artificial Sequence
  chemically synthesized
atttatcatttatttgtgtt

SEQ ID NO: 427487 - DNA, 20 bp, Artificial Sequence
  chemically synthesized
catttatcatttatttgtgt

SEQ ID NO: 427488 - DNA, 20 bp, Artificial Sequence
  chemically synthesized
caaataaatgataaatgttt

SEQ ID NO: 427489 - DNA, 20 bp, Artificial Sequence
  chemically synthesized
aaataaatgataaatgtttg

SEQ ID NO: 427490 - DNA, 20 bp, Artificial Sequence
  chemically synthesized
aataatcaaatcaggataat

SEQ ID NO: 427491 - DNA, 20 bp, Artificial Sequence
  chemically synthesized
caatctgtaataatcaaatc

SEQ ID NO: 427492 - DNA, 20 bp, Artificial Sequence
  chemically synthesized
acaatctgtaataatcaaat

SEQ ID NO: 427493 - DNA, 20 bp, Artificial Sequence
  chemically synthesized
ttatcctgatttgattatta

SEQ ID NO: 427494 - DNA, 20 bp, Artificial Sequence
  chemically synthesized
tacatgtgatattttgatac

SEQ ID NO: 427495 - DNA, 20 bp, Artificial Sequence
  chemically synthesized
atacatgtgatattttgata

SEQ ID NO: 427496 - DNA, 20 bp, Artificial Sequence
  chemically synthesized
taattattgtgggtacgtaa

SEQ ID NO: 427497 - DNA, 20 bp, Artificial Sequence
  chemically synthesized
tttaattattgtgggtacgt

SEQ ID NO: 427498 - DNA, 20 bp, Artificial Sequence
  chemically synthesized
ttcttctttttaattattgt

SEQ ID NO: 427499 - DNA, 20 bp, Artificial Sequence
  chemically synthesized
tttcttctttttaattattg

SEQ ID NO: 427500 - DNA, 20 bp, Artificial Sequence
  chemically synthesized
acgtacccacaataattaaa

SEQ ID NO: 427501 - DNA, 20 bp, Artificial Sequence
  chemically synthesized
tacccacaataattaaaaag

SEQ ID NO: 427502 - DNA, 20 bp, Artificial Sequence
  chemically synthesized
cacaataattaaaaagaaga

SEQ ID NO: 427503 - DNA, 20 bp, Artificial Sequence
  chemically synthesized
gaaaaacaaaacatatcaca

SEQ ID NO: 427504 - DNA, 20 bp, Artificial Sequence
  chemically synthesized
aaaaacaaaacatatcacaa

SEQ ID NO: 427505 - DNA, 20 bp, Artificial Sequence
  chemically synthesized
acatatcacaaaggatgacg

SEQ ID NO: 427506 - DNA, 20 bp, Artificial Sequence
  chemically synthesized
acactattaattcatcaatc

SEQ ID NO: 427507 - DNA, 20 bp, Artificial Sequence
  chemically synthesized
tagcttgattgatgaattaa

SEQ ID NO: 427508 - DNA, 20 bp, Artificial Sequence
  chemically synthesized
aattaatagtgtatgcaact

SEQ ID NO: 427509 - DNA, 20 bp, Artificial Sequence
  chemically synthesized
gtgtatgcaactaagatgat

SEQ ID NO: 427510 - DNA, 20 bp, Artificial Sequence
  chemically synthesized
tctacactctccaatcatct

SEQ ID NO: 427511 - DNA, 20 bp, Artificial Sequence
  chemically synthesized
gtatgcaactaagatgattg

SEQ ID NO: 427512 - DNA, 20 bp, Artificial Sequence
  chemically synthesized
atgcaactaagatgattgga

SEQ ID NO: 427513 - DNA, 20 bp, Artificial Sequence
  chemically synthesized
actaagatgattggagagtg

SEQ ID NO: 427514 - DNA, 20 bp, Artificial Sequence
  chemically synthesized
tgattggagagtgtagacct

SEQ ID NO: 427515 - DNA, 20 bp, Artificial Sequence
  chemically synthesized
gattttcctttcatggacta

SEQ ID NO: 427516 - DNA, 20 bp, Artificial Sequence
  chemically synthesized
tgattttcctttcatggact

SEQ ID NO: 427517 - DNA, 20 bp, Artificial Sequence
  chemically synthesized
gtgtagaccttagtccatga

SEQ ID NO: 427518 - DNA, 20 bp, Artificial Sequence
  chemically synthesized
tgtagaccttagtccatgaa

SEQ ID NO: 427519 - DNA, 20 bp, Artificial Sequence
  chemically synthesized
aaactctgattttcctttca

SEQ ID NO: 427520 - DNA, 20 bp, Artificial Sequence
  chemically synthesized
ttagtccatgaaaggaaaat

SEQ ID NO: 427521 - DNA, 20 bp, Artificial Sequence
  chemically synthesized
agtccatgaaaggaaaatca

SEQ ID NO: 427522 - DNA, 20 bp, Artificial Sequence
  chemically synthesized
aaggaaaatcagagttttca

SEQ ID NO: 427523 - DNA, 20 bp, Artificial Sequence
  chemically synthesized
ggaaaatcagagttttcaca

SEQ ID NO: 427524 - DNA, 20 bp, Artificial Sequence
  chemically synthesized
aaaatcagagttttcacaga

SEQ ID NO: 427525 - DNA, 20 bp, Artificial Sequence
  chemically synthesized
agagttttcacagagagcaa

SEQ ID NO: 427526 - DNA, 20 bp, Artificial Sequence
  chemically synthesized
gagttttcacagagagcaaa

SEQ ID NO: 427527 - DNA, 20 bp, Artificial Sequence
  chemically synthesized
agttttcacagagagcaaaa

SEQ ID NO: 427528 - DNA, 20 bp, Artificial Sequence
  chemically synthesized
agagaaatccaaagacaaga

SEQ ID NO: 427529 - DNA, 20 bp, Artificial Sequence
  chemically synthesized
gggtgattctatcttgtctt

SEQ ID NO: 427530 - DNA, 20 bp, Artificial Sequence
  chemically synthesized
ctggagagaaatccaaagac

SEQ ID NO: 427531 - DNA, 20 bp, Artificial Sequence
  chemically synthesized
tatggctggagagaaatcca

SEQ ID NO: 427532 - DNA, 20 bp, Artificial Sequence
  chemically synthesized
cttgtctttggatttctctc

SEQ ID NO: 427533 - DNA, 20 bp, Artificial Sequence
  chemically synthesized
cgtgtgcatctatggctgga

SEQ ID NO: 427534 - DNA, 20 bp, Artificial Sequence
  chemically synthesized
tttggatttctctccagcca

SEQ ID NO: 427535 - DNA, 20 bp, Artificial Sequence
  chemically synthesized
agcgtgtgcatctatggctg

SEQ ID NO: 427536 - DNA, 20 bp, Artificial Sequence
  chemically synthesized
cgagcgtgtgcatctatggc

SEQ ID NO: 427537 - DNA, 20 bp, Artificial Sequence
  chemically synthesized
gtagcgagcgtgtgcatcta

SEQ ID NO: 427538 - DNA, 20 bp, Artificial Sequence
  chemically synthesized
gtaaggtatgcaaaggtagc

SEQ ID NO: 427539 - DNA, 20 bp, Artificial Sequence
  chemically synthesized
tggagtaaggtatgcaaagg

SEQ ID NO: 427540 - DNA, 20 bp, Artificial Sequence
  chemically synthesized
tggtggagtaaggtatgcaa

SEQ ID NO: 427541 - DNA, 20 bp, Artificial Sequence
  chemically synthesized
atggtggagtaaggtatgca

SEQ ID NO: 427542 - DNA, 20 bp, Artificial Sequence
  chemically synthesized
actttttagatggtggagta

SEQ ID NO: 427543 - DNA, 20 bp, Artificial Sequence
  chemically synthesized
aactttttagatggtggagt

SEQ ID NO: 427544 - DNA, 20 bp, Artificial Sequence
  chemically synthesized
aggaaactttttagatggtg

SEQ ID NO: 427545 - DNA, 20 bp, Artificial Sequence
  chemically synthesized
aaaggaaactttttagatgg

SEQ ID NO: 427546 - DNA, 20 bp, Artificial Sequence
  chemically synthesized
accttactccaccatctaaa

SEQ ID NO: 427547 - DNA, 20 bp, Artificial Sequence
  chemically synthesized
ataaaaggaaactttttaga

SEQ ID NO: 427548 - DNA, 20 bp, Artificial Sequence
  chemically synthesized
tgaaataaaaggaaactttt

SEQ ID NO: 427549 - DNA, 20 bp, Artificial Sequence
  chemically synthesized
tccagtggtattgaaataaa

SEQ ID NO: 427550 - DNA, 20 bp, Artificial Sequence
  chemically synthesized
ttccagtggtattgaaataa

SEQ ID NO: 427551 - DNA, 20 bp, Artificial Sequence
  chemically synthesized
tccttttatttcaataccac

SEQ ID NO: 427552 - DNA, 20 bp, Artificial Sequence
  chemically synthesized
ggaaatggtgggttttccag

SEQ ID NO: 427553 - DNA, 20 bp, Artificial Sequence
  chemically synthesized
gaaggaaatggtgggttttc

SEQ ID NO: 427554 - DNA, 20 bp, Artificial Sequence
  chemically synthesized
tctatgatgaaggaaatggt

SEQ ID NO: 427555 - DNA, 20 bp, Artificial Sequence
  chemically synthesized
atctatgatgaaggaaatgg

SEQ ID NO: 427556 - DNA, 20 bp, Artificial Sequence
  chemically synthesized
ttaatctatgatgaaggaaa

SEQ ID NO: 427557 - DNA, 20 bp, Artificial Sequence
  chemically synthesized
acccaccatttccttcatca

SEQ ID NO: 427558 - DNA, 20 bp, Artificial Sequence
  chemically synthesized
tctttcttaatctatgatga

SEQ ID NO: 427559 - DNA, 20 bp, Artificial Sequence
  chemically synthesized
ctctttcttaatctatgatg

SEQ ID NO: 427560 - DNA, 20 bp, Artificial Sequence
  chemically synthesized
catttccttcatcatagatt

SEQ ID NO: 427561 - DNA, 20 bp, Artificial Sequence
  chemically synthesized
tccttcatcatagattaaga

SEQ ID NO: 427562 - DNA, 20 bp, Artificial Sequence
  chemically synthesized
cttcatcatagattaagaaa

SEQ ID NO: 427563 - DNA, 20 bp, Artificial Sequence
  chemically synthesized
catcatagattaagaaagag

SEQ ID NO: 427564 - DNA, 20 bp, Artificial Sequence
  chemically synthesized
atcatagattaagaaagagt

SEQ ID NO: 427565 - DNA, 20 bp, Artificial Sequence
  chemically synthesized
agaaagagtgggtttttctg

SEQ ID NO: 427566 - DNA, 20 bp, Artificial Sequence
  chemically synthesized
aacaatggtagttggaactt

SEQ ID NO: 427567 - DNA, 20 bp, Artificial Sequence
  chemically synthesized
aaagcattaacaatggtagt

SEQ ID NO: 427568 - DNA, 20 bp, Artificial Sequence
  chemically synthesized
attgaaagcattaacaatgg

SEQ ID NO: 427569 - DNA, 20 bp, Artificial Sequence
  chemically synthesized
tagattgaaagcattaacaa

SEQ ID NO: 427570 - DNA, 20 bp, Artificial Sequence
  chemically synthesized
gaaaatagacaatagattga

SEQ ID NO: 427571 - DNA, 20 bp, Artificial Sequence
  chemically synthesized
taagcatggaaaatagacaa

SEQ ID NO: 427572 - DNA, 20 bp, Artificial Sequence
  chemically synthesized
acaatcataagcatggaaaa

SEQ ID NO: 427573 - DNA, 20 bp, Artificial Sequence
  chemically synthesized
ggctgacacaatcataagca

SEQ ID NO: 427574 - DNA, 20 bp, Artificial Sequence
  chemically synthesized
acatgggctgacacaatcat

SEQ ID NO: 427575 - DNA, 20 bp, Artificial Sequence
  chemically synthesized
ttccatgcttatgattgtgt

SEQ ID NO: 427576 - DNA, 20 bp, Artificial Sequence
  chemically synthesized
ggtaagagttagttacacat

SEQ ID NO: 427577 - DNA, 20 bp, Artificial Sequence
  chemically synthesized
tggtaagagttagttacaca

SEQ ID NO: 427578 - DNA, 20 bp, Artificial Sequence
  chemically synthesized
tatttcaacttggtaagagt

SEQ ID NO: 427579 - DNA, 20 bp, Artificial Sequence
  chemically synthesized
atgtgtaactaactcttacc

SEQ ID NO: 427580 - DNA, 20 bp, Artificial Sequence
  chemically synthesized
aacgtatttcaacttggtaa

SEQ ID NO: 427581 - DNA, 20 bp, Artificial Sequence
  chemically synthesized
tgaacgtatttcaacttggt

SEQ ID NO: 427582 - DNA, 20 bp, Artificial Sequence
  chemically synthesized
ttagtgaacgtatttcaact

SEQ ID NO: 427583 - DNA, 20 bp, Artificial Sequence
  chemically synthesized
caagttgaaatacgttcact

SEQ ID NO: 427584 - DNA, 20 bp, Artificial Sequence
  chemically synthesized
aagttgaaatacgttcacta

SEQ ID NO: 427585 - DNA, 20 bp, Artificial Sequence
  chemically synthesized
tcttatgcaaaaaagaacct

SEQ ID NO: 427586 - DNA, 20 bp, Artificial Sequence
  chemically synthesized
tatacaggtcttatgcaaaa

SEQ ID NO: 427587 - DNA, 20 bp, Artificial Sequence
  chemically synthesized
actaaggttcttttttgcat

SEQ ID NO: 427588 - DNA, 20 bp, Artificial Sequence
  chemically synthesized
ttttttgcataagacctgta

SEQ ID NO: 427589 - DNA, 20 bp, Artificial Sequence
  chemically synthesized
aatatatagctattctatac

SEQ ID NO: 427590 - DNA, 20 bp, Artificial Sequence
  chemically synthesized
tgcataagacctgtatagaa

SEQ ID NO: 427591 - DNA, 20 bp, Artificial Sequence
  chemically synthesized
caatatatagctattctata

SEQ ID NO: 427592 - DNA, 20 bp, Artificial Sequence
  chemically synthesized
gtatagaatagctatatatt

SEQ ID NO: 427593 - DNA, 20 bp, Artificial Sequence
  chemically synthesized
tatagaatagctatatattg

SEQ ID NO: 427594 - DNA, 20 bp, Artificial Sequence
  chemically synthesized
tctattaattcctcaatata

SEQ ID NO: 427595 - DNA, 20 bp, Artificial Sequence
  chemically synthesized
gctatatattgaggaattaa

SEQ ID NO: 427596 - DNA, 20 bp, Artificial Sequence
  chemically synthesized
atattgaggaattaatagaa

SEQ ID NO: 427597 - DNA, 20 bp, Artificial Sequence
  chemically synthesized
attttttatataccaaccac

SEQ ID NO: 427598 - DNA, 20 bp, Artificial Sequence
  chemically synthesized
tatagtatctcactcgtggt

SEQ ID NO: 427599 - DNA, 20 bp, Artificial Sequence
  chemically synthesized
tttatataccaaccacgagt

SEQ ID NO: 427600 - DNA, 20 bp, Artificial Sequence
  chemically synthesized
ctagtatagtatctcactcg

SEQ ID NO: 427601 - DNA, 20 bp, Artificial Sequence
  chemically synthesized
ccacgagtgagatactatac

SEQ ID NO: 427602 - DNA, 20 bp, Artificial Sequence
  chemically synthesized
cacgagtgagatactatact

SEQ ID NO: 427603 - DNA, 20 bp, Artificial Sequence
  chemically synthesized
tacatgaataacacctagta

SEQ ID NO: 427604 - DNA, 20 bp, Artificial Sequence
  chemically synthesized
aaaaatacatgaataacacc

SEQ ID NO: 427605 - DNA, 20 bp, Artificial Sequence
  chemically synthesized
taacatggaggattattgtg

SEQ ID NO: 427606 - DNA, 20 bp, Artificial Sequence
  chemically synthesized
ttcacaataatcctccatgt

SEQ ID NO: 427607 - DNA, 20 bp, Artificial Sequence
  chemically synthesized
atatgaaataactaacatgg

SEQ ID NO: 427608 - DNA, 20 bp, Artificial Sequence
  chemically synthesized
tatatgaaataactaacatg

SEQ ID NO: 427609 - DNA, 20 bp, Artificial Sequence
  chemically synthesized
catatatgaaataactaaca

SEQ ID NO: 427610 - DNA, 20 bp, Artificial Sequence
  chemically synthesized
atgttagttatttcatatat

SEQ ID NO: 427611 - DNA, 20 bp, Artificial Sequence
  chemically synthesized
atttcatatatgagaaaaca

SEQ ID NO: 427612 - DNA, 20 bp, Artificial Sequence
  chemically synthesized
tttcatatatgagaaaacat

SEQ ID NO: 427613 - DNA, 20 bp, Artificial Sequence
  chemically synthesized
catatatgagaaaacatggg

SEQ ID NO: 427614 - DNA, 20 bp, Artificial Sequence
  chemically synthesized
atatatgagaaaacatggga

SEQ ID NO: 427615 - DNA, 20 bp, Artificial Sequence
  chemically synthesized
aaacatgggaaggctccttc

SEQ ID NO: 427616 - DNA, 20 bp, Artificial Sequence
  chemically synthesized
aacatgggaaggctccttcc

SEQ ID NO: 427617 - DNA, 20 bp, Artificial Sequence
  chemically synthesized
ttagcaagatagcctggaag

SEQ ID NO: 427618 - DNA, 20 bp, Artificial Sequence
  chemically synthesized
agttagcaagatagcctgga

SEQ ID NO: 427619 - DNA, 20 bp, Artificial Sequence
  chemically synthesized
tagttagcaagatagcctgg

SEQ ID NO: 427620 - DNA, 20 bp, Artificial Sequence
  chemically synthesized
ttatagttagcaagatagcc

SEQ ID NO: 427621 - DNA, 20 bp, Artificial Sequence
  chemically synthesized
tagggttatagttagcaaga

SEQ ID NO: 427622 - DNA, 20 bp, Artificial Sequence
  chemically synthesized
atgctagggttatagttagc

SEQ ID NO: 427623 - DNA, 20 bp, Artificial Sequence
  chemically synthesized
agaaatgctagggttatagt

SEQ ID NO: 427624 - DNA, 20 bp, Artificial Sequence
  chemically synthesized
tatcttgctaactataaccc

SEQ ID NO: 427625 - DNA, 20 bp, Artificial Sequence
  chemically synthesized
gtttagaaatgctagggtta

SEQ ID NO: 427626 - DNA, 20 bp, Artificial Sequence
  chemically synthesized
ttttgtgtttagaaatgcta

SEQ ID NO: 427627 - DNA, 20 bp, Artificial Sequence
  chemically synthesized
attttgtgtttagaaatgct

SEQ ID NO: 427628 - DNA, 20 bp, Artificial Sequence
  chemically synthesized
tattttgtgtttagaaatgc

SEQ ID NO: 427629 - DNA, 20 bp, Artificial Sequence
  chemically synthesized
aatttcttatattttgtgtt

SEQ ID NO: 427630 - DNA, 20 bp, Artificial Sequence
  chemically synthesized
catttctaaacacaaaatat

SEQ ID NO: 427631 - DNA, 20 bp, Artificial Sequence
  chemically synthesized
aacacaaaatataagaaatt

SEQ ID NO: 427632 - DNA, 20 bp, Artificial Sequence
  chemically synthesized
atataagaaattcagtgtct

SEQ ID NO: 427633 - DNA, 20 bp, Artificial Sequence
  chemically synthesized
gaaattcagtgtcttagcac

SEQ ID NO: 427634 - DNA, 20 bp, Artificial Sequence
  chemically synthesized
aggaaagaatagccagtgct

SEQ ID NO: 427635 - DNA, 20 bp, Artificial Sequence
  chemically synthesized
ttccagaaggaaagaatagc

SEQ ID NO: 427636 - DNA, 20 bp, Artificial Sequence
  chemically synthesized
aaccttccagaaggaaagaa

SEQ ID NO: 427637 - DNA, 20 bp, Artificial Sequence
  chemically synthesized
cactggctattctttccttc

SEQ ID NO: 427638 - DNA, 20 bp, Artificial Sequence
  chemically synthesized
ggaagaaccttccagaagga

SEQ ID NO: 427639 - DNA, 20 bp, Artificial Sequence
  chemically synthesized
tggctattctttccttctgg

SEQ ID NO: 427640 - DNA, 20 bp, Artificial Sequence
  chemically synthesized
ggctattctttccttctgga

SEQ ID NO: 427641 - DNA, 20 bp, Artificial Sequence
  chemically synthesized
ctgaggaagaaccttccaga

SEQ ID NO: 427642 - DNA, 20 bp, Artificial Sequence
  chemically synthesized
actgaggaagaaccttccag

SEQ ID NO: 427643 - DNA, 20 bp, Artificial Sequence
  chemically synthesized
aaaactgaggaagaaccttc

SEQ ID NO: 427644 - DNA, 20 bp, Artificial Sequence
  chemically synthesized
ccttctggaaggttcttcct

SEQ ID NO: 427645 - DNA, 20 bp, Artificial Sequence
  chemically synthesized
cagtcatgtaaaaactgagg

SEQ ID NO: 427646 - DNA, 20 bp, Artificial Sequence
  chemically synthesized
aaccagtcatgtaaaaactg

SEQ ID NO: 427647 - DNA, 20 bp, Artificial Sequence
  chemically synthesized
gaaccagtcatgtaaaaact

SEQ ID NO: 427648 - DNA, 20 bp, Artificial Sequence
  chemically synthesized
ttcctcagtttttacatgac

SEQ ID NO: 427649 - DNA, 20 bp, Artificial Sequence
  chemically synthesized
ttttacatgactggttcctc

SEQ ID NO: 427650 - DNA, 20 bp, Artificial Sequence
  chemically synthesized
atatgactgtctagaggaac

SEQ ID NO: 427651 - DNA, 20 bp, Artificial Sequence
  chemically synthesized
acatgactggttcctctaga

SEQ ID NO: 427652 - DNA, 20 bp, Artificial Sequence
  chemically synthesized
gctgagatatgactgtctag

SEQ ID NO: 427653 - DNA, 20 bp, Artificial Sequence
  chemically synthesized
agctgagatatgactgtcta

SEQ ID NO: 427654 - DNA, 20 bp, Artificial Sequence
  chemically synthesized
tcagctgagatatgactgtc

SEQ ID NO: 427655 - DNA, 20 bp, Artificial Sequence
  chemically synthesized
tcctctagacagtcatatct

SEQ ID NO: 427656 - DNA, 20 bp, Artificial Sequence
  chemically synthesized
gctgaagaggcatgtcagct

SEQ ID NO: 427657 - DNA, 20 bp, Artificial Sequence
  chemically synthesized
tctttgctgaagaggcatgt

SEQ ID NO: 427658 - DNA, 20 bp, Artificial Sequence
  chemically synthesized
tctcagctgacatgcctctt

SEQ ID NO: 427659 - DNA, 20 bp, Artificial Sequence
  chemically synthesized
aaagagaatctttgctgaag

SEQ ID NO: 427660 - DNA, 20 bp, Artificial Sequence
  chemically synthesized
gctgacatgcctcttcagca

SEQ ID NO: 427661 - DNA, 20 bp, Artificial Sequence
  chemically synthesized
taaagagaatctttgctgaa

SEQ ID NO: 427662 - DNA, 20 bp, Artificial Sequence
  chemically synthesized
agtaaagagaatctttgctg

SEQ ID NO: 427663 - DNA, 20 bp, Artificial Sequence
  chemically synthesized
attccagcttcagtagtaaa

SEQ ID NO: 427664 - DNA, 20 bp, Artificial Sequence
  chemically synthesized
ttattccagcttcagtagta

SEQ ID NO: 427665 - DNA, 20 bp, Artificial Sequence
  chemically synthesized
aaagattctctttactactg

SEQ ID NO: 427666 - DNA, 20 bp, Artificial Sequence
  chemically synthesized
attctctttactactgaagc

SEQ ID NO: 427667 - DNA, 20 bp, Artificial Sequence
  chemically synthesized
ggtagttattccagcttcag

SEQ ID NO: 427668 - DNA, 20 bp, Artificial Sequence
  chemically synthesized
ttgggtagttattccagctt

SEQ ID NO: 427669 - DNA, 20 bp, Artificial Sequence
  chemically synthesized
gagtgattgggtagttattc

SEQ ID NO: 427670 - DNA, 20 bp, Artificial Sequence
  chemically synthesized
tgagatagtgagtgattggg

SEQ ID NO: 427671 - DNA, 20 bp, Artificial Sequence
  chemically synthesized
agttgagatagtgagtgatt

SEQ ID NO: 427672 - DNA, 20 bp, Artificial Sequence
  chemically synthesized
gagttgagatagtgagtgat

SEQ ID NO: 427673 - DNA, 20 bp, Artificial Sequence
  chemically synthesized
acaaactgagttgagatagt

SEQ ID NO: 427674 - DNA, 20 bp, Artificial Sequence
  chemically synthesized
gagaacaaactgagttgaga

SEQ ID NO: 427675 - DNA, 20 bp, Artificial Sequence
  chemically synthesized
aatcactcactatctcaact

SEQ ID NO: 427676 - DNA, 20 bp, Artificial Sequence
  chemically synthesized
cattgagaacaaactgagtt

SEQ ID NO: 427677 - DNA, 20 bp, Artificial Sequence
  chemically synthesized
tgttgcattgagaacaaact

SEQ ID NO: 427678 - DNA, 20 bp, Artificial Sequence
  chemically synthesized
tcagataaaagtgttgcatt

SEQ ID NO: 427679 - DNA, 20 bp, Artificial Sequence
  chemically synthesized
acaagaaacatatcagataa

SEQ ID NO: 427680 - DNA, 20 bp, Artificial Sequence
  chemically synthesized
taaataaacaagaaacatat

SEQ ID NO: 427681 - DNA, 20 bp, Artificial Sequence
  chemically synthesized
gtctcttgtgataaataaac

SEQ ID NO: 427682 - DNA, 20 bp, Artificial Sequence
  chemically synthesized
gtttcttgtttatttatcac

SEQ ID NO: 427683 - DNA, 20 bp, Artificial Sequence
  chemically synthesized
ttcttgtttatttatcacaa

SEQ ID NO: 427684 - DNA, 20 bp, Artificial Sequence
  chemically synthesized
aagagacataatttcttttt

SEQ ID NO: 427685 - DNA, 20 bp, Artificial Sequence
  chemically synthesized
cagagcctacatttctgaaa

SEQ ID NO: 427686 - DNA, 20 bp, Artificial Sequence
  chemically synthesized
taatttctttttcagaaatg

SEQ ID NO: 427687 - DNA, 20 bp, Artificial Sequence
  chemically synthesized
aatttctttttcagaaatgt

SEQ ID NO: 427688 - DNA, 20 bp, Artificial Sequence
  chemically synthesized
tttcagaaatgtaggctctg

SEQ ID NO: 427689 - DNA, 20 bp, Artificial Sequence
  chemically synthesized
ttcagaaatgtaggctctgt

SEQ ID NO: 427690 - DNA, 20 bp, Artificial Sequence
  chemically synthesized
cagaaatgtaggctctgtgg

SEQ ID NO: 427691 - DNA, 20 bp, Artificial Sequence
  chemically synthesized
tatatttccctgctcccaca

SEQ ID NO: 427692 - DNA, 20 bp, Artificial Sequence
  chemically synthesized
aaatgtaggctctgtgggag

SEQ ID NO: 427693 - DNA, 20 bp, Artificial Sequence
  chemically synthesized
aatgtaggctctgtgggagc

SEQ ID NO: 427694 - DNA, 20 bp, Artificial Sequence
  chemically synthesized
tatatatttccctgctccca

SEQ ID NO: 427695 - DNA, 20 bp, Artificial Sequence
  chemically synthesized
atgtaggctctgtgggagca

SEQ ID NO: 427696 - DNA, 20 bp, Artificial Sequence
  chemically synthesized
gggagcagggaaatatatat

SEQ ID NO: 427697 - DNA, 20 bp, Artificial Sequence
  chemically synthesized
atctattgttgagttgtaat

SEQ ID NO: 427698 - DNA, 20 bp, Artificial Sequence
  chemically synthesized
atccaattacaactcaacaa

SEQ ID NO: 427699 - DNA, 20 bp, Artificial Sequence
  chemically synthesized
gaagtgacttatctattgtt

SEQ ID NO: 427700 - DNA, 20 bp, Artificial Sequence
  chemically synthesized
attacaactcaacaatagat

SEQ ID NO: 427701 - DNA, 20 bp, Artificial Sequence
  chemically synthesized
actcagatcttcaatgatgg

SEQ ID NO: 427702 - DNA, 20 bp, Artificial Sequence
  chemically synthesized
ataagtcacttccatcattg

SEQ ID NO: 427703 - DNA, 20 bp, Artificial Sequence
  chemically synthesized
gaaactcagatcttcaatga

SEQ ID NO: 427704 - DNA, 20 bp, Artificial Sequence
  chemically synthesized
acttccatcattgaagatct

SEQ ID NO: 427705 - DNA, 20 bp, Artificial Sequence
  chemically synthesized
actttatagatgatgaaact

SEQ ID NO: 427706 - DNA, 20 bp, Artificial Sequence
  chemically synthesized
tctgagtttcatcatctata

SEQ ID NO: 427707 - DNA, 20 bp, Artificial Sequence
  chemically synthesized
agtttcatcatctataaagt

SEQ ID NO: 427708 - DNA, 20 bp, Artificial Sequence
  chemically synthesized
ataaatattatcttacttta

SEQ ID NO: 427709 - DNA, 20 bp, Artificial Sequence
  chemically synthesized
taaagtaagataatatttat

SEQ ID NO: 427710 - DNA, 20 bp, Artificial Sequence
  chemically synthesized
aagataatatttatcagata

SEQ ID NO: 427711 - DNA, 20 bp, Artificial Sequence
  chemically synthesized
actgtatatatatatatatt

SEQ ID NO: 427712 - DNA, 20 bp, Artificial Sequence
  chemically synthesized
actaaatatatatatatata

SEQ ID NO: 427713 - DNA, 20 bp, Artificial Sequence
  chemically synthesized
tatatatatacagtaatgtc

SEQ ID NO: 427714 - DNA, 20 bp, Artificial Sequence
  chemically synthesized
atatatacagtaatgtccag

SEQ ID NO: 427715 - DNA, 20 bp, Artificial Sequence
  chemically synthesized
atacagtaatgtccagtaga

SEQ ID NO: 427716 - DNA, 20 bp, Artificial Sequence
  chemically synthesized
ttgttcagcatactttctac

SEQ ID NO: 427717 - DNA, 20 bp, Artificial Sequence
  chemically synthesized
tagaaagtatgctgaacaat

SEQ ID NO: 427718 - DNA, 20 bp, Artificial Sequence
  chemically synthesized
tttacagaacactaattgtt

SEQ ID NO: 427719 - DNA, 20 bp, Artificial Sequence
  chemically synthesized
gcacttaaaaaatttgttta

SEQ ID NO: 427720 - DNA, 20 bp, Artificial Sequence
  chemically synthesized
gttctgtaaacaaatttttt

SEQ ID NO: 427721 - DNA, 20 bp, Artificial Sequence
  chemically synthesized
gagaccggtatatttcagaa

SEQ ID NO: 427722 - DNA, 20 bp, Artificial Sequence
  chemically synthesized
gatgagagaccggtatattt

SEQ ID NO: 427723 - DNA, 20 bp, Artificial Sequence
  chemically synthesized
tgcactattctgaaatatac

SEQ ID NO: 427724 - DNA, 20 bp, Artificial Sequence
  chemically synthesized
aaatgagaaggatgagagac

SEQ ID NO: 427725 - DNA, 20 bp, Artificial Sequence
  chemically synthesized
aaataaaatgagaaggatga

SEQ ID NO: 427726 - DNA, 20 bp, Artificial Sequence
  chemically synthesized
aaaaataaaatgagaaggat

SEQ ID NO: 427727 - DNA, 20 bp, Artificial Sequence
  chemically synthesized
ttttaaaaaataaaatgaga

SEQ ID NO: 427728 - DNA, 20 bp, Artificial Sequence
  chemically synthesized
attttaaaaaataaaatgag

SEQ ID NO: 427729 - DNA, 20 bp, Artificial Sequence
  chemically synthesized
atgattttaaaaaataaaat

SEQ ID NO: 427730 - DNA, 20 bp, Artificial Sequence
  chemically synthesized
ttttttaaaatcattttatt

SEQ ID NO: 427731 - DNA, 20 bp, Artificial Sequence
  chemically synthesized
attttgtggtgtgtgagtta

SEQ ID NO: 427732 - DNA, 20 bp, Artificial Sequence
  chemically synthesized
gagtgaattttgtggtgtgt

SEQ ID NO: 427733 - DNA, 20 bp, Artificial Sequence
  chemically synthesized
ctttaaaagagtgaattttg

SEQ ID NO: 427734 - DNA, 20 bp, Artificial Sequence
  chemically synthesized
ccacaaaattcactctttta

SEQ ID NO: 427735 - DNA, 20 bp, Artificial Sequence
  chemically synthesized
ctgaattgtgcactttaaaa

SEQ ID NO: 427736 - DNA, 20 bp, Artificial Sequence
  chemically synthesized
cactgaattgtgcactttaa

SEQ ID NO: 427737 - DNA, 20 bp, Artificial Sequence
  chemically synthesized
ctcttttaaagtgcacaatt

SEQ ID NO: 427738 - DNA, 20 bp, Artificial Sequence
  chemically synthesized
gtgcacaattcagtgatata

SEQ ID NO: 427739 - DNA, 20 bp, Artificial Sequence
  chemically synthesized
tgatatatagtatattcaca

SEQ ID NO: 427740 - DNA, 20 bp, Artificial Sequence
  chemically synthesized
aggaaaaaagaaagtggtga

SEQ ID NO: 427741 - DNA, 20 bp, Artificial Sequence
  chemically synthesized
aaataaaggaaaaaagaaag

SEQ ID NO: 427742 - DNA, 20 bp, Artificial Sequence
  chemically synthesized
aataaataaaggaaaaaaga

SEQ ID NO: 427743 - DNA, 20 bp, Artificial Sequence
  chemically synthesized
aataaataaataaaggaaaa

SEQ ID NO: 427744 - DNA, 20 bp, Artificial Sequence
  chemically synthesized
tcaaaaaaataaataaataa

SEQ ID NO: 427745 - DNA, 20 bp, Artificial Sequence
  chemically synthesized
ctcaaaaaaataaataaata

SEQ ID NO: 427746 - DNA, 20 bp, Artificial Sequence
  chemically synthesized
ctttatttatttattttttt

SEQ ID NO: 427747 - DNA, 20 bp, Artificial Sequence
  chemically synthesized
atttatttatttttttgaga

SEQ ID NO: 427748 - DNA, 20 bp, Artificial Sequence
  chemically synthesized
ttatttatttttttgagaca

SEQ ID NO: 427749 - DNA, 20 bp, Artificial Sequence
  chemically synthesized
ctccagcctggcgacagagc

SEQ ID NO: 427750 - DNA, 20 bp, Artificial Sequence
  chemically synthesized
acagagtctcgctctgtcgc

SEQ ID NO: 427751 - DNA, 20 bp, Artificial Sequence
  chemically synthesized
cagagtctcgctctgtcgcc

SEQ ID NO: 427752 - DNA, 20 bp, Artificial Sequence
  chemically synthesized
tgcactccagcctggcgaca

SEQ ID NO: 427753 - DNA, 20 bp, Artificial Sequence
  chemically synthesized
gctgcactccagcctggcga

SEQ ID NO: 427754 - DNA, 20 bp, Artificial Sequence
  chemically synthesized
gtctcgctctgtcgccaggc

SEQ ID NO: 427755 - DNA, 20 bp, Artificial Sequence
  chemically synthesized
ctcgctctgtcgccaggctg

SEQ ID NO: 427756 - DNA, 20 bp, Artificial Sequence
  chemically synthesized
cgcgccgctgcactccagcc

SEQ ID NO: 427757 - DNA, 20 bp, Artificial Sequence
  chemically synthesized
tctgtcgccaggctggagtg

SEQ ID NO: 427758 - DNA, 20 bp, Artificial Sequence
  chemically synthesized
aagatcgcgccgctgcactc

SEQ ID NO: 427759 - DNA, 20 bp, Artificial Sequence
  chemically synthesized
gtcgccaggctggagtgcag

SEQ ID NO: 427760 - DNA, 20 bp, Artificial Sequence
  chemically synthesized
ggagtgcagcggcgcgatct

SEQ ID NO: 427761 - DNA, 20 bp, Artificial Sequence
  chemically synthesized
ggtggaggttgcagtgagcc

SEQ ID NO: 427762 - DNA, 20 bp, Artificial Sequence
  chemically synthesized
caggaggtggaggttgcagt

SEQ ID NO: 427763 - DNA, 20 bp, Artificial Sequence
  chemically synthesized
aacccaggaggtggaggttg

SEQ ID NO: 427764 - DNA, 20 bp, Artificial Sequence
  chemically synthesized
tgcttgaacccaggaggtgg

SEQ ID NO: 427765 - DNA, 20 bp, Artificial Sequence
  chemically synthesized
tcactgcaacctccacctcc

SEQ ID NO: 427766 - DNA, 20 bp, Artificial Sequence
  chemically synthesized
ttgcttgaacccaggaggtg

SEQ ID NO: 427767 - DNA, 20 bp, Artificial Sequence
  chemically synthesized
cactgcaacctccacctcct

SEQ ID NO: 427768 - DNA, 20 bp, Artificial Sequence
  chemically synthesized
aattgcttgaacccaggagg

SEQ ID NO: 427769 - DNA, 20 bp, Artificial Sequence
  chemically synthesized
gagaattgcttgaacccagg

SEQ ID NO: 427770 - DNA, 20 bp, Artificial Sequence
  chemically synthesized
ggagaattgcttgaacccag

SEQ ID NO: 427771 - DNA, 20 bp, Artificial Sequence
  chemically synthesized
aacctccacctcctgggttc

SEQ ID NO: 427772 - DNA, 20 bp, Artificial Sequence
  chemically synthesized
caggagaattgcttgaaccc

SEQ ID NO: 427773 - DNA, 20 bp, Artificial Sequence
  chemically synthesized
gcaggagaattgcttgaacc

SEQ ID NO: 427774 - DNA, 20 bp, Artificial Sequence
  chemically synthesized
ttcaagcaattctcctgcct

SEQ ID NO: 427775 - DNA, 20 bp, Artificial Sequence
  chemically synthesized
tgctcgggagactgaggcag

SEQ ID NO: 427776 - DNA, 20 bp, Artificial Sequence
  chemically synthesized
gctgctcgggagactgaggc

SEQ ID NO: 427777 - DNA, 20 bp, Artificial Sequence
  chemically synthesized
agctgctcgggagactgagg

SEQ ID NO: 427778 - DNA, 20 bp, Artificial Sequence
  chemically synthesized
cctagctgctcgggagactg

SEQ ID NO: 427779 - DNA, 20 bp, Artificial Sequence
  chemically synthesized
tcctagctgctcgggagact

SEQ ID NO: 427780 - DNA, 20 bp, Artificial Sequence
  chemically synthesized
ttctcctgcctcagtctccc

SEQ ID NO: 427781 - DNA, 20 bp, Artificial Sequence
  chemically synthesized
tcctgcctcagtctcccgag

SEQ ID NO: 427782 - DNA, 20 bp, Artificial Sequence
  chemically synthesized
ctgtagtcctagctgctcgg

SEQ ID NO: 427783 - DNA, 20 bp, Artificial Sequence
  chemically synthesized
gcctcagtctcccgagcagc

SEQ ID NO: 427784 - DNA, 20 bp, Artificial Sequence
  chemically synthesized
acctgtagtcctagctgctc

SEQ ID NO: 427785 - DNA, 20 bp, Artificial Sequence
  chemically synthesized
cctcagtctcccgagcagct

SEQ ID NO: 427786 - DNA, 20 bp, Artificial Sequence
  chemically synthesized
cacctgtagtcctagctgct

SEQ ID NO: 427787 - DNA, 20 bp, Artificial Sequence
  chemically synthesized
ctcccgagcagctaggacta

SEQ ID NO: 427788 - DNA, 20 bp, Artificial Sequence
  chemically synthesized
tcccgagcagctaggactac

SEQ ID NO: 427789 - DNA, 20 bp, Artificial Sequence
  chemically synthesized
gtagtgcgcacctgtagtcc

SEQ ID NO: 427790 - DNA, 20 bp, Artificial Sequence
  chemically synthesized
ggtgtggtagtgcgcacctg

SEQ ID NO: 427791 - DNA, 20 bp, Artificial Sequence
  chemically synthesized
caggtgcgcactaccacacc

SEQ ID NO: 427792 - DNA, 20 bp, Artificial Sequence
  chemically synthesized
aaaaaatgagctgggtgtgg

SEQ ID NO: 427793 - DNA, 20 bp, Artificial Sequence
  chemically synthesized
taaaaaaaatgagctgggtg

SEQ ID NO: 427794 - DNA, 20 bp, Artificial Sequence
  chemically synthesized
atatttaaaaaaaatgagct

SEQ ID NO: 427795 - DNA, 20 bp, Artificial Sequence
  chemically synthesized
tatatttaaaaaaaatgagc

SEQ ID NO: 427796 - DNA, 20 bp, Artificial Sequence
  chemically synthesized
aatatatatttaaaaaaaat

SEQ ID NO: 427797 - DNA, 20 bp, Artificial Sequence
  chemically synthesized
tttttttaaatatatatttt

SEQ ID NO: 427798 - DNA, 20 bp, Artificial Sequence
  chemically synthesized
ttttaaatatatattttcag

SEQ ID NO: 427799 - DNA, 20 bp, Artificial Sequence
  chemically synthesized
ttaaatatatattttcagta

SEQ ID NO: 427800 - DNA, 20 bp, Artificial Sequence
  chemically synthesized
atatatattttcagtagaga

SEQ ID NO: 427801 - DNA, 20 bp, Artificial Sequence
  chemically synthesized
tatatattttcagtagagac

SEQ ID NO: 427802 - DNA, 20 bp, Artificial Sequence
  chemically synthesized
gagacgggatttcaccatat

SEQ ID NO: 427803 - DNA, 20 bp, Artificial Sequence
  chemically synthesized
cgggatttcaccatattggc

SEQ ID NO: 427804 - DNA, 20 bp, Artificial Sequence
  chemically synthesized
caagaccatcctggccaata

SEQ ID NO: 427805 - DNA, 20 bp, Artificial Sequence
  chemically synthesized
gggatttcaccatattggcc

SEQ ID NO: 427806 - DNA, 20 bp, Artificial Sequence
  chemically synthesized
tttcaccatattggccagga

SEQ ID NO: 427807 - DNA, 20 bp, Artificial Sequence
  chemically synthesized
ttaggagatcaagaccatcc

SEQ ID NO: 427808 - DNA, 20 bp, Artificial Sequence
  chemically synthesized
gatcacgaggttaggagatc

SEQ ID NO: 427809 - DNA, 20 bp, Artificial Sequence
  chemically synthesized
caggtggatcacgaggttag

SEQ ID NO: 427810 - DNA, 20 bp, Artificial Sequence
  chemically synthesized
ggcaggtggatcacgaggtt

SEQ ID NO: 427811 - DNA, 20 bp, Artificial Sequence
  chemically synthesized
aggcaggtggatcacgaggt

SEQ ID NO: 427812 - DNA, 20 bp, Artificial Sequence
  chemically synthesized
gccaaggcaggtggatcacg

SEQ ID NO: 427813 - DNA, 20 bp, Artificial Sequence
  chemically synthesized
ggccaaggcaggtggatcac

SEQ ID NO: 427814 - DNA, 20 bp, Artificial Sequence
  chemically synthesized
acctcgtgatccacctgcct

SEQ ID NO: 427815 - DNA, 20 bp, Artificial Sequence
  chemically synthesized
ctttgggaggccaaggcagg

SEQ ID NO: 427816 - DNA, 20 bp, Artificial Sequence
  chemically synthesized
gcactttgggaggccaaggc

SEQ ID NO: 427817 - DNA, 20 bp, Artificial Sequence
  chemically synthesized
agcactttgggaggccaagg

SEQ ID NO: 427818 - DNA, 20 bp, Artificial Sequence
  chemically synthesized
cccagcactttgggaggcca

SEQ ID NO: 427819 - DNA, 20 bp, Artificial Sequence
  chemically synthesized
tcccagcactttgggaggcc

SEQ ID NO: 427820 - DNA, 20 bp, Artificial Sequence
  chemically synthesized
ccacctgccttggcctccca

SEQ ID NO: 427821 - DNA, 20 bp, Artificial Sequence
  chemically synthesized
tgtaatcccagcactttggg

SEQ ID NO: 427822 - DNA, 20 bp, Artificial Sequence
  chemically synthesized
ctgtaatcccagcactttgg

SEQ ID NO: 427823 - DNA, 20 bp, Artificial Sequence
  chemically synthesized
gccttggcctcccaaagtgc

SEQ ID NO: 427824 - DNA, 20 bp, Artificial Sequence
  chemically synthesized
acctgtaatcccagcacttt

SEQ ID NO: 427825 - DNA, 20 bp, Artificial Sequence
  chemically synthesized
ccttggcctcccaaagtgct

SEQ ID NO: 427826 - DNA, 20 bp, Artificial Sequence
  chemically synthesized
cacctgtaatcccagcactt

SEQ ID NO: 427827 - DNA, 20 bp, Artificial Sequence
  chemically synthesized
ctcccaaagtgctgggatta

SEQ ID NO: 427828 - DNA, 20 bp, Artificial Sequence
  chemically synthesized
tcccaaagtgctgggattac

SEQ ID NO: 427829 - DNA, 20 bp, Artificial Sequence
  chemically synthesized
gtggctcacacctgtaatcc

SEQ ID NO: 427830 - DNA, 20 bp, Artificial Sequence
  chemically synthesized
agtgctgggattacaggtgt

SEQ ID NO: 427831 - DNA, 20 bp, Artificial Sequence
  chemically synthesized
caggtgtgagccactgcgcc

SEQ ID NO: 427832 - DNA, 20 bp, Artificial Sequence
  chemically synthesized
taacagttggccaggcgcag

SEQ ID NO: 427833 - DNA, 20 bp, Artificial Sequence
  chemically synthesized
tggtaacagttggccaggcg

SEQ ID NO: 427834 - DNA, 20 bp, Artificial Sequence
  chemically synthesized
gaaagtggtaacagttggcc

SEQ ID NO: 427835 - DNA, 20 bp, Artificial Sequence
  chemically synthesized
agaaagtggtaacagttggc

SEQ ID NO: 427836 - DNA, 20 bp, Artificial Sequence
  chemically synthesized
tattagaaagtggtaacagt

SEQ ID NO: 427837 - DNA, 20 bp, Artificial Sequence
  chemically synthesized
tttatattagaaagtggtaa

SEQ ID NO: 427838 - DNA, 20 bp, Artificial Sequence
  chemically synthesized
aaatgttttatattagaaag

SEQ ID NO: 427839 - DNA, 20 bp, Artificial Sequence
  chemically synthesized
cgaaaatgttttatattaga

SEQ ID NO: 427840 - DNA, 20 bp, Artificial Sequence
  chemically synthesized
ctgacgaaaatgttttatat

SEQ ID NO: 427841 - DNA, 20 bp, Artificial Sequence
  chemically synthesized
ctaatataaaacattttcgt

SEQ ID NO: 427842 - DNA, 20 bp, Artificial Sequence
  chemically synthesized
acattttcgtcagcccaaaa

SEQ ID NO: 427843 - DNA, 20 bp, Artificial Sequence
  chemically synthesized
gagtatggggtttctttttt

SEQ ID NO: 427844 - DNA, 20 bp, Artificial Sequence
  chemically synthesized
tgagtatggggtttcttttt

SEQ ID NO: 427845 - DNA, 20 bp, Artificial Sequence
  chemically synthesized
agtgattcctaatgagtatg

SEQ ID NO: 427846 - DNA, 20 bp, Artificial Sequence
  chemically synthesized
gagtgattcctaatgagtat

SEQ ID NO: 427847 - DNA, 20 bp, Artificial Sequence
  chemically synthesized
aaaagaaaccccatactcat

SEQ ID NO: 427848 - DNA, 20 bp, Artificial Sequence
  chemically synthesized
agagtgattcctaatgagta

SEQ ID NO: 427849 - DNA, 20 bp, Artificial Sequence
  chemically synthesized
aaagaaaccccatactcatt

SEQ ID NO: 427850 - DNA, 20 bp, Artificial Sequence
  chemically synthesized
aaaggagagtgattcctaat

SEQ ID NO: 427851 - DNA, 20 bp, Artificial Sequence
  chemically synthesized
ctggggacgtggagaaagga

SEQ ID NO: 427852 - DNA, 20 bp, Artificial Sequence
  chemically synthesized
gcctggggacgtggagaaag

SEQ ID NO: 427853 - DNA, 20 bp, Artificial Sequence
  chemically synthesized
gggcctggggacgtggagaa

SEQ ID NO: 427854 - DNA, 20 bp, Artificial Sequence
  chemically synthesized
agggcctggggacgtggaga

SEQ ID NO: 427855 - DNA, 20 bp, Artificial Sequence
  chemically synthesized
tagtagggcctggggacgtg

SEQ ID NO: 427856 - DNA, 20 bp, Artificial Sequence
  chemically synthesized
ctctcctttctccacgtccc

SEQ ID NO: 427857 - DNA, 20 bp, Artificial Sequence
  chemically synthesized
tctcctttctccacgtcccc

SEQ ID NO: 427858 - DNA, 20 bp, Artificial Sequence
  chemically synthesized
attagtagggcctggggacg

SEQ ID NO: 427859 - DNA, 20 bp, Artificial Sequence
  chemically synthesized
aagtagattagtagggcctg

SEQ ID NO: 427860 - DNA, 20 bp, Artificial Sequence
  chemically synthesized
aaagtagattagtagggcct

SEQ ID NO: 427861 - DNA, 20 bp, Artificial Sequence
  chemically synthesized
gaaagtagattagtagggcc

SEQ ID NO: 427862 - DNA, 20 bp, Artificial Sequence
  chemically synthesized
agacagaaagtagattagta

SEQ ID NO: 427863 - DNA, 20 bp, Artificial Sequence
  chemically synthesized
cagacagaaagtagattagt

SEQ ID NO: 427864 - DNA, 20 bp, Artificial Sequence
  chemically synthesized
acagacagaaagtagattag

SEQ ID NO: 427865 - DNA, 20 bp, Artificial Sequence
  chemically synthesized
aatacagacagaaagtagat

SEQ ID NO: 427866 - DNA, 20 bp, Artificial Sequence
  chemically synthesized
taatcaatacagacagaaag

SEQ ID NO: 427867 - DNA, 20 bp, Artificial Sequence
  chemically synthesized
gtctaatcaatacagacaga

SEQ ID NO: 427868 - DNA, 20 bp, Artificial Sequence
  chemically synthesized
aatagtctaatcaatacaga

SEQ ID NO: 427869 - DNA, 20 bp, Artificial Sequence
  chemically synthesized
tactttctgtctgtattgat

SEQ ID NO: 427870 - DNA, 20 bp, Artificial Sequence
  chemically synthesized
tcagaatagtctaatcaata

SEQ ID NO: 427871 - DNA, 20 bp, Artificial Sequence
  chemically synthesized
tttacataaagttttcagaa

SEQ ID NO: 427872 - DNA, 20 bp, Artificial Sequence
  chemically synthesized
tgagatttacataaagtttt

SEQ ID NO: 427873 - DNA, 20 bp, Artificial Sequence
  chemically synthesized
taaattatgagatttacata

SEQ ID NO: 427874 - DNA, 20 bp, Artificial Sequence
  chemically synthesized
tatgaaattttttaaattat

SEQ ID NO: 427875 - DNA, 20 bp, Artificial Sequence
  chemically synthesized
cataatttttaaatttttat

SEQ ID NO: 427876 - DNA, 20 bp, Artificial Sequence
  chemically synthesized
ttttaaatttttataagttg

SEQ ID NO: 427877 - DNA, 20 bp, Artificial Sequence
  chemically synthesized
tttaaatttttataagttga

SEQ ID NO: 427878 - DNA, 20 bp, Artificial Sequence
  chemically synthesized
tataagttgaaggtattaac

SEQ ID NO: 427879 - DNA, 20 bp, Artificial Sequence
  chemically synthesized
ttaataataaaatacttctt

SEQ ID NO: 427880 - DNA, 20 bp, Artificial Sequence
  chemically synthesized
aataataaaatacttcttga

SEQ ID NO: 427881 - DNA, 20 bp, Artificial Sequence
  chemically synthesized
accctgagttagctctcaag

SEQ ID NO: 427882 - DNA, 20 bp, Artificial Sequence
  chemically synthesized
ctaaccctgagttagctctc

SEQ ID NO: 427883 - DNA, 20 bp, Artificial Sequence
  chemically synthesized
atacttcttgagagctaact

SEQ ID NO: 427884 - DNA, 20 bp, Artificial Sequence
  chemically synthesized
tacttcttgagagctaactc

SEQ ID NO: 427885 - DNA, 20 bp, Artificial Sequence
  chemically synthesized
acttcttgagagctaactca

SEQ ID NO: 427886 - DNA, 20 bp, Artificial Sequence
  chemically synthesized
taaagcagctaaccctgagt

SEQ ID NO: 427887 - DNA, 20 bp, Artificial Sequence
  chemically synthesized
cttgagagctaactcagggt

SEQ ID NO: 427888 - DNA, 20 bp, Artificial Sequence
  chemically synthesized
aatataaagcagctaaccct

SEQ ID NO: 427889 - DNA, 20 bp, Artificial Sequence
  chemically synthesized
aagcatgaagaaatataaag

SEQ ID NO: 427890 - DNA, 20 bp, Artificial Sequence
  chemically synthesized
ctaaagcatgaagaaatata

SEQ ID NO: 427891 - DNA, 20 bp, Artificial Sequence
  chemically synthesized
ctttatatttcttcatgctt

SEQ ID NO: 427892 - DNA, 20 bp, Artificial Sequence
  chemically synthesized
attatatgagctaaagcatg

SEQ ID NO: 427893 - DNA, 20 bp, Artificial Sequence
  chemically synthesized
tataatgattatatgagcta

SEQ ID NO: 427894 - DNA, 20 bp, Artificial Sequence
  chemically synthesized
ctctgttataatgattatat

SEQ ID NO: 427895 - DNA, 20 bp, Artificial Sequence
  chemically synthesized
agctcatataatcattataa

SEQ ID NO: 427896 - DNA, 20 bp, Artificial Sequence
  chemically synthesized
ctcatataatcattataaca

SEQ ID NO: 427897 - DNA, 20 bp, Artificial Sequence
  chemically synthesized
atataatcattataacagag

SEQ ID NO: 427898 - DNA, 20 bp, Artificial Sequence
  chemically synthesized
tataatcattataacagaga

SEQ ID NO: 427899 - DNA, 20 bp, Artificial Sequence
  chemically synthesized
aatcattataacagagaagg

SEQ ID NO: 427900 - DNA, 20 bp, Artificial Sequence
  chemically synthesized
catctgtagaaagattgtaa

SEQ ID NO: 427901 - DNA, 20 bp, Artificial Sequence
  chemically synthesized
tttctattacaatctttcta

SEQ ID NO: 427902 - DNA, 20 bp, Artificial Sequence
  chemically synthesized
tttccatttgcatctgtaga

SEQ ID NO: 427903 - DNA, 20 bp, Artificial Sequence
  chemically synthesized
agtttttccatttgcatctg

SEQ ID NO: 427904 - DNA, 20 bp, Artificial Sequence
  chemically synthesized
aatctttctacagatgcaaa

SEQ ID NO: 427905 - DNA, 20 bp, Artificial Sequence
  chemically synthesized
cagatgcaaatggaaaaact

SEQ ID NO: 427906 - DNA, 20 bp, Artificial Sequence
  chemically synthesized
agatgcaaatggaaaaactg

SEQ ID NO: 427907 - DNA, 20 bp, Artificial Sequence
  chemically synthesized
tttcttaaactcgtgtgcct

SEQ ID NO: 427908 - DNA, 20 bp, Artificial Sequence
  chemically synthesized
atggaaaaactgaggcacac

SEQ ID NO: 427909 - DNA, 20 bp, Artificial Sequence
  chemically synthesized
aaactgaggcacacgagttt

SEQ ID NO: 427910 - DNA, 20 bp, Artificial Sequence
  chemically synthesized
acacgagtttaagaaactcc

SEQ ID NO: 427911 - DNA, 20 bp, Artificial Sequence
  chemically synthesized
ttttaactgtgtagttctgg

SEQ ID NO: 427912 - DNA, 20 bp, Artificial Sequence
  chemically synthesized
ttttttaactgtgtagttct

SEQ ID NO: 427913 - DNA, 20 bp, Artificial Sequence
  chemically synthesized
attttttaactgtgtagttc

SEQ ID NO: 427914 - DNA, 20 bp, Artificial Sequence
  chemically synthesized
aagaaactcccagaactaca

SEQ ID NO: 427915 - DNA, 20 bp, Artificial Sequence
  chemically synthesized
ttctacattttttaactgtg

SEQ ID NO: 427916 - DNA, 20 bp, Artificial Sequence
  chemically synthesized
aactacacagttaaaaaatg

SEQ ID NO: 427917 - DNA, 20 bp, Artificial Sequence
  chemically synthesized
tacacagttaaaaaatgtag

SEQ ID NO: 427918 - DNA, 20 bp, Artificial Sequence
  chemically synthesized
cagttaaaaaatgtagaagt

SEQ ID NO: 427919 - DNA, 20 bp, Artificial Sequence
  chemically synthesized
agttaaaaaatgtagaagtc

SEQ ID NO: 427920 - DNA, 20 bp, Artificial Sequence
  chemically synthesized
aatgtagaagtcaggattcc

SEQ ID NO: 427921 - DNA, 20 bp, Artificial Sequence
  chemically synthesized
tagaagtcaggattccaagt

SEQ ID NO: 427922 - DNA, 20 bp, Artificial Sequence
  chemically synthesized
agaagtcaggattccaagtc

SEQ ID NO: 427923 - DNA, 20 bp, Artificial Sequence
  chemically synthesized
gaagactgaaaagcccgact

SEQ ID NO: 427924 - DNA, 20 bp, Artificial Sequence
  chemically synthesized
ggattccaagtcgggctttt

SEQ ID NO: 427925 - DNA, 20 bp, Artificial Sequence
  chemically synthesized
gcaaacacaggaagactgaa

SEQ ID NO: 427926 - DNA, 20 bp, Artificial Sequence
  chemically synthesized
tgagagctggcaaacacagg

SEQ ID NO: 427927 - DNA, 20 bp, Artificial Sequence
  chemically synthesized
aggtgagagctggcaaacac

SEQ ID NO: 427928 - DNA, 20 bp, Artificial Sequence
  chemically synthesized
ttcagtcttcctgtgtttgc

SEQ ID NO: 427929 - DNA, 20 bp, Artificial Sequence
  chemically synthesized
caggtgagagctggcaaaca

SEQ ID NO: 427930 - DNA, 20 bp, Artificial Sequence
  chemically synthesized
cacaatactcaggtgagagc

SEQ ID NO: 427931 - DNA, 20 bp, Artificial Sequence
  chemically synthesized
gtgtttgccagctctcacct

SEQ ID NO: 427932 - DNA, 20 bp, Artificial Sequence
  chemically synthesized
gtaacacaatactcaggtga

SEQ ID NO: 427933 - DNA, 20 bp, Artificial Sequence
  chemically synthesized
tagtaacacaatactcaggt

SEQ ID NO: 427934 - DNA, 20 bp, Artificial Sequence
  chemically synthesized
ctactagtaacacaatactc

SEQ ID NO: 427935 - DNA, 20 bp, Artificial Sequence
  chemically synthesized
tctactagtaacacaatact

SEQ ID NO: 427936 - DNA, 20 bp, Artificial Sequence
  chemically synthesized
tcacctgagtattgtgttac

SEQ ID NO: 427937 - DNA, 20 bp, Artificial Sequence
  chemically synthesized
cctgagtattgtgttactag

SEQ ID NO: 427938 - DNA, 20 bp, Artificial Sequence
  chemically synthesized
tgagtattgtgttactagta

SEQ ID NO: 427939 - DNA, 20 bp, Artificial Sequence
  chemically synthesized
gagtattgtgttactagtag

SEQ ID NO: 427940 - DNA, 20 bp, Artificial Sequence
  chemically synthesized
agtattgtgttactagtaga

SEQ ID NO: 427941 - DNA, 20 bp, Artificial Sequence
  chemically synthesized
ctgtgagcacgtccctctac

SEQ ID NO: 427942 - DNA, 20 bp, Artificial Sequence
  chemically synthesized
ctagtagagggacgtgctca

SEQ ID NO: 427943 - DNA, 20 bp, Artificial Sequence
  chemically synthesized
cccctcataggggcgactgt

SEQ ID NO: 427944 - DNA, 20 bp, Artificial Sequence
  chemically synthesized
gtgctcacagtcgcccctat

SEQ ID NO: 427945 - DNA, 20 bp, Artificial Sequence
  chemically synthesized
tgctcacagtcgcccctatg

SEQ ID NO: 427946 - DNA, 20 bp, Artificial Sequence
  chemically synthesized
gctcacagtcgcccctatga

SEQ ID NO: 427947 - DNA, 20 bp, Artificial Sequence
  chemically synthesized
ctcacagtcgcccctatgag

SEQ ID NO: 427948 - DNA, 20 bp, Artificial Sequence
  chemically synthesized
catccaaatacccctcatag

SEQ ID NO: 427949 - DNA, 20 bp, Artificial Sequence
  chemically synthesized
gcatccaaatacccctcata

SEQ ID NO: 427950 - DNA, 20 bp, Artificial Sequence
  chemically synthesized
tgcatccaaatacccctcat

SEQ ID NO: 427951 - DNA, 20 bp, Artificial Sequence
  chemically synthesized
ctgcatccaaatacccctca

SEQ ID NO: 427952 - DNA, 20 bp, Artificial Sequence
  chemically synthesized
tcgcccctatgaggggtatt

SEQ ID NO: 427953 - DNA, 20 bp, Artificial Sequence
  chemically synthesized
ctatgaggggtatttggatg

SEQ ID NO: 427954 - DNA, 20 bp, Artificial Sequence
  chemically synthesized
atcatttcaatccacaaaaa

SEQ ID NO: 427955 - DNA, 20 bp, Artificial Sequence
  chemically synthesized
tcatttcaatccacaaaaat

SEQ ID NO: 427956 - DNA, 20 bp, Artificial Sequence
  chemically synthesized
gaggactaagcctatttttg

SEQ ID NO: 427957 - DNA, 20 bp, Artificial Sequence
  chemically synthesized
tcaatccacaaaaataggct

SEQ ID NO: 427958 - DNA, 20 bp, Artificial Sequence
  chemically synthesized
ttccttacttattgaggact

SEQ ID NO: 427959 - DNA, 20 bp, Artificial Sequence
  chemically synthesized
aaataggcttagtcctcaat

SEQ ID NO: 427960 - DNA, 20 bp, Artificial Sequence
  chemically synthesized
ccttgattccttacttattg

SEQ ID NO: 427961 - DNA, 20 bp, Artificial Sequence
  chemically synthesized
aggcttagtcctcaataagt

SEQ ID NO: 427962 - DNA, 20 bp, Artificial Sequence
  chemically synthesized
accttgattccttacttatt

SEQ ID NO: 427963 - DNA, 20 bp, Artificial Sequence
  chemically synthesized
ggcttagtcctcaataagta

SEQ ID NO: 427964 - DNA, 20 bp, Artificial Sequence
  chemically synthesized
tcctcaataagtaaggaatc

SEQ ID NO: 427965 - DNA, 20 bp, Artificial Sequence
  chemically synthesized
cctcaataagtaaggaatca

SEQ ID NO: 427966 - DNA, 20 bp, Artificial Sequence
  chemically synthesized
aataagtaaggaatcaaggt

SEQ ID NO: 427967 - DNA, 20 bp, Artificial Sequence
  chemically synthesized
ataagtaaggaatcaaggtg

SEQ ID NO: 427968 - DNA, 20 bp, Artificial Sequence
  chemically synthesized
taagtaaggaatcaaggtga

SEQ ID NO: 427969 - DNA, 20 bp, Artificial Sequence
  chemically synthesized
gaatcaaggtgagggcactg

SEQ ID NO: 427970 - DNA, 20 bp, Artificial Sequence
  chemically synthesized
atcaaggtgagggcactgca

SEQ ID NO: 427971 - DNA, 20 bp, Artificial Sequence
  chemically synthesized
aggtgagggcactgcagagt

SEQ ID NO: 427972 - DNA, 20 bp, Artificial Sequence
  chemically synthesized
tcaacaaaatactaactctg

SEQ ID NO: 427973 - DNA, 20 bp, Artificial Sequence
  chemically synthesized
gcagagttagtattttgttg

SEQ ID NO: 427974 - DNA, 20 bp, Artificial Sequence
  chemically synthesized
cgtctcaaaaagaaaaaaaa

SEQ ID NO: 427975 - DNA, 20 bp, Artificial Sequence
  chemically synthesized
aatcttttttttttcttttt

SEQ ID NO: 427976 - DNA, 20 bp, Artificial Sequence
  chemically synthesized
agagcaagactcgtctcaaa

SEQ ID NO: 427977 - DNA, 20 bp, Artificial Sequence
  chemically synthesized
tttttttttctttttgagac

SEQ ID NO: 427978 - DNA, 20 bp, Artificial Sequence
  chemically synthesized
tgcagcctgggtgacagagc

SEQ ID NO: 427979 - DNA, 20 bp, Artificial Sequence
  chemically synthesized
acgagtcttgctctgtcacc

SEQ ID NO: 427980 - DNA, 20 bp, Artificial Sequence
  chemically synthesized
gcactgcagcctgggtgaca

SEQ ID NO: 427981 - DNA, 20 bp, Artificial Sequence
  chemically synthesized
cgagtcttgctctgtcaccc

SEQ ID NO: 427982 - DNA, 20 bp, Artificial Sequence
  chemically synthesized
ctgcactgcagcctgggtga

SEQ ID NO: 427983 - DNA, 20 bp, Artificial Sequence
  chemically synthesized
ttgctctgtcacccaggctg

SEQ ID NO: 427984 - DNA, 20 bp, Artificial Sequence
  chemically synthesized
gagccactgcactgcagcct

SEQ ID NO: 427985 - DNA, 20 bp, Artificial Sequence
  chemically synthesized
tgagccactgcactgcagcc

SEQ ID NO: 427986 - DNA, 20 bp, Artificial Sequence
  chemically synthesized
ctgtcacccaggctgcagtg

SEQ ID NO: 427987 - DNA, 20 bp, Artificial Sequence
  chemically synthesized
gagattgagccactgcactg

SEQ ID NO: 427988 - DNA, 20 bp, Artificial Sequence
  chemically synthesized
tcacccaggctgcagtgcag

SEQ ID NO: 427989 - DNA, 20 bp, Artificial Sequence
  chemically synthesized
ggttgcagtgagcagagatt

SEQ ID NO: 427990 - DNA, 20 bp, Artificial Sequence
  chemically synthesized
ggcggaggttgcagtgagca

SEQ ID NO: 427991 - DNA, 20 bp, Artificial Sequence
  chemically synthesized
gaggcggaggttgcagtgag

SEQ ID NO: 427992 - DNA, 20 bp, Artificial Sequence
  chemically synthesized
tgggaggcggaggttgcagt

SEQ ID NO: 427993 - DNA, 20 bp, Artificial Sequence
  chemically synthesized
aacctgggaggcggaggttg

SEQ ID NO: 427994 - DNA, 20 bp, Artificial Sequence
  chemically synthesized
cgcttgaacctgggaggcgg

SEQ ID NO: 427995 - DNA, 20 bp, Artificial Sequence
  chemically synthesized
tcactgcaacctccgcctcc

SEQ ID NO: 427996 - DNA, 20 bp, Artificial Sequence
  chemically synthesized
tcgcttgaacctgggaggcg

SEQ ID NO: 427997 - DNA, 20 bp, Artificial Sequence
  chemically synthesized
cactgcaacctccgcctccc

SEQ ID NO: 427998 - DNA, 20 bp, Artificial Sequence
  chemically synthesized
aatcgcttgaacctgggagg

SEQ ID NO: 427999 - DNA, 20 bp, Artificial Sequence
  chemically synthesized
gagaatcgcttgaacctggg

SEQ ID NO: 428000 - DNA, 20 bp, Artificial Sequence
  chemically synthesized
ggagaatcgcttgaacctgg

SEQ ID NO: 428001 - DNA, 20 bp, Artificial Sequence
  chemically synthesized
aacctccgcctcccaggttc

SEQ ID NO: 428002 - DNA, 20 bp, Artificial Sequence
  chemically synthesized
caggagaatcgcttgaacct

SEQ ID NO: 428003 - DNA, 20 bp, Artificial Sequence
  chemically synthesized
gcaggagaatcgcttgaacc

SEQ ID NO: 428004 - DNA, 20 bp, Artificial Sequence
  chemically synthesized
ttcaagcgattctcctgcct

SEQ ID NO: 428005 - DNA, 20 bp, Artificial Sequence
  chemically synthesized
tactcgggaggctgaggcag

SEQ ID NO: 428006 - DNA, 20 bp, Artificial Sequence
  chemically synthesized
gctactcgggaggctgaggc

SEQ ID NO: 428007 - DNA, 20 bp, Artificial Sequence
  chemically synthesized
agctactcgggaggctgagg

SEQ ID NO: 428008 - DNA, 20 bp, Artificial Sequence
  chemically synthesized
cccagctactcgggaggctg

SEQ ID NO: 428009 - DNA, 20 bp, Artificial Sequence
  chemically synthesized
tcccagctactcgggaggct

SEQ ID NO: 428010 - DNA, 20 bp, Artificial Sequence
  chemically synthesized
ttctcctgcctcagcctccc

SEQ ID NO: 428011 - DNA, 20 bp, Artificial Sequence
  chemically synthesized
tcctgcctcagcctcccgag

SEQ ID NO: 428012 - DNA, 20 bp, Artificial Sequence
  chemically synthesized
tgtagtcccagctactcggg

SEQ ID NO: 428013 - DNA, 20 bp, Artificial Sequence
  chemically synthesized
ctgtagtcccagctactcgg

SEQ ID NO: 428014 - DNA, 20 bp, Artificial Sequence
  chemically synthesized
gcctcagcctcccgagtagc

SEQ ID NO: 428015 - DNA, 20 bp, Artificial Sequence
  chemically synthesized
acctgtagtcccagctactc

SEQ ID NO: 428016 - DNA, 20 bp, Artificial Sequence
  chemically synthesized
cctcagcctcccgagtagct

SEQ ID NO: 428017 - DNA, 20 bp, Artificial Sequence
  chemically synthesized
cacctgtagtcccagctact

SEQ ID NO: 428018 - DNA, 20 bp, Artificial Sequence
  chemically synthesized
ctcccgagtagctgggacta

SEQ ID NO: 428019 - DNA, 20 bp, Artificial Sequence
  chemically synthesized
tcccgagtagctgggactac

SEQ ID NO: 428020 - DNA, 20 bp, Artificial Sequence
  chemically synthesized
gtagcacacacctgtagtcc

SEQ ID NO: 428021 - DNA, 20 bp, Artificial Sequence
  chemically synthesized
ggtgtagtagcacacacctg

SEQ ID NO: 428022 - DNA, 20 bp, Artificial Sequence
  chemically synthesized
caggtgtgtgctactacacc

SEQ ID NO: 428023 - DNA, 20 bp, Artificial Sequence
  chemically synthesized
aaaaaattagccaggtgtag

SEQ ID NO: 428024 - DNA, 20 bp, Artificial Sequence
  chemically synthesized
ataaaaaaattagccaggtg

SEQ ID NO: 428025 - DNA, 20 bp, Artificial Sequence
  chemically synthesized
aaaaaataaaaaaattagcc

SEQ ID NO: 428026 - DNA, 20 bp, Artificial Sequence
  chemically synthesized
taaaaaataaaaaaattagc

SEQ ID NO: 428027 - DNA, 20 bp, Artificial Sequence
  chemically synthesized
ctactaaaaaataaaaaaat

SEQ ID NO: 428028 - DNA, 20 bp, Artificial Sequence
  chemically synthesized
tggctaatttttttattttt

SEQ ID NO: 428029 - DNA, 20 bp, Artificial Sequence
  chemically synthesized
ctaatttttttattttttag

SEQ ID NO: 428030 - DNA, 20 bp, Artificial Sequence
  chemically synthesized
aatttttttattttttagta

SEQ ID NO: 428031 - DNA, 20 bp, Artificial Sequence
  chemically synthesized
tttttattttttagtagaga

SEQ ID NO: 428032 - DNA, 20 bp, Artificial Sequence
  chemically synthesized
ttttattttttagtagagac

SEQ ID NO: 428033 - DNA, 20 bp, Artificial Sequence
  chemically synthesized
tttattttttagtagagacg

SEQ ID NO: 428034 - DNA, 20 bp, Artificial Sequence
  chemically synthesized
gagacggggtttcaccgtgt

SEQ ID NO: 428035 - DNA, 20 bp, Artificial Sequence
  chemically synthesized
cggggtttcaccgtgtcagc

SEQ ID NO: 428036 - DNA, 20 bp, Artificial Sequence
  chemically synthesized
cgagaccatcctggctgaca

SEQ ID NO: 428037 - DNA, 20 bp, Artificial Sequence
  chemically synthesized
ggggtttcaccgtgtcagcc

SEQ ID NO: 428038 - DNA, 20 bp, Artificial Sequence
  chemically synthesized
tttcaccgtgtcagccagga

SEQ ID NO: 428039 - DNA, 20 bp, Artificial Sequence
  chemically synthesized
tcaggatgtcgagaccatcc

SEQ ID NO: 428040 - DNA, 20 bp, Artificial Sequence
  chemically synthesized
gatcacaaggtcaggatgtc

SEQ ID NO: 428041 - DNA, 20 bp, Artificial Sequence
  chemically synthesized
ggcgggtggatcacaaggtc

SEQ ID NO: 428042 - DNA, 20 bp, Artificial Sequence
  chemically synthesized
aggcgggtggatcacaaggt

SEQ ID NO: 428043 - DNA, 20 bp, Artificial Sequence
  chemically synthesized
gctgaggcgggtggatcaca

SEQ ID NO: 428044 - DNA, 20 bp, Artificial Sequence
  chemically synthesized
ggctgaggcgggtggatcac

SEQ ID NO: 428045 - DNA, 20 bp, Artificial Sequence
  chemically synthesized
accttgtgatccacccgcct

SEQ ID NO: 428046 - DNA, 20 bp, Artificial Sequence
  chemically synthesized
ctttgggaggctgaggcggg

SEQ ID NO: 428047 - DNA, 20 bp, Artificial Sequence
  chemically synthesized
gcactttgggaggctgaggc

SEQ ID NO: 428048 - DNA, 20 bp, Artificial Sequence
  chemically synthesized
agcactttgggaggctgagg

SEQ ID NO: 428049 - DNA, 20 bp, Artificial Sequence
  chemically synthesized
cccagcactttgggaggctg

SEQ ID NO: 428050 - DNA, 20 bp, Artificial Sequence
  chemically synthesized
tcccagcactttgggaggct

SEQ ID NO: 428051 - DNA, 20 bp, Artificial Sequence
  chemically synthesized
ccacccgcctcagcctccca

SEQ ID NO: 428052 - DNA, 20 bp, Artificial Sequence
  chemically synthesized
tgtaatcccagcactttggg

SEQ ID NO: 428053 - DNA, 20 bp, Artificial Sequence
  chemically synthesized
ctgtaatcccagcactttgg

SEQ ID NO: 428054 - DNA, 20 bp, Artificial Sequence
  chemically synthesized
gcctcagcctcccaaagtgc

SEQ ID NO: 428055 - DNA, 20 bp, Artificial Sequence
  chemically synthesized
gcctgtaatcccagcacttt

SEQ ID NO: 428056 - DNA, 20 bp, Artificial Sequence
  chemically synthesized
cctcagcctcccaaagtgct

SEQ ID NO: 428057 - DNA, 20 bp, Artificial Sequence
  chemically synthesized
cgcctgtaatcccagcactt

SEQ ID NO: 428058 - DNA, 20 bp, Artificial Sequence
  chemically synthesized
ctcccaaagtgctgggatta

SEQ ID NO: 428059 - DNA, 20 bp, Artificial Sequence
  chemically synthesized
tcccaaagtgctgggattac

SEQ ID NO: 428060 - DNA, 20 bp, Artificial Sequence
  chemically synthesized
gtggttcacgcctgtaatcc

SEQ ID NO: 428061 - DNA, 20 bp, Artificial Sequence
  chemically synthesized
caggcgtgaaccaccgccgc

SEQ ID NO: 428062 - DNA, 20 bp, Artificial Sequence
  chemically synthesized
gatttattggccagcggcgg

SEQ ID NO: 428063 - DNA, 20 bp, Artificial Sequence
  chemically synthesized
taagatttattggccagcgg

SEQ ID NO: 428064 - DNA, 20 bp, Artificial Sequence
  chemically synthesized
ttttaagatttattggccag

SEQ ID NO: 428065 - DNA, 20 bp, Artificial Sequence
  chemically synthesized
atattttaagatttattggc

SEQ ID NO: 428066 - DNA, 20 bp, Artificial Sequence
  chemically synthesized
aagaatattttaagatttat

SEQ ID NO: 428067 - DNA, 20 bp, Artificial Sequence
  chemically synthesized
gagagcaggaagaatatttt

SEQ ID NO: 428068 - DNA, 20 bp, Artificial Sequence
  chemically synthesized
acaaaagaaaggagagcagg

SEQ ID NO: 428069 - DNA, 20 bp, Artificial Sequence
  chemically synthesized
cagacaaaagaaaggagagc

SEQ ID NO: 428070 - DNA, 20 bp, Artificial Sequence
  chemically synthesized
acagacaaaagaaaggagag

SEQ ID NO: 428071 - DNA, 20 bp, Artificial Sequence
  chemically synthesized
ataacagacaaaagaaagga

SEQ ID NO: 428072 - DNA, 20 bp, Artificial Sequence
  chemically synthesized
aaataacagacaaaagaaag

SEQ ID NO: 428073 - DNA, 20 bp, Artificial Sequence
  chemically synthesized
ggaaataacagacaaaagaa

SEQ ID NO: 428074 - DNA, 20 bp, Artificial Sequence
  chemically synthesized
gggaaataacagacaaaaga

SEQ ID NO: 428075 - DNA, 20 bp, Artificial Sequence
  chemically synthesized
tccagggaaataacagacaa

SEQ ID NO: 428076 - DNA, 20 bp, Artificial Sequence
  chemically synthesized
gtagatatccagggaaataa

SEQ ID NO: 428077 - DNA, 20 bp, Artificial Sequence
  chemically synthesized
tcttttgtctgttatttccc

SEQ ID NO: 428078 - DNA, 20 bp, Artificial Sequence
  chemically synthesized
tatttcacagtagatatcca

SEQ ID NO: 428079 - DNA, 20 bp, Artificial Sequence
  chemically synthesized
gtatttcacagtagatatcc

SEQ ID NO: 428080 - DNA, 20 bp, Artificial Sequence
  chemically synthesized
agtatttcacagtagatatc

SEQ ID NO: 428081 - DNA, 20 bp, Artificial Sequence
  chemically synthesized
gagaccacagtatttcacag

SEQ ID NO: 428082 - DNA, 20 bp, Artificial Sequence
  chemically synthesized
tgtgagaccacagtatttca

SEQ ID NO: 428083 - DNA, 20 bp, Artificial Sequence
  chemically synthesized
atatctactgtgaaatactg

SEQ ID NO: 428084 - DNA, 20 bp, Artificial Sequence
  chemically synthesized
ctggtttgtatgtgagacca

SEQ ID NO: 428085 - DNA, 20 bp, Artificial Sequence
  chemically synthesized
atttttcctggtttgtatgt

SEQ ID NO: 428086 - DNA, 20 bp, Artificial Sequence
  chemically synthesized
ctgtggtctcacatacaaac

SEQ ID NO: 428087 - DNA, 20 bp, Artificial Sequence
  chemically synthesized
tgtggtctcacatacaaacc

SEQ ID NO: 428088 - DNA, 20 bp, Artificial Sequence
  chemically synthesized
cacctccctctcatttttcc

SEQ ID NO: 428089 - DNA, 20 bp, Artificial Sequence
  chemically synthesized
acatacaaaccaggaaaaat

SEQ ID NO: 428090 - DNA, 20 bp, Artificial Sequence
  chemically synthesized
atacaaaccaggaaaaatga

SEQ ID NO: 428091 - DNA, 20 bp, Artificial Sequence
  chemically synthesized
tacaaaccaggaaaaatgag

SEQ ID NO: 428092 - DNA, 20 bp, Artificial Sequence
  chemically synthesized
acaaaccaggaaaaatgaga

SEQ ID NO: 428093 - DNA, 20 bp, Artificial Sequence
  chemically synthesized
aaaccaggaaaaatgagagg

SEQ ID NO: 428094 - DNA, 20 bp, Artificial Sequence
  chemically synthesized
aaccaggaaaaatgagaggg

SEQ ID NO: 428095 - DNA, 20 bp, Artificial Sequence
  chemically synthesized
ggtgcattttatctcaaata

SEQ ID NO: 428096 - DNA, 20 bp, Artificial Sequence
  chemically synthesized
ttattagaagttctgtattt

SEQ ID NO: 428097 - DNA, 20 bp, Artificial Sequence
  chemically synthesized
aaataactctgttttattag

SEQ ID NO: 428098 - DNA, 20 bp, Artificial Sequence
  chemically synthesized
atacagaacttctaataaaa

SEQ ID NO: 428099 - DNA, 20 bp, Artificial Sequence
  chemically synthesized
ttaaaataactctgttttat

SEQ ID NO: 428100 - DNA, 20 bp, Artificial Sequence
  chemically synthesized
acagaacttctaataaaaca

SEQ ID NO: 428101 - DNA, 20 bp, Artificial Sequence
  chemically synthesized
acagagttattttaaatgta

SEQ ID NO: 428102 - DNA, 20 bp, Artificial Sequence
  chemically synthesized
cagagttattttaaatgtat

SEQ ID NO: 428103 - DNA, 20 bp, Artificial Sequence
  chemically synthesized
agagttattttaaatgtata

SEQ ID NO: 428104 - DNA, 20 bp, Artificial Sequence
  chemically synthesized
gagttattttaaatgtatag

SEQ ID NO: 428105 - DNA, 20 bp, Artificial Sequence
  chemically synthesized
agttattttaaatgtatagg

SEQ ID NO: 428106 - DNA, 20 bp, Artificial Sequence
  chemically synthesized
taatgctaaatcaaataatc

SEQ ID NO: 428107 - DNA, 20 bp, Artificial Sequence
  chemically synthesized
aaacacttgattatttgatt

SEQ ID NO: 428108 - DNA, 20 bp, Artificial Sequence
  chemically synthesized
ttgcatgcattttattctgc

SEQ ID NO: 428109 - DNA, 20 bp, Artificial Sequence
  chemically synthesized
gaactaattttgattgccag

SEQ ID NO: 428110 - DNA, 20 bp, Artificial Sequence
  chemically synthesized
ctggaactaattttgattgc

SEQ ID NO: 428111 - DNA, 20 bp, Artificial Sequence
  chemically synthesized
attctgctggcaatcaaaat

SEQ ID NO: 428112 - DNA, 20 bp, Artificial Sequence
  chemically synthesized
ctggcaatcaaaattagttc

SEQ ID NO: 428113 - DNA, 20 bp, Artificial Sequence
  chemically synthesized
gcaatcaaaattagttccag

SEQ ID NO: 428114 - DNA, 20 bp, Artificial Sequence
  chemically synthesized
atcaaaattagttccagaag

SEQ ID NO: 428115 - DNA, 20 bp, Artificial Sequence
  chemically synthesized
tcaaaattagttccagaaga

SEQ ID NO: 428116 - DNA, 20 bp, Artificial Sequence
  chemically synthesized
tgccattccggaccttcttc

SEQ ID NO: 428117 - DNA, 20 bp, Artificial Sequence
  chemically synthesized
attagttccagaagaaggtc

SEQ ID NO: 428118 - DNA, 20 bp, Artificial Sequence
  chemically synthesized
ttccagaagaaggtccggaa

SEQ ID NO: 428119 - DNA, 20 bp, Artificial Sequence
  chemically synthesized
cagaagaaggtccggaatgg

SEQ ID NO: 428120 - DNA, 20 bp, Artificial Sequence
  chemically synthesized
gaatgtgtcaactgccattc

SEQ ID NO: 428121 - DNA, 20 bp, Artificial Sequence
  chemically synthesized
atatcagggctattgagcag

SEQ ID NO: 428122 - DNA, 20 bp, Artificial Sequence
  chemically synthesized
tgacacattcccctgctcaa

SEQ ID NO: 428123 - DNA, 20 bp, Artificial Sequence
  chemically synthesized
aatatcagggctattgagca

SEQ ID NO: 428124 - DNA, 20 bp, Artificial Sequence
  chemically synthesized
aaatatcagggctattgagc

SEQ ID NO: 428125 - DNA, 20 bp, Artificial Sequence
  chemically synthesized
taaatatcagggctattgag

SEQ ID NO: 428126 - DNA, 20 bp, Artificial Sequence
  chemically synthesized
ttataaatatcagggctatt

SEQ ID NO: 428127 - DNA, 20 bp, Artificial Sequence
  chemically synthesized
aatcataattataaatatca

SEQ ID NO: 428128 - DNA, 20 bp, Artificial Sequence
  chemically synthesized
aaatcataattataaatatc

SEQ ID NO: 428129 - DNA, 20 bp, Artificial Sequence
  chemically synthesized
caaatcataattataaatat

SEQ ID NO: 428130 - DNA, 20 bp, Artificial Sequence
  chemically synthesized
atgatttgaatacattttac

SEQ ID NO: 428131 - DNA, 20 bp, Artificial Sequence
  chemically synthesized
tgatttgaatacattttact

SEQ ID NO: 428132 - DNA, 20 bp, Artificial Sequence
  chemically synthesized
ttgaatacattttactgggc

SEQ ID NO: 428133 - DNA, 20 bp, Artificial Sequence
  chemically synthesized
tgctttaatatttactagcc

SEQ ID NO: 428134 - DNA, 20 bp, Artificial Sequence
  chemically synthesized
aaatttgctttaatatttac

SEQ ID NO: 428135 - DNA, 20 bp, Artificial Sequence
  chemically synthesized
tactgggctagtaaatatta

SEQ ID NO: 428136 - DNA, 20 bp, Artificial Sequence
  chemically synthesized
taaatattaaagcaaatttt

SEQ ID NO: 428137 - DNA, 20 bp, Artificial Sequence
  chemically synthesized
aatgatgaaaaaattaattt

SEQ ID NO: 428138 - DNA, 20 bp, Artificial Sequence
  chemically synthesized
gtttgttgtttgtaaattta

SEQ ID NO: 428139 - DNA, 20 bp, Artificial Sequence
  chemically synthesized
atgtttgttgtttgtaaatt

SEQ ID NO: 428140 - DNA, 20 bp, Artificial Sequence
  chemically synthesized
caacaaacatgcaattttct

SEQ ID NO: 428141 - DNA, 20 bp, Artificial Sequence
  chemically synthesized
caaacatgcaattttctaag

SEQ ID NO: 428142 - DNA, 20 bp, Artificial Sequence
  chemically synthesized
ctggtgtgtgttattctact

SEQ ID NO: 428143 - DNA, 20 bp, Artificial Sequence
  chemically synthesized
ctaagtagaataacacacac

SEQ ID NO: 428144 - DNA, 20 bp, Artificial Sequence
  chemically synthesized
taagtagaataacacacacc

SEQ ID NO: 428145 - DNA, 20 bp, Artificial Sequence
  chemically synthesized
aagtagaataacacacacca

SEQ ID NO: 428146 - DNA, 20 bp, Artificial Sequence
  chemically synthesized
gtagaataacacacaccagg

SEQ ID NO: 428147 - DNA, 20 bp, Artificial Sequence
  chemically synthesized
tttcaaatatcattactccc

SEQ ID NO: 428148 - DNA, 20 bp, Artificial Sequence
  chemically synthesized
tttgaaatgactgtgaattt

SEQ ID NO: 428149 - DNA, 20 bp, Artificial Sequence
  chemically synthesized
catccagagaccaaaattca

SEQ ID NO: 428150 - DNA, 20 bp, Artificial Sequence
  chemically synthesized
tgactgtgaattttggtctc

SEQ ID NO: 428151 - DNA, 20 bp, Artificial Sequence
  chemically synthesized
ccaaaagccaagaacatcca

SEQ ID NO: 428152 - DNA, 20 bp, Artificial Sequence
  chemically synthesized
gaccaaaagccaagaacatc

SEQ ID NO: 428153 - DNA, 20 bp, Artificial Sequence
  chemically synthesized
ttttggtctctggatgttct

SEQ ID NO: 428154 - DNA, 20 bp, Artificial Sequence
  chemically synthesized
ctctggatgttcttggcttt

SEQ ID NO: 428155 - DNA, 20 bp, Artificial Sequence
  chemically synthesized
gaatcatatgaccaaaagcc

SEQ ID NO: 428156 - DNA, 20 bp, Artificial Sequence
  chemically synthesized
gtagtgaatcatatgaccaa

SEQ ID NO: 428157 - DNA, 20 bp, Artificial Sequence
  chemically synthesized
atatgattcactacaccttc

SEQ ID NO: 428158 - DNA, 20 bp, Artificial Sequence
  chemically synthesized
aattacatgcctagaaggtg

SEQ ID NO: 428159 - DNA, 20 bp, Artificial Sequence
  chemically synthesized
tatgattcactacaccttct

SEQ ID NO: 428160 - DNA, 20 bp, Artificial Sequence
  chemically synthesized
gagataattacatgcctaga

SEQ ID NO: 428161 - DNA, 20 bp, Artificial Sequence
  chemically synthesized
agagataattacatgcctag

SEQ ID NO: 428162 - DNA, 20 bp, Artificial Sequence
  chemically synthesized
ttaagagataattacatgcc

SEQ ID NO: 428163 - DNA, 20 bp, Artificial Sequence
  chemically synthesized
gacaggatgtgaggtgttaa

SEQ ID NO: 428164 - DNA, 20 bp, Artificial Sequence
  chemically synthesized
atgacaggatgtgaggtgtt

SEQ ID NO: 428165 - DNA, 20 bp, Artificial Sequence
  chemically synthesized
atactgtatgacaggatgtg

SEQ ID NO: 428166 - DNA, 20 bp, Artificial Sequence
  chemically synthesized
catactgtatgacaggatgt

SEQ ID NO: 428167 - DNA, 20 bp, Artificial Sequence
  chemically synthesized
acacctcacatcctgtcata

SEQ ID NO: 428168 - DNA, 20 bp, Artificial Sequence
  chemically synthesized
ggaatggcatactgtatgac

SEQ ID NO: 428169 - DNA, 20 bp, Artificial Sequence
  chemically synthesized
aggaatggcatactgtatga

SEQ ID NO: 428170 - DNA, 20 bp, Artificial Sequence
  chemically synthesized
accaattctcatttaaggaa

SEQ ID NO: 428171 - DNA, 20 bp, Artificial Sequence
  chemically synthesized
cagtatgccattccttaaat

SEQ ID NO: 428172 - DNA, 20 bp, Artificial Sequence
  chemically synthesized
tcgagaccaattctcattta

SEQ ID NO: 428173 - DNA, 20 bp, Artificial Sequence
  chemically synthesized
ctcgagaccaattctcattt

SEQ ID NO: 428174 - DNA, 20 bp, Artificial Sequence
  chemically synthesized
gccattccttaaatgagaat

SEQ ID NO: 428175 - DNA, 20 bp, Artificial Sequence
  chemically synthesized
cttaaatgagaattggtctc

SEQ ID NO: 428176 - DNA, 20 bp, Artificial Sequence
  chemically synthesized
ctaaatatacaatgatactc

SEQ ID NO: 428177 - DNA, 20 bp, Artificial Sequence
  chemically synthesized
ctcgagtatcattgtatatt

SEQ ID NO: 428178 - DNA, 20 bp, Artificial Sequence
  chemically synthesized
atgtttctattaaaattatt

SEQ ID NO: 428179 - DNA, 20 bp, Artificial Sequence
  chemically synthesized
ttagatcttaataattttaa

SEQ ID NO: 428180 - DNA, 20 bp, Artificial Sequence
  chemically synthesized
attttaatagaaacatcaac

SEQ ID NO: 428181 - DNA, 20 bp, Artificial Sequence
  chemically synthesized
ttttgcccttcagaaattac

SEQ ID NO: 428182 - DNA, 20 bp, Artificial Sequence
  chemically synthesized
acatcaaccagtaatttctg

SEQ ID NO: 428183 - DNA, 20 bp, Artificial Sequence
  chemically synthesized
catcaaccagtaatttctga

SEQ ID NO: 428184 - DNA, 20 bp, Artificial Sequence
  chemically synthesized
atcaaccagtaatttctgaa

SEQ ID NO: 428185 - DNA, 20 bp, Artificial Sequence
  chemically synthesized
aatttatatattttgccctt

SEQ ID NO: 428186 - DNA, 20 bp, Artificial Sequence
  chemically synthesized
ttaaagaaaagatatatttt

SEQ ID NO: 428187 - DNA, 20 bp, Artificial Sequence
  chemically synthesized
agctagattttattaaagaa

SEQ ID NO: 428188 - DNA, 20 bp, Artificial Sequence
  chemically synthesized
ttaagagctagattttatta

SEQ ID NO: 428189 - DNA, 20 bp, Artificial Sequence
  chemically synthesized
atcttttctttaataaaatc

SEQ ID NO: 428190 - DNA, 20 bp, Artificial Sequence
  chemically synthesized
ctgaatagaattttaagagc

SEQ ID NO: 428191 - DNA, 20 bp, Artificial Sequence
  chemically synthesized
aggtctgaatagaattttaa

SEQ ID NO: 428192 - DNA, 20 bp, Artificial Sequence
  chemically synthesized
ctaggtctgaatagaatttt

SEQ ID NO: 428193 - DNA, 20 bp, Artificial Sequence
  chemically synthesized
ctagctcttaaaattctatt

SEQ ID NO: 428194 - DNA, 20 bp, Artificial Sequence
  chemically synthesized
aggatcattctaggtctgaa

SEQ ID NO: 428195 - DNA, 20 bp, Artificial Sequence
  chemically synthesized
cttaaaattctattcagacc

SEQ ID NO: 428196 - DNA, 20 bp, Artificial Sequence
  chemically synthesized
tgatcttaaaggatcattct

SEQ ID NO: 428197 - DNA, 20 bp, Artificial Sequence
  chemically synthesized
atgatcttaaaggatcattc

SEQ ID NO: 428198 - DNA, 20 bp, Artificial Sequence
  chemically synthesized
cagacctagaatgatccttt

SEQ ID NO: 428199 - DNA, 20 bp, Artificial Sequence
  chemically synthesized
taggagttaaatgatcttaa

SEQ ID NO: 428200 - DNA, 20 bp, Artificial Sequence
  chemically synthesized
ataggagttaaatgatctta

SEQ ID NO: 428201 - DNA, 20 bp, Artificial Sequence
  chemically synthesized
attttgcaatttaattatag

SEQ ID NO: 428202 - DNA, 20 bp, Artificial Sequence
  chemically synthesized
aaattttgcaatttaattat

SEQ ID NO: 428203 - DNA, 20 bp, Artificial Sequence
  chemically synthesized
caaattttgcaatttaatta

SEQ ID NO: 428204 - DNA, 20 bp, Artificial Sequence
  chemically synthesized
tgagttttaggttgaatttt

SEQ ID NO: 428205 - DNA, 20 bp, Artificial Sequence
  chemically synthesized
aaaatacagctttgagtttt

SEQ ID NO: 428206 - DNA, 20 bp, Artificial Sequence
  chemically synthesized
aaaattcaacctaaaactca

SEQ ID NO: 428207 - DNA, 20 bp, Artificial Sequence
  chemically synthesized
taaaatacagctttgagttt

SEQ ID NO: 428208 - DNA, 20 bp, Artificial Sequence
  chemically synthesized
gaactttaaaatacagcttt

SEQ ID NO: 428209 - DNA, 20 bp, Artificial Sequence
  chemically synthesized
aaactcaaagctgtatttta

SEQ ID NO: 428210 - DNA, 20 bp, Artificial Sequence
  chemically synthesized
gcaacatgaactttaaaata

SEQ ID NO: 428211 - DNA, 20 bp, Artificial Sequence
  chemically synthesized
tctggcagatgcagtaaaac

SEQ ID NO: 428212 - DNA, 20 bp, Artificial Sequence
  chemically synthesized
acttgttttactgcatctgc

SEQ ID NO: 428213 - DNA, 20 bp, Artificial Sequence
  chemically synthesized
ggtgcattctctggcagatg

SEQ ID NO: 428214 - DNA, 20 bp, Artificial Sequence
  chemically synthesized
ttgttttactgcatctgcca

SEQ ID NO: 428215 - DNA, 20 bp, Artificial Sequence
  chemically synthesized
ttttgtggtgcattctctgg

SEQ ID NO: 428216 - DNA, 20 bp, Artificial Sequence
  chemically synthesized
ggattttgtggtgcattctc

SEQ ID NO: 428217 - DNA, 20 bp, Artificial Sequence
  chemically synthesized
aatatctataaaggattttg

SEQ ID NO: 428218 - DNA, 20 bp, Artificial Sequence
  chemically synthesized
atgcaccacaaaatccttta

SEQ ID NO: 428219 - DNA, 20 bp, Artificial Sequence
  chemically synthesized
attcatctgaatatctataa

SEQ ID NO: 428220 - DNA, 20 bp, Artificial Sequence
  chemically synthesized
gattcatctgaatatctata

SEQ ID NO: 428221 - DNA, 20 bp, Artificial Sequence
  chemically synthesized
caaaatcctttatagatatt

SEQ ID NO: 428222 - DNA, 20 bp, Artificial Sequence
  chemically synthesized
attcagatgaatctctctac

SEQ ID NO: 428223 - DNA, 20 bp, Artificial Sequence
  chemically synthesized
ccttcttcatttctggtaga

SEQ ID NO: 428224 - DNA, 20 bp, Artificial Sequence
  chemically synthesized
ttccttcttcatttctggta

SEQ ID NO: 428225 - DNA, 20 bp, Artificial Sequence
  chemically synthesized
cgttccttcttcatttctgg

SEQ ID NO: 428226 - DNA, 20 bp, Artificial Sequence
  chemically synthesized
gaatctctctaccagaaatg

SEQ ID NO: 428227 - DNA, 20 bp, Artificial Sequence
  chemically synthesized
cagcgttccttcttcatttc

SEQ ID NO: 428228 - DNA, 20 bp, Artificial Sequence
  chemically synthesized
tctctctaccagaaatgaag

SEQ ID NO: 428229 - DNA, 20 bp, Artificial Sequence
  chemically synthesized
ctctctaccagaaatgaaga

SEQ ID NO: 428230 - DNA, 20 bp, Artificial Sequence
  chemically synthesized
agaaggaacgctgctaatct

SEQ ID NO: 428231 - DNA, 20 bp, Artificial Sequence
  chemically synthesized
caatgaaagcccaagattag

SEQ ID NO: 428232 - DNA, 20 bp, Artificial Sequence
  chemically synthesized
gaaggaacgctgctaatctt

SEQ ID NO: 428233 - DNA, 20 bp, Artificial Sequence
  chemically synthesized
aaccaatgaaagcccaagat

SEQ ID NO: 428234 - DNA, 20 bp, Artificial Sequence
  chemically synthesized
aatcaaaccaatgaaagccc

SEQ ID NO: 428235 - DNA, 20 bp, Artificial Sequence
  chemically synthesized
tgctaatcttgggctttcat

SEQ ID NO: 428236 - DNA, 20 bp, Artificial Sequence
  chemically synthesized
aatggtaatcaaaccaatga

SEQ ID NO: 428237 - DNA, 20 bp, Artificial Sequence
  chemically synthesized
gcagccatttagagttgaaa

SEQ ID NO: 428238 - DNA, 20 bp, Artificial Sequence
  chemically synthesized
attaccatttcaactctaaa

SEQ ID NO: 428239 - DNA, 20 bp, Artificial Sequence
  chemically synthesized
aattatcatgcagccattta

SEQ ID NO: 428240 - DNA, 20 bp, Artificial Sequence
  chemically synthesized
ctaattatcatgcagccatt

SEQ ID NO: 428241 - DNA, 20 bp, Artificial Sequence
  chemically synthesized
cacacccactaattatcatg

SEQ ID NO: 428242 - DNA, 20 bp, Artificial Sequence
  chemically synthesized
ctaaatggctgcatgataat

SEQ ID NO: 428243 - DNA, 20 bp, Artificial Sequence
  chemically synthesized
aatggctgcatgataattag

SEQ ID NO: 428244 - DNA, 20 bp, Artificial Sequence
  chemically synthesized
atggctgcatgataattagt

SEQ ID NO: 428245 - DNA, 20 bp, Artificial Sequence
  chemically synthesized
tgcatgataattagtgggtg

SEQ ID NO: 428246 - DNA, 20 bp, Artificial Sequence
  chemically synthesized
attagtgggtgtggaataac

SEQ ID NO: 428247 - DNA, 20 bp, Artificial Sequence
  chemically synthesized
aattgcttcttgagcagtac

SEQ ID NO: 428248 - DNA, 20 bp, Artificial Sequence
  chemically synthesized
tggaataaccagtactgctc

SEQ ID NO: 428249 - DNA, 20 bp, Artificial Sequence
  chemically synthesized
aataaccagtactgctcaag

SEQ ID NO: 428250 - DNA, 20 bp, Artificial Sequence
  chemically synthesized
aaaggcaattgcttcttgag

SEQ ID NO: 428251 - DNA, 20 bp, Artificial Sequence
  chemically synthesized
agtaaaggcaattgcttctt

SEQ ID NO: 428252 - DNA, 20 bp, Artificial Sequence
  chemically synthesized
gaaactttgtttttcagtaa

SEQ ID NO: 428253 - DNA, 20 bp, Artificial Sequence
  chemically synthesized
cgaaactttgtttttcagta

SEQ ID NO: 428254 - DNA, 20 bp, Artificial Sequence
  chemically synthesized
attgcctttactgaaaaaca

SEQ ID NO: 428255 - DNA, 20 bp, Artificial Sequence
  chemically synthesized
tctttcgaaactttgttttt

SEQ ID NO: 428256 - DNA, 20 bp, Artificial Sequence
  chemically synthesized
actgaaaaacaaagtttcga

SEQ ID NO: 428257 - DNA, 20 bp, Artificial Sequence
  chemically synthesized
gaaaaacaaagtttcgaaag

SEQ ID NO: 428258 - DNA, 20 bp, Artificial Sequence
  chemically synthesized
acaaagtttcgaaagaagca

SEQ ID NO: 428259 - DNA, 20 bp, Artificial Sequence
  chemically synthesized
aaagaagcacagtaaactcc

SEQ ID NO: 428260 - DNA, 20 bp, Artificial Sequence
  chemically synthesized
agaagcacagtaaactccaa

SEQ ID NO: 428261 - DNA, 20 bp, Artificial Sequence
  chemically synthesized
attgaattgattgtctcttg

SEQ ID NO: 428262 - DNA, 20 bp, Artificial Sequence
  chemically synthesized
agattgaattgattgtctct

SEQ ID NO: 428263 - DNA, 20 bp, Artificial Sequence
  chemically synthesized
actatggcagggaggtgtgt

SEQ ID NO: 428264 - DNA, 20 bp, Artificial Sequence
  chemically synthesized
catttaaaactatggcaggg

SEQ ID NO: 428265 - DNA, 20 bp, Artificial Sequence
  chemically synthesized
tcttacacacctccctgcca

SEQ ID NO: 428266 - DNA, 20 bp, Artificial Sequence
  chemically synthesized
ccatttaaaactatggcagg

SEQ ID NO: 428267 - DNA, 20 bp, Artificial Sequence
  chemically synthesized
ctccatttaaaactatggca

SEQ ID NO: 428268 - DNA, 20 bp, Artificial Sequence
  chemically synthesized
gctccatttaaaactatggc

SEQ ID NO: 428269 - DNA, 20 bp, Artificial Sequence
  chemically synthesized
tgctccatttaaaactatgg

SEQ ID NO: 428270 - DNA, 20 bp, Artificial Sequence
  chemically synthesized
atctgctccatttaaaacta

SEQ ID NO: 428271 - DNA, 20 bp, Artificial Sequence
  chemically synthesized
ctccctgccatagttttaaa

SEQ ID NO: 428272 - DNA, 20 bp, Artificial Sequence
  chemically synthesized
ccctgccatagttttaaatg

SEQ ID NO: 428273 - DNA, 20 bp, Artificial Sequence
  chemically synthesized
tgccatagttttaaatggag

SEQ ID NO: 428274 - DNA, 20 bp, Artificial Sequence
  chemically synthesized
aaatggagcagatgtgctaa

SEQ ID NO: 428275 - DNA, 20 bp, Artificial Sequence
  chemically synthesized
ggagcagatgtgctaaaagc

SEQ ID NO: 428276 - DNA, 20 bp, Artificial Sequence
  chemically synthesized
accgtcttctcactggcttt

SEQ ID NO: 428277 - DNA, 20 bp, Artificial Sequence
  chemically synthesized
cagatgtgctaaaagccagt

SEQ ID NO: 428278 - DNA, 20 bp, Artificial Sequence
  chemically synthesized
atgtgctaaaagccagtgag

SEQ ID NO: 428279 - DNA, 20 bp, Artificial Sequence
  chemically synthesized
aatatcaaccgtcttctcac

SEQ ID NO: 428280 - DNA, 20 bp, Artificial Sequence
  chemically synthesized
gctaaaagccagtgagaaga

SEQ ID NO: 428281 - DNA, 20 bp, Artificial Sequence
  chemically synthesized
agaagacggttgatatttct

SEQ ID NO: 428282 - DNA, 20 bp, Artificial Sequence
  chemically synthesized
gaagacggttgatatttctt

SEQ ID NO: 428283 - DNA, 20 bp, Artificial Sequence
  chemically synthesized
aagacggttgatatttctta

SEQ ID NO: 428284 - DNA, 20 bp, Artificial Sequence
  chemically synthesized
tctatttctgtttgaaccct

SEQ ID NO: 428285 - DNA, 20 bp, Artificial Sequence
  chemically synthesized
gatatttcttagggttcaaa

SEQ ID NO: 428286 - DNA, 20 bp, Artificial Sequence
  chemically synthesized
tcttagggttcaaacagaaa

SEQ ID NO: 428287 - DNA, 20 bp, Artificial Sequence
  chemically synthesized
tcaaacagaaatagaatatc

SEQ ID NO: 428288 - DNA, 20 bp, Artificial Sequence
  chemically synthesized
aaatatgggcagtcaagtgc

SEQ ID NO: 428289 - DNA, 20 bp, Artificial Sequence
  chemically synthesized
tgtgaaaaatatgggcagtc

SEQ ID NO: 428290 - DNA, 20 bp, Artificial Sequence
  chemically synthesized
atcattgtgaaaaatatggg

SEQ ID NO: 428291 - DNA, 20 bp, Artificial Sequence
  chemically synthesized
taaatcattgtgaaaaatat

SEQ ID NO: 428292 - DNA, 20 bp, Artificial Sequence
  chemically synthesized
ataaatcattgtgaaaaata

SEQ ID NO: 428293 - DNA, 20 bp, Artificial Sequence
  chemically synthesized
tttttcacaatgatttattg

SEQ ID NO: 428294 - DNA, 20 bp, Artificial Sequence
  chemically synthesized
caatgatttattgcagtaaa

SEQ ID NO: 428295 - DNA, 20 bp, Artificial Sequence
  chemically synthesized
ttgcagtaaatagtctacac

SEQ ID NO: 428296 - DNA, 20 bp, Artificial Sequence
  chemically synthesized
ccaaaactgggacgctcgtg

SEQ ID NO: 428297 - DNA, 20 bp, Artificial Sequence
  chemically synthesized
aatagtctacacgagcgtcc

SEQ ID NO: 428298 - DNA, 20 bp, Artificial Sequence
  chemically synthesized
ctacacgagcgtcccagttt

SEQ ID NO: 428299 - DNA, 20 bp, Artificial Sequence
  chemically synthesized
tagggaaaaagtccaaaact

SEQ ID NO: 428300 - DNA, 20 bp, Artificial Sequence
  chemically synthesized
atagggaaaaagtccaaaac

SEQ ID NO: 428301 - DNA, 20 bp, Artificial Sequence
  chemically synthesized
aaacctgactgatagggaaa

SEQ ID NO: 428302 - DNA, 20 bp, Artificial Sequence
  chemically synthesized
gttttggactttttccctat

SEQ ID NO: 428303 - DNA, 20 bp, Artificial Sequence
  chemically synthesized
tggactttttccctatcagt

SEQ ID NO: 428304 - DNA, 20 bp, Artificial Sequence
  chemically synthesized
ctttaaaaacctgactgata

SEQ ID NO: 428305 - DNA, 20 bp, Artificial Sequence
  chemically synthesized
ggactttttccctatcagtc

SEQ ID NO: 428306 - DNA, 20 bp, Artificial Sequence
  chemically synthesized
gctttaaaaacctgactgat

SEQ ID NO: 428307 - DNA, 20 bp, Artificial Sequence
  chemically synthesized
ggctttaaaaacctgactga

SEQ ID NO: 428308 - DNA, 20 bp, Artificial Sequence
  chemically synthesized
ccctatcagtcaggttttta

SEQ ID NO: 428309 - DNA, 20 bp, Artificial Sequence
  chemically synthesized
gtcaggtttttaaagcctta

SEQ ID NO: 428310 - DNA, 20 bp, Artificial Sequence
  chemically synthesized
aggtttttaaagccttaaag

SEQ ID NO: 428311 - DNA, 20 bp, Artificial Sequence
  chemically synthesized
gtttttaaagccttaaagta

SEQ ID NO: 428312 - DNA, 20 bp, Artificial Sequence
  chemically synthesized
tttaatttaactctacttta

SEQ ID NO: 428313 - DNA, 20 bp, Artificial Sequence
  chemically synthesized
atttaatttaactctacttt

SEQ ID NO: 428314 - DNA, 20 bp, Artificial Sequence
  chemically synthesized
agtagagttaaattaaataa

SEQ ID NO: 428315 - DNA, 20 bp, Artificial Sequence
  chemically synthesized
agagttaaattaaataaaag

SEQ ID NO: 428316 - DNA, 20 bp, Artificial Sequence
  chemically synthesized
gagttaaattaaataaaaga

SEQ ID NO: 428317 - DNA, 20 bp, Artificial Sequence
  chemically synthesized
agttaaattaaataaaagaa

SEQ ID NO: 428318 - DNA, 20 bp, Artificial Sequence
  chemically synthesized
aaattaaataaaagaaggga

SEQ ID NO: 428319 - DNA, 20 bp, Artificial Sequence
  chemically synthesized
gttctctaacttttagataa

SEQ ID NO: 428320 - DNA, 20 bp, Artificial Sequence
  chemically synthesized
aagggatggcttttatctaa

SEQ ID NO: 428321 - DNA, 20 bp, Artificial Sequence
  chemically synthesized
gatggcttttatctaaaagt

SEQ ID NO: 428322 - DNA, 20 bp, Artificial Sequence
  chemically synthesized
tggcttttatctaaaagtta

SEQ ID NO: 428323 - DNA, 20 bp, Artificial Sequence
  chemically synthesized
cttgttcgttctctaacttt

SEQ ID NO: 428324 - DNA, 20 bp, Artificial Sequence
  chemically synthesized
ctaaaagttagagaacgaac

SEQ ID NO: 428325 - DNA, 20 bp, Artificial Sequence
  chemically synthesized
gaacgaacaagaatgttttc

SEQ ID NO: 428326 - DNA, 20 bp, Artificial Sequence
  chemically synthesized
agaatgttttctagatatta

SEQ ID NO: 428327 - DNA, 20 bp, Artificial Sequence
  chemically synthesized
aatgaatttactttaatatc

SEQ ID NO: 428328 - DNA, 20 bp, Artificial Sequence
  chemically synthesized
atttataattatgccatatt

SEQ ID NO: 428329 - DNA, 20 bp, Artificial Sequence
  chemically synthesized
gaatggcatccatctgaata

SEQ ID NO: 428330 - DNA, 20 bp, Artificial Sequence
  chemically synthesized
ataattatgccatattcaga

SEQ ID NO: 428331 - DNA, 20 bp, Artificial Sequence
  chemically synthesized
gaacatttaatatataggaa

SEQ ID NO: 428332 - DNA, 20 bp, Artificial Sequence
  chemically synthesized
atcatgaacatttaatatat

SEQ ID NO: 428333 - DNA, 20 bp, Artificial Sequence
  chemically synthesized
aatcatgaacatttaatata

SEQ ID NO: 428334 - DNA, 20 bp, Artificial Sequence
  chemically synthesized
attaaatgttcatgatttta

SEQ ID NO: 428335 - DNA, 20 bp, Artificial Sequence
  chemically synthesized
ttaaatgttcatgattttaa

SEQ ID NO: 428336 - DNA, 20 bp, Artificial Sequence
  chemically synthesized
ttcatgattttaaaggtcat

SEQ ID NO: 428337 - DNA, 20 bp, Artificial Sequence
  chemically synthesized
ttctaattttttattattca

SEQ ID NO: 428338 - DNA, 20 bp, Artificial Sequence
  chemically synthesized
cactatgaataataaaaaat

SEQ ID NO: 428339 - DNA, 20 bp, Artificial Sequence
  chemically synthesized
aaaatgtgaaaaataatgaa

SEQ ID NO: 428340 - DNA, 20 bp, Artificial Sequence
  chemically synthesized
aaaaataatgaatggaatta

SEQ ID NO: 428341 - DNA, 20 bp, Artificial Sequence
  chemically synthesized
aataatgaatggaattatag

SEQ ID NO: 428342 - DNA, 20 bp, Artificial Sequence
  chemically synthesized
tatagtagaatctattttaa

SEQ ID NO: 428343 - DNA, 20 bp, Artificial Sequence
  chemically synthesized
taaatggagatccattaaaa

SEQ ID NO: 428344 - DNA, 20 bp, Artificial Sequence
  chemically synthesized
tctaatgattcagttaaatg

SEQ ID NO: 428345 - DNA, 20 bp, Artificial Sequence
  chemically synthesized
aatctaatgattcagttaaa

SEQ ID NO: 428346 - DNA, 20 bp, Artificial Sequence
  chemically synthesized
tctccatttaactgaatcat

SEQ ID NO: 428347 - DNA, 20 bp, Artificial Sequence
  chemically synthesized
ctttggttaatctaatgatt

SEQ ID NO: 428348 - DNA, 20 bp, Artificial Sequence
  chemically synthesized
ctgaatcattagattaacca

SEQ ID NO: 428349 - DNA, 20 bp, Artificial Sequence
  chemically synthesized
acaaagggaatggagagctt

SEQ ID NO: 428350 - DNA, 20 bp, Artificial Sequence
  chemically synthesized
aatctaacaaagggaatgga

SEQ ID NO: 428351 - DNA, 20 bp, Artificial Sequence
  chemically synthesized
taaatctaacaaagggaatg

SEQ ID NO: 428352 - DNA, 20 bp, Artificial Sequence
  chemically synthesized
agtaaatctaacaaagggaa

SEQ ID NO: 428353 - DNA, 20 bp, Artificial Sequence
  chemically synthesized
aagctctccattccctttgt

SEQ ID NO: 428354 - DNA, 20 bp, Artificial Sequence
  chemically synthesized
tccatagtaaatctaacaaa

SEQ ID NO: 428355 - DNA, 20 bp, Artificial Sequence
  chemically synthesized
atccatagtaaatctaacaa

SEQ ID NO: 428356 - DNA, 20 bp, Artificial Sequence
  chemically synthesized
gatccatagtaaatctaaca

SEQ ID NO: 428357 - DNA, 20 bp, Artificial Sequence
  chemically synthesized
tccctttgttagatttacta

SEQ ID NO: 428358 - DNA, 20 bp, Artificial Sequence
  chemically synthesized
tgttagatttactatggatc

SEQ ID NO: 428359 - DNA, 20 bp, Artificial Sequence
  chemically synthesized
cagcaggtcatcttgatcca

SEQ ID NO: 428360 - DNA, 20 bp, Artificial Sequence
  chemically synthesized
tctagttaaggtttttcagc

SEQ ID NO: 428361 - DNA, 20 bp, Artificial Sequence
  chemically synthesized
ttctagttaaggtttttcag

SEQ ID NO: 428362 - DNA, 20 bp, Artificial Sequence
  chemically synthesized
gatttctagttaaggttttt

SEQ ID NO: 428363 - DNA, 20 bp, Artificial Sequence
  chemically synthesized
acctgctgaaaaaccttaac

SEQ ID NO: 428364 - DNA, 20 bp, Artificial Sequence
  chemically synthesized
catagagagatttctagtta

SEQ ID NO: 428365 - DNA, 20 bp, Artificial Sequence
  chemically synthesized
tcatagagagatttctagtt

SEQ ID NO: 428366 - DNA, 20 bp, Artificial Sequence
  chemically synthesized
atctctcatagagagatttc

SEQ ID NO: 428367 - DNA, 20 bp, Artificial Sequence
  chemically synthesized
ttaactagaaatctctctat

SEQ ID NO: 428368 - DNA, 20 bp, Artificial Sequence
  chemically synthesized
aactagaaatctctctatga

SEQ ID NO: 428369 - DNA, 20 bp, Artificial Sequence
  chemically synthesized
tacgatttatctctcataga

SEQ ID NO: 428370 - DNA, 20 bp, Artificial Sequence
  chemically synthesized
catacgatttatctctcata

SEQ ID NO: 428371 - DNA, 20 bp, Artificial Sequence
  chemically synthesized
agcatacgatttatctctca

SEQ ID NO: 428372 - DNA, 20 bp, Artificial Sequence
  chemically synthesized
gagagataaatcgtatgctt

SEQ ID NO: 428373 - DNA, 20 bp, Artificial Sequence
  chemically synthesized
agataaatcgtatgctttgg

SEQ ID NO: 428374 - DNA, 20 bp, Artificial Sequence
  chemically synthesized
cagctatctttaatccgcca

SEQ ID NO: 428375 - DNA, 20 bp, Artificial Sequence
  chemically synthesized
tcgtatgctttggcggatta

SEQ ID NO: 428376 - DNA, 20 bp, Artificial Sequence
  chemically synthesized
atgctttggcggattaaaga

SEQ ID NO: 428377 - DNA, 20 bp, Artificial Sequence
  chemically synthesized
agaaatgtcaaaaaaattcg

SEQ ID NO: 428378 - DNA, 20 bp, Artificial Sequence
  chemically synthesized
tttttttgacatttcttcac

SEQ ID NO: 428379 - DNA, 20 bp, Artificial Sequence
  chemically synthesized
ttttttgacatttcttcact

SEQ ID NO: 428380 - DNA, 20 bp, Artificial Sequence
  chemically synthesized
tttttgacatttcttcactg

SEQ ID NO: 428381 - DNA, 20 bp, Artificial Sequence
  chemically synthesized
tttgacatttcttcactggg

SEQ ID NO: 428382 - DNA, 20 bp, Artificial Sequence
  chemically synthesized
aagactttacctccccagtg

SEQ ID NO: 428383 - DNA, 20 bp, Artificial Sequence
  chemically synthesized
ttgacatttcttcactgggg

SEQ ID NO: 428384 - DNA, 20 bp, Artificial Sequence
  chemically synthesized
aaacaaagactttacctccc

SEQ ID NO: 428385 - DNA, 20 bp, Artificial Sequence
  chemically synthesized
atttcttcactggggaggta

SEQ ID NO: 428386 - DNA, 20 bp, Artificial Sequence
  chemically synthesized
caaattcaagggaggaaaca

SEQ ID NO: 428387 - DNA, 20 bp, Artificial Sequence
  chemically synthesized
aacccacccaaattcaaggg

SEQ ID NO: 428388 - DNA, 20 bp, Artificial Sequence
  chemically synthesized
gaacccacccaaattcaagg

SEQ ID NO: 428389 - DNA, 20 bp, Artificial Sequence
  chemically synthesized
tttgtttcctcccttgaatt

SEQ ID NO: 428390 - DNA, 20 bp, Artificial Sequence
  chemically synthesized
cagaacccacccaaattcaa

SEQ ID NO: 428391 - DNA, 20 bp, Artificial Sequence
  chemically synthesized
ttgtttcctcccttgaattt

SEQ ID NO: 428392 - DNA, 20 bp, Artificial Sequence
  chemically synthesized
acagaacccacccaaattca

SEQ ID NO: 428393 - DNA, 20 bp, Artificial Sequence
  chemically synthesized
cacagaacccacccaaattc

SEQ ID NO: 428394 - DNA, 20 bp, Artificial Sequence
  chemically synthesized
tttcctcccttgaatttggg

SEQ ID NO: 428395 - DNA, 20 bp, Artificial Sequence
  chemically synthesized
ttcctcccttgaatttgggt

SEQ ID NO: 428396 - DNA, 20 bp, Artificial Sequence
  chemically synthesized
ttgaatttgggtgggttctg

SEQ ID NO: 428397 - DNA, 20 bp, Artificial Sequence
  chemically synthesized
gcattctattagagcagcca

SEQ ID NO: 428398 - DNA, 20 bp, Artificial Sequence
  chemically synthesized
gggttctgtggctgctctaa

SEQ ID NO: 428399 - DNA, 20 bp, Artificial Sequence
  chemically synthesized
tctactgcattctattagag

SEQ ID NO: 428400 - DNA, 20 bp, Artificial Sequence
  chemically synthesized
tattctactgcattctatta

SEQ ID NO: 428401 - DNA, 20 bp, Artificial Sequence
  chemically synthesized
actattctactgcattctat

SEQ ID NO: 428402 - DNA, 20 bp, Artificial Sequence
  chemically synthesized
gtggctgctctaatagaatg

SEQ ID NO: 428403 - DNA, 20 bp, Artificial Sequence
  chemically synthesized
gctgctctaatagaatgcag

SEQ ID NO: 428404 - DNA, 20 bp, Artificial Sequence
  chemically synthesized
tctaatagaatgcagtagaa

SEQ ID NO: 428405 - DNA, 20 bp, Artificial Sequence
  chemically synthesized
aatagaatgcagtagaatag

SEQ ID NO: 428406 - DNA, 20 bp, Artificial Sequence
  chemically synthesized
tgcagtagaatagtggtccc

SEQ ID NO: 428407 - DNA, 20 bp, Artificial Sequence
  chemically synthesized
ctctggtgccaaaaaggctg

SEQ ID NO: 428408 - DNA, 20 bp, Artificial Sequence
  chemically synthesized
tctctggtgccaaaaaggct

SEQ ID NO: 428409 - DNA, 20 bp, Artificial Sequence
  chemically synthesized
atagtggtccccagcctttt

SEQ ID NO: 428410 - DNA, 20 bp, Artificial Sequence
  chemically synthesized
gtctctggtgccaaaaaggc

SEQ ID NO: 428411 - DNA, 20 bp, Artificial Sequence
  chemically synthesized
cccagtctctggtgccaaaa

SEQ ID NO: 428412 - DNA, 20 bp, Artificial Sequence
  chemically synthesized
ccccagtctctggtgccaaa

SEQ ID NO: 428413 - DNA, 20 bp, Artificial Sequence
  chemically synthesized
gtccccagcctttttggcac

SEQ ID NO: 428414 - DNA, 20 bp, Artificial Sequence
  chemically synthesized
ccccagcctttttggcacca

SEQ ID NO: 428415 - DNA, 20 bp, Artificial Sequence
  chemically synthesized
gcctttttggcaccagagac

SEQ ID NO: 428416 - DNA, 20 bp, Artificial Sequence
  chemically synthesized
cctttttggcaccagagact

SEQ ID NO: 428417 - DNA, 20 bp, Artificial Sequence
  chemically synthesized
ctttttggcaccagagactg

SEQ ID NO: 428418 - DNA, 20 bp, Artificial Sequence
  chemically synthesized
atccatcaaaccccagtctc

SEQ ID NO: 428419 - DNA, 20 bp, Artificial Sequence
  chemically synthesized
aattgtcatccatcaaaccc

SEQ ID NO: 428420 - DNA, 20 bp, Artificial Sequence
  chemically synthesized
caccagagactggggtttga

SEQ ID NO: 428421 - DNA, 20 bp, Artificial Sequence
  chemically synthesized
gatggatgacaattttccca

SEQ ID NO: 428422 - DNA, 20 bp, Artificial Sequence
  chemically synthesized
atgacaattttcccacagac

SEQ ID NO: 428423 - DNA, 20 bp, Artificial Sequence
  chemically synthesized
tgacaattttcccacagact

SEQ ID NO: 428424 - DNA, 20 bp, Artificial Sequence
  chemically synthesized
ccccactaaccccagtctgt

SEQ ID NO: 428425 - DNA, 20 bp, Artificial Sequence
  chemically synthesized
gacaattttcccacagactg

SEQ ID NO: 428426 - DNA, 20 bp, Artificial Sequence
  chemically synthesized
cccccactaaccccagtctg

SEQ ID NO: 428427 - DNA, 20 bp, Artificial Sequence
  chemically synthesized
attttcccacagactggggt

SEQ ID NO: 428428 - DNA, 20 bp, Artificial Sequence
  chemically synthesized
ttcccacagactggggttag

SEQ ID NO: 428429 - DNA, 20 bp, Artificial Sequence
  chemically synthesized
cacctcccccccactaaccc

SEQ ID NO: 428430 - DNA, 20 bp, Artificial Sequence
  chemically synthesized
tcccacagactggggttagt

SEQ ID NO: 428431 - DNA, 20 bp, Artificial Sequence
  chemically synthesized
cccacagactggggttagtg

SEQ ID NO: 428432 - DNA, 20 bp, Artificial Sequence
  chemically synthesized
ccacagactggggttagtgg

SEQ ID NO: 428433 - DNA, 20 bp, Artificial Sequence
  chemically synthesized
cacagactggggttagtggg

SEQ ID NO: 428434 - DNA, 20 bp, Artificial Sequence
  chemically synthesized
acagactggggttagtgggg

SEQ ID NO: 428435 - DNA, 20 bp, Artificial Sequence
  chemically synthesized
agactggggttagtgggggg

SEQ ID NO: 428436 - DNA, 20 bp, Artificial Sequence
  chemically synthesized
gactggggttagtggggggg

SEQ ID NO: 428437 - DNA, 20 bp, Artificial Sequence
  chemically synthesized
ggggttagtgggggggaggt

SEQ ID NO: 428438 - DNA, 20 bp, Artificial Sequence
  chemically synthesized
gggttagtgggggggaggtg

SEQ ID NO: 428439 - DNA, 20 bp, Artificial Sequence
  chemically synthesized
ggttagtgggggggaggtga

SEQ ID NO: 428440 - DNA, 20 bp, Artificial Sequence
  chemically synthesized
agtgggggggaggtgaggga

SEQ ID NO: 428441 - DNA, 20 bp, Artificial Sequence
  chemically synthesized
gggaggtgagggatagtgtt

SEQ ID NO: 428442 - DNA, 20 bp, Artificial Sequence
  chemically synthesized
agggatagtgttaagataat

SEQ ID NO: 428443 - DNA, 20 bp, Artificial Sequence
  chemically synthesized
ggatagtgttaagataattg

SEQ ID NO: 428444 - DNA, 20 bp, Artificial Sequence
  chemically synthesized
aaagtgcatgataaatgaaa

SEQ ID NO: 428445 - DNA, 20 bp, Artificial Sequence
  chemically synthesized
taataataataatagaaata

SEQ ID NO: 428446 - DNA, 20 bp, Artificial Sequence
  chemically synthesized
atacaatgtaataataataa

SEQ ID NO: 428447 - DNA, 20 bp, Artificial Sequence
  chemically synthesized
cactgattctatgatatggt

SEQ ID NO: 428448 - DNA, 20 bp, Artificial Sequence
  chemically synthesized
ttatgtaactcaccatatca

SEQ ID NO: 428449 - DNA, 20 bp, Artificial Sequence
  chemically synthesized
ctcccactgattctatgata

SEQ ID NO: 428450 - DNA, 20 bp, Artificial Sequence
  chemically synthesized
aactcaccatatcatagaat

SEQ ID NO: 428451 - DNA, 20 bp, Artificial Sequence
  chemically synthesized
tcaccatatcatagaatcag

SEQ ID NO: 428452 - DNA, 20 bp, Artificial Sequence
  chemically synthesized
caccatatcatagaatcagt

SEQ ID NO: 428453 - DNA, 20 bp, Artificial Sequence
  chemically synthesized
ccatatcatagaatcagtgg

SEQ ID NO: 428454 - DNA, 20 bp, Artificial Sequence
  chemically synthesized
atagaatcagtgggagccct

SEQ ID NO: 428455 - DNA, 20 bp, Artificial Sequence
  chemically synthesized
gttgcaggaaagaaagctca

SEQ ID NO: 428456 - DNA, 20 bp, Artificial Sequence
  chemically synthesized
agttgcaggaaagaaagctc

SEQ ID NO: 428457 - DNA, 20 bp, Artificial Sequence
  chemically synthesized
tagttgcaggaaagaaagct

SEQ ID NO: 428458 - DNA, 20 bp, Artificial Sequence
  chemically synthesized
ccgtctagttgcaggaaaga

SEQ ID NO: 428459 - DNA, 20 bp, Artificial Sequence
  chemically synthesized
gggaccgtctagttgcagga

SEQ ID NO: 428460 - DNA, 20 bp, Artificial Sequence
  chemically synthesized
tgagctttctttcctgcaac

SEQ ID NO: 428461 - DNA, 20 bp, Artificial Sequence
  chemically synthesized
agatgggaccgtctagttgc

SEQ ID NO: 428462 - DNA, 20 bp, Artificial Sequence
  chemically synthesized
cagatgggaccgtctagttg

SEQ ID NO: 428463 - DNA, 20 bp, Artificial Sequence
  chemically synthesized
ctttctttcctgcaactaga

SEQ ID NO: 428464 - DNA, 20 bp, Artificial Sequence
  chemically synthesized
catgcccagatgggaccgtc

SEQ ID NO: 428465 - DNA, 20 bp, Artificial Sequence
  chemically synthesized
tgcaactagacggtcccatc

SEQ ID NO: 428466 - DNA, 20 bp, Artificial Sequence
  chemically synthesized
gcaactagacggtcccatct

SEQ ID NO: 428467 - DNA, 20 bp, Artificial Sequence
  chemically synthesized
gtctcccgtcatgcccagat

SEQ ID NO: 428468 - DNA, 20 bp, Artificial Sequence
  chemically synthesized
tgtctcccgtcatgcccaga

SEQ ID NO: 428469 - DNA, 20 bp, Artificial Sequence
  chemically synthesized
acggtcccatctgggcatga

SEQ ID NO: 428470 - DNA, 20 bp, Artificial Sequence
  chemically synthesized
tcactgtctcccgtcatgcc

SEQ ID NO: 428471 - DNA, 20 bp, Artificial Sequence
  chemically synthesized
cggtcccatctgggcatgac

SEQ ID NO: 428472 - DNA, 20 bp, Artificial Sequence
  chemically synthesized
gtcccatctgggcatgacgg

SEQ ID NO: 428473 - DNA, 20 bp, Artificial Sequence
  chemically synthesized
catctgggcatgacgggaga

SEQ ID NO: 428474 - DNA, 20 bp, Artificial Sequence
  chemically synthesized
gggagacagtgacacatcat

SEQ ID NO: 428475 - DNA, 20 bp, Artificial Sequence
  chemically synthesized
agtgacacatcatcagtcac

SEQ ID NO: 428476 - DNA, 20 bp, Artificial Sequence
  chemically synthesized
atgaggagtatcaggcaatc

SEQ ID NO: 428477 - DNA, 20 bp, Artificial Sequence
  chemically synthesized
tactctttatgaggagtatc

SEQ ID NO: 428478 - DNA, 20 bp, Artificial Sequence
  chemically synthesized
atactctttatgaggagtat

SEQ ID NO: 428479 - DNA, 20 bp, Artificial Sequence
  chemically synthesized
attgcctgatactcctcata

SEQ ID NO: 428480 - DNA, 20 bp, Artificial Sequence
  chemically synthesized
ggtcgcatactctttatgag

SEQ ID NO: 428481 - DNA, 20 bp, Artificial Sequence
  chemically synthesized
tgcctgatactcctcataaa

SEQ ID NO: 428482 - DNA, 20 bp, Artificial Sequence
  chemically synthesized
taggtcgcatactctttatg

SEQ ID NO: 428483 - DNA, 20 bp, Artificial Sequence
  chemically synthesized
ctaggtcgcatactctttat

SEQ ID NO: 428484 - DNA, 20 bp, Artificial Sequence
  chemically synthesized
ctcataaagagtatgcgacc

SEQ ID NO: 428485 - DNA, 20 bp, Artificial Sequence
  chemically synthesized
actgcacatgtgagagatct

SEQ ID NO: 428486 - DNA, 20 bp, Artificial Sequence
  chemically synthesized
aactgcacatgtgagagatc

SEQ ID NO: 428487 - DNA, 20 bp, Artificial Sequence
  chemically synthesized
attgtgaactgcacatgtga

SEQ ID NO: 428488 - DNA, 20 bp, Artificial Sequence
  chemically synthesized
acctagatctctcacatgtg

SEQ ID NO: 428489 - DNA, 20 bp, Artificial Sequence
  chemically synthesized
ctattgtgaactgcacatgt

SEQ ID NO: 428490 - DNA, 20 bp, Artificial Sequence
  chemically synthesized
ctcacatgtgcagttcacaa

SEQ ID NO: 428491 - DNA, 20 bp, Artificial Sequence
  chemically synthesized
tcacatgtgcagttcacaat

SEQ ID NO: 428492 - DNA, 20 bp, Artificial Sequence
  chemically synthesized
cacatgtgcagttcacaata

SEQ ID NO: 428493 - DNA, 20 bp, Artificial Sequence
  chemically synthesized
cacaatagggttgtgctcct

SEQ ID NO: 428494 - DNA, 20 bp, Artificial Sequence
  chemically synthesized
caatggctttagagtctcag

SEQ ID NO: 428495 - DNA, 20 bp, Artificial Sequence
  chemically synthesized
agcaatggctttagagtctc

SEQ ID NO: 428496 - DNA, 20 bp, Artificial Sequence
  chemically synthesized
cagcaatggctttagagtct

SEQ ID NO: 428497 - DNA, 20 bp, Artificial Sequence
  chemically synthesized
gttgtgctcctgagactcta

SEQ ID NO: 428498 - DNA, 20 bp, Artificial Sequence
  chemically synthesized
tcagatcagcaatggcttta

SEQ ID NO: 428499 - DNA, 20 bp, Artificial Sequence
  chemically synthesized
tgtcagatcagcaatggctt

SEQ ID NO: 428500 - DNA, 20 bp, Artificial Sequence
  chemically synthesized
gcctcctgtcagatcagcaa

SEQ ID NO: 428501 - DNA, 20 bp, Artificial Sequence
  chemically synthesized
taaagccattgctgatctga

SEQ ID NO: 428502 - DNA, 20 bp, Artificial Sequence
  chemically synthesized
aaagccattgctgatctgac

SEQ ID NO: 428503 - DNA, 20 bp, Artificial Sequence
  chemically synthesized
aaccctgcctcctgtcagat

SEQ ID NO: 428504 - DNA, 20 bp, Artificial Sequence
  chemically synthesized
agccattgctgatctgacag

SEQ ID NO: 428505 - DNA, 20 bp, Artificial Sequence
  chemically synthesized
gccattgctgatctgacagg

SEQ ID NO: 428506 - DNA, 20 bp, Artificial Sequence
  chemically synthesized
gcctgaaccctgcctcctgt

SEQ ID NO: 428507 - DNA, 20 bp, Artificial Sequence
  chemically synthesized
attgctgatctgacaggagg

SEQ ID NO: 428508 - DNA, 20 bp, Artificial Sequence
  chemically synthesized
ttgctgatctgacaggaggc

SEQ ID NO: 428509 - DNA, 20 bp, Artificial Sequence
  chemically synthesized
tgctgatctgacaggaggca

SEQ ID NO: 428510 - DNA, 20 bp, Artificial Sequence
  chemically synthesized
atctgacaggaggcagggtt

SEQ ID NO: 428511 - DNA, 20 bp, Artificial Sequence
  chemically synthesized
tctgacaggaggcagggttc

SEQ ID NO: 428512 - DNA, 20 bp, Artificial Sequence
  chemically synthesized
gacaggaggcagggttcagg

SEQ ID NO: 428513 - DNA, 20 bp, Artificial Sequence
  chemically synthesized
cagggttcaggcagtaatgc

SEQ ID NO: 428514 - DNA, 20 bp, Artificial Sequence
  chemically synthesized
tcaggcagtaatgccagcaa

SEQ ID NO: 428515 - DNA, 20 bp, Artificial Sequence
  chemically synthesized
caggcagtaatgccagcaat

SEQ ID NO: 428516 - DNA, 20 bp, Artificial Sequence
  chemically synthesized
ttacagccacttcccattgc

SEQ ID NO: 428517 - DNA, 20 bp, Artificial Sequence
  chemically synthesized
gcagtaatgccagcaatggg

SEQ ID NO: 428518 - DNA, 20 bp, Artificial Sequence
  chemically synthesized
gtaatgccagcaatgggaag

SEQ ID NO: 428519 - DNA, 20 bp, Artificial Sequence
  chemically synthesized
atgggaagtggctgtaaata

SEQ ID NO: 428520 - DNA, 20 bp, Artificial Sequence
  chemically synthesized
tgaagcttcatctgtattta

SEQ ID NO: 428521 - DNA, 20 bp, Artificial Sequence
  chemically synthesized
agtggctgtaaatacagatg

SEQ ID NO: 428522 - DNA, 20 bp, Artificial Sequence
  chemically synthesized
aaatacagatgaagcttcac

SEQ ID NO: 428523 - DNA, 20 bp, Artificial Sequence
  chemically synthesized
aggcgagcggtgagccagtg

SEQ ID NO: 428524 - DNA, 20 bp, Artificial Sequence
  chemically synthesized
gcaggaggcgagcggtgagc

SEQ ID NO: 428525 - DNA, 20 bp, Artificial Sequence
  chemically synthesized
cacagcaggaggcgagcggt

SEQ ID NO: 428526 - DNA, 20 bp, Artificial Sequence
  chemically synthesized
gctgcacagcaggaggcgag

SEQ ID NO: 428527 - DNA, 20 bp, Artificial Sequence
  chemically synthesized
ccagctgcacagcaggaggc

SEQ ID NO: 428528 - DNA, 20 bp, Artificial Sequence
  chemically synthesized
gaacccagctgcacagcagg

SEQ ID NO: 428529 - DNA, 20 bp, Artificial Sequence
  chemically synthesized
ggaacccagctgcacagcag

SEQ ID NO: 428530 - DNA, 20 bp, Artificial Sequence
  chemically synthesized
accgctcgcctcctgctgtg

SEQ ID NO: 428531 - DNA, 20 bp, Artificial Sequence
  chemically synthesized
gaggaacccagctgcacagc

SEQ ID NO: 428532 - DNA, 20 bp, Artificial Sequence
  chemically synthesized
tgaggaacccagctgcacag

SEQ ID NO: 428533 - DNA, 20 bp, Artificial Sequence
  chemically synthesized
ctcgcctcctgctgtgcagc

SEQ ID NO: 428534 - DNA, 20 bp, Artificial Sequence
  chemically synthesized
tcgcctcctgctgtgcagct

SEQ ID NO: 428535 - DNA, 20 bp, Artificial Sequence
  chemically synthesized
ctgtgaggaacccagctgca

SEQ ID NO: 428536 - DNA, 20 bp, Artificial Sequence
  chemically synthesized
tctgtggcctgtgaggaacc

SEQ ID NO: 428537 - DNA, 20 bp, Artificial Sequence
  chemically synthesized
ctgtgcagctgggttcctca

SEQ ID NO: 428538 - DNA, 20 bp, Artificial Sequence
  chemically synthesized
tgtgcagctgggttcctcac

SEQ ID NO: 428539 - DNA, 20 bp, Artificial Sequence
  chemically synthesized
gtacccatctgtggcctgtg

SEQ ID NO: 428540 - DNA, 20 bp, Artificial Sequence
  chemically synthesized
ggtacccatctgtggcctgt

SEQ ID NO: 428541 - DNA, 20 bp, Artificial Sequence
  chemically synthesized
gctgggttcctcacaggcca

SEQ ID NO: 428542 - DNA, 20 bp, Artificial Sequence
  chemically synthesized
ggttcctcacaggccacaga

SEQ ID NO: 428543 - DNA, 20 bp, Artificial Sequence
  chemically synthesized
gttcctcacaggccacagat

SEQ ID NO: 428544 - DNA, 20 bp, Artificial Sequence
  chemically synthesized
cacacaccggtacccatctg

SEQ ID NO: 428545 - DNA, 20 bp, Artificial Sequence
  chemically synthesized
cacaggccacagatgggtac

SEQ ID NO: 428546 - DNA, 20 bp, Artificial Sequence
  chemically synthesized
cacagatgggtaccggtgtg

SEQ ID NO: 428547 - DNA, 20 bp, Artificial Sequence
  chemically synthesized
ccaacccctgggccacacac

SEQ ID NO: 428548 - DNA, 20 bp, Artificial Sequence
  chemically synthesized
atgggtaccggtgtgtggcc

SEQ ID NO: 428549 - DNA, 20 bp, Artificial Sequence
  chemically synthesized
tgggtaccggtgtgtggccc

SEQ ID NO: 428550 - DNA, 20 bp, Artificial Sequence
  chemically synthesized
gggtaccggtgtgtggccca

SEQ ID NO: 428551 - DNA, 20 bp, Artificial Sequence
  chemically synthesized
ggtaccggtgtgtggcccag

SEQ ID NO: 428552 - DNA, 20 bp, Artificial Sequence
  chemically synthesized
ccggtgtgtggcccaggggt

SEQ ID NO: 428553 - DNA, 20 bp, Artificial Sequence
  chemically synthesized
cggtgtgtggcccaggggtt

SEQ ID NO: 428554 - DNA, 20 bp, Artificial Sequence
  chemically synthesized
tgcaggggtccccaacccct

SEQ ID NO: 428555 - DNA, 20 bp, Artificial Sequence
  chemically synthesized
ggtgtgtggcccaggggttg

SEQ ID NO: 428556 - DNA, 20 bp, Artificial Sequence
  chemically synthesized
ctgcaggggtccccaacccc

SEQ ID NO: 428557 - DNA, 20 bp, Artificial Sequence
  chemically synthesized
ccaggggttggggacccctg

SEQ ID NO: 428558 - DNA, 20 bp, Artificial Sequence
  chemically synthesized
cagcagctctttcactgcag

SEQ ID NO: 428559 - DNA, 20 bp, Artificial Sequence
  chemically synthesized
acagcagctctttcactgca

SEQ ID NO: 428560 - DNA, 20 bp, Artificial Sequence
  chemically synthesized
gttggggacccctgcagtga

SEQ ID NO: 428561 - DNA, 20 bp, Artificial Sequence
  chemically synthesized
aacagcagctctttcactgc

SEQ ID NO: 428562 - DNA, 20 bp, Artificial Sequence
  chemically synthesized
gaacagcagctctttcactg

SEQ ID NO: 428563 - DNA, 20 bp, Artificial Sequence
  chemically synthesized
tggggacccctgcagtgaaa

SEQ ID NO: 428564 - DNA, 20 bp, Artificial Sequence
  chemically synthesized
cagtgaaagagctgctgttc

SEQ ID NO: 428565 - DNA, 20 bp, Artificial Sequence
  chemically synthesized
aaccctggaaactagaacag

SEQ ID NO: 428566 - DNA, 20 bp, Artificial Sequence
  chemically synthesized
cctaaccctggaaactagaa

SEQ ID NO: 428567 - DNA, 20 bp, Artificial Sequence
  chemically synthesized
agagctgctgttctagtttc

SEQ ID NO: 428568 - DNA, 20 bp, Artificial Sequence
  chemically synthesized
gagctgctgttctagtttcc

SEQ ID NO: 428569 - DNA, 20 bp, Artificial Sequence
  chemically synthesized
agctgctgttctagtttcca

SEQ ID NO: 428570 - DNA, 20 bp, Artificial Sequence
  chemically synthesized
tcaggcctaaccctggaaac

SEQ ID NO: 428571 - DNA, 20 bp, Artificial Sequence
  chemically synthesized
gctgttctagtttccagggt

SEQ ID NO: 428572 - DNA, 20 bp, Artificial Sequence
  chemically synthesized
ctgttctagtttccagggtt

SEQ ID NO: 428573 - DNA, 20 bp, Artificial Sequence
  chemically synthesized
ggtatcttcaggcctaaccc

SEQ ID NO: 428574 - DNA, 20 bp, Artificial Sequence
  chemically synthesized
agtttccagggttaggcctg

SEQ ID NO: 428575 - DNA, 20 bp, Artificial Sequence
  chemically synthesized
tataagtttctggtatcttc

SEQ ID NO: 428576 - DNA, 20 bp, Artificial Sequence
  chemically synthesized
agggttaggcctgaagatac

SEQ ID NO: 428577 - DNA, 20 bp, Artificial Sequence
  chemically synthesized
atataagtttctggtatctt

SEQ ID NO: 428578 - DNA, 20 bp, Artificial Sequence
  chemically synthesized
agacggaaaatataagtttc

SEQ ID NO: 428579 - DNA, 20 bp, Artificial Sequence
  chemically synthesized
atacaaaagacggaaaatat

SEQ ID NO: 428580 - DNA, 20 bp, Artificial Sequence
  chemically synthesized
agagtgaatgatacaaaaga

SEQ ID NO: 428581 - DNA, 20 bp, Artificial Sequence
  chemically synthesized
ttctagagtgaatgatacaa

SEQ ID NO: 428582 - DNA, 20 bp, Artificial Sequence
  chemically synthesized
gtcttttgtatcattcactc

SEQ ID NO: 428583 - DNA, 20 bp, Artificial Sequence
  chemically synthesized
catgggagctcagggttcta

SEQ ID NO: 428584 - DNA, 20 bp, Artificial Sequence
  chemically synthesized
atcattcactctagaaccct

SEQ ID NO: 428585 - DNA, 20 bp, Artificial Sequence
  chemically synthesized
cacatgggagctcagggttc

SEQ ID NO: 428586 - DNA, 20 bp, Artificial Sequence
  chemically synthesized
acttatcacatgggagctca

SEQ ID NO: 428587 - DNA, 20 bp, Artificial Sequence
  chemically synthesized
aacttatcacatgggagctc

SEQ ID NO: 428588 - DNA, 20 bp, Artificial Sequence
  chemically synthesized
gaacttatcacatgggagct

SEQ ID NO: 428589 - DNA, 20 bp, Artificial Sequence
  chemically synthesized
ttgttgaacttatcacatgg

SEQ ID NO: 428590 - DNA, 20 bp, Artificial Sequence
  chemically synthesized
accctgagctcccatgtgat

SEQ ID NO: 428591 - DNA, 20 bp, Artificial Sequence
  chemically synthesized
gattgttgaacttatcacat

SEQ ID NO: 428592 - DNA, 20 bp, Artificial Sequence
  chemically synthesized
ggattgttgaacttatcaca

SEQ ID NO: 428593 - DNA, 20 bp, Artificial Sequence
  chemically synthesized
tgtgataagttcaacaatcc

SEQ ID NO: 428594 - DNA, 20 bp, Artificial Sequence
  chemically synthesized
gtgataagttcaacaatcct

SEQ ID NO: 428595 - DNA, 20 bp, Artificial Sequence
  chemically synthesized
ctcttcagcatggtagaccc

SEQ ID NO: 428596 - DNA, 20 bp, Artificial Sequence
  chemically synthesized
cctcttcagcatggtagacc

SEQ ID NO: 428597 - DNA, 20 bp, Artificial Sequence
  chemically synthesized
atgtggcctcttcagcatgg

SEQ ID NO: 428598 - DNA, 20 bp, Artificial Sequence
  chemically synthesized
atcctgggtctaccatgctg

SEQ ID NO: 428599 - DNA, 20 bp, Artificial Sequence
  chemically synthesized
cctgggtctaccatgctgaa

SEQ ID NO: 428600 - DNA, 20 bp, Artificial Sequence
  chemically synthesized
tacatgtggcctcttcagca

SEQ ID NO: 428601 - DNA, 20 bp, Artificial Sequence
  chemically synthesized
ctgggtctaccatgctgaag

SEQ ID NO: 428602 - DNA, 20 bp, Artificial Sequence
  chemically synthesized
gtacctacatgtggcctctt

SEQ ID NO: 428603 - DNA, 20 bp, Artificial Sequence
  chemically synthesized
catgctgaagaggccacatg

SEQ ID NO: 428604 - DNA, 20 bp, Artificial Sequence
  chemically synthesized
atgctgaagaggccacatgt

SEQ ID NO: 428605 - DNA, 20 bp, Artificial Sequence
  chemically synthesized
ttgactctagtacctacatg

SEQ ID NO: 428606 - DNA, 20 bp, Artificial Sequence
  chemically synthesized
aagaggccacatgtaggtac

SEQ ID NO: 428607 - DNA, 20 bp, Artificial Sequence
  chemically synthesized
gaggccacatgtaggtacta

SEQ ID NO: 428608 - DNA, 20 bp, Artificial Sequence
  chemically synthesized
catgtaggtactagagtcaa

SEQ ID NO: 428609 - DNA, 20 bp, Artificial Sequence
  chemically synthesized
tcaactagatctattgactc

SEQ ID NO: 428610 - DNA, 20 bp, Artificial Sequence
  chemically synthesized
ggtactagagtcaatagatc

SEQ ID NO: 428611 - DNA, 20 bp, Artificial Sequence
  chemically synthesized
acagggagacttgggtcaac

SEQ ID NO: 428612 - DNA, 20 bp, Artificial Sequence
  chemically synthesized
tcaatagatctagttgaccc

SEQ ID NO: 428613 - DNA, 20 bp, Artificial Sequence
  chemically synthesized
tggagacgacagggagactt

SEQ ID NO: 428614 - DNA, 20 bp, Artificial Sequence
  chemically synthesized
gtggagacgacagggagact

SEQ ID NO: 428615 - DNA, 20 bp, Artificial Sequence
  chemically synthesized
gctttggtggagacgacagg

SEQ ID NO: 428616 - DNA, 20 bp, Artificial Sequence
  chemically synthesized
ttgctttggtggagacgaca

SEQ ID NO: 428617 - DNA, 20 bp, Artificial Sequence
  chemically synthesized
gttgctttggtggagacgac

SEQ ID NO: 428618 - DNA, 20 bp, Artificial Sequence
  chemically synthesized
tgttgctttggtggagacga

SEQ ID NO: 428619 - DNA, 20 bp, Artificial Sequence
  chemically synthesized
tctccctgtcgtctccacca

SEQ ID NO: 428620 - DNA, 20 bp, Artificial Sequence
  chemically synthesized
atatgtatgttgctttggtg

SEQ ID NO: 428621 - DNA, 20 bp, Artificial Sequence
  chemically synthesized
tcatatgtatgttgctttgg

SEQ ID NO: 428622 - DNA, 20 bp, Artificial Sequence
  chemically synthesized
tactcatatgtatgttgctt

SEQ ID NO: 428623 - DNA, 20 bp, Artificial Sequence
  chemically synthesized
caccaaagcaacatacatat

SEQ ID NO: 428624 - DNA, 20 bp, Artificial Sequence
  chemically synthesized
aagcaacatacatatgagta

SEQ ID NO: 428625 - DNA, 20 bp, Artificial Sequence
  chemically synthesized
acatatgagtacagctgtct

SEQ ID NO: 428626 - DNA, 20 bp, Artificial Sequence
  chemically synthesized
ctggtcagcagaatccaaga

SEQ ID NO: 428627 - DNA, 20 bp, Artificial Sequence
  chemically synthesized
tgagctggtcagcagaatcc

SEQ ID NO: 428628 - DNA, 20 bp, Artificial Sequence
  chemically synthesized
ctgtcttggattctgctgac

SEQ ID NO: 428629 - DNA, 20 bp, Artificial Sequence
  chemically synthesized
ctggcagatgagctggtcag

SEQ ID NO: 428630 - DNA, 20 bp, Artificial Sequence
  chemically synthesized
cagctggcagatgagctggt

SEQ ID NO: 428631 - DNA, 20 bp, Artificial Sequence
  chemically synthesized
tactcagctggcagatgagc

SEQ ID NO: 428632 - DNA, 20 bp, Artificial Sequence
  chemically synthesized
ctgctgaccagctcatctgc

SEQ ID NO: 428633 - DNA, 20 bp, Artificial Sequence
  chemically synthesized
atgatactcagctggcagat

SEQ ID NO: 428634 - DNA, 20 bp, Artificial Sequence
  chemically synthesized
gaccagctcatctgccagct

SEQ ID NO: 428635 - DNA, 20 bp, Artificial Sequence
  chemically synthesized
cctaaatgatactcagctgg

SEQ ID NO: 428636 - DNA, 20 bp, Artificial Sequence
  chemically synthesized
atccctaaatgatactcagc

SEQ ID NO: 428637 - DNA, 20 bp, Artificial Sequence
  chemically synthesized
cttgatccctaaatgatact

SEQ ID NO: 428638 - DNA, 20 bp, Artificial Sequence
  chemically synthesized
tctgccagctgagtatcatt

SEQ ID NO: 428639 - DNA, 20 bp, Artificial Sequence
  chemically synthesized
ctgccagctgagtatcattt

SEQ ID NO: 428640 - DNA, 20 bp, Artificial Sequence
  chemically synthesized
tgccagctgagtatcattta

SEQ ID NO: 428641 - DNA, 20 bp, Artificial Sequence
  chemically synthesized
ctgagtatcatttagggatc

SEQ ID NO: 428642 - DNA, 20 bp, Artificial Sequence
  chemically synthesized
gggatcaagttgataccaca

SEQ ID NO: 428643 - DNA, 20 bp, Artificial Sequence
  chemically synthesized
gatcaagttgataccacata

SEQ ID NO: 428644 - DNA, 20 bp, Artificial Sequence
  chemically synthesized
caagttgataccacatagag

SEQ ID NO: 428645 - DNA, 20 bp, Artificial Sequence
  chemically synthesized
gggtgattttccactctatg

SEQ ID NO: 428646 - DNA, 20 bp, Artificial Sequence
  chemically synthesized
acatagagtggaaaatcacc

SEQ ID NO: 428647 - DNA, 20 bp, Artificial Sequence
  chemically synthesized
aatttgagcgtgggtcaact

SEQ ID NO: 428648 - DNA, 20 bp, Artificial Sequence
  chemically synthesized
aaatttgagcgtgggtcaac

SEQ ID NO: 428649 - DNA, 20 bp, Artificial Sequence
  chemically synthesized
tgggtcataaatttgagcgt

SEQ ID NO: 428650 - DNA, 20 bp, Artificial Sequence
  chemically synthesized
gtgggtcataaatttgagcg

SEQ ID NO: 428651 - DNA, 20 bp, Artificial Sequence
  chemically synthesized
attttgtgggtcataaattt

SEQ ID NO: 428652 - DNA, 20 bp, Artificial Sequence
  chemically synthesized
tttatagctcatgattttgt

SEQ ID NO: 428653 - DNA, 20 bp, Artificial Sequence
  chemically synthesized
ttttatagctcatgattttg

SEQ ID NO: 428654 - DNA, 20 bp, Artificial Sequence
  chemically synthesized
tttatgacccacaaaatcat

SEQ ID NO: 428655 - DNA, 20 bp, Artificial Sequence
  chemically synthesized
acaaaatcatgagctataaa

SEQ ID NO: 428656 - DNA, 20 bp, Artificial Sequence
  chemically synthesized
aaaacaccagtcacttttta

SEQ ID NO: 428657 - DNA, 20 bp, Artificial Sequence
  chemically synthesized
catgagctataaaaagtgac

SEQ ID NO: 428658 - DNA, 20 bp, Artificial Sequence
  chemically synthesized
taaaaagtgactggtgtttt

SEQ ID NO: 428659 - DNA, 20 bp, Artificial Sequence
  chemically synthesized
aacttaatagcttaaaacac

SEQ ID NO: 428660 - DNA, 20 bp, Artificial Sequence
  chemically synthesized
gactggtgttttaagctatt

SEQ ID NO: 428661 - DNA, 20 bp, Artificial Sequence
  chemically synthesized
caatttattataaaacttaa

SEQ ID NO: 428662 - DNA, 20 bp, Artificial Sequence
  chemically synthesized
ttttataataaattgttact

SEQ ID NO: 428663 - DNA, 20 bp, Artificial Sequence
  chemically synthesized
aataaattgttactcagcaa

SEQ ID NO: 428664 - DNA, 20 bp, Artificial Sequence
  chemically synthesized
tgttccggttatctattgct

SEQ ID NO: 428665 - DNA, 20 bp, Artificial Sequence
  chemically synthesized
gttactcagcaatagataac

SEQ ID NO: 428666 - DNA, 20 bp, Artificial Sequence
  chemically synthesized
agcaatagataaccggaaca

SEQ ID NO: 428667 - DNA, 20 bp, Artificial Sequence
  chemically synthesized
agttgattcttgctatgttc

SEQ ID NO: 428668 - DNA, 20 bp, Artificial Sequence
  chemically synthesized
atagataaccggaacatagc

SEQ ID NO: 428669 - DNA, 20 bp, Artificial Sequence
  chemically synthesized
agcaggaatgggaacaatca

SEQ ID NO: 428670 - DNA, 20 bp, Artificial Sequence
  chemically synthesized
atcattacatgagcaggaat

SEQ ID NO: 428671 - DNA, 20 bp, Artificial Sequence
  chemically synthesized
gatcattacatgagcaggaa

SEQ ID NO: 428672 - DNA, 20 bp, Artificial Sequence
  chemically synthesized
tattagatcattacatgagc

SEQ ID NO: 428673 - DNA, 20 bp, Artificial Sequence
  chemically synthesized
atattagatcattacatgag

SEQ ID NO: 428674 - DNA, 20 bp, Artificial Sequence
  chemically synthesized
attatattagatcattacat

SEQ ID NO: 428675 - DNA, 20 bp, Artificial Sequence
  chemically synthesized
tatgtagtatataattatat

SEQ ID NO: 428676 - DNA, 20 bp, Artificial Sequence
  chemically synthesized
tcatgtatcatcaaattatg

SEQ ID NO: 428677 - DNA, 20 bp, Artificial Sequence
  chemically synthesized
tgatacatgactataaaata

SEQ ID NO: 428678 - DNA, 20 bp, Artificial Sequence
  chemically synthesized
gaacgcatctctttatttta

SEQ ID NO: 428679 - DNA, 20 bp, Artificial Sequence
  chemically synthesized
atacatgactataaaataaa

SEQ ID NO: 428680 - DNA, 20 bp, Artificial Sequence
  chemically synthesized
gataatttgtattttttaga

SEQ ID NO: 428681 - DNA, 20 bp, Artificial Sequence
  chemically synthesized
tactgataatttgtattttt

SEQ ID NO: 428682 - DNA, 20 bp, Artificial Sequence
  chemically synthesized
ttctaaaaaatacaaattat

SEQ ID NO: 428683 - DNA, 20 bp, Artificial Sequence
  chemically synthesized
tacaaattatcagtaaaaat

SEQ ID NO: 428684 - DNA, 20 bp, Artificial Sequence
  chemically synthesized
ttatcagtaaaaattagctg

SEQ ID NO: 428685 - DNA, 20 bp, Artificial Sequence
  chemically synthesized
ccaaaggcctgtttattctt

SEQ ID NO: 428686 - DNA, 20 bp, Artificial Sequence
  chemically synthesized
aaaattagctgaagaataaa

SEQ ID NO: 428687 - DNA, 20 bp, Artificial Sequence
  chemically synthesized
aaattagctgaagaataaac

SEQ ID NO: 428688 - DNA, 20 bp, Artificial Sequence
  chemically synthesized
ctgaagaataaacaggcctt

SEQ ID NO: 428689 - DNA, 20 bp, Artificial Sequence
  chemically synthesized
tgaagaataaacaggccttt

SEQ ID NO: 428690 - DNA, 20 bp, Artificial Sequence
  chemically synthesized
aagaataaacaggcctttgg

SEQ ID NO: 428691 - DNA, 20 bp, Artificial Sequence
  chemically synthesized
gaataaacaggcctttggga

SEQ ID NO: 428692 - DNA, 20 bp, Artificial Sequence
  chemically synthesized
aataaacaggcctttgggag

SEQ ID NO: 428693 - DNA, 20 bp, Artificial Sequence
  chemically synthesized
ttctaatatccctctcccaa

SEQ ID NO: 428694 - DNA, 20 bp, Artificial Sequence
  chemically synthesized
ataaacaggcctttgggaga

SEQ ID NO: 428695 - DNA, 20 bp, Artificial Sequence
  chemically synthesized
tttctaatatccctctccca

SEQ ID NO: 428696 - DNA, 20 bp, Artificial Sequence
  chemically synthesized
ggcctttgggagagggatat

SEQ ID NO: 428697 - DNA, 20 bp, Artificial Sequence
  chemically synthesized
ttgggagagggatattagaa

SEQ ID NO: 428698 - DNA, 20 bp, Artificial Sequence
  chemically synthesized
gggatattagaaaagtattg

SEQ ID NO: 428699 - DNA, 20 bp, Artificial Sequence
  chemically synthesized
ggatattagaaaagtattga

SEQ ID NO: 428700 - DNA, 20 bp, Artificial Sequence
  chemically synthesized
tttgcaaaacaatttaagag

SEQ ID NO: 428701 - DNA, 20 bp, Artificial Sequence
  chemically synthesized
atttgcaaaacaatttaaga

SEQ ID NO: 428702 - DNA, 20 bp, Artificial Sequence
  chemically synthesized
catttgcaaaacaatttaag

SEQ ID NO: 428703 - DNA, 20 bp, Artificial Sequence
  chemically synthesized
acatttgcaaaacaatttaa

SEQ ID NO: 428704 - DNA, 20 bp, Artificial Sequence
  chemically synthesized
agacatttgcaaaacaattt

SEQ ID NO: 428705 - DNA, 20 bp, Artificial Sequence
  chemically synthesized
tgcagtagagaaagaacaca

SEQ ID NO: 428706 - DNA, 20 bp, Artificial Sequence
  chemically synthesized
tgtgcagtagagaaagaaca

SEQ ID NO: 428707 - DNA, 20 bp, Artificial Sequence
  chemically synthesized
tcgtttctgtgcagtagaga

SEQ ID NO: 428708 - DNA, 20 bp, Artificial Sequence
  chemically synthesized
tgtgttctttctctactgca

SEQ ID NO: 428709 - DNA, 20 bp, Artificial Sequence
  chemically synthesized
gttttcgtttctgtgcagta

SEQ ID NO: 428710 - DNA, 20 bp, Artificial Sequence
  chemically synthesized
acgttttcgtttctgtgcag

SEQ ID NO: 428711 - DNA, 20 bp, Artificial Sequence
  chemically synthesized
tgtacgttttcgtttctgtg

SEQ ID NO: 428712 - DNA, 20 bp, Artificial Sequence
  chemically synthesized
gcacagaaacgaaaacgtac

SEQ ID NO: 428713 - DNA, 20 bp, Artificial Sequence
  chemically synthesized
ggatttggtggtacagatta

SEQ ID NO: 428714 - DNA, 20 bp, Artificial Sequence
  chemically synthesized
gaggatttggtggtacagat

SEQ ID NO: 428715 - DNA, 20 bp, Artificial Sequence
  chemically synthesized
atcaagaggatttggtggta

SEQ ID NO: 428716 - DNA, 20 bp, Artificial Sequence
  chemically synthesized
ataaaatcaagaggatttgg

SEQ ID NO: 428717 - DNA, 20 bp, Artificial Sequence
  chemically synthesized
atcataaaatcaagaggatt

SEQ ID NO: 428718 - DNA, 20 bp, Artificial Sequence
  chemically synthesized
taagagatcataaaatcaag

SEQ ID NO: 428719 - DNA, 20 bp, Artificial Sequence
  chemically synthesized
gtaagagatcataaaatcaa

SEQ ID NO: 428720 - DNA, 20 bp, Artificial Sequence
  chemically synthesized
tagtaagagatcataaaatc

SEQ ID NO: 428721 - DNA, 20 bp, Artificial Sequence
  chemically synthesized
tataaggaagaaagtagtaa

SEQ ID NO: 428722 - DNA, 20 bp, Artificial Sequence
  chemically synthesized
tttataaggaagaaagtagt

SEQ ID NO: 428723 - DNA, 20 bp, Artificial Sequence
  chemically synthesized
gacttttataaggaagaaag

SEQ ID NO: 428724 - DNA, 20 bp, Artificial Sequence
  chemically synthesized
actgacttttataaggaaga

SEQ ID NO: 428725 - DNA, 20 bp, Artificial Sequence
  chemically synthesized
aaagactgacttttataagg

SEQ ID NO: 428726 - DNA, 20 bp, Artificial Sequence
  chemically synthesized
tactactttcttccttataa

SEQ ID NO: 428727 - DNA, 20 bp, Artificial Sequence
  chemically synthesized
aaaaaagactgacttttata

SEQ ID NO: 428728 - DNA, 20 bp, Artificial Sequence
  chemically synthesized
aaaaaaagactgacttttat

SEQ ID NO: 428729 - DNA, 20 bp, Artificial Sequence
  chemically synthesized
actttcttccttataaaagt

SEQ ID NO: 428730 - DNA, 20 bp, Artificial Sequence
  chemically synthesized
tcaaaaaaaaaaaaaaaaaa

SEQ ID NO: 428731 - DNA, 20 bp, Artificial Sequence
  chemically synthesized
tttttttttttttttttttt

SEQ ID NO: 428732 - DNA, 20 bp, Artificial Sequence
  chemically synthesized
ttttttttttttttttttga

SEQ ID NO: 428733 - DNA, 20 bp, Artificial Sequence
  chemically synthesized
tttttttttttttttttgag

SEQ ID NO: 428734 - DNA, 20 bp, Artificial Sequence
  chemically synthesized
ttttttttttttttttgaga

SEQ ID NO: 428735 - DNA, 20 bp, Artificial Sequence
  chemically synthesized
ttttttttttttttgagagg

SEQ ID NO: 428736 - DNA, 20 bp, Artificial Sequence
  chemically synthesized
tccagcctgggcaacagagt

SEQ ID NO: 428737 - DNA, 20 bp, Artificial Sequence
  chemically synthesized
gggagtctcactctgttgcc

SEQ ID NO: 428738 - DNA, 20 bp, Artificial Sequence
  chemically synthesized
gcactccagcctgggcaaca

SEQ ID NO: 428739 - DNA, 20 bp, Artificial Sequence
  chemically synthesized
ggagtctcactctgttgccc

SEQ ID NO: 428740 - DNA, 20 bp, Artificial Sequence
  chemically synthesized
ctgcactccagcctgggcaa

SEQ ID NO: 428741 - DNA, 20 bp, Artificial Sequence
  chemically synthesized
tctcactctgttgcccaggc

SEQ ID NO: 428742 - DNA, 20 bp, Artificial Sequence
  chemically synthesized
tcactctgttgcccaggctg

SEQ ID NO: 428743 - DNA, 20 bp, Artificial Sequence
  chemically synthesized
acgccactgcactccagcct

SEQ ID NO: 428744 - DNA, 20 bp, Artificial Sequence
  chemically synthesized
cacgccactgcactccagcc

SEQ ID NO: 428745 - DNA, 20 bp, Artificial Sequence
  chemically synthesized
ctgttgcccaggctggagtg

SEQ ID NO: 428746 - DNA, 20 bp, Artificial Sequence
  chemically synthesized
gagatcacgccactgcactc

SEQ ID NO: 428747 - DNA, 20 bp, Artificial Sequence
  chemically synthesized
ttgcccaggctggagtgcag

SEQ ID NO: 428748 - DNA, 20 bp, Artificial Sequence
  chemically synthesized
ggagtgcagtggcgtgatct

SEQ ID NO: 428749 - DNA, 20 bp, Artificial Sequence
  chemically synthesized
ggcagaggttgcagtgagcc

SEQ ID NO: 428750 - DNA, 20 bp, Artificial Sequence
  chemically synthesized
ctgaaggcagaggttgcagt

SEQ ID NO: 428751 - DNA, 20 bp, Artificial Sequence
  chemically synthesized
gaaactgaaggcagaggttg

SEQ ID NO: 428752 - DNA, 20 bp, Artificial Sequence
  chemically synthesized
ctcactgcaacctctgcctt

SEQ ID NO: 428753 - DNA, 20 bp, Artificial Sequence
  chemically synthesized
tcccttgaaactgaaggcag

SEQ ID NO: 428754 - DNA, 20 bp, Artificial Sequence
  chemically synthesized
atcccttgaaactgaaggca

SEQ ID NO: 428755 - DNA, 20 bp, Artificial Sequence
  chemically synthesized
gaatcccttgaaactgaagg

SEQ ID NO: 428756 - DNA, 20 bp, Artificial Sequence
  chemically synthesized
ggagaatcccttgaaactga

SEQ ID NO: 428757 - DNA, 20 bp, Artificial Sequence
  chemically synthesized
caacctctgccttcagtttc

SEQ ID NO: 428758 - DNA, 20 bp, Artificial Sequence
  chemically synthesized
aggagaatcccttgaaactg

SEQ ID NO: 428759 - DNA, 20 bp, Artificial Sequence
  chemically synthesized
aacctctgccttcagtttca

SEQ ID NO: 428760 - DNA, 20 bp, Artificial Sequence
  chemically synthesized
acctctgccttcagtttcaa

SEQ ID NO: 428761 - DNA, 20 bp, Artificial Sequence
  chemically synthesized
ttcaagggattctcctgcct

SEQ ID NO: 428762 - DNA, 20 bp, Artificial Sequence
  chemically synthesized
tactcaggaggctgaggcag

SEQ ID NO: 428763 - DNA, 20 bp, Artificial Sequence
  chemically synthesized
gctactcaggaggctgaggc

SEQ ID NO: 428764 - DNA, 20 bp, Artificial Sequence
  chemically synthesized
agctactcaggaggctgagg

SEQ ID NO: 428765 - DNA, 20 bp, Artificial Sequence
  chemically synthesized
cccagctactcaggaggctg

SEQ ID NO: 428766 - DNA, 20 bp, Artificial Sequence
  chemically synthesized
tcccagctactcaggaggct

SEQ ID NO: 428767 - DNA, 20 bp, Artificial Sequence
  chemically synthesized
ttctcctgcctcagcctcct

SEQ ID NO: 428768 - DNA, 20 bp, Artificial Sequence
  chemically synthesized
tcctgcctcagcctcctgag

SEQ ID NO: 428769 - DNA, 20 bp, Artificial Sequence
  chemically synthesized
tgtaatcccagctactcagg

SEQ ID NO: 428770 - DNA, 20 bp, Artificial Sequence
  chemically synthesized
ctgtaatcccagctactcag

SEQ ID NO: 428771 - DNA, 20 bp, Artificial Sequence
  chemically synthesized
gcctcagcctcctgagtagc

SEQ ID NO: 428772 - DNA, 20 bp, Artificial Sequence
  chemically synthesized
atctgtaatcccagctactc

SEQ ID NO: 428773 - DNA, 20 bp, Artificial Sequence
  chemically synthesized
cctcagcctcctgagtagct

SEQ ID NO: 428774 - DNA, 20 bp, Artificial Sequence
  chemically synthesized
catctgtaatcccagctact

SEQ ID NO: 428775 - DNA, 20 bp, Artificial Sequence
  chemically synthesized
ctcctgagtagctgggatta

SEQ ID NO: 428776 - DNA, 20 bp, Artificial Sequence
  chemically synthesized
gtggtgcacatctgtaatcc

SEQ ID NO: 428777 - DNA, 20 bp, Artificial Sequence
  chemically synthesized
cagatgtgcaccaccacgcc

SEQ ID NO: 428778 - DNA, 20 bp, Artificial Sequence
  chemically synthesized
caaagattagccgggcgtgg

SEQ ID NO: 428779 - DNA, 20 bp, Artificial Sequence
  chemically synthesized
atacaaagattagccgggcg

SEQ ID NO: 428780 - DNA, 20 bp, Artificial Sequence
  chemically synthesized
taaacatacaaagattagcc

SEQ ID NO: 428781 - DNA, 20 bp, Artificial Sequence
  chemically synthesized
ctaaacatacaaagattagc

SEQ ID NO: 428782 - DNA, 20 bp, Artificial Sequence
  chemically synthesized
tctactaaacatacaaagat

SEQ ID NO: 428783 - DNA, 20 bp, Artificial Sequence
  chemically synthesized
ccaactctactaaacataca

SEQ ID NO: 428784 - DNA, 20 bp, Artificial Sequence
  chemically synthesized
ccggctaatctttgtatgtt

SEQ ID NO: 428785 - DNA, 20 bp, Artificial Sequence
  chemically synthesized
gctaatctttgtatgtttag

SEQ ID NO: 428786 - DNA, 20 bp, Artificial Sequence
  chemically synthesized
taatctttgtatgtttagta

SEQ ID NO: 428787 - DNA, 20 bp, Artificial Sequence
  chemically synthesized
ctttgtatgtttagtagagt

SEQ ID NO: 428788 - DNA, 20 bp, Artificial Sequence
  chemically synthesized
tttgtatgtttagtagagtt

SEQ ID NO: 428789 - DNA, 20 bp, Artificial Sequence
  chemically synthesized
ttgtatgtttagtagagttg

SEQ ID NO: 428790 - DNA, 20 bp, Artificial Sequence
  chemically synthesized
gagttggggtttcgccatac

SEQ ID NO: 428791 - DNA, 20 bp, Artificial Sequence
  chemically synthesized
tggggtttcgccatactggc

SEQ ID NO: 428792 - DNA, 20 bp, Artificial Sequence
  chemically synthesized
cgagaccaacctggccagta

SEQ ID NO: 428793 - DNA, 20 bp, Artificial Sequence
  chemically synthesized
ggggtttcgccatactggcc

SEQ ID NO: 428794 - DNA, 20 bp, Artificial Sequence
  chemically synthesized
tttcgccatactggccaggt

SEQ ID NO: 428795 - DNA, 20 bp, Artificial Sequence
  chemically synthesized
gagttcgagaccaacctggc

SEQ ID NO: 428796 - DNA, 20 bp, Artificial Sequence
  chemically synthesized
tcaggagttcgagaccaacc

SEQ ID NO: 428797 - DNA, 20 bp, Artificial Sequence
  chemically synthesized
tcacttgaggtcaggagttc

SEQ ID NO: 428798 - DNA, 20 bp, Artificial Sequence
  chemically synthesized
ggcggatcacttgaggtcag

SEQ ID NO: 428799 - DNA, 20 bp, Artificial Sequence
  chemically synthesized
ggtctcgaactcctgacctc

SEQ ID NO: 428800 - DNA, 20 bp, Artificial Sequence
  chemically synthesized
cgggcggatcacttgaggtc

SEQ ID NO: 428801 - DNA, 20 bp, Artificial Sequence
  chemically synthesized
gcgggcggatcacttgaggt

SEQ ID NO: 428802 - DNA, 20 bp, Artificial Sequence
  chemically synthesized
cgaggcgggcggatcacttg

SEQ ID NO: 428803 - DNA, 20 bp, Artificial Sequence
  chemically synthesized
ccgaggcgggcggatcactt

SEQ ID NO: 428804 - DNA, 20 bp, Artificial Sequence
  chemically synthesized
ctcaagtgatccgcccgcct

SEQ ID NO: 428805 - DNA, 20 bp, Artificial Sequence
  chemically synthesized
ttttgggaggccgaggcggg

SEQ ID NO: 428806 - DNA, 20 bp, Artificial Sequence
  chemically synthesized
catttttgggaggccgaggc

SEQ ID NO: 428807 - DNA, 20 bp, Artificial Sequence
  chemically synthesized
gcatttttgggaggccgagg

SEQ ID NO: 428808 - DNA, 20 bp, Artificial Sequence
  chemically synthesized
ccagcatttttgggaggccg

SEQ ID NO: 428809 - DNA, 20 bp, Artificial Sequence
  chemically synthesized
cccagcatttttgggaggcc

SEQ ID NO: 428810 - DNA, 20 bp, Artificial Sequence
  chemically synthesized
gtaatcccagcatttttggg

SEQ ID NO: 428811 - DNA, 20 bp, Artificial Sequence
  chemically synthesized
tgtaatcccagcatttttgg

SEQ ID NO: 428812 - DNA, 20 bp, Artificial Sequence
  chemically synthesized
cctgtaatcccagcattttt

SEQ ID NO: 428813 - DNA, 20 bp, Artificial Sequence
  chemically synthesized
cctcggcctcccaaaaatgc

SEQ ID NO: 428814 - DNA, 20 bp, Artificial Sequence
  chemically synthesized
acctgtaatcccagcatttt

SEQ ID NO: 428815 - DNA, 20 bp, Artificial Sequence
  chemically synthesized
ctcggcctcccaaaaatgct

SEQ ID NO: 428816 - DNA, 20 bp, Artificial Sequence
  chemically synthesized
tcccaaaaatgctgggatta

SEQ ID NO: 428817 - DNA, 20 bp, Artificial Sequence
  chemically synthesized
cccaaaaatgctgggattac

SEQ ID NO: 428818 - DNA, 20 bp, Artificial Sequence
  chemically synthesized
gtggctcccacctgtaatcc

SEQ ID NO: 428819 - DNA, 20 bp, Artificial Sequence
  chemically synthesized
aaaaatgctgggattacagg

SEQ ID NO: 428820 - DNA, 20 bp, Artificial Sequence
  chemically synthesized
aaaatgctgggattacaggt

SEQ ID NO: 428821 - DNA, 20 bp, Artificial Sequence
  chemically synthesized
aatgctgggattacaggtgg

SEQ ID NO: 428822 - DNA, 20 bp, Artificial Sequence
  chemically synthesized
caggtgggagccactgcgcc

SEQ ID NO: 428823 - DNA, 20 bp, Artificial Sequence
  chemically synthesized
tgactactggccaggcgcag

SEQ ID NO: 428824 - DNA, 20 bp, Artificial Sequence
  chemically synthesized
ctgtgactactggccaggcg

SEQ ID NO: 428825 - DNA, 20 bp, Artificial Sequence
  chemically synthesized
tgggagccactgcgcctggc

SEQ ID NO: 428826 - DNA, 20 bp, Artificial Sequence
  chemically synthesized
gagccactgcgcctggccag

SEQ ID NO: 428827 - DNA, 20 bp, Artificial Sequence
  chemically synthesized
taagactgtgactactggcc

SEQ ID NO: 428828 - DNA, 20 bp, Artificial Sequence
  chemically synthesized
ttaagactgtgactactggc

SEQ ID NO: 428829 - DNA, 20 bp, Artificial Sequence
  chemically synthesized
ctgcgcctggccagtagtca

SEQ ID NO: 428830 - DNA, 20 bp, Artificial Sequence
  chemically synthesized
gcaattaagactgtgactac

SEQ ID NO: 428831 - DNA, 20 bp, Artificial Sequence
  chemically synthesized
gtgttcaaggaatagcaatt

SEQ ID NO: 428832 - DNA, 20 bp, Artificial Sequence
  chemically synthesized
gtgagagtgtgttcaaggaa

SEQ ID NO: 428833 - DNA, 20 bp, Artificial Sequence
  chemically synthesized
ctcaggtgagagtgtgttca

SEQ ID NO: 428834 - DNA, 20 bp, Artificial Sequence
  chemically synthesized
tctcaggtgagagtgtgttc

SEQ ID NO: 428835 - DNA, 20 bp, Artificial Sequence
  chemically synthesized
ccttgaacacactctcacct

SEQ ID NO: 428836 - DNA, 20 bp, Artificial Sequence
  chemically synthesized
gaaaaaaggctctcaggtga

SEQ ID NO: 428837 - DNA, 20 bp, Artificial Sequence
  chemically synthesized
ttgaacacactctcacctga

SEQ ID NO: 428838 - DNA, 20 bp, Artificial Sequence
  chemically synthesized
tggaaaaaaggctctcaggt

SEQ ID NO: 428839 - DNA, 20 bp, Artificial Sequence
  chemically synthesized
tgagtggaaaaaaggctctc

SEQ ID NO: 428840 - DNA, 20 bp, Artificial Sequence
  chemically synthesized
atgagtggaaaaaaggctct

SEQ ID NO: 428841 - DNA, 20 bp, Artificial Sequence
  chemically synthesized
taagggaatgagtggaaaaa

SEQ ID NO: 428842 - DNA, 20 bp, Artificial Sequence
  chemically synthesized
ttaagggaatgagtggaaaa

SEQ ID NO: 428843 - DNA, 20 bp, Artificial Sequence
  chemically synthesized
ttccaggttaagggaatgag

SEQ ID NO: 428844 - DNA, 20 bp, Artificial Sequence
  chemically synthesized
ttgttccaggttaagggaat

SEQ ID NO: 428845 - DNA, 20 bp, Artificial Sequence
  chemically synthesized
ttccactcattcccttaacc

SEQ ID NO: 428846 - DNA, 20 bp, Artificial Sequence
  chemically synthesized
agaagattgttccaggttaa

SEQ ID NO: 428847 - DNA, 20 bp, Artificial Sequence
  chemically synthesized
gagaagattgttccaggtta

SEQ ID NO: 428848 - DNA, 20 bp, Artificial Sequence
  chemically synthesized
agagaagattgttccaggtt

SEQ ID NO: 428849 - DNA, 20 bp, Artificial Sequence
  chemically synthesized
tagatagagaagattgttcc

SEQ ID NO: 428850 - DNA, 20 bp, Artificial Sequence
  chemically synthesized
ctagatagagaagattgttc

SEQ ID NO: 428851 - DNA, 20 bp, Artificial Sequence
  chemically synthesized
ctggaacaatcttctctatc

SEQ ID NO: 428852 - DNA, 20 bp, Artificial Sequence
  chemically synthesized
aagaagccaactagatagag

SEQ ID NO: 428853 - DNA, 20 bp, Artificial Sequence
  chemically synthesized
gacaagaagccaactagata

SEQ ID NO: 428854 - DNA, 20 bp, Artificial Sequence
  chemically synthesized
aacaatcttctctatctagt

SEQ ID NO: 428855 - DNA, 20 bp, Artificial Sequence
  chemically synthesized
gagacaagaagccaactaga

SEQ ID NO: 428856 - DNA, 20 bp, Artificial Sequence
  chemically synthesized
gaacgagacaagaagccaac

SEQ ID NO: 428857 - DNA, 20 bp, Artificial Sequence
  chemically synthesized
ttaaatcagaacgagacaag

SEQ ID NO: 428858 - DNA, 20 bp, Artificial Sequence
  chemically synthesized
aggttaaatcagaacgagac

SEQ ID NO: 428859 - DNA, 20 bp, Artificial Sequence
  chemically synthesized
tgagcaggttaaatcagaac

SEQ ID NO: 428860 - DNA, 20 bp, Artificial Sequence
  chemically synthesized
ttgcactgagcaggttaaat

SEQ ID NO: 428861 - DNA, 20 bp, Artificial Sequence
  chemically synthesized
tcgttctgatttaacctgct

SEQ ID NO: 428862 - DNA, 20 bp, Artificial Sequence
  chemically synthesized
tatgatgagttgcactgagc

SEQ ID NO: 428863 - DNA, 20 bp, Artificial Sequence
  chemically synthesized
ttatgatgagttgcactgag

SEQ ID NO: 428864 - DNA, 20 bp, Artificial Sequence
  chemically synthesized
gtgttatgatgagttgcact

SEQ ID NO: 428865 - DNA, 20 bp, Artificial Sequence
  chemically synthesized
atgaaataatgtgttatgat

SEQ ID NO: 428866 - DNA, 20 bp, Artificial Sequence
  chemically synthesized
cattatttcatgctcttttc

SEQ ID NO: 428867 - DNA, 20 bp, Artificial Sequence
  chemically synthesized
attatttcatgctcttttcc

SEQ ID NO: 428868 - DNA, 20 bp, Artificial Sequence
  chemically synthesized
gaatactagggcctggaaaa

SEQ ID NO: 428869 - DNA, 20 bp, Artificial Sequence
  chemically synthesized
aggaatactagggcctggaa

SEQ ID NO: 428870 - DNA, 20 bp, Artificial Sequence
  chemically synthesized
tcatgctcttttccaggccc

SEQ ID NO: 428871 - DNA, 20 bp, Artificial Sequence
  chemically synthesized
aaatcaggaatactagggcc

SEQ ID NO: 428872 - DNA, 20 bp, Artificial Sequence
  chemically synthesized
aagggaaatcaggaatacta

SEQ ID NO: 428873 - DNA, 20 bp, Artificial Sequence
  chemically synthesized
caagggaaatcaggaatact

SEQ ID NO: 428874 - DNA, 20 bp, Artificial Sequence
  chemically synthesized
gcaagggaaatcaggaatac

SEQ ID NO: 428875 - DNA, 20 bp, Artificial Sequence
  chemically synthesized
gtagtagggcaagggaaatc

SEQ ID NO: 428876 - DNA, 20 bp, Artificial Sequence
  chemically synthesized
agtagtagggcaagggaaat

SEQ ID NO: 428877 - DNA, 20 bp, Artificial Sequence
  chemically synthesized
aaataaaagtagtagggcaa

SEQ ID NO: 428878 - DNA, 20 bp, Artificial Sequence
  chemically synthesized
aaaataaaagtagtagggca

SEQ ID NO: 428879 - DNA, 20 bp, Artificial Sequence
  chemically synthesized
gaaaataaaagtagtagggc

SEQ ID NO: 428880 - DNA, 20 bp, Artificial Sequence
  chemically synthesized
taaggaaaataaaagtagta

SEQ ID NO: 428881 - DNA, 20 bp, Artificial Sequence
  chemically synthesized
ctaaggaaaataaaagtagt

SEQ ID NO: 428882 - DNA, 20 bp, Artificial Sequence
  chemically synthesized
gctaaggaaaataaaagtag

SEQ ID NO: 428883 - DNA, 20 bp, Artificial Sequence
  chemically synthesized
agtgctaaggaaaataaaag

SEQ ID NO: 428884 - DNA, 20 bp, Artificial Sequence
  chemically synthesized
ataagtgctaaggaaaataa

SEQ ID NO: 428885 - DNA, 20 bp, Artificial Sequence
  chemically synthesized
cctactacttttattttcct

SEQ ID NO: 428886 - DNA, 20 bp, Artificial Sequence
  chemically synthesized
ttagtgaaatataagtgcta

SEQ ID NO: 428887 - DNA, 20 bp, Artificial Sequence
  chemically synthesized
gttagtgaaatataagtgct

SEQ ID NO: 428888 - DNA, 20 bp, Artificial Sequence
  chemically synthesized
gttgtgtgttagtgaaatat

SEQ ID NO: 428889 - DNA, 20 bp, Artificial Sequence
  chemically synthesized
taataagttatgttgtgtgt

SEQ ID NO: 428890 - DNA, 20 bp, Artificial Sequence
  chemically synthesized
cagtaatttggtaggttaat

SEQ ID NO: 428891 - DNA, 20 bp, Artificial Sequence
  chemically synthesized
aatcaggacagtaatttggt

SEQ ID NO: 428892 - DNA, 20 bp, Artificial Sequence
  chemically synthesized
caatcaggacagtaatttgg

SEQ ID NO: 428893 - DNA, 20 bp, Artificial Sequence
  chemically synthesized
ccacaatcaggacagtaatt

SEQ ID NO: 428894 - DNA, 20 bp, Artificial Sequence
  chemically synthesized
ctgatttcccacaatcagga

SEQ ID NO: 428895 - DNA, 20 bp, Artificial Sequence
  chemically synthesized
ccaaattactgtcctgattg

SEQ ID NO: 428896 - DNA, 20 bp, Artificial Sequence
  chemically synthesized
caaattactgtcctgattgt

SEQ ID NO: 428897 - DNA, 20 bp, Artificial Sequence
  chemically synthesized
ccctctgatttcccacaatc

SEQ ID NO: 428898 - DNA, 20 bp, Artificial Sequence
  chemically synthesized
gccctctgatttcccacaat

SEQ ID NO: 428899 - DNA, 20 bp, Artificial Sequence
  chemically synthesized
ctgtcctgattgtgggaaat

SEQ ID NO: 428900 - DNA, 20 bp, Artificial Sequence
  chemically synthesized
gtcctgattgtgggaaatca

SEQ ID NO: 428901 - DNA, 20 bp, Artificial Sequence
  chemically synthesized
tcctgattgtgggaaatcag

SEQ ID NO: 428902 - DNA, 20 bp, Artificial Sequence
  chemically synthesized
cctgattgtgggaaatcaga

SEQ ID NO: 428903 - DNA, 20 bp, Artificial Sequence
  chemically synthesized
tgtggtttgcttcagggtaa

SEQ ID NO: 428904 - DNA, 20 bp, Artificial Sequence
  chemically synthesized
atcagagggcttttaccctg

SEQ ID NO: 428905 - DNA, 20 bp, Artificial Sequence
  chemically synthesized
ctctgttgtggtttgcttca

SEQ ID NO: 428906 - DNA, 20 bp, Artificial Sequence
  chemically synthesized
tctctgttgtggtttgcttc

SEQ ID NO: 428907 - DNA, 20 bp, Artificial Sequence
  chemically synthesized
ttctctgttgtggtttgctt

SEQ ID NO: 428908 - DNA, 20 bp, Artificial Sequence
  chemically synthesized
taccctgaagcaaaccacaa

SEQ ID NO: 428909 - DNA, 20 bp, Artificial Sequence
  chemically synthesized
ccctgaagcaaaccacaaca

SEQ ID NO: 428910 - DNA, 20 bp, Artificial Sequence
  chemically synthesized
aatagtctatttctctgttg

SEQ ID NO: 428911 - DNA, 20 bp, Artificial Sequence
  chemically synthesized
agcaaaccacaacagagaaa

SEQ ID NO: 428912 - DNA, 20 bp, Artificial Sequence
  chemically synthesized
cagagaaatagactattttg

SEQ ID NO: 428913 - DNA, 20 bp, Artificial Sequence
  chemically synthesized
cctaaacctttgcttcaaaa

SEQ ID NO: 428914 - DNA, 20 bp, Artificial Sequence
  chemically synthesized
aaatagactattttgaagca

SEQ ID NO: 428915 - DNA, 20 bp, Artificial Sequence
  chemically synthesized
aatagactattttgaagcaa

SEQ ID NO: 428916 - DNA, 20 bp, Artificial Sequence
  chemically synthesized
actattttgaagcaaaggtt

SEQ ID NO: 428917 - DNA, 20 bp, Artificial Sequence
  chemically synthesized
ctattttgaagcaaaggttt

SEQ ID NO: 428918 - DNA, 20 bp, Artificial Sequence
  chemically synthesized
attttgaagcaaaggtttag

SEQ ID NO: 428919 - DNA, 20 bp, Artificial Sequence
  chemically synthesized
aaggtttaggagatcacata

SEQ ID NO: 428920 - DNA, 20 bp, Artificial Sequence
  chemically synthesized
aaatgttgatattttgttca

SEQ ID NO: 428921 - DNA, 20 bp, Artificial Sequence
  chemically synthesized
aacattttaaaactatatac

SEQ ID NO: 428922 - DNA, 20 bp, Artificial Sequence
  chemically synthesized
cttcttaatagtctggtata

SEQ ID NO: 428923 - DNA, 20 bp, Artificial Sequence
  chemically synthesized
aaactatataccagactatt

SEQ ID NO: 428924 - DNA, 20 bp, Artificial Sequence
  chemically synthesized
ttgagttcttcttaatagtc

SEQ ID NO: 428925 - DNA, 20 bp, Artificial Sequence
  chemically synthesized
ctatataccagactattaag

SEQ ID NO: 428926 - DNA, 20 bp, Artificial Sequence
  chemically synthesized
aaaccttgagttcttcttaa

SEQ ID NO: 428927 - DNA, 20 bp, Artificial Sequence
  chemically synthesized
cagactattaagaagaactc

SEQ ID NO: 428928 - DNA, 20 bp, Artificial Sequence
  chemically synthesized
agactattaagaagaactca

SEQ ID NO: 428929 - DNA, 20 bp, Artificial Sequence
  chemically synthesized
ctgcccttgttgaaaacctt

SEQ ID NO: 428930 - DNA, 20 bp, Artificial Sequence
  chemically synthesized
aagaactcaaggttttcaac

SEQ ID NO: 428931 - DNA, 20 bp, Artificial Sequence
  chemically synthesized
agaactcaaggttttcaaca

SEQ ID NO: 428932 - DNA, 20 bp, Artificial Sequence
  chemically synthesized
gaactcaaggttttcaacaa

SEQ ID NO: 428933 - DNA, 20 bp, Artificial Sequence
  chemically synthesized
ctcaaggttttcaacaaggg

SEQ ID NO: 428934 - DNA, 20 bp, Artificial Sequence
  chemically synthesized
ttttcaacaagggcagtgat

SEQ ID NO: 428935 - DNA, 20 bp, Artificial Sequence
  chemically synthesized
tttcaacaagggcagtgata

SEQ ID NO: 428936 - DNA, 20 bp, Artificial Sequence
  chemically synthesized
tcaacaagggcagtgataag

SEQ ID NO: 428937 - DNA, 20 bp, Artificial Sequence
  chemically synthesized
aacaagggcagtgataagga

SEQ ID NO: 428938 - DNA, 20 bp, Artificial Sequence
  chemically synthesized
acaagggcagtgataaggag

SEQ ID NO: 428939 - DNA, 20 bp, Artificial Sequence
  chemically synthesized
gggcagtgataaggagaggt

SEQ ID NO: 428940 - DNA, 20 bp, Artificial Sequence
  chemically synthesized
gagggcagcataacatagca

SEQ ID NO: 428941 - DNA, 20 bp, Artificial Sequence
  chemically synthesized
tgccagagggcagcataaca

SEQ ID NO: 428942 - DNA, 20 bp, Artificial Sequence
  chemically synthesized
tgctatgttatgctgccctc

SEQ ID NO: 428943 - DNA, 20 bp, Artificial Sequence
  chemically synthesized
ttgaactccatgccagaggg

SEQ ID NO: 428944 - DNA, 20 bp, Artificial Sequence
  chemically synthesized
tgttatgctgccctctggca

SEQ ID NO: 428945 - DNA, 20 bp, Artificial Sequence
  chemically synthesized
tatttgaactccatgccaga

SEQ ID NO: 428946 - DNA, 20 bp, Artificial Sequence
  chemically synthesized
ctatttgaactccatgccag

SEQ ID NO: 428947 - DNA, 20 bp, Artificial Sequence
  chemically synthesized
ttatgctgccctctggcatg

SEQ ID NO: 428948 - DNA, 20 bp, Artificial Sequence
  chemically synthesized
cctatttgaactccatgcca

SEQ ID NO: 428949 - DNA, 20 bp, Artificial Sequence
  chemically synthesized
ggcctatttgaactccatgc

SEQ ID NO: 428950 - DNA, 20 bp, Artificial Sequence
  chemically synthesized
cctctggcatggagttcaaa

SEQ ID NO: 428951 - DNA, 20 bp, Artificial Sequence
  chemically synthesized
ctctggcatggagttcaaat

SEQ ID NO: 428952 - DNA, 20 bp, Artificial Sequence
  chemically synthesized
gcatggagttcaaataggcc

SEQ ID NO: 428953 - DNA, 20 bp, Artificial Sequence
  chemically synthesized
agttcaaataggccaagata

SEQ ID NO: 428954 - DNA, 20 bp, Artificial Sequence
  chemically synthesized
acatgaacagggctttatct

SEQ ID NO: 428955 - DNA, 20 bp, Artificial Sequence
  chemically synthesized
cattcaaaaatacatgaaca

SEQ ID NO: 428956 - DNA, 20 bp, Artificial Sequence
  chemically synthesized
ccattcaaaaatacatgaac

SEQ ID NO: 428957 - DNA, 20 bp, Artificial Sequence
  chemically synthesized
tccattcaaaaatacatgaa

SEQ ID NO: 428958 - DNA, 20 bp, Artificial Sequence
  chemically synthesized
cctgttcatgtatttttgaa

SEQ ID NO: 428959 - DNA, 20 bp, Artificial Sequence
  chemically synthesized
tatttttgaatggataaaca

SEQ ID NO: 428960 - DNA, 20 bp, Artificial Sequence
  chemically synthesized
atggataaacaaagtccctc

SEQ ID NO: 428961 - DNA, 20 bp, Artificial Sequence
  chemically synthesized
taaacaaagtccctctagat

SEQ ID NO: 428962 - DNA, 20 bp, Artificial Sequence
  chemically synthesized
aaacgctgtactcatctaga

SEQ ID NO: 428963 - DNA, 20 bp, Artificial Sequence
  chemically synthesized
caaacgctgtactcatctag

SEQ ID NO: 428964 - DNA, 20 bp, Artificial Sequence
  chemically synthesized
tcaaacgctgtactcatcta

SEQ ID NO: 428965 - DNA, 20 bp, Artificial Sequence
  chemically synthesized
aatcaaacgctgtactcatc

SEQ ID NO: 428966 - DNA, 20 bp, Artificial Sequence
  chemically synthesized
aaagtccctctagatgagta

SEQ ID NO: 428967 - DNA, 20 bp, Artificial Sequence
  chemically synthesized
ttgggttacctgaaatagtg

SEQ ID NO: 428968 - DNA, 20 bp, Artificial Sequence
  chemically synthesized
gatttttaactacactattt

SEQ ID NO: 428969 - DNA, 20 bp, Artificial Sequence
  chemically synthesized
atttttaactacactatttc

SEQ ID NO: 428970 - DNA, 20 bp, Artificial Sequence
  chemically synthesized
aagctttgggttacctgaaa

SEQ ID NO: 428971 - DNA, 20 bp, Artificial Sequence
  chemically synthesized
acactatttcaggtaaccca

SEQ ID NO: 428972 - DNA, 20 bp, Artificial Sequence
  chemically synthesized
tttcagacaagaaaagcttt

SEQ ID NO: 428973 - DNA, 20 bp, Artificial Sequence
  chemically synthesized
gtttcagacaagaaaagctt

SEQ ID NO: 428974 - DNA, 20 bp, Artificial Sequence
  chemically synthesized
ttatatgtttcagacaagaa

SEQ ID NO: 428975 - DNA, 20 bp, Artificial Sequence
  chemically synthesized
ataacttatatgtttcagac

SEQ ID NO: 428976 - DNA, 20 bp, Artificial Sequence
  chemically synthesized
ctgtcataacttatatgttt

SEQ ID NO: 428977 - DNA, 20 bp, Artificial Sequence
  chemically synthesized
ttttcttgtctgaaacatat

SEQ ID NO: 428978 - DNA, 20 bp, Artificial Sequence
  chemically synthesized
ctgaaacatataagttatga

SEQ ID NO: 428979 - DNA, 20 bp, Artificial Sequence
  chemically synthesized
tgaaacatataagttatgac

SEQ ID NO: 428980 - DNA, 20 bp, Artificial Sequence
  chemically synthesized
tataagttatgacaggtctc

SEQ ID NO: 428981 - DNA, 20 bp, Artificial Sequence
  chemically synthesized
ttatgacaggtctctggaac

SEQ ID NO: 428982 - DNA, 20 bp, Artificial Sequence
  chemically synthesized
tttagatataacttgttcca

SEQ ID NO: 428983 - DNA, 20 bp, Artificial Sequence
  chemically synthesized
catttagatataacttgttc

SEQ ID NO: 428984 - DNA, 20 bp, Artificial Sequence
  chemically synthesized
aacaagttatatctaaatgc

SEQ ID NO: 428985 - DNA, 20 bp, Artificial Sequence
  chemically synthesized
caagttatatctaaatgcca

SEQ ID NO: 428986 - DNA, 20 bp, Artificial Sequence
  chemically synthesized
tactacctgactctggcatt

SEQ ID NO: 428987 - DNA, 20 bp, Artificial Sequence
  chemically synthesized
ttatatctaaatgccagagt

SEQ ID NO: 428988 - DNA, 20 bp, Artificial Sequence
  chemically synthesized
tatatctaaatgccagagtc

SEQ ID NO: 428989 - DNA, 20 bp, Artificial Sequence
  chemically synthesized
tgccttatactacctgactc

SEQ ID NO: 428990 - DNA, 20 bp, Artificial Sequence
  chemically synthesized
atctaaatgccagagtcagg

SEQ ID NO: 428991 - DNA, 20 bp, Artificial Sequence
  chemically synthesized
atgccagagtcaggtagtat

SEQ ID NO: 428992 - DNA, 20 bp, Artificial Sequence
  chemically synthesized
tgccagagtcaggtagtata

SEQ ID NO: 428993 - DNA, 20 bp, Artificial Sequence
  chemically synthesized
gtcaggtagtataaggcaaa

SEQ ID NO: 428994 - DNA, 20 bp, Artificial Sequence
  chemically synthesized
tttggtgacacaagtaaaaa

SEQ ID NO: 428995 - DNA, 20 bp, Artificial Sequence
  chemically synthesized
taagagatgtttggtgacac

SEQ ID NO: 428996 - DNA, 20 bp, Artificial Sequence
  chemically synthesized
gctaaaatgtaagagatgtt

SEQ ID NO: 428997 - DNA, 20 bp, Artificial Sequence
  chemically synthesized
agtcagcagctaaaatgtaa

SEQ ID NO: 428998 - DNA, 20 bp, Artificial Sequence
  chemically synthesized
accaaacatctcttacattt

SEQ ID NO: 428999 - DNA, 20 bp, Artificial Sequence
  chemically synthesized
aaagtcagcagctaaaatgt

SEQ ID NO: 429000 - DNA, 20 bp, Artificial Sequence
  chemically synthesized
atacattagtgaaaagtcag

SEQ ID NO: 429001 - DNA, 20 bp, Artificial Sequence
  chemically synthesized
ttaatacattagtgaaaagt

SEQ ID NO: 429002 - DNA, 20 bp, Artificial Sequence
  chemically synthesized
tgtattaatacattagtgaa

SEQ ID NO: 429003 - DNA, 20 bp, Artificial Sequence
  chemically synthesized
aatattctgtattaatacat

SEQ ID NO: 429004 - DNA, 20 bp, Artificial Sequence
  chemically synthesized
ttttcactaatgtattaata

SEQ ID NO: 429005 - DNA, 20 bp, Artificial Sequence
  chemically synthesized
ttagttaaattgaagaaaag

SEQ ID NO: 429006 - DNA, 20 bp, Artificial Sequence
  chemically synthesized
tctttagttaaattgaagaa

SEQ ID NO: 429007 - DNA, 20 bp, Artificial Sequence
  chemically synthesized
tcagttctttagttaaattg

SEQ ID NO: 429008 - DNA, 20 bp, Artificial Sequence
  chemically synthesized
gcttttcttcaatttaacta

SEQ ID NO: 429009 - DNA, 20 bp, Artificial Sequence
  chemically synthesized
aatgtaagtattcagttctt

SEQ ID NO: 429010 - DNA, 20 bp, Artificial Sequence
  chemically synthesized
tgatactaaatgtaagtatt

SEQ ID NO: 429011 - DNA, 20 bp, Artificial Sequence
  chemically synthesized
aagaactgaatacttacatt

SEQ ID NO: 429012 - DNA, 20 bp, Artificial Sequence
  chemically synthesized
agaaatttgatactaaatgt

SEQ ID NO: 429013 - DNA, 20 bp, Artificial Sequence
  chemically synthesized
ttttaaaagaagacacatta

SEQ ID NO: 429014 - DNA, 20 bp, Artificial Sequence
  chemically synthesized
tacctttgtatttttaaaag

SEQ ID NO: 429015 - DNA, 20 bp, Artificial Sequence
  chemically synthesized
aattacctttgtatttttaa

SEQ ID NO: 429016 - DNA, 20 bp, Artificial Sequence
  chemically synthesized
tgtcttcttttaaaaataca

SEQ ID NO: 429017 - DNA, 20 bp, Artificial Sequence
  chemically synthesized
gtcttcttttaaaaatacaa

SEQ ID NO: 429018 - DNA, 20 bp, Artificial Sequence
  chemically synthesized
aaatatcaattaaatctgaa

SEQ ID NO: 429019 - DNA, 20 bp, Artificial Sequence
  chemically synthesized
aataaaatctagtcactatt

SEQ ID NO: 429020 - DNA, 20 bp, Artificial Sequence
  chemically synthesized
aattaaatctgaatagtgac

SEQ ID NO: 429021 - DNA, 20 bp, Artificial Sequence
  chemically synthesized
tctcatatctaaataaaatc

SEQ ID NO: 429022 - DNA, 20 bp, Artificial Sequence
  chemically synthesized
aatagtgactagattttatt

SEQ ID NO: 429023 - DNA, 20 bp, Artificial Sequence
  chemically synthesized
actagattttatttagatat

SEQ ID NO: 429024 - DNA, 20 bp, Artificial Sequence
  chemically synthesized
tagattttatttagatatga

SEQ ID NO: 429025 - DNA, 20 bp, Artificial Sequence
  chemically synthesized
tgagagatacataaatacta

SEQ ID NO: 429026 - DNA, 20 bp, Artificial Sequence
  chemically synthesized
gagaccatgatttgtatcca

SEQ ID NO: 429027 - DNA, 20 bp, Artificial Sequence
  chemically synthesized
aatactatggatacaaatca

SEQ ID NO: 429028 - DNA, 20 bp, Artificial Sequence
  chemically synthesized
caaatcatggtctctgcctt

SEQ ID NO: 429029 - DNA, 20 bp, Artificial Sequence
  chemically synthesized
aaatcatggtctctgccttc

SEQ ID NO: 429030 - DNA, 20 bp, Artificial Sequence
  chemically synthesized
ccatcagctgcctgaaggca

SEQ ID NO: 429031 - DNA, 20 bp, Artificial Sequence
  chemically synthesized
ggccatcagctgcctgaagg

SEQ ID NO: 429032 - DNA, 20 bp, Artificial Sequence
  chemically synthesized
tcatggtctctgccttcagg

SEQ ID NO: 429033 - DNA, 20 bp, Artificial Sequence
  chemically synthesized
cagggccatcagctgcctga

SEQ ID NO: 429034 - DNA, 20 bp, Artificial Sequence
  chemically synthesized
acagggccatcagctgcctg

SEQ ID NO: 429035 - DNA, 20 bp, Artificial Sequence
  chemically synthesized
ctctgccttcaggcagctga

SEQ ID NO: 429036 - DNA, 20 bp, Artificial Sequence
  chemically synthesized
atacaagttcacagggccat

SEQ ID NO: 429037 - DNA, 20 bp, Artificial Sequence
  chemically synthesized
gcttcacatacaagttcaca

SEQ ID NO: 429038 - DNA, 20 bp, Artificial Sequence
  chemically synthesized
ggcttcacatacaagttcac

SEQ ID NO: 429039 - DNA, 20 bp, Artificial Sequence
  chemically synthesized
aggcttcacatacaagttca

SEQ ID NO: 429040 - DNA, 20 bp, Artificial Sequence
  chemically synthesized
gccctgtgaacttgtatgtg

SEQ ID NO: 429041 - DNA, 20 bp, Artificial Sequence
  chemically synthesized
cccagacaggcttcacatac

SEQ ID NO: 429042 - DNA, 20 bp, Artificial Sequence
  chemically synthesized
acttgtatgtgaagcctgtc

SEQ ID NO: 429043 - DNA, 20 bp, Artificial Sequence
  chemically synthesized
cttgtatgtgaagcctgtct

SEQ ID NO: 429044 - DNA, 20 bp, Artificial Sequence
  chemically synthesized
ttgtatgtgaagcctgtctg

SEQ ID NO: 429045 - DNA, 20 bp, Artificial Sequence
  chemically synthesized
gctagaatttgaccccagac

SEQ ID NO: 429046 - DNA, 20 bp, Artificial Sequence
  chemically synthesized
agctagaatttgaccccaga

SEQ ID NO: 429047 - DNA, 20 bp, Artificial Sequence
  chemically synthesized
gcagagctagaatttgaccc

SEQ ID NO: 429048 - DNA, 20 bp, Artificial Sequence
  chemically synthesized
gcctgtctggggtcaaattc

SEQ ID NO: 429049 - DNA, 20 bp, Artificial Sequence
  chemically synthesized
ctacaagtaagtggcagagc

SEQ ID NO: 429050 - DNA, 20 bp, Artificial Sequence
  chemically synthesized
aagactacaagtaagtggca

SEQ ID NO: 429051 - DNA, 20 bp, Artificial Sequence
  chemically synthesized
ctaagactacaagtaagtgg

SEQ ID NO: 429052 - DNA, 20 bp, Artificial Sequence
  chemically synthesized
tacctaagactacaagtaag

SEQ ID NO: 429053 - DNA, 20 bp, Artificial Sequence
  chemically synthesized
ctagctctgccacttacttg

SEQ ID NO: 429054 - DNA, 20 bp, Artificial Sequence
  chemically synthesized
acttacctaagactacaagt

SEQ ID NO: 429055 - DNA, 20 bp, Artificial Sequence
  chemically synthesized
ctgccacttacttgtagtct

SEQ ID NO: 429056 - DNA, 20 bp, Artificial Sequence
  chemically synthesized
agtaacttacctaagactac

SEQ ID NO: 429057 - DNA, 20 bp, Artificial Sequence
  chemically synthesized
tgccacttacttgtagtctt

SEQ ID NO: 429058 - DNA, 20 bp, Artificial Sequence
  chemically synthesized
acttacttgtagtcttaggt

SEQ ID NO: 429059 - DNA, 20 bp, Artificial Sequence
  chemically synthesized
aaaaattgagtaacttacct

SEQ ID NO: 429060 - DNA, 20 bp, Artificial Sequence
  chemically synthesized
attggagatcagaaaaaatt

SEQ ID NO: 429061 - DNA, 20 bp, Artificial Sequence
  chemically synthesized
taggcaatgaaattggagat

SEQ ID NO: 429062 - DNA, 20 bp, Artificial Sequence
  chemically synthesized
ttttataggcaatgaaattg

SEQ ID NO: 429063 - DNA, 20 bp, Artificial Sequence
  chemically synthesized
tcttttataggcaatgaaat

SEQ ID NO: 429064 - DNA, 20 bp, Artificial Sequence
  chemically synthesized
tccaatttcattgcctataa

SEQ ID NO: 429065 - DNA, 20 bp, Artificial Sequence
  chemically synthesized
caatttcattgcctataaaa

SEQ ID NO: 429066 - DNA, 20 bp, Artificial Sequence
  chemically synthesized
atacaccaattctcttttat

SEQ ID NO: 429067 - DNA, 20 bp, Artificial Sequence
  chemically synthesized
tatacaccaattctctttta

SEQ ID NO: 429068 - DNA, 20 bp, Artificial Sequence
  chemically synthesized
cattgcctataaaagagaat

SEQ ID NO: 429069 - DNA, 20 bp, Artificial Sequence
  chemically synthesized
ctgctttattgaggtatgat

SEQ ID NO: 429070 - DNA, 20 bp, Artificial Sequence
  chemically synthesized
atgccaatcatacctcaata

SEQ ID NO: 429071 - DNA, 20 bp, Artificial Sequence
  chemically synthesized
ttttttaaactgctttattg

SEQ ID NO: 429072 - DNA, 20 bp, Artificial Sequence
  chemically synthesized
ccaatcatacctcaataaag

SEQ ID NO: 429073 - DNA, 20 bp, Artificial Sequence
  chemically synthesized
gttttttaaactgctttatt

SEQ ID NO: 429074 - DNA, 20 bp, Artificial Sequence
  chemically synthesized
taaagcagtttaaaaaactg

SEQ ID NO: 429075 - DNA, 20 bp, Artificial Sequence
  chemically synthesized
ttcagaaataattgattctt

SEQ ID NO: 429076 - DNA, 20 bp, Artificial Sequence
  chemically synthesized
tgaagaatcaattatttctg

SEQ ID NO: 429077 - DNA, 20 bp, Artificial Sequence
  chemically synthesized
taccaattcttttttttctt

SEQ ID NO: 429078 - DNA, 20 bp, Artificial Sequence
  chemically synthesized
aattatttctgaagaaaaaa

SEQ ID NO: 429079 - DNA, 20 bp, Artificial Sequence
  chemically synthesized
ttctgaagaaaaaaaagaat

SEQ ID NO: 429080 - DNA, 20 bp, Artificial Sequence
  chemically synthesized
gaagaaaaaaaagaattggt

SEQ ID NO: 429081 - DNA, 20 bp, Artificial Sequence
  chemically synthesized
aattggtaagaactccttta

SEQ ID NO: 429082 - DNA, 20 bp, Artificial Sequence
  chemically synthesized
aattatcacacactataaag

SEQ ID NO: 429083 - DNA, 20 bp, Artificial Sequence
  chemically synthesized
ttaattatcacacactataa

SEQ ID NO: 429084 - DNA, 20 bp, Artificial Sequence
  chemically synthesized
tttaattatcacacactata

SEQ ID NO: 429085 - DNA, 20 bp, Artificial Sequence
  chemically synthesized
gataattaaataacaaaaac

SEQ ID NO: 429086 - DNA, 20 bp, Artificial Sequence
  chemically synthesized
aaataacaaaaactagaaca

SEQ ID NO: 429087 - DNA, 20 bp, Artificial Sequence
  chemically synthesized
ccatgcctgccactttgttc

SEQ ID NO: 429088 - DNA, 20 bp, Artificial Sequence
  chemically synthesized
taacaaaaactagaacaaag

SEQ ID NO: 429089 - DNA, 20 bp, Artificial Sequence
  chemically synthesized
caaaaactagaacaaagtgg

SEQ ID NO: 429090 - DNA, 20 bp, Artificial Sequence
  chemically synthesized
aaaaactagaacaaagtggc

SEQ ID NO: 429091 - DNA, 20 bp, Artificial Sequence
  chemically synthesized
ctagaacaaagtggcaggca

SEQ ID NO: 429092 - DNA, 20 bp, Artificial Sequence
  chemically synthesized
tagaacaaagtggcaggcat

SEQ ID NO: 429093 - DNA, 20 bp, Artificial Sequence
  chemically synthesized
aaagtggcaggcatgggaca

SEQ ID NO: 429094 - DNA, 20 bp, Artificial Sequence
  chemically synthesized
catgggacatggtccatatt

SEQ ID NO: 429095 - DNA, 20 bp, Artificial Sequence
  chemically synthesized
tgggacatggtccatattca

SEQ ID NO: 429096 - DNA, 20 bp, Artificial Sequence
  chemically synthesized
aaaacttttagctctgaata

SEQ ID NO: 429097 - DNA, 20 bp, Artificial Sequence
  chemically synthesized
tggtccatattcagagctaa

SEQ ID NO: 429098 - DNA, 20 bp, Artificial Sequence
  chemically synthesized
aaatagtgagagaaaacttt

SEQ ID NO: 429099 - DNA, 20 bp, Artificial Sequence
  chemically synthesized
taggaaaataaaaatagtga

SEQ ID NO: 429100 - DNA, 20 bp, Artificial Sequence
  chemically synthesized
tttaggaaaataaaaatagt

SEQ ID NO: 429101 - DNA, 20 bp, Artificial Sequence
  chemically synthesized
tcattttaggaaaataaaaa

SEQ ID NO: 429102 - DNA, 20 bp, Artificial Sequence
  chemically synthesized
tagaaatactagttcatttt

SEQ ID NO: 429103 - DNA, 20 bp, Artificial Sequence
  chemically synthesized
ctagaaatactagttcattt

SEQ ID NO: 429104 - DNA, 20 bp, Artificial Sequence
  chemically synthesized
tttattttcctaaaatgaac

SEQ ID NO: 429105 - DNA, 20 bp, Artificial Sequence
  chemically synthesized
ctaaaatgaactagtatttc

SEQ ID NO: 429106 - DNA, 20 bp, Artificial Sequence
  chemically synthesized
attgtatcttctagaaatac

SEQ ID NO: 429107 - DNA, 20 bp, Artificial Sequence
  chemically synthesized
aaatgaactagtatttctag

SEQ ID NO: 429108 - DNA, 20 bp, Artificial Sequence
  chemically synthesized
tttattctcattgtatcttc

SEQ ID NO: 429109 - DNA, 20 bp, Artificial Sequence
  chemically synthesized
gtatttctagaagatacaat

SEQ ID NO: 429110 - DNA, 20 bp, Artificial Sequence
  chemically synthesized
taaaagaaaatattttcaat

SEQ ID NO: 429111 - DNA, 20 bp, Artificial Sequence
  chemically synthesized
aaaatattttcttttaataa

SEQ ID NO: 429112 - DNA, 20 bp, Artificial Sequence
  chemically synthesized
ttttaaagcactgttattaa

SEQ ID NO: 429113 - DNA, 20 bp, Artificial Sequence
  chemically synthesized
taataacagtgctttaaaat

SEQ ID NO: 429114 - DNA, 20 bp, Artificial Sequence
  chemically synthesized
taatttttttgctaatttta

SEQ ID NO: 429115 - DNA, 20 bp, Artificial Sequence
  chemically synthesized
aattagcaaaaaaattaaaa

SEQ ID NO: 429116 - DNA, 20 bp, Artificial Sequence
  chemically synthesized
ttaaaatagaattttgaaaa

SEQ ID NO: 429117 - DNA, 20 bp, Artificial Sequence
  chemically synthesized
ttttgaaaaaagtaatcaaa

SEQ ID NO: 429118 - DNA, 20 bp, Artificial Sequence
  chemically synthesized
agaacatacagtcagtagta

SEQ ID NO: 429119 - DNA, 20 bp, Artificial Sequence
  chemically synthesized
tgtaaagaacatacagtcag

SEQ ID NO: 429120 - DNA, 20 bp, Artificial Sequence
  chemically synthesized
aaatgtaaagaacatacagt

SEQ ID NO: 429121 - DNA, 20 bp, Artificial Sequence
  chemically synthesized
atacaaatgtaaagaacata

SEQ ID NO: 429122 - DNA, 20 bp, Artificial Sequence
  chemically synthesized
aaacaaaacatacaaatgta

SEQ ID NO: 429123 - DNA, 20 bp, Artificial Sequence
  chemically synthesized
tatgttttgtttttatattt

SEQ ID NO: 429124 - DNA, 20 bp, Artificial Sequence
  chemically synthesized
ttttatattttggtattttt

SEQ ID NO: 429125 - DNA, 20 bp, Artificial Sequence
  chemically synthesized
ttggtatttttaagtattat

SEQ ID NO: 429126 - DNA, 20 bp, Artificial Sequence
  chemically synthesized
gtatttttaagtattattag

SEQ ID NO: 429127 - DNA, 20 bp, Artificial Sequence
  chemically synthesized
tatttttaagtattattagt

SEQ ID NO: 429128 - DNA, 20 bp, Artificial Sequence
  chemically synthesized
agtaggtgttcttaaacatt

SEQ ID NO: 429129 - DNA, 20 bp, Artificial Sequence
  chemically synthesized
aatatcttacctaaatgttt

SEQ ID NO: 429130 - DNA, 20 bp, Artificial Sequence
  chemically synthesized
gtaggtgttcttaaacattt

SEQ ID NO: 429131 - DNA, 20 bp, Artificial Sequence
  chemically synthesized
gtgttcttaaacatttaggt

SEQ ID NO: 429132 - DNA, 20 bp, Artificial Sequence
  chemically synthesized
catttaggtaagatattgta

SEQ ID NO: 429133 - DNA, 20 bp, Artificial Sequence
  chemically synthesized
gtaagatattgtatagttat

SEQ ID NO: 429134 - DNA, 20 bp, Artificial Sequence
  chemically synthesized
taataataataataatagta

SEQ ID NO: 429135 - DNA, 20 bp, Artificial Sequence
  chemically synthesized
aataataataataataataa

SEQ ID NO: 429136 - DNA, 20 bp, Artificial Sequence
  chemically synthesized
attattattattattattat

SEQ ID NO: 429137 - DNA, 20 bp, Artificial Sequence
  chemically synthesized
ttattattattattattaga

SEQ ID NO: 429138 - DNA, 20 bp, Artificial Sequence
  chemically synthesized
attattattattattagata

SEQ ID NO: 429139 - DNA, 20 bp, Artificial Sequence
  chemically synthesized
tccatcctgggcgacagagg

SEQ ID NO: 429140 - DNA, 20 bp, Artificial Sequence
  chemically synthesized
actccatcctgggcgacaga

SEQ ID NO: 429141 - DNA, 20 bp, Artificial Sequence
  chemically synthesized
cactccatcctgggcgacag

SEQ ID NO: 429142 - DNA, 20 bp, Artificial Sequence
  chemically synthesized
tagagtctccctctgtcgcc

SEQ ID NO: 429143 - DNA, 20 bp, Artificial Sequence
  chemically synthesized
gcactccatcctgggcgaca

SEQ ID NO: 429144 - DNA, 20 bp, Artificial Sequence
  chemically synthesized
agagtctccctctgtcgccc

SEQ ID NO: 429145 - DNA, 20 bp, Artificial Sequence
  chemically synthesized
ctgcactccatcctgggcga

SEQ ID NO: 429146 - DNA, 20 bp, Artificial Sequence
  chemically synthesized
tctccctctgtcgcccagga

SEQ ID NO: 429147 - DNA, 20 bp, Artificial Sequence
  chemically synthesized
tccctctgtcgcccaggatg

SEQ ID NO: 429148 - DNA, 20 bp, Artificial Sequence
  chemically synthesized
gggccactgcactccatcct

SEQ ID NO: 429149 - DNA, 20 bp, Artificial Sequence
  chemically synthesized
tgggccactgcactccatcc

SEQ ID NO: 429150 - DNA, 20 bp, Artificial Sequence
  chemically synthesized
ctgtcgcccaggatggagtg

SEQ ID NO: 429151 - DNA, 20 bp, Artificial Sequence
  chemically synthesized
tcgcccaggatggagtgcag

SEQ ID NO: 429152 - DNA, 20 bp, Artificial Sequence
  chemically synthesized
ggagtgcagtggcccaatct

SEQ ID NO: 429153 - DNA, 20 bp, Artificial Sequence
  chemically synthesized
ggttgcagtgagccaagatt

SEQ ID NO: 429154 - DNA, 20 bp, Artificial Sequence
  chemically synthesized
aggttgcagtgagccaagat

SEQ ID NO: 429155 - DNA, 20 bp, Artificial Sequence
  chemically synthesized
ggcagaggttgcagtgagcc

SEQ ID NO: 429156 - DNA, 20 bp, Artificial Sequence
  chemically synthesized
tgggaggcagaggttgcagt

SEQ ID NO: 429157 - DNA, 20 bp, Artificial Sequence
  chemically synthesized
aacctgggaggcagaggttg

SEQ ID NO: 429158 - DNA, 20 bp, Artificial Sequence
  chemically synthesized
cacttgaacctgggaggcag

SEQ ID NO: 429159 - DNA, 20 bp, Artificial Sequence
  chemically synthesized
tcactgcaacctctgcctcc

SEQ ID NO: 429160 - DNA, 20 bp, Artificial Sequence
  chemically synthesized
tcacttgaacctgggaggca

SEQ ID NO: 429161 - DNA, 20 bp, Artificial Sequence
  chemically synthesized
cactgcaacctctgcctccc

SEQ ID NO: 429162 - DNA, 20 bp, Artificial Sequence
  chemically synthesized
aatcacttgaacctgggagg

SEQ ID NO: 429163 - DNA, 20 bp, Artificial Sequence
  chemically synthesized
gagaatcacttgaacctggg

SEQ ID NO: 429164 - DNA, 20 bp, Artificial Sequence
  chemically synthesized
ggagaatcacttgaacctgg

SEQ ID NO: 429165 - DNA, 20 bp, Artificial Sequence
  chemically synthesized
aacctctgcctcccaggttc

SEQ ID NO: 429166 - DNA, 20 bp, Artificial Sequence
  chemically synthesized
caggagaatcacttgaacct

SEQ ID NO: 429167 - DNA, 20 bp, Artificial Sequence
  chemically synthesized
gcaggagaatcacttgaacc

SEQ ID NO: 429168 - DNA, 20 bp, Artificial Sequence
  chemically synthesized
ttcaagtgattctcctgcct

SEQ ID NO: 429169 - DNA, 20 bp, Artificial Sequence
  chemically synthesized
tacctgggaggctgaggcag

SEQ ID NO: 429170 - DNA, 20 bp, Artificial Sequence
  chemically synthesized
gctacctgggaggctgaggc

SEQ ID NO: 429171 - DNA, 20 bp, Artificial Sequence
  chemically synthesized
agctacctgggaggctgagg

SEQ ID NO: 429172 - DNA, 20 bp, Artificial Sequence
  chemically synthesized
cccagctacctgggaggctg

SEQ ID NO: 429173 - DNA, 20 bp, Artificial Sequence
  chemically synthesized
attctcctgcctcagcctcc

SEQ ID NO: 429174 - DNA, 20 bp, Artificial Sequence
  chemically synthesized
tcccagctacctgggaggct

SEQ ID NO: 429175 - DNA, 20 bp, Artificial Sequence
  chemically synthesized
ttctcctgcctcagcctccc

SEQ ID NO: 429176 - DNA, 20 bp, Artificial Sequence
  chemically synthesized
tcctgcctcagcctcccagg

SEQ ID NO: 429177 - DNA, 20 bp, Artificial Sequence
  chemically synthesized
tgtaatcccagctacctggg

SEQ ID NO: 429178 - DNA, 20 bp, Artificial Sequence
  chemically synthesized
ctgtaatcccagctacctgg

SEQ ID NO: 429179 - DNA, 20 bp, Artificial Sequence
  chemically synthesized
gcctcagcctcccaggtagc

SEQ ID NO: 429180 - DNA, 20 bp, Artificial Sequence
  chemically synthesized
ccctgtaatcccagctacct

SEQ ID NO: 429181 - DNA, 20 bp, Artificial Sequence
  chemically synthesized
cctcagcctcccaggtagct

SEQ ID NO: 429182 - DNA, 20 bp, Artificial Sequence
  chemically synthesized
tccctgtaatcccagctacc

SEQ ID NO: 429183 - DNA, 20 bp, Artificial Sequence
  chemically synthesized
ctcccaggtagctgggatta

SEQ ID NO: 429184 - DNA, 20 bp, Artificial Sequence
  chemically synthesized
tcccaggtagctgggattac

SEQ ID NO: 429185 - DNA, 20 bp, Artificial Sequence
  chemically synthesized
gtggtgggtccctgtaatcc

SEQ ID NO: 429186 - DNA, 20 bp, Artificial Sequence
  chemically synthesized
cccaggtagctgggattaca

SEQ ID NO: 429187 - DNA, 20 bp, Artificial Sequence
  chemically synthesized
gattacagggacccaccacc

SEQ ID NO: 429188 - DNA, 20 bp, Artificial Sequence
  chemically synthesized
aattagccagtcttggtggt

SEQ ID NO: 429189 - DNA, 20 bp, Artificial Sequence
  chemically synthesized
aaattagccagtcttggtgg

SEQ ID NO: 429190 - DNA, 20 bp, Artificial Sequence
  chemically synthesized
cagggacccaccaccaagac

SEQ ID NO: 429191 - DNA, 20 bp, Artificial Sequence
  chemically synthesized
aaaaaattagccagtcttgg

SEQ ID NO: 429192 - DNA, 20 bp, Artificial Sequence
  chemically synthesized
aaaaaaaaattagccagtct

SEQ ID NO: 429193 - DNA, 20 bp, Artificial Sequence
  chemically synthesized
aaatacaaaaaaaaattagc

SEQ ID NO: 429194 - DNA, 20 bp, Artificial Sequence
  chemically synthesized
ctaaaaatacaaaaaaaaat

SEQ ID NO: 429195 - DNA, 20 bp, Artificial Sequence
  chemically synthesized
ctaatttttttttgtatttt

SEQ ID NO: 429196 - DNA, 20 bp, Artificial Sequence
  chemically synthesized
atttttttttgtatttttag

SEQ ID NO: 429197 - DNA, 20 bp, Artificial Sequence
  chemically synthesized
ttttttttgtatttttagta

SEQ ID NO: 429198 - DNA, 20 bp, Artificial Sequence
  chemically synthesized
tttttgtatttttagtagag

SEQ ID NO: 429199 - DNA, 20 bp, Artificial Sequence
  chemically synthesized
ttttgtatttttagtagaga

SEQ ID NO: 429200 - DNA, 20 bp, Artificial Sequence
  chemically synthesized
tttgtatttttagtagagaa

SEQ ID NO: 429201 - DNA, 20 bp, Artificial Sequence
  chemically synthesized
ttgtatttttagtagagaag

SEQ ID NO: 429202 - DNA, 20 bp, Artificial Sequence
  chemically synthesized
gagaaggggtttcaccttgt

SEQ ID NO: 429203 - DNA, 20 bp, Artificial Sequence
  chemically synthesized
aggggtttcaccttgttggc

SEQ ID NO: 429204 - DNA, 20 bp, Artificial Sequence
  chemically synthesized
caagaccagcctggccaaca

SEQ ID NO: 429205 - DNA, 20 bp, Artificial Sequence
  chemically synthesized
ggggtttcaccttgttggcc

SEQ ID NO: 429206 - DNA, 20 bp, Artificial Sequence
  chemically synthesized
tcaagaccagcctggccaac

SEQ ID NO: 429207 - DNA, 20 bp, Artificial Sequence
  chemically synthesized
tttcaccttgttggccaggc

SEQ ID NO: 429208 - DNA, 20 bp, Artificial Sequence
  chemically synthesized
tgaagggttcaagaccagcc

SEQ ID NO: 429209 - DNA, 20 bp, Artificial Sequence
  chemically synthesized
tcaggtgaagggttcaagac

SEQ ID NO: 429210 - DNA, 20 bp, Artificial Sequence
  chemically synthesized
ttacctcaggtgaagggttc

SEQ ID NO: 429211 - DNA, 20 bp, Artificial Sequence
  chemically synthesized
tggtcttgaacccttcacct

SEQ ID NO: 429212 - DNA, 20 bp, Artificial Sequence
  chemically synthesized
ggcagattacctcaggtgaa

SEQ ID NO: 429213 - DNA, 20 bp, Artificial Sequence
  chemically synthesized
ggtcttgaacccttcacctg

SEQ ID NO: 429214 - DNA, 20 bp, Artificial Sequence
  chemically synthesized
aggcagattacctcaggtga

SEQ ID NO: 429215 - DNA, 20 bp, Artificial Sequence
  chemically synthesized
caggcagattacctcaggtg

SEQ ID NO: 429216 - DNA, 20 bp, Artificial Sequence
  chemically synthesized
caaggcaggcagattacctc

SEQ ID NO: 429217 - DNA, 20 bp, Artificial Sequence
  chemically synthesized
ccaaggcaggcagattacct

SEQ ID NO: 429218 - DNA, 20 bp, Artificial Sequence
  chemically synthesized
ctgaggtaatctgcctgcct

SEQ ID NO: 429219 - DNA, 20 bp, Artificial Sequence
  chemically synthesized
ttttgggaggccaaggcagg

SEQ ID NO: 429220 - DNA, 20 bp, Artificial Sequence
  chemically synthesized
gcattttgggaggccaaggc

SEQ ID NO: 429221 - DNA, 20 bp, Artificial Sequence
  chemically synthesized
agcattttgggaggccaagg

SEQ ID NO: 429222 - DNA, 20 bp, Artificial Sequence
  chemically synthesized
cccagcattttgggaggcca

SEQ ID NO: 429223 - DNA, 20 bp, Artificial Sequence
  chemically synthesized
tcccagcattttgggaggcc

SEQ ID NO: 429224 - DNA, 20 bp, Artificial Sequence
  chemically synthesized
tgtaatcccagcattttggg

SEQ ID NO: 429225 - DNA, 20 bp, Artificial Sequence
  chemically synthesized
ttgtaatcccagcattttgg

SEQ ID NO: 429226 - DNA, 20 bp, Artificial Sequence
  chemically synthesized
gccttggcctcccaaaatgc

SEQ ID NO: 429227 - DNA, 20 bp, Artificial Sequence
  chemically synthesized
acttgtaatcccagcatttt

SEQ ID NO: 429228 - DNA, 20 bp, Artificial Sequence
  chemically synthesized
ccttggcctcccaaaatgct

SEQ ID NO: 429229 - DNA, 20 bp, Artificial Sequence
  chemically synthesized
cacttgtaatcccagcattt

SEQ ID NO: 429230 - DNA, 20 bp, Artificial Sequence
  chemically synthesized
tcccaaaatgctgggattac

SEQ ID NO: 429231 - DNA, 20 bp, Artificial Sequence
  chemically synthesized
gtggctcacacttgtaatcc

SEQ ID NO: 429232 - DNA, 20 bp, Artificial Sequence
  chemically synthesized
aatgctgggattacaagtgt

SEQ ID NO: 429233 - DNA, 20 bp, Artificial Sequence
  chemically synthesized
caagtgtgagccactgtacc

SEQ ID NO: 429234 - DNA, 20 bp, Artificial Sequence
  chemically synthesized
ggaaagctggccaggtacag

SEQ ID NO: 429235 - DNA, 20 bp, Artificial Sequence
  chemically synthesized
ataggaaagctggccaggta

SEQ ID NO: 429236 - DNA, 20 bp, Artificial Sequence
  chemically synthesized
tgtgagccactgtacctggc

SEQ ID NO: 429237 - DNA, 20 bp, Artificial Sequence
  chemically synthesized
gaaaaataggaaagctggcc

SEQ ID NO: 429238 - DNA, 20 bp, Artificial Sequence
  chemically synthesized
agaaaaataggaaagctggc

SEQ ID NO: 429239 - DNA, 20 bp, Artificial Sequence
  chemically synthesized
cattagaaaaataggaaagc

SEQ ID NO: 429240 - DNA, 20 bp, Artificial Sequence
  chemically synthesized
ttctcattagaaaaatagga

SEQ ID NO: 429241 - DNA, 20 bp, Artificial Sequence
  chemically synthesized
tattttctcattagaaaaat

SEQ ID NO: 429242 - DNA, 20 bp, Artificial Sequence
  chemically synthesized
ctattttctcattagaaaaa

SEQ ID NO: 429243 - DNA, 20 bp, Artificial Sequence
  chemically synthesized
agctttcctatttttctaat

SEQ ID NO: 429244 - DNA, 20 bp, Artificial Sequence
  chemically synthesized
acaagctactattttctcat

SEQ ID NO: 429245 - DNA, 20 bp, Artificial Sequence
  chemically synthesized
ctatttttctaatgagaaaa

SEQ ID NO: 429246 - DNA, 20 bp, Artificial Sequence
  chemically synthesized
tttttctaatgagaaaatag

SEQ ID NO: 429247 - DNA, 20 bp, Artificial Sequence
  chemically synthesized
tgagaaaatagtagcttgtt

SEQ ID NO: 429248 - DNA, 20 bp, Artificial Sequence
  chemically synthesized
agaaaatagtagcttgttga

SEQ ID NO: 429249 - DNA, 20 bp, Artificial Sequence
  chemically synthesized
ctccgtgtgtggctctcaac

SEQ ID NO: 429250 - DNA, 20 bp, Artificial Sequence
  chemically synthesized
agcttgttgagagccacaca

SEQ ID NO: 429251 - DNA, 20 bp, Artificial Sequence
  chemically synthesized
cttgttgagagccacacacg

SEQ ID NO: 429252 - DNA, 20 bp, Artificial Sequence
  chemically synthesized
aaaatcacaaactccgtgtg

SEQ ID NO: 429253 - DNA, 20 bp, Artificial Sequence
  chemically synthesized
ttgtgatttttttttttctt

SEQ ID NO: 429254 - DNA, 20 bp, Artificial Sequence
  chemically synthesized
tgtgatttttttttttcttc

SEQ ID NO: 429255 - DNA, 20 bp, Artificial Sequence
  chemically synthesized
tataaatgcaacgtatcctg

SEQ ID NO: 429256 - DNA, 20 bp, Artificial Sequence
  chemically synthesized
gttgcatttatattgtatat

SEQ ID NO: 429257 - DNA, 20 bp, Artificial Sequence
  chemically synthesized
ttgtatatcagcgtgtatta

SEQ ID NO: 429258 - DNA, 20 bp, Artificial Sequence
  chemically synthesized
tcagcgtgtattaaagtgtg

SEQ ID NO: 429259 - DNA, 20 bp, Artificial Sequence
  chemically synthesized
gcgtgtattaaagtgtgtgg

SEQ ID NO: 429260 - DNA, 20 bp, Artificial Sequence
  chemically synthesized
taaagtgtgtggaagccctc

SEQ ID NO: 429261 - DNA, 20 bp, Artificial Sequence
  chemically synthesized
aagtgtgtggaagccctctg

SEQ ID NO: 429262 - DNA, 20 bp, Artificial Sequence
  chemically synthesized
cacatgtaaaaatctccaga

SEQ ID NO: 429263 - DNA, 20 bp, Artificial Sequence
  chemically synthesized
ccacatgtaaaaatctccag

SEQ ID NO: 429264 - DNA, 20 bp, Artificial Sequence
  chemically synthesized
tccacatgtaaaaatctcca

SEQ ID NO: 429265 - DNA, 20 bp, Artificial Sequence
  chemically synthesized
attccacatgtaaaaatctc

SEQ ID NO: 429266 - DNA, 20 bp, Artificial Sequence
  chemically synthesized
cctctggagatttttacatg

SEQ ID NO: 429267 - DNA, 20 bp, Artificial Sequence
  chemically synthesized
tttttacatgtggaatatac

SEQ ID NO: 429268 - DNA, 20 bp, Artificial Sequence
  chemically synthesized
tgtggaatatactagttact

SEQ ID NO: 429269 - DNA, 20 bp, Artificial Sequence
  chemically synthesized
acagagaattactaagtaac

SEQ ID NO: 429270 - DNA, 20 bp, Artificial Sequence
  chemically synthesized
cttgcctacagagaattact

SEQ ID NO: 429271 - DNA, 20 bp, Artificial Sequence
  chemically synthesized
agttacttagtaattctctg

SEQ ID NO: 429272 - DNA, 20 bp, Artificial Sequence
  chemically synthesized
gttacttagtaattctctgt

SEQ ID NO: 429273 - DNA, 20 bp, Artificial Sequence
  chemically synthesized
cttagtaattctctgtaggc

SEQ ID NO: 429274 - DNA, 20 bp, Artificial Sequence
  chemically synthesized
aacttagccgcttgcctaca

SEQ ID NO: 429275 - DNA, 20 bp, Artificial Sequence
  chemically synthesized
tgaacttagccgcttgccta

SEQ ID NO: 429276 - DNA, 20 bp, Artificial Sequence
  chemically synthesized
agtaattctctgtaggcaag

SEQ ID NO: 429277 - DNA, 20 bp, Artificial Sequence
  chemically synthesized
ttctctgtaggcaagcggct

SEQ ID NO: 429278 - DNA, 20 bp, Artificial Sequence
  chemically synthesized
tggttttccatacgtgaact

SEQ ID NO: 429279 - DNA, 20 bp, Artificial Sequence
  chemically synthesized
caagcggctaagttcacgta

SEQ ID NO: 429280 - DNA, 20 bp, Artificial Sequence
  chemically synthesized
ttcacgtatggaaaaccatt

SEQ ID NO: 429281 - DNA, 20 bp, Artificial Sequence
  chemically synthesized
gttacagcaatgggtcttaa

SEQ ID NO: 429282 - DNA, 20 bp, Artificial Sequence
  chemically synthesized
cttgtctgtgttacagcaat

SEQ ID NO: 429283 - DNA, 20 bp, Artificial Sequence
  chemically synthesized
ccttgtctgtgttacagcaa

SEQ ID NO: 429284 - DNA, 20 bp, Artificial Sequence
  chemically synthesized
taagacccattgctgtaaca

SEQ ID NO: 429285 - DNA, 20 bp, Artificial Sequence
  chemically synthesized
taatacccttgtctgtgtta

SEQ ID NO: 429286 - DNA, 20 bp, Artificial Sequence
  chemically synthesized
cccattgctgtaacacagac

SEQ ID NO: 429287 - DNA, 20 bp, Artificial Sequence
  chemically synthesized
ccattgctgtaacacagaca

SEQ ID NO: 429288 - DNA, 20 bp, Artificial Sequence
  chemically synthesized
cattgctgtaacacagacaa

SEQ ID NO: 429289 - DNA, 20 bp, Artificial Sequence
  chemically synthesized
cagacaagggtattactgtt

SEQ ID NO: 429290 - DNA, 20 bp, Artificial Sequence
  chemically synthesized
taaaatggcaatacacttaa

SEQ ID NO: 429291 - DNA, 20 bp, Artificial Sequence
  chemically synthesized
ttaagtgtattgccatttta

SEQ ID NO: 429292 - DNA, 20 bp, Artificial Sequence
  chemically synthesized
cgtttggaatgaccataaaa

SEQ ID NO: 429293 - DNA, 20 bp, Artificial Sequence
  chemically synthesized
attttatggtcattccaaac

SEQ ID NO: 429294 - DNA, 20 bp, Artificial Sequence
  chemically synthesized
atgaagcagcttttctcgtt

SEQ ID NO: 429295 - DNA, 20 bp, Artificial Sequence
  chemically synthesized
atggtcattccaaacgagaa

SEQ ID NO: 429296 - DNA, 20 bp, Artificial Sequence
  chemically synthesized
atatgattcctggaatgaag

SEQ ID NO: 429297 - DNA, 20 bp, Artificial Sequence
  chemically synthesized
cgagaaaagctgcttcattc

SEQ ID NO: 429298 - DNA, 20 bp, Artificial Sequence
  chemically synthesized
gagaaaagctgcttcattcc

SEQ ID NO: 429299 - DNA, 20 bp, Artificial Sequence
  chemically synthesized
gcaatatgattcctggaatg

SEQ ID NO: 429300 - DNA, 20 bp, Artificial Sequence
  chemically synthesized
tataatagcaatatgattcc

SEQ ID NO: 429301 - DNA, 20 bp, Artificial Sequence
  chemically synthesized
ggttttctggtgaattataa

SEQ ID NO: 429302 - DNA, 20 bp, Artificial Sequence
  chemically synthesized
atattgctattataattcac

SEQ ID NO: 429303 - DNA, 20 bp, Artificial Sequence
  chemically synthesized
aaaagaaagtgtaggttttc

SEQ ID NO: 429304 - DNA, 20 bp, Artificial Sequence
  chemically synthesized
attggaggaaaagaaagtgt

SEQ ID NO: 429305 - DNA, 20 bp, Artificial Sequence
  chemically synthesized
tattggaggaaaagaaagtg

SEQ ID NO: 429306 - DNA, 20 bp, Artificial Sequence
  chemically synthesized
ctgtctattggaggaaaaga

SEQ ID NO: 429307 - DNA, 20 bp, Artificial Sequence
  chemically synthesized
gtgactgtctattggaggaa

SEQ ID NO: 429308 - DNA, 20 bp, Artificial Sequence
  chemically synthesized
tacactttcttttcctccaa

SEQ ID NO: 429309 - DNA, 20 bp, Artificial Sequence
  chemically synthesized
tttaagtgactgtctattgg

SEQ ID NO: 429310 - DNA, 20 bp, Artificial Sequence
  chemically synthesized
ctttcttttcctccaataga

SEQ ID NO: 429311 - DNA, 20 bp, Artificial Sequence
  chemically synthesized
ctttaagtgactgtctattg

SEQ ID NO: 429312 - DNA, 20 bp, Artificial Sequence
  chemically synthesized
tgctttaagtgactgtctat

SEQ ID NO: 429313 - DNA, 20 bp, Artificial Sequence
  chemically synthesized
ctccaatagacagtcactta

SEQ ID NO: 429314 - DNA, 20 bp, Artificial Sequence
  chemically synthesized
tttttttgtacatttgcttt

SEQ ID NO: 429315 - DNA, 20 bp, Artificial Sequence
  chemically synthesized
aatgtacaaaaaaaatacaa

SEQ ID NO: 429316 - DNA, 20 bp, Artificial Sequence
  chemically synthesized
aaaaaaaatacaatggaata

SEQ ID NO: 429317 - DNA, 20 bp, Artificial Sequence
  chemically synthesized
aaatacaatggaatatggtt

SEQ ID NO: 429318 - DNA, 20 bp, Artificial Sequence
  chemically synthesized
aatacaatggaatatggttt

SEQ ID NO: 429319 - DNA, 20 bp, Artificial Sequence
  chemically synthesized
ggaattaatgaaaatttaaa

SEQ ID NO: 429320 - DNA, 20 bp, Artificial Sequence
  chemically synthesized
attaatgaaaatttaaaaag

SEQ ID NO: 429321 - DNA, 20 bp, Artificial Sequence
  chemically synthesized
taaaaagcagcaatcccatt

SEQ ID NO: 429322 - DNA, 20 bp, Artificial Sequence
  chemically synthesized
aaagcagcaatcccattgag

SEQ ID NO: 429323 - DNA, 20 bp, Artificial Sequence
  chemically synthesized
ttgccttctgtcttctcaat

SEQ ID NO: 429324 - DNA, 20 bp, Artificial Sequence
  chemically synthesized
attgccttctgtcttctcaa

SEQ ID NO: 429325 - DNA, 20 bp, Artificial Sequence
  chemically synthesized
cagcaatcccattgagaaga

SEQ ID NO: 429326 - DNA, 20 bp, Artificial Sequence
  chemically synthesized
caatcccattgagaagacag

SEQ ID NO: 429327 - DNA, 20 bp, Artificial Sequence
  chemically synthesized
aatcccattgagaagacaga

SEQ ID NO: 429328 - DNA, 20 bp, Artificial Sequence
  chemically synthesized
ggcaatacattttaaaaact

SEQ ID NO: 429329 - DNA, 20 bp, Artificial Sequence
  chemically synthesized
attttcccttgcataatgct

SEQ ID NO: 429330 - DNA, 20 bp, Artificial Sequence
  chemically synthesized
ttaaaaactgagcattatgc

SEQ ID NO: 429331 - DNA, 20 bp, Artificial Sequence
  chemically synthesized
taaaaactgagcattatgca

SEQ ID NO: 429332 - DNA, 20 bp, Artificial Sequence
  chemically synthesized
aaaaactgagcattatgcaa

SEQ ID NO: 429333 - DNA, 20 bp, Artificial Sequence
  chemically synthesized
cattatgcaagggaaaattt

SEQ ID NO: 429334 - DNA, 20 bp, Artificial Sequence
  chemically synthesized
tatgcaagggaaaatttgag

SEQ ID NO: 429335 - DNA, 20 bp, Artificial Sequence
  chemically synthesized
ggaaaatttgagcagttttc

SEQ ID NO: 429336 - DNA, 20 bp, Artificial Sequence
  chemically synthesized
aatttgagcagttttcaagt

SEQ ID NO: 429337 - DNA, 20 bp, Artificial Sequence
  chemically synthesized
atttgttaatgagaacaata

SEQ ID NO: 429338 - DNA, 20 bp, Artificial Sequence
  chemically synthesized
caccatctacatttgttaat

SEQ ID NO: 429339 - DNA, 20 bp, Artificial Sequence
  chemically synthesized
attgttctcattaacaaatg

SEQ ID NO: 429340 - DNA, 20 bp, Artificial Sequence
  chemically synthesized
ttctcattaacaaatgtaga

SEQ ID NO: 429341 - DNA, 20 bp, Artificial Sequence
  chemically synthesized
attaacaaatgtagatggtg

SEQ ID NO: 429342 - DNA, 20 bp, Artificial Sequence
  chemically synthesized
agatggtgcagcatttacta

SEQ ID NO: 429343 - DNA, 20 bp, Artificial Sequence
  chemically synthesized
aagtctgaatcaattgtctg

SEQ ID NO: 429344 - DNA, 20 bp, Artificial Sequence
  chemically synthesized
tttactacagacaattgatt

SEQ ID NO: 429345 - DNA, 20 bp, Artificial Sequence
  chemically synthesized
ttgattcagacttaaacttt

SEQ ID NO: 429346 - DNA, 20 bp, Artificial Sequence
  chemically synthesized
gatttgtagcccaaaagttt

SEQ ID NO: 429347 - DNA, 20 bp, Artificial Sequence
  chemically synthesized
tgattcagacttaaactttt

SEQ ID NO: 429348 - DNA, 20 bp, Artificial Sequence
  chemically synthesized
ataaatgatttgtagcccaa

SEQ ID NO: 429349 - DNA, 20 bp, Artificial Sequence
  chemically synthesized
tctgaaatataaatgatttg

SEQ ID NO: 429350 - DNA, 20 bp, Artificial Sequence
  chemically synthesized
gctacaaatcatttatattt

SEQ ID NO: 429351 - DNA, 20 bp, Artificial Sequence
  chemically synthesized
tacaaatcatttatatttca

SEQ ID NO: 429352 - DNA, 20 bp, Artificial Sequence
  chemically synthesized
tatttcagagaaaaaatatg

SEQ ID NO: 429353 - DNA, 20 bp, Artificial Sequence
  chemically synthesized
aatatgtggtcaaaaacaac

SEQ ID NO: 429354 - DNA, 20 bp, Artificial Sequence
  chemically synthesized
atatgtggtcaaaaacaact

SEQ ID NO: 429355 - DNA, 20 bp, Artificial Sequence
  chemically synthesized
tgtggtcaaaaacaactagg

SEQ ID NO: 429356 - DNA, 20 bp, Artificial Sequence
  chemically synthesized
gtggtcaaaaacaactaggc

SEQ ID NO: 429357 - DNA, 20 bp, Artificial Sequence
  chemically synthesized
tggtcaaaaacaactaggca

SEQ ID NO: 429358 - DNA, 20 bp, Artificial Sequence
  chemically synthesized
ggtcaaaaacaactaggcag

SEQ ID NO: 429359 - DNA, 20 bp, Artificial Sequence
  chemically synthesized
gtcaaaaacaactaggcagg

SEQ ID NO: 429360 - DNA, 20 bp, Artificial Sequence
  chemically synthesized
gtgagccaacgccccctgcc

SEQ ID NO: 429361 - DNA, 20 bp, Artificial Sequence
  chemically synthesized
aacaactaggcagggggcgt

SEQ ID NO: 429362 - DNA, 20 bp, Artificial Sequence
  chemically synthesized
agttctgggattacaggcgt

SEQ ID NO: 429363 - DNA, 20 bp, Artificial Sequence
  chemically synthesized
ttggctcacgcctgtaatcc

SEQ ID NO: 429364 - DNA, 20 bp, Artificial Sequence
  chemically synthesized
tcccaaagttctgggattac

SEQ ID NO: 429365 - DNA, 20 bp, Artificial Sequence
  chemically synthesized
ctcccaaagttctgggatta

SEQ ID NO: 429366 - DNA, 20 bp, Artificial Sequence
  chemically synthesized
cgcctgtaatcccagaactt

SEQ ID NO: 429367 - DNA, 20 bp, Artificial Sequence
  chemically synthesized
cctcggcctcccaaagttct

SEQ ID NO: 429368 - DNA, 20 bp, Artificial Sequence
  chemically synthesized
gcctgtaatcccagaacttt

SEQ ID NO: 429369 - DNA, 20 bp, Artificial Sequence
  chemically synthesized
gcctcggcctcccaaagttc

SEQ ID NO: 429370 - DNA, 20 bp, Artificial Sequence
  chemically synthesized
ctgtaatcccagaactttgg

SEQ ID NO: 429371 - DNA, 20 bp, Artificial Sequence
  chemically synthesized
tgtaatcccagaactttggg

SEQ ID NO: 429372 - DNA, 20 bp, Artificial Sequence
  chemically synthesized
ccgcctgcctcggcctccca

SEQ ID NO: 429373 - DNA, 20 bp, Artificial Sequence
  chemically synthesized
tcccagaactttgggaggcc

SEQ ID NO: 429374 - DNA, 20 bp, Artificial Sequence
  chemically synthesized
cccagaactttgggaggccg

SEQ ID NO: 429375 - DNA, 20 bp, Artificial Sequence
  chemically synthesized
agaactttgggaggccgagg

SEQ ID NO: 429376 - DNA, 20 bp, Artificial Sequence
  chemically synthesized
gaactttgggaggccgaggc

SEQ ID NO: 429377 - DNA, 20 bp, Artificial Sequence
  chemically synthesized
ctttgggaggccgaggcagg

SEQ ID NO: 429378 - DNA, 20 bp, Artificial Sequence
  chemically synthesized
cttaggtgatccgcctgcct

SEQ ID NO: 429379 - DNA, 20 bp, Artificial Sequence
  chemically synthesized
ccgaggcaggcggatcacct

SEQ ID NO: 429380 - DNA, 20 bp, Artificial Sequence
  chemically synthesized
cgaggcaggcggatcaccta

SEQ ID NO: 429381 - DNA, 20 bp, Artificial Sequence
  chemically synthesized
gcaggcggatcacctaaggt

SEQ ID NO: 429382 - DNA, 20 bp, Artificial Sequence
  chemically synthesized
caggcggatcacctaaggtt

SEQ ID NO: 429383 - DNA, 20 bp, Artificial Sequence
  chemically synthesized
ggtcttaaactcccaacctt

SEQ ID NO: 429384 - DNA, 20 bp, Artificial Sequence
  chemically synthesized
ggcggatcacctaaggttgg

SEQ ID NO: 429385 - DNA, 20 bp, Artificial Sequence
  chemically synthesized
tggtcttaaactcccaacct

SEQ ID NO: 429386 - DNA, 20 bp, Artificial Sequence
  chemically synthesized
tcacctaaggttgggagttt

SEQ ID NO: 429387 - DNA, 20 bp, Artificial Sequence
  chemically synthesized
taaggttgggagtttaagac

SEQ ID NO: 429388 - DNA, 20 bp, Artificial Sequence
  chemically synthesized
tttctccatgttggtcaggc

SEQ ID NO: 429389 - DNA, 20 bp, Artificial Sequence
  chemically synthesized
ggggtttctccatgttggtc

SEQ ID NO: 429390 - DNA, 20 bp, Artificial Sequence
  chemically synthesized
taagaccagcctgaccaaca

SEQ ID NO: 429391 - DNA, 20 bp, Artificial Sequence
  chemically synthesized
cggggtttctccatgttggt

SEQ ID NO: 429392 - DNA, 20 bp, Artificial Sequence
  chemically synthesized
agaccagcctgaccaacatg

SEQ ID NO: 429393 - DNA, 20 bp, Artificial Sequence
  chemically synthesized
gaaacggggtttctccatgt

SEQ ID NO: 429394 - DNA, 20 bp, Artificial Sequence
  chemically synthesized
ttgtatttttaatagaaacg

SEQ ID NO: 429395 - DNA, 20 bp, Artificial Sequence
  chemically synthesized
tttgtatttttaatagaaac

SEQ ID NO: 429396 - DNA, 20 bp, Artificial Sequence
  chemically synthesized
ctttgtatttttaatagaaa

SEQ ID NO: 429397 - DNA, 20 bp, Artificial Sequence
  chemically synthesized
ggctaactttgtatttttaa

SEQ ID NO: 429398 - DNA, 20 bp, Artificial Sequence
  chemically synthesized
ccgtttctattaaaaataca

SEQ ID NO: 429399 - DNA, 20 bp, Artificial Sequence
  chemically synthesized
ttctattaaaaatacaaagt

SEQ ID NO: 429400 - DNA, 20 bp, Artificial Sequence
  chemically synthesized
attaaaaatacaaagttagc

SEQ ID NO: 429401 - DNA, 20 bp, Artificial Sequence
  chemically synthesized
ttaaaaatacaaagttagcc

SEQ ID NO: 429402 - DNA, 20 bp, Artificial Sequence
  chemically synthesized
aatacaaagttagccgggca

SEQ ID NO: 429403 - DNA, 20 bp, Artificial Sequence
  chemically synthesized
acaaagttagccgggcatgg

SEQ ID NO: 429404 - DNA, 20 bp, Artificial Sequence
  chemically synthesized
aggcaatgcactaccatgcc

SEQ ID NO: 429405 - DNA, 20 bp, Artificial Sequence
  chemically synthesized
tagtgcattgcctataatcc

SEQ ID NO: 429406 - DNA, 20 bp, Artificial Sequence
  chemically synthesized
tcccaagtagctgggattat

SEQ ID NO: 429407 - DNA, 20 bp, Artificial Sequence
  chemically synthesized
ctcccaagtagctgggatta

SEQ ID NO: 429408 - DNA, 20 bp, Artificial Sequence
  chemically synthesized
tgcctataatcccagctact

SEQ ID NO: 429409 - DNA, 20 bp, Artificial Sequence
  chemically synthesized
cctcagcctcccaagtagct

SEQ ID NO: 429410 - DNA, 20 bp, Artificial Sequence
  chemically synthesized
gcctataatcccagctactt

SEQ ID NO: 429411 - DNA, 20 bp, Artificial Sequence
  chemically synthesized
gcctcagcctcccaagtagc

SEQ ID NO: 429412 - DNA, 20 bp, Artificial Sequence
  chemically synthesized
ctataatcccagctacttgg

SEQ ID NO: 429413 - DNA, 20 bp, Artificial Sequence
  chemically synthesized
tataatcccagctacttggg

SEQ ID NO: 429414 - DNA, 20 bp, Artificial Sequence
  chemically synthesized
tcctgcctcagcctcccaag

SEQ ID NO: 429415 - DNA, 20 bp, Artificial Sequence
  chemically synthesized
ttctcctgcctcagcctccc

SEQ ID NO: 429416 - DNA, 20 bp, Artificial Sequence
  chemically synthesized
tcccagctacttgggaggct

SEQ ID NO: 429417 - DNA, 20 bp, Artificial Sequence
  chemically synthesized
cccagctacttgggaggctg

SEQ ID NO: 429418 - DNA, 20 bp, Artificial Sequence
  chemically synthesized
agctacttgggaggctgagg

SEQ ID NO: 429419 - DNA, 20 bp, Artificial Sequence
  chemically synthesized
gctacttgggaggctgaggc

SEQ ID NO: 429420 - DNA, 20 bp, Artificial Sequence
  chemically synthesized
tacttgggaggctgaggcag

SEQ ID NO: 429421 - DNA, 20 bp, Artificial Sequence
  chemically synthesized
ttcaagtgattctcctgcct

SEQ ID NO: 429422 - DNA, 20 bp, Artificial Sequence
  chemically synthesized
gcaggagaatcacttgaacc

SEQ ID NO: 429423 - DNA, 20 bp, Artificial Sequence
  chemically synthesized
caggagaatcacttgaaccc

SEQ ID NO: 429424 - DNA, 20 bp, Artificial Sequence
  chemically synthesized
aacctccacctcctgggttc

SEQ ID NO: 429425 - DNA, 20 bp, Artificial Sequence
  chemically synthesized
ggagaatcacttgaacccag

SEQ ID NO: 429426 - DNA, 20 bp, Artificial Sequence
  chemically synthesized
gagaatcacttgaacccagg

SEQ ID NO: 429427 - DNA, 20 bp, Artificial Sequence
  chemically synthesized
aatcacttgaacccaggagg

SEQ ID NO: 429428 - DNA, 20 bp, Artificial Sequence
  chemically synthesized
ctccgcaacctccacctcct

SEQ ID NO: 429429 - DNA, 20 bp, Artificial Sequence
  chemically synthesized
tcacttgaacccaggaggtg

SEQ ID NO: 429430 - DNA, 20 bp, Artificial Sequence
  chemically synthesized
tctccgcaacctccacctcc

SEQ ID NO: 429431 - DNA, 20 bp, Artificial Sequence
  chemically synthesized
cacttgaacccaggaggtgg

SEQ ID NO: 429432 - DNA, 20 bp, Artificial Sequence
  chemically synthesized
aacccaggaggtggaggttg

SEQ ID NO: 429433 - DNA, 20 bp, Artificial Sequence
  chemically synthesized
cccaggaggtggaggttgcg

SEQ ID NO: 429434 - DNA, 20 bp, Artificial Sequence
  chemically synthesized
caggaggtggaggttgcgga

SEQ ID NO: 429435 - DNA, 20 bp, Artificial Sequence
  chemically synthesized
ggtggaggttgcggagagcc

SEQ ID NO: 429436 - DNA, 20 bp, Artificial Sequence
  chemically synthesized
ggagtgcaatggcacgatct

SEQ ID NO: 429437 - DNA, 20 bp, Artificial Sequence
  chemically synthesized
ttgcccaggctggagtgcaa

SEQ ID NO: 429438 - DNA, 20 bp, Artificial Sequence
  chemically synthesized
gagatcgtgccattgcactc

SEQ ID NO: 429439 - DNA, 20 bp, Artificial Sequence
  chemically synthesized
cgtgccattgcactccagcc

SEQ ID NO: 429440 - DNA, 20 bp, Artificial Sequence
  chemically synthesized
gtgccattgcactccagcct

SEQ ID NO: 429441 - DNA, 20 bp, Artificial Sequence
  chemically synthesized
cactcttgttgcccaggctg

SEQ ID NO: 429442 - DNA, 20 bp, Artificial Sequence
  chemically synthesized
ttcactcttgttgcccaggc

SEQ ID NO: 429443 - DNA, 20 bp, Artificial Sequence
  chemically synthesized
tgcactccagcctgggcaac

SEQ ID NO: 429444 - DNA, 20 bp, Artificial Sequence
  chemically synthesized
gagtttcactcttgttgccc

SEQ ID NO: 429445 - DNA, 20 bp, Artificial Sequence
  chemically synthesized
cgagtttcactcttgttgcc

SEQ ID NO: 429446 - DNA, 20 bp, Artificial Sequence
  chemically synthesized
cactccagcctgggcaacaa

SEQ ID NO: 429447 - DNA, 20 bp, Artificial Sequence
  chemically synthesized
tgggcaacaagagtgaaact

SEQ ID NO: 429448 - DNA, 20 bp, Artificial Sequence
  chemically synthesized
tgtttgtttgttttgagacc

SEQ ID NO: 429449 - DNA, 20 bp, Artificial Sequence
  chemically synthesized
tttgtttgtttgtttgtttt

SEQ ID NO: 429450 - DNA, 20 bp, Artificial Sequence
  chemically synthesized
aatgtctcttgtgggaaata

SEQ ID NO: 429451 - DNA, 20 bp, Artificial Sequence
  chemically synthesized
aacaaaactgtatttcccac

SEQ ID NO: 429452 - DNA, 20 bp, Artificial Sequence
  chemically synthesized
caaaactgtatttcccacaa

SEQ ID NO: 429453 - DNA, 20 bp, Artificial Sequence
  chemically synthesized
aatagtttaatgtctcttgt

SEQ ID NO: 429454 - DNA, 20 bp, Artificial Sequence
  chemically synthesized
aaatagtttaatgtctcttg

SEQ ID NO: 429455 - DNA, 20 bp, Artificial Sequence
  chemically synthesized
gtagtaaataaaaacaaaaa

SEQ ID NO: 429456 - DNA, 20 bp, Artificial Sequence
  chemically synthesized
aaaattgcgtaacattaagg

SEQ ID NO: 429457 - DNA, 20 bp, Artificial Sequence
  chemically synthesized
tgaaaaattgcgtaacatta

SEQ ID NO: 429458 - DNA, 20 bp, Artificial Sequence
  chemically synthesized
ttgaaaaattgcgtaacatt

SEQ ID NO: 429459 - DNA, 20 bp, Artificial Sequence
  chemically synthesized
aatgttacgcaatttttcaa

SEQ ID NO: 429460 - DNA, 20 bp, Artificial Sequence
  chemically synthesized
caaaagaaaatataatactg

SEQ ID NO: 429461 - DNA, 20 bp, Artificial Sequence
  chemically synthesized
ttttaaattttttacgtcta

SEQ ID NO: 429462 - DNA, 20 bp, Artificial Sequence
  chemically synthesized
aatttaaaacgtatgaaaac

SEQ ID NO: 429463 - DNA, 20 bp, Artificial Sequence
  chemically synthesized
atttaaaacgtatgaaaact

SEQ ID NO: 429464 - DNA, 20 bp, Artificial Sequence
  chemically synthesized
ttaagataattgatatatcc

SEQ ID NO: 429465 - DNA, 20 bp, Artificial Sequence
  chemically synthesized
gggatatatcaattatctta

SEQ ID NO: 429466 - DNA, 20 bp, Artificial Sequence
  chemically synthesized
atatatcaattatcttaaag

SEQ ID NO: 429467 - DNA, 20 bp, Artificial Sequence
  chemically synthesized
gtttcaggaatatcttcttt

SEQ ID NO: 429468 - DNA, 20 bp, Artificial Sequence
  chemically synthesized
ttaaatcttaagtatgtttc

SEQ ID NO: 429469 - DNA, 20 bp, Artificial Sequence
  chemically synthesized
attaaatcttaagtatgttt

SEQ ID NO: 429470 - DNA, 20 bp, Artificial Sequence
  chemically synthesized
gatattcctgaaacatactt

SEQ ID NO: 429471 - DNA, 20 bp, Artificial Sequence
  chemically synthesized
atatttcaatattaaatctt

SEQ ID NO: 429472 - DNA, 20 bp, Artificial Sequence
  chemically synthesized
aatacattaaatattgttta

SEQ ID NO: 429473 - DNA, 20 bp, Artificial Sequence
  chemically synthesized
gtttaaagaaattctgttaa

SEQ ID NO: 429474 - DNA, 20 bp, Artificial Sequence
  chemically synthesized
atgtgccccacagcttttaa

SEQ ID NO: 429475 - DNA, 20 bp, Artificial Sequence
  chemically synthesized
agaaattctgttaaaagctg

SEQ ID NO: 429476 - DNA, 20 bp, Artificial Sequence
  chemically synthesized
gaaattctgttaaaagctgt

SEQ ID NO: 429477 - DNA, 20 bp, Artificial Sequence
  chemically synthesized
aaattctgttaaaagctgtg

SEQ ID NO: 429478 - DNA, 20 bp, Artificial Sequence
  chemically synthesized
tgccttcataatgtgcccca

SEQ ID NO: 429479 - DNA, 20 bp, Artificial Sequence
  chemically synthesized
aagctgtggggcacattatg

SEQ ID NO: 429480 - DNA, 20 bp, Artificial Sequence
  chemically synthesized
agctgtggggcacattatga

SEQ ID NO: 429481 - DNA, 20 bp, Artificial Sequence
  chemically synthesized
tataacaaaggtaaagaagt

SEQ ID NO: 429482 - DNA, 20 bp, Artificial Sequence
  chemically synthesized
attttataacaaaggtaaag

SEQ ID NO: 429483 - DNA, 20 bp, Artificial Sequence
  chemically synthesized
ttaattttataacaaaggta

SEQ ID NO: 429484 - DNA, 20 bp, Artificial Sequence
  chemically synthesized
caaaattaattttataacaa

SEQ ID NO: 429485 - DNA, 20 bp, Artificial Sequence
  chemically synthesized
acaaaattaattttataaca

SEQ ID NO: 429486 - DNA, 20 bp, Artificial Sequence
  chemically synthesized
cttgattgatgaaaaattga

SEQ ID NO: 429487 - DNA, 20 bp, Artificial Sequence
  chemically synthesized
ccatcaatttttcatcaatc

SEQ ID NO: 429488 - DNA, 20 bp, Artificial Sequence
  chemically synthesized
catcaatttttcatcaatca

SEQ ID NO: 429489 - DNA, 20 bp, Artificial Sequence
  chemically synthesized
gatttgaattttcaagtgta

SEQ ID NO: 429490 - DNA, 20 bp, Artificial Sequence
  chemically synthesized
ccctgtggatttgaattttc

SEQ ID NO: 429491 - DNA, 20 bp, Artificial Sequence
  chemically synthesized
cacttgaaaattcaaatcca

SEQ ID NO: 429492 - DNA, 20 bp, Artificial Sequence
  chemically synthesized
acttgaaaattcaaatccac

SEQ ID NO: 429493 - DNA, 20 bp, Artificial Sequence
  chemically synthesized
cttgaaaattcaaatccaca

SEQ ID NO: 429494 - DNA, 20 bp, Artificial Sequence
  chemically synthesized
ctatcttttcaagatccctg

SEQ ID NO: 429495 - DNA, 20 bp, Artificial Sequence
  chemically synthesized
aaatccacagggatcttgaa

SEQ ID NO: 429496 - DNA, 20 bp, Artificial Sequence
  chemically synthesized
ccacagggatcttgaaaaga

SEQ ID NO: 429497 - DNA, 20 bp, Artificial Sequence
  chemically synthesized
actatctatgctatcttttc

SEQ ID NO: 429498 - DNA, 20 bp, Artificial Sequence
  chemically synthesized
gggatcttgaaaagatagca

SEQ ID NO: 429499 - DNA, 20 bp, Artificial Sequence
  chemically synthesized
tcttgaaaagatagcataga

SEQ ID NO: 429500 - DNA, 20 bp, Artificial Sequence
  chemically synthesized
ttttcatctattaaaagaga

SEQ ID NO: 429501 - DNA, 20 bp, Artificial Sequence
  chemically synthesized
atagtatctttctcttttaa

SEQ ID NO: 429502 - DNA, 20 bp, Artificial Sequence
  chemically synthesized
ttgtttttcatctattaaaa

SEQ ID NO: 429503 - DNA, 20 bp, Artificial Sequence
  chemically synthesized
agttgtttttcatctattaa

SEQ ID NO: 429504 - DNA, 20 bp, Artificial Sequence
  chemically synthesized
taatagatgaaaaacaactg

SEQ ID NO: 429505 - DNA, 20 bp, Artificial Sequence
  chemically synthesized
agatgaaaaacaactgcaga

SEQ ID NO: 429506 - DNA, 20 bp, Artificial Sequence
  chemically synthesized
gatgaaaaacaactgcagaa

SEQ ID NO: 429507 - DNA, 20 bp, Artificial Sequence
  chemically synthesized
aagatgtctgtgcctttctg

SEQ ID NO: 429508 - DNA, 20 bp, Artificial Sequence
  chemically synthesized
aaaacaactgcagaaaggca

SEQ ID NO: 429509 - DNA, 20 bp, Artificial Sequence
  chemically synthesized
cagaaaggcacagacatctt

SEQ ID NO: 429510 - DNA, 20 bp, Artificial Sequence
  chemically synthesized
gtatgacttatttagtactg

SEQ ID NO: 429511 - DNA, 20 bp, Artificial Sequence
  chemically synthesized
agacatcttcagtactaaat

SEQ ID NO: 429512 - DNA, 20 bp, Artificial Sequence
  chemically synthesized
attgtatcgtatgacttatt

SEQ ID NO: 429513 - DNA, 20 bp, Artificial Sequence
  chemically synthesized
taccttttctttatatcaat

SEQ ID NO: 429514 - DNA, 20 bp, Artificial Sequence
  chemically synthesized
caatatgtctaattgatata

SEQ ID NO: 429515 - DNA, 20 bp, Artificial Sequence
  chemically synthesized
tgtctaattgatataaagaa

SEQ ID NO: 429516 - DNA, 20 bp, Artificial Sequence
  chemically synthesized
gtctaattgatataaagaaa

SEQ ID NO: 429517 - DNA, 20 bp, Artificial Sequence
  chemically synthesized
gccagaaggagcagtatggc

SEQ ID NO: 429518 - DNA, 20 bp, Artificial Sequence
  chemically synthesized
actagccagaaggagcagta

SEQ ID NO: 429519 - DNA, 20 bp, Artificial Sequence
  chemically synthesized
tcttgccatactgctccttc

SEQ ID NO: 429520 - DNA, 20 bp, Artificial Sequence
  chemically synthesized
aataaactagccagaaggag

SEQ ID NO: 429521 - DNA, 20 bp, Artificial Sequence
  chemically synthesized
agaaataaactagccagaag

SEQ ID NO: 429522 - DNA, 20 bp, Artificial Sequence
  chemically synthesized
gccatactgctccttctggc

SEQ ID NO: 429523 - DNA, 20 bp, Artificial Sequence
  chemically synthesized
ttagaaataaactagccaga

SEQ ID NO: 429524 - DNA, 20 bp, Artificial Sequence
  chemically synthesized
tttagaaataaactagccag

SEQ ID NO: 429525 - DNA, 20 bp, Artificial Sequence
  chemically synthesized
agctttagaaataaactagc

SEQ ID NO: 429526 - DNA, 20 bp, Artificial Sequence
  chemically synthesized
atatagctttagaaataaac

SEQ ID NO: 429527 - DNA, 20 bp, Artificial Sequence
  chemically synthesized
ttctggctagtttatttcta

SEQ ID NO: 429528 - DNA, 20 bp, Artificial Sequence
  chemically synthesized
aagattcttggatatagctt

SEQ ID NO: 429529 - DNA, 20 bp, Artificial Sequence
  chemically synthesized
ttatttctaaagctatatcc

SEQ ID NO: 429530 - DNA, 20 bp, Artificial Sequence
  chemically synthesized
tttagcaagattcttggata

SEQ ID NO: 429531 - DNA, 20 bp, Artificial Sequence
  chemically synthesized
gatatttttagcaagattct

SEQ ID NO: 429532 - DNA, 20 bp, Artificial Sequence
  chemically synthesized
acacagctgatatttttagc

SEQ ID NO: 429533 - DNA, 20 bp, Artificial Sequence
  chemically synthesized
aagaatcttgctaaaaatat

SEQ ID NO: 429534 - DNA, 20 bp, Artificial Sequence
  chemically synthesized
aataacacagctgatatttt

SEQ ID NO: 429535 - DNA, 20 bp, Artificial Sequence
  chemically synthesized
tagattgaatgaaaataaca

SEQ ID NO: 429536 - DNA, 20 bp, Artificial Sequence
  chemically synthesized
aatagaatgtttgaaagaaa

SEQ ID NO: 429537 - DNA, 20 bp, Artificial Sequence
  chemically synthesized
ttgaaaaatagaatgtttga

SEQ ID NO: 429538 - DNA, 20 bp, Artificial Sequence
  chemically synthesized
tgaaacctaattttgaaaaa

SEQ ID NO: 429539 - DNA, 20 bp, Artificial Sequence
  chemically synthesized
aacattctatttttcaaaat

SEQ ID NO: 429540 - DNA, 20 bp, Artificial Sequence
  chemically synthesized
acattctatttttcaaaatt

SEQ ID NO: 429541 - DNA, 20 bp, Artificial Sequence
  chemically synthesized
ttcaaaattaggtttcattt

SEQ ID NO: 429542 - DNA, 20 bp, Artificial Sequence
  chemically synthesized
attaggtttcatttgagcat

SEQ ID NO: 429543 - DNA, 20 bp, Artificial Sequence
  chemically synthesized
catttgagcatcagtaactt

SEQ ID NO: 429544 - DNA, 20 bp, Artificial Sequence
  chemically synthesized
ttgagcatcagtaactttag

SEQ ID NO: 429545 - DNA, 20 bp, Artificial Sequence
  chemically synthesized
aagtattattttttcttcta

SEQ ID NO: 429546 - DNA, 20 bp, Artificial Sequence
  chemically synthesized
aagaaaaaataatacttaaa

SEQ ID NO: 429547 - DNA, 20 bp, Artificial Sequence
  chemically synthesized
agaaaaaataatacttaaaa

SEQ ID NO: 429548 - DNA, 20 bp, Artificial Sequence
  chemically synthesized
tgcctggccagggccttttt

SEQ ID NO: 429549 - DNA, 20 bp, Artificial Sequence
  chemically synthesized
aataatacttaaaaaggccc

SEQ ID NO: 429550 - DNA, 20 bp, Artificial Sequence
  chemically synthesized
atacttaaaaaggccctggc

SEQ ID NO: 429551 - DNA, 20 bp, Artificial Sequence
  chemically synthesized
tacttaaaaaggccctggcc

SEQ ID NO: 429552 - DNA, 20 bp, Artificial Sequence
  chemically synthesized
tgagccaccgtgcctggcca

SEQ ID NO: 429553 - DNA, 20 bp, Artificial Sequence
  chemically synthesized
atgagccaccgtgcctggcc

SEQ ID NO: 429554 - DNA, 20 bp, Artificial Sequence
  chemically synthesized
catgagccaccgtgcctggc

SEQ ID NO: 429555 - DNA, 20 bp, Artificial Sequence
  chemically synthesized
aaaaaggccctggccaggca

SEQ ID NO: 429556 - DNA, 20 bp, Artificial Sequence
  chemically synthesized
aaggccctggccaggcacgg

SEQ ID NO: 429557 - DNA, 20 bp, Artificial Sequence
  chemically synthesized
caggcatgagccaccgtgcc

SEQ ID NO: 429558 - DNA, 20 bp, Artificial Sequence
  chemically synthesized
agtgctgggattacaggcat

SEQ ID NO: 429559 - DNA, 20 bp, Artificial Sequence
  chemically synthesized
gtggctcatgcctgtaatcc

SEQ ID NO: 429560 - DNA, 20 bp, Artificial Sequence
  chemically synthesized
tcccaaagtgctgggattac

SEQ ID NO: 429561 - DNA, 20 bp, Artificial Sequence
  chemically synthesized
ctcccaaagtgctgggatta

SEQ ID NO: 429562 - DNA, 20 bp, Artificial Sequence
  chemically synthesized
tgcctgtaatcccagcactt

SEQ ID NO: 429563 - DNA, 20 bp, Artificial Sequence
  chemically synthesized
cctcggcctcccaaagtgct

SEQ ID NO: 429564 - DNA, 20 bp, Artificial Sequence
  chemically synthesized
gcctgtaatcccagcacttt

SEQ ID NO: 429565 - DNA, 20 bp, Artificial Sequence
  chemically synthesized
gcctcggcctcccaaagtgc

SEQ ID NO: 429566 - DNA, 20 bp, Artificial Sequence
  chemically synthesized
ctgtaatcccagcactttgg

SEQ ID NO: 429567 - DNA, 20 bp, Artificial Sequence
  chemically synthesized
tgtaatcccagcactttggg

SEQ ID NO: 429568 - DNA, 20 bp, Artificial Sequence
  chemically synthesized
ctgcctgcctcggcctccca

SEQ ID NO: 429569 - DNA, 20 bp, Artificial Sequence
  chemically synthesized
tcccagcactttgggaggcc

SEQ ID NO: 429570 - DNA, 20 bp, Artificial Sequence
  chemically synthesized
cccagcactttgggaggccg

SEQ ID NO: 429571 - DNA, 20 bp, Artificial Sequence
  chemically synthesized
agcactttgggaggccgagg

SEQ ID NO: 429572 - DNA, 20 bp, Artificial Sequence
  chemically synthesized
gcactttgggaggccgaggc

SEQ ID NO: 429573 - DNA, 20 bp, Artificial Sequence
  chemically synthesized
ctttgggaggccgaggcagg

SEQ ID NO: 429574 - DNA, 20 bp, Artificial Sequence
  chemically synthesized
ctcaaatgatctgcctgcct

SEQ ID NO: 429575 - DNA, 20 bp, Artificial Sequence
  chemically synthesized
ccgaggcaggcagatcattt

SEQ ID NO: 429576 - DNA, 20 bp, Artificial Sequence
  chemically synthesized
cgaggcaggcagatcatttg

SEQ ID NO: 429577 - DNA, 20 bp, Artificial Sequence
  chemically synthesized
gcaggcagatcatttgaggt

SEQ ID NO: 429578 - DNA, 20 bp, Artificial Sequence
  chemically synthesized
caggcagatcatttgaggtc

SEQ ID NO: 429579 - DNA, 20 bp, Artificial Sequence
  chemically synthesized
ggcagatcatttgaggtcag

SEQ ID NO: 429580 - DNA, 20 bp, Artificial Sequence
  chemically synthesized
gatcatttgaggtcaggaga

SEQ ID NO: 429581 - DNA, 20 bp, Artificial Sequence
  chemically synthesized
tcatttgaggtcaggagatg

SEQ ID NO: 429582 - DNA, 20 bp, Artificial Sequence
  chemically synthesized
tgaggtcaggagatggagac

SEQ ID NO: 429583 - DNA, 20 bp, Artificial Sequence
  chemically synthesized
tttcactgtgttgatcaggc

SEQ ID NO: 429584 - DNA, 20 bp, Artificial Sequence
  chemically synthesized
agggtttcactgtgttgatc

SEQ ID NO: 429585 - DNA, 20 bp, Artificial Sequence
  chemically synthesized
ggagaccagcctgatcaaca

SEQ ID NO: 429586 - DNA, 20 bp, Artificial Sequence
  chemically synthesized
cagggtttcactgtgttgat

SEQ ID NO: 429587 - DNA, 20 bp, Artificial Sequence
  chemically synthesized
ttgtatttttagtagagaca

SEQ ID NO: 429588 - DNA, 20 bp, Artificial Sequence
  chemically synthesized
tttgtatttttagtagagac

SEQ ID NO: 429589 - DNA, 20 bp, Artificial Sequence
  chemically synthesized
ttttgtatttttagtagaga

SEQ ID NO: 429590 - DNA, 20 bp, Artificial Sequence
  chemically synthesized
taatttttgtatttttagta

SEQ ID NO: 429591 - DNA, 20 bp, Artificial Sequence
  chemically synthesized
gctaatttttgtatttttag

SEQ ID NO: 429592 - DNA, 20 bp, Artificial Sequence
  chemically synthesized
ctggctaatttttgtatttt

SEQ ID NO: 429593 - DNA, 20 bp, Artificial Sequence
  chemically synthesized
tctactaaaaatacaaaaat

SEQ ID NO: 429594 - DNA, 20 bp, Artificial Sequence
  chemically synthesized
ctaaaaatacaaaaattagc

SEQ ID NO: 429595 - DNA, 20 bp, Artificial Sequence
  chemically synthesized
taaaaatacaaaaattagcc

SEQ ID NO: 429596 - DNA, 20 bp, Artificial Sequence
  chemically synthesized
atacaaaaattagccaggcg

SEQ ID NO: 429597 - DNA, 20 bp, Artificial Sequence
  chemically synthesized
caaaaattagccaggcgtgg

SEQ ID NO: 429598 - DNA, 20 bp, Artificial Sequence
  chemically synthesized
caggcgcccaccaccacgcc

SEQ ID NO: 429599 - DNA, 20 bp, Artificial Sequence
  chemically synthesized
aaattagccaggcgtggtgg

SEQ ID NO: 429600 - DNA, 20 bp, Artificial Sequence
  chemically synthesized
aattagccaggcgtggtggt

SEQ ID NO: 429601 - DNA, 20 bp, Artificial Sequence
  chemically synthesized
gtggtgggcgcctgtaatcc

SEQ ID NO: 429602 - DNA, 20 bp, Artificial Sequence
  chemically synthesized
tcctaagtagctgggattac

SEQ ID NO: 429603 - DNA, 20 bp, Artificial Sequence
  chemically synthesized
ctcctaagtagctgggatta

SEQ ID NO: 429604 - DNA, 20 bp, Artificial Sequence
  chemically synthesized
cgcctgtaatcccagctact

SEQ ID NO: 429605 - DNA, 20 bp, Artificial Sequence
  chemically synthesized
cctcagcctcctaagtagct

SEQ ID NO: 429606 - DNA, 20 bp, Artificial Sequence
  chemically synthesized
gcctgtaatcccagctactt

SEQ ID NO: 429607 - DNA, 20 bp, Artificial Sequence
  chemically synthesized
gcctcagcctcctaagtagc

SEQ ID NO: 429608 - DNA, 20 bp, Artificial Sequence
  chemically synthesized
ctgtaatcccagctacttag

SEQ ID NO: 429609 - DNA, 20 bp, Artificial Sequence
  chemically synthesized
tgtaatcccagctacttagg

SEQ ID NO: 429610 - DNA, 20 bp, Artificial Sequence
  chemically synthesized
tcctgcctcagcctcctaag

SEQ ID NO: 429611 - DNA, 20 bp, Artificial Sequence
  chemically synthesized
ttctcctgcctcagcctcct

SEQ ID NO: 429612 - DNA, 20 bp, Artificial Sequence
  chemically synthesized
tcccagctacttaggaggct

SEQ ID NO: 429613 - DNA, 20 bp, Artificial Sequence
  chemically synthesized
cccagctacttaggaggctg

SEQ ID NO: 429614 - DNA, 20 bp, Artificial Sequence
  chemically synthesized
agctacttaggaggctgagg

SEQ ID NO: 429615 - DNA, 20 bp, Artificial Sequence
  chemically synthesized
gctacttaggaggctgaggc

SEQ ID NO: 429616 - DNA, 20 bp, Artificial Sequence
  chemically synthesized
tacttaggaggctgaggcag

SEQ ID NO: 429617 - DNA, 20 bp, Artificial Sequence
  chemically synthesized
ctcaagcaattctcctgcct

SEQ ID NO: 429618 - DNA, 20 bp, Artificial Sequence
  chemically synthesized
ctgaggcaggagaattgctt

SEQ ID NO: 429619 - DNA, 20 bp, Artificial Sequence
  chemically synthesized
gcaggagaattgcttgagcc

SEQ ID NO: 429620 - DNA, 20 bp, Artificial Sequence
  chemically synthesized
caggagaattgcttgagccc

SEQ ID NO: 429621 - DNA, 20 bp, Artificial Sequence
  chemically synthesized
aacttccgcctcctgggctc

SEQ ID NO: 429622 - DNA, 20 bp, Artificial Sequence
  chemically synthesized
ggagaattgcttgagcccag

SEQ ID NO: 429623 - DNA, 20 bp, Artificial Sequence
  chemically synthesized
gagaattgcttgagcccagg

SEQ ID NO: 429624 - DNA, 20 bp, Artificial Sequence
  chemically synthesized
aattgcttgagcccaggagg

SEQ ID NO: 429625 - DNA, 20 bp, Artificial Sequence
  chemically synthesized
cactgcaacttccgcctcct

SEQ ID NO: 429626 - DNA, 20 bp, Artificial Sequence
  chemically synthesized
tcactgcaacttccgcctcc

SEQ ID NO: 429627 - DNA, 20 bp, Artificial Sequence
  chemically synthesized
tgcttgagcccaggaggcgg

SEQ ID NO: 429628 - DNA, 20 bp, Artificial Sequence
  chemically synthesized
agcccaggaggcggaagttg

SEQ ID NO: 429629 - DNA, 20 bp, Artificial Sequence
  chemically synthesized
caggaggcggaagttgcagt

SEQ ID NO: 429630 - DNA, 20 bp, Artificial Sequence
  chemically synthesized
gaggcggaagttgcagtgag

SEQ ID NO: 429631 - DNA, 20 bp, Artificial Sequence
  chemically synthesized
ggcggaagttgcagtgagca

SEQ ID NO: 429632 - DNA, 20 bp, Artificial Sequence
  chemically synthesized
caggctggagtgcaatggtg

SEQ ID NO: 429633 - DNA, 20 bp, Artificial Sequence
  chemically synthesized
ctgcccaggctggagtgcaa

SEQ ID NO: 429634 - DNA, 20 bp, Artificial Sequence
  chemically synthesized
gagactgcaccattgcactc

SEQ ID NO: 429635 - DNA, 20 bp, Artificial Sequence
  chemically synthesized
tgcaccattgcactccagcc

SEQ ID NO: 429636 - DNA, 20 bp, Artificial Sequence
  chemically synthesized
gcaccattgcactccagcct

SEQ ID NO: 429637 - DNA, 20 bp, Artificial Sequence
  chemically synthesized
tcgttttgctgcccaggctg

SEQ ID NO: 429638 - DNA, 20 bp, Artificial Sequence
  chemically synthesized
ccattgcactccagcctggg

SEQ ID NO: 429639 - DNA, 20 bp, Artificial Sequence
  chemically synthesized
gctcgttttgctgcccaggc

SEQ ID NO: 429640 - DNA, 20 bp, Artificial Sequence
  chemically synthesized
tagtgctcgttttgctgccc

SEQ ID NO: 429641 - DNA, 20 bp, Artificial Sequence
  chemically synthesized
ttagtgctcgttttgctgcc

SEQ ID NO: 429642 - DNA, 20 bp, Artificial Sequence
  chemically synthesized
tccagcctgggcagcaaaac

SEQ ID NO: 429643 - DNA, 20 bp, Artificial Sequence
  chemically synthesized
tgggcagcaaaacgagcact

SEQ ID NO: 429644 - DNA, 20 bp, Artificial Sequence
  chemically synthesized
attactactaatttttttct

SEQ ID NO: 429645 - DNA, 20 bp, Artificial Sequence
  chemically synthesized
acgagcactaagaaaaaaat

SEQ ID NO: 429646 - DNA, 20 bp, Artificial Sequence
  chemically synthesized
agcactaagaaaaaaattag

SEQ ID NO: 429647 - DNA, 20 bp, Artificial Sequence
  chemically synthesized
aaaattagtagtaatatgca

SEQ ID NO: 429648 - DNA, 20 bp, Artificial Sequence
  chemically synthesized
ttagtagtaatatgcaaagt

SEQ ID NO: 429649 - DNA, 20 bp, Artificial Sequence
  chemically synthesized
tagtagtaatatgcaaagtc

SEQ ID NO: 429650 - DNA, 20 bp, Artificial Sequence
  chemically synthesized
taatatgcaaagtcaggtct

SEQ ID NO: 429651 - DNA, 20 bp, Artificial Sequence
  chemically synthesized
atatgcaaagtcaggtctca

SEQ ID NO: 429652 - DNA, 20 bp, Artificial Sequence
  chemically synthesized
ttagaagaaacaggagctct

SEQ ID NO: 429653 - DNA, 20 bp, Artificial Sequence
  chemically synthesized
acctaatttagaagaaacag

SEQ ID NO: 429654 - DNA, 20 bp, Artificial Sequence
  chemically synthesized
acacctaatttagaagaaac

SEQ ID NO: 429655 - DNA, 20 bp, Artificial Sequence
  chemically synthesized
tacacctaatttagaagaaa

SEQ ID NO: 429656 - DNA, 20 bp, Artificial Sequence
  chemically synthesized
agctcctgtttcttctaaat

SEQ ID NO: 429657 - DNA, 20 bp, Artificial Sequence
  chemically synthesized
gctcctgtttcttctaaatt

SEQ ID NO: 429658 - DNA, 20 bp, Artificial Sequence
  chemically synthesized
aggagatacacctaatttag

SEQ ID NO: 429659 - DNA, 20 bp, Artificial Sequence
  chemically synthesized
ctgaggagatacacctaatt

SEQ ID NO: 429660 - DNA, 20 bp, Artificial Sequence
  chemically synthesized
ctaaattaggtgtatctcct

SEQ ID NO: 429661 - DNA, 20 bp, Artificial Sequence
  chemically synthesized
gactaaattcaaagactgag

SEQ ID NO: 429662 - DNA, 20 bp, Artificial Sequence
  chemically synthesized
tagactaaattcaaagactg

SEQ ID NO: 429663 - DNA, 20 bp, Artificial Sequence
  chemically synthesized
ttagactaaattcaaagact

SEQ ID NO: 429664 - DNA, 20 bp, Artificial Sequence
  chemically synthesized
atctcctcagtctttgaatt

SEQ ID NO: 429665 - DNA, 20 bp, Artificial Sequence
  chemically synthesized
accaatttagactaaattca

SEQ ID NO: 429666 - DNA, 20 bp, Artificial Sequence
  chemically synthesized
tctttgaatttagtctaaat

SEQ ID NO: 429667 - DNA, 20 bp, Artificial Sequence
  chemically synthesized
ttattatttataaaccaatt

SEQ ID NO: 429668 - DNA, 20 bp, Artificial Sequence
  chemically synthesized
gcagggagctagaaagattc

SEQ ID NO: 429669 - DNA, 20 bp, Artificial Sequence
  chemically synthesized
ggcagggagctagaaagatt

SEQ ID NO: 429670 - DNA, 20 bp, Artificial Sequence
  chemically synthesized
ataataatcctgaatctttc

SEQ ID NO: 429671 - DNA, 20 bp, Artificial Sequence
  chemically synthesized
ctttgtggcagggagctaga

SEQ ID NO: 429672 - DNA, 20 bp, Artificial Sequence
  chemically synthesized
ccatctttgtggcagggagc

SEQ ID NO: 429673 - DNA, 20 bp, Artificial Sequence
  chemically synthesized
atatccatctttgtggcagg

SEQ ID NO: 429674 - DNA, 20 bp, Artificial Sequence
  chemically synthesized
ctttctagctccctgccaca

SEQ ID NO: 429675 - DNA, 20 bp, Artificial Sequence
  chemically synthesized
aaatatccatctttgtggca

SEQ ID NO: 429676 - DNA, 20 bp, Artificial Sequence
  chemically synthesized
taaatatccatctttgtggc

SEQ ID NO: 429677 - DNA, 20 bp, Artificial Sequence
  chemically synthesized
ctaaatatccatctttgtgg

SEQ ID NO: 429678 - DNA, 20 bp, Artificial Sequence
  chemically synthesized
ctagctccctgccacaaaga

SEQ ID NO: 429679 - DNA, 20 bp, Artificial Sequence
  chemically synthesized
tatctaaatatccatctttg

SEQ ID NO: 429680 - DNA, 20 bp, Artificial Sequence
  chemically synthesized
ctgccacaaagatggatatt

SEQ ID NO: 429681 - DNA, 20 bp, Artificial Sequence
  chemically synthesized
atggatatttagatatacta

SEQ ID NO: 429682 - DNA, 20 bp, Artificial Sequence
  chemically synthesized
aggaatagtgaaatattcca

SEQ ID NO: 429683 - DNA, 20 bp, Artificial Sequence
  chemically synthesized
atctagaaataaaacaggaa

SEQ ID NO: 429684 - DNA, 20 bp, Artificial Sequence
  chemically synthesized
ttttaatctagaaataaaac

SEQ ID NO: 429685 - DNA, 20 bp, Artificial Sequence
  chemically synthesized
tttttaatctagaaataaaa

SEQ ID NO: 429686 - DNA, 20 bp, Artificial Sequence
  chemically synthesized
cactattcctgttttatttc

SEQ ID NO: 429687 - DNA, 20 bp, Artificial Sequence
  chemically synthesized
tgttttggtgatttttaatc

SEQ ID NO: 429688 - DNA, 20 bp, Artificial Sequence
  chemically synthesized
agattaaaaatcaccaaaac

SEQ ID NO: 429689 - DNA, 20 bp, Artificial Sequence
  chemically synthesized
gattaaaaatcaccaaaaca

SEQ ID NO: 429690 - DNA, 20 bp, Artificial Sequence
  chemically synthesized
ttaaaaatcaccaaaacaag

SEQ ID NO: 429691 - DNA, 20 bp, Artificial Sequence
  chemically synthesized
aaatttctgtctccttgttt

SEQ ID NO: 429692 - DNA, 20 bp, Artificial Sequence
  chemically synthesized
aaatcaccaaaacaaggaga

SEQ ID NO: 429693 - DNA, 20 bp, Artificial Sequence
  chemically synthesized
gggaaaaattagggtcaggg

SEQ ID NO: 429694 - DNA, 20 bp, Artificial Sequence
  chemically synthesized
aaggggaaaaattagggtca

SEQ ID NO: 429695 - DNA, 20 bp, Artificial Sequence
  chemically synthesized
caaggggaaaaattagggtc

SEQ ID NO: 429696 - DNA, 20 bp, Artificial Sequence
  chemically synthesized
tcaaggggaaaaattagggt

SEQ ID NO: 429697 - DNA, 20 bp, Artificial Sequence
  chemically synthesized
gatttcaaggggaaaaatta

SEQ ID NO: 429698 - DNA, 20 bp, Artificial Sequence
  chemically synthesized
agatttcaaggggaaaaatt

SEQ ID NO: 429699 - DNA, 20 bp, Artificial Sequence
  chemically synthesized
aagatttcaaggggaaaaat

SEQ ID NO: 429700 - DNA, 20 bp, Artificial Sequence
  chemically synthesized
attgatagcaagatttcaag

SEQ ID NO: 429701 - DNA, 20 bp, Artificial Sequence
  chemically synthesized
aattgatagcaagatttcaa

SEQ ID NO: 429702 - DNA, 20 bp, Artificial Sequence
  chemically synthesized
taattgatagcaagatttca

SEQ ID NO: 429703 - DNA, 20 bp, Artificial Sequence
  chemically synthesized
ataattgatagcaagatttc

SEQ ID NO: 429704 - DNA, 20 bp, Artificial Sequence
  chemically synthesized
aggtcagtataattgatagc

SEQ ID NO: 429705 - DNA, 20 bp, Artificial Sequence
  chemically synthesized
ccaaaggtcagtataattga

SEQ ID NO: 429706 - DNA, 20 bp, Artificial Sequence
  chemically synthesized
ctatcaattatactgacctt

SEQ ID NO: 429707 - DNA, 20 bp, Artificial Sequence
  chemically synthesized
aaatgcctacaaccaaaggt

SEQ ID NO: 429708 - DNA, 20 bp, Artificial Sequence
  chemically synthesized
attatactgacctttggttg

SEQ ID NO: 429709 - DNA, 20 bp, Artificial Sequence
  chemically synthesized
aaagaaatgcctacaaccaa

SEQ ID NO: 429710 - DNA, 20 bp, Artificial Sequence
  chemically synthesized
ttatactgacctttggttgt

SEQ ID NO: 429711 - DNA, 20 bp, Artificial Sequence
  chemically synthesized
taaagaaatgcctacaacca

SEQ ID NO: 429712 - DNA, 20 bp, Artificial Sequence
  chemically synthesized
aacaaaaaaacacaaatata

SEQ ID NO: 429713 - DNA, 20 bp, Artificial Sequence
  chemically synthesized
atgaatagagtttatgtaga

SEQ ID NO: 429714 - DNA, 20 bp, Artificial Sequence
  chemically synthesized
ccccatgaatagagtttatg

SEQ ID NO: 429715 - DNA, 20 bp, Artificial Sequence
  chemically synthesized
ttctacataaactctattca

SEQ ID NO: 429716 - DNA, 20 bp, Artificial Sequence
  chemically synthesized
tctacataaactctattcat

SEQ ID NO: 429717 - DNA, 20 bp, Artificial Sequence
  chemically synthesized
ggcaaaagaccccatgaata

SEQ ID NO: 429718 - DNA, 20 bp, Artificial Sequence
  chemically synthesized
ctacataaactctattcatg

SEQ ID NO: 429719 - DNA, 20 bp, Artificial Sequence
  chemically synthesized
ttggcaaaagaccccatgaa

SEQ ID NO: 429720 - DNA, 20 bp, Artificial Sequence
  chemically synthesized
ataatataatgagttggcaa

SEQ ID NO: 429721 - DNA, 20 bp, Artificial Sequence
  chemically synthesized
gaaaggataatataatgagt

SEQ ID NO: 429722 - DNA, 20 bp, Artificial Sequence
  chemically synthesized
ttctgaaaggataatataat

SEQ ID NO: 429723 - DNA, 20 bp, Artificial Sequence
  chemically synthesized
aactcattatattatccttt

SEQ ID NO: 429724 - DNA, 20 bp, Artificial Sequence
  chemically synthesized
gcctttgaccatattctgaa

SEQ ID NO: 429725 - DNA, 20 bp, Artificial Sequence
  chemically synthesized
tgcctttgaccatattctga

SEQ ID NO: 429726 - DNA, 20 bp, Artificial Sequence
  chemically synthesized
tatattatcctttcagaata

SEQ ID NO: 429727 - DNA, 20 bp, Artificial Sequence
  chemically synthesized
atcctttcagaatatggtca

SEQ ID NO: 429728 - DNA, 20 bp, Artificial Sequence
  chemically synthesized
tcctttcagaatatggtcaa

SEQ ID NO: 429729 - DNA, 20 bp, Artificial Sequence
  chemically synthesized
ttcagaatatggtcaaaggc

SEQ ID NO: 429730 - DNA, 20 bp, Artificial Sequence
  chemically synthesized
tgacaattggattgtaaaat

SEQ ID NO: 429731 - DNA, 20 bp, Artificial Sequence
  chemically synthesized
atgacaattggattgtaaaa

SEQ ID NO: 429732 - DNA, 20 bp, Artificial Sequence
  chemically synthesized
atcctcttagaaatgacaat

SEQ ID NO: 429733 - DNA, 20 bp, Artificial Sequence
  chemically synthesized
acaatccaattgtcatttct

SEQ ID NO: 429734 - DNA, 20 bp, Artificial Sequence
  chemically synthesized
aatccaattgtcatttctaa

SEQ ID NO: 429735 - DNA, 20 bp, Artificial Sequence
  chemically synthesized
atccaattgtcatttctaag

SEQ ID NO: 429736 - DNA, 20 bp, Artificial Sequence
  chemically synthesized
gagtaattccaatatcctct

SEQ ID NO: 429737 - DNA, 20 bp, Artificial Sequence
  chemically synthesized
tgtcatttctaagaggatat

SEQ ID NO: 429738 - DNA, 20 bp, Artificial Sequence
  chemically synthesized
atattggaattactcatgta

SEQ ID NO: 429739 - DNA, 20 bp, Artificial Sequence
  chemically synthesized
attggaattactcatgtaca

SEQ ID NO: 429740 - DNA, 20 bp, Artificial Sequence
  chemically synthesized
taaccttttactctgtacat

SEQ ID NO: 429741 - DNA, 20 bp, Artificial Sequence
  chemically synthesized
attactcatgtacagagtaa

SEQ ID NO: 429742 - DNA, 20 bp, Artificial Sequence
  chemically synthesized
ttactcatgtacagagtaaa

SEQ ID NO: 429743 - DNA, 20 bp, Artificial Sequence
  chemically synthesized
cttttgctaagtaggaggtg

SEQ ID NO: 429744 - DNA, 20 bp, Artificial Sequence
  chemically synthesized
tcttttgctaagtaggaggt

SEQ ID NO: 429745 - DNA, 20 bp, Artificial Sequence
  chemically synthesized
tattttcctcacctcctact

SEQ ID NO: 429746 - DNA, 20 bp, Artificial Sequence
  chemically synthesized
actttcttttgctaagtagg

SEQ ID NO: 429747 - DNA, 20 bp, Artificial Sequence
  chemically synthesized
cactttcttttgctaagtag

SEQ ID NO: 429748 - DNA, 20 bp, Artificial Sequence
  chemically synthesized
ttcactttcttttgctaagt

SEQ ID NO: 429749 - DNA, 20 bp, Artificial Sequence
  chemically synthesized
tttcactttcttttgctaag

SEQ ID NO: 429750 - DNA, 20 bp, Artificial Sequence
  chemically synthesized
cctcacctcctacttagcaa

SEQ ID NO: 429751 - DNA, 20 bp, Artificial Sequence
  chemically synthesized
tgttttcactttcttttgct

SEQ ID NO: 429752 - DNA, 20 bp, Artificial Sequence
  chemically synthesized
acctcctacttagcaaaaga

SEQ ID NO: 429753 - DNA, 20 bp, Artificial Sequence
  chemically synthesized
aacaatgacattcttatttt

SEQ ID NO: 429754 - DNA, 20 bp, Artificial Sequence
  chemically synthesized
gtaattaaatcactaaaaat

SEQ ID NO: 429755 - DNA, 20 bp, Artificial Sequence
  chemically synthesized
atgaagaaaatcacatggat

SEQ ID NO: 429756 - DNA, 20 bp, Artificial Sequence
  chemically synthesized
attagatgaagaaaatcaca

SEQ ID NO: 429757 - DNA, 20 bp, Artificial Sequence
  chemically synthesized
taattttgttaaattagatg

SEQ ID NO: 429758 - DNA, 20 bp, Artificial Sequence
  chemically synthesized
ctctgataattttgttaaat

SEQ ID NO: 429759 - DNA, 20 bp, Artificial Sequence
  chemically synthesized
atctaatttaacaaaattat

SEQ ID NO: 429760 - DNA, 20 bp, Artificial Sequence
  chemically synthesized
ctaatttaacaaaattatca

SEQ ID NO: 429761 - DNA, 20 bp, Artificial Sequence
  chemically synthesized
taacaaaattatcagagaca

SEQ ID NO: 429762 - DNA, 20 bp, Artificial Sequence
  chemically synthesized
taagaaagatgatatgtaat

SEQ ID NO: 429763 - DNA, 20 bp, Artificial Sequence
  chemically synthesized
cttgtacttctggaataaga

SEQ ID NO: 429764 - DNA, 20 bp, Artificial Sequence
  chemically synthesized
acatatcatctttcttattc

SEQ ID NO: 429765 - DNA, 20 bp, Artificial Sequence
  chemically synthesized
tatcatctttcttattccag

SEQ ID NO: 429766 - DNA, 20 bp, Artificial Sequence
  chemically synthesized
ttgtcttgtacttctggaat

SEQ ID NO: 429767 - DNA, 20 bp, Artificial Sequence
  chemically synthesized
ctttcttattccagaagtac

SEQ ID NO: 429768 - DNA, 20 bp, Artificial Sequence
  chemically synthesized
ttagttttgtcttgtacttc

SEQ ID NO: 429769 - DNA, 20 bp, Artificial Sequence
  chemically synthesized
ttataagcagaaatcaaggt

SEQ ID NO: 429770 - DNA, 20 bp, Artificial Sequence
  chemically synthesized
aagattataagcagaaatca

SEQ ID NO: 429771 - DNA, 20 bp, Artificial Sequence
  chemically synthesized
taagattataagcagaaatc

SEQ ID NO: 429772 - DNA, 20 bp, Artificial Sequence
  chemically synthesized
ggagaatgtaagattataag

SEQ ID NO: 429773 - DNA, 20 bp, Artificial Sequence
  chemically synthesized
tggggagaatgtaagattat

SEQ ID NO: 429774 - DNA, 20 bp, Artificial Sequence
  chemically synthesized
tgaatccatggggagaatgt

SEQ ID NO: 429775 - DNA, 20 bp, Artificial Sequence
  chemically synthesized
ataatcttacattctcccca

SEQ ID NO: 429776 - DNA, 20 bp, Artificial Sequence
  chemically synthesized
gagctgtgtgaatccatggg

SEQ ID NO: 429777 - DNA, 20 bp, Artificial Sequence
  chemically synthesized
tagagctgtgtgaatccatg

SEQ ID NO: 429778 - DNA, 20 bp, Artificial Sequence
  chemically synthesized
gtagagctgtgtgaatccat

SEQ ID NO: 429779 - DNA, 20 bp, Artificial Sequence
  chemically synthesized
ggtagagctgtgtgaatcca

SEQ ID NO: 429780 - DNA, 20 bp, Artificial Sequence
  chemically synthesized
attctccccatggattcaca

SEQ ID NO: 429781 - DNA, 20 bp, Artificial Sequence
  chemically synthesized
attagccacaaatcagggta

SEQ ID NO: 429782 - DNA, 20 bp, Artificial Sequence
  chemically synthesized
ttattagccacaaatcaggg

SEQ ID NO: 429783 - DNA, 20 bp, Artificial Sequence
  chemically synthesized
cacagctctaccctgatttg

SEQ ID NO: 429784 - DNA, 20 bp, Artificial Sequence
  chemically synthesized
ttgttattagccacaaatca

SEQ ID NO: 429785 - DNA, 20 bp, Artificial Sequence
  chemically synthesized
gttgttattagccacaaatc

SEQ ID NO: 429786 - DNA, 20 bp, Artificial Sequence
  chemically synthesized
tgttgttattagccacaaat

SEQ ID NO: 429787 - DNA, 20 bp, Artificial Sequence
  chemically synthesized
aaaattaaaattgttgttat

SEQ ID NO: 429788 - DNA, 20 bp, Artificial Sequence
  chemically synthesized
attactttcattaaaagaat

SEQ ID NO: 429789 - DNA, 20 bp, Artificial Sequence
  chemically synthesized
tattactttcattaaaagaa

SEQ ID NO: 429790 - DNA, 20 bp, Artificial Sequence
  chemically synthesized
ttttcctattcttttaatga

SEQ ID NO: 429791 - DNA, 20 bp, Artificial Sequence
  chemically synthesized
aggaatattactttcattaa

SEQ ID NO: 429792 - DNA, 20 bp, Artificial Sequence
  chemically synthesized
catttttcagagaagaagag

SEQ ID NO: 429793 - DNA, 20 bp, Artificial Sequence
  chemically synthesized
tcatttttcagagaagaaga

SEQ ID NO: 429794 - DNA, 20 bp, Artificial Sequence
  chemically synthesized
attcatttttcagagaagaa

SEQ ID NO: 429795 - DNA, 20 bp, Artificial Sequence
  chemically synthesized
gcattcatttttcagagaag

SEQ ID NO: 429796 - DNA, 20 bp, Artificial Sequence
  chemically synthesized
aaggcattcatttttcagag

SEQ ID NO: 429797 - DNA, 20 bp, Artificial Sequence
  chemically synthesized
ataaaggcattcatttttca

SEQ ID NO: 429798 - DNA, 20 bp, Artificial Sequence
  chemically synthesized
tcataaaggcattcattttt

SEQ ID NO: 429799 - DNA, 20 bp, Artificial Sequence
  chemically synthesized
ttttccctcccaaatcataa

SEQ ID NO: 429800 - DNA, 20 bp, Artificial Sequence
  chemically synthesized
aaatgaatgcctttatgatt

SEQ ID NO: 429801 - DNA, 20 bp, Artificial Sequence
  chemically synthesized
tttttccctcccaaatcata

SEQ ID NO: 429802 - DNA, 20 bp, Artificial Sequence
  chemically synthesized
aatgaatgcctttatgattt

SEQ ID NO: 429803 - DNA, 20 bp, Artificial Sequence
  chemically synthesized
tgaatgcctttatgatttgg

SEQ ID NO: 429804 - DNA, 20 bp, Artificial Sequence
  chemically synthesized
gaatgcctttatgatttggg

SEQ ID NO: 429805 - DNA, 20 bp, Artificial Sequence
  chemically synthesized
aatgcctttatgatttggga

SEQ ID NO: 429806 - DNA, 20 bp, Artificial Sequence
  chemically synthesized
gggagggaaaaattctcctt

SEQ ID NO: 429807 - DNA, 20 bp, Artificial Sequence
  chemically synthesized
ggggaaggaaaacaccaaag

SEQ ID NO: 429808 - DNA, 20 bp, Artificial Sequence
  chemically synthesized
aaggggaaggaaaacaccaa

SEQ ID NO: 429809 - DNA, 20 bp, Artificial Sequence
  chemically synthesized
gaaggggaaggaaaacacca

SEQ ID NO: 429810 - DNA, 20 bp, Artificial Sequence
  chemically synthesized
ttggtgttttccttcccctt

SEQ ID NO: 429811 - DNA, 20 bp, Artificial Sequence
  chemically synthesized
tgtgggtcaactgaagggga

SEQ ID NO: 429812 - DNA, 20 bp, Artificial Sequence
  chemically synthesized
gtgtgggtcaactgaagggg

SEQ ID NO: 429813 - DNA, 20 bp, Artificial Sequence
  chemically synthesized
atagtgtgggtcaactgaag

SEQ ID NO: 429814 - DNA, 20 bp, Artificial Sequence
  chemically synthesized
aatagtgtgggtcaactgaa

SEQ ID NO: 429815 - DNA, 20 bp, Artificial Sequence
  chemically synthesized
taatagtgtgggtcaactga

SEQ ID NO: 429816 - DNA, 20 bp, Artificial Sequence
  chemically synthesized
ttaatagtgtgggtcaactg

SEQ ID NO: 429817 - DNA, 20 bp, Artificial Sequence
  chemically synthesized
gtgaagattattaatagtgt

SEQ ID NO: 429818 - DNA, 20 bp, Artificial Sequence
  chemically synthesized
tgtgaagattattaatagtg

SEQ ID NO: 429819 - DNA, 20 bp, Artificial Sequence
  chemically synthesized
gatattgtgaagattattaa

SEQ ID NO: 429820 - DNA, 20 bp, Artificial Sequence
  chemically synthesized
caacaatgattgatattgtg

SEQ ID NO: 429821 - DNA, 20 bp, Artificial Sequence
  chemically synthesized
cacaatatcaatcattgttg

SEQ ID NO: 429822 - DNA, 20 bp, Artificial Sequence
  chemically synthesized
tatcaatcattgttgcagct

SEQ ID NO: 429823 - DNA, 20 bp, Artificial Sequence
  chemically synthesized
tcattgttgcagcttagaca

SEQ ID NO: 429824 - DNA, 20 bp, Artificial Sequence
  chemically synthesized
cataaacattgtctatgtct

SEQ ID NO: 429825 - DNA, 20 bp, Artificial Sequence
  chemically synthesized
tagacatagacaatgtttat

SEQ ID NO: 429826 - DNA, 20 bp, Artificial Sequence
  chemically synthesized
aaaaaaaaaaaaaaagagaa

SEQ ID NO: 429827 - DNA, 20 bp, Artificial Sequence
  chemically synthesized
taaaaaaaaaaaaaaagaga

SEQ ID NO: 429828 - DNA, 20 bp, Artificial Sequence
  chemically synthesized
tgtctaaaaaaaaaaaaaaa

SEQ ID NO: 429829 - DNA, 20 bp, Artificial Sequence
  chemically synthesized
tctgtctaaaaaaaaaaaaa

SEQ ID NO: 429830 - DNA, 20 bp, Artificial Sequence
  chemically synthesized
tttctctttttttttttttt

SEQ ID NO: 429831 - DNA, 20 bp, Artificial Sequence
  chemically synthesized
tctttttttttttttttaga

SEQ ID NO: 429832 - DNA, 20 bp, Artificial Sequence
  chemically synthesized
tttttttttttttttagaca

SEQ ID NO: 429833 - DNA, 20 bp, Artificial Sequence
  chemically synthesized
tccagcctgggtgacagagc

SEQ ID NO: 429834 - DNA, 20 bp, Artificial Sequence
  chemically synthesized
cagagtcttgctctgtcacc

SEQ ID NO: 429835 - DNA, 20 bp, Artificial Sequence
  chemically synthesized
gcactccagcctgggtgaca

SEQ ID NO: 429836 - DNA, 20 bp, Artificial Sequence
  chemically synthesized
agagtcttgctctgtcaccc

SEQ ID NO: 429837 - DNA, 20 bp, Artificial Sequence
  chemically synthesized
ctgcactccagcctgggtga

SEQ ID NO: 429838 - DNA, 20 bp, Artificial Sequence
  chemically synthesized
tcttgctctgtcacccaggc

SEQ ID NO: 429839 - DNA, 20 bp, Artificial Sequence
  chemically synthesized
ttgctctgtcacccaggctg

SEQ ID NO: 429840 - DNA, 20 bp, Artificial Sequence
  chemically synthesized
gagccactgcactccagcct

SEQ ID NO: 429841 - DNA, 20 bp, Artificial Sequence
  chemically synthesized
tgagccactgcactccagcc

SEQ ID NO: 429842 - DNA, 20 bp, Artificial Sequence
  chemically synthesized
ctgtcacccaggctggagtg

SEQ ID NO: 429843 - DNA, 20 bp, Artificial Sequence
  chemically synthesized
gagattgagccactgcactc

SEQ ID NO: 429844 - DNA, 20 bp, Artificial Sequence
  chemically synthesized
tcacccaggctggagtgcag

SEQ ID NO: 429845 - DNA, 20 bp, Artificial Sequence
  chemically synthesized
ggagtgcagtggctcaatct

SEQ ID NO: 429846 - DNA, 20 bp, Artificial Sequence
  chemically synthesized
ggttgcagtgagctgagatt

SEQ ID NO: 429847 - DNA, 20 bp, Artificial Sequence
  chemically synthesized
ggcggaggttgcagtgagct

SEQ ID NO: 429848 - DNA, 20 bp, Artificial Sequence
  chemically synthesized
tgggaggcggaggttgcagt

SEQ ID NO: 429849 - DNA, 20 bp, Artificial Sequence
  chemically synthesized
aatctgggaggcggaggttg

SEQ ID NO: 429850 - DNA, 20 bp, Artificial Sequence
  chemically synthesized
cgcttgaatctgggaggcgg

SEQ ID NO: 429851 - DNA, 20 bp, Artificial Sequence
  chemically synthesized
tcactgcaacctccgcctcc

SEQ ID NO: 429852 - DNA, 20 bp, Artificial Sequence
  chemically synthesized
tcgcttgaatctgggaggcg

SEQ ID NO: 429853 - DNA, 20 bp, Artificial Sequence
  chemically synthesized
aatcgcttgaatctgggagg

SEQ ID NO: 429854 - DNA, 20 bp, Artificial Sequence
  chemically synthesized
gagaatcgcttgaatctggg

SEQ ID NO: 429855 - DNA, 20 bp, Artificial Sequence
  chemically synthesized
ggagaatcgcttgaatctgg

SEQ ID NO: 429856 - DNA, 20 bp, Artificial Sequence
  chemically synthesized
aacctccgcctcccagattc

SEQ ID NO: 429857 - DNA, 20 bp, Artificial Sequence
  chemically synthesized
caggagaatcgcttgaatct

SEQ ID NO: 429858 - DNA, 20 bp, Artificial Sequence
  chemically synthesized
gcaggagaatcgcttgaatc

SEQ ID NO: 429859 - DNA, 20 bp, Artificial Sequence
  chemically synthesized
ttcaagcgattctcctgcct

SEQ ID NO: 429860 - DNA, 20 bp, Artificial Sequence
  chemically synthesized
tactcaggaggccaaggcag

SEQ ID NO: 429861 - DNA, 20 bp, Artificial Sequence
  chemically synthesized
gctactcaggaggccaaggc

SEQ ID NO: 429862 - DNA, 20 bp, Artificial Sequence
  chemically synthesized
agctactcaggaggccaagg

SEQ ID NO: 429863 - DNA, 20 bp, Artificial Sequence
  chemically synthesized
tccagctactcaggaggcca

SEQ ID NO: 429864 - DNA, 20 bp, Artificial Sequence
  chemically synthesized
ttccagctactcaggaggcc

SEQ ID NO: 429865 - DNA, 20 bp, Artificial Sequence
  chemically synthesized
ttctcctgccttggcctcct

SEQ ID NO: 429866 - DNA, 20 bp, Artificial Sequence
  chemically synthesized
tcctgccttggcctcctgag

SEQ ID NO: 429867 - DNA, 20 bp, Artificial Sequence
  chemically synthesized
tgtagttccagctactcagg

SEQ ID NO: 429868 - DNA, 20 bp, Artificial Sequence
  chemically synthesized
ctgtagttccagctactcag

SEQ ID NO: 429869 - DNA, 20 bp, Artificial Sequence
  chemically synthesized
gccttggcctcctgagtagc

SEQ ID NO: 429870 - DNA, 20 bp, Artificial Sequence
  chemically synthesized
acctgtagttccagctactc

SEQ ID NO: 429871 - DNA, 20 bp, Artificial Sequence
  chemically synthesized
cacctgtagttccagctact

SEQ ID NO: 429872 - DNA, 20 bp, Artificial Sequence
  chemically synthesized
ctcctgagtagctggaacta

SEQ ID NO: 429873 - DNA, 20 bp, Artificial Sequence
  chemically synthesized
tcctgagtagctggaactac

SEQ ID NO: 429874 - DNA, 20 bp, Artificial Sequence
  chemically synthesized
gtggcgggcacctgtagttc

SEQ ID NO: 429875 - DNA, 20 bp, Artificial Sequence
  chemically synthesized
ggtgtggtggcgggcacctg

SEQ ID NO: 429876 - DNA, 20 bp, Artificial Sequence
  chemically synthesized
aattagctgggtgtggtggc

SEQ ID NO: 429877 - DNA, 20 bp, Artificial Sequence
  chemically synthesized
aaattagctgggtgtggtgg

SEQ ID NO: 429878 - DNA, 20 bp, Artificial Sequence
  chemically synthesized
caggtgcccgccaccacacc

SEQ ID NO: 429879 - DNA, 20 bp, Artificial Sequence
  chemically synthesized
caaaaattagctgggtgtgg

SEQ ID NO: 429880 - DNA, 20 bp, Artificial Sequence
  chemically synthesized
atacaaaaattagctgggtg

SEQ ID NO: 429881 - DNA, 20 bp, Artificial Sequence
  chemically synthesized
taaaaatacaaaaattagct

SEQ ID NO: 429882 - DNA, 20 bp, Artificial Sequence
  chemically synthesized
ttaaaaatacaaaaattagc

SEQ ID NO: 429883 - DNA, 20 bp, Artificial Sequence
  chemically synthesized
tctattaaaaatacaaaaat

SEQ ID NO: 429884 - DNA, 20 bp, Artificial Sequence
  chemically synthesized
gctaatttttgtatttttaa

SEQ ID NO: 429885 - DNA, 20 bp, Artificial Sequence
  chemically synthesized
taatttttgtatttttaata

SEQ ID NO: 429886 - DNA, 20 bp, Artificial Sequence
  chemically synthesized
ttttgtatttttaatagaga

SEQ ID NO: 429887 - DNA, 20 bp, Artificial Sequence
  chemically synthesized
tttgtatttttaatagagat

SEQ ID NO: 429888 - DNA, 20 bp, Artificial Sequence
  chemically synthesized
ttgtatttttaatagagatg

SEQ ID NO: 429889 - DNA, 20 bp, Artificial Sequence
  chemically synthesized
gagatggggtttcaccatgt

SEQ ID NO: 429890 - DNA, 20 bp, Artificial Sequence
  chemically synthesized
tggggtttcaccatgttggc

SEQ ID NO: 429891 - DNA, 20 bp, Artificial Sequence
  chemically synthesized
caagaccagcctggccaaca

SEQ ID NO: 429892 - DNA, 20 bp, Artificial Sequence
  chemically synthesized
ggggtttcaccatgttggcc

SEQ ID NO: 429893 - DNA, 20 bp, Artificial Sequence
  chemically synthesized
tttcaccatgttggccaggc

SEQ ID NO: 429894 - DNA, 20 bp, Artificial Sequence
  chemically synthesized
tcaggggttcaagaccagcc

SEQ ID NO: 429895 - DNA, 20 bp, Artificial Sequence
  chemically synthesized
tgaggtcaggggttcaagac

SEQ ID NO: 429896 - DNA, 20 bp, Artificial Sequence
  chemically synthesized
tcacctgaggtcaggggttc

SEQ ID NO: 429897 - DNA, 20 bp, Artificial Sequence
  chemically synthesized
tggtcttgaacccctgacct

SEQ ID NO: 429898 - DNA, 20 bp, Artificial Sequence
  chemically synthesized
ggtggatcacctgaggtcag

SEQ ID NO: 429899 - DNA, 20 bp, Artificial Sequence
  chemically synthesized
ggtcttgaacccctgacctc

SEQ ID NO: 429900 - DNA, 20 bp, Artificial Sequence
  chemically synthesized
aggtggatcacctgaggtca

SEQ ID NO: 429901 - DNA, 20 bp, Artificial Sequence
  chemically synthesized
caggtggatcacctgaggtc

SEQ ID NO: 429902 - DNA, 20 bp, Artificial Sequence
  chemically synthesized
gcaggtggatcacctgaggt

SEQ ID NO: 429903 - DNA, 20 bp, Artificial Sequence
  chemically synthesized
caaagcaggtggatcacctg

SEQ ID NO: 429904 - DNA, 20 bp, Artificial Sequence
  chemically synthesized
ccaaagcaggtggatcacct

SEQ ID NO: 429905 - DNA, 20 bp, Artificial Sequence
  chemically synthesized
ctcaggtgatccacctgctt

SEQ ID NO: 429906 - DNA, 20 bp, Artificial Sequence
  chemically synthesized
ctttgggaggccaaagcagg

SEQ ID NO: 429907 - DNA, 20 bp, Artificial Sequence
  chemically synthesized
gcactttgggaggccaaagc

SEQ ID NO: 429908 - DNA, 20 bp, Artificial Sequence
  chemically synthesized
agcactttgggaggccaaag

SEQ ID NO: 429909 - DNA, 20 bp, Artificial Sequence
  chemically synthesized
cccagcactttgggaggcca

SEQ ID NO: 429910 - DNA, 20 bp, Artificial Sequence
  chemically synthesized
ccacctgctttggcctccca

SEQ ID NO: 429911 - DNA, 20 bp, Artificial Sequence
  chemically synthesized
tgcaatcccagcactttggg

SEQ ID NO: 429912 - DNA, 20 bp, Artificial Sequence
  chemically synthesized
ctgcaatcccagcactttgg

SEQ ID NO: 429913 - DNA, 20 bp, Artificial Sequence
  chemically synthesized
gctttggcctcccaaagtgc

SEQ ID NO: 429914 - DNA, 20 bp, Artificial Sequence
  chemically synthesized
acctgcaatcccagcacttt

SEQ ID NO: 429915 - DNA, 20 bp, Artificial Sequence
  chemically synthesized
ctttggcctcccaaagtgct

SEQ ID NO: 429916 - DNA, 20 bp, Artificial Sequence
  chemically synthesized
aacctgcaatcccagcactt

SEQ ID NO: 429917 - DNA, 20 bp, Artificial Sequence
  chemically synthesized
ctcccaaagtgctgggattg

SEQ ID NO: 429918 - DNA, 20 bp, Artificial Sequence
  chemically synthesized
tcccaaagtgctgggattgc

SEQ ID NO: 429919 - DNA, 20 bp, Artificial Sequence
  chemically synthesized
gtggttcaaacctgcaatcc

SEQ ID NO: 429920 - DNA, 20 bp, Artificial Sequence
  chemically synthesized
caggtttgaaccactgcacc

SEQ ID NO: 429921 - DNA, 20 bp, Artificial Sequence
  chemically synthesized
gaaatgctggctgggtgcag

SEQ ID NO: 429922 - DNA, 20 bp, Artificial Sequence
  chemically synthesized
tttgaaatgctggctgggtg

SEQ ID NO: 429923 - DNA, 20 bp, Artificial Sequence
  chemically synthesized
tttgaaccactgcacccagc

SEQ ID NO: 429924 - DNA, 20 bp, Artificial Sequence
  chemically synthesized
ctggatttgaaatgctggct

SEQ ID NO: 429925 - DNA, 20 bp, Artificial Sequence
  chemically synthesized
tctggatttgaaatgctggc

SEQ ID NO: 429926 - DNA, 20 bp, Artificial Sequence
  chemically synthesized
agcatctggatttgaaatgc

SEQ ID NO: 429927 - DNA, 20 bp, Artificial Sequence
  chemically synthesized
cccagccagcatttcaaatc

SEQ ID NO: 429928 - DNA, 20 bp, Artificial Sequence
  chemically synthesized
gagcctcctgtggtagcatc

SEQ ID NO: 429929 - DNA, 20 bp, Artificial Sequence
  chemically synthesized
ttcaaatccagatgctacca

SEQ ID NO: 429930 - DNA, 20 bp, Artificial Sequence
  chemically synthesized
tcaaatccagatgctaccac

SEQ ID NO: 429931 - DNA, 20 bp, Artificial Sequence
  chemically synthesized
aaatccagatgctaccacag

SEQ ID NO: 429932 - DNA, 20 bp, Artificial Sequence
  chemically synthesized
aatccagatgctaccacagg

SEQ ID NO: 429933 - DNA, 20 bp, Artificial Sequence
  chemically synthesized
aggcccagagcctcctgtgg

SEQ ID NO: 429934 - DNA, 20 bp, Artificial Sequence
  chemically synthesized
ttaaggcccagagcctcctg

SEQ ID NO: 429935 - DNA, 20 bp, Artificial Sequence
  chemically synthesized
gatgctaccacaggaggctc

SEQ ID NO: 429936 - DNA, 20 bp, Artificial Sequence
  chemically synthesized
atgctaccacaggaggctct

SEQ ID NO: 429937 - DNA, 20 bp, Artificial Sequence
  chemically synthesized
ctgcatttctttaaggccca

SEQ ID NO: 429938 - DNA, 20 bp, Artificial Sequence
  chemically synthesized
acaggaggctctgggcctta

SEQ ID NO: 429939 - DNA, 20 bp, Artificial Sequence
  chemically synthesized
ggctgcatttctttaaggcc

SEQ ID NO: 429940 - DNA, 20 bp, Artificial Sequence
  chemically synthesized
tagctggctgcatttcttta

SEQ ID NO: 429941 - DNA, 20 bp, Artificial Sequence
  chemically synthesized
ctagctggctgcatttcttt

SEQ ID NO: 429942 - DNA, 20 bp, Artificial Sequence
  chemically synthesized
ctctgggccttaaagaaatg

SEQ ID NO: 429943 - DNA, 20 bp, Artificial Sequence
  chemically synthesized
gggccttaaagaaatgcagc

SEQ ID NO: 429944 - DNA, 20 bp, Artificial Sequence
  chemically synthesized
cttaaagaaatgcagccagc

SEQ ID NO: 429945 - DNA, 20 bp, Artificial Sequence
  chemically synthesized
aagaaatgcagccagctagc

SEQ ID NO: 429946 - DNA, 20 bp, Artificial Sequence
  chemically synthesized
agaaatgcagccagctagcc

SEQ ID NO: 429947 - DNA, 20 bp, Artificial Sequence
  chemically synthesized
agccaccatgcccggctagc

SEQ ID NO: 429948 - DNA, 20 bp, Artificial Sequence
  chemically synthesized
tacgagccaccatgcccggc

SEQ ID NO: 429949 - DNA, 20 bp, Artificial Sequence
  chemically synthesized
tgcagccagctagccgggca

SEQ ID NO: 429950 - DNA, 20 bp, Artificial Sequence
  chemically synthesized
agccagctagccgggcatgg

SEQ ID NO: 429951 - DNA, 20 bp, Artificial Sequence
  chemically synthesized
cagatacgagccaccatgcc

SEQ ID NO: 429952 - DNA, 20 bp, Artificial Sequence
  chemically synthesized
aatgctaggagtacagatac

SEQ ID NO: 429953 - DNA, 20 bp, Artificial Sequence
  chemically synthesized
gtggctcgtatctgtactcc

SEQ ID NO: 429954 - DNA, 20 bp, Artificial Sequence
  chemically synthesized
cttccaaaatgctaggagta

SEQ ID NO: 429955 - DNA, 20 bp, Artificial Sequence
  chemically synthesized
ttggccttccaaaatgctag

SEQ ID NO: 429956 - DNA, 20 bp, Artificial Sequence
  chemically synthesized
tatctgtactcctagcattt

SEQ ID NO: 429957 - DNA, 20 bp, Artificial Sequence
  chemically synthesized
ccttggccttccaaaatgct

SEQ ID NO: 429958 - DNA, 20 bp, Artificial Sequence
  chemically synthesized
accttggccttccaaaatgc

SEQ ID NO: 429959 - DNA, 20 bp, Artificial Sequence
  chemically synthesized
ctgtactcctagcattttgg

SEQ ID NO: 429960 - DNA, 20 bp, Artificial Sequence
  chemically synthesized
tgtactcctagcattttgga

SEQ ID NO: 429961 - DNA, 20 bp, Artificial Sequence
  chemically synthesized
tcctagcattttggaaggcc

SEQ ID NO: 429962 - DNA, 20 bp, Artificial Sequence
  chemically synthesized
cctagcattttggaaggcca

SEQ ID NO: 429963 - DNA, 20 bp, Artificial Sequence
  chemically synthesized
agcattttggaaggccaagg

SEQ ID NO: 429964 - DNA, 20 bp, Artificial Sequence
  chemically synthesized
gcattttggaaggccaaggt

SEQ ID NO: 429965 - DNA, 20 bp, Artificial Sequence
  chemically synthesized
ttttggaaggccaaggtggg

SEQ ID NO: 429966 - DNA, 20 bp, Artificial Sequence
  chemically synthesized
ctcaagtgatcttcccacct

SEQ ID NO: 429967 - DNA, 20 bp, Artificial Sequence
  chemically synthesized
ccaaggtgggaagatcactt

SEQ ID NO: 429968 - DNA, 20 bp, Artificial Sequence
  chemically synthesized
caaggtgggaagatcacttg

SEQ ID NO: 429969 - DNA, 20 bp, Artificial Sequence
  chemically synthesized
tgggaagatcacttgaggcc

SEQ ID NO: 429970 - DNA, 20 bp, Artificial Sequence
  chemically synthesized
ggtctcaaactctgggcctc

SEQ ID NO: 429971 - DNA, 20 bp, Artificial Sequence
  chemically synthesized
ggaagatcacttgaggccca

SEQ ID NO: 429972 - DNA, 20 bp, Artificial Sequence
  chemically synthesized
tcacttgaggcccagagttt

SEQ ID NO: 429973 - DNA, 20 bp, Artificial Sequence
  chemically synthesized
ccaggctggtctcaaactct

SEQ ID NO: 429974 - DNA, 20 bp, Artificial Sequence
  chemically synthesized
cccaggctggtctcaaactc

SEQ ID NO: 429975 - DNA, 20 bp, Artificial Sequence
  chemically synthesized
tgaggcccagagtttgagac

SEQ ID NO: 429976 - DNA, 20 bp, Artificial Sequence
  chemically synthesized
cccagagtttgagaccagcc

SEQ ID NO: 429977 - DNA, 20 bp, Artificial Sequence
  chemically synthesized
ccagagtttgagaccagcct

SEQ ID NO: 429978 - DNA, 20 bp, Artificial Sequence
  chemically synthesized
tctccctgtgttgcccaggc

SEQ ID NO: 429979 - DNA, 20 bp, Artificial Sequence
  chemically synthesized
ggcatctccctgtgttgccc

SEQ ID NO: 429980 - DNA, 20 bp, Artificial Sequence
  chemically synthesized
tgagaccagcctgggcaaca

SEQ ID NO: 429981 - DNA, 20 bp, Artificial Sequence
  chemically synthesized
tggcatctccctgtgttgcc

SEQ ID NO: 429982 - DNA, 20 bp, Artificial Sequence
  chemically synthesized
gagaccagcctgggcaacac

SEQ ID NO: 429983 - DNA, 20 bp, Artificial Sequence
  chemically synthesized
agaccagcctgggcaacaca

SEQ ID NO: 429984 - DNA, 20 bp, Artificial Sequence
  chemically synthesized
accagcctgggcaacacagg

SEQ ID NO: 429985 - DNA, 20 bp, Artificial Sequence
  chemically synthesized
tttttttttctttgtagaga

SEQ ID NO: 429986 - DNA, 20 bp, Artificial Sequence
  chemically synthesized
agggagatgccatctctaca

SEQ ID NO: 429987 - DNA, 20 bp, Artificial Sequence
  chemically synthesized
tttttttttttttctttgta

SEQ ID NO: 429988 - DNA, 20 bp, Artificial Sequence
  chemically synthesized
aatttttttttttttctttg

SEQ ID NO: 429989 - DNA, 20 bp, Artificial Sequence
  chemically synthesized
agaaaaaaaaaaaaattaac

SEQ ID NO: 429990 - DNA, 20 bp, Artificial Sequence
  chemically synthesized
gaaaaaaaaaaaaattaacc

SEQ ID NO: 429991 - DNA, 20 bp, Artificial Sequence
  chemically synthesized
aaaaaaaaattaaccaggca

SEQ ID NO: 429992 - DNA, 20 bp, Artificial Sequence
  chemically synthesized
aaaaaaaattaaccaggcat

SEQ ID NO: 429993 - DNA, 20 bp, Artificial Sequence
  chemically synthesized
ctcctgtttcagcccatgcc

SEQ ID NO: 429994 - DNA, 20 bp, Artificial Sequence
  chemically synthesized
taaccaggcatgggctgaaa

SEQ ID NO: 429995 - DNA, 20 bp, Artificial Sequence
  chemically synthesized
aaccaggcatgggctgaaac

SEQ ID NO: 429996 - DNA, 20 bp, Artificial Sequence
  chemically synthesized
ccaggcatgggctgaaacag

SEQ ID NO: 429997 - DNA, 20 bp, Artificial Sequence
  chemically synthesized
caggcatgggctgaaacagg

SEQ ID NO: 429998 - DNA, 20 bp, Artificial Sequence
  chemically synthesized
ctaaagtgatcctcctgttt

SEQ ID NO: 429999 - DNA, 20 bp, Artificial Sequence
  chemically synthesized
ctgaaacaggaggatcactt

SEQ ID NO: 430000 - DNA, 20 bp, Artificial Sequence
  chemically synthesized
acaggaggatcactttagcc

SEQ ID NO: 430001 - DNA, 20 bp, Artificial Sequence
  chemically synthesized
caggaggatcactttagccc

SEQ ID NO: 430002 - DNA, 20 bp, Artificial Sequence
  chemically synthesized
agcctcaaactcctgggcta

SEQ ID NO: 430003 - DNA, 20 bp, Artificial Sequence
  chemically synthesized
ggaggatcactttagcccag

SEQ ID NO: 430004 - DNA, 20 bp, Artificial Sequence
  chemically synthesized
cactgaagcctcaaactcct

SEQ ID NO: 430005 - DNA, 20 bp, Artificial Sequence
  chemically synthesized
tcactttagcccaggagttt

SEQ ID NO: 430006 - DNA, 20 bp, Artificial Sequence
  chemically synthesized
tcactgaagcctcaaactcc

SEQ ID NO: 430007 - DNA, 20 bp, Artificial Sequence
  chemically synthesized
cactttagcccaggagtttg

SEQ ID NO: 430008 - DNA, 20 bp, Artificial Sequence
  chemically synthesized
agcccaggagtttgaggctt

SEQ ID NO: 430009 - DNA, 20 bp, Artificial Sequence
  chemically synthesized
caggagtttgaggcttcagt

SEQ ID NO: 430010 - DNA, 20 bp, Artificial Sequence
  chemically synthesized
gagtttgaggcttcagtgag

SEQ ID NO: 430011 - DNA, 20 bp, Artificial Sequence
  chemically synthesized
gtggcgcgatctgctcactg

SEQ ID NO: 430012 - DNA, 20 bp, Artificial Sequence
  chemically synthesized
tcacttgggctgaagcgtgg

SEQ ID NO: 430013 - DNA, 20 bp, Artificial Sequence
  chemically synthesized
cagatcgcgccaccacgctt

SEQ ID NO: 430014 - DNA, 20 bp, Artificial Sequence
  chemically synthesized
ctgtcacttgggctgaagcg

SEQ ID NO: 430015 - DNA, 20 bp, Artificial Sequence
  chemically synthesized
gcgccaccacgcttcagccc

SEQ ID NO: 430016 - DNA, 20 bp, Artificial Sequence
  chemically synthesized
ttgctctgtcacttgggctg

SEQ ID NO: 430017 - DNA, 20 bp, Artificial Sequence
  chemically synthesized
ccacgcttcagcccaagtga

SEQ ID NO: 430018 - DNA, 20 bp, Artificial Sequence
  chemically synthesized
gaggtcttgctctgtcactt

SEQ ID NO: 430019 - DNA, 20 bp, Artificial Sequence
  chemically synthesized
acgcttcagcccaagtgaca

SEQ ID NO: 430020 - DNA, 20 bp, Artificial Sequence
  chemically synthesized
tgaggtcttgctctgtcact

SEQ ID NO: 430021 - DNA, 20 bp, Artificial Sequence
  chemically synthesized
ttcagcccaagtgacagagc

SEQ ID NO: 430022 - DNA, 20 bp, Artificial Sequence
  chemically synthesized
ttatttattttttagaaatg

SEQ ID NO: 430023 - DNA, 20 bp, Artificial Sequence
  chemically synthesized
tttatttattttttagaaat

SEQ ID NO: 430024 - DNA, 20 bp, Artificial Sequence
  chemically synthesized
ttattcatttatttattttt

SEQ ID NO: 430025 - DNA, 20 bp, Artificial Sequence
  chemically synthesized
taaaaaataaataaatgaat

SEQ ID NO: 430026 - DNA, 20 bp, Artificial Sequence
  chemically synthesized
aaataaataaatgaataaga

SEQ ID NO: 430027 - DNA, 20 bp, Artificial Sequence
  chemically synthesized
aaatgaataagaaagaaatg

SEQ ID NO: 430028 - DNA, 20 bp, Artificial Sequence
  chemically synthesized
aagaaagaaatgcagccact

SEQ ID NO: 430029 - DNA, 20 bp, Artificial Sequence
  chemically synthesized
aaaacagcattggttccaag

SEQ ID NO: 430030 - DNA, 20 bp, Artificial Sequence
  chemically synthesized
tgaaaaacagcattggttcc

SEQ ID NO: 430031 - DNA, 20 bp, Artificial Sequence
  chemically synthesized
aaagatctgaaaaacagcat

SEQ ID NO: 430032 - DNA, 20 bp, Artificial Sequence
  chemically synthesized
ttggaaccaatgctgttttt

SEQ ID NO: 430033 - DNA, 20 bp, Artificial Sequence
  chemically synthesized
aggctcaaagatctgaaaaa

SEQ ID NO: 430034 - DNA, 20 bp, Artificial Sequence
  chemically synthesized
atgctgtttttcagatcttt

SEQ ID NO: 430035 - DNA, 20 bp, Artificial Sequence
  chemically synthesized
taatgttactgagaggctca

SEQ ID NO: 430036 - DNA, 20 bp, Artificial Sequence
  chemically synthesized
tttcagatctttgagcctct

SEQ ID NO: 430037 - DNA, 20 bp, Artificial Sequence
  chemically synthesized
tcttaattaatgttactgag

SEQ ID NO: 430038 - DNA, 20 bp, Artificial Sequence
  chemically synthesized
ttcttaattaatgttactga

SEQ ID NO: 430039 - DNA, 20 bp, Artificial Sequence
  chemically synthesized
ggttcttaattaatgttact

SEQ ID NO: 430040 - DNA, 20 bp, Artificial Sequence
  chemically synthesized
gcctctcagtaacattaatt

SEQ ID NO: 430041 - DNA, 20 bp, Artificial Sequence
  chemically synthesized
gtaacattaattaagaaccc

SEQ ID NO: 430042 - DNA, 20 bp, Artificial Sequence
  chemically synthesized
gttagtatatttatttacca

SEQ ID NO: 430043 - DNA, 20 bp, Artificial Sequence
  chemically synthesized
ggttagtatatttatttacc

SEQ ID NO: 430044 - DNA, 20 bp, Artificial Sequence
  chemically synthesized
tggttagtatatttatttac

SEQ ID NO: 430045 - DNA, 20 bp, Artificial Sequence
  chemically synthesized
tggtaaataaatatactaac

SEQ ID NO: 430046 - DNA, 20 bp, Artificial Sequence
  chemically synthesized
taaataaatatactaaccag

SEQ ID NO: 430047 - DNA, 20 bp, Artificial Sequence
  chemically synthesized
caattattcttgccactggt

SEQ ID NO: 430048 - DNA, 20 bp, Artificial Sequence
  chemically synthesized
taaatatactaaccagtggc

SEQ ID NO: 430049 - DNA, 20 bp, Artificial Sequence
  chemically synthesized
cagtcaattattcttgccac

SEQ ID NO: 430050 - DNA, 20 bp, Artificial Sequence
  chemically synthesized
caagaataattgactgcaaa

SEQ ID NO: 430051 - DNA, 20 bp, Artificial Sequence
  chemically synthesized
ataaaacattcagccatttg

SEQ ID NO: 430052 - DNA, 20 bp, Artificial Sequence
  chemically synthesized
agtgaaaataataaaacatt

SEQ ID NO: 430053 - DNA, 20 bp, Artificial Sequence
  chemically synthesized
caaaaacttctatttaaaaa

SEQ ID NO: 430054 - DNA, 20 bp, Artificial Sequence
  chemically synthesized
ttattttcactttttttaaa

SEQ ID NO: 430055 - DNA, 20 bp, Artificial Sequence
  chemically synthesized
ttttcactttttttaaatag

SEQ ID NO: 430056 - DNA, 20 bp, Artificial Sequence
  chemically synthesized
tagaagtttttgacaacata

SEQ ID NO: 430057 - DNA, 20 bp, Artificial Sequence
  chemically synthesized
agaagtttttgacaacataa

SEQ ID NO: 430058 - DNA, 20 bp, Artificial Sequence
  chemically synthesized
caacataaaggccttaccca

SEQ ID NO: 430059 - DNA, 20 bp, Artificial Sequence
  chemically synthesized
aacataaaggccttacccaa

SEQ ID NO: 430060 - DNA, 20 bp, Artificial Sequence
  chemically synthesized
tattgttattcctttgggta

SEQ ID NO: 430061 - DNA, 20 bp, Artificial Sequence
  chemically synthesized
ttattgttattcctttgggt

SEQ ID NO: 430062 - DNA, 20 bp, Artificial Sequence
  chemically synthesized
attattattgttattccttt

SEQ ID NO: 430063 - DNA, 20 bp, Artificial Sequence
  chemically synthesized
cattattattgttattcctt

SEQ ID NO: 430064 - DNA, 20 bp, Artificial Sequence
  chemically synthesized
ggaataacaataataatgaa

SEQ ID NO: 430065 - DNA, 20 bp, Artificial Sequence
  chemically synthesized
aataacaataataatgaaaa

SEQ ID NO: 430066 - DNA, 20 bp, Artificial Sequence
  chemically synthesized
acaataataatgaaaagagc

SEQ ID NO: 430067 - DNA, 20 bp, Artificial Sequence
  chemically synthesized
ctgtgattttgtgaacacaa

SEQ ID NO: 430068 - DNA, 20 bp, Artificial Sequence
  chemically synthesized
ccattgtgttcacaaaatca

SEQ ID NO: 430069 - DNA, 20 bp, Artificial Sequence
  chemically synthesized
agtattctcagagatgaaaa

SEQ ID NO: 430070 - DNA, 20 bp, Artificial Sequence
  chemically synthesized
gagtattctcagagatgaaa

SEQ ID NO: 430071 - DNA, 20 bp, Artificial Sequence
  chemically synthesized
aataatcctttttcatctct

SEQ ID NO: 430072 - DNA, 20 bp, Artificial Sequence
  chemically synthesized
caagttttggagtattctca

SEQ ID NO: 430073 - DNA, 20 bp, Artificial Sequence
  chemically synthesized
gacaagttttggagtattct

SEQ ID NO: 430074 - DNA, 20 bp, Artificial Sequence
  chemically synthesized
actcagatggacaagttttg

SEQ ID NO: 430075 - DNA, 20 bp, Artificial Sequence
  chemically synthesized
atactcagatggacaagttt

SEQ ID NO: 430076 - DNA, 20 bp, Artificial Sequence
  chemically synthesized
ccattgatactcagatggac

SEQ ID NO: 430077 - DNA, 20 bp, Artificial Sequence
  chemically synthesized
actccaaaacttgtccatct

SEQ ID NO: 430078 - DNA, 20 bp, Artificial Sequence
  chemically synthesized
attttccattgatactcaga

SEQ ID NO: 430079 - DNA, 20 bp, Artificial Sequence
  chemically synthesized
caagattttccattgatact

SEQ ID NO: 430080 - DNA, 20 bp, Artificial Sequence
  chemically synthesized
cttgtccatctgagtatcaa

SEQ ID NO: 430081 - DNA, 20 bp, Artificial Sequence
  chemically synthesized
aattccttttaataaagagc

SEQ ID NO: 430082 - DNA, 20 bp, Artificial Sequence
  chemically synthesized
gaagaattccttttaataaa

SEQ ID NO: 430083 - DNA, 20 bp, Artificial Sequence
  chemically synthesized
aaaatcttgctctttattaa

SEQ ID NO: 430084 - DNA, 20 bp, Artificial Sequence
  chemically synthesized
aaatcttgctctttattaaa

SEQ ID NO: 430085 - DNA, 20 bp, Artificial Sequence
  chemically synthesized
gtgaagaattccttttaata

SEQ ID NO: 430086 - DNA, 20 bp, Artificial Sequence
  chemically synthesized
agcttttctgaacattagtg

SEQ ID NO: 430087 - DNA, 20 bp, Artificial Sequence
  chemically synthesized
aggaattcttcactaatgtt

SEQ ID NO: 430088 - DNA, 20 bp, Artificial Sequence
  chemically synthesized
tcctcagcttttctgaacat

SEQ ID NO: 430089 - DNA, 20 bp, Artificial Sequence
  chemically synthesized
ttcttcactaatgttcagaa

SEQ ID NO: 430090 - DNA, 20 bp, Artificial Sequence
  chemically synthesized
cactaatgttcagaaaagct

SEQ ID NO: 430091 - DNA, 20 bp, Artificial Sequence
  chemically synthesized
actaatgttcagaaaagctg

SEQ ID NO: 430092 - DNA, 20 bp, Artificial Sequence
  chemically synthesized
agtgatgtaagtacattcct

SEQ ID NO: 430093 - DNA, 20 bp, Artificial Sequence
  chemically synthesized
agtagtgacggtagtgatgt

SEQ ID NO: 430094 - DNA, 20 bp, Artificial Sequence
  chemically synthesized
gcatactctagtagtgacgg

SEQ ID NO: 430095 - DNA, 20 bp, Artificial Sequence
  chemically synthesized
tacatcactaccgtcactac

SEQ ID NO: 430096 - DNA, 20 bp, Artificial Sequence
  chemically synthesized
agtgcatactctagtagtga

SEQ ID NO: 430097 - DNA, 20 bp, Artificial Sequence
  chemically synthesized
catcactaccgtcactacta

SEQ ID NO: 430098 - DNA, 20 bp, Artificial Sequence
  chemically synthesized
gccaccagtgcatactctag

SEQ ID NO: 430099 - DNA, 20 bp, Artificial Sequence
  chemically synthesized
ttagccaccagtgcatactc

SEQ ID NO: 430100 - DNA, 20 bp, Artificial Sequence
  chemically synthesized
gtcactactagagtatgcac

SEQ ID NO: 430101 - DNA, 20 bp, Artificial Sequence
  chemically synthesized
actactagagtatgcactgg

SEQ ID NO: 430102 - DNA, 20 bp, Artificial Sequence
  chemically synthesized
tgttaggacattttagccac

SEQ ID NO: 430103 - DNA, 20 bp, Artificial Sequence
  chemically synthesized
aagaagttgttaggacattt

SEQ ID NO: 430104 - DNA, 20 bp, Artificial Sequence
  chemically synthesized
tgagccctgaagaagttgtt

SEQ ID NO: 430105 - DNA, 20 bp, Artificial Sequence
  chemically synthesized
ttgagccctgaagaagttgt

SEQ ID NO: 430106 - DNA, 20 bp, Artificial Sequence
  chemically synthesized
aaatgtcctaacaacttctt

SEQ ID NO: 430107 - DNA, 20 bp, Artificial Sequence
  chemically synthesized
aatgtcctaacaacttcttc

SEQ ID NO: 430108 - DNA, 20 bp, Artificial Sequence
  chemically synthesized
atgtcctaacaacttcttca

SEQ ID NO: 430109 - DNA, 20 bp, Artificial Sequence
  chemically synthesized
aaaatatttgagccctgaag

SEQ ID NO: 430110 - DNA, 20 bp, Artificial Sequence
  chemically synthesized
cctaaaatatttgagccctg

SEQ ID NO: 430111 - DNA, 20 bp, Artificial Sequence
  chemically synthesized
ttcaaagccctaaaatattt

SEQ ID NO: 430112 - DNA, 20 bp, Artificial Sequence
  chemically synthesized
tcttcagggctcaaatattt

SEQ ID NO: 430113 - DNA, 20 bp, Artificial Sequence
  chemically synthesized
cttcagggctcaaatatttt

SEQ ID NO: 430114 - DNA, 20 bp, Artificial Sequence
  chemically synthesized
ttcagggctcaaatatttta

SEQ ID NO: 430115 - DNA, 20 bp, Artificial Sequence
  chemically synthesized
tttacacatctttgaattca

SEQ ID NO: 430116 - DNA, 20 bp, Artificial Sequence
  chemically synthesized
attttagggctttgaattca

SEQ ID NO: 430117 - DNA, 20 bp, Artificial Sequence
  chemically synthesized
gaattcaaagatgtgtaaaa

SEQ ID NO: 430118 - DNA, 20 bp, Artificial Sequence
  chemically synthesized
attcaaagatgtgtaaaata

SEQ ID NO: 430119 - DNA, 20 bp, Artificial Sequence
  chemically synthesized
aaaatagagtctctgtcttc

SEQ ID NO: 430120 - DNA, 20 bp, Artificial Sequence
  chemically synthesized
ttataaagtccttgaagaca

SEQ ID NO: 430121 - DNA, 20 bp, Artificial Sequence
  chemically synthesized
aaatagagtctctgtcttca

SEQ ID NO: 430122 - DNA, 20 bp, Artificial Sequence
  chemically synthesized
agttataaagtccttgaaga

SEQ ID NO: 430123 - DNA, 20 bp, Artificial Sequence
  chemically synthesized
tagaagttataaagtccttg

SEQ ID NO: 430124 - DNA, 20 bp, Artificial Sequence
  chemically synthesized
ccatatgcatagaagttata

SEQ ID NO: 430125 - DNA, 20 bp, Artificial Sequence
  chemically synthesized
agcacataccatatgcatag

SEQ ID NO: 430126 - DNA, 20 bp, Artificial Sequence
  chemically synthesized
ctttataacttctatgcata

SEQ ID NO: 430127 - DNA, 20 bp, Artificial Sequence
  chemically synthesized
gctagcacataccatatgca

SEQ ID NO: 430128 - DNA, 20 bp, Artificial Sequence
  chemically synthesized
tctatgcatatggtatgtgc

SEQ ID NO: 430129 - DNA, 20 bp, Artificial Sequence
  chemically synthesized
gcatatggtatgtgctagcg

SEQ ID NO: 430130 - DNA, 20 bp, Artificial Sequence
  chemically synthesized
aactcttccatcatccacgc

SEQ ID NO: 430131 - DNA, 20 bp, Artificial Sequence
  chemically synthesized
gtatgtgctagcgtggatga

SEQ ID NO: 430132 - DNA, 20 bp, Artificial Sequence
  chemically synthesized
tgtgctagcgtggatgatgg

SEQ ID NO: 430133 - DNA, 20 bp, Artificial Sequence
  chemically synthesized
tgctagcgtggatgatggaa

SEQ ID NO: 430134 - DNA, 20 bp, Artificial Sequence
  chemically synthesized
gttacatttaaccttcacca

SEQ ID NO: 430135 - DNA, 20 bp, Artificial Sequence
  chemically synthesized
aaatcttcctgccatggtga

SEQ ID NO: 430136 - DNA, 20 bp, Artificial Sequence
  chemically synthesized
taaatcttcctgccatggtg

SEQ ID NO: 430137 - DNA, 20 bp, Artificial Sequence
  chemically synthesized
acatttaaccttcaccatgg

SEQ ID NO: 430138 - DNA, 20 bp, Artificial Sequence
  chemically synthesized
catttaaccttcaccatggc

SEQ ID NO: 430139 - DNA, 20 bp, Artificial Sequence
  chemically synthesized
ttaaccttcaccatggcagg

SEQ ID NO: 430140 - DNA, 20 bp, Artificial Sequence
  chemically synthesized
cccaataaatcttcctgcca

SEQ ID NO: 430141 - DNA, 20 bp, Artificial Sequence
  chemically synthesized
accatggcaggaagatttat

SEQ ID NO: 430142 - DNA, 20 bp, Artificial Sequence
  chemically synthesized
ccatggcaggaagatttatt

SEQ ID NO: 430143 - DNA, 20 bp, Artificial Sequence
  chemically synthesized
catggcaggaagatttattg

SEQ ID NO: 430144 - DNA, 20 bp, Artificial Sequence
  chemically synthesized
atggcaggaagatttattgg

SEQ ID NO: 430145 - DNA, 20 bp, Artificial Sequence
  chemically synthesized
ggcaggaagatttattgggg

SEQ ID NO: 430146 - DNA, 20 bp, Artificial Sequence
  chemically synthesized
ttgggggagataaaactttg

SEQ ID NO: 430147 - DNA, 20 bp, Artificial Sequence
  chemically synthesized
ggagataaaactttgaagat

SEQ ID NO: 430148 - DNA, 20 bp, Artificial Sequence
  chemically synthesized
ggctctcttgcttatcttca

SEQ ID NO: 430149 - DNA, 20 bp, Artificial Sequence
  chemically synthesized
ataaaactttgaagataagc

SEQ ID NO: 430150 - DNA, 20 bp, Artificial Sequence
  chemically synthesized
aaaactttgaagataagcaa

SEQ ID NO: 430151 - DNA, 20 bp, Artificial Sequence
  chemically synthesized
aactttgaagataagcaaga

SEQ ID NO: 430152 - DNA, 20 bp, Artificial Sequence
  chemically synthesized
ttgaagataagcaagagagc

SEQ ID NO: 430153 - DNA, 20 bp, Artificial Sequence
  chemically synthesized
actttgttttatttttaatc

SEQ ID NO: 430154 - DNA, 20 bp, Artificial Sequence
  chemically synthesized
gccagattaaaaataaaaca

SEQ ID NO: 430155 - DNA, 20 bp, Artificial Sequence
  chemically synthesized
agattaaaaataaaacaaag

SEQ ID NO: 430156 - DNA, 20 bp, Artificial Sequence
  chemically synthesized
ttaaaaataaaacaaagtag

SEQ ID NO: 430157 - DNA, 20 bp, Artificial Sequence
  chemically synthesized
taaaaataaaacaaagtaga

SEQ ID NO: 430158 - DNA, 20 bp, Artificial Sequence
  chemically synthesized
aaaataaaacaaagtagaag

SEQ ID NO: 430159 - DNA, 20 bp, Artificial Sequence
  chemically synthesized
aaataaaacaaagtagaagg

SEQ ID NO: 430160 - DNA, 20 bp, Artificial Sequence
  chemically synthesized
aaaacaaagtagaaggagga

SEQ ID NO: 430161 - DNA, 20 bp, Artificial Sequence
  chemically synthesized
aaagtagaaggaggaaagaa

SEQ ID NO: 430162 - DNA, 20 bp, Artificial Sequence
  chemically synthesized
aagtagaaggaggaaagaat

SEQ ID NO: 430163 - DNA, 20 bp, Artificial Sequence
  chemically synthesized
gaggaaagaatgggtgtttc

SEQ ID NO: 430164 - DNA, 20 bp, Artificial Sequence
  chemically synthesized
atataatgtgctcttgctga

SEQ ID NO: 430165 - DNA, 20 bp, Artificial Sequence
  chemically synthesized
aaagaattacccatcagcaa

SEQ ID NO: 430166 - DNA, 20 bp, Artificial Sequence
  chemically synthesized
tataatgtgctcttgctgat

SEQ ID NO: 430167 - DNA, 20 bp, Artificial Sequence
  chemically synthesized
acaaagaattacccatcagc

SEQ ID NO: 430168 - DNA, 20 bp, Artificial Sequence
  chemically synthesized
atacacaaagaattacccat

SEQ ID NO: 430169 - DNA, 20 bp, Artificial Sequence
  chemically synthesized
taggagtatgaaaatacaca

SEQ ID NO: 430170 - DNA, 20 bp, Artificial Sequence
  chemically synthesized
tgtattttcatactcctatt

SEQ ID NO: 430171 - DNA, 20 bp, Artificial Sequence
  chemically synthesized
aataggtacacactaaatag

SEQ ID NO: 430172 - DNA, 20 bp, Artificial Sequence
  chemically synthesized
aaaataggtacacactaaat

SEQ ID NO: 430173 - DNA, 20 bp, Artificial Sequence
  chemically synthesized
aaaaataggtacacactaaa

SEQ ID NO: 430174 - DNA, 20 bp, Artificial Sequence
  chemically synthesized
cgatatactgtgagaaaaat

SEQ ID NO: 430175 - DNA, 20 bp, Artificial Sequence
  chemically synthesized
tcgatatactgtgagaaaaa

SEQ ID NO: 430176 - DNA, 20 bp, Artificial Sequence
  chemically synthesized
gtgtgtacctatttttctca

SEQ ID NO: 430177 - DNA, 20 bp, Artificial Sequence
  chemically synthesized
agcgtatttcgatatactgt

SEQ ID NO: 430178 - DNA, 20 bp, Artificial Sequence
  chemically synthesized
tacccgaggaagtcagataa

SEQ ID NO: 430179 - DNA, 20 bp, Artificial Sequence
  chemically synthesized
acgctattatctgacttcct

SEQ ID NO: 430180 - DNA, 20 bp, Artificial Sequence
  chemically synthesized
gtagacttacccgaggaagt

SEQ ID NO: 430181 - DNA, 20 bp, Artificial Sequence
  chemically synthesized
cgctattatctgacttcctc

SEQ ID NO: 430182 - DNA, 20 bp, Artificial Sequence
  chemically synthesized
tcttgtagacttacccgagg

SEQ ID NO: 430183 - DNA, 20 bp, Artificial Sequence
  chemically synthesized
attatctgacttcctcgggt

SEQ ID NO: 430184 - DNA, 20 bp, Artificial Sequence
  chemically synthesized
tggtcttgtagacttacccg

SEQ ID NO: 430185 - DNA, 20 bp, Artificial Sequence
  chemically synthesized
ttggtcttgtagacttaccc

SEQ ID NO: 430186 - DNA, 20 bp, Artificial Sequence
  chemically synthesized
acttcctcgggtaagtctac

SEQ ID NO: 430187 - DNA, 20 bp, Artificial Sequence
  chemically synthesized
ttattgtatatttggtcttg

SEQ ID NO: 430188 - DNA, 20 bp, Artificial Sequence
  chemically synthesized
tagatttgttattgtatatt

SEQ ID NO: 430189 - DNA, 20 bp, Artificial Sequence
  chemically synthesized
tatacaataacaaatctatt

SEQ ID NO: 430190 - DNA, 20 bp, Artificial Sequence
  chemically synthesized
acaataacaaatctattgag

SEQ ID NO: 430191 - DNA, 20 bp, Artificial Sequence
  chemically synthesized
aaataactgtatcttctcaa

SEQ ID NO: 430192 - DNA, 20 bp, Artificial Sequence
  chemically synthesized
acaaatctattgagaagata

SEQ ID NO: 430193 - DNA, 20 bp, Artificial Sequence
  chemically synthesized
gatacagttatttacatgca

SEQ ID NO: 430194 - DNA, 20 bp, Artificial Sequence
  chemically synthesized
acagttatttacatgcacag

SEQ ID NO: 430195 - DNA, 20 bp, Artificial Sequence
  chemically synthesized
cagttatttacatgcacaga

SEQ ID NO: 430196 - DNA, 20 bp, Artificial Sequence
  chemically synthesized
catgcacagaaggttattgt

SEQ ID NO: 430197 - DNA, 20 bp, Artificial Sequence
  chemically synthesized
atcagcaagggcatttgata

SEQ ID NO: 430198 - DNA, 20 bp, Artificial Sequence
  chemically synthesized
atatcagcaagggcatttga

SEQ ID NO: 430199 - DNA, 20 bp, Artificial Sequence
  chemically synthesized
ggtcaggccaatatcagcaa

SEQ ID NO: 430200 - DNA, 20 bp, Artificial Sequence
  chemically synthesized
gggtcaggccaatatcagca

SEQ ID NO: 430201 - DNA, 20 bp, Artificial Sequence
  chemically synthesized
tgggtcaggccaatatcagc

SEQ ID NO: 430202 - DNA, 20 bp, Artificial Sequence
  chemically synthesized
tcaaatgcccttgctgatat

SEQ ID NO: 430203 - DNA, 20 bp, Artificial Sequence
  chemically synthesized
attgtgggtcaggccaatat

SEQ ID NO: 430204 - DNA, 20 bp, Artificial Sequence
  chemically synthesized
aaacgtttgaattgtgggtc

SEQ ID NO: 430205 - DNA, 20 bp, Artificial Sequence
  chemically synthesized
caaacgtttgaattgtgggt

SEQ ID NO: 430206 - DNA, 20 bp, Artificial Sequence
  chemically synthesized
tacccaaacgtttgaattgt

SEQ ID NO: 430207 - DNA, 20 bp, Artificial Sequence
  chemically synthesized
gtacccaaacgtttgaattg

SEQ ID NO: 430208 - DNA, 20 bp, Artificial Sequence
  chemically synthesized
tgacccacaattcaaacgtt

SEQ ID NO: 430209 - DNA, 20 bp, Artificial Sequence
  chemically synthesized
gacccacaattcaaacgttt

SEQ ID NO: 430210 - DNA, 20 bp, Artificial Sequence
  chemically synthesized
tcaaacgtttgggtaccttc

SEQ ID NO: 430211 - DNA, 20 bp, Artificial Sequence
  chemically synthesized
aaatacagacattttcttga

SEQ ID NO: 430212 - DNA, 20 bp, Artificial Sequence
  chemically synthesized
aaaatacagacattttcttg

SEQ ID NO: 430213 - DNA, 20 bp, Artificial Sequence
  chemically synthesized
tcaaaggacattaaaaaata

SEQ ID NO: 430214 - DNA, 20 bp, Artificial Sequence
  chemically synthesized
gactagagtaataatttcaa

SEQ ID NO: 430215 - DNA, 20 bp, Artificial Sequence
  chemically synthesized
tgactagagtaataatttca

SEQ ID NO: 430216 - DNA, 20 bp, Artificial Sequence
  chemically synthesized
gtcctttgaaattattactc

SEQ ID NO: 430217 - DNA, 20 bp, Artificial Sequence
  chemically synthesized
tatcgtataatgcatgacta

SEQ ID NO: 430218 - DNA, 20 bp, Artificial Sequence
  chemically synthesized
tttatcgtataatgcatgac

SEQ ID NO: 430219 - DNA, 20 bp, Artificial Sequence
  chemically synthesized
agtcatgcattatacgataa

SEQ ID NO: 430220 - DNA, 20 bp, Artificial Sequence
  chemically synthesized
cttactgttccattggacat

SEQ ID NO: 430221 - DNA, 20 bp, Artificial Sequence
  chemically synthesized
tacacgaaactgatgtccaa

SEQ ID NO: 430222 - DNA, 20 bp, Artificial Sequence
  chemically synthesized
gaaactgatgtccaatggaa

SEQ ID NO: 430223 - DNA, 20 bp, Artificial Sequence
  chemically synthesized
gtcaaagcttactgttccat

SEQ ID NO: 430224 - DNA, 20 bp, Artificial Sequence
  chemically synthesized
ctgatgtccaatggaacagt

SEQ ID NO: 430225 - DNA, 20 bp, Artificial Sequence
  chemically synthesized
aatggaacagtaagctttga

SEQ ID NO: 430226 - DNA, 20 bp, Artificial Sequence
  chemically synthesized
ataaagaatgtgaactgtca

SEQ ID NO: 430227 - DNA, 20 bp, Artificial Sequence
  chemically synthesized
ttgacagttcacattcttta

SEQ ID NO: 430228 - DNA, 20 bp, Artificial Sequence
  chemically synthesized
taaacatcttattatctata

SEQ ID NO: 430229 - DNA, 20 bp, Artificial Sequence
  chemically synthesized
tcacattctttatagataat

SEQ ID NO: 430230 - DNA, 20 bp, Artificial Sequence
  chemically synthesized
cgcaggaaactaatacatca

SEQ ID NO: 430231 - DNA, 20 bp, Artificial Sequence
  chemically synthesized
aattcatttccatgatgtat

SEQ ID NO: 430232 - DNA, 20 bp, Artificial Sequence
  chemically synthesized
catgatgtattagtttcctg

SEQ ID NO: 430233 - DNA, 20 bp, Artificial Sequence
  chemically synthesized
tactttttaacagcagccgc

SEQ ID NO: 430234 - DNA, 20 bp, Artificial Sequence
  chemically synthesized
gtactttttaacagcagccg

SEQ ID NO: 430235 - DNA, 20 bp, Artificial Sequence
  chemically synthesized
tttgtagtactttttaacag

SEQ ID NO: 430236 - DNA, 20 bp, Artificial Sequence
  chemically synthesized
ttcctgcggctgctgttaaa

SEQ ID NO: 430237 - DNA, 20 bp, Artificial Sequence
  chemically synthesized
cagtttgtagtactttttaa

SEQ ID NO: 430238 - DNA, 20 bp, Artificial Sequence
  chemically synthesized
tgttaaaaagtactacaaac

SEQ ID NO: 430239 - DNA, 20 bp, Artificial Sequence
  chemically synthesized
gttaaaaagtactacaaact

SEQ ID NO: 430240 - DNA, 20 bp, Artificial Sequence
  chemically synthesized
tacaaaccctacccagtttg

SEQ ID NO: 430241 - DNA, 20 bp, Artificial Sequence
  chemically synthesized
aaaaagtactacaaactggg

SEQ ID NO: 430242 - DNA, 20 bp, Artificial Sequence
  chemically synthesized
aaaagtactacaaactgggt

SEQ ID NO: 430243 - DNA, 20 bp, Artificial Sequence
  chemically synthesized
aaagtactacaaactgggta

SEQ ID NO: 430244 - DNA, 20 bp, Artificial Sequence
  chemically synthesized
aaacaactacaaaccctacc

SEQ ID NO: 430245 - DNA, 20 bp, Artificial Sequence
  chemically synthesized
tacaaactgggtagggtttg

SEQ ID NO: 430246 - DNA, 20 bp, Artificial Sequence
  chemically synthesized
gtagttgtttgtttgttttt

SEQ ID NO: 430247 - DNA, 20 bp, Artificial Sequence
  chemically synthesized
tagttgtttgtttgtttttt

SEQ ID NO: 430248 - DNA, 20 bp, Artificial Sequence
  chemically synthesized
gttgtttgtttgttttttag

SEQ ID NO: 430249 - DNA, 20 bp, Artificial Sequence
  chemically synthesized
aggagaaacatattgtctcc

SEQ ID NO: 430250 - DNA, 20 bp, Artificial Sequence
  chemically synthesized
aacatattgtctcccagttc

SEQ ID NO: 430251 - DNA, 20 bp, Artificial Sequence
  chemically synthesized
cttctagccaccagaactgg

SEQ ID NO: 430252 - DNA, 20 bp, Artificial Sequence
  chemically synthesized
aacttctagccaccagaact

SEQ ID NO: 430253 - DNA, 20 bp, Artificial Sequence
  chemically synthesized
atattgtctcccagttctgg

SEQ ID NO: 430254 - DNA, 20 bp, Artificial Sequence
  chemically synthesized
gaacttctagccaccagaac

SEQ ID NO: 430255 - DNA, 20 bp, Artificial Sequence
  chemically synthesized
tgtctcccagttctggtggc

SEQ ID NO: 430256 - DNA, 20 bp, Artificial Sequence
  chemically synthesized
gattttgaacttctagccac

SEQ ID NO: 430257 - DNA, 20 bp, Artificial Sequence
  chemically synthesized
ctcccagttctggtggctag

SEQ ID NO: 430258 - DNA, 20 bp, Artificial Sequence
  chemically synthesized
atactttgattttgaacttc

SEQ ID NO: 430259 - DNA, 20 bp, Artificial Sequence
  chemically synthesized
tggctagaagttcaaaatca

SEQ ID NO: 430260 - DNA, 20 bp, Artificial Sequence
  chemically synthesized
gaagttcaaaatcaaagtat

SEQ ID NO: 430261 - DNA, 20 bp, Artificial Sequence
  chemically synthesized
gttcaaaatcaaagtattag

SEQ ID NO: 430262 - DNA, 20 bp, Artificial Sequence
  chemically synthesized
ttcaaaatcaaagtattagc

SEQ ID NO: 430263 - DNA, 20 bp, Artificial Sequence
  chemically synthesized
tcaaaatcaaagtattagca

SEQ ID NO: 430264 - DNA, 20 bp, Artificial Sequence
  chemically synthesized
tagagtattcagtgagagca

SEQ ID NO: 430265 - DNA, 20 bp, Artificial Sequence
  chemically synthesized
tctcctagagtattcagtga

SEQ ID NO: 430266 - DNA, 20 bp, Artificial Sequence
  chemically synthesized
tctctcctagagtattcagt

SEQ ID NO: 430267 - DNA, 20 bp, Artificial Sequence
  chemically synthesized
catgctctcactgaatactc

SEQ ID NO: 430268 - DNA, 20 bp, Artificial Sequence
  chemically synthesized
agactctctcctagagtatt

SEQ ID NO: 430269 - DNA, 20 bp, Artificial Sequence
  chemically synthesized
atgctctcactgaatactct

SEQ ID NO: 430270 - DNA, 20 bp, Artificial Sequence
  chemically synthesized
gctctcactgaatactctag

SEQ ID NO: 430271 - DNA, 20 bp, Artificial Sequence
  chemically synthesized
tctcactgaatactctagga

SEQ ID NO: 430272 - DNA, 20 bp, Artificial Sequence
  chemically synthesized
tcactgaatactctaggaga

SEQ ID NO: 430273 - DNA, 20 bp, Artificial Sequence
  chemically synthesized
acggaacagactctctccta

SEQ ID NO: 430274 - DNA, 20 bp, Artificial Sequence
  chemically synthesized
gcacggaacagactctctcc

SEQ ID NO: 430275 - DNA, 20 bp, Artificial Sequence
  chemically synthesized
gctaagaaagaggcacggaa

SEQ ID NO: 430276 - DNA, 20 bp, Artificial Sequence
  chemically synthesized
cagaagctaagaaagaggca

SEQ ID NO: 430277 - DNA, 20 bp, Artificial Sequence
  chemically synthesized
tctgttccgtgcctctttct

SEQ ID NO: 430278 - DNA, 20 bp, Artificial Sequence
  chemically synthesized
aataccagaagctaagaaag

SEQ ID NO: 430279 - DNA, 20 bp, Artificial Sequence
  chemically synthesized
caataccagaagctaagaaa

SEQ ID NO: 430280 - DNA, 20 bp, Artificial Sequence
  chemically synthesized
ggcaataccagaagctaaga

SEQ ID NO: 430281 - DNA, 20 bp, Artificial Sequence
  chemically synthesized
cgtgcctctttcttagcttc

SEQ ID NO: 430282 - DNA, 20 bp, Artificial Sequence
  chemically synthesized
tgctggcaataccagaagct

SEQ ID NO: 430283 - DNA, 20 bp, Artificial Sequence
  chemically synthesized
aggattgctggcaataccag

SEQ ID NO: 430284 - DNA, 20 bp, Artificial Sequence
  chemically synthesized
ttcttagcttctggtattgc

SEQ ID NO: 430285 - DNA, 20 bp, Artificial Sequence
  chemically synthesized
gcaaggattgctggcaatac

SEQ ID NO: 430286 - DNA, 20 bp, Artificial Sequence
  chemically synthesized
caaagaatggcaaggattgc

SEQ ID NO: 430287 - DNA, 20 bp, Artificial Sequence
  chemically synthesized
ctataagccaaagaatggca

SEQ ID NO: 430288 - DNA, 20 bp, Artificial Sequence
  chemically synthesized
tctataagccaaagaatggc

SEQ ID NO: 430289 - DNA, 20 bp, Artificial Sequence
  chemically synthesized
cagcaatccttgccattctt

SEQ ID NO: 430290 - DNA, 20 bp, Artificial Sequence
  chemically synthesized
cgtgtctataagccaaagaa

SEQ ID NO: 430291 - DNA, 20 bp, Artificial Sequence
  chemically synthesized
ccttgccattctttggctta

SEQ ID NO: 430292 - DNA, 20 bp, Artificial Sequence
  chemically synthesized
agtgacgtgtctataagcca

SEQ ID NO: 430293 - DNA, 20 bp, Artificial Sequence
  chemically synthesized
atcccgagtgacgtgtctat

SEQ ID NO: 430294 - DNA, 20 bp, Artificial Sequence
  chemically synthesized
tggcttatagacacgtcact

SEQ ID NO: 430295 - DNA, 20 bp, Artificial Sequence
  chemically synthesized
ggcttatagacacgtcactc

SEQ ID NO: 430296 - DNA, 20 bp, Artificial Sequence
  chemically synthesized
tatagacacgtcactcggga

SEQ ID NO: 430297 - DNA, 20 bp, Artificial Sequence
  chemically synthesized
catatgacagaggctatccc

SEQ ID NO: 430298 - DNA, 20 bp, Artificial Sequence
  chemically synthesized
gggagaatcccatatgacag

SEQ ID NO: 430299 - DNA, 20 bp, Artificial Sequence
  chemically synthesized
tcgggatagcctctgtcata

SEQ ID NO: 430300 - DNA, 20 bp, Artificial Sequence
  chemically synthesized
agggagaatcccatatgaca

SEQ ID NO: 430301 - DNA, 20 bp, Artificial Sequence
  chemically synthesized
cgggatagcctctgtcatat

SEQ ID NO: 430302 - DNA, 20 bp, Artificial Sequence
  chemically synthesized
acagggagaatcccatatga

SEQ ID NO: 430303 - DNA, 20 bp, Artificial Sequence
  chemically synthesized
atacagagaagacacacagg

SEQ ID NO: 430304 - DNA, 20 bp, Artificial Sequence
  chemically synthesized
aaatacagagaagacacaca

SEQ ID NO: 430305 - DNA, 20 bp, Artificial Sequence
  chemically synthesized
gaaatacagagaagacacac

SEQ ID NO: 430306 - DNA, 20 bp, Artificial Sequence
  chemically synthesized
agaaatacagagaagacaca

SEQ ID NO: 430307 - DNA, 20 bp, Artificial Sequence
  chemically synthesized
agaagagaagaaatacagag

SEQ ID NO: 430308 - DNA, 20 bp, Artificial Sequence
  chemically synthesized
agaagaagagaagaaataca

SEQ ID NO: 430309 - DNA, 20 bp, Artificial Sequence
  chemically synthesized
taagaagaagagaagaaata

SEQ ID NO: 430310 - DNA, 20 bp, Artificial Sequence
  chemically synthesized
tgtccttataagaagaagag

SEQ ID NO: 430311 - DNA, 20 bp, Artificial Sequence
  chemically synthesized
tgatgtccttataagaagaa

SEQ ID NO: 430312 - DNA, 20 bp, Artificial Sequence
  chemically synthesized
gctgatgtccttataagaag

SEQ ID NO: 430313 - DNA, 20 bp, Artificial Sequence
  chemically synthesized
atttcttctcttcttcttat

SEQ ID NO: 430314 - DNA, 20 bp, Artificial Sequence
  chemically synthesized
tttcttctcttcttcttata

SEQ ID NO: 430315 - DNA, 20 bp, Artificial Sequence
  chemically synthesized
atggctgatgtccttataag

SEQ ID NO: 430316 - DNA, 20 bp, Artificial Sequence
  chemically synthesized
aacatggctgatgtccttat

SEQ ID NO: 430317 - DNA, 20 bp, Artificial Sequence
  chemically synthesized
tcttcttcttataaggacat

SEQ ID NO: 430318 - DNA, 20 bp, Artificial Sequence
  chemically synthesized
tataaggacatcagccatgt

SEQ ID NO: 430319 - DNA, 20 bp, Artificial Sequence
  chemically synthesized
ggtgggcctttaatctaaca

SEQ ID NO: 430320 - DNA, 20 bp, Artificial Sequence
  chemically synthesized
acatcagccatgttagatta

SEQ ID NO: 430321 - DNA, 20 bp, Artificial Sequence
  chemically synthesized
catcagccatgttagattaa

SEQ ID NO: 430322 - DNA, 20 bp, Artificial Sequence
  chemically synthesized
atgtcatattggagtggggt

SEQ ID NO: 430323 - DNA, 20 bp, Artificial Sequence
  chemically synthesized
gatgtcatattggagtgggg

SEQ ID NO: 430324 - DNA, 20 bp, Artificial Sequence
  chemically synthesized
gatgatgtcatattggagtg

SEQ ID NO: 430325 - DNA, 20 bp, Artificial Sequence
  chemically synthesized
agatgatgtcatattggagt

SEQ ID NO: 430326 - DNA, 20 bp, Artificial Sequence
  chemically synthesized
aagatgatgtcatattggag

SEQ ID NO: 430327 - DNA, 20 bp, Artificial Sequence
  chemically synthesized
gttaagatgatgtcatattg

SEQ ID NO: 430328 - DNA, 20 bp, Artificial Sequence
  chemically synthesized
tagttaagatgatgtcatat

SEQ ID NO: 430329 - DNA, 20 bp, Artificial Sequence
  chemically synthesized
ctttgcagatgtaattagtt

SEQ ID NO: 430330 - DNA, 20 bp, Artificial Sequence
  chemically synthesized
ggggtctttgcagatgtaat

SEQ ID NO: 430331 - DNA, 20 bp, Artificial Sequence
  chemically synthesized
cttaactaattacatctgca

SEQ ID NO: 430332 - DNA, 20 bp, Artificial Sequence
  chemically synthesized
gtttgcaaatggggtctttg

SEQ ID NO: 430333 - DNA, 20 bp, Artificial Sequence
  chemically synthesized
gtggtttttgtttgcaaatg

SEQ ID NO: 430334 - DNA, 20 bp, Artificial Sequence
  chemically synthesized
tgtggtttttgtttgcaaat

SEQ ID NO: 430335 - DNA, 20 bp, Artificial Sequence
  chemically synthesized
atgtggtttttgtttgcaaa

SEQ ID NO: 430336 - DNA, 20 bp, Artificial Sequence
  chemically synthesized
tttctggaacttcaaaaatg

SEQ ID NO: 430337 - DNA, 20 bp, Artificial Sequence
  chemically synthesized
aaacaaaaaccacatttttg

SEQ ID NO: 430338 - DNA, 20 bp, Artificial Sequence
  chemically synthesized
aaaccacatttttgaagttc

SEQ ID NO: 430339 - DNA, 20 bp, Artificial Sequence
  chemically synthesized
acatttttgaagttccagaa

SEQ ID NO: 430340 - DNA, 20 bp, Artificial Sequence
  chemically synthesized
ctcaaaattcatgtcttttc

SEQ ID NO: 430341 - DNA, 20 bp, Artificial Sequence
  chemically synthesized
ccagaaaagacatgaatttt

SEQ ID NO: 430342 - DNA, 20 bp, Artificial Sequence
  chemically synthesized
cagaaaagacatgaattttg

SEQ ID NO: 430343 - DNA, 20 bp, Artificial Sequence
  chemically synthesized
agaaaagacatgaattttga

SEQ ID NO: 430344 - DNA, 20 bp, Artificial Sequence
  chemically synthesized
tgagggtgcactatctaacc

SEQ ID NO: 430345 - DNA, 20 bp, Artificial Sequence
  chemically synthesized
atcacgtgcactgggttaga

SEQ ID NO: 430346 - DNA, 20 bp, Artificial Sequence
  chemically synthesized
tgttatcacgtgcactgggt

SEQ ID NO: 430347 - DNA, 20 bp, Artificial Sequence
  chemically synthesized
attgtgttatcacgtgcact

SEQ ID NO: 430348 - DNA, 20 bp, Artificial Sequence
  chemically synthesized
gattgtgttatcacgtgcac

SEQ ID NO: 430349 - DNA, 20 bp, Artificial Sequence
  chemically synthesized
tgacagcagtcagttcattg

SEQ ID NO: 430350 - DNA, 20 bp, Artificial Sequence
  chemically synthesized
ttgacagcagtcagttcatt

SEQ ID NO: 430351 - DNA, 20 bp, Artificial Sequence
  chemically synthesized
actgagagattgacagcagt

SEQ ID NO: 430352 - DNA, 20 bp, Artificial Sequence
  chemically synthesized
gaaaactgagagattgacag

SEQ ID NO: 430353 - DNA, 20 bp, Artificial Sequence
  chemically synthesized
gttgaaaactgagagattga

SEQ ID NO: 430354 - DNA, 20 bp, Artificial Sequence
  chemically synthesized
actgactgctgtcaatctct

SEQ ID NO: 430355 - DNA, 20 bp, Artificial Sequence
  chemically synthesized
gtagtggagttgaaaactga

SEQ ID NO: 430356 - DNA, 20 bp, Artificial Sequence
  chemically synthesized
gagtagtggagttgaaaact

SEQ ID NO: 430357 - DNA, 20 bp, Artificial Sequence
  chemically synthesized
gatgtagtagttgagtagtg

SEQ ID NO: 430358 - DNA, 20 bp, Artificial Sequence
  chemically synthesized
tggatgtagtagttgagtag

SEQ ID NO: 430359 - DNA, 20 bp, Artificial Sequence
  chemically synthesized
agttggatgtagtagttgag

SEQ ID NO: 430360 - DNA, 20 bp, Artificial Sequence
  chemically synthesized
ctaagttggatgtagtagtt

SEQ ID NO: 430361 - DNA, 20 bp, Artificial Sequence
  chemically synthesized
gtctgctaagttggatgtag

SEQ ID NO: 430362 - DNA, 20 bp, Artificial Sequence
  chemically synthesized
tttgtctgctaagttggatg

SEQ ID NO: 430363 - DNA, 20 bp, Artificial Sequence
  chemically synthesized
ctcaactactacatccaact

SEQ ID NO: 430364 - DNA, 20 bp, Artificial Sequence
  chemically synthesized
aactactacatccaacttag

SEQ ID NO: 430365 - DNA, 20 bp, Artificial Sequence
  chemically synthesized
tatttgtttgtctgctaagt

SEQ ID NO: 430366 - DNA, 20 bp, Artificial Sequence
  chemically synthesized
catatatttgtttgtctgct

SEQ ID NO: 430367 - DNA, 20 bp, Artificial Sequence
  chemically synthesized
aacaaatatatgtattgaat

SEQ ID NO: 430368 - DNA, 20 bp, Artificial Sequence
  chemically synthesized
tatatgtattgaatgagaaa

SEQ ID NO: 430369 - DNA, 20 bp, Artificial Sequence
  chemically synthesized
attgaatgagaaacagtccc

SEQ ID NO: 430370 - DNA, 20 bp, Artificial Sequence
  chemically synthesized
aatgagaaacagtccctagc

SEQ ID NO: 430371 - DNA, 20 bp, Artificial Sequence
  chemically synthesized
tactttacttttaccagcta

SEQ ID NO: 430372 - DNA, 20 bp, Artificial Sequence
  chemically synthesized
ctactttacttttaccagct

SEQ ID NO: 430373 - DNA, 20 bp, Artificial Sequence
  chemically synthesized
cctactttacttttaccagc

SEQ ID NO: 430374 - DNA, 20 bp, Artificial Sequence
  chemically synthesized
aaacagtccctagctggtaa

SEQ ID NO: 430375 - DNA, 20 bp, Artificial Sequence
  chemically synthesized
tggccctactttacttttac

SEQ ID NO: 430376 - DNA, 20 bp, Artificial Sequence
  chemically synthesized
gtccctagctggtaaaagta

SEQ ID NO: 430377 - DNA, 20 bp, Artificial Sequence
  chemically synthesized
cctagctggtaaaagtaaag

SEQ ID NO: 430378 - DNA, 20 bp, Artificial Sequence
  chemically synthesized
ctagctggtaaaagtaaagt

SEQ ID NO: 430379 - DNA, 20 bp, Artificial Sequence
  chemically synthesized
tagctggtaaaagtaaagta

SEQ ID NO: 430380 - DNA, 20 bp, Artificial Sequence
  chemically synthesized
tggtaaaagtaaagtagggc

SEQ ID NO: 430381 - DNA, 20 bp, Artificial Sequence
  chemically synthesized
ggtaaaagtaaagtagggcc

SEQ ID NO: 430382 - DNA, 20 bp, Artificial Sequence
  chemically synthesized
taaaagtaaagtagggccag

SEQ ID NO: 430383 - DNA, 20 bp, Artificial Sequence
  chemically synthesized
aagtaaagtagggccaggag

SEQ ID NO: 430384 - DNA, 20 bp, Artificial Sequence
  chemically synthesized
taaagtagggccaggagcgg

SEQ ID NO: 430385 - DNA, 20 bp, Artificial Sequence
  chemically synthesized
caggcgtgagccaccgctcc

SEQ ID NO: 430386 - DNA, 20 bp, Artificial Sequence
  chemically synthesized
agtgctgggattacaggcgt

SEQ ID NO: 430387 - DNA, 20 bp, Artificial Sequence
  chemically synthesized
gtggctcacgcctgtaatcc

SEQ ID NO: 430388 - DNA, 20 bp, Artificial Sequence
  chemically synthesized
tcccaaagtgctgggattac

SEQ ID NO: 430389 - DNA, 20 bp, Artificial Sequence
  chemically synthesized
ctcccaaagtgctgggatta

SEQ ID NO: 430390 - DNA, 20 bp, Artificial Sequence
  chemically synthesized
cgcctgtaatcccagcactt

SEQ ID NO: 430391 - DNA, 20 bp, Artificial Sequence
  chemically synthesized
cctcagcctcccaaagtgct

SEQ ID NO: 430392 - DNA, 20 bp, Artificial Sequence
  chemically synthesized
gcctgtaatcccagcacttt

SEQ ID NO: 430393 - DNA, 20 bp, Artificial Sequence
  chemically synthesized
acctcagcctcccaaagtgc

SEQ ID NO: 430394 - DNA, 20 bp, Artificial Sequence
  chemically synthesized
ctgtaatcccagcactttgg

SEQ ID NO: 430395 - DNA, 20 bp, Artificial Sequence
  chemically synthesized
tgtaatcccagcactttggg

SEQ ID NO: 430396 - DNA, 20 bp, Artificial Sequence
  chemically synthesized
ccacccacctcagcctccca

SEQ ID NO: 430397 - DNA, 20 bp, Artificial Sequence
  chemically synthesized
tcccagcactttgggaggct

SEQ ID NO: 430398 - DNA, 20 bp, Artificial Sequence
  chemically synthesized
cccagcactttgggaggctg

SEQ ID NO: 430399 - DNA, 20 bp, Artificial Sequence
  chemically synthesized
agcactttgggaggctgagg

SEQ ID NO: 430400 - DNA, 20 bp, Artificial Sequence
  chemically synthesized
gcactttgggaggctgaggt

SEQ ID NO: 430401 - DNA, 20 bp, Artificial Sequence
  chemically synthesized
ctttgggaggctgaggtggg

SEQ ID NO: 430402 - DNA, 20 bp, Artificial Sequence
  chemically synthesized
ctcaggtgatccacccacct

SEQ ID NO: 430403 - DNA, 20 bp, Artificial Sequence
  chemically synthesized
ctgaggtgggtggatcacct

SEQ ID NO: 430404 - DNA, 20 bp, Artificial Sequence
  chemically synthesized
tgaggtgggtggatcacctg

SEQ ID NO: 430405 - DNA, 20 bp, Artificial Sequence
  chemically synthesized
gtgggtggatcacctgaggt

SEQ ID NO: 430406 - DNA, 20 bp, Artificial Sequence
  chemically synthesized
tgggtggatcacctgaggtc

SEQ ID NO: 430407 - DNA, 20 bp, Artificial Sequence
  chemically synthesized
gggtggatcacctgaggtca

SEQ ID NO: 430408 - DNA, 20 bp, Artificial Sequence
  chemically synthesized
tggtctccaaccctgacctc

SEQ ID NO: 430409 - DNA, 20 bp, Artificial Sequence
  chemically synthesized
gtggtctccaaccctgacct

SEQ ID NO: 430410 - DNA, 20 bp, Artificial Sequence
  chemically synthesized
ggatcacctgaggtcagggt

SEQ ID NO: 430411 - DNA, 20 bp, Artificial Sequence
  chemically synthesized
atcacctgaggtcagggttg

SEQ ID NO: 430412 - DNA, 20 bp, Artificial Sequence
  chemically synthesized
gaggtcagggttggagacca

SEQ ID NO: 430413 - DNA, 20 bp, Artificial Sequence
  chemically synthesized
tcagggttggagaccacagc

SEQ ID NO: 430414 - DNA, 20 bp, Artificial Sequence
  chemically synthesized
cagggttggagaccacagcc

SEQ ID NO: 430415 - DNA, 20 bp, Artificial Sequence
  chemically synthesized
agggttggagaccacagcca

SEQ ID NO: 430416 - DNA, 20 bp, Artificial Sequence
  chemically synthesized
ttgccatgttaccctggctg

SEQ ID NO: 430417 - DNA, 20 bp, Artificial Sequence
  chemically synthesized
ggggttttgccatgttaccc

SEQ ID NO: 430418 - DNA, 20 bp, Artificial Sequence
  chemically synthesized
agaccacagccagggtaaca

SEQ ID NO: 430419 - DNA, 20 bp, Artificial Sequence
  chemically synthesized
ttgtatttttagtagagatg

SEQ ID NO: 430420 - DNA, 20 bp, Artificial Sequence
  chemically synthesized
tttgtatttttagtagagat

SEQ ID NO: 430421 - DNA, 20 bp, Artificial Sequence
  chemically synthesized
ttttgtatttttagtagaga

SEQ ID NO: 430422 - DNA, 20 bp, Artificial Sequence
  chemically synthesized
taatttttgtatttttagta

SEQ ID NO: 430423 - DNA, 20 bp, Artificial Sequence
  chemically synthesized
gctaatttttgtatttttag

SEQ ID NO: 430424 - DNA, 20 bp, Artificial Sequence
  chemically synthesized
ctggctaatttttgtatttt

SEQ ID NO: 430425 - DNA, 20 bp, Artificial Sequence
  chemically synthesized
tctactaaaaatacaaaaat

SEQ ID NO: 430426 - DNA, 20 bp, Artificial Sequence
  chemically synthesized
ctaaaaatacaaaaattagc

SEQ ID NO: 430427 - DNA, 20 bp, Artificial Sequence
  chemically synthesized
taaaaatacaaaaattagcc

SEQ ID NO: 430428 - DNA, 20 bp, Artificial Sequence
  chemically synthesized
atacaaaaattagccaggca

SEQ ID NO: 430429 - DNA, 20 bp, Artificial Sequence
  chemically synthesized
caaaaattagccaggcatgg

SEQ ID NO: 430430 - DNA, 20 bp, Artificial Sequence
  chemically synthesized
caggagtgtgccaccatgcc

SEQ ID NO: 430431 - DNA, 20 bp, Artificial Sequence
  chemically synthesized
cagggtagctgggattacag

SEQ ID NO: 430432 - DNA, 20 bp, Artificial Sequence
  chemically synthesized
gtggcacactcctgtaatcc

SEQ ID NO: 430433 - DNA, 20 bp, Artificial Sequence
  chemically synthesized
tccagggtagctgggattac

SEQ ID NO: 430434 - DNA, 20 bp, Artificial Sequence
  chemically synthesized
ctccagggtagctgggatta

SEQ ID NO: 430435 - DNA, 20 bp, Artificial Sequence
  chemically synthesized
cctcagcctccagggtagct

SEQ ID NO: 430436 - DNA, 20 bp, Artificial Sequence
  chemically synthesized
tcctgtaatcccagctaccc

SEQ ID NO: 430437 - DNA, 20 bp, Artificial Sequence
  chemically synthesized
gcctcagcctccagggtagc

SEQ ID NO: 430438 - DNA, 20 bp, Artificial Sequence
  chemically synthesized
ctgtaatcccagctaccctg

SEQ ID NO: 430439 - DNA, 20 bp, Artificial Sequence
  chemically synthesized
tgtaatcccagctaccctgg

SEQ ID NO: 430440 - DNA, 20 bp, Artificial Sequence
  chemically synthesized
tcccgcctcagcctccaggg

SEQ ID NO: 430441 - DNA, 20 bp, Artificial Sequence
  chemically synthesized
ttctcccgcctcagcctcca

SEQ ID NO: 430442 - DNA, 20 bp, Artificial Sequence
  chemically synthesized
tcccagctaccctggaggct

SEQ ID NO: 430443 - DNA, 20 bp, Artificial Sequence
  chemically synthesized
attctcccgcctcagcctcc

SEQ ID NO: 430444 - DNA, 20 bp, Artificial Sequence
  chemically synthesized
cccagctaccctggaggctg

SEQ ID NO: 430445 - DNA, 20 bp, Artificial Sequence
  chemically synthesized
gattctcccgcctcagcctc

SEQ ID NO: 430446 - DNA, 20 bp, Artificial Sequence
  chemically synthesized
agctaccctggaggctgagg

SEQ ID NO: 430447 - DNA, 20 bp, Artificial Sequence
  chemically synthesized
gctaccctggaggctgaggc

SEQ ID NO: 430448 - DNA, 20 bp, Artificial Sequence
  chemically synthesized
taccctggaggctgaggcgg

SEQ ID NO: 430449 - DNA, 20 bp, Artificial Sequence
  chemically synthesized
tttaagcgattctcccgcct

SEQ ID NO: 430450 - DNA, 20 bp, Artificial Sequence
  chemically synthesized
gcgggagaatcgcttaaacc

SEQ ID NO: 430451 - DNA, 20 bp, Artificial Sequence
  chemically synthesized
cgggagaatcgcttaaaccc

SEQ ID NO: 430452 - DNA, 20 bp, Artificial Sequence
  chemically synthesized
aacctccacctcctgggttt

SEQ ID NO: 430453 - DNA, 20 bp, Artificial Sequence
  chemically synthesized
ggagaatcgcttaaacccag

SEQ ID NO: 430454 - DNA, 20 bp, Artificial Sequence
  chemically synthesized
gagaatcgcttaaacccagg

SEQ ID NO: 430455 - DNA, 20 bp, Artificial Sequence
  chemically synthesized
aatcgcttaaacccaggagg

SEQ ID NO: 430456 - DNA, 20 bp, Artificial Sequence
  chemically synthesized
cactgcaacctccacctcct

SEQ ID NO: 430457 - DNA, 20 bp, Artificial Sequence
  chemically synthesized
tcgcttaaacccaggaggtg

SEQ ID NO: 430458 - DNA, 20 bp, Artificial Sequence
  chemically synthesized
tcactgcaacctccacctcc

SEQ ID NO: 430459 - DNA, 20 bp, Artificial Sequence
  chemically synthesized
cgcttaaacccaggaggtgg

SEQ ID NO: 430460 - DNA, 20 bp, Artificial Sequence
  chemically synthesized
aacccaggaggtggaggttg

SEQ ID NO: 430461 - DNA, 20 bp, Artificial Sequence
  chemically synthesized
caggaggtggaggttgcagt

SEQ ID NO: 430462 - DNA, 20 bp, Artificial Sequence
  chemically synthesized
ggtggaggttgcagtgagct

SEQ ID NO: 430463 - DNA, 20 bp, Artificial Sequence
  chemically synthesized
ggagtgcaatggtgcgatct

SEQ ID NO: 430464 - DNA, 20 bp, Artificial Sequence
  chemically synthesized
tctcccaggctggagtgcaa

SEQ ID NO: 430465 - DNA, 20 bp, Artificial Sequence
  chemically synthesized
gagatcgcaccattgcactc

SEQ ID NO: 430466 - DNA, 20 bp, Artificial Sequence
  chemically synthesized
cgcaccattgcactccagcc

SEQ ID NO: 430467 - DNA, 20 bp, Artificial Sequence
  chemically synthesized
gcaccattgcactccagcct

SEQ ID NO: 430468 - DNA, 20 bp, Artificial Sequence
  chemically synthesized
cactcttgtctcccaggctg

SEQ ID NO: 430469 - DNA, 20 bp, Artificial Sequence
  chemically synthesized
accattgcactccagcctgg

SEQ ID NO: 430470 - DNA, 20 bp, Artificial Sequence
  chemically synthesized
ttcactcttgtctcccaggc

SEQ ID NO: 430471 - DNA, 20 bp, Artificial Sequence
  chemically synthesized
tgcactccagcctgggagac

SEQ ID NO: 430472 - DNA, 20 bp, Artificial Sequence
  chemically synthesized
gagtttcactcttgtctccc

SEQ ID NO: 430473 - DNA, 20 bp, Artificial Sequence
  chemically synthesized
ggagtttcactcttgtctcc

SEQ ID NO: 430474 - DNA, 20 bp, Artificial Sequence
  chemically synthesized
cactccagcctgggagacaa

SEQ ID NO: 430475 - DNA, 20 bp, Artificial Sequence
  chemically synthesized
tactttctttttttgagatg

SEQ ID NO: 430476 - DNA, 20 bp, Artificial Sequence
  chemically synthesized
tttactttctttttttgaga

SEQ ID NO: 430477 - DNA, 20 bp, Artificial Sequence
  chemically synthesized
gtgaaactccatctcaaaaa

SEQ ID NO: 430478 - DNA, 20 bp, Artificial Sequence
  chemically synthesized
ctaatttactttcttttttt

SEQ ID NO: 430479 - DNA, 20 bp, Artificial Sequence
  chemically synthesized
aactccatctcaaaaaaaga

SEQ ID NO: 430480 - DNA, 20 bp, Artificial Sequence
  chemically synthesized
ctcaaaaaaagaaagtaaat

SEQ ID NO: 430481 - DNA, 20 bp, Artificial Sequence
  chemically synthesized
caaaaaaagaaagtaaatta

SEQ ID NO: 430482 - DNA, 20 bp, Artificial Sequence
  chemically synthesized
aaaaaagaaagtaaattaga

SEQ ID NO: 430483 - DNA, 20 bp, Artificial Sequence
  chemically synthesized
aaagaaagtaaattagagag

SEQ ID NO: 430484 - DNA, 20 bp, Artificial Sequence
  chemically synthesized
agtaaattagagagaagcta

SEQ ID NO: 430485 - DNA, 20 bp, Artificial Sequence
  chemically synthesized
taaattagagagaagctaaa

SEQ ID NO: 430486 - DNA, 20 bp, Artificial Sequence
  chemically synthesized
atcctgcctgatttactctt

SEQ ID NO: 430487 - DNA, 20 bp, Artificial Sequence
  chemically synthesized
agagaagctaaagagtaaat

SEQ ID NO: 430488 - DNA, 20 bp, Artificial Sequence
  chemically synthesized
gagaagctaaagagtaaatc

SEQ ID NO: 430489 - DNA, 20 bp, Artificial Sequence
  chemically synthesized
aagctaaagagtaaatcagg

SEQ ID NO: 430490 - DNA, 20 bp, Artificial Sequence
  chemically synthesized
agctaaagagtaaatcaggc

SEQ ID NO: 430491 - DNA, 20 bp, Artificial Sequence
  chemically synthesized
gtaaatcaggcaggattttc

SEQ ID NO: 430492 - DNA, 20 bp, Artificial Sequence
  chemically synthesized
taaatcaggcaggattttct

SEQ ID NO: 430493 - DNA, 20 bp, Artificial Sequence
  chemically synthesized
atcaggcaggattttctggg

SEQ ID NO: 430494 - DNA, 20 bp, Artificial Sequence
  chemically synthesized
caggcaggattttctgggca

SEQ ID NO: 430495 - DNA, 20 bp, Artificial Sequence
  chemically synthesized
gcaggattttctgggcagag

SEQ ID NO: 430496 - DNA, 20 bp, Artificial Sequence
  chemically synthesized
ccaagcatgacttctctgcc

SEQ ID NO: 430497 - DNA, 20 bp, Artificial Sequence
  chemically synthesized
ctgggcagagaagtcatgct

SEQ ID NO: 430498 - DNA, 20 bp, Artificial Sequence
  chemically synthesized
agaagtcatgcttggctata

SEQ ID NO: 430499 - DNA, 20 bp, Artificial Sequence
  chemically synthesized
actttcatagctttatagcc

SEQ ID NO: 430500 - DNA, 20 bp, Artificial Sequence
  chemically synthesized
tgtgtactttcatagcttta

SEQ ID NO: 430501 - DNA, 20 bp, Artificial Sequence
  chemically synthesized
gcttggctataaagctatga

SEQ ID NO: 430502 - DNA, 20 bp, Artificial Sequence
  chemically synthesized
ttgatttctgtgtactttca

SEQ ID NO: 430503 - DNA, 20 bp, Artificial Sequence
  chemically synthesized
tataaagctatgaaagtaca

SEQ ID NO: 430504 - DNA, 20 bp, Artificial Sequence
  chemically synthesized
aagtacacagaaatcaaaca

SEQ ID NO: 430505 - DNA, 20 bp, Artificial Sequence
  chemically synthesized
gaaatcaaacatagctcatt

SEQ ID NO: 430506 - DNA, 20 bp, Artificial Sequence
  chemically synthesized
taattatgcctgatctaaat

SEQ ID NO: 430507 - DNA, 20 bp, Artificial Sequence
  chemically synthesized
caaacatagctcatttagat

SEQ ID NO: 430508 - DNA, 20 bp, Artificial Sequence
  chemically synthesized
aaacatagctcatttagatc

SEQ ID NO: 430509 - DNA, 20 bp, Artificial Sequence
  chemically synthesized
ggcataattattataataaa

SEQ ID NO: 430510 - DNA, 20 bp, Artificial Sequence
  chemically synthesized
aataaaaagtcattatctta

SEQ ID NO: 430511 - DNA, 20 bp, Artificial Sequence
  chemically synthesized
ataatattatgtgaggccat

SEQ ID NO: 430512 - DNA, 20 bp, Artificial Sequence
  chemically synthesized
ataggcaataatattatgtg

SEQ ID NO: 430513 - DNA, 20 bp, Artificial Sequence
  chemically synthesized
tataggcaataatattatgt

SEQ ID NO: 430514 - DNA, 20 bp, Artificial Sequence
  chemically synthesized
ggaccaacacagaaatatat

SEQ ID NO: 430515 - DNA, 20 bp, Artificial Sequence
  chemically synthesized
aggaccaacacagaaatata

SEQ ID NO: 430516 - DNA, 20 bp, Artificial Sequence
  chemically synthesized
ttgcctatatatttctgtgt

SEQ ID NO: 430517 - DNA, 20 bp, Artificial Sequence
  chemically synthesized
agtattatgaaggaccaaca

SEQ ID NO: 430518 - DNA, 20 bp, Artificial Sequence
  chemically synthesized
tgtaaatccaagtattatga

SEQ ID NO: 430519 - DNA, 20 bp, Artificial Sequence
  chemically synthesized
atgtaaatccaagtattatg

SEQ ID NO: 430520 - DNA, 20 bp, Artificial Sequence
  chemically synthesized
tgttggtccttcataatact

SEQ ID NO: 430521 - DNA, 20 bp, Artificial Sequence
  chemically synthesized
acaattctgcatgtaaatcc

SEQ ID NO: 430522 - DNA, 20 bp, Artificial Sequence
  chemically synthesized
ataatacttggatttacatg

SEQ ID NO: 430523 - DNA, 20 bp, Artificial Sequence
  chemically synthesized
agagcacttaaaatatgata

SEQ ID NO: 430524 - DNA, 20 bp, Artificial Sequence
  chemically synthesized
atatttctgtatcatatttt

SEQ ID NO: 430525 - DNA, 20 bp, Artificial Sequence
  chemically synthesized
caaataattaatgcattaca

SEQ ID NO: 430526 - DNA, 20 bp, Artificial Sequence
  chemically synthesized
agcaaataattaatgcatta

SEQ ID NO: 430527 - DNA, 20 bp, Artificial Sequence
  chemically synthesized
gtaatgcattaattatttgc

SEQ ID NO: 430528 - DNA, 20 bp, Artificial Sequence
  chemically synthesized
agctgcagcctacatgaggc

SEQ ID NO: 430529 - DNA, 20 bp, Artificial Sequence
  chemically synthesized
aattatttgctagcctcatg

SEQ ID NO: 430530 - DNA, 20 bp, Artificial Sequence
  chemically synthesized
attatttgctagcctcatgt

SEQ ID NO: 430531 - DNA, 20 bp, Artificial Sequence
  chemically synthesized
ggagagctgcagcctacatg

SEQ ID NO: 430532 - DNA, 20 bp, Artificial Sequence
  chemically synthesized
tggagagctgcagcctacat

SEQ ID NO: 430533 - DNA, 20 bp, Artificial Sequence
  chemically synthesized
tgctagcctcatgtaggctg

SEQ ID NO: 430534 - DNA, 20 bp, Artificial Sequence
  chemically synthesized
acttaaaggctggagagctg

SEQ ID NO: 430535 - DNA, 20 bp, Artificial Sequence
  chemically synthesized
tcatgtaggctgcagctctc

SEQ ID NO: 430536 - DNA, 20 bp, Artificial Sequence
  chemically synthesized
gactgaacttaaaggctgga

SEQ ID NO: 430537 - DNA, 20 bp, Artificial Sequence
  chemically synthesized
atgactgaacttaaaggctg

SEQ ID NO: 430538 - DNA, 20 bp, Artificial Sequence
  chemically synthesized
gctgcagctctccagccttt

SEQ ID NO: 430539 - DNA, 20 bp, Artificial Sequence
  chemically synthesized
atatgactgaacttaaaggc

SEQ ID NO: 430540 - DNA, 20 bp, Artificial Sequence
  chemically synthesized
agctctccagcctttaagtt

SEQ ID NO: 430541 - DNA, 20 bp, Artificial Sequence
  chemically synthesized
tggcatatgactgaacttaa

SEQ ID NO: 430542 - DNA, 20 bp, Artificial Sequence
  chemically synthesized
ttggcatatgactgaactta

SEQ ID NO: 430543 - DNA, 20 bp, Artificial Sequence
  chemically synthesized
ttcagtcatatgccaacctg

SEQ ID NO: 430544 - DNA, 20 bp, Artificial Sequence
  chemically synthesized
atccctcacgttcttcaggt

SEQ ID NO: 430545 - DNA, 20 bp, Artificial Sequence
  chemically synthesized
ctcaatccctcacgttcttc

SEQ ID NO: 430546 - DNA, 20 bp, Artificial Sequence
  chemically synthesized
tctcaatccctcacgttctt

SEQ ID NO: 430547 - DNA, 20 bp, Artificial Sequence
  chemically synthesized
tatgccaacctgaagaacgt

SEQ ID NO: 430548 - DNA, 20 bp, Artificial Sequence
  chemically synthesized
atgccaacctgaagaacgtg

SEQ ID NO: 430549 - DNA, 20 bp, Artificial Sequence
  chemically synthesized
tgccaacctgaagaacgtga

SEQ ID NO: 430550 - DNA, 20 bp, Artificial Sequence
  chemically synthesized
cctgaagaacgtgagggatt

SEQ ID NO: 430551 - DNA, 20 bp, Artificial Sequence
  chemically synthesized
tgaagaacgtgagggattga

SEQ ID NO: 430552 - DNA, 20 bp, Artificial Sequence
  chemically synthesized
aagaacgtgagggattgaga

SEQ ID NO: 430553 - DNA, 20 bp, Artificial Sequence
  chemically synthesized
attgagagagtgtcttaaat

SEQ ID NO: 430554 - DNA, 20 bp, Artificial Sequence
  chemically synthesized
tgagagagtgtcttaaatga

SEQ ID NO: 430555 - DNA, 20 bp, Artificial Sequence
  chemically synthesized
accatgggcttctctcattt

SEQ ID NO: 430556 - DNA, 20 bp, Artificial Sequence
  chemically synthesized
gagagtgtcttaaatgagag

SEQ ID NO: 430557 - DNA, 20 bp, Artificial Sequence
  chemically synthesized
tcttaaatgagagaagccca

SEQ ID NO: 430558 - DNA, 20 bp, Artificial Sequence
  chemically synthesized
taaatgagagaagcccatgg

SEQ ID NO: 430559 - DNA, 20 bp, Artificial Sequence
  chemically synthesized
ctgatgaagctggccaccat

SEQ ID NO: 430560 - DNA, 20 bp, Artificial Sequence
  chemically synthesized
tgagagaagcccatggtggc

SEQ ID NO: 430561 - DNA, 20 bp, Artificial Sequence
  chemically synthesized
tctgatgaagctggccacca

SEQ ID NO: 430562 - DNA, 20 bp, Artificial Sequence
  chemically synthesized
cccatggtggccagcttcat

SEQ ID NO: 430563 - DNA, 20 bp, Artificial Sequence
  chemically synthesized
cactaggtttctgatgaagc

SEQ ID NO: 430564 - DNA, 20 bp, Artificial Sequence
  chemically synthesized
gccacactaggtttctgatg

SEQ ID NO: 430565 - DNA, 20 bp, Artificial Sequence
  chemically synthesized
ggccagcttcatcagaaacc

SEQ ID NO: 430566 - DNA, 20 bp, Artificial Sequence
  chemically synthesized
gcttcatcagaaacctagtg

SEQ ID NO: 430567 - DNA, 20 bp, Artificial Sequence
  chemically synthesized
gcgaaaaccagagccacact

SEQ ID NO: 430568 - DNA, 20 bp, Artificial Sequence
  chemically synthesized
ggcgaaaaccagagccacac

SEQ ID NO: 430569 - DNA, 20 bp, Artificial Sequence
  chemically synthesized
tcagaaacctagtgtggctc

SEQ ID NO: 430570 - DNA, 20 bp, Artificial Sequence
  chemically synthesized
aaagaacctggcgaaaacca

SEQ ID NO: 430571 - DNA, 20 bp, Artificial Sequence
  chemically synthesized
acaaagaacctggcgaaaac

SEQ ID NO: 430572 - DNA, 20 bp, Artificial Sequence
  chemically synthesized
agtgtggctctggttttcgc

SEQ ID NO: 430573 - DNA, 20 bp, Artificial Sequence
  chemically synthesized
gtgtggctctggttttcgcc

SEQ ID NO: 430574 - DNA, 20 bp, Artificial Sequence
  chemically synthesized
gtcacaaggaacaaagaacc

SEQ ID NO: 430575 - DNA, 20 bp, Artificial Sequence
  chemically synthesized
agaatgagtcacaaggaaca

SEQ ID NO: 430576 - DNA, 20 bp, Artificial Sequence
  chemically synthesized
aaggcagagaatgagtcaca

SEQ ID NO: 430577 - DNA, 20 bp, Artificial Sequence
  chemically synthesized
caaggcagagaatgagtcac

SEQ ID NO: 430578 - DNA, 20 bp, Artificial Sequence
  chemically synthesized
gacaatgcaaggcagagaat

SEQ ID NO: 430579 - DNA, 20 bp, Artificial Sequence
  chemically synthesized
cgaatagacaatgcaaggca

SEQ ID NO: 430580 - DNA, 20 bp, Artificial Sequence
  chemically synthesized
accgaatagacaatgcaagg

SEQ ID NO: 430581 - DNA, 20 bp, Artificial Sequence
  chemically synthesized
gggaccgaatagacaatgca

SEQ ID NO: 430582 - DNA, 20 bp, Artificial Sequence
  chemically synthesized
ggggaccgaatagacaatgc

SEQ ID NO: 430583 - DNA, 20 bp, Artificial Sequence
  chemically synthesized
tctgccttgcattgtctatt

SEQ ID NO: 430584 - DNA, 20 bp, Artificial Sequence
  chemically synthesized
acaggcctgaggggaccgaa

SEQ ID NO: 430585 - DNA, 20 bp, Artificial Sequence
  chemically synthesized
cattgtctattcggtcccct

SEQ ID NO: 430586 - DNA, 20 bp, Artificial Sequence
  chemically synthesized
attgtctattcggtcccctc

SEQ ID NO: 430587 - DNA, 20 bp, Artificial Sequence
  chemically synthesized
ccagctaggacaggcctgag

SEQ ID NO: 430588 - DNA, 20 bp, Artificial Sequence
  chemically synthesized
tccagctaggacaggcctga

SEQ ID NO: 430589 - DNA, 20 bp, Artificial Sequence
  chemically synthesized
ttccagctaggacaggcctg

SEQ ID NO: 430590 - DNA, 20 bp, Artificial Sequence
  chemically synthesized
tttccagctaggacaggcct

SEQ ID NO: 430591 - DNA, 20 bp, Artificial Sequence
  chemically synthesized
cggtcccctcaggcctgtcc

SEQ ID NO: 430592 - DNA, 20 bp, Artificial Sequence
  chemically synthesized
gagctctttccagctaggac

SEQ ID NO: 430593 - DNA, 20 bp, Artificial Sequence
  chemically synthesized
cccctcaggcctgtcctagc

SEQ ID NO: 430594 - DNA, 20 bp, Artificial Sequence
  chemically synthesized
agagctctttccagctagga

SEQ ID NO: 430595 - DNA, 20 bp, Artificial Sequence
  chemically synthesized
tcaggcctgtcctagctgga

SEQ ID NO: 430596 - DNA, 20 bp, Artificial Sequence
  chemically synthesized
aaagagagctctttccagct

SEQ ID NO: 430597 - DNA, 20 bp, Artificial Sequence
  chemically synthesized
taaagagagctctttccagc

SEQ ID NO: 430598 - DNA, 20 bp, Artificial Sequence
  chemically synthesized
aggcctgtcctagctggaaa

SEQ ID NO: 430599 - DNA, 20 bp, Artificial Sequence
  chemically synthesized
gaagtaaagagagctctttc

SEQ ID NO: 430600 - DNA, 20 bp, Artificial Sequence
  chemically synthesized
atgggatcaggaagtaaaga

SEQ ID NO: 430601 - DNA, 20 bp, Artificial Sequence
  chemically synthesized
agatgggatcaggaagtaaa

SEQ ID NO: 430602 - DNA, 20 bp, Artificial Sequence
  chemically synthesized
acagatgggatcaggaagta

SEQ ID NO: 430603 - DNA, 20 bp, Artificial Sequence
  chemically synthesized
aaggaacagatgggatcagg

SEQ ID NO: 430604 - DNA, 20 bp, Artificial Sequence
  chemically synthesized
gtcaaggaacagatgggatc

SEQ ID NO: 430605 - DNA, 20 bp, Artificial Sequence
  chemically synthesized
ggtcaaggaacagatgggat

SEQ ID NO: 430606 - DNA, 20 bp, Artificial Sequence
  chemically synthesized
ggggaggtcaaggaacagat

SEQ ID NO: 430607 - DNA, 20 bp, Artificial Sequence
  chemically synthesized
aggggaggtcaaggaacaga

SEQ ID NO: 430608 - DNA, 20 bp, Artificial Sequence
  chemically synthesized
tcagaggggaggtcaaggaa

SEQ ID NO: 430609 - DNA, 20 bp, Artificial Sequence
  chemically synthesized
gtgggtcagaggggaggtca

SEQ ID NO: 430610 - DNA, 20 bp, Artificial Sequence
  chemically synthesized
ggtgggtcagaggggaggtc

SEQ ID NO: 430611 - DNA, 20 bp, Artificial Sequence
  chemically synthesized
ccagtggtgggtcagagggg

SEQ ID NO: 430612 - DNA, 20 bp, Artificial Sequence
  chemically synthesized
cccagtggtgggtcagaggg

SEQ ID NO: 430613 - DNA, 20 bp, Artificial Sequence
  chemically synthesized
tgcccagtggtgggtcagag

SEQ ID NO: 430614 - DNA, 20 bp, Artificial Sequence
  chemically synthesized
atgcccagtggtgggtcaga

SEQ ID NO: 430615 - DNA, 20 bp, Artificial Sequence
  chemically synthesized
catgcccagtggtgggtcag

SEQ ID NO: 430616 - DNA, 20 bp, Artificial Sequence
  chemically synthesized
gcatgcccagtggtgggtca

SEQ ID NO: 430617 - DNA, 20 bp, Artificial Sequence
  chemically synthesized
gagcatgcccagtggtgggt

SEQ ID NO: 430618 - DNA, 20 bp, Artificial Sequence
  chemically synthesized
cctcccctctgacccaccac

SEQ ID NO: 430619 - DNA, 20 bp, Artificial Sequence
  chemically synthesized
ctcccctctgacccaccact

SEQ ID NO: 430620 - DNA, 20 bp, Artificial Sequence
  chemically synthesized
ttctgagcatgcccagtggt

SEQ ID NO: 430621 - DNA, 20 bp, Artificial Sequence
  chemically synthesized
attctgagcatgcccagtgg

SEQ ID NO: 430622 - DNA, 20 bp, Artificial Sequence
  chemically synthesized
cctattctgagcatgcccag

SEQ ID NO: 430623 - DNA, 20 bp, Artificial Sequence
  chemically synthesized
tttcctattctgagcatgcc

SEQ ID NO: 430624 - DNA, 20 bp, Artificial Sequence
  chemically synthesized
gacccaccactgggcatgct

SEQ ID NO: 430625 - DNA, 20 bp, Artificial Sequence
  chemically synthesized
accactgggcatgctcagaa

SEQ ID NO: 430626 - DNA, 20 bp, Artificial Sequence
  chemically synthesized
ccactgggcatgctcagaat

SEQ ID NO: 430627 - DNA, 20 bp, Artificial Sequence
  chemically synthesized
atggcacaatttcctattct

SEQ ID NO: 430628 - DNA, 20 bp, Artificial Sequence
  chemically synthesized
aataggaaattgtgccataa

SEQ ID NO: 430629 - DNA, 20 bp, Artificial Sequence
  chemically synthesized
agtgtcaggattatctatta

SEQ ID NO: 430630 - DNA, 20 bp, Artificial Sequence
  chemically synthesized
aagaaatggaacagagtgtc

SEQ ID NO: 430631 - DNA, 20 bp, Artificial Sequence
  chemically synthesized
gaagaaatggaacagagtgt

SEQ ID NO: 430632 - DNA, 20 bp, Artificial Sequence
  chemically synthesized
taacatgaagaaatggaaca

SEQ ID NO: 430633 - DNA, 20 bp, Artificial Sequence
  chemically synthesized
actaacatgaagaaatggaa

SEQ ID NO: 430634 - DNA, 20 bp, Artificial Sequence
  chemically synthesized
aattaactaacatgaagaaa

SEQ ID NO: 430635 - DNA, 20 bp, Artificial Sequence
  chemically synthesized
tctgttccatttcttcatgt

SEQ ID NO: 430636 - DNA, 20 bp, Artificial Sequence
  chemically synthesized
aatggtaattaactaacatg

SEQ ID NO: 430637 - DNA, 20 bp, Artificial Sequence
  chemically synthesized
atgttagttaattaccattc

SEQ ID NO: 430638 - DNA, 20 bp, Artificial Sequence
  chemically synthesized
tgttagttaattaccattca

SEQ ID NO: 430639 - DNA, 20 bp, Artificial Sequence
  chemically synthesized
gtaggcctcaagaccttgaa

SEQ ID NO: 430640 - DNA, 20 bp, Artificial Sequence
  chemically synthesized
taattaccattcaaggtctt

SEQ ID NO: 430641 - DNA, 20 bp, Artificial Sequence
  chemically synthesized
aattaccattcaaggtcttg

SEQ ID NO: 430642 - DNA, 20 bp, Artificial Sequence
  chemically synthesized
gagcagttaatgtaggcctc

SEQ ID NO: 430643 - DNA, 20 bp, Artificial Sequence
  chemically synthesized
catttaagagcagttaatgt

SEQ ID NO: 430644 - DNA, 20 bp, Artificial Sequence
  chemically synthesized
acatttaagagcagttaatg

SEQ ID NO: 430645 - DNA, 20 bp, Artificial Sequence
  chemically synthesized
atagacctgacatttaagag

SEQ ID NO: 430646 - DNA, 20 bp, Artificial Sequence
  chemically synthesized
tacatagacctgacatttaa

SEQ ID NO: 430647 - DNA, 20 bp, Artificial Sequence
  chemically synthesized
cattaactgctcttaaatgt

SEQ ID NO: 430648 - DNA, 20 bp, Artificial Sequence
  chemically synthesized
attaactgctcttaaatgtc

SEQ ID NO: 430649 - DNA, 20 bp, Artificial Sequence
  chemically synthesized
ggtacatagacctgacattt

SEQ ID NO: 430650 - DNA, 20 bp, Artificial Sequence
  chemically synthesized
cataacaggcaataggtaca

SEQ ID NO: 430651 - DNA, 20 bp, Artificial Sequence
  chemically synthesized
cctgctccataacaggcaat

SEQ ID NO: 430652 - DNA, 20 bp, Artificial Sequence
  chemically synthesized
gcctgctccataacaggcaa

SEQ ID NO: 430653 - DNA, 20 bp, Artificial Sequence
  chemically synthesized
tatgtacctattgcctgtta

SEQ ID NO: 430654 - DNA, 20 bp, Artificial Sequence
  chemically synthesized
tgtacctattgcctgttatg

SEQ ID NO: 430655 - DNA, 20 bp, Artificial Sequence
  chemically synthesized
caacaggcctgctccataac

SEQ ID NO: 430656 - DNA, 20 bp, Artificial Sequence
  chemically synthesized
ccaacaggcctgctccataa

SEQ ID NO: 430657 - DNA, 20 bp, Artificial Sequence
  chemically synthesized
acctattgcctgttatggag

SEQ ID NO: 430658 - DNA, 20 bp, Artificial Sequence
  chemically synthesized
cctattgcctgttatggagc

SEQ ID NO: 430659 - DNA, 20 bp, Artificial Sequence
  chemically synthesized
ctgttatggagcaggcctgt

SEQ ID NO: 430660 - DNA, 20 bp, Artificial Sequence
  chemically synthesized
atgctgctttggtcaccaac

SEQ ID NO: 430661 - DNA, 20 bp, Artificial Sequence
  chemically synthesized
tatgctgctttggtcaccaa

SEQ ID NO: 430662 - DNA, 20 bp, Artificial Sequence
  chemically synthesized
agcaggcctgttggtgacca

SEQ ID NO: 430663 - DNA, 20 bp, Artificial Sequence
  chemically synthesized
aggcctgttggtgaccaaag

SEQ ID NO: 430664 - DNA, 20 bp, Artificial Sequence
  chemically synthesized
gatgctaggttatgctgctt

SEQ ID NO: 430665 - DNA, 20 bp, Artificial Sequence
  chemically synthesized
gtgaccaaagcagcataacc

SEQ ID NO: 430666 - DNA, 20 bp, Artificial Sequence
  chemically synthesized
atatctgagcaacagatgct

SEQ ID NO: 430667 - DNA, 20 bp, Artificial Sequence
  chemically synthesized
gatatctgagcaacagatgc

SEQ ID NO: 430668 - DNA, 20 bp, Artificial Sequence
  chemically synthesized
ataacctagcatctgttgct

SEQ ID NO: 430669 - DNA, 20 bp, Artificial Sequence
  chemically synthesized
gggacatgatatctgagcaa

SEQ ID NO: 430670 - DNA, 20 bp, Artificial Sequence
  chemically synthesized
ggtgctgggacatgatatct

SEQ ID NO: 430671 - DNA, 20 bp, Artificial Sequence
  chemically synthesized
gttgctcagatatcatgtcc

SEQ ID NO: 430672 - DNA, 20 bp, Artificial Sequence
  chemically synthesized
gggcaattaattggggtgct

SEQ ID NO: 430673 - DNA, 20 bp, Artificial Sequence
  chemically synthesized
agggcaattaattggggtgc

SEQ ID NO: 430674 - DNA, 20 bp, Artificial Sequence
  chemically synthesized
agggctagggcaattaattg

SEQ ID NO: 430675 - DNA, 20 bp, Artificial Sequence
  chemically synthesized
tagggctagggcaattaatt

SEQ ID NO: 430676 - DNA, 20 bp, Artificial Sequence
  chemically synthesized
ctagggctagggcaattaat

SEQ ID NO: 430677 - DNA, 20 bp, Artificial Sequence
  chemically synthesized
agcaccccaattaattgccc

SEQ ID NO: 430678 - DNA, 20 bp, Artificial Sequence
  chemically synthesized
ccaattaattgccctagccc

SEQ ID NO: 430679 - DNA, 20 bp, Artificial Sequence
  chemically synthesized
gactggctagactagggcta

SEQ ID NO: 430680 - DNA, 20 bp, Artificial Sequence
  chemically synthesized
agactggctagactagggct

SEQ ID NO: 430681 - DNA, 20 bp, Artificial Sequence
  chemically synthesized
aagactggctagactagggc

SEQ ID NO: 430682 - DNA, 20 bp, Artificial Sequence
  chemically synthesized
taattgccctagccctagtc

SEQ ID NO: 430683 - DNA, 20 bp, Artificial Sequence
  chemically synthesized
tctgaagactggctagacta

SEQ ID NO: 430684 - DNA, 20 bp, Artificial Sequence
  chemically synthesized
ttctgaagactggctagact

SEQ ID NO: 430685 - DNA, 20 bp, Artificial Sequence
  chemically synthesized
tgccctagccctagtctagc

SEQ ID NO: 430686 - DNA, 20 bp, Artificial Sequence
  chemically synthesized
gttctgaagactggctagac

SEQ ID NO: 430687 - DNA, 20 bp, Artificial Sequence
  chemically synthesized
attcagttctgaagactggc

SEQ ID NO: 430688 - DNA, 20 bp, Artificial Sequence
  chemically synthesized
gccctagtctagccagtctt

SEQ ID NO: 430689 - DNA, 20 bp, Artificial Sequence
  chemically synthesized
aatgattcagttctgaagac

SEQ ID NO: 430690 - DNA, 20 bp, Artificial Sequence
  chemically synthesized
taaataatgattcagttctg

SEQ ID NO: 430691 - DNA, 20 bp, Artificial Sequence
  chemically synthesized
agaccaaataaataatgatt

SEQ ID NO: 430692 - DNA, 20 bp, Artificial Sequence
  chemically synthesized
gaactgaatcattatttatt

SEQ ID NO: 430693 - DNA, 20 bp, Artificial Sequence
  chemically synthesized
aatggggtttggtttgcata

SEQ ID NO: 430694 - DNA, 20 bp, Artificial Sequence
  chemically synthesized
aatgtgatttaaatggggtt

SEQ ID NO: 430695 - DNA, 20 bp, Artificial Sequence
  chemically synthesized
agatgaatgtgatttaaatg

SEQ ID NO: 430696 - DNA, 20 bp, Artificial Sequence
  chemically synthesized
tagatgaatgtgatttaaat

SEQ ID NO: 430697 - DNA, 20 bp, Artificial Sequence
  chemically synthesized
gtagatgaatgtgatttaaa

SEQ ID NO: 430698 - DNA, 20 bp, Artificial Sequence
  chemically synthesized
ttaaatcacattcatctacc

SEQ ID NO: 430699 - DNA, 20 bp, Artificial Sequence
  chemically synthesized
taaatcacattcatctaccc

SEQ ID NO: 430700 - DNA, 20 bp, Artificial Sequence
  chemically synthesized
tgataaatgagagtcctggg

SEQ ID NO: 430701 - DNA, 20 bp, Artificial Sequence
  chemically synthesized
gattgataaatgagagtcct

SEQ ID NO: 430702 - DNA, 20 bp, Artificial Sequence
  chemically synthesized
tgattgataaatgagagtcc

SEQ ID NO: 430703 - DNA, 20 bp, Artificial Sequence
  chemically synthesized
tcagtttgattgataaatga

SEQ ID NO: 430704 - DNA, 20 bp, Artificial Sequence
  chemically synthesized
tgtcagtttgattgataaat

SEQ ID NO: 430705 - DNA, 20 bp, Artificial Sequence
  chemically synthesized
tcatctgacatttaaaatgt

SEQ ID NO: 430706 - DNA, 20 bp, Artificial Sequence
  chemically synthesized
caaactgacattttaaatgt

SEQ ID NO: 430707 - DNA, 20 bp, Artificial Sequence
  chemically synthesized
tgacattttaaatgtcagat

SEQ ID NO: 430708 - DNA, 20 bp, Artificial Sequence
  chemically synthesized
tttaaatgtcagatgagtta

SEQ ID NO: 430709 - DNA, 20 bp, Artificial Sequence
  chemically synthesized
tgagttatggtatatccttt

SEQ ID NO: 430710 - DNA, 20 bp, Artificial Sequence
  chemically synthesized
atgttatcatgatcactcaa

SEQ ID NO: 430711 - DNA, 20 bp, Artificial Sequence
  chemically synthesized
aatgttatcatgatcactca

SEQ ID NO: 430712 - DNA, 20 bp, Artificial Sequence
  chemically synthesized
tgataacattccctcatatt

SEQ ID NO: 430713 - DNA, 20 bp, Artificial Sequence
  chemically synthesized
agtttatctcctaaatatga

SEQ ID NO: 430714 - DNA, 20 bp, Artificial Sequence
  chemically synthesized
gataacattccctcatattt

SEQ ID NO: 430715 - DNA, 20 bp, Artificial Sequence
  chemically synthesized
cagtttatctcctaaatatg

SEQ ID NO: 430716 - DNA, 20 bp, Artificial Sequence
  chemically synthesized
acagtttatctcctaaatat

SEQ ID NO: 430717 - DNA, 20 bp, Artificial Sequence
  chemically synthesized
taacattccctcatatttag

SEQ ID NO: 430718 - DNA, 20 bp, Artificial Sequence
  chemically synthesized
aaaatattgatgtatgcaga

SEQ ID NO: 430719 - DNA, 20 bp, Artificial Sequence
  chemically synthesized
tttaaaaatattgatgtatg

SEQ ID NO: 430720 - DNA, 20 bp, Artificial Sequence
  chemically synthesized
atcaatatttttaaacaccg

SEQ ID NO: 430721 - DNA, 20 bp, Artificial Sequence
  chemically synthesized
atatttttaaacaccgaagt

SEQ ID NO: 430722 - DNA, 20 bp, Artificial Sequence
  chemically synthesized
cagacctttgacacttactt

SEQ ID NO: 430723 - DNA, 20 bp, Artificial Sequence
  chemically synthesized
aaacaccgaagtaagtgtca

SEQ ID NO: 430724 - DNA, 20 bp, Artificial Sequence
  chemically synthesized
aacaccgaagtaagtgtcaa

SEQ ID NO: 430725 - DNA, 20 bp, Artificial Sequence
  chemically synthesized
taaatttcatcattaatttt

SEQ ID NO: 430726 - DNA, 20 bp, Artificial Sequence
  chemically synthesized
aatgatgaaatttatcactt

SEQ ID NO: 430727 - DNA, 20 bp, Artificial Sequence
  chemically synthesized
tttaagcatgcagaatactg

SEQ ID NO: 430728 - DNA, 20 bp, Artificial Sequence
  chemically synthesized
actcctatcttttaagcatg

SEQ ID NO: 430729 - DNA, 20 bp, Artificial Sequence
  chemically synthesized
tcagtattctgcatgcttaa

SEQ ID NO: 430730 - DNA, 20 bp, Artificial Sequence
  chemically synthesized
tattctgcatgcttaaaaga

SEQ ID NO: 430731 - DNA, 20 bp, Artificial Sequence
  chemically synthesized
attctgcatgcttaaaagat

SEQ ID NO: 430732 - DNA, 20 bp, Artificial Sequence
  chemically synthesized
aggtgtgactcctatctttt

SEQ ID NO: 430733 - DNA, 20 bp, Artificial Sequence
  chemically synthesized
tctgcatgcttaaaagatag

SEQ ID NO: 430734 - DNA, 20 bp, Artificial Sequence
  chemically synthesized
ataataggttattggaaggt

SEQ ID NO: 430735 - DNA, 20 bp, Artificial Sequence
  chemically synthesized
tataataggttattggaagg

SEQ ID NO: 430736 - DNA, 20 bp, Artificial Sequence
  chemically synthesized
tcttataataggttattgga

SEQ ID NO: 430737 - DNA, 20 bp, Artificial Sequence
  chemically synthesized
ctcttataataggttattgg

SEQ ID NO: 430738 - DNA, 20 bp, Artificial Sequence
  chemically synthesized
tggctcttataataggttat

SEQ ID NO: 430739 - DNA, 20 bp, Artificial Sequence
  chemically synthesized
accttccaataacctattat

SEQ ID NO: 430740 - DNA, 20 bp, Artificial Sequence
  chemically synthesized
cttccaataacctattataa

SEQ ID NO: 430741 - DNA, 20 bp, Artificial Sequence
  chemically synthesized
tcatttttggctcttataat

SEQ ID NO: 430742 - DNA, 20 bp, Artificial Sequence
  chemically synthesized
atcatttttggctcttataa

SEQ ID NO: 430743 - DNA, 20 bp, Artificial Sequence
  chemically synthesized
attataagagccaaaaatga

SEQ ID NO: 430744 - DNA, 20 bp, Artificial Sequence
  chemically synthesized
tgaatgttagctatcatttt

SEQ ID NO: 430745 - DNA, 20 bp, Artificial Sequence
  chemically synthesized
agatacctagttttgaatgt

SEQ ID NO: 430746 - DNA, 20 bp, Artificial Sequence
  chemically synthesized
tgatagctaacattcaaaac

SEQ ID NO: 430747 - DNA, 20 bp, Artificial Sequence
  chemically synthesized
gatagctaacattcaaaact

SEQ ID NO: 430748 - DNA, 20 bp, Artificial Sequence
  chemically synthesized
tttgttgtatgatagatacc

SEQ ID NO: 430749 - DNA, 20 bp, Artificial Sequence
  chemically synthesized
gtaaaatatttgttgtatga

SEQ ID NO: 430750 - DNA, 20 bp, Artificial Sequence
  chemically synthesized
cagtgatatgaatattatat

SEQ ID NO: 430751 - DNA, 20 bp, Artificial Sequence
  chemically synthesized
tctatgaagtgggaaaataa

SEQ ID NO: 430752 - DNA, 20 bp, Artificial Sequence
  chemically synthesized
actgttattttcccacttca

SEQ ID NO: 430753 - DNA, 20 bp, Artificial Sequence
  chemically synthesized
taagcccgtgtctatgaagt

SEQ ID NO: 430754 - DNA, 20 bp, Artificial Sequence
  chemically synthesized
ctaagcccgtgtctatgaag

SEQ ID NO: 430755 - DNA, 20 bp, Artificial Sequence
  chemically synthesized
tcactaagcccgtgtctatg

SEQ ID NO: 430756 - DNA, 20 bp, Artificial Sequence
  chemically synthesized
attttcccacttcatagaca

SEQ ID NO: 430757 - DNA, 20 bp, Artificial Sequence
  chemically synthesized
ttttcccacttcatagacac

SEQ ID NO: 430758 - DNA, 20 bp, Artificial Sequence
  chemically synthesized
ccacttcatagacacgggct

SEQ ID NO: 430759 - DNA, 20 bp, Artificial Sequence
  chemically synthesized
aaaagttatgaaatttcact

SEQ ID NO: 430760 - DNA, 20 bp, Artificial Sequence
  chemically synthesized
ttttcattgtaatgttgaaa

SEQ ID NO: 430761 - DNA, 20 bp, Artificial Sequence
  chemically synthesized
cattacaatgaaaaatatct

SEQ ID NO: 430762 - DNA, 20 bp, Artificial Sequence
  chemically synthesized
gcaaagccactaaagaaact

SEQ ID NO: 430763 - DNA, 20 bp, Artificial Sequence
  chemically synthesized
gaaaaatatctgagtttctt

SEQ ID NO: 430764 - DNA, 20 bp, Artificial Sequence
  chemically synthesized
aaatatctgagtttctttag

SEQ ID NO: 430765 - DNA, 20 bp, Artificial Sequence
  chemically synthesized
tgcaacaggcaaagccacta

SEQ ID NO: 430766 - DNA, 20 bp, Artificial Sequence
  chemically synthesized
attgaggtctgcaacaggca

SEQ ID NO: 430767 - DNA, 20 bp, Artificial Sequence
  chemically synthesized
tttagtggctttgcctgttg

SEQ ID NO: 430768 - DNA, 20 bp, Artificial Sequence
  chemically synthesized
aaaaaattgaggtctgcaac

SEQ ID NO: 430769 - DNA, 20 bp, Artificial Sequence
  chemically synthesized
aaaaaaattgaggtctgcaa

SEQ ID NO: 430770 - DNA, 20 bp, Artificial Sequence
  chemically synthesized
gtataataaaaaaaaaattg

SEQ ID NO: 430771 - DNA, 20 bp, Artificial Sequence
  chemically synthesized
agtataataaaaaaaaaatt

SEQ ID NO: 430772 - DNA, 20 bp, Artificial Sequence
  chemically synthesized
ttttattatactttaaattc

SEQ ID NO: 430773 - DNA, 20 bp, Artificial Sequence
  chemically synthesized
cacatgtatcccagaattta

SEQ ID NO: 430774 - DNA, 20 bp, Artificial Sequence
  chemically synthesized
tttattatactttaaattct

SEQ ID NO: 430775 - DNA, 20 bp, Artificial Sequence
  chemically synthesized
catgttctgcacatgtatcc

SEQ ID NO: 430776 - DNA, 20 bp, Artificial Sequence
  chemically synthesized
taaattctgggatacatgtg

SEQ ID NO: 430777 - DNA, 20 bp, Artificial Sequence
  chemically synthesized
ggatacatgtgcagaacatg

SEQ ID NO: 430778 - DNA, 20 bp, Artificial Sequence
  chemically synthesized
gatacatgtgcagaacatgc

SEQ ID NO: 430779 - DNA, 20 bp, Artificial Sequence
  chemically synthesized
gaacatgcaggtttgttaca

SEQ ID NO: 430780 - DNA, 20 bp, Artificial Sequence
  chemically synthesized
aacatgcaggtttgttacat

SEQ ID NO: 430781 - DNA, 20 bp, Artificial Sequence
  chemically synthesized
acataggtatacacatgcca

SEQ ID NO: 430782 - DNA, 20 bp, Artificial Sequence
  chemically synthesized
taggtatacacatgccatgg

SEQ ID NO: 430783 - DNA, 20 bp, Artificial Sequence
  chemically synthesized
atgggtgcagcaagccacca

SEQ ID NO: 430784 - DNA, 20 bp, Artificial Sequence
  chemically synthesized
gatgagttgatgggtgcagc

SEQ ID NO: 430785 - DNA, 20 bp, Artificial Sequence
  chemically synthesized
agatgatgagttgatgggtg

SEQ ID NO: 430786 - DNA, 20 bp, Artificial Sequence
  chemically synthesized
aatgtagatgatgagttgat

SEQ ID NO: 430787 - DNA, 20 bp, Artificial Sequence
  chemically synthesized
taatgtagatgatgagttga

SEQ ID NO: 430788 - DNA, 20 bp, Artificial Sequence
  chemically synthesized
aaatacctaatgtagatgat

SEQ ID NO: 430789 - DNA, 20 bp, Artificial Sequence
  chemically synthesized
catcaactcatcatctacat

SEQ ID NO: 430790 - DNA, 20 bp, Artificial Sequence
  chemically synthesized
atcaactcatcatctacatt

SEQ ID NO: 430791 - DNA, 20 bp, Artificial Sequence
  chemically synthesized
attaggagaaatacctaatg

SEQ ID NO: 430792 - DNA, 20 bp, Artificial Sequence
  chemically synthesized
tatgggagggatagcattag

SEQ ID NO: 430793 - DNA, 20 bp, Artificial Sequence
  chemically synthesized
gctatgggagggatagcatt

SEQ ID NO: 430794 - DNA, 20 bp, Artificial Sequence
  chemically synthesized
ggctatgggagggatagcat

SEQ ID NO: 430795 - DNA, 20 bp, Artificial Sequence
  chemically synthesized
gtgaggggctatgggaggga

SEQ ID NO: 430796 - DNA, 20 bp, Artificial Sequence
  chemically synthesized
tcctaatgctatccctccca

SEQ ID NO: 430797 - DNA, 20 bp, Artificial Sequence
  chemically synthesized
gtgggtgaggggctatggga

SEQ ID NO: 430798 - DNA, 20 bp, Artificial Sequence
  chemically synthesized
ggtgggtgaggggctatggg

SEQ ID NO: 430799 - DNA, 20 bp, Artificial Sequence
  chemically synthesized
tggtgggtgaggggctatgg

SEQ ID NO: 430800 - DNA, 20 bp, Artificial Sequence
  chemically synthesized
gttggtgggtgaggggctat

SEQ ID NO: 430801 - DNA, 20 bp, Artificial Sequence
  chemically synthesized
tgttggtgggtgaggggcta

SEQ ID NO: 430802 - DNA, 20 bp, Artificial Sequence
  chemically synthesized
ggggcctgttggtgggtgag

SEQ ID NO: 430803 - DNA, 20 bp, Artificial Sequence
  chemically synthesized
tggggcctgttggtgggtga

SEQ ID NO: 430804 - DNA, 20 bp, Artificial Sequence
  chemically synthesized
ctggggcctgttggtgggtg

SEQ ID NO: 430805 - DNA, 20 bp, Artificial Sequence
  chemically synthesized
actggggcctgttggtgggt

SEQ ID NO: 430806 - DNA, 20 bp, Artificial Sequence
  chemically synthesized
catagcccctcacccaccaa

SEQ ID NO: 430807 - DNA, 20 bp, Artificial Sequence
  chemically synthesized
atagcccctcacccaccaac

SEQ ID NO: 430808 - DNA, 20 bp, Artificial Sequence
  chemically synthesized
acacactggggcctgttggt

SEQ ID NO: 430809 - DNA, 20 bp, Artificial Sequence
  chemically synthesized
cacacactggggcctgttgg

SEQ ID NO: 430810 - DNA, 20 bp, Artificial Sequence
  chemically synthesized
catcacacactggggcctgt

SEQ ID NO: 430811 - DNA, 20 bp, Artificial Sequence
  chemically synthesized
cctcacccaccaacaggccc

SEQ ID NO: 430812 - DNA, 20 bp, Artificial Sequence
  chemically synthesized
gaggagaacatcacacactg

SEQ ID NO: 430813 - DNA, 20 bp, Artificial Sequence
  chemically synthesized
ggaggagaacatcacacact

SEQ ID NO: 430814 - DNA, 20 bp, Artificial Sequence
  chemically synthesized
gggaggagaacatcacacac

SEQ ID NO: 430815 - DNA, 20 bp, Artificial Sequence
  chemically synthesized
gaacacatggacacagggag

SEQ ID NO: 430816 - DNA, 20 bp, Artificial Sequence
  chemically synthesized
gagaacacatggacacaggg

SEQ ID NO: 430817 - DNA, 20 bp, Artificial Sequence
  chemically synthesized
tgagaacacatggacacagg

SEQ ID NO: 430818 - DNA, 20 bp, Artificial Sequence
  chemically synthesized
aatgagaacacatggacaca

SEQ ID NO: 430819 - DNA, 20 bp, Artificial Sequence
  chemically synthesized
caatgagaacacatggacac

SEQ ID NO: 430820 - DNA, 20 bp, Artificial Sequence
  chemically synthesized
acaatgagaacacatggaca

SEQ ID NO: 430821 - DNA, 20 bp, Artificial Sequence
  chemically synthesized
agttgaacaatgagaacaca

SEQ ID NO: 430822 - DNA, 20 bp, Artificial Sequence
  chemically synthesized
ataagtgggagttgaacaat

SEQ ID NO: 430823 - DNA, 20 bp, Artificial Sequence
  chemically synthesized
atgttctcactcataagtgg

SEQ ID NO: 430824 - DNA, 20 bp, Artificial Sequence
  chemically synthesized
attgttcaactcccacttat

SEQ ID NO: 430825 - DNA, 20 bp, Artificial Sequence
  chemically synthesized
gcatgttctcactcataagt

SEQ ID NO: 430826 - DNA, 20 bp, Artificial Sequence
  chemically synthesized
cgcatgttctcactcataag

SEQ ID NO: 430827 - DNA, 20 bp, Artificial Sequence
  chemically synthesized
ttcaactcccacttatgagt

SEQ ID NO: 430828 - DNA, 20 bp, Artificial Sequence
  chemically synthesized
caccgcatgttctcactcat

SEQ ID NO: 430829 - DNA, 20 bp, Artificial Sequence
  chemically synthesized
cacttatgagtgagaacatg

SEQ ID NO: 430830 - DNA, 20 bp, Artificial Sequence
  chemically synthesized
catcagactaacacaggaac

SEQ ID NO: 430831 - DNA, 20 bp, Artificial Sequence
  chemically synthesized
tcatcagactaacacaggaa

SEQ ID NO: 430832 - DNA, 20 bp, Artificial Sequence
  chemically synthesized
ttgttttcctgttcctgtgt

SEQ ID NO: 430833 - DNA, 20 bp, Artificial Sequence
  chemically synthesized
cattctcatcagactaacac

SEQ ID NO: 430834 - DNA, 20 bp, Artificial Sequence
  chemically synthesized
tcattctcatcagactaaca

SEQ ID NO: 430835 - DNA, 20 bp, Artificial Sequence
  chemically synthesized
tgttcctgtgttagtctgat

SEQ ID NO: 430836 - DNA, 20 bp, Artificial Sequence
  chemically synthesized
ctggaaaccatcattctcat

SEQ ID NO: 430837 - DNA, 20 bp, Artificial Sequence
  chemically synthesized
tgttagtctgatgagaatga

SEQ ID NO: 430838 - DNA, 20 bp, Artificial Sequence
  chemically synthesized
ctgatgagaatgatggtttc

SEQ ID NO: 430839 - DNA, 20 bp, Artificial Sequence
  chemically synthesized
tgcaggaaaatggatgaagc

SEQ ID NO: 430840 - DNA, 20 bp, Artificial Sequence
  chemically synthesized
cctttgcaggaaaatggatg

SEQ ID NO: 430841 - DNA, 20 bp, Artificial Sequence
  chemically synthesized
tcgtgtcctttgcaggaaaa

SEQ ID NO: 430842 - DNA, 20 bp, Artificial Sequence
  chemically synthesized
gcttcatccattttcctgca

SEQ ID NO: 430843 - DNA, 20 bp, Artificial Sequence
  chemically synthesized
cttcatccattttcctgcaa

SEQ ID NO: 430844 - DNA, 20 bp, Artificial Sequence
  chemically synthesized
gatgtgttcgtgtcctttgc

SEQ ID NO: 430845 - DNA, 20 bp, Artificial Sequence
  chemically synthesized
agatgtgttcgtgtcctttg

SEQ ID NO: 430846 - DNA, 20 bp, Artificial Sequence
  chemically synthesized
atactacacagacattaaaa

SEQ ID NO: 430847 - DNA, 20 bp, Artificial Sequence
  chemically synthesized
catcttttttaatgtctgtg

SEQ ID NO: 430848 - DNA, 20 bp, Artificial Sequence
  chemically synthesized
atacaccatggaatactaca

SEQ ID NO: 430849 - DNA, 20 bp, Artificial Sequence
  chemically synthesized
aatgtctgtgtagtattcca

SEQ ID NO: 430850 - DNA, 20 bp, Artificial Sequence
  chemically synthesized
aatgtggcacatatacacca

SEQ ID NO: 430851 - DNA, 20 bp, Artificial Sequence
  chemically synthesized
tagactggataaagaaaatg

SEQ ID NO: 430852 - DNA, 20 bp, Artificial Sequence
  chemically synthesized
tgtgccacattttctttatc

SEQ ID NO: 430853 - DNA, 20 bp, Artificial Sequence
  chemically synthesized
catcagtgatagactggata

SEQ ID NO: 430854 - DNA, 20 bp, Artificial Sequence
  chemically synthesized
aatgcccatcagtgatagac

SEQ ID NO: 430855 - DNA, 20 bp, Artificial Sequence
  chemically synthesized
tttatccagtctatcactga

SEQ ID NO: 430856 - DNA, 20 bp, Artificial Sequence
  chemically synthesized
acccaaatgcccatcagtga

SEQ ID NO: 430857 - DNA, 20 bp, Artificial Sequence
  chemically synthesized
ttatccagtctatcactgat

SEQ ID NO: 430858 - DNA, 20 bp, Artificial Sequence
  chemically synthesized
gaaccaacccaaatgcccat

SEQ ID NO: 430859 - DNA, 20 bp, Artificial Sequence
  chemically synthesized
gtctatcactgatgggcatt

SEQ ID NO: 430860 - DNA, 20 bp, Artificial Sequence
  chemically synthesized
tctatcactgatgggcattt

SEQ ID NO: 430861 - DNA, 20 bp, Artificial Sequence
  chemically synthesized
tcactgatgggcatttgggt

SEQ ID NO: 430862 - DNA, 20 bp, Artificial Sequence
  chemically synthesized
tgggcatttgggttggttct

SEQ ID NO: 430863 - DNA, 20 bp, Artificial Sequence
  chemically synthesized
tattcccaagagcaaagact

SEQ ID NO: 430864 - DNA, 20 bp, Artificial Sequence
  chemically synthesized
tggttctaagtctttgctct

SEQ ID NO: 430865 - DNA, 20 bp, Artificial Sequence
  chemically synthesized
ggttctaagtctttgctctt

SEQ ID NO: 430866 - DNA, 20 bp, Artificial Sequence
  chemically synthesized
cagcactattcccaagagca

SEQ ID NO: 430867 - DNA, 20 bp, Artificial Sequence
  chemically synthesized
taagtctttgctcttgggaa

SEQ ID NO: 430868 - DNA, 20 bp, Artificial Sequence
  chemically synthesized
tattgcagcactattcccaa

SEQ ID NO: 430869 - DNA, 20 bp, Artificial Sequence
  chemically synthesized
tttattgcagcactattccc

SEQ ID NO: 430870 - DNA, 20 bp, Artificial Sequence
  chemically synthesized
atgtacacgtatgtttattg

SEQ ID NO: 430871 - DNA, 20 bp, Artificial Sequence
  chemically synthesized
tacgtgtacatgtgtcttta

SEQ ID NO: 430872 - DNA, 20 bp, Artificial Sequence
  chemically synthesized
gtgtacatgtgtctttatag

SEQ ID NO: 430873 - DNA, 20 bp, Artificial Sequence
  chemically synthesized
ttataaatcattctactata

SEQ ID NO: 430874 - DNA, 20 bp, Artificial Sequence
  chemically synthesized
agaatgatttataatccttt

SEQ ID NO: 430875 - DNA, 20 bp, Artificial Sequence
  chemically synthesized
attactgggtgtatactcaa

SEQ ID NO: 430876 - DNA, 20 bp, Artificial Sequence
  chemically synthesized
cattactgggtgtatactca

SEQ ID NO: 430877 - DNA, 20 bp, Artificial Sequence
  chemically synthesized
taatcctttgagtatacacc

SEQ ID NO: 430878 - DNA, 20 bp, Artificial Sequence
  chemically synthesized
tttgagtatacacccagtaa

SEQ ID NO: 430879 - DNA, 20 bp, Artificial Sequence
  chemically synthesized
ttgagtatacacccagtaat

SEQ ID NO: 430880 - DNA, 20 bp, Artificial Sequence
  chemically synthesized
gacccagcaatcccattact

SEQ ID NO: 430881 - DNA, 20 bp, Artificial Sequence
  chemically synthesized
tgacccagcaatcccattac

SEQ ID NO: 430882 - DNA, 20 bp, Artificial Sequence
  chemically synthesized
acacccagtaatgggattgc

SEQ ID NO: 430883 - DNA, 20 bp, Artificial Sequence
  chemically synthesized
cacccagtaatgggattgct

SEQ ID NO: 430884 - DNA, 20 bp, Artificial Sequence
  chemically synthesized
aatgggattgctgggtcaaa

SEQ ID NO: 430885 - DNA, 20 bp, Artificial Sequence
  chemically synthesized
accagaaataccatttgacc

SEQ ID NO: 430886 - DNA, 20 bp, Artificial Sequence
  chemically synthesized
gctgggtcaaatggtatttc

SEQ ID NO: 430887 - DNA, 20 bp, Artificial Sequence
  chemically synthesized
tcaaatggtatttctggttc

SEQ ID NO: 430888 - DNA, 20 bp, Artificial Sequence
  chemically synthesized
attcctcaaggatctagaac

SEQ ID NO: 430889 - DNA, 20 bp, Artificial Sequence
  chemically synthesized
atttctggttctagatcctt

SEQ ID NO: 430890 - DNA, 20 bp, Artificial Sequence
  chemically synthesized
tatgcaattcctcaaggatc

SEQ ID NO: 430891 - DNA, 20 bp, Artificial Sequence
  chemically synthesized
tttctggttctagatccttg

SEQ ID NO: 430892 - DNA, 20 bp, Artificial Sequence
  chemically synthesized
ttgaggtatgcaattcctca

SEQ ID NO: 430893 - DNA, 20 bp, Artificial Sequence
  chemically synthesized
attgaggtatgcaattcctc

SEQ ID NO: 430894 - DNA, 20 bp, Artificial Sequence
  chemically synthesized
taaattgtatttaaaaattg

SEQ ID NO: 430895 - DNA, 20 bp, Artificial Sequence
  chemically synthesized
ttaaattgtatttaaaaatt

SEQ ID NO: 430896 - DNA, 20 bp, Artificial Sequence
  chemically synthesized
aggtaggcctgaatgtgata

SEQ ID NO: 430897 - DNA, 20 bp, Artificial Sequence
  chemically synthesized
ttttttatctatatcacatt

SEQ ID NO: 430898 - DNA, 20 bp, Artificial Sequence
  chemically synthesized
tttttatctatatcacattc

SEQ ID NO: 430899 - DNA, 20 bp, Artificial Sequence
  chemically synthesized
cacattcaggcctacctcta

SEQ ID NO: 430900 - DNA, 20 bp, Artificial Sequence
  chemically synthesized
tcattatatactttagaggt

SEQ ID NO: 430901 - DNA, 20 bp, Artificial Sequence
  chemically synthesized
gtcattatatactttagagg

SEQ ID NO: 430902 - DNA, 20 bp, Artificial Sequence
  chemically synthesized
attgtcattatatactttag

SEQ ID NO: 430903 - DNA, 20 bp, Artificial Sequence
  chemically synthesized
gattgtcattatatacttta

SEQ ID NO: 430904 - DNA, 20 bp, Artificial Sequence
  chemically synthesized
gggattgtcattatatactt

SEQ ID NO: 430905 - DNA, 20 bp, Artificial Sequence
  chemically synthesized
agtggaaccattgtaaatcg

SEQ ID NO: 430906 - DNA, 20 bp, Artificial Sequence
  chemically synthesized
aagtggaaccattgtaaatc

SEQ ID NO: 430907 - DNA, 20 bp, Artificial Sequence
  chemically synthesized
taagtggaaccattgtaaat

SEQ ID NO: 430908 - DNA, 20 bp, Artificial Sequence
  chemically synthesized
tgacaatccccgatttacaa

SEQ ID NO: 430909 - DNA, 20 bp, Artificial Sequence
  chemically synthesized
caaagtcaaaaaattgtaag

SEQ ID NO: 430910 - DNA, 20 bp, Artificial Sequence
  chemically synthesized
ttgcaaagtcaaaaaattgt

SEQ ID NO: 430911 - DNA, 20 bp, Artificial Sequence
  chemically synthesized
acaattttttgactttgcaa

SEQ ID NO: 430912 - DNA, 20 bp, Artificial Sequence
  chemically synthesized
cactatttcataccattgca

SEQ ID NO: 430913 - DNA, 20 bp, Artificial Sequence
  chemically synthesized
gactttgcaatggtatgaaa

SEQ ID NO: 430914 - DNA, 20 bp, Artificial Sequence
  chemically synthesized
ggtatgaaatagtgcacatt

SEQ ID NO: 430915 - DNA, 20 bp, Artificial Sequence
  chemically synthesized
atgaaatagtgcacattcag

SEQ ID NO: 430916 - DNA, 20 bp, Artificial Sequence
  chemically synthesized
ttcagtagaaaccacacttc

SEQ ID NO: 430917 - DNA, 20 bp, Artificial Sequence
  chemically synthesized
ttgtatggatacttgaagtg

SEQ ID NO: 430918 - DNA, 20 bp, Artificial Sequence
  chemically synthesized
aatggttgtatggatacttg

SEQ ID NO: 430919 - DNA, 20 bp, Artificial Sequence
  chemically synthesized
tgaaaaccagaatggttgta

SEQ ID NO: 430920 - DNA, 20 bp, Artificial Sequence
  chemically synthesized
aagtatccatacaaccattc

SEQ ID NO: 430921 - DNA, 20 bp, Artificial Sequence
  chemically synthesized
acttaaagtgaaaaccagaa

SEQ ID NO: 430922 - DNA, 20 bp, Artificial Sequence
  chemically synthesized
actgtacttaaagtgaaaac

SEQ ID NO: 430923 - DNA, 20 bp, Artificial Sequence
  chemically synthesized
accattctggttttcacttt

SEQ ID NO: 430924 - DNA, 20 bp, Artificial Sequence
  chemically synthesized
tctggttttcactttaagta

SEQ ID NO: 430925 - DNA, 20 bp, Artificial Sequence
  chemically synthesized
tttattcagtactgtactta

SEQ ID NO: 430926 - DNA, 20 bp, Artificial Sequence
  chemically synthesized
ttaagtacagtactgaataa

SEQ ID NO: 430927 - DNA, 20 bp, Artificial Sequence
  chemically synthesized
agtgttgagtatcttttatt

SEQ ID NO: 430928 - DNA, 20 bp, Artificial Sequence
  chemically synthesized
ctattttataataaagtgtt

SEQ ID NO: 430929 - DNA, 20 bp, Artificial Sequence
  chemically synthesized
tcaaattctattttataata

SEQ ID NO: 430930 - DNA, 20 bp, Artificial Sequence
  chemically synthesized
ctcaacactttattataaaa

SEQ ID NO: 430931 - DNA, 20 bp, Artificial Sequence
  chemically synthesized
tttattataaaatagaattt

SEQ ID NO: 430932 - DNA, 20 bp, Artificial Sequence
  chemically synthesized
ttataaaatagaatttgagt

SEQ ID NO: 430933 - DNA, 20 bp, Artificial Sequence
  chemically synthesized
tagataattttgcccaaata

SEQ ID NO: 430934 - DNA, 20 bp, Artificial Sequence
  chemically synthesized
agataattttgcccaaatat

SEQ ID NO: 430935 - DNA, 20 bp, Artificial Sequence
  chemically synthesized
actgagattagcctatattt

SEQ ID NO: 430936 - DNA, 20 bp, Artificial Sequence
  chemically synthesized
cactgagattagcctatatt

SEQ ID NO: 430937 - DNA, 20 bp, Artificial Sequence
  chemically synthesized
gcccaaatataggctaatct

SEQ ID NO: 430938 - DNA, 20 bp, Artificial Sequence
  chemically synthesized
catgctcagaacactgagat

SEQ ID NO: 430939 - DNA, 20 bp, Artificial Sequence
  chemically synthesized
ttaatcatgctcagaacact

SEQ ID NO: 430940 - DNA, 20 bp, Artificial Sequence
  chemically synthesized
taggctaatctcagtgttct

SEQ ID NO: 430941 - DNA, 20 bp, Artificial Sequence
  chemically synthesized
tagcctaccttaatcatgct

SEQ ID NO: 430942 - DNA, 20 bp, Artificial Sequence
  chemically synthesized
tcagtgttctgagcatgatt

SEQ ID NO: 430943 - DNA, 20 bp, Artificial Sequence
  chemically synthesized
cagtgttctgagcatgatta

SEQ ID NO: 430944 - DNA, 20 bp, Artificial Sequence
  chemically synthesized
tgttctgagcatgattaagg

SEQ ID NO: 430945 - DNA, 20 bp, Artificial Sequence
  chemically synthesized
gttctgagcatgattaaggt

SEQ ID NO: 430946 - DNA, 20 bp, Artificial Sequence
  chemically synthesized
tgagcatgattaaggtaggc

SEQ ID NO: 430947 - DNA, 20 bp, Artificial Sequence
  chemically synthesized
tgattaaggtaggctagtct

SEQ ID NO: 430948 - DNA, 20 bp, Artificial Sequence
  chemically synthesized
ccaaacatcatagcttagac

SEQ ID NO: 430949 - DNA, 20 bp, Artificial Sequence
  chemically synthesized
atctaccaaacatcatagct

SEQ ID NO: 430950 - DNA, 20 bp, Artificial Sequence
  chemically synthesized
ctagtctaagctatgatgtt

SEQ ID NO: 430951 - DNA, 20 bp, Artificial Sequence
  chemically synthesized
acctaatctaccaaacatca

SEQ ID NO: 430952 - DNA, 20 bp, Artificial Sequence
  chemically synthesized
gtctaagctatgatgtttgg

SEQ ID NO: 430953 - DNA, 20 bp, Artificial Sequence
  chemically synthesized
agctatgatgtttggtagat

SEQ ID NO: 430954 - DNA, 20 bp, Artificial Sequence
  chemically synthesized
gctatgatgtttggtagatt

SEQ ID NO: 430955 - DNA, 20 bp, Artificial Sequence
  chemically synthesized
taatttgaaaatattataag

SEQ ID NO: 430956 - DNA, 20 bp, Artificial Sequence
  chemically synthesized
ccataatttgaaaatattat

SEQ ID NO: 430957 - DNA, 20 bp, Artificial Sequence
  chemically synthesized
cttataatattttcaaatta

SEQ ID NO: 430958 - DNA, 20 bp, Artificial Sequence
  chemically synthesized
ataatattttcaaattatgg

SEQ ID NO: 430959 - DNA, 20 bp, Artificial Sequence
  chemically synthesized
taatattttcaaattatggt

SEQ ID NO: 430960 - DNA, 20 bp, Artificial Sequence
  chemically synthesized
tcaaattatggtgggtttat

SEQ ID NO: 430961 - DNA, 20 bp, Artificial Sequence
  chemically synthesized
ttggaacataaccccactgt

SEQ ID NO: 430962 - DNA, 20 bp, Artificial Sequence
  chemically synthesized
atatccctcgacttacagtg

SEQ ID NO: 430963 - DNA, 20 bp, Artificial Sequence
  chemically synthesized
gatatccctcgacttacagt

SEQ ID NO: 430964 - DNA, 20 bp, Artificial Sequence
  chemically synthesized
tgatatccctcgacttacag

SEQ ID NO: 430965 - DNA, 20 bp, Artificial Sequence
  chemically synthesized
acataaccccactgtaagtc

SEQ ID NO: 430966 - DNA, 20 bp, Artificial Sequence
  chemically synthesized
cataaccccactgtaagtcg

SEQ ID NO: 430967 - DNA, 20 bp, Artificial Sequence
  chemically synthesized
tgctgatatccctcgactta

SEQ ID NO: 430968 - DNA, 20 bp, Artificial Sequence
  chemically synthesized
ataaccccactgtaagtcga

SEQ ID NO: 430969 - DNA, 20 bp, Artificial Sequence
  chemically synthesized
cactgtaagtcgagggatat

SEQ ID NO: 430970 - DNA, 20 bp, Artificial Sequence
  chemically synthesized
agggatatcagcaacgcgtt

SEQ ID NO: 430971 - DNA, 20 bp, Artificial Sequence
  chemically synthesized
gggatatcagcaacgcgttt

SEQ ID NO: 430972 - DNA, 20 bp, Artificial Sequence
  chemically synthesized
agcaacgcgtttaggaaaaa

SEQ ID NO: 430973 - DNA, 20 bp, Artificial Sequence
  chemically synthesized
caacgcgtttaggaaaaata

SEQ ID NO: 430974 - DNA, 20 bp, Artificial Sequence
  chemically synthesized
aacgcgtttaggaaaaatag

SEQ ID NO: 430975 - DNA, 20 bp, Artificial Sequence
  chemically synthesized
gtttaggaaaaatagaggca

SEQ ID NO: 430976 - DNA, 20 bp, Artificial Sequence
  chemically synthesized
aatagaggcaaagtgtcctc

SEQ ID NO: 430977 - DNA, 20 bp, Artificial Sequence
  chemically synthesized
atagaggcaaagtgtcctct

SEQ ID NO: 430978 - DNA, 20 bp, Artificial Sequence
  chemically synthesized
tagaggcaaagtgtcctcta

SEQ ID NO: 430979 - DNA, 20 bp, Artificial Sequence
  chemically synthesized
aggcaaagtgtcctctaggg

SEQ ID NO: 430980 - DNA, 20 bp, Artificial Sequence
  chemically synthesized
ggtagctgagtccaccctag

SEQ ID NO: 430981 - DNA, 20 bp, Artificial Sequence
  chemically synthesized
tggtagctgagtccacccta

SEQ ID NO: 430982 - DNA, 20 bp, Artificial Sequence
  chemically synthesized
cctggtagctgagtccaccc

SEQ ID NO: 430983 - DNA, 20 bp, Artificial Sequence
  chemically synthesized
agtgtcctctagggtggact

SEQ ID NO: 430984 - DNA, 20 bp, Artificial Sequence
  chemically synthesized
tctagggtggactcagctac

SEQ ID NO: 430985 - DNA, 20 bp, Artificial Sequence
  chemically synthesized
ctagggtggactcagctacc

SEQ ID NO: 430986 - DNA, 20 bp, Artificial Sequence
  chemically synthesized
aggctgtggccctggtagct

SEQ ID NO: 430987 - DNA, 20 bp, Artificial Sequence
  chemically synthesized
tagggtggactcagctacca

SEQ ID NO: 430988 - DNA, 20 bp, Artificial Sequence
  chemically synthesized
tgactaggctgtggccctgg

SEQ ID NO: 430989 - DNA, 20 bp, Artificial Sequence
  chemically synthesized
ggactcagctaccagggcca

SEQ ID NO: 430990 - DNA, 20 bp, Artificial Sequence
  chemically synthesized
ccctgactaggctgtggccc

SEQ ID NO: 430991 - DNA, 20 bp, Artificial Sequence
  chemically synthesized
cagctaccagggccacagcc

SEQ ID NO: 430992 - DNA, 20 bp, Artificial Sequence
  chemically synthesized
cagtgtccctgactaggctg

SEQ ID NO: 430993 - DNA, 20 bp, Artificial Sequence
  chemically synthesized
taccagggccacagcctagt

SEQ ID NO: 430994 - DNA, 20 bp, Artificial Sequence
  chemically synthesized
accagggccacagcctagtc

SEQ ID NO: 430995 - DNA, 20 bp, Artificial Sequence
  chemically synthesized
ccagggccacagcctagtca

SEQ ID NO: 430996 - DNA, 20 bp, Artificial Sequence
  chemically synthesized
taaaggcagtgtccctgact

SEQ ID NO: 430997 - DNA, 20 bp, Artificial Sequence
  chemically synthesized
ataaaggcagtgtccctgac

SEQ ID NO: 430998 - DNA, 20 bp, Artificial Sequence
  chemically synthesized
agccttccttcacataaagg

SEQ ID NO: 430999 - DNA, 20 bp, Artificial Sequence
  chemically synthesized
agggacactgcctttatgtg

SEQ ID NO: 431000 - DNA, 20 bp, Artificial Sequence
  chemically synthesized
tagagccttccttcacataa

SEQ ID NO: 431001 - DNA, 20 bp, Artificial Sequence
  chemically synthesized
gggacactgcctttatgtga

SEQ ID NO: 431002 - DNA, 20 bp, Artificial Sequence
  chemically synthesized
gtagagccttccttcacata

SEQ ID NO: 431003 - DNA, 20 bp, Artificial Sequence
  chemically synthesized
acactgcctttatgtgaagg

SEQ ID NO: 431004 - DNA, 20 bp, Artificial Sequence
  chemically synthesized
cactgcctttatgtgaagga

SEQ ID NO: 431005 - DNA, 20 bp, Artificial Sequence
  chemically synthesized
gtgtctgccctgaggaagta

SEQ ID NO: 431006 - DNA, 20 bp, Artificial Sequence
  chemically synthesized
gaaggaaggctctacttcct

SEQ ID NO: 431007 - DNA, 20 bp, Artificial Sequence
  chemically synthesized
aaggaaggctctacttcctc

SEQ ID NO: 431008 - DNA, 20 bp, Artificial Sequence
  chemically synthesized
ttgtgtctgccctgaggaag

SEQ ID NO: 431009 - DNA, 20 bp, Artificial Sequence
  chemically synthesized
aggaaggctctacttcctca

SEQ ID NO: 431010 - DNA, 20 bp, Artificial Sequence
  chemically synthesized
ggattgtgtctgccctgagg

SEQ ID NO: 431011 - DNA, 20 bp, Artificial Sequence
  chemically synthesized
aaggctctacttcctcaggg

SEQ ID NO: 431012 - DNA, 20 bp, Artificial Sequence
  chemically synthesized
atgggattgtgtctgccctg

SEQ ID NO: 431013 - DNA, 20 bp, Artificial Sequence
  chemically synthesized
catgggattgtgtctgccct

SEQ ID NO: 431014 - DNA, 20 bp, Artificial Sequence
  chemically synthesized
cagggcagacacaatcccat

SEQ ID NO: 431015 - DNA, 20 bp, Artificial Sequence
  chemically synthesized
ggcatccaagacacactcat

SEQ ID NO: 431016 - DNA, 20 bp, Artificial Sequence
  chemically synthesized
aggcatccaagacacactca

SEQ ID NO: 431017 - DNA, 20 bp, Artificial Sequence
  chemically synthesized
acaatcccatgagtgtgtct

SEQ ID NO: 431018 - DNA, 20 bp, Artificial Sequence
  chemically synthesized
agccctttgtaaaggcatcc

SEQ ID NO: 431019 - DNA, 20 bp, Artificial Sequence
  chemically synthesized
gtgtcttggatgcctttaca

SEQ ID NO: 431020 - DNA, 20 bp, Artificial Sequence
  chemically synthesized
tgtcttggatgcctttacaa

SEQ ID NO: 431021 - DNA, 20 bp, Artificial Sequence
  chemically synthesized
gtcttggatgcctttacaaa

SEQ ID NO: 431022 - DNA, 20 bp, Artificial Sequence
  chemically synthesized
tgaaatccagccctttgtaa

SEQ ID NO: 431023 - DNA, 20 bp, Artificial Sequence
  chemically synthesized
ctgaaatccagccctttgta

SEQ ID NO: 431024 - DNA, 20 bp, Artificial Sequence
  chemically synthesized
tggatgcctttacaaagggc

SEQ ID NO: 431025 - DNA, 20 bp, Artificial Sequence
  chemically synthesized
ctttacaaagggctggattt

SEQ ID NO: 431026 - DNA, 20 bp, Artificial Sequence
  chemically synthesized
ggcaggtgaggactgaaatc

SEQ ID NO: 431027 - DNA, 20 bp, Artificial Sequence
  chemically synthesized
ctcggctgagaaggcaggtg

SEQ ID NO: 431028 - DNA, 20 bp, Artificial Sequence
  chemically synthesized
gctcggctgagaaggcaggt

SEQ ID NO: 431029 - DNA, 20 bp, Artificial Sequence
  chemically synthesized
tcagtcctcacctgccttct

SEQ ID NO: 431030 - DNA, 20 bp, Artificial Sequence
  chemically synthesized
gcatgctcggctgagaaggc

SEQ ID NO: 431031 - DNA, 20 bp, Artificial Sequence
  chemically synthesized
ggcatgctcggctgagaagg

SEQ ID NO: 431032 - DNA, 20 bp, Artificial Sequence
  chemically synthesized
ccaggcatgctcggctgaga

SEQ ID NO: 431033 - DNA, 20 bp, Artificial Sequence
  chemically synthesized
cctcacctgccttctcagcc

SEQ ID NO: 431034 - DNA, 20 bp, Artificial Sequence
  chemically synthesized
cccaggcatgctcggctgag

SEQ ID NO: 431035 - DNA, 20 bp, Artificial Sequence
  chemically synthesized
atgcccaggcatgctcggct

SEQ ID NO: 431036 - DNA, 20 bp, Artificial Sequence
  chemically synthesized
tttgcatgcccaggcatgct

SEQ ID NO: 431037 - DNA, 20 bp, Artificial Sequence
  chemically synthesized
ccttctcagccgagcatgcc

SEQ ID NO: 431038 - DNA, 20 bp, Artificial Sequence
  chemically synthesized
cttctcagccgagcatgcct

SEQ ID NO: 431039 - DNA, 20 bp, Artificial Sequence
  chemically synthesized
tgtgctatttttgcatgccc

SEQ ID NO: 431040 - DNA, 20 bp, Artificial Sequence
  chemically synthesized
ttgtgctatttttgcatgcc

SEQ ID NO: 431041 - DNA, 20 bp, Artificial Sequence
  chemically synthesized
catgcctgggcatgcaaaaa

SEQ ID NO: 431042 - DNA, 20 bp, Artificial Sequence
  chemically synthesized
ggcatgcaaaaatagcacaa

SEQ ID NO: 431043 - DNA, 20 bp, Artificial Sequence
  chemically synthesized
aaaaatagcacaatggtaca

SEQ ID NO: 431044 - DNA, 20 bp, Artificial Sequence
  chemically synthesized
ttttaatggaatgtatttaa

SEQ ID NO: 431045 - DNA, 20 bp, Artificial Sequence
  chemically synthesized
gttttaatggaatgtattta

SEQ ID NO: 431046 - DNA, 20 bp, Artificial Sequence
  chemically synthesized
tgttttaatggaatgtattt

SEQ ID NO: 431047 - DNA, 20 bp, Artificial Sequence
  chemically synthesized
aatttatgtatttgttttaa

SEQ ID NO: 431048 - DNA, 20 bp, Artificial Sequence
  chemically synthesized
ttaaaacaaatacataaatt

SEQ ID NO: 431049 - DNA, 20 bp, Artificial Sequence
  chemically synthesized
aaacaaatacataaatttgg

SEQ ID NO: 431050 - DNA, 20 bp, Artificial Sequence
  chemically synthesized
aacaaatacataaatttggc

SEQ ID NO: 431051 - DNA, 20 bp, Artificial Sequence
  chemically synthesized
acaaatacataaatttggca

SEQ ID NO: 431052 - DNA, 20 bp, Artificial Sequence
  chemically synthesized
tacataaatttggcagggca

SEQ ID NO: 431053 - DNA, 20 bp, Artificial Sequence
  chemically synthesized
aaatttggcagggcaaagtt

SEQ ID NO: 431054 - DNA, 20 bp, Artificial Sequence
  chemically synthesized
tggcagggcaaagttaagtt

SEQ ID NO: 431055 - DNA, 20 bp, Artificial Sequence
  chemically synthesized
ccttgctggcttttgaataa

SEQ ID NO: 431056 - DNA, 20 bp, Artificial Sequence
  chemically synthesized
tttagaaatctattattcaa

SEQ ID NO: 431057 - DNA, 20 bp, Artificial Sequence
  chemically synthesized
gaaatctattattcaaaagc

SEQ ID NO: 431058 - DNA, 20 bp, Artificial Sequence
  chemically synthesized
tctattattcaaaagccagc

SEQ ID NO: 431059 - DNA, 20 bp, Artificial Sequence
  chemically synthesized
ctattattcaaaagccagca

SEQ ID NO: 431060 - DNA, 20 bp, Artificial Sequence
  chemically synthesized
aaggactttagaatccttgc

SEQ ID NO: 431061 - DNA, 20 bp, Artificial Sequence
  chemically synthesized
aaaagccagcaaggattcta

SEQ ID NO: 431062 - DNA, 20 bp, Artificial Sequence
  chemically synthesized
ctaagatcactgaaggactt

SEQ ID NO: 431063 - DNA, 20 bp, Artificial Sequence
  chemically synthesized
gcaaggattctaaagtcctt

SEQ ID NO: 431064 - DNA, 20 bp, Artificial Sequence
  chemically synthesized
tcgcaatctaagatcactga

SEQ ID NO: 431065 - DNA, 20 bp, Artificial Sequence
  chemically synthesized
atcgcaatctaagatcactg

SEQ ID NO: 431066 - DNA, 20 bp, Artificial Sequence
  chemically synthesized
ctaaagtccttcagtgatct

SEQ ID NO: 431067 - DNA, 20 bp, Artificial Sequence
  chemically synthesized
tcttcaaaagatcgcaatct

SEQ ID NO: 431068 - DNA, 20 bp, Artificial Sequence
  chemically synthesized
tcttagattgcgatcttttg

SEQ ID NO: 431069 - DNA, 20 bp, Artificial Sequence
  chemically synthesized
tagattgcgatcttttgaag

SEQ ID NO: 431070 - DNA, 20 bp, Artificial Sequence
  chemically synthesized
atatttaatgtcttcttcaa

SEQ ID NO: 431071 - DNA, 20 bp, Artificial Sequence
  chemically synthesized
tgataaatgaggtcagatat

SEQ ID NO: 431072 - DNA, 20 bp, Artificial Sequence
  chemically synthesized
ttcctcttgataaatgaggt

SEQ ID NO: 431073 - DNA, 20 bp, Artificial Sequence
  chemically synthesized
acatttcctcttgataaatg

SEQ ID NO: 431074 - DNA, 20 bp, Artificial Sequence
  chemically synthesized
aatatctgacctcatttatc

SEQ ID NO: 431075 - DNA, 20 bp, Artificial Sequence
  chemically synthesized
cacatttcctcttgataaat

SEQ ID NO: 431076 - DNA, 20 bp, Artificial Sequence
  chemically synthesized
tatctgacctcatttatcaa

SEQ ID NO: 431077 - DNA, 20 bp, Artificial Sequence
  chemically synthesized
atctgacctcatttatcaag

SEQ ID NO: 431078 - DNA, 20 bp, Artificial Sequence
  chemically synthesized
catttatcaagaggaaatgt

SEQ ID NO: 431079 - DNA, 20 bp, Artificial Sequence
  chemically synthesized
ggaaatgtgagtttctctca

SEQ ID NO: 431080 - DNA, 20 bp, Artificial Sequence
  chemically synthesized
gaaatgtgagtttctctcaa

SEQ ID NO: 431081 - DNA, 20 bp, Artificial Sequence
  chemically synthesized
aaatgtgagtttctctcaaa

SEQ ID NO: 431082 - DNA, 20 bp, Artificial Sequence
  chemically synthesized
atctactcaacaccctttga

SEQ ID NO: 431083 - DNA, 20 bp, Artificial Sequence
  chemically synthesized
atatctactcaacacccttt

SEQ ID NO: 431084 - DNA, 20 bp, Artificial Sequence
  chemically synthesized
agtttctctcaaagggtgtt

SEQ ID NO: 431085 - DNA, 20 bp, Artificial Sequence
  chemically synthesized
ttctctcaaagggtgttgag

SEQ ID NO: 431086 - DNA, 20 bp, Artificial Sequence
  chemically synthesized
tgagttctgtttgttagaga

SEQ ID NO: 431087 - DNA, 20 bp, Artificial Sequence
  chemically synthesized
tgtttactatctctaacaaa

SEQ ID NO: 431088 - DNA, 20 bp, Artificial Sequence
  chemically synthesized
tggatgagttctgtttgtta

SEQ ID NO: 431089 - DNA, 20 bp, Artificial Sequence
  chemically synthesized
tctggatgagttctgtttgt

SEQ ID NO: 431090 - DNA, 20 bp, Artificial Sequence
  chemically synthesized
tctaacaaacagaactcatc

SEQ ID NO: 431091 - DNA, 20 bp, Artificial Sequence
  chemically synthesized
accaagattatcatctggat

SEQ ID NO: 431092 - DNA, 20 bp, Artificial Sequence
  chemically synthesized
gcaagaccaagattatcatc

SEQ ID NO: 431093 - DNA, 20 bp, Artificial Sequence
  chemically synthesized
actcatccagatgataatct

SEQ ID NO: 431094 - DNA, 20 bp, Artificial Sequence
  chemically synthesized
catcaccggcaggcaagacc

SEQ ID NO: 431095 - DNA, 20 bp, Artificial Sequence
  chemically synthesized
ataatcttggtcttgcctgc

SEQ ID NO: 431096 - DNA, 20 bp, Artificial Sequence
  chemically synthesized
ctagatcatcaccggcaggc

SEQ ID NO: 431097 - DNA, 20 bp, Artificial Sequence
  chemically synthesized
tttactagatcatcaccggc

SEQ ID NO: 431098 - DNA, 20 bp, Artificial Sequence
  chemically synthesized
gtttactagatcatcaccgg

SEQ ID NO: 431099 - DNA, 20 bp, Artificial Sequence
  chemically synthesized
taagtttactagatcatcac

SEQ ID NO: 431100 - DNA, 20 bp, Artificial Sequence
  chemically synthesized
cttgcctgccggtgatgatc

SEQ ID NO: 431101 - DNA, 20 bp, Artificial Sequence
  chemically synthesized
tgctgtgtctataagtttac

SEQ ID NO: 431102 - DNA, 20 bp, Artificial Sequence
  chemically synthesized
gtgatgatctagtaaactta

SEQ ID NO: 431103 - DNA, 20 bp, Artificial Sequence
  chemically synthesized
atctagtaaacttatagaca

SEQ ID NO: 431104 - DNA, 20 bp, Artificial Sequence
  chemically synthesized
taaaaaattgctgtgtctat

SEQ ID NO: 431105 - DNA, 20 bp, Artificial Sequence
  chemically synthesized
ttatagacacagcaattttt

SEQ ID NO: 431106 - DNA, 20 bp, Artificial Sequence
  chemically synthesized
gcaattttttagcaaacttt

SEQ ID NO: 431107 - DNA, 20 bp, Artificial Sequence
  chemically synthesized
ttttttagcaaactttaaga

SEQ ID NO: 431108 - DNA, 20 bp, Artificial Sequence
  chemically synthesized
aattttgttatactatctta

SEQ ID NO: 431109 - DNA, 20 bp, Artificial Sequence
  chemically synthesized
agatagtataacaaaattta

SEQ ID NO: 431110 - DNA, 20 bp, Artificial Sequence
  chemically synthesized
caaaatttaaagacaaaact

SEQ ID NO: 431111 - DNA, 20 bp, Artificial Sequence
  chemically synthesized
aaaatttaaagacaaaacta

SEQ ID NO: 431112 - DNA, 20 bp, Artificial Sequence
  chemically synthesized
attaaaggtttaaaaatcct

SEQ ID NO: 431113 - DNA, 20 bp, Artificial Sequence
  chemically synthesized
tctaatttaaataagattaa

SEQ ID NO: 431114 - DNA, 20 bp, Artificial Sequence
  chemically synthesized
ttctaatttaaataagatta

SEQ ID NO: 431115 - DNA, 20 bp, Artificial Sequence
  chemically synthesized
gatagagttctaatttaaat

SEQ ID NO: 431116 - DNA, 20 bp, Artificial Sequence
  chemically synthesized
acctttaatcttatttaaat

SEQ ID NO: 431117 - DNA, 20 bp, Artificial Sequence
  chemically synthesized
ggacatttaattcattgata

SEQ ID NO: 431118 - DNA, 20 bp, Artificial Sequence
  chemically synthesized
ttggacatttaattcattga

SEQ ID NO: 431119 - DNA, 20 bp, Artificial Sequence
  chemically synthesized
aatgaattaaatgtccaacc

SEQ ID NO: 431120 - DNA, 20 bp, Artificial Sequence
  chemically synthesized
atgaattaaatgtccaacct

SEQ ID NO: 431121 - DNA, 20 bp, Artificial Sequence
  chemically synthesized
agaatttttaacacctaggt

SEQ ID NO: 431122 - DNA, 20 bp, Artificial Sequence
  chemically synthesized
atagagaatttttaacacct

SEQ ID NO: 431123 - DNA, 20 bp, Artificial Sequence
  chemically synthesized
aatagagaatttttaacacc

SEQ ID NO: 431124 - DNA, 20 bp, Artificial Sequence
  chemically synthesized
gagaaattattagagtaata

SEQ ID NO: 431125 - DNA, 20 bp, Artificial Sequence
  chemically synthesized
gggagaaattattagagtaa

SEQ ID NO: 431126 - DNA, 20 bp, Artificial Sequence
  chemically synthesized
aatttggggagaaattatta

SEQ ID NO: 431127 - DNA, 20 bp, Artificial Sequence
  chemically synthesized
aaaatttggggagaaattat

SEQ ID NO: 431128 - DNA, 20 bp, Artificial Sequence
  chemically synthesized
aatatgttacaaaatttggg

SEQ ID NO: 431129 - DNA, 20 bp, Artificial Sequence
  chemically synthesized
cgaatatgttacaaaatttg

SEQ ID NO: 431130 - DNA, 20 bp, Artificial Sequence
  chemically synthesized
tcgaatatgttacaaaattt

SEQ ID NO: 431131 - DNA, 20 bp, Artificial Sequence
  chemically synthesized
atcgaatatgttacaaaatt

SEQ ID NO: 431132 - DNA, 20 bp, Artificial Sequence
  chemically synthesized
ttgtaacatattcgatattc

SEQ ID NO: 431133 - DNA, 20 bp, Artificial Sequence
  chemically synthesized
tattacaatgcaaagagttc

SEQ ID NO: 431134 - DNA, 20 bp, Artificial Sequence
  chemically synthesized
aaatgctattacaatgcaaa

SEQ ID NO: 431135 - DNA, 20 bp, Artificial Sequence
  chemically synthesized
caaaatgctattacaatgca

SEQ ID NO: 431136 - DNA, 20 bp, Artificial Sequence
  chemically synthesized
cagaactctttgcattgtaa

SEQ ID NO: 431137 - DNA, 20 bp, Artificial Sequence
  chemically synthesized
gttttgctttagtatttaat

SEQ ID NO: 431138 - DNA, 20 bp, Artificial Sequence
  chemically synthesized
acgtatctcattaaatacta

SEQ ID NO: 431139 - DNA, 20 bp, Artificial Sequence
  chemically synthesized
tttcctttaatgttttgctt

SEQ ID NO: 431140 - DNA, 20 bp, Artificial Sequence
  chemically synthesized
aatactaaagcaaaacatta

SEQ ID NO: 431141 - DNA, 20 bp, Artificial Sequence
  chemically synthesized
atactaaagcaaaacattaa

SEQ ID NO: 431142 - DNA, 20 bp, Artificial Sequence
  chemically synthesized
cctcatctgtaggattggga

SEQ ID NO: 431143 - DNA, 20 bp, Artificial Sequence
  chemically synthesized
aaattactgtcccaatccta

SEQ ID NO: 431144 - DNA, 20 bp, Artificial Sequence
  chemically synthesized
atttcctcatctgtaggatt

SEQ ID NO: 431145 - DNA, 20 bp, Artificial Sequence
  chemically synthesized
aatttcctcatctgtaggat

SEQ ID NO: 431146 - DNA, 20 bp, Artificial Sequence
  chemically synthesized
actgtcccaatcctacagat

SEQ ID NO: 431147 - DNA, 20 bp, Artificial Sequence
  chemically synthesized
ctgtcccaatcctacagatg

SEQ ID NO: 431148 - DNA, 20 bp, Artificial Sequence
  chemically synthesized
gactcaatttcctcatctgt

SEQ ID NO: 431149 - DNA, 20 bp, Artificial Sequence
  chemically synthesized
agactcaatttcctcatctg

SEQ ID NO: 431150 - DNA, 20 bp, Artificial Sequence
  chemically synthesized
atcctacagatgaggaaatt

SEQ ID NO: 431151 - DNA, 20 bp, Artificial Sequence
  chemically synthesized
cagatgaggaaattgagtct

SEQ ID NO: 431152 - DNA, 20 bp, Artificial Sequence
  chemically synthesized
gaggaaattgagtctcagta

SEQ ID NO: 431153 - DNA, 20 bp, Artificial Sequence
  chemically synthesized
aaagatgatctaactatact

SEQ ID NO: 431154 - DNA, 20 bp, Artificial Sequence
  chemically synthesized
aaattgagtctcagtatagt

SEQ ID NO: 431155 - DNA, 20 bp, Artificial Sequence
  chemically synthesized
tatagttagatcatctttct

SEQ ID NO: 431156 - DNA, 20 bp, Artificial Sequence
  chemically synthesized
atagttagatcatctttcta

SEQ ID NO: 431157 - DNA, 20 bp, Artificial Sequence
  chemically synthesized
tagttagatcatctttctaa

SEQ ID NO: 431158 - DNA, 20 bp, Artificial Sequence
  chemically synthesized
agtcttgtgtttcccttaga

SEQ ID NO: 431159 - DNA, 20 bp, Artificial Sequence
  chemically synthesized
caaaagtcttgtgtttccct

SEQ ID NO: 431160 - DNA, 20 bp, Artificial Sequence
  chemically synthesized
catctttctaagggaaacac

SEQ ID NO: 431161 - DNA, 20 bp, Artificial Sequence
  chemically synthesized
tgactaattgataaagacaa

SEQ ID NO: 431162 - DNA, 20 bp, Artificial Sequence
  chemically synthesized
agacttttgtctttatcaat

SEQ ID NO: 431163 - DNA, 20 bp, Artificial Sequence
  chemically synthesized
aatgatgtgactaattgata

SEQ ID NO: 431164 - DNA, 20 bp, Artificial Sequence
  chemically synthesized
catcatttatatcatttatt

SEQ ID NO: 431165 - DNA, 20 bp, Artificial Sequence
  chemically synthesized
catttattgagcactgttct

SEQ ID NO: 431166 - DNA, 20 bp, Artificial Sequence
  chemically synthesized
atttattgagcactgttcta

SEQ ID NO: 431167 - DNA, 20 bp, Artificial Sequence
  chemically synthesized
tttattgagcactgttctaa

SEQ ID NO: 431168 - DNA, 20 bp, Artificial Sequence
  chemically synthesized
catttgtgatacccttagaa

SEQ ID NO: 431169 - DNA, 20 bp, Artificial Sequence
  chemically synthesized
gccgccatttgtgataccct

SEQ ID NO: 431170 - DNA, 20 bp, Artificial Sequence
  chemically synthesized
tgttctaagggtatcacaaa

SEQ ID NO: 431171 - DNA, 20 bp, Artificial Sequence
  chemically synthesized
tctaagggtatcacaaatgg

SEQ ID NO: 431172 - DNA, 20 bp, Artificial Sequence
  chemically synthesized
actgttgatgattcaaagag

SEQ ID NO: 431173 - DNA, 20 bp, Artificial Sequence
  chemically synthesized
tggactgttgatgattcaaa

SEQ ID NO: 431174 - DNA, 20 bp, Artificial Sequence
  chemically synthesized
gttggactgttgatgattca

SEQ ID NO: 431175 - DNA, 20 bp, Artificial Sequence
  chemically synthesized
gctgctctttgaatcatcaa

SEQ ID NO: 431176 - DNA, 20 bp, Artificial Sequence
  chemically synthesized
tgaatcatcaacagtccaac

SEQ ID NO: 431177 - DNA, 20 bp, Artificial Sequence
  chemically synthesized
gaatcatcaacagtccaaca

SEQ ID NO: 431178 - DNA, 20 bp, Artificial Sequence
  chemically synthesized
taacagcacctacaccttgt

SEQ ID NO: 431179 - DNA, 20 bp, Artificial Sequence
  chemically synthesized
atcaacagtccaacaaggtg

SEQ ID NO: 431180 - DNA, 20 bp, Artificial Sequence
  chemically synthesized
tcaacagtccaacaaggtgt

SEQ ID NO: 431181 - DNA, 20 bp, Artificial Sequence
  chemically synthesized
tgtaaacatggggaaaataa

SEQ ID NO: 431182 - DNA, 20 bp, Artificial Sequence
  chemically synthesized
ctacctcttctgtaaacatg

SEQ ID NO: 431183 - DNA, 20 bp, Artificial Sequence
  chemically synthesized
tgttattttccccatgttta

SEQ ID NO: 431184 - DNA, 20 bp, Artificial Sequence
  chemically synthesized
tctacctcttctgtaaacat

SEQ ID NO: 431185 - DNA, 20 bp, Artificial Sequence
  chemically synthesized
atctacctcttctgtaaaca

SEQ ID NO: 431186 - DNA, 20 bp, Artificial Sequence
  chemically synthesized
tattttccccatgtttacag

SEQ ID NO: 431187 - DNA, 20 bp, Artificial Sequence
  chemically synthesized
ttttccccatgtttacagaa

SEQ ID NO: 431188 - DNA, 20 bp, Artificial Sequence
  chemically synthesized
tttccccatgtttacagaag

SEQ ID NO: 431189 - DNA, 20 bp, Artificial Sequence
  chemically synthesized
ccccatgtttacagaagagg

SEQ ID NO: 431190 - DNA, 20 bp, Artificial Sequence
  chemically synthesized
gtttacagaagaggtagatt

SEQ ID NO: 431191 - DNA, 20 bp, Artificial Sequence
  chemically synthesized
tttacagaagaggtagattg

SEQ ID NO: 431192 - DNA, 20 bp, Artificial Sequence
  chemically synthesized
agaagaggtagattgaggaa

SEQ ID NO: 431193 - DNA, 20 bp, Artificial Sequence
  chemically synthesized
aagaggtagattgaggaaca

SEQ ID NO: 431194 - DNA, 20 bp, Artificial Sequence
  chemically synthesized
gaggtagattgaggaacaga

SEQ ID NO: 431195 - DNA, 20 bp, Artificial Sequence
  chemically synthesized
aggtagattgaggaacagag

SEQ ID NO: 431196 - DNA, 20 bp, Artificial Sequence
  chemically synthesized
agaggttaaataatgtgccc

SEQ ID NO: 431197 - DNA, 20 bp, Artificial Sequence
  chemically synthesized
gaggttaaataatgtgccca

SEQ ID NO: 431198 - DNA, 20 bp, Artificial Sequence
  chemically synthesized
ctctaccagcatttgacctt

SEQ ID NO: 431199 - DNA, 20 bp, Artificial Sequence
  chemically synthesized
tctctaccagcatttgacct

SEQ ID NO: 431200 - DNA, 20 bp, Artificial Sequence
  chemically synthesized
atgtgcccaaggtcaaatgc

SEQ ID NO: 431201 - DNA, 20 bp, Artificial Sequence
  chemically synthesized
tgcccaaggtcaaatgctgg

SEQ ID NO: 431202 - DNA, 20 bp, Artificial Sequence
  chemically synthesized
cccaaggtcaaatgctggta

SEQ ID NO: 431203 - DNA, 20 bp, Artificial Sequence
  chemically synthesized
aaaatggttttattctctac

SEQ ID NO: 431204 - DNA, 20 bp, Artificial Sequence
  chemically synthesized
aggcactcatacataaaaaa

SEQ ID NO: 431205 - DNA, 20 bp, Artificial Sequence
  chemically synthesized
taaaaccattttttatgtat

SEQ ID NO: 431206 - DNA, 20 bp, Artificial Sequence
  chemically synthesized
taaagagttttgtaagaaat

SEQ ID NO: 431207 - DNA, 20 bp, Artificial Sequence
  chemically synthesized
ataaagagttttgtaagaaa

SEQ ID NO: 431208 - DNA, 20 bp, Artificial Sequence
  chemically synthesized
atatatataaagagttttgt

SEQ ID NO: 431209 - DNA, 20 bp, Artificial Sequence
  chemically synthesized
ctgaacataatatatataaa

SEQ ID NO: 431210 - DNA, 20 bp, Artificial Sequence
  chemically synthesized
tactgaacataatatatata

SEQ ID NO: 431211 - DNA, 20 bp, Artificial Sequence
  chemically synthesized
ctctttatatatattatgtt

SEQ ID NO: 431212 - DNA, 20 bp, Artificial Sequence
  chemically synthesized
atatattatgttcagtattt

SEQ ID NO: 431213 - DNA, 20 bp, Artificial Sequence
  chemically synthesized
tatattatgttcagtatttt

SEQ ID NO: 431214 - DNA, 20 bp, Artificial Sequence
  chemically synthesized
atgttcagtattttaggaac

SEQ ID NO: 431215 - DNA, 20 bp, Artificial Sequence
  chemically synthesized
tcagtattttaggaaccaga

SEQ ID NO: 431216 - DNA, 20 bp, Artificial Sequence
  chemically synthesized
cagtattttaggaaccagaa

SEQ ID NO: 431217 - DNA, 20 bp, Artificial Sequence
  chemically synthesized
agtattttaggaaccagaaa

SEQ ID NO: 431218 - DNA, 20 bp, Artificial Sequence
  chemically synthesized
aataacaatatcaccctttc

SEQ ID NO: 431219 - DNA, 20 bp, Artificial Sequence
  chemically synthesized
agatttatcaataataaaat

SEQ ID NO: 431220 - DNA, 20 bp, Artificial Sequence
  chemically synthesized
cagatttatcaataataaaa

SEQ ID NO: 431221 - DNA, 20 bp, Artificial Sequence
  chemically synthesized
attttattattgataaatct

SEQ ID NO: 431222 - DNA, 20 bp, Artificial Sequence
  chemically synthesized
ttttattattgataaatctg

SEQ ID NO: 431223 - DNA, 20 bp, Artificial Sequence
  chemically synthesized
ttattgataaatctgaggtt

SEQ ID NO: 431224 - DNA, 20 bp, Artificial Sequence
  chemically synthesized
tgtttaacctttctcaacct

SEQ ID NO: 431225 - DNA, 20 bp, Artificial Sequence
  chemically synthesized
tgataaatctgaggttgaga

SEQ ID NO: 431226 - DNA, 20 bp, Artificial Sequence
  chemically synthesized
gataaatctgaggttgagaa

SEQ ID NO: 431227 - DNA, 20 bp, Artificial Sequence
  chemically synthesized
actcattagtcacgtaaatt

SEQ ID NO: 431228 - DNA, 20 bp, Artificial Sequence
  chemically synthesized
accaaatttacgtgactaat

SEQ ID NO: 431229 - DNA, 20 bp, Artificial Sequence
  chemically synthesized
gattcctggttgtcactcat

SEQ ID NO: 431230 - DNA, 20 bp, Artificial Sequence
  chemically synthesized
cgtgactaatgagtgacaac

SEQ ID NO: 431231 - DNA, 20 bp, Artificial Sequence
  chemically synthesized
gtgactaatgagtgacaacc

SEQ ID NO: 431232 - DNA, 20 bp, Artificial Sequence
  chemically synthesized
atgagtgacaaccaggaatc

SEQ ID NO: 431233 - DNA, 20 bp, Artificial Sequence
  chemically synthesized
caaaaggtgggctcgattcc

SEQ ID NO: 431234 - DNA, 20 bp, Artificial Sequence
  chemically synthesized
tttcagaaacagcaaaaggt

SEQ ID NO: 431235 - DNA, 20 bp, Artificial Sequence
  chemically synthesized
gtttcagaaacagcaaaagg

SEQ ID NO: 431236 - DNA, 20 bp, Artificial Sequence
  chemically synthesized
catgtttcagaaacagcaaa

SEQ ID NO: 431237 - DNA, 20 bp, Artificial Sequence
  chemically synthesized
acatgtttcagaaacagcaa

SEQ ID NO: 431238 - DNA, 20 bp, Artificial Sequence
  chemically synthesized
aagaatacatgtttcagaaa

SEQ ID NO: 431239 - DNA, 20 bp, Artificial Sequence
  chemically synthesized
tctgggaagaatacatgttt

SEQ ID NO: 431240 - DNA, 20 bp, Artificial Sequence
  chemically synthesized
tctgaaacatgtattcttcc

SEQ ID NO: 431241 - DNA, 20 bp, Artificial Sequence
  chemically synthesized
agattaaaggttattctggg

SEQ ID NO: 431242 - DNA, 20 bp, Artificial Sequence
  chemically synthesized
gagagattaaaggttattct

SEQ ID NO: 431243 - DNA, 20 bp, Artificial Sequence
  chemically synthesized
tgagagattaaaggttattc

SEQ ID NO: 431244 - DNA, 20 bp, Artificial Sequence
  chemically synthesized
agctgttattgagagattaa

SEQ ID NO: 431245 - DNA, 20 bp, Artificial Sequence
  chemically synthesized
gagctgttattgagagatta

SEQ ID NO: 431246 - DNA, 20 bp, Artificial Sequence
  chemically synthesized
aacctttaatctctcaataa

SEQ ID NO: 431247 - DNA, 20 bp, Artificial Sequence
  chemically synthesized
attgtatgagctgttattga

SEQ ID NO: 431248 - DNA, 20 bp, Artificial Sequence
  chemically synthesized
gaattgtatgagctgttatt

SEQ ID NO: 431249 - DNA, 20 bp, Artificial Sequence
  chemically synthesized
atgggaaggaggaattgtat

SEQ ID NO: 431250 - DNA, 20 bp, Artificial Sequence
  chemically synthesized
ggttttgtgagatgggaagg

SEQ ID NO: 431251 - DNA, 20 bp, Artificial Sequence
  chemically synthesized
aggttttgtgagatgggaag

SEQ ID NO: 431252 - DNA, 20 bp, Artificial Sequence
  chemically synthesized
ataggttttgtgagatggga

SEQ ID NO: 431253 - DNA, 20 bp, Artificial Sequence
  chemically synthesized
aataggttttgtgagatggg

SEQ ID NO: 431254 - DNA, 20 bp, Artificial Sequence
  chemically synthesized
cagaataggttttgtgagat

SEQ ID NO: 431255 - DNA, 20 bp, Artificial Sequence
  chemically synthesized
tcagaataggttttgtgaga

SEQ ID NO: 431256 - DNA, 20 bp, Artificial Sequence
  chemically synthesized
gagctcagaataggttttgt

SEQ ID NO: 431257 - DNA, 20 bp, Artificial Sequence
  chemically synthesized
catctcacaaaacctattct

SEQ ID NO: 431258 - DNA, 20 bp, Artificial Sequence
  chemically synthesized
gtagacatagagctcagaat

SEQ ID NO: 431259 - DNA, 20 bp, Artificial Sequence
  chemically synthesized
ggtagacatagagctcagaa

SEQ ID NO: 431260 - DNA, 20 bp, Artificial Sequence
  chemically synthesized
ttcgtggtagacatagagct

SEQ ID NO: 431261 - DNA, 20 bp, Artificial Sequence
  chemically synthesized
gcttattcgtggtagacata

SEQ ID NO: 431262 - DNA, 20 bp, Artificial Sequence
  chemically synthesized
gggcttattcgtggtagaca

SEQ ID NO: 431263 - DNA, 20 bp, Artificial Sequence
  chemically synthesized
actcttgggcttattcgtgg

SEQ ID NO: 431264 - DNA, 20 bp, Artificial Sequence
  chemically synthesized
gctctatgtctaccacgaat

SEQ ID NO: 431265 - DNA, 20 bp, Artificial Sequence
  chemically synthesized
tctactcttgggcttattcg

SEQ ID NO: 431266 - DNA, 20 bp, Artificial Sequence
  chemically synthesized
tgtctaccacgaataagccc

SEQ ID NO: 431267 - DNA, 20 bp, Artificial Sequence
  chemically synthesized
tctaccacgaataagcccaa

SEQ ID NO: 431268 - DNA, 20 bp, Artificial Sequence
  chemically synthesized
accacgaataagcccaagag

SEQ ID NO: 431269 - DNA, 20 bp, Artificial Sequence
  chemically synthesized
cacgaataagcccaagagta

SEQ ID NO: 431270 - DNA, 20 bp, Artificial Sequence
  chemically synthesized
gataaattctctctactctt

SEQ ID NO: 431271 - DNA, 20 bp, Artificial Sequence
  chemically synthesized
agataaattctctctactct

SEQ ID NO: 431272 - DNA, 20 bp, Artificial Sequence
  chemically synthesized
cgaataagcccaagagtaga

SEQ ID NO: 431273 - DNA, 20 bp, Artificial Sequence
  chemically synthesized
gtagagagaatttatctcac

SEQ ID NO: 431274 - DNA, 20 bp, Artificial Sequence
  chemically synthesized
tagagagaatttatctcaca

SEQ ID NO: 431275 - DNA, 20 bp, Artificial Sequence
  chemically synthesized
gggtatacggtaagccttgt

SEQ ID NO: 431276 - DNA, 20 bp, Artificial Sequence
  chemically synthesized
attgaaaaggggtatacggt

SEQ ID NO: 431277 - DNA, 20 bp, Artificial Sequence
  chemically synthesized
aattattgaaaaggggtata

SEQ ID NO: 431278 - DNA, 20 bp, Artificial Sequence
  chemically synthesized
tgataaaaattattgaaaag

SEQ ID NO: 431279 - DNA, 20 bp, Artificial Sequence
  chemically synthesized
gtgataaaaattattgaaaa

SEQ ID NO: 431280 - DNA, 20 bp, Artificial Sequence
  chemically synthesized
tgtgataaaaattattgaaa

SEQ ID NO: 431281 - DNA, 20 bp, Artificial Sequence
  chemically synthesized
atgtgataaaaattattgaa

SEQ ID NO: 431282 - DNA, 20 bp, Artificial Sequence
  chemically synthesized
tgttgactaaggaagagaaa

SEQ ID NO: 431283 - DNA, 20 bp, Artificial Sequence
  chemically synthesized
gttgttgactaaggaagaga

SEQ ID NO: 431284 - DNA, 20 bp, Artificial Sequence
  chemically synthesized
ttatttctctttctcttcct

SEQ ID NO: 431285 - DNA, 20 bp, Artificial Sequence
  chemically synthesized
aaatgttgttgactaaggaa

SEQ ID NO: 431286 - DNA, 20 bp, Artificial Sequence
  chemically synthesized
ttaaatgttgttgactaagg

SEQ ID NO: 431287 - DNA, 20 bp, Artificial Sequence
  chemically synthesized
aaattaaatgttgttgacta

SEQ ID NO: 431288 - DNA, 20 bp, Artificial Sequence
  chemically synthesized
taaattaaatgttgttgact

SEQ ID NO: 431289 - DNA, 20 bp, Artificial Sequence
  chemically synthesized
tagtgtagggatagtttcag

SEQ ID NO: 431290 - DNA, 20 bp, Artificial Sequence
  chemically synthesized
attagtgtagggatagtttc

SEQ ID NO: 431291 - DNA, 20 bp, Artificial Sequence
  chemically synthesized
gattagtgtagggatagttt

SEQ ID NO: 431292 - DNA, 20 bp, Artificial Sequence
  chemically synthesized
acttcagattagtgtaggga

SEQ ID NO: 431293 - DNA, 20 bp, Artificial Sequence
  chemically synthesized
aacaacttcagattagtgta

SEQ ID NO: 431294 - DNA, 20 bp, Artificial Sequence
  chemically synthesized
taacaacttcagattagtgt

SEQ ID NO: 431295 - DNA, 20 bp, Artificial Sequence
  chemically synthesized
ttaacaacttcagattagtg

SEQ ID NO: 431296 - DNA, 20 bp, Artificial Sequence
  chemically synthesized
actatccctacactaatctg

SEQ ID NO: 431297 - DNA, 20 bp, Artificial Sequence
  chemically synthesized
gtaatttaacaacttcagat

SEQ ID NO: 431298 - DNA, 20 bp, Artificial Sequence
  chemically synthesized
acttagtaatttaacaactt

SEQ ID NO: 431299 - DNA, 20 bp, Artificial Sequence
  chemically synthesized
tctgaagttgttaaattact

SEQ ID NO: 431300 - DNA, 20 bp, Artificial Sequence
  chemically synthesized
aatatgaatgcaaaataact

SEQ ID NO: 431301 - DNA, 20 bp, Artificial Sequence
  chemically synthesized
tgaacttggacaattaattt

SEQ ID NO: 431302 - DNA, 20 bp, Artificial Sequence
  chemically synthesized
atttccaaaattaattgtcc

SEQ ID NO: 431303 - DNA, 20 bp, Artificial Sequence
  chemically synthesized
ttcattttgagagatgaact

SEQ ID NO: 431304 - DNA, 20 bp, Artificial Sequence
  chemically synthesized
ctgaaattatttcattttga

SEQ ID NO: 431305 - DNA, 20 bp, Artificial Sequence
  chemically synthesized
agctgaaattatttcatttt

SEQ ID NO: 431306 - DNA, 20 bp, Artificial Sequence
  chemically synthesized
ctctcaaaatgaaataattt

SEQ ID NO: 431307 - DNA, 20 bp, Artificial Sequence
  chemically synthesized
caaaatgaaataatttcagc

SEQ ID NO: 431308 - DNA, 20 bp, Artificial Sequence
  chemically synthesized
aaataatttcagctagaaat

SEQ ID NO: 431309 - DNA, 20 bp, Artificial Sequence
  chemically synthesized
actgtgccacagctcatttc

SEQ ID NO: 431310 - DNA, 20 bp, Artificial Sequence
  chemically synthesized
tttcagctagaaatgagctg

SEQ ID NO: 431311 - DNA, 20 bp, Artificial Sequence
  chemically synthesized
gctagaaatgagctgtggca

SEQ ID NO: 431312 - DNA, 20 bp, Artificial Sequence
  chemically synthesized
tccaaaggcttactgtgcca

SEQ ID NO: 431313 - DNA, 20 bp, Artificial Sequence
  chemically synthesized
gaaatgagctgtggcacagt

SEQ ID NO: 431314 - DNA, 20 bp, Artificial Sequence
  chemically synthesized
gctgtggcacagtaagcctt

SEQ ID NO: 431315 - DNA, 20 bp, Artificial Sequence
  chemically synthesized
tggcacagtaagcctttgga

SEQ ID NO: 431316 - DNA, 20 bp, Artificial Sequence
  chemically synthesized
ggcacagtaagcctttggat

SEQ ID NO: 431317 - DNA, 20 bp, Artificial Sequence
  chemically synthesized
gcacagtaagcctttggatg

SEQ ID NO: 431318 - DNA, 20 bp, Artificial Sequence
  chemically synthesized
taattaccttccccatccaa

SEQ ID NO: 431319 - DNA, 20 bp, Artificial Sequence
  chemically synthesized
ataattaccttccccatcca

SEQ ID NO: 431320 - DNA, 20 bp, Artificial Sequence
  chemically synthesized
cagtaagcctttggatgggg

SEQ ID NO: 431321 - DNA, 20 bp, Artificial Sequence
  chemically synthesized
agtaagcctttggatgggga

SEQ ID NO: 431322 - DNA, 20 bp, Artificial Sequence
  chemically synthesized
ttataattgttctgtaactc

SEQ ID NO: 431323 - DNA, 20 bp, Artificial Sequence
  chemically synthesized
atgttccataaccagagtta

SEQ ID NO: 431324 - DNA, 20 bp, Artificial Sequence
  chemically synthesized
ttgttctgtaactctggtta

SEQ ID NO: 431325 - DNA, 20 bp, Artificial Sequence
  chemically synthesized
cagatcatgttccataacca

SEQ ID NO: 431326 - DNA, 20 bp, Artificial Sequence
  chemically synthesized
tccagatcatgttccataac

SEQ ID NO: 431327 - DNA, 20 bp, Artificial Sequence
  chemically synthesized
tctggttatggaacatgatc

SEQ ID NO: 431328 - DNA, 20 bp, Artificial Sequence
  chemically synthesized
gttatggaacatgatctgga

SEQ ID NO: 431329 - DNA, 20 bp, Artificial Sequence
  chemically synthesized
tggaacatgatctggacagt

SEQ ID NO: 431330 - DNA, 20 bp, Artificial Sequence
  chemically synthesized
tctatccaactctcactgtc

SEQ ID NO: 431331 - DNA, 20 bp, Artificial Sequence
  chemically synthesized
gaacatgatctggacagtga

SEQ ID NO: 431332 - DNA, 20 bp, Artificial Sequence
  chemically synthesized
atgatctggacagtgagagt

SEQ ID NO: 431333 - DNA, 20 bp, Artificial Sequence
  chemically synthesized
tctggacagtgagagttgga

SEQ ID NO: 431334 - DNA, 20 bp, Artificial Sequence
  chemically synthesized
tggacagtgagagttggata

SEQ ID NO: 431335 - DNA, 20 bp, Artificial Sequence
  chemically synthesized
gacagtgagagttggataga

SEQ ID NO: 431336 - DNA, 20 bp, Artificial Sequence
  chemically synthesized
acagtgagagttggatagag

SEQ ID NO: 431337 - DNA, 20 bp, Artificial Sequence
  chemically synthesized
cagtgagagttggatagaga

SEQ ID NO: 431338 - DNA, 20 bp, Artificial Sequence
  chemically synthesized
tgagagttggatagagaggg

SEQ ID NO: 431339 - DNA, 20 bp, Artificial Sequence
  chemically synthesized
tggatagagagggaagccac

SEQ ID NO: 431340 - DNA, 20 bp, Artificial Sequence
  chemically synthesized
ggatagagagggaagccact

SEQ ID NO: 431341 - DNA, 20 bp, Artificial Sequence
  chemically synthesized
gatagagagggaagccactg

SEQ ID NO: 431342 - DNA, 20 bp, Artificial Sequence
  chemically synthesized
atagagagggaagccactgg

SEQ ID NO: 431343 - DNA, 20 bp, Artificial Sequence
  chemically synthesized
gagagggaagccactggggg

SEQ ID NO: 431344 - DNA, 20 bp, Artificial Sequence
  chemically synthesized
cttagtcacactacccccag

SEQ ID NO: 431345 - DNA, 20 bp, Artificial Sequence
  chemically synthesized
tgtcttagtcacactacccc

SEQ ID NO: 431346 - DNA, 20 bp, Artificial Sequence
  chemically synthesized
ccactgggggtagtgtgact

SEQ ID NO: 431347 - DNA, 20 bp, Artificial Sequence
  chemically synthesized
cagattctaaaacagtgtct

SEQ ID NO: 431348 - DNA, 20 bp, Artificial Sequence
  chemically synthesized
gtgtgactaagacactgttt

SEQ ID NO: 431349 - DNA, 20 bp, Artificial Sequence
  chemically synthesized
catatcctcagattctaaaa

SEQ ID NO: 431350 - DNA, 20 bp, Artificial Sequence
  chemically synthesized
aagacactgttttagaatct

SEQ ID NO: 431351 - DNA, 20 bp, Artificial Sequence
  chemically synthesized
agacactgttttagaatctg

SEQ ID NO: 431352 - DNA, 20 bp, Artificial Sequence
  chemically synthesized
gttttagaatctgaggatat

SEQ ID NO: 431353 - DNA, 20 bp, Artificial Sequence
  chemically synthesized
ggaacttgaactcatatcct

SEQ ID NO: 431354 - DNA, 20 bp, Artificial Sequence
  chemically synthesized
gaatctgaggatatgagttc

SEQ ID NO: 431355 - DNA, 20 bp, Artificial Sequence
  chemically synthesized
ggatatgagttcaagttcca

SEQ ID NO: 431356 - DNA, 20 bp, Artificial Sequence
  chemically synthesized
aatctagcaggtgttagctg

SEQ ID NO: 431357 - DNA, 20 bp, Artificial Sequence
  chemically synthesized
actacaaatctagcaggtgt

SEQ ID NO: 431358 - DNA, 20 bp, Artificial Sequence
  chemically synthesized
gttccacagctaacacctgc

SEQ ID NO: 431359 - DNA, 20 bp, Artificial Sequence
  chemically synthesized
ttacagactacaaatctagc

SEQ ID NO: 431360 - DNA, 20 bp, Artificial Sequence
  chemically synthesized
cttacagactacaaatctag

SEQ ID NO: 431361 - DNA, 20 bp, Artificial Sequence
  chemically synthesized
gctaacacctgctagatttg

SEQ ID NO: 431362 - DNA, 20 bp, Artificial Sequence
  chemically synthesized
caacttacagactacaaatc

SEQ ID NO: 431363 - DNA, 20 bp, Artificial Sequence
  chemically synthesized
ctgctagatttgtagtctgt

SEQ ID NO: 431364 - DNA, 20 bp, Artificial Sequence
  chemically synthesized
ctttgaaatttgacaactta

SEQ ID NO: 431365 - DNA, 20 bp, Artificial Sequence
  chemically synthesized
ctgtaagttgtcaaatttca

SEQ ID NO: 431366 - DNA, 20 bp, Artificial Sequence
  chemically synthesized
ctcttatccaagaggaatat

SEQ ID NO: 431367 - DNA, 20 bp, Artificial Sequence
  chemically synthesized
aaagaatcttatattcctct

SEQ ID NO: 431368 - DNA, 20 bp, Artificial Sequence
  chemically synthesized
atcttatattcctcttggat

SEQ ID NO: 431369 - DNA, 20 bp, Artificial Sequence
  chemically synthesized
ttacctatctcttatccaag

SEQ ID NO: 431370 - DNA, 20 bp, Artificial Sequence
  chemically synthesized
attacctatctcttatccaa

SEQ ID NO: 431371 - DNA, 20 bp, Artificial Sequence
  chemically synthesized
cttatattcctcttggataa

SEQ ID NO: 431372 - DNA, 20 bp, Artificial Sequence
  chemically synthesized
ttattacctatctcttatcc

SEQ ID NO: 431373 - DNA, 20 bp, Artificial Sequence
  chemically synthesized
tattcctcttggataagaga

SEQ ID NO: 431374 - DNA, 20 bp, Artificial Sequence
  chemically synthesized
attcctcttggataagagat

SEQ ID NO: 431375 - DNA, 20 bp, Artificial Sequence
  chemically synthesized
gataggtaataaaaactacc

SEQ ID NO: 431376 - DNA, 20 bp, Artificial Sequence
  chemically synthesized
gtaataaaaactacctggca

SEQ ID NO: 431377 - DNA, 20 bp, Artificial Sequence
  chemically synthesized
acaaaaccatctgtgccagg

SEQ ID NO: 431378 - DNA, 20 bp, Artificial Sequence
  chemically synthesized
tctacaaaaccatctgtgcc

SEQ ID NO: 431379 - DNA, 20 bp, Artificial Sequence
  chemically synthesized
taaaaactacctggcacaga

SEQ ID NO: 431380 - DNA, 20 bp, Artificial Sequence
  chemically synthesized
ttctacaaaaccatctgtgc

SEQ ID NO: 431381 - DNA, 20 bp, Artificial Sequence
  chemically synthesized
acctggcacagatggttttg

SEQ ID NO: 431382 - DNA, 20 bp, Artificial Sequence
  chemically synthesized
agtttccacagttattttat

SEQ ID NO: 431383 - DNA, 20 bp, Artificial Sequence
  chemically synthesized
aaaatccaataaaataactg

SEQ ID NO: 431384 - DNA, 20 bp, Artificial Sequence
  chemically synthesized
tgaaaatttcaaagtttcca

SEQ ID NO: 431385 - DNA, 20 bp, Artificial Sequence
  chemically synthesized
aatggcacttgaaaatttca

SEQ ID NO: 431386 - DNA, 20 bp, Artificial Sequence
  chemically synthesized
gtggaaactttgaaattttc

SEQ ID NO: 431387 - DNA, 20 bp, Artificial Sequence
  chemically synthesized
attggtatttgatattttaa

SEQ ID NO: 431388 - DNA, 20 bp, Artificial Sequence
  chemically synthesized
tcataagctaattattaaat

SEQ ID NO: 431389 - DNA, 20 bp, Artificial Sequence
  chemically synthesized
tcaaataccaatttaataat

SEQ ID NO: 431390 - DNA, 20 bp, Artificial Sequence
  chemically synthesized
tttaataattagcttatgat

SEQ ID NO: 431391 - DNA, 20 bp, Artificial Sequence
  chemically synthesized
gtccctaaccatctgatcat

SEQ ID NO: 431392 - DNA, 20 bp, Artificial Sequence
  chemically synthesized
ataattagcttatgatcaga

SEQ ID NO: 431393 - DNA, 20 bp, Artificial Sequence
  chemically synthesized
ttagcttatgatcagatggt

SEQ ID NO: 431394 - DNA, 20 bp, Artificial Sequence
  chemically synthesized
tagcttatgatcagatggtt

SEQ ID NO: 431395 - DNA, 20 bp, Artificial Sequence
  chemically synthesized
agcttatgatcagatggtta

SEQ ID NO: 431396 - DNA, 20 bp, Artificial Sequence
  chemically synthesized
gttagggacgttgactgccg

SEQ ID NO: 431397 - DNA, 20 bp, Artificial Sequence
  chemically synthesized
gatttgaatatacacttcgg

SEQ ID NO: 431398 - DNA, 20 bp, Artificial Sequence
  chemically synthesized
attgatttgaatatacactt

SEQ ID NO: 431399 - DNA, 20 bp, Artificial Sequence
  chemically synthesized
agtgtatattcaaatcaatg

SEQ ID NO: 431400 - DNA, 20 bp, Artificial Sequence
  chemically synthesized
atattcaaatcaatgcagta

SEQ ID NO: 431401 - DNA, 20 bp, Artificial Sequence
  chemically synthesized
tattcaaatcaatgcagtat

SEQ ID NO: 431402 - DNA, 20 bp, Artificial Sequence
  chemically synthesized
tcaatgcagtataggcttta

SEQ ID NO: 431403 - DNA, 20 bp, Artificial Sequence
  chemically synthesized
atgcagtataggctttaaag

SEQ ID NO: 431404 - DNA, 20 bp, Artificial Sequence
  chemically synthesized
tgcagtataggctttaaagt

SEQ ID NO: 431405 - DNA, 20 bp, Artificial Sequence
  chemically synthesized
gcagtataggctttaaagta

SEQ ID NO: 431406 - DNA, 20 bp, Artificial Sequence
  chemically synthesized
catgctttggccctacttta

SEQ ID NO: 431407 - DNA, 20 bp, Artificial Sequence
  chemically synthesized
taggctttaaagtagggcca

SEQ ID NO: 431408 - DNA, 20 bp, Artificial Sequence
  chemically synthesized
ttaaaatgcatttcatgctt

SEQ ID NO: 431409 - DNA, 20 bp, Artificial Sequence
  chemically synthesized
agcatgaaatgcattttaat

SEQ ID NO: 431410 - DNA, 20 bp, Artificial Sequence
  chemically synthesized
ttttaataagtgtacacttc

SEQ ID NO: 431411 - DNA, 20 bp, Artificial Sequence
  chemically synthesized
tttaataagtgtacacttct

SEQ ID NO: 431412 - DNA, 20 bp, Artificial Sequence
  chemically synthesized
caactttcaaagaatcctag

SEQ ID NO: 431413 - DNA, 20 bp, Artificial Sequence
  chemically synthesized
tttcaactttcaaagaatcc

SEQ ID NO: 431414 - DNA, 20 bp, Artificial Sequence
  chemically synthesized
acacttctaggattctttga

SEQ ID NO: 431415 - DNA, 20 bp, Artificial Sequence
  chemically synthesized
aattattttttcaactttca

SEQ ID NO: 431416 - DNA, 20 bp, Artificial Sequence
  chemically synthesized
ttgaaagttgaaaaaataat

SEQ ID NO: 431417 - DNA, 20 bp, Artificial Sequence
  chemically synthesized
aagttgaaaaaataattagt

SEQ ID NO: 431418 - DNA, 20 bp, Artificial Sequence
  chemically synthesized
aaaaataattagtaagaaaa

SEQ ID NO: 431419 - DNA, 20 bp, Artificial Sequence
  chemically synthesized
aaataattagtaagaaaatg

SEQ ID NO: 431420 - DNA, 20 bp, Artificial Sequence
  chemically synthesized
ttagtaagaaaatggagatg

SEQ ID NO: 431421 - DNA, 20 bp, Artificial Sequence
  chemically synthesized
atggagatgaagccctacac

SEQ ID NO: 431422 - DNA, 20 bp, Artificial Sequence
  chemically synthesized
tggagatgaagccctacact

SEQ ID NO: 431423 - DNA, 20 bp, Artificial Sequence
  chemically synthesized
agtgctatcatcctagtgta

SEQ ID NO: 431424 - DNA, 20 bp, Artificial Sequence
  chemically synthesized
aagtgctatcatcctagtgt

SEQ ID NO: 431425 - DNA, 20 bp, Artificial Sequence
  chemically synthesized
taagtgctatcatcctagtg

SEQ ID NO: 431426 - DNA, 20 bp, Artificial Sequence
  chemically synthesized
gaagccctacactaggatga

SEQ ID NO: 431427 - DNA, 20 bp, Artificial Sequence
  chemically synthesized
ttttctaagtgctatcatcc

SEQ ID NO: 431428 - DNA, 20 bp, Artificial Sequence
  chemically synthesized
tacactaggatgatagcact

SEQ ID NO: 431429 - DNA, 20 bp, Artificial Sequence
  chemically synthesized
aggatgatagcacttagaaa

SEQ ID NO: 431430 - DNA, 20 bp, Artificial Sequence
  chemically synthesized
attcacttttatctttttct

SEQ ID NO: 431431 - DNA, 20 bp, Artificial Sequence
  chemically synthesized
tagcacttagaaaaagataa

SEQ ID NO: 431432 - DNA, 20 bp, Artificial Sequence
  chemically synthesized
tagaaaaagataaaagtgaa

SEQ ID NO: 431433 - DNA, 20 bp, Artificial Sequence
  chemically synthesized
aaagtgaatagatgtgtcaa

SEQ ID NO: 431434 - DNA, 20 bp, Artificial Sequence
  chemically synthesized
gtgaatagatgtgtcaaaag

SEQ ID NO: 431435 - DNA, 20 bp, Artificial Sequence
  chemically synthesized
tgtgtcaaaagcagatttaa

SEQ ID NO: 431436 - DNA, 20 bp, Artificial Sequence
  chemically synthesized
gtgtcaaaagcagatttaat

SEQ ID NO: 431437 - DNA, 20 bp, Artificial Sequence
  chemically synthesized
atttaatgggaattgacaaa

SEQ ID NO: 431438 - DNA, 20 bp, Artificial Sequence
  chemically synthesized
tttaatgggaattgacaaaa

SEQ ID NO: 431439 - DNA, 20 bp, Artificial Sequence
  chemically synthesized
ttaatgggaattgacaaaaa

SEQ ID NO: 431440 - DNA, 20 bp, Artificial Sequence
  chemically synthesized
aaaatctttgagtcagtttc

SEQ ID NO: 431441 - DNA, 20 bp, Artificial Sequence
  chemically synthesized
gaatacttgaaactgactca

SEQ ID NO: 431442 - DNA, 20 bp, Artificial Sequence
  chemically synthesized
cagactcaaaatctttgagt

SEQ ID NO: 431443 - DNA, 20 bp, Artificial Sequence
  chemically synthesized
ccctcagactcaaaatcttt

SEQ ID NO: 431444 - DNA, 20 bp, Artificial Sequence
  chemically synthesized
gaaactgactcaaagatttt

SEQ ID NO: 431445 - DNA, 20 bp, Artificial Sequence
  chemically synthesized
gactcaaagattttgagtct

SEQ ID NO: 431446 - DNA, 20 bp, Artificial Sequence
  chemically synthesized
actcaaagattttgagtctg

SEQ ID NO: 431447 - DNA, 20 bp, Artificial Sequence
  chemically synthesized
ctcaaagattttgagtctga

SEQ ID NO: 431448 - DNA, 20 bp, Artificial Sequence
  chemically synthesized
agattttgagtctgagggat

SEQ ID NO: 431449 - DNA, 20 bp, Artificial Sequence
  chemically synthesized
ccctgactcttccaatccct

SEQ ID NO: 431450 - DNA, 20 bp, Artificial Sequence
  chemically synthesized
ttttgagtctgagggattgg

SEQ ID NO: 431451 - DNA, 20 bp, Artificial Sequence
  chemically synthesized
ttgagtctgagggattggaa

SEQ ID NO: 431452 - DNA, 20 bp, Artificial Sequence
  chemically synthesized
gtctgagggattggaagagt

SEQ ID NO: 431453 - DNA, 20 bp, Artificial Sequence
  chemically synthesized
tctgagggattggaagagtc

SEQ ID NO: 431454 - DNA, 20 bp, Artificial Sequence
  chemically synthesized
ctgagggattggaagagtca

SEQ ID NO: 431455 - DNA, 20 bp, Artificial Sequence
  chemically synthesized
tgagggattggaagagtcag

SEQ ID NO: 431456 - DNA, 20 bp, Artificial Sequence
  chemically synthesized
aagagtcaggggactgctgt

SEQ ID NO: 431457 - DNA, 20 bp, Artificial Sequence
  chemically synthesized
agtcaggggactgctgttgg

SEQ ID NO: 431458 - DNA, 20 bp, Artificial Sequence
  chemically synthesized
tgctcccactcttccaacag

SEQ ID NO: 431459 - DNA, 20 bp, Artificial Sequence
  chemically synthesized
tcaggggactgctgttggaa

SEQ ID NO: 431460 - DNA, 20 bp, Artificial Sequence
  chemically synthesized
atttgctcccactcttccaa

SEQ ID NO: 431461 - DNA, 20 bp, Artificial Sequence
  chemically synthesized
ggggactgctgttggaagag

SEQ ID NO: 431462 - DNA, 20 bp, Artificial Sequence
  chemically synthesized
gggactgctgttggaagagt

SEQ ID NO: 431463 - DNA, 20 bp, Artificial Sequence
  chemically synthesized
gactgctgttggaagagtgg

SEQ ID NO: 431464 - DNA, 20 bp, Artificial Sequence
  chemically synthesized
gttggaagagtgggagcaaa

SEQ ID NO: 431465 - DNA, 20 bp, Artificial Sequence
  chemically synthesized
agagtgggagcaaatagaat

SEQ ID NO: 431466 - DNA, 20 bp, Artificial Sequence
  chemically synthesized
tatccaaaaccagttatttt

SEQ ID NO: 431467 - DNA, 20 bp, Artificial Sequence
  chemically synthesized
acgcacacaccaaaaataac

SEQ ID NO: 431468 - DNA, 20 bp, Artificial Sequence
  chemically synthesized
acaccaaaaataactggttt

SEQ ID NO: 431469 - DNA, 20 bp, Artificial Sequence
  chemically synthesized
gctctcaaaatatccaaaac

SEQ ID NO: 431470 - DNA, 20 bp, Artificial Sequence
  chemically synthesized
taactggttttggatatttt

SEQ ID NO: 431471 - DNA, 20 bp, Artificial Sequence
  chemically synthesized
actggttttggatattttga

SEQ ID NO: 431472 - DNA, 20 bp, Artificial Sequence
  chemically synthesized
tttggatattttgagagcca

SEQ ID NO: 431473 - DNA, 20 bp, Artificial Sequence
  chemically synthesized
agcctttagcttttgggcta

SEQ ID NO: 431474 - DNA, 20 bp, Artificial Sequence
  chemically synthesized
ttttgagagccatagcccaa

SEQ ID NO: 431475 - DNA, 20 bp, Artificial Sequence
  chemically synthesized
tagaacagcctttagctttt

SEQ ID NO: 431476 - DNA, 20 bp, Artificial Sequence
  chemically synthesized
gagccatagcccaaaagcta

SEQ ID NO: 431477 - DNA, 20 bp, Artificial Sequence
  chemically synthesized
atagaacagcctttagcttt

SEQ ID NO: 431478 - DNA, 20 bp, Artificial Sequence
  chemically synthesized
agccatagcccaaaagctaa

SEQ ID NO: 431479 - DNA, 20 bp, Artificial Sequence
  chemically synthesized
attcaacatagaacagcctt

SEQ ID NO: 431480 - DNA, 20 bp, Artificial Sequence
  chemically synthesized
tttgataattcaacatagaa

SEQ ID NO: 431481 - DNA, 20 bp, Artificial Sequence
  chemically synthesized
gtggctttgataattcaaca

SEQ ID NO: 431482 - DNA, 20 bp, Artificial Sequence
  chemically synthesized
tgttctatgttgaattatca

SEQ ID NO: 431483 - DNA, 20 bp, Artificial Sequence
  chemically synthesized
taaaaacagagatcagaaag

SEQ ID NO: 431484 - DNA, 20 bp, Artificial Sequence
  chemically synthesized
gcataaaaacagagatcaga

SEQ ID NO: 431485 - DNA, 20 bp, Artificial Sequence
  chemically synthesized
aacagcataaaaacagagat

SEQ ID NO: 431486 - DNA, 20 bp, Artificial Sequence
  chemically synthesized
aaaaaaacagcataaaaaca

SEQ ID NO: 431487 - DNA, 20 bp, Artificial Sequence
  chemically synthesized
aaaaaaaaacagcataaaaa

SEQ ID NO: 431488 - DNA, 20 bp, Artificial Sequence
  chemically synthesized
gaaaatgctaaaaaaaaaaa

SEQ ID NO: 431489 - DNA, 20 bp, Artificial Sequence
  chemically synthesized
ttttatgctgtttttttttt

SEQ ID NO: 431490 - DNA, 20 bp, Artificial Sequence
  chemically synthesized
tttcaaatttttcctcactt

SEQ ID NO: 431491 - DNA, 20 bp, Artificial Sequence
  chemically synthesized
attttacagaatcttaagtg

SEQ ID NO: 431492 - DNA, 20 bp, Artificial Sequence
  chemically synthesized
aattttacagaatcttaagt

SEQ ID NO: 431493 - DNA, 20 bp, Artificial Sequence
  chemically synthesized
taaaaattttacagaatctt

SEQ ID NO: 431494 - DNA, 20 bp, Artificial Sequence
  chemically synthesized
tataagcaataaaaatttta

SEQ ID NO: 431495 - DNA, 20 bp, Artificial Sequence
  chemically synthesized
aatttcttacacaagcatat

SEQ ID NO: 431496 - DNA, 20 bp, Artificial Sequence
  chemically synthesized
tattgcttatatgcttgtgt

SEQ ID NO: 431497 - DNA, 20 bp, Artificial Sequence
  chemically synthesized
atgatatgaatttcttacac

SEQ ID NO: 431498 - DNA, 20 bp, Artificial Sequence
  chemically synthesized
tatcctactaaaaatttttg

SEQ ID NO: 431499 - DNA, 20 bp, Artificial Sequence
  chemically synthesized
attatcctactaaaaatttt

SEQ ID NO: 431500 - DNA, 20 bp, Artificial Sequence
  chemically synthesized
gattgtgctccaaaaatttt

SEQ ID NO: 431501 - DNA, 20 bp, Artificial Sequence
  chemically synthesized
tgtgctccaaaaatttttag

SEQ ID NO: 431502 - DNA, 20 bp, Artificial Sequence
  chemically synthesized
gtgctccaaaaatttttagt

SEQ ID NO: 431503 - DNA, 20 bp, Artificial Sequence
  chemically synthesized
aaaaatttttagtaggataa

SEQ ID NO: 431504 - DNA, 20 bp, Artificial Sequence
  chemically synthesized
ttgcaggtcattttcagaag

SEQ ID NO: 431505 - DNA, 20 bp, Artificial Sequence
  chemically synthesized
atattgcaggtcattttcag

SEQ ID NO: 431506 - DNA, 20 bp, Artificial Sequence
  chemically synthesized
ctaatattgcaggtcatttt

SEQ ID NO: 431507 - DNA, 20 bp, Artificial Sequence
  chemically synthesized
ctgaaaatgacctgcaatat

SEQ ID NO: 431508 - DNA, 20 bp, Artificial Sequence
  chemically synthesized
aaataataacctaatattgc

SEQ ID NO: 431509 - DNA, 20 bp, Artificial Sequence
  chemically synthesized
tgaaaatgacctgcaatatt

SEQ ID NO: 431510 - DNA, 20 bp, Artificial Sequence
  chemically synthesized
caaataataacctaatattg

SEQ ID NO: 431511 - DNA, 20 bp, Artificial Sequence
  chemically synthesized
taggttattatttgttatat

SEQ ID NO: 431512 - DNA, 20 bp, Artificial Sequence
  chemically synthesized
aggttattatttgttatatt

SEQ ID NO: 431513 - DNA, 20 bp, Artificial Sequence
  chemically synthesized
attatttgttatattaggtc

SEQ ID NO: 431514 - DNA, 20 bp, Artificial Sequence
  chemically synthesized
tgttatattaggtctagaaa

SEQ ID NO: 431515 - DNA, 20 bp, Artificial Sequence
  chemically synthesized
tcaatagtttatgctgtttc

SEQ ID NO: 431516 - DNA, 20 bp, Artificial Sequence
  chemically synthesized
acagcataaactattgactg

SEQ ID NO: 431517 - DNA, 20 bp, Artificial Sequence
  chemically synthesized
aaatgtcaaacttcagtcaa

SEQ ID NO: 431518 - DNA, 20 bp, Artificial Sequence
  chemically synthesized
aattttaaaatgtcaaactt

SEQ ID NO: 431519 - DNA, 20 bp, Artificial Sequence
  chemically synthesized
gactttcctccagtttatta

SEQ ID NO: 431520 - DNA, 20 bp, Artificial Sequence
  chemically synthesized
tttaaaattctctaataaac

SEQ ID NO: 431521 - DNA, 20 bp, Artificial Sequence
  chemically synthesized
tggactttcctccagtttat

SEQ ID NO: 431522 - DNA, 20 bp, Artificial Sequence
  chemically synthesized
taaaattctctaataaactg

SEQ ID NO: 431523 - DNA, 20 bp, Artificial Sequence
  chemically synthesized
aaaattctctaataaactgg

SEQ ID NO: 431524 - DNA, 20 bp, Artificial Sequence
  chemically synthesized
ttctctaataaactggagga

SEQ ID NO: 431525 - DNA, 20 bp, Artificial Sequence
  chemically synthesized
agcagaggtggactttcctc

SEQ ID NO: 431526 - DNA, 20 bp, Artificial Sequence
  chemically synthesized
ggaggaaagtccacctctgc

SEQ ID NO: 431527 - DNA, 20 bp, Artificial Sequence
  chemically synthesized
ctgcagagttccagcagagg

SEQ ID NO: 431528 - DNA, 20 bp, Artificial Sequence
  chemically synthesized
gcactgcagagttccagcag

SEQ ID NO: 431529 - DNA, 20 bp, Artificial Sequence
  chemically synthesized
tgcactgcagagttccagca

SEQ ID NO: 431530 - DNA, 20 bp, Artificial Sequence
  chemically synthesized
tgtgcactgcagagttccag

SEQ ID NO: 431531 - DNA, 20 bp, Artificial Sequence
  chemically synthesized
ttctgtgcactgcagagttc

SEQ ID NO: 431532 - DNA, 20 bp, Artificial Sequence
  chemically synthesized
ccacctctgctggaactctg

SEQ ID NO: 431533 - DNA, 20 bp, Artificial Sequence
  chemically synthesized
tttgccttctgtgcactgca

SEQ ID NO: 431534 - DNA, 20 bp, Artificial Sequence
  chemically synthesized
tgctggaactctgcagtgca

SEQ ID NO: 431535 - DNA, 20 bp, Artificial Sequence
  chemically synthesized
tatttgccttctgtgcactg

SEQ ID NO: 431536 - DNA, 20 bp, Artificial Sequence
  chemically synthesized
tggaactctgcagtgcacag

SEQ ID NO: 431537 - DNA, 20 bp, Artificial Sequence
  chemically synthesized
ggaactctgcagtgcacaga

SEQ ID NO: 431538 - DNA, 20 bp, Artificial Sequence
  chemically synthesized
agtgcacagaaggcaaataa

SEQ ID NO: 431539 - DNA, 20 bp, Artificial Sequence
  chemically synthesized
gcgaagccatggcaggatag

SEQ ID NO: 431540 - DNA, 20 bp, Artificial Sequence
  chemically synthesized
taagcgaagccatggcagga

SEQ ID NO: 431541 - DNA, 20 bp, Artificial Sequence
  chemically synthesized
aatagactgctatcctgcca

SEQ ID NO: 431542 - DNA, 20 bp, Artificial Sequence
  chemically synthesized
gtattaagcgaagccatggc

SEQ ID NO: 431543 - DNA, 20 bp, Artificial Sequence
  chemically synthesized
tgtattaagcgaagccatgg

SEQ ID NO: 431544 - DNA, 20 bp, Artificial Sequence
  chemically synthesized
atttgtattaagcgaagcca

SEQ ID NO: 431545 - DNA, 20 bp, Artificial Sequence
  chemically synthesized
gtacaaatttgtattaagcg

SEQ ID NO: 431546 - DNA, 20 bp, Artificial Sequence
  chemically synthesized
atattgtacaaatttgtatt

SEQ ID NO: 431547 - DNA, 20 bp, Artificial Sequence
  chemically synthesized
cacaatgttttatgagaaaa

SEQ ID NO: 431548 - DNA, 20 bp, Artificial Sequence
  chemically synthesized
gacatatcacaatgttttat

SEQ ID NO: 431549 - DNA, 20 bp, Artificial Sequence
  chemically synthesized
cataaaacattgtgatatgt

SEQ ID NO: 431550 - DNA, 20 bp, Artificial Sequence
  chemically synthesized
ataaaacattgtgatatgtc

SEQ ID NO: 431551 - DNA, 20 bp, Artificial Sequence
  chemically synthesized
aacattgtgatatgtcaggc

SEQ ID NO: 431552 - DNA, 20 bp, Artificial Sequence
  chemically synthesized
gtgatatgtcaggccagtaa

SEQ ID NO: 431553 - DNA, 20 bp, Artificial Sequence
  chemically synthesized
tgatatgtcaggccagtaac

SEQ ID NO: 431554 - DNA, 20 bp, Artificial Sequence
  chemically synthesized
atcattttcacacctgttac

SEQ ID NO: 431555 - DNA, 20 bp, Artificial Sequence
  chemically synthesized
agtaacaggtgtgaaaatga

SEQ ID NO: 431556 - DNA, 20 bp, Artificial Sequence
  chemically synthesized
atgatggaatcaaatcctca

SEQ ID NO: 431557 - DNA, 20 bp, Artificial Sequence
  chemically synthesized
ttctaaacacgtattctgtg

SEQ ID NO: 431558 - DNA, 20 bp, Artificial Sequence
  chemically synthesized
gttctaaacacgtattctgt

SEQ ID NO: 431559 - DNA, 20 bp, Artificial Sequence
  chemically synthesized
atcctcacagaatacgtgtt

SEQ ID NO: 431560 - DNA, 20 bp, Artificial Sequence
  chemically synthesized
cacagaatacgtgtttagaa

SEQ ID NO: 431561 - DNA, 20 bp, Artificial Sequence
  chemically synthesized
gtgtttagaacagacctctt

SEQ ID NO: 431562 - DNA, 20 bp, Artificial Sequence
  chemically synthesized
aaaagttgtctttactgaag

SEQ ID NO: 431563 - DNA, 20 bp, Artificial Sequence
  chemically synthesized
tagaacagacctcttcagta

SEQ ID NO: 431564 - DNA, 20 bp, Artificial Sequence
  chemically synthesized
taaaagttgtctttactgaa

SEQ ID NO: 431565 - DNA, 20 bp, Artificial Sequence
  chemically synthesized
tttaaaagttgtctttactg

SEQ ID NO: 431566 - DNA, 20 bp, Artificial Sequence
  chemically synthesized
tgcccggcctgtatttttaa

SEQ ID NO: 431567 - DNA, 20 bp, Artificial Sequence
  chemically synthesized
aaagacaacttttaaaaata

SEQ ID NO: 431568 - DNA, 20 bp, Artificial Sequence
  chemically synthesized
aagacaacttttaaaaatac

SEQ ID NO: 431569 - DNA, 20 bp, Artificial Sequence
  chemically synthesized
caacttttaaaaatacaggc

SEQ ID NO: 431570 - DNA, 20 bp, Artificial Sequence
  chemically synthesized
aacttttaaaaatacaggcc

SEQ ID NO: 431571 - DNA, 20 bp, Artificial Sequence
  chemically synthesized
aaaatacaggccgggcacga

SEQ ID NO: 431572 - DNA, 20 bp, Artificial Sequence
  chemically synthesized
cagacttgagccatcgtgcc

SEQ ID NO: 431573 - DNA, 20 bp, Artificial Sequence
  chemically synthesized
caggccgggcacgatggctc

SEQ ID NO: 431574 - DNA, 20 bp, Artificial Sequence
  chemically synthesized
agtgctgggattacagactt

SEQ ID NO: 431575 - DNA, 20 bp, Artificial Sequence
  chemically synthesized
atggctcaagtctgtaatcc

SEQ ID NO: 431576 - DNA, 20 bp, Artificial Sequence
  chemically synthesized
ctcgcaaagtgctgggatta

SEQ ID NO: 431577 - DNA, 20 bp, Artificial Sequence
  chemically synthesized
cctcggcctcgcaaagtgct

SEQ ID NO: 431578 - DNA, 20 bp, Artificial Sequence
  chemically synthesized
gcctcggcctcgcaaagtgc

SEQ ID NO: 431579 - DNA, 20 bp, Artificial Sequence
  chemically synthesized
ctgtaatcccagcactttgc

SEQ ID NO: 431580 - DNA, 20 bp, Artificial Sequence
  chemically synthesized
tgtaatcccagcactttgcg

SEQ ID NO: 431581 - DNA, 20 bp, Artificial Sequence
  chemically synthesized
ccacctgcctcggcctcgca

SEQ ID NO: 431582 - DNA, 20 bp, Artificial Sequence
  chemically synthesized
tcccagcactttgcgaggcc

SEQ ID NO: 431583 - DNA, 20 bp, Artificial Sequence
  chemically synthesized
cccagcactttgcgaggccg

SEQ ID NO: 431584 - DNA, 20 bp, Artificial Sequence
  chemically synthesized
agcactttgcgaggccgagg

SEQ ID NO: 431585 - DNA, 20 bp, Artificial Sequence
  chemically synthesized
gcactttgcgaggccgaggc

SEQ ID NO: 431586 - DNA, 20 bp, Artificial Sequence
  chemically synthesized
ctttgcgaggccgaggcagg

SEQ ID NO: 431587 - DNA, 20 bp, Artificial Sequence
  chemically synthesized
ctcgggtgatccacctgcct

SEQ ID NO: 431588 - DNA, 20 bp, Artificial Sequence
  chemically synthesized
ccgaggcaggtggatcaccc

SEQ ID NO: 431589 - DNA, 20 bp, Artificial Sequence
  chemically synthesized
gcaggtggatcacccgagat

SEQ ID NO: 431590 - DNA, 20 bp, Artificial Sequence
  chemically synthesized
caggtggatcacccgagatc

SEQ ID NO: 431591 - DNA, 20 bp, Artificial Sequence
  chemically synthesized
ggtctcgaactcctgatctc

SEQ ID NO: 431592 - DNA, 20 bp, Artificial Sequence
  chemically synthesized
ggtggatcacccgagatcag

SEQ ID NO: 431593 - DNA, 20 bp, Artificial Sequence
  chemically synthesized
tggtctcgaactcctgatct

SEQ ID NO: 431594 - DNA, 20 bp, Artificial Sequence
  chemically synthesized
tcacccgagatcaggagttc

SEQ ID NO: 431595 - DNA, 20 bp, Artificial Sequence
  chemically synthesized
cgagatcaggagttcgagac

SEQ ID NO: 431596 - DNA, 20 bp, Artificial Sequence
  chemically synthesized
tcaggagttcgagaccagcc

SEQ ID NO: 431597 - DNA, 20 bp, Artificial Sequence
  chemically synthesized
tttcaccatgttggccaggc

SEQ ID NO: 431598 - DNA, 20 bp, Artificial Sequence
  chemically synthesized
ggagtttcaccatgttggcc

SEQ ID NO: 431599 - DNA, 20 bp, Artificial Sequence
  chemically synthesized
cgagaccagcctggccaaca

SEQ ID NO: 431600 - DNA, 20 bp, Artificial Sequence
  chemically synthesized
aggagtttcaccatgttggc

SEQ ID NO: 431601 - DNA, 20 bp, Artificial Sequence
  chemically synthesized
gtgaaggagtttcaccatgt

SEQ ID NO: 431602 - DNA, 20 bp, Artificial Sequence
  chemically synthesized
ttgtatttttagtagtgaag

SEQ ID NO: 431603 - DNA, 20 bp, Artificial Sequence
  chemically synthesized
ttttgtatttttagtagtga

SEQ ID NO: 431604 - DNA, 20 bp, Artificial Sequence
  chemically synthesized
attttgtatttttagtagtg

SEQ ID NO: 431605 - DNA, 20 bp, Artificial Sequence
  chemically synthesized
ggctaattttgtatttttag

SEQ ID NO: 431606 - DNA, 20 bp, Artificial Sequence
  chemically synthesized
cctggctaattttgtatttt

SEQ ID NO: 431607 - DNA, 20 bp, Artificial Sequence
  chemically synthesized
cactactaaaaatacaaaat

SEQ ID NO: 431608 - DNA, 20 bp, Artificial Sequence
  chemically synthesized
actaaaaatacaaaattagc

SEQ ID NO: 431609 - DNA, 20 bp, Artificial Sequence
  chemically synthesized
ctaaaaatacaaaattagcc

SEQ ID NO: 431610 - DNA, 20 bp, Artificial Sequence
  chemically synthesized
aatacaaaattagccaggca

SEQ ID NO: 431611 - DNA, 20 bp, Artificial Sequence
  chemically synthesized
acaaaattagccaggcatgg

SEQ ID NO: 431612 - DNA, 20 bp, Artificial Sequence
  chemically synthesized
cagtcgtgtgccaccatgcc

SEQ ID NO: 431613 - DNA, 20 bp, Artificial Sequence
  chemically synthesized
ggcatggtggcacacgactg

SEQ ID NO: 431614 - DNA, 20 bp, Artificial Sequence
  chemically synthesized
gtggcacacgactgtagtcc

SEQ ID NO: 431615 - DNA, 20 bp, Artificial Sequence
  chemically synthesized
tggcacacgactgtagtccc

SEQ ID NO: 431616 - DNA, 20 bp, Artificial Sequence
  chemically synthesized
ctcccaggtacctgggacta

SEQ ID NO: 431617 - DNA, 20 bp, Artificial Sequence
  chemically synthesized
cgactgtagtcccaggtacc

SEQ ID NO: 431618 - DNA, 20 bp, Artificial Sequence
  chemically synthesized
cttcagcctcccaggtacct

SEQ ID NO: 431619 - DNA, 20 bp, Artificial Sequence
  chemically synthesized
gactgtagtcccaggtacct

SEQ ID NO: 431620 - DNA, 20 bp, Artificial Sequence
  chemically synthesized
gcttcagcctcccaggtacc

SEQ ID NO: 431621 - DNA, 20 bp, Artificial Sequence
  chemically synthesized
ctgtagtcccaggtacctgg

SEQ ID NO: 431622 - DNA, 20 bp, Artificial Sequence
  chemically synthesized
tgtagtcccaggtacctggg

SEQ ID NO: 431623 - DNA, 20 bp, Artificial Sequence
  chemically synthesized
ttctcctgcttcagcctccc

SEQ ID NO: 431624 - DNA, 20 bp, Artificial Sequence
  chemically synthesized
attctcctgcttcagcctcc

SEQ ID NO: 431625 - DNA, 20 bp, Artificial Sequence
  chemically synthesized
cccaggtacctgggaggctg

SEQ ID NO: 431626 - DNA, 20 bp, Artificial Sequence
  chemically synthesized
aggtacctgggaggctgaag

SEQ ID NO: 431627 - DNA, 20 bp, Artificial Sequence
  chemically synthesized
ggtacctgggaggctgaagc

SEQ ID NO: 431628 - DNA, 20 bp, Artificial Sequence
  chemically synthesized
tacctgggaggctgaagcag

SEQ ID NO: 431629 - DNA, 20 bp, Artificial Sequence
  chemically synthesized
ttctagcgattctcctgctt

SEQ ID NO: 431630 - DNA, 20 bp, Artificial Sequence
  chemically synthesized
ggctgaagcaggagaatcgc

SEQ ID NO: 431631 - DNA, 20 bp, Artificial Sequence
  chemically synthesized
gcaggagaatcgctagaacc

SEQ ID NO: 431632 - DNA, 20 bp, Artificial Sequence
  chemically synthesized
caggagaatcgctagaaccc

SEQ ID NO: 431633 - DNA, 20 bp, Artificial Sequence
  chemically synthesized
aacctccgcctcctgggttc

SEQ ID NO: 431634 - DNA, 20 bp, Artificial Sequence
  chemically synthesized
ggagaatcgctagaacccag

SEQ ID NO: 431635 - DNA, 20 bp, Artificial Sequence
  chemically synthesized
gagaatcgctagaacccagg

SEQ ID NO: 431636 - DNA, 20 bp, Artificial Sequence
  chemically synthesized
aatcgctagaacccaggagg

SEQ ID NO: 431637 - DNA, 20 bp, Artificial Sequence
  chemically synthesized
cactgcaacctccgcctcct

SEQ ID NO: 431638 - DNA, 20 bp, Artificial Sequence
  chemically synthesized
tcgctagaacccaggaggcg

SEQ ID NO: 431639 - DNA, 20 bp, Artificial Sequence
  chemically synthesized
tcactgcaacctccgcctcc

SEQ ID NO: 431640 - DNA, 20 bp, Artificial Sequence
  chemically synthesized
cgctagaacccaggaggcgg

SEQ ID NO: 431641 - DNA, 20 bp, Artificial Sequence
  chemically synthesized
aacccaggaggcggaggttg

SEQ ID NO: 431642 - DNA, 20 bp, Artificial Sequence
  chemically synthesized
caggaggcggaggttgcagt

SEQ ID NO: 431643 - DNA, 20 bp, Artificial Sequence
  chemically synthesized
ggcggaggttgcagtgagcc

SEQ ID NO: 431644 - DNA, 20 bp, Artificial Sequence
  chemically synthesized
ggagtgccgtggcacgatct

SEQ ID NO: 431645 - DNA, 20 bp, Artificial Sequence
  chemically synthesized
agtgagccaagatcgtgcca

SEQ ID NO: 431646 - DNA, 20 bp, Artificial Sequence
  chemically synthesized
ttgcccaggctggagtgccg

SEQ ID NO: 431647 - DNA, 20 bp, Artificial Sequence
  chemically synthesized
aagatcgtgccacggcactc

SEQ ID NO: 431648 - DNA, 20 bp, Artificial Sequence
  chemically synthesized
cgtgccacggcactccagcc

SEQ ID NO: 431649 - DNA, 20 bp, Artificial Sequence
  chemically synthesized
gtgccacggcactccagcct

SEQ ID NO: 431650 - DNA, 20 bp, Artificial Sequence
  chemically synthesized
tcactctgttgcccaggctg

SEQ ID NO: 431651 - DNA, 20 bp, Artificial Sequence
  chemically synthesized
tctcactctgttgcccaggc

SEQ ID NO: 431652 - DNA, 20 bp, Artificial Sequence
  chemically synthesized
cggcactccagcctgggcaa

SEQ ID NO: 431653 - DNA, 20 bp, Artificial Sequence
  chemically synthesized
ggagtctcactctgttgccc

SEQ ID NO: 431654 - DNA, 20 bp, Artificial Sequence
  chemically synthesized
gcactccagcctgggcaaca

SEQ ID NO: 431655 - DNA, 20 bp, Artificial Sequence
  chemically synthesized
tggagtctcactctgttgcc

SEQ ID NO: 431656 - DNA, 20 bp, Artificial Sequence
  chemically synthesized
tccagcctgggcaacagagt

SEQ ID NO: 431657 - DNA, 20 bp, Artificial Sequence
  chemically synthesized
acatatatatttttgagatg

SEQ ID NO: 431658 - DNA, 20 bp, Artificial Sequence
  chemically synthesized
acacatatatatttttgaga

SEQ ID NO: 431659 - DNA, 20 bp, Artificial Sequence
  chemically synthesized
atacacacatatatattttt

SEQ ID NO: 431660 - DNA, 20 bp, Artificial Sequence
  chemically synthesized
gatatagatatatatagata

SEQ ID NO: 431661 - DNA, 20 bp, Artificial Sequence
  chemically synthesized
gagatagatatagatatata

SEQ ID NO: 431662 - DNA, 20 bp, Artificial Sequence
  chemically synthesized
tagatagatagagatagata

SEQ ID NO: 431663 - DNA, 20 bp, Artificial Sequence
  chemically synthesized
gatagatagatagatagaga

SEQ ID NO: 431664 - DNA, 20 bp, Artificial Sequence
  chemically synthesized
gatagatagatagatagata

SEQ ID NO: 431665 - DNA, 20 bp, Artificial Sequence
  chemically synthesized
tagatagatagatagataga

SEQ ID NO: 431666 - DNA, 20 bp, Artificial Sequence
  chemically synthesized
tagatagatagatagataga

SEQ ID NO: 431667 - DNA, 20 bp, Artificial Sequence
  chemically synthesized
tagatagatagatagataga

SEQ ID NO: 431668 - DNA, 20 bp, Artificial Sequence
  chemically synthesized
tagatagatagatagataga

SEQ ID NO: 431669 - DNA, 20 bp, Artificial Sequence
  chemically synthesized
tagatagatagatagataga

SEQ ID NO: 431670 - DNA, 20 bp, Artificial Sequence
  chemically synthesized
tatatagatagatagataga

SEQ ID NO: 431671 - DNA, 20 bp, Artificial Sequence
  chemically synthesized
actttatatagatagataga

SEQ ID NO: 431672 - DNA, 20 bp, Artificial Sequence
  chemically synthesized
taaaactttatatagataga

SEQ ID NO: 431673 - DNA, 20 bp, Artificial Sequence
  chemically synthesized
ctcctaaaactttatataga

SEQ ID NO: 431674 - DNA, 20 bp, Artificial Sequence
  chemically synthesized
tctatctatctatctatata

SEQ ID NO: 431675 - DNA, 20 bp, Artificial Sequence
  chemically synthesized
atttctcctaaaactttata

SEQ ID NO: 431676 - DNA, 20 bp, Artificial Sequence
  chemically synthesized
tatctatctatataaagttt

SEQ ID NO: 431677 - DNA, 20 bp, Artificial Sequence
  chemically synthesized
atctatctatataaagtttt

SEQ ID NO: 431678 - DNA, 20 bp, Artificial Sequence
  chemically synthesized
ctatctatataaagttttag

SEQ ID NO: 431679 - DNA, 20 bp, Artificial Sequence
  chemically synthesized
agttttaggagaaatctgct

SEQ ID NO: 431680 - DNA, 20 bp, Artificial Sequence
  chemically synthesized
gagaggaatgcaattctgag

SEQ ID NO: 431681 - DNA, 20 bp, Artificial Sequence
  chemically synthesized
taagagaggaatgcaattct

SEQ ID NO: 431682 - DNA, 20 bp, Artificial Sequence
  chemically synthesized
cttatcactatgagtaagag

SEQ ID NO: 431683 - DNA, 20 bp, Artificial Sequence
  chemically synthesized
ccttatcactatgagtaaga

SEQ ID NO: 431684 - DNA, 20 bp, Artificial Sequence
  chemically synthesized
ttgcattcctctcttactca

SEQ ID NO: 431685 - DNA, 20 bp, Artificial Sequence
  chemically synthesized
ccccttatcactatgagtaa

SEQ ID NO: 431686 - DNA, 20 bp, Artificial Sequence
  chemically synthesized
gtccccttatcactatgagt

SEQ ID NO: 431687 - DNA, 20 bp, Artificial Sequence
  chemically synthesized
cgaggtccccttatcactat

SEQ ID NO: 431688 - DNA, 20 bp, Artificial Sequence
  chemically synthesized
cctctcttactcatagtgat

SEQ ID NO: 431689 - DNA, 20 bp, Artificial Sequence
  chemically synthesized
ctctcttactcatagtgata

SEQ ID NO: 431690 - DNA, 20 bp, Artificial Sequence
  chemically synthesized
tctcttactcatagtgataa

SEQ ID NO: 431691 - DNA, 20 bp, Artificial Sequence
  chemically synthesized
ctcttactcatagtgataag

SEQ ID NO: 431692 - DNA, 20 bp, Artificial Sequence
  chemically synthesized
atagtgataaggggacctcg

SEQ ID NO: 431693 - DNA, 20 bp, Artificial Sequence
  chemically synthesized
tacaagactttttagctacg

SEQ ID NO: 431694 - DNA, 20 bp, Artificial Sequence
  chemically synthesized
ctacaagactttttagctac

SEQ ID NO: 431695 - DNA, 20 bp, Artificial Sequence
  chemically synthesized
aaggggacctcgtagctaaa

SEQ ID NO: 431696 - DNA, 20 bp, Artificial Sequence
  chemically synthesized
acctcctctacaagactttt

SEQ ID NO: 431697 - DNA, 20 bp, Artificial Sequence
  chemically synthesized
ctcgtagctaaaaagtcttg

SEQ ID NO: 431698 - DNA, 20 bp, Artificial Sequence
  chemically synthesized
cgtagctaaaaagtcttgta

SEQ ID NO: 431699 - DNA, 20 bp, Artificial Sequence
  chemically synthesized
gtagctaaaaagtcttgtag

SEQ ID NO: 431700 - DNA, 20 bp, Artificial Sequence
  chemically synthesized
agctaaaaagtcttgtagag

SEQ ID NO: 431701 - DNA, 20 bp, Artificial Sequence
  chemically synthesized
gctaaaaagtcttgtagagg

SEQ ID NO: 431702 - DNA, 20 bp, Artificial Sequence
  chemically synthesized
gaacttttaacctcctctac

SEQ ID NO: 431703 - DNA, 20 bp, Artificial Sequence
  chemically synthesized
agtcttgtagaggaggttaa

SEQ ID NO: 431704 - DNA, 20 bp, Artificial Sequence
  chemically synthesized
aggaggttaaaagttcttca

SEQ ID NO: 431705 - DNA, 20 bp, Artificial Sequence
  chemically synthesized
ttgagaatgtttttactttg

SEQ ID NO: 431706 - DNA, 20 bp, Artificial Sequence
  chemically synthesized
agtaaaaacattctcaactc

SEQ ID NO: 431707 - DNA, 20 bp, Artificial Sequence
  chemically synthesized
acatgttgttttctggagtt

SEQ ID NO: 431708 - DNA, 20 bp, Artificial Sequence
  chemically synthesized
gacttacatgttgttttctg

SEQ ID NO: 431709 - DNA, 20 bp, Artificial Sequence
  chemically synthesized
ttgacttacatgttgttttc

SEQ ID NO: 431710 - DNA, 20 bp, Artificial Sequence
  chemically synthesized
aactccagaaaacaacatgt

SEQ ID NO: 431711 - DNA, 20 bp, Artificial Sequence
  chemically synthesized
ttggcttagaaaacatgagt

SEQ ID NO: 431712 - DNA, 20 bp, Artificial Sequence
  chemically synthesized
attggcttagaaaacatgag

SEQ ID NO: 431713 - DNA, 20 bp, Artificial Sequence
  chemically synthesized
gatattggcttagaaaacat

SEQ ID NO: 431714 - DNA, 20 bp, Artificial Sequence
  chemically synthesized
tcaacccactcatgttttct

SEQ ID NO: 431715 - DNA, 20 bp, Artificial Sequence
  chemically synthesized
aactttctaagatattggct

SEQ ID NO: 431716 - DNA, 20 bp, Artificial Sequence
  chemically synthesized
tgttttctaagccaatatct

SEQ ID NO: 431717 - DNA, 20 bp, Artificial Sequence
  chemically synthesized
acaacaactttctaagatat

SEQ ID NO: 431718 - DNA, 20 bp, Artificial Sequence
  chemically synthesized
ttctaagccaatatcttaga

SEQ ID NO: 431719 - DNA, 20 bp, Artificial Sequence
  chemically synthesized
ggagtcgacaacaactttct

SEQ ID NO: 431720 - DNA, 20 bp, Artificial Sequence
  chemically synthesized
agttgttgtcgactcctcat

SEQ ID NO: 431721 - DNA, 20 bp, Artificial Sequence
  chemically synthesized
gggtagcagaggctcatgag

SEQ ID NO: 431722 - DNA, 20 bp, Artificial Sequence
  chemically synthesized
gtgggtagcagaggctcatg

SEQ ID NO: 431723 - DNA, 20 bp, Artificial Sequence
  chemically synthesized
tgtgggtagcagaggctcat

SEQ ID NO: 431724 - DNA, 20 bp, Artificial Sequence
  chemically synthesized
agattggctgtgggtagcag

SEQ ID NO: 431725 - DNA, 20 bp, Artificial Sequence
  chemically synthesized
cagattggctgtgggtagca

SEQ ID NO: 431726 - DNA, 20 bp, Artificial Sequence
  chemically synthesized
tcatgagcctctgctaccca

SEQ ID NO: 431727 - DNA, 20 bp, Artificial Sequence
  chemically synthesized
aacagattggctgtgggtag

SEQ ID NO: 431728 - DNA, 20 bp, Artificial Sequence
  chemically synthesized
agcaacagattggctgtggg

SEQ ID NO: 431729 - DNA, 20 bp, Artificial Sequence
  chemically synthesized
tttagcaacagattggctgt

SEQ ID NO: 431730 - DNA, 20 bp, Artificial Sequence
  chemically synthesized
atttagcaacagattggctg

SEQ ID NO: 431731 - DNA, 20 bp, Artificial Sequence
  chemically synthesized
cacaacatttagcaacagat

SEQ ID NO: 431732 - DNA, 20 bp, Artificial Sequence
  chemically synthesized
gaattcacaacatttagcaa

SEQ ID NO: 431733 - DNA, 20 bp, Artificial Sequence
  chemically synthesized
aaaaaagaattcacaacatt

SEQ ID NO: 431734 - DNA, 20 bp, Artificial Sequence
  chemically synthesized
agacatacaatacaataaaa

SEQ ID NO: 431735 - DNA, 20 bp, Artificial Sequence
  chemically synthesized
aagtgaagaaaaaagttatt

SEQ ID NO: 431736 - DNA, 20 bp, Artificial Sequence
  chemically synthesized
attttggcaagtgaagaaaa

SEQ ID NO: 431737 - DNA, 20 bp, Artificial Sequence
  chemically synthesized
ggattttattttggcaagtg

SEQ ID NO: 431738 - DNA, 20 bp, Artificial Sequence
  chemically synthesized
catatggattttattttggc

SEQ ID NO: 431739 - DNA, 20 bp, Artificial Sequence
  chemically synthesized
ggagcatatggattttattt

SEQ ID NO: 431740 - DNA, 20 bp, Artificial Sequence
  chemically synthesized
agtagggtggggggagcata

SEQ ID NO: 431741 - DNA, 20 bp, Artificial Sequence
  chemically synthesized
accatgcagtagggtggggg

SEQ ID NO: 431742 - DNA, 20 bp, Artificial Sequence
  chemically synthesized
gaaccatgcagtagggtggg

SEQ ID NO: 431743 - DNA, 20 bp, Artificial Sequence
  chemically synthesized
agaaccatgcagtagggtgg

SEQ ID NO: 431744 - DNA, 20 bp, Artificial Sequence
  chemically synthesized
gagaaccatgcagtagggtg

SEQ ID NO: 431745 - DNA, 20 bp, Artificial Sequence
  chemically synthesized
ggagaaccatgcagtagggt

SEQ ID NO: 431746 - DNA, 20 bp, Artificial Sequence
  chemically synthesized
tggagaaccatgcagtaggg

SEQ ID NO: 431747 - DNA, 20 bp, Artificial Sequence
  chemically synthesized
gctccccccaccctactgca

SEQ ID NO: 431748 - DNA, 20 bp, Artificial Sequence
  chemically synthesized
tactggagaaccatgcagta

SEQ ID NO: 431749 - DNA, 20 bp, Artificial Sequence
  chemically synthesized
ttactggagaaccatgcagt

SEQ ID NO: 431750 - DNA, 20 bp, Artificial Sequence
  chemically synthesized
tttactggagaaccatgcag

SEQ ID NO: 431751 - DNA, 20 bp, Artificial Sequence
  chemically synthesized
gtctttactggagaaccatg

SEQ ID NO: 431752 - DNA, 20 bp, Artificial Sequence
  chemically synthesized
caccctactgcatggttctc

SEQ ID NO: 431753 - DNA, 20 bp, Artificial Sequence
  chemically synthesized
tactgcatggttctccagta

SEQ ID NO: 431754 - DNA, 20 bp, Artificial Sequence
  chemically synthesized
aatatctatagtctttactg

SEQ ID NO: 431755 - DNA, 20 bp, Artificial Sequence
  chemically synthesized
aaaatatctatagtctttac

SEQ ID NO: 431756 - DNA, 20 bp, Artificial Sequence
  chemically synthesized
tggttctccagtaaagacta

SEQ ID NO: 431757 - DNA, 20 bp, Artificial Sequence
  chemically synthesized
ataagcagaaaaaatatcta

SEQ ID NO: 431758 - DNA, 20 bp, Artificial Sequence
  chemically synthesized
atttaatatatataaataag

SEQ ID NO: 431759 - DNA, 20 bp, Artificial Sequence
  chemically synthesized
tctatttaatatatataaat

SEQ ID NO: 431760 - DNA, 20 bp, Artificial Sequence
  chemically synthesized
gcttatttatatatattaaa

SEQ ID NO: 431761 - DNA, 20 bp, Artificial Sequence
  chemically synthesized
atatatattaaatagatttt

SEQ ID NO: 431762 - DNA, 20 bp, Artificial Sequence
  chemically synthesized
tatatattaaatagattttt

SEQ ID NO: 431763 - DNA, 20 bp, Artificial Sequence
  chemically synthesized
atattaaatagatttttagg

SEQ ID NO: 431764 - DNA, 20 bp, Artificial Sequence
  chemically synthesized
tttgcaacttcaaagagaca

SEQ ID NO: 431765 - DNA, 20 bp, Artificial Sequence
  chemically synthesized
aaaatcactttgtctctttg

SEQ ID NO: 431766 - DNA, 20 bp, Artificial Sequence
  chemically synthesized
taacaatttgcaacttcaaa

SEQ ID NO: 431767 - DNA, 20 bp, Artificial Sequence
  chemically synthesized
tataacaatttgcaacttca

SEQ ID NO: 431768 - DNA, 20 bp, Artificial Sequence
  chemically synthesized
tttgaagttgcaaattgtta

SEQ ID NO: 431769 - DNA, 20 bp, Artificial Sequence
  chemically synthesized
gttgcaaattgttatagacc

SEQ ID NO: 431770 - DNA, 20 bp, Artificial Sequence
  chemically synthesized
ttgcaaattgttatagacca

SEQ ID NO: 431771 - DNA, 20 bp, Artificial Sequence
  chemically synthesized
aaattgttatagaccaaggc

SEQ ID NO: 431772 - DNA, 20 bp, Artificial Sequence
  chemically synthesized
ttatgggcatgaaccagcct

SEQ ID NO: 431773 - DNA, 20 bp, Artificial Sequence
  chemically synthesized
caacctttatgggcatgaac

SEQ ID NO: 431774 - DNA, 20 bp, Artificial Sequence
  chemically synthesized
aaggctggttcatgcccata

SEQ ID NO: 431775 - DNA, 20 bp, Artificial Sequence
  chemically synthesized
aggctggttcatgcccataa

SEQ ID NO: 431776 - DNA, 20 bp, Artificial Sequence
  chemically synthesized
attaattaaacaacctttat

SEQ ID NO: 431777 - DNA, 20 bp, Artificial Sequence
  chemically synthesized
gattaattaaacaaccttta

SEQ ID NO: 431778 - DNA, 20 bp, Artificial Sequence
  chemically synthesized
attaatcgaatttgatatga

SEQ ID NO: 431779 - DNA, 20 bp, Artificial Sequence
  chemically synthesized
taatcgaatttgatatgaca

SEQ ID NO: 431780 - DNA, 20 bp, Artificial Sequence
  chemically synthesized
acagagtattacacacaaaa

SEQ ID NO: 431781 - DNA, 20 bp, Artificial Sequence
  chemically synthesized
gagtattacacacaaaatag

SEQ ID NO: 431782 - DNA, 20 bp, Artificial Sequence
  chemically synthesized
attacacacaaaatagtgga

SEQ ID NO: 431783 - DNA, 20 bp, Artificial Sequence
  chemically synthesized
ggacggaatatgcacaaaac

SEQ ID NO: 431784 - DNA, 20 bp, Artificial Sequence
  chemically synthesized
acaaaacaagtttttcacaa

SEQ ID NO: 431785 - DNA, 20 bp, Artificial Sequence
  chemically synthesized
caaaacaagtttttcacaaa

SEQ ID NO: 431786 - DNA, 20 bp, Artificial Sequence
  chemically synthesized
aacaagtttttcacaaaagg

SEQ ID NO: 431787 - DNA, 20 bp, Artificial Sequence
  chemically synthesized
ttttcacaaaaggaagtgaa

SEQ ID NO: 431788 - DNA, 20 bp, Artificial Sequence
  chemically synthesized
tacacagatgaatttggcac

SEQ ID NO: 431789 - DNA, 20 bp, Artificial Sequence
  chemically synthesized
tagtgttacacagatgaatt

SEQ ID NO: 431790 - DNA, 20 bp, Artificial Sequence
  chemically synthesized
tatttatttctagtgttaca

SEQ ID NO: 431791 - DNA, 20 bp, Artificial Sequence
  chemically synthesized
caaattcatctgtgtaacac

SEQ ID NO: 431792 - DNA, 20 bp, Artificial Sequence
  chemically synthesized
atttttaaaatatttatttc

SEQ ID NO: 431793 - DNA, 20 bp, Artificial Sequence
  chemically synthesized
ttaaaaatatatttattgct

SEQ ID NO: 431794 - DNA, 20 bp, Artificial Sequence
  chemically synthesized
aatggccagttttttaaact

SEQ ID NO: 431795 - DNA, 20 bp, Artificial Sequence
  chemically synthesized
tattgcttagtttaaaaaac

SEQ ID NO: 431796 - DNA, 20 bp, Artificial Sequence
  chemically synthesized
gcttaaagctcagaaatggc

SEQ ID NO: 431797 - DNA, 20 bp, Artificial Sequence
  chemically synthesized
ttaaaaaactggccatttct

SEQ ID NO: 431798 - DNA, 20 bp, Artificial Sequence
  chemically synthesized
gatagcttaaagctcagaaa

SEQ ID NO: 431799 - DNA, 20 bp, Artificial Sequence
  chemically synthesized
actggccatttctgagcttt

SEQ ID NO: 431800 - DNA, 20 bp, Artificial Sequence
  chemically synthesized
tccaatgatagcttaaagct

SEQ ID NO: 431801 - DNA, 20 bp, Artificial Sequence
  chemically synthesized
aagcttccaatgatagctta

SEQ ID NO: 431802 - DNA, 20 bp, Artificial Sequence
  chemically synthesized
tctgagctttaagctatcat

SEQ ID NO: 431803 - DNA, 20 bp, Artificial Sequence
  chemically synthesized
gagctttaagctatcattgg

SEQ ID NO: 431804 - DNA, 20 bp, Artificial Sequence
  chemically synthesized
aattataaagcttccaatga

SEQ ID NO: 431805 - DNA, 20 bp, Artificial Sequence
  chemically synthesized
aaataaaaccttaaattata

SEQ ID NO: 431806 - DNA, 20 bp, Artificial Sequence
  chemically synthesized
cattggaagctttataattt

SEQ ID NO: 431807 - DNA, 20 bp, Artificial Sequence
  chemically synthesized
attggaagctttataattta

SEQ ID NO: 431808 - DNA, 20 bp, Artificial Sequence
  chemically synthesized
acagctcaattatatttagc

SEQ ID NO: 431809 - DNA, 20 bp, Artificial Sequence
  chemically synthesized
ttaaacagctcaattatatt

SEQ ID NO: 431810 - DNA, 20 bp, Artificial Sequence
  chemically synthesized
tttgcttgctaaatataatt

SEQ ID NO: 431811 - DNA, 20 bp, Artificial Sequence
  chemically synthesized
ggctaaggattacaattaaa

SEQ ID NO: 431812 - DNA, 20 bp, Artificial Sequence
  chemically synthesized
agctgtttaattgtaatcct

SEQ ID NO: 431813 - DNA, 20 bp, Artificial Sequence
  chemically synthesized
ttaattgtaatccttagcct

SEQ ID NO: 431814 - DNA, 20 bp, Artificial Sequence
  chemically synthesized
tggctaaggagccaaggcta

SEQ ID NO: 431815 - DNA, 20 bp, Artificial Sequence
  chemically synthesized
ttggctaaggagccaaggct

SEQ ID NO: 431816 - DNA, 20 bp, Artificial Sequence
  chemically synthesized
ctacattggctaaggagcca

SEQ ID NO: 431817 - DNA, 20 bp, Artificial Sequence
  chemically synthesized
aatccttagccttggctcct

SEQ ID NO: 431818 - DNA, 20 bp, Artificial Sequence
  chemically synthesized
tctacattggctaaggagcc

SEQ ID NO: 431819 - DNA, 20 bp, Artificial Sequence
  chemically synthesized
taagctctacattggctaag

SEQ ID NO: 431820 - DNA, 20 bp, Artificial Sequence
  chemically synthesized
attaagctctacattggcta

SEQ ID NO: 431821 - DNA, 20 bp, Artificial Sequence
  chemically synthesized
tattaagctctacattggct

SEQ ID NO: 431822 - DNA, 20 bp, Artificial Sequence
  chemically synthesized
ccttggctccttagccaatg

SEQ ID NO: 431823 - DNA, 20 bp, Artificial Sequence
  chemically synthesized
ttggctccttagccaatgta

SEQ ID NO: 431824 - DNA, 20 bp, Artificial Sequence
  chemically synthesized
gaatttattaagctctacat

SEQ ID NO: 431825 - DNA, 20 bp, Artificial Sequence
  chemically synthesized
aatctaaaggtgaatttatt

SEQ ID NO: 431826 - DNA, 20 bp, Artificial Sequence
  chemically synthesized
gagcttaataaattcacctt

SEQ ID NO: 431827 - DNA, 20 bp, Artificial Sequence
  chemically synthesized
gtttattattgataatctaa

SEQ ID NO: 431828 - DNA, 20 bp, Artificial Sequence
  chemically synthesized
tgtttattattgataatcta

SEQ ID NO: 431829 - DNA, 20 bp, Artificial Sequence
  chemically synthesized
ttatcaataataaacacaca

SEQ ID NO: 431830 - DNA, 20 bp, Artificial Sequence
  chemically synthesized
tttacggactattgcaatat

SEQ ID NO: 431831 - DNA, 20 bp, Artificial Sequence
  chemically synthesized
ggtaaaatctaatattgcaa

SEQ ID NO: 431832 - DNA, 20 bp, Artificial Sequence
  chemically synthesized
aaagtaagcccggaagttta

SEQ ID NO: 431833 - DNA, 20 bp, Artificial Sequence
  chemically synthesized
tgcaatagtccgtaaacttc

SEQ ID NO: 431834 - DNA, 20 bp, Artificial Sequence
  chemically synthesized
gcaatagtccgtaaacttcc

SEQ ID NO: 431835 - DNA, 20 bp, Artificial Sequence
  chemically synthesized
cttttagaaagtaagcccgg

SEQ ID NO: 431836 - DNA, 20 bp, Artificial Sequence
  chemically synthesized
ctgcttttagaaagtaagcc

SEQ ID NO: 431837 - DNA, 20 bp, Artificial Sequence
  chemically synthesized
cttatctgcttttagaaagt

SEQ ID NO: 431838 - DNA, 20 bp, Artificial Sequence
  chemically synthesized
cttccgggcttactttctaa

SEQ ID NO: 431839 - DNA, 20 bp, Artificial Sequence
  chemically synthesized
tctgcttatctgcttttaga

SEQ ID NO: 431840 - DNA, 20 bp, Artificial Sequence
  chemically synthesized
ccgggcttactttctaaaag

SEQ ID NO: 431841 - DNA, 20 bp, Artificial Sequence
  chemically synthesized
taactctgcttatctgcttt

SEQ ID NO: 431842 - DNA, 20 bp, Artificial Sequence
  chemically synthesized
cttactttctaaaagcagat

SEQ ID NO: 431843 - DNA, 20 bp, Artificial Sequence
  chemically synthesized
actttctaaaagcagataag

SEQ ID NO: 431844 - DNA, 20 bp, Artificial Sequence
  chemically synthesized
tttctaaaagcagataagca

SEQ ID NO: 431845 - DNA, 20 bp, Artificial Sequence
  chemically synthesized
gcagataagcagagttattg

SEQ ID NO: 431846 - DNA, 20 bp, Artificial Sequence
  chemically synthesized
gataagcagagttattgaag

SEQ ID NO: 431847 - DNA, 20 bp, Artificial Sequence
  chemically synthesized
agaatcgtgtgtctatattt

SEQ ID NO: 431848 - DNA, 20 bp, Artificial Sequence
  chemically synthesized
aatcgtgtgtctatatttca

SEQ ID NO: 431849 - DNA, 20 bp, Artificial Sequence
  chemically synthesized
gagtttatgcctctgaaata

SEQ ID NO: 431850 - DNA, 20 bp, Artificial Sequence
  chemically synthesized
atcgtgtgtctatatttcag

SEQ ID NO: 431851 - DNA, 20 bp, Artificial Sequence
  chemically synthesized
tcagaggcataaactcattt

SEQ ID NO: 431852 - DNA, 20 bp, Artificial Sequence
  chemically synthesized
cagaggcataaactcatttt

SEQ ID NO: 431853 - DNA, 20 bp, Artificial Sequence
  chemically synthesized
gaggcataaactcattttag

SEQ ID NO: 431854 - DNA, 20 bp, Artificial Sequence
  chemically synthesized
gtaataatgactcctaaaat

SEQ ID NO: 431855 - DNA, 20 bp, Artificial Sequence
  chemically synthesized
ggtatgctgtgaaagtagtg

SEQ ID NO: 431856 - DNA, 20 bp, Artificial Sequence
  chemically synthesized
ttattactacactactttca

SEQ ID NO: 431857 - DNA, 20 bp, Artificial Sequence
  chemically synthesized
ttaaaggtatgctgtgaaag

SEQ ID NO: 431858 - DNA, 20 bp, Artificial Sequence
  chemically synthesized
tgattaaaggtatgctgtga

SEQ ID NO: 431859 - DNA, 20 bp, Artificial Sequence
  chemically synthesized
ttcacagcatacctttaatc

SEQ ID NO: 431860 - DNA, 20 bp, Artificial Sequence
  chemically synthesized
tatttctgatacttgattaa

SEQ ID NO: 431861 - DNA, 20 bp, Artificial Sequence
  chemically synthesized
ttatttctgatacttgatta

SEQ ID NO: 431862 - DNA, 20 bp, Artificial Sequence
  chemically synthesized
gcatacctttaatcaagtat

SEQ ID NO: 431863 - DNA, 20 bp, Artificial Sequence
  chemically synthesized
ttaatcaagtatcagaaata

SEQ ID NO: 431864 - DNA, 20 bp, Artificial Sequence
  chemically synthesized
atcaagtatcagaaataaag

SEQ ID NO: 431865 - DNA, 20 bp, Artificial Sequence
  chemically synthesized
agaaataaagtagaacacat

SEQ ID NO: 431866 - DNA, 20 bp, Artificial Sequence
  chemically synthesized
agtagaacacatcagaaaat

SEQ ID NO: 431867 - DNA, 20 bp, Artificial Sequence
  chemically synthesized
agaacacatcagaaaataag

SEQ ID NO: 431868 - DNA, 20 bp, Artificial Sequence
  chemically synthesized
aggtgtggtaaattgtttat

SEQ ID NO: 431869 - DNA, 20 bp, Artificial Sequence
  chemically synthesized
gaaagtctgcatttcaggtg

SEQ ID NO: 431870 - DNA, 20 bp, Artificial Sequence
  chemically synthesized
aatttaccacacctgaaatg

SEQ ID NO: 431871 - DNA, 20 bp, Artificial Sequence
  chemically synthesized
cgtatgaaagtctgcatttc

SEQ ID NO: 431872 - DNA, 20 bp, Artificial Sequence
  chemically synthesized
tcgtatgaaagtctgcattt

SEQ ID NO: 431873 - DNA, 20 bp, Artificial Sequence
  chemically synthesized
ctagaacatttttcgtatga

SEQ ID NO: 431874 - DNA, 20 bp, Artificial Sequence
  chemically synthesized
ctttcatacgaaaaatgttc

SEQ ID NO: 431875 - DNA, 20 bp, Artificial Sequence
  chemically synthesized
cgaaaaatgttctagcacaa

SEQ ID NO: 431876 - DNA, 20 bp, Artificial Sequence
  chemically synthesized
gaaaaatgttctagcacaac

SEQ ID NO: 431877 - DNA, 20 bp, Artificial Sequence
  chemically synthesized
gcctgtggaccctgttgtgc

SEQ ID NO: 431878 - DNA, 20 bp, Artificial Sequence
  chemically synthesized
aaaaatgttctagcacaaca

SEQ ID NO: 431879 - DNA, 20 bp, Artificial Sequence
  chemically synthesized
ttctagcacaacagggtcca

SEQ ID NO: 431880 - DNA, 20 bp, Artificial Sequence
  chemically synthesized
tctagcacaacagggtccac

SEQ ID NO: 431881 - DNA, 20 bp, Artificial Sequence
  chemically synthesized
acaggattgttgattgcctg

SEQ ID NO: 431882 - DNA, 20 bp, Artificial Sequence
  chemically synthesized
cccaggagaaggaagagaac

SEQ ID NO: 431883 - DNA, 20 bp, Artificial Sequence
  chemically synthesized
gcccaggagaaggaagagaa

SEQ ID NO: 431884 - DNA, 20 bp, Artificial Sequence
  chemically synthesized
gatcagcccaggagaaggaa

SEQ ID NO: 431885 - DNA, 20 bp, Artificial Sequence
  chemically synthesized
tagatcagcccaggagaagg

SEQ ID NO: 431886 - DNA, 20 bp, Artificial Sequence
  chemically synthesized
tcctgttctcttccttctcc

SEQ ID NO: 431887 - DNA, 20 bp, Artificial Sequence
  chemically synthesized
cctgttctcttccttctcct

SEQ ID NO: 431888 - DNA, 20 bp, Artificial Sequence
  chemically synthesized
taatagatcagcccaggaga

SEQ ID NO: 431889 - DNA, 20 bp, Artificial Sequence
  chemically synthesized
ctaatagatcagcccaggag

SEQ ID NO: 431890 - DNA, 20 bp, Artificial Sequence
  chemically synthesized
atgctaatagatcagcccag

SEQ ID NO: 431891 - DNA, 20 bp, Artificial Sequence
  chemically synthesized
ccatgctaatagatcagccc

SEQ ID NO: 431892 - DNA, 20 bp, Artificial Sequence
  chemically synthesized
gccatgctaatagatcagcc

SEQ ID NO: 431893 - DNA, 20 bp, Artificial Sequence
  chemically synthesized
cttctcctgggctgatctat

SEQ ID NO: 431894 - DNA, 20 bp, Artificial Sequence
  chemically synthesized
tattagccatgctaatagat

SEQ ID NO: 431895 - DNA, 20 bp, Artificial Sequence
  chemically synthesized
cctgggctgatctattagca

SEQ ID NO: 431896 - DNA, 20 bp, Artificial Sequence
  chemically synthesized
tgatctattagccatgctaa

SEQ ID NO: 431897 - DNA, 20 bp, Artificial Sequence
  chemically synthesized
tgatctattagcatggctaa

SEQ ID NO: 431898 - DNA, 20 bp, Artificial Sequence
  chemically synthesized
aggagagtgcaatgatctat

SEQ ID NO: 431899 - DNA, 20 bp, Artificial Sequence
  chemically synthesized
tagatcattgcactctccta

SEQ ID NO: 431900 - DNA, 20 bp, Artificial Sequence
  chemically synthesized
gatcattgcactctcctaca

SEQ ID NO: 431901 - DNA, 20 bp, Artificial Sequence
  chemically synthesized
cccatctggcctctgtagga

SEQ ID NO: 431902 - DNA, 20 bp, Artificial Sequence
  chemically synthesized
atcattgcactctcctacag

SEQ ID NO: 431903 - DNA, 20 bp, Artificial Sequence
  chemically synthesized
gtcccatctggcctctgtag

SEQ ID NO: 431904 - DNA, 20 bp, Artificial Sequence
  chemically synthesized
aagtcccatctggcctctgt

SEQ ID NO: 431905 - DNA, 20 bp, Artificial Sequence
  chemically synthesized
ttgcactctcctacagaggc

SEQ ID NO: 431906 - DNA, 20 bp, Artificial Sequence
  chemically synthesized
gaagtcccatctggcctctg

SEQ ID NO: 431907 - DNA, 20 bp, Artificial Sequence
  chemically synthesized
actctcctacagaggccaga

SEQ ID NO: 431908 - DNA, 20 bp, Artificial Sequence
  chemically synthesized
ctctcctacagaggccagat

SEQ ID NO: 431909 - DNA, 20 bp, Artificial Sequence
  chemically synthesized
aaatgtggagaagtcccatc

SEQ ID NO: 431910 - DNA, 20 bp, Artificial Sequence
  chemically synthesized
tcttgaactaaaatgtggag

SEQ ID NO: 431911 - DNA, 20 bp, Artificial Sequence
  chemically synthesized
gatgggacttctccacattt

SEQ ID NO: 431912 - DNA, 20 bp, Artificial Sequence
  chemically synthesized
tcttcttgaactaaaatgtg

SEQ ID NO: 431913 - DNA, 20 bp, Artificial Sequence
  chemically synthesized
tatcttcttgaactaaaatg

SEQ ID NO: 431914 - DNA, 20 bp, Artificial Sequence
  chemically synthesized
acttctccacattttagttc

SEQ ID NO: 431915 - DNA, 20 bp, Artificial Sequence
  chemically synthesized
tctccacattttagttcaag

SEQ ID NO: 431916 - DNA, 20 bp, Artificial Sequence
  chemically synthesized
tgccaactctaattaattgg

SEQ ID NO: 431917 - DNA, 20 bp, Artificial Sequence
  chemically synthesized
agaagatactaccaattaat

SEQ ID NO: 431918 - DNA, 20 bp, Artificial Sequence
  chemically synthesized
aagtgccaactctaattaat

SEQ ID NO: 431919 - DNA, 20 bp, Artificial Sequence
  chemically synthesized
aagatactaccaattaatta

SEQ ID NO: 431920 - DNA, 20 bp, Artificial Sequence
  chemically synthesized
tactaccaattaattagagt

SEQ ID NO: 431921 - DNA, 20 bp, Artificial Sequence
  chemically synthesized
attaattagagttggcactt

SEQ ID NO: 431922 - DNA, 20 bp, Artificial Sequence
  chemically synthesized
ttaattagagttggcacttg

SEQ ID NO: 431923 - DNA, 20 bp, Artificial Sequence
  chemically synthesized
gcaaagcaaataataacctc

SEQ ID NO: 431924 - DNA, 20 bp, Artificial Sequence
  chemically synthesized
gaaagaaagtaagtaaagca

SEQ ID NO: 431925 - DNA, 20 bp, Artificial Sequence
  chemically synthesized
aaaaagaaagaaagtaagta

SEQ ID NO: 431926 - DNA, 20 bp, Artificial Sequence
  chemically synthesized
aaaaaaaaaagaaagaaagt

SEQ ID NO: 431927 - DNA, 20 bp, Artificial Sequence
  chemically synthesized
aaaaaaaaaaaaaagaaaga

SEQ ID NO: 431928 - DNA, 20 bp, Artificial Sequence
  chemically synthesized
tgcaaaaaaaaaaaaaaaga

SEQ ID NO: 431929 - DNA, 20 bp, Artificial Sequence
  chemically synthesized
tgtatgcaaaaaaaaaaaaa

SEQ ID NO: 431930 - DNA, 20 bp, Artificial Sequence
  chemically synthesized
tttttttttttttttgcata

SEQ ID NO: 431931 - DNA, 20 bp, Artificial Sequence
  chemically synthesized
tttttttttgcatacagact

SEQ ID NO: 431932 - DNA, 20 bp, Artificial Sequence
  chemically synthesized
tttttgcatacagacttaga

SEQ ID NO: 431933 - DNA, 20 bp, Artificial Sequence
  chemically synthesized
tgattttaatttagctgtct

SEQ ID NO: 431934 - DNA, 20 bp, Artificial Sequence
  chemically synthesized
tgttcaatatgattttaatt

SEQ ID NO: 431935 - DNA, 20 bp, Artificial Sequence
  chemically synthesized
gtcctaatatcacattgaag

SEQ ID NO: 431936 - DNA, 20 bp, Artificial Sequence
  chemically synthesized
atgtcctaatatcacattga

SEQ ID NO: 431937 - DNA, 20 bp, Artificial Sequence
  chemically synthesized
aatgtcctaatatcacattg

SEQ ID NO: 431938 - DNA, 20 bp, Artificial Sequence
  chemically synthesized
catctccttcaatgtgatat

SEQ ID NO: 431939 - DNA, 20 bp, Artificial Sequence
  chemically synthesized
atctccttcaatgtgatatt

SEQ ID NO: 431940 - DNA, 20 bp, Artificial Sequence
  chemically synthesized
atgtgatattaggacatttc

SEQ ID NO: 431941 - DNA, 20 bp, Artificial Sequence
  chemically synthesized
tgatattaggacatttctag

SEQ ID NO: 431942 - DNA, 20 bp, Artificial Sequence
  chemically synthesized
tagattcaagtaaacacttc

SEQ ID NO: 431943 - DNA, 20 bp, Artificial Sequence
  chemically synthesized
gaagtgtttacttgaatcta

SEQ ID NO: 431944 - DNA, 20 bp, Artificial Sequence
  chemically synthesized
agctcaaaatctgtagattc

SEQ ID NO: 431945 - DNA, 20 bp, Artificial Sequence
  chemically synthesized
cccttatagctcaaaatctg

SEQ ID NO: 431946 - DNA, 20 bp, Artificial Sequence
  chemically synthesized
tacttgaatctacagatttt

SEQ ID NO: 431947 - DNA, 20 bp, Artificial Sequence
  chemically synthesized
atctacagattttgagctat

SEQ ID NO: 431948 - DNA, 20 bp, Artificial Sequence
  chemically synthesized
tctacagattttgagctata

SEQ ID NO: 431949 - DNA, 20 bp, Artificial Sequence
  chemically synthesized
ctacagattttgagctataa

SEQ ID NO: 431950 - DNA, 20 bp, Artificial Sequence
  chemically synthesized
tcctaaactcaagtccctta

SEQ ID NO: 431951 - DNA, 20 bp, Artificial Sequence
  chemically synthesized
ttttgagctataagggactt

SEQ ID NO: 431952 - DNA, 20 bp, Artificial Sequence
  chemically synthesized
agctataagggacttgagtt

SEQ ID NO: 431953 - DNA, 20 bp, Artificial Sequence
  chemically synthesized
gctataagggacttgagttt

SEQ ID NO: 431954 - DNA, 20 bp, Artificial Sequence
  chemically synthesized
taaactaaattcctaaactc

SEQ ID NO: 431955 - DNA, 20 bp, Artificial Sequence
  chemically synthesized
gggacttgagtttaggaatt

SEQ ID NO: 431956 - DNA, 20 bp, Artificial Sequence
  chemically synthesized
tttagtttaaatttgactaa

SEQ ID NO: 431957 - DNA, 20 bp, Artificial Sequence
  chemically synthesized
ggtagaaaactgtatgctat

SEQ ID NO: 431958 - DNA, 20 bp, Artificial Sequence
  chemically synthesized
taaatttgactaatagcata

SEQ ID NO: 431959 - DNA, 20 bp, Artificial Sequence
  chemically synthesized
tagcatacagttttctacct

SEQ ID NO: 431960 - DNA, 20 bp, Artificial Sequence
  chemically synthesized
gtgagtttattaggctgagg

SEQ ID NO: 431961 - DNA, 20 bp, Artificial Sequence
  chemically synthesized
tcagtgagtttattaggctg

SEQ ID NO: 431962 - DNA, 20 bp, Artificial Sequence
  chemically synthesized
gtcagtgagtttattaggct

SEQ ID NO: 431963 - DNA, 20 bp, Artificial Sequence
  chemically synthesized
ttagagtcagtgagtttatt

SEQ ID NO: 431964 - DNA, 20 bp, Artificial Sequence
  chemically synthesized
attagagtcagtgagtttat

SEQ ID NO: 431965 - DNA, 20 bp, Artificial Sequence
  chemically synthesized
aattcgttattagagtcagt

SEQ ID NO: 431966 - DNA, 20 bp, Artificial Sequence
  chemically synthesized
ttcaaattcgttattagagt

SEQ ID NO: 431967 - DNA, 20 bp, Artificial Sequence
  chemically synthesized
gtttttcaaattcgttatta

SEQ ID NO: 431968 - DNA, 20 bp, Artificial Sequence
  chemically synthesized
ttgtttttcaaattcgttat

SEQ ID NO: 431969 - DNA, 20 bp, Artificial Sequence
  chemically synthesized
tttgaaaaacaacatgtcct

SEQ ID NO: 431970 - DNA, 20 bp, Artificial Sequence
  chemically synthesized
gtgggtttgtcaggatgcta

SEQ ID NO: 431971 - DNA, 20 bp, Artificial Sequence
  chemically synthesized
tgtgggtttgtcaggatgct

SEQ ID NO: 431972 - DNA, 20 bp, Artificial Sequence
  chemically synthesized
agcagttctgtgggtttgtc

SEQ ID NO: 431973 - DNA, 20 bp, Artificial Sequence
  chemically synthesized
cagcagttctgtgggtttgt

SEQ ID NO: 431974 - DNA, 20 bp, Artificial Sequence
  chemically synthesized
ttagcatcctgacaaaccca

SEQ ID NO: 431975 - DNA, 20 bp, Artificial Sequence
  chemically synthesized
ggaaggagcagcagttctgt

SEQ ID NO: 431976 - DNA, 20 bp, Artificial Sequence
  chemically synthesized
aggaaggagcagcagttctg

SEQ ID NO: 431977 - DNA, 20 bp, Artificial Sequence
  chemically synthesized
catgtaggaggaaggagcag

SEQ ID NO: 431978 - DNA, 20 bp, Artificial Sequence
  chemically synthesized
tgacatgtaggaggaaggag

SEQ ID NO: 431979 - DNA, 20 bp, Artificial Sequence
  chemically synthesized
aactgacatgtaggaggaag

SEQ ID NO: 431980 - DNA, 20 bp, Artificial Sequence
  chemically synthesized
caaactgacatgtaggagga

SEQ ID NO: 431981 - DNA, 20 bp, Artificial Sequence
  chemically synthesized
ccaaactgacatgtaggagg

SEQ ID NO: 431982 - DNA, 20 bp, Artificial Sequence
  chemically synthesized
aacccaaactgacatgtagg

SEQ ID NO: 431983 - DNA, 20 bp, Artificial Sequence
  chemically synthesized
aaacccaaactgacatgtag

SEQ ID NO: 431984 - DNA, 20 bp, Artificial Sequence
  chemically synthesized
tgctccttcctcctacatgt

SEQ ID NO: 431985 - DNA, 20 bp, Artificial Sequence
  chemically synthesized
tgaaacccaaactgacatgt

SEQ ID NO: 431986 - DNA, 20 bp, Artificial Sequence
  chemically synthesized
ctgaaacccaaactgacatg

SEQ ID NO: 431987 - DNA, 20 bp, Artificial Sequence
  chemically synthesized
cttcctcctacatgtcagtt

SEQ ID NO: 431988 - DNA, 20 bp, Artificial Sequence
  chemically synthesized
ttcctcctacatgtcagttt

SEQ ID NO: 431989 - DNA, 20 bp, Artificial Sequence
  chemically synthesized
ctacatgtcagtttgggttt

SEQ ID NO: 431990 - DNA, 20 bp, Artificial Sequence
  chemically synthesized
tctaacacataaagaaaatt

SEQ ID NO: 431991 - DNA, 20 bp, Artificial Sequence
  chemically synthesized
tctcaattttctttatgtgt

SEQ ID NO: 431992 - DNA, 20 bp, Artificial Sequence
  chemically synthesized
ttatgaacttctaacacata

SEQ ID NO: 431993 - DNA, 20 bp, Artificial Sequence
  chemically synthesized
caattttctttatgtgttag

SEQ ID NO: 431994 - DNA, 20 bp, Artificial Sequence
  chemically synthesized
atgtgttagaagttcataat

SEQ ID NO: 431995 - DNA, 20 bp, Artificial Sequence
  chemically synthesized
tgttagaagttcataattgg

SEQ ID NO: 431996 - DNA, 20 bp, Artificial Sequence
  chemically synthesized
ataattggaagtgtgaataa

SEQ ID NO: 431997 - DNA, 20 bp, Artificial Sequence
  chemically synthesized
ttggaagtgtgaataaaagt

SEQ ID NO: 431998 - DNA, 20 bp, Artificial Sequence
  chemically synthesized
tggaagtgtgaataaaagtt

SEQ ID NO: 431999 - DNA, 20 bp, Artificial Sequence
  chemically synthesized
ggaagtgtgaataaaagtta

SEQ ID NO: 432000 - DNA, 20 bp, Artificial Sequence
  chemically synthesized
gaagtgtgaataaaagttag

SEQ ID NO: 432001 - DNA, 20 bp, Artificial Sequence
  chemically synthesized
gggaaaaatgacttaaactt

SEQ ID NO: 432002 - DNA, 20 bp, Artificial Sequence
  chemically synthesized
ttttcctgctgctgaagttt

SEQ ID NO: 432003 - DNA, 20 bp, Artificial Sequence
  chemically synthesized
aaaaatgacttaaacttcag

SEQ ID NO: 432004 - DNA, 20 bp, Artificial Sequence
  chemically synthesized
aatgacttaaacttcagcag

SEQ ID NO: 432005 - DNA, 20 bp, Artificial Sequence
  chemically synthesized
atgacttaaacttcagcagc

SEQ ID NO: 432006 - DNA, 20 bp, Artificial Sequence
  chemically synthesized
attatcttttcctgctgctg

SEQ ID NO: 432007 - DNA, 20 bp, Artificial Sequence
  chemically synthesized
ttaaacttcagcagcaggaa

SEQ ID NO: 432008 - DNA, 20 bp, Artificial Sequence
  chemically synthesized
ctaaaactagacagacagta

SEQ ID NO: 432009 - DNA, 20 bp, Artificial Sequence
  chemically synthesized
gataatctttactgtctgtc

SEQ ID NO: 432010 - DNA, 20 bp, Artificial Sequence
  chemically synthesized
atgctctaaaactagacaga

SEQ ID NO: 432011 - DNA, 20 bp, Artificial Sequence
  chemically synthesized
ttggatgctctaaaactaga

SEQ ID NO: 432012 - DNA, 20 bp, Artificial Sequence
  chemically synthesized
ctttactgtctgtctagttt

SEQ ID NO: 432013 - DNA, 20 bp, Artificial Sequence
  chemically synthesized
ttactgtctgtctagtttta

SEQ ID NO: 432014 - DNA, 20 bp, Artificial Sequence
  chemically synthesized
tttattggatgctctaaaac

SEQ ID NO: 432015 - DNA, 20 bp, Artificial Sequence
  chemically synthesized
ttttagagcatccaataaac

SEQ ID NO: 432016 - DNA, 20 bp, Artificial Sequence
  chemically synthesized
tgatggatgttcttgtttat

SEQ ID NO: 432017 - DNA, 20 bp, Artificial Sequence
  chemically synthesized
gccaccaaagagttttttga

SEQ ID NO: 432018 - DNA, 20 bp, Artificial Sequence
  chemically synthesized
acatccatcaaaaaactctt

SEQ ID NO: 432019 - DNA, 20 bp, Artificial Sequence
  chemically synthesized
tccatcaaaaaactctttgg

SEQ ID NO: 432020 - DNA, 20 bp, Artificial Sequence
  chemically synthesized
catttcctcaagccaccaaa

SEQ ID NO: 432021 - DNA, 20 bp, Artificial Sequence
  chemically synthesized
cacatttcctcaagccacca

SEQ ID NO: 432022 - DNA, 20 bp, Artificial Sequence
  chemically synthesized
aaaaaactctttggtggctt

SEQ ID NO: 432023 - DNA, 20 bp, Artificial Sequence
  chemically synthesized
aaaaactctttggtggcttg

SEQ ID NO: 432024 - DNA, 20 bp, Artificial Sequence
  chemically synthesized
ggcactccccacatttcctc

SEQ ID NO: 432025 - DNA, 20 bp, Artificial Sequence
  chemically synthesized
tttggtggcttgaggaaatg

SEQ ID NO: 432026 - DNA, 20 bp, Artificial Sequence
  chemically synthesized
ttggtggcttgaggaaatgt

SEQ ID NO: 432027 - DNA, 20 bp, Artificial Sequence
  chemically synthesized
tggtggcttgaggaaatgtg

SEQ ID NO: 432028 - DNA, 20 bp, Artificial Sequence
  chemically synthesized
gtggcttgaggaaatgtggg

SEQ ID NO: 432029 - DNA, 20 bp, Artificial Sequence
  chemically synthesized
aggaaatgtggggagtgcct

SEQ ID NO: 432030 - DNA, 20 bp, Artificial Sequence
  chemically synthesized
agaaggatagcgtgatactc

SEQ ID NO: 432031 - DNA, 20 bp, Artificial Sequence
  chemically synthesized
aagaaggatagcgtgatact

SEQ ID NO: 432032 - DNA, 20 bp, Artificial Sequence
  chemically synthesized
caaaaatttcacaagaagga

SEQ ID NO: 432033 - DNA, 20 bp, Artificial Sequence
  chemically synthesized
ttatcaaaaatttcacaaga

SEQ ID NO: 432034 - DNA, 20 bp, Artificial Sequence
  chemically synthesized
attatcaaaaatttcacaag

SEQ ID NO: 432035 - DNA, 20 bp, Artificial Sequence
  chemically synthesized
tgtattatcaaaaatttcac

SEQ ID NO: 432036 - DNA, 20 bp, Artificial Sequence
  chemically synthesized
tttttgataatacatgtctg

SEQ ID NO: 432037 - DNA, 20 bp, Artificial Sequence
  chemically synthesized
tgataatacatgtctgtagt

SEQ ID NO: 432038 - DNA, 20 bp, Artificial Sequence
  chemically synthesized
gttgtgaatcatgcttacta

SEQ ID NO: 432039 - DNA, 20 bp, Artificial Sequence
  chemically synthesized
attataaattgtttagttag

SEQ ID NO: 432040 - DNA, 20 bp, Artificial Sequence
  chemically synthesized
ggaattataaattgtttagt

SEQ ID NO: 432041 - DNA, 20 bp, Artificial Sequence
  chemically synthesized
tgttggaattataaattgtt

SEQ ID NO: 432042 - DNA, 20 bp, Artificial Sequence
  chemically synthesized
tgtaatttaggtgaaattgt

SEQ ID NO: 432043 - DNA, 20 bp, Artificial Sequence
  chemically synthesized
aacacacctttgtgtaattt

SEQ ID NO: 432044 - DNA, 20 bp, Artificial Sequence
  chemically synthesized
aaacacacctttgtgtaatt

SEQ ID NO: 432045 - DNA, 20 bp, Artificial Sequence
  chemically synthesized
aatttcacctaaattacaca

SEQ ID NO: 432046 - DNA, 20 bp, Artificial Sequence
  chemically synthesized
atttcacctaaattacacaa

SEQ ID NO: 432047 - DNA, 20 bp, Artificial Sequence
  chemically synthesized
aaattacacaaaggtgtgtt

SEQ ID NO: 432048 - DNA, 20 bp, Artificial Sequence
  chemically synthesized
aaaggtgtgtttagaatata

SEQ ID NO: 432049 - DNA, 20 bp, Artificial Sequence
  chemically synthesized
aaggtgtgtttagaatatac

SEQ ID NO: 432050 - DNA, 20 bp, Artificial Sequence
  chemically synthesized
ggtgtgtttagaatatacag

SEQ ID NO: 432051 - DNA, 20 bp, Artificial Sequence
  chemically synthesized
gtttagaatatacaggagaa

SEQ ID NO: 432052 - DNA, 20 bp, Artificial Sequence
  chemically synthesized
agaatatacaggagaatagc

SEQ ID NO: 432053 - DNA, 20 bp, Artificial Sequence
  chemically synthesized
aatacatttttttttcatac

SEQ ID NO: 432054 - DNA, 20 bp, Artificial Sequence
  chemically synthesized
gtatgaaaaaaaaatgtatt

SEQ ID NO: 432055 - DNA, 20 bp, Artificial Sequence
  chemically synthesized
atgaaaaaaaaatgtattca

SEQ ID NO: 432056 - DNA, 20 bp, Artificial Sequence
  chemically synthesized
aaaaaaatgtattcagagaa

SEQ ID NO: 432057 - DNA, 20 bp, Artificial Sequence
  chemically synthesized
cagagaaaagacaaataata

SEQ ID NO: 432058 - DNA, 20 bp, Artificial Sequence
  chemically synthesized
aaaagacaaataatacagct

SEQ ID NO: 432059 - DNA, 20 bp, Artificial Sequence
  chemically synthesized
aaagacaaataatacagctc

SEQ ID NO: 432060 - DNA, 20 bp, Artificial Sequence
  chemically synthesized
ctgagaaacatttcattcct

SEQ ID NO: 432061 - DNA, 20 bp, Artificial Sequence
  chemically synthesized
ctcaggaatgaaatgtttct

SEQ ID NO: 432062 - DNA, 20 bp, Artificial Sequence
  chemically synthesized
gaatgaaatgtttctcagct

SEQ ID NO: 432063 - DNA, 20 bp, Artificial Sequence
  chemically synthesized
aatgaaatgtttctcagcta

SEQ ID NO: 432064 - DNA, 20 bp, Artificial Sequence
  chemically synthesized
atgaaatgtttctcagctaa

SEQ ID NO: 432065 - DNA, 20 bp, Artificial Sequence
  chemically synthesized
tcctatgtcgtcccttagct

SEQ ID NO: 432066 - DNA, 20 bp, Artificial Sequence
  chemically synthesized
tgtgatcctatgtcgtccct

SEQ ID NO: 432067 - DNA, 20 bp, Artificial Sequence
  chemically synthesized
ttctcagctaagggacgaca

SEQ ID NO: 432068 - DNA, 20 bp, Artificial Sequence
  chemically synthesized
tctcagctaagggacgacat

SEQ ID NO: 432069 - DNA, 20 bp, Artificial Sequence
  chemically synthesized
acataggatcacaattcatc

SEQ ID NO: 432070 - DNA, 20 bp, Artificial Sequence
  chemically synthesized
cataggatcacaattcatct

SEQ ID NO: 432071 - DNA, 20 bp, Artificial Sequence
  chemically synthesized
gcaactgcggaaaaaacacc

SEQ ID NO: 432072 - DNA, 20 bp, Artificial Sequence
  chemically synthesized
tcatctaggtgttttttccg

SEQ ID NO: 432073 - DNA, 20 bp, Artificial Sequence
  chemically synthesized
atatgtactgaaagcaactg

SEQ ID NO: 432074 - DNA, 20 bp, Artificial Sequence
  chemically synthesized
gttttttccgcagttgcttt

SEQ ID NO: 432075 - DNA, 20 bp, Artificial Sequence
  chemically synthesized
tttgtataaatatgtactga

SEQ ID NO: 432076 - DNA, 20 bp, Artificial Sequence
  chemically synthesized
tcagtacatatttatacaaa

SEQ ID NO: 432077 - DNA, 20 bp, Artificial Sequence
  chemically synthesized
tatttatacaaacagaataa

SEQ ID NO: 432078 - DNA, 20 bp, Artificial Sequence
  chemically synthesized
ttatacaaacagaataaaag

SEQ ID NO: 432079 - DNA, 20 bp, Artificial Sequence
  chemically synthesized
aaacagaataaaagaagtac

SEQ ID NO: 432080 - DNA, 20 bp, Artificial Sequence
  chemically synthesized
gtttactacttatttggttc

SEQ ID NO: 432081 - DNA, 20 bp, Artificial Sequence
  chemically synthesized
aagaagtaccggaaccaaat

SEQ ID NO: 432082 - DNA, 20 bp, Artificial Sequence
  chemically synthesized
aagtaccggaaccaaataag

SEQ ID NO: 432083 - DNA, 20 bp, Artificial Sequence
  chemically synthesized
ccctttgtttactacttatt

SEQ ID NO: 432084 - DNA, 20 bp, Artificial Sequence
  chemically synthesized
aaccaaataagtagtaaaca

SEQ ID NO: 432085 - DNA, 20 bp, Artificial Sequence
  chemically synthesized
accaaataagtagtaaacaa

SEQ ID NO: 432086 - DNA, 20 bp, Artificial Sequence
  chemically synthesized
ccaaataagtagtaaacaaa

SEQ ID NO: 432087 - DNA, 20 bp, Artificial Sequence
  chemically synthesized
caaataagtagtaaacaaag

SEQ ID NO: 432088 - DNA, 20 bp, Artificial Sequence
  chemically synthesized
aaataagtagtaaacaaagg

SEQ ID NO: 432089 - DNA, 20 bp, Artificial Sequence
  chemically synthesized
aagtagtaaacaaaggggga

SEQ ID NO: 432090 - DNA, 20 bp, Artificial Sequence
  chemically synthesized
gtagtaaacaaagggggaaa

SEQ ID NO: 432091 - DNA, 20 bp, Artificial Sequence
  chemically synthesized
taatttgcaatgctcatgca

SEQ ID NO: 432092 - DNA, 20 bp, Artificial Sequence
  chemically synthesized
tcattttattttctgtgcat

SEQ ID NO: 432093 - DNA, 20 bp, Artificial Sequence
  chemically synthesized
catgcacagaaaataaaatg

SEQ ID NO: 432094 - DNA, 20 bp, Artificial Sequence
  chemically synthesized
atgcacagaaaataaaatga

SEQ ID NO: 432095 - DNA, 20 bp, Artificial Sequence
  chemically synthesized
aaataaaatgaaggtaataa

SEQ ID NO: 432096 - DNA, 20 bp, Artificial Sequence
  chemically synthesized
gaaggtaataatagcacaaa

SEQ ID NO: 432097 - DNA, 20 bp, Artificial Sequence
  chemically synthesized
taatagcacaaaaagaaaac

SEQ ID NO: 432098 - DNA, 20 bp, Artificial Sequence
  chemically synthesized
aatagcacaaaaagaaaaca

SEQ ID NO: 432099 - DNA, 20 bp, Artificial Sequence
  chemically synthesized
atagcacaaaaagaaaacaa

SEQ ID NO: 432100 - DNA, 20 bp, Artificial Sequence
  chemically synthesized
aaaaagaaaacaagggcatc

SEQ ID NO: 432101 - DNA, 20 bp, Artificial Sequence
  chemically synthesized
agaaaacaagggcatcaagt

SEQ ID NO: 432102 - DNA, 20 bp, Artificial Sequence
  chemically synthesized
aaacaagggcatcaagtaag

SEQ ID NO: 432103 - DNA, 20 bp, Artificial Sequence
  chemically synthesized
acaagggcatcaagtaagaa

SEQ ID NO: 432104 - DNA, 20 bp, Artificial Sequence
  chemically synthesized
caagggcatcaagtaagaag

SEQ ID NO: 432105 - DNA, 20 bp, Artificial Sequence
  chemically synthesized
gggcatcaagtaagaagagg

SEQ ID NO: 432106 - DNA, 20 bp, Artificial Sequence
  chemically synthesized
aggaagaaaaccaaaacaca

SEQ ID NO: 432107 - DNA, 20 bp, Artificial Sequence
  chemically synthesized
tcttcttgtcctgtgtgttt

SEQ ID NO: 432108 - DNA, 20 bp, Artificial Sequence
  chemically synthesized
ggaagaaaaccaaaacacac

SEQ ID NO: 432109 - DNA, 20 bp, Artificial Sequence
  chemically synthesized
aaaaccaaaacacacaggac

SEQ ID NO: 432110 - DNA, 20 bp, Artificial Sequence
  chemically synthesized
accaaaacacacaggacaag

SEQ ID NO: 432111 - DNA, 20 bp, Artificial Sequence
  chemically synthesized
aaacacacaggacaagaaga

SEQ ID NO: 432112 - DNA, 20 bp, Artificial Sequence
  chemically synthesized
aacacacaggacaagaagat

SEQ ID NO: 432113 - DNA, 20 bp, Artificial Sequence
  chemically synthesized
acacacaggacaagaagatg

SEQ ID NO: 432114 - DNA, 20 bp, Artificial Sequence
  chemically synthesized
agaagatggggcgttaaaac

SEQ ID NO: 432115 - DNA, 20 bp, Artificial Sequence
  chemically synthesized
gatggggcgttaaaacaaga

SEQ ID NO: 432116 - DNA, 20 bp, Artificial Sequence
  chemically synthesized
gcgttaaaacaagaaagctc

SEQ ID NO: 432117 - DNA, 20 bp, Artificial Sequence
  chemically synthesized
ttaaaacaagaaagctctag

SEQ ID NO: 432118 - DNA, 20 bp, Artificial Sequence
  chemically synthesized
aaaacaagaaagctctagtg

SEQ ID NO: 432119 - DNA, 20 bp, Artificial Sequence
  chemically synthesized
cctcagttactgctccacta

SEQ ID NO: 432120 - DNA, 20 bp, Artificial Sequence
  chemically synthesized
acaagaaagctctagtggag

SEQ ID NO: 432121 - DNA, 20 bp, Artificial Sequence
  chemically synthesized
accctcagttactgctccac

SEQ ID NO: 432122 - DNA, 20 bp, Artificial Sequence
  chemically synthesized
gctctagtggagcagtaact

SEQ ID NO: 432123 - DNA, 20 bp, Artificial Sequence
  chemically synthesized
ctctagtggagcagtaactg

SEQ ID NO: 432124 - DNA, 20 bp, Artificial Sequence
  chemically synthesized
tctagtggagcagtaactga

SEQ ID NO: 432125 - DNA, 20 bp, Artificial Sequence
  chemically synthesized
tggagcagtaactgagggta

SEQ ID NO: 432126 - DNA, 20 bp, Artificial Sequence
  chemically synthesized
ggagcagtaactgagggtaa

SEQ ID NO: 432127 - DNA, 20 bp, Artificial Sequence
  chemically synthesized
ttgagcgcttcctttaccct

SEQ ID NO: 432128 - DNA, 20 bp, Artificial Sequence
  chemically synthesized
gcagtaactgagggtaaagg

SEQ ID NO: 432129 - DNA, 20 bp, Artificial Sequence
  chemically synthesized
tgagggtaaaggaagcgctc

SEQ ID NO: 432130 - DNA, 20 bp, Artificial Sequence
  chemically synthesized
cttcctatacatcaaaactt

SEQ ID NO: 432131 - DNA, 20 bp, Artificial Sequence
  chemically synthesized
agcgctcaagttttgatgta

SEQ ID NO: 432132 - DNA, 20 bp, Artificial Sequence
  chemically synthesized
gcgctcaagttttgatgtat

SEQ ID NO: 432133 - DNA, 20 bp, Artificial Sequence
  chemically synthesized
ctcaagttttgatgtatagg

SEQ ID NO: 432134 - DNA, 20 bp, Artificial Sequence
  chemically synthesized
gttttgatgtataggaagca

SEQ ID NO: 432135 - DNA, 20 bp, Artificial Sequence
  chemically synthesized
ttgatgtataggaagcaaag

SEQ ID NO: 432136 - DNA, 20 bp, Artificial Sequence
  chemically synthesized
tgatgtataggaagcaaaga

SEQ ID NO: 432137 - DNA, 20 bp, Artificial Sequence
  chemically synthesized
gaagcaaagaaggtaactga

SEQ ID NO: 432138 - DNA, 20 bp, Artificial Sequence
  chemically synthesized
acaacatcattaatcacttt

SEQ ID NO: 432139 - DNA, 20 bp, Artificial Sequence
  chemically synthesized
agtgattaatgatgttgttt

SEQ ID NO: 432140 - DNA, 20 bp, Artificial Sequence
  chemically synthesized
taatgatgttgttttggcaa

SEQ ID NO: 432141 - DNA, 20 bp, Artificial Sequence
  chemically synthesized
atgttgttttggcaacagaa

SEQ ID NO: 432142 - DNA, 20 bp, Artificial Sequence
  chemically synthesized
ttgttttggcaacagaatag

SEQ ID NO: 432143 - DNA, 20 bp, Artificial Sequence
  chemically synthesized
tggcaacagaatagcagatt

SEQ ID NO: 432144 - DNA, 20 bp, Artificial Sequence
  chemically synthesized
ggcaacagaatagcagatta

SEQ ID NO: 432145 - DNA, 20 bp, Artificial Sequence
  chemically synthesized
gcaacagaatagcagattaa

SEQ ID NO: 432146 - DNA, 20 bp, Artificial Sequence
  chemically synthesized
acagaatagcagattaaggg

SEQ ID NO: 432147 - DNA, 20 bp, Artificial Sequence
  chemically synthesized
tcctttccaatcagttcaga

SEQ ID NO: 432148 - DNA, 20 bp, Artificial Sequence
  chemically synthesized
gggcagctttctgaactgat

SEQ ID NO: 432149 - DNA, 20 bp, Artificial Sequence
  chemically synthesized
agcatcctttccaatcagtt

SEQ ID NO: 432150 - DNA, 20 bp, Artificial Sequence
  chemically synthesized
agctttctgaactgattgga

SEQ ID NO: 432151 - DNA, 20 bp, Artificial Sequence
  chemically synthesized
gctttctgaactgattggaa

SEQ ID NO: 432152 - DNA, 20 bp, Artificial Sequence
  chemically synthesized
ccttcagcatcctttccaat

SEQ ID NO: 432153 - DNA, 20 bp, Artificial Sequence
  chemically synthesized
actgattggaaaggatgctg

SEQ ID NO: 432154 - DNA, 20 bp, Artificial Sequence
  chemically synthesized
ctgattggaaaggatgctga

SEQ ID NO: 432155 - DNA, 20 bp, Artificial Sequence
  chemically synthesized
attggaaaggatgctgaagg

SEQ ID NO: 432156 - DNA, 20 bp, Artificial Sequence
  chemically synthesized
ttggaaaggatgctgaagga

SEQ ID NO: 432157 - DNA, 20 bp, Artificial Sequence
  chemically synthesized
ctgagcacctttccttcctt

SEQ ID NO: 432158 - DNA, 20 bp, Artificial Sequence
  chemically synthesized
aaaggatgctgaaggaagga

SEQ ID NO: 432159 - DNA, 20 bp, Artificial Sequence
  chemically synthesized
aaggatgctgaaggaaggaa

SEQ ID NO: 432160 - DNA, 20 bp, Artificial Sequence
  chemically synthesized
ctgaaggaaggaaaggtgct

SEQ ID NO: 432161 - DNA, 20 bp, Artificial Sequence
  chemically synthesized
ggaaggaaaggtgctcagtg

SEQ ID NO: 432162 - DNA, 20 bp, Artificial Sequence
  chemically synthesized
gaaggaaaggtgctcagtgt

SEQ ID NO: 432163 - DNA, 20 bp, Artificial Sequence
  chemically synthesized
catctccgatttcccacact

SEQ ID NO: 432164 - DNA, 20 bp, Artificial Sequence
  chemically synthesized
aggtgctcagtgtgggaaat

SEQ ID NO: 432165 - DNA, 20 bp, Artificial Sequence
  chemically synthesized
gtgctcagtgtgggaaatcg

SEQ ID NO: 432166 - DNA, 20 bp, Artificial Sequence
  chemically synthesized
tcagtgtgggaaatcggaga

SEQ ID NO: 432167 - DNA, 20 bp, Artificial Sequence
  chemically synthesized
gtgtgggaaatcggagatgg

SEQ ID NO: 432168 - DNA, 20 bp, Artificial Sequence
  chemically synthesized
tgtgggaaatcggagatggc

SEQ ID NO: 432169 - DNA, 20 bp, Artificial Sequence
  chemically synthesized
aaatcggagatggcaggata

SEQ ID NO: 432170 - DNA, 20 bp, Artificial Sequence
  chemically synthesized
aatcggagatggcaggatac

SEQ ID NO: 432171 - DNA, 20 bp, Artificial Sequence
  chemically synthesized
atggcaggatacaggaatac

SEQ ID NO: 432172 - DNA, 20 bp, Artificial Sequence
  chemically synthesized
tggcaggatacaggaatacc

SEQ ID NO: 432173 - DNA, 20 bp, Artificial Sequence
  chemically synthesized
ggatacaggaataccaggtc

SEQ ID NO: 432174 - DNA, 20 bp, Artificial Sequence
  chemically synthesized
atacaggaataccaggtcaa

SEQ ID NO: 432175 - DNA, 20 bp, Artificial Sequence
  chemically synthesized
tactgagatctctcttgacc

SEQ ID NO: 432176 - DNA, 20 bp, Artificial Sequence
  chemically synthesized
acaggaataccaggtcaaga

SEQ ID NO: 432177 - DNA, 20 bp, Artificial Sequence
  chemically synthesized
taccaggtcaagagagatct

SEQ ID NO: 432178 - DNA, 20 bp, Artificial Sequence
  chemically synthesized
caggtcaagagagatctcag

SEQ ID NO: 432179 - DNA, 20 bp, Artificial Sequence
  chemically synthesized
aaaacctagaatatactact

SEQ ID NO: 432180 - DNA, 20 bp, Artificial Sequence
  chemically synthesized
gagatctcagtagtatattc

SEQ ID NO: 432181 - DNA, 20 bp, Artificial Sequence
  chemically synthesized
agatctcagtagtatattct

SEQ ID NO: 432182 - DNA, 20 bp, Artificial Sequence
  chemically synthesized
tccattatatttttaaaacc

SEQ ID NO: 432183 - DNA, 20 bp, Artificial Sequence
  chemically synthesized
tctaggttttaaaaatataa

SEQ ID NO: 432184 - DNA, 20 bp, Artificial Sequence
  chemically synthesized
taggttttaaaaatataatg

SEQ ID NO: 432185 - DNA, 20 bp, Artificial Sequence
  chemically synthesized
atataatggagtgattgata

SEQ ID NO: 432186 - DNA, 20 bp, Artificial Sequence
  chemically synthesized
agtgattgatatagtttgaa

SEQ ID NO: 432187 - DNA, 20 bp, Artificial Sequence
  chemically synthesized
gattgatatagtttgaatag

SEQ ID NO: 432188 - DNA, 20 bp, Artificial Sequence
  chemically synthesized
atatagtttgaatagtagtc

SEQ ID NO: 432189 - DNA, 20 bp, Artificial Sequence
  chemically synthesized
tatagtttgaatagtagtct

SEQ ID NO: 432190 - DNA, 20 bp, Artificial Sequence
  chemically synthesized
ttgaatagtagtctaggtgt

SEQ ID NO: 432191 - DNA, 20 bp, Artificial Sequence
  chemically synthesized
ctgtgtctctttctaacacc

SEQ ID NO: 432192 - DNA, 20 bp, Artificial Sequence
  chemically synthesized
atagtagtctaggtgttaga

SEQ ID NO: 432193 - DNA, 20 bp, Artificial Sequence
  chemically synthesized
agtagtctaggtgttagaaa

SEQ ID NO: 432194 - DNA, 20 bp, Artificial Sequence
  chemically synthesized
ctaggtgttagaaagagaca

SEQ ID NO: 432195 - DNA, 20 bp, Artificial Sequence
  chemically synthesized
tgattgataatgatattgtt

SEQ ID NO: 432196 - DNA, 20 bp, Artificial Sequence
  chemically synthesized
tatcattatcaatcatcgct

SEQ ID NO: 432197 - DNA, 20 bp, Artificial Sequence
  chemically synthesized
ttatcaatcatcgctgagaa

SEQ ID NO: 432198 - DNA, 20 bp, Artificial Sequence
  chemically synthesized
tatcaatcatcgctgagaaa

SEQ ID NO: 432199 - DNA, 20 bp, Artificial Sequence
  chemically synthesized
aattactccttgccttttct

SEQ ID NO: 432200 - DNA, 20 bp, Artificial Sequence
  chemically synthesized
aatcatcgctgagaaaaggc

SEQ ID NO: 432201 - DNA, 20 bp, Artificial Sequence
  chemically synthesized
atcatcgctgagaaaaggca

SEQ ID NO: 432202 - DNA, 20 bp, Artificial Sequence
  chemically synthesized
catcgctgagaaaaggcaag

SEQ ID NO: 432203 - DNA, 20 bp, Artificial Sequence
  chemically synthesized
aaaggcaaggagtaatttaa

SEQ ID NO: 432204 - DNA, 20 bp, Artificial Sequence
  chemically synthesized
aaggcaaggagtaatttaac

SEQ ID NO: 432205 - DNA, 20 bp, Artificial Sequence
  chemically synthesized
agtaatttaacaggaatgat

SEQ ID NO: 432206 - DNA, 20 bp, Artificial Sequence
  chemically synthesized
taacaggaatgataagctta

SEQ ID NO: 432207 - DNA, 20 bp, Artificial Sequence
  chemically synthesized
aacaggaatgataagcttac

SEQ ID NO: 432208 - DNA, 20 bp, Artificial Sequence
  chemically synthesized
tttcacttttaatttcctgt

SEQ ID NO: 432209 - DNA, 20 bp, Artificial Sequence
  chemically synthesized
ataagcttacaggaaattaa

SEQ ID NO: 432210 - DNA, 20 bp, Artificial Sequence
  chemically synthesized
caggaaattaaaagtgaaat

SEQ ID NO: 432211 - DNA, 20 bp, Artificial Sequence
  chemically synthesized
aaaagtgaaataagatatat

SEQ ID NO: 432212 - DNA, 20 bp, Artificial Sequence
  chemically synthesized
agtgaaataagatatatgag

SEQ ID NO: 432213 - DNA, 20 bp, Artificial Sequence
  chemically synthesized
taagatatatgagaagatgt

SEQ ID NO: 432214 - DNA, 20 bp, Artificial Sequence
  chemically synthesized
atatatgagaagatgtgaga

SEQ ID NO: 432215 - DNA, 20 bp, Artificial Sequence
  chemically synthesized
atatgagaagatgtgagaaa

SEQ ID NO: 432216 - DNA, 20 bp, Artificial Sequence
  chemically synthesized
agatgtgagaaagagattaa

SEQ ID NO: 432217 - DNA, 20 bp, Artificial Sequence
  chemically synthesized
gatgtgagaaagagattaac

SEQ ID NO: 432218 - DNA, 20 bp, Artificial Sequence
  chemically synthesized
caggattattctttaaaaca

SEQ ID NO: 432219 - DNA, 20 bp, Artificial Sequence
  chemically synthesized
aaatttacttccatgtttta

SEQ ID NO: 432220 - DNA, 20 bp, Artificial Sequence
  chemically synthesized
gattattctttaaaacatgg

SEQ ID NO: 432221 - DNA, 20 bp, Artificial Sequence
  chemically synthesized
taaaacatggaagtaaattt

SEQ ID NO: 432222 - DNA, 20 bp, Artificial Sequence
  chemically synthesized
tatgggttattatttggaaa

SEQ ID NO: 432223 - DNA, 20 bp, Artificial Sequence
  chemically synthesized
gtatgggttattatttggaa

SEQ ID NO: 432224 - DNA, 20 bp, Artificial Sequence
  chemically synthesized
agtatgggttattatttgga

SEQ ID NO: 432225 - DNA, 20 bp, Artificial Sequence
  chemically synthesized
taggagtatgggttattatt

SEQ ID NO: 432226 - DNA, 20 bp, Artificial Sequence
  chemically synthesized
aagttttaatttaggagtat

SEQ ID NO: 432227 - DNA, 20 bp, Artificial Sequence
  chemically synthesized
taagttttaatttaggagta

SEQ ID NO: 432228 - DNA, 20 bp, Artificial Sequence
  chemically synthesized
caccataagttttaatttag

SEQ ID NO: 432229 - DNA, 20 bp, Artificial Sequence
  chemically synthesized
ttcaccataagttttaattt

SEQ ID NO: 432230 - DNA, 20 bp, Artificial Sequence
  chemically synthesized
tttcaccataagttttaatt

SEQ ID NO: 432231 - DNA, 20 bp, Artificial Sequence
  chemically synthesized
tactcctaaattaaaactta

SEQ ID NO: 432232 - DNA, 20 bp, Artificial Sequence
  chemically synthesized
atgctgtattatttcaccat

SEQ ID NO: 432233 - DNA, 20 bp, Artificial Sequence
  chemically synthesized
aaacttatggtgaaataata

SEQ ID NO: 432234 - DNA, 20 bp, Artificial Sequence
  chemically synthesized
acagcataattttctacata

SEQ ID NO: 432235 - DNA, 20 bp, Artificial Sequence
  chemically synthesized
ttactgaattcatccgtatg

SEQ ID NO: 432236 - DNA, 20 bp, Artificial Sequence
  chemically synthesized
tttctacatacggatgaatt

SEQ ID NO: 432237 - DNA, 20 bp, Artificial Sequence
  chemically synthesized
tacatacggatgaattcagt

SEQ ID NO: 432238 - DNA, 20 bp, Artificial Sequence
  chemically synthesized
acatacggatgaattcagta

SEQ ID NO: 432239 - DNA, 20 bp, Artificial Sequence
  chemically synthesized
atacggatgaattcagtaag

SEQ ID NO: 432240 - DNA, 20 bp, Artificial Sequence
  chemically synthesized
gctttcaatttttagaaatt

SEQ ID NO: 432241 - DNA, 20 bp, Artificial Sequence
  chemically synthesized
aactttgcgctttcaatttt

SEQ ID NO: 432242 - DNA, 20 bp, Artificial Sequence
  chemically synthesized
acttaatttctaaaaattga

SEQ ID NO: 432243 - DNA, 20 bp, Artificial Sequence
  chemically synthesized
ttctaaaaattgaaagcgca

SEQ ID NO: 432244 - DNA, 20 bp, Artificial Sequence
  chemically synthesized
caaagttattttgatttgta

SEQ ID NO: 432245 - DNA, 20 bp, Artificial Sequence
  chemically synthesized
attttgatttgtaaagtttt

SEQ ID NO: 432246 - DNA, 20 bp, Artificial Sequence
  chemically synthesized
aagtcactgatatttaatag

SEQ ID NO: 432247 - DNA, 20 bp, Artificial Sequence
  chemically synthesized
aaagtcactgatatttaata

SEQ ID NO: 432248 - DNA, 20 bp, Artificial Sequence
  chemically synthesized
gcaaagtcactgatatttaa

SEQ ID NO: 432249 - DNA, 20 bp, Artificial Sequence
  chemically synthesized
atcattcctctattaaatat

SEQ ID NO: 432250 - DNA, 20 bp, Artificial Sequence
  chemically synthesized
acctgaaaaagtagtaagca

SEQ ID NO: 432251 - DNA, 20 bp, Artificial Sequence
  chemically synthesized
acaatacctgaaaaagtagt

SEQ ID NO: 432252 - DNA, 20 bp, Artificial Sequence
  chemically synthesized
gactttgcttactacttttt

SEQ ID NO: 432253 - DNA, 20 bp, Artificial Sequence
  chemically synthesized
actttgcttactactttttc

SEQ ID NO: 432254 - DNA, 20 bp, Artificial Sequence
  chemically synthesized
ccccacaatacctgaaaaag

SEQ ID NO: 432255 - DNA, 20 bp, Artificial Sequence
  chemically synthesized
ataccccacaatacctgaaa

SEQ ID NO: 432256 - DNA, 20 bp, Artificial Sequence
  chemically synthesized
tactactttttcaggtattg

SEQ ID NO: 432257 - DNA, 20 bp, Artificial Sequence
  chemically synthesized
actactttttcaggtattgt

SEQ ID NO: 432258 - DNA, 20 bp, Artificial Sequence
  chemically synthesized
ctactttttcaggtattgtg

SEQ ID NO: 432259 - DNA, 20 bp, Artificial Sequence
  chemically synthesized
tgtggggtatgtatccaaaa

SEQ ID NO: 432260 - DNA, 20 bp, Artificial Sequence
  chemically synthesized
aatcaggtaacacacttttt

SEQ ID NO: 432261 - DNA, 20 bp, Artificial Sequence
  chemically synthesized
tagacataaatgcataaatc

SEQ ID NO: 432262 - DNA, 20 bp, Artificial Sequence
  chemically synthesized
atagacataaatgcataaat

SEQ ID NO: 432263 - DNA, 20 bp, Artificial Sequence
  chemically synthesized
agaagcaatgttttaaaaaa

SEQ ID NO: 432264 - DNA, 20 bp, Artificial Sequence
  chemically synthesized
aagaggagaaattatagaag

SEQ ID NO: 432265 - DNA, 20 bp, Artificial Sequence
  chemically synthesized
gaaaagaggagaaattatag

SEQ ID NO: 432266 - DNA, 20 bp, Artificial Sequence
  chemically synthesized
actgaaaagaggagaaatta

SEQ ID NO: 432267 - DNA, 20 bp, Artificial Sequence
  chemically synthesized
tctataatttctcctctttt

SEQ ID NO: 432268 - DNA, 20 bp, Artificial Sequence
  chemically synthesized
attctttgaactgaaaagag

SEQ ID NO: 432269 - DNA, 20 bp, Artificial Sequence
  chemically synthesized
ccattctttgaactgaaaag

SEQ ID NO: 432270 - DNA, 20 bp, Artificial Sequence
  chemically synthesized
tccattctttgaactgaaaa

SEQ ID NO: 432271 - DNA, 20 bp, Artificial Sequence
  chemically synthesized
attccattctttgaactgaa

SEQ ID NO: 432272 - DNA, 20 bp, Artificial Sequence
  chemically synthesized
tttctcctcttttcagttca

SEQ ID NO: 432273 - DNA, 20 bp, Artificial Sequence
  chemically synthesized
cctcttttcagttcaaagaa

SEQ ID NO: 432274 - DNA, 20 bp, Artificial Sequence
  chemically synthesized
tcagttcaaagaatggaata

SEQ ID NO: 432275 - DNA, 20 bp, Artificial Sequence
  chemically synthesized
aaagaatggaatatagtaca

SEQ ID NO: 432276 - DNA, 20 bp, Artificial Sequence
  chemically synthesized
cagccatgactttttgttca

SEQ ID NO: 432277 - DNA, 20 bp, Artificial Sequence
  chemically synthesized
tacaaagaaccttgaacaaa

SEQ ID NO: 432278 - DNA, 20 bp, Artificial Sequence
  chemically synthesized
ccagccatgactttttgttc

SEQ ID NO: 432279 - DNA, 20 bp, Artificial Sequence
  chemically synthesized
gaaccttgaacaaaaagtca

SEQ ID NO: 432280 - DNA, 20 bp, Artificial Sequence
  chemically synthesized
cttgaacaaaaagtcatggc

SEQ ID NO: 432281 - DNA, 20 bp, Artificial Sequence
  chemically synthesized
ttgaacaaaaagtcatggct

SEQ ID NO: 432282 - DNA, 20 bp, Artificial Sequence
  chemically synthesized
gtatattcagaaataaagcc

SEQ ID NO: 432283 - DNA, 20 bp, Artificial Sequence
  chemically synthesized
tgtatgtatattcagaaata

SEQ ID NO: 432284 - DNA, 20 bp, Artificial Sequence
  chemically synthesized
tatatgtatgtatgtatatt

SEQ ID NO: 432285 - DNA, 20 bp, Artificial Sequence
  chemically synthesized
atatatatattttttttcct

SEQ ID NO: 432286 - DNA, 20 bp, Artificial Sequence
  chemically synthesized
cactcaatgaatacacactg

SEQ ID NO: 432287 - DNA, 20 bp, Artificial Sequence
  chemically synthesized
tcactcaatgaatacacact

SEQ ID NO: 432288 - DNA, 20 bp, Artificial Sequence
  chemically synthesized
ttcctcagtgtgtattcatt

SEQ ID NO: 432289 - DNA, 20 bp, Artificial Sequence
  chemically synthesized
ttcattgagtgaacctgaat

SEQ ID NO: 432290 - DNA, 20 bp, Artificial Sequence
  chemically synthesized
acagtttaaattgctcattc

SEQ ID NO: 432291 - DNA, 20 bp, Artificial Sequence
  chemically synthesized
gacagtttaaattgctcatt

SEQ ID NO: 432292 - DNA, 20 bp, Artificial Sequence
  chemically synthesized
aatgagcaatttaaactgtc

SEQ ID NO: 432293 - DNA, 20 bp, Artificial Sequence
  chemically synthesized
atgagcaatttaaactgtct

SEQ ID NO: 432294 - DNA, 20 bp, Artificial Sequence
  chemically synthesized
ctagtaaaaggcagcctaga

SEQ ID NO: 432295 - DNA, 20 bp, Artificial Sequence
  chemically synthesized
tagactagtaaaaggcagcc

SEQ ID NO: 432296 - DNA, 20 bp, Artificial Sequence
  chemically synthesized
tttgatagactagtaaaagg

SEQ ID NO: 432297 - DNA, 20 bp, Artificial Sequence
  chemically synthesized
ctgtctaggctgccttttac

SEQ ID NO: 432298 - DNA, 20 bp, Artificial Sequence
  chemically synthesized
ttatttgatagactagtaaa

SEQ ID NO: 432299 - DNA, 20 bp, Artificial Sequence
  chemically synthesized
tttatttgatagactagtaa

SEQ ID NO: 432300 - DNA, 20 bp, Artificial Sequence
  chemically synthesized
aattcttttatttgatagac

SEQ ID NO: 432301 - DNA, 20 bp, Artificial Sequence
  chemically synthesized
aaattaattcttttatttga

SEQ ID NO: 432302 - DNA, 20 bp, Artificial Sequence
  chemically synthesized
tttactagtctatcaaataa

SEQ ID NO: 432303 - DNA, 20 bp, Artificial Sequence
  chemically synthesized
gccttctagatttatttgag

SEQ ID NO: 432304 - DNA, 20 bp, Artificial Sequence
  chemically synthesized
atagccttctagatttattt

SEQ ID NO: 432305 - DNA, 20 bp, Artificial Sequence
  chemically synthesized
aatttctactcaaataaatc

SEQ ID NO: 432306 - DNA, 20 bp, Artificial Sequence
  chemically synthesized
ttctactcaaataaatctag

SEQ ID NO: 432307 - DNA, 20 bp, Artificial Sequence
  chemically synthesized
tctactcaaataaatctaga

SEQ ID NO: 432308 - DNA, 20 bp, Artificial Sequence
  chemically synthesized
atatcccattaatagccttc

SEQ ID NO: 432309 - DNA, 20 bp, Artificial Sequence
  chemically synthesized
taaatctagaaggctattaa

SEQ ID NO: 432310 - DNA, 20 bp, Artificial Sequence
  chemically synthesized
aaatctagaaggctattaat

SEQ ID NO: 432311 - DNA, 20 bp, Artificial Sequence
  chemically synthesized
atgtgttaatatcccattaa

SEQ ID NO: 432312 - DNA, 20 bp, Artificial Sequence
  chemically synthesized
tgggatattaacacatttaa

SEQ ID NO: 432313 - DNA, 20 bp, Artificial Sequence
  chemically synthesized
gatattaacacatttaaaag

SEQ ID NO: 432314 - DNA, 20 bp, Artificial Sequence
  chemically synthesized
acacatttaaaagtggttta

SEQ ID NO: 432315 - DNA, 20 bp, Artificial Sequence
  chemically synthesized
catttaaaagtggtttaaag

SEQ ID NO: 432316 - DNA, 20 bp, Artificial Sequence
  chemically synthesized
aaagtggtttaaagtagaaa

SEQ ID NO: 432317 - DNA, 20 bp, Artificial Sequence
  chemically synthesized
aaatcagtgatacatatcga

SEQ ID NO: 432318 - DNA, 20 bp, Artificial Sequence
  chemically synthesized
tgtggaatggataagcaaat

SEQ ID NO: 432319 - DNA, 20 bp, Artificial Sequence
  chemically synthesized
acttaatttgtggaatggat

SEQ ID NO: 432320 - DNA, 20 bp, Artificial Sequence
  chemically synthesized
taggtacttaatttgtggaa

SEQ ID NO: 432321 - DNA, 20 bp, Artificial Sequence
  chemically synthesized
gcttatccattccacaaatt

SEQ ID NO: 432322 - DNA, 20 bp, Artificial Sequence
  chemically synthesized
catagtaggtacttaatttg

SEQ ID NO: 432323 - DNA, 20 bp, Artificial Sequence
  chemically synthesized
cacaaattaagtacctacta

SEQ ID NO: 432324 - DNA, 20 bp, Artificial Sequence
  chemically synthesized
caaattaagtacctactatg

SEQ ID NO: 432325 - DNA, 20 bp, Artificial Sequence
  chemically synthesized
gacagcatctgctccatagt

SEQ ID NO: 432326 - DNA, 20 bp, Artificial Sequence
  chemically synthesized
agacagcatctgctccatag

SEQ ID NO: 432327 - DNA, 20 bp, Artificial Sequence
  chemically synthesized
attaagtacctactatggag

SEQ ID NO: 432328 - DNA, 20 bp, Artificial Sequence
  chemically synthesized
ccaagacagcatctgctcca

SEQ ID NO: 432329 - DNA, 20 bp, Artificial Sequence
  chemically synthesized
ctatggagcagatgctgtct

SEQ ID NO: 432330 - DNA, 20 bp, Artificial Sequence
  chemically synthesized
atgttgtcccagaaccaaga

SEQ ID NO: 432331 - DNA, 20 bp, Artificial Sequence
  chemically synthesized
agcagatgctgtcttggttc

SEQ ID NO: 432332 - DNA, 20 bp, Artificial Sequence
  chemically synthesized
gcagatgctgtcttggttct

SEQ ID NO: 432333 - DNA, 20 bp, Artificial Sequence
  chemically synthesized
atagatgttgtcccagaacc

SEQ ID NO: 432334 - DNA, 20 bp, Artificial Sequence
  chemically synthesized
gtcattcatagatgttgtcc

SEQ ID NO: 432335 - DNA, 20 bp, Artificial Sequence
  chemically synthesized
gacaatttcagtgtcattca

SEQ ID NO: 432336 - DNA, 20 bp, Artificial Sequence
  chemically synthesized
taggagagcagggacaattt

SEQ ID NO: 432337 - DNA, 20 bp, Artificial Sequence
  chemically synthesized
caatacctgataggagagca

SEQ ID NO: 432338 - DNA, 20 bp, Artificial Sequence
  chemically synthesized
ccaatacctgataggagagc

SEQ ID NO: 432339 - DNA, 20 bp, Artificial Sequence
  chemically synthesized
accaatacctgataggagag

SEQ ID NO: 432340 - DNA, 20 bp, Artificial Sequence
  chemically synthesized
aattgtccctgctctcctat

SEQ ID NO: 432341 - DNA, 20 bp, Artificial Sequence
  chemically synthesized
attgtccctgctctcctatc

SEQ ID NO: 432342 - DNA, 20 bp, Artificial Sequence
  chemically synthesized
aataccaatacctgatagga

SEQ ID NO: 432343 - DNA, 20 bp, Artificial Sequence
  chemically synthesized
ataataccaatacctgatag

SEQ ID NO: 432344 - DNA, 20 bp, Artificial Sequence
  chemically synthesized
taataataccaatacctgat

SEQ ID NO: 432345 - DNA, 20 bp, Artificial Sequence
  chemically synthesized
ttaataataccaatacctga

SEQ ID NO: 432346 - DNA, 20 bp, Artificial Sequence
  chemically synthesized
cctgctctcctatcaggtat

SEQ ID NO: 432347 - DNA, 20 bp, Artificial Sequence
  chemically synthesized
aggacttctcagaaatacgt

SEQ ID NO: 432348 - DNA, 20 bp, Artificial Sequence
  chemically synthesized
ttaaaaactgacgtatttct

SEQ ID NO: 432349 - DNA, 20 bp, Artificial Sequence
  chemically synthesized
aaaactgacgtatttctgag

SEQ ID NO: 432350 - DNA, 20 bp, Artificial Sequence
  chemically synthesized
aaagaattctcaggacttct

SEQ ID NO: 432351 - DNA, 20 bp, Artificial Sequence
  chemically synthesized
acgtatttctgagaagtcct

SEQ ID NO: 432352 - DNA, 20 bp, Artificial Sequence
  chemically synthesized
ctactacagaaagaattctc

SEQ ID NO: 432353 - DNA, 20 bp, Artificial Sequence
  chemically synthesized
cctactacagaaagaattct

SEQ ID NO: 432354 - DNA, 20 bp, Artificial Sequence
  chemically synthesized
agtcctgagaattctttctg

SEQ ID NO: 432355 - DNA, 20 bp, Artificial Sequence
  chemically synthesized
cctgagaattctttctgtag

SEQ ID NO: 432356 - DNA, 20 bp, Artificial Sequence
  chemically synthesized
gcgttgtttcctactacaga

SEQ ID NO: 432357 - DNA, 20 bp, Artificial Sequence
  chemically synthesized
ctgagaattctttctgtagt

SEQ ID NO: 432358 - DNA, 20 bp, Artificial Sequence
  chemically synthesized
tcaagcgttgtttcctacta

SEQ ID NO: 432359 - DNA, 20 bp, Artificial Sequence
  chemically synthesized
ttcttcagcagaaattattc

SEQ ID NO: 432360 - DNA, 20 bp, Artificial Sequence
  chemically synthesized
cgcttgaataatttctgctg

SEQ ID NO: 432361 - DNA, 20 bp, Artificial Sequence
  chemically synthesized
tgtttttaaatgttcttcag

SEQ ID NO: 432362 - DNA, 20 bp, Artificial Sequence
  chemically synthesized
ctgtgtttttaaatgttctt

SEQ ID NO: 432363 - DNA, 20 bp, Artificial Sequence
  chemically synthesized
ctgaagaacatttaaaaaca

SEQ ID NO: 432364 - DNA, 20 bp, Artificial Sequence
  chemically synthesized
atttaaaaacacagttatga

SEQ ID NO: 432365 - DNA, 20 bp, Artificial Sequence
  chemically synthesized
aaaaacacagttatgaaagc

SEQ ID NO: 432366 - DNA, 20 bp, Artificial Sequence
  chemically synthesized
aaacacagttatgaaagctg

SEQ ID NO: 432367 - DNA, 20 bp, Artificial Sequence
  chemically synthesized
acacagttatgaaagctgga

SEQ ID NO: 432368 - DNA, 20 bp, Artificial Sequence
  chemically synthesized
caataatatggattactctc

SEQ ID NO: 432369 - DNA, 20 bp, Artificial Sequence
  chemically synthesized
ctgaagcaaggacaataata

SEQ ID NO: 432370 - DNA, 20 bp, Artificial Sequence
  chemically synthesized
ccatattattgtccttgctt

SEQ ID NO: 432371 - DNA, 20 bp, Artificial Sequence
  chemically synthesized
tagaaaaataaactgaagca

SEQ ID NO: 432372 - DNA, 20 bp, Artificial Sequence
  chemically synthesized
atagaaaaataaactgaagc

SEQ ID NO: 432373 - DNA, 20 bp, Artificial Sequence
  chemically synthesized
aataatagaaaaataaactg

SEQ ID NO: 432374 - DNA, 20 bp, Artificial Sequence
  chemically synthesized
taaaatgcataaaataataa

SEQ ID NO: 432375 - DNA, 20 bp, Artificial Sequence
  chemically synthesized
ttattttatgcattttaatg

SEQ ID NO: 432376 - DNA, 20 bp, Artificial Sequence
  chemically synthesized
tattttatgcattttaatgt

SEQ ID NO: 432377 - DNA, 20 bp, Artificial Sequence
  chemically synthesized
agaaagacctaaatcgaagt

SEQ ID NO: 432378 - DNA, 20 bp, Artificial Sequence
  chemically synthesized
taggtaaactaacttcgatt

SEQ ID NO: 432379 - DNA, 20 bp, Artificial Sequence
  chemically synthesized
aggtaaactaacttcgattt

SEQ ID NO: 432380 - DNA, 20 bp, Artificial Sequence
  chemically synthesized
aaggagaaagacctaaatcg

SEQ ID NO: 432381 - DNA, 20 bp, Artificial Sequence
  chemically synthesized
cctgaagttgtgcaaggaga

SEQ ID NO: 432382 - DNA, 20 bp, Artificial Sequence
  chemically synthesized
cctccctgaagttgtgcaag

SEQ ID NO: 432383 - DNA, 20 bp, Artificial Sequence
  chemically synthesized
gtcctccctgaagttgtgca

SEQ ID NO: 432384 - DNA, 20 bp, Artificial Sequence
  chemically synthesized
agtcctccctgaagttgtgc

SEQ ID NO: 432385 - DNA, 20 bp, Artificial Sequence
  chemically synthesized
tctttctccttgcacaactt

SEQ ID NO: 432386 - DNA, 20 bp, Artificial Sequence
  chemically synthesized
ctttctccttgcacaacttc

SEQ ID NO: 432387 - DNA, 20 bp, Artificial Sequence
  chemically synthesized
tttctccttgcacaacttca

SEQ ID NO: 432388 - DNA, 20 bp, Artificial Sequence
  chemically synthesized
tctccttgcacaacttcagg

SEQ ID NO: 432389 - DNA, 20 bp, Artificial Sequence
  chemically synthesized
ctccttgcacaacttcaggg

SEQ ID NO: 432390 - DNA, 20 bp, Artificial Sequence
  chemically synthesized
tctatgaacagtcctccctg

SEQ ID NO: 432391 - DNA, 20 bp, Artificial Sequence
  chemically synthesized
acttcagggaggactgttca

SEQ ID NO: 432392 - DNA, 20 bp, Artificial Sequence
  chemically synthesized
caagttatattttctatgaa

SEQ ID NO: 432393 - DNA, 20 bp, Artificial Sequence
  chemically synthesized
aattcaaggacacaattttc

SEQ ID NO: 432394 - DNA, 20 bp, Artificial Sequence
  chemically synthesized
ccatttagtgcataaattca

SEQ ID NO: 432395 - DNA, 20 bp, Artificial Sequence
  chemically synthesized
accatttagtgcataaattc

SEQ ID NO: 432396 - DNA, 20 bp, Artificial Sequence
  chemically synthesized
ccttgaatttatgcactaaa

SEQ ID NO: 432397 - DNA, 20 bp, Artificial Sequence
  chemically synthesized
tgaattgaagcagtaccatt

SEQ ID NO: 432398 - DNA, 20 bp, Artificial Sequence
  chemically synthesized
ttgaagaatatgaattgaag

SEQ ID NO: 432399 - DNA, 20 bp, Artificial Sequence
  chemically synthesized
gaattgaagaatatgaattg

SEQ ID NO: 432400 - DNA, 20 bp, Artificial Sequence
  chemically synthesized
aataattactagtcgaattg

SEQ ID NO: 432401 - DNA, 20 bp, Artificial Sequence
  chemically synthesized
ttcatattcttcaattcgac

SEQ ID NO: 432402 - DNA, 20 bp, Artificial Sequence
  chemically synthesized
aaaatctttcaaataattac

SEQ ID NO: 432403 - DNA, 20 bp, Artificial Sequence
  chemically synthesized
ttcgactagtaattatttga

SEQ ID NO: 432404 - DNA, 20 bp, Artificial Sequence
  chemically synthesized
ctaatttctttcaaattata

SEQ ID NO: 432405 - DNA, 20 bp, Artificial Sequence
  chemically synthesized
tttttaactttataatttga

SEQ ID NO: 432406 - DNA, 20 bp, Artificial Sequence
  chemically synthesized
ctttataatttgaaagaaat

SEQ ID NO: 432407 - DNA, 20 bp, Artificial Sequence
  chemically synthesized
aagaaattagacttatatga

SEQ ID NO: 432408 - DNA, 20 bp, Artificial Sequence
  chemically synthesized
aatttttacaactttcatat

SEQ ID NO: 432409 - DNA, 20 bp, Artificial Sequence
  chemically synthesized
attctgggtgaaggatacat

SEQ ID NO: 432410 - DNA, 20 bp, Artificial Sequence
  chemically synthesized
attctaatgtatccttcacc

SEQ ID NO: 432411 - DNA, 20 bp, Artificial Sequence
  chemically synthesized
taaaaaaaaattctgggtga

SEQ ID NO: 432412 - DNA, 20 bp, Artificial Sequence
  chemically synthesized
gtaaaaaaaaattctgggtg

SEQ ID NO: 432413 - DNA, 20 bp, Artificial Sequence
  chemically synthesized
ataaagtaaaaaaaaattct

SEQ ID NO: 432414 - DNA, 20 bp, Artificial Sequence
  chemically synthesized
gataaagtaaaaaaaaattc

SEQ ID NO: 432415 - DNA, 20 bp, Artificial Sequence
  chemically synthesized
aagaaattatatttaagata

SEQ ID NO: 432416 - DNA, 20 bp, Artificial Sequence
  chemically synthesized
gacaaaaagaaattatattt

SEQ ID NO: 432417 - DNA, 20 bp, Artificial Sequence
  chemically synthesized
gactctaaaatacagacaaa

SEQ ID NO: 432418 - DNA, 20 bp, Artificial Sequence
  chemically synthesized
atttctttttgtctgtattt

SEQ ID NO: 432419 - DNA, 20 bp, Artificial Sequence
  chemically synthesized
ttctttttgtctgtatttta

SEQ ID NO: 432420 - DNA, 20 bp, Artificial Sequence
  chemically synthesized
tagaaattgactctaaaata

SEQ ID NO: 432421 - DNA, 20 bp, Artificial Sequence
  chemically synthesized
ttttagagtcaatttctact

SEQ ID NO: 432422 - DNA, 20 bp, Artificial Sequence
  chemically synthesized
tagagtcaatttctactcag

SEQ ID NO: 432423 - DNA, 20 bp, Artificial Sequence
  chemically synthesized
tatatacttgttcttctgag

SEQ ID NO: 432424 - DNA, 20 bp, Artificial Sequence
  chemically synthesized
cattatatacttgttcttct

SEQ ID NO: 432425 - DNA, 20 bp, Artificial Sequence
  chemically synthesized
caatttctactcagaagaac

SEQ ID NO: 432426 - DNA, 20 bp, Artificial Sequence
  chemically synthesized
ctgtgccacacacattttaa

SEQ ID NO: 432427 - DNA, 20 bp, Artificial Sequence
  chemically synthesized
aaaaactgttaaaatgtgtg

SEQ ID NO: 432428 - DNA, 20 bp, Artificial Sequence
  chemically synthesized
ctgttaaaatgtgtgtggca

SEQ ID NO: 432429 - DNA, 20 bp, Artificial Sequence
  chemically synthesized
tggcacagaaaaatgatttt

SEQ ID NO: 432430 - DNA, 20 bp, Artificial Sequence
  chemically synthesized
gcacagaaaaatgattttga

SEQ ID NO: 432431 - DNA, 20 bp, Artificial Sequence
  chemically synthesized
tgattttgagagtaaaattt

SEQ ID NO: 432432 - DNA, 20 bp, Artificial Sequence
  chemically synthesized
ttgagagtaaaatttgagca

SEQ ID NO: 432433 - DNA, 20 bp, Artificial Sequence
  chemically synthesized
agtaaaatttgagcatggaa

SEQ ID NO: 432434 - DNA, 20 bp, Artificial Sequence
  chemically synthesized
aaaatttgagcatggaaaag

SEQ ID NO: 432435 - DNA, 20 bp, Artificial Sequence
  chemically synthesized
tgaatataagtataataatt

SEQ ID NO: 432436 - DNA, 20 bp, Artificial Sequence
  chemically synthesized
taattattatacttatattc

SEQ ID NO: 432437 - DNA, 20 bp, Artificial Sequence
  chemically synthesized
ggtcccctgtgcttgaatat

SEQ ID NO: 432438 - DNA, 20 bp, Artificial Sequence
  chemically synthesized
attatacttatattcaagca

SEQ ID NO: 432439 - DNA, 20 bp, Artificial Sequence
  chemically synthesized
ttatacttatattcaagcac

SEQ ID NO: 432440 - DNA, 20 bp, Artificial Sequence
  chemically synthesized
tatacttatattcaagcaca

SEQ ID NO: 432441 - DNA, 20 bp, Artificial Sequence
  chemically synthesized
atacttatattcaagcacag

SEQ ID NO: 432442 - DNA, 20 bp, Artificial Sequence
  chemically synthesized
gatattgctgagaaaagttt

SEQ ID NO: 432443 - DNA, 20 bp, Artificial Sequence
  chemically synthesized
caggggaccaaaacttttct

SEQ ID NO: 432444 - DNA, 20 bp, Artificial Sequence
  chemically synthesized
agacatgatattgctgagaa

SEQ ID NO: 432445 - DNA, 20 bp, Artificial Sequence
  chemically synthesized
ttactagacatgatattgct

SEQ ID NO: 432446 - DNA, 20 bp, Artificial Sequence
  chemically synthesized
tttctcagcaatatcatgtc

SEQ ID NO: 432447 - DNA, 20 bp, Artificial Sequence
  chemically synthesized
tcagcaatatcatgtctagt

SEQ ID NO: 432448 - DNA, 20 bp, Artificial Sequence
  chemically synthesized
agcaatatcatgtctagtaa

SEQ ID NO: 432449 - DNA, 20 bp, Artificial Sequence
  chemically synthesized
aatatcatgtctagtaagag

SEQ ID NO: 432450 - DNA, 20 bp, Artificial Sequence
  chemically synthesized
atattttcctctgctcttac

SEQ ID NO: 432451 - DNA, 20 bp, Artificial Sequence
  chemically synthesized
tatcatgtctagtaagagca

SEQ ID NO: 432452 - DNA, 20 bp, Artificial Sequence
  chemically synthesized
atcatgtctagtaagagcag

SEQ ID NO: 432453 - DNA, 20 bp, Artificial Sequence
  chemically synthesized
gagcagaggaaaatatttaa

SEQ ID NO: 432454 - DNA, 20 bp, Artificial Sequence
  chemically synthesized
gaggaaaatatttaaaagct

SEQ ID NO: 432455 - DNA, 20 bp, Artificial Sequence
  chemically synthesized
aatatttaaaagcttggact

SEQ ID NO: 432456 - DNA, 20 bp, Artificial Sequence
  chemically synthesized
atatttaaaagcttggactt

SEQ ID NO: 432457 - DNA, 20 bp, Artificial Sequence
  chemically synthesized
gccattttgttcccaagtcc

SEQ ID NO: 432458 - DNA, 20 bp, Artificial Sequence
  chemically synthesized
ctctgggccattttgttccc

SEQ ID NO: 432459 - DNA, 20 bp, Artificial Sequence
  chemically synthesized
gcttggacttgggaacaaaa

SEQ ID NO: 432460 - DNA, 20 bp, Artificial Sequence
  chemically synthesized
gacttgggaacaaaatggcc

SEQ ID NO: 432461 - DNA, 20 bp, Artificial Sequence
  chemically synthesized
cttgggaacaaaatggccca

SEQ ID NO: 432462 - DNA, 20 bp, Artificial Sequence
  chemically synthesized
ggtaaatgggaagtgactct

SEQ ID NO: 432463 - DNA, 20 bp, Artificial Sequence
  chemically synthesized
tggtaaatgggaagtgactc

SEQ ID NO: 432464 - DNA, 20 bp, Artificial Sequence
  chemically synthesized
attcataagtggtaaatggg

SEQ ID NO: 432465 - DNA, 20 bp, Artificial Sequence
  chemically synthesized
accattcataagtggtaaat

SEQ ID NO: 432466 - DNA, 20 bp, Artificial Sequence
  chemically synthesized
caccattcataagtggtaaa

SEQ ID NO: 432467 - DNA, 20 bp, Artificial Sequence
  chemically synthesized
aaggccacaccattcataag

SEQ ID NO: 432468 - DNA, 20 bp, Artificial Sequence
  chemically synthesized
tcccatttaccacttatgaa

SEQ ID NO: 432469 - DNA, 20 bp, Artificial Sequence
  chemically synthesized
ctgaaggccacaccattcat

SEQ ID NO: 432470 - DNA, 20 bp, Artificial Sequence
  chemically synthesized
tttaccacttatgaatggtg

SEQ ID NO: 432471 - DNA, 20 bp, Artificial Sequence
  chemically synthesized
cttatgaatggtgtggcctt

SEQ ID NO: 432472 - DNA, 20 bp, Artificial Sequence
  chemically synthesized
atggttaatgagcatgctga

SEQ ID NO: 432473 - DNA, 20 bp, Artificial Sequence
  chemically synthesized
aatggttaatgagcatgctg

SEQ ID NO: 432474 - DNA, 20 bp, Artificial Sequence
  chemically synthesized
taagacactgaatggttaat

SEQ ID NO: 432475 - DNA, 20 bp, Artificial Sequence
  chemically synthesized
cagcatgctcattaaccatt

SEQ ID NO: 432476 - DNA, 20 bp, Artificial Sequence
  chemically synthesized
aaggaatttaagacactgaa

SEQ ID NO: 432477 - DNA, 20 bp, Artificial Sequence
  chemically synthesized
tctttacacaaaaggaattt

SEQ ID NO: 432478 - DNA, 20 bp, Artificial Sequence
  chemically synthesized
atattctctctttacacaaa

SEQ ID NO: 432479 - DNA, 20 bp, Artificial Sequence
  chemically synthesized
tcttaaattccttttgtgta

SEQ ID NO: 432480 - DNA, 20 bp, Artificial Sequence
  chemically synthesized
aatattctctctttacacaa

SEQ ID NO: 432481 - DNA, 20 bp, Artificial Sequence
  chemically synthesized
ttaaattccttttgtgtaaa

SEQ ID NO: 432482 - DNA, 20 bp, Artificial Sequence
  chemically synthesized
aaattccttttgtgtaaaga

SEQ ID NO: 432483 - DNA, 20 bp, Artificial Sequence
  chemically synthesized
atattatcatatatcattta

SEQ ID NO: 432484 - DNA, 20 bp, Artificial Sequence
  chemically synthesized
tattatcatatatcatttaa

SEQ ID NO: 432485 - DNA, 20 bp, Artificial Sequence
  chemically synthesized
tatcatttaaaggctttata

SEQ ID NO: 432486 - DNA, 20 bp, Artificial Sequence
  chemically synthesized
taactcatttaatctttata

SEQ ID NO: 432487 - DNA, 20 bp, Artificial Sequence
  chemically synthesized
aggctttataaagattaaat

SEQ ID NO: 432488 - DNA, 20 bp, Artificial Sequence
  chemically synthesized
taaatgagttaatatttata

SEQ ID NO: 432489 - DNA, 20 bp, Artificial Sequence
  chemically synthesized
gttaatatttataaagtgct

SEQ ID NO: 432490 - DNA, 20 bp, Artificial Sequence
  chemically synthesized
gtgtgccagacattttttct

SEQ ID NO: 432491 - DNA, 20 bp, Artificial Sequence
  chemically synthesized
aagtgcttagaaaaaatgtc

SEQ ID NO: 432492 - DNA, 20 bp, Artificial Sequence
  chemically synthesized
tagaaaaaatgtctggcaca

SEQ ID NO: 432493 - DNA, 20 bp, Artificial Sequence
  chemically synthesized
taatggtgcttactgtgtgc

SEQ ID NO: 432494 - DNA, 20 bp, Artificial Sequence
  chemically synthesized
aaaaatgtctggcacacagt

SEQ ID NO: 432495 - DNA, 20 bp, Artificial Sequence
  chemically synthesized
cacacagtaagcaccattaa

SEQ ID NO: 432496 - DNA, 20 bp, Artificial Sequence
  chemically synthesized
tacttttatcaagccattaa

SEQ ID NO: 432497 - DNA, 20 bp, Artificial Sequence
  chemically synthesized
caccattaatggcttgataa

SEQ ID NO: 432498 - DNA, 20 bp, Artificial Sequence
  chemically synthesized
cctgtcaaattacttttatc

SEQ ID NO: 432499 - DNA, 20 bp, Artificial Sequence
  chemically synthesized
gcttgataaaagtaatttga

SEQ ID NO: 432500 - DNA, 20 bp, Artificial Sequence
  chemically synthesized
cttgataaaagtaatttgac

SEQ ID NO: 432501 - DNA, 20 bp, Artificial Sequence
  chemically synthesized
taatttgacaggtaaaccaa

SEQ ID NO: 432502 - DNA, 20 bp, Artificial Sequence
  chemically synthesized
caaaatagaaagagtactgt

SEQ ID NO: 432503 - DNA, 20 bp, Artificial Sequence
  chemically synthesized
ttgacattacaaaatagaaa

SEQ ID NO: 432504 - DNA, 20 bp, Artificial Sequence
  chemically synthesized
atttgacattacaaaataga

SEQ ID NO: 432505 - DNA, 20 bp, Artificial Sequence
  chemically synthesized
catgatttgacattacaaaa

SEQ ID NO: 432506 - DNA, 20 bp, Artificial Sequence
  chemically synthesized
tattttgtaatgtcaaatca

SEQ ID NO: 432507 - DNA, 20 bp, Artificial Sequence
  chemically synthesized
tttatctcagagttcaagtg

SEQ ID NO: 432508 - DNA, 20 bp, Artificial Sequence
  chemically synthesized
catggctacacttgaactct

SEQ ID NO: 432509 - DNA, 20 bp, Artificial Sequence
  chemically synthesized
ttctctttatctcagagttc

SEQ ID NO: 432510 - DNA, 20 bp, Artificial Sequence
  chemically synthesized
tacacttgaactctgagata

SEQ ID NO: 432511 - DNA, 20 bp, Artificial Sequence
  chemically synthesized
caatctttctctttatctca

SEQ ID NO: 432512 - DNA, 20 bp, Artificial Sequence
  chemically synthesized
cacttgaactctgagataaa

SEQ ID NO: 432513 - DNA, 20 bp, Artificial Sequence
  chemically synthesized
cccaatctttctctttatct

SEQ ID NO: 432514 - DNA, 20 bp, Artificial Sequence
  chemically synthesized
tgaactctgagataaagaga

SEQ ID NO: 432515 - DNA, 20 bp, Artificial Sequence
  chemically synthesized
tctgagataaagagaaagat

SEQ ID NO: 432516 - DNA, 20 bp, Artificial Sequence
  chemically synthesized
ctgagataaagagaaagatt

SEQ ID NO: 432517 - DNA, 20 bp, Artificial Sequence
  chemically synthesized
tgagataaagagaaagattg

SEQ ID NO: 432518 - DNA, 20 bp, Artificial Sequence
  chemically synthesized
gagataaagagaaagattgg

SEQ ID NO: 432519 - DNA, 20 bp, Artificial Sequence
  chemically synthesized
aaagagaaagattgggggca

SEQ ID NO: 432520 - DNA, 20 bp, Artificial Sequence
  chemically synthesized
gagaaagattgggggcatgg

SEQ ID NO: 432521 - DNA, 20 bp, Artificial Sequence
  chemically synthesized
gaaagattgggggcatggaa

SEQ ID NO: 432522 - DNA, 20 bp, Artificial Sequence
  chemically synthesized
agattgggggcatggaagag

SEQ ID NO: 432523 - DNA, 20 bp, Artificial Sequence
  chemically synthesized
tgtttgtgtgtgtatatatt

SEQ ID NO: 432524 - DNA, 20 bp, Artificial Sequence
  chemically synthesized
gtttgtgtgtgtatatattt

SEQ ID NO: 432525 - DNA, 20 bp, Artificial Sequence
  chemically synthesized
ggtgttaaaatattttatct

SEQ ID NO: 432526 - DNA, 20 bp, Artificial Sequence
  chemically synthesized
aaatattttatctaagtttc

SEQ ID NO: 432527 - DNA, 20 bp, Artificial Sequence
  chemically synthesized
tgtgcagaattccggaaact

SEQ ID NO: 432528 - DNA, 20 bp, Artificial Sequence
  chemically synthesized
cactacattgtgcagaattc

SEQ ID NO: 432529 - DNA, 20 bp, Artificial Sequence
  chemically synthesized
ttccggaattctgcacaatg

SEQ ID NO: 432530 - DNA, 20 bp, Artificial Sequence
  chemically synthesized
tttattttcactacattgtg

SEQ ID NO: 432531 - DNA, 20 bp, Artificial Sequence
  chemically synthesized
acaatgtagtgaaaataaat

SEQ ID NO: 432532 - DNA, 20 bp, Artificial Sequence
  chemically synthesized
aattggtaaaatcacgttta

SEQ ID NO: 432533 - DNA, 20 bp, Artificial Sequence
  chemically synthesized
aaaatcacgtttatggctaa

SEQ ID NO: 432534 - DNA, 20 bp, Artificial Sequence
  chemically synthesized
attgtatatatgtttgccat

SEQ ID NO: 432535 - DNA, 20 bp, Artificial Sequence
  chemically synthesized
tggcaaacatatatacaatg

SEQ ID NO: 432536 - DNA, 20 bp, Artificial Sequence
  chemically synthesized
gttcaacagtattttggaag

SEQ ID NO: 432537 - DNA, 20 bp, Artificial Sequence
  chemically synthesized
tttgttcaacagtattttgg

SEQ ID NO: 432538 - DNA, 20 bp, Artificial Sequence
  chemically synthesized
ttttttgttcaacagtattt

SEQ ID NO: 432539 - DNA, 20 bp, Artificial Sequence
  chemically synthesized
taaagttattttttgttcaa

SEQ ID NO: 432540 - DNA, 20 bp, Artificial Sequence
  chemically synthesized
taaaaaatatatagtaaata

SEQ ID NO: 432541 - DNA, 20 bp, Artificial Sequence
  chemically synthesized
ttctgatgttaaaaaatata

SEQ ID NO: 432542 - DNA, 20 bp, Artificial Sequence
  chemically synthesized
tactatatattttttaacat

SEQ ID NO: 432543 - DNA, 20 bp, Artificial Sequence
  chemically synthesized
atatattttttaacatcaga

SEQ ID NO: 432544 - DNA, 20 bp, Artificial Sequence
  chemically synthesized
tttaacatcagaaagaacgt

SEQ ID NO: 432545 - DNA, 20 bp, Artificial Sequence
  chemically synthesized
ttaacatcagaaagaacgtt

SEQ ID NO: 432546 - DNA, 20 bp, Artificial Sequence
  chemically synthesized
tcaagatttggcaggattgt

SEQ ID NO: 432547 - DNA, 20 bp, Artificial Sequence
  chemically synthesized
atcaagatttggcaggattg

SEQ ID NO: 432548 - DNA, 20 bp, Artificial Sequence
  chemically synthesized
ggtcaaaatcaagatttggc

SEQ ID NO: 432549 - DNA, 20 bp, Artificial Sequence
  chemically synthesized
aggtcaaaatcaagatttgg

SEQ ID NO: 432550 - DNA, 20 bp, Artificial Sequence
  chemically synthesized
tacaggtcaaaatcaagatt

SEQ ID NO: 432551 - DNA, 20 bp, Artificial Sequence
  chemically synthesized
gtaccatacaggtcaaaatc

SEQ ID NO: 432552 - DNA, 20 bp, Artificial Sequence
  chemically synthesized
aatcttgattttgacctgta

SEQ ID NO: 432553 - DNA, 20 bp, Artificial Sequence
  chemically synthesized
ctacaatcccagtaccatac

SEQ ID NO: 432554 - DNA, 20 bp, Artificial Sequence
  chemically synthesized
actacaatcccagtaccata

SEQ ID NO: 432555 - DNA, 20 bp, Artificial Sequence
  chemically synthesized
gattttgacctgtatggtac

SEQ ID NO: 432556 - DNA, 20 bp, Artificial Sequence
  chemically synthesized
attttgacctgtatggtact

SEQ ID NO: 432557 - DNA, 20 bp, Artificial Sequence
  chemically synthesized
cctgtatggtactgggattg

SEQ ID NO: 432558 - DNA, 20 bp, Artificial Sequence
  chemically synthesized
acctgagcccactacaatcc

SEQ ID NO: 432559 - DNA, 20 bp, Artificial Sequence
  chemically synthesized
gtatggtactgggattgtag

SEQ ID NO: 432560 - DNA, 20 bp, Artificial Sequence
  chemically synthesized
tatggtactgggattgtagt

SEQ ID NO: 432561 - DNA, 20 bp, Artificial Sequence
  chemically synthesized
tactgggattgtagtgggct

SEQ ID NO: 432562 - DNA, 20 bp, Artificial Sequence
  chemically synthesized
actgggattgtagtgggctc

SEQ ID NO: 432563 - DNA, 20 bp, Artificial Sequence
  chemically synthesized
caaaggtcaacaaaacacct

SEQ ID NO: 432564 - DNA, 20 bp, Artificial Sequence
  chemically synthesized
gagtatggctaataattcaa

SEQ ID NO: 432565 - DNA, 20 bp, Artificial Sequence
  chemically synthesized
agagtatggctaataattca

SEQ ID NO: 432566 - DNA, 20 bp, Artificial Sequence
  chemically synthesized
tttgttgacctttgaattat

SEQ ID NO: 432567 - DNA, 20 bp, Artificial Sequence
  chemically synthesized
caaaaacaactttcagagta

SEQ ID NO: 432568 - DNA, 20 bp, Artificial Sequence
  chemically synthesized
aattattagccatactctga

SEQ ID NO: 432569 - DNA, 20 bp, Artificial Sequence
  chemically synthesized
aatttcaaaaacaactttca

SEQ ID NO: 432570 - DNA, 20 bp, Artificial Sequence
  chemically synthesized
tcaatttcaaaaacaacttt

SEQ ID NO: 432571 - DNA, 20 bp, Artificial Sequence
  chemically synthesized
ttgtttttgaaattgaatcc

SEQ ID NO: 432572 - DNA, 20 bp, Artificial Sequence
  chemically synthesized
ctatatatcaggaattttct

SEQ ID NO: 432573 - DNA, 20 bp, Artificial Sequence
  chemically synthesized
gctatatatcaggaattttc

SEQ ID NO: 432574 - DNA, 20 bp, Artificial Sequence
  chemically synthesized
cctagaaaattcctgatata

SEQ ID NO: 432575 - DNA, 20 bp, Artificial Sequence
  chemically synthesized
aaaaaaaaaagctatatatc

SEQ ID NO: 432576 - DNA, 20 bp, Artificial Sequence
  chemically synthesized
caaaaaaaaaagctatatat

SEQ ID NO: 432577 - DNA, 20 bp, Artificial Sequence
  chemically synthesized
tgatatatagcttttttttt

SEQ ID NO: 432578 - DNA, 20 bp, Artificial Sequence
  chemically synthesized
atgcaagtttccaaaaaaaa

SEQ ID NO: 432579 - DNA, 20 bp, Artificial Sequence
  chemically synthesized
tttttttggaaacttgcatt

SEQ ID NO: 432580 - DNA, 20 bp, Artificial Sequence
  chemically synthesized
gacccaaattatctgaatgc

SEQ ID NO: 432581 - DNA, 20 bp, Artificial Sequence
  chemically synthesized
aaacttgcattcagataatt

SEQ ID NO: 432582 - DNA, 20 bp, Artificial Sequence
  chemically synthesized
aacttgcattcagataattt

SEQ ID NO: 432583 - DNA, 20 bp, Artificial Sequence
  chemically synthesized
attcagataatttgggtctt

SEQ ID NO: 432584 - DNA, 20 bp, Artificial Sequence
  chemically synthesized
ttcagataatttgggtctta

SEQ ID NO: 432585 - DNA, 20 bp, Artificial Sequence
  chemically synthesized
ggttaatttaaatttacctt

SEQ ID NO: 432586 - DNA, 20 bp, Artificial Sequence
  chemically synthesized
aaatttaaattaaccctatt

SEQ ID NO: 432587 - DNA, 20 bp, Artificial Sequence
  chemically synthesized
ttccttgacgtttctaaata

SEQ ID NO: 432588 - DNA, 20 bp, Artificial Sequence
  chemically synthesized
tttccttgacgtttctaaat

SEQ ID NO: 432589 - DNA, 20 bp, Artificial Sequence
  chemically synthesized
atttccttgacgtttctaaa

SEQ ID NO: 432590 - DNA, 20 bp, Artificial Sequence
  chemically synthesized
taaccctatttagaaacgtc

SEQ ID NO: 432591 - DNA, 20 bp, Artificial Sequence
  chemically synthesized
aaccctatttagaaacgtca

SEQ ID NO: 432592 - DNA, 20 bp, Artificial Sequence
  chemically synthesized
caaggaaattaaacatatta

SEQ ID NO: 432593 - DNA, 20 bp, Artificial Sequence
  chemically synthesized
aggaaattaaacatattaaa

SEQ ID NO: 432594 - DNA, 20 bp, Artificial Sequence
  chemically synthesized
taaacatattaaagagatat

SEQ ID NO: 432595 - DNA, 20 bp, Artificial Sequence
  chemically synthesized
tcacatatacaaacttacat

SEQ ID NO: 432596 - DNA, 20 bp, Artificial Sequence
  chemically synthesized
ttcctaaagaaggctcatgt

SEQ ID NO: 432597 - DNA, 20 bp, Artificial Sequence
  chemically synthesized
aaacttacatgagccttctt

SEQ ID NO: 432598 - DNA, 20 bp, Artificial Sequence
  chemically synthesized
aacttacatgagccttcttt

SEQ ID NO: 432599 - DNA, 20 bp, Artificial Sequence
  chemically synthesized
tgcttgcttcttcctaaaga

SEQ ID NO: 432600 - DNA, 20 bp, Artificial Sequence
  chemically synthesized
ttacatgagccttctttagg

SEQ ID NO: 432601 - DNA, 20 bp, Artificial Sequence
  chemically synthesized
ctgcttgcttcttcctaaag

SEQ ID NO: 432602 - DNA, 20 bp, Artificial Sequence
  chemically synthesized
catgagccttctttaggaag

SEQ ID NO: 432603 - DNA, 20 bp, Artificial Sequence
  chemically synthesized
tatctgcttgcttcttccta

SEQ ID NO: 432604 - DNA, 20 bp, Artificial Sequence
  chemically synthesized
agccttctttaggaagaagc

SEQ ID NO: 432605 - DNA, 20 bp, Artificial Sequence
  chemically synthesized
cttctttaggaagaagcaag

SEQ ID NO: 432606 - DNA, 20 bp, Artificial Sequence
  chemically synthesized
gcaagcagataaatgaaaat

SEQ ID NO: 432607 - DNA, 20 bp, Artificial Sequence
  chemically synthesized
attagaaaaatattgaattg

SEQ ID NO: 432608 - DNA, 20 bp, Artificial Sequence
  chemically synthesized
aaatattgaattgtggaaaa

SEQ ID NO: 432609 - DNA, 20 bp, Artificial Sequence
  chemically synthesized
tattgaattgtggaaaacag

SEQ ID NO: 432610 - DNA, 20 bp, Artificial Sequence
  chemically synthesized
tgtggaaaacagaagtcaat

SEQ ID NO: 432611 - DNA, 20 bp, Artificial Sequence
  chemically synthesized
gtggaaaacagaagtcaatg

SEQ ID NO: 432612 - DNA, 20 bp, Artificial Sequence
  chemically synthesized
agaagtcaatgaggaaaaat

SEQ ID NO: 432613 - DNA, 20 bp, Artificial Sequence
  chemically synthesized
aattagtaattaatccaatg

SEQ ID NO: 432614 - DNA, 20 bp, Artificial Sequence
  chemically synthesized
atgatctcagagtactacat

SEQ ID NO: 432615 - DNA, 20 bp, Artificial Sequence
  chemically synthesized
ttaatccaatgtagtactct

SEQ ID NO: 432616 - DNA, 20 bp, Artificial Sequence
  chemically synthesized
aggcatcatcaatgatctca

SEQ ID NO: 432617 - DNA, 20 bp, Artificial Sequence
  chemically synthesized
caaggcatcatcaatgatct

SEQ ID NO: 432618 - DNA, 20 bp, Artificial Sequence
  chemically synthesized
gagatcattgatgatgcctt

SEQ ID NO: 432619 - DNA, 20 bp, Artificial Sequence
  chemically synthesized
cattgatgatgccttgagtg

SEQ ID NO: 432620 - DNA, 20 bp, Artificial Sequence
  chemically synthesized
tagactcccagccacactca

SEQ ID NO: 432621 - DNA, 20 bp, Artificial Sequence
  chemically synthesized
gtagactcccagccacactc

SEQ ID NO: 432622 - DNA, 20 bp, Artificial Sequence
  chemically synthesized
gatgatgccttgagtgtggc

SEQ ID NO: 432623 - DNA, 20 bp, Artificial Sequence
  chemically synthesized
atgatgccttgagtgtggct

SEQ ID NO: 432624 - DNA, 20 bp, Artificial Sequence
  chemically synthesized
gatgccttgagtgtggctgg

SEQ ID NO: 432625 - DNA, 20 bp, Artificial Sequence
  chemically synthesized
caataatccaggtagactcc

SEQ ID NO: 432626 - DNA, 20 bp, Artificial Sequence
  chemically synthesized
agtgtggctgggagtctacc

SEQ ID NO: 432627 - DNA, 20 bp, Artificial Sequence
  chemically synthesized
ctccccatcaataatccagg

SEQ ID NO: 432628 - DNA, 20 bp, Artificial Sequence
  chemically synthesized
tttctccccatcaataatcc

SEQ ID NO: 432629 - DNA, 20 bp, Artificial Sequence
  chemically synthesized
gtttctccccatcaataatc

SEQ ID NO: 432630 - DNA, 20 bp, Artificial Sequence
  chemically synthesized
gagtctacctggattattga

SEQ ID NO: 432631 - DNA, 20 bp, Artificial Sequence
  chemically synthesized
agtctacctggattattgat

SEQ ID NO: 432632 - DNA, 20 bp, Artificial Sequence
  chemically synthesized
gtctacctggattattgatg

SEQ ID NO: 432633 - DNA, 20 bp, Artificial Sequence
  chemically synthesized
ctacctggattattgatggg

SEQ ID NO: 432634 - DNA, 20 bp, Artificial Sequence
  chemically synthesized
tttgtcaccatgatcatcaa

SEQ ID NO: 432635 - DNA, 20 bp, Artificial Sequence
  chemically synthesized
ggagaaacttttgatgatca

SEQ ID NO: 432636 - DNA, 20 bp, Artificial Sequence
  chemically synthesized
tgatcatggtgacaaaatca

SEQ ID NO: 432637 - DNA, 20 bp, Artificial Sequence
  chemically synthesized
atcatggtgacaaaatcaaa

SEQ ID NO: 432638 - DNA, 20 bp, Artificial Sequence
  chemically synthesized
atggtgacaaaatcaaagag

SEQ ID NO: 432639 - DNA, 20 bp, Artificial Sequence
  chemically synthesized
tggtgacaaaatcaaagaga

SEQ ID NO: 432640 - DNA, 20 bp, Artificial Sequence
  chemically synthesized
aaaatcaaagagaaggcgta

SEQ ID NO: 432641 - DNA, 20 bp, Artificial Sequence
  chemically synthesized
aaatcaaagagaaggcgtaa

SEQ ID NO: 432642 - DNA, 20 bp, Artificial Sequence
  chemically synthesized
aagagaaggcgtaaaggata

SEQ ID NO: 432643 - DNA, 20 bp, Artificial Sequence
  chemically synthesized
aggatacagttatattccct

SEQ ID NO: 432644 - DNA, 20 bp, Artificial Sequence
  chemically synthesized
ataactaattattttactta

SEQ ID NO: 432645 - DNA, 20 bp, Artificial Sequence
  chemically synthesized
tataactaattattttactt

SEQ ID NO: 432646 - DNA, 20 bp, Artificial Sequence
  chemically synthesized
ctataactaattattttact

SEQ ID NO: 432647 - DNA, 20 bp, Artificial Sequence
  chemically synthesized
tattccctaagtaaaataat

SEQ ID NO: 432648 - DNA, 20 bp, Artificial Sequence
  chemically synthesized
ctaagtaaaataattagtta

SEQ ID NO: 432649 - DNA, 20 bp, Artificial Sequence
  chemically synthesized
taagtaaaataattagttat

SEQ ID NO: 432650 - DNA, 20 bp, Artificial Sequence
  chemically synthesized
aaataattagttataggatt

SEQ ID NO: 432651 - DNA, 20 bp, Artificial Sequence
  chemically synthesized
gattgagaatttcaaataaa

SEQ ID NO: 432652 - DNA, 20 bp, Artificial Sequence
  chemically synthesized
atttcaaataaaaagcaata

SEQ ID NO: 432653 - DNA, 20 bp, Artificial Sequence
  chemically synthesized
aaataaaaagcaatatggaa

SEQ ID NO: 432654 - DNA, 20 bp, Artificial Sequence
  chemically synthesized
tattatataaataatgtaac

SEQ ID NO: 432655 - DNA, 20 bp, Artificial Sequence
  chemically synthesized
tataaataatgtaactggca

SEQ ID NO: 432656 - DNA, 20 bp, Artificial Sequence
  chemically synthesized
tgcatttctgtgttctgtgc

SEQ ID NO: 432657 - DNA, 20 bp, Artificial Sequence
  chemically synthesized
aatgtaactggcacagaaca

SEQ ID NO: 432658 - DNA, 20 bp, Artificial Sequence
  chemically synthesized
atcttatttggaaattcaaa

SEQ ID NO: 432659 - DNA, 20 bp, Artificial Sequence
  chemically synthesized
tatcttatttggaaattcaa

SEQ ID NO: 432660 - DNA, 20 bp, Artificial Sequence
  chemically synthesized
taccttttgaatttccaaat

SEQ ID NO: 432661 - DNA, 20 bp, Artificial Sequence
  chemically synthesized
ttttgaatttccaaataaga

SEQ ID NO: 432662 - DNA, 20 bp, Artificial Sequence
  chemically synthesized
tgacaggaatctatcttatt

SEQ ID NO: 432663 - DNA, 20 bp, Artificial Sequence
  chemically synthesized
ctatcttctagagagttgac

SEQ ID NO: 432664 - DNA, 20 bp, Artificial Sequence
  chemically synthesized
cctatcttctagagagttga

SEQ ID NO: 432665 - DNA, 20 bp, Artificial Sequence
  chemically synthesized
atagattcctgtcaactctc

SEQ ID NO: 432666 - DNA, 20 bp, Artificial Sequence
  chemically synthesized
gattcctgtcaactctctag

SEQ ID NO: 432667 - DNA, 20 bp, Artificial Sequence
  chemically synthesized
aaaaaaacctatcttctaga

SEQ ID NO: 432668 - DNA, 20 bp, Artificial Sequence
  chemically synthesized
cctgtcaactctctagaaga

SEQ ID NO: 432669 - DNA, 20 bp, Artificial Sequence
  chemically synthesized
aaaaaaaaacctatcttcta

SEQ ID NO: 432670 - DNA, 20 bp, Artificial Sequence
  chemically synthesized
ctgtcaactctctagaagat

SEQ ID NO: 432671 - DNA, 20 bp, Artificial Sequence
  chemically synthesized
aaaaaaaaaaacctatcttc

SEQ ID NO: 432672 - DNA, 20 bp, Artificial Sequence
  chemically synthesized
gcatgcaagagaatcaatag

SEQ ID NO: 432673 - DNA, 20 bp, Artificial Sequence
  chemically synthesized
tgcatgcaagagaatcaata

SEQ ID NO: 432674 - DNA, 20 bp, Artificial Sequence
  chemically synthesized
tgtgcatgcaagagaatcaa

SEQ ID NO: 432675 - DNA, 20 bp, Artificial Sequence
  chemically synthesized
caaagactttgtgcatgcaa

SEQ ID NO: 432676 - DNA, 20 bp, Artificial Sequence
  chemically synthesized
ttcaaagactttgtgcatgc

SEQ ID NO: 432677 - DNA, 20 bp, Artificial Sequence
  chemically synthesized
ttgattctcttgcatgcaca

SEQ ID NO: 432678 - DNA, 20 bp, Artificial Sequence
  chemically synthesized
tgatgagaaacaaatattca

SEQ ID NO: 432679 - DNA, 20 bp, Artificial Sequence
  chemically synthesized
tttgaatatttgtttctcat

SEQ ID NO: 432680 - DNA, 20 bp, Artificial Sequence
  chemically synthesized
ctgttgaaggtaaatctgat

SEQ ID NO: 432681 - DNA, 20 bp, Artificial Sequence
  chemically synthesized
ctcatcagatttaccttcaa

SEQ ID NO: 432682 - DNA, 20 bp, Artificial Sequence
  chemically synthesized
ggaggccccaatactgttga

SEQ ID NO: 432683 - DNA, 20 bp, Artificial Sequence
  chemically synthesized
gggaggccccaatactgttg

SEQ ID NO: 432684 - DNA, 20 bp, Artificial Sequence
  chemically synthesized
agatttaccttcaacagtat

SEQ ID NO: 432685 - DNA, 20 bp, Artificial Sequence
  chemically synthesized
gatttaccttcaacagtatt

SEQ ID NO: 432686 - DNA, 20 bp, Artificial Sequence
  chemically synthesized
atttaccttcaacagtattg

SEQ ID NO: 432687 - DNA, 20 bp, Artificial Sequence
  chemically synthesized
aaagcatgtatgtaattggg

SEQ ID NO: 432688 - DNA, 20 bp, Artificial Sequence
  chemically synthesized
aaaagcatgtatgtaattgg

SEQ ID NO: 432689 - DNA, 20 bp, Artificial Sequence
  chemically synthesized
ataaaagcatgtatgtaatt

SEQ ID NO: 432690 - DNA, 20 bp, Artificial Sequence
  chemically synthesized
aataaaagcatgtatgtaat

SEQ ID NO: 432691 - DNA, 20 bp, Artificial Sequence
  chemically synthesized
ttctgttcattgggtaataa

SEQ ID NO: 432692 - DNA, 20 bp, Artificial Sequence
  chemically synthesized
tgcttttattacccaatgaa

SEQ ID NO: 432693 - DNA, 20 bp, Artificial Sequence
  chemically synthesized
ttgttttttttctgttcatt

SEQ ID NO: 432694 - DNA, 20 bp, Artificial Sequence
  chemically synthesized
attgttttttttctgttcat

SEQ ID NO: 432695 - DNA, 20 bp, Artificial Sequence
  chemically synthesized
ttcagttgaaataatatgaa

SEQ ID NO: 432696 - DNA, 20 bp, Artificial Sequence
  chemically synthesized
atattatttcaactgaaatc

SEQ ID NO: 432697 - DNA, 20 bp, Artificial Sequence
  chemically synthesized
gcttttaacaagcttgattt

SEQ ID NO: 432698 - DNA, 20 bp, Artificial Sequence
  chemically synthesized
actgaaatcaagcttgttaa

SEQ ID NO: 432699 - DNA, 20 bp, Artificial Sequence
  chemically synthesized
attgtgagagagcttttaac

SEQ ID NO: 432700 - DNA, 20 bp, Artificial Sequence
  chemically synthesized
caaaattaacaattgtgaga

SEQ ID NO: 432701 - DNA, 20 bp, Artificial Sequence
  chemically synthesized
tacaaaattaacaattgtga

SEQ ID NO: 432702 - DNA, 20 bp, Artificial Sequence
  chemically synthesized
tgtacaaaattaacaattgt

SEQ ID NO: 432703 - DNA, 20 bp, Artificial Sequence
  chemically synthesized
tgtacatttgcaaaaatcaa

SEQ ID NO: 432704 - DNA, 20 bp, Artificial Sequence
  chemically synthesized
catttgcaaaaatcaatagc

SEQ ID NO: 432705 - DNA, 20 bp, Artificial Sequence
  chemically synthesized
ttcgtgtctagtaaattttc

SEQ ID NO: 432706 - DNA, 20 bp, Artificial Sequence
  chemically synthesized
tcaatagctagaaaatttac

SEQ ID NO: 432707 - DNA, 20 bp, Artificial Sequence
  chemically synthesized
tagaaaatttactagacacg

SEQ ID NO: 432708 - DNA, 20 bp, Artificial Sequence
  chemically synthesized
agaaaatttactagacacga

SEQ ID NO: 432709 - DNA, 20 bp, Artificial Sequence
  chemically synthesized
gtttcagaggccttcgtgtc

SEQ ID NO: 432710 - DNA, 20 bp, Artificial Sequence
  chemically synthesized
gatcatttgtattgtttcag

SEQ ID NO: 432711 - DNA, 20 bp, Artificial Sequence
  chemically synthesized
agatcatttgtattgtttca

SEQ ID NO: 432712 - DNA, 20 bp, Artificial Sequence
  chemically synthesized
aaagatcatttgtattgttt

SEQ ID NO: 432713 - DNA, 20 bp, Artificial Sequence
  chemically synthesized
tacaaatgatctttatgccc

SEQ ID NO: 432714 - DNA, 20 bp, Artificial Sequence
  chemically synthesized
attcgtagccctagggcata

SEQ ID NO: 432715 - DNA, 20 bp, Artificial Sequence
  chemically synthesized
acaaatgatctttatgccct

SEQ ID NO: 432716 - DNA, 20 bp, Artificial Sequence
  chemically synthesized
caaatgatctttatgcccta

SEQ ID NO: 432717 - DNA, 20 bp, Artificial Sequence
  chemically synthesized
tcaataaattcgtagcccta

SEQ ID NO: 432718 - DNA, 20 bp, Artificial Sequence
  chemically synthesized
atcaataaattcgtagccct

SEQ ID NO: 432719 - DNA, 20 bp, Artificial Sequence
  chemically synthesized
tatcaataaattcgtagccc

SEQ ID NO: 432720 - DNA, 20 bp, Artificial Sequence
  chemically synthesized
taaccttatcaataaattcg

SEQ ID NO: 432721 - DNA, 20 bp, Artificial Sequence
  chemically synthesized
agggctacgaatttattgat

SEQ ID NO: 432722 - DNA, 20 bp, Artificial Sequence
  chemically synthesized
gggctacgaatttattgata

SEQ ID NO: 432723 - DNA, 20 bp, Artificial Sequence
  chemically synthesized
ttgataaggttaacaatcct

SEQ ID NO: 432724 - DNA, 20 bp, Artificial Sequence
  chemically synthesized
tgataaggttaacaatcctt

SEQ ID NO: 432725 - DNA, 20 bp, Artificial Sequence
  chemically synthesized
aagtaagctgtcattaccca

SEQ ID NO: 432726 - DNA, 20 bp, Artificial Sequence
  chemically synthesized
gaagtaagctgtcattaccc

SEQ ID NO: 432727 - DNA, 20 bp, Artificial Sequence
  chemically synthesized
taacaatccttgggtaatga

SEQ ID NO: 432728 - DNA, 20 bp, Artificial Sequence
  chemically synthesized
gctagattcagaagagaagt

SEQ ID NO: 432729 - DNA, 20 bp, Artificial Sequence
  chemically synthesized
ttaggctagattcagaagag

SEQ ID NO: 432730 - DNA, 20 bp, Artificial Sequence
  chemically synthesized
tctttaggctagattcagaa

SEQ ID NO: 432731 - DNA, 20 bp, Artificial Sequence
  chemically synthesized
gcttacttctcttctgaatc

SEQ ID NO: 432732 - DNA, 20 bp, Artificial Sequence
  chemically synthesized
aatctttaggctagattcag

SEQ ID NO: 432733 - DNA, 20 bp, Artificial Sequence
  chemically synthesized
tggaatctttaggctagatt

SEQ ID NO: 432734 - DNA, 20 bp, Artificial Sequence
  chemically synthesized
tctcttctgaatctagccta

SEQ ID NO: 432735 - DNA, 20 bp, Artificial Sequence
  chemically synthesized
atttaatggaatctttaggc

SEQ ID NO: 432736 - DNA, 20 bp, Artificial Sequence
  chemically synthesized
atatatttaatggaatcttt

SEQ ID NO: 432737 - DNA, 20 bp, Artificial Sequence
  chemically synthesized
aatatatttaatggaatctt

SEQ ID NO: 432738 - DNA, 20 bp, Artificial Sequence
  chemically synthesized
ttgtttagaaatatatttaa

SEQ ID NO: 432739 - DNA, 20 bp, Artificial Sequence
  chemically synthesized
atctagacatttttgttgtt

SEQ ID NO: 432740 - DNA, 20 bp, Artificial Sequence
  chemically synthesized
ttctaaacaacaaaaatgtc

SEQ ID NO: 432741 - DNA, 20 bp, Artificial Sequence
  chemically synthesized
aacaacaaaaatgtctagat

SEQ ID NO: 432742 - DNA, 20 bp, Artificial Sequence
  chemically synthesized
caacaaaaatgtctagatga

SEQ ID NO: 432743 - DNA, 20 bp, Artificial Sequence
  chemically synthesized
aatcagtttagactctcatc

SEQ ID NO: 432744 - DNA, 20 bp, Artificial Sequence
  chemically synthesized
gcaaacacttgaaatcagtt

SEQ ID NO: 432745 - DNA, 20 bp, Artificial Sequence
  chemically synthesized
tgagagtctaaactgatttc

SEQ ID NO: 432746 - DNA, 20 bp, Artificial Sequence
  chemically synthesized
ttgaagcaaacacttgaaat

SEQ ID NO: 432747 - DNA, 20 bp, Artificial Sequence
  chemically synthesized
gatttcaagtgtttgcttca

SEQ ID NO: 432748 - DNA, 20 bp, Artificial Sequence
  chemically synthesized
atttcaagtgtttgcttcaa

SEQ ID NO: 432749 - DNA, 20 bp, Artificial Sequence
  chemically synthesized
tgtctttgttttgtcctttg

SEQ ID NO: 432750 - DNA, 20 bp, Artificial Sequence
  chemically synthesized
ttgcttcaaaggacaaaaca

SEQ ID NO: 432751 - DNA, 20 bp, Artificial Sequence
  chemically synthesized
ttcaaaggacaaaacaaaga

SEQ ID NO: 432752 - DNA, 20 bp, Artificial Sequence
  chemically synthesized
caaagacagatgctcccttc

SEQ ID NO: 432753 - DNA, 20 bp, Artificial Sequence
  chemically synthesized
ctaagtcattggctggaagg

SEQ ID NO: 432754 - DNA, 20 bp, Artificial Sequence
  chemically synthesized
gtctaagtcattggctggaa

SEQ ID NO: 432755 - DNA, 20 bp, Artificial Sequence
  chemically synthesized
tgtctaagtcattggctgga

SEQ ID NO: 432756 - DNA, 20 bp, Artificial Sequence
  chemically synthesized
ttgtctaagtcattggctgg

SEQ ID NO: 432757 - DNA, 20 bp, Artificial Sequence
  chemically synthesized
ggattgtctaagtcattggc

SEQ ID NO: 432758 - DNA, 20 bp, Artificial Sequence
  chemically synthesized
ctcccttccagccaatgact

SEQ ID NO: 432759 - DNA, 20 bp, Artificial Sequence
  chemically synthesized
atatggattgtctaagtcat

SEQ ID NO: 432760 - DNA, 20 bp, Artificial Sequence
  chemically synthesized
atctttaatatggattgtct

SEQ ID NO: 432761 - DNA, 20 bp, Artificial Sequence
  chemically synthesized
gacttagacaatccatatta

SEQ ID NO: 432762 - DNA, 20 bp, Artificial Sequence
  chemically synthesized
attgacttcaatctttaata

SEQ ID NO: 432763 - DNA, 20 bp, Artificial Sequence
  chemically synthesized
acaatccatattaaagattg

SEQ ID NO: 432764 - DNA, 20 bp, Artificial Sequence
  chemically synthesized
atattaaagattgaagtcaa

SEQ ID NO: 432765 - DNA, 20 bp, Artificial Sequence
  chemically synthesized
agtcaatggtcatgatatac

SEQ ID NO: 432766 - DNA, 20 bp, Artificial Sequence
  chemically synthesized
gtcaatggtcatgatatact

SEQ ID NO: 432767 - DNA, 20 bp, Artificial Sequence
  chemically synthesized
atggtcatgatatactaggt

SEQ ID NO: 432768 - DNA, 20 bp, Artificial Sequence
  chemically synthesized
tggtcatgatatactaggtt

SEQ ID NO: 432769 - DNA, 20 bp, Artificial Sequence
  chemically synthesized
tcaagccagattgcccaacc

SEQ ID NO: 432770 - DNA, 20 bp, Artificial Sequence
  chemically synthesized
atatactaggttgggcaatc

SEQ ID NO: 432771 - DNA, 20 bp, Artificial Sequence
  chemically synthesized
agtcaatgtcacattcaagc

SEQ ID NO: 432772 - DNA, 20 bp, Artificial Sequence
  chemically synthesized
aaccagtcaatgtcacattc

SEQ ID NO: 432773 - DNA, 20 bp, Artificial Sequence
  chemically synthesized
ggcttgaatgtgacattgac

SEQ ID NO: 432774 - DNA, 20 bp, Artificial Sequence
  chemically synthesized
cattaattcaaaatttaaac

SEQ ID NO: 432775 - DNA, 20 bp, Artificial Sequence
  chemically synthesized
tgatggatgaaatattttga

SEQ ID NO: 432776 - DNA, 20 bp, Artificial Sequence
  chemically synthesized
actgatggatgaaatatttt

SEQ ID NO: 432777 - DNA, 20 bp, Artificial Sequence
  chemically synthesized
tctcaaaatatttcatccat

SEQ ID NO: 432778 - DNA, 20 bp, Artificial Sequence
  chemically synthesized
aaaatatttcatccatcagt

SEQ ID NO: 432779 - DNA, 20 bp, Artificial Sequence
  chemically synthesized
agtgtaaataaaccaactga

SEQ ID NO: 432780 - DNA, 20 bp, Artificial Sequence
  chemically synthesized
gtcagtaattggtaaataat

SEQ ID NO: 432781 - DNA, 20 bp, Artificial Sequence
  chemically synthesized
ttagcacctatgtcagtaat

SEQ ID NO: 432782 - DNA, 20 bp, Artificial Sequence
  chemically synthesized
ttatttaccaattactgaca

SEQ ID NO: 432783 - DNA, 20 bp, Artificial Sequence
  chemically synthesized
tatttaccaattactgacat

SEQ ID NO: 432784 - DNA, 20 bp, Artificial Sequence
  chemically synthesized
ctgcgtgttagcacctatgt

SEQ ID NO: 432785 - DNA, 20 bp, Artificial Sequence
  chemically synthesized
ctgacataggtgctaacacg

SEQ ID NO: 432786 - DNA, 20 bp, Artificial Sequence
  chemically synthesized
taaaagtttttgctgcgtgt

SEQ ID NO: 432787 - DNA, 20 bp, Artificial Sequence
  chemically synthesized
acaaataaaaataattttaa

SEQ ID NO: 432788 - DNA, 20 bp, Artificial Sequence
  chemically synthesized
taaagctattaaaattaaaa

SEQ ID NO: 432789 - DNA, 20 bp, Artificial Sequence
  chemically synthesized
ctaaagctattaaaattaaa

SEQ ID NO: 432790 - DNA, 20 bp, Artificial Sequence
  chemically synthesized
tatttcctttttaattttaa

SEQ ID NO: 432791 - DNA, 20 bp, Artificial Sequence
  chemically synthesized
ctttttaattttaatagctt

SEQ ID NO: 432792 - DNA, 20 bp, Artificial Sequence
  chemically synthesized
tttttaattttaatagcttt

SEQ ID NO: 432793 - DNA, 20 bp, Artificial Sequence
  chemically synthesized
ttttaattttaatagcttta

SEQ ID NO: 432794 - DNA, 20 bp, Artificial Sequence
  chemically synthesized
tttaattttaatagctttag

SEQ ID NO: 432795 - DNA, 20 bp, Artificial Sequence
  chemically synthesized
aattttaatagctttagggg

SEQ ID NO: 432796 - DNA, 20 bp, Artificial Sequence
  chemically synthesized
aaaaaccacttccaccccta

SEQ ID NO: 432797 - DNA, 20 bp, Artificial Sequence
  chemically synthesized
tttaatagctttaggggtgg

SEQ ID NO: 432798 - DNA, 20 bp, Artificial Sequence
  chemically synthesized
aatagctttaggggtggaag

SEQ ID NO: 432799 - DNA, 20 bp, Artificial Sequence
  chemically synthesized
tggttttttgttacacaaat

SEQ ID NO: 432800 - DNA, 20 bp, Artificial Sequence
  chemically synthesized
tgttacacaaatgagttcta

SEQ ID NO: 432801 - DNA, 20 bp, Artificial Sequence
  chemically synthesized
tacacaaatgagttctatag

SEQ ID NO: 432802 - DNA, 20 bp, Artificial Sequence
  chemically synthesized
aatctcagaattcaccacta

SEQ ID NO: 432803 - DNA, 20 bp, Artificial Sequence
  chemically synthesized
gttctatagtggtgaattct

SEQ ID NO: 432804 - DNA, 20 bp, Artificial Sequence
  chemically synthesized
agtggtgaattctgagattt

SEQ ID NO: 432805 - DNA, 20 bp, Artificial Sequence
  chemically synthesized
tgacaggtgcactaaaatct

SEQ ID NO: 432806 - DNA, 20 bp, Artificial Sequence
  chemically synthesized
ttttagtgcacctgtcacct

SEQ ID NO: 432807 - DNA, 20 bp, Artificial Sequence
  chemically synthesized
atataccctactcaggtgac

SEQ ID NO: 432808 - DNA, 20 bp, Artificial Sequence
  chemically synthesized
aatataccctactcaggtga

SEQ ID NO: 432809 - DNA, 20 bp, Artificial Sequence
  chemically synthesized
tagtgcacctgtcacctgag

SEQ ID NO: 432810 - DNA, 20 bp, Artificial Sequence
  chemically synthesized
agtgcacctgtcacctgagt

SEQ ID NO: 432811 - DNA, 20 bp, Artificial Sequence
  chemically synthesized
gtgcacctgtcacctgagta

SEQ ID NO: 432812 - DNA, 20 bp, Artificial Sequence
  chemically synthesized
aggtacaatataccctactc

SEQ ID NO: 432813 - DNA, 20 bp, Artificial Sequence
  chemically synthesized
taggtacaatataccctact

SEQ ID NO: 432814 - DNA, 20 bp, Artificial Sequence
  chemically synthesized
attaaaaaaaaggacacatt

SEQ ID NO: 432815 - DNA, 20 bp, Artificial Sequence
  chemically synthesized
gattaaaaaaaaggacacat

SEQ ID NO: 432816 - DNA, 20 bp, Artificial Sequence
  chemically synthesized
ggggctagcgattaaaaaaa

SEQ ID NO: 432817 - DNA, 20 bp, Artificial Sequence
  chemically synthesized
gggggctagcgattaaaaaa

SEQ ID NO: 432818 - DNA, 20 bp, Artificial Sequence
  chemically synthesized
gtgtccttttttttaatcgc

SEQ ID NO: 432819 - DNA, 20 bp, Artificial Sequence
  chemically synthesized
aagagttctaggaggggggc

SEQ ID NO: 432820 - DNA, 20 bp, Artificial Sequence
  chemically synthesized
ttaatcgctagcccccctcc

SEQ ID NO: 432821 - DNA, 20 bp, Artificial Sequence
  chemically synthesized
catcaagagttctaggaggg

SEQ ID NO: 432822 - DNA, 20 bp, Artificial Sequence
  chemically synthesized
tcatcaagagttctaggagg

SEQ ID NO: 432823 - DNA, 20 bp, Artificial Sequence
  chemically synthesized
ttcatcaagagttctaggag

SEQ ID NO: 432824 - DNA, 20 bp, Artificial Sequence
  chemically synthesized
attcatcaagagttctagga

SEQ ID NO: 432825 - DNA, 20 bp, Artificial Sequence
  chemically synthesized
aattcatcaagagttctagg

SEQ ID NO: 432826 - DNA, 20 bp, Artificial Sequence
  chemically synthesized
gaattcatcaagagttctag

SEQ ID NO: 432827 - DNA, 20 bp, Artificial Sequence
  chemically synthesized
ctgaattcatcaagagttct

SEQ ID NO: 432828 - DNA, 20 bp, Artificial Sequence
  chemically synthesized
tctgaattcatcaagagttc

SEQ ID NO: 432829 - DNA, 20 bp, Artificial Sequence
  chemically synthesized
ctagattctgaattcatcaa

SEQ ID NO: 432830 - DNA, 20 bp, Artificial Sequence
  chemically synthesized
ccctagattctgaattcatc

SEQ ID NO: 432831 - DNA, 20 bp, Artificial Sequence
  chemically synthesized
cctagaactcttgatgaatt

SEQ ID NO: 432832 - DNA, 20 bp, Artificial Sequence
  chemically synthesized
ctcttgatgaattcagaatc

SEQ ID NO: 432833 - DNA, 20 bp, Artificial Sequence
  chemically synthesized
tcttgatgaattcagaatct

SEQ ID NO: 432834 - DNA, 20 bp, Artificial Sequence
  chemically synthesized
cttgatgaattcagaatcta

SEQ ID NO: 432835 - DNA, 20 bp, Artificial Sequence
  chemically synthesized
tgatgaattcagaatctagg

SEQ ID NO: 432836 - DNA, 20 bp, Artificial Sequence
  chemically synthesized
gaattcagaatctagggaga

SEQ ID NO: 432837 - DNA, 20 bp, Artificial Sequence
  chemically synthesized
tgcttttctgactttctccc

SEQ ID NO: 432838 - DNA, 20 bp, Artificial Sequence
  chemically synthesized
tcagaatctagggagaaagt

SEQ ID NO: 432839 - DNA, 20 bp, Artificial Sequence
  chemically synthesized
atctagggagaaagtcagaa

SEQ ID NO: 432840 - DNA, 20 bp, Artificial Sequence
  chemically synthesized
gagaaagtcagaaaagcaat

SEQ ID NO: 432841 - DNA, 20 bp, Artificial Sequence
  chemically synthesized
agcaatcagtcaatacaacg

SEQ ID NO: 432842 - DNA, 20 bp, Artificial Sequence
  chemically synthesized
tcagtcaatacaacgtagta

SEQ ID NO: 432843 - DNA, 20 bp, Artificial Sequence
  chemically synthesized
agtcaatacaacgtagtaca

SEQ ID NO: 432844 - DNA, 20 bp, Artificial Sequence
  chemically synthesized
gtcaatacaacgtagtacag

SEQ ID NO: 432845 - DNA, 20 bp, Artificial Sequence
  chemically synthesized
tacagaggaaaatctctgaa

SEQ ID NO: 432846 - DNA, 20 bp, Artificial Sequence
  chemically synthesized
gttacatggaagtctattca

SEQ ID NO: 432847 - DNA, 20 bp, Artificial Sequence
  chemically synthesized
tggttacatggaagtctatt

SEQ ID NO: 432848 - DNA, 20 bp, Artificial Sequence
  chemically synthesized
agtaggcattggttacatgg

SEQ ID NO: 432849 - DNA, 20 bp, Artificial Sequence
  chemically synthesized
ctgagtaggcattggttaca

SEQ ID NO: 432850 - DNA, 20 bp, Artificial Sequence
  chemically synthesized
caaattacctgagtaggcat

SEQ ID NO: 432851 - DNA, 20 bp, Artificial Sequence
  chemically synthesized
ccatgtaaccaatgcctact

SEQ ID NO: 432852 - DNA, 20 bp, Artificial Sequence
  chemically synthesized
catgtaaccaatgcctactc

SEQ ID NO: 432853 - DNA, 20 bp, Artificial Sequence
  chemically synthesized
atctggcaaattacctgagt

SEQ ID NO: 432854 - DNA, 20 bp, Artificial Sequence
  chemically synthesized
aatctggcaaattacctgag

SEQ ID NO: 432855 - DNA, 20 bp, Artificial Sequence
  chemically synthesized
gttaatctggcaaattacct

SEQ ID NO: 432856 - DNA, 20 bp, Artificial Sequence
  chemically synthesized
tgcctactcaggtaatttgc

SEQ ID NO: 432857 - DNA, 20 bp, Artificial Sequence
  chemically synthesized
atgcagggtgtttgttaatc

SEQ ID NO: 432858 - DNA, 20 bp, Artificial Sequence
  chemically synthesized
tacttttcagaggaaatgca

SEQ ID NO: 432859 - DNA, 20 bp, Artificial Sequence
  chemically synthesized
gtacttttcagaggaaatgc

SEQ ID NO: 432860 - DNA, 20 bp, Artificial Sequence
  chemically synthesized
tgtacttttcagaggaaatg

SEQ ID NO: 432861 - DNA, 20 bp, Artificial Sequence
  chemically synthesized
caccctgcatttcctctgaa

SEQ ID NO: 432862 - DNA, 20 bp, Artificial Sequence
  chemically synthesized
ttagccaatgtacttttcag

SEQ ID NO: 432863 - DNA, 20 bp, Artificial Sequence
  chemically synthesized
attagccaatgtacttttca

SEQ ID NO: 432864 - DNA, 20 bp, Artificial Sequence
  chemically synthesized
gcattagccaatgtactttt

SEQ ID NO: 432865 - DNA, 20 bp, Artificial Sequence
  chemically synthesized
atttcctctgaaaagtacat

SEQ ID NO: 432866 - DNA, 20 bp, Artificial Sequence
  chemically synthesized
aaagtacattggctaatgcc

SEQ ID NO: 432867 - DNA, 20 bp, Artificial Sequence
  chemically synthesized
aagtacattggctaatgccc

SEQ ID NO: 432868 - DNA, 20 bp, Artificial Sequence
  chemically synthesized
agtacattggctaatgccca

SEQ ID NO: 432869 - DNA, 20 bp, Artificial Sequence
  chemically synthesized
atccatcttgccctgggcat

SEQ ID NO: 432870 - DNA, 20 bp, Artificial Sequence
  chemically synthesized
cattggctaatgcccagggc

SEQ ID NO: 432871 - DNA, 20 bp, Artificial Sequence
  chemically synthesized
aaaagtatccatcttgccct

SEQ ID NO: 432872 - DNA, 20 bp, Artificial Sequence
  chemically synthesized
taaaagtatccatcttgccc

SEQ ID NO: 432873 - DNA, 20 bp, Artificial Sequence
  chemically synthesized
ggctaatgcccagggcaaga

SEQ ID NO: 432874 - DNA, 20 bp, Artificial Sequence
  chemically synthesized
cagggcaagatggatacttt

SEQ ID NO: 432875 - DNA, 20 bp, Artificial Sequence
  chemically synthesized
agggcaagatggatactttt

SEQ ID NO: 432876 - DNA, 20 bp, Artificial Sequence
  chemically synthesized
atgagttgagtattacctaa

SEQ ID NO: 432877 - DNA, 20 bp, Artificial Sequence
  chemically synthesized
ttaggtaatactcaactcat

SEQ ID NO: 432878 - DNA, 20 bp, Artificial Sequence
  chemically synthesized
catgggtctaccaatgagtt

SEQ ID NO: 432879 - DNA, 20 bp, Artificial Sequence
  chemically synthesized
ggtaatactcaactcattgg

SEQ ID NO: 432880 - DNA, 20 bp, Artificial Sequence
  chemically synthesized
aacctcatgggtctaccaat

SEQ ID NO: 432881 - DNA, 20 bp, Artificial Sequence
  chemically synthesized
caactcattggtagacccat

SEQ ID NO: 432882 - DNA, 20 bp, Artificial Sequence
  chemically synthesized
aactcattggtagacccatg

SEQ ID NO: 432883 - DNA, 20 bp, Artificial Sequence
  chemically synthesized
ttgtgagagcggaacctcat

SEQ ID NO: 432884 - DNA, 20 bp, Artificial Sequence
  chemically synthesized
cttgtgagagcggaacctca

SEQ ID NO: 432885 - DNA, 20 bp, Artificial Sequence
  chemically synthesized
ccatgaggttccgctctcac

SEQ ID NO: 432886 - DNA, 20 bp, Artificial Sequence
  chemically synthesized
acatactcaacttgtgagag

SEQ ID NO: 432887 - DNA, 20 bp, Artificial Sequence
  chemically synthesized
ggtacatactcaacttgtga

SEQ ID NO: 432888 - DNA, 20 bp, Artificial Sequence
  chemically synthesized
aggttccgctctcacaagtt

SEQ ID NO: 432889 - DNA, 20 bp, Artificial Sequence
  chemically synthesized
tgggtacatactcaacttgt

SEQ ID NO: 432890 - DNA, 20 bp, Artificial Sequence
  chemically synthesized
caagttgagtatgtacccaa

SEQ ID NO: 432891 - DNA, 20 bp, Artificial Sequence
  chemically synthesized
gcttaactaagttagctttt

SEQ ID NO: 432892 - DNA, 20 bp, Artificial Sequence
  chemically synthesized
ggcttaactaagttagcttt

SEQ ID NO: 432893 - DNA, 20 bp, Artificial Sequence
  chemically synthesized
tatgtacccaaaagctaact

SEQ ID NO: 432894 - DNA, 20 bp, Artificial Sequence
  chemically synthesized
tataactggcttaactaagt

SEQ ID NO: 432895 - DNA, 20 bp, Artificial Sequence
  chemically synthesized
acccaaaagctaacttagtt

SEQ ID NO: 432896 - DNA, 20 bp, Artificial Sequence
  chemically synthesized
taattataactggcttaact

SEQ ID NO: 432897 - DNA, 20 bp, Artificial Sequence
  chemically synthesized
aaaagctaacttagttaagc

SEQ ID NO: 432898 - DNA, 20 bp, Artificial Sequence
  chemically synthesized
actctagaaataattataac

SEQ ID NO: 432899 - DNA, 20 bp, Artificial Sequence
  chemically synthesized
aagccagttataattatttc

SEQ ID NO: 432900 - DNA, 20 bp, Artificial Sequence
  chemically synthesized
gccagttataattatttcta

SEQ ID NO: 432901 - DNA, 20 bp, Artificial Sequence
  chemically synthesized
tgataatctttatgtaactc

SEQ ID NO: 432902 - DNA, 20 bp, Artificial Sequence
  chemically synthesized
attatttctagagttacata

SEQ ID NO: 432903 - DNA, 20 bp, Artificial Sequence
  chemically synthesized
ttcatggagcttacattttt

SEQ ID NO: 432904 - DNA, 20 bp, Artificial Sequence
  chemically synthesized
gattatcaactgaaaaatgt

SEQ ID NO: 432905 - DNA, 20 bp, Artificial Sequence
  chemically synthesized
tgaaaaatgtaagctccatg

SEQ ID NO: 432906 - DNA, 20 bp, Artificial Sequence
  chemically synthesized
gcaaagccctcgtcttcatg

SEQ ID NO: 432907 - DNA, 20 bp, Artificial Sequence
  chemically synthesized
aatgtaagctccatgaagac

SEQ ID NO: 432908 - DNA, 20 bp, Artificial Sequence
  chemically synthesized
cggcaaagccctcgtcttca

SEQ ID NO: 432909 - DNA, 20 bp, Artificial Sequence
  chemically synthesized
atgtaagctccatgaagacg

SEQ ID NO: 432910 - DNA, 20 bp, Artificial Sequence
  chemically synthesized
tgtaagctccatgaagacga

SEQ ID NO: 432911 - DNA, 20 bp, Artificial Sequence
  chemically synthesized
ctagttacttgggaacggca

SEQ ID NO: 432912 - DNA, 20 bp, Artificial Sequence
  chemically synthesized
acgagggctttgccgttccc

SEQ ID NO: 432913 - DNA, 20 bp, Artificial Sequence
  chemically synthesized
ctagtctagttacttgggaa

SEQ ID NO: 432914 - DNA, 20 bp, Artificial Sequence
  chemically synthesized
ctttgccgttcccaagtaac

SEQ ID NO: 432915 - DNA, 20 bp, Artificial Sequence
  chemically synthesized
aggatctagtctagttactt

SEQ ID NO: 432916 - DNA, 20 bp, Artificial Sequence
  chemically synthesized
caggatctagtctagttact

SEQ ID NO: 432917 - DNA, 20 bp, Artificial Sequence
  chemically synthesized
ccgttcccaagtaactagac

SEQ ID NO: 432918 - DNA, 20 bp, Artificial Sequence
  chemically synthesized
atattaagcaggatctagtc

SEQ ID NO: 432919 - DNA, 20 bp, Artificial Sequence
  chemically synthesized
aataaatattaagcaggatc

SEQ ID NO: 432920 - DNA, 20 bp, Artificial Sequence
  chemically synthesized
tgacttaataaatattaagc

SEQ ID NO: 432921 - DNA, 20 bp, Artificial Sequence
  chemically synthesized
atgacttaataaatattaag

SEQ ID NO: 432922 - DNA, 20 bp, Artificial Sequence
  chemically synthesized
tgtatgacttaataaatatt

SEQ ID NO: 432923 - DNA, 20 bp, Artificial Sequence
  chemically synthesized
gatcctgcttaatatttatt

SEQ ID NO: 432924 - DNA, 20 bp, Artificial Sequence
  chemically synthesized
attaagtcatacacttacaa

SEQ ID NO: 432925 - DNA, 20 bp, Artificial Sequence
  chemically synthesized
gcataaataaaaacttttgt

SEQ ID NO: 432926 - DNA, 20 bp, Artificial Sequence
  chemically synthesized
tatttctacaacattcagtt

SEQ ID NO: 432927 - DNA, 20 bp, Artificial Sequence
  chemically synthesized
aaaatctaaactgaatgttg

SEQ ID NO: 432928 - DNA, 20 bp, Artificial Sequence
  chemically synthesized
ttgattatttctacaacatt

SEQ ID NO: 432929 - DNA, 20 bp, Artificial Sequence
  chemically synthesized
gtagaaataatcaataaata

SEQ ID NO: 432930 - DNA, 20 bp, Artificial Sequence
  chemically synthesized
tgcaaaatgattcaaatgct

SEQ ID NO: 432931 - DNA, 20 bp, Artificial Sequence
  chemically synthesized
aaatgattcaaatgcttgga

SEQ ID NO: 432932 - DNA, 20 bp, Artificial Sequence
  chemically synthesized
aattttacatttgtctgtcc

SEQ ID NO: 432933 - DNA, 20 bp, Artificial Sequence
  chemically synthesized
ttaaaaataataaaaatctt

SEQ ID NO: 432934 - DNA, 20 bp, Artificial Sequence
  chemically synthesized
gcaatctgcacatagaacta

SEQ ID NO: 432935 - DNA, 20 bp, Artificial Sequence
  chemically synthesized
aaaatctttagttctatgtg

SEQ ID NO: 432936 - DNA, 20 bp, Artificial Sequence
  chemically synthesized
tttgtgaagcaatctgcaca

SEQ ID NO: 432937 - DNA, 20 bp, Artificial Sequence
  chemically synthesized
agaaataaaagatatttgtg

SEQ ID NO: 432938 - DNA, 20 bp, Artificial Sequence
  chemically synthesized
tatatctgaatgagaaataa

SEQ ID NO: 432939 - DNA, 20 bp, Artificial Sequence
  chemically synthesized
aatatcttttatttctcatt

SEQ ID NO: 432940 - DNA, 20 bp, Artificial Sequence
  chemically synthesized
cagtttctttatatctgaat

SEQ ID NO: 432941 - DNA, 20 bp, Artificial Sequence
  chemically synthesized
ttatttctcattcagatata

SEQ ID NO: 432942 - DNA, 20 bp, Artificial Sequence
  chemically synthesized
agatataaagaaactgaaac

SEQ ID NO: 432943 - DNA, 20 bp, Artificial Sequence
  chemically synthesized
taatctataatttccagttt

SEQ ID NO: 432944 - DNA, 20 bp, Artificial Sequence
  chemically synthesized
gaaactgaaactggaaatta

SEQ ID NO: 432945 - DNA, 20 bp, Artificial Sequence
  chemically synthesized
ctagcataatctataatttc

SEQ ID NO: 432946 - DNA, 20 bp, Artificial Sequence
  chemically synthesized
ctggaaattatagattatgc

SEQ ID NO: 432947 - DNA, 20 bp, Artificial Sequence
  chemically synthesized
ttatagattatgctagctat

SEQ ID NO: 432948 - DNA, 20 bp, Artificial Sequence
  chemically synthesized
atagttctattgctcatagc

SEQ ID NO: 432949 - DNA, 20 bp, Artificial Sequence
  chemically synthesized
attatgctagctatgagcaa

SEQ ID NO: 432950 - DNA, 20 bp, Artificial Sequence
  chemically synthesized
gatcatagttctattgctca

SEQ ID NO: 432951 - DNA, 20 bp, Artificial Sequence
  chemically synthesized
gagcaatagaactatgatcc

SEQ ID NO: 432952 - DNA, 20 bp, Artificial Sequence
  chemically synthesized
tacctatgtggcttggatca

SEQ ID NO: 432953 - DNA, 20 bp, Artificial Sequence
  chemically synthesized
gaactatgatccaagccaca

SEQ ID NO: 432954 - DNA, 20 bp, Artificial Sequence
  chemically synthesized
ttaaaattacctatgtggct

SEQ ID NO: 432955 - DNA, 20 bp, Artificial Sequence
  chemically synthesized
aactatgatccaagccacat

SEQ ID NO: 432956 - DNA, 20 bp, Artificial Sequence
  chemically synthesized
acaaattaaaattacctatg

SEQ ID NO: 432957 - DNA, 20 bp, Artificial Sequence
  chemically synthesized
attatttgtaatgtgggtat

SEQ ID NO: 432958 - DNA, 20 bp, Artificial Sequence
  chemically synthesized
tttctcattatttgtaatgt

SEQ ID NO: 432959 - DNA, 20 bp, Artificial Sequence
  chemically synthesized
atttctcattatttgtaatg

SEQ ID NO: 432960 - DNA, 20 bp, Artificial Sequence
  chemically synthesized
atacccacattacaaataat

SEQ ID NO: 432961 - DNA, 20 bp, Artificial Sequence
  chemically synthesized
acattacaaataatgagaaa

SEQ ID NO: 432962 - DNA, 20 bp, Artificial Sequence
  chemically synthesized
cattacaaataatgagaaat

SEQ ID NO: 432963 - DNA, 20 bp, Artificial Sequence
  chemically synthesized
gtaaaatacagtatggatgt

SEQ ID NO: 432964 - DNA, 20 bp, Artificial Sequence
  chemically synthesized
tggttaagtaaaatacagta

SEQ ID NO: 432965 - DNA, 20 bp, Artificial Sequence
  chemically synthesized
ctgtttggttaagtaaaata

SEQ ID NO: 432966 - DNA, 20 bp, Artificial Sequence
  chemically synthesized
ctgtattttacttaaccaaa

SEQ ID NO: 432967 - DNA, 20 bp, Artificial Sequence
  chemically synthesized
tatttgggatctgtttggtt

SEQ ID NO: 432968 - DNA, 20 bp, Artificial Sequence
  chemically synthesized
gatagtatttgggatctgtt

SEQ ID NO: 432969 - DNA, 20 bp, Artificial Sequence
  chemically synthesized
atcttgaaatgatagtattt

SEQ ID NO: 432970 - DNA, 20 bp, Artificial Sequence
  chemically synthesized
catcttgaaatgatagtatt

SEQ ID NO: 432971 - DNA, 20 bp, Artificial Sequence
  chemically synthesized
atcccaaatactatcatttc

SEQ ID NO: 432972 - DNA, 20 bp, Artificial Sequence
  chemically synthesized
tgcgttgcatcttgaaatga

SEQ ID NO: 432973 - DNA, 20 bp, Artificial Sequence
  chemically synthesized
acgcatataaaattattatt

SEQ ID NO: 432974 - DNA, 20 bp, Artificial Sequence
  chemically synthesized
ttagtgtaaaaataatatga

SEQ ID NO: 432975 - DNA, 20 bp, Artificial Sequence
  chemically synthesized
tttcatattatttttacact

SEQ ID NO: 432976 - DNA, 20 bp, Artificial Sequence
  chemically synthesized
cacactggactttgaagact

SEQ ID NO: 432977 - DNA, 20 bp, Artificial Sequence
  chemically synthesized
atttttacactaagtcttca

SEQ ID NO: 432978 - DNA, 20 bp, Artificial Sequence
  chemically synthesized
tacactaagtcttcaaagtc

SEQ ID NO: 432979 - DNA, 20 bp, Artificial Sequence
  chemically synthesized
aaaatacacactggactttg

SEQ ID NO: 432980 - DNA, 20 bp, Artificial Sequence
  chemically synthesized
tataaatgtaaaatacacac

SEQ ID NO: 432981 - DNA, 20 bp, Artificial Sequence
  chemically synthesized
cagtgtgtattttacattta

SEQ ID NO: 432982 - DNA, 20 bp, Artificial Sequence
  chemically synthesized
tgtagctagcatgaattgag

SEQ ID NO: 432983 - DNA, 20 bp, Artificial Sequence
  chemically synthesized
atgtagctagcatgaattga

SEQ ID NO: 432984 - DNA, 20 bp, Artificial Sequence
  chemically synthesized
gaatgtagctagcatgaatt

SEQ ID NO: 432985 - DNA, 20 bp, Artificial Sequence
  chemically synthesized
tagtacctctcaattcatgc

SEQ ID NO: 432986 - DNA, 20 bp, Artificial Sequence
  chemically synthesized
tatggccattggaatgtagc

SEQ ID NO: 432987 - DNA, 20 bp, Artificial Sequence
  chemically synthesized
catctatggccattggaatg

SEQ ID NO: 432988 - DNA, 20 bp, Artificial Sequence
  chemically synthesized
tcatgctagctacattccaa

SEQ ID NO: 432989 - DNA, 20 bp, Artificial Sequence
  chemically synthesized
tagctacattccaatggcca

SEQ ID NO: 432990 - DNA, 20 bp, Artificial Sequence
  chemically synthesized
cacttgccatctatggccat

SEQ ID NO: 432991 - DNA, 20 bp, Artificial Sequence
  chemically synthesized
tacattccaatggccataga

SEQ ID NO: 432992 - DNA, 20 bp, Artificial Sequence
  chemically synthesized
tggtagccacttgccatcta

SEQ ID NO: 432993 - DNA, 20 bp, Artificial Sequence
  chemically synthesized
ttccaatggccatagatggc

SEQ ID NO: 432994 - DNA, 20 bp, Artificial Sequence
  chemically synthesized
caatggccatagatggcaag

SEQ ID NO: 432995 - DNA, 20 bp, Artificial Sequence
  chemically synthesized
ttctgtgaagttcagtatgg

SEQ ID NO: 432996 - DNA, 20 bp, Artificial Sequence
  chemically synthesized
tacttctgtgaagttcagta

SEQ ID NO: 432997 - DNA, 20 bp, Artificial Sequence
  chemically synthesized
ggctaccatactgaacttca

SEQ ID NO: 432998 - DNA, 20 bp, Artificial Sequence
  chemically synthesized
ttgtctacttctgtgaagtt

SEQ ID NO: 432999 - DNA, 20 bp, Artificial Sequence
  chemically synthesized
taccatactgaacttcacag

SEQ ID NO: 433000 - DNA, 20 bp, Artificial Sequence
  chemically synthesized
ccatattgtctacttctgtg

SEQ ID NO: 433001 - DNA, 20 bp, Artificial Sequence
  chemically synthesized
catactgaacttcacagaag

SEQ ID NO: 433002 - DNA, 20 bp, Artificial Sequence
  chemically synthesized
cttcacagaagtagacaata

SEQ ID NO: 433003 - DNA, 20 bp, Artificial Sequence
  chemically synthesized
aatatggatgtgatttctgt

SEQ ID NO: 433004 - DNA, 20 bp, Artificial Sequence
  chemically synthesized
tggatgtgatttctgtaaga

SEQ ID NO: 433005 - DNA, 20 bp, Artificial Sequence
  chemically synthesized
gatgtgatttctgtaagaaa

SEQ ID NO: 433006 - DNA, 20 bp, Artificial Sequence
  chemically synthesized
gattatttttctctttctta

SEQ ID NO: 433007 - DNA, 20 bp, Artificial Sequence
  chemically synthesized
agaaattcacagattagagt

SEQ ID NO: 433008 - DNA, 20 bp, Artificial Sequence
  chemically synthesized
ctacagaaattcacagatta

SEQ ID NO: 433009 - DNA, 20 bp, Artificial Sequence
  chemically synthesized
tactacagaaattcacagat

SEQ ID NO: 433010 - DNA, 20 bp, Artificial Sequence
  chemically synthesized
atacctactacagaaattca

SEQ ID NO: 433011 - DNA, 20 bp, Artificial Sequence
  chemically synthesized
ctctaatctgtgaatttctg

SEQ ID NO: 433012 - DNA, 20 bp, Artificial Sequence
  chemically synthesized
taatctgtgaatttctgtag

SEQ ID NO: 433013 - DNA, 20 bp, Artificial Sequence
  chemically synthesized
aatctgtgaatttctgtagt

SEQ ID NO: 433014 - DNA, 20 bp, Artificial Sequence
  chemically synthesized
cctagacctcatacctacta

SEQ ID NO: 433015 - DNA, 20 bp, Artificial Sequence
  chemically synthesized
tgaatttctgtagtaggtat

SEQ ID NO: 433016 - DNA, 20 bp, Artificial Sequence
  chemically synthesized
gaatttctgtagtaggtatg

SEQ ID NO: 433017 - DNA, 20 bp, Artificial Sequence
  chemically synthesized
tctgtagtaggtatgaggtc

SEQ ID NO: 433018 - DNA, 20 bp, Artificial Sequence
  chemically synthesized
ctgtagtaggtatgaggtct

SEQ ID NO: 433019 - DNA, 20 bp, Artificial Sequence
  chemically synthesized
aaacaaaatgtacatagacc

SEQ ID NO: 433020 - DNA, 20 bp, Artificial Sequence
  chemically synthesized
acggacaaacaaaatgtaca

SEQ ID NO: 433021 - DNA, 20 bp, Artificial Sequence
  chemically synthesized
atgtacattttgtttgtccg

SEQ ID NO: 433022 - DNA, 20 bp, Artificial Sequence
  chemically synthesized
ctggatcaatgggacatcca

SEQ ID NO: 433023 - DNA, 20 bp, Artificial Sequence
  chemically synthesized
ccgtggatgtcccattgatc

SEQ ID NO: 433024 - DNA, 20 bp, Artificial Sequence
  chemically synthesized
acaaatggtgctggatcaat

SEQ ID NO: 433025 - DNA, 20 bp, Artificial Sequence
  chemically synthesized
aacaaatggtgctggatcaa

SEQ ID NO: 433026 - DNA, 20 bp, Artificial Sequence
  chemically synthesized
gtgttttcaacaaatggtgc

SEQ ID NO: 433027 - DNA, 20 bp, Artificial Sequence
  chemically synthesized
agagtagtgttttcaacaaa

SEQ ID NO: 433028 - DNA, 20 bp, Artificial Sequence
  chemically synthesized
taaattcagtggaggaagag

SEQ ID NO: 433029 - DNA, 20 bp, Artificial Sequence
  chemically synthesized
aaataaattcagtggaggaa

SEQ ID NO: 433030 - DNA, 20 bp, Artificial Sequence
  chemically synthesized
caaaataaattcagtggagg

SEQ ID NO: 433031 - DNA, 20 bp, Artificial Sequence
  chemically synthesized
tttcaaaataaattcagtgg

SEQ ID NO: 433032 - DNA, 20 bp, Artificial Sequence
  chemically synthesized
gtttcaaaataaattcagtg

SEQ ID NO: 433033 - DNA, 20 bp, Artificial Sequence
  chemically synthesized
aagtttcaaaataaattcag

SEQ ID NO: 433034 - DNA, 20 bp, Artificial Sequence
  chemically synthesized
acaaagtttcaaaataaatt

SEQ ID NO: 433035 - DNA, 20 bp, Artificial Sequence
  chemically synthesized
tgcccaacatatttttgaca

SEQ ID NO: 433036 - DNA, 20 bp, Artificial Sequence
  chemically synthesized
aaactttgtcaaaaatatgt

SEQ ID NO: 433037 - DNA, 20 bp, Artificial Sequence
  chemically synthesized
aactttgtcaaaaatatgtt

SEQ ID NO: 433038 - DNA, 20 bp, Artificial Sequence
  chemically synthesized
atatgttgggcatatttgtg

SEQ ID NO: 433039 - DNA, 20 bp, Artificial Sequence
  chemically synthesized
tatgttgggcatatttgtgt

SEQ ID NO: 433040 - DNA, 20 bp, Artificial Sequence
  chemically synthesized
tatttgtgtgggtatgtttc

SEQ ID NO: 433041 - DNA, 20 bp, Artificial Sequence
  chemically synthesized
attgaacagaataaagagtc

SEQ ID NO: 433042 - DNA, 20 bp, Artificial Sequence
  chemically synthesized
gatcaattgaacagaataaa

SEQ ID NO: 433043 - DNA, 20 bp, Artificial Sequence
  chemically synthesized
tagatcaattgaacagaata

SEQ ID NO: 433044 - DNA, 20 bp, Artificial Sequence
  chemically synthesized
tgacacatagatcaattgaa

SEQ ID NO: 433045 - DNA, 20 bp, Artificial Sequence
  chemically synthesized
ttgtcagaaggattgacaca

SEQ ID NO: 433046 - DNA, 20 bp, Artificial Sequence
  chemically synthesized
tattgtgttatattgtcaga

SEQ ID NO: 433047 - DNA, 20 bp, Artificial Sequence
  chemically synthesized
atattgtgttatattgtcag

SEQ ID NO: 433048 - DNA, 20 bp, Artificial Sequence
  chemically synthesized
caaatattgtgttatattgt

SEQ ID NO: 433049 - DNA, 20 bp, Artificial Sequence
  chemically synthesized
taacacaatatttgttgctg

SEQ ID NO: 433050 - DNA, 20 bp, Artificial Sequence
  chemically synthesized
taaaacttaccacataacca

SEQ ID NO: 433051 - DNA, 20 bp, Artificial Sequence
  chemically synthesized
tatttgttgctgtggttatg

SEQ ID NO: 433052 - DNA, 20 bp, Artificial Sequence
  chemically synthesized
tgttgctgtggttatgtggt

SEQ ID NO: 433053 - DNA, 20 bp, Artificial Sequence
  chemically synthesized
tatgtggtaagttttaaaat

SEQ ID NO: 433054 - DNA, 20 bp, Artificial Sequence
  chemically synthesized
aaaatcagatcttattgtat

SEQ ID NO: 433055 - DNA, 20 bp, Artificial Sequence
  chemically synthesized
tgttgttaagcttatacaat

SEQ ID NO: 433056 - DNA, 20 bp, Artificial Sequence
  chemically synthesized
cagtaacattatatgttgtt

SEQ ID NO: 433057 - DNA, 20 bp, Artificial Sequence
  chemically synthesized
aattgcggaagttatcattt

SEQ ID NO: 433058 - DNA, 20 bp, Artificial Sequence
  chemically synthesized
gttttttccccaaattgcgg

SEQ ID NO: 433059 - DNA, 20 bp, Artificial Sequence
  chemically synthesized
aaatgataacttccgcaatt

SEQ ID NO: 433060 - DNA, 20 bp, Artificial Sequence
  chemically synthesized
aatgataacttccgcaattt

SEQ ID NO: 433061 - DNA, 20 bp, Artificial Sequence
  chemically synthesized
atgataacttccgcaatttg

SEQ ID NO: 433062 - DNA, 20 bp, Artificial Sequence
  chemically synthesized
tctgttttttccccaaattg

SEQ ID NO: 433063 - DNA, 20 bp, Artificial Sequence
  chemically synthesized
tccgcaatttggggaaaaaa

SEQ ID NO: 433064 - DNA, 20 bp, Artificial Sequence
  chemically synthesized
aatttggggaaaaaacagac

SEQ ID NO: 433065 - DNA, 20 bp, Artificial Sequence
  chemically synthesized
tggggaaaaaacagaccaga

SEQ ID NO: 433066 - DNA, 20 bp, Artificial Sequence
  chemically synthesized
aaaggagtgttcaatccatc

SEQ ID NO: 433067 - DNA, 20 bp, Artificial Sequence
  chemically synthesized
gagagagagagagtttaaag

SEQ ID NO: 433068 - DNA, 20 bp, Artificial Sequence
  chemically synthesized
gagagagagagagagtttaa

SEQ ID NO: 433069 - DNA, 20 bp, Artificial Sequence
  chemically synthesized
agagagagagagagagttta

SEQ ID NO: 433070 - DNA, 20 bp, Artificial Sequence
  chemically synthesized
acagctgagagagagagaga

SEQ ID NO: 433071 - DNA, 20 bp, Artificial Sequence
  chemically synthesized
agacagctgagagagagaga

SEQ ID NO: 433072 - DNA, 20 bp, Artificial Sequence
  chemically synthesized
ttagacagctgagagagaga

SEQ ID NO: 433073 - DNA, 20 bp, Artificial Sequence
  chemically synthesized
taaactctctctctctctct

SEQ ID NO: 433074 - DNA, 20 bp, Artificial Sequence
  chemically synthesized
atttagacagctgagagaga

SEQ ID NO: 433075 - DNA, 20 bp, Artificial Sequence
  chemically synthesized
gcatttagacagctgagaga

SEQ ID NO: 433076 - DNA, 20 bp, Artificial Sequence
  chemically synthesized
aggcatttagacagctgaga

SEQ ID NO: 433077 - DNA, 20 bp, Artificial Sequence
  chemically synthesized
tgaggcatttagacagctga

SEQ ID NO: 433078 - DNA, 20 bp, Artificial Sequence
  chemically synthesized
tttgaggcatttagacagct

SEQ ID NO: 433079 - DNA, 20 bp, Artificial Sequence
  chemically synthesized
tccattttgaggcatttaga

SEQ ID NO: 433080 - DNA, 20 bp, Artificial Sequence
  chemically synthesized
aatttccattttgaggcatt

SEQ ID NO: 433081 - DNA, 20 bp, Artificial Sequence
  chemically synthesized
gctgtctaaatgcctcaaaa

SEQ ID NO: 433082 - DNA, 20 bp, Artificial Sequence
  chemically synthesized
tctgttgaatttccattttg

SEQ ID NO: 433083 - DNA, 20 bp, Artificial Sequence
  chemically synthesized
atctgttgaatttccatttt

SEQ ID NO: 433084 - DNA, 20 bp, Artificial Sequence
  chemically synthesized
gcctcaaaatggaaattcaa

SEQ ID NO: 433085 - DNA, 20 bp, Artificial Sequence
  chemically synthesized
aaaatggaaattcaacagat

SEQ ID NO: 433086 - DNA, 20 bp, Artificial Sequence
  chemically synthesized
aatggaaattcaacagatga

SEQ ID NO: 433087 - DNA, 20 bp, Artificial Sequence
  chemically synthesized
acagatgagagcttcttatt

SEQ ID NO: 433088 - DNA, 20 bp, Artificial Sequence
  chemically synthesized
acttcccctttctcaataag

SEQ ID NO: 433089 - DNA, 20 bp, Artificial Sequence
  chemically synthesized
atgagagcttcttattgaga

SEQ ID NO: 433090 - DNA, 20 bp, Artificial Sequence
  chemically synthesized
actacttcccctttctcaat

SEQ ID NO: 433091 - DNA, 20 bp, Artificial Sequence
  chemically synthesized
tgagagcttcttattgagaa

SEQ ID NO: 433092 - DNA, 20 bp, Artificial Sequence
  chemically synthesized
gagagcttcttattgagaaa

SEQ ID NO: 433093 - DNA, 20 bp, Artificial Sequence
  chemically synthesized
agagcttcttattgagaaag

SEQ ID NO: 433094 - DNA, 20 bp, Artificial Sequence
  chemically synthesized
gcttcttattgagaaagggg

SEQ ID NO: 433095 - DNA, 20 bp, Artificial Sequence
  chemically synthesized
tcttattgagaaaggggaag

SEQ ID NO: 433096 - DNA, 20 bp, Artificial Sequence
  chemically synthesized
tattgagaaaggggaagtag

SEQ ID NO: 433097 - DNA, 20 bp, Artificial Sequence
  chemically synthesized
attgagaaaggggaagtagt

SEQ ID NO: 433098 - DNA, 20 bp, Artificial Sequence
  chemically synthesized
ttgagaaaggggaagtagta

SEQ ID NO: 433099 - DNA, 20 bp, Artificial Sequence
  chemically synthesized
tgagaaaggggaagtagtag

SEQ ID NO: 433100 - DNA, 20 bp, Artificial Sequence
  chemically synthesized
aaccagagaggtggtcaaaa

SEQ ID NO: 433101 - DNA, 20 bp, Artificial Sequence
  chemically synthesized
atctattttgaccacctctc

SEQ ID NO: 433102 - DNA, 20 bp, Artificial Sequence
  chemically synthesized
gaggtttcaaaccagagagg

SEQ ID NO: 433103 - DNA, 20 bp, Artificial Sequence
  chemically synthesized
ccagaggtttcaaaccagag

SEQ ID NO: 433104 - DNA, 20 bp, Artificial Sequence
  chemically synthesized
cccagaggtttcaaaccaga

SEQ ID NO: 433105 - DNA, 20 bp, Artificial Sequence
  chemically synthesized
cccccagaggtttcaaacca

SEQ ID NO: 433106 - DNA, 20 bp, Artificial Sequence
  chemically synthesized
aacccccagaggtttcaaac

SEQ ID NO: 433107 - DNA, 20 bp, Artificial Sequence
  chemically synthesized
cctctctggtttgaaacctc

SEQ ID NO: 433108 - DNA, 20 bp, Artificial Sequence
  chemically synthesized
ctctctggtttgaaacctct

SEQ ID NO: 433109 - DNA, 20 bp, Artificial Sequence
  chemically synthesized
tctctggtttgaaacctctg

SEQ ID NO: 433110 - DNA, 20 bp, Artificial Sequence
  chemically synthesized
ctctggtttgaaacctctgg

SEQ ID NO: 433111 - DNA, 20 bp, Artificial Sequence
  chemically synthesized
cttttctcttaaacccccag

SEQ ID NO: 433112 - DNA, 20 bp, Artificial Sequence
  chemically synthesized
ccttttctcttaaaccccca

SEQ ID NO: 433113 - DNA, 20 bp, Artificial Sequence
  chemically synthesized
tttgaaacctctgggggttt

SEQ ID NO: 433114 - DNA, 20 bp, Artificial Sequence
  chemically synthesized
ctccttttctcttaaacccc

SEQ ID NO: 433115 - DNA, 20 bp, Artificial Sequence
  chemically synthesized
tgaaacctctgggggtttaa

SEQ ID NO: 433116 - DNA, 20 bp, Artificial Sequence
  chemically synthesized
cctctgggggtttaagagaa

SEQ ID NO: 433117 - DNA, 20 bp, Artificial Sequence
  chemically synthesized
ctctgggggtttaagagaaa

SEQ ID NO: 433118 - DNA, 20 bp, Artificial Sequence
  chemically synthesized
ctgggggtttaagagaaaag

SEQ ID NO: 433119 - DNA, 20 bp, Artificial Sequence
  chemically synthesized
tttaagagaaaaggagattc

SEQ ID NO: 433120 - DNA, 20 bp, Artificial Sequence
  chemically synthesized
agaaaaggagattcaagata

SEQ ID NO: 433121 - DNA, 20 bp, Artificial Sequence
  chemically synthesized
aggagattcaagatatggct

SEQ ID NO: 433122 - DNA, 20 bp, Artificial Sequence
  chemically synthesized
gtagcattaacattaaaact

SEQ ID NO: 433123 - DNA, 20 bp, Artificial Sequence
  chemically synthesized
tagttttaatgttaatgcta

SEQ ID NO: 433124 - DNA, 20 bp, Artificial Sequence
  chemically synthesized
ttttaatgttaatgctacag

SEQ ID NO: 433125 - DNA, 20 bp, Artificial Sequence
  chemically synthesized
aagtcccagctgtactactg

SEQ ID NO: 433126 - DNA, 20 bp, Artificial Sequence
  chemically synthesized
atgttaatgctacagtagta

SEQ ID NO: 433127 - DNA, 20 bp, Artificial Sequence
  chemically synthesized
taatgctacagtagtacagc

SEQ ID NO: 433128 - DNA, 20 bp, Artificial Sequence
  chemically synthesized
aatgctacagtagtacagct

SEQ ID NO: 433129 - DNA, 20 bp, Artificial Sequence
  chemically synthesized
agtaaatgtaggacaagtcc

SEQ ID NO: 433130 - DNA, 20 bp, Artificial Sequence
  chemically synthesized
gttctcagtaaatgtaggac

SEQ ID NO: 433131 - DNA, 20 bp, Artificial Sequence
  chemically synthesized
ttagagttctcagtaaatgt

SEQ ID NO: 433132 - DNA, 20 bp, Artificial Sequence
  chemically synthesized
attagagttctcagtaaatg

SEQ ID NO: 433133 - DNA, 20 bp, Artificial Sequence
  chemically synthesized
ggacttgtcctacatttact

SEQ ID NO: 433134 - DNA, 20 bp, Artificial Sequence
  chemically synthesized
ttttcgtaaattagagttct

SEQ ID NO: 433135 - DNA, 20 bp, Artificial Sequence
  chemically synthesized
gatctagttttcgtaaatta

SEQ ID NO: 433136 - DNA, 20 bp, Artificial Sequence
  chemically synthesized
aggatctagttttcgtaaat

SEQ ID NO: 433137 - DNA, 20 bp, Artificial Sequence
  chemically synthesized
gaactctaatttacgaaaac

SEQ ID NO: 433138 - DNA, 20 bp, Artificial Sequence
  chemically synthesized
aatttacgaaaactagatcc

SEQ ID NO: 433139 - DNA, 20 bp, Artificial Sequence
  chemically synthesized
gctttcagaatgctaggatc

SEQ ID NO: 433140 - DNA, 20 bp, Artificial Sequence
  chemically synthesized
aaatctgctttcagaatgct

SEQ ID NO: 433141 - DNA, 20 bp, Artificial Sequence
  chemically synthesized
caaatctgctttcagaatgc

SEQ ID NO: 433142 - DNA, 20 bp, Artificial Sequence
  chemically synthesized
actagatcctagcattctga

SEQ ID NO: 433143 - DNA, 20 bp, Artificial Sequence
  chemically synthesized
agatcctagcattctgaaag

SEQ ID NO: 433144 - DNA, 20 bp, Artificial Sequence
  chemically synthesized
agaggtctcaaatctgcttt

SEQ ID NO: 433145 - DNA, 20 bp, Artificial Sequence
  chemically synthesized
agcattctgaaagcagattt

SEQ ID NO: 433146 - DNA, 20 bp, Artificial Sequence
  chemically synthesized
aagcagatttgagacctcta

SEQ ID NO: 433147 - DNA, 20 bp, Artificial Sequence
  chemically synthesized
tgtaaaagaaatagctttag

SEQ ID NO: 433148 - DNA, 20 bp, Artificial Sequence
  chemically synthesized
ctgtaaaagaaatagcttta

SEQ ID NO: 433149 - DNA, 20 bp, Artificial Sequence
  chemically synthesized
aactgtaaaagaaatagctt

SEQ ID NO: 433150 - DNA, 20 bp, Artificial Sequence
  chemically synthesized
ggaaaaaactgtaaaagaaa

SEQ ID NO: 433151 - DNA, 20 bp, Artificial Sequence
  chemically synthesized
ctctaaagctatttctttta

SEQ ID NO: 433152 - DNA, 20 bp, Artificial Sequence
  chemically synthesized
aaaggtggaaaaaactgtaa

SEQ ID NO: 433153 - DNA, 20 bp, Artificial Sequence
  chemically synthesized
tttacagttttttccacctt

SEQ ID NO: 433154 - DNA, 20 bp, Artificial Sequence
  chemically synthesized
caatagactgcaaccaaagg

SEQ ID NO: 433155 - DNA, 20 bp, Artificial Sequence
  chemically synthesized
gttttttccacctttggttg

SEQ ID NO: 433156 - DNA, 20 bp, Artificial Sequence
  chemically synthesized
atacaatagactgcaaccaa

SEQ ID NO: 433157 - DNA, 20 bp, Artificial Sequence
  chemically synthesized
aatacaatagactgcaacca

SEQ ID NO: 433158 - DNA, 20 bp, Artificial Sequence
  chemically synthesized
aaagaatcaggacaatacaa

SEQ ID NO: 433159 - DNA, 20 bp, Artificial Sequence
  chemically synthesized
agtaggtgaaaaaaagaatc

SEQ ID NO: 433160 - DNA, 20 bp, Artificial Sequence
  chemically synthesized
gagtaggtgaaaaaaagaat

SEQ ID NO: 433161 - DNA, 20 bp, Artificial Sequence
  chemically synthesized
acctacgagtaggtgaaaaa

SEQ ID NO: 433162 - DNA, 20 bp, Artificial Sequence
  chemically synthesized
ttctttttttcacctactcg

SEQ ID NO: 433163 - DNA, 20 bp, Artificial Sequence
  chemically synthesized
tctttttttcacctactcgt

SEQ ID NO: 433164 - DNA, 20 bp, Artificial Sequence
  chemically synthesized
attaagaataacctacgagt

SEQ ID NO: 433165 - DNA, 20 bp, Artificial Sequence
  chemically synthesized
gattaagaataacctacgag

SEQ ID NO: 433166 - DNA, 20 bp, Artificial Sequence
  chemically synthesized
agtgattaagaataacctac

SEQ ID NO: 433167 - DNA, 20 bp, Artificial Sequence
  chemically synthesized
gtggttggtttcaagtgatt

SEQ ID NO: 433168 - DNA, 20 bp, Artificial Sequence
  chemically synthesized
acatagaagtggttggtttc

SEQ ID NO: 433169 - DNA, 20 bp, Artificial Sequence
  chemically synthesized
atcatatacatagaagtggt

SEQ ID NO: 433170 - DNA, 20 bp, Artificial Sequence
  chemically synthesized
aaaaatcatatacatagaag

SEQ ID NO: 433171 - DNA, 20 bp, Artificial Sequence
  chemically synthesized
agcaaaaatcatatacatag

SEQ ID NO: 433172 - DNA, 20 bp, Artificial Sequence
  chemically synthesized
ggaagcaaaaatcatataca

SEQ ID NO: 433173 - DNA, 20 bp, Artificial Sequence
  chemically synthesized
agggatctgtgagggaaagg

SEQ ID NO: 433174 - DNA, 20 bp, Artificial Sequence
  chemically synthesized
ctgagggatctgtgagggaa

SEQ ID NO: 433175 - DNA, 20 bp, Artificial Sequence
  chemically synthesized
tttttgcttcctttccctca

SEQ ID NO: 433176 - DNA, 20 bp, Artificial Sequence
  chemically synthesized
cctgagggatctgtgaggga

SEQ ID NO: 433177 - DNA, 20 bp, Artificial Sequence
  chemically synthesized
ggtacctgagggatctgtga

SEQ ID NO: 433178 - DNA, 20 bp, Artificial Sequence
  chemically synthesized
gggtacctgagggatctgtg

SEQ ID NO: 433179 - DNA, 20 bp, Artificial Sequence
  chemically synthesized
agggtacctgagggatctgt

SEQ ID NO: 433180 - DNA, 20 bp, Artificial Sequence
  chemically synthesized
cctttccctcacagatccct

SEQ ID NO: 433181 - DNA, 20 bp, Artificial Sequence
  chemically synthesized
ctttccctcacagatccctc

SEQ ID NO: 433182 - DNA, 20 bp, Artificial Sequence
  chemically synthesized
gtataagacagggtacctga

SEQ ID NO: 433183 - DNA, 20 bp, Artificial Sequence
  chemically synthesized
agtataagacagggtacctg

SEQ ID NO: 433184 - DNA, 20 bp, Artificial Sequence
  chemically synthesized
aagtataagacagggtacct

SEQ ID NO: 433185 - DNA, 20 bp, Artificial Sequence
  chemically synthesized
cttactaaaagtataagaca

SEQ ID NO: 433186 - DNA, 20 bp, Artificial Sequence
  chemically synthesized
acttactaaaagtataagac

SEQ ID NO: 433187 - DNA, 20 bp, Artificial Sequence
  chemically synthesized
gacttactaaaagtataaga

SEQ ID NO: 433188 - DNA, 20 bp, Artificial Sequence
  chemically synthesized
ggtaccctgtcttatacttt

SEQ ID NO: 433189 - DNA, 20 bp, Artificial Sequence
  chemically synthesized
gcatgacttactaaaagtat

SEQ ID NO: 433190 - DNA, 20 bp, Artificial Sequence
  chemically synthesized
ccctgtcttatacttttagt

SEQ ID NO: 433191 - DNA, 20 bp, Artificial Sequence
  chemically synthesized
tattttgcatgacttactaa

SEQ ID NO: 433192 - DNA, 20 bp, Artificial Sequence
  chemically synthesized
gtaagtcatgcaaaataatt

SEQ ID NO: 433193 - DNA, 20 bp, Artificial Sequence
  chemically synthesized
atgcaaaataattgagaaat

SEQ ID NO: 433194 - DNA, 20 bp, Artificial Sequence
  chemically synthesized
cactctaatttaataaaatg

SEQ ID NO: 433195 - DNA, 20 bp, Artificial Sequence
  chemically synthesized
attgctgcattttattaaat

SEQ ID NO: 433196 - DNA, 20 bp, Artificial Sequence
  chemically synthesized
tgctgcattttattaaatta

SEQ ID NO: 433197 - DNA, 20 bp, Artificial Sequence
  chemically synthesized
tgcattttattaaattagag

SEQ ID NO: 433198 - DNA, 20 bp, Artificial Sequence
  chemically synthesized
ttttattaaattagagtggt

SEQ ID NO: 433199 - DNA, 20 bp, Artificial Sequence
  chemically synthesized
gtcagatatacttttactga

SEQ ID NO: 433200 - DNA, 20 bp, Artificial Sequence
  chemically synthesized
atccaaatctctgtcagtaa

SEQ ID NO: 433201 - DNA, 20 bp, Artificial Sequence
  chemically synthesized
cagatatacttttactgaca

SEQ ID NO: 433202 - DNA, 20 bp, Artificial Sequence
  chemically synthesized
agtaaaatccaaatctctgt

SEQ ID NO: 433203 - DNA, 20 bp, Artificial Sequence
  chemically synthesized
tacttttactgacagagatt

SEQ ID NO: 433204 - DNA, 20 bp, Artificial Sequence
  chemically synthesized
ctctctcttctgtttcaaga

SEQ ID NO: 433205 - DNA, 20 bp, Artificial Sequence
  chemically synthesized
tggattttactgtcttgaaa

SEQ ID NO: 433206 - DNA, 20 bp, Artificial Sequence
  chemically synthesized
attttactgtcttgaaacag

SEQ ID NO: 433207 - DNA, 20 bp, Artificial Sequence
  chemically synthesized
tttgctctctcttctgtttc

SEQ ID NO: 433208 - DNA, 20 bp, Artificial Sequence
  chemically synthesized
tttactgtcttgaaacagaa

SEQ ID NO: 433209 - DNA, 20 bp, Artificial Sequence
  chemically synthesized
tactgtcttgaaacagaaga

SEQ ID NO: 433210 - DNA, 20 bp, Artificial Sequence
  chemically synthesized
ctgtcttgaaacagaagaga

SEQ ID NO: 433211 - DNA, 20 bp, Artificial Sequence
  chemically synthesized
aaacagaagagagagcaaaa

SEQ ID NO: 433212 - DNA, 20 bp, Artificial Sequence
  chemically synthesized
gaagagagagcaaaatggtt

SEQ ID NO: 433213 - DNA, 20 bp, Artificial Sequence
  chemically synthesized
gagagagcaaaatggttaag

SEQ ID NO: 433214 - DNA, 20 bp, Artificial Sequence
  chemically synthesized
agagagcaaaatggttaaga

SEQ ID NO: 433215 - DNA, 20 bp, Artificial Sequence
  chemically synthesized
aaaatggttaagaaggtgat

SEQ ID NO: 433216 - DNA, 20 bp, Artificial Sequence
  chemically synthesized
aggcactgttacataaatgt

SEQ ID NO: 433217 - DNA, 20 bp, Artificial Sequence
  chemically synthesized
atgaactgacatttatgtaa

SEQ ID NO: 433218 - DNA, 20 bp, Artificial Sequence
  chemically synthesized
ccaaccatatattaataata

SEQ ID NO: 433219 - DNA, 20 bp, Artificial Sequence
  chemically synthesized
accaaccatatattaataat

SEQ ID NO: 433220 - DNA, 20 bp, Artificial Sequence
  chemically synthesized
agtgccttattattaatata

SEQ ID NO: 433221 - DNA, 20 bp, Artificial Sequence
  chemically synthesized
ccttattattaatatatggt

SEQ ID NO: 433222 - DNA, 20 bp, Artificial Sequence
  chemically synthesized
ctctcaaagggtacaaagca

SEQ ID NO: 433223 - DNA, 20 bp, Artificial Sequence
  chemically synthesized
aatatctctcaaagggtaca

SEQ ID NO: 433224 - DNA, 20 bp, Artificial Sequence
  chemically synthesized
tgctgtgctttgtacccttt

SEQ ID NO: 433225 - DNA, 20 bp, Artificial Sequence
  chemically synthesized
ctgtgctttgtaccctttga

SEQ ID NO: 433226 - DNA, 20 bp, Artificial Sequence
  chemically synthesized
atcacaaaatatctctcaaa

SEQ ID NO: 433227 - DNA, 20 bp, Artificial Sequence
  chemically synthesized
gatcacaaaatatctctcaa

SEQ ID NO: 433228 - DNA, 20 bp, Artificial Sequence
  chemically synthesized
ggatcacaaaatatctctca

SEQ ID NO: 433229 - DNA, 20 bp, Artificial Sequence
  chemically synthesized
tattttgtgatccaatttta

SEQ ID NO: 433230 - DNA, 20 bp, Artificial Sequence
  chemically synthesized
ccttttcctatctataaaat

SEQ ID NO: 433231 - DNA, 20 bp, Artificial Sequence
  chemically synthesized
ttgtgatccaattttataga

SEQ ID NO: 433232 - DNA, 20 bp, Artificial Sequence
  chemically synthesized
tgtgatccaattttatagat

SEQ ID NO: 433233 - DNA, 20 bp, Artificial Sequence
  chemically synthesized
tccaattttatagataggaa

SEQ ID NO: 433234 - DNA, 20 bp, Artificial Sequence
  chemically synthesized
ccaattttatagataggaaa

SEQ ID NO: 433235 - DNA, 20 bp, Artificial Sequence
  chemically synthesized
gttccaaaactgaatattta

SEQ ID NO: 433236 - DNA, 20 bp, Artificial Sequence
  chemically synthesized
gaaaaggatctctaaatatt

SEQ ID NO: 433237 - DNA, 20 bp, Artificial Sequence
  chemically synthesized
cagttccaaaactgaatatt

SEQ ID NO: 433238 - DNA, 20 bp, Artificial Sequence
  chemically synthesized
gatctctaaatattcagttt

SEQ ID NO: 433239 - DNA, 20 bp, Artificial Sequence
  chemically synthesized
ggatgacctggttagaacat

SEQ ID NO: 433240 - DNA, 20 bp, Artificial Sequence
  chemically synthesized
tttggaactgatgttctaac

SEQ ID NO: 433241 - DNA, 20 bp, Artificial Sequence
  chemically synthesized
ttggaactgatgttctaacc

SEQ ID NO: 433242 - DNA, 20 bp, Artificial Sequence
  chemically synthesized
tcaagtcaggatgacctggt

SEQ ID NO: 433243 - DNA, 20 bp, Artificial Sequence
  chemically synthesized
aatttcaagtcaggatgacc

SEQ ID NO: 433244 - DNA, 20 bp, Artificial Sequence
  chemically synthesized
atcacctgaaatttcaagtc

SEQ ID NO: 433245 - DNA, 20 bp, Artificial Sequence
  chemically synthesized
aatcacctgaaatttcaagt

SEQ ID NO: 433246 - DNA, 20 bp, Artificial Sequence
  chemically synthesized
gtcatcctgacttgaaattt

SEQ ID NO: 433247 - DNA, 20 bp, Artificial Sequence
  chemically synthesized
agggaatcacctgaaatttc

SEQ ID NO: 433248 - DNA, 20 bp, Artificial Sequence
  chemically synthesized
tcatcctgacttgaaatttc

SEQ ID NO: 433249 - DNA, 20 bp, Artificial Sequence
  chemically synthesized
tgcgtcaagatgcatcatga

SEQ ID NO: 433250 - DNA, 20 bp, Artificial Sequence
  chemically synthesized
ttgcgtcaagatgcatcatg

SEQ ID NO: 433251 - DNA, 20 bp, Artificial Sequence
  chemically synthesized
tttgcgtcaagatgcatcat

SEQ ID NO: 433252 - DNA, 20 bp, Artificial Sequence
  chemically synthesized
gtacattttttgtttgcgtc

SEQ ID NO: 433253 - DNA, 20 bp, Artificial Sequence
  chemically synthesized
cacatttataataatatatt

SEQ ID NO: 433254 - DNA, 20 bp, Artificial Sequence
  chemically synthesized
gaatatattattataaatgt

SEQ ID NO: 433255 - DNA, 20 bp, Artificial Sequence
  chemically synthesized
ttattataaatgtgagtaac

SEQ ID NO: 433256 - DNA, 20 bp, Artificial Sequence
  chemically synthesized
tcttctttcccatgcatttc

SEQ ID NO: 433257 - DNA, 20 bp, Artificial Sequence
  chemically synthesized
tgtgagtaactagaaatgca

SEQ ID NO: 433258 - DNA, 20 bp, Artificial Sequence
  chemically synthesized
gtgagtaactagaaatgcat

SEQ ID NO: 433259 - DNA, 20 bp, Artificial Sequence
  chemically synthesized
gtaactagaaatgcatggga

SEQ ID NO: 433260 - DNA, 20 bp, Artificial Sequence
  chemically synthesized
actagaaatgcatgggaaag

SEQ ID NO: 433261 - DNA, 20 bp, Artificial Sequence
  chemically synthesized
tagaaatgcatgggaaagaa

SEQ ID NO: 433262 - DNA, 20 bp, Artificial Sequence
  chemically synthesized
agaaatgcatgggaaagaag

SEQ ID NO: 433263 - DNA, 20 bp, Artificial Sequence
  chemically synthesized
gaaatgcatgggaaagaaga

SEQ ID NO: 433264 - DNA, 20 bp, Artificial Sequence
  chemically synthesized
aaatgcatgggaaagaagag

SEQ ID NO: 433265 - DNA, 20 bp, Artificial Sequence
  chemically synthesized
atgcatgggaaagaagaggg

SEQ ID NO: 433266 - DNA, 20 bp, Artificial Sequence
  chemically synthesized
tgcatgggaaagaagagggg

SEQ ID NO: 433267 - DNA, 20 bp, Artificial Sequence
  chemically synthesized
gggaaagaagaggggaggaa

SEQ ID NO: 433268 - DNA, 20 bp, Artificial Sequence
  chemically synthesized
gaaagaagaggggaggaaaa

SEQ ID NO: 433269 - DNA, 20 bp, Artificial Sequence
  chemically synthesized
gaggggaggaaaagagtaaa

SEQ ID NO: 433270 - DNA, 20 bp, Artificial Sequence
  chemically synthesized
aggggaggaaaagagtaaaa

SEQ ID NO: 433271 - DNA, 20 bp, Artificial Sequence
  chemically synthesized
gtattcaacaaacctttatt

SEQ ID NO: 433272 - DNA, 20 bp, Artificial Sequence
  chemically synthesized
atataatagacactcaataa

SEQ ID NO: 433273 - DNA, 20 bp, Artificial Sequence
  chemically synthesized
catataatagacactcaata

SEQ ID NO: 433274 - DNA, 20 bp, Artificial Sequence
  chemically synthesized
tttattgagtgtctattata

SEQ ID NO: 433275 - DNA, 20 bp, Artificial Sequence
  chemically synthesized
gaacatagccagccatataa

SEQ ID NO: 433276 - DNA, 20 bp, Artificial Sequence
  chemically synthesized
ttgagtgtctattatatggc

SEQ ID NO: 433277 - DNA, 20 bp, Artificial Sequence
  chemically synthesized
tccagtacctagaacatagc

SEQ ID NO: 433278 - DNA, 20 bp, Artificial Sequence
  chemically synthesized
ttatatggctggctatgttc

SEQ ID NO: 433279 - DNA, 20 bp, Artificial Sequence
  chemically synthesized
tatatggctggctatgttct

SEQ ID NO: 433280 - DNA, 20 bp, Artificial Sequence
  chemically synthesized
cacctccagtacctagaaca

SEQ ID NO: 433281 - DNA, 20 bp, Artificial Sequence
  chemically synthesized
gctggctatgttctaggtac

SEQ ID NO: 433282 - DNA, 20 bp, Artificial Sequence
  chemically synthesized
tggctatgttctaggtactg

SEQ ID NO: 433283 - DNA, 20 bp, Artificial Sequence
  chemically synthesized
gttaccacacctccagtacc

SEQ ID NO: 433284 - DNA, 20 bp, Artificial Sequence
  chemically synthesized
ggctatgttctaggtactgg

SEQ ID NO: 433285 - DNA, 20 bp, Artificial Sequence
  chemically synthesized
tgttctaggtactggaggtg

SEQ ID NO: 433286 - DNA, 20 bp, Artificial Sequence
  chemically synthesized
ttcccaagttaccacacctc

SEQ ID NO: 433287 - DNA, 20 bp, Artificial Sequence
  chemically synthesized
gtactggaggtgtggtaact

SEQ ID NO: 433288 - DNA, 20 bp, Artificial Sequence
  chemically synthesized
tactggaggtgtggtaactt

SEQ ID NO: 433289 - DNA, 20 bp, Artificial Sequence
  chemically synthesized
tatgttgataaaattttccc

SEQ ID NO: 433290 - DNA, 20 bp, Artificial Sequence
  chemically synthesized
aattttatcaacatatatta

SEQ ID NO: 433291 - DNA, 20 bp, Artificial Sequence
  chemically synthesized
aagtatggcggggaattatg

SEQ ID NO: 433292 - DNA, 20 bp, Artificial Sequence
  chemically synthesized
aaggaaataaaagtatggcg

SEQ ID NO: 433293 - DNA, 20 bp, Artificial Sequence
  chemically synthesized
aaaggaaataaaagtatggc

SEQ ID NO: 433294 - DNA, 20 bp, Artificial Sequence
  chemically synthesized
caaaggaaataaaagtatgg

SEQ ID NO: 433295 - DNA, 20 bp, Artificial Sequence
  chemically synthesized
attcaaaggaaataaaagta

SEQ ID NO: 433296 - DNA, 20 bp, Artificial Sequence
  chemically synthesized
tgtgaattcaaaggaaataa

SEQ ID NO: 433297 - DNA, 20 bp, Artificial Sequence
  chemically synthesized
aatggaaactgtgaattcaa

SEQ ID NO: 433298 - DNA, 20 bp, Artificial Sequence
  chemically synthesized
taatggaaactgtgaattca

SEQ ID NO: 433299 - DNA, 20 bp, Artificial Sequence
  chemically synthesized
ttttatttcctttgaattca

SEQ ID NO: 433300 - DNA, 20 bp, Artificial Sequence
  chemically synthesized
aactcaataaattattttaa

SEQ ID NO: 433301 - DNA, 20 bp, Artificial Sequence
  chemically synthesized
ttccattaaaataatttatt

SEQ ID NO: 433302 - DNA, 20 bp, Artificial Sequence
  chemically synthesized
taaaataatttattgagtta

SEQ ID NO: 433303 - DNA, 20 bp, Artificial Sequence
  chemically synthesized
taatttattgagttaaagcc

SEQ ID NO: 433304 - DNA, 20 bp, Artificial Sequence
  chemically synthesized
atttattgagttaaagccta

SEQ ID NO: 433305 - DNA, 20 bp, Artificial Sequence
  chemically synthesized
ttgagttaaagcctagagca

SEQ ID NO: 433306 - DNA, 20 bp, Artificial Sequence
  chemically synthesized
aagttgcctgtctatgctct

SEQ ID NO: 433307 - DNA, 20 bp, Artificial Sequence
  chemically synthesized
aaagttgcctgtctatgctc

SEQ ID NO: 433308 - DNA, 20 bp, Artificial Sequence
  chemically synthesized
gttaaagcctagagcataga

SEQ ID NO: 433309 - DNA, 20 bp, Artificial Sequence
  chemically synthesized
ttaaagcctagagcatagac

SEQ ID NO: 433310 - DNA, 20 bp, Artificial Sequence
  chemically synthesized
catagacaggcaacttttca

SEQ ID NO: 433311 - DNA, 20 bp, Artificial Sequence
  chemically synthesized
cttattatggtatctttgaa

SEQ ID NO: 433312 - DNA, 20 bp, Artificial Sequence
  chemically synthesized
cttttcaaagataccataat

SEQ ID NO: 433313 - DNA, 20 bp, Artificial Sequence
  chemically synthesized
gagtaaataaaaacttatta

SEQ ID NO: 433314 - DNA, 20 bp, Artificial Sequence
  chemically synthesized
ctagtccttctttcaaaaat

SEQ ID NO: 433315 - DNA, 20 bp, Artificial Sequence
  chemically synthesized
ttttatttactcatttttga

SEQ ID NO: 433316 - DNA, 20 bp, Artificial Sequence
  chemically synthesized
tatttactcatttttgaaag

SEQ ID NO: 433317 - DNA, 20 bp, Artificial Sequence
  chemically synthesized
atttactcatttttgaaaga

SEQ ID NO: 433318 - DNA, 20 bp, Artificial Sequence
  chemically synthesized
ctcatttttgaaagaaggac

SEQ ID NO: 433319 - DNA, 20 bp, Artificial Sequence
  chemically synthesized
tttttgaaagaaggactagt

SEQ ID NO: 433320 - DNA, 20 bp, Artificial Sequence
  chemically synthesized
gtttatggccagcatccgac

SEQ ID NO: 433321 - DNA, 20 bp, Artificial Sequence
  chemically synthesized
aagaaggactagtcggatgc

SEQ ID NO: 433322 - DNA, 20 bp, Artificial Sequence
  chemically synthesized
ttttagcccctgtttatggc

SEQ ID NO: 433323 - DNA, 20 bp, Artificial Sequence
  chemically synthesized
agtcggatgctggccataaa

SEQ ID NO: 433324 - DNA, 20 bp, Artificial Sequence
  chemically synthesized
gtcggatgctggccataaac

SEQ ID NO: 433325 - DNA, 20 bp, Artificial Sequence
  chemically synthesized
tcggatgctggccataaaca

SEQ ID NO: 433326 - DNA, 20 bp, Artificial Sequence
  chemically synthesized
cggatgctggccataaacag

SEQ ID NO: 433327 - DNA, 20 bp, Artificial Sequence
  chemically synthesized
gaaattttagcccctgttta

SEQ ID NO: 433328 - DNA, 20 bp, Artificial Sequence
  chemically synthesized
tggaaagatggatgaaattt

SEQ ID NO: 433329 - DNA, 20 bp, Artificial Sequence
  chemically synthesized
cattggtggaaatggaaaga

SEQ ID NO: 433330 - DNA, 20 bp, Artificial Sequence
  chemically synthesized
cctccattggtggaaatgga

SEQ ID NO: 433331 - DNA, 20 bp, Artificial Sequence
  chemically synthesized
tacacctccattggtggaaa

SEQ ID NO: 433332 - DNA, 20 bp, Artificial Sequence
  chemically synthesized
catctttccatttccaccaa

SEQ ID NO: 433333 - DNA, 20 bp, Artificial Sequence
  chemically synthesized
tctttccatttccaccaatg

SEQ ID NO: 433334 - DNA, 20 bp, Artificial Sequence
  chemically synthesized
ctttccatttccaccaatgg

SEQ ID NO: 433335 - DNA, 20 bp, Artificial Sequence
  chemically synthesized
caactctacacctccattgg

SEQ ID NO: 433336 - DNA, 20 bp, Artificial Sequence
  chemically synthesized
ttccaactctacacctccat

SEQ ID NO: 433337 - DNA, 20 bp, Artificial Sequence
  chemically synthesized
catttccaccaatggaggtg

SEQ ID NO: 433338 - DNA, 20 bp, Artificial Sequence
  chemically synthesized
tttccaccaatggaggtgta

SEQ ID NO: 433339 - DNA, 20 bp, Artificial Sequence
  chemically synthesized
caccaatggaggtgtagagt

SEQ ID NO: 433340 - DNA, 20 bp, Artificial Sequence
  chemically synthesized
ggaggtgtagagttggaatg

SEQ ID NO: 433341 - DNA, 20 bp, Artificial Sequence
  chemically synthesized
tgtagagttggaatgaagtt

SEQ ID NO: 433342 - DNA, 20 bp, Artificial Sequence
  chemically synthesized
tggaatgaagttaagtgacc

SEQ ID NO: 433343 - DNA, 20 bp, Artificial Sequence
  chemically synthesized
ttcacctctctcaagaggct

SEQ ID NO: 433344 - DNA, 20 bp, Artificial Sequence
  chemically synthesized
gttaagtgaccaagcctctt

SEQ ID NO: 433345 - DNA, 20 bp, Artificial Sequence
  chemically synthesized
taagtgaccaagcctcttga

SEQ ID NO: 433346 - DNA, 20 bp, Artificial Sequence
  chemically synthesized
agtgaccaagcctcttgaga

SEQ ID NO: 433347 - DNA, 20 bp, Artificial Sequence
  chemically synthesized
tatccttcacctctctcaag

SEQ ID NO: 433348 - DNA, 20 bp, Artificial Sequence
  chemically synthesized
gtgaccaagcctcttgagag

SEQ ID NO: 433349 - DNA, 20 bp, Artificial Sequence
  chemically synthesized
atatccttcacctctctcaa

SEQ ID NO: 433350 - DNA, 20 bp, Artificial Sequence
  chemically synthesized
agatatccttcacctctctc

SEQ ID NO: 433351 - DNA, 20 bp, Artificial Sequence
  chemically synthesized
caagcctcttgagagaggtg

SEQ ID NO: 433352 - DNA, 20 bp, Artificial Sequence
  chemically synthesized
aagcctcttgagagaggtga

SEQ ID NO: 433353 - DNA, 20 bp, Artificial Sequence
  chemically synthesized
gagagaggtgaaggatatct

SEQ ID NO: 433354 - DNA, 20 bp, Artificial Sequence
  chemically synthesized
agagaggtgaaggatatctc

SEQ ID NO: 433355 - DNA, 20 bp, Artificial Sequence
  chemically synthesized
gtgaaggatatctcaggaat

SEQ ID NO: 433356 - DNA, 20 bp, Artificial Sequence
  chemically synthesized
attgctagttgcttattcct

SEQ ID NO: 433357 - DNA, 20 bp, Artificial Sequence
  chemically synthesized
atatctcaggaataagcaac

SEQ ID NO: 433358 - DNA, 20 bp, Artificial Sequence
  chemically synthesized
caggaataagcaactagcaa

SEQ ID NO: 433359 - DNA, 20 bp, Artificial Sequence
  chemically synthesized
ttttctcctttgtctattgc

SEQ ID NO: 433360 - DNA, 20 bp, Artificial Sequence
  chemically synthesized
taagcaactagcaatagaca

SEQ ID NO: 433361 - DNA, 20 bp, Artificial Sequence
  chemically synthesized
aagcaactagcaatagacaa

SEQ ID NO: 433362 - DNA, 20 bp, Artificial Sequence
  chemically synthesized
gcaactagcaatagacaaag

SEQ ID NO: 433363 - DNA, 20 bp, Artificial Sequence
  chemically synthesized
acaaaggagaaaaatcgaaa

SEQ ID NO: 433364 - DNA, 20 bp, Artificial Sequence
  chemically synthesized
aaaggagaaaaatcgaaaca

SEQ ID NO: 433365 - DNA, 20 bp, Artificial Sequence
  chemically synthesized
aggagaaaaatcgaaacaga

SEQ ID NO: 433366 - DNA, 20 bp, Artificial Sequence
  chemically synthesized
gaaaaatcgaaacagagaga

SEQ ID NO: 433367 - DNA, 20 bp, Artificial Sequence
  chemically synthesized
atcgaaacagagagaaagaa

SEQ ID NO: 433368 - DNA, 20 bp, Artificial Sequence
  chemically synthesized
aacagagagaaagaatggtt

SEQ ID NO: 433369 - DNA, 20 bp, Artificial Sequence
  chemically synthesized
agtggtggatggggaatgga

SEQ ID NO: 433370 - DNA, 20 bp, Artificial Sequence
  chemically synthesized
tggcagtggtggatggggaa

SEQ ID NO: 433371 - DNA, 20 bp, Artificial Sequence
  chemically synthesized
atgtttggcagtggtggatg

SEQ ID NO: 433372 - DNA, 20 bp, Artificial Sequence
  chemically synthesized
tatgtttggcagtggtggat

SEQ ID NO: 433373 - DNA, 20 bp, Artificial Sequence
  chemically synthesized
gtatgtttggcagtggtgga

SEQ ID NO: 433374 - DNA, 20 bp, Artificial Sequence
  chemically synthesized
ataagtatgtttggcagtgg

SEQ ID NO: 433375 - DNA, 20 bp, Artificial Sequence
  chemically synthesized
tgtataagtatgtttggcag

SEQ ID NO: 433376 - DNA, 20 bp, Artificial Sequence
  chemically synthesized
agttgtataagtatgtttgg

SEQ ID NO: 433377 - DNA, 20 bp, Artificial Sequence
  chemically synthesized
cagagttgtataagtatgtt

SEQ ID NO: 433378 - DNA, 20 bp, Artificial Sequence
  chemically synthesized
ttgagtggccagagttgtat

SEQ ID NO: 433379 - DNA, 20 bp, Artificial Sequence
  chemically synthesized
caaacatacttatacaactc

SEQ ID NO: 433380 - DNA, 20 bp, Artificial Sequence
  chemically synthesized
ttaggtagtttgagtggcca

SEQ ID NO: 433381 - DNA, 20 bp, Artificial Sequence
  chemically synthesized
atttaggtagtttgagtggc

SEQ ID NO: 433382 - DNA, 20 bp, Artificial Sequence
  chemically synthesized
gctcatttaggtagtttgag

SEQ ID NO: 433383 - DNA, 20 bp, Artificial Sequence
  chemically synthesized
ttggctcatttaggtagttt

SEQ ID NO: 433384 - DNA, 20 bp, Artificial Sequence
  chemically synthesized
gccactcaaactacctaaat

SEQ ID NO: 433385 - DNA, 20 bp, Artificial Sequence
  chemically synthesized
tcgaagttggctcatttagg

SEQ ID NO: 433386 - DNA, 20 bp, Artificial Sequence
  chemically synthesized
tcatcgaagttggctcattt

SEQ ID NO: 433387 - DNA, 20 bp, Artificial Sequence
  chemically synthesized
ttcatcgaagttggctcatt

SEQ ID NO: 433388 - DNA, 20 bp, Artificial Sequence
  chemically synthesized
agtgtttgtttcatcgaagt

SEQ ID NO: 433389 - DNA, 20 bp, Artificial Sequence
  chemically synthesized
caatagtgtttgtttcatcg

SEQ ID NO: 433390 - DNA, 20 bp, Artificial Sequence
  chemically synthesized
ttcgatgaaacaaacactat

SEQ ID NO: 433391 - DNA, 20 bp, Artificial Sequence
  chemically synthesized
tcgatgaaacaaacactatt

SEQ ID NO: 433392 - DNA, 20 bp, Artificial Sequence
  chemically synthesized
gatgaaacaaacactattgg

SEQ ID NO: 433393 - DNA, 20 bp, Artificial Sequence
  chemically synthesized
tgaaacaaacactattggga

SEQ ID NO: 433394 - DNA, 20 bp, Artificial Sequence
  chemically synthesized
gggagtgtaatctctcccaa

SEQ ID NO: 433395 - DNA, 20 bp, Artificial Sequence
  chemically synthesized
tgggagagattacactcccg

SEQ ID NO: 433396 - DNA, 20 bp, Artificial Sequence
  chemically synthesized
gagagattacactcccgtgg

SEQ ID NO: 433397 - DNA, 20 bp, Artificial Sequence
  chemically synthesized
cttacttgatactaccacgg

SEQ ID NO: 433398 - DNA, 20 bp, Artificial Sequence
  chemically synthesized
atcttacttgatactaccac

SEQ ID NO: 433399 - DNA, 20 bp, Artificial Sequence
  chemically synthesized
gatcttacttgatactacca

SEQ ID NO: 433400 - DNA, 20 bp, Artificial Sequence
  chemically synthesized
tacactcccgtggtagtatc

SEQ ID NO: 433401 - DNA, 20 bp, Artificial Sequence
  chemically synthesized
ctcccgtggtagtatcaagt

SEQ ID NO: 433402 - DNA, 20 bp, Artificial Sequence
  chemically synthesized
taatgcgttaaatgcaggat

SEQ ID NO: 433403 - DNA, 20 bp, Artificial Sequence
  chemically synthesized
cctcctaatgcgttaaatgc

SEQ ID NO: 433404 - DNA, 20 bp, Artificial Sequence
  chemically synthesized
tcctcctaatgcgttaaatg

SEQ ID NO: 433405 - DNA, 20 bp, Artificial Sequence
  chemically synthesized
ttatcctgcatttaacgcat

SEQ ID NO: 433406 - DNA, 20 bp, Artificial Sequence
  chemically synthesized
tatcctgcatttaacgcatt

SEQ ID NO: 433407 - DNA, 20 bp, Artificial Sequence
  chemically synthesized
tcctgcatttaacgcattag

SEQ ID NO: 433408 - DNA, 20 bp, Artificial Sequence
  chemically synthesized
cctgcatttaacgcattagg

SEQ ID NO: 433409 - DNA, 20 bp, Artificial Sequence
  chemically synthesized
gcatttaacgcattaggagg

SEQ ID NO: 433410 - DNA, 20 bp, Artificial Sequence
  chemically synthesized
attaggaggaagtatttcac

SEQ ID NO: 433411 - DNA, 20 bp, Artificial Sequence
  chemically synthesized
aggaggaagtatttcaccag

SEQ ID NO: 433412 - DNA, 20 bp, Artificial Sequence
  chemically synthesized
ctaataatgtttttagctac

SEQ ID NO: 433413 - DNA, 20 bp, Artificial Sequence
  chemically synthesized
tgttagactaataatgtttt

SEQ ID NO: 433414 - DNA, 20 bp, Artificial Sequence
  chemically synthesized
ccagtagctaaaaacattat

SEQ ID NO: 433415 - DNA, 20 bp, Artificial Sequence
  chemically synthesized
ttgatagaaacagttaatgt

SEQ ID NO: 433416 - DNA, 20 bp, Artificial Sequence
  chemically synthesized
ttaaatccctttgatagaaa

SEQ ID NO: 433417 - DNA, 20 bp, Artificial Sequence
  chemically synthesized
aacattaactgtttctatca

SEQ ID NO: 433418 - DNA, 20 bp, Artificial Sequence
  chemically synthesized
acattaactgtttctatcaa

SEQ ID NO: 433419 - DNA, 20 bp, Artificial Sequence
  chemically synthesized
cattaactgtttctatcaaa

SEQ ID NO: 433420 - DNA, 20 bp, Artificial Sequence
  chemically synthesized
atgtaattaaatccctttga

SEQ ID NO: 433421 - DNA, 20 bp, Artificial Sequence
  chemically synthesized
tttaattacatgacattaaa

SEQ ID NO: 433422 - DNA, 20 bp, Artificial Sequence
  chemically synthesized
gaaaaaaattatttgtatac

SEQ ID NO: 433423 - DNA, 20 bp, Artificial Sequence
  chemically synthesized
ttattatttctgtgtttgtt

SEQ ID NO: 433424 - DNA, 20 bp, Artificial Sequence
  chemically synthesized
aatttttttctcaacaaaca

SEQ ID NO: 433425 - DNA, 20 bp, Artificial Sequence
  chemically synthesized
caaacacagaaataataaaa

SEQ ID NO: 433426 - DNA, 20 bp, Artificial Sequence
  chemically synthesized
aacacagaaataataaaata

SEQ ID NO: 433427 - DNA, 20 bp, Artificial Sequence
  chemically synthesized
agaaataataaaatagagaa

SEQ ID NO: 433428 - DNA, 20 bp, Artificial Sequence
  chemically synthesized
taataaaatagagaaaagac

SEQ ID NO: 433429 - DNA, 20 bp, Artificial Sequence
  chemically synthesized
aataaaatagagaaaagact

SEQ ID NO: 433430 - DNA, 20 bp, Artificial Sequence
  chemically synthesized
atagagaaaagactaggtga

SEQ ID NO: 433431 - DNA, 20 bp, Artificial Sequence
  chemically synthesized
aatatatgtgatctgtcacc

SEQ ID NO: 433432 - DNA, 20 bp, Artificial Sequence
  chemically synthesized
ggtgacagatcacatatatt

SEQ ID NO: 433433 - DNA, 20 bp, Artificial Sequence
  chemically synthesized
tatattgagatacttgccat

SEQ ID NO: 433434 - DNA, 20 bp, Artificial Sequence
  chemically synthesized
atattgagatacttgccata

SEQ ID NO: 433435 - DNA, 20 bp, Artificial Sequence
  chemically synthesized
gatcagtctcaccttatggc

SEQ ID NO: 433436 - DNA, 20 bp, Artificial Sequence
  chemically synthesized
tgagatacttgccataaggt

SEQ ID NO: 433437 - DNA, 20 bp, Artificial Sequence
  chemically synthesized
tgttgatcagtctcacctta

SEQ ID NO: 433438 - DNA, 20 bp, Artificial Sequence
  chemically synthesized
ccttgaagaaggatgttgat

SEQ ID NO: 433439 - DNA, 20 bp, Artificial Sequence
  chemically synthesized
actgatcaacatccttcttc

SEQ ID NO: 433440 - DNA, 20 bp, Artificial Sequence
  chemically synthesized
ctgatcaacatccttcttca

SEQ ID NO: 433441 - DNA, 20 bp, Artificial Sequence
  chemically synthesized
aatttttatatccttgaaga

SEQ ID NO: 433442 - DNA, 20 bp, Artificial Sequence
  chemically synthesized
aaatttttatatccttgaag

SEQ ID NO: 433443 - DNA, 20 bp, Artificial Sequence
  chemically synthesized
attaaatttttatatccttg

SEQ ID NO: 433444 - DNA, 20 bp, Artificial Sequence
  chemically synthesized
atataaaaatttaatttact

SEQ ID NO: 433445 - DNA, 20 bp, Artificial Sequence
  chemically synthesized
ataaaaatttaatttactta

SEQ ID NO: 433446 - DNA, 20 bp, Artificial Sequence
  chemically synthesized
taaaaatttaatttacttag

SEQ ID NO: 433447 - DNA, 20 bp, Artificial Sequence
  chemically synthesized
aaaaatttaatttacttaga

SEQ ID NO: 433448 - DNA, 20 bp, Artificial Sequence
  chemically synthesized
aaaatttaatttacttagag

SEQ ID NO: 433449 - DNA, 20 bp, Artificial Sequence
  chemically synthesized
aaatttaatttacttagagg

SEQ ID NO: 433450 - DNA, 20 bp, Artificial Sequence
  chemically synthesized
taatttctgaaaccccctct

SEQ ID NO: 433451 - DNA, 20 bp, Artificial Sequence
  chemically synthesized
aatttacttagagggggttt

SEQ ID NO: 433452 - DNA, 20 bp, Artificial Sequence
  chemically synthesized
tttcagaaattactaattga

SEQ ID NO: 433453 - DNA, 20 bp, Artificial Sequence
  chemically synthesized
gttaagtaagatctttcaat

SEQ ID NO: 433454 - DNA, 20 bp, Artificial Sequence
  chemically synthesized
gtaaaaaaaatttgttaagt

SEQ ID NO: 433455 - DNA, 20 bp, Artificial Sequence
  chemically synthesized
taatgtaaaaaaaatttgtt

SEQ ID NO: 433456 - DNA, 20 bp, Artificial Sequence
  chemically synthesized
ttaacaaattttttttacat

SEQ ID NO: 433457 - DNA, 20 bp, Artificial Sequence
  chemically synthesized
ttttttacattagaaaaaat

SEQ ID NO: 433458 - DNA, 20 bp, Artificial Sequence
  chemically synthesized
cattagaaaaaatcagaact

SEQ ID NO: 433459 - DNA, 20 bp, Artificial Sequence
  chemically synthesized
tagtgacaagaggatttacc

SEQ ID NO: 433460 - DNA, 20 bp, Artificial Sequence
  chemically synthesized
attttactaatagtgacaag

SEQ ID NO: 433461 - DNA, 20 bp, Artificial Sequence
  chemically synthesized
gattttactaatagtgacaa

SEQ ID NO: 433462 - DNA, 20 bp, Artificial Sequence
  chemically synthesized
atgattttactaatagtgac

SEQ ID NO: 433463 - DNA, 20 bp, Artificial Sequence
  chemically synthesized
gtaaatcctcttgtcactat

SEQ ID NO: 433464 - DNA, 20 bp, Artificial Sequence
  chemically synthesized
aattaacatgattttactaa

SEQ ID NO: 433465 - DNA, 20 bp, Artificial Sequence
  chemically synthesized
attagtaaaatcatgttaat

SEQ ID NO: 433466 - DNA, 20 bp, Artificial Sequence
  chemically synthesized
agtgtattaaaataaagttt

SEQ ID NO: 433467 - DNA, 20 bp, Artificial Sequence
  chemically synthesized
aagtatagtgtattaaaata

SEQ ID NO: 433468 - DNA, 20 bp, Artificial Sequence
  chemically synthesized
actgaagtataggaaaagta

SEQ ID NO: 433469 - DNA, 20 bp, Artificial Sequence
  chemically synthesized
tattgactgaagtataggaa

SEQ ID NO: 433470 - DNA, 20 bp, Artificial Sequence
  chemically synthesized
actatacttttcctatactt

SEQ ID NO: 433471 - DNA, 20 bp, Artificial Sequence
  chemically synthesized
taagttattgactgaagtat

SEQ ID NO: 433472 - DNA, 20 bp, Artificial Sequence
  chemically synthesized
ctaagttattgactgaagta

SEQ ID NO: 433473 - DNA, 20 bp, Artificial Sequence
  chemically synthesized
acaaactaagttattgactg

SEQ ID NO: 433474 - DNA, 20 bp, Artificial Sequence
  chemically synthesized
ctatacttcagtcaataact

SEQ ID NO: 433475 - DNA, 20 bp, Artificial Sequence
  chemically synthesized
tcagtcaataacttagtttg

SEQ ID NO: 433476 - DNA, 20 bp, Artificial Sequence
  chemically synthesized
attatagaaaaccacaaact

SEQ ID NO: 433477 - DNA, 20 bp, Artificial Sequence
  chemically synthesized
taaacttagtgattgaatta

SEQ ID NO: 433478 - DNA, 20 bp, Artificial Sequence
  chemically synthesized
ttttctataattcaatcact

SEQ ID NO: 433479 - DNA, 20 bp, Artificial Sequence
  chemically synthesized
tatttttctctaaataaact

SEQ ID NO: 433480 - DNA, 20 bp, Artificial Sequence
  chemically synthesized
attcaatcactaagtttatt

SEQ ID NO: 433481 - DNA, 20 bp, Artificial Sequence
  chemically synthesized
tcaatcactaagtttattta

SEQ ID NO: 433482 - DNA, 20 bp, Artificial Sequence
  chemically synthesized
agagaaaaatatccttaact

SEQ ID NO: 433483 - DNA, 20 bp, Artificial Sequence
  chemically synthesized
agaaaaatatccttaacttg

SEQ ID NO: 433484 - DNA, 20 bp, Artificial Sequence
  chemically synthesized
gaccactggactccaagtta

SEQ ID NO: 433485 - DNA, 20 bp, Artificial Sequence
  chemically synthesized
agaccactggactccaagtt

SEQ ID NO: 433486 - DNA, 20 bp, Artificial Sequence
  chemically synthesized
aatatccttaacttggagtc

SEQ ID NO: 433487 - DNA, 20 bp, Artificial Sequence
  chemically synthesized
ttcaaagaccactggactcc

SEQ ID NO: 433488 - DNA, 20 bp, Artificial Sequence
  chemically synthesized
atccttaacttggagtccag

SEQ ID NO: 433489 - DNA, 20 bp, Artificial Sequence
  chemically synthesized
ttgggagattcaaagaccac

SEQ ID NO: 433490 - DNA, 20 bp, Artificial Sequence
  chemically synthesized
catatattttgggagattca

SEQ ID NO: 433491 - DNA, 20 bp, Artificial Sequence
  chemically synthesized
aaatattgcatatattttgg

SEQ ID NO: 433492 - DNA, 20 bp, Artificial Sequence
  chemically synthesized
taaaatattgcatatatttt

SEQ ID NO: 433493 - DNA, 20 bp, Artificial Sequence
  chemically synthesized
ataaaatattgcatatattt

SEQ ID NO: 433494 - DNA, 20 bp, Artificial Sequence
  chemically synthesized
atactcatgatgtacacaca

SEQ ID NO: 433495 - DNA, 20 bp, Artificial Sequence
  chemically synthesized
tgtccatgtgtgtacatcat

SEQ ID NO: 433496 - DNA, 20 bp, Artificial Sequence
  chemically synthesized
atgtgtgtacatcatgagta

SEQ ID NO: 433497 - DNA, 20 bp, Artificial Sequence
  chemically synthesized
ttaaaaatcaaatgtaaaca

SEQ ID NO: 433498 - DNA, 20 bp, Artificial Sequence
  chemically synthesized
gtttacatttgatttttaaa

SEQ ID NO: 433499 - DNA, 20 bp, Artificial Sequence
  chemically synthesized
aattcatgattttagttgga

SEQ ID NO: 433500 - DNA, 20 bp, Artificial Sequence
  chemically synthesized
aaattcatgattttagttgg

SEQ ID NO: 433501 - DNA, 20 bp, Artificial Sequence
  chemically synthesized
taaattcatgattttagttg

SEQ ID NO: 433502 - DNA, 20 bp, Artificial Sequence
  chemically synthesized
aataaattcatgattttagt

SEQ ID NO: 433503 - DNA, 20 bp, Artificial Sequence
  chemically synthesized
aaacaataaattcatgattt

SEQ ID NO: 433504 - DNA, 20 bp, Artificial Sequence
  chemically synthesized
atttattgttttaaatttaa

SEQ ID NO: 433505 - DNA, 20 bp, Artificial Sequence
  chemically synthesized
attgttttaaatttaaaagt

SEQ ID NO: 433506 - DNA, 20 bp, Artificial Sequence
  chemically synthesized
aaatttaaaagttggctaaa

SEQ ID NO: 433507 - DNA, 20 bp, Artificial Sequence
  chemically synthesized
acataaacatcatagccatt

SEQ ID NO: 433508 - DNA, 20 bp, Artificial Sequence
  chemically synthesized
atgaaaatacataaacatca

SEQ ID NO: 433509 - DNA, 20 bp, Artificial Sequence
  chemically synthesized
tgtttatgtattttcatcaa

SEQ ID NO: 433510 - DNA, 20 bp, Artificial Sequence
  chemically synthesized
gtttatgtattttcatcaaa

SEQ ID NO: 433511 - DNA, 20 bp, Artificial Sequence
  chemically synthesized
tttatgtattttcatcaaaa

SEQ ID NO: 433512 - DNA, 20 bp, Artificial Sequence
  chemically synthesized
atgtattttcatcaaaaggg

SEQ ID NO: 433513 - DNA, 20 bp, Artificial Sequence
  chemically synthesized
gttgtttgtgttttatttcc

SEQ ID NO: 433514 - DNA, 20 bp, Artificial Sequence
  chemically synthesized
tgtacatcaagtcatagact

SEQ ID NO: 433515 - DNA, 20 bp, Artificial Sequence
  chemically synthesized
ggtttttgtacatcaagtca

SEQ ID NO: 433516 - DNA, 20 bp, Artificial Sequence
  chemically synthesized
tgtaaaggtttttgtacatc

SEQ ID NO: 433517 - DNA, 20 bp, Artificial Sequence
  chemically synthesized
tggggtacgatacagtgtaa

SEQ ID NO: 433518 - DNA, 20 bp, Artificial Sequence
  chemically synthesized
ttggggtacgatacagtgta

SEQ ID NO: 433519 - DNA, 20 bp, Artificial Sequence
  chemically synthesized
tatgtttttggggtacgata

SEQ ID NO: 433520 - DNA, 20 bp, Artificial Sequence
  chemically synthesized
tgaatctgagtatgtttttg

SEQ ID NO: 433521 - DNA, 20 bp, Artificial Sequence
  chemically synthesized
ttgaatctgagtatgttttt

SEQ ID NO: 433522 - DNA, 20 bp, Artificial Sequence
  chemically synthesized
tttgaatctgagtatgtttt

SEQ ID NO: 433523 - DNA, 20 bp, Artificial Sequence
  chemically synthesized
tcgtaccccaaaaacatact

SEQ ID NO: 433524 - DNA, 20 bp, Artificial Sequence
  chemically synthesized
ttcctctctcttttgaatct

SEQ ID NO: 433525 - DNA, 20 bp, Artificial Sequence
  chemically synthesized
aaaaacatactcagattcaa

SEQ ID NO: 433526 - DNA, 20 bp, Artificial Sequence
  chemically synthesized
aaacatactcagattcaaaa

SEQ ID NO: 433527 - DNA, 20 bp, Artificial Sequence
  chemically synthesized
acatactcagattcaaaaga

SEQ ID NO: 433528 - DNA, 20 bp, Artificial Sequence
  chemically synthesized
atactcagattcaaaagaga

SEQ ID NO: 433529 - DNA, 20 bp, Artificial Sequence
  chemically synthesized
tactcagattcaaaagagag

SEQ ID NO: 433530 - DNA, 20 bp, Artificial Sequence
  chemically synthesized
gattcaaaagagagaggaat

SEQ ID NO: 433531 - DNA, 20 bp, Artificial Sequence
  chemically synthesized
agaaaaataatgaaacattt

SEQ ID NO: 433532 - DNA, 20 bp, Artificial Sequence
  chemically synthesized
taatgaaacatttcagttta

SEQ ID NO: 433533 - DNA, 20 bp, Artificial Sequence
  chemically synthesized
ttcagtttaaagtgtcttct

SEQ ID NO: 433534 - DNA, 20 bp, Artificial Sequence
  chemically synthesized
agtttaaagtgtcttctcag

SEQ ID NO: 433535 - DNA, 20 bp, Artificial Sequence
  chemically synthesized
acactgaatctgccactgag

SEQ ID NO: 433536 - DNA, 20 bp, Artificial Sequence
  chemically synthesized
ttaaagtgtcttctcagtgg

SEQ ID NO: 433537 - DNA, 20 bp, Artificial Sequence
  chemically synthesized
aatacactgaatctgccact

SEQ ID NO: 433538 - DNA, 20 bp, Artificial Sequence
  chemically synthesized
tgtcttctcagtggcagatt

SEQ ID NO: 433539 - DNA, 20 bp, Artificial Sequence
  chemically synthesized
ttaatctctagaagaagcaa

SEQ ID NO: 433540 - DNA, 20 bp, Artificial Sequence
  chemically synthesized
ttcattacttttgcttcttc

SEQ ID NO: 433541 - DNA, 20 bp, Artificial Sequence
  chemically synthesized
cattacttttgcttcttcta

SEQ ID NO: 433542 - DNA, 20 bp, Artificial Sequence
  chemically synthesized
tgcactttaatctctagaag

SEQ ID NO: 433543 - DNA, 20 bp, Artificial Sequence
  chemically synthesized
ttatgcactttaatctctag

SEQ ID NO: 433544 - DNA, 20 bp, Artificial Sequence
  chemically synthesized
tttgcttcttctagagatta

SEQ ID NO: 433545 - DNA, 20 bp, Artificial Sequence
  chemically synthesized
agattatgcactttaatctc

SEQ ID NO: 433546 - DNA, 20 bp, Artificial Sequence
  chemically synthesized
ttagctactgtttatgagat

SEQ ID NO: 433547 - DNA, 20 bp, Artificial Sequence
  chemically synthesized
gcataatctaatctcataaa

SEQ ID NO: 433548 - DNA, 20 bp, Artificial Sequence
  chemically synthesized
atgaattagctactgtttat

SEQ ID NO: 433549 - DNA, 20 bp, Artificial Sequence
  chemically synthesized
taatctaatctcataaacag

SEQ ID NO: 433550 - DNA, 20 bp, Artificial Sequence
  chemically synthesized
tctattaagccagtatgaat

SEQ ID NO: 433551 - DNA, 20 bp, Artificial Sequence
  chemically synthesized
aaacagtagctaattcatac

SEQ ID NO: 433552 - DNA, 20 bp, Artificial Sequence
  chemically synthesized
gctaattcatactggcttaa

SEQ ID NO: 433553 - DNA, 20 bp, Artificial Sequence
  chemically synthesized
caactgatcttctattaagc

SEQ ID NO: 433554 - DNA, 20 bp, Artificial Sequence
  chemically synthesized
aattcatactggcttaatag

SEQ ID NO: 433555 - DNA, 20 bp, Artificial Sequence
  chemically synthesized
ttcccaactgatcttctatt

SEQ ID NO: 433556 - DNA, 20 bp, Artificial Sequence
  chemically synthesized
atactggcttaatagaagat

SEQ ID NO: 433557 - DNA, 20 bp, Artificial Sequence
  chemically synthesized
tggcttaatagaagatcagt

SEQ ID NO: 433558 - DNA, 20 bp, Artificial Sequence
  chemically synthesized
ggcttaatagaagatcagtt

SEQ ID NO: 433559 - DNA, 20 bp, Artificial Sequence
  chemically synthesized
gaagatcagttgggaataat

SEQ ID NO: 433560 - DNA, 20 bp, Artificial Sequence
  chemically synthesized
gttgggaataataagctcga

SEQ ID NO: 433561 - DNA, 20 bp, Artificial Sequence
  chemically synthesized
aataatgttatcattctatc

SEQ ID NO: 433562 - DNA, 20 bp, Artificial Sequence
  chemically synthesized
tagaatgataacattattac

SEQ ID NO: 433563 - DNA, 20 bp, Artificial Sequence
  chemically synthesized
aacattattactggaattct

SEQ ID NO: 433564 - DNA, 20 bp, Artificial Sequence
  chemically synthesized
ccaagttcttctgagaattc

SEQ ID NO: 433565 - DNA, 20 bp, Artificial Sequence
  chemically synthesized
attattactggaattctcag

SEQ ID NO: 433566 - DNA, 20 bp, Artificial Sequence
  chemically synthesized
ttggattgccaagttcttct

SEQ ID NO: 433567 - DNA, 20 bp, Artificial Sequence
  chemically synthesized
ctggaattctcagaagaact

SEQ ID NO: 433568 - DNA, 20 bp, Artificial Sequence
  chemically synthesized
tccatcttgcttggattgcc

SEQ ID NO: 433569 - DNA, 20 bp, Artificial Sequence
  chemically synthesized
tcagaagaacttggcaatcc

SEQ ID NO: 433570 - DNA, 20 bp, Artificial Sequence
  chemically synthesized
aagaacttggcaatccaagc

SEQ ID NO: 433571 - DNA, 20 bp, Artificial Sequence
  chemically synthesized
acttggcaatccaagcaaga

SEQ ID NO: 433572 - DNA, 20 bp, Artificial Sequence
  chemically synthesized
ttagtcttatccatcttgct

SEQ ID NO: 433573 - DNA, 20 bp, Artificial Sequence
  chemically synthesized
gcaatccaagcaagatggat

SEQ ID NO: 433574 - DNA, 20 bp, Artificial Sequence
  chemically synthesized
tattctttgtaatattttat

SEQ ID NO: 433575 - DNA, 20 bp, Artificial Sequence
  chemically synthesized
aagactaataaaatattaca

SEQ ID NO: 433576 - DNA, 20 bp, Artificial Sequence
  chemically synthesized
ataaaatattacaaagaata

SEQ ID NO: 433577 - DNA, 20 bp, Artificial Sequence
  chemically synthesized
tattacaaagaataaagaaa

SEQ ID NO: 433578 - DNA, 20 bp, Artificial Sequence
  chemically synthesized
caaagaataaagaaaaagtt

SEQ ID NO: 433579 - DNA, 20 bp, Artificial Sequence
  chemically synthesized
gaaaaagttaagatttatga

SEQ ID NO: 433580 - DNA, 20 bp, Artificial Sequence
  chemically synthesized
cataataacagaaacataaa

SEQ ID NO: 433581 - DNA, 20 bp, Artificial Sequence
  chemically synthesized
ggtattatatgacataataa

SEQ ID NO: 433582 - DNA, 20 bp, Artificial Sequence
  chemically synthesized
attatgtcatataataccat

SEQ ID NO: 433583 - DNA, 20 bp, Artificial Sequence
  chemically synthesized
gtcatataataccataagct

SEQ ID NO: 433584 - DNA, 20 bp, Artificial Sequence
  chemically synthesized
tcatataataccataagctg

SEQ ID NO: 433585 - DNA, 20 bp, Artificial Sequence
  chemically synthesized
atatgaattacctcagctta

SEQ ID NO: 433586 - DNA, 20 bp, Artificial Sequence
  chemically synthesized
acagactatatgaattacct

SEQ ID NO: 433587 - DNA, 20 bp, Artificial Sequence
  chemically synthesized
ataagctgaggtaattcata

SEQ ID NO: 433588 - DNA, 20 bp, Artificial Sequence
  chemically synthesized
tgatttggtgaaatgtagaa

SEQ ID NO: 433589 - DNA, 20 bp, Artificial Sequence
  chemically synthesized
aagggtgatttggtgaaatg

SEQ ID NO: 433590 - DNA, 20 bp, Artificial Sequence
  chemically synthesized
tttagttattaagggtgatt

SEQ ID NO: 433591 - DNA, 20 bp, Artificial Sequence
  chemically synthesized
ctttatcgtttagttattaa

SEQ ID NO: 433592 - DNA, 20 bp, Artificial Sequence
  chemically synthesized
actttatcgtttagttatta

SEQ ID NO: 433593 - DNA, 20 bp, Artificial Sequence
  chemically synthesized
cactttatcgtttagttatt

SEQ ID NO: 433594 - DNA, 20 bp, Artificial Sequence
  chemically synthesized
cccttaataactaaacgata

SEQ ID NO: 433595 - DNA, 20 bp, Artificial Sequence
  chemically synthesized
aattttatcactttatcgtt

SEQ ID NO: 433596 - DNA, 20 bp, Artificial Sequence
  chemically synthesized
acgataaagtgataaaattc

SEQ ID NO: 433597 - DNA, 20 bp, Artificial Sequence
  chemically synthesized
taaaattcaagacactgtgt

SEQ ID NO: 433598 - DNA, 20 bp, Artificial Sequence
  chemically synthesized
tgccctcttattttccaaca

SEQ ID NO: 433599 - DNA, 20 bp, Artificial Sequence
  chemically synthesized
aagacactgtgttggaaaat

SEQ ID NO: 433600 - DNA, 20 bp, Artificial Sequence
  chemically synthesized
gacactgtgttggaaaataa

SEQ ID NO: 433601 - DNA, 20 bp, Artificial Sequence
  chemically synthesized
acactgtgttggaaaataag

SEQ ID NO: 433602 - DNA, 20 bp, Artificial Sequence
  chemically synthesized
cactgtgttggaaaataaga

SEQ ID NO: 433603 - DNA, 20 bp, Artificial Sequence
  chemically synthesized
tgtgttggaaaataagaggg

SEQ ID NO: 433604 - DNA, 20 bp, Artificial Sequence
  chemically synthesized
tgttggaaaataagagggca

SEQ ID NO: 433605 - DNA, 20 bp, Artificial Sequence
  chemically synthesized
gttggaaaataagagggcag

SEQ ID NO: 433606 - DNA, 20 bp, Artificial Sequence
  chemically synthesized
ttggaaaataagagggcaga

SEQ ID NO: 433607 - DNA, 20 bp, Artificial Sequence
  chemically synthesized
aaaataagagggcagaggga

SEQ ID NO: 433608 - DNA, 20 bp, Artificial Sequence
  chemically synthesized
aaataagagggcagagggaa

SEQ ID NO: 433609 - DNA, 20 bp, Artificial Sequence
  chemically synthesized
ataagagggcagagggaaag

SEQ ID NO: 433610 - DNA, 20 bp, Artificial Sequence
  chemically synthesized
agggcagagggaaaggagct

SEQ ID NO: 433611 - DNA, 20 bp, Artificial Sequence
  chemically synthesized
ttaattattatttatcatcc

SEQ ID NO: 433612 - DNA, 20 bp, Artificial Sequence
  chemically synthesized
tttaaggtccttagaaattg

SEQ ID NO: 433613 - DNA, 20 bp, Artificial Sequence
  chemically synthesized
aataattaactccaatttct

SEQ ID NO: 433614 - DNA, 20 bp, Artificial Sequence
  chemically synthesized
ataattaactccaatttcta

SEQ ID NO: 433615 - DNA, 20 bp, Artificial Sequence
  chemically synthesized
attttaaggtccttagaaat

SEQ ID NO: 433616 - DNA, 20 bp, Artificial Sequence
  chemically synthesized
caaccagattttaaggtcct

SEQ ID NO: 433617 - DNA, 20 bp, Artificial Sequence
  chemically synthesized
tttctaaggaccttaaaatc

SEQ ID NO: 433618 - DNA, 20 bp, Artificial Sequence
  chemically synthesized
ttattgacaaccagatttta

SEQ ID NO: 433619 - DNA, 20 bp, Artificial Sequence
  chemically synthesized
tttattgacaaccagatttt

SEQ ID NO: 433620 - DNA, 20 bp, Artificial Sequence
  chemically synthesized
tattgatgtttattgacaac

SEQ ID NO: 433621 - DNA, 20 bp, Artificial Sequence
  chemically synthesized
aaaaattattgtatctatat

SEQ ID NO: 433622 - DNA, 20 bp, Artificial Sequence
  chemically synthesized
ttgtagttaccaatcttata

SEQ ID NO: 433623 - DNA, 20 bp, Artificial Sequence
  chemically synthesized
ttattgtatctatataagat

SEQ ID NO: 433624 - DNA, 20 bp, Artificial Sequence
  chemically synthesized
tttttttttttttttttttg

SEQ ID NO: 433625 - DNA, 20 bp, Artificial Sequence
  chemically synthesized
acaaaaaaaaaaaaaaaaaa

SEQ ID NO: 433626 - DNA, 20 bp, Artificial Sequence
  chemically synthesized
aaaaaaaaaaaaagaatccc

SEQ ID NO: 433627 - DNA, 20 bp, Artificial Sequence
  chemically synthesized
tgcagggtctggggattctg

SEQ ID NO: 433628 - DNA, 20 bp, Artificial Sequence
  chemically synthesized
ctgcagggtctggggattct

SEQ ID NO: 433629 - DNA, 20 bp, Artificial Sequence
  chemically synthesized
aaaagaatccccagaatccc

SEQ ID NO: 433630 - DNA, 20 bp, Artificial Sequence
  chemically synthesized
tctgcagggtctggggattc

SEQ ID NO: 433631 - DNA, 20 bp, Artificial Sequence
  chemically synthesized
tcccaattctgcagggtctg

SEQ ID NO: 433632 - DNA, 20 bp, Artificial Sequence
  chemically synthesized
atcccaattctgcagggtct

SEQ ID NO: 433633 - DNA, 20 bp, Artificial Sequence
  chemically synthesized
cccagaatccccagaccctg

SEQ ID NO: 433634 - DNA, 20 bp, Artificial Sequence
  chemically synthesized
aatcccaattctgcagggtc

SEQ ID NO: 433635 - DNA, 20 bp, Artificial Sequence
  chemically synthesized
ccctcaatcccaattctgca

SEQ ID NO: 433636 - DNA, 20 bp, Artificial Sequence
  chemically synthesized
atccccagaccctgcagaat

SEQ ID NO: 433637 - DNA, 20 bp, Artificial Sequence
  chemically synthesized
accctcaatcccaattctgc

SEQ ID NO: 433638 - DNA, 20 bp, Artificial Sequence
  chemically synthesized
tccccagaccctgcagaatt

SEQ ID NO: 433639 - DNA, 20 bp, Artificial Sequence
  chemically synthesized
taccctcaatcccaattctg

SEQ ID NO: 433640 - DNA, 20 bp, Artificial Sequence
  chemically synthesized
gaccctgcagaattgggatt

SEQ ID NO: 433641 - DNA, 20 bp, Artificial Sequence
  chemically synthesized
accctgcagaattgggattg

SEQ ID NO: 433642 - DNA, 20 bp, Artificial Sequence
  chemically synthesized
ccctgcagaattgggattga

SEQ ID NO: 433643 - DNA, 20 bp, Artificial Sequence
  chemically synthesized
tgcagaattgggattgaggg

SEQ ID NO: 433644 - DNA, 20 bp, Artificial Sequence
  chemically synthesized
gggattgagggtagaatgac

SEQ ID NO: 433645 - DNA, 20 bp, Artificial Sequence
  chemically synthesized
ggattgagggtagaatgaca

SEQ ID NO: 433646 - DNA, 20 bp, Artificial Sequence
  chemically synthesized
gattgagggtagaatgacaa

SEQ ID NO: 433647 - DNA, 20 bp, Artificial Sequence
  chemically synthesized
tagaatgacaagggtcctca

SEQ ID NO: 433648 - DNA, 20 bp, Artificial Sequence
  chemically synthesized
tcccatgattgtcagctgtg

SEQ ID NO: 433649 - DNA, 20 bp, Artificial Sequence
  chemically synthesized
ttcccatgattgtcagctgt

SEQ ID NO: 433650 - DNA, 20 bp, Artificial Sequence
  chemically synthesized
gtcctcacagctgacaatca

SEQ ID NO: 433651 - DNA, 20 bp, Artificial Sequence
  chemically synthesized
cttgtcgttcccatgattgt

SEQ ID NO: 433652 - DNA, 20 bp, Artificial Sequence
  chemically synthesized
tcctcacagctgacaatcat

SEQ ID NO: 433653 - DNA, 20 bp, Artificial Sequence
  chemically synthesized
ctgacaatcatgggaacgac

SEQ ID NO: 433654 - DNA, 20 bp, Artificial Sequence
  chemically synthesized
tgacaatcatgggaacgaca

SEQ ID NO: 433655 - DNA, 20 bp, Artificial Sequence
  chemically synthesized
acaatcatgggaacgacaag

SEQ ID NO: 433656 - DNA, 20 bp, Artificial Sequence
  chemically synthesized
gggaacgacaaggagaacaa

SEQ ID NO: 433657 - DNA, 20 bp, Artificial Sequence
  chemically synthesized
aagacatttcacacttctca

SEQ ID NO: 433658 - DNA, 20 bp, Artificial Sequence
  chemically synthesized
gacatttcacacttctcaaa

SEQ ID NO: 433659 - DNA, 20 bp, Artificial Sequence
  chemically synthesized
caggtagtaatctctttgag

SEQ ID NO: 433660 - DNA, 20 bp, Artificial Sequence
  chemically synthesized
aaacaggtagtaatctcttt

SEQ ID NO: 433661 - DNA, 20 bp, Artificial Sequence
  chemically synthesized
caagtgatcctcaaaacagg

SEQ ID NO: 433662 - DNA, 20 bp, Artificial Sequence
  chemically synthesized
aagagattactacctgtttt

SEQ ID NO: 433663 - DNA, 20 bp, Artificial Sequence
  chemically synthesized
agagattactacctgttttg

SEQ ID NO: 433664 - DNA, 20 bp, Artificial Sequence
  chemically synthesized
tgacaagtgatcctcaaaac

SEQ ID NO: 433665 - DNA, 20 bp, Artificial Sequence
  chemically synthesized
ctgacaagtgatcctcaaaa

SEQ ID NO: 433666 - DNA, 20 bp, Artificial Sequence
  chemically synthesized
ctgttttgaggatcacttgt

SEQ ID NO: 433667 - DNA, 20 bp, Artificial Sequence
  chemically synthesized
tgttttgaggatcacttgtc

SEQ ID NO: 433668 - DNA, 20 bp, Artificial Sequence
  chemically synthesized
ttttgaggatcacttgtcag

SEQ ID NO: 433669 - DNA, 20 bp, Artificial Sequence
  chemically synthesized
acagaagatgcactcctgac

SEQ ID NO: 433670 - DNA, 20 bp, Artificial Sequence
  chemically synthesized
accaccctgcatagtcacag

SEQ ID NO: 433671 - DNA, 20 bp, Artificial Sequence
  chemically synthesized
ctgaccaccctgcatagtca

SEQ ID NO: 433672 - DNA, 20 bp, Artificial Sequence
  chemically synthesized
gtgcatcttctgtgactatg

SEQ ID NO: 433673 - DNA, 20 bp, Artificial Sequence
  chemically synthesized
tgcatcttctgtgactatgc

SEQ ID NO: 433674 - DNA, 20 bp, Artificial Sequence
  chemically synthesized
gcatcttctgtgactatgca

SEQ ID NO: 433675 - DNA, 20 bp, Artificial Sequence
  chemically synthesized
tcttctgtgactatgcaggg

SEQ ID NO: 433676 - DNA, 20 bp, Artificial Sequence
  chemically synthesized
ttttacctgaccaccctgca

SEQ ID NO: 433677 - DNA, 20 bp, Artificial Sequence
  chemically synthesized
ctgtgactatgcagggtggt

SEQ ID NO: 433678 - DNA, 20 bp, Artificial Sequence
  chemically synthesized
tgtgactatgcagggtggtc

SEQ ID NO: 433679 - DNA, 20 bp, Artificial Sequence
  chemically synthesized
tatgcagggtggtcaggtaa

SEQ ID NO: 433680 - DNA, 20 bp, Artificial Sequence
  chemically synthesized
atgcagggtggtcaggtaaa

SEQ ID NO: 433681 - DNA, 20 bp, Artificial Sequence
  chemically synthesized
cagggtggtcaggtaaaagg

SEQ ID NO: 433682 - DNA, 20 bp, Artificial Sequence
  chemically synthesized
caggtaaaaggaagttacta

SEQ ID NO: 433683 - DNA, 20 bp, Artificial Sequence
  chemically synthesized
aaaaggaagttactacagta

SEQ ID NO: 433684 - DNA, 20 bp, Artificial Sequence
  chemically synthesized
aaaggaagttactacagtaa

SEQ ID NO: 433685 - DNA, 20 bp, Artificial Sequence
  chemically synthesized
ctcatcaccatcctttactg

SEQ ID NO: 433686 - DNA, 20 bp, Artificial Sequence
  chemically synthesized
gaagttactacagtaaagga

SEQ ID NO: 433687 - DNA, 20 bp, Artificial Sequence
  chemically synthesized
ctacagtaaaggatggtgat

SEQ ID NO: 433688 - DNA, 20 bp, Artificial Sequence
  chemically synthesized
tacagtaaaggatggtgatg

SEQ ID NO: 433689 - DNA, 20 bp, Artificial Sequence
  chemically synthesized
taaaggatggtgatgaggaa

SEQ ID NO: 433690 - DNA, 20 bp, Artificial Sequence
  chemically synthesized
ggatggtgatgaggaatggt

SEQ ID NO: 433691 - DNA, 20 bp, Artificial Sequence
  chemically synthesized
gatgaggaatggtgagtttc

SEQ ID NO: 433692 - DNA, 20 bp, Artificial Sequence
  chemically synthesized
atgaggaatggtgagtttcc

SEQ ID NO: 433693 - DNA, 20 bp, Artificial Sequence
  chemically synthesized
atggtgagtttccaggtcac

SEQ ID NO: 433694 - DNA, 20 bp, Artificial Sequence
  chemically synthesized
actttcagtttccagtgacc

SEQ ID NO: 433695 - DNA, 20 bp, Artificial Sequence
  chemically synthesized
cataggagactttcagtttc

SEQ ID NO: 433696 - DNA, 20 bp, Artificial Sequence
  chemically synthesized
tccaggtcactggaaactga

SEQ ID NO: 433697 - DNA, 20 bp, Artificial Sequence
  chemically synthesized
tcgagttcataggagacttt

SEQ ID NO: 433698 - DNA, 20 bp, Artificial Sequence
  chemically synthesized
gcggcttctcgagttcatag

SEQ ID NO: 433699 - DNA, 20 bp, Artificial Sequence
  chemically synthesized
ttgcggcttctcgagttcat

SEQ ID NO: 433700 - DNA, 20 bp, Artificial Sequence
  chemically synthesized
tgaaagtctcctatgaactc

SEQ ID NO: 433701 - DNA, 20 bp, Artificial Sequence
  chemically synthesized
tttgcggcttctcgagttca

SEQ ID NO: 433702 - DNA, 20 bp, Artificial Sequence
  chemically synthesized
aagtctcctatgaactcgag

SEQ ID NO: 433703 - DNA, 20 bp, Artificial Sequence
  chemically synthesized
ccttggttttgcggcttctc

SEQ ID NO: 433704 - DNA, 20 bp, Artificial Sequence
  chemically synthesized
actcgagaagccgcaaaacc

SEQ ID NO: 433705 - DNA, 20 bp, Artificial Sequence
  chemically synthesized
ctttctcttccttggttttg

SEQ ID NO: 433706 - DNA, 20 bp, Artificial Sequence
  chemically synthesized
ctcgagaagccgcaaaacca

SEQ ID NO: 433707 - DNA, 20 bp, Artificial Sequence
  chemically synthesized
gagaagccgcaaaaccaagg

SEQ ID NO: 433708 - DNA, 20 bp, Artificial Sequence
  chemically synthesized
gaagccgcaaaaccaaggaa

SEQ ID NO: 433709 - DNA, 20 bp, Artificial Sequence
  chemically synthesized
aaattactctttctcttcct

SEQ ID NO: 433710 - DNA, 20 bp, Artificial Sequence
  chemically synthesized
ccgcaaaaccaaggaagaga

SEQ ID NO: 433711 - DNA, 20 bp, Artificial Sequence
  chemically synthesized
gcaaaaccaaggaagagaaa

SEQ ID NO: 433712 - DNA, 20 bp, Artificial Sequence
  chemically synthesized
ttttataataaatgttgctg

SEQ ID NO: 433713 - DNA, 20 bp, Artificial Sequence
  chemically synthesized
aacagatatgaagaaatcca

SEQ ID NO: 433714 - DNA, 20 bp, Artificial Sequence
  chemically synthesized
aaagtgttaaaacagatatg

SEQ ID NO: 433715 - DNA, 20 bp, Artificial Sequence
  chemically synthesized
ataactcaaaagtgttaaaa

SEQ ID NO: 433716 - DNA, 20 bp, Artificial Sequence
  chemically synthesized
atatctgttttaacactttt

SEQ ID NO: 433717 - DNA, 20 bp, Artificial Sequence
  chemically synthesized
cacacacttaaataactcaa

SEQ ID NO: 433718 - DNA, 20 bp, Artificial Sequence
  chemically synthesized
ttaacacttttgagttattt

SEQ ID NO: 433719 - DNA, 20 bp, Artificial Sequence
  chemically synthesized
aataacaaaaattaattaag

SEQ ID NO: 433720 - DNA, 20 bp, Artificial Sequence
  chemically synthesized
aacaataacaaaaattaatt

SEQ ID NO: 433721 - DNA, 20 bp, Artificial Sequence
  chemically synthesized
tgttattgttgttttgaatg

SEQ ID NO: 433722 - DNA, 20 bp, Artificial Sequence
  chemically synthesized
caatgcagtccaattttggg

SEQ ID NO: 433723 - DNA, 20 bp, Artificial Sequence
  chemically synthesized
atgtggcatctacccaaaat

SEQ ID NO: 433724 - DNA, 20 bp, Artificial Sequence
  chemically synthesized
gaccaatgcagtccaatttt

SEQ ID NO: 433725 - DNA, 20 bp, Artificial Sequence
  chemically synthesized
agaccaatgcagtccaattt

SEQ ID NO: 433726 - DNA, 20 bp, Artificial Sequence
  chemically synthesized
tacccaaaattggactgcat

SEQ ID NO: 433727 - DNA, 20 bp, Artificial Sequence
  chemically synthesized
tgtaaatacagagaccaatg

SEQ ID NO: 433728 - DNA, 20 bp, Artificial Sequence
  chemically synthesized
atataagccttgtaaataca

SEQ ID NO: 433729 - DNA, 20 bp, Artificial Sequence
  chemically synthesized
gcattggtctctgtatttac

SEQ ID NO: 433730 - DNA, 20 bp, Artificial Sequence
  chemically synthesized
aaatataagccttgtaaata

SEQ ID NO: 433731 - DNA, 20 bp, Artificial Sequence
  chemically synthesized
cattggtctctgtatttaca

SEQ ID NO: 433732 - DNA, 20 bp, Artificial Sequence
  chemically synthesized
aagttaatatatgcaaatat

SEQ ID NO: 433733 - DNA, 20 bp, Artificial Sequence
  chemically synthesized
tggttgttatgtattgcatt

SEQ ID NO: 433734 - DNA, 20 bp, Artificial Sequence
  chemically synthesized
ttaatgcaatacataacaac

SEQ ID NO: 433735 - DNA, 20 bp, Artificial Sequence
  chemically synthesized
ctatatctggattgttcatc

SEQ ID NO: 433736 - DNA, 20 bp, Artificial Sequence
  chemically synthesized
taacaaccagatgaacaatc

SEQ ID NO: 433737 - DNA, 20 bp, Artificial Sequence
  chemically synthesized
ccagatgaacaatccagata

SEQ ID NO: 433738 - DNA, 20 bp, Artificial Sequence
  chemically synthesized
cagatgaacaatccagatat

SEQ ID NO: 433739 - DNA, 20 bp, Artificial Sequence
  chemically synthesized
agatgaacaatccagatata

SEQ ID NO: 433740 - DNA, 20 bp, Artificial Sequence
  chemically synthesized
gatgaacaatccagatatag

SEQ ID NO: 433741 - DNA, 20 bp, Artificial Sequence
  chemically synthesized
taatcactttcccctatatc

SEQ ID NO: 433742 - DNA, 20 bp, Artificial Sequence
  chemically synthesized
aacaatccagatatagggga

SEQ ID NO: 433743 - DNA, 20 bp, Artificial Sequence
  chemically synthesized
aaagtgattacaccttgtac

SEQ ID NO: 433744 - DNA, 20 bp, Artificial Sequence
  chemically synthesized
aagtgattacaccttgtact

SEQ ID NO: 433745 - DNA, 20 bp, Artificial Sequence
  chemically synthesized
tccttgtccatcccagtaca

SEQ ID NO: 433746 - DNA, 20 bp, Artificial Sequence
  chemically synthesized
ctccttgtccatcccagtac

SEQ ID NO: 433747 - DNA, 20 bp, Artificial Sequence
  chemically synthesized
gattacaccttgtactggga

SEQ ID NO: 433748 - DNA, 20 bp, Artificial Sequence
  chemically synthesized
taagtcctccttgtccatcc

SEQ ID NO: 433749 - DNA, 20 bp, Artificial Sequence
  chemically synthesized
caccttgtactgggatggac

SEQ ID NO: 433750 - DNA, 20 bp, Artificial Sequence
  chemically synthesized
accttgtactgggatggaca

SEQ ID NO: 433751 - DNA, 20 bp, Artificial Sequence
  chemically synthesized
cttgtactgggatggacaag

SEQ ID NO: 433752 - DNA, 20 bp, Artificial Sequence
  chemically synthesized
ttgtactgggatggacaagg

SEQ ID NO: 433753 - DNA, 20 bp, Artificial Sequence
  chemically synthesized
tggacaaggaggacttaatt

SEQ ID NO: 433754 - DNA, 20 bp, Artificial Sequence
  chemically synthesized
ggacaaggaggacttaatta

SEQ ID NO: 433755 - DNA, 20 bp, Artificial Sequence
  chemically synthesized
cttctctaaattccttaatt

SEQ ID NO: 433756 - DNA, 20 bp, Artificial Sequence
  chemically synthesized
gaggacttaattaaggaatt

SEQ ID NO: 433757 - DNA, 20 bp, Artificial Sequence
  chemically synthesized
ggacttaattaaggaattta

SEQ ID NO: 433758 - DNA, 20 bp, Artificial Sequence
  chemically synthesized
cttaattaaggaatttagag

SEQ ID NO: 433759 - DNA, 20 bp, Artificial Sequence
  chemically synthesized
ttaaggaatttagagaagct

SEQ ID NO: 433760 - DNA, 20 bp, Artificial Sequence
  chemically synthesized
tttaccctaatttcatgact

SEQ ID NO: 433761 - DNA, 20 bp, Artificial Sequence
  chemically synthesized
gagaagctcagtcatgaaat

SEQ ID NO: 433762 - DNA, 20 bp, Artificial Sequence
  chemically synthesized
agaagctcagtcatgaaatt

SEQ ID NO: 433763 - DNA, 20 bp, Artificial Sequence
  chemically synthesized
gaagctcagtcatgaaatta

SEQ ID NO: 433764 - DNA, 20 bp, Artificial Sequence
  chemically synthesized
aattagggtaaacttcaaac

SEQ ID NO: 433765 - DNA, 20 bp, Artificial Sequence
  chemically synthesized
ttttatttttttcttgtttg

SEQ ID NO: 433766 - DNA, 20 bp, Artificial Sequence
  chemically synthesized
caaacaagaaaaaaataaaa

SEQ ID NO: 433767 - DNA, 20 bp, Artificial Sequence
  chemically synthesized
aaacaagaaaaaaataaaaa

SEQ ID NO: 433768 - DNA, 20 bp, Artificial Sequence
  chemically synthesized
aagaaaaaaataaaaaagga

SEQ ID NO: 433769 - DNA, 20 bp, Artificial Sequence
  chemically synthesized
agaaaaaaataaaaaaggat

SEQ ID NO: 433770 - DNA, 20 bp, Artificial Sequence
  chemically synthesized
aaaaaaggatgggttgaaac

SEQ ID NO: 433771 - DNA, 20 bp, Artificial Sequence
  chemically synthesized
aaaaaggatgggttgaaact

SEQ ID NO: 433772 - DNA, 20 bp, Artificial Sequence
  chemically synthesized
aaaaggatgggttgaaacta

SEQ ID NO: 433773 - DNA, 20 bp, Artificial Sequence
  chemically synthesized
aggatgggttgaaactaggg

SEQ ID NO: 433774 - DNA, 20 bp, Artificial Sequence
  chemically synthesized
ggatgggttgaaactagggt

SEQ ID NO: 433775 - DNA, 20 bp, Artificial Sequence
  chemically synthesized
ttcttatttcaatcctaccc

SEQ ID NO: 433776 - DNA, 20 bp, Artificial Sequence
  chemically synthesized
aactagggtaggattgaaat

SEQ ID NO: 433777 - DNA, 20 bp, Artificial Sequence
  chemically synthesized
tagggtaggattgaaataag

SEQ ID NO: 433778 - DNA, 20 bp, Artificial Sequence
  chemically synthesized
agggtaggattgaaataaga

SEQ ID NO: 433779 - DNA, 20 bp, Artificial Sequence
  chemically synthesized
ggattgaaataagaaggaaa

SEQ ID NO: 433780 - DNA, 20 bp, Artificial Sequence
  chemically synthesized
agaaggaaatagatgaacat

SEQ ID NO: 433781 - DNA, 20 bp, Artificial Sequence
  chemically synthesized
aaggaaatagatgaacatta

SEQ ID NO: 433782 - DNA, 20 bp, Artificial Sequence
  chemically synthesized
aacattagagataatcactt

SEQ ID NO: 433783 - DNA, 20 bp, Artificial Sequence
  chemically synthesized
tcaattttatgttttcactt

SEQ ID NO: 433784 - DNA, 20 bp, Artificial Sequence
  chemically synthesized
ttaagtgaaaacataaaatt

SEQ ID NO: 433785 - DNA, 20 bp, Artificial Sequence
  chemically synthesized
catgcatgaatttcatgata

SEQ ID NO: 433786 - DNA, 20 bp, Artificial Sequence
  chemically synthesized
tcatgcatgaatttcatgat

SEQ ID NO: 433787 - DNA, 20 bp, Artificial Sequence
  chemically synthesized
aaacagatcaacaggcatga

SEQ ID NO: 433788 - DNA, 20 bp, Artificial Sequence
  chemically synthesized
tattttttaaacagatcaac

SEQ ID NO: 433789 - DNA, 20 bp, Artificial Sequence
  chemically synthesized
ttattttttaaacagatcaa

SEQ ID NO: 433790 - DNA, 20 bp, Artificial Sequence
  chemically synthesized
ggctactattattttttaaa

SEQ ID NO: 433791 - DNA, 20 bp, Artificial Sequence
  chemically synthesized
ttgatctgtttaaaaaataa

SEQ ID NO: 433792 - DNA, 20 bp, Artificial Sequence
  chemically synthesized
atctgtttaaaaaataatag

SEQ ID NO: 433793 - DNA, 20 bp, Artificial Sequence
  chemically synthesized
tgatcatttgagaatatttg

SEQ ID NO: 433794 - DNA, 20 bp, Artificial Sequence
  chemically synthesized
gattcgatgcatgatcattt

SEQ ID NO: 433795 - DNA, 20 bp, Artificial Sequence
  chemically synthesized
tgatcatgcatcgaatcttg

SEQ ID NO: 433796 - DNA, 20 bp, Artificial Sequence
  chemically synthesized
tgattactcttggggtccac

SEQ ID NO: 433797 - DNA, 20 bp, Artificial Sequence
  chemically synthesized
catcgaatcttgtggacccc

SEQ ID NO: 433798 - DNA, 20 bp, Artificial Sequence
  chemically synthesized
tcgaatcttgtggaccccaa

SEQ ID NO: 433799 - DNA, 20 bp, Artificial Sequence
  chemically synthesized
tagggatatgattactcttg

SEQ ID NO: 433800 - DNA, 20 bp, Artificial Sequence
  chemically synthesized
ttagggatatgattactctt

SEQ ID NO: 433801 - DNA, 20 bp, Artificial Sequence
  chemically synthesized
cttagggatatgattactct

SEQ ID NO: 433802 - DNA, 20 bp, Artificial Sequence
  chemically synthesized
ccaagagtaatcatatccct

SEQ ID NO: 433803 - DNA, 20 bp, Artificial Sequence
  chemically synthesized
caagagtaatcatatcccta

SEQ ID NO: 433804 - DNA, 20 bp, Artificial Sequence
  chemically synthesized
aagagtaatcatatccctaa

SEQ ID NO: 433805 - DNA, 20 bp, Artificial Sequence
  chemically synthesized
gagtaatcatatccctaagg

SEQ ID NO: 433806 - DNA, 20 bp, Artificial Sequence
  chemically synthesized
tacgttatttagctccctta

SEQ ID NO: 433807 - DNA, 20 bp, Artificial Sequence
  chemically synthesized
atacgttatttagctccctt

SEQ ID NO: 433808 - DNA, 20 bp, Artificial Sequence
  chemically synthesized
catacgttatttagctccct

SEQ ID NO: 433809 - DNA, 20 bp, Artificial Sequence
  chemically synthesized
atctacactcatacgttatt

SEQ ID NO: 433810 - DNA, 20 bp, Artificial Sequence
  chemically synthesized
aagggagctaaataacgtat

SEQ ID NO: 433811 - DNA, 20 bp, Artificial Sequence
  chemically synthesized
agctaaataacgtatgagtg

SEQ ID NO: 433812 - DNA, 20 bp, Artificial Sequence
  chemically synthesized
tttgaaaaactgcattgcaa

SEQ ID NO: 433813 - DNA, 20 bp, Artificial Sequence
  chemically synthesized
tgtagatgtctattgcaatg

SEQ ID NO: 433814 - DNA, 20 bp, Artificial Sequence
  chemically synthesized
ggaagtcaacaaattgtcaa

SEQ ID NO: 433815 - DNA, 20 bp, Artificial Sequence
  chemically synthesized
acaatttgttgacttccttc

SEQ ID NO: 433816 - DNA, 20 bp, Artificial Sequence
  chemically synthesized
caatttgttgacttccttca

SEQ ID NO: 433817 - DNA, 20 bp, Artificial Sequence
  chemically synthesized
agctaagccaaccttgaagg

SEQ ID NO: 433818 - DNA, 20 bp, Artificial Sequence
  chemically synthesized
ttgttgacttccttcaaggt

SEQ ID NO: 433819 - DNA, 20 bp, Artificial Sequence
  chemically synthesized
gaaagctaagccaaccttga

SEQ ID NO: 433820 - DNA, 20 bp, Artificial Sequence
  chemically synthesized
agaaagctaagccaaccttg

SEQ ID NO: 433821 - DNA, 20 bp, Artificial Sequence
  chemically synthesized
gacttccttcaaggttggct

SEQ ID NO: 433822 - DNA, 20 bp, Artificial Sequence
  chemically synthesized
ggaggctgagaaagaaagct

SEQ ID NO: 433823 - DNA, 20 bp, Artificial Sequence
  chemically synthesized
gttggcttagctttctttct

SEQ ID NO: 433824 - DNA, 20 bp, Artificial Sequence
  chemically synthesized
cttttggaggctgagaaaga

SEQ ID NO: 433825 - DNA, 20 bp, Artificial Sequence
  chemically synthesized
tagccttttggaggctgaga

SEQ ID NO: 433826 - DNA, 20 bp, Artificial Sequence
  chemically synthesized
ttgatagccttttggaggct

SEQ ID NO: 433827 - DNA, 20 bp, Artificial Sequence
  chemically synthesized
ctttctttctcagcctccaa

SEQ ID NO: 433828 - DNA, 20 bp, Artificial Sequence
  chemically synthesized
tttctttctcagcctccaaa

SEQ ID NO: 433829 - DNA, 20 bp, Artificial Sequence
  chemically synthesized
gaaacttgatagccttttgg

SEQ ID NO: 433830 - DNA, 20 bp, Artificial Sequence
  chemically synthesized
ggaaacttgatagccttttg

SEQ ID NO: 433831 - DNA, 20 bp, Artificial Sequence
  chemically synthesized
tgggaaacttgatagccttt

SEQ ID NO: 433832 - DNA, 20 bp, Artificial Sequence
  chemically synthesized
tcagcctccaaaaggctatc

SEQ ID NO: 433833 - DNA, 20 bp, Artificial Sequence
  chemically synthesized
gaactacatgggaaacttga

SEQ ID NO: 433834 - DNA, 20 bp, Artificial Sequence
  chemically synthesized
aggctatcaagtttcccatg

SEQ ID NO: 433835 - DNA, 20 bp, Artificial Sequence
  chemically synthesized
atcatctcaaagaactacat

SEQ ID NO: 433836 - DNA, 20 bp, Artificial Sequence
  chemically synthesized
gatcatctcaaagaactaca

SEQ ID NO: 433837 - DNA, 20 bp, Artificial Sequence
  chemically synthesized
agtttcccatgtagttcttt

SEQ ID NO: 433838 - DNA, 20 bp, Artificial Sequence
  chemically synthesized
aacatagatcgatcatctca

SEQ ID NO: 433839 - DNA, 20 bp, Artificial Sequence
  chemically synthesized
gagatgatcgatctatgttt

SEQ ID NO: 433840 - DNA, 20 bp, Artificial Sequence
  chemically synthesized
agatgatcgatctatgtttt

SEQ ID NO: 433841 - DNA, 20 bp, Artificial Sequence
  chemically synthesized
ttgcaactcctcccaaaaca

SEQ ID NO: 433842 - DNA, 20 bp, Artificial Sequence
  chemically synthesized
atgatcgatctatgttttgg

SEQ ID NO: 433843 - DNA, 20 bp, Artificial Sequence
  chemically synthesized
tgatcgatctatgttttggg

SEQ ID NO: 433844 - DNA, 20 bp, Artificial Sequence
  chemically synthesized
atcgatctatgttttgggag

SEQ ID NO: 433845 - DNA, 20 bp, Artificial Sequence
  chemically synthesized
ggaggagttgcaaaatatat

SEQ ID NO: 433846 - DNA, 20 bp, Artificial Sequence
  chemically synthesized
gttgcaaaatatatgagata

SEQ ID NO: 433847 - DNA, 20 bp, Artificial Sequence
  chemically synthesized
aatccttctgatacagaagg

SEQ ID NO: 433848 - DNA, 20 bp, Artificial Sequence
  chemically synthesized
gatatagccaccttctgtat

SEQ ID NO: 433849 - DNA, 20 bp, Artificial Sequence
  chemically synthesized
gggaatccttctgatacaga

SEQ ID NO: 433850 - DNA, 20 bp, Artificial Sequence
  chemically synthesized
agggaatccttctgatacag

SEQ ID NO: 433851 - DNA, 20 bp, Artificial Sequence
  chemically synthesized
atagccaccttctgtatcag

SEQ ID NO: 433852 - DNA, 20 bp, Artificial Sequence
  chemically synthesized
tagccaccttctgtatcaga

SEQ ID NO: 433853 - DNA, 20 bp, Artificial Sequence
  chemically synthesized
aagagggaatccttctgata

SEQ ID NO: 433854 - DNA, 20 bp, Artificial Sequence
  chemically synthesized
gtatcagaaggattccctct

SEQ ID NO: 433855 - DNA, 20 bp, Artificial Sequence
  chemically synthesized
tatcagaaggattccctctt

SEQ ID NO: 433856 - DNA, 20 bp, Artificial Sequence
  chemically synthesized
attgttctgataacccaaga

SEQ ID NO: 433857 - DNA, 20 bp, Artificial Sequence
  chemically synthesized
gattgttctgataacccaag

SEQ ID NO: 433858 - DNA, 20 bp, Artificial Sequence
  chemically synthesized
tgattgttctgataacccaa

SEQ ID NO: 433859 - DNA, 20 bp, Artificial Sequence
  chemically synthesized
aggattccctcttgggttat

SEQ ID NO: 433860 - DNA, 20 bp, Artificial Sequence
  chemically synthesized
tttgattgttctgataaccc

SEQ ID NO: 433861 - DNA, 20 bp, Artificial Sequence
  chemically synthesized
ttgggttatcagaacaatca

SEQ ID NO: 433862 - DNA, 20 bp, Artificial Sequence
  chemically synthesized
ggttatcagaacaatcaaag

SEQ ID NO: 433863 - DNA, 20 bp, Artificial Sequence
  chemically synthesized
tctctcctccagtaatcaga

SEQ ID NO: 433864 - DNA, 20 bp, Artificial Sequence
  chemically synthesized
caaagaagctatctgattac

SEQ ID NO: 433865 - DNA, 20 bp, Artificial Sequence
  chemically synthesized
aagaagctatctgattactg

SEQ ID NO: 433866 - DNA, 20 bp, Artificial Sequence
  chemically synthesized
tcagtctctcctccagtaat

SEQ ID NO: 433867 - DNA, 20 bp, Artificial Sequence
  chemically synthesized
agaagctatctgattactgg

SEQ ID NO: 433868 - DNA, 20 bp, Artificial Sequence
  chemically synthesized
aagctatctgattactggag

SEQ ID NO: 433869 - DNA, 20 bp, Artificial Sequence
  chemically synthesized
gctatctgattactggagga

SEQ ID NO: 433870 - DNA, 20 bp, Artificial Sequence
  chemically synthesized
ttttatgtcagtctctcctc

SEQ ID NO: 433871 - DNA, 20 bp, Artificial Sequence
  chemically synthesized
taaaaactacaattttatgt

SEQ ID NO: 433872 - DNA, 20 bp, Artificial Sequence
  chemically synthesized
gagagactgacataaaattg

SEQ ID NO: 433873 - DNA, 20 bp, Artificial Sequence
  chemically synthesized
tagtttttaacttcttgtga

SEQ ID NO: 433874 - DNA, 20 bp, Artificial Sequence
  chemically synthesized
gctctcacaactttcacaag

SEQ ID NO: 433875 - DNA, 20 bp, Artificial Sequence
  chemically synthesized
caagctctcacaactttcac

SEQ ID NO: 433876 - DNA, 20 bp, Artificial Sequence
  chemically synthesized
taacttcttgtgaaagttgt

SEQ ID NO: 433877 - DNA, 20 bp, Artificial Sequence
  chemically synthesized
acttcttgtgaaagttgtga

SEQ ID NO: 433878 - DNA, 20 bp, Artificial Sequence
  chemically synthesized
ttactcctgcatgcagtgtc

SEQ ID NO: 433879 - DNA, 20 bp, Artificial Sequence
  chemically synthesized
tgagagcttgacactgcatg

SEQ ID NO: 433880 - DNA, 20 bp, Artificial Sequence
  chemically synthesized
gagagcttgacactgcatgc

SEQ ID NO: 433881 - DNA, 20 bp, Artificial Sequence
  chemically synthesized
gagcttgacactgcatgcag

SEQ ID NO: 433882 - DNA, 20 bp, Artificial Sequence
  chemically synthesized
tcttaagttactcctgcatg

SEQ ID NO: 433883 - DNA, 20 bp, Artificial Sequence
  chemically synthesized
actgcatgcaggagtaactt

SEQ ID NO: 433884 - DNA, 20 bp, Artificial Sequence
  chemically synthesized
acagagggaagattgttctt

SEQ ID NO: 433885 - DNA, 20 bp, Artificial Sequence
  chemically synthesized
taagaacaatcttccctctg

SEQ ID NO: 433886 - DNA, 20 bp, Artificial Sequence
  chemically synthesized
gatttcaaagccacagaggg

SEQ ID NO: 433887 - DNA, 20 bp, Artificial Sequence
  chemically synthesized
ggtgatttcaaagccacaga

SEQ ID NO: 433888 - DNA, 20 bp, Artificial Sequence
  chemically synthesized
gggtgatttcaaagccacag

SEQ ID NO: 433889 - DNA, 20 bp, Artificial Sequence
  chemically synthesized
ggggtgatttcaaagccaca

SEQ ID NO: 433890 - DNA, 20 bp, Artificial Sequence
  chemically synthesized
atggggtgatttcaaagcca

SEQ ID NO: 433891 - DNA, 20 bp, Artificial Sequence
  chemically synthesized
tcccacatggggtgatttca

SEQ ID NO: 433892 - DNA, 20 bp, Artificial Sequence
  chemically synthesized
ggctttgaaatcaccccatg

SEQ ID NO: 433893 - DNA, 20 bp, Artificial Sequence
  chemically synthesized
gctttgaaatcaccccatgt

SEQ ID NO: 433894 - DNA, 20 bp, Artificial Sequence
  chemically synthesized
ccttgtagttatcccacatg

SEQ ID NO: 433895 - DNA, 20 bp, Artificial Sequence
  chemically synthesized
gccttgtagttatcccacat

SEQ ID NO: 433896 - DNA, 20 bp, Artificial Sequence
  chemically synthesized
ggccttgtagttatcccaca

SEQ ID NO: 433897 - DNA, 20 bp, Artificial Sequence
  chemically synthesized
accccatgtgggataactac

SEQ ID NO: 433898 - DNA, 20 bp, Artificial Sequence
  chemically synthesized
ccccatgtgggataactaca

SEQ ID NO: 433899 - DNA, 20 bp, Artificial Sequence
  chemically synthesized
tccaacaataacaggccttg

SEQ ID NO: 433900 - DNA, 20 bp, Artificial Sequence
  chemically synthesized
ttagctcttccaacaataac

SEQ ID NO: 433901 - DNA, 20 bp, Artificial Sequence
  chemically synthesized
actacaaggcctgttattgt

SEQ ID NO: 433902 - DNA, 20 bp, Artificial Sequence
  chemically synthesized
cttagctcttccaacaataa

SEQ ID NO: 433903 - DNA, 20 bp, Artificial Sequence
  chemically synthesized
acaaggcctgttattgttgg

SEQ ID NO: 433904 - DNA, 20 bp, Artificial Sequence
  chemically synthesized
aaggcctgttattgttggaa

SEQ ID NO: 433905 - DNA, 20 bp, Artificial Sequence
  chemically synthesized
ctgttattgttggaagagct

SEQ ID NO: 433906 - DNA, 20 bp, Artificial Sequence
  chemically synthesized
ttgttggaagagctaagcaa

SEQ ID NO: 433907 - DNA, 20 bp, Artificial Sequence
  chemically synthesized
gttctctttaaactattgct

SEQ ID NO: 433908 - DNA, 20 bp, Artificial Sequence
  chemically synthesized
aagagctaagcaatagttta

SEQ ID NO: 433909 - DNA, 20 bp, Artificial Sequence
  chemically synthesized
gagctaagcaatagtttaaa

SEQ ID NO: 433910 - DNA, 20 bp, Artificial Sequence
  chemically synthesized
agcaatagtttaaagagaac

SEQ ID NO: 433911 - DNA, 20 bp, Artificial Sequence
  chemically synthesized
cttgatttttgtaacaaatc

SEQ ID NO: 433912 - DNA, 20 bp, Artificial Sequence
  chemically synthesized
ctagatttgttacaaaaatc

SEQ ID NO: 433913 - DNA, 20 bp, Artificial Sequence
  chemically synthesized
atttgttacaaaaatcaaga

SEQ ID NO: 433914 - DNA, 20 bp, Artificial Sequence
  chemically synthesized
ctagtatgttgaattttagg

SEQ ID NO: 433915 - DNA, 20 bp, Artificial Sequence
  chemically synthesized
ggcctagtatgttgaatttt

SEQ ID NO: 433916 - DNA, 20 bp, Artificial Sequence
  chemically synthesized
aggcctagtatgttgaattt

SEQ ID NO: 433917 - DNA, 20 bp, Artificial Sequence
  chemically synthesized
ctgcctaaaattcaacatac

SEQ ID NO: 433918 - DNA, 20 bp, Artificial Sequence
  chemically synthesized
tgcctaaaattcaacatact

SEQ ID NO: 433919 - DNA, 20 bp, Artificial Sequence
  chemically synthesized
ataatatacgtaaataggcc

SEQ ID NO: 433920 - DNA, 20 bp, Artificial Sequence
  chemically synthesized
tgggcataatatacgtaaat

SEQ ID NO: 433921 - DNA, 20 bp, Artificial Sequence
  chemically synthesized
ttgggcataatatacgtaaa

SEQ ID NO: 433922 - DNA, 20 bp, Artificial Sequence
  chemically synthesized
tatttacgtatattatgccc

SEQ ID NO: 433923 - DNA, 20 bp, Artificial Sequence
  chemically synthesized
atttacgtatattatgccca

SEQ ID NO: 433924 - DNA, 20 bp, Artificial Sequence
  chemically synthesized
tattaccagccaagtgcctt

SEQ ID NO: 433925 - DNA, 20 bp, Artificial Sequence
  chemically synthesized
tatattatgcccaaggcact

SEQ ID NO: 433926 - DNA, 20 bp, Artificial Sequence
  chemically synthesized
gtattaccagccaagtgcct

SEQ ID NO: 433927 - DNA, 20 bp, Artificial Sequence
  chemically synthesized
ttatgcccaaggcacttggc

SEQ ID NO: 433928 - DNA, 20 bp, Artificial Sequence
  chemically synthesized
tagcccctgtattaccagcc

SEQ ID NO: 433929 - DNA, 20 bp, Artificial Sequence
  chemically synthesized
aaggcacttggctggtaata

SEQ ID NO: 433930 - DNA, 20 bp, Artificial Sequence
  chemically synthesized
aggcacttggctggtaatac

SEQ ID NO: 433931 - DNA, 20 bp, Artificial Sequence
  chemically synthesized
ttgtttagcccctgtattac

SEQ ID NO: 433932 - DNA, 20 bp, Artificial Sequence
  chemically synthesized
ggcacttggctggtaataca

SEQ ID NO: 433933 - DNA, 20 bp, Artificial Sequence
  chemically synthesized
gcacttggctggtaatacag

SEQ ID NO: 433934 - DNA, 20 bp, Artificial Sequence
  chemically synthesized
ggtaatacaggggctaaaca

SEQ ID NO: 433935 - DNA, 20 bp, Artificial Sequence
  chemically synthesized
actaattttctttctttgtt

SEQ ID NO: 433936 - DNA, 20 bp, Artificial Sequence
  chemically synthesized
atacaggggctaaacaaaga

SEQ ID NO: 433937 - DNA, 20 bp, Artificial Sequence
  chemically synthesized
gctaaacaaagaaagaaaat

SEQ ID NO: 433938 - DNA, 20 bp, Artificial Sequence
  chemically synthesized
aaagaaaattagttcttgcc

SEQ ID NO: 433939 - DNA, 20 bp, Artificial Sequence
  chemically synthesized
aagaaaattagttcttgcct

SEQ ID NO: 433940 - DNA, 20 bp, Artificial Sequence
  chemically synthesized
agaaaattagttcttgccta

SEQ ID NO: 433941 - DNA, 20 bp, Artificial Sequence
  chemically synthesized
cttttcctccttccctaggc

SEQ ID NO: 433942 - DNA, 20 bp, Artificial Sequence
  chemically synthesized
aaattagttcttgcctaggg

SEQ ID NO: 433943 - DNA, 20 bp, Artificial Sequence
  chemically synthesized
aattagttcttgcctaggga

SEQ ID NO: 433944 - DNA, 20 bp, Artificial Sequence
  chemically synthesized
ttagttcttgcctagggaag

SEQ ID NO: 433945 - DNA, 20 bp, Artificial Sequence
  chemically synthesized
attccttttcctccttccct

SEQ ID NO: 433946 - DNA, 20 bp, Artificial Sequence
  chemically synthesized
tagttcttgcctagggaagg

SEQ ID NO: 433947 - DNA, 20 bp, Artificial Sequence
  chemically synthesized
tattccttttcctccttccc

SEQ ID NO: 433948 - DNA, 20 bp, Artificial Sequence
  chemically synthesized
cttgcctagggaaggaggaa

SEQ ID NO: 433949 - DNA, 20 bp, Artificial Sequence
  chemically synthesized
ttgcctagggaaggaggaaa

SEQ ID NO: 433950 - DNA, 20 bp, Artificial Sequence
  chemically synthesized
aggaaaaggaataatttatt

SEQ ID NO: 433951 - DNA, 20 bp, Artificial Sequence
  chemically synthesized
taaagggcatagtgtataat

SEQ ID NO: 433952 - DNA, 20 bp, Artificial Sequence
  chemically synthesized
tgacataaatataaagggca

SEQ ID NO: 433953 - DNA, 20 bp, Artificial Sequence
  chemically synthesized
ttggatgacataaatataaa

SEQ ID NO: 433954 - DNA, 20 bp, Artificial Sequence
  chemically synthesized
attggatgacataaatataa

SEQ ID NO: 433955 - DNA, 20 bp, Artificial Sequence
  chemically synthesized
cattggatgacataaatata

SEQ ID NO: 433956 - DNA, 20 bp, Artificial Sequence
  chemically synthesized
tttatgtcatccaatgcaca

SEQ ID NO: 433957 - DNA, 20 bp, Artificial Sequence
  chemically synthesized
cataataaagctttgtgcat

SEQ ID NO: 433958 - DNA, 20 bp, Artificial Sequence
  chemically synthesized
atatttcctaaatcataata

SEQ ID NO: 433959 - DNA, 20 bp, Artificial Sequence
  chemically synthesized
cacaaagctttattatgatt

SEQ ID NO: 433960 - DNA, 20 bp, Artificial Sequence
  chemically synthesized
acaaagctttattatgattt

SEQ ID NO: 433961 - DNA, 20 bp, Artificial Sequence
  chemically synthesized
gaaatattatactcacttta

SEQ ID NO: 433962 - DNA, 20 bp, Artificial Sequence
  chemically synthesized
aaatattatactcactttac

SEQ ID NO: 433963 - DNA, 20 bp, Artificial Sequence
  chemically synthesized
gtgcttttttcctgtaaagt

SEQ ID NO: 433964 - DNA, 20 bp, Artificial Sequence
  chemically synthesized
catggtgcttttttcctgta

SEQ ID NO: 433965 - DNA, 20 bp, Artificial Sequence
  chemically synthesized
atactcactttacaggaaaa

SEQ ID NO: 433966 - DNA, 20 bp, Artificial Sequence
  chemically synthesized
tacaggaaaaaagcaccatg

SEQ ID NO: 433967 - DNA, 20 bp, Artificial Sequence
  chemically synthesized
tcaatgttcttttcacttca

SEQ ID NO: 433968 - DNA, 20 bp, Artificial Sequence
  chemically synthesized
aaaaagcaccatgaagtgaa

SEQ ID NO: 433969 - DNA, 20 bp, Artificial Sequence
  chemically synthesized
agtgaaaagaacattgacta

SEQ ID NO: 433970 - DNA, 20 bp, Artificial Sequence
  chemically synthesized
tgaaaagaacattgactaca

SEQ ID NO: 433971 - DNA, 20 bp, Artificial Sequence
  chemically synthesized
aagaacattgactacagagt

SEQ ID NO: 433972 - DNA, 20 bp, Artificial Sequence
  chemically synthesized
ctcaggtgtgtctgactctg

SEQ ID NO: 433973 - DNA, 20 bp, Artificial Sequence
  chemically synthesized
ctacagagtcagacacacct

SEQ ID NO: 433974 - DNA, 20 bp, Artificial Sequence
  chemically synthesized
gtcagacacacctgagtttg

SEQ ID NO: 433975 - DNA, 20 bp, Artificial Sequence
  chemically synthesized
ctaagccacacttcaaactc

SEQ ID NO: 433976 - DNA, 20 bp, Artificial Sequence
  chemically synthesized
gctaagccacacttcaaact

SEQ ID NO: 433977 - DNA, 20 bp, Artificial Sequence
  chemically synthesized
acacacctgagtttgaagtg

SEQ ID NO: 433978 - DNA, 20 bp, Artificial Sequence
  chemically synthesized
cctgagtttgaagtgtggct

SEQ ID NO: 433979 - DNA, 20 bp, Artificial Sequence
  chemically synthesized
cttagaactattaagaggct

SEQ ID NO: 433980 - DNA, 20 bp, Artificial Sequence
  chemically synthesized
agtgtggcttagcctcttaa

SEQ ID NO: 433981 - DNA, 20 bp, Artificial Sequence
  chemically synthesized
cctttcttagaactattaag

SEQ ID NO: 433982 - DNA, 20 bp, Artificial Sequence
  chemically synthesized
tcctttcttagaactattaa

SEQ ID NO: 433983 - DNA, 20 bp, Artificial Sequence
  chemically synthesized
attcctttcttagaactatt

SEQ ID NO: 433984 - DNA, 20 bp, Artificial Sequence
  chemically synthesized
cttagcctcttaatagttct

SEQ ID NO: 433985 - DNA, 20 bp, Artificial Sequence
  chemically synthesized
gcctcttaatagttctaaga

SEQ ID NO: 433986 - DNA, 20 bp, Artificial Sequence
  chemically synthesized
cctcttaatagttctaagaa

SEQ ID NO: 433987 - DNA, 20 bp, Artificial Sequence
  chemically synthesized
aagaggttaaattcctttct

SEQ ID NO: 433988 - DNA, 20 bp, Artificial Sequence
  chemically synthesized
gaaaggaatttaacctcttc

SEQ ID NO: 433989 - DNA, 20 bp, Artificial Sequence
  chemically synthesized
aaaggaatttaacctcttcg

SEQ ID NO: 433990 - DNA, 20 bp, Artificial Sequence
  chemically synthesized
tcagaaaactggcctcgaag

SEQ ID NO: 433991 - DNA, 20 bp, Artificial Sequence
  chemically synthesized
atcagaaaactggcctcgaa

SEQ ID NO: 433992 - DNA, 20 bp, Artificial Sequence
  chemically synthesized
gaatttaacctcttcgaggc

SEQ ID NO: 433993 - DNA, 20 bp, Artificial Sequence
  chemically synthesized
taatcagaaaactggcctcg

SEQ ID NO: 433994 - DNA, 20 bp, Artificial Sequence
  chemically synthesized
tgttttactaatcagaaaac

SEQ ID NO: 433995 - DNA, 20 bp, Artificial Sequence
  chemically synthesized
ttcgaggccagttttctgat

SEQ ID NO: 433996 - DNA, 20 bp, Artificial Sequence
  chemically synthesized
tgcttccctgttttactaat

SEQ ID NO: 433997 - DNA, 20 bp, Artificial Sequence
  chemically synthesized
cagttttctgattagtaaaa

SEQ ID NO: 433998 - DNA, 20 bp, Artificial Sequence
  chemically synthesized
agttttctgattagtaaaac

SEQ ID NO: 433999 - DNA, 20 bp, Artificial Sequence
  chemically synthesized
gttttctgattagtaaaaca

SEQ ID NO: 434000 - DNA, 20 bp, Artificial Sequence
  chemically synthesized
ttctgattagtaaaacaggg

SEQ ID NO: 434001 - DNA, 20 bp, Artificial Sequence
  chemically synthesized
atttgctccttcacaataga

SEQ ID NO: 434002 - DNA, 20 bp, Artificial Sequence
  chemically synthesized
tatttgctccttcacaatag

SEQ ID NO: 434003 - DNA, 20 bp, Artificial Sequence
  chemically synthesized
gcatattaccttctattgtg

SEQ ID NO: 434004 - DNA, 20 bp, Artificial Sequence
  chemically synthesized
catattaccttctattgtga

SEQ ID NO: 434005 - DNA, 20 bp, Artificial Sequence
  chemically synthesized
cggtatttgctccttcacaa

SEQ ID NO: 434006 - DNA, 20 bp, Artificial Sequence
  chemically synthesized
tattaccttctattgtgaag

SEQ ID NO: 434007 - DNA, 20 bp, Artificial Sequence
  chemically synthesized
tattgtgaaggagcaaatac

SEQ ID NO: 434008 - DNA, 20 bp, Artificial Sequence
  chemically synthesized
taactgcaaaacagcatagc

SEQ ID NO: 434009 - DNA, 20 bp, Artificial Sequence
  chemically synthesized
atgttaactgcaaaacagca

SEQ ID NO: 434010 - DNA, 20 bp, Artificial Sequence
  chemically synthesized
ataccggctatgctgttttg

SEQ ID NO: 434011 - DNA, 20 bp, Artificial Sequence
  chemically synthesized
tatgaatgttaactgcaaaa

SEQ ID NO: 434012 - DNA, 20 bp, Artificial Sequence
  chemically synthesized
tgcagttaacattcatatga

SEQ ID NO: 434013 - DNA, 20 bp, Artificial Sequence
  chemically synthesized
gcagttaacattcatatgaa

SEQ ID NO: 434014 - DNA, 20 bp, Artificial Sequence
  chemically synthesized
aacattcatatgaaaggtat

SEQ ID NO: 434015 - DNA, 20 bp, Artificial Sequence
  chemically synthesized
gaaaggtataagataataat

SEQ ID NO: 434016 - DNA, 20 bp, Artificial Sequence
  chemically synthesized
attaaatgtatatcatgttc

SEQ ID NO: 434017 - DNA, 20 bp, Artificial Sequence
  chemically synthesized
tcttagcatataataaggtc

SEQ ID NO: 434018 - DNA, 20 bp, Artificial Sequence
  chemically synthesized
aaaagtcttagcatataata

SEQ ID NO: 434019 - DNA, 20 bp, Artificial Sequence
  chemically synthesized
gaaaagtcttagcatataat

SEQ ID NO: 434020 - DNA, 20 bp, Artificial Sequence
  chemically synthesized
tccagaccttattatatgct

SEQ ID NO: 434021 - DNA, 20 bp, Artificial Sequence
  chemically synthesized
gataatatatggaaaagtct

SEQ ID NO: 434022 - DNA, 20 bp, Artificial Sequence
  chemically synthesized
aaatgagataatatatggaa

SEQ ID NO: 434023 - DNA, 20 bp, Artificial Sequence
  chemically synthesized
agattaaatgagataatata

SEQ ID NO: 434024 - DNA, 20 bp, Artificial Sequence
  chemically synthesized
ggttgctatgaagattaaat

SEQ ID NO: 434025 - DNA, 20 bp, Artificial Sequence
  chemically synthesized
attatctcatttaatcttca

SEQ ID NO: 434026 - DNA, 20 bp, Artificial Sequence
  chemically synthesized
ctcctcacctggttgctatg

SEQ ID NO: 434027 - DNA, 20 bp, Artificial Sequence
  chemically synthesized
catttaatcttcatagcaac

SEQ ID NO: 434028 - DNA, 20 bp, Artificial Sequence
  chemically synthesized
atttaatcttcatagcaacc

SEQ ID NO: 434029 - DNA, 20 bp, Artificial Sequence
  chemically synthesized
aatcttcatagcaaccaggt

SEQ ID NO: 434030 - DNA, 20 bp, Artificial Sequence
  chemically synthesized
atcttcatagcaaccaggtg

SEQ ID NO: 434031 - DNA, 20 bp, Artificial Sequence
  chemically synthesized
cttcatagcaaccaggtgag

SEQ ID NO: 434032 - DNA, 20 bp, Artificial Sequence
  chemically synthesized
ttcatagcaaccaggtgagg

SEQ ID NO: 434033 - DNA, 20 bp, Artificial Sequence
  chemically synthesized
attcctggcccctcctcacc

SEQ ID NO: 434034 - DNA, 20 bp, Artificial Sequence
  chemically synthesized
tcatagcaaccaggtgagga

SEQ ID NO: 434035 - DNA, 20 bp, Artificial Sequence
  chemically synthesized
catagcaaccaggtgaggag

SEQ ID NO: 434036 - DNA, 20 bp, Artificial Sequence
  chemically synthesized
gcaaccaggtgaggaggggc

SEQ ID NO: 434037 - DNA, 20 bp, Artificial Sequence
  chemically synthesized
caaccaggtgaggaggggcc

SEQ ID NO: 434038 - DNA, 20 bp, Artificial Sequence
  chemically synthesized
taaaataatggaaaaattcc

SEQ ID NO: 434039 - DNA, 20 bp, Artificial Sequence
  chemically synthesized
tttccttaactgtaaaataa

SEQ ID NO: 434040 - DNA, 20 bp, Artificial Sequence
  chemically synthesized
ggaatttttccattatttta

SEQ ID NO: 434041 - DNA, 20 bp, Artificial Sequence
  chemically synthesized
ttttccattattttacagtt

SEQ ID NO: 434042 - DNA, 20 bp, Artificial Sequence
  chemically synthesized
tttccattattttacagtta

SEQ ID NO: 434043 - DNA, 20 bp, Artificial Sequence
  chemically synthesized
ttttacagttaaggaaacta

SEQ ID NO: 434044 - DNA, 20 bp, Artificial Sequence
  chemically synthesized
cagttaaggaaactaaagct

SEQ ID NO: 434045 - DNA, 20 bp, Artificial Sequence
  chemically synthesized
gtttctttaaatctgagctt

SEQ ID NO: 434046 - DNA, 20 bp, Artificial Sequence
  chemically synthesized
gaaactaaagctcagattta

SEQ ID NO: 434047 - DNA, 20 bp, Artificial Sequence
  chemically synthesized
acccaggtttctttaaatct

SEQ ID NO: 434048 - DNA, 20 bp, Artificial Sequence
  chemically synthesized
agctcagatttaaagaaacc

SEQ ID NO: 434049 - DNA, 20 bp, Artificial Sequence
  chemically synthesized
gctcagatttaaagaaacct

SEQ ID NO: 434050 - DNA, 20 bp, Artificial Sequence
  chemically synthesized
gatttaaagaaacctgggtg

SEQ ID NO: 434051 - DNA, 20 bp, Artificial Sequence
  chemically synthesized
tttttgatttgactgcaccc

SEQ ID NO: 434052 - DNA, 20 bp, Artificial Sequence
  chemically synthesized
ttttttgatttgactgcacc

SEQ ID NO: 434053 - DNA, 20 bp, Artificial Sequence
  chemically synthesized
tgggtgcagtcaaatcaaaa

SEQ ID NO: 434054 - DNA, 20 bp, Artificial Sequence
  chemically synthesized
cagtcaaatcaaaaaagatt

SEQ ID NO: 434055 - DNA, 20 bp, Artificial Sequence
  chemically synthesized
tcaaatcaaaaaagattaag

SEQ ID NO: 434056 - DNA, 20 bp, Artificial Sequence
  chemically synthesized
aaaagattaagtggctgaac

SEQ ID NO: 434057 - DNA, 20 bp, Artificial Sequence
  chemically synthesized
cgatatagctcatgccggtt

SEQ ID NO: 434058 - DNA, 20 bp, Artificial Sequence
  chemically synthesized
ttaagtggctgaaccggcat

SEQ ID NO: 434059 - DNA, 20 bp, Artificial Sequence
  chemically synthesized
gagcacgatatagctcatgc

SEQ ID NO: 434060 - DNA, 20 bp, Artificial Sequence
  chemically synthesized
tctgagatgagagcacgata

SEQ ID NO: 434061 - DNA, 20 bp, Artificial Sequence
  chemically synthesized
gctatatcgtgctctcatct

SEQ ID NO: 434062 - DNA, 20 bp, Artificial Sequence
  chemically synthesized
cgaaaggctctctgagatga

SEQ ID NO: 434063 - DNA, 20 bp, Artificial Sequence
  chemically synthesized
tatatcgtgctctcatctca

SEQ ID NO: 434064 - DNA, 20 bp, Artificial Sequence
  chemically synthesized
tgcgaaaggctctctgagat

SEQ ID NO: 434065 - DNA, 20 bp, Artificial Sequence
  chemically synthesized
tatcgtgctctcatctcaga

SEQ ID NO: 434066 - DNA, 20 bp, Artificial Sequence
  chemically synthesized
gtctatgcgaaaggctctct

SEQ ID NO: 434067 - DNA, 20 bp, Artificial Sequence
  chemically synthesized
atctcagagagcctttcgca

SEQ ID NO: 434068 - DNA, 20 bp, Artificial Sequence
  chemically synthesized
tcctcagatgtctatgcgaa

SEQ ID NO: 434069 - DNA, 20 bp, Artificial Sequence
  chemically synthesized
ctcctcagatgtctatgcga

SEQ ID NO: 434070 - DNA, 20 bp, Artificial Sequence
  chemically synthesized
agcctttcgcatagacatct

SEQ ID NO: 434071 - DNA, 20 bp, Artificial Sequence
  chemically synthesized
gcctttcgcatagacatctg

SEQ ID NO: 434072 - DNA, 20 bp, Artificial Sequence
  chemically synthesized
ctttcgcatagacatctgag

SEQ ID NO: 434073 - DNA, 20 bp, Artificial Sequence
  chemically synthesized
tttcgcatagacatctgagg

SEQ ID NO: 434074 - DNA, 20 bp, Artificial Sequence
  chemically synthesized
tgttaccctttgttcctcct

SEQ ID NO: 434075 - DNA, 20 bp, Artificial Sequence
  chemically synthesized
tagacatctgaggaggaaca

SEQ ID NO: 434076 - DNA, 20 bp, Artificial Sequence
  chemically synthesized
agacatctgaggaggaacaa

SEQ ID NO: 434077 - DNA, 20 bp, Artificial Sequence
  chemically synthesized
gacatctgaggaggaacaaa

SEQ ID NO: 434078 - DNA, 20 bp, Artificial Sequence
  chemically synthesized
ggaacaaagggtaacaataa

SEQ ID NO: 434079 - DNA, 20 bp, Artificial Sequence
  chemically synthesized
aatcaggagggtcagagaaa

SEQ ID NO: 434080 - DNA, 20 bp, Artificial Sequence
  chemically synthesized
aaaatcaggagggtcagaga

SEQ ID NO: 434081 - DNA, 20 bp, Artificial Sequence
  chemically synthesized
cttgaaaatcaggagggtca

SEQ ID NO: 434082 - DNA, 20 bp, Artificial Sequence
  chemically synthesized
ggcttgaaaatcaggagggt

SEQ ID NO: 434083 - DNA, 20 bp, Artificial Sequence
  chemically synthesized
ggctggcttgaaaatcagga

SEQ ID NO: 434084 - DNA, 20 bp, Artificial Sequence
  chemically synthesized
gggctggcttgaaaatcagg

SEQ ID NO: 434085 - DNA, 20 bp, Artificial Sequence
  chemically synthesized
ggggctggcttgaaaatcag

SEQ ID NO: 434086 - DNA, 20 bp, Artificial Sequence
  chemically synthesized
ctctgaccctcctgattttc

SEQ ID NO: 434087 - DNA, 20 bp, Artificial Sequence
  chemically synthesized
aaggggctggcttgaaaatc

SEQ ID NO: 434088 - DNA, 20 bp, Artificial Sequence
  chemically synthesized
gaaggggctggcttgaaaat

SEQ ID NO: 434089 - DNA, 20 bp, Artificial Sequence
  chemically synthesized
gaccctcctgattttcaagc

SEQ ID NO: 434090 - DNA, 20 bp, Artificial Sequence
  chemically synthesized
agtgggcatgtggaaggggc

SEQ ID NO: 434091 - DNA, 20 bp, Artificial Sequence
  chemically synthesized
ttgaagtgggcatgtggaag

SEQ ID NO: 434092 - DNA, 20 bp, Artificial Sequence
  chemically synthesized
gttgaagtgggcatgtggaa

SEQ ID NO: 434093 - DNA, 20 bp, Artificial Sequence
  chemically synthesized
ggttgaagtgggcatgtgga

SEQ ID NO: 434094 - DNA, 20 bp, Artificial Sequence
  chemically synthesized
gggttgaagtgggcatgtgg

SEQ ID NO: 434095 - DNA, 20 bp, Artificial Sequence
  chemically synthesized
caagggttgaagtgggcatg

SEQ ID NO: 434096 - DNA, 20 bp, Artificial Sequence
  chemically synthesized
atcttggcaagggttgaagt

SEQ ID NO: 434097 - DNA, 20 bp, Artificial Sequence
  chemically synthesized
aatcttggcaagggttgaag

SEQ ID NO: 434098 - DNA, 20 bp, Artificial Sequence
  chemically synthesized
aagaatcttggcaagggttg

SEQ ID NO: 434099 - DNA, 20 bp, Artificial Sequence
  chemically synthesized
tgcccacttcaacccttgcc

SEQ ID NO: 434100 - DNA, 20 bp, Artificial Sequence
  chemically synthesized
atacacaagaatcttggcaa

SEQ ID NO: 434101 - DNA, 20 bp, Artificial Sequence
  chemically synthesized
catacacaagaatcttggca

SEQ ID NO: 434102 - DNA, 20 bp, Artificial Sequence
  chemically synthesized
tcatacacaagaatcttggc

SEQ ID NO: 434103 - DNA, 20 bp, Artificial Sequence
  chemically synthesized
ttactcatacacaagaatct

SEQ ID NO: 434104 - DNA, 20 bp, Artificial Sequence
  chemically synthesized
ttgccaagattcttgtgtat

SEQ ID NO: 434105 - DNA, 20 bp, Artificial Sequence
  chemically synthesized
taacagagttactcatacac

SEQ ID NO: 434106 - DNA, 20 bp, Artificial Sequence
  chemically synthesized
gtatgagtaactctgttacc

SEQ ID NO: 434107 - DNA, 20 bp, Artificial Sequence
  chemically synthesized
caaaactagactaggtaaca

SEQ ID NO: 434108 - DNA, 20 bp, Artificial Sequence
  chemically synthesized
tgcaaaactagactaggtaa

SEQ ID NO: 434109 - DNA, 20 bp, Artificial Sequence
  chemically synthesized
agtaactctgttacctagtc

SEQ ID NO: 434110 - DNA, 20 bp, Artificial Sequence
  chemically synthesized
gattcatgcaaaactagact

SEQ ID NO: 434111 - DNA, 20 bp, Artificial Sequence
  chemically synthesized
ggattcatgcaaaactagac

SEQ ID NO: 434112 - DNA, 20 bp, Artificial Sequence
  chemically synthesized
aacagggattcatgcaaaac

SEQ ID NO: 434113 - DNA, 20 bp, Artificial Sequence
  chemically synthesized
gaagtgcttgaagaggaaca

SEQ ID NO: 434114 - DNA, 20 bp, Artificial Sequence
  chemically synthesized
agaagtgcttgaagaggaac

SEQ ID NO: 434115 - DNA, 20 bp, Artificial Sequence
  chemically synthesized
aagaagtgcttgaagaggaa

SEQ ID NO: 434116 - DNA, 20 bp, Artificial Sequence
  chemically synthesized
atgaatccctgttcctcttc

SEQ ID NO: 434117 - DNA, 20 bp, Artificial Sequence
  chemically synthesized
agctaaagaagtgcttgaag

SEQ ID NO: 434118 - DNA, 20 bp, Artificial Sequence
  chemically synthesized
aagctaaagaagtgcttgaa

SEQ ID NO: 434119 - DNA, 20 bp, Artificial Sequence
  chemically synthesized
tgaagctaaagaagtgcttg

SEQ ID NO: 434120 - DNA, 20 bp, Artificial Sequence
  chemically synthesized
ttcctcttcaagcacttctt

SEQ ID NO: 434121 - DNA, 20 bp, Artificial Sequence
  chemically synthesized
tagaaaacctgaagctaaag

SEQ ID NO: 434122 - DNA, 20 bp, Artificial Sequence
  chemically synthesized
ttcaagcacttctttagctt

SEQ ID NO: 434123 - DNA, 20 bp, Artificial Sequence
  chemically synthesized
tcaagcacttctttagcttc

SEQ ID NO: 434124 - DNA, 20 bp, Artificial Sequence
  chemically synthesized
gattagaaaacctgaagcta

SEQ ID NO: 434125 - DNA, 20 bp, Artificial Sequence
  chemically synthesized
tttccagattagaaaacctg

SEQ ID NO: 434126 - DNA, 20 bp, Artificial Sequence
  chemically synthesized
tagcttcaggttttctaatc

SEQ ID NO: 434127 - DNA, 20 bp, Artificial Sequence
  chemically synthesized
agaaacagaagtttccagat

SEQ ID NO: 434128 - DNA, 20 bp, Artificial Sequence
  chemically synthesized
aattcagaaacagaagtttc

SEQ ID NO: 434129 - DNA, 20 bp, Artificial Sequence
  chemically synthesized
caggtctaattcagaaacag

SEQ ID NO: 434130 - DNA, 20 bp, Artificial Sequence
  chemically synthesized
gttcaggtctaattcagaaa

SEQ ID NO: 434131 - DNA, 20 bp, Artificial Sequence
  chemically synthesized
ggaaacttctgtttctgaat

SEQ ID NO: 434132 - DNA, 20 bp, Artificial Sequence
  chemically synthesized
aaattagttcaggtctaatt

SEQ ID NO: 434133 - DNA, 20 bp, Artificial Sequence
  chemically synthesized
ttgacagcctaaattagttc

SEQ ID NO: 434134 - DNA, 20 bp, Artificial Sequence
  chemically synthesized
tttgacagcctaaattagtt

SEQ ID NO: 434135 - DNA, 20 bp, Artificial Sequence
  chemically synthesized
gaattagacctgaactaatt

SEQ ID NO: 434136 - DNA, 20 bp, Artificial Sequence
  chemically synthesized
aattagacctgaactaattt

SEQ ID NO: 434137 - DNA, 20 bp, Artificial Sequence
  chemically synthesized
aaccttttgacagcctaaat

SEQ ID NO: 434138 - DNA, 20 bp, Artificial Sequence
  chemically synthesized
gaactaatttaggctgtcaa

SEQ ID NO: 434139 - DNA, 20 bp, Artificial Sequence
  chemically synthesized
aactaatttaggctgtcaaa

SEQ ID NO: 434140 - DNA, 20 bp, Artificial Sequence
  chemically synthesized
tcaagacacaaaccttttga

SEQ ID NO: 434141 - DNA, 20 bp, Artificial Sequence
  chemically synthesized
tccgactcaggggaagtttc

SEQ ID NO: 434142 - DNA, 20 bp, Artificial Sequence
  chemically synthesized
tgtgtcttgaaacttcccct

SEQ ID NO: 434143 - DNA, 20 bp, Artificial Sequence
  chemically synthesized
ttattgttccgactcagggg

SEQ ID NO: 434144 - DNA, 20 bp, Artificial Sequence
  chemically synthesized
tcttgaaacttcccctgagt

SEQ ID NO: 434145 - DNA, 20 bp, Artificial Sequence
  chemically synthesized
tatttattgttccgactcag

SEQ ID NO: 434146 - DNA, 20 bp, Artificial Sequence
  chemically synthesized
atatttattgttccgactca

SEQ ID NO: 434147 - DNA, 20 bp, Artificial Sequence
  chemically synthesized
aatatttattgttccgactc

SEQ ID NO: 434148 - DNA, 20 bp, Artificial Sequence
  chemically synthesized
caatatttattgttccgact

SEQ ID NO: 434149 - DNA, 20 bp, Artificial Sequence
  chemically synthesized
caataaatattgtgcataaa

SEQ ID NO: 434150 - DNA, 20 bp, Artificial Sequence
  chemically synthesized
attgtgcataaatagaaact

SEQ ID NO: 434151 - DNA, 20 bp, Artificial Sequence
  chemically synthesized
ctcttctccttatttcagct

SEQ ID NO: 434152 - DNA, 20 bp, Artificial Sequence
  chemically synthesized
aatagaaactcagctgaaat

SEQ ID NO: 434153 - DNA, 20 bp, Artificial Sequence
  chemically synthesized
atagaaactcagctgaaata

SEQ ID NO: 434154 - DNA, 20 bp, Artificial Sequence
  chemically synthesized
agaaactcagctgaaataag

SEQ ID NO: 434155 - DNA, 20 bp, Artificial Sequence
  chemically synthesized
attaactcttctccttattt

SEQ ID NO: 434156 - DNA, 20 bp, Artificial Sequence
  chemically synthesized
aactcagctgaaataaggag

SEQ ID NO: 434157 - DNA, 20 bp, Artificial Sequence
  chemically synthesized
ctcagctgaaataaggagaa

SEQ ID NO: 434158 - DNA, 20 bp, Artificial Sequence
  chemically synthesized
aatgtaaaaaaaaaaaaaac

SEQ ID NO: 434159 - DNA, 20 bp, Artificial Sequence
  chemically synthesized
atgtaaaaaaaaaaaaaacc

SEQ ID NO: 434160 - DNA, 20 bp, Artificial Sequence
  chemically synthesized
aatataattatacgtatacc

SEQ ID NO: 434161 - DNA, 20 bp, Artificial Sequence
  chemically synthesized
ttttatttcattttattttt

SEQ ID NO: 434162 - DNA, 20 bp, Artificial Sequence
  chemically synthesized
taaaaaataaaatgaaataa

SEQ ID NO: 434163 - DNA, 20 bp, Artificial Sequence
  chemically synthesized
ataaaatgaaataaaagctt

SEQ ID NO: 434164 - DNA, 20 bp, Artificial Sequence
  chemically synthesized
tgaatccacgtatgaagccg

SEQ ID NO: 434165 - DNA, 20 bp, Artificial Sequence
  chemically synthesized
aaaagcttcggcttcatacg

SEQ ID NO: 434166 - DNA, 20 bp, Artificial Sequence
  chemically synthesized
aatccctgaatccacgtatg

SEQ ID NO: 434167 - DNA, 20 bp, Artificial Sequence
  chemically synthesized
ttcggcttcatacgtggatt

SEQ ID NO: 434168 - DNA, 20 bp, Artificial Sequence
  chemically synthesized
tcggcttcatacgtggattc

SEQ ID NO: 434169 - DNA, 20 bp, Artificial Sequence
  chemically synthesized
cggcttcatacgtggattca

SEQ ID NO: 434170 - DNA, 20 bp, Artificial Sequence
  chemically synthesized
acgtggattcagggattcac

SEQ ID NO: 434171 - DNA, 20 bp, Artificial Sequence
  chemically synthesized
gtggattcagggattcacaa

SEQ ID NO: 434172 - DNA, 20 bp, Artificial Sequence
  chemically synthesized
ggattcagggattcacaaga

SEQ ID NO: 434173 - DNA, 20 bp, Artificial Sequence
  chemically synthesized
ttcagggattcacaagagag

SEQ ID NO: 434174 - DNA, 20 bp, Artificial Sequence
  chemically synthesized
tcagggattcacaagagagc

SEQ ID NO: 434175 - DNA, 20 bp, Artificial Sequence
  chemically synthesized
ttcacaagagagcaggtttg

SEQ ID NO: 434176 - DNA, 20 bp, Artificial Sequence
  chemically synthesized
gcaggtttgcagccacgaaa

SEQ ID NO: 434177 - DNA, 20 bp, Artificial Sequence
  chemically synthesized
cttctgtgcttgctttttcg

SEQ ID NO: 434178 - DNA, 20 bp, Artificial Sequence
  chemically synthesized
gtttgcagccacgaaaaagc

SEQ ID NO: 434179 - DNA, 20 bp, Artificial Sequence
  chemically synthesized
cagccacgaaaaagcaagca

SEQ ID NO: 434180 - DNA, 20 bp, Artificial Sequence
  chemically synthesized
ccacgaaaaagcaagcacag

SEQ ID NO: 434181 - DNA, 20 bp, Artificial Sequence
  chemically synthesized
aacagcttgagtgtgcacat

SEQ ID NO: 434182 - DNA, 20 bp, Artificial Sequence
  chemically synthesized
gtgcgctcatgtgcacactc

SEQ ID NO: 434183 - DNA, 20 bp, Artificial Sequence
  chemically synthesized
ctatgttccatcaacagctt

SEQ ID NO: 434184 - DNA, 20 bp, Artificial Sequence
  chemically synthesized
gtgcacactcaagctgttga

SEQ ID NO: 434185 - DNA, 20 bp, Artificial Sequence
  chemically synthesized
caaatgctatgttccatcaa

SEQ ID NO: 434186 - DNA, 20 bp, Artificial Sequence
  chemically synthesized
ctcaagctgttgatggaaca

SEQ ID NO: 434187 - DNA, 20 bp, Artificial Sequence
  chemically synthesized
tgatggaacatagcatttgt

SEQ ID NO: 434188 - DNA, 20 bp, Artificial Sequence
  chemically synthesized
gaacatagcatttgtgagtg

SEQ ID NO: 434189 - DNA, 20 bp, Artificial Sequence
  chemically synthesized
aacatagcatttgtgagtga

SEQ ID NO: 434190 - DNA, 20 bp, Artificial Sequence
  chemically synthesized
acatagcatttgtgagtgaa

SEQ ID NO: 434191 - DNA, 20 bp, Artificial Sequence
  chemically synthesized
gtgagtgaagggatgaaaat

SEQ ID NO: 434192 - DNA, 20 bp, Artificial Sequence
  chemically synthesized
tgaagggatgaaaattagaa

SEQ ID NO: 434193 - DNA, 20 bp, Artificial Sequence
  chemically synthesized
gaagggatgaaaattagaat

SEQ ID NO: 434194 - DNA, 20 bp, Artificial Sequence
  chemically synthesized
ggatgaaaattagaataggc

SEQ ID NO: 434195 - DNA, 20 bp, Artificial Sequence
  chemically synthesized
gatgaaaattagaataggcc

SEQ ID NO: 434196 - DNA, 20 bp, Artificial Sequence
  chemically synthesized
aaattagaataggccaggcg

SEQ ID NO: 434197 - DNA, 20 bp, Artificial Sequence
  chemically synthesized
ttagaataggccaggcgcag

SEQ ID NO: 434198 - DNA, 20 bp, Artificial Sequence
  chemically synthesized
caggcgtgagccactgcgcc

SEQ ID NO: 434199 - DNA, 20 bp, Artificial Sequence
  chemically synthesized
agtgctgggattacaggcgt

SEQ ID NO: 434200 - DNA, 20 bp, Artificial Sequence
  chemically synthesized
gtggctcacgcctgtaatcc

SEQ ID NO: 434201 - DNA, 20 bp, Artificial Sequence
  chemically synthesized
tcccaaagtgctgggattac

SEQ ID NO: 434202 - DNA, 20 bp, Artificial Sequence
  chemically synthesized
ttcccaaagtgctgggatta

SEQ ID NO: 434203 - DNA, 20 bp, Artificial Sequence
  chemically synthesized
cgcctgtaatcccagcactt

SEQ ID NO: 434204 - DNA, 20 bp, Artificial Sequence
  chemically synthesized
ccttggcttcccaaagtgct

SEQ ID NO: 434205 - DNA, 20 bp, Artificial Sequence
  chemically synthesized
gcctgtaatcccagcacttt

SEQ ID NO: 434206 - DNA, 20 bp, Artificial Sequence
  chemically synthesized
gccttggcttcccaaagtgc

SEQ ID NO: 434207 - DNA, 20 bp, Artificial Sequence
  chemically synthesized
tgtaatcccagcactttggg

SEQ ID NO: 434208 - DNA, 20 bp, Artificial Sequence
  chemically synthesized
ccacccgccttggcttccca

SEQ ID NO: 434209 - DNA, 20 bp, Artificial Sequence
  chemically synthesized
tcccagcactttgggaagcc

SEQ ID NO: 434210 - DNA, 20 bp, Artificial Sequence
  chemically synthesized
cccagcactttgggaagcca

SEQ ID NO: 434211 - DNA, 20 bp, Artificial Sequence
  chemically synthesized
agcactttgggaagccaagg

SEQ ID NO: 434212 - DNA, 20 bp, Artificial Sequence
  chemically synthesized
gcactttgggaagccaaggc

SEQ ID NO: 434213 - DNA, 20 bp, Artificial Sequence
  chemically synthesized
ctttgggaagccaaggcggg

SEQ ID NO: 434214 - DNA, 20 bp, Artificial Sequence
  chemically synthesized
gtcaaatgatccacccgcct

SEQ ID NO: 434215 - DNA, 20 bp, Artificial Sequence
  chemically synthesized
gcgggtggatcatttgacgt

SEQ ID NO: 434216 - DNA, 20 bp, Artificial Sequence
  chemically synthesized
cgggtggatcatttgacgtc

SEQ ID NO: 434217 - DNA, 20 bp, Artificial Sequence
  chemically synthesized
ggtggatcatttgacgtcag

SEQ ID NO: 434218 - DNA, 20 bp, Artificial Sequence
  chemically synthesized
tcatttgacgtcaggagttc

SEQ ID NO: 434219 - DNA, 20 bp, Artificial Sequence
  chemically synthesized
tgacgtcaggagttcaagac

SEQ ID NO: 434220 - DNA, 20 bp, Artificial Sequence
  chemically synthesized
tttcaccatgttggcaaggc

SEQ ID NO: 434221 - DNA, 20 bp, Artificial Sequence
  chemically synthesized
ggggtttcaccatgttggca

SEQ ID NO: 434222 - DNA, 20 bp, Artificial Sequence
  chemically synthesized
caagaccagccttgccaaca

SEQ ID NO: 434223 - DNA, 20 bp, Artificial Sequence
  chemically synthesized
tggggtttcaccatgttggc

SEQ ID NO: 434224 - DNA, 20 bp, Artificial Sequence
  chemically synthesized
gagatggggtttcaccatgt

SEQ ID NO: 434225 - DNA, 20 bp, Artificial Sequence
  chemically synthesized
ttgtatttttagtagagatg

SEQ ID NO: 434226 - DNA, 20 bp, Artificial Sequence
  chemically synthesized
tttgtatttttagtagagat

SEQ ID NO: 434227 - DNA, 20 bp, Artificial Sequence
  chemically synthesized
ttttgtatttttagtagaga

SEQ ID NO: 434228 - DNA, 20 bp, Artificial Sequence
  chemically synthesized
taatttttgtatttttagta

SEQ ID NO: 434229 - DNA, 20 bp, Artificial Sequence
  chemically synthesized
gctaatttttgtatttttag

SEQ ID NO: 434230 - DNA, 20 bp, Artificial Sequence
  chemically synthesized
ccggctaatttttgtatttt

SEQ ID NO: 434231 - DNA, 20 bp, Artificial Sequence
  chemically synthesized
tctactaaaaatacaaaaat

SEQ ID NO: 434232 - DNA, 20 bp, Artificial Sequence
  chemically synthesized
ctaaaaatacaaaaattagc

SEQ ID NO: 434233 - DNA, 20 bp, Artificial Sequence
  chemically synthesized
atacaaaaattagccggtca

SEQ ID NO: 434234 - DNA, 20 bp, Artificial Sequence
  chemically synthesized
caaaaattagccggtcatgg

SEQ ID NO: 434235 - DNA, 20 bp, Artificial Sequence
  chemically synthesized
aagtggagcgccaccatgac

SEQ ID NO: 434236 - DNA, 20 bp, Artificial Sequence
  chemically synthesized
agtagctgggattacaagtg

SEQ ID NO: 434237 - DNA, 20 bp, Artificial Sequence
  chemically synthesized
cgagtagctgggattacaag

SEQ ID NO: 434238 - DNA, 20 bp, Artificial Sequence
  chemically synthesized
tggcgctccacttgtaatcc

SEQ ID NO: 434239 - DNA, 20 bp, Artificial Sequence
  chemically synthesized
tcccgagtagctgggattac

SEQ ID NO: 434240 - DNA, 20 bp, Artificial Sequence
  chemically synthesized
cacttgtaatcccagctact

SEQ ID NO: 434241 - DNA, 20 bp, Artificial Sequence
  chemically synthesized
cctcagcctcccgagtagct

SEQ ID NO: 434242 - DNA, 20 bp, Artificial Sequence
  chemically synthesized
acttgtaatcccagctactc

SEQ ID NO: 434243 - DNA, 20 bp, Artificial Sequence
  chemically synthesized
gcctcagcctcccgagtagc

SEQ ID NO: 434244 - DNA, 20 bp, Artificial Sequence
  chemically synthesized
ttgtaatcccagctactcgg

SEQ ID NO: 434245 - DNA, 20 bp, Artificial Sequence
  chemically synthesized
tgtaatcccagctactcggg

SEQ ID NO: 434246 - DNA, 20 bp, Artificial Sequence
  chemically synthesized
tcctgcctcagcctcccgag

SEQ ID NO: 434247 - DNA, 20 bp, Artificial Sequence
  chemically synthesized
ttgtcctgcctcagcctccc

SEQ ID NO: 434248 - DNA, 20 bp, Artificial Sequence
  chemically synthesized
tcccagctactcgggaggct

SEQ ID NO: 434249 - DNA, 20 bp, Artificial Sequence
  chemically synthesized
cccagctactcgggaggctg

SEQ ID NO: 434250 - DNA, 20 bp, Artificial Sequence
  chemically synthesized
agctactcgggaggctgagg

SEQ ID NO: 434251 - DNA, 20 bp, Artificial Sequence
  chemically synthesized
gctactcgggaggctgaggc

SEQ ID NO: 434252 - DNA, 20 bp, Artificial Sequence
  chemically synthesized
ttcaagcaattgtcctgcct

SEQ ID NO: 434253 - DNA, 20 bp, Artificial Sequence
  chemically synthesized
gcaggacaattgcttgaatc

SEQ ID NO: 434254 - DNA, 20 bp, Artificial Sequence
  chemically synthesized
aacctccgcctgctggattc

SEQ ID NO: 434255 - DNA, 20 bp, Artificial Sequence
  chemically synthesized
ggacaattgcttgaatccag

SEQ ID NO: 434256 - DNA, 20 bp, Artificial Sequence
  chemically synthesized
gacaattgcttgaatccagc

SEQ ID NO: 434257 - DNA, 20 bp, Artificial Sequence
  chemically synthesized
aattgcttgaatccagcagg

SEQ ID NO: 434258 - DNA, 20 bp, Artificial Sequence
  chemically synthesized
ttgcttgaatccagcaggcg

SEQ ID NO: 434259 - DNA, 20 bp, Artificial Sequence
  chemically synthesized
tcactgcaacctccgcctgc

SEQ ID NO: 434260 - DNA, 20 bp, Artificial Sequence
  chemically synthesized
tgcttgaatccagcaggcgg

SEQ ID NO: 434261 - DNA, 20 bp, Artificial Sequence
  chemically synthesized
aatccagcaggcggaggttg

SEQ ID NO: 434262 - DNA, 20 bp, Artificial Sequence
  chemically synthesized
cagcaggcggaggttgcagt

SEQ ID NO: 434263 - DNA, 20 bp, Artificial Sequence
  chemically synthesized
ggcggaggttgcagtgagcc

SEQ ID NO: 434264 - DNA, 20 bp, Artificial Sequence
  chemically synthesized
gcagtgcaatggcatgatct

SEQ ID NO: 434265 - DNA, 20 bp, Artificial Sequence
  chemically synthesized
tagcccaggccgcagtgcaa

SEQ ID NO: 434266 - DNA, 20 bp, Artificial Sequence
  chemically synthesized
gagatcatgccattgcactg

SEQ ID NO: 434267 - DNA, 20 bp, Artificial Sequence
  chemically synthesized
catgccattgcactgcggcc

SEQ ID NO: 434268 - DNA, 20 bp, Artificial Sequence
  chemically synthesized
atgccattgcactgcggcct

SEQ ID NO: 434269 - DNA, 20 bp, Artificial Sequence
  chemically synthesized
tgctcttgtagcccaggccg

SEQ ID NO: 434270 - DNA, 20 bp, Artificial Sequence
  chemically synthesized
tgcactgcggcctgggctac

SEQ ID NO: 434271 - DNA, 20 bp, Artificial Sequence
  chemically synthesized
cagttttgctcttgtagccc

SEQ ID NO: 434272 - DNA, 20 bp, Artificial Sequence
  chemically synthesized
acagttttgctcttgtagcc

SEQ ID NO: 434273 - DNA, 20 bp, Artificial Sequence
  chemically synthesized
cactgcggcctgggctacaa

SEQ ID NO: 434274 - DNA, 20 bp, Artificial Sequence
  chemically synthesized
gagacacagttttgctcttg

SEQ ID NO: 434275 - DNA, 20 bp, Artificial Sequence
  chemically synthesized
ttattttattttttgagaca

SEQ ID NO: 434276 - DNA, 20 bp, Artificial Sequence
  chemically synthesized
ctctttttattttatttttt

SEQ ID NO: 434277 - DNA, 20 bp, Artificial Sequence
  chemically synthesized
gtctcaaaaaataaaataaa

SEQ ID NO: 434278 - DNA, 20 bp, Artificial Sequence
  chemically synthesized
ctcaaaaaataaaataaaaa

SEQ ID NO: 434279 - DNA, 20 bp, Artificial Sequence
  chemically synthesized
aaaaataaaataaaaagaga

SEQ ID NO: 434280 - DNA, 20 bp, Artificial Sequence
  chemically synthesized
taaaaagagaaagtgctcaa

SEQ ID NO: 434281 - DNA, 20 bp, Artificial Sequence
  chemically synthesized
aaaagagaaagtgctcaaaa

SEQ ID NO: 434282 - DNA, 20 bp, Artificial Sequence
  chemically synthesized
cttcacacagtttctctttt

SEQ ID NO: 434283 - DNA, 20 bp, Artificial Sequence
  chemically synthesized
ctcaaaagagaaactgtgtg

SEQ ID NO: 434284 - DNA, 20 bp, Artificial Sequence
  chemically synthesized
tcaaaagagaaactgtgtga

SEQ ID NO: 434285 - DNA, 20 bp, Artificial Sequence
  chemically synthesized
caaaagagaaactgtgtgaa

SEQ ID NO: 434286 - DNA, 20 bp, Artificial Sequence
  chemically synthesized
aaaagagaaactgtgtgaag

SEQ ID NO: 434287 - DNA, 20 bp, Artificial Sequence
  chemically synthesized
cctaaactgtccccttcaca

SEQ ID NO: 434288 - DNA, 20 bp, Artificial Sequence
  chemically synthesized
gagaaactgtgtgaagggga

SEQ ID NO: 434289 - DNA, 20 bp, Artificial Sequence
  chemically synthesized
actgtgtgaaggggacagtt

SEQ ID NO: 434290 - DNA, 20 bp, Artificial Sequence
  chemically synthesized
ctgtgtgaaggggacagttt

SEQ ID NO: 434291 - DNA, 20 bp, Artificial Sequence
  chemically synthesized
tgtgtgaaggggacagttta

SEQ ID NO: 434292 - DNA, 20 bp, Artificial Sequence
  chemically synthesized
gaaggggacagtttagggct

SEQ ID NO: 434293 - DNA, 20 bp, Artificial Sequence
  chemically synthesized
aaggggacagtttagggctt

SEQ ID NO: 434294 - DNA, 20 bp, Artificial Sequence
  chemically synthesized
aggggacagtttagggcttg

SEQ ID NO: 434295 - DNA, 20 bp, Artificial Sequence
  chemically synthesized
attcttgttttgttttcccc

SEQ ID NO: 434296 - DNA, 20 bp, Artificial Sequence
  chemically synthesized
gggcttggggaaaacaaaac

SEQ ID NO: 434297 - DNA, 20 bp, Artificial Sequence
  chemically synthesized
aacaagaatgcgatctcacc

SEQ ID NO: 434298 - DNA, 20 bp, Artificial Sequence
  chemically synthesized
caagaatgcgatctcaccta

SEQ ID NO: 434299 - DNA, 20 bp, Artificial Sequence
  chemically synthesized
gtggaaattggtctctaggt

SEQ ID NO: 434300 - DNA, 20 bp, Artificial Sequence
  chemically synthesized
tcatgtggaaattggtctct

SEQ ID NO: 434301 - DNA, 20 bp, Artificial Sequence
  chemically synthesized
atcatgtggaaattggtctc

SEQ ID NO: 434302 - DNA, 20 bp, Artificial Sequence
  chemically synthesized
ctgtgggatcatgtggaaat

SEQ ID NO: 434303 - DNA, 20 bp, Artificial Sequence
  chemically synthesized
gagctccctgtgggatcatg

SEQ ID NO: 434304 - DNA, 20 bp, Artificial Sequence
  chemically synthesized
ccaatttccacatgatccca

SEQ ID NO: 434305 - DNA, 20 bp, Artificial Sequence
  chemically synthesized
caatttccacatgatcccac

SEQ ID NO: 434306 - DNA, 20 bp, Artificial Sequence
  chemically synthesized
aatttccacatgatcccaca

SEQ ID NO: 434307 - DNA, 20 bp, Artificial Sequence
  chemically synthesized
tttccacatgatcccacagg

SEQ ID NO: 434308 - DNA, 20 bp, Artificial Sequence
  chemically synthesized
tgccctccagagctccctgt

SEQ ID NO: 434309 - DNA, 20 bp, Artificial Sequence
  chemically synthesized
ttgccctccagagctccctg

SEQ ID NO: 434310 - DNA, 20 bp, Artificial Sequence
  chemically synthesized
catgatcccacagggagctc

SEQ ID NO: 434311 - DNA, 20 bp, Artificial Sequence
  chemically synthesized
tgatcccacagggagctctg

SEQ ID NO: 434312 - DNA, 20 bp, Artificial Sequence
  chemically synthesized
gatcccacagggagctctgg

SEQ ID NO: 434313 - DNA, 20 bp, Artificial Sequence
  chemically synthesized
atcccacagggagctctgga

SEQ ID NO: 434314 - DNA, 20 bp, Artificial Sequence
  chemically synthesized
gggatgcaatttgccctcca

SEQ ID NO: 434315 - DNA, 20 bp, Artificial Sequence
  chemically synthesized
ctgggatgcaatttgccctc

SEQ ID NO: 434316 - DNA, 20 bp, Artificial Sequence
  chemically synthesized
ctggagggcaaattgcatcc

SEQ ID NO: 434317 - DNA, 20 bp, Artificial Sequence
  chemically synthesized
ggagggcaaattgcatccca

SEQ ID NO: 434318 - DNA, 20 bp, Artificial Sequence
  chemically synthesized
cacaaggtgagatcagctct

SEQ ID NO: 434319 - DNA, 20 bp, Artificial Sequence
  chemically synthesized
ccacaaggtgagatcagctc

SEQ ID NO: 434320 - DNA, 20 bp, Artificial Sequence
  chemically synthesized
catttgccacaaggtgagat

SEQ ID NO: 434321 - DNA, 20 bp, Artificial Sequence
  chemically synthesized
ccagagctgatctcaccttg

SEQ ID NO: 434322 - DNA, 20 bp, Artificial Sequence
  chemically synthesized
caacccatttgccacaaggt

SEQ ID NO: 434323 - DNA, 20 bp, Artificial Sequence
  chemically synthesized
agtccaacccatttgccaca

SEQ ID NO: 434324 - DNA, 20 bp, Artificial Sequence
  chemically synthesized
gagtccaacccatttgccac

SEQ ID NO: 434325 - DNA, 20 bp, Artificial Sequence
  chemically synthesized
tgatctcaccttgtggcaaa

SEQ ID NO: 434326 - DNA, 20 bp, Artificial Sequence
  chemically synthesized
gatctcaccttgtggcaaat

SEQ ID NO: 434327 - DNA, 20 bp, Artificial Sequence
  chemically synthesized
tcaccttgtggcaaatgggt

SEQ ID NO: 434328 - DNA, 20 bp, Artificial Sequence
  chemically synthesized
accaacgactgaaagtacaa

SEQ ID NO: 434329 - DNA, 20 bp, Artificial Sequence
  chemically synthesized
gggttggactcttgtacttt

SEQ ID NO: 434330 - DNA, 20 bp, Artificial Sequence
  chemically synthesized
caaccaacgactgaaagtac

SEQ ID NO: 434331 - DNA, 20 bp, Artificial Sequence
  chemically synthesized
agtttgcaaccaacgactga

SEQ ID NO: 434332 - DNA, 20 bp, Artificial Sequence
  chemically synthesized
actcttgtactttcagtcgt

SEQ ID NO: 434333 - DNA, 20 bp, Artificial Sequence
  chemically synthesized
cgttggttgcaaactgacct

SEQ ID NO: 434334 - DNA, 20 bp, Artificial Sequence
  chemically synthesized
gttggttgcaaactgacctg

SEQ ID NO: 434335 - DNA, 20 bp, Artificial Sequence
  chemically synthesized
atatgtgccccacctcaggt

SEQ ID NO: 434336 - DNA, 20 bp, Artificial Sequence
  chemically synthesized
ggttgcaaactgacctgagg

SEQ ID NO: 434337 - DNA, 20 bp, Artificial Sequence
  chemically synthesized
gttgcaaactgacctgaggt

SEQ ID NO: 434338 - DNA, 20 bp, Artificial Sequence
  chemically synthesized
ttgcaaactgacctgaggtg

SEQ ID NO: 434339 - DNA, 20 bp, Artificial Sequence
  chemically synthesized
ggccatatgtgccccacctc

SEQ ID NO: 434340 - DNA, 20 bp, Artificial Sequence
  chemically synthesized
aggccatatgtgccccacct

SEQ ID NO: 434341 - DNA, 20 bp, Artificial Sequence
  chemically synthesized
gacctgaggtggggcacata

SEQ ID NO: 434342 - DNA, 20 bp, Artificial Sequence
  chemically synthesized
gtggggcacatatggccttt

SEQ ID NO: 434343 - DNA, 20 bp, Artificial Sequence
  chemically synthesized
tggggcacatatggcctttc

SEQ ID NO: 434344 - DNA, 20 bp, Artificial Sequence
  chemically synthesized
aagaaagccaggagcctgaa

SEQ ID NO: 434345 - DNA, 20 bp, Artificial Sequence
  chemically synthesized
gaagaaagccaggagcctga

SEQ ID NO: 434346 - DNA, 20 bp, Artificial Sequence
  chemically synthesized
catatggcctttcaggctcc

SEQ ID NO: 434347 - DNA, 20 bp, Artificial Sequence
  chemically synthesized
cttaccctgaagaaagccag

SEQ ID NO: 434348 - DNA, 20 bp, Artificial Sequence
  chemically synthesized
ttcttaccctgaagaaagcc

SEQ ID NO: 434349 - DNA, 20 bp, Artificial Sequence
  chemically synthesized
gttcttaccctgaagaaagc

SEQ ID NO: 434350 - DNA, 20 bp, Artificial Sequence
  chemically synthesized
ttcaggctcctggctttctt

SEQ ID NO: 434351 - DNA, 20 bp, Artificial Sequence
  chemically synthesized
tcaggctcctggctttcttc

SEQ ID NO: 434352 - DNA, 20 bp, Artificial Sequence
  chemically synthesized
caggctcctggctttcttca

SEQ ID NO: 434353 - DNA, 20 bp, Artificial Sequence
  chemically synthesized
acttgttcttaccctgaaga

SEQ ID NO: 434354 - DNA, 20 bp, Artificial Sequence
  chemically synthesized
ctcctggctttcttcagggt

SEQ ID NO: 434355 - DNA, 20 bp, Artificial Sequence
  chemically synthesized
agagacttgttcttaccctg

SEQ ID NO: 434356 - DNA, 20 bp, Artificial Sequence
  chemically synthesized
gctttcttcagggtaagaac

SEQ ID NO: 434357 - DNA, 20 bp, Artificial Sequence
  chemically synthesized
tcagggtaagaacaagtctc

SEQ ID NO: 434358 - DNA, 20 bp, Artificial Sequence
  chemically synthesized
agggtaagaacaagtctctg

SEQ ID NO: 434359 - DNA, 20 bp, Artificial Sequence
  chemically synthesized
gtaagaacaagtctctggag

SEQ ID NO: 434360 - DNA, 20 bp, Artificial Sequence
  chemically synthesized
taagaacaagtctctggaga

SEQ ID NO: 434361 - DNA, 20 bp, Artificial Sequence
  chemically synthesized
cacagctgcttccttctcca

SEQ ID NO: 434362 - DNA, 20 bp, Artificial Sequence
  chemically synthesized
gaacaagtctctggagaagg

SEQ ID NO: 434363 - DNA, 20 bp, Artificial Sequence
  chemically synthesized
cccacagctgcttccttctc

SEQ ID NO: 434364 - DNA, 20 bp, Artificial Sequence
  chemically synthesized
caagtctctggagaaggaag

SEQ ID NO: 434365 - DNA, 20 bp, Artificial Sequence
  chemically synthesized
tctggagaaggaagcagctg

SEQ ID NO: 434366 - DNA, 20 bp, Artificial Sequence
  chemically synthesized
ctggagaaggaagcagctgt

SEQ ID NO: 434367 - DNA, 20 bp, Artificial Sequence
  chemically synthesized
ctgggagtgcttgttgccca

SEQ ID NO: 434368 - DNA, 20 bp, Artificial Sequence
  chemically synthesized
aggaagcagctgtgggcaac

SEQ ID NO: 434369 - DNA, 20 bp, Artificial Sequence
  chemically synthesized
ctgtgggcaacaagcactcc

SEQ ID NO: 434370 - DNA, 20 bp, Artificial Sequence
  chemically synthesized
tgggcaacaagcactcccag

SEQ ID NO: 434371 - DNA, 20 bp, Artificial Sequence
  chemically synthesized
acccatcccctagctgctgg

SEQ ID NO: 434372 - DNA, 20 bp, Artificial Sequence
  chemically synthesized
caacaagcactcccagcagc

SEQ ID NO: 434373 - DNA, 20 bp, Artificial Sequence
  chemically synthesized
aacaagcactcccagcagct

SEQ ID NO: 434374 - DNA, 20 bp, Artificial Sequence
  chemically synthesized
acacccatcccctagctgct

SEQ ID NO: 434375 - DNA, 20 bp, Artificial Sequence
  chemically synthesized
acaagcactcccagcagcta

SEQ ID NO: 434376 - DNA, 20 bp, Artificial Sequence
  chemically synthesized
cacacccatcccctagctgc

SEQ ID NO: 434377 - DNA, 20 bp, Artificial Sequence
  chemically synthesized
caagcactcccagcagctag

SEQ ID NO: 434378 - DNA, 20 bp, Artificial Sequence
  chemically synthesized
cactcccagcagctagggga

SEQ ID NO: 434379 - DNA, 20 bp, Artificial Sequence
  chemically synthesized
actcccagcagctaggggat

SEQ ID NO: 434380 - DNA, 20 bp, Artificial Sequence
  chemically synthesized
caggtagcacacccatcccc

SEQ ID NO: 434381 - DNA, 20 bp, Artificial Sequence
  chemically synthesized
taggggatgggtgtgctacc

SEQ ID NO: 434382 - DNA, 20 bp, Artificial Sequence
  chemically synthesized
ctgaagtccccatcaccagg

SEQ ID NO: 434383 - DNA, 20 bp, Artificial Sequence
  chemically synthesized
atgggtgtgctacctggtga

SEQ ID NO: 434384 - DNA, 20 bp, Artificial Sequence
  chemically synthesized
tgggtgtgctacctggtgat

SEQ ID NO: 434385 - DNA, 20 bp, Artificial Sequence
  chemically synthesized
gggtgtgctacctggtgatg

SEQ ID NO: 434386 - DNA, 20 bp, Artificial Sequence
  chemically synthesized
ctactgaagtccccatcacc

SEQ ID NO: 434387 - DNA, 20 bp, Artificial Sequence
  chemically synthesized
tctactgaagtccccatcac

SEQ ID NO: 434388 - DNA, 20 bp, Artificial Sequence
  chemically synthesized
ctacctggtgatggggactt

SEQ ID NO: 434389 - DNA, 20 bp, Artificial Sequence
  chemically synthesized
cctggtgatggggacttcag

SEQ ID NO: 434390 - DNA, 20 bp, Artificial Sequence
  chemically synthesized
ggcactgatatgttctactg

SEQ ID NO: 434391 - DNA, 20 bp, Artificial Sequence
  chemically synthesized
gggacttcagtagaacatat

SEQ ID NO: 434392 - DNA, 20 bp, Artificial Sequence
  chemically synthesized
tagaacatatcagtgcccac

SEQ ID NO: 434393 - DNA, 20 bp, Artificial Sequence
  chemically synthesized
gaacatatcagtgcccacta

SEQ ID NO: 434394 - DNA, 20 bp, Artificial Sequence
  chemically synthesized
caattctctctgactctagt

SEQ ID NO: 434395 - DNA, 20 bp, Artificial Sequence
  chemically synthesized
atatcagtgcccactagagt

SEQ ID NO: 434396 - DNA, 20 bp, Artificial Sequence
  chemically synthesized
tcaattctctctgactctag

SEQ ID NO: 434397 - DNA, 20 bp, Artificial Sequence
  chemically synthesized
atcagtgcccactagagtca

SEQ ID NO: 434398 - DNA, 20 bp, Artificial Sequence
  chemically synthesized
aaatcaattctctctgactc

SEQ ID NO: 434399 - DNA, 20 bp, Artificial Sequence
  chemically synthesized
cagtgcccactagagtcaga

SEQ ID NO: 434400 - DNA, 20 bp, Artificial Sequence
  chemically synthesized
agagtcagagagaattgatt

SEQ ID NO: 434401 - DNA, 20 bp, Artificial Sequence
  chemically synthesized
gagtcagagagaattgattt

SEQ ID NO: 434402 - DNA, 20 bp, Artificial Sequence
  chemically synthesized
gagaattgatttgggtctta

SEQ ID NO: 434403 - DNA, 20 bp, Artificial Sequence
  chemically synthesized
attgatttgggtcttaaaga

SEQ ID NO: 434404 - DNA, 20 bp, Artificial Sequence
  chemically synthesized
tccgtttgtatactgtcttt

SEQ ID NO: 434405 - DNA, 20 bp, Artificial Sequence
  chemically synthesized
tcttaaagacagtatacaaa

SEQ ID NO: 434406 - DNA, 20 bp, Artificial Sequence
  chemically synthesized
tttgttttatttattttttt

SEQ ID NO: 434407 - DNA, 20 bp, Artificial Sequence
  chemically synthesized
ttttatttatttttttgaga

SEQ ID NO: 434408 - DNA, 20 bp, Artificial Sequence
  chemically synthesized
tttatttatttttttgagac

SEQ ID NO: 434409 - DNA, 20 bp, Artificial Sequence
  chemically synthesized
ttatttatttttttgagaca

SEQ ID NO: 434410 - DNA, 20 bp, Artificial Sequence
  chemically synthesized
tccagcctgagtgacagagt

SEQ ID NO: 434411 - DNA, 20 bp, Artificial Sequence
  chemically synthesized
cagggtctcactctgtcact

SEQ ID NO: 434412 - DNA, 20 bp, Artificial Sequence
  chemically synthesized
gcactccagcctgagtgaca

SEQ ID NO: 434413 - DNA, 20 bp, Artificial Sequence
  chemically synthesized
agggtctcactctgtcactc

SEQ ID NO: 434414 - DNA, 20 bp, Artificial Sequence
  chemically synthesized
ctgcactccagcctgagtga

SEQ ID NO: 434415 - DNA, 20 bp, Artificial Sequence
  chemically synthesized
tctcactctgtcactcaggc

SEQ ID NO: 434416 - DNA, 20 bp, Artificial Sequence
  chemically synthesized
tcactctgtcactcaggctg

SEQ ID NO: 434417 - DNA, 20 bp, Artificial Sequence
  chemically synthesized
gcaccactgcactccagcct

SEQ ID NO: 434418 - DNA, 20 bp, Artificial Sequence
  chemically synthesized
ctgtcactcaggctggagtg

SEQ ID NO: 434419 - DNA, 20 bp, Artificial Sequence
  chemically synthesized
gagattgcaccactgcactc

SEQ ID NO: 434420 - DNA, 20 bp, Artificial Sequence
  chemically synthesized
tcactcaggctggagtgcag

SEQ ID NO: 434421 - DNA, 20 bp, Artificial Sequence
  chemically synthesized
ggagtgcagtggtgcaatct

SEQ ID NO: 434422 - DNA, 20 bp, Artificial Sequence
  chemically synthesized
ggcggcagttgcagtgagcc

SEQ ID NO: 434423 - DNA, 20 bp, Artificial Sequence
  chemically synthesized
agggaggcggcagttgcagt

SEQ ID NO: 434424 - DNA, 20 bp, Artificial Sequence
  chemically synthesized
aaccagggaggcggcagttg

SEQ ID NO: 434425 - DNA, 20 bp, Artificial Sequence
  chemically synthesized
cacttgaaccagggaggcgg

SEQ ID NO: 434426 - DNA, 20 bp, Artificial Sequence
  chemically synthesized
cactgcaactgccgcctccc

SEQ ID NO: 434427 - DNA, 20 bp, Artificial Sequence
  chemically synthesized
aaccacttgaaccagggagg

SEQ ID NO: 434428 - DNA, 20 bp, Artificial Sequence
  chemically synthesized
gacaaccacttgaaccaggg

SEQ ID NO: 434429 - DNA, 20 bp, Artificial Sequence
  chemically synthesized
ggacaaccacttgaaccagg

SEQ ID NO: 434430 - DNA, 20 bp, Artificial Sequence
  chemically synthesized
aactgccgcctccctggttc

SEQ ID NO: 434431 - DNA, 20 bp, Artificial Sequence
  chemically synthesized
caggacaaccacttgaacca

SEQ ID NO: 434432 - DNA, 20 bp, Artificial Sequence
  chemically synthesized
gcaggacaaccacttgaacc

SEQ ID NO: 434433 - DNA, 20 bp, Artificial Sequence
  chemically synthesized
tgccgcctccctggttcaag

SEQ ID NO: 434434 - DNA, 20 bp, Artificial Sequence
  chemically synthesized
ggcaggacaaccacttgaac

SEQ ID NO: 434435 - DNA, 20 bp, Artificial Sequence
  chemically synthesized
ttcaagtggttgtcctgcct

SEQ ID NO: 434436 - DNA, 20 bp, Artificial Sequence
  chemically synthesized
gctactagggaggctgaggc

SEQ ID NO: 434437 - DNA, 20 bp, Artificial Sequence
  chemically synthesized
agctactagggaggctgagg

SEQ ID NO: 434438 - DNA, 20 bp, Artificial Sequence
  chemically synthesized
cccagctactagggaggctg

SEQ ID NO: 434439 - DNA, 20 bp, Artificial Sequence
  chemically synthesized
tcccagctactagggaggct

SEQ ID NO: 434440 - DNA, 20 bp, Artificial Sequence
  chemically synthesized
ttgtcctgcctcagcctccc

SEQ ID NO: 434441 - DNA, 20 bp, Artificial Sequence
  chemically synthesized
tcctgcctcagcctccctag

SEQ ID NO: 434442 - DNA, 20 bp, Artificial Sequence
  chemically synthesized
tgtaatcccagctactaggg

SEQ ID NO: 434443 - DNA, 20 bp, Artificial Sequence
  chemically synthesized
ctgtaatcccagctactagg

SEQ ID NO: 434444 - DNA, 20 bp, Artificial Sequence
  chemically synthesized
gcctcagcctccctagtagc

SEQ ID NO: 434445 - DNA, 20 bp, Artificial Sequence
  chemically synthesized
acctgtaatcccagctacta

SEQ ID NO: 434446 - DNA, 20 bp, Artificial Sequence
  chemically synthesized
cctcagcctccctagtagct

SEQ ID NO: 434447 - DNA, 20 bp, Artificial Sequence
  chemically synthesized
cacctgtaatcccagctact

SEQ ID NO: 434448 - DNA, 20 bp, Artificial Sequence
  chemically synthesized
gcacctgtaatcccagctac

SEQ ID NO: 434449 - DNA, 20 bp, Artificial Sequence
  chemically synthesized
ctccctagtagctgggatta

SEQ ID NO: 434450 - DNA, 20 bp, Artificial Sequence
  chemically synthesized
tccctagtagctgggattac

SEQ ID NO: 434451 - DNA, 20 bp, Artificial Sequence
  chemically synthesized
gtggtgcgcacctgtaatcc

SEQ ID NO: 434452 - DNA, 20 bp, Artificial Sequence
  chemically synthesized
aaaaaattagtcgggcatgg

SEQ ID NO: 434453 - DNA, 20 bp, Artificial Sequence
  chemically synthesized
tacaaaaaattagtcgggca

SEQ ID NO: 434454 - DNA, 20 bp, Artificial Sequence
  chemically synthesized
aaaaatacaaaaaattagtc

SEQ ID NO: 434455 - DNA, 20 bp, Artificial Sequence
  chemically synthesized
taaaaatacaaaaaattagt

SEQ ID NO: 434456 - DNA, 20 bp, Artificial Sequence
  chemically synthesized
ctactaaaaatacaaaaaat

SEQ ID NO: 434457 - DNA, 20 bp, Artificial Sequence
  chemically synthesized
cgactaattttttgtatttt

SEQ ID NO: 434458 - DNA, 20 bp, Artificial Sequence
  chemically synthesized
ctaattttttgtatttttag

SEQ ID NO: 434459 - DNA, 20 bp, Artificial Sequence
  chemically synthesized
aattttttgtatttttagta

SEQ ID NO: 434460 - DNA, 20 bp, Artificial Sequence
  chemically synthesized
ttttgtatttttagtagaga

SEQ ID NO: 434461 - DNA, 20 bp, Artificial Sequence
  chemically synthesized
tttgtatttttagtagagac

SEQ ID NO: 434462 - DNA, 20 bp, Artificial Sequence
  chemically synthesized
ttgtatttttagtagagacg

SEQ ID NO: 434463 - DNA, 20 bp, Artificial Sequence
  chemically synthesized
gagacggggtttcaccatgt

SEQ ID NO: 434464 - DNA, 20 bp, Artificial Sequence
  chemically synthesized
cggggtttcaccatgttggc

SEQ ID NO: 434465 - DNA, 20 bp, Artificial Sequence
  chemically synthesized
cgagaccaacctggccaaca

SEQ ID NO: 434466 - DNA, 20 bp, Artificial Sequence
  chemically synthesized
ggggtttcaccatgttggcc

SEQ ID NO: 434467 - DNA, 20 bp, Artificial Sequence
  chemically synthesized
tttcaccatgttggccaggt

SEQ ID NO: 434468 - DNA, 20 bp, Artificial Sequence
  chemically synthesized
ccaggagttcgagaccaacc

SEQ ID NO: 434469 - DNA, 20 bp, Artificial Sequence
  chemically synthesized
ccaggttggtctcgaactcc

SEQ ID NO: 434470 - DNA, 20 bp, Artificial Sequence
  chemically synthesized
tcatttgaggccaggagttc

SEQ ID NO: 434471 - DNA, 20 bp, Artificial Sequence
  chemically synthesized
ggtggatcatttgaggccag

SEQ ID NO: 434472 - DNA, 20 bp, Artificial Sequence
  chemically synthesized
cgggtggatcatttgaggcc

SEQ ID NO: 434473 - DNA, 20 bp, Artificial Sequence
  chemically synthesized
gcgggtggatcatttgaggc

SEQ ID NO: 434474 - DNA, 20 bp, Artificial Sequence
  chemically synthesized
tgaggcgggtggatcatttg

SEQ ID NO: 434475 - DNA, 20 bp, Artificial Sequence
  chemically synthesized
ctgaggcgggtggatcattt

SEQ ID NO: 434476 - DNA, 20 bp, Artificial Sequence
  chemically synthesized
ctcaaatgatccacccgcct

SEQ ID NO: 434477 - DNA, 20 bp, Artificial Sequence
  chemically synthesized
ctttgggagtctgaggcggg

SEQ ID NO: 434478 - DNA, 20 bp, Artificial Sequence
  chemically synthesized
ggactttgggagtctgaggc

SEQ ID NO: 434479 - DNA, 20 bp, Artificial Sequence
  chemically synthesized
aggactttgggagtctgagg

SEQ ID NO: 434480 - DNA, 20 bp, Artificial Sequence
  chemically synthesized
cccaggactttgggagtctg

SEQ ID NO: 434481 - DNA, 20 bp, Artificial Sequence
  chemically synthesized
tcccaggactttgggagtct

SEQ ID NO: 434482 - DNA, 20 bp, Artificial Sequence
  chemically synthesized
ccacccgcctcagactccca

SEQ ID NO: 434483 - DNA, 20 bp, Artificial Sequence
  chemically synthesized
ctgtaatcccaggactttgg

SEQ ID NO: 434484 - DNA, 20 bp, Artificial Sequence
  chemically synthesized
gcctcagactcccaaagtcc

SEQ ID NO: 434485 - DNA, 20 bp, Artificial Sequence
  chemically synthesized
gcctgtaatcccaggacttt

SEQ ID NO: 434486 - DNA, 20 bp, Artificial Sequence
  chemically synthesized
cctcagactcccaaagtcct

SEQ ID NO: 434487 - DNA, 20 bp, Artificial Sequence
  chemically synthesized
cgcctgtaatcccaggactt

SEQ ID NO: 434488 - DNA, 20 bp, Artificial Sequence
  chemically synthesized
ctcccaaagtcctgggatta

SEQ ID NO: 434489 - DNA, 20 bp, Artificial Sequence
  chemically synthesized
tggctcacgcctgtaatccc

SEQ ID NO: 434490 - DNA, 20 bp, Artificial Sequence
  chemically synthesized
tcccaaagtcctgggattac

SEQ ID NO: 434491 - DNA, 20 bp, Artificial Sequence
  chemically synthesized
gtggctcacgcctgtaatcc

SEQ ID NO: 434492 - DNA, 20 bp, Artificial Sequence
  chemically synthesized
agtcctgggattacaggcgt

SEQ ID NO: 434493 - DNA, 20 bp, Artificial Sequence
  chemically synthesized
taaaataaggtcgggcgcgg

SEQ ID NO: 434494 - DNA, 20 bp, Artificial Sequence
  chemically synthesized
aaataaaataaggtcgggcg

SEQ ID NO: 434495 - DNA, 20 bp, Artificial Sequence
  chemically synthesized
taataaaataaaataaggtc

SEQ ID NO: 434496 - DNA, 20 bp, Artificial Sequence
  chemically synthesized
ataataaaataaaataaggt

SEQ ID NO: 434497 - DNA, 20 bp, Artificial Sequence
  chemically synthesized
tattataataaaataaaata

SEQ ID NO: 434498 - DNA, 20 bp, Artificial Sequence
  chemically synthesized
ttattataataaaataaaat

SEQ ID NO: 434499 - DNA, 20 bp, Artificial Sequence
  chemically synthesized
ttattttattttattataat

SEQ ID NO: 434500 - DNA, 20 bp, Artificial Sequence
  chemically synthesized
ttttattttattataataag

SEQ ID NO: 434501 - DNA, 20 bp, Artificial Sequence
  chemically synthesized
ttataataagaagacaacat

SEQ ID NO: 434502 - DNA, 20 bp, Artificial Sequence
  chemically synthesized
ttaaacatttgttaagagag

SEQ ID NO: 434503 - DNA, 20 bp, Artificial Sequence
  chemically synthesized
tacttaaacatttgttaaga

SEQ ID NO: 434504 - DNA, 20 bp, Artificial Sequence
  chemically synthesized
tatacttaaacatttgttaa

SEQ ID NO: 434505 - DNA, 20 bp, Artificial Sequence
  chemically synthesized
tgtatacttaaacatttgtt

SEQ ID NO: 434506 - DNA, 20 bp, Artificial Sequence
  chemically synthesized
tactctcttaacaaatgttt

SEQ ID NO: 434507 - DNA, 20 bp, Artificial Sequence
  chemically synthesized
aaatgtttaagtatacaata

SEQ ID NO: 434508 - DNA, 20 bp, Artificial Sequence
  chemically synthesized
caatacggtattgttaacta

SEQ ID NO: 434509 - DNA, 20 bp, Artificial Sequence
  chemically synthesized
aatacggtattgttaactac

SEQ ID NO: 434510 - DNA, 20 bp, Artificial Sequence
  chemically synthesized
gttgcacaacagtgtgcctg

SEQ ID NO: 434511 - DNA, 20 bp, Artificial Sequence
  chemically synthesized
tctggatatctgttgcacaa

SEQ ID NO: 434512 - DNA, 20 bp, Artificial Sequence
  chemically synthesized
acaggcacactgttgtgcaa

SEQ ID NO: 434513 - DNA, 20 bp, Artificial Sequence
  chemically synthesized
actgttgtgcaacagatatc

SEQ ID NO: 434514 - DNA, 20 bp, Artificial Sequence
  chemically synthesized
tataaaaaatgagtaggttc

SEQ ID NO: 434515 - DNA, 20 bp, Artificial Sequence
  chemically synthesized
ttcagttataaaaaatgagt

SEQ ID NO: 434516 - DNA, 20 bp, Artificial Sequence
  chemically synthesized
tttcagttataaaaaatgag

SEQ ID NO: 434517 - DNA, 20 bp, Artificial Sequence
  chemically synthesized
aagtttcagttataaaaaat

SEQ ID NO: 434518 - DNA, 20 bp, Artificial Sequence
  chemically synthesized
tgtcaacagatatcaagttt

SEQ ID NO: 434519 - DNA, 20 bp, Artificial Sequence
  chemically synthesized
tcccgttgtcaacagatatc

SEQ ID NO: 434520 - DNA, 20 bp, Artificial Sequence
  chemically synthesized
aacttgatatctgttgacaa

SEQ ID NO: 434521 - DNA, 20 bp, Artificial Sequence
  chemically synthesized
aaaatatttcccgttgtcaa

SEQ ID NO: 434522 - DNA, 20 bp, Artificial Sequence
  chemically synthesized
acttgatatctgttgacaac

SEQ ID NO: 434523 - DNA, 20 bp, Artificial Sequence
  chemically synthesized
acaacgggaaatattttctt

SEQ ID NO: 434524 - DNA, 20 bp, Artificial Sequence
  chemically synthesized
tttttaatatcatgagacta

SEQ ID NO: 434525 - DNA, 20 bp, Artificial Sequence
  chemically synthesized
agatacatttttaatatcat

SEQ ID NO: 434526 - DNA, 20 bp, Artificial Sequence
  chemically synthesized
ttatctaaaaatcataaatt

SEQ ID NO: 434527 - DNA, 20 bp, Artificial Sequence
  chemically synthesized
gtatctgaatttatgatttt

SEQ ID NO: 434528 - DNA, 20 bp, Artificial Sequence
  chemically synthesized
gaatttatgatttttagata

SEQ ID NO: 434529 - DNA, 20 bp, Artificial Sequence
  chemically synthesized
atttttagataaagcactca

SEQ ID NO: 434530 - DNA, 20 bp, Artificial Sequence
  chemically synthesized
ttttagataaagcactcata

SEQ ID NO: 434531 - DNA, 20 bp, Artificial Sequence
  chemically synthesized
ttttgcccaatagtctctat

SEQ ID NO: 434532 - DNA, 20 bp, Artificial Sequence
  chemically synthesized
aaagcactcatagagactat

SEQ ID NO: 434533 - DNA, 20 bp, Artificial Sequence
  chemically synthesized
aagcactcatagagactatt

SEQ ID NO: 434534 - DNA, 20 bp, Artificial Sequence
  chemically synthesized
tctgttcgtattttgcccaa

SEQ ID NO: 434535 - DNA, 20 bp, Artificial Sequence
  chemically synthesized
actattgggcaaaatacgaa

SEQ ID NO: 434536 - DNA, 20 bp, Artificial Sequence
  chemically synthesized
acagatgtattgatttctcc

SEQ ID NO: 434537 - DNA, 20 bp, Artificial Sequence
  chemically synthesized
cagatgtattgatttctcca

SEQ ID NO: 434538 - DNA, 20 bp, Artificial Sequence
  chemically synthesized
agatgtattgatttctccaa

SEQ ID NO: 434539 - DNA, 20 bp, Artificial Sequence
  chemically synthesized
attccagtttggaacccttg

SEQ ID NO: 434540 - DNA, 20 bp, Artificial Sequence
  chemically synthesized
aaattccagtttggaaccct

SEQ ID NO: 434541 - DNA, 20 bp, Artificial Sequence
  chemically synthesized
tttctccaagggttccaaac

SEQ ID NO: 434542 - DNA, 20 bp, Artificial Sequence
  chemically synthesized
agttttttaaaattccagtt

SEQ ID NO: 434543 - DNA, 20 bp, Artificial Sequence
  chemically synthesized
actcaagttttttaaaattc

SEQ ID NO: 434544 - DNA, 20 bp, Artificial Sequence
  chemically synthesized
actggaattttaaaaaactt

SEQ ID NO: 434545 - DNA, 20 bp, Artificial Sequence
  chemically synthesized
aattttaaaaaacttgagtt

SEQ ID NO: 434546 - DNA, 20 bp, Artificial Sequence
  chemically synthesized
atatgcatgaatcttaactc

SEQ ID NO: 434547 - DNA, 20 bp, Artificial Sequence
  chemically synthesized
agttaagattcatgcatatt

SEQ ID NO: 434548 - DNA, 20 bp, Artificial Sequence
  chemically synthesized
atgcatatttagtaacaacc

SEQ ID NO: 434549 - DNA, 20 bp, Artificial Sequence
  chemically synthesized
ttagtaacaacctagtaaca

SEQ ID NO: 434550 - DNA, 20 bp, Artificial Sequence
  chemically synthesized
gggcatacatccgtgttact

SEQ ID NO: 434551 - DNA, 20 bp, Artificial Sequence
  chemically synthesized
agggcatacatccgtgttac

SEQ ID NO: 434552 - DNA, 20 bp, Artificial Sequence
  chemically synthesized
gtaacacggatgtatgccct

SEQ ID NO: 434553 - DNA, 20 bp, Artificial Sequence
  chemically synthesized
aacacggatgtatgccctca

SEQ ID NO: 434554 - DNA, 20 bp, Artificial Sequence
  chemically synthesized
ttctgattcccattctctga

SEQ ID NO: 434555 - DNA, 20 bp, Artificial Sequence
  chemically synthesized
ggatgtatgccctcagagaa

SEQ ID NO: 434556 - DNA, 20 bp, Artificial Sequence
  chemically synthesized
attctgattcccattctctg

SEQ ID NO: 434557 - DNA, 20 bp, Artificial Sequence
  chemically synthesized
gatgtatgccctcagagaat

SEQ ID NO: 434558 - DNA, 20 bp, Artificial Sequence
  chemically synthesized
gattctgattcccattctct

SEQ ID NO: 434559 - DNA, 20 bp, Artificial Sequence
  chemically synthesized
tgccctcagagaatgggaat

SEQ ID NO: 434560 - DNA, 20 bp, Artificial Sequence
  chemically synthesized
agaatgggaatcagaatcta

SEQ ID NO: 434561 - DNA, 20 bp, Artificial Sequence
  chemically synthesized
aatctctagtgacaatactt

SEQ ID NO: 434562 - DNA, 20 bp, Artificial Sequence
  chemically synthesized
agaatctaaagtattgtcac

SEQ ID NO: 434563 - DNA, 20 bp, Artificial Sequence
  chemically synthesized
aatctaaagtattgtcacta

SEQ ID NO: 434564 - DNA, 20 bp, Artificial Sequence
  chemically synthesized
gaaagctttgtttcaatctc

SEQ ID NO: 434565 - DNA, 20 bp, Artificial Sequence
  chemically synthesized
tgtcactagagattgaaaca

SEQ ID NO: 434566 - DNA, 20 bp, Artificial Sequence
  chemically synthesized
tttataacaattggagttga

SEQ ID NO: 434567 - DNA, 20 bp, Artificial Sequence
  chemically synthesized
tccttcttttataacaattg

SEQ ID NO: 434568 - DNA, 20 bp, Artificial Sequence
  chemically synthesized
attccttcttttataacaat

SEQ ID NO: 434569 - DNA, 20 bp, Artificial Sequence
  chemically synthesized
ttcaactccaattgttataa

SEQ ID NO: 434570 - DNA, 20 bp, Artificial Sequence
  chemically synthesized
aactccaattgttataaaag

SEQ ID NO: 434571 - DNA, 20 bp, Artificial Sequence
  chemically synthesized
actccaattgttataaaaga

SEQ ID NO: 434572 - DNA, 20 bp, Artificial Sequence
  chemically synthesized
attgttataaaagaaggaat

SEQ ID NO: 434573 - DNA, 20 bp, Artificial Sequence
  chemically synthesized
tgcagtggattatgtcaaaa

SEQ ID NO: 434574 - DNA, 20 bp, Artificial Sequence
  chemically synthesized
attttgacataatccactgc

SEQ ID NO: 434575 - DNA, 20 bp, Artificial Sequence
  chemically synthesized
ttttgacataatccactgca

SEQ ID NO: 434576 - DNA, 20 bp, Artificial Sequence
  chemically synthesized
tttgacataatccactgcaa

SEQ ID NO: 434577 - DNA, 20 bp, Artificial Sequence
  chemically synthesized
ctgcttactttcccttgcag

SEQ ID NO: 434578 - DNA, 20 bp, Artificial Sequence
  chemically synthesized
acataatccactgcaaggga

SEQ ID NO: 434579 - DNA, 20 bp, Artificial Sequence
  chemically synthesized
tttctgcttactttcccttg

SEQ ID NO: 434580 - DNA, 20 bp, Artificial Sequence
  chemically synthesized
aatccactgcaagggaaagt

SEQ ID NO: 434581 - DNA, 20 bp, Artificial Sequence
  chemically synthesized
ccactgcaagggaaagtaag

SEQ ID NO: 434582 - DNA, 20 bp, Artificial Sequence
  chemically synthesized
ggaaagtaagcagaaatatc

SEQ ID NO: 434583 - DNA, 20 bp, Artificial Sequence
  chemically synthesized
aagtaagcagaaatatccag

SEQ ID NO: 434584 - DNA, 20 bp, Artificial Sequence
  chemically synthesized
agtaagcagaaatatccagt

SEQ ID NO: 434585 - DNA, 20 bp, Artificial Sequence
  chemically synthesized
agctttcctccaaatcccac

SEQ ID NO: 434586 - DNA, 20 bp, Artificial Sequence
  chemically synthesized
cagaaatatccagtgggatt

SEQ ID NO: 434587 - DNA, 20 bp, Artificial Sequence
  chemically synthesized
gaaatatccagtgggatttg

SEQ ID NO: 434588 - DNA, 20 bp, Artificial Sequence
  chemically synthesized
aaatatccagtgggatttgg

SEQ ID NO: 434589 - DNA, 20 bp, Artificial Sequence
  chemically synthesized
atccagtgggatttggagga

SEQ ID NO: 434590 - DNA, 20 bp, Artificial Sequence
  chemically synthesized
atttggaggaaagctgtgta

SEQ ID NO: 434591 - DNA, 20 bp, Artificial Sequence
  chemically synthesized
tttggaggaaagctgtgtaa

SEQ ID NO: 434592 - DNA, 20 bp, Artificial Sequence
  chemically synthesized
ttggaggaaagctgtgtaaa

SEQ ID NO: 434593 - DNA, 20 bp, Artificial Sequence
  chemically synthesized
tttaagaagcgccctttaca

SEQ ID NO: 434594 - DNA, 20 bp, Artificial Sequence
  chemically synthesized
gtaaagggcgcttcttaaat

SEQ ID NO: 434595 - DNA, 20 bp, Artificial Sequence
  chemically synthesized
aagggtttgtccaatttaag

SEQ ID NO: 434596 - DNA, 20 bp, Artificial Sequence
  chemically synthesized
tgaaagggtttgtccaattt

SEQ ID NO: 434597 - DNA, 20 bp, Artificial Sequence
  chemically synthesized
aggactccagcagagtgaaa

SEQ ID NO: 434598 - DNA, 20 bp, Artificial Sequence
  chemically synthesized
aaggactccagcagagtgaa

SEQ ID NO: 434599 - DNA, 20 bp, Artificial Sequence
  chemically synthesized
gaaggactccagcagagtga

SEQ ID NO: 434600 - DNA, 20 bp, Artificial Sequence
  chemically synthesized
gacaaaccctttcactctgc

SEQ ID NO: 434601 - DNA, 20 bp, Artificial Sequence
  chemically synthesized
caaaccctttcactctgctg

SEQ ID NO: 434602 - DNA, 20 bp, Artificial Sequence
  chemically synthesized
tgtcaggaaggactccagca

SEQ ID NO: 434603 - DNA, 20 bp, Artificial Sequence
  chemically synthesized
ggtgtcaggaaggactccag

SEQ ID NO: 434604 - DNA, 20 bp, Artificial Sequence
  chemically synthesized
ccaggtgtcaggaaggactc

SEQ ID NO: 434605 - DNA, 20 bp, Artificial Sequence
  chemically synthesized
cctctttccaggtgtcagga

SEQ ID NO: 434606 - DNA, 20 bp, Artificial Sequence
  chemically synthesized
gcctctttccaggtgtcagg

SEQ ID NO: 434607 - DNA, 20 bp, Artificial Sequence
  chemically synthesized
ctggagtccttcctgacacc

SEQ ID NO: 434608 - DNA, 20 bp, Artificial Sequence
  chemically synthesized
ccagcctctttccaggtgtc

SEQ ID NO: 434609 - DNA, 20 bp, Artificial Sequence
  chemically synthesized
tccagcctctttccaggtgt

SEQ ID NO: 434610 - DNA, 20 bp, Artificial Sequence
  chemically synthesized
agtccttcctgacacctgga

SEQ ID NO: 434611 - DNA, 20 bp, Artificial Sequence
  chemically synthesized
tccttcctgacacctggaaa

SEQ ID NO: 434612 - DNA, 20 bp, Artificial Sequence
  chemically synthesized
ccttcctgacacctggaaag

SEQ ID NO: 434613 - DNA, 20 bp, Artificial Sequence
  chemically synthesized
tggacctccagcctctttcc

SEQ ID NO: 434614 - DNA, 20 bp, Artificial Sequence
  chemically synthesized
ctggacctccagcctctttc

SEQ ID NO: 434615 - DNA, 20 bp, Artificial Sequence
  chemically synthesized
cctgacacctggaaagaggc

SEQ ID NO: 434616 - DNA, 20 bp, Artificial Sequence
  chemically synthesized
tgacacctggaaagaggctg

SEQ ID NO: 434617 - DNA, 20 bp, Artificial Sequence
  chemically synthesized
gacacctggaaagaggctgg

SEQ ID NO: 434618 - DNA, 20 bp, Artificial Sequence
  chemically synthesized
ctggaaagaggctggaggtc

SEQ ID NO: 434619 - DNA, 20 bp, Artificial Sequence
  chemically synthesized
taaaatggctgctggacctc

SEQ ID NO: 434620 - DNA, 20 bp, Artificial Sequence
  chemically synthesized
gaaagaggctggaggtccag

SEQ ID NO: 434621 - DNA, 20 bp, Artificial Sequence
  chemically synthesized
tcattgtctaaaatggctgc

SEQ ID NO: 434622 - DNA, 20 bp, Artificial Sequence
  chemically synthesized
tggaggtccagcagccattt

SEQ ID NO: 434623 - DNA, 20 bp, Artificial Sequence
  chemically synthesized
tgtaacatcattgtctaaaa

SEQ ID NO: 434624 - DNA, 20 bp, Artificial Sequence
  chemically synthesized
tagacaatgatgttacatcg

SEQ ID NO: 434625 - DNA, 20 bp, Artificial Sequence
  chemically synthesized
gatgttacatcgaagaccga

SEQ ID NO: 434626 - DNA, 20 bp, Artificial Sequence
  chemically synthesized
ccatctttctgtgcaacttt

SEQ ID NO: 434627 - DNA, 20 bp, Artificial Sequence
  chemically synthesized
atcgaagaccgaaagttgca

SEQ ID NO: 434628 - DNA, 20 bp, Artificial Sequence
  chemically synthesized
aagaccgaaagttgcacaga

SEQ ID NO: 434629 - DNA, 20 bp, Artificial Sequence
  chemically synthesized
ccgaaagttgcacagaaaga

SEQ ID NO: 434630 - DNA, 20 bp, Artificial Sequence
  chemically synthesized
aaagttgcacagaaagatgg

SEQ ID NO: 434631 - DNA, 20 bp, Artificial Sequence
  chemically synthesized
aagttgcacagaaagatgga

SEQ ID NO: 434632 - DNA, 20 bp, Artificial Sequence
  chemically synthesized
acagaaagatggaaggttcc

SEQ ID NO: 434633 - DNA, 20 bp, Artificial Sequence
  chemically synthesized
cagaaagatggaaggttcct

SEQ ID NO: 434634 - DNA, 20 bp, Artificial Sequence
  chemically synthesized
gccatggtggtcaaggaccc

SEQ ID NO: 434635 - DNA, 20 bp, Artificial Sequence
  chemically synthesized
ggccatggtggtcaaggacc

SEQ ID NO: 434636 - DNA, 20 bp, Artificial Sequence
  chemically synthesized
gagcagggccatggtggtca

SEQ ID NO: 434637 - DNA, 20 bp, Artificial Sequence
  chemically synthesized
agagcagggccatggtggtc

SEQ ID NO: 434638 - DNA, 20 bp, Artificial Sequence
  chemically synthesized
tcctgggtccttgaccacca

SEQ ID NO: 434639 - DNA, 20 bp, Artificial Sequence
  chemically synthesized
ccggtagagcagggccatgg

SEQ ID NO: 434640 - DNA, 20 bp, Artificial Sequence
  chemically synthesized
ttgccggtagagcagggcca

SEQ ID NO: 434641 - DNA, 20 bp, Artificial Sequence
  chemically synthesized
agtacattgccggtagagca

SEQ ID NO: 434642 - DNA, 20 bp, Artificial Sequence
  chemically synthesized
ccaccatggccctgctctac

SEQ ID NO: 434643 - DNA, 20 bp, Artificial Sequence
  chemically synthesized
cagtacattgccggtagagc

SEQ ID NO: 434644 - DNA, 20 bp, Artificial Sequence
  chemically synthesized
gcagtacattgccggtagag

SEQ ID NO: 434645 - DNA, 20 bp, Artificial Sequence
  chemically synthesized
gaagcagtacattgccggta

SEQ ID NO: 434646 - DNA, 20 bp, Artificial Sequence
  chemically synthesized
tggaagcagtacattgccgg

SEQ ID NO: 434647 - DNA, 20 bp, Artificial Sequence
  chemically synthesized
agctggaagcagtacattgc

SEQ ID NO: 434648 - DNA, 20 bp, Artificial Sequence
  chemically synthesized
taccggcaatgtactgcttc

SEQ ID NO: 434649 - DNA, 20 bp, Artificial Sequence
  chemically synthesized
gagtgagctccagctggaag

SEQ ID NO: 434650 - DNA, 20 bp, Artificial Sequence
  chemically synthesized
ggcaatgtactgcttccagc

SEQ ID NO: 434651 - DNA, 20 bp, Artificial Sequence
  chemically synthesized
caatgtactgcttccagctg

SEQ ID NO: 434652 - DNA, 20 bp, Artificial Sequence
  chemically synthesized
catgagtgagctccagctgg

SEQ ID NO: 434653 - DNA, 20 bp, Artificial Sequence
  chemically synthesized
ccacatgagtgagctccagc

SEQ ID NO: 434654 - DNA, 20 bp, Artificial Sequence
  chemically synthesized
cttgccacatgagtgagctc

SEQ ID NO: 434655 - DNA, 20 bp, Artificial Sequence
  chemically synthesized
ccagctggagctcactcatg

SEQ ID NO: 434656 - DNA, 20 bp, Artificial Sequence
  chemically synthesized
tgttgccttgccacatgagt

SEQ ID NO: 434657 - DNA, 20 bp, Artificial Sequence
  chemically synthesized
ctggagctcactcatgtggc

SEQ ID NO: 434658 - DNA, 20 bp, Artificial Sequence
  chemically synthesized
gatttgttgccttgccacat

SEQ ID NO: 434659 - DNA, 20 bp, Artificial Sequence
  chemically synthesized
tggagctcactcatgtggca

SEQ ID NO: 434660 - DNA, 20 bp, Artificial Sequence
  chemically synthesized
tagaagtgtgttaagtaaga

SEQ ID NO: 434661 - DNA, 20 bp, Artificial Sequence
  chemically synthesized
aatagaagtgtgttaagtaa

SEQ ID NO: 434662 - DNA, 20 bp, Artificial Sequence
  chemically synthesized
gaaatagaagtgtgttaagt

SEQ ID NO: 434663 - DNA, 20 bp, Artificial Sequence
  chemically synthesized
tccagaaatagaagtgtgtt

SEQ ID NO: 434664 - DNA, 20 bp, Artificial Sequence
  chemically synthesized
acttaacacacttctatttc

SEQ ID NO: 434665 - DNA, 20 bp, Artificial Sequence
  chemically synthesized
tatcagaaatccagaaatag

SEQ ID NO: 434666 - DNA, 20 bp, Artificial Sequence
  chemically synthesized
gtgtatcagaaatccagaaa

SEQ ID NO: 434667 - DNA, 20 bp, Artificial Sequence
  chemically synthesized
ggctgcgtgtatcagaaatc

SEQ ID NO: 434668 - DNA, 20 bp, Artificial Sequence
  chemically synthesized
ttctggatttctgatacacg

SEQ ID NO: 434669 - DNA, 20 bp, Artificial Sequence
  chemically synthesized
ttgggtttggctgcgtgtat

SEQ ID NO: 434670 - DNA, 20 bp, Artificial Sequence
  chemically synthesized
gcatcaggtaggattgggtt

SEQ ID NO: 434671 - DNA, 20 bp, Artificial Sequence
  chemically synthesized
tgagtgcatcaggtaggatt

SEQ ID NO: 434672 - DNA, 20 bp, Artificial Sequence
  chemically synthesized
atgagtgcatcaggtaggat

SEQ ID NO: 434673 - DNA, 20 bp, Artificial Sequence
  chemically synthesized
aaaaaatgagtgcatcaggt

SEQ ID NO: 434674 - DNA, 20 bp, Artificial Sequence
  chemically synthesized
taaaaaatgagtgcatcagg

SEQ ID NO: 434675 - DNA, 20 bp, Artificial Sequence
  chemically synthesized
tattaaaaaatgagtgcatc

SEQ ID NO: 434676 - DNA, 20 bp, Artificial Sequence
  chemically synthesized
gtattaaaaaatgagtgcat

SEQ ID NO: 434677 - DNA, 20 bp, Artificial Sequence
  chemically synthesized
cattttgagtattaaaaaat

SEQ ID NO: 434678 - DNA, 20 bp, Artificial Sequence
  chemically synthesized
tcattttttaatactcaaaa

SEQ ID NO: 434679 - DNA, 20 bp, Artificial Sequence
  chemically synthesized
cattttttaatactcaaaat

SEQ ID NO: 434680 - DNA, 20 bp, Artificial Sequence
  chemically synthesized
ggtaagatagttcccatttt

SEQ ID NO: 434681 - DNA, 20 bp, Artificial Sequence
  chemically synthesized
aaaaagtgataatggtaaga

SEQ ID NO: 434682 - DNA, 20 bp, Artificial Sequence
  chemically synthesized
taacaaaaagtgataatggt

SEQ ID NO: 434683 - DNA, 20 bp, Artificial Sequence
  chemically synthesized
ggtgtaacaaaaagtgataa

SEQ ID NO: 434684 - DNA, 20 bp, Artificial Sequence
  chemically synthesized
aaaatctgaggtgtaacaaa

SEQ ID NO: 434685 - DNA, 20 bp, Artificial Sequence
  chemically synthesized
tatcactttttgttacacct

SEQ ID NO: 434686 - DNA, 20 bp, Artificial Sequence
  chemically synthesized
cactttttcaggaaaatctg

SEQ ID NO: 434687 - DNA, 20 bp, Artificial Sequence
  chemically synthesized
gcactttttcaggaaaatct

SEQ ID NO: 434688 - DNA, 20 bp, Artificial Sequence
  chemically synthesized
cacctcagattttcctgaaa

SEQ ID NO: 434689 - DNA, 20 bp, Artificial Sequence
  chemically synthesized
ttttgacaatgcactttttc

SEQ ID NO: 434690 - DNA, 20 bp, Artificial Sequence
  chemically synthesized
gttttgacaatgcacttttt

SEQ ID NO: 434691 - DNA, 20 bp, Artificial Sequence
  chemically synthesized
atatcattatttttaaaaca

SEQ ID NO: 434692 - DNA, 20 bp, Artificial Sequence
  chemically synthesized
atcattatttttaaaacaaa

SEQ ID NO: 434693 - DNA, 20 bp, Artificial Sequence
  chemically synthesized
attattaaatacattaaaac

SEQ ID NO: 434694 - DNA, 20 bp, Artificial Sequence
  chemically synthesized
aaatacattaaaaccagaca

SEQ ID NO: 434695 - DNA, 20 bp, Artificial Sequence
  chemically synthesized
aatacattaaaaccagacaa

SEQ ID NO: 434696 - DNA, 20 bp, Artificial Sequence
  chemically synthesized
ttaatttatgagcctttgtc

SEQ ID NO: 434697 - DNA, 20 bp, Artificial Sequence
  chemically synthesized
acacgtttgcattaatttat

SEQ ID NO: 434698 - DNA, 20 bp, Artificial Sequence
  chemically synthesized
cataaattaatgcaaacgtg

SEQ ID NO: 434699 - DNA, 20 bp, Artificial Sequence
  chemically synthesized
attaatgcaaacgtgtggaa

SEQ ID NO: 434700 - DNA, 20 bp, Artificial Sequence
  chemically synthesized
gtggaatagtttcatcacac

SEQ ID NO: 434701 - DNA, 20 bp, Artificial Sequence
  chemically synthesized
cacacaagtgaaaattaaat

SEQ ID NO: 434702 - DNA, 20 bp, Artificial Sequence
  chemically synthesized
agagctttattatggcagag

SEQ ID NO: 434703 - DNA, 20 bp, Artificial Sequence
  chemically synthesized
aacagagctttattatggca

SEQ ID NO: 434704 - DNA, 20 bp, Artificial Sequence
  chemically synthesized
caaacagagctttattatgg

SEQ ID NO: 434705 - DNA, 20 bp, Artificial Sequence
  chemically synthesized
tggactgctctgccataata

SEQ ID NO: 434706 - DNA, 20 bp, Artificial Sequence
  chemically synthesized
aggcaaacagagctttatta

SEQ ID NO: 434707 - DNA, 20 bp, Artificial Sequence
  chemically synthesized
catttcaaagcaggcaaaca

SEQ ID NO: 434708 - DNA, 20 bp, Artificial Sequence
  chemically synthesized
ttcatttcaaagcaggcaaa

SEQ ID NO: 434709 - DNA, 20 bp, Artificial Sequence
  chemically synthesized
gatgcttttcatttcaaagc

SEQ ID NO: 434710 - DNA, 20 bp, Artificial Sequence
  chemically synthesized
tgatgcttttcatttcaaag

SEQ ID NO: 434711 - DNA, 20 bp, Artificial Sequence
  chemically synthesized
gcatgatgcttttcatttca

SEQ ID NO: 434712 - DNA, 20 bp, Artificial Sequence
  chemically synthesized
tttgcctgctttgaaatgaa

SEQ ID NO: 434713 - DNA, 20 bp, Artificial Sequence
  chemically synthesized
tcaaagaaacgcagcagtaa

SEQ ID NO: 434714 - DNA, 20 bp, Artificial Sequence
  chemically synthesized
tacttttcaaagaaacgcag

SEQ ID NO: 434715 - DNA, 20 bp, Artificial Sequence
  chemically synthesized
tggtacttttcaaagaaacg

SEQ ID NO: 434716 - DNA, 20 bp, Artificial Sequence
  chemically synthesized
tactgctgcgtttctttgaa

SEQ ID NO: 434717 - DNA, 20 bp, Artificial Sequence
  chemically synthesized
gagagatttggtacttttca

SEQ ID NO: 434718 - DNA, 20 bp, Artificial Sequence
  chemically synthesized
agcaactcagaagagagatt

SEQ ID NO: 434719 - DNA, 20 bp, Artificial Sequence
  chemically synthesized
aagtaccaaatctctcttct

SEQ ID NO: 434720 - DNA, 20 bp, Artificial Sequence
  chemically synthesized
gacaagagcaactcagaaga

SEQ ID NO: 434721 - DNA, 20 bp, Artificial Sequence
  chemically synthesized
aagacaagagcaactcagaa

SEQ ID NO: 434722 - DNA, 20 bp, Artificial Sequence
  chemically synthesized
aaaagacaagagcaactcag

SEQ ID NO: 434723 - DNA, 20 bp, Artificial Sequence
  chemically synthesized
tcaaaaagacaagagcaact

SEQ ID NO: 434724 - DNA, 20 bp, Artificial Sequence
  chemically synthesized
ccttatactcaaaaagacaa

SEQ ID NO: 434725 - DNA, 20 bp, Artificial Sequence
  chemically synthesized
taccttatactcaaaaagac

SEQ ID NO: 434726 - DNA, 20 bp, Artificial Sequence
  chemically synthesized
tgagttgctcttgtcttttt

SEQ ID NO: 434727 - DNA, 20 bp, Artificial Sequence
  chemically synthesized
ataaataccttatactcaaa

SEQ ID NO: 434728 - DNA, 20 bp, Artificial Sequence
  chemically synthesized
gctcttgtctttttgagtat

SEQ ID NO: 434729 - DNA, 20 bp, Artificial Sequence
  chemically synthesized
ctcttgtctttttgagtata

SEQ ID NO: 434730 - DNA, 20 bp, Artificial Sequence
  chemically synthesized
tataaggtatttattaccac

SEQ ID NO: 434731 - DNA, 20 bp, Artificial Sequence
  chemically synthesized
ataaggtatttattaccact

SEQ ID NO: 434732 - DNA, 20 bp, Artificial Sequence
  chemically synthesized
acattctgtttttatcccag

SEQ ID NO: 434733 - DNA, 20 bp, Artificial Sequence
  chemically synthesized
tcaacattctgtttttatcc

SEQ ID NO: 434734 - DNA, 20 bp, Artificial Sequence
  chemically synthesized
tattaccactgggataaaaa

SEQ ID NO: 434735 - DNA, 20 bp, Artificial Sequence
  chemically synthesized
ggataaaaacagaatgttga

SEQ ID NO: 434736 - DNA, 20 bp, Artificial Sequence
  chemically synthesized
atgttgatggtcacatgatg

SEQ ID NO: 434737 - DNA, 20 bp, Artificial Sequence
  chemically synthesized
tgttgatggtcacatgatgc

SEQ ID NO: 434738 - DNA, 20 bp, Artificial Sequence
  chemically synthesized
tgatggtcacatgatgcagg

SEQ ID NO: 434739 - DNA, 20 bp, Artificial Sequence
  chemically synthesized
ggtcacatgatgcaggcagc

SEQ ID NO: 434740 - DNA, 20 bp, Artificial Sequence
  chemically synthesized
gtcacatgatgcaggcagct

SEQ ID NO: 434741 - DNA, 20 bp, Artificial Sequence
  chemically synthesized
ctgaccttgagttgaaatcc

SEQ ID NO: 434742 - DNA, 20 bp, Artificial Sequence
  chemically synthesized
ggcagctgggatttcaactc

SEQ ID NO: 434743 - DNA, 20 bp, Artificial Sequence
  chemically synthesized
gcagctgggatttcaactca

SEQ ID NO: 434744 - DNA, 20 bp, Artificial Sequence
  chemically synthesized
ctgggatttcaactcaaggt

SEQ ID NO: 434745 - DNA, 20 bp, Artificial Sequence
  chemically synthesized
agggtccagtgactgacctt

SEQ ID NO: 434746 - DNA, 20 bp, Artificial Sequence
  chemically synthesized
ttcaactcaaggtcagtcac

SEQ ID NO: 434747 - DNA, 20 bp, Artificial Sequence
  chemically synthesized
aaggtcagtcactggaccct

SEQ ID NO: 434748 - DNA, 20 bp, Artificial Sequence
  chemically synthesized
aggtcagtcactggaccctc

SEQ ID NO: 434749 - DNA, 20 bp, Artificial Sequence
  chemically synthesized
tatctggctgcctgagggtc

SEQ ID NO: 434750 - DNA, 20 bp, Artificial Sequence
  chemically synthesized
tcagtcactggaccctcagg

SEQ ID NO: 434751 - DNA, 20 bp, Artificial Sequence
  chemically synthesized
aacactatctggctgcctga

SEQ ID NO: 434752 - DNA, 20 bp, Artificial Sequence
  chemically synthesized
caacactatctggctgcctg

SEQ ID NO: 434753 - DNA, 20 bp, Artificial Sequence
  chemically synthesized
tcactggaccctcaggcagc

SEQ ID NO: 434754 - DNA, 20 bp, Artificial Sequence
  chemically synthesized
acaacactatctggctgcct

SEQ ID NO: 434755 - DNA, 20 bp, Artificial Sequence
  chemically synthesized
tggaccctcaggcagccaga

SEQ ID NO: 434756 - DNA, 20 bp, Artificial Sequence
  chemically synthesized
aaaaaataaacaacactatc

SEQ ID NO: 434757 - DNA, 20 bp, Artificial Sequence
  chemically synthesized
ggctaaaggcatcatcaatt

SEQ ID NO: 434758 - DNA, 20 bp, Artificial Sequence
  chemically synthesized
tgccaaattgatgatgcctt

SEQ ID NO: 434759 - DNA, 20 bp, Artificial Sequence
  chemically synthesized
gctccttatttaaaggctaa

SEQ ID NO: 434760 - DNA, 20 bp, Artificial Sequence
  chemically synthesized
tgctccttatttaaaggcta

SEQ ID NO: 434761 - DNA, 20 bp, Artificial Sequence
  chemically synthesized
gatgcctttagcctttaaat

SEQ ID NO: 434762 - DNA, 20 bp, Artificial Sequence
  chemically synthesized
atgcctttagcctttaaata

SEQ ID NO: 434763 - DNA, 20 bp, Artificial Sequence
  chemically synthesized
agtcagtgctccttatttaa

SEQ ID NO: 434764 - DNA, 20 bp, Artificial Sequence
  chemically synthesized
tagtcagtgctccttattta

SEQ ID NO: 434765 - DNA, 20 bp, Artificial Sequence
  chemically synthesized
gcctttagcctttaaataag

SEQ ID NO: 434766 - DNA, 20 bp, Artificial Sequence
  chemically synthesized
ggacaaaatttaatcatagt

SEQ ID NO: 434767 - DNA, 20 bp, Artificial Sequence
  chemically synthesized
tttaggacaaaatttaatca

SEQ ID NO: 434768 - DNA, 20 bp, Artificial Sequence
  chemically synthesized
tatgattaaattttgtccta

SEQ ID NO: 434769 - DNA, 20 bp, Artificial Sequence
  chemically synthesized
tgattaaattttgtcctaaa

SEQ ID NO: 434770 - DNA, 20 bp, Artificial Sequence
  chemically synthesized
agagtgtgaaatatctcttt

SEQ ID NO: 434771 - DNA, 20 bp, Artificial Sequence
  chemically synthesized
tagagtgtgaaatatctctt

SEQ ID NO: 434772 - DNA, 20 bp, Artificial Sequence
  chemically synthesized
atatttcacactctaataca

SEQ ID NO: 434773 - DNA, 20 bp, Artificial Sequence
  chemically synthesized
gagatacattctatgtatta

SEQ ID NO: 434774 - DNA, 20 bp, Artificial Sequence
  chemically synthesized
atgagatacattctatgtat

SEQ ID NO: 434775 - DNA, 20 bp, Artificial Sequence
  chemically synthesized
tactctgttacaattttaat

SEQ ID NO: 434776 - DNA, 20 bp, Artificial Sequence
  chemically synthesized
gtatctcattaaaattgtaa

SEQ ID NO: 434777 - DNA, 20 bp, Artificial Sequence
  chemically synthesized
atctcattaaaattgtaaca

SEQ ID NO: 434778 - DNA, 20 bp, Artificial Sequence
  chemically synthesized
cattaaaattgtaacagagt

SEQ ID NO: 434779 - DNA, 20 bp, Artificial Sequence
  chemically synthesized
aaattgtaacagagtaagaa

SEQ ID NO: 434780 - DNA, 20 bp, Artificial Sequence
  chemically synthesized
agagtaagaaaagcttactt

SEQ ID NO: 434781 - DNA, 20 bp, Artificial Sequence
  chemically synthesized
agtaagaaaagcttacttca

SEQ ID NO: 434782 - DNA, 20 bp, Artificial Sequence
  chemically synthesized
ttctgagagatctctgaagt

SEQ ID NO: 434783 - DNA, 20 bp, Artificial Sequence
  chemically synthesized
ttttttctgagagatctctg

SEQ ID NO: 434784 - DNA, 20 bp, Artificial Sequence
  chemically synthesized
agcttacttcagagatctct

SEQ ID NO: 434785 - DNA, 20 bp, Artificial Sequence
  chemically synthesized
gtactccaatttttttctga

SEQ ID NO: 434786 - DNA, 20 bp, Artificial Sequence
  chemically synthesized
ctgtactccaatttttttct

SEQ ID NO: 434787 - DNA, 20 bp, Artificial Sequence
  chemically synthesized
gagatctctcagaaaaaaat

SEQ ID NO: 434788 - DNA, 20 bp, Artificial Sequence
  chemically synthesized
gatctctcagaaaaaaattg

SEQ ID NO: 434789 - DNA, 20 bp, Artificial Sequence
  chemically synthesized
ctcagaaaaaaattggagta

SEQ ID NO: 434790 - DNA, 20 bp, Artificial Sequence
  chemically synthesized
aaaaattggagtacagcctg

SEQ ID NO: 434791 - DNA, 20 bp, Artificial Sequence
  chemically synthesized
tgattattttagataacttc

SEQ ID NO: 434792 - DNA, 20 bp, Artificial Sequence
  chemically synthesized
ctgattattttagataactt

SEQ ID NO: 434793 - DNA, 20 bp, Artificial Sequence
  chemically synthesized
ctgaagttatctaaaataat

SEQ ID NO: 434794 - DNA, 20 bp, Artificial Sequence
  chemically synthesized
tggttccatgctgattattt

SEQ ID NO: 434795 - DNA, 20 bp, Artificial Sequence
  chemically synthesized
gttatctaaaataatcagca

SEQ ID NO: 434796 - DNA, 20 bp, Artificial Sequence
  chemically synthesized
ataatcagcatggaaccatg

SEQ ID NO: 434797 - DNA, 20 bp, Artificial Sequence
  chemically synthesized
catctgatttcaaatctgca

SEQ ID NO: 434798 - DNA, 20 bp, Artificial Sequence
  chemically synthesized
gaaccatgcagatttgaaat

SEQ ID NO: 434799 - DNA, 20 bp, Artificial Sequence
  chemically synthesized
atgacaaacatgtactttca

SEQ ID NO: 434800 - DNA, 20 bp, Artificial Sequence
  chemically synthesized
ttcaaatgttcatgctttga

SEQ ID NO: 434801 - DNA, 20 bp, Artificial Sequence
  chemically synthesized
aaagcatgaacatttgaaaa

SEQ ID NO: 434802 - DNA, 20 bp, Artificial Sequence
  chemically synthesized
ttgaaaacagtaacttgcat

SEQ ID NO: 434803 - DNA, 20 bp, Artificial Sequence
  chemically synthesized
cctcgtttagaaactgatgc

SEQ ID NO: 434804 - DNA, 20 bp, Artificial Sequence
  chemically synthesized
acttgcatcagtttctaaac

SEQ ID NO: 434805 - DNA, 20 bp, Artificial Sequence
  chemically synthesized
cttgcatcagtttctaaacg

SEQ ID NO: 434806 - DNA, 20 bp, Artificial Sequence
  chemically synthesized
ttgcatcagtttctaaacga

SEQ ID NO: 434807 - DNA, 20 bp, Artificial Sequence
  chemically synthesized
gttacattaaatccctcgtt

SEQ ID NO: 434808 - DNA, 20 bp, Artificial Sequence
  chemically synthesized
gagggatttaatgtaactat

SEQ ID NO: 434809 - DNA, 20 bp, Artificial Sequence
  chemically synthesized
tctcacactgattattctga

SEQ ID NO: 434810 - DNA, 20 bp, Artificial Sequence
  chemically synthesized
aatgtaactatcagaataat

SEQ ID NO: 434811 - DNA, 20 bp, Artificial Sequence
  chemically synthesized
actatcagaataatcagtgt

SEQ ID NO: 434812 - DNA, 20 bp, Artificial Sequence
  chemically synthesized
ccaaattcaattttatattt

SEQ ID NO: 434813 - DNA, 20 bp, Artificial Sequence
  chemically synthesized
ctgaaatataaaattgaatt

SEQ ID NO: 434814 - DNA, 20 bp, Artificial Sequence
  chemically synthesized
tgaaatataaaattgaattt

SEQ ID NO: 434815 - DNA, 20 bp, Artificial Sequence
  chemically synthesized
taaaattgaatttgggtctt

SEQ ID NO: 434816 - DNA, 20 bp, Artificial Sequence
  chemically synthesized
tgaatttgggtcttcagaat

SEQ ID NO: 434817 - DNA, 20 bp, Artificial Sequence
  chemically synthesized
ctgttaagtttctaattctg

SEQ ID NO: 434818 - DNA, 20 bp, Artificial Sequence
  chemically synthesized
cttcagaattagaaacttaa

SEQ ID NO: 434819 - DNA, 20 bp, Artificial Sequence
  chemically synthesized
aatgacctcctttttctgtt

SEQ ID NO: 434820 - DNA, 20 bp, Artificial Sequence
  chemically synthesized
aattagaaacttaacagaaa

SEQ ID NO: 434821 - DNA, 20 bp, Artificial Sequence
  chemically synthesized
attagaaacttaacagaaaa

SEQ ID NO: 434822 - DNA, 20 bp, Artificial Sequence
  chemically synthesized
tagaaacttaacagaaaaag

SEQ ID NO: 434823 - DNA, 20 bp, Artificial Sequence
  chemically synthesized
agaaacttaacagaaaaagg

SEQ ID NO: 434824 - DNA, 20 bp, Artificial Sequence
  chemically synthesized
acagaaaaaggaggtcattg

SEQ ID NO: 434825 - DNA, 20 bp, Artificial Sequence
  chemically synthesized
ttttgtttttatgcctaatt

SEQ ID NO: 434826 - DNA, 20 bp, Artificial Sequence
  chemically synthesized
gcccattcaatttctaaatt

SEQ ID NO: 434827 - DNA, 20 bp, Artificial Sequence
  chemically synthesized
ggcccattcaatttctaaat

SEQ ID NO: 434828 - DNA, 20 bp, Artificial Sequence
  chemically synthesized
tgcctaatttagaaattgaa

SEQ ID NO: 434829 - DNA, 20 bp, Artificial Sequence
  chemically synthesized
gcctaatttagaaattgaat

SEQ ID NO: 434830 - DNA, 20 bp, Artificial Sequence
  chemically synthesized
aatttagaaattgaatgggc

SEQ ID NO: 434831 - DNA, 20 bp, Artificial Sequence
  chemically synthesized
atttagaaattgaatgggcc

SEQ ID NO: 434832 - DNA, 20 bp, Artificial Sequence
  chemically synthesized
attgaatgggccgggtgcga

SEQ ID NO: 434833 - DNA, 20 bp, Artificial Sequence
  chemically synthesized
cagtggtgagccatcgcacc

SEQ ID NO: 434834 - DNA, 20 bp, Artificial Sequence
  chemically synthesized
agtgctgagattacagtggt

SEQ ID NO: 434835 - DNA, 20 bp, Artificial Sequence
  chemically synthesized
ccaaagtgctgagattacag

SEQ ID NO: 434836 - DNA, 20 bp, Artificial Sequence
  chemically synthesized
atggctcaccactgtaatct

SEQ ID NO: 434837 - DNA, 20 bp, Artificial Sequence
  chemically synthesized
ctcccaaagtgctgagatta

SEQ ID NO: 434838 - DNA, 20 bp, Artificial Sequence
  chemically synthesized
ccactgtaatctcagcactt

SEQ ID NO: 434839 - DNA, 20 bp, Artificial Sequence
  chemically synthesized
cctcggcctcccaaagtgct

SEQ ID NO: 434840 - DNA, 20 bp, Artificial Sequence
  chemically synthesized
cactgtaatctcagcacttt

SEQ ID NO: 434841 - DNA, 20 bp, Artificial Sequence
  chemically synthesized
ctgtaatctcagcactttgg

SEQ ID NO: 434842 - DNA, 20 bp, Artificial Sequence
  chemically synthesized
tgtaatctcagcactttggg

SEQ ID NO: 434843 - DNA, 20 bp, Artificial Sequence
  chemically synthesized
ccgcccgcctcggcctccca

SEQ ID NO: 434844 - DNA, 20 bp, Artificial Sequence
  chemically synthesized
tctcagcactttgggaggcc

SEQ ID NO: 434845 - DNA, 20 bp, Artificial Sequence
  chemically synthesized
ctcagcactttgggaggccg

SEQ ID NO: 434846 - DNA, 20 bp, Artificial Sequence
  chemically synthesized
agcactttgggaggccgagg

SEQ ID NO: 434847 - DNA, 20 bp, Artificial Sequence
  chemically synthesized
gcactttgggaggccgaggc

SEQ ID NO: 434848 - DNA, 20 bp, Artificial Sequence
  chemically synthesized
ctttgggaggccgaggcggg

SEQ ID NO: 434849 - DNA, 20 bp, Artificial Sequence
  chemically synthesized
acctcgtgatccgcccgcct

SEQ ID NO: 434850 - DNA, 20 bp, Artificial Sequence
  chemically synthesized
ggccgaggcgggcggatcac

SEQ ID NO: 434851 - DNA, 20 bp, Artificial Sequence
  chemically synthesized
gccgaggcgggcggatcacg

SEQ ID NO: 434852 - DNA, 20 bp, Artificial Sequence
  chemically synthesized
aggcgggcggatcacgaggt

SEQ ID NO: 434853 - DNA, 20 bp, Artificial Sequence
  chemically synthesized
ggcgggcggatcacgaggtc

SEQ ID NO: 434854 - DNA, 20 bp, Artificial Sequence
  chemically synthesized
cgggcggatcacgaggtcag

SEQ ID NO: 434855 - DNA, 20 bp, Artificial Sequence
  chemically synthesized
gatcacgaggtcaggagatc

SEQ ID NO: 434856 - DNA, 20 bp, Artificial Sequence
  chemically synthesized
tcaggagatcgagaccatcc

SEQ ID NO: 434857 - DNA, 20 bp, Artificial Sequence
  chemically synthesized
tttcactgcgttagccagga

SEQ ID NO: 434858 - DNA, 20 bp, Artificial Sequence
  chemically synthesized
ggggtttcactgcgttagcc

SEQ ID NO: 434859 - DNA, 20 bp, Artificial Sequence
  chemically synthesized
cgagaccatcctggctaacg

SEQ ID NO: 434860 - DNA, 20 bp, Artificial Sequence
  chemically synthesized
cggggtttcactgcgttagc

SEQ ID NO: 434861 - DNA, 20 bp, Artificial Sequence
  chemically synthesized
gaaacggggtttcactgcgt

SEQ ID NO: 434862 - DNA, 20 bp, Artificial Sequence
  chemically synthesized
ttgtatttttagtagaaacg

SEQ ID NO: 434863 - DNA, 20 bp, Artificial Sequence
  chemically synthesized
tttgtatttttagtagaaac

SEQ ID NO: 434864 - DNA, 20 bp, Artificial Sequence
  chemically synthesized
ttttgtatttttagtagaaa

SEQ ID NO: 434865 - DNA, 20 bp, Artificial Sequence
  chemically synthesized
taatttttttgtatttttag

SEQ ID NO: 434866 - DNA, 20 bp, Artificial Sequence
  chemically synthesized
ggctaatttttttgtatttt

SEQ ID NO: 434867 - DNA, 20 bp, Artificial Sequence
  chemically synthesized
tactaaaaatacaaaaaaat

SEQ ID NO: 434868 - DNA, 20 bp, Artificial Sequence
  chemically synthesized
aaaaatacaaaaaaattagc

SEQ ID NO: 434869 - DNA, 20 bp, Artificial Sequence
  chemically synthesized
aaaatacaaaaaaattagcc

SEQ ID NO: 434870 - DNA, 20 bp, Artificial Sequence
  chemically synthesized
acaaaaaaattagccgggcg

SEQ ID NO: 434871 - DNA, 20 bp, Artificial Sequence
  chemically synthesized
aaaaaattagccgggcgtgg

SEQ ID NO: 434872 - DNA, 20 bp, Artificial Sequence
  chemically synthesized
caggcgcccgccaccacgcc

SEQ ID NO: 434873 - DNA, 20 bp, Artificial Sequence
  chemically synthesized
aaattagccgggcgtggtgg

SEQ ID NO: 434874 - DNA, 20 bp, Artificial Sequence
  chemically synthesized
aattagccgggcgtggtggc

SEQ ID NO: 434875 - DNA, 20 bp, Artificial Sequence
  chemically synthesized
ggcgtggtggcgggcgcctg

SEQ ID NO: 434876 - DNA, 20 bp, Artificial Sequence
  chemically synthesized
gtggcgggcgcctgtagtcc

SEQ ID NO: 434877 - DNA, 20 bp, Artificial Sequence
  chemically synthesized
tcccgagtagctgggactac

SEQ ID NO: 434878 - DNA, 20 bp, Artificial Sequence
  chemically synthesized
ctcccgagtagctgggacta

SEQ ID NO: 434879 - DNA, 20 bp, Artificial Sequence
  chemically synthesized
cgcctgtagtcccagctact

SEQ ID NO: 434880 - DNA, 20 bp, Artificial Sequence
  chemically synthesized
cctcaggctcccgagtagct

SEQ ID NO: 434881 - DNA, 20 bp, Artificial Sequence
  chemically synthesized
gcctgtagtcccagctactc

SEQ ID NO: 434882 - DNA, 20 bp, Artificial Sequence
  chemically synthesized
gcctcaggctcccgagtagc

SEQ ID NO: 434883 - DNA, 20 bp, Artificial Sequence
  chemically synthesized
ctgtagtcccagctactcgg

SEQ ID NO: 434884 - DNA, 20 bp, Artificial Sequence
  chemically synthesized
tcctgcctcaggctcccgag

SEQ ID NO: 434885 - DNA, 20 bp, Artificial Sequence
  chemically synthesized
ttctcctgcctcaggctccc

SEQ ID NO: 434886 - DNA, 20 bp, Artificial Sequence
  chemically synthesized
tcccagctactcgggagcct

SEQ ID NO: 434887 - DNA, 20 bp, Artificial Sequence
  chemically synthesized
cccagctactcgggagcctg

SEQ ID NO: 434888 - DNA, 20 bp, Artificial Sequence
  chemically synthesized
agctactcgggagcctgagg

SEQ ID NO: 434889 - DNA, 20 bp, Artificial Sequence
  chemically synthesized
gctactcgggagcctgaggc

SEQ ID NO: 434890 - DNA, 20 bp, Artificial Sequence
  chemically synthesized
tactcgggagcctgaggcag

SEQ ID NO: 434891 - DNA, 20 bp, Artificial Sequence
  chemically synthesized
tcacgccattctcctgcctc

SEQ ID NO: 434892 - DNA, 20 bp, Artificial Sequence
  chemically synthesized
ttcacgccattctcctgcct

SEQ ID NO: 434893 - DNA, 20 bp, Artificial Sequence
  chemically synthesized
gggagcctgaggcaggagaa

SEQ ID NO: 434894 - DNA, 20 bp, Artificial Sequence
  chemically synthesized
gcaggagaatggcgtgaacc

SEQ ID NO: 434895 - DNA, 20 bp, Artificial Sequence
  chemically synthesized
caggagaatggcgtgaacct

SEQ ID NO: 434896 - DNA, 20 bp, Artificial Sequence
  chemically synthesized
ggagaatggcgtgaacctgg

SEQ ID NO: 434897 - DNA, 20 bp, Artificial Sequence
  chemically synthesized
gagaatggcgtgaacctggg

SEQ ID NO: 434898 - DNA, 20 bp, Artificial Sequence
  chemically synthesized
aatggcgtgaacctgggagg

SEQ ID NO: 434899 - DNA, 20 bp, Artificial Sequence
  chemically synthesized
cactgcaagctccgcctccc

SEQ ID NO: 434900 - DNA, 20 bp, Artificial Sequence
  chemically synthesized
tggcgtgaacctgggaggcg

SEQ ID NO: 434901 - DNA, 20 bp, Artificial Sequence
  chemically synthesized
tcactgcaagctccgcctcc

SEQ ID NO: 434902 - DNA, 20 bp, Artificial Sequence
  chemically synthesized
aacctgggaggcggagcttg

SEQ ID NO: 434903 - DNA, 20 bp, Artificial Sequence
  chemically synthesized
tgggaggcggagcttgcagt

SEQ ID NO: 434904 - DNA, 20 bp, Artificial Sequence
  chemically synthesized
gcgcgatctcggctcactgc

SEQ ID NO: 434905 - DNA, 20 bp, Artificial Sequence
  chemically synthesized
ggcggagcttgcagtgagcc

SEQ ID NO: 434906 - DNA, 20 bp, Artificial Sequence
  chemically synthesized
agagtgcagtggcgcgatct

SEQ ID NO: 434907 - DNA, 20 bp, Artificial Sequence
  chemically synthesized
tcacccaggctagagtgcag

SEQ ID NO: 434908 - DNA, 20 bp, Artificial Sequence
  chemically synthesized
gagatcgcgccactgcactc

SEQ ID NO: 434909 - DNA, 20 bp, Artificial Sequence
  chemically synthesized
ctgtcacccaggctagagtg

SEQ ID NO: 434910 - DNA, 20 bp, Artificial Sequence
  chemically synthesized
cgcgccactgcactctagcc

SEQ ID NO: 434911 - DNA, 20 bp, Artificial Sequence
  chemically synthesized
gcgccactgcactctagcct

SEQ ID NO: 434912 - DNA, 20 bp, Artificial Sequence
  chemically synthesized
tcgctctgtcacccaggcta

SEQ ID NO: 434913 - DNA, 20 bp, Artificial Sequence
  chemically synthesized
tctcgctctgtcacccaggc

SEQ ID NO: 434914 - DNA, 20 bp, Artificial Sequence
  chemically synthesized
ctgcactctagcctgggtga

SEQ ID NO: 434915 - DNA, 20 bp, Artificial Sequence
  chemically synthesized
ggagtctcgctctgtcaccc

SEQ ID NO: 434916 - DNA, 20 bp, Artificial Sequence
  chemically synthesized
gcactctagcctgggtgaca

SEQ ID NO: 434917 - DNA, 20 bp, Artificial Sequence
  chemically synthesized
cggagtctcgctctgtcacc

SEQ ID NO: 434918 - DNA, 20 bp, Artificial Sequence
  chemically synthesized
tctagcctgggtgacagagc

SEQ ID NO: 434919 - DNA, 20 bp, Artificial Sequence
  chemically synthesized
ctttttttttttttgagacg

SEQ ID NO: 434920 - DNA, 20 bp, Artificial Sequence
  chemically synthesized
ttctttttttttttttgaga

SEQ ID NO: 434921 - DNA, 20 bp, Artificial Sequence
  chemically synthesized
ttctttcttttttttttttt

SEQ ID NO: 434922 - DNA, 20 bp, Artificial Sequence
  chemically synthesized
ctccgtctcaaaaaaaaaaa

SEQ ID NO: 434923 - DNA, 20 bp, Artificial Sequence
  chemically synthesized
gtctcaaaaaaaaaaaaaga

SEQ ID NO: 434924 - DNA, 20 bp, Artificial Sequence
  chemically synthesized
aaaaaaaaaaaaagaaagaa

SEQ ID NO: 434925 - DNA, 20 bp, Artificial Sequence
  chemically synthesized
aaagaaaagaaattgaatga

SEQ ID NO: 434926 - DNA, 20 bp, Artificial Sequence
  chemically synthesized
atgaaagttcattgataatg

SEQ ID NO: 434927 - DNA, 20 bp, Artificial Sequence
  chemically synthesized
gaaagttcattgataatgca

SEQ ID NO: 434928 - DNA, 20 bp, Artificial Sequence
  chemically synthesized
atttttggctacatttattt

SEQ ID NO: 434929 - DNA, 20 bp, Artificial Sequence
  chemically synthesized
cagagattctaaaataaatg

SEQ ID NO: 434930 - DNA, 20 bp, Artificial Sequence
  chemically synthesized
aataaatgtagccaaaaata

SEQ ID NO: 434931 - DNA, 20 bp, Artificial Sequence
  chemically synthesized
atgctgattggctttatttt

SEQ ID NO: 434932 - DNA, 20 bp, Artificial Sequence
  chemically synthesized
tagccaaaaataaagccaat

SEQ ID NO: 434933 - DNA, 20 bp, Artificial Sequence
  chemically synthesized
aatagttttggtatgctgat

SEQ ID NO: 434934 - DNA, 20 bp, Artificial Sequence
  chemically synthesized
ttctaagattgtaatagttt

SEQ ID NO: 434935 - DNA, 20 bp, Artificial Sequence
  chemically synthesized
atggatttctaagattgtaa

SEQ ID NO: 434936 - DNA, 20 bp, Artificial Sequence
  chemically synthesized
taccaaaactattacaatct

SEQ ID NO: 434937 - DNA, 20 bp, Artificial Sequence
  chemically synthesized
aaaaatcataatggatttct

SEQ ID NO: 434938 - DNA, 20 bp, Artificial Sequence
  chemically synthesized
gcactttttaaaaatcataa

SEQ ID NO: 434939 - DNA, 20 bp, Artificial Sequence
  chemically synthesized
aatccattatgatttttaaa

SEQ ID NO: 434940 - DNA, 20 bp, Artificial Sequence
  chemically synthesized
tcagaggaaaaaaaaaaaaa

SEQ ID NO: 434941 - DNA, 20 bp, Artificial Sequence
  chemically synthesized
tttttttttttttttcctct

SEQ ID NO: 434942 - DNA, 20 bp, Artificial Sequence
  chemically synthesized
tttttttttttcctctgaga

SEQ ID NO: 434943 - DNA, 20 bp, Artificial Sequence
  chemically synthesized
agagcgaaactccatctcag

SEQ ID NO: 434944 - DNA, 20 bp, Artificial Sequence
  chemically synthesized
tttttttttcctctgagatg

SEQ ID NO: 434945 - DNA, 20 bp, Artificial Sequence
  chemically synthesized
aagagcgaaactccatctca

SEQ ID NO: 434946 - DNA, 20 bp, Artificial Sequence
  chemically synthesized
acaagagcgaaactccatct

SEQ ID NO: 434947 - DNA, 20 bp, Artificial Sequence
  chemically synthesized
ccctccagcctgggcgacaa

SEQ ID NO: 434948 - DNA, 20 bp, Artificial Sequence
  chemically synthesized
ggagtttcgctcttgtcgcc

SEQ ID NO: 434949 - DNA, 20 bp, Artificial Sequence
  chemically synthesized
gagtttcgctcttgtcgccc

SEQ ID NO: 434950 - DNA, 20 bp, Artificial Sequence
  chemically synthesized
tgccctccagcctgggcgac

SEQ ID NO: 434951 - DNA, 20 bp, Artificial Sequence
  chemically synthesized
ttcgctcttgtcgcccaggc

SEQ ID NO: 434952 - DNA, 20 bp, Artificial Sequence
  chemically synthesized
cgctcttgtcgcccaggctg

SEQ ID NO: 434953 - DNA, 20 bp, Artificial Sequence
  chemically synthesized
gctcttgtcgcccaggctgg

SEQ ID NO: 434954 - DNA, 20 bp, Artificial Sequence
  chemically synthesized
gtgccattgccctccagcct

SEQ ID NO: 434955 - DNA, 20 bp, Artificial Sequence
  chemically synthesized
ctcttgtcgcccaggctgga

SEQ ID NO: 434956 - DNA, 20 bp, Artificial Sequence
  chemically synthesized
cgtgccattgccctccagcc

SEQ ID NO: 434957 - DNA, 20 bp, Artificial Sequence
  chemically synthesized
gagatcgtgccattgccctc

SEQ ID NO: 434958 - DNA, 20 bp, Artificial Sequence
  chemically synthesized
tcgcccaggctggagggcaa

SEQ ID NO: 434959 - DNA, 20 bp, Artificial Sequence
  chemically synthesized
ctggagacggaggttgaggt

SEQ ID NO: 434960 - DNA, 20 bp, Artificial Sequence
  chemically synthesized
aaccctggagacggaggttg

SEQ ID NO: 434961 - DNA, 20 bp, Artificial Sequence
  chemically synthesized
gaaccctggagacggaggtt

SEQ ID NO: 434962 - DNA, 20 bp, Artificial Sequence
  chemically synthesized
ctcacctcaacctccgtctc

SEQ ID NO: 434963 - DNA, 20 bp, Artificial Sequence
  chemically synthesized
tgcttgaaccctggagacgg

SEQ ID NO: 434964 - DNA, 20 bp, Artificial Sequence
  chemically synthesized
tcacctcaacctccgtctcc

SEQ ID NO: 434965 - DNA, 20 bp, Artificial Sequence
  chemically synthesized
ttgcttgaaccctggagacg

SEQ ID NO: 434966 - DNA, 20 bp, Artificial Sequence
  chemically synthesized
cacctcaacctccgtctcca

SEQ ID NO: 434967 - DNA, 20 bp, Artificial Sequence
  chemically synthesized
aattgcttgaaccctggaga

SEQ ID NO: 434968 - DNA, 20 bp, Artificial Sequence
  chemically synthesized
ggagaattgcttgaaccctg

SEQ ID NO: 434969 - DNA, 20 bp, Artificial Sequence
  chemically synthesized
aacctccgtctccagggttc

SEQ ID NO: 434970 - DNA, 20 bp, Artificial Sequence
  chemically synthesized
caggagaattgcttgaaccc

SEQ ID NO: 434971 - DNA, 20 bp, Artificial Sequence
  chemically synthesized
ttcaagcaattctcctgcct

SEQ ID NO: 434972 - DNA, 20 bp, Artificial Sequence
  chemically synthesized
tactcaggaagctgaggcag

SEQ ID NO: 434973 - DNA, 20 bp, Artificial Sequence
  chemically synthesized
gctactcaggaagctgaggc

SEQ ID NO: 434974 - DNA, 20 bp, Artificial Sequence
  chemically synthesized
agctactcaggaagctgagg

SEQ ID NO: 434975 - DNA, 20 bp, Artificial Sequence
  chemically synthesized
cccagctactcaggaagctg

SEQ ID NO: 434976 - DNA, 20 bp, Artificial Sequence
  chemically synthesized
tcccagctactcaggaagct

SEQ ID NO: 434977 - DNA, 20 bp, Artificial Sequence
  chemically synthesized
ttctcctgcctcagcttcct

SEQ ID NO: 434978 - DNA, 20 bp, Artificial Sequence
  chemically synthesized
tcctgcctcagcttcctgag

SEQ ID NO: 434979 - DNA, 20 bp, Artificial Sequence
  chemically synthesized
tgtaatcccagctactcagg

SEQ ID NO: 434980 - DNA, 20 bp, Artificial Sequence
  chemically synthesized
gcctcagcttcctgagtagc

SEQ ID NO: 434981 - DNA, 20 bp, Artificial Sequence
  chemically synthesized
acctgtaatcccagctactc

SEQ ID NO: 434982 - DNA, 20 bp, Artificial Sequence
  chemically synthesized
cctcagcttcctgagtagct

SEQ ID NO: 434983 - DNA, 20 bp, Artificial Sequence
  chemically synthesized
cacctgtaatcccagctact

SEQ ID NO: 434984 - DNA, 20 bp, Artificial Sequence
  chemically synthesized
ttcctgagtagctgggatta

SEQ ID NO: 434985 - DNA, 20 bp, Artificial Sequence
  chemically synthesized
tcctgagtagctgggattac

SEQ ID NO: 434986 - DNA, 20 bp, Artificial Sequence
  chemically synthesized
gtggtgcacacctgtaatcc

SEQ ID NO: 434987 - DNA, 20 bp, Artificial Sequence
  chemically synthesized
caggtgtgcaccaccacgcc

SEQ ID NO: 434988 - DNA, 20 bp, Artificial Sequence
  chemically synthesized
acaaaattagccaggcgtgg

SEQ ID NO: 434989 - DNA, 20 bp, Artificial Sequence
  chemically synthesized
aatacaaaattagccaggcg

SEQ ID NO: 434990 - DNA, 20 bp, Artificial Sequence
  chemically synthesized
ctaaaaatacaaaattagcc

SEQ ID NO: 434991 - DNA, 20 bp, Artificial Sequence
  chemically synthesized
actaaaaatacaaaattagc

SEQ ID NO: 434992 - DNA, 20 bp, Artificial Sequence
  chemically synthesized
ctctactaaaaatacaaaat

SEQ ID NO: 434993 - DNA, 20 bp, Artificial Sequence
  chemically synthesized
cctggctaattttgtatttt

SEQ ID NO: 434994 - DNA, 20 bp, Artificial Sequence
  chemically synthesized
ggctaattttgtatttttag

SEQ ID NO: 434995 - DNA, 20 bp, Artificial Sequence
  chemically synthesized
ctaattttgtatttttagta

SEQ ID NO: 434996 - DNA, 20 bp, Artificial Sequence
  chemically synthesized
ttttgtatttttagtagaga

SEQ ID NO: 434997 - DNA, 20 bp, Artificial Sequence
  chemically synthesized
tttgtatttttagtagagat

SEQ ID NO: 434998 - DNA, 20 bp, Artificial Sequence
  chemically synthesized
ttgtatttttagtagagatg

SEQ ID NO: 434999 - DNA, 20 bp, Artificial Sequence
  chemically synthesized
gagatggggtttcaccatgt

SEQ ID NO: 435000 - DNA, 20 bp, Artificial Sequence
  chemically synthesized
tggggtttcaccatgttggt

SEQ ID NO: 435001 - DNA, 20 bp, Artificial Sequence
  chemically synthesized
tgagaccagcctgaccaaca

SEQ ID NO: 435002 - DNA, 20 bp, Artificial Sequence
  chemically synthesized
ggggtttcaccatgttggtc

SEQ ID NO: 435003 - DNA, 20 bp, Artificial Sequence
  chemically synthesized
tttcaccatgttggtcaggc

SEQ ID NO: 435004 - DNA, 20 bp, Artificial Sequence
  chemically synthesized
tcagatcaggagtttgagac

SEQ ID NO: 435005 - DNA, 20 bp, Artificial Sequence
  chemically synthesized
tcacttcagatcaggagttt

SEQ ID NO: 435006 - DNA, 20 bp, Artificial Sequence
  chemically synthesized
ggcagatcacttcagatcag

SEQ ID NO: 435007 - DNA, 20 bp, Artificial Sequence
  chemically synthesized
ggtctcaaactcctgatctg

SEQ ID NO: 435008 - DNA, 20 bp, Artificial Sequence
  chemically synthesized
tgggcagatcacttcagatc

SEQ ID NO: 435009 - DNA, 20 bp, Artificial Sequence
  chemically synthesized
gtgggcagatcacttcagat

SEQ ID NO: 435010 - DNA, 20 bp, Artificial Sequence
  chemically synthesized
ccaaggtgggcagatcactt

SEQ ID NO: 435011 - DNA, 20 bp, Artificial Sequence
  chemically synthesized
ctgaagtgatctgcccacct

SEQ ID NO: 435012 - DNA, 20 bp, Artificial Sequence
  chemically synthesized
ctttgggaggccaaggtggg

SEQ ID NO: 435013 - DNA, 20 bp, Artificial Sequence
  chemically synthesized
gcactttgggaggccaaggt

SEQ ID NO: 435014 - DNA, 20 bp, Artificial Sequence
  chemically synthesized
agcactttgggaggccaagg

SEQ ID NO: 435015 - DNA, 20 bp, Artificial Sequence
  chemically synthesized
cccagcactttgggaggcca

SEQ ID NO: 435016 - DNA, 20 bp, Artificial Sequence
  chemically synthesized
tcccagcactttgggaggcc

SEQ ID NO: 435017 - DNA, 20 bp, Artificial Sequence
  chemically synthesized
ctgcccaccttggcctccca

SEQ ID NO: 435018 - DNA, 20 bp, Artificial Sequence
  chemically synthesized
tgtaatcccagcactttggg

SEQ ID NO: 435019 - DNA, 20 bp, Artificial Sequence
  chemically synthesized
ctgtaatcccagcactttgg

SEQ ID NO: 435020 - DNA, 20 bp, Artificial Sequence
  chemically synthesized
accttggcctcccaaagtgc

SEQ ID NO: 435021 - DNA, 20 bp, Artificial Sequence
  chemically synthesized
gcctgtaatcccagcacttt

SEQ ID NO: 435022 - DNA, 20 bp, Artificial Sequence
  chemically synthesized
ccttggcctcccaaagtgct

SEQ ID NO: 435023 - DNA, 20 bp, Artificial Sequence
  chemically synthesized
cgcctgtaatcccagcactt

SEQ ID NO: 435024 - DNA, 20 bp, Artificial Sequence
  chemically synthesized
ctcccaaagtgctgggatta

SEQ ID NO: 435025 - DNA, 20 bp, Artificial Sequence
  chemically synthesized
tcccaaagtgctgggattac

SEQ ID NO: 435026 - DNA, 20 bp, Artificial Sequence
  chemically synthesized
gtggctcacgcctgtaatcc

SEQ ID NO: 435027 - DNA, 20 bp, Artificial Sequence
  chemically synthesized
agtgctgggattacaggcgt

SEQ ID NO: 435028 - DNA, 20 bp, Artificial Sequence
  chemically synthesized
gattacaggcgtgagccact

SEQ ID NO: 435029 - DNA, 20 bp, Artificial Sequence
  chemically synthesized
caggcgtgagccactgagcc

SEQ ID NO: 435030 - DNA, 20 bp, Artificial Sequence
  chemically synthesized
cacttttcggccgggctcag

SEQ ID NO: 435031 - DNA, 20 bp, Artificial Sequence
  chemically synthesized
tagcacttttcggccgggct

SEQ ID NO: 435032 - DNA, 20 bp, Artificial Sequence
  chemically synthesized
agccactgagcccggccgaa

SEQ ID NO: 435033 - DNA, 20 bp, Artificial Sequence
  chemically synthesized
caatatagcacttttcggcc

SEQ ID NO: 435034 - DNA, 20 bp, Artificial Sequence
  chemically synthesized
gcaatatagcacttttcggc

SEQ ID NO: 435035 - DNA, 20 bp, Artificial Sequence
  chemically synthesized
aatagcaatatagcactttt

SEQ ID NO: 435036 - DNA, 20 bp, Artificial Sequence
  chemically synthesized
aatagtagggaatagcaata

SEQ ID NO: 435037 - DNA, 20 bp, Artificial Sequence
  chemically synthesized
gaataataaatagtagggaa

SEQ ID NO: 435038 - DNA, 20 bp, Artificial Sequence
  chemically synthesized
tttcagaataataaatagta

SEQ ID NO: 435039 - DNA, 20 bp, Artificial Sequence
  chemically synthesized
ctttcagaataataaatagt

SEQ ID NO: 435040 - DNA, 20 bp, Artificial Sequence
  chemically synthesized
tctttcagaataataaatag

SEQ ID NO: 435041 - DNA, 20 bp, Artificial Sequence
  chemically synthesized
gtctctttcagaataataaa

SEQ ID NO: 435042 - DNA, 20 bp, Artificial Sequence
  chemically synthesized
cctactatttattattctga

SEQ ID NO: 435043 - DNA, 20 bp, Artificial Sequence
  chemically synthesized
tactatttattattctgaaa

SEQ ID NO: 435044 - DNA, 20 bp, Artificial Sequence
  chemically synthesized
aacatgtgatatgtctcttt

SEQ ID NO: 435045 - DNA, 20 bp, Artificial Sequence
  chemically synthesized
taaataacgaacaaacctcc

SEQ ID NO: 435046 - DNA, 20 bp, Artificial Sequence
  chemically synthesized
aaataacgaacaaacctcct

SEQ ID NO: 435047 - DNA, 20 bp, Artificial Sequence
  chemically synthesized
ataaatatgatgatcccagg

SEQ ID NO: 435048 - DNA, 20 bp, Artificial Sequence
  chemically synthesized
gataaatatgatgatcccag

SEQ ID NO: 435049 - DNA, 20 bp, Artificial Sequence
  chemically synthesized
gtgataaatatgatgatccc

SEQ ID NO: 435050 - DNA, 20 bp, Artificial Sequence
  chemically synthesized
cgtgataaatatgatgatcc

SEQ ID NO: 435051 - DNA, 20 bp, Artificial Sequence
  chemically synthesized
tatttatcacgcacttttta

SEQ ID NO: 435052 - DNA, 20 bp, Artificial Sequence
  chemically synthesized
catgtttgattttctttaaa

SEQ ID NO: 435053 - DNA, 20 bp, Artificial Sequence
  chemically synthesized
gaataaatttgtataaacag

SEQ ID NO: 435054 - DNA, 20 bp, Artificial Sequence
  chemically synthesized
tgggaataaatttgtataaa

SEQ ID NO: 435055 - DNA, 20 bp, Artificial Sequence
  chemically synthesized
gtaaaataaatatttagaat

SEQ ID NO: 435056 - DNA, 20 bp, Artificial Sequence
  chemically synthesized
tgtaaaataaatatttagaa

SEQ ID NO: 435057 - DNA, 20 bp, Artificial Sequence
  chemically synthesized
ctgtttgtaaaataaatatt

SEQ ID NO: 435058 - DNA, 20 bp, Artificial Sequence
  chemically synthesized
ctaaatatttattttacaaa

SEQ ID NO: 435059 - DNA, 20 bp, Artificial Sequence
  chemically synthesized
tgtagcccaagaatataaga

SEQ ID NO: 435060 - DNA, 20 bp, Artificial Sequence
  chemically synthesized
agaatactttcttatattct

SEQ ID NO: 435061 - DNA, 20 bp, Artificial Sequence
  chemically synthesized
ttcatgtagcccaagaatat

SEQ ID NO: 435062 - DNA, 20 bp, Artificial Sequence
  chemically synthesized
gaatactttcttatattctt

SEQ ID NO: 435063 - DNA, 20 bp, Artificial Sequence
  chemically synthesized
aataatgattcatgtagccc

SEQ ID NO: 435064 - DNA, 20 bp, Artificial Sequence
  chemically synthesized
gttgataataatgattcatg

SEQ ID NO: 435065 - DNA, 20 bp, Artificial Sequence
  chemically synthesized
acatgaatcattattatcaa

SEQ ID NO: 435066 - DNA, 20 bp, Artificial Sequence
  chemically synthesized
tgaatcattattatcaacag

SEQ ID NO: 435067 - DNA, 20 bp, Artificial Sequence
  chemically synthesized
gaatcattattatcaacaga

SEQ ID NO: 435068 - DNA, 20 bp, Artificial Sequence
  chemically synthesized
aatcattattatcaacagaa

SEQ ID NO: 435069 - DNA, 20 bp, Artificial Sequence
  chemically synthesized
cagaagggtgtctgtcatta

SEQ ID NO: 435070 - DNA, 20 bp, Artificial Sequence
  chemically synthesized
agaagggtgtctgtcattac

SEQ ID NO: 435071 - DNA, 20 bp, Artificial Sequence
  chemically synthesized
tattgtgcttcctgtaatga

SEQ ID NO: 435072 - DNA, 20 bp, Artificial Sequence
  chemically synthesized
agggtgtctgtcattacagg

SEQ ID NO: 435073 - DNA, 20 bp, Artificial Sequence
  chemically synthesized
agtaaccctcaaaagtatac

SEQ ID NO: 435074 - DNA, 20 bp, Artificial Sequence
  chemically synthesized
cacaatacttgtatactttt

SEQ ID NO: 435075 - DNA, 20 bp, Artificial Sequence
  chemically synthesized
acaatacttgtatacttttg

SEQ ID NO: 435076 - DNA, 20 bp, Artificial Sequence
  chemically synthesized
caatacttgtatacttttga

SEQ ID NO: 435077 - DNA, 20 bp, Artificial Sequence
  chemically synthesized
tgtgtgtgagtaaccctcaa

SEQ ID NO: 435078 - DNA, 20 bp, Artificial Sequence
  chemically synthesized
gtgtgtgtgcgcgtgtgtgt

SEQ ID NO: 435079 - DNA, 20 bp, Artificial Sequence
  chemically synthesized
cacatgcacacacatacaca

SEQ ID NO: 435080 - DNA, 20 bp, Artificial Sequence
  chemically synthesized
catgcacacacatacacaca

SEQ ID NO: 435081 - DNA, 20 bp, Artificial Sequence
  chemically synthesized
acacacatacacacagagtt

SEQ ID NO: 435082 - DNA, 20 bp, Artificial Sequence
  chemically synthesized
cacacatacacacagagttt

SEQ ID NO: 435083 - DNA, 20 bp, Artificial Sequence
  chemically synthesized
acacagagtttgggacctac

SEQ ID NO: 435084 - DNA, 20 bp, Artificial Sequence
  chemically synthesized
ataagattataaagtcttgt

SEQ ID NO: 435085 - DNA, 20 bp, Artificial Sequence
  chemically synthesized
aataagattataaagtcttg

SEQ ID NO: 435086 - DNA, 20 bp, Artificial Sequence
  chemically synthesized
gcaggcataataagattata

SEQ ID NO: 435087 - DNA, 20 bp, Artificial Sequence
  chemically synthesized
aaatgggtagcaggcataat

SEQ ID NO: 435088 - DNA, 20 bp, Artificial Sequence
  chemically synthesized
aagaagatgaaatgggtagc

SEQ ID NO: 435089 - DNA, 20 bp, Artificial Sequence
  chemically synthesized
gaagaagatgaaatgggtag

SEQ ID NO: 435090 - DNA, 20 bp, Artificial Sequence
  chemically synthesized
gaagaagaagatgaaatggg

SEQ ID NO: 435091 - DNA, 20 bp, Artificial Sequence
  chemically synthesized
agtgaagaagaagatgaaat

SEQ ID NO: 435092 - DNA, 20 bp, Artificial Sequence
  chemically synthesized
cagtgaagaagaagatgaaa

SEQ ID NO: 435093 - DNA, 20 bp, Artificial Sequence
  chemically synthesized
caagacaaacagtgaagaag

SEQ ID NO: 435094 - DNA, 20 bp, Artificial Sequence
  chemically synthesized
caacaagacaaacagtgaag

SEQ ID NO: 435095 - DNA, 20 bp, Artificial Sequence
  chemically synthesized
atacaacaagacaaacagtg

SEQ ID NO: 435096 - DNA, 20 bp, Artificial Sequence
  chemically synthesized
cagagatacaacaagacaaa

SEQ ID NO: 435097 - DNA, 20 bp, Artificial Sequence
  chemically synthesized
acaacgaacagagatacaac

SEQ ID NO: 435098 - DNA, 20 bp, Artificial Sequence
  chemically synthesized
tgggtaggccacaacgaaca

SEQ ID NO: 435099 - DNA, 20 bp, Artificial Sequence
  chemically synthesized
tgttgtatctctgttcgttg

SEQ ID NO: 435100 - DNA, 20 bp, Artificial Sequence
  chemically synthesized
ggtgggtaggccacaacgaa

SEQ ID NO: 435101 - DNA, 20 bp, Artificial Sequence
  chemically synthesized
agagaggagcaggggtgggt

SEQ ID NO: 435102 - DNA, 20 bp, Artificial Sequence
  chemically synthesized
cagagaggagcaggggtggg

SEQ ID NO: 435103 - DNA, 20 bp, Artificial Sequence
  chemically synthesized
tgtcagagaggagcaggggt

SEQ ID NO: 435104 - DNA, 20 bp, Artificial Sequence
  chemically synthesized
ctgtcagagaggagcagggg

SEQ ID NO: 435105 - DNA, 20 bp, Artificial Sequence
  chemically synthesized
aaactgtcagagaggagcag

SEQ ID NO: 435106 - DNA, 20 bp, Artificial Sequence
  chemically synthesized
aaaactgtcagagaggagca

SEQ ID NO: 435107 - DNA, 20 bp, Artificial Sequence
  chemically synthesized
caaaactgtcagagaggagc

SEQ ID NO: 435108 - DNA, 20 bp, Artificial Sequence
  chemically synthesized
ccaaaactgtcagagaggag

SEQ ID NO: 435109 - DNA, 20 bp, Artificial Sequence
  chemically synthesized
aacccaaaactgtcagagag

SEQ ID NO: 435110 - DNA, 20 bp, Artificial Sequence
  chemically synthesized
ccacccctgctcctctctga

SEQ ID NO: 435111 - DNA, 20 bp, Artificial Sequence
  chemically synthesized
tcaacccaaaactgtcagag

SEQ ID NO: 435112 - DNA, 20 bp, Artificial Sequence
  chemically synthesized
ttcaacccaaaactgtcaga

SEQ ID NO: 435113 - DNA, 20 bp, Artificial Sequence
  chemically synthesized
agttcaacccaaaactgtca

SEQ ID NO: 435114 - DNA, 20 bp, Artificial Sequence
  chemically synthesized
ctgctcctctctgacagttt

SEQ ID NO: 435115 - DNA, 20 bp, Artificial Sequence
  chemically synthesized
taagttcaacccaaaactgt

SEQ ID NO: 435116 - DNA, 20 bp, Artificial Sequence
  chemically synthesized
tgctcctctctgacagtttt

SEQ ID NO: 435117 - DNA, 20 bp, Artificial Sequence
  chemically synthesized
agttttgggttgaacttacc

SEQ ID NO: 435118 - DNA, 20 bp, Artificial Sequence
  chemically synthesized
tcctggaaccagagccaggt

SEQ ID NO: 435119 - DNA, 20 bp, Artificial Sequence
  chemically synthesized
gggttgaacttacctggctc

SEQ ID NO: 435120 - DNA, 20 bp, Artificial Sequence
  chemically synthesized
ccactcctggaaccagagcc

SEQ ID NO: 435121 - DNA, 20 bp, Artificial Sequence
  chemically synthesized
cccactcctggaaccagagc

SEQ ID NO: 435122 - DNA, 20 bp, Artificial Sequence
  chemically synthesized
aacttacctggctctggttc

SEQ ID NO: 435123 - DNA, 20 bp, Artificial Sequence
  chemically synthesized
acttacctggctctggttcc

SEQ ID NO: 435124 - DNA, 20 bp, Artificial Sequence
  chemically synthesized
gacacccactcctggaacca

SEQ ID NO: 435125 - DNA, 20 bp, Artificial Sequence
  chemically synthesized
ttacctggctctggttccag

SEQ ID NO: 435126 - DNA, 20 bp, Artificial Sequence
  chemically synthesized
cagacacccactcctggaac

SEQ ID NO: 435127 - DNA, 20 bp, Artificial Sequence
  chemically synthesized
cctggctctggttccaggag

SEQ ID NO: 435128 - DNA, 20 bp, Artificial Sequence
  chemically synthesized
ctggctctggttccaggagt

SEQ ID NO: 435129 - DNA, 20 bp, Artificial Sequence
  chemically synthesized
ttccatcagacacccactcc

SEQ ID NO: 435130 - DNA, 20 bp, Artificial Sequence
  chemically synthesized
ttccaggagtgggtgtctga

SEQ ID NO: 435131 - DNA, 20 bp, Artificial Sequence
  chemically synthesized
tctgattgggcaggttccat

SEQ ID NO: 435132 - DNA, 20 bp, Artificial Sequence
  chemically synthesized
tctgatggaacctgcccaat

SEQ ID NO: 435133 - DNA, 20 bp, Artificial Sequence
  chemically synthesized
gtacagtgttctgattgggc

SEQ ID NO: 435134 - DNA, 20 bp, Artificial Sequence
  chemically synthesized
agtacagtgttctgattggg

SEQ ID NO: 435135 - DNA, 20 bp, Artificial Sequence
  chemically synthesized
aggagtacagtgttctgatt

SEQ ID NO: 435136 - DNA, 20 bp, Artificial Sequence
  chemically synthesized
caggagtacagtgttctgat

SEQ ID NO: 435137 - DNA, 20 bp, Artificial Sequence
  chemically synthesized
atcaacctagttcaggagta

SEQ ID NO: 435138 - DNA, 20 bp, Artificial Sequence
  chemically synthesized
agaacactgtactcctgaac

SEQ ID NO: 435139 - DNA, 20 bp, Artificial Sequence
  chemically synthesized
gaacactgtactcctgaact

SEQ ID NO: 435140 - DNA, 20 bp, Artificial Sequence
  chemically synthesized
aatcaatcaacctagttcag

SEQ ID NO: 435141 - DNA, 20 bp, Artificial Sequence
  chemically synthesized
tgaatcaatcaacctagttc

SEQ ID NO: 435142 - DNA, 20 bp, Artificial Sequence
  chemically synthesized
ctgaatcaatcaacctagtt

SEQ ID NO: 435143 - DNA, 20 bp, Artificial Sequence
  chemically synthesized
cattcctgaatcaatcaacc

SEQ ID NO: 435144 - DNA, 20 bp, Artificial Sequence
  chemically synthesized
ctgaactaggttgattgatt

SEQ ID NO: 435145 - DNA, 20 bp, Artificial Sequence
  chemically synthesized
tgaactaggttgattgattc

SEQ ID NO: 435146 - DNA, 20 bp, Artificial Sequence
  chemically synthesized
ttgattgattcaggaatgtg

SEQ ID NO: 435147 - DNA, 20 bp, Artificial Sequence
  chemically synthesized
tgattgattcaggaatgtgt

SEQ ID NO: 435148 - DNA, 20 bp, Artificial Sequence
  chemically synthesized
gaatgtgtaggtgatttctt

SEQ ID NO: 435149 - DNA, 20 bp, Artificial Sequence
  chemically synthesized
atgtgtaggtgatttcttca

SEQ ID NO: 435150 - DNA, 20 bp, Artificial Sequence
  chemically synthesized
attacttgtaattgactctg

SEQ ID NO: 435151 - DNA, 20 bp, Artificial Sequence
  chemically synthesized
atttcttcagagtcaattac

SEQ ID NO: 435152 - DNA, 20 bp, Artificial Sequence
  chemically synthesized
gagtcaattacaagtaatcc

SEQ ID NO: 435153 - DNA, 20 bp, Artificial Sequence
  chemically synthesized
agtcaattacaagtaatcct

SEQ ID NO: 435154 - DNA, 20 bp, Artificial Sequence
  chemically synthesized
ttctctccaacagaagacct

SEQ ID NO: 435155 - DNA, 20 bp, Artificial Sequence
  chemically synthesized
attctctccaacagaagacc

SEQ ID NO: 435156 - DNA, 20 bp, Artificial Sequence
  chemically synthesized
agtaatcctaggtcttctgt

SEQ ID NO: 435157 - DNA, 20 bp, Artificial Sequence
  chemically synthesized
taatcctaggtcttctgttg

SEQ ID NO: 435158 - DNA, 20 bp, Artificial Sequence
  chemically synthesized
aacaccattctctccaacag

SEQ ID NO: 435159 - DNA, 20 bp, Artificial Sequence
  chemically synthesized
atcctaggtcttctgttgga

SEQ ID NO: 435160 - DNA, 20 bp, Artificial Sequence
  chemically synthesized
gaaaacaccattctctccaa

SEQ ID NO: 435161 - DNA, 20 bp, Artificial Sequence
  chemically synthesized
aggtcttctgttggagagaa

SEQ ID NO: 435162 - DNA, 20 bp, Artificial Sequence
  chemically synthesized
atggtgttttcattttctat

SEQ ID NO: 435163 - DNA, 20 bp, Artificial Sequence
  chemically synthesized
tcattgtacctcaattccaa

SEQ ID NO: 435164 - DNA, 20 bp, Artificial Sequence
  chemically synthesized
tttcattttctattggaatt

SEQ ID NO: 435165 - DNA, 20 bp, Artificial Sequence
  chemically synthesized
ttcattttctattggaattg

SEQ ID NO: 435166 - DNA, 20 bp, Artificial Sequence
  chemically synthesized
gaattgaggtacaatgatat

SEQ ID NO: 435167 - DNA, 20 bp, Artificial Sequence
  chemically synthesized
aggtacaatgatataagtct

SEQ ID NO: 435168 - DNA, 20 bp, Artificial Sequence
  chemically synthesized
atgggacccattattagtct

SEQ ID NO: 435169 - DNA, 20 bp, Artificial Sequence
  chemically synthesized
tataagtctaagactaataa

SEQ ID NO: 435170 - DNA, 20 bp, Artificial Sequence
  chemically synthesized
ataagtctaagactaataat

SEQ ID NO: 435171 - DNA, 20 bp, Artificial Sequence
  chemically synthesized
ctcgatatgggacccattat

SEQ ID NO: 435172 - DNA, 20 bp, Artificial Sequence
  chemically synthesized
ctaataatgggtcccatatc

SEQ ID NO: 435173 - DNA, 20 bp, Artificial Sequence
  chemically synthesized
aataatgggtcccatatcga

SEQ ID NO: 435174 - DNA, 20 bp, Artificial Sequence
  chemically synthesized
tagacattatctctcgatat

SEQ ID NO: 435175 - DNA, 20 bp, Artificial Sequence
  chemically synthesized
ttagacattatctctcgata

SEQ ID NO: 435176 - DNA, 20 bp, Artificial Sequence
  chemically synthesized
catatcgagagataatgtct

SEQ ID NO: 435177 - DNA, 20 bp, Artificial Sequence
  chemically synthesized
tatcgagagataatgtctaa

SEQ ID NO: 435178 - DNA, 20 bp, Artificial Sequence
  chemically synthesized
aaaaaaaaaaaaaaagctct

SEQ ID NO: 435179 - DNA, 20 bp, Artificial Sequence
  chemically synthesized
cttaaaaaaaaaaaaaaaaa

SEQ ID NO: 435180 - DNA, 20 bp, Artificial Sequence
  chemically synthesized
cttttttttttttttttttt

SEQ ID NO: 435181 - DNA, 20 bp, Artificial Sequence
  chemically synthesized
ttttttttttttttttttaa

SEQ ID NO: 435182 - DNA, 20 bp, Artificial Sequence
  chemically synthesized
tttctccactgtgttttcaa

SEQ ID NO: 435183 - DNA, 20 bp, Artificial Sequence
  chemically synthesized
ctttctccactgtgttttca

SEQ ID NO: 435184 - DNA, 20 bp, Artificial Sequence
  chemically synthesized
tttaagagcctttgaaaaca

SEQ ID NO: 435185 - DNA, 20 bp, Artificial Sequence
  chemically synthesized
aagagcctttgaaaacacag

SEQ ID NO: 435186 - DNA, 20 bp, Artificial Sequence
  chemically synthesized
gagcctttgaaaacacagtg

SEQ ID NO: 435187 - DNA, 20 bp, Artificial Sequence
  chemically synthesized
ctttgaaaacacagtggaga

SEQ ID NO: 435188 - DNA, 20 bp, Artificial Sequence
  chemically synthesized
tttgaaaacacagtggagaa

SEQ ID NO: 435189 - DNA, 20 bp, Artificial Sequence
  chemically synthesized
ttgaaaacacagtggagaaa

SEQ ID NO: 435190 - DNA, 20 bp, Artificial Sequence
  chemically synthesized
aaacacagtggagaaagggt

SEQ ID NO: 435191 - DNA, 20 bp, Artificial Sequence
  chemically synthesized
acacagtggagaaagggtga

SEQ ID NO: 435192 - DNA, 20 bp, Artificial Sequence
  chemically synthesized
acagtggagaaagggtgaga

SEQ ID NO: 435193 - DNA, 20 bp, Artificial Sequence
  chemically synthesized
cagtggagaaagggtgagag

SEQ ID NO: 435194 - DNA, 20 bp, Artificial Sequence
  chemically synthesized
agaaagggtgagagaggtac

SEQ ID NO: 435195 - DNA, 20 bp, Artificial Sequence
  chemically synthesized
gaaagggtgagagaggtact

SEQ ID NO: 435196 - DNA, 20 bp, Artificial Sequence
  chemically synthesized
gggtgagagaggtactgggc

SEQ ID NO: 435197 - DNA, 20 bp, Artificial Sequence
  chemically synthesized
ggtgagagaggtactgggct

SEQ ID NO: 435198 - DNA, 20 bp, Artificial Sequence
  chemically synthesized
tcaagtgatgtcacctagcc

SEQ ID NO: 435199 - DNA, 20 bp, Artificial Sequence
  chemically synthesized
ggatctcaagtgatgtcacc

SEQ ID NO: 435200 - DNA, 20 bp, Artificial Sequence
  chemically synthesized
tgggctaggtgacatcactt

SEQ ID NO: 435201 - DNA, 20 bp, Artificial Sequence
  chemically synthesized
acagttagttttgggatctc

SEQ ID NO: 435202 - DNA, 20 bp, Artificial Sequence
  chemically synthesized
cttcagatacagttagtttt

SEQ ID NO: 435203 - DNA, 20 bp, Artificial Sequence
  chemically synthesized
acttcagatacagttagttt

SEQ ID NO: 435204 - DNA, 20 bp, Artificial Sequence
  chemically synthesized
ttacttacttcagatacagt

SEQ ID NO: 435205 - DNA, 20 bp, Artificial Sequence
  chemically synthesized
cccaaaactaactgtatctg

SEQ ID NO: 435206 - DNA, 20 bp, Artificial Sequence
  chemically synthesized
ggtattacttacttcagata

SEQ ID NO: 435207 - DNA, 20 bp, Artificial Sequence
  chemically synthesized
aaactaactgtatctgaagt

SEQ ID NO: 435208 - DNA, 20 bp, Artificial Sequence
  chemically synthesized
tgaagaggtattacttactt

SEQ ID NO: 435209 - DNA, 20 bp, Artificial Sequence
  chemically synthesized
catgtaacgaaaaagtgaag

SEQ ID NO: 435210 - DNA, 20 bp, Artificial Sequence
  chemically synthesized
tcatgtaacgaaaaagtgaa

SEQ ID NO: 435211 - DNA, 20 bp, Artificial Sequence
  chemically synthesized
gctcatgtaacgaaaaagtg

SEQ ID NO: 435212 - DNA, 20 bp, Artificial Sequence
  chemically synthesized
cctttgctcatgtaacgaaa

SEQ ID NO: 435213 - DNA, 20 bp, Artificial Sequence
  chemically synthesized
tcttcactttttcgttacat

SEQ ID NO: 435214 - DNA, 20 bp, Artificial Sequence
  chemically synthesized
actttttcgttacatgagca

SEQ ID NO: 435215 - DNA, 20 bp, Artificial Sequence
  chemically synthesized
ctttttcgttacatgagcaa

SEQ ID NO: 435216 - DNA, 20 bp, Artificial Sequence
  chemically synthesized
aaccagtttaagaaaaaaaa

SEQ ID NO: 435217 - DNA, 20 bp, Artificial Sequence
  chemically synthesized
aacttttttttttcttaaac

SEQ ID NO: 435218 - DNA, 20 bp, Artificial Sequence
  chemically synthesized
aaaacctagcaaaccagttt

SEQ ID NO: 435219 - DNA, 20 bp, Artificial Sequence
  chemically synthesized
tttttcttaaactggtttgc

SEQ ID NO: 435220 - DNA, 20 bp, Artificial Sequence
  chemically synthesized
ttttcttaaactggtttgct

SEQ ID NO: 435221 - DNA, 20 bp, Artificial Sequence
  chemically synthesized
tttacaaaaacctagcaaac

SEQ ID NO: 435222 - DNA, 20 bp, Artificial Sequence
  chemically synthesized
tctgctaatttacaaaaacc

SEQ ID NO: 435223 - DNA, 20 bp, Artificial Sequence
  chemically synthesized
tttgctaggtttttgtaaat

SEQ ID NO: 435224 - DNA, 20 bp, Artificial Sequence
  chemically synthesized
gctaggtttttgtaaattag

SEQ ID NO: 435225 - DNA, 20 bp, Artificial Sequence
  chemically synthesized
tttttgtaaattagcagaaa

SEQ ID NO: 435226 - DNA, 20 bp, Artificial Sequence
  chemically synthesized
atacatatatgtgtgtatgt

SEQ ID NO: 435227 - DNA, 20 bp, Artificial Sequence
  chemically synthesized
atatgtatgtatgtatattt

SEQ ID NO: 435228 - DNA, 20 bp, Artificial Sequence
  chemically synthesized
tatgtatgtatattttggtt

SEQ ID NO: 435229 - DNA, 20 bp, Artificial Sequence
  chemically synthesized
tgtatattttggttgagatt

SEQ ID NO: 435230 - DNA, 20 bp, Artificial Sequence
  chemically synthesized
ttttggttgagattaagaaa

SEQ ID NO: 435231 - DNA, 20 bp, Artificial Sequence
  chemically synthesized
ttggttgagattaagaaata

SEQ ID NO: 435232 - DNA, 20 bp, Artificial Sequence
  chemically synthesized
gagattaagaaatagagacc

SEQ ID NO: 435233 - DNA, 20 bp, Artificial Sequence
  chemically synthesized
agattaagaaatagagacct

SEQ ID NO: 435234 - DNA, 20 bp, Artificial Sequence
  chemically synthesized
cagttatatcattagaacct

SEQ ID NO: 435235 - DNA, 20 bp, Artificial Sequence
  chemically synthesized
tcagttatatcattagaacc

SEQ ID NO: 435236 - DNA, 20 bp, Artificial Sequence
  chemically synthesized
tctttagtcagttatatcat

SEQ ID NO: 435237 - DNA, 20 bp, Artificial Sequence
  chemically synthesized
tctaatgatataactgacta

SEQ ID NO: 435238 - DNA, 20 bp, Artificial Sequence
  chemically synthesized
ggattaattttatctttagt

SEQ ID NO: 435239 - DNA, 20 bp, Artificial Sequence
  chemically synthesized
aattggattaattttatctt

SEQ ID NO: 435240 - DNA, 20 bp, Artificial Sequence
  chemically synthesized
gtgctgaaactttcaataat

SEQ ID NO: 435241 - DNA, 20 bp, Artificial Sequence
  chemically synthesized
aaaattaatccaattattga

SEQ ID NO: 435242 - DNA, 20 bp, Artificial Sequence
  chemically synthesized
aatccaattattgaaagttt

SEQ ID NO: 435243 - DNA, 20 bp, Artificial Sequence
  chemically synthesized
tattgaaagtttcagcacct

SEQ ID NO: 435244 - DNA, 20 bp, Artificial Sequence
  chemically synthesized
attgtttaaagaggcaactg

SEQ ID NO: 435245 - DNA, 20 bp, Artificial Sequence
  chemically synthesized
cattgtttaaagaggcaact

SEQ ID NO: 435246 - DNA, 20 bp, Artificial Sequence
  chemically synthesized
aactaactcattgtttaaag

SEQ ID NO: 435247 - DNA, 20 bp, Artificial Sequence
  chemically synthesized
taactaactcattgtttaaa

SEQ ID NO: 435248 - DNA, 20 bp, Artificial Sequence
  chemically synthesized
tctaactaactcattgttta

SEQ ID NO: 435249 - DNA, 20 bp, Artificial Sequence
  chemically synthesized
cagttgcctctttaaacaat

SEQ ID NO: 435250 - DNA, 20 bp, Artificial Sequence
  chemically synthesized
tgcctctttaaacaatgagt

SEQ ID NO: 435251 - DNA, 20 bp, Artificial Sequence
  chemically synthesized
tctttaaacaatgagttagt

SEQ ID NO: 435252 - DNA, 20 bp, Artificial Sequence
  chemically synthesized
tagttagattacatgactga

SEQ ID NO: 435253 - DNA, 20 bp, Artificial Sequence
  chemically synthesized
ttttagatctagacaactgt

SEQ ID NO: 435254 - DNA, 20 bp, Artificial Sequence
  chemically synthesized
ttacatgactgacagttgtc

SEQ ID NO: 435255 - DNA, 20 bp, Artificial Sequence
  chemically synthesized
ggatccaatgattttagatc

SEQ ID NO: 435256 - DNA, 20 bp, Artificial Sequence
  chemically synthesized
ttgtctagatctaaaatcat

SEQ ID NO: 435257 - DNA, 20 bp, Artificial Sequence
  chemically synthesized
ttgattggatccaatgattt

SEQ ID NO: 435258 - DNA, 20 bp, Artificial Sequence
  chemically synthesized
attcatgaaaatcaattgat

SEQ ID NO: 435259 - DNA, 20 bp, Artificial Sequence
  chemically synthesized
ttgattttcatgaatgaaca

SEQ ID NO: 435260 - DNA, 20 bp, Artificial Sequence
  chemically synthesized
tgaacaaagacatttaaatc

SEQ ID NO: 435261 - DNA, 20 bp, Artificial Sequence
  chemically synthesized
acaaagacatttaaatctgg

SEQ ID NO: 435262 - DNA, 20 bp, Artificial Sequence
  chemically synthesized
agacatttaaatctggaagt

SEQ ID NO: 435263 - DNA, 20 bp, Artificial Sequence
  chemically synthesized
ggtttaatagaacttacttc

SEQ ID NO: 435264 - DNA, 20 bp, Artificial Sequence
  chemically synthesized
gaagtaagttctattaaacc

SEQ ID NO: 435265 - DNA, 20 bp, Artificial Sequence
  chemically synthesized
tatcaagatactaggtttaa

SEQ ID NO: 435266 - DNA, 20 bp, Artificial Sequence
  chemically synthesized
cctggggttatcaagatact

SEQ ID NO: 435267 - DNA, 20 bp, Artificial Sequence
  chemically synthesized
gcctggggttatcaagatac

SEQ ID NO: 435268 - DNA, 20 bp, Artificial Sequence
  chemically synthesized
ttatctggcctggggttatc

SEQ ID NO: 435269 - DNA, 20 bp, Artificial Sequence
  chemically synthesized
acctagtatcttgataaccc

SEQ ID NO: 435270 - DNA, 20 bp, Artificial Sequence
  chemically synthesized
cctagtatcttgataacccc

SEQ ID NO: 435271 - DNA, 20 bp, Artificial Sequence
  chemically synthesized
gtatcttgataaccccaggc

SEQ ID NO: 435272 - DNA, 20 bp, Artificial Sequence
  chemically synthesized
ttatagttttatctggcctg

SEQ ID NO: 435273 - DNA, 20 bp, Artificial Sequence
  chemically synthesized
tttatagttttatctggcct

SEQ ID NO: 435274 - DNA, 20 bp, Artificial Sequence
  chemically synthesized
ttttatagttttatctggcc

SEQ ID NO: 435275 - DNA, 20 bp, Artificial Sequence
  chemically synthesized
tttttttttatagttttatc

SEQ ID NO: 435276 - DNA, 20 bp, Artificial Sequence
  chemically synthesized
gaccagtcatttttttttta

SEQ ID NO: 435277 - DNA, 20 bp, Artificial Sequence
  chemically synthesized
aactataaaaaaaaaatgac

SEQ ID NO: 435278 - DNA, 20 bp, Artificial Sequence
  chemically synthesized
ccatcgactgatatagagac

SEQ ID NO: 435279 - DNA, 20 bp, Artificial Sequence
  chemically synthesized
aaaatgactggtctctatat

SEQ ID NO: 435280 - DNA, 20 bp, Artificial Sequence
  chemically synthesized
ggtgcccatcgactgatata

SEQ ID NO: 435281 - DNA, 20 bp, Artificial Sequence
  chemically synthesized
atggtgcccatcgactgata

SEQ ID NO: 435282 - DNA, 20 bp, Artificial Sequence
  chemically synthesized
ctggtctctatatcagtcga

SEQ ID NO: 435283 - DNA, 20 bp, Artificial Sequence
  chemically synthesized
tggtctctatatcagtcgat

SEQ ID NO: 435284 - DNA, 20 bp, Artificial Sequence
  chemically synthesized
agtcgatgggcaccatttta

SEQ ID NO: 435285 - DNA, 20 bp, Artificial Sequence
  chemically synthesized
gaaataaattaactataaaa

SEQ ID NO: 435286 - DNA, 20 bp, Artificial Sequence
  chemically synthesized
attttatagttaatttattt

SEQ ID NO: 435287 - DNA, 20 bp, Artificial Sequence
  chemically synthesized
ttttatagttaatttatttc

SEQ ID NO: 435288 - DNA, 20 bp, Artificial Sequence
  chemically synthesized
gttaatttatttcaggaaca

SEQ ID NO: 435289 - DNA, 20 bp, Artificial Sequence
  chemically synthesized
aatttatttcaggaacatgg

SEQ ID NO: 435290 - DNA, 20 bp, Artificial Sequence
  chemically synthesized
ggaacatggcagttataaca

SEQ ID NO: 435291 - DNA, 20 bp, Artificial Sequence
  chemically synthesized
gaacatggcagttataacac

SEQ ID NO: 435292 - DNA, 20 bp, Artificial Sequence
  chemically synthesized
agttataacacaggtaacta

SEQ ID NO: 435293 - DNA, 20 bp, Artificial Sequence
  chemically synthesized
gttataacacaggtaactat

SEQ ID NO: 435294 - DNA, 20 bp, Artificial Sequence
  chemically synthesized
aacacaggtaactataggac

SEQ ID NO: 435295 - DNA, 20 bp, Artificial Sequence
  chemically synthesized
aggtttaccagcttgtccta

SEQ ID NO: 435296 - DNA, 20 bp, Artificial Sequence
  chemically synthesized
caggtaactataggacaagc

SEQ ID NO: 435297 - DNA, 20 bp, Artificial Sequence
  chemically synthesized
ttacctacaatgaggtttac

SEQ ID NO: 435298 - DNA, 20 bp, Artificial Sequence
  chemically synthesized
caagctggtaaacctcattg

SEQ ID NO: 435299 - DNA, 20 bp, Artificial Sequence
  chemically synthesized
aagctggtaaacctcattgt

SEQ ID NO: 435300 - DNA, 20 bp, Artificial Sequence
  chemically synthesized
ctcagtgattacctacaatg

SEQ ID NO: 435301 - DNA, 20 bp, Artificial Sequence
  chemically synthesized
gctcagtgattacctacaat

SEQ ID NO: 435302 - DNA, 20 bp, Artificial Sequence
  chemically synthesized
cctcattgtaggtaatcact

SEQ ID NO: 435303 - DNA, 20 bp, Artificial Sequence
  chemically synthesized
ttgtaggtaatcactgagct

SEQ ID NO: 435304 - DNA, 20 bp, Artificial Sequence
  chemically synthesized
tgtaggtaatcactgagctc

SEQ ID NO: 435305 - DNA, 20 bp, Artificial Sequence
  chemically synthesized
gtaggtaatcactgagctca

SEQ ID NO: 435306 - DNA, 20 bp, Artificial Sequence
  chemically synthesized
tcatgctacctccctgagct

SEQ ID NO: 435307 - DNA, 20 bp, Artificial Sequence
  chemically synthesized
aggtaatcactgagctcagg

SEQ ID NO: 435308 - DNA, 20 bp, Artificial Sequence
  chemically synthesized
ggtaatcactgagctcaggg

SEQ ID NO: 435309 - DNA, 20 bp, Artificial Sequence
  chemically synthesized
aatcactgagctcagggagg

SEQ ID NO: 435310 - DNA, 20 bp, Artificial Sequence
  chemically synthesized
ccacatcatgctacctccct

SEQ ID NO: 435311 - DNA, 20 bp, Artificial Sequence
  chemically synthesized
ctcagggaggtagcatgatg

SEQ ID NO: 435312 - DNA, 20 bp, Artificial Sequence
  chemically synthesized
agggaggtagcatgatgtgg

SEQ ID NO: 435313 - DNA, 20 bp, Artificial Sequence
  chemically synthesized
tagcatgatgtggtggataa

SEQ ID NO: 435314 - DNA, 20 bp, Artificial Sequence
  chemically synthesized
atgatgtggtggataacagc

SEQ ID NO: 435315 - DNA, 20 bp, Artificial Sequence
  chemically synthesized
tgatgtggtggataacagca

SEQ ID NO: 435316 - DNA, 20 bp, Artificial Sequence
  chemically synthesized
gatgtggtggataacagcaa

SEQ ID NO: 435317 - DNA, 20 bp, Artificial Sequence
  chemically synthesized
tggtggataacagcaaggga

SEQ ID NO: 435318 - DNA, 20 bp, Artificial Sequence
  chemically synthesized
ggtggataacagcaagggat

SEQ ID NO: 435319 - DNA, 20 bp, Artificial Sequence
  chemically synthesized
gtggataacagcaagggata

SEQ ID NO: 435320 - DNA, 20 bp, Artificial Sequence
  chemically synthesized
gataacagcaagggataggg

SEQ ID NO: 435321 - DNA, 20 bp, Artificial Sequence
  chemically synthesized
ataacagcaagggataggga

SEQ ID NO: 435322 - DNA, 20 bp, Artificial Sequence
  chemically synthesized
aacagcaagggatagggaag

SEQ ID NO: 435323 - DNA, 20 bp, Artificial Sequence
  chemically synthesized
gcaagggatagggaaggaga

SEQ ID NO: 435324 - DNA, 20 bp, Artificial Sequence
  chemically synthesized
aggagaaagtttgactttca

SEQ ID NO: 435325 - DNA, 20 bp, Artificial Sequence
  chemically synthesized
gagttagaattagactttga

SEQ ID NO: 435326 - DNA, 20 bp, Artificial Sequence
  chemically synthesized
gaagaattctgagttagaat

SEQ ID NO: 435327 - DNA, 20 bp, Artificial Sequence
  chemically synthesized
ttcaaagtctaattctaact

SEQ ID NO: 435328 - DNA, 20 bp, Artificial Sequence
  chemically synthesized
acagatgaagaattctgagt

SEQ ID NO: 435329 - DNA, 20 bp, Artificial Sequence
  chemically synthesized
ttttacagatgaagaattct

SEQ ID NO: 435330 - DNA, 20 bp, Artificial Sequence
  chemically synthesized
ttgttcccattttacagatg

SEQ ID NO: 435331 - DNA, 20 bp, Artificial Sequence
  chemically synthesized
agaattcttcatctgtaaaa

SEQ ID NO: 435332 - DNA, 20 bp, Artificial Sequence
  chemically synthesized
gaattcttcatctgtaaaat

SEQ ID NO: 435333 - DNA, 20 bp, Artificial Sequence
  chemically synthesized
ctattattgttcccatttta

SEQ ID NO: 435334 - DNA, 20 bp, Artificial Sequence
  chemically synthesized
ctgtaaaatgggaacaataa

SEQ ID NO: 435335 - DNA, 20 bp, Artificial Sequence
  chemically synthesized
gaacaataatagctctctca

SEQ ID NO: 435336 - DNA, 20 bp, Artificial Sequence
  chemically synthesized
aacaataatagctctctcac

SEQ ID NO: 435337 - DNA, 20 bp, Artificial Sequence
  chemically synthesized
cttaggacaagcctgtgaga

SEQ ID NO: 435338 - DNA, 20 bp, Artificial Sequence
  chemically synthesized
tacttaggacaagcctgtga

SEQ ID NO: 435339 - DNA, 20 bp, Artificial Sequence
  chemically synthesized
aatacttaggacaagcctgt

SEQ ID NO: 435340 - DNA, 20 bp, Artificial Sequence
  chemically synthesized
ctctctcacaggcttgtcct

SEQ ID NO: 435341 - DNA, 20 bp, Artificial Sequence
  chemically synthesized
tgtgagtaaatacttaggac

SEQ ID NO: 435342 - DNA, 20 bp, Artificial Sequence
  chemically synthesized
tattatgtgagtaaatactt

SEQ ID NO: 435343 - DNA, 20 bp, Artificial Sequence
  chemically synthesized
atattatgtgagtaaatact

SEQ ID NO: 435344 - DNA, 20 bp, Artificial Sequence
  chemically synthesized
gagctttgtgtatattatgt

SEQ ID NO: 435345 - DNA, 20 bp, Artificial Sequence
  chemically synthesized
ttactcacataatatacaca

SEQ ID NO: 435346 - DNA, 20 bp, Artificial Sequence
  chemically synthesized
tatacacaaagctcttatta

SEQ ID NO: 435347 - DNA, 20 bp, Artificial Sequence
  chemically synthesized
tgtgctacgtactgtaataa

SEQ ID NO: 435348 - DNA, 20 bp, Artificial Sequence
  chemically synthesized
tttgtgctacgtactgtaat

SEQ ID NO: 435349 - DNA, 20 bp, Artificial Sequence
  chemically synthesized
aaagctcttattacagtacg

SEQ ID NO: 435350 - DNA, 20 bp, Artificial Sequence
  chemically synthesized
ttattacagtacgtagcaca

SEQ ID NO: 435351 - DNA, 20 bp, Artificial Sequence
  chemically synthesized
tacagtacgtagcacaaagt

SEQ ID NO: 435352 - DNA, 20 bp, Artificial Sequence
  chemically synthesized
aatgacatatggcaaatttt

SEQ ID NO: 435353 - DNA, 20 bp, Artificial Sequence
  chemically synthesized
ccgcagctaataatgacata

SEQ ID NO: 435354 - DNA, 20 bp, Artificial Sequence
  chemically synthesized
aatttgccatatgtcattat

SEQ ID NO: 435355 - DNA, 20 bp, Artificial Sequence
  chemically synthesized
ccatatgtcattattagctg

SEQ ID NO: 435356 - DNA, 20 bp, Artificial Sequence
  chemically synthesized
atatgtcattattagctgcg

SEQ ID NO: 435357 - DNA, 20 bp, Artificial Sequence
  chemically synthesized
tggtcagtgcaatagctccg

SEQ ID NO: 435358 - DNA, 20 bp, Artificial Sequence
  chemically synthesized
caagcacttggtcagtgcaa

SEQ ID NO: 435359 - DNA, 20 bp, Artificial Sequence
  chemically synthesized
gcggagctattgcactgacc

SEQ ID NO: 435360 - DNA, 20 bp, Artificial Sequence
  chemically synthesized
tgttttttcaagcacttggt

SEQ ID NO: 435361 - DNA, 20 bp, Artificial Sequence
  chemically synthesized
gatttgttttttcaagcact

SEQ ID NO: 435362 - DNA, 20 bp, Artificial Sequence
  chemically synthesized
aggaaatgatttgttttttc

SEQ ID NO: 435363 - DNA, 20 bp, Artificial Sequence
  chemically synthesized
aaaaaacaaatcatttcctt

SEQ ID NO: 435364 - DNA, 20 bp, Artificial Sequence
  chemically synthesized
caaatcatttcctttggcgt

SEQ ID NO: 435365 - DNA, 20 bp, Artificial Sequence
  chemically synthesized
tgcattaacactcacgccaa

SEQ ID NO: 435366 - DNA, 20 bp, Artificial Sequence
  chemically synthesized
gtgcattaacactcacgcca

SEQ ID NO: 435367 - DNA, 20 bp, Artificial Sequence
  chemically synthesized
ttggcgtgagtgttaatgca

SEQ ID NO: 435368 - DNA, 20 bp, Artificial Sequence
  chemically synthesized
ggcgtgagtgttaatgcaca

SEQ ID NO: 435369 - DNA, 20 bp, Artificial Sequence
  chemically synthesized
gcgtgagtgttaatgcacag

SEQ ID NO: 435370 - DNA, 20 bp, Artificial Sequence
  chemically synthesized
ctttcacatagtatttttca

SEQ ID NO: 435371 - DNA, 20 bp, Artificial Sequence
  chemically synthesized
ctttgaaaaatactatgtga

SEQ ID NO: 435372 - DNA, 20 bp, Artificial Sequence
  chemically synthesized
tttttttaatgactttcaca

SEQ ID NO: 435373 - DNA, 20 bp, Artificial Sequence
  chemically synthesized
tatgtgaaagtcattaaaaa

SEQ ID NO: 435374 - DNA, 20 bp, Artificial Sequence
  chemically synthesized
attaaaaaaagaaaacctct

SEQ ID NO: 435375 - DNA, 20 bp, Artificial Sequence
  chemically synthesized
aaaaaaagaaaacctctcag

SEQ ID NO: 435376 - DNA, 20 bp, Artificial Sequence
  chemically synthesized
aaggaagctaatctgctgag

SEQ ID NO: 435377 - DNA, 20 bp, Artificial Sequence
  chemically synthesized
gaaggaagctaatctgctga

SEQ ID NO: 435378 - DNA, 20 bp, Artificial Sequence
  chemically synthesized
aagaaaacctctcagcagat

SEQ ID NO: 435379 - DNA, 20 bp, Artificial Sequence
  chemically synthesized
ttgaaggaagctaatctgct

SEQ ID NO: 435380 - DNA, 20 bp, Artificial Sequence
  chemically synthesized
gatcttacaaaggttgaagg

SEQ ID NO: 435381 - DNA, 20 bp, Artificial Sequence
  chemically synthesized
caggatcttacaaaggttga

SEQ ID NO: 435382 - DNA, 20 bp, Artificial Sequence
  chemically synthesized
gcaggatcttacaaaggttg

SEQ ID NO: 435383 - DNA, 20 bp, Artificial Sequence
  chemically synthesized
tagcttccttcaacctttgt

SEQ ID NO: 435384 - DNA, 20 bp, Artificial Sequence
  chemically synthesized
tcaaaagcaggatcttacaa

SEQ ID NO: 435385 - DNA, 20 bp, Artificial Sequence
  chemically synthesized
gtcaaaagcaggatcttaca

SEQ ID NO: 435386 - DNA, 20 bp, Artificial Sequence
  chemically synthesized
ctgggttggccgtcaaaagc

SEQ ID NO: 435387 - DNA, 20 bp, Artificial Sequence
  chemically synthesized
ttgtaagatcctgcttttga

SEQ ID NO: 435388 - DNA, 20 bp, Artificial Sequence
  chemically synthesized
actgggttggccgtcaaaag

SEQ ID NO: 435389 - DNA, 20 bp, Artificial Sequence
  chemically synthesized
agcactgggttggccgtcaa

SEQ ID NO: 435390 - DNA, 20 bp, Artificial Sequence
  chemically synthesized
cctgcttttgacggccaacc

SEQ ID NO: 435391 - DNA, 20 bp, Artificial Sequence
  chemically synthesized
aagtgtggaaagcactgggt

SEQ ID NO: 435392 - DNA, 20 bp, Artificial Sequence
  chemically synthesized
gagaaagtgtggaaagcact

SEQ ID NO: 435393 - DNA, 20 bp, Artificial Sequence
  chemically synthesized
tgagaaagtgtggaaagcac

SEQ ID NO: 435394 - DNA, 20 bp, Artificial Sequence
  chemically synthesized
aatgtgtgagaaagtgtgga

SEQ ID NO: 435395 - DNA, 20 bp, Artificial Sequence
  chemically synthesized
aggcaatgtgtgagaaagtg

SEQ ID NO: 435396 - DNA, 20 bp, Artificial Sequence
  chemically synthesized
ataacaggcaatgtgtgaga

SEQ ID NO: 435397 - DNA, 20 bp, Artificial Sequence
  chemically synthesized
agaaataacaggcaatgtgt

SEQ ID NO: 435398 - DNA, 20 bp, Artificial Sequence
  chemically synthesized
ttttcctgaccagaaataac

SEQ ID NO: 435399 - DNA, 20 bp, Artificial Sequence
  chemically synthesized
cacacattgcctgttatttc

SEQ ID NO: 435400 - DNA, 20 bp, Artificial Sequence
  chemically synthesized
attttcctgaccagaaataa

SEQ ID NO: 435401 - DNA, 20 bp, Artificial Sequence
  chemically synthesized
cattgcctgttatttctggt

SEQ ID NO: 435402 - DNA, 20 bp, Artificial Sequence
  chemically synthesized
attgcctgttatttctggtc

SEQ ID NO: 435403 - DNA, 20 bp, Artificial Sequence
  chemically synthesized
tatttatttattttcctgac

SEQ ID NO: 435404 - DNA, 20 bp, Artificial Sequence
  chemically synthesized
ggtcaggaaaataaataaat

SEQ ID NO: 435405 - DNA, 20 bp, Artificial Sequence
  chemically synthesized
taaataaataagtgcccatc

SEQ ID NO: 435406 - DNA, 20 bp, Artificial Sequence
  chemically synthesized
ggaaaaatacttggccagat

SEQ ID NO: 435407 - DNA, 20 bp, Artificial Sequence
  chemically synthesized
aaataagtgcccatctggcc

SEQ ID NO: 435408 - DNA, 20 bp, Artificial Sequence
  chemically synthesized
tggaaaaatacttggccaga

SEQ ID NO: 435409 - DNA, 20 bp, Artificial Sequence
  chemically synthesized
aaggtggaaaaatacttggc

SEQ ID NO: 435410 - DNA, 20 bp, Artificial Sequence
  chemically synthesized
tataaaggtggaaaaatact

SEQ ID NO: 435411 - DNA, 20 bp, Artificial Sequence
  chemically synthesized
atttctggttcatataaagg

SEQ ID NO: 435412 - DNA, 20 bp, Artificial Sequence
  chemically synthesized
ggtatttctggttcatataa

SEQ ID NO: 435413 - DNA, 20 bp, Artificial Sequence
  chemically synthesized
tggtatttctggttcatata

SEQ ID NO: 435414 - DNA, 20 bp, Artificial Sequence
  chemically synthesized
ttttccacctttatatgaac

SEQ ID NO: 435415 - DNA, 20 bp, Artificial Sequence
  chemically synthesized
ttagaaacaattggtatttc

SEQ ID NO: 435416 - DNA, 20 bp, Artificial Sequence
  chemically synthesized
gaatacacattagaaacaat

SEQ ID NO: 435417 - DNA, 20 bp, Artificial Sequence
  chemically synthesized
tgcatctggggaatacacat

SEQ ID NO: 435418 - DNA, 20 bp, Artificial Sequence
  chemically synthesized
tgtttctaatgtgtattccc

SEQ ID NO: 435419 - DNA, 20 bp, Artificial Sequence
  chemically synthesized
gaggataagtattgcatctg

SEQ ID NO: 435420 - DNA, 20 bp, Artificial Sequence
  chemically synthesized
agaggataagtattgcatct

SEQ ID NO: 435421 - DNA, 20 bp, Artificial Sequence
  chemically synthesized
tagaggataagtattgcatc

SEQ ID NO: 435422 - DNA, 20 bp, Artificial Sequence
  chemically synthesized
cttagctgtaaatagaggat

SEQ ID NO: 435423 - DNA, 20 bp, Artificial Sequence
  chemically synthesized
caatacttatcctctattta

SEQ ID NO: 435424 - DNA, 20 bp, Artificial Sequence
  chemically synthesized
agtggcttagctgtaaatag

SEQ ID NO: 435425 - DNA, 20 bp, Artificial Sequence
  chemically synthesized
cagtggcttagctgtaaata

SEQ ID NO: 435426 - DNA, 20 bp, Artificial Sequence
  chemically synthesized
atcagtggcttagctgtaaa

SEQ ID NO: 435427 - DNA, 20 bp, Artificial Sequence
  chemically synthesized
cttatcctctatttacagct

SEQ ID NO: 435428 - DNA, 20 bp, Artificial Sequence
  chemically synthesized
ttccacagtaatcagtggct

SEQ ID NO: 435429 - DNA, 20 bp, Artificial Sequence
  chemically synthesized
atattttccacagtaatcag

SEQ ID NO: 435430 - DNA, 20 bp, Artificial Sequence
  chemically synthesized
agctaagccactgattactg

SEQ ID NO: 435431 - DNA, 20 bp, Artificial Sequence
  chemically synthesized
acaatattttccacagtaat

SEQ ID NO: 435432 - DNA, 20 bp, Artificial Sequence
  chemically synthesized
tttgctgacaatattttcca

SEQ ID NO: 435433 - DNA, 20 bp, Artificial Sequence
  chemically synthesized
attactgtggaaaatattgt

SEQ ID NO: 435434 - DNA, 20 bp, Artificial Sequence
  chemically synthesized
cagcaatacattttggggta

SEQ ID NO: 435435 - DNA, 20 bp, Artificial Sequence
  chemically synthesized
tttcacagcaatacattttg

SEQ ID NO: 435436 - DNA, 20 bp, Artificial Sequence
  chemically synthesized
ctttcacagcaatacatttt

SEQ ID NO: 435437 - DNA, 20 bp, Artificial Sequence
  chemically synthesized
cctttcacagcaatacattt

SEQ ID NO: 435438 - DNA, 20 bp, Artificial Sequence
  chemically synthesized
cccaaaatgtattgctgtga

SEQ ID NO: 435439 - DNA, 20 bp, Artificial Sequence
  chemically synthesized
ccaaaatgtattgctgtgaa

SEQ ID NO: 435440 - DNA, 20 bp, Artificial Sequence
  chemically synthesized
caaaatgtattgctgtgaaa

SEQ ID NO: 435441 - DNA, 20 bp, Artificial Sequence
  chemically synthesized
aaaatgtattgctgtgaaag

SEQ ID NO: 435442 - DNA, 20 bp, Artificial Sequence
  chemically synthesized
aatatttttttcccctttca

SEQ ID NO: 435443 - DNA, 20 bp, Artificial Sequence
  chemically synthesized
gctgttatcgattcggttta

SEQ ID NO: 435444 - DNA, 20 bp, Artificial Sequence
  chemically synthesized
tgctgttatcgattcggttt

SEQ ID NO: 435445 - DNA, 20 bp, Artificial Sequence
  chemically synthesized
gtgctgttatcgattcggtt

SEQ ID NO: 435446 - DNA, 20 bp, Artificial Sequence
  chemically synthesized
catgagtgctgttatcgatt

SEQ ID NO: 435447 - DNA, 20 bp, Artificial Sequence
  chemically synthesized
accctaaaccgaatcgataa

SEQ ID NO: 435448 - DNA, 20 bp, Artificial Sequence
  chemically synthesized
cgataacagcactcatgtct

SEQ ID NO: 435449 - DNA, 20 bp, Artificial Sequence
  chemically synthesized
tgtaaatctatccaagacat

SEQ ID NO: 435450 - DNA, 20 bp, Artificial Sequence
  chemically synthesized
aacagcactcatgtcttgga

SEQ ID NO: 435451 - DNA, 20 bp, Artificial Sequence
  chemically synthesized
ctctttctgtaaatctatcc

SEQ ID NO: 435452 - DNA, 20 bp, Artificial Sequence
  chemically synthesized
tcatgtcttggatagattta

SEQ ID NO: 435453 - DNA, 20 bp, Artificial Sequence
  chemically synthesized
gtcttggatagatttacaga

SEQ ID NO: 435454 - DNA, 20 bp, Artificial Sequence
  chemically synthesized
cttggatagatttacagaaa

SEQ ID NO: 435455 - DNA, 20 bp, Artificial Sequence
  chemically synthesized
ggatagatttacagaaagag

SEQ ID NO: 435456 - DNA, 20 bp, Artificial Sequence
  chemically synthesized
gatagatttacagaaagaga

SEQ ID NO: 435457 - DNA, 20 bp, Artificial Sequence
  chemically synthesized
catctcttagcaaataaaaa

SEQ ID NO: 435458 - DNA, 20 bp, Artificial Sequence
  chemically synthesized
cgtcgctatttttatttgct

SEQ ID NO: 435459 - DNA, 20 bp, Artificial Sequence
  chemically synthesized
tcgctatttttatttgctaa

SEQ ID NO: 435460 - DNA, 20 bp, Artificial Sequence
  chemically synthesized
taaaaaaaggcaacatctct

SEQ ID NO: 435461 - DNA, 20 bp, Artificial Sequence
  chemically synthesized
aaatattttaatataaaaaa

SEQ ID NO: 435462 - DNA, 20 bp, Artificial Sequence
  chemically synthesized
taaatattttaatataaaaa

SEQ ID NO: 435463 - DNA, 20 bp, Artificial Sequence
  chemically synthesized
tttttatattaaaatattta

SEQ ID NO: 435464 - DNA, 20 bp, Artificial Sequence
  chemically synthesized
aagaaacagatcaatcagag

SEQ ID NO: 435465 - DNA, 20 bp, Artificial Sequence
  chemically synthesized
caaaagaaacagatcaatca

SEQ ID NO: 435466 - DNA, 20 bp, Artificial Sequence
  chemically synthesized
ctcaaaagaaacagatcaat

SEQ ID NO: 435467 - DNA, 20 bp, Artificial Sequence
  chemically synthesized
agattatgtctcaaaagaaa

SEQ ID NO: 435468 - DNA, 20 bp, Artificial Sequence
  chemically synthesized
ctgattgatctgtttctttt

SEQ ID NO: 435469 - DNA, 20 bp, Artificial Sequence
  chemically synthesized
agagcaagattatgtctcaa

SEQ ID NO: 435470 - DNA, 20 bp, Artificial Sequence
  chemically synthesized
tccaacttgggcaacagagc

SEQ ID NO: 435471 - DNA, 20 bp, Artificial Sequence
  chemically synthesized
gcattccaacttgggcaaca

SEQ ID NO: 435472 - DNA, 20 bp, Artificial Sequence
  chemically synthesized
ataatcttgctctgttgccc

SEQ ID NO: 435473 - DNA, 20 bp, Artificial Sequence
  chemically synthesized
ttgcattccaacttgggcaa

SEQ ID NO: 435474 - DNA, 20 bp, Artificial Sequence
  chemically synthesized
tcttgctctgttgcccaagt

SEQ ID NO: 435475 - DNA, 20 bp, Artificial Sequence
  chemically synthesized
tcaccattgcattccaactt

SEQ ID NO: 435476 - DNA, 20 bp, Artificial Sequence
  chemically synthesized
ctcaccattgcattccaact

SEQ ID NO: 435477 - DNA, 20 bp, Artificial Sequence
  chemically synthesized
ttgcccaagttggaatgcaa

SEQ ID NO: 435478 - DNA, 20 bp, Artificial Sequence
  chemically synthesized
ccaagttggaatgcaatggt

SEQ ID NO: 435479 - DNA, 20 bp, Artificial Sequence
  chemically synthesized
ggtgagatcatgactcactg

SEQ ID NO: 435480 - DNA, 20 bp, Artificial Sequence
  chemically synthesized
taggaggtcaaggctacagt

SEQ ID NO: 435481 - DNA, 20 bp, Artificial Sequence
  chemically synthesized
agcctaggaggtcaaggcta

SEQ ID NO: 435482 - DNA, 20 bp, Artificial Sequence
  chemically synthesized
cactggagcctaggaggtca

SEQ ID NO: 435483 - DNA, 20 bp, Artificial Sequence
  chemically synthesized
tcactgtagccttgacctcc

SEQ ID NO: 435484 - DNA, 20 bp, Artificial Sequence
  chemically synthesized
tcactggagcctaggaggtc

SEQ ID NO: 435485 - DNA, 20 bp, Artificial Sequence
  chemically synthesized
cactgtagccttgacctcct

SEQ ID NO: 435486 - DNA, 20 bp, Artificial Sequence
  chemically synthesized
gaggatcactggagcctagg

SEQ ID NO: 435487 - DNA, 20 bp, Artificial Sequence
  chemically synthesized
ggaggatcactggagcctag

SEQ ID NO: 435488 - DNA, 20 bp, Artificial Sequence
  chemically synthesized
agccttgacctcctaggctc

SEQ ID NO: 435489 - DNA, 20 bp, Artificial Sequence
  chemically synthesized
caggaggatcactggagcct

SEQ ID NO: 435490 - DNA, 20 bp, Artificial Sequence
  chemically synthesized
gcaggaggatcactggagcc

SEQ ID NO: 435491 - DNA, 20 bp, Artificial Sequence
  chemically synthesized
ctgaggcaggaggatcactg

SEQ ID NO: 435492 - DNA, 20 bp, Artificial Sequence
  chemically synthesized
ggctgaggcaggaggatcac

SEQ ID NO: 435493 - DNA, 20 bp, Artificial Sequence
  chemically synthesized
ctccagtgatcctcctgcct

SEQ ID NO: 435494 - DNA, 20 bp, Artificial Sequence
  chemically synthesized
actcaggaggctgaggcagg

SEQ ID NO: 435495 - DNA, 20 bp, Artificial Sequence
  chemically synthesized
tactcaggaggctgaggcag

SEQ ID NO: 435496 - DNA, 20 bp, Artificial Sequence
  chemically synthesized
cctactcaggaggctgaggc

SEQ ID NO: 435497 - DNA, 20 bp, Artificial Sequence
  chemically synthesized
acctactcaggaggctgagg

SEQ ID NO: 435498 - DNA, 20 bp, Artificial Sequence
  chemically synthesized
cccacctactcaggaggctg

SEQ ID NO: 435499 - DNA, 20 bp, Artificial Sequence
  chemically synthesized
tcccacctactcaggaggct

SEQ ID NO: 435500 - DNA, 20 bp, Artificial Sequence
  chemically synthesized
tcctcctgcctcagcctcct

SEQ ID NO: 435501 - DNA, 20 bp, Artificial Sequence
  chemically synthesized
tcctgcctcagcctcctgag

SEQ ID NO: 435502 - DNA, 20 bp, Artificial Sequence
  chemically synthesized
cctgcctcagcctcctgagt

SEQ ID NO: 435503 - DNA, 20 bp, Artificial Sequence
  chemically synthesized
tatagtcccacctactcagg

SEQ ID NO: 435504 - DNA, 20 bp, Artificial Sequence
  chemically synthesized
ctatagtcccacctactcag

SEQ ID NO: 435505 - DNA, 20 bp, Artificial Sequence
  chemically synthesized
gcctcagcctcctgagtagg

SEQ ID NO: 435506 - DNA, 20 bp, Artificial Sequence
  chemically synthesized
gcctatagtcccacctactc

SEQ ID NO: 435507 - DNA, 20 bp, Artificial Sequence
  chemically synthesized
cctcagcctcctgagtaggt

SEQ ID NO: 435508 - DNA, 20 bp, Artificial Sequence
  chemically synthesized
cgcctatagtcccacctact

SEQ ID NO: 435509 - DNA, 20 bp, Artificial Sequence
  chemically synthesized
ctcctgagtaggtgggacta

SEQ ID NO: 435510 - DNA, 20 bp, Artificial Sequence
  chemically synthesized
tcctgagtaggtgggactat

SEQ ID NO: 435511 - DNA, 20 bp, Artificial Sequence
  chemically synthesized
gcatagtgacaacacgccta

SEQ ID NO: 435512 - DNA, 20 bp, Artificial Sequence
  chemically synthesized
aggcgtgttgtcactatgcc

SEQ ID NO: 435513 - DNA, 20 bp, Artificial Sequence
  chemically synthesized
gaaaagaaatgagccaggca

SEQ ID NO: 435514 - DNA, 20 bp, Artificial Sequence
  chemically synthesized
aaaatgaaaagaaatgagcc

SEQ ID NO: 435515 - DNA, 20 bp, Artificial Sequence
  chemically synthesized
aaaaatgaaaagaaatgagc

SEQ ID NO: 435516 - DNA, 20 bp, Artificial Sequence
  chemically synthesized
aaaaaaaaatgaaaagaaat

SEQ ID NO: 435517 - DNA, 20 bp, Artificial Sequence
  chemically synthesized
ctctacaaaaaaaaaatgaa

SEQ ID NO: 435518 - DNA, 20 bp, Artificial Sequence
  chemically synthesized
ttcttttcattttttttttg

SEQ ID NO: 435519 - DNA, 20 bp, Artificial Sequence
  chemically synthesized
cttttcattttttttttgta

SEQ ID NO: 435520 - DNA, 20 bp, Artificial Sequence
  chemically synthesized
cattttttttttgtagagat

SEQ ID NO: 435521 - DNA, 20 bp, Artificial Sequence
  chemically synthesized
attttttttttgtagagatg

SEQ ID NO: 435522 - DNA, 20 bp, Artificial Sequence
  chemically synthesized
accaccctggacaacagagt

SEQ ID NO: 435523 - DNA, 20 bp, Artificial Sequence
  chemically synthesized
tgaggtctcactctgttgtc

SEQ ID NO: 435524 - DNA, 20 bp, Artificial Sequence
  chemically synthesized
caagaccaccctggacaaca

SEQ ID NO: 435525 - DNA, 20 bp, Artificial Sequence
  chemically synthesized
gaggtctcactctgttgtcc

SEQ ID NO: 435526 - DNA, 20 bp, Artificial Sequence
  chemically synthesized
aggtctcactctgttgtcca

SEQ ID NO: 435527 - DNA, 20 bp, Artificial Sequence
  chemically synthesized
ttcaagaccaccctggacaa

SEQ ID NO: 435528 - DNA, 20 bp, Artificial Sequence
  chemically synthesized
tctcactctgttgtccaggg

SEQ ID NO: 435529 - DNA, 20 bp, Artificial Sequence
  chemically synthesized
ccaggagttcaagaccaccc

SEQ ID NO: 435530 - DNA, 20 bp, Artificial Sequence
  chemically synthesized
ccagggtggtcttgaactcc

SEQ ID NO: 435531 - DNA, 20 bp, Artificial Sequence
  chemically synthesized
tcccttgagcccaggagttc

SEQ ID NO: 435532 - DNA, 20 bp, Artificial Sequence
  chemically synthesized
cagggtggtcttgaactcct

SEQ ID NO: 435533 - DNA, 20 bp, Artificial Sequence
  chemically synthesized
agaggatcccttgagcccag

SEQ ID NO: 435534 - DNA, 20 bp, Artificial Sequence
  chemically synthesized
ggtcttgaactcctgggctc

SEQ ID NO: 435535 - DNA, 20 bp, Artificial Sequence
  chemically synthesized
gtcttgaactcctgggctca

SEQ ID NO: 435536 - DNA, 20 bp, Artificial Sequence
  chemically synthesized
agagaggatcccttgagccc

SEQ ID NO: 435537 - DNA, 20 bp, Artificial Sequence
  chemically synthesized
tcttgaactcctgggctcaa

SEQ ID NO: 435538 - DNA, 20 bp, Artificial Sequence
  chemically synthesized
gagagaggatcccttgagcc

SEQ ID NO: 435539 - DNA, 20 bp, Artificial Sequence
  chemically synthesized
aaggagagagaggatccctt

SEQ ID NO: 435540 - DNA, 20 bp, Artificial Sequence
  chemically synthesized
ttgggaggccaaggagagag

SEQ ID NO: 435541 - DNA, 20 bp, Artificial Sequence
  chemically synthesized
tttgggaggccaaggagaga

SEQ ID NO: 435542 - DNA, 20 bp, Artificial Sequence
  chemically synthesized
caagggatcctctctctcct

SEQ ID NO: 435543 - DNA, 20 bp, Artificial Sequence
  chemically synthesized
actttgggaggccaaggaga

SEQ ID NO: 435544 - DNA, 20 bp, Artificial Sequence
  chemically synthesized
gtactttgggaggccaagga

SEQ ID NO: 435545 - DNA, 20 bp, Artificial Sequence
  chemically synthesized
cagtactttgggaggccaag

SEQ ID NO: 435546 - DNA, 20 bp, Artificial Sequence
  chemically synthesized
gccagtactttgggaggcca

SEQ ID NO: 435547 - DNA, 20 bp, Artificial Sequence
  chemically synthesized
tgccagtactttgggaggcc

SEQ ID NO: 435548 - DNA, 20 bp, Artificial Sequence
  chemically synthesized
tctctctccttggcctccca

SEQ ID NO: 435549 - DNA, 20 bp, Artificial Sequence
  chemically synthesized
tataatgccagtactttggg

SEQ ID NO: 435550 - DNA, 20 bp, Artificial Sequence
  chemically synthesized
ctataatgccagtactttgg

SEQ ID NO: 435551 - DNA, 20 bp, Artificial Sequence
  chemically synthesized
tccttggcctcccaaagtac

SEQ ID NO: 435552 - DNA, 20 bp, Artificial Sequence
  chemically synthesized
gcctataatgccagtacttt

SEQ ID NO: 435553 - DNA, 20 bp, Artificial Sequence
  chemically synthesized
tgcctataatgccagtactt

SEQ ID NO: 435554 - DNA, 20 bp, Artificial Sequence
  chemically synthesized
ctcccaaagtactggcatta

SEQ ID NO: 435555 - DNA, 20 bp, Artificial Sequence
  chemically synthesized
tcccaaagtactggcattat

SEQ ID NO: 435556 - DNA, 20 bp, Artificial Sequence
  chemically synthesized
gtggctcatgcctataatgc

SEQ ID NO: 435557 - DNA, 20 bp, Artificial Sequence
  chemically synthesized
agtactggcattataggcat

SEQ ID NO: 435558 - DNA, 20 bp, Artificial Sequence
  chemically synthesized
taggcatgagccaccacacc

SEQ ID NO: 435559 - DNA, 20 bp, Artificial Sequence
  chemically synthesized
atcagagtggctgggtgtgg

SEQ ID NO: 435560 - DNA, 20 bp, Artificial Sequence
  chemically synthesized
gaaatcagagtggctgggtg

SEQ ID NO: 435561 - DNA, 20 bp, Artificial Sequence
  chemically synthesized
actcagaaatcagagtggct

SEQ ID NO: 435562 - DNA, 20 bp, Artificial Sequence
  chemically synthesized
gactcagaaatcagagtggc

SEQ ID NO: 435563 - DNA, 20 bp, Artificial Sequence
  chemically synthesized
ttaagactcagaaatcagag

SEQ ID NO: 435564 - DNA, 20 bp, Artificial Sequence
  chemically synthesized
tgattaagactcagaaatca

SEQ ID NO: 435565 - DNA, 20 bp, Artificial Sequence
  chemically synthesized
acccagccactctgatttct

SEQ ID NO: 435566 - DNA, 20 bp, Artificial Sequence
  chemically synthesized
tttgattaagactcagaaat

SEQ ID NO: 435567 - DNA, 20 bp, Artificial Sequence
  chemically synthesized
ttgctactttgattaagact

SEQ ID NO: 435568 - DNA, 20 bp, Artificial Sequence
  chemically synthesized
tgatttctgagtcttaatca

SEQ ID NO: 435569 - DNA, 20 bp, Artificial Sequence
  chemically synthesized
ataagtttgctactttgatt

SEQ ID NO: 435570 - DNA, 20 bp, Artificial Sequence
  chemically synthesized
tttctgagtcttaatcaaag

SEQ ID NO: 435571 - DNA, 20 bp, Artificial Sequence
  chemically synthesized
atcaaagtagcaaacttata

SEQ ID NO: 435572 - DNA, 20 bp, Artificial Sequence
  chemically synthesized
aaagtagcaaacttataaag

SEQ ID NO: 435573 - DNA, 20 bp, Artificial Sequence
  chemically synthesized
tgatgaaatcactactttat

SEQ ID NO: 435574 - DNA, 20 bp, Artificial Sequence
  chemically synthesized
tcctttttctttgttaatat

SEQ ID NO: 435575 - DNA, 20 bp, Artificial Sequence
  chemically synthesized
atcacatgccaatattaaca

SEQ ID NO: 435576 - DNA, 20 bp, Artificial Sequence
  chemically synthesized
tgccaatattaacaaagaaa

SEQ ID NO: 435577 - DNA, 20 bp, Artificial Sequence
  chemically synthesized
gccaatattaacaaagaaaa

SEQ ID NO: 435578 - DNA, 20 bp, Artificial Sequence
  chemically synthesized
aatattaacaaagaaaaagg

SEQ ID NO: 435579 - DNA, 20 bp, Artificial Sequence
  chemically synthesized
tattaacaaagaaaaaggaa

SEQ ID NO: 435580 - DNA, 20 bp, Artificial Sequence
  chemically synthesized
taacaaagaaaaaggaagag

SEQ ID NO: 435581 - DNA, 20 bp, Artificial Sequence
  chemically synthesized
attttacagtatcagttatg

SEQ ID NO: 435582 - DNA, 20 bp, Artificial Sequence
  chemically synthesized
atattttacagtatcagtta

SEQ ID NO: 435583 - DNA, 20 bp, Artificial Sequence
  chemically synthesized
agaaaaatattttacagtat

SEQ ID NO: 435584 - DNA, 20 bp, Artificial Sequence
  chemically synthesized
caaattagaaaaatatttta

SEQ ID NO: 435585 - DNA, 20 bp, Artificial Sequence
  chemically synthesized
actgatatctttatgcaaat

SEQ ID NO: 435586 - DNA, 20 bp, Artificial Sequence
  chemically synthesized
atatttttctaatttgcata

SEQ ID NO: 435587 - DNA, 20 bp, Artificial Sequence
  chemically synthesized
tctaatttgcataaagatat

SEQ ID NO: 435588 - DNA, 20 bp, Artificial Sequence
  chemically synthesized
taaagatatcagttctaccc

SEQ ID NO: 435589 - DNA, 20 bp, Artificial Sequence
  chemically synthesized
atcttgtaaatatactaggg

SEQ ID NO: 435590 - DNA, 20 bp, Artificial Sequence
  chemically synthesized
catatcttgtaaatatacta

SEQ ID NO: 435591 - DNA, 20 bp, Artificial Sequence
  chemically synthesized
tcatatcttgtaaatatact

SEQ ID NO: 435592 - DNA, 20 bp, Artificial Sequence
  chemically synthesized
gtcatatcttgtaaatatac

SEQ ID NO: 435593 - DNA, 20 bp, Artificial Sequence
  chemically synthesized
ttctaccctagtatatttac

SEQ ID NO: 435594 - DNA, 20 bp, Artificial Sequence
  chemically synthesized
atgaattaaaatgtaaatgt

SEQ ID NO: 435595 - DNA, 20 bp, Artificial Sequence
  chemically synthesized
tacattttaattcatataac

SEQ ID NO: 435596 - DNA, 20 bp, Artificial Sequence
  chemically synthesized
aattcatataaccagtttgt

SEQ ID NO: 435597 - DNA, 20 bp, Artificial Sequence
  chemically synthesized
ggattccttctcttacaaac

SEQ ID NO: 435598 - DNA, 20 bp, Artificial Sequence
  chemically synthesized
ttcatataaccagtttgtaa

SEQ ID NO: 435599 - DNA, 20 bp, Artificial Sequence
  chemically synthesized
atataaccagtttgtaagag

SEQ ID NO: 435600 - DNA, 20 bp, Artificial Sequence
  chemically synthesized
tataaccagtttgtaagaga

SEQ ID NO: 435601 - DNA, 20 bp, Artificial Sequence
  chemically synthesized
gtaagagaaggaatcctatc

SEQ ID NO: 435602 - DNA, 20 bp, Artificial Sequence
  chemically synthesized
taagagaaggaatcctatca

SEQ ID NO: 435603 - DNA, 20 bp, Artificial Sequence
  chemically synthesized
gtaggcttattttccttgat

SEQ ID NO: 435604 - DNA, 20 bp, Artificial Sequence
  chemically synthesized
tgtaggcttattttccttga

SEQ ID NO: 435605 - DNA, 20 bp, Artificial Sequence
  chemically synthesized
ggaatcctatcaaggaaaat

SEQ ID NO: 435606 - DNA, 20 bp, Artificial Sequence
  chemically synthesized
tatcaaggaaaataagccta

SEQ ID NO: 435607 - DNA, 20 bp, Artificial Sequence
  chemically synthesized
acaaaaagttagttttctgt

SEQ ID NO: 435608 - DNA, 20 bp, Artificial Sequence
  chemically synthesized
cacaaaaagttagttttctg

SEQ ID NO: 435609 - DNA, 20 bp, Artificial Sequence
  chemically synthesized
atcattttatcacaaaaagt

SEQ ID NO: 435610 - DNA, 20 bp, Artificial Sequence
  chemically synthesized
taaaatcattttatcacaaa

SEQ ID NO: 435611 - DNA, 20 bp, Artificial Sequence
  chemically synthesized
tgtgataaaatgattttata

SEQ ID NO: 435612 - DNA, 20 bp, Artificial Sequence
  chemically synthesized
gattttataaagctgacaat

SEQ ID NO: 435613 - DNA, 20 bp, Artificial Sequence
  chemically synthesized
cttctttaaatgcttattgt

SEQ ID NO: 435614 - DNA, 20 bp, Artificial Sequence
  chemically synthesized
aagctgacaataagcattta

SEQ ID NO: 435615 - DNA, 20 bp, Artificial Sequence
  chemically synthesized
ctgacaataagcatttaaag

SEQ ID NO: 435616 - DNA, 20 bp, Artificial Sequence
  chemically synthesized
ataagcatttaaagaagtac

SEQ ID NO: 435617 - DNA, 20 bp, Artificial Sequence
  chemically synthesized
tgtgttaaaggttcatgttc

SEQ ID NO: 435618 - DNA, 20 bp, Artificial Sequence
  chemically synthesized
gtagattggatatgtgttaa

SEQ ID NO: 435619 - DNA, 20 bp, Artificial Sequence
  chemically synthesized
agtagattggatatgtgtta

SEQ ID NO: 435620 - DNA, 20 bp, Artificial Sequence
  chemically synthesized
ttttttctaaaacagtagat

SEQ ID NO: 435621 - DNA, 20 bp, Artificial Sequence
  chemically synthesized
acatatccaatctactgttt

SEQ ID NO: 435622 - DNA, 20 bp, Artificial Sequence
  chemically synthesized
cttaattttttctaaaacag

SEQ ID NO: 435623 - DNA, 20 bp, Artificial Sequence
  chemically synthesized
attcttaattttttctaaaa

SEQ ID NO: 435624 - DNA, 20 bp, Artificial Sequence
  chemically synthesized
ctactgttttagaaaaaatt

SEQ ID NO: 435625 - DNA, 20 bp, Artificial Sequence
  chemically synthesized
ttttagaaaaaattaagaat

SEQ ID NO: 435626 - DNA, 20 bp, Artificial Sequence
  chemically synthesized
ttgcgttgcatacatttttg

SEQ ID NO: 435627 - DNA, 20 bp, Artificial Sequence
  chemically synthesized
aatgtatgcaacgcaaattc

SEQ ID NO: 435628 - DNA, 20 bp, Artificial Sequence
  chemically synthesized
gcaacgcaaattctagttta

SEQ ID NO: 435629 - DNA, 20 bp, Artificial Sequence
  chemically synthesized
caggatattccgctttaaac

SEQ ID NO: 435630 - DNA, 20 bp, Artificial Sequence
  chemically synthesized
acgcaaattctagtttaaag

SEQ ID NO: 435631 - DNA, 20 bp, Artificial Sequence
  chemically synthesized
ctccatatttattagattac

SEQ ID NO: 435632 - DNA, 20 bp, Artificial Sequence
  chemically synthesized
tctccatatttattagatta

SEQ ID NO: 435633 - DNA, 20 bp, Artificial Sequence
  chemically synthesized
atcctgtaatctaataaata

SEQ ID NO: 435634 - DNA, 20 bp, Artificial Sequence
  chemically synthesized
aaaatcatctccatatttat

SEQ ID NO: 435635 - DNA, 20 bp, Artificial Sequence
  chemically synthesized
cctgtaatctaataaatatg

SEQ ID NO: 435636 - DNA, 20 bp, Artificial Sequence
  chemically synthesized
aatatggagatgatttttta

SEQ ID NO: 435637 - DNA, 20 bp, Artificial Sequence
  chemically synthesized
gattttttatagtgatgtaa

SEQ ID NO: 435638 - DNA, 20 bp, Artificial Sequence
  chemically synthesized
attttttatagtgatgtaat

SEQ ID NO: 435639 - DNA, 20 bp, Artificial Sequence
  chemically synthesized
tttatagtgatgtaatgggc

SEQ ID NO: 435640 - DNA, 20 bp, Artificial Sequence
  chemically synthesized
ataagtctaaaggtacaatc

SEQ ID NO: 435641 - DNA, 20 bp, Artificial Sequence
  chemically synthesized
aatgggctagattgtacctt

SEQ ID NO: 435642 - DNA, 20 bp, Artificial Sequence
  chemically synthesized
ttttattcccataagtctaa

SEQ ID NO: 435643 - DNA, 20 bp, Artificial Sequence
  chemically synthesized
tttttattcccataagtcta

SEQ ID NO: 435644 - DNA, 20 bp, Artificial Sequence
  chemically synthesized
agattgtacctttagactta

SEQ ID NO: 435645 - DNA, 20 bp, Artificial Sequence
  chemically synthesized
gattgtacctttagacttat

SEQ ID NO: 435646 - DNA, 20 bp, Artificial Sequence
  chemically synthesized
aataatatttttattcccat

SEQ ID NO: 435647 - DNA, 20 bp, Artificial Sequence
  chemically synthesized
tttaaaatagttttgaaatt

SEQ ID NO: 435648 - DNA, 20 bp, Artificial Sequence
  chemically synthesized
atttaaaatagttttgaaat

SEQ ID NO: 435649 - DNA, 20 bp, Artificial Sequence
  chemically synthesized
agaatttaaaagatttaaaa

SEQ ID NO: 435650 - DNA, 20 bp, Artificial Sequence
  chemically synthesized
tttaatttagtagaatttaa

SEQ ID NO: 435651 - DNA, 20 bp, Artificial Sequence
  chemically synthesized
tattttcttatttaatttag

SEQ ID NO: 435652 - DNA, 20 bp, Artificial Sequence
  chemically synthesized
ttttattttcttatttaatt

SEQ ID NO: 435653 - DNA, 20 bp, Artificial Sequence
  chemically synthesized
taaattctactaaattaaat

SEQ ID NO: 435654 - DNA, 20 bp, Artificial Sequence
  chemically synthesized
taaataagaaaataaaattt

SEQ ID NO: 435655 - DNA, 20 bp, Artificial Sequence
  chemically synthesized
taagaaaataaaatttgagt

SEQ ID NO: 435656 - DNA, 20 bp, Artificial Sequence
  chemically synthesized
atttgagttagccactcaaa

SEQ ID NO: 435657 - DNA, 20 bp, Artificial Sequence
  chemically synthesized
tttgagttagccactcaaac

SEQ ID NO: 435658 - DNA, 20 bp, Artificial Sequence
  chemically synthesized
taacaaatctcctgtttgag

SEQ ID NO: 435659 - DNA, 20 bp, Artificial Sequence
  chemically synthesized
tgagttagccactcaaacag

SEQ ID NO: 435660 - DNA, 20 bp, Artificial Sequence
  chemically synthesized
gaataacaaatctcctgttt

SEQ ID NO: 435661 - DNA, 20 bp, Artificial Sequence
  chemically synthesized
aaaggcaattgtttttaaat

SEQ ID NO: 435662 - DNA, 20 bp, Artificial Sequence
  chemically synthesized
gatttaaaaacaattgcctt

SEQ ID NO: 435663 - DNA, 20 bp, Artificial Sequence
  chemically synthesized
ttgagagtgattgttaccaa

SEQ ID NO: 435664 - DNA, 20 bp, Artificial Sequence
  chemically synthesized
tttgagagtgattgttacca

SEQ ID NO: 435665 - DNA, 20 bp, Artificial Sequence
  chemically synthesized
tggtaacaatcactctcaaa

SEQ ID NO: 435666 - DNA, 20 bp, Artificial Sequence
  chemically synthesized
atttttctcgaactgtttga

SEQ ID NO: 435667 - DNA, 20 bp, Artificial Sequence
  chemically synthesized
atatttttctcgaactgttt

SEQ ID NO: 435668 - DNA, 20 bp, Artificial Sequence
  chemically synthesized
caatcactctcaaacagttc

SEQ ID NO: 435669 - DNA, 20 bp, Artificial Sequence
  chemically synthesized
tatatgtatgtatatattca

SEQ ID NO: 435670 - DNA, 20 bp, Artificial Sequence
  chemically synthesized
atatgtatgtatatattcat

SEQ ID NO: 435671 - DNA, 20 bp, Artificial Sequence
  chemically synthesized
gtatgtatatattcatgggc

SEQ ID NO: 435672 - DNA, 20 bp, Artificial Sequence
  chemically synthesized
tatgtatatattcatgggca

SEQ ID NO: 435673 - DNA, 20 bp, Artificial Sequence
  chemically synthesized
tgtatatattcatgggcaag

SEQ ID NO: 435674 - DNA, 20 bp, Artificial Sequence
  chemically synthesized
atatattcatgggcaaggag

SEQ ID NO: 435675 - DNA, 20 bp, Artificial Sequence
  chemically synthesized
tatattcatgggcaaggaga

SEQ ID NO: 435676 - DNA, 20 bp, Artificial Sequence
  chemically synthesized
catgggcaaggagaaggatt

SEQ ID NO: 435677 - DNA, 20 bp, Artificial Sequence
  chemically synthesized
gcaaggagaaggatttagaa

SEQ ID NO: 435678 - DNA, 20 bp, Artificial Sequence
  chemically synthesized
caaggagaaggatttagaaa

SEQ ID NO: 435679 - DNA, 20 bp, Artificial Sequence
  chemically synthesized
aggagaaggatttagaaaag

SEQ ID NO: 435680 - DNA, 20 bp, Artificial Sequence
  chemically synthesized
gaaaaggagaaaatttttct

SEQ ID NO: 435681 - DNA, 20 bp, Artificial Sequence
  chemically synthesized
gagaaaatttttctaagttt

SEQ ID NO: 435682 - DNA, 20 bp, Artificial Sequence
  chemically synthesized
tccaattgatcaccgaaact

SEQ ID NO: 435683 - DNA, 20 bp, Artificial Sequence
  chemically synthesized
tctaagtttcggtgatcaat

SEQ ID NO: 435684 - DNA, 20 bp, Artificial Sequence
  chemically synthesized
tcggtgatcaattggaatga

SEQ ID NO: 435685 - DNA, 20 bp, Artificial Sequence
  chemically synthesized
tgaaagtgtgaaattacctt

SEQ ID NO: 435686 - DNA, 20 bp, Artificial Sequence
  chemically synthesized
aagtgtgaaattaccttcag

SEQ ID NO: 435687 - DNA, 20 bp, Artificial Sequence
  chemically synthesized
ttagttgacaacactgctga

SEQ ID NO: 435688 - DNA, 20 bp, Artificial Sequence
  chemically synthesized
tttagttgacaacactgctg

SEQ ID NO: 435689 - DNA, 20 bp, Artificial Sequence
  chemically synthesized
gcagtgttgtcaactaaact

SEQ ID NO: 435690 - DNA, 20 bp, Artificial Sequence
  chemically synthesized
gagacagaaagtgctgagtt

SEQ ID NO: 435691 - DNA, 20 bp, Artificial Sequence
  chemically synthesized
ctgttgagacagaaagtgct

SEQ ID NO: 435692 - DNA, 20 bp, Artificial Sequence
  chemically synthesized
tgtgcacctgttgagacaga

SEQ ID NO: 435693 - DNA, 20 bp, Artificial Sequence
  chemically synthesized
ctcagcactttctgtctcaa

SEQ ID NO: 435694 - DNA, 20 bp, Artificial Sequence
  chemically synthesized
tcagcactttctgtctcaac

SEQ ID NO: 435695 - DNA, 20 bp, Artificial Sequence
  chemically synthesized
tgagtgtgcacctgttgaga

SEQ ID NO: 435696 - DNA, 20 bp, Artificial Sequence
  chemically synthesized
ggcttgagtgtgcacctgtt

SEQ ID NO: 435697 - DNA, 20 bp, Artificial Sequence
  chemically synthesized
gtctcaacaggtgcacactc

SEQ ID NO: 435698 - DNA, 20 bp, Artificial Sequence
  chemically synthesized
agctgagagttggtgggctt

SEQ ID NO: 435699 - DNA, 20 bp, Artificial Sequence
  chemically synthesized
acaaatagctgagagttggt

SEQ ID NO: 435700 - DNA, 20 bp, Artificial Sequence
  chemically synthesized
gacaaatagctgagagttgg

SEQ ID NO: 435701 - DNA, 20 bp, Artificial Sequence
  chemically synthesized
cactcaagcccaccaactct

SEQ ID NO: 435702 - DNA, 20 bp, Artificial Sequence
  chemically synthesized
tttgacaaatagctgagagt

SEQ ID NO: 435703 - DNA, 20 bp, Artificial Sequence
  chemically synthesized
tagctttgacaaatagctga

SEQ ID NO: 435704 - DNA, 20 bp, Artificial Sequence
  chemically synthesized
cttagctttgacaaatagct

SEQ ID NO: 435705 - DNA, 20 bp, Artificial Sequence
  chemically synthesized
caactctcagctatttgtca

SEQ ID NO: 435706 - DNA, 20 bp, Artificial Sequence
  chemically synthesized
ttttccttagctttgacaaa

SEQ ID NO: 435707 - DNA, 20 bp, Artificial Sequence
  chemically synthesized
ctcagctatttgtcaaagct

SEQ ID NO: 435708 - DNA, 20 bp, Artificial Sequence
  chemically synthesized
tcagctatttgtcaaagcta

SEQ ID NO: 435709 - DNA, 20 bp, Artificial Sequence
  chemically synthesized
atttgtcaaagctaaggaaa

SEQ ID NO: 435710 - DNA, 20 bp, Artificial Sequence
  chemically synthesized
ggactggctatctttttcct

SEQ ID NO: 435711 - DNA, 20 bp, Artificial Sequence
  chemically synthesized
gtcaaagctaaggaaaaaga

SEQ ID NO: 435712 - DNA, 20 bp, Artificial Sequence
  chemically synthesized
aagctaaggaaaaagatagc

SEQ ID NO: 435713 - DNA, 20 bp, Artificial Sequence
  chemically synthesized
aggcgcagctgtgtggggac

SEQ ID NO: 435714 - DNA, 20 bp, Artificial Sequence
  chemically synthesized
aaagatagccagtccccaca

SEQ ID NO: 435715 - DNA, 20 bp, Artificial Sequence
  chemically synthesized
gccagaggcgcagctgtgtg

SEQ ID NO: 435716 - DNA, 20 bp, Artificial Sequence
  chemically synthesized
agccagaggcgcagctgtgt

SEQ ID NO: 435717 - DNA, 20 bp, Artificial Sequence
  chemically synthesized
cagccagaggcgcagctgtg

SEQ ID NO: 435718 - DNA, 20 bp, Artificial Sequence
  chemically synthesized
tccccacacagctgcgcctc

SEQ ID NO: 435719 - DNA, 20 bp, Artificial Sequence
  chemically synthesized
tgtagtggcagccagaggcg

SEQ ID NO: 435720 - DNA, 20 bp, Artificial Sequence
  chemically synthesized
tcttttgtagtggcagccag

SEQ ID NO: 435721 - DNA, 20 bp, Artificial Sequence
  chemically synthesized
ttcttttgtagtggcagcca

SEQ ID NO: 435722 - DNA, 20 bp, Artificial Sequence
  chemically synthesized
cattcttttgtagtggcagc

SEQ ID NO: 435723 - DNA, 20 bp, Artificial Sequence
  chemically synthesized
gcctcattcttttgtagtgg

SEQ ID NO: 435724 - DNA, 20 bp, Artificial Sequence
  chemically synthesized
gcctctggctgccactacaa

SEQ ID NO: 435725 - DNA, 20 bp, Artificial Sequence
  chemically synthesized
cgagcctcattcttttgtag

SEQ ID NO: 435726 - DNA, 20 bp, Artificial Sequence
  chemically synthesized
agccgagcctcattcttttg

SEQ ID NO: 435727 - DNA, 20 bp, Artificial Sequence
  chemically synthesized
ggctgccactacaaaagaat

SEQ ID NO: 435728 - DNA, 20 bp, Artificial Sequence
  chemically synthesized
gctgccactacaaaagaatg

SEQ ID NO: 435729 - DNA, 20 bp, Artificial Sequence
  chemically synthesized
cactacaaaagaatgaggct

SEQ ID NO: 435730 - DNA, 20 bp, Artificial Sequence
  chemically synthesized
ccccaaacctaaaaatagcc

SEQ ID NO: 435731 - DNA, 20 bp, Artificial Sequence
  chemically synthesized
gaatgaggctcggctatttt

SEQ ID NO: 435732 - DNA, 20 bp, Artificial Sequence
  chemically synthesized
aatgaggctcggctattttt

SEQ ID NO: 435733 - DNA, 20 bp, Artificial Sequence
  chemically synthesized
gcctaccccaaacctaaaaa

SEQ ID NO: 435734 - DNA, 20 bp, Artificial Sequence
  chemically synthesized
ggctcggctatttttaggtt

SEQ ID NO: 435735 - DNA, 20 bp, Artificial Sequence
  chemically synthesized
gctcggctatttttaggttt

SEQ ID NO: 435736 - DNA, 20 bp, Artificial Sequence
  chemically synthesized
ctcggctatttttaggtttg

SEQ ID NO: 435737 - DNA, 20 bp, Artificial Sequence
  chemically synthesized
ggctatttttaggtttgggg

SEQ ID NO: 435738 - DNA, 20 bp, Artificial Sequence
  chemically synthesized
gctatttttaggtttggggt

SEQ ID NO: 435739 - DNA, 20 bp, Artificial Sequence
  chemically synthesized
ttaggtttggggtaggcaat

SEQ ID NO: 435740 - DNA, 20 bp, Artificial Sequence
  chemically synthesized
gtaggcaatcagccaaatct

SEQ ID NO: 435741 - DNA, 20 bp, Artificial Sequence
  chemically synthesized
cttgtggtgctgctgagatt

SEQ ID NO: 435742 - DNA, 20 bp, Artificial Sequence
  chemically synthesized
ggcaatcagccaaatctcag

SEQ ID NO: 435743 - DNA, 20 bp, Artificial Sequence
  chemically synthesized
catgctcttgtggtgctgct

SEQ ID NO: 435744 - DNA, 20 bp, Artificial Sequence
  chemically synthesized
ccaaatctcagcagcaccac

SEQ ID NO: 435745 - DNA, 20 bp, Artificial Sequence
  chemically synthesized
aaatctcagcagcaccacaa

SEQ ID NO: 435746 - DNA, 20 bp, Artificial Sequence
  chemically synthesized
tatctcagcacatgctcttg

SEQ ID NO: 435747 - DNA, 20 bp, Artificial Sequence
  chemically synthesized
gcaccacaagagcatgtgct

SEQ ID NO: 435748 - DNA, 20 bp, Artificial Sequence
  chemically synthesized
ctctaaagtctcagttatct

SEQ ID NO: 435749 - DNA, 20 bp, Artificial Sequence
  chemically synthesized
gagcatgtgctgagataact

SEQ ID NO: 435750 - DNA, 20 bp, Artificial Sequence
  chemically synthesized
tgctgagataactgagactt

SEQ ID NO: 435751 - DNA, 20 bp, Artificial Sequence
  chemically synthesized
ctggttcaactctaaagtct

SEQ ID NO: 435752 - DNA, 20 bp, Artificial Sequence
  chemically synthesized
ctgagataactgagacttta

SEQ ID NO: 435753 - DNA, 20 bp, Artificial Sequence
  chemically synthesized
ggagtcctggttcaactcta

SEQ ID NO: 435754 - DNA, 20 bp, Artificial Sequence
  chemically synthesized
ctgagactttagagttgaac

SEQ ID NO: 435755 - DNA, 20 bp, Artificial Sequence
  chemically synthesized
tgagactttagagttgaacc

SEQ ID NO: 435756 - DNA, 20 bp, Artificial Sequence
  chemically synthesized
ttgggaggctggtggagtcc

SEQ ID NO: 435757 - DNA, 20 bp, Artificial Sequence
  chemically synthesized
gagttgaaccaggactccac

SEQ ID NO: 435758 - DNA, 20 bp, Artificial Sequence
  chemically synthesized
aggaagttgggaggctggtg

SEQ ID NO: 435759 - DNA, 20 bp, Artificial Sequence
  chemically synthesized
gcaggaagttgggaggctgg

SEQ ID NO: 435760 - DNA, 20 bp, Artificial Sequence
  chemically synthesized
taggcaggaagttgggaggc

SEQ ID NO: 435761 - DNA, 20 bp, Artificial Sequence
  chemically synthesized
tgtctaggcaggaagttggg

SEQ ID NO: 435762 - DNA, 20 bp, Artificial Sequence
  chemically synthesized
gtgtctaggcaggaagttgg

SEQ ID NO: 435763 - DNA, 20 bp, Artificial Sequence
  chemically synthesized
gggtgtctaggcaggaagtt

SEQ ID NO: 435764 - DNA, 20 bp, Artificial Sequence
  chemically synthesized
tgggtgtctaggcaggaagt

SEQ ID NO: 435765 - DNA, 20 bp, Artificial Sequence
  chemically synthesized
cagcctcccaacttcctgcc

SEQ ID NO: 435766 - DNA, 20 bp, Artificial Sequence
  chemically synthesized
gggttgggtgtctaggcagg

SEQ ID NO: 435767 - DNA, 20 bp, Artificial Sequence
  chemically synthesized
acagggttgggtgtctaggc

SEQ ID NO: 435768 - DNA, 20 bp, Artificial Sequence
  chemically synthesized
cacagggttgggtgtctagg

SEQ ID NO: 435769 - DNA, 20 bp, Artificial Sequence
  chemically synthesized
gaacacagggttgggtgtct

SEQ ID NO: 435770 - DNA, 20 bp, Artificial Sequence
  chemically synthesized
agaacacagggttgggtgtc

SEQ ID NO: 435771 - DNA, 20 bp, Artificial Sequence
  chemically synthesized
agaaatgagaacacagggtt

SEQ ID NO: 435772 - DNA, 20 bp, Artificial Sequence
  chemically synthesized
cagaaatgagaacacagggt

SEQ ID NO: 435773 - DNA, 20 bp, Artificial Sequence
  chemically synthesized
accacagaaatgagaacaca

SEQ ID NO: 435774 - DNA, 20 bp, Artificial Sequence
  chemically synthesized
gaccacagaaatgagaacac

SEQ ID NO: 435775 - DNA, 20 bp, Artificial Sequence
  chemically synthesized
tgaccacagaaatgagaaca

SEQ ID NO: 435776 - DNA, 20 bp, Artificial Sequence
  chemically synthesized
accctgtgttctcatttctg

SEQ ID NO: 435777 - DNA, 20 bp, Artificial Sequence
  chemically synthesized
gacttggtgaccacagaaat

SEQ ID NO: 435778 - DNA, 20 bp, Artificial Sequence
  chemically synthesized
cacaggtgacttggtgacca

SEQ ID NO: 435779 - DNA, 20 bp, Artificial Sequence
  chemically synthesized
ttctcatttctgtggtcacc

SEQ ID NO: 435780 - DNA, 20 bp, Artificial Sequence
  chemically synthesized
gatgaaagccacaggtgact

SEQ ID NO: 435781 - DNA, 20 bp, Artificial Sequence
  chemically synthesized
tgtggtcaccaagtcacctg

SEQ ID NO: 435782 - DNA, 20 bp, Artificial Sequence
  chemically synthesized
cggatcatgatgaaagccac

SEQ ID NO: 435783 - DNA, 20 bp, Artificial Sequence
  chemically synthesized
gcggatcatgatgaaagcca

SEQ ID NO: 435784 - DNA, 20 bp, Artificial Sequence
  chemically synthesized
gatttcgcggatcatgatga

SEQ ID NO: 435785 - DNA, 20 bp, Artificial Sequence
  chemically synthesized
gcacagaaatgtagatttcg

SEQ ID NO: 435786 - DNA, 20 bp, Artificial Sequence
  chemically synthesized
ctgggaaaagcacagaaatg

SEQ ID NO: 435787 - DNA, 20 bp, Artificial Sequence
  chemically synthesized
gagaggagctgggaaaagca

SEQ ID NO: 435788 - DNA, 20 bp, Artificial Sequence
  chemically synthesized
ctacatttctgtgcttttcc

SEQ ID NO: 435789 - DNA, 20 bp, Artificial Sequence
  chemically synthesized
aacaggagaggagctgggaa

SEQ ID NO: 435790 - DNA, 20 bp, Artificial Sequence
  chemically synthesized
gttgtaacaggagaggagct

SEQ ID NO: 435791 - DNA, 20 bp, Artificial Sequence
  chemically synthesized
agttgtaacaggagaggagc

SEQ ID NO: 435792 - DNA, 20 bp, Artificial Sequence
  chemically synthesized
tgaaagttgtaacaggagag

SEQ ID NO: 435793 - DNA, 20 bp, Artificial Sequence
  chemically synthesized
aatgaaagttgtaacaggag

SEQ ID NO: 435794 - DNA, 20 bp, Artificial Sequence
  chemically synthesized
aaatgaaagttgtaacagga

SEQ ID NO: 435795 - DNA, 20 bp, Artificial Sequence
  chemically synthesized
agaaatgaaagttgtaacag

SEQ ID NO: 435796 - DNA, 20 bp, Artificial Sequence
  chemically synthesized
taagaaatgaaagttgtaac

SEQ ID NO: 435797 - DNA, 20 bp, Artificial Sequence
  chemically synthesized
ataagaaatgaaagttgtaa

SEQ ID NO: 435798 - DNA, 20 bp, Artificial Sequence
  chemically synthesized
ggtctagagataagaaatga

SEQ ID NO: 435799 - DNA, 20 bp, Artificial Sequence
  chemically synthesized
caactttcatttcttatctc

SEQ ID NO: 435800 - DNA, 20 bp, Artificial Sequence
  chemically synthesized
tggcttcaaggtctagagat

SEQ ID NO: 435801 - DNA, 20 bp, Artificial Sequence
  chemically synthesized
tttcatggcttcaaggtcta

SEQ ID NO: 435802 - DNA, 20 bp, Artificial Sequence
  chemically synthesized
tttcttatctctagaccttg

SEQ ID NO: 435803 - DNA, 20 bp, Artificial Sequence
  chemically synthesized
aatttcatggcttcaaggtc

SEQ ID NO: 435804 - DNA, 20 bp, Artificial Sequence
  chemically synthesized
aggaaaatttcatggcttca

SEQ ID NO: 435805 - DNA, 20 bp, Artificial Sequence
  chemically synthesized
aaggaaaatttcatggcttc

SEQ ID NO: 435806 - DNA, 20 bp, Artificial Sequence
  chemically synthesized
aactaataaggaaaatttca

SEQ ID NO: 435807 - DNA, 20 bp, Artificial Sequence
  chemically synthesized
agccatgaaattttccttat

SEQ ID NO: 435808 - DNA, 20 bp, Artificial Sequence
  chemically synthesized
gttgagtaaaggaactaata

SEQ ID NO: 435809 - DNA, 20 bp, Artificial Sequence
  chemically synthesized
tgttgagtaaaggaactaat

SEQ ID NO: 435810 - DNA, 20 bp, Artificial Sequence
  chemically synthesized
tttttttccttgttgagtaa

SEQ ID NO: 435811 - DNA, 20 bp, Artificial Sequence
  chemically synthesized
ttttttttccttgttgagta

SEQ ID NO: 435812 - DNA, 20 bp, Artificial Sequence
  chemically synthesized
tattagttcctttactcaac

SEQ ID NO: 435813 - DNA, 20 bp, Artificial Sequence
  chemically synthesized
attagttcctttactcaaca

SEQ ID NO: 435814 - DNA, 20 bp, Artificial Sequence
  chemically synthesized
ggtttttttttttccttgtt

SEQ ID NO: 435815 - DNA, 20 bp, Artificial Sequence
  chemically synthesized
acaaggaaaaaaaaaaacct

SEQ ID NO: 435816 - DNA, 20 bp, Artificial Sequence
  chemically synthesized
agcagctgcagagtgttctg

SEQ ID NO: 435817 - DNA, 20 bp, Artificial Sequence
  chemically synthesized
aagcagctgcagagtgttct

SEQ ID NO: 435818 - DNA, 20 bp, Artificial Sequence
  chemically synthesized
aaaaacctcagaacactctg

SEQ ID NO: 435819 - DNA, 20 bp, Artificial Sequence
  chemically synthesized
tctttatagaagcagctgca

SEQ ID NO: 435820 - DNA, 20 bp, Artificial Sequence
  chemically synthesized
tttctttatagaagcagctg

SEQ ID NO: 435821 - DNA, 20 bp, Artificial Sequence
  chemically synthesized
cactgctttctttatagaag

SEQ ID NO: 435822 - DNA, 20 bp, Artificial Sequence
  chemically synthesized
actctgcagctgcttctata

SEQ ID NO: 435823 - DNA, 20 bp, Artificial Sequence
  chemically synthesized
ccacactgctttctttatag

SEQ ID NO: 435824 - DNA, 20 bp, Artificial Sequence
  chemically synthesized
tgcagctgcttctataaaga

SEQ ID NO: 435825 - DNA, 20 bp, Artificial Sequence
  chemically synthesized
aacccacactgctttcttta

SEQ ID NO: 435826 - DNA, 20 bp, Artificial Sequence
  chemically synthesized
agctgcttctataaagaaag

SEQ ID NO: 435827 - DNA, 20 bp, Artificial Sequence
  chemically synthesized
cttctataaagaaagcagtg

SEQ ID NO: 435828 - DNA, 20 bp, Artificial Sequence
  chemically synthesized
ttctataaagaaagcagtgt

SEQ ID NO: 435829 - DNA, 20 bp, Artificial Sequence
  chemically synthesized
aggcttaatgaaatgaagga

SEQ ID NO: 435830 - DNA, 20 bp, Artificial Sequence
  chemically synthesized
ttagaggcttaatgaaatga

SEQ ID NO: 435831 - DNA, 20 bp, Artificial Sequence
  chemically synthesized
cttagaggcttaatgaaatg

SEQ ID NO: 435832 - DNA, 20 bp, Artificial Sequence
  chemically synthesized
aatctgtccttcatttcatt

SEQ ID NO: 435833 - DNA, 20 bp, Artificial Sequence
  chemically synthesized
cttcatttcattaagcctct

SEQ ID NO: 435834 - DNA, 20 bp, Artificial Sequence
  chemically synthesized
tagcaatggccatgacttag

SEQ ID NO: 435835 - DNA, 20 bp, Artificial Sequence
  chemically synthesized
ttcattaagcctctaagtca

SEQ ID NO: 435836 - DNA, 20 bp, Artificial Sequence
  chemically synthesized
gtagcaatggccatgactta

SEQ ID NO: 435837 - DNA, 20 bp, Artificial Sequence
  chemically synthesized
tggtagcaatggccatgact

SEQ ID NO: 435838 - DNA, 20 bp, Artificial Sequence
  chemically synthesized
tttaagcacagtggtagcaa

SEQ ID NO: 435839 - DNA, 20 bp, Artificial Sequence
  chemically synthesized
cttgtttttaagcacagtgg

SEQ ID NO: 435840 - DNA, 20 bp, Artificial Sequence
  chemically synthesized
tctcttgtttttaagcacag

SEQ ID NO: 435841 - DNA, 20 bp, Artificial Sequence
  chemically synthesized
ttttctcttgtttttaagca

SEQ ID NO: 435842 - DNA, 20 bp, Artificial Sequence
  chemically synthesized
ctaccactgtgcttaaaaac

SEQ ID NO: 435843 - DNA, 20 bp, Artificial Sequence
  chemically synthesized
ttcacttttctcttgttttt

SEQ ID NO: 435844 - DNA, 20 bp, Artificial Sequence
  chemically synthesized
accactgtgcttaaaaacaa

SEQ ID NO: 435845 - DNA, 20 bp, Artificial Sequence
  chemically synthesized
tgtgcttaaaaacaagagaa

SEQ ID NO: 435846 - DNA, 20 bp, Artificial Sequence
  chemically synthesized
gagaaaagtgaatgcttata

SEQ ID NO: 435847 - DNA, 20 bp, Artificial Sequence
  chemically synthesized
gaaaagtgaatgcttataaa

SEQ ID NO: 435848 - DNA, 20 bp, Artificial Sequence
  chemically synthesized
ttgtacctgccactctttat

SEQ ID NO: 435849 - DNA, 20 bp, Artificial Sequence
  chemically synthesized
aagtgaatgcttataaagag

SEQ ID NO: 435850 - DNA, 20 bp, Artificial Sequence
  chemically synthesized
tgaatgcttataaagagtgg

SEQ ID NO: 435851 - DNA, 20 bp, Artificial Sequence
  chemically synthesized
gaatgcttataaagagtggc

SEQ ID NO: 435852 - DNA, 20 bp, Artificial Sequence
  chemically synthesized
ggtacaataactgatgtaca

SEQ ID NO: 435853 - DNA, 20 bp, Artificial Sequence
  chemically synthesized
tgttttccttctttgtacat

SEQ ID NO: 435854 - DNA, 20 bp, Artificial Sequence
  chemically synthesized
acaataactgatgtacaaag

SEQ ID NO: 435855 - DNA, 20 bp, Artificial Sequence
  chemically synthesized
caataactgatgtacaaaga

SEQ ID NO: 435856 - DNA, 20 bp, Artificial Sequence
  chemically synthesized
atgtacaaagaaggaaaaca

SEQ ID NO: 435857 - DNA, 20 bp, Artificial Sequence
  chemically synthesized
cccttttaactatcaaaaca

SEQ ID NO: 435858 - DNA, 20 bp, Artificial Sequence
  chemically synthesized
cacagattactgtgttttga

SEQ ID NO: 435859 - DNA, 20 bp, Artificial Sequence
  chemically synthesized
tactgtgttttgatagttaa

SEQ ID NO: 435860 - DNA, 20 bp, Artificial Sequence
  chemically synthesized
actgtgttttgatagttaaa

SEQ ID NO: 435861 - DNA, 20 bp, Artificial Sequence
  chemically synthesized
ctgtgttttgatagttaaaa

SEQ ID NO: 435862 - DNA, 20 bp, Artificial Sequence
  chemically synthesized
gtgttttgatagttaaaagg

SEQ ID NO: 435863 - DNA, 20 bp, Artificial Sequence
  chemically synthesized
tttgatagttaaaagggagc

SEQ ID NO: 435864 - DNA, 20 bp, Artificial Sequence
  chemically synthesized
tagttaaaagggagccagaa

SEQ ID NO: 435865 - DNA, 20 bp, Artificial Sequence
  chemically synthesized
agttaaaagggagccagaat

SEQ ID NO: 435866 - DNA, 20 bp, Artificial Sequence
  chemically synthesized
gttaaaagggagccagaata

SEQ ID NO: 435867 - DNA, 20 bp, Artificial Sequence
  chemically synthesized
taaaagggagccagaatagg

SEQ ID NO: 435868 - DNA, 20 bp, Artificial Sequence
  chemically synthesized
gactccttagctccctattc

SEQ ID NO: 435869 - DNA, 20 bp, Artificial Sequence
  chemically synthesized
gggagccagaatagggagct

SEQ ID NO: 435870 - DNA, 20 bp, Artificial Sequence
  chemically synthesized
ggagccagaatagggagcta

SEQ ID NO: 435871 - DNA, 20 bp, Artificial Sequence
  chemically synthesized
agccagaatagggagctaag

SEQ ID NO: 435872 - DNA, 20 bp, Artificial Sequence
  chemically synthesized
gctattgatatcagactcct

SEQ ID NO: 435873 - DNA, 20 bp, Artificial Sequence
  chemically synthesized
gctaaggagtctgatatcaa

SEQ ID NO: 435874 - DNA, 20 bp, Artificial Sequence
  chemically synthesized
ataatgtacgctattgatat

SEQ ID NO: 435875 - DNA, 20 bp, Artificial Sequence
  chemically synthesized
tctggatcagcattcaacaa

SEQ ID NO: 435876 - DNA, 20 bp, Artificial Sequence
  chemically synthesized
ttctggatcagcattcaaca

SEQ ID NO: 435877 - DNA, 20 bp, Artificial Sequence
  chemically synthesized
acctttgttgaatgctgatc

SEQ ID NO: 435878 - DNA, 20 bp, Artificial Sequence
  chemically synthesized
tttgttgaatgctgatccag

SEQ ID NO: 435879 - DNA, 20 bp, Artificial Sequence
  chemically synthesized
ttgttgaatgctgatccaga

SEQ ID NO: 435880 - DNA, 20 bp, Artificial Sequence
  chemically synthesized
gacatattaaccttctggat

SEQ ID NO: 435881 - DNA, 20 bp, Artificial Sequence
  chemically synthesized
tcttagacatattaaccttc

SEQ ID NO: 435882 - DNA, 20 bp, Artificial Sequence
  chemically synthesized
tccagaaggttaatatgtct

SEQ ID NO: 435883 - DNA, 20 bp, Artificial Sequence
  chemically synthesized
atttcacaaatgcacattct

SEQ ID NO: 435884 - DNA, 20 bp, Artificial Sequence
  chemically synthesized
tgtgaaatttccctatgtgc

SEQ ID NO: 435885 - DNA, 20 bp, Artificial Sequence
  chemically synthesized
tgagattatgctagcacata

SEQ ID NO: 435886 - DNA, 20 bp, Artificial Sequence
  chemically synthesized
gtgagattatgctagcacat

SEQ ID NO: 435887 - DNA, 20 bp, Artificial Sequence
  chemically synthesized
agtgagattatgctagcaca

SEQ ID NO: 435888 - DNA, 20 bp, Artificial Sequence
  chemically synthesized
aacacctagtgagattatgc

SEQ ID NO: 435889 - DNA, 20 bp, Artificial Sequence
  chemically synthesized
atgtgctagcataatctcac

SEQ ID NO: 435890 - DNA, 20 bp, Artificial Sequence
  chemically synthesized
tgtgctagcataatctcact

SEQ ID NO: 435891 - DNA, 20 bp, Artificial Sequence
  chemically synthesized
gaaatcatgcaacacctagt

SEQ ID NO: 435892 - DNA, 20 bp, Artificial Sequence
  chemically synthesized
catggaaatcatgcaacacc

SEQ ID NO: 435893 - DNA, 20 bp, Artificial Sequence
  chemically synthesized
aggtgttgcatgatttccat

SEQ ID NO: 435894 - DNA, 20 bp, Artificial Sequence
  chemically synthesized
ggtgttgcatgatttccatg

SEQ ID NO: 435895 - DNA, 20 bp, Artificial Sequence
  chemically synthesized
ttgcatgatttccatgagga

SEQ ID NO: 435896 - DNA, 20 bp, Artificial Sequence
  chemically synthesized
ctaaaacccagctttcctca

SEQ ID NO: 435897 - DNA, 20 bp, Artificial Sequence
  chemically synthesized
atgatttccatgaggaaagc

SEQ ID NO: 435898 - DNA, 20 bp, Artificial Sequence
  chemically synthesized
tgatttccatgaggaaagct

SEQ ID NO: 435899 - DNA, 20 bp, Artificial Sequence
  chemically synthesized
ccatgaggaaagctgggttt

SEQ ID NO: 435900 - DNA, 20 bp, Artificial Sequence
  chemically synthesized
taatttattccactaaaacc

SEQ ID NO: 435901 - DNA, 20 bp, Artificial Sequence
  chemically synthesized
tgaggaaagctgggttttag

SEQ ID NO: 435902 - DNA, 20 bp, Artificial Sequence
  chemically synthesized
tggaataaattattctacat

SEQ ID NO: 435903 - DNA, 20 bp, Artificial Sequence
  chemically synthesized
gaagacaaaaaaatctaatg

SEQ ID NO: 435904 - DNA, 20 bp, Artificial Sequence
  chemically synthesized
aaataaaaaacagttatgag

SEQ ID NO: 435905 - DNA, 20 bp, Artificial Sequence
  chemically synthesized
tacaaataaaaaacagttat

SEQ ID NO: 435906 - DNA, 20 bp, Artificial Sequence
  chemically synthesized
ttttgtttacaaataaaaaa

SEQ ID NO: 435907 - DNA, 20 bp, Artificial Sequence
  chemically synthesized
tgttttttatttgtaaacaa

SEQ ID NO: 435908 - DNA, 20 bp, Artificial Sequence
  chemically synthesized
aaagtacatgcacacattta

SEQ ID NO: 435909 - DNA, 20 bp, Artificial Sequence
  chemically synthesized
gcacacatttacggtatcct

SEQ ID NO: 435910 - DNA, 20 bp, Artificial Sequence
  chemically synthesized
cacacatttacggtatcctc

SEQ ID NO: 435911 - DNA, 20 bp, Artificial Sequence
  chemically synthesized
tgttttgatagcaatacctg

SEQ ID NO: 435912 - DNA, 20 bp, Artificial Sequence
  chemically synthesized
ctgttttgatagcaatacct

SEQ ID NO: 435913 - DNA, 20 bp, Artificial Sequence
  chemically synthesized
ctcaggtattgctatcaaaa

SEQ ID NO: 435914 - DNA, 20 bp, Artificial Sequence
  chemically synthesized
ttattttattactgttttga

SEQ ID NO: 435915 - DNA, 20 bp, Artificial Sequence
  chemically synthesized
aaaaaatcattaaaaaagaa

SEQ ID NO: 435916 - DNA, 20 bp, Artificial Sequence
  chemically synthesized
acaaaaaaaaatcattaaaa

SEQ ID NO: 435917 - DNA, 20 bp, Artificial Sequence
  chemically synthesized
tttttgttgtgaactgacat

SEQ ID NO: 435918 - DNA, 20 bp, Artificial Sequence
  chemically synthesized
tcgtatatgaaagctcatgt

SEQ ID NO: 435919 - DNA, 20 bp, Artificial Sequence
  chemically synthesized
aaatcggatttcgtatatga

SEQ ID NO: 435920 - DNA, 20 bp, Artificial Sequence
  chemically synthesized
tgtgccttatatttcaaaat

SEQ ID NO: 435921 - DNA, 20 bp, Artificial Sequence
  chemically synthesized
gaaatccgattttgaaatat

SEQ ID NO: 435922 - DNA, 20 bp, Artificial Sequence
  chemically synthesized
aaatccgattttgaaatata

SEQ ID NO: 435923 - DNA, 20 bp, Artificial Sequence
  chemically synthesized
cacatttattttgaaattaa

SEQ ID NO: 435924 - DNA, 20 bp, Artificial Sequence
  chemically synthesized
acatttattttgaaattaat

SEQ ID NO: 435925 - DNA, 20 bp, Artificial Sequence
  chemically synthesized
catttattttgaaattaata

SEQ ID NO: 435926 - DNA, 20 bp, Artificial Sequence
  chemically synthesized
tttgaaattaatagggaatc

SEQ ID NO: 435927 - DNA, 20 bp, Artificial Sequence
  chemically synthesized
ttgaaattaatagggaatct

SEQ ID NO: 435928 - DNA, 20 bp, Artificial Sequence
  chemically synthesized
tggctttgctttgtttgacc

SEQ ID NO: 435929 - DNA, 20 bp, Artificial Sequence
  chemically synthesized
tagggaatctaggtcaaaca

SEQ ID NO: 435930 - DNA, 20 bp, Artificial Sequence
  chemically synthesized
aatctaggtcaaacaaagca

SEQ ID NO: 435931 - DNA, 20 bp, Artificial Sequence
  chemically synthesized
agttctgtaaaattaaggtt

SEQ ID NO: 435932 - DNA, 20 bp, Artificial Sequence
  chemically synthesized
agaacagttctgtaaaatta

SEQ ID NO: 435933 - DNA, 20 bp, Artificial Sequence
  chemically synthesized
aaagccaaaccttaatttta

SEQ ID NO: 435934 - DNA, 20 bp, Artificial Sequence
  chemically synthesized
tagaacagttctgtaaaatt

SEQ ID NO: 435935 - DNA, 20 bp, Artificial Sequence
  chemically synthesized
gactttttgtagaggtagaa

SEQ ID NO: 435936 - DNA, 20 bp, Artificial Sequence
  chemically synthesized
tgagtgactttttgtagagg

SEQ ID NO: 435937 - DNA, 20 bp, Artificial Sequence
  chemically synthesized
aactgttctacctctacaaa

SEQ ID NO: 435938 - DNA, 20 bp, Artificial Sequence
  chemically synthesized
ttttgagtgactttttgtag

SEQ ID NO: 435939 - DNA, 20 bp, Artificial Sequence
  chemically synthesized
gttttgagtgactttttgta

SEQ ID NO: 435940 - DNA, 20 bp, Artificial Sequence
  chemically synthesized
ttgttttgagtgactttttg

SEQ ID NO: 435941 - DNA, 20 bp, Artificial Sequence
  chemically synthesized
acaatttaaacaattgtttt

SEQ ID NO: 435942 - DNA, 20 bp, Artificial Sequence
  chemically synthesized
acatgttaaaatgcattttc

SEQ ID NO: 435943 - DNA, 20 bp, Artificial Sequence
  chemically synthesized
tcatatggaattatatttat

SEQ ID NO: 435944 - DNA, 20 bp, Artificial Sequence
  chemically synthesized
gtcatatggaattatattta

SEQ ID NO: 435945 - DNA, 20 bp, Artificial Sequence
  chemically synthesized
aaatataattccatatgact

SEQ ID NO: 435946 - DNA, 20 bp, Artificial Sequence
  chemically synthesized
ttattttcatcttagtcata

SEQ ID NO: 435947 - DNA, 20 bp, Artificial Sequence
  chemically synthesized
tttatttattattttcatct

SEQ ID NO: 435948 - DNA, 20 bp, Artificial Sequence
  chemically synthesized
gaaaataataaataaaataa

SEQ ID NO: 435949 - DNA, 20 bp, Artificial Sequence
  chemically synthesized
aataataaataaaataatag

SEQ ID NO: 435950 - DNA, 20 bp, Artificial Sequence
  chemically synthesized
taaaatcaaaataggaaata

SEQ ID NO: 435951 - DNA, 20 bp, Artificial Sequence
  chemically synthesized
aatggggataaaatcaaaat

SEQ ID NO: 435952 - DNA, 20 bp, Artificial Sequence
  chemically synthesized
taatggggataaaatcaaaa

SEQ ID NO: 435953 - DNA, 20 bp, Artificial Sequence
  chemically synthesized
gaatttgttctggaataatg

SEQ ID NO: 435954 - DNA, 20 bp, Artificial Sequence
  chemically synthesized
tgattttatccccattattc

SEQ ID NO: 435955 - DNA, 20 bp, Artificial Sequence
  chemically synthesized
tgaatttgttctggaataat

SEQ ID NO: 435956 - DNA, 20 bp, Artificial Sequence
  chemically synthesized
ttgaatttgttctggaataa

SEQ ID NO: 435957 - DNA, 20 bp, Artificial Sequence
  chemically synthesized
ctgccatattgaatttgttc

SEQ ID NO: 435958 - DNA, 20 bp, Artificial Sequence
  chemically synthesized
attccagaacaaattcaata

SEQ ID NO: 435959 - DNA, 20 bp, Artificial Sequence
  chemically synthesized
ccagaacaaattcaatatgg

SEQ ID NO: 435960 - DNA, 20 bp, Artificial Sequence
  chemically synthesized
caatatggcagataaattgc

SEQ ID NO: 435961 - DNA, 20 bp, Artificial Sequence
  chemically synthesized
aatatggcagataaattgca

SEQ ID NO: 435962 - DNA, 20 bp, Artificial Sequence
  chemically synthesized
aaaaaaaaaaaaaaaaaaga

SEQ ID NO: 435963 - DNA, 20 bp, Artificial Sequence
  chemically synthesized
caaaaaaaaaaaaaaaaaaa

SEQ ID NO: 435964 - DNA, 20 bp, Artificial Sequence
  chemically synthesized
tttttttttttttttttttt

SEQ ID NO: 435965 - DNA, 20 bp, Artificial Sequence
  chemically synthesized
ttttttttttttttttgaga

SEQ ID NO: 435966 - DNA, 20 bp, Artificial Sequence
  chemically synthesized
ttttttttttttttgagaca

SEQ ID NO: 435967 - DNA, 20 bp, Artificial Sequence
  chemically synthesized
tccagcctgggcgacagagc

SEQ ID NO: 435968 - DNA, 20 bp, Artificial Sequence
  chemically synthesized
cagagtctcgctctgtcgcc

SEQ ID NO: 435969 - DNA, 20 bp, Artificial Sequence
  chemically synthesized
gcactccagcctgggcgaca

SEQ ID NO: 435970 - DNA, 20 bp, Artificial Sequence
  chemically synthesized
agagtctcgctctgtcgccc

SEQ ID NO: 435971 - DNA, 20 bp, Artificial Sequence
  chemically synthesized
tggcactccagcctgggcga

SEQ ID NO: 435972 - DNA, 20 bp, Artificial Sequence
  chemically synthesized
tctcgctctgtcgcccaggc

SEQ ID NO: 435973 - DNA, 20 bp, Artificial Sequence
  chemically synthesized
tcgctctgtcgcccaggctg

SEQ ID NO: 435974 - DNA, 20 bp, Artificial Sequence
  chemically synthesized
gtgccatggcactccagcct

SEQ ID NO: 435975 - DNA, 20 bp, Artificial Sequence
  chemically synthesized
cgtgccatggcactccagcc

SEQ ID NO: 435976 - DNA, 20 bp, Artificial Sequence
  chemically synthesized
aagatcgtgccatggcactc

SEQ ID NO: 435977 - DNA, 20 bp, Artificial Sequence
  chemically synthesized
tcgcccaggctggagtgcca

SEQ ID NO: 435978 - DNA, 20 bp, Artificial Sequence
  chemically synthesized
ggtgagccaagatcgtgcca

SEQ ID NO: 435979 - DNA, 20 bp, Artificial Sequence
  chemically synthesized
ggagtgccatggcacgatct

SEQ ID NO: 435980 - DNA, 20 bp, Artificial Sequence
  chemically synthesized
ggtggaggttgcggtgagcc

SEQ ID NO: 435981 - DNA, 20 bp, Artificial Sequence
  chemically synthesized
caggaggtggaggttgcggt

SEQ ID NO: 435982 - DNA, 20 bp, Artificial Sequence
  chemically synthesized
aacccaggaggtggaggttg

SEQ ID NO: 435983 - DNA, 20 bp, Artificial Sequence
  chemically synthesized
cgcttgaacccaggaggtgg

SEQ ID NO: 435984 - DNA, 20 bp, Artificial Sequence
  chemically synthesized
tcaccgcaacctccacctcc

SEQ ID NO: 435985 - DNA, 20 bp, Artificial Sequence
  chemically synthesized
tcgcttgaacccaggaggtg

SEQ ID NO: 435986 - DNA, 20 bp, Artificial Sequence
  chemically synthesized
caccgcaacctccacctcct

SEQ ID NO: 435987 - DNA, 20 bp, Artificial Sequence
  chemically synthesized
aatcgcttgaacccaggagg

SEQ ID NO: 435988 - DNA, 20 bp, Artificial Sequence
  chemically synthesized
gagaatcgcttgaacccagg

SEQ ID NO: 435989 - DNA, 20 bp, Artificial Sequence
  chemically synthesized
ggagaatcgcttgaacccag

SEQ ID NO: 435990 - DNA, 20 bp, Artificial Sequence
  chemically synthesized
aacctccacctcctgggttc

SEQ ID NO: 435991 - DNA, 20 bp, Artificial Sequence
  chemically synthesized
caggagaatcgcttgaaccc

SEQ ID NO: 435992 - DNA, 20 bp, Artificial Sequence
  chemically synthesized
gcaggagaatcgcttgaacc

SEQ ID NO: 435993 - DNA, 20 bp, Artificial Sequence
  chemically synthesized
ttcaagcgattctcctgcct

SEQ ID NO: 435994 - DNA, 20 bp, Artificial Sequence
  chemically synthesized
tactcaggaggctgaggcag

SEQ ID NO: 435995 - DNA, 20 bp, Artificial Sequence
  chemically synthesized
gctactcaggaggctgaggc

SEQ ID NO: 435996 - DNA, 20 bp, Artificial Sequence
  chemically synthesized
agctactcaggaggctgagg

SEQ ID NO: 435997 - DNA, 20 bp, Artificial Sequence
  chemically synthesized
cccagctactcaggaggctg

SEQ ID NO: 435998 - DNA, 20 bp, Artificial Sequence
  chemically synthesized
tcccagctactcaggaggct

SEQ ID NO: 435999 - DNA, 20 bp, Artificial Sequence
  chemically synthesized
ttctcctgcctcagcctcct

SEQ ID NO: 436000 - DNA, 20 bp, Artificial Sequence
  chemically synthesized
tcctgcctcagcctcctgag

SEQ ID NO: 436001 - DNA, 20 bp, Artificial Sequence
  chemically synthesized
tgtaatcccagctactcagg

SEQ ID NO: 436002 - DNA, 20 bp, Artificial Sequence
  chemically synthesized
ctgtaatcccagctactcag

SEQ ID NO: 436003 - DNA, 20 bp, Artificial Sequence
  chemically synthesized
gcctcagcctcctgagtagc

SEQ ID NO: 436004 - DNA, 20 bp, Artificial Sequence
  chemically synthesized
gcctgtaatcccagctactc

SEQ ID NO: 436005 - DNA, 20 bp, Artificial Sequence
  chemically synthesized
cctcagcctcctgagtagct

SEQ ID NO: 436006 - DNA, 20 bp, Artificial Sequence
  chemically synthesized
tgcctgtaatcccagctact

SEQ ID NO: 436007 - DNA, 20 bp, Artificial Sequence
  chemically synthesized
ctcctgagtagctgggatta

SEQ ID NO: 436008 - DNA, 20 bp, Artificial Sequence
  chemically synthesized
tcctgagtagctgggattac

SEQ ID NO: 436009 - DNA, 20 bp, Artificial Sequence
  chemically synthesized
gtggtgcatgcctgtaatcc

SEQ ID NO: 436010 - DNA, 20 bp, Artificial Sequence
  chemically synthesized
caggcatgcaccaccacgcc

SEQ ID NO: 436011 - DNA, 20 bp, Artificial Sequence
  chemically synthesized
caaaaattagccgggcgtgg

SEQ ID NO: 436012 - DNA, 20 bp, Artificial Sequence
  chemically synthesized
atacaaaaattagccgggcg

SEQ ID NO: 436013 - DNA, 20 bp, Artificial Sequence
  chemically synthesized
taaaaatacaaaaattagcc

SEQ ID NO: 436014 - DNA, 20 bp, Artificial Sequence
  chemically synthesized
gtaaaaatacaaaaattagc

SEQ ID NO: 436015 - DNA, 20 bp, Artificial Sequence
  chemically synthesized
tctagtaaaaatacaaaaat

SEQ ID NO: 436016 - DNA, 20 bp, Artificial Sequence
  chemically synthesized
gctaatttttgtatttttac

SEQ ID NO: 436017 - DNA, 20 bp, Artificial Sequence
  chemically synthesized
taatttttgtatttttacta

SEQ ID NO: 436018 - DNA, 20 bp, Artificial Sequence
  chemically synthesized
ttttgtatttttactagaga

SEQ ID NO: 436019 - DNA, 20 bp, Artificial Sequence
  chemically synthesized
tttgtatttttactagagat

SEQ ID NO: 436020 - DNA, 20 bp, Artificial Sequence
  chemically synthesized
ttgtatttttactagagatg

SEQ ID NO: 436021 - DNA, 20 bp, Artificial Sequence
  chemically synthesized
acatggtgaaaccccatctc

SEQ ID NO: 436022 - DNA, 20 bp, Artificial Sequence
  chemically synthesized
gagatggggtttcaccatgt

SEQ ID NO: 436023 - DNA, 20 bp, Artificial Sequence
  chemically synthesized
tggggtttcaccatgttggt

SEQ ID NO: 436024 - DNA, 20 bp, Artificial Sequence
  chemically synthesized
cgagaccagcctgaccaaca

SEQ ID NO: 436025 - DNA, 20 bp, Artificial Sequence
  chemically synthesized
ggggtttcaccatgttggtc

SEQ ID NO: 436026 - DNA, 20 bp, Artificial Sequence
  chemically synthesized
tttcaccatgttggtcaggc

SEQ ID NO: 436027 - DNA, 20 bp, Artificial Sequence
  chemically synthesized
cgaggtcaggagttcgagac

SEQ ID NO: 436028 - DNA, 20 bp, Artificial Sequence
  chemically synthesized
catcacgaggtcaggagttc

SEQ ID NO: 436029 - DNA, 20 bp, Artificial Sequence
  chemically synthesized
tgggagcatcacgaggtcag

SEQ ID NO: 436030 - DNA, 20 bp, Artificial Sequence
  chemically synthesized
ggtgggagcatcacgaggtc

SEQ ID NO: 436031 - DNA, 20 bp, Artificial Sequence
  chemically synthesized
aggtgggagcatcacgaggt

SEQ ID NO: 436032 - DNA, 20 bp, Artificial Sequence
  chemically synthesized
gccgaggtgggagcatcacg

SEQ ID NO: 436033 - DNA, 20 bp, Artificial Sequence
  chemically synthesized
ggccgaggtgggagcatcac

SEQ ID NO: 436034 - DNA, 20 bp, Artificial Sequence
  chemically synthesized
acctcgtgatgctcccacct

SEQ ID NO: 436035 - DNA, 20 bp, Artificial Sequence
  chemically synthesized
actttgggaggccgaggtgg

SEQ ID NO: 436036 - DNA, 20 bp, Artificial Sequence
  chemically synthesized
gcactttgggaggccgaggt

SEQ ID NO: 436037 - DNA, 20 bp, Artificial Sequence
  chemically synthesized
agcactttgggaggccgagg

SEQ ID NO: 436038 - DNA, 20 bp, Artificial Sequence
  chemically synthesized
cccagcactttgggaggccg

SEQ ID NO: 436039 - DNA, 20 bp, Artificial Sequence
  chemically synthesized
tcccagcactttgggaggcc

SEQ ID NO: 436040 - DNA, 20 bp, Artificial Sequence
  chemically synthesized
gctcccacctcggcctccca

SEQ ID NO: 436041 - DNA, 20 bp, Artificial Sequence
  chemically synthesized
tgtaatcccagcactttggg

SEQ ID NO: 436042 - DNA, 20 bp, Artificial Sequence
  chemically synthesized
ctgtaatcccagcactttgg

SEQ ID NO: 436043 - DNA, 20 bp, Artificial Sequence
  chemically synthesized
acctcggcctcccaaagtgc

SEQ ID NO: 436044 - DNA, 20 bp, Artificial Sequence
  chemically synthesized
atctgtaatcccagcacttt

SEQ ID NO: 436045 - DNA, 20 bp, Artificial Sequence
  chemically synthesized
cctcggcctcccaaagtgct

SEQ ID NO: 436046 - DNA, 20 bp, Artificial Sequence
  chemically synthesized
catctgtaatcccagcactt

SEQ ID NO: 436047 - DNA, 20 bp, Artificial Sequence
  chemically synthesized
ctcccaaagtgctgggatta

SEQ ID NO: 436048 - DNA, 20 bp, Artificial Sequence
  chemically synthesized
gtggctcacatctgtaatcc

SEQ ID NO: 436049 - DNA, 20 bp, Artificial Sequence
  chemically synthesized
agtgctgggattacagatgt

SEQ ID NO: 436050 - DNA, 20 bp, Artificial Sequence
  chemically synthesized
cagatgtgagccaccgcgcc

SEQ ID NO: 436051 - DNA, 20 bp, Artificial Sequence
  chemically synthesized
ccttgctgggccgggcgcgg

SEQ ID NO: 436052 - DNA, 20 bp, Artificial Sequence
  chemically synthesized
aatccttgctgggccgggcg

SEQ ID NO: 436053 - DNA, 20 bp, Artificial Sequence
  chemically synthesized
gtgagccaccgcgcccggcc

SEQ ID NO: 436054 - DNA, 20 bp, Artificial Sequence
  chemically synthesized
aaataaatccttgctgggcc

SEQ ID NO: 436055 - DNA, 20 bp, Artificial Sequence
  chemically synthesized
gccaccgcgcccggcccagc

SEQ ID NO: 436056 - DNA, 20 bp, Artificial Sequence
  chemically synthesized
aaaataaatccttgctgggc

SEQ ID NO: 436057 - DNA, 20 bp, Artificial Sequence
  chemically synthesized
ccaccgcgcccggcccagca

SEQ ID NO: 436058 - DNA, 20 bp, Artificial Sequence
  chemically synthesized
cctgaaaataaatccttgct

SEQ ID NO: 436059 - DNA, 20 bp, Artificial Sequence
  chemically synthesized
ccctgaaaataaatccttgc

SEQ ID NO: 436060 - DNA, 20 bp, Artificial Sequence
  chemically synthesized
gcccagcaaggatttatttt

SEQ ID NO: 436061 - DNA, 20 bp, Artificial Sequence
  chemically synthesized
cccagcaaggatttattttc

SEQ ID NO: 436062 - DNA, 20 bp, Artificial Sequence
  chemically synthesized
ccagcaaggatttattttca

SEQ ID NO: 436063 - DNA, 20 bp, Artificial Sequence
  chemically synthesized
agcaaggatttattttcagg

SEQ ID NO: 436064 - DNA, 20 bp, Artificial Sequence
  chemically synthesized
aggatttattttcagggagc

SEQ ID NO: 436065 - DNA, 20 bp, Artificial Sequence
  chemically synthesized
ggctgatctctgcataatac

SEQ ID NO: 436066 - DNA, 20 bp, Artificial Sequence
  chemically synthesized
ttcagggagccagtattatg

SEQ ID NO: 436067 - DNA, 20 bp, Artificial Sequence
  chemically synthesized
cagggagccagtattatgca

SEQ ID NO: 436068 - DNA, 20 bp, Artificial Sequence
  chemically synthesized
agccagtattatgcagagat

SEQ ID NO: 436069 - DNA, 20 bp, Artificial Sequence
  chemically synthesized
atgcagagatcagcctgctt

SEQ ID NO: 436070 - DNA, 20 bp, Artificial Sequence
  chemically synthesized
gacactgtattttctaaagc

SEQ ID NO: 436071 - DNA, 20 bp, Artificial Sequence
  chemically synthesized
agacactgtattttctaaag

SEQ ID NO: 436072 - DNA, 20 bp, Artificial Sequence
  chemically synthesized
gagagacactgtattttcta

SEQ ID NO: 436073 - DNA, 20 bp, Artificial Sequence
  chemically synthesized
tcagcctgctttagaaaata

SEQ ID NO: 436074 - DNA, 20 bp, Artificial Sequence
  chemically synthesized
aatggtgcactcattcatga

SEQ ID NO: 436075 - DNA, 20 bp, Artificial Sequence
  chemically synthesized
atacagtgtctctcatgaat

SEQ ID NO: 436076 - DNA, 20 bp, Artificial Sequence
  chemically synthesized
caaatggtgcactcattcat

SEQ ID NO: 436077 - DNA, 20 bp, Artificial Sequence
  chemically synthesized
aatagattatttttggcaaa

SEQ ID NO: 436078 - DNA, 20 bp, Artificial Sequence
  chemically synthesized
aagatacaatagattatttt

SEQ ID NO: 436079 - DNA, 20 bp, Artificial Sequence
  chemically synthesized
ggcctgagaagaagatacaa

SEQ ID NO: 436080 - DNA, 20 bp, Artificial Sequence
  chemically synthesized
aatctattgtatcttcttct

SEQ ID NO: 436081 - DNA, 20 bp, Artificial Sequence
  chemically synthesized
atctattgtatcttcttctc

SEQ ID NO: 436082 - DNA, 20 bp, Artificial Sequence
  chemically synthesized
ttaattattggcctgagaag

SEQ ID NO: 436083 - DNA, 20 bp, Artificial Sequence
  chemically synthesized
tttttaattattggcctgag

SEQ ID NO: 436084 - DNA, 20 bp, Artificial Sequence
  chemically synthesized
acatttttaattattggcct

SEQ ID NO: 436085 - DNA, 20 bp, Artificial Sequence
  chemically synthesized
tataatacatttttaattat

SEQ ID NO: 436086 - DNA, 20 bp, Artificial Sequence
  chemically synthesized
taaaaatgtattatactcca

SEQ ID NO: 436087 - DNA, 20 bp, Artificial Sequence
  chemically synthesized
tttatttacgtttttctttg

SEQ ID NO: 436088 - DNA, 20 bp, Artificial Sequence
  chemically synthesized
tttttatttacgtttttctt

SEQ ID NO: 436089 - DNA, 20 bp, Artificial Sequence
  chemically synthesized
aaagaaaaacgtaaataaaa

SEQ ID NO: 436090 - DNA, 20 bp, Artificial Sequence
  chemically synthesized
caataaccatataattttac

SEQ ID NO: 436091 - DNA, 20 bp, Artificial Sequence
  chemically synthesized
acaataaccatataatttta

SEQ ID NO: 436092 - DNA, 20 bp, Artificial Sequence
  chemically synthesized
gacaatcctgtaaaattata

SEQ ID NO: 436093 - DNA, 20 bp, Artificial Sequence
  chemically synthesized
atattaaaaacgtttttgta

SEQ ID NO: 436094 - DNA, 20 bp, Artificial Sequence
  chemically synthesized
caatattaaaaacgtttttg

SEQ ID NO: 436095 - DNA, 20 bp, Artificial Sequence
  chemically synthesized
aatatgtaaacattcaaatt

SEQ ID NO: 436096 - DNA, 20 bp, Artificial Sequence
  chemically synthesized
atatgtaaacattcaaattg

SEQ ID NO: 436097 - DNA, 20 bp, Artificial Sequence
  chemically synthesized
atgtaaacattcaaattgag

SEQ ID NO: 436098 - DNA, 20 bp, Artificial Sequence
  chemically synthesized
aaacattcaaattgaggagc

SEQ ID NO: 436099 - DNA, 20 bp, Artificial Sequence
  chemically synthesized
tcaaattgaggagcaagttt

SEQ ID NO: 436100 - DNA, 20 bp, Artificial Sequence
  chemically synthesized
aaattgaggagcaagtttta

SEQ ID NO: 436101 - DNA, 20 bp, Artificial Sequence
  chemically synthesized
ttgaggagcaagttttagag

SEQ ID NO: 436102 - DNA, 20 bp, Artificial Sequence
  chemically synthesized
tgaggagcaagttttagagt

SEQ ID NO: 436103 - DNA, 20 bp, Artificial Sequence
  chemically synthesized
gaggagcaagttttagagta

SEQ ID NO: 436104 - DNA, 20 bp, Artificial Sequence
  chemically synthesized
agtggcagatatgagatttt

SEQ ID NO: 436105 - DNA, 20 bp, Artificial Sequence
  chemically synthesized
aactaataagtggcagatat

SEQ ID NO: 436106 - DNA, 20 bp, Artificial Sequence
  chemically synthesized
gccatataactaataagtgg

SEQ ID NO: 436107 - DNA, 20 bp, Artificial Sequence
  chemically synthesized
atctcatatctgccacttat

SEQ ID NO: 436108 - DNA, 20 bp, Artificial Sequence
  chemically synthesized
aaggccatataactaataag

SEQ ID NO: 436109 - DNA, 20 bp, Artificial Sequence
  chemically synthesized
ctcaaggccatataactaat

SEQ ID NO: 436110 - DNA, 20 bp, Artificial Sequence
  chemically synthesized
tctgccacttattagttata

SEQ ID NO: 436111 - DNA, 20 bp, Artificial Sequence
  chemically synthesized
cttattagttatatggcctt

SEQ ID NO: 436112 - DNA, 20 bp, Artificial Sequence
  chemically synthesized
ttagttatatggccttgaga

SEQ ID NO: 436113 - DNA, 20 bp, Artificial Sequence
  chemically synthesized
gtgcttaagtaactttctca

SEQ ID NO: 436114 - DNA, 20 bp, Artificial Sequence
  chemically synthesized
agtgcttaagtaactttctc

SEQ ID NO: 436115 - DNA, 20 bp, Artificial Sequence
  chemically synthesized
tggccttgagaaagttactt

SEQ ID NO: 436116 - DNA, 20 bp, Artificial Sequence
  chemically synthesized
aaaaccgaagcacagtgctt

SEQ ID NO: 436117 - DNA, 20 bp, Artificial Sequence
  chemically synthesized
gttacttaagcactgtgctt

SEQ ID NO: 436118 - DNA, 20 bp, Artificial Sequence
  chemically synthesized
taaaaaacaaaaccgaagca

SEQ ID NO: 436119 - DNA, 20 bp, Artificial Sequence
  chemically synthesized
gagattaaaaaacaaaaccg

SEQ ID NO: 436120 - DNA, 20 bp, Artificial Sequence
  chemically synthesized
ttgttttttaatctctaaaa

SEQ ID NO: 436121 - DNA, 20 bp, Artificial Sequence
  chemically synthesized
tgttttttaatctctaaaat

SEQ ID NO: 436122 - DNA, 20 bp, Artificial Sequence
  chemically synthesized
aaagaatacttcccatttta

SEQ ID NO: 436123 - DNA, 20 bp, Artificial Sequence
  chemically synthesized
tttttaatctctaaaatggg

SEQ ID NO: 436124 - DNA, 20 bp, Artificial Sequence
  chemically synthesized
ggaaagaatacttcccattt

SEQ ID NO: 436125 - DNA, 20 bp, Artificial Sequence
  chemically synthesized
tcagaaccagatcatgagga

SEQ ID NO: 436126 - DNA, 20 bp, Artificial Sequence
  chemically synthesized
agtattctttcctcatgatc

SEQ ID NO: 436127 - DNA, 20 bp, Artificial Sequence
  chemically synthesized
attttcagaaccagatcatg

SEQ ID NO: 436128 - DNA, 20 bp, Artificial Sequence
  chemically synthesized
aattttcagaaccagatcat

SEQ ID NO: 436129 - DNA, 20 bp, Artificial Sequence
  chemically synthesized
cctcatttaattttcagaac

SEQ ID NO: 436130 - DNA, 20 bp, Artificial Sequence
  chemically synthesized
tttgtgcctcatttaatttt

SEQ ID NO: 436131 - DNA, 20 bp, Artificial Sequence
  chemically synthesized
tctggttctgaaaattaaat

SEQ ID NO: 436132 - DNA, 20 bp, Artificial Sequence
  chemically synthesized
ctggttctgaaaattaaatg

SEQ ID NO: 436133 - DNA, 20 bp, Artificial Sequence
  chemically synthesized
cacaaatattcacactcccc

SEQ ID NO: 436134 - DNA, 20 bp, Artificial Sequence
  chemically synthesized
acaaatattcacactccccc

SEQ ID NO: 436135 - DNA, 20 bp, Artificial Sequence
  chemically synthesized
caaatattcacactccccca

SEQ ID NO: 436136 - DNA, 20 bp, Artificial Sequence
  chemically synthesized
aggattagagaaccctgggg

SEQ ID NO: 436137 - DNA, 20 bp, Artificial Sequence
  chemically synthesized
aaaggattagagaaccctgg

SEQ ID NO: 436138 - DNA, 20 bp, Artificial Sequence
  chemically synthesized
gaaaggattagagaaccctg

SEQ ID NO: 436139 - DNA, 20 bp, Artificial Sequence
  chemically synthesized
ggaaaggattagagaaccct

SEQ ID NO: 436140 - DNA, 20 bp, Artificial Sequence
  chemically synthesized
aggaaaggattagagaaccc

SEQ ID NO: 436141 - DNA, 20 bp, Artificial Sequence
  chemically synthesized
cactatcaaggaaaggatta

SEQ ID NO: 436142 - DNA, 20 bp, Artificial Sequence
  chemically synthesized
tacactatcaaggaaaggat

SEQ ID NO: 436143 - DNA, 20 bp, Artificial Sequence
  chemically synthesized
gggaatacactatcaaggaa

SEQ ID NO: 436144 - DNA, 20 bp, Artificial Sequence
  chemically synthesized
ttctctaatcctttccttga

SEQ ID NO: 436145 - DNA, 20 bp, Artificial Sequence
  chemically synthesized
agggaatacactatcaagga

SEQ ID NO: 436146 - DNA, 20 bp, Artificial Sequence
  chemically synthesized
acggagggaatacactatca

SEQ ID NO: 436147 - DNA, 20 bp, Artificial Sequence
  chemically synthesized
aacggagggaatacactatc

SEQ ID NO: 436148 - DNA, 20 bp, Artificial Sequence
  chemically synthesized
tgatagtgtattccctccgt

SEQ ID NO: 436149 - DNA, 20 bp, Artificial Sequence
  chemically synthesized
agaacgagatttctaacgga

SEQ ID NO: 436150 - DNA, 20 bp, Artificial Sequence
  chemically synthesized
gagaacgagatttctaacgg

SEQ ID NO: 436151 - DNA, 20 bp, Artificial Sequence
  chemically synthesized
agagaacgagatttctaacg

SEQ ID NO: 436152 - DNA, 20 bp, Artificial Sequence
  chemically synthesized
gaagagaacgagatttctaa

SEQ ID NO: 436153 - DNA, 20 bp, Artificial Sequence
  chemically synthesized
ttgaagttaaagaagagaac

SEQ ID NO: 436154 - DNA, 20 bp, Artificial Sequence
  chemically synthesized
tgatagttgaagttaaagaa

SEQ ID NO: 436155 - DNA, 20 bp, Artificial Sequence
  chemically synthesized
gatgatagttgaagttaaag

SEQ ID NO: 436156 - DNA, 20 bp, Artificial Sequence
  chemically synthesized
atagatgatagttgaagtta

SEQ ID NO: 436157 - DNA, 20 bp, Artificial Sequence
  chemically synthesized
atggagatagatgatagttg

SEQ ID NO: 436158 - DNA, 20 bp, Artificial Sequence
  chemically synthesized
acttacatggagatagatga

SEQ ID NO: 436159 - DNA, 20 bp, Artificial Sequence
  chemically synthesized
gagaatcacttacatggaga

SEQ ID NO: 436160 - DNA, 20 bp, Artificial Sequence
  chemically synthesized
actatcatctatctccatgt

SEQ ID NO: 436161 - DNA, 20 bp, Artificial Sequence
  chemically synthesized
acttgagaatcacttacatg

SEQ ID NO: 436162 - DNA, 20 bp, Artificial Sequence
  chemically synthesized
atacttgagaatcacttaca

SEQ ID NO: 436163 - DNA, 20 bp, Artificial Sequence
  chemically synthesized
tctccatgtaagtgattctc

SEQ ID NO: 436164 - DNA, 20 bp, Artificial Sequence
  chemically synthesized
gacttaagagagaaatactt

SEQ ID NO: 436165 - DNA, 20 bp, Artificial Sequence
  chemically synthesized
ttctcaagtatttctctctt

SEQ ID NO: 436166 - DNA, 20 bp, Artificial Sequence
  chemically synthesized
ctaaagagttagacttaaga

SEQ ID NO: 436167 - DNA, 20 bp, Artificial Sequence
  chemically synthesized
aactaaagagttagacttaa

SEQ ID NO: 436168 - DNA, 20 bp, Artificial Sequence
  chemically synthesized
aaaactaaagagttagactt

SEQ ID NO: 436169 - DNA, 20 bp, Artificial Sequence
  chemically synthesized
ctctcttaagtctaactctt

SEQ ID NO: 436170 - DNA, 20 bp, Artificial Sequence
  chemically synthesized
gaggactaaaactaaagagt

SEQ ID NO: 436171 - DNA, 20 bp, Artificial Sequence
  chemically synthesized
gggggaggactaaaactaaa

SEQ ID NO: 436172 - DNA, 20 bp, Artificial Sequence
  chemically synthesized
taagtctaactctttagttt

SEQ ID NO: 436173 - DNA, 20 bp, Artificial Sequence
  chemically synthesized
gtgggggaggactaaaacta

SEQ ID NO: 436174 - DNA, 20 bp, Artificial Sequence
  chemically synthesized
aataaaagtttttgtggggg

SEQ ID NO: 436175 - DNA, 20 bp, Artificial Sequence
  chemically synthesized
taataaaagtttttgtgggg

SEQ ID NO: 436176 - DNA, 20 bp, Artificial Sequence
  chemically synthesized
gataataaaagtttttgtgg

SEQ ID NO: 436177 - DNA, 20 bp, Artificial Sequence
  chemically synthesized
agataataaaagtttttgtg

SEQ ID NO: 436178 - DNA, 20 bp, Artificial Sequence
  chemically synthesized
tagataataaaagtttttgt

SEQ ID NO: 436179 - DNA, 20 bp, Artificial Sequence
  chemically synthesized
gtagataataaaagtttttg

SEQ ID NO: 436180 - DNA, 20 bp, Artificial Sequence
  chemically synthesized
tccaggtgggtagataataa

SEQ ID NO: 436181 - DNA, 20 bp, Artificial Sequence
  chemically synthesized
acttttattatctacccacc

SEQ ID NO: 436182 - DNA, 20 bp, Artificial Sequence
  chemically synthesized
tgatgggctatccaggtggg

SEQ ID NO: 436183 - DNA, 20 bp, Artificial Sequence
  chemically synthesized
ttattatctacccacctgga

SEQ ID NO: 436184 - DNA, 20 bp, Artificial Sequence
  chemically synthesized
tgttgatgggctatccaggt

SEQ ID NO: 436185 - DNA, 20 bp, Artificial Sequence
  chemically synthesized
ttgttgatgggctatccagg

SEQ ID NO: 436186 - DNA, 20 bp, Artificial Sequence
  chemically synthesized
gaattgttgatgggctatcc

SEQ ID NO: 436187 - DNA, 20 bp, Artificial Sequence
  chemically synthesized
agaattgttgatgggctatc

SEQ ID NO: 436188 - DNA, 20 bp, Artificial Sequence
  chemically synthesized
atcaacttagaattgttgat

SEQ ID NO: 436189 - DNA, 20 bp, Artificial Sequence
  chemically synthesized
catcaacttagaattgttga

SEQ ID NO: 436190 - DNA, 20 bp, Artificial Sequence
  chemically synthesized
gatagcccatcaacaattct

SEQ ID NO: 436191 - DNA, 20 bp, Artificial Sequence
  chemically synthesized
tttgttttgagacatcaact

SEQ ID NO: 436192 - DNA, 20 bp, Artificial Sequence
  chemically synthesized
aagttgatgtctcaaaacaa

SEQ ID NO: 436193 - DNA, 20 bp, Artificial Sequence
  chemically synthesized
ggaaaagggccttttgtttt

SEQ ID NO: 436194 - DNA, 20 bp, Artificial Sequence
  chemically synthesized
agttgatgtctcaaaacaaa

SEQ ID NO: 436195 - DNA, 20 bp, Artificial Sequence
  chemically synthesized
attggaggggaaggggaaaa

SEQ ID NO: 436196 - DNA, 20 bp, Artificial Sequence
  chemically synthesized
aattggaggggaaggggaaa

SEQ ID NO: 436197 - DNA, 20 bp, Artificial Sequence
  chemically synthesized
aaattggaggggaaggggaa

SEQ ID NO: 436198 - DNA, 20 bp, Artificial Sequence
  chemically synthesized
gatcaaaattggaggggaag

SEQ ID NO: 436199 - DNA, 20 bp, Artificial Sequence
  chemically synthesized
ggatcaaaattggaggggaa

SEQ ID NO: 436200 - DNA, 20 bp, Artificial Sequence
  chemically synthesized
aggatcaaaattggagggga

SEQ ID NO: 436201 - DNA, 20 bp, Artificial Sequence
  chemically synthesized
taggatcaaaattggagggg

SEQ ID NO: 436202 - DNA, 20 bp, Artificial Sequence
  chemically synthesized
gaataggatcaaaattggag

SEQ ID NO: 436203 - DNA, 20 bp, Artificial Sequence
  chemically synthesized
ggaataggatcaaaattgga

SEQ ID NO: 436204 - DNA, 20 bp, Artificial Sequence
  chemically synthesized
aggaataggatcaaaattgg

SEQ ID NO: 436205 - DNA, 20 bp, Artificial Sequence
  chemically synthesized
caggaataggatcaaaattg

SEQ ID NO: 436206 - DNA, 20 bp, Artificial Sequence
  chemically synthesized
accaggaataggatcaaaat

SEQ ID NO: 436207 - DNA, 20 bp, Artificial Sequence
  chemically synthesized
tccaattttgatcctattcc

SEQ ID NO: 436208 - DNA, 20 bp, Artificial Sequence
  chemically synthesized
gaagtagagaaaccaggaat

SEQ ID NO: 436209 - DNA, 20 bp, Artificial Sequence
  chemically synthesized
agaagtagagaaaccaggaa

SEQ ID NO: 436210 - DNA, 20 bp, Artificial Sequence
  chemically synthesized
ttaacagaagtagagaaacc

SEQ ID NO: 436211 - DNA, 20 bp, Artificial Sequence
  chemically synthesized
attaacagaagtagagaaac

SEQ ID NO: 436212 - DNA, 20 bp, Artificial Sequence
  chemically synthesized
tggtaacattaacagaagta

SEQ ID NO: 436213 - DNA, 20 bp, Artificial Sequence
  chemically synthesized
gatggtaacattaacagaag

SEQ ID NO: 436214 - DNA, 20 bp, Artificial Sequence
  chemically synthesized
gatgatggtaacattaacag

SEQ ID NO: 436215 - DNA, 20 bp, Artificial Sequence
  chemically synthesized
tgagatgatggtaacattaa

SEQ ID NO: 436216 - DNA, 20 bp, Artificial Sequence
  chemically synthesized
gtgaggaactggtgagatga

SEQ ID NO: 436217 - DNA, 20 bp, Artificial Sequence
  chemically synthesized
taatgttaccatcatctcac

SEQ ID NO: 436218 - DNA, 20 bp, Artificial Sequence
  chemically synthesized
aatcaccgtgaggaactggt

SEQ ID NO: 436219 - DNA, 20 bp, Artificial Sequence
  chemically synthesized
agctaatcaccgtgaggaac

SEQ ID NO: 436220 - DNA, 20 bp, Artificial Sequence
  chemically synthesized
atcatctcaccagttcctca

SEQ ID NO: 436221 - DNA, 20 bp, Artificial Sequence
  chemically synthesized
gttaatagctaatcaccgtg

SEQ ID NO: 436222 - DNA, 20 bp, Artificial Sequence
  chemically synthesized
tgttaatagctaatcaccgt

SEQ ID NO: 436223 - DNA, 20 bp, Artificial Sequence
  chemically synthesized
caccagttcctcacggtgat

SEQ ID NO: 436224 - DNA, 20 bp, Artificial Sequence
  chemically synthesized
ggaattcttaaaattgttaa

SEQ ID NO: 436225 - DNA, 20 bp, Artificial Sequence
  chemically synthesized
gattagctattaacaatttt

SEQ ID NO: 436226 - DNA, 20 bp, Artificial Sequence
  chemically synthesized
atgtttaatgaagcatatgt

SEQ ID NO: 436227 - DNA, 20 bp, Artificial Sequence
  chemically synthesized
catttatctaatgtttaatg

SEQ ID NO: 436228 - DNA, 20 bp, Artificial Sequence
  chemically synthesized
acatatgcttcattaaacat

SEQ ID NO: 436229 - DNA, 20 bp, Artificial Sequence
  chemically synthesized
ttcattaaacattagataaa

SEQ ID NO: 436230 - DNA, 20 bp, Artificial Sequence
  chemically synthesized
tcattaaacattagataaat

SEQ ID NO: 436231 - DNA, 20 bp, Artificial Sequence
  chemically synthesized
catttattgactgcatgtta

SEQ ID NO: 436232 - DNA, 20 bp, Artificial Sequence
  chemically synthesized
catggaacttctttaacatg

SEQ ID NO: 436233 - DNA, 20 bp, Artificial Sequence
  chemically synthesized
ttattgactgcatgttaaag

SEQ ID NO: 436234 - DNA, 20 bp, Artificial Sequence
  chemically synthesized
tgcatgttaaagaagttcca

SEQ ID NO: 436235 - DNA, 20 bp, Artificial Sequence
  chemically synthesized
ttcccaaactcatttcacca

SEQ ID NO: 436236 - DNA, 20 bp, Artificial Sequence
  chemically synthesized
aagaagttccatggtgaaat

SEQ ID NO: 436237 - DNA, 20 bp, Artificial Sequence
  chemically synthesized
gttccatggtgaaatgagtt

SEQ ID NO: 436238 - DNA, 20 bp, Artificial Sequence
  chemically synthesized
ttccatggtgaaatgagttt

SEQ ID NO: 436239 - DNA, 20 bp, Artificial Sequence
  chemically synthesized
gtgaaatgagtttgggaaac

SEQ ID NO: 436240 - DNA, 20 bp, Artificial Sequence
  chemically synthesized
tgaaatgagtttgggaaact

SEQ ID NO: 436241 - DNA, 20 bp, Artificial Sequence
  chemically synthesized
agtttgggaaactaggttaa

SEQ ID NO: 436242 - DNA, 20 bp, Artificial Sequence
  chemically synthesized
cagctgtttaacttttaacc

SEQ ID NO: 436243 - DNA, 20 bp, Artificial Sequence
  chemically synthesized
aaactaggttaaaagttaaa

SEQ ID NO: 436244 - DNA, 20 bp, Artificial Sequence
  chemically synthesized
ctggaatcctgcaggaaaga

SEQ ID NO: 436245 - DNA, 20 bp, Artificial Sequence
  chemically synthesized
ttaaacagctgtctttcctg

SEQ ID NO: 436246 - DNA, 20 bp, Artificial Sequence
  chemically synthesized
taaacagctgtctttcctgc

SEQ ID NO: 436247 - DNA, 20 bp, Artificial Sequence
  chemically synthesized
tgctctggaatcctgcagga

SEQ ID NO: 436248 - DNA, 20 bp, Artificial Sequence
  chemically synthesized
aagatgctctggaatcctgc

SEQ ID NO: 436249 - DNA, 20 bp, Artificial Sequence
  chemically synthesized
aaagatgctctggaatcctg

SEQ ID NO: 436250 - DNA, 20 bp, Artificial Sequence
  chemically synthesized
ctgtctttcctgcaggattc

SEQ ID NO: 436251 - DNA, 20 bp, Artificial Sequence
  chemically synthesized
gtctttcctgcaggattcca

SEQ ID NO: 436252 - DNA, 20 bp, Artificial Sequence
  chemically synthesized
atgcatatgcaaagatgctc

SEQ ID NO: 436253 - DNA, 20 bp, Artificial Sequence
  chemically synthesized
ctcaatgtaatgcatatgca

SEQ ID NO: 436254 - DNA, 20 bp, Artificial Sequence
  chemically synthesized
ctttgcatatgcattacatt

SEQ ID NO: 436255 - DNA, 20 bp, Artificial Sequence
  chemically synthesized
gcattacattgagaaactct

SEQ ID NO: 436256 - DNA, 20 bp, Artificial Sequence
  chemically synthesized
cattacattgagaaactcta

SEQ ID NO: 436257 - DNA, 20 bp, Artificial Sequence
  chemically synthesized
attacattgagaaactctaa

SEQ ID NO: 436258 - DNA, 20 bp, Artificial Sequence
  chemically synthesized
ttacattgagaaactctaag

SEQ ID NO: 436259 - DNA, 20 bp, Artificial Sequence
  chemically synthesized
ctacatactaaatcccctta

SEQ ID NO: 436260 - DNA, 20 bp, Artificial Sequence
  chemically synthesized
tactacatactaaatcccct

SEQ ID NO: 436261 - DNA, 20 bp, Artificial Sequence
  chemically synthesized
tgagaaactctaaggggatt

SEQ ID NO: 436262 - DNA, 20 bp, Artificial Sequence
  chemically synthesized
ctctaaggggatttagtatg

SEQ ID NO: 436263 - DNA, 20 bp, Artificial Sequence
  chemically synthesized
ttagtatgtagtattcccct

SEQ ID NO: 436264 - DNA, 20 bp, Artificial Sequence
  chemically synthesized
tctttagtcataaaactgag

SEQ ID NO: 436265 - DNA, 20 bp, Artificial Sequence
  chemically synthesized
ttctttagtcataaaactga

SEQ ID NO: 436266 - DNA, 20 bp, Artificial Sequence
  chemically synthesized
cttctttagtcataaaactg

SEQ ID NO: 436267 - DNA, 20 bp, Artificial Sequence
  chemically synthesized
acttctttagtcataaaact

SEQ ID NO: 436268 - DNA, 20 bp, Artificial Sequence
  chemically synthesized
tcccctcagttttatgacta

SEQ ID NO: 436269 - DNA, 20 bp, Artificial Sequence
  chemically synthesized
cctcagttttatgactaaag

SEQ ID NO: 436270 - DNA, 20 bp, Artificial Sequence
  chemically synthesized
gcccccaaaaaagacttctt

SEQ ID NO: 436271 - DNA, 20 bp, Artificial Sequence
  chemically synthesized
atgactaaagaagtcttttt

SEQ ID NO: 436272 - DNA, 20 bp, Artificial Sequence
  chemically synthesized
tgactaaagaagtctttttt

SEQ ID NO: 436273 - DNA, 20 bp, Artificial Sequence
  chemically synthesized
gactaaagaagtcttttttg

SEQ ID NO: 436274 - DNA, 20 bp, Artificial Sequence
  chemically synthesized
actaaagaagtcttttttgg

SEQ ID NO: 436275 - DNA, 20 bp, Artificial Sequence
  chemically synthesized
ttggccccacgcccccaaaa

SEQ ID NO: 436276 - DNA, 20 bp, Artificial Sequence
  chemically synthesized
agaagtcttttttgggggcg

SEQ ID NO: 436277 - DNA, 20 bp, Artificial Sequence
  chemically synthesized
gaagtcttttttgggggcgt

SEQ ID NO: 436278 - DNA, 20 bp, Artificial Sequence
  chemically synthesized
aagtcttttttgggggcgtg

SEQ ID NO: 436279 - DNA, 20 bp, Artificial Sequence
  chemically synthesized
tttgggggcgtggggccaaa

SEQ ID NO: 436280 - DNA, 20 bp, Artificial Sequence
  chemically synthesized
tgggggcgtggggccaaaca

SEQ ID NO: 436281 - DNA, 20 bp, Artificial Sequence
  chemically synthesized
gggggcgtggggccaaacag

SEQ ID NO: 436282 - DNA, 20 bp, Artificial Sequence
  chemically synthesized
ggggcgtggggccaaacaga

SEQ ID NO: 436283 - DNA, 20 bp, Artificial Sequence
  chemically synthesized
gggcgtggggccaaacagag

SEQ ID NO: 436284 - DNA, 20 bp, Artificial Sequence
  chemically synthesized
cattatgggccccctctgtt

SEQ ID NO: 436285 - DNA, 20 bp, Artificial Sequence
  chemically synthesized
ggcgtggggccaaacagagg

SEQ ID NO: 436286 - DNA, 20 bp, Artificial Sequence
  chemically synthesized
gcacagtaattattcattat

SEQ ID NO: 436287 - DNA, 20 bp, Artificial Sequence
  chemically synthesized
ggcacagtaattattcatta

SEQ ID NO: 436288 - DNA, 20 bp, Artificial Sequence
  chemically synthesized
aatgaataattactgtgcca

SEQ ID NO: 436289 - DNA, 20 bp, Artificial Sequence
  chemically synthesized
tgaataattactgtgccata

SEQ ID NO: 436290 - DNA, 20 bp, Artificial Sequence
  chemically synthesized
cccaagagtgctctatggca

SEQ ID NO: 436291 - DNA, 20 bp, Artificial Sequence
  chemically synthesized
aatcccccaagagtgctcta

SEQ ID NO: 436292 - DNA, 20 bp, Artificial Sequence
  chemically synthesized
actgtgccatagagcactct

SEQ ID NO: 436293 - DNA, 20 bp, Artificial Sequence
  chemically synthesized
ctgtgccatagagcactctt

SEQ ID NO: 436294 - DNA, 20 bp, Artificial Sequence
  chemically synthesized
tgtgccatagagcactcttg

SEQ ID NO: 436295 - DNA, 20 bp, Artificial Sequence
  chemically synthesized
gtgccatagagcactcttgg

SEQ ID NO: 436296 - DNA, 20 bp, Artificial Sequence
  chemically synthesized
ccctgatattaatcccccaa

SEQ ID NO: 436297 - DNA, 20 bp, Artificial Sequence
  chemically synthesized
ctccctgatattaatccccc

SEQ ID NO: 436298 - DNA, 20 bp, Artificial Sequence
  chemically synthesized
cactcttgggggattaatat

SEQ ID NO: 436299 - DNA, 20 bp, Artificial Sequence
  chemically synthesized
actcttgggggattaatatc

SEQ ID NO: 436300 - DNA, 20 bp, Artificial Sequence
  chemically synthesized
ctcttgggggattaatatca

SEQ ID NO: 436301 - DNA, 20 bp, Artificial Sequence
  chemically synthesized
cttgggggattaatatcagg

SEQ ID NO: 436302 - DNA, 20 bp, Artificial Sequence
  chemically synthesized
ggaaaagggaataatgatag

SEQ ID NO: 436303 - DNA, 20 bp, Artificial Sequence
  chemically synthesized
tgaggaaaagggaataatga

SEQ ID NO: 436304 - DNA, 20 bp, Artificial Sequence
  chemically synthesized
attgtgggagatgaggaaaa

SEQ ID NO: 436305 - DNA, 20 bp, Artificial Sequence
  chemically synthesized
aattgtgggagatgaggaaa

SEQ ID NO: 436306 - DNA, 20 bp, Artificial Sequence
  chemically synthesized
aaattgtgggagatgaggaa

SEQ ID NO: 436307 - DNA, 20 bp, Artificial Sequence
  chemically synthesized
ttgctaaattgtgggagatg

SEQ ID NO: 436308 - DNA, 20 bp, Artificial Sequence
  chemically synthesized
gttgctaaattgtgggagat

SEQ ID NO: 436309 - DNA, 20 bp, Artificial Sequence
  chemically synthesized
aagttgttgctaaattgtgg

SEQ ID NO: 436310 - DNA, 20 bp, Artificial Sequence
  chemically synthesized
tttcctcatctcccacaatt

SEQ ID NO: 436311 - DNA, 20 bp, Artificial Sequence
  chemically synthesized
gtaagttgttgctaaattgt

SEQ ID NO: 436312 - DNA, 20 bp, Artificial Sequence
  chemically synthesized
agtaagttgttgctaaattg

SEQ ID NO: 436313 - DNA, 20 bp, Artificial Sequence
  chemically synthesized
gaaccaaattatttggtagt

SEQ ID NO: 436314 - DNA, 20 bp, Artificial Sequence
  chemically synthesized
aggagaaccaaattatttgg

SEQ ID NO: 436315 - DNA, 20 bp, Artificial Sequence
  chemically synthesized
caacttactaccaaataatt

SEQ ID NO: 436316 - DNA, 20 bp, Artificial Sequence
  chemically synthesized
acaaggagaaccaaattatt

SEQ ID NO: 436317 - DNA, 20 bp, Artificial Sequence
  chemically synthesized
tgagatagggattcaacaag

SEQ ID NO: 436318 - DNA, 20 bp, Artificial Sequence
  chemically synthesized
aatgagatagggattcaaca

SEQ ID NO: 436319 - DNA, 20 bp, Artificial Sequence
  chemically synthesized
gaatgagatagggattcaac

SEQ ID NO: 436320 - DNA, 20 bp, Artificial Sequence
  chemically synthesized
cagtagctcagaatgagata

SEQ ID NO: 436321 - DNA, 20 bp, Artificial Sequence
  chemically synthesized
gcagtagctcagaatgagat

SEQ ID NO: 436322 - DNA, 20 bp, Artificial Sequence
  chemically synthesized
agcagtagctcagaatgaga

SEQ ID NO: 436323 - DNA, 20 bp, Artificial Sequence
  chemically synthesized
ttgaatccctatctcattct

SEQ ID NO: 436324 - DNA, 20 bp, Artificial Sequence
  chemically synthesized
caaaagcagtagctcagaat

SEQ ID NO: 436325 - DNA, 20 bp, Artificial Sequence
  chemically synthesized
gatttacaaaagcagtagct

SEQ ID NO: 436326 - DNA, 20 bp, Artificial Sequence
  chemically synthesized
ggccagatttacaaaagcag

SEQ ID NO: 436327 - DNA, 20 bp, Artificial Sequence
  chemically synthesized
ctaggccagatttacaaaag

SEQ ID NO: 436328 - DNA, 20 bp, Artificial Sequence
  chemically synthesized
agcctaggccagatttacaa

SEQ ID NO: 436329 - DNA, 20 bp, Artificial Sequence
  chemically synthesized
agctactgcttttgtaaatc

SEQ ID NO: 436330 - DNA, 20 bp, Artificial Sequence
  chemically synthesized
ctgcttttgtaaatctggcc

SEQ ID NO: 436331 - DNA, 20 bp, Artificial Sequence
  chemically synthesized
tgcttttgtaaatctggcct

SEQ ID NO: 436332 - DNA, 20 bp, Artificial Sequence
  chemically synthesized
agcctacatgtagcctaggc

SEQ ID NO: 436333 - DNA, 20 bp, Artificial Sequence
  chemically synthesized
ggagagcctacatgtagcct

SEQ ID NO: 436334 - DNA, 20 bp, Artificial Sequence
  chemically synthesized
aggagagcctacatgtagcc

SEQ ID NO: 436335 - DNA, 20 bp, Artificial Sequence
  chemically synthesized
aatctggcctaggctacatg

SEQ ID NO: 436336 - DNA, 20 bp, Artificial Sequence
  chemically synthesized
atctggcctaggctacatgt

SEQ ID NO: 436337 - DNA, 20 bp, Artificial Sequence
  chemically synthesized
gtgaaaggagagcctacatg

SEQ ID NO: 436338 - DNA, 20 bp, Artificial Sequence
  chemically synthesized
aagaaaaggcagtgaaagga

SEQ ID NO: 436339 - DNA, 20 bp, Artificial Sequence
  chemically synthesized
ataagaaaaggcagtgaaag

SEQ ID NO: 436340 - DNA, 20 bp, Artificial Sequence
  chemically synthesized
gaataagaaaaggcagtgaa

SEQ ID NO: 436341 - DNA, 20 bp, Artificial Sequence
  chemically synthesized
agaataagaaaaggcagtga

SEQ ID NO: 436342 - DNA, 20 bp, Artificial Sequence
  chemically synthesized
gatgttagaataagaaaagg

SEQ ID NO: 436343 - DNA, 20 bp, Artificial Sequence
  chemically synthesized
tgagatgttagaataagaaa

SEQ ID NO: 436344 - DNA, 20 bp, Artificial Sequence
  chemically synthesized
ttgagatgttagaataagaa

SEQ ID NO: 436345 - DNA, 20 bp, Artificial Sequence
  chemically synthesized
agagtttgagatgttagaat

SEQ ID NO: 436346 - DNA, 20 bp, Artificial Sequence
  chemically synthesized
gaattgagagtttgagatgt

SEQ ID NO: 436347 - DNA, 20 bp, Artificial Sequence
  chemically synthesized
agatattgaattgagagttt

SEQ ID NO: 436348 - DNA, 20 bp, Artificial Sequence
  chemically synthesized
tacagaagatattgaattga

SEQ ID NO: 436349 - DNA, 20 bp, Artificial Sequence
  chemically synthesized
tctacagaagatattgaatt

SEQ ID NO: 436350 - DNA, 20 bp, Artificial Sequence
  chemically synthesized
tctcaattcaatatcttctg

SEQ ID NO: 436351 - DNA, 20 bp, Artificial Sequence
  chemically synthesized
atagatctcaaattctacag

SEQ ID NO: 436352 - DNA, 20 bp, Artificial Sequence
  chemically synthesized
aaaatagatctcaaattcta

SEQ ID NO: 436353 - DNA, 20 bp, Artificial Sequence
  chemically synthesized
caatatcttctgtagaattt

SEQ ID NO: 436354 - DNA, 20 bp, Artificial Sequence
  chemically synthesized
tttgtatctcttacagaaaa

SEQ ID NO: 436355 - DNA, 20 bp, Artificial Sequence
  chemically synthesized
atttgagatctattttctgt

SEQ ID NO: 436356 - DNA, 20 bp, Artificial Sequence
  chemically synthesized
ttgagatctattttctgtaa

SEQ ID NO: 436357 - DNA, 20 bp, Artificial Sequence
  chemically synthesized
acccatctttgtatctctta

SEQ ID NO: 436358 - DNA, 20 bp, Artificial Sequence
  chemically synthesized
tattttctgtaagagataca

SEQ ID NO: 436359 - DNA, 20 bp, Artificial Sequence
  chemically synthesized
ttctgtaagagatacaaaga

SEQ ID NO: 436360 - DNA, 20 bp, Artificial Sequence
  chemically synthesized
tctgtaagagatacaaagat

SEQ ID NO: 436361 - DNA, 20 bp, Artificial Sequence
  chemically synthesized
taagagatacaaagatgggt

SEQ ID NO: 436362 - DNA, 20 bp, Artificial Sequence
  chemically synthesized
tcacagatcccaagacaata

SEQ ID NO: 436363 - DNA, 20 bp, Artificial Sequence
  chemically synthesized
agacatgatctctattgtct

SEQ ID NO: 436364 - DNA, 20 bp, Artificial Sequence
  chemically synthesized
gacatgatctctattgtctt

SEQ ID NO: 436365 - DNA, 20 bp, Artificial Sequence
  chemically synthesized
tctcacagatcccaagacaa

SEQ ID NO: 436366 - DNA, 20 bp, Artificial Sequence
  chemically synthesized
tcccatctctcacagatccc

SEQ ID NO: 436367 - DNA, 20 bp, Artificial Sequence
  chemically synthesized
tctattgtcttgggatctgt

SEQ ID NO: 436368 - DNA, 20 bp, Artificial Sequence
  chemically synthesized
tattgtcttgggatctgtga

SEQ ID NO: 436369 - DNA, 20 bp, Artificial Sequence
  chemically synthesized
gtcttgggatctgtgagaga

SEQ ID NO: 436370 - DNA, 20 bp, Artificial Sequence
  chemically synthesized
tggcctattcccatctctca

SEQ ID NO: 436371 - DNA, 20 bp, Artificial Sequence
  chemically synthesized
tcttgggatctgtgagagat

SEQ ID NO: 436372 - DNA, 20 bp, Artificial Sequence
  chemically synthesized
ggatctgtgagagatgggaa

SEQ ID NO: 436373 - DNA, 20 bp, Artificial Sequence
  chemically synthesized
gatctgtgagagatgggaat

SEQ ID NO: 436374 - DNA, 20 bp, Artificial Sequence
  chemically synthesized
tgtgagagatgggaataggc

SEQ ID NO: 436375 - DNA, 20 bp, Artificial Sequence
  chemically synthesized
gagagatgggaataggccag

SEQ ID NO: 436376 - DNA, 20 bp, Artificial Sequence
  chemically synthesized
gagatgggaataggccagca

SEQ ID NO: 436377 - DNA, 20 bp, Artificial Sequence
  chemically synthesized
aatatatatttgaactctgc

SEQ ID NO: 436378 - DNA, 20 bp, Artificial Sequence
  chemically synthesized
caaatatatattcaatacca

SEQ ID NO: 436379 - DNA, 20 bp, Artificial Sequence
  chemically synthesized
aaatatatattcaataccat

SEQ ID NO: 436380 - DNA, 20 bp, Artificial Sequence
  chemically synthesized
tatattcaataccataggca

SEQ ID NO: 436381 - DNA, 20 bp, Artificial Sequence
  chemically synthesized
atgtggtatgtctatgccta

SEQ ID NO: 436382 - DNA, 20 bp, Artificial Sequence
  chemically synthesized
cttgtttcacaacatttatg

SEQ ID NO: 436383 - DNA, 20 bp, Artificial Sequence
  chemically synthesized
ccacataaatgttgtgaaac

SEQ ID NO: 436384 - DNA, 20 bp, Artificial Sequence
  chemically synthesized
aaatgttgtgaaacaagaaa

SEQ ID NO: 436385 - DNA, 20 bp, Artificial Sequence
  chemically synthesized
tgttgtgaaacaagaaatag

SEQ ID NO: 436386 - DNA, 20 bp, Artificial Sequence
  chemically synthesized
aatagcagtcaatgcttata

SEQ ID NO: 436387 - DNA, 20 bp, Artificial Sequence
  chemically synthesized
atagcagtcaatgcttatat

SEQ ID NO: 436388 - DNA, 20 bp, Artificial Sequence
  chemically synthesized
taatgtaacctttcccatat

SEQ ID NO: 436389 - DNA, 20 bp, Artificial Sequence
  chemically synthesized
cagtcaatgcttatatggga

SEQ ID NO: 436390 - DNA, 20 bp, Artificial Sequence
  chemically synthesized
agtcaatgcttatatgggaa

SEQ ID NO: 436391 - DNA, 20 bp, Artificial Sequence
  chemically synthesized
ttatatgggaaaggttacat

SEQ ID NO: 436392 - DNA, 20 bp, Artificial Sequence
  chemically synthesized
tatatgggaaaggttacatt

SEQ ID NO: 436393 - DNA, 20 bp, Artificial Sequence
  chemically synthesized
aggttacattaggttttttt

SEQ ID NO: 436394 - DNA, 20 bp, Artificial Sequence
  chemically synthesized
ggttacattaggttttttta

SEQ ID NO: 436395 - DNA, 20 bp, Artificial Sequence
  chemically synthesized
tacattaggtttttttaagg

SEQ ID NO: 436396 - DNA, 20 bp, Artificial Sequence
  chemically synthesized
attaggtttttttaaggaag

SEQ ID NO: 436397 - DNA, 20 bp, Artificial Sequence
  chemically synthesized
ttaggtttttttaaggaagt

SEQ ID NO: 436398 - DNA, 20 bp, Artificial Sequence
  chemically synthesized
ttttttaaggaagtgggacc

SEQ ID NO: 436399 - DNA, 20 bp, Artificial Sequence
  chemically synthesized
ttcctggactaatattatcc

SEQ ID NO: 436400 - DNA, 20 bp, Artificial Sequence
  chemically synthesized
gttcctggactaatattatc

SEQ ID NO: 436401 - DNA, 20 bp, Artificial Sequence
  chemically synthesized
aagtgggacctggataatat

SEQ ID NO: 436402 - DNA, 20 bp, Artificial Sequence
  chemically synthesized
ggacctggataatattagtc

SEQ ID NO: 436403 - DNA, 20 bp, Artificial Sequence
  chemically synthesized
gacctggataatattagtcc

SEQ ID NO: 436404 - DNA, 20 bp, Artificial Sequence
  chemically synthesized
atctttcatttagaagttcc

SEQ ID NO: 436405 - DNA, 20 bp, Artificial Sequence
  chemically synthesized
cttttaaatctttcatttag

SEQ ID NO: 436406 - DNA, 20 bp, Artificial Sequence
  chemically synthesized
gtccaggaacttctaaatga

SEQ ID NO: 436407 - DNA, 20 bp, Artificial Sequence
  chemically synthesized
atacttttaaatctttcatt

SEQ ID NO: 436408 - DNA, 20 bp, Artificial Sequence
  chemically synthesized
cttctaaatgaaagatttaa

SEQ ID NO: 436409 - DNA, 20 bp, Artificial Sequence
  chemically synthesized
aaaagtatttatctacccca

SEQ ID NO: 436410 - DNA, 20 bp, Artificial Sequence
  chemically synthesized
tgagaagatagtctttgggg

SEQ ID NO: 436411 - DNA, 20 bp, Artificial Sequence
  chemically synthesized
agatgagaagatagtctttg

SEQ ID NO: 436412 - DNA, 20 bp, Artificial Sequence
  chemically synthesized
aagatgagaagatagtcttt

SEQ ID NO: 436413 - DNA, 20 bp, Artificial Sequence
  chemically synthesized
taagatgagaagatagtctt

SEQ ID NO: 436414 - DNA, 20 bp, Artificial Sequence
  chemically synthesized
tttagtttaagatgagaaga

SEQ ID NO: 436415 - DNA, 20 bp, Artificial Sequence
  chemically synthesized
tatttttagtttaagatgag

SEQ ID NO: 436416 - DNA, 20 bp, Artificial Sequence
  chemically synthesized
acttatttttagtttaagat

SEQ ID NO: 436417 - DNA, 20 bp, Artificial Sequence
  chemically synthesized
tttaaacttatttttagttt

SEQ ID NO: 436418 - DNA, 20 bp, Artificial Sequence
  chemically synthesized
tctcatcttaaactaaaaat

SEQ ID NO: 436419 - DNA, 20 bp, Artificial Sequence
  chemically synthesized
ttatattttaaacttatttt

SEQ ID NO: 436420 - DNA, 20 bp, Artificial Sequence
  chemically synthesized
tttcacaataaaatgctcac

SEQ ID NO: 436421 - DNA, 20 bp, Artificial Sequence
  chemically synthesized
tcacaataaaatgctcactg

SEQ ID NO: 436422 - DNA, 20 bp, Artificial Sequence
  chemically synthesized
tttttcaaagtttctccagt

SEQ ID NO: 436423 - DNA, 20 bp, Artificial Sequence
  chemically synthesized
tatttttttcaaagtttctc

SEQ ID NO: 436424 - DNA, 20 bp, Artificial Sequence
  chemically synthesized
ttacatttttatttttttca

SEQ ID NO: 436425 - DNA, 20 bp, Artificial Sequence
  chemically synthesized
aaaaataaaaatgtaaatat

SEQ ID NO: 436426 - DNA, 20 bp, Artificial Sequence
  chemically synthesized
atgtaaatataagaatattg

SEQ ID NO: 436427 - DNA, 20 bp, Artificial Sequence
  chemically synthesized
ataagaatattgaagtaatc

SEQ ID NO: 436428 - DNA, 20 bp, Artificial Sequence
  chemically synthesized
tctagggtgaaattacacgc

SEQ ID NO: 436429 - DNA, 20 bp, Artificial Sequence
  chemically synthesized
tccagcgtgtaatttcaccc

SEQ ID NO: 436430 - DNA, 20 bp, Artificial Sequence
  chemically synthesized
attagcagtagatgtatcta

SEQ ID NO: 436431 - DNA, 20 bp, Artificial Sequence
  chemically synthesized
cattagcagtagatgtatct

SEQ ID NO: 436432 - DNA, 20 bp, Artificial Sequence
  chemically synthesized
tcattagcagtagatgtatc

SEQ ID NO: 436433 - DNA, 20 bp, Artificial Sequence
  chemically synthesized
atttcacccatcattagcag

SEQ ID NO: 436434 - DNA, 20 bp, Artificial Sequence
  chemically synthesized
gatacatctactgctaatga

SEQ ID NO: 436435 - DNA, 20 bp, Artificial Sequence
  chemically synthesized
aaaatttcacccatcattag

SEQ ID NO: 436436 - DNA, 20 bp, Artificial Sequence
  chemically synthesized
atacatctactgctaatgat

SEQ ID NO: 436437 - DNA, 20 bp, Artificial Sequence
  chemically synthesized
aataaaatttcacccatcat

SEQ ID NO: 436438 - DNA, 20 bp, Artificial Sequence
  chemically synthesized
tgatgggtgaaattttattt

SEQ ID NO: 436439 - DNA, 20 bp, Artificial Sequence
  chemically synthesized
tggatatttgacttgtctac

SEQ ID NO: 436440 - DNA, 20 bp, Artificial Sequence
  chemically synthesized
agaattgttgacttgtagac

SEQ ID NO: 436441 - DNA, 20 bp, Artificial Sequence
  chemically synthesized
tctttagaattgttgacttg

SEQ ID NO: 436442 - DNA, 20 bp, Artificial Sequence
  chemically synthesized
tctacaagtcaacaattcta

SEQ ID NO: 436443 - DNA, 20 bp, Artificial Sequence
  chemically synthesized
agtcaacaattctaaagatt

SEQ ID NO: 436444 - DNA, 20 bp, Artificial Sequence
  chemically synthesized
agctctggaagctaaatctt

SEQ ID NO: 436445 - DNA, 20 bp, Artificial Sequence
  chemically synthesized
aattctaaagatttagcttc

SEQ ID NO: 436446 - DNA, 20 bp, Artificial Sequence
  chemically synthesized
ttctaaagatttagcttcca

SEQ ID NO: 436447 - DNA, 20 bp, Artificial Sequence
  chemically synthesized
ttagaaaactttagctctgg

SEQ ID NO: 436448 - DNA, 20 bp, Artificial Sequence
  chemically synthesized
agatttagcttccagagcta

SEQ ID NO: 436449 - DNA, 20 bp, Artificial Sequence
  chemically synthesized
ttgttagaaaactttagctc

SEQ ID NO: 436450 - DNA, 20 bp, Artificial Sequence
  chemically synthesized
gcattattgttagaaaactt

SEQ ID NO: 436451 - DNA, 20 bp, Artificial Sequence
  chemically synthesized
catttaattggcattattgt

SEQ ID NO: 436452 - DNA, 20 bp, Artificial Sequence
  chemically synthesized
aaccttttaaaacatttaat

SEQ ID NO: 436453 - DNA, 20 bp, Artificial Sequence
  chemically synthesized
atgccaattaaatgttttaa

SEQ ID NO: 436454 - DNA, 20 bp, Artificial Sequence
  chemically synthesized
tgccaattaaatgttttaaa

SEQ ID NO: 436455 - DNA, 20 bp, Artificial Sequence
  chemically synthesized
ttttaaaaggttaattataa

SEQ ID NO: 436456 - DNA, 20 bp, Artificial Sequence
  chemically synthesized
tgttgtgaacaggaggtgac

SEQ ID NO: 436457 - DNA, 20 bp, Artificial Sequence
  chemically synthesized
agcaaaatgttgtgaacagg

SEQ ID NO: 436458 - DNA, 20 bp, Artificial Sequence
  chemically synthesized
aagcaaaatgttgtgaacag

SEQ ID NO: 436459 - DNA, 20 bp, Artificial Sequence
  chemically synthesized
aaaagcaaaatgttgtgaac

SEQ ID NO: 436460 - DNA, 20 bp, Artificial Sequence
  chemically synthesized
gaaaagcaaaatgttgtgaa

SEQ ID NO: 436461 - DNA, 20 bp, Artificial Sequence
  chemically synthesized
ttaagatatatggaaatgaa

SEQ ID NO: 436462 - DNA, 20 bp, Artificial Sequence
  chemically synthesized
agatgtatacttaagatata

SEQ ID NO: 436463 - DNA, 20 bp, Artificial Sequence
  chemically synthesized
ttttcatttccatatatctt

SEQ ID NO: 436464 - DNA, 20 bp, Artificial Sequence
  chemically synthesized
tagctttcagatgtatactt

SEQ ID NO: 436465 - DNA, 20 bp, Artificial Sequence
  chemically synthesized
tatcttaagtatacatctga

SEQ ID NO: 436466 - DNA, 20 bp, Artificial Sequence
  chemically synthesized
tacaacgctcacatagcttt

SEQ ID NO: 436467 - DNA, 20 bp, Artificial Sequence
  chemically synthesized
tatacatctgaaagctatgt

SEQ ID NO: 436468 - DNA, 20 bp, Artificial Sequence
  chemically synthesized
gacaatttacaacgctcaca

SEQ ID NO: 436469 - DNA, 20 bp, Artificial Sequence
  chemically synthesized
tgtgagcgttgtaaattgtc

SEQ ID NO: 436470 - DNA, 20 bp, Artificial Sequence
  chemically synthesized
ttgtcaagttgaacttaaca

SEQ ID NO: 436471 - DNA, 20 bp, Artificial Sequence
  chemically synthesized
aacataaactatactttgtt

SEQ ID NO: 436472 - DNA, 20 bp, Artificial Sequence
  chemically synthesized
aagttgaacttaacaaagta

SEQ ID NO: 436473 - DNA, 20 bp, Artificial Sequence
  chemically synthesized
taacaaagtatagtttatgt

SEQ ID NO: 436474 - DNA, 20 bp, Artificial Sequence
  chemically synthesized
aacaaagtatagtttatgtt

SEQ ID NO: 436475 - DNA, 20 bp, Artificial Sequence
  chemically synthesized
acaaagtatagtttatgttg

SEQ ID NO: 436476 - DNA, 20 bp, Artificial Sequence
  chemically synthesized
ttggggaaaactcattaaaa

SEQ ID NO: 436477 - DNA, 20 bp, Artificial Sequence
  chemically synthesized
gaaatggatcccattttaat

SEQ ID NO: 436478 - DNA, 20 bp, Artificial Sequence
  chemically synthesized
tggggaaaactcattaaaat

SEQ ID NO: 436479 - DNA, 20 bp, Artificial Sequence
  chemically synthesized
ttcttttggaaattaagaaa

SEQ ID NO: 436480 - DNA, 20 bp, Artificial Sequence
  chemically synthesized
agatgattcttttggaaatt

SEQ ID NO: 436481 - DNA, 20 bp, Artificial Sequence
  chemically synthesized
atccatttcttaatttccaa

SEQ ID NO: 436482 - DNA, 20 bp, Artificial Sequence
  chemically synthesized
attcatatagatgattcttt

SEQ ID NO: 436483 - DNA, 20 bp, Artificial Sequence
  chemically synthesized
aaatcaatgttcaattcata

SEQ ID NO: 436484 - DNA, 20 bp, Artificial Sequence
  chemically synthesized
aaacattctaatgtgtatat

SEQ ID NO: 436485 - DNA, 20 bp, Artificial Sequence
  chemically synthesized
aaaacattctaatgtgtata

SEQ ID NO: 436486 - DNA, 20 bp, Artificial Sequence
  chemically synthesized
ttcaatacccatatacacat

SEQ ID NO: 436487 - DNA, 20 bp, Artificial Sequence
  chemically synthesized
tttatgatttacattgctta

SEQ ID NO: 436488 - DNA, 20 bp, Artificial Sequence
  chemically synthesized
gatttacattgcttacagca

SEQ ID NO: 436489 - DNA, 20 bp, Artificial Sequence
  chemically synthesized
tggtgaatattctgtgctgt

SEQ ID NO: 436490 - DNA, 20 bp, Artificial Sequence
  chemically synthesized
tctactcttagcaataatat

SEQ ID NO: 436491 - DNA, 20 bp, Artificial Sequence
  chemically synthesized
tattcaccaatattattgct

SEQ ID NO: 436492 - DNA, 20 bp, Artificial Sequence
  chemically synthesized
ttcaccaatattattgctaa

SEQ ID NO: 436493 - DNA, 20 bp, Artificial Sequence
  chemically synthesized
accaatattattgctaagag

SEQ ID NO: 436494 - DNA, 20 bp, Artificial Sequence
  chemically synthesized
caatattattgctaagagta

SEQ ID NO: 436495 - DNA, 20 bp, Artificial Sequence
  chemically synthesized
ttgagtcatatctctactct

SEQ ID NO: 436496 - DNA, 20 bp, Artificial Sequence
  chemically synthesized
agagtagagatatgactcaa

SEQ ID NO: 436497 - DNA, 20 bp, Artificial Sequence
  chemically synthesized
gattaaatattgatactttt

SEQ ID NO: 436498 - DNA, 20 bp, Artificial Sequence
  chemically synthesized
aaaagtatcaatatttaatc

SEQ ID NO: 436499 - DNA, 20 bp, Artificial Sequence
  chemically synthesized
gtatcaatatttaatccagt

SEQ ID NO: 436500 - DNA, 20 bp, Artificial Sequence
  chemically synthesized
acatagagcttcatacttac

SEQ ID NO: 436501 - DNA, 20 bp, Artificial Sequence
  chemically synthesized
tatttaatccagtaagtatg

SEQ ID NO: 436502 - DNA, 20 bp, Artificial Sequence
  chemically synthesized
tagtgattgcaattaacata

SEQ ID NO: 436503 - DNA, 20 bp, Artificial Sequence
  chemically synthesized
aatagtgattgcaattaaca

SEQ ID NO: 436504 - DNA, 20 bp, Artificial Sequence
  chemically synthesized
ttgggcaaattgtttatgaa

SEQ ID NO: 436505 - DNA, 20 bp, Artificial Sequence
  chemically synthesized
agaaatgtttaggcaatgtt

SEQ ID NO: 436506 - DNA, 20 bp, Artificial Sequence
  chemically synthesized
aagaaatgtttaggcaatgt

SEQ ID NO: 436507 - DNA, 20 bp, Artificial Sequence
  chemically synthesized
ttgaatggcaagaaatgttt

SEQ ID NO: 436508 - DNA, 20 bp, Artificial Sequence
  chemically synthesized
cttgaatggcaagaaatgtt

SEQ ID NO: 436509 - DNA, 20 bp, Artificial Sequence
  chemically synthesized
ctaaacatttcttgccattc

SEQ ID NO: 436510 - DNA, 20 bp, Artificial Sequence
  chemically synthesized
aaaataaacccttgaatggc

SEQ ID NO: 436511 - DNA, 20 bp, Artificial Sequence
  chemically synthesized
taaacatttcttgccattca

SEQ ID NO: 436512 - DNA, 20 bp, Artificial Sequence
  chemically synthesized
aaacatttcttgccattcaa

SEQ ID NO: 436513 - DNA, 20 bp, Artificial Sequence
  chemically synthesized
gcaaaaaataaacccttgaa

SEQ ID NO: 436514 - DNA, 20 bp, Artificial Sequence
  chemically synthesized
atcatactctaattcacaga

SEQ ID NO: 436515 - DNA, 20 bp, Artificial Sequence
  chemically synthesized
tatcatactctaattcacag

SEQ ID NO: 436516 - DNA, 20 bp, Artificial Sequence
  chemically synthesized
attttttgccttctgtgaat

SEQ ID NO: 436517 - DNA, 20 bp, Artificial Sequence
  chemically synthesized
tttttgccttctgtgaatta

SEQ ID NO: 436518 - DNA, 20 bp, Artificial Sequence
  chemically synthesized
tactatcatactctaattca

SEQ ID NO: 436519 - DNA, 20 bp, Artificial Sequence
  chemically synthesized
ttctgtgaattagagtatga

SEQ ID NO: 436520 - DNA, 20 bp, Artificial Sequence
  chemically synthesized
aattagagtatgatagtaaa

SEQ ID NO: 436521 - DNA, 20 bp, Artificial Sequence
  chemically synthesized
aaatggtaataaatgatctt

SEQ ID NO: 436522 - DNA, 20 bp, Artificial Sequence
  chemically synthesized
taataaatgatcttaagtga

SEQ ID NO: 436523 - DNA, 20 bp, Artificial Sequence
  chemically synthesized
ttacttatttactatcactt

SEQ ID NO: 436524 - DNA, 20 bp, Artificial Sequence
  chemically synthesized
gatcttaagtgatagtaaat

SEQ ID NO: 436525 - DNA, 20 bp, Artificial Sequence
  chemically synthesized
taaataagtaatttctataa

SEQ ID NO: 436526 - DNA, 20 bp, Artificial Sequence
  chemically synthesized
gaacaaaagttattctgtta

SEQ ID NO: 436527 - DNA, 20 bp, Artificial Sequence
  chemically synthesized
taacagaataacttttgttc

SEQ ID NO: 436528 - DNA, 20 bp, Artificial Sequence
  chemically synthesized
tgcacatatctctagaacaa

SEQ ID NO: 436529 - DNA, 20 bp, Artificial Sequence
  chemically synthesized
acagaataacttttgttcta

SEQ ID NO: 436530 - DNA, 20 bp, Artificial Sequence
  chemically synthesized
ttgtgccttgcacatatctc

SEQ ID NO: 436531 - DNA, 20 bp, Artificial Sequence
  chemically synthesized
tttgttctagagatatgtgc

SEQ ID NO: 436532 - DNA, 20 bp, Artificial Sequence
  chemically synthesized
ttgttctagagatatgtgca

SEQ ID NO: 436533 - DNA, 20 bp, Artificial Sequence
  chemically synthesized
gctttggatacagttgagtg

SEQ ID NO: 436534 - DNA, 20 bp, Artificial Sequence
  chemically synthesized
ggcctgctttggatacagtt

SEQ ID NO: 436535 - DNA, 20 bp, Artificial Sequence
  chemically synthesized
actacactcaactgtatcca

SEQ ID NO: 436536 - DNA, 20 bp, Artificial Sequence
  chemically synthesized
tctgtggcctgctttggata

SEQ ID NO: 436537 - DNA, 20 bp, Artificial Sequence
  chemically synthesized
acactcaactgtatccaaag

SEQ ID NO: 436538 - DNA, 20 bp, Artificial Sequence
  chemically synthesized
cactcaactgtatccaaagc

SEQ ID NO: 436539 - DNA, 20 bp, Artificial Sequence
  chemically synthesized
taaggatctgtggcctgctt

SEQ ID NO: 436540 - DNA, 20 bp, Artificial Sequence
  chemically synthesized
actgtatccaaagcaggcca

SEQ ID NO: 436541 - DNA, 20 bp, Artificial Sequence
  chemically synthesized
gttttctctttaaggatctg

SEQ ID NO: 436542 - DNA, 20 bp, Artificial Sequence
  chemically synthesized
aagcaggccacagatcctta

SEQ ID NO: 436543 - DNA, 20 bp, Artificial Sequence
  chemically synthesized
gcaggccacagatccttaaa

SEQ ID NO: 436544 - DNA, 20 bp, Artificial Sequence
  chemically synthesized
attcctaagttttctcttta

SEQ ID NO: 436545 - DNA, 20 bp, Artificial Sequence
  chemically synthesized
aattcctaagttttctcttt

SEQ ID NO: 436546 - DNA, 20 bp, Artificial Sequence
  chemically synthesized
agatccttaaagagaaaact

SEQ ID NO: 436547 - DNA, 20 bp, Artificial Sequence
  chemically synthesized
gatccttaaagagaaaactt

SEQ ID NO: 436548 - DNA, 20 bp, Artificial Sequence
  chemically synthesized
tgttgccacagtaaattcct

SEQ ID NO: 436549 - DNA, 20 bp, Artificial Sequence
  chemically synthesized
gaaaacttaggaatttactg

SEQ ID NO: 436550 - DNA, 20 bp, Artificial Sequence
  chemically synthesized
ttaggaatttactgtggcaa

SEQ ID NO: 436551 - DNA, 20 bp, Artificial Sequence
  chemically synthesized
taggaatttactgtggcaac

SEQ ID NO: 436552 - DNA, 20 bp, Artificial Sequence
  chemically synthesized
tttttcctctcctgttgcca

SEQ ID NO: 436553 - DNA, 20 bp, Artificial Sequence
  chemically synthesized
ggaatttactgtggcaacag

SEQ ID NO: 436554 - DNA, 20 bp, Artificial Sequence
  chemically synthesized
aatttactgtggcaacagga

SEQ ID NO: 436555 - DNA, 20 bp, Artificial Sequence
  chemically synthesized
atttactgtggcaacaggag

SEQ ID NO: 436556 - DNA, 20 bp, Artificial Sequence
  chemically synthesized
gtggcaacaggagaggaaaa

SEQ ID NO: 436557 - DNA, 20 bp, Artificial Sequence
  chemically synthesized
agaggaaaaaagcaaataaa

SEQ ID NO: 436558 - DNA, 20 bp, Artificial Sequence
  chemically synthesized
gaggaaaaaagcaaataaaa

SEQ ID NO: 436559 - DNA, 20 bp, Artificial Sequence
  chemically synthesized
aaaaaggaaatgtacaaatg

SEQ ID NO: 436560 - DNA, 20 bp, Artificial Sequence
  chemically synthesized
aaaaggaaatgtacaaatgt

SEQ ID NO: 436561 - DNA, 20 bp, Artificial Sequence
  chemically synthesized
aaatgtacaaatgtaggtat

SEQ ID NO: 436562 - DNA, 20 bp, Artificial Sequence
  chemically synthesized
aatgtacaaatgtaggtatg

SEQ ID NO: 436563 - DNA, 20 bp, Artificial Sequence
  chemically synthesized
tgtacaaatgtaggtatgag

SEQ ID NO: 436564 - DNA, 20 bp, Artificial Sequence
  chemically synthesized
gtacaaatgtaggtatgagg

SEQ ID NO: 436565 - DNA, 20 bp, Artificial Sequence
  chemically synthesized
taccttattttttttagaaa

SEQ ID NO: 436566 - DNA, 20 bp, Artificial Sequence
  chemically synthesized
ctaccttattttttttagaa

SEQ ID NO: 436567 - DNA, 20 bp, Artificial Sequence
  chemically synthesized
ctaaactaccttattttttt

SEQ ID NO: 436568 - DNA, 20 bp, Artificial Sequence
  chemically synthesized
tgtccttttctaaaaaaaat

SEQ ID NO: 436569 - DNA, 20 bp, Artificial Sequence
  chemically synthesized
gtccttttctaaaaaaaata

SEQ ID NO: 436570 - DNA, 20 bp, Artificial Sequence
  chemically synthesized
cttttctaaaaaaaataagg

SEQ ID NO: 436571 - DNA, 20 bp, Artificial Sequence
  chemically synthesized
ctaaaaaaaataaggtagtt

SEQ ID NO: 436572 - DNA, 20 bp, Artificial Sequence
  chemically synthesized
aaaaataaggtagtttagca

SEQ ID NO: 436573 - DNA, 20 bp, Artificial Sequence
  chemically synthesized
tttagcatagttgcaatgtg

SEQ ID NO: 436574 - DNA, 20 bp, Artificial Sequence
  chemically synthesized
agttgcaatgtgtggtatat

SEQ ID NO: 436575 - DNA, 20 bp, Artificial Sequence
  chemically synthesized
tgcaatgtgtggtatatgag

SEQ ID NO: 436576 - DNA, 20 bp, Artificial Sequence
  chemically synthesized
gcaatgtgtggtatatgagt

SEQ ID NO: 436577 - DNA, 20 bp, Artificial Sequence
  chemically synthesized
caatgtgtggtatatgagtg

SEQ ID NO: 436578 - DNA, 20 bp, Artificial Sequence
  chemically synthesized
atatgagtggggcaaaaaat

SEQ ID NO: 436579 - DNA, 20 bp, Artificial Sequence
  chemically synthesized
tatgagtggggcaaaaaatg

SEQ ID NO: 436580 - DNA, 20 bp, Artificial Sequence
  chemically synthesized
gagtggggcaaaaaatgagg

SEQ ID NO: 436581 - DNA, 20 bp, Artificial Sequence
  chemically synthesized
agtggggcaaaaaatgaggt

SEQ ID NO: 436582 - DNA, 20 bp, Artificial Sequence
  chemically synthesized
ggggcaaaaaatgaggtagg

SEQ ID NO: 436583 - DNA, 20 bp, Artificial Sequence
  chemically synthesized
gggcaaaaaatgaggtagga

SEQ ID NO: 436584 - DNA, 20 bp, Artificial Sequence
  chemically synthesized
tgaggtaggaaggacaaata

SEQ ID NO: 436585 - DNA, 20 bp, Artificial Sequence
  chemically synthesized
gaggtaggaaggacaaataa

SEQ ID NO: 436586 - DNA, 20 bp, Artificial Sequence
  chemically synthesized
aggaaggacaaataaaggac

SEQ ID NO: 436587 - DNA, 20 bp, Artificial Sequence
  chemically synthesized
caaataaaggaccagtaacg

SEQ ID NO: 436588 - DNA, 20 bp, Artificial Sequence
  chemically synthesized
tttcaaaagctcttcgttac

SEQ ID NO: 436589 - DNA, 20 bp, Artificial Sequence
  chemically synthesized
aataaaggaccagtaacgaa

SEQ ID NO: 436590 - DNA, 20 bp, Artificial Sequence
  chemically synthesized
agacctgaaataaatttcaa

SEQ ID NO: 436591 - DNA, 20 bp, Artificial Sequence
  chemically synthesized
agagcttttgaaatttattt

SEQ ID NO: 436592 - DNA, 20 bp, Artificial Sequence
  chemically synthesized
gagcttttgaaatttatttc

SEQ ID NO: 436593 - DNA, 20 bp, Artificial Sequence
  chemically synthesized
tttgaaatttatttcaggtc

SEQ ID NO: 436594 - DNA, 20 bp, Artificial Sequence
  chemically synthesized
ttgaaatttatttcaggtct

SEQ ID NO: 436595 - DNA, 20 bp, Artificial Sequence
  chemically synthesized
gaaatttatttcaggtctgg

SEQ ID NO: 436596 - DNA, 20 bp, Artificial Sequence
  chemically synthesized
taagtcaaaatcatcactcc

SEQ ID NO: 436597 - DNA, 20 bp, Artificial Sequence
  chemically synthesized
atgattttgacttaattccc

SEQ ID NO: 436598 - DNA, 20 bp, Artificial Sequence
  chemically synthesized
ttagagaaaaccagggaatt

SEQ ID NO: 436599 - DNA, 20 bp, Artificial Sequence
  chemically synthesized
aacagtattagagaaaacca

SEQ ID NO: 436600 - DNA, 20 bp, Artificial Sequence
  chemically synthesized
aaacagtattagagaaaacc

SEQ ID NO: 436601 - DNA, 20 bp, Artificial Sequence
  chemically synthesized
caaacagtattagagaaaac

SEQ ID NO: 436602 - DNA, 20 bp, Artificial Sequence
  chemically synthesized
aacaacaacaaacagtatta

SEQ ID NO: 436603 - DNA, 20 bp, Artificial Sequence
  chemically synthesized
acaacaacaacaaacagtat

SEQ ID NO: 436604 - DNA, 20 bp, Artificial Sequence
  chemically synthesized
cagaaaacaacaacaacaaa

SEQ ID NO: 436605 - DNA, 20 bp, Artificial Sequence
  chemically synthesized
gttgttgttttctgcatata

SEQ ID NO: 436606 - DNA, 20 bp, Artificial Sequence
  chemically synthesized
ctaccaattttctatatatg

SEQ ID NO: 436607 - DNA, 20 bp, Artificial Sequence
  chemically synthesized
tttctgcatatatagaaaat

SEQ ID NO: 436608 - DNA, 20 bp, Artificial Sequence
  chemically synthesized
ctgcatatatagaaaattgg

SEQ ID NO: 436609 - DNA, 20 bp, Artificial Sequence
  chemically synthesized
catgtgcattacatatgtat

SEQ ID NO: 436610 - DNA, 20 bp, Artificial Sequence
  chemically synthesized
gtgcattacatatgtattgg

SEQ ID NO: 436611 - DNA, 20 bp, Artificial Sequence
  chemically synthesized
tatacaattgttgaatcatt

SEQ ID NO: 436612 - DNA, 20 bp, Artificial Sequence
  chemically synthesized
aatacccacagcatcataaa

SEQ ID NO: 436613 - DNA, 20 bp, Artificial Sequence
  chemically synthesized
gtaatacccacagcatcata

SEQ ID NO: 436614 - DNA, 20 bp, Artificial Sequence
  chemically synthesized
tattactctttatgatgctg

SEQ ID NO: 436615 - DNA, 20 bp, Artificial Sequence
  chemically synthesized
attactctttatgatgctgt

SEQ ID NO: 436616 - DNA, 20 bp, Artificial Sequence
  chemically synthesized
caatgcttctgtaataccca

SEQ ID NO: 436617 - DNA, 20 bp, Artificial Sequence
  chemically synthesized
ttatgatgctgtgggtatta

SEQ ID NO: 436618 - DNA, 20 bp, Artificial Sequence
  chemically synthesized
tgatgctgtgggtattacag

SEQ ID NO: 436619 - DNA, 20 bp, Artificial Sequence
  chemically synthesized
gggtattacagaagcattgt

SEQ ID NO: 436620 - DNA, 20 bp, Artificial Sequence
  chemically synthesized
ggtattacagaagcattgta

SEQ ID NO: 436621 - DNA, 20 bp, Artificial Sequence
  chemically synthesized
aagcattgtaaggtactaca

SEQ ID NO: 436622 - DNA, 20 bp, Artificial Sequence
  chemically synthesized
tatggtataagaggaccatg

SEQ ID NO: 436623 - DNA, 20 bp, Artificial Sequence
  chemically synthesized
gaaaaaatctatggtataag

SEQ ID NO: 436624 - DNA, 20 bp, Artificial Sequence
  chemically synthesized
agaaaaaatctatggtataa

SEQ ID NO: 436625 - DNA, 20 bp, Artificial Sequence
  chemically synthesized
tacatggtcctcttatacca

SEQ ID NO: 436626 - DNA, 20 bp, Artificial Sequence
  chemically synthesized
ttagaaaaaatctatggtat

SEQ ID NO: 436627 - DNA, 20 bp, Artificial Sequence
  chemically synthesized
gtaggtttagaaaaaatcta

SEQ ID NO: 436628 - DNA, 20 bp, Artificial Sequence
  chemically synthesized
acgctatacagttgtaggtt

SEQ ID NO: 436629 - DNA, 20 bp, Artificial Sequence
  chemically synthesized
accacacgctatacagttgt

SEQ ID NO: 436630 - DNA, 20 bp, Artificial Sequence
  chemically synthesized
taccacacgctatacagttg

SEQ ID NO: 436631 - DNA, 20 bp, Artificial Sequence
  chemically synthesized
tttctaaacctacaactgta

SEQ ID NO: 436632 - DNA, 20 bp, Artificial Sequence
  chemically synthesized
atatcataccacacgctata

SEQ ID NO: 436633 - DNA, 20 bp, Artificial Sequence
  chemically synthesized
acctacaactgtatagcgtg

SEQ ID NO: 436634 - DNA, 20 bp, Artificial Sequence
  chemically synthesized
tggtatgatatgaaaatcac

SEQ ID NO: 436635 - DNA, 20 bp, Artificial Sequence
  chemically synthesized
tgatatgaaaatcactggct

SEQ ID NO: 436636 - DNA, 20 bp, Artificial Sequence
  chemically synthesized
agacccagctagttctcagc

SEQ ID NO: 436637 - DNA, 20 bp, Artificial Sequence
  chemically synthesized
gaaaatcactggctgagaac

SEQ ID NO: 436638 - DNA, 20 bp, Artificial Sequence
  chemically synthesized
actaagacccagctagttct

SEQ ID NO: 436639 - DNA, 20 bp, Artificial Sequence
  chemically synthesized
atcactggctgagaactagc

SEQ ID NO: 436640 - DNA, 20 bp, Artificial Sequence
  chemically synthesized
tcactggctgagaactagct

SEQ ID NO: 436641 - DNA, 20 bp, Artificial Sequence
  chemically synthesized
atacaaaactaagacccagc

SEQ ID NO: 436642 - DNA, 20 bp, Artificial Sequence
  chemically synthesized
gctgagaactagctgggtct

SEQ ID NO: 436643 - DNA, 20 bp, Artificial Sequence
  chemically synthesized
ttagatacaaaactaagacc

SEQ ID NO: 436644 - DNA, 20 bp, Artificial Sequence
  chemically synthesized
aaacagttagatacaaaact

SEQ ID NO: 436645 - DNA, 20 bp, Artificial Sequence
  chemically synthesized
ctccagttctcagaaacagt

SEQ ID NO: 436646 - DNA, 20 bp, Artificial Sequence
  chemically synthesized
ttttgtatctaactgtttct

SEQ ID NO: 436647 - DNA, 20 bp, Artificial Sequence
  chemically synthesized
gagactccagttctcagaaa

SEQ ID NO: 436648 - DNA, 20 bp, Artificial Sequence
  chemically synthesized
atctaactgtttctgagaac

SEQ ID NO: 436649 - DNA, 20 bp, Artificial Sequence
  chemically synthesized
ctaactgtttctgagaactg

SEQ ID NO: 436650 - DNA, 20 bp, Artificial Sequence
  chemically synthesized
gaaagtgagactccagttct

SEQ ID NO: 436651 - DNA, 20 bp, Artificial Sequence
  chemically synthesized
agatgtggaaagtgagactc

SEQ ID NO: 436652 - DNA, 20 bp, Artificial Sequence
  chemically synthesized
attatatagatgtggaaagt

SEQ ID NO: 436653 - DNA, 20 bp, Artificial Sequence
  chemically synthesized
cctcattatatagatgtgga

SEQ ID NO: 436654 - DNA, 20 bp, Artificial Sequence
  chemically synthesized
atttcctcattatatagatg

SEQ ID NO: 436655 - DNA, 20 bp, Artificial Sequence
  chemically synthesized
actttccacatctatataat

SEQ ID NO: 436656 - DNA, 20 bp, Artificial Sequence
  chemically synthesized
ctttccacatctatataatg

SEQ ID NO: 436657 - DNA, 20 bp, Artificial Sequence
  chemically synthesized
ttttccatttcctcattata

SEQ ID NO: 436658 - DNA, 20 bp, Artificial Sequence
  chemically synthesized
acatctatataatgaggaaa

SEQ ID NO: 436659 - DNA, 20 bp, Artificial Sequence
  chemically synthesized
aggaaatggaaaatattctc

SEQ ID NO: 436660 - DNA, 20 bp, Artificial Sequence
  chemically synthesized
ggaaatggaaaatattctcc

SEQ ID NO: 436661 - DNA, 20 bp, Artificial Sequence
  chemically synthesized
tcacaactgcagaaaacctg

SEQ ID NO: 436662 - DNA, 20 bp, Artificial Sequence
  chemically synthesized
catcacaactgcagaaaacc

SEQ ID NO: 436663 - DNA, 20 bp, Artificial Sequence
  chemically synthesized
aatattctccaggttttctg

SEQ ID NO: 436664 - DNA, 20 bp, Artificial Sequence
  chemically synthesized
gtcatagatcatcacaactg

SEQ ID NO: 436665 - DNA, 20 bp, Artificial Sequence
  chemically synthesized
tacagtgaataacaaggtca

SEQ ID NO: 436666 - DNA, 20 bp, Artificial Sequence
  chemically synthesized
acaccctacagtgaataaca

SEQ ID NO: 436667 - DNA, 20 bp, Artificial Sequence
  chemically synthesized
aacaccctacagtgaataac

SEQ ID NO: 436668 - DNA, 20 bp, Artificial Sequence
  chemically synthesized
tatgaccttgttattcactg

SEQ ID NO: 436669 - DNA, 20 bp, Artificial Sequence
  chemically synthesized
atgaccttgttattcactgt

SEQ ID NO: 436670 - DNA, 20 bp, Artificial Sequence
  chemically synthesized
tgaccttgttattcactgta

SEQ ID NO: 436671 - DNA, 20 bp, Artificial Sequence
  chemically synthesized
ttcaccagcttaacacccta

SEQ ID NO: 436672 - DNA, 20 bp, Artificial Sequence
  chemically synthesized
gttattcactgtagggtgtt

SEQ ID NO: 436673 - DNA, 20 bp, Artificial Sequence
  chemically synthesized
ttcactgtagggtgttaagc

SEQ ID NO: 436674 - DNA, 20 bp, Artificial Sequence
  chemically synthesized
agggtgttaagctggtgaaa

SEQ ID NO: 436675 - DNA, 20 bp, Artificial Sequence
  chemically synthesized
ctgcagttttgctgtttcac

SEQ ID NO: 436676 - DNA, 20 bp, Artificial Sequence
  chemically synthesized
ctggtgaaacagcaaaactg

SEQ ID NO: 436677 - DNA, 20 bp, Artificial Sequence
  chemically synthesized
gaaaactggtatttggtctg

SEQ ID NO: 436678 - DNA, 20 bp, Artificial Sequence
  chemically synthesized
caaaactgcagaccaaatac

SEQ ID NO: 436679 - DNA, 20 bp, Artificial Sequence
  chemically synthesized
gttaaaggaaaactggtatt

SEQ ID NO: 436680 - DNA, 20 bp, Artificial Sequence
  chemically synthesized
agagatggttaaaggaaaac

SEQ ID NO: 436681 - DNA, 20 bp, Artificial Sequence
  chemically synthesized
agagagagagagatggttaa

SEQ ID NO: 436682 - DNA, 20 bp, Artificial Sequence
  chemically synthesized
gagagagagagagatggtta

SEQ ID NO: 436683 - DNA, 20 bp, Artificial Sequence
  chemically synthesized
gagagagagagagagagaga

SEQ ID NO: 436684 - DNA, 20 bp, Artificial Sequence
  chemically synthesized
cagagagagagagagagaga

SEQ ID NO: 436685 - DNA, 20 bp, Artificial Sequence
  chemically synthesized
gacagagagagagagagaga

SEQ ID NO: 436686 - DNA, 20 bp, Artificial Sequence
  chemically synthesized
gagacagagagagagagaga

SEQ ID NO: 436687 - DNA, 20 bp, Artificial Sequence
  chemically synthesized
gagagacagagagagagaga

SEQ ID NO: 436688 - DNA, 20 bp, Artificial Sequence
  chemically synthesized
gagagagacagagagagaga

SEQ ID NO: 436689 - DNA, 20 bp, Artificial Sequence
  chemically synthesized
atgagagagacagagagaga

SEQ ID NO: 436690 - DNA, 20 bp, Artificial Sequence
  chemically synthesized
tgatgagagagacagagaga

SEQ ID NO: 436691 - DNA, 20 bp, Artificial Sequence
  chemically synthesized
gatgatgagagagacagaga

SEQ ID NO: 436692 - DNA, 20 bp, Artificial Sequence
  chemically synthesized
tagatgatgagagagacaga

SEQ ID NO: 436693 - DNA, 20 bp, Artificial Sequence
  chemically synthesized
gatagatgatgagagagaca

SEQ ID NO: 436694 - DNA, 20 bp, Artificial Sequence
  chemically synthesized
tagatagatgatgagagaga

SEQ ID NO: 436695 - DNA, 20 bp, Artificial Sequence
  chemically synthesized
atgttagatagatgatgaga

SEQ ID NO: 436696 - DNA, 20 bp, Artificial Sequence
  chemically synthesized
agatgttagatagatgatga

SEQ ID NO: 436697 - DNA, 20 bp, Artificial Sequence
  chemically synthesized
gtagatgttagatagatgat

SEQ ID NO: 436698 - DNA, 20 bp, Artificial Sequence
  chemically synthesized
ttaaaatagtagatgttaga

SEQ ID NO: 436699 - DNA, 20 bp, Artificial Sequence
  chemically synthesized
ttttttaaaatagtagatgt

SEQ ID NO: 436700 - DNA, 20 bp, Artificial Sequence
  chemically synthesized
ctgatgattttttaaaatag

SEQ ID NO: 436701 - DNA, 20 bp, Artificial Sequence
  chemically synthesized
agactgatgattttttaaaa

SEQ ID NO: 436702 - DNA, 20 bp, Artificial Sequence
  chemically synthesized
ctactattttaaaaaatcat

SEQ ID NO: 436703 - DNA, 20 bp, Artificial Sequence
  chemically synthesized
aaagtaagatatgcattgag

SEQ ID NO: 436704 - DNA, 20 bp, Artificial Sequence
  chemically synthesized
gagaaagtaagatatgcatt

SEQ ID NO: 436705 - DNA, 20 bp, Artificial Sequence
  chemically synthesized
aatgggaaaatggagaaagt

SEQ ID NO: 436706 - DNA, 20 bp, Artificial Sequence
  chemically synthesized
gaagaatgggaaaatggaga

SEQ ID NO: 436707 - DNA, 20 bp, Artificial Sequence
  chemically synthesized
gctggaagaatgggaaaatg

SEQ ID NO: 436708 - DNA, 20 bp, Artificial Sequence
  chemically synthesized
gggctggaagaatgggaaaa

SEQ ID NO: 436709 - DNA, 20 bp, Artificial Sequence
  chemically synthesized
tctccattttcccattcttc

SEQ ID NO: 436710 - DNA, 20 bp, Artificial Sequence
  chemically synthesized
gagcaaagggctggaagaat

SEQ ID NO: 436711 - DNA, 20 bp, Artificial Sequence
  chemically synthesized
agagcaaagggctggaagaa

SEQ ID NO: 436712 - DNA, 20 bp, Artificial Sequence
  chemically synthesized
cgaaaagagcaaagggctgg

SEQ ID NO: 436713 - DNA, 20 bp, Artificial Sequence
  chemically synthesized
gtccgaaaagagcaaagggc

SEQ ID NO: 436714 - DNA, 20 bp, Artificial Sequence
  chemically synthesized
aggtgtccgaaaagagcaaa

SEQ ID NO: 436715 - DNA, 20 bp, Artificial Sequence
  chemically synthesized
aaggtgtccgaaaagagcaa

SEQ ID NO: 436716 - DNA, 20 bp, Artificial Sequence
  chemically synthesized
aaaggtgtccgaaaagagca

SEQ ID NO: 436717 - DNA, 20 bp, Artificial Sequence
  chemically synthesized
ttccagccctttgctctttt

SEQ ID NO: 436718 - DNA, 20 bp, Artificial Sequence
  chemically synthesized
aaataaaaggtgtccgaaaa

SEQ ID NO: 436719 - DNA, 20 bp, Artificial Sequence
  chemically synthesized
gtaaataaaaggtgtccgaa

SEQ ID NO: 436720 - DNA, 20 bp, Artificial Sequence
  chemically synthesized
actgtagacgggtaaataaa

SEQ ID NO: 436721 - DNA, 20 bp, Artificial Sequence
  chemically synthesized
aactgtagacgggtaaataa

SEQ ID NO: 436722 - DNA, 20 bp, Artificial Sequence
  chemically synthesized
accttttatttacccgtcta

SEQ ID NO: 436723 - DNA, 20 bp, Artificial Sequence
  chemically synthesized
agggcaaaagaactgtagac

SEQ ID NO: 436724 - DNA, 20 bp, Artificial Sequence
  chemically synthesized
gagggcaaaagaactgtaga

SEQ ID NO: 436725 - DNA, 20 bp, Artificial Sequence
  chemically synthesized
accagagggcaaaagaactg

SEQ ID NO: 436726 - DNA, 20 bp, Artificial Sequence
  chemically synthesized
cacaaagtaccagagggcaa

SEQ ID NO: 436727 - DNA, 20 bp, Artificial Sequence
  chemically synthesized
tctacagttcttttgccctc

SEQ ID NO: 436728 - DNA, 20 bp, Artificial Sequence
  chemically synthesized
ggtaaccacaaagtaccaga

SEQ ID NO: 436729 - DNA, 20 bp, Artificial Sequence
  chemically synthesized
tggtaaccacaaagtaccag

SEQ ID NO: 436730 - DNA, 20 bp, Artificial Sequence
  chemically synthesized
ctggtaaccacaaagtacca

SEQ ID NO: 436731 - DNA, 20 bp, Artificial Sequence
  chemically synthesized
aactggtaaccacaaagtac

SEQ ID NO: 436732 - DNA, 20 bp, Artificial Sequence
  chemically synthesized
ttttgccctctggtactttg

SEQ ID NO: 436733 - DNA, 20 bp, Artificial Sequence
  chemically synthesized
aatagcaactggtaaccaca

SEQ ID NO: 436734 - DNA, 20 bp, Artificial Sequence
  chemically synthesized
ctctggtactttgtggttac

SEQ ID NO: 436735 - DNA, 20 bp, Artificial Sequence
  chemically synthesized
gtgggaagtacaatagcaac

SEQ ID NO: 436736 - DNA, 20 bp, Artificial Sequence
  chemically synthesized
atcctttgtgggaagtacaa

SEQ ID NO: 436737 - DNA, 20 bp, Artificial Sequence
  chemically synthesized
ttgctattgtacttcccaca

SEQ ID NO: 436738 - DNA, 20 bp, Artificial Sequence
  chemically synthesized
tgctattgtacttcccacaa

SEQ ID NO: 436739 - DNA, 20 bp, Artificial Sequence
  chemically synthesized
gcaaattgatcctttgtggg

SEQ ID NO: 436740 - DNA, 20 bp, Artificial Sequence
  chemically synthesized
agtgcaaattgatcctttgt

SEQ ID NO: 436741 - DNA, 20 bp, Artificial Sequence
  chemically synthesized
tagtgcaaattgatcctttg

SEQ ID NO: 436742 - DNA, 20 bp, Artificial Sequence
  chemically synthesized
gactgctgtcagtatgattg

SEQ ID NO: 436743 - DNA, 20 bp, Artificial Sequence
  chemically synthesized
ttgcactacaatcatactga

SEQ ID NO: 436744 - DNA, 20 bp, Artificial Sequence
  chemically synthesized
cactacaatcatactgacag

SEQ ID NO: 436745 - DNA, 20 bp, Artificial Sequence
  chemically synthesized
gagttactgaggactgctgt

SEQ ID NO: 436746 - DNA, 20 bp, Artificial Sequence
  chemically synthesized
atcatactgacagcagtcct

SEQ ID NO: 436747 - DNA, 20 bp, Artificial Sequence
  chemically synthesized
ttttttcccctgagttactg

SEQ ID NO: 436748 - DNA, 20 bp, Artificial Sequence
  chemically synthesized
gacagcagtcctcagtaact

SEQ ID NO: 436749 - DNA, 20 bp, Artificial Sequence
  chemically synthesized
tttttttcccctgagttact

SEQ ID NO: 436750 - DNA, 20 bp, Artificial Sequence
  chemically synthesized
acagcagtcctcagtaactc

SEQ ID NO: 436751 - DNA, 20 bp, Artificial Sequence
  chemically synthesized
cagcagtcctcagtaactca

SEQ ID NO: 436752 - DNA, 20 bp, Artificial Sequence
  chemically synthesized
agcagtcctcagtaactcag

SEQ ID NO: 436753 - DNA, 20 bp, Artificial Sequence
  chemically synthesized
gagtctgttttttttcccct

SEQ ID NO: 436754 - DNA, 20 bp, Artificial Sequence
  chemically synthesized
gtaactcaggggaaaaaaaa

SEQ ID NO: 436755 - DNA, 20 bp, Artificial Sequence
  chemically synthesized
gggaaaaaaaacagactctt

SEQ ID NO: 436756 - DNA, 20 bp, Artificial Sequence
  chemically synthesized
aaaaaaaacagactcttaag

SEQ ID NO: 436757 - DNA, 20 bp, Artificial Sequence
  chemically synthesized
ggatccccactgctgcttaa

SEQ ID NO: 436758 - DNA, 20 bp, Artificial Sequence
  chemically synthesized
aaaaacagactcttaagcag

SEQ ID NO: 436759 - DNA, 20 bp, Artificial Sequence
  chemically synthesized
ttggatccccactgctgctt

SEQ ID NO: 436760 - DNA, 20 bp, Artificial Sequence
  chemically synthesized
aacagactcttaagcagcag

SEQ ID NO: 436761 - DNA, 20 bp, Artificial Sequence
  chemically synthesized
acagactcttaagcagcagt

SEQ ID NO: 436762 - DNA, 20 bp, Artificial Sequence
  chemically synthesized
cagactcttaagcagcagtg

SEQ ID NO: 436763 - DNA, 20 bp, Artificial Sequence
  chemically synthesized
taagcagcagtggggatcca

SEQ ID NO: 436764 - DNA, 20 bp, Artificial Sequence
  chemically synthesized
gttccctgggaaatggtctt

SEQ ID NO: 436765 - DNA, 20 bp, Artificial Sequence
  chemically synthesized
gggatccaaagaccatttcc

SEQ ID NO: 436766 - DNA, 20 bp, Artificial Sequence
  chemically synthesized
ggatccaaagaccatttccc

SEQ ID NO: 436767 - DNA, 20 bp, Artificial Sequence
  chemically synthesized
gatccaaagaccatttccca

SEQ ID NO: 436768 - DNA, 20 bp, Artificial Sequence
  chemically synthesized
ccgactggttccctgggaaa

SEQ ID NO: 436769 - DNA, 20 bp, Artificial Sequence
  chemically synthesized
aagaccatttcccagggaac

SEQ ID NO: 436770 - DNA, 20 bp, Artificial Sequence
  chemically synthesized
tgtgacccgactggttccct

SEQ ID NO: 436771 - DNA, 20 bp, Artificial Sequence
  chemically synthesized
ctgtgacccgactggttccc

SEQ ID NO: 436772 - DNA, 20 bp, Artificial Sequence
  chemically synthesized
ccatttcccagggaaccagt

SEQ ID NO: 436773 - DNA, 20 bp, Artificial Sequence
  chemically synthesized
catttcccagggaaccagtc

SEQ ID NO: 436774 - DNA, 20 bp, Artificial Sequence
  chemically synthesized
cactcttcctgtgacccgac

SEQ ID NO: 436775 - DNA, 20 bp, Artificial Sequence
  chemically synthesized
ccagggaaccagtcgggtca

SEQ ID NO: 436776 - DNA, 20 bp, Artificial Sequence
  chemically synthesized
cagggaaccagtcgggtcac

SEQ ID NO: 436777 - DNA, 20 bp, Artificial Sequence
  chemically synthesized
ggaaccagtcgggtcacagg

SEQ ID NO: 436778 - DNA, 20 bp, Artificial Sequence
  chemically synthesized
aaccagtcgggtcacaggaa

SEQ ID NO: 436779 - DNA, 20 bp, Artificial Sequence
  chemically synthesized
cagtcgggtcacaggaagag

SEQ ID NO: 436780 - DNA, 20 bp, Artificial Sequence
  chemically synthesized
agtcgggtcacaggaagagt

SEQ ID NO: 436781 - DNA, 20 bp, Artificial Sequence
  chemically synthesized
cgggtcacaggaagagtggg

SEQ ID NO: 436782 - DNA, 20 bp, Artificial Sequence
  chemically synthesized
ggtcacaggaagagtgggaa

SEQ ID NO: 436783 - DNA, 20 bp, Artificial Sequence
  chemically synthesized
caggaagagtgggaagagaa

SEQ ID NO: 436784 - DNA, 20 bp, Artificial Sequence
  chemically synthesized
agagtgggaagagaacagca

SEQ ID NO: 436785 - DNA, 20 bp, Artificial Sequence
  chemically synthesized
gaagagaacagcaaagcccc

SEQ ID NO: 436786 - DNA, 20 bp, Artificial Sequence
  chemically synthesized
gggaagaggaaaataacttg

SEQ ID NO: 436787 - DNA, 20 bp, Artificial Sequence
  chemically synthesized
tgggaagaggaaaataactt

SEQ ID NO: 436788 - DNA, 20 bp, Artificial Sequence
  chemically synthesized
gtgggaagaggaaaataact

SEQ ID NO: 436789 - DNA, 20 bp, Artificial Sequence
  chemically synthesized
tgagtgaaatatgtgggaag

SEQ ID NO: 436790 - DNA, 20 bp, Artificial Sequence
  chemically synthesized
ctgagtgaaatatgtgggaa

SEQ ID NO: 436791 - DNA, 20 bp, Artificial Sequence
  chemically synthesized
atctgagtgaaatatgtggg

SEQ ID NO: 436792 - DNA, 20 bp, Artificial Sequence
  chemically synthesized
ggcatctgagtgaaatatgt

SEQ ID NO: 436793 - DNA, 20 bp, Artificial Sequence
  chemically synthesized
tggcatctgagtgaaatatg

SEQ ID NO: 436794 - DNA, 20 bp, Artificial Sequence
  chemically synthesized
ctcttcccacatatttcact

SEQ ID NO: 436795 - DNA, 20 bp, Artificial Sequence
  chemically synthesized
gcaaacaaaaattggcatct

SEQ ID NO: 436796 - DNA, 20 bp, Artificial Sequence
  chemically synthesized
ctttgagagcaaacaaaaat

SEQ ID NO: 436797 - DNA, 20 bp, Artificial Sequence
  chemically synthesized
ccaatttttgtttgctctca

SEQ ID NO: 436798 - DNA, 20 bp, Artificial Sequence
  chemically synthesized
gtcaaataaaacagctttga

SEQ ID NO: 436799 - DNA, 20 bp, Artificial Sequence
  chemically synthesized
ctgtcaaataaaacagcttt

SEQ ID NO: 436800 - DNA, 20 bp, Artificial Sequence
  chemically synthesized
aggagccctgtcaaataaaa

SEQ ID NO: 436801 - DNA, 20 bp, Artificial Sequence
  chemically synthesized
ctcaaagctgttttatttga

SEQ ID NO: 436802 - DNA, 20 bp, Artificial Sequence
  chemically synthesized
tcaaagctgttttatttgac

SEQ ID NO: 436803 - DNA, 20 bp, Artificial Sequence
  chemically synthesized
caaagctgttttatttgaca

SEQ ID NO: 436804 - DNA, 20 bp, Artificial Sequence
  chemically synthesized
tttgacagggctccttgtta

SEQ ID NO: 436805 - DNA, 20 bp, Artificial Sequence
  chemically synthesized
gcaatttagcccataacaag

SEQ ID NO: 436806 - DNA, 20 bp, Artificial Sequence
  chemically synthesized
ttgacagggctccttgttat

SEQ ID NO: 436807 - DNA, 20 bp, Artificial Sequence
  chemically synthesized
gggcaatttagcccataaca

SEQ ID NO: 436808 - DNA, 20 bp, Artificial Sequence
  chemically synthesized
ggggcaatttagcccataac

SEQ ID NO: 436809 - DNA, 20 bp, Artificial Sequence
  chemically synthesized
aatttgggaaaggggcaatt

SEQ ID NO: 436810 - DNA, 20 bp, Artificial Sequence
  chemically synthesized
aacagacgaatttgggaaag

SEQ ID NO: 436811 - DNA, 20 bp, Artificial Sequence
  chemically synthesized
caacagacgaatttgggaaa

SEQ ID NO: 436812 - DNA, 20 bp, Artificial Sequence
  chemically synthesized
tcaacagacgaatttgggaa

SEQ ID NO: 436813 - DNA, 20 bp, Artificial Sequence
  chemically synthesized
ttcaacagacgaatttggga

SEQ ID NO: 436814 - DNA, 20 bp, Artificial Sequence
  chemically synthesized
ggacttcaacagacgaattt

SEQ ID NO: 436815 - DNA, 20 bp, Artificial Sequence
  chemically synthesized
aggacttcaacagacgaatt

SEQ ID NO: 436816 - DNA, 20 bp, Artificial Sequence
  chemically synthesized
tttcccaaattcgtctgttg

SEQ ID NO: 436817 - DNA, 20 bp, Artificial Sequence
  chemically synthesized
aatgggggttaggacttcaa

SEQ ID NO: 436818 - DNA, 20 bp, Artificial Sequence
  chemically synthesized
attctgagacaatgggggtt

SEQ ID NO: 436819 - DNA, 20 bp, Artificial Sequence
  chemically synthesized
cattctgagacaatgggggt

SEQ ID NO: 436820 - DNA, 20 bp, Artificial Sequence
  chemically synthesized
gtcacattctgagacaatgg

SEQ ID NO: 436821 - DNA, 20 bp, Artificial Sequence
  chemically synthesized
agtcacattctgagacaatg

SEQ ID NO: 436822 - DNA, 20 bp, Artificial Sequence
  chemically synthesized
agtcctaacccccattgtct

SEQ ID NO: 436823 - DNA, 20 bp, Artificial Sequence
  chemically synthesized
cagtcacattctgagacaat

SEQ ID NO: 436824 - DNA, 20 bp, Artificial Sequence
  chemically synthesized
acagtcacattctgagacaa

SEQ ID NO: 436825 - DNA, 20 bp, Artificial Sequence
  chemically synthesized
tccaactacagtcacattct

SEQ ID NO: 436826 - DNA, 20 bp, Artificial Sequence
  chemically synthesized
attgtctcagaatgtgactg

SEQ ID NO: 436827 - DNA, 20 bp, Artificial Sequence
  chemically synthesized
tctcagaatgtgactgtagt

SEQ ID NO: 436828 - DNA, 20 bp, Artificial Sequence
  chemically synthesized
tcagaatgtgactgtagttg

SEQ ID NO: 436829 - DNA, 20 bp, Artificial Sequence
  chemically synthesized
aaagaccctatctccaacta

SEQ ID NO: 436830 - DNA, 20 bp, Artificial Sequence
  chemically synthesized
aatgtgactgtagttggaga

SEQ ID NO: 436831 - DNA, 20 bp, Artificial Sequence
  chemically synthesized
atgtgactgtagttggagat

SEQ ID NO: 436832 - DNA, 20 bp, Artificial Sequence
  chemically synthesized
tgtgactgtagttggagata

SEQ ID NO: 436833 - DNA, 20 bp, Artificial Sequence
  chemically synthesized
agttggagatagggtcttta

SEQ ID NO: 436834 - DNA, 20 bp, Artificial Sequence
  chemically synthesized
ttggagatagggtctttaaa

SEQ ID NO: 436835 - DNA, 20 bp, Artificial Sequence
  chemically synthesized
tggagatagggtctttaaag

SEQ ID NO: 436836 - DNA, 20 bp, Artificial Sequence
  chemically synthesized
taaccttaaatacctcttta

SEQ ID NO: 436837 - DNA, 20 bp, Artificial Sequence
  chemically synthesized
gggtctttaaagaggtattt

SEQ ID NO: 436838 - DNA, 20 bp, Artificial Sequence
  chemically synthesized
ggtctttaaagaggtattta

SEQ ID NO: 436839 - DNA, 20 bp, Artificial Sequence
  chemically synthesized
agaggtatttaaggttaaat

SEQ ID NO: 436840 - DNA, 20 bp, Artificial Sequence
  chemically synthesized
gaggtatttaaggttaaatg

SEQ ID NO: 436841 - DNA, 20 bp, Artificial Sequence
  chemically synthesized
taaggttaaatgaggtcact

SEQ ID NO: 436842 - DNA, 20 bp, Artificial Sequence
  chemically synthesized
aaggttaaatgaggtcacta

SEQ ID NO: 436843 - DNA, 20 bp, Artificial Sequence
  chemically synthesized
ttaaatgaggtcactaaggt

SEQ ID NO: 436844 - DNA, 20 bp, Artificial Sequence
  chemically synthesized
gattggattagagctcacct

SEQ ID NO: 436845 - DNA, 20 bp, Artificial Sequence
  chemically synthesized
atactaatcagattggatta

SEQ ID NO: 436846 - DNA, 20 bp, Artificial Sequence
  chemically synthesized
ggatactaatcagattggat

SEQ ID NO: 436847 - DNA, 20 bp, Artificial Sequence
  chemically synthesized
gagctctaatccaatctgat

SEQ ID NO: 436848 - DNA, 20 bp, Artificial Sequence
  chemically synthesized
tataaggatactaatcagat

SEQ ID NO: 436849 - DNA, 20 bp, Artificial Sequence
  chemically synthesized
ctttttataaggatactaat

SEQ ID NO: 436850 - DNA, 20 bp, Artificial Sequence
  chemically synthesized
ctgattagtatccttataaa

SEQ ID NO: 436851 - DNA, 20 bp, Artificial Sequence
  chemically synthesized
tctaatctcatctttttata

SEQ ID NO: 436852 - DNA, 20 bp, Artificial Sequence
  chemically synthesized
ttctaatctcatctttttat

SEQ ID NO: 436853 - DNA, 20 bp, Artificial Sequence
  chemically synthesized
tagtatccttataaaaagat

SEQ ID NO: 436854 - DNA, 20 bp, Artificial Sequence
  chemically synthesized
tccttataaaaagatgagat

SEQ ID NO: 436855 - DNA, 20 bp, Artificial Sequence
  chemically synthesized
aaaaagatgagattagaaca

SEQ ID NO: 436856 - DNA, 20 bp, Artificial Sequence
  chemically synthesized
agatgagattagaacacaga

SEQ ID NO: 436857 - DNA, 20 bp, Artificial Sequence
  chemically synthesized
gatgagattagaacacagac

SEQ ID NO: 436858 - DNA, 20 bp, Artificial Sequence
  chemically synthesized
gattagaacacagacaggaa

SEQ ID NO: 436859 - DNA, 20 bp, Artificial Sequence
  chemically synthesized
ttagaacacagacaggaaca

SEQ ID NO: 436860 - DNA, 20 bp, Artificial Sequence
  chemically synthesized
tagaacacagacaggaacag

SEQ ID NO: 436861 - DNA, 20 bp, Artificial Sequence
  chemically synthesized
acacagacaggaacagagga

SEQ ID NO: 436862 - DNA, 20 bp, Artificial Sequence
  chemically synthesized
aggaacagaggaaagaccat

SEQ ID NO: 436863 - DNA, 20 bp, Artificial Sequence
  chemically synthesized
aacagaggaaagaccatgag

SEQ ID NO: 436864 - DNA, 20 bp, Artificial Sequence
  chemically synthesized
cctctccatctgtcttctca

SEQ ID NO: 436865 - DNA, 20 bp, Artificial Sequence
  chemically synthesized
gaggaaagaccatgagaaga

SEQ ID NO: 436866 - DNA, 20 bp, Artificial Sequence
  chemically synthesized
aaagaccatgagaagacaga

SEQ ID NO: 436867 - DNA, 20 bp, Artificial Sequence
  chemically synthesized
agaccatgagaagacagatg

SEQ ID NO: 436868 - DNA, 20 bp, Artificial Sequence
  chemically synthesized
accatgagaagacagatgga

SEQ ID NO: 436869 - DNA, 20 bp, Artificial Sequence
  chemically synthesized
ccatgagaagacagatggag

SEQ ID NO: 436870 - DNA, 20 bp, Artificial Sequence
  chemically synthesized
catgagaagacagatggaga

SEQ ID NO: 436871 - DNA, 20 bp, Artificial Sequence
  chemically synthesized
gagaagacagatggagaggg

SEQ ID NO: 436872 - DNA, 20 bp, Artificial Sequence
  chemically synthesized
cctccctccttagtttgcag

SEQ ID NO: 436873 - DNA, 20 bp, Artificial Sequence
  chemically synthesized
gcctccctccttagtttgca

SEQ ID NO: 436874 - DNA, 20 bp, Artificial Sequence
  chemically synthesized
gagggcagcctctgcaaact

SEQ ID NO: 436875 - DNA, 20 bp, Artificial Sequence
  chemically synthesized
agggcagcctctgcaaacta

SEQ ID NO: 436876 - DNA, 20 bp, Artificial Sequence
  chemically synthesized
aagcctccctccttagtttg

SEQ ID NO: 436877 - DNA, 20 bp, Artificial Sequence
  chemically synthesized
ggcagcctctgcaaactaag

SEQ ID NO: 436878 - DNA, 20 bp, Artificial Sequence
  chemically synthesized
gcagcctctgcaaactaagg

SEQ ID NO: 436879 - DNA, 20 bp, Artificial Sequence
  chemically synthesized
cagcctctgcaaactaagga

SEQ ID NO: 436880 - DNA, 20 bp, Artificial Sequence
  chemically synthesized
gcctctgcaaactaaggagg

SEQ ID NO: 436881 - DNA, 20 bp, Artificial Sequence
  chemically synthesized
cctctgcaaactaaggaggg

SEQ ID NO: 436882 - DNA, 20 bp, Artificial Sequence
  chemically synthesized
tcttctgaagcctccctcct

SEQ ID NO: 436883 - DNA, 20 bp, Artificial Sequence
  chemically synthesized
caaactaaggagggaggctt

SEQ ID NO: 436884 - DNA, 20 bp, Artificial Sequence
  chemically synthesized
actaaggagggaggcttcag

SEQ ID NO: 436885 - DNA, 20 bp, Artificial Sequence
  chemically synthesized
atcagggctgatttcttctg

SEQ ID NO: 436886 - DNA, 20 bp, Artificial Sequence
  chemically synthesized
agggaggcttcagaagaaat

SEQ ID NO: 436887 - DNA, 20 bp, Artificial Sequence
  chemically synthesized
gtaaaggctaggtataatca

SEQ ID NO: 436888 - DNA, 20 bp, Artificial Sequence
  chemically synthesized
agtaaaggctaggtataatc

SEQ ID NO: 436889 - DNA, 20 bp, Artificial Sequence
  chemically synthesized
tagtaaaggctaggtataat

SEQ ID NO: 436890 - DNA, 20 bp, Artificial Sequence
  chemically synthesized
aaatcagccctgattatacc

SEQ ID NO: 436891 - DNA, 20 bp, Artificial Sequence
  chemically synthesized
tctccacagtagtaaaggct

SEQ ID NO: 436892 - DNA, 20 bp, Artificial Sequence
  chemically synthesized
ttctccacagtagtaaaggc

SEQ ID NO: 436893 - DNA, 20 bp, Artificial Sequence
  chemically synthesized
tattttctccacagtagtaa

SEQ ID NO: 436894 - DNA, 20 bp, Artificial Sequence
  chemically synthesized
ttattttctccacagtagta

SEQ ID NO: 436895 - DNA, 20 bp, Artificial Sequence
  chemically synthesized
atacctagcctttactactg

SEQ ID NO: 436896 - DNA, 20 bp, Artificial Sequence
  chemically synthesized
acctagcctttactactgtg

SEQ ID NO: 436897 - DNA, 20 bp, Artificial Sequence
  chemically synthesized
gaaatttattttctccacag

SEQ ID NO: 436898 - DNA, 20 bp, Artificial Sequence
  chemically synthesized
acagaaatttattttctcca

SEQ ID NO: 436899 - DNA, 20 bp, Artificial Sequence
  chemically synthesized
gagaaaataaatttctgttt

SEQ ID NO: 436900 - DNA, 20 bp, Artificial Sequence
  chemically synthesized
agtagactgggtttcttaaa

SEQ ID NO: 436901 - DNA, 20 bp, Artificial Sequence
  chemically synthesized
aaatttctgtttaagaaacc

SEQ ID NO: 436902 - DNA, 20 bp, Artificial Sequence
  chemically synthesized
acaaaataccacagtagact

SEQ ID NO: 436903 - DNA, 20 bp, Artificial Sequence
  chemically synthesized
aacaaaataccacagtagac

SEQ ID NO: 436904 - DNA, 20 bp, Artificial Sequence
  chemically synthesized
ttaagaaacccagtctactg

SEQ ID NO: 436905 - DNA, 20 bp, Artificial Sequence
  chemically synthesized
gccataacaaaataccacag

SEQ ID NO: 436906 - DNA, 20 bp, Artificial Sequence
  chemically synthesized
attgccataacaaaatacca

SEQ ID NO: 436907 - DNA, 20 bp, Artificial Sequence
  chemically synthesized
tctactgtggtattttgtta

SEQ ID NO: 436908 - DNA, 20 bp, Artificial Sequence
  chemically synthesized
gtattttgttatggcaatgc

SEQ ID NO: 436909 - DNA, 20 bp, Artificial Sequence
  chemically synthesized
taaggaatgtattattttgc

SEQ ID NO: 436910 - DNA, 20 bp, Artificial Sequence
  chemically synthesized
taaaacattacaaatgaata

SEQ ID NO: 436911 - DNA, 20 bp, Artificial Sequence
  chemically synthesized
ataaaacattacaaatgaat

SEQ ID NO: 436912 - DNA, 20 bp, Artificial Sequence
  chemically synthesized
taatgttttatatttgaatt

SEQ ID NO: 436913 - DNA, 20 bp, Artificial Sequence
  chemically synthesized
atatatacaaaggggagaat

SEQ ID NO: 436914 - DNA, 20 bp, Artificial Sequence
  chemically synthesized
ctatatatatatacaaaggg

SEQ ID NO: 436915 - DNA, 20 bp, Artificial Sequence
  chemically synthesized
atctatatatatatacaaag

SEQ ID NO: 436916 - DNA, 20 bp, Artificial Sequence
  chemically synthesized
tatctatatatatatacaaa

SEQ ID NO: 436917 - DNA, 20 bp, Artificial Sequence
  chemically synthesized
atatctatatatatatacaa

SEQ ID NO: 436918 - DNA, 20 bp, Artificial Sequence
  chemically synthesized
tatatctatatatatataca

SEQ ID NO: 436919 - DNA, 20 bp, Artificial Sequence
  chemically synthesized
ctcccctttgtatatatata

SEQ ID NO: 436920 - DNA, 20 bp, Artificial Sequence
  chemically synthesized
ttattgttctagcagcaaga

SEQ ID NO: 436921 - DNA, 20 bp, Artificial Sequence
  chemically synthesized
gttattgttctagcagcaag

SEQ ID NO: 436922 - DNA, 20 bp, Artificial Sequence
  chemically synthesized
atatatatccttcttgctgc

SEQ ID NO: 436923 - DNA, 20 bp, Artificial Sequence
  chemically synthesized
tttgttattgttctagcagc

SEQ ID NO: 436924 - DNA, 20 bp, Artificial Sequence
  chemically synthesized
tctttttgttattgttctag

SEQ ID NO: 436925 - DNA, 20 bp, Artificial Sequence
  chemically synthesized
tcatctttttgttattgttc

SEQ ID NO: 436926 - DNA, 20 bp, Artificial Sequence
  chemically synthesized
gctgctagaacaataacaaa

SEQ ID NO: 436927 - DNA, 20 bp, Artificial Sequence
  chemically synthesized
acaaaaagatgattaactgt

SEQ ID NO: 436928 - DNA, 20 bp, Artificial Sequence
  chemically synthesized
aagatgattaactgtaagca

SEQ ID NO: 436929 - DNA, 20 bp, Artificial Sequence
  chemically synthesized
tcattgtaacactatgctta

SEQ ID NO: 436930 - DNA, 20 bp, Artificial Sequence
  chemically synthesized
ctaagggcatgtgagcaaca

SEQ ID NO: 436931 - DNA, 20 bp, Artificial Sequence
  chemically synthesized
atctaagggcatgtgagcaa

SEQ ID NO: 436932 - DNA, 20 bp, Artificial Sequence
  chemically synthesized
atacatatctaagggcatgt

SEQ ID NO: 436933 - DNA, 20 bp, Artificial Sequence
  chemically synthesized
ctctgttgctcacatgccct

SEQ ID NO: 436934 - DNA, 20 bp, Artificial Sequence
  chemically synthesized
ataaacaaatacatatctaa

SEQ ID NO: 436935 - DNA, 20 bp, Artificial Sequence
  chemically synthesized
aataaacaaatacatatcta

SEQ ID NO: 436936 - DNA, 20 bp, Artificial Sequence
  chemically synthesized
gaataaacaaatacatatct

SEQ ID NO: 436937 - DNA, 20 bp, Artificial Sequence
  chemically synthesized
tgtatttgtttattcaaaaa

SEQ ID NO: 436938 - DNA, 20 bp, Artificial Sequence
  chemically synthesized
gcttaatatataaagttatt

SEQ ID NO: 436939 - DNA, 20 bp, Artificial Sequence
  chemically synthesized
agcataaggcttaatatata

SEQ ID NO: 436940 - DNA, 20 bp, Artificial Sequence
  chemically synthesized
accaaataactttatatatt

SEQ ID NO: 436941 - DNA, 20 bp, Artificial Sequence
  chemically synthesized
catacctagagatgagcata

SEQ ID NO: 436942 - DNA, 20 bp, Artificial Sequence
  chemically synthesized
ccatacctagagatgagcat

SEQ ID NO: 436943 - DNA, 20 bp, Artificial Sequence
  chemically synthesized
ttaagccttatgctcatctc

SEQ ID NO: 436944 - DNA, 20 bp, Artificial Sequence
  chemically synthesized
taagccttatgctcatctct

SEQ ID NO: 436945 - DNA, 20 bp, Artificial Sequence
  chemically synthesized
tctcccccatacctagagat

SEQ ID NO: 436946 - DNA, 20 bp, Artificial Sequence
  chemically synthesized
cttatgctcatctctaggta

SEQ ID NO: 436947 - DNA, 20 bp, Artificial Sequence
  chemically synthesized
ttatgctcatctctaggtat

SEQ ID NO: 436948 - DNA, 20 bp, Artificial Sequence
  chemically synthesized
ccacctctcccccataccta

SEQ ID NO: 436949 - DNA, 20 bp, Artificial Sequence
  chemically synthesized
tatgctcatctctaggtatg

SEQ ID NO: 436950 - DNA, 20 bp, Artificial Sequence
  chemically synthesized
atgctcatctctaggtatgg

SEQ ID NO: 436951 - DNA, 20 bp, Artificial Sequence
  chemically synthesized
tcccacctctcccccatacc

SEQ ID NO: 436952 - DNA, 20 bp, Artificial Sequence
  chemically synthesized
gctcatctctaggtatgggg

SEQ ID NO: 436953 - DNA, 20 bp, Artificial Sequence
  chemically synthesized
tcatctctaggtatggggga

SEQ ID NO: 436954 - DNA, 20 bp, Artificial Sequence
  chemically synthesized
catctctaggtatgggggag

SEQ ID NO: 436955 - DNA, 20 bp, Artificial Sequence
  chemically synthesized
ctctaggtatgggggagagg

SEQ ID NO: 436956 - DNA, 20 bp, Artificial Sequence
  chemically synthesized
tctaggtatgggggagaggt

SEQ ID NO: 436957 - DNA, 20 bp, Artificial Sequence
  chemically synthesized
gaaacatgatgataaaataa

SEQ ID NO: 436958 - DNA, 20 bp, Artificial Sequence
  chemically synthesized
gcatgtttatcagtgttaca

SEQ ID NO: 436959 - DNA, 20 bp, Artificial Sequence
  chemically synthesized
aaatatcttggcatgtttat

SEQ ID NO: 436960 - DNA, 20 bp, Artificial Sequence
  chemically synthesized
gtaacactgataaacatgcc

SEQ ID NO: 436961 - DNA, 20 bp, Artificial Sequence
  chemically synthesized
atatgagaatacaaatatct

SEQ ID NO: 436962 - DNA, 20 bp, Artificial Sequence
  chemically synthesized
atatttgtattctcatatta

SEQ ID NO: 436963 - DNA, 20 bp, Artificial Sequence
  chemically synthesized
caatttatttactttaatat

SEQ ID NO: 436964 - DNA, 20 bp, Artificial Sequence
  chemically synthesized
gtaaataaattgacaaaata

SEQ ID NO: 436965 - DNA, 20 bp, Artificial Sequence
  chemically synthesized
aaattgacaaaatatggtga

SEQ ID NO: 436966 - DNA, 20 bp, Artificial Sequence
  chemically synthesized
ttttgatgaacttatgctat

SEQ ID NO: 436967 - DNA, 20 bp, Artificial Sequence
  chemically synthesized
ttaaagtgttctcatagcat

SEQ ID NO: 436968 - DNA, 20 bp, Artificial Sequence
  chemically synthesized
atggttttaaagtgttctca

SEQ ID NO: 436969 - DNA, 20 bp, Artificial Sequence
  chemically synthesized
ggaggttaggtatggtttta

SEQ ID NO: 436970 - DNA, 20 bp, Artificial Sequence
  chemically synthesized
ccgccaatggaggttaggta

SEQ ID NO: 436971 - DNA, 20 bp, Artificial Sequence
  chemically synthesized
tgactccgccaatggaggtt

SEQ ID NO: 436972 - DNA, 20 bp, Artificial Sequence
  chemically synthesized
ttgactccgccaatggaggt

SEQ ID NO: 436973 - DNA, 20 bp, Artificial Sequence
  chemically synthesized
aaaccatacctaacctccat

SEQ ID NO: 436974 - DNA, 20 bp, Artificial Sequence
  chemically synthesized
ccatacctaacctccattgg

SEQ ID NO: 436975 - DNA, 20 bp, Artificial Sequence
  chemically synthesized
tccattgactccgccaatgg

SEQ ID NO: 436976 - DNA, 20 bp, Artificial Sequence
  chemically synthesized
ctccattgactccgccaatg

SEQ ID NO: 436977 - DNA, 20 bp, Artificial Sequence
  chemically synthesized
atacctaacctccattggcg

SEQ ID NO: 436978 - DNA, 20 bp, Artificial Sequence
  chemically synthesized
atctccattgactccgccaa

SEQ ID NO: 436979 - DNA, 20 bp, Artificial Sequence
  chemically synthesized
acctccattggcggagtcaa

SEQ ID NO: 436980 - DNA, 20 bp, Artificial Sequence
  chemically synthesized
ctccattggcggagtcaatg

SEQ ID NO: 436981 - DNA, 20 bp, Artificial Sequence
  chemically synthesized
ttggcggagtcaatggagat

SEQ ID NO: 436982 - DNA, 20 bp, Artificial Sequence
  chemically synthesized
cggagtcaatggagattggt

SEQ ID NO: 436983 - DNA, 20 bp, Artificial Sequence
  chemically synthesized
gagtcaatggagattggtga

SEQ ID NO: 436984 - DNA, 20 bp, Artificial Sequence
  chemically synthesized
agtcaatggagattggtgag

SEQ ID NO: 436985 - DNA, 20 bp, Artificial Sequence
  chemically synthesized
gtcaatggagattggtgaga

SEQ ID NO: 436986 - DNA, 20 bp, Artificial Sequence
  chemically synthesized
tcaatggagattggtgagag

SEQ ID NO: 436987 - DNA, 20 bp, Artificial Sequence
  chemically synthesized
tggagattggtgagaggggt

SEQ ID NO: 436988 - DNA, 20 bp, Artificial Sequence
  chemically synthesized
ggagattggtgagaggggtt

SEQ ID NO: 436989 - DNA, 20 bp, Artificial Sequence
  chemically synthesized
gttaggaaataatttttcct

SEQ ID NO: 436990 - DNA, 20 bp, Artificial Sequence
  chemically synthesized
aaataatttttcctgagatg

SEQ ID NO: 436991 - DNA, 20 bp, Artificial Sequence
  chemically synthesized
cctggtttccacttcatctc

SEQ ID NO: 436992 - DNA, 20 bp, Artificial Sequence
  chemically synthesized
gcctggtttccacttcatct

SEQ ID NO: 436993 - DNA, 20 bp, Artificial Sequence
  chemically synthesized
taatttttcctgagatgaag

SEQ ID NO: 436994 - DNA, 20 bp, Artificial Sequence
  chemically synthesized
tcctgagatgaagtggaaac

SEQ ID NO: 436995 - DNA, 20 bp, Artificial Sequence
  chemically synthesized
cctgagatgaagtggaaacc

SEQ ID NO: 436996 - DNA, 20 bp, Artificial Sequence
  chemically synthesized
tcacttaattaattaaagcc

SEQ ID NO: 436997 - DNA, 20 bp, Artificial Sequence
  chemically synthesized
accaatcacttaattaatta

SEQ ID NO: 436998 - DNA, 20 bp, Artificial Sequence
  chemically synthesized
aaaccaggctttaattaatt

SEQ ID NO: 436999 - DNA, 20 bp, Artificial Sequence
  chemically synthesized
gctttaattaattaagtgat

SEQ ID NO: 437000 - DNA, 20 bp, Artificial Sequence
  chemically synthesized
taattaattaagtgattggt

SEQ ID NO: 437001 - DNA, 20 bp, Artificial Sequence
  chemically synthesized
aattaattaagtgattggta

SEQ ID NO: 437002 - DNA, 20 bp, Artificial Sequence
  chemically synthesized
ttaattaagtgattggtaag

SEQ ID NO: 437003 - DNA, 20 bp, Artificial Sequence
  chemically synthesized
attaagtgattggtaaggag

SEQ ID NO: 437004 - DNA, 20 bp, Artificial Sequence
  chemically synthesized
ttaagtgattggtaaggaga

SEQ ID NO: 437005 - DNA, 20 bp, Artificial Sequence
  chemically synthesized
aagtgattggtaaggagaag

SEQ ID NO: 437006 - DNA, 20 bp, Artificial Sequence
  chemically synthesized
agtgattggtaaggagaagg

SEQ ID NO: 437007 - DNA, 20 bp, Artificial Sequence
  chemically synthesized
gtgattggtaaggagaagga

SEQ ID NO: 437008 - DNA, 20 bp, Artificial Sequence
  chemically synthesized
aaggagaaggagggtaattt

SEQ ID NO: 437009 - DNA, 20 bp, Artificial Sequence
  chemically synthesized
aggagaaggagggtaatttc

SEQ ID NO: 437010 - DNA, 20 bp, Artificial Sequence
  chemically synthesized
agaaggagggtaatttcagg

SEQ ID NO: 437011 - DNA, 20 bp, Artificial Sequence
  chemically synthesized
gctttcgtgttgtcagggat

SEQ ID NO: 437012 - DNA, 20 bp, Artificial Sequence
  chemically synthesized
accatgctttcgtgttgtca

SEQ ID NO: 437013 - DNA, 20 bp, Artificial Sequence
  chemically synthesized
taccatgctttcgtgttgtc

SEQ ID NO: 437014 - DNA, 20 bp, Artificial Sequence
  chemically synthesized
ctaccatgctttcgtgttgt

SEQ ID NO: 437015 - DNA, 20 bp, Artificial Sequence
  chemically synthesized
acttatccctgacaacacga

SEQ ID NO: 437016 - DNA, 20 bp, Artificial Sequence
  chemically synthesized
tccctgacaacacgaaagca

SEQ ID NO: 437017 - DNA, 20 bp, Artificial Sequence
  chemically synthesized
ctgacaacacgaaagcatgg

SEQ ID NO: 437018 - DNA, 20 bp, Artificial Sequence
  chemically synthesized
aacacgaaagcatggtagtt

SEQ ID NO: 437019 - DNA, 20 bp, Artificial Sequence
  chemically synthesized
acacgaaagcatggtagttt

SEQ ID NO: 437020 - DNA, 20 bp, Artificial Sequence
  chemically synthesized
cacgaaagcatggtagtttg

SEQ ID NO: 437021 - DNA, 20 bp, Artificial Sequence
  chemically synthesized
acgaaagcatggtagtttgg

SEQ ID NO: 437022 - DNA, 20 bp, Artificial Sequence
  chemically synthesized
gtagtttgggggcccgcaca

SEQ ID NO: 437023 - DNA, 20 bp, Artificial Sequence
  chemically synthesized
tagtttgggggcccgcacat

SEQ ID NO: 437024 - DNA, 20 bp, Artificial Sequence
  chemically synthesized
agccaaaggctcctatgtgc

SEQ ID NO: 437025 - DNA, 20 bp, Artificial Sequence
  chemically synthesized
gtttgggggcccgcacatag

SEQ ID NO: 437026 - DNA, 20 bp, Artificial Sequence
  chemically synthesized
tagccaaaggctcctatgtg

SEQ ID NO: 437027 - DNA, 20 bp, Artificial Sequence
  chemically synthesized
ggcccgcacataggagcctt

SEQ ID NO: 437028 - DNA, 20 bp, Artificial Sequence
  chemically synthesized
cacataggagcctttggcta

SEQ ID NO: 437029 - DNA, 20 bp, Artificial Sequence
  chemically synthesized
actcctaaccctttagccaa

SEQ ID NO: 437030 - DNA, 20 bp, Artificial Sequence
  chemically synthesized
acataggagcctttggctaa

SEQ ID NO: 437031 - DNA, 20 bp, Artificial Sequence
  chemically synthesized
tactcctaaccctttagcca

SEQ ID NO: 437032 - DNA, 20 bp, Artificial Sequence
  chemically synthesized
cataggagcctttggctaaa

SEQ ID NO: 437033 - DNA, 20 bp, Artificial Sequence
  chemically synthesized
ggagcctttggctaaagggt

SEQ ID NO: 437034 - DNA, 20 bp, Artificial Sequence
  chemically synthesized
gagcctttggctaaagggtt

SEQ ID NO: 437035 - DNA, 20 bp, Artificial Sequence
  chemically synthesized
atctcttactcctaaccctt

SEQ ID NO: 437036 - DNA, 20 bp, Artificial Sequence
  chemically synthesized
gcctttggctaaagggttag

SEQ ID NO: 437037 - DNA, 20 bp, Artificial Sequence
  chemically synthesized
ttggctaaagggttaggagt

SEQ ID NO: 437038 - DNA, 20 bp, Artificial Sequence
  chemically synthesized
ggctaaagggttaggagtaa

SEQ ID NO: 437039 - DNA, 20 bp, Artificial Sequence
  chemically synthesized
aagggttaggagtaagagat

SEQ ID NO: 437040 - DNA, 20 bp, Artificial Sequence
  chemically synthesized
agggttaggagtaagagatg

SEQ ID NO: 437041 - DNA, 20 bp, Artificial Sequence
  chemically synthesized
ggttaggagtaagagatgag

SEQ ID NO: 437042 - DNA, 20 bp, Artificial Sequence
  chemically synthesized
taggagtaagagatgaggag

SEQ ID NO: 437043 - DNA, 20 bp, Artificial Sequence
  chemically synthesized
aggagtaagagatgaggaga

SEQ ID NO: 437044 - DNA, 20 bp, Artificial Sequence
  chemically synthesized
ggagtaagagatgaggagaa

SEQ ID NO: 437045 - DNA, 20 bp, Artificial Sequence
  chemically synthesized
gtaagagatgaggagaaggg

SEQ ID NO: 437046 - DNA, 20 bp, Artificial Sequence
  chemically synthesized
taagagatgaggagaagggt

SEQ ID NO: 437047 - DNA, 20 bp, Artificial Sequence
  chemically synthesized
agagatgaggagaagggtag

SEQ ID NO: 437048 - DNA, 20 bp, Artificial Sequence
  chemically synthesized
agatgaggagaagggtagga

SEQ ID NO: 437049 - DNA, 20 bp, Artificial Sequence
  chemically synthesized
gatgaggagaagggtaggag

SEQ ID NO: 437050 - DNA, 20 bp, Artificial Sequence
  chemically synthesized
tgaggagaagggtaggagag

SEQ ID NO: 437051 - DNA, 20 bp, Artificial Sequence
  chemically synthesized
gaggagaagggtaggagagg

SEQ ID NO: 437052 - DNA, 20 bp, Artificial Sequence
  chemically synthesized
gagaagggtaggagaggagg

SEQ ID NO: 437053 - DNA, 20 bp, Artificial Sequence
  chemically synthesized
aagggtaggagaggaggtag

SEQ ID NO: 437054 - DNA, 20 bp, Artificial Sequence
  chemically synthesized
ggagaggaggtagcagcaat

SEQ ID NO: 437055 - DNA, 20 bp, Artificial Sequence
  chemically synthesized
aggaggtagcagcaataagc

SEQ ID NO: 437056 - DNA, 20 bp, Artificial Sequence
  chemically synthesized
ggaggtagcagcaataagct

SEQ ID NO: 437057 - DNA, 20 bp, Artificial Sequence
  chemically synthesized
aaggtcatgttatcaggacc

SEQ ID NO: 437058 - DNA, 20 bp, Artificial Sequence
  chemically synthesized
gtatgtaaggtcatgttatc

SEQ ID NO: 437059 - DNA, 20 bp, Artificial Sequence
  chemically synthesized
tgtatgtaaggtcatgttat

SEQ ID NO: 437060 - DNA, 20 bp, Artificial Sequence
  chemically synthesized
ccaactccgtgatgtatgta

SEQ ID NO: 437061 - DNA, 20 bp, Artificial Sequence
  chemically synthesized
gccaactccgtgatgtatgt

SEQ ID NO: 437062 - DNA, 20 bp, Artificial Sequence
  chemically synthesized
acatgaccttacatacatca

SEQ ID NO: 437063 - DNA, 20 bp, Artificial Sequence
  chemically synthesized
atgaccttacatacatcacg

SEQ ID NO: 437064 - DNA, 20 bp, Artificial Sequence
  chemically synthesized
ccttacatacatcacggagt

SEQ ID NO: 437065 - DNA, 20 bp, Artificial Sequence
  chemically synthesized
atacatcacggagttggcat

SEQ ID NO: 437066 - DNA, 20 bp, Artificial Sequence
  chemically synthesized
acggagttggcattagtctc

SEQ ID NO: 437067 - DNA, 20 bp, Artificial Sequence
  chemically synthesized
gagttggcattagtctctag

SEQ ID NO: 437068 - DNA, 20 bp, Artificial Sequence
  chemically synthesized
agttggcattagtctctagc

SEQ ID NO: 437069 - DNA, 20 bp, Artificial Sequence
  chemically synthesized
gaaaatattttttcctgcta

SEQ ID NO: 437070 - DNA, 20 bp, Artificial Sequence
  chemically synthesized
tggaaaatattttttcctgc

SEQ ID NO: 437071 - DNA, 20 bp, Artificial Sequence
  chemically synthesized
aaaaatattttccaactttt

SEQ ID NO: 437072 - DNA, 20 bp, Artificial Sequence
  chemically synthesized
attagccttaacttaaaagt

SEQ ID NO: 437073 - DNA, 20 bp, Artificial Sequence
  chemically synthesized
tattttccaacttttaagtt

SEQ ID NO: 437074 - DNA, 20 bp, Artificial Sequence
  chemically synthesized
taaaattagccttaacttaa

SEQ ID NO: 437075 - DNA, 20 bp, Artificial Sequence
  chemically synthesized
attttccaacttttaagtta

SEQ ID NO: 437076 - DNA, 20 bp, Artificial Sequence
  chemically synthesized
acaggtgacaagtttaaaat

SEQ ID NO: 437077 - DNA, 20 bp, Artificial Sequence
  chemically synthesized
aagagattactacaggtgac

SEQ ID NO: 437078 - DNA, 20 bp, Artificial Sequence
  chemically synthesized
aattttaaacttgtcacctg

SEQ ID NO: 437079 - DNA, 20 bp, Artificial Sequence
  chemically synthesized
tcatttaaagagattactac

SEQ ID NO: 437080 - DNA, 20 bp, Artificial Sequence
  chemically synthesized
ttcatttaaagagattacta

SEQ ID NO: 437081 - DNA, 20 bp, Artificial Sequence
  chemically synthesized
ggaaatttcattcatttaaa

SEQ ID NO: 437082 - DNA, 20 bp, Artificial Sequence
  chemically synthesized
agggaaatttcattcattta

SEQ ID NO: 437083 - DNA, 20 bp, Artificial Sequence
  chemically synthesized
gattactataaatgaagaca

SEQ ID NO: 437084 - DNA, 20 bp, Artificial Sequence
  chemically synthesized
tgattactataaatgaagac

SEQ ID NO: 437085 - DNA, 20 bp, Artificial Sequence
  chemically synthesized
ctgattactataaatgaaga

SEQ ID NO: 437086 - DNA, 20 bp, Artificial Sequence
  chemically synthesized
aatttccctgtcttcattta

SEQ ID NO: 437087 - DNA, 20 bp, Artificial Sequence
  chemically synthesized
gatgctgattactataaatg

SEQ ID NO: 437088 - DNA, 20 bp, Artificial Sequence
  chemically synthesized
ctgtcttcatttatagtaat

SEQ ID NO: 437089 - DNA, 20 bp, Artificial Sequence
  chemically synthesized
taatcagcatctttcactgc

SEQ ID NO: 437090 - DNA, 20 bp, Artificial Sequence
  chemically synthesized
tagaaatttccttgcagtga

SEQ ID NO: 437091 - DNA, 20 bp, Artificial Sequence
  chemically synthesized
aatcagcatctttcactgca

SEQ ID NO: 437092 - DNA, 20 bp, Artificial Sequence
  chemically synthesized
ttcacttagaaatttccttg

SEQ ID NO: 437093 - DNA, 20 bp, Artificial Sequence
  chemically synthesized
ttcactgcaaggaaatttct

SEQ ID NO: 437094 - DNA, 20 bp, Artificial Sequence
  chemically synthesized
gagtaaaatgtacattcact

SEQ ID NO: 437095 - DNA, 20 bp, Artificial Sequence
  chemically synthesized
cctaaaggaaattagaagtt

SEQ ID NO: 437096 - DNA, 20 bp, Artificial Sequence
  chemically synthesized
agattcctaaaggaaattag

SEQ ID NO: 437097 - DNA, 20 bp, Artificial Sequence
  chemically synthesized
tttagattcctaaaggaaat

SEQ ID NO: 437098 - DNA, 20 bp, Artificial Sequence
  chemically synthesized
actcaacttctaatttcctt

SEQ ID NO: 437099 - DNA, 20 bp, Artificial Sequence
  chemically synthesized
ctcaacttctaatttccttt

SEQ ID NO: 437100 - DNA, 20 bp, Artificial Sequence
  chemically synthesized
gaatgagtttagattcctaa

SEQ ID NO: 437101 - DNA, 20 bp, Artificial Sequence
  chemically synthesized
tgaatgagtttagattccta

SEQ ID NO: 437102 - DNA, 20 bp, Artificial Sequence
  chemically synthesized
gtgaaaatattgaatgagtt

SEQ ID NO: 437103 - DNA, 20 bp, Artificial Sequence
  chemically synthesized
attttgtgaaaatattgaat

SEQ ID NO: 437104 - DNA, 20 bp, Artificial Sequence
  chemically synthesized
acaaaatgataactgtaatc

SEQ ID NO: 437105 - DNA, 20 bp, Artificial Sequence
  chemically synthesized
caaaatgataactgtaatca

SEQ ID NO: 437106 - DNA, 20 bp, Artificial Sequence
  chemically synthesized
aaagctctctgccttgatta

SEQ ID NO: 437107 - DNA, 20 bp, Artificial Sequence
  chemically synthesized
aatgataactgtaatcaagg

SEQ ID NO: 437108 - DNA, 20 bp, Artificial Sequence
  chemically synthesized
tgataactgtaatcaaggca

SEQ ID NO: 437109 - DNA, 20 bp, Artificial Sequence
  chemically synthesized
ataactgtaatcaaggcaga

SEQ ID NO: 437110 - DNA, 20 bp, Artificial Sequence
  chemically synthesized
caaggcagagagctttattt

SEQ ID NO: 437111 - DNA, 20 bp, Artificial Sequence
  chemically synthesized
attctttgttagctgaaata

SEQ ID NO: 437112 - DNA, 20 bp, Artificial Sequence
  chemically synthesized
gagctttatttcagctaaca

SEQ ID NO: 437113 - DNA, 20 bp, Artificial Sequence
  chemically synthesized
tgtgtagggctattctttgt

SEQ ID NO: 437114 - DNA, 20 bp, Artificial Sequence
  chemically synthesized
ttatttcagctaacaaagaa

SEQ ID NO: 437115 - DNA, 20 bp, Artificial Sequence
  chemically synthesized
acaaagaatagccctacaca

SEQ ID NO: 437116 - DNA, 20 bp, Artificial Sequence
  chemically synthesized
caaagaatagccctacacaa

SEQ ID NO: 437117 - DNA, 20 bp, Artificial Sequence
  chemically synthesized
atttgcaattcctttgtgta

SEQ ID NO: 437118 - DNA, 20 bp, Artificial Sequence
  chemically synthesized
tatttgcaattcctttgtgt

SEQ ID NO: 437119 - DNA, 20 bp, Artificial Sequence
  chemically synthesized
atatttgcaattcctttgtg

SEQ ID NO: 437120 - DNA, 20 bp, Artificial Sequence
  chemically synthesized
aaattataacagtcattatt

SEQ ID NO: 437121 - DNA, 20 bp, Artificial Sequence
  chemically synthesized
acagagaagataaattataa

SEQ ID NO: 437122 - DNA, 20 bp, Artificial Sequence
  chemically synthesized
agtagtatccttcaacagag

SEQ ID NO: 437123 - DNA, 20 bp, Artificial Sequence
  chemically synthesized
ataatttatcttctctgttg

SEQ ID NO: 437124 - DNA, 20 bp, Artificial Sequence
  chemically synthesized
taatttatcttctctgttga

SEQ ID NO: 437125 - DNA, 20 bp, Artificial Sequence
  chemically synthesized
ggaagtagtatccttcaaca

SEQ ID NO: 437126 - DNA, 20 bp, Artificial Sequence
  chemically synthesized
caggaagtagtatccttcaa

SEQ ID NO: 437127 - DNA, 20 bp, Artificial Sequence
  chemically synthesized
gctacaaacagaacaggaag

SEQ ID NO: 437128 - DNA, 20 bp, Artificial Sequence
  chemically synthesized
atggctacaaacagaacagg

SEQ ID NO: 437129 - DNA, 20 bp, Artificial Sequence
  chemically synthesized
atcatggctacaaacagaac

SEQ ID NO: 437130 - DNA, 20 bp, Artificial Sequence
  chemically synthesized
tatcatggctacaaacagaa

SEQ ID NO: 437131 - DNA, 20 bp, Artificial Sequence
  chemically synthesized
actacttcctgttctgtttg

SEQ ID NO: 437132 - DNA, 20 bp, Artificial Sequence
  chemically synthesized
ttgtttatcatggctacaaa

SEQ ID NO: 437133 - DNA, 20 bp, Artificial Sequence
  chemically synthesized
atgataccatttgtttatca

SEQ ID NO: 437134 - DNA, 20 bp, Artificial Sequence
  chemically synthesized
ttgtagccatgataaacaaa

SEQ ID NO: 437135 - DNA, 20 bp, Artificial Sequence
  chemically synthesized
aaatggtatcatgatcctta

SEQ ID NO: 437136 - DNA, 20 bp, Artificial Sequence
  chemically synthesized
gtatcatgatccttatagtc

SEQ ID NO: 437137 - DNA, 20 bp, Artificial Sequence
  chemically synthesized
agtccatttcctggactata

SEQ ID NO: 437138 - DNA, 20 bp, Artificial Sequence
  chemically synthesized
tatcatgatccttatagtcc

SEQ ID NO: 437139 - DNA, 20 bp, Artificial Sequence
  chemically synthesized
cagtccatttcctggactat

SEQ ID NO: 437140 - DNA, 20 bp, Artificial Sequence
  chemically synthesized
gatccttatagtccaggaaa

SEQ ID NO: 437141 - DNA, 20 bp, Artificial Sequence
  chemically synthesized
acataaaacagtccatttcc

SEQ ID NO: 437142 - DNA, 20 bp, Artificial Sequence
  chemically synthesized
aggaaatggactgttttatg

SEQ ID NO: 437143 - DNA, 20 bp, Artificial Sequence
  chemically synthesized
aatatttcatctacataaaa

SEQ ID NO: 437144 - DNA, 20 bp, Artificial Sequence
  chemically synthesized
gctgggtttggaatgtgaga

SEQ ID NO: 437145 - DNA, 20 bp, Artificial Sequence
  chemically synthesized
ctaggctgggtttggaatgt

SEQ ID NO: 437146 - DNA, 20 bp, Artificial Sequence
  chemically synthesized
tctgtctcacattccaaacc

SEQ ID NO: 437147 - DNA, 20 bp, Artificial Sequence
  chemically synthesized
atcctgtcctaggctgggtt

SEQ ID NO: 437148 - DNA, 20 bp, Artificial Sequence
  chemically synthesized
ctcacattccaaacccagcc

SEQ ID NO: 437149 - DNA, 20 bp, Artificial Sequence
  chemically synthesized
tcacattccaaacccagcct

SEQ ID NO: 437150 - DNA, 20 bp, Artificial Sequence
  chemically synthesized
cataaatcctgtcctaggct

SEQ ID NO: 437151 - DNA, 20 bp, Artificial Sequence
  chemically synthesized
tcataaatcctgtcctaggc

SEQ ID NO: 437152 - DNA, 20 bp, Artificial Sequence
  chemically synthesized
attccaaacccagcctagga

SEQ ID NO: 437153 - DNA, 20 bp, Artificial Sequence
  chemically synthesized
ttccaaacccagcctaggac

SEQ ID NO: 437154 - DNA, 20 bp, Artificial Sequence
  chemically synthesized
gttatcataaatcctgtcct

SEQ ID NO: 437155 - DNA, 20 bp, Artificial Sequence
  chemically synthesized
agttatcataaatcctgtcc

SEQ ID NO: 437156 - DNA, 20 bp, Artificial Sequence
  chemically synthesized
tatccagcatagatgggggg

SEQ ID NO: 437157 - DNA, 20 bp, Artificial Sequence
  chemically synthesized
tgatatccagcatagatggg

SEQ ID NO: 437158 - DNA, 20 bp, Artificial Sequence
  chemically synthesized
gtgatatccagcatagatgg

SEQ ID NO: 437159 - DNA, 20 bp, Artificial Sequence
  chemically synthesized
tgtgatatccagcatagatg

SEQ ID NO: 437160 - DNA, 20 bp, Artificial Sequence
  chemically synthesized
gtgtgatatccagcatagat

SEQ ID NO: 437161 - DNA, 20 bp, Artificial Sequence
  chemically synthesized
taactgccccccatctatgc

SEQ ID NO: 437162 - DNA, 20 bp, Artificial Sequence
  chemically synthesized
agtgtgatatccagcataga

SEQ ID NO: 437163 - DNA, 20 bp, Artificial Sequence
  chemically synthesized
tcatagtgtgatatccagca

SEQ ID NO: 437164 - DNA, 20 bp, Artificial Sequence
  chemically synthesized
cgtcatcatagtgtgatatc

SEQ ID NO: 437165 - DNA, 20 bp, Artificial Sequence
  chemically synthesized
tacaaatacacacgtcatca

SEQ ID NO: 437166 - DNA, 20 bp, Artificial Sequence
  chemically synthesized
gtgtgtatttgtatttctgt

SEQ ID NO: 437167 - DNA, 20 bp, Artificial Sequence
  chemically synthesized
atagttatgaattgagctca

SEQ ID NO: 437168 - DNA, 20 bp, Artificial Sequence
  chemically synthesized
gagttgcatagttatgaatt

SEQ ID NO: 437169 - DNA, 20 bp, Artificial Sequence
  chemically synthesized
tatgcttcaggagagttgca

SEQ ID NO: 437170 - DNA, 20 bp, Artificial Sequence
  chemically synthesized
ataactatgcaactctcctg

SEQ ID NO: 437171 - DNA, 20 bp, Artificial Sequence
  chemically synthesized
gccaagtttatgcttcagga

SEQ ID NO: 437172 - DNA, 20 bp, Artificial Sequence
  chemically synthesized
tagccaagtttatgcttcag

SEQ ID NO: 437173 - DNA, 20 bp, Artificial Sequence
  chemically synthesized
tgtagccaagtttatgcttc

SEQ ID NO: 437174 - DNA, 20 bp, Artificial Sequence
  chemically synthesized
atgtagccaagtttatgctt

SEQ ID NO: 437175 - DNA, 20 bp, Artificial Sequence
  chemically synthesized
actctcctgaagcataaact

SEQ ID NO: 437176 - DNA, 20 bp, Artificial Sequence
  chemically synthesized
ttagccattttgatgtagcc

SEQ ID NO: 437177 - DNA, 20 bp, Artificial Sequence
  chemically synthesized
aatatttagccattttgatg

SEQ ID NO: 437178 - DNA, 20 bp, Artificial Sequence
  chemically synthesized
taaacttggctacatcaaaa

SEQ ID NO: 437179 - DNA, 20 bp, Artificial Sequence
  chemically synthesized
catcaaaatggctaaatatt

SEQ ID NO: 437180 - DNA, 20 bp, Artificial Sequence
  chemically synthesized
aaaacattagaccaaatatt

SEQ ID NO: 437181 - DNA, 20 bp, Artificial Sequence
  chemically synthesized
ttaagtttaaagaaaaacat

SEQ ID NO: 437182 - DNA, 20 bp, Artificial Sequence
  chemically synthesized
aaacttataatttaagttta

SEQ ID NO: 437183 - DNA, 20 bp, Artificial Sequence
  chemically synthesized
tttctttaaacttaaattat

SEQ ID NO: 437184 - DNA, 20 bp, Artificial Sequence
  chemically synthesized
gtaatctaaacttataattt

SEQ ID NO: 437185 - DNA, 20 bp, Artificial Sequence
  chemically synthesized
ttaaacttaaattataagtt

SEQ ID NO: 437186 - DNA, 20 bp, Artificial Sequence
  chemically synthesized
ccaattgtttaagtaagtta

SEQ ID NO: 437187 - DNA, 20 bp, Artificial Sequence
  chemically synthesized
gccaattgtttaagtaagtt

SEQ ID NO: 437188 - DNA, 20 bp, Artificial Sequence
  chemically synthesized
gtccagccaattgtttaagt

SEQ ID NO: 437189 - DNA, 20 bp, Artificial Sequence
  chemically synthesized
ccttaacttacttaaacaat

SEQ ID NO: 437190 - DNA, 20 bp, Artificial Sequence
  chemically synthesized
aaatgtccagccaattgttt

SEQ ID NO: 437191 - DNA, 20 bp, Artificial Sequence
  chemically synthesized
aacttacttaaacaattggc

SEQ ID NO: 437192 - DNA, 20 bp, Artificial Sequence
  chemically synthesized
tcaatattttttcaaatgtc

SEQ ID NO: 437193 - DNA, 20 bp, Artificial Sequence
  chemically synthesized
aaaaaaaaaaaaaagaaaga

SEQ ID NO: 437194 - DNA, 20 bp, Artificial Sequence
  chemically synthesized
aaaaaaaaaaaaaaaaaaga

SEQ ID NO: 437195 - DNA, 20 bp, Artificial Sequence
  chemically synthesized
aaaaaaaaaaaaaaaaaaaa

SEQ ID NO: 437196 - DNA, 20 bp, Artificial Sequence
  chemically synthesized
tttttttttttttttttttt

SEQ ID NO: 437197 - DNA, 20 bp, Artificial Sequence
  chemically synthesized
ttttttttttttttttgaga

SEQ ID NO: 437198 - DNA, 20 bp, Artificial Sequence
  chemically synthesized
ttttttttttttttgagacg

SEQ ID NO: 437199 - DNA, 20 bp, Artificial Sequence
  chemically synthesized
tccggcctgggcgacagagc

SEQ ID NO: 437200 - DNA, 20 bp, Artificial Sequence
  chemically synthesized
cggagtctcgctctgtcgcc

SEQ ID NO: 437201 - DNA, 20 bp, Artificial Sequence
  chemically synthesized
gcagtccggcctgggcgaca

SEQ ID NO: 437202 - DNA, 20 bp, Artificial Sequence
  chemically synthesized
ggagtctcgctctgtcgccc

SEQ ID NO: 437203 - DNA, 20 bp, Artificial Sequence
  chemically synthesized
ccgcagtccggcctgggcga

SEQ ID NO: 437204 - DNA, 20 bp, Artificial Sequence
  chemically synthesized
tctcgctctgtcgcccaggc

SEQ ID NO: 437205 - DNA, 20 bp, Artificial Sequence
  chemically synthesized
tgcagtccgcagtccggcct

SEQ ID NO: 437206 - DNA, 20 bp, Artificial Sequence
  chemically synthesized
ctgcagtccgcagtccggcc

SEQ ID NO: 437207 - DNA, 20 bp, Artificial Sequence
  chemically synthesized
ctgtcgcccaggccggactg

SEQ ID NO: 437208 - DNA, 20 bp, Artificial Sequence
  chemically synthesized
cgccactgcagtccgcagtc

SEQ ID NO: 437209 - DNA, 20 bp, Artificial Sequence
  chemically synthesized
ccaggccggactgcggactg

SEQ ID NO: 437210 - DNA, 20 bp, Artificial Sequence
  chemically synthesized
gattgcgccactgcagtccg

SEQ ID NO: 437211 - DNA, 20 bp, Artificial Sequence
  chemically synthesized
ggccggactgcggactgcag

SEQ ID NO: 437212 - DNA, 20 bp, Artificial Sequence
  chemically synthesized
gagccgagattgcgccactg

SEQ ID NO: 437213 - DNA, 20 bp, Artificial Sequence
  chemically synthesized
ggactgcagtggcgcaatct

SEQ ID NO: 437214 - DNA, 20 bp, Artificial Sequence
  chemically synthesized
agcggagcttgcagtgagcc

SEQ ID NO: 437215 - DNA, 20 bp, Artificial Sequence
  chemically synthesized
gcgcaatctcggctcactgc

SEQ ID NO: 437216 - DNA, 20 bp, Artificial Sequence
  chemically synthesized
cgggaagcggagcttgcagt

SEQ ID NO: 437217 - DNA, 20 bp, Artificial Sequence
  chemically synthesized
aacccgggaagcggagcttg

SEQ ID NO: 437218 - DNA, 20 bp, Artificial Sequence
  chemically synthesized
tcactgcaagctccgcttcc

SEQ ID NO: 437219 - DNA, 20 bp, Artificial Sequence
  chemically synthesized
tggcgtgaacccgggaagcg

SEQ ID NO: 437220 - DNA, 20 bp, Artificial Sequence
  chemically synthesized
cactgcaagctccgcttccc

SEQ ID NO: 437221 - DNA, 20 bp, Artificial Sequence
  chemically synthesized
aatggcgtgaacccgggaag

SEQ ID NO: 437222 - DNA, 20 bp, Artificial Sequence
  chemically synthesized
gagaatggcgtgaacccggg

SEQ ID NO: 437223 - DNA, 20 bp, Artificial Sequence
  chemically synthesized
caggagaatggcgtgaaccc

SEQ ID NO: 437224 - DNA, 20 bp, Artificial Sequence
  chemically synthesized
gcaggagaatggcgtgaacc

SEQ ID NO: 437225 - DNA, 20 bp, Artificial Sequence
  chemically synthesized
gggaggctgaggcaggagaa

SEQ ID NO: 437226 - DNA, 20 bp, Artificial Sequence
  chemically synthesized
ttcacgccattctcctgcct

SEQ ID NO: 437227 - DNA, 20 bp, Artificial Sequence
  chemically synthesized
tactcgggaggctgaggcag

SEQ ID NO: 437228 - DNA, 20 bp, Artificial Sequence
  chemically synthesized
gctactcgggaggctgaggc

SEQ ID NO: 437229 - DNA, 20 bp, Artificial Sequence
  chemically synthesized
agctactcgggaggctgagg

SEQ ID NO: 437230 - DNA, 20 bp, Artificial Sequence
  chemically synthesized
cccagctactcgggaggctg

SEQ ID NO: 437231 - DNA, 20 bp, Artificial Sequence
  chemically synthesized
tcccagctactcgggaggct

SEQ ID NO: 437232 - DNA, 20 bp, Artificial Sequence
  chemically synthesized
ttctcctgcctcagcctccc

SEQ ID NO: 437233 - DNA, 20 bp, Artificial Sequence
  chemically synthesized
tcctgcctcagcctcccgag

SEQ ID NO: 437234 - DNA, 20 bp, Artificial Sequence
  chemically synthesized
tgtggtcccagctactcggg

SEQ ID NO: 437235 - DNA, 20 bp, Artificial Sequence
  chemically synthesized
ctgtggtcccagctactcgg

SEQ ID NO: 437236 - DNA, 20 bp, Artificial Sequence
  chemically synthesized
gcctcagcctcccgagtagc

SEQ ID NO: 437237 - DNA, 20 bp, Artificial Sequence
  chemically synthesized
gcctgtggtcccagctactc

SEQ ID NO: 437238 - DNA, 20 bp, Artificial Sequence
  chemically synthesized
cctcagcctcccgagtagct

SEQ ID NO: 437239 - DNA, 20 bp, Artificial Sequence
  chemically synthesized
cgcctgtggtcccagctact

SEQ ID NO: 437240 - DNA, 20 bp, Artificial Sequence
  chemically synthesized
ctcccgagtagctgggacca

SEQ ID NO: 437241 - DNA, 20 bp, Artificial Sequence
  chemically synthesized
tcccgagtagctgggaccac

SEQ ID NO: 437242 - DNA, 20 bp, Artificial Sequence
  chemically synthesized
gtggcgggcgcctgtggtcc

SEQ ID NO: 437243 - DNA, 20 bp, Artificial Sequence
  chemically synthesized
ggcgcggtggcgggcgcctg

SEQ ID NO: 437244 - DNA, 20 bp, Artificial Sequence
  chemically synthesized
aattagccgggcgcggtggc

SEQ ID NO: 437245 - DNA, 20 bp, Artificial Sequence
  chemically synthesized
aaattagccgggcgcggtgg

SEQ ID NO: 437246 - DNA, 20 bp, Artificial Sequence
  chemically synthesized
caggcgcccgccaccgcgcc

SEQ ID NO: 437247 - DNA, 20 bp, Artificial Sequence
  chemically synthesized
aaaaaattagccgggcgcgg

SEQ ID NO: 437248 - DNA, 20 bp, Artificial Sequence
  chemically synthesized
tacaaaaaattagccgggcg

SEQ ID NO: 437249 - DNA, 20 bp, Artificial Sequence
  chemically synthesized
aaaaatacaaaaaattagcc

SEQ ID NO: 437250 - DNA, 20 bp, Artificial Sequence
  chemically synthesized
taaaaatacaaaaaattagc

SEQ ID NO: 437251 - DNA, 20 bp, Artificial Sequence
  chemically synthesized
ctactaaaaatacaaaaaat

SEQ ID NO: 437252 - DNA, 20 bp, Artificial Sequence
  chemically synthesized
cggctaattttttgtatttt

SEQ ID NO: 437253 - DNA, 20 bp, Artificial Sequence
  chemically synthesized
ctaattttttgtatttttag

SEQ ID NO: 437254 - DNA, 20 bp, Artificial Sequence
  chemically synthesized
aattttttgtatttttagta

SEQ ID NO: 437255 - DNA, 20 bp, Artificial Sequence
  chemically synthesized
ttttgtatttttagtagaga

SEQ ID NO: 437256 - DNA, 20 bp, Artificial Sequence
  chemically synthesized
tttgtatttttagtagagac

SEQ ID NO: 437257 - DNA, 20 bp, Artificial Sequence
  chemically synthesized
ttgtatttttagtagagacg

SEQ ID NO: 437258 - DNA, 20 bp, Artificial Sequence
  chemically synthesized
gagacggggtttcaccttgt

SEQ ID NO: 437259 - DNA, 20 bp, Artificial Sequence
  chemically synthesized
cggggtttcaccttgttagc

SEQ ID NO: 437260 - DNA, 20 bp, Artificial Sequence
  chemically synthesized
cgagaccatcctggctaaca

SEQ ID NO: 437261 - DNA, 20 bp, Artificial Sequence
  chemically synthesized
ggggtttcaccttgttagcc

SEQ ID NO: 437262 - DNA, 20 bp, Artificial Sequence
  chemically synthesized
tcgagaccatcctggctaac

SEQ ID NO: 437263 - DNA, 20 bp, Artificial Sequence
  chemically synthesized
tttcaccttgttagccagga

SEQ ID NO: 437264 - DNA, 20 bp, Artificial Sequence
  chemically synthesized
tcaggagatcgagaccatcc

SEQ ID NO: 437265 - DNA, 20 bp, Artificial Sequence
  chemically synthesized
gatcatgaggtcaggagatc

SEQ ID NO: 437266 - DNA, 20 bp, Artificial Sequence
  chemically synthesized
cgggtggatcatgaggtcag

SEQ ID NO: 437267 - DNA, 20 bp, Artificial Sequence
  chemically synthesized
ggcgggtggatcatgaggtc

SEQ ID NO: 437268 - DNA, 20 bp, Artificial Sequence
  chemically synthesized
aggcgggtggatcatgaggt

SEQ ID NO: 437269 - DNA, 20 bp, Artificial Sequence
  chemically synthesized
gccgaggcgggtggatcatg

SEQ ID NO: 437270 - DNA, 20 bp, Artificial Sequence
  chemically synthesized
ggccgaggcgggtggatcat

SEQ ID NO: 437271 - DNA, 20 bp, Artificial Sequence
  chemically synthesized
acctcatgatccacccgcct

SEQ ID NO: 437272 - DNA, 20 bp, Artificial Sequence
  chemically synthesized
ctttgggaggccgaggcggg

SEQ ID NO: 437273 - DNA, 20 bp, Artificial Sequence
  chemically synthesized
gcactttgggaggccgaggc

SEQ ID NO: 437274 - DNA, 20 bp, Artificial Sequence
  chemically synthesized
agcactttgggaggccgagg

SEQ ID NO: 437275 - DNA, 20 bp, Artificial Sequence
  chemically synthesized
cccagcactttgggaggccg

SEQ ID NO: 437276 - DNA, 20 bp, Artificial Sequence
  chemically synthesized
tcccagcactttgggaggcc

SEQ ID NO: 437277 - DNA, 20 bp, Artificial Sequence
  chemically synthesized
ccacccgcctcggcctccca

SEQ ID NO: 437278 - DNA, 20 bp, Artificial Sequence
  chemically synthesized
tgtaatcccagcactttggg

SEQ ID NO: 437279 - DNA, 20 bp, Artificial Sequence
  chemically synthesized
ctgtaatcccagcactttgg

SEQ ID NO: 437280 - DNA, 20 bp, Artificial Sequence
  chemically synthesized
gcctcggcctcccaaagtgc

SEQ ID NO: 437281 - DNA, 20 bp, Artificial Sequence
  chemically synthesized
gcctgtaatcccagcacttt

SEQ ID NO: 437282 - DNA, 20 bp, Artificial Sequence
  chemically synthesized
cctcggcctcccaaagtgct

SEQ ID NO: 437283 - DNA, 20 bp, Artificial Sequence
  chemically synthesized
cgcctgtaatcccagcactt

SEQ ID NO: 437284 - DNA, 20 bp, Artificial Sequence
  chemically synthesized
ctcccaaagtgctgggatta

SEQ ID NO: 437285 - DNA, 20 bp, Artificial Sequence
  chemically synthesized
tcccaaagtgctgggattac

SEQ ID NO: 437286 - DNA, 20 bp, Artificial Sequence
  chemically synthesized
gtggctcacgcctgtaatcc

SEQ ID NO: 437287 - DNA, 20 bp, Artificial Sequence
  chemically synthesized
agtgctgggattacaggcgt

SEQ ID NO: 437288 - DNA, 20 bp, Artificial Sequence
  chemically synthesized
caggcgtgagccaccgcgcc

SEQ ID NO: 437289 - DNA, 20 bp, Artificial Sequence
  chemically synthesized
aaagatcaggctgggcgcgg

SEQ ID NO: 437290 - DNA, 20 bp, Artificial Sequence
  chemically synthesized
aagaaagatcaggctgggcg

SEQ ID NO: 437291 - DNA, 20 bp, Artificial Sequence
  chemically synthesized
atagaaagaaagatcaggct

SEQ ID NO: 437292 - DNA, 20 bp, Artificial Sequence
  chemically synthesized
tatagaaagaaagatcaggc

SEQ ID NO: 437293 - DNA, 20 bp, Artificial Sequence
  chemically synthesized
tatgtatagaaagaaagatc

SEQ ID NO: 437294 - DNA, 20 bp, Artificial Sequence
  chemically synthesized
atatgtatagaaagaaagat

SEQ ID NO: 437295 - DNA, 20 bp, Artificial Sequence
  chemically synthesized
agcttatatgtatagaaaga

SEQ ID NO: 437296 - DNA, 20 bp, Artificial Sequence
  chemically synthesized
agaaagcttatatgtataga

SEQ ID NO: 437297 - DNA, 20 bp, Artificial Sequence
  chemically synthesized
atctttctttctatacatat

SEQ ID NO: 437298 - DNA, 20 bp, Artificial Sequence
  chemically synthesized
ggacagaaagcttatatgta

SEQ ID NO: 437299 - DNA, 20 bp, Artificial Sequence
  chemically synthesized
ccttttataaattggacaga

SEQ ID NO: 437300 - DNA, 20 bp, Artificial Sequence
  chemically synthesized
acttccttttataaattgga

SEQ ID NO: 437301 - DNA, 20 bp, Artificial Sequence
  chemically synthesized
tactacttccttttataaat

SEQ ID NO: 437302 - DNA, 20 bp, Artificial Sequence
  chemically synthesized
gctttctgtccaatttataa

SEQ ID NO: 437303 - DNA, 20 bp, Artificial Sequence
  chemically synthesized
ctttctgtccaatttataaa

SEQ ID NO: 437304 - DNA, 20 bp, Artificial Sequence
  chemically synthesized
tctgtccaatttataaaagg

SEQ ID NO: 437305 - DNA, 20 bp, Artificial Sequence
  chemically synthesized
gtccaatttataaaaggaag

SEQ ID NO: 437306 - DNA, 20 bp, Artificial Sequence
  chemically synthesized
taatattatatattatatat

SEQ ID NO: 437307 - DNA, 20 bp, Artificial Sequence
  chemically synthesized
taatattatatatatatata

SEQ ID NO: 437308 - DNA, 20 bp, Artificial Sequence
  chemically synthesized
atttcttactagggcagtat

SEQ ID NO: 437309 - DNA, 20 bp, Artificial Sequence
  chemically synthesized
gatttcttactagggcagta

SEQ ID NO: 437310 - DNA, 20 bp, Artificial Sequence
  chemically synthesized
agtgtacacctatactgccc

SEQ ID NO: 437311 - DNA, 20 bp, Artificial Sequence
  chemically synthesized
tacacctatactgccctagt

SEQ ID NO: 437312 - DNA, 20 bp, Artificial Sequence
  chemically synthesized
ttcctgatttcttactaggg

SEQ ID NO: 437313 - DNA, 20 bp, Artificial Sequence
  chemically synthesized
gacttcctgatttcttacta

SEQ ID NO: 437314 - DNA, 20 bp, Artificial Sequence
  chemically synthesized
tgacttcctgatttcttact

SEQ ID NO: 437315 - DNA, 20 bp, Artificial Sequence
  chemically synthesized
ctgacttcctgatttcttac

SEQ ID NO: 437316 - DNA, 20 bp, Artificial Sequence
  chemically synthesized
atactgccctagtaagaaat

SEQ ID NO: 437317 - DNA, 20 bp, Artificial Sequence
  chemically synthesized
tactgccctagtaagaaatc

SEQ ID NO: 437318 - DNA, 20 bp, Artificial Sequence
  chemically synthesized
tgccctagtaagaaatcagg

SEQ ID NO: 437319 - DNA, 20 bp, Artificial Sequence
  chemically synthesized
ctagtaagaaatcaggaagt

SEQ ID NO: 437320 - DNA, 20 bp, Artificial Sequence
  chemically synthesized
agagagacaaaaatagtaga

SEQ ID NO: 437321 - DNA, 20 bp, Artificial Sequence
  chemically synthesized
ggagagagacaaaaatagta

SEQ ID NO: 437322 - DNA, 20 bp, Artificial Sequence
  chemically synthesized
gaggagagagacaaaaatag

SEQ ID NO: 437323 - DNA, 20 bp, Artificial Sequence
  chemically synthesized
aatgaggagagagacaaaaa

SEQ ID NO: 437324 - DNA, 20 bp, Artificial Sequence
  chemically synthesized
ttgcgcgggtaatgaggaga

SEQ ID NO: 437325 - DNA, 20 bp, Artificial Sequence
  chemically synthesized
atttgcgcgggtaatgagga

SEQ ID NO: 437326 - DNA, 20 bp, Artificial Sequence
  chemically synthesized
ttatttgcgcgggtaatgag

SEQ ID NO: 437327 - DNA, 20 bp, Artificial Sequence
  chemically synthesized
acttatttgcgcgggtaatg

SEQ ID NO: 437328 - DNA, 20 bp, Artificial Sequence
  chemically synthesized
aacttatttgcgcgggtaat

SEQ ID NO: 437329 - DNA, 20 bp, Artificial Sequence
  chemically synthesized
ttagtaaaacttatttgcgc

SEQ ID NO: 437330 - DNA, 20 bp, Artificial Sequence
  chemically synthesized
tcctcattacccgcgcaaat

SEQ ID NO: 437331 - DNA, 20 bp, Artificial Sequence
  chemically synthesized
attagtaaaacttatttgcg

SEQ ID NO: 437332 - DNA, 20 bp, Artificial Sequence
  chemically synthesized
aagatatttagatatttaat

SEQ ID NO: 437333 - DNA, 20 bp, Artificial Sequence
  chemically synthesized
aaatgcaaacaaaagatatt

SEQ ID NO: 437334 - DNA, 20 bp, Artificial Sequence
  chemically synthesized
aaaagacaaaatgcaaacaa

SEQ ID NO: 437335 - DNA, 20 bp, Artificial Sequence
  chemically synthesized
ttagggcattaggaatgaaa

SEQ ID NO: 437336 - DNA, 20 bp, Artificial Sequence
  chemically synthesized
gataagagccttagggcatt

SEQ ID NO: 437337 - DNA, 20 bp, Artificial Sequence
  chemically synthesized
tttttcattcctaatgccct

SEQ ID NO: 437338 - DNA, 20 bp, Artificial Sequence
  chemically synthesized
agataagagccttagggcat

SEQ ID NO: 437339 - DNA, 20 bp, Artificial Sequence
  chemically synthesized
ttttcattcctaatgcccta

SEQ ID NO: 437340 - DNA, 20 bp, Artificial Sequence
  chemically synthesized
tatcccagataagagcctta

SEQ ID NO: 437341 - DNA, 20 bp, Artificial Sequence
  chemically synthesized
atatcccagataagagcctt

SEQ ID NO: 437342 - DNA, 20 bp, Artificial Sequence
  chemically synthesized
tatatcccagataagagcct

SEQ ID NO: 437343 - DNA, 20 bp, Artificial Sequence
  chemically synthesized
aatgccctaaggctcttatc

SEQ ID NO: 437344 - DNA, 20 bp, Artificial Sequence
  chemically synthesized
atgccctaaggctcttatct

SEQ ID NO: 437345 - DNA, 20 bp, Artificial Sequence
  chemically synthesized
tgcagttatatcccagataa

SEQ ID NO: 437346 - DNA, 20 bp, Artificial Sequence
  chemically synthesized
gttgcagttatatcccagat

SEQ ID NO: 437347 - DNA, 20 bp, Artificial Sequence
  chemically synthesized
agagggttgcagttatatcc

SEQ ID NO: 437348 - DNA, 20 bp, Artificial Sequence
  chemically synthesized
aagcaggtgtaagagggttg

SEQ ID NO: 437349 - DNA, 20 bp, Artificial Sequence
  chemically synthesized
ttctaaaagcaggtgtaaga

SEQ ID NO: 437350 - DNA, 20 bp, Artificial Sequence
  chemically synthesized
gttctaaaagcaggtgtaag

SEQ ID NO: 437351 - DNA, 20 bp, Artificial Sequence
  chemically synthesized
tgttctaaaagcaggtgtaa

SEQ ID NO: 437352 - DNA, 20 bp, Artificial Sequence
  chemically synthesized
actgttctaaaagcaggtgt

SEQ ID NO: 437353 - DNA, 20 bp, Artificial Sequence
  chemically synthesized
aaccctcttacacctgcttt

SEQ ID NO: 437354 - DNA, 20 bp, Artificial Sequence
  chemically synthesized
agagccactgttctaaaagc

SEQ ID NO: 437355 - DNA, 20 bp, Artificial Sequence
  chemically synthesized
tagagccactgttctaaaag

SEQ ID NO: 437356 - DNA, 20 bp, Artificial Sequence
  chemically synthesized
tcttacacctgcttttagaa

SEQ ID NO: 437357 - DNA, 20 bp, Artificial Sequence
  chemically synthesized
gtttagagccactgttctaa

SEQ ID NO: 437358 - DNA, 20 bp, Artificial Sequence
  chemically synthesized
tacacctgcttttagaacag

SEQ ID NO: 437359 - DNA, 20 bp, Artificial Sequence
  chemically synthesized
ccaagtgcagattgtgttta

SEQ ID NO: 437360 - DNA, 20 bp, Artificial Sequence
  chemically synthesized
caccaagtgcagattgtgtt

SEQ ID NO: 437361 - DNA, 20 bp, Artificial Sequence
  chemically synthesized
ctctaaacacaatctgcact

SEQ ID NO: 437362 - DNA, 20 bp, Artificial Sequence
  chemically synthesized
acatacaggcacaccaagtg

SEQ ID NO: 437363 - DNA, 20 bp, Artificial Sequence
  chemically synthesized
tcagaacatacaggcacacc

SEQ ID NO: 437364 - DNA, 20 bp, Artificial Sequence
  chemically synthesized
ccaatgaaatcagaacatac

SEQ ID NO: 437365 - DNA, 20 bp, Artificial Sequence
  chemically synthesized
accaatgaaatcagaacata

SEQ ID NO: 437366 - DNA, 20 bp, Artificial Sequence
  chemically synthesized
cctgtatgttctgatttcat

SEQ ID NO: 437367 - DNA, 20 bp, Artificial Sequence
  chemically synthesized
ctcttgcagaccaatgaaat

SEQ ID NO: 437368 - DNA, 20 bp, Artificial Sequence
  chemically synthesized
ttctgatttcattggtctgc

SEQ ID NO: 437369 - DNA, 20 bp, Artificial Sequence
  chemically synthesized
ctgatttcattggtctgcaa

SEQ ID NO: 437370 - DNA, 20 bp, Artificial Sequence
  chemically synthesized
agggtttgtgaaaactcttg

SEQ ID NO: 437371 - DNA, 20 bp, Artificial Sequence
  chemically synthesized
tctatttgttagatgacaca

SEQ ID NO: 437372 - DNA, 20 bp, Artificial Sequence
  chemically synthesized
atctatttgttagatgacac

SEQ ID NO: 437373 - DNA, 20 bp, Artificial Sequence
  chemically synthesized
gatctatttgttagatgaca

SEQ ID NO: 437374 - DNA, 20 bp, Artificial Sequence
  chemically synthesized
accctgtgtcatctaacaaa

SEQ ID NO: 437375 - DNA, 20 bp, Artificial Sequence
  chemically synthesized
ggaggttcagatctatttgt

SEQ ID NO: 437376 - DNA, 20 bp, Artificial Sequence
  chemically synthesized
aatttttaaaggaggaggtt

SEQ ID NO: 437377 - DNA, 20 bp, Artificial Sequence
  chemically synthesized
tcttgaatttttaaaggagg

SEQ ID NO: 437378 - DNA, 20 bp, Artificial Sequence
  chemically synthesized
atcttgaatttttaaaggag

SEQ ID NO: 437379 - DNA, 20 bp, Artificial Sequence
  chemically synthesized
gcatcttgaatttttaaagg

SEQ ID NO: 437380 - DNA, 20 bp, Artificial Sequence
  chemically synthesized
tgcatcttgaatttttaaag

SEQ ID NO: 437381 - DNA, 20 bp, Artificial Sequence
  chemically synthesized
tttgcatcttgaatttttaa

SEQ ID NO: 437382 - DNA, 20 bp, Artificial Sequence
  chemically synthesized
ttttgcatcttgaattttta

SEQ ID NO: 437383 - DNA, 20 bp, Artificial Sequence
  chemically synthesized
acctcctcctttaaaaattc

SEQ ID NO: 437384 - DNA, 20 bp, Artificial Sequence
  chemically synthesized
gcaaactatgtgttgtcaag

SEQ ID NO: 437385 - DNA, 20 bp, Artificial Sequence
  chemically synthesized
aaagcaaactatgtgttgtc

SEQ ID NO: 437386 - DNA, 20 bp, Artificial Sequence
  chemically synthesized
aaacacttcttgacaacaca

SEQ ID NO: 437387 - DNA, 20 bp, Artificial Sequence
  chemically synthesized
caacacatagtttgctttct

SEQ ID NO: 437388 - DNA, 20 bp, Artificial Sequence
  chemically synthesized
taaaagtaaaaaagctaaga

SEQ ID NO: 437389 - DNA, 20 bp, Artificial Sequence
  chemically synthesized
aaagtaaaagtaaaaaagct

SEQ ID NO: 437390 - DNA, 20 bp, Artificial Sequence
  chemically synthesized
aaaaaaaagtaaaagtaaaa

SEQ ID NO: 437391 - DNA, 20 bp, Artificial Sequence
  chemically synthesized
aaaaaacgaaaaaaaagtaa

SEQ ID NO: 437392 - DNA, 20 bp, Artificial Sequence
  chemically synthesized
tctcaaaaaaaacgaaaaaa

SEQ ID NO: 437393 - DNA, 20 bp, Artificial Sequence
  chemically synthesized
acttttttttcgtttttttt

SEQ ID NO: 437394 - DNA, 20 bp, Artificial Sequence
  chemically synthesized
ttttttcgttttttttgaga

SEQ ID NO: 437395 - DNA, 20 bp, Artificial Sequence
  chemically synthesized
ttttcgttttttttgagata

SEQ ID NO: 437396 - DNA, 20 bp, Artificial Sequence
  chemically synthesized
tccagcctaggtgacagagc

SEQ ID NO: 437397 - DNA, 20 bp, Artificial Sequence
  chemically synthesized
tagagtctcgctctgtcacc

SEQ ID NO: 437398 - DNA, 20 bp, Artificial Sequence
  chemically synthesized
gcactccagcctaggtgaca

SEQ ID NO: 437399 - DNA, 20 bp, Artificial Sequence
  chemically synthesized
agagtctcgctctgtcacct

SEQ ID NO: 437400 - DNA, 20 bp, Artificial Sequence
  chemically synthesized
ctgcactccagcctaggtga

SEQ ID NO: 437401 - DNA, 20 bp, Artificial Sequence
  chemically synthesized
tctcgctctgtcacctaggc

SEQ ID NO: 437402 - DNA, 20 bp, Artificial Sequence
  chemically synthesized
tcgctctgtcacctaggctg

SEQ ID NO: 437403 - DNA, 20 bp, Artificial Sequence
  chemically synthesized
gtgccactgcactccagcct

SEQ ID NO: 437404 - DNA, 20 bp, Artificial Sequence
  chemically synthesized
cgtgccactgcactccagcc

SEQ ID NO: 437405 - DNA, 20 bp, Artificial Sequence
  chemically synthesized
ctgtcacctaggctggagtg

SEQ ID NO: 437406 - DNA, 20 bp, Artificial Sequence
  chemically synthesized
aagttcgtgccactgcactc

SEQ ID NO: 437407 - DNA, 20 bp, Artificial Sequence
  chemically synthesized
tcacctaggctggagtgcag

SEQ ID NO: 437408 - DNA, 20 bp, Artificial Sequence
  chemically synthesized
ggagtgcagtggcacgaact

SEQ ID NO: 437409 - DNA, 20 bp, Artificial Sequence
  chemically synthesized
ggcagaggttgcagtgagcc

SEQ ID NO: 437410 - DNA, 20 bp, Artificial Sequence
  chemically synthesized
caggaggcagaggttgcagt

SEQ ID NO: 437411 - DNA, 20 bp, Artificial Sequence
  chemically synthesized
aacccaggaggcagaggttg

SEQ ID NO: 437412 - DNA, 20 bp, Artificial Sequence
  chemically synthesized
ccgttgaacccaggaggcag

SEQ ID NO: 437413 - DNA, 20 bp, Artificial Sequence
  chemically synthesized
tcactgcaacctctgcctcc

SEQ ID NO: 437414 - DNA, 20 bp, Artificial Sequence
  chemically synthesized
tccgttgaacccaggaggca

SEQ ID NO: 437415 - DNA, 20 bp, Artificial Sequence
  chemically synthesized
cactgcaacctctgcctcct

SEQ ID NO: 437416 - DNA, 20 bp, Artificial Sequence
  chemically synthesized
aatccgttgaacccaggagg

SEQ ID NO: 437417 - DNA, 20 bp, Artificial Sequence
  chemically synthesized
aagaatccgttgaacccagg

SEQ ID NO: 437418 - DNA, 20 bp, Artificial Sequence
  chemically synthesized
gaagaatccgttgaacccag

SEQ ID NO: 437419 - DNA, 20 bp, Artificial Sequence
  chemically synthesized
cagaagaatccgttgaaccc

SEQ ID NO: 437420 - DNA, 20 bp, Artificial Sequence
  chemically synthesized
cctctgcctcctgggttcaa

SEQ ID NO: 437421 - DNA, 20 bp, Artificial Sequence
  chemically synthesized
gcagaagaatccgttgaacc

SEQ ID NO: 437422 - DNA, 20 bp, Artificial Sequence
  chemically synthesized
ttcaacggattcttctgcct

SEQ ID NO: 437423 - DNA, 20 bp, Artificial Sequence
  chemically synthesized
tgcttgggaggctgaggcag

SEQ ID NO: 437424 - DNA, 20 bp, Artificial Sequence
  chemically synthesized
agctgcttgggaggctgagg

SEQ ID NO: 437425 - DNA, 20 bp, Artificial Sequence
  chemically synthesized
cccagctgcttgggaggctg

SEQ ID NO: 437426 - DNA, 20 bp, Artificial Sequence
  chemically synthesized
tcccagctgcttgggaggct

SEQ ID NO: 437427 - DNA, 20 bp, Artificial Sequence
  chemically synthesized
ttcttctgcctcagcctccc

SEQ ID NO: 437428 - DNA, 20 bp, Artificial Sequence
  chemically synthesized
ttctgcctcagcctcccaag

SEQ ID NO: 437429 - DNA, 20 bp, Artificial Sequence
  chemically synthesized
tgtaatcccagctgcttggg

SEQ ID NO: 437430 - DNA, 20 bp, Artificial Sequence
  chemically synthesized
gtgtaatcccagctgcttgg

SEQ ID NO: 437431 - DNA, 20 bp, Artificial Sequence
  chemically synthesized
gcctcagcctcccaagcagc

SEQ ID NO: 437432 - DNA, 20 bp, Artificial Sequence
  chemically synthesized
acgtgtaatcccagctgctt

SEQ ID NO: 437433 - DNA, 20 bp, Artificial Sequence
  chemically synthesized
cctcagcctcccaagcagct

SEQ ID NO: 437434 - DNA, 20 bp, Artificial Sequence
  chemically synthesized
cacgtgtaatcccagctgct

SEQ ID NO: 437435 - DNA, 20 bp, Artificial Sequence
  chemically synthesized
gtggtgcacacgtgtaatcc

SEQ ID NO: 437436 - DNA, 20 bp, Artificial Sequence
  chemically synthesized
cacgtgtgcaccaccacgtc

SEQ ID NO: 437437 - DNA, 20 bp, Artificial Sequence
  chemically synthesized
caaacattagctggacgtgg

SEQ ID NO: 437438 - DNA, 20 bp, Artificial Sequence
  chemically synthesized
agacaaacattagctggacg

SEQ ID NO: 437439 - DNA, 20 bp, Artificial Sequence
  chemically synthesized
ctaaaaagacaaacattagc

SEQ ID NO: 437440 - DNA, 20 bp, Artificial Sequence
  chemically synthesized
tctactaaaaagacaaacat

SEQ ID NO: 437441 - DNA, 20 bp, Artificial Sequence
  chemically synthesized
ccagctaatgtttgtctttt

SEQ ID NO: 437442 - DNA, 20 bp, Artificial Sequence
  chemically synthesized
gctaatgtttgtctttttag

SEQ ID NO: 437443 - DNA, 20 bp, Artificial Sequence
  chemically synthesized
taatgtttgtctttttagta

SEQ ID NO: 437444 - DNA, 20 bp, Artificial Sequence
  chemically synthesized
gtaaccccgtctctactaaa

SEQ ID NO: 437445 - DNA, 20 bp, Artificial Sequence
  chemically synthesized
gtttgtctttttagtagaga

SEQ ID NO: 437446 - DNA, 20 bp, Artificial Sequence
  chemically synthesized
tttgtctttttagtagagac

SEQ ID NO: 437447 - DNA, 20 bp, Artificial Sequence
  chemically synthesized
ttgtctttttagtagagacg

SEQ ID NO: 437448 - DNA, 20 bp, Artificial Sequence
  chemically synthesized
gagacggggttacaccatgt

SEQ ID NO: 437449 - DNA, 20 bp, Artificial Sequence
  chemically synthesized
cggggttacaccatgttggc

SEQ ID NO: 437450 - DNA, 20 bp, Artificial Sequence
  chemically synthesized
cgagaccagcctggccaaca

SEQ ID NO: 437451 - DNA, 20 bp, Artificial Sequence
  chemically synthesized
ggggttacaccatgttggcc

SEQ ID NO: 437452 - DNA, 20 bp, Artificial Sequence
  chemically synthesized
ttacaccatgttggccaggc

SEQ ID NO: 437453 - DNA, 20 bp, Artificial Sequence
  chemically synthesized
ccaggagttcgagaccagcc

SEQ ID NO: 437454 - DNA, 20 bp, Artificial Sequence
  chemically synthesized
tgaggccaggagttcgagac

SEQ ID NO: 437455 - DNA, 20 bp, Artificial Sequence
  chemically synthesized
ccaggctggtctcgaactcc

SEQ ID NO: 437456 - DNA, 20 bp, Artificial Sequence
  chemically synthesized
tcacttgaggccaggagttc

SEQ ID NO: 437457 - DNA, 20 bp, Artificial Sequence
  chemically synthesized
ggaagatcacttgaggccag

SEQ ID NO: 437458 - DNA, 20 bp, Artificial Sequence
  chemically synthesized
ggtctcgaactcctggcctc

SEQ ID NO: 437459 - DNA, 20 bp, Artificial Sequence
  chemically synthesized
cgggaagatcacttgaggcc

SEQ ID NO: 437460 - DNA, 20 bp, Artificial Sequence
  chemically synthesized
gcgggaagatcacttgaggc

SEQ ID NO: 437461 - DNA, 20 bp, Artificial Sequence
  chemically synthesized
caaggcgggaagatcacttg

SEQ ID NO: 437462 - DNA, 20 bp, Artificial Sequence
  chemically synthesized
ccaaggcgggaagatcactt

SEQ ID NO: 437463 - DNA, 20 bp, Artificial Sequence
  chemically synthesized
ctcaagtgatcttcccgcct

SEQ ID NO: 437464 - DNA, 20 bp, Artificial Sequence
  chemically synthesized
ctttgggaggccaaggcggg

SEQ ID NO: 437465 - DNA, 20 bp, Artificial Sequence
  chemically synthesized
acactttgggaggccaaggc

SEQ ID NO: 437466 - DNA, 20 bp, Artificial Sequence
  chemically synthesized
aacactttgggaggccaagg

SEQ ID NO: 437467 - DNA, 20 bp, Artificial Sequence
  chemically synthesized
cccaacactttgggaggcca

SEQ ID NO: 437468 - DNA, 20 bp, Artificial Sequence
  chemically synthesized
tcccaacactttgggaggcc

SEQ ID NO: 437469 - DNA, 20 bp, Artificial Sequence
  chemically synthesized
cttcccgccttggcctccca

SEQ ID NO: 437470 - DNA, 20 bp, Artificial Sequence
  chemically synthesized
agtaatcccaacactttggg

SEQ ID NO: 437471 - DNA, 20 bp, Artificial Sequence
  chemically synthesized
aagtaatcccaacactttgg

SEQ ID NO: 437472 - DNA, 20 bp, Artificial Sequence
  chemically synthesized
gccttggcctcccaaagtgt

SEQ ID NO: 437473 - DNA, 20 bp, Artificial Sequence
  chemically synthesized
gcaagtaatcccaacacttt

SEQ ID NO: 437474 - DNA, 20 bp, Artificial Sequence
  chemically synthesized
ccttggcctcccaaagtgtt

SEQ ID NO: 437475 - DNA, 20 bp, Artificial Sequence
  chemically synthesized
tgcaagtaatcccaacactt

SEQ ID NO: 437476 - DNA, 20 bp, Artificial Sequence
  chemically synthesized
agtgttgggattacttgcat

SEQ ID NO: 437477 - DNA, 20 bp, Artificial Sequence
  chemically synthesized
ccaggcatggtggctcatgc

SEQ ID NO: 437478 - DNA, 20 bp, Artificial Sequence
  chemically synthesized
cttgcatgagccaccatgcc

SEQ ID NO: 437479 - DNA, 20 bp, Artificial Sequence
  chemically synthesized
ataaagcaggccaggcatgg

SEQ ID NO: 437480 - DNA, 20 bp, Artificial Sequence
  chemically synthesized
accataaagcaggccaggca

SEQ ID NO: 437481 - DNA, 20 bp, Artificial Sequence
  chemically synthesized
ataaaaccataaagcaggcc

SEQ ID NO: 437482 - DNA, 20 bp, Artificial Sequence
  chemically synthesized
aataaaaccataaagcaggc

SEQ ID NO: 437483 - DNA, 20 bp, Artificial Sequence
  chemically synthesized
accatgcctggcctgcttta

SEQ ID NO: 437484 - DNA, 20 bp, Artificial Sequence
  chemically synthesized
gcaaaataaaaccataaagc

SEQ ID NO: 437485 - DNA, 20 bp, Artificial Sequence
  chemically synthesized
agcaaaataaaaccataaag

SEQ ID NO: 437486 - DNA, 20 bp, Artificial Sequence
  chemically synthesized
gtgagcaaaataaaaccata

SEQ ID NO: 437487 - DNA, 20 bp, Artificial Sequence
  chemically synthesized
ttttattttgctcactgtct

SEQ ID NO: 437488 - DNA, 20 bp, Artificial Sequence
  chemically synthesized
ctagtactagcttagacagt

SEQ ID NO: 437489 - DNA, 20 bp, Artificial Sequence
  chemically synthesized
attttgctcactgtctaagc

SEQ ID NO: 437490 - DNA, 20 bp, Artificial Sequence
  chemically synthesized
tcacctagtactagcttaga

SEQ ID NO: 437491 - DNA, 20 bp, Artificial Sequence
  chemically synthesized
ctcctcacctagtactagct

SEQ ID NO: 437492 - DNA, 20 bp, Artificial Sequence
  chemically synthesized
ctcactgtctaagctagtac

SEQ ID NO: 437493 - DNA, 20 bp, Artificial Sequence
  chemically synthesized
tcactgtctaagctagtact

SEQ ID NO: 437494 - DNA, 20 bp, Artificial Sequence
  chemically synthesized
atctactcctcacctagtac

SEQ ID NO: 437495 - DNA, 20 bp, Artificial Sequence
  chemically synthesized
tgtctaagctagtactaggt

SEQ ID NO: 437496 - DNA, 20 bp, Artificial Sequence
  chemically synthesized
gtctaagctagtactaggtg

SEQ ID NO: 437497 - DNA, 20 bp, Artificial Sequence
  chemically synthesized
ctaagctagtactaggtgag

SEQ ID NO: 437498 - DNA, 20 bp, Artificial Sequence
  chemically synthesized
tctagcatctactcctcacc

SEQ ID NO: 437499 - DNA, 20 bp, Artificial Sequence
  chemically synthesized
agctagtactaggtgaggag

SEQ ID NO: 437500 - DNA, 20 bp, Artificial Sequence
  chemically synthesized
actaggtgaggagtagatgc

SEQ ID NO: 437501 - DNA, 20 bp, Artificial Sequence
  chemically synthesized
aacatattacaatgggtttc

SEQ ID NO: 437502 - DNA, 20 bp, Artificial Sequence
  chemically synthesized
tctgagcaacatattacaat

SEQ ID NO: 437503 - DNA, 20 bp, Artificial Sequence
  chemically synthesized
ctctgagcaacatattacaa

SEQ ID NO: 437504 - DNA, 20 bp, Artificial Sequence
  chemically synthesized
acccattgtaatatgttgct

SEQ ID NO: 437505 - DNA, 20 bp, Artificial Sequence
  chemically synthesized
ccattgtaatatgttgctca

SEQ ID NO: 437506 - DNA, 20 bp, Artificial Sequence
  chemically synthesized
tgtaatatgttgctcagagc

SEQ ID NO: 437507 - DNA, 20 bp, Artificial Sequence
  chemically synthesized
aaagagaaatggctggctct

SEQ ID NO: 437508 - DNA, 20 bp, Artificial Sequence
  chemically synthesized
atggtggaaagagaaatggc

SEQ ID NO: 437509 - DNA, 20 bp, Artificial Sequence
  chemically synthesized
atgaatggtggaaagagaaa

SEQ ID NO: 437510 - DNA, 20 bp, Artificial Sequence
  chemically synthesized
ttgggtatgaatggtggaaa

SEQ ID NO: 437511 - DNA, 20 bp, Artificial Sequence
  chemically synthesized
gtttgggtatgaatggtgga

SEQ ID NO: 437512 - DNA, 20 bp, Artificial Sequence
  chemically synthesized
ttgggtttgggtatgaatgg

SEQ ID NO: 437513 - DNA, 20 bp, Artificial Sequence
  chemically synthesized
ggtttgggtttgggtatgaa

SEQ ID NO: 437514 - DNA, 20 bp, Artificial Sequence
  chemically synthesized
ttcttgtttggtttgggttt

SEQ ID NO: 437515 - DNA, 20 bp, Artificial Sequence
  chemically synthesized
attcttgtttggtttgggtt

SEQ ID NO: 437516 - DNA, 20 bp, Artificial Sequence
  chemically synthesized
acattattcttgtttggttt

SEQ ID NO: 437517 - DNA, 20 bp, Artificial Sequence
  chemically synthesized
cacattattcttgtttggtt

SEQ ID NO: 437518 - DNA, 20 bp, Artificial Sequence
  chemically synthesized
tacccaaacccaaaccaaac

SEQ ID NO: 437519 - DNA, 20 bp, Artificial Sequence
  chemically synthesized
tctctcacattattcttgtt

SEQ ID NO: 437520 - DNA, 20 bp, Artificial Sequence
  chemically synthesized
aaaccaaacaagaataatgt

SEQ ID NO: 437521 - DNA, 20 bp, Artificial Sequence
  chemically synthesized
accaaacaagaataatgtga

SEQ ID NO: 437522 - DNA, 20 bp, Artificial Sequence
  chemically synthesized
acaagaataatgtgagagat

SEQ ID NO: 437523 - DNA, 20 bp, Artificial Sequence
  chemically synthesized
atgtgagagatcagccatgc

SEQ ID NO: 437524 - DNA, 20 bp, Artificial Sequence
  chemically synthesized
tgtgagagatcagccatgct

SEQ ID NO: 437525 - DNA, 20 bp, Artificial Sequence
  chemically synthesized
tgaattgataggtcctagca

SEQ ID NO: 437526 - DNA, 20 bp, Artificial Sequence
  chemically synthesized
atgactgaattgataggtcc

SEQ ID NO: 437527 - DNA, 20 bp, Artificial Sequence
  chemically synthesized
catgctaggacctatcaatt

SEQ ID NO: 437528 - DNA, 20 bp, Artificial Sequence
  chemically synthesized
ttaacgatgactgaattgat

SEQ ID NO: 437529 - DNA, 20 bp, Artificial Sequence
  chemically synthesized
cttaacgatgactgaattga

SEQ ID NO: 437530 - DNA, 20 bp, Artificial Sequence
  chemically synthesized
ctatcaattcagtcatcgtt

SEQ ID NO: 437531 - DNA, 20 bp, Artificial Sequence
  chemically synthesized
catcgttaagcaacaatcac

SEQ ID NO: 437532 - DNA, 20 bp, Artificial Sequence
  chemically synthesized
tcgttaagcaacaatcacta

SEQ ID NO: 437533 - DNA, 20 bp, Artificial Sequence
  chemically synthesized
agcaacaatcactagagact

SEQ ID NO: 437534 - DNA, 20 bp, Artificial Sequence
  chemically synthesized
tatcacatgtactaagtctc

SEQ ID NO: 437535 - DNA, 20 bp, Artificial Sequence
  chemically synthesized
tgttacatatcacatgtact

SEQ ID NO: 437536 - DNA, 20 bp, Artificial Sequence
  chemically synthesized
ttagtacatgtgatatgtaa

SEQ ID NO: 437537 - DNA, 20 bp, Artificial Sequence
  chemically synthesized
gtacatgtgatatgtaacag

SEQ ID NO: 437538 - DNA, 20 bp, Artificial Sequence
  chemically synthesized
aggcggtgagtttatttaca

SEQ ID NO: 437539 - DNA, 20 bp, Artificial Sequence
  chemically synthesized
tgtttctcacaataggcggt

SEQ ID NO: 437540 - DNA, 20 bp, Artificial Sequence
  chemically synthesized
ggtctgtttctcacaatagg

SEQ ID NO: 437541 - DNA, 20 bp, Artificial Sequence
  chemically synthesized
ataaactcaccgcctattgt

SEQ ID NO: 437542 - DNA, 20 bp, Artificial Sequence
  chemically synthesized
acaggtctgtttctcacaat

SEQ ID NO: 437543 - DNA, 20 bp, Artificial Sequence
  chemically synthesized
tacaggtctgtttctcacaa

SEQ ID NO: 437544 - DNA, 20 bp, Artificial Sequence
  chemically synthesized
tcaccgcctattgtgagaaa

SEQ ID NO: 437545 - DNA, 20 bp, Artificial Sequence
  chemically synthesized
gtgagaaacagacctgtaaa

SEQ ID NO: 437546 - DNA, 20 bp, Artificial Sequence
  chemically synthesized
gtcctttatccactgtttac

SEQ ID NO: 437547 - DNA, 20 bp, Artificial Sequence
  chemically synthesized
agaaacagacctgtaaacag

SEQ ID NO: 437548 - DNA, 20 bp, Artificial Sequence
  chemically synthesized
tgtcctttatccactgttta

SEQ ID NO: 437549 - DNA, 20 bp, Artificial Sequence
  chemically synthesized
agacctgtaaacagtggata

SEQ ID NO: 437550 - DNA, 20 bp, Artificial Sequence
  chemically synthesized
gacctgtaaacagtggataa

SEQ ID NO: 437551 - DNA, 20 bp, Artificial Sequence
  chemically synthesized
gtaaacagtggataaaggac

SEQ ID NO: 437552 - DNA, 20 bp, Artificial Sequence
  chemically synthesized
taaaggacaagaattgcatg

SEQ ID NO: 437553 - DNA, 20 bp, Artificial Sequence
  chemically synthesized
acaagaattgcatgcagtta

SEQ ID NO: 437554 - DNA, 20 bp, Artificial Sequence
  chemically synthesized
tgcatgcagttaaagaaaaa

SEQ ID NO: 437555 - DNA, 20 bp, Artificial Sequence
  chemically synthesized
gcatgcagttaaagaaaaac

SEQ ID NO: 437556 - DNA, 20 bp, Artificial Sequence
  chemically synthesized
gaaaaacaggcaaaataccc

SEQ ID NO: 437557 - DNA, 20 bp, Artificial Sequence
  chemically synthesized
aaaaacaggcaaaataccct

SEQ ID NO: 437558 - DNA, 20 bp, Artificial Sequence
  chemically synthesized
ttccttcctctgaattccca

SEQ ID NO: 437559 - DNA, 20 bp, Artificial Sequence
  chemically synthesized
ggcaaaataccctgggaatt

SEQ ID NO: 437560 - DNA, 20 bp, Artificial Sequence
  chemically synthesized
attccttcctctgaattccc

SEQ ID NO: 437561 - DNA, 20 bp, Artificial Sequence
  chemically synthesized
cattccttcctctgaattcc

SEQ ID NO: 437562 - DNA, 20 bp, Artificial Sequence
  chemically synthesized
caaaataccctgggaattca

SEQ ID NO: 437563 - DNA, 20 bp, Artificial Sequence
  chemically synthesized
aaaataccctgggaattcag

SEQ ID NO: 437564 - DNA, 20 bp, Artificial Sequence
  chemically synthesized
ataccctgggaattcagagg

SEQ ID NO: 437565 - DNA, 20 bp, Artificial Sequence
  chemically synthesized
taccctgggaattcagagga

SEQ ID NO: 437566 - DNA, 20 bp, Artificial Sequence
  chemically synthesized
ggaaggaatgccaaatcacc

SEQ ID NO: 437567 - DNA, 20 bp, Artificial Sequence
  chemically synthesized
tgtaggtgaactgggtgatt

SEQ ID NO: 437568 - DNA, 20 bp, Artificial Sequence
  chemically synthesized
tctttagatgtaggtgaact

SEQ ID NO: 437569 - DNA, 20 bp, Artificial Sequence
  chemically synthesized
ttctttagatgtaggtgaac

SEQ ID NO: 437570 - DNA, 20 bp, Artificial Sequence
  chemically synthesized
acccagttcacctacatcta

SEQ ID NO: 437571 - DNA, 20 bp, Artificial Sequence
  chemically synthesized
aaaaagccttctttagatgt

SEQ ID NO: 437572 - DNA, 20 bp, Artificial Sequence
  chemically synthesized
aaaaaagccttctttagatg

SEQ ID NO: 437573 - DNA, 20 bp, Artificial Sequence
  chemically synthesized
cagttcacctacatctaaag

SEQ ID NO: 437574 - DNA, 20 bp, Artificial Sequence
  chemically synthesized
agttcacctacatctaaaga

SEQ ID NO: 437575 - DNA, 20 bp, Artificial Sequence
  chemically synthesized
acaagaaaaaaagccttctt

SEQ ID NO: 437576 - DNA, 20 bp, Artificial Sequence
  chemically synthesized
attttgatgaacaagaaaaa

SEQ ID NO: 437577 - DNA, 20 bp, Artificial Sequence
  chemically synthesized
acacgagtattttgatgaac

SEQ ID NO: 437578 - DNA, 20 bp, Artificial Sequence
  chemically synthesized
gttcatcaaaatactcgtgt

SEQ ID NO: 437579 - DNA, 20 bp, Artificial Sequence
  chemically synthesized
cttcatgctagttccaacac

SEQ ID NO: 437580 - DNA, 20 bp, Artificial Sequence
  chemically synthesized
caaaatactcgtgttggaac

SEQ ID NO: 437581 - DNA, 20 bp, Artificial Sequence
  chemically synthesized
ctcgtgttggaactagcatg

SEQ ID NO: 437582 - DNA, 20 bp, Artificial Sequence
  chemically synthesized
cgtgttggaactagcatgaa

SEQ ID NO: 437583 - DNA, 20 bp, Artificial Sequence
  chemically synthesized
tgaagtgacactcttcatgc

SEQ ID NO: 437584 - DNA, 20 bp, Artificial Sequence
  chemically synthesized
aaaaaaggccaaagaaggtg

SEQ ID NO: 437585 - DNA, 20 bp, Artificial Sequence
  chemically synthesized
gagtgtcacttcaccttctt

SEQ ID NO: 437586 - DNA, 20 bp, Artificial Sequence
  chemically synthesized
agggtaaaaaaggccaaaga

SEQ ID NO: 437587 - DNA, 20 bp, Artificial Sequence
  chemically synthesized
aagggtaaaaaaggccaaag

SEQ ID NO: 437588 - DNA, 20 bp, Artificial Sequence
  chemically synthesized
caaaagggtaaaaaaggcca

SEQ ID NO: 437589 - DNA, 20 bp, Artificial Sequence
  chemically synthesized
tttacacaaaagggtaaaaa

SEQ ID NO: 437590 - DNA, 20 bp, Artificial Sequence
  chemically synthesized
ttttacacaaaagggtaaaa

SEQ ID NO: 437591 - DNA, 20 bp, Artificial Sequence
  chemically synthesized
gaatcttcttttacacaaaa

SEQ ID NO: 437592 - DNA, 20 bp, Artificial Sequence
  chemically synthesized
agaatcttcttttacacaaa

SEQ ID NO: 437593 - DNA, 20 bp, Artificial Sequence
  chemically synthesized
aagaatcttcttttacacaa

SEQ ID NO: 437594 - DNA, 20 bp, Artificial Sequence
  chemically synthesized
ttttttacccttttgtgtaa

SEQ ID NO: 437595 - DNA, 20 bp, Artificial Sequence
  chemically synthesized
tttacccttttgtgtaaaag

SEQ ID NO: 437596 - DNA, 20 bp, Artificial Sequence
  chemically synthesized
actgttatgctttgaagatc

SEQ ID NO: 437597 - DNA, 20 bp, Artificial Sequence
  chemically synthesized
aagaagattcttgatcttca

SEQ ID NO: 437598 - DNA, 20 bp, Artificial Sequence
  chemically synthesized
aacatgactgttatgctttg

SEQ ID NO: 437599 - DNA, 20 bp, Artificial Sequence
  chemically synthesized
tcttgatcttcaaagcataa

SEQ ID NO: 437600 - DNA, 20 bp, Artificial Sequence
  chemically synthesized
catgttttattttactctat

SEQ ID NO: 437601 - DNA, 20 bp, Artificial Sequence
  chemically synthesized
gttttattttactctatgag

SEQ ID NO: 437602 - DNA, 20 bp, Artificial Sequence
  chemically synthesized
tcttaatgaatctgctcata

SEQ ID NO: 437603 - DNA, 20 bp, Artificial Sequence
  chemically synthesized
attcttaatgaatctgctca

SEQ ID NO: 437604 - DNA, 20 bp, Artificial Sequence
  chemically synthesized
actctatgagcagattcatt

SEQ ID NO: 437605 - DNA, 20 bp, Artificial Sequence
  chemically synthesized
cagattcattaagaatgtga

SEQ ID NO: 437606 - DNA, 20 bp, Artificial Sequence
  chemically synthesized
taatgttaatttgaatgaat

SEQ ID NO: 437607 - DNA, 20 bp, Artificial Sequence
  chemically synthesized
ttaatgttaatttgaatgaa

SEQ ID NO: 437608 - DNA, 20 bp, Artificial Sequence
  chemically synthesized
ttcattcaaattaacattaa

SEQ ID NO: 437609 - DNA, 20 bp, Artificial Sequence
  chemically synthesized
tgacatcttattcattggga

SEQ ID NO: 437610 - DNA, 20 bp, Artificial Sequence
  chemically synthesized
tttgacatcttattcattgg

SEQ ID NO: 437611 - DNA, 20 bp, Artificial Sequence
  chemically synthesized
aagacactctcccaatgaat

SEQ ID NO: 437612 - DNA, 20 bp, Artificial Sequence
  chemically synthesized
tttttgacatcttattcatt

SEQ ID NO: 437613 - DNA, 20 bp, Artificial Sequence
  chemically synthesized
atttttgacatcttattcat

SEQ ID NO: 437614 - DNA, 20 bp, Artificial Sequence
  chemically synthesized
taagatgtcaaaaatcatgt

SEQ ID NO: 437615 - DNA, 20 bp, Artificial Sequence
  chemically synthesized
aaaaatcatgttagtaattg

SEQ ID NO: 437616 - DNA, 20 bp, Artificial Sequence
  chemically synthesized
aggcatgcagcatgagagca

SEQ ID NO: 437617 - DNA, 20 bp, Artificial Sequence
  chemically synthesized
ataggcatgcagcatgagag

SEQ ID NO: 437618 - DNA, 20 bp, Artificial Sequence
  chemically synthesized
caaataggcatgcagcatga

SEQ ID NO: 437619 - DNA, 20 bp, Artificial Sequence
  chemically synthesized
tacaaataggcatgcagcat

SEQ ID NO: 437620 - DNA, 20 bp, Artificial Sequence
  chemically synthesized
gatgagtacaaataggcatg

SEQ ID NO: 437621 - DNA, 20 bp, Artificial Sequence
  chemically synthesized
ctcagtcgatgagtacaaat

SEQ ID NO: 437622 - DNA, 20 bp, Artificial Sequence
  chemically synthesized
gctcagtcgatgagtacaaa

SEQ ID NO: 437623 - DNA, 20 bp, Artificial Sequence
  chemically synthesized
cctatttgtactcatcgact

SEQ ID NO: 437624 - DNA, 20 bp, Artificial Sequence
  chemically synthesized
ctcgttagtgctcagtcgat

SEQ ID NO: 437625 - DNA, 20 bp, Artificial Sequence
  chemically synthesized
gtgtatttctcgttagtgct

SEQ ID NO: 437626 - DNA, 20 bp, Artificial Sequence
  chemically synthesized
ctcatcgactgagcactaac

SEQ ID NO: 437627 - DNA, 20 bp, Artificial Sequence
  chemically synthesized
gttaggtgtgtatttctcgt

SEQ ID NO: 437628 - DNA, 20 bp, Artificial Sequence
  chemically synthesized
cgagaaatacacacctaact

SEQ ID NO: 437629 - DNA, 20 bp, Artificial Sequence
  chemically synthesized
tccttctgctgttctaagtt

SEQ ID NO: 437630 - DNA, 20 bp, Artificial Sequence
  chemically synthesized
ctccttctgctgttctaagt

SEQ ID NO: 437631 - DNA, 20 bp, Artificial Sequence
  chemically synthesized
aatacacacctaacttagaa

SEQ ID NO: 437632 - DNA, 20 bp, Artificial Sequence
  chemically synthesized
acacacctaacttagaacag

SEQ ID NO: 437633 - DNA, 20 bp, Artificial Sequence
  chemically synthesized
tctgctccttctgctgttct

SEQ ID NO: 437634 - DNA, 20 bp, Artificial Sequence
  chemically synthesized
cacctaacttagaacagcag

SEQ ID NO: 437635 - DNA, 20 bp, Artificial Sequence
  chemically synthesized
acctaacttagaacagcaga

SEQ ID NO: 437636 - DNA, 20 bp, Artificial Sequence
  chemically synthesized
ctaacttagaacagcagaag

SEQ ID NO: 437637 - DNA, 20 bp, Artificial Sequence
  chemically synthesized
acttagaacagcagaaggag

SEQ ID NO: 437638 - DNA, 20 bp, Artificial Sequence
  chemically synthesized
gcagaaggagcagatgcttt

SEQ ID NO: 437639 - DNA, 20 bp, Artificial Sequence
  chemically synthesized
tactgagaaatattatctta

SEQ ID NO: 437640 - DNA, 20 bp, Artificial Sequence
  chemically synthesized
tgctttaagataatatttct

SEQ ID NO: 437641 - DNA, 20 bp, Artificial Sequence
  chemically synthesized
ttaaattgttgcatattact

SEQ ID NO: 437642 - DNA, 20 bp, Artificial Sequence
  chemically synthesized
aatttcaaatactgaacttc

SEQ ID NO: 437643 - DNA, 20 bp, Artificial Sequence
  chemically synthesized
atttcaaatactgaacttct

SEQ ID NO: 437644 - DNA, 20 bp, Artificial Sequence
  chemically synthesized
atttccaaggcccagaagtt

SEQ ID NO: 437645 - DNA, 20 bp, Artificial Sequence
  chemically synthesized
atgtaatttccaaggcccag

SEQ ID NO: 437646 - DNA, 20 bp, Artificial Sequence
  chemically synthesized
aatactgaacttctgggcct

SEQ ID NO: 437647 - DNA, 20 bp, Artificial Sequence
  chemically synthesized
tatatgtaatttccaaggcc

SEQ ID NO: 437648 - DNA, 20 bp, Artificial Sequence
  chemically synthesized
acctgtatatgtaatttcca

SEQ ID NO: 437649 - DNA, 20 bp, Artificial Sequence
  chemically synthesized
aacctgtatatgtaatttcc

SEQ ID NO: 437650 - DNA, 20 bp, Artificial Sequence
  chemically synthesized
ggccttggaaattacatata

SEQ ID NO: 437651 - DNA, 20 bp, Artificial Sequence
  chemically synthesized
gccttggaaattacatatac

SEQ ID NO: 437652 - DNA, 20 bp, Artificial Sequence
  chemically synthesized
aattacatatacaggttttg

SEQ ID NO: 437653 - DNA, 20 bp, Artificial Sequence
  chemically synthesized
tacaggttttgcagtcaaat

SEQ ID NO: 437654 - DNA, 20 bp, Artificial Sequence
  chemically synthesized
gcagtcaaatgagtattgtt

SEQ ID NO: 437655 - DNA, 20 bp, Artificial Sequence
  chemically synthesized
ttagacatattaaatgtgct

SEQ ID NO: 437656 - DNA, 20 bp, Artificial Sequence
  chemically synthesized
actgatgaaattttagatct

SEQ ID NO: 437657 - DNA, 20 bp, Artificial Sequence
  chemically synthesized
tttgaaaactgatgaaattt

SEQ ID NO: 437658 - DNA, 20 bp, Artificial Sequence
  chemically synthesized
gctgagatctaaaatttcat

SEQ ID NO: 437659 - DNA, 20 bp, Artificial Sequence
  chemically synthesized
tttcatcagttttcaaattt

SEQ ID NO: 437660 - DNA, 20 bp, Artificial Sequence
  chemically synthesized
atcagttttcaaatttaagc

SEQ ID NO: 437661 - DNA, 20 bp, Artificial Sequence
  chemically synthesized
cagttttcaaatttaagcca

SEQ ID NO: 437662 - DNA, 20 bp, Artificial Sequence
  chemically synthesized
agttttcaaatttaagccag

SEQ ID NO: 437663 - DNA, 20 bp, Artificial Sequence
  chemically synthesized
gttttcaaatttaagccaga

SEQ ID NO: 437664 - DNA, 20 bp, Artificial Sequence
  chemically synthesized
ttttcaaatttaagccagag

SEQ ID NO: 437665 - DNA, 20 bp, Artificial Sequence
  chemically synthesized
attagggtatatttcccctc

SEQ ID NO: 437666 - DNA, 20 bp, Artificial Sequence
  chemically synthesized
agaggggaaatataccctaa

SEQ ID NO: 437667 - DNA, 20 bp, Artificial Sequence
  chemically synthesized
tgagggtttttgaaccatta

SEQ ID NO: 437668 - DNA, 20 bp, Artificial Sequence
  chemically synthesized
ttgagggtttttgaaccatt

SEQ ID NO: 437669 - DNA, 20 bp, Artificial Sequence
  chemically synthesized
attgagggtttttgaaccat

SEQ ID NO: 437670 - DNA, 20 bp, Artificial Sequence
  chemically synthesized
taaaccagaatttaaattga

SEQ ID NO: 437671 - DNA, 20 bp, Artificial Sequence
  chemically synthesized
ataaaccagaatttaaattg

SEQ ID NO: 437672 - DNA, 20 bp, Artificial Sequence
  chemically synthesized
tataaaccagaatttaaatt

SEQ ID NO: 437673 - DNA, 20 bp, Artificial Sequence
  chemically synthesized
aaaaccctcaatttaaattc

SEQ ID NO: 437674 - DNA, 20 bp, Artificial Sequence
  chemically synthesized
aatttaaattctggtttata

SEQ ID NO: 437675 - DNA, 20 bp, Artificial Sequence
  chemically synthesized
aagatcattgctatataaac

SEQ ID NO: 437676 - DNA, 20 bp, Artificial Sequence
  chemically synthesized
ggtttatatagcaatgatct

SEQ ID NO: 437677 - DNA, 20 bp, Artificial Sequence
  chemically synthesized
gaaataaatttaaagtaacc

SEQ ID NO: 437678 - DNA, 20 bp, Artificial Sequence
  chemically synthesized
atggcttagaaataaattta

SEQ ID NO: 437679 - DNA, 20 bp, Artificial Sequence
  chemically synthesized
gttactttaaatttatttct

SEQ ID NO: 437680 - DNA, 20 bp, Artificial Sequence
  chemically synthesized
aaaagaaaaaaatcatggct

SEQ ID NO: 437681 - DNA, 20 bp, Artificial Sequence
  chemically synthesized
ccactaaaagaaaaaaatca

SEQ ID NO: 437682 - DNA, 20 bp, Artificial Sequence
  chemically synthesized
aagccatgatttttttcttt

SEQ ID NO: 437683 - DNA, 20 bp, Artificial Sequence
  chemically synthesized
ccatgatttttttcttttag

SEQ ID NO: 437684 - DNA, 20 bp, Artificial Sequence
  chemically synthesized
attgtaatatttgccactaa

SEQ ID NO: 437685 - DNA, 20 bp, Artificial Sequence
  chemically synthesized
aatattacaataataaattc

SEQ ID NO: 437686 - DNA, 20 bp, Artificial Sequence
  chemically synthesized
atattacaataataaattca

SEQ ID NO: 437687 - DNA, 20 bp, Artificial Sequence
  chemically synthesized
tattacaataataaattcaa

SEQ ID NO: 437688 - DNA, 20 bp, Artificial Sequence
  chemically synthesized
atgaattactttttgttggt

SEQ ID NO: 437689 - DNA, 20 bp, Artificial Sequence
  chemically synthesized
tatgaattactttttgttgg

SEQ ID NO: 437690 - DNA, 20 bp, Artificial Sequence
  chemically synthesized
aaatcatacccaccaacaaa

SEQ ID NO: 437691 - DNA, 20 bp, Artificial Sequence
  chemically synthesized
aggtatgaattactttttgt

SEQ ID NO: 437692 - DNA, 20 bp, Artificial Sequence
  chemically synthesized
aaaagtaattcatacctctg

SEQ ID NO: 437693 - DNA, 20 bp, Artificial Sequence
  chemically synthesized
gtaattcatacctctgaagt

SEQ ID NO: 437694 - DNA, 20 bp, Artificial Sequence
  chemically synthesized
actaaaatagctaacttcag

SEQ ID NO: 437695 - DNA, 20 bp, Artificial Sequence
  chemically synthesized
aactaaaatagctaacttca

SEQ ID NO: 437696 - DNA, 20 bp, Artificial Sequence
  chemically synthesized
ccaactaaaatagctaactt

SEQ ID NO: 437697 - DNA, 20 bp, Artificial Sequence
  chemically synthesized
acctctgaagttagctattt

SEQ ID NO: 437698 - DNA, 20 bp, Artificial Sequence
  chemically synthesized
ctgaagttagctattttagt

SEQ ID NO: 437699 - DNA, 20 bp, Artificial Sequence
  chemically synthesized
agagtattgtccaactaaaa

SEQ ID NO: 437700 - DNA, 20 bp, Artificial Sequence
  chemically synthesized
tagcataagtcgcaaggtaa

SEQ ID NO: 437701 - DNA, 20 bp, Artificial Sequence
  chemically synthesized
aatagcataagtcgcaaggt

SEQ ID NO: 437702 - DNA, 20 bp, Artificial Sequence
  chemically synthesized
atctaatagcataagtcgca

SEQ ID NO: 437703 - DNA, 20 bp, Artificial Sequence
  chemically synthesized
aatctaatagcataagtcgc

SEQ ID NO: 437704 - DNA, 20 bp, Artificial Sequence
  chemically synthesized
taccttgcgacttatgctat

SEQ ID NO: 437705 - DNA, 20 bp, Artificial Sequence
  chemically synthesized
acacaggaatctaatagcat

SEQ ID NO: 437706 - DNA, 20 bp, Artificial Sequence
  chemically synthesized
agatgaacacaggaatctaa

SEQ ID NO: 437707 - DNA, 20 bp, Artificial Sequence
  chemically synthesized
tgctataaaaagatgaacac

SEQ ID NO: 437708 - DNA, 20 bp, Artificial Sequence
  chemically synthesized
gtgctataaaaagatgaaca

SEQ ID NO: 437709 - DNA, 20 bp, Artificial Sequence
  chemically synthesized
ttcctgtgttcatcttttta

SEQ ID NO: 437710 - DNA, 20 bp, Artificial Sequence
  chemically synthesized
gtgtatttgtgtgctataaa

SEQ ID NO: 437711 - DNA, 20 bp, Artificial Sequence
  chemically synthesized
ttttatagcacacaaataca

SEQ ID NO: 437712 - DNA, 20 bp, Artificial Sequence
  chemically synthesized
tttatagcacacaaatacac

SEQ ID NO: 437713 - DNA, 20 bp, Artificial Sequence
  chemically synthesized
tacacaggtgttcactcaca

SEQ ID NO: 437714 - DNA, 20 bp, Artificial Sequence
  chemically synthesized
gtacgtgaatgcatctgtgt

SEQ ID NO: 437715 - DNA, 20 bp, Artificial Sequence
  chemically synthesized
cctgtaaaactcaagtttca

SEQ ID NO: 437716 - DNA, 20 bp, Artificial Sequence
  chemically synthesized
acgtacacactatgaaactt

SEQ ID NO: 437717 - DNA, 20 bp, Artificial Sequence
  chemically synthesized
atttttttcctgtaaaactc

SEQ ID NO: 437718 - DNA, 20 bp, Artificial Sequence
  chemically synthesized
actatgaaacttgagtttta

SEQ ID NO: 437719 - DNA, 20 bp, Artificial Sequence
  chemically synthesized
ctatgaaacttgagttttac

SEQ ID NO: 437720 - DNA, 20 bp, Artificial Sequence
  chemically synthesized
gaatttatttggacacattt

SEQ ID NO: 437721 - DNA, 20 bp, Artificial Sequence
  chemically synthesized
ttttacagttagaatttatt

SEQ ID NO: 437722 - DNA, 20 bp, Artificial Sequence
  chemically synthesized
gagagaagaaattttacagt

SEQ ID NO: 437723 - DNA, 20 bp, Artificial Sequence
  chemically synthesized
agccgagagaagaaatttta

SEQ ID NO: 437724 - DNA, 20 bp, Artificial Sequence
  chemically synthesized
aactgtaaaatttcttctct

SEQ ID NO: 437725 - DNA, 20 bp, Artificial Sequence
  chemically synthesized
ccaccacacccagccgagag

SEQ ID NO: 437726 - DNA, 20 bp, Artificial Sequence
  chemically synthesized
gtaaaatttcttctctcggc

SEQ ID NO: 437727 - DNA, 20 bp, Artificial Sequence
  chemically synthesized
taaaatttcttctctcggct

SEQ ID NO: 437728 - DNA, 20 bp, Artificial Sequence
  chemically synthesized
gagccaccacacccagccga

SEQ ID NO: 437729 - DNA, 20 bp, Artificial Sequence
  chemically synthesized
gtgagccaccacacccagcc

SEQ ID NO: 437730 - DNA, 20 bp, Artificial Sequence
  chemically synthesized
tttcttctctcggctgggtg

SEQ ID NO: 437731 - DNA, 20 bp, Artificial Sequence
  chemically synthesized
cttctctcggctgggtgtgg

SEQ ID NO: 437732 - DNA, 20 bp, Artificial Sequence
  chemically synthesized
taggtgtgagccaccacacc

SEQ ID NO: 437733 - DNA, 20 bp, Artificial Sequence
  chemically synthesized
agtgctgggtttataggtgt

SEQ ID NO: 437734 - DNA, 20 bp, Artificial Sequence
  chemically synthesized
gtggctcacacctataaacc

SEQ ID NO: 437735 - DNA, 20 bp, Artificial Sequence
  chemically synthesized
tcccaaagtgctgggtttat

SEQ ID NO: 437736 - DNA, 20 bp, Artificial Sequence
  chemically synthesized
ctcccaaagtgctgggttta

SEQ ID NO: 437737 - DNA, 20 bp, Artificial Sequence
  chemically synthesized
cacctataaacccagcactt

SEQ ID NO: 437738 - DNA, 20 bp, Artificial Sequence
  chemically synthesized
cctcagcctcccaaagtgct

SEQ ID NO: 437739 - DNA, 20 bp, Artificial Sequence
  chemically synthesized
acctataaacccagcacttt

SEQ ID NO: 437740 - DNA, 20 bp, Artificial Sequence
  chemically synthesized
acctcagcctcccaaagtgc

SEQ ID NO: 437741 - DNA, 20 bp, Artificial Sequence
  chemically synthesized
ctataaacccagcactttgg

SEQ ID NO: 437742 - DNA, 20 bp, Artificial Sequence
  chemically synthesized
tataaacccagcactttggg

SEQ ID NO: 437743 - DNA, 20 bp, Artificial Sequence
  chemically synthesized
ctgcccacctcagcctccca

SEQ ID NO: 437744 - DNA, 20 bp, Artificial Sequence
  chemically synthesized
acccagcactttgggaggct

SEQ ID NO: 437745 - DNA, 20 bp, Artificial Sequence
  chemically synthesized
cccagcactttgggaggctg

SEQ ID NO: 437746 - DNA, 20 bp, Artificial Sequence
  chemically synthesized
agcactttgggaggctgagg

SEQ ID NO: 437747 - DNA, 20 bp, Artificial Sequence
  chemically synthesized
gcactttgggaggctgaggt

SEQ ID NO: 437748 - DNA, 20 bp, Artificial Sequence
  chemically synthesized
ctttgggaggctgaggtggg

SEQ ID NO: 437749 - DNA, 20 bp, Artificial Sequence
  chemically synthesized
ctcaggtgatctgcccacct

SEQ ID NO: 437750 - DNA, 20 bp, Artificial Sequence
  chemically synthesized
ctgaggtgggcagatcacct

SEQ ID NO: 437751 - DNA, 20 bp, Artificial Sequence
  chemically synthesized
tgaggtgggcagatcacctg

SEQ ID NO: 437752 - DNA, 20 bp, Artificial Sequence
  chemically synthesized
gtgggcagatcacctgaggt

SEQ ID NO: 437753 - DNA, 20 bp, Artificial Sequence
  chemically synthesized
ggtcttgaacttctgacctc

SEQ ID NO: 437754 - DNA, 20 bp, Artificial Sequence
  chemically synthesized
ggcagatcacctgaggtcag

SEQ ID NO: 437755 - DNA, 20 bp, Artificial Sequence
  chemically synthesized
tggtcttgaacttctgacct

SEQ ID NO: 437756 - DNA, 20 bp, Artificial Sequence
  chemically synthesized
tcacctgaggtcagaagttc

SEQ ID NO: 437757 - DNA, 20 bp, Artificial Sequence
  chemically synthesized
tgaggtcagaagttcaagac

SEQ ID NO: 437758 - DNA, 20 bp, Artificial Sequence
  chemically synthesized
tcagaagttcaagaccagcc

SEQ ID NO: 437759 - DNA, 20 bp, Artificial Sequence
  chemically synthesized
ttttgccatgttggccaggc

SEQ ID NO: 437760 - DNA, 20 bp, Artificial Sequence
  chemically synthesized
ggggttttgccatgttggcc

SEQ ID NO: 437761 - DNA, 20 bp, Artificial Sequence
  chemically synthesized
caagaccagcctggccaaca

SEQ ID NO: 437762 - DNA, 20 bp, Artificial Sequence
  chemically synthesized
cggggttttgccatgttggc

SEQ ID NO: 437763 - DNA, 20 bp, Artificial Sequence
  chemically synthesized
gagacggggttttgccatgt

SEQ ID NO: 437764 - DNA, 20 bp, Artificial Sequence
  chemically synthesized
ttatatttttagtagagacg

SEQ ID NO: 437765 - DNA, 20 bp, Artificial Sequence
  chemically synthesized
tttatatttttagtagagac

SEQ ID NO: 437766 - DNA, 20 bp, Artificial Sequence
  chemically synthesized
ttttatatttttagtagaga

SEQ ID NO: 437767 - DNA, 20 bp, Artificial Sequence
  chemically synthesized
taatttttatatttttagta

SEQ ID NO: 437768 - DNA, 20 bp, Artificial Sequence
  chemically synthesized
cctaatttttatatttttag

SEQ ID NO: 437769 - DNA, 20 bp, Artificial Sequence
  chemically synthesized
ccgcctaatttttatatttt

SEQ ID NO: 437770 - DNA, 20 bp, Artificial Sequence
  chemically synthesized
tctactaaaaatataaaaat

SEQ ID NO: 437771 - DNA, 20 bp, Artificial Sequence
  chemically synthesized
ctactaaaaatataaaaatt

SEQ ID NO: 437772 - DNA, 20 bp, Artificial Sequence
  chemically synthesized
ctaaaaatataaaaattagg

SEQ ID NO: 437773 - DNA, 20 bp, Artificial Sequence
  chemically synthesized
taaaaatataaaaattaggc

SEQ ID NO: 437774 - DNA, 20 bp, Artificial Sequence
  chemically synthesized
atataaaaattaggcgggca

SEQ ID NO: 437775 - DNA, 20 bp, Artificial Sequence
  chemically synthesized
taaaaattaggcgggcatgg

SEQ ID NO: 437776 - DNA, 20 bp, Artificial Sequence
  chemically synthesized
aaaaattaggcgggcatggt

SEQ ID NO: 437777 - DNA, 20 bp, Artificial Sequence
  chemically synthesized
gagtaactgggattacaggc

SEQ ID NO: 437778 - DNA, 20 bp, Artificial Sequence
  chemically synthesized
tgagtaactgggattacagg

SEQ ID NO: 437779 - DNA, 20 bp, Artificial Sequence
  chemically synthesized
gtgggacccgcctgtaatcc

SEQ ID NO: 437780 - DNA, 20 bp, Artificial Sequence
  chemically synthesized
tcctgagtaactgggattac

SEQ ID NO: 437781 - DNA, 20 bp, Artificial Sequence
  chemically synthesized
ctcctgagtaactgggatta

SEQ ID NO: 437782 - DNA, 20 bp, Artificial Sequence
  chemically synthesized
cgcctgtaatcccagttact

SEQ ID NO: 437783 - DNA, 20 bp, Artificial Sequence
  chemically synthesized
tctcagcctcctgagtaact

SEQ ID NO: 437784 - DNA, 20 bp, Artificial Sequence
  chemically synthesized
gcctgtaatcccagttactc

SEQ ID NO: 437785 - DNA, 20 bp, Artificial Sequence
  chemically synthesized
gtctcagcctcctgagtaac

SEQ ID NO: 437786 - DNA, 20 bp, Artificial Sequence
  chemically synthesized
ctgtaatcccagttactcag

SEQ ID NO: 437787 - DNA, 20 bp, Artificial Sequence
  chemically synthesized
tgtaatcccagttactcagg

SEQ ID NO: 437788 - DNA, 20 bp, Artificial Sequence
  chemically synthesized
ttctcctgtctcagcctcct

SEQ ID NO: 437789 - DNA, 20 bp, Artificial Sequence
  chemically synthesized
tcccagttactcaggaggct

SEQ ID NO: 437790 - DNA, 20 bp, Artificial Sequence
  chemically synthesized
agttactcaggaggctgaga

SEQ ID NO: 437791 - DNA, 20 bp, Artificial Sequence
  chemically synthesized
gttactcaggaggctgagac

SEQ ID NO: 437792 - DNA, 20 bp, Artificial Sequence
  chemically synthesized
tactcaggaggctgagacag

SEQ ID NO: 437793 - DNA, 20 bp, Artificial Sequence
  chemically synthesized
ttcaagcgattctcctgtct

SEQ ID NO: 437794 - DNA, 20 bp, Artificial Sequence
  chemically synthesized
acaggagaatcgcttgaact

SEQ ID NO: 437795 - DNA, 20 bp, Artificial Sequence
  chemically synthesized
caggagaatcgcttgaactc

SEQ ID NO: 437796 - DNA, 20 bp, Artificial Sequence
  chemically synthesized
aaccttcacctcctgagttc

SEQ ID NO: 437797 - DNA, 20 bp, Artificial Sequence
  chemically synthesized
ggagaatcgcttgaactcag

SEQ ID NO: 437798 - DNA, 20 bp, Artificial Sequence
  chemically synthesized
gagaatcgcttgaactcagg

SEQ ID NO: 437799 - DNA, 20 bp, Artificial Sequence
  chemically synthesized
cactgcaaccttcacctcct

SEQ ID NO: 437800 - DNA, 20 bp, Artificial Sequence
  chemically synthesized
tcgcttgaactcaggaggtg

SEQ ID NO: 437801 - DNA, 20 bp, Artificial Sequence
  chemically synthesized
cgcttgaactcaggaggtga

SEQ ID NO: 437802 - DNA, 20 bp, Artificial Sequence
  chemically synthesized
aactcaggaggtgaaggttg

SEQ ID NO: 437803 - DNA, 20 bp, Artificial Sequence
  chemically synthesized
caggaggtgaaggttgcagt

SEQ ID NO: 437804 - DNA, 20 bp, Artificial Sequence
  chemically synthesized
ggtgaaggttgcagtgagcc

SEQ ID NO: 437805 - DNA, 20 bp, Artificial Sequence
  chemically synthesized
ggaatgcagttgtgtgatct

SEQ ID NO: 437806 - DNA, 20 bp, Artificial Sequence
  chemically synthesized
gagatcacacaactgcattc

SEQ ID NO: 437807 - DNA, 20 bp, Artificial Sequence
  chemically synthesized
ctgttgcccaggctggaatg

SEQ ID NO: 437808 - DNA, 20 bp, Artificial Sequence
  chemically synthesized
cacacaactgcattccagcc

SEQ ID NO: 437809 - DNA, 20 bp, Artificial Sequence
  chemically synthesized
acacaactgcattccagcct

SEQ ID NO: 437810 - DNA, 20 bp, Artificial Sequence
  chemically synthesized
tctcgctctgttgcccaggc

SEQ ID NO: 437811 - DNA, 20 bp, Artificial Sequence
  chemically synthesized
ctgcattccagcctgggcaa

SEQ ID NO: 437812 - DNA, 20 bp, Artificial Sequence
  chemically synthesized
agagtctcgctctgttgccc

SEQ ID NO: 437813 - DNA, 20 bp, Artificial Sequence
  chemically synthesized
gcattccagcctgggcaaca

SEQ ID NO: 437814 - DNA, 20 bp, Artificial Sequence
  chemically synthesized
cagagtctcgctctgttgcc

SEQ ID NO: 437815 - DNA, 20 bp, Artificial Sequence
  chemically synthesized
tccagcctgggcaacagagc

SEQ ID NO: 437816 - DNA, 20 bp, Artificial Sequence
  chemically synthesized
gttttcttttttttgagaca

SEQ ID NO: 437817 - DNA, 20 bp, Artificial Sequence
  chemically synthesized
atgttttcttttttttgaga

SEQ ID NO: 437818 - DNA, 20 bp, Artificial Sequence
  chemically synthesized
cgagactctgtctcaaaaaa

SEQ ID NO: 437819 - DNA, 20 bp, Artificial Sequence
  chemically synthesized
agaaatgttttctttttttt

SEQ ID NO: 437820 - DNA, 20 bp, Artificial Sequence
  chemically synthesized
gaaatttgtacataagagag

SEQ ID NO: 437821 - DNA, 20 bp, Artificial Sequence
  chemically synthesized
tgagaaatttgtacataaga

SEQ ID NO: 437822 - DNA, 20 bp, Artificial Sequence
  chemically synthesized
agtgagaaatttgtacataa

SEQ ID NO: 437823 - DNA, 20 bp, Artificial Sequence
  chemically synthesized
ggagtgagaaatttgtacat

SEQ ID NO: 437824 - DNA, 20 bp, Artificial Sequence
  chemically synthesized
ccattggagaaaaatggagt

SEQ ID NO: 437825 - DNA, 20 bp, Artificial Sequence
  chemically synthesized
attcccattggagaaaaatg

SEQ ID NO: 437826 - DNA, 20 bp, Artificial Sequence
  chemically synthesized
aaattcccattggagaaaaa

SEQ ID NO: 437827 - DNA, 20 bp, Artificial Sequence
  chemically synthesized
ctcactccatttttctccaa

SEQ ID NO: 437828 - DNA, 20 bp, Artificial Sequence
  chemically synthesized
tcactccatttttctccaat

SEQ ID NO: 437829 - DNA, 20 bp, Artificial Sequence
  chemically synthesized
ccaaatttaaattcccattg

SEQ ID NO: 437830 - DNA, 20 bp, Artificial Sequence
  chemically synthesized
ttccaaatttaaattcccat

SEQ ID NO: 437831 - DNA, 20 bp, Artificial Sequence
  chemically synthesized
ctccaatgggaatttaaatt

SEQ ID NO: 437832 - DNA, 20 bp, Artificial Sequence
  chemically synthesized
ttaaatttggaaccactctg

SEQ ID NO: 437833 - DNA, 20 bp, Artificial Sequence
  chemically synthesized
tgattacattagcttcagag

SEQ ID NO: 437834 - DNA, 20 bp, Artificial Sequence
  chemically synthesized
gtatgattacattagcttca

SEQ ID NO: 437835 - DNA, 20 bp, Artificial Sequence
  chemically synthesized
tggtatgattacattagctt

SEQ ID NO: 437836 - DNA, 20 bp, Artificial Sequence
  chemically synthesized
tgtatctggtatgattacat

SEQ ID NO: 437837 - DNA, 20 bp, Artificial Sequence
  chemically synthesized
tgaagctaatgtaatcatac

SEQ ID NO: 437838 - DNA, 20 bp, Artificial Sequence
  chemically synthesized
tattgaaatatttatgtatc

SEQ ID NO: 437839 - DNA, 20 bp, Artificial Sequence
  chemically synthesized
cataaatatttcaatatgta

SEQ ID NO: 437840 - DNA, 20 bp, Artificial Sequence
  chemically synthesized
tatagcaattgattttgtta

SEQ ID NO: 437841 - DNA, 20 bp, Artificial Sequence
  chemically synthesized
tttgttacagtctttgataa

SEQ ID NO: 437842 - DNA, 20 bp, Artificial Sequence
  chemically synthesized
acactgtatctcttttatca

SEQ ID NO: 437843 - DNA, 20 bp, Artificial Sequence
  chemically synthesized
tgttacagtctttgataaaa

SEQ ID NO: 437844 - DNA, 20 bp, Artificial Sequence
  chemically synthesized
agtctttgataaaagagata

SEQ ID NO: 437845 - DNA, 20 bp, Artificial Sequence
  chemically synthesized
gataaaagagatacagtgta

SEQ ID NO: 437846 - DNA, 20 bp, Artificial Sequence
  chemically synthesized
gtgtatagacacaattttaa

SEQ ID NO: 437847 - DNA, 20 bp, Artificial Sequence
  chemically synthesized
ttttaatggtttcctgcaat

SEQ ID NO: 437848 - DNA, 20 bp, Artificial Sequence
  chemically synthesized
ccaagtatctttccaattgc

SEQ ID NO: 437849 - DNA, 20 bp, Artificial Sequence
  chemically synthesized
accaagtatctttccaattg

SEQ ID NO: 437850 - DNA, 20 bp, Artificial Sequence
  chemically synthesized
aatggtttcctgcaattgga

SEQ ID NO: 437851 - DNA, 20 bp, Artificial Sequence
  chemically synthesized
cctgcaattggaaagatact

SEQ ID NO: 437852 - DNA, 20 bp, Artificial Sequence
  chemically synthesized
tactaattgatgaatatacc

SEQ ID NO: 437853 - DNA, 20 bp, Artificial Sequence
  chemically synthesized
tacttggtatattcatcaat

SEQ ID NO: 437854 - DNA, 20 bp, Artificial Sequence
  chemically synthesized
tttctaatagaagtataaaa

SEQ ID NO: 437855 - DNA, 20 bp, Artificial Sequence
  chemically synthesized
ctttctaatagaagtataaa

SEQ ID NO: 437856 - DNA, 20 bp, Artificial Sequence
  chemically synthesized
tatcctttttatacttctat

SEQ ID NO: 437857 - DNA, 20 bp, Artificial Sequence
  chemically synthesized
aaacatagcctttctaatag

SEQ ID NO: 437858 - DNA, 20 bp, Artificial Sequence
  chemically synthesized
ctttttatacttctattaga

SEQ ID NO: 437859 - DNA, 20 bp, Artificial Sequence
  chemically synthesized
tttttatacttctattagaa

SEQ ID NO: 437860 - DNA, 20 bp, Artificial Sequence
  chemically synthesized
caaaaacatagcctttctaa

SEQ ID NO: 437861 - DNA, 20 bp, Artificial Sequence
  chemically synthesized
tgggtacttaaacaaaaaca

SEQ ID NO: 437862 - DNA, 20 bp, Artificial Sequence
  chemically synthesized
gaaaggctatgtttttgttt

SEQ ID NO: 437863 - DNA, 20 bp, Artificial Sequence
  chemically synthesized
atgtttttgtttaagtaccc

SEQ ID NO: 437864 - DNA, 20 bp, Artificial Sequence
  chemically synthesized
aaattcacttttggaatctt

SEQ ID NO: 437865 - DNA, 20 bp, Artificial Sequence
  chemically synthesized
caaattcacttttggaatct

SEQ ID NO: 437866 - DNA, 20 bp, Artificial Sequence
  chemically synthesized
ttaagtacccaagattccaa

SEQ ID NO: 437867 - DNA, 20 bp, Artificial Sequence
  chemically synthesized
catagatacaaattcacttt

SEQ ID NO: 437868 - DNA, 20 bp, Artificial Sequence
  chemically synthesized
tgaatttgtatctatgaata

SEQ ID NO: 437869 - DNA, 20 bp, Artificial Sequence
  chemically synthesized
ttcacattaaactgtattca

SEQ ID NO: 437870 - DNA, 20 bp, Artificial Sequence
  chemically synthesized
gccaggtatacaattcattt

SEQ ID NO: 437871 - DNA, 20 bp, Artificial Sequence
  chemically synthesized
actcaaatgaattgtatacc

SEQ ID NO: 437872 - DNA, 20 bp, Artificial Sequence
  chemically synthesized
caaatgaattgtatacctgg

SEQ ID NO: 437873 - DNA, 20 bp, Artificial Sequence
  chemically synthesized
aaatgaattgtatacctggc

SEQ ID NO: 437874 - DNA, 20 bp, Artificial Sequence
  chemically synthesized
tgaattgtatacctggcagg

SEQ ID NO: 437875 - DNA, 20 bp, Artificial Sequence
  chemically synthesized
gaattgtatacctggcaggc

SEQ ID NO: 437876 - DNA, 20 bp, Artificial Sequence
  chemically synthesized
atcaattcatcctgcctgcc

SEQ ID NO: 437877 - DNA, 20 bp, Artificial Sequence
  chemically synthesized
tatcaattcatcctgcctgc

SEQ ID NO: 437878 - DNA, 20 bp, Artificial Sequence
  chemically synthesized
tggcaggcaggatgaattga

SEQ ID NO: 437879 - DNA, 20 bp, Artificial Sequence
  chemically synthesized
aattgatagcatgttatttt

SEQ ID NO: 437880 - DNA, 20 bp, Artificial Sequence
  chemically synthesized
catgttatttttagaaatct

SEQ ID NO: 437881 - DNA, 20 bp, Artificial Sequence
  chemically synthesized
gaattatgcatacatacact

SEQ ID NO: 437882 - DNA, 20 bp, Artificial Sequence
  chemically synthesized
agtgtatgtatgcataattc

SEQ ID NO: 437883 - DNA, 20 bp, Artificial Sequence
  chemically synthesized
atgcataattctagtttttg

SEQ ID NO: 437884 - DNA, 20 bp, Artificial Sequence
  chemically synthesized
tctcagataacttcaaaaac

SEQ ID NO: 437885 - DNA, 20 bp, Artificial Sequence
  chemically synthesized
tctagtttttgaagttatct

SEQ ID NO: 437886 - DNA, 20 bp, Artificial Sequence
  chemically synthesized
tagtttttgaagttatctga

SEQ ID NO: 437887 - DNA, 20 bp, Artificial Sequence
  chemically synthesized
atatgatatggaaagactct

SEQ ID NO: 437888 - DNA, 20 bp, Artificial Sequence
  chemically synthesized
tgggtataatatgatatgga

SEQ ID NO: 437889 - DNA, 20 bp, Artificial Sequence
  chemically synthesized
tttttgggtataatatgata

SEQ ID NO: 437890 - DNA, 20 bp, Artificial Sequence
  chemically synthesized
atgatgacacttaatttttt

SEQ ID NO: 437891 - DNA, 20 bp, Artificial Sequence
  chemically synthesized
catattatacccaaaaaatt

SEQ ID NO: 437892 - DNA, 20 bp, Artificial Sequence
  chemically synthesized
gatgatgacacttaattttt

SEQ ID NO: 437893 - DNA, 20 bp, Artificial Sequence
  chemically synthesized
aattaagtgtcatcatctaa

SEQ ID NO: 437894 - DNA, 20 bp, Artificial Sequence
  chemically synthesized
tttcttttgtttcaaaccat

SEQ ID NO: 437895 - DNA, 20 bp, Artificial Sequence
  chemically synthesized
catctaatggtttgaaacaa

SEQ ID NO: 437896 - DNA, 20 bp, Artificial Sequence
  chemically synthesized
ttgaaacaaaagaaatttat

SEQ ID NO: 437897 - DNA, 20 bp, Artificial Sequence
  chemically synthesized
aaagtgatggaaagaattat

SEQ ID NO: 437898 - DNA, 20 bp, Artificial Sequence
  chemically synthesized
taatatccaaaagtgatgga

SEQ ID NO: 437899 - DNA, 20 bp, Artificial Sequence
  chemically synthesized
ataattctttccatcacttt

SEQ ID NO: 437900 - DNA, 20 bp, Artificial Sequence
  chemically synthesized
taattaatatccaaaagtga

SEQ ID NO: 437901 - DNA, 20 bp, Artificial Sequence
  chemically synthesized
ttgaattaattaatatccaa

SEQ ID NO: 437902 - DNA, 20 bp, Artificial Sequence
  chemically synthesized
acatttataaaacttcttcc

SEQ ID NO: 437903 - DNA, 20 bp, Artificial Sequence
  chemically synthesized
tatttccttgtactaggaag

SEQ ID NO: 437904 - DNA, 20 bp, Artificial Sequence
  chemically synthesized
gaatatttccttgtactagg

SEQ ID NO: 437905 - DNA, 20 bp, Artificial Sequence
  chemically synthesized
ataaaacttcttcctagtac

SEQ ID NO: 437906 - DNA, 20 bp, Artificial Sequence
  chemically synthesized
taaaacttcttcctagtaca

SEQ ID NO: 437907 - DNA, 20 bp, Artificial Sequence
  chemically synthesized
tttgaatatttccttgtact

SEQ ID NO: 437908 - DNA, 20 bp, Artificial Sequence
  chemically synthesized
ttttgaatatttccttgtac

SEQ ID NO: 437909 - DNA, 20 bp, Artificial Sequence
  chemically synthesized
ggaaatattcaaaactctat

SEQ ID NO: 437910 - DNA, 20 bp, Artificial Sequence
  chemically synthesized
tatgtgtttatattctcata

SEQ ID NO: 437911 - DNA, 20 bp, Artificial Sequence
  chemically synthesized
tctatgtgtttatattctca

SEQ ID NO: 437912 - DNA, 20 bp, Artificial Sequence
  chemically synthesized
tctatgagaatataaacaca

SEQ ID NO: 437913 - DNA, 20 bp, Artificial Sequence
  chemically synthesized
atgagaatataaacacatag

SEQ ID NO: 437914 - DNA, 20 bp, Artificial Sequence
  chemically synthesized
atataaacacatagaagatg

SEQ ID NO: 437915 - DNA, 20 bp, Artificial Sequence
  chemically synthesized
cacatagaagatgtggtttg

SEQ ID NO: 437916 - DNA, 20 bp, Artificial Sequence
  chemically synthesized
aagatgtggtttgcggcatc

SEQ ID NO: 437917 - DNA, 20 bp, Artificial Sequence
  chemically synthesized
agatgtggtttgcggcatcc

SEQ ID NO: 437918 - DNA, 20 bp, Artificial Sequence
  chemically synthesized
atgtggtttgcggcatccag

SEQ ID NO: 437919 - DNA, 20 bp, Artificial Sequence
  chemically synthesized
gctactagattatatactcc

SEQ ID NO: 437920 - DNA, 20 bp, Artificial Sequence
  chemically synthesized
gcatccaggagtatataatc

SEQ ID NO: 437921 - DNA, 20 bp, Artificial Sequence
  chemically synthesized
tccaggagtatataatctag

SEQ ID NO: 437922 - DNA, 20 bp, Artificial Sequence
  chemically synthesized
aggagtatataatctagtag

SEQ ID NO: 437923 - DNA, 20 bp, Artificial Sequence
  chemically synthesized
gagtatataatctagtagcg

SEQ ID NO: 437924 - DNA, 20 bp, Artificial Sequence
  chemically synthesized
aattatattatctccgctac

SEQ ID NO: 437925 - DNA, 20 bp, Artificial Sequence
  chemically synthesized
cggagataatataattttta

SEQ ID NO: 437926 - DNA, 20 bp, Artificial Sequence
  chemically synthesized
aagttatatttcaaataata

SEQ ID NO: 437927 - DNA, 20 bp, Artificial Sequence
  chemically synthesized
tatttcaaataatatagact

SEQ ID NO: 437928 - DNA, 20 bp, Artificial Sequence
  chemically synthesized
acttgtcagatgaggtaact

SEQ ID NO: 437929 - DNA, 20 bp, Artificial Sequence
  chemically synthesized
ccattctcacttgtcagatg

SEQ ID NO: 437930 - DNA, 20 bp, Artificial Sequence
  chemically synthesized
actcagttacctcatctgac

SEQ ID NO: 437931 - DNA, 20 bp, Artificial Sequence
  chemically synthesized
accattctcacttgtcagat

SEQ ID NO: 437932 - DNA, 20 bp, Artificial Sequence
  chemically synthesized
agttacctcatctgacaagt

SEQ ID NO: 437933 - DNA, 20 bp, Artificial Sequence
  chemically synthesized
atattaccattctcacttgt

SEQ ID NO: 437934 - DNA, 20 bp, Artificial Sequence
  chemically synthesized
cctcatctgacaagtgagaa

SEQ ID NO: 437935 - DNA, 20 bp, Artificial Sequence
  chemically synthesized
tggtaatatattttttgcca

SEQ ID NO: 437936 - DNA, 20 bp, Artificial Sequence
  chemically synthesized
aattggttttataaaaacta

SEQ ID NO: 437937 - DNA, 20 bp, Artificial Sequence
  chemically synthesized
aaagataatatacatataat

SEQ ID NO: 437938 - DNA, 20 bp, Artificial Sequence
  chemically synthesized
taatgataataaagacaata

SEQ ID NO: 437939 - DNA, 20 bp, Artificial Sequence
  chemically synthesized
agtgaatgataatgataata

SEQ ID NO: 437940 - DNA, 20 bp, Artificial Sequence
  chemically synthesized
atcattatcattcactataa

SEQ ID NO: 437941 - DNA, 20 bp, Artificial Sequence
  chemically synthesized
catatattcattatctttta

SEQ ID NO: 437942 - DNA, 20 bp, Artificial Sequence
  chemically synthesized
atatatgcaaattaattttt

SEQ ID NO: 437943 - DNA, 20 bp, Artificial Sequence
  chemically synthesized
tatgcaaattaatttttcag

SEQ ID NO: 437944 - DNA, 20 bp, Artificial Sequence
  chemically synthesized
gcaaattaatttttcagtgg

SEQ ID NO: 437945 - DNA, 20 bp, Artificial Sequence
  chemically synthesized
cagtggtagaacttgatttc

SEQ ID NO: 437946 - DNA, 20 bp, Artificial Sequence
  chemically synthesized
attcatgacatctagaaatc

SEQ ID NO: 437947 - DNA, 20 bp, Artificial Sequence
  chemically synthesized
gagttctaattcatgacatc

SEQ ID NO: 437948 - DNA, 20 bp, Artificial Sequence
  chemically synthesized
gatttctagatgtcatgaat

SEQ ID NO: 437949 - DNA, 20 bp, Artificial Sequence
  chemically synthesized
ttgagaaatggaaaagagta

SEQ ID NO: 437950 - DNA, 20 bp, Artificial Sequence
  chemically synthesized
gattgagaaatggaaaagag

SEQ ID NO: 437951 - DNA, 20 bp, Artificial Sequence
  chemically synthesized
tctgattgagaaatggaaaa

SEQ ID NO: 437952 - DNA, 20 bp, Artificial Sequence
  chemically synthesized
actctgattgagaaatggaa

SEQ ID NO: 437953 - DNA, 20 bp, Artificial Sequence
  chemically synthesized
tatagactctgattgagaaa

SEQ ID NO: 437954 - DNA, 20 bp, Artificial Sequence
  chemically synthesized
actcttttccatttctcaat

SEQ ID NO: 437955 - DNA, 20 bp, Artificial Sequence
  chemically synthesized
tcttttccatttctcaatca

SEQ ID NO: 437956 - DNA, 20 bp, Artificial Sequence
  chemically synthesized
tgaaaatatagactctgatt

SEQ ID NO: 437957 - DNA, 20 bp, Artificial Sequence
  chemically synthesized
aattttgaaagttgaaaata

SEQ ID NO: 437958 - DNA, 20 bp, Artificial Sequence
  chemically synthesized
aatgtggtgtgcaattttga

SEQ ID NO: 437959 - DNA, 20 bp, Artificial Sequence
  chemically synthesized
gggctcacattgtagaaatg

SEQ ID NO: 437960 - DNA, 20 bp, Artificial Sequence
  chemically synthesized
acaccacatttctacaatgt

SEQ ID NO: 437961 - DNA, 20 bp, Artificial Sequence
  chemically synthesized
tctgcctggggctcacattg

SEQ ID NO: 437962 - DNA, 20 bp, Artificial Sequence
  chemically synthesized
catttctacaatgtgagccc

SEQ ID NO: 437963 - DNA, 20 bp, Artificial Sequence
  chemically synthesized
atttctacaatgtgagcccc

SEQ ID NO: 437964 - DNA, 20 bp, Artificial Sequence
  chemically synthesized
tctacaatgtgagccccagg

SEQ ID NO: 437965 - DNA, 20 bp, Artificial Sequence
  chemically synthesized
acaatgtgagccccaggcag

SEQ ID NO: 437966 - DNA, 20 bp, Artificial Sequence
  chemically synthesized
tataagcattcttctgcctg

SEQ ID NO: 437967 - DNA, 20 bp, Artificial Sequence
  chemically synthesized
ttataagcattcttctgcct

SEQ ID NO: 437968 - DNA, 20 bp, Artificial Sequence
  chemically synthesized
cttataagcattcttctgcc

SEQ ID NO: 437969 - DNA, 20 bp, Artificial Sequence
  chemically synthesized
ccaggcagaagaatgcttat

SEQ ID NO: 437970 - DNA, 20 bp, Artificial Sequence
  chemically synthesized
gtgcctagatgaaagcttat

SEQ ID NO: 437971 - DNA, 20 bp, Artificial Sequence
  chemically synthesized
aatgcttataagctttcatc

SEQ ID NO: 437972 - DNA, 20 bp, Artificial Sequence
  chemically synthesized
atgcttataagctttcatct

SEQ ID NO: 437973 - DNA, 20 bp, Artificial Sequence
  chemically synthesized
aatatattgtgcctagatga

SEQ ID NO: 437974 - DNA, 20 bp, Artificial Sequence
  chemically synthesized
cttatataatatattgtgcc

SEQ ID NO: 437975 - DNA, 20 bp, Artificial Sequence
  chemically synthesized
ctaggcacaatatattatat

SEQ ID NO: 437976 - DNA, 20 bp, Artificial Sequence
  chemically synthesized
taggcacaatatattatata

SEQ ID NO: 437977 - DNA, 20 bp, Artificial Sequence
  chemically synthesized
acaatatattatataaggcc

SEQ ID NO: 437978 - DNA, 20 bp, Artificial Sequence
  chemically synthesized
tatattatataaggcctgga

SEQ ID NO: 437979 - DNA, 20 bp, Artificial Sequence
  chemically synthesized
gaccagccagaaaaccatcc

SEQ ID NO: 437980 - DNA, 20 bp, Artificial Sequence
  chemically synthesized
tgaccagccagaaaaccatc

SEQ ID NO: 437981 - DNA, 20 bp, Artificial Sequence
  chemically synthesized
ataaggcctggatggttttc

SEQ ID NO: 437982 - DNA, 20 bp, Artificial Sequence
  chemically synthesized
ggcctggatggttttctggc

SEQ ID NO: 437983 - DNA, 20 bp, Artificial Sequence
  chemically synthesized
aaagcagagaattgaccagc

SEQ ID NO: 437984 - DNA, 20 bp, Artificial Sequence
  chemically synthesized
gccaaaagcagagaattgac

SEQ ID NO: 437985 - DNA, 20 bp, Artificial Sequence
  chemically synthesized
gctggtcaattctctgcttt

SEQ ID NO: 437986 - DNA, 20 bp, Artificial Sequence
  chemically synthesized
atctccgtatgccaaaagca

SEQ ID NO: 437987 - DNA, 20 bp, Artificial Sequence
  chemically synthesized
tgatctccgtatgccaaaag

SEQ ID NO: 437988 - DNA, 20 bp, Artificial Sequence
  chemically synthesized
ttttgatctccgtatgccaa

SEQ ID NO: 437989 - DNA, 20 bp, Artificial Sequence
  chemically synthesized
aattctctgcttttggcata

SEQ ID NO: 437990 - DNA, 20 bp, Artificial Sequence
  chemically synthesized
ttctctgcttttggcatacg

SEQ ID NO: 437991 - DNA, 20 bp, Artificial Sequence
  chemically synthesized
tggcatacggagatcaaaat

SEQ ID NO: 437992 - DNA, 20 bp, Artificial Sequence
  chemically synthesized
ggcatacggagatcaaaatt

SEQ ID NO: 437993 - DNA, 20 bp, Artificial Sequence
  chemically synthesized
ttgggttatatgatctaatt

SEQ ID NO: 437994 - DNA, 20 bp, Artificial Sequence
  chemically synthesized
tgtattatcttcaactaaat

SEQ ID NO: 437995 - DNA, 20 bp, Artificial Sequence
  chemically synthesized
tatatgatctaatttagttg

SEQ ID NO: 437996 - DNA, 20 bp, Artificial Sequence
  chemically synthesized
caataatatacactttcatt

SEQ ID NO: 437997 - DNA, 20 bp, Artificial Sequence
  chemically synthesized
attaaattttttcttaatga

SEQ ID NO: 437998 - DNA, 20 bp, Artificial Sequence
  chemically synthesized
attaagaaaaaatttaatta

SEQ ID NO: 437999 - DNA, 20 bp, Artificial Sequence
  chemically synthesized
tatgacaatttttatgatga

SEQ ID NO: 438000 - DNA, 20 bp, Artificial Sequence
  chemically synthesized
tatcatcataaaaattgtca

SEQ ID NO: 438001 - DNA, 20 bp, Artificial Sequence
  chemically synthesized
tcataaaaattgtcatagat

SEQ ID NO: 438002 - DNA, 20 bp, Artificial Sequence
  chemically synthesized
aattgtcatagataagaaca

SEQ ID NO: 438003 - DNA, 20 bp, Artificial Sequence
  chemically synthesized
accaaagaaaagatgcgata

SEQ ID NO: 438004 - DNA, 20 bp, Artificial Sequence
  chemically synthesized
actatatcgcatcttttctt

SEQ ID NO: 438005 - DNA, 20 bp, Artificial Sequence
  chemically synthesized
ataaaatttcaaccaaagaa

SEQ ID NO: 438006 - DNA, 20 bp, Artificial Sequence
  chemically synthesized
gacttataaaatttcaacca

SEQ ID NO: 438007 - DNA, 20 bp, Artificial Sequence
  chemically synthesized
ttctttggttgaaattttat

SEQ ID NO: 438008 - DNA, 20 bp, Artificial Sequence
  chemically synthesized
tgaaattttataagtcaaaa

SEQ ID NO: 438009 - DNA, 20 bp, Artificial Sequence
  chemically synthesized
tagattgtcatgtcacatac

SEQ ID NO: 438010 - DNA, 20 bp, Artificial Sequence
  chemically synthesized
tttgaggagatttgttaaag

SEQ ID NO: 438011 - DNA, 20 bp, Artificial Sequence
  chemically synthesized
ctttgaggagatttgttaaa

SEQ ID NO: 438012 - DNA, 20 bp, Artificial Sequence
  chemically synthesized
atctttgaggagatttgtta

SEQ ID NO: 438013 - DNA, 20 bp, Artificial Sequence
  chemically synthesized
ctctttaacaaatctcctca

SEQ ID NO: 438014 - DNA, 20 bp, Artificial Sequence
  chemically synthesized
tttaatattttatctttgag

SEQ ID NO: 438015 - DNA, 20 bp, Artificial Sequence
  chemically synthesized
tctttaatattttatctttg

SEQ ID NO: 438016 - DNA, 20 bp, Artificial Sequence
  chemically synthesized
ttctttaatattttatcttt

SEQ ID NO: 438017 - DNA, 20 bp, Artificial Sequence
  chemically synthesized
tcctcaaagataaaatatta

SEQ ID NO: 438018 - DNA, 20 bp, Artificial Sequence
  chemically synthesized
aagataaaatattaaagaaa

SEQ ID NO: 438019 - DNA, 20 bp, Artificial Sequence
  chemically synthesized
tattaaagaaaaagttacta

SEQ ID NO: 438020 - DNA, 20 bp, Artificial Sequence
  chemically synthesized
tctgtaaactaataagacca

SEQ ID NO: 438021 - DNA, 20 bp, Artificial Sequence
  chemically synthesized
aaaagttactatggtcttat

SEQ ID NO: 438022 - DNA, 20 bp, Artificial Sequence
  chemically synthesized
ttaagtttctgtaaactaat

SEQ ID NO: 438023 - DNA, 20 bp, Artificial Sequence
  chemically synthesized
actatggtcttattagttta

SEQ ID NO: 438024 - DNA, 20 bp, Artificial Sequence
  chemically synthesized
cctgcttttataataaaatt

SEQ ID NO: 438025 - DNA, 20 bp, Artificial Sequence
  chemically synthesized
gaaacttaattttattataa

SEQ ID NO: 438026 - DNA, 20 bp, Artificial Sequence
  chemically synthesized
acttaattttattataaaag

SEQ ID NO: 438027 - DNA, 20 bp, Artificial Sequence
  chemically synthesized
cttaattttattataaaagc

SEQ ID NO: 438028 - DNA, 20 bp, Artificial Sequence
  chemically synthesized
attttattataaaagcaggt

SEQ ID NO: 438029 - DNA, 20 bp, Artificial Sequence
  chemically synthesized
tttattataaaagcaggtca

SEQ ID NO: 438030 - DNA, 20 bp, Artificial Sequence
  chemically synthesized
ttattataaaagcaggtcag

SEQ ID NO: 438031 - DNA, 20 bp, Artificial Sequence
  chemically synthesized
tattataaaagcaggtcaga

SEQ ID NO: 438032 - DNA, 20 bp, Artificial Sequence
  chemically synthesized
ggtcagagggcctactactt

SEQ ID NO: 438033 - DNA, 20 bp, Artificial Sequence
  chemically synthesized
cattaatttactgaagtagt

SEQ ID NO: 438034 - DNA, 20 bp, Artificial Sequence
  chemically synthesized
tcattaatttactgaagtag

SEQ ID NO: 438035 - DNA, 20 bp, Artificial Sequence
  chemically synthesized
atatcattaatttactgaag

SEQ ID NO: 438036 - DNA, 20 bp, Artificial Sequence
  chemically synthesized
gtgatatcattaatttactg

SEQ ID NO: 438037 - DNA, 20 bp, Artificial Sequence
  chemically synthesized
gtaaattaatgatatcactc

SEQ ID NO: 438038 - DNA, 20 bp, Artificial Sequence
  chemically synthesized
ttaatgatatcactcaagct

SEQ ID NO: 438039 - DNA, 20 bp, Artificial Sequence
  chemically synthesized
tttatgagaaaacttagctt

SEQ ID NO: 438040 - DNA, 20 bp, Artificial Sequence
  chemically synthesized
aggcattttatgagaaaact

SEQ ID NO: 438041 - DNA, 20 bp, Artificial Sequence
  chemically synthesized
ggtatgcacaggcattttat

SEQ ID NO: 438042 - DNA, 20 bp, Artificial Sequence
  chemically synthesized
tccacagatctggtatgcac

SEQ ID NO: 438043 - DNA, 20 bp, Artificial Sequence
  chemically synthesized
cataaaatgcctgtgcatac

SEQ ID NO: 438044 - DNA, 20 bp, Artificial Sequence
  chemically synthesized
atccacagatctggtatgca

SEQ ID NO: 438045 - DNA, 20 bp, Artificial Sequence
  chemically synthesized
gcctgtgcataccagatctg

SEQ ID NO: 438046 - DNA, 20 bp, Artificial Sequence
  chemically synthesized
attacagaaatccacagatc

SEQ ID NO: 438047 - DNA, 20 bp, Artificial Sequence
  chemically synthesized
caaagtattacagaaatcca

SEQ ID NO: 438048 - DNA, 20 bp, Artificial Sequence
  chemically synthesized
tttcaatttccaaagtatta

SEQ ID NO: 438049 - DNA, 20 bp, Artificial Sequence
  chemically synthesized
tgtggatttctgtaatactt

SEQ ID NO: 438050 - DNA, 20 bp, Artificial Sequence
  chemically synthesized
ttgaaccctttcaatttcca

SEQ ID NO: 438051 - DNA, 20 bp, Artificial Sequence
  chemically synthesized
tgtaatactttggaaattga

SEQ ID NO: 438052 - DNA, 20 bp, Artificial Sequence
  chemically synthesized
gtaatactttggaaattgaa

SEQ ID NO: 438053 - DNA, 20 bp, Artificial Sequence
  chemically synthesized
taatactttggaaattgaaa

SEQ ID NO: 438054 - DNA, 20 bp, Artificial Sequence
  chemically synthesized
tttggaaattgaaagggttc

SEQ ID NO: 438055 - DNA, 20 bp, Artificial Sequence
  chemically synthesized
attgaaagggttcaagacac

SEQ ID NO: 438056 - DNA, 20 bp, Artificial Sequence
  chemically synthesized
aataatgaatttttaaaaac

SEQ ID NO: 438057 - DNA, 20 bp, Artificial Sequence
  chemically synthesized
ttaacgtaatatacaaaata

SEQ ID NO: 438058 - DNA, 20 bp, Artificial Sequence
  chemically synthesized
aaaatatagttcatattcac

SEQ ID NO: 438059 - DNA, 20 bp, Artificial Sequence
  chemically synthesized
gtttgtaatattttattgac

SEQ ID NO: 438060 - DNA, 20 bp, Artificial Sequence
  chemically synthesized
ataaaatattacaaacattt

SEQ ID NO: 438061 - DNA, 20 bp, Artificial Sequence
  chemically synthesized
gcaaaaataataaatatgaa

SEQ ID NO: 438062 - DNA, 20 bp, Artificial Sequence
  chemically synthesized
caaaaataataaatatgaat

SEQ ID NO: 438063 - DNA, 20 bp, Artificial Sequence
  chemically synthesized
aataaatatgaataggttgt

SEQ ID NO: 438064 - DNA, 20 bp, Artificial Sequence
  chemically synthesized
atatgaataggttgttagac

SEQ ID NO: 438065 - DNA, 20 bp, Artificial Sequence
  chemically synthesized
aggttgttagactggctctg

SEQ ID NO: 438066 - DNA, 20 bp, Artificial Sequence
  chemically synthesized
aaaaataggatctacagagc

SEQ ID NO: 438067 - DNA, 20 bp, Artificial Sequence
  chemically synthesized
aaacaaaaataggatctaca

SEQ ID NO: 438068 - DNA, 20 bp, Artificial Sequence
  chemically synthesized
gaaaacaaaaataggatcta

SEQ ID NO: 438069 - DNA, 20 bp, Artificial Sequence
  chemically synthesized
tggactctgaaaacaaaaat

SEQ ID NO: 438070 - DNA, 20 bp, Artificial Sequence
  chemically synthesized
atggactctgaaaacaaaaa

SEQ ID NO: 438071 - DNA, 20 bp, Artificial Sequence
  chemically synthesized
gtagatcctatttttgtttt

SEQ ID NO: 438072 - DNA, 20 bp, Artificial Sequence
  chemically synthesized
agatcctatttttgttttca

SEQ ID NO: 438073 - DNA, 20 bp, Artificial Sequence
  chemically synthesized
ctcaaatacatggaattgaa

SEQ ID NO: 438074 - DNA, 20 bp, Artificial Sequence
  chemically synthesized
ccattcaattccatgtattt

SEQ ID NO: 438075 - DNA, 20 bp, Artificial Sequence
  chemically synthesized
tattgcatgactcaaataca

SEQ ID NO: 438076 - DNA, 20 bp, Artificial Sequence
  chemically synthesized
agtatgcccaaattcaaggt

SEQ ID NO: 438077 - DNA, 20 bp, Artificial Sequence
  chemically synthesized
aacatttctcaccttgaatt

SEQ ID NO: 438078 - DNA, 20 bp, Artificial Sequence
  chemically synthesized
acatttctcaccttgaattt

SEQ ID NO: 438079 - DNA, 20 bp, Artificial Sequence
  chemically synthesized
tacaagtatgcccaaattca

SEQ ID NO: 438080 - DNA, 20 bp, Artificial Sequence
  chemically synthesized
atacaagtatgcccaaattc

SEQ ID NO: 438081 - DNA, 20 bp, Artificial Sequence
  chemically synthesized
tgaatttgggcatacttgta

SEQ ID NO: 438082 - DNA, 20 bp, Artificial Sequence
  chemically synthesized
gaatttgggcatacttgtat

SEQ ID NO: 438083 - DNA, 20 bp, Artificial Sequence
  chemically synthesized
aatttgggcatacttgtatg

SEQ ID NO: 438084 - DNA, 20 bp, Artificial Sequence
  chemically synthesized
acaagcatggagccccatac

SEQ ID NO: 438085 - DNA, 20 bp, Artificial Sequence
  chemically synthesized
aatatgtgtgcacaagcatg

SEQ ID NO: 438086 - DNA, 20 bp, Artificial Sequence
  chemically synthesized
taaatatgtgtgcacaagca

SEQ ID NO: 438087 - DNA, 20 bp, Artificial Sequence
  chemically synthesized
ctggataaatatgtgtgcac

SEQ ID NO: 438088 - DNA, 20 bp, Artificial Sequence
  chemically synthesized
cttgtgcacacatatttatc

SEQ ID NO: 438089 - DNA, 20 bp, Artificial Sequence
  chemically synthesized
cacatatttatccagacact

SEQ ID NO: 438090 - DNA, 20 bp, Artificial Sequence
  chemically synthesized
ataaaaggaaacttagtgtc

SEQ ID NO: 438091 - DNA, 20 bp, Artificial Sequence
  chemically synthesized
ctcatttataaaaggaaact

SEQ ID NO: 438092 - DNA, 20 bp, Artificial Sequence
  chemically synthesized
ggattgagctcatttataaa

SEQ ID NO: 438093 - DNA, 20 bp, Artificial Sequence
  chemically synthesized
gggattgagctcatttataa

SEQ ID NO: 438094 - DNA, 20 bp, Artificial Sequence
  chemically synthesized
ctaagtttccttttataaat

SEQ ID NO: 438095 - DNA, 20 bp, Artificial Sequence
  chemically synthesized
tttataaatgagctcaatcc

SEQ ID NO: 438096 - DNA, 20 bp, Artificial Sequence
  chemically synthesized
atctgttttaatctgggatt

SEQ ID NO: 438097 - DNA, 20 bp, Artificial Sequence
  chemically synthesized
tctttcatctgttttaatct

SEQ ID NO: 438098 - DNA, 20 bp, Artificial Sequence
  chemically synthesized
atctttcatctgttttaatc

SEQ ID NO: 438099 - DNA, 20 bp, Artificial Sequence
  chemically synthesized
agctcaatcccagattaaaa

SEQ ID NO: 438100 - DNA, 20 bp, Artificial Sequence
  chemically synthesized
tcccagattaaaacagatga

SEQ ID NO: 438101 - DNA, 20 bp, Artificial Sequence
  chemically synthesized
tgaaagatttccaatcattg

SEQ ID NO: 438102 - DNA, 20 bp, Artificial Sequence
  chemically synthesized
tgggagctggccacaatgat

SEQ ID NO: 438103 - DNA, 20 bp, Artificial Sequence
  chemically synthesized
agatttccaatcattgtggc

SEQ ID NO: 438104 - DNA, 20 bp, Artificial Sequence
  chemically synthesized
caatcattgtggccagctcc

SEQ ID NO: 438105 - DNA, 20 bp, Artificial Sequence
  chemically synthesized
aatcattgtggccagctccc

SEQ ID NO: 438106 - DNA, 20 bp, Artificial Sequence
  chemically synthesized
atcattgtggccagctccca

SEQ ID NO: 438107 - DNA, 20 bp, Artificial Sequence
  chemically synthesized
ttattttccaccctgggagc

SEQ ID NO: 438108 - DNA, 20 bp, Artificial Sequence
  chemically synthesized
attgtggccagctcccaggg

SEQ ID NO: 438109 - DNA, 20 bp, Artificial Sequence
  chemically synthesized
aagcttattttccaccctgg

SEQ ID NO: 438110 - DNA, 20 bp, Artificial Sequence
  chemically synthesized
ctaagcttattttccaccct

SEQ ID NO: 438111 - DNA, 20 bp, Artificial Sequence
  chemically synthesized
cctaagcttattttccaccc

SEQ ID NO: 438112 - DNA, 20 bp, Artificial Sequence
  chemically synthesized
cagctcccagggtggaaaat

SEQ ID NO: 438113 - DNA, 20 bp, Artificial Sequence
  chemically synthesized
cccagggtggaaaataagct

SEQ ID NO: 438114 - DNA, 20 bp, Artificial Sequence
  chemically synthesized
ccagggtggaaaataagctt

SEQ ID NO: 438115 - DNA, 20 bp, Artificial Sequence
  chemically synthesized
ggaaaataagcttaggaatg

SEQ ID NO: 438116 - DNA, 20 bp, Artificial Sequence
  chemically synthesized
tttcagtttgctgcattcct

SEQ ID NO: 438117 - DNA, 20 bp, Artificial Sequence
  chemically synthesized
ttccagagagtattcagttt

SEQ ID NO: 438118 - DNA, 20 bp, Artificial Sequence
  chemically synthesized
tgtccattccagagagtatt

SEQ ID NO: 438119 - DNA, 20 bp, Artificial Sequence
  chemically synthesized
aactgaaactgaatactctc

SEQ ID NO: 438120 - DNA, 20 bp, Artificial Sequence
  chemically synthesized
aaactgaatactctctggaa

SEQ ID NO: 438121 - DNA, 20 bp, Artificial Sequence
  chemically synthesized
aacggaatgtccattccaga

SEQ ID NO: 438122 - DNA, 20 bp, Artificial Sequence
  chemically synthesized
agaacggaatgtccattcca

SEQ ID NO: 438123 - DNA, 20 bp, Artificial Sequence
  chemically synthesized
ttagaacggaatgtccattc

SEQ ID NO: 438124 - DNA, 20 bp, Artificial Sequence
  chemically synthesized
tggaatggacattccgttct

SEQ ID NO: 438125 - DNA, 20 bp, Artificial Sequence
  chemically synthesized
ttcctgaaggagacttagaa

SEQ ID NO: 438126 - DNA, 20 bp, Artificial Sequence
  chemically synthesized
gaggtttcctgaaggagact

SEQ ID NO: 438127 - DNA, 20 bp, Artificial Sequence
  chemically synthesized
attccgttctaagtctcctt

SEQ ID NO: 438128 - DNA, 20 bp, Artificial Sequence
  chemically synthesized
ttccgttctaagtctccttc

SEQ ID NO: 438129 - DNA, 20 bp, Artificial Sequence
  chemically synthesized
ttgttggaggtttcctgaag

SEQ ID NO: 438130 - DNA, 20 bp, Artificial Sequence
  chemically synthesized
tattgttggaggtttcctga

SEQ ID NO: 438131 - DNA, 20 bp, Artificial Sequence
  chemically synthesized
ctattgttggaggtttcctg

SEQ ID NO: 438132 - DNA, 20 bp, Artificial Sequence
  chemically synthesized
cttcaggaaacctccaacaa

SEQ ID NO: 438133 - DNA, 20 bp, Artificial Sequence
  chemically synthesized
cctgcttgagctattgttgg

SEQ ID NO: 438134 - DNA, 20 bp, Artificial Sequence
  chemically synthesized
tcctgcttgagctattgttg

SEQ ID NO: 438135 - DNA, 20 bp, Artificial Sequence
  chemically synthesized
gctcctgcttgagctattgt

SEQ ID NO: 438136 - DNA, 20 bp, Artificial Sequence
  chemically synthesized
gaaacctccaacaatagctc

SEQ ID NO: 438137 - DNA, 20 bp, Artificial Sequence
  chemically synthesized
acctccaacaatagctcaag

SEQ ID NO: 438138 - DNA, 20 bp, Artificial Sequence
  chemically synthesized
cctccaacaatagctcaagc

SEQ ID NO: 438139 - DNA, 20 bp, Artificial Sequence
  chemically synthesized
tccaacaatagctcaagcag

SEQ ID NO: 438140 - DNA, 20 bp, Artificial Sequence
  chemically synthesized
acaagtgtttgctcctgctt

SEQ ID NO: 438141 - DNA, 20 bp, Artificial Sequence
  chemically synthesized
aggagcaaacacttgtcttt

SEQ ID NO: 438142 - DNA, 20 bp, Artificial Sequence
  chemically synthesized
ggagcaaacacttgtctttg

SEQ ID NO: 438143 - DNA, 20 bp, Artificial Sequence
  chemically synthesized
gcttggactacctcaaagac

SEQ ID NO: 438144 - DNA, 20 bp, Artificial Sequence
  chemically synthesized
gcaaacacttgtctttgagg

SEQ ID NO: 438145 - DNA, 20 bp, Artificial Sequence
  chemically synthesized
ggttggcttggactacctca

SEQ ID NO: 438146 - DNA, 20 bp, Artificial Sequence
  chemically synthesized
acttgtctttgaggtagtcc

SEQ ID NO: 438147 - DNA, 20 bp, Artificial Sequence
  chemically synthesized
gagaaagtgaatggttggct

SEQ ID NO: 438148 - DNA, 20 bp, Artificial Sequence
  chemically synthesized
ttactgagaaagtgaatggt

SEQ ID NO: 438149 - DNA, 20 bp, Artificial Sequence
  chemically synthesized
cagattactgagaaagtgaa

SEQ ID NO: 438150 - DNA, 20 bp, Artificial Sequence
  chemically synthesized
aagccaaccattcactttct

SEQ ID NO: 438151 - DNA, 20 bp, Artificial Sequence
  chemically synthesized
ctgaggacagattactgaga

SEQ ID NO: 438152 - DNA, 20 bp, Artificial Sequence
  chemically synthesized
gtgtctgaggacagattact

SEQ ID NO: 438153 - DNA, 20 bp, Artificial Sequence
  chemically synthesized
ctttctcagtaatctgtcct

SEQ ID NO: 438154 - DNA, 20 bp, Artificial Sequence
  chemically synthesized
gtccagtgggtgtctgagga

SEQ ID NO: 438155 - DNA, 20 bp, Artificial Sequence
  chemically synthesized
ctaagtccagtgggtgtctg

SEQ ID NO: 438156 - DNA, 20 bp, Artificial Sequence
  chemically synthesized
tctaagtccagtgggtgtct

SEQ ID NO: 438157 - DNA, 20 bp, Artificial Sequence
  chemically synthesized
atctgtcctcagacacccac

SEQ ID NO: 438158 - DNA, 20 bp, Artificial Sequence
  chemically synthesized
acaggagctctaagtccagt

SEQ ID NO: 438159 - DNA, 20 bp, Artificial Sequence
  chemically synthesized
cctcagacacccactggact

SEQ ID NO: 438160 - DNA, 20 bp, Artificial Sequence
  chemically synthesized
cacaggagctctaagtccag

SEQ ID NO: 438161 - DNA, 20 bp, Artificial Sequence
  chemically synthesized
tcagacacccactggactta

SEQ ID NO: 438162 - DNA, 20 bp, Artificial Sequence
  chemically synthesized
gggcacaggagctctaagtc

SEQ ID NO: 438163 - DNA, 20 bp, Artificial Sequence
  chemically synthesized
gaggtgggcacaggagctct

SEQ ID NO: 438164 - DNA, 20 bp, Artificial Sequence
  chemically synthesized
gtcctttgaggtgggcacag

SEQ ID NO: 438165 - DNA, 20 bp, Artificial Sequence
  chemically synthesized
ctgtcctttgaggtgggcac

SEQ ID NO: 438166 - DNA, 20 bp, Artificial Sequence
  chemically synthesized
gctgtcctttgaggtgggca

SEQ ID NO: 438167 - DNA, 20 bp, Artificial Sequence
  chemically synthesized
gagctcctgtgcccacctca

SEQ ID NO: 438168 - DNA, 20 bp, Artificial Sequence
  chemically synthesized
agctcctgtgcccacctcaa

SEQ ID NO: 438169 - DNA, 20 bp, Artificial Sequence
  chemically synthesized
gggctgctgtcctttgaggt

SEQ ID NO: 438170 - DNA, 20 bp, Artificial Sequence
  chemically synthesized
agggctgctgtcctttgagg

SEQ ID NO: 438171 - DNA, 20 bp, Artificial Sequence
  chemically synthesized
cctgtgcccacctcaaagga

SEQ ID NO: 438172 - DNA, 20 bp, Artificial Sequence
  chemically synthesized
gccagggctgctgtcctttg

SEQ ID NO: 438173 - DNA, 20 bp, Artificial Sequence
  chemically synthesized
tgccagggctgctgtccttt

SEQ ID NO: 438174 - DNA, 20 bp, Artificial Sequence
  chemically synthesized
gtgcccacctcaaaggacag

SEQ ID NO: 438175 - DNA, 20 bp, Artificial Sequence
  chemically synthesized
acctcaaaggacagcagccc

SEQ ID NO: 438176 - DNA, 20 bp, Artificial Sequence
  chemically synthesized
cctatagtgcatgcatgcca

SEQ ID NO: 438177 - DNA, 20 bp, Artificial Sequence
  chemically synthesized
tcctatagtgcatgcatgcc

SEQ ID NO: 438178 - DNA, 20 bp, Artificial Sequence
  chemically synthesized
ctcctatagtgcatgcatgc

SEQ ID NO: 438179 - DNA, 20 bp, Artificial Sequence
  chemically synthesized
gccctggcatgcatgcacta

SEQ ID NO: 438180 - DNA, 20 bp, Artificial Sequence
  chemically synthesized
ccctggcatgcatgcactat

SEQ ID NO: 438181 - DNA, 20 bp, Artificial Sequence
  chemically synthesized
ctggcatgcatgcactatag

SEQ ID NO: 438182 - DNA, 20 bp, Artificial Sequence
  chemically synthesized
gcatgcatgcactataggag

SEQ ID NO: 438183 - DNA, 20 bp, Artificial Sequence
  chemically synthesized
gagaatcacttctgctccta

SEQ ID NO: 438184 - DNA, 20 bp, Artificial Sequence
  chemically synthesized
tgcatgcactataggagcag

SEQ ID NO: 438185 - DNA, 20 bp, Artificial Sequence
  chemically synthesized
gtgagcagagtagaaatttg

SEQ ID NO: 438186 - DNA, 20 bp, Artificial Sequence
  chemically synthesized
aggtgagcagagtagaaatt

SEQ ID NO: 438187 - DNA, 20 bp, Artificial Sequence
  chemically synthesized
tggtggagaggtgagcagag

SEQ ID NO: 438188 - DNA, 20 bp, Artificial Sequence
  chemically synthesized
aagtggtggagaggtgagca

SEQ ID NO: 438189 - DNA, 20 bp, Artificial Sequence
  chemically synthesized
caaagtggtggagaggtgag

SEQ ID NO: 438190 - DNA, 20 bp, Artificial Sequence
  chemically synthesized
atgcaaagtggtggagaggt

SEQ ID NO: 438191 - DNA, 20 bp, Artificial Sequence
  chemically synthesized
attgatgcaaagtggtggag

SEQ ID NO: 438192 - DNA, 20 bp, Artificial Sequence
  chemically synthesized
aattgatgcaaagtggtgga

SEQ ID NO: 438193 - DNA, 20 bp, Artificial Sequence
  chemically synthesized
caaattgatgcaaagtggtg

SEQ ID NO: 438194 - DNA, 20 bp, Artificial Sequence
  chemically synthesized
gccaaattgatgcaaagtgg

SEQ ID NO: 438195 - DNA, 20 bp, Artificial Sequence
  chemically synthesized
gatgccaaattgatgcaaag

SEQ ID NO: 438196 - DNA, 20 bp, Artificial Sequence
  chemically synthesized
ggagatgccaaattgatgca

SEQ ID NO: 438197 - DNA, 20 bp, Artificial Sequence
  chemically synthesized
tccaccactttgcatcaatt

SEQ ID NO: 438198 - DNA, 20 bp, Artificial Sequence
  chemically synthesized
gcatcaatttggcatctcct

SEQ ID NO: 438199 - DNA, 20 bp, Artificial Sequence
  chemically synthesized
acaaagctgagatatcttag

SEQ ID NO: 438200 - DNA, 20 bp, Artificial Sequence
  chemically synthesized
ttacaaagctgagatatctt

SEQ ID NO: 438201 - DNA, 20 bp, Artificial Sequence
  chemically synthesized
gttacaaagctgagatatct

SEQ ID NO: 438202 - DNA, 20 bp, Artificial Sequence
  chemically synthesized
tggcatctcctaagatatct

SEQ ID NO: 438203 - DNA, 20 bp, Artificial Sequence
  chemically synthesized
ctttgaggagttacaaagct

SEQ ID NO: 438204 - DNA, 20 bp, Artificial Sequence
  chemically synthesized
gattcctttgaggagttaca

SEQ ID NO: 438205 - DNA, 20 bp, Artificial Sequence
  chemically synthesized
ctcagctttgtaactcctca

SEQ ID NO: 438206 - DNA, 20 bp, Artificial Sequence
  chemically synthesized
tcagctttgtaactcctcaa

SEQ ID NO: 438207 - DNA, 20 bp, Artificial Sequence
  chemically synthesized
tttgtggggattcctttgag

SEQ ID NO: 438208 - DNA, 20 bp, Artificial Sequence
  chemically synthesized
aatttgtggggattcctttg

SEQ ID NO: 438209 - DNA, 20 bp, Artificial Sequence
  chemically synthesized
caatttgtggggattccttt

SEQ ID NO: 438210 - DNA, 20 bp, Artificial Sequence
  chemically synthesized
tcaaaggaatccccacaaat

SEQ ID NO: 438211 - DNA, 20 bp, Artificial Sequence
  chemically synthesized
aaaaagagccccaatttgtg

SEQ ID NO: 438212 - DNA, 20 bp, Artificial Sequence
  chemically synthesized
caaaggaatccccacaaatt

SEQ ID NO: 438213 - DNA, 20 bp, Artificial Sequence
  chemically synthesized
aaaaaagagccccaatttgt

SEQ ID NO: 438214 - DNA, 20 bp, Artificial Sequence
  chemically synthesized
aaaggaatccccacaaattg

SEQ ID NO: 438215 - DNA, 20 bp, Artificial Sequence
  chemically synthesized
taaaaaagagccccaatttg

SEQ ID NO: 438216 - DNA, 20 bp, Artificial Sequence
  chemically synthesized
gaaatgtccaagttaaaaaa

SEQ ID NO: 438217 - DNA, 20 bp, Artificial Sequence
  chemically synthesized
aggaaatgtccaagttaaaa

SEQ ID NO: 438218 - DNA, 20 bp, Artificial Sequence
  chemically synthesized
attggggctcttttttaact

SEQ ID NO: 438219 - DNA, 20 bp, Artificial Sequence
  chemically synthesized
tagtctcaaaggaaatgtcc

SEQ ID NO: 438220 - DNA, 20 bp, Artificial Sequence
  chemically synthesized
ttaacttggacatttccttt

SEQ ID NO: 438221 - DNA, 20 bp, Artificial Sequence
  chemically synthesized
tctttctttcttagtctcaa

SEQ ID NO: 438222 - DNA, 20 bp, Artificial Sequence
  chemically synthesized
tggacatttcctttgagact

SEQ ID NO: 438223 - DNA, 20 bp, Artificial Sequence
  chemically synthesized
ctctttctttcttagtctca

SEQ ID NO: 438224 - DNA, 20 bp, Artificial Sequence
  chemically synthesized
catttcctttgagactaaga

SEQ ID NO: 438225 - DNA, 20 bp, Artificial Sequence
  chemically synthesized
tcctttgagactaagaaaga

SEQ ID NO: 438226 - DNA, 20 bp, Artificial Sequence
  chemically synthesized
tttgttttctctttctttct

SEQ ID NO: 438227 - DNA, 20 bp, Artificial Sequence
  chemically synthesized
ctttgagactaagaaagaaa

SEQ ID NO: 438228 - DNA, 20 bp, Artificial Sequence
  chemically synthesized
taagaaagaaagagaaaaca

SEQ ID NO: 438229 - DNA, 20 bp, Artificial Sequence
  chemically synthesized
gaaagagaaaacaaagtaca

SEQ ID NO: 438230 - DNA, 20 bp, Artificial Sequence
  chemically synthesized
catataatctgtcgtgtttt

SEQ ID NO: 438231 - DNA, 20 bp, Artificial Sequence
  chemically synthesized
acagataaccaaaaacacga

SEQ ID NO: 438232 - DNA, 20 bp, Artificial Sequence
  chemically synthesized
ttatatgaatcatccaaatt

SEQ ID NO: 438233 - DNA, 20 bp, Artificial Sequence
  chemically synthesized
aaaatgttggttgcttaatt

SEQ ID NO: 438234 - DNA, 20 bp, Artificial Sequence
  chemically synthesized
aaattaagcaaccaacattt

SEQ ID NO: 438235 - DNA, 20 bp, Artificial Sequence
  chemically synthesized
taaatcttagactaaaatgt

SEQ ID NO: 438236 - DNA, 20 bp, Artificial Sequence
  chemically synthesized
agcaaccaacattttagtct

SEQ ID NO: 438237 - DNA, 20 bp, Artificial Sequence
  chemically synthesized
attgtaaaaattataaatct

SEQ ID NO: 438238 - DNA, 20 bp, Artificial Sequence
  chemically synthesized
tataatttttacaatatatt

SEQ ID NO: 438239 - DNA, 20 bp, Artificial Sequence
  chemically synthesized
ttacaatatattgagtacac

SEQ ID NO: 438240 - DNA, 20 bp, Artificial Sequence
  chemically synthesized
attgagtacactggacaaaa

SEQ ID NO: 438241 - DNA, 20 bp, Artificial Sequence
  chemically synthesized
taagtagatacttttttgtc

SEQ ID NO: 438242 - DNA, 20 bp, Artificial Sequence
  chemically synthesized
tggacaaaaaagtatctact

SEQ ID NO: 438243 - DNA, 20 bp, Artificial Sequence
  chemically synthesized
ggacaaaaaagtatctactt

SEQ ID NO: 438244 - DNA, 20 bp, Artificial Sequence
  chemically synthesized
caggatgggataatcctaag

SEQ ID NO: 438245 - DNA, 20 bp, Artificial Sequence
  chemically synthesized
gaacaggatgggataatcct

SEQ ID NO: 438246 - DNA, 20 bp, Artificial Sequence
  chemically synthesized
cacacaaaatagaacaggat

SEQ ID NO: 438247 - DNA, 20 bp, Artificial Sequence
  chemically synthesized
acacacaaaatagaacagga

SEQ ID NO: 438248 - DNA, 20 bp, Artificial Sequence
  chemically synthesized
acacacacacaaaatagaac

SEQ ID NO: 438249 - DNA, 20 bp, Artificial Sequence
  chemically synthesized
cacacacacacaaaatagaa

SEQ ID NO: 438250 - DNA, 20 bp, Artificial Sequence
  chemically synthesized
acacacacacacacacaaaa

SEQ ID NO: 438251 - DNA, 20 bp, Artificial Sequence
  chemically synthesized
gtgtacaaaataatgcatgc

SEQ ID NO: 438252 - DNA, 20 bp, Artificial Sequence
  chemically synthesized
tggaaaagccttatgaatac

SEQ ID NO: 438253 - DNA, 20 bp, Artificial Sequence
  chemically synthesized
taatgcatgccagtattcat

SEQ ID NO: 438254 - DNA, 20 bp, Artificial Sequence
  chemically synthesized
aatgcatgccagtattcata

SEQ ID NO: 438255 - DNA, 20 bp, Artificial Sequence
  chemically synthesized
aggcatcattcagattggaa

SEQ ID NO: 438256 - DNA, 20 bp, Artificial Sequence
  chemically synthesized
aactcaggcatcattcagat

SEQ ID NO: 438257 - DNA, 20 bp, Artificial Sequence
  chemically synthesized
tttgaaactcaggcatcatt

SEQ ID NO: 438258 - DNA, 20 bp, Artificial Sequence
  chemically synthesized
ttccaatctgaatgatgcct

SEQ ID NO: 438259 - DNA, 20 bp, Artificial Sequence
  chemically synthesized
tgtatacatatttgaaactc

SEQ ID NO: 438260 - DNA, 20 bp, Artificial Sequence
  chemically synthesized
ctgtatacatatttgaaact

SEQ ID NO: 438261 - DNA, 20 bp, Artificial Sequence
  chemically synthesized
ctgagtttcaaatatgtata

SEQ ID NO: 438262 - DNA, 20 bp, Artificial Sequence
  chemically synthesized
atatgtatacagtgatgtaa

SEQ ID NO: 438263 - DNA, 20 bp, Artificial Sequence
  chemically synthesized
gtgatgtaatggctaaacaa

SEQ ID NO: 438264 - DNA, 20 bp, Artificial Sequence
  chemically synthesized
gcatttatctgactattgtt

SEQ ID NO: 438265 - DNA, 20 bp, Artificial Sequence
  chemically synthesized
tgtaatggctaaacaatagt

SEQ ID NO: 438266 - DNA, 20 bp, Artificial Sequence
  chemically synthesized
atagtcagataaatgctgtg

SEQ ID NO: 438267 - DNA, 20 bp, Artificial Sequence
  chemically synthesized
tacacaaatgaatgactaca

SEQ ID NO: 438268 - DNA, 20 bp, Artificial Sequence
  chemically synthesized
tcattcatttgtgtacctac

SEQ ID NO: 438269 - DNA, 20 bp, Artificial Sequence
  chemically synthesized
aattgtgcctaacagcttgt

SEQ ID NO: 438270 - DNA, 20 bp, Artificial Sequence
  chemically synthesized
taattgtgcctaacagcttg

SEQ ID NO: 438271 - DNA, 20 bp, Artificial Sequence
  chemically synthesized
tttgtgtacctacaagctgt

SEQ ID NO: 438272 - DNA, 20 bp, Artificial Sequence
  chemically synthesized
ttgtgtacctacaagctgtt

SEQ ID NO: 438273 - DNA, 20 bp, Artificial Sequence
  chemically synthesized
tgtggattaattgtgcctaa

SEQ ID NO: 438274 - DNA, 20 bp, Artificial Sequence
  chemically synthesized
tagcctgtgcttattatatg

SEQ ID NO: 438275 - DNA, 20 bp, Artificial Sequence
  chemically synthesized
acaattaatccacatataat

SEQ ID NO: 438276 - DNA, 20 bp, Artificial Sequence
  chemically synthesized
taatccacatataataagca

SEQ ID NO: 438277 - DNA, 20 bp, Artificial Sequence
  chemically synthesized
aatccacatataataagcac

SEQ ID NO: 438278 - DNA, 20 bp, Artificial Sequence
  chemically synthesized
taagcacaggctatctcctc

SEQ ID NO: 438279 - DNA, 20 bp, Artificial Sequence
  chemically synthesized
tctcttgctccttgaggaga

SEQ ID NO: 438280 - DNA, 20 bp, Artificial Sequence
  chemically synthesized
aagcacaggctatctcctca

SEQ ID NO: 438281 - DNA, 20 bp, Artificial Sequence
  chemically synthesized
gcacaggctatctcctcaag

SEQ ID NO: 438282 - DNA, 20 bp, Artificial Sequence
  chemically synthesized
tcactctcttgctccttgag

SEQ ID NO: 438283 - DNA, 20 bp, Artificial Sequence
  chemically synthesized
actcactctcttgctccttg

SEQ ID NO: 438284 - DNA, 20 bp, Artificial Sequence
  chemically synthesized
aggctatctcctcaaggagc

SEQ ID NO: 438285 - DNA, 20 bp, Artificial Sequence
  chemically synthesized
gactcactctcttgctcctt

SEQ ID NO: 438286 - DNA, 20 bp, Artificial Sequence
  chemically synthesized
gctatctcctcaaggagcaa

SEQ ID NO: 438287 - DNA, 20 bp, Artificial Sequence
  chemically synthesized
tatctcctcaaggagcaaga

SEQ ID NO: 438288 - DNA, 20 bp, Artificial Sequence
  chemically synthesized
tcctcaaggagcaagagagt

SEQ ID NO: 438289 - DNA, 20 bp, Artificial Sequence
  chemically synthesized
caaggagcaagagagtgagt

SEQ ID NO: 438290 - DNA, 20 bp, Artificial Sequence
  chemically synthesized
ggagcaagagagtgagtcag

SEQ ID NO: 438291 - DNA, 20 bp, Artificial Sequence
  chemically synthesized
aagagagtgagtcagaagcc

SEQ ID NO: 438292 - DNA, 20 bp, Artificial Sequence
  chemically synthesized
agagtgagtcagaagccgag

SEQ ID NO: 438293 - DNA, 20 bp, Artificial Sequence
  chemically synthesized
ttagctgtcagtttgcttct

SEQ ID NO: 438294 - DNA, 20 bp, Artificial Sequence
  chemically synthesized
gaagccgagaagcaaactga

SEQ ID NO: 438295 - DNA, 20 bp, Artificial Sequence
  chemically synthesized
atatcccctattttagctgt

SEQ ID NO: 438296 - DNA, 20 bp, Artificial Sequence
  chemically synthesized
aagcaaactgacagctaaaa

SEQ ID NO: 438297 - DNA, 20 bp, Artificial Sequence
  chemically synthesized
agcaaactgacagctaaaat

SEQ ID NO: 438298 - DNA, 20 bp, Artificial Sequence
  chemically synthesized
gcaaactgacagctaaaata

SEQ ID NO: 438299 - DNA, 20 bp, Artificial Sequence
  chemically synthesized
caaactgacagctaaaatag

SEQ ID NO: 438300 - DNA, 20 bp, Artificial Sequence
  chemically synthesized
agcaattatatcccctattt

SEQ ID NO: 438301 - DNA, 20 bp, Artificial Sequence
  chemically synthesized
aggggatataattgcttgtc

SEQ ID NO: 438302 - DNA, 20 bp, Artificial Sequence
  chemically synthesized
cactatggataattctagac

SEQ ID NO: 438303 - DNA, 20 bp, Artificial Sequence
  chemically synthesized
aaactcactatggataattc

SEQ ID NO: 438304 - DNA, 20 bp, Artificial Sequence
  chemically synthesized
tgcttgtctagaattatcca

SEQ ID NO: 438305 - DNA, 20 bp, Artificial Sequence
  chemically synthesized
tgtctagaattatccatagt

SEQ ID NO: 438306 - DNA, 20 bp, Artificial Sequence
  chemically synthesized
ttcttattgtaaactcacta

SEQ ID NO: 438307 - DNA, 20 bp, Artificial Sequence
  chemically synthesized
atccatagtgagtttacaat

SEQ ID NO: 438308 - DNA, 20 bp, Artificial Sequence
  chemically synthesized
tttacaataagaatacatat

SEQ ID NO: 438309 - DNA, 20 bp, Artificial Sequence
  chemically synthesized
ttacaataagaatacatatt

SEQ ID NO: 438310 - DNA, 20 bp, Artificial Sequence
  chemically synthesized
tacaataagaatacatattg

SEQ ID NO: 438311 - DNA, 20 bp, Artificial Sequence
  chemically synthesized
ctaccctaggtcagaaaatg

SEQ ID NO: 438312 - DNA, 20 bp, Artificial Sequence
  chemically synthesized
actaccctaggtcagaaaat

SEQ ID NO: 438313 - DNA, 20 bp, Artificial Sequence
  chemically synthesized
tactaccctaggtcagaaaa

SEQ ID NO: 438314 - DNA, 20 bp, Artificial Sequence
  chemically synthesized
tggggccccattttctgacc

SEQ ID NO: 438315 - DNA, 20 bp, Artificial Sequence
  chemically synthesized
ggggccccattttctgacct

SEQ ID NO: 438316 - DNA, 20 bp, Artificial Sequence
  chemically synthesized
gggccccattttctgaccta

SEQ ID NO: 438317 - DNA, 20 bp, Artificial Sequence
  chemically synthesized
aattccttactaccctaggt

SEQ ID NO: 438318 - DNA, 20 bp, Artificial Sequence
  chemically synthesized
ccccattttctgacctaggg

SEQ ID NO: 438319 - DNA, 20 bp, Artificial Sequence
  chemically synthesized
aaagaattccttactaccct

SEQ ID NO: 438320 - DNA, 20 bp, Artificial Sequence
  chemically synthesized
attttctgacctagggtagt

SEQ ID NO: 438321 - DNA, 20 bp, Artificial Sequence
  chemically synthesized
aaaagaattccttactaccc

SEQ ID NO: 438322 - DNA, 20 bp, Artificial Sequence
  chemically synthesized
ttttctgacctagggtagta

SEQ ID NO: 438323 - DNA, 20 bp, Artificial Sequence
  chemically synthesized
ccttatagaatattgtttaa

SEQ ID NO: 438324 - DNA, 20 bp, Artificial Sequence
  chemically synthesized
tcttttaaacaatattctat

SEQ ID NO: 438325 - DNA, 20 bp, Artificial Sequence
  chemically synthesized
cttttaaacaatattctata

SEQ ID NO: 438326 - DNA, 20 bp, Artificial Sequence
  chemically synthesized
taaacaatattctataagga

SEQ ID NO: 438327 - DNA, 20 bp, Artificial Sequence
  chemically synthesized
attatttttatctttcctta

SEQ ID NO: 438328 - DNA, 20 bp, Artificial Sequence
  chemically synthesized
aaagataaaaataatattaa

SEQ ID NO: 438329 - DNA, 20 bp, Artificial Sequence
  chemically synthesized
aaaataatattaatagtcat

SEQ ID NO: 438330 - DNA, 20 bp, Artificial Sequence
  chemically synthesized
ataatattaatagtcattgg

SEQ ID NO: 438331 - DNA, 20 bp, Artificial Sequence
  chemically synthesized
atattaatagtcattggtgg

SEQ ID NO: 438332 - DNA, 20 bp, Artificial Sequence
  chemically synthesized
attaatagtcattggtggaa

SEQ ID NO: 438333 - DNA, 20 bp, Artificial Sequence
  chemically synthesized
agtcattggtggaagagaca

SEQ ID NO: 438334 - DNA, 20 bp, Artificial Sequence
  chemically synthesized
tggtggaagagacatggtga

SEQ ID NO: 438335 - DNA, 20 bp, Artificial Sequence
  chemically synthesized
tggaagagacatggtgatag

SEQ ID NO: 438336 - DNA, 20 bp, Artificial Sequence
  chemically synthesized
gacatggtgatagtggtttt

SEQ ID NO: 438337 - DNA, 20 bp, Artificial Sequence
  chemically synthesized
acatggtgatagtggttttt

SEQ ID NO: 438338 - DNA, 20 bp, Artificial Sequence
  chemically synthesized
atggtgatagtggtttttgg

SEQ ID NO: 438339 - DNA, 20 bp, Artificial Sequence
  chemically synthesized
ggtttttgggagaacattcc

SEQ ID NO: 438340 - DNA, 20 bp, Artificial Sequence
  chemically synthesized
ttttgggagaacattccaag

SEQ ID NO: 438341 - DNA, 20 bp, Artificial Sequence
  chemically synthesized
tgggagaacattccaagaag

SEQ ID NO: 438342 - DNA, 20 bp, Artificial Sequence
  chemically synthesized
gggagaacattccaagaagt

SEQ ID NO: 438343 - DNA, 20 bp, Artificial Sequence
  chemically synthesized
tatgacttgttcccacttct

SEQ ID NO: 438344 - DNA, 20 bp, Artificial Sequence
  chemically synthesized
acattccaagaagtgggaac

SEQ ID NO: 438345 - DNA, 20 bp, Artificial Sequence
  chemically synthesized
caagaagtgggaacaagtca

SEQ ID NO: 438346 - DNA, 20 bp, Artificial Sequence
  chemically synthesized
acacaaaattacatgaacca

SEQ ID NO: 438347 - DNA, 20 bp, Artificial Sequence
  chemically synthesized
ttcagcaaataaaataactt

SEQ ID NO: 438348 - DNA, 20 bp, Artificial Sequence
  chemically synthesized
ttattttatttgctgaacca

SEQ ID NO: 438349 - DNA, 20 bp, Artificial Sequence
  chemically synthesized
gatataaaattactttggtt

SEQ ID NO: 438350 - DNA, 20 bp, Artificial Sequence
  chemically synthesized
gtctagatataaaattactt

SEQ ID NO: 438351 - DNA, 20 bp, Artificial Sequence
  chemically synthesized
aaccaaagtaattttatatc

SEQ ID NO: 438352 - DNA, 20 bp, Artificial Sequence
  chemically synthesized
aaagtaattttatatctaga

SEQ ID NO: 438353 - DNA, 20 bp, Artificial Sequence
  chemically synthesized
gtaattttatatctagacag

SEQ ID NO: 438354 - DNA, 20 bp, Artificial Sequence
  chemically synthesized
ccaccaggaacacttctgtc

SEQ ID NO: 438355 - DNA, 20 bp, Artificial Sequence
  chemically synthesized
tatctagacagaagtgttcc

SEQ ID NO: 438356 - DNA, 20 bp, Artificial Sequence
  chemically synthesized
ctagacagaagtgttcctgg

SEQ ID NO: 438357 - DNA, 20 bp, Artificial Sequence
  chemically synthesized
tagacagaagtgttcctggt

SEQ ID NO: 438358 - DNA, 20 bp, Artificial Sequence
  chemically synthesized
agacagaagtgttcctggtg

SEQ ID NO: 438359 - DNA, 20 bp, Artificial Sequence
  chemically synthesized
ctgatctgctgttccccacc

SEQ ID NO: 438360 - DNA, 20 bp, Artificial Sequence
  chemically synthesized
cctgatctgctgttccccac

SEQ ID NO: 438361 - DNA, 20 bp, Artificial Sequence
  chemically synthesized
gaagtgttcctggtggggaa

SEQ ID NO: 438362 - DNA, 20 bp, Artificial Sequence
  chemically synthesized
gtgttcctggtggggaacag

SEQ ID NO: 438363 - DNA, 20 bp, Artificial Sequence
  chemically synthesized
cctggtggggaacagcagat

SEQ ID NO: 438364 - DNA, 20 bp, Artificial Sequence
  chemically synthesized
ctggtggggaacagcagatc

SEQ ID NO: 438365 - DNA, 20 bp, Artificial Sequence
  chemically synthesized
ggtggggaacagcagatcag

SEQ ID NO: 438366 - DNA, 20 bp, Artificial Sequence
  chemically synthesized
gtggggaacagcagatcagg

SEQ ID NO: 438367 - DNA, 20 bp, Artificial Sequence
  chemically synthesized
ggaacagcagatcaggaggt

SEQ ID NO: 438368 - DNA, 20 bp, Artificial Sequence
  chemically synthesized
aacagcagatcaggaggtga

SEQ ID NO: 438369 - DNA, 20 bp, Artificial Sequence
  chemically synthesized
gatcaggaggtgagagacat

SEQ ID NO: 438370 - DNA, 20 bp, Artificial Sequence
  chemically synthesized
caggaggtgagagacatgag

SEQ ID NO: 438371 - DNA, 20 bp, Artificial Sequence
  chemically synthesized
gtacaaggtctttcacagta

SEQ ID NO: 438372 - DNA, 20 bp, Artificial Sequence
  chemically synthesized
gagcagatgccatactgtga

SEQ ID NO: 438373 - DNA, 20 bp, Artificial Sequence
  chemically synthesized
ctaacgtacaaggtctttca

SEQ ID NO: 438374 - DNA, 20 bp, Artificial Sequence
  chemically synthesized
ctgtgaaagaccttgtacgt

SEQ ID NO: 438375 - DNA, 20 bp, Artificial Sequence
  chemically synthesized
atccaaggtcctaacgtaca

SEQ ID NO: 438376 - DNA, 20 bp, Artificial Sequence
  chemically synthesized
tgtgaaagaccttgtacgtt

SEQ ID NO: 438377 - DNA, 20 bp, Artificial Sequence
  chemically synthesized
aatccaaggtcctaacgtac

SEQ ID NO: 438378 - DNA, 20 bp, Artificial Sequence
  chemically synthesized
gaccttgtacgttaggacct

SEQ ID NO: 438379 - DNA, 20 bp, Artificial Sequence
  chemically synthesized
tagcttcagggtaaaatcca

SEQ ID NO: 438380 - DNA, 20 bp, Artificial Sequence
  chemically synthesized
ctagcttcagggtaaaatcc

SEQ ID NO: 438381 - DNA, 20 bp, Artificial Sequence
  chemically synthesized
ggaccttggattttaccctg

SEQ ID NO: 438382 - DNA, 20 bp, Artificial Sequence
  chemically synthesized
cttggattttaccctgaagc

SEQ ID NO: 438383 - DNA, 20 bp, Artificial Sequence
  chemically synthesized
tagagaatcttctagcttca

SEQ ID NO: 438384 - DNA, 20 bp, Artificial Sequence
  chemically synthesized
ttagagaatcttctagcttc

SEQ ID NO: 438385 - DNA, 20 bp, Artificial Sequence
  chemically synthesized
ggattttaccctgaagctag

SEQ ID NO: 438386 - DNA, 20 bp, Artificial Sequence
  chemically synthesized
tttagagaatcttctagctt

SEQ ID NO: 438387 - DNA, 20 bp, Artificial Sequence
  chemically synthesized
acgtcctttagagaatcttc

SEQ ID NO: 438388 - DNA, 20 bp, Artificial Sequence
  chemically synthesized
tgaagctagaagattctcta

SEQ ID NO: 438389 - DNA, 20 bp, Artificial Sequence
  chemically synthesized
gaagctagaagattctctaa

SEQ ID NO: 438390 - DNA, 20 bp, Artificial Sequence
  chemically synthesized
ctccagcttaacgtccttta

SEQ ID NO: 438391 - DNA, 20 bp, Artificial Sequence
  chemically synthesized
gcctccagcttaacgtcctt

SEQ ID NO: 438392 - DNA, 20 bp, Artificial Sequence
  chemically synthesized
aagattctctaaaggacgtt

SEQ ID NO: 438393 - DNA, 20 bp, Artificial Sequence
  chemically synthesized
ttctctaaaggacgttaagc

SEQ ID NO: 438394 - DNA, 20 bp, Artificial Sequence
  chemically synthesized
ctctaaaggacgttaagctg

SEQ ID NO: 438395 - DNA, 20 bp, Artificial Sequence
  chemically synthesized
tctaaaggacgttaagctgg

SEQ ID NO: 438396 - DNA, 20 bp, Artificial Sequence
  chemically synthesized
caaataagattgtgtgcctc

SEQ ID NO: 438397 - DNA, 20 bp, Artificial Sequence
  chemically synthesized
gttgagtttctaaaacaaat

SEQ ID NO: 438398 - DNA, 20 bp, Artificial Sequence
  chemically synthesized
gcacacaatcttatttgttt

SEQ ID NO: 438399 - DNA, 20 bp, Artificial Sequence
  chemically synthesized
tatttgttttagaaactcaa

SEQ ID NO: 438400 - DNA, 20 bp, Artificial Sequence
  chemically synthesized
atttgttttagaaactcaac

SEQ ID NO: 438401 - DNA, 20 bp, Artificial Sequence
  chemically synthesized
tttgttttagaaactcaacg

SEQ ID NO: 438402 - DNA, 20 bp, Artificial Sequence
  chemically synthesized
ttgttttagaaactcaacgg

SEQ ID NO: 438403 - DNA, 20 bp, Artificial Sequence
  chemically synthesized
ttgtaattgctgcccccgtt

SEQ ID NO: 438404 - DNA, 20 bp, Artificial Sequence
  chemically synthesized
ttttagaaactcaacggggg

SEQ ID NO: 438405 - DNA, 20 bp, Artificial Sequence
  chemically synthesized
tcaacgggggcagcaattac

SEQ ID NO: 438406 - DNA, 20 bp, Artificial Sequence
  chemically synthesized
caacgggggcagcaattaca

SEQ ID NO: 438407 - DNA, 20 bp, Artificial Sequence
  chemically synthesized
cgggggcagcaattacaagg

SEQ ID NO: 438408 - DNA, 20 bp, Artificial Sequence
  chemically synthesized
gggggcagcaattacaaggt

SEQ ID NO: 438409 - DNA, 20 bp, Artificial Sequence
  chemically synthesized
ttacaaggtgggattttctg

SEQ ID NO: 438410 - DNA, 20 bp, Artificial Sequence
  chemically synthesized
aggtgggattttctgaagac

SEQ ID NO: 438411 - DNA, 20 bp, Artificial Sequence
  chemically synthesized
cttgctttcaatctggtctt

SEQ ID NO: 438412 - DNA, 20 bp, Artificial Sequence
  chemically synthesized
ttttctgaagaccagattga

SEQ ID NO: 438413 - DNA, 20 bp, Artificial Sequence
  chemically synthesized
tgatctccttgctttcaatc

SEQ ID NO: 438414 - DNA, 20 bp, Artificial Sequence
  chemically synthesized
ctgaagaccagattgaaagc

SEQ ID NO: 438415 - DNA, 20 bp, Artificial Sequence
  chemically synthesized
tgaagaccagattgaaagca

SEQ ID NO: 438416 - DNA, 20 bp, Artificial Sequence
  chemically synthesized
aagaccagattgaaagcaag

SEQ ID NO: 438417 - DNA, 20 bp, Artificial Sequence
  chemically synthesized
cacacgcacaaacataaaat

SEQ ID NO: 438418 - DNA, 20 bp, Artificial Sequence
  chemically synthesized
cacgcacaaacataaaatca

SEQ ID NO: 438419 - DNA, 20 bp, Artificial Sequence
  chemically synthesized
acgcacaaacataaaatcag

SEQ ID NO: 438420 - DNA, 20 bp, Artificial Sequence
  chemically synthesized
cacaaacataaaatcagagg

SEQ ID NO: 438421 - DNA, 20 bp, Artificial Sequence
  chemically synthesized
taaacagatacatagatcaa

SEQ ID NO: 438422 - DNA, 20 bp, Artificial Sequence
  chemically synthesized
aacttgtataaacagataca

SEQ ID NO: 438423 - DNA, 20 bp, Artificial Sequence
  chemically synthesized
atctatgtatctgtttatac

SEQ ID NO: 438424 - DNA, 20 bp, Artificial Sequence
  chemically synthesized
tggataccaacttgtataaa

SEQ ID NO: 438425 - DNA, 20 bp, Artificial Sequence
  chemically synthesized
atgtatctgtttatacaagt

SEQ ID NO: 438426 - DNA, 20 bp, Artificial Sequence
  chemically synthesized
ctaaaagataaatgtacatt

SEQ ID NO: 438427 - DNA, 20 bp, Artificial Sequence
  chemically synthesized
ccaaatgtacatttatcttt

SEQ ID NO: 438428 - DNA, 20 bp, Artificial Sequence
  chemically synthesized
aaatgtacatttatctttta

SEQ ID NO: 438429 - DNA, 20 bp, Artificial Sequence
  chemically synthesized
actaatgtatataactctaa

SEQ ID NO: 438430 - DNA, 20 bp, Artificial Sequence
  chemically synthesized
tcttttagagttatatacat

SEQ ID NO: 438431 - DNA, 20 bp, Artificial Sequence
  chemically synthesized
ttatttgtgattaacaataa

SEQ ID NO: 438432 - DNA, 20 bp, Artificial Sequence
  chemically synthesized
ataatagttaaaataataca

SEQ ID NO: 438433 - DNA, 20 bp, Artificial Sequence
  chemically synthesized
ttggtgagggtcaaagtgtt

SEQ ID NO: 438434 - DNA, 20 bp, Artificial Sequence
  chemically synthesized
aagtttcttggtgagggtca

SEQ ID NO: 438435 - DNA, 20 bp, Artificial Sequence
  chemically synthesized
tcaacactttgaccctcacc

SEQ ID NO: 438436 - DNA, 20 bp, Artificial Sequence
  chemically synthesized
tatataaagtttcttggtga

SEQ ID NO: 438437 - DNA, 20 bp, Artificial Sequence
  chemically synthesized
atatataaagtttcttggtg

SEQ ID NO: 438438 - DNA, 20 bp, Artificial Sequence
  chemically synthesized
gatatataaagtttcttggt

SEQ ID NO: 438439 - DNA, 20 bp, Artificial Sequence
  chemically synthesized
gggggatatataaagtttct

SEQ ID NO: 438440 - DNA, 20 bp, Artificial Sequence
  chemically synthesized
ctttaaaagggggatatata

SEQ ID NO: 438441 - DNA, 20 bp, Artificial Sequence
  chemically synthesized
ctttatatatccccctttta

SEQ ID NO: 438442 - DNA, 20 bp, Artificial Sequence
  chemically synthesized
ttattgttggctttaaaagg

SEQ ID NO: 438443 - DNA, 20 bp, Artificial Sequence
  chemically synthesized
cttattgttggctttaaaag

SEQ ID NO: 438444 - DNA, 20 bp, Artificial Sequence
  chemically synthesized
acttattgttggctttaaaa

SEQ ID NO: 438445 - DNA, 20 bp, Artificial Sequence
  chemically synthesized
tacttattgttggctttaaa

SEQ ID NO: 438446 - DNA, 20 bp, Artificial Sequence
  chemically synthesized
ttacttattgttggctttaa

SEQ ID NO: 438447 - DNA, 20 bp, Artificial Sequence
  chemically synthesized
ccccttttaaagccaacaat

SEQ ID NO: 438448 - DNA, 20 bp, Artificial Sequence
  chemically synthesized
ttcacaagcttacttattgt

SEQ ID NO: 438449 - DNA, 20 bp, Artificial Sequence
  chemically synthesized
ttttaaagccaacaataagt

SEQ ID NO: 438450 - DNA, 20 bp, Artificial Sequence
  chemically synthesized
caacaataagtaagcttgtg

SEQ ID NO: 438451 - DNA, 20 bp, Artificial Sequence
  chemically synthesized
aacaataagtaagcttgtga

SEQ ID NO: 438452 - DNA, 20 bp, Artificial Sequence
  chemically synthesized
acaataagtaagcttgtgaa

SEQ ID NO: 438453 - DNA, 20 bp, Artificial Sequence
  chemically synthesized
caataagtaagcttgtgaag

SEQ ID NO: 438454 - DNA, 20 bp, Artificial Sequence
  chemically synthesized
gaaaaataatgccccttcac

SEQ ID NO: 438455 - DNA, 20 bp, Artificial Sequence
  chemically synthesized
actgtcctcaagaggaaatt

SEQ ID NO: 438456 - DNA, 20 bp, Artificial Sequence
  chemically synthesized
tactgtcctcaagaggaaat

SEQ ID NO: 438457 - DNA, 20 bp, Artificial Sequence
  chemically synthesized
atttttcctaatttcctctt

SEQ ID NO: 438458 - DNA, 20 bp, Artificial Sequence
  chemically synthesized
tttttcctaatttcctcttg

SEQ ID NO: 438459 - DNA, 20 bp, Artificial Sequence
  chemically synthesized
tgtctactactgtcctcaag

SEQ ID NO: 438460 - DNA, 20 bp, Artificial Sequence
  chemically synthesized
tcctaatttcctcttgagga

SEQ ID NO: 438461 - DNA, 20 bp, Artificial Sequence
  chemically synthesized
atgtctactactgtcctcaa

SEQ ID NO: 438462 - DNA, 20 bp, Artificial Sequence
  chemically synthesized
gcatgtctactactgtcctc

SEQ ID NO: 438463 - DNA, 20 bp, Artificial Sequence
  chemically synthesized
taatttcctcttgaggacag

SEQ ID NO: 438464 - DNA, 20 bp, Artificial Sequence
  chemically synthesized
tttcctcttgaggacagtag

SEQ ID NO: 438465 - DNA, 20 bp, Artificial Sequence
  chemically synthesized
aggacagtagtagacatgct

SEQ ID NO: 438466 - DNA, 20 bp, Artificial Sequence
  chemically synthesized
agtagtagacatgctcagct

SEQ ID NO: 438467 - DNA, 20 bp, Artificial Sequence
  chemically synthesized
catatttctggcactgagct

SEQ ID NO: 438468 - DNA, 20 bp, Artificial Sequence
  chemically synthesized
agacatgctcagctcagtgc

SEQ ID NO: 438469 - DNA, 20 bp, Artificial Sequence
  chemically synthesized
cctaccatatttctggcact

SEQ ID NO: 438470 - DNA, 20 bp, Artificial Sequence
  chemically synthesized
tcagctcagtgccagaaata

SEQ ID NO: 438471 - DNA, 20 bp, Artificial Sequence
  chemically synthesized
ttgagagcctaccatatttc

SEQ ID NO: 438472 - DNA, 20 bp, Artificial Sequence
  chemically synthesized
gctcagtgccagaaatatgg

SEQ ID NO: 438473 - DNA, 20 bp, Artificial Sequence
  chemically synthesized
ctcagtgccagaaatatggt

SEQ ID NO: 438474 - DNA, 20 bp, Artificial Sequence
  chemically synthesized
atttaactagtattaattga

SEQ ID NO: 438475 - DNA, 20 bp, Artificial Sequence
  chemically synthesized
ttatttaactagtattaatt

SEQ ID NO: 438476 - DNA, 20 bp, Artificial Sequence
  chemically synthesized
ggtaggctctcaattaatac

SEQ ID NO: 438477 - DNA, 20 bp, Artificial Sequence
  chemically synthesized
caagccaatatttatttaac

SEQ ID NO: 438478 - DNA, 20 bp, Artificial Sequence
  chemically synthesized
aatactagttaaataaatat

SEQ ID NO: 438479 - DNA, 20 bp, Artificial Sequence
  chemically synthesized
taaataaatattggcttgtc

SEQ ID NO: 438480 - DNA, 20 bp, Artificial Sequence
  chemically synthesized
aaataaatattggcttgtcc

SEQ ID NO: 438481 - DNA, 20 bp, Artificial Sequence
  chemically synthesized
aaaggcaagtaatcctggac

SEQ ID NO: 438482 - DNA, 20 bp, Artificial Sequence
  chemically synthesized
cctacaaaggcaagtaatcc

SEQ ID NO: 438483 - DNA, 20 bp, Artificial Sequence
  chemically synthesized
tccaggattacttgcctttg

SEQ ID NO: 438484 - DNA, 20 bp, Artificial Sequence
  chemically synthesized
ttgcctctacctacaaaggc

SEQ ID NO: 438485 - DNA, 20 bp, Artificial Sequence
  chemically synthesized
ccaggattacttgcctttgt

SEQ ID NO: 438486 - DNA, 20 bp, Artificial Sequence
  chemically synthesized
ggattacttgcctttgtagg

SEQ ID NO: 438487 - DNA, 20 bp, Artificial Sequence
  chemically synthesized
aaacttgcctctacctacaa

SEQ ID NO: 438488 - DNA, 20 bp, Artificial Sequence
  chemically synthesized
taaacttgcctctacctaca

SEQ ID NO: 438489 - DNA, 20 bp, Artificial Sequence
  chemically synthesized
attacttgcctttgtaggta

SEQ ID NO: 438490 - DNA, 20 bp, Artificial Sequence
  chemically synthesized
ttacttgcctttgtaggtag

SEQ ID NO: 438491 - DNA, 20 bp, Artificial Sequence
  chemically synthesized
ttgcctttgtaggtagaggc

SEQ ID NO: 438492 - DNA, 20 bp, Artificial Sequence
  chemically synthesized
gtagaggcaagtttaaaacc

SEQ ID NO: 438493 - DNA, 20 bp, Artificial Sequence
  chemically synthesized
tagaggcaagtttaaaaccc

SEQ ID NO: 438494 - DNA, 20 bp, Artificial Sequence
  chemically synthesized
aggcaagtttaaaacccagg

SEQ ID NO: 438495 - DNA, 20 bp, Artificial Sequence
  chemically synthesized
gacaatgcctgagactacct

SEQ ID NO: 438496 - DNA, 20 bp, Artificial Sequence
  chemically synthesized
tgacaatgcctgagactacc

SEQ ID NO: 438497 - DNA, 20 bp, Artificial Sequence
  chemically synthesized
gtttaaaacccaggtagtct

SEQ ID NO: 438498 - DNA, 20 bp, Artificial Sequence
  chemically synthesized
tttaaaacccaggtagtctc

SEQ ID NO: 438499 - DNA, 20 bp, Artificial Sequence
  chemically synthesized
atggtaacttgacaatgcct

SEQ ID NO: 438500 - DNA, 20 bp, Artificial Sequence
  chemically synthesized
aggtagtctcaggcattgtc

SEQ ID NO: 438501 - DNA, 20 bp, Artificial Sequence
  chemically synthesized
ttgtcaagttaccatgcccg

SEQ ID NO: 438502 - DNA, 20 bp, Artificial Sequence
  chemically synthesized
gttatgctggtccacgggca

SEQ ID NO: 438503 - DNA, 20 bp, Artificial Sequence
  chemically synthesized
aagttaccatgcccgtggac

SEQ ID NO: 438504 - DNA, 20 bp, Artificial Sequence
  chemically synthesized
tagaagttatgctggtccac

SEQ ID NO: 438505 - DNA, 20 bp, Artificial Sequence
  chemically synthesized
ctagaagttatgctggtcca

SEQ ID NO: 438506 - DNA, 20 bp, Artificial Sequence
  chemically synthesized
acaagcgctagaagttatgc

SEQ ID NO: 438507 - DNA, 20 bp, Artificial Sequence
  chemically synthesized
ccgtggaccagcataacttc

SEQ ID NO: 438508 - DNA, 20 bp, Artificial Sequence
  chemically synthesized
ccctatatgacaagcgctag

SEQ ID NO: 438509 - DNA, 20 bp, Artificial Sequence
  chemically synthesized
aaaccctatatgacaagcgc

SEQ ID NO: 438510 - DNA, 20 bp, Artificial Sequence
  chemically synthesized
aacttctagcgcttgtcata

SEQ ID NO: 438511 - DNA, 20 bp, Artificial Sequence
  chemically synthesized
acttctagcgcttgtcatat

SEQ ID NO: 438512 - DNA, 20 bp, Artificial Sequence
  chemically synthesized
gaccaaaaaccctatatgac

SEQ ID NO: 438513 - DNA, 20 bp, Artificial Sequence
  chemically synthesized
cttctagcgcttgtcatata

SEQ ID NO: 438514 - DNA, 20 bp, Artificial Sequence
  chemically synthesized
cgcttgtcatatagggtttt

SEQ ID NO: 438515 - DNA, 20 bp, Artificial Sequence
  chemically synthesized
tttgtaaggtgttgtgtttc

SEQ ID NO: 438516 - DNA, 20 bp, Artificial Sequence
  chemically synthesized
ctttgtaaggtgttgtgttt

SEQ ID NO: 438517 - DNA, 20 bp, Artificial Sequence
  chemically synthesized
ctgaaacacaacaccttaca

SEQ ID NO: 438518 - DNA, 20 bp, Artificial Sequence
  chemically synthesized
aaacacaacaccttacaaag

SEQ ID NO: 438519 - DNA, 20 bp, Artificial Sequence
  chemically synthesized
tctatatgtcctactttgta

SEQ ID NO: 438520 - DNA, 20 bp, Artificial Sequence
  chemically synthesized
aacacaacaccttacaaagt

SEQ ID NO: 438521 - DNA, 20 bp, Artificial Sequence
  chemically synthesized
ttctatatgtcctactttgt

SEQ ID NO: 438522 - DNA, 20 bp, Artificial Sequence
  chemically synthesized
accttacaaagtaggacata

SEQ ID NO: 438523 - DNA, 20 bp, Artificial Sequence
  chemically synthesized
aaagtaggacatatagaata

SEQ ID NO: 438524 - DNA, 20 bp, Artificial Sequence
  chemically synthesized
ataaaatatcatgatgatgg

SEQ ID NO: 438525 - DNA, 20 bp, Artificial Sequence
  chemically synthesized
aataaaatatcatgatgatg

SEQ ID NO: 438526 - DNA, 20 bp, Artificial Sequence
  chemically synthesized
tgaataaaatatcatgatga

SEQ ID NO: 438527 - DNA, 20 bp, Artificial Sequence
  chemically synthesized
atcatgatattttattcaat

SEQ ID NO: 438528 - DNA, 20 bp, Artificial Sequence
  chemically synthesized
tgatgcacgttcccatataa

SEQ ID NO: 438529 - DNA, 20 bp, Artificial Sequence
  chemically synthesized
gcaatccatttctattatat

SEQ ID NO: 438530 - DNA, 20 bp, Artificial Sequence
  chemically synthesized
tgcaatccatttctattata

SEQ ID NO: 438531 - DNA, 20 bp, Artificial Sequence
  chemically synthesized
acgttcccatataatagaaa

SEQ ID NO: 438532 - DNA, 20 bp, Artificial Sequence
  chemically synthesized
aatagaaatggattgcattc

SEQ ID NO: 438533 - DNA, 20 bp, Artificial Sequence
  chemically synthesized
agaaatggattgcattctag

SEQ ID NO: 438534 - DNA, 20 bp, Artificial Sequence
  chemically synthesized
tggattgcattctagcagat

SEQ ID NO: 438535 - DNA, 20 bp, Artificial Sequence
  chemically synthesized
atggtttaatgctaatctgc

SEQ ID NO: 438536 - DNA, 20 bp, Artificial Sequence
  chemically synthesized
atcactcaaggtacaaagga

SEQ ID NO: 438537 - DNA, 20 bp, Artificial Sequence
  chemically synthesized
gtctatcactcaaggtacaa

SEQ ID NO: 438538 - DNA, 20 bp, Artificial Sequence
  chemically synthesized
agtctatcactcaaggtaca

SEQ ID NO: 438539 - DNA, 20 bp, Artificial Sequence
  chemically synthesized
taaaccatcctttgtacctt

SEQ ID NO: 438540 - DNA, 20 bp, Artificial Sequence
  chemically synthesized
atcctttgtaccttgagtga

SEQ ID NO: 438541 - DNA, 20 bp, Artificial Sequence
  chemically synthesized
attaataagtctatcactca

SEQ ID NO: 438542 - DNA, 20 bp, Artificial Sequence
  chemically synthesized
aattaataagtctatcactc

SEQ ID NO: 438543 - DNA, 20 bp, Artificial Sequence
  chemically synthesized
gataagtcttgtaaattaat

SEQ ID NO: 438544 - DNA, 20 bp, Artificial Sequence
  chemically synthesized
tgatagacttattaatttac

SEQ ID NO: 438545 - DNA, 20 bp, Artificial Sequence
  chemically synthesized
caccaaacctaatcgaggat

SEQ ID NO: 438546 - DNA, 20 bp, Artificial Sequence
  chemically synthesized
ttacaagacttatcctcgat

SEQ ID NO: 438547 - DNA, 20 bp, Artificial Sequence
  chemically synthesized
tacaagacttatcctcgatt

SEQ ID NO: 438548 - DNA, 20 bp, Artificial Sequence
  chemically synthesized
atcatcaccaaacctaatcg

SEQ ID NO: 438549 - DNA, 20 bp, Artificial Sequence
  chemically synthesized
tatcatcaccaaacctaatc

SEQ ID NO: 438550 - DNA, 20 bp, Artificial Sequence
  chemically synthesized
gacttatcctcgattaggtt

SEQ ID NO: 438551 - DNA, 20 bp, Artificial Sequence
  chemically synthesized
taggtttggtgatgataccc

SEQ ID NO: 438552 - DNA, 20 bp, Artificial Sequence
  chemically synthesized
ggtgatgataccctagcctt

SEQ ID NO: 438553 - DNA, 20 bp, Artificial Sequence
  chemically synthesized
tcttggttttctgaaggcta

SEQ ID NO: 438554 - DNA, 20 bp, Artificial Sequence
  chemically synthesized
ctcttggttttctgaaggct

SEQ ID NO: 438555 - DNA, 20 bp, Artificial Sequence
  chemically synthesized
gctcttggttttctgaaggc

SEQ ID NO: 438556 - DNA, 20 bp, Artificial Sequence
  chemically synthesized
ataagctcttggttttctga

SEQ ID NO: 438557 - DNA, 20 bp, Artificial Sequence
  chemically synthesized
aataagctcttggttttctg

SEQ ID NO: 438558 - DNA, 20 bp, Artificial Sequence
  chemically synthesized
accctagccttcagaaaacc

SEQ ID NO: 438559 - DNA, 20 bp, Artificial Sequence
  chemically synthesized
cctagccttcagaaaaccaa

SEQ ID NO: 438560 - DNA, 20 bp, Artificial Sequence
  chemically synthesized
ttagacctttaataagctct

SEQ ID NO: 438561 - DNA, 20 bp, Artificial Sequence
  chemically synthesized
agaaaaccaagagcttatta

SEQ ID NO: 438562 - DNA, 20 bp, Artificial Sequence
  chemically synthesized
gaaaaccaagagcttattaa

SEQ ID NO: 438563 - DNA, 20 bp, Artificial Sequence
  chemically synthesized
tacagcattagacctttaat

SEQ ID NO: 438564 - DNA, 20 bp, Artificial Sequence
  chemically synthesized
aaatttgaaaaatacagcat

SEQ ID NO: 438565 - DNA, 20 bp, Artificial Sequence
  chemically synthesized
aaataaaaatttgaaaaata

SEQ ID NO: 438566 - DNA, 20 bp, Artificial Sequence
  chemically synthesized
tttttattttgcaatcatta

SEQ ID NO: 438567 - DNA, 20 bp, Artificial Sequence
  chemically synthesized
ttgcaatcattatagactca

SEQ ID NO: 438568 - DNA, 20 bp, Artificial Sequence
  chemically synthesized
tgcaatcattatagactcac

SEQ ID NO: 438569 - DNA, 20 bp, Artificial Sequence
  chemically synthesized
aatcattatagactcacagg

SEQ ID NO: 438570 - DNA, 20 bp, Artificial Sequence
  chemically synthesized
atttctttgcgacttcctgt

SEQ ID NO: 438571 - DNA, 20 bp, Artificial Sequence
  chemically synthesized
tagactcacaggaagtcgca

SEQ ID NO: 438572 - DNA, 20 bp, Artificial Sequence
  chemically synthesized
aggtaaagtgaagtttgcac

SEQ ID NO: 438573 - DNA, 20 bp, Artificial Sequence
  chemically synthesized
acattgggagaggtaaagtg

SEQ ID NO: 438574 - DNA, 20 bp, Artificial Sequence
  chemically synthesized
tatcaacattgggagaggta

SEQ ID NO: 438575 - DNA, 20 bp, Artificial Sequence
  chemically synthesized
catggtatcaacattgggag

SEQ ID NO: 438576 - DNA, 20 bp, Artificial Sequence
  chemically synthesized
acatggtatcaacattggga

SEQ ID NO: 438577 - DNA, 20 bp, Artificial Sequence
  chemically synthesized
atacatggtatcaacattgg

SEQ ID NO: 438578 - DNA, 20 bp, Artificial Sequence
  chemically synthesized
ttatacatggtatcaacatt

SEQ ID NO: 438579 - DNA, 20 bp, Artificial Sequence
  chemically synthesized
gttatacatggtatcaacat

SEQ ID NO: 438580 - DNA, 20 bp, Artificial Sequence
  chemically synthesized
tattgtactatagttataca

SEQ ID NO: 438581 - DNA, 20 bp, Artificial Sequence
  chemically synthesized
gttgataccatgtataacta

SEQ ID NO: 438582 - DNA, 20 bp, Artificial Sequence
  chemically synthesized
ccagtttttatattgtacta

SEQ ID NO: 438583 - DNA, 20 bp, Artificial Sequence
  chemically synthesized
ctatagtacaatataaaaac

SEQ ID NO: 438584 - DNA, 20 bp, Artificial Sequence
  chemically synthesized
tatagtacaatataaaaact

SEQ ID NO: 438585 - DNA, 20 bp, Artificial Sequence
  chemically synthesized
gaattatagcaataatttcc

SEQ ID NO: 438586 - DNA, 20 bp, Artificial Sequence
  chemically synthesized
gaaattattgctataattca

SEQ ID NO: 438587 - DNA, 20 bp, Artificial Sequence
  chemically synthesized
cgaataagctctatgaatta

SEQ ID NO: 438588 - DNA, 20 bp, Artificial Sequence
  chemically synthesized
aattattgctataattcata

SEQ ID NO: 438589 - DNA, 20 bp, Artificial Sequence
  chemically synthesized
tataattcatagagcttatt

SEQ ID NO: 438590 - DNA, 20 bp, Artificial Sequence
  chemically synthesized
ataattcatagagcttattc

SEQ ID NO: 438591 - DNA, 20 bp, Artificial Sequence
  chemically synthesized
ctatctggtaaagcccgaat

SEQ ID NO: 438592 - DNA, 20 bp, Artificial Sequence
  chemically synthesized
agagcttattcgggctttac

SEQ ID NO: 438593 - DNA, 20 bp, Artificial Sequence
  chemically synthesized
cttattcgggctttaccaga

SEQ ID NO: 438594 - DNA, 20 bp, Artificial Sequence
  chemically synthesized
gcatacttgtctatctggta

SEQ ID NO: 438595 - DNA, 20 bp, Artificial Sequence
  chemically synthesized
tcgggctttaccagatagac

SEQ ID NO: 438596 - DNA, 20 bp, Artificial Sequence
  chemically synthesized
caagtgcatacttgtctatc

SEQ ID NO: 438597 - DNA, 20 bp, Artificial Sequence
  chemically synthesized
cacacacaccagagtcacac

SEQ ID NO: 438598 - DNA, 20 bp, Artificial Sequence
  chemically synthesized
agtatgcacttgtgtgactc

SEQ ID NO: 438599 - DNA, 20 bp, Artificial Sequence
  chemically synthesized
acacacacacacacacacca

SEQ ID NO: 438600 - DNA, 20 bp, Artificial Sequence
  chemically synthesized
aaacacacacacacacacac

SEQ ID NO: 438601 - DNA, 20 bp, Artificial Sequence
  chemically synthesized
tgtgtgtgtgtttgtgtgtg

SEQ ID NO: 438602 - DNA, 20 bp, Artificial Sequence
  chemically synthesized
acacttgataatgtcgaata

SEQ ID NO: 438603 - DNA, 20 bp, Artificial Sequence
  chemically synthesized
ctacacttgataatgtcgaa

SEQ ID NO: 438604 - DNA, 20 bp, Artificial Sequence
  chemically synthesized
aagctctattcgacattatc

SEQ ID NO: 438605 - DNA, 20 bp, Artificial Sequence
  chemically synthesized
ctattcgacattatcaagtg

SEQ ID NO: 438606 - DNA, 20 bp, Artificial Sequence
  chemically synthesized
attgtggtgtttgttacaca

SEQ ID NO: 438607 - DNA, 20 bp, Artificial Sequence
  chemically synthesized
cctgctcaatattttgattg

SEQ ID NO: 438608 - DNA, 20 bp, Artificial Sequence
  chemically synthesized
aacaccacaatcaaaatatt

SEQ ID NO: 438609 - DNA, 20 bp, Artificial Sequence
  chemically synthesized
accacaatcaaaatattgag

SEQ ID NO: 438610 - DNA, 20 bp, Artificial Sequence
  chemically synthesized
ccacaatcaaaatattgagc

SEQ ID NO: 438611 - DNA, 20 bp, Artificial Sequence
  chemically synthesized
ttgagcaggtccatcaccac

SEQ ID NO: 438612 - DNA, 20 bp, Artificial Sequence
  chemically synthesized
acaatggagccttgtggtga

SEQ ID NO: 438613 - DNA, 20 bp, Artificial Sequence
  chemically synthesized
tgagcaggtccatcaccaca

SEQ ID NO: 438614 - DNA, 20 bp, Artificial Sequence
  chemically synthesized
ggtgccacaatggagccttg

SEQ ID NO: 438615 - DNA, 20 bp, Artificial Sequence
  chemically synthesized
atcaccacaaggctccattg

SEQ ID NO: 438616 - DNA, 20 bp, Artificial Sequence
  chemically synthesized
tatataatggtgccacaatg

SEQ ID NO: 438617 - DNA, 20 bp, Artificial Sequence
  chemically synthesized
gctatataatggtgccacaa

SEQ ID NO: 438618 - DNA, 20 bp, Artificial Sequence
  chemically synthesized
tccattgtggcaccattata

SEQ ID NO: 438619 - DNA, 20 bp, Artificial Sequence
  chemically synthesized
gcagagggtatgctatataa

SEQ ID NO: 438620 - DNA, 20 bp, Artificial Sequence
  chemically synthesized
gaggtcaggaataaggcaga

SEQ ID NO: 438621 - DNA, 20 bp, Artificial Sequence
  chemically synthesized
agaggtcaggaataaggcag

SEQ ID NO: 438622 - DNA, 20 bp, Artificial Sequence
  chemically synthesized
cagaggtcaggaataaggca

SEQ ID NO: 438623 - DNA, 20 bp, Artificial Sequence
  chemically synthesized
gccagaggtcaggaataagg

SEQ ID NO: 438624 - DNA, 20 bp, Artificial Sequence
  chemically synthesized
gttgccagaggtcaggaata

SEQ ID NO: 438625 - DNA, 20 bp, Artificial Sequence
  chemically synthesized
ggttgccagaggtcaggaat

SEQ ID NO: 438626 - DNA, 20 bp, Artificial Sequence
  chemically synthesized
tctgccttattcctgacctc

SEQ ID NO: 438627 - DNA, 20 bp, Artificial Sequence
  chemically synthesized
gatattggttgccagaggtc

SEQ ID NO: 438628 - DNA, 20 bp, Artificial Sequence
  chemically synthesized
agatattggttgccagaggt

SEQ ID NO: 438629 - DNA, 20 bp, Artificial Sequence
  chemically synthesized
gaacagatattggttgccag

SEQ ID NO: 438630 - DNA, 20 bp, Artificial Sequence
  chemically synthesized
agaacagatattggttgcca

SEQ ID NO: 438631 - DNA, 20 bp, Artificial Sequence
  chemically synthesized
taagaacagatattggttgc

SEQ ID NO: 438632 - DNA, 20 bp, Artificial Sequence
  chemically synthesized
ttgatattaagaacagatat

SEQ ID NO: 438633 - DNA, 20 bp, Artificial Sequence
  chemically synthesized
acagatattgatattaagaa

SEQ ID NO: 438634 - DNA, 20 bp, Artificial Sequence
  chemically synthesized
taagaacagatattgatatt

SEQ ID NO: 438635 - DNA, 20 bp, Artificial Sequence
  chemically synthesized
ataattatagatattaagaa

SEQ ID NO: 438636 - DNA, 20 bp, Artificial Sequence
  chemically synthesized
gaaatataattatagatatt

SEQ ID NO: 438637 - DNA, 20 bp, Artificial Sequence
  chemically synthesized
acattactgaaatataatta

SEQ ID NO: 438638 - DNA, 20 bp, Artificial Sequence
  chemically synthesized
taatatctataattatattt

SEQ ID NO: 438639 - DNA, 20 bp, Artificial Sequence
  chemically synthesized
atttcagtaatgttatatac

SEQ ID NO: 438640 - DNA, 20 bp, Artificial Sequence
  chemically synthesized
gttatatacaagaaataaca

SEQ ID NO: 438641 - DNA, 20 bp, Artificial Sequence
  chemically synthesized
attgagcaaaaaaaagtcaa

SEQ ID NO: 438642 - DNA, 20 bp, Artificial Sequence
  chemically synthesized
tattgagcaaaaaaaagtca

SEQ ID NO: 438643 - DNA, 20 bp, Artificial Sequence
  chemically synthesized
gcaccatattgagcaaaaaa

SEQ ID NO: 438644 - DNA, 20 bp, Artificial Sequence
  chemically synthesized
tgacttttttttgctcaata

SEQ ID NO: 438645 - DNA, 20 bp, Artificial Sequence
  chemically synthesized
gatgtcaagagcaccatatt

SEQ ID NO: 438646 - DNA, 20 bp, Artificial Sequence
  chemically synthesized
acaactccaatggatgtcaa

SEQ ID NO: 438647 - DNA, 20 bp, Artificial Sequence
  chemically synthesized
tcacaactccaatggatgtc

SEQ ID NO: 438648 - DNA, 20 bp, Artificial Sequence
  chemically synthesized
atggtgctcttgacatccat

SEQ ID NO: 438649 - DNA, 20 bp, Artificial Sequence
  chemically synthesized
ggtgctcttgacatccattg

SEQ ID NO: 438650 - DNA, 20 bp, Artificial Sequence
  chemically synthesized
ctcaatattcacaactccaa

SEQ ID NO: 438651 - DNA, 20 bp, Artificial Sequence
  chemically synthesized
ccattggagttgtgaatatt

SEQ ID NO: 438652 - DNA, 20 bp, Artificial Sequence
  chemically synthesized
gagttgtgaatattgagtat

SEQ ID NO: 438653 - DNA, 20 bp, Artificial Sequence
  chemically synthesized
ttgtgaatattgagtatcag

SEQ ID NO: 438654 - DNA, 20 bp, Artificial Sequence
  chemically synthesized
aatactacacaacaatttaa

SEQ ID NO: 438655 - DNA, 20 bp, Artificial Sequence
  chemically synthesized
aaatactacacaacaattta

SEQ ID NO: 438656 - DNA, 20 bp, Artificial Sequence
  chemically synthesized
cattcctttaaattgttgtg

SEQ ID NO: 438657 - DNA, 20 bp, Artificial Sequence
  chemically synthesized
ttaaattgttgtgtagtatt

SEQ ID NO: 438658 - DNA, 20 bp, Artificial Sequence
  chemically synthesized
aattgttgtgtagtatttag

SEQ ID NO: 438659 - DNA, 20 bp, Artificial Sequence
  chemically synthesized
tgtgtagtatttagtggtat

SEQ ID NO: 438660 - DNA, 20 bp, Artificial Sequence
  chemically synthesized
ttagtggtatgagtatataa

SEQ ID NO: 438661 - DNA, 20 bp, Artificial Sequence
  chemically synthesized
gtatataacagtttgtttaa

SEQ ID NO: 438662 - DNA, 20 bp, Artificial Sequence
  chemically synthesized
gtttaacagtcactcattga

SEQ ID NO: 438663 - DNA, 20 bp, Artificial Sequence
  chemically synthesized
cagctcaagtatccatcaat

SEQ ID NO: 438664 - DNA, 20 bp, Artificial Sequence
  chemically synthesized
tcactcattgatggatactt

SEQ ID NO: 438665 - DNA, 20 bp, Artificial Sequence
  chemically synthesized
ctagaaacaagaaacagctc

SEQ ID NO: 438666 - DNA, 20 bp, Artificial Sequence
  chemically synthesized
cagtagctagaaacaagaaa

SEQ ID NO: 438667 - DNA, 20 bp, Artificial Sequence
  chemically synthesized
cttgagctgtttcttgtttc

SEQ ID NO: 438668 - DNA, 20 bp, Artificial Sequence
  chemically synthesized
tgaatgcagtagctagaaac

SEQ ID NO: 438669 - DNA, 20 bp, Artificial Sequence
  chemically synthesized
cttgacatgaatgcagtagc

SEQ ID NO: 438670 - DNA, 20 bp, Artificial Sequence
  chemically synthesized
aaaccttgacatgaatgcag

SEQ ID NO: 438671 - DNA, 20 bp, Artificial Sequence
  chemically synthesized
caaaaaccttgacatgaatg

SEQ ID NO: 438672 - DNA, 20 bp, Artificial Sequence
  chemically synthesized
ctagctactgcattcatgtc

SEQ ID NO: 438673 - DNA, 20 bp, Artificial Sequence
  chemically synthesized
tagctactgcattcatgtca

SEQ ID NO: 438674 - DNA, 20 bp, Artificial Sequence
  chemically synthesized
tgcattcatgtcaaggtttt

SEQ ID NO: 438675 - DNA, 20 bp, Artificial Sequence
  chemically synthesized
gcattcatgtcaaggttttt

SEQ ID NO: 438676 - DNA, 20 bp, Artificial Sequence
  chemically synthesized
gaacataaacatcaattttc

SEQ ID NO: 438677 - DNA, 20 bp, Artificial Sequence
  chemically synthesized
aacataaacatcaattttct

SEQ ID NO: 438678 - DNA, 20 bp, Artificial Sequence
  chemically synthesized
tgtactcttgatatttatcc

SEQ ID NO: 438679 - DNA, 20 bp, Artificial Sequence
  chemically synthesized
aattttctgggataaatatc

SEQ ID NO: 438680 - DNA, 20 bp, Artificial Sequence
  chemically synthesized
ttttctgggataaatatcaa

SEQ ID NO: 438681 - DNA, 20 bp, Artificial Sequence
  chemically synthesized
aatatcaagagtacaattgc

SEQ ID NO: 438682 - DNA, 20 bp, Artificial Sequence
  chemically synthesized
atatcaagagtacaattgct

SEQ ID NO: 438683 - DNA, 20 bp, Artificial Sequence
  chemically synthesized
agtacaattgctgggctgta

SEQ ID NO: 438684 - DNA, 20 bp, Artificial Sequence
  chemically synthesized
catgcagtcaccatacagcc

SEQ ID NO: 438685 - DNA, 20 bp, Artificial Sequence
  chemically synthesized
ttaaacatgcagtcaccata

SEQ ID NO: 438686 - DNA, 20 bp, Artificial Sequence
  chemically synthesized
ttcttctaaaattaaacatg

SEQ ID NO: 438687 - DNA, 20 bp, Artificial Sequence
  chemically synthesized
ggtgactgcatgtttaattt

SEQ ID NO: 438688 - DNA, 20 bp, Artificial Sequence
  chemically synthesized
gactgcatgtttaattttag

SEQ ID NO: 438689 - DNA, 20 bp, Artificial Sequence
  chemically synthesized
cattctagaaaacagtttag

SEQ ID NO: 438690 - DNA, 20 bp, Artificial Sequence
  chemically synthesized
accattctagaaaacagttt

SEQ ID NO: 438691 - DNA, 20 bp, Artificial Sequence
  chemically synthesized
aaccattctagaaaacagtt

SEQ ID NO: 438692 - DNA, 20 bp, Artificial Sequence
  chemically synthesized
gaaactcctaaactgttttc

SEQ ID NO: 438693 - DNA, 20 bp, Artificial Sequence
  chemically synthesized
ggtacaaccattctagaaaa

SEQ ID NO: 438694 - DNA, 20 bp, Artificial Sequence
  chemically synthesized
tcctaaactgttttctagaa

SEQ ID NO: 438695 - DNA, 20 bp, Artificial Sequence
  chemically synthesized
gtaaaatggtacaaccattc

SEQ ID NO: 438696 - DNA, 20 bp, Artificial Sequence
  chemically synthesized
ttgctgatgggaatgtaaaa

SEQ ID NO: 438697 - DNA, 20 bp, Artificial Sequence
  chemically synthesized
gtaccattttacattcccat

SEQ ID NO: 438698 - DNA, 20 bp, Artificial Sequence
  chemically synthesized
gtctttctaatattgctgat

SEQ ID NO: 438699 - DNA, 20 bp, Artificial Sequence
  chemically synthesized
ggtctttctaatattgctga

SEQ ID NO: 438700 - DNA, 20 bp, Artificial Sequence
  chemically synthesized
tacattcccatcagcaatat

SEQ ID NO: 438701 - DNA, 20 bp, Artificial Sequence
  chemically synthesized
ttcccatcagcaatattaga

SEQ ID NO: 438702 - DNA, 20 bp, Artificial Sequence
  chemically synthesized
tcagcaatattagaaagacc

SEQ ID NO: 438703 - DNA, 20 bp, Artificial Sequence
  chemically synthesized
aacagggatgcaaaggaact

SEQ ID NO: 438704 - DNA, 20 bp, Artificial Sequence
  chemically synthesized
taacagggatgcaaaggaac

SEQ ID NO: 438705 - DNA, 20 bp, Artificial Sequence
  chemically synthesized
gaaagctaacagggatgcaa

SEQ ID NO: 438706 - DNA, 20 bp, Artificial Sequence
  chemically synthesized
tgaaagctaacagggatgca

SEQ ID NO: 438707 - DNA, 20 bp, Artificial Sequence
  chemically synthesized
cagttcctttgcatccctgt

SEQ ID NO: 438708 - DNA, 20 bp, Artificial Sequence
  chemically synthesized
gacaacactgaaagctaaca

SEQ ID NO: 438709 - DNA, 20 bp, Artificial Sequence
  chemically synthesized
tgacaacactgaaagctaac

SEQ ID NO: 438710 - DNA, 20 bp, Artificial Sequence
  chemically synthesized
gtgacaacactgaaagctaa

SEQ ID NO: 438711 - DNA, 20 bp, Artificial Sequence
  chemically synthesized
tttgcatccctgttagcttt

SEQ ID NO: 438712 - DNA, 20 bp, Artificial Sequence
  chemically synthesized
aaaaacagtgacaacactga

SEQ ID NO: 438713 - DNA, 20 bp, Artificial Sequence
  chemically synthesized
taaaattaaaaaaagaaaaa

SEQ ID NO: 438714 - DNA, 20 bp, Artificial Sequence
  chemically synthesized
agaatggctaaaattaaaaa

SEQ ID NO: 438715 - DNA, 20 bp, Artificial Sequence
  chemically synthesized
tgtttttctttttttaattt

SEQ ID NO: 438716 - DNA, 20 bp, Artificial Sequence
  chemically synthesized
tttaattttagccattctga

SEQ ID NO: 438717 - DNA, 20 bp, Artificial Sequence
  chemically synthesized
ttaattttagccattctgat

SEQ ID NO: 438718 - DNA, 20 bp, Artificial Sequence
  chemically synthesized
tcactatacacctatcagaa

SEQ ID NO: 438719 - DNA, 20 bp, Artificial Sequence
  chemically synthesized
agttatcactatacacctat

SEQ ID NO: 438720 - DNA, 20 bp, Artificial Sequence
  chemically synthesized
tagccattctgataggtgta

SEQ ID NO: 438721 - DNA, 20 bp, Artificial Sequence
  chemically synthesized
tgtatagtgataactcattg

SEQ ID NO: 438722 - DNA, 20 bp, Artificial Sequence
  chemically synthesized
atgcaaattaacactacaat

SEQ ID NO: 438723 - DNA, 20 bp, Artificial Sequence
  chemically synthesized
gttaatttgcatttctttaa

SEQ ID NO: 438724 - DNA, 20 bp, Artificial Sequence
  chemically synthesized
atttgcatttctttaatggc

SEQ ID NO: 438725 - DNA, 20 bp, Artificial Sequence
  chemically synthesized
ttcagcttcactagccatta

SEQ ID NO: 438726 - DNA, 20 bp, Artificial Sequence
  chemically synthesized
catttctttaatggctagtg

SEQ ID NO: 438727 - DNA, 20 bp, Artificial Sequence
  chemically synthesized
aaaaagatgttcagcttcac

SEQ ID NO: 438728 - DNA, 20 bp, Artificial Sequence
  chemically synthesized
gaaatgcataaaaagatgtt

SEQ ID NO: 438729 - DNA, 20 bp, Artificial Sequence
  chemically synthesized
atggtaaagaaatgcataaa

SEQ ID NO: 438730 - DNA, 20 bp, Artificial Sequence
  chemically synthesized
aagaggatatacagatggta

SEQ ID NO: 438731 - DNA, 20 bp, Artificial Sequence
  chemically synthesized
cactgaagaggatatacaga

SEQ ID NO: 438732 - DNA, 20 bp, Artificial Sequence
  chemically synthesized
atttcactgaagaggatata

SEQ ID NO: 438733 - DNA, 20 bp, Artificial Sequence
  chemically synthesized
taccatctgtatatcctctt

SEQ ID NO: 438734 - DNA, 20 bp, Artificial Sequence
  chemically synthesized
taatagacatttcactgaag

SEQ ID NO: 438735 - DNA, 20 bp, Artificial Sequence
  chemically synthesized
ttaatagacatttcactgaa

SEQ ID NO: 438736 - DNA, 20 bp, Artificial Sequence
  chemically synthesized
ccttaatagacatttcactg

SEQ ID NO: 438737 - DNA, 20 bp, Artificial Sequence
  chemically synthesized
tcttcagtgaaatgtctatt

SEQ ID NO: 438738 - DNA, 20 bp, Artificial Sequence
  chemically synthesized
cttcagtgaaatgtctatta

SEQ ID NO: 438739 - DNA, 20 bp, Artificial Sequence
  chemically synthesized
aaatgtgggaaaagccttaa

SEQ ID NO: 438740 - DNA, 20 bp, Artificial Sequence
  chemically synthesized
agtggaaaaaaatgtgggaa

SEQ ID NO: 438741 - DNA, 20 bp, Artificial Sequence
  chemically synthesized
aatctagtggaaaaaaatgt

SEQ ID NO: 438742 - DNA, 20 bp, Artificial Sequence
  chemically synthesized
taatctagtggaaaaaaatg

SEQ ID NO: 438743 - DNA, 20 bp, Artificial Sequence
  chemically synthesized
tttcccacatttttttccac

SEQ ID NO: 438744 - DNA, 20 bp, Artificial Sequence
  chemically synthesized
taaaaccacaaataatctag

SEQ ID NO: 438745 - DNA, 20 bp, Artificial Sequence
  chemically synthesized
cactaaaaccacaaataatc

SEQ ID NO: 438746 - DNA, 20 bp, Artificial Sequence
  chemically synthesized
tttttccactagattatttg

SEQ ID NO: 438747 - DNA, 20 bp, Artificial Sequence
  chemically synthesized
cactagattatttgtggttt

SEQ ID NO: 438748 - DNA, 20 bp, Artificial Sequence
  chemically synthesized
ttatttgtggttttagtgct

SEQ ID NO: 438749 - DNA, 20 bp, Artificial Sequence
  chemically synthesized
tggttttagtgctcagtttt

SEQ ID NO: 438750 - DNA, 20 bp, Artificial Sequence
  chemically synthesized
tataaatatcactcaaaact

SEQ ID NO: 438751 - DNA, 20 bp, Artificial Sequence
  chemically synthesized
tgagtgatatttatatattc

SEQ ID NO: 438752 - DNA, 20 bp, Artificial Sequence
  chemically synthesized
tatttatatattctagatac

SEQ ID NO: 438753 - DNA, 20 bp, Artificial Sequence
  chemically synthesized
agtctcaaagaactagtatc

SEQ ID NO: 438754 - DNA, 20 bp, Artificial Sequence
  chemically synthesized
attctagatactagttcttt

SEQ ID NO: 438755 - DNA, 20 bp, Artificial Sequence
  chemically synthesized
tttgtaaagtctcaaagaac

SEQ ID NO: 438756 - DNA, 20 bp, Artificial Sequence
  chemically synthesized
tctatctttgtaaagtctca

SEQ ID NO: 438757 - DNA, 20 bp, Artificial Sequence
  chemically synthesized
tagttctttgagactttaca

SEQ ID NO: 438758 - DNA, 20 bp, Artificial Sequence
  chemically synthesized
ttccttaatctatctttgta

SEQ ID NO: 438759 - DNA, 20 bp, Artificial Sequence
  chemically synthesized
tctttgagactttacaaaga

SEQ ID NO: 438760 - DNA, 20 bp, Artificial Sequence
  chemically synthesized
agactttacaaagatagatt

SEQ ID NO: 438761 - DNA, 20 bp, Artificial Sequence
  chemically synthesized
gactttacaaagatagatta

SEQ ID NO: 438762 - DNA, 20 bp, Artificial Sequence
  chemically synthesized
ttacaaagatagattaagga

SEQ ID NO: 438763 - DNA, 20 bp, Artificial Sequence
  chemically synthesized
agatagattaaggaaagaaa

SEQ ID NO: 438764 - DNA, 20 bp, Artificial Sequence
  chemically synthesized
gatagattaaggaaagaaaa

SEQ ID NO: 438765 - DNA, 20 bp, Artificial Sequence
  chemically synthesized
ttaaggaaagaaaaaggaca

SEQ ID NO: 438766 - DNA, 20 bp, Artificial Sequence
  chemically synthesized
taaggaaagaaaaaggacat

SEQ ID NO: 438767 - DNA, 20 bp, Artificial Sequence
  chemically synthesized
aaaaggacatgggttaaaaa

SEQ ID NO: 438768 - DNA, 20 bp, Artificial Sequence
  chemically synthesized
aaacagtaaaaaacaaaatc

SEQ ID NO: 438769 - DNA, 20 bp, Artificial Sequence
  chemically synthesized
aaaacaaaatcaagaaccac

SEQ ID NO: 438770 - DNA, 20 bp, Artificial Sequence
  chemically synthesized
cccatactgcttttcacttg

SEQ ID NO: 438771 - DNA, 20 bp, Artificial Sequence
  chemically synthesized
aatcaagaaccacaagtgaa

SEQ ID NO: 438772 - DNA, 20 bp, Artificial Sequence
  chemically synthesized
caagaaccacaagtgaaaag

SEQ ID NO: 438773 - DNA, 20 bp, Artificial Sequence
  chemically synthesized
accacaagtgaaaagcagta

SEQ ID NO: 438774 - DNA, 20 bp, Artificial Sequence
  chemically synthesized
ccacaagtgaaaagcagtat

SEQ ID NO: 438775 - DNA, 20 bp, Artificial Sequence
  chemically synthesized
agcagtatgggaaatcaaaa

SEQ ID NO: 438776 - DNA, 20 bp, Artificial Sequence
  chemically synthesized
gcagtatgggaaatcaaaaa

SEQ ID NO: 438777 - DNA, 20 bp, Artificial Sequence
  chemically synthesized
cagtatgggaaatcaaaaaa

SEQ ID NO: 438778 - DNA, 20 bp, Artificial Sequence
  chemically synthesized
tgggaaatcaaaaaagggaa

SEQ ID NO: 438779 - DNA, 20 bp, Artificial Sequence
  chemically synthesized
aagatttgctttttgtcatt

SEQ ID NO: 438780 - DNA, 20 bp, Artificial Sequence
  chemically synthesized
aaagatttgctttttgtcat

SEQ ID NO: 438781 - DNA, 20 bp, Artificial Sequence
  chemically synthesized
gaacagcacccaatgacaaa

SEQ ID NO: 438782 - DNA, 20 bp, Artificial Sequence
  chemically synthesized
tcatatataaatatataata

SEQ ID NO: 438783 - DNA, 20 bp, Artificial Sequence
  chemically synthesized
ttattatatatttatatatg

SEQ ID NO: 438784 - DNA, 20 bp, Artificial Sequence
  chemically synthesized
aagcactttcattttggtta

SEQ ID NO: 438785 - DNA, 20 bp, Artificial Sequence
  chemically synthesized
tgaagctttaaccaaaatga

SEQ ID NO: 438786 - DNA, 20 bp, Artificial Sequence
  chemically synthesized
atgacaaagcactttcattt

SEQ ID NO: 438787 - DNA, 20 bp, Artificial Sequence
  chemically synthesized
tatgaaaattttatatgaca

SEQ ID NO: 438788 - DNA, 20 bp, Artificial Sequence
  chemically synthesized
tgctttaatgaacataatta

SEQ ID NO: 438789 - DNA, 20 bp, Artificial Sequence
  chemically synthesized
atctgtaattatgttcatta

SEQ ID NO: 438790 - DNA, 20 bp, Artificial Sequence
  chemically synthesized
tcattaaagcattacacatc

SEQ ID NO: 438791 - DNA, 20 bp, Artificial Sequence
  chemically synthesized
ccccatatatatttttaaat

SEQ ID NO: 438792 - DNA, 20 bp, Artificial Sequence
  chemically synthesized
aacttatttaaaaatatata

SEQ ID NO: 438793 - DNA, 20 bp, Artificial Sequence
  chemically synthesized
acttatttaaaaatatatat

SEQ ID NO: 438794 - DNA, 20 bp, Artificial Sequence
  chemically synthesized
cttatttaaaaatatatatg

SEQ ID NO: 438795 - DNA, 20 bp, Artificial Sequence
  chemically synthesized
tacctggaaccaaacacatt

SEQ ID NO: 438796 - DNA, 20 bp, Artificial Sequence
  chemically synthesized
atggggaaacctaatgtgtt

SEQ ID NO: 438797 - DNA, 20 bp, Artificial Sequence
  chemically synthesized
ttacctggaaccaaacacat

SEQ ID NO: 438798 - DNA, 20 bp, Artificial Sequence
  chemically synthesized
aaacctaatgtgtttggttc

SEQ ID NO: 438799 - DNA, 20 bp, Artificial Sequence
  chemically synthesized
aacctaatgtgtttggttcc

SEQ ID NO: 438800 - DNA, 20 bp, Artificial Sequence
  chemically synthesized
gtgtttggttccaggtaata

SEQ ID NO: 438801 - DNA, 20 bp, Artificial Sequence
  chemically synthesized
ttgctcaccactttattacc

SEQ ID NO: 438802 - DNA, 20 bp, Artificial Sequence
  chemically synthesized
tttggttccaggtaataaag

SEQ ID NO: 438803 - DNA, 20 bp, Artificial Sequence
  chemically synthesized
gttccaggtaataaagtggt

SEQ ID NO: 438804 - DNA, 20 bp, Artificial Sequence
  chemically synthesized
caggtaataaagtggtgagc

SEQ ID NO: 438805 - DNA, 20 bp, Artificial Sequence
  chemically synthesized
aataaagtggtgagcaagaa

SEQ ID NO: 438806 - DNA, 20 bp, Artificial Sequence
  chemically synthesized
agtggtgagcaagaacagtt

SEQ ID NO: 438807 - DNA, 20 bp, Artificial Sequence
  chemically synthesized
gtggtgagcaagaacagttg

SEQ ID NO: 438808 - DNA, 20 bp, Artificial Sequence
  chemically synthesized
caagaacagttgaggtgtct

SEQ ID NO: 438809 - DNA, 20 bp, Artificial Sequence
  chemically synthesized
agttgaggtgtcttggttca

SEQ ID NO: 438810 - DNA, 20 bp, Artificial Sequence
  chemically synthesized
tgtggtaagttctatgaacc

SEQ ID NO: 438811 - DNA, 20 bp, Artificial Sequence
  chemically synthesized
tgccagtcggattatgtggt

SEQ ID NO: 438812 - DNA, 20 bp, Artificial Sequence
  chemically synthesized
tacttgccagtcggattatg

SEQ ID NO: 438813 - DNA, 20 bp, Artificial Sequence
  chemically synthesized
aacttaccacataatccgac

SEQ ID NO: 438814 - DNA, 20 bp, Artificial Sequence
  chemically synthesized
taccacataatccgactggc

SEQ ID NO: 438815 - DNA, 20 bp, Artificial Sequence
  chemically synthesized
actaattaatacttgccagt

SEQ ID NO: 438816 - DNA, 20 bp, Artificial Sequence
  chemically synthesized
cgtgactaattaatacttgc

SEQ ID NO: 438817 - DNA, 20 bp, Artificial Sequence
  chemically synthesized
tccgactggcaagtattaat

SEQ ID NO: 438818 - DNA, 20 bp, Artificial Sequence
  chemically synthesized
attagtcacgtacatacata

SEQ ID NO: 438819 - DNA, 20 bp, Artificial Sequence
  chemically synthesized
acatacatatggaatcataa

SEQ ID NO: 438820 - DNA, 20 bp, Artificial Sequence
  chemically synthesized
taacatctgttcataacaca

SEQ ID NO: 438821 - DNA, 20 bp, Artificial Sequence
  chemically synthesized
acagtgctatgtgttatgaa

SEQ ID NO: 438822 - DNA, 20 bp, Artificial Sequence
  chemically synthesized
tgttatgaacagatgttacg

SEQ ID NO: 438823 - DNA, 20 bp, Artificial Sequence
  chemically synthesized
tatgaacagatgttacgtgg

SEQ ID NO: 438824 - DNA, 20 bp, Artificial Sequence
  chemically synthesized
tgaacagatgttacgtggta

SEQ ID NO: 438825 - DNA, 20 bp, Artificial Sequence
  chemically synthesized
gaacagatgttacgtggtag

SEQ ID NO: 438826 - DNA, 20 bp, Artificial Sequence
  chemically synthesized
gtagaggaatttgatgtact

SEQ ID NO: 438827 - DNA, 20 bp, Artificial Sequence
  chemically synthesized
tagaggaatttgatgtactt

SEQ ID NO: 438828 - DNA, 20 bp, Artificial Sequence
  chemically synthesized
agaggaatttgatgtactta

SEQ ID NO: 438829 - DNA, 20 bp, Artificial Sequence
  chemically synthesized
gaggaatttgatgtacttag

SEQ ID NO: 438830 - DNA, 20 bp, Artificial Sequence
  chemically synthesized
gatagacatcaaaatcccct

SEQ ID NO: 438831 - DNA, 20 bp, Artificial Sequence
  chemically synthesized
aggggattttgatgtctatc

SEQ ID NO: 438832 - DNA, 20 bp, Artificial Sequence
  chemically synthesized
gggattttgatgtctatcca

SEQ ID NO: 438833 - DNA, 20 bp, Artificial Sequence
  chemically synthesized
ggattttgatgtctatccag

SEQ ID NO: 438834 - DNA, 20 bp, Artificial Sequence
  chemically synthesized
cctacaagcttacctctgga

SEQ ID NO: 438835 - DNA, 20 bp, Artificial Sequence
  chemically synthesized
tttgatgtctatccagaggt

SEQ ID NO: 438836 - DNA, 20 bp, Artificial Sequence
  chemically synthesized
tccacctacaagcttacctc

SEQ ID NO: 438837 - DNA, 20 bp, Artificial Sequence
  chemically synthesized
tctatccagaggtaagcttg

SEQ ID NO: 438838 - DNA, 20 bp, Artificial Sequence
  chemically synthesized
ctatccagaggtaagcttgt

SEQ ID NO: 438839 - DNA, 20 bp, Artificial Sequence
  chemically synthesized
tccagaggtaagcttgtagg

SEQ ID NO: 438840 - DNA, 20 bp, Artificial Sequence
  chemically synthesized
tgacaccattttccacctac

SEQ ID NO: 438841 - DNA, 20 bp, Artificial Sequence
  chemically synthesized
gtaagcttgtaggtggaaaa

SEQ ID NO: 438842 - DNA, 20 bp, Artificial Sequence
  chemically synthesized
aggtggaaaatggtgtcatc

SEQ ID NO: 438843 - DNA, 20 bp, Artificial Sequence
  chemically synthesized
ggtggaaaatggtgtcatca

SEQ ID NO: 438844 - DNA, 20 bp, Artificial Sequence
  chemically synthesized
atggtgtcatcaaggtaaaa

SEQ ID NO: 438845 - DNA, 20 bp, Artificial Sequence
  chemically synthesized
tggtgtcatcaaggtaaaaa

SEQ ID NO: 438846 - DNA, 20 bp, Artificial Sequence
  chemically synthesized
ggtgtcatcaaggtaaaaaa

SEQ ID NO: 438847 - DNA, 20 bp, Artificial Sequence
  chemically synthesized
gtgtcatcaaggtaaaaaag

SEQ ID NO: 438848 - DNA, 20 bp, Artificial Sequence
  chemically synthesized
tcaaggtaaaaaaggggaaa

SEQ ID NO: 438849 - DNA, 20 bp, Artificial Sequence
  chemically synthesized
caaggtaaaaaaggggaaac

SEQ ID NO: 438850 - DNA, 20 bp, Artificial Sequence
  chemically synthesized
aaggtaaaaaaggggaaacg

SEQ ID NO: 438851 - DNA, 20 bp, Artificial Sequence
  chemically synthesized
ggtaaaaaaggggaaacggg

SEQ ID NO: 438852 - DNA, 20 bp, Artificial Sequence
  chemically synthesized
gtaaaaaaggggaaacgggg

SEQ ID NO: 438853 - DNA, 20 bp, Artificial Sequence
  chemically synthesized
aaggggaaacggggaggttc

SEQ ID NO: 438854 - DNA, 20 bp, Artificial Sequence
  chemically synthesized
acggggaggttctagacaaa

SEQ ID NO: 438855 - DNA, 20 bp, Artificial Sequence
  chemically synthesized
tgtatgcttttctatttgtc

SEQ ID NO: 438856 - DNA, 20 bp, Artificial Sequence
  chemically synthesized
gaggttctagacaaatagaa

SEQ ID NO: 438857 - DNA, 20 bp, Artificial Sequence
  chemically synthesized
aaatagaaaagcatacacaa

SEQ ID NO: 438858 - DNA, 20 bp, Artificial Sequence
  chemically synthesized
aagcatacacaaaagtactg

SEQ ID NO: 438859 - DNA, 20 bp, Artificial Sequence
  chemically synthesized
tagctttttttttttatcta

SEQ ID NO: 438860 - DNA, 20 bp, Artificial Sequence
  chemically synthesized
gtactgtagataaaaaaaaa

SEQ ID NO: 438861 - DNA, 20 bp, Artificial Sequence
  chemically synthesized
taaaaaaaaaaagctatacc

SEQ ID NO: 438862 - DNA, 20 bp, Artificial Sequence
  chemically synthesized
ttttgttccctgactaggta

SEQ ID NO: 438863 - DNA, 20 bp, Artificial Sequence
  chemically synthesized
aaaaaaaagctatacctagt

SEQ ID NO: 438864 - DNA, 20 bp, Artificial Sequence
  chemically synthesized
aaaaaaagctatacctagtc

SEQ ID NO: 438865 - DNA, 20 bp, Artificial Sequence
  chemically synthesized
aaaaaagctatacctagtca

SEQ ID NO: 438866 - DNA, 20 bp, Artificial Sequence
  chemically synthesized
tttctttttgttccctgact

SEQ ID NO: 438867 - DNA, 20 bp, Artificial Sequence
  chemically synthesized
ctttctttttgttccctgac

SEQ ID NO: 438868 - DNA, 20 bp, Artificial Sequence
  chemically synthesized
atacctagtcagggaacaaa

SEQ ID NO: 438869 - DNA, 20 bp, Artificial Sequence
  chemically synthesized
ctagtcagggaacaaaaaga

SEQ ID NO: 438870 - DNA, 20 bp, Artificial Sequence
  chemically synthesized
tcagggaacaaaaagaaagc

SEQ ID NO: 438871 - DNA, 20 bp, Artificial Sequence
  chemically synthesized
ggaacaaaaagaaagccagt

SEQ ID NO: 438872 - DNA, 20 bp, Artificial Sequence
  chemically synthesized
gaacaaaaagaaagccagta

SEQ ID NO: 438873 - DNA, 20 bp, Artificial Sequence
  chemically synthesized
aacaaaaagaaagccagtaa

SEQ ID NO: 438874 - DNA, 20 bp, Artificial Sequence
  chemically synthesized
acaaaaagaaagccagtaag

SEQ ID NO: 438875 - DNA, 20 bp, Artificial Sequence
  chemically synthesized
caaaaagaaagccagtaagg

SEQ ID NO: 438876 - DNA, 20 bp, Artificial Sequence
  chemically synthesized
cctttgcctcgcccccttac

SEQ ID NO: 438877 - DNA, 20 bp, Artificial Sequence
  chemically synthesized
aagaaagccagtaagggggc

SEQ ID NO: 438878 - DNA, 20 bp, Artificial Sequence
  chemically synthesized
agaaagccagtaagggggcg

SEQ ID NO: 438879 - DNA, 20 bp, Artificial Sequence
  chemically synthesized
gccagtaagggggcgaggca

SEQ ID NO: 438880 - DNA, 20 bp, Artificial Sequence
  chemically synthesized
ccagtaagggggcgaggcaa

SEQ ID NO: 438881 - DNA, 20 bp, Artificial Sequence
  chemically synthesized
gcgaggcaaaggaaacatga

SEQ ID NO: 438882 - DNA, 20 bp, Artificial Sequence
  chemically synthesized
cgaggcaaaggaaacatgat

SEQ ID NO: 438883 - DNA, 20 bp, Artificial Sequence
  chemically synthesized
aaggaaacatgatgggaaat

SEQ ID NO: 438884 - DNA, 20 bp, Artificial Sequence
  chemically synthesized
aaacatgatgggaaatgaga

SEQ ID NO: 438885 - DNA, 20 bp, Artificial Sequence
  chemically synthesized
aacatgatgggaaatgagat

SEQ ID NO: 438886 - DNA, 20 bp, Artificial Sequence
  chemically synthesized
catgatgggaaatgagatag

SEQ ID NO: 438887 - DNA, 20 bp, Artificial Sequence
  chemically synthesized
tgatgggaaatgagatagga

SEQ ID NO: 438888 - DNA, 20 bp, Artificial Sequence
  chemically synthesized
gatgggaaatgagataggag

SEQ ID NO: 438889 - DNA, 20 bp, Artificial Sequence
  chemically synthesized
gggaaatgagataggagagg

SEQ ID NO: 438890 - DNA, 20 bp, Artificial Sequence
  chemically synthesized
ggaaatgagataggagaggt

SEQ ID NO: 438891 - DNA, 20 bp, Artificial Sequence
  chemically synthesized
aatgagataggagaggtagg

SEQ ID NO: 438892 - DNA, 20 bp, Artificial Sequence
  chemically synthesized
taggagaggtaggcagtgtc

SEQ ID NO: 438893 - DNA, 20 bp, Artificial Sequence
  chemically synthesized
cacatttaaaaatcaaagtc

SEQ ID NO: 438894 - DNA, 20 bp, Artificial Sequence
  chemically synthesized
caaaacacatttaaaaatca

SEQ ID NO: 438895 - DNA, 20 bp, Artificial Sequence
  chemically synthesized
gtgttttgttttgttttgtt

SEQ ID NO: 438896 - DNA, 20 bp, Artificial Sequence
  chemically synthesized
tttgttttgtttggctttcc

SEQ ID NO: 438897 - DNA, 20 bp, Artificial Sequence
  chemically synthesized
gtttctcttggttgctagga

SEQ ID NO: 438898 - DNA, 20 bp, Artificial Sequence
  chemically synthesized
gtttggctttcctagcaacc

SEQ ID NO: 438899 - DNA, 20 bp, Artificial Sequence
  chemically synthesized
agtagtttctcttggttgct

SEQ ID NO: 438900 - DNA, 20 bp, Artificial Sequence
  chemically synthesized
tagtagtttctcttggttgc

SEQ ID NO: 438901 - DNA, 20 bp, Artificial Sequence
  chemically synthesized
ttggctttcctagcaaccaa

SEQ ID NO: 438902 - DNA, 20 bp, Artificial Sequence
  chemically synthesized
atcatgttagtagtttctct

SEQ ID NO: 438903 - DNA, 20 bp, Artificial Sequence
  chemically synthesized
cacttgttaaatcatgttag

SEQ ID NO: 438904 - DNA, 20 bp, Artificial Sequence
  chemically synthesized
caccacttgttaaatcatgt

SEQ ID NO: 438905 - DNA, 20 bp, Artificial Sequence
  chemically synthesized
aactactaacatgatttaac

SEQ ID NO: 438906 - DNA, 20 bp, Artificial Sequence
  chemically synthesized
tactaacatgatttaacaag

SEQ ID NO: 438907 - DNA, 20 bp, Artificial Sequence
  chemically synthesized
taacatgatttaacaagtgg

SEQ ID NO: 438908 - DNA, 20 bp, Artificial Sequence
  chemically synthesized
catgcagccaattaaattcg

SEQ ID NO: 438909 - DNA, 20 bp, Artificial Sequence
  chemically synthesized
gtggtatcttcgaatttaat

SEQ ID NO: 438910 - DNA, 20 bp, Artificial Sequence
  chemically synthesized
cgaatttaattggctgcatg

SEQ ID NO: 438911 - DNA, 20 bp, Artificial Sequence
  chemically synthesized
tccactctctaaacttcatg

SEQ ID NO: 438912 - DNA, 20 bp, Artificial Sequence
  chemically synthesized
ttaattggctgcatgaagtt

SEQ ID NO: 438913 - DNA, 20 bp, Artificial Sequence
  chemically synthesized
aattggctgcatgaagttta

SEQ ID NO: 438914 - DNA, 20 bp, Artificial Sequence
  chemically synthesized
ttggctgcatgaagtttaga

SEQ ID NO: 438915 - DNA, 20 bp, Artificial Sequence
  chemically synthesized
gctgcatgaagtttagagag

SEQ ID NO: 438916 - DNA, 20 bp, Artificial Sequence
  chemically synthesized
agtttagagagtggattatc

SEQ ID NO: 438917 - DNA, 20 bp, Artificial Sequence
  chemically synthesized
gtggattatcaagaatacga

SEQ ID NO: 438918 - DNA, 20 bp, Artificial Sequence
  chemically synthesized
ggattatcaagaatacgaaa

SEQ ID NO: 438919 - DNA, 20 bp, Artificial Sequence
  chemically synthesized
caagaatacgaaagagaatg

SEQ ID NO: 438920 - DNA, 20 bp, Artificial Sequence
  chemically synthesized
agaatacgaaagagaatgca

SEQ ID NO: 438921 - DNA, 20 bp, Artificial Sequence
  chemically synthesized
gaaagagaatgcagagaaac

SEQ ID NO: 438922 - DNA, 20 bp, Artificial Sequence
  chemically synthesized
gagaatgcagagaaactgga

SEQ ID NO: 438923 - DNA, 20 bp, Artificial Sequence
  chemically synthesized
agaatgcagagaaactggaa

SEQ ID NO: 438924 - DNA, 20 bp, Artificial Sequence
  chemically synthesized
tgcagagaaactggaaagga

SEQ ID NO: 438925 - DNA, 20 bp, Artificial Sequence
  chemically synthesized
atacagcagcctttcctttc

SEQ ID NO: 438926 - DNA, 20 bp, Artificial Sequence
  chemically synthesized
gcagagaaactggaaaggaa

SEQ ID NO: 438927 - DNA, 20 bp, Artificial Sequence
  chemically synthesized
ttctctcactaggaatacag

SEQ ID NO: 438928 - DNA, 20 bp, Artificial Sequence
  chemically synthesized
aggaaaggctgctgtattcc

SEQ ID NO: 438929 - DNA, 20 bp, Artificial Sequence
  chemically synthesized
attttctctcactaggaata

SEQ ID NO: 438930 - DNA, 20 bp, Artificial Sequence
  chemically synthesized
aaggctgctgtattcctagt

SEQ ID NO: 438931 - DNA, 20 bp, Artificial Sequence
  chemically synthesized
ggctgctgtattcctagtga

SEQ ID NO: 438932 - DNA, 20 bp, Artificial Sequence
  chemically synthesized
gcaatatattttctctcact

SEQ ID NO: 438933 - DNA, 20 bp, Artificial Sequence
  chemically synthesized
cgcaatatattttctctcac

SEQ ID NO: 438934 - DNA, 20 bp, Artificial Sequence
  chemically synthesized
tgagagaaaatatattgcgc

SEQ ID NO: 438935 - DNA, 20 bp, Artificial Sequence
  chemically synthesized
gagagaaaatatattgcgct

SEQ ID NO: 438936 - DNA, 20 bp, Artificial Sequence
  chemically synthesized
aatatattgcgctaggatga

SEQ ID NO: 438937 - DNA, 20 bp, Artificial Sequence
  chemically synthesized
tatctcctctaccatcatcc

SEQ ID NO: 438938 - DNA, 20 bp, Artificial Sequence
  chemically synthesized
atattgcgctaggatgatgg

SEQ ID NO: 438939 - DNA, 20 bp, Artificial Sequence
  chemically synthesized
attgcgctaggatgatggta

SEQ ID NO: 438940 - DNA, 20 bp, Artificial Sequence
  chemically synthesized
ttgcgctaggatgatggtag

SEQ ID NO: 438941 - DNA, 20 bp, Artificial Sequence
  chemically synthesized
gcgctaggatgatggtagag

SEQ ID NO: 438942 - DNA, 20 bp, Artificial Sequence
  chemically synthesized
ggatgatggtagaggagata

SEQ ID NO: 438943 - DNA, 20 bp, Artificial Sequence
  chemically synthesized
atgatggtagaggagataaa

SEQ ID NO: 438944 - DNA, 20 bp, Artificial Sequence
  chemically synthesized
atggtagaggagataaagag

SEQ ID NO: 438945 - DNA, 20 bp, Artificial Sequence
  chemically synthesized
gtagaggagataaagagaag

SEQ ID NO: 438946 - DNA, 20 bp, Artificial Sequence
  chemically synthesized
agaagtggatgaaaatatat

SEQ ID NO: 438947 - DNA, 20 bp, Artificial Sequence
  chemically synthesized
aagtggatgaaaatatatta

SEQ ID NO: 438948 - DNA, 20 bp, Artificial Sequence
  chemically synthesized
agtggatgaaaatatattag

SEQ ID NO: 438949 - DNA, 20 bp, Artificial Sequence
  chemically synthesized
atattagaggataaaaccca

SEQ ID NO: 438950 - DNA, 20 bp, Artificial Sequence
  chemically synthesized
aagtcattgccagtcactgt

SEQ ID NO: 438951 - DNA, 20 bp, Artificial Sequence
  chemically synthesized
aggataaaacccacagtgac

SEQ ID NO: 438952 - DNA, 20 bp, Artificial Sequence
  chemically synthesized
taagtcattgccagtcactg

SEQ ID NO: 438953 - DNA, 20 bp, Artificial Sequence
  chemically synthesized
agttatttctaagtcattgc

SEQ ID NO: 438954 - DNA, 20 bp, Artificial Sequence
  chemically synthesized
cacagtgactggcaatgact

SEQ ID NO: 438955 - DNA, 20 bp, Artificial Sequence
  chemically synthesized
ttttttacccagttatttct

SEQ ID NO: 438956 - DNA, 20 bp, Artificial Sequence
  chemically synthesized
ggcaatgacttagaaataac

SEQ ID NO: 438957 - DNA, 20 bp, Artificial Sequence
  chemically synthesized
gcaatgacttagaaataact

SEQ ID NO: 438958 - DNA, 20 bp, Artificial Sequence
  chemically synthesized
ttagaaataactgggtaaaa

SEQ ID NO: 438959 - DNA, 20 bp, Artificial Sequence
  chemically synthesized
aaactctgatcttttttacc

SEQ ID NO: 438960 - DNA, 20 bp, Artificial Sequence
  chemically synthesized
aataactgggtaaaaaagat

SEQ ID NO: 438961 - DNA, 20 bp, Artificial Sequence
  chemically synthesized
taactgggtaaaaaagatca

SEQ ID NO: 438962 - DNA, 20 bp, Artificial Sequence
  chemically synthesized
gtaaaaaagatcagagtttc

SEQ ID NO: 438963 - DNA, 20 bp, Artificial Sequence
  chemically synthesized
taaaaaagatcagagtttca

SEQ ID NO: 438964 - DNA, 20 bp, Artificial Sequence
  chemically synthesized
aagatcagagtttcaaggat

SEQ ID NO: 438965 - DNA, 20 bp, Artificial Sequence
  chemically synthesized
tcaaggatgagatatgtttc

SEQ ID NO: 438966 - DNA, 20 bp, Artificial Sequence
  chemically synthesized
attcacccagtttcacaagc

SEQ ID NO: 438967 - DNA, 20 bp, Artificial Sequence
  chemically synthesized
atgtttctggcttgtgaaac

SEQ ID NO: 438968 - DNA, 20 bp, Artificial Sequence
  chemically synthesized
aaccattcacccagtttcac

SEQ ID NO: 438969 - DNA, 20 bp, Artificial Sequence
  chemically synthesized
tgtttctggcttgtgaaact

SEQ ID NO: 438970 - DNA, 20 bp, Artificial Sequence
  chemically synthesized
ggcttgtgaaactgggtgaa

SEQ ID NO: 438971 - DNA, 20 bp, Artificial Sequence
  chemically synthesized
gaatggtgcaaccattcacc

SEQ ID NO: 438972 - DNA, 20 bp, Artificial Sequence
  chemically synthesized
ttgtttttcttatcattgaa

SEQ ID NO: 438973 - DNA, 20 bp, Artificial Sequence
  chemically synthesized
tggttgcaccattcaatgat

SEQ ID NO: 438974 - DNA, 20 bp, Artificial Sequence
  chemically synthesized
tcaatgataagaaaaacaat

SEQ ID NO: 438975 - DNA, 20 bp, Artificial Sequence
  chemically synthesized
atgataagaaaaacaatgag

SEQ ID NO: 438976 - DNA, 20 bp, Artificial Sequence
  chemically synthesized
tgataagaaaaacaatgaga

SEQ ID NO: 438977 - DNA, 20 bp, Artificial Sequence
  chemically synthesized
taagaaaaacaatgagaagg

SEQ ID NO: 438978 - DNA, 20 bp, Artificial Sequence
  chemically synthesized
gaaaaacaatgagaaggaag

SEQ ID NO: 438979 - DNA, 20 bp, Artificial Sequence
  chemically synthesized
aaaaacaatgagaaggaagc

SEQ ID NO: 438980 - DNA, 20 bp, Artificial Sequence
  chemically synthesized
agaaggaagcaggttttgtg

SEQ ID NO: 438981 - DNA, 20 bp, Artificial Sequence
  chemically synthesized
gaagcaggttttgtgcggtg

SEQ ID NO: 438982 - DNA, 20 bp, Artificial Sequence
  chemically synthesized
agcaggttttgtgcggtgaa

SEQ ID NO: 438983 - DNA, 20 bp, Artificial Sequence
  chemically synthesized
ggttttgtgcggtgaagaga

SEQ ID NO: 438984 - DNA, 20 bp, Artificial Sequence
  chemically synthesized
ggtgaagagaaagttctgtt

SEQ ID NO: 438985 - DNA, 20 bp, Artificial Sequence
  chemically synthesized
gtgaagagaaagttctgttt

SEQ ID NO: 438986 - DNA, 20 bp, Artificial Sequence
  chemically synthesized
tgaagagaaagttctgttta

SEQ ID NO: 438987 - DNA, 20 bp, Artificial Sequence
  chemically synthesized
ctccctctaaatgccctaaa

SEQ ID NO: 438988 - DNA, 20 bp, Artificial Sequence
  chemically synthesized
aaagttctgtttagggcatt

SEQ ID NO: 438989 - DNA, 20 bp, Artificial Sequence
  chemically synthesized
agttctgtttagggcattta

SEQ ID NO: 438990 - DNA, 20 bp, Artificial Sequence
  chemically synthesized
gttctgtttagggcatttag

SEQ ID NO: 438991 - DNA, 20 bp, Artificial Sequence
  chemically synthesized
ttctgtttagggcatttaga

SEQ ID NO: 438992 - DNA, 20 bp, Artificial Sequence
  chemically synthesized
ctgtttagggcatttagagg

SEQ ID NO: 438993 - DNA, 20 bp, Artificial Sequence
  chemically synthesized
tgtttagggcatttagaggg

SEQ ID NO: 438994 - DNA, 20 bp, Artificial Sequence
  chemically synthesized
gagggaggtgactatcacat

SEQ ID NO: 438995 - DNA, 20 bp, Artificial Sequence
  chemically synthesized
gcatctccattcttatgtga

SEQ ID NO: 438996 - DNA, 20 bp, Artificial Sequence
  chemically synthesized
aggtgactatcacataagaa

SEQ ID NO: 438997 - DNA, 20 bp, Artificial Sequence
  chemically synthesized
gtgactatcacataagaatg

SEQ ID NO: 438998 - DNA, 20 bp, Artificial Sequence
  chemically synthesized
ataagaatggagatgccacc

SEQ ID NO: 438999 - DNA, 20 bp, Artificial Sequence
  chemically synthesized
taagaatggagatgccaccc

SEQ ID NO: 439000 - DNA, 20 bp, Artificial Sequence
  chemically synthesized
gaatggagatgccacccagg

SEQ ID NO: 439001 - DNA, 20 bp, Artificial Sequence
  chemically synthesized
tgtgatttcaactgcctggg

SEQ ID NO: 439002 - DNA, 20 bp, Artificial Sequence
  chemically synthesized
aactgtgatttcaactgcct

SEQ ID NO: 439003 - DNA, 20 bp, Artificial Sequence
  chemically synthesized
gaactgtgatttcaactgcc

SEQ ID NO: 439004 - DNA, 20 bp, Artificial Sequence
  chemically synthesized
cacccaggcagttgaaatca

SEQ ID NO: 439005 - DNA, 20 bp, Artificial Sequence
  chemically synthesized
ggcagttgaaatcacagttc

SEQ ID NO: 439006 - DNA, 20 bp, Artificial Sequence
  chemically synthesized
tagatttctccaatgaattc

SEQ ID NO: 439007 - DNA, 20 bp, Artificial Sequence
  chemically synthesized
atcacagttctggaattcat

SEQ ID NO: 439008 - DNA, 20 bp, Artificial Sequence
  chemically synthesized
cacagttctggaattcattg

SEQ ID NO: 439009 - DNA, 20 bp, Artificial Sequence
  chemically synthesized
ggaattcattggagaaatct

SEQ ID NO: 439010 - DNA, 20 bp, Artificial Sequence
  chemically synthesized
ttcattggagaaatctaagc

SEQ ID NO: 439011 - DNA, 20 bp, Artificial Sequence
  chemically synthesized
cattggagaaatctaagcta

SEQ ID NO: 439012 - DNA, 20 bp, Artificial Sequence
  chemically synthesized
attggagaaatctaagctag

SEQ ID NO: 439013 - DNA, 20 bp, Artificial Sequence
  chemically synthesized
accaagttatacctctagct

SEQ ID NO: 439014 - DNA, 20 bp, Artificial Sequence
  chemically synthesized
aactaaccaagttatacctc

SEQ ID NO: 439015 - DNA, 20 bp, Artificial Sequence
  chemically synthesized
tctaagctagaggtataact

SEQ ID NO: 439016 - DNA, 20 bp, Artificial Sequence
  chemically synthesized
agctagaggtataacttggt

SEQ ID NO: 439017 - DNA, 20 bp, Artificial Sequence
  chemically synthesized
ttatatacagataactaacc

SEQ ID NO: 439018 - DNA, 20 bp, Artificial Sequence
  chemically synthesized
ttggttagttatctgtatat

SEQ ID NO: 439019 - DNA, 20 bp, Artificial Sequence
  chemically synthesized
gctttattaacacttatata

SEQ ID NO: 439020 - DNA, 20 bp, Artificial Sequence
  chemically synthesized
tctgtatataagtgttaata

SEQ ID NO: 439021 - DNA, 20 bp, Artificial Sequence
  chemically synthesized
tataagtgttaataaagctg

SEQ ID NO: 439022 - DNA, 20 bp, Artificial Sequence
  chemically synthesized
gttaataaagctgtggacat

SEQ ID NO: 439023 - DNA, 20 bp, Artificial Sequence
  chemically synthesized
gatcattgcacttatgtcca

SEQ ID NO: 439024 - DNA, 20 bp, Artificial Sequence
  chemically synthesized
tggacataagtgcaatgatc

SEQ ID NO: 439025 - DNA, 20 bp, Artificial Sequence
  chemically synthesized
ggacataagtgcaatgatcg

SEQ ID NO: 439026 - DNA, 20 bp, Artificial Sequence
  chemically synthesized
cataagtgcaatgatcgagg

SEQ ID NO: 439027 - DNA, 20 bp, Artificial Sequence
  chemically synthesized
taagtgcaatgatcgaggaa

SEQ ID NO: 439028 - DNA, 20 bp, Artificial Sequence
  chemically synthesized
atcgaggaagagatcattat

SEQ ID NO: 439029 - DNA, 20 bp, Artificial Sequence
  chemically synthesized
gaggaagagatcattatgag

SEQ ID NO: 439030 - DNA, 20 bp, Artificial Sequence
  chemically synthesized
ggaagagatcattatgagaa

SEQ ID NO: 439031 - DNA, 20 bp, Artificial Sequence
  chemically synthesized
ttatgagaagagaattatgc

SEQ ID NO: 439032 - DNA, 20 bp, Artificial Sequence
  chemically synthesized
tatgagaagagaattatgct

SEQ ID NO: 439033 - DNA, 20 bp, Artificial Sequence
  chemically synthesized
gaagagaattatgctaggac

SEQ ID NO: 439034 - DNA, 20 bp, Artificial Sequence
  chemically synthesized
gtttccttgggatctagtcc

SEQ ID NO: 439035 - DNA, 20 bp, Artificial Sequence
  chemically synthesized
ttatgctaggactagatccc

SEQ ID NO: 439036 - DNA, 20 bp, Artificial Sequence
  chemically synthesized
tatgctaggactagatccca

SEQ ID NO: 439037 - DNA, 20 bp, Artificial Sequence
  chemically synthesized
aattaggtttccttgggatc

SEQ ID NO: 439038 - DNA, 20 bp, Artificial Sequence
  chemically synthesized
tttaaaaattaggtttcctt

SEQ ID NO: 439039 - DNA, 20 bp, Artificial Sequence
  chemically synthesized
ctttaaaaattaggtttcct

SEQ ID NO: 439040 - DNA, 20 bp, Artificial Sequence
  chemically synthesized
cttctcagcctttaaaaatt

SEQ ID NO: 439041 - DNA, 20 bp, Artificial Sequence
  chemically synthesized
ccaaggaaacctaattttta

SEQ ID NO: 439042 - DNA, 20 bp, Artificial Sequence
  chemically synthesized
tcttctcagcctttaaaaat

SEQ ID NO: 439043 - DNA, 20 bp, Artificial Sequence
  chemically synthesized
caaggaaacctaatttttaa

SEQ ID NO: 439044 - DNA, 20 bp, Artificial Sequence
  chemically synthesized
aaacctaatttttaaaggct

SEQ ID NO: 439045 - DNA, 20 bp, Artificial Sequence
  chemically synthesized
cctaatttttaaaggctgag

SEQ ID NO: 439046 - DNA, 20 bp, Artificial Sequence
  chemically synthesized
taatttttaaaggctgagaa

SEQ ID NO: 439047 - DNA, 20 bp, Artificial Sequence
  chemically synthesized
atttttaaaggctgagaaga

SEQ ID NO: 439048 - DNA, 20 bp, Artificial Sequence
  chemically synthesized
tttttaaaggctgagaagag

SEQ ID NO: 439049 - DNA, 20 bp, Artificial Sequence
  chemically synthesized
gcaggctgatcctctcttct

SEQ ID NO: 439050 - DNA, 20 bp, Artificial Sequence
  chemically synthesized
aaaggctgagaagagaggat

SEQ ID NO: 439051 - DNA, 20 bp, Artificial Sequence
  chemically synthesized
gagaggatcagcctgcaatg

SEQ ID NO: 439052 - DNA, 20 bp, Artificial Sequence
  chemically synthesized
ttgtattcagtctgcattgc

SEQ ID NO: 439053 - DNA, 20 bp, Artificial Sequence
  chemically synthesized
tttgtattcagtctgcattg

SEQ ID NO: 439054 - DNA, 20 bp, Artificial Sequence
  chemically synthesized
ctttggagggtgtttgtatt

SEQ ID NO: 439055 - DNA, 20 bp, Artificial Sequence
  chemically synthesized
ctgaatacaaacaccctcca

SEQ ID NO: 439056 - DNA, 20 bp, Artificial Sequence
  chemically synthesized
aatacaaacaccctccaaag

SEQ ID NO: 439057 - DNA, 20 bp, Artificial Sequence
  chemically synthesized
ggcttcactactactttgga

SEQ ID NO: 439058 - DNA, 20 bp, Artificial Sequence
  chemically synthesized
tggcttcactactactttgg

SEQ ID NO: 439059 - DNA, 20 bp, Artificial Sequence
  chemically synthesized
atggcttcactactactttg

SEQ ID NO: 439060 - DNA, 20 bp, Artificial Sequence
  chemically synthesized
acaaacaccctccaaagtag

SEQ ID NO: 439061 - DNA, 20 bp, Artificial Sequence
  chemically synthesized
tcatggcttcactactactt

SEQ ID NO: 439062 - DNA, 20 bp, Artificial Sequence
  chemically synthesized
caccctccaaagtagtagtg

SEQ ID NO: 439063 - DNA, 20 bp, Artificial Sequence
  chemically synthesized
caaagtagtagtgaagccat

SEQ ID NO: 439064 - DNA, 20 bp, Artificial Sequence
  chemically synthesized
aagtagtagtgaagccatga

SEQ ID NO: 439065 - DNA, 20 bp, Artificial Sequence
  chemically synthesized
agtagtagtgaagccatgag

SEQ ID NO: 439066 - DNA, 20 bp, Artificial Sequence
  chemically synthesized
atctgtgcactgtcctctca

SEQ ID NO: 439067 - DNA, 20 bp, Artificial Sequence
  chemically synthesized
gtagtgaagccatgagagga

SEQ ID NO: 439068 - DNA, 20 bp, Artificial Sequence
  chemically synthesized
agccatgagaggacagtgca

SEQ ID NO: 439069 - DNA, 20 bp, Artificial Sequence
  chemically synthesized
aggacagtgcacagatctta

SEQ ID NO: 439070 - DNA, 20 bp, Artificial Sequence
  chemically synthesized
ttaaaaatgttgtcgtcttt

SEQ ID NO: 439071 - DNA, 20 bp, Artificial Sequence
  chemically synthesized
ttaaagacgacaacattttt

SEQ ID NO: 439072 - DNA, 20 bp, Artificial Sequence
  chemically synthesized
aagacgacaacatttttaag

SEQ ID NO: 439073 - DNA, 20 bp, Artificial Sequence
  chemically synthesized
agacgacaacatttttaaga

SEQ ID NO: 439074 - DNA, 20 bp, Artificial Sequence
  chemically synthesized
gacgacaacatttttaagaa

SEQ ID NO: 439075 - DNA, 20 bp, Artificial Sequence
  chemically synthesized
cgacaacatttttaagaagg

SEQ ID NO: 439076 - DNA, 20 bp, Artificial Sequence
  chemically synthesized
atttttaagaagggagaaaa

SEQ ID NO: 439077 - DNA, 20 bp, Artificial Sequence
  chemically synthesized
ttgaacttgcagaaggtcaa

SEQ ID NO: 439078 - DNA, 20 bp, Artificial Sequence
  chemically synthesized
ggtcactattgaccttctgc

SEQ ID NO: 439079 - DNA, 20 bp, Artificial Sequence
  chemically synthesized
gtctttcttgaacttgcaga

SEQ ID NO: 439080 - DNA, 20 bp, Artificial Sequence
  chemically synthesized
cgtctttcttgaacttgcag

SEQ ID NO: 439081 - DNA, 20 bp, Artificial Sequence
  chemically synthesized
tattgaccttctgcaagttc

SEQ ID NO: 439082 - DNA, 20 bp, Artificial Sequence
  chemically synthesized
cttcgtctttcttgaacttg

SEQ ID NO: 439083 - DNA, 20 bp, Artificial Sequence
  chemically synthesized
gaccttctgcaagttcaaga

SEQ ID NO: 439084 - DNA, 20 bp, Artificial Sequence
  chemically synthesized
ctgcaagttcaagaaagacg

SEQ ID NO: 439085 - DNA, 20 bp, Artificial Sequence
  chemically synthesized
gacgaagaaatttcattaat

SEQ ID NO: 439086 - DNA, 20 bp, Artificial Sequence
  chemically synthesized
gaaatttcattaattggttc

SEQ ID NO: 439087 - DNA, 20 bp, Artificial Sequence
  chemically synthesized
aatttcattaattggttcta

SEQ ID NO: 439088 - DNA, 20 bp, Artificial Sequence
  chemically synthesized
agtagaggacttcatgtctc

SEQ ID NO: 439089 - DNA, 20 bp, Artificial Sequence
  chemically synthesized
taattggttctagagacatg

SEQ ID NO: 439090 - DNA, 20 bp, Artificial Sequence
  chemically synthesized
gctaagttcaagtgaagtag

SEQ ID NO: 439091 - DNA, 20 bp, Artificial Sequence
  chemically synthesized
tgctaagttcaagtgaagta

SEQ ID NO: 439092 - DNA, 20 bp, Artificial Sequence
  chemically synthesized
cctgctaagttcaagtgaag

SEQ ID NO: 439093 - DNA, 20 bp, Artificial Sequence
  chemically synthesized
caccctgctaagttcaagtg

SEQ ID NO: 439094 - DNA, 20 bp, Artificial Sequence
  chemically synthesized
tcctctacttcacttgaact

SEQ ID NO: 439095 - DNA, 20 bp, Artificial Sequence
  chemically synthesized
agcttcaccctgctaagttc

SEQ ID NO: 439096 - DNA, 20 bp, Artificial Sequence
  chemically synthesized
tctacttcacttgaacttag

SEQ ID NO: 439097 - DNA, 20 bp, Artificial Sequence
  chemically synthesized
ctacttcacttgaacttagc

SEQ ID NO: 439098 - DNA, 20 bp, Artificial Sequence
  chemically synthesized
tacttcacttgaacttagca

SEQ ID NO: 439099 - DNA, 20 bp, Artificial Sequence
  chemically synthesized
tattcaagcttcaccctgct

SEQ ID NO: 439100 - DNA, 20 bp, Artificial Sequence
  chemically synthesized
cacttgaacttagcagggtg

SEQ ID NO: 439101 - DNA, 20 bp, Artificial Sequence
  chemically synthesized
ttagcagggtgaagcttgaa

SEQ ID NO: 439102 - DNA, 20 bp, Artificial Sequence
  chemically synthesized
ctttcattatttttctattc

SEQ ID NO: 439103 - DNA, 20 bp, Artificial Sequence
  chemically synthesized
cttgaatagaaaaataatga

SEQ ID NO: 439104 - DNA, 20 bp, Artificial Sequence
  chemically synthesized
taatgaaagcatgcaattaa

SEQ ID NO: 439105 - DNA, 20 bp, Artificial Sequence
  chemically synthesized
aaagcatgcaattaaaagaa

SEQ ID NO: 439106 - DNA, 20 bp, Artificial Sequence
  chemically synthesized
agcatgcaattaaaagaaaa

SEQ ID NO: 439107 - DNA, 20 bp, Artificial Sequence
  chemically synthesized
catcagttggacaagatatt

SEQ ID NO: 439108 - DNA, 20 bp, Artificial Sequence
  chemically synthesized
cttatatgcatcagttggac

SEQ ID NO: 439109 - DNA, 20 bp, Artificial Sequence
  chemically synthesized
tatctcttatatgcatcagt

SEQ ID NO: 439110 - DNA, 20 bp, Artificial Sequence
  chemically synthesized
tttctatctcttatatgcat

SEQ ID NO: 439111 - DNA, 20 bp, Artificial Sequence
  chemically synthesized
cttgtccaactgatgcatat

SEQ ID NO: 439112 - DNA, 20 bp, Artificial Sequence
  chemically synthesized
tgtccaactgatgcatataa

SEQ ID NO: 439113 - DNA, 20 bp, Artificial Sequence
  chemically synthesized
caactgatgcatataagaga

SEQ ID NO: 439114 - DNA, 20 bp, Artificial Sequence
  chemically synthesized
tgatgcatataagagataga

SEQ ID NO: 439115 - DNA, 20 bp, Artificial Sequence
  chemically synthesized
tgcatataagagatagaaag

SEQ ID NO: 439116 - DNA, 20 bp, Artificial Sequence
  chemically synthesized
aaaaatacaaaaataaagca

SEQ ID NO: 439117 - DNA, 20 bp, Artificial Sequence
  chemically synthesized
atggtaaaaatacaaaaata

SEQ ID NO: 439118 - DNA, 20 bp, Artificial Sequence
  chemically synthesized
tttttgtatttttaccataa

SEQ ID NO: 439119 - DNA, 20 bp, Artificial Sequence
  chemically synthesized
ttagattataaattctgtta

SEQ ID NO: 439120 - DNA, 20 bp, Artificial Sequence
  chemically synthesized
gataatttgtttaagaaaat

SEQ ID NO: 439121 - DNA, 20 bp, Artificial Sequence
  chemically synthesized
tcttttttgataatttgttt

SEQ ID NO: 439122 - DNA, 20 bp, Artificial Sequence
  chemically synthesized
tcttaaacaaattatcaaaa

SEQ ID NO: 439123 - DNA, 20 bp, Artificial Sequence
  chemically synthesized
tatcaaaaaagaaaccaaca

SEQ ID NO: 439124 - DNA, 20 bp, Artificial Sequence
  chemically synthesized
aacattagcagtaactttgt

SEQ ID NO: 439125 - DNA, 20 bp, Artificial Sequence
  chemically synthesized
actttaatattcaacattag

SEQ ID NO: 439126 - DNA, 20 bp, Artificial Sequence
  chemically synthesized
agtactttaatattcaacat

SEQ ID NO: 439127 - DNA, 20 bp, Artificial Sequence
  chemically synthesized
actgctaatgttgaatatta

SEQ ID NO: 439128 - DNA, 20 bp, Artificial Sequence
  chemically synthesized
tattaaagtactattattaa

SEQ ID NO: 439129 - DNA, 20 bp, Artificial Sequence
  chemically synthesized
aattaagaagctattaataa

SEQ ID NO: 439130 - DNA, 20 bp, Artificial Sequence
  chemically synthesized
ttattaatagcttcttaatt

SEQ ID NO: 439131 - DNA, 20 bp, Artificial Sequence
  chemically synthesized
ttatttatttcttaattaag

SEQ ID NO: 439132 - DNA, 20 bp, Artificial Sequence
  chemically synthesized
taattatttatttcttaatt

SEQ ID NO: 439133 - DNA, 20 bp, Artificial Sequence
  chemically synthesized
aattatatgtttgttacaat

SEQ ID NO: 439134 - DNA, 20 bp, Artificial Sequence
  chemically synthesized
attatatgtttgttacaatt

SEQ ID NO: 439135 - DNA, 20 bp, Artificial Sequence
  chemically synthesized
gaatgacatttgaatataat

SEQ ID NO: 439136 - DNA, 20 bp, Artificial Sequence
  chemically synthesized
aagaacactacaacacggtt

SEQ ID NO: 439137 - DNA, 20 bp, Artificial Sequence
  chemically synthesized
aaagaacactacaacacggt

SEQ ID NO: 439138 - DNA, 20 bp, Artificial Sequence
  chemically synthesized
tttttttcccaaccgtgttg

SEQ ID NO: 439139 - DNA, 20 bp, Artificial Sequence
  chemically synthesized
gtgtaaagaacactacaaca

SEQ ID NO: 439140 - DNA, 20 bp, Artificial Sequence
  chemically synthesized
ttttccatttgaaaagtgta

SEQ ID NO: 439141 - DNA, 20 bp, Artificial Sequence
  chemically synthesized
tgttctttacacttttcaaa

SEQ ID NO: 439142 - DNA, 20 bp, Artificial Sequence
  chemically synthesized
aatacatttttccatttgaa

SEQ ID NO: 439143 - DNA, 20 bp, Artificial Sequence
  chemically synthesized
ttcaaatggaaaaatgtatt

SEQ ID NO: 439144 - DNA, 20 bp, Artificial Sequence
  chemically synthesized
tatcatgttactgatcttat

SEQ ID NO: 439145 - DNA, 20 bp, Artificial Sequence
  chemically synthesized
tttggctttactgataagat

SEQ ID NO: 439146 - DNA, 20 bp, Artificial Sequence
  chemically synthesized
tgttactgatcttatcagta

SEQ ID NO: 439147 - DNA, 20 bp, Artificial Sequence
  chemically synthesized
aagtttttggctttactgat

SEQ ID NO: 439148 - DNA, 20 bp, Artificial Sequence
  chemically synthesized
ggtttacgtatgaaagtttt

SEQ ID NO: 439149 - DNA, 20 bp, Artificial Sequence
  chemically synthesized
attaagtggtttacgtatga

SEQ ID NO: 439150 - DNA, 20 bp, Artificial Sequence
  chemically synthesized
cacattacttggaaattaag

SEQ ID NO: 439151 - DNA, 20 bp, Artificial Sequence
  chemically synthesized
acgtaaaccacttaatttcc

SEQ ID NO: 439152 - DNA, 20 bp, Artificial Sequence
  chemically synthesized
atacacattacttggaaatt

SEQ ID NO: 439153 - DNA, 20 bp, Artificial Sequence
  chemically synthesized
acacatacatacacattact

SEQ ID NO: 439154 - DNA, 20 bp, Artificial Sequence
  chemically synthesized
tgtctatcatacatacacag

SEQ ID NO: 439155 - DNA, 20 bp, Artificial Sequence
  chemically synthesized
ctgtctatcatacatacaca

SEQ ID NO: 439156 - DNA, 20 bp, Artificial Sequence
  chemically synthesized
ttctgtctatcatacataca

SEQ ID NO: 439157 - DNA, 20 bp, Artificial Sequence
  chemically synthesized
gtgcctctgtgtatgtatga

SEQ ID NO: 439158 - DNA, 20 bp, Artificial Sequence
  chemically synthesized
ctctgtgtatgtatgataga

SEQ ID NO: 439159 - DNA, 20 bp, Artificial Sequence
  chemically synthesized
gtgtatgtatgatagacaga

SEQ ID NO: 439160 - DNA, 20 bp, Artificial Sequence
  chemically synthesized
atgatagacagaaagacaaa

SEQ ID NO: 439161 - DNA, 20 bp, Artificial Sequence
  chemically synthesized
gatagacagaaagacaaaaa

SEQ ID NO: 439162 - DNA, 20 bp, Artificial Sequence
  chemically synthesized
agacagaaagacaaaaagag

SEQ ID NO: 439163 - DNA, 20 bp, Artificial Sequence
  chemically synthesized
aagagaagatctatgcacac

SEQ ID NO: 439164 - DNA, 20 bp, Artificial Sequence
  chemically synthesized
ttcaatattactagtgtgca

SEQ ID NO: 439165 - DNA, 20 bp, Artificial Sequence
  chemically synthesized
ctcatttctttcaatattac

SEQ ID NO: 439166 - DNA, 20 bp, Artificial Sequence
  chemically synthesized
atgcacactagtaatattga

SEQ ID NO: 439167 - DNA, 20 bp, Artificial Sequence
  chemically synthesized
ctagtaatattgaaagaaat

SEQ ID NO: 439168 - DNA, 20 bp, Artificial Sequence
  chemically synthesized
gtgtgatgaatgaagtaaat

SEQ ID NO: 439169 - DNA, 20 bp, Artificial Sequence
  chemically synthesized
ttatgacagtgtgatgaatg

SEQ ID NO: 439170 - DNA, 20 bp, Artificial Sequence
  chemically synthesized
tcattcatcacactgtcata

SEQ ID NO: 439171 - DNA, 20 bp, Artificial Sequence
  chemically synthesized
aaaaaagaaagtctttatga

SEQ ID NO: 439172 - DNA, 20 bp, Artificial Sequence
  chemically synthesized
cacttttctaggaaaaaaga

SEQ ID NO: 439173 - DNA, 20 bp, Artificial Sequence
  chemically synthesized
ataaagactttcttttttcc

SEQ ID NO: 439174 - DNA, 20 bp, Artificial Sequence
  chemically synthesized
ataccacttttctaggaaaa

SEQ ID NO: 439175 - DNA, 20 bp, Artificial Sequence
  chemically synthesized
gactttcttttttcctagaa

SEQ ID NO: 439176 - DNA, 20 bp, Artificial Sequence
  chemically synthesized
tttcttttttcctagaaaag

SEQ ID NO: 439177 - DNA, 20 bp, Artificial Sequence
  chemically synthesized
gtatgagataccacttttct

SEQ ID NO: 439178 - DNA, 20 bp, Artificial Sequence
  chemically synthesized
tgtatgagataccacttttc

SEQ ID NO: 439179 - DNA, 20 bp, Artificial Sequence
  chemically synthesized
gagattagatgaggttgtat

SEQ ID NO: 439180 - DNA, 20 bp, Artificial Sequence
  chemically synthesized
ctagtgtatgagattagatg

SEQ ID NO: 439181 - DNA, 20 bp, Artificial Sequence
  chemically synthesized
tctagtgtatgagattagat

SEQ ID NO: 439182 - DNA, 20 bp, Artificial Sequence
  chemically synthesized
atttttctagtgtatgagat

SEQ ID NO: 439183 - DNA, 20 bp, Artificial Sequence
  chemically synthesized
cctcatctaatctcatacac

SEQ ID NO: 439184 - DNA, 20 bp, Artificial Sequence
  chemically synthesized
gatccatttttctagtgtat

SEQ ID NO: 439185 - DNA, 20 bp, Artificial Sequence
  chemically synthesized
aatctcatacactagaaaaa

SEQ ID NO: 439186 - DNA, 20 bp, Artificial Sequence
  chemically synthesized
tcaatgctgatccatttttc

SEQ ID NO: 439187 - DNA, 20 bp, Artificial Sequence
  chemically synthesized
catacactagaaaaatggat

SEQ ID NO: 439188 - DNA, 20 bp, Artificial Sequence
  chemically synthesized
atataaaaataagaaattgt

SEQ ID NO: 439189 - DNA, 20 bp, Artificial Sequence
  chemically synthesized
atgtgtgattatataaaaat

SEQ ID NO: 439190 - DNA, 20 bp, Artificial Sequence
  chemically synthesized
ttttatataatcacacatct

SEQ ID NO: 439191 - DNA, 20 bp, Artificial Sequence
  chemically synthesized
cttactgctataatgacact

SEQ ID NO: 439192 - DNA, 20 bp, Artificial Sequence
  chemically synthesized
cacacatcttagtgtcatta

SEQ ID NO: 439193 - DNA, 20 bp, Artificial Sequence
  chemically synthesized
acatcttagtgtcattatag

SEQ ID NO: 439194 - DNA, 20 bp, Artificial Sequence
  chemically synthesized
cttagtgtcattatagcagt

SEQ ID NO: 439195 - DNA, 20 bp, Artificial Sequence
  chemically synthesized
tatttgtatatttaatatta

SEQ ID NO: 439196 - DNA, 20 bp, Artificial Sequence
  chemically synthesized
tttgtatatttaatattaaa

SEQ ID NO: 439197 - DNA, 20 bp, Artificial Sequence
  chemically synthesized
gtatatttaatattaaagag

SEQ ID NO: 439198 - DNA, 20 bp, Artificial Sequence
  chemically synthesized
agacccagtaggttaatttg

SEQ ID NO: 439199 - DNA, 20 bp, Artificial Sequence
  chemically synthesized
agtgctacaaattaacctac

SEQ ID NO: 439200 - DNA, 20 bp, Artificial Sequence
  chemically synthesized
gtgctacaaattaacctact

SEQ ID NO: 439201 - DNA, 20 bp, Artificial Sequence
  chemically synthesized
atatatttcggagacccagt

SEQ ID NO: 439202 - DNA, 20 bp, Artificial Sequence
  chemically synthesized
aatatatttcggagacccag

SEQ ID NO: 439203 - DNA, 20 bp, Artificial Sequence
  chemically synthesized
agaaatatatttcggagacc

SEQ ID NO: 439204 - DNA, 20 bp, Artificial Sequence
  chemically synthesized
taattcagaaatatatttcg

SEQ ID NO: 439205 - DNA, 20 bp, Artificial Sequence
  chemically synthesized
cttaattcagaaatatattt

SEQ ID NO: 439206 - DNA, 20 bp, Artificial Sequence
  chemically synthesized
ccgaaatatatttctgaatt

SEQ ID NO: 439207 - DNA, 20 bp, Artificial Sequence
  chemically synthesized
cgaaatatatttctgaatta

SEQ ID NO: 439208 - DNA, 20 bp, Artificial Sequence
  chemically synthesized
tatagaaataagccttaatt

SEQ ID NO: 439209 - DNA, 20 bp, Artificial Sequence
  chemically synthesized
tgaattaaggcttatttcta

SEQ ID NO: 439210 - DNA, 20 bp, Artificial Sequence
  chemically synthesized
tttggataagctatagaaat

SEQ ID NO: 439211 - DNA, 20 bp, Artificial Sequence
  chemically synthesized
attgatctttggataagcta

SEQ ID NO: 439212 - DNA, 20 bp, Artificial Sequence
  chemically synthesized
ttatttctatagcttatcca

SEQ ID NO: 439213 - DNA, 20 bp, Artificial Sequence
  chemically synthesized
aaggttattgatctttggat

SEQ ID NO: 439214 - DNA, 20 bp, Artificial Sequence
  chemically synthesized
actgtaaggttattgatctt

SEQ ID NO: 439215 - DNA, 20 bp, Artificial Sequence
  chemically synthesized
tccaaagatcaataacctta

SEQ ID NO: 439216 - DNA, 20 bp, Artificial Sequence
  chemically synthesized
agatcaataaccttacagtt

SEQ ID NO: 439217 - DNA, 20 bp, Artificial Sequence
  chemically synthesized
aatgcatcttcttaactgta

SEQ ID NO: 439218 - DNA, 20 bp, Artificial Sequence
  chemically synthesized
aaatgcatcttcttaactgt

SEQ ID NO: 439219 - DNA, 20 bp, Artificial Sequence
  chemically synthesized
tcaataaccttacagttaag

SEQ ID NO: 439220 - DNA, 20 bp, Artificial Sequence
  chemically synthesized
taaaatttatattatcctga

SEQ ID NO: 439221 - DNA, 20 bp, Artificial Sequence
  chemically synthesized
aactagtatataaaactatc

SEQ ID NO: 439222 - DNA, 20 bp, Artificial Sequence
  chemically synthesized
taactagtatataaaactat

SEQ ID NO: 439223 - DNA, 20 bp, Artificial Sequence
  chemically synthesized
atcctgatagttttatatac

SEQ ID NO: 439224 - DNA, 20 bp, Artificial Sequence
  chemically synthesized
tgatagttttatatactagt

SEQ ID NO: 439225 - DNA, 20 bp, Artificial Sequence
  chemically synthesized
agtattgtccagtaactaac

SEQ ID NO: 439226 - DNA, 20 bp, Artificial Sequence
  chemically synthesized
tttatatactagttagttac

SEQ ID NO: 439227 - DNA, 20 bp, Artificial Sequence
  chemically synthesized
atcaattgtttagtattgtc

SEQ ID NO: 439228 - DNA, 20 bp, Artificial Sequence
  chemically synthesized
tttccatggtatcaattgtt

SEQ ID NO: 439229 - DNA, 20 bp, Artificial Sequence
  chemically synthesized
atactaaacaattgatacca

SEQ ID NO: 439230 - DNA, 20 bp, Artificial Sequence
  chemically synthesized
gattatcatgtgcgtttcca

SEQ ID NO: 439231 - DNA, 20 bp, Artificial Sequence
  chemically synthesized
gaaacgcacatgataatcaa

SEQ ID NO: 439232 - DNA, 20 bp, Artificial Sequence
  chemically synthesized
aaaaaaaaaaaaaaaaaaaa

SEQ ID NO: 439233 - DNA, 20 bp, Artificial Sequence
  chemically synthesized
tttttttttttttttttttt

SEQ ID NO: 439234 - DNA, 20 bp, Artificial Sequence
  chemically synthesized
ttttttttttttttttgaga

SEQ ID NO: 439235 - DNA, 20 bp, Artificial Sequence
  chemically synthesized
ttttttttttttttgagaca

SEQ ID NO: 439236 - DNA, 20 bp, Artificial Sequence
  chemically synthesized
tccagcctgggtgaaagagt

SEQ ID NO: 439237 - DNA, 20 bp, Artificial Sequence
  chemically synthesized
cagagtctcactctttcacc

SEQ ID NO: 439238 - DNA, 20 bp, Artificial Sequence
  chemically synthesized
gtactccagcctgggtgaaa

SEQ ID NO: 439239 - DNA, 20 bp, Artificial Sequence
  chemically synthesized
agagtctcactctttcaccc

SEQ ID NO: 439240 - DNA, 20 bp, Artificial Sequence
  chemically synthesized
ctgtactccagcctgggtga

SEQ ID NO: 439241 - DNA, 20 bp, Artificial Sequence
  chemically synthesized
tctcactctttcacccaggc

SEQ ID NO: 439242 - DNA, 20 bp, Artificial Sequence
  chemically synthesized
tcactctttcacccaggctg

SEQ ID NO: 439243 - DNA, 20 bp, Artificial Sequence
  chemically synthesized
tcgccactgtactccagcct

SEQ ID NO: 439244 - DNA, 20 bp, Artificial Sequence
  chemically synthesized
ctcgccactgtactccagcc

SEQ ID NO: 439245 - DNA, 20 bp, Artificial Sequence
  chemically synthesized
ctttcacccaggctggagta

SEQ ID NO: 439246 - DNA, 20 bp, Artificial Sequence
  chemically synthesized
gagatctcgccactgtactc

SEQ ID NO: 439247 - DNA, 20 bp, Artificial Sequence
  chemically synthesized
tcacccaggctggagtacag

SEQ ID NO: 439248 - DNA, 20 bp, Artificial Sequence
  chemically synthesized
ccaggctggagtacagtggc

SEQ ID NO: 439249 - DNA, 20 bp, Artificial Sequence
  chemically synthesized
ggtggaagttgcagtgagcg

SEQ ID NO: 439250 - DNA, 20 bp, Artificial Sequence
  chemically synthesized
gaggtggaagttgcagtgag

SEQ ID NO: 439251 - DNA, 20 bp, Artificial Sequence
  chemically synthesized
cgggaggtggaagttgcagt

SEQ ID NO: 439252 - DNA, 20 bp, Artificial Sequence
  chemically synthesized
agcccgggaggtggaagttg

SEQ ID NO: 439253 - DNA, 20 bp, Artificial Sequence
  chemically synthesized
cacttgagcccgggaggtgg

SEQ ID NO: 439254 - DNA, 20 bp, Artificial Sequence
  chemically synthesized
tcactgcaacttccacctcc

SEQ ID NO: 439255 - DNA, 20 bp, Artificial Sequence
  chemically synthesized
cactgcaacttccacctccc

SEQ ID NO: 439256 - DNA, 20 bp, Artificial Sequence
  chemically synthesized
aatcacttgagcccgggagg

SEQ ID NO: 439257 - DNA, 20 bp, Artificial Sequence
  chemically synthesized
gagaatcacttgagcccggg

SEQ ID NO: 439258 - DNA, 20 bp, Artificial Sequence
  chemically synthesized
ggagaatcacttgagcccgg

SEQ ID NO: 439259 - DNA, 20 bp, Artificial Sequence
  chemically synthesized
aacttccacctcccgggctc

SEQ ID NO: 439260 - DNA, 20 bp, Artificial Sequence
  chemically synthesized
caggagaatcacttgagccc

SEQ ID NO: 439261 - DNA, 20 bp, Artificial Sequence
  chemically synthesized
gcaggagaatcacttgagcc

SEQ ID NO: 439262 - DNA, 20 bp, Artificial Sequence
  chemically synthesized
ctgtggcaggagaatcactt

SEQ ID NO: 439263 - DNA, 20 bp, Artificial Sequence
  chemically synthesized
ctcaagtgattctcctgcca

SEQ ID NO: 439264 - DNA, 20 bp, Artificial Sequence
  chemically synthesized
tactcaggaggctgtggcag

SEQ ID NO: 439265 - DNA, 20 bp, Artificial Sequence
  chemically synthesized
gctactcaggaggctgtggc

SEQ ID NO: 439266 - DNA, 20 bp, Artificial Sequence
  chemically synthesized
agctactcaggaggctgtgg

SEQ ID NO: 439267 - DNA, 20 bp, Artificial Sequence
  chemically synthesized
cccagctactcaggaggctg

SEQ ID NO: 439268 - DNA, 20 bp, Artificial Sequence
  chemically synthesized
ttctcctgccacagcctcct

SEQ ID NO: 439269 - DNA, 20 bp, Artificial Sequence
  chemically synthesized
tcctgccacagcctcctgag

SEQ ID NO: 439270 - DNA, 20 bp, Artificial Sequence
  chemically synthesized
tgtaatcccagctactcagg

SEQ ID NO: 439271 - DNA, 20 bp, Artificial Sequence
  chemically synthesized
ctgtaatcccagctactcag

SEQ ID NO: 439272 - DNA, 20 bp, Artificial Sequence
  chemically synthesized
gccacagcctcctgagtagc

SEQ ID NO: 439273 - DNA, 20 bp, Artificial Sequence
  chemically synthesized
acctgtaatcccagctactc

SEQ ID NO: 439274 - DNA, 20 bp, Artificial Sequence
  chemically synthesized
ccacagcctcctgagtagct

SEQ ID NO: 439275 - DNA, 20 bp, Artificial Sequence
  chemically synthesized
cacctgtaatcccagctact

SEQ ID NO: 439276 - DNA, 20 bp, Artificial Sequence
  chemically synthesized
ctcctgagtagctgggatta

SEQ ID NO: 439277 - DNA, 20 bp, Artificial Sequence
  chemically synthesized
tcctgagtagctgggattac

SEQ ID NO: 439278 - DNA, 20 bp, Artificial Sequence
  chemically synthesized
gtggcgtgcacctgtaatcc

SEQ ID NO: 439279 - DNA, 20 bp, Artificial Sequence
  chemically synthesized
caggtgcacgccaccacgtc

SEQ ID NO: 439280 - DNA, 20 bp, Artificial Sequence
  chemically synthesized
caaaaattagccagacgtgg

SEQ ID NO: 439281 - DNA, 20 bp, Artificial Sequence
  chemically synthesized
atacaaaaattagccagacg

SEQ ID NO: 439282 - DNA, 20 bp, Artificial Sequence
  chemically synthesized
actaaaatacaaaaattagc

SEQ ID NO: 439283 - DNA, 20 bp, Artificial Sequence
  chemically synthesized
ctctactaaaatacaaaaat

SEQ ID NO: 439284 - DNA, 20 bp, Artificial Sequence
  chemically synthesized
tctggctaatttttgtattt

SEQ ID NO: 439285 - DNA, 20 bp, Artificial Sequence
  chemically synthesized
ggctaatttttgtattttag

SEQ ID NO: 439286 - DNA, 20 bp, Artificial Sequence
  chemically synthesized
ctaatttttgtattttagta

SEQ ID NO: 439287 - DNA, 20 bp, Artificial Sequence
  chemically synthesized
tttgtattttagtagagatg

SEQ ID NO: 439288 - DNA, 20 bp, Artificial Sequence
  chemically synthesized
gagatgtggtttcaccatgt

SEQ ID NO: 439289 - DNA, 20 bp, Artificial Sequence
  chemically synthesized
tgtggtttcaccatgttggc

SEQ ID NO: 439290 - DNA, 20 bp, Artificial Sequence
  chemically synthesized
ccagaccagcctggccaaca

SEQ ID NO: 439291 - DNA, 20 bp, Artificial Sequence
  chemically synthesized
gtggtttcaccatgttggcc

SEQ ID NO: 439292 - DNA, 20 bp, Artificial Sequence
  chemically synthesized
tttcaccatgttggccaggc

SEQ ID NO: 439293 - DNA, 20 bp, Artificial Sequence
  chemically synthesized
tcaggaattccagaccagcc

SEQ ID NO: 439294 - DNA, 20 bp, Artificial Sequence
  chemically synthesized
ccatgttggccaggctggtc

SEQ ID NO: 439295 - DNA, 20 bp, Artificial Sequence
  chemically synthesized
tgaggtcaggaattccagac

SEQ ID NO: 439296 - DNA, 20 bp, Artificial Sequence
  chemically synthesized
tcacctgaggtcaggaattc

SEQ ID NO: 439297 - DNA, 20 bp, Artificial Sequence
  chemically synthesized
tggtctggaattcctgacct

SEQ ID NO: 439298 - DNA, 20 bp, Artificial Sequence
  chemically synthesized
ggtctggaattcctgacctc

SEQ ID NO: 439299 - DNA, 20 bp, Artificial Sequence
  chemically synthesized
cgggcagatcacctgaggtc

SEQ ID NO: 439300 - DNA, 20 bp, Artificial Sequence
  chemically synthesized
gcgggcagatcacctgaggt

SEQ ID NO: 439301 - DNA, 20 bp, Artificial Sequence
  chemically synthesized
caaggcgggcagatcacctg

SEQ ID NO: 439302 - DNA, 20 bp, Artificial Sequence
  chemically synthesized
ccaaggcgggcagatcacct

SEQ ID NO: 439303 - DNA, 20 bp, Artificial Sequence
  chemically synthesized
ctcaggtgatctgcccgcct

SEQ ID NO: 439304 - DNA, 20 bp, Artificial Sequence
  chemically synthesized
ctttgggaggccaaggcggg

SEQ ID NO: 439305 - DNA, 20 bp, Artificial Sequence
  chemically synthesized
acactttgggaggccaaggc

SEQ ID NO: 439306 - DNA, 20 bp, Artificial Sequence
  chemically synthesized
aacactttgggaggccaagg

SEQ ID NO: 439307 - DNA, 20 bp, Artificial Sequence
  chemically synthesized
cccaacactttgggaggcca

SEQ ID NO: 439308 - DNA, 20 bp, Artificial Sequence
  chemically synthesized
tcccaacactttgggaggcc

SEQ ID NO: 439309 - DNA, 20 bp, Artificial Sequence
  chemically synthesized
ctgcccgccttggcctccca

SEQ ID NO: 439310 - DNA, 20 bp, Artificial Sequence
  chemically synthesized
tgtaatcccaacactttggg

SEQ ID NO: 439311 - DNA, 20 bp, Artificial Sequence
  chemically synthesized
ctgtaatcccaacactttgg

SEQ ID NO: 439312 - DNA, 20 bp, Artificial Sequence
  chemically synthesized
gccttggcctcccaaagtgt

SEQ ID NO: 439313 - DNA, 20 bp, Artificial Sequence
  chemically synthesized
gcctgtaatcccaacacttt

SEQ ID NO: 439314 - DNA, 20 bp, Artificial Sequence
  chemically synthesized
ccttggcctcccaaagtgtt

SEQ ID NO: 439315 - DNA, 20 bp, Artificial Sequence
  chemically synthesized
tgcctgtaatcccaacactt

SEQ ID NO: 439316 - DNA, 20 bp, Artificial Sequence
  chemically synthesized
ctcccaaagtgttgggatta

SEQ ID NO: 439317 - DNA, 20 bp, Artificial Sequence
  chemically synthesized
tcccaaagtgttgggattac

SEQ ID NO: 439318 - DNA, 20 bp, Artificial Sequence
  chemically synthesized
agtgttgggattacaggcat

SEQ ID NO: 439319 - DNA, 20 bp, Artificial Sequence
  chemically synthesized
caggcatgagccaccgcgac

SEQ ID NO: 439320 - DNA, 20 bp, Artificial Sequence
  chemically synthesized
tggttattggctggtcgcgg

SEQ ID NO: 439321 - DNA, 20 bp, Artificial Sequence
  chemically synthesized
tattggttattggctggtcg

SEQ ID NO: 439322 - DNA, 20 bp, Artificial Sequence
  chemically synthesized
aaagcctattggttattggc

SEQ ID NO: 439323 - DNA, 20 bp, Artificial Sequence
  chemically synthesized
attaaaagcctattggttat

SEQ ID NO: 439324 - DNA, 20 bp, Artificial Sequence
  chemically synthesized
cgcgaccagccaataaccaa

SEQ ID NO: 439325 - DNA, 20 bp, Artificial Sequence
  chemically synthesized
gcgaccagccaataaccaat

SEQ ID NO: 439326 - DNA, 20 bp, Artificial Sequence
  chemically synthesized
atttcaaattaaaagcctat

SEQ ID NO: 439327 - DNA, 20 bp, Artificial Sequence
  chemically synthesized
aataatttatttcaaattaa

SEQ ID NO: 439328 - DNA, 20 bp, Artificial Sequence
  chemically synthesized
tttaatttgaaataaattat

SEQ ID NO: 439329 - DNA, 20 bp, Artificial Sequence
  chemically synthesized
ttaatttgaaataaattatt

SEQ ID NO: 439330 - DNA, 20 bp, Artificial Sequence
  chemically synthesized
taatttgaaataaattattg

SEQ ID NO: 439331 - DNA, 20 bp, Artificial Sequence
  chemically synthesized
atttgaaataaattattggg

SEQ ID NO: 439332 - DNA, 20 bp, Artificial Sequence
  chemically synthesized
ggtgggaggcaaagggaagt

SEQ ID NO: 439333 - DNA, 20 bp, Artificial Sequence
  chemically synthesized
tgagggtgggaggcaaaggg

SEQ ID NO: 439334 - DNA, 20 bp, Artificial Sequence
  chemically synthesized
aaatgagggtgggaggcaaa

SEQ ID NO: 439335 - DNA, 20 bp, Artificial Sequence
  chemically synthesized
taaatgagggtgggaggcaa

SEQ ID NO: 439336 - DNA, 20 bp, Artificial Sequence
  chemically synthesized
ataaatgagggtgggaggca

SEQ ID NO: 439337 - DNA, 20 bp, Artificial Sequence
  chemically synthesized
gatgtataaatgagggtggg

SEQ ID NO: 439338 - DNA, 20 bp, Artificial Sequence
  chemically synthesized
agatgtataaatgagggtgg

SEQ ID NO: 439339 - DNA, 20 bp, Artificial Sequence
  chemically synthesized
caagatgtataaatgagggt

SEQ ID NO: 439340 - DNA, 20 bp, Artificial Sequence
  chemically synthesized
tcaagatgtataaatgaggg

SEQ ID NO: 439341 - DNA, 20 bp, Artificial Sequence
  chemically synthesized
tattcaagatgtataaatga

SEQ ID NO: 439342 - DNA, 20 bp, Artificial Sequence
  chemically synthesized
ttattcaagatgtataaatg

SEQ ID NO: 439343 - DNA, 20 bp, Artificial Sequence
  chemically synthesized
attattcaagatgtataaat

SEQ ID NO: 439344 - DNA, 20 bp, Artificial Sequence
  chemically synthesized
gtgatggaacagaattattc

SEQ ID NO: 439345 - DNA, 20 bp, Artificial Sequence
  chemically synthesized
tgtcagagatcgtgatggaa

SEQ ID NO: 439346 - DNA, 20 bp, Artificial Sequence
  chemically synthesized
aataatgtcagagatcgtga

SEQ ID NO: 439347 - DNA, 20 bp, Artificial Sequence
  chemically synthesized
catatttaaaaataatgtca

SEQ ID NO: 439348 - DNA, 20 bp, Artificial Sequence
  chemically synthesized
tacatatttaaaaataatgt

SEQ ID NO: 439349 - DNA, 20 bp, Artificial Sequence
  chemically synthesized
tgacattatttttaaatatg

SEQ ID NO: 439350 - DNA, 20 bp, Artificial Sequence
  chemically synthesized
tgcattcattacctctttat

SEQ ID NO: 439351 - DNA, 20 bp, Artificial Sequence
  chemically synthesized
tattctctcatctcataaag

SEQ ID NO: 439352 - DNA, 20 bp, Artificial Sequence
  chemically synthesized
ttattctctcatctcataaa

SEQ ID NO: 439353 - DNA, 20 bp, Artificial Sequence
  chemically synthesized
ttttattctctcatctcata

SEQ ID NO: 439354 - DNA, 20 bp, Artificial Sequence
  chemically synthesized
tcattacctctttatgagat

SEQ ID NO: 439355 - DNA, 20 bp, Artificial Sequence
  chemically synthesized
attacctctttatgagatga

SEQ ID NO: 439356 - DNA, 20 bp, Artificial Sequence
  chemically synthesized
agagaataaaattgcttgtg

SEQ ID NO: 439357 - DNA, 20 bp, Artificial Sequence
  chemically synthesized
aataaaattgcttgtgaagt

SEQ ID NO: 439358 - DNA, 20 bp, Artificial Sequence
  chemically synthesized
ctgagtttctctgacttcac

SEQ ID NO: 439359 - DNA, 20 bp, Artificial Sequence
  chemically synthesized
taaaattgcttgtgaagtca

SEQ ID NO: 439360 - DNA, 20 bp, Artificial Sequence
  chemically synthesized
cttgtgaagtcagagaaact

SEQ ID NO: 439361 - DNA, 20 bp, Artificial Sequence
  chemically synthesized
atatgattagaaataatact

SEQ ID NO: 439362 - DNA, 20 bp, Artificial Sequence
  chemically synthesized
ggcattctcatatatatgat

SEQ ID NO: 439363 - DNA, 20 bp, Artificial Sequence
  chemically synthesized
ttatttctaatcatatatat

SEQ ID NO: 439364 - DNA, 20 bp, Artificial Sequence
  chemically synthesized
ctgtacgataacgtcaacat

SEQ ID NO: 439365 - DNA, 20 bp, Artificial Sequence
  chemically synthesized
ccaatgttgacgttatcgta

SEQ ID NO: 439366 - DNA, 20 bp, Artificial Sequence
  chemically synthesized
aatgttgacgttatcgtaca

SEQ ID NO: 439367 - DNA, 20 bp, Artificial Sequence
  chemically synthesized
gagtgcacattgcttaactc

SEQ ID NO: 439368 - DNA, 20 bp, Artificial Sequence
  chemically synthesized
agtgcacattgcttaactcc

SEQ ID NO: 439369 - DNA, 20 bp, Artificial Sequence
  chemically synthesized
gtgcacattgcttaactcca

SEQ ID NO: 439370 - DNA, 20 bp, Artificial Sequence
  chemically synthesized
taaatgacacccctggagtt

SEQ ID NO: 439371 - DNA, 20 bp, Artificial Sequence
  chemically synthesized
tgcacattgcttaactccag

SEQ ID NO: 439372 - DNA, 20 bp, Artificial Sequence
  chemically synthesized
tgaggtaaatgacacccctg

SEQ ID NO: 439373 - DNA, 20 bp, Artificial Sequence
  chemically synthesized
tatgaggtaaatgacacccc

SEQ ID NO: 439374 - DNA, 20 bp, Artificial Sequence
  chemically synthesized
caggggtgtcatttacctca

SEQ ID NO: 439375 - DNA, 20 bp, Artificial Sequence
  chemically synthesized
actattaatattatgctatg

SEQ ID NO: 439376 - DNA, 20 bp, Artificial Sequence
  chemically synthesized
gactattaatattatgctat

SEQ ID NO: 439377 - DNA, 20 bp, Artificial Sequence
  chemically synthesized
acctcatagcataatattaa

SEQ ID NO: 439378 - DNA, 20 bp, Artificial Sequence
  chemically synthesized
atattaatagtccacgttac

SEQ ID NO: 439379 - DNA, 20 bp, Artificial Sequence
  chemically synthesized
tctagagtgtaccagtaacg

SEQ ID NO: 439380 - DNA, 20 bp, Artificial Sequence
  chemically synthesized
tgtacaattctagagtgtac

SEQ ID NO: 439381 - DNA, 20 bp, Artificial Sequence
  chemically synthesized
tccacgttactggtacactc

SEQ ID NO: 439382 - DNA, 20 bp, Artificial Sequence
  chemically synthesized
gtgtacactgtacaattcta

SEQ ID NO: 439383 - DNA, 20 bp, Artificial Sequence
  chemically synthesized
tagtgtacactgtacaattc

SEQ ID NO: 439384 - DNA, 20 bp, Artificial Sequence
  chemically synthesized
tggtacactctagaattgta

SEQ ID NO: 439385 - DNA, 20 bp, Artificial Sequence
  chemically synthesized
tttagttgcatacattcata

SEQ ID NO: 439386 - DNA, 20 bp, Artificial Sequence
  chemically synthesized
gtcatccacagtgtgatatt

SEQ ID NO: 439387 - DNA, 20 bp, Artificial Sequence
  chemically synthesized
tgcaactaaatatcacactg

SEQ ID NO: 439388 - DNA, 20 bp, Artificial Sequence
  chemically synthesized
ttcattatgttagtcatcca

SEQ ID NO: 439389 - DNA, 20 bp, Artificial Sequence
  chemically synthesized
ttctcttatcttcattatgt

SEQ ID NO: 439390 - DNA, 20 bp, Artificial Sequence
  chemically synthesized
tgtggatgactaacataatg

SEQ ID NO: 439391 - DNA, 20 bp, Artificial Sequence
  chemically synthesized
atgactaacataatgaagat

SEQ ID NO: 439392 - DNA, 20 bp, Artificial Sequence
  chemically synthesized
gactaacataatgaagataa

SEQ ID NO: 439393 - DNA, 20 bp, Artificial Sequence
  chemically synthesized
aatgaagataagagaaaaat

SEQ ID NO: 439394 - DNA, 20 bp, Artificial Sequence
  chemically synthesized
gaaaaattagtttatgtaaa

SEQ ID NO: 439395 - DNA, 20 bp, Artificial Sequence
  chemically synthesized
aaaaattagtttatgtaaaa

SEQ ID NO: 439396 - DNA, 20 bp, Artificial Sequence
  chemically synthesized
tagtttatgtaaaaaggcaa

SEQ ID NO: 439397 - DNA, 20 bp, Artificial Sequence
  chemically synthesized
taaaaaggcaacagtaatta

SEQ ID NO: 439398 - DNA, 20 bp, Artificial Sequence
  chemically synthesized
gcataaacagtaggttattt

SEQ ID NO: 439399 - DNA, 20 bp, Artificial Sequence
  chemically synthesized
tagtacttggcataaacagt

SEQ ID NO: 439400 - DNA, 20 bp, Artificial Sequence
  chemically synthesized
atagtacttggcataaacag

SEQ ID NO: 439401 - DNA, 20 bp, Artificial Sequence
  chemically synthesized
tgaatagtacttggcataaa

SEQ ID NO: 439402 - DNA, 20 bp, Artificial Sequence
  chemically synthesized
aataacctactgtttatgcc

SEQ ID NO: 439403 - DNA, 20 bp, Artificial Sequence
  chemically synthesized
atactattctgaatagtact

SEQ ID NO: 439404 - DNA, 20 bp, Artificial Sequence
  chemically synthesized
tgtttatgccaagtactatt

SEQ ID NO: 439405 - DNA, 20 bp, Artificial Sequence
  chemically synthesized
atgccaagtactattcagaa

SEQ ID NO: 439406 - DNA, 20 bp, Artificial Sequence
  chemically synthesized
acgtgccatactattctgaa

SEQ ID NO: 439407 - DNA, 20 bp, Artificial Sequence
  chemically synthesized
aagtactattcagaatagta

SEQ ID NO: 439408 - DNA, 20 bp, Artificial Sequence
  chemically synthesized
ttgtaaaaaaatggtttaca

SEQ ID NO: 439409 - DNA, 20 bp, Artificial Sequence
  chemically synthesized
gatttagtattgtaaaaaaa

SEQ ID NO: 439410 - DNA, 20 bp, Artificial Sequence
  chemically synthesized
gggctaacctgaacatgatt

SEQ ID NO: 439411 - DNA, 20 bp, Artificial Sequence
  chemically synthesized
ttacaatactaaatcatgtt

SEQ ID NO: 439412 - DNA, 20 bp, Artificial Sequence
  chemically synthesized
tacaatactaaatcatgttc

SEQ ID NO: 439413 - DNA, 20 bp, Artificial Sequence
  chemically synthesized
atactaaatcatgttcaggt

SEQ ID NO: 439414 - DNA, 20 bp, Artificial Sequence
  chemically synthesized
aaatcatgttcaggttagcc

SEQ ID NO: 439415 - DNA, 20 bp, Artificial Sequence
  chemically synthesized
gttcaggttagcccagttct

SEQ ID NO: 439416 - DNA, 20 bp, Artificial Sequence
  chemically synthesized
tgaacaaaaagctaagaact

SEQ ID NO: 439417 - DNA, 20 bp, Artificial Sequence
  chemically synthesized
atgaacaaaaagctaagaac

SEQ ID NO: 439418 - DNA, 20 bp, Artificial Sequence
  chemically synthesized
tgctacatgaacaaaaagct

SEQ ID NO: 439419 - DNA, 20 bp, Artificial Sequence
  chemically synthesized
aactgtgctacatgaacaaa

SEQ ID NO: 439420 - DNA, 20 bp, Artificial Sequence
  chemically synthesized
ttcttagctttttgttcatg

SEQ ID NO: 439421 - DNA, 20 bp, Artificial Sequence
  chemically synthesized
agctttttgttcatgtagca

SEQ ID NO: 439422 - DNA, 20 bp, Artificial Sequence
  chemically synthesized
agtttatttcagttatgtac

SEQ ID NO: 439423 - DNA, 20 bp, Artificial Sequence
  chemically synthesized
gagtttatttcagttatgta

SEQ ID NO: 439424 - DNA, 20 bp, Artificial Sequence
  chemically synthesized
tgttcttttagagtttattt

SEQ ID NO: 439425 - DNA, 20 bp, Artificial Sequence
  chemically synthesized
ataactgaaataaactctaa

SEQ ID NO: 439426 - DNA, 20 bp, Artificial Sequence
  chemically synthesized
tctcactagttgttctttta

SEQ ID NO: 439427 - DNA, 20 bp, Artificial Sequence
  chemically synthesized
ggtctcactagttgttcttt

SEQ ID NO: 439428 - DNA, 20 bp, Artificial Sequence
  chemically synthesized
ataaactctaaaagaacaac

SEQ ID NO: 439429 - DNA, 20 bp, Artificial Sequence
  chemically synthesized
actctaaaagaacaactagt

SEQ ID NO: 439430 - DNA, 20 bp, Artificial Sequence
  chemically synthesized
catccttagagtggtctcac

SEQ ID NO: 439431 - DNA, 20 bp, Artificial Sequence
  chemically synthesized
acaactagtgagaccactct

SEQ ID NO: 439432 - DNA, 20 bp, Artificial Sequence
  chemically synthesized
caactagtgagaccactcta

SEQ ID NO: 439433 - DNA, 20 bp, Artificial Sequence
  chemically synthesized
acagttagccatccttagag

SEQ ID NO: 439434 - DNA, 20 bp, Artificial Sequence
  chemically synthesized
tagtgagaccactctaagga

SEQ ID NO: 439435 - DNA, 20 bp, Artificial Sequence
  chemically synthesized
tctacagttagccatcctta

SEQ ID NO: 439436 - DNA, 20 bp, Artificial Sequence
  chemically synthesized
catctacagttagccatcct

SEQ ID NO: 439437 - DNA, 20 bp, Artificial Sequence
  chemically synthesized
actctaaggatggctaactg

SEQ ID NO: 439438 - DNA, 20 bp, Artificial Sequence
  chemically synthesized
tgtttgtaatcatctacagt

SEQ ID NO: 439439 - DNA, 20 bp, Artificial Sequence
  chemically synthesized
ggtttgtttgtaatcatcta

SEQ ID NO: 439440 - DNA, 20 bp, Artificial Sequence
  chemically synthesized
gtagatgattacaaacaaac

SEQ ID NO: 439441 - DNA, 20 bp, Artificial Sequence
  chemically synthesized
tagatgattacaaacaaacc

SEQ ID NO: 439442 - DNA, 20 bp, Artificial Sequence
  chemically synthesized
agatgattacaaacaaacca

SEQ ID NO: 439443 - DNA, 20 bp, Artificial Sequence
  chemically synthesized
aaataaaactaatgcagccc

SEQ ID NO: 439444 - DNA, 20 bp, Artificial Sequence
  chemically synthesized
caaacaaaccagggctgcat

SEQ ID NO: 439445 - DNA, 20 bp, Artificial Sequence
  chemically synthesized
gatcaaaaataaaactaatg

SEQ ID NO: 439446 - DNA, 20 bp, Artificial Sequence
  chemically synthesized
cttactttgtgaagatgaaa

SEQ ID NO: 439447 - DNA, 20 bp, Artificial Sequence
  chemically synthesized
tgatctttttcatcttcaca

SEQ ID NO: 439448 - DNA, 20 bp, Artificial Sequence
  chemically synthesized
ctcactcttcttactttgtg

SEQ ID NO: 439449 - DNA, 20 bp, Artificial Sequence
  chemically synthesized
ctttttcatcttcacaaagt

SEQ ID NO: 439450 - DNA, 20 bp, Artificial Sequence
  chemically synthesized
tttcatcttcacaaagtaag

SEQ ID NO: 439451 - DNA, 20 bp, Artificial Sequence
  chemically synthesized
tcatcttcacaaagtaagaa

SEQ ID NO: 439452 - DNA, 20 bp, Artificial Sequence
  chemically synthesized
cttcacaaagtaagaagagt

SEQ ID NO: 439453 - DNA, 20 bp, Artificial Sequence
  chemically synthesized
acaaagtaagaagagtgaga

SEQ ID NO: 439454 - DNA, 20 bp, Artificial Sequence
  chemically synthesized
tagtaataaaattgtgaaac

SEQ ID NO: 439455 - DNA, 20 bp, Artificial Sequence
  chemically synthesized
gtgaaacaagataactgtta

SEQ ID NO: 439456 - DNA, 20 bp, Artificial Sequence
  chemically synthesized
gtctatgataatatccataa

SEQ ID NO: 439457 - DNA, 20 bp, Artificial Sequence
  chemically synthesized
aactgttatggatattatca

SEQ ID NO: 439458 - DNA, 20 bp, Artificial Sequence
  chemically synthesized
gttatggatattatcataga

SEQ ID NO: 439459 - DNA, 20 bp, Artificial Sequence
  chemically synthesized
tcatagacagctccctatgc

SEQ ID NO: 439460 - DNA, 20 bp, Artificial Sequence
  chemically synthesized
attctctagacttgcatagg

SEQ ID NO: 439461 - DNA, 20 bp, Artificial Sequence
  chemically synthesized
ccattctctagacttgcata

SEQ ID NO: 439462 - DNA, 20 bp, Artificial Sequence
  chemically synthesized
cccattctctagacttgcat

SEQ ID NO: 439463 - DNA, 20 bp, Artificial Sequence
  chemically synthesized
gcccattctctagacttgca

SEQ ID NO: 439464 - DNA, 20 bp, Artificial Sequence
  chemically synthesized
gacagctccctatgcaagtc

SEQ ID NO: 439465 - DNA, 20 bp, Artificial Sequence
  chemically synthesized
cagctccctatgcaagtcta

SEQ ID NO: 439466 - DNA, 20 bp, Artificial Sequence
  chemically synthesized
ccctatgcaagtctagagaa

SEQ ID NO: 439467 - DNA, 20 bp, Artificial Sequence
  chemically synthesized
cctatgcaagtctagagaat

SEQ ID NO: 439468 - DNA, 20 bp, Artificial Sequence
  chemically synthesized
aataactcatgcccattctc

SEQ ID NO: 439469 - DNA, 20 bp, Artificial Sequence
  chemically synthesized
caagtctagagaatgggcat

SEQ ID NO: 439470 - DNA, 20 bp, Artificial Sequence
  chemically synthesized
gagaatgggcatgagttatt

SEQ ID NO: 439471 - DNA, 20 bp, Artificial Sequence
  chemically synthesized
agaatgggcatgagttattt

SEQ ID NO: 439472 - DNA, 20 bp, Artificial Sequence
  chemically synthesized
atgagttatttaggatatct

SEQ ID NO: 439473 - DNA, 20 bp, Artificial Sequence
  chemically synthesized
tattttcttagataaaaact

SEQ ID NO: 439474 - DNA, 20 bp, Artificial Sequence
  chemically synthesized
ggatatctcagtttttatct

SEQ ID NO: 439475 - DNA, 20 bp, Artificial Sequence
  chemically synthesized
attggcatattatattttct

SEQ ID NO: 439476 - DNA, 20 bp, Artificial Sequence
  chemically synthesized
atataatatgccaatgtcta

SEQ ID NO: 439477 - DNA, 20 bp, Artificial Sequence
  chemically synthesized
tactcaaagcctatagacat

SEQ ID NO: 439478 - DNA, 20 bp, Artificial Sequence
  chemically synthesized
tataatatgccaatgtctat

SEQ ID NO: 439479 - DNA, 20 bp, Artificial Sequence
  chemically synthesized
ggttgtttactcaaagccta

SEQ ID NO: 439480 - DNA, 20 bp, Artificial Sequence
  chemically synthesized
tgccaatgtctataggcttt

SEQ ID NO: 439481 - DNA, 20 bp, Artificial Sequence
  chemically synthesized
aattttgggttgtttactca

SEQ ID NO: 439482 - DNA, 20 bp, Artificial Sequence
  chemically synthesized
ataaaacccattaaaatttt

SEQ ID NO: 439483 - DNA, 20 bp, Artificial Sequence
  chemically synthesized
aataaaacccattaaaattt

SEQ ID NO: 439484 - DNA, 20 bp, Artificial Sequence
  chemically synthesized
taaacaacccaaaattttaa

SEQ ID NO: 439485 - DNA, 20 bp, Artificial Sequence
  chemically synthesized
aaacaacccaaaattttaat

SEQ ID NO: 439486 - DNA, 20 bp, Artificial Sequence
  chemically synthesized
tttaatgggttttattttta

SEQ ID NO: 439487 - DNA, 20 bp, Artificial Sequence
  chemically synthesized
taatgggttttatttttaaa

SEQ ID NO: 439488 - DNA, 20 bp, Artificial Sequence
  chemically synthesized
tttttaaagagcatcctcaa

SEQ ID NO: 439489 - DNA, 20 bp, Artificial Sequence
  chemically synthesized
ttttaaagagcatcctcaat

SEQ ID NO: 439490 - DNA, 20 bp, Artificial Sequence
  chemically synthesized
gaactagacatgtcccattg

SEQ ID NO: 439491 - DNA, 20 bp, Artificial Sequence
  chemically synthesized
agaactagacatgtcccatt

SEQ ID NO: 439492 - DNA, 20 bp, Artificial Sequence
  chemically synthesized
catcctcaatgggacatgtc

SEQ ID NO: 439493 - DNA, 20 bp, Artificial Sequence
  chemically synthesized
tagtatcttctaacaagaac

SEQ ID NO: 439494 - DNA, 20 bp, Artificial Sequence
  chemically synthesized
gggacatgtctagttcttgt

SEQ ID NO: 439495 - DNA, 20 bp, Artificial Sequence
  chemically synthesized
acatgtctagttcttgttag

SEQ ID NO: 439496 - DNA, 20 bp, Artificial Sequence
  chemically synthesized
gaatcatagtatcttctaac

SEQ ID NO: 439497 - DNA, 20 bp, Artificial Sequence
  chemically synthesized
atataaaatggcaggaatca

SEQ ID NO: 439498 - DNA, 20 bp, Artificial Sequence
  chemically synthesized
agaacaaaatataaaatggc

SEQ ID NO: 439499 - DNA, 20 bp, Artificial Sequence
  chemically synthesized
tagaacaaaatataaaatgg

SEQ ID NO: 439500 - DNA, 20 bp, Artificial Sequence
  chemically synthesized
ggatagaacaaaatataaaa

SEQ ID NO: 439501 - DNA, 20 bp, Artificial Sequence
  chemically synthesized
atattttgttctatcctttt

SEQ ID NO: 439502 - DNA, 20 bp, Artificial Sequence
  chemically synthesized
taatagaattctaaaaagga

SEQ ID NO: 439503 - DNA, 20 bp, Artificial Sequence
  chemically synthesized
attttaatagaattctaaaa

SEQ ID NO: 439504 - DNA, 20 bp, Artificial Sequence
  chemically synthesized
gattttaatagaattctaaa

SEQ ID NO: 439505 - DNA, 20 bp, Artificial Sequence
  chemically synthesized
cacgatctctcagattttaa

SEQ ID NO: 439506 - DNA, 20 bp, Artificial Sequence
  chemically synthesized
ttagaattctattaaaatct

SEQ ID NO: 439507 - DNA, 20 bp, Artificial Sequence
  chemically synthesized
agaattctattaaaatctga

SEQ ID NO: 439508 - DNA, 20 bp, Artificial Sequence
  chemically synthesized
agtcagttgtcacgatctct

SEQ ID NO: 439509 - DNA, 20 bp, Artificial Sequence
  chemically synthesized
gagagatcgtgacaactgac

SEQ ID NO: 439510 - DNA, 20 bp, Artificial Sequence
  chemically synthesized
atcgtgacaactgactggtt

SEQ ID NO: 439511 - DNA, 20 bp, Artificial Sequence
  chemically synthesized
attaaagattcttaaccagt

SEQ ID NO: 439512 - DNA, 20 bp, Artificial Sequence
  chemically synthesized
taggattaaagattcttaac

SEQ ID NO: 439513 - DNA, 20 bp, Artificial Sequence
  chemically synthesized
gcagcatgacagtaggatta

SEQ ID NO: 439514 - DNA, 20 bp, Artificial Sequence
  chemically synthesized
aatggtggcagcatgacagt

SEQ ID NO: 439515 - DNA, 20 bp, Artificial Sequence
  chemically synthesized
taatggtggcagcatgacag

SEQ ID NO: 439516 - DNA, 20 bp, Artificial Sequence
  chemically synthesized
ttttaatggtggcagcatga

SEQ ID NO: 439517 - DNA, 20 bp, Artificial Sequence
  chemically synthesized
agtcaggattttaatggtgg

SEQ ID NO: 439518 - DNA, 20 bp, Artificial Sequence
  chemically synthesized
tagagtcaggattttaatgg

SEQ ID NO: 439519 - DNA, 20 bp, Artificial Sequence
  chemically synthesized
tggtagagtcaggattttaa

SEQ ID NO: 439520 - DNA, 20 bp, Artificial Sequence
  chemically synthesized
agctggtacgtggtagagtc

SEQ ID NO: 439521 - DNA, 20 bp, Artificial Sequence
  chemically synthesized
cagctggtacgtggtagagt

SEQ ID NO: 439522 - DNA, 20 bp, Artificial Sequence
  chemically synthesized
agctcagctggtacgtggta

SEQ ID NO: 439523 - DNA, 20 bp, Artificial Sequence
  chemically synthesized
gtagctcagctggtacgtgg

SEQ ID NO: 439524 - DNA, 20 bp, Artificial Sequence
  chemically synthesized
atcctgactctaccacgtac

SEQ ID NO: 439525 - DNA, 20 bp, Artificial Sequence
  chemically synthesized
aaggtagctcagctggtacg

SEQ ID NO: 439526 - DNA, 20 bp, Artificial Sequence
  chemically synthesized
gactctaccacgtaccagct

SEQ ID NO: 439527 - DNA, 20 bp, Artificial Sequence
  chemically synthesized
tttgcttaaggtagctcagc

SEQ ID NO: 439528 - DNA, 20 bp, Artificial Sequence
  chemically synthesized
gtaatttgcttaaggtagct

SEQ ID NO: 439529 - DNA, 20 bp, Artificial Sequence
  chemically synthesized
cgtaccagctgagctacctt

SEQ ID NO: 439530 - DNA, 20 bp, Artificial Sequence
  chemically synthesized
attaagtaatttgcttaagg

SEQ ID NO: 439531 - DNA, 20 bp, Artificial Sequence
  chemically synthesized
gagattaagtaatttgctta

SEQ ID NO: 439532 - DNA, 20 bp, Artificial Sequence
  chemically synthesized
ggagattaagtaatttgctt

SEQ ID NO: 439533 - DNA, 20 bp, Artificial Sequence
  chemically synthesized
tgtagaggtacagggagatt

SEQ ID NO: 439534 - DNA, 20 bp, Artificial Sequence
  chemically synthesized
tgaatatgtagaggtacagg

SEQ ID NO: 439535 - DNA, 20 bp, Artificial Sequence
  chemically synthesized
gatgaatatgtagaggtaca

SEQ ID NO: 439536 - DNA, 20 bp, Artificial Sequence
  chemically synthesized
agatgaatatgtagaggtac

SEQ ID NO: 439537 - DNA, 20 bp, Artificial Sequence
  chemically synthesized
cagatgaatatgtagaggta

SEQ ID NO: 439538 - DNA, 20 bp, Artificial Sequence
  chemically synthesized
tttaccagatgaatatgtag

SEQ ID NO: 439539 - DNA, 20 bp, Artificial Sequence
  chemically synthesized
atttaccagatgaatatgta

SEQ ID NO: 439540 - DNA, 20 bp, Artificial Sequence
  chemically synthesized
aaatttaccagatgaatatg

SEQ ID NO: 439541 - DNA, 20 bp, Artificial Sequence
  chemically synthesized
tgtacctctacatattcatc

SEQ ID NO: 439542 - DNA, 20 bp, Artificial Sequence
  chemically synthesized
acatattcatctggtaaatt

SEQ ID NO: 439543 - DNA, 20 bp, Artificial Sequence
  chemically synthesized
acataatcatctaaatttac

SEQ ID NO: 439544 - DNA, 20 bp, Artificial Sequence
  chemically synthesized
gattatgtttccccaccttc

SEQ ID NO: 439545 - DNA, 20 bp, Artificial Sequence
  chemically synthesized
catattaactctagaaggtg

SEQ ID NO: 439546 - DNA, 20 bp, Artificial Sequence
  chemically synthesized
ccatattaactctagaaggt

SEQ ID NO: 439547 - DNA, 20 bp, Artificial Sequence
  chemically synthesized
ttatgtttccccaccttcta

SEQ ID NO: 439548 - DNA, 20 bp, Artificial Sequence
  chemically synthesized
tccatattaactctagaagg

SEQ ID NO: 439549 - DNA, 20 bp, Artificial Sequence
  chemically synthesized
agttccatattaactctaga

SEQ ID NO: 439550 - DNA, 20 bp, Artificial Sequence
  chemically synthesized
aagttccatattaactctag

SEQ ID NO: 439551 - DNA, 20 bp, Artificial Sequence
  chemically synthesized
gataagttccatattaactc

SEQ ID NO: 439552 - DNA, 20 bp, Artificial Sequence
  chemically synthesized
cccaccttctagagttaata

SEQ ID NO: 439553 - DNA, 20 bp, Artificial Sequence
  chemically synthesized
acatcacatacatatgtgat

SEQ ID NO: 439554 - DNA, 20 bp, Artificial Sequence
  chemically synthesized
acatatgtatgtgatgtaat

SEQ ID NO: 439555 - DNA, 20 bp, Artificial Sequence
  chemically synthesized
atatgtatgtgatgtaatca

SEQ ID NO: 439556 - DNA, 20 bp, Artificial Sequence
  chemically synthesized
tgtatgtgatgtaatcagag

SEQ ID NO: 439557 - DNA, 20 bp, Artificial Sequence
  chemically synthesized
acaagcctgtaataagtgtc

SEQ ID NO: 439558 - DNA, 20 bp, Artificial Sequence
  chemically synthesized
aacaagcctgtaataagtgt

SEQ ID NO: 439559 - DNA, 20 bp, Artificial Sequence
  chemically synthesized
gaagtgcctgacacttatta

SEQ ID NO: 439560 - DNA, 20 bp, Artificial Sequence
  chemically synthesized
aagtgcctgacacttattac

SEQ ID NO: 439561 - DNA, 20 bp, Artificial Sequence
  chemically synthesized
ccatttaacaagcctgtaat

SEQ ID NO: 439562 - DNA, 20 bp, Artificial Sequence
  chemically synthesized
cttattacaggcttgttaaa

SEQ ID NO: 439563 - DNA, 20 bp, Artificial Sequence
  chemically synthesized
tactgtatttaccatttaac

SEQ ID NO: 439564 - DNA, 20 bp, Artificial Sequence
  chemically synthesized
ggcttgttaaatggtaaata

SEQ ID NO: 439565 - DNA, 20 bp, Artificial Sequence
  chemically synthesized
taaatacagtattatcattg

SEQ ID NO: 439566 - DNA, 20 bp, Artificial Sequence
  chemically synthesized
acagtattatcattgaagat

SEQ ID NO: 439567 - DNA, 20 bp, Artificial Sequence
  chemically synthesized
cagtattatcattgaagatt

SEQ ID NO: 439568 - DNA, 20 bp, Artificial Sequence
  chemically synthesized
cattgaagattaggtgaatc

SEQ ID NO: 439569 - DNA, 20 bp, Artificial Sequence
  chemically synthesized
aagattaggtgaatctagaa

SEQ ID NO: 439570 - DNA, 20 bp, Artificial Sequence
  chemically synthesized
gtgtgtgcatagcactattc

SEQ ID NO: 439571 - DNA, 20 bp, Artificial Sequence
  chemically synthesized
gacagtaccttgtgtgtgca

SEQ ID NO: 439572 - DNA, 20 bp, Artificial Sequence
  chemically synthesized
gaatagtgctatgcacacac

SEQ ID NO: 439573 - DNA, 20 bp, Artificial Sequence
  chemically synthesized
aatagtgctatgcacacaca

SEQ ID NO: 439574 - DNA, 20 bp, Artificial Sequence
  chemically synthesized
cacacacaaggtactgtcaa

SEQ ID NO: 439575 - DNA, 20 bp, Artificial Sequence
  chemically synthesized
cttacatacacagctattga

SEQ ID NO: 439576 - DNA, 20 bp, Artificial Sequence
  chemically synthesized
ctgtcaatagctgtgtatgt

SEQ ID NO: 439577 - DNA, 20 bp, Artificial Sequence
  chemically synthesized
attgatctgtcttacataca

SEQ ID NO: 439578 - DNA, 20 bp, Artificial Sequence
  chemically synthesized
caatagctgtgtatgtaaga

SEQ ID NO: 439579 - DNA, 20 bp, Artificial Sequence
  chemically synthesized
caagaagcagtgaggcaaaa

SEQ ID NO: 439580 - DNA, 20 bp, Artificial Sequence
  chemically synthesized
gcaagaagcagtgaggcaaa

SEQ ID NO: 439581 - DNA, 20 bp, Artificial Sequence
  chemically synthesized
aatgattgcaagaagcagtg

SEQ ID NO: 439582 - DNA, 20 bp, Artificial Sequence
  chemically synthesized
gaatgattgcaagaagcagt

SEQ ID NO: 439583 - DNA, 20 bp, Artificial Sequence
  chemically synthesized
tagagaatgattgcaagaag

SEQ ID NO: 439584 - DNA, 20 bp, Artificial Sequence
  chemically synthesized
aattagagaatgattgcaag

SEQ ID NO: 439585 - DNA, 20 bp, Artificial Sequence
  chemically synthesized
gtgaattagagaatgattgc

SEQ ID NO: 439586 - DNA, 20 bp, Artificial Sequence
  chemically synthesized
acatacagagatgtgaatta

SEQ ID NO: 439587 - DNA, 20 bp, Artificial Sequence
  chemically synthesized
ggacatacagagatgtgaat

SEQ ID NO: 439588 - DNA, 20 bp, Artificial Sequence
  chemically synthesized
cataagagtatggacataca

SEQ ID NO: 439589 - DNA, 20 bp, Artificial Sequence
  chemically synthesized
ggcataagagtatggacata

SEQ ID NO: 439590 - DNA, 20 bp, Artificial Sequence
  chemically synthesized
tataaataggcataagagta

SEQ ID NO: 439591 - DNA, 20 bp, Artificial Sequence
  chemically synthesized
atttttataaataggcataa

SEQ ID NO: 439592 - DNA, 20 bp, Artificial Sequence
  chemically synthesized
ccatttttataaataggcat

SEQ ID NO: 439593 - DNA, 20 bp, Artificial Sequence
  chemically synthesized
aagaatccatttttataaat

SEQ ID NO: 439594 - DNA, 20 bp, Artificial Sequence
  chemically synthesized
gaagaatccatttttataaa

SEQ ID NO: 439595 - DNA, 20 bp, Artificial Sequence
  chemically synthesized
cttatgcctatttataaaaa

SEQ ID NO: 439596 - DNA, 20 bp, Artificial Sequence
  chemically synthesized
ataaaaatggattcttcaat

SEQ ID NO: 439597 - DNA, 20 bp, Artificial Sequence
  chemically synthesized
gattatggacattctcattg

SEQ ID NO: 439598 - DNA, 20 bp, Artificial Sequence
  chemically synthesized
acttatgaatagtgtgatta

SEQ ID NO: 439599 - DNA, 20 bp, Artificial Sequence
  chemically synthesized
tccataatcacactattcat

SEQ ID NO: 439600 - DNA, 20 bp, Artificial Sequence
  chemically synthesized
cataaatgattacttatgaa

SEQ ID NO: 439601 - DNA, 20 bp, Artificial Sequence
  chemically synthesized
atcaagaaagttataaagca

SEQ ID NO: 439602 - DNA, 20 bp, Artificial Sequence
  chemically synthesized
aaaatatcaagaaagttata

SEQ ID NO: 439603 - DNA, 20 bp, Artificial Sequence
  chemically synthesized
actactataaaatatcaaga

SEQ ID NO: 439604 - DNA, 20 bp, Artificial Sequence
  chemically synthesized
tacaactactataaaatatc

SEQ ID NO: 439605 - DNA, 20 bp, Artificial Sequence
  chemically synthesized
ataactttcttgatatttta

SEQ ID NO: 439606 - DNA, 20 bp, Artificial Sequence
  chemically synthesized
actttcttgatattttatag

SEQ ID NO: 439607 - DNA, 20 bp, Artificial Sequence
  chemically synthesized
agcaactctaagtcagagaa

SEQ ID NO: 439608 - DNA, 20 bp, Artificial Sequence
  chemically synthesized
tgtgtatctgttctctgact

SEQ ID NO: 439609 - DNA, 20 bp, Artificial Sequence
  chemically synthesized
tgtatctgttctctgactta

SEQ ID NO: 439610 - DNA, 20 bp, Artificial Sequence
  chemically synthesized
gagacagcaactctaagtca

SEQ ID NO: 439611 - DNA, 20 bp, Artificial Sequence
  chemically synthesized
atgagacagcaactctaagt

SEQ ID NO: 439612 - DNA, 20 bp, Artificial Sequence
  chemically synthesized
ttttatgagacagcaactct

SEQ ID NO: 439613 - DNA, 20 bp, Artificial Sequence
  chemically synthesized
tctctttgctttttatgaga

SEQ ID NO: 439614 - DNA, 20 bp, Artificial Sequence
  chemically synthesized
tagagttgctgtctcataaa

SEQ ID NO: 439615 - DNA, 20 bp, Artificial Sequence
  chemically synthesized
atgttctctttgctttttat

SEQ ID NO: 439616 - DNA, 20 bp, Artificial Sequence
  chemically synthesized
ttgctgtctcataaaaagca

SEQ ID NO: 439617 - DNA, 20 bp, Artificial Sequence
  chemically synthesized
gctgtctcataaaaagcaaa

SEQ ID NO: 439618 - DNA, 20 bp, Artificial Sequence
  chemically synthesized
cataaaaagcaaagagaaca

SEQ ID NO: 439619 - DNA, 20 bp, Artificial Sequence
  chemically synthesized
ataaaaagcaaagagaacat

SEQ ID NO: 439620 - DNA, 20 bp, Artificial Sequence
  chemically synthesized
cataggtgttcaacaatgtt

SEQ ID NO: 439621 - DNA, 20 bp, Artificial Sequence
  chemically synthesized
gttcaacaatgttgagttat

SEQ ID NO: 439622 - DNA, 20 bp, Artificial Sequence
  chemically synthesized
gagcaactttttttaacatt

SEQ ID NO: 439623 - DNA, 20 bp, Artificial Sequence
  chemically synthesized
tgagcaactttttttaacat

SEQ ID NO: 439624 - DNA, 20 bp, Artificial Sequence
  chemically synthesized
taaaaacctaatgttaaaaa

SEQ ID NO: 439625 - DNA, 20 bp, Artificial Sequence
  chemically synthesized
tagaatagtaatatgatatt

SEQ ID NO: 439626 - DNA, 20 bp, Artificial Sequence
  chemically synthesized
tatcatattactattctatc

SEQ ID NO: 439627 - DNA, 20 bp, Artificial Sequence
  chemically synthesized
ggaagtaagactcgatagaa

SEQ ID NO: 439628 - DNA, 20 bp, Artificial Sequence
  chemically synthesized
ttggaggaagtaagactcga

SEQ ID NO: 439629 - DNA, 20 bp, Artificial Sequence
  chemically synthesized
cagttagctttggaggaagt

SEQ ID NO: 439630 - DNA, 20 bp, Artificial Sequence
  chemically synthesized
atcgagtcttacttcctcca

SEQ ID NO: 439631 - DNA, 20 bp, Artificial Sequence
  chemically synthesized
ttatcagttagctttggagg

SEQ ID NO: 439632 - DNA, 20 bp, Artificial Sequence
  chemically synthesized
tacttatcagttagctttgg

SEQ ID NO: 439633 - DNA, 20 bp, Artificial Sequence
  chemically synthesized
gtacttatcagttagctttg

SEQ ID NO: 439634 - DNA, 20 bp, Artificial Sequence
  chemically synthesized
atgtacttatcagttagctt

SEQ ID NO: 439635 - DNA, 20 bp, Artificial Sequence
  chemically synthesized
ttcctccaaagctaactgat

SEQ ID NO: 439636 - DNA, 20 bp, Artificial Sequence
  chemically synthesized
aatgtaatgtacttatcagt

SEQ ID NO: 439637 - DNA, 20 bp, Artificial Sequence
  chemically synthesized
gatgaatgtaatgtacttat

SEQ ID NO: 439638 - DNA, 20 bp, Artificial Sequence
  chemically synthesized
acattacattcatccatgat

SEQ ID NO: 439639 - DNA, 20 bp, Artificial Sequence
  chemically synthesized
tgagtaattcaatctaatca

SEQ ID NO: 439640 - DNA, 20 bp, Artificial Sequence
  chemically synthesized
taaagagatagaaggcattt

SEQ ID NO: 439641 - DNA, 20 bp, Artificial Sequence
  chemically synthesized
aatcacaataaagagataga

SEQ ID NO: 439642 - DNA, 20 bp, Artificial Sequence
  chemically synthesized
gaatcacaataaagagatag

SEQ ID NO: 439643 - DNA, 20 bp, Artificial Sequence
  chemically synthesized
ccagaatcacaataaagaga

SEQ ID NO: 439644 - DNA, 20 bp, Artificial Sequence
  chemically synthesized
aaagccagaatcacaataaa

SEQ ID NO: 439645 - DNA, 20 bp, Artificial Sequence
  chemically synthesized
ataaagccagaatcacaata

SEQ ID NO: 439646 - DNA, 20 bp, Artificial Sequence
  chemically synthesized
ctatctctttattgtgattc

SEQ ID NO: 439647 - DNA, 20 bp, Artificial Sequence
  chemically synthesized
catttcagtttaaataaagc

SEQ ID NO: 439648 - DNA, 20 bp, Artificial Sequence
  chemically synthesized
ttgacatttcagtttaaata

SEQ ID NO: 439649 - DNA, 20 bp, Artificial Sequence
  chemically synthesized
cctagaaaacattgacattt

SEQ ID NO: 439650 - DNA, 20 bp, Artificial Sequence
  chemically synthesized
actgaaatgtcaatgttttc

SEQ ID NO: 439651 - DNA, 20 bp, Artificial Sequence
  chemically synthesized
ctgaaatgtcaatgttttct

SEQ ID NO: 439652 - DNA, 20 bp, Artificial Sequence
  chemically synthesized
gcaaaaatggtaaaaatacc

SEQ ID NO: 439653 - DNA, 20 bp, Artificial Sequence
  chemically synthesized
aggtatttttaccatttttg

SEQ ID NO: 439654 - DNA, 20 bp, Artificial Sequence
  chemically synthesized
tatcccaatatctgcaaaaa

SEQ ID NO: 439655 - DNA, 20 bp, Artificial Sequence
  chemically synthesized
tttaccatttttgcagatat

SEQ ID NO: 439656 - DNA, 20 bp, Artificial Sequence
  chemically synthesized
ttaccatttttgcagatatt

SEQ ID NO: 439657 - DNA, 20 bp, Artificial Sequence
  chemically synthesized
gggataatcactttcactaa

SEQ ID NO: 439658 - DNA, 20 bp, Artificial Sequence
  chemically synthesized
ttctggaggaccgttagtga

SEQ ID NO: 439659 - DNA, 20 bp, Artificial Sequence
  chemically synthesized
taaaaattctggaggaccgt

SEQ ID NO: 439660 - DNA, 20 bp, Artificial Sequence
  chemically synthesized
cactttcactaacggtcctc

SEQ ID NO: 439661 - DNA, 20 bp, Artificial Sequence
  chemically synthesized
gaaatgtctaaaaattctgg

SEQ ID NO: 439662 - DNA, 20 bp, Artificial Sequence
  chemically synthesized
agaaatgtctaaaaattctg

SEQ ID NO: 439663 - DNA, 20 bp, Artificial Sequence
  chemically synthesized
taacggtcctccagaatttt

SEQ ID NO: 439664 - DNA, 20 bp, Artificial Sequence
  chemically synthesized
ggagaaatgtctaaaaattc

SEQ ID NO: 439665 - DNA, 20 bp, Artificial Sequence
  chemically synthesized
tttttagacatttctccaat

SEQ ID NO: 439666 - DNA, 20 bp, Artificial Sequence
  chemically synthesized
gttaatatagatgcttattg

SEQ ID NO: 439667 - DNA, 20 bp, Artificial Sequence
  chemically synthesized
tagttaatatagatgcttat

SEQ ID NO: 439668 - DNA, 20 bp, Artificial Sequence
  chemically synthesized
taatgctagtttagttaata

SEQ ID NO: 439669 - DNA, 20 bp, Artificial Sequence
  chemically synthesized
agcatctatattaactaaac

SEQ ID NO: 439670 - DNA, 20 bp, Artificial Sequence
  chemically synthesized
cactttatttaatgctagtt

SEQ ID NO: 439671 - DNA, 20 bp, Artificial Sequence
  chemically synthesized
gtttgcactttatttaatgc

SEQ ID NO: 439672 - DNA, 20 bp, Artificial Sequence
  chemically synthesized
aactaaactagcattaaata

SEQ ID NO: 439673 - DNA, 20 bp, Artificial Sequence
  chemically synthesized
ttgcatagttatgacaaggt

SEQ ID NO: 439674 - DNA, 20 bp, Artificial Sequence
  chemically synthesized
agaattgcatagttatgaca

SEQ ID NO: 439675 - DNA, 20 bp, Artificial Sequence
  chemically synthesized
cagaattgcatagttatgac

SEQ ID NO: 439676 - DNA, 20 bp, Artificial Sequence
  chemically synthesized
ttagagaatacagaattgca

SEQ ID NO: 439677 - DNA, 20 bp, Artificial Sequence
  chemically synthesized
aaatcatcctttagagaata

SEQ ID NO: 439678 - DNA, 20 bp, Artificial Sequence
  chemically synthesized
atgcaattctgtattctcta

SEQ ID NO: 439679 - DNA, 20 bp, Artificial Sequence
  chemically synthesized
tgcaattctgtattctctaa

SEQ ID NO: 439680 - DNA, 20 bp, Artificial Sequence
  chemically synthesized
atatgaaaaatcatccttta

SEQ ID NO: 439681 - DNA, 20 bp, Artificial Sequence
  chemically synthesized
taatatgaaaaatcatcctt

SEQ ID NO: 439682 - DNA, 20 bp, Artificial Sequence
  chemically synthesized
attgctcagtcagaattgtt

SEQ ID NO: 439683 - DNA, 20 bp, Artificial Sequence
  chemically synthesized
attactcaacaattctgact

SEQ ID NO: 439684 - DNA, 20 bp, Artificial Sequence
  chemically synthesized
ctcaatttcaattgctcagt

SEQ ID NO: 439685 - DNA, 20 bp, Artificial Sequence
  chemically synthesized
tagtctcaatttcaattgct

SEQ ID NO: 439686 - DNA, 20 bp, Artificial Sequence
  chemically synthesized
ctgactgagcaattgaaatt

SEQ ID NO: 439687 - DNA, 20 bp, Artificial Sequence
  chemically synthesized
tcagtgtaaaacatttatca

SEQ ID NO: 439688 - DNA, 20 bp, Artificial Sequence
  chemically synthesized
atgataaatgttttacactg

SEQ ID NO: 439689 - DNA, 20 bp, Artificial Sequence
  chemically synthesized
tgataaatgttttacactga

SEQ ID NO: 439690 - DNA, 20 bp, Artificial Sequence
  chemically synthesized
tgtataatgaaatgagcctt

SEQ ID NO: 439691 - DNA, 20 bp, Artificial Sequence
  chemically synthesized
tgactactgtataatgaaat

SEQ ID NO: 439692 - DNA, 20 bp, Artificial Sequence
  chemically synthesized
tgaaggctcatttcattata

SEQ ID NO: 439693 - DNA, 20 bp, Artificial Sequence
  chemically synthesized
aggctcatttcattatacag

SEQ ID NO: 439694 - DNA, 20 bp, Artificial Sequence
  chemically synthesized
tcatttcattatacagtagt

SEQ ID NO: 439695 - DNA, 20 bp, Artificial Sequence
  chemically synthesized
tatacagtagtcagttgaaa

SEQ ID NO: 439696 - DNA, 20 bp, Artificial Sequence
  chemically synthesized
atacagtagtcagttgaaat

SEQ ID NO: 439697 - DNA, 20 bp, Artificial Sequence
  chemically synthesized
tacagtagtcagttgaaatg

SEQ ID NO: 439698 - DNA, 20 bp, Artificial Sequence
  chemically synthesized
cagttgaaatggggtttccg

SEQ ID NO: 439699 - DNA, 20 bp, Artificial Sequence
  chemically synthesized
ttgaaatggggtttccgaag

SEQ ID NO: 439700 - DNA, 20 bp, Artificial Sequence
  chemically synthesized
tgaaatggggtttccgaaga

SEQ ID NO: 439701 - DNA, 20 bp, Artificial Sequence
  chemically synthesized
cttcctaaaaataccttctt

SEQ ID NO: 439702 - DNA, 20 bp, Artificial Sequence
  chemically synthesized
gtttccgaagaaggtatttt

SEQ ID NO: 439703 - DNA, 20 bp, Artificial Sequence
  chemically synthesized
tttccgaagaaggtattttt

SEQ ID NO: 439704 - DNA, 20 bp, Artificial Sequence
  chemically synthesized
ccgaagaaggtatttttagg

SEQ ID NO: 439705 - DNA, 20 bp, Artificial Sequence
  chemically synthesized
gaaggtatttttaggaagtg

SEQ ID NO: 439706 - DNA, 20 bp, Artificial Sequence
  chemically synthesized
aggtatttttaggaagtgca

SEQ ID NO: 439707 - DNA, 20 bp, Artificial Sequence
  chemically synthesized
tttttaggaagtgcagagta

SEQ ID NO: 439708 - DNA, 20 bp, Artificial Sequence
  chemically synthesized
ttttaggaagtgcagagtac

SEQ ID NO: 439709 - DNA, 20 bp, Artificial Sequence
  chemically synthesized
gaagtgcagagtacaggaaa

SEQ ID NO: 439710 - DNA, 20 bp, Artificial Sequence
  chemically synthesized
tttaaattgtataacgtatt

SEQ ID NO: 439711 - DNA, 20 bp, Artificial Sequence
  chemically synthesized
tacaatttaaatatttattg

SEQ ID NO: 439712 - DNA, 20 bp, Artificial Sequence
  chemically synthesized
tttattgaagcttttctact

SEQ ID NO: 439713 - DNA, 20 bp, Artificial Sequence
  chemically synthesized
aaaatgttgccttagtagaa

SEQ ID NO: 439714 - DNA, 20 bp, Artificial Sequence
  chemically synthesized
ttattgaagcttttctacta

SEQ ID NO: 439715 - DNA, 20 bp, Artificial Sequence
  chemically synthesized
ttaccaaaatgttgccttag

SEQ ID NO: 439716 - DNA, 20 bp, Artificial Sequence
  chemically synthesized
atattaccaaaatgttgcct

SEQ ID NO: 439717 - DNA, 20 bp, Artificial Sequence
  chemically synthesized
tttctactaaggcaacattt

SEQ ID NO: 439718 - DNA, 20 bp, Artificial Sequence
  chemically synthesized
caacattttggtaatattca

SEQ ID NO: 439719 - DNA, 20 bp, Artificial Sequence
  chemically synthesized
tttggtaatattcacagaaa

SEQ ID NO: 439720 - DNA, 20 bp, Artificial Sequence
  chemically synthesized
tattcacagaaatagcaata

SEQ ID NO: 439721 - DNA, 20 bp, Artificial Sequence
  chemically synthesized
attcacagaaatagcaatat

SEQ ID NO: 439722 - DNA, 20 bp, Artificial Sequence
  chemically synthesized
tcacagaaatagcaatatgg

SEQ ID NO: 439723 - DNA, 20 bp, Artificial Sequence
  chemically synthesized
cacagaaatagcaatatggg

SEQ ID NO: 439724 - DNA, 20 bp, Artificial Sequence
  chemically synthesized
atagcaatatgggaggaaat

SEQ ID NO: 439725 - DNA, 20 bp, Artificial Sequence
  chemically synthesized
tagcaatatgggaggaaatt

SEQ ID NO: 439726 - DNA, 20 bp, Artificial Sequence
  chemically synthesized
agcaatatgggaggaaatta

SEQ ID NO: 439727 - DNA, 20 bp, Artificial Sequence
  chemically synthesized
gcaatatgggaggaaattag

SEQ ID NO: 439728 - DNA, 20 bp, Artificial Sequence
  chemically synthesized
gggaggaaattaggggtaaa

SEQ ID NO: 439729 - DNA, 20 bp, Artificial Sequence
  chemically synthesized
ggaaattaggggtaaataga

SEQ ID NO: 439730 - DNA, 20 bp, Artificial Sequence
  chemically synthesized
aattaggggtaaatagatgg

SEQ ID NO: 439731 - DNA, 20 bp, Artificial Sequence
  chemically synthesized
ttaggggtaaatagatggta

SEQ ID NO: 439732 - DNA, 20 bp, Artificial Sequence
  chemically synthesized
taaatagatggtagagactg

SEQ ID NO: 439733 - DNA, 20 bp, Artificial Sequence
  chemically synthesized
attaggtgtcttggtttcca

SEQ ID NO: 439734 - DNA, 20 bp, Artificial Sequence
  chemically synthesized
tggtagagactgtggaaacc

SEQ ID NO: 439735 - DNA, 20 bp, Artificial Sequence
  chemically synthesized
acttttagcattaggtgtct

SEQ ID NO: 439736 - DNA, 20 bp, Artificial Sequence
  chemically synthesized
aggatcccacttttagcatt

SEQ ID NO: 439737 - DNA, 20 bp, Artificial Sequence
  chemically synthesized
accaagacacctaatgctaa

SEQ ID NO: 439738 - DNA, 20 bp, Artificial Sequence
  chemically synthesized
gaggatcccacttttagcat

SEQ ID NO: 439739 - DNA, 20 bp, Artificial Sequence
  chemically synthesized
aagacacctaatgctaaaag

SEQ ID NO: 439740 - DNA, 20 bp, Artificial Sequence
  chemically synthesized
agacacctaatgctaaaagt

SEQ ID NO: 439741 - DNA, 20 bp, Artificial Sequence
  chemically synthesized
atgaatgaggatcccacttt

SEQ ID NO: 439742 - DNA, 20 bp, Artificial Sequence
  chemically synthesized
atttaatgacttcatgaatg

SEQ ID NO: 439743 - DNA, 20 bp, Artificial Sequence
  chemically synthesized
aagtgggatcctcattcatg

SEQ ID NO: 439744 - DNA, 20 bp, Artificial Sequence
  chemically synthesized
aatttaatgacttcatgaat

SEQ ID NO: 439745 - DNA, 20 bp, Artificial Sequence
  chemically synthesized
cattcatgaagtcattaaat

SEQ ID NO: 439746 - DNA, 20 bp, Artificial Sequence
  chemically synthesized
ttcatgaagtcattaaattg

SEQ ID NO: 439747 - DNA, 20 bp, Artificial Sequence
  chemically synthesized
gtcattaaattggagatcga

SEQ ID NO: 439748 - DNA, 20 bp, Artificial Sequence
  chemically synthesized
tcattaaattggagatcgaa

SEQ ID NO: 439749 - DNA, 20 bp, Artificial Sequence
  chemically synthesized
aaattggagatcgaaaggaa

SEQ ID NO: 439750 - DNA, 20 bp, Artificial Sequence
  chemically synthesized
gaaaggaacagacctcttta

SEQ ID NO: 439751 - DNA, 20 bp, Artificial Sequence
  chemically synthesized
aaaataatatttccataaag

SEQ ID NO: 439752 - DNA, 20 bp, Artificial Sequence
  chemically synthesized
gaaaataatatttccataaa

SEQ ID NO: 439753 - DNA, 20 bp, Artificial Sequence
  chemically synthesized
aggaaaataatatttccata

SEQ ID NO: 439754 - DNA, 20 bp, Artificial Sequence
  chemically synthesized
tatggaaatattattttcct

SEQ ID NO: 439755 - DNA, 20 bp, Artificial Sequence
  chemically synthesized
gaaaaaatgatgaaattcta

SEQ ID NO: 439756 - DNA, 20 bp, Artificial Sequence
  chemically synthesized
agaaaaaatgatgaaattct

SEQ ID NO: 439757 - DNA, 20 bp, Artificial Sequence
  chemically synthesized
tagaatttcatcattttttc

SEQ ID NO: 439758 - DNA, 20 bp, Artificial Sequence
  chemically synthesized
aaaatcagagaagacacatc

SEQ ID NO: 439759 - DNA, 20 bp, Artificial Sequence
  chemically synthesized
ctaaaaaaaaaaaatcagag

SEQ ID NO: 439760 - DNA, 20 bp, Artificial Sequence
  chemically synthesized
gcactaaaaaaaaaaaatca

SEQ ID NO: 439761 - DNA, 20 bp, Artificial Sequence
  chemically synthesized
aagcactaaaaaaaaaaaat

SEQ ID NO: 439762 - DNA, 20 bp, Artificial Sequence
  chemically synthesized
cttctctgattttttttttt

SEQ ID NO: 439763 - DNA, 20 bp, Artificial Sequence
  chemically synthesized
aaattcaataaagaagacaa

SEQ ID NO: 439764 - DNA, 20 bp, Artificial Sequence
  chemically synthesized
agatcggaaattcaataaag

SEQ ID NO: 439765 - DNA, 20 bp, Artificial Sequence
  chemically synthesized
aggagatcggaaattcaata

SEQ ID NO: 439766 - DNA, 20 bp, Artificial Sequence
  chemically synthesized
atagagtgtgaagaggagat

SEQ ID NO: 439767 - DNA, 20 bp, Artificial Sequence
  chemically synthesized
agataatagagtgtgaagag

SEQ ID NO: 439768 - DNA, 20 bp, Artificial Sequence
  chemically synthesized
aaagataatagagtgtgaag

SEQ ID NO: 439769 - DNA, 20 bp, Artificial Sequence
  chemically synthesized
gaaagataatagagtgtgaa

SEQ ID NO: 439770 - DNA, 20 bp, Artificial Sequence
  chemically synthesized
tagaaagataatagagtgtg

SEQ ID NO: 439771 - DNA, 20 bp, Artificial Sequence
  chemically synthesized
gaccagctagaaagataata

SEQ ID NO: 439772 - DNA, 20 bp, Artificial Sequence
  chemically synthesized
gagaccagctagaaagataa

SEQ ID NO: 439773 - DNA, 20 bp, Artificial Sequence
  chemically synthesized
ttcacactctattatctttc

SEQ ID NO: 439774 - DNA, 20 bp, Artificial Sequence
  chemically synthesized
cactctattatctttctagc

SEQ ID NO: 439775 - DNA, 20 bp, Artificial Sequence
  chemically synthesized
agtggatgagaccagctaga

SEQ ID NO: 439776 - DNA, 20 bp, Artificial Sequence
  chemically synthesized
atggagtggatgagaccagc

SEQ ID NO: 439777 - DNA, 20 bp, Artificial Sequence
  chemically synthesized
actcatggagtggatgagac

SEQ ID NO: 439778 - DNA, 20 bp, Artificial Sequence
  chemically synthesized
atgcaactcatggagtggat

SEQ ID NO: 439779 - DNA, 20 bp, Artificial Sequence
  chemically synthesized
gctggtctcatccactccat

SEQ ID NO: 439780 - DNA, 20 bp, Artificial Sequence
  chemically synthesized
taaatatgcaactcatggag

SEQ ID NO: 439781 - DNA, 20 bp, Artificial Sequence
  chemically synthesized
atttaaatatgcaactcatg

SEQ ID NO: 439782 - DNA, 20 bp, Artificial Sequence
  chemically synthesized
ggatttaaatatgcaactca

SEQ ID NO: 439783 - DNA, 20 bp, Artificial Sequence
  chemically synthesized
tagaaatgaagtcattatta

SEQ ID NO: 439784 - DNA, 20 bp, Artificial Sequence
  chemically synthesized
ctagaaatgaagtcattatt

SEQ ID NO: 439785 - DNA, 20 bp, Artificial Sequence
  chemically synthesized
cctagaaatgaagtcattat

SEQ ID NO: 439786 - DNA, 20 bp, Artificial Sequence
  chemically synthesized
cctaataatgacttcatttc

SEQ ID NO: 439787 - DNA, 20 bp, Artificial Sequence
  chemically synthesized
ctaataatgacttcatttct

SEQ ID NO: 439788 - DNA, 20 bp, Artificial Sequence
  chemically synthesized
gggtattgtgcctagaaatg

SEQ ID NO: 439789 - DNA, 20 bp, Artificial Sequence
  chemically synthesized
tagcgcgtgggtattgtgcc

SEQ ID NO: 439790 - DNA, 20 bp, Artificial Sequence
  chemically synthesized
tgtatttttatgtagcgcgt

SEQ ID NO: 439791 - DNA, 20 bp, Artificial Sequence
  chemically synthesized
ttgtatttttatgtagcgcg

SEQ ID NO: 439792 - DNA, 20 bp, Artificial Sequence
  chemically synthesized
ttttgttttgtatttttatg

SEQ ID NO: 439793 - DNA, 20 bp, Artificial Sequence
  chemically synthesized
acaaaacaaaacaaacacct

SEQ ID NO: 439794 - DNA, 20 bp, Artificial Sequence
  chemically synthesized
gattaggggtgtggatgcta

SEQ ID NO: 439795 - DNA, 20 bp, Artificial Sequence
  chemically synthesized
ggattaggggtgtggatgct

SEQ ID NO: 439796 - DNA, 20 bp, Artificial Sequence
  chemically synthesized
aacaggaaggattaggggtg

SEQ ID NO: 439797 - DNA, 20 bp, Artificial Sequence
  chemically synthesized
ggaacaacaggaaggattag

SEQ ID NO: 439798 - DNA, 20 bp, Artificial Sequence
  chemically synthesized
tggaacaacaggaaggatta

SEQ ID NO: 439799 - DNA, 20 bp, Artificial Sequence
  chemically synthesized
ttggaacaacaggaaggatt

SEQ ID NO: 439800 - DNA, 20 bp, Artificial Sequence
  chemically synthesized
attggaacaacaggaaggat

SEQ ID NO: 439801 - DNA, 20 bp, Artificial Sequence
  chemically synthesized
gggaaattggaacaacagga

SEQ ID NO: 439802 - DNA, 20 bp, Artificial Sequence
  chemically synthesized
agggaaattggaacaacagg

SEQ ID NO: 439803 - DNA, 20 bp, Artificial Sequence
  chemically synthesized
ggaagggaaattggaacaac

SEQ ID NO: 439804 - DNA, 20 bp, Artificial Sequence
  chemically synthesized
tggaagggaaattggaacaa

SEQ ID NO: 439805 - DNA, 20 bp, Artificial Sequence
  chemically synthesized
aaggagattggaagggaaat

SEQ ID NO: 439806 - DNA, 20 bp, Artificial Sequence
  chemically synthesized
catttgcaaggagattggaa

SEQ ID NO: 439807 - DNA, 20 bp, Artificial Sequence
  chemically synthesized
ccatttgcaaggagattgga

SEQ ID NO: 439808 - DNA, 20 bp, Artificial Sequence
  chemically synthesized
gccatttgcaaggagattgg

SEQ ID NO: 439809 - DNA, 20 bp, Artificial Sequence
  chemically synthesized
ggtgccatttgcaaggagat

SEQ ID NO: 439810 - DNA, 20 bp, Artificial Sequence
  chemically synthesized
ataatggtgccatttgcaag

SEQ ID NO: 439811 - DNA, 20 bp, Artificial Sequence
  chemically synthesized
ccttccaatctccttgcaaa

SEQ ID NO: 439812 - DNA, 20 bp, Artificial Sequence
  chemically synthesized
ggataatggtgccatttgca

SEQ ID NO: 439813 - DNA, 20 bp, Artificial Sequence
  chemically synthesized
tggataatggtgccatttgc

SEQ ID NO: 439814 - DNA, 20 bp, Artificial Sequence
  chemically synthesized
atgcacacctgggtggataa

SEQ ID NO: 439815 - DNA, 20 bp, Artificial Sequence
  chemically synthesized
aaatggcaccattatccacc

SEQ ID NO: 439816 - DNA, 20 bp, Artificial Sequence
  chemically synthesized
aatggcaccattatccaccc

SEQ ID NO: 439817 - DNA, 20 bp, Artificial Sequence
  chemically synthesized
ccatgaaatgcacacctggg

SEQ ID NO: 439818 - DNA, 20 bp, Artificial Sequence
  chemically synthesized
gctccatgaaatgcacacct

SEQ ID NO: 439819 - DNA, 20 bp, Artificial Sequence
  chemically synthesized
tgctccatgaaatgcacacc

SEQ ID NO: 439820 - DNA, 20 bp, Artificial Sequence
  chemically synthesized
ccacccaggtgtgcatttca

SEQ ID NO: 439821 - DNA, 20 bp, Artificial Sequence
  chemically synthesized
acccaggtgtgcatttcatg

SEQ ID NO: 439822 - DNA, 20 bp, Artificial Sequence
  chemically synthesized
tgtgcatttcatggagcaca

SEQ ID NO: 439823 - DNA, 20 bp, Artificial Sequence
  chemically synthesized
gagatagaatcaataggaat

SEQ ID NO: 439824 - DNA, 20 bp, Artificial Sequence
  chemically synthesized
gtatatgagatagaatcaat

SEQ ID NO: 439825 - DNA, 20 bp, Artificial Sequence
  chemically synthesized
tgtatatgagatagaatcaa

SEQ ID NO: 439826 - DNA, 20 bp, Artificial Sequence
  chemically synthesized
ttcaagatttgtatatgaga

SEQ ID NO: 439827 - DNA, 20 bp, Artificial Sequence
  chemically synthesized
tctattcaagatttgtatat

SEQ ID NO: 439828 - DNA, 20 bp, Artificial Sequence
  chemically synthesized
tctcatatacaaatcttgaa

SEQ ID NO: 439829 - DNA, 20 bp, Artificial Sequence
  chemically synthesized
tgaaagaagtaaatctattc

SEQ ID NO: 439830 - DNA, 20 bp, Artificial Sequence
  chemically synthesized
ggggacagtggagatgaaag

SEQ ID NO: 439831 - DNA, 20 bp, Artificial Sequence
  chemically synthesized
aatggggacagtggagatga

SEQ ID NO: 439832 - DNA, 20 bp, Artificial Sequence
  chemically synthesized
ggactagaatggggacagtg

SEQ ID NO: 439833 - DNA, 20 bp, Artificial Sequence
  chemically synthesized
ttggactagaatggggacag

SEQ ID NO: 439834 - DNA, 20 bp, Artificial Sequence
  chemically synthesized
gatttggactagaatgggga

SEQ ID NO: 439835 - DNA, 20 bp, Artificial Sequence
  chemically synthesized
catctccactgtccccattc

SEQ ID NO: 439836 - DNA, 20 bp, Artificial Sequence
  chemically synthesized
aggtgatttggactagaatg

SEQ ID NO: 439837 - DNA, 20 bp, Artificial Sequence
  chemically synthesized
aaggtgatttggactagaat

SEQ ID NO: 439838 - DNA, 20 bp, Artificial Sequence
  chemically synthesized
gaaggtgatttggactagaa

SEQ ID NO: 439839 - DNA, 20 bp, Artificial Sequence
  chemically synthesized
caaaagaaggtgatttggac

SEQ ID NO: 439840 - DNA, 20 bp, Artificial Sequence
  chemically synthesized
tcatccaaaagaaggtgatt

SEQ ID NO: 439841 - DNA, 20 bp, Artificial Sequence
  chemically synthesized
tagtccaaatcaccttcttt

SEQ ID NO: 439842 - DNA, 20 bp, Artificial Sequence
  chemically synthesized
acggtagctcatccaaaaga

SEQ ID NO: 439843 - DNA, 20 bp, Artificial Sequence
  chemically synthesized
tacggtagctcatccaaaag

SEQ ID NO: 439844 - DNA, 20 bp, Artificial Sequence
  chemically synthesized
caaatcaccttcttttggat

SEQ ID NO: 439845 - DNA, 20 bp, Artificial Sequence
  chemically synthesized
aattacggtagctcatccaa

SEQ ID NO: 439846 - DNA, 20 bp, Artificial Sequence
  chemically synthesized
tcaatctgaagcaattacgg

SEQ ID NO: 439847 - DNA, 20 bp, Artificial Sequence
  chemically synthesized
ctatcaatctgaagcaatta

SEQ ID NO: 439848 - DNA, 20 bp, Artificial Sequence
  chemically synthesized
atgagctaccgtaattgctt

SEQ ID NO: 439849 - DNA, 20 bp, Artificial Sequence
  chemically synthesized
gatgaaggactatcaatctg

SEQ ID NO: 439850 - DNA, 20 bp, Artificial Sequence
  chemically synthesized
ccgtaattgcttcagattga

SEQ ID NO: 439851 - DNA, 20 bp, Artificial Sequence
  chemically synthesized
caagtgcctagggtagatga

SEQ ID NO: 439852 - DNA, 20 bp, Artificial Sequence
  chemically synthesized
gcaagtgcctagggtagatg

SEQ ID NO: 439853 - DNA, 20 bp, Artificial Sequence
  chemically synthesized
tgatagtccttcatctaccc

SEQ ID NO: 439854 - DNA, 20 bp, Artificial Sequence
  chemically synthesized
gatagtccttcatctaccct

SEQ ID NO: 439855 - DNA, 20 bp, Artificial Sequence
  chemically synthesized
agattggcaagtgcctaggg

SEQ ID NO: 439856 - DNA, 20 bp, Artificial Sequence
  chemically synthesized
aagagattggcaagtgccta

SEQ ID NO: 439857 - DNA, 20 bp, Artificial Sequence
  chemically synthesized
aaagagattggcaagtgcct

SEQ ID NO: 439858 - DNA, 20 bp, Artificial Sequence
  chemically synthesized
gaaagagattggcaagtgcc

SEQ ID NO: 439859 - DNA, 20 bp, Artificial Sequence
  chemically synthesized
tttgtgtgaaagagattggc

SEQ ID NO: 439860 - DNA, 20 bp, Artificial Sequence
  chemically synthesized
ctgttttgtgtgaaagagat

SEQ ID NO: 439861 - DNA, 20 bp, Artificial Sequence
  chemically synthesized
tcactctgttttgtgtgaaa

SEQ ID NO: 439862 - DNA, 20 bp, Artificial Sequence
  chemically synthesized
tatcactctgttttgtgtga

SEQ ID NO: 439863 - DNA, 20 bp, Artificial Sequence
  chemically synthesized
ccaatctctttcacacaaaa

SEQ ID NO: 439864 - DNA, 20 bp, Artificial Sequence
  chemically synthesized
aatctctttcacacaaaaca

SEQ ID NO: 439865 - DNA, 20 bp, Artificial Sequence
  chemically synthesized
tttcacacaaaacagagtga

SEQ ID NO: 439866 - DNA, 20 bp, Artificial Sequence
  chemically synthesized
taaacatatttgtatttttt

SEQ ID NO: 439867 - DNA, 20 bp, Artificial Sequence
  chemically synthesized
aaatacaaatatgtttacat

SEQ ID NO: 439868 - DNA, 20 bp, Artificial Sequence
  chemically synthesized
acagccttatgggtttcagg

SEQ ID NO: 439869 - DNA, 20 bp, Artificial Sequence
  chemically synthesized
tggacagccttatgggtttc

SEQ ID NO: 439870 - DNA, 20 bp, Artificial Sequence
  chemically synthesized
atggacagccttatgggttt

SEQ ID NO: 439871 - DNA, 20 bp, Artificial Sequence
  chemically synthesized
gttttctacctgaaacccat

SEQ ID NO: 439872 - DNA, 20 bp, Artificial Sequence
  chemically synthesized
ttttctacctgaaacccata

SEQ ID NO: 439873 - DNA, 20 bp, Artificial Sequence
  chemically synthesized
agatcaatggacagccttat

SEQ ID NO: 439874 - DNA, 20 bp, Artificial Sequence
  chemically synthesized
aagatcaatggacagcctta

SEQ ID NO: 439875 - DNA, 20 bp, Artificial Sequence
  chemically synthesized
tttatactaagatcaatgga

SEQ ID NO: 439876 - DNA, 20 bp, Artificial Sequence
  chemically synthesized
ataaggctgtccattgatct

SEQ ID NO: 439877 - DNA, 20 bp, Artificial Sequence
  chemically synthesized
tctctttatactaagatcaa

SEQ ID NO: 439878 - DNA, 20 bp, Artificial Sequence
  chemically synthesized
tgtccattgatcttagtata

SEQ ID NO: 439879 - DNA, 20 bp, Artificial Sequence
  chemically synthesized
attatttttctctttatact

SEQ ID NO: 439880 - DNA, 20 bp, Artificial Sequence
  chemically synthesized
tccattgatcttagtataaa

SEQ ID NO: 439881 - DNA, 20 bp, Artificial Sequence
  chemically synthesized
attcagagccttgaaggtta

SEQ ID NO: 439882 - DNA, 20 bp, Artificial Sequence
  chemically synthesized
aaataatttctataaccttc

SEQ ID NO: 439883 - DNA, 20 bp, Artificial Sequence
  chemically synthesized
aataatttctataaccttca

SEQ ID NO: 439884 - DNA, 20 bp, Artificial Sequence
  chemically synthesized
ccaatcattcagagccttga

SEQ ID NO: 439885 - DNA, 20 bp, Artificial Sequence
  chemically synthesized
tccaatcattcagagccttg

SEQ ID NO: 439886 - DNA, 20 bp, Artificial Sequence
  chemically synthesized
gactggggtccaatcattca

SEQ ID NO: 439887 - DNA, 20 bp, Artificial Sequence
  chemically synthesized
ccttcaaggctctgaatgat

SEQ ID NO: 439888 - DNA, 20 bp, Artificial Sequence
  chemically synthesized
ccgactggggtccaatcatt

SEQ ID NO: 439889 - DNA, 20 bp, Artificial Sequence
  chemically synthesized
ggctctgaatgattggaccc

SEQ ID NO: 439890 - DNA, 20 bp, Artificial Sequence
  chemically synthesized
ctgaatgattggaccccagt

SEQ ID NO: 439891 - DNA, 20 bp, Artificial Sequence
  chemically synthesized
tgcatctgaatggccgactg

SEQ ID NO: 439892 - DNA, 20 bp, Artificial Sequence
  chemically synthesized
ttgcatctgaatggccgact

SEQ ID NO: 439893 - DNA, 20 bp, Artificial Sequence
  chemically synthesized
cttgcatctgaatggccgac

SEQ ID NO: 439894 - DNA, 20 bp, Artificial Sequence
  chemically synthesized
ttggaccccagtcggccatt

SEQ ID NO: 439895 - DNA, 20 bp, Artificial Sequence
  chemically synthesized
ggaacaagcttgcatctgaa

SEQ ID NO: 439896 - DNA, 20 bp, Artificial Sequence
  chemically synthesized
ccagtcggccattcagatgc

SEQ ID NO: 439897 - DNA, 20 bp, Artificial Sequence
  chemically synthesized
agggcagaaaagtgtggaac

SEQ ID NO: 439898 - DNA, 20 bp, Artificial Sequence
  chemically synthesized
acagtgagggcagaaaagtg

SEQ ID NO: 439899 - DNA, 20 bp, Artificial Sequence
  chemically synthesized
agagtacagtgagggcagaa

SEQ ID NO: 439900 - DNA, 20 bp, Artificial Sequence
  chemically synthesized
ttcctagagtacagtgaggg

SEQ ID NO: 439901 - DNA, 20 bp, Artificial Sequence
  chemically synthesized
gctttcctagagtacagtga

SEQ ID NO: 439902 - DNA, 20 bp, Artificial Sequence
  chemically synthesized
agctttcctagagtacagtg

SEQ ID NO: 439903 - DNA, 20 bp, Artificial Sequence
  chemically synthesized
cagctttcctagagtacagt

SEQ ID NO: 439904 - DNA, 20 bp, Artificial Sequence
  chemically synthesized
tttctgccctcactgtactc

SEQ ID NO: 439905 - DNA, 20 bp, Artificial Sequence
  chemically synthesized
ttctgccctcactgtactct

SEQ ID NO: 439906 - DNA, 20 bp, Artificial Sequence
  chemically synthesized
agtacagctttcctagagta

SEQ ID NO: 439907 - DNA, 20 bp, Artificial Sequence
  chemically synthesized
gccctcactgtactctagga

SEQ ID NO: 439908 - DNA, 20 bp, Artificial Sequence
  chemically synthesized
aaacaagtacagctttccta

SEQ ID NO: 439909 - DNA, 20 bp, Artificial Sequence
  chemically synthesized
taaaacaagtacagctttcc

SEQ ID NO: 439910 - DNA, 20 bp, Artificial Sequence
  chemically synthesized
agaaagatctaaaacaagta

SEQ ID NO: 439911 - DNA, 20 bp, Artificial Sequence
  chemically synthesized
taggaaagctgtacttgttt

SEQ ID NO: 439912 - DNA, 20 bp, Artificial Sequence
  chemically synthesized
tatggagaaagatctaaaac

SEQ ID NO: 439913 - DNA, 20 bp, Artificial Sequence
  chemically synthesized
tgtggaaaatggtatggaga

SEQ ID NO: 439914 - DNA, 20 bp, Artificial Sequence
  chemically synthesized
tgaatgtggaaaatggtatg

SEQ ID NO: 439915 - DNA, 20 bp, Artificial Sequence
  chemically synthesized
tctgaatgtggaaaatggta

SEQ ID NO: 439916 - DNA, 20 bp, Artificial Sequence
  chemically synthesized
atgtttctgaatgtggaaaa

SEQ ID NO: 439917 - DNA, 20 bp, Artificial Sequence
  chemically synthesized
tccataccattttccacatt

SEQ ID NO: 439918 - DNA, 20 bp, Artificial Sequence
  chemically synthesized
gggagcaatgtttctgaatg

SEQ ID NO: 439919 - DNA, 20 bp, Artificial Sequence
  chemically synthesized
agaaacattgctccctctga

SEQ ID NO: 439920 - DNA, 20 bp, Artificial Sequence
  chemically synthesized
aaaaatgtccctgtcagagg

SEQ ID NO: 439921 - DNA, 20 bp, Artificial Sequence
  chemically synthesized
gaaacattgctccctctgac

SEQ ID NO: 439922 - DNA, 20 bp, Artificial Sequence
  chemically synthesized
aaacattgctccctctgaca

SEQ ID NO: 439923 - DNA, 20 bp, Artificial Sequence
  chemically synthesized
gcaaaaatgtccctgtcaga

SEQ ID NO: 439924 - DNA, 20 bp, Artificial Sequence
  chemically synthesized
agcaaaaatgtccctgtcag

SEQ ID NO: 439925 - DNA, 20 bp, Artificial Sequence
  chemically synthesized
gagcaaaaatgtccctgtca

SEQ ID NO: 439926 - DNA, 20 bp, Artificial Sequence
  chemically synthesized
gggagcaaaaatgtccctgt

SEQ ID NO: 439927 - DNA, 20 bp, Artificial Sequence
  chemically synthesized
gttgtccaaaagaaaagagg

SEQ ID NO: 439928 - DNA, 20 bp, Artificial Sequence
  chemically synthesized
tagttgtccaaaagaaaaga

SEQ ID NO: 439929 - DNA, 20 bp, Artificial Sequence
  chemically synthesized
atagttgtccaaaagaaaag

SEQ ID NO: 439930 - DNA, 20 bp, Artificial Sequence
  chemically synthesized
tatagttgtccaaaagaaaa

SEQ ID NO: 439931 - DNA, 20 bp, Artificial Sequence
  chemically synthesized
ttttgctccctcttttcttt

SEQ ID NO: 439932 - DNA, 20 bp, Artificial Sequence
  chemically synthesized
agtatagttgtccaaaagaa

SEQ ID NO: 439933 - DNA, 20 bp, Artificial Sequence
  chemically synthesized
gttagagtatagttgtccaa

SEQ ID NO: 439934 - DNA, 20 bp, Artificial Sequence
  chemically synthesized
agaagaatgaggttagagta

SEQ ID NO: 439935 - DNA, 20 bp, Artificial Sequence
  chemically synthesized
ggcaaagaagaatgaggtta

SEQ ID NO: 439936 - DNA, 20 bp, Artificial Sequence
  chemically synthesized
aaggcaaagaagaatgaggt

SEQ ID NO: 439937 - DNA, 20 bp, Artificial Sequence
  chemically synthesized
aagcaaggcaaagaagaatg

SEQ ID NO: 439938 - DNA, 20 bp, Artificial Sequence
  chemically synthesized
aaagcaaggcaaagaagaat

SEQ ID NO: 439939 - DNA, 20 bp, Artificial Sequence
  chemically synthesized
atattcaaagcaaggcaaag

SEQ ID NO: 439940 - DNA, 20 bp, Artificial Sequence
  chemically synthesized
aaaatattcaaagcaaggca

SEQ ID NO: 439941 - DNA, 20 bp, Artificial Sequence
  chemically synthesized
aaaaaaaaatattcaaagca

SEQ ID NO: 439942 - DNA, 20 bp, Artificial Sequence
  chemically synthesized
aaaaaaaaaatattcaaagc

SEQ ID NO: 439943 - DNA, 20 bp, Artificial Sequence
  chemically synthesized
tgagaaaaaaaaaatattca

SEQ ID NO: 439944 - DNA, 20 bp, Artificial Sequence
  chemically synthesized
tttgaatattttttttttct

SEQ ID NO: 439945 - DNA, 20 bp, Artificial Sequence
  chemically synthesized
gaatattttttttttctcag

SEQ ID NO: 439946 - DNA, 20 bp, Artificial Sequence
  chemically synthesized
gaaattggggaaatacttct

SEQ ID NO: 439947 - DNA, 20 bp, Artificial Sequence
  chemically synthesized
tagaccagtcttcgaaattg

SEQ ID NO: 439948 - DNA, 20 bp, Artificial Sequence
  chemically synthesized
gaagtatttccccaatttcg

SEQ ID NO: 439949 - DNA, 20 bp, Artificial Sequence
  chemically synthesized
ttagaccagtcttcgaaatt

SEQ ID NO: 439950 - DNA, 20 bp, Artificial Sequence
  chemically synthesized
gttagaccagtcttcgaaat

SEQ ID NO: 439951 - DNA, 20 bp, Artificial Sequence
  chemically synthesized
atttccccaatttcgaagac

SEQ ID NO: 439952 - DNA, 20 bp, Artificial Sequence
  chemically synthesized
tataatagggagagttagac

SEQ ID NO: 439953 - DNA, 20 bp, Artificial Sequence
  chemically synthesized
gaatgtataatagggagagt

SEQ ID NO: 439954 - DNA, 20 bp, Artificial Sequence
  chemically synthesized
ataagaatgtataataggga

SEQ ID NO: 439955 - DNA, 20 bp, Artificial Sequence
  chemically synthesized
taataagaatgtataatagg

SEQ ID NO: 439956 - DNA, 20 bp, Artificial Sequence
  chemically synthesized
tgtaataagaatgtataata

SEQ ID NO: 439957 - DNA, 20 bp, Artificial Sequence
  chemically synthesized
ttgtaataagaatgtataat

SEQ ID NO: 439958 - DNA, 20 bp, Artificial Sequence
  chemically synthesized
attgtaataagaatgtataa

SEQ ID NO: 439959 - DNA, 20 bp, Artificial Sequence
  chemically synthesized
aataaagcacacattgtaat

SEQ ID NO: 439960 - DNA, 20 bp, Artificial Sequence
  chemically synthesized
acaatgtgtgctttattcta

SEQ ID NO: 439961 - DNA, 20 bp, Artificial Sequence
  chemically synthesized
gagataagggctatagaata

SEQ ID NO: 439962 - DNA, 20 bp, Artificial Sequence
  chemically synthesized
tgcattggagataagggcta

SEQ ID NO: 439963 - DNA, 20 bp, Artificial Sequence
  chemically synthesized
actacttgcattggagataa

SEQ ID NO: 439964 - DNA, 20 bp, Artificial Sequence
  chemically synthesized
aactacttgcattggagata

SEQ ID NO: 439965 - DNA, 20 bp, Artificial Sequence
  chemically synthesized
aaactacttgcattggagat

SEQ ID NO: 439966 - DNA, 20 bp, Artificial Sequence
  chemically synthesized
atagcccttatctccaatgc

SEQ ID NO: 439967 - DNA, 20 bp, Artificial Sequence
  chemically synthesized
cacgcaaactacttgcattg

SEQ ID NO: 439968 - DNA, 20 bp, Artificial Sequence
  chemically synthesized
gcccttatctccaatgcaag

SEQ ID NO: 439969 - DNA, 20 bp, Artificial Sequence
  chemically synthesized
cacacgcaaactacttgcat

SEQ ID NO: 439970 - DNA, 20 bp, Artificial Sequence
  chemically synthesized
gagagactagcatttcaagg

SEQ ID NO: 439971 - DNA, 20 bp, Artificial Sequence
  chemically synthesized
agagagactagcatttcaag

SEQ ID NO: 439972 - DNA, 20 bp, Artificial Sequence
  chemically synthesized
aaagagagactagcatttca

SEQ ID NO: 439973 - DNA, 20 bp, Artificial Sequence
  chemically synthesized
gcacatcctccttgaaatgc

SEQ ID NO: 439974 - DNA, 20 bp, Artificial Sequence
  chemically synthesized
caaagagagactagcatttc

SEQ ID NO: 439975 - DNA, 20 bp, Artificial Sequence
  chemically synthesized
aagtgaactcaaagagagac

SEQ ID NO: 439976 - DNA, 20 bp, Artificial Sequence
  chemically synthesized
tgaaatgctagtctctcttt

SEQ ID NO: 439977 - DNA, 20 bp, Artificial Sequence
  chemically synthesized
taaacaagtgaactcaaaga

SEQ ID NO: 439978 - DNA, 20 bp, Artificial Sequence
  chemically synthesized
tctaaacaagtgaactcaaa

SEQ ID NO: 439979 - DNA, 20 bp, Artificial Sequence
  chemically synthesized
attctaaacaagtgaactca

SEQ ID NO: 439980 - DNA, 20 bp, Artificial Sequence
  chemically synthesized
tctctttgagttcacttgtt

SEQ ID NO: 439981 - DNA, 20 bp, Artificial Sequence
  chemically synthesized
ctggcgatagtattctaaac

SEQ ID NO: 439982 - DNA, 20 bp, Artificial Sequence
  chemically synthesized
cttgtttagaatactatcgc

SEQ ID NO: 439983 - DNA, 20 bp, Artificial Sequence
  chemically synthesized
tgtttagaatactatcgcca

SEQ ID NO: 439984 - DNA, 20 bp, Artificial Sequence
  chemically synthesized
actgtgctatgctctggcga

SEQ ID NO: 439985 - DNA, 20 bp, Artificial Sequence
  chemically synthesized
agaatactatcgccagagca

SEQ ID NO: 439986 - DNA, 20 bp, Artificial Sequence
  chemically synthesized
ccaggtactgtgctatgctc

SEQ ID NO: 439987 - DNA, 20 bp, Artificial Sequence
  chemically synthesized
actatcgccagagcatagca

SEQ ID NO: 439988 - DNA, 20 bp, Artificial Sequence
  chemically synthesized
ccagagcatagcacagtacc

SEQ ID NO: 439989 - DNA, 20 bp, Artificial Sequence
  chemically synthesized
ttgagtgcccattttgtgcc

SEQ ID NO: 439990 - DNA, 20 bp, Artificial Sequence
  chemically synthesized
attgagtgcccattttgtgc

SEQ ID NO: 439991 - DNA, 20 bp, Artificial Sequence
  chemically synthesized
gcacagtacctggcacaaaa

SEQ ID NO: 439992 - DNA, 20 bp, Artificial Sequence
  chemically synthesized
cacagtacctggcacaaaat

SEQ ID NO: 439993 - DNA, 20 bp, Artificial Sequence
  chemically synthesized
atgtaacaaatacacatatt

SEQ ID NO: 439994 - DNA, 20 bp, Artificial Sequence
  chemically synthesized
caatatgtgtatttgttaca

SEQ ID NO: 439995 - DNA, 20 bp, Artificial Sequence
  chemically synthesized
tggacaaatgaatcaataaa

SEQ ID NO: 439996 - DNA, 20 bp, Artificial Sequence
  chemically synthesized
ataaatggataacaaatcat

SEQ ID NO: 439997 - DNA, 20 bp, Artificial Sequence
  chemically synthesized
gataacaaatcatcagctgt

SEQ ID NO: 439998 - DNA, 20 bp, Artificial Sequence
  chemically synthesized
cagtttaaagaagggactta

SEQ ID NO: 439999 - DNA, 20 bp, Artificial Sequence
  chemically synthesized
ggtgaccacagtttaaagaa

SEQ ID NO: 440000 - DNA, 20 bp, Artificial Sequence
  chemically synthesized
gggtgaccacagtttaaaga

SEQ ID NO: 440001 - DNA, 20 bp, Artificial Sequence
  chemically synthesized
tgggtgaccacagtttaaag

SEQ ID NO: 440002 - DNA, 20 bp, Artificial Sequence
  chemically synthesized
taagtcccttctttaaactg

SEQ ID NO: 440003 - DNA, 20 bp, Artificial Sequence
  chemically synthesized
ttttgggtgaccacagttta

SEQ ID NO: 440004 - DNA, 20 bp, Artificial Sequence
  chemically synthesized
tgtgtggttttgggtgacca

SEQ ID NO: 440005 - DNA, 20 bp, Artificial Sequence
  chemically synthesized
aacttgtattgtgtggtttt

SEQ ID NO: 440006 - DNA, 20 bp, Artificial Sequence
  chemically synthesized
aaacttgtattgtgtggttt

SEQ ID NO: 440007 - DNA, 20 bp, Artificial Sequence
  chemically synthesized
tctctaaaacttgtattgtg

SEQ ID NO: 440008 - DNA, 20 bp, Artificial Sequence
  chemically synthesized
cacccaaaaccacacaatac

SEQ ID NO: 440009 - DNA, 20 bp, Artificial Sequence
  chemically synthesized
aaaccacacaatacaagttt

SEQ ID NO: 440010 - DNA, 20 bp, Artificial Sequence
  chemically synthesized
accacacaatacaagtttta

SEQ ID NO: 440011 - DNA, 20 bp, Artificial Sequence
  chemically synthesized
cacacaatacaagttttaga

SEQ ID NO: 440012 - DNA, 20 bp, Artificial Sequence
  chemically synthesized
aaaaataaaagtatcaaaat

SEQ ID NO: 440013 - DNA, 20 bp, Artificial Sequence
  chemically synthesized
tattttgatacttttatttt

SEQ ID NO: 440014 - DNA, 20 bp, Artificial Sequence
  chemically synthesized
caaaataaatccaaaaataa

SEQ ID NO: 440015 - DNA, 20 bp, Artificial Sequence
  chemically synthesized
tttatttttggatttatttt

SEQ ID NO: 440016 - DNA, 20 bp, Artificial Sequence
  chemically synthesized
tatttttggatttattttga

SEQ ID NO: 440017 - DNA, 20 bp, Artificial Sequence
  chemically synthesized
ttaaatgtctgaaaatggat

SEQ ID NO: 440018 - DNA, 20 bp, Artificial Sequence
  chemically synthesized
tttgagagccaatccatttt

SEQ ID NO: 440019 - DNA, 20 bp, Artificial Sequence
  chemically synthesized
ttactttaaatgtctgaaaa

SEQ ID NO: 440020 - DNA, 20 bp, Artificial Sequence
  chemically synthesized
aatccattttcagacattta

SEQ ID NO: 440021 - DNA, 20 bp, Artificial Sequence
  chemically synthesized
tttaaagtaaaacactgcaa

SEQ ID NO: 440022 - DNA, 20 bp, Artificial Sequence
  chemically synthesized
gctcaagcctatggcttttg

SEQ ID NO: 440023 - DNA, 20 bp, Artificial Sequence
  chemically synthesized
gtaaaacactgcaaaagcca

SEQ ID NO: 440024 - DNA, 20 bp, Artificial Sequence
  chemically synthesized
taaaacactgcaaaagccat

SEQ ID NO: 440025 - DNA, 20 bp, Artificial Sequence
  chemically synthesized
actgcaaaagccataggctt

SEQ ID NO: 440026 - DNA, 20 bp, Artificial Sequence
  chemically synthesized
gttcactttgctcaagccta

SEQ ID NO: 440027 - DNA, 20 bp, Artificial Sequence
  chemically synthesized
aaaagccataggcttgagca

SEQ ID NO: 440028 - DNA, 20 bp, Artificial Sequence
  chemically synthesized
cacagaggttcactttgctc

SEQ ID NO: 440029 - DNA, 20 bp, Artificial Sequence
  chemically synthesized
agcaccaagtgttatcacag

SEQ ID NO: 440030 - DNA, 20 bp, Artificial Sequence
  chemically synthesized
gagcaccaagtgttatcaca

SEQ ID NO: 440031 - DNA, 20 bp, Artificial Sequence
  chemically synthesized
gagagcaccaagtgttatca

SEQ ID NO: 440032 - DNA, 20 bp, Artificial Sequence
  chemically synthesized
tgaacctctgtgataacact

SEQ ID NO: 440033 - DNA, 20 bp, Artificial Sequence
  chemically synthesized
atgggctgtcagagagcacc

SEQ ID NO: 440034 - DNA, 20 bp, Artificial Sequence
  chemically synthesized
taacacttggtgctctctga

SEQ ID NO: 440035 - DNA, 20 bp, Artificial Sequence
  chemically synthesized
gtctctaatgggctgtcaga

SEQ ID NO: 440036 - DNA, 20 bp, Artificial Sequence
  chemically synthesized
ccgtctctaatgggctgtca

SEQ ID NO: 440037 - DNA, 20 bp, Artificial Sequence
  chemically synthesized
ccccgtctctaatgggctgt

SEQ ID NO: 440038 - DNA, 20 bp, Artificial Sequence
  chemically synthesized
ggtgctctctgacagcccat

SEQ ID NO: 440039 - DNA, 20 bp, Artificial Sequence
  chemically synthesized
tgctctctgacagcccatta

SEQ ID NO: 440040 - DNA, 20 bp, Artificial Sequence
  chemically synthesized
gtacacaccccgtctctaat

SEQ ID NO: 440041 - DNA, 20 bp, Artificial Sequence
  chemically synthesized
ctctgacagcccattagaga

SEQ ID NO: 440042 - DNA, 20 bp, Artificial Sequence
  chemically synthesized
tgtacacaccccgtctctaa

SEQ ID NO: 440043 - DNA, 20 bp, Artificial Sequence
  chemically synthesized
tctgacagcccattagagac

SEQ ID NO: 440044 - DNA, 20 bp, Artificial Sequence
  chemically synthesized
ctgacagcccattagagacg

SEQ ID NO: 440045 - DNA, 20 bp, Artificial Sequence
  chemically synthesized
gggtgtgtacacctaatcca

SEQ ID NO: 440046 - DNA, 20 bp, Artificial Sequence
  chemically synthesized
ggtgtgtacacctaatccaa

SEQ ID NO: 440047 - DNA, 20 bp, Artificial Sequence
  chemically synthesized
ctagaggattcctttggatt

SEQ ID NO: 440048 - DNA, 20 bp, Artificial Sequence
  chemically synthesized
gctagaggattcctttggat

SEQ ID NO: 440049 - DNA, 20 bp, Artificial Sequence
  chemically synthesized
gaagagctagaggattcctt

SEQ ID NO: 440050 - DNA, 20 bp, Artificial Sequence
  chemically synthesized
cctaatccaaaggaatcctc

SEQ ID NO: 440051 - DNA, 20 bp, Artificial Sequence
  chemically synthesized
aacagctgctgaagagctag

SEQ ID NO: 440052 - DNA, 20 bp, Artificial Sequence
  chemically synthesized
gaacagctgctgaagagcta

SEQ ID NO: 440053 - DNA, 20 bp, Artificial Sequence
  chemically synthesized
aaaggaatcctctagctctt

SEQ ID NO: 440054 - DNA, 20 bp, Artificial Sequence
  chemically synthesized
gtgaacagctgctgaagagc

SEQ ID NO: 440055 - DNA, 20 bp, Artificial Sequence
  chemically synthesized
ggaatcctctagctcttcag

SEQ ID NO: 440056 - DNA, 20 bp, Artificial Sequence
  chemically synthesized
ccatgtgaacagctgctgaa

SEQ ID NO: 440057 - DNA, 20 bp, Artificial Sequence
  chemically synthesized
agccatgtgaacagctgctg

SEQ ID NO: 440058 - DNA, 20 bp, Artificial Sequence
  chemically synthesized
ctcttcagcagctgttcaca

SEQ ID NO: 440059 - DNA, 20 bp, Artificial Sequence
  chemically synthesized
cagggcatgagccatgtgaa

SEQ ID NO: 440060 - DNA, 20 bp, Artificial Sequence
  chemically synthesized
gacgctgaagggcagggcat

SEQ ID NO: 440061 - DNA, 20 bp, Artificial Sequence
  chemically synthesized
atggctcatgccctgccctt

SEQ ID NO: 440062 - DNA, 20 bp, Artificial Sequence
  chemically synthesized
ttagtagacgctgaagggca

SEQ ID NO: 440063 - DNA, 20 bp, Artificial Sequence
  chemically synthesized
tttagtagacgctgaagggc

SEQ ID NO: 440064 - DNA, 20 bp, Artificial Sequence
  chemically synthesized
atttagtagacgctgaaggg

SEQ ID NO: 440065 - DNA, 20 bp, Artificial Sequence
  chemically synthesized
ctgatttagtagacgctgaa

SEQ ID NO: 440066 - DNA, 20 bp, Artificial Sequence
  chemically synthesized
cctgatttagtagacgctga

SEQ ID NO: 440067 - DNA, 20 bp, Artificial Sequence
  chemically synthesized
tcctgatttagtagacgctg

SEQ ID NO: 440068 - DNA, 20 bp, Artificial Sequence
  chemically synthesized
cccttcagcgtctactaaat

SEQ ID NO: 440069 - DNA, 20 bp, Artificial Sequence
  chemically synthesized
ccttcagcgtctactaaatc

SEQ ID NO: 440070 - DNA, 20 bp, Artificial Sequence
  chemically synthesized
gctggggaatcctgatttag

SEQ ID NO: 440071 - DNA, 20 bp, Artificial Sequence
  chemically synthesized
acagctggggaatcctgatt

SEQ ID NO: 440072 - DNA, 20 bp, Artificial Sequence
  chemically synthesized
tctactaaatcaggattccc

SEQ ID NO: 440073 - DNA, 20 bp, Artificial Sequence
  chemically synthesized
acgggaagctcagacagctg

SEQ ID NO: 440074 - DNA, 20 bp, Artificial Sequence
  chemically synthesized
tacgggaagctcagacagct

SEQ ID NO: 440075 - DNA, 20 bp, Artificial Sequence
  chemically synthesized
tcaggattccccagctgtct

SEQ ID NO: 440076 - DNA, 20 bp, Artificial Sequence
  chemically synthesized
ttacgggaagctcagacagc

SEQ ID NO: 440077 - DNA, 20 bp, Artificial Sequence
  chemically synthesized
tcgcttacgggaagctcaga

SEQ ID NO: 440078 - DNA, 20 bp, Artificial Sequence
  chemically synthesized
aaaatcgcttacgggaagct

SEQ ID NO: 440079 - DNA, 20 bp, Artificial Sequence
  chemically synthesized
cagctgtctgagcttcccgt

SEQ ID NO: 440080 - DNA, 20 bp, Artificial Sequence
  chemically synthesized
taactaaaatcgcttacggg

SEQ ID NO: 440081 - DNA, 20 bp, Artificial Sequence
  chemically synthesized
ggttaactaaaatcgcttac

SEQ ID NO: 440082 - DNA, 20 bp, Artificial Sequence
  chemically synthesized
tggttaactaaaatcgctta

SEQ ID NO: 440083 - DNA, 20 bp, Artificial Sequence
  chemically synthesized
gagcttcccgtaagcgattt

SEQ ID NO: 440084 - DNA, 20 bp, Artificial Sequence
  chemically synthesized
gattttagttaaccacctac

SEQ ID NO: 440085 - DNA, 20 bp, Artificial Sequence
  chemically synthesized
aagaaatgttggcttgtagg

SEQ ID NO: 440086 - DNA, 20 bp, Artificial Sequence
  chemically synthesized
tgcaagaaatgttggcttgt

SEQ ID NO: 440087 - DNA, 20 bp, Artificial Sequence
  chemically synthesized
atgcaagaaatgttggcttg

SEQ ID NO: 440088 - DNA, 20 bp, Artificial Sequence
  chemically synthesized
taatcagatgcaagaaatgt

SEQ ID NO: 440089 - DNA, 20 bp, Artificial Sequence
  chemically synthesized
taaagagcgtaatcagatgc

SEQ ID NO: 440090 - DNA, 20 bp, Artificial Sequence
  chemically synthesized
tagactttaaagagcgtaat

SEQ ID NO: 440091 - DNA, 20 bp, Artificial Sequence
  chemically synthesized
gcatctgattacgctcttta

SEQ ID NO: 440092 - DNA, 20 bp, Artificial Sequence
  chemically synthesized
aagggaaattagactttaaa

SEQ ID NO: 440093 - DNA, 20 bp, Artificial Sequence
  chemically synthesized
aaaagggaaattagacttta

SEQ ID NO: 440094 - DNA, 20 bp, Artificial Sequence
  chemically synthesized
ctaggaagcaaaagggaaat

SEQ ID NO: 440095 - DNA, 20 bp, Artificial Sequence
  chemically synthesized
aaaataactaggaagcaaaa

SEQ ID NO: 440096 - DNA, 20 bp, Artificial Sequence
  chemically synthesized
caaaataactaggaagcaaa

SEQ ID NO: 440097 - DNA, 20 bp, Artificial Sequence
  chemically synthesized
gcaaaataactaggaagcaa

SEQ ID NO: 440098 - DNA, 20 bp, Artificial Sequence
  chemically synthesized
ctaatttcccttttgcttcc

SEQ ID NO: 440099 - DNA, 20 bp, Artificial Sequence
  chemically synthesized
catgttgcaaaataactagg

SEQ ID NO: 440100 - DNA, 20 bp, Artificial Sequence
  chemically synthesized
tcacatgttgcaaaataact

SEQ ID NO: 440101 - DNA, 20 bp, Artificial Sequence
  chemically synthesized
ctcacatgttgcaaaataac

SEQ ID NO: 440102 - DNA, 20 bp, Artificial Sequence
  chemically synthesized
ctagttattttgcaacatgt

SEQ ID NO: 440103 - DNA, 20 bp, Artificial Sequence
  chemically synthesized
ttttgcaacatgtgagtcat

SEQ ID NO: 440104 - DNA, 20 bp, Artificial Sequence
  chemically synthesized
tttgcaacatgtgagtcatt

SEQ ID NO: 440105 - DNA, 20 bp, Artificial Sequence
  chemically synthesized
attgggattcatcattttta

SEQ ID NO: 440106 - DNA, 20 bp, Artificial Sequence
  chemically synthesized
tattttttcacttactcaac

SEQ ID NO: 440107 - DNA, 20 bp, Artificial Sequence
  chemically synthesized
tattaataaactagttgagt

SEQ ID NO: 440108 - DNA, 20 bp, Artificial Sequence
  chemically synthesized
aaaatattaataaactagtt

SEQ ID NO: 440109 - DNA, 20 bp, Artificial Sequence
  chemically synthesized
tgaacaaaatattaataaac

SEQ ID NO: 440110 - DNA, 20 bp, Artificial Sequence
  chemically synthesized
ttattaatattttgttcact

SEQ ID NO: 440111 - DNA, 20 bp, Artificial Sequence
  chemically synthesized
ttagaaataaattggtgact

SEQ ID NO: 440112 - DNA, 20 bp, Artificial Sequence
  chemically synthesized
acgatgtattagaaataaat

SEQ ID NO: 440113 - DNA, 20 bp, Artificial Sequence
  chemically synthesized
ggtgcttaagaacgatgtat

SEQ ID NO: 440114 - DNA, 20 bp, Artificial Sequence
  chemically synthesized
atttctaatacatcgttctt

SEQ ID NO: 440115 - DNA, 20 bp, Artificial Sequence
  chemically synthesized
tcctttttatgttggtgctt

SEQ ID NO: 440116 - DNA, 20 bp, Artificial Sequence
  chemically synthesized
ttcttaagcaccaacataaa

SEQ ID NO: 440117 - DNA, 20 bp, Artificial Sequence
  chemically synthesized
tgagtaattcctttttatgt

SEQ ID NO: 440118 - DNA, 20 bp, Artificial Sequence
  chemically synthesized
tcttaagcaccaacataaaa

SEQ ID NO: 440119 - DNA, 20 bp, Artificial Sequence
  chemically synthesized
attttcatcaaaggcaaatt

SEQ ID NO: 440120 - DNA, 20 bp, Artificial Sequence
  chemically synthesized
ggcccacgtattttcatcaa

SEQ ID NO: 440121 - DNA, 20 bp, Artificial Sequence
  chemically synthesized
tggcccacgtattttcatca

SEQ ID NO: 440122 - DNA, 20 bp, Artificial Sequence
  chemically synthesized
ttgcctttgatgaaaatacg

SEQ ID NO: 440123 - DNA, 20 bp, Artificial Sequence
  chemically synthesized
tgcctttgatgaaaatacgt

SEQ ID NO: 440124 - DNA, 20 bp, Artificial Sequence
  chemically synthesized
gaaaaatcacaaaatcagaa

SEQ ID NO: 440125 - DNA, 20 bp, Artificial Sequence
  chemically synthesized
agaaagaaaaatcacaaaat

SEQ ID NO: 440126 - DNA, 20 bp, Artificial Sequence
  chemically synthesized
gaaaaattaaagaaataaga

SEQ ID NO: 440127 - DNA, 20 bp, Artificial Sequence
  chemically synthesized
tgaggaaaaattaaagaaat

SEQ ID NO: 440128 - DNA, 20 bp, Artificial Sequence
  chemically synthesized
agctgtgtgaggaaaaatta

SEQ ID NO: 440129 - DNA, 20 bp, Artificial Sequence
  chemically synthesized
ttctttaatttttcctcaca

SEQ ID NO: 440130 - DNA, 20 bp, Artificial Sequence
  chemically synthesized
ttagccttggaagctgtgtg

SEQ ID NO: 440131 - DNA, 20 bp, Artificial Sequence
  chemically synthesized
tttagccttggaagctgtgt

SEQ ID NO: 440132 - DNA, 20 bp, Artificial Sequence
  chemically synthesized
tttttcctcacacagcttcc

SEQ ID NO: 440133 - DNA, 20 bp, Artificial Sequence
  chemically synthesized
ttttcctcacacagcttcca

SEQ ID NO: 440134 - DNA, 20 bp, Artificial Sequence
  chemically synthesized
agtgcagattttagccttgg

SEQ ID NO: 440135 - DNA, 20 bp, Artificial Sequence
  chemically synthesized
acaagtgcagattttagcct

SEQ ID NO: 440136 - DNA, 20 bp, Artificial Sequence
  chemically synthesized
actgttacaagtgcagattt

SEQ ID NO: 440137 - DNA, 20 bp, Artificial Sequence
  chemically synthesized
tcagtacactgttacaagtg

SEQ ID NO: 440138 - DNA, 20 bp, Artificial Sequence
  chemically synthesized
gctaaaatctgcacttgtaa

SEQ ID NO: 440139 - DNA, 20 bp, Artificial Sequence
  chemically synthesized
gggagtcagtacactgttac

SEQ ID NO: 440140 - DNA, 20 bp, Artificial Sequence
  chemically synthesized
gacttaaagggcaagggagt

SEQ ID NO: 440141 - DNA, 20 bp, Artificial Sequence
  chemically synthesized
tgctgacttaaagggcaagg

SEQ ID NO: 440142 - DNA, 20 bp, Artificial Sequence
  chemically synthesized
agtgctgacttaaagggcaa

SEQ ID NO: 440143 - DNA, 20 bp, Artificial Sequence
  chemically synthesized
aagtgctgacttaaagggca

SEQ ID NO: 440144 - DNA, 20 bp, Artificial Sequence
  chemically synthesized
tactgactcccttgcccttt

SEQ ID NO: 440145 - DNA, 20 bp, Artificial Sequence
  chemically synthesized
taagtgctgacttaaagggc

SEQ ID NO: 440146 - DNA, 20 bp, Artificial Sequence
  chemically synthesized
gactcccttgccctttaagt

SEQ ID NO: 440147 - DNA, 20 bp, Artificial Sequence
  chemically synthesized
gagctaagtgctgacttaaa

SEQ ID NO: 440148 - DNA, 20 bp, Artificial Sequence
  chemically synthesized
tgagctaagtgctgacttaa

SEQ ID NO: 440149 - DNA, 20 bp, Artificial Sequence
  chemically synthesized
ctgagctaagtgctgactta

SEQ ID NO: 440150 - DNA, 20 bp, Artificial Sequence
  chemically synthesized
ttgccctttaagtcagcact

SEQ ID NO: 440151 - DNA, 20 bp, Artificial Sequence
  chemically synthesized
ctttaagtcagcacttagct

SEQ ID NO: 440152 - DNA, 20 bp, Artificial Sequence
  chemically synthesized
tttaagtcagcacttagctc

SEQ ID NO: 440153 - DNA, 20 bp, Artificial Sequence
  chemically synthesized
atagtaccttagcctgagct

SEQ ID NO: 440154 - DNA, 20 bp, Artificial Sequence
  chemically synthesized
gtcagcacttagctcaggct

SEQ ID NO: 440155 - DNA, 20 bp, Artificial Sequence
  chemically synthesized
tcagcacttagctcaggcta

SEQ ID NO: 440156 - DNA, 20 bp, Artificial Sequence
  chemically synthesized
ttgcaatagtaccttagcct

SEQ ID NO: 440157 - DNA, 20 bp, Artificial Sequence
  chemically synthesized
ttacggttgcaatagtacct

SEQ ID NO: 440158 - DNA, 20 bp, Artificial Sequence
  chemically synthesized
ttatcagattacggttgcaa

SEQ ID NO: 440159 - DNA, 20 bp, Artificial Sequence
  chemically synthesized
tctcttcctttatcagatta

SEQ ID NO: 440160 - DNA, 20 bp, Artificial Sequence
  chemically synthesized
attgcaaccgtaatctgata

SEQ ID NO: 440161 - DNA, 20 bp, Artificial Sequence
  chemically synthesized
ttgcaaccgtaatctgataa

SEQ ID NO: 440162 - DNA, 20 bp, Artificial Sequence
  chemically synthesized
caaccgtaatctgataaagg

SEQ ID NO: 440163 - DNA, 20 bp, Artificial Sequence
  chemically synthesized
caacttgtctcttcctttat

SEQ ID NO: 440164 - DNA, 20 bp, Artificial Sequence
  chemically synthesized
accgtaatctgataaaggaa

SEQ ID NO: 440165 - DNA, 20 bp, Artificial Sequence
  chemically synthesized
aatctgataaaggaagagac

SEQ ID NO: 440166 - DNA, 20 bp, Artificial Sequence
  chemically synthesized
gataaaggaagagacaagtt

SEQ ID NO: 440167 - DNA, 20 bp, Artificial Sequence
  chemically synthesized
agacaagttgagtgcaaata

SEQ ID NO: 440168 - DNA, 20 bp, Artificial Sequence
  chemically synthesized
agttgagtgcaaataaagat

SEQ ID NO: 440169 - DNA, 20 bp, Artificial Sequence
  chemically synthesized
gtgcaaataaagatgagtgc

SEQ ID NO: 440170 - DNA, 20 bp, Artificial Sequence
  chemically synthesized
tgcaaataaagatgagtgcc

SEQ ID NO: 440171 - DNA, 20 bp, Artificial Sequence
  chemically synthesized
taaagatgagtgccaggaat

SEQ ID NO: 440172 - DNA, 20 bp, Artificial Sequence
  chemically synthesized
agtagcttttttctcattcc

SEQ ID NO: 440173 - DNA, 20 bp, Artificial Sequence
  chemically synthesized
gagtgccaggaatgagaaaa

SEQ ID NO: 440174 - DNA, 20 bp, Artificial Sequence
  chemically synthesized
taaaagggcataaacatcag

SEQ ID NO: 440175 - DNA, 20 bp, Artificial Sequence
  chemically synthesized
ctataaaagggcataaacat

SEQ ID NO: 440176 - DNA, 20 bp, Artificial Sequence
  chemically synthesized
ctgatgtttatgccctttta

SEQ ID NO: 440177 - DNA, 20 bp, Artificial Sequence
  chemically synthesized
atggaatcaggactataaaa

SEQ ID NO: 440178 - DNA, 20 bp, Artificial Sequence
  chemically synthesized
catggaatcaggactataaa

SEQ ID NO: 440179 - DNA, 20 bp, Artificial Sequence
  chemically synthesized
tcatggaatcaggactataa

SEQ ID NO: 440180 - DNA, 20 bp, Artificial Sequence
  chemically synthesized
gctaagactgtcatggaatc

SEQ ID NO: 440181 - DNA, 20 bp, Artificial Sequence
  chemically synthesized
ggctaagactgtcatggaat

SEQ ID NO: 440182 - DNA, 20 bp, Artificial Sequence
  chemically synthesized
ttatagtcctgattccatga

SEQ ID NO: 440183 - DNA, 20 bp, Artificial Sequence
  chemically synthesized
gcttttggctaagactgtca

SEQ ID NO: 440184 - DNA, 20 bp, Artificial Sequence
  chemically synthesized
tcctgattccatgacagtct

SEQ ID NO: 440185 - DNA, 20 bp, Artificial Sequence
  chemically synthesized
tccatgacagtcttagccaa

SEQ ID NO: 440186 - DNA, 20 bp, Artificial Sequence
  chemically synthesized
cttccactctgcttttggct

SEQ ID NO: 440187 - DNA, 20 bp, Artificial Sequence
  chemically synthesized
atgacagtcttagccaaaag

SEQ ID NO: 440188 - DNA, 20 bp, Artificial Sequence
  chemically synthesized
gacagtcttagccaaaagca

SEQ ID NO: 440189 - DNA, 20 bp, Artificial Sequence
  chemically synthesized
cccttcttccactctgcttt

SEQ ID NO: 440190 - DNA, 20 bp, Artificial Sequence
  chemically synthesized
agtcttagccaaaagcagag

SEQ ID NO: 440191 - DNA, 20 bp, Artificial Sequence
  chemically synthesized
cttagccaaaagcagagtgg

SEQ ID NO: 440192 - DNA, 20 bp, Artificial Sequence
  chemically synthesized
agccaaaagcagagtggaag

SEQ ID NO: 440193 - DNA, 20 bp, Artificial Sequence
  chemically synthesized
gccaaaagcagagtggaaga

SEQ ID NO: 440194 - DNA, 20 bp, Artificial Sequence
  chemically synthesized
ccaaaagcagagtggaagaa

SEQ ID NO: 440195 - DNA, 20 bp, Artificial Sequence
  chemically synthesized
aaaagcagagtggaagaagg

SEQ ID NO: 440196 - DNA, 20 bp, Artificial Sequence
  chemically synthesized
ttttgttttgttttgtttta

SEQ ID NO: 440197 - DNA, 20 bp, Artificial Sequence
  chemically synthesized
tttaaaacaaaacaaaacaa

SEQ ID NO: 440198 - DNA, 20 bp, Artificial Sequence
  chemically synthesized
aacaaaacaaaacaaaagcc

SEQ ID NO: 440199 - DNA, 20 bp, Artificial Sequence
  chemically synthesized
aaaacaaaacaaaagccaag

SEQ ID NO: 440200 - DNA, 20 bp, Artificial Sequence
  chemically synthesized
aacaaaacaaaagccaagaa

SEQ ID NO: 440201 - DNA, 20 bp, Artificial Sequence
  chemically synthesized
acaaaacaaaagccaagaag

SEQ ID NO: 440202 - DNA, 20 bp, Artificial Sequence
  chemically synthesized
caaaacaaaagccaagaaga

SEQ ID NO: 440203 - DNA, 20 bp, Artificial Sequence
  chemically synthesized
aaatgtttttaccctcttct

SEQ ID NO: 440204 - DNA, 20 bp, Artificial Sequence
  chemically synthesized
gaagagggtaaaaacattta

SEQ ID NO: 440205 - DNA, 20 bp, Artificial Sequence
  chemically synthesized
aagagggtaaaaacatttaa

SEQ ID NO: 440206 - DNA, 20 bp, Artificial Sequence
  chemically synthesized
agagggtaaaaacatttaaa

SEQ ID NO: 440207 - DNA, 20 bp, Artificial Sequence
  chemically synthesized
ggtaaaaacatttaaagggt

SEQ ID NO: 440208 - DNA, 20 bp, Artificial Sequence
  chemically synthesized
gcattttatttgcccataat

SEQ ID NO: 440209 - DNA, 20 bp, Artificial Sequence
  chemically synthesized
cccatattatttccaattat

SEQ ID NO: 440210 - DNA, 20 bp, Artificial Sequence
  chemically synthesized
tcccatattatttccaatta

SEQ ID NO: 440211 - DNA, 20 bp, Artificial Sequence
  chemically synthesized
gcccataattggaaataata

SEQ ID NO: 440212 - DNA, 20 bp, Artificial Sequence
  chemically synthesized
cccataattggaaataatat

SEQ ID NO: 440213 - DNA, 20 bp, Artificial Sequence
  chemically synthesized
aataatatgggacaccgtaa

SEQ ID NO: 440214 - DNA, 20 bp, Artificial Sequence
  chemically synthesized
gctgagcacaattaccatta

SEQ ID NO: 440215 - DNA, 20 bp, Artificial Sequence
  chemically synthesized
accgtaatggtaattgtgct

SEQ ID NO: 440216 - DNA, 20 bp, Artificial Sequence
  chemically synthesized
aaaaaaggtcagtgttagct

SEQ ID NO: 440217 - DNA, 20 bp, Artificial Sequence
  chemically synthesized
tttttaaaaaaggtcagtgt

SEQ ID NO: 440218 - DNA, 20 bp, Artificial Sequence
  chemically synthesized
ttttgatttttaaaaaaggt

SEQ ID NO: 440219 - DNA, 20 bp, Artificial Sequence
  chemically synthesized
aaaattttgatttttaaaaa

SEQ ID NO: 440220 - DNA, 20 bp, Artificial Sequence
  chemically synthesized
gaaaattttgatttttaaaa

SEQ ID NO: 440221 - DNA, 20 bp, Artificial Sequence
  chemically synthesized
aaaaatcaaaattttcatga

SEQ ID NO: 440222 - DNA, 20 bp, Artificial Sequence
  chemically synthesized
tcaaaattttcatgatagtg

SEQ ID NO: 440223 - DNA, 20 bp, Artificial Sequence
  chemically synthesized
agtgaagacaacacatttaa

SEQ ID NO: 440224 - DNA, 20 bp, Artificial Sequence
  chemically synthesized
acatttaaaagttgacaaat

SEQ ID NO: 440225 - DNA, 20 bp, Artificial Sequence
  chemically synthesized
ttaaaagttgacaaattagc

SEQ ID NO: 440226 - DNA, 20 bp, Artificial Sequence
  chemically synthesized
aaaagttgacaaattagcaa

SEQ ID NO: 440227 - DNA, 20 bp, Artificial Sequence
  chemically synthesized
gaattcacatatatatcacg

SEQ ID NO: 440228 - DNA, 20 bp, Artificial Sequence
  chemically synthesized
acatgggcatatcaacaatg

SEQ ID NO: 440229 - DNA, 20 bp, Artificial Sequence
  chemically synthesized
tacatgggcatatcaacaat

SEQ ID NO: 440230 - DNA, 20 bp, Artificial Sequence
  chemically synthesized
attgttgatatgcccatgta

SEQ ID NO: 440231 - DNA, 20 bp, Artificial Sequence
  chemically synthesized
taaatatgaaaaccatacat

SEQ ID NO: 440232 - DNA, 20 bp, Artificial Sequence
  chemically synthesized
ataaatatgaaaaccataca

SEQ ID NO: 440233 - DNA, 20 bp, Artificial Sequence
  chemically synthesized
aacaaaaaacatcatgattc

SEQ ID NO: 440234 - DNA, 20 bp, Artificial Sequence
  chemically synthesized
ttaaagaaacttcaaaaaat

SEQ ID NO: 440235 - DNA, 20 bp, Artificial Sequence
  chemically synthesized
ttcgagcatctgattttttg

SEQ ID NO: 440236 - DNA, 20 bp, Artificial Sequence
  chemically synthesized
agaggattaagataatttta

SEQ ID NO: 440237 - DNA, 20 bp, Artificial Sequence
  chemically synthesized
aatgggttttggagaggatt

SEQ ID NO: 440238 - DNA, 20 bp, Artificial Sequence
  chemically synthesized
tggcttaatgggttttggag

SEQ ID NO: 440239 - DNA, 20 bp, Artificial Sequence
  chemically synthesized
atggcttaatgggttttgga

SEQ ID NO: 440240 - DNA, 20 bp, Artificial Sequence
  chemically synthesized
agatggcttaatgggttttg

SEQ ID NO: 440241 - DNA, 20 bp, Artificial Sequence
  chemically synthesized
gtagatggcttaatgggttt

SEQ ID NO: 440242 - DNA, 20 bp, Artificial Sequence
  chemically synthesized
aatcctctccaaaacccatt

SEQ ID NO: 440243 - DNA, 20 bp, Artificial Sequence
  chemically synthesized
gagaatgtagatggcttaat

SEQ ID NO: 440244 - DNA, 20 bp, Artificial Sequence
  chemically synthesized
tgagaatgtagatggcttaa

SEQ ID NO: 440245 - DNA, 20 bp, Artificial Sequence
  chemically synthesized
taatgaaatgagaatgtaga

SEQ ID NO: 440246 - DNA, 20 bp, Artificial Sequence
  chemically synthesized
catgtaatgaaatgagaatg

SEQ ID NO: 440247 - DNA, 20 bp, Artificial Sequence
  chemically synthesized
gcttatccatgtaatgaaat

SEQ ID NO: 440248 - DNA, 20 bp, Artificial Sequence
  chemically synthesized
tacattctcatttcattaca

SEQ ID NO: 440249 - DNA, 20 bp, Artificial Sequence
  chemically synthesized
tctcatttcattacatggat

SEQ ID NO: 440250 - DNA, 20 bp, Artificial Sequence
  chemically synthesized
ttcattacatggataagcat

SEQ ID NO: 440251 - DNA, 20 bp, Artificial Sequence
  chemically synthesized
tacattaaaatgcattatta

SEQ ID NO: 440252 - DNA, 20 bp, Artificial Sequence
  chemically synthesized
tggttgtgtcaacgaagagg

SEQ ID NO: 440253 - DNA, 20 bp, Artificial Sequence
  chemically synthesized
gtggttgtgtcaacgaagag

SEQ ID NO: 440254 - DNA, 20 bp, Artificial Sequence
  chemically synthesized
atgtggttgtgtcaacgaag

SEQ ID NO: 440255 - DNA, 20 bp, Artificial Sequence
  chemically synthesized
aatgtggttgtgtcaacgaa

SEQ ID NO: 440256 - DNA, 20 bp, Artificial Sequence
  chemically synthesized
aaaatgtggttgtgtcaacg

SEQ ID NO: 440257 - DNA, 20 bp, Artificial Sequence
  chemically synthesized
tttattttagtagaaaaatg

SEQ ID NO: 440258 - DNA, 20 bp, Artificial Sequence
  chemically synthesized
agtttagttatttattttag

SEQ ID NO: 440259 - DNA, 20 bp, Artificial Sequence
  chemically synthesized
tttagtttagttatttattt

SEQ ID NO: 440260 - DNA, 20 bp, Artificial Sequence
  chemically synthesized
gtttattattcattttagtt

SEQ ID NO: 440261 - DNA, 20 bp, Artificial Sequence
  chemically synthesized
tttttgtttattattcattt

SEQ ID NO: 440262 - DNA, 20 bp, Artificial Sequence
  chemically synthesized
atgaataataaacaaaaata

SEQ ID NO: 440263 - DNA, 20 bp, Artificial Sequence
  chemically synthesized
tgaataataaacaaaaataa

SEQ ID NO: 440264 - DNA, 20 bp, Artificial Sequence
  chemically synthesized
aataaacaaaaataaaggca

SEQ ID NO: 440265 - DNA, 20 bp, Artificial Sequence
  chemically synthesized
ataaaggcaaagctcttcct

SEQ ID NO: 440266 - DNA, 20 bp, Artificial Sequence
  chemically synthesized
gaataaaagaatctgaggaa

SEQ ID NO: 440267 - DNA, 20 bp, Artificial Sequence
  chemically synthesized
ttgaataaaagaatctgagg

SEQ ID NO: 440268 - DNA, 20 bp, Artificial Sequence
  chemically synthesized
catttgaataaaagaatctg

SEQ ID NO: 440269 - DNA, 20 bp, Artificial Sequence
  chemically synthesized
ccatttgaataaaagaatct

SEQ ID NO: 440270 - DNA, 20 bp, Artificial Sequence
  chemically synthesized
tctaattgccatttgaataa

SEQ ID NO: 440271 - DNA, 20 bp, Artificial Sequence
  chemically synthesized
ctcagattcttttattcaaa

SEQ ID NO: 440272 - DNA, 20 bp, Artificial Sequence
  chemically synthesized
tcttttattcaaatggcaat

SEQ ID NO: 440273 - DNA, 20 bp, Artificial Sequence
  chemically synthesized
aagactggtgaataatatgt

SEQ ID NO: 440274 - DNA, 20 bp, Artificial Sequence
  chemically synthesized
taagactggtgaataatatg

SEQ ID NO: 440275 - DNA, 20 bp, Artificial Sequence
  chemically synthesized
tagacctacatattattcac

SEQ ID NO: 440276 - DNA, 20 bp, Artificial Sequence
  chemically synthesized
tacatattattcaccagtct

SEQ ID NO: 440277 - DNA, 20 bp, Artificial Sequence
  chemically synthesized
atctgaaatatatctaagac

SEQ ID NO: 440278 - DNA, 20 bp, Artificial Sequence
  chemically synthesized
tggaaatctgaaatatatct

SEQ ID NO: 440279 - DNA, 20 bp, Artificial Sequence
  chemically synthesized
caccagtcttagatatattt

SEQ ID NO: 440280 - DNA, 20 bp, Artificial Sequence
  chemically synthesized
tatatttcagatttccaaat

SEQ ID NO: 440281 - DNA, 20 bp, Artificial Sequence
  chemically synthesized
ttgattttctcatgccaatt

SEQ ID NO: 440282 - DNA, 20 bp, Artificial Sequence
  chemically synthesized
tcagatttccaaattggcat

SEQ ID NO: 440283 - DNA, 20 bp, Artificial Sequence
  chemically synthesized
aaatcaattcatcaatttgc

SEQ ID NO: 440284 - DNA, 20 bp, Artificial Sequence
  chemically synthesized
tgtccataaattaaaaatgc

SEQ ID NO: 440285 - DNA, 20 bp, Artificial Sequence
  chemically synthesized
ttgctagcatttttaattta

SEQ ID NO: 440286 - DNA, 20 bp, Artificial Sequence
  chemically synthesized
ggacaattattttcttaaaa

SEQ ID NO: 440287 - DNA, 20 bp, Artificial Sequence
  chemically synthesized
ttttgattacataccatttt

SEQ ID NO: 440288 - DNA, 20 bp, Artificial Sequence
  chemically synthesized
tggtatgtaatcaaaatact

SEQ ID NO: 440289 - DNA, 20 bp, Artificial Sequence
  chemically synthesized
ctctttcagaatttttaact

SEQ ID NO: 440290 - DNA, 20 bp, Artificial Sequence
  chemically synthesized
tactgagttaaaaattctga

SEQ ID NO: 440291 - DNA, 20 bp, Artificial Sequence
  chemically synthesized
ctgagttaaaaattctgaaa

SEQ ID NO: 440292 - DNA, 20 bp, Artificial Sequence
  chemically synthesized
ttgttcttaaatgactcttt

SEQ ID NO: 440293 - DNA, 20 bp, Artificial Sequence
  chemically synthesized
aaattctgaaagagtcattt

SEQ ID NO: 440294 - DNA, 20 bp, Artificial Sequence
  chemically synthesized
agaacaacaacaaacaacaa

SEQ ID NO: 440295 - DNA, 20 bp, Artificial Sequence
  chemically synthesized
caacagcaacaacattttat

SEQ ID NO: 440296 - DNA, 20 bp, Artificial Sequence
  chemically synthesized
gcaacaacattttatcagca

SEQ ID NO: 440297 - DNA, 20 bp, Artificial Sequence
  chemically synthesized
caacattttatcagcatggc

SEQ ID NO: 440298 - DNA, 20 bp, Artificial Sequence
  chemically synthesized
aacattttatcagcatggca

SEQ ID NO: 440299 - DNA, 20 bp, Artificial Sequence
  chemically synthesized
atgatcctttaattgaaatg

SEQ ID NO: 440300 - DNA, 20 bp, Artificial Sequence
  chemically synthesized
caatgatcctttaattgaaa

SEQ ID NO: 440301 - DNA, 20 bp, Artificial Sequence
  chemically synthesized
tgacaactccatttcaatta

SEQ ID NO: 440302 - DNA, 20 bp, Artificial Sequence
  chemically synthesized
gacaactccatttcaattaa

SEQ ID NO: 440303 - DNA, 20 bp, Artificial Sequence
  chemically synthesized
taatgggaactgggggagaa

SEQ ID NO: 440304 - DNA, 20 bp, Artificial Sequence
  chemically synthesized
gatcattgtccattctcccc

SEQ ID NO: 440305 - DNA, 20 bp, Artificial Sequence
  chemically synthesized
ctcactaatgggaactgggg

SEQ ID NO: 440306 - DNA, 20 bp, Artificial Sequence
  chemically synthesized
tcctcactaatgggaactgg

SEQ ID NO: 440307 - DNA, 20 bp, Artificial Sequence
  chemically synthesized
ttcctcactaatgggaactg

SEQ ID NO: 440308 - DNA, 20 bp, Artificial Sequence
  chemically synthesized
attcctcactaatgggaact

SEQ ID NO: 440309 - DNA, 20 bp, Artificial Sequence
  chemically synthesized
cattcctcactaatgggaac

SEQ ID NO: 440310 - DNA, 20 bp, Artificial Sequence
  chemically synthesized
cattctcccccagttcccat

SEQ ID NO: 440311 - DNA, 20 bp, Artificial Sequence
  chemically synthesized
ctcccccagttcccattagt

SEQ ID NO: 440312 - DNA, 20 bp, Artificial Sequence
  chemically synthesized
tcccccagttcccattagtg

SEQ ID NO: 440313 - DNA, 20 bp, Artificial Sequence
  chemically synthesized
gaaccccattcctcactaat

SEQ ID NO: 440314 - DNA, 20 bp, Artificial Sequence
  chemically synthesized
tgaaccccattcctcactaa

SEQ ID NO: 440315 - DNA, 20 bp, Artificial Sequence
  chemically synthesized
cagttcccattagtgaggaa

SEQ ID NO: 440316 - DNA, 20 bp, Artificial Sequence
  chemically synthesized
agttcccattagtgaggaat

SEQ ID NO: 440317 - DNA, 20 bp, Artificial Sequence
  chemically synthesized
gttcccattagtgaggaatg

SEQ ID NO: 440318 - DNA, 20 bp, Artificial Sequence
  chemically synthesized
aggaatggggttcataatga

SEQ ID NO: 440319 - DNA, 20 bp, Artificial Sequence
  chemically synthesized
gaatggggttcataatgaca

SEQ ID NO: 440320 - DNA, 20 bp, Artificial Sequence
  chemically synthesized
ggttcataatgacagagtga

SEQ ID NO: 440321 - DNA, 20 bp, Artificial Sequence
  chemically synthesized
cataatgacagagtgaaagt

SEQ ID NO: 440322 - DNA, 20 bp, Artificial Sequence
  chemically synthesized
ataatgacagagtgaaagtg

SEQ ID NO: 440323 - DNA, 20 bp, Artificial Sequence
  chemically synthesized
cagagtgaaagtgaggcatt

SEQ ID NO: 440324 - DNA, 20 bp, Artificial Sequence
  chemically synthesized
agagtgaaagtgaggcattg

SEQ ID NO: 440325 - DNA, 20 bp, Artificial Sequence
  chemically synthesized
gagtgaaagtgaggcattga

SEQ ID NO: 440326 - DNA, 20 bp, Artificial Sequence
  chemically synthesized
gtgaaagtgaggcattgagg

SEQ ID NO: 440327 - DNA, 20 bp, Artificial Sequence
  chemically synthesized
aaagtgaggcattgagggag

SEQ ID NO: 440328 - DNA, 20 bp, Artificial Sequence
  chemically synthesized
aagtgaggcattgagggaga

SEQ ID NO: 440329 - DNA, 20 bp, Artificial Sequence
  chemically synthesized
ggcattgagggagaaggcaa

SEQ ID NO: 440330 - DNA, 20 bp, Artificial Sequence
  chemically synthesized
gagaaggcaaaagatcacaa

SEQ ID NO: 440331 - DNA, 20 bp, Artificial Sequence
  chemically synthesized
aggcaaaagatcacaaaaga

SEQ ID NO: 440332 - DNA, 20 bp, Artificial Sequence
  chemically synthesized
caaaagatcacaaaagaaag

SEQ ID NO: 440333 - DNA, 20 bp, Artificial Sequence
  chemically synthesized
aaaagatcacaaaagaaagc

SEQ ID NO: 440334 - DNA, 20 bp, Artificial Sequence
  chemically synthesized
ttagtagtctggatttggtt

SEQ ID NO: 440335 - DNA, 20 bp, Artificial Sequence
  chemically synthesized
attgatttctaaaccaaatc

SEQ ID NO: 440336 - DNA, 20 bp, Artificial Sequence
  chemically synthesized
tgttcttagtagtctggatt

SEQ ID NO: 440337 - DNA, 20 bp, Artificial Sequence
  chemically synthesized
taaaccaaatccagactact

SEQ ID NO: 440338 - DNA, 20 bp, Artificial Sequence
  chemically synthesized
aaccaatgttcttagtagtc

SEQ ID NO: 440339 - DNA, 20 bp, Artificial Sequence
  chemically synthesized
gagaaaaccaatgttcttag

SEQ ID NO: 440340 - DNA, 20 bp, Artificial Sequence
  chemically synthesized
atccagactactaagaacat

SEQ ID NO: 440341 - DNA, 20 bp, Artificial Sequence
  chemically synthesized
cctgagaaaaccaatgttct

SEQ ID NO: 440342 - DNA, 20 bp, Artificial Sequence
  chemically synthesized
actaagaacattggttttct

SEQ ID NO: 440343 - DNA, 20 bp, Artificial Sequence
  chemically synthesized
ctaagaacattggttttctc

SEQ ID NO: 440344 - DNA, 20 bp, Artificial Sequence
  chemically synthesized
taagaacattggttttctca

SEQ ID NO: 440345 - DNA, 20 bp, Artificial Sequence
  chemically synthesized
atgtaatgatagtaagccct

SEQ ID NO: 440346 - DNA, 20 bp, Artificial Sequence
  chemically synthesized
gtagtatatgtaatgatagt

SEQ ID NO: 440347 - DNA, 20 bp, Artificial Sequence
  chemically synthesized
ttgcgtagtatatgtaatga

SEQ ID NO: 440348 - DNA, 20 bp, Artificial Sequence
  chemically synthesized
atcattacatatactacgca

SEQ ID NO: 440349 - DNA, 20 bp, Artificial Sequence
  chemically synthesized
cctctgaaggtgactttgcg

SEQ ID NO: 440350 - DNA, 20 bp, Artificial Sequence
  chemically synthesized
atactacgcaaagtcacctt

SEQ ID NO: 440351 - DNA, 20 bp, Artificial Sequence
  chemically synthesized
actacgcaaagtcaccttca

SEQ ID NO: 440352 - DNA, 20 bp, Artificial Sequence
  chemically synthesized
ctacgcaaagtcaccttcag

SEQ ID NO: 440353 - DNA, 20 bp, Artificial Sequence
  chemically synthesized
tggaggcctacaacctctga

SEQ ID NO: 440354 - DNA, 20 bp, Artificial Sequence
  chemically synthesized
ctggaggcctacaacctctg

SEQ ID NO: 440355 - DNA, 20 bp, Artificial Sequence
  chemically synthesized
aaagtcaccttcagaggttg

SEQ ID NO: 440356 - DNA, 20 bp, Artificial Sequence
  chemically synthesized
aagtcaccttcagaggttgt

SEQ ID NO: 440357 - DNA, 20 bp, Artificial Sequence
  chemically synthesized
cttcagaggttgtaggcctc

SEQ ID NO: 440358 - DNA, 20 bp, Artificial Sequence
  chemically synthesized
cacacagagcaattttctgg

SEQ ID NO: 440359 - DNA, 20 bp, Artificial Sequence
  chemically synthesized
acacacagagcaattttctg

SEQ ID NO: 440360 - DNA, 20 bp, Artificial Sequence
  chemically synthesized
gaacacacagagcaattttc

SEQ ID NO: 440361 - DNA, 20 bp, Artificial Sequence
  chemically synthesized
agtaggcaacggaacacaca

SEQ ID NO: 440362 - DNA, 20 bp, Artificial Sequence
  chemically synthesized
tcagtaggcaacggaacaca

SEQ ID NO: 440363 - DNA, 20 bp, Artificial Sequence
  chemically synthesized
ttgggaatttcagtaggcaa

SEQ ID NO: 440364 - DNA, 20 bp, Artificial Sequence
  chemically synthesized
aaatacttgggaatttcagt

SEQ ID NO: 440365 - DNA, 20 bp, Artificial Sequence
  chemically synthesized
aaaatacttgggaatttcag

SEQ ID NO: 440366 - DNA, 20 bp, Artificial Sequence
  chemically synthesized
ttcaaaatacttgggaattt

SEQ ID NO: 440367 - DNA, 20 bp, Artificial Sequence
  chemically synthesized
cgttgcctactgaaattccc

SEQ ID NO: 440368 - DNA, 20 bp, Artificial Sequence
  chemically synthesized
atcactcgttcaaaatactt

SEQ ID NO: 440369 - DNA, 20 bp, Artificial Sequence
  chemically synthesized
tatcactcgttcaaaatact

SEQ ID NO: 440370 - DNA, 20 bp, Artificial Sequence
  chemically synthesized
aattcccaagtattttgaac

SEQ ID NO: 440371 - DNA, 20 bp, Artificial Sequence
  chemically synthesized
gtattttgaacgagtgatat

SEQ ID NO: 440372 - DNA, 20 bp, Artificial Sequence
  chemically synthesized
agtgatatcagattaaaata

SEQ ID NO: 440373 - DNA, 20 bp, Artificial Sequence
  chemically synthesized
atcagattaaaataaagatc

SEQ ID NO: 440374 - DNA, 20 bp, Artificial Sequence
  chemically synthesized
attaaaataaagatcgagct

SEQ ID NO: 440375 - DNA, 20 bp, Artificial Sequence
  chemically synthesized
taaaataaagatcgagctca

SEQ ID NO: 440376 - DNA, 20 bp, Artificial Sequence
  chemically synthesized
gataatttctattcaactct

SEQ ID NO: 440377 - DNA, 20 bp, Artificial Sequence
  chemically synthesized
agatcgagctcagagttgaa

SEQ ID NO: 440378 - DNA, 20 bp, Artificial Sequence
  chemically synthesized
atagaaattatcccttaaaa

SEQ ID NO: 440379 - DNA, 20 bp, Artificial Sequence
  chemically synthesized
tgtttaggctgccattttaa

SEQ ID NO: 440380 - DNA, 20 bp, Artificial Sequence
  chemically synthesized
ctgtttaggctgccatttta

SEQ ID NO: 440381 - DNA, 20 bp, Artificial Sequence
  chemically synthesized
gaaattatcccttaaaatgg

SEQ ID NO: 440382 - DNA, 20 bp, Artificial Sequence
  chemically synthesized
tctgtttaggctgccatttt

SEQ ID NO: 440383 - DNA, 20 bp, Artificial Sequence
  chemically synthesized
ccttaaaatggcagcctaaa

SEQ ID NO: 440384 - DNA, 20 bp, Artificial Sequence
  chemically synthesized
taaaatggcagcctaaacag

SEQ ID NO: 440385 - DNA, 20 bp, Artificial Sequence
  chemically synthesized
atagctcacatcttctgttt

SEQ ID NO: 440386 - DNA, 20 bp, Artificial Sequence
  chemically synthesized
tatagctcacatcttctgtt

SEQ ID NO: 440387 - DNA, 20 bp, Artificial Sequence
  chemically synthesized
gcagcctaaacagaagatgt

SEQ ID NO: 440388 - DNA, 20 bp, Artificial Sequence
  chemically synthesized
acagaagatgtgagctataa

SEQ ID NO: 440389 - DNA, 20 bp, Artificial Sequence
  chemically synthesized
agaagatgtgagctataaaa

SEQ ID NO: 440390 - DNA, 20 bp, Artificial Sequence
  chemically synthesized
gaagatgtgagctataaaag

SEQ ID NO: 440391 - DNA, 20 bp, Artificial Sequence
  chemically synthesized
aagatgtgagctataaaaga

SEQ ID NO: 440392 - DNA, 20 bp, Artificial Sequence
  chemically synthesized
gatcagtactccctctttta

SEQ ID NO: 440393 - DNA, 20 bp, Artificial Sequence
  chemically synthesized
gatgtgagctataaaagagg

SEQ ID NO: 440394 - DNA, 20 bp, Artificial Sequence
  chemically synthesized
cccattaaaaacacaaagat

SEQ ID NO: 440395 - DNA, 20 bp, Artificial Sequence
  chemically synthesized
tcattcccattaaaaacaca

SEQ ID NO: 440396 - DNA, 20 bp, Artificial Sequence
  chemically synthesized
actgatctttgtgtttttaa

SEQ ID NO: 440397 - DNA, 20 bp, Artificial Sequence
  chemically synthesized
ctgatctttgtgtttttaat

SEQ ID NO: 440398 - DNA, 20 bp, Artificial Sequence
  chemically synthesized
tttgtgtttttaatgggaat

SEQ ID NO: 440399 - DNA, 20 bp, Artificial Sequence
  chemically synthesized
ttgtgtttttaatgggaatg

SEQ ID NO: 440400 - DNA, 20 bp, Artificial Sequence
  chemically synthesized
tgtttttaatgggaatgagg

SEQ ID NO: 440401 - DNA, 20 bp, Artificial Sequence
  chemically synthesized
tttttaatgggaatgaggta

SEQ ID NO: 440402 - DNA, 20 bp, Artificial Sequence
  chemically synthesized
ttttaatgggaatgaggtag

SEQ ID NO: 440403 - DNA, 20 bp, Artificial Sequence
  chemically synthesized
ggaatgaggtagaggttgta

SEQ ID NO: 440404 - DNA, 20 bp, Artificial Sequence
  chemically synthesized
ggtagaggttgtatggccgt

SEQ ID NO: 440405 - DNA, 20 bp, Artificial Sequence
  chemically synthesized
aggttgtatggccgtgagat

SEQ ID NO: 440406 - DNA, 20 bp, Artificial Sequence
  chemically synthesized
ggttgtatggccgtgagatg

SEQ ID NO: 440407 - DNA, 20 bp, Artificial Sequence
  chemically synthesized
taaaaagagtcctcatctca

SEQ ID NO: 440408 - DNA, 20 bp, Artificial Sequence
  chemically synthesized
aaaaaaaaataaaataaaaa

SEQ ID NO: 440409 - DNA, 20 bp, Artificial Sequence
  chemically synthesized
ttaaaaaaaaataaaataaa

SEQ ID NO: 440410 - DNA, 20 bp, Artificial Sequence
  chemically synthesized
tttatttttttttaactttt

SEQ ID NO: 440411 - DNA, 20 bp, Artificial Sequence
  chemically synthesized
ttttttttaacttttaagtt

SEQ ID NO: 440412 - DNA, 20 bp, Artificial Sequence
  chemically synthesized
acttgtagccctgaacttaa

SEQ ID NO: 440413 - DNA, 20 bp, Artificial Sequence
  chemically synthesized
tttttttaacttttaagttc

SEQ ID NO: 440414 - DNA, 20 bp, Artificial Sequence
  chemically synthesized
ttttttaacttttaagttca

SEQ ID NO: 440415 - DNA, 20 bp, Artificial Sequence
  chemically synthesized
acttttaagttcagggctac

SEQ ID NO: 440416 - DNA, 20 bp, Artificial Sequence
  chemically synthesized
taagttcagggctacaagtg

SEQ ID NO: 440417 - DNA, 20 bp, Artificial Sequence
  chemically synthesized
aagttcagggctacaagtgc

SEQ ID NO: 440418 - DNA, 20 bp, Artificial Sequence
  chemically synthesized
atgtaacaaacctgcacttg

SEQ ID NO: 440419 - DNA, 20 bp, Artificial Sequence
  chemically synthesized
acaagtgcaggtttgttaca

SEQ ID NO: 440420 - DNA, 20 bp, Artificial Sequence
  chemically synthesized
caagtgcaggtttgttacat

SEQ ID NO: 440421 - DNA, 20 bp, Artificial Sequence
  chemically synthesized
acataggtaaacttgtgcca

SEQ ID NO: 440422 - DNA, 20 bp, Artificial Sequence
  chemically synthesized
cataggtaaacttgtgccat

SEQ ID NO: 440423 - DNA, 20 bp, Artificial Sequence
  chemically synthesized
acagcaaacccctatggcac

SEQ ID NO: 440424 - DNA, 20 bp, Artificial Sequence
  chemically synthesized
ataggtaaacttgtgccata

SEQ ID NO: 440425 - DNA, 20 bp, Artificial Sequence
  chemically synthesized
taggtaaacttgtgccatag

SEQ ID NO: 440426 - DNA, 20 bp, Artificial Sequence
  chemically synthesized
atctgtacagcaaaccccta

SEQ ID NO: 440427 - DNA, 20 bp, Artificial Sequence
  chemically synthesized
tgccataggggtttgctgta

SEQ ID NO: 440428 - DNA, 20 bp, Artificial Sequence
  chemically synthesized
gggtgatgaaataatctgta

SEQ ID NO: 440429 - DNA, 20 bp, Artificial Sequence
  chemically synthesized
gtacagattatttcatcacc

SEQ ID NO: 440430 - DNA, 20 bp, Artificial Sequence
  chemically synthesized
tacagattatttcatcaccc

SEQ ID NO: 440431 - DNA, 20 bp, Artificial Sequence
  chemically synthesized
tatttcatcacccaggtatc

SEQ ID NO: 440432 - DNA, 20 bp, Artificial Sequence
  chemically synthesized
gggtactaggcttgatacct

SEQ ID NO: 440433 - DNA, 20 bp, Artificial Sequence
  chemically synthesized
tgggtactaggcttgatacc

SEQ ID NO: 440434 - DNA, 20 bp, Artificial Sequence
  chemically synthesized
catcacccaggtatcaagcc

SEQ ID NO: 440435 - DNA, 20 bp, Artificial Sequence
  chemically synthesized
aaaagcaactaatgggtact

SEQ ID NO: 440436 - DNA, 20 bp, Artificial Sequence
  chemically synthesized
gaaaagcaactaatgggtac

SEQ ID NO: 440437 - DNA, 20 bp, Artificial Sequence
  chemically synthesized
gtatcaagcctagtacccat

SEQ ID NO: 440438 - DNA, 20 bp, Artificial Sequence
  chemically synthesized
gatcaggaaaagcaactaat

SEQ ID NO: 440439 - DNA, 20 bp, Artificial Sequence
  chemically synthesized
ggatcaggaaaagcaactaa

SEQ ID NO: 440440 - DNA, 20 bp, Artificial Sequence
  chemically synthesized
aggaggaagaggatcaggaa

SEQ ID NO: 440441 - DNA, 20 bp, Artificial Sequence
  chemically synthesized
gttggaggaggaagaggatc

SEQ ID NO: 440442 - DNA, 20 bp, Artificial Sequence
  chemically synthesized
ggttggaggaggaagaggat

SEQ ID NO: 440443 - DNA, 20 bp, Artificial Sequence
  chemically synthesized
tagagggttggaggaggaag

SEQ ID NO: 440444 - DNA, 20 bp, Artificial Sequence
  chemically synthesized
gtagagggttggaggaggaa

SEQ ID NO: 440445 - DNA, 20 bp, Artificial Sequence
  chemically synthesized
gggtagagggttggaggagg

SEQ ID NO: 440446 - DNA, 20 bp, Artificial Sequence
  chemically synthesized
ggagggtagagggttggagg

SEQ ID NO: 440447 - DNA, 20 bp, Artificial Sequence
  chemically synthesized
cggagggtagagggttggag

SEQ ID NO: 440448 - DNA, 20 bp, Artificial Sequence
  chemically synthesized
ttcggagggtagagggttgg

SEQ ID NO: 440449 - DNA, 20 bp, Artificial Sequence
  chemically synthesized
tttcggagggtagagggttg

SEQ ID NO: 440450 - DNA, 20 bp, Artificial Sequence
  chemically synthesized
cctttcggagggtagagggt

SEQ ID NO: 440451 - DNA, 20 bp, Artificial Sequence
  chemically synthesized
ggggcctttcggagggtaga

SEQ ID NO: 440452 - DNA, 20 bp, Artificial Sequence
  chemically synthesized
tggggcctttcggagggtag

SEQ ID NO: 440453 - DNA, 20 bp, Artificial Sequence
  chemically synthesized
ctggggcctttcggagggta

SEQ ID NO: 440454 - DNA, 20 bp, Artificial Sequence
  chemically synthesized
ccctggggcctttcggaggg

SEQ ID NO: 440455 - DNA, 20 bp, Artificial Sequence
  chemically synthesized
tccaaccctctaccctccga

SEQ ID NO: 440456 - DNA, 20 bp, Artificial Sequence
  chemically synthesized
ccaaccctctaccctccgaa

SEQ ID NO: 440457 - DNA, 20 bp, Artificial Sequence
  chemically synthesized
acaccctggggcctttcgga

SEQ ID NO: 440458 - DNA, 20 bp, Artificial Sequence
  chemically synthesized
cacaccctggggcctttcgg

SEQ ID NO: 440459 - DNA, 20 bp, Artificial Sequence
  chemically synthesized
acacaccctggggcctttcg

SEQ ID NO: 440460 - DNA, 20 bp, Artificial Sequence
  chemically synthesized
caacacaccctggggccttt

SEQ ID NO: 440461 - DNA, 20 bp, Artificial Sequence
  chemically synthesized
ctctaccctccgaaaggccc

SEQ ID NO: 440462 - DNA, 20 bp, Artificial Sequence
  chemically synthesized
tctaccctccgaaaggcccc

SEQ ID NO: 440463 - DNA, 20 bp, Artificial Sequence
  chemically synthesized
ctaccctccgaaaggcccca

SEQ ID NO: 440464 - DNA, 20 bp, Artificial Sequence
  chemically synthesized
gagagaaacaacacaccctg

SEQ ID NO: 440465 - DNA, 20 bp, Artificial Sequence
  chemically synthesized
agagagaaacaacacaccct

SEQ ID NO: 440466 - DNA, 20 bp, Artificial Sequence
  chemically synthesized
tagagagaaacaacacaccc

SEQ ID NO: 440467 - DNA, 20 bp, Artificial Sequence
  chemically synthesized
tgtgttgtttctctctatat

SEQ ID NO: 440468 - DNA, 20 bp, Artificial Sequence
  chemically synthesized
taaaagtgtcctcatataga

SEQ ID NO: 440469 - DNA, 20 bp, Artificial Sequence
  chemically synthesized
gtgttgtttctctctatatg

SEQ ID NO: 440470 - DNA, 20 bp, Artificial Sequence
  chemically synthesized
cttaaaagtgtcctcatata

SEQ ID NO: 440471 - DNA, 20 bp, Artificial Sequence
  chemically synthesized
tgcttaaaagtgtcctcata

SEQ ID NO: 440472 - DNA, 20 bp, Artificial Sequence
  chemically synthesized
ctctatatgaggacactttt

SEQ ID NO: 440473 - DNA, 20 bp, Artificial Sequence
  chemically synthesized
ctctgctgtcttatgcttaa

SEQ ID NO: 440474 - DNA, 20 bp, Artificial Sequence
  chemically synthesized
atgaggacacttttaagcat

SEQ ID NO: 440475 - DNA, 20 bp, Artificial Sequence
  chemically synthesized
ggacacttttaagcataaga

SEQ ID NO: 440476 - DNA, 20 bp, Artificial Sequence
  chemically synthesized
cacttttaagcataagacag

SEQ ID NO: 440477 - DNA, 20 bp, Artificial Sequence
  chemically synthesized
cttttaagcataagacagca

SEQ ID NO: 440478 - DNA, 20 bp, Artificial Sequence
  chemically synthesized
atgagaatgaggaagggaaa

SEQ ID NO: 440479 - DNA, 20 bp, Artificial Sequence
  chemically synthesized
agacaaatgagaatgaggaa

SEQ ID NO: 440480 - DNA, 20 bp, Artificial Sequence
  chemically synthesized
cagacaaatgagaatgagga

SEQ ID NO: 440481 - DNA, 20 bp, Artificial Sequence
  chemically synthesized
gcagacaaatgagaatgagg

SEQ ID NO: 440482 - DNA, 20 bp, Artificial Sequence
  chemically synthesized
gcagcagacaaatgagaatg

SEQ ID NO: 440483 - DNA, 20 bp, Artificial Sequence
  chemically synthesized
ggcagcagacaaatgagaat

SEQ ID NO: 440484 - DNA, 20 bp, Artificial Sequence
  chemically synthesized
ctgataggcagcagacaaat

SEQ ID NO: 440485 - DNA, 20 bp, Artificial Sequence
  chemically synthesized
agcacaattctgataggcag

SEQ ID NO: 440486 - DNA, 20 bp, Artificial Sequence
  chemically synthesized
ctcatttgtctgctgcctat

SEQ ID NO: 440487 - DNA, 20 bp, Artificial Sequence
  chemically synthesized
ttaagcacaattctgatagg

SEQ ID NO: 440488 - DNA, 20 bp, Artificial Sequence
  chemically synthesized
ttcttaagcacaattctgat

SEQ ID NO: 440489 - DNA, 20 bp, Artificial Sequence
  chemically synthesized
tttcttaagcacaattctga

SEQ ID NO: 440490 - DNA, 20 bp, Artificial Sequence
  chemically synthesized
tgcctatcagaattgtgctt

SEQ ID NO: 440491 - DNA, 20 bp, Artificial Sequence
  chemically synthesized
aagggcatataaattttctt

SEQ ID NO: 440492 - DNA, 20 bp, Artificial Sequence
  chemically synthesized
atttggctccagcgttttaa

SEQ ID NO: 440493 - DNA, 20 bp, Artificial Sequence
  chemically synthesized
catttggctccagcgtttta

SEQ ID NO: 440494 - DNA, 20 bp, Artificial Sequence
  chemically synthesized
tttatatgcccttaaaacgc

SEQ ID NO: 440495 - DNA, 20 bp, Artificial Sequence
  chemically synthesized
acatttggctccagcgtttt

SEQ ID NO: 440496 - DNA, 20 bp, Artificial Sequence
  chemically synthesized
tatatgcccttaaaacgctg

SEQ ID NO: 440497 - DNA, 20 bp, Artificial Sequence
  chemically synthesized
caaaaaaatacatttggctc

SEQ ID NO: 440498 - DNA, 20 bp, Artificial Sequence
  chemically synthesized
aaagaccaaaaaaatacatt

SEQ ID NO: 440499 - DNA, 20 bp, Artificial Sequence
  chemically synthesized
tggagccaaatgtatttttt

SEQ ID NO: 440500 - DNA, 20 bp, Artificial Sequence
  chemically synthesized
tatttttttggtctttttgt

SEQ ID NO: 440501 - DNA, 20 bp, Artificial Sequence
  chemically synthesized
atttttttggtctttttgtt

SEQ ID NO: 440502 - DNA, 20 bp, Artificial Sequence
  chemically synthesized
cttgaatatggcccaacaaa

SEQ ID NO: 440503 - DNA, 20 bp, Artificial Sequence
  chemically synthesized
ctttttgttgggccatattc

SEQ ID NO: 440504 - DNA, 20 bp, Artificial Sequence
  chemically synthesized
tttttgttgggccatattca

SEQ ID NO: 440505 - DNA, 20 bp, Artificial Sequence
  chemically synthesized
caagattacttccttgaata

SEQ ID NO: 440506 - DNA, 20 bp, Artificial Sequence
  chemically synthesized
ttgttgggccatattcaagg

SEQ ID NO: 440507 - DNA, 20 bp, Artificial Sequence
  chemically synthesized
ttcaaggaagtaatcttgaa

SEQ ID NO: 440508 - DNA, 20 bp, Artificial Sequence
  chemically synthesized
tcaaggaagtaatcttgaat

SEQ ID NO: 440509 - DNA, 20 bp, Artificial Sequence
  chemically synthesized
caaggaagtaatcttgaatg

SEQ ID NO: 440510 - DNA, 20 bp, Artificial Sequence
  chemically synthesized
gcctttctgtttccccattc

SEQ ID NO: 440511 - DNA, 20 bp, Artificial Sequence
  chemically synthesized
agtaatcttgaatggggaaa

SEQ ID NO: 440512 - DNA, 20 bp, Artificial Sequence
  chemically synthesized
atcttgaatggggaaacaga

SEQ ID NO: 440513 - DNA, 20 bp, Artificial Sequence
  chemically synthesized
tcttgaatggggaaacagaa

SEQ ID NO: 440514 - DNA, 20 bp, Artificial Sequence
  chemically synthesized
gaaacagaaaggctatgccc

SEQ ID NO: 440515 - DNA, 20 bp, Artificial Sequence
  chemically synthesized
aaacagaaaggctatgccct

SEQ ID NO: 440516 - DNA, 20 bp, Artificial Sequence
  chemically synthesized
atactttaacacccagggca

SEQ ID NO: 440517 - DNA, 20 bp, Artificial Sequence
  chemically synthesized
atgaaatactttaacaccca

SEQ ID NO: 440518 - DNA, 20 bp, Artificial Sequence
  chemically synthesized
tatgaaatactttaacaccc

SEQ ID NO: 440519 - DNA, 20 bp, Artificial Sequence
  chemically synthesized
aggctatgccctgggtgtta

SEQ ID NO: 440520 - DNA, 20 bp, Artificial Sequence
  chemically synthesized
ttatgaaatactttaacacc

SEQ ID NO: 440521 - DNA, 20 bp, Artificial Sequence
  chemically synthesized
ttaaagtatttcataatctc

SEQ ID NO: 440522 - DNA, 20 bp, Artificial Sequence
  chemically synthesized
aaagtatttcataatctcta

SEQ ID NO: 440523 - DNA, 20 bp, Artificial Sequence
  chemically synthesized
aagtatttcataatctctag

SEQ ID NO: 440524 - DNA, 20 bp, Artificial Sequence
  chemically synthesized
gtatttcataatctctagag

SEQ ID NO: 440525 - DNA, 20 bp, Artificial Sequence
  chemically synthesized
taaaccagatggctcctcta

SEQ ID NO: 440526 - DNA, 20 bp, Artificial Sequence
  chemically synthesized
cttaaaccagatggctcctc

SEQ ID NO: 440527 - DNA, 20 bp, Artificial Sequence
  chemically synthesized
taatctctagaggagccatc

SEQ ID NO: 440528 - DNA, 20 bp, Artificial Sequence
  chemically synthesized
atgtgccttcttaaaccaga

SEQ ID NO: 440529 - DNA, 20 bp, Artificial Sequence
  chemically synthesized
ctagaggagccatctggttt

SEQ ID NO: 440530 - DNA, 20 bp, Artificial Sequence
  chemically synthesized
gaggagccatctggtttaag

SEQ ID NO: 440531 - DNA, 20 bp, Artificial Sequence
  chemically synthesized
ttcaatgtgccttcttaaac

SEQ ID NO: 440532 - DNA, 20 bp, Artificial Sequence
  chemically synthesized
aggagccatctggtttaaga

SEQ ID NO: 440533 - DNA, 20 bp, Artificial Sequence
  chemically synthesized
tcatatattacagcatatta

SEQ ID NO: 440534 - DNA, 20 bp, Artificial Sequence
  chemically synthesized
tctgtttccctcatatatta

SEQ ID NO: 440535 - DNA, 20 bp, Artificial Sequence
  chemically synthesized
tataatatgctgtaatatat

SEQ ID NO: 440536 - DNA, 20 bp, Artificial Sequence
  chemically synthesized
ataatatgctgtaatatatg

SEQ ID NO: 440537 - DNA, 20 bp, Artificial Sequence
  chemically synthesized
taatatgctgtaatatatga

SEQ ID NO: 440538 - DNA, 20 bp, Artificial Sequence
  chemically synthesized
gctgtaatatatgagggaaa

SEQ ID NO: 440539 - DNA, 20 bp, Artificial Sequence
  chemically synthesized
gaaaggcttgatagtataaa

SEQ ID NO: 440540 - DNA, 20 bp, Artificial Sequence
  chemically synthesized
aacagactttttatactatc

SEQ ID NO: 440541 - DNA, 20 bp, Artificial Sequence
  chemically synthesized
ttttttcatgaaaggcttga

SEQ ID NO: 440542 - DNA, 20 bp, Artificial Sequence
  chemically synthesized
tcatgaaattttttcatgaa

SEQ ID NO: 440543 - DNA, 20 bp, Artificial Sequence
  chemically synthesized
ttcatgaaattttttcatga

SEQ ID NO: 440544 - DNA, 20 bp, Artificial Sequence
  chemically synthesized
aaaaataaacaaaatcattt

SEQ ID NO: 440545 - DNA, 20 bp, Artificial Sequence
  chemically synthesized
atcattttagcttttaatct

SEQ ID NO: 440546 - DNA, 20 bp, Artificial Sequence
  chemically synthesized
aaatatagttccaagattaa

SEQ ID NO: 440547 - DNA, 20 bp, Artificial Sequence
  chemically synthesized
cctatactaaatatagttcc

SEQ ID NO: 440548 - DNA, 20 bp, Artificial Sequence
  chemically synthesized
tttaatcttggaactatatt

SEQ ID NO: 440549 - DNA, 20 bp, Artificial Sequence
  chemically synthesized
aatcactcctatactaaata

SEQ ID NO: 440550 - DNA, 20 bp, Artificial Sequence
  chemically synthesized
tcttggaactatatttagta

SEQ ID NO: 440551 - DNA, 20 bp, Artificial Sequence
  chemically synthesized
cttggaactatatttagtat

SEQ ID NO: 440552 - DNA, 20 bp, Artificial Sequence
  chemically synthesized
tggaactatatttagtatag

SEQ ID NO: 440553 - DNA, 20 bp, Artificial Sequence
  chemically synthesized
gtataggagtgattcacaaa

SEQ ID NO: 440554 - DNA, 20 bp, Artificial Sequence
  chemically synthesized
taggagtgattcacaaatag

SEQ ID NO: 440555 - DNA, 20 bp, Artificial Sequence
  chemically synthesized
ggagtgattcacaaatagca

SEQ ID NO: 440556 - DNA, 20 bp, Artificial Sequence
  chemically synthesized
gataaccccttcgaatggga

SEQ ID NO: 440557 - DNA, 20 bp, Artificial Sequence
  chemically synthesized
cagagttactctcccattcg

SEQ ID NO: 440558 - DNA, 20 bp, Artificial Sequence
  chemically synthesized
ctgataaccccttcgaatgg

SEQ ID NO: 440559 - DNA, 20 bp, Artificial Sequence
  chemically synthesized
agagttactctcccattcga

SEQ ID NO: 440560 - DNA, 20 bp, Artificial Sequence
  chemically synthesized
gagttactctcccattcgaa

SEQ ID NO: 440561 - DNA, 20 bp, Artificial Sequence
  chemically synthesized
ttctgataaccccttcgaat

SEQ ID NO: 440562 - DNA, 20 bp, Artificial Sequence
  chemically synthesized
agttactctcccattcgaag

SEQ ID NO: 440563 - DNA, 20 bp, Artificial Sequence
  chemically synthesized
attctgataaccccttcgaa

SEQ ID NO: 440564 - DNA, 20 bp, Artificial Sequence
  chemically synthesized
ctcccattcgaaggggttat

SEQ ID NO: 440565 - DNA, 20 bp, Artificial Sequence
  chemically synthesized
gaaggggttatcagaatctc

SEQ ID NO: 440566 - DNA, 20 bp, Artificial Sequence
  chemically synthesized
ggggttatcagaatctctgg

SEQ ID NO: 440567 - DNA, 20 bp, Artificial Sequence
  chemically synthesized
aaaagtgaatgtgtcttcca

SEQ ID NO: 440568 - DNA, 20 bp, Artificial Sequence
  chemically synthesized
ctaaaagtgaatgtgtcttc

SEQ ID NO: 440569 - DNA, 20 bp, Artificial Sequence
  chemically synthesized
ctggaagacacattcacttt

SEQ ID NO: 440570 - DNA, 20 bp, Artificial Sequence
  chemically synthesized
ctccctctacttaatactaa

SEQ ID NO: 440571 - DNA, 20 bp, Artificial Sequence
  chemically synthesized
acacattcacttttagtatt

SEQ ID NO: 440572 - DNA, 20 bp, Artificial Sequence
  chemically synthesized
cattcacttttagtattaag

SEQ ID NO: 440573 - DNA, 20 bp, Artificial Sequence
  chemically synthesized
ttcacttttagtattaagta

SEQ ID NO: 440574 - DNA, 20 bp, Artificial Sequence
  chemically synthesized
tcacttttagtattaagtag

SEQ ID NO: 440575 - DNA, 20 bp, Artificial Sequence
  chemically synthesized
cacttttagtattaagtaga

SEQ ID NO: 440576 - DNA, 20 bp, Artificial Sequence
  chemically synthesized
cttttagtattaagtagagg

SEQ ID NO: 440577 - DNA, 20 bp, Artificial Sequence
  chemically synthesized
taaaatccttgcaaaatttc

SEQ ID NO: 440578 - DNA, 20 bp, Artificial Sequence
  chemically synthesized
gagggagcttgaaattttgc

SEQ ID NO: 440579 - DNA, 20 bp, Artificial Sequence
  chemically synthesized
agggagcttgaaattttgca

SEQ ID NO: 440580 - DNA, 20 bp, Artificial Sequence
  chemically synthesized
ttgaaattttgcaaggattt

SEQ ID NO: 440581 - DNA, 20 bp, Artificial Sequence
  chemically synthesized
tgaaattttgcaaggatttt

SEQ ID NO: 440582 - DNA, 20 bp, Artificial Sequence
  chemically synthesized
gaaattttgcaaggatttta

SEQ ID NO: 440583 - DNA, 20 bp, Artificial Sequence
  chemically synthesized
gattttagggacaattctat

SEQ ID NO: 440584 - DNA, 20 bp, Artificial Sequence
  chemically synthesized
ttttctatttatgtcactta

SEQ ID NO: 440585 - DNA, 20 bp, Artificial Sequence
  chemically synthesized
aattctataagtgacataaa

SEQ ID NO: 440586 - DNA, 20 bp, Artificial Sequence
  chemically synthesized
attattttaccaagtttgga

SEQ ID NO: 440587 - DNA, 20 bp, Artificial Sequence
  chemically synthesized
tagaaaaaaccctccaaact

SEQ ID NO: 440588 - DNA, 20 bp, Artificial Sequence
  chemically synthesized
tattattttaccaagtttgg

SEQ ID NO: 440589 - DNA, 20 bp, Artificial Sequence
  chemically synthesized
ttattattttaccaagtttg

SEQ ID NO: 440590 - DNA, 20 bp, Artificial Sequence
  chemically synthesized
atttattattttaccaagtt

SEQ ID NO: 440591 - DNA, 20 bp, Artificial Sequence
  chemically synthesized
ggataatttattattttacc

SEQ ID NO: 440592 - DNA, 20 bp, Artificial Sequence
  chemically synthesized
taaaataataaattatccca

SEQ ID NO: 440593 - DNA, 20 bp, Artificial Sequence
  chemically synthesized
agttaaaatggcaacaccat

SEQ ID NO: 440594 - DNA, 20 bp, Artificial Sequence
  chemically synthesized
aagttaaaatggcaacacca

SEQ ID NO: 440595 - DNA, 20 bp, Artificial Sequence
  chemically synthesized
tacagatatcaaagttaaaa

SEQ ID NO: 440596 - DNA, 20 bp, Artificial Sequence
  chemically synthesized
tcattttaatacagatatca

SEQ ID NO: 440597 - DNA, 20 bp, Artificial Sequence
  chemically synthesized
tctgaagtttcattttaata

SEQ ID NO: 440598 - DNA, 20 bp, Artificial Sequence
  chemically synthesized
tctgtattaaaatgaaactt

SEQ ID NO: 440599 - DNA, 20 bp, Artificial Sequence
  chemically synthesized
gacatatgtttggagttctg

SEQ ID NO: 440600 - DNA, 20 bp, Artificial Sequence
  chemically synthesized
aaaatattgacatatgtttg

SEQ ID NO: 440601 - DNA, 20 bp, Artificial Sequence
  chemically synthesized
ataaaatattgacatatgtt

SEQ ID NO: 440602 - DNA, 20 bp, Artificial Sequence
  chemically synthesized
aaacatatgtcaatatttta

SEQ ID NO: 440603 - DNA, 20 bp, Artificial Sequence
  chemically synthesized
attttatagcatgaaacccc

SEQ ID NO: 440604 - DNA, 20 bp, Artificial Sequence
  chemically synthesized
ttttatagcatgaaacccca

SEQ ID NO: 440605 - DNA, 20 bp, Artificial Sequence
  chemically synthesized
tatagcatgaaaccccaagg

SEQ ID NO: 440606 - DNA, 20 bp, Artificial Sequence
  chemically synthesized
ctattagttagacttccttg

SEQ ID NO: 440607 - DNA, 20 bp, Artificial Sequence
  chemically synthesized
tctattagttagacttcctt

SEQ ID NO: 440608 - DNA, 20 bp, Artificial Sequence
  chemically synthesized
atctattagttagacttcct

SEQ ID NO: 440609 - DNA, 20 bp, Artificial Sequence
  chemically synthesized
ccccaaggaagtctaactaa

SEQ ID NO: 440610 - DNA, 20 bp, Artificial Sequence
  chemically synthesized
tacgtaaaacatctattagt

SEQ ID NO: 440611 - DNA, 20 bp, Artificial Sequence
  chemically synthesized
tccctacgtaaaacatctat

SEQ ID NO: 440612 - DNA, 20 bp, Artificial Sequence
  chemically synthesized
taactaatagatgttttacg

SEQ ID NO: 440613 - DNA, 20 bp, Artificial Sequence
  chemically synthesized
aactaatagatgttttacgt

SEQ ID NO: 440614 - DNA, 20 bp, Artificial Sequence
  chemically synthesized
actaatagatgttttacgta

SEQ ID NO: 440615 - DNA, 20 bp, Artificial Sequence
  chemically synthesized
tagatgttttacgtagggaa

SEQ ID NO: 440616 - DNA, 20 bp, Artificial Sequence
  chemically synthesized
agatgttttacgtagggaaa

SEQ ID NO: 440617 - DNA, 20 bp, Artificial Sequence
  chemically synthesized
ttttacgtagggaaaaggtg

SEQ ID NO: 440618 - DNA, 20 bp, Artificial Sequence
  chemically synthesized
ccaagcaaataaatagtttg

SEQ ID NO: 440619 - DNA, 20 bp, Artificial Sequence
  chemically synthesized
aaacaaaccaagcaaataaa

SEQ ID NO: 440620 - DNA, 20 bp, Artificial Sequence
  chemically synthesized
ctacaaactatttatttgct

SEQ ID NO: 440621 - DNA, 20 bp, Artificial Sequence
  chemically synthesized
cttcaaaaaacaaacaaacc

SEQ ID NO: 440622 - DNA, 20 bp, Artificial Sequence
  chemically synthesized
cttggtttgtttgttttttg

SEQ ID NO: 440623 - DNA, 20 bp, Artificial Sequence
  chemically synthesized
tttgtttgttttttgaagat

SEQ ID NO: 440624 - DNA, 20 bp, Artificial Sequence
  chemically synthesized
gaagatcagtatactgcatt

SEQ ID NO: 440625 - DNA, 20 bp, Artificial Sequence
  chemically synthesized
cttgtagagtgtgctcaatg

SEQ ID NO: 440626 - DNA, 20 bp, Artificial Sequence
  chemically synthesized
ctgcattgagcacactctac

SEQ ID NO: 440627 - DNA, 20 bp, Artificial Sequence
  chemically synthesized
tgcattgagcacactctaca

SEQ ID NO: 440628 - DNA, 20 bp, Artificial Sequence
  chemically synthesized
gcattgagcacactctacaa

SEQ ID NO: 440629 - DNA, 20 bp, Artificial Sequence
  chemically synthesized
cattgagcacactctacaag

SEQ ID NO: 440630 - DNA, 20 bp, Artificial Sequence
  chemically synthesized
tgaaaatatttccccttgta

SEQ ID NO: 440631 - DNA, 20 bp, Artificial Sequence
  chemically synthesized
catgaaaatatttccccttg

SEQ ID NO: 440632 - DNA, 20 bp, Artificial Sequence
  chemically synthesized
ggaaatattttcatgaaacc

SEQ ID NO: 440633 - DNA, 20 bp, Artificial Sequence
  chemically synthesized
cgtttttattaaatgcaacc

SEQ ID NO: 440634 - DNA, 20 bp, Artificial Sequence
  chemically synthesized
acgtttttattaaatgcaac

SEQ ID NO: 440635 - DNA, 20 bp, Artificial Sequence
  chemically synthesized
aacgtttatttcccacactg

SEQ ID NO: 440636 - DNA, 20 bp, Artificial Sequence
  chemically synthesized
aaggtcatgggctgcagtgt

SEQ ID NO: 440637 - DNA, 20 bp, Artificial Sequence
  chemically synthesized
gaaggtcatgggctgcagtg

SEQ ID NO: 440638 - DNA, 20 bp, Artificial Sequence
  chemically synthesized
ctggggaaggtcatgggctg

SEQ ID NO: 440639 - DNA, 20 bp, Artificial Sequence
  chemically synthesized
tattttctggggaaggtcat

SEQ ID NO: 440640 - DNA, 20 bp, Artificial Sequence
  chemically synthesized
atattttctggggaaggtca

SEQ ID NO: 440641 - DNA, 20 bp, Artificial Sequence
  chemically synthesized
ctgcagcccatgaccttccc

SEQ ID NO: 440642 - DNA, 20 bp, Artificial Sequence
  chemically synthesized
attggaatattttctgggga

SEQ ID NO: 440643 - DNA, 20 bp, Artificial Sequence
  chemically synthesized
tattggaatattttctgggg

SEQ ID NO: 440644 - DNA, 20 bp, Artificial Sequence
  chemically synthesized
tcgtattggaatattttctg

SEQ ID NO: 440645 - DNA, 20 bp, Artificial Sequence
  chemically synthesized
ttcgtattggaatattttct

SEQ ID NO: 440646 - DNA, 20 bp, Artificial Sequence
  chemically synthesized
gttcgtattggaatattttc

SEQ ID NO: 440647 - DNA, 20 bp, Artificial Sequence
  chemically synthesized
tcaaggcagttggttcgtat

SEQ ID NO: 440648 - DNA, 20 bp, Artificial Sequence
  chemically synthesized
tgttctgttatcaaggcagt

SEQ ID NO: 440649 - DNA, 20 bp, Artificial Sequence
  chemically synthesized
tttgtgttctgttatcaagg

SEQ ID NO: 440650 - DNA, 20 bp, Artificial Sequence
  chemically synthesized
cgaaccaactgccttgataa

SEQ ID NO: 440651 - DNA, 20 bp, Artificial Sequence
  chemically synthesized
aggtttgtgttctgttatca

SEQ ID NO: 440652 - DNA, 20 bp, Artificial Sequence
  chemically synthesized
gaggtttgtgttctgttatc

SEQ ID NO: 440653 - DNA, 20 bp, Artificial Sequence
  chemically synthesized
ataacagaacacaaacctcc

SEQ ID NO: 440654 - DNA, 20 bp, Artificial Sequence
  chemically synthesized
taacagaacacaaacctcct

SEQ ID NO: 440655 - DNA, 20 bp, Artificial Sequence
  chemically synthesized
agtcctgctatagtcctagg

SEQ ID NO: 440656 - DNA, 20 bp, Artificial Sequence
  chemically synthesized
aagtcctgctatagtcctag

SEQ ID NO: 440657 - DNA, 20 bp, Artificial Sequence
  chemically synthesized
acacaaacctcctaggacta

SEQ ID NO: 440658 - DNA, 20 bp, Artificial Sequence
  chemically synthesized
caaagtcctgctatagtcct

SEQ ID NO: 440659 - DNA, 20 bp, Artificial Sequence
  chemically synthesized
acaaagtcctgctatagtcc

SEQ ID NO: 440660 - DNA, 20 bp, Artificial Sequence
  chemically synthesized
caaacctcctaggactatag

SEQ ID NO: 440661 - DNA, 20 bp, Artificial Sequence
  chemically synthesized
aaacctcctaggactatagc

SEQ ID NO: 440662 - DNA, 20 bp, Artificial Sequence
  chemically synthesized
tttctcacaaagtcctgcta

SEQ ID NO: 440663 - DNA, 20 bp, Artificial Sequence
  chemically synthesized
ggactatagcaggactttgt

SEQ ID NO: 440664 - DNA, 20 bp, Artificial Sequence
  chemically synthesized
tatagcaggactttgtgaga

SEQ ID NO: 440665 - DNA, 20 bp, Artificial Sequence
  chemically synthesized
caatggttttctttctcaca

SEQ ID NO: 440666 - DNA, 20 bp, Artificial Sequence
  chemically synthesized
ttggattcagagagaggcaa

SEQ ID NO: 440667 - DNA, 20 bp, Artificial Sequence
  chemically synthesized
ttttgattggattcagagag

SEQ ID NO: 440668 - DNA, 20 bp, Artificial Sequence
  chemically synthesized
gttttgattggattcagaga

SEQ ID NO: 440669 - DNA, 20 bp, Artificial Sequence
  chemically synthesized
aggttttgattggattcaga

SEQ ID NO: 440670 - DNA, 20 bp, Artificial Sequence
  chemically synthesized
tcaggttttgattggattca

SEQ ID NO: 440671 - DNA, 20 bp, Artificial Sequence
  chemically synthesized
attcaggttttgattggatt

SEQ ID NO: 440672 - DNA, 20 bp, Artificial Sequence
  chemically synthesized
cagtacattcaggttttgat

SEQ ID NO: 440673 - DNA, 20 bp, Artificial Sequence
  chemically synthesized
tatttttatacagtacattc

SEQ ID NO: 440674 - DNA, 20 bp, Artificial Sequence
  chemically synthesized
ttatttttatacagtacatt

SEQ ID NO: 440675 - DNA, 20 bp, Artificial Sequence
  chemically synthesized
gaccttggtttatttttata

SEQ ID NO: 440676 - DNA, 20 bp, Artificial Sequence
  chemically synthesized
gtactgtataaaaataaacc

SEQ ID NO: 440677 - DNA, 20 bp, Artificial Sequence
  chemically synthesized
tactgtataaaaataaacca

SEQ ID NO: 440678 - DNA, 20 bp, Artificial Sequence
  chemically synthesized
acaaggaataatgatgacct

SEQ ID NO: 440679 - DNA, 20 bp, Artificial Sequence
  chemically synthesized
cacgccaaatcacaatgaca

SEQ ID NO: 440680 - DNA, 20 bp, Artificial Sequence
  chemically synthesized
gcacgccaaatcacaatgac

SEQ ID NO: 440681 - DNA, 20 bp, Artificial Sequence
  chemically synthesized
tattccttgtcattgtgatt

SEQ ID NO: 440682 - DNA, 20 bp, Artificial Sequence
  chemically synthesized
atacagggtatataatttga

SEQ ID NO: 440683 - DNA, 20 bp, Artificial Sequence
  chemically synthesized
tatacagggtatataatttg

SEQ ID NO: 440684 - DNA, 20 bp, Artificial Sequence
  chemically synthesized
gcagttatttgaaatataca

SEQ ID NO: 440685 - DNA, 20 bp, Artificial Sequence
  chemically synthesized
tgcagttatttgaaatatac

SEQ ID NO: 440686 - DNA, 20 bp, Artificial Sequence
  chemically synthesized
gtgcagttatttgaaatata

SEQ ID NO: 440687 - DNA, 20 bp, Artificial Sequence
  chemically synthesized
ctcagttaatggaggcggtg

SEQ ID NO: 440688 - DNA, 20 bp, Artificial Sequence
  chemically synthesized
tcaaactcagttaatggagg

SEQ ID NO: 440689 - DNA, 20 bp, Artificial Sequence
  chemically synthesized
atgtcaaactcagttaatgg

SEQ ID NO: 440690 - DNA, 20 bp, Artificial Sequence
  chemically synthesized
gatgtcaaactcagttaatg

SEQ ID NO: 440691 - DNA, 20 bp, Artificial Sequence
  chemically synthesized
ctgcaccgcctccattaact

SEQ ID NO: 440692 - DNA, 20 bp, Artificial Sequence
  chemically synthesized
gtgatgtcaaactcagttaa

SEQ ID NO: 440693 - DNA, 20 bp, Artificial Sequence
  chemically synthesized
gattaaagtgatgtcaaact

SEQ ID NO: 440694 - DNA, 20 bp, Artificial Sequence
  chemically synthesized
ctgaaaagatacattgatta

SEQ ID NO: 440695 - DNA, 20 bp, Artificial Sequence
  chemically synthesized
ctttaatcaatgtatctttt

SEQ ID NO: 440696 - DNA, 20 bp, Artificial Sequence
  chemically synthesized
tttctgcctttcattctgaa

SEQ ID NO: 440697 - DNA, 20 bp, Artificial Sequence
  chemically synthesized
aatgtatcttttcagaatga

SEQ ID NO: 440698 - DNA, 20 bp, Artificial Sequence
  chemically synthesized
atgtatcttttcagaatgaa

SEQ ID NO: 440699 - DNA, 20 bp, Artificial Sequence
  chemically synthesized
tatcttttcagaatgaaagg

SEQ ID NO: 440700 - DNA, 20 bp, Artificial Sequence
  chemically synthesized
ttaaaagaatttataatggt

SEQ ID NO: 440701 - DNA, 20 bp, Artificial Sequence
  chemically synthesized
gttaaaagaatttataatgg

SEQ ID NO: 440702 - DNA, 20 bp, Artificial Sequence
  chemically synthesized
agagttaaaagaatttataa

SEQ ID NO: 440703 - DNA, 20 bp, Artificial Sequence
  chemically synthesized
aatgcagattagagagttaa

SEQ ID NO: 440704 - DNA, 20 bp, Artificial Sequence
  chemically synthesized
tttatttaatgcagattaga

SEQ ID NO: 440705 - DNA, 20 bp, Artificial Sequence
  chemically synthesized
cttttatttaatgcagatta

SEQ ID NO: 440706 - DNA, 20 bp, Artificial Sequence
  chemically synthesized
accttttatttaatgcagat

SEQ ID NO: 440707 - DNA, 20 bp, Artificial Sequence
  chemically synthesized
agacaaccttttatttaatg

SEQ ID NO: 440708 - DNA, 20 bp, Artificial Sequence
  chemically synthesized
ctctaatctgcattaaataa

SEQ ID NO: 440709 - DNA, 20 bp, Artificial Sequence
  chemically synthesized
tctaatctgcattaaataaa

SEQ ID NO: 440710 - DNA, 20 bp, Artificial Sequence
  chemically synthesized
ttaaataaaaggttgtcttt

SEQ ID NO: 440711 - DNA, 20 bp, Artificial Sequence
  chemically synthesized
agagcatttattatttctca

SEQ ID NO: 440712 - DNA, 20 bp, Artificial Sequence
  chemically synthesized
gagaaataataaatgctcta

SEQ ID NO: 440713 - DNA, 20 bp, Artificial Sequence
  chemically synthesized
atgctagttatatttcttta

SEQ ID NO: 440714 - DNA, 20 bp, Artificial Sequence
  chemically synthesized
tgatgctagttatatttctt

SEQ ID NO: 440715 - DNA, 20 bp, Artificial Sequence
  chemically synthesized
atgctctaaagaaatataac

SEQ ID NO: 440716 - DNA, 20 bp, Artificial Sequence
  chemically synthesized
ttttaaaataaaattgatgc

SEQ ID NO: 440717 - DNA, 20 bp, Artificial Sequence
  chemically synthesized
attttattttaaaatgtaac

SEQ ID NO: 440718 - DNA, 20 bp, Artificial Sequence
  chemically synthesized
ttttattttaaaatgtaact

SEQ ID NO: 440719 - DNA, 20 bp, Artificial Sequence
  chemically synthesized
ttttaaaatgtaactgggaa

SEQ ID NO: 440720 - DNA, 20 bp, Artificial Sequence
  chemically synthesized
gttgacatttaatcttttcc

SEQ ID NO: 440721 - DNA, 20 bp, Artificial Sequence
  chemically synthesized
tgtcaacacatctcttcata

SEQ ID NO: 440722 - DNA, 20 bp, Artificial Sequence
  chemically synthesized
ggaaatcacctctgtatgaa

SEQ ID NO: 440723 - DNA, 20 bp, Artificial Sequence
  chemically synthesized
tcaacacatctcttcataca

SEQ ID NO: 440724 - DNA, 20 bp, Artificial Sequence
  chemically synthesized
caacacatctcttcatacag

SEQ ID NO: 440725 - DNA, 20 bp, Artificial Sequence
  chemically synthesized
tgggaaatcacctctgtatg

SEQ ID NO: 440726 - DNA, 20 bp, Artificial Sequence
  chemically synthesized
tcatacagaggtgatttccc

SEQ ID NO: 440727 - DNA, 20 bp, Artificial Sequence
  chemically synthesized
taaggctttaatagtttctt

SEQ ID NO: 440728 - DNA, 20 bp, Artificial Sequence
  chemically synthesized
gtaaggctttaatagtttct

SEQ ID NO: 440729 - DNA, 20 bp, Artificial Sequence
  chemically synthesized
gatttcccaagaaactatta

SEQ ID NO: 440730 - DNA, 20 bp, Artificial Sequence
  chemically synthesized
tcatgtaagtaaggctttaa

SEQ ID NO: 440731 - DNA, 20 bp, Artificial Sequence
  chemically synthesized
aggggcccctcatgtaagta

SEQ ID NO: 440732 - DNA, 20 bp, Artificial Sequence
  chemically synthesized
gaggggcccctcatgtaagt

SEQ ID NO: 440733 - DNA, 20 bp, Artificial Sequence
  chemically synthesized
tattaaagccttacttacat

SEQ ID NO: 440734 - DNA, 20 bp, Artificial Sequence
  chemically synthesized
attaaagccttacttacatg

SEQ ID NO: 440735 - DNA, 20 bp, Artificial Sequence
  chemically synthesized
ttaaagccttacttacatga

SEQ ID NO: 440736 - DNA, 20 bp, Artificial Sequence
  chemically synthesized
taaagccttacttacatgag

SEQ ID NO: 440737 - DNA, 20 bp, Artificial Sequence
  chemically synthesized
ttgggaggggcccctcatgt

SEQ ID NO: 440738 - DNA, 20 bp, Artificial Sequence
  chemically synthesized
ttacatgaggggcccctccc

SEQ ID NO: 440739 - DNA, 20 bp, Artificial Sequence
  chemically synthesized
tacatgaggggcccctccca

SEQ ID NO: 440740 - DNA, 20 bp, Artificial Sequence
  chemically synthesized
attggatacagccttgggag

SEQ ID NO: 440741 - DNA, 20 bp, Artificial Sequence
  chemically synthesized
aattggatacagccttggga

SEQ ID NO: 440742 - DNA, 20 bp, Artificial Sequence
  chemically synthesized
aaattggatacagccttggg

SEQ ID NO: 440743 - DNA, 20 bp, Artificial Sequence
  chemically synthesized
aaaattggatacagccttgg

SEQ ID NO: 440744 - DNA, 20 bp, Artificial Sequence
  chemically synthesized
agaaaattggatacagcctt

SEQ ID NO: 440745 - DNA, 20 bp, Artificial Sequence
  chemically synthesized
tagaaaattggatacagcct

SEQ ID NO: 440746 - DNA, 20 bp, Artificial Sequence
  chemically synthesized
aaataatagaaaattggata

SEQ ID NO: 440747 - DNA, 20 bp, Artificial Sequence
  chemically synthesized
taagaaaaataatagaaaat

SEQ ID NO: 440748 - DNA, 20 bp, Artificial Sequence
  chemically synthesized
tgctattttaagaaaaataa

SEQ ID NO: 440749 - DNA, 20 bp, Artificial Sequence
  chemically synthesized
ttctattatttttcttaaaa

SEQ ID NO: 440750 - DNA, 20 bp, Artificial Sequence
  chemically synthesized
acaattgggggtgctatttt

SEQ ID NO: 440751 - DNA, 20 bp, Artificial Sequence
  chemically synthesized
gcctgaggttatacaattgg

SEQ ID NO: 440752 - DNA, 20 bp, Artificial Sequence
  chemically synthesized
ggcctgaggttatacaattg

SEQ ID NO: 440753 - DNA, 20 bp, Artificial Sequence
  chemically synthesized
gggcctgaggttatacaatt

SEQ ID NO: 440754 - DNA, 20 bp, Artificial Sequence
  chemically synthesized
ggggcctgaggttatacaat

SEQ ID NO: 440755 - DNA, 20 bp, Artificial Sequence
  chemically synthesized
cacccccaattgtataacct

SEQ ID NO: 440756 - DNA, 20 bp, Artificial Sequence
  chemically synthesized
acccccaattgtataacctc

SEQ ID NO: 440757 - DNA, 20 bp, Artificial Sequence
  chemically synthesized
gaaaggatttatggggcctg

SEQ ID NO: 440758 - DNA, 20 bp, Artificial Sequence
  chemically synthesized
agaaaggatttatggggcct

SEQ ID NO: 440759 - DNA, 20 bp, Artificial Sequence
  chemically synthesized
ccaggaagaaaggatttatg

SEQ ID NO: 440760 - DNA, 20 bp, Artificial Sequence
  chemically synthesized
accaggaagaaaggatttat

SEQ ID NO: 440761 - DNA, 20 bp, Artificial Sequence
  chemically synthesized
aaccaggaagaaaggattta

SEQ ID NO: 440762 - DNA, 20 bp, Artificial Sequence
  chemically synthesized
ccccataaatcctttcttcc

SEQ ID NO: 440763 - DNA, 20 bp, Artificial Sequence
  chemically synthesized
acagaacgaaccaggaagaa

SEQ ID NO: 440764 - DNA, 20 bp, Artificial Sequence
  chemically synthesized
cacagaacgaaccaggaaga

SEQ ID NO: 440765 - DNA, 20 bp, Artificial Sequence
  chemically synthesized
acaacacagaacgaaccagg

SEQ ID NO: 440766 - DNA, 20 bp, Artificial Sequence
  chemically synthesized
ctgacaacacagaacgaacc

SEQ ID NO: 440767 - DNA, 20 bp, Artificial Sequence
  chemically synthesized
tctgacaacacagaacgaac

SEQ ID NO: 440768 - DNA, 20 bp, Artificial Sequence
  chemically synthesized
cctggttcgttctgtgttgt

SEQ ID NO: 440769 - DNA, 20 bp, Artificial Sequence
  chemically synthesized
acattccctgtctgacaaca

SEQ ID NO: 440770 - DNA, 20 bp, Artificial Sequence
  chemically synthesized
gttcgttctgtgttgtcaga

SEQ ID NO: 440771 - DNA, 20 bp, Artificial Sequence
  chemically synthesized
ttcgttctgtgttgtcagac

SEQ ID NO: 440772 - DNA, 20 bp, Artificial Sequence
  chemically synthesized
tcgttctgtgttgtcagaca

SEQ ID NO: 440773 - DNA, 20 bp, Artificial Sequence
  chemically synthesized
gtcagacagggaatgtacat

SEQ ID NO: 440774 - DNA, 20 bp, Artificial Sequence
  chemically synthesized
tttttaaggaattgacaaat

SEQ ID NO: 440775 - DNA, 20 bp, Artificial Sequence
  chemically synthesized
taaacacacatcatttttta

SEQ ID NO: 440776 - DNA, 20 bp, Artificial Sequence
  chemically synthesized
ttaaacacacatcatttttt

SEQ ID NO: 440777 - DNA, 20 bp, Artificial Sequence
  chemically synthesized
aaaatgatgtgtgtttaaaa

SEQ ID NO: 440778 - DNA, 20 bp, Artificial Sequence
  chemically synthesized
tgtgtttaaaatagaaaatt

SEQ ID NO: 440779 - DNA, 20 bp, Artificial Sequence
  chemically synthesized
agaaaatttagaaaaatgaa

SEQ ID NO: 440780 - DNA, 20 bp, Artificial Sequence
  chemically synthesized
tgaacagaaaattatcttta

SEQ ID NO: 440781 - DNA, 20 bp, Artificial Sequence
  chemically synthesized
cagaaaattatctttaaaga

SEQ ID NO: 440782 - DNA, 20 bp, Artificial Sequence
  chemically synthesized
agaaaattatctttaaagaa

SEQ ID NO: 440783 - DNA, 20 bp, Artificial Sequence
  chemically synthesized
tagaaattaacctttcttta

SEQ ID NO: 440784 - DNA, 20 bp, Artificial Sequence
  chemically synthesized
aagaaaggttaatttctaat

SEQ ID NO: 440785 - DNA, 20 bp, Artificial Sequence
  chemically synthesized
gtttcctaagagggtctaat

SEQ ID NO: 440786 - DNA, 20 bp, Artificial Sequence
  chemically synthesized
aatttctaattagaccctct

SEQ ID NO: 440787 - DNA, 20 bp, Artificial Sequence
  chemically synthesized
atttctaattagaccctctt

SEQ ID NO: 440788 - DNA, 20 bp, Artificial Sequence
  chemically synthesized
gggtataaagtttcctaaga

SEQ ID NO: 440789 - DNA, 20 bp, Artificial Sequence
  chemically synthesized
agggtataaagtttcctaag

SEQ ID NO: 440790 - DNA, 20 bp, Artificial Sequence
  chemically synthesized
cagggtataaagtttcctaa

SEQ ID NO: 440791 - DNA, 20 bp, Artificial Sequence
  chemically synthesized
cacagggtataaagtttcct

SEQ ID NO: 440792 - DNA, 20 bp, Artificial Sequence
  chemically synthesized
cattcaaatcacagggtata

SEQ ID NO: 440793 - DNA, 20 bp, Artificial Sequence
  chemically synthesized
ttatatgcattcaaatcaca

SEQ ID NO: 440794 - DNA, 20 bp, Artificial Sequence
  chemically synthesized
tttatatgcattcaaatcac

SEQ ID NO: 440795 - DNA, 20 bp, Artificial Sequence
  chemically synthesized
atttatatgcattcaaatca

SEQ ID NO: 440796 - DNA, 20 bp, Artificial Sequence
  chemically synthesized
gaaacacagtattttggtat

SEQ ID NO: 440797 - DNA, 20 bp, Artificial Sequence
  chemically synthesized
atacaagaaacacagtattt

SEQ ID NO: 440798 - DNA, 20 bp, Artificial Sequence
  chemically synthesized
catcacacatacaagaaaca

SEQ ID NO: 440799 - DNA, 20 bp, Artificial Sequence
  chemically synthesized
ctttatttcatcacacatac

SEQ ID NO: 440800 - DNA, 20 bp, Artificial Sequence
  chemically synthesized
cttgtatgtgtgatgaaata

SEQ ID NO: 440801 - DNA, 20 bp, Artificial Sequence
  chemically synthesized
tgtatgtgtgatgaaataaa

SEQ ID NO: 440802 - DNA, 20 bp, Artificial Sequence
  chemically synthesized
gaaataaagagttgatgaaa

SEQ ID NO: 440803 - DNA, 20 bp, Artificial Sequence
  chemically synthesized
tatgataaatcatttttaat

SEQ ID NO: 440804 - DNA, 20 bp, Artificial Sequence
  chemically synthesized
ataaatcatttttaataagt

SEQ ID NO: 440805 - DNA, 20 bp, Artificial Sequence
  chemically synthesized
taaatcatttttaataagtt

SEQ ID NO: 440806 - DNA, 20 bp, Artificial Sequence
  chemically synthesized
aagttaggaaaatattacaa

SEQ ID NO: 440807 - DNA, 20 bp, Artificial Sequence
  chemically synthesized
ttaggaaaatattacaatag

SEQ ID NO: 440808 - DNA, 20 bp, Artificial Sequence
  chemically synthesized
taggaaaatattacaataga

SEQ ID NO: 440809 - DNA, 20 bp, Artificial Sequence
  chemically synthesized
gaaaatattacaatagaagg

SEQ ID NO: 440810 - DNA, 20 bp, Artificial Sequence
  chemically synthesized
aatattacaatagaaggtgg

SEQ ID NO: 440811 - DNA, 20 bp, Artificial Sequence
  chemically synthesized
atattacaatagaaggtgga

SEQ ID NO: 440812 - DNA, 20 bp, Artificial Sequence
  chemically synthesized
attacaatagaaggtggaag

SEQ ID NO: 440813 - DNA, 20 bp, Artificial Sequence
  chemically synthesized
acaatagaaggtggaaggag

SEQ ID NO: 440814 - DNA, 20 bp, Artificial Sequence
  chemically synthesized
caatagaaggtggaaggaga

SEQ ID NO: 440815 - DNA, 20 bp, Artificial Sequence
  chemically synthesized
agaaggtggaaggagaagga

SEQ ID NO: 440816 - DNA, 20 bp, Artificial Sequence
  chemically synthesized
gtggaaggagaaggaaagtt

SEQ ID NO: 440817 - DNA, 20 bp, Artificial Sequence
  chemically synthesized
tggaaggagaaggaaagttt

SEQ ID NO: 440818 - DNA, 20 bp, Artificial Sequence
  chemically synthesized
tttatctcaagagtaaaaca

SEQ ID NO: 440819 - DNA, 20 bp, Artificial Sequence
  chemically synthesized
aatgactttgttttactctt

SEQ ID NO: 440820 - DNA, 20 bp, Artificial Sequence
  chemically synthesized
tcatcaaaattttatctcaa

SEQ ID NO: 440821 - DNA, 20 bp, Artificial Sequence
  chemically synthesized
tttcatcaaaattttatctc

SEQ ID NO: 440822 - DNA, 20 bp, Artificial Sequence
  chemically synthesized
ttgagataaaattttgatga

SEQ ID NO: 440823 - DNA, 20 bp, Artificial Sequence
  chemically synthesized
tttgatgaaagataataaaa

SEQ ID NO: 440824 - DNA, 20 bp, Artificial Sequence
  chemically synthesized
atcattgtcttggaaacatc

SEQ ID NO: 440825 - DNA, 20 bp, Artificial Sequence
  chemically synthesized
aatcattgtcttggaaacat

SEQ ID NO: 440826 - DNA, 20 bp, Artificial Sequence
  chemically synthesized
gaaaaacacctgatgtttcc

SEQ ID NO: 440827 - DNA, 20 bp, Artificial Sequence
  chemically synthesized
agagattaaaatcattgtct

SEQ ID NO: 440828 - DNA, 20 bp, Artificial Sequence
  chemically synthesized
acttgtgtagtttaataaaa

SEQ ID NO: 440829 - DNA, 20 bp, Artificial Sequence
  chemically synthesized
ccacttgtgtagtttaataa

SEQ ID NO: 440830 - DNA, 20 bp, Artificial Sequence
  chemically synthesized
tctcttttattaaactacac

SEQ ID NO: 440831 - DNA, 20 bp, Artificial Sequence
  chemically synthesized
cttttattaaactacacaag

SEQ ID NO: 440832 - DNA, 20 bp, Artificial Sequence
  chemically synthesized
caagtttttaaccacttgtg

SEQ ID NO: 440833 - DNA, 20 bp, Artificial Sequence
  chemically synthesized
tacatatgaaacaaattgtc

SEQ ID NO: 440834 - DNA, 20 bp, Artificial Sequence
  chemically synthesized
ttgacaatttgtttcatatg

SEQ ID NO: 440835 - DNA, 20 bp, Artificial Sequence
  chemically synthesized
ttcatatgtagcaaatgaca

SEQ ID NO: 440836 - DNA, 20 bp, Artificial Sequence
  chemically synthesized
catatgtagcaaatgacatg

SEQ ID NO: 440837 - DNA, 20 bp, Artificial Sequence
  chemically synthesized
gtagcaaatgacatggagta

SEQ ID NO: 440838 - DNA, 20 bp, Artificial Sequence
  chemically synthesized
tagcaaatgacatggagtac

SEQ ID NO: 440839 - DNA, 20 bp, Artificial Sequence
  chemically synthesized
agcaaatgacatggagtaca

SEQ ID NO: 440840 - DNA, 20 bp, Artificial Sequence
  chemically synthesized
gggatttcaaatgaatgcta

SEQ ID NO: 440841 - DNA, 20 bp, Artificial Sequence
  chemically synthesized
ggatttcaaatgaatgctat

SEQ ID NO: 440842 - DNA, 20 bp, Artificial Sequence
  chemically synthesized
cagcttcctctttattccta

SEQ ID NO: 440843 - DNA, 20 bp, Artificial Sequence
  chemically synthesized
aaatgaatgctataggaata

SEQ ID NO: 440844 - DNA, 20 bp, Artificial Sequence
  chemically synthesized
atgaatgctataggaataaa

SEQ ID NO: 440845 - DNA, 20 bp, Artificial Sequence
  chemically synthesized
tgaatgctataggaataaag

SEQ ID NO: 440846 - DNA, 20 bp, Artificial Sequence
  chemically synthesized
atgctataggaataaagagg

SEQ ID NO: 440847 - DNA, 20 bp, Artificial Sequence
  chemically synthesized
tttgggcacagatattaata

SEQ ID NO: 440848 - DNA, 20 bp, Artificial Sequence
  chemically synthesized
gcaaattcatcatttgggca

SEQ ID NO: 440849 - DNA, 20 bp, Artificial Sequence
  chemically synthesized
gaattgcaaattcatcattt

SEQ ID NO: 440850 - DNA, 20 bp, Artificial Sequence
  chemically synthesized
tgaattgcaaattcatcatt

SEQ ID NO: 440851 - DNA, 20 bp, Artificial Sequence
  chemically synthesized
caaatgatgaatttgcaatt

SEQ ID NO: 440852 - DNA, 20 bp, Artificial Sequence
  chemically synthesized
atttgcaattcagtactgtc

SEQ ID NO: 440853 - DNA, 20 bp, Artificial Sequence
  chemically synthesized
gcaattcagtactgtctagc

SEQ ID NO: 440854 - DNA, 20 bp, Artificial Sequence
  chemically synthesized
ctgacactattccagctaga

SEQ ID NO: 440855 - DNA, 20 bp, Artificial Sequence
  chemically synthesized
tcagtactgtctagctggaa

SEQ ID NO: 440856 - DNA, 20 bp, Artificial Sequence
  chemically synthesized
ttggctgacactattccagc

SEQ ID NO: 440857 - DNA, 20 bp, Artificial Sequence
  chemically synthesized
ggtgttggctgacactattc

SEQ ID NO: 440858 - DNA, 20 bp, Artificial Sequence
  chemically synthesized
ctgtctagctggaatagtgt

SEQ ID NO: 440859 - DNA, 20 bp, Artificial Sequence
  chemically synthesized
atttaaggggaaaaaggtgt

SEQ ID NO: 440860 - DNA, 20 bp, Artificial Sequence
  chemically synthesized
tacattatttaaggggaaaa

SEQ ID NO: 440861 - DNA, 20 bp, Artificial Sequence
  chemically synthesized
ttacattatttaaggggaaa

SEQ ID NO: 440862 - DNA, 20 bp, Artificial Sequence
  chemically synthesized
gcataattacattatttaag

SEQ ID NO: 440863 - DNA, 20 bp, Artificial Sequence
  chemically synthesized
tgcataattacattatttaa

SEQ ID NO: 440864 - DNA, 20 bp, Artificial Sequence
  chemically synthesized
atgcataattacattattta

SEQ ID NO: 440865 - DNA, 20 bp, Artificial Sequence
  chemically synthesized
tatgcataattacattattt

SEQ ID NO: 440866 - DNA, 20 bp, Artificial Sequence
  chemically synthesized
ttaaataatgtaattatgca

SEQ ID NO: 440867 - DNA, 20 bp, Artificial Sequence
  chemically synthesized
attatgcatagaacactttg

SEQ ID NO: 440868 - DNA, 20 bp, Artificial Sequence
  chemically synthesized
aactttaaaaaaagactaca

SEQ ID NO: 440869 - DNA, 20 bp, Artificial Sequence
  chemically synthesized
cactttgtagtcttttttta

SEQ ID NO: 440870 - DNA, 20 bp, Artificial Sequence
  chemically synthesized
gttactctaaactttaaaaa

SEQ ID NO: 440871 - DNA, 20 bp, Artificial Sequence
  chemically synthesized
tgtagtctttttttaaagtt

SEQ ID NO: 440872 - DNA, 20 bp, Artificial Sequence
  chemically synthesized
tagtctttttttaaagttta

SEQ ID NO: 440873 - DNA, 20 bp, Artificial Sequence
  chemically synthesized
atacaatagagtatgtcata

SEQ ID NO: 440874 - DNA, 20 bp, Artificial Sequence
  chemically synthesized
acattatgaaaaatacaata

SEQ ID NO: 440875 - DNA, 20 bp, Artificial Sequence
  chemically synthesized
taacattatgaaaaatacaa

SEQ ID NO: 440876 - DNA, 20 bp, Artificial Sequence
  chemically synthesized
ttcataatgttatgtcatgt

SEQ ID NO: 440877 - DNA, 20 bp, Artificial Sequence
  chemically synthesized
tgtcatgtaagatacaccaa

SEQ ID NO: 440878 - DNA, 20 bp, Artificial Sequence
  chemically synthesized
tactgttaatacaaagcttt

SEQ ID NO: 440879 - DNA, 20 bp, Artificial Sequence
  chemically synthesized
gatgatatactgttaataca

SEQ ID NO: 440880 - DNA, 20 bp, Artificial Sequence
  chemically synthesized
caccaaaagctttgtattaa

SEQ ID NO: 440881 - DNA, 20 bp, Artificial Sequence
  chemically synthesized
ttaacagtatatcatcaatt

SEQ ID NO: 440882 - DNA, 20 bp, Artificial Sequence
  chemically synthesized
agtatatcatcaatttagat

SEQ ID NO: 440883 - DNA, 20 bp, Artificial Sequence
  chemically synthesized
gatcagcaatctctttttcg

SEQ ID NO: 440884 - DNA, 20 bp, Artificial Sequence
  chemically synthesized
gacatcttaactacgaaaaa

SEQ ID NO: 440885 - DNA, 20 bp, Artificial Sequence
  chemically synthesized
aagacatcttaactacgaaa

SEQ ID NO: 440886 - DNA, 20 bp, Artificial Sequence
  chemically synthesized
gcaatctctttttcgtagtt

SEQ ID NO: 440887 - DNA, 20 bp, Artificial Sequence
  chemically synthesized
cgtagttaagatgtctttaa

SEQ ID NO: 440888 - DNA, 20 bp, Artificial Sequence
  chemically synthesized
ttcatctgcagaatctttta

SEQ ID NO: 440889 - DNA, 20 bp, Artificial Sequence
  chemically synthesized
gatgtctttaaaagattctg

SEQ ID NO: 440890 - DNA, 20 bp, Artificial Sequence
  chemically synthesized
accttttagaatttcatctg

SEQ ID NO: 440891 - DNA, 20 bp, Artificial Sequence
  chemically synthesized
ttctgcagatgaaattctaa

SEQ ID NO: 440892 - DNA, 20 bp, Artificial Sequence
  chemically synthesized
tctgcagatgaaattctaaa

SEQ ID NO: 440893 - DNA, 20 bp, Artificial Sequence
  chemically synthesized
ggtctaataaaatcaccttt

SEQ ID NO: 440894 - DNA, 20 bp, Artificial Sequence
  chemically synthesized
attctaaaaggtgattttat

SEQ ID NO: 440895 - DNA, 20 bp, Artificial Sequence
  chemically synthesized
aaggtgattttattagacct

SEQ ID NO: 440896 - DNA, 20 bp, Artificial Sequence
  chemically synthesized
taaatgatgtaagtcatctg

SEQ ID NO: 440897 - DNA, 20 bp, Artificial Sequence
  chemically synthesized
ttaaatgatgtaagtcatct

SEQ ID NO: 440898 - DNA, 20 bp, Artificial Sequence
  chemically synthesized
tgaatatatttaaatgatgt

SEQ ID NO: 440899 - DNA, 20 bp, Artificial Sequence
  chemically synthesized
tcaaatgaaatgtctatttg

SEQ ID NO: 440900 - DNA, 20 bp, Artificial Sequence
  chemically synthesized
ttcaaatagtgtactgcaaa

SEQ ID NO: 440901 - DNA, 20 bp, Artificial Sequence
  chemically synthesized
attgtaaagaattattcaaa

SEQ ID NO: 440902 - DNA, 20 bp, Artificial Sequence
  chemically synthesized
tactcaaataatgcattgta

SEQ ID NO: 440903 - DNA, 20 bp, Artificial Sequence
  chemically synthesized
ttctttacaatgcattattt

SEQ ID NO: 440904 - DNA, 20 bp, Artificial Sequence
  chemically synthesized
cattatttgagtaattctaa

SEQ ID NO: 440905 - DNA, 20 bp, Artificial Sequence
  chemically synthesized
catattgtattgttcacttt

SEQ ID NO: 440906 - DNA, 20 bp, Artificial Sequence
  chemically synthesized
atacaatatgtttgacaata

SEQ ID NO: 440907 - DNA, 20 bp, Artificial Sequence
  chemically synthesized
caatacagtgatctctttta

SEQ ID NO: 440908 - DNA, 20 bp, Artificial Sequence
  chemically synthesized
aatacagtgatctcttttaa

SEQ ID NO: 440909 - DNA, 20 bp, Artificial Sequence
  chemically synthesized
atacagtgatctcttttaaa

SEQ ID NO: 440910 - DNA, 20 bp, Artificial Sequence
  chemically synthesized
aaaacagttaccctttaaaa

SEQ ID NO: 440911 - DNA, 20 bp, Artificial Sequence
  chemically synthesized
ccaaaacagttaccctttaa

SEQ ID NO: 440912 - DNA, 20 bp, Artificial Sequence
  chemically synthesized
cttttaaagggtaactgttt

SEQ ID NO: 440913 - DNA, 20 bp, Artificial Sequence
  chemically synthesized
ttgttgttttttaaccaaaa

SEQ ID NO: 440914 - DNA, 20 bp, Artificial Sequence
  chemically synthesized
acaacaaaacgtacttttgt

SEQ ID NO: 440915 - DNA, 20 bp, Artificial Sequence
  chemically synthesized
gtagtttgataaacttacaa

SEQ ID NO: 440916 - DNA, 20 bp, Artificial Sequence
  chemically synthesized
tttgtaagtttatcaaacta

SEQ ID NO: 440917 - DNA, 20 bp, Artificial Sequence
  chemically synthesized
tccagtttgtaaatttgccg

SEQ ID NO: 440918 - DNA, 20 bp, Artificial Sequence
  chemically synthesized
actacggcaaatttacaaac

SEQ ID NO: 440919 - DNA, 20 bp, Artificial Sequence
  chemically synthesized
ggatgtttgacatttgaatc

SEQ ID NO: 440920 - DNA, 20 bp, Artificial Sequence
  chemically synthesized
gattcaaatgtcaaacatcc

SEQ ID NO: 440921 - DNA, 20 bp, Artificial Sequence
  chemically synthesized
tcaaatgtcaaacatccaag

SEQ ID NO: 440922 - DNA, 20 bp, Artificial Sequence
  chemically synthesized
aatgtcaaacatccaagtag

SEQ ID NO: 440923 - DNA, 20 bp, Artificial Sequence
  chemically synthesized
tttgacaacatactgctact

SEQ ID NO: 440924 - DNA, 20 bp, Artificial Sequence
  chemically synthesized
agtagcagtatgttgtcaaa

SEQ ID NO: 440925 - DNA, 20 bp, Artificial Sequence
  chemically synthesized
gcaaaatttaatgtataata

SEQ ID NO: 440926 - DNA, 20 bp, Artificial Sequence
  chemically synthesized
ttaatgtataatatagccct

SEQ ID NO: 440927 - DNA, 20 bp, Artificial Sequence
  chemically synthesized
aaaaaacggagatatactca

SEQ ID NO: 440928 - DNA, 20 bp, Artificial Sequence
  chemically synthesized
gaaaaaacggagatatactc

SEQ ID NO: 440929 - DNA, 20 bp, Artificial Sequence
  chemically synthesized
agaaaaaacggagatatact

SEQ ID NO: 440930 - DNA, 20 bp, Artificial Sequence
  chemically synthesized
gagtttggtaagaaaaaacg

SEQ ID NO: 440931 - DNA, 20 bp, Artificial Sequence
  chemically synthesized
atgagtttggtaagaaaaaa

SEQ ID NO: 440932 - DNA, 20 bp, Artificial Sequence
  chemically synthesized
aacatgacaatgagtttggt

SEQ ID NO: 440933 - DNA, 20 bp, Artificial Sequence
  chemically synthesized
atgcaacatgacaatgagtt

SEQ ID NO: 440934 - DNA, 20 bp, Artificial Sequence
  chemically synthesized
tgcctatgcaacatgacaat

SEQ ID NO: 440935 - DNA, 20 bp, Artificial Sequence
  chemically synthesized
aaactcattgtcatgttgca

SEQ ID NO: 440936 - DNA, 20 bp, Artificial Sequence
  chemically synthesized
aactcattgtcatgttgcat

SEQ ID NO: 440937 - DNA, 20 bp, Artificial Sequence
  chemically synthesized
gctgcatttaaaaaatcatc

SEQ ID NO: 440938 - DNA, 20 bp, Artificial Sequence
  chemically synthesized
acttgatgattttttaaatg

SEQ ID NO: 440939 - DNA, 20 bp, Artificial Sequence
  chemically synthesized
tgcagcgtgaaaaaatccta

SEQ ID NO: 440940 - DNA, 20 bp, Artificial Sequence
  chemically synthesized
gcagcgtgaaaaaatcctac

SEQ ID NO: 440941 - DNA, 20 bp, Artificial Sequence
  chemically synthesized
cagcgtgaaaaaatcctaca

SEQ ID NO: 440942 - DNA, 20 bp, Artificial Sequence
  chemically synthesized
ctttttgggacatgccctgt

SEQ ID NO: 440943 - DNA, 20 bp, Artificial Sequence
  chemically synthesized
tctttttgggacatgccctg

SEQ ID NO: 440944 - DNA, 20 bp, Artificial Sequence
  chemically synthesized
cctacagggcatgtcccaaa

SEQ ID NO: 440945 - DNA, 20 bp, Artificial Sequence
  chemically synthesized
cgaagaaaggtaatcttttt

SEQ ID NO: 440946 - DNA, 20 bp, Artificial Sequence
  chemically synthesized
gcgaagaaaggtaatctttt

SEQ ID NO: 440947 - DNA, 20 bp, Artificial Sequence
  chemically synthesized
aattcttagaatgcgaagaa

SEQ ID NO: 440948 - DNA, 20 bp, Artificial Sequence
  chemically synthesized
caattcttagaatgcgaaga

SEQ ID NO: 440949 - DNA, 20 bp, Artificial Sequence
  chemically synthesized
ctttcaattcttagaatgcg

SEQ ID NO: 440950 - DNA, 20 bp, Artificial Sequence
  chemically synthesized
attacctttcttcgcattct

SEQ ID NO: 440951 - DNA, 20 bp, Artificial Sequence
  chemically synthesized
ttcaaataactttcaattct

SEQ ID NO: 440952 - DNA, 20 bp, Artificial Sequence
  chemically synthesized
cttcgcattctaagaattga

SEQ ID NO: 440953 - DNA, 20 bp, Artificial Sequence
  chemically synthesized
ttatttgaatatctatgaca

SEQ ID NO: 440954 - DNA, 20 bp, Artificial Sequence
  chemically synthesized
atctacactctgctttgtca

SEQ ID NO: 440955 - DNA, 20 bp, Artificial Sequence
  chemically synthesized
tttgaatatctatgacaaag

SEQ ID NO: 440956 - DNA, 20 bp, Artificial Sequence
  chemically synthesized
tgaatatctatgacaaagca

SEQ ID NO: 440957 - DNA, 20 bp, Artificial Sequence
  chemically synthesized
atctatgacaaagcagagtg

SEQ ID NO: 440958 - DNA, 20 bp, Artificial Sequence
  chemically synthesized
aattctgctgaaattaagca

SEQ ID NO: 440959 - DNA, 20 bp, Artificial Sequence
  chemically synthesized
caattctgctgaaattaagc

SEQ ID NO: 440960 - DNA, 20 bp, Artificial Sequence
  chemically synthesized
agatttaccttgcttaattt

SEQ ID NO: 440961 - DNA, 20 bp, Artificial Sequence
  chemically synthesized
tatgcaattctgctgaaatt

SEQ ID NO: 440962 - DNA, 20 bp, Artificial Sequence
  chemically synthesized
tttaccttgcttaatttcag

SEQ ID NO: 440963 - DNA, 20 bp, Artificial Sequence
  chemically synthesized
agtatatagagcaattttga

SEQ ID NO: 440964 - DNA, 20 bp, Artificial Sequence
  chemically synthesized
acatcatatacaagtatata

SEQ ID NO: 440965 - DNA, 20 bp, Artificial Sequence
  chemically synthesized
taacatcatatacaagtata

SEQ ID NO: 440966 - DNA, 20 bp, Artificial Sequence
  chemically synthesized
acataattaacatcatatac

SEQ ID NO: 440967 - DNA, 20 bp, Artificial Sequence
  chemically synthesized
tgtatatgatgttaattatg

SEQ ID NO: 440968 - DNA, 20 bp, Artificial Sequence
  chemically synthesized
atatatatatataaaatcac

SEQ ID NO: 440969 - DNA, 20 bp, Artificial Sequence
  chemically synthesized
ataaataccatcaaaatcac

SEQ ID NO: 440970 - DNA, 20 bp, Artificial Sequence
  chemically synthesized
aaaatcactagtgattttga

SEQ ID NO: 440971 - DNA, 20 bp, Artificial Sequence
  chemically synthesized
tatttatgttacatatatca

SEQ ID NO: 440972 - DNA, 20 bp, Artificial Sequence
  chemically synthesized
tgtgtgtatattgcaaacaa

SEQ ID NO: 440973 - DNA, 20 bp, Artificial Sequence
  chemically synthesized
tatcattacaaatatatgca

SEQ ID NO: 440974 - DNA, 20 bp, Artificial Sequence
  chemically synthesized
catgcatatatttgtaatga

SEQ ID NO: 440975 - DNA, 20 bp, Artificial Sequence
  chemically synthesized
tgtaatgatagtaaatataa

SEQ ID NO: 440976 - DNA, 20 bp, Artificial Sequence
  chemically synthesized
ataatagtttttcaatctaa

SEQ ID NO: 440977 - DNA, 20 bp, Artificial Sequence
  chemically synthesized
gtggacatcattattacttt

SEQ ID NO: 440978 - DNA, 20 bp, Artificial Sequence
  chemically synthesized
gtaataatgatgtccaccaa

SEQ ID NO: 440979 - DNA, 20 bp, Artificial Sequence
  chemically synthesized
gcttcataaatttcttttgg

SEQ ID NO: 440980 - DNA, 20 bp, Artificial Sequence
  chemically synthesized
cttgcttcataaatttcttt

SEQ ID NO: 440981 - DNA, 20 bp, Artificial Sequence
  chemically synthesized
tccaccaaaagaaatttatg

SEQ ID NO: 440982 - DNA, 20 bp, Artificial Sequence
  chemically synthesized
ccaaaagaaatttatgaagc

SEQ ID NO: 440983 - DNA, 20 bp, Artificial Sequence
  chemically synthesized
atgaagcaagccaacaatgt

SEQ ID NO: 440984 - DNA, 20 bp, Artificial Sequence
  chemically synthesized
acaatatttacttacattgt

SEQ ID NO: 440985 - DNA, 20 bp, Artificial Sequence
  chemically synthesized
taagtaaatattgtattata

SEQ ID NO: 440986 - DNA, 20 bp, Artificial Sequence
  chemically synthesized
aaatattgtattataaagtc

SEQ ID NO: 440987 - DNA, 20 bp, Artificial Sequence
  chemically synthesized
tattgtattataaagtctgg

SEQ ID NO: 440988 - DNA, 20 bp, Artificial Sequence
  chemically synthesized
tgagtcacattaaaagctac

SEQ ID NO: 440989 - DNA, 20 bp, Artificial Sequence
  chemically synthesized
catgtattgagtcacattaa

SEQ ID NO: 440990 - DNA, 20 bp, Artificial Sequence
  chemically synthesized
ttttaatgtgactcaataca

SEQ ID NO: 440991 - DNA, 20 bp, Artificial Sequence
  chemically synthesized
gttaacattgtccatgtatt

SEQ ID NO: 440992 - DNA, 20 bp, Artificial Sequence
  chemically synthesized
tgggaaaactttgtggaaat

SEQ ID NO: 440993 - DNA, 20 bp, Artificial Sequence
  chemically synthesized
aatgttaacttatttccaca

SEQ ID NO: 440994 - DNA, 20 bp, Artificial Sequence
  chemically synthesized
ttgccactgggaaaactttg

SEQ ID NO: 440995 - DNA, 20 bp, Artificial Sequence
  chemically synthesized
ttatttccacaaagttttcc

SEQ ID NO: 440996 - DNA, 20 bp, Artificial Sequence
  chemically synthesized
tttccacaaagttttcccag

SEQ ID NO: 440997 - DNA, 20 bp, Artificial Sequence
  chemically synthesized
aaggcagaagttttgccact

SEQ ID NO: 440998 - DNA, 20 bp, Artificial Sequence
  chemically synthesized
aaaggcagaagttttgccac

SEQ ID NO: 440999 - DNA, 20 bp, Artificial Sequence
  chemically synthesized
actactaaaaaaaaaggcag

SEQ ID NO: 441000 - DNA, 20 bp, Artificial Sequence
  chemically synthesized
acaactactaaaaaaaaagg

SEQ ID NO: 441001 - DNA, 20 bp, Artificial Sequence
  chemically synthesized
aaaacttctgcctttttttt

SEQ ID NO: 441002 - DNA, 20 bp, Artificial Sequence
  chemically synthesized
tccacaactactaaaaaaaa

SEQ ID NO: 441003 - DNA, 20 bp, Artificial Sequence
  chemically synthesized
ctccacaactactaaaaaaa

SEQ ID NO: 441004 - DNA, 20 bp, Artificial Sequence
  chemically synthesized
acttctgcctttttttttag

SEQ ID NO: 441005 - DNA, 20 bp, Artificial Sequence
  chemically synthesized
gcctttttttttagtagttg

SEQ ID NO: 441006 - DNA, 20 bp, Artificial Sequence
  chemically synthesized
ctttttttttagtagttgtg

SEQ ID NO: 441007 - DNA, 20 bp, Artificial Sequence
  chemically synthesized
gttgtggagcattacttatt

SEQ ID NO: 441008 - DNA, 20 bp, Artificial Sequence
  chemically synthesized
tgtggagcattacttatttg

SEQ ID NO: 441009 - DNA, 20 bp, Artificial Sequence
  chemically synthesized
tggagcattacttatttgga

SEQ ID NO: 441010 - DNA, 20 bp, Artificial Sequence
  chemically synthesized
aaaaataaatctctccaaat

SEQ ID NO: 441011 - DNA, 20 bp, Artificial Sequence
  chemically synthesized
tattttttcattcttaatta

SEQ ID NO: 441012 - DNA, 20 bp, Artificial Sequence
  chemically synthesized
attttttcattcttaattat

SEQ ID NO: 441013 - DNA, 20 bp, Artificial Sequence
  chemically synthesized
tgagggcaatgcctataatt

SEQ ID NO: 441014 - DNA, 20 bp, Artificial Sequence
  chemically synthesized
ttattctaaaatagatatga

SEQ ID NO: 441015 - DNA, 20 bp, Artificial Sequence
  chemically synthesized
gttattctaaaatagatatg

SEQ ID NO: 441016 - DNA, 20 bp, Artificial Sequence
  chemically synthesized
agttattctaaaatagatat

SEQ ID NO: 441017 - DNA, 20 bp, Artificial Sequence
  chemically synthesized
cattgccctcatatctattt

SEQ ID NO: 441018 - DNA, 20 bp, Artificial Sequence
  chemically synthesized
ggagtgtagttattctaaaa

SEQ ID NO: 441019 - DNA, 20 bp, Artificial Sequence
  chemically synthesized
catctttgacttgtggagtg

SEQ ID NO: 441020 - DNA, 20 bp, Artificial Sequence
  chemically synthesized
ttagaataactacactccac

SEQ ID NO: 441021 - DNA, 20 bp, Artificial Sequence
  chemically synthesized
ccacccatctttgacttgtg

SEQ ID NO: 441022 - DNA, 20 bp, Artificial Sequence
  chemically synthesized
taactacactccacaagtca

SEQ ID NO: 441023 - DNA, 20 bp, Artificial Sequence
  chemically synthesized
ccccacccatctttgacttg

SEQ ID NO: 441024 - DNA, 20 bp, Artificial Sequence
  chemically synthesized
tacactccacaagtcaaaga

SEQ ID NO: 441025 - DNA, 20 bp, Artificial Sequence
  chemically synthesized
acactccacaagtcaaagat

SEQ ID NO: 441026 - DNA, 20 bp, Artificial Sequence
  chemically synthesized
ctccacaagtcaaagatggg

SEQ ID NO: 441027 - DNA, 20 bp, Artificial Sequence
  chemically synthesized
tccacaagtcaaagatgggt

SEQ ID NO: 441028 - DNA, 20 bp, Artificial Sequence
  chemically synthesized
ccacaagtcaaagatgggtg

SEQ ID NO: 441029 - DNA, 20 bp, Artificial Sequence
  chemically synthesized
caagtcaaagatgggtgggg

SEQ ID NO: 441030 - DNA, 20 bp, Artificial Sequence
  chemically synthesized
agtcaaagatgggtggggaa

SEQ ID NO: 441031 - DNA, 20 bp, Artificial Sequence
  chemically synthesized
tgtgtgtcccgaagagatgg

SEQ ID NO: 441032 - DNA, 20 bp, Artificial Sequence
  chemically synthesized
gagataaactcccatctctt

SEQ ID NO: 441033 - DNA, 20 bp, Artificial Sequence
  chemically synthesized
actgtgtgtcccgaagagat

SEQ ID NO: 441034 - DNA, 20 bp, Artificial Sequence
  chemically synthesized
agataaactcccatctcttc

SEQ ID NO: 441035 - DNA, 20 bp, Artificial Sequence
  chemically synthesized
gactgtgtgtcccgaagaga

SEQ ID NO: 441036 - DNA, 20 bp, Artificial Sequence
  chemically synthesized
taaggactgtgtgtcccgaa

SEQ ID NO: 441037 - DNA, 20 bp, Artificial Sequence
  chemically synthesized
gataaggactgtgtgtcccg

SEQ ID NO: 441038 - DNA, 20 bp, Artificial Sequence
  chemically synthesized
tcccatctcttcgggacaca

SEQ ID NO: 441039 - DNA, 20 bp, Artificial Sequence
  chemically synthesized
agtaaaaataatatatgata

SEQ ID NO: 441040 - DNA, 20 bp, Artificial Sequence
  chemically synthesized
cagtaaaaataatatatgat

SEQ ID NO: 441041 - DNA, 20 bp, Artificial Sequence
  chemically synthesized
aaaaatggactgtggcacaa

SEQ ID NO: 441042 - DNA, 20 bp, Artificial Sequence
  chemically synthesized
ttatttttactgttgtgcca

SEQ ID NO: 441043 - DNA, 20 bp, Artificial Sequence
  chemically synthesized
aaggatttaaaaatggactg

SEQ ID NO: 441044 - DNA, 20 bp, Artificial Sequence
  chemically synthesized
actaatgaaggatttaaaaa

SEQ ID NO: 441045 - DNA, 20 bp, Artificial Sequence
  chemically synthesized
tccatttttaaatccttcat

SEQ ID NO: 441046 - DNA, 20 bp, Artificial Sequence
  chemically synthesized
aaagtcatgatgactaatga

SEQ ID NO: 441047 - DNA, 20 bp, Artificial Sequence
  chemically synthesized
gaaagtcatgatgactaatg

SEQ ID NO: 441048 - DNA, 20 bp, Artificial Sequence
  chemically synthesized
tatttcgtttatttttaaga

SEQ ID NO: 441049 - DNA, 20 bp, Artificial Sequence
  chemically synthesized
caactatttcgtttattttt

SEQ ID NO: 441050 - DNA, 20 bp, Artificial Sequence
  chemically synthesized
tttcttaaaaataaacgaaa

SEQ ID NO: 441051 - DNA, 20 bp, Artificial Sequence
  chemically synthesized
atagttgtatttctatatga

SEQ ID NO: 441052 - DNA, 20 bp, Artificial Sequence
  chemically synthesized
tttttagtttgtctttcata

SEQ ID NO: 441053 - DNA, 20 bp, Artificial Sequence
  chemically synthesized
agcttttcagttcaattttt

SEQ ID NO: 441054 - DNA, 20 bp, Artificial Sequence
  chemically synthesized
aactaaaaaattgaactgaa

SEQ ID NO: 441055 - DNA, 20 bp, Artificial Sequence
  chemically synthesized
aaaaaattgaactgaaaagc

SEQ ID NO: 441056 - DNA, 20 bp, Artificial Sequence
  chemically synthesized
tctattatgagccagctttt

SEQ ID NO: 441057 - DNA, 20 bp, Artificial Sequence
  chemically synthesized
gtttcatgtctattatgagc

SEQ ID NO: 441058 - DNA, 20 bp, Artificial Sequence
  chemically synthesized
actgaaaagctggctcataa

SEQ ID NO: 441059 - DNA, 20 bp, Artificial Sequence
  chemically synthesized
tgttgtttcatgtctattat

SEQ ID NO: 441060 - DNA, 20 bp, Artificial Sequence
  chemically synthesized
cataatagacatgaaacaac

SEQ ID NO: 441061 - DNA, 20 bp, Artificial Sequence
  chemically synthesized
ataatagacatgaaacaaca

SEQ ID NO: 441062 - DNA, 20 bp, Artificial Sequence
  chemically synthesized
cctaattatatttagtagta

SEQ ID NO: 441063 - DNA, 20 bp, Artificial Sequence
  chemically synthesized
gaactcctaattatatttag

SEQ ID NO: 441064 - DNA, 20 bp, Artificial Sequence
  chemically synthesized
gaggaactcctaattatatt

SEQ ID NO: 441065 - DNA, 20 bp, Artificial Sequence
  chemically synthesized
actttactactaaatataat

SEQ ID NO: 441066 - DNA, 20 bp, Artificial Sequence
  chemically synthesized
ctttactactaaatataatt

SEQ ID NO: 441067 - DNA, 20 bp, Artificial Sequence
  chemically synthesized
ttactactaaatataattag

SEQ ID NO: 441068 - DNA, 20 bp, Artificial Sequence
  chemically synthesized
aatataattaggagttcctc

SEQ ID NO: 441069 - DNA, 20 bp, Artificial Sequence
  chemically synthesized
gtaaacgacatacaaacttg

SEQ ID NO: 441070 - DNA, 20 bp, Artificial Sequence
  chemically synthesized
ggtaaacgacatacaaactt

SEQ ID NO: 441071 - DNA, 20 bp, Artificial Sequence
  chemically synthesized
agtttgtatgtcgtttaccc

SEQ ID NO: 441072 - DNA, 20 bp, Artificial Sequence
  chemically synthesized
aaatgatcagatgatttctt

SEQ ID NO: 441073 - DNA, 20 bp, Artificial Sequence
  chemically synthesized
caaatgatcagatgatttct

SEQ ID NO: 441074 - DNA, 20 bp, Artificial Sequence
  chemically synthesized
gatctatgctatcaaatgat

SEQ ID NO: 441075 - DNA, 20 bp, Artificial Sequence
  chemically synthesized
gaaatcatctgatcatttga

SEQ ID NO: 441076 - DNA, 20 bp, Artificial Sequence
  chemically synthesized
catctgatcatttgatagca

SEQ ID NO: 441077 - DNA, 20 bp, Artificial Sequence
  chemically synthesized
ataattatcatgatatgcta

SEQ ID NO: 441078 - DNA, 20 bp, Artificial Sequence
  chemically synthesized
tatcatgatatgctacagaa

SEQ ID NO: 441079 - DNA, 20 bp, Artificial Sequence
  chemically synthesized
tcatgatatgctacagaaaa

SEQ ID NO: 441080 - DNA, 20 bp, Artificial Sequence
  chemically synthesized
atttcaaatgctcttttctg

SEQ ID NO: 441081 - DNA, 20 bp, Artificial Sequence
  chemically synthesized
acagaaaagagcatttgaaa

SEQ ID NO: 441082 - DNA, 20 bp, Artificial Sequence
  chemically synthesized
gcatttgaaatagtaaatgt

SEQ ID NO: 441083 - DNA, 20 bp, Artificial Sequence
  chemically synthesized
ttgaaatagtaaatgtgagt

SEQ ID NO: 441084 - DNA, 20 bp, Artificial Sequence
  chemically synthesized
ggatgtgaaaagtattgata

SEQ ID NO: 441085 - DNA, 20 bp, Artificial Sequence
  chemically synthesized
ggataattgaaggatgtgaa

SEQ ID NO: 441086 - DNA, 20 bp, Artificial Sequence
  chemically synthesized
gagttgggacggataattga

SEQ ID NO: 441087 - DNA, 20 bp, Artificial Sequence
  chemically synthesized
tgagttgggacggataattg

SEQ ID NO: 441088 - DNA, 20 bp, Artificial Sequence
  chemically synthesized
aagaataaaatgagttggga

SEQ ID NO: 441089 - DNA, 20 bp, Artificial Sequence
  chemically synthesized
aataaagaataaaatgagtt

SEQ ID NO: 441090 - DNA, 20 bp, Artificial Sequence
  chemically synthesized
aaataaagaataaaatgagt

SEQ ID NO: 441091 - DNA, 20 bp, Artificial Sequence
  chemically synthesized
gataaaataaagaataaaat

SEQ ID NO: 441092 - DNA, 20 bp, Artificial Sequence
  chemically synthesized
gacacatcatggataaaata

SEQ ID NO: 441093 - DNA, 20 bp, Artificial Sequence
  chemically synthesized
aaagtttctctgacacatca

SEQ ID NO: 441094 - DNA, 20 bp, Artificial Sequence
  chemically synthesized
ttattttatccatgatgtgt

SEQ ID NO: 441095 - DNA, 20 bp, Artificial Sequence
  chemically synthesized
attttatccatgatgtgtca

SEQ ID NO: 441096 - DNA, 20 bp, Artificial Sequence
  chemically synthesized
ggaggcctaaaagttagaaa

SEQ ID NO: 441097 - DNA, 20 bp, Artificial Sequence
  chemically synthesized
gagaaactttttctaacttt

SEQ ID NO: 441098 - DNA, 20 bp, Artificial Sequence
  chemically synthesized
agaaactttttctaactttt

SEQ ID NO: 441099 - DNA, 20 bp, Artificial Sequence
  chemically synthesized
ctacatggaggcctaaaagt

SEQ ID NO: 441100 - DNA, 20 bp, Artificial Sequence
  chemically synthesized
ggaactacatggaggcctaa

SEQ ID NO: 441101 - DNA, 20 bp, Artificial Sequence
  chemically synthesized
ctaacttttaggcctccatg

SEQ ID NO: 441102 - DNA, 20 bp, Artificial Sequence
  chemically synthesized
actgtataggaactacatgg

SEQ ID NO: 441103 - DNA, 20 bp, Artificial Sequence
  chemically synthesized
tactgtataggaactacatg

SEQ ID NO: 441104 - DNA, 20 bp, Artificial Sequence
  chemically synthesized
actactgtataggaactaca

SEQ ID NO: 441105 - DNA, 20 bp, Artificial Sequence
  chemically synthesized
gcctccatgtagttcctata

SEQ ID NO: 441106 - DNA, 20 bp, Artificial Sequence
  chemically synthesized
tccatgtagttcctatacag

SEQ ID NO: 441107 - DNA, 20 bp, Artificial Sequence
  chemically synthesized
aattgaactaactactgtat

SEQ ID NO: 441108 - DNA, 20 bp, Artificial Sequence
  chemically synthesized
caattgaactaactactgta

SEQ ID NO: 441109 - DNA, 20 bp, Artificial Sequence
  chemically synthesized
tgtagttcctatacagtagt

SEQ ID NO: 441110 - DNA, 20 bp, Artificial Sequence
  chemically synthesized
atacagtagttagttcaatt

SEQ ID NO: 441111 - DNA, 20 bp, Artificial Sequence
  chemically synthesized
gttcaattgagaatatatgt

SEQ ID NO: 441112 - DNA, 20 bp, Artificial Sequence
  chemically synthesized
ttcaattgagaatatatgtc

SEQ ID NO: 441113 - DNA, 20 bp, Artificial Sequence
  chemically synthesized
attgagaatatatgtcaggt

SEQ ID NO: 441114 - DNA, 20 bp, Artificial Sequence
  chemically synthesized
atttagtaacagttacataa

SEQ ID NO: 441115 - DNA, 20 bp, Artificial Sequence
  chemically synthesized
tatttagtaacagttacata

SEQ ID NO: 441116 - DNA, 20 bp, Artificial Sequence
  chemically synthesized
gatacttccgtatttagtaa

SEQ ID NO: 441117 - DNA, 20 bp, Artificial Sequence
  chemically synthesized
tatgtaactgttactaaata

SEQ ID NO: 441118 - DNA, 20 bp, Artificial Sequence
  chemically synthesized
gtaactgttactaaatacgg

SEQ ID NO: 441119 - DNA, 20 bp, Artificial Sequence
  chemically synthesized
ttagttgatacttccgtatt

SEQ ID NO: 441120 - DNA, 20 bp, Artificial Sequence
  chemically synthesized
atctgagttattattttgat

SEQ ID NO: 441121 - DNA, 20 bp, Artificial Sequence
  chemically synthesized
aactaatcaaaataataact

SEQ ID NO: 441122 - DNA, 20 bp, Artificial Sequence
  chemically synthesized
gtgagatagtttgtatatct

SEQ ID NO: 441123 - DNA, 20 bp, Artificial Sequence
  chemically synthesized
cagatatacaaactatctca

SEQ ID NO: 441124 - DNA, 20 bp, Artificial Sequence
  chemically synthesized
ttattttgattgctgtgaga

SEQ ID NO: 441125 - DNA, 20 bp, Artificial Sequence
  chemically synthesized
agatttattttgattgctgt

SEQ ID NO: 441126 - DNA, 20 bp, Artificial Sequence
  chemically synthesized
caatcaaaataaatctgtta

SEQ ID NO: 441127 - DNA, 20 bp, Artificial Sequence
  chemically synthesized
agaatgtcatttgactataa

SEQ ID NO: 441128 - DNA, 20 bp, Artificial Sequence
  chemically synthesized
cactgcagtaatagaatatg

SEQ ID NO: 441129 - DNA, 20 bp, Artificial Sequence
  chemically synthesized
ttctgcatattctattactg

SEQ ID NO: 441130 - DNA, 20 bp, Artificial Sequence
  chemically synthesized
ttaacaaaccactgcagtaa

SEQ ID NO: 441131 - DNA, 20 bp, Artificial Sequence
  chemically synthesized
tgcatattctattactgcag

SEQ ID NO: 441132 - DNA, 20 bp, Artificial Sequence
  chemically synthesized
tcttgattaacaaaccactg

SEQ ID NO: 441133 - DNA, 20 bp, Artificial Sequence
  chemically synthesized
actgcagtggtttgttaatc

SEQ ID NO: 441134 - DNA, 20 bp, Artificial Sequence
  chemically synthesized
taatcaagaaatcatgtgtt

SEQ ID NO: 441135 - DNA, 20 bp, Artificial Sequence
  chemically synthesized
atgtgtttagttctatcgca

SEQ ID NO: 441136 - DNA, 20 bp, Artificial Sequence
  chemically synthesized
gtaaaagtttttctttgcga

SEQ ID NO: 441137 - DNA, 20 bp, Artificial Sequence
  chemically synthesized
tcaacagaaatggagtgtaa

SEQ ID NO: 441138 - DNA, 20 bp, Artificial Sequence
  chemically synthesized
aaaacttttcaacagaaatg

SEQ ID NO: 441139 - DNA, 20 bp, Artificial Sequence
  chemically synthesized
ggaaaacttttcaacagaaa

SEQ ID NO: 441140 - DNA, 20 bp, Artificial Sequence
  chemically synthesized
tacactccatttctgttgaa

SEQ ID NO: 441141 - DNA, 20 bp, Artificial Sequence
  chemically synthesized
tcattgggaaaacttttcaa

SEQ ID NO: 441142 - DNA, 20 bp, Artificial Sequence
  chemically synthesized
aggaatatatatttttcatt

SEQ ID NO: 441143 - DNA, 20 bp, Artificial Sequence
  chemically synthesized
caggaatatatatttttcat

SEQ ID NO: 441144 - DNA, 20 bp, Artificial Sequence
  chemically synthesized
atatatatatgtatttattc

SEQ ID NO: 441145 - DNA, 20 bp, Artificial Sequence
  chemically synthesized
catatatatatgtatttatt

SEQ ID NO: 441146 - DNA, 20 bp, Artificial Sequence
  chemically synthesized
aataaatacatatatatatg

SEQ ID NO: 441147 - DNA, 20 bp, Artificial Sequence
  chemically synthesized
tatcacagtagtttgcaaag

SEQ ID NO: 441148 - DNA, 20 bp, Artificial Sequence
  chemically synthesized
aattatcacagtagtttgca

SEQ ID NO: 441149 - DNA, 20 bp, Artificial Sequence
  chemically synthesized
ttgattttaaattatcacag

SEQ ID NO: 441150 - DNA, 20 bp, Artificial Sequence
  chemically synthesized
agattgattttaaattatca

SEQ ID NO: 441151 - DNA, 20 bp, Artificial Sequence
  chemically synthesized
ttaaaatcaatctacctaat

SEQ ID NO: 441152 - DNA, 20 bp, Artificial Sequence
  chemically synthesized
tgacaagctcactaattagg

SEQ ID NO: 441153 - DNA, 20 bp, Artificial Sequence
  chemically synthesized
aatcaatctacctaattagt

SEQ ID NO: 441154 - DNA, 20 bp, Artificial Sequence
  chemically synthesized
ttgtgacaagctcactaatt

SEQ ID NO: 441155 - DNA, 20 bp, Artificial Sequence
  chemically synthesized
tttgtgacaagctcactaat

SEQ ID NO: 441156 - DNA, 20 bp, Artificial Sequence
  chemically synthesized
cataacgtttagtttgtgac

SEQ ID NO: 441157 - DNA, 20 bp, Artificial Sequence
  chemically synthesized
ttttactgtggcataacgtt

SEQ ID NO: 441158 - DNA, 20 bp, Artificial Sequence
  chemically synthesized
acaaactaaacgttatgcca

SEQ ID NO: 441159 - DNA, 20 bp, Artificial Sequence
  chemically synthesized
actaaaaatatattttactg

SEQ ID NO: 441160 - DNA, 20 bp, Artificial Sequence
  chemically synthesized
gccacagtaaaatatatttt

SEQ ID NO: 441161 - DNA, 20 bp, Artificial Sequence
  chemically synthesized
agaggactgttgtaagtaca

SEQ ID NO: 441162 - DNA, 20 bp, Artificial Sequence
  chemically synthesized
tagttactttgtacttacaa

SEQ ID NO: 441163 - DNA, 20 bp, Artificial Sequence
  chemically synthesized
aagaagtagaggactgttgt

SEQ ID NO: 441164 - DNA, 20 bp, Artificial Sequence
  chemically synthesized
gctttggtgggaagaagtag

SEQ ID NO: 441165 - DNA, 20 bp, Artificial Sequence
  chemically synthesized
tgctttggtgggaagaagta

SEQ ID NO: 441166 - DNA, 20 bp, Artificial Sequence
  chemically synthesized
aatgctttggtgggaagaag

SEQ ID NO: 441167 - DNA, 20 bp, Artificial Sequence
  chemically synthesized
caaaatgctttggtgggaag

SEQ ID NO: 441168 - DNA, 20 bp, Artificial Sequence
  chemically synthesized
tcctctacttcttcccacca

SEQ ID NO: 441169 - DNA, 20 bp, Artificial Sequence
  chemically synthesized
tttcaaaatgctttggtggg

SEQ ID NO: 441170 - DNA, 20 bp, Artificial Sequence
  chemically synthesized
acttttcaaaatgctttggt

SEQ ID NO: 441171 - DNA, 20 bp, Artificial Sequence
  chemically synthesized
cacttttcaaaatgctttgg

SEQ ID NO: 441172 - DNA, 20 bp, Artificial Sequence
  chemically synthesized
atacacttttcaaaatgctt

SEQ ID NO: 441173 - DNA, 20 bp, Artificial Sequence
  chemically synthesized
tcccaccaaagcattttgaa

SEQ ID NO: 441174 - DNA, 20 bp, Artificial Sequence
  chemically synthesized
cattttgaaaagtgtatatc

SEQ ID NO: 441175 - DNA, 20 bp, Artificial Sequence
  chemically synthesized
attttgaaaagtgtatatca

SEQ ID NO: 441176 - DNA, 20 bp, Artificial Sequence
  chemically synthesized
ttgaaaagtgtatatcaagg

SEQ ID NO: 441177 - DNA, 20 bp, Artificial Sequence
  chemically synthesized
aggcagcgataaaaaaaacc

SEQ ID NO: 441178 - DNA, 20 bp, Artificial Sequence
  chemically synthesized
cgataaaaaaaacctggtaa

SEQ ID NO: 441179 - DNA, 20 bp, Artificial Sequence
  chemically synthesized
aagtttgaagaacttttacc

SEQ ID NO: 441180 - DNA, 20 bp, Artificial Sequence
  chemically synthesized
aaagtttgaagaacttttac

SEQ ID NO: 441181 - DNA, 20 bp, Artificial Sequence
  chemically synthesized
tactggagcaataaagtttg

SEQ ID NO: 441182 - DNA, 20 bp, Artificial Sequence
  chemically synthesized
ttaagcctactggagcaata

SEQ ID NO: 441183 - DNA, 20 bp, Artificial Sequence
  chemically synthesized
ttcttcaaactttattgctc

SEQ ID NO: 441184 - DNA, 20 bp, Artificial Sequence
  chemically synthesized
ttcaaactttattgctccag

SEQ ID NO: 441185 - DNA, 20 bp, Artificial Sequence
  chemically synthesized
tcaaactttattgctccagt

SEQ ID NO: 441186 - DNA, 20 bp, Artificial Sequence
  chemically synthesized
cattgtttttaagcctactg

SEQ ID NO: 441187 - DNA, 20 bp, Artificial Sequence
  chemically synthesized
ctcattgtttttaagcctac

SEQ ID NO: 441188 - DNA, 20 bp, Artificial Sequence
  chemically synthesized
gttggtttctcattgttttt

SEQ ID NO: 441189 - DNA, 20 bp, Artificial Sequence
  chemically synthesized
ccagtaggcttaaaaacaat

SEQ ID NO: 441190 - DNA, 20 bp, Artificial Sequence
  chemically synthesized
ttaaagctgctgaagtttgt

SEQ ID NO: 441191 - DNA, 20 bp, Artificial Sequence
  chemically synthesized
aatgagaaaccaacaaactt

SEQ ID NO: 441192 - DNA, 20 bp, Artificial Sequence
  chemically synthesized
gagaaaccaacaaacttcag

SEQ ID NO: 441193 - DNA, 20 bp, Artificial Sequence
  chemically synthesized
tactttttttaaagctgctg

SEQ ID NO: 441194 - DNA, 20 bp, Artificial Sequence
  chemically synthesized
aacttcagcagctttaaaaa

SEQ ID NO: 441195 - DNA, 20 bp, Artificial Sequence
  chemically synthesized
ctgaagtgttacttttttta

SEQ ID NO: 441196 - DNA, 20 bp, Artificial Sequence
  chemically synthesized
ctttaaaaaaagtaacactt

SEQ ID NO: 441197 - DNA, 20 bp, Artificial Sequence
  chemically synthesized
aaaacgaataggaaaaactg

SEQ ID NO: 441198 - DNA, 20 bp, Artificial Sequence
  chemically synthesized
accttcggagaaaaacgaat

SEQ ID NO: 441199 - DNA, 20 bp, Artificial Sequence
  chemically synthesized
taccttcggagaaaaacgaa

SEQ ID NO: 441200 - DNA, 20 bp, Artificial Sequence
  chemically synthesized
ttcctattcgtttttctccg

SEQ ID NO: 441201 - DNA, 20 bp, Artificial Sequence
  chemically synthesized
tcctattcgtttttctccga

SEQ ID NO: 441202 - DNA, 20 bp, Artificial Sequence
  chemically synthesized
ctgggaggcaattaccttcg

SEQ ID NO: 441203 - DNA, 20 bp, Artificial Sequence
  chemically synthesized
atctgggaggcaattacctt

SEQ ID NO: 441204 - DNA, 20 bp, Artificial Sequence
  chemically synthesized
ctccgaaggtaattgcctcc

SEQ ID NO: 441205 - DNA, 20 bp, Artificial Sequence
  chemically synthesized
ctacaggactcagatctggg

SEQ ID NO: 441206 - DNA, 20 bp, Artificial Sequence
  chemically synthesized
cctacaggactcagatctgg

SEQ ID NO: 441207 - DNA, 20 bp, Artificial Sequence
  chemically synthesized
ggtaattgcctcccagatct

SEQ ID NO: 441208 - DNA, 20 bp, Artificial Sequence
  chemically synthesized
cccctacaggactcagatct

SEQ ID NO: 441209 - DNA, 20 bp, Artificial Sequence
  chemically synthesized
ccccctacaggactcagatc

SEQ ID NO: 441210 - DNA, 20 bp, Artificial Sequence
  chemically synthesized
cctcccagatctgagtcctg

SEQ ID NO: 441211 - DNA, 20 bp, Artificial Sequence
  chemically synthesized
cactttccccctacaggact

SEQ ID NO: 441212 - DNA, 20 bp, Artificial Sequence
  chemically synthesized
ctcccagatctgagtcctgt

SEQ ID NO: 441213 - DNA, 20 bp, Artificial Sequence
  chemically synthesized
tcccagatctgagtcctgta

SEQ ID NO: 441214 - DNA, 20 bp, Artificial Sequence
  chemically synthesized
cccagatctgagtcctgtag

SEQ ID NO: 441215 - DNA, 20 bp, Artificial Sequence
  chemically synthesized
ccagatctgagtcctgtagg

SEQ ID NO: 441216 - DNA, 20 bp, Artificial Sequence
  chemically synthesized
atcactcactttccccctac

SEQ ID NO: 441217 - DNA, 20 bp, Artificial Sequence
  chemically synthesized
gatcactcactttcccccta

SEQ ID NO: 441218 - DNA, 20 bp, Artificial Sequence
  chemically synthesized
atctgagtcctgtaggggga

SEQ ID NO: 441219 - DNA, 20 bp, Artificial Sequence
  chemically synthesized
gagtcctgtagggggaaagt

SEQ ID NO: 441220 - DNA, 20 bp, Artificial Sequence
  chemically synthesized
aagtgagtgatcccaacact

SEQ ID NO: 441221 - DNA, 20 bp, Artificial Sequence
  chemically synthesized
gtgttgactcactcagtgtt

SEQ ID NO: 441222 - DNA, 20 bp, Artificial Sequence
  chemically synthesized
tgtgttgactcactcagtgt

SEQ ID NO: 441223 - DNA, 20 bp, Artificial Sequence
  chemically synthesized
gagtgatcccaacactgagt

SEQ ID NO: 441224 - DNA, 20 bp, Artificial Sequence
  chemically synthesized
agttactgtgttgactcact

SEQ ID NO: 441225 - DNA, 20 bp, Artificial Sequence
  chemically synthesized
caacactgagtgagtcaaca

SEQ ID NO: 441226 - DNA, 20 bp, Artificial Sequence
  chemically synthesized
gtcaacacagtaactgatgc

SEQ ID NO: 441227 - DNA, 20 bp, Artificial Sequence
  chemically synthesized
tcaacacagtaactgatgcc

SEQ ID NO: 441228 - DNA, 20 bp, Artificial Sequence
  chemically synthesized
cctctacagaatcctggcat

SEQ ID NO: 441229 - DNA, 20 bp, Artificial Sequence
  chemically synthesized
cgggggcctctacagaatcc

SEQ ID NO: 441230 - DNA, 20 bp, Artificial Sequence
  chemically synthesized
taactgatgccaggattctg

SEQ ID NO: 441231 - DNA, 20 bp, Artificial Sequence
  chemically synthesized
actgatgccaggattctgta

SEQ ID NO: 441232 - DNA, 20 bp, Artificial Sequence
  chemically synthesized
ctgatgccaggattctgtag

SEQ ID NO: 441233 - DNA, 20 bp, Artificial Sequence
  chemically synthesized
gaaatatccgggggcctcta

SEQ ID NO: 441234 - DNA, 20 bp, Artificial Sequence
  chemically synthesized
caggattctgtagaggcccc

SEQ ID NO: 441235 - DNA, 20 bp, Artificial Sequence
  chemically synthesized
ctggaatttgaaatatccgg

SEQ ID NO: 441236 - DNA, 20 bp, Artificial Sequence
  chemically synthesized
cctggaatttgaaatatccg

SEQ ID NO: 441237 - DNA, 20 bp, Artificial Sequence
  chemically synthesized
tcctggaatttgaaatatcc

SEQ ID NO: 441238 - DNA, 20 bp, Artificial Sequence
  chemically synthesized
gtcctggaatttgaaatatc

SEQ ID NO: 441239 - DNA, 20 bp, Artificial Sequence
  chemically synthesized
cccccggatatttcaaattc

SEQ ID NO: 441240 - DNA, 20 bp, Artificial Sequence
  chemically synthesized
ccccggatatttcaaattcc

SEQ ID NO: 441241 - DNA, 20 bp, Artificial Sequence
  chemically synthesized
acttgcttgtgcgcaggtcc

SEQ ID NO: 441242 - DNA, 20 bp, Artificial Sequence
  chemically synthesized
aaattccaggacctgcgcac

SEQ ID NO: 441243 - DNA, 20 bp, Artificial Sequence
  chemically synthesized
cgggtcacttgcttgtgcgc

SEQ ID NO: 441244 - DNA, 20 bp, Artificial Sequence
  chemically synthesized
gcgggtcacttgcttgtgcg

SEQ ID NO: 441245 - DNA, 20 bp, Artificial Sequence
  chemically synthesized
tccaggacctgcgcacaagc

SEQ ID NO: 441246 - DNA, 20 bp, Artificial Sequence
  chemically synthesized
accaacttgagagagaaggc

SEQ ID NO: 441247 - DNA, 20 bp, Artificial Sequence
  chemically synthesized
aaccaacttgagagagaagg

SEQ ID NO: 441248 - DNA, 20 bp, Artificial Sequence
  chemically synthesized
ggaaaccaacttgagagaga

SEQ ID NO: 441249 - DNA, 20 bp, Artificial Sequence
  chemically synthesized
agtgacccgccttctctctc

SEQ ID NO: 441250 - DNA, 20 bp, Artificial Sequence
  chemically synthesized
gggaaaccaacttgagagag

SEQ ID NO: 441251 - DNA, 20 bp, Artificial Sequence
  chemically synthesized
tatgggaaaccaacttgaga

SEQ ID NO: 441252 - DNA, 20 bp, Artificial Sequence
  chemically synthesized
acccgccttctctctcaagt

SEQ ID NO: 441253 - DNA, 20 bp, Artificial Sequence
  chemically synthesized
attatgggaaaccaacttga

SEQ ID NO: 441254 - DNA, 20 bp, Artificial Sequence
  chemically synthesized
ctattatgggaaaccaactt

SEQ ID NO: 441255 - DNA, 20 bp, Artificial Sequence
  chemically synthesized
ctcaagttggtttcccataa

SEQ ID NO: 441256 - DNA, 20 bp, Artificial Sequence
  chemically synthesized
tcaagttggtttcccataat

SEQ ID NO: 441257 - DNA, 20 bp, Artificial Sequence
  chemically synthesized
accatggacagtcctattat

SEQ ID NO: 441258 - DNA, 20 bp, Artificial Sequence
  chemically synthesized
gaccatggacagtcctatta

SEQ ID NO: 441259 - DNA, 20 bp, Artificial Sequence
  chemically synthesized
tcccataataggactgtcca

SEQ ID NO: 441260 - DNA, 20 bp, Artificial Sequence
  chemically synthesized
ttatatgtagtgaccatgga

SEQ ID NO: 441261 - DNA, 20 bp, Artificial Sequence
  chemically synthesized
aaccttatatgtagtgacca

SEQ ID NO: 441262 - DNA, 20 bp, Artificial Sequence
  chemically synthesized
tgtccatggtcactacatat

SEQ ID NO: 441263 - DNA, 20 bp, Artificial Sequence
  chemically synthesized
gtccatggtcactacatata

SEQ ID NO: 441264 - DNA, 20 bp, Artificial Sequence
  chemically synthesized
tggaagcacaaccttatatg

SEQ ID NO: 441265 - DNA, 20 bp, Artificial Sequence
  chemically synthesized
tacatataaggttgtgcttc

SEQ ID NO: 441266 - DNA, 20 bp, Artificial Sequence
  chemically synthesized
ataaggttgtgcttccagca

SEQ ID NO: 441267 - DNA, 20 bp, Artificial Sequence
  chemically synthesized
cacagagcttgccatgctgg

SEQ ID NO: 441268 - DNA, 20 bp, Artificial Sequence
  chemically synthesized
ggttgtgcttccagcatggc

SEQ ID NO: 441269 - DNA, 20 bp, Artificial Sequence
  chemically synthesized
attcacagagcttgccatgc

SEQ ID NO: 441270 - DNA, 20 bp, Artificial Sequence
  chemically synthesized
gagcattgtttgaattcaca

SEQ ID NO: 441271 - DNA, 20 bp, Artificial Sequence
  chemically synthesized
ttgagcattgtttgaattca

SEQ ID NO: 441272 - DNA, 20 bp, Artificial Sequence
  chemically synthesized
atattaatcagaacacagtt

SEQ ID NO: 441273 - DNA, 20 bp, Artificial Sequence
  chemically synthesized
tttggatattaatcagaaca

SEQ ID NO: 441274 - DNA, 20 bp, Artificial Sequence
  chemically synthesized
attctggtttggatattaat

SEQ ID NO: 441275 - DNA, 20 bp, Artificial Sequence
  chemically synthesized
gttctgattaatatccaaac

SEQ ID NO: 441276 - DNA, 20 bp, Artificial Sequence
  chemically synthesized
tccactgtgctattctggtt

SEQ ID NO: 441277 - DNA, 20 bp, Artificial Sequence
  chemically synthesized
gattaatatccaaaccagaa

SEQ ID NO: 441278 - DNA, 20 bp, Artificial Sequence
  chemically synthesized
ctatgtccactgtgctattc

SEQ ID NO: 441279 - DNA, 20 bp, Artificial Sequence
  chemically synthesized
atatccaaaccagaatagca

SEQ ID NO: 441280 - DNA, 20 bp, Artificial Sequence
  chemically synthesized
tccaaaccagaatagcacag

SEQ ID NO: 441281 - DNA, 20 bp, Artificial Sequence
  chemically synthesized
ccagaatagcacagtggaca

SEQ ID NO: 441282 - DNA, 20 bp, Artificial Sequence
  chemically synthesized
ggacatagtacttgctttta

SEQ ID NO: 441283 - DNA, 20 bp, Artificial Sequence
  chemically synthesized
gtttagaaggctttaaaagc

SEQ ID NO: 441284 - DNA, 20 bp, Artificial Sequence
  chemically synthesized
ttgtgtttagaaggctttaa

SEQ ID NO: 441285 - DNA, 20 bp, Artificial Sequence
  chemically synthesized
gaatagtttttgtgtttaga

SEQ ID NO: 441286 - DNA, 20 bp, Artificial Sequence
  chemically synthesized
tgaatagtttttgtgtttag

SEQ ID NO: 441287 - DNA, 20 bp, Artificial Sequence
  chemically synthesized
tactgaatagtttttgtgtt

SEQ ID NO: 441288 - DNA, 20 bp, Artificial Sequence
  chemically synthesized
ttctaaacacaaaaactatt

SEQ ID NO: 441289 - DNA, 20 bp, Artificial Sequence
  chemically synthesized
tgttatgcttttgtactgaa

SEQ ID NO: 441290 - DNA, 20 bp, Artificial Sequence
  chemically synthesized
acaaaaactattcagtacaa

SEQ ID NO: 441291 - DNA, 20 bp, Artificial Sequence
  chemically synthesized
attcacatgaaagttacaga

SEQ ID NO: 441292 - DNA, 20 bp, Artificial Sequence
  chemically synthesized
ataaattcacatgaaagtta

SEQ ID NO: 441293 - DNA, 20 bp, Artificial Sequence
  chemically synthesized
ctgttaataaattcacatga

SEQ ID NO: 441294 - DNA, 20 bp, Artificial Sequence
  chemically synthesized
ctttcatgtgaatttattaa

SEQ ID NO: 441295 - DNA, 20 bp, Artificial Sequence
  chemically synthesized
ttcatgtgaatttattaaca

SEQ ID NO: 441296 - DNA, 20 bp, Artificial Sequence
  chemically synthesized
atgtgaatttattaacagag

SEQ ID NO: 441297 - DNA, 20 bp, Artificial Sequence
  chemically synthesized
tattaacagagcagaaaatc

SEQ ID NO: 441298 - DNA, 20 bp, Artificial Sequence
  chemically synthesized
ttaaaagtcaattttgaatc

SEQ ID NO: 441299 - DNA, 20 bp, Artificial Sequence
  chemically synthesized
aggataaaaaaggcatttaa

SEQ ID NO: 441300 - DNA, 20 bp, Artificial Sequence
  chemically synthesized
tgttgttgagaggataaaaa

SEQ ID NO: 441301 - DNA, 20 bp, Artificial Sequence
  chemically synthesized
gtgttgttgagaggataaaa

SEQ ID NO: 441302 - DNA, 20 bp, Artificial Sequence
  chemically synthesized
aaatttttggtgttgttgag

SEQ ID NO: 441303 - DNA, 20 bp, Artificial Sequence
  chemically synthesized
gaaatttttggtgttgttga

SEQ ID NO: 441304 - DNA, 20 bp, Artificial Sequence
  chemically synthesized
gtgaaatttttggtgttgtt

SEQ ID NO: 441305 - DNA, 20 bp, Artificial Sequence
  chemically synthesized
atttggtagagtgaaatttt

SEQ ID NO: 441306 - DNA, 20 bp, Artificial Sequence
  chemically synthesized
gcattcctttttatttggta

SEQ ID NO: 441307 - DNA, 20 bp, Artificial Sequence
  chemically synthesized
gggcattcctttttatttgg

SEQ ID NO: 441308 - DNA, 20 bp, Artificial Sequence
  chemically synthesized
atttcactctaccaaataaa

SEQ ID NO: 441309 - DNA, 20 bp, Artificial Sequence
  chemically synthesized
tttcactctaccaaataaaa

SEQ ID NO: 441310 - DNA, 20 bp, Artificial Sequence
  chemically synthesized
tctgggcattcctttttatt

SEQ ID NO: 441311 - DNA, 20 bp, Artificial Sequence
  chemically synthesized
accaaataaaaaggaatgcc

SEQ ID NO: 441312 - DNA, 20 bp, Artificial Sequence
  chemically synthesized
acaaatgcatggattattct

SEQ ID NO: 441313 - DNA, 20 bp, Artificial Sequence
  chemically synthesized
aacaaatgcatggattattc

SEQ ID NO: 441314 - DNA, 20 bp, Artificial Sequence
  chemically synthesized
gtggatacataacaaatgca

SEQ ID NO: 441315 - DNA, 20 bp, Artificial Sequence
  chemically synthesized
aaaataactttggtagacag

SEQ ID NO: 441316 - DNA, 20 bp, Artificial Sequence
  chemically synthesized
tatgtatccactgtctacca

SEQ ID NO: 441317 - DNA, 20 bp, Artificial Sequence
  chemically synthesized
gaaaaaataactttggtaga

SEQ ID NO: 441318 - DNA, 20 bp, Artificial Sequence
  chemically synthesized
aggggaaaaaataactttgg

SEQ ID NO: 441319 - DNA, 20 bp, Artificial Sequence
  chemically synthesized
ccaaggggaaaaaataactt

SEQ ID NO: 441320 - DNA, 20 bp, Artificial Sequence
  chemically synthesized
ccaaagttattttttcccct

SEQ ID NO: 441321 - DNA, 20 bp, Artificial Sequence
  chemically synthesized
caaagttattttttcccctt

SEQ ID NO: 441322 - DNA, 20 bp, Artificial Sequence
  chemically synthesized
acttttgattgaatcccaag

SEQ ID NO: 441323 - DNA, 20 bp, Artificial Sequence
  chemically synthesized
aacttttgattgaatcccaa

SEQ ID NO: 441324 - DNA, 20 bp, Artificial Sequence
  chemically synthesized
taacttttgattgaatccca

SEQ ID NO: 441325 - DNA, 20 bp, Artificial Sequence
  chemically synthesized
ataacttttgattgaatccc

SEQ ID NO: 441326 - DNA, 20 bp, Artificial Sequence
  chemically synthesized
tccccttgggattcaatcaa

SEQ ID NO: 441327 - DNA, 20 bp, Artificial Sequence
  chemically synthesized
ttatgtattgatgatgccaa

SEQ ID NO: 441328 - DNA, 20 bp, Artificial Sequence
  chemically synthesized
gcttctcttattcagactgt

SEQ ID NO: 441329 - DNA, 20 bp, Artificial Sequence
  chemically synthesized
atgatgccaacagtctgaat

SEQ ID NO: 441330 - DNA, 20 bp, Artificial Sequence
  chemically synthesized
gatgccaacagtctgaataa

SEQ ID NO: 441331 - DNA, 20 bp, Artificial Sequence
  chemically synthesized
ctgctgctgcttctcttatt

SEQ ID NO: 441332 - DNA, 20 bp, Artificial Sequence
  chemically synthesized
gccaacagtctgaataagag

SEQ ID NO: 441333 - DNA, 20 bp, Artificial Sequence
  chemically synthesized
aacagtctgaataagagaag

SEQ ID NO: 441334 - DNA, 20 bp, Artificial Sequence
  chemically synthesized
agtctgaataagagaagcag

SEQ ID NO: 441335 - DNA, 20 bp, Artificial Sequence
  chemically synthesized
ctgaataagagaagcagcag

SEQ ID NO: 441336 - DNA, 20 bp, Artificial Sequence
  chemically synthesized
agagaagcagcagcagaatg

SEQ ID NO: 441337 - DNA, 20 bp, Artificial Sequence
  chemically synthesized
gaagcagcagcagaatgcag

SEQ ID NO: 441338 - DNA, 20 bp, Artificial Sequence
  chemically synthesized
aatgcagcagctgaattctg

SEQ ID NO: 441339 - DNA, 20 bp, Artificial Sequence
  chemically synthesized
cacattctgccttcagaatt

SEQ ID NO: 441340 - DNA, 20 bp, Artificial Sequence
  chemically synthesized
atgcagcagctgaattctga

SEQ ID NO: 441341 - DNA, 20 bp, Artificial Sequence
  chemically synthesized
cagcagctgaattctgaagg

SEQ ID NO: 441342 - DNA, 20 bp, Artificial Sequence
  chemically synthesized
acacacacacattctgcctt

SEQ ID NO: 441343 - DNA, 20 bp, Artificial Sequence
  chemically synthesized
aggcagaatgtgtgtgtgta

SEQ ID NO: 441344 - DNA, 20 bp, Artificial Sequence
  chemically synthesized
ggcagaatgtgtgtgtgtat

SEQ ID NO: 441345 - DNA, 20 bp, Artificial Sequence
  chemically synthesized
gtgtgtgtgtataggtctca

SEQ ID NO: 441346 - DNA, 20 bp, Artificial Sequence
  chemically synthesized
tgtgtgtgtataggtctcat

SEQ ID NO: 441347 - DNA, 20 bp, Artificial Sequence
  chemically synthesized
agcaggaaaacatgtcccat

SEQ ID NO: 441348 - DNA, 20 bp, Artificial Sequence
  chemically synthesized
agagtattctttattttagc

SEQ ID NO: 441349 - DNA, 20 bp, Artificial Sequence
  chemically synthesized
aagagtattctttattttag

SEQ ID NO: 441350 - DNA, 20 bp, Artificial Sequence
  chemically synthesized
catgttttcctgctaaaata

SEQ ID NO: 441351 - DNA, 20 bp, Artificial Sequence
  chemically synthesized
tataagagtattctttattt

SEQ ID NO: 441352 - DNA, 20 bp, Artificial Sequence
  chemically synthesized
atttctttcctgcattataa

SEQ ID NO: 441353 - DNA, 20 bp, Artificial Sequence
  chemically synthesized
taaagaatactcttataatg

SEQ ID NO: 441354 - DNA, 20 bp, Artificial Sequence
  chemically synthesized
aaagaatactcttataatgc

SEQ ID NO: 441355 - DNA, 20 bp, Artificial Sequence
  chemically synthesized
aaatttctttcctgcattat

SEQ ID NO: 441356 - DNA, 20 bp, Artificial Sequence
  chemically synthesized
aatactcttataatgcagga

SEQ ID NO: 441357 - DNA, 20 bp, Artificial Sequence
  chemically synthesized
acaactgaaatttaggattt

SEQ ID NO: 441358 - DNA, 20 bp, Artificial Sequence
  chemically synthesized
ttttctcaaatcctaaattt

SEQ ID NO: 441359 - DNA, 20 bp, Artificial Sequence
  chemically synthesized
ataattcacaactgaaattt

SEQ ID NO: 441360 - DNA, 20 bp, Artificial Sequence
  chemically synthesized
cataattcacaactgaaatt

SEQ ID NO: 441361 - DNA, 20 bp, Artificial Sequence
  chemically synthesized
atttgttagtaaagaagttt

SEQ ID NO: 441362 - DNA, 20 bp, Artificial Sequence
  chemically synthesized
agaataatttgttagtaaag

SEQ ID NO: 441363 - DNA, 20 bp, Artificial Sequence
  chemically synthesized
gaaagaataatttgttagta

SEQ ID NO: 441364 - DNA, 20 bp, Artificial Sequence
  chemically synthesized
tggaagaaagaataatttgt

SEQ ID NO: 441365 - DNA, 20 bp, Artificial Sequence
  chemically synthesized
ggcaccagagaaatggaaga

SEQ ID NO: 441366 - DNA, 20 bp, Artificial Sequence
  chemically synthesized
aattggcaccagagaaatgg

SEQ ID NO: 441367 - DNA, 20 bp, Artificial Sequence
  chemically synthesized
tattctttcttccatttctc

SEQ ID NO: 441368 - DNA, 20 bp, Artificial Sequence
  chemically synthesized
aagaattggcaccagagaaa

SEQ ID NO: 441369 - DNA, 20 bp, Artificial Sequence
  chemically synthesized
tgttttaagaattggcacca

SEQ ID NO: 441370 - DNA, 20 bp, Artificial Sequence
  chemically synthesized
ggtgttttaagaattggcac

SEQ ID NO: 441371 - DNA, 20 bp, Artificial Sequence
  chemically synthesized
aaaaatggtgttttaagaat

SEQ ID NO: 441372 - DNA, 20 bp, Artificial Sequence
  chemically synthesized
gtctaaaaaaatggtgtttt

SEQ ID NO: 441373 - DNA, 20 bp, Artificial Sequence
  chemically synthesized
ttcttaaaacaccatttttt

SEQ ID NO: 441374 - DNA, 20 bp, Artificial Sequence
  chemically synthesized
taactcaatgtctaaaaaaa

SEQ ID NO: 441375 - DNA, 20 bp, Artificial Sequence
  chemically synthesized
acaccatttttttagacatt

SEQ ID NO: 441376 - DNA, 20 bp, Artificial Sequence
  chemically synthesized
ttgagttaatgatcatttaa

SEQ ID NO: 441377 - DNA, 20 bp, Artificial Sequence
  chemically synthesized
gatcatttaatggttctgaa

SEQ ID NO: 441378 - DNA, 20 bp, Artificial Sequence
  chemically synthesized
tcatttaatggttctgaata

SEQ ID NO: 441379 - DNA, 20 bp, Artificial Sequence
  chemically synthesized
catttaatggttctgaatag

SEQ ID NO: 441380 - DNA, 20 bp, Artificial Sequence
  chemically synthesized
acagaaaacaagcctctatt

SEQ ID NO: 441381 - DNA, 20 bp, Artificial Sequence
  chemically synthesized
attcacttaatacagaaaac

SEQ ID NO: 441382 - DNA, 20 bp, Artificial Sequence
  chemically synthesized
agaggcttgttttctgtatt

SEQ ID NO: 441383 - DNA, 20 bp, Artificial Sequence
  chemically synthesized
acaactgtattcacttaata

SEQ ID NO: 441384 - DNA, 20 bp, Artificial Sequence
  chemically synthesized
ttttctgtattaagtgaata

SEQ ID NO: 441385 - DNA, 20 bp, Artificial Sequence
  chemically synthesized
tacagttgtattatgtcatt

SEQ ID NO: 441386 - DNA, 20 bp, Artificial Sequence
  chemically synthesized
tgtaaatcattctttgccaa

SEQ ID NO: 441387 - DNA, 20 bp, Artificial Sequence
  chemically synthesized
gaagaagctttctattggca

SEQ ID NO: 441388 - DNA, 20 bp, Artificial Sequence
  chemically synthesized
aatcattctttgccaataga

SEQ ID NO: 441389 - DNA, 20 bp, Artificial Sequence
  chemically synthesized
aagatgaagaagctttctat

SEQ ID NO: 441390 - DNA, 20 bp, Artificial Sequence
  chemically synthesized
taataaggaacaagatgaag

SEQ ID NO: 441391 - DNA, 20 bp, Artificial Sequence
  chemically synthesized
aagtaataaggaacaagatg

SEQ ID NO: 441392 - DNA, 20 bp, Artificial Sequence
  chemically synthesized
gcataaaagtaataaggaac

SEQ ID NO: 441393 - DNA, 20 bp, Artificial Sequence
  chemically synthesized
cctgttgcataaaagtaata

SEQ ID NO: 441394 - DNA, 20 bp, Artificial Sequence
  chemically synthesized
gcctgttgcataaaagtaat

SEQ ID NO: 441395 - DNA, 20 bp, Artificial Sequence
  chemically synthesized
tgggctcgcctgttgcataa

SEQ ID NO: 441396 - DNA, 20 bp, Artificial Sequence
  chemically synthesized
tccttattacttttatgcaa

SEQ ID NO: 441397 - DNA, 20 bp, Artificial Sequence
  chemically synthesized
ccttattacttttatgcaac

SEQ ID NO: 441398 - DNA, 20 bp, Artificial Sequence
  chemically synthesized
attacttttatgcaacaggc

SEQ ID NO: 441399 - DNA, 20 bp, Artificial Sequence
  chemically synthesized
caatgttttctatcaatttt

SEQ ID NO: 441400 - DNA, 20 bp, Artificial Sequence
  chemically synthesized
acaggcgagcccaaaattga

SEQ ID NO: 441401 - DNA, 20 bp, Artificial Sequence
  chemically synthesized
ccaatgttttctatcaattt

SEQ ID NO: 441402 - DNA, 20 bp, Artificial Sequence
  chemically synthesized
ccaaaattgatagaaaacat

SEQ ID NO: 441403 - DNA, 20 bp, Artificial Sequence
  chemically synthesized
aacattggaaacatttttta

SEQ ID NO: 441404 - DNA, 20 bp, Artificial Sequence
  chemically synthesized
ttggaaacattttttaaaga

SEQ ID NO: 441405 - DNA, 20 bp, Artificial Sequence
  chemically synthesized
aaagaaagatattcttttta

SEQ ID NO: 441406 - DNA, 20 bp, Artificial Sequence
  chemically synthesized
gggattattataactataaa

SEQ ID NO: 441407 - DNA, 20 bp, Artificial Sequence
  chemically synthesized
ctcaaacaaaaattttagta

SEQ ID NO: 441408 - DNA, 20 bp, Artificial Sequence
  chemically synthesized
actcaaacaaaaattttagt

SEQ ID NO: 441409 - DNA, 20 bp, Artificial Sequence
  chemically synthesized
cactcaaacaaaaattttag

SEQ ID NO: 441410 - DNA, 20 bp, Artificial Sequence
  chemically synthesized
aaacactcaaacaaaaattt

SEQ ID NO: 441411 - DNA, 20 bp, Artificial Sequence
  chemically synthesized
ccctactaaaatttttgttt

SEQ ID NO: 441412 - DNA, 20 bp, Artificial Sequence
  chemically synthesized
ttttattgtaccatttgtta

SEQ ID NO: 441413 - DNA, 20 bp, Artificial Sequence
  chemically synthesized
gagtctgtcactttaacaaa

SEQ ID NO: 441414 - DNA, 20 bp, Artificial Sequence
  chemically synthesized
tgtaccatttgttaaagtga

SEQ ID NO: 441415 - DNA, 20 bp, Artificial Sequence
  chemically synthesized
aatgtttgacatagaaaaat

SEQ ID NO: 441416 - DNA, 20 bp, Artificial Sequence
  chemically synthesized
aagcagttgaatgtttgaca

SEQ ID NO: 441417 - DNA, 20 bp, Artificial Sequence
  chemically synthesized
ttactcattgcagtcgcaag

SEQ ID NO: 441418 - DNA, 20 bp, Artificial Sequence
  chemically synthesized
ctattactcattgcagtcgc

SEQ ID NO: 441419 - DNA, 20 bp, Artificial Sequence
  chemically synthesized
caactgcttgcgactgcaat

SEQ ID NO: 441420 - DNA, 20 bp, Artificial Sequence
  chemically synthesized
tttttatctattactcattg

SEQ ID NO: 441421 - DNA, 20 bp, Artificial Sequence
  chemically synthesized
cttgcgactgcaatgagtaa

SEQ ID NO: 441422 - DNA, 20 bp, Artificial Sequence
  chemically synthesized
ataaaaattaaaaaaatatt

SEQ ID NO: 441423 - DNA, 20 bp, Artificial Sequence
  chemically synthesized
aaattaaaaaaatattgagt

SEQ ID NO: 441424 - DNA, 20 bp, Artificial Sequence
  chemically synthesized
aactattaaggtaaacatca

SEQ ID NO: 441425 - DNA, 20 bp, Artificial Sequence
  chemically synthesized
gactgtgatgtttaccttaa

SEQ ID NO: 441426 - DNA, 20 bp, Artificial Sequence
  chemically synthesized
aaatgtacaattaactatta

SEQ ID NO: 441427 - DNA, 20 bp, Artificial Sequence
  chemically synthesized
aaaatgtacaattaactatt

SEQ ID NO: 441428 - DNA, 20 bp, Artificial Sequence
  chemically synthesized
taattgtacattttgtgttt

SEQ ID NO: 441429 - DNA, 20 bp, Artificial Sequence
  chemically synthesized
cataacattgctattttccc

SEQ ID NO: 441430 - DNA, 20 bp, Artificial Sequence
  chemically synthesized
acaccttttgctggggaaaa

SEQ ID NO: 441431 - DNA, 20 bp, Artificial Sequence
  chemically synthesized
attgctattttccccagcaa

SEQ ID NO: 441432 - DNA, 20 bp, Artificial Sequence
  chemically synthesized
ttgctattttccccagcaaa

SEQ ID NO: 441433 - DNA, 20 bp, Artificial Sequence
  chemically synthesized
atctcatacaccttttgctg

SEQ ID NO: 441434 - DNA, 20 bp, Artificial Sequence
  chemically synthesized
tatctcatacaccttttgct

SEQ ID NO: 441435 - DNA, 20 bp, Artificial Sequence
  chemically synthesized
ttatctcatacaccttttgc

SEQ ID NO: 441436 - DNA, 20 bp, Artificial Sequence
  chemically synthesized
ttccccagcaaaaggtgtat

SEQ ID NO: 441437 - DNA, 20 bp, Artificial Sequence
  chemically synthesized
aggtgtatgagataaaacat

SEQ ID NO: 441438 - DNA, 20 bp, Artificial Sequence
  chemically synthesized
ggtgtatgagataaaacata

SEQ ID NO: 441439 - DNA, 20 bp, Artificial Sequence
  chemically synthesized
gaatgttttaaattaaaatt

SEQ ID NO: 441440 - DNA, 20 bp, Artificial Sequence
  chemically synthesized
agaatgttttaaattaaaat

SEQ ID NO: 441441 - DNA, 20 bp, Artificial Sequence
  chemically synthesized
atttaaaacattcttttccc

SEQ ID NO: 441442 - DNA, 20 bp, Artificial Sequence
  chemically synthesized
tttaaaacattcttttccct

SEQ ID NO: 441443 - DNA, 20 bp, Artificial Sequence
  chemically synthesized
aaaggaggtgacctagggaa

SEQ ID NO: 441444 - DNA, 20 bp, Artificial Sequence
  chemically synthesized
agaggaaaggaggtgaccta

SEQ ID NO: 441445 - DNA, 20 bp, Artificial Sequence
  chemically synthesized
gagaggaaaggaggtgacct

SEQ ID NO: 441446 - DNA, 20 bp, Artificial Sequence
  chemically synthesized
tgagaggaaaggaggtgacc

SEQ ID NO: 441447 - DNA, 20 bp, Artificial Sequence
  chemically synthesized
aaccacactgagaggaaagg

SEQ ID NO: 441448 - DNA, 20 bp, Artificial Sequence
  chemically synthesized
caaccacactgagaggaaag

SEQ ID NO: 441449 - DNA, 20 bp, Artificial Sequence
  chemically synthesized
taggtcacctcctttcctct

SEQ ID NO: 441450 - DNA, 20 bp, Artificial Sequence
  chemically synthesized
gacaaccacactgagaggaa

SEQ ID NO: 441451 - DNA, 20 bp, Artificial Sequence
  chemically synthesized
agacaaccacactgagagga

SEQ ID NO: 441452 - DNA, 20 bp, Artificial Sequence
  chemically synthesized
cacctcctttcctctcagtg

SEQ ID NO: 441453 - DNA, 20 bp, Artificial Sequence
  chemically synthesized
atttagacaaccacactgag

SEQ ID NO: 441454 - DNA, 20 bp, Artificial Sequence
  chemically synthesized
tatttagacaaccacactga

SEQ ID NO: 441455 - DNA, 20 bp, Artificial Sequence
  chemically synthesized
catatttagacaaccacact

SEQ ID NO: 441456 - DNA, 20 bp, Artificial Sequence
  chemically synthesized
attttgcttatatgcatatt

SEQ ID NO: 441457 - DNA, 20 bp, Artificial Sequence
  chemically synthesized
ggttgtctaaatatgcatat

SEQ ID NO: 441458 - DNA, 20 bp, Artificial Sequence
  chemically synthesized
aaaattttcataaaacaaca

SEQ ID NO: 441459 - DNA, 20 bp, Artificial Sequence
  chemically synthesized
aaaaaatgaaaaaattgttt

SEQ ID NO: 441460 - DNA, 20 bp, Artificial Sequence
  chemically synthesized
aaaaatgaaaaaattgtttt

SEQ ID NO: 441461 - DNA, 20 bp, Artificial Sequence
  chemically synthesized
aaaatgaaaaaattgttttg

SEQ ID NO: 441462 - DNA, 20 bp, Artificial Sequence
  chemically synthesized
aaattgttttggggctgatt

SEQ ID NO: 441463 - DNA, 20 bp, Artificial Sequence
  chemically synthesized
atgcagacttagagccaaat

SEQ ID NO: 441464 - DNA, 20 bp, Artificial Sequence
  chemically synthesized
tttggggctgatttggctct

SEQ ID NO: 441465 - DNA, 20 bp, Artificial Sequence
  chemically synthesized
gatgctaacatgcagactta

SEQ ID NO: 441466 - DNA, 20 bp, Artificial Sequence
  chemically synthesized
ctgatgctaacatgcagact

SEQ ID NO: 441467 - DNA, 20 bp, Artificial Sequence
  chemically synthesized
ttggctctaagtctgcatgt

SEQ ID NO: 441468 - DNA, 20 bp, Artificial Sequence
  chemically synthesized
gggacactgatgctaacatg

SEQ ID NO: 441469 - DNA, 20 bp, Artificial Sequence
  chemically synthesized
ctaagtctgcatgttagcat

SEQ ID NO: 441470 - DNA, 20 bp, Artificial Sequence
  chemically synthesized
attgtacctcacagcataga

SEQ ID NO: 441471 - DNA, 20 bp, Artificial Sequence
  chemically synthesized
tattgtacctcacagcatag

SEQ ID NO: 441472 - DNA, 20 bp, Artificial Sequence
  chemically synthesized
atattgtacctcacagcata

SEQ ID NO: 441473 - DNA, 20 bp, Artificial Sequence
  chemically synthesized
tcagtgtccctctatgctgt

SEQ ID NO: 441474 - DNA, 20 bp, Artificial Sequence
  chemically synthesized
cagtgtccctctatgctgtg

SEQ ID NO: 441475 - DNA, 20 bp, Artificial Sequence
  chemically synthesized
caatattgtacctcacagca

SEQ ID NO: 441476 - DNA, 20 bp, Artificial Sequence
  chemically synthesized
ctgggcaatattgtacctca

SEQ ID NO: 441477 - DNA, 20 bp, Artificial Sequence
  chemically synthesized
ctgtgaggtacaatattgcc

SEQ ID NO: 441478 - DNA, 20 bp, Artificial Sequence
  chemically synthesized
gtgaggtacaatattgccca

SEQ ID NO: 441479 - DNA, 20 bp, Artificial Sequence
  chemically synthesized
tacaatattgcccagagtat

SEQ ID NO: 441480 - DNA, 20 bp, Artificial Sequence
  chemically synthesized
acaaagggcacttatactct

SEQ ID NO: 441481 - DNA, 20 bp, Artificial Sequence
  chemically synthesized
tacaaagggcacttatactc

SEQ ID NO: 441482 - DNA, 20 bp, Artificial Sequence
  chemically synthesized
ctcacagtgcaagatacaaa

SEQ ID NO: 441483 - DNA, 20 bp, Artificial Sequence
  chemically synthesized
actcacagtgcaagatacaa

SEQ ID NO: 441484 - DNA, 20 bp, Artificial Sequence
  chemically synthesized
aactcacagtgcaagataca

SEQ ID NO: 441485 - DNA, 20 bp, Artificial Sequence
  chemically synthesized
ccctttgtatcttgcactgt

SEQ ID NO: 441486 - DNA, 20 bp, Artificial Sequence
  chemically synthesized
ttgtagaaaactcacagtgc

SEQ ID NO: 441487 - DNA, 20 bp, Artificial Sequence
  chemically synthesized
ttatgtttgtagaaaactca

SEQ ID NO: 441488 - DNA, 20 bp, Artificial Sequence
  chemically synthesized
taaacaagggtttatgtttg

SEQ ID NO: 441489 - DNA, 20 bp, Artificial Sequence
  chemically synthesized
tacaaacataaacccttgtt

SEQ ID NO: 441490 - DNA, 20 bp, Artificial Sequence
  chemically synthesized
acaaacataaacccttgttt

SEQ ID NO: 441491 - DNA, 20 bp, Artificial Sequence
  chemically synthesized
tcacgccttggcctaaacaa

SEQ ID NO: 441492 - DNA, 20 bp, Artificial Sequence
  chemically synthesized
ttcacgccttggcctaaaca

SEQ ID NO: 441493 - DNA, 20 bp, Artificial Sequence
  chemically synthesized
attcacgccttggcctaaac

SEQ ID NO: 441494 - DNA, 20 bp, Artificial Sequence
  chemically synthesized
cataaacccttgtttaggcc

SEQ ID NO: 441495 - DNA, 20 bp, Artificial Sequence
  chemically synthesized
ataaacccttgtttaggcca

SEQ ID NO: 441496 - DNA, 20 bp, Artificial Sequence
  chemically synthesized
gacaagttgtattcacgcct

SEQ ID NO: 441497 - DNA, 20 bp, Artificial Sequence
  chemically synthesized
aaggcgtgaatacaacttgt

SEQ ID NO: 441498 - DNA, 20 bp, Artificial Sequence
  chemically synthesized
gatgttggtttgggaccgac

SEQ ID NO: 441499 - DNA, 20 bp, Artificial Sequence
  chemically synthesized
cgtgatattgatgttggttt

SEQ ID NO: 441500 - DNA, 20 bp, Artificial Sequence
  chemically synthesized
acgtgatattgatgttggtt

SEQ ID NO: 441501 - DNA, 20 bp, Artificial Sequence
  chemically synthesized
ttcccacgtgatattgatgt

SEQ ID NO: 441502 - DNA, 20 bp, Artificial Sequence
  chemically synthesized
aaaccaacatcaatatcacg

SEQ ID NO: 441503 - DNA, 20 bp, Artificial Sequence
  chemically synthesized
aaccaacatcaatatcacgt

SEQ ID NO: 441504 - DNA, 20 bp, Artificial Sequence
  chemically synthesized
aatatcacgtgggaacttct

SEQ ID NO: 441505 - DNA, 20 bp, Artificial Sequence
  chemically synthesized
tgtcaacttgcatttctcag

SEQ ID NO: 441506 - DNA, 20 bp, Artificial Sequence
  chemically synthesized
tcgtgtcaacttgcatttct

SEQ ID NO: 441507 - DNA, 20 bp, Artificial Sequence
  chemically synthesized
tgggaacttctgagaaatgc

SEQ ID NO: 441508 - DNA, 20 bp, Artificial Sequence
  chemically synthesized
tgagaaatgcaagttgacac

SEQ ID NO: 441509 - DNA, 20 bp, Artificial Sequence
  chemically synthesized
aagttgacacgagacctcaa

SEQ ID NO: 441510 - DNA, 20 bp, Artificial Sequence
  chemically synthesized
tgacacgagacctcaaaagt

SEQ ID NO: 441511 - DNA, 20 bp, Artificial Sequence
  chemically synthesized
cccagaatttctgacttttg

SEQ ID NO: 441512 - DNA, 20 bp, Artificial Sequence
  chemically synthesized
ccccagaatttctgactttt

SEQ ID NO: 441513 - DNA, 20 bp, Artificial Sequence
  chemically synthesized
acctcaaaagtcagaaattc

SEQ ID NO: 441514 - DNA, 20 bp, Artificial Sequence
  chemically synthesized
cctcaaaagtcagaaattct

SEQ ID NO: 441515 - DNA, 20 bp, Artificial Sequence
  chemically synthesized
ctcaaaagtcagaaattctg

SEQ ID NO: 441516 - DNA, 20 bp, Artificial Sequence
  chemically synthesized
aaagtcagaaattctggggt

SEQ ID NO: 441517 - DNA, 20 bp, Artificial Sequence
  chemically synthesized
aagtcagaaattctggggtt

SEQ ID NO: 441518 - DNA, 20 bp, Artificial Sequence
  chemically synthesized
agagtgctgtgtcccaaccc

SEQ ID NO: 441519 - DNA, 20 bp, Artificial Sequence
  chemically synthesized
gaaattctggggttgggaca

SEQ ID NO: 441520 - DNA, 20 bp, Artificial Sequence
  chemically synthesized
agaatcaccggtaaaacaca

SEQ ID NO: 441521 - DNA, 20 bp, Artificial Sequence
  chemically synthesized
ttagaatcaccggtaaaaca

SEQ ID NO: 441522 - DNA, 20 bp, Artificial Sequence
  chemically synthesized
cacagcactctgtgttttac

SEQ ID NO: 441523 - DNA, 20 bp, Artificial Sequence
  chemically synthesized
tgaccatgcattagaatcac

SEQ ID NO: 441524 - DNA, 20 bp, Artificial Sequence
  chemically synthesized
ttaccggtgattctaatgca

SEQ ID NO: 441525 - DNA, 20 bp, Artificial Sequence
  chemically synthesized
tctcaaagttgaccatgcat

SEQ ID NO: 441526 - DNA, 20 bp, Artificial Sequence
  chemically synthesized
tctaatgcatggtcaacttt

SEQ ID NO: 441527 - DNA, 20 bp, Artificial Sequence
  chemically synthesized
atacactttagggtttctca

SEQ ID NO: 441528 - DNA, 20 bp, Artificial Sequence
  chemically synthesized
gtcaactttgagaaacccta

SEQ ID NO: 441529 - DNA, 20 bp, Artificial Sequence
  chemically synthesized
ttttagaaacatacacttta

SEQ ID NO: 441530 - DNA, 20 bp, Artificial Sequence
  chemically synthesized
tttttagaaacatacacttt

SEQ ID NO: 441531 - DNA, 20 bp, Artificial Sequence
  chemically synthesized
gtttttagaaacatacactt

SEQ ID NO: 441532 - DNA, 20 bp, Artificial Sequence
  chemically synthesized
tttagaaccacggttgtttt

SEQ ID NO: 441533 - DNA, 20 bp, Artificial Sequence
  chemically synthesized
tatgtttctaaaaacaaccg

SEQ ID NO: 441534 - DNA, 20 bp, Artificial Sequence
  chemically synthesized
ctttgttacatttagaacca

SEQ ID NO: 441535 - DNA, 20 bp, Artificial Sequence
  chemically synthesized
ggacacatctttgttacatt

SEQ ID NO: 441536 - DNA, 20 bp, Artificial Sequence
  chemically synthesized
ccgtggttctaaatgtaaca

SEQ ID NO: 441537 - DNA, 20 bp, Artificial Sequence
  chemically synthesized
aatgtaacaaagatgtgtcc

SEQ ID NO: 441538 - DNA, 20 bp, Artificial Sequence
  chemically synthesized
atgtaacaaagatgtgtcct

SEQ ID NO: 441539 - DNA, 20 bp, Artificial Sequence
  chemically synthesized
tggtgctttagacattaccc

SEQ ID NO: 441540 - DNA, 20 bp, Artificial Sequence
  chemically synthesized
ttggtgctttagacattacc

SEQ ID NO: 441541 - DNA, 20 bp, Artificial Sequence
  chemically synthesized
tgtgtcctgggtaatgtcta

SEQ ID NO: 441542 - DNA, 20 bp, Artificial Sequence
  chemically synthesized
tctatcaggatttggtgctt

SEQ ID NO: 441543 - DNA, 20 bp, Artificial Sequence
  chemically synthesized
cattcagatctatcaggatt

SEQ ID NO: 441544 - DNA, 20 bp, Artificial Sequence
  chemically synthesized
tctaaagcaccaaatcctga

SEQ ID NO: 441545 - DNA, 20 bp, Artificial Sequence
  chemically synthesized
tcagggcattcagatctatc

SEQ ID NO: 441546 - DNA, 20 bp, Artificial Sequence
  chemically synthesized
ctcagggcattcagatctat

SEQ ID NO: 441547 - DNA, 20 bp, Artificial Sequence
  chemically synthesized
taaatgtatctcagggcatt

SEQ ID NO: 441548 - DNA, 20 bp, Artificial Sequence
  chemically synthesized
ctgatagatctgaatgccct

SEQ ID NO: 441549 - DNA, 20 bp, Artificial Sequence
  chemically synthesized
tggcaattaaatgtatctca

SEQ ID NO: 441550 - DNA, 20 bp, Artificial Sequence
  chemically synthesized
atggcaattaaatgtatctc

SEQ ID NO: 441551 - DNA, 20 bp, Artificial Sequence
  chemically synthesized
aatggcaattaaatgtatct

SEQ ID NO: 441552 - DNA, 20 bp, Artificial Sequence
  chemically synthesized
agatacatttaattgccatt

SEQ ID NO: 441553 - DNA, 20 bp, Artificial Sequence
  chemically synthesized
gattatcaactaaggctgaa

SEQ ID NO: 441554 - DNA, 20 bp, Artificial Sequence
  chemically synthesized
atttaattgccattcagcct

SEQ ID NO: 441555 - DNA, 20 bp, Artificial Sequence
  chemically synthesized
taaattctgattatcaacta

SEQ ID NO: 441556 - DNA, 20 bp, Artificial Sequence
  chemically synthesized
ataaattctgattatcaact

SEQ ID NO: 441557 - DNA, 20 bp, Artificial Sequence
  chemically synthesized
attcagccttagttgataat

SEQ ID NO: 441558 - DNA, 20 bp, Artificial Sequence
  chemically synthesized
gttgataatcagaatttatt

SEQ ID NO: 441559 - DNA, 20 bp, Artificial Sequence
  chemically synthesized
cacaatgcagaaatcattat

SEQ ID NO: 441560 - DNA, 20 bp, Artificial Sequence
  chemically synthesized
acacaatgcagaaatcatta

SEQ ID NO: 441561 - DNA, 20 bp, Artificial Sequence
  chemically synthesized
ataatgatttctgcattgtg

SEQ ID NO: 441562 - DNA, 20 bp, Artificial Sequence
  chemically synthesized
tatatgcattccacacaatg

SEQ ID NO: 441563 - DNA, 20 bp, Artificial Sequence
  chemically synthesized
ggaatgcatatacttccctt

SEQ ID NO: 441564 - DNA, 20 bp, Artificial Sequence
  chemically synthesized
ggattataaaatcttaaggg

SEQ ID NO: 441565 - DNA, 20 bp, Artificial Sequence
  chemically synthesized
cctggattataaaatcttaa

SEQ ID NO: 441566 - DNA, 20 bp, Artificial Sequence
  chemically synthesized
acctggattataaaatctta

SEQ ID NO: 441567 - DNA, 20 bp, Artificial Sequence
  chemically synthesized
cacctggattataaaatctt

SEQ ID NO: 441568 - DNA, 20 bp, Artificial Sequence
  chemically synthesized
tcccttaagattttataatc

SEQ ID NO: 441569 - DNA, 20 bp, Artificial Sequence
  chemically synthesized
cccttaagattttataatcc

SEQ ID NO: 441570 - DNA, 20 bp, Artificial Sequence
  chemically synthesized
tgtaagcatatatttgcacc

SEQ ID NO: 441571 - DNA, 20 bp, Artificial Sequence
  chemically synthesized
ttcacttttccagttattgt

SEQ ID NO: 441572 - DNA, 20 bp, Artificial Sequence
  chemically synthesized
aaatatatgcttacaataac

SEQ ID NO: 441573 - DNA, 20 bp, Artificial Sequence
  chemically synthesized
tatgcttacaataactggaa

SEQ ID NO: 441574 - DNA, 20 bp, Artificial Sequence
  chemically synthesized
ttacgtgcctttcacttttc

SEQ ID NO: 441575 - DNA, 20 bp, Artificial Sequence
  chemically synthesized
tacaataactggaaaagtga

SEQ ID NO: 441576 - DNA, 20 bp, Artificial Sequence
  chemically synthesized
acaataactggaaaagtgaa

SEQ ID NO: 441577 - DNA, 20 bp, Artificial Sequence
  chemically synthesized
aaggcacgtaaaataaaatt

SEQ ID NO: 441578 - DNA, 20 bp, Artificial Sequence
  chemically synthesized
gaactggagttcaatttgtt

SEQ ID NO: 441579 - DNA, 20 bp, Artificial Sequence
  chemically synthesized
agaccgaacaaattgaactc

SEQ ID NO: 441580 - DNA, 20 bp, Artificial Sequence
  chemically synthesized
gaacaaattgaactccagtt

SEQ ID NO: 441581 - DNA, 20 bp, Artificial Sequence
  chemically synthesized
tggtgacacagtctgaactg

SEQ ID NO: 441582 - DNA, 20 bp, Artificial Sequence
  chemically synthesized
tgtggtgacacagtctgaac

SEQ ID NO: 441583 - DNA, 20 bp, Artificial Sequence
  chemically synthesized
aagaaagtactgtggtgaca

SEQ ID NO: 441584 - DNA, 20 bp, Artificial Sequence
  chemically synthesized
cagttcagactgtgtcacca

SEQ ID NO: 441585 - DNA, 20 bp, Artificial Sequence
  chemically synthesized
agggacacaagaaagtactg

SEQ ID NO: 441586 - DNA, 20 bp, Artificial Sequence
  chemically synthesized
agtgattaagggacacaaga

SEQ ID NO: 441587 - DNA, 20 bp, Artificial Sequence
  chemically synthesized
gataagtgattaagggacac

SEQ ID NO: 441588 - DNA, 20 bp, Artificial Sequence
  chemically synthesized
ggagaaagataagtgattaa

SEQ ID NO: 441589 - DNA, 20 bp, Artificial Sequence
  chemically synthesized
aggagaaagataagtgatta

SEQ ID NO: 441590 - DNA, 20 bp, Artificial Sequence
  chemically synthesized
aaggagaaagataagtgatt

SEQ ID NO: 441591 - DNA, 20 bp, Artificial Sequence
  chemically synthesized
gaggactaaaggagaaagat

SEQ ID NO: 441592 - DNA, 20 bp, Artificial Sequence
  chemically synthesized
aatcacttatctttctcctt

SEQ ID NO: 441593 - DNA, 20 bp, Artificial Sequence
  chemically synthesized
attctgaggactaaaggaga

SEQ ID NO: 441594 - DNA, 20 bp, Artificial Sequence
  chemically synthesized
agttattctgaggactaaag

SEQ ID NO: 441595 - DNA, 20 bp, Artificial Sequence
  chemically synthesized
gtagttattctgaggactaa

SEQ ID NO: 441596 - DNA, 20 bp, Artificial Sequence
  chemically synthesized
tatctttctcctttagtcct

SEQ ID NO: 441597 - DNA, 20 bp, Artificial Sequence
  chemically synthesized
tgtagttattctgaggacta

SEQ ID NO: 441598 - DNA, 20 bp, Artificial Sequence
  chemically synthesized
tacaagatgtagttattctg

SEQ ID NO: 441599 - DNA, 20 bp, Artificial Sequence
  chemically synthesized
ctacaagatgtagttattct

SEQ ID NO: 441600 - DNA, 20 bp, Artificial Sequence
  chemically synthesized
ctcagaataactacatcttg

SEQ ID NO: 441601 - DNA, 20 bp, Artificial Sequence
  chemically synthesized
ctaataagacctacaagatg

SEQ ID NO: 441602 - DNA, 20 bp, Artificial Sequence
  chemically synthesized
tcagaataactacatcttgt

SEQ ID NO: 441603 - DNA, 20 bp, Artificial Sequence
  chemically synthesized
atggggctaataagacctac

SEQ ID NO: 441604 - DNA, 20 bp, Artificial Sequence
  chemically synthesized
ctacatcttgtaggtcttat

SEQ ID NO: 441605 - DNA, 20 bp, Artificial Sequence
  chemically synthesized
tcctttattatggggctaat

SEQ ID NO: 441606 - DNA, 20 bp, Artificial Sequence
  chemically synthesized
gtcttattagccccataata

SEQ ID NO: 441607 - DNA, 20 bp, Artificial Sequence
  chemically synthesized
gagcaagttcctttattatg

SEQ ID NO: 441608 - DNA, 20 bp, Artificial Sequence
  chemically synthesized
tcttattagccccataataa

SEQ ID NO: 441609 - DNA, 20 bp, Artificial Sequence
  chemically synthesized
tgagcaagttcctttattat

SEQ ID NO: 441610 - DNA, 20 bp, Artificial Sequence
  chemically synthesized
ttgagcaagttcctttatta

SEQ ID NO: 441611 - DNA, 20 bp, Artificial Sequence
  chemically synthesized
ttaaaaatggaaatttgagc

SEQ ID NO: 441612 - DNA, 20 bp, Artificial Sequence
  chemically synthesized
gttattaaaaatggaaattt

SEQ ID NO: 441613 - DNA, 20 bp, Artificial Sequence
  chemically synthesized
tctgtgacagttattaaaaa

SEQ ID NO: 441614 - DNA, 20 bp, Artificial Sequence
  chemically synthesized
tccatttttaataactgtca

SEQ ID NO: 441615 - DNA, 20 bp, Artificial Sequence
  chemically synthesized
aatttttaaaaattctgtga

SEQ ID NO: 441616 - DNA, 20 bp, Artificial Sequence
  chemically synthesized
tataagtatttgaaaataac

SEQ ID NO: 441617 - DNA, 20 bp, Artificial Sequence
  chemically synthesized
ttgttattttcaaatactta

SEQ ID NO: 441618 - DNA, 20 bp, Artificial Sequence
  chemically synthesized
gcaaattcctgtgaatctat

SEQ ID NO: 441619 - DNA, 20 bp, Artificial Sequence
  chemically synthesized
ttcaaatacttatagattca

SEQ ID NO: 441620 - DNA, 20 bp, Artificial Sequence
  chemically synthesized
tcaaatacttatagattcac

SEQ ID NO: 441621 - DNA, 20 bp, Artificial Sequence
  chemically synthesized
tatagattcacaggaatttg

SEQ ID NO: 441622 - DNA, 20 bp, Artificial Sequence
  chemically synthesized
atagattcacaggaatttgc

SEQ ID NO: 441623 - DNA, 20 bp, Artificial Sequence
  chemically synthesized
tagattcacaggaatttgcg

SEQ ID NO: 441624 - DNA, 20 bp, Artificial Sequence
  chemically synthesized
ttcacaggaatttgcgggga

SEQ ID NO: 441625 - DNA, 20 bp, Artificial Sequence
  chemically synthesized
gaatttgcggggatagtata

SEQ ID NO: 441626 - DNA, 20 bp, Artificial Sequence
  chemically synthesized
atttgcggggatagtataca

SEQ ID NO: 441627 - DNA, 20 bp, Artificial Sequence
  chemically synthesized
aaactgggtgaagggtacat

SEQ ID NO: 441628 - DNA, 20 bp, Artificial Sequence
  chemically synthesized
gaaactgggtgaagggtaca

SEQ ID NO: 441629 - DNA, 20 bp, Artificial Sequence
  chemically synthesized
gatcccatgtacccttcacc

SEQ ID NO: 441630 - DNA, 20 bp, Artificial Sequence
  chemically synthesized
tttgggagaaactgggtgaa

SEQ ID NO: 441631 - DNA, 20 bp, Artificial Sequence
  chemically synthesized
ctttgggagaaactgggtga

SEQ ID NO: 441632 - DNA, 20 bp, Artificial Sequence
  chemically synthesized
tctttgggagaaactgggtg

SEQ ID NO: 441633 - DNA, 20 bp, Artificial Sequence
  chemically synthesized
gttaatctttgggagaaact

SEQ ID NO: 441634 - DNA, 20 bp, Artificial Sequence
  chemically synthesized
agttaatctttgggagaaac

SEQ ID NO: 441635 - DNA, 20 bp, Artificial Sequence
  chemically synthesized
ccttcacccagtttctccca

SEQ ID NO: 441636 - DNA, 20 bp, Artificial Sequence
  chemically synthesized
ttattgtagttaatctttgg

SEQ ID NO: 441637 - DNA, 20 bp, Artificial Sequence
  chemically synthesized
agttattgtagttaatcttt

SEQ ID NO: 441638 - DNA, 20 bp, Artificial Sequence
  chemically synthesized
tagttattgtagttaatctt

SEQ ID NO: 441639 - DNA, 20 bp, Artificial Sequence
  chemically synthesized
atactgaattgtagttattg

SEQ ID NO: 441640 - DNA, 20 bp, Artificial Sequence
  chemically synthesized
taactacaataactacaatt

SEQ ID NO: 441641 - DNA, 20 bp, Artificial Sequence
  chemically synthesized
tattgtaggatactgaattg

SEQ ID NO: 441642 - DNA, 20 bp, Artificial Sequence
  chemically synthesized
tactgaattgtagttattgt

SEQ ID NO: 441643 - DNA, 20 bp, Artificial Sequence
  chemically synthesized
atactgaattgtagttattg

SEQ ID NO: 441644 - DNA, 20 bp, Artificial Sequence
  chemically synthesized
atcctacaataactacaatt

SEQ ID NO: 441645 - DNA, 20 bp, Artificial Sequence
  chemically synthesized
ctggttttgatactgaattg

SEQ ID NO: 441646 - DNA, 20 bp, Artificial Sequence
  chemically synthesized
ctacaattcagtatcaaaac

SEQ ID NO: 441647 - DNA, 20 bp, Artificial Sequence
  chemically synthesized
tacaattcagtatcaaaacc

SEQ ID NO: 441648 - DNA, 20 bp, Artificial Sequence
  chemically synthesized
acatatcaatgtcagtttcc

SEQ ID NO: 441649 - DNA, 20 bp, Artificial Sequence
  chemically synthesized
atatgtatacatatcaatgt

SEQ ID NO: 441650 - DNA, 20 bp, Artificial Sequence
  chemically synthesized
tacacaaatcagtgatgaaa

SEQ ID NO: 441651 - DNA, 20 bp, Artificial Sequence
  chemically synthesized
gaggttgaggttacacaaat

SEQ ID NO: 441652 - DNA, 20 bp, Artificial Sequence
  chemically synthesized
gtgtttatttgtggaggttg

SEQ ID NO: 441653 - DNA, 20 bp, Artificial Sequence
  chemically synthesized
ggtgtttatttgtggaggtt

SEQ ID NO: 441654 - DNA, 20 bp, Artificial Sequence
  chemically synthesized
aaacaggtgtttatttgtgg

SEQ ID NO: 441655 - DNA, 20 bp, Artificial Sequence
  chemically synthesized
gaaacaggtgtttatttgtg

SEQ ID NO: 441656 - DNA, 20 bp, Artificial Sequence
  chemically synthesized
atgaaacaggtgtttatttg

SEQ ID NO: 441657 - DNA, 20 bp, Artificial Sequence
  chemically synthesized
aatctctgtggtgatgaaac

SEQ ID NO: 441658 - DNA, 20 bp, Artificial Sequence
  chemically synthesized
aaatctctgtggtgatgaaa

SEQ ID NO: 441659 - DNA, 20 bp, Artificial Sequence
  chemically synthesized
aaacacctgtttcatcacca

SEQ ID NO: 441660 - DNA, 20 bp, Artificial Sequence
  chemically synthesized
acacctgtttcatcaccaca

SEQ ID NO: 441661 - DNA, 20 bp, Artificial Sequence
  chemically synthesized
tagcatgaggcaaatctctg

SEQ ID NO: 441662 - DNA, 20 bp, Artificial Sequence
  chemically synthesized
gactgtaaaggggtagcatg

SEQ ID NO: 441663 - DNA, 20 bp, Artificial Sequence
  chemically synthesized
tgactgtaaaggggtagcat

SEQ ID NO: 441664 - DNA, 20 bp, Artificial Sequence
  chemically synthesized
ctgttgtgactgtaaagggg

SEQ ID NO: 441665 - DNA, 20 bp, Artificial Sequence
  chemically synthesized
tgcctcatgctaccccttta

SEQ ID NO: 441666 - DNA, 20 bp, Artificial Sequence
  chemically synthesized
tgactgttgtgactgtaaag

SEQ ID NO: 441667 - DNA, 20 bp, Artificial Sequence
  chemically synthesized
gtgactgttgtgactgtaaa

SEQ ID NO: 441668 - DNA, 20 bp, Artificial Sequence
  chemically synthesized
ggtgactgttgtgactgtaa

SEQ ID NO: 441669 - DNA, 20 bp, Artificial Sequence
  chemically synthesized
gggtgactgttgtgactgta

SEQ ID NO: 441670 - DNA, 20 bp, Artificial Sequence
  chemically synthesized
ctacccctttacagtcacaa

SEQ ID NO: 441671 - DNA, 20 bp, Artificial Sequence
  chemically synthesized
gctttagggatatttaggga

SEQ ID NO: 441672 - DNA, 20 bp, Artificial Sequence
  chemically synthesized
ggctttagggatatttaggg

SEQ ID NO: 441673 - DNA, 20 bp, Artificial Sequence
  chemically synthesized
aggctttagggatatttagg

SEQ ID NO: 441674 - DNA, 20 bp, Artificial Sequence
  chemically synthesized
ccaggctttagggatattta

SEQ ID NO: 441675 - DNA, 20 bp, Artificial Sequence
  chemically synthesized
accaggctttagggatattt

SEQ ID NO: 441676 - DNA, 20 bp, Artificial Sequence
  chemically synthesized
taccaggctttagggatatt

SEQ ID NO: 441677 - DNA, 20 bp, Artificial Sequence
  chemically synthesized
accctccctaaatatcccta

SEQ ID NO: 441678 - DNA, 20 bp, Artificial Sequence
  chemically synthesized
ccctaaatatccctaaagcc

SEQ ID NO: 441679 - DNA, 20 bp, Artificial Sequence
  chemically synthesized
ttgattggtaccaggcttta

SEQ ID NO: 441680 - DNA, 20 bp, Artificial Sequence
  chemically synthesized
attgattggtaccaggcttt

SEQ ID NO: 441681 - DNA, 20 bp, Artificial Sequence
  chemically synthesized
aattgattggtaccaggctt

SEQ ID NO: 441682 - DNA, 20 bp, Artificial Sequence
  chemically synthesized
agaacaaattgattggtacc

SEQ ID NO: 441683 - DNA, 20 bp, Artificial Sequence
  chemically synthesized
gagaacaaattgattggtac

SEQ ID NO: 441684 - DNA, 20 bp, Artificial Sequence
  chemically synthesized
gtgatggagaacaaattgat

SEQ ID NO: 441685 - DNA, 20 bp, Artificial Sequence
  chemically synthesized
atgacaaaattacagtgatg

SEQ ID NO: 441686 - DNA, 20 bp, Artificial Sequence
  chemically synthesized
aaatgacaaaattacagtga

SEQ ID NO: 441687 - DNA, 20 bp, Artificial Sequence
  chemically synthesized
ttcttaaaatgacaaaatta

SEQ ID NO: 441688 - DNA, 20 bp, Artificial Sequence
  chemically synthesized
cactgtaattttgtcatttt

SEQ ID NO: 441689 - DNA, 20 bp, Artificial Sequence
  chemically synthesized
ttttgtcattttaagaatat

SEQ ID NO: 441690 - DNA, 20 bp, Artificial Sequence
  chemically synthesized
attagataaatgcaatgatt

SEQ ID NO: 441691 - DNA, 20 bp, Artificial Sequence
  chemically synthesized
gattcggtatgtaacctttt

SEQ ID NO: 441692 - DNA, 20 bp, Artificial Sequence
  chemically synthesized
aaaaaaaagccaatctcaaa

SEQ ID NO: 441693 - DNA, 20 bp, Artificial Sequence
  chemically synthesized
ggtatgtaaccttttgagat

SEQ ID NO: 441694 - DNA, 20 bp, Artificial Sequence
  chemically synthesized
aaaaaaaaagccaatctcaa

SEQ ID NO: 441695 - DNA, 20 bp, Artificial Sequence
  chemically synthesized
gaatgccaaaaaaaaaaaaa

SEQ ID NO: 441696 - DNA, 20 bp, Artificial Sequence
  chemically synthesized
attggctttttttttttttt

SEQ ID NO: 441697 - DNA, 20 bp, Artificial Sequence
  chemically synthesized
ttttttggcattctgtactt

SEQ ID NO: 441698 - DNA, 20 bp, Artificial Sequence
  chemically synthesized
acttaaatggatctcaagta

SEQ ID NO: 441699 - DNA, 20 bp, Artificial Sequence
  chemically synthesized
tgacaacttaaatggatctc

SEQ ID NO: 441700 - DNA, 20 bp, Artificial Sequence
  chemically synthesized
tctgtacttgagatccattt

SEQ ID NO: 441701 - DNA, 20 bp, Artificial Sequence
  chemically synthesized
gctattgatgacaacttaaa

SEQ ID NO: 441702 - DNA, 20 bp, Artificial Sequence
  chemically synthesized
tccatttaagttgtcatcaa

SEQ ID NO: 441703 - DNA, 20 bp, Artificial Sequence
  chemically synthesized
actcagcaataaaaggaaat

SEQ ID NO: 441704 - DNA, 20 bp, Artificial Sequence
  chemically synthesized
aactactactcagcaataaa

SEQ ID NO: 441705 - DNA, 20 bp, Artificial Sequence
  chemically synthesized
gaactactactcagcaataa

SEQ ID NO: 441706 - DNA, 20 bp, Artificial Sequence
  chemically synthesized
gcttatttccttttattgct

SEQ ID NO: 441707 - DNA, 20 bp, Artificial Sequence
  chemically synthesized
tatttccttttattgctgag

SEQ ID NO: 441708 - DNA, 20 bp, Artificial Sequence
  chemically synthesized
ttccttttattgctgagtag

SEQ ID NO: 441709 - DNA, 20 bp, Artificial Sequence
  chemically synthesized
ccatgccatgaactactact

SEQ ID NO: 441710 - DNA, 20 bp, Artificial Sequence
  chemically synthesized
tattgctgagtagtagttca

SEQ ID NO: 441711 - DNA, 20 bp, Artificial Sequence
  chemically synthesized
ctgagtagtagttcatggca

SEQ ID NO: 441712 - DNA, 20 bp, Artificial Sequence
  chemically synthesized
ttcatggcatggatgttcta

SEQ ID NO: 441713 - DNA, 20 bp, Artificial Sequence
  chemically synthesized
gtatgtgaataaagtaacta

SEQ ID NO: 441714 - DNA, 20 bp, Artificial Sequence
  chemically synthesized
tatcccacagtatgtgaata

SEQ ID NO: 441715 - DNA, 20 bp, Artificial Sequence
  chemically synthesized
gttactttattcacatactg

SEQ ID NO: 441716 - DNA, 20 bp, Artificial Sequence
  chemically synthesized
ttactttattcacatactgt

SEQ ID NO: 441717 - DNA, 20 bp, Artificial Sequence
  chemically synthesized
gaaacaacgaaaatatccca

SEQ ID NO: 441718 - DNA, 20 bp, Artificial Sequence
  chemically synthesized
tgggatattttcgttgtttc

SEQ ID NO: 441719 - DNA, 20 bp, Artificial Sequence
  chemically synthesized
gggatattttcgttgtttcc

SEQ ID NO: 441720 - DNA, 20 bp, Artificial Sequence
  chemically synthesized
ggatattttcgttgtttcca

SEQ ID NO: 441721 - DNA, 20 bp, Artificial Sequence
  chemically synthesized
ttttcgttgtttccagggtt

SEQ ID NO: 441722 - DNA, 20 bp, Artificial Sequence
  chemically synthesized
tatttgtagtgaccaaaccc

SEQ ID NO: 441723 - DNA, 20 bp, Artificial Sequence
  chemically synthesized
gggtttggtcactacaaata

SEQ ID NO: 441724 - DNA, 20 bp, Artificial Sequence
  chemically synthesized
ttgttttgcagctttatttg

SEQ ID NO: 441725 - DNA, 20 bp, Artificial Sequence
  chemically synthesized
aaaactacatgattgttttg

SEQ ID NO: 441726 - DNA, 20 bp, Artificial Sequence
  chemically synthesized
aaagctgcaaaacaatcatg

SEQ ID NO: 441727 - DNA, 20 bp, Artificial Sequence
  chemically synthesized
tttttcatttttcattcctc

SEQ ID NO: 441728 - DNA, 20 bp, Artificial Sequence
  chemically synthesized
actctgggacatgaatctag

SEQ ID NO: 441729 - DNA, 20 bp, Artificial Sequence
  chemically synthesized
cactctgggacatgaatcta

SEQ ID NO: 441730 - DNA, 20 bp, Artificial Sequence
  chemically synthesized
cacactctgggacatgaatc

SEQ ID NO: 441731 - DNA, 20 bp, Artificial Sequence
  chemically synthesized
attcctctagattcatgtcc

SEQ ID NO: 441732 - DNA, 20 bp, Artificial Sequence
  chemically synthesized
tcctctagattcatgtccca

SEQ ID NO: 441733 - DNA, 20 bp, Artificial Sequence
  chemically synthesized
tagattcatgtcccagagtg

SEQ ID NO: 441734 - DNA, 20 bp, Artificial Sequence
  chemically synthesized
gtaaattataaccacactct

SEQ ID NO: 441735 - DNA, 20 bp, Artificial Sequence
  chemically synthesized
ggtaaattataaccacactc

SEQ ID NO: 441736 - DNA, 20 bp, Artificial Sequence
  chemically synthesized
aacttattctaaaatttata

SEQ ID NO: 441737 - DNA, 20 bp, Artificial Sequence
  chemically synthesized
ataatttaccatataaattt

SEQ ID NO: 441738 - DNA, 20 bp, Artificial Sequence
  chemically synthesized
taccatataaattttagaat

SEQ ID NO: 441739 - DNA, 20 bp, Artificial Sequence
  chemically synthesized
agaataagtttatctacaaa

SEQ ID NO: 441740 - DNA, 20 bp, Artificial Sequence
  chemically synthesized
tagatctgtagatctatttg

SEQ ID NO: 441741 - DNA, 20 bp, Artificial Sequence
  chemically synthesized
tttatctacaaatagatcta

SEQ ID NO: 441742 - DNA, 20 bp, Artificial Sequence
  chemically synthesized
atattctgtagatagatctg

SEQ ID NO: 441743 - DNA, 20 bp, Artificial Sequence
  chemically synthesized
tagatctacagatctatcta

SEQ ID NO: 441744 - DNA, 20 bp, Artificial Sequence
  chemically synthesized
cctgaaagatattctgtaga

SEQ ID NO: 441745 - DNA, 20 bp, Artificial Sequence
  chemically synthesized
tctacctgaaagatattctg

SEQ ID NO: 441746 - DNA, 20 bp, Artificial Sequence
  chemically synthesized
tctatctacagaatatcttt

SEQ ID NO: 441747 - DNA, 20 bp, Artificial Sequence
  chemically synthesized
ctatctacagaatatctttc

SEQ ID NO: 441748 - DNA, 20 bp, Artificial Sequence
  chemically synthesized
tctacagaatatctttcagg

SEQ ID NO: 441749 - DNA, 20 bp, Artificial Sequence
  chemically synthesized
cctatcaaaattctacctga

SEQ ID NO: 441750 - DNA, 20 bp, Artificial Sequence
  chemically synthesized
tctttcaggtagaattttga

SEQ ID NO: 441751 - DNA, 20 bp, Artificial Sequence
  chemically synthesized
ctttcaggtagaattttgat

SEQ ID NO: 441752 - DNA, 20 bp, Artificial Sequence
  chemically synthesized
ttaaaattatgaatacattt

SEQ ID NO: 441753 - DNA, 20 bp, Artificial Sequence
  chemically synthesized
aaattatgaatacattttgg

SEQ ID NO: 441754 - DNA, 20 bp, Artificial Sequence
  chemically synthesized
atgaattggaggaatcaatg

SEQ ID NO: 441755 - DNA, 20 bp, Artificial Sequence
  chemically synthesized
gtactatgttaatgaattgg

SEQ ID NO: 441756 - DNA, 20 bp, Artificial Sequence
  chemically synthesized
tgtactatgttaatgaattg

SEQ ID NO: 441757 - DNA, 20 bp, Artificial Sequence
  chemically synthesized
tatgtactatgttaatgaat

SEQ ID NO: 441758 - DNA, 20 bp, Artificial Sequence
  chemically synthesized
attcctccaattcattaaca

SEQ ID NO: 441759 - DNA, 20 bp, Artificial Sequence
  chemically synthesized
tagtacatatgtccaatatt

SEQ ID NO: 441760 - DNA, 20 bp, Artificial Sequence
  chemically synthesized
agtacatatgtccaatattt

SEQ ID NO: 441761 - DNA, 20 bp, Artificial Sequence
  chemically synthesized
attaaagataacctaaatat

SEQ ID NO: 441762 - DNA, 20 bp, Artificial Sequence
  chemically synthesized
gagtatgatgaaataaatta

SEQ ID NO: 441763 - DNA, 20 bp, Artificial Sequence
  chemically synthesized
ttaatttatttcatcatact

SEQ ID NO: 441764 - DNA, 20 bp, Artificial Sequence
  chemically synthesized
aagcactgtgtaaaaaagcc

SEQ ID NO: 441765 - DNA, 20 bp, Artificial Sequence
  chemically synthesized
tcatactcggcttttttaca

SEQ ID NO: 441766 - DNA, 20 bp, Artificial Sequence
  chemically synthesized
acacaaagcactgtgtaaaa

SEQ ID NO: 441767 - DNA, 20 bp, Artificial Sequence
  chemically synthesized
atatatctaatcacaacaca

SEQ ID NO: 441768 - DNA, 20 bp, Artificial Sequence
  chemically synthesized
acagtgctttgtgttgtgat

SEQ ID NO: 441769 - DNA, 20 bp, Artificial Sequence
  chemically synthesized
tattaatatttctaatataa

SEQ ID NO: 441770 - DNA, 20 bp, Artificial Sequence
  chemically synthesized
cgacagtagtgccattatat

SEQ ID NO: 441771 - DNA, 20 bp, Artificial Sequence
  chemically synthesized
taatataatggcactactgt

SEQ ID NO: 441772 - DNA, 20 bp, Artificial Sequence
  chemically synthesized
atcacatgcataaccgacag

SEQ ID NO: 441773 - DNA, 20 bp, Artificial Sequence
  chemically synthesized
gcaatcacatgcataaccga

SEQ ID NO: 441774 - DNA, 20 bp, Artificial Sequence
  chemically synthesized
tgcatgtgattgcacaaaaa

SEQ ID NO: 441775 - DNA, 20 bp, Artificial Sequence
  chemically synthesized
gcatgtgattgcacaaaaaa

SEQ ID NO: 441776 - DNA, 20 bp, Artificial Sequence
  chemically synthesized
attgcacaaaaaaaggaaaa

SEQ ID NO: 441777 - DNA, 20 bp, Artificial Sequence
  chemically synthesized
gcacaaaaaaaggaaaacag

SEQ ID NO: 441778 - DNA, 20 bp, Artificial Sequence
  chemically synthesized
acaaaaaaaggaaaacagca

SEQ ID NO: 441779 - DNA, 20 bp, Artificial Sequence
  chemically synthesized
aacaggaaaagaacgggttt

SEQ ID NO: 441780 - DNA, 20 bp, Artificial Sequence
  chemically synthesized
aaaacaaacaggaaaagaac

SEQ ID NO: 441781 - DNA, 20 bp, Artificial Sequence
  chemically synthesized
aaaaacaaacaggaaaagaa

SEQ ID NO: 441782 - DNA, 20 bp, Artificial Sequence
  chemically synthesized
aaagcaaaaacaaacaggaa

SEQ ID NO: 441783 - DNA, 20 bp, Artificial Sequence
  chemically synthesized
cttaaaaagcaaaaacaaac

SEQ ID NO: 441784 - DNA, 20 bp, Artificial Sequence
  chemically synthesized
tcttaaaaagcaaaaacaaa

SEQ ID NO: 441785 - DNA, 20 bp, Artificial Sequence
  chemically synthesized
cctgtttgtttttgcttttt

SEQ ID NO: 441786 - DNA, 20 bp, Artificial Sequence
  chemically synthesized
ttaaatgaaaatttcttaaa

SEQ ID NO: 441787 - DNA, 20 bp, Artificial Sequence
  chemically synthesized
tttttaagaaattttcattt

SEQ ID NO: 441788 - DNA, 20 bp, Artificial Sequence
  chemically synthesized
tttaagaaattttcatttaa

SEQ ID NO: 441789 - DNA, 20 bp, Artificial Sequence
  chemically synthesized
agaaattttcatttaagaga

SEQ ID NO: 441790 - DNA, 20 bp, Artificial Sequence
  chemically synthesized
aaattttcatttaagagatg

SEQ ID NO: 441791 - DNA, 20 bp, Artificial Sequence
  chemically synthesized
aattttcatttaagagatgg

SEQ ID NO: 441792 - DNA, 20 bp, Artificial Sequence
  chemically synthesized
tccagcctggatgacagagc

SEQ ID NO: 441793 - DNA, 20 bp, Artificial Sequence
  chemically synthesized
tggaggcttgctctgtcatc

SEQ ID NO: 441794 - DNA, 20 bp, Artificial Sequence
  chemically synthesized
acactccagcctggatgaca

SEQ ID NO: 441795 - DNA, 20 bp, Artificial Sequence
  chemically synthesized
ggaggcttgctctgtcatcc

SEQ ID NO: 441796 - DNA, 20 bp, Artificial Sequence
  chemically synthesized
ctacactccagcctggatga

SEQ ID NO: 441797 - DNA, 20 bp, Artificial Sequence
  chemically synthesized
gcttgctctgtcatccaggc

SEQ ID NO: 441798 - DNA, 20 bp, Artificial Sequence
  chemically synthesized
ttgctctgtcatccaggctg

SEQ ID NO: 441799 - DNA, 20 bp, Artificial Sequence
  chemically synthesized
tgtgtcgctacactccagcc

SEQ ID NO: 441800 - DNA, 20 bp, Artificial Sequence
  chemically synthesized
ctgtcatccaggctggagtg

SEQ ID NO: 441801 - DNA, 20 bp, Artificial Sequence
  chemically synthesized
atgattgtgtcgctacactc

SEQ ID NO: 441802 - DNA, 20 bp, Artificial Sequence
  chemically synthesized
gacacaatcatacctcgtta

SEQ ID NO: 441803 - DNA, 20 bp, Artificial Sequence
  chemically synthesized
aggagtttgagactataacg

SEQ ID NO: 441804 - DNA, 20 bp, Artificial Sequence
  chemically synthesized
caggagtttgagactataac

SEQ ID NO: 441805 - DNA, 20 bp, Artificial Sequence
  chemically synthesized
tcgttatagtctcaaactcc

SEQ ID NO: 441806 - DNA, 20 bp, Artificial Sequence
  chemically synthesized
tcacttgagcccaggagttt

SEQ ID NO: 441807 - DNA, 20 bp, Artificial Sequence
  chemically synthesized
cgttatagtctcaaactcct

SEQ ID NO: 441808 - DNA, 20 bp, Artificial Sequence
  chemically synthesized
ggaggatcacttgagcccag

SEQ ID NO: 441809 - DNA, 20 bp, Artificial Sequence
  chemically synthesized
agtctcaaactcctgggctc

SEQ ID NO: 441810 - DNA, 20 bp, Artificial Sequence
  chemically synthesized
caggaggatcacttgagccc

SEQ ID NO: 441811 - DNA, 20 bp, Artificial Sequence
  chemically synthesized
gcaggaggatcacttgagcc

SEQ ID NO: 441812 - DNA, 20 bp, Artificial Sequence
  chemically synthesized
ttgaggcaggaggatcactt

SEQ ID NO: 441813 - DNA, 20 bp, Artificial Sequence
  chemically synthesized
actcagaagattgaggcagg

SEQ ID NO: 441814 - DNA, 20 bp, Artificial Sequence
  chemically synthesized
tactcagaagattgaggcag

SEQ ID NO: 441815 - DNA, 20 bp, Artificial Sequence
  chemically synthesized
gctactcagaagattgaggc

SEQ ID NO: 441816 - DNA, 20 bp, Artificial Sequence
  chemically synthesized
agctactcagaagattgagg

SEQ ID NO: 441817 - DNA, 20 bp, Artificial Sequence
  chemically synthesized
cccagctactcagaagattg

SEQ ID NO: 441818 - DNA, 20 bp, Artificial Sequence
  chemically synthesized
acccagctactcagaagatt

SEQ ID NO: 441819 - DNA, 20 bp, Artificial Sequence
  chemically synthesized
tcctcctgcctcaatcttct

SEQ ID NO: 441820 - DNA, 20 bp, Artificial Sequence
  chemically synthesized
tcctgcctcaatcttctgag

SEQ ID NO: 441821 - DNA, 20 bp, Artificial Sequence
  chemically synthesized
ctgtagacccagctactcag

SEQ ID NO: 441822 - DNA, 20 bp, Artificial Sequence
  chemically synthesized
gcctcaatcttctgagtagc

SEQ ID NO: 441823 - DNA, 20 bp, Artificial Sequence
  chemically synthesized
cctcaatcttctgagtagct

SEQ ID NO: 441824 - DNA, 20 bp, Artificial Sequence
  chemically synthesized
cacctgtagacccagctact

SEQ ID NO: 441825 - DNA, 20 bp, Artificial Sequence
  chemically synthesized
cttctgagtagctgggtcta

SEQ ID NO: 441826 - DNA, 20 bp, Artificial Sequence
  chemically synthesized
ttctgagtagctgggtctac

SEQ ID NO: 441827 - DNA, 20 bp, Artificial Sequence
  chemically synthesized
gtggcattcacctgtagacc

SEQ ID NO: 441828 - DNA, 20 bp, Artificial Sequence
  chemically synthesized
aatatggtggcattcacctg

SEQ ID NO: 441829 - DNA, 20 bp, Artificial Sequence
  chemically synthesized
caggtgaatgccaccatatt

SEQ ID NO: 441830 - DNA, 20 bp, Artificial Sequence
  chemically synthesized
attaaattagctgaatatgg

SEQ ID NO: 441831 - DNA, 20 bp, Artificial Sequence
  chemically synthesized
aatattaaattagctgaata

SEQ ID NO: 441832 - DNA, 20 bp, Artificial Sequence
  chemically synthesized
ctctaaaaaaaatattaaat

SEQ ID NO: 441833 - DNA, 20 bp, Artificial Sequence
  chemically synthesized
agctaatttaatattttttt

SEQ ID NO: 441834 - DNA, 20 bp, Artificial Sequence
  chemically synthesized
ctaatttaatatttttttta

SEQ ID NO: 441835 - DNA, 20 bp, Artificial Sequence
  chemically synthesized
tttaatattttttttagaga

SEQ ID NO: 441836 - DNA, 20 bp, Artificial Sequence
  chemically synthesized
ttaatattttttttagagac

SEQ ID NO: 441837 - DNA, 20 bp, Artificial Sequence
  chemically synthesized
taatattttttttagagaca

SEQ ID NO: 441838 - DNA, 20 bp, Artificial Sequence
  chemically synthesized
accagcctgcgcaacataac

SEQ ID NO: 441839 - DNA, 20 bp, Artificial Sequence
  chemically synthesized
cagggtcttgttatgttgcg

SEQ ID NO: 441840 - DNA, 20 bp, Artificial Sequence
  chemically synthesized
agggtcttgttatgttgcgc

SEQ ID NO: 441841 - DNA, 20 bp, Artificial Sequence
  chemically synthesized
tcttgttatgttgcgcaggc

SEQ ID NO: 441842 - DNA, 20 bp, Artificial Sequence
  chemically synthesized
tgaggccagaagttaaagac

SEQ ID NO: 441843 - DNA, 20 bp, Artificial Sequence
  chemically synthesized
gcaggctggtctttaacttc

SEQ ID NO: 441844 - DNA, 20 bp, Artificial Sequence
  chemically synthesized
ttacttgaggccagaagtta

SEQ ID NO: 441845 - DNA, 20 bp, Artificial Sequence
  chemically synthesized
ggaggattacttgaggccag

SEQ ID NO: 441846 - DNA, 20 bp, Artificial Sequence
  chemically synthesized
ggtctttaacttctggcctc

SEQ ID NO: 441847 - DNA, 20 bp, Artificial Sequence
  chemically synthesized
gcaggaggattacttgaggc

SEQ ID NO: 441848 - DNA, 20 bp, Artificial Sequence
  chemically synthesized
tgaggcaggaggattacttg

SEQ ID NO: 441849 - DNA, 20 bp, Artificial Sequence
  chemically synthesized
ctgaggcaggaggattactt

SEQ ID NO: 441850 - DNA, 20 bp, Artificial Sequence
  chemically synthesized
ctcaagtaatcctcctgcct

SEQ ID NO: 441851 - DNA, 20 bp, Artificial Sequence
  chemically synthesized
cctggggaggctgaggcagg

SEQ ID NO: 441852 - DNA, 20 bp, Artificial Sequence
  chemically synthesized
tcctggggaggctgaggcag

SEQ ID NO: 441853 - DNA, 20 bp, Artificial Sequence
  chemically synthesized
gctcctggggaggctgaggc

SEQ ID NO: 441854 - DNA, 20 bp, Artificial Sequence
  chemically synthesized
agctcctggggaggctgagg

SEQ ID NO: 441855 - DNA, 20 bp, Artificial Sequence
  chemically synthesized
cccagctcctggggaggctg

SEQ ID NO: 441856 - DNA, 20 bp, Artificial Sequence
  chemically synthesized
tcccagctcctggggaggct

SEQ ID NO: 441857 - DNA, 20 bp, Artificial Sequence
  chemically synthesized
tcctcctgcctcagcctccc

SEQ ID NO: 441858 - DNA, 20 bp, Artificial Sequence
  chemically synthesized
cctcctgcctcagcctcccc

SEQ ID NO: 441859 - DNA, 20 bp, Artificial Sequence
  chemically synthesized
tcctgcctcagcctccccag

SEQ ID NO: 441860 - DNA, 20 bp, Artificial Sequence
  chemically synthesized
tataatcccagctcctgggg

SEQ ID NO: 441861 - DNA, 20 bp, Artificial Sequence
  chemically synthesized
ctataatcccagctcctggg

SEQ ID NO: 441862 - DNA, 20 bp, Artificial Sequence
  chemically synthesized
gcctcagcctccccaggagc

SEQ ID NO: 441863 - DNA, 20 bp, Artificial Sequence
  chemically synthesized
gcctataatcccagctcctg

SEQ ID NO: 441864 - DNA, 20 bp, Artificial Sequence
  chemically synthesized
cctcagcctccccaggagct

SEQ ID NO: 441865 - DNA, 20 bp, Artificial Sequence
  chemically synthesized
tgcctataatcccagctcct

SEQ ID NO: 441866 - DNA, 20 bp, Artificial Sequence
  chemically synthesized
atgcctataatcccagctcc

SEQ ID NO: 441867 - DNA, 20 bp, Artificial Sequence
  chemically synthesized
ctccccaggagctgggatta

SEQ ID NO: 441868 - DNA, 20 bp, Artificial Sequence
  chemically synthesized
tccccaggagctgggattat

SEQ ID NO: 441869 - DNA, 20 bp, Artificial Sequence
  chemically synthesized
gtggctcatgcctataatcc

SEQ ID NO: 441870 - DNA, 20 bp, Artificial Sequence
  chemically synthesized
ggagctgggattataggcat

SEQ ID NO: 441871 - DNA, 20 bp, Artificial Sequence
  chemically synthesized
taggcatgagccaccacact

SEQ ID NO: 441872 - DNA, 20 bp, Artificial Sequence
  chemically synthesized
tacaaactggccgagtgtgg

SEQ ID NO: 441873 - DNA, 20 bp, Artificial Sequence
  chemically synthesized
ttttacaaactggccgagtg

SEQ ID NO: 441874 - DNA, 20 bp, Artificial Sequence
  chemically synthesized
catgagccaccacactcggc

SEQ ID NO: 441875 - DNA, 20 bp, Artificial Sequence
  chemically synthesized
cttctttttacaaactggcc

SEQ ID NO: 441876 - DNA, 20 bp, Artificial Sequence
  chemically synthesized
atgtgcttctttttacaaac

SEQ ID NO: 441877 - DNA, 20 bp, Artificial Sequence
  chemically synthesized
acactcggccagtttgtaaa

SEQ ID NO: 441878 - DNA, 20 bp, Artificial Sequence
  chemically synthesized
ctcggccagtttgtaaaaag

SEQ ID NO: 441879 - DNA, 20 bp, Artificial Sequence
  chemically synthesized
aaaaaatgttatatgcttgt

SEQ ID NO: 441880 - DNA, 20 bp, Artificial Sequence
  chemically synthesized
aagacatacaagcggccaac

SEQ ID NO: 441881 - DNA, 20 bp, Artificial Sequence
  chemically synthesized
cttgaaagaagacatacaag

SEQ ID NO: 441882 - DNA, 20 bp, Artificial Sequence
  chemically synthesized
cttcttgaaagaagacatac

SEQ ID NO: 441883 - DNA, 20 bp, Artificial Sequence
  chemically synthesized
ccgcttgtatgtcttctttc

SEQ ID NO: 441884 - DNA, 20 bp, Artificial Sequence
  chemically synthesized
gaacagacacttcttgaaag

SEQ ID NO: 441885 - DNA, 20 bp, Artificial Sequence
  chemically synthesized
cttgtatgtcttctttcaag

SEQ ID NO: 441886 - DNA, 20 bp, Artificial Sequence
  chemically synthesized
cctgaacagacacttcttga

SEQ ID NO: 441887 - DNA, 20 bp, Artificial Sequence
  chemically synthesized
tctttcaagaagtgtctgtt

SEQ ID NO: 441888 - DNA, 20 bp, Artificial Sequence
  chemically synthesized
ctttcaagaagtgtctgttc

SEQ ID NO: 441889 - DNA, 20 bp, Artificial Sequence
  chemically synthesized
caagaagtgtctgttcaggc

SEQ ID NO: 441890 - DNA, 20 bp, Artificial Sequence
  chemically synthesized
gctaacacacccggcctgaa

SEQ ID NO: 441891 - DNA, 20 bp, Artificial Sequence
  chemically synthesized
aagaagtgtctgttcaggcc

SEQ ID NO: 441892 - DNA, 20 bp, Artificial Sequence
  chemically synthesized
tctgttcaggccgggtgtgt

SEQ ID NO: 441893 - DNA, 20 bp, Artificial Sequence
  chemically synthesized
caggcatgagctaacacacc

SEQ ID NO: 441894 - DNA, 20 bp, Artificial Sequence
  chemically synthesized
agtaatagaattacaggcat

SEQ ID NO: 441895 - DNA, 20 bp, Artificial Sequence
  chemically synthesized
tctcaaagtaatagaattac

SEQ ID NO: 441896 - DNA, 20 bp, Artificial Sequence
  chemically synthesized
ttctcaaagtaatagaatta

SEQ ID NO: 441897 - DNA, 20 bp, Artificial Sequence
  chemically synthesized
gcctgtaattctattacttt

SEQ ID NO: 441898 - DNA, 20 bp, Artificial Sequence
  chemically synthesized
gcctcaacttctcaaagtaa

SEQ ID NO: 441899 - DNA, 20 bp, Artificial Sequence
  chemically synthesized
tgtaattctattactttgag

SEQ ID NO: 441900 - DNA, 20 bp, Artificial Sequence
  chemically synthesized
ctgcctgcctcaacttctca

SEQ ID NO: 441901 - DNA, 20 bp, Artificial Sequence
  chemically synthesized
ttctattactttgagaagtt

SEQ ID NO: 441902 - DNA, 20 bp, Artificial Sequence
  chemically synthesized
tctattactttgagaagttg

SEQ ID NO: 441903 - DNA, 20 bp, Artificial Sequence
  chemically synthesized
attactttgagaagttgagg

SEQ ID NO: 441904 - DNA, 20 bp, Artificial Sequence
  chemically synthesized
ttactttgagaagttgaggc

SEQ ID NO: 441905 - DNA, 20 bp, Artificial Sequence
  chemically synthesized
ctttgagaagttgaggcagg

SEQ ID NO: 441906 - DNA, 20 bp, Artificial Sequence
  chemically synthesized
tgaggcaggcagatcgcttt

SEQ ID NO: 441907 - DNA, 20 bp, Artificial Sequence
  chemically synthesized
caggcagatcgctttgagct

SEQ ID NO: 441908 - DNA, 20 bp, Artificial Sequence
  chemically synthesized
aggcagatcgctttgagctc

SEQ ID NO: 441909 - DNA, 20 bp, Artificial Sequence
  chemically synthesized
gtcttgaactcctgagctca

SEQ ID NO: 441910 - DNA, 20 bp, Artificial Sequence
  chemically synthesized
gcagatcgctttgagctcag

SEQ ID NO: 441911 - DNA, 20 bp, Artificial Sequence
  chemically synthesized
ctggctggtcttgaactcct

SEQ ID NO: 441912 - DNA, 20 bp, Artificial Sequence
  chemically synthesized
cgctttgagctcaggagttc

SEQ ID NO: 441913 - DNA, 20 bp, Artificial Sequence
  chemically synthesized
tgagctcaggagttcaagac

SEQ ID NO: 441914 - DNA, 20 bp, Artificial Sequence
  chemically synthesized
ctcaggagttcaagaccagc

SEQ ID NO: 441915 - DNA, 20 bp, Artificial Sequence
  chemically synthesized
tcaggagttcaagaccagcc

SEQ ID NO: 441916 - DNA, 20 bp, Artificial Sequence
  chemically synthesized
caggagttcaagaccagcca

SEQ ID NO: 441917 - DNA, 20 bp, Artificial Sequence
  chemically synthesized
tttcaccatgtcgccctggc

SEQ ID NO: 441918 - DNA, 20 bp, Artificial Sequence
  chemically synthesized
ggggtttcaccatgtcgccc

SEQ ID NO: 441919 - DNA, 20 bp, Artificial Sequence
  chemically synthesized
caagaccagccagggcgaca

SEQ ID NO: 441920 - DNA, 20 bp, Artificial Sequence
  chemically synthesized
ctgtattttttttagagatg

SEQ ID NO: 441921 - DNA, 20 bp, Artificial Sequence
  chemically synthesized
gctgtattttttttagagat

SEQ ID NO: 441922 - DNA, 20 bp, Artificial Sequence
  chemically synthesized
ggctgtattttttttagaga

SEQ ID NO: 441923 - DNA, 20 bp, Artificial Sequence
  chemically synthesized
tcacggctgtatttttttta

SEQ ID NO: 441924 - DNA, 20 bp, Artificial Sequence
  chemically synthesized
catcacggctgtattttttt

SEQ ID NO: 441925 - DNA, 20 bp, Artificial Sequence
  chemically synthesized
ccccatctctaaaaaaaata

SEQ ID NO: 441926 - DNA, 20 bp, Artificial Sequence
  chemically synthesized
aaaaaatacagccgtgatgt

SEQ ID NO: 441927 - DNA, 20 bp, Artificial Sequence
  chemically synthesized
aaaaatacagccgtgatgtc

SEQ ID NO: 441928 - DNA, 20 bp, Artificial Sequence
  chemically synthesized
atgacaggcgcctgacatca

SEQ ID NO: 441929 - DNA, 20 bp, Artificial Sequence
  chemically synthesized
atgtcaggcgcctgtcatca

SEQ ID NO: 441930 - DNA, 20 bp, Artificial Sequence
  chemically synthesized
tcctgagtggctgtgatgac

SEQ ID NO: 441931 - DNA, 20 bp, Artificial Sequence
  chemically synthesized
ctcctgagtggctgtgatga

SEQ ID NO: 441932 - DNA, 20 bp, Artificial Sequence
  chemically synthesized
cgcctgtcatcacagccact

SEQ ID NO: 441933 - DNA, 20 bp, Artificial Sequence
  chemically synthesized
gcctgtcatcacagccactc

SEQ ID NO: 441934 - DNA, 20 bp, Artificial Sequence
  chemically synthesized
ctgtcatcacagccactcag

SEQ ID NO: 441935 - DNA, 20 bp, Artificial Sequence
  chemically synthesized
tgtcatcacagccactcagg

SEQ ID NO: 441936 - DNA, 20 bp, Artificial Sequence
  chemically synthesized
tccagcctcagcctcctgag

SEQ ID NO: 441937 - DNA, 20 bp, Artificial Sequence
  chemically synthesized
ttctccagcctcagcctcct

SEQ ID NO: 441938 - DNA, 20 bp, Artificial Sequence
  chemically synthesized
tcacagccactcaggaggct

SEQ ID NO: 441939 - DNA, 20 bp, Artificial Sequence
  chemically synthesized
cacagccactcaggaggctg

SEQ ID NO: 441940 - DNA, 20 bp, Artificial Sequence
  chemically synthesized
gccactcaggaggctgaggc

SEQ ID NO: 441941 - DNA, 20 bp, Artificial Sequence
  chemically synthesized
cactcaggaggctgaggctg

SEQ ID NO: 441942 - DNA, 20 bp, Artificial Sequence
  chemically synthesized
ctcaagcgattctccagcct

SEQ ID NO: 441943 - DNA, 20 bp, Artificial Sequence
  chemically synthesized
cccctgctcaagcgattctc

SEQ ID NO: 441944 - DNA, 20 bp, Artificial Sequence
  chemically synthesized
ctgaggctggagaatcgctt

SEQ ID NO: 441945 - DNA, 20 bp, Artificial Sequence
  chemically synthesized
aggctggagaatcgcttgag

SEQ ID NO: 441946 - DNA, 20 bp, Artificial Sequence
  chemically synthesized
ggctggagaatcgcttgagc

SEQ ID NO: 441947 - DNA, 20 bp, Artificial Sequence
  chemically synthesized
gctggagaatcgcttgagca

SEQ ID NO: 441948 - DNA, 20 bp, Artificial Sequence
  chemically synthesized
ctggagaatcgcttgagcag

SEQ ID NO: 441949 - DNA, 20 bp, Artificial Sequence
  chemically synthesized
aaacttcacctcccctgctc

SEQ ID NO: 441950 - DNA, 20 bp, Artificial Sequence
  chemically synthesized
ggagaatcgcttgagcaggg

SEQ ID NO: 441951 - DNA, 20 bp, Artificial Sequence
  chemically synthesized
gagaatcgcttgagcagggg

SEQ ID NO: 441952 - DNA, 20 bp, Artificial Sequence
  chemically synthesized
tcgcttgagcaggggaggtg

SEQ ID NO: 441953 - DNA, 20 bp, Artificial Sequence
  chemically synthesized
agcaggggaggtgaagtttg

SEQ ID NO: 441954 - DNA, 20 bp, Artificial Sequence
  chemically synthesized
ggggaggtgaagtttgcagt

SEQ ID NO: 441955 - DNA, 20 bp, Artificial Sequence
  chemically synthesized
ggtgaagtttgcagtgagcc

SEQ ID NO: 441956 - DNA, 20 bp, Artificial Sequence
  chemically synthesized
gaagtgcagtggcacagtct

SEQ ID NO: 441957 - DNA, 20 bp, Artificial Sequence
  chemically synthesized
caggctgaagtgcagtggca

SEQ ID NO: 441958 - DNA, 20 bp, Artificial Sequence
  chemically synthesized
tagtccaggctgaagtgcag

SEQ ID NO: 441959 - DNA, 20 bp, Artificial Sequence
  chemically synthesized
gagactgtgccactgcactt

SEQ ID NO: 441960 - DNA, 20 bp, Artificial Sequence
  chemically synthesized
tcttagtccaggctgaagtg

SEQ ID NO: 441961 - DNA, 20 bp, Artificial Sequence
  chemically synthesized
tgtgccactgcacttcagcc

SEQ ID NO: 441962 - DNA, 20 bp, Artificial Sequence
  chemically synthesized
cttgctcttagtccaggctg

SEQ ID NO: 441963 - DNA, 20 bp, Artificial Sequence
  chemically synthesized
actgcacttcagcctggact

SEQ ID NO: 441964 - DNA, 20 bp, Artificial Sequence
  chemically synthesized
tgcacttcagcctggactaa

SEQ ID NO: 441965 - DNA, 20 bp, Artificial Sequence
  chemically synthesized
tagggtcttgctcttagtcc

SEQ ID NO: 441966 - DNA, 20 bp, Artificial Sequence
  chemically synthesized
atagggtcttgctcttagtc

SEQ ID NO: 441967 - DNA, 20 bp, Artificial Sequence
  chemically synthesized
cttcagcctggactaagagc

SEQ ID NO: 441968 - DNA, 20 bp, Artificial Sequence
  chemically synthesized
ttgagatagggtcttgctct

SEQ ID NO: 441969 - DNA, 20 bp, Artificial Sequence
  chemically synthesized
ttttttttttttttgagata

SEQ ID NO: 441970 - DNA, 20 bp, Artificial Sequence
  chemically synthesized
tttttttttttttttgagat

SEQ ID NO: 441971 - DNA, 20 bp, Artificial Sequence
  chemically synthesized
ttttttttttttttttgaga

SEQ ID NO: 441972 - DNA, 20 bp, Artificial Sequence
  chemically synthesized
acactttttttttttttttt

SEQ ID NO: 441973 - DNA, 20 bp, Artificial Sequence
  chemically synthesized
tatctcaaaaaaaaaaaaaa

SEQ ID NO: 441974 - DNA, 20 bp, Artificial Sequence
  chemically synthesized
aaatgggcaaagtatatgaa

SEQ ID NO: 441975 - DNA, 20 bp, Artificial Sequence
  chemically synthesized
acattcattaaaaatgggca

SEQ ID NO: 441976 - DNA, 20 bp, Artificial Sequence
  chemically synthesized
caaatacattcattaaaaat

SEQ ID NO: 441977 - DNA, 20 bp, Artificial Sequence
  chemically synthesized
acaaatacattcattaaaaa

SEQ ID NO: 441978 - DNA, 20 bp, Artificial Sequence
  chemically synthesized
ttaatgaatgtatttgtatt

SEQ ID NO: 441979 - DNA, 20 bp, Artificial Sequence
  chemically synthesized
tgtatttggtttgttgattt

SEQ ID NO: 441980 - DNA, 20 bp, Artificial Sequence
  chemically synthesized
ttgttgatttaagtttctta

SEQ ID NO: 441981 - DNA, 20 bp, Artificial Sequence
  chemically synthesized
gcctagtatccagaatctat

SEQ ID NO: 441982 - DNA, 20 bp, Artificial Sequence
  chemically synthesized
tttaagtttcttatagattc

SEQ ID NO: 441983 - DNA, 20 bp, Artificial Sequence
  chemically synthesized
ttcttatagattctggatac

SEQ ID NO: 441984 - DNA, 20 bp, Artificial Sequence
  chemically synthesized
tcttatagattctggatact

SEQ ID NO: 441985 - DNA, 20 bp, Artificial Sequence
  chemically synthesized
tctgacaaaggcctagtatc

SEQ ID NO: 441986 - DNA, 20 bp, Artificial Sequence
  chemically synthesized
atatgcatctgacaaaggcc

SEQ ID NO: 441987 - DNA, 20 bp, Artificial Sequence
  chemically synthesized
tctggatactaggcctttgt

SEQ ID NO: 441988 - DNA, 20 bp, Artificial Sequence
  chemically synthesized
acaaaatatgcatctgacaa

SEQ ID NO: 441989 - DNA, 20 bp, Artificial Sequence
  chemically synthesized
cacaaaatatgcatctgaca

SEQ ID NO: 441990 - DNA, 20 bp, Artificial Sequence
  chemically synthesized
agtaaacagacgaagaatgg

SEQ ID NO: 441991 - DNA, 20 bp, Artificial Sequence
  chemically synthesized
aaagtaaacagacgaagaat

SEQ ID NO: 441992 - DNA, 20 bp, Artificial Sequence
  chemically synthesized
caaagtaaacagacgaagaa

SEQ ID NO: 441993 - DNA, 20 bp, Artificial Sequence
  chemically synthesized
atcaacaaagtaaacagacg

SEQ ID NO: 441994 - DNA, 20 bp, Artificial Sequence
  chemically synthesized
agaaacatcaacaaagtaaa

SEQ ID NO: 441995 - DNA, 20 bp, Artificial Sequence
  chemically synthesized
aagcaaaagaaacatcaaca

SEQ ID NO: 441996 - DNA, 20 bp, Artificial Sequence
  chemically synthesized
aaagagcttctgcaaagcaa

SEQ ID NO: 441997 - DNA, 20 bp, Artificial Sequence
  chemically synthesized
ttgatgtttcttttgctttg

SEQ ID NO: 441998 - DNA, 20 bp, Artificial Sequence
  chemically synthesized
atgtttcttttgctttgcag

SEQ ID NO: 441999 - DNA, 20 bp, Artificial Sequence
  chemically synthesized
taagccaaagagcttctgca

SEQ ID NO: 442000 - DNA, 20 bp, Artificial Sequence
  chemically synthesized
tttgctttgcagaagctctt

SEQ ID NO: 442001 - DNA, 20 bp, Artificial Sequence
  chemically synthesized
tttgcagaagctctttggct

SEQ ID NO: 442002 - DNA, 20 bp, Artificial Sequence
  chemically synthesized
tggaacttgactaagccaaa

SEQ ID NO: 442003 - DNA, 20 bp, Artificial Sequence
  chemically synthesized
agtggaacttgactaagcca

SEQ ID NO: 442004 - DNA, 20 bp, Artificial Sequence
  chemically synthesized
agaagctctttggcttagtc

SEQ ID NO: 442005 - DNA, 20 bp, Artificial Sequence
  chemically synthesized
ttgacaagtggaacttgact

SEQ ID NO: 442006 - DNA, 20 bp, Artificial Sequence
  chemically synthesized
caaaaacaaaaattgacaag

SEQ ID NO: 442007 - DNA, 20 bp, Artificial Sequence
  chemically synthesized
caacaaaaacaaaaattgac

SEQ ID NO: 442008 - DNA, 20 bp, Artificial Sequence
  chemically synthesized
aatttttgtttttgttgcaa

SEQ ID NO: 442009 - DNA, 20 bp, Artificial Sequence
  chemically synthesized
gtttttgttgcaatggcttt

SEQ ID NO: 442010 - DNA, 20 bp, Artificial Sequence
  chemically synthesized
tttttgttgcaatggctttt

SEQ ID NO: 442011 - DNA, 20 bp, Artificial Sequence
  chemically synthesized
ttttgttgcaatggcttttg

SEQ ID NO: 442012 - DNA, 20 bp, Artificial Sequence
  chemically synthesized
atttatgactaagtccccaa

SEQ ID NO: 442013 - DNA, 20 bp, Artificial Sequence
  chemically synthesized
tgcaatggcttttggggact

SEQ ID NO: 442014 - DNA, 20 bp, Artificial Sequence
  chemically synthesized
ttggcaaagaatttatgact

SEQ ID NO: 442015 - DNA, 20 bp, Artificial Sequence
  chemically synthesized
ttagtcataaattctttgcc

SEQ ID NO: 442016 - DNA, 20 bp, Artificial Sequence
  chemically synthesized
tttttacattggtcttggca

SEQ ID NO: 442017 - DNA, 20 bp, Artificial Sequence
  chemically synthesized
acccttttttacattggtct

SEQ ID NO: 442018 - DNA, 20 bp, Artificial Sequence
  chemically synthesized
ggaagtacccttttttacat

SEQ ID NO: 442019 - DNA, 20 bp, Artificial Sequence
  chemically synthesized
ttgccaagaccaatgtaaaa

SEQ ID NO: 442020 - DNA, 20 bp, Artificial Sequence
  chemically synthesized
tgccaagaccaatgtaaaaa

SEQ ID NO: 442021 - DNA, 20 bp, Artificial Sequence
  chemically synthesized
gccaagaccaatgtaaaaaa

SEQ ID NO: 442022 - DNA, 20 bp, Artificial Sequence
  chemically synthesized
atgtaaaaaagggtacttcc

SEQ ID NO: 442023 - DNA, 20 bp, Artificial Sequence
  chemically synthesized
tgtaaaaaagggtacttcct

SEQ ID NO: 442024 - DNA, 20 bp, Artificial Sequence
  chemically synthesized
atcctagaagaaaacctagg

SEQ ID NO: 442025 - DNA, 20 bp, Artificial Sequence
  chemically synthesized
aaaatcctagaagaaaacct

SEQ ID NO: 442026 - DNA, 20 bp, Artificial Sequence
  chemically synthesized
aaaaatcctagaagaaaacc

SEQ ID NO: 442027 - DNA, 20 bp, Artificial Sequence
  chemically synthesized
gtacttcctaggttttcttc

SEQ ID NO: 442028 - DNA, 20 bp, Artificial Sequence
  chemically synthesized
tacttcctaggttttcttct

SEQ ID NO: 442029 - DNA, 20 bp, Artificial Sequence
  chemically synthesized
catactgtaaaaaatcctag

SEQ ID NO: 442030 - DNA, 20 bp, Artificial Sequence
  chemically synthesized
cctcatactgtaaaaaatcc

SEQ ID NO: 442031 - DNA, 20 bp, Artificial Sequence
  chemically synthesized
ttttcttctaggatttttta

SEQ ID NO: 442032 - DNA, 20 bp, Artificial Sequence
  chemically synthesized
tctaggattttttacagtat

SEQ ID NO: 442033 - DNA, 20 bp, Artificial Sequence
  chemically synthesized
ctaggattttttacagtatg

SEQ ID NO: 442034 - DNA, 20 bp, Artificial Sequence
  chemically synthesized
tgaactaaaggtttaaatat

SEQ ID NO: 442035 - DNA, 20 bp, Artificial Sequence
  chemically synthesized
aggtcttatatttaaacctt

SEQ ID NO: 442036 - DNA, 20 bp, Artificial Sequence
  chemically synthesized
atcaactgacggtgaactaa

SEQ ID NO: 442037 - DNA, 20 bp, Artificial Sequence
  chemically synthesized
aatcaactgacggtgaacta

SEQ ID NO: 442038 - DNA, 20 bp, Artificial Sequence
  chemically synthesized
ttaaacctttagttcaccgt

SEQ ID NO: 442039 - DNA, 20 bp, Artificial Sequence
  chemically synthesized
tatatacaaaaatcaactga

SEQ ID NO: 442040 - DNA, 20 bp, Artificial Sequence
  chemically synthesized
tgatttttgtatataatgaa

SEQ ID NO: 442041 - DNA, 20 bp, Artificial Sequence
  chemically synthesized
tttttgtatataatgaaaag

SEQ ID NO: 442042 - DNA, 20 bp, Artificial Sequence
  chemically synthesized
tttgtatataatgaaaagta

SEQ ID NO: 442043 - DNA, 20 bp, Artificial Sequence
  chemically synthesized
ttgtatataatgaaaagtag

SEQ ID NO: 442044 - DNA, 20 bp, Artificial Sequence
  chemically synthesized
cacatgcagaagattgaaat

SEQ ID NO: 442045 - DNA, 20 bp, Artificial Sequence
  chemically synthesized
caatttcaatcttctgcatg

SEQ ID NO: 442046 - DNA, 20 bp, Artificial Sequence
  chemically synthesized
aactggctggccacatgcag

SEQ ID NO: 442047 - DNA, 20 bp, Artificial Sequence
  chemically synthesized
gaaaactggctggccacatg

SEQ ID NO: 442048 - DNA, 20 bp, Artificial Sequence
  chemically synthesized
ttcaatcttctgcatgtggc

SEQ ID NO: 442049 - DNA, 20 bp, Artificial Sequence
  chemically synthesized
atcttctgcatgtggccagc

SEQ ID NO: 442050 - DNA, 20 bp, Artificial Sequence
  chemically synthesized
atggtgctgggaaaactggc

SEQ ID NO: 442051 - DNA, 20 bp, Artificial Sequence
  chemically synthesized
atgtggccagccagttttcc

SEQ ID NO: 442052 - DNA, 20 bp, Artificial Sequence
  chemically synthesized
atagatggtgctgggaaaac

SEQ ID NO: 442053 - DNA, 20 bp, Artificial Sequence
  chemically synthesized
cctattcaatagatggtgct

SEQ ID NO: 442054 - DNA, 20 bp, Artificial Sequence
  chemically synthesized
tcctattcaatagatggtgc

SEQ ID NO: 442055 - DNA, 20 bp, Artificial Sequence
  chemically synthesized
aggacttcctattcaataga

SEQ ID NO: 442056 - DNA, 20 bp, Artificial Sequence
  chemically synthesized
tcccagcaccatctattgaa

SEQ ID NO: 442057 - DNA, 20 bp, Artificial Sequence
  chemically synthesized
cccagcaccatctattgaat

SEQ ID NO: 442058 - DNA, 20 bp, Artificial Sequence
  chemically synthesized
ggaaaggacttcctattcaa

SEQ ID NO: 442059 - DNA, 20 bp, Artificial Sequence
  chemically synthesized
agcaccatctattgaatagg

SEQ ID NO: 442060 - DNA, 20 bp, Artificial Sequence
  chemically synthesized
caaaaataagcaatggggaa

SEQ ID NO: 442061 - DNA, 20 bp, Artificial Sequence
  chemically synthesized
acaaaaataagcaatgggga

SEQ ID NO: 442062 - DNA, 20 bp, Artificial Sequence
  chemically synthesized
gtcaacaaaaataagcaatg

SEQ ID NO: 442063 - DNA, 20 bp, Artificial Sequence
  chemically synthesized
agtcaacaaaaataagcaat

SEQ ID NO: 442064 - DNA, 20 bp, Artificial Sequence
  chemically synthesized
aagtcaacaaaaataagcaa

SEQ ID NO: 442065 - DNA, 20 bp, Artificial Sequence
  chemically synthesized
ttgactaagtcaacaaaaat

SEQ ID NO: 442066 - DNA, 20 bp, Artificial Sequence
  chemically synthesized
attgcttatttttgttgact

SEQ ID NO: 442067 - DNA, 20 bp, Artificial Sequence
  chemically synthesized
tatttttgttgacttagtca

SEQ ID NO: 442068 - DNA, 20 bp, Artificial Sequence
  chemically synthesized
taaccatctgatctttgact

SEQ ID NO: 442069 - DNA, 20 bp, Artificial Sequence
  chemically synthesized
ttgttgacttagtcaaagat

SEQ ID NO: 442070 - DNA, 20 bp, Artificial Sequence
  chemically synthesized
tgacttagtcaaagatcaga

SEQ ID NO: 442071 - DNA, 20 bp, Artificial Sequence
  chemically synthesized
agtcaaagatcagatggtta

SEQ ID NO: 442072 - DNA, 20 bp, Artificial Sequence
  chemically synthesized
gtcaaagatcagatggttat

SEQ ID NO: 442073 - DNA, 20 bp, Artificial Sequence
  chemically synthesized
taggtgtgtcgctttgtttc

SEQ ID NO: 442074 - DNA, 20 bp, Artificial Sequence
  chemically synthesized
aggtgtgtcgctttgtttct

SEQ ID NO: 442075 - DNA, 20 bp, Artificial Sequence
  chemically synthesized
gaatagtgaacccagaaaca

SEQ ID NO: 442076 - DNA, 20 bp, Artificial Sequence
  chemically synthesized
atggaacagaatagtgaacc

SEQ ID NO: 442077 - DNA, 20 bp, Artificial Sequence
  chemically synthesized
catagaccaatggaacagaa

SEQ ID NO: 442078 - DNA, 20 bp, Artificial Sequence
  chemically synthesized
ggttcactattctgttccat

SEQ ID NO: 442079 - DNA, 20 bp, Artificial Sequence
  chemically synthesized
cagaccatagaccaatggaa

SEQ ID NO: 442080 - DNA, 20 bp, Artificial Sequence
  chemically synthesized
aaaaacagaccatagaccaa

SEQ ID NO: 442081 - DNA, 20 bp, Artificial Sequence
  chemically synthesized
tattctgttccattggtcta

SEQ ID NO: 442082 - DNA, 20 bp, Artificial Sequence
  chemically synthesized
actggtacaaaaacagacca

SEQ ID NO: 442083 - DNA, 20 bp, Artificial Sequence
  chemically synthesized
gcatggtactggtacaaaaa

SEQ ID NO: 442084 - DNA, 20 bp, Artificial Sequence
  chemically synthesized
tctatggtctgtttttgtac

SEQ ID NO: 442085 - DNA, 20 bp, Artificial Sequence
  chemically synthesized
taacccaaacagcatggtac

SEQ ID NO: 442086 - DNA, 20 bp, Artificial Sequence
  chemically synthesized
tgtaccagtaccatgctgtt

SEQ ID NO: 442087 - DNA, 20 bp, Artificial Sequence
  chemically synthesized
ctacagtaacccaaacagca

SEQ ID NO: 442088 - DNA, 20 bp, Artificial Sequence
  chemically synthesized
gtaccagtaccatgctgttt

SEQ ID NO: 442089 - DNA, 20 bp, Artificial Sequence
  chemically synthesized
taagcctacagtaacccaaa

SEQ ID NO: 442090 - DNA, 20 bp, Artificial Sequence
  chemically synthesized
ccatgctgtttgggttactg

SEQ ID NO: 442091 - DNA, 20 bp, Artificial Sequence
  chemically synthesized
catgctgtttgggttactgt

SEQ ID NO: 442092 - DNA, 20 bp, Artificial Sequence
  chemically synthesized
caagctatactataagccta

SEQ ID NO: 442093 - DNA, 20 bp, Artificial Sequence
  chemically synthesized
tttgggttactgtaggctta

SEQ ID NO: 442094 - DNA, 20 bp, Artificial Sequence
  chemically synthesized
gttactgtaggcttatagta

SEQ ID NO: 442095 - DNA, 20 bp, Artificial Sequence
  chemically synthesized
ctgacttcaagctatactat

SEQ ID NO: 442096 - DNA, 20 bp, Artificial Sequence
  chemically synthesized
taggcttatagtatagcttg

SEQ ID NO: 442097 - DNA, 20 bp, Artificial Sequence
  chemically synthesized
cttatagtatagcttgaagt

SEQ ID NO: 442098 - DNA, 20 bp, Artificial Sequence
  chemically synthesized
ttatagtatagcttgaagtc

SEQ ID NO: 442099 - DNA, 20 bp, Artificial Sequence
  chemically synthesized
gcatcacactacctgacttc

SEQ ID NO: 442100 - DNA, 20 bp, Artificial Sequence
  chemically synthesized
tagtatagcttgaagtcagg

SEQ ID NO: 442101 - DNA, 20 bp, Artificial Sequence
  chemically synthesized
agctaaaagaataaagcaag

SEQ ID NO: 442102 - DNA, 20 bp, Artificial Sequence
  chemically synthesized
aagctaaaagaataaagcaa

SEQ ID NO: 442103 - DNA, 20 bp, Artificial Sequence
  chemically synthesized
ttaagctaaaagaataaagc

SEQ ID NO: 442104 - DNA, 20 bp, Artificial Sequence
  chemically synthesized
aatcttaagctaaaagaata

SEQ ID NO: 442105 - DNA, 20 bp, Artificial Sequence
  chemically synthesized
tgcctcttgctttattcttt

SEQ ID NO: 442106 - DNA, 20 bp, Artificial Sequence
  chemically synthesized
ttgctttattcttttagctt

SEQ ID NO: 442107 - DNA, 20 bp, Artificial Sequence
  chemically synthesized
ccaaagcaatcttaagctaa

SEQ ID NO: 442108 - DNA, 20 bp, Artificial Sequence
  chemically synthesized
catagagccaaagcaatctt

SEQ ID NO: 442109 - DNA, 20 bp, Artificial Sequence
  chemically synthesized
cttttagcttaagattgctt

SEQ ID NO: 442110 - DNA, 20 bp, Artificial Sequence
  chemically synthesized
caaaagagcccatagagcca

SEQ ID NO: 442111 - DNA, 20 bp, Artificial Sequence
  chemically synthesized
ttaagattgctttggctcta

SEQ ID NO: 442112 - DNA, 20 bp, Artificial Sequence
  chemically synthesized
taagattgctttggctctat

SEQ ID NO: 442113 - DNA, 20 bp, Artificial Sequence
  chemically synthesized
tggaaccaaaagagcccata

SEQ ID NO: 442114 - DNA, 20 bp, Artificial Sequence
  chemically synthesized
tatggaaccaaaagagccca

SEQ ID NO: 442115 - DNA, 20 bp, Artificial Sequence
  chemically synthesized
tttggctctatgggctcttt

SEQ ID NO: 442116 - DNA, 20 bp, Artificial Sequence
  chemically synthesized
aaatttgtatggaaccaaaa

SEQ ID NO: 442117 - DNA, 20 bp, Artificial Sequence
  chemically synthesized
ccaaatttgtatggaaccaa

SEQ ID NO: 442118 - DNA, 20 bp, Artificial Sequence
  chemically synthesized
aagactaatccaaatttgta

SEQ ID NO: 442119 - DNA, 20 bp, Artificial Sequence
  chemically synthesized
cttttggttccatacaaatt

SEQ ID NO: 442120 - DNA, 20 bp, Artificial Sequence
  chemically synthesized
ggttccatacaaatttggat

SEQ ID NO: 442121 - DNA, 20 bp, Artificial Sequence
  chemically synthesized
atttttcattttcattagaa

SEQ ID NO: 442122 - DNA, 20 bp, Artificial Sequence
  chemically synthesized
ttttcatttttcattttcat

SEQ ID NO: 442123 - DNA, 20 bp, Artificial Sequence
  chemically synthesized
tgaaaaatgaaaattgacgt

SEQ ID NO: 442124 - DNA, 20 bp, Artificial Sequence
  chemically synthesized
aaaatgaaaattgacgttgg

SEQ ID NO: 442125 - DNA, 20 bp, Artificial Sequence
  chemically synthesized
attgacgttggtagtttgat

SEQ ID NO: 442126 - DNA, 20 bp, Artificial Sequence
  chemically synthesized
cgttggtagtttgataagat

SEQ ID NO: 442127 - DNA, 20 bp, Artificial Sequence
  chemically synthesized
cccaaagcaatttacagatt

SEQ ID NO: 442128 - DNA, 20 bp, Artificial Sequence
  chemically synthesized
atactgcccaaagcaattta

SEQ ID NO: 442129 - DNA, 20 bp, Artificial Sequence
  chemically synthesized
actgaatctgtaaattgctt

SEQ ID NO: 442130 - DNA, 20 bp, Artificial Sequence
  chemically synthesized
ctgaatctgtaaattgcttt

SEQ ID NO: 442131 - DNA, 20 bp, Artificial Sequence
  chemically synthesized
aatctgtaaattgctttggg

SEQ ID NO: 442132 - DNA, 20 bp, Artificial Sequence
  chemically synthesized
taaaatggccatactgccca

SEQ ID NO: 442133 - DNA, 20 bp, Artificial Sequence
  chemically synthesized
gtaaattgctttgggcagta

SEQ ID NO: 442134 - DNA, 20 bp, Artificial Sequence
  chemically synthesized
aagaataaatattgttaaaa

SEQ ID NO: 442135 - DNA, 20 bp, Artificial Sequence
  chemically synthesized
aatatttattcttccaatcc

SEQ ID NO: 442136 - DNA, 20 bp, Artificial Sequence
  chemically synthesized
atttcatgctcttggattgg

SEQ ID NO: 442137 - DNA, 20 bp, Artificial Sequence
  chemically synthesized
tatttattcttccaatccaa

SEQ ID NO: 442138 - DNA, 20 bp, Artificial Sequence
  chemically synthesized
aacatttcatgctcttggat

SEQ ID NO: 442139 - DNA, 20 bp, Artificial Sequence
  chemically synthesized
tgcaaaacatttcatgctct

SEQ ID NO: 442140 - DNA, 20 bp, Artificial Sequence
  chemically synthesized
aacactgctgaaagaaatca

SEQ ID NO: 442141 - DNA, 20 bp, Artificial Sequence
  chemically synthesized
aaaacactgctgaaagaaat

SEQ ID NO: 442142 - DNA, 20 bp, Artificial Sequence
  chemically synthesized
gtgttgtctctgatttcttt

SEQ ID NO: 442143 - DNA, 20 bp, Artificial Sequence
  chemically synthesized
ttgtctctgatttctttcag

SEQ ID NO: 442144 - DNA, 20 bp, Artificial Sequence
  chemically synthesized
gaactacaaaacactgctga

SEQ ID NO: 442145 - DNA, 20 bp, Artificial Sequence
  chemically synthesized
tttctttcagcagtgttttg

SEQ ID NO: 442146 - DNA, 20 bp, Artificial Sequence
  chemically synthesized
gttttgtagttctccttgta

SEQ ID NO: 442147 - DNA, 20 bp, Artificial Sequence
  chemically synthesized
aggtgaaagaactatacaag

SEQ ID NO: 442148 - DNA, 20 bp, Artificial Sequence
  chemically synthesized
ggaggtgaaagaactataca

SEQ ID NO: 442149 - DNA, 20 bp, Artificial Sequence
  chemically synthesized
aggaggtgaaagaactatac

SEQ ID NO: 442150 - DNA, 20 bp, Artificial Sequence
  chemically synthesized
gcagctaaccaaggaggtga

SEQ ID NO: 442151 - DNA, 20 bp, Artificial Sequence
  chemically synthesized
gtatagttctttcacctcct

SEQ ID NO: 442152 - DNA, 20 bp, Artificial Sequence
  chemically synthesized
agttctttcacctccttggt

SEQ ID NO: 442153 - DNA, 20 bp, Artificial Sequence
  chemically synthesized
gaccatgcagctaaccaagg

SEQ ID NO: 442154 - DNA, 20 bp, Artificial Sequence
  chemically synthesized
tgaccatgcagctaaccaag

SEQ ID NO: 442155 - DNA, 20 bp, Artificial Sequence
  chemically synthesized
catgaccatgcagctaacca

SEQ ID NO: 442156 - DNA, 20 bp, Artificial Sequence
  chemically synthesized
tcatgaccatgcagctaacc

SEQ ID NO: 442157 - DNA, 20 bp, Artificial Sequence
  chemically synthesized
cacctccttggttagctgca

SEQ ID NO: 442158 - DNA, 20 bp, Artificial Sequence
  chemically synthesized
cattctttttcatgaccatg

SEQ ID NO: 442159 - DNA, 20 bp, Artificial Sequence
  chemically synthesized
ttagctgcatggtcatgaaa

SEQ ID NO: 442160 - DNA, 20 bp, Artificial Sequence
  chemically synthesized
gaatgaaatcatgtactttg

SEQ ID NO: 442161 - DNA, 20 bp, Artificial Sequence
  chemically synthesized
gaaatcatgtactttgcagc

SEQ ID NO: 442162 - DNA, 20 bp, Artificial Sequence
  chemically synthesized
gctgcattcatcttgctgca

SEQ ID NO: 442163 - DNA, 20 bp, Artificial Sequence
  chemically synthesized
actttgcagcaagatgaatg

SEQ ID NO: 442164 - DNA, 20 bp, Artificial Sequence
  chemically synthesized
tgcagcaagatgaatgcagc

SEQ ID NO: 442165 - DNA, 20 bp, Artificial Sequence
  chemically synthesized
cagcaagatgaatgcagctg

SEQ ID NO: 442166 - DNA, 20 bp, Artificial Sequence
  chemically synthesized
agcaagatgaatgcagctgg

SEQ ID NO: 442167 - DNA, 20 bp, Artificial Sequence
  chemically synthesized
ttgcataggataatggcctc

SEQ ID NO: 442168 - DNA, 20 bp, Artificial Sequence
  chemically synthesized
tgttaatttgcataggataa

SEQ ID NO: 442169 - DNA, 20 bp, Artificial Sequence
  chemically synthesized
gttcctgtgttaatttgcat

SEQ ID NO: 442170 - DNA, 20 bp, Artificial Sequence
  chemically synthesized
tgttcctgtgttaatttgca

SEQ ID NO: 442171 - DNA, 20 bp, Artificial Sequence
  chemically synthesized
ttatcctatgcaaattaaca

SEQ ID NO: 442172 - DNA, 20 bp, Artificial Sequence
  chemically synthesized
tatcctatgcaaattaacac

SEQ ID NO: 442173 - DNA, 20 bp, Artificial Sequence
  chemically synthesized
tatgcaaattaacacaggaa

SEQ ID NO: 442174 - DNA, 20 bp, Artificial Sequence
  chemically synthesized
aagtgagaacatgcggtatt

SEQ ID NO: 442175 - DNA, 20 bp, Artificial Sequence
  chemically synthesized
catttataagtgagaacatg

SEQ ID NO: 442176 - DNA, 20 bp, Artificial Sequence
  chemically synthesized
ttttgctcccatttataagt

SEQ ID NO: 442177 - DNA, 20 bp, Artificial Sequence
  chemically synthesized
cgcatgttctcacttataaa

SEQ ID NO: 442178 - DNA, 20 bp, Artificial Sequence
  chemically synthesized
gcatgttctcacttataaat

SEQ ID NO: 442179 - DNA, 20 bp, Artificial Sequence
  chemically synthesized
agtgttttgctcccatttat

SEQ ID NO: 442180 - DNA, 20 bp, Artificial Sequence
  chemically synthesized
atgttctcacttataaatgg

SEQ ID NO: 442181 - DNA, 20 bp, Artificial Sequence
  chemically synthesized
ataaatgggagcaaaacact

SEQ ID NO: 442182 - DNA, 20 bp, Artificial Sequence
  chemically synthesized
ggagcaaaacactgagtaca

SEQ ID NO: 442183 - DNA, 20 bp, Artificial Sequence
  chemically synthesized
ctttatgtccactgtgtact

SEQ ID NO: 442184 - DNA, 20 bp, Artificial Sequence
  chemically synthesized
gcaaaacactgagtacacag

SEQ ID NO: 442185 - DNA, 20 bp, Artificial Sequence
  chemically synthesized
ctgagtacacagtggacata

SEQ ID NO: 442186 - DNA, 20 bp, Artificial Sequence
  chemically synthesized
gtacacagtggacataaaga

SEQ ID NO: 442187 - DNA, 20 bp, Artificial Sequence
  chemically synthesized
tacacagtggacataaagat

SEQ ID NO: 442188 - DNA, 20 bp, Artificial Sequence
  chemically synthesized
gtggacataaagatgggaac

SEQ ID NO: 442189 - DNA, 20 bp, Artificial Sequence
  chemically synthesized
ggacataaagatgggaacaa

SEQ ID NO: 442190 - DNA, 20 bp, Artificial Sequence
  chemically synthesized
aagatgggaacaagagatac

SEQ ID NO: 442191 - DNA, 20 bp, Artificial Sequence
  chemically synthesized
agatgggaacaagagatact

SEQ ID NO: 442192 - DNA, 20 bp, Artificial Sequence
  chemically synthesized
gatgggaacaagagatactg

SEQ ID NO: 442193 - DNA, 20 bp, Artificial Sequence
  chemically synthesized
attccccctctagtagtccc

SEQ ID NO: 442194 - DNA, 20 bp, Artificial Sequence
  chemically synthesized
caagagatactggggactac

SEQ ID NO: 442195 - DNA, 20 bp, Artificial Sequence
  chemically synthesized
agagatactggggactacta

SEQ ID NO: 442196 - DNA, 20 bp, Artificial Sequence
  chemically synthesized
gagatactggggactactag

SEQ ID NO: 442197 - DNA, 20 bp, Artificial Sequence
  chemically synthesized
agatactggggactactaga

SEQ ID NO: 442198 - DNA, 20 bp, Artificial Sequence
  chemically synthesized
gatactggggactactagag

SEQ ID NO: 442199 - DNA, 20 bp, Artificial Sequence
  chemically synthesized
atactggggactactagagg

SEQ ID NO: 442200 - DNA, 20 bp, Artificial Sequence
  chemically synthesized
tccctccattccccctctag

SEQ ID NO: 442201 - DNA, 20 bp, Artificial Sequence
  chemically synthesized
gcttccctccattccccctc

SEQ ID NO: 442202 - DNA, 20 bp, Artificial Sequence
  chemically synthesized
ggggactactagagggggaa

SEQ ID NO: 442203 - DNA, 20 bp, Artificial Sequence
  chemically synthesized
ggactactagagggggaatg

SEQ ID NO: 442204 - DNA, 20 bp, Artificial Sequence
  chemically synthesized
gactactagagggggaatgg

SEQ ID NO: 442205 - DNA, 20 bp, Artificial Sequence
  chemically synthesized
actactagagggggaatgga

SEQ ID NO: 442206 - DNA, 20 bp, Artificial Sequence
  chemically synthesized
actagagggggaatggaggg

SEQ ID NO: 442207 - DNA, 20 bp, Artificial Sequence
  chemically synthesized
agagggggaatggagggaag

SEQ ID NO: 442208 - DNA, 20 bp, Artificial Sequence
  chemically synthesized
gagggggaatggagggaagc

SEQ ID NO: 442209 - DNA, 20 bp, Artificial Sequence
  chemically synthesized
gaatggagggaagcgggtgt

SEQ ID NO: 442210 - DNA, 20 bp, Artificial Sequence
  chemically synthesized
gtacccagtaggtagttttt

SEQ ID NO: 442211 - DNA, 20 bp, Artificial Sequence
  chemically synthesized
tgagctgaaaaactacctac

SEQ ID NO: 442212 - DNA, 20 bp, Artificial Sequence
  chemically synthesized
gagctgaaaaactacctact

SEQ ID NO: 442213 - DNA, 20 bp, Artificial Sequence
  chemically synthesized
tgagcattgtacccagtagg

SEQ ID NO: 442214 - DNA, 20 bp, Artificial Sequence
  chemically synthesized
tagtgagcattgtacccagt

SEQ ID NO: 442215 - DNA, 20 bp, Artificial Sequence
  chemically synthesized
gtagtgagcattgtacccag

SEQ ID NO: 442216 - DNA, 20 bp, Artificial Sequence
  chemically synthesized
caggtagtgagcattgtacc

SEQ ID NO: 442217 - DNA, 20 bp, Artificial Sequence
  chemically synthesized
tgggtacaatgctcactacc

SEQ ID NO: 442218 - DNA, 20 bp, Artificial Sequence
  chemically synthesized
gggtacaatgctcactacct

SEQ ID NO: 442219 - DNA, 20 bp, Artificial Sequence
  chemically synthesized
gatccagtcacccaggtagt

SEQ ID NO: 442220 - DNA, 20 bp, Artificial Sequence
  chemically synthesized
tgatgatccagtcacccagg

SEQ ID NO: 442221 - DNA, 20 bp, Artificial Sequence
  chemically synthesized
atgctcactacctgggtgac

SEQ ID NO: 442222 - DNA, 20 bp, Artificial Sequence
  chemically synthesized
tactgatgatccagtcaccc

SEQ ID NO: 442223 - DNA, 20 bp, Artificial Sequence
  chemically synthesized
gtactgatgatccagtcacc

SEQ ID NO: 442224 - DNA, 20 bp, Artificial Sequence
  chemically synthesized
tacctgggtgactggatcat

SEQ ID NO: 442225 - DNA, 20 bp, Artificial Sequence
  chemically synthesized
ggtttggggtactgatgatc

SEQ ID NO: 442226 - DNA, 20 bp, Artificial Sequence
  chemically synthesized
ttgtgtgatgtggaggtttg

SEQ ID NO: 442227 - DNA, 20 bp, Artificial Sequence
  chemically synthesized
attgtgtgatgtggaggttt

SEQ ID NO: 442228 - DNA, 20 bp, Artificial Sequence
  chemically synthesized
tattgtgtgatgtggaggtt

SEQ ID NO: 442229 - DNA, 20 bp, Artificial Sequence
  chemically synthesized
gggcatattgtgtgatgtgg

SEQ ID NO: 442230 - DNA, 20 bp, Artificial Sequence
  chemically synthesized
agggcatattgtgtgatgtg

SEQ ID NO: 442231 - DNA, 20 bp, Artificial Sequence
  chemically synthesized
caagggcatattgtgtgatg

SEQ ID NO: 442232 - DNA, 20 bp, Artificial Sequence
  chemically synthesized
tgttcaggagtttgttacaa

SEQ ID NO: 442233 - DNA, 20 bp, Artificial Sequence
  chemically synthesized
atgttcaggagtttgttaca

SEQ ID NO: 442234 - DNA, 20 bp, Artificial Sequence
  chemically synthesized
catgttcaggagtttgttac

SEQ ID NO: 442235 - DNA, 20 bp, Artificial Sequence
  chemically synthesized
aatcgggggtacatgttcag

SEQ ID NO: 442236 - DNA, 20 bp, Artificial Sequence
  chemically synthesized
tgaatcgggggtacatgttc

SEQ ID NO: 442237 - DNA, 20 bp, Artificial Sequence
  chemically synthesized
ttgaatcgggggtacatgtt

SEQ ID NO: 442238 - DNA, 20 bp, Artificial Sequence
  chemically synthesized
caactttcattttgaatcgg

SEQ ID NO: 442239 - DNA, 20 bp, Artificial Sequence
  chemically synthesized
tcaactttcattttgaatcg

SEQ ID NO: 442240 - DNA, 20 bp, Artificial Sequence
  chemically synthesized
ttcaactttcattttgaatc

SEQ ID NO: 442241 - DNA, 20 bp, Artificial Sequence
  chemically synthesized
tttcaactttcattttgaat

SEQ ID NO: 442242 - DNA, 20 bp, Artificial Sequence
  chemically synthesized
gtacccccgattcaaaatga

SEQ ID NO: 442243 - DNA, 20 bp, Artificial Sequence
  chemically synthesized
aatgaaattacaattgttta

SEQ ID NO: 442244 - DNA, 20 bp, Artificial Sequence
  chemically synthesized
ttgtttacagatgaattaat

SEQ ID NO: 442245 - DNA, 20 bp, Artificial Sequence
  chemically synthesized
atacatttttcaaaaatata

SEQ ID NO: 442246 - DNA, 20 bp, Artificial Sequence
  chemically synthesized
ataaagcataatttttatta

SEQ ID NO: 442247 - DNA, 20 bp, Artificial Sequence
  chemically synthesized
taatttaaaaaaatgtgtat

SEQ ID NO: 442248 - DNA, 20 bp, Artificial Sequence
  chemically synthesized
atctaagtgtagacaaaaaa

SEQ ID NO: 442249 - DNA, 20 bp, Artificial Sequence
  chemically synthesized
tacttttttttgtctacact

SEQ ID NO: 442250 - DNA, 20 bp, Artificial Sequence
  chemically synthesized
caacatgtatcatctaagtg

SEQ ID NO: 442251 - DNA, 20 bp, Artificial Sequence
  chemically synthesized
ttttacaacatgtatcatct

SEQ ID NO: 442252 - DNA, 20 bp, Artificial Sequence
  chemically synthesized
atgatacatgttgtaaaatg

SEQ ID NO: 442253 - DNA, 20 bp, Artificial Sequence
  chemically synthesized
acatgttgtaaaatgaagac

SEQ ID NO: 442254 - DNA, 20 bp, Artificial Sequence
  chemically synthesized
attggaatataatcatgggc

SEQ ID NO: 442255 - DNA, 20 bp, Artificial Sequence
  chemically synthesized
taatattggaatataatcat

SEQ ID NO: 442256 - DNA, 20 bp, Artificial Sequence
  chemically synthesized
ttaatattggaatataatca

SEQ ID NO: 442257 - DNA, 20 bp, Artificial Sequence
  chemically synthesized
caaggatgactggttaatat

SEQ ID NO: 442258 - DNA, 20 bp, Artificial Sequence
  chemically synthesized
gattatattccaatattaac

SEQ ID NO: 442259 - DNA, 20 bp, Artificial Sequence
  chemically synthesized
tttaataacacaaggatgac

SEQ ID NO: 442260 - DNA, 20 bp, Artificial Sequence
  chemically synthesized
gccatctatttaataacaca

SEQ ID NO: 442261 - DNA, 20 bp, Artificial Sequence
  chemically synthesized
tgccatctatttaataacac

SEQ ID NO: 442262 - DNA, 20 bp, Artificial Sequence
  chemically synthesized
gtcatccttgtgttattaaa

SEQ ID NO: 442263 - DNA, 20 bp, Artificial Sequence
  chemically synthesized
tccttgtgttattaaataga

SEQ ID NO: 442264 - DNA, 20 bp, Artificial Sequence
  chemically synthesized
taaatagatggcatattaat

SEQ ID NO: 442265 - DNA, 20 bp, Artificial Sequence
  chemically synthesized
tagatggcatattaattaga

SEQ ID NO: 442266 - DNA, 20 bp, Artificial Sequence
  chemically synthesized
taattagaaagaactgaata

SEQ ID NO: 442267 - DNA, 20 bp, Artificial Sequence
  chemically synthesized
cactttacgtttaccatatt

SEQ ID NO: 442268 - DNA, 20 bp, Artificial Sequence
  chemically synthesized
aactgaatatggtaaacgta

SEQ ID NO: 442269 - DNA, 20 bp, Artificial Sequence
  chemically synthesized
atggtaaacgtaaagtgaac

SEQ ID NO: 442270 - DNA, 20 bp, Artificial Sequence
  chemically synthesized
tggtaaacgtaaagtgaaca

SEQ ID NO: 442271 - DNA, 20 bp, Artificial Sequence
  chemically synthesized
gtaaacgtaaagtgaacaag

SEQ ID NO: 442272 - DNA, 20 bp, Artificial Sequence
  chemically synthesized
ggagttaattcttaaataat

SEQ ID NO: 442273 - DNA, 20 bp, Artificial Sequence
  chemically synthesized
tttagggtttccaattattt

SEQ ID NO: 442274 - DNA, 20 bp, Artificial Sequence
  chemically synthesized
ttaaataattggaaacccta

SEQ ID NO: 442275 - DNA, 20 bp, Artificial Sequence
  chemically synthesized
taaataattggaaaccctaa

SEQ ID NO: 442276 - DNA, 20 bp, Artificial Sequence
  chemically synthesized
aatataaaataatgccttta

SEQ ID NO: 442277 - DNA, 20 bp, Artificial Sequence
  chemically synthesized
taatataaaataatgccttt

SEQ ID NO: 442278 - DNA, 20 bp, Artificial Sequence
  chemically synthesized
gtaatataaaataatgcctt

SEQ ID NO: 442279 - DNA, 20 bp, Artificial Sequence
  chemically synthesized
ggcattattttatattactt

SEQ ID NO: 442280 - DNA, 20 bp, Artificial Sequence
  chemically synthesized
attattttatattactttgg

SEQ ID NO: 442281 - DNA, 20 bp, Artificial Sequence
  chemically synthesized
aaaatgaccctgcacttcca

SEQ ID NO: 442282 - DNA, 20 bp, Artificial Sequence
  chemically synthesized
tttatattactttggaagtg

SEQ ID NO: 442283 - DNA, 20 bp, Artificial Sequence
  chemically synthesized
ttatattactttggaagtgc

SEQ ID NO: 442284 - DNA, 20 bp, Artificial Sequence
  chemically synthesized
tatattactttggaagtgca

SEQ ID NO: 442285 - DNA, 20 bp, Artificial Sequence
  chemically synthesized
attaaataatcaaacaagtt

SEQ ID NO: 442286 - DNA, 20 bp, Artificial Sequence
  chemically synthesized
tattaaataatcaaacaagt

SEQ ID NO: 442287 - DNA, 20 bp, Artificial Sequence
  chemically synthesized
attatattaaataatcaaac

SEQ ID NO: 442288 - DNA, 20 bp, Artificial Sequence
  chemically synthesized
tgattatttaatataattcc

SEQ ID NO: 442289 - DNA, 20 bp, Artificial Sequence
  chemically synthesized
gctgcattaatcataatgct

SEQ ID NO: 442290 - DNA, 20 bp, Artificial Sequence
  chemically synthesized
tccaagcattatgattaatg

SEQ ID NO: 442291 - DNA, 20 bp, Artificial Sequence
  chemically synthesized
ttatgattaatgcagcttca

SEQ ID NO: 442292 - DNA, 20 bp, Artificial Sequence
  chemically synthesized
tatgattaatgcagcttcac

SEQ ID NO: 442293 - DNA, 20 bp, Artificial Sequence
  chemically synthesized
ttcaacttatttgtcctgtg

SEQ ID NO: 442294 - DNA, 20 bp, Artificial Sequence
  chemically synthesized
tgcagcttcacaggacaaat

SEQ ID NO: 442295 - DNA, 20 bp, Artificial Sequence
  chemically synthesized
ttcacaggacaaataagttg

SEQ ID NO: 442296 - DNA, 20 bp, Artificial Sequence
  chemically synthesized
cacaggacaaataagttgaa

SEQ ID NO: 442297 - DNA, 20 bp, Artificial Sequence
  chemically synthesized
acaaataagttgaagagaaa

SEQ ID NO: 442298 - DNA, 20 bp, Artificial Sequence
  chemically synthesized
caaataagttgaagagaaac

SEQ ID NO: 442299 - DNA, 20 bp, Artificial Sequence
  chemically synthesized
ttgaagagaaacaggcttat

SEQ ID NO: 442300 - DNA, 20 bp, Artificial Sequence
  chemically synthesized
tgaagagaaacaggcttatt

SEQ ID NO: 442301 - DNA, 20 bp, Artificial Sequence
  chemically synthesized
atataagtatattacctaat

SEQ ID NO: 442302 - DNA, 20 bp, Artificial Sequence
  chemically synthesized
taaatttgtgaattttatat

SEQ ID NO: 442303 - DNA, 20 bp, Artificial Sequence
  chemically synthesized
aaattcacaaatttattgat

SEQ ID NO: 442304 - DNA, 20 bp, Artificial Sequence
  chemically synthesized
aattcacaaatttattgatt

SEQ ID NO: 442305 - DNA, 20 bp, Artificial Sequence
  chemically synthesized
attcacaaatttattgatta

SEQ ID NO: 442306 - DNA, 20 bp, Artificial Sequence
  chemically synthesized
gattagggaaaaaatcatta

SEQ ID NO: 442307 - DNA, 20 bp, Artificial Sequence
  chemically synthesized
atcactgtggaaaaaggaag

SEQ ID NO: 442308 - DNA, 20 bp, Artificial Sequence
  chemically synthesized
tggatcactgtggaaaaagg

SEQ ID NO: 442309 - DNA, 20 bp, Artificial Sequence
  chemically synthesized
atttctacttcctttttcca

SEQ ID NO: 442310 - DNA, 20 bp, Artificial Sequence
  chemically synthesized
atatggatcactgtggaaaa

SEQ ID NO: 442311 - DNA, 20 bp, Artificial Sequence
  chemically synthesized
aatatggatcactgtggaaa

SEQ ID NO: 442312 - DNA, 20 bp, Artificial Sequence
  chemically synthesized
tcaaccaatatggatcactg

SEQ ID NO: 442313 - DNA, 20 bp, Artificial Sequence
  chemically synthesized
ttttccacagtgatccatat

SEQ ID NO: 442314 - DNA, 20 bp, Artificial Sequence
  chemically synthesized
gggtaacatttcaaccaata

SEQ ID NO: 442315 - DNA, 20 bp, Artificial Sequence
  chemically synthesized
tgaaatgttacccatattat

SEQ ID NO: 442316 - DNA, 20 bp, Artificial Sequence
  chemically synthesized
aaatatatgccttataatat

SEQ ID NO: 442317 - DNA, 20 bp, Artificial Sequence
  chemically synthesized
gaaatgttacccatattata

SEQ ID NO: 442318 - DNA, 20 bp, Artificial Sequence
  chemically synthesized
gaaatatatgccttataata

SEQ ID NO: 442319 - DNA, 20 bp, Artificial Sequence
  chemically synthesized
attataaggcatatatttct

SEQ ID NO: 442320 - DNA, 20 bp, Artificial Sequence
  chemically synthesized
ttataaggcatatatttctt

SEQ ID NO: 442321 - DNA, 20 bp, Artificial Sequence
  chemically synthesized
aagagattttttaaacacct

SEQ ID NO: 442322 - DNA, 20 bp, Artificial Sequence
  chemically synthesized
aggtgtttaaaaaatctctt

SEQ ID NO: 442323 - DNA, 20 bp, Artificial Sequence
  chemically synthesized
tttaaaaaatctctttagtt

SEQ ID NO: 442324 - DNA, 20 bp, Artificial Sequence
  chemically synthesized
tcccattggacttaactaaa

SEQ ID NO: 442325 - DNA, 20 bp, Artificial Sequence
  chemically synthesized
tttcccattggacttaacta

SEQ ID NO: 442326 - DNA, 20 bp, Artificial Sequence
  chemically synthesized
atctctttagttaagtccaa

SEQ ID NO: 442327 - DNA, 20 bp, Artificial Sequence
  chemically synthesized
tctctttagttaagtccaat

SEQ ID NO: 442328 - DNA, 20 bp, Artificial Sequence
  chemically synthesized
aaactagcatattttcccat

SEQ ID NO: 442329 - DNA, 20 bp, Artificial Sequence
  chemically synthesized
agtccaatgggaaaatatgc

SEQ ID NO: 442330 - DNA, 20 bp, Artificial Sequence
  chemically synthesized
gggaaaatatgctagtttgt

SEQ ID NO: 442331 - DNA, 20 bp, Artificial Sequence
  chemically synthesized
ctataaactcactcacaaac

SEQ ID NO: 442332 - DNA, 20 bp, Artificial Sequence
  chemically synthesized
aaatatgctagtttgtgagt

SEQ ID NO: 442333 - DNA, 20 bp, Artificial Sequence
  chemically synthesized
ctagtttgtgagtgagttta

SEQ ID NO: 442334 - DNA, 20 bp, Artificial Sequence
  chemically synthesized
tagtttgtgagtgagtttat

SEQ ID NO: 442335 - DNA, 20 bp, Artificial Sequence
  chemically synthesized
gtgagtgagtttataggcac

SEQ ID NO: 442336 - DNA, 20 bp, Artificial Sequence
  chemically synthesized
tgagtgagtttataggcact

SEQ ID NO: 442337 - DNA, 20 bp, Artificial Sequence
  chemically synthesized
gagtttataggcactaggac

SEQ ID NO: 442338 - DNA, 20 bp, Artificial Sequence
  chemically synthesized
tgtcttattttttctggtcc

SEQ ID NO: 442339 - DNA, 20 bp, Artificial Sequence
  chemically synthesized
tctatttgtcttattttttc

SEQ ID NO: 442340 - DNA, 20 bp, Artificial Sequence
  chemically synthesized
gcactaggaccagaaaaaat

SEQ ID NO: 442341 - DNA, 20 bp, Artificial Sequence
  chemically synthesized
accagaaaaaataagacaaa

SEQ ID NO: 442342 - DNA, 20 bp, Artificial Sequence
  chemically synthesized
aaataagacaaatagaattc

SEQ ID NO: 442343 - DNA, 20 bp, Artificial Sequence
  chemically synthesized
caaatagaattcaagcaatt

SEQ ID NO: 442344 - DNA, 20 bp, Artificial Sequence
  chemically synthesized
aatagaattcaagcaatttg

SEQ ID NO: 442345 - DNA, 20 bp, Artificial Sequence
  chemically synthesized
atagaattcaagcaatttgg

SEQ ID NO: 442346 - DNA, 20 bp, Artificial Sequence
  chemically synthesized
tagaattcaagcaatttgga

SEQ ID NO: 442347 - DNA, 20 bp, Artificial Sequence
  chemically synthesized
caatttggagggtgtccaaa

SEQ ID NO: 442348 - DNA, 20 bp, Artificial Sequence
  chemically synthesized
gtgaaacatttttgtctatt

SEQ ID NO: 442349 - DNA, 20 bp, Artificial Sequence
  chemically synthesized
tgcaattcctatcaaaacat

SEQ ID NO: 442350 - DNA, 20 bp, Artificial Sequence
  chemically synthesized
atgtttcactgatgttttga

SEQ ID NO: 442351 - DNA, 20 bp, Artificial Sequence
  chemically synthesized
tgtttcactgatgttttgat

SEQ ID NO: 442352 - DNA, 20 bp, Artificial Sequence
  chemically synthesized
taggaattgcattcaaacta

SEQ ID NO: 442353 - DNA, 20 bp, Artificial Sequence
  chemically synthesized
attgcattcaaactatagat

SEQ ID NO: 442354 - DNA, 20 bp, Artificial Sequence
  chemically synthesized
attcttccaaaactaatcta

SEQ ID NO: 442355 - DNA, 20 bp, Artificial Sequence
  chemically synthesized
ttcaaactatagattagttt

SEQ ID NO: 442356 - DNA, 20 bp, Artificial Sequence
  chemically synthesized
aaactatagattagttttgg

SEQ ID NO: 442357 - DNA, 20 bp, Artificial Sequence
  chemically synthesized
tggaattggaggatacaaca

SEQ ID NO: 442358 - DNA, 20 bp, Artificial Sequence
  chemically synthesized
tactgtattaatggaattgg

SEQ ID NO: 442359 - DNA, 20 bp, Artificial Sequence
  chemically synthesized
atactgtattaatggaattg

SEQ ID NO: 442360 - DNA, 20 bp, Artificial Sequence
  chemically synthesized
atatactgtattaatggaat

SEQ ID NO: 442361 - DNA, 20 bp, Artificial Sequence
  chemically synthesized
atcctccaattccattaata

SEQ ID NO: 442362 - DNA, 20 bp, Artificial Sequence
  chemically synthesized
ggagatatatactgtattaa

SEQ ID NO: 442363 - DNA, 20 bp, Artificial Sequence
  chemically synthesized
tgcaaagacttaaataaacg

SEQ ID NO: 442364 - DNA, 20 bp, Artificial Sequence
  chemically synthesized
gtatatatctccgtttattt

SEQ ID NO: 442365 - DNA, 20 bp, Artificial Sequence
  chemically synthesized
aatgcaaagacttaaataaa

SEQ ID NO: 442366 - DNA, 20 bp, Artificial Sequence
  chemically synthesized
aaagctaaggaaataatgca

SEQ ID NO: 442367 - DNA, 20 bp, Artificial Sequence
  chemically synthesized
aagtctttgcattatttcct

SEQ ID NO: 442368 - DNA, 20 bp, Artificial Sequence
  chemically synthesized
tactacaaactaaaaagcta

SEQ ID NO: 442369 - DNA, 20 bp, Artificial Sequence
  chemically synthesized
gcattatttccttagctttt

SEQ ID NO: 442370 - DNA, 20 bp, Artificial Sequence
  chemically synthesized
atactacaaactaaaaagct

SEQ ID NO: 442371 - DNA, 20 bp, Artificial Sequence
  chemically synthesized
tctatatactacaaactaaa

SEQ ID NO: 442372 - DNA, 20 bp, Artificial Sequence
  chemically synthesized
ttccttagctttttagtttg

SEQ ID NO: 442373 - DNA, 20 bp, Artificial Sequence
  chemically synthesized
gctttttagtttgtagtata

SEQ ID NO: 442374 - DNA, 20 bp, Artificial Sequence
  chemically synthesized
tagtttgtagtatatagatc

SEQ ID NO: 442375 - DNA, 20 bp, Artificial Sequence
  chemically synthesized
gaatctaataaaacatttac

SEQ ID NO: 442376 - DNA, 20 bp, Artificial Sequence
  chemically synthesized
agatctggtaaatgttttat

SEQ ID NO: 442377 - DNA, 20 bp, Artificial Sequence
  chemically synthesized
aaatgttttattagattcat

SEQ ID NO: 442378 - DNA, 20 bp, Artificial Sequence
  chemically synthesized
tcataagtatttcattgttt

SEQ ID NO: 442379 - DNA, 20 bp, Artificial Sequence
  chemically synthesized
ataagtatttcattgtttca

SEQ ID NO: 442380 - DNA, 20 bp, Artificial Sequence
  chemically synthesized
cattgtttcagagtgactgc

SEQ ID NO: 442381 - DNA, 20 bp, Artificial Sequence
  chemically synthesized
atttttcacatagtatcttg

SEQ ID NO: 442382 - DNA, 20 bp, Artificial Sequence
  chemically synthesized
gaaacccaaaatttttcaca

SEQ ID NO: 442383 - DNA, 20 bp, Artificial Sequence
  chemically synthesized
agatactatgtgaaaaattt

SEQ ID NO: 442384 - DNA, 20 bp, Artificial Sequence
  chemically synthesized
gatactatgtgaaaaatttt

SEQ ID NO: 442385 - DNA, 20 bp, Artificial Sequence
  chemically synthesized
atgtgaaaaattttgggttt

SEQ ID NO: 442386 - DNA, 20 bp, Artificial Sequence
  chemically synthesized
tgaaaaattttgggtttcag

SEQ ID NO: 442387 - DNA, 20 bp, Artificial Sequence
  chemically synthesized
ttaattgtatttttgtatac

SEQ ID NO: 442388 - DNA, 20 bp, Artificial Sequence
  chemically synthesized
aataatcattttactgtgat

SEQ ID NO: 442389 - DNA, 20 bp, Artificial Sequence
  chemically synthesized
tctcatattaaatcttatca

SEQ ID NO: 442390 - DNA, 20 bp, Artificial Sequence
  chemically synthesized
actgtgataagatttaatat

SEQ ID NO: 442391 - DNA, 20 bp, Artificial Sequence
  chemically synthesized
ttaagaatctgttcgttggg

SEQ ID NO: 442392 - DNA, 20 bp, Artificial Sequence
  chemically synthesized
tatgagatctacccaacgaa

SEQ ID NO: 442393 - DNA, 20 bp, Artificial Sequence
  chemically synthesized
aatttaagaatctgttcgtt

SEQ ID NO: 442394 - DNA, 20 bp, Artificial Sequence
  chemically synthesized
taatttaagaatctgttcgt

SEQ ID NO: 442395 - DNA, 20 bp, Artificial Sequence
  chemically synthesized
acaatacagcattataattt

SEQ ID NO: 442396 - DNA, 20 bp, Artificial Sequence
  chemically synthesized
cgtatctatatgtaacaata

SEQ ID NO: 442397 - DNA, 20 bp, Artificial Sequence
  chemically synthesized
taatgctgtattgttacata

SEQ ID NO: 442398 - DNA, 20 bp, Artificial Sequence
  chemically synthesized
catatagatacgatgttgta

SEQ ID NO: 442399 - DNA, 20 bp, Artificial Sequence
  chemically synthesized
atagatacgatgttgtacag

SEQ ID NO: 442400 - DNA, 20 bp, Artificial Sequence
  chemically synthesized
gatgttgtacagcagatctc

SEQ ID NO: 442401 - DNA, 20 bp, Artificial Sequence
  chemically synthesized
tataagatgaataagttcta

SEQ ID NO: 442402 - DNA, 20 bp, Artificial Sequence
  chemically synthesized
tatataagatgaataagttc

SEQ ID NO: 442403 - DNA, 20 bp, Artificial Sequence
  chemically synthesized
ttcatttatataagatgaat

SEQ ID NO: 442404 - DNA, 20 bp, Artificial Sequence
  chemically synthesized
atatgaagtttcatttatat

SEQ ID NO: 442405 - DNA, 20 bp, Artificial Sequence
  chemically synthesized
attgctaatcaatgaatatg

SEQ ID NO: 442406 - DNA, 20 bp, Artificial Sequence
  chemically synthesized
gaaacttcatattcattgat

SEQ ID NO: 442407 - DNA, 20 bp, Artificial Sequence
  chemically synthesized
gattagcaattgacttttat

SEQ ID NO: 442408 - DNA, 20 bp, Artificial Sequence
  chemically synthesized
gatacaagatcaacttataa

SEQ ID NO: 442409 - DNA, 20 bp, Artificial Sequence
  chemically synthesized
ataagttgatcttgtatcct

SEQ ID NO: 442410 - DNA, 20 bp, Artificial Sequence
  chemically synthesized
ttgttaaggtcttaggatac

SEQ ID NO: 442411 - DNA, 20 bp, Artificial Sequence
  chemically synthesized
gatgagtttgttaaggtctt

SEQ ID NO: 442412 - DNA, 20 bp, Artificial Sequence
  chemically synthesized
tgatgagtttgttaaggtct

SEQ ID NO: 442413 - DNA, 20 bp, Artificial Sequence
  chemically synthesized
tagaaatgatgagtttgtta

SEQ ID NO: 442414 - DNA, 20 bp, Artificial Sequence
  chemically synthesized
ttagaaatgatgagtttgtt

SEQ ID NO: 442415 - DNA, 20 bp, Artificial Sequence
  chemically synthesized
aagttactcttagaaatgat

SEQ ID NO: 442416 - DNA, 20 bp, Artificial Sequence
  chemically synthesized
ttaacaaactcatcatttct

SEQ ID NO: 442417 - DNA, 20 bp, Artificial Sequence
  chemically synthesized
aacaaactcatcatttctaa

SEQ ID NO: 442418 - DNA, 20 bp, Artificial Sequence
  chemically synthesized
gtattctacaaagttactct

SEQ ID NO: 442419 - DNA, 20 bp, Artificial Sequence
  chemically synthesized
catttctaagagtaactttg

SEQ ID NO: 442420 - DNA, 20 bp, Artificial Sequence
  chemically synthesized
aaaatcccaggtattctaca

SEQ ID NO: 442421 - DNA, 20 bp, Artificial Sequence
  chemically synthesized
gagtaactttgtagaatacc

SEQ ID NO: 442422 - DNA, 20 bp, Artificial Sequence
  chemically synthesized
agtaactttgtagaatacct

SEQ ID NO: 442423 - DNA, 20 bp, Artificial Sequence
  chemically synthesized
gatgatctatgtaaaatccc

SEQ ID NO: 442424 - DNA, 20 bp, Artificial Sequence
  chemically synthesized
tgatgatctatgtaaaatcc

SEQ ID NO: 442425 - DNA, 20 bp, Artificial Sequence
  chemically synthesized
agaatacctgggattttaca

SEQ ID NO: 442426 - DNA, 20 bp, Artificial Sequence
  chemically synthesized
atcatcataacatctgcaaa

SEQ ID NO: 442427 - DNA, 20 bp, Artificial Sequence
  chemically synthesized
catcataacatctgcaaatg

SEQ ID NO: 442428 - DNA, 20 bp, Artificial Sequence
  chemically synthesized
agttatactgtctccatttg

SEQ ID NO: 442429 - DNA, 20 bp, Artificial Sequence
  chemically synthesized
ataacatctgcaaatggaga

SEQ ID NO: 442430 - DNA, 20 bp, Artificial Sequence
  chemically synthesized
gcgtacaaatcaggaaggaa

SEQ ID NO: 442431 - DNA, 20 bp, Artificial Sequence
  chemically synthesized
taaaagcgtacaaatcagga

SEQ ID NO: 442432 - DNA, 20 bp, Artificial Sequence
  chemically synthesized
ataaaagcgtacaaatcagg

SEQ ID NO: 442433 - DNA, 20 bp, Artificial Sequence
  chemically synthesized
tggataaaagcgtacaaatc

SEQ ID NO: 442434 - DNA, 20 bp, Artificial Sequence
  chemically synthesized
gtggataaaagcgtacaaat

SEQ ID NO: 442435 - DNA, 20 bp, Artificial Sequence
  chemically synthesized
aatgcaagaaaagtggataa

SEQ ID NO: 442436 - DNA, 20 bp, Artificial Sequence
  chemically synthesized
gtgtaaaaatgcaagaaaag

SEQ ID NO: 442437 - DNA, 20 bp, Artificial Sequence
  chemically synthesized
ctagtgtaaaaatgcaagaa

SEQ ID NO: 442438 - DNA, 20 bp, Artificial Sequence
  chemically synthesized
tctagctagtgtaaaaatgc

SEQ ID NO: 442439 - DNA, 20 bp, Artificial Sequence
  chemically synthesized
cttttcttgcatttttacac

SEQ ID NO: 442440 - DNA, 20 bp, Artificial Sequence
  chemically synthesized
tcttgcatttttacactagc

SEQ ID NO: 442441 - DNA, 20 bp, Artificial Sequence
  chemically synthesized
atagtactggaagttctagc

SEQ ID NO: 442442 - DNA, 20 bp, Artificial Sequence
  chemically synthesized
tttacactagctagaacttc

SEQ ID NO: 442443 - DNA, 20 bp, Artificial Sequence
  chemically synthesized
attcatagtactggaagttc

SEQ ID NO: 442444 - DNA, 20 bp, Artificial Sequence
  chemically synthesized
actattattcatagtactgg

SEQ ID NO: 442445 - DNA, 20 bp, Artificial Sequence
  chemically synthesized
cctactattattcatagtac

SEQ ID NO: 442446 - DNA, 20 bp, Artificial Sequence
  chemically synthesized
acttccagtactatgaataa

SEQ ID NO: 442447 - DNA, 20 bp, Artificial Sequence
  chemically synthesized
ttcagccctactattattca

SEQ ID NO: 442448 - DNA, 20 bp, Artificial Sequence
  chemically synthesized
tccagtactatgaataatag

SEQ ID NO: 442449 - DNA, 20 bp, Artificial Sequence
  chemically synthesized
ccagtactatgaataatagt

SEQ ID NO: 442450 - DNA, 20 bp, Artificial Sequence
  chemically synthesized
cagtactatgaataatagta

SEQ ID NO: 442451 - DNA, 20 bp, Artificial Sequence
  chemically synthesized
atgaataatagtagggctga

SEQ ID NO: 442452 - DNA, 20 bp, Artificial Sequence
  chemically synthesized
aaggcaaagacggttgcttt

SEQ ID NO: 442453 - DNA, 20 bp, Artificial Sequence
  chemically synthesized
tattaggattaaggcaaaga

SEQ ID NO: 442454 - DNA, 20 bp, Artificial Sequence
  chemically synthesized
ctaatattaggattaaggca

SEQ ID NO: 442455 - DNA, 20 bp, Artificial Sequence
  chemically synthesized
tcttcctaatattaggatta

SEQ ID NO: 442456 - DNA, 20 bp, Artificial Sequence
  chemically synthesized
ttcttcctaatattaggatt

SEQ ID NO: 442457 - DNA, 20 bp, Artificial Sequence
  chemically synthesized
ctttgccttaatcctaatat

SEQ ID NO: 442458 - DNA, 20 bp, Artificial Sequence
  chemically synthesized
tttgccttaatcctaatatt

SEQ ID NO: 442459 - DNA, 20 bp, Artificial Sequence
  chemically synthesized
acacctttcttcctaatatt

SEQ ID NO: 442460 - DNA, 20 bp, Artificial Sequence
  chemically synthesized
tacacctttcttcctaatat

SEQ ID NO: 442461 - DNA, 20 bp, Artificial Sequence
  chemically synthesized
gccttaatcctaatattagg

SEQ ID NO: 442462 - DNA, 20 bp, Artificial Sequence
  chemically synthesized
taatcctaatattaggaaga

SEQ ID NO: 442463 - DNA, 20 bp, Artificial Sequence
  chemically synthesized
aatcctaatattaggaagaa

SEQ ID NO: 442464 - DNA, 20 bp, Artificial Sequence
  chemically synthesized
taacattgtaataataatga

SEQ ID NO: 442465 - DNA, 20 bp, Artificial Sequence
  chemically synthesized
tttcattattattacaatgt

SEQ ID NO: 442466 - DNA, 20 bp, Artificial Sequence
  chemically synthesized
attattacaatgttagctat

SEQ ID NO: 442467 - DNA, 20 bp, Artificial Sequence
  chemically synthesized
gaataactacagaaatctta

SEQ ID NO: 442468 - DNA, 20 bp, Artificial Sequence
  chemically synthesized
tgttagctataagatttctg

SEQ ID NO: 442469 - DNA, 20 bp, Artificial Sequence
  chemically synthesized
aacttggaaaagaataacta

SEQ ID NO: 442470 - DNA, 20 bp, Artificial Sequence
  chemically synthesized
ttctgtagttattcttttcc

SEQ ID NO: 442471 - DNA, 20 bp, Artificial Sequence
  chemically synthesized
agaacgtcctcaacttggaa

SEQ ID NO: 442472 - DNA, 20 bp, Artificial Sequence
  chemically synthesized
tagttattcttttccaagtt

SEQ ID NO: 442473 - DNA, 20 bp, Artificial Sequence
  chemically synthesized
agttattcttttccaagttg

SEQ ID NO: 442474 - DNA, 20 bp, Artificial Sequence
  chemically synthesized
ggaggagaacgtcctcaact

SEQ ID NO: 442475 - DNA, 20 bp, Artificial Sequence
  chemically synthesized
tcagaaaactaacaatggag

SEQ ID NO: 442476 - DNA, 20 bp, Artificial Sequence
  chemically synthesized
aggacgttctcctccattgt

SEQ ID NO: 442477 - DNA, 20 bp, Artificial Sequence
  chemically synthesized
tctcagaaaactaacaatgg

SEQ ID NO: 442478 - DNA, 20 bp, Artificial Sequence
  chemically synthesized
ctctcagaaaactaacaatg

SEQ ID NO: 442479 - DNA, 20 bp, Artificial Sequence
  chemically synthesized
agctctcagaaaactaacaa

SEQ ID NO: 442480 - DNA, 20 bp, Artificial Sequence
  chemically synthesized
tcctccattgttagttttct

SEQ ID NO: 442481 - DNA, 20 bp, Artificial Sequence
  chemically synthesized
ctccattgttagttttctga

SEQ ID NO: 442482 - DNA, 20 bp, Artificial Sequence
  chemically synthesized
ccatttatgataaaagctct

SEQ ID NO: 442483 - DNA, 20 bp, Artificial Sequence
  chemically synthesized
cagtgccccatttatgataa

SEQ ID NO: 442484 - DNA, 20 bp, Artificial Sequence
  chemically synthesized
ctgagagcttttatcataaa

SEQ ID NO: 442485 - DNA, 20 bp, Artificial Sequence
  chemically synthesized
tgagagcttttatcataaat

SEQ ID NO: 442486 - DNA, 20 bp, Artificial Sequence
  chemically synthesized
gagagcttttatcataaatg

SEQ ID NO: 442487 - DNA, 20 bp, Artificial Sequence
  chemically synthesized
aaaaaacgtttgacaaaatt

SEQ ID NO: 442488 - DNA, 20 bp, Artificial Sequence
  chemically synthesized
gatcatatcaattgatggag

SEQ ID NO: 442489 - DNA, 20 bp, Artificial Sequence
  chemically synthesized
tgatcatatcaattgatgga

SEQ ID NO: 442490 - DNA, 20 bp, Artificial Sequence
  chemically synthesized
ttgatcatatcaattgatgg

SEQ ID NO: 442491 - DNA, 20 bp, Artificial Sequence
  chemically synthesized
cttgatcatatcaattgatg

SEQ ID NO: 442492 - DNA, 20 bp, Artificial Sequence
  chemically synthesized
cacttgatcatatcaattga

SEQ ID NO: 442493 - DNA, 20 bp, Artificial Sequence
  chemically synthesized
ctccatcaattgatatgatc

SEQ ID NO: 442494 - DNA, 20 bp, Artificial Sequence
  chemically synthesized
atcaagtgattattcttctt

SEQ ID NO: 442495 - DNA, 20 bp, Artificial Sequence
  chemically synthesized
attatattaagaagctaaag

SEQ ID NO: 442496 - DNA, 20 bp, Artificial Sequence
  chemically synthesized
cacattatattaagaagcta

SEQ ID NO: 442497 - DNA, 20 bp, Artificial Sequence
  chemically synthesized
tttttacacattatattaag

SEQ ID NO: 442498 - DNA, 20 bp, Artificial Sequence
  chemically synthesized
aaatttttacacattatatt

SEQ ID NO: 442499 - DNA, 20 bp, Artificial Sequence
  chemically synthesized
ataatgtgtaaaaatttgtt

SEQ ID NO: 442500 - DNA, 20 bp, Artificial Sequence
  chemically synthesized
taatgtgtaaaaatttgtta

SEQ ID NO: 442501 - DNA, 20 bp, Artificial Sequence
  chemically synthesized
ctcatggatatagagacaaa

SEQ ID NO: 442502 - DNA, 20 bp, Artificial Sequence
  chemically synthesized
caataaaactcatggatata

SEQ ID NO: 442503 - DNA, 20 bp, Artificial Sequence
  chemically synthesized
ctttttgtctctatatccat

SEQ ID NO: 442504 - DNA, 20 bp, Artificial Sequence
  chemically synthesized
accaataaaactcatggata

SEQ ID NO: 442505 - DNA, 20 bp, Artificial Sequence
  chemically synthesized
ttacagaccaataaaactca

SEQ ID NO: 442506 - DNA, 20 bp, Artificial Sequence
  chemically synthesized
tctatatccatgagttttat

SEQ ID NO: 442507 - DNA, 20 bp, Artificial Sequence
  chemically synthesized
gtagaagagtcaacaaatta

SEQ ID NO: 442508 - DNA, 20 bp, Artificial Sequence
  chemically synthesized
accaggtaagcacagtagaa

SEQ ID NO: 442509 - DNA, 20 bp, Artificial Sequence
  chemically synthesized
aaaccaggtaagcacagtag

SEQ ID NO: 442510 - DNA, 20 bp, Artificial Sequence
  chemically synthesized
ataaaaccaggtaagcacag

SEQ ID NO: 442511 - DNA, 20 bp, Artificial Sequence
  chemically synthesized
ataataaaaccaggtaagca

SEQ ID NO: 442512 - DNA, 20 bp, Artificial Sequence
  chemically synthesized
actcttctactgtgcttacc

SEQ ID NO: 442513 - DNA, 20 bp, Artificial Sequence
  chemically synthesized
ttttgataataaaaccaggt

SEQ ID NO: 442514 - DNA, 20 bp, Artificial Sequence
  chemically synthesized
agtattttgataataaaacc

SEQ ID NO: 442515 - DNA, 20 bp, Artificial Sequence
  chemically synthesized
aagtattttgataataaaac

SEQ ID NO: 442516 - DNA, 20 bp, Artificial Sequence
  chemically synthesized
aaatgtactttatgaggaag

SEQ ID NO: 442517 - DNA, 20 bp, Artificial Sequence
  chemically synthesized
caaaatacttcttcctcata

SEQ ID NO: 442518 - DNA, 20 bp, Artificial Sequence
  chemically synthesized
tccaaatgtactttatgagg

SEQ ID NO: 442519 - DNA, 20 bp, Artificial Sequence
  chemically synthesized
acttccaaatgtactttatg

SEQ ID NO: 442520 - DNA, 20 bp, Artificial Sequence
  chemically synthesized
cacttccaaatgtactttat

SEQ ID NO: 442521 - DNA, 20 bp, Artificial Sequence
  chemically synthesized
tcttcctcataaagtacatt

SEQ ID NO: 442522 - DNA, 20 bp, Artificial Sequence
  chemically synthesized
tcctcataaagtacatttgg

SEQ ID NO: 442523 - DNA, 20 bp, Artificial Sequence
  chemically synthesized
cttccagaaaatagaagagg

SEQ ID NO: 442524 - DNA, 20 bp, Artificial Sequence
  chemically synthesized
acttccagaaaatagaagag

SEQ ID NO: 442525 - DNA, 20 bp, Artificial Sequence
  chemically synthesized
caacttccagaaaatagaag

SEQ ID NO: 442526 - DNA, 20 bp, Artificial Sequence
  chemically synthesized
tcaacttccagaaaatagaa

SEQ ID NO: 442527 - DNA, 20 bp, Artificial Sequence
  chemically synthesized
tgtcaacttccagaaaatag

SEQ ID NO: 442528 - DNA, 20 bp, Artificial Sequence
  chemically synthesized
ttgcctcctcttctattttc

SEQ ID NO: 442529 - DNA, 20 bp, Artificial Sequence
  chemically synthesized
aactgtcaacttccagaaaa

SEQ ID NO: 442530 - DNA, 20 bp, Artificial Sequence
  chemically synthesized
cctcctcttctattttctgg

SEQ ID NO: 442531 - DNA, 20 bp, Artificial Sequence
  chemically synthesized
aggagagaactgtcaacttc

SEQ ID NO: 442532 - DNA, 20 bp, Artificial Sequence
  chemically synthesized
ttctattttctggaagttga

SEQ ID NO: 442533 - DNA, 20 bp, Artificial Sequence
  chemically synthesized
tttttcaagtgatgaaagga

SEQ ID NO: 442534 - DNA, 20 bp, Artificial Sequence
  chemically synthesized
catttttcaagtgatgaaag

SEQ ID NO: 442535 - DNA, 20 bp, Artificial Sequence
  chemically synthesized
gacatttttcaagtgatgaa

SEQ ID NO: 442536 - DNA, 20 bp, Artificial Sequence
  chemically synthesized
tgacatttttcaagtgatga

SEQ ID NO: 442537 - DNA, 20 bp, Artificial Sequence
  chemically synthesized
gaagaagtatgacatttttc

SEQ ID NO: 442538 - DNA, 20 bp, Artificial Sequence
  chemically synthesized
aaatgtcatacttcttcctt

SEQ ID NO: 442539 - DNA, 20 bp, Artificial Sequence
  chemically synthesized
ccatgaaagcccgaaggaag

SEQ ID NO: 442540 - DNA, 20 bp, Artificial Sequence
  chemically synthesized
aatgtcatacttcttccttc

SEQ ID NO: 442541 - DNA, 20 bp, Artificial Sequence
  chemically synthesized
aaaccatgaaagcccgaagg

SEQ ID NO: 442542 - DNA, 20 bp, Artificial Sequence
  chemically synthesized
gtgaaaccatgaaagcccga

SEQ ID NO: 442543 - DNA, 20 bp, Artificial Sequence
  chemically synthesized
tgtgaaaccatgaaagcccg

SEQ ID NO: 442544 - DNA, 20 bp, Artificial Sequence
  chemically synthesized
cttcttccttcgggctttca

SEQ ID NO: 442545 - DNA, 20 bp, Artificial Sequence
  chemically synthesized
tttcttatgtgaaaccatga

SEQ ID NO: 442546 - DNA, 20 bp, Artificial Sequence
  chemically synthesized
gggctttcatggtttcacat

SEQ ID NO: 442547 - DNA, 20 bp, Artificial Sequence
  chemically synthesized
caaaaaagttcaaatggcag

SEQ ID NO: 442548 - DNA, 20 bp, Artificial Sequence
  chemically synthesized
gcaaaaaagttcaaatggca

SEQ ID NO: 442549 - DNA, 20 bp, Artificial Sequence
  chemically synthesized
aggcaaaaaagttcaaatgg

SEQ ID NO: 442550 - DNA, 20 bp, Artificial Sequence
  chemically synthesized
tataggcaaaaaagttcaaa

SEQ ID NO: 442551 - DNA, 20 bp, Artificial Sequence
  chemically synthesized
cactttatctataggcaaaa

SEQ ID NO: 442552 - DNA, 20 bp, Artificial Sequence
  chemically synthesized
catttgaacttttttgccta

SEQ ID NO: 442553 - DNA, 20 bp, Artificial Sequence
  chemically synthesized
aacttttttgcctatagata

SEQ ID NO: 442554 - DNA, 20 bp, Artificial Sequence
  chemically synthesized
gaaaaagacactttatctat

SEQ ID NO: 442555 - DNA, 20 bp, Artificial Sequence
  chemically synthesized
agaaaaagacactttatcta

SEQ ID NO: 442556 - DNA, 20 bp, Artificial Sequence
  chemically synthesized
taaaaacagtgaaagagaaa

SEQ ID NO: 442557 - DNA, 20 bp, Artificial Sequence
  chemically synthesized
aagtcttaaaaacagtgaaa

SEQ ID NO: 442558 - DNA, 20 bp, Artificial Sequence
  chemically synthesized
aaaagtcttaaaaacagtga

SEQ ID NO: 442559 - DNA, 20 bp, Artificial Sequence
  chemically synthesized
ttttctctttcactgttttt

SEQ ID NO: 442560 - DNA, 20 bp, Artificial Sequence
  chemically synthesized
tttaaaaaaagtcttaaaaa

SEQ ID NO: 442561 - DNA, 20 bp, Artificial Sequence
  chemically synthesized
ttatattttttttttaaaaa

SEQ ID NO: 442562 - DNA, 20 bp, Artificial Sequence
  chemically synthesized
ttttaaaaaaaaaatataac

SEQ ID NO: 442563 - DNA, 20 bp, Artificial Sequence
  chemically synthesized
aaaaaaatataactagtttt

SEQ ID NO: 442564 - DNA, 20 bp, Artificial Sequence
  chemically synthesized
atagtcaaatgtctgaaaac

SEQ ID NO: 442565 - DNA, 20 bp, Artificial Sequence
  chemically synthesized
actcatgcttagacgcatca

SEQ ID NO: 442566 - DNA, 20 bp, Artificial Sequence
  chemically synthesized
catttgactatgatgcgtct

SEQ ID NO: 442567 - DNA, 20 bp, Artificial Sequence
  chemically synthesized
actatgatgcgtctaagcat

SEQ ID NO: 442568 - DNA, 20 bp, Artificial Sequence
  chemically synthesized
aacccaaagaaactcatgct

SEQ ID NO: 442569 - DNA, 20 bp, Artificial Sequence
  chemically synthesized
cgtctaagcatgagtttctt

SEQ ID NO: 442570 - DNA, 20 bp, Artificial Sequence
  chemically synthesized
gtctaagcatgagtttcttt

SEQ ID NO: 442571 - DNA, 20 bp, Artificial Sequence
  chemically synthesized
gagtatacaggataaaccca

SEQ ID NO: 442572 - DNA, 20 bp, Artificial Sequence
  chemically synthesized
ttgggtttatcctgtatact

SEQ ID NO: 442573 - DNA, 20 bp, Artificial Sequence
  chemically synthesized
attcaaggagctgagtatac

SEQ ID NO: 442574 - DNA, 20 bp, Artificial Sequence
  chemically synthesized
gattcaaggagctgagtata

SEQ ID NO: 442575 - DNA, 20 bp, Artificial Sequence
  chemically synthesized
ccctacagattcaaggagct

SEQ ID NO: 442576 - DNA, 20 bp, Artificial Sequence
  chemically synthesized
caaaaccctacagattcaag

SEQ ID NO: 442577 - DNA, 20 bp, Artificial Sequence
  chemically synthesized
tgcaaaaccctacagattca

SEQ ID NO: 442578 - DNA, 20 bp, Artificial Sequence
  chemically synthesized
tactcagctccttgaatctg

SEQ ID NO: 442579 - DNA, 20 bp, Artificial Sequence
  chemically synthesized
atgcaaaaccctacagattc

SEQ ID NO: 442580 - DNA, 20 bp, Artificial Sequence
  chemically synthesized
actcagctccttgaatctgt

SEQ ID NO: 442581 - DNA, 20 bp, Artificial Sequence
  chemically synthesized
ctcagctccttgaatctgta

SEQ ID NO: 442582 - DNA, 20 bp, Artificial Sequence
  chemically synthesized
ttgtaaaatgcaaaacccta

SEQ ID NO: 442583 - DNA, 20 bp, Artificial Sequence
  chemically synthesized
gttttgcattttacaaaatt

SEQ ID NO: 442584 - DNA, 20 bp, Artificial Sequence
  chemically synthesized
ttttcaatcattatgtgctt

SEQ ID NO: 442585 - DNA, 20 bp, Artificial Sequence
  chemically synthesized
gtgttgttgaacaagtactc

SEQ ID NO: 442586 - DNA, 20 bp, Artificial Sequence
  chemically synthesized
aagggagggtgttgttgaac

SEQ ID NO: 442587 - DNA, 20 bp, Artificial Sequence
  chemically synthesized
atcagagtttcaaaaaggga

SEQ ID NO: 442588 - DNA, 20 bp, Artificial Sequence
  chemically synthesized
catcagagtttcaaaaaggg

SEQ ID NO: 442589 - DNA, 20 bp, Artificial Sequence
  chemically synthesized
ccatcagagtttcaaaaagg

SEQ ID NO: 442590 - DNA, 20 bp, Artificial Sequence
  chemically synthesized
tgccatcagagtttcaaaaa

SEQ ID NO: 442591 - DNA, 20 bp, Artificial Sequence
  chemically synthesized
atgccatcagagtttcaaaa

SEQ ID NO: 442592 - DNA, 20 bp, Artificial Sequence
  chemically synthesized
tatgccatcagagtttcaaa

SEQ ID NO: 442593 - DNA, 20 bp, Artificial Sequence
  chemically synthesized
ctccctttttgaaactctga

SEQ ID NO: 442594 - DNA, 20 bp, Artificial Sequence
  chemically synthesized
atctacggtttatgccatca

SEQ ID NO: 442595 - DNA, 20 bp, Artificial Sequence
  chemically synthesized
agatctacggtttatgccat

SEQ ID NO: 442596 - DNA, 20 bp, Artificial Sequence
  chemically synthesized
aactctgatggcataaaccg

SEQ ID NO: 442597 - DNA, 20 bp, Artificial Sequence
  chemically synthesized
ggattataataaaagatcta

SEQ ID NO: 442598 - DNA, 20 bp, Artificial Sequence
  chemically synthesized
gtcctatgggattataataa

SEQ ID NO: 442599 - DNA, 20 bp, Artificial Sequence
  chemically synthesized
gatcttttattataatccca

SEQ ID NO: 442600 - DNA, 20 bp, Artificial Sequence
  chemically synthesized
atcttttattataatcccat

SEQ ID NO: 442601 - DNA, 20 bp, Artificial Sequence
  chemically synthesized
aatattctcagttgtcctat

SEQ ID NO: 442602 - DNA, 20 bp, Artificial Sequence
  chemically synthesized
aaatattctcagttgtccta

SEQ ID NO: 442603 - DNA, 20 bp, Artificial Sequence
  chemically synthesized
tataatcccataggacaact

SEQ ID NO: 442604 - DNA, 20 bp, Artificial Sequence
  chemically synthesized
ttttaaaatgaaaatattct

SEQ ID NO: 442605 - DNA, 20 bp, Artificial Sequence
  chemically synthesized
attacacagtcgtaacaaga

SEQ ID NO: 442606 - DNA, 20 bp, Artificial Sequence
  chemically synthesized
aattacacagtcgtaacaag

SEQ ID NO: 442607 - DNA, 20 bp, Artificial Sequence
  chemically synthesized
agaaattacacagtcgtaac

SEQ ID NO: 442608 - DNA, 20 bp, Artificial Sequence
  chemically synthesized
ataggacaatagaaattaca

SEQ ID NO: 442609 - DNA, 20 bp, Artificial Sequence
  chemically synthesized
tgtgcagaaagataggacaa

SEQ ID NO: 442610 - DNA, 20 bp, Artificial Sequence
  chemically synthesized
aaatctgtgtgcagaaagat

SEQ ID NO: 442611 - DNA, 20 bp, Artificial Sequence
  chemically synthesized
gaaatctgtgtgcagaaaga

SEQ ID NO: 442612 - DNA, 20 bp, Artificial Sequence
  chemically synthesized
aggggaaatctgtgtgcaga

SEQ ID NO: 442613 - DNA, 20 bp, Artificial Sequence
  chemically synthesized
ttgtcctatctttctgcaca

SEQ ID NO: 442614 - DNA, 20 bp, Artificial Sequence
  chemically synthesized
agacaggggaaatctgtgtg

SEQ ID NO: 442615 - DNA, 20 bp, Artificial Sequence
  chemically synthesized
gaatggaggtgaggagacag

SEQ ID NO: 442616 - DNA, 20 bp, Artificial Sequence
  chemically synthesized
agaatggaggtgaggagaca

SEQ ID NO: 442617 - DNA, 20 bp, Artificial Sequence
  chemically synthesized
tagaatggaggtgaggagac

SEQ ID NO: 442618 - DNA, 20 bp, Artificial Sequence
  chemically synthesized
gtagaatggaggtgaggaga

SEQ ID NO: 442619 - DNA, 20 bp, Artificial Sequence
  chemically synthesized
aacagtagaatggaggtgag

SEQ ID NO: 442620 - DNA, 20 bp, Artificial Sequence
  chemically synthesized
tcaacagtagaatggaggtg

SEQ ID NO: 442621 - DNA, 20 bp, Artificial Sequence
  chemically synthesized
ctcaacagtagaatggaggt

SEQ ID NO: 442622 - DNA, 20 bp, Artificial Sequence
  chemically synthesized
tggtctcaacagtagaatgg

SEQ ID NO: 442623 - DNA, 20 bp, Artificial Sequence
  chemically synthesized
atggtctcaacagtagaatg

SEQ ID NO: 442624 - DNA, 20 bp, Artificial Sequence
  chemically synthesized
aaatggtctcaacagtagaa

SEQ ID NO: 442625 - DNA, 20 bp, Artificial Sequence
  chemically synthesized
ctcacctccattctactgtt

SEQ ID NO: 442626 - DNA, 20 bp, Artificial Sequence
  chemically synthesized
tcaataaatggtctcaacag

SEQ ID NO: 442627 - DNA, 20 bp, Artificial Sequence
  chemically synthesized
agttcaataaatggtctcaa

SEQ ID NO: 442628 - DNA, 20 bp, Artificial Sequence
  chemically synthesized
tcaaaaaaaagttcaataaa

SEQ ID NO: 442629 - DNA, 20 bp, Artificial Sequence
  chemically synthesized
aaaatatcgtaatcaaaaaa

SEQ ID NO: 442630 - DNA, 20 bp, Artificial Sequence
  chemically synthesized
ttttttgattacgatatttt

SEQ ID NO: 442631 - DNA, 20 bp, Artificial Sequence
  chemically synthesized
catagaacgacatgacattt

SEQ ID NO: 442632 - DNA, 20 bp, Artificial Sequence
  chemically synthesized
tcagaaagaaatagaagaca

SEQ ID NO: 442633 - DNA, 20 bp, Artificial Sequence
  chemically synthesized
gaaaagtcagaaagaaatag

SEQ ID NO: 442634 - DNA, 20 bp, Artificial Sequence
  chemically synthesized
tgggaaaagtcagaaagaaa

SEQ ID NO: 442635 - DNA, 20 bp, Artificial Sequence
  chemically synthesized
aaaaaatgggaaaagtcaga

SEQ ID NO: 442636 - DNA, 20 bp, Artificial Sequence
  chemically synthesized
aaataaaaaatgggaaaagt

SEQ ID NO: 442637 - DNA, 20 bp, Artificial Sequence
  chemically synthesized
caacaaataaaaaatgggaa

SEQ ID NO: 442638 - DNA, 20 bp, Artificial Sequence
  chemically synthesized
ttttgcaacaaataaaaaat

SEQ ID NO: 442639 - DNA, 20 bp, Artificial Sequence
  chemically synthesized
attttgcaacaaataaaaaa

SEQ ID NO: 442640 - DNA, 20 bp, Artificial Sequence
  chemically synthesized
ttgttgcaaaatgttttaaa

SEQ ID NO: 442641 - DNA, 20 bp, Artificial Sequence
  chemically synthesized
catcccgaaaattgttgagt

SEQ ID NO: 442642 - DNA, 20 bp, Artificial Sequence
  chemically synthesized
tagccatcccgaaaattgtt

SEQ ID NO: 442643 - DNA, 20 bp, Artificial Sequence
  chemically synthesized
aaagcttactcaacaatttt

SEQ ID NO: 442644 - DNA, 20 bp, Artificial Sequence
  chemically synthesized
aagcttactcaacaattttc

SEQ ID NO: 442645 - DNA, 20 bp, Artificial Sequence
  chemically synthesized
ttactcaacaattttcggga

SEQ ID NO: 442646 - DNA, 20 bp, Artificial Sequence
  chemically synthesized
atctagcaaggatattaaag

SEQ ID NO: 442647 - DNA, 20 bp, Artificial Sequence
  chemically synthesized
attatctagcaaggatatta

SEQ ID NO: 442648 - DNA, 20 bp, Artificial Sequence
  chemically synthesized
ggctactttaatatccttgc

SEQ ID NO: 442649 - DNA, 20 bp, Artificial Sequence
  chemically synthesized
gatgacagaattatctagca

SEQ ID NO: 442650 - DNA, 20 bp, Artificial Sequence
  chemically synthesized
agatgacagaattatctagc

SEQ ID NO: 442651 - DNA, 20 bp, Artificial Sequence
  chemically synthesized
acaaagatgacagaattatc

SEQ ID NO: 442652 - DNA, 20 bp, Artificial Sequence
  chemically synthesized
tactgacatgacaaagatga

SEQ ID NO: 442653 - DNA, 20 bp, Artificial Sequence
  chemically synthesized
tcacttatactgacatgaca

SEQ ID NO: 442654 - DNA, 20 bp, Artificial Sequence
  chemically synthesized
ttctgtcatctttgtcatgt

SEQ ID NO: 442655 - DNA, 20 bp, Artificial Sequence
  chemically synthesized
catctttgtcatgtcagtat

SEQ ID NO: 442656 - DNA, 20 bp, Artificial Sequence
  chemically synthesized
actggaatgcaaaaagatag

SEQ ID NO: 442657 - DNA, 20 bp, Artificial Sequence
  chemically synthesized
tcaactggaatgcaaaaaga

SEQ ID NO: 442658 - DNA, 20 bp, Artificial Sequence
  chemically synthesized
aatctcaactggaatgcaaa

SEQ ID NO: 442659 - DNA, 20 bp, Artificial Sequence
  chemically synthesized
actactatctttttgcattc

SEQ ID NO: 442660 - DNA, 20 bp, Artificial Sequence
  chemically synthesized
tatctttttgcattccagtt

SEQ ID NO: 442661 - DNA, 20 bp, Artificial Sequence
  chemically synthesized
ccaaaaaagaaaatctcaac

SEQ ID NO: 442662 - DNA, 20 bp, Artificial Sequence
  chemically synthesized
ccagttgagattttcttttt

SEQ ID NO: 442663 - DNA, 20 bp, Artificial Sequence
  chemically synthesized
taatatcccaaatgccaaaa

SEQ ID NO: 442664 - DNA, 20 bp, Artificial Sequence
  chemically synthesized
agattttcttttttggcatt

SEQ ID NO: 442665 - DNA, 20 bp, Artificial Sequence
  chemically synthesized
gattttcttttttggcattt

SEQ ID NO: 442666 - DNA, 20 bp, Artificial Sequence
  chemically synthesized
catttgggatattacattat

SEQ ID NO: 442667 - DNA, 20 bp, Artificial Sequence
  chemically synthesized
gatattacattatcagactc

SEQ ID NO: 442668 - DNA, 20 bp, Artificial Sequence
  chemically synthesized
atagatttaaataagatcca

SEQ ID NO: 442669 - DNA, 20 bp, Artificial Sequence
  chemically synthesized
aaatagatttaaataagatc

SEQ ID NO: 442670 - DNA, 20 bp, Artificial Sequence
  chemically synthesized
gagctaaaatagatttaaat

SEQ ID NO: 442671 - DNA, 20 bp, Artificial Sequence
  chemically synthesized
gatcttatttaaatctattt

SEQ ID NO: 442672 - DNA, 20 bp, Artificial Sequence
  chemically synthesized
cagaaggggacgagctaaaa

SEQ ID NO: 442673 - DNA, 20 bp, Artificial Sequence
  chemically synthesized
cagaacagtcagaaggggac

SEQ ID NO: 442674 - DNA, 20 bp, Artificial Sequence
  chemically synthesized
tccaccagaacagtcagaag

SEQ ID NO: 442675 - DNA, 20 bp, Artificial Sequence
  chemically synthesized
ttccaccagaacagtcagaa

SEQ ID NO: 442676 - DNA, 20 bp, Artificial Sequence
  chemically synthesized
cttccaccagaacagtcaga

SEQ ID NO: 442677 - DNA, 20 bp, Artificial Sequence
  chemically synthesized
tcttccaccagaacagtcag

SEQ ID NO: 442678 - DNA, 20 bp, Artificial Sequence
  chemically synthesized
tcgtccccttctgactgttc

SEQ ID NO: 442679 - DNA, 20 bp, Artificial Sequence
  chemically synthesized
ctatcttccaccagaacagt

SEQ ID NO: 442680 - DNA, 20 bp, Artificial Sequence
  chemically synthesized
tccccttctgactgttctgg

SEQ ID NO: 442681 - DNA, 20 bp, Artificial Sequence
  chemically synthesized
acctctatcttccaccagaa

SEQ ID NO: 442682 - DNA, 20 bp, Artificial Sequence
  chemically synthesized
ccttctgactgttctggtgg

SEQ ID NO: 442683 - DNA, 20 bp, Artificial Sequence
  chemically synthesized
cttctacctctatcttccac

SEQ ID NO: 442684 - DNA, 20 bp, Artificial Sequence
  chemically synthesized
ctgactgttctggtggaaga

SEQ ID NO: 442685 - DNA, 20 bp, Artificial Sequence
  chemically synthesized
gactgttctggtggaagata

SEQ ID NO: 442686 - DNA, 20 bp, Artificial Sequence
  chemically synthesized
actgttctggtggaagatag

SEQ ID NO: 442687 - DNA, 20 bp, Artificial Sequence
  chemically synthesized
gttctggtggaagatagagg

SEQ ID NO: 442688 - DNA, 20 bp, Artificial Sequence
  chemically synthesized
ctggtggaagatagaggtag

SEQ ID NO: 442689 - DNA, 20 bp, Artificial Sequence
  chemically synthesized
actcccacctggcaataagg

SEQ ID NO: 442690 - DNA, 20 bp, Artificial Sequence
  chemically synthesized
gaagtgtgctgccttattgc

SEQ ID NO: 442691 - DNA, 20 bp, Artificial Sequence
  chemically synthesized
aagtgtgctgccttattgcc

SEQ ID NO: 442692 - DNA, 20 bp, Artificial Sequence
  chemically synthesized
ttcactcccacctggcaata

SEQ ID NO: 442693 - DNA, 20 bp, Artificial Sequence
  chemically synthesized
cttcactcccacctggcaat

SEQ ID NO: 442694 - DNA, 20 bp, Artificial Sequence
  chemically synthesized
tgtgctgccttattgccagg

SEQ ID NO: 442695 - DNA, 20 bp, Artificial Sequence
  chemically synthesized
gtgctgccttattgccaggt

SEQ ID NO: 442696 - DNA, 20 bp, Artificial Sequence
  chemically synthesized
gctgccttattgccaggtgg

SEQ ID NO: 442697 - DNA, 20 bp, Artificial Sequence
  chemically synthesized
ccaggaccttcactcccacc

SEQ ID NO: 442698 - DNA, 20 bp, Artificial Sequence
  chemically synthesized
cttattgccaggtgggagtg

SEQ ID NO: 442699 - DNA, 20 bp, Artificial Sequence
  chemically synthesized
ttattgccaggtgggagtga

SEQ ID NO: 442700 - DNA, 20 bp, Artificial Sequence
  chemically synthesized
ccaggtgggagtgaaggtcc

SEQ ID NO: 442701 - DNA, 20 bp, Artificial Sequence
  chemically synthesized
catagatggagtggggaacc

SEQ ID NO: 442702 - DNA, 20 bp, Artificial Sequence
  chemically synthesized
ccatagatggagtggggaac

SEQ ID NO: 442703 - DNA, 20 bp, Artificial Sequence
  chemically synthesized
tatcaaccatagatggagtg

SEQ ID NO: 442704 - DNA, 20 bp, Artificial Sequence
  chemically synthesized
gtatcaaccatagatggagt

SEQ ID NO: 442705 - DNA, 20 bp, Artificial Sequence
  chemically synthesized
agtatcaaccatagatggag

SEQ ID NO: 442706 - DNA, 20 bp, Artificial Sequence
  chemically synthesized
ctggttccccactccatcta

SEQ ID NO: 442707 - DNA, 20 bp, Artificial Sequence
  chemically synthesized
taaagtatcaaccatagatg

SEQ ID NO: 442708 - DNA, 20 bp, Artificial Sequence
  chemically synthesized
tctaaagtatcaaccataga

SEQ ID NO: 442709 - DNA, 20 bp, Artificial Sequence
  chemically synthesized
aatctctaaagtatcaacca

SEQ ID NO: 442710 - DNA, 20 bp, Artificial Sequence
  chemically synthesized
tccatctatggttgatactt

SEQ ID NO: 442711 - DNA, 20 bp, Artificial Sequence
  chemically synthesized
catctatggttgatacttta

SEQ ID NO: 442712 - DNA, 20 bp, Artificial Sequence
  chemically synthesized
cacacacacaataatctcta

SEQ ID NO: 442713 - DNA, 20 bp, Artificial Sequence
  chemically synthesized
tgtcaagtaaaatttattta

SEQ ID NO: 442714 - DNA, 20 bp, Artificial Sequence
  chemically synthesized
aagggaattaagatggtgtc

SEQ ID NO: 442715 - DNA, 20 bp, Artificial Sequence
  chemically synthesized
aattttaaagggaattaaga

SEQ ID NO: 442716 - DNA, 20 bp, Artificial Sequence
  chemically synthesized
tactaattttaaagggaatt

SEQ ID NO: 442717 - DNA, 20 bp, Artificial Sequence
  chemically synthesized
atctacttactaattttaaa

SEQ ID NO: 442718 - DNA, 20 bp, Artificial Sequence
  chemically synthesized
atcttaattccctttaaaat

SEQ ID NO: 442719 - DNA, 20 bp, Artificial Sequence
  chemically synthesized
tatctacttactaattttaa

SEQ ID NO: 442720 - DNA, 20 bp, Artificial Sequence
  chemically synthesized
atatctacttactaatttta

SEQ ID NO: 442721 - DNA, 20 bp, Artificial Sequence
  chemically synthesized
taattccctttaaaattagt

SEQ ID NO: 442722 - DNA, 20 bp, Artificial Sequence
  chemically synthesized
ttccctttaaaattagtaag

SEQ ID NO: 442723 - DNA, 20 bp, Artificial Sequence
  chemically synthesized
aaaattagtaagtagatatc

SEQ ID NO: 442724 - DNA, 20 bp, Artificial Sequence
  chemically synthesized
aaaatgaactcacaaggttc

SEQ ID NO: 442725 - DNA, 20 bp, Artificial Sequence
  chemically synthesized
gtagatatctggaaccttgt

SEQ ID NO: 442726 - DNA, 20 bp, Artificial Sequence
  chemically synthesized
catttaaaaatgaactcaca

SEQ ID NO: 442727 - DNA, 20 bp, Artificial Sequence
  chemically synthesized
acatttaaaaatgaactcac

SEQ ID NO: 442728 - DNA, 20 bp, Artificial Sequence
  chemically synthesized
tgagttcatttttaaatgtt

SEQ ID NO: 442729 - DNA, 20 bp, Artificial Sequence
  chemically synthesized
gttcagatttttttttccac

SEQ ID NO: 442730 - DNA, 20 bp, Artificial Sequence
  chemically synthesized
ctttttttttttttgtccag

SEQ ID NO: 442731 - DNA, 20 bp, Artificial Sequence
  chemically synthesized
gctctttttttttttttgtc

SEQ ID NO: 442732 - DNA, 20 bp, Artificial Sequence
  chemically synthesized
ccactggacaaaaaaaaaaa

SEQ ID NO: 442733 - DNA, 20 bp, Artificial Sequence
  chemically synthesized
actggacaaaaaaaaaaaaa

SEQ ID NO: 442734 - DNA, 20 bp, Artificial Sequence
  chemically synthesized
gtctatggaaatgtgagtta

SEQ ID NO: 442735 - DNA, 20 bp, Artificial Sequence
  chemically synthesized
ttcattgtctatggaaatgt

SEQ ID NO: 442736 - DNA, 20 bp, Artificial Sequence
  chemically synthesized
agctttaactcacatttcca

SEQ ID NO: 442737 - DNA, 20 bp, Artificial Sequence
  chemically synthesized
gccatgggcttcattgtcta

SEQ ID NO: 442738 - DNA, 20 bp, Artificial Sequence
  chemically synthesized
tcacatttccatagacaatg

SEQ ID NO: 442739 - DNA, 20 bp, Artificial Sequence
  chemically synthesized
tccatagacaatgaagccca

SEQ ID NO: 442740 - DNA, 20 bp, Artificial Sequence
  chemically synthesized
catcgttatgtgaatgccat

SEQ ID NO: 442741 - DNA, 20 bp, Artificial Sequence
  chemically synthesized
acatcgttatgtgaatgcca

SEQ ID NO: 442742 - DNA, 20 bp, Artificial Sequence
  chemically synthesized
ttcacataacgatgtgattt

SEQ ID NO: 442743 - DNA, 20 bp, Artificial Sequence
  chemically synthesized
tcacataacgatgtgatttc

SEQ ID NO: 442744 - DNA, 20 bp, Artificial Sequence
  chemically synthesized
aacgatgtgatttcaggact

SEQ ID NO: 442745 - DNA, 20 bp, Artificial Sequence
  chemically synthesized
tagtactgatatgtagtacc

SEQ ID NO: 442746 - DNA, 20 bp, Artificial Sequence
  chemically synthesized
caggacttggtactacatat

SEQ ID NO: 442747 - DNA, 20 bp, Artificial Sequence
  chemically synthesized
ctatagatagtactgatatg

SEQ ID NO: 442748 - DNA, 20 bp, Artificial Sequence
  chemically synthesized
ctacatatcagtactatcta

SEQ ID NO: 442749 - DNA, 20 bp, Artificial Sequence
  chemically synthesized
acatatcagtactatctata

SEQ ID NO: 442750 - DNA, 20 bp, Artificial Sequence
  chemically synthesized
ttctttcttgactctataga

SEQ ID NO: 442751 - DNA, 20 bp, Artificial Sequence
  chemically synthesized
tcagtactatctatagagtc

SEQ ID NO: 442752 - DNA, 20 bp, Artificial Sequence
  chemically synthesized
tgttttctttcttgactcta

SEQ ID NO: 442753 - DNA, 20 bp, Artificial Sequence
  chemically synthesized
tactatctatagagtcaaga

SEQ ID NO: 442754 - DNA, 20 bp, Artificial Sequence
  chemically synthesized
gagttttgcttatatttggt

SEQ ID NO: 442755 - DNA, 20 bp, Artificial Sequence
  chemically synthesized
aacatttgcttaccaaatat

SEQ ID NO: 442756 - DNA, 20 bp, Artificial Sequence
  chemically synthesized
ttttgagttttgcttatatt

SEQ ID NO: 442757 - DNA, 20 bp, Artificial Sequence
  chemically synthesized
aacacaggcaaattagtttt

SEQ ID NO: 442758 - DNA, 20 bp, Artificial Sequence
  chemically synthesized
ttttcacaacacaggcaaat

SEQ ID NO: 442759 - DNA, 20 bp, Artificial Sequence
  chemically synthesized
agtcattattttcacaacac

SEQ ID NO: 442760 - DNA, 20 bp, Artificial Sequence
  chemically synthesized
gagtcattattttcacaaca

SEQ ID NO: 442761 - DNA, 20 bp, Artificial Sequence
  chemically synthesized
gaatcaatccacaaagtgag

SEQ ID NO: 442762 - DNA, 20 bp, Artificial Sequence
  chemically synthesized
aataatgactcctcactttg

SEQ ID NO: 442763 - DNA, 20 bp, Artificial Sequence
  chemically synthesized
gggaatcaatccacaaagtg

SEQ ID NO: 442764 - DNA, 20 bp, Artificial Sequence
  chemically synthesized
tgggaatcaatccacaaagt

SEQ ID NO: 442765 - DNA, 20 bp, Artificial Sequence
  chemically synthesized
cagttgggaatcaatccaca

SEQ ID NO: 442766 - DNA, 20 bp, Artificial Sequence
  chemically synthesized
atttacctcataaaacagtt

SEQ ID NO: 442767 - DNA, 20 bp, Artificial Sequence
  chemically synthesized
catttacctcataaaacagt

SEQ ID NO: 442768 - DNA, 20 bp, Artificial Sequence
  chemically synthesized
ttgattcccaactgttttat

SEQ ID NO: 442769 - DNA, 20 bp, Artificial Sequence
  chemically synthesized
tgattcccaactgttttatg

SEQ ID NO: 442770 - DNA, 20 bp, Artificial Sequence
  chemically synthesized
tgtacatttacctcataaaa

SEQ ID NO: 442771 - DNA, 20 bp, Artificial Sequence
  chemically synthesized
tgttttatgaggtaaatgta

SEQ ID NO: 442772 - DNA, 20 bp, Artificial Sequence
  chemically synthesized
gttttatgaggtaaatgtac

SEQ ID NO: 442773 - DNA, 20 bp, Artificial Sequence
  chemically synthesized
ttttatgaggtaaatgtaca

SEQ ID NO: 442774 - DNA, 20 bp, Artificial Sequence
  chemically synthesized
taaatgtacagggattaatg

SEQ ID NO: 442775 - DNA, 20 bp, Artificial Sequence
  chemically synthesized
gggattaatgaagattttta

SEQ ID NO: 442776 - DNA, 20 bp, Artificial Sequence
  chemically synthesized
ttttaaagatttctgaatgt

SEQ ID NO: 442777 - DNA, 20 bp, Artificial Sequence
  chemically synthesized
cataatacctttcttacatt

SEQ ID NO: 442778 - DNA, 20 bp, Artificial Sequence
  chemically synthesized
aaagatttctgaatgtaaga

SEQ ID NO: 442779 - DNA, 20 bp, Artificial Sequence
  chemically synthesized
aagatttctgaatgtaagaa

SEQ ID NO: 442780 - DNA, 20 bp, Artificial Sequence
  chemically synthesized
gaatgtaagaaaggtattat

SEQ ID NO: 442781 - DNA, 20 bp, Artificial Sequence
  chemically synthesized
agaaaggtattatgagtaca

SEQ ID NO: 442782 - DNA, 20 bp, Artificial Sequence
  chemically synthesized
aggtattatgagtacaaaga

SEQ ID NO: 442783 - DNA, 20 bp, Artificial Sequence
  chemically synthesized
gatagtaaatgcattgatgc

SEQ ID NO: 442784 - DNA, 20 bp, Artificial Sequence
  chemically synthesized
gtaaatgcattgatgctagt

SEQ ID NO: 442785 - DNA, 20 bp, Artificial Sequence
  chemically synthesized
tgcattgatgctagtgagct

SEQ ID NO: 442786 - DNA, 20 bp, Artificial Sequence
  chemically synthesized
gttactgattctcagctcac

SEQ ID NO: 442787 - DNA, 20 bp, Artificial Sequence
  chemically synthesized
gatgctagtgagctgagaat

SEQ ID NO: 442788 - DNA, 20 bp, Artificial Sequence
  chemically synthesized
taaaacatgttactgattct

SEQ ID NO: 442789 - DNA, 20 bp, Artificial Sequence
  chemically synthesized
gaatcagtaacatgttttaa

SEQ ID NO: 442790 - DNA, 20 bp, Artificial Sequence
  chemically synthesized
tttaatagttgtatctctta

SEQ ID NO: 442791 - DNA, 20 bp, Artificial Sequence
  chemically synthesized
ttaatagttgtatctcttat

SEQ ID NO: 442792 - DNA, 20 bp, Artificial Sequence
  chemically synthesized
taatagttgtatctcttatg

SEQ ID NO: 442793 - DNA, 20 bp, Artificial Sequence
  chemically synthesized
tcttcactaataccccataa

SEQ ID NO: 442794 - DNA, 20 bp, Artificial Sequence
  chemically synthesized
gatcttcactaataccccat

SEQ ID NO: 442795 - DNA, 20 bp, Artificial Sequence
  chemically synthesized
ttgtatctcttatggggtat

SEQ ID NO: 442796 - DNA, 20 bp, Artificial Sequence
  chemically synthesized
tctcttatggggtattagtg

SEQ ID NO: 442797 - DNA, 20 bp, Artificial Sequence
  chemically synthesized
tggggtattagtgaagatcc

SEQ ID NO: 442798 - DNA, 20 bp, Artificial Sequence
  chemically synthesized
ggtattagtgaagatcctgg

SEQ ID NO: 442799 - DNA, 20 bp, Artificial Sequence
  chemically synthesized
gtattagtgaagatcctggt

SEQ ID NO: 442800 - DNA, 20 bp, Artificial Sequence
  chemically synthesized
tgctacctatatttcctacc

SEQ ID NO: 442801 - DNA, 20 bp, Artificial Sequence
  chemically synthesized
ctgctacctatatttcctac

SEQ ID NO: 442802 - DNA, 20 bp, Artificial Sequence
  chemically synthesized
gaagatcctggtaggaaata

SEQ ID NO: 442803 - DNA, 20 bp, Artificial Sequence
  chemically synthesized
aagatcctggtaggaaatat

SEQ ID NO: 442804 - DNA, 20 bp, Artificial Sequence
  chemically synthesized
atcctggtaggaaatatagg

SEQ ID NO: 442805 - DNA, 20 bp, Artificial Sequence
  chemically synthesized
ctggtaggaaatataggtag

SEQ ID NO: 442806 - DNA, 20 bp, Artificial Sequence
  chemically synthesized
aatataggtagcagattcaa

SEQ ID NO: 442807 - DNA, 20 bp, Artificial Sequence
  chemically synthesized
gcagattcaaaagcatttaa

SEQ ID NO: 442808 - DNA, 20 bp, Artificial Sequence
  chemically synthesized
gcatttaacagataataatt

SEQ ID NO: 442809 - DNA, 20 bp, Artificial Sequence
  chemically synthesized
aacagataataattcggtga

SEQ ID NO: 442810 - DNA, 20 bp, Artificial Sequence
  chemically synthesized
ataattcggtgaaagaacta

SEQ ID NO: 442811 - DNA, 20 bp, Artificial Sequence
  chemically synthesized
cctgcctatatgtttgtcca

SEQ ID NO: 442812 - DNA, 20 bp, Artificial Sequence
  chemically synthesized
aagaactatggacaaacata

SEQ ID NO: 442813 - DNA, 20 bp, Artificial Sequence
  chemically synthesized
agaactatggacaaacatat

SEQ ID NO: 442814 - DNA, 20 bp, Artificial Sequence
  chemically synthesized
actatggacaaacatatagg

SEQ ID NO: 442815 - DNA, 20 bp, Artificial Sequence
  chemically synthesized
ctatggacaaacatataggc

SEQ ID NO: 442816 - DNA, 20 bp, Artificial Sequence
  chemically synthesized
aaacatataggcaggctgat

SEQ ID NO: 442817 - DNA, 20 bp, Artificial Sequence
  chemically synthesized
catcccttatttgttctcat

SEQ ID NO: 442818 - DNA, 20 bp, Artificial Sequence
  chemically synthesized
gcaggctgatgagaacaaat

SEQ ID NO: 442819 - DNA, 20 bp, Artificial Sequence
  chemically synthesized
caggctgatgagaacaaata

SEQ ID NO: 442820 - DNA, 20 bp, Artificial Sequence
  chemically synthesized
aggctgatgagaacaaataa

SEQ ID NO: 442821 - DNA, 20 bp, Artificial Sequence
  chemically synthesized
tgatgagaacaaataaggga

SEQ ID NO: 442822 - DNA, 20 bp, Artificial Sequence
  chemically synthesized
gagaacaaataagggatggt

SEQ ID NO: 442823 - DNA, 20 bp, Artificial Sequence
  chemically synthesized
ataagggatggtgagtcacc

SEQ ID NO: 442824 - DNA, 20 bp, Artificial Sequence
  chemically synthesized
gggatggtgagtcacctagc

SEQ ID NO: 442825 - DNA, 20 bp, Artificial Sequence
  chemically synthesized
atggtgagtcacctagcaag

SEQ ID NO: 442826 - DNA, 20 bp, Artificial Sequence
  chemically synthesized
tacctctcttgctgcttgct

SEQ ID NO: 442827 - DNA, 20 bp, Artificial Sequence
  chemically synthesized
ttacctctcttgctgcttgc

SEQ ID NO: 442828 - DNA, 20 bp, Artificial Sequence
  chemically synthesized
tgagtcacctagcaagcagc

SEQ ID NO: 442829 - DNA, 20 bp, Artificial Sequence
  chemically synthesized
agtcacctagcaagcagcaa

SEQ ID NO: 442830 - DNA, 20 bp, Artificial Sequence
  chemically synthesized
tcacctagcaagcagcaaga

SEQ ID NO: 442831 - DNA, 20 bp, Artificial Sequence
  chemically synthesized
cacctagcaagcagcaagag

SEQ ID NO: 442832 - DNA, 20 bp, Artificial Sequence
  chemically synthesized
aggtaatttgtttctacctc

SEQ ID NO: 442833 - DNA, 20 bp, Artificial Sequence
  chemically synthesized
ggtaatttgtttctacctcc

SEQ ID NO: 442834 - DNA, 20 bp, Artificial Sequence
  chemically synthesized
tgacatattaggcctggagg

SEQ ID NO: 442835 - DNA, 20 bp, Artificial Sequence
  chemically synthesized
ccttgacatattaggcctgg

SEQ ID NO: 442836 - DNA, 20 bp, Artificial Sequence
  chemically synthesized
accttgacatattaggcctg

SEQ ID NO: 442837 - DNA, 20 bp, Artificial Sequence
  chemically synthesized
ttaccttgacatattaggcc

SEQ ID NO: 442838 - DNA, 20 bp, Artificial Sequence
  chemically synthesized
ttcctttaccttgacatatt

SEQ ID NO: 442839 - DNA, 20 bp, Artificial Sequence
  chemically synthesized
acctccaggcctaatatgtc

SEQ ID NO: 442840 - DNA, 20 bp, Artificial Sequence
  chemically synthesized
attcctttaccttgacatat

SEQ ID NO: 442841 - DNA, 20 bp, Artificial Sequence
  chemically synthesized
cctccaggcctaatatgtca

SEQ ID NO: 442842 - DNA, 20 bp, Artificial Sequence
  chemically synthesized
aggcctaatatgtcaaggta

SEQ ID NO: 442843 - DNA, 20 bp, Artificial Sequence
  chemically synthesized
ggcctaatatgtcaaggtaa

SEQ ID NO: 442844 - DNA, 20 bp, Artificial Sequence
  chemically synthesized
tcaaggtaaaggaataatgt

SEQ ID NO: 442845 - DNA, 20 bp, Artificial Sequence
  chemically synthesized
gtaaaggaataatgttggaa

SEQ ID NO: 442846 - DNA, 20 bp, Artificial Sequence
  chemically synthesized
gaataatgttggaatagcaa

SEQ ID NO: 442847 - DNA, 20 bp, Artificial Sequence
  chemically synthesized
atgttggaatagcaatagaa

SEQ ID NO: 442848 - DNA, 20 bp, Artificial Sequence
  chemically synthesized
tgttggaatagcaatagaaa

SEQ ID NO: 442849 - DNA, 20 bp, Artificial Sequence
  chemically synthesized
gttggaatagcaatagaaaa

SEQ ID NO: 442850 - DNA, 20 bp, Artificial Sequence
  chemically synthesized
ggaatagcaatagaaaaggg

SEQ ID NO: 442851 - DNA, 20 bp, Artificial Sequence
  chemically synthesized
tagaaaagggcagtcactac

SEQ ID NO: 442852 - DNA, 20 bp, Artificial Sequence
  chemically synthesized
agaaaagggcagtcactacc

SEQ ID NO: 442853 - DNA, 20 bp, Artificial Sequence
  chemically synthesized
atgcctcactaaggtcctgg

SEQ ID NO: 442854 - DNA, 20 bp, Artificial Sequence
  chemically synthesized
ggcagtcactaccaggacct

SEQ ID NO: 442855 - DNA, 20 bp, Artificial Sequence
  chemically synthesized
catatgcctcactaaggtcc

SEQ ID NO: 442856 - DNA, 20 bp, Artificial Sequence
  chemically synthesized
gtcactaccaggaccttagt

SEQ ID NO: 442857 - DNA, 20 bp, Artificial Sequence
  chemically synthesized
tcactaccaggaccttagtg

SEQ ID NO: 442858 - DNA, 20 bp, Artificial Sequence
  chemically synthesized
acttcacatatgcctcacta

SEQ ID NO: 442859 - DNA, 20 bp, Artificial Sequence
  chemically synthesized
cacttcacatatgcctcact

SEQ ID NO: 442860 - DNA, 20 bp, Artificial Sequence
  chemically synthesized
accttagtgaggcatatgtg

SEQ ID NO: 442861 - DNA, 20 bp, Artificial Sequence
  chemically synthesized
ttagtgaggcatatgtgaag

SEQ ID NO: 442862 - DNA, 20 bp, Artificial Sequence
  chemically synthesized
gggcaagggaaaaaaaggtt

SEQ ID NO: 442863 - DNA, 20 bp, Artificial Sequence
  chemically synthesized
tcagagggcaagggaaaaaa

SEQ ID NO: 442864 - DNA, 20 bp, Artificial Sequence
  chemically synthesized
atcagagggcaagggaaaaa

SEQ ID NO: 442865 - DNA, 20 bp, Artificial Sequence
  chemically synthesized
agctggacatcagagggcaa

SEQ ID NO: 442866 - DNA, 20 bp, Artificial Sequence
  chemically synthesized
cagctggacatcagagggca

SEQ ID NO: 442867 - DNA, 20 bp, Artificial Sequence
  chemically synthesized
ccagctggacatcagagggc

SEQ ID NO: 442868 - DNA, 20 bp, Artificial Sequence
  chemically synthesized
gacaccagctggacatcaga

SEQ ID NO: 442869 - DNA, 20 bp, Artificial Sequence
  chemically synthesized
tgacaccagctggacatcag

SEQ ID NO: 442870 - DNA, 20 bp, Artificial Sequence
  chemically synthesized
ttcccttgccctctgatgtc

SEQ ID NO: 442871 - DNA, 20 bp, Artificial Sequence
  chemically synthesized
gtgacaccagctggacatca

SEQ ID NO: 442872 - DNA, 20 bp, Artificial Sequence
  chemically synthesized
atgtgacaccagctggacat

SEQ ID NO: 442873 - DNA, 20 bp, Artificial Sequence
  chemically synthesized
cttgccctctgatgtccagc

SEQ ID NO: 442874 - DNA, 20 bp, Artificial Sequence
  chemically synthesized
ggaaattatgtgacaccagc

SEQ ID NO: 442875 - DNA, 20 bp, Artificial Sequence
  chemically synthesized
tttaggaaattatgtgacac

SEQ ID NO: 442876 - DNA, 20 bp, Artificial Sequence
  chemically synthesized
ggtgtcacataatttcctaa

SEQ ID NO: 442877 - DNA, 20 bp, Artificial Sequence
  chemically synthesized
tcacataatttcctaaaagt

SEQ ID NO: 442878 - DNA, 20 bp, Artificial Sequence
  chemically synthesized
cctcttgtgcactaactttt

SEQ ID NO: 442879 - DNA, 20 bp, Artificial Sequence
  chemically synthesized
gcctcttgtgcactaacttt

SEQ ID NO: 442880 - DNA, 20 bp, Artificial Sequence
  chemically synthesized
tttcctaaaagttagtgcac

SEQ ID NO: 442881 - DNA, 20 bp, Artificial Sequence
  chemically synthesized
tcctaaaagttagtgcacaa

SEQ ID NO: 442882 - DNA, 20 bp, Artificial Sequence
  chemically synthesized
cctaaaagttagtgcacaag

SEQ ID NO: 442883 - DNA, 20 bp, Artificial Sequence
  chemically synthesized
agttagtgcacaagaggcgt

SEQ ID NO: 442884 - DNA, 20 bp, Artificial Sequence
  chemically synthesized
aggcgttggtgatacaaatg

SEQ ID NO: 442885 - DNA, 20 bp, Artificial Sequence
  chemically synthesized
gcgttggtgatacaaatgaa

SEQ ID NO: 442886 - DNA, 20 bp, Artificial Sequence
  chemically synthesized
ggtgatacaaatgaagagac

SEQ ID NO: 442887 - DNA, 20 bp, Artificial Sequence
  chemically synthesized
aaatgaagagacaagctttc

SEQ ID NO: 442888 - DNA, 20 bp, Artificial Sequence
  chemically synthesized
aatgaagagacaagctttcc

SEQ ID NO: 442889 - DNA, 20 bp, Artificial Sequence
  chemically synthesized
atgaagagacaagctttcca

SEQ ID NO: 442890 - DNA, 20 bp, Artificial Sequence
  chemically synthesized
gccctgttttttgccctgga

SEQ ID NO: 442891 - DNA, 20 bp, Artificial Sequence
  chemically synthesized
ctctgccctgttttttgccc

SEQ ID NO: 442892 - DNA, 20 bp, Artificial Sequence
  chemically synthesized
aagctttccagggcaaaaaa

SEQ ID NO: 442893 - DNA, 20 bp, Artificial Sequence
  chemically synthesized
agctttccagggcaaaaaac

SEQ ID NO: 442894 - DNA, 20 bp, Artificial Sequence
  chemically synthesized
gctttccagggcaaaaaaca

SEQ ID NO: 442895 - DNA, 20 bp, Artificial Sequence
  chemically synthesized
ttccagggcaaaaaacaggg

SEQ ID NO: 442896 - DNA, 20 bp, Artificial Sequence
  chemically synthesized
ccagggcaaaaaacagggca

SEQ ID NO: 442897 - DNA, 20 bp, Artificial Sequence
  chemically synthesized
cagggcagagaattgcaaaa

SEQ ID NO: 442898 - DNA, 20 bp, Artificial Sequence
  chemically synthesized
agggcagagaattgcaaaat

SEQ ID NO: 442899 - DNA, 20 bp, Artificial Sequence
  chemically synthesized
agagaattgcaaaatgggtg

SEQ ID NO: 442900 - DNA, 20 bp, Artificial Sequence
  chemically synthesized
gaattgcaaaatgggtgtgg

SEQ ID NO: 442901 - DNA, 20 bp, Artificial Sequence
  chemically synthesized
tgcaaaatgggtgtggtagc

SEQ ID NO: 442902 - DNA, 20 bp, Artificial Sequence
  chemically synthesized
gcaaaatgggtgtggtagcg

SEQ ID NO: 442903 - DNA, 20 bp, Artificial Sequence
  chemically synthesized
aaaatgggtgtggtagcgag

SEQ ID NO: 442904 - DNA, 20 bp, Artificial Sequence
  chemically synthesized
atgggtgtggtagcgaggag

SEQ ID NO: 442905 - DNA, 20 bp, Artificial Sequence
  chemically synthesized
gggtgtggtagcgaggagtg

SEQ ID NO: 442906 - DNA, 20 bp, Artificial Sequence
  chemically synthesized
ttcagttgtattagtggcag

SEQ ID NO: 442907 - DNA, 20 bp, Artificial Sequence
  chemically synthesized
ttcttcagttgtattagtgg

SEQ ID NO: 442908 - DNA, 20 bp, Artificial Sequence
  chemically synthesized
aaattcttcagttgtattag

SEQ ID NO: 442909 - DNA, 20 bp, Artificial Sequence
  chemically synthesized
taaaaattcttcagttgtat

SEQ ID NO: 442910 - DNA, 20 bp, Artificial Sequence
  chemically synthesized
cactgccactaatacaactg

SEQ ID NO: 442911 - DNA, 20 bp, Artificial Sequence
  chemically synthesized
cctgcttgctaaaaattctt

SEQ ID NO: 442912 - DNA, 20 bp, Artificial Sequence
  chemically synthesized
taatacaactgaagaatttt

SEQ ID NO: 442913 - DNA, 20 bp, Artificial Sequence
  chemically synthesized
acaactgaagaatttttagc

SEQ ID NO: 442914 - DNA, 20 bp, Artificial Sequence
  chemically synthesized
actgaagaatttttagcaag

SEQ ID NO: 442915 - DNA, 20 bp, Artificial Sequence
  chemically synthesized
ctgaagaatttttagcaagc

SEQ ID NO: 442916 - DNA, 20 bp, Artificial Sequence
  chemically synthesized
aagactgaaatggtaggggt

SEQ ID NO: 442917 - DNA, 20 bp, Artificial Sequence
  chemically synthesized
atccaagactgaaatggtag

SEQ ID NO: 442918 - DNA, 20 bp, Artificial Sequence
  chemically synthesized
catccaagactgaaatggta

SEQ ID NO: 442919 - DNA, 20 bp, Artificial Sequence
  chemically synthesized
caggctcacccctaccattt

SEQ ID NO: 442920 - DNA, 20 bp, Artificial Sequence
  chemically synthesized
ccatccaagactgaaatggt

SEQ ID NO: 442921 - DNA, 20 bp, Artificial Sequence
  chemically synthesized
tccatccaagactgaaatgg

SEQ ID NO: 442922 - DNA, 20 bp, Artificial Sequence
  chemically synthesized
gtatccatccaagactgaaa

SEQ ID NO: 442923 - DNA, 20 bp, Artificial Sequence
  chemically synthesized
cacccctaccatttcagtct

SEQ ID NO: 442924 - DNA, 20 bp, Artificial Sequence
  chemically synthesized
cctaccatttcagtcttgga

SEQ ID NO: 442925 - DNA, 20 bp, Artificial Sequence
  chemically synthesized
ctagtactgagtatccatcc

SEQ ID NO: 442926 - DNA, 20 bp, Artificial Sequence
  chemically synthesized
ttcagtcttggatggatact

SEQ ID NO: 442927 - DNA, 20 bp, Artificial Sequence
  chemically synthesized
cttggatggatactcagtac

SEQ ID NO: 442928 - DNA, 20 bp, Artificial Sequence
  chemically synthesized
caaggtatcacactagtact

SEQ ID NO: 442929 - DNA, 20 bp, Artificial Sequence
  chemically synthesized
ttttctacaaggtatcacac

SEQ ID NO: 442930 - DNA, 20 bp, Artificial Sequence
  chemically synthesized
agtactagtgtgataccttg

SEQ ID NO: 442931 - DNA, 20 bp, Artificial Sequence
  chemically synthesized
ccttgatcatattttctaca

SEQ ID NO: 442932 - DNA, 20 bp, Artificial Sequence
  chemically synthesized
tccttgatcatattttctac

SEQ ID NO: 442933 - DNA, 20 bp, Artificial Sequence
  chemically synthesized
accttgtagaaaatatgatc

SEQ ID NO: 442934 - DNA, 20 bp, Artificial Sequence
  chemically synthesized
ccttgtagaaaatatgatca

SEQ ID NO: 442935 - DNA, 20 bp, Artificial Sequence
  chemically synthesized
aaaatatgatcaaggatgaa

SEQ ID NO: 442936 - DNA, 20 bp, Artificial Sequence
  chemically synthesized
aggcaaaggctacattgcgt

SEQ ID NO: 442937 - DNA, 20 bp, Artificial Sequence
  chemically synthesized
tgaatagatcctacgcaatg

SEQ ID NO: 442938 - DNA, 20 bp, Artificial Sequence
  chemically synthesized
aaggcaaaggctacattgcg

SEQ ID NO: 442939 - DNA, 20 bp, Artificial Sequence
  chemically synthesized
agggttgaaaatgaaggcaa

SEQ ID NO: 442940 - DNA, 20 bp, Artificial Sequence
  chemically synthesized
tagggttgaaaatgaaggca

SEQ ID NO: 442941 - DNA, 20 bp, Artificial Sequence
  chemically synthesized
agatgtagggttgaaaatga

SEQ ID NO: 442942 - DNA, 20 bp, Artificial Sequence
  chemically synthesized
gagatgtagggttgaaaatg

SEQ ID NO: 442943 - DNA, 20 bp, Artificial Sequence
  chemically synthesized
caaggaagttcagagatgta

SEQ ID NO: 442944 - DNA, 20 bp, Artificial Sequence
  chemically synthesized
tcaaggaagttcagagatgt

SEQ ID NO: 442945 - DNA, 20 bp, Artificial Sequence
  chemically synthesized
ctcaaggaagttcagagatg

SEQ ID NO: 442946 - DNA, 20 bp, Artificial Sequence
  chemically synthesized
acataactcaaggaagttca

SEQ ID NO: 442947 - DNA, 20 bp, Artificial Sequence
  chemically synthesized
taacataactcaaggaagtt

SEQ ID NO: 442948 - DNA, 20 bp, Artificial Sequence
  chemically synthesized
ctacatctctgaacttcctt

SEQ ID NO: 442949 - DNA, 20 bp, Artificial Sequence
  chemically synthesized
gcacataacataactcaagg

SEQ ID NO: 442950 - DNA, 20 bp, Artificial Sequence
  chemically synthesized
aaagcacataacataactca

SEQ ID NO: 442951 - DNA, 20 bp, Artificial Sequence
  chemically synthesized
gaaagcacataacataactc

SEQ ID NO: 442952 - DNA, 20 bp, Artificial Sequence
  chemically synthesized
tctgagatataatagtagga

SEQ ID NO: 442953 - DNA, 20 bp, Artificial Sequence
  chemically synthesized
ataatctgagatataatagt

SEQ ID NO: 442954 - DNA, 20 bp, Artificial Sequence
  chemically synthesized
aataatctgagatataatag

SEQ ID NO: 442955 - DNA, 20 bp, Artificial Sequence
  chemically synthesized
ttaaataatctgagatataa

SEQ ID NO: 442956 - DNA, 20 bp, Artificial Sequence
  chemically synthesized
gctttcctactattatatct

SEQ ID NO: 442957 - DNA, 20 bp, Artificial Sequence
  chemically synthesized
atgaattttttaaataatct

SEQ ID NO: 442958 - DNA, 20 bp, Artificial Sequence
  chemically synthesized
attcatcatacatgttttct

SEQ ID NO: 442959 - DNA, 20 bp, Artificial Sequence
  chemically synthesized
atacatgttttctgagcatg

SEQ ID NO: 442960 - DNA, 20 bp, Artificial Sequence
  chemically synthesized
agggagtaaagctgcatgct

SEQ ID NO: 442961 - DNA, 20 bp, Artificial Sequence
  chemically synthesized
acacatgcaaaaagggagta

SEQ ID NO: 442962 - DNA, 20 bp, Artificial Sequence
  chemically synthesized
ttatcacacatgcaaaaagg

SEQ ID NO: 442963 - DNA, 20 bp, Artificial Sequence
  chemically synthesized
atttatcacacatgcaaaaa

SEQ ID NO: 442964 - DNA, 20 bp, Artificial Sequence
  chemically synthesized
tatttatcacacatgcaaaa

SEQ ID NO: 442965 - DNA, 20 bp, Artificial Sequence
  chemically synthesized
ttatttatcacacatgcaaa

SEQ ID NO: 442966 - DNA, 20 bp, Artificial Sequence
  chemically synthesized
tgcatgtgtgataaataaat

SEQ ID NO: 442967 - DNA, 20 bp, Artificial Sequence
  chemically synthesized
gcatgtgtgataaataaatt

SEQ ID NO: 442968 - DNA, 20 bp, Artificial Sequence
  chemically synthesized
aataaattgggtgtatgttt

SEQ ID NO: 442969 - DNA, 20 bp, Artificial Sequence
  chemically synthesized
ataaattgggtgtatgttta

SEQ ID NO: 442970 - DNA, 20 bp, Artificial Sequence
  chemically synthesized
ttaaggtgtttcttacctga

SEQ ID NO: 442971 - DNA, 20 bp, Artificial Sequence
  chemically synthesized
gagcttgccttccatcaggt

SEQ ID NO: 442972 - DNA, 20 bp, Artificial Sequence
  chemically synthesized
aggtgtttcttacctgatgg

SEQ ID NO: 442973 - DNA, 20 bp, Artificial Sequence
  chemically synthesized
ggtgtttcttacctgatgga

SEQ ID NO: 442974 - DNA, 20 bp, Artificial Sequence
  chemically synthesized
gatggagcttgccttccatc

SEQ ID NO: 442975 - DNA, 20 bp, Artificial Sequence
  chemically synthesized
tgatggagcttgccttccat

SEQ ID NO: 442976 - DNA, 20 bp, Artificial Sequence
  chemically synthesized
tttcttacctgatggaaggc

SEQ ID NO: 442977 - DNA, 20 bp, Artificial Sequence
  chemically synthesized
aagacacaactgttttgatg

SEQ ID NO: 442978 - DNA, 20 bp, Artificial Sequence
  chemically synthesized
gaaggcaagctccatcaaaa

SEQ ID NO: 442979 - DNA, 20 bp, Artificial Sequence
  chemically synthesized
ggaagacacaactgttttga

SEQ ID NO: 442980 - DNA, 20 bp, Artificial Sequence
  chemically synthesized
aacagttgtgtcttcctttt

SEQ ID NO: 442981 - DNA, 20 bp, Artificial Sequence
  chemically synthesized
tgataaagcaactaaaaagg

SEQ ID NO: 442982 - DNA, 20 bp, Artificial Sequence
  chemically synthesized
tagtgataaagcaactaaaa

SEQ ID NO: 442983 - DNA, 20 bp, Artificial Sequence
  chemically synthesized
atagtgataaagcaactaaa

SEQ ID NO: 442984 - DNA, 20 bp, Artificial Sequence
  chemically synthesized
aatgacaagcaatagtgata

SEQ ID NO: 442985 - DNA, 20 bp, Artificial Sequence
  chemically synthesized
cacaacaaaatgacaagcaa

SEQ ID NO: 442986 - DNA, 20 bp, Artificial Sequence
  chemically synthesized
tattcacacaacaaaatgac

SEQ ID NO: 442987 - DNA, 20 bp, Artificial Sequence
  chemically synthesized
atacaaagaaattgcaagtg

SEQ ID NO: 442988 - DNA, 20 bp, Artificial Sequence
  chemically synthesized
taatacaaagaaattgcaag

SEQ ID NO: 442989 - DNA, 20 bp, Artificial Sequence
  chemically synthesized
atataatacaaagaaattgc

SEQ ID NO: 442990 - DNA, 20 bp, Artificial Sequence
  chemically synthesized
tacacaaaggatataataca

SEQ ID NO: 442991 - DNA, 20 bp, Artificial Sequence
  chemically synthesized
agggagcatataatacacaa

SEQ ID NO: 442992 - DNA, 20 bp, Artificial Sequence
  chemically synthesized
gagggagcatataatacaca

SEQ ID NO: 442993 - DNA, 20 bp, Artificial Sequence
  chemically synthesized
caaagcccagaagaatgagg

SEQ ID NO: 442994 - DNA, 20 bp, Artificial Sequence
  chemically synthesized
aacaaagcccagaagaatga

SEQ ID NO: 442995 - DNA, 20 bp, Artificial Sequence
  chemically synthesized
aaacaaagcccagaagaatg

SEQ ID NO: 442996 - DNA, 20 bp, Artificial Sequence
  chemically synthesized
tatatgctccctcattcttc

SEQ ID NO: 442997 - DNA, 20 bp, Artificial Sequence
  chemically synthesized
taaacaaagcccagaagaat

SEQ ID NO: 442998 - DNA, 20 bp, Artificial Sequence
  chemically synthesized
atatgctccctcattcttct

SEQ ID NO: 442999 - DNA, 20 bp, Artificial Sequence
  chemically synthesized
taaatttaaacaaagcccag

SEQ ID NO: 443000 - DNA, 20 bp, Artificial Sequence
  chemically synthesized
aagtaaatttaaacaaagcc

SEQ ID NO: 443001 - DNA, 20 bp, Artificial Sequence
  chemically synthesized
tcataaagtaaatttaaaca

SEQ ID NO: 443002 - DNA, 20 bp, Artificial Sequence
  chemically synthesized
ttgtttaaatttactttatg

SEQ ID NO: 443003 - DNA, 20 bp, Artificial Sequence
  chemically synthesized
taaaaaaaataatcttcata

SEQ ID NO: 443004 - DNA, 20 bp, Artificial Sequence
  chemically synthesized
tttatgaagattattttttt

SEQ ID NO: 443005 - DNA, 20 bp, Artificial Sequence
  chemically synthesized
ctatgagtgggagtgaggag

SEQ ID NO: 443006 - DNA, 20 bp, Artificial Sequence
  chemically synthesized
catctatgagtgggagtgag

SEQ ID NO: 443007 - DNA, 20 bp, Artificial Sequence
  chemically synthesized
cccatctatgagtgggagtg

SEQ ID NO: 443008 - DNA, 20 bp, Artificial Sequence
  chemically synthesized
acccatctatgagtgggagt

SEQ ID NO: 443009 - DNA, 20 bp, Artificial Sequence
  chemically synthesized
cttctcctcactcccactca

SEQ ID NO: 443010 - DNA, 20 bp, Artificial Sequence
  chemically synthesized
ttagacccatctatgagtgg

SEQ ID NO: 443011 - DNA, 20 bp, Artificial Sequence
  chemically synthesized
tgttagacccatctatgagt

SEQ ID NO: 443012 - DNA, 20 bp, Artificial Sequence
  chemically synthesized
ttgttagacccatctatgag

SEQ ID NO: 443013 - DNA, 20 bp, Artificial Sequence
  chemically synthesized
tcctcactcccactcataga

SEQ ID NO: 443014 - DNA, 20 bp, Artificial Sequence
  chemically synthesized
cctcactcccactcatagat

SEQ ID NO: 443015 - DNA, 20 bp, Artificial Sequence
  chemically synthesized
atattgttagacccatctat

SEQ ID NO: 443016 - DNA, 20 bp, Artificial Sequence
  chemically synthesized
taaagatgcattcatattgt

SEQ ID NO: 443017 - DNA, 20 bp, Artificial Sequence
  chemically synthesized
atgaatgcatctttactact

SEQ ID NO: 443018 - DNA, 20 bp, Artificial Sequence
  chemically synthesized
aagtttacagctgagtagta

SEQ ID NO: 443019 - DNA, 20 bp, Artificial Sequence
  chemically synthesized
tcaagaagtttacagctgag

SEQ ID NO: 443020 - DNA, 20 bp, Artificial Sequence
  chemically synthesized
atatcaagaagtttacagct

SEQ ID NO: 443021 - DNA, 20 bp, Artificial Sequence
  chemically synthesized
tcttaatatcaagaagttta

SEQ ID NO: 443022 - DNA, 20 bp, Artificial Sequence
  chemically synthesized
aattaattcttaatatcaag

SEQ ID NO: 443023 - DNA, 20 bp, Artificial Sequence
  chemically synthesized
gctgtaaacttcttgatatt

SEQ ID NO: 443024 - DNA, 20 bp, Artificial Sequence
  chemically synthesized
agcaattaattcttaatatc

SEQ ID NO: 443025 - DNA, 20 bp, Artificial Sequence
  chemically synthesized
agttatcaacataatataaa

SEQ ID NO: 443026 - DNA, 20 bp, Artificial Sequence
  chemically synthesized
ttatattatgttgataactt

SEQ ID NO: 443027 - DNA, 20 bp, Artificial Sequence
  chemically synthesized
caatgtgcttttgagagcta

SEQ ID NO: 443028 - DNA, 20 bp, Artificial Sequence
  chemically synthesized
ttgataactttagctctcaa

SEQ ID NO: 443029 - DNA, 20 bp, Artificial Sequence
  chemically synthesized
tacacccaatgtgcttttga

SEQ ID NO: 443030 - DNA, 20 bp, Artificial Sequence
  chemically synthesized
attacacccaatgtgctttt

SEQ ID NO: 443031 - DNA, 20 bp, Artificial Sequence
  chemically synthesized
tttagctctcaaaagcacat

SEQ ID NO: 443032 - DNA, 20 bp, Artificial Sequence
  chemically synthesized
ttagctctcaaaagcacatt

SEQ ID NO: 443033 - DNA, 20 bp, Artificial Sequence
  chemically synthesized
caaaagcacattgggtgtaa

SEQ ID NO: 443034 - DNA, 20 bp, Artificial Sequence
  chemically synthesized
aaaagcacattgggtgtaat

SEQ ID NO: 443035 - DNA, 20 bp, Artificial Sequence
  chemically synthesized
aagcacattgggtgtaatag

SEQ ID NO: 443036 - DNA, 20 bp, Artificial Sequence
  chemically synthesized
cattgggtgtaataggagtt

SEQ ID NO: 443037 - DNA, 20 bp, Artificial Sequence
  chemically synthesized
taataggagtttagtgatat

SEQ ID NO: 443038 - DNA, 20 bp, Artificial Sequence
  chemically synthesized
aggagtttagtgatatcagt

SEQ ID NO: 443039 - DNA, 20 bp, Artificial Sequence
  chemically synthesized
tagtgatatcagttggaaaa

SEQ ID NO: 443040 - DNA, 20 bp, Artificial Sequence
  chemically synthesized
agtgatatcagttggaaaaa

SEQ ID NO: 443041 - DNA, 20 bp, Artificial Sequence
  chemically synthesized
atcagttggaaaaaaggaaa

SEQ ID NO: 443042 - DNA, 20 bp, Artificial Sequence
  chemically synthesized
tcagttggaaaaaaggaaac

SEQ ID NO: 443043 - DNA, 20 bp, Artificial Sequence
  chemically synthesized
ttggaaaaaaggaaacaggc

SEQ ID NO: 443044 - DNA, 20 bp, Artificial Sequence
  chemically synthesized
ggaaaaaaggaaacaggcaa

SEQ ID NO: 443045 - DNA, 20 bp, Artificial Sequence
  chemically synthesized
aaaaaaggaaacaggcaaga

SEQ ID NO: 443046 - DNA, 20 bp, Artificial Sequence
  chemically synthesized
aaaaaggaaacaggcaagag

SEQ ID NO: 443047 - DNA, 20 bp, Artificial Sequence
  chemically synthesized
aaaaggaaacaggcaagaga

SEQ ID NO: 443048 - DNA, 20 bp, Artificial Sequence
  chemically synthesized
acaggcaagagagggaaata

SEQ ID NO: 443049 - DNA, 20 bp, Artificial Sequence
  chemically synthesized
aaataaagaaatttatgatc

SEQ ID NO: 443050 - DNA, 20 bp, Artificial Sequence
  chemically synthesized
ttttaaattttatgatgatc

SEQ ID NO: 443051 - DNA, 20 bp, Artificial Sequence
  chemically synthesized
ttgctactctcaaacattca

SEQ ID NO: 443052 - DNA, 20 bp, Artificial Sequence
  chemically synthesized
aaaataaactttgaatgttt

SEQ ID NO: 443053 - DNA, 20 bp, Artificial Sequence
  chemically synthesized
aataaactttgaatgtttga

SEQ ID NO: 443054 - DNA, 20 bp, Artificial Sequence
  chemically synthesized
aaactttgaatgtttgagag

SEQ ID NO: 443055 - DNA, 20 bp, Artificial Sequence
  chemically synthesized
catacactctcaaagagatt

SEQ ID NO: 443056 - DNA, 20 bp, Artificial Sequence
  chemically synthesized
gtagcaaaccaaatctcttt

SEQ ID NO: 443057 - DNA, 20 bp, Artificial Sequence
  chemically synthesized
agcaaaccaaatctctttga

SEQ ID NO: 443058 - DNA, 20 bp, Artificial Sequence
  chemically synthesized
ttttagcatacactctcaaa

SEQ ID NO: 443059 - DNA, 20 bp, Artificial Sequence
  chemically synthesized
tcttttagcatacactctca

SEQ ID NO: 443060 - DNA, 20 bp, Artificial Sequence
  chemically synthesized
tctttgagagtgtatgctaa

SEQ ID NO: 443061 - DNA, 20 bp, Artificial Sequence
  chemically synthesized
ccaaggttcataatttcttt

SEQ ID NO: 443062 - DNA, 20 bp, Artificial Sequence
  chemically synthesized
ctaaaagaaattatgaacct

SEQ ID NO: 443063 - DNA, 20 bp, Artificial Sequence
  chemically synthesized
atggtcatcccatagtacca

SEQ ID NO: 443064 - DNA, 20 bp, Artificial Sequence
  chemically synthesized
aattatgaaccttggtacta

SEQ ID NO: 443065 - DNA, 20 bp, Artificial Sequence
  chemically synthesized
tatggtcatcccatagtacc

SEQ ID NO: 443066 - DNA, 20 bp, Artificial Sequence
  chemically synthesized
attatgaaccttggtactat

SEQ ID NO: 443067 - DNA, 20 bp, Artificial Sequence
  chemically synthesized
ttgtcactatggtcatccca

SEQ ID NO: 443068 - DNA, 20 bp, Artificial Sequence
  chemically synthesized
ttggtactatgggatgacca

SEQ ID NO: 443069 - DNA, 20 bp, Artificial Sequence
  chemically synthesized
taaatgagaatttgtcacta

SEQ ID NO: 443070 - DNA, 20 bp, Artificial Sequence
  chemically synthesized
ccagttccattgttttaaat

SEQ ID NO: 443071 - DNA, 20 bp, Artificial Sequence
  chemically synthesized
caaattctcatttaaaacaa

SEQ ID NO: 443072 - DNA, 20 bp, Artificial Sequence
  chemically synthesized
ctcatttaaaacaatggaac

SEQ ID NO: 443073 - DNA, 20 bp, Artificial Sequence
  chemically synthesized
tcatttaaaacaatggaact

SEQ ID NO: 443074 - DNA, 20 bp, Artificial Sequence
  chemically synthesized
aaaacaatggaactgggccg

SEQ ID NO: 443075 - DNA, 20 bp, Artificial Sequence
  chemically synthesized
tacacatttattccacggcc

SEQ ID NO: 443076 - DNA, 20 bp, Artificial Sequence
  chemically synthesized
ataaatacacatttattcca

SEQ ID NO: 443077 - DNA, 20 bp, Artificial Sequence
  chemically synthesized
tttatttatgaaacatttat

SEQ ID NO: 443078 - DNA, 20 bp, Artificial Sequence
  chemically synthesized
ttatttatgaaacatttatt

SEQ ID NO: 443079 - DNA, 20 bp, Artificial Sequence
  chemically synthesized
tatttatgaaacatttatta

SEQ ID NO: 443080 - DNA, 20 bp, Artificial Sequence
  chemically synthesized
tatgaaacatttattagggc

SEQ ID NO: 443081 - DNA, 20 bp, Artificial Sequence
  chemically synthesized
tatctttaatgcagaaaatc

SEQ ID NO: 443082 - DNA, 20 bp, Artificial Sequence
  chemically synthesized
gggccagattttctgcatta

SEQ ID NO: 443083 - DNA, 20 bp, Artificial Sequence
  chemically synthesized
gttagctcatatctttaatg

SEQ ID NO: 443084 - DNA, 20 bp, Artificial Sequence
  chemically synthesized
attttctgcattaaagatat

SEQ ID NO: 443085 - DNA, 20 bp, Artificial Sequence
  chemically synthesized
aagatatgagctaacaactt

SEQ ID NO: 443086 - DNA, 20 bp, Artificial Sequence
  chemically synthesized
gggcagggacctgaagttgt

SEQ ID NO: 443087 - DNA, 20 bp, Artificial Sequence
  chemically synthesized
agatatgagctaacaacttc

SEQ ID NO: 443088 - DNA, 20 bp, Artificial Sequence
  chemically synthesized
tatttgagggcagggacctg

SEQ ID NO: 443089 - DNA, 20 bp, Artificial Sequence
  chemically synthesized
gtataatctatttgagggca

SEQ ID NO: 443090 - DNA, 20 bp, Artificial Sequence
  chemically synthesized
ggtataatctatttgagggc

SEQ ID NO: 443091 - DNA, 20 bp, Artificial Sequence
  chemically synthesized
aggtataatctatttgaggg

SEQ ID NO: 443092 - DNA, 20 bp, Artificial Sequence
  chemically synthesized
ttcaggtccctgccctcaaa

SEQ ID NO: 443093 - DNA, 20 bp, Artificial Sequence
  chemically synthesized
ccaaggtataatctatttga

SEQ ID NO: 443094 - DNA, 20 bp, Artificial Sequence
  chemically synthesized
cccaaggtataatctatttg

SEQ ID NO: 443095 - DNA, 20 bp, Artificial Sequence
  chemically synthesized
acccaaggtataatctattt

SEQ ID NO: 443096 - DNA, 20 bp, Artificial Sequence
  chemically synthesized
ccctcaaatagattatacct

SEQ ID NO: 443097 - DNA, 20 bp, Artificial Sequence
  chemically synthesized
cctcaaatagattatacctt

SEQ ID NO: 443098 - DNA, 20 bp, Artificial Sequence
  chemically synthesized
cttttcttttaatataccca

SEQ ID NO: 443099 - DNA, 20 bp, Artificial Sequence
  chemically synthesized
acttttcttttaatataccc

SEQ ID NO: 443100 - DNA, 20 bp, Artificial Sequence
  chemically synthesized
ttataccttgggtatattaa

SEQ ID NO: 443101 - DNA, 20 bp, Artificial Sequence
  chemically synthesized
ccttgggtatattaaaagaa

SEQ ID NO: 443102 - DNA, 20 bp, Artificial Sequence
  chemically synthesized
attgaagtttatcaattagc

SEQ ID NO: 443103 - DNA, 20 bp, Artificial Sequence
  chemically synthesized
tattgaagtttatcaattag

SEQ ID NO: 443104 - DNA, 20 bp, Artificial Sequence
  chemically synthesized
gcttattgaagtttatcaat

SEQ ID NO: 443105 - DNA, 20 bp, Artificial Sequence
  chemically synthesized
gctaattgataaacttcaat

SEQ ID NO: 443106 - DNA, 20 bp, Artificial Sequence
  chemically synthesized
gaaagtcttcaagcttattg

SEQ ID NO: 443107 - DNA, 20 bp, Artificial Sequence
  chemically synthesized
gataaacttcaataagcttg

SEQ ID NO: 443108 - DNA, 20 bp, Artificial Sequence
  chemically synthesized
tctctgagacgaaagtcttc

SEQ ID NO: 443109 - DNA, 20 bp, Artificial Sequence
  chemically synthesized
aagcttgaagactttcgtct

SEQ ID NO: 443110 - DNA, 20 bp, Artificial Sequence
  chemically synthesized
taggtacctctctgagacga

SEQ ID NO: 443111 - DNA, 20 bp, Artificial Sequence
  chemically synthesized
gcttgaagactttcgtctca

SEQ ID NO: 443112 - DNA, 20 bp, Artificial Sequence
  chemically synthesized
ttgaagactttcgtctcaga

SEQ ID NO: 443113 - DNA, 20 bp, Artificial Sequence
  chemically synthesized
tgaagactttcgtctcagag

SEQ ID NO: 443114 - DNA, 20 bp, Artificial Sequence
  chemically synthesized
ttgctattaggtacctctct

SEQ ID NO: 443115 - DNA, 20 bp, Artificial Sequence
  chemically synthesized
cgtctcagagaggtacctaa

SEQ ID NO: 443116 - DNA, 20 bp, Artificial Sequence
  chemically synthesized
tcagagaggtacctaatagc

SEQ ID NO: 443117 - DNA, 20 bp, Artificial Sequence
  chemically synthesized
taaaacctggtcttgctatt

SEQ ID NO: 443118 - DNA, 20 bp, Artificial Sequence
  chemically synthesized
ttaaaacctggtcttgctat

SEQ ID NO: 443119 - DNA, 20 bp, Artificial Sequence
  chemically synthesized
gaggtacctaatagcaagac

SEQ ID NO: 443120 - DNA, 20 bp, Artificial Sequence
  chemically synthesized
aggtacctaatagcaagacc

SEQ ID NO: 443121 - DNA, 20 bp, Artificial Sequence
  chemically synthesized
aatagcaagaccaggtttta

SEQ ID NO: 443122 - DNA, 20 bp, Artificial Sequence
  chemically synthesized
acggtgttatctttaaaacc

SEQ ID NO: 443123 - DNA, 20 bp, Artificial Sequence
  chemically synthesized
tttatagtaggcagtgcata

SEQ ID NO: 443124 - DNA, 20 bp, Artificial Sequence
  chemically synthesized
tgacaatattttatagtagg

SEQ ID NO: 443125 - DNA, 20 bp, Artificial Sequence
  chemically synthesized
aaatgacaatattttatagt

SEQ ID NO: 443126 - DNA, 20 bp, Artificial Sequence
  chemically synthesized
taaatgacaatattttatag

SEQ ID NO: 443127 - DNA, 20 bp, Artificial Sequence
  chemically synthesized
acctaaatgacaatatttta

SEQ ID NO: 443128 - DNA, 20 bp, Artificial Sequence
  chemically synthesized
tactataaaatattgtcatt

SEQ ID NO: 443129 - DNA, 20 bp, Artificial Sequence
  chemically synthesized
actataaaatattgtcattt

SEQ ID NO: 443130 - DNA, 20 bp, Artificial Sequence
  chemically synthesized
attgtcatttaggttaaatt

SEQ ID NO: 443131 - DNA, 20 bp, Artificial Sequence
  chemically synthesized
attaagcattgcgttttaaa

SEQ ID NO: 443132 - DNA, 20 bp, Artificial Sequence
  chemically synthesized
ctagtgtatgcgtttgggag

SEQ ID NO: 443133 - DNA, 20 bp, Artificial Sequence
  chemically synthesized
tgtctagtgtatgcgtttgg

SEQ ID NO: 443134 - DNA, 20 bp, Artificial Sequence
  chemically synthesized
cttgtctagtgtatgcgttt

SEQ ID NO: 443135 - DNA, 20 bp, Artificial Sequence
  chemically synthesized
tcttgtctagtgtatgcgtt

SEQ ID NO: 443136 - DNA, 20 bp, Artificial Sequence
  chemically synthesized
ctgctcccaaacgcatacac

SEQ ID NO: 443137 - DNA, 20 bp, Artificial Sequence
  chemically synthesized
cccaaacgcatacactagac

SEQ ID NO: 443138 - DNA, 20 bp, Artificial Sequence
  chemically synthesized
ctgagacttttcatcttgtc

SEQ ID NO: 443139 - DNA, 20 bp, Artificial Sequence
  chemically synthesized
catacactagacaagatgaa

SEQ ID NO: 443140 - DNA, 20 bp, Artificial Sequence
  chemically synthesized
ctagacaagatgaaaagtct

SEQ ID NO: 443141 - DNA, 20 bp, Artificial Sequence
  chemically synthesized
agaactttgattattgatct

SEQ ID NO: 443142 - DNA, 20 bp, Artificial Sequence
  chemically synthesized
aagtctcagatcaataatca

SEQ ID NO: 443143 - DNA, 20 bp, Artificial Sequence
  chemically synthesized
ataatcaaagttctcatctc

SEQ ID NO: 443144 - DNA, 20 bp, Artificial Sequence
  chemically synthesized
tattattttcttcttgagat

SEQ ID NO: 443145 - DNA, 20 bp, Artificial Sequence
  chemically synthesized
atcaaagttctcatctcaag

SEQ ID NO: 443146 - DNA, 20 bp, Artificial Sequence
  chemically synthesized
ctctttattattttcttctt

SEQ ID NO: 443147 - DNA, 20 bp, Artificial Sequence
  chemically synthesized
atctcaagaagaaaataata

SEQ ID NO: 443148 - DNA, 20 bp, Artificial Sequence
  chemically synthesized
ctcaagaagaaaataataaa

SEQ ID NO: 443149 - DNA, 20 bp, Artificial Sequence
  chemically synthesized
ttttctgtttttattttgat

SEQ ID NO: 443150 - DNA, 20 bp, Artificial Sequence
  chemically synthesized
aaaactaatcaaaataaaaa

SEQ ID NO: 443151 - DNA, 20 bp, Artificial Sequence
  chemically synthesized
tcaaaataaaaacagaaaaa

SEQ ID NO: 443152 - DNA, 20 bp, Artificial Sequence
  chemically synthesized
ataaaaacagaaaaacagta

SEQ ID NO: 443153 - DNA, 20 bp, Artificial Sequence
  chemically synthesized
aaaacagaaaaacagtaaag

SEQ ID NO: 443154 - DNA, 20 bp, Artificial Sequence
  chemically synthesized
gtaaagaagattcattaaca

SEQ ID NO: 443155 - DNA, 20 bp, Artificial Sequence
  chemically synthesized
aaagaagattcattaacaaa

SEQ ID NO: 443156 - DNA, 20 bp, Artificial Sequence
  chemically synthesized
tattgaccgttttgaaaaaa

SEQ ID NO: 443157 - DNA, 20 bp, Artificial Sequence
  chemically synthesized
aaagagctattttttcaaaa

SEQ ID NO: 443158 - DNA, 20 bp, Artificial Sequence
  chemically synthesized
taaaattgacaatgtgctaa

SEQ ID NO: 443159 - DNA, 20 bp, Artificial Sequence
  chemically synthesized
aattttttctttgtcacttt

SEQ ID NO: 443160 - DNA, 20 bp, Artificial Sequence
  chemically synthesized
acaatgtgctaaaagtgaca

SEQ ID NO: 443161 - DNA, 20 bp, Artificial Sequence
  chemically synthesized
aaagtgacaaagaaaaaatt

SEQ ID NO: 443162 - DNA, 20 bp, Artificial Sequence
  chemically synthesized
agtgacaaagaaaaaattga

SEQ ID NO: 443163 - DNA, 20 bp, Artificial Sequence
  chemically synthesized
gtgacaaagaaaaaattgag

SEQ ID NO: 443164 - DNA, 20 bp, Artificial Sequence
  chemically synthesized
agaaaaaattgagaggacac

SEQ ID NO: 443165 - DNA, 20 bp, Artificial Sequence
  chemically synthesized
aggacacaagttacccgtat

SEQ ID NO: 443166 - DNA, 20 bp, Artificial Sequence
  chemically synthesized
ccctacttcatttctgatac

SEQ ID NO: 443167 - DNA, 20 bp, Artificial Sequence
  chemically synthesized
tccctacttcatttctgata

SEQ ID NO: 443168 - DNA, 20 bp, Artificial Sequence
  chemically synthesized
agttacccgtatcagaaatg

SEQ ID NO: 443169 - DNA, 20 bp, Artificial Sequence
  chemically synthesized
tacccgtatcagaaatgaag

SEQ ID NO: 443170 - DNA, 20 bp, Artificial Sequence
  chemically synthesized
acccgtatcagaaatgaagt

SEQ ID NO: 443171 - DNA, 20 bp, Artificial Sequence
  chemically synthesized
cccgtatcagaaatgaagta

SEQ ID NO: 443172 - DNA, 20 bp, Artificial Sequence
  chemically synthesized
tgaagtagggaatattacta

SEQ ID NO: 443173 - DNA, 20 bp, Artificial Sequence
  chemically synthesized
gaagtagggaatattactac

SEQ ID NO: 443174 - DNA, 20 bp, Artificial Sequence
  chemically synthesized
agggaatattactacaggcc

SEQ ID NO: 443175 - DNA, 20 bp, Artificial Sequence
  chemically synthesized
ctttgtattttccaggcctg

SEQ ID NO: 443176 - DNA, 20 bp, Artificial Sequence
  chemically synthesized
tttttttctttgtattttcc

SEQ ID NO: 443177 - DNA, 20 bp, Artificial Sequence
  chemically synthesized
ttttttttctttgtattttc

SEQ ID NO: 443178 - DNA, 20 bp, Artificial Sequence
  chemically synthesized
ctacaggcctggaaaataca

SEQ ID NO: 443179 - DNA, 20 bp, Artificial Sequence
  chemically synthesized
ggaaaatacaaagaaaaaaa

SEQ ID NO: 443180 - DNA, 20 bp, Artificial Sequence
  chemically synthesized
aatacaaagaaaaaaaaaga

SEQ ID NO: 443181 - DNA, 20 bp, Artificial Sequence
  chemically synthesized
caaagaaaaaaaaagacagt

SEQ ID NO: 443182 - DNA, 20 bp, Artificial Sequence
  chemically synthesized
aaagaaaaaaaaagacagta

SEQ ID NO: 443183 - DNA, 20 bp, Artificial Sequence
  chemically synthesized
aagaaaaaaaaagacagtaa

SEQ ID NO: 443184 - DNA, 20 bp, Artificial Sequence
  chemically synthesized
cttatgtgaagaattgttca

SEQ ID NO: 443185 - DNA, 20 bp, Artificial Sequence
  chemically synthesized
ctatgaacaattcttcacat

SEQ ID NO: 443186 - DNA, 20 bp, Artificial Sequence
  chemically synthesized
aattattaaatacttatgtg

SEQ ID NO: 443187 - DNA, 20 bp, Artificial Sequence
  chemically synthesized
cacataagtatttaataatt

SEQ ID NO: 443188 - DNA, 20 bp, Artificial Sequence
  chemically synthesized
atttaataatttagatgaaa

SEQ ID NO: 443189 - DNA, 20 bp, Artificial Sequence
  chemically synthesized
gaaatagattgattcttcaa

SEQ ID NO: 443190 - DNA, 20 bp, Artificial Sequence
  chemically synthesized
aaatagattgattcttcaaa

SEQ ID NO: 443191 - DNA, 20 bp, Artificial Sequence
  chemically synthesized
acagtagtttgtgccttttg

SEQ ID NO: 443192 - DNA, 20 bp, Artificial Sequence
  chemically synthesized
ttatattcattgatttacag

SEQ ID NO: 443193 - DNA, 20 bp, Artificial Sequence
  chemically synthesized
attttatattcattgattta

SEQ ID NO: 443194 - DNA, 20 bp, Artificial Sequence
  chemically synthesized
gtaaatcaatgaatataaaa

SEQ ID NO: 443195 - DNA, 20 bp, Artificial Sequence
  chemically synthesized
tataaaatggataatttgaa

SEQ ID NO: 443196 - DNA, 20 bp, Artificial Sequence
  chemically synthesized
aatggataatttgaatggcc

SEQ ID NO: 443197 - DNA, 20 bp, Artificial Sequence
  chemically synthesized
aatttgaatggcctagactt

SEQ ID NO: 443198 - DNA, 20 bp, Artificial Sequence
  chemically synthesized
ctattaaatagccaaagtct

SEQ ID NO: 443199 - DNA, 20 bp, Artificial Sequence
  chemically synthesized
actattaaatagccaaagtc

SEQ ID NO: 443200 - DNA, 20 bp, Artificial Sequence
  chemically synthesized
aaattactattaaatagcca

SEQ ID NO: 443201 - DNA, 20 bp, Artificial Sequence
  chemically synthesized
cctagactttggctatttaa

SEQ ID NO: 443202 - DNA, 20 bp, Artificial Sequence
  chemically synthesized
atatccaaattactattaaa

SEQ ID NO: 443203 - DNA, 20 bp, Artificial Sequence
  chemically synthesized
ttggctatttaatagtaatt

SEQ ID NO: 443204 - DNA, 20 bp, Artificial Sequence
  chemically synthesized
taatagtaatttggatatac

SEQ ID NO: 443205 - DNA, 20 bp, Artificial Sequence
  chemically synthesized
atttggatatactagataat

SEQ ID NO: 443206 - DNA, 20 bp, Artificial Sequence
  chemically synthesized
taacagttatactcattatc

SEQ ID NO: 443207 - DNA, 20 bp, Artificial Sequence
  chemically synthesized
agataatgagtataactgtt

SEQ ID NO: 443208 - DNA, 20 bp, Artificial Sequence
  chemically synthesized
gataatgagtataactgtta

SEQ ID NO: 443209 - DNA, 20 bp, Artificial Sequence
  chemically synthesized
tatgagttatatttccttaa

SEQ ID NO: 443210 - DNA, 20 bp, Artificial Sequence
  chemically synthesized
tgtagaagtttttaaattat

SEQ ID NO: 443211 - DNA, 20 bp, Artificial Sequence
  chemically synthesized
taatttaaaaacttctacaa

SEQ ID NO: 443212 - DNA, 20 bp, Artificial Sequence
  chemically synthesized
atagaagtttgcttttgtag

SEQ ID NO: 443213 - DNA, 20 bp, Artificial Sequence
  chemically synthesized
gttatagaagtttgcttttg

SEQ ID NO: 443214 - DNA, 20 bp, Artificial Sequence
  chemically synthesized
cttttccaatgcagttatag

SEQ ID NO: 443215 - DNA, 20 bp, Artificial Sequence
  chemically synthesized
atacttttccaatgcagtta

SEQ ID NO: 443216 - DNA, 20 bp, Artificial Sequence
  chemically synthesized
gcaaacttctataactgcat

SEQ ID NO: 443217 - DNA, 20 bp, Artificial Sequence
  chemically synthesized
attggcatacttttccaatg

SEQ ID NO: 443218 - DNA, 20 bp, Artificial Sequence
  chemically synthesized
cttctataactgcattggaa

SEQ ID NO: 443219 - DNA, 20 bp, Artificial Sequence
  chemically synthesized
gtgttaattcttcacaagat

SEQ ID NO: 443220 - DNA, 20 bp, Artificial Sequence
  chemically synthesized
aaaagtatgccaatcttgtg

SEQ ID NO: 443221 - DNA, 20 bp, Artificial Sequence
  chemically synthesized
aattggtgttaattcttcac

SEQ ID NO: 443222 - DNA, 20 bp, Artificial Sequence
  chemically synthesized
tggaaaagaatgtgtagaat

SEQ ID NO: 443223 - DNA, 20 bp, Artificial Sequence
  chemically synthesized
atgttctggaaaagaatgtg

SEQ ID NO: 443224 - DNA, 20 bp, Artificial Sequence
  chemically synthesized
caattctacacattcttttc

SEQ ID NO: 443225 - DNA, 20 bp, Artificial Sequence
  chemically synthesized
ttcccttccatgttctggaa

SEQ ID NO: 443226 - DNA, 20 bp, Artificial Sequence
  chemically synthesized
acacattcttttccagaaca

SEQ ID NO: 443227 - DNA, 20 bp, Artificial Sequence
  chemically synthesized
ttttcttcccttccatgttc

SEQ ID NO: 443228 - DNA, 20 bp, Artificial Sequence
  chemically synthesized
cattcttttccagaacatgg

SEQ ID NO: 443229 - DNA, 20 bp, Artificial Sequence
  chemically synthesized
attcttttccagaacatgga

SEQ ID NO: 443230 - DNA, 20 bp, Artificial Sequence
  chemically synthesized
ttcttttccagaacatggaa

SEQ ID NO: 443231 - DNA, 20 bp, Artificial Sequence
  chemically synthesized
ttttccagaacatggaaggg

SEQ ID NO: 443232 - DNA, 20 bp, Artificial Sequence
  chemically synthesized
gaagggaagaaaacaattct

SEQ ID NO: 443233 - DNA, 20 bp, Artificial Sequence
  chemically synthesized
ctggactcaacacatatact

SEQ ID NO: 443234 - DNA, 20 bp, Artificial Sequence
  chemically synthesized
caattctgagtatatgtgtt

SEQ ID NO: 443235 - DNA, 20 bp, Artificial Sequence
  chemically synthesized
ctgagtatatgtgttgagtc

SEQ ID NO: 443236 - DNA, 20 bp, Artificial Sequence
  chemically synthesized
atatgtgttgagtccagcaa

SEQ ID NO: 443237 - DNA, 20 bp, Artificial Sequence
  chemically synthesized
tttgggtatcaggctattgc

SEQ ID NO: 443238 - DNA, 20 bp, Artificial Sequence
  chemically synthesized
gtttttctggtttgggtatc

SEQ ID NO: 443239 - DNA, 20 bp, Artificial Sequence
  chemically synthesized
tgtttttctggtttgggtat

SEQ ID NO: 443240 - DNA, 20 bp, Artificial Sequence
  chemically synthesized
caatagcctgatacccaaac

SEQ ID NO: 443241 - DNA, 20 bp, Artificial Sequence
  chemically synthesized
ttgtactgtttttctggttt

SEQ ID NO: 443242 - DNA, 20 bp, Artificial Sequence
  chemically synthesized
tttgtactgtttttctggtt

SEQ ID NO: 443243 - DNA, 20 bp, Artificial Sequence
  chemically synthesized
tgatacccaaaccagaaaaa

SEQ ID NO: 443244 - DNA, 20 bp, Artificial Sequence
  chemically synthesized
cttcttttgtactgtttttc

SEQ ID NO: 443245 - DNA, 20 bp, Artificial Sequence
  chemically synthesized
aaaccagaaaaacagtacaa

SEQ ID NO: 443246 - DNA, 20 bp, Artificial Sequence
  chemically synthesized
ccagaaaaacagtacaaaag

SEQ ID NO: 443247 - DNA, 20 bp, Artificial Sequence
  chemically synthesized
ttgtaaggaatatggattta

SEQ ID NO: 443248 - DNA, 20 bp, Artificial Sequence
  chemically synthesized
attaatatttgtaaggaata

SEQ ID NO: 443249 - DNA, 20 bp, Artificial Sequence
  chemically synthesized
attttccattaatatttgta

SEQ ID NO: 443250 - DNA, 20 bp, Artificial Sequence
  chemically synthesized
aattttccattaatatttgt

SEQ ID NO: 443251 - DNA, 20 bp, Artificial Sequence
  chemically synthesized
atattccttacaaatattaa

SEQ ID NO: 443252 - DNA, 20 bp, Artificial Sequence
  chemically synthesized
aaaatttattaatacaattt

SEQ ID NO: 443253 - DNA, 20 bp, Artificial Sequence
  chemically synthesized
caatttcagcacataaaatt

SEQ ID NO: 443254 - DNA, 20 bp, Artificial Sequence
  chemically synthesized
aaaattcagcaatgtactaa

SEQ ID NO: 443255 - DNA, 20 bp, Artificial Sequence
  chemically synthesized
ataaaccccaagtgatccat

SEQ ID NO: 443256 - DNA, 20 bp, Artificial Sequence
  chemically synthesized
caatgtactaatggatcact

SEQ ID NO: 443257 - DNA, 20 bp, Artificial Sequence
  chemically synthesized
aatgtactaatggatcactt

SEQ ID NO: 443258 - DNA, 20 bp, Artificial Sequence
  chemically synthesized
atgtactaatggatcacttg

SEQ ID NO: 443259 - DNA, 20 bp, Artificial Sequence
  chemically synthesized
acatcctggaaataaacccc

SEQ ID NO: 443260 - DNA, 20 bp, Artificial Sequence
  chemically synthesized
gatcacttggggtttatttc

SEQ ID NO: 443261 - DNA, 20 bp, Artificial Sequence
  chemically synthesized
atcacttggggtttatttcc

SEQ ID NO: 443262 - DNA, 20 bp, Artificial Sequence
  chemically synthesized
atcaagccagatttacatcc

SEQ ID NO: 443263 - DNA, 20 bp, Artificial Sequence
  chemically synthesized
ttatttccaggatgtaaatc

SEQ ID NO: 443264 - DNA, 20 bp, Artificial Sequence
  chemically synthesized
ctaattttcaaatatcaagc

SEQ ID NO: 443265 - DNA, 20 bp, Artificial Sequence
  chemically synthesized
gtgactaattttcaaatatc

SEQ ID NO: 443266 - DNA, 20 bp, Artificial Sequence
  chemically synthesized
ctggcttgatatttgaaaat

SEQ ID NO: 443267 - DNA, 20 bp, Artificial Sequence
  chemically synthesized
cctgttaatatggtagattg

SEQ ID NO: 443268 - DNA, 20 bp, Artificial Sequence
  chemically synthesized
tctatgacctgttaatatgg

SEQ ID NO: 443269 - DNA, 20 bp, Artificial Sequence
  chemically synthesized
actacaatctaccatattaa

SEQ ID NO: 443270 - DNA, 20 bp, Artificial Sequence
  chemically synthesized
ctacaatctaccatattaac

SEQ ID NO: 443271 - DNA, 20 bp, Artificial Sequence
  chemically synthesized
tcctctatgacctgttaata

SEQ ID NO: 443272 - DNA, 20 bp, Artificial Sequence
  chemically synthesized
tctaccatattaacaggtca

SEQ ID NO: 443273 - DNA, 20 bp, Artificial Sequence
  chemically synthesized
taccatattaacaggtcata

SEQ ID NO: 443274 - DNA, 20 bp, Artificial Sequence
  chemically synthesized
accatattaacaggtcatag

SEQ ID NO: 443275 - DNA, 20 bp, Artificial Sequence
  chemically synthesized
gaaaaatcacacgatgttat

SEQ ID NO: 443276 - DNA, 20 bp, Artificial Sequence
  chemically synthesized
gttatcagtaaatgtactaa

SEQ ID NO: 443277 - DNA, 20 bp, Artificial Sequence
  chemically synthesized
atcagtttgtcaaatgcttt

SEQ ID NO: 443278 - DNA, 20 bp, Artificial Sequence
  chemically synthesized
tgtttcaagattagatatat

SEQ ID NO: 443279 - DNA, 20 bp, Artificial Sequence
  chemically synthesized
cagacaggttgtttcaagat

SEQ ID NO: 443280 - DNA, 20 bp, Artificial Sequence
  chemically synthesized
tttttcagacaggttgtttc

SEQ ID NO: 443281 - DNA, 20 bp, Artificial Sequence
  chemically synthesized
tttagtcctatttttcagac

SEQ ID NO: 443282 - DNA, 20 bp, Artificial Sequence
  chemically synthesized
ctttagtcctatttttcaga

SEQ ID NO: 443283 - DNA, 20 bp, Artificial Sequence
  chemically synthesized
gaaacaacctgtctgaaaaa

SEQ ID NO: 443284 - DNA, 20 bp, Artificial Sequence
  chemically synthesized
aaacaacctgtctgaaaaat

SEQ ID NO: 443285 - DNA, 20 bp, Artificial Sequence
  chemically synthesized
tctcctttagtcctattttt

SEQ ID NO: 443286 - DNA, 20 bp, Artificial Sequence
  chemically synthesized
ctgtctgaaaaataggacta

SEQ ID NO: 443287 - DNA, 20 bp, Artificial Sequence
  chemically synthesized
tgtctgaaaaataggactaa

SEQ ID NO: 443288 - DNA, 20 bp, Artificial Sequence
  chemically synthesized
tctgaaaaataggactaaag

SEQ ID NO: 443289 - DNA, 20 bp, Artificial Sequence
  chemically synthesized
aagttgaggaaattctcctt

SEQ ID NO: 443290 - DNA, 20 bp, Artificial Sequence
  chemically synthesized
agatgttgtttattaagttg

SEQ ID NO: 443291 - DNA, 20 bp, Artificial Sequence
  chemically synthesized
tagatgttgtttattaagtt

SEQ ID NO: 443292 - DNA, 20 bp, Artificial Sequence
  chemically synthesized
ttatgtagatgttgtttatt

SEQ ID NO: 443293 - DNA, 20 bp, Artificial Sequence
  chemically synthesized
aagttagctgtaggtttatg

SEQ ID NO: 443294 - DNA, 20 bp, Artificial Sequence
  chemically synthesized
acaacatctacataaaccta

SEQ ID NO: 443295 - DNA, 20 bp, Artificial Sequence
  chemically synthesized
ttaagtatgaagttagctgt

SEQ ID NO: 443296 - DNA, 20 bp, Artificial Sequence
  chemically synthesized
attaagtatgaagttagctg

SEQ ID NO: 443297 - DNA, 20 bp, Artificial Sequence
  chemically synthesized
ttcactattaagtatgaagt

SEQ ID NO: 443298 - DNA, 20 bp, Artificial Sequence
  chemically synthesized
atacttcactattaagtatg

SEQ ID NO: 443299 - DNA, 20 bp, Artificial Sequence
  chemically synthesized
acagctaacttcatacttaa

SEQ ID NO: 443300 - DNA, 20 bp, Artificial Sequence
  chemically synthesized
taacttcatacttaatagtg

SEQ ID NO: 443301 - DNA, 20 bp, Artificial Sequence
  chemically synthesized
gcatttaatacttcactatt

SEQ ID NO: 443302 - DNA, 20 bp, Artificial Sequence
  chemically synthesized
tgttcacaatattaagggga

SEQ ID NO: 443303 - DNA, 20 bp, Artificial Sequence
  chemically synthesized
gccttgttcacaatattaag

SEQ ID NO: 443304 - DNA, 20 bp, Artificial Sequence
  chemically synthesized
cgccttgttcacaatattaa

SEQ ID NO: 443305 - DNA, 20 bp, Artificial Sequence
  chemically synthesized
acgccttgttcacaatatta

SEQ ID NO: 443306 - DNA, 20 bp, Artificial Sequence
  chemically synthesized
cacgccttgttcacaatatt

SEQ ID NO: 443307 - DNA, 20 bp, Artificial Sequence
  chemically synthesized
ttccccttaatattgtgaac

SEQ ID NO: 443308 - DNA, 20 bp, Artificial Sequence
  chemically synthesized
tccccttaatattgtgaaca

SEQ ID NO: 443309 - DNA, 20 bp, Artificial Sequence
  chemically synthesized
agtacgtgaataagagtggt

SEQ ID NO: 443310 - DNA, 20 bp, Artificial Sequence
  chemically synthesized
tagcagtacgtgaataagag

SEQ ID NO: 443311 - DNA, 20 bp, Artificial Sequence
  chemically synthesized
ttgtagcagtacgtgaataa

SEQ ID NO: 443312 - DNA, 20 bp, Artificial Sequence
  chemically synthesized
acttgtagcagtacgtgaat

SEQ ID NO: 443313 - DNA, 20 bp, Artificial Sequence
  chemically synthesized
tcttattcacgtactgctac

SEQ ID NO: 443314 - DNA, 20 bp, Artificial Sequence
  chemically synthesized
gcactggctagaacttgtag

SEQ ID NO: 443315 - DNA, 20 bp, Artificial Sequence
  chemically synthesized
tcacgtactgctacaagttc

SEQ ID NO: 443316 - DNA, 20 bp, Artificial Sequence
  chemically synthesized
attgcactggctagaacttg

SEQ ID NO: 443317 - DNA, 20 bp, Artificial Sequence
  chemically synthesized
gtactgctacaagttctagc

SEQ ID NO: 443318 - DNA, 20 bp, Artificial Sequence
  chemically synthesized
tcttgcctcattgcactggc

SEQ ID NO: 443319 - DNA, 20 bp, Artificial Sequence
  chemically synthesized
caagttctagccagtgcaat

SEQ ID NO: 443320 - DNA, 20 bp, Artificial Sequence
  chemically synthesized
attgtcttgcctcattgcac

SEQ ID NO: 443321 - DNA, 20 bp, Artificial Sequence
  chemically synthesized
aagttctagccagtgcaatg

SEQ ID NO: 443322 - DNA, 20 bp, Artificial Sequence
  chemically synthesized
tctagccagtgcaatgaggc

SEQ ID NO: 443323 - DNA, 20 bp, Artificial Sequence
  chemically synthesized
gacaattaaatcaatccata

SEQ ID NO: 443324 - DNA, 20 bp, Artificial Sequence
  chemically synthesized
attaaatcaatccatacaga

SEQ ID NO: 443325 - DNA, 20 bp, Artificial Sequence
  chemically synthesized
ttaaatcaatccatacagat

SEQ ID NO: 443326 - DNA, 20 bp, Artificial Sequence
  chemically synthesized
gtcttcctttcccatctgta

SEQ ID NO: 443327 - DNA, 20 bp, Artificial Sequence
  chemically synthesized
atcaatccatacagatggga

SEQ ID NO: 443328 - DNA, 20 bp, Artificial Sequence
  chemically synthesized
tcaatccatacagatgggaa

SEQ ID NO: 443329 - DNA, 20 bp, Artificial Sequence
  chemically synthesized
atccatacagatgggaaagg

SEQ ID NO: 443330 - DNA, 20 bp, Artificial Sequence
  chemically synthesized
ataaaattgtcccttatatg

SEQ ID NO: 443331 - DNA, 20 bp, Artificial Sequence
  chemically synthesized
ttcatgccatctacatataa

SEQ ID NO: 443332 - DNA, 20 bp, Artificial Sequence
  chemically synthesized
tttcatgccatctacatata

SEQ ID NO: 443333 - DNA, 20 bp, Artificial Sequence
  chemically synthesized
ttttcatgccatctacatat

SEQ ID NO: 443334 - DNA, 20 bp, Artificial Sequence
  chemically synthesized
aattgtcccttatatgtaga

SEQ ID NO: 443335 - DNA, 20 bp, Artificial Sequence
  chemically synthesized
ggcatgaaaataaaattttc

SEQ ID NO: 443336 - DNA, 20 bp, Artificial Sequence
  chemically synthesized
tctaggagattatttataga

SEQ ID NO: 443337 - DNA, 20 bp, Artificial Sequence
  chemically synthesized
aatttctaggagattattta

SEQ ID NO: 443338 - DNA, 20 bp, Artificial Sequence
  chemically synthesized
gctatctataaataatctcc

SEQ ID NO: 443339 - DNA, 20 bp, Artificial Sequence
  chemically synthesized
cacttatcaataatttctag

SEQ ID NO: 443340 - DNA, 20 bp, Artificial Sequence
  chemically synthesized
ttcacttatcaataatttct

SEQ ID NO: 443341 - DNA, 20 bp, Artificial Sequence
  chemically synthesized
attcacttatcaataatttc

SEQ ID NO: 443342 - DNA, 20 bp, Artificial Sequence
  chemically synthesized
atctcctagaaattattgat

SEQ ID NO: 443343 - DNA, 20 bp, Artificial Sequence
  chemically synthesized
tattgataagtgaattcatc

SEQ ID NO: 443344 - DNA, 20 bp, Artificial Sequence
  chemically synthesized
attgataagtgaattcatca

SEQ ID NO: 443345 - DNA, 20 bp, Artificial Sequence
  chemically synthesized
gataagtgaattcatcaagg

SEQ ID NO: 443346 - DNA, 20 bp, Artificial Sequence
  chemically synthesized
aagtgaattcatcaaggtag

SEQ ID NO: 443347 - DNA, 20 bp, Artificial Sequence
  chemically synthesized
agtgaattcatcaaggtagc

SEQ ID NO: 443348 - DNA, 20 bp, Artificial Sequence
  chemically synthesized
tcatcaaggtagcaggatgc

SEQ ID NO: 443349 - DNA, 20 bp, Artificial Sequence
  chemically synthesized
ttgattgtaaccatttacat

SEQ ID NO: 443350 - DNA, 20 bp, Artificial Sequence
  chemically synthesized
gtgggaggtgctaatgtaaa

SEQ ID NO: 443351 - DNA, 20 bp, Artificial Sequence
  chemically synthesized
ctaagaatttcatttgtggg

SEQ ID NO: 443352 - DNA, 20 bp, Artificial Sequence
  chemically synthesized
tctaagaatttcatttgtgg

SEQ ID NO: 443353 - DNA, 20 bp, Artificial Sequence
  chemically synthesized
gatctaagaatttcatttgt

SEQ ID NO: 443354 - DNA, 20 bp, Artificial Sequence
  chemically synthesized
agatctaagaatttcatttg

SEQ ID NO: 443355 - DNA, 20 bp, Artificial Sequence
  chemically synthesized
cctcccacaaatgaaattct

SEQ ID NO: 443356 - DNA, 20 bp, Artificial Sequence
  chemically synthesized
attttgctagttttagatct

SEQ ID NO: 443357 - DNA, 20 bp, Artificial Sequence
  chemically synthesized
gaaattcttagatctaaaac

SEQ ID NO: 443358 - DNA, 20 bp, Artificial Sequence
  chemically synthesized
ggtatgtattttgctagttt

SEQ ID NO: 443359 - DNA, 20 bp, Artificial Sequence
  chemically synthesized
agatatggtatgtattttgc

SEQ ID NO: 443360 - DNA, 20 bp, Artificial Sequence
  chemically synthesized
cagttttcctcatatagata

SEQ ID NO: 443361 - DNA, 20 bp, Artificial Sequence
  chemically synthesized
aatacataccatatctatat

SEQ ID NO: 443362 - DNA, 20 bp, Artificial Sequence
  chemically synthesized
atacataccatatctatatg

SEQ ID NO: 443363 - DNA, 20 bp, Artificial Sequence
  chemically synthesized
gggttgcagttttcctcata

SEQ ID NO: 443364 - DNA, 20 bp, Artificial Sequence
  chemically synthesized
tttctttcatcagagggttg

SEQ ID NO: 443365 - DNA, 20 bp, Artificial Sequence
  chemically synthesized
ctatgatttctttcatcaga

SEQ ID NO: 443366 - DNA, 20 bp, Artificial Sequence
  chemically synthesized
aaactgcaaccctctgatga

SEQ ID NO: 443367 - DNA, 20 bp, Artificial Sequence
  chemically synthesized
tctatgatttctttcatcag

SEQ ID NO: 443368 - DNA, 20 bp, Artificial Sequence
  chemically synthesized
ttctatgatttctttcatca

SEQ ID NO: 443369 - DNA, 20 bp, Artificial Sequence
  chemically synthesized
tcttctatgatttctttcat

SEQ ID NO: 443370 - DNA, 20 bp, Artificial Sequence
  chemically synthesized
ccctctgatgaaagaaatca

SEQ ID NO: 443371 - DNA, 20 bp, Artificial Sequence
  chemically synthesized
tctgatgaaagaaatcatag

SEQ ID NO: 443372 - DNA, 20 bp, Artificial Sequence
  chemically synthesized
tagaagataatccatattca

SEQ ID NO: 443373 - DNA, 20 bp, Artificial Sequence
  chemically synthesized
agccttcccatccatgaata

SEQ ID NO: 443374 - DNA, 20 bp, Artificial Sequence
  chemically synthesized
agataatccatattcatgga

SEQ ID NO: 443375 - DNA, 20 bp, Artificial Sequence
  chemically synthesized
gataatccatattcatggat

SEQ ID NO: 443376 - DNA, 20 bp, Artificial Sequence
  chemically synthesized
aatccatattcatggatggg

SEQ ID NO: 443377 - DNA, 20 bp, Artificial Sequence
  chemically synthesized
atccatattcatggatggga

SEQ ID NO: 443378 - DNA, 20 bp, Artificial Sequence
  chemically synthesized
actgacataataaaaatatt

SEQ ID NO: 443379 - DNA, 20 bp, Artificial Sequence
  chemically synthesized
gctcaatatttttattatgt

SEQ ID NO: 443380 - DNA, 20 bp, Artificial Sequence
  chemically synthesized
ttgagtctatagatcaattt

SEQ ID NO: 443381 - DNA, 20 bp, Artificial Sequence
  chemically synthesized
gttattctcaaattgatcta

SEQ ID NO: 443382 - DNA, 20 bp, Artificial Sequence
  chemically synthesized
ttgggattacattgagtcta

SEQ ID NO: 443383 - DNA, 20 bp, Artificial Sequence
  chemically synthesized
attttgattgggattacatt

SEQ ID NO: 443384 - DNA, 20 bp, Artificial Sequence
  chemically synthesized
taactactgagattttgatt

SEQ ID NO: 443385 - DNA, 20 bp, Artificial Sequence
  chemically synthesized
gtaactactgagattttgat

SEQ ID NO: 443386 - DNA, 20 bp, Artificial Sequence
  chemically synthesized
tgtaatcccaatcaaaatct

SEQ ID NO: 443387 - DNA, 20 bp, Artificial Sequence
  chemically synthesized
aatcccaatcaaaatctcag

SEQ ID NO: 443388 - DNA, 20 bp, Artificial Sequence
  chemically synthesized
atatctgcaaagtaactact

SEQ ID NO: 443389 - DNA, 20 bp, Artificial Sequence
  chemically synthesized
aaatctcagtagttactttg

SEQ ID NO: 443390 - DNA, 20 bp, Artificial Sequence
  chemically synthesized
tctctttgttaatatctgca

SEQ ID NO: 443391 - DNA, 20 bp, Artificial Sequence
  chemically synthesized
ttactttgcagatattaaca

SEQ ID NO: 443392 - DNA, 20 bp, Artificial Sequence
  chemically synthesized
actttgcagatattaacaaa

SEQ ID NO: 443393 - DNA, 20 bp, Artificial Sequence
  chemically synthesized
ttgcctttccatatcatttt

SEQ ID NO: 443394 - DNA, 20 bp, Artificial Sequence
  chemically synthesized
aagagattctaaaaatgata

SEQ ID NO: 443395 - DNA, 20 bp, Artificial Sequence
  chemically synthesized
gattctaaaaatgatatgga

SEQ ID NO: 443396 - DNA, 20 bp, Artificial Sequence
  chemically synthesized
attctaaaaatgatatggaa

SEQ ID NO: 443397 - DNA, 20 bp, Artificial Sequence
  chemically synthesized
taaaaatgatatggaaaggc

SEQ ID NO: 443398 - DNA, 20 bp, Artificial Sequence
  chemically synthesized
gaaaggcaagaaaccttgaa

SEQ ID NO: 443399 - DNA, 20 bp, Artificial Sequence
  chemically synthesized
aatgttgttttggctattca

SEQ ID NO: 443400 - DNA, 20 bp, Artificial Sequence
  chemically synthesized
caatgttgttttggctattc

SEQ ID NO: 443401 - DNA, 20 bp, Artificial Sequence
  chemically synthesized
ccagcccttcaatgttgttt

SEQ ID NO: 443402 - DNA, 20 bp, Artificial Sequence
  chemically synthesized
gaatagccaaaacaacattg

SEQ ID NO: 443403 - DNA, 20 bp, Artificial Sequence
  chemically synthesized
aatagccaaaacaacattga

SEQ ID NO: 443404 - DNA, 20 bp, Artificial Sequence
  chemically synthesized
atagccaaaacaacattgaa

SEQ ID NO: 443405 - DNA, 20 bp, Artificial Sequence
  chemically synthesized
ccaaaacaacattgaagggc

SEQ ID NO: 443406 - DNA, 20 bp, Artificial Sequence
  chemically synthesized
caaaacaacattgaagggct

SEQ ID NO: 443407 - DNA, 20 bp, Artificial Sequence
  chemically synthesized
caacattgaagggctgggcg

SEQ ID NO: 443408 - DNA, 20 bp, Artificial Sequence
  chemically synthesized
cattgaagggctgggcgtgg

SEQ ID NO: 443409 - DNA, 20 bp, Artificial Sequence
  chemically synthesized
caggtgtgagccaccacgcc

SEQ ID NO: 443410 - DNA, 20 bp, Artificial Sequence
  chemically synthesized
agtgctgggattacaggtgt

SEQ ID NO: 443411 - DNA, 20 bp, Artificial Sequence
  chemically synthesized
gtggctcacacctgtaatcc

SEQ ID NO: 443412 - DNA, 20 bp, Artificial Sequence
  chemically synthesized
tcccaaagtgctgggattac

SEQ ID NO: 443413 - DNA, 20 bp, Artificial Sequence
  chemically synthesized
ctcccaaagtgctgggatta

SEQ ID NO: 443414 - DNA, 20 bp, Artificial Sequence
  chemically synthesized
cacctgtaatcccagcactt

SEQ ID NO: 443415 - DNA, 20 bp, Artificial Sequence
  chemically synthesized
ccttggcctcccaaagtgct

SEQ ID NO: 443416 - DNA, 20 bp, Artificial Sequence
  chemically synthesized
acctgtaatcccagcacttt

SEQ ID NO: 443417 - DNA, 20 bp, Artificial Sequence
  chemically synthesized
accttggcctcccaaagtgc

SEQ ID NO: 443418 - DNA, 20 bp, Artificial Sequence
  chemically synthesized
ctgtaatcccagcactttgg

SEQ ID NO: 443419 - DNA, 20 bp, Artificial Sequence
  chemically synthesized
tgtaatcccagcactttggg

SEQ ID NO: 443420 - DNA, 20 bp, Artificial Sequence
  chemically synthesized
ctgcccaccttggcctccca

SEQ ID NO: 443421 - DNA, 20 bp, Artificial Sequence
  chemically synthesized
tcccagcactttgggaggcc

SEQ ID NO: 443422 - DNA, 20 bp, Artificial Sequence
  chemically synthesized
cccagcactttgggaggcca

SEQ ID NO: 443423 - DNA, 20 bp, Artificial Sequence
  chemically synthesized
agcactttgggaggccaagg

SEQ ID NO: 443424 - DNA, 20 bp, Artificial Sequence
  chemically synthesized
gcactttgggaggccaaggt

SEQ ID NO: 443425 - DNA, 20 bp, Artificial Sequence
  chemically synthesized
ctttgggaggccaaggtggg

SEQ ID NO: 443426 - DNA, 20 bp, Artificial Sequence
  chemically synthesized
ctcaagtgatctgcccacct

SEQ ID NO: 443427 - DNA, 20 bp, Artificial Sequence
  chemically synthesized
ccaaggtgggcagatcactt

SEQ ID NO: 443428 - DNA, 20 bp, Artificial Sequence
  chemically synthesized
caaggtgggcagatcacttg

SEQ ID NO: 443429 - DNA, 20 bp, Artificial Sequence
  chemically synthesized
gtgggcagatcacttgaggt

SEQ ID NO: 443430 - DNA, 20 bp, Artificial Sequence
  chemically synthesized
tgggcagatcacttgaggtc

SEQ ID NO: 443431 - DNA, 20 bp, Artificial Sequence
  chemically synthesized
ggtctcatactcctgacctc

SEQ ID NO: 443432 - DNA, 20 bp, Artificial Sequence
  chemically synthesized
ggcagatcacttgaggtcag

SEQ ID NO: 443433 - DNA, 20 bp, Artificial Sequence
  chemically synthesized
tcacttgaggtcaggagtat

SEQ ID NO: 443434 - DNA, 20 bp, Artificial Sequence
  chemically synthesized
tgaggtcaggagtatgagac

SEQ ID NO: 443435 - DNA, 20 bp, Artificial Sequence
  chemically synthesized
tcaggagtatgagaccagcc

SEQ ID NO: 443436 - DNA, 20 bp, Artificial Sequence
  chemically synthesized
cttcatgatgttggccaggc

SEQ ID NO: 443437 - DNA, 20 bp, Artificial Sequence
  chemically synthesized
ggggcttcatgatgttggcc

SEQ ID NO: 443438 - DNA, 20 bp, Artificial Sequence
  chemically synthesized
cggggcttcatgatgttggc

SEQ ID NO: 443439 - DNA, 20 bp, Artificial Sequence
  chemically synthesized
cagacggggcttcatgatgt

SEQ ID NO: 443440 - DNA, 20 bp, Artificial Sequence
  chemically synthesized
ccagcctggccaacatcatg

SEQ ID NO: 443441 - DNA, 20 bp, Artificial Sequence
  chemically synthesized
tgttgtttttagtacagacg

SEQ ID NO: 443442 - DNA, 20 bp, Artificial Sequence
  chemically synthesized
ttgttgtttttagtacagac

SEQ ID NO: 443443 - DNA, 20 bp, Artificial Sequence
  chemically synthesized
tttgttgtttttagtacaga

SEQ ID NO: 443444 - DNA, 20 bp, Artificial Sequence
  chemically synthesized
aatttttgttgtttttagta

SEQ ID NO: 443445 - DNA, 20 bp, Artificial Sequence
  chemically synthesized
cagctaatttttgttgtttt

SEQ ID NO: 443446 - DNA, 20 bp, Artificial Sequence
  chemically synthesized
gtactaaaaacaacaaaaat

SEQ ID NO: 443447 - DNA, 20 bp, Artificial Sequence
  chemically synthesized
taaaaacaacaaaaattagc

SEQ ID NO: 443448 - DNA, 20 bp, Artificial Sequence
  chemically synthesized
aaaaacaacaaaaattagct

SEQ ID NO: 443449 - DNA, 20 bp, Artificial Sequence
  chemically synthesized
aaacaacaaaaattagctgg

SEQ ID NO: 443450 - DNA, 20 bp, Artificial Sequence
  chemically synthesized
caacaaaaattagctgggag

SEQ ID NO: 443451 - DNA, 20 bp, Artificial Sequence
  chemically synthesized
caaaaattagctgggagtgg

SEQ ID NO: 443452 - DNA, 20 bp, Artificial Sequence
  chemically synthesized
caggcgtgtgccaccactcc

SEQ ID NO: 443453 - DNA, 20 bp, Artificial Sequence
  chemically synthesized
gtggcacacgcctgtaatcc

SEQ ID NO: 443454 - DNA, 20 bp, Artificial Sequence
  chemically synthesized
tctcaagtagctgggattac

SEQ ID NO: 443455 - DNA, 20 bp, Artificial Sequence
  chemically synthesized
ctctcaagtagctgggatta

SEQ ID NO: 443456 - DNA, 20 bp, Artificial Sequence
  chemically synthesized
tttcagcctctcaagtagct

SEQ ID NO: 443457 - DNA, 20 bp, Artificial Sequence
  chemically synthesized
gcctgtaatcccagctactt

SEQ ID NO: 443458 - DNA, 20 bp, Artificial Sequence
  chemically synthesized
atttcagcctctcaagtagc

SEQ ID NO: 443459 - DNA, 20 bp, Artificial Sequence
  chemically synthesized
ctgtaatcccagctacttga

SEQ ID NO: 443460 - DNA, 20 bp, Artificial Sequence
  chemically synthesized
tgtaatcccagctacttgag

SEQ ID NO: 443461 - DNA, 20 bp, Artificial Sequence
  chemically synthesized
tttcatttcagcctctcaag

SEQ ID NO: 443462 - DNA, 20 bp, Artificial Sequence
  chemically synthesized
ttctttcatttcagcctctc

SEQ ID NO: 443463 - DNA, 20 bp, Artificial Sequence
  chemically synthesized
tacttgagaggctgaaatga

SEQ ID NO: 443464 - DNA, 20 bp, Artificial Sequence
  chemically synthesized
ttcaagcgattctttcattt

SEQ ID NO: 443465 - DNA, 20 bp, Artificial Sequence
  chemically synthesized
atgaaagaatcgcttgaacc

SEQ ID NO: 443466 - DNA, 20 bp, Artificial Sequence
  chemically synthesized
tgaaagaatcgcttgaaccc

SEQ ID NO: 443467 - DNA, 20 bp, Artificial Sequence
  chemically synthesized
aatctccgcctcctgggttc

SEQ ID NO: 443468 - DNA, 20 bp, Artificial Sequence
  chemically synthesized
aaagaatcgcttgaacccag

SEQ ID NO: 443469 - DNA, 20 bp, Artificial Sequence
  chemically synthesized
aagaatcgcttgaacccagg

SEQ ID NO: 443470 - DNA, 20 bp, Artificial Sequence
  chemically synthesized
aatcgcttgaacccaggagg

SEQ ID NO: 443471 - DNA, 20 bp, Artificial Sequence
  chemically synthesized
cactgcaatctccgcctcct

SEQ ID NO: 443472 - DNA, 20 bp, Artificial Sequence
  chemically synthesized
tcgcttgaacccaggaggcg

SEQ ID NO: 443473 - DNA, 20 bp, Artificial Sequence
  chemically synthesized
tcactgcaatctccgcctcc

SEQ ID NO: 443474 - DNA, 20 bp, Artificial Sequence
  chemically synthesized
aacccaggaggcggagattg

SEQ ID NO: 443475 - DNA, 20 bp, Artificial Sequence
  chemically synthesized
caggaggcggagattgcagt

SEQ ID NO: 443476 - DNA, 20 bp, Artificial Sequence
  chemically synthesized
ggcggagattgcagtgagcc

SEQ ID NO: 443477 - DNA, 20 bp, Artificial Sequence
  chemically synthesized
ggagtgcaatggcatgatct

SEQ ID NO: 443478 - DNA, 20 bp, Artificial Sequence
  chemically synthesized
tcacccaggctggagtgcaa

SEQ ID NO: 443479 - DNA, 20 bp, Artificial Sequence
  chemically synthesized
gagatcatgccattgcactc

SEQ ID NO: 443480 - DNA, 20 bp, Artificial Sequence
  chemically synthesized
catgccattgcactccagcc

SEQ ID NO: 443481 - DNA, 20 bp, Artificial Sequence
  chemically synthesized
atgccattgcactccagcct

SEQ ID NO: 443482 - DNA, 20 bp, Artificial Sequence
  chemically synthesized
tctctctgtcacccaggctg

SEQ ID NO: 443483 - DNA, 20 bp, Artificial Sequence
  chemically synthesized
cctctctctgtcacccaggc

SEQ ID NO: 443484 - DNA, 20 bp, Artificial Sequence
  chemically synthesized
ttgcactccagcctgggtga

SEQ ID NO: 443485 - DNA, 20 bp, Artificial Sequence
  chemically synthesized
tctccctctctctgtcaccc

SEQ ID NO: 443486 - DNA, 20 bp, Artificial Sequence
  chemically synthesized
gcactccagcctgggtgaca

SEQ ID NO: 443487 - DNA, 20 bp, Artificial Sequence
  chemically synthesized
gtctccctctctctgtcacc

SEQ ID NO: 443488 - DNA, 20 bp, Artificial Sequence
  chemically synthesized
actccagcctgggtgacaga

SEQ ID NO: 443489 - DNA, 20 bp, Artificial Sequence
  chemically synthesized
tccagcctgggtgacagaga

SEQ ID NO: 443490 - DNA, 20 bp, Artificial Sequence
  chemically synthesized
ccagcctgggtgacagagag

SEQ ID NO: 443491 - DNA, 20 bp, Artificial Sequence
  chemically synthesized
cagcctgggtgacagagaga

SEQ ID NO: 443492 - DNA, 20 bp, Artificial Sequence
  chemically synthesized
gcctgggtgacagagagagg

SEQ ID NO: 443493 - DNA, 20 bp, Artificial Sequence
  chemically synthesized
ttgtttgtttgtttgagatg

SEQ ID NO: 443494 - DNA, 20 bp, Artificial Sequence
  chemically synthesized
gtttgtttgtttgtttgaga

SEQ ID NO: 443495 - DNA, 20 bp, Artificial Sequence
  chemically synthesized
gtttgtttgtttgtttgttt

SEQ ID NO: 443496 - DNA, 20 bp, Artificial Sequence
  chemically synthesized
aacaaacaaaaacaatattg

SEQ ID NO: 443497 - DNA, 20 bp, Artificial Sequence
  chemically synthesized
acaaacaaaaacaatattga

SEQ ID NO: 443498 - DNA, 20 bp, Artificial Sequence
  chemically synthesized
caaaaacaatattgaaggac

SEQ ID NO: 443499 - DNA, 20 bp, Artificial Sequence
  chemically synthesized
aatattgaaggacaagcaca

SEQ ID NO: 443500 - DNA, 20 bp, Artificial Sequence
  chemically synthesized
ttgaaggacaagcacaaagt

SEQ ID NO: 443501 - DNA, 20 bp, Artificial Sequence
  chemically synthesized
aaggacaagcacaaagtcag

SEQ ID NO: 443502 - DNA, 20 bp, Artificial Sequence
  chemically synthesized
aagcacaaagtcagaagatt

SEQ ID NO: 443503 - DNA, 20 bp, Artificial Sequence
  chemically synthesized
accgaagtcttgaagtagag

SEQ ID NO: 443504 - DNA, 20 bp, Artificial Sequence
  chemically synthesized
gattgagactgctctacttc

SEQ ID NO: 443505 - DNA, 20 bp, Artificial Sequence
  chemically synthesized
attaccgaagtcttgaagta

SEQ ID NO: 443506 - DNA, 20 bp, Artificial Sequence
  chemically synthesized
tgattaccgaagtcttgaag

SEQ ID NO: 443507 - DNA, 20 bp, Artificial Sequence
  chemically synthesized
tcttgattaccgaagtcttg

SEQ ID NO: 443508 - DNA, 20 bp, Artificial Sequence
  chemically synthesized
actgctctacttcaagactt

SEQ ID NO: 443509 - DNA, 20 bp, Artificial Sequence
  chemically synthesized
agacactgtcttgattaccg

SEQ ID NO: 443510 - DNA, 20 bp, Artificial Sequence
  chemically synthesized
acttcaagacttcggtaatc

SEQ ID NO: 443511 - DNA, 20 bp, Artificial Sequence
  chemically synthesized
caagacttcggtaatcaaga

SEQ ID NO: 443512 - DNA, 20 bp, Artificial Sequence
  chemically synthesized
taatcaagacagtgtcttat

SEQ ID NO: 443513 - DNA, 20 bp, Artificial Sequence
  chemically synthesized
tgatctcttcttttgccaat

SEQ ID NO: 443514 - DNA, 20 bp, Artificial Sequence
  chemically synthesized
agacagtgtcttattggcaa

SEQ ID NO: 443515 - DNA, 20 bp, Artificial Sequence
  chemically synthesized
cagtgtcttattggcaaaag

SEQ ID NO: 443516 - DNA, 20 bp, Artificial Sequence
  chemically synthesized
gtgtcttattggcaaaagaa

SEQ ID NO: 443517 - DNA, 20 bp, Artificial Sequence
  chemically synthesized
ttggcaaaagaagagatcaa

SEQ ID NO: 443518 - DNA, 20 bp, Artificial Sequence
  chemically synthesized
aaaagaagagatcaatggaa

SEQ ID NO: 443519 - DNA, 20 bp, Artificial Sequence
  chemically synthesized
aagagatcaatggaacagaa

SEQ ID NO: 443520 - DNA, 20 bp, Artificial Sequence
  chemically synthesized
gagatcaatggaacagaata

SEQ ID NO: 443521 - DNA, 20 bp, Artificial Sequence
  chemically synthesized
gatcaatggaacagaataga

SEQ ID NO: 443522 - DNA, 20 bp, Artificial Sequence
  chemically synthesized
atggaacagaatagagagcc

SEQ ID NO: 443523 - DNA, 20 bp, Artificial Sequence
  chemically synthesized
tggaacagaatagagagccc

SEQ ID NO: 443524 - DNA, 20 bp, Artificial Sequence
  chemically synthesized
atttatgtgggtttattcct

SEQ ID NO: 443525 - DNA, 20 bp, Artificial Sequence
  chemically synthesized
tatttatgtgggtttattcc

SEQ ID NO: 443526 - DNA, 20 bp, Artificial Sequence
  chemically synthesized
tcagttgactatatttatgt

SEQ ID NO: 443527 - DNA, 20 bp, Artificial Sequence
  chemically synthesized
gtcagttgactatatttatg

SEQ ID NO: 443528 - DNA, 20 bp, Artificial Sequence
  chemically synthesized
ggaataaacccacataaata

SEQ ID NO: 443529 - DNA, 20 bp, Artificial Sequence
  chemically synthesized
ctccgttatcaaacatcagt

SEQ ID NO: 443530 - DNA, 20 bp, Artificial Sequence
  chemically synthesized
tttgctccgttatcaaacat

SEQ ID NO: 443531 - DNA, 20 bp, Artificial Sequence
  chemically synthesized
aactgactgatgtttgataa

SEQ ID NO: 443532 - DNA, 20 bp, Artificial Sequence
  chemically synthesized
ctgactgatgtttgataacg

SEQ ID NO: 443533 - DNA, 20 bp, Artificial Sequence
  chemically synthesized
tgatgtttgataacggagca

SEQ ID NO: 443534 - DNA, 20 bp, Artificial Sequence
  chemically synthesized
tccagcaccatttattgaaa

SEQ ID NO: 443535 - DNA, 20 bp, Artificial Sequence
  chemically synthesized
ttccagcaccatttattgaa

SEQ ID NO: 443536 - DNA, 20 bp, Artificial Sequence
  chemically synthesized
aagacaaccttttcaataaa

SEQ ID NO: 443537 - DNA, 20 bp, Artificial Sequence
  chemically synthesized
accttttcaataaatggtgc

SEQ ID NO: 443538 - DNA, 20 bp, Artificial Sequence
  chemically synthesized
ataaatggtgctggaacaac

SEQ ID NO: 443539 - DNA, 20 bp, Artificial Sequence
  chemically synthesized
atgtggatgcccagttgttc

SEQ ID NO: 443540 - DNA, 20 bp, Artificial Sequence
  chemically synthesized
taaatggtgctggaacaact

SEQ ID NO: 443541 - DNA, 20 bp, Artificial Sequence
  chemically synthesized
ggtgtttgcatgtggatgcc

SEQ ID NO: 443542 - DNA, 20 bp, Artificial Sequence
  chemically synthesized
ttgtgaaaggtgtttgcatg

SEQ ID NO: 443543 - DNA, 20 bp, Artificial Sequence
  chemically synthesized
tttgagttaatgtttgtgaa

SEQ ID NO: 443544 - DNA, 20 bp, Artificial Sequence
  chemically synthesized
ttttgagttaatgtttgtga

SEQ ID NO: 443545 - DNA, 20 bp, Artificial Sequence
  chemically synthesized
tcacaaacattaactcaaaa

SEQ ID NO: 443546 - DNA, 20 bp, Artificial Sequence
  chemically synthesized
ttaagtttctgatccatttt

SEQ ID NO: 443547 - DNA, 20 bp, Artificial Sequence
  chemically synthesized
aacattaactcaaaatggat

SEQ ID NO: 443548 - DNA, 20 bp, Artificial Sequence
  chemically synthesized
tagttttgcattttacattt

SEQ ID NO: 443549 - DNA, 20 bp, Artificial Sequence
  chemically synthesized
atgtaaaatgcaaaactata

SEQ ID NO: 443550 - DNA, 20 bp, Artificial Sequence
  chemically synthesized
gttatcttctgtgggcttta

SEQ ID NO: 443551 - DNA, 20 bp, Artificial Sequence
  chemically synthesized
atgcaaaactataaagccca

SEQ ID NO: 443552 - DNA, 20 bp, Artificial Sequence
  chemically synthesized
caaaactataaagcccacag

SEQ ID NO: 443553 - DNA, 20 bp, Artificial Sequence
  chemically synthesized
tctcctatgttatcttctgt

SEQ ID NO: 443554 - DNA, 20 bp, Artificial Sequence
  chemically synthesized
ttctcctatgttatcttctg

SEQ ID NO: 443555 - DNA, 20 bp, Artificial Sequence
  chemically synthesized
aaagcccacagaagataaca

SEQ ID NO: 443556 - DNA, 20 bp, Artificial Sequence
  chemically synthesized
aagcccacagaagataacat

SEQ ID NO: 443557 - DNA, 20 bp, Artificial Sequence
  chemically synthesized
gcccacagaagataacatag

SEQ ID NO: 443558 - DNA, 20 bp, Artificial Sequence
  chemically synthesized
aacataggagaaaatctata

SEQ ID NO: 443559 - DNA, 20 bp, Artificial Sequence
  chemically synthesized
acataggagaaaatctatat

SEQ ID NO: 443560 - DNA, 20 bp, Artificial Sequence
  chemically synthesized
aagtcatcaccagacccata

SEQ ID NO: 443561 - DNA, 20 bp, Artificial Sequence
  chemically synthesized
ggagaaaatctatatgggtc

SEQ ID NO: 443562 - DNA, 20 bp, Artificial Sequence
  chemically synthesized
tatatctaaaaagtcatcac

SEQ ID NO: 443563 - DNA, 20 bp, Artificial Sequence
  chemically synthesized
tgggtctggtgatgactttt

SEQ ID NO: 443564 - DNA, 20 bp, Artificial Sequence
  chemically synthesized
tctttggtgttatatctaaa

SEQ ID NO: 443565 - DNA, 20 bp, Artificial Sequence
  chemically synthesized
actttttagatataacacca

SEQ ID NO: 443566 - DNA, 20 bp, Artificial Sequence
  chemically synthesized
tcttgcataggtcatgtctt

SEQ ID NO: 443567 - DNA, 20 bp, Artificial Sequence
  chemically synthesized
accaaagacatgacctatgc

SEQ ID NO: 443568 - DNA, 20 bp, Artificial Sequence
  chemically synthesized
ttatcaattatttcttgcat

SEQ ID NO: 443569 - DNA, 20 bp, Artificial Sequence
  chemically synthesized
cttatcaattatttcttgca

SEQ ID NO: 443570 - DNA, 20 bp, Artificial Sequence
  chemically synthesized
ctatgcaagaaataattgat

SEQ ID NO: 443571 - DNA, 20 bp, Artificial Sequence
  chemically synthesized
tgcaagaaataattgataag

SEQ ID NO: 443572 - DNA, 20 bp, Artificial Sequence
  chemically synthesized
gcaagaaataattgataagc

SEQ ID NO: 443573 - DNA, 20 bp, Artificial Sequence
  chemically synthesized
agaatttttcaatattaatg

SEQ ID NO: 443574 - DNA, 20 bp, Artificial Sequence
  chemically synthesized
tgacaatgtcttttgcagca

SEQ ID NO: 443575 - DNA, 20 bp, Artificial Sequence
  chemically synthesized
tgaaaaattctatgctgcaa

SEQ ID NO: 443576 - DNA, 20 bp, Artificial Sequence
  chemically synthesized
tcttttgacaatgtcttttg

SEQ ID NO: 443577 - DNA, 20 bp, Artificial Sequence
  chemically synthesized
gctgcaaaagacattgtcaa

SEQ ID NO: 443578 - DNA, 20 bp, Artificial Sequence
  chemically synthesized
gacattgtcaaaagaatgta

SEQ ID NO: 443579 - DNA, 20 bp, Artificial Sequence
  chemically synthesized
tgtcaaaagaatgtaaagac

SEQ ID NO: 443580 - DNA, 20 bp, Artificial Sequence
  chemically synthesized
aagaatgtaaagacaagcca

SEQ ID NO: 443581 - DNA, 20 bp, Artificial Sequence
  chemically synthesized
tgtaaagacaagccacagaa

SEQ ID NO: 443582 - DNA, 20 bp, Artificial Sequence
  chemically synthesized
gtaaagacaagccacagaat

SEQ ID NO: 443583 - DNA, 20 bp, Artificial Sequence
  chemically synthesized
aaatattctctcctattctg

SEQ ID NO: 443584 - DNA, 20 bp, Artificial Sequence
  chemically synthesized
aaagacaagccacagaatag

SEQ ID NO: 443585 - DNA, 20 bp, Artificial Sequence
  chemically synthesized
agacaagccacagaatagga

SEQ ID NO: 443586 - DNA, 20 bp, Artificial Sequence
  chemically synthesized
ataggagagaatatttgcaa

SEQ ID NO: 443587 - DNA, 20 bp, Artificial Sequence
  chemically synthesized
aatatttgcaaaagacatat

SEQ ID NO: 443588 - DNA, 20 bp, Artificial Sequence
  chemically synthesized
atatttgcaaaagacatatc

SEQ ID NO: 443589 - DNA, 20 bp, Artificial Sequence
  chemically synthesized
gcaaaagacatatcaggtaa

SEQ ID NO: 443590 - DNA, 20 bp, Artificial Sequence
  chemically synthesized
tctttgtatattttggataa

SEQ ID NO: 443591 - DNA, 20 bp, Artificial Sequence
  chemically synthesized
taacagttctttgtatattt

SEQ ID NO: 443592 - DNA, 20 bp, Artificial Sequence
  chemically synthesized
actgttatccaaaatataca

SEQ ID NO: 443593 - DNA, 20 bp, Artificial Sequence
  chemically synthesized
ttcttattgttgatttttaa

SEQ ID NO: 443594 - DNA, 20 bp, Artificial Sequence
  chemically synthesized
aactgttaaaaatcaacaat

SEQ ID NO: 443595 - DNA, 20 bp, Artificial Sequence
  chemically synthesized
ttttgcccatttttaaaata

SEQ ID NO: 443596 - DNA, 20 bp, Artificial Sequence
  chemically synthesized
tgttttgcccatttttaaaa

SEQ ID NO: 443597 - DNA, 20 bp, Artificial Sequence
  chemically synthesized
aaacaactctattttaaaaa

SEQ ID NO: 443598 - DNA, 20 bp, Artificial Sequence
  chemically synthesized
aacaactctattttaaaaat

SEQ ID NO: 443599 - DNA, 20 bp, Artificial Sequence
  chemically synthesized
aaatgggcaaaacaccttaa

SEQ ID NO: 443600 - DNA, 20 bp, Artificial Sequence
  chemically synthesized
ctttggtgagttatctgtta

SEQ ID NO: 443601 - DNA, 20 bp, Artificial Sequence
  chemically synthesized
tctttggtgagttatctgtt

SEQ ID NO: 443602 - DNA, 20 bp, Artificial Sequence
  chemically synthesized
ccttaacagataactcacca

SEQ ID NO: 443603 - DNA, 20 bp, Artificial Sequence
  chemically synthesized
taacagataactcaccaaag

SEQ ID NO: 443604 - DNA, 20 bp, Artificial Sequence
  chemically synthesized
atctgtatatcttctttggt

SEQ ID NO: 443605 - DNA, 20 bp, Artificial Sequence
  chemically synthesized
ttccatctgtatatcttctt

SEQ ID NO: 443606 - DNA, 20 bp, Artificial Sequence
  chemically synthesized
aactcaccaaagaagatata

SEQ ID NO: 443607 - DNA, 20 bp, Artificial Sequence
  chemically synthesized
caccaaagaagatatacaga

SEQ ID NO: 443608 - DNA, 20 bp, Artificial Sequence
  chemically synthesized
gaagatatacagatggaaaa

SEQ ID NO: 443609 - DNA, 20 bp, Artificial Sequence
  chemically synthesized
aagatatacagatggaaaac

SEQ ID NO: 443610 - DNA, 20 bp, Artificial Sequence
  chemically synthesized
atggaaaacaggcgtatgaa

SEQ ID NO: 443611 - DNA, 20 bp, Artificial Sequence
  chemically synthesized
tcctgatgacatatgatgtg

SEQ ID NO: 443612 - DNA, 20 bp, Artificial Sequence
  chemically synthesized
cgcttcacatcatatgtcat

SEQ ID NO: 443613 - DNA, 20 bp, Artificial Sequence
  chemically synthesized
gcttcacatcatatgtcatc

SEQ ID NO: 443614 - DNA, 20 bp, Artificial Sequence
  chemically synthesized
ccattctaagaggtatgtag

SEQ ID NO: 443615 - DNA, 20 bp, Artificial Sequence
  chemically synthesized
tgaccattctaagaggtatg

SEQ ID NO: 443616 - DNA, 20 bp, Artificial Sequence
  chemically synthesized
tgatgctactacatacctct

SEQ ID NO: 443617 - DNA, 20 bp, Artificial Sequence
  chemically synthesized
ctactacatacctcttagaa

SEQ ID NO: 443618 - DNA, 20 bp, Artificial Sequence
  chemically synthesized
tgagtgttgaccattctaag

SEQ ID NO: 443619 - DNA, 20 bp, Artificial Sequence
  chemically synthesized
ctgagtgttgaccattctaa

SEQ ID NO: 443620 - DNA, 20 bp, Artificial Sequence
  chemically synthesized
ttctgagtgttgaccattct

SEQ ID NO: 443621 - DNA, 20 bp, Artificial Sequence
  chemically synthesized
ctcttagaatggtcaacact

SEQ ID NO: 443622 - DNA, 20 bp, Artificial Sequence
  chemically synthesized
agaatggtcaacactcagaa

SEQ ID NO: 443623 - DNA, 20 bp, Artificial Sequence
  chemically synthesized
ttgggtggtgtcactgttct

SEQ ID NO: 443624 - DNA, 20 bp, Artificial Sequence
  chemically synthesized
atatcctcaccagcattggg

SEQ ID NO: 443625 - DNA, 20 bp, Artificial Sequence
  chemically synthesized
acagtgacaccacccaatgc

SEQ ID NO: 443626 - DNA, 20 bp, Artificial Sequence
  chemically synthesized
tccatatcctcaccagcatt

SEQ ID NO: 443627 - DNA, 20 bp, Artificial Sequence
  chemically synthesized
ctccatatcctcaccagcat

SEQ ID NO: 443628 - DNA, 20 bp, Artificial Sequence
  chemically synthesized
tgacaccacccaatgctggt

SEQ ID NO: 443629 - DNA, 20 bp, Artificial Sequence
  chemically synthesized
gacaccacccaatgctggtg

SEQ ID NO: 443630 - DNA, 20 bp, Artificial Sequence
  chemically synthesized
ctattactccatatcctcac

SEQ ID NO: 443631 - DNA, 20 bp, Artificial Sequence
  chemically synthesized
acccaatgctggtgaggata

SEQ ID NO: 443632 - DNA, 20 bp, Artificial Sequence
  chemically synthesized
ccaatgctggtgaggatatg

SEQ ID NO: 443633 - DNA, 20 bp, Artificial Sequence
  chemically synthesized
ctggtgaggatatggagtaa

SEQ ID NO: 443634 - DNA, 20 bp, Artificial Sequence
  chemically synthesized
tggtgaggatatggagtaat

SEQ ID NO: 443635 - DNA, 20 bp, Artificial Sequence
  chemically synthesized
ttctcacaagcaatgaacaa

SEQ ID NO: 443636 - DNA, 20 bp, Artificial Sequence
  chemically synthesized
cattctcacaagcaatgaac

SEQ ID NO: 443637 - DNA, 20 bp, Artificial Sequence
  chemically synthesized
aactcttgttcattgcttgt

SEQ ID NO: 443638 - DNA, 20 bp, Artificial Sequence
  chemically synthesized
gtacaagtttacattctcac

SEQ ID NO: 443639 - DNA, 20 bp, Artificial Sequence
  chemically synthesized
ctgattttcagtggttgtac

SEQ ID NO: 443640 - DNA, 20 bp, Artificial Sequence
  chemically synthesized
atccttaaactgattttcag

SEQ ID NO: 443641 - DNA, 20 bp, Artificial Sequence
  chemically synthesized
cttgtacaaccactgaaaat

SEQ ID NO: 443642 - DNA, 20 bp, Artificial Sequence
  chemically synthesized
aaaatccttaaactgatttt

SEQ ID NO: 443643 - DNA, 20 bp, Artificial Sequence
  chemically synthesized
caaccactgaaaatcagttt

SEQ ID NO: 443644 - DNA, 20 bp, Artificial Sequence
  chemically synthesized
aaccactgaaaatcagttta

SEQ ID NO: 443645 - DNA, 20 bp, Artificial Sequence
  chemically synthesized
tcatatagcaagagtatgtt

SEQ ID NO: 443646 - DNA, 20 bp, Artificial Sequence
  chemically synthesized
attacttgatcatatagcaa

SEQ ID NO: 443647 - DNA, 20 bp, Artificial Sequence
  chemically synthesized
taattacttgatcatatagc

SEQ ID NO: 443648 - DNA, 20 bp, Artificial Sequence
  chemically synthesized
catactcttgctatatgatc

SEQ ID NO: 443649 - DNA, 20 bp, Artificial Sequence
  chemically synthesized
agtctaattacttgatcata

SEQ ID NO: 443650 - DNA, 20 bp, Artificial Sequence
  chemically synthesized
ttgctatatgatcaagtaat

SEQ ID NO: 443651 - DNA, 20 bp, Artificial Sequence
  chemically synthesized
gatcaagtaattagactctt

SEQ ID NO: 443652 - DNA, 20 bp, Artificial Sequence
  chemically synthesized
ttatttgggtaaataccaaa

SEQ ID NO: 443653 - DNA, 20 bp, Artificial Sequence
  chemically synthesized
gcttatttgggtaaatacca

SEQ ID NO: 443654 - DNA, 20 bp, Artificial Sequence
  chemically synthesized
tctttggtatttacccaaat

SEQ ID NO: 443655 - DNA, 20 bp, Artificial Sequence
  chemically synthesized
cataagttttcagcttattt

SEQ ID NO: 443656 - DNA, 20 bp, Artificial Sequence
  chemically synthesized
acataagttttcagcttatt

SEQ ID NO: 443657 - DNA, 20 bp, Artificial Sequence
  chemically synthesized
tttgtgcggacataagtttt

SEQ ID NO: 443658 - DNA, 20 bp, Artificial Sequence
  chemically synthesized
gcaggtttttgtgcggacat

SEQ ID NO: 443659 - DNA, 20 bp, Artificial Sequence
  chemically synthesized
tccatctgcaggtttttgtg

SEQ ID NO: 443660 - DNA, 20 bp, Artificial Sequence
  chemically synthesized
tatgtccgcacaaaaacctg

SEQ ID NO: 443661 - DNA, 20 bp, Artificial Sequence
  chemically synthesized
tccgcacaaaaacctgcaga

SEQ ID NO: 443662 - DNA, 20 bp, Artificial Sequence
  chemically synthesized
tgctataaacatccatctgc

SEQ ID NO: 443663 - DNA, 20 bp, Artificial Sequence
  chemically synthesized
ctgctataaacatccatctg

SEQ ID NO: 443664 - DNA, 20 bp, Artificial Sequence
  chemically synthesized
aacctgcagatggatgttta

SEQ ID NO: 443665 - DNA, 20 bp, Artificial Sequence
  chemically synthesized
ctgcagatggatgtttatag

SEQ ID NO: 443666 - DNA, 20 bp, Artificial Sequence
  chemically synthesized
agttcaggcaattatgaata

SEQ ID NO: 443667 - DNA, 20 bp, Artificial Sequence
  chemically synthesized
tattcataattgcctgaact

SEQ ID NO: 443668 - DNA, 20 bp, Artificial Sequence
  chemically synthesized
atcttgttgtttccaagttc

SEQ ID NO: 443669 - DNA, 20 bp, Artificial Sequence
  chemically synthesized
catcttgttgtttccaagtt

SEQ ID NO: 443670 - DNA, 20 bp, Artificial Sequence
  chemically synthesized
aagaacatcttgttgtttcc

SEQ ID NO: 443671 - DNA, 20 bp, Artificial Sequence
  chemically synthesized
tgcctgaacttggaaacaac

SEQ ID NO: 443672 - DNA, 20 bp, Artificial Sequence
  chemically synthesized
ggaaacaacaagatgttctt

SEQ ID NO: 443673 - DNA, 20 bp, Artificial Sequence
  chemically synthesized
aacaacaagatgttcttcag

SEQ ID NO: 443674 - DNA, 20 bp, Artificial Sequence
  chemically synthesized
acaacaagatgttcttcagt

SEQ ID NO: 443675 - DNA, 20 bp, Artificial Sequence
  chemically synthesized
atttatccattcacctactg

SEQ ID NO: 443676 - DNA, 20 bp, Artificial Sequence
  chemically synthesized
gatgttcttcagtaggtgaa

SEQ ID NO: 443677 - DNA, 20 bp, Artificial Sequence
  chemically synthesized
aggtgaatggataaataaac

SEQ ID NO: 443678 - DNA, 20 bp, Artificial Sequence
  chemically synthesized
gataaataaactggtacatt

SEQ ID NO: 443679 - DNA, 20 bp, Artificial Sequence
  chemically synthesized
catctatagtctgaatgtac

SEQ ID NO: 443680 - DNA, 20 bp, Artificial Sequence
  chemically synthesized
aaactggtacattcagacta

SEQ ID NO: 443681 - DNA, 20 bp, Artificial Sequence
  chemically synthesized
tcatttctttttagcatcta

SEQ ID NO: 443682 - DNA, 20 bp, Artificial Sequence
  chemically synthesized
ttcagactatagatgctaaa

SEQ ID NO: 443683 - DNA, 20 bp, Artificial Sequence
  chemically synthesized
cttgatagctcatttctttt

SEQ ID NO: 443684 - DNA, 20 bp, Artificial Sequence
  chemically synthesized
tatagatgctaaaaagaaat

SEQ ID NO: 443685 - DNA, 20 bp, Artificial Sequence
  chemically synthesized
ctaaaaagaaatgagctatc

SEQ ID NO: 443686 - DNA, 20 bp, Artificial Sequence
  chemically synthesized
agtgtattttcatgtcttga

SEQ ID NO: 443687 - DNA, 20 bp, Artificial Sequence
  chemically synthesized
tcaagacatgaaaatacact

SEQ ID NO: 443688 - DNA, 20 bp, Artificial Sequence
  chemically synthesized
caagacatgaaaatacacta

SEQ ID NO: 443689 - DNA, 20 bp, Artificial Sequence
  chemically synthesized
aacaggcatttaagtttcct

SEQ ID NO: 443690 - DNA, 20 bp, Artificial Sequence
  chemically synthesized
tcagttagaaacaggcattt

SEQ ID NO: 443691 - DNA, 20 bp, Artificial Sequence
  chemically synthesized
ggcttccttcagttagaaac

SEQ ID NO: 443692 - DNA, 20 bp, Artificial Sequence
  chemically synthesized
tggcttccttcagttagaaa

SEQ ID NO: 443693 - DNA, 20 bp, Artificial Sequence
  chemically synthesized
taaatgcctgtttctaactg

SEQ ID NO: 443694 - DNA, 20 bp, Artificial Sequence
  chemically synthesized
aaatgcctgtttctaactga

SEQ ID NO: 443695 - DNA, 20 bp, Artificial Sequence
  chemically synthesized
tcagattggcttccttcagt

SEQ ID NO: 443696 - DNA, 20 bp, Artificial Sequence
  chemically synthesized
tgcctgtttctaactgaagg

SEQ ID NO: 443697 - DNA, 20 bp, Artificial Sequence
  chemically synthesized
attttcagattggcttcctt

SEQ ID NO: 443698 - DNA, 20 bp, Artificial Sequence
  chemically synthesized
atatagaagcattttcagat

SEQ ID NO: 443699 - DNA, 20 bp, Artificial Sequence
  chemically synthesized
acagtatatagaagcatttt

SEQ ID NO: 443700 - DNA, 20 bp, Artificial Sequence
  chemically synthesized
tggaatcctacagtatatag

SEQ ID NO: 443701 - DNA, 20 bp, Artificial Sequence
  chemically synthesized
gaaaatgcttctatatactg

SEQ ID NO: 443702 - DNA, 20 bp, Artificial Sequence
  chemically synthesized
agttggaatcctacagtata

SEQ ID NO: 443703 - DNA, 20 bp, Artificial Sequence
  chemically synthesized
aaaatgcttctatatactgt

SEQ ID NO: 443704 - DNA, 20 bp, Artificial Sequence
  chemically synthesized
gtcatatagttggaatccta

SEQ ID NO: 443705 - DNA, 20 bp, Artificial Sequence
  chemically synthesized
tttcctggatgtcatatagt

SEQ ID NO: 443706 - DNA, 20 bp, Artificial Sequence
  chemically synthesized
tacctttcctggatgtcata

SEQ ID NO: 443707 - DNA, 20 bp, Artificial Sequence
  chemically synthesized
gattccaactatatgacatc

SEQ ID NO: 443708 - DNA, 20 bp, Artificial Sequence
  chemically synthesized
attccaactatatgacatcc

SEQ ID NO: 443709 - DNA, 20 bp, Artificial Sequence
  chemically synthesized
caactatatgacatccagga

SEQ ID NO: 443710 - DNA, 20 bp, Artificial Sequence
  chemically synthesized
aactatatgacatccaggaa

SEQ ID NO: 443711 - DNA, 20 bp, Artificial Sequence
  chemically synthesized
cttcataattttacctttcc

SEQ ID NO: 443712 - DNA, 20 bp, Artificial Sequence
  chemically synthesized
ccaggaaaggtaaaattatg

SEQ ID NO: 443713 - DNA, 20 bp, Artificial Sequence
  chemically synthesized
gaaaggtaaaattatgaaga

SEQ ID NO: 443714 - DNA, 20 bp, Artificial Sequence
  chemically synthesized
tatgaagatagtaaaaatat

SEQ ID NO: 443715 - DNA, 20 bp, Artificial Sequence
  chemically synthesized
gaagatagtaaaaatatcag

SEQ ID NO: 443716 - DNA, 20 bp, Artificial Sequence
  chemically synthesized
gtaaaaatatcagtggttgc

SEQ ID NO: 443717 - DNA, 20 bp, Artificial Sequence
  chemically synthesized
taaaaatatcagtggttgcc

SEQ ID NO: 443718 - DNA, 20 bp, Artificial Sequence
  chemically synthesized
aaaaatatcagtggttgcca

SEQ ID NO: 443719 - DNA, 20 bp, Artificial Sequence
  chemically synthesized
aaaatatcagtggttgccag

SEQ ID NO: 443720 - DNA, 20 bp, Artificial Sequence
  chemically synthesized
tatcagtggttgccaggggt

SEQ ID NO: 443721 - DNA, 20 bp, Artificial Sequence
  chemically synthesized
cctccctgccaactaacccc

SEQ ID NO: 443722 - DNA, 20 bp, Artificial Sequence
  chemically synthesized
agtggttgccaggggttagt

SEQ ID NO: 443723 - DNA, 20 bp, Artificial Sequence
  chemically synthesized
ggttgccaggggttagttgg

SEQ ID NO: 443724 - DNA, 20 bp, Artificial Sequence
  chemically synthesized
gttgccaggggttagttggc

SEQ ID NO: 443725 - DNA, 20 bp, Artificial Sequence
  chemically synthesized
ttgccaggggttagttggca

SEQ ID NO: 443726 - DNA, 20 bp, Artificial Sequence
  chemically synthesized
gccaggggttagttggcagg

SEQ ID NO: 443727 - DNA, 20 bp, Artificial Sequence
  chemically synthesized
ccaggggttagttggcaggg

SEQ ID NO: 443728 - DNA, 20 bp, Artificial Sequence
  chemically synthesized
agttggcagggaggcatgac

SEQ ID NO: 443729 - DNA, 20 bp, Artificial Sequence
  chemically synthesized
gttggcagggaggcatgact

SEQ ID NO: 443730 - DNA, 20 bp, Artificial Sequence
  chemically synthesized
ggcagggaggcatgactagg

SEQ ID NO: 443731 - DNA, 20 bp, Artificial Sequence
  chemically synthesized
cagggaggcatgactaggca

SEQ ID NO: 443732 - DNA, 20 bp, Artificial Sequence
  chemically synthesized
taaaatatttgtgctctgcc

SEQ ID NO: 443733 - DNA, 20 bp, Artificial Sequence
  chemically synthesized
taggcagagcacaaatattt

SEQ ID NO: 443734 - DNA, 20 bp, Artificial Sequence
  chemically synthesized
aggcagagcacaaatatttt

SEQ ID NO: 443735 - DNA, 20 bp, Artificial Sequence
  chemically synthesized
agagcacaaatattttaggt

SEQ ID NO: 443736 - DNA, 20 bp, Artificial Sequence
  chemically synthesized
tatgataatatcatacagag

SEQ ID NO: 443737 - DNA, 20 bp, Artificial Sequence
  chemically synthesized
tactatgataatatcataca

SEQ ID NO: 443738 - DNA, 20 bp, Artificial Sequence
  chemically synthesized
tctactatgataatatcata

SEQ ID NO: 443739 - DNA, 20 bp, Artificial Sequence
  chemically synthesized
tactctgtatgatattatca

SEQ ID NO: 443740 - DNA, 20 bp, Artificial Sequence
  chemically synthesized
tctgtatgatattatcatag

SEQ ID NO: 443741 - DNA, 20 bp, Artificial Sequence
  chemically synthesized
tgtgtgtttggacaaattta

SEQ ID NO: 443742 - DNA, 20 bp, Artificial Sequence
  chemically synthesized
tataaatttgtccaaacaca

SEQ ID NO: 443743 - DNA, 20 bp, Artificial Sequence
  chemically synthesized
tgttgtgttttctgtgtgtt

SEQ ID NO: 443744 - DNA, 20 bp, Artificial Sequence
  chemically synthesized
cacacagaaaacacaacaac

SEQ ID NO: 443745 - DNA, 20 bp, Artificial Sequence
  chemically synthesized
cacagaaaacacaacaacaa

SEQ ID NO: 443746 - DNA, 20 bp, Artificial Sequence
  chemically synthesized
acaacaagagtaaactctaa

SEQ ID NO: 443747 - DNA, 20 bp, Artificial Sequence
  chemically synthesized
cagatccataggttccatta

SEQ ID NO: 443748 - DNA, 20 bp, Artificial Sequence
  chemically synthesized
ctcagatccataggttccat

SEQ ID NO: 443749 - DNA, 20 bp, Artificial Sequence
  chemically synthesized
gtaaactctaatggaaccta

SEQ ID NO: 443750 - DNA, 20 bp, Artificial Sequence
  chemically synthesized
tcattataactcagatccat

SEQ ID NO: 443751 - DNA, 20 bp, Artificial Sequence
  chemically synthesized
ctaatggaacctatggatct

SEQ ID NO: 443752 - DNA, 20 bp, Artificial Sequence
  chemically synthesized
atcattataactcagatcca

SEQ ID NO: 443753 - DNA, 20 bp, Artificial Sequence
  chemically synthesized
gtcaacacatcattataact

SEQ ID NO: 443754 - DNA, 20 bp, Artificial Sequence
  chemically synthesized
gttataatgatgtgttgacg

SEQ ID NO: 443755 - DNA, 20 bp, Artificial Sequence
  chemically synthesized
ttataatgatgtgttgacgt

SEQ ID NO: 443756 - DNA, 20 bp, Artificial Sequence
  chemically synthesized
ttgtaacgaatgtaccactc

SEQ ID NO: 443757 - DNA, 20 bp, Artificial Sequence
  chemically synthesized
aacgaatgtaccactctggt

SEQ ID NO: 443758 - DNA, 20 bp, Artificial Sequence
  chemically synthesized
attaataactctcaccagag

SEQ ID NO: 443759 - DNA, 20 bp, Artificial Sequence
  chemically synthesized
cgaatgtaccactctggtga

SEQ ID NO: 443760 - DNA, 20 bp, Artificial Sequence
  chemically synthesized
attattaataactctcacca

SEQ ID NO: 443761 - DNA, 20 bp, Artificial Sequence
  chemically synthesized
tcattattaataactctcac

SEQ ID NO: 443762 - DNA, 20 bp, Artificial Sequence
  chemically synthesized
gtgagagttattaataatga

SEQ ID NO: 443763 - DNA, 20 bp, Artificial Sequence
  chemically synthesized
gagagttattaataatgaca

SEQ ID NO: 443764 - DNA, 20 bp, Artificial Sequence
  chemically synthesized
agagttattaataatgacag

SEQ ID NO: 443765 - DNA, 20 bp, Artificial Sequence
  chemically synthesized
ccattgtgcccgcacgagca

SEQ ID NO: 443766 - DNA, 20 bp, Artificial Sequence
  chemically synthesized
tgacagaggccatgctcgtg

SEQ ID NO: 443767 - DNA, 20 bp, Artificial Sequence
  chemically synthesized
gacagaggccatgctcgtgc

SEQ ID NO: 443768 - DNA, 20 bp, Artificial Sequence
  chemically synthesized
tctacccattgtgcccgcac

SEQ ID NO: 443769 - DNA, 20 bp, Artificial Sequence
  chemically synthesized
ccatgctcgtgcgggcacaa

SEQ ID NO: 443770 - DNA, 20 bp, Artificial Sequence
  chemically synthesized
catgctcgtgcgggcacaat

SEQ ID NO: 443771 - DNA, 20 bp, Artificial Sequence
  chemically synthesized
gctcgtgcgggcacaatggg

SEQ ID NO: 443772 - DNA, 20 bp, Artificial Sequence
  chemically synthesized
gtgcgggcacaatgggtaga

SEQ ID NO: 443773 - DNA, 20 bp, Artificial Sequence
  chemically synthesized
tgcgggcacaatgggtagat

SEQ ID NO: 443774 - DNA, 20 bp, Artificial Sequence
  chemically synthesized
cacagcaaaattgaaagaca

SEQ ID NO: 443775 - DNA, 20 bp, Artificial Sequence
  chemically synthesized
ttcacagcaaaattgaaaga

SEQ ID NO: 443776 - DNA, 20 bp, Artificial Sequence
  chemically synthesized
taggttcacagcaaaattga

SEQ ID NO: 443777 - DNA, 20 bp, Artificial Sequence
  chemically synthesized
ttggagaacctttaggttca

SEQ ID NO: 443778 - DNA, 20 bp, Artificial Sequence
  chemically synthesized
tcaattttgctgtgaaccta

SEQ ID NO: 443779 - DNA, 20 bp, Artificial Sequence
  chemically synthesized
caattttgctgtgaacctaa

SEQ ID NO: 443780 - DNA, 20 bp, Artificial Sequence
  chemically synthesized
tttatttttggagaaccttt

SEQ ID NO: 443781 - DNA, 20 bp, Artificial Sequence
  chemically synthesized
ctttatttttggagaacctt

SEQ ID NO: 443782 - DNA, 20 bp, Artificial Sequence
  chemically synthesized
gttaatagactttatttttg

SEQ ID NO: 443783 - DNA, 20 bp, Artificial Sequence
  chemically synthesized
ctaaaggttctccaaaaata

SEQ ID NO: 443784 - DNA, 20 bp, Artificial Sequence
  chemically synthesized
ttgttaatagactttatttt

SEQ ID NO: 443785 - DNA, 20 bp, Artificial Sequence
  chemically synthesized
agaatgcaagtgattgttaa

SEQ ID NO: 443786 - DNA, 20 bp, Artificial Sequence
  chemically synthesized
attattaattcacagaatgc

SEQ ID NO: 443787 - DNA, 20 bp, Artificial Sequence
  chemically synthesized
atatgttcattattaattca

SEQ ID NO: 443788 - DNA, 20 bp, Artificial Sequence
  chemically synthesized
gtgaattaataatgaacata

SEQ ID NO: 443789 - DNA, 20 bp, Artificial Sequence
  chemically synthesized
taataatgaacatatggaca

SEQ ID NO: 443790 - DNA, 20 bp, Artificial Sequence
  chemically synthesized
ggacatggaaatttaaaata

SEQ ID NO: 443791 - DNA, 20 bp, Artificial Sequence
  chemically synthesized
tatatttaatttttgtgaca

SEQ ID NO: 443792 - DNA, 20 bp, Artificial Sequence
  chemically synthesized
aaattaaatataaatctaac

SEQ ID NO: 443793 - DNA, 20 bp, Artificial Sequence
  chemically synthesized
catgtaagtacatggcttgt

SEQ ID NO: 443794 - DNA, 20 bp, Artificial Sequence
  chemically synthesized
gctttcaccatgtaagtaca

SEQ ID NO: 443795 - DNA, 20 bp, Artificial Sequence
  chemically synthesized
taacaagccatgtacttaca

SEQ ID NO: 443796 - DNA, 20 bp, Artificial Sequence
  chemically synthesized
tttttttgctttcaccatgt

SEQ ID NO: 443797 - DNA, 20 bp, Artificial Sequence
  chemically synthesized
gccatgtacttacatggtga

SEQ ID NO: 443798 - DNA, 20 bp, Artificial Sequence
  chemically synthesized
tacatggtgaaagcaaaaaa

SEQ ID NO: 443799 - DNA, 20 bp, Artificial Sequence
  chemically synthesized
gtgaaagcaaaaaaaagttt

SEQ ID NO: 443800 - DNA, 20 bp, Artificial Sequence
  chemically synthesized
aaagcaaaaaaaagttttag

SEQ ID NO: 443801 - DNA, 20 bp, Artificial Sequence
  chemically synthesized
aaagttttagaagtaaatca

SEQ ID NO: 443802 - DNA, 20 bp, Artificial Sequence
  chemically synthesized
aatatatttcttcattaatt

SEQ ID NO: 443803 - DNA, 20 bp, Artificial Sequence
  chemically synthesized
atagaacatctaaattaatg

SEQ ID NO: 443804 - DNA, 20 bp, Artificial Sequence
  chemically synthesized
gaagaaatatattgtgctcg

SEQ ID NO: 443805 - DNA, 20 bp, Artificial Sequence
  chemically synthesized
atatattgtgctcgtggatt

SEQ ID NO: 443806 - DNA, 20 bp, Artificial Sequence
  chemically synthesized
tgttgaatctctcaatccac

SEQ ID NO: 443807 - DNA, 20 bp, Artificial Sequence
  chemically synthesized
atattgtgctcgtggattga

SEQ ID NO: 443808 - DNA, 20 bp, Artificial Sequence
  chemically synthesized
gtggattgagagattcaaca

SEQ ID NO: 443809 - DNA, 20 bp, Artificial Sequence
  chemically synthesized
tgtaaactgtgtaacagttt

SEQ ID NO: 443810 - DNA, 20 bp, Artificial Sequence
  chemically synthesized
gtgtaaactgtgtaacagtt

SEQ ID NO: 443811 - DNA, 20 bp, Artificial Sequence
  chemically synthesized
attttacccaaactgttaca

SEQ ID NO: 443812 - DNA, 20 bp, Artificial Sequence
  chemically synthesized
aaattgtgtaaactgtgtaa

SEQ ID NO: 443813 - DNA, 20 bp, Artificial Sequence
  chemically synthesized
cacaatttttatcaaaatct

SEQ ID NO: 443814 - DNA, 20 bp, Artificial Sequence
  chemically synthesized
taaattccaaaaatattgct

SEQ ID NO: 443815 - DNA, 20 bp, Artificial Sequence
  chemically synthesized
caaaatctcagcaatatttt

SEQ ID NO: 443816 - DNA, 20 bp, Artificial Sequence
  chemically synthesized
tcagcaatatttttggaatt

SEQ ID NO: 443817 - DNA, 20 bp, Artificial Sequence
  chemically synthesized
cagcaatatttttggaattt

SEQ ID NO: 443818 - DNA, 20 bp, Artificial Sequence
  chemically synthesized
atatttttggaatttaggtg

SEQ ID NO: 443819 - DNA, 20 bp, Artificial Sequence
  chemically synthesized
tatttttggaatttaggtgt

SEQ ID NO: 443820 - DNA, 20 bp, Artificial Sequence
  chemically synthesized
gtaggaaaaatttatgtgaa

SEQ ID NO: 443821 - DNA, 20 bp, Artificial Sequence
  chemically synthesized
taggaaaaatttatgtgaaa

SEQ ID NO: 443822 - DNA, 20 bp, Artificial Sequence
  chemically synthesized
gccttttcacataaatttta

SEQ ID NO: 443823 - DNA, 20 bp, Artificial Sequence
  chemically synthesized
ttgccttttcacataaattt

SEQ ID NO: 443824 - DNA, 20 bp, Artificial Sequence
  chemically synthesized
cactctaaaatttatgtgaa

SEQ ID NO: 443825 - DNA, 20 bp, Artificial Sequence
  chemically synthesized
actctaaaatttatgtgaaa

SEQ ID NO: 443826 - DNA, 20 bp, Artificial Sequence
  chemically synthesized
aaatttatgtgaaaaggcaa

SEQ ID NO: 443827 - DNA, 20 bp, Artificial Sequence
  chemically synthesized
atgtgaaaaggcaatggatt

SEQ ID NO: 443828 - DNA, 20 bp, Artificial Sequence
  chemically synthesized
aaaaggcaatggatttagaa

SEQ ID NO: 443829 - DNA, 20 bp, Artificial Sequence
  chemically synthesized
cttccttttcaacattgttt

SEQ ID NO: 443830 - DNA, 20 bp, Artificial Sequence
  chemically synthesized
atagctaaaacaatgttgaa

SEQ ID NO: 443831 - DNA, 20 bp, Artificial Sequence
  chemically synthesized
tagctaaaacaatgttgaaa

SEQ ID NO: 443832 - DNA, 20 bp, Artificial Sequence
  chemically synthesized
ctaaaacaatgttgaaaagg

SEQ ID NO: 443833 - DNA, 20 bp, Artificial Sequence
  chemically synthesized
aatgttgaaaaggaagaatg

SEQ ID NO: 443834 - DNA, 20 bp, Artificial Sequence
  chemically synthesized
ttgaaaaggaagaatgaagt

SEQ ID NO: 443835 - DNA, 20 bp, Artificial Sequence
  chemically synthesized
gaaaaggaagaatgaagtaa

SEQ ID NO: 443836 - DNA, 20 bp, Artificial Sequence
  chemically synthesized
aaaaggaagaatgaagtaag

SEQ ID NO: 443837 - DNA, 20 bp, Artificial Sequence
  chemically synthesized
aagaatgaagtaagaggaat

SEQ ID NO: 443838 - DNA, 20 bp, Artificial Sequence
  chemically synthesized
agtaagaggaataagtctac

SEQ ID NO: 443839 - DNA, 20 bp, Artificial Sequence
  chemically synthesized
ttaataagtcttcagtctgg

SEQ ID NO: 443840 - DNA, 20 bp, Artificial Sequence
  chemically synthesized
ggaataagtctaccagactg

SEQ ID NO: 443841 - DNA, 20 bp, Artificial Sequence
  chemically synthesized
tatttaataagtcttcagtc

SEQ ID NO: 443842 - DNA, 20 bp, Artificial Sequence
  chemically synthesized
gtagctatttaataagtctt

SEQ ID NO: 443843 - DNA, 20 bp, Artificial Sequence
  chemically synthesized
cagactgaagacttattaaa

SEQ ID NO: 443844 - DNA, 20 bp, Artificial Sequence
  chemically synthesized
gattactgtagctatttaat

SEQ ID NO: 443845 - DNA, 20 bp, Artificial Sequence
  chemically synthesized
gaagacttattaaatagcta

SEQ ID NO: 443846 - DNA, 20 bp, Artificial Sequence
  chemically synthesized
ccacactatcttgattactg

SEQ ID NO: 443847 - DNA, 20 bp, Artificial Sequence
  chemically synthesized
attaaatagctacagtaatc

SEQ ID NO: 443848 - DNA, 20 bp, Artificial Sequence
  chemically synthesized
aatagctacagtaatcaaga

SEQ ID NO: 443849 - DNA, 20 bp, Artificial Sequence
  chemically synthesized
ctacagtaatcaagatagtg

SEQ ID NO: 443850 - DNA, 20 bp, Artificial Sequence
  chemically synthesized
taatcaagatagtgtggtgt

SEQ ID NO: 443851 - DNA, 20 bp, Artificial Sequence
  chemically synthesized
agatagtgtggtgttggtgt

SEQ ID NO: 443852 - DNA, 20 bp, Artificial Sequence
  chemically synthesized
gatagtgtggtgttggtgtt

SEQ ID NO: 443853 - DNA, 20 bp, Artificial Sequence
  chemically synthesized
gtgtggtgttggtgttggga

SEQ ID NO: 443854 - DNA, 20 bp, Artificial Sequence
  chemically synthesized
ttggtgttgggatagacacg

SEQ ID NO: 443855 - DNA, 20 bp, Artificial Sequence
  chemically synthesized
gggatagacacgcagattaa

SEQ ID NO: 443856 - DNA, 20 bp, Artificial Sequence
  chemically synthesized
agacacgcagattaatggaa

SEQ ID NO: 443857 - DNA, 20 bp, Artificial Sequence
  chemically synthesized
cgcagattaatggaacagaa

SEQ ID NO: 443858 - DNA, 20 bp, Artificial Sequence
  chemically synthesized
cagattaatggaacagaata

SEQ ID NO: 443859 - DNA, 20 bp, Artificial Sequence
  chemically synthesized
atggaacagaatagagactt

SEQ ID NO: 443860 - DNA, 20 bp, Artificial Sequence
  chemically synthesized
cagaatagagacttcagaaa

SEQ ID NO: 443861 - DNA, 20 bp, Artificial Sequence
  chemically synthesized
tttgtgtgggtctatttctg

SEQ ID NO: 443862 - DNA, 20 bp, Artificial Sequence
  chemically synthesized
atcagttgagcaatttgtgt

SEQ ID NO: 443863 - DNA, 20 bp, Artificial Sequence
  chemically synthesized
aatcagttgagcaatttgtg

SEQ ID NO: 443864 - DNA, 20 bp, Artificial Sequence
  chemically synthesized
gcactgtgtcaaaatcagtt

SEQ ID NO: 443865 - DNA, 20 bp, Artificial Sequence
  chemically synthesized
attttgcactgtgtcaaaat

SEQ ID NO: 443866 - DNA, 20 bp, Artificial Sequence
  chemically synthesized
ttgctcaactgattttgaca

SEQ ID NO: 443867 - DNA, 20 bp, Artificial Sequence
  chemically synthesized
tgacacagtgcaaaataatt

SEQ ID NO: 443868 - DNA, 20 bp, Artificial Sequence
  chemically synthesized
cacagtgcaaaataattcag

SEQ ID NO: 443869 - DNA, 20 bp, Artificial Sequence
  chemically synthesized
cagtgcaaaataattcagtg

SEQ ID NO: 443870 - DNA, 20 bp, Artificial Sequence
  chemically synthesized
caaaataattcagtggagca

SEQ ID NO: 443871 - DNA, 20 bp, Artificial Sequence
  chemically synthesized
ataattcagtggagcaaaga

SEQ ID NO: 443872 - DNA, 20 bp, Artificial Sequence
  chemically synthesized
tctaagacccatgtgttgaa

SEQ ID NO: 443873 - DNA, 20 bp, Artificial Sequence
  chemically synthesized
aagatagtcttttcaacaca

SEQ ID NO: 443874 - DNA, 20 bp, Artificial Sequence
  chemically synthesized
agatagtcttttcaacacat

SEQ ID NO: 443875 - DNA, 20 bp, Artificial Sequence
  chemically synthesized
tcttttcaacacatgggtct

SEQ ID NO: 443876 - DNA, 20 bp, Artificial Sequence
  chemically synthesized
caacacatgggtcttagaac

SEQ ID NO: 443877 - DNA, 20 bp, Artificial Sequence
  chemically synthesized
tatttttgtccacttgttct

SEQ ID NO: 443878 - DNA, 20 bp, Artificial Sequence
  chemically synthesized
cacatgggtcttagaacaag

SEQ ID NO: 443879 - DNA, 20 bp, Artificial Sequence
  chemically synthesized
gaacaagtggacaaaaataa

SEQ ID NO: 443880 - DNA, 20 bp, Artificial Sequence
  chemically synthesized
aagtggacaaaaataatgga

SEQ ID NO: 443881 - DNA, 20 bp, Artificial Sequence
  chemically synthesized
caaaaataatggaaagaaaa

SEQ ID NO: 443882 - DNA, 20 bp, Artificial Sequence
  chemically synthesized
aaataatggaaagaaaaaag

SEQ ID NO: 443883 - DNA, 20 bp, Artificial Sequence
  chemically synthesized
tggaaagaaaaaagaagaaa

SEQ ID NO: 443884 - DNA, 20 bp, Artificial Sequence
  chemically synthesized
taaggtgtaaagttatgtca

SEQ ID NO: 443885 - DNA, 20 bp, Artificial Sequence
  chemically synthesized
ataaggtgtaaagttatgtc

SEQ ID NO: 443886 - DNA, 20 bp, Artificial Sequence
  chemically synthesized
tttattttgcataaggtgta

SEQ ID NO: 443887 - DNA, 20 bp, Artificial Sequence
  chemically synthesized
tttgcattttattttgcata

SEQ ID NO: 443888 - DNA, 20 bp, Artificial Sequence
  chemically synthesized
atttgcattttattttgcat

SEQ ID NO: 443889 - DNA, 20 bp, Artificial Sequence
  chemically synthesized
tatgcaaaataaaatgcaaa

SEQ ID NO: 443890 - DNA, 20 bp, Artificial Sequence
  chemically synthesized
aaatattttacaaaaacata

SEQ ID NO: 443891 - DNA, 20 bp, Artificial Sequence
  chemically synthesized
aatattttacaaaaacatac

SEQ ID NO: 443892 - DNA, 20 bp, Artificial Sequence
  chemically synthesized
tattttacaaaaacatacag

SEQ ID NO: 443893 - DNA, 20 bp, Artificial Sequence
  chemically synthesized
ttttacaaaaacatacagga

SEQ ID NO: 443894 - DNA, 20 bp, Artificial Sequence
  chemically synthesized
aaaacatacaggagagtctt

SEQ ID NO: 443895 - DNA, 20 bp, Artificial Sequence
  chemically synthesized
aaacatacaggagagtcttc

SEQ ID NO: 443896 - DNA, 20 bp, Artificial Sequence
  chemically synthesized
cctcctagcctttcatcctg

SEQ ID NO: 443897 - DNA, 20 bp, Artificial Sequence
  chemically synthesized
caggagagtcttcaggatga

SEQ ID NO: 443898 - DNA, 20 bp, Artificial Sequence
  chemically synthesized
aggagagtcttcaggatgaa

SEQ ID NO: 443899 - DNA, 20 bp, Artificial Sequence
  chemically synthesized
gagtcttcaggatgaaaggc

SEQ ID NO: 443900 - DNA, 20 bp, Artificial Sequence
  chemically synthesized
agtcttcaggatgaaaggct

SEQ ID NO: 443901 - DNA, 20 bp, Artificial Sequence
  chemically synthesized
tcttcaggatgaaaggctag

SEQ ID NO: 443902 - DNA, 20 bp, Artificial Sequence
  chemically synthesized
cttcaggatgaaaggctagg

SEQ ID NO: 443903 - DNA, 20 bp, Artificial Sequence
  chemically synthesized
tcaggatgaaaggctaggag

SEQ ID NO: 443904 - DNA, 20 bp, Artificial Sequence
  chemically synthesized
tcaaatctaagaactcctcc

SEQ ID NO: 443905 - DNA, 20 bp, Artificial Sequence
  chemically synthesized
gaaaggctaggaggagttct

SEQ ID NO: 443906 - DNA, 20 bp, Artificial Sequence
  chemically synthesized
acgattttaacgtcaaatct

SEQ ID NO: 443907 - DNA, 20 bp, Artificial Sequence
  chemically synthesized
gttaaaatcgtgtgccttaa

SEQ ID NO: 443908 - DNA, 20 bp, Artificial Sequence
  chemically synthesized
ttatcaaattgtgtctttta

SEQ ID NO: 443909 - DNA, 20 bp, Artificial Sequence
  chemically synthesized
tttatcaaattgtgtctttt

SEQ ID NO: 443910 - DNA, 20 bp, Artificial Sequence
  chemically synthesized
aaattttaaaattttgctct

SEQ ID NO: 443911 - DNA, 20 bp, Artificial Sequence
  chemically synthesized
tttaaaattttgctctgaga

SEQ ID NO: 443912 - DNA, 20 bp, Artificial Sequence
  chemically synthesized
tcttggcagcatctttctca

SEQ ID NO: 443913 - DNA, 20 bp, Artificial Sequence
  chemically synthesized
cctcttggcagcatctttct

SEQ ID NO: 443914 - DNA, 20 bp, Artificial Sequence
  chemically synthesized
gctctgagaaagatgctgcc

SEQ ID NO: 443915 - DNA, 20 bp, Artificial Sequence
  chemically synthesized
tctgagaaagatgctgccaa

SEQ ID NO: 443916 - DNA, 20 bp, Artificial Sequence
  chemically synthesized
ctgagaaagatgctgccaag

SEQ ID NO: 443917 - DNA, 20 bp, Artificial Sequence
  chemically synthesized
ctgtctcttcatcctcttgg

SEQ ID NO: 443918 - DNA, 20 bp, Artificial Sequence
  chemically synthesized
agcctgtctcttcatcctct

SEQ ID NO: 443919 - DNA, 20 bp, Artificial Sequence
  chemically synthesized
aagatgctgccaagaggatg

SEQ ID NO: 443920 - DNA, 20 bp, Artificial Sequence
  chemically synthesized
gatgctgccaagaggatgaa

SEQ ID NO: 443921 - DNA, 20 bp, Artificial Sequence
  chemically synthesized
ctgccaagaggatgaagaga

SEQ ID NO: 443922 - DNA, 20 bp, Artificial Sequence
  chemically synthesized
tgccaagaggatgaagagac

SEQ ID NO: 443923 - DNA, 20 bp, Artificial Sequence
  chemically synthesized
gaagagacaggctgcacatc

SEQ ID NO: 443924 - DNA, 20 bp, Artificial Sequence
  chemically synthesized
caggtatttttctcgatgtg

SEQ ID NO: 443925 - DNA, 20 bp, Artificial Sequence
  chemically synthesized
tggtcagatatatggtttgc

SEQ ID NO: 443926 - DNA, 20 bp, Artificial Sequence
  chemically synthesized
atggtcagatatatggtttg

SEQ ID NO: 443927 - DNA, 20 bp, Artificial Sequence
  chemically synthesized
ctagtgcatggtcagatata

SEQ ID NO: 443928 - DNA, 20 bp, Artificial Sequence
  chemically synthesized
tctagatactagtgcatggt

SEQ ID NO: 443929 - DNA, 20 bp, Artificial Sequence
  chemically synthesized
ccatatatctgaccatgcac

SEQ ID NO: 443930 - DNA, 20 bp, Artificial Sequence
  chemically synthesized
ttagtctagatactagtgca

SEQ ID NO: 443931 - DNA, 20 bp, Artificial Sequence
  chemically synthesized
tctgaccatgcactagtatc

SEQ ID NO: 443932 - DNA, 20 bp, Artificial Sequence
  chemically synthesized
tcttcatttagtctagatac

SEQ ID NO: 443933 - DNA, 20 bp, Artificial Sequence
  chemically synthesized
catgaattcttcatttagtc

SEQ ID NO: 443934 - DNA, 20 bp, Artificial Sequence
  chemically synthesized
actagtatctagactaaatg

SEQ ID NO: 443935 - DNA, 20 bp, Artificial Sequence
  chemically synthesized
ggttacatgaattcttcatt

SEQ ID NO: 443936 - DNA, 20 bp, Artificial Sequence
  chemically synthesized
gaagaattcatgtaacccaa

SEQ ID NO: 443937 - DNA, 20 bp, Artificial Sequence
  chemically synthesized
tctattttgtttttactttt

SEQ ID NO: 443938 - DNA, 20 bp, Artificial Sequence
  chemically synthesized
gtctattttgtttttacttt

SEQ ID NO: 443939 - DNA, 20 bp, Artificial Sequence
  chemically synthesized
acccaaaagtaaaaacaaaa

SEQ ID NO: 443940 - DNA, 20 bp, Artificial Sequence
  chemically synthesized
atagacacaaaaaaatccat

SEQ ID NO: 443941 - DNA, 20 bp, Artificial Sequence
  chemically synthesized
tcttttgcccatttttctaa

SEQ ID NO: 443942 - DNA, 20 bp, Artificial Sequence
  chemically synthesized
aaaaaaatccattagaaaaa

SEQ ID NO: 443943 - DNA, 20 bp, Artificial Sequence
  chemically synthesized
aaaaaatccattagaaaaat

SEQ ID NO: 443944 - DNA, 20 bp, Artificial Sequence
  chemically synthesized
tccattagaaaaatgggcaa

SEQ ID NO: 443945 - DNA, 20 bp, Artificial Sequence
  chemically synthesized
agaaaaatgggcaaaagaca

SEQ ID NO: 443946 - DNA, 20 bp, Artificial Sequence
  chemically synthesized
aaaaatgggcaaaagacatg

SEQ ID NO: 443947 - DNA, 20 bp, Artificial Sequence
  chemically synthesized
gacatggagacatttcacca

SEQ ID NO: 443948 - DNA, 20 bp, Artificial Sequence
  chemically synthesized
cgccatctatgtgttgtctt

SEQ ID NO: 443949 - DNA, 20 bp, Artificial Sequence
  chemically synthesized
atttcaccaaagacaacaca

SEQ ID NO: 443950 - DNA, 20 bp, Artificial Sequence
  chemically synthesized
caccaaagacaacacataga

SEQ ID NO: 443951 - DNA, 20 bp, Artificial Sequence
  chemically synthesized
caaagacaacacatagatgg

SEQ ID NO: 443952 - DNA, 20 bp, Artificial Sequence
  chemically synthesized
acaacacatagatggcggat

SEQ ID NO: 443953 - DNA, 20 bp, Artificial Sequence
  chemically synthesized
atggcggataagcttgtgaa

SEQ ID NO: 443954 - DNA, 20 bp, Artificial Sequence
  chemically synthesized
gatgctgaacatcttttcac

SEQ ID NO: 443955 - DNA, 20 bp, Artificial Sequence
  chemically synthesized
taagcttgtgaaaagatgtt

SEQ ID NO: 443956 - DNA, 20 bp, Artificial Sequence
  chemically synthesized
gaaaagatgttcagcatcat

SEQ ID NO: 443957 - DNA, 20 bp, Artificial Sequence
  chemically synthesized
tgttcagcatcattggctct

SEQ ID NO: 443958 - DNA, 20 bp, Artificial Sequence
  chemically synthesized
gttcagcatcattggctctt

SEQ ID NO: 443959 - DNA, 20 bp, Artificial Sequence
  chemically synthesized
ttcagcatcattggctctta

SEQ ID NO: 443960 - DNA, 20 bp, Artificial Sequence
  chemically synthesized
tttaattcgaatttccctaa

SEQ ID NO: 443961 - DNA, 20 bp, Artificial Sequence
  chemically synthesized
gttttaattcgaatttccct

SEQ ID NO: 443962 - DNA, 20 bp, Artificial Sequence
  chemically synthesized
cacagagttatatcgtattg

SEQ ID NO: 443963 - DNA, 20 bp, Artificial Sequence
  chemically synthesized
gcacagagttatatcgtatt

SEQ ID NO: 443964 - DNA, 20 bp, Artificial Sequence
  chemically synthesized
tagccattctaatatgcaca

SEQ ID NO: 443965 - DNA, 20 bp, Artificial Sequence
  chemically synthesized
cgatataactctgtgcatat

SEQ ID NO: 443966 - DNA, 20 bp, Artificial Sequence
  chemically synthesized
cttagccattctaatatgca

SEQ ID NO: 443967 - DNA, 20 bp, Artificial Sequence
  chemically synthesized
taactctgtgcatattagaa

SEQ ID NO: 443968 - DNA, 20 bp, Artificial Sequence
  chemically synthesized
ctgtgcatattagaatggct

SEQ ID NO: 443969 - DNA, 20 bp, Artificial Sequence
  chemically synthesized
gttgtcactattttttaact

SEQ ID NO: 443970 - DNA, 20 bp, Artificial Sequence
  chemically synthesized
agaatggctaagttaaaaaa

SEQ ID NO: 443971 - DNA, 20 bp, Artificial Sequence
  chemically synthesized
atagtgacaacatcaaacac

SEQ ID NO: 443972 - DNA, 20 bp, Artificial Sequence
  chemically synthesized
tgacaacatcaaacactggc

SEQ ID NO: 443973 - DNA, 20 bp, Artificial Sequence
  chemically synthesized
tcatttctctgcattcttgc

SEQ ID NO: 443974 - DNA, 20 bp, Artificial Sequence
  chemically synthesized
atcaaacactggcaagaatg

SEQ ID NO: 443975 - DNA, 20 bp, Artificial Sequence
  chemically synthesized
caaacactggcaagaatgca

SEQ ID NO: 443976 - DNA, 20 bp, Artificial Sequence
  chemically synthesized
tggcaagaatgcagagaaat

SEQ ID NO: 443977 - DNA, 20 bp, Artificial Sequence
  chemically synthesized
tgtttccaccaacaatgtgt

SEQ ID NO: 443978 - DNA, 20 bp, Artificial Sequence
  chemically synthesized
tgagatcacttacacattgt

SEQ ID NO: 443979 - DNA, 20 bp, Artificial Sequence
  chemically synthesized
gatcacttacacattgttgg

SEQ ID NO: 443980 - DNA, 20 bp, Artificial Sequence
  chemically synthesized
cacattgttggtggaaacat

SEQ ID NO: 443981 - DNA, 20 bp, Artificial Sequence
  chemically synthesized
ttgttggtggaaacatgaga

SEQ ID NO: 443982 - DNA, 20 bp, Artificial Sequence
  chemically synthesized
ggtggaaacatgagatggta

SEQ ID NO: 443983 - DNA, 20 bp, Artificial Sequence
  chemically synthesized
gtggaaacatgagatggtaa

SEQ ID NO: 443984 - DNA, 20 bp, Artificial Sequence
  chemically synthesized
atggtaaaggtactctgtaa

SEQ ID NO: 443985 - DNA, 20 bp, Artificial Sequence
  chemically synthesized
caatgcaccaaacttttaca

SEQ ID NO: 443986 - DNA, 20 bp, Artificial Sequence
  chemically synthesized
tacaatgcaccaaactttta

SEQ ID NO: 443987 - DNA, 20 bp, Artificial Sequence
  chemically synthesized
aaaggtactctgtaaaagtt

SEQ ID NO: 443988 - DNA, 20 bp, Artificial Sequence
  chemically synthesized
ctgtaggttagttgtatgtt

SEQ ID NO: 443989 - DNA, 20 bp, Artificial Sequence
  chemically synthesized
ctaaacatacaactaaccta

SEQ ID NO: 443990 - DNA, 20 bp, Artificial Sequence
  chemically synthesized
gaaatttctgggctgtaggt

SEQ ID NO: 443991 - DNA, 20 bp, Artificial Sequence
  chemically synthesized
catacaactaacctacagcc

SEQ ID NO: 443992 - DNA, 20 bp, Artificial Sequence
  chemically synthesized
gaatgaaatttctgggctgt

SEQ ID NO: 443993 - DNA, 20 bp, Artificial Sequence
  chemically synthesized
ggaatgaaatttctgggctg

SEQ ID NO: 443994 - DNA, 20 bp, Artificial Sequence
  chemically synthesized
tgccatggaatgaaatttct

SEQ ID NO: 443995 - DNA, 20 bp, Artificial Sequence
  chemically synthesized
atgccatggaatgaaatttc

SEQ ID NO: 443996 - DNA, 20 bp, Artificial Sequence
  chemically synthesized
agcccagaaatttcattcca

SEQ ID NO: 443997 - DNA, 20 bp, Artificial Sequence
  chemically synthesized
tttatctgggattaatgcca

SEQ ID NO: 443998 - DNA, 20 bp, Artificial Sequence
  chemically synthesized
tcattccatggcattaatcc

SEQ ID NO: 443999 - DNA, 20 bp, Artificial Sequence
  chemically synthesized
gagcaaattttcatttatct

SEQ ID NO: 444000 - DNA, 20 bp, Artificial Sequence
  chemically synthesized
tgagcaaattttcatttatc

SEQ ID NO: 444001 - DNA, 20 bp, Artificial Sequence
  chemically synthesized
ctcatgtacagtttttttat

SEQ ID NO: 444002 - DNA, 20 bp, Artificial Sequence
  chemically synthesized
ctcataaaaaaactgtacat

SEQ ID NO: 444003 - DNA, 20 bp, Artificial Sequence
  chemically synthesized
ctgctatgaagactcatgta

SEQ ID NO: 444004 - DNA, 20 bp, Artificial Sequence
  chemically synthesized
aaactgtacatgagtcttca

SEQ ID NO: 444005 - DNA, 20 bp, Artificial Sequence
  chemically synthesized
ctgtacatgagtcttcatag

SEQ ID NO: 444006 - DNA, 20 bp, Artificial Sequence
  chemically synthesized
ttacaaatacagctgctatg

SEQ ID NO: 444007 - DNA, 20 bp, Artificial Sequence
  chemically synthesized
gtttctgcctattacaaata

SEQ ID NO: 444008 - DNA, 20 bp, Artificial Sequence
  chemically synthesized
catagcagctgtatttgtaa

SEQ ID NO: 444009 - DNA, 20 bp, Artificial Sequence
  chemically synthesized
atagcagctgtatttgtaat

SEQ ID NO: 444010 - DNA, 20 bp, Artificial Sequence
  chemically synthesized
gcagctgtatttgtaatagg

SEQ ID NO: 444011 - DNA, 20 bp, Artificial Sequence
  chemically synthesized
tatttgtaataggcagaaac

SEQ ID NO: 444012 - DNA, 20 bp, Artificial Sequence
  chemically synthesized
aaggacatctgggttgtttc

SEQ ID NO: 444013 - DNA, 20 bp, Artificial Sequence
  chemically synthesized
ggcagaaactggaaacaacc

SEQ ID NO: 444014 - DNA, 20 bp, Artificial Sequence
  chemically synthesized
ttgcctgttgaaggacatct

SEQ ID NO: 444015 - DNA, 20 bp, Artificial Sequence
  chemically synthesized
tttgcctgttgaaggacatc

SEQ ID NO: 444016 - DNA, 20 bp, Artificial Sequence
  chemically synthesized
acaacccagatgtccttcaa

SEQ ID NO: 444017 - DNA, 20 bp, Artificial Sequence
  chemically synthesized
caacccagatgtccttcaac

SEQ ID NO: 444018 - DNA, 20 bp, Artificial Sequence
  chemically synthesized
attaaccatttgcctgttga

SEQ ID NO: 444019 - DNA, 20 bp, Artificial Sequence
  chemically synthesized
gattaaccatttgcctgttg

SEQ ID NO: 444020 - DNA, 20 bp, Artificial Sequence
  chemically synthesized
gatgtccttcaacaggcaaa

SEQ ID NO: 444021 - DNA, 20 bp, Artificial Sequence
  chemically synthesized
aggcaaatggttaatcaaac

SEQ ID NO: 444022 - DNA, 20 bp, Artificial Sequence
  chemically synthesized
attccatggtatgaatatgc

SEQ ID NO: 444023 - DNA, 20 bp, Artificial Sequence
  chemically synthesized
aaactggcatattcatacca

SEQ ID NO: 444024 - DNA, 20 bp, Artificial Sequence
  chemically synthesized
tactgctgagtagtattcca

SEQ ID NO: 444025 - DNA, 20 bp, Artificial Sequence
  chemically synthesized
tcataccatggaatactact

SEQ ID NO: 444026 - DNA, 20 bp, Artificial Sequence
  chemically synthesized
taccatggaatactactcag

SEQ ID NO: 444027 - DNA, 20 bp, Artificial Sequence
  chemically synthesized
tgttcctttgtactgctgag

SEQ ID NO: 444028 - DNA, 20 bp, Artificial Sequence
  chemically synthesized
atgtgttcctttgtactgct

SEQ ID NO: 444029 - DNA, 20 bp, Artificial Sequence
  chemically synthesized
gaatactactcagcagtaca

SEQ ID NO: 444030 - DNA, 20 bp, Artificial Sequence
  chemically synthesized
aatactactcagcagtacaa

SEQ ID NO: 444031 - DNA, 20 bp, Artificial Sequence
  chemically synthesized
gttgatgcacattacaaatc

SEQ ID NO: 444032 - DNA, 20 bp, Artificial Sequence
  chemically synthesized
gatgcacattacaaatctgg

SEQ ID NO: 444033 - DNA, 20 bp, Artificial Sequence
  chemically synthesized
taattctctggagattcttc

SEQ ID NO: 444034 - DNA, 20 bp, Artificial Sequence
  chemically synthesized
tacaaatctggaagaatctc

SEQ ID NO: 444035 - DNA, 20 bp, Artificial Sequence
  chemically synthesized
caaatctggaagaatctcca

SEQ ID NO: 444036 - DNA, 20 bp, Artificial Sequence
  chemically synthesized
tcactcagcataattctctg

SEQ ID NO: 444037 - DNA, 20 bp, Artificial Sequence
  chemically synthesized
gttcactcagcataattctc

SEQ ID NO: 444038 - DNA, 20 bp, Artificial Sequence
  chemically synthesized
aatctccagagaattatgct

SEQ ID NO: 444039 - DNA, 20 bp, Artificial Sequence
  chemically synthesized
gagaattatgctgagtgaac

SEQ ID NO: 444040 - DNA, 20 bp, Artificial Sequence
  chemically synthesized
taggactagccttgttcact

SEQ ID NO: 444041 - DNA, 20 bp, Artificial Sequence
  chemically synthesized
agaattatgctgagtgaaca

SEQ ID NO: 444042 - DNA, 20 bp, Artificial Sequence
  chemically synthesized
ttatgctgagtgaacaaggc

SEQ ID NO: 444043 - DNA, 20 bp, Artificial Sequence
  chemically synthesized
attatgtagctatttaggac

SEQ ID NO: 444044 - DNA, 20 bp, Artificial Sequence
  chemically synthesized
tgaacaaggctagtcctaaa

SEQ ID NO: 444045 - DNA, 20 bp, Artificial Sequence
  chemically synthesized
cctgtattatgtagctattt

SEQ ID NO: 444046 - DNA, 20 bp, Artificial Sequence
  chemically synthesized
ccctgtattatgtagctatt

SEQ ID NO: 444047 - DNA, 20 bp, Artificial Sequence
  chemically synthesized
tcctaaatagctacataata

SEQ ID NO: 444048 - DNA, 20 bp, Artificial Sequence
  chemically synthesized
aaatgaaaccctgtattatg

SEQ ID NO: 444049 - DNA, 20 bp, Artificial Sequence
  chemically synthesized
cctaaatagctacataatac

SEQ ID NO: 444050 - DNA, 20 bp, Artificial Sequence
  chemically synthesized
ctaaatagctacataataca

SEQ ID NO: 444051 - DNA, 20 bp, Artificial Sequence
  chemically synthesized
ttcatttacataacactttt

SEQ ID NO: 444052 - DNA, 20 bp, Artificial Sequence
  chemically synthesized
gtataattttatcatctcaa

SEQ ID NO: 444053 - DNA, 20 bp, Artificial Sequence
  chemically synthesized
agatgataaaattatacaaa

SEQ ID NO: 444054 - DNA, 20 bp, Artificial Sequence
  chemically synthesized
atgataaaattatacaaata

SEQ ID NO: 444055 - DNA, 20 bp, Artificial Sequence
  chemically synthesized
tatacaaatagagatcatat

SEQ ID NO: 444056 - DNA, 20 bp, Artificial Sequence
  chemically synthesized
acaaatagagatcatattag

SEQ ID NO: 444057 - DNA, 20 bp, Artificial Sequence
  chemically synthesized
gagatcatattagtagttgc

SEQ ID NO: 444058 - DNA, 20 bp, Artificial Sequence
  chemically synthesized
gatcatattagtagttgcta

SEQ ID NO: 444059 - DNA, 20 bp, Artificial Sequence
  chemically synthesized
attagtagttgctagagatt

SEQ ID NO: 444060 - DNA, 20 bp, Artificial Sequence
  chemically synthesized
ttagtagttgctagagatta

SEQ ID NO: 444061 - DNA, 20 bp, Artificial Sequence
  chemically synthesized
ctcaggcactccttaatctc

SEQ ID NO: 444062 - DNA, 20 bp, Artificial Sequence
  chemically synthesized
agtagttgctagagattaag

SEQ ID NO: 444063 - DNA, 20 bp, Artificial Sequence
  chemically synthesized
ctagagattaaggagtgcct

SEQ ID NO: 444064 - DNA, 20 bp, Artificial Sequence
  chemically synthesized
tagagattaaggagtgcctg

SEQ ID NO: 444065 - DNA, 20 bp, Artificial Sequence
  chemically synthesized
agagattaaggagtgcctga

SEQ ID NO: 444066 - DNA, 20 bp, Artificial Sequence
  chemically synthesized
gattaaggagtgcctgaggg

SEQ ID NO: 444067 - DNA, 20 bp, Artificial Sequence
  chemically synthesized
attaaggagtgcctgagggc

SEQ ID NO: 444068 - DNA, 20 bp, Artificial Sequence
  chemically synthesized
cccacttttttcctgccctc

SEQ ID NO: 444069 - DNA, 20 bp, Artificial Sequence
  chemically synthesized
acccacttttttcctgccct

SEQ ID NO: 444070 - DNA, 20 bp, Artificial Sequence
  chemically synthesized
agtgcctgagggcaggaaaa

SEQ ID NO: 444071 - DNA, 20 bp, Artificial Sequence
  chemically synthesized
gcctgagggcaggaaaaaag

SEQ ID NO: 444072 - DNA, 20 bp, Artificial Sequence
  chemically synthesized
cctgagggcaggaaaaaagt

SEQ ID NO: 444073 - DNA, 20 bp, Artificial Sequence
  chemically synthesized
aaaagtgggtctgaccatga

SEQ ID NO: 444074 - DNA, 20 bp, Artificial Sequence
  chemically synthesized
tcatgttgccctttcatggt

SEQ ID NO: 444075 - DNA, 20 bp, Artificial Sequence
  chemically synthesized
aaagtgggtctgaccatgaa

SEQ ID NO: 444076 - DNA, 20 bp, Artificial Sequence
  chemically synthesized
aagtgggtctgaccatgaaa

SEQ ID NO: 444077 - DNA, 20 bp, Artificial Sequence
  chemically synthesized
tcactcatgttgccctttca

SEQ ID NO: 444078 - DNA, 20 bp, Artificial Sequence
  chemically synthesized
tgaccatgaaagggcaacat

SEQ ID NO: 444079 - DNA, 20 bp, Artificial Sequence
  chemically synthesized
ggcaacatgagtgatccttg

SEQ ID NO: 444080 - DNA, 20 bp, Artificial Sequence
  chemically synthesized
aggatatttccatcaccaca

SEQ ID NO: 444081 - DNA, 20 bp, Artificial Sequence
  chemically synthesized
atgagtgatccttgtggtga

SEQ ID NO: 444082 - DNA, 20 bp, Artificial Sequence
  chemically synthesized
caggatatttccatcaccac

SEQ ID NO: 444083 - DNA, 20 bp, Artificial Sequence
  chemically synthesized
catcagcacagataaaatac

SEQ ID NO: 444084 - DNA, 20 bp, Artificial Sequence
  chemically synthesized
acatcagcacagataaaata

SEQ ID NO: 444085 - DNA, 20 bp, Artificial Sequence
  chemically synthesized
acaagatattgacatcagca

SEQ ID NO: 444086 - DNA, 20 bp, Artificial Sequence
  chemically synthesized
ttacaacaagatattgacat

SEQ ID NO: 444087 - DNA, 20 bp, Artificial Sequence
  chemically synthesized
ctatagaacaatattacaac

SEQ ID NO: 444088 - DNA, 20 bp, Artificial Sequence
  chemically synthesized
cttgttgtaatattgttcta

SEQ ID NO: 444089 - DNA, 20 bp, Artificial Sequence
  chemically synthesized
aaggtaaagtcacagaacta

SEQ ID NO: 444090 - DNA, 20 bp, Artificial Sequence
  chemically synthesized
ccctccttaaggtaaagtca

SEQ ID NO: 444091 - DNA, 20 bp, Artificial Sequence
  chemically synthesized
tagttctgtgactttacctt

SEQ ID NO: 444092 - DNA, 20 bp, Artificial Sequence
  chemically synthesized
agttctgtgactttacctta

SEQ ID NO: 444093 - DNA, 20 bp, Artificial Sequence
  chemically synthesized
cccagtccctccttaaggta

SEQ ID NO: 444094 - DNA, 20 bp, Artificial Sequence
  chemically synthesized
ttctgtgactttaccttaag

SEQ ID NO: 444095 - DNA, 20 bp, Artificial Sequence
  chemically synthesized
tctgtgactttaccttaagg

SEQ ID NO: 444096 - DNA, 20 bp, Artificial Sequence
  chemically synthesized
ctgtgactttaccttaagga

SEQ ID NO: 444097 - DNA, 20 bp, Artificial Sequence
  chemically synthesized
ttttacccagtccctcctta

SEQ ID NO: 444098 - DNA, 20 bp, Artificial Sequence
  chemically synthesized
attttacccagtccctcctt

SEQ ID NO: 444099 - DNA, 20 bp, Artificial Sequence
  chemically synthesized
actttaccttaaggagggac

SEQ ID NO: 444100 - DNA, 20 bp, Artificial Sequence
  chemically synthesized
ctttaccttaaggagggact

SEQ ID NO: 444101 - DNA, 20 bp, Artificial Sequence
  chemically synthesized
taaggagggactgggtaaaa

SEQ ID NO: 444102 - DNA, 20 bp, Artificial Sequence
  chemically synthesized
atcctgtgtgccattttacc

SEQ ID NO: 444103 - DNA, 20 bp, Artificial Sequence
  chemically synthesized
ggactgggtaaaatggcaca

SEQ ID NO: 444104 - DNA, 20 bp, Artificial Sequence
  chemically synthesized
gactgggtaaaatggcacac

SEQ ID NO: 444105 - DNA, 20 bp, Artificial Sequence
  chemically synthesized
gttgtaagaaataatacaga

SEQ ID NO: 444106 - DNA, 20 bp, Artificial Sequence
  chemically synthesized
tgcagttgtaagaaataata

SEQ ID NO: 444107 - DNA, 20 bp, Artificial Sequence
  chemically synthesized
gtaaattcacatgcagttgt

SEQ ID NO: 444108 - DNA, 20 bp, Artificial Sequence
  chemically synthesized
gataactgtaaattcacatg

SEQ ID NO: 444109 - DNA, 20 bp, Artificial Sequence
  chemically synthesized
tacaactgcatgtgaattta

SEQ ID NO: 444110 - DNA, 20 bp, Artificial Sequence
  chemically synthesized
ttttaaaaaaaaaagataga

SEQ ID NO: 444111 - DNA, 20 bp, Artificial Sequence
  chemically synthesized
tgtcttttaaaaaaaaaaga

SEQ ID NO: 444112 - DNA, 20 bp, Artificial Sequence
  chemically synthesized
ccactgtcttttaaaaaaaa

SEQ ID NO: 444113 - DNA, 20 bp, Artificial Sequence
  chemically synthesized
tatctatcttttttttttaa

SEQ ID NO: 444114 - DNA, 20 bp, Artificial Sequence
  chemically synthesized
tatcttttttttttaaaaga

SEQ ID NO: 444115 - DNA, 20 bp, Artificial Sequence
  chemically synthesized
cttttttttttaaaagacag

SEQ ID NO: 444116 - DNA, 20 bp, Artificial Sequence
  chemically synthesized
ttttttttttaaaagacagt

SEQ ID NO: 444117 - DNA, 20 bp, Artificial Sequence
  chemically synthesized
ttttttaaaagacagtgggc

SEQ ID NO: 444118 - DNA, 20 bp, Artificial Sequence
  chemically synthesized
tttttaaaagacagtgggct

SEQ ID NO: 444119 - DNA, 20 bp, Artificial Sequence
  chemically synthesized
aaaagacagtgggctgggtt

SEQ ID NO: 444120 - DNA, 20 bp, Artificial Sequence
  chemically synthesized
tttggctcataggctaaacc

SEQ ID NO: 444121 - DNA, 20 bp, Artificial Sequence
  chemically synthesized
gtgggctgggtttagcctat

SEQ ID NO: 444122 - DNA, 20 bp, Artificial Sequence
  chemically synthesized
gtctgtaaactttggctcat

SEQ ID NO: 444123 - DNA, 20 bp, Artificial Sequence
  chemically synthesized
tgggtttagcctatgagcca

SEQ ID NO: 444124 - DNA, 20 bp, Artificial Sequence
  chemically synthesized
agtctgtaaactttggctca

SEQ ID NO: 444125 - DNA, 20 bp, Artificial Sequence
  chemically synthesized
agcctatgagccaaagttta

SEQ ID NO: 444126 - DNA, 20 bp, Artificial Sequence
  chemically synthesized
tggcaggagtctgtaaactt

SEQ ID NO: 444127 - DNA, 20 bp, Artificial Sequence
  chemically synthesized
atgtcagtgtcgtatggcag

SEQ ID NO: 444128 - DNA, 20 bp, Artificial Sequence
  chemically synthesized
gaatgtcagtgtcgtatggc

SEQ ID NO: 444129 - DNA, 20 bp, Artificial Sequence
  chemically synthesized
cgaatgtcagtgtcgtatgg

SEQ ID NO: 444130 - DNA, 20 bp, Artificial Sequence
  chemically synthesized
gcacgaatgtcagtgtcgta

SEQ ID NO: 444131 - DNA, 20 bp, Artificial Sequence
  chemically synthesized
ttatttgtatgcacgaatgt

SEQ ID NO: 444132 - DNA, 20 bp, Artificial Sequence
  chemically synthesized
tcgtgcatacaaataaatat

SEQ ID NO: 444133 - DNA, 20 bp, Artificial Sequence
  chemically synthesized
taagataaaactacattgtg

SEQ ID NO: 444134 - DNA, 20 bp, Artificial Sequence
  chemically synthesized
ctccatcaggcttcacaatg

SEQ ID NO: 444135 - DNA, 20 bp, Artificial Sequence
  chemically synthesized
aactacattgtgaagcctga

SEQ ID NO: 444136 - DNA, 20 bp, Artificial Sequence
  chemically synthesized
ctacattgtgaagcctgatg

SEQ ID NO: 444137 - DNA, 20 bp, Artificial Sequence
  chemically synthesized
gatgccacctaatctccatc

SEQ ID NO: 444138 - DNA, 20 bp, Artificial Sequence
  chemically synthesized
tgatgccacctaatctccat

SEQ ID NO: 444139 - DNA, 20 bp, Artificial Sequence
  chemically synthesized
ttgtgaagcctgatggagat

SEQ ID NO: 444140 - DNA, 20 bp, Artificial Sequence
  chemically synthesized
tgtgaagcctgatggagatt

SEQ ID NO: 444141 - DNA, 20 bp, Artificial Sequence
  chemically synthesized
gaagcctgatggagattagg

SEQ ID NO: 444142 - DNA, 20 bp, Artificial Sequence
  chemically synthesized
acaaaaaaaagcaagtgcaa

SEQ ID NO: 444143 - DNA, 20 bp, Artificial Sequence
  chemically synthesized
tccttttaacaaaaaaaagc

SEQ ID NO: 444144 - DNA, 20 bp, Artificial Sequence
  chemically synthesized
agtatccttttaacaaaaaa

SEQ ID NO: 444145 - DNA, 20 bp, Artificial Sequence
  chemically synthesized
cacttgcttttttttgttaa

SEQ ID NO: 444146 - DNA, 20 bp, Artificial Sequence
  chemically synthesized
acttgcttttttttgttaaa

SEQ ID NO: 444147 - DNA, 20 bp, Artificial Sequence
  chemically synthesized
tgttaaaaggatactgcaac

SEQ ID NO: 444148 - DNA, 20 bp, Artificial Sequence
  chemically synthesized
tacgttatataatctagttg

SEQ ID NO: 444149 - DNA, 20 bp, Artificial Sequence
  chemically synthesized
gtgtgttacgttatataatc

SEQ ID NO: 444150 - DNA, 20 bp, Artificial Sequence
  chemically synthesized
atataacgtaacacacttaa

SEQ ID NO: 444151 - DNA, 20 bp, Artificial Sequence
  chemically synthesized
ctgaattagataattctttt

SEQ ID NO: 444152 - DNA, 20 bp, Artificial Sequence
  chemically synthesized
cttaaaagaattatctaatt

SEQ ID NO: 444153 - DNA, 20 bp, Artificial Sequence
  chemically synthesized
ttaaaagaattatctaattc

SEQ ID NO: 444154 - DNA, 20 bp, Artificial Sequence
  chemically synthesized
tatttaaaattttcctgaat

SEQ ID NO: 444155 - DNA, 20 bp, Artificial Sequence
  chemically synthesized
aaaattttaaatatgcaaat

SEQ ID NO: 444156 - DNA, 20 bp, Artificial Sequence
  chemically synthesized
aaatatgcaaatcagaattc

SEQ ID NO: 444157 - DNA, 20 bp, Artificial Sequence
  chemically synthesized
aatatgcaaatcagaattct

SEQ ID NO: 444158 - DNA, 20 bp, Artificial Sequence
  chemically synthesized
tattttatttaaacgatacc

SEQ ID NO: 444159 - DNA, 20 bp, Artificial Sequence
  chemically synthesized
tatcgtttaaataaaatatt

SEQ ID NO: 444160 - DNA, 20 bp, Artificial Sequence
  chemically synthesized
tcgtttaaataaaatattta

SEQ ID NO: 444161 - DNA, 20 bp, Artificial Sequence
  chemically synthesized
tatttagagtcttgtaaaaa

SEQ ID NO: 444162 - DNA, 20 bp, Artificial Sequence
  chemically synthesized
cactgagagcctgtttttac

SEQ ID NO: 444163 - DNA, 20 bp, Artificial Sequence
  chemically synthesized
atttagagtcttgtaaaaac

SEQ ID NO: 444164 - DNA, 20 bp, Artificial Sequence
  chemically synthesized
gtcttgtaaaaacaggctct

SEQ ID NO: 444165 - DNA, 20 bp, Artificial Sequence
  chemically synthesized
caataacacaatggcactga

SEQ ID NO: 444166 - DNA, 20 bp, Artificial Sequence
  chemically synthesized
aacaataacacaatggcact

SEQ ID NO: 444167 - DNA, 20 bp, Artificial Sequence
  chemically synthesized
gagtattaacaataacacaa

SEQ ID NO: 444168 - DNA, 20 bp, Artificial Sequence
  chemically synthesized
taaacttatgaaacagtttt

SEQ ID NO: 444169 - DNA, 20 bp, Artificial Sequence
  chemically synthesized
aatactcaaaactgtttcat

SEQ ID NO: 444170 - DNA, 20 bp, Artificial Sequence
  chemically synthesized
caataaataaacttatgaaa

SEQ ID NO: 444171 - DNA, 20 bp, Artificial Sequence
  chemically synthesized
ttcataagtttatttattga

SEQ ID NO: 444172 - DNA, 20 bp, Artificial Sequence
  chemically synthesized
aagtttatttattgaaagcc

SEQ ID NO: 444173 - DNA, 20 bp, Artificial Sequence
  chemically synthesized
atttattgaaagcctagacc

SEQ ID NO: 444174 - DNA, 20 bp, Artificial Sequence
  chemically synthesized
gtgtagtaataacttggtct

SEQ ID NO: 444175 - DNA, 20 bp, Artificial Sequence
  chemically synthesized
tgtgtagtaataacttggtc

SEQ ID NO: 444176 - DNA, 20 bp, Artificial Sequence
  chemically synthesized
tttcttgtgtagtaataact

SEQ ID NO: 444177 - DNA, 20 bp, Artificial Sequence
  chemically synthesized
agaccaagttattactacac

SEQ ID NO: 444178 - DNA, 20 bp, Artificial Sequence
  chemically synthesized
caagttattactacacaaga

SEQ ID NO: 444179 - DNA, 20 bp, Artificial Sequence
  chemically synthesized
tttctttactctttcttgtg

SEQ ID NO: 444180 - DNA, 20 bp, Artificial Sequence
  chemically synthesized
agttattactacacaagaaa

SEQ ID NO: 444181 - DNA, 20 bp, Artificial Sequence
  chemically synthesized
ttactacacaagaaagagta

SEQ ID NO: 444182 - DNA, 20 bp, Artificial Sequence
  chemically synthesized
gaaaacaatataaatctatg

SEQ ID NO: 444183 - DNA, 20 bp, Artificial Sequence
  chemically synthesized
actctaaaatgtcatccaca

SEQ ID NO: 444184 - DNA, 20 bp, Artificial Sequence
  chemically synthesized
aatctatgtggatgacattt

SEQ ID NO: 444185 - DNA, 20 bp, Artificial Sequence
  chemically synthesized
tctatgtggatgacatttta

SEQ ID NO: 444186 - DNA, 20 bp, Artificial Sequence
  chemically synthesized
gacattttagagtgcaactt

SEQ ID NO: 444187 - DNA, 20 bp, Artificial Sequence
  chemically synthesized
ttgagcctacaagtttgctg

SEQ ID NO: 444188 - DNA, 20 bp, Artificial Sequence
  chemically synthesized
gtgcaacttcagcaaacttg

SEQ ID NO: 444189 - DNA, 20 bp, Artificial Sequence
  chemically synthesized
tgcaacttcagcaaacttgt

SEQ ID NO: 444190 - DNA, 20 bp, Artificial Sequence
  chemically synthesized
ggattttaatttgagcctac

SEQ ID NO: 444191 - DNA, 20 bp, Artificial Sequence
  chemically synthesized
ttaggaaaggattttaattt

SEQ ID NO: 444192 - DNA, 20 bp, Artificial Sequence
  chemically synthesized
ttaaagaaagaaattaggaa

SEQ ID NO: 444193 - DNA, 20 bp, Artificial Sequence
  chemically synthesized
tttaaagaaagaaattagga

SEQ ID NO: 444194 - DNA, 20 bp, Artificial Sequence
  chemically synthesized
cttttttaaagaaagaaatt

SEQ ID NO: 444195 - DNA, 20 bp, Artificial Sequence
  chemically synthesized
gcttttttaaagaaagaaat

SEQ ID NO: 444196 - DNA, 20 bp, Artificial Sequence
  chemically synthesized
ttcttttgcttttttaaaga

SEQ ID NO: 444197 - DNA, 20 bp, Artificial Sequence
  chemically synthesized
cctaatttctttctttaaaa

SEQ ID NO: 444198 - DNA, 20 bp, Artificial Sequence
  chemically synthesized
ttttttcttttgctttttta

SEQ ID NO: 444199 - DNA, 20 bp, Artificial Sequence
  chemically synthesized
ttctttctttaaaaaagcaa

SEQ ID NO: 444200 - DNA, 20 bp, Artificial Sequence
  chemically synthesized
aaaataattctaacagggag

SEQ ID NO: 444201 - DNA, 20 bp, Artificial Sequence
  chemically synthesized
gaaaaaaatcccctccctgt

SEQ ID NO: 444202 - DNA, 20 bp, Artificial Sequence
  chemically synthesized
aaaaataattctaacaggga

SEQ ID NO: 444203 - DNA, 20 bp, Artificial Sequence
  chemically synthesized
aaaaaataattctaacaggg

SEQ ID NO: 444204 - DNA, 20 bp, Artificial Sequence
  chemically synthesized
aaaaaaataattctaacagg

SEQ ID NO: 444205 - DNA, 20 bp, Artificial Sequence
  chemically synthesized
gtaaaaaaataattctaaca

SEQ ID NO: 444206 - DNA, 20 bp, Artificial Sequence
  chemically synthesized
agtaaaaaaataattctaac

SEQ ID NO: 444207 - DNA, 20 bp, Artificial Sequence
  chemically synthesized
gagtaaaaaaataattctaa

SEQ ID NO: 444208 - DNA, 20 bp, Artificial Sequence
  chemically synthesized
aaatggtggttttaagaaca

SEQ ID NO: 444209 - DNA, 20 bp, Artificial Sequence
  chemically synthesized
aaaaatggtggttttaagaa

SEQ ID NO: 444210 - DNA, 20 bp, Artificial Sequence
  chemically synthesized
tggaaaaaaatggtggtttt

SEQ ID NO: 444211 - DNA, 20 bp, Artificial Sequence
  chemically synthesized
cttgccatggaaaaaaatgg

SEQ ID NO: 444212 - DNA, 20 bp, Artificial Sequence
  chemically synthesized
agccttgccatggaaaaaaa

SEQ ID NO: 444213 - DNA, 20 bp, Artificial Sequence
  chemically synthesized
aaaaccaccatttttttcca

SEQ ID NO: 444214 - DNA, 20 bp, Artificial Sequence
  chemically synthesized
ccaccatttttttccatggc

SEQ ID NO: 444215 - DNA, 20 bp, Artificial Sequence
  chemically synthesized
caccatttttttccatggca

SEQ ID NO: 444216 - DNA, 20 bp, Artificial Sequence
  chemically synthesized
atgaaaacttagccttgcca

SEQ ID NO: 444217 - DNA, 20 bp, Artificial Sequence
  chemically synthesized
tttttttccatggcaaggct

SEQ ID NO: 444218 - DNA, 20 bp, Artificial Sequence
  chemically synthesized
accttatcaggatgaaaact

SEQ ID NO: 444219 - DNA, 20 bp, Artificial Sequence
  chemically synthesized
ggctaagttttcatcctgat

SEQ ID NO: 444220 - DNA, 20 bp, Artificial Sequence
  chemically synthesized
gctaagttttcatcctgata

SEQ ID NO: 444221 - DNA, 20 bp, Artificial Sequence
  chemically synthesized
accttcagaaaaaccttatc

SEQ ID NO: 444222 - DNA, 20 bp, Artificial Sequence
  chemically synthesized
aaccttcagaaaaaccttat

SEQ ID NO: 444223 - DNA, 20 bp, Artificial Sequence
  chemically synthesized
atcctgataaggtttttctg

SEQ ID NO: 444224 - DNA, 20 bp, Artificial Sequence
  chemically synthesized
tcctgataaggtttttctga

SEQ ID NO: 444225 - DNA, 20 bp, Artificial Sequence
  chemically synthesized
aggatgacacattaaacctt

SEQ ID NO: 444226 - DNA, 20 bp, Artificial Sequence
  chemically synthesized
aaggtttaatgtgtcatcct

SEQ ID NO: 444227 - DNA, 20 bp, Artificial Sequence
  chemically synthesized
attcttaccaattgtttctt

SEQ ID NO: 444228 - DNA, 20 bp, Artificial Sequence
  chemically synthesized
aattcttaccaattgtttct

SEQ ID NO: 444229 - DNA, 20 bp, Artificial Sequence
  chemically synthesized
gtgtcatcctaagaaacaat

SEQ ID NO: 444230 - DNA, 20 bp, Artificial Sequence
  chemically synthesized
catcctaagaaacaattggt

SEQ ID NO: 444231 - DNA, 20 bp, Artificial Sequence
  chemically synthesized
aacaattggtaagaattgat

SEQ ID NO: 444232 - DNA, 20 bp, Artificial Sequence
  chemically synthesized
ttggtaagaattgataagaa

SEQ ID NO: 444233 - DNA, 20 bp, Artificial Sequence
  chemically synthesized
gtaagaattgataagaacag

SEQ ID NO: 444234 - DNA, 20 bp, Artificial Sequence
  chemically synthesized
aacagaagatccaacgattg

SEQ ID NO: 444235 - DNA, 20 bp, Artificial Sequence
  chemically synthesized
gctttaggcaccgcaatcgt

SEQ ID NO: 444236 - DNA, 20 bp, Artificial Sequence
  chemically synthesized
tccaacgattgcggtgccta

SEQ ID NO: 444237 - DNA, 20 bp, Artificial Sequence
  chemically synthesized
gattgcggtgcctaaagctc

SEQ ID NO: 444238 - DNA, 20 bp, Artificial Sequence
  chemically synthesized
taagaatagcctcgagcttt

SEQ ID NO: 444239 - DNA, 20 bp, Artificial Sequence
  chemically synthesized
attgcggtgcctaaagctcg

SEQ ID NO: 444240 - DNA, 20 bp, Artificial Sequence
  chemically synthesized
ctaagaatagcctcgagctt

SEQ ID NO: 444241 - DNA, 20 bp, Artificial Sequence
  chemically synthesized
gcacaactaagaatagcctc

SEQ ID NO: 444242 - DNA, 20 bp, Artificial Sequence
  chemically synthesized
ctaaagctcgaggctattct

SEQ ID NO: 444243 - DNA, 20 bp, Artificial Sequence
  chemically synthesized
aaaatatgcacaactaagaa

SEQ ID NO: 444244 - DNA, 20 bp, Artificial Sequence
  chemically synthesized
ctcgaaaaatatgcacaact

SEQ ID NO: 444245 - DNA, 20 bp, Artificial Sequence
  chemically synthesized
cttagttgtgcatatttttc

SEQ ID NO: 444246 - DNA, 20 bp, Artificial Sequence
  chemically synthesized
tcgagcacgtgattatatga

SEQ ID NO: 444247 - DNA, 20 bp, Artificial Sequence
  chemically synthesized
gaagtcttcaaaaatatgtg

SEQ ID NO: 444248 - DNA, 20 bp, Artificial Sequence
  chemically synthesized
aagttctgcacatatttttg

SEQ ID NO: 444249 - DNA, 20 bp, Artificial Sequence
  chemically synthesized
tgggcccctttatttcatag

SEQ ID NO: 444250 - DNA, 20 bp, Artificial Sequence
  chemically synthesized
ttgaagacttctatgaaata

SEQ ID NO: 444251 - DNA, 20 bp, Artificial Sequence
  chemically synthesized
ttttgggcccctttatttca

SEQ ID NO: 444252 - DNA, 20 bp, Artificial Sequence
  chemically synthesized
tgaagacttctatgaaataa

SEQ ID NO: 444253 - DNA, 20 bp, Artificial Sequence
  chemically synthesized
gaagacttctatgaaataaa

SEQ ID NO: 444254 - DNA, 20 bp, Artificial Sequence
  chemically synthesized
aagacttctatgaaataaag

SEQ ID NO: 444255 - DNA, 20 bp, Artificial Sequence
  chemically synthesized
tatgaaataaaggggcccaa

SEQ ID NO: 444256 - DNA, 20 bp, Artificial Sequence
  chemically synthesized
caaatgaagcttaagctttt

SEQ ID NO: 444257 - DNA, 20 bp, Artificial Sequence
  chemically synthesized
ataaaggggcccaaaagctt

SEQ ID NO: 444258 - DNA, 20 bp, Artificial Sequence
  chemically synthesized
gcaaatgaagcttaagcttt

SEQ ID NO: 444259 - DNA, 20 bp, Artificial Sequence
  chemically synthesized
tcaggaagcaaatgaagctt

SEQ ID NO: 444260 - DNA, 20 bp, Artificial Sequence
  chemically synthesized
gagttgtcaggaagcaaatg

SEQ ID NO: 444261 - DNA, 20 bp, Artificial Sequence
  chemically synthesized
agatgatttgagttgtcagg

SEQ ID NO: 444262 - DNA, 20 bp, Artificial Sequence
  chemically synthesized
tccagatgatttgagttgtc

SEQ ID NO: 444263 - DNA, 20 bp, Artificial Sequence
  chemically synthesized
ttccagatgatttgagttgt

SEQ ID NO: 444264 - DNA, 20 bp, Artificial Sequence
  chemically synthesized
ctctcctttccagatgattt

SEQ ID NO: 444265 - DNA, 20 bp, Artificial Sequence
  chemically synthesized
tcctgacaactcaaatcatc

SEQ ID NO: 444266 - DNA, 20 bp, Artificial Sequence
  chemically synthesized
gacaactcaaatcatctgga

SEQ ID NO: 444267 - DNA, 20 bp, Artificial Sequence
  chemically synthesized
acaactcaaatcatctggaa

SEQ ID NO: 444268 - DNA, 20 bp, Artificial Sequence
  chemically synthesized
aactcaaatcatctggaaag

SEQ ID NO: 444269 - DNA, 20 bp, Artificial Sequence
  chemically synthesized
ctcaaatcatctggaaagga

SEQ ID NO: 444270 - DNA, 20 bp, Artificial Sequence
  chemically synthesized
ctcaaagcttctctcctttc

SEQ ID NO: 444271 - DNA, 20 bp, Artificial Sequence
  chemically synthesized
aaatcatctggaaaggagag

SEQ ID NO: 444272 - DNA, 20 bp, Artificial Sequence
  chemically synthesized
ctggaaaggagagaagcttt

SEQ ID NO: 444273 - DNA, 20 bp, Artificial Sequence
  chemically synthesized
ggaaaggagagaagctttga

SEQ ID NO: 444274 - DNA, 20 bp, Artificial Sequence
  chemically synthesized
gaaaggagagaagctttgag

SEQ ID NO: 444275 - DNA, 20 bp, Artificial Sequence
  chemically synthesized
ctgctacataaatcctctca

SEQ ID NO: 444276 - DNA, 20 bp, Artificial Sequence
  chemically synthesized
aagctttgagaggatttatg

SEQ ID NO: 444277 - DNA, 20 bp, Artificial Sequence
  chemically synthesized
ctttgagaggatttatgtag

SEQ ID NO: 444278 - DNA, 20 bp, Artificial Sequence
  chemically synthesized
gaggatttatgtagcagatg

SEQ ID NO: 444279 - DNA, 20 bp, Artificial Sequence
  chemically synthesized
attagagaaaatagcatgtg

SEQ ID NO: 444280 - DNA, 20 bp, Artificial Sequence
  chemically synthesized
ttaaaaactattagagaaaa

SEQ ID NO: 444281 - DNA, 20 bp, Artificial Sequence
  chemically synthesized
gcacatgctattttctctaa

SEQ ID NO: 444282 - DNA, 20 bp, Artificial Sequence
  chemically synthesized
tctctctttaaaaactatta

SEQ ID NO: 444283 - DNA, 20 bp, Artificial Sequence
  chemically synthesized
tctctctctttaaaaactat

SEQ ID NO: 444284 - DNA, 20 bp, Artificial Sequence
  chemically synthesized
attttctctaatagttttta

SEQ ID NO: 444285 - DNA, 20 bp, Artificial Sequence
  chemically synthesized
tttctctaatagtttttaaa

SEQ ID NO: 444286 - DNA, 20 bp, Artificial Sequence
  chemically synthesized
tctctaatagtttttaaaga

SEQ ID NO: 444287 - DNA, 20 bp, Artificial Sequence
  chemically synthesized
tctaatagtttttaaagaga

SEQ ID NO: 444288 - DNA, 20 bp, Artificial Sequence
  chemically synthesized
taatagtttttaaagagaga

SEQ ID NO: 444289 - DNA, 20 bp, Artificial Sequence
  chemically synthesized
atagtttttaaagagagaga

SEQ ID NO: 444290 - DNA, 20 bp, Artificial Sequence
  chemically synthesized
agtttttaaagagagagaga

SEQ ID NO: 444291 - DNA, 20 bp, Artificial Sequence
  chemically synthesized
tttttaaagagagagagaga

SEQ ID NO: 444292 - DNA, 20 bp, Artificial Sequence
  chemically synthesized
tttaaagagagagagagaga

SEQ ID NO: 444293 - DNA, 20 bp, Artificial Sequence
  chemically synthesized
taaagagagagagagagaga

SEQ ID NO: 444294 - DNA, 20 bp, Artificial Sequence
  chemically synthesized
aagagagagagagagagaga

SEQ ID NO: 444295 - DNA, 20 bp, Artificial Sequence
  chemically synthesized
gagagagagagagagagaga

SEQ ID NO: 444296 - DNA, 20 bp, Artificial Sequence
  chemically synthesized
gagagagagagagagtcttt

SEQ ID NO: 444297 - DNA, 20 bp, Artificial Sequence
  chemically synthesized
agagagagagagtctttgag

SEQ ID NO: 444298 - DNA, 20 bp, Artificial Sequence
  chemically synthesized
tcaaaacaggatgccactca

SEQ ID NO: 444299 - DNA, 20 bp, Artificial Sequence
  chemically synthesized
tgtagtgaggtattcaaaac

SEQ ID NO: 444300 - DNA, 20 bp, Artificial Sequence
  chemically synthesized
ctgtagtgaggtattcaaaa

SEQ ID NO: 444301 - DNA, 20 bp, Artificial Sequence
  chemically synthesized
ctgttttgaatacctcacta

SEQ ID NO: 444302 - DNA, 20 bp, Artificial Sequence
  chemically synthesized
ttttaaggcattctgtagtg

SEQ ID NO: 444303 - DNA, 20 bp, Artificial Sequence
  chemically synthesized
tttttaaggcattctgtagt

SEQ ID NO: 444304 - DNA, 20 bp, Artificial Sequence
  chemically synthesized
tttctttttaaggcattctg

SEQ ID NO: 444305 - DNA, 20 bp, Artificial Sequence
  chemically synthesized
tcactacagaatgccttaaa

SEQ ID NO: 444306 - DNA, 20 bp, Artificial Sequence
  chemically synthesized
tttctttccatttcttttta

SEQ ID NO: 444307 - DNA, 20 bp, Artificial Sequence
  chemically synthesized
ttttctttccatttcttttt

SEQ ID NO: 444308 - DNA, 20 bp, Artificial Sequence
  chemically synthesized
cagaatgccttaaaaagaaa

SEQ ID NO: 444309 - DNA, 20 bp, Artificial Sequence
  chemically synthesized
atgccttaaaaagaaatgga

SEQ ID NO: 444310 - DNA, 20 bp, Artificial Sequence
  chemically synthesized
attttgaaccaaattataaa

SEQ ID NO: 444311 - DNA, 20 bp, Artificial Sequence
  chemically synthesized
aataaacaccatttataatt

SEQ ID NO: 444312 - DNA, 20 bp, Artificial Sequence
  chemically synthesized
aatttggttcaaaattttct

SEQ ID NO: 444313 - DNA, 20 bp, Artificial Sequence
  chemically synthesized
agtatattcattgtggggct

SEQ ID NO: 444314 - DNA, 20 bp, Artificial Sequence
  chemically synthesized
gagtaagtatattcattgtg

SEQ ID NO: 444315 - DNA, 20 bp, Artificial Sequence
  chemically synthesized
tgagtaagtatattcattgt

SEQ ID NO: 444316 - DNA, 20 bp, Artificial Sequence
  chemically synthesized
gtgagtaagtatattcattg

SEQ ID NO: 444317 - DNA, 20 bp, Artificial Sequence
  chemically synthesized
actctcaggcttcagtgagt

SEQ ID NO: 444318 - DNA, 20 bp, Artificial Sequence
  chemically synthesized
atgaatatacttactcactg

SEQ ID NO: 444319 - DNA, 20 bp, Artificial Sequence
  chemically synthesized
tctgactctcaggcttcagt

SEQ ID NO: 444320 - DNA, 20 bp, Artificial Sequence
  chemically synthesized
atacttactcactgaagcct

SEQ ID NO: 444321 - DNA, 20 bp, Artificial Sequence
  chemically synthesized
aggctctgactctcaggctt

SEQ ID NO: 444322 - DNA, 20 bp, Artificial Sequence
  chemically synthesized
acttactcactgaagcctga

SEQ ID NO: 444323 - DNA, 20 bp, Artificial Sequence
  chemically synthesized
actcactgaagcctgagagt

SEQ ID NO: 444324 - DNA, 20 bp, Artificial Sequence
  chemically synthesized
attaacaggctctgactctc

SEQ ID NO: 444325 - DNA, 20 bp, Artificial Sequence
  chemically synthesized
tcactgaagcctgagagtca

SEQ ID NO: 444326 - DNA, 20 bp, Artificial Sequence
  chemically synthesized
cattaacaggctctgactct

SEQ ID NO: 444327 - DNA, 20 bp, Artificial Sequence
  chemically synthesized
tgagagtcagagcctgttaa

SEQ ID NO: 444328 - DNA, 20 bp, Artificial Sequence
  chemically synthesized
tttctctgatttccattaac

SEQ ID NO: 444329 - DNA, 20 bp, Artificial Sequence
  chemically synthesized
ttttctctgatttccattaa

SEQ ID NO: 444330 - DNA, 20 bp, Artificial Sequence
  chemically synthesized
cagagcctgttaatggaaat

SEQ ID NO: 444331 - DNA, 20 bp, Artificial Sequence
  chemically synthesized
gagcctgttaatggaaatca

SEQ ID NO: 444332 - DNA, 20 bp, Artificial Sequence
  chemically synthesized
tatttgattcgaatttaaat

SEQ ID NO: 444333 - DNA, 20 bp, Artificial Sequence
  chemically synthesized
atttgattcgaatttaaatg

SEQ ID NO: 444334 - DNA, 20 bp, Artificial Sequence
  chemically synthesized
tttaaatgaggtttcacaaa

SEQ ID NO: 444335 - DNA, 20 bp, Artificial Sequence
  chemically synthesized
tttcacaaatggattgaatt

SEQ ID NO: 444336 - DNA, 20 bp, Artificial Sequence
  chemically synthesized
tcacaaatggattgaattta

SEQ ID NO: 444337 - DNA, 20 bp, Artificial Sequence
  chemically synthesized
cacaaatggattgaatttag

SEQ ID NO: 444338 - DNA, 20 bp, Artificial Sequence
  chemically synthesized
caaatggattgaatttagag

SEQ ID NO: 444339 - DNA, 20 bp, Artificial Sequence
  chemically synthesized
aaatggattgaatttagagg

SEQ ID NO: 444340 - DNA, 20 bp, Artificial Sequence
  chemically synthesized
aatttagaggaggataaaaa

SEQ ID NO: 444341 - DNA, 20 bp, Artificial Sequence
  chemically synthesized
ggataaaaaaagttttatat

SEQ ID NO: 444342 - DNA, 20 bp, Artificial Sequence
  chemically synthesized
ataaaactgaacagaatttt

SEQ ID NO: 444343 - DNA, 20 bp, Artificial Sequence
  chemically synthesized
ttatgtctcaaaattctgtt

SEQ ID NO: 444344 - DNA, 20 bp, Artificial Sequence
  chemically synthesized
aaacattttataaaactgaa

SEQ ID NO: 444345 - DNA, 20 bp, Artificial Sequence
  chemically synthesized
taaaatgtttaaacattgtg

SEQ ID NO: 444346 - DNA, 20 bp, Artificial Sequence
  chemically synthesized
tgtttaaacattgtgaagtc

SEQ ID NO: 444347 - DNA, 20 bp, Artificial Sequence
  chemically synthesized
aaagctatctttcaaataac

SEQ ID NO: 444348 - DNA, 20 bp, Artificial Sequence
  chemically synthesized
tgtgaagtctggttatttga

SEQ ID NO: 444349 - DNA, 20 bp, Artificial Sequence
  chemically synthesized
aagtctggttatttgaaaga

SEQ ID NO: 444350 - DNA, 20 bp, Artificial Sequence
  chemically synthesized
tttaatatactatagattaa

SEQ ID NO: 444351 - DNA, 20 bp, Artificial Sequence
  chemically synthesized
gaaagatagcttttaatcta

SEQ ID NO: 444352 - DNA, 20 bp, Artificial Sequence
  chemically synthesized
cactaatctttaatatacta

SEQ ID NO: 444353 - DNA, 20 bp, Artificial Sequence
  chemically synthesized
ttttaatctatagtatatta

SEQ ID NO: 444354 - DNA, 20 bp, Artificial Sequence
  chemically synthesized
atctatagtatattaaagat

SEQ ID NO: 444355 - DNA, 20 bp, Artificial Sequence
  chemically synthesized
atattaaagattagtgctta

SEQ ID NO: 444356 - DNA, 20 bp, Artificial Sequence
  chemically synthesized
ttaaacccagaatatacttt

SEQ ID NO: 444357 - DNA, 20 bp, Artificial Sequence
  chemically synthesized
ttagtgcttaaagtatattc

SEQ ID NO: 444358 - DNA, 20 bp, Artificial Sequence
  chemically synthesized
tagtgcttaaagtatattct

SEQ ID NO: 444359 - DNA, 20 bp, Artificial Sequence
  chemically synthesized
aaagtatattctgggtttaa

SEQ ID NO: 444360 - DNA, 20 bp, Artificial Sequence
  chemically synthesized
gtttagacatctattaaacc

SEQ ID NO: 444361 - DNA, 20 bp, Artificial Sequence
  chemically synthesized
tttaggttgtttaggttgtt

SEQ ID NO: 444362 - DNA, 20 bp, Artificial Sequence
  chemically synthesized
ataaatgctttaggttgttt

SEQ ID NO: 444363 - DNA, 20 bp, Artificial Sequence
  chemically synthesized
tataaatgctttaggttgtt

SEQ ID NO: 444364 - DNA, 20 bp, Artificial Sequence
  chemically synthesized
taaacaacctaaacaaccta

SEQ ID NO: 444365 - DNA, 20 bp, Artificial Sequence
  chemically synthesized
taaggaaatataaatgcttt

SEQ ID NO: 444366 - DNA, 20 bp, Artificial Sequence
  chemically synthesized
ttaaggaaatataaatgctt

SEQ ID NO: 444367 - DNA, 20 bp, Artificial Sequence
  chemically synthesized
caatattttaaaaatgttta

SEQ ID NO: 444368 - DNA, 20 bp, Artificial Sequence
  chemically synthesized
tcaatattttaaaaatgttt

SEQ ID NO: 444369 - DNA, 20 bp, Artificial Sequence
  chemically synthesized
ttaaaatattgaaaatctta

SEQ ID NO: 444370 - DNA, 20 bp, Artificial Sequence
  chemically synthesized
taactctaaagattcaccat

SEQ ID NO: 444371 - DNA, 20 bp, Artificial Sequence
  chemically synthesized
aaaatcttatggtgaatctt

SEQ ID NO: 444372 - DNA, 20 bp, Artificial Sequence
  chemically synthesized
aatcttatggtgaatcttta

SEQ ID NO: 444373 - DNA, 20 bp, Artificial Sequence
  chemically synthesized
tccaaataaagttaactcta

SEQ ID NO: 444374 - DNA, 20 bp, Artificial Sequence
  chemically synthesized
tctttagagttaactttatt

SEQ ID NO: 444375 - DNA, 20 bp, Artificial Sequence
  chemically synthesized
acttctcaatattccaaata

SEQ ID NO: 444376 - DNA, 20 bp, Artificial Sequence
  chemically synthesized
ttaactttatttggaatatt

SEQ ID NO: 444377 - DNA, 20 bp, Artificial Sequence
  chemically synthesized
actttatttggaatattgag

SEQ ID NO: 444378 - DNA, 20 bp, Artificial Sequence
  chemically synthesized
agtatgatgttattgaaccc

SEQ ID NO: 444379 - DNA, 20 bp, Artificial Sequence
  chemically synthesized
ttcaataacatattaaactt

SEQ ID NO: 444380 - DNA, 20 bp, Artificial Sequence
  chemically synthesized
gttcaataacatattaaact

SEQ ID NO: 444381 - DNA, 20 bp, Artificial Sequence
  chemically synthesized
tttaatatgttattgaaccc

SEQ ID NO: 444382 - DNA, 20 bp, Artificial Sequence
  chemically synthesized
atgttattgaacccaagttt

SEQ ID NO: 444383 - DNA, 20 bp, Artificial Sequence
  chemically synthesized
acacacacacacttaaactt

SEQ ID NO: 444384 - DNA, 20 bp, Artificial Sequence
  chemically synthesized
cacacacacacacttaaact

SEQ ID NO: 444385 - DNA, 20 bp, Artificial Sequence
  chemically synthesized
tgtgtgtgtgtgtgtgtgtg

SEQ ID NO: 444386 - DNA, 20 bp, Artificial Sequence
  chemically synthesized
gtgtgtgtgtgtgtgtgtgt

SEQ ID NO: 444387 - DNA, 20 bp, Artificial Sequence
  chemically synthesized
aagataatttgtgatggaaa

SEQ ID NO: 444388 - DNA, 20 bp, Artificial Sequence
  chemically synthesized
ccttggaagataatttgtga

SEQ ID NO: 444389 - DNA, 20 bp, Artificial Sequence
  chemically synthesized
tccatcacaaattatcttcc

SEQ ID NO: 444390 - DNA, 20 bp, Artificial Sequence
  chemically synthesized
ccatcacaaattatcttcca

SEQ ID NO: 444391 - DNA, 20 bp, Artificial Sequence
  chemically synthesized
gagagagacatgtaccttgg

SEQ ID NO: 444392 - DNA, 20 bp, Artificial Sequence
  chemically synthesized
ggagagagagacatgtacct

SEQ ID NO: 444393 - DNA, 20 bp, Artificial Sequence
  chemically synthesized
catttgctaacgtggagaga

SEQ ID NO: 444394 - DNA, 20 bp, Artificial Sequence
  chemically synthesized
ctcatttgctaacgtggaga

SEQ ID NO: 444395 - DNA, 20 bp, Artificial Sequence
  chemically synthesized
acatgtctctctctccacgt

SEQ ID NO: 444396 - DNA, 20 bp, Artificial Sequence
  chemically synthesized
acctcatttgctaacgtgga

SEQ ID NO: 444397 - DNA, 20 bp, Artificial Sequence
  chemically synthesized
gtacctcatttgctaacgtg

SEQ ID NO: 444398 - DNA, 20 bp, Artificial Sequence
  chemically synthesized
atgtacctcatttgctaacg

SEQ ID NO: 444399 - DNA, 20 bp, Artificial Sequence
  chemically synthesized
ctctctccacgttagcaaat

SEQ ID NO: 444400 - DNA, 20 bp, Artificial Sequence
  chemically synthesized
tctctccacgttagcaaatg

SEQ ID NO: 444401 - DNA, 20 bp, Artificial Sequence
  chemically synthesized
ttagcaaatgaggtacattt

SEQ ID NO: 444402 - DNA, 20 bp, Artificial Sequence
  chemically synthesized
tagcaaatgaggtacattta

SEQ ID NO: 444403 - DNA, 20 bp, Artificial Sequence
  chemically synthesized
agcaaatgaggtacatttaa

SEQ ID NO: 444404 - DNA, 20 bp, Artificial Sequence
  chemically synthesized
tttaagggttttcatattct

SEQ ID NO: 444405 - DNA, 20 bp, Artificial Sequence
  chemically synthesized
ttaagggttttcatattctg

SEQ ID NO: 444406 - DNA, 20 bp, Artificial Sequence
  chemically synthesized
agttcctgaaggtattacct

SEQ ID NO: 444407 - DNA, 20 bp, Artificial Sequence
  chemically synthesized
atattctgaggtaatacctt

SEQ ID NO: 444408 - DNA, 20 bp, Artificial Sequence
  chemically synthesized
tattctgaggtaataccttc

SEQ ID NO: 444409 - DNA, 20 bp, Artificial Sequence
  chemically synthesized
tctcttctccaagttcctga

SEQ ID NO: 444410 - DNA, 20 bp, Artificial Sequence
  chemically synthesized
ctctcttctccaagttcctg

SEQ ID NO: 444411 - DNA, 20 bp, Artificial Sequence
  chemically synthesized
aggtaataccttcaggaact

SEQ ID NO: 444412 - DNA, 20 bp, Artificial Sequence
  chemically synthesized
gtaataccttcaggaacttg

SEQ ID NO: 444413 - DNA, 20 bp, Artificial Sequence
  chemically synthesized
ataccttcaggaacttggag

SEQ ID NO: 444414 - DNA, 20 bp, Artificial Sequence
  chemically synthesized
accttcaggaacttggagaa

SEQ ID NO: 444415 - DNA, 20 bp, Artificial Sequence
  chemically synthesized
ctaatcttactctcttctcc

SEQ ID NO: 444416 - DNA, 20 bp, Artificial Sequence
  chemically synthesized
cttcaggaacttggagaaga

SEQ ID NO: 444417 - DNA, 20 bp, Artificial Sequence
  chemically synthesized
aggaacttggagaagagagt

SEQ ID NO: 444418 - DNA, 20 bp, Artificial Sequence
  chemically synthesized
cttggagaagagagtaagat

SEQ ID NO: 444419 - DNA, 20 bp, Artificial Sequence
  chemically synthesized
gaagagagtaagattagaaa

SEQ ID NO: 444420 - DNA, 20 bp, Artificial Sequence
  chemically synthesized
ccctttttattttaaatata

SEQ ID NO: 444421 - DNA, 20 bp, Artificial Sequence
  chemically synthesized
tcccctttttattttaaata

SEQ ID NO: 444422 - DNA, 20 bp, Artificial Sequence
  chemically synthesized
atctctatatttaaaataaa

SEQ ID NO: 444423 - DNA, 20 bp, Artificial Sequence
  chemically synthesized
tctctatatttaaaataaaa

SEQ ID NO: 444424 - DNA, 20 bp, Artificial Sequence
  chemically synthesized
ctctatatttaaaataaaaa

SEQ ID NO: 444425 - DNA, 20 bp, Artificial Sequence
  chemically synthesized
tctatatttaaaataaaaag

SEQ ID NO: 444426 - DNA, 20 bp, Artificial Sequence
  chemically synthesized
tatatttaaaataaaaaggg

SEQ ID NO: 444427 - DNA, 20 bp, Artificial Sequence
  chemically synthesized
atatttaaaataaaaagggg

SEQ ID NO: 444428 - DNA, 20 bp, Artificial Sequence
  chemically synthesized
tatttaaaataaaaagggga

SEQ ID NO: 444429 - DNA, 20 bp, Artificial Sequence
  chemically synthesized
aaataaaaaggggagggact

SEQ ID NO: 444430 - DNA, 20 bp, Artificial Sequence
  chemically synthesized
ataaaaaggggagggacttg

SEQ ID NO: 444431 - DNA, 20 bp, Artificial Sequence
  chemically synthesized
aaaaggggagggacttggag

SEQ ID NO: 444432 - DNA, 20 bp, Artificial Sequence
  chemically synthesized
aaaggggagggacttggaga

SEQ ID NO: 444433 - DNA, 20 bp, Artificial Sequence
  chemically synthesized
aaggggagggacttggagaa

SEQ ID NO: 444434 - DNA, 20 bp, Artificial Sequence
  chemically synthesized
tatcgaagtagcccttctcc

SEQ ID NO: 444435 - DNA, 20 bp, Artificial Sequence
  chemically synthesized
atactgaggttttatcgaag

SEQ ID NO: 444436 - DNA, 20 bp, Artificial Sequence
  chemically synthesized
ttcatactgaggttttatcg

SEQ ID NO: 444437 - DNA, 20 bp, Artificial Sequence
  chemically synthesized
gggctacttcgataaaacct

SEQ ID NO: 444438 - DNA, 20 bp, Artificial Sequence
  chemically synthesized
atttccccgttttcatactg

SEQ ID NO: 444439 - DNA, 20 bp, Artificial Sequence
  chemically synthesized
gatttccccgttttcatact

SEQ ID NO: 444440 - DNA, 20 bp, Artificial Sequence
  chemically synthesized
ataaaacctcagtatgaaaa

SEQ ID NO: 444441 - DNA, 20 bp, Artificial Sequence
  chemically synthesized
taaaacctcagtatgaaaac

SEQ ID NO: 444442 - DNA, 20 bp, Artificial Sequence
  chemically synthesized
aaaacctcagtatgaaaacg

SEQ ID NO: 444443 - DNA, 20 bp, Artificial Sequence
  chemically synthesized
gtatgaaaacggggaaatct

SEQ ID NO: 444444 - DNA, 20 bp, Artificial Sequence
  chemically synthesized
atgaaaacggggaaatctga

SEQ ID NO: 444445 - DNA, 20 bp, Artificial Sequence
  chemically synthesized
ctaggagccaattgtactct

SEQ ID NO: 444446 - DNA, 20 bp, Artificial Sequence
  chemically synthesized
gggaaatctgagagtacaat

SEQ ID NO: 444447 - DNA, 20 bp, Artificial Sequence
  chemically synthesized
ctgagagtacaattggctcc

SEQ ID NO: 444448 - DNA, 20 bp, Artificial Sequence
  chemically synthesized
agagtacaattggctcctag

SEQ ID NO: 444449 - DNA, 20 bp, Artificial Sequence
  chemically synthesized
gagtacaattggctcctaga

SEQ ID NO: 444450 - DNA, 20 bp, Artificial Sequence
  chemically synthesized
tttgctaaccaaccttctag

SEQ ID NO: 444451 - DNA, 20 bp, Artificial Sequence
  chemically synthesized
acaattggctcctagaaggt

SEQ ID NO: 444452 - DNA, 20 bp, Artificial Sequence
  chemically synthesized
tttttgctaaccaaccttct

SEQ ID NO: 444453 - DNA, 20 bp, Artificial Sequence
  chemically synthesized
atttttgctaaccaaccttc

SEQ ID NO: 444454 - DNA, 20 bp, Artificial Sequence
  chemically synthesized
ttggctcctagaaggttggt

SEQ ID NO: 444455 - DNA, 20 bp, Artificial Sequence
  chemically synthesized
aaatataatacatttttaaa

SEQ ID NO: 444456 - DNA, 20 bp, Artificial Sequence
  chemically synthesized
tataatacatttttaaatag

SEQ ID NO: 444457 - DNA, 20 bp, Artificial Sequence
  chemically synthesized
ttttaaatagaagcaatgat

SEQ ID NO: 444458 - DNA, 20 bp, Artificial Sequence
  chemically synthesized
ttaaatagaagcaatgataa

SEQ ID NO: 444459 - DNA, 20 bp, Artificial Sequence
  chemically synthesized
aatagaagcaatgataagag

SEQ ID NO: 444460 - DNA, 20 bp, Artificial Sequence
  chemically synthesized
agaagcaatgataagagcag

SEQ ID NO: 444461 - DNA, 20 bp, Artificial Sequence
  chemically synthesized
agagcagcagttaaatacat

SEQ ID NO: 444462 - DNA, 20 bp, Artificial Sequence
  chemically synthesized
agcagttaaatacattagaa

SEQ ID NO: 444463 - DNA, 20 bp, Artificial Sequence
  chemically synthesized
taaatacattagaaaagata

SEQ ID NO: 444464 - DNA, 20 bp, Artificial Sequence
  chemically synthesized
ttagaaaagataaagtatat

SEQ ID NO: 444465 - DNA, 20 bp, Artificial Sequence
  chemically synthesized
tagaaaagataaagtatatt

SEQ ID NO: 444466 - DNA, 20 bp, Artificial Sequence
  chemically synthesized
gataaagtatattaggctat

SEQ ID NO: 444467 - DNA, 20 bp, Artificial Sequence
  chemically synthesized
ataaagtatattaggctatc

SEQ ID NO: 444468 - DNA, 20 bp, Artificial Sequence
  chemically synthesized
aggtggaagtgagagcctga

SEQ ID NO: 444469 - DNA, 20 bp, Artificial Sequence
  chemically synthesized
gggaatataggtggaagtga

SEQ ID NO: 444470 - DNA, 20 bp, Artificial Sequence
  chemically synthesized
tggggaatataggtggaagt

SEQ ID NO: 444471 - DNA, 20 bp, Artificial Sequence
  chemically synthesized
taaatggggaatataggtgg

SEQ ID NO: 444472 - DNA, 20 bp, Artificial Sequence
  chemically synthesized
ttttaaatggggaatatagg

SEQ ID NO: 444473 - DNA, 20 bp, Artificial Sequence
  chemically synthesized
tttttttaaatggggaatat

SEQ ID NO: 444474 - DNA, 20 bp, Artificial Sequence
  chemically synthesized
atttttttaaatggggaata

SEQ ID NO: 444475 - DNA, 20 bp, Artificial Sequence
  chemically synthesized
aagaaaaatttttttaaatg

SEQ ID NO: 444476 - DNA, 20 bp, Artificial Sequence
  chemically synthesized
gaagaaaaatttttttaaat

SEQ ID NO: 444477 - DNA, 20 bp, Artificial Sequence
  chemically synthesized
tgaagaaaaatttttttaaa

SEQ ID NO: 444478 - DNA, 20 bp, Artificial Sequence
  chemically synthesized
catttaaaaaaatttttctt

SEQ ID NO: 444479 - DNA, 20 bp, Artificial Sequence
  chemically synthesized
ctcaaaaaaaaaaaaagctg

SEQ ID NO: 444480 - DNA, 20 bp, Artificial Sequence
  chemically synthesized
ccctgtctcaaaaaaaaaaa

SEQ ID NO: 444481 - DNA, 20 bp, Artificial Sequence
  chemically synthesized
cttcagcttttttttttttt

SEQ ID NO: 444482 - DNA, 20 bp, Artificial Sequence
  chemically synthesized
agctttttttttttttgaga

SEQ ID NO: 444483 - DNA, 20 bp, Artificial Sequence
  chemically synthesized
gctttttttttttttgagac

SEQ ID NO: 444484 - DNA, 20 bp, Artificial Sequence
  chemically synthesized
ctttttttttttttgagaca

SEQ ID NO: 444485 - DNA, 20 bp, Artificial Sequence
  chemically synthesized
tccagcctgggcaacagagt

SEQ ID NO: 444486 - DNA, 20 bp, Artificial Sequence
  chemically synthesized
cagggtctcactctgttgcc

SEQ ID NO: 444487 - DNA, 20 bp, Artificial Sequence
  chemically synthesized
ccactccagcctgggcaaca

SEQ ID NO: 444488 - DNA, 20 bp, Artificial Sequence
  chemically synthesized
agggtctcactctgttgccc

SEQ ID NO: 444489 - DNA, 20 bp, Artificial Sequence
  chemically synthesized
taccactccagcctgggcaa

SEQ ID NO: 444490 - DNA, 20 bp, Artificial Sequence
  chemically synthesized
tctcactctgttgcccaggc

SEQ ID NO: 444491 - DNA, 20 bp, Artificial Sequence
  chemically synthesized
tcactctgttgcccaggctg

SEQ ID NO: 444492 - DNA, 20 bp, Artificial Sequence
  chemically synthesized
tatgtttaccactccagcct

SEQ ID NO: 444493 - DNA, 20 bp, Artificial Sequence
  chemically synthesized
gtatgtttaccactccagcc

SEQ ID NO: 444494 - DNA, 20 bp, Artificial Sequence
  chemically synthesized
ctctgttgcccaggctggag

SEQ ID NO: 444495 - DNA, 20 bp, Artificial Sequence
  chemically synthesized
actgtgtatgtttaccactc

SEQ ID NO: 444496 - DNA, 20 bp, Artificial Sequence
  chemically synthesized
gctggagtggtaaacataca

SEQ ID NO: 444497 - DNA, 20 bp, Artificial Sequence
  chemically synthesized
cagtctggaaaatagtttgg

SEQ ID NO: 444498 - DNA, 20 bp, Artificial Sequence
  chemically synthesized
tatcagtctggaaaatagtt

SEQ ID NO: 444499 - DNA, 20 bp, Artificial Sequence
  chemically synthesized
caaactgccaaactattttc

SEQ ID NO: 444500 - DNA, 20 bp, Artificial Sequence
  chemically synthesized
aagaatatcagtctggaaaa

SEQ ID NO: 444501 - DNA, 20 bp, Artificial Sequence
  chemically synthesized
tactgaaaagaatatcagtc

SEQ ID NO: 444502 - DNA, 20 bp, Artificial Sequence
  chemically synthesized
tacattactgaaaagaatat

SEQ ID NO: 444503 - DNA, 20 bp, Artificial Sequence
  chemically synthesized
ttccagactgatattctttt

SEQ ID NO: 444504 - DNA, 20 bp, Artificial Sequence
  chemically synthesized
atcactcgtacattactgaa

SEQ ID NO: 444505 - DNA, 20 bp, Artificial Sequence
  chemically synthesized
tattcttttcagtaatgtac

SEQ ID NO: 444506 - DNA, 20 bp, Artificial Sequence
  chemically synthesized
tagcaaaaatgtggagaaat

SEQ ID NO: 444507 - DNA, 20 bp, Artificial Sequence
  chemically synthesized
ctagcaaaaatgtggagaaa

SEQ ID NO: 444508 - DNA, 20 bp, Artificial Sequence
  chemically synthesized
aaataactagcaaaaatgtg

SEQ ID NO: 444509 - DNA, 20 bp, Artificial Sequence
  chemically synthesized
ccaaataactagcaaaaatg

SEQ ID NO: 444510 - DNA, 20 bp, Artificial Sequence
  chemically synthesized
ccatttctccacatttttgc

SEQ ID NO: 444511 - DNA, 20 bp, Artificial Sequence
  chemically synthesized
ccacatttttgctagttatt

SEQ ID NO: 444512 - DNA, 20 bp, Artificial Sequence
  chemically synthesized
tgacactaccaccaaataac

SEQ ID NO: 444513 - DNA, 20 bp, Artificial Sequence
  chemically synthesized
catttttgctagttatttgg

SEQ ID NO: 444514 - DNA, 20 bp, Artificial Sequence
  chemically synthesized
ttttgctagttatttggtgg

SEQ ID NO: 444515 - DNA, 20 bp, Artificial Sequence
  chemically synthesized
agagtgtctgaaataaaaaa

SEQ ID NO: 444516 - DNA, 20 bp, Artificial Sequence
  chemically synthesized
agtgtcactattttttattt

SEQ ID NO: 444517 - DNA, 20 bp, Artificial Sequence
  chemically synthesized
ataaaactacacatttttca

SEQ ID NO: 444518 - DNA, 20 bp, Artificial Sequence
  chemically synthesized
agataaaactacacattttt

SEQ ID NO: 444519 - DNA, 20 bp, Artificial Sequence
  chemically synthesized
cagacactctgaaaaatgtg

SEQ ID NO: 444520 - DNA, 20 bp, Artificial Sequence
  chemically synthesized
tgtgtagttttatctcactg

SEQ ID NO: 444521 - DNA, 20 bp, Artificial Sequence
  chemically synthesized
atataaattgaaaccacagt

SEQ ID NO: 444522 - DNA, 20 bp, Artificial Sequence
  chemically synthesized
gcaaatataaattgaaacca

SEQ ID NO: 444523 - DNA, 20 bp, Artificial Sequence
  chemically synthesized
atttatatttgcttgatgtc

SEQ ID NO: 444524 - DNA, 20 bp, Artificial Sequence
  chemically synthesized
attaaatatcactagacatc

SEQ ID NO: 444525 - DNA, 20 bp, Artificial Sequence
  chemically synthesized
gaaaagatattaaatatcac

SEQ ID NO: 444526 - DNA, 20 bp, Artificial Sequence
  chemically synthesized
taaatgacaaacatatggaa

SEQ ID NO: 444527 - DNA, 20 bp, Artificial Sequence
  chemically synthesized
atatataaatgacaaacata

SEQ ID NO: 444528 - DNA, 20 bp, Artificial Sequence
  chemically synthesized
tgtcatttatatatactatt

SEQ ID NO: 444529 - DNA, 20 bp, Artificial Sequence
  chemically synthesized
cgaagagacattttactgaa

SEQ ID NO: 444530 - DNA, 20 bp, Artificial Sequence
  chemically synthesized
aaatgagccaaaggcacgaa

SEQ ID NO: 444531 - DNA, 20 bp, Artificial Sequence
  chemically synthesized
ggaaatgagccaaaggcacg

SEQ ID NO: 444532 - DNA, 20 bp, Artificial Sequence
  chemically synthesized
aaaatgtctcttcgtgcctt

SEQ ID NO: 444533 - DNA, 20 bp, Artificial Sequence
  chemically synthesized
ttaattaggaaatgagccaa

SEQ ID NO: 444534 - DNA, 20 bp, Artificial Sequence
  chemically synthesized
attaattaggaaatgagcca

SEQ ID NO: 444535 - DNA, 20 bp, Artificial Sequence
  chemically synthesized
aaataaattaattaggaaat

SEQ ID NO: 444536 - DNA, 20 bp, Artificial Sequence
  chemically synthesized
aatccaaaaataaattaatt

SEQ ID NO: 444537 - DNA, 20 bp, Artificial Sequence
  chemically synthesized
aaatccaaaaataaattaat

SEQ ID NO: 444538 - DNA, 20 bp, Artificial Sequence
  chemically synthesized
tttcctaattaatttatttt

SEQ ID NO: 444539 - DNA, 20 bp, Artificial Sequence
  chemically synthesized
atttttggatttttgctttt

SEQ ID NO: 444540 - DNA, 20 bp, Artificial Sequence
  chemically synthesized
gaagaacttagaaaactcaa

SEQ ID NO: 444541 - DNA, 20 bp, Artificial Sequence
  chemically synthesized
tttttgcttttgagttttct

SEQ ID NO: 444542 - DNA, 20 bp, Artificial Sequence
  chemically synthesized
gggactatatacgaagaact

SEQ ID NO: 444543 - DNA, 20 bp, Artificial Sequence
  chemically synthesized
ttttctaagttcttcgtata

SEQ ID NO: 444544 - DNA, 20 bp, Artificial Sequence
  chemically synthesized
aaaaacagggactatatacg

SEQ ID NO: 444545 - DNA, 20 bp, Artificial Sequence
  chemically synthesized
gcatatcagttgcaaaaaca

SEQ ID NO: 444546 - DNA, 20 bp, Artificial Sequence
  chemically synthesized
tgcatatcagttgcaaaaac

SEQ ID NO: 444547 - DNA, 20 bp, Artificial Sequence
  chemically synthesized
ttgcatatcagttgcaaaaa

SEQ ID NO: 444548 - DNA, 20 bp, Artificial Sequence
  chemically synthesized
gggagaaaatatttgcatat

SEQ ID NO: 444549 - DNA, 20 bp, Artificial Sequence
  chemically synthesized
aaatacaaggtacagaatgg

SEQ ID NO: 444550 - DNA, 20 bp, Artificial Sequence
  chemically synthesized
tgaaatacaaggtacagaat

SEQ ID NO: 444551 - DNA, 20 bp, Artificial Sequence
  chemically synthesized
gtgaaatacaaggtacagaa

SEQ ID NO: 444552 - DNA, 20 bp, Artificial Sequence
  chemically synthesized
aagaagtgaaatacaaggta

SEQ ID NO: 444553 - DNA, 20 bp, Artificial Sequence
  chemically synthesized
ctcttaagaagtgaaataca

SEQ ID NO: 444554 - DNA, 20 bp, Artificial Sequence
  chemically synthesized
cctcttaagaagtgaaatac

SEQ ID NO: 444555 - DNA, 20 bp, Artificial Sequence
  chemically synthesized
taccttgtatttcacttctt

SEQ ID NO: 444556 - DNA, 20 bp, Artificial Sequence
  chemically synthesized
ccttgtatttcacttcttaa

SEQ ID NO: 444557 - DNA, 20 bp, Artificial Sequence
  chemically synthesized
cttgtatttcacttcttaag

SEQ ID NO: 444558 - DNA, 20 bp, Artificial Sequence
  chemically synthesized
ctgaaaaggatcctcttaag

SEQ ID NO: 444559 - DNA, 20 bp, Artificial Sequence
  chemically synthesized
gatctgaaaaggatcctctt

SEQ ID NO: 444560 - DNA, 20 bp, Artificial Sequence
  chemically synthesized
cttcttaagaggatcctttt

SEQ ID NO: 444561 - DNA, 20 bp, Artificial Sequence
  chemically synthesized
ttaaaacttttgatctgaaa

SEQ ID NO: 444562 - DNA, 20 bp, Artificial Sequence
  chemically synthesized
attaaaacttttgatctgaa

SEQ ID NO: 444563 - DNA, 20 bp, Artificial Sequence
  chemically synthesized
gaggatccttttcagatcaa

SEQ ID NO: 444564 - DNA, 20 bp, Artificial Sequence
  chemically synthesized
caaaagttttaattttaacg

SEQ ID NO: 444565 - DNA, 20 bp, Artificial Sequence
  chemically synthesized
tttaacgaagtccaatttat

SEQ ID NO: 444566 - DNA, 20 bp, Artificial Sequence
  chemically synthesized
aaaaagaaaaactgataaat

SEQ ID NO: 444567 - DNA, 20 bp, Artificial Sequence
  chemically synthesized
ttatcagtttttctttttta

SEQ ID NO: 444568 - DNA, 20 bp, Artificial Sequence
  chemically synthesized
aaatagcacaatccataaaa

SEQ ID NO: 444569 - DNA, 20 bp, Artificial Sequence
  chemically synthesized
ctttttacactttacacaaa

SEQ ID NO: 444570 - DNA, 20 bp, Artificial Sequence
  chemically synthesized
tggattgtgctatttgtgta

SEQ ID NO: 444571 - DNA, 20 bp, Artificial Sequence
  chemically synthesized
ctatttgtgtaaagtgtaaa

SEQ ID NO: 444572 - DNA, 20 bp, Artificial Sequence
  chemically synthesized
agtgtaaaaagtctttgcct

SEQ ID NO: 444573 - DNA, 20 bp, Artificial Sequence
  chemically synthesized
aaaattttgtgactgaggca

SEQ ID NO: 444574 - DNA, 20 bp, Artificial Sequence
  chemically synthesized
gggagaaaattttgtgactg

SEQ ID NO: 444575 - DNA, 20 bp, Artificial Sequence
  chemically synthesized
tgggagaaaattttgtgact

SEQ ID NO: 444576 - DNA, 20 bp, Artificial Sequence
  chemically synthesized
tattttagaaaaacatatgg

SEQ ID NO: 444577 - DNA, 20 bp, Artificial Sequence
  chemically synthesized
aatattttagaaaaacatat

SEQ ID NO: 444578 - DNA, 20 bp, Artificial Sequence
  chemically synthesized
aaatattttagaaaaacata

SEQ ID NO: 444579 - DNA, 20 bp, Artificial Sequence
  chemically synthesized
acataaaactacaaatattt

SEQ ID NO: 444580 - DNA, 20 bp, Artificial Sequence
  chemically synthesized
atgtttttctaaaatatttg

SEQ ID NO: 444581 - DNA, 20 bp, Artificial Sequence
  chemically synthesized
atgttttatatttgacattt

SEQ ID NO: 444582 - DNA, 20 bp, Artificial Sequence
  chemically synthesized
catttgagataattttgcat

SEQ ID NO: 444583 - DNA, 20 bp, Artificial Sequence
  chemically synthesized
gataattttgcataagactt

SEQ ID NO: 444584 - DNA, 20 bp, Artificial Sequence
  chemically synthesized
ttttgcataagacttaagtt

SEQ ID NO: 444585 - DNA, 20 bp, Artificial Sequence
  chemically synthesized
tttgcataagacttaagttg

SEQ ID NO: 444586 - DNA, 20 bp, Artificial Sequence
  chemically synthesized
aataaatagagcctcaactt

SEQ ID NO: 444587 - DNA, 20 bp, Artificial Sequence
  chemically synthesized
aatatataagtaaataaata

SEQ ID NO: 444588 - DNA, 20 bp, Artificial Sequence
  chemically synthesized
taaatatataagtaaataaa

SEQ ID NO: 444589 - DNA, 20 bp, Artificial Sequence
  chemically synthesized
aagcccacccataaatatat

SEQ ID NO: 444590 - DNA, 20 bp, Artificial Sequence
  chemically synthesized
tttatttacttatatattta

SEQ ID NO: 444591 - DNA, 20 bp, Artificial Sequence
  chemically synthesized
ttatttacttatatatttat

SEQ ID NO: 444592 - DNA, 20 bp, Artificial Sequence
  chemically synthesized
tttacttatatatttatggg

SEQ ID NO: 444593 - DNA, 20 bp, Artificial Sequence
  chemically synthesized
ttacttatatatttatgggt

SEQ ID NO: 444594 - DNA, 20 bp, Artificial Sequence
  chemically synthesized
atctaaaggcaaaacaaaca

SEQ ID NO: 444595 - DNA, 20 bp, Artificial Sequence
  chemically synthesized
ggctttgtttgttttgcctt

SEQ ID NO: 444596 - DNA, 20 bp, Artificial Sequence
  chemically synthesized
ttgagcaagtagacatctaa

SEQ ID NO: 444597 - DNA, 20 bp, Artificial Sequence
  chemically synthesized
tttgagcaagtagacatcta

SEQ ID NO: 444598 - DNA, 20 bp, Artificial Sequence
  chemically synthesized
gtgagtggtgtttgagcaag

SEQ ID NO: 444599 - DNA, 20 bp, Artificial Sequence
  chemically synthesized
taagtgagtggtgtttgagc

SEQ ID NO: 444600 - DNA, 20 bp, Artificial Sequence
  chemically synthesized
tttctaagtgagtggtgttt

SEQ ID NO: 444601 - DNA, 20 bp, Artificial Sequence
  chemically synthesized
ttgctcaaacaccactcact

SEQ ID NO: 444602 - DNA, 20 bp, Artificial Sequence
  chemically synthesized
gtgcgttttttctaagtgag

SEQ ID NO: 444603 - DNA, 20 bp, Artificial Sequence
  chemically synthesized
agtgtgcgttttttctaagt

SEQ ID NO: 444604 - DNA, 20 bp, Artificial Sequence
  chemically synthesized
aaatagtgtgcgttttttct

SEQ ID NO: 444605 - DNA, 20 bp, Artificial Sequence
  chemically synthesized
tctatagccttttcaacaaa

SEQ ID NO: 444606 - DNA, 20 bp, Artificial Sequence
  chemically synthesized
aacgcacactatttgttgaa

SEQ ID NO: 444607 - DNA, 20 bp, Artificial Sequence
  chemically synthesized
acgcacactatttgttgaaa

SEQ ID NO: 444608 - DNA, 20 bp, Artificial Sequence
  chemically synthesized
actatttgttgaaaaggcta

SEQ ID NO: 444609 - DNA, 20 bp, Artificial Sequence
  chemically synthesized
tgttgaaaaggctatagaaa

SEQ ID NO: 444610 - DNA, 20 bp, Artificial Sequence
  chemically synthesized
taacagcctttccatttcta

SEQ ID NO: 444611 - DNA, 20 bp, Artificial Sequence
  chemically synthesized
gaaaaggctatagaaatgga

SEQ ID NO: 444612 - DNA, 20 bp, Artificial Sequence
  chemically synthesized
aaaaggctatagaaatggaa

SEQ ID NO: 444613 - DNA, 20 bp, Artificial Sequence
  chemically synthesized
attccaaggaggaattttaa

SEQ ID NO: 444614 - DNA, 20 bp, Artificial Sequence
  chemically synthesized
aggctgttaaaattcctcct

SEQ ID NO: 444615 - DNA, 20 bp, Artificial Sequence
  chemically synthesized
ttgtgaaagcaattccaagg

SEQ ID NO: 444616 - DNA, 20 bp, Artificial Sequence
  chemically synthesized
gttgtgaaagcaattccaag

SEQ ID NO: 444617 - DNA, 20 bp, Artificial Sequence
  chemically synthesized
aagttgtgaaagcaattcca

SEQ ID NO: 444618 - DNA, 20 bp, Artificial Sequence
  chemically synthesized
aaagttgtgaaagcaattcc

SEQ ID NO: 444619 - DNA, 20 bp, Artificial Sequence
  chemically synthesized
cattttttaaaaagttgtga

SEQ ID NO: 444620 - DNA, 20 bp, Artificial Sequence
  chemically synthesized
gtgcaaactcattttttaaa

SEQ ID NO: 444621 - DNA, 20 bp, Artificial Sequence
  chemically synthesized
ttcacaactttttaaaaaat

SEQ ID NO: 444622 - DNA, 20 bp, Artificial Sequence
  chemically synthesized
tgagtttgcacatatttgtg

SEQ ID NO: 444623 - DNA, 20 bp, Artificial Sequence
  chemically synthesized
gagtttgcacatatttgtgc

SEQ ID NO: 444624 - DNA, 20 bp, Artificial Sequence
  chemically synthesized
tatttgtgcgggtctatttc

SEQ ID NO: 444625 - DNA, 20 bp, Artificial Sequence
  chemically synthesized
tagaatagagattccagaaa

SEQ ID NO: 444626 - DNA, 20 bp, Artificial Sequence
  chemically synthesized
atgcaatagaatagagattc

SEQ ID NO: 444627 - DNA, 20 bp, Artificial Sequence
  chemically synthesized
tagttcaatgcaatagaata

SEQ ID NO: 444628 - DNA, 20 bp, Artificial Sequence
  chemically synthesized
catagttcaatgcaatagaa

SEQ ID NO: 444629 - DNA, 20 bp, Artificial Sequence
  chemically synthesized
agacgcatagttcaatgcaa

SEQ ID NO: 444630 - DNA, 20 bp, Artificial Sequence
  chemically synthesized
ttgggggagagatagacgca

SEQ ID NO: 444631 - DNA, 20 bp, Artificial Sequence
  chemically synthesized
gtgtggaattgggggagaga

SEQ ID NO: 444632 - DNA, 20 bp, Artificial Sequence
  chemically synthesized
gacagtgtggaattggggga

SEQ ID NO: 444633 - DNA, 20 bp, Artificial Sequence
  chemically synthesized
aagacagtgtggaattgggg

SEQ ID NO: 444634 - DNA, 20 bp, Artificial Sequence
  chemically synthesized
tcaagacagtgtggaattgg

SEQ ID NO: 444635 - DNA, 20 bp, Artificial Sequence
  chemically synthesized
atcaagacagtgtggaattg

SEQ ID NO: 444636 - DNA, 20 bp, Artificial Sequence
  chemically synthesized
aatcaagacagtgtggaatt

SEQ ID NO: 444637 - DNA, 20 bp, Artificial Sequence
  chemically synthesized
taatcaagacagtgtggaat

SEQ ID NO: 444638 - DNA, 20 bp, Artificial Sequence
  chemically synthesized
ctacagtaatcaagacagtg

SEQ ID NO: 444639 - DNA, 20 bp, Artificial Sequence
  chemically synthesized
tgtagctacagtaatcaaga

SEQ ID NO: 444640 - DNA, 20 bp, Artificial Sequence
  chemically synthesized
attatgtagctacagtaatc

SEQ ID NO: 444641 - DNA, 20 bp, Artificial Sequence
  chemically synthesized
ccacactgtcttgattactg

SEQ ID NO: 444642 - DNA, 20 bp, Artificial Sequence
  chemically synthesized
taaggcttattatgtagcta

SEQ ID NO: 444643 - DNA, 20 bp, Artificial Sequence
  chemically synthesized
gattactgtagctacataat

SEQ ID NO: 444644 - DNA, 20 bp, Artificial Sequence
  chemically synthesized
aaatattaaggcttattatg

SEQ ID NO: 444645 - DNA, 20 bp, Artificial Sequence
  chemically synthesized
acataataagccttaatatt

SEQ ID NO: 444646 - DNA, 20 bp, Artificial Sequence
  chemically synthesized
aatcactccactaaatatta

SEQ ID NO: 444647 - DNA, 20 bp, Artificial Sequence
  chemically synthesized
gaatcactccactaaatatt

SEQ ID NO: 444648 - DNA, 20 bp, Artificial Sequence
  chemically synthesized
taataagccttaatatttag

SEQ ID NO: 444649 - DNA, 20 bp, Artificial Sequence
  chemically synthesized
ataagccttaatatttagtg

SEQ ID NO: 444650 - DNA, 20 bp, Artificial Sequence
  chemically synthesized
acaaagaagaataaagtgga

SEQ ID NO: 444651 - DNA, 20 bp, Artificial Sequence
  chemically synthesized
cttgacaaagaagaataaag

SEQ ID NO: 444652 - DNA, 20 bp, Artificial Sequence
  chemically synthesized
aatcttgacaaagaagaata

SEQ ID NO: 444653 - DNA, 20 bp, Artificial Sequence
  chemically synthesized
ccactttattcttctttgtc

SEQ ID NO: 444654 - DNA, 20 bp, Artificial Sequence
  chemically synthesized
ctaatacaatcttgacaaag

SEQ ID NO: 444655 - DNA, 20 bp, Artificial Sequence
  chemically synthesized
tagctaatacaatcttgaca

SEQ ID NO: 444656 - DNA, 20 bp, Artificial Sequence
  chemically synthesized
cttctttgtcaagattgtat

SEQ ID NO: 444657 - DNA, 20 bp, Artificial Sequence
  chemically synthesized
aagattgtattagctattat

SEQ ID NO: 444658 - DNA, 20 bp, Artificial Sequence
  chemically synthesized
agattgtattagctattatc

SEQ ID NO: 444659 - DNA, 20 bp, Artificial Sequence
  chemically synthesized
gaaaagtacaagcctgataa

SEQ ID NO: 444660 - DNA, 20 bp, Artificial Sequence
  chemically synthesized
aaatttatacggaaaagtac

SEQ ID NO: 444661 - DNA, 20 bp, Artificial Sequence
  chemically synthesized
tattctaaatttatacggaa

SEQ ID NO: 444662 - DNA, 20 bp, Artificial Sequence
  chemically synthesized
cagcttattctaaatttata

SEQ ID NO: 444663 - DNA, 20 bp, Artificial Sequence
  chemically synthesized
tgtacttttccgtataaatt

SEQ ID NO: 444664 - DNA, 20 bp, Artificial Sequence
  chemically synthesized
tttccgtataaatttagaat

SEQ ID NO: 444665 - DNA, 20 bp, Artificial Sequence
  chemically synthesized
aatttagaataagctgatcc

SEQ ID NO: 444666 - DNA, 20 bp, Artificial Sequence
  chemically synthesized
tctttttagtagacttggat

SEQ ID NO: 444667 - DNA, 20 bp, Artificial Sequence
  chemically synthesized
caaggtctttttagtagact

SEQ ID NO: 444668 - DNA, 20 bp, Artificial Sequence
  chemically synthesized
gctgatccaagtctactaaa

SEQ ID NO: 444669 - DNA, 20 bp, Artificial Sequence
  chemically synthesized
taccagcaaggtctttttag

SEQ ID NO: 444670 - DNA, 20 bp, Artificial Sequence
  chemically synthesized
aaataccagcaaggtctttt

SEQ ID NO: 444671 - DNA, 20 bp, Artificial Sequence
  chemically synthesized
gtctactaaaaagaccttgc

SEQ ID NO: 444672 - DNA, 20 bp, Artificial Sequence
  chemically synthesized
tttctactaaaataccagca

SEQ ID NO: 444673 - DNA, 20 bp, Artificial Sequence
  chemically synthesized
atttctactaaaataccagc

SEQ ID NO: 444674 - DNA, 20 bp, Artificial Sequence
  chemically synthesized
aaaagaccttgctggtattt

SEQ ID NO: 444675 - DNA, 20 bp, Artificial Sequence
  chemically synthesized
tgccatttctactaaaatac

SEQ ID NO: 444676 - DNA, 20 bp, Artificial Sequence
  chemically synthesized
agaccttgctggtattttag

SEQ ID NO: 444677 - DNA, 20 bp, Artificial Sequence
  chemically synthesized
tgctggtattttagtagaaa

SEQ ID NO: 444678 - DNA, 20 bp, Artificial Sequence
  chemically synthesized
tagaaatggcattaaaacta

SEQ ID NO: 444679 - DNA, 20 bp, Artificial Sequence
  chemically synthesized
attatctccaaattaatcta

SEQ ID NO: 444680 - DNA, 20 bp, Artificial Sequence
  chemically synthesized
attaaaactatagattaatt

SEQ ID NO: 444681 - DNA, 20 bp, Artificial Sequence
  chemically synthesized
taaaactatagattaatttg

SEQ ID NO: 444682 - DNA, 20 bp, Artificial Sequence
  chemically synthesized
ttggaatactcaacatggta

SEQ ID NO: 444683 - DNA, 20 bp, Artificial Sequence
  chemically synthesized
attgacatctttaccatgtt

SEQ ID NO: 444684 - DNA, 20 bp, Artificial Sequence
  chemically synthesized
atggattggaatactcaaca

SEQ ID NO: 444685 - DNA, 20 bp, Artificial Sequence
  chemically synthesized
tgttgagtattccaatccat

SEQ ID NO: 444686 - DNA, 20 bp, Artificial Sequence
  chemically synthesized
gatatactctgctaatggat

SEQ ID NO: 444687 - DNA, 20 bp, Artificial Sequence
  chemically synthesized
tgagtattccaatccattag

SEQ ID NO: 444688 - DNA, 20 bp, Artificial Sequence
  chemically synthesized
agtattccaatccattagca

SEQ ID NO: 444689 - DNA, 20 bp, Artificial Sequence
  chemically synthesized
ggagagatatactctgctaa

SEQ ID NO: 444690 - DNA, 20 bp, Artificial Sequence
  chemically synthesized
aaaattaacttataaatgga

SEQ ID NO: 444691 - DNA, 20 bp, Artificial Sequence
  chemically synthesized
gagtatatctctccatttat

SEQ ID NO: 444692 - DNA, 20 bp, Artificial Sequence
  chemically synthesized
aaaaaattaacttataaatg

SEQ ID NO: 444693 - DNA, 20 bp, Artificial Sequence
  chemically synthesized
ataaaaaattaacttataaa

SEQ ID NO: 444694 - DNA, 20 bp, Artificial Sequence
  chemically synthesized
caaaacactgttgaaaaaca

SEQ ID NO: 444695 - DNA, 20 bp, Artificial Sequence
  chemically synthesized
tatcatgctgtgtttttcaa

SEQ ID NO: 444696 - DNA, 20 bp, Artificial Sequence
  chemically synthesized
tttcaacagtgttttgcatt

SEQ ID NO: 444697 - DNA, 20 bp, Artificial Sequence
  chemically synthesized
acagtgttttgcattgagat

SEQ ID NO: 444698 - DNA, 20 bp, Artificial Sequence
  chemically synthesized
atattagaaatatgaaaaca

SEQ ID NO: 444699 - DNA, 20 bp, Artificial Sequence
  chemically synthesized
atagcacattgtaagtatat

SEQ ID NO: 444700 - DNA, 20 bp, Artificial Sequence
  chemically synthesized
agcagacaatagcacattgt

SEQ ID NO: 444701 - DNA, 20 bp, Artificial Sequence
  chemically synthesized
atcacatgcatagcagacaa

SEQ ID NO: 444702 - DNA, 20 bp, Artificial Sequence
  chemically synthesized
ttgtgtaatcacatgcatag

SEQ ID NO: 444703 - DNA, 20 bp, Artificial Sequence
  chemically synthesized
tctttgtgtaatcacatgca

SEQ ID NO: 444704 - DNA, 20 bp, Artificial Sequence
  chemically synthesized
gctatgcatgtgattacaca

SEQ ID NO: 444705 - DNA, 20 bp, Artificial Sequence
  chemically synthesized
ttacacaaagattgcgaaca

SEQ ID NO: 444706 - DNA, 20 bp, Artificial Sequence
  chemically synthesized
aaagattgcgaacatagcaa

SEQ ID NO: 444707 - DNA, 20 bp, Artificial Sequence
  chemically synthesized
aagattgcgaacatagcaaa

SEQ ID NO: 444708 - DNA, 20 bp, Artificial Sequence
  chemically synthesized
tcttttctaaatcataattt

SEQ ID NO: 444709 - DNA, 20 bp, Artificial Sequence
  chemically synthesized
aaaggtctaaaattatgatt

SEQ ID NO: 444710 - DNA, 20 bp, Artificial Sequence
  chemically synthesized
tctaaaattatgatttagaa

SEQ ID NO: 444711 - DNA, 20 bp, Artificial Sequence
  chemically synthesized
aaattatgatttagaaaaga

SEQ ID NO: 444712 - DNA, 20 bp, Artificial Sequence
  chemically synthesized
ttatgatttagaaaagaaag

SEQ ID NO: 444713 - DNA, 20 bp, Artificial Sequence
  chemically synthesized
atatttagctatagtcgttt

SEQ ID NO: 444714 - DNA, 20 bp, Artificial Sequence
  chemically synthesized
tatatttagctatagtcgtt

SEQ ID NO: 444715 - DNA, 20 bp, Artificial Sequence
  chemically synthesized
tttaaaaacctaaacgacta

SEQ ID NO: 444716 - DNA, 20 bp, Artificial Sequence
  chemically synthesized
atatggtgtatatttagcta

SEQ ID NO: 444717 - DNA, 20 bp, Artificial Sequence
  chemically synthesized
atacacatatggtgtatatt

SEQ ID NO: 444718 - DNA, 20 bp, Artificial Sequence
  chemically synthesized
atttcaacatcatacacata

SEQ ID NO: 444719 - DNA, 20 bp, Artificial Sequence
  chemically synthesized
tatgatgttgaaataatttt

SEQ ID NO: 444720 - DNA, 20 bp, Artificial Sequence
  chemically synthesized
ttgaaataattttaagtaat

SEQ ID NO: 444721 - DNA, 20 bp, Artificial Sequence
  chemically synthesized
aataagattataattgttta

SEQ ID NO: 444722 - DNA, 20 bp, Artificial Sequence
  chemically synthesized
taagattataattgtttata

SEQ ID NO: 444723 - DNA, 20 bp, Artificial Sequence
  chemically synthesized
aagattataattgtttatag

SEQ ID NO: 444724 - DNA, 20 bp, Artificial Sequence
  chemically synthesized
agattataattgtttataga

SEQ ID NO: 444725 - DNA, 20 bp, Artificial Sequence
  chemically synthesized
attgtttatagagggattga

SEQ ID NO: 444726 - DNA, 20 bp, Artificial Sequence
  chemically synthesized
tgtttatagagggattgata

SEQ ID NO: 444727 - DNA, 20 bp, Artificial Sequence
  chemically synthesized
ttgcattcatgaaaaattac

SEQ ID NO: 444728 - DNA, 20 bp, Artificial Sequence
  chemically synthesized
tttgcattcatgaaaaatta

SEQ ID NO: 444729 - DNA, 20 bp, Artificial Sequence
  chemically synthesized
aatatattttaattacatta

SEQ ID NO: 444730 - DNA, 20 bp, Artificial Sequence
  chemically synthesized
attacattaaagtcatgcat

SEQ ID NO: 444731 - DNA, 20 bp, Artificial Sequence
  chemically synthesized
tacattaaagtcatgcatca

SEQ ID NO: 444732 - DNA, 20 bp, Artificial Sequence
  chemically synthesized
gttttttaattacttttctt

SEQ ID NO: 444733 - DNA, 20 bp, Artificial Sequence
  chemically synthesized
taaaactgtaggctaaagaa

SEQ ID NO: 444734 - DNA, 20 bp, Artificial Sequence
  chemically synthesized
aattacttttctttagccta

SEQ ID NO: 444735 - DNA, 20 bp, Artificial Sequence
  chemically synthesized
tatcataaaactgtaggcta

SEQ ID NO: 444736 - DNA, 20 bp, Artificial Sequence
  chemically synthesized
aacatgtatcataaaactgt

SEQ ID NO: 444737 - DNA, 20 bp, Artificial Sequence
  chemically synthesized
caacatgtatcataaaactg

SEQ ID NO: 444738 - DNA, 20 bp, Artificial Sequence
  chemically synthesized
atgatacatgttgtaaaatg

SEQ ID NO: 444739 - DNA, 20 bp, Artificial Sequence
  chemically synthesized
acatgttgtaaaatgaagac

SEQ ID NO: 444740 - DNA, 20 bp, Artificial Sequence
  chemically synthesized
actgcaatataagcaaggac

SEQ ID NO: 444741 - DNA, 20 bp, Artificial Sequence
  chemically synthesized
ttaatactgcaatataagca

SEQ ID NO: 444742 - DNA, 20 bp, Artificial Sequence
  chemically synthesized
gttaatactgcaatataagc

SEQ ID NO: 444743 - DNA, 20 bp, Artificial Sequence
  chemically synthesized
actggtccttgcttatattg

SEQ ID NO: 444744 - DNA, 20 bp, Artificial Sequence
  chemically synthesized
acaggttaatactgcaatat

SEQ ID NO: 444745 - DNA, 20 bp, Artificial Sequence
  chemically synthesized
tgtcatctgttttatgatac

SEQ ID NO: 444746 - DNA, 20 bp, Artificial Sequence
  chemically synthesized
ttgtcatctgttttatgata

SEQ ID NO: 444747 - DNA, 20 bp, Artificial Sequence
  chemically synthesized
tattaacctgtatcataaaa

SEQ ID NO: 444748 - DNA, 20 bp, Artificial Sequence
  chemically synthesized
taaaacagatgacaaactct

SEQ ID NO: 444749 - DNA, 20 bp, Artificial Sequence
  chemically synthesized
tttagtgctcttagttctaa

SEQ ID NO: 444750 - DNA, 20 bp, Artificial Sequence
  chemically synthesized
gatgacaaactcttagaact

SEQ ID NO: 444751 - DNA, 20 bp, Artificial Sequence
  chemically synthesized
aatttagtgctcttagttct

SEQ ID NO: 444752 - DNA, 20 bp, Artificial Sequence
  chemically synthesized
tgacaaactcttagaactaa

SEQ ID NO: 444753 - DNA, 20 bp, Artificial Sequence
  chemically synthesized
acttttaaatttagtgctct

SEQ ID NO: 444754 - DNA, 20 bp, Artificial Sequence
  chemically synthesized
actaagagcactaaatttaa

SEQ ID NO: 444755 - DNA, 20 bp, Artificial Sequence
  chemically synthesized
ttcttgttcacttttaaatt

SEQ ID NO: 444756 - DNA, 20 bp, Artificial Sequence
  chemically synthesized
cactaaatttaaaagtgaac

SEQ ID NO: 444757 - DNA, 20 bp, Artificial Sequence
  chemically synthesized
tgaacaagaaatgaattctt

SEQ ID NO: 444758 - DNA, 20 bp, Artificial Sequence
  chemically synthesized
tttagggttttaagatactt

SEQ ID NO: 444759 - DNA, 20 bp, Artificial Sequence
  chemically synthesized
aaaaatgcctttagggtttt

SEQ ID NO: 444760 - DNA, 20 bp, Artificial Sequence
  chemically synthesized
ttaagtatcttaaaacccta

SEQ ID NO: 444761 - DNA, 20 bp, Artificial Sequence
  chemically synthesized
taagtatcttaaaaccctaa

SEQ ID NO: 444762 - DNA, 20 bp, Artificial Sequence
  chemically synthesized
tatttttaaaaatgccttta

SEQ ID NO: 444763 - DNA, 20 bp, Artificial Sequence
  chemically synthesized
ttatttttaaaaatgccttt

SEQ ID NO: 444764 - DNA, 20 bp, Artificial Sequence
  chemically synthesized
tttatttttaaaaatgcctt

SEQ ID NO: 444765 - DNA, 20 bp, Artificial Sequence
  chemically synthesized
ttttatttcatcatacattg

SEQ ID NO: 444766 - DNA, 20 bp, Artificial Sequence
  chemically synthesized
ttcatcatacattgtggatg

SEQ ID NO: 444767 - DNA, 20 bp, Artificial Sequence
  chemically synthesized
catcatacattgtggatgta

SEQ ID NO: 444768 - DNA, 20 bp, Artificial Sequence
  chemically synthesized
cattgtggatgtagagtcat

SEQ ID NO: 444769 - DNA, 20 bp, Artificial Sequence
  chemically synthesized
gtggatgtagagtcattggt

SEQ ID NO: 444770 - DNA, 20 bp, Artificial Sequence
  chemically synthesized
attatattgttataatgcag

SEQ ID NO: 444771 - DNA, 20 bp, Artificial Sequence
  chemically synthesized
aattatattgttataatgca

SEQ ID NO: 444772 - DNA, 20 bp, Artificial Sequence
  chemically synthesized
taattatattgttataatgc

SEQ ID NO: 444773 - DNA, 20 bp, Artificial Sequence
  chemically synthesized
ataattatattgttataatg

SEQ ID NO: 444774 - DNA, 20 bp, Artificial Sequence
  chemically synthesized
cattataacaatataattat

SEQ ID NO: 444775 - DNA, 20 bp, Artificial Sequence
  chemically synthesized
ataacaatataattattgga

SEQ ID NO: 444776 - DNA, 20 bp, Artificial Sequence
  chemically synthesized
catgttgaattagatattaa

SEQ ID NO: 444777 - DNA, 20 bp, Artificial Sequence
  chemically synthesized
tctattattccatgttgaat

SEQ ID NO: 444778 - DNA, 20 bp, Artificial Sequence
  chemically synthesized
ttttaatatctaattcaaca

SEQ ID NO: 444779 - DNA, 20 bp, Artificial Sequence
  chemically synthesized
tctaattcaacatggaataa

SEQ ID NO: 444780 - DNA, 20 bp, Artificial Sequence
  chemically synthesized
aacatggaataatagatttt

SEQ ID NO: 444781 - DNA, 20 bp, Artificial Sequence
  chemically synthesized
gaataatagattttcagcaa

SEQ ID NO: 444782 - DNA, 20 bp, Artificial Sequence
  chemically synthesized
aataatagattttcagcaaa

SEQ ID NO: 444783 - DNA, 20 bp, Artificial Sequence
  chemically synthesized
taatagattttcagcaaaag

SEQ ID NO: 444784 - DNA, 20 bp, Artificial Sequence
  chemically synthesized
aatagattttcagcaaaagg

SEQ ID NO: 444785 - DNA, 20 bp, Artificial Sequence
  chemically synthesized
atagattttcagcaaaagga

SEQ ID NO: 444786 - DNA, 20 bp, Artificial Sequence
  chemically synthesized
agattttcagcaaaaggagg

SEQ ID NO: 444787 - DNA, 20 bp, Artificial Sequence
  chemically synthesized
aaaggcctgtcaataaaggt

SEQ ID NO: 444788 - DNA, 20 bp, Artificial Sequence
  chemically synthesized
atatatctgacctttattga

SEQ ID NO: 444789 - DNA, 20 bp, Artificial Sequence
  chemically synthesized
acaaaaaggcctgtcaataa

SEQ ID NO: 444790 - DNA, 20 bp, Artificial Sequence
  chemically synthesized
tatatctgacctttattgac

SEQ ID NO: 444791 - DNA, 20 bp, Artificial Sequence
  chemically synthesized
gacaaaaaggcctgtcaata

SEQ ID NO: 444792 - DNA, 20 bp, Artificial Sequence
  chemically synthesized
ggtaattactggagacaaaa

SEQ ID NO: 444793 - DNA, 20 bp, Artificial Sequence
  chemically synthesized
gggtaattactggagacaaa

SEQ ID NO: 444794 - DNA, 20 bp, Artificial Sequence
  chemically synthesized
ttgacaggcctttttgtctc

SEQ ID NO: 444795 - DNA, 20 bp, Artificial Sequence
  chemically synthesized
tagagattgggtaattactg

SEQ ID NO: 444796 - DNA, 20 bp, Artificial Sequence
  chemically synthesized
catagagattgggtaattac

SEQ ID NO: 444797 - DNA, 20 bp, Artificial Sequence
  chemically synthesized
cactgaatcgcatagagatt

SEQ ID NO: 444798 - DNA, 20 bp, Artificial Sequence
  chemically synthesized
acactgaatcgcatagagat

SEQ ID NO: 444799 - DNA, 20 bp, Artificial Sequence
  chemically synthesized
taagaacactgaatcgcata

SEQ ID NO: 444800 - DNA, 20 bp, Artificial Sequence
  chemically synthesized
tacccaatctctatgcgatt

SEQ ID NO: 444801 - DNA, 20 bp, Artificial Sequence
  chemically synthesized
cttaagaacactgaatcgca

SEQ ID NO: 444802 - DNA, 20 bp, Artificial Sequence
  chemically synthesized
ctatgcgattcagtgttctt

SEQ ID NO: 444803 - DNA, 20 bp, Artificial Sequence
  chemically synthesized
tatgcgattcagtgttctta

SEQ ID NO: 444804 - DNA, 20 bp, Artificial Sequence
  chemically synthesized
aagaaaagttggatttcctt

SEQ ID NO: 444805 - DNA, 20 bp, Artificial Sequence
  chemically synthesized
taattaagagcaagaaaagt

SEQ ID NO: 444806 - DNA, 20 bp, Artificial Sequence
  chemically synthesized
caaataattaagagcaagaa

SEQ ID NO: 444807 - DNA, 20 bp, Artificial Sequence
  chemically synthesized
ggaaacaaataattaagagc

SEQ ID NO: 444808 - DNA, 20 bp, Artificial Sequence
  chemically synthesized
ttgtggaaacaaataattaa

SEQ ID NO: 444809 - DNA, 20 bp, Artificial Sequence
  chemically synthesized
ttttgtggaaacaaataatt

SEQ ID NO: 444810 - DNA, 20 bp, Artificial Sequence
  chemically synthesized
tgtgtttggctagtattttg

SEQ ID NO: 444811 - DNA, 20 bp, Artificial Sequence
  chemically synthesized
tatttgtttccacaaaatac

SEQ ID NO: 444812 - DNA, 20 bp, Artificial Sequence
  chemically synthesized
ctaatagctatgtgtttggc

SEQ ID NO: 444813 - DNA, 20 bp, Artificial Sequence
  chemically synthesized
caaaatactagccaaacaca

SEQ ID NO: 444814 - DNA, 20 bp, Artificial Sequence
  chemically synthesized
agacctaatagctatgtgtt

SEQ ID NO: 444815 - DNA, 20 bp, Artificial Sequence
  chemically synthesized
ctagccaaacacatagctat

SEQ ID NO: 444816 - DNA, 20 bp, Artificial Sequence
  chemically synthesized
tagccaaacacatagctatt

SEQ ID NO: 444817 - DNA, 20 bp, Artificial Sequence
  chemically synthesized
tccacctcacatagacctaa

SEQ ID NO: 444818 - DNA, 20 bp, Artificial Sequence
  chemically synthesized
catagctattaggtctatgt

SEQ ID NO: 444819 - DNA, 20 bp, Artificial Sequence
  chemically synthesized
atagctattaggtctatgtg

SEQ ID NO: 444820 - DNA, 20 bp, Artificial Sequence
  chemically synthesized
gctattaggtctatgtgagg

SEQ ID NO: 444821 - DNA, 20 bp, Artificial Sequence
  chemically synthesized
atgtatacgtccacctcaca

SEQ ID NO: 444822 - DNA, 20 bp, Artificial Sequence
  chemically synthesized
tatacatcaaaatttcttca

SEQ ID NO: 444823 - DNA, 20 bp, Artificial Sequence
  chemically synthesized
acgttggttaagtggctgtg

SEQ ID NO: 444824 - DNA, 20 bp, Artificial Sequence
  chemically synthesized
aacttagcacgttggttaag

SEQ ID NO: 444825 - DNA, 20 bp, Artificial Sequence
  chemically synthesized
gaaaacttagcacgttggtt

SEQ ID NO: 444826 - DNA, 20 bp, Artificial Sequence
  chemically synthesized
agccacttaaccaacgtgct

SEQ ID NO: 444827 - DNA, 20 bp, Artificial Sequence
  chemically synthesized
ttctggaaaacttagcacgt

SEQ ID NO: 444828 - DNA, 20 bp, Artificial Sequence
  chemically synthesized
aaccaacgtgctaagttttc

SEQ ID NO: 444829 - DNA, 20 bp, Artificial Sequence
  chemically synthesized
gttttggattctggaaaact

SEQ ID NO: 444830 - DNA, 20 bp, Artificial Sequence
  chemically synthesized
aactgatttgttttggattc

SEQ ID NO: 444831 - DNA, 20 bp, Artificial Sequence
  chemically synthesized
cctcttaaactgatttgttt

SEQ ID NO: 444832 - DNA, 20 bp, Artificial Sequence
  chemically synthesized
ttccagaatccaaaacaaat

SEQ ID NO: 444833 - DNA, 20 bp, Artificial Sequence
  chemically synthesized
aatccaaaacaaatcagttt

SEQ ID NO: 444834 - DNA, 20 bp, Artificial Sequence
  chemically synthesized
tccaaaacaaatcagtttaa

SEQ ID NO: 444835 - DNA, 20 bp, Artificial Sequence
  chemically synthesized
ccaaaacaaatcagtttaag

SEQ ID NO: 444836 - DNA, 20 bp, Artificial Sequence
  chemically synthesized
aaacaaatcagtttaagagg

SEQ ID NO: 444837 - DNA, 20 bp, Artificial Sequence
  chemically synthesized
aacaaatcagtttaagaggt

SEQ ID NO: 444838 - DNA, 20 bp, Artificial Sequence
  chemically synthesized
gtttaagaggtaggtatgca

SEQ ID NO: 444839 - DNA, 20 bp, Artificial Sequence
  chemically synthesized
ttaaaatctagagtattaca

SEQ ID NO: 444840 - DNA, 20 bp, Artificial Sequence
  chemically synthesized
tttaaaatctagagtattac

SEQ ID NO: 444841 - DNA, 20 bp, Artificial Sequence
  chemically synthesized
ttttaaaatctagagtatta

SEQ ID NO: 444842 - DNA, 20 bp, Artificial Sequence
  chemically synthesized
gcaaagaccctgtaatactc

SEQ ID NO: 444843 - DNA, 20 bp, Artificial Sequence
  chemically synthesized
ggatacttttttaaaatcta

SEQ ID NO: 444844 - DNA, 20 bp, Artificial Sequence
  chemically synthesized
aaggatacttttttaaaatc

SEQ ID NO: 444845 - DNA, 20 bp, Artificial Sequence
  chemically synthesized
taatactctagattttaaaa

SEQ ID NO: 444846 - DNA, 20 bp, Artificial Sequence
  chemically synthesized
agattttaaaaaagtatcct

SEQ ID NO: 444847 - DNA, 20 bp, Artificial Sequence
  chemically synthesized
ttaaaaaagtatccttagtt

SEQ ID NO: 444848 - DNA, 20 bp, Artificial Sequence
  chemically synthesized
tttctcatggtacttaacta

SEQ ID NO: 444849 - DNA, 20 bp, Artificial Sequence
  chemically synthesized
ttttctcatggtacttaact

SEQ ID NO: 444850 - DNA, 20 bp, Artificial Sequence
  chemically synthesized
tatccttagttaagtaccat

SEQ ID NO: 444851 - DNA, 20 bp, Artificial Sequence
  chemically synthesized
taaactagctcattttctca

SEQ ID NO: 444852 - DNA, 20 bp, Artificial Sequence
  chemically synthesized
gttaagtaccatgagaaaat

SEQ ID NO: 444853 - DNA, 20 bp, Artificial Sequence
  chemically synthesized
agtaccatgagaaaatgagc

SEQ ID NO: 444854 - DNA, 20 bp, Artificial Sequence
  chemically synthesized
tcctaacatagcacataaac

SEQ ID NO: 444855 - DNA, 20 bp, Artificial Sequence
  chemically synthesized
agctagtttatgtgctatgt

SEQ ID NO: 444856 - DNA, 20 bp, Artificial Sequence
  chemically synthesized
gctagtttatgtgctatgtt

SEQ ID NO: 444857 - DNA, 20 bp, Artificial Sequence
  chemically synthesized
tggctattatgttcctaaca

SEQ ID NO: 444858 - DNA, 20 bp, Artificial Sequence
  chemically synthesized
gtgctatgttaggaacataa

SEQ ID NO: 444859 - DNA, 20 bp, Artificial Sequence
  chemically synthesized
tatttatttttttttttttt

SEQ ID NO: 444860 - DNA, 20 bp, Artificial Sequence
  chemically synthesized
aaaaaaaaaaaaataaataa

SEQ ID NO: 444861 - DNA, 20 bp, Artificial Sequence
  chemically synthesized
aaaaaaaaataaataacagt

SEQ ID NO: 444862 - DNA, 20 bp, Artificial Sequence
  chemically synthesized
aaataaataacagttggaat

SEQ ID NO: 444863 - DNA, 20 bp, Artificial Sequence
  chemically synthesized
aataaataacagttggaatc

SEQ ID NO: 444864 - DNA, 20 bp, Artificial Sequence
  chemically synthesized
acagttggaatcaggcacct

SEQ ID NO: 444865 - DNA, 20 bp, Artificial Sequence
  chemically synthesized
aaaatactcatgaagtacca

SEQ ID NO: 444866 - DNA, 20 bp, Artificial Sequence
  chemically synthesized
caaaatactcatgaagtacc

SEQ ID NO: 444867 - DNA, 20 bp, Artificial Sequence
  chemically synthesized
caggcaccttggtacttcat

SEQ ID NO: 444868 - DNA, 20 bp, Artificial Sequence
  chemically synthesized
actgttgcaaaatactcatg

SEQ ID NO: 444869 - DNA, 20 bp, Artificial Sequence
  chemically synthesized
acttcatgagtattttgcaa

SEQ ID NO: 444870 - DNA, 20 bp, Artificial Sequence
  chemically synthesized
agtattttgcaacagtataa

SEQ ID NO: 444871 - DNA, 20 bp, Artificial Sequence
  chemically synthesized
gtattttgcaacagtataat

SEQ ID NO: 444872 - DNA, 20 bp, Artificial Sequence
  chemically synthesized
tattttgcaacagtataata

SEQ ID NO: 444873 - DNA, 20 bp, Artificial Sequence
  chemically synthesized
aacagtataatagggccttt

SEQ ID NO: 444874 - DNA, 20 bp, Artificial Sequence
  chemically synthesized
gcaagcacatcattactgaa

SEQ ID NO: 444875 - DNA, 20 bp, Artificial Sequence
  chemically synthesized
tgcaagcacatcattactga

SEQ ID NO: 444876 - DNA, 20 bp, Artificial Sequence
  chemically synthesized
tcagtaatgatgtgcttgca

SEQ ID NO: 444877 - DNA, 20 bp, Artificial Sequence
  chemically synthesized
attttcatgtatttctatgc

SEQ ID NO: 444878 - DNA, 20 bp, Artificial Sequence
  chemically synthesized
ttacacaaatttgatatttt

SEQ ID NO: 444879 - DNA, 20 bp, Artificial Sequence
  chemically synthesized
atatttttagtaactgaatt

SEQ ID NO: 444880 - DNA, 20 bp, Artificial Sequence
  chemically synthesized
ttacaaaactaaactaaatt

SEQ ID NO: 444881 - DNA, 20 bp, Artificial Sequence
  chemically synthesized
tttagtaactgaatttagtt

SEQ ID NO: 444882 - DNA, 20 bp, Artificial Sequence
  chemically synthesized
ttagtttagttttgtaaact

SEQ ID NO: 444883 - DNA, 20 bp, Artificial Sequence
  chemically synthesized
gttttgtaaactcagaactc

SEQ ID NO: 444884 - DNA, 20 bp, Artificial Sequence
  chemically synthesized
gcacgtcacccttgagttct

SEQ ID NO: 444885 - DNA, 20 bp, Artificial Sequence
  chemically synthesized
ttttgtaaactcagaactca

SEQ ID NO: 444886 - DNA, 20 bp, Artificial Sequence
  chemically synthesized
tttgtaaactcagaactcaa

SEQ ID NO: 444887 - DNA, 20 bp, Artificial Sequence
  chemically synthesized
cacatatgcacgtcaccctt

SEQ ID NO: 444888 - DNA, 20 bp, Artificial Sequence
  chemically synthesized
gggtgacgtgcatatgtgcg

SEQ ID NO: 444889 - DNA, 20 bp, Artificial Sequence
  chemically synthesized
gtgacgtgcatatgtgcgtg

SEQ ID NO: 444890 - DNA, 20 bp, Artificial Sequence
  chemically synthesized
ttgcttgtgtatgtatgtgt

SEQ ID NO: 444891 - DNA, 20 bp, Artificial Sequence
  chemically synthesized
tgacttacacatacatacac

SEQ ID NO: 444892 - DNA, 20 bp, Artificial Sequence
  chemically synthesized
aagcaatcatatgtacaact

SEQ ID NO: 444893 - DNA, 20 bp, Artificial Sequence
  chemically synthesized
agcaatcatatgtacaactt

SEQ ID NO: 444894 - DNA, 20 bp, Artificial Sequence
  chemically synthesized
atatgtacaacttgggctct

SEQ ID NO: 444895 - DNA, 20 bp, Artificial Sequence
  chemically synthesized
gccctactttctaagagccc

SEQ ID NO: 444896 - DNA, 20 bp, Artificial Sequence
  chemically synthesized
gtacaacttgggctcttaga

SEQ ID NO: 444897 - DNA, 20 bp, Artificial Sequence
  chemically synthesized
caatgtgccctactttctaa

SEQ ID NO: 444898 - DNA, 20 bp, Artificial Sequence
  chemically synthesized
caacttgggctcttagaaag

SEQ ID NO: 444899 - DNA, 20 bp, Artificial Sequence
  chemically synthesized
aacttgggctcttagaaagt

SEQ ID NO: 444900 - DNA, 20 bp, Artificial Sequence
  chemically synthesized
gacaatgtgccctactttct

SEQ ID NO: 444901 - DNA, 20 bp, Artificial Sequence
  chemically synthesized
acttgggctcttagaaagta

SEQ ID NO: 444902 - DNA, 20 bp, Artificial Sequence
  chemically synthesized
aaagtagggcacattgtcac

SEQ ID NO: 444903 - DNA, 20 bp, Artificial Sequence
  chemically synthesized
gaatcatatgacaattcaac

SEQ ID NO: 444904 - DNA, 20 bp, Artificial Sequence
  chemically synthesized
aacgacttatcatttaaatc

SEQ ID NO: 444905 - DNA, 20 bp, Artificial Sequence
  chemically synthesized
gaacgacttatcatttaaat

SEQ ID NO: 444906 - DNA, 20 bp, Artificial Sequence
  chemically synthesized
tgattcctgatttaaatgat

SEQ ID NO: 444907 - DNA, 20 bp, Artificial Sequence
  chemically synthesized
gaagtaagggttgaagaaat

SEQ ID NO: 444908 - DNA, 20 bp, Artificial Sequence
  chemically synthesized
cgctcaagaagtaagggttg

SEQ ID NO: 444909 - DNA, 20 bp, Artificial Sequence
  chemically synthesized
actgttcgctcaagaagtaa

SEQ ID NO: 444910 - DNA, 20 bp, Artificial Sequence
  chemically synthesized
gactgttcgctcaagaagta

SEQ ID NO: 444911 - DNA, 20 bp, Artificial Sequence
  chemically synthesized
ttcttcaacccttacttctt

SEQ ID NO: 444912 - DNA, 20 bp, Artificial Sequence
  chemically synthesized
ggactgttcgctcaagaagt

SEQ ID NO: 444913 - DNA, 20 bp, Artificial Sequence
  chemically synthesized
atatggactgttcgctcaag

SEQ ID NO: 444914 - DNA, 20 bp, Artificial Sequence
  chemically synthesized
acccttacttcttgagcgaa

SEQ ID NO: 444915 - DNA, 20 bp, Artificial Sequence
  chemically synthesized
tgcatatggactgttcgctc

SEQ ID NO: 444916 - DNA, 20 bp, Artificial Sequence
  chemically synthesized
actccatactgatttgcata

SEQ ID NO: 444917 - DNA, 20 bp, Artificial Sequence
  chemically synthesized
cgaacagtccatatgcaaat

SEQ ID NO: 444918 - DNA, 20 bp, Artificial Sequence
  chemically synthesized
agtccatatgcaaatcagta

SEQ ID NO: 444919 - DNA, 20 bp, Artificial Sequence
  chemically synthesized
tccatatgcaaatcagtatg

SEQ ID NO: 444920 - DNA, 20 bp, Artificial Sequence
  chemically synthesized
atatgcaaatcagtatggag

SEQ ID NO: 444921 - DNA, 20 bp, Artificial Sequence
  chemically synthesized
ctcactagaacgtgagatta

SEQ ID NO: 444922 - DNA, 20 bp, Artificial Sequence
  chemically synthesized
caaactttaatctcacgttc

SEQ ID NO: 444923 - DNA, 20 bp, Artificial Sequence
  chemically synthesized
taaaatactcactagaacgt

SEQ ID NO: 444924 - DNA, 20 bp, Artificial Sequence
  chemically synthesized
ctttaatctcacgttctagt

SEQ ID NO: 444925 - DNA, 20 bp, Artificial Sequence
  chemically synthesized
ttttagtataaaatactcac

SEQ ID NO: 444926 - DNA, 20 bp, Artificial Sequence
  chemically synthesized
tgactctatctggtggtttt

SEQ ID NO: 444927 - DNA, 20 bp, Artificial Sequence
  chemically synthesized
tattttatactaaaaaccac

SEQ ID NO: 444928 - DNA, 20 bp, Artificial Sequence
  chemically synthesized
ttatactaaaaaccaccaga

SEQ ID NO: 444929 - DNA, 20 bp, Artificial Sequence
  chemically synthesized
atactaaaaaccaccagata

SEQ ID NO: 444930 - DNA, 20 bp, Artificial Sequence
  chemically synthesized
cttttcatgactctatctgg

SEQ ID NO: 444931 - DNA, 20 bp, Artificial Sequence
  chemically synthesized
ctacttttcatgactctatc

SEQ ID NO: 444932 - DNA, 20 bp, Artificial Sequence
  chemically synthesized
ccaccagatagagtcatgaa

SEQ ID NO: 444933 - DNA, 20 bp, Artificial Sequence
  chemically synthesized
ccagatagagtcatgaaaag

SEQ ID NO: 444934 - DNA, 20 bp, Artificial Sequence
  chemically synthesized
tacacaaacgcattttctta

SEQ ID NO: 444935 - DNA, 20 bp, Artificial Sequence
  chemically synthesized
atgaaactcatagttacttt

SEQ ID NO: 444936 - DNA, 20 bp, Artificial Sequence
  chemically synthesized
cattttcttaaagtaactat

SEQ ID NO: 444937 - DNA, 20 bp, Artificial Sequence
  chemically synthesized
atgaaagtaaatgaaactca

SEQ ID NO: 444938 - DNA, 20 bp, Artificial Sequence
  chemically synthesized
agtaacaaagtataagatga

SEQ ID NO: 444939 - DNA, 20 bp, Artificial Sequence
  chemically synthesized
cctttgaagtaacaaagtat

SEQ ID NO: 444940 - DNA, 20 bp, Artificial Sequence
  chemically synthesized
cttctccctttgaagtaaca

SEQ ID NO: 444941 - DNA, 20 bp, Artificial Sequence
  chemically synthesized
tcttatactttgttacttca

SEQ ID NO: 444942 - DNA, 20 bp, Artificial Sequence
  chemically synthesized
cttatactttgttacttcaa

SEQ ID NO: 444943 - DNA, 20 bp, Artificial Sequence
  chemically synthesized
ttatactttgttacttcaaa

SEQ ID NO: 444944 - DNA, 20 bp, Artificial Sequence
  chemically synthesized
atactttgttacttcaaagg

SEQ ID NO: 444945 - DNA, 20 bp, Artificial Sequence
  chemically synthesized
atcagtaacttctccctttg

SEQ ID NO: 444946 - DNA, 20 bp, Artificial Sequence
  chemically synthesized
ctttgttacttcaaagggag

SEQ ID NO: 444947 - DNA, 20 bp, Artificial Sequence
  chemically synthesized
taaagggagataagaaaaat

SEQ ID NO: 444948 - DNA, 20 bp, Artificial Sequence
  chemically synthesized
catggctgataaagggagat

SEQ ID NO: 444949 - DNA, 20 bp, Artificial Sequence
  chemically synthesized
tttttcttatctccctttat

SEQ ID NO: 444950 - DNA, 20 bp, Artificial Sequence
  chemically synthesized
agggacatggctgataaagg

SEQ ID NO: 444951 - DNA, 20 bp, Artificial Sequence
  chemically synthesized
ccagggacatggctgataaa

SEQ ID NO: 444952 - DNA, 20 bp, Artificial Sequence
  chemically synthesized
gccagggacatggctgataa

SEQ ID NO: 444953 - DNA, 20 bp, Artificial Sequence
  chemically synthesized
tgccagggacatggctgata

SEQ ID NO: 444954 - DNA, 20 bp, Artificial Sequence
  chemically synthesized
ccctttatcagccatgtccc

SEQ ID NO: 444955 - DNA, 20 bp, Artificial Sequence
  chemically synthesized
tctatttcttgccagggaca

SEQ ID NO: 444956 - DNA, 20 bp, Artificial Sequence
  chemically synthesized
ttatcagccatgtccctggc

SEQ ID NO: 444957 - DNA, 20 bp, Artificial Sequence
  chemically synthesized
ttgaattctatttcttgcca

SEQ ID NO: 444958 - DNA, 20 bp, Artificial Sequence
  chemically synthesized
gttgaattctatttcttgcc

SEQ ID NO: 444959 - DNA, 20 bp, Artificial Sequence
  chemically synthesized
tgttgaattctatttcttgc

SEQ ID NO: 444960 - DNA, 20 bp, Artificial Sequence
  chemically synthesized
gccatgtccctggcaagaaa

SEQ ID NO: 444961 - DNA, 20 bp, Artificial Sequence
  chemically synthesized
gcaagaaatagaattcaaca

SEQ ID NO: 444962 - DNA, 20 bp, Artificial Sequence
  chemically synthesized
gaaatagaattcaacatgga

SEQ ID NO: 444963 - DNA, 20 bp, Artificial Sequence
  chemically synthesized
acatggatggttcaataaaa

SEQ ID NO: 444964 - DNA, 20 bp, Artificial Sequence
  chemically synthesized
tggttcaataaaacagtaca

SEQ ID NO: 444965 - DNA, 20 bp, Artificial Sequence
  chemically synthesized
ggttcaataaaacagtacaa

SEQ ID NO: 444966 - DNA, 20 bp, Artificial Sequence
  chemically synthesized
cagtacaaaggaactacttt

SEQ ID NO: 444967 - DNA, 20 bp, Artificial Sequence
  chemically synthesized
gtacaaaggaactactttca

SEQ ID NO: 444968 - DNA, 20 bp, Artificial Sequence
  chemically synthesized
tacaaaggaactactttcag

SEQ ID NO: 444969 - DNA, 20 bp, Artificial Sequence
  chemically synthesized
cccattcacacctctgaaag

SEQ ID NO: 444970 - DNA, 20 bp, Artificial Sequence
  chemically synthesized
aagcccattcacacctctga

SEQ ID NO: 444971 - DNA, 20 bp, Artificial Sequence
  chemically synthesized
actactttcagaggtgtgaa

SEQ ID NO: 444972 - DNA, 20 bp, Artificial Sequence
  chemically synthesized
ctactttcagaggtgtgaat

SEQ ID NO: 444973 - DNA, 20 bp, Artificial Sequence
  chemically synthesized
cagaggtgtgaatgggctta

SEQ ID NO: 444974 - DNA, 20 bp, Artificial Sequence
  chemically synthesized
tagccccttttggtttcttt

SEQ ID NO: 444975 - DNA, 20 bp, Artificial Sequence
  chemically synthesized
aatgggcttaaagaaaccaa

SEQ ID NO: 444976 - DNA, 20 bp, Artificial Sequence
  chemically synthesized
atgggcttaaagaaaccaaa

SEQ ID NO: 444977 - DNA, 20 bp, Artificial Sequence
  chemically synthesized
tgggcttaaagaaaccaaaa

SEQ ID NO: 444978 - DNA, 20 bp, Artificial Sequence
  chemically synthesized
gggcttaaagaaaccaaaag

SEQ ID NO: 444979 - DNA, 20 bp, Artificial Sequence
  chemically synthesized
ggtgcctcgatagccccttt

SEQ ID NO: 444980 - DNA, 20 bp, Artificial Sequence
  chemically synthesized
agaaaccaaaaggggctatc

SEQ ID NO: 444981 - DNA, 20 bp, Artificial Sequence
  chemically synthesized
gaaaccaaaaggggctatcg

SEQ ID NO: 444982 - DNA, 20 bp, Artificial Sequence
  chemically synthesized
gttgtctctaggtgcctcga

SEQ ID NO: 444983 - DNA, 20 bp, Artificial Sequence
  chemically synthesized
aaaggggctatcgaggcacc

SEQ ID NO: 444984 - DNA, 20 bp, Artificial Sequence
  chemically synthesized
aggggctatcgaggcaccta

SEQ ID NO: 444985 - DNA, 20 bp, Artificial Sequence
  chemically synthesized
gcctactggaggttgtctct

SEQ ID NO: 444986 - DNA, 20 bp, Artificial Sequence
  chemically synthesized
tgcctactggaggttgtctc

SEQ ID NO: 444987 - DNA, 20 bp, Artificial Sequence
  chemically synthesized
aggcacctagagacaacctc

SEQ ID NO: 444988 - DNA, 20 bp, Artificial Sequence
  chemically synthesized
cacctagagacaacctccag

SEQ ID NO: 444989 - DNA, 20 bp, Artificial Sequence
  chemically synthesized
acctagagacaacctccagt

SEQ ID NO: 444990 - DNA, 20 bp, Artificial Sequence
  chemically synthesized
atatcacaattgcctactgg

SEQ ID NO: 444991 - DNA, 20 bp, Artificial Sequence
  chemically synthesized
tatatcacaattgcctactg

SEQ ID NO: 444992 - DNA, 20 bp, Artificial Sequence
  chemically synthesized
ggtatatcacaattgcctac

SEQ ID NO: 444993 - DNA, 20 bp, Artificial Sequence
  chemically synthesized
caattgtgatatacctttcc

SEQ ID NO: 444994 - DNA, 20 bp, Artificial Sequence
  chemically synthesized
aggcatggtaaggctgggaa

SEQ ID NO: 444995 - DNA, 20 bp, Artificial Sequence
  chemically synthesized
caggcatggtaaggctggga

SEQ ID NO: 444996 - DNA, 20 bp, Artificial Sequence
  chemically synthesized
tcttcaggcatggtaaggct

SEQ ID NO: 444997 - DNA, 20 bp, Artificial Sequence
  chemically synthesized
ctcttcaggcatggtaaggc

SEQ ID NO: 444998 - DNA, 20 bp, Artificial Sequence
  chemically synthesized
ttgactcttcaggcatggta

SEQ ID NO: 444999 - DNA, 20 bp, Artificial Sequence
  chemically synthesized
cttgactcttcaggcatggt

SEQ ID NO: 445000 - DNA, 20 bp, Artificial Sequence
  chemically synthesized
tcccagccttaccatgcctg

SEQ ID NO: 445001 - DNA, 20 bp, Artificial Sequence
  chemically synthesized
ttcacttgactcttcaggca

SEQ ID NO: 445002 - DNA, 20 bp, Artificial Sequence
  chemically synthesized
ccagccttaccatgcctgaa

SEQ ID NO: 445003 - DNA, 20 bp, Artificial Sequence
  chemically synthesized
cttccttcacttgactcttc

SEQ ID NO: 445004 - DNA, 20 bp, Artificial Sequence
  chemically synthesized
cttaccatgcctgaagagtc

SEQ ID NO: 445005 - DNA, 20 bp, Artificial Sequence
  chemically synthesized
acttccttcacttgactctt

SEQ ID NO: 445006 - DNA, 20 bp, Artificial Sequence
  chemically synthesized
catgcctgaagagtcaagtg

SEQ ID NO: 445007 - DNA, 20 bp, Artificial Sequence
  chemically synthesized
atgcctgaagagtcaagtga

SEQ ID NO: 445008 - DNA, 20 bp, Artificial Sequence
  chemically synthesized
cctgaagagtcaagtgaagg

SEQ ID NO: 445009 - DNA, 20 bp, Artificial Sequence
  chemically synthesized
gaagagtcaagtgaaggaag

SEQ ID NO: 445010 - DNA, 20 bp, Artificial Sequence
  chemically synthesized
aagagtcaagtgaaggaagt

SEQ ID NO: 445011 - DNA, 20 bp, Artificial Sequence
  chemically synthesized
gaagtaggattttctaaatc

SEQ ID NO: 445012 - DNA, 20 bp, Artificial Sequence
  chemically synthesized
gctctatctcttactggatt

SEQ ID NO: 445013 - DNA, 20 bp, Artificial Sequence
  chemically synthesized
taggattttctaaatccagt

SEQ ID NO: 445014 - DNA, 20 bp, Artificial Sequence
  chemically synthesized
ggattttctaaatccagtaa

SEQ ID NO: 445015 - DNA, 20 bp, Artificial Sequence
  chemically synthesized
tctatggctctatctcttac

SEQ ID NO: 445016 - DNA, 20 bp, Artificial Sequence
  chemically synthesized
tttctaaatccagtaagaga

SEQ ID NO: 445017 - DNA, 20 bp, Artificial Sequence
  chemically synthesized
tctaaatccagtaagagata

SEQ ID NO: 445018 - DNA, 20 bp, Artificial Sequence
  chemically synthesized
tccagtaagagatagagcca

SEQ ID NO: 445019 - DNA, 20 bp, Artificial Sequence
  chemically synthesized
cagtaagagatagagccata

SEQ ID NO: 445020 - DNA, 20 bp, Artificial Sequence
  chemically synthesized
agtaagagatagagccatag

SEQ ID NO: 445021 - DNA, 20 bp, Artificial Sequence
  chemically synthesized
taagagatagagccatagag

SEQ ID NO: 445022 - DNA, 20 bp, Artificial Sequence
  chemically synthesized
cctgttaagaatctcctcta

SEQ ID NO: 445023 - DNA, 20 bp, Artificial Sequence
  chemically synthesized
gccatagaggagattcttaa

SEQ ID NO: 445024 - DNA, 20 bp, Artificial Sequence
  chemically synthesized
ccatagaggagattcttaac

SEQ ID NO: 445025 - DNA, 20 bp, Artificial Sequence
  chemically synthesized
agaggagattcttaacagga

SEQ ID NO: 445026 - DNA, 20 bp, Artificial Sequence
  chemically synthesized
atatctctaactatcctgtt

SEQ ID NO: 445027 - DNA, 20 bp, Artificial Sequence
  chemically synthesized
gagattcttaacaggatagt

SEQ ID NO: 445028 - DNA, 20 bp, Artificial Sequence
  chemically synthesized
gattcttaacaggatagtta

SEQ ID NO: 445029 - DNA, 20 bp, Artificial Sequence
  chemically synthesized
aacaggatagttagagatat

SEQ ID NO: 445030 - DNA, 20 bp, Artificial Sequence
  chemically synthesized
gttagagatataagctgcca

SEQ ID NO: 445031 - DNA, 20 bp, Artificial Sequence
  chemically synthesized
agagatataagctgccatgg

SEQ ID NO: 445032 - DNA, 20 bp, Artificial Sequence
  chemically synthesized
gagatataagctgccatggt

SEQ ID NO: 445033 - DNA, 20 bp, Artificial Sequence
  chemically synthesized
tgccttatttcccaccatgg

SEQ ID NO: 445034 - DNA, 20 bp, Artificial Sequence
  chemically synthesized
ttgtgccttatttcccacca

SEQ ID NO: 445035 - DNA, 20 bp, Artificial Sequence
  chemically synthesized
aagctgccatggtgggaaat

SEQ ID NO: 445036 - DNA, 20 bp, Artificial Sequence
  chemically synthesized
agctgccatggtgggaaata

SEQ ID NO: 445037 - DNA, 20 bp, Artificial Sequence
  chemically synthesized
atggtgggaaataaggcaca

SEQ ID NO: 445038 - DNA, 20 bp, Artificial Sequence
  chemically synthesized
ggtgggaaataaggcacaaa

SEQ ID NO: 445039 - DNA, 20 bp, Artificial Sequence
  chemically synthesized
tgggaaataaggcacaaaga

SEQ ID NO: 445040 - DNA, 20 bp, Artificial Sequence
  chemically synthesized
gaaataaggcacaaagagag

SEQ ID NO: 445041 - DNA, 20 bp, Artificial Sequence
  chemically synthesized
aataaggcacaaagagagtg

SEQ ID NO: 445042 - DNA, 20 bp, Artificial Sequence
  chemically synthesized
ataaggcacaaagagagtgg

SEQ ID NO: 445043 - DNA, 20 bp, Artificial Sequence
  chemically synthesized
gagagtggaggtcaatgtaa

SEQ ID NO: 445044 - DNA, 20 bp, Artificial Sequence
  chemically synthesized
agagtggaggtcaatgtaaa

SEQ ID NO: 445045 - DNA, 20 bp, Artificial Sequence
  chemically synthesized
tcaatgtaaaaggaatgtcc

SEQ ID NO: 445046 - DNA, 20 bp, Artificial Sequence
  chemically synthesized
ggcagaaagagagcagatct

SEQ ID NO: 445047 - DNA, 20 bp, Artificial Sequence
  chemically synthesized
aggcagaaagagagcagatc

SEQ ID NO: 445048 - DNA, 20 bp, Artificial Sequence
  chemically synthesized
acagaaaggcagaaagagag

SEQ ID NO: 445049 - DNA, 20 bp, Artificial Sequence
  chemically synthesized
aagacagaaaggcagaaaga

SEQ ID NO: 445050 - DNA, 20 bp, Artificial Sequence
  chemically synthesized
ataagacagaaaggcagaaa

SEQ ID NO: 445051 - DNA, 20 bp, Artificial Sequence
  chemically synthesized
acataagacagaaaggcaga

SEQ ID NO: 445052 - DNA, 20 bp, Artificial Sequence
  chemically synthesized
ataaacataagacagaaagg

SEQ ID NO: 445053 - DNA, 20 bp, Artificial Sequence
  chemically synthesized
ggcataaacataagacagaa

SEQ ID NO: 445054 - DNA, 20 bp, Artificial Sequence
  chemically synthesized
aggcataaacataagacaga

SEQ ID NO: 445055 - DNA, 20 bp, Artificial Sequence
  chemically synthesized
tggaaggcataaacataaga

SEQ ID NO: 445056 - DNA, 20 bp, Artificial Sequence
  chemically synthesized
ccaatggaaggcataaacat

SEQ ID NO: 445057 - DNA, 20 bp, Artificial Sequence
  chemically synthesized
cttatgtttatgccttccat

SEQ ID NO: 445058 - DNA, 20 bp, Artificial Sequence
  chemically synthesized
tgttggttttggccaatgga

SEQ ID NO: 445059 - DNA, 20 bp, Artificial Sequence
  chemically synthesized
ctgttggttttggccaatgg

SEQ ID NO: 445060 - DNA, 20 bp, Artificial Sequence
  chemically synthesized
ctcctgttggttttggccaa

SEQ ID NO: 445061 - DNA, 20 bp, Artificial Sequence
  chemically synthesized
cttccattggccaaaaccaa

SEQ ID NO: 445062 - DNA, 20 bp, Artificial Sequence
  chemically synthesized
gagtagtctcctgttggttt

SEQ ID NO: 445063 - DNA, 20 bp, Artificial Sequence
  chemically synthesized
ttccattggccaaaaccaac

SEQ ID NO: 445064 - DNA, 20 bp, Artificial Sequence
  chemically synthesized
ccattggccaaaaccaacag

SEQ ID NO: 445065 - DNA, 20 bp, Artificial Sequence
  chemically synthesized
cttgccgagtagtctcctgt

SEQ ID NO: 445066 - DNA, 20 bp, Artificial Sequence
  chemically synthesized
aaaaccaacaggagactact

SEQ ID NO: 445067 - DNA, 20 bp, Artificial Sequence
  chemically synthesized
ccaacaggagactactcggc

SEQ ID NO: 445068 - DNA, 20 bp, Artificial Sequence
  chemically synthesized
caacaggagactactcggca

SEQ ID NO: 445069 - DNA, 20 bp, Artificial Sequence
  chemically synthesized
tccttagctcccttgccgag

SEQ ID NO: 445070 - DNA, 20 bp, Artificial Sequence
  chemically synthesized
aacaggagactactcggcaa

SEQ ID NO: 445071 - DNA, 20 bp, Artificial Sequence
  chemically synthesized
caggagactactcggcaagg

SEQ ID NO: 445072 - DNA, 20 bp, Artificial Sequence
  chemically synthesized
atttccttagctcccttgcc

SEQ ID NO: 445073 - DNA, 20 bp, Artificial Sequence
  chemically synthesized
gactactcggcaagggagct

SEQ ID NO: 445074 - DNA, 20 bp, Artificial Sequence
  chemically synthesized
actactcggcaagggagcta

SEQ ID NO: 445075 - DNA, 20 bp, Artificial Sequence
  chemically synthesized
ccctataaattgcatttcct

SEQ ID NO: 445076 - DNA, 20 bp, Artificial Sequence
  chemically synthesized
agctaaggaaatgcaattta

SEQ ID NO: 445077 - DNA, 20 bp, Artificial Sequence
  chemically synthesized
gctaaggaaatgcaatttat

SEQ ID NO: 445078 - DNA, 20 bp, Artificial Sequence
  chemically synthesized
ctaaggaaatgcaatttata

SEQ ID NO: 445079 - DNA, 20 bp, Artificial Sequence
  chemically synthesized
taaggaaatgcaatttatag

SEQ ID NO: 445080 - DNA, 20 bp, Artificial Sequence
  chemically synthesized
gaaatgcaatttataggggt

SEQ ID NO: 445081 - DNA, 20 bp, Artificial Sequence
  chemically synthesized
atttataggggtcagcttca

SEQ ID NO: 445082 - DNA, 20 bp, Artificial Sequence
  chemically synthesized
tgttctgctctgtcactgtg

SEQ ID NO: 445083 - DNA, 20 bp, Artificial Sequence
  chemically synthesized
aggggtcagcttcacagtga

SEQ ID NO: 445084 - DNA, 20 bp, Artificial Sequence
  chemically synthesized
gggtcagcttcacagtgaca

SEQ ID NO: 445085 - DNA, 20 bp, Artificial Sequence
  chemically synthesized
tcagcttcacagtgacagag

SEQ ID NO: 445086 - DNA, 20 bp, Artificial Sequence
  chemically synthesized
agtgacagagcagaacaaaa

SEQ ID NO: 445087 - DNA, 20 bp, Artificial Sequence
  chemically synthesized
tgacagagcagaacaaaaaa

SEQ ID NO: 445088 - DNA, 20 bp, Artificial Sequence
  chemically synthesized
gaacaaaaaagagcataaaa

SEQ ID NO: 445089 - DNA, 20 bp, Artificial Sequence
  chemically synthesized
aaaaagagcataaaatggat

SEQ ID NO: 445090 - DNA, 20 bp, Artificial Sequence
  chemically synthesized
aaaagagcataaaatggatt

SEQ ID NO: 445091 - DNA, 20 bp, Artificial Sequence
  chemically synthesized
agcataaaatggattgggcc

SEQ ID NO: 445092 - DNA, 20 bp, Artificial Sequence
  chemically synthesized
taaaatggattgggccaagc

SEQ ID NO: 445093 - DNA, 20 bp, Artificial Sequence
  chemically synthesized
atggattgggccaagccagc

SEQ ID NO: 445094 - DNA, 20 bp, Artificial Sequence
  chemically synthesized
acactcttttcttgctggct

SEQ ID NO: 445095 - DNA, 20 bp, Artificial Sequence
  chemically synthesized
ttgggccaagccagcaagaa

SEQ ID NO: 445096 - DNA, 20 bp, Artificial Sequence
  chemically synthesized
tcagtacactcttttcttgc

SEQ ID NO: 445097 - DNA, 20 bp, Artificial Sequence
  chemically synthesized
gggccaagccagcaagaaaa

SEQ ID NO: 445098 - DNA, 20 bp, Artificial Sequence
  chemically synthesized
tctctaaattttaaatattt

SEQ ID NO: 445099 - DNA, 20 bp, Artificial Sequence
  chemically synthesized
gtactgaaatatttaaaatt

SEQ ID NO: 445100 - DNA, 20 bp, Artificial Sequence
  chemically synthesized
actgaaatatttaaaattta

SEQ ID NO: 445101 - DNA, 20 bp, Artificial Sequence
  chemically synthesized
tgaaatatttaaaatttaga

SEQ ID NO: 445102 - DNA, 20 bp, Artificial Sequence
  chemically synthesized
aatacagcattttaggttgg

SEQ ID NO: 445103 - DNA, 20 bp, Artificial Sequence
  chemically synthesized
accaatacagcattttaggt

SEQ ID NO: 445104 - DNA, 20 bp, Artificial Sequence
  chemically synthesized
tttcaccaatacagcatttt

SEQ ID NO: 445105 - DNA, 20 bp, Artificial Sequence
  chemically synthesized
atttcaccaatacagcattt

SEQ ID NO: 445106 - DNA, 20 bp, Artificial Sequence
  chemically synthesized
accaacctaaaatgctgtat

SEQ ID NO: 445107 - DNA, 20 bp, Artificial Sequence
  chemically synthesized
gaaggataatttcaccaata

SEQ ID NO: 445108 - DNA, 20 bp, Artificial Sequence
  chemically synthesized
ttggtgaaattatccttcaa

SEQ ID NO: 445109 - DNA, 20 bp, Artificial Sequence
  chemically synthesized
catttctcttttacttttga

SEQ ID NO: 445110 - DNA, 20 bp, Artificial Sequence
  chemically synthesized
tcatttctcttttacttttg

SEQ ID NO: 445111 - DNA, 20 bp, Artificial Sequence
  chemically synthesized
aaattatccttcaaaagtaa

SEQ ID NO: 445112 - DNA, 20 bp, Artificial Sequence
  chemically synthesized
attatccttcaaaagtaaaa

SEQ ID NO: 445113 - DNA, 20 bp, Artificial Sequence
  chemically synthesized
aagagaaatgaatactttat

SEQ ID NO: 445114 - DNA, 20 bp, Artificial Sequence
  chemically synthesized
ctcagcgtgtttgtctgata

SEQ ID NO: 445115 - DNA, 20 bp, Artificial Sequence
  chemically synthesized
ctttatcagacaaacacgct

SEQ ID NO: 445116 - DNA, 20 bp, Artificial Sequence
  chemically synthesized
tttatcagacaaacacgctg

SEQ ID NO: 445117 - DNA, 20 bp, Artificial Sequence
  chemically synthesized
ttatcagacaaacacgctga

SEQ ID NO: 445118 - DNA, 20 bp, Artificial Sequence
  chemically synthesized
ctactggcagcaaattccct

SEQ ID NO: 445119 - DNA, 20 bp, Artificial Sequence
  chemically synthesized
acgctgagggaatttgctgc

SEQ ID NO: 445120 - DNA, 20 bp, Artificial Sequence
  chemically synthesized
ctgagggaatttgctgccag

SEQ ID NO: 445121 - DNA, 20 bp, Artificial Sequence
  chemically synthesized
ttgcaaggcagatctactgg

SEQ ID NO: 445122 - DNA, 20 bp, Artificial Sequence
  chemically synthesized
ttcttgcaaggcagatctac

SEQ ID NO: 445123 - DNA, 20 bp, Artificial Sequence
  chemically synthesized
tgccagtagatctgccttgc

SEQ ID NO: 445124 - DNA, 20 bp, Artificial Sequence
  chemically synthesized
ttttgacatttcttgcaagg

SEQ ID NO: 445125 - DNA, 20 bp, Artificial Sequence
  chemically synthesized
ttcttttgacatttcttgca

SEQ ID NO: 445126 - DNA, 20 bp, Artificial Sequence
  chemically synthesized
cttcttttgacatttcttgc

SEQ ID NO: 445127 - DNA, 20 bp, Artificial Sequence
  chemically synthesized
tgccttgcaagaaatgtcaa

SEQ ID NO: 445128 - DNA, 20 bp, Artificial Sequence
  chemically synthesized
cttgcaagaaatgtcaaaag

SEQ ID NO: 445129 - DNA, 20 bp, Artificial Sequence
  chemically synthesized
ttgcaagaaatgtcaaaaga

SEQ ID NO: 445130 - DNA, 20 bp, Artificial Sequence
  chemically synthesized
aaatgtcaaaagaaggactt

SEQ ID NO: 445131 - DNA, 20 bp, Artificial Sequence
  chemically synthesized
atgtcaaaagaaggacttca

SEQ ID NO: 445132 - DNA, 20 bp, Artificial Sequence
  chemically synthesized
catcattttctttttctctg

SEQ ID NO: 445133 - DNA, 20 bp, Artificial Sequence
  chemically synthesized
aaagaaggacttcagagaaa

SEQ ID NO: 445134 - DNA, 20 bp, Artificial Sequence
  chemically synthesized
agagaaaaagaaaatgatgt

SEQ ID NO: 445135 - DNA, 20 bp, Artificial Sequence
  chemically synthesized
aaaaagaaaatgatgtaagt

SEQ ID NO: 445136 - DNA, 20 bp, Artificial Sequence
  chemically synthesized
aatgatgtaagtcagaaact

SEQ ID NO: 445137 - DNA, 20 bp, Artificial Sequence
  chemically synthesized
tcctttctttatgtagatct

SEQ ID NO: 445138 - DNA, 20 bp, Artificial Sequence
  chemically synthesized
cagaaacttagatctacata

SEQ ID NO: 445139 - DNA, 20 bp, Artificial Sequence
  chemically synthesized
atgtacttcctttctttatg

SEQ ID NO: 445140 - DNA, 20 bp, Artificial Sequence
  chemically synthesized
aacttagatctacataaaga

SEQ ID NO: 445141 - DNA, 20 bp, Artificial Sequence
  chemically synthesized
acttagatctacataaagaa

SEQ ID NO: 445142 - DNA, 20 bp, Artificial Sequence
  chemically synthesized
tagatctacataaagaaagg

SEQ ID NO: 445143 - DNA, 20 bp, Artificial Sequence
  chemically synthesized
cataaagaaaggaagtacat

SEQ ID NO: 445144 - DNA, 20 bp, Artificial Sequence
  chemically synthesized
taaagaaaggaagtacatta

SEQ ID NO: 445145 - DNA, 20 bp, Artificial Sequence
  chemically synthesized
agaaaggaagtacattagag

SEQ ID NO: 445146 - DNA, 20 bp, Artificial Sequence
  chemically synthesized
gaaaggaagtacattagaga

SEQ ID NO: 445147 - DNA, 20 bp, Artificial Sequence
  chemically synthesized
attagagaaggaaaaaatga

SEQ ID NO: 445148 - DNA, 20 bp, Artificial Sequence
  chemically synthesized
tcaatcaggaataggaagaa

SEQ ID NO: 445149 - DNA, 20 bp, Artificial Sequence
  chemically synthesized
ttagatcaatcaggaatagg

SEQ ID NO: 445150 - DNA, 20 bp, Artificial Sequence
  chemically synthesized
ttattagatcaatcaggaat

SEQ ID NO: 445151 - DNA, 20 bp, Artificial Sequence
  chemically synthesized
tttattagatcaatcaggaa

SEQ ID NO: 445152 - DNA, 20 bp, Artificial Sequence
  chemically synthesized
aaatatttattagatcaatc

SEQ ID NO: 445153 - DNA, 20 bp, Artificial Sequence
  chemically synthesized
caaatatttattagatcaat

SEQ ID NO: 445154 - DNA, 20 bp, Artificial Sequence
  chemically synthesized
tatattgaacaaatatttat

SEQ ID NO: 445155 - DNA, 20 bp, Artificial Sequence
  chemically synthesized
atatttgttcaatataataa

SEQ ID NO: 445156 - DNA, 20 bp, Artificial Sequence
  chemically synthesized
ttgttcaatataataacagc

SEQ ID NO: 445157 - DNA, 20 bp, Artificial Sequence
  chemically synthesized
ttcaatataataacagcaag

SEQ ID NO: 445158 - DNA, 20 bp, Artificial Sequence
  chemically synthesized
ataacagcaagaagaaacat

SEQ ID NO: 445159 - DNA, 20 bp, Artificial Sequence
  chemically synthesized
aagaagaaacattggatgat

SEQ ID NO: 445160 - DNA, 20 bp, Artificial Sequence
  chemically synthesized
gaagaaacattggatgatta

SEQ ID NO: 445161 - DNA, 20 bp, Artificial Sequence
  chemically synthesized
cattggatgattagagctta

SEQ ID NO: 445162 - DNA, 20 bp, Artificial Sequence
  chemically synthesized
gatgattagagcttatggat

SEQ ID NO: 445163 - DNA, 20 bp, Artificial Sequence
  chemically synthesized
cattcgtttctcttatccat

SEQ ID NO: 445164 - DNA, 20 bp, Artificial Sequence
  chemically synthesized
tgattagagcttatggataa

SEQ ID NO: 445165 - DNA, 20 bp, Artificial Sequence
  chemically synthesized
tggataagagaaacgaatgc

SEQ ID NO: 445166 - DNA, 20 bp, Artificial Sequence
  chemically synthesized
ttgaacctttgtaacattac

SEQ ID NO: 445167 - DNA, 20 bp, Artificial Sequence
  chemically synthesized
cgaatgccagtaatgttaca

SEQ ID NO: 445168 - DNA, 20 bp, Artificial Sequence
  chemically synthesized
gaatgccagtaatgttacaa

SEQ ID NO: 445169 - DNA, 20 bp, Artificial Sequence
  chemically synthesized
cagtaatgttacaaaggttc

SEQ ID NO: 445170 - DNA, 20 bp, Artificial Sequence
  chemically synthesized
taatgttacaaaggttcaag

SEQ ID NO: 445171 - DNA, 20 bp, Artificial Sequence
  chemically synthesized
aatgttacaaaggttcaaga

SEQ ID NO: 445172 - DNA, 20 bp, Artificial Sequence
  chemically synthesized
gttacaaaggttcaagaagg

SEQ ID NO: 445173 - DNA, 20 bp, Artificial Sequence
  chemically synthesized
tacaaaggttcaagaaggaa

SEQ ID NO: 445174 - DNA, 20 bp, Artificial Sequence
  chemically synthesized
aaggttcaagaaggaagagt

SEQ ID NO: 445175 - DNA, 20 bp, Artificial Sequence
  chemically synthesized
aggttcaagaaggaagagtt

SEQ ID NO: 445176 - DNA, 20 bp, Artificial Sequence
  chemically synthesized
agagttgggaatattctgtg

SEQ ID NO: 445177 - DNA, 20 bp, Artificial Sequence
  chemically synthesized
gagttgggaatattctgtgt

SEQ ID NO: 445178 - DNA, 20 bp, Artificial Sequence
  chemically synthesized
ccaatccgttttttcccaca

SEQ ID NO: 445179 - DNA, 20 bp, Artificial Sequence
  chemically synthesized
atattctgtgtgggaaaaaa

SEQ ID NO: 445180 - DNA, 20 bp, Artificial Sequence
  chemically synthesized
ctgtgtgggaaaaaacggat

SEQ ID NO: 445181 - DNA, 20 bp, Artificial Sequence
  chemically synthesized
gtgtgggaaaaaacggattg

SEQ ID NO: 445182 - DNA, 20 bp, Artificial Sequence
  chemically synthesized
tgggaaaaaacggattggag

SEQ ID NO: 445183 - DNA, 20 bp, Artificial Sequence
  chemically synthesized
gggaaaaaacggattggagt

SEQ ID NO: 445184 - DNA, 20 bp, Artificial Sequence
  chemically synthesized
gaaaaaacggattggagtgg

SEQ ID NO: 445185 - DNA, 20 bp, Artificial Sequence
  chemically synthesized
aaaacggattggagtgggag

SEQ ID NO: 445186 - DNA, 20 bp, Artificial Sequence
  chemically synthesized
tctgatgttaatttacgtaa

SEQ ID NO: 445187 - DNA, 20 bp, Artificial Sequence
  chemically synthesized
ttctgatgttaatttacgta

SEQ ID NO: 445188 - DNA, 20 bp, Artificial Sequence
  chemically synthesized
tcctttacgtaaattaacat

SEQ ID NO: 445189 - DNA, 20 bp, Artificial Sequence
  chemically synthesized
ttgaactcctaattagagga

SEQ ID NO: 445190 - DNA, 20 bp, Artificial Sequence
  chemically synthesized
catcagaaccatcctctaat

SEQ ID NO: 445191 - DNA, 20 bp, Artificial Sequence
  chemically synthesized
atcagaaccatcctctaatt

SEQ ID NO: 445192 - DNA, 20 bp, Artificial Sequence
  chemically synthesized
gaacttgaactcctaattag

SEQ ID NO: 445193 - DNA, 20 bp, Artificial Sequence
  chemically synthesized
cagaaccatcctctaattag

SEQ ID NO: 445194 - DNA, 20 bp, Artificial Sequence
  chemically synthesized
tgaacttgaactcctaatta

SEQ ID NO: 445195 - DNA, 20 bp, Artificial Sequence
  chemically synthesized
gttgaacttgaactcctaat

SEQ ID NO: 445196 - DNA, 20 bp, Artificial Sequence
  chemically synthesized
catcctctaattaggagttc

SEQ ID NO: 445197 - DNA, 20 bp, Artificial Sequence
  chemically synthesized
agttcaagttcaacttcact

SEQ ID NO: 445198 - DNA, 20 bp, Artificial Sequence
  chemically synthesized
attatgattacaaccaagtg

SEQ ID NO: 445199 - DNA, 20 bp, Artificial Sequence
  chemically synthesized
ttgaaattatgattacaacc

SEQ ID NO: 445200 - DNA, 20 bp, Artificial Sequence
  chemically synthesized
ctttagcttttaagaagaga

SEQ ID NO: 445201 - DNA, 20 bp, Artificial Sequence
  chemically synthesized
tcaattctttctcttcttaa

SEQ ID NO: 445202 - DNA, 20 bp, Artificial Sequence
  chemically synthesized
gctcctttagcttttaagaa

SEQ ID NO: 445203 - DNA, 20 bp, Artificial Sequence
  chemically synthesized
tggctcctttagcttttaag

SEQ ID NO: 445204 - DNA, 20 bp, Artificial Sequence
  chemically synthesized
acctggctcctttagctttt

SEQ ID NO: 445205 - DNA, 20 bp, Artificial Sequence
  chemically synthesized
ctttctcttcttaaaagcta

SEQ ID NO: 445206 - DNA, 20 bp, Artificial Sequence
  chemically synthesized
tttctcttcttaaaagctaa

SEQ ID NO: 445207 - DNA, 20 bp, Artificial Sequence
  chemically synthesized
tctcttcttaaaagctaaag

SEQ ID NO: 445208 - DNA, 20 bp, Artificial Sequence
  chemically synthesized
ttcttaaaagctaaaggagc

SEQ ID NO: 445209 - DNA, 20 bp, Artificial Sequence
  chemically synthesized
gactccgcacctggctcctt

SEQ ID NO: 445210 - DNA, 20 bp, Artificial Sequence
  chemically synthesized
tcttaaaagctaaaggagcc

SEQ ID NO: 445211 - DNA, 20 bp, Artificial Sequence
  chemically synthesized
aaagctaaaggagccaggtg

SEQ ID NO: 445212 - DNA, 20 bp, Artificial Sequence
  chemically synthesized
agctaaaggagccaggtgcg

SEQ ID NO: 445213 - DNA, 20 bp, Artificial Sequence
  chemically synthesized
caggtgtgagactccgcacc

SEQ ID NO: 445214 - DNA, 20 bp, Artificial Sequence
  chemically synthesized
agtgctaggattacaggtgt

SEQ ID NO: 445215 - DNA, 20 bp, Artificial Sequence
  chemically synthesized
gagtctcacacctgtaatcc

SEQ ID NO: 445216 - DNA, 20 bp, Artificial Sequence
  chemically synthesized
tcccaaagtgctaggattac

SEQ ID NO: 445217 - DNA, 20 bp, Artificial Sequence
  chemically synthesized
ctcccaaagtgctaggatta

SEQ ID NO: 445218 - DNA, 20 bp, Artificial Sequence
  chemically synthesized
cacctgtaatcctagcactt

SEQ ID NO: 445219 - DNA, 20 bp, Artificial Sequence
  chemically synthesized
tctcggcctcccaaagtgct

SEQ ID NO: 445220 - DNA, 20 bp, Artificial Sequence
  chemically synthesized
acctgtaatcctagcacttt

SEQ ID NO: 445221 - DNA, 20 bp, Artificial Sequence
  chemically synthesized
ctctcggcctcccaaagtgc

SEQ ID NO: 445222 - DNA, 20 bp, Artificial Sequence
  chemically synthesized
ctgtaatcctagcactttgg

SEQ ID NO: 445223 - DNA, 20 bp, Artificial Sequence
  chemically synthesized
tgtaatcctagcactttggg

SEQ ID NO: 445224 - DNA, 20 bp, Artificial Sequence
  chemically synthesized
ctgcccctctcggcctccca

SEQ ID NO: 445225 - DNA, 20 bp, Artificial Sequence
  chemically synthesized
tcctagcactttgggaggcc

SEQ ID NO: 445226 - DNA, 20 bp, Artificial Sequence
  chemically synthesized
ctagcactttgggaggccga

SEQ ID NO: 445227 - DNA, 20 bp, Artificial Sequence
  chemically synthesized
tagcactttgggaggccgag

SEQ ID NO: 445228 - DNA, 20 bp, Artificial Sequence
  chemically synthesized
agcactttgggaggccgaga

SEQ ID NO: 445229 - DNA, 20 bp, Artificial Sequence
  chemically synthesized
gcactttgggaggccgagag

SEQ ID NO: 445230 - DNA, 20 bp, Artificial Sequence
  chemically synthesized
ctttgggaggccgagagggg

SEQ ID NO: 445231 - DNA, 20 bp, Artificial Sequence
  chemically synthesized
ctcaagtgatctgcccctct

SEQ ID NO: 445232 - DNA, 20 bp, Artificial Sequence
  chemically synthesized
ccgagaggggcagatcactt

SEQ ID NO: 445233 - DNA, 20 bp, Artificial Sequence
  chemically synthesized
cgagaggggcagatcacttg

SEQ ID NO: 445234 - DNA, 20 bp, Artificial Sequence
  chemically synthesized
aggggcagatcacttgaggt

SEQ ID NO: 445235 - DNA, 20 bp, Artificial Sequence
  chemically synthesized
ggggcagatcacttgaggtc

SEQ ID NO: 445236 - DNA, 20 bp, Artificial Sequence
  chemically synthesized
ggtctcaaactcctgacctc

SEQ ID NO: 445237 - DNA, 20 bp, Artificial Sequence
  chemically synthesized
ggcagatcacttgaggtcag

SEQ ID NO: 445238 - DNA, 20 bp, Artificial Sequence
  chemically synthesized
tcacttgaggtcaggagttt

SEQ ID NO: 445239 - DNA, 20 bp, Artificial Sequence
  chemically synthesized
tgaggtcaggagtttgagac

SEQ ID NO: 445240 - DNA, 20 bp, Artificial Sequence
  chemically synthesized
tcaggagtttgagaccagca

SEQ ID NO: 445241 - DNA, 20 bp, Artificial Sequence
  chemically synthesized
tttcaacatgttgaccatgc

SEQ ID NO: 445242 - DNA, 20 bp, Artificial Sequence
  chemically synthesized
ttgtatttttagtagagaag

SEQ ID NO: 445243 - DNA, 20 bp, Artificial Sequence
  chemically synthesized
tttgtatttttagtagagaa

SEQ ID NO: 445244 - DNA, 20 bp, Artificial Sequence
  chemically synthesized
ttttgtatttttagtagaga

SEQ ID NO: 445245 - DNA, 20 bp, Artificial Sequence
  chemically synthesized
tttttgtatttttagtagag

SEQ ID NO: 445246 - DNA, 20 bp, Artificial Sequence
  chemically synthesized
aattttttgtatttttagta

SEQ ID NO: 445247 - DNA, 20 bp, Artificial Sequence
  chemically synthesized
ctaattttttgtatttttag

SEQ ID NO: 445248 - DNA, 20 bp, Artificial Sequence
  chemically synthesized
cggctaattttttgtatttt

SEQ ID NO: 445249 - DNA, 20 bp, Artificial Sequence
  chemically synthesized
ctactaaaaatacaaaaaat

SEQ ID NO: 445250 - DNA, 20 bp, Artificial Sequence
  chemically synthesized
aaaaatacaaaaaattagcc

SEQ ID NO: 445251 - DNA, 20 bp, Artificial Sequence
  chemically synthesized
tacaaaaaattagccgagca

SEQ ID NO: 445252 - DNA, 20 bp, Artificial Sequence
  chemically synthesized
aaaaaattagccgagcatgg

SEQ ID NO: 445253 - DNA, 20 bp, Artificial Sequence
  chemically synthesized
caggcgcccgccaccatgct

SEQ ID NO: 445254 - DNA, 20 bp, Artificial Sequence
  chemically synthesized
aaattagccgagcatggtgg

SEQ ID NO: 445255 - DNA, 20 bp, Artificial Sequence
  chemically synthesized
aattagccgagcatggtggc

SEQ ID NO: 445256 - DNA, 20 bp, Artificial Sequence
  chemically synthesized
agcatggtggcgggcgcctg

SEQ ID NO: 445257 - DNA, 20 bp, Artificial Sequence
  chemically synthesized
gtggcgggcgcctgcagtcc

SEQ ID NO: 445258 - DNA, 20 bp, Artificial Sequence
  chemically synthesized
tcttgagtagctgggactgc

SEQ ID NO: 445259 - DNA, 20 bp, Artificial Sequence
  chemically synthesized
ctcttgagtagctgggactg

SEQ ID NO: 445260 - DNA, 20 bp, Artificial Sequence
  chemically synthesized
cctcagtctcttgagtagct

SEQ ID NO: 445261 - DNA, 20 bp, Artificial Sequence
  chemically synthesized
gcctgcagtcccagctactc

SEQ ID NO: 445262 - DNA, 20 bp, Artificial Sequence
  chemically synthesized
gcctcagtctcttgagtagc

SEQ ID NO: 445263 - DNA, 20 bp, Artificial Sequence
  chemically synthesized
ctgcagtcccagctactcaa

SEQ ID NO: 445264 - DNA, 20 bp, Artificial Sequence
  chemically synthesized
tcatgcctcagtctcttgag

SEQ ID NO: 445265 - DNA, 20 bp, Artificial Sequence
  chemically synthesized
ttctcatgcctcagtctctt

SEQ ID NO: 445266 - DNA, 20 bp, Artificial Sequence
  chemically synthesized
tcccagctactcaagagact

SEQ ID NO: 445267 - DNA, 20 bp, Artificial Sequence
  chemically synthesized
cccagctactcaagagactg

SEQ ID NO: 445268 - DNA, 20 bp, Artificial Sequence
  chemically synthesized
tactcaagagactgaggcat

SEQ ID NO: 445269 - DNA, 20 bp, Artificial Sequence
  chemically synthesized
tttaagcgattctcatgcct

SEQ ID NO: 445270 - DNA, 20 bp, Artificial Sequence
  chemically synthesized
gcatgagaatcgcttaaacc

SEQ ID NO: 445271 - DNA, 20 bp, Artificial Sequence
  chemically synthesized
agcctccacctgctgggttt

SEQ ID NO: 445272 - DNA, 20 bp, Artificial Sequence
  chemically synthesized
tgagaatcgcttaaacccag

SEQ ID NO: 445273 - DNA, 20 bp, Artificial Sequence
  chemically synthesized
gagaatcgcttaaacccagc

SEQ ID NO: 445274 - DNA, 20 bp, Artificial Sequence
  chemically synthesized
aatcgcttaaacccagcagg

SEQ ID NO: 445275 - DNA, 20 bp, Artificial Sequence
  chemically synthesized
aaatgcagcctccacctgct

SEQ ID NO: 445276 - DNA, 20 bp, Artificial Sequence
  chemically synthesized
tcgcttaaacccagcaggtg

SEQ ID NO: 445277 - DNA, 20 bp, Artificial Sequence
  chemically synthesized
aaaatgcagcctccacctgc

SEQ ID NO: 445278 - DNA, 20 bp, Artificial Sequence
  chemically synthesized
cgcttaaacccagcaggtgg

SEQ ID NO: 445279 - DNA, 20 bp, Artificial Sequence
  chemically synthesized
atgaataaataattaaaatg

SEQ ID NO: 445280 - DNA, 20 bp, Artificial Sequence
  chemically synthesized
attatttattcatctgatga

SEQ ID NO: 445281 - DNA, 20 bp, Artificial Sequence
  chemically synthesized
ttttagattctgtccatcat

SEQ ID NO: 445282 - DNA, 20 bp, Artificial Sequence
  chemically synthesized
tttattcatctgatgatgga

SEQ ID NO: 445283 - DNA, 20 bp, Artificial Sequence
  chemically synthesized
atgatggacagaatctaaaa

SEQ ID NO: 445284 - DNA, 20 bp, Artificial Sequence
  chemically synthesized
ttctatgagttcaacttttt

SEQ ID NO: 445285 - DNA, 20 bp, Artificial Sequence
  chemically synthesized
atctaaaaaagttgaactca

SEQ ID NO: 445286 - DNA, 20 bp, Artificial Sequence
  chemically synthesized
attctaatctgtatttctat

SEQ ID NO: 445287 - DNA, 20 bp, Artificial Sequence
  chemically synthesized
aagttgaactcatagaaata

SEQ ID NO: 445288 - DNA, 20 bp, Artificial Sequence
  chemically synthesized
gaactcatagaaatacagat

SEQ ID NO: 445289 - DNA, 20 bp, Artificial Sequence
  chemically synthesized
tagaaatacagattagaatg

SEQ ID NO: 445290 - DNA, 20 bp, Artificial Sequence
  chemically synthesized
gattagaatgaagattacca

SEQ ID NO: 445291 - DNA, 20 bp, Artificial Sequence
  chemically synthesized
aatgaagattaccacagaaa

SEQ ID NO: 445292 - DNA, 20 bp, Artificial Sequence
  chemically synthesized
ggacccttccgccatttctg

SEQ ID NO: 445293 - DNA, 20 bp, Artificial Sequence
  chemically synthesized
gaagattaccacagaaatgg

SEQ ID NO: 445294 - DNA, 20 bp, Artificial Sequence
  chemically synthesized
gattaccacagaaatggcgg

SEQ ID NO: 445295 - DNA, 20 bp, Artificial Sequence
  chemically synthesized
attaccacagaaatggcgga

SEQ ID NO: 445296 - DNA, 20 bp, Artificial Sequence
  chemically synthesized
ttaccacagaaatggcggaa

SEQ ID NO: 445297 - DNA, 20 bp, Artificial Sequence
  chemically synthesized
aaatggcggaagggtcctac

SEQ ID NO: 445298 - DNA, 20 bp, Artificial Sequence
  chemically synthesized
aatggcggaagggtcctacc

SEQ ID NO: 445299 - DNA, 20 bp, Artificial Sequence
  chemically synthesized
aacatctttcttttcccggt

SEQ ID NO: 445300 - DNA, 20 bp, Artificial Sequence
  chemically synthesized
cggaagggtcctaccgggaa

SEQ ID NO: 445301 - DNA, 20 bp, Artificial Sequence
  chemically synthesized
caacatctttcttttcccgg

SEQ ID NO: 445302 - DNA, 20 bp, Artificial Sequence
  chemically synthesized
gatcaacatctttcttttcc

SEQ ID NO: 445303 - DNA, 20 bp, Artificial Sequence
  chemically synthesized
agggtcctaccgggaaaaga

SEQ ID NO: 445304 - DNA, 20 bp, Artificial Sequence
  chemically synthesized
gaaaagaaagatgttgatca

SEQ ID NO: 445305 - DNA, 20 bp, Artificial Sequence
  chemically synthesized
aaaagaaagatgttgatcaa

SEQ ID NO: 445306 - DNA, 20 bp, Artificial Sequence
  chemically synthesized
aaagaaagatgttgatcaaa

SEQ ID NO: 445307 - DNA, 20 bp, Artificial Sequence
  chemically synthesized
gatcaaagggtacgaatttt

SEQ ID NO: 445308 - DNA, 20 bp, Artificial Sequence
  chemically synthesized
aaagggtacgaatttttagt

SEQ ID NO: 445309 - DNA, 20 bp, Artificial Sequence
  chemically synthesized
aagggtacgaatttttagtt

SEQ ID NO: 445310 - DNA, 20 bp, Artificial Sequence
  chemically synthesized
ggtacgaatttttagttagg

SEQ ID NO: 445311 - DNA, 20 bp, Artificial Sequence
  chemically synthesized
gtacgaatttttagttaggt

SEQ ID NO: 445312 - DNA, 20 bp, Artificial Sequence
  chemically synthesized
acgaatttttagttaggtag

SEQ ID NO: 445313 - DNA, 20 bp, Artificial Sequence
  chemically synthesized
cgaatttttagttaggtagg

SEQ ID NO: 445314 - DNA, 20 bp, Artificial Sequence
  chemically synthesized
atttttagttaggtaggagg

SEQ ID NO: 445315 - DNA, 20 bp, Artificial Sequence
  chemically synthesized
tttagttaggtaggaggaag

SEQ ID NO: 445316 - DNA, 20 bp, Artificial Sequence
  chemically synthesized
taggtaggaggaagaagctt

SEQ ID NO: 445317 - DNA, 20 bp, Artificial Sequence
  chemically synthesized
tcatgtacaatagatcacta

SEQ ID NO: 445318 - DNA, 20 bp, Artificial Sequence
  chemically synthesized
atagtcaccatcatgtacaa

SEQ ID NO: 445319 - DNA, 20 bp, Artificial Sequence
  chemically synthesized
tagtgatctattgtacatga

SEQ ID NO: 445320 - DNA, 20 bp, Artificial Sequence
  chemically synthesized
tgatgcattatgatatatta

SEQ ID NO: 445321 - DNA, 20 bp, Artificial Sequence
  chemically synthesized
atatttcaaaattgctgaaa

SEQ ID NO: 445322 - DNA, 20 bp, Artificial Sequence
  chemically synthesized
tttcaaaattgctgaaatag

SEQ ID NO: 445323 - DNA, 20 bp, Artificial Sequence
  chemically synthesized
aatattaaaatccactattt

SEQ ID NO: 445324 - DNA, 20 bp, Artificial Sequence
  chemically synthesized
gttacctcatattttttttg

SEQ ID NO: 445325 - DNA, 20 bp, Artificial Sequence
  chemically synthesized
tttcaccacaaaaaaaatat

SEQ ID NO: 445326 - DNA, 20 bp, Artificial Sequence
  chemically synthesized
ttcaccacaaaaaaaatatg

SEQ ID NO: 445327 - DNA, 20 bp, Artificial Sequence
  chemically synthesized
acaaaaaaaatatgaggtaa

SEQ ID NO: 445328 - DNA, 20 bp, Artificial Sequence
  chemically synthesized
caatgcagagtgattaaatc

SEQ ID NO: 445329 - DNA, 20 bp, Artificial Sequence
  chemically synthesized
acaatgcagagtgattaaat

SEQ ID NO: 445330 - DNA, 20 bp, Artificial Sequence
  chemically synthesized
tgatatatgcttacaatgca

SEQ ID NO: 445331 - DNA, 20 bp, Artificial Sequence
  chemically synthesized
atttaatcactctgcattgt

SEQ ID NO: 445332 - DNA, 20 bp, Artificial Sequence
  chemically synthesized
tttgatatatgcttacaatg

SEQ ID NO: 445333 - DNA, 20 bp, Artificial Sequence
  chemically synthesized
tgcattgtaagcatatatca

SEQ ID NO: 445334 - DNA, 20 bp, Artificial Sequence
  chemically synthesized
tgtatttataggttacaata

SEQ ID NO: 445335 - DNA, 20 bp, Artificial Sequence
  chemically synthesized
taatatttgtttgtatttat

SEQ ID NO: 445336 - DNA, 20 bp, Artificial Sequence
  chemically synthesized
ttaatatttgtttgtattta

SEQ ID NO: 445337 - DNA, 20 bp, Artificial Sequence
  chemically synthesized
aatattaattgtcaatgaaa

SEQ ID NO: 445338 - DNA, 20 bp, Artificial Sequence
  chemically synthesized
acaacatcaatacgacatat

SEQ ID NO: 445339 - DNA, 20 bp, Artificial Sequence
  chemically synthesized
gacatatgagactaccatta

SEQ ID NO: 445340 - DNA, 20 bp, Artificial Sequence
  chemically synthesized
cactttttggactataatgg

SEQ ID NO: 445341 - DNA, 20 bp, Artificial Sequence
  chemically synthesized
gtgcactttttggactataa

SEQ ID NO: 445342 - DNA, 20 bp, Artificial Sequence
  chemically synthesized
gactaccattatagtccaaa

SEQ ID NO: 445343 - DNA, 20 bp, Artificial Sequence
  chemically synthesized
atgcccaggagtgcactttt

SEQ ID NO: 445344 - DNA, 20 bp, Artificial Sequence
  chemically synthesized
tagtccaaaaagtgcactcc

SEQ ID NO: 445345 - DNA, 20 bp, Artificial Sequence
  chemically synthesized
agtccaaaaagtgcactcct

SEQ ID NO: 445346 - DNA, 20 bp, Artificial Sequence
  chemically synthesized
tctctgggataaatgcccag

SEQ ID NO: 445347 - DNA, 20 bp, Artificial Sequence
  chemically synthesized
tttctctgggataaatgccc

SEQ ID NO: 445348 - DNA, 20 bp, Artificial Sequence
  chemically synthesized
atttctctgggataaatgcc

SEQ ID NO: 445349 - DNA, 20 bp, Artificial Sequence
  chemically synthesized
gcactcctgggcatttatcc

SEQ ID NO: 445350 - DNA, 20 bp, Artificial Sequence
  chemically synthesized
actcctgggcatttatccca

SEQ ID NO: 445351 - DNA, 20 bp, Artificial Sequence
  chemically synthesized
acataagtcttcatttctct

SEQ ID NO: 445352 - DNA, 20 bp, Artificial Sequence
  chemically synthesized
aacataagtcttcatttctc

SEQ ID NO: 445353 - DNA, 20 bp, Artificial Sequence
  chemically synthesized
gcatttatcccagagaaatg

SEQ ID NO: 445354 - DNA, 20 bp, Artificial Sequence
  chemically synthesized
tacaggatttgtgtgaacat

SEQ ID NO: 445355 - DNA, 20 bp, Artificial Sequence
  chemically synthesized
ttcacacaaatcctgtacat

SEQ ID NO: 445356 - DNA, 20 bp, Artificial Sequence
  chemically synthesized
tcacacaaatcctgtacatt

SEQ ID NO: 445357 - DNA, 20 bp, Artificial Sequence
  chemically synthesized
tgctgtgaaccctaatgtac

SEQ ID NO: 445358 - DNA, 20 bp, Artificial Sequence
  chemically synthesized
cacacaaatcctgtacatta

SEQ ID NO: 445359 - DNA, 20 bp, Artificial Sequence
  chemically synthesized
ttgctgtgaaccctaatgta

SEQ ID NO: 445360 - DNA, 20 bp, Artificial Sequence
  chemically synthesized
atcctgtacattagggttca

SEQ ID NO: 445361 - DNA, 20 bp, Artificial Sequence
  chemically synthesized
agggttcacagcaattttat

SEQ ID NO: 445362 - DNA, 20 bp, Artificial Sequence
  chemically synthesized
cacagcaattttattagtaa

SEQ ID NO: 445363 - DNA, 20 bp, Artificial Sequence
  chemically synthesized
atattgttgtttacagtgtg

SEQ ID NO: 445364 - DNA, 20 bp, Artificial Sequence
  chemically synthesized
gatattgttgtttacagtgt

SEQ ID NO: 445365 - DNA, 20 bp, Artificial Sequence
  chemically synthesized
agatattgttgtttacagtg

SEQ ID NO: 445366 - DNA, 20 bp, Artificial Sequence
  chemically synthesized
ctgagagatattgttgttta

SEQ ID NO: 445367 - DNA, 20 bp, Artificial Sequence
  chemically synthesized
ctgtaaacaacaatatctct

SEQ ID NO: 445368 - DNA, 20 bp, Artificial Sequence
  chemically synthesized
aaacaacaatatctctcagt

SEQ ID NO: 445369 - DNA, 20 bp, Artificial Sequence
  chemically synthesized
tttcaccattcactgactga

SEQ ID NO: 445370 - DNA, 20 bp, Artificial Sequence
  chemically synthesized
agtttcaccattcactgact

SEQ ID NO: 445371 - DNA, 20 bp, Artificial Sequence
  chemically synthesized
aatatctctcagtcagtgaa

SEQ ID NO: 445372 - DNA, 20 bp, Artificial Sequence
  chemically synthesized
gtcagtgaatggtgaaactg

SEQ ID NO: 445373 - DNA, 20 bp, Artificial Sequence
  chemically synthesized
tcagtgaatggtgaaactgt

SEQ ID NO: 445374 - DNA, 20 bp, Artificial Sequence
  chemically synthesized
ttatggttgtggacatccta

SEQ ID NO: 445375 - DNA, 20 bp, Artificial Sequence
  chemically synthesized
tgctgatttatttatggttg

SEQ ID NO: 445376 - DNA, 20 bp, Artificial Sequence
  chemically synthesized
atatgttgctgatttattta

SEQ ID NO: 445377 - DNA, 20 bp, Artificial Sequence
  chemically synthesized
gtccacaaccataaataaat

SEQ ID NO: 445378 - DNA, 20 bp, Artificial Sequence
  chemically synthesized
aataaatcagcaacatatat

SEQ ID NO: 445379 - DNA, 20 bp, Artificial Sequence
  chemically synthesized
caacatatattagtaataaa
